United States Patent 10,706,955 (BIOINFORMATIC PROCESSES FOR DETERMINATION OF PEPTIDE BINDING) - sequence listing, part 83

SEQ ID NO: 3163527 - protein, 18 aa, Giardia lamblia
LVEFSEYSKALGLEEVFH

SEQ ID NO: 3163528 - protein, 17 aa, Giardia lamblia
LVEKKSCLKKRNKEGST

SEQ ID NO: 3163529 - protein, 35 aa, Giardia lamblia
LVEKSCKFIPTLILRGNPFGAFGLGEIGAGLCRAA

SEQ ID NO: 3163530 - protein, 18 aa, Giardia lamblia
LVELLALYKELIGQYLRN

SEQ ID NO: 3163531 - protein, 31 aa, Giardia lamblia
LVELRRRTASFLLREARFDHDPLLKRAATDN

SEQ ID NO: 3163532 - protein, 18 aa, Giardia lamblia
LVELWLSEAALRDHEGRT

SEQ ID NO: 3163533 - protein, 20 aa, Giardia lamblia
LVERCKPGSLLLLNTSASNV

SEQ ID NO: 3163534 - protein, 25 aa, Giardia lamblia
LVFDFCPRKVVLRGLVDIPPAQLEQ

SEQ ID NO: 3163535 - protein, 17 aa, Giardia lamblia
LVFKCVDLVDLILTSSS

SEQ ID NO: 3163536 - protein, 19 aa, Giardia lamblia
LVFLPPAAVPVSFCEDEQL

SEQ ID NO: 3163537 - protein, 22 aa, Giardia lamblia
LVFRTLEGLQFLCASQPPGGGR

SEQ ID NO: 3163538 - protein, 20 aa, Giardia lamblia
LVGAVSRMLLLKSSGDQSTF

SEQ ID NO: 3163539 - protein, 22 aa, Giardia lamblia
LVGFGRAFCLPQPFDESTTRII

SEQ ID NO: 3163540 - protein, 20 aa, Giardia lamblia
LVGGELKYRAGRAVCYCAIK

SEQ ID NO: 3163541 - protein, 18 aa, Giardia lamblia
LVGLRINFEKILEQVSLL

SEQ ID NO: 3163542 - protein, 21 aa, Giardia lamblia
LVHAHARFQIVNTIYTHQVPE

SEQ ID NO: 3163543 - protein, 17 aa, Giardia lamblia
LVHCDLRPANVLISADG

SEQ ID NO: 3163544 - protein, 17 aa, Giardia lamblia
LVHHGFFGKSFLRVTDS

SEQ ID NO: 3163545 - protein, 20 aa, Giardia lamblia
LVHRRYCIVNESAIVIQKNY

SEQ ID NO: 3163546 - protein, 18 aa, Giardia lamblia
LVHSCLLVDPTERITAAE

SEQ ID NO: 3163547 - protein, 17 aa, Giardia lamblia
LVHYILSFWDCYNLKRL

SEQ ID NO: 3163548 - protein, 24 aa, Giardia lamblia
LVICSGPVLRCIKLGDSSAKILPP

SEQ ID NO: 3163549 - protein, 21 aa, Giardia lamblia
LVIEACILSSAFSGFLDLLNK

SEQ ID NO: 3163550 - protein, 30 aa, Giardia lamblia
LVIEAFRLIPGASMGLSFGISFGSSTDTRV

SEQ ID NO: 3163551 - protein, 19 aa, Giardia lamblia
LVIGGGCFEAHLSTALSQY

SEQ ID NO: 3163552 - protein, 17 aa, Giardia lamblia
LVIGSLRNLTSMFDPSL

SEQ ID NO: 3163553 - protein, 25 aa, Giardia lamblia
LVINSPVRLSGAWGSMLSDGATPAM

SEQ ID NO: 3163554 - protein, 19 aa, Giardia lamblia
LVIPNLMATCAMQGTGQLT

SEQ ID NO: 3163555 - protein, 17 aa, Giardia lamblia
LVKAILFEIEKLANRGM

SEQ ID NO: 3163556 - protein, 23 aa, Giardia lamblia
LVKCPTPLFLAQYVPPVLFVAHH

SEQ ID NO: 3163557 - protein, 17 aa, Giardia lamblia
LVKEAKDPLRALLKHVP

SEQ ID NO: 3163558 - protein, 22 aa, Giardia lamblia
LVKIFRSLCGQLEERLQHESGL

SEQ ID NO: 3163559 - protein, 18 aa, Giardia lamblia
LVKKNGYSSLMVAAVHGH

SEQ ID NO: 3163560 - protein, 39 aa, Giardia lamblia
LVKLRHLLELKAAEGVGSFVPCFWESVCKEFAHRRRSLQ

SEQ ID NO: 3163561 - protein, 20 aa, Giardia lamblia
LVKQGVLRPEFAGMTDQTFK

SEQ ID NO: 3163562 - protein, 21 aa, Giardia lamblia
LVKRIYEMILTKLINTKFEYY

SEQ ID NO: 3163563 - protein, 20 aa, Giardia lamblia
LVKRRWVQEHLIPKGIVDSV

SEQ ID NO: 3163564 - protein, 18 aa, Giardia lamblia
LVKSCWQRWTDDEHMAMC

SEQ ID NO: 3163565 - protein, 21 aa, Giardia lamblia
LVKSIEYAAVMALKHNLGLTC

SEQ ID NO: 3163566 - protein, 23 aa, Giardia lamblia
LVKTDLRLVSKIDVRDNMTDADV

SEQ ID NO: 3163567 - protein, 24 aa, Giardia lamblia
LVKVACPFVIWIPGSIAMHEPEPA

SEQ ID NO: 3163568 - protein, 19 aa, Giardia lamblia
LVKVEGVDKVVFIRGKHEF

SEQ ID NO: 3163569 - protein, 19 aa, Giardia lamblia
LVLAIRVGNEILVEMLLEF

SEQ ID NO: 3163570 - protein, 17 aa, Giardia lamblia
LVLCDNFVDLMNVVYAE

SEQ ID NO: 3163571 - protein, 18 aa, Giardia lamblia
LVLCECGIGKVCSGTAAV

SEQ ID NO: 3163572 - protein, 21 aa, Giardia lamblia
LVLEAVCQFFGVKGNRVQDKD

SEQ ID NO: 3163573 - protein, 17 aa, Giardia lamblia
LVLFIRSLVVNPSFDSQ

SEQ ID NO: 3163574 - protein, 25 aa, Giardia lamblia
LVLLICIIGDYPFRDVSTFEIVPSV

SEQ ID NO: 3163575 - protein, 30 aa, Giardia lamblia
LVLLPGPYKPCIHRKFRELASDIGVFKNEE

SEQ ID NO: 3163576 - protein, 17 aa, Giardia lamblia
LVLRIPLNTAGGDRAAI

SEQ ID NO: 3163577 - protein, 25 aa, Giardia lamblia
LVLRKDHLCCFIPSDMIFGQIVLRD

SEQ ID NO: 3163578 - protein, 30 aa, Giardia lamblia
LVLRVVGHPGILCWLQFHMNLRSEFTMDPE

SEQ ID NO: 3163579 - protein, 27 aa, Giardia lamblia
LVLYASQGFPFWNVFFEQRKKWLVTRK

SEQ ID NO: 3163580 - protein, 24 aa, Giardia lamblia
LVLYEMLLYIAGADRYSVPITEFI

SEQ ID NO: 3163581 - protein, 26 aa, Giardia lamblia
LVMVRFEGFAVLVFCSPFSKITAAEV

SEQ ID NO: 3163582 - protein, 18 aa, Giardia lamblia
LVNAERVIKGLIIMTKET

SEQ ID NO: 3163583 - protein, 19 aa, Giardia lamblia
LVNAERVIKGLIIMTKETE

SEQ ID NO: 3163584 - protein, 20 aa, Giardia lamblia
LVNCCTLDWFTGWPDEALID

SEQ ID NO: 3163585 - protein, 25 aa, Giardia lamblia
LVNCKKRGLPIPECYFTRINELFGP

SEQ ID NO: 3163586 - protein, 17 aa, Giardia lamblia
LVNCYFLGEIADESPPF

SEQ ID NO: 3163587 - protein, 19 aa, Giardia lamblia
LVNMCRPYINTAIFMGVQG

SEQ ID NO: 3163588 - protein, 23 aa, Giardia lamblia
LVNRKGMSALMFAAELNNVSAAR

SEQ ID NO: 3163589 - protein, 26 aa, Giardia lamblia
LVNRLKQTALMIACERNNAAIASLLM

SEQ ID NO: 3163590 - protein, 27 aa, Giardia lamblia
LVNTDMKYLAWIQHKTAVFNRSVANAR

SEQ ID NO: 3163591 - protein, 20 aa, Giardia lamblia
LVPHEARIPTRRGFSALMFA

SEQ ID NO: 3163592 - protein, 21 aa, Giardia lamblia
LVPHEKCILRCGISATEASLF

SEQ ID NO: 3163593 - protein, 23 aa, Giardia lamblia
LVPHMSALVLKVFDPTIVIKKVQ

SEQ ID NO: 3163594 - protein, 18 aa, Giardia lamblia
LVPHRFQLDVPDVVDFKV

SEQ ID NO: 3163595 - protein, 24 aa, Giardia lamblia
LVPLHHHRIFSAKLPLLAEKMTWT

SEQ ID NO: 3163596 - protein, 23 aa, Giardia lamblia
LVQQRVAASLALREASQKSISSP

SEQ ID NO: 3163597 - protein, 24 aa, Giardia lamblia
LVQRADGVDLHWTKIGNELFSCTI

SEQ ID NO: 3163598 - protein, 17 aa, Giardia lamblia
LVQRPKDRVSIFEVHKL

SEQ ID NO: 3163599 - protein, 24 aa, Giardia lamblia
LVRDLRLGTDPALAQYSDLLSVSS

SEQ ID NO: 3163600 - protein, 19 aa, Giardia lamblia
LVREARLMSRDRIETHPAH

SEQ ID NO: 3163601 - protein, 18 aa, Giardia lamblia
LVRESRIAIRTIYIDMYS

SEQ ID NO: 3163602 - protein, 19 aa, Giardia lamblia
LVRKISFSAFQPIYGAQAN

SEQ ID NO: 3163603 - protein, 22 aa, Giardia lamblia
LVRKLPEKYHILFEKAREKERR

SEQ ID NO: 3163604 - protein, 18 aa, Giardia lamblia
LVRLLGLELTPLLQKADR

SEQ ID NO: 3163605 - protein, 24 aa, Giardia lamblia
LVRNKRLPTALIHDVKQETVRIQE

SEQ ID NO: 3163606 - protein, 22 aa, Giardia lamblia
LVRRLKSFFIDFQNCYDAITLV

SEQ ID NO: 3163607 - protein, 23 aa, Giardia lamblia
LVSDCDYFPLVIVDEASQVTEPL

SEQ ID NO: 3163608 - protein, 19 aa, Giardia lamblia
LVSDGKCLTNFHGMDITRH

SEQ ID NO: 3163609 - protein, 17 aa, Giardia lamblia
LVSELVFLAMEVSRVTE

SEQ ID NO: 3163610 - protein, 19 aa, Giardia lamblia
LVSHPDYPALLGSQRCLRA

SEQ ID NO: 3163611 - protein, 25 aa, Giardia lamblia
LVSIAARFGKTIVVLNCDSGSIPSV

SEQ ID NO: 3163612 - protein, 17 aa, Giardia lamblia
LVSIAWRHISSLAKRYA

SEQ ID NO: 3163613 - protein, 25 aa, Giardia lamblia
LVSIEHKICIASGIVYICSQMPLFV

SEQ ID NO: 3163614 - protein, 40 aa, Giardia lamblia
LVSMKIKLSEGFFAFFLSPRVVDMVETLFWLVHSVVFSPK

SEQ ID NO: 3163615 - protein, 17 aa, Giardia lamblia
LVSQLKLTINELTLAKQ

SEQ ID NO: 3163616 - protein, 18 aa, Giardia lamblia
LVSRAELDKAATLISQQQ

SEQ ID NO: 3163617 - protein, 17 aa, Giardia lamblia
LVSRAELHGSNEVSWII

SEQ ID NO: 3163618 - protein, 18 aa, Giardia lamblia
LVSRSFISLAHIQQPMVM

SEQ ID NO: 3163619 - protein, 29 aa, Giardia lamblia
LVSTLLHLRTCLAHYGLSLYLESLASTNI

SEQ ID NO: 3163620 - protein, 18 aa, Giardia lamblia
LVSYSFDFVLPASLLSNT

SEQ ID NO: 3163621 - protein, 20 aa, Giardia lamblia
LVTEAVCRDVLVSALQNEAQ

SEQ ID NO: 3163622 - protein, 17 aa, Giardia lamblia
LVTFRLAECNLNVSQAC

SEQ ID NO: 3163623 - protein, 17 aa, Giardia lamblia
LVTIYVVKMSEKRAKQG

SEQ ID NO: 3163624 - protein, 24 aa, Giardia lamblia
LVTLKRPDFLGGKEPAEVFVDGWR

SEQ ID NO: 3163625 - protein, 24 aa, Giardia lamblia
LVTLRRPDFLGGKEPAEVFIDGWR

SEQ ID NO: 3163626 - protein, 24 aa, Giardia lamblia
LVTLRRPNFLGGKEPAEVFVDEWT

SEQ ID NO: 3163627 - protein, 20 aa, Giardia lamblia
LVTPGLRFLGTREFLRPMTA

SEQ ID NO: 3163628 - protein, 20 aa, Giardia lamblia
LVTRSDFRNISLVGSEKQSH

SEQ ID NO: 3163629 - protein, 19 aa, Giardia lamblia
LVTVCKPISPSPFACNTVR

SEQ ID NO: 3163630 - protein, 17 aa, Giardia lamblia
LVTWKTELAYVRPVIAL

SEQ ID NO: 3163631 - protein, 18 aa, Giardia lamblia
LVTYWRALLDYQKKLMTQ

SEQ ID NO: 3163632 - protein, 20 aa, Giardia lamblia
LVVEFLGCSTYRFLQQYTRR

SEQ ID NO: 3163633 - protein, 18 aa, Giardia lamblia
LVVGRLPFLFADEVIVEI

SEQ ID NO: 3163634 - protein, 23 aa, Giardia lamblia
LVVLPRKDFLALLQTSSDTLTII

SEQ ID NO: 3163635 - protein, 18 aa, Giardia lamblia
LVVSIGLNKVKVVRKGIN

SEQ ID NO: 3163636 - protein, 17 aa, Giardia lamblia
LVVSVAPILRLLVYEDG

SEQ ID NO: 3163637 - protein, 23 aa, Giardia lamblia
LVVYGLDYHKAWQRDVAPEISFA

SEQ ID NO: 3163638 - protein, 32 aa, Giardia lamblia
LVVYKRAYYYSFAYYYVGLCMRTDAKYKEALD

SEQ ID NO: 3163639 - protein, 22 aa, Giardia lamblia
LVWQKLDGGWRIGAEHKFQQPI

SEQ ID NO: 3163640 - protein, 22 aa, Giardia lamblia
LVYCTSMRAFGLVSMDSSESYE

SEQ ID NO: 3163641 - protein, 19 aa, Giardia lamblia
LVYCVCALKPPAYSANPEE

SEQ ID NO: 3163642 - protein, 17 aa, Giardia lamblia
LVYDITRRASFEHVANW

SEQ ID NO: 3163643 - protein, 19 aa, Giardia lamblia
LVYPFKSDVVPLISKVTGV

SEQ ID NO: 3163644 - protein, 19 aa, Giardia lamblia
LWAPDVTGLMRAAATNDMN

SEQ ID NO: 3163645 - protein, 27 aa, Giardia lamblia
LWDIRSEGRPLITLPIHPFVKDYAQRL

SEQ ID NO: 3163646 - protein, 23 aa, Giardia lamblia
LWDVRSSTLLQHYSCHTNQVTCL

SEQ ID NO: 3163647 - protein, 18 aa, Giardia lamblia
LWHEGNIKVAIETLLQEK

SEQ ID NO: 3163648 - protein, 19 aa, Giardia lamblia
LWKVVGYYVNICLGHTPPY

SEQ ID NO: 3163649 - protein, 33 aa, Giardia lamblia
LWLEARRCCPDCTRYSPVLVYGFEQLAARAAAH

SEQ ID NO: 3163650 - protein, 23 aa, Giardia lamblia
LWMQAMCVIIWQFSHMFRIRSRH

SEQ ID NO: 3163651 - protein, 23 aa, Giardia lamblia
LWNNERYSPIVLPREQEVLDTVK

SEQ ID NO: 3163652 - protein, 19 aa, Giardia lamblia
LWQRLITRILSSKRVSRSS

SEQ ID NO: 3163653 - protein, 21 aa, Giardia lamblia
LWRHLTVLYADAWSPGEGEHK

SEQ ID NO: 3163654 - protein, 17 aa, Giardia lamblia
LWRLRKGDDITQPKTRG

SEQ ID NO: 3163655 - protein, 18 aa, Giardia lamblia
LWTLRAMINLLPTASELH

SEQ ID NO: 3163656 - protein, 18 aa, Giardia lamblia
LWTSRGSGIVINKLLLLP

SEQ ID NO: 3163657 - protein, 18 aa, Giardia lamblia
LYAACLYASPMLMEPFYL

SEQ ID NO: 3163658 - protein, 27 aa, Giardia lamblia
LYAAVECYFMTAALDLFKIIIPVKPYF

SEQ ID NO: 3163659 - protein, 28 aa, Giardia lamblia
LYADAGGPRIHWDGSLVSLLQNSGPGSS

SEQ ID NO: 3163660 - protein, 32 aa, Giardia lamblia
LYADDITIILGFRKSCIFAGNRGCDPSTYIFK

SEQ ID NO: 3163661 - protein, 17 aa, Giardia lamblia
LYADTPQIRMCLEEFRA

SEQ ID NO: 3163662 - protein, 24 aa, Giardia lamblia
LYAIYVFLASSWVANKLEFGFEYS

SEQ ID NO: 3163663 - protein, 24 aa, Giardia lamblia
LYALEGYPALAVREIQLDSFTEDI

SEQ ID NO: 3163664 - protein, 17 aa, Giardia lamblia
LYALVGPLPKTGMASQS

SEQ ID NO: 3163665 - protein, 17 aa, Giardia lamblia
LYAPSWIMEYCNIRPGD

SEQ ID NO: 3163666 - protein, 18 aa, Giardia lamblia
LYAPTCRTCWKSIAHQRS

SEQ ID NO: 3163667 - protein, 17 aa, Giardia lamblia
LYARKLPVLNADELIAN

SEQ ID NO: 3163668 - protein, 19 aa, Giardia lamblia
LYASPMLMEPFYLVDILAP

SEQ ID NO: 3163669 - protein, 17 aa, Giardia lamblia
LYASTIVYYGGKEVSYD

SEQ ID NO: 3163670 - protein, 46 aa, Giardia lamblia
LYDEIPLCMGSQYGAIELCIRFKRENMLLWILEYCSRHSKLETAAK

SEQ ID NO: 3163671 - protein, 24 aa, Giardia lamblia
LYDFSRLRMQYSIMSKRHLQWFVE

SEQ ID NO: 3163672 - protein, 18 aa, Giardia lamblia
LYDGGRFLLKQSKPLLEA

SEQ ID NO: 3163673 - protein, 35 aa, Giardia lamblia
LYDIFKADIWSIGCLFIEMFTTYPPFFQFKQVPAL

SEQ ID NO: 3163674 - protein, 18 aa, Giardia lamblia
LYDIKMSQCIDLRATSNT

SEQ ID NO: 3163675 - protein, 23 aa, Giardia lamblia
LYDLKQCCSWIGSLESLADMQGV

SEQ ID NO: 3163676 - protein, 27 aa, Giardia lamblia
LYDLPTPYLKRFACILLSIDGRPETVD

SEQ ID NO: 3163677 - protein, 29 aa, Giardia lamblia
LYDTHCFRDFSTLCVKSMFLYDMESPNQY

SEQ ID NO: 3163678 - protein, 25 aa, Giardia lamblia
LYEIKRLDRWDGFLWRTELTEENSG

SEQ ID NO: 3163679 - protein, 18 aa, Giardia lamblia
LYEKCASLCLSHEKPHLS

SEQ ID NO: 3163680 - protein, 23 aa, Giardia lamblia
LYELAYRKPKFIFTIGDGTVPLI

SEQ ID NO: 3163681 - protein, 23 aa, Giardia lamblia
LYEYACQIIPILHREITPDNLIV

SEQ ID NO: 3163682 - protein, 20 aa, Giardia lamblia
LYFLDKRQGLLMLPYATIYI

SEQ ID NO: 3163683 - protein, 21 aa, Giardia lamblia
LYFMDVCAMISSPTPHRVPVE

SEQ ID NO: 3163684 - protein, 17 aa, Giardia lamblia
LYFNGDIFTEDWAIQDR

SEQ ID NO: 3163685 - protein, 17 aa, Giardia lamblia
LYFSSKNPFQIVLHLGY

SEQ ID NO: 3163686 - protein, 25 aa, Giardia lamblia
LYGDHEFYCMLLAIASQYSSSKVSE

SEQ ID NO: 3163687 - protein, 17 aa, Giardia lamblia
LYGGKQAPTEWVIMECR

SEQ ID NO: 3163688 - protein, 18 aa, Giardia lamblia
LYGGKSCIIHGDIPQIDR

SEQ ID NO: 3163689 - protein, 20 aa, Giardia lamblia
LYGQTALMLAIMNKHDSIAR

SEQ ID NO: 3163690 - protein, 27 aa, Giardia lamblia
LYGSALRAKAFQEIYCNSSNYTKMIYL

SEQ ID NO: 3163691 - protein, 19 aa, Giardia lamblia
LYHAKVYNDQCFEWFSQLK

SEQ ID NO: 3163692 - protein, 21 aa, Giardia lamblia
LYHNIAVALNCEGRPSDAVDF

SEQ ID NO: 3163693 - protein, 17 aa, Giardia lamblia
LYIFGGRGADSSLNDLW

SEQ ID NO: 3163694 - protein, 27 aa, Giardia lamblia
LYIKELSMFAIAIIKQGLTVSGAEDIL

SEQ ID NO: 3163695 - protein, 17 aa, Giardia lamblia
LYILIGGILQNRDMSPL

SEQ ID NO: 3163696 - protein, 31 aa, Giardia lamblia
LYILQYPLRPTWRLYNWSSMSSVTFHPSINH

SEQ ID NO: 3163697 - protein, 24 aa, Giardia lamblia
LYIMGAGFYPAFKAYSQNKFTAGK

SEQ ID NO: 3163698 - protein, 24 aa, Giardia lamblia
LYIVSGNLSFFWVGSLVPEELRRG

SEQ ID NO: 3163699 - protein, 22 aa, Giardia lamblia
LYKAVCDVGGCMVIIADHGNSD

SEQ ID NO: 3163700 - protein, 19 aa, Giardia lamblia
LYKDLFWKLMRSRSSGNIL

SEQ ID NO: 3163701 - protein, 22 aa, Giardia lamblia
LYLCMHCNFCACLDHVNIHQEK

SEQ ID NO: 3163702 - protein, 17 aa, Giardia lamblia
LYLCRSMESSYFINMIY

SEQ ID NO: 3163703 - protein, 18 aa, Giardia lamblia
LYLFLSMIAPTCLDSSIH

SEQ ID NO: 3163704 - protein, 19 aa, Giardia lamblia
LYLLRYPHYELIRITPDGH

SEQ ID NO: 3163705 - protein, 33 aa, Giardia lamblia
LYLRYHEVVGLSFLKIDLFKAVTGLSEELFPQR

SEQ ID NO: 3163706 - protein, 17 aa, Giardia lamblia
LYMAHLRASRVHNVSGH

SEQ ID NO: 3163707 - protein, 20 aa, Giardia lamblia
LYMHCLKRIVEGALSPLYHE

SEQ ID NO: 3163708 - protein, 24 aa, Giardia lamblia
LYMNARAAAIFSRLRKLFRGLKGL

SEQ ID NO: 3163709 - protein, 19 aa, Giardia lamblia
LYMRKYRVLLPAAEGLLLF

SEQ ID NO: 3163710 - protein, 31 aa, Giardia lamblia
LYNHLLRTCCRTCLNRCLATGIEGSDLLKFL

SEQ ID NO: 3163711 - protein, 21 aa, Giardia lamblia
LYNIVKLLLKEAGQHLIATSE

SEQ ID NO: 3163712 - protein, 20 aa, Giardia lamblia
LYNLVCEQIKSKFKQISPDE

SEQ ID NO: 3163713 - protein, 19 aa, Giardia lamblia
LYNLVSNLRTKECSLDAAK

SEQ ID NO: 3163714 - protein, 21 aa, Giardia lamblia
LYNMKEIRESSLLQFVNDPHC

SEQ ID NO: 3163715 - protein, 18 aa, Giardia lamblia
LYNSLIAGLHGPSENSGE

SEQ ID NO: 3163716 - protein, 42 aa, Giardia lamblia
LYPLRSRTSLISLCLGLVKYWISTCCGYDFSFSGLFTQAYSM

SEQ ID NO: 3163717 - protein, 24 aa, Giardia lamblia
LYPRIRKVMRYDIAPSAKAGELQE

SEQ ID NO: 3163718 - protein, 20 aa, Giardia lamblia
LYQFSFRPSSILDIGCADGY

SEQ ID NO: 3163719 - protein, 18 aa, Giardia lamblia
LYQGLLASFDWGYKQYVE

SEQ ID NO: 3163720 - protein, 18 aa, Giardia lamblia
LYQHSFGTLAVQAQQNIG

SEQ ID NO: 3163721 - protein, 24 aa, Giardia lamblia
LYQKIGCTPLMFAAGGGHKELVEL

SEQ ID NO: 3163722 - protein, 18 aa, Giardia lamblia
LYQLFTPEWRSELLCALF

SEQ ID NO: 3163723 - protein, 18 aa, Giardia lamblia
LYRDSCIQSNGVFVKDMS

SEQ ID NO: 3163724 - protein, 17 aa, Giardia lamblia
LYRIYDHYRDAHYAFGE

SEQ ID NO: 3163725 - protein, 21 aa, Giardia lamblia
LYRKNVQELAEIIANNERHFN

SEQ ID NO: 3163726 - protein, 21 aa, Giardia lamblia
LYRKYVHPFIFALGTILPLNP

SEQ ID NO: 3163727 - protein, 18 aa, Giardia lamblia
LYRNGFAQMVNRHMKETS

SEQ ID NO: 3163728 - protein, 17 aa, Giardia lamblia
LYRSMGFDLYEHARDKG

SEQ ID NO: 3163729 - protein, 19 aa, Giardia lamblia
LYSDLLFSRMESLASSISQ

SEQ ID NO: 3163730 - protein, 21 aa, Giardia lamblia
LYSIPAWKPGRHHSRSNFQMI

SEQ ID NO: 3163731 - protein, 18 aa, Giardia lamblia
LYSLEGIRIYCSAPSQGV

SEQ ID NO: 3163732 - protein, 17 aa, Giardia lamblia
LYSLISCCNHSCTPNAQ

SEQ ID NO: 3163733 - protein, 18 aa, Giardia lamblia
LYSLRAFPPKKVRRASNM

SEQ ID NO: 3163734 - protein, 19 aa, Giardia lamblia
LYSMEFLKENVHWLSTQIS

SEQ ID NO: 3163735 - protein, 20 aa, Giardia lamblia
LYSNEHVLCITSLKKAETKL

SEQ ID NO: 3163736 - protein, 20 aa, Giardia lamblia
LYSRPCEVIYGFDIDCSGVA

SEQ ID NO: 3163737 - protein, 20 aa, Giardia lamblia
LYSSEECKIVISALQSVLTL

SEQ ID NO: 3163738 - protein, 20 aa, Giardia lamblia
LYSYSLCSFICSCLQPDPVK

SEQ ID NO: 3163739 - protein, 28 aa, Giardia lamblia
LYTCFTSIRAEVQWVFTAMASHFPGDQG

SEQ ID NO: 3163740 - protein, 17 aa, Giardia lamblia
LYTEDWTLGLSKFELQF

SEQ ID NO: 3163741 - protein, 18 aa, Giardia lamblia
LYTGMAFESVLRAKIPDA

SEQ ID NO: 3163742 - protein, 30 aa, Giardia lamblia
LYTKRPDLARFALIAEFCGALTPSRSTACC

SEQ ID NO: 3163743 - protein, 31 aa, Giardia lamblia
LYTPVCLQIPSTLPVPRHAFGAITTSTGTIS

SEQ ID NO: 3163744 - protein, 28 aa, Giardia lamblia
LYTQCVVPLRLSDIGVYILLSSATPNQE

SEQ ID NO: 3163745 - protein, 17 aa, Giardia lamblia
LYTRFIASIVNNQGLGA

SEQ ID NO: 3163746 - protein, 18 aa, Giardia lamblia
LYTSLKNYIMDGVQIDPN

SEQ ID NO: 3163747 - protein, 17 aa, Giardia lamblia
LYVCNFASSGVSAYTSP

SEQ ID NO: 3163748 - protein, 18 aa, Giardia lamblia
LYVEGLDIYMTCSRDNLA

SEQ ID NO: 3163749 - protein, 22 aa, Giardia lamblia
LYVPNRLLAAYIQEPEQLQLHE

SEQ ID NO: 3163750 - protein, 19 aa, Giardia lamblia
LYVPSDIARKLLFRVETCD

SEQ ID NO: 3163751 - protein, 18 aa, Giardia lamblia
LYVQSDLPKISFKHKYDL

SEQ ID NO: 3163752 - protein, 19 aa, Giardia lamblia
LYVTQIVKGLIFIHYNGYT

SEQ ID NO: 3163753 - protein, 25 aa, Giardia lamblia
LYWNGFPHYGPKPDLPGSGSAEVQS

SEQ ID NO: 3163754 - protein, 17 aa, Giardia lamblia
LYYLLLRRGESYAKHLF

SEQ ID NO: 3163755 - protein, 28 aa, Giardia lamblia
LYYLVLGCRSNCHFNSFNVLEQSTLSNR

SEQ ID NO: 3163756 - protein, 27 aa, Giardia lamblia
LYYREVPAVERFHFPKNQIVYGAYLAS

SEQ ID NO: 3163757 - protein, 19 aa, Giardia lamblia
LYYVPFPKEFDSVEKIINA

SEQ ID NO: 3163758 - protein, 24 aa, Giardia lamblia
MAAGLSCISDLLAPKVPLEVKTAS

SEQ ID NO: 3163759 - protein, 20 aa, Giardia lamblia
MAALGHWRSEQPGLWAIGDL

SEQ ID NO: 3163760 - protein, 27 aa, Giardia lamblia
MAASRLFRRMDLFWATNYLCYDHISVG

SEQ ID NO: 3163761 - protein, 22 aa, Giardia lamblia
MADGYYQRRFVAAAVKNISNRP

SEQ ID NO: 3163762 - protein, 20 aa, Giardia lamblia
MADLFRFADEMRMSRKMQSI

SEQ ID NO: 3163763 - protein, 17 aa, Giardia lamblia
MADLLCYHAKRIYKESC

SEQ ID NO: 3163764 - protein, 18 aa, Giardia lamblia
MADVNGFTALMVAAQTGH

SEQ ID NO: 3163765 - protein, 18 aa, Giardia lamblia
MADVPSEMKQCVFKPKLS

SEQ ID NO: 3163766 - protein, 18 aa, Giardia lamblia
MADVYGCPTEGPAKGGIG

SEQ ID NO: 3163767 - protein, 23 aa, Giardia lamblia
MADYYGWTALMWAVSCNQIECVR

SEQ ID NO: 3163768 - protein, 21 aa, Giardia lamblia
MAEMFREMARNPELIRQQFNS

SEQ ID NO: 3163769 - protein, 20 aa, Giardia lamblia
MAGGDFVSGIVLERTKPAQQ

SEQ ID NO: 3163770 - protein, 23 aa, Giardia lamblia
MAGGLRRKYIHLSEDIVLIQAMR

SEQ ID NO: 3163771 - protein, 19 aa, Giardia lamblia
MAGMHGCSKVVSFLESEGI

SEQ ID NO: 3163772 - protein, 19 aa, Giardia lamblia
MAGNVYTLALISFRLIQGS

SEQ ID NO: 3163773 - protein, 20 aa, Giardia lamblia
MAHASLRYCHVFYAVGSEDL

SEQ ID NO: 3163774 - protein, 20 aa, Giardia lamblia
MAHRYICPDTIYVLESGVAQ

SEQ ID NO: 3163775 - protein, 17 aa, Giardia lamblia
MAIACEQLLRIREAQLF

SEQ ID NO: 3163776 - protein, 17 aa, Giardia lamblia
MAIISIGFMLEKLDDPV

SEQ ID NO: 3163777 - protein, 19 aa, Giardia lamblia
MAIQLHDLVSVTILSDYER

SEQ ID NO: 3163778 - protein, 24 aa, Giardia lamblia
MAIRLVRLKISVSMVLMPASSVSS

SEQ ID NO: 3163779 - protein, 20 aa, Giardia lamblia
MAKFACKEADLPAELQRTTM

SEQ ID NO: 3163780 - protein, 26 aa, Giardia lamblia
MAKTTRFSPVMSMKGSRTEVFSVASP

SEQ ID NO: 3163781 - protein, 17 aa, Giardia lamblia
MAKTVFGKSELDDVFTA

SEQ ID NO: 3163782 - protein, 28 aa, Giardia lamblia
MAKVSLIKCTVCGLGVDISAAQPGSLVT

SEQ ID NO: 3163783 - protein, 18 aa, Giardia lamblia
MALADLQARHDALSEDNS

SEQ ID NO: 3163784 - protein, 20 aa, Giardia lamblia
MALFDECQRLLSSSEEDLGE

SEQ ID NO: 3163785 - protein, 17 aa, Giardia lamblia
MALTRLINYGLIVITED

SEQ ID NO: 3163786 - protein, 18 aa, Giardia lamblia
MALVKGMGCKGVSSQYCG

SEQ ID NO: 3163787 - protein, 27 aa, Giardia lamblia
MALYSLKLPKSLMLCTKPHAFKDVVPD

SEQ ID NO: 3163788 - protein, 20 aa, Giardia lamblia
MAMFCQSLVWPVETYLGQYK

SEQ ID NO: 3163789 - protein, 17 aa, Giardia lamblia
MANSFPTFGVQVLSMSK

SEQ ID NO: 3163790 - protein, 18 aa, Giardia lamblia
MAPATAMMIAAMNGSIDC

SEQ ID NO: 3163791 - protein, 24 aa, Giardia lamblia
MAPILKDIVDKVVLLAPVGMVMEL

SEQ ID NO: 3163792 - protein, 23 aa, Giardia lamblia
MAPKCQKMIDLIIEISKNVINSN

SEQ ID NO: 3163793 - protein, 21 aa, Giardia lamblia
MAPSSPCIRDNSELERLLCVI

SEQ ID NO: 3163794 - protein, 17 aa, Giardia lamblia
MAQAFDRYAALAGALSD

SEQ ID NO: 3163795 - protein, 18 aa, Giardia lamblia
MAQASCRELEKAPLSDPY

SEQ ID NO: 3163796 - protein, 33 aa, Giardia lamblia
MAQHLRWLSKLAHTHISPLISHTYSKESSCLSL

SEQ ID NO: 3163797 - protein, 21 aa, Giardia lamblia
MAQSCIKLHRWQDAVDRIEEY

SEQ ID NO: 3163798 - protein, 22 aa, Giardia lamblia
MARRELQYYKDCEATKRQKTIK

SEQ ID NO: 3163799 - protein, 20 aa, Giardia lamblia
MASGVRPDATLLPRTHEEER

SEQ ID NO: 3163800 - protein, 17 aa, Giardia lamblia
MASLRGRLCTESDATEH

SEQ ID NO: 3163801 - protein, 24 aa, Giardia lamblia
MATLRRPDFLKGKDPKDVFVDRWR

SEQ ID NO: 3163802 - protein, 31 aa, Giardia lamblia
MATPPELCTFCIYCGLKFHPDAVFCGNCGSK

SEQ ID NO: 3163803 - protein, 23 aa, Giardia lamblia
MAVAPPNWRNTGLNEDLEAFGDN

SEQ ID NO: 3163804 - protein, 23 aa, Giardia lamblia
MAVCSISDLISRFEASVASAFST

SEQ ID NO: 3163805 - protein, 19 aa, Giardia lamblia
MAVFLWKSPALMLQPENVK

SEQ ID NO: 3163806 - protein, 20 aa, Giardia lamblia
MAVNRLAALSTRSTKSARRP

SEQ ID NO: 3163807 - protein, 17 aa, Giardia lamblia
MAVRSGPRCELSCTEIH

SEQ ID NO: 3163808 - protein, 17 aa, Giardia lamblia
MAWDPMLLHIFSVSTEV

SEQ ID NO: 3163809 - protein, 18 aa, Giardia lamblia
MAYKSMIIVRDLNFGARQ

SEQ ID NO: 3163810 - protein, 17 aa, Giardia lamblia
MCAACIGDVGAVRRNIQ

SEQ ID NO: 3163811 - protein, 25 aa, Giardia lamblia
MCARFDARRYVQWADLFQTMKHAQL

SEQ ID NO: 3163812 - protein, 21 aa, Giardia lamblia
MCARWHPTEDLIVTASMDATV

SEQ ID NO: 3163813 - protein, 18 aa, Giardia lamblia
MCELAAQLIDKADEALET

SEQ ID NO: 3163814 - protein, 18 aa, Giardia lamblia
MCEYSLPFYWNGIEDIHK

SEQ ID NO: 3163815 - protein, 18 aa, Giardia lamblia
MCLAGKFLEAAREYVNMC

SEQ ID NO: 3163816 - protein, 18 aa, Giardia lamblia
MCSMPGHAVNAIVRINGQ

SEQ ID NO: 3163817 - protein, 18 aa, Giardia lamblia
MCSQLKCADLSHNLISSI

SEQ ID NO: 3163818 - protein, 20 aa, Giardia lamblia
MCTSCGKGLGTFVPSSTNSS

SEQ ID NO: 3163819 - protein, 23 aa, Giardia lamblia
MDAKRLELELSRVVDDDDADQIT

SEQ ID NO: 3163820 - protein, 18 aa, Giardia lamblia
MDALPILIKTHAPALRDF

SEQ ID NO: 3163821 - protein, 23 aa, Giardia lamblia
MDATCPVVYPKLDPCWDENGHEE

SEQ ID NO: 3163822 - protein, 32 aa, Giardia lamblia
MDAYCAAFQCLPSLRGADTVKILSQCTIGPNV

SEQ ID NO: 3163823 - protein, 19 aa, Giardia lamblia
MDDGAALSTVLADLAGAVK

SEQ ID NO: 3163824 - protein, 18 aa, Giardia lamblia
MDDIQACLTKAIRARTTG

SEQ ID NO: 3163825 - protein, 23 aa, Giardia lamblia
MDDVCKAVGVLQSKLKEETRTVG

SEQ ID NO: 3163826 - protein, 17 aa, Giardia lamblia
MDECIDLSKPGGVLLTD

SEQ ID NO: 3163827 - protein, 18 aa, Giardia lamblia
MDELCTARETAIALRERE

SEQ ID NO: 3163828 - protein, 17 aa, Giardia lamblia
MDFKVMYSPLATADLHR

SEQ ID NO: 3163829 - protein, 24 aa, Giardia lamblia
MDGQFFLYRFFKPSNIFLCENGCI

SEQ ID NO: 3163830 - protein, 22 aa, Giardia lamblia
MDGTCSEYMWFSESCSDSRRND

SEQ ID NO: 3163831 - protein, 27 aa, Giardia lamblia
MDGTRFYNPICPLEIAKRICVNGFLSK

SEQ ID NO: 3163832 - protein, 22 aa, Giardia lamblia
MDHALRVNIRFVVDNYVAHPTQ

SEQ ID NO: 3163833 - protein, 18 aa, Giardia lamblia
MDIEKLCTLDHFRQIIAK

SEQ ID NO: 3163834 - protein, 17 aa, Giardia lamblia
MDIKRLKEAGIHTIQSL

SEQ ID NO: 3163835 - protein, 18 aa, Giardia lamblia
MDILKRKISTTLTNVEYA

SEQ ID NO: 3163836 - protein, 23 aa, Giardia lamblia
MDKTVLCQMCRSLATMGKTHLSV

SEQ ID NO: 3163837 - protein, 17 aa, Giardia lamblia
MDLKDEFGFEPLPYNQA

SEQ ID NO: 3163838 - protein, 17 aa, Giardia lamblia
MDLPCPTSSVPAKPCPN

SEQ ID NO: 3163839 - protein, 26 aa, Giardia lamblia
MDLRKVEKLWAIALLITDVVTSNSIL

SEQ ID NO: 3163840 - protein, 24 aa, Giardia lamblia
MDLVPTLRRLRVKSKRTPMSRRYF

SEQ ID NO: 3163841 - protein, 22 aa, Giardia lamblia
MDMKAKLSIFTAKWPAQNQPTT

SEQ ID NO: 3163842 - protein, 18 aa, Giardia lamblia
MDMTNFYNACQVLQMAGV

SEQ ID NO: 3163843 - protein, 25 aa, Giardia lamblia
MDNFEFFQWFKWFFDQNYKGSKSGA

SEQ ID NO: 3163844 - protein, 21 aa, Giardia lamblia
MDNFRILVASWDMRYRVINPS

SEQ ID NO: 3163845 - protein, 18 aa, Giardia lamblia
MDNVISTGPGLAAVTIDT

SEQ ID NO: 3163846 - protein, 18 aa, Giardia lamblia
MDPNERYIYCGTSEGSVL

SEQ ID NO: 3163847 - protein, 19 aa, Giardia lamblia
MDPRRRPSIEELLTNKHML

SEQ ID NO: 3163848 - protein, 23 aa, Giardia lamblia
MDQLECAQILIPYEVGLTTDNGW

SEQ ID NO: 3163849 - protein, 18 aa, Giardia lamblia
MDSFKGICTTVVGYANAS

SEQ ID NO: 3163850 - protein, 25 aa, Giardia lamblia
MDSTSRPGLSMNISVRQDVKIQGAI

SEQ ID NO: 3163851 - protein, 20 aa, Giardia lamblia
MDTECCFDLPSIPASDRQNS

SEQ ID NO: 3163852 - protein, 17 aa, Giardia lamblia
MDVISRLLPLCAPSTSG

SEQ ID NO: 3163853 - protein, 22 aa, Giardia lamblia
MDVTRRLFGVFYVRQAANKLLH

SEQ ID NO: 3163854 - protein, 18 aa, Giardia lamblia
MEAAFRLYLGISSVDDHR

SEQ ID NO: 3163855 - protein, 17 aa, Giardia lamblia
MEAARWGRPECLQELLG

SEQ ID NO: 3163856 - protein, 23 aa, Giardia lamblia
MEAEFNRLQAIDFNEKRKDIEQM

SEQ ID NO: 3163857 - protein, 20 aa, Giardia lamblia
MEALHARGIFLCHRAVSDGN

SEQ ID NO: 3163858 - protein, 26 aa, Giardia lamblia
MECCKNGYSEMICHLISEAGMQTGND

SEQ ID NO: 3163859 - protein, 18 aa, Giardia lamblia
MECPPALIDTSSREAHAA

SEQ ID NO: 3163860 - protein, 24 aa, Giardia lamblia
MEDAKRAIACLLFGGTNKYTQELI

SEQ ID NO: 3163861 - protein, 23 aa, Giardia lamblia
MEDNCGRTALMSAAENNHPQCVE

SEQ ID NO: 3163862 - protein, 18 aa, Giardia lamblia
MEEARTALEGVLTAPELS

SEQ ID NO: 3163863 - protein, 18 aa, Giardia lamblia
MEEGVLLACAGYSSVLGY

SEQ ID NO: 3163864 - protein, 19 aa, Giardia lamblia
MEELMALRELMLDKGTNTD

SEQ ID NO: 3163865 - protein, 18 aa, Giardia lamblia
MEFCDKGDLSDLIKHYRR

SEQ ID NO: 3163866 - protein, 20 aa, Giardia lamblia
MEFCEGGELSEFIRMHKNKR

SEQ ID NO: 3163867 - protein, 23 aa, Giardia lamblia
MEGLNCPPRAILTGHTGGVICIA

SEQ ID NO: 3163868 - protein, 22 aa, Giardia lamblia
MEHLLRNRGYEYLTEQNELAQK

SEQ ID NO: 3163869 - protein, 19 aa, Giardia lamblia
MEHRNFVPGVARLLGTAVR

SEQ ID NO: 3163870 - protein, 17 aa, Giardia lamblia
MEIESLLAMSTSKANDM

SEQ ID NO: 3163871 - protein, 20 aa, Giardia lamblia
MEITRSCFPNSEFASLNSVE

SEQ ID NO: 3163872 - protein, 17 aa, Giardia lamblia
MELCNGGSLQDVIKKMR

SEQ ID NO: 3163873 - protein, 24 aa, Giardia lamblia
MELIKRIPAALVIEMEGGAVGQVC

SEQ ID NO: 3163874 - protein, 19 aa, Giardia lamblia
MELNRKLIFMRDHPILARI

SEQ ID NO: 3163875 - protein, 25 aa, Giardia lamblia
MELPRRDCADLLLSSKKERMISRVT

SEQ ID NO: 3163876 - protein, 17 aa, Giardia lamblia
MELRGATALVGLFSTCI

SEQ ID NO: 3163877 - protein, 21 aa, Giardia lamblia
MELSIGWSMCLTNALTMLSST

SEQ ID NO: 3163878 - protein, 24 aa, Giardia lamblia
MELVDCAFPLLSGFTLTSDNAEAF

SEQ ID NO: 3163879 - protein, 20 aa, Giardia lamblia
MELYKRIKYSDGDTVIHKVR

SEQ ID NO: 3163880 - protein, 18 aa, Giardia lamblia
MEMTFKSDLTVAVEYLKD

SEQ ID NO: 3163881 - protein, 25 aa, Giardia lamblia
MEQLSRSAALLAWKSIKETNAGKEM

SEQ ID NO: 3163882 - protein, 25 aa, Giardia lamblia
MEQYAATCKLILMAESISGLIPPIV

SEQ ID NO: 3163883 - protein, 17 aa, Giardia lamblia
MERVTALLVSGEQKVEK

SEQ ID NO: 3163884 - protein, 17 aa, Giardia lamblia
MESCLRSLFRNRPEMRE

SEQ ID NO: 3163885 - protein, 18 aa, Giardia lamblia
MESIGMCTGSGLNTSNTS

SEQ ID NO: 3163886 - protein, 18 aa, Giardia lamblia
MESVCYRYDNSVRNDSNE

SEQ ID NO: 3163887 - protein, 23 aa, Giardia lamblia
METILHLSKSVPRDSSVDIPCPV

SEQ ID NO: 3163888 - protein, 30 aa, Giardia lamblia
METKEWRKLLGQRPVLRMAPASLKDKSTCE

SEQ ID NO: 3163889 - protein, 20 aa, Giardia lamblia
METSCERLRAANKDLIEQLT

SEQ ID NO: 3163890 - protein, 25 aa, Giardia lamblia
MEYMIDNCRAFFDSLMIPYRVVIIV

SEQ ID NO: 3163891 - protein, 19 aa, Giardia lamblia
MFAALRPIYSMVASNRDAL

SEQ ID NO: 3163892 - protein, 18 aa, Giardia lamblia
MFCKFQLRLTLTGVTNDN

SEQ ID NO: 3163893 - protein, 17 aa, Giardia lamblia
MFLERLRDIPAEDMLDW

SEQ ID NO: 3163894 - protein, 17 aa, Giardia lamblia
MFLLRLNKLGANVLPQY

SEQ ID NO: 3163895 - protein, 23 aa, Giardia lamblia
MFNSVPYFLSIAIPVTPLPGTCE

SEQ ID NO: 3163896 - protein, 23 aa, Giardia lamblia
MFPAYTYPRLRSFSCFKGHFGTA

SEQ ID NO: 3163897 - protein, 26 aa, Giardia lamblia
MFQQINARHGFTFDLQFSALEIYNER

SEQ ID NO: 3163898 - protein, 23 aa, Giardia lamblia
MFQREYTRLQGLMVVENKQRKTL

SEQ ID NO: 3163899 - protein, 19 aa, Giardia lamblia
MFSCTSVIGLLPTVSKIHV

SEQ ID NO: 3163900 - protein, 26 aa, Giardia lamblia
MGAIKRLFAPFFGLRHIKDIISEMLL

SEQ ID NO: 3163901 - protein, 21 aa, Giardia lamblia
MGALCGLADSIIYSEVSGAMF

SEQ ID NO: 3163902 - protein, 28 aa, Giardia lamblia
MGASIPCPRRFFIHGWWTINHQKIGKSL

SEQ ID NO: 3163903 - protein, 17 aa, Giardia lamblia
MGEESRFFKALASSEAP

SEQ ID NO: 3163904 - protein, 23 aa, Giardia lamblia
MGEEYAIQIALAFFETDDFPRIF

SEQ ID NO: 3163905 - protein, 17 aa, Giardia lamblia
MGGGIAASISSRFPAAL

SEQ ID NO: 3163906 - protein, 24 aa, Giardia lamblia
MGHALCVKELIAREAKMFERTGSA

SEQ ID NO: 3163907 - protein, 20 aa, Giardia lamblia
MGHYACIMGWTGIENLEEML

SEQ ID NO: 3163908 - protein, 25 aa, Giardia lamblia
MGLGKTVMVLFFLRCIIKHPHPVMR

SEQ ID NO: 3163909 - protein, 20 aa, Giardia lamblia
MGLNMMSLIKPFPVDAPVFG

SEQ ID NO: 3163910 - protein, 20 aa, Giardia lamblia
MGLNQPRGAMEITKELGLQS

SEQ ID NO: 3163911 - protein, 21 aa, Giardia lamblia
MGLYLRVRNPVCAEIGACRFF

SEQ ID NO: 3163912 - protein, 19 aa, Giardia lamblia
MGMDCMAVNPYSFLLTPFS

SEQ ID NO: 3163913 - protein, 19 aa, Giardia lamblia
MGMSSDYQLAVKMGADYVR

SEQ ID NO: 3163914 - protein, 23 aa, Giardia lamblia
MGMTIVFDVHALQSFYRLKSYKD

SEQ ID NO: 3163915 - protein, 24 aa, Giardia lamblia
MGNVRAVQHLSRFEAGHADHHGRT

SEQ ID NO: 3163916 - protein, 21 aa, Giardia lamblia
MGNVRMVTWYYSPFPPPYTHL

SEQ ID NO: 3163917 - protein, 18 aa, Giardia lamblia
MGPMPMPSVPTITACQRR

SEQ ID NO: 3163918 - protein, 17 aa, Giardia lamblia
MGPRKSASWMYLSRLAA

SEQ ID NO: 3163919 - protein, 24 aa, Giardia lamblia
MGPRLACPRLSRTLLPEDVQNMDI

SEQ ID NO: 3163920 - protein, 18 aa, Giardia lamblia
MGPYDYCALCQKKYERAR

SEQ ID NO: 3163921 - protein, 25 aa, Giardia lamblia
MGQTAKLYLDICFDNYFLMTQPTSR

SEQ ID NO: 3163922 - protein, 21 aa, Giardia lamblia
MGRKTARACGLEGHIDTRYAG

SEQ ID NO: 3163923 - protein, 40 aa, Giardia lamblia
MGSGANMGMGMGMQRPMGMPRPAGAIPMPANPMQRMQQPP

SEQ ID NO: 3163924 - protein, 17 aa, Giardia lamblia
MGSIRFKTFDLGGHEVA

SEQ ID NO: 3163925 - protein, 24 aa, Giardia lamblia
MGSLEKYYSLGPLLVKIEELSFGT

SEQ ID NO: 3163926 - protein, 24 aa, Giardia lamblia
MGSPCGQGACSVIYTLDALPGEVL

SEQ ID NO: 3163927 - protein, 17 aa, Giardia lamblia
MGSSGLLDATRTKPTLK

SEQ ID NO: 3163928 - protein, 18 aa, Giardia lamblia
MGSVRGYSRVKLRVPIPI

SEQ ID NO: 3163929 - protein, 23 aa, Giardia lamblia
MGTSAWYGSCSTWYSSLVEPTID

SEQ ID NO: 3163930 - protein, 26 aa, Giardia lamblia
MGTTGLCKAAAAGDLEMVKILFESEK

SEQ ID NO: 3163931 - protein, 25 aa, Giardia lamblia
MGTVFRAALFISNSFQALGFCPFSP

SEQ ID NO: 3163932 - protein, 22 aa, Giardia lamblia
MGTVIYPNRFNIFYDTLDHIIG

SEQ ID NO: 3163933 - protein, 25 aa, Giardia lamblia
MGTVYHCMACSYFITQQADSDKLAL

SEQ ID NO: 3163934 - protein, 23 aa, Giardia lamblia
MGVDPENKCFRMYEELIEGNPIQ

SEQ ID NO: 3163935 - protein, 17 aa, Giardia lamblia
MGVTTYLLLGGVLPYEE

SEQ ID NO: 3163936 - protein, 25 aa, Giardia lamblia
MGWDDPRLLTLDGLRRRGYTPSSIN

SEQ ID NO: 3163937 - protein, 21 aa, Giardia lamblia
MGWTALMFAALWGHVETISCL

SEQ ID NO: 3163938 - protein, 43 aa, Giardia lamblia
MHAQLCPAKHSFPRVASHFVFRLKNFAFIYAMESASLHLSQLK

SEQ ID NO: 3163939 - protein, 19 aa, Giardia lamblia
MHARMDAVSGCVCICSDDY

SEQ ID NO: 3163940 - protein, 19 aa, Giardia lamblia
MHASLQLANLRACDKQFSA

SEQ ID NO: 3163941 - protein, 20 aa, Giardia lamblia
MHATRFDWSKAIPPTAFSNR

SEQ ID NO: 3163942 - protein, 35 aa, Giardia lamblia
MHCLSLCETMRMAAEMGLGVPYLVSGSLELVLESL

SEQ ID NO: 3163943 - protein, 21 aa, Giardia lamblia
MHDKYGWTALIWAIDNNNIEC

SEQ ID NO: 3163944 - protein, 22 aa, Giardia lamblia
MHDVLKLFILRREKKDVESLPA

SEQ ID NO: 3163945 - protein, 28 aa, Giardia lamblia
MHELEFFKEKFLLLQQLDAVWLELAIRI

SEQ ID NO: 3163946 - protein, 24 aa, Giardia lamblia
MHERWLRKQMRAVEKLIEKENREI

SEQ ID NO: 3163947 - protein, 26 aa, Giardia lamblia
MHGHPECVELLYAREILIQDNKGNKA

SEQ ID NO: 3163948 - protein, 18 aa, Giardia lamblia
MHGKKVALAECIVTAAAK

SEQ ID NO: 3163949 - protein, 20 aa, Giardia lamblia
MHGNARFTLNLKELRNVSPE

SEQ ID NO: 3163950 - protein, 28 aa, Giardia lamblia
MHGSRFESCVLCVVVLNVDMCQKELGHA

SEQ ID NO: 3163951 - protein, 20 aa, Giardia lamblia
MHHVLRWLSHMKSFSQAERA

SEQ ID NO: 3163952 - protein, 23 aa, Giardia lamblia
MHILTDFIVVFWAKKSKKMGSMC

SEQ ID NO: 3163953 - protein, 17 aa, Giardia lamblia
MHLACLSGRLNVVQLLV

SEQ ID NO: 3163954 - protein, 22 aa, Giardia lamblia
MHLKSPVMPAGRSITDSLIMSL

SEQ ID NO: 3163955 - protein, 17 aa, Giardia lamblia
MHLLCEANLLRKGGLTA

SEQ ID NO: 3163956 - protein, 19 aa, Giardia lamblia
MHRDFKLFFTLSDSKAKLS

SEQ ID NO: 3163957 - protein, 31 aa, Giardia lamblia
MHSDMIGKCACKWNTEEIAFFINTQELAMGT

SEQ ID NO: 3163958 - protein, 17 aa, Giardia lamblia
MHTKLAIKNSLETARLE

SEQ ID NO: 3163959 - protein, 26 aa, Giardia lamblia
MHTLPMKRVNLIAGELRLLQHKIGVA

SEQ ID NO: 3163960 - protein, 18 aa, Giardia lamblia
MHTYQWWYPLNLSTMRAQ

SEQ ID NO: 3163961 - protein, 21 aa, Giardia lamblia
MHWFVRLQALIYINDHLTKDD

SEQ ID NO: 3163962 - protein, 25 aa, Giardia lamblia
MHYHGAATIVQWLRFHLKRKNARLE

SEQ ID NO: 3163963 - protein, 23 aa, Giardia lamblia
MIAAECGHGGYVKKLLDKERGMS

SEQ ID NO: 3163964 - protein, 22 aa, Giardia lamblia
MIAAECGWVDIVRTLMPREARL

SEQ ID NO: 3163965 - protein, 19 aa, Giardia lamblia
MIAAHKGYFTIAKLLHNHE

SEQ ID NO: 3163966 - protein, 27 aa, Giardia lamblia
MIAANFNFAPACSILYESESTFYQSDG

SEQ ID NO: 3163967 - protein, 26 aa, Giardia lamblia
MIALCYMSVCPMENLQMLIESPVADV

SEQ ID NO: 3163968 - protein, 20 aa, Giardia lamblia
MIASRLGWTELVDMARHKEA

SEQ ID NO: 3163969 - protein, 19 aa, Giardia lamblia
MIDAACGKISEPLTPAQLV

SEQ ID NO: 3163970 - protein, 21 aa, Giardia lamblia
MIDAAFPWLLHEFSLEHVQYF

SEQ ID NO: 3163971 - protein, 26 aa, Giardia lamblia
MIDSLFKPWLIEVNHSPSFTCDTPLD

SEQ ID NO: 3163972 - protein, 30 aa, Giardia lamblia
MIDTSALSGLRLTPFNNLILISITYQRGHQ

SEQ ID NO: 3163973 - protein, 19 aa, Giardia lamblia
MIECGGFGKVFKCKENTTG

SEQ ID NO: 3163974 - protein, 23 aa, Giardia lamblia
MIFAIVAGCDVHFYTTQDFSCIA

SEQ ID NO: 3163975 - protein, 17 aa, Giardia lamblia
MIFEHINMLYLQNLEDF

SEQ ID NO: 3163976 - protein, 24 aa, Giardia lamblia
MIGDKPWLDLLLERDPQYFCYHQT

SEQ ID NO: 3163977 - protein, 18 aa, Giardia lamblia
MIGFPGFVGFPQTPDEDF

SEQ ID NO: 3163978 - protein, 24 aa, Giardia lamblia
MIHRLKHITLVWAAKFGSAGTKNF

SEQ ID NO: 3163979 - protein, 19 aa, Giardia lamblia
MIIDHGSFLGGPYSLTTIT

SEQ ID NO: 3163980 - protein, 27 aa, Giardia lamblia
MIILKEWKRVWYLGGHGGVLIEIATPY

SEQ ID NO: 3163981 - protein, 21 aa, Giardia lamblia
MIKALENRLAQFGDRMNTAGP

SEQ ID NO: 3163982 - protein, 19 aa, Giardia lamblia
MIKMIGRLLAITADIRDQL

SEQ ID NO: 3163983 - protein, 23 aa, Giardia lamblia
MIKQLKSIWSIASAWNNYYSSVK

SEQ ID NO: 3163984 - protein, 27 aa, Giardia lamblia
MILILREWRYALLLRRMERVTASRHNQ

SEQ ID NO: 3163985 - protein, 17 aa, Giardia lamblia
MINAGPPAFLFNNSPAA

SEQ ID NO: 3163986 - protein, 17 aa, Giardia lamblia
MINLCLNQNIKTRVTLD

SEQ ID NO: 3163987 - protein, 18 aa, Giardia lamblia
MIQSYCGVVQDITDGVIS

SEQ ID NO: 3163988 - protein, 33 aa, Giardia lamblia
MIRNALTHWRLICYKKRYMRVFEDAHDAVAKVR

SEQ ID NO: 3163989 - protein, 19 aa, Giardia lamblia
MIRQSRPASPMSVTQQEGE

SEQ ID NO: 3163990 - protein, 17 aa, Giardia lamblia
MIRRRQVVLATQILVSW

SEQ ID NO: 3163991 - protein, 28 aa, Giardia lamblia
MISANVGFKYGVSLLLNEELSLRDRNGY

SEQ ID NO: 3163992 - protein, 22 aa, Giardia lamblia
MISSAIHRLMKTGSRVESTEFE

SEQ ID NO: 3163993 - protein, 28 aa, Giardia lamblia
MIVTCLCLRVSGKLNRSWKSRPTATSDQ

SEQ ID NO: 3163994 - protein, 24 aa, Giardia lamblia
MIYNEFIHLLVVYHMTRFRRLLST

SEQ ID NO: 3163995 - protein, 18 aa, Giardia lamblia
MKALDMRGVLQPEEGIAD

SEQ ID NO: 3163996 - protein, 19 aa, Giardia lamblia
MKANIGIMLDYYSILDDLF

SEQ ID NO: 3163997 - protein, 18 aa, Giardia lamblia
MKDECGKTALMRAAQGNN

SEQ ID NO: 3163998 - protein, 17 aa, Giardia lamblia
MKDERIVALEKELGSFK

SEQ ID NO: 3163999 - protein, 25 aa, Giardia lamblia
MKDFGGISLFFARHQPLPAMVNQIR

SEQ ID NO: 3164000 - protein, 29 aa, Giardia lamblia
MKDGRTALMSACFAGRFYAVKRLVEKEFH

SEQ ID NO: 3164001 - protein, 19 aa, Giardia lamblia
MKDIMSAAIANTAHLAPSD

SEQ ID NO: 3164002 - protein, 22 aa, Giardia lamblia
MKEKRLKVTMNAVRYPRQSAYQ

SEQ ID NO: 3164003 - protein, 25 aa, Giardia lamblia
MKENTRLRLSLSEMQSQIGHILLKN

SEQ ID NO: 3164004 - protein, 21 aa, Giardia lamblia
MKGFPNVAVAFRLDVDALASV

SEQ ID NO: 3164005 - protein, 19 aa, Giardia lamblia
MKGIRCALCSTEYDAEMAR

SEQ ID NO: 3164006 - protein, 20 aa, Giardia lamblia
MKGKRQKAASVKRITDTLDA

SEQ ID NO: 3164007 - protein, 26 aa, Giardia lamblia
MKGVPVLFMKAQRTVLFLPINERAHK

SEQ ID NO: 3164008 - protein, 19 aa, Giardia lamblia
MKIDLPWDRPASKAPIPSR

SEQ ID NO: 3164009 - protein, 17 aa, Giardia lamblia
MKILRYENMRLILQEMS

SEQ ID NO: 3164010 - protein, 19 aa, Giardia lamblia
MKKIIALEAGYFGTSSNHS

SEQ ID NO: 3164011 - protein, 21 aa, Giardia lamblia
MKKTCMLEKCISRMDGEVPVI

SEQ ID NO: 3164012 - protein, 21 aa, Giardia lamblia
MKLQITEFYQTLLLPSVQRLY

SEQ ID NO: 3164013 - protein, 17 aa, Giardia lamblia
MKMGPFAGQCVKDCKQS

SEQ ID NO: 3164014 - protein, 25 aa, Giardia lamblia
MKMRDGNALLAFKLTQLCCDLYSKH

SEQ ID NO: 3164015 - protein, 26 aa, Giardia lamblia
MKNLIARDCFPLIVFAFGKKKCETYA

SEQ ID NO: 3164016 - protein, 17 aa, Giardia lamblia
MKPKVRFSTDVEDPEGH

SEQ ID NO: 3164017 - protein, 27 aa, Giardia lamblia
MKQATELPVPKRRSVSMETEKVATNDV

SEQ ID NO: 3164018 - protein, 18 aa, Giardia lamblia
MKQLESLIHGKLQEYPAA

SEQ ID NO: 3164019 - protein, 20 aa, Giardia lamblia
MKQNVLLRELVKSFEEQLSS

SEQ ID NO: 3164020 - protein, 25 aa, Giardia lamblia
MKRALRCFGEGLGNNITSDSATSRG

SEQ ID NO: 3164021 - protein, 21 aa, Giardia lamblia
MKREYEELVGGLRRQIDGLNA

SEQ ID NO: 3164022 - protein, 22 aa, Giardia lamblia
MKRISACSGARIISAVSDLTDS

SEQ ID NO: 3164023 - protein, 21 aa, Giardia lamblia
MKRLIDFKISNSITFVESISD

SEQ ID NO: 3164024 - protein, 22 aa, Giardia lamblia
MKRPCSSSLIADRDRLYGDMTN

SEQ ID NO: 3164025 - protein, 17 aa, Giardia lamblia
MKRVLQLQASPDRVAGK

SEQ ID NO: 3164026 - protein, 17 aa, Giardia lamblia
MKSAIGYQSNEVGRDLI

SEQ ID NO: 3164027 - protein, 18 aa, Giardia lamblia
MKSKVCVDTPTANRVVIF

SEQ ID NO: 3164028 - protein, 23 aa, Giardia lamblia
MKSLGPWLKDMIQRCDQLVSWSS

SEQ ID NO: 3164029 - protein, 25 aa, Giardia lamblia
MKSPSEYRFTLSIVKEQPEFRYTVQ

SEQ ID NO: 3164030 - protein, 26 aa, Giardia lamblia
MKTRNGSTALCFAAVLGYRDIAEILL

SEQ ID NO: 3164031 - protein, 26 aa, Giardia lamblia
MKVDFLRKGLTDFFWDSEEGQAYLTG

SEQ ID NO: 3164032 - protein, 20 aa, Giardia lamblia
MKVLECLKGLSNTFTLLGTC

SEQ ID NO: 3164033 - protein, 17 aa, Giardia lamblia
MKVTLCNPFYLNRSLAG

SEQ ID NO: 3164034 - protein, 17 aa, Giardia lamblia
MKYGAFVKPLSVEVGDF

SEQ ID NO: 3164035 - protein, 19 aa, Giardia lamblia
MKYLVLDEADRLLCGDPEF

SEQ ID NO: 3164036 - protein, 25 aa, Giardia lamblia
MKYSLEMRKQLAGKFDYSEQIDKLR

SEQ ID NO: 3164037 - protein, 20 aa, Giardia lamblia
MKYSNGVLLSADTRATMGNL

SEQ ID NO: 3164038 - protein, 25 aa, Giardia lamblia
MLAAERGYDKCVEMLLSEAKLTTQT

SEQ ID NO: 3164039 - protein, 29 aa, Giardia lamblia
MLAAKRGSLEIVELLAPKESGMLNSEGHT

SEQ ID NO: 3164040 - protein, 18 aa, Giardia lamblia
MLAAKRGYTEIVEILAPH

SEQ ID NO: 3164041 - protein, 18 aa, Giardia lamblia
MLAANGIFALRRVKRRNM

SEQ ID NO: 3164042 - protein, 24 aa, Giardia lamblia
MLAAWKGNILIAGHLLTELGMQTE

SEQ ID NO: 3164043 - protein, 29 aa, Giardia lamblia
MLAFKRVGKLKVPMFLEFAMMQNTVDQIK

SEQ ID NO: 3164044 - protein, 27 aa, Giardia lamblia
MLAITCNFPEAIPLLMNVEAGMKKDNG

SEQ ID NO: 3164045 - protein, 23 aa, Giardia lamblia
MLAPSEYPCYTHVYKVQTDEPPL

SEQ ID NO: 3164046 - protein, 19 aa, Giardia lamblia
MLASICWSFTGSKEDTVVC

SEQ ID NO: 3164047 - protein, 17 aa, Giardia lamblia
MLATCFNTACDHVLTYL

SEQ ID NO: 3164048 - protein, 17 aa, Giardia lamblia
MLCKDFLNQYVIDQDSG

SEQ ID NO: 3164049 - protein, 25 aa, Giardia lamblia
MLCPSLPLRYLFSVNSIFPELGYGC

SEQ ID NO: 3164050 - protein, 18 aa, Giardia lamblia
MLDKRATVAQLYLQTFPS

SEQ ID NO: 3164051 - protein, 21 aa, Giardia lamblia
MLDRHTGSAFIIFKKRGAALC

SEQ ID NO: 3164052 - protein, 23 aa, Giardia lamblia
MLECRDLKANLSRERDRTKAMEQ

SEQ ID NO: 3164053 - protein, 18 aa, Giardia lamblia
MLEDCSYGSLLRTKDLEI

SEQ ID NO: 3164054 - protein, 18 aa, Giardia lamblia
MLEDLMIISSYSMDLLPP

SEQ ID NO: 3164055 - protein, 24 aa, Giardia lamblia
MLEIALDLDKGYKMYFKDEDTPIQ

SEQ ID NO: 3164056 - protein, 18 aa, Giardia lamblia
MLEKVPLADTWRAMEQLV

SEQ ID NO: 3164057 - protein, 26 aa, Giardia lamblia
MLEREEDLRLAAMLRQKEIEERKKEE

SEQ ID NO: 3164058 - protein, 18 aa, Giardia lamblia
MLFRRLGRETFFDLLNPN

SEQ ID NO: 3164059 - protein, 17 aa, Giardia lamblia
MLFVPRYSPEHALWLGE

SEQ ID NO: 3164060 - protein, 30 aa, Giardia lamblia
MLHVSLAVLCRLNYSFGFVLLPYTTQALNA

SEQ ID NO: 3164061 - protein, 23 aa, Giardia lamblia
MLIHINAAIPHCIDALRNSLSNS

SEQ ID NO: 3164062 - protein, 21 aa, Giardia lamblia
MLITMLDFIHSLQFQYVTILT

SEQ ID NO: 3164063 - protein, 25 aa, Giardia lamblia
MLKAKGISLPPSLIKDAAANIRRQQ

SEQ ID NO: 3164064 - protein, 20 aa, Giardia lamblia
MLKLLERAFTPLTDFGSQSM

SEQ ID NO: 3164065 - protein, 22 aa, Giardia lamblia
MLKVKDMGRRLLVSVPDSSQLI

SEQ ID NO: 3164066 - protein, 19 aa, Giardia lamblia
MLLANRLAAEYTLEKYPSI

SEQ ID NO: 3164067 - protein, 19 aa, Giardia lamblia
MLLEPCMTTPCLTFQSYTE

SEQ ID NO: 3164068 - protein, 23 aa, Giardia lamblia
MLLEYWNHVCLFIQKADNLEKER

SEQ ID NO: 3164069 - protein, 21 aa, Giardia lamblia
MLLIDNCKAYIFACQTEGRQV

SEQ ID NO: 3164070 - protein, 22 aa, Giardia lamblia
MLLKRVRHMQILYPSGSTKPVF

SEQ ID NO: 3164071 - protein, 17 aa, Giardia lamblia
MLLLHSVPGCGKTSIAT

SEQ ID NO: 3164072 - protein, 17 aa, Giardia lamblia
MLMQTCFQIGLNQHCPP

SEQ ID NO: 3164073 - protein, 27 aa, Giardia lamblia
MLNARACKLAWDVANCERVQKRQRDRE

SEQ ID NO: 3164074 - protein, 19 aa, Giardia lamblia
MLNFLSRCSSYFANPQLFF

SEQ ID NO: 3164075 - protein, 24 aa, Giardia lamblia
MLNKYRFLLDIDRIIKEVHTRYKI

SEQ ID NO: 3164076 - protein, 23 aa, Giardia lamblia
MLNSYALRVMTTFILTNSPELVH

SEQ ID NO: 3164077 - protein, 24 aa, Giardia lamblia
MLPISQLRASFGFSNDANVGYAAF

SEQ ID NO: 3164078 - protein, 19 aa, Giardia lamblia
MLPQLVHRPILLSVFMRCC

SEQ ID NO: 3164079 - protein, 22 aa, Giardia lamblia
MLPSCAESLVLLNTALDAASYL

SEQ ID NO: 3164080 - protein, 19 aa, Giardia lamblia
MLPTPAKFHYIFNLRDLSR

SEQ ID NO: 3164081 - protein, 24 aa, Giardia lamblia
MLQLPQAGSFQGLMLTPRMNSIAN

SEQ ID NO: 3164082 - protein, 26 aa, Giardia lamblia
MLRGEMPRNWLLAMHRVLETFAECSS

SEQ ID NO: 3164083 - protein, 20 aa, Giardia lamblia
MLRYKCGALETTLNSANARI

SEQ ID NO: 3164084 - protein, 25 aa, Giardia lamblia
MLSEIRRTMWSSSLPIIGRTTAAGR

SEQ ID NO: 3164085 - protein, 26 aa, Giardia lamblia
MLSPERPPFRPVRNRANVIMFVGLQG

SEQ ID NO: 3164086 - protein, 26 aa, Giardia lamblia
MLVQRASPIILSIYIDFHQRAGRPLD

SEQ ID NO: 3164087 - protein, 23 aa, Giardia lamblia
MLYKRTASIIAIAVLTYPLQLRR

SEQ ID NO: 3164088 - protein, 26 aa, Giardia lamblia
MMAAKRLSLAVVRILAPFECGEVHSI

SEQ ID NO: 3164089 - protein, 18 aa, Giardia lamblia
MMAKEGKMQESIVSSVTM

SEQ ID NO: 3164090 - protein, 27 aa, Giardia lamblia
MMDCFYEYICPVVSLSFHLTKEEETAS

SEQ ID NO: 3164091 - protein, 19 aa, Giardia lamblia
MMDHMNDFFGSTRSIFGNM

SEQ ID NO: 3164092 - protein, 19 aa, Giardia lamblia
MMFSEKMKAVFLGDYVDRG

SEQ ID NO: 3164093 - protein, 30 aa, Giardia lamblia
MMPEYLRLLPSRALKCYLMQKSDRLMRDFS

SEQ ID NO: 3164094 - protein, 19 aa, Giardia lamblia
MMQKHVLGLEYEQEQILNN

SEQ ID NO: 3164095 - protein, 19 aa, Giardia lamblia
MMRKAPCSVDRTQTLRTAA

SEQ ID NO: 3164096 - protein, 20 aa, Giardia lamblia
MMVLFKRAAPGVSEQMLQDM

SEQ ID NO: 3164097 - protein, 18 aa, Giardia lamblia
MNAIKALLDAAGRHKTFR

SEQ ID NO: 3164098 - protein, 24 aa, Giardia lamblia
MNATKFMLEQGVPMGVMVSSPTST

SEQ ID NO: 3164099 - protein, 22 aa, Giardia lamblia
MNDFKDAFIALAEARNIQMSAG

SEQ ID NO: 3164100 - protein, 17 aa, Giardia lamblia
MNFSVSTKKEWFASILA

SEQ ID NO: 3164101 - protein, 23 aa, Giardia lamblia
MNGHPEVCKILLGAEHGSCDKDG

SEQ ID NO: 3164102 - protein, 27 aa, Giardia lamblia
MNIAGKLPNLFGAIIFFYHGQLFVAGG

SEQ ID NO: 3164103 - protein, 17 aa, Giardia lamblia
MNIKLGSSKHETALQAE

SEQ ID NO: 3164104 - protein, 25 aa, Giardia lamblia
MNIPNLADFLILFLKRYADLARSKE

SEQ ID NO: 3164105 - protein, 17 aa, Giardia lamblia
MNLRLVSPQGVIKEIKR

SEQ ID NO: 3164106 - protein, 26 aa, Giardia lamblia
MNMERWKRKPDALGNYALHIAAQANN

SEQ ID NO: 3164107 - protein, 19 aa, Giardia lamblia
MNMQLAKSFEVVGGIISKS

SEQ ID NO: 3164108 - protein, 24 aa, Giardia lamblia
MNNICKRCMVQIGYAIGVAEPVSI

SEQ ID NO: 3164109 - protein, 18 aa, Giardia lamblia
MNNIVVFAFLSRAGVLTI

SEQ ID NO: 3164110 - protein, 21 aa, Giardia lamblia
MNNLAAVYLLAPRLSNIRDQN

SEQ ID NO: 3164111 - protein, 18 aa, Giardia lamblia
MNPFHFRNDFHILHISSL

SEQ ID NO: 3164112 - protein, 22 aa, Giardia lamblia
MNPNYCEPRLLLVNDPVVDRQA

SEQ ID NO: 3164113 - protein, 21 aa, Giardia lamblia
MNPYHLAARLGKARAMDALSI

SEQ ID NO: 3164114 - protein, 18 aa, Giardia lamblia
MNQALSHQIAMFKYNKDD

SEQ ID NO: 3164115 - protein, 26 aa, Giardia lamblia
MNRGTLPYRDFCSALASALTDSGRSN

SEQ ID NO: 3164116 - protein, 24 aa, Giardia lamblia
MNRRAEIDQALGFTASVTTKSFTE

SEQ ID NO: 3164117 - protein, 19 aa, Giardia lamblia
MNSCMLCTIYQETLFLQAL

SEQ ID NO: 3164118 - protein, 17 aa, Giardia lamblia
MNSHPVVTFGSTGGASI

SEQ ID NO: 3164119 - protein, 19 aa, Giardia lamblia
MNSPPRRQGPAAAPLNVHV

SEQ ID NO: 3164120 - protein, 24 aa, Giardia lamblia
MNVSLEVPTRVLLRKDAIAKPASK

SEQ ID NO: 3164121 - protein, 17 aa, Giardia lamblia
MNWDALEALYILVSNPL

SEQ ID NO: 3164122 - protein, 17 aa, Giardia lamblia
MNYKASEVFLDSKRLAS

SEQ ID NO: 3164123 - protein, 24 aa, Giardia lamblia
MNYPALCITAGFKSQAIKDANPGL

SEQ ID NO: 3164124 - protein, 19 aa, Giardia lamblia
MPADILAEVAEIFVRKYDA

SEQ ID NO: 3164125 - protein, 18 aa, Giardia lamblia
MPAHARALHSVWDDVSAV

SEQ ID NO: 3164126 - protein, 21 aa, Giardia lamblia
MPALLSFFDRFCALIMENLTG

SEQ ID NO: 3164127 - protein, 23 aa, Giardia lamblia
MPAQEIQDIIAYKYIFGNASMLK

SEQ ID NO: 3164128 - protein, 24 aa, Giardia lamblia
MPAQLSLTVSPLWTEREVATSSFV

SEQ ID NO: 3164129 - protein, 17 aa, Giardia lamblia
MPAVVRAAGAVHWEQPS

SEQ ID NO: 3164130 - protein, 23 aa, Giardia lamblia
MPDDWYGTKVCYTKLYGRELVRE

SEQ ID NO: 3164131 - protein, 19 aa, Giardia lamblia
MPDICEICSTNTVEEYVIY

SEQ ID NO: 3164132 - protein, 18 aa, Giardia lamblia
MPDMANDLVDWLFKRKYM

SEQ ID NO: 3164133 - protein, 21 aa, Giardia lamblia
MPDNIKDIIAYYGSEAGNADA

SEQ ID NO: 3164134 - protein, 29 aa, Giardia lamblia
MPDNSKCKMCGSVGTLVRHISFVDCPGHD

SEQ ID NO: 3164135 - protein, 17 aa, Giardia lamblia
MPDQFLTSTENALRRTI

SEQ ID NO: 3164136 - protein, 24 aa, Giardia lamblia
MPEDPFAAIVYRLCMIQRARTSER

SEQ ID NO: 3164137 - protein, 22 aa, Giardia lamblia
MPESLKYLLPVEGRMTRRNGRT

SEQ ID NO: 3164138 - protein, 18 aa, Giardia lamblia
MPGKCASVTPFGEPPEFL

SEQ ID NO: 3164139 - protein, 19 aa, Giardia lamblia
MPGRGFTPQDRRPAIKRGK

SEQ ID NO: 3164140 - protein, 18 aa, Giardia lamblia
MPLFEILEYSTLIDSSNV

SEQ ID NO: 3164141 - protein, 20 aa, Giardia lamblia
MPLVQVIGASPWNRRLPNEP

SEQ ID NO: 3164142 - protein, 18 aa, Giardia lamblia
MPMFASLIANGWELCGDA

SEQ ID NO: 3164143 - protein, 19 aa, Giardia lamblia
MPNRSSALASLNLKAFSTA

SEQ ID NO: 3164144 - protein, 23 aa, Giardia lamblia
MPPDMCDDFSDPIVVLFRTKTSR

SEQ ID NO: 3164145 - protein, 27 aa, Giardia lamblia
MPPEASIALVTGCRFLAVRDGPRGKTV

SEQ ID NO: 3164146 - protein, 18 aa, Giardia lamblia
MPPVESLFHHGLLANFRA

SEQ ID NO: 3164147 - protein, 22 aa, Giardia lamblia
MPSDVWQFGVALYSVLIGKHRE

SEQ ID NO: 3164148 - protein, 22 aa, Giardia lamblia
MPSLCLGSAPWCTMHYDEDLSK

SEQ ID NO: 3164149 - protein, 18 aa, Giardia lamblia
MPSMPVVSLKGAAKAGSL

SEQ ID NO: 3164150 - protein, 22 aa, Giardia lamblia
MPTDLLDRLLIIHTDAFTEDQI

SEQ ID NO: 3164151 - protein, 17 aa, Giardia lamblia
MPTKAQRAIDVSRSGVT

SEQ ID NO: 3164152 - protein, 34 aa, Giardia lamblia
MPTLEDLTALFIKREVRFLEGMGATLALGILERS

SEQ ID NO: 3164153 - protein, 22 aa, Giardia lamblia
MPTPTFLVCPDVVKFENVGQIA

SEQ ID NO: 3164154 - protein, 19 aa, Giardia lamblia
MPVQSRRALPESASVTQLQ

SEQ ID NO: 3164155 - protein, 27 aa, Giardia lamblia
MPVSGLFEFSDALKFSIQRRSIPFFTK

SEQ ID NO: 3164156 - protein, 17 aa, Giardia lamblia
MQAAAPQAMCPMHVAGG

SEQ ID NO: 3164157 - protein, 27 aa, Giardia lamblia
MQAFRGCLRPTTFALHRDAAYSIYTSM

SEQ ID NO: 3164158 - protein, 24 aa, Giardia lamblia
MQAGPRAAIAYMRENEKHIEVLMM

SEQ ID NO: 3164159 - protein, 26 aa, Giardia lamblia
MQALNMMGFRFSNAFVEPIWNDKYID

SEQ ID NO: 3164160 - protein, 27 aa, Giardia lamblia
MQAVQLWLLKFLNIHYPLFTHLFTNTF

SEQ ID NO: 3164161 - protein, 24 aa, Giardia lamblia
MQDHLPICAYLGPLEKNVIGANDQ

SEQ ID NO: 3164162 - protein, 21 aa, Giardia lamblia
MQDIFGRTALMLAAESNNSDC

SEQ ID NO: 3164163 - protein, 19 aa, Giardia lamblia
MQDKLGWTALMYAVRSKNT

SEQ ID NO: 3164164 - protein, 18 aa, Giardia lamblia
MQDTEVLRRELERANAAA

SEQ ID NO: 3164165 - protein, 22 aa, Giardia lamblia
MQELLNRTAGYEVLINDLNQQR

SEQ ID NO: 3164166 - protein, 18 aa, Giardia lamblia
MQGFHHPYILPVREVVID

SEQ ID NO: 3164167 - protein, 32 aa, Giardia lamblia
MQGFPLQTIRVWARKYLTSFKKLQHESIRIIH

SEQ ID NO: 3164168 - protein, 19 aa, Giardia lamblia
MQIDFCKGGALGINDGAEV

SEQ ID NO: 3164169 - protein, 19 aa, Giardia lamblia
MQKKDGWTALMLAANNSHA

SEQ ID NO: 3164170 - protein, 17 aa, Giardia lamblia
MQKTTLVTPGLRFLGTR

SEQ ID NO: 3164171 - protein, 30 aa, Giardia lamblia
MQLDIKAYRKFCKQLVILAAEQQKLKQGLT

SEQ ID NO: 3164172 - protein, 17 aa, Giardia lamblia
MQLELKLASLHDESSIV

SEQ ID NO: 3164173 - protein, 19 aa, Giardia lamblia
MQLLKRWAFLEQLDGTLCI

SEQ ID NO: 3164174 - protein, 29 aa, Giardia lamblia
MQLQFASPCIRSSICMRLFDSSLIKLAFN

SEQ ID NO: 3164175 - protein, 22 aa, Giardia lamblia
MQMKSPVPTRVILSAIRQIATA

SEQ ID NO: 3164176 - protein, 19 aa, Giardia lamblia
MQMVFSRISSITIEAGLFV

SEQ ID NO: 3164177 - protein, 26 aa, Giardia lamblia
MQREAEIQRYIGFLRHVEVLKQLREN

SEQ ID NO: 3164178 - protein, 17 aa, Giardia lamblia
MQRHLNFLVFPEMNDNG

SEQ ID NO: 3164179 - protein, 24 aa, Giardia lamblia
MQSEFKVAEFFYRQAARGPMERFA

SEQ ID NO: 3164180 - protein, 17 aa, Giardia lamblia
MQSIVFLCLDKKYRSLK

SEQ ID NO: 3164181 - protein, 17 aa, Giardia lamblia
MQSNGFPNVPVLEAVVI

SEQ ID NO: 3164182 - protein, 20 aa, Giardia lamblia
MQSRMELVVAPSYQDVSLRF

SEQ ID NO: 3164183 - protein, 26 aa, Giardia lamblia
MQSSRAHCIYTIYLKQRSRVDETAPT

SEQ ID NO: 3164184 - protein, 21 aa, Giardia lamblia
MQTRFGTTALMIATRENQVAV

SEQ ID NO: 3164185 - protein, 19 aa, Giardia lamblia
MQTTREWLGFPPGTTALDI

SEQ ID NO: 3164186 - protein, 25 aa, Giardia lamblia
MQTVQGWSALMFAAFSNKPDCVELL

SEQ ID NO: 3164187 - protein, 22 aa, Giardia lamblia
MQVSEIWHRLHASHDVVDHPIS

SEQ ID NO: 3164188 - protein, 20 aa, Giardia lamblia
MQYRPQLIYRAVELLDQAVR

SEQ ID NO: 3164189 - protein, 18 aa, Giardia lamblia
MRAIKSVLVMAGGLRRKY

SEQ ID NO: 3164190 - protein, 25 aa, Giardia lamblia
MRANNGWTCSMSLAAKGRVDLLKKV

SEQ ID NO: 3164191 - protein, 17 aa, Giardia lamblia
MRASRFAVVVTKIDQPG

SEQ ID NO: 3164192 - protein, 25 aa, Giardia lamblia
MRDARGRNALQYAVRAGQPECVKAL

SEQ ID NO: 3164193 - protein, 21 aa, Giardia lamblia
MRDCSGWTALMSAAWNGHLEV

SEQ ID NO: 3164194 - protein, 23 aa, Giardia lamblia
MRDIYGRTALMIAAQNGYVGVVE

SEQ ID NO: 3164195 - protein, 25 aa, Giardia lamblia
MRDRAGRMAFNFAKTEEVRNIISDF

SEQ ID NO: 3164196 - protein, 26 aa, Giardia lamblia
MRDSCGRTALYRAIELGYLGLVQVLG

SEQ ID NO: 3164197 - protein, 19 aa, Giardia lamblia
MRDSFLRFLHASHGPNWKE

SEQ ID NO: 3164198 - protein, 24 aa, Giardia lamblia
MREDFKLSESEFFLRSLNISGGAD

SEQ ID NO: 3164199 - protein, 17 aa, Giardia lamblia
MREGLLVISPELGDYEL

SEQ ID NO: 3164200 - protein, 18 aa, Giardia lamblia
MREGRTMPLSRFTNPPPP

SEQ ID NO: 3164201 - protein, 17 aa, Giardia lamblia
MRERAWVSAHYIPKSRM

SEQ ID NO: 3164202 - protein, 23 aa, Giardia lamblia
MRESFCFWYPVDLRCSGKDLIPN

SEQ ID NO: 3164203 - protein, 17 aa, Giardia lamblia
MRFEAAVQDVAQRGVFR

SEQ ID NO: 3164204 - protein, 24 aa, Giardia lamblia
MRFPTEYYRSLELPVKGGADVTTL

SEQ ID NO: 3164205 - protein, 18 aa, Giardia lamblia
MRFYPWLQDTGGFYVALL

SEQ ID NO: 3164206 - protein, 26 aa, Giardia lamblia
MRGPFPSVTMWKWYKQGSLPNTLRIR

SEQ ID NO: 3164207 - protein, 17 aa, Giardia lamblia
MRHCIVGSPIHTSISVT

SEQ ID NO: 3164208 - protein, 19 aa, Giardia lamblia
MRIDSLISFYEDCKDRIIF

SEQ ID NO: 3164209 - protein, 24 aa, Giardia lamblia
MRIEAELRLGLFQQAREGLEKHIP

SEQ ID NO: 3164210 - protein, 21 aa, Giardia lamblia
MRKGSRWYSLEMAAAVTHAGA

SEQ ID NO: 3164211 - protein, 24 aa, Giardia lamblia
MRKKWKASEPPSLPPPPSSDDTLP

SEQ ID NO: 3164212 - protein, 20 aa, Giardia lamblia
MRKLPRFPSFVGTLNYFQPM

SEQ ID NO: 3164213 - protein, 19 aa, Giardia lamblia
MRKTWMPLVRKIVADEKGD

SEQ ID NO: 3164214 - protein, 17 aa, Giardia lamblia
MRKYFSFEVQILDDKNI

SEQ ID NO: 3164215 - protein, 17 aa, Giardia lamblia
MRLEPRPGQRLISDSRS

SEQ ID NO: 3164216 - protein, 18 aa, Giardia lamblia
MRMGKEYDVWLLSLLPQQ

SEQ ID NO: 3164217 - protein, 17 aa, Giardia lamblia
MRMVRLLLDSEARTTTR

SEQ ID NO: 3164218 - protein, 22 aa, Giardia lamblia
MRNCNGMTALMLAAERDHEAVV

SEQ ID NO: 3164219 - protein, 19 aa, Giardia lamblia
MRNDYRMVHILKQHEAGCC

SEQ ID NO: 3164220 - protein, 18 aa, Giardia lamblia
MRNKADWTALMIAAQANS

SEQ ID NO: 3164221 - protein, 25 aa, Giardia lamblia
MRNKAFYCFSCGGVIESSVLERGLS

SEQ ID NO: 3164222 - protein, 23 aa, Giardia lamblia
MRPDCAWKVPILVDLTVPPAATS

SEQ ID NO: 3164223 - protein, 25 aa, Giardia lamblia
MRPDRACAYSLAMAKGHIHVANLLK

SEQ ID NO: 3164224 - protein, 21 aa, Giardia lamblia
MRPPDVEGCFLALNETVGNIY

SEQ ID NO: 3164225 - protein, 25 aa, Giardia lamblia
MRQGHSSIFLPSWINLANSTAAMAA

SEQ ID NO: 3164226 - protein, 18 aa, Giardia lamblia
MRQIISFKMKLPDPRLTE

SEQ ID NO: 3164227 - protein, 18 aa, Giardia lamblia
MRQSCDFVYVSSAISASA

SEQ ID NO: 3164228 - protein, 27 aa, Giardia lamblia
MRRDRMLKRRTEIMIDRDMKQNVLLRE

SEQ ID NO: 3164229 - protein, 20 aa, Giardia lamblia
MRRDRYTGATAMIIAAEHGA

SEQ ID NO: 3164230 - protein, 24 aa, Giardia lamblia
MRRKDGRTALMISIANGTPELVQL

SEQ ID NO: 3164231 - protein, 26 aa, Giardia lamblia
MRRNTSWPRWTNIFFSATKALLGGRC

SEQ ID NO: 3164232 - protein, 23 aa, Giardia lamblia
MRRPTSLSSPVRDAMSFSHRIAP

SEQ ID NO: 3164233 - protein, 22 aa, Giardia lamblia
MRRRGSESSSRLNGRAPSSSYS

SEQ ID NO: 3164234 - protein, 27 aa, Giardia lamblia
MRRSAESGSAFAIHAIHEMQKPTEQPG

SEQ ID NO: 3164235 - protein, 23 aa, Giardia lamblia
MRRSDGWTSLMYCAQHDLVTIGK

SEQ ID NO: 3164236 - protein, 18 aa, Giardia lamblia
MRSDYGWTALMLAAQNGH

SEQ ID NO: 3164237 - protein, 19 aa, Giardia lamblia
MRSGAPGTDRSDIWAIGAT

SEQ ID NO: 3164238 - protein, 23 aa, Giardia lamblia
MRSRDGYTAIMWAAQTGSAGLVK

SEQ ID NO: 3164239 - protein, 26 aa, Giardia lamblia
MRSSNGWTALMWAALVGRTEVVKLLL

SEQ ID NO: 3164240 - protein, 17 aa, Giardia lamblia
MRSVYQLNTDKLEYNYR

SEQ ID NO: 3164241 - protein, 26 aa, Giardia lamblia
MRTTKWDFGFSALSWAAMNGHVDCVR

SEQ ID NO: 3164242 - protein, 17 aa, Giardia lamblia
MRVYKLSTIMSIIDQTR

SEQ ID NO: 3164243 - protein, 19 aa, Giardia lamblia
MRYANADLCIPRILETSDD

SEQ ID NO: 3164244 - protein, 17 aa, Giardia lamblia
MSADGVVGAAIFSVSRS

SEQ ID NO: 3164245 - protein, 18 aa, Giardia lamblia
MSAFPKRPPSDCVEVPNT

SEQ ID NO: 3164246 - protein, 31 aa, Giardia lamblia
MSAFPLQESFCVKGRELLDKQSIVPALLSDL

SEQ ID NO: 3164247 - protein, 19 aa, Giardia lamblia
MSALMYAAQYGYMTVCKTL

SEQ ID NO: 3164248 - protein, 17 aa, Giardia lamblia
MSAVLYMHLHGVAHMDL

SEQ ID NO: 3164249 - protein, 24 aa, Giardia lamblia
MSAWKLEMTDYLLTHPPTGPTPIH

SEQ ID NO: 3164250 - protein, 23 aa, Giardia lamblia
MSDARSYTGLMYAAMNGHPEVCK

SEQ ID NO: 3164251 - protein, 21 aa, Giardia lamblia
MSDFLTMRYGVQVDKEHLVDR

SEQ ID NO: 3164252 - protein, 18 aa, Giardia lamblia
MSDRELLLQLGRATAKKY

SEQ ID NO: 3164253 - protein, 23 aa, Giardia lamblia
MSDRSGNTALMWATKHSQSTSAA

SEQ ID NO: 3164254 - protein, 25 aa, Giardia lamblia
MSEKMPSPIRKRGTLGNITRFMTHM

SEQ ID NO: 3164255 - protein, 17 aa, Giardia lamblia
MSFCAKTLTELMIAITE

SEQ ID NO: 3164256 - protein, 20 aa, Giardia lamblia
MSFDITDVYTIDRIHDSLAN

SEQ ID NO: 3164257 - protein, 21 aa, Giardia lamblia
MSFILRFLFSPIQTGHQSKNS

SEQ ID NO: 3164258 - protein, 17 aa, Giardia lamblia
MSFLNFDRFYVLHPDVL

SEQ ID NO: 3164259 - protein, 22 aa, Giardia lamblia
MSFTLAPNFEWIDLPSDDDDDD

SEQ ID NO: 3164260 - protein, 25 aa, Giardia lamblia
MSFYSAECKRLFKADTDSAYSEKYS

SEQ ID NO: 3164261 - protein, 25 aa, Giardia lamblia
MSGGFFALGCFVELDEEAVTKAIID

SEQ ID NO: 3164262 - protein, 19 aa, Giardia lamblia
MSLAAKGRVDLLKKVASKE

SEQ ID NO: 3164263 - protein, 18 aa, Giardia lamblia
MSLKPFFGESMCLNHAAA

SEQ ID NO: 3164264 - protein, 27 aa, Giardia lamblia
MSLNSPRGYCLTINILSRHPAQKRSKS

SEQ ID NO: 3164265 - protein, 19 aa, Giardia lamblia
MSLSPKLAAKSPMRSVVGP

SEQ ID NO: 3164266 - protein, 24 aa, Giardia lamblia
MSLTELRQRLLLMKEVNLQILEDR

SEQ ID NO: 3164267 - protein, 22 aa, Giardia lamblia
MSMATGRRLSVIEAADTVRTLT

SEQ ID NO: 3164268 - protein, 23 aa, Giardia lamblia
MSMGDVCEGCIELNKELSQLKAE

SEQ ID NO: 3164269 - protein, 17 aa, Giardia lamblia
MSNEVRAVILQDTYQKL

SEQ ID NO: 3164270 - protein, 18 aa, Giardia lamblia
MSNLKFLGTIEGACRSLM

SEQ ID NO: 3164271 - protein, 18 aa, Giardia lamblia
MSPAGRRQAFPASEGVSP

SEQ ID NO: 3164272 - protein, 20 aa, Giardia lamblia
MSPCPPLQCEPVTDNVGISM

SEQ ID NO: 3164273 - protein, 25 aa, Giardia lamblia
MSPDFGTCEHMNWFYFAIGNVRKHT

SEQ ID NO: 3164274 - protein, 20 aa, Giardia lamblia
MSPHAFNPSILFNIESGGAA

SEQ ID NO: 3164275 - protein, 18 aa, Giardia lamblia
MSPHKGGISKEILRLFNE

SEQ ID NO: 3164276 - protein, 17 aa, Giardia lamblia
MSPKRLRSPQHKRGKTD

SEQ ID NO: 3164277 - protein, 17 aa, Giardia lamblia
MSPQDVWGLGCILYECL

SEQ ID NO: 3164278 - protein, 17 aa, Giardia lamblia
MSPWATIEGGALSDKGP

SEQ ID NO: 3164279 - protein, 19 aa, Giardia lamblia
MSQILEFYIRKLVSDSISR

SEQ ID NO: 3164280 - protein, 18 aa, Giardia lamblia
MSRLMAVLLTAFENPSDA

SEQ ID NO: 3164281 - protein, 22 aa, Giardia lamblia
MSRRDCLCLAPTGSGKSGAYII

SEQ ID NO: 3164282 - protein, 24 aa, Giardia lamblia
MSRSIPELLFYRFSSTKGCNDKLH

SEQ ID NO: 3164283 - protein, 17 aa, Giardia lamblia
MSSAAFYKVYNSILCRY

SEQ ID NO: 3164284 - protein, 20 aa, Giardia lamblia
MSSADGWTALMYAAYNGHSD

SEQ ID NO: 3164285 - protein, 24 aa, Giardia lamblia
MSSIPEALCARLLGMHVIGLSVVT

SEQ ID NO: 3164286 - protein, 29 aa, Giardia lamblia
MSSIVKPPEAWFWYPITSRLCRTALDKRH

SEQ ID NO: 3164287 - protein, 19 aa, Giardia lamblia
MSSSLPDMSLQTPKTLTKS

SEQ ID NO: 3164288 - protein, 18 aa, Giardia lamblia
MSSTSFCINQDCILSQDI

SEQ ID NO: 3164289 - protein, 18 aa, Giardia lamblia
MSSVTKALAAEWSVATKG

SEQ ID NO: 3164290 - protein, 18 aa, Giardia lamblia
MSSYRGGHKPCNSISGTH

SEQ ID NO: 3164291 - protein, 19 aa, Giardia lamblia
MSTHELVSLLISNTPSNGS

SEQ ID NO: 3164292 - protein, 19 aa, Giardia lamblia
MSTHVAGLFSSDRTLKSAS

SEQ ID NO: 3164293 - protein, 24 aa, Giardia lamblia
MSTIPRKDWQASISKVCNLCSKAL

SEQ ID NO: 3164294 - protein, 23 aa, Giardia lamblia
MSTKLSVGLPRSMSSGATAMSPA

SEQ ID NO: 3164295 - protein, 18 aa, Giardia lamblia
MSTWYSVTVKPELETPLL

SEQ ID NO: 3164296 - protein, 19 aa, Giardia lamblia
MSVFIVRSYADGVFFESGL

SEQ ID NO: 3164297 - protein, 19 aa, Giardia lamblia
MTALMHAARTQSLDVAKLL

SEQ ID NO: 3164298 - protein, 19 aa, Giardia lamblia
MTALMYAAHFGKLEAVKEL

SEQ ID NO: 3164299 - protein, 22 aa, Giardia lamblia
MTAVGGVYRLDGMAGILASERP

SEQ ID NO: 3164300 - protein, 19 aa, Giardia lamblia
MTCLSALGSQLSHCKTPSA

SEQ ID NO: 3164301 - protein, 17 aa, Giardia lamblia
MTDRLKAELEMLMKENG

SEQ ID NO: 3164302 - protein, 28 aa, Giardia lamblia
MTDTEIELTWGLCKSSYIEEFVAQIMRF

SEQ ID NO: 3164303 - protein, 18 aa, Giardia lamblia
MTEKMALEHADLNALEQE

SEQ ID NO: 3164304 - protein, 18 aa, Giardia lamblia
MTESCVEEALTATSLLEV

SEQ ID NO: 3164305 - protein, 22 aa, Giardia lamblia
MTFYRSRLYLFLVGSEGKKPVI

SEQ ID NO: 3164306 - protein, 17 aa, Giardia lamblia
MTGHMLPSMILPHELLR

SEQ ID NO: 3164307 - protein, 17 aa, Giardia lamblia
MTGLHIAARGGDTDQVK

SEQ ID NO: 3164308 - protein, 19 aa, Giardia lamblia
MTGTMPQHQVLRLRVSDDR

SEQ ID NO: 3164309 - protein, 17 aa, Giardia lamblia
MTHRDIEVVIYFTAKLV

SEQ ID NO: 3164310 - protein, 26 aa, Giardia lamblia
MTIAPDCIKCTFDVATITSPSTPVTY

SEQ ID NO: 3164311 - protein, 23 aa, Giardia lamblia
MTIARKCLFRDVSRQTKSSLTAL

SEQ ID NO: 3164312 - protein, 23 aa, Giardia lamblia
MTIGEVFSGLFAVADSFHEVITE

SEQ ID NO: 3164313 - protein, 20 aa, Giardia lamblia
MTILQLRTSQLRLVSADPVA

SEQ ID NO: 3164314 - protein, 19 aa, Giardia lamblia
MTINDLKSAAVSFEAVISG

SEQ ID NO: 3164315 - protein, 19 aa, Giardia lamblia
MTKNFKLRQDKARLNALDY

SEQ ID NO: 3164316 - protein, 20 aa, Giardia lamblia
MTKYWSGAIGSSFKKAYYSS

SEQ ID NO: 3164317 - protein, 23 aa, Giardia lamblia
MTLACAFRILLTVETSMLFLRYF

SEQ ID NO: 3164318 - protein, 25 aa, Giardia lamblia
MTLKRLCRKCFLRAIEDEVQRTVEM

SEQ ID NO: 3164319 - protein, 25 aa, Giardia lamblia
MTMHAAVAYGIYYLCHGGCSDLRTF

SEQ ID NO: 3164320 - protein, 25 aa, Giardia lamblia
MTMSMCPDFLAICTCVYPHGKRSAL

SEQ ID NO: 3164321 - protein, 36 aa, Giardia lamblia
MTNPFLITSIRLVPDFSRIITLFSYLLRYIKEIKMK

SEQ ID NO: 3164322 - protein, 25 aa, Giardia lamblia
MTNVEGRTALMLAAAANNPEICKIL

SEQ ID NO: 3164323 - protein, 25 aa, Giardia lamblia
MTPEDWKIGIFVVGYHINMIRYLVE

SEQ ID NO: 3164324 - protein, 23 aa, Giardia lamblia
MTPKALRKICVEKGGYATPELND

SEQ ID NO: 3164325 - protein, 26 aa, Giardia lamblia
MTPWFRILFDRVLEPWLLDPSACLAE

SEQ ID NO: 3164326 - protein, 19 aa, Giardia lamblia
MTRSLLRRSDLQHSHTAAA

SEQ ID NO: 3164327 - protein, 24 aa, Giardia lamblia
MTSECGWTALVYASAYLNLACIEV

SEQ ID NO: 3164328 - protein, 24 aa, Giardia lamblia
MTTEDKLGALIRLRERVRRLREDK

SEQ ID NO: 3164329 - protein, 17 aa, Giardia lamblia
MTVCKTLMYAEAKLTRH

SEQ ID NO: 3164330 - protein, 17 aa, Giardia lamblia
MTVELALGLQALGITKG

SEQ ID NO: 3164331 - protein, 20 aa, Giardia lamblia
MTYIPAPRRTSFYCFCKGIV

SEQ ID NO: 3164332 - protein, 25 aa, Giardia lamblia
MVAAAEGYCDIVHLLMGREKLLKDL

SEQ ID NO: 3164333 - protein, 20 aa, Giardia lamblia
MVAHLKPLMTAARALRGQYN

SEQ ID NO: 3164334 - protein, 27 aa, Giardia lamblia
MVASIGVGCSLVWMHFGYMRPFNLDSD

SEQ ID NO: 3164335 - protein, 17 aa, Giardia lamblia
MVDDLKSLGAREISLTL

SEQ ID NO: 3164336 - protein, 17 aa, Giardia lamblia
MVDHGGWYDRDELFFKQ

SEQ ID NO: 3164337 - protein, 19 aa, Giardia lamblia
MVDMICFAALLANVEVAHI

SEQ ID NO: 3164338 - protein, 20 aa, Giardia lamblia
MVEACFQCTVCKDVKKASVK

SEQ ID NO: 3164339 - protein, 22 aa, Giardia lamblia
MVELLAPYEALEFGEMAIRRTS

SEQ ID NO: 3164340 - protein, 19 aa, Giardia lamblia
MVESFRIRTAETLSNVAAS

SEQ ID NO: 3164341 - protein, 17 aa, Giardia lamblia
MVFCCICDELTRLPPAY

SEQ ID NO: 3164342 - protein, 17 aa, Giardia lamblia
MVFENGASLSPGGGRTL

SEQ ID NO: 3164343 - protein, 25 aa, Giardia lamblia
MVGQTNCWVLPTGRYGAYYINKDEV

SEQ ID NO: 3164344 - protein, 23 aa, Giardia lamblia
MVHLHMERLRFIFEDYVRLRLSK

SEQ ID NO: 3164345 - protein, 19 aa, Giardia lamblia
MVIKACNLANLVHPYIEIC

SEQ ID NO: 3164346 - protein, 23 aa, Giardia lamblia
MVINCGWLKAGMYKEVYEDIKAV

SEQ ID NO: 3164347 - protein, 20 aa, Giardia lamblia
MVINILLNCRDIYTPFQALY

SEQ ID NO: 3164348 - protein, 24 aa, Giardia lamblia
MVITLECDEILSGVRDYDTLNCST

SEQ ID NO: 3164349 - protein, 18 aa, Giardia lamblia
MVLHPRGRSLAFLPVPCP

SEQ ID NO: 3164350 - protein, 25 aa, Giardia lamblia
MVMEYRWLLEDAPGEYVFTHLAPTF

SEQ ID NO: 3164351 - protein, 19 aa, Giardia lamblia
MVNEHVILFRSPSNRRLSY

SEQ ID NO: 3164352 - protein, 22 aa, Giardia lamblia
MVNRLRIQLMNERKMTEKYKKD

SEQ ID NO: 3164353 - protein, 28 aa, Giardia lamblia
MVNSGGILRRSFITSFDEIRLITLALIE

SEQ ID NO: 3164354 - protein, 23 aa, Giardia lamblia
MVNYSAAEALRISVDETEQRREK

SEQ ID NO: 3164355 - protein, 22 aa, Giardia lamblia
MVPVAGEGFVLRKLFDIPNAHR

SEQ ID NO: 3164356 - protein, 18 aa, Giardia lamblia
MVPYPIYLNASRNSKDDM

SEQ ID NO: 3164357 - protein, 18 aa, Giardia lamblia
MVQILLPYELSIKTTGTD

SEQ ID NO: 3164358 - protein, 28 aa, Giardia lamblia
MVQRVVEMYIVFSLVWAFGGSLDSDGRQ

SEQ ID NO: 3164359 - protein, 19 aa, Giardia lamblia
MVSDLSCIVIISGLPTPEA

SEQ ID NO: 3164360 - protein, 18 aa, Giardia lamblia
MVSEAAFISSYVVDTFTK

SEQ ID NO: 3164361 - protein, 33 aa, Giardia lamblia
MVSELKKRIAAIPEYRGKFTIIHKDFTKMPPSE

SEQ ID NO: 3164362 - protein, 17 aa, Giardia lamblia
MVSPMCMTSISGAPYPH

SEQ ID NO: 3164363 - protein, 19 aa, Giardia lamblia
MVTVDGWTALMGAAYSNSP

SEQ ID NO: 3164364 - protein, 17 aa, Giardia lamblia
MVVCGDALVGPSTSDGD

SEQ ID NO: 3164365 - protein, 18 aa, Giardia lamblia
MVVFCKWDGADPYFYYWK

SEQ ID NO: 3164366 - protein, 20 aa, Giardia lamblia
MVVPCPSITCTIPKKTRYNE

SEQ ID NO: 3164367 - protein, 24 aa, Giardia lamblia
MVYPGRTDFSIGASATYKPTIGGP

SEQ ID NO: 3164368 - protein, 19 aa, Giardia lamblia
MWAHMCNIAIESKNSKLLA

SEQ ID NO: 3164369 - protein, 18 aa, Giardia lamblia
MWAIGCILGEMLGGSPMF

SEQ ID NO: 3164370 - protein, 17 aa, Giardia lamblia
MWALGIVLYELMMLTTP

SEQ ID NO: 3164371 - protein, 21 aa, Giardia lamblia
MWDKSVRFYSEFLKESMSVKS

SEQ ID NO: 3164372 - protein, 19 aa, Giardia lamblia
MWHQGLRSGFGCHFYPETL

SEQ ID NO: 3164373 - protein, 19 aa, Giardia lamblia
MWMGYDISKSLMALFSSVR

SEQ ID NO: 3164374 - protein, 23 aa, Giardia lamblia
MWRIREILQAIGLEPTDEELFTM

SEQ ID NO: 3164375 - protein, 19 aa, Giardia lamblia
MWSLGAIIYELVTLRRPDF

SEQ ID NO: 3164376 - protein, 29 aa, Giardia lamblia
MYAAWRGHLQLVELLACFKNGVELGLQRA

SEQ ID NO: 3164377 - protein, 18 aa, Giardia lamblia
MYAFPRLYLPKRFVEEAE

SEQ ID NO: 3164378 - protein, 17 aa, Giardia lamblia
MYAVARSREITLFDDRG

SEQ ID NO: 3164379 - protein, 19 aa, Giardia lamblia
MYCYAPPELLHAVAKSELQ

SEQ ID NO: 3164380 - protein, 18 aa, Giardia lamblia
MYEPVFFFQIQIVRMKDG

SEQ ID NO: 3164381 - protein, 33 aa, Giardia lamblia
MYEYCIELCKILYVLCQYSPRLIMNLTALGLPP

SEQ ID NO: 3164382 - protein, 18 aa, Giardia lamblia
MYFLLSVMSEYWKPDMTK

SEQ ID NO: 3164383 - protein, 19 aa, Giardia lamblia
MYIHAFQAYLFNLATSRCI

SEQ ID NO: 3164384 - protein, 18 aa, Giardia lamblia
MYITLLFQWVQGQLEDEA

SEQ ID NO: 3164385 - protein, 18 aa, Giardia lamblia
MYMAGLRDSSEFDMWRAA

SEQ ID NO: 3164386 - protein, 26 aa, Giardia lamblia
MYNLGHSLLYMGIRAVEAGTNLKTLS

SEQ ID NO: 3164387 - protein, 17 aa, Giardia lamblia
MYPKRKRPLCSVPGIPR

SEQ ID NO: 3164388 - protein, 20 aa, Giardia lamblia
MYRYELVSKLGSGSFGKVYK

SEQ ID NO: 3164389 - protein, 18 aa, Giardia lamblia
MYSPQWFFEEVIRKHAMF

SEQ ID NO: 3164390 - protein, 25 aa, Giardia lamblia
MYTGSWDKRILCFSIVDRTIVDNAI

SEQ ID NO: 3164391 - protein, 27 aa, Giardia lamblia
MYVTRIGRIVFRLCFRNWTGPGDCSAS

SEQ ID NO: 3164392 - protein, 17 aa, Giardia lamblia
NAAGALFHLLPYYDGAQ

SEQ ID NO: 3164393 - protein, 20 aa, Giardia lamblia
NAAGELPVSIGISRTYPNSI

SEQ ID NO: 3164394 - protein, 29 aa, Giardia lamblia
NAAQRKGVGKGNRCPYCDRSMDTELVAAE

SEQ ID NO: 3164395 - protein, 19 aa, Giardia lamblia
NACLVCLDNRATIFYLPCQ

SEQ ID NO: 3164396 - protein, 27 aa, Giardia lamblia
NACQRCGCLRKQLIYLSSQFHRLYSNF

SEQ ID NO: 3164397 - protein, 19 aa, Giardia lamblia
NADAALLLENEFQQIVSMA

SEQ ID NO: 3164398 - protein, 26 aa, Giardia lamblia
NADAVARLVPESGLISDDGWSALMLA

SEQ ID NO: 3164399 - protein, 18 aa, Giardia lamblia
NADGWRETWSNTTYSQHV

SEQ ID NO: 3164400 - protein, 24 aa, Giardia lamblia
NADLDRFLLKYGIDRQLTDCEYFL

SEQ ID NO: 3164401 - protein, 17 aa, Giardia lamblia
NADSIAFAQKMMSADMA

SEQ ID NO: 3164402 - protein, 22 aa, Giardia lamblia
NAEAICLAELIDSPSSSAHCQP

SEQ ID NO: 3164403 - protein, 17 aa, Giardia lamblia
NAEGWTALMYAAAYNMD

SEQ ID NO: 3164404 - protein, 23 aa, Giardia lamblia
NAEHRISGFLERWSLSNNVLPSR

SEQ ID NO: 3164405 - protein, 25 aa, Giardia lamblia
NAELILRIAELEMEVEMLKEDLDLR

SEQ ID NO: 3164406 - protein, 23 aa, Giardia lamblia
NAELSLLLVFPFCELDLKTYLKH

SEQ ID NO: 3164407 - protein, 23 aa, Giardia lamblia
NAEPRIPGIYAITLVRRASAEED

SEQ ID NO: 3164408 - protein, 23 aa, Giardia lamblia
NAEVLCSALAAFEGHVYSSIDPT

SEQ ID NO: 3164409 - protein, 18 aa, Giardia lamblia
NAFETGLRDRGFLYHQRN

SEQ ID NO: 3164410 - protein, 28 aa, Giardia lamblia
NAFLRRMAFWEIGESFVTTPGVMAEVCD

SEQ ID NO: 3164411 - protein, 21 aa, Giardia lamblia
NAFPDCASIELSIQTATVKSR

SEQ ID NO: 3164412 - protein, 24 aa, Giardia lamblia
NAFSYRGSAVYAFTSTFFAFGNLA

SEQ ID NO: 3164413 - protein, 21 aa, Giardia lamblia
NAFTGKGFIKFASQSAAEECV

SEQ ID NO: 3164414 - protein, 19 aa, Giardia lamblia
NAGFCRLDVFVYCFNYLFD

SEQ ID NO: 3164415 - protein, 27 aa, Giardia lamblia
NAGKHPCPFEFSAPFLRSYSTPTSFVD

SEQ ID NO: 3164416 - protein, 23 aa, Giardia lamblia
NAGLEAFVSLALGANFPCLPAIP

SEQ ID NO: 3164417 - protein, 20 aa, Giardia lamblia
NAGRVGIFRLHYRTLTEEVP

SEQ ID NO: 3164418 - protein, 19 aa, Giardia lamblia
NAGSGSWDSYLFLTGSESI

SEQ ID NO: 3164419 - protein, 20 aa, Giardia lamblia
NAHPRIYIFQAHLPQNRDAP

SEQ ID NO: 3164420 - protein, 18 aa, Giardia lamblia
NAIENCHLALKVITKNVD

SEQ ID NO: 3164421 - protein, 19 aa, Giardia lamblia
NAIISWKTVYLKVTQNSVQ

SEQ ID NO: 3164422 - protein, 22 aa, Giardia lamblia
NAIKISCEYYNLGMTKVVYGRV

SEQ ID NO: 3164423 - protein, 25 aa, Giardia lamblia
NAIKRKDFSAIIWLIANTVSSEWEK

SEQ ID NO: 3164424 - protein, 20 aa, Giardia lamblia
NAKHKLVCLKTDYKNIMNEI

SEQ ID NO: 3164425 - protein, 25 aa, Giardia lamblia
NAKLKAALLELGRRYKALQATGVDN

SEQ ID NO: 3164426 - protein, 33 aa, Giardia lamblia
NAKLQRAREALRLSYRRLNIRKAEAATYKAMKD

SEQ ID NO: 3164427 - protein, 22 aa, Giardia lamblia
NALARNDFRVFGTVASSLAFGD

SEQ ID NO: 3164428 - protein, 31 aa, Giardia lamblia
NALDPRITFPTVLEMRSAPEIVPHENGTYVF

SEQ ID NO: 3164429 - protein, 18 aa, Giardia lamblia
NALELAIENGHIEISKLL

SEQ ID NO: 3164430 - protein, 22 aa, Giardia lamblia
NALGHAIAWIRYSLDAVCKQAT

SEQ ID NO: 3164431 - protein, 17 aa, Giardia lamblia
NALKKAISFSNLQVSRI

SEQ ID NO: 3164432 - protein, 17 aa, Giardia lamblia
NALKTAARIRTSKVRRV

SEQ ID NO: 3164433 - protein, 25 aa, Giardia lamblia
NALLKRDLEELQMRYQTDMNAATTS

SEQ ID NO: 3164434 - protein, 20 aa, Giardia lamblia
NALLRKQYQEMAANHPDVAE

SEQ ID NO: 3164435 - protein, 17 aa, Giardia lamblia
NALPVLCPKLYSVDISA

SEQ ID NO: 3164436 - protein, 29 aa, Giardia lamblia
NALQFLRIDIININFFFARQGIPVLSARE

SEQ ID NO: 3164437 - protein, 17 aa, Giardia lamblia
NALRIVDHYVTYGEPTV

SEQ ID NO: 3164438 - protein, 25 aa, Giardia lamblia
NALSAEKEATCAIVKPHAVAESPII

SEQ ID NO: 3164439 - protein, 24 aa, Giardia lamblia
NAMALTLPAYIPVQFRTLYIDNVT

SEQ ID NO: 3164440 - protein, 17 aa, Giardia lamblia
NAMNCARKMNKLRKMQD

SEQ ID NO: 3164441 - protein, 18 aa, Giardia lamblia
NANLKRCIEEELQSELPC

SEQ ID NO: 3164442 - protein, 19 aa, Giardia lamblia
NANPRGGQDLVSIMNQFNK

SEQ ID NO: 3164443 - protein, 25 aa, Giardia lamblia
NANVLKHLGGWAIIFNLAESSPSAD

SEQ ID NO: 3164444 - protein, 20 aa, Giardia lamblia
NANYALTCALYRSEVGIIDD

SEQ ID NO: 3164445 - protein, 21 aa, Giardia lamblia
NAPDVRRILHRHITPQSIVMR

SEQ ID NO: 3164446 - protein, 53 aa, Giardia lamblia
NAPITLKCGHTFCKGCLSSKRQKACKICRLRYRITPNINICLHHIVELAGQLG

SEQ ID NO: 3164447 - protein, 19 aa, Giardia lamblia
NAPNLFSSPSIVIDKNSSI

SEQ ID NO: 3164448 - protein, 24 aa, Giardia lamblia
NAQLCKAAGLLLEKFYSCGCYCEN

SEQ ID NO: 3164449 - protein, 24 aa, Giardia lamblia
NAQLKVKILNLERLLANSASETAD

SEQ ID NO: 3164450 - protein, 25 aa, Giardia lamblia
NAQSCKRALPPVPHDIFMALLSSGL

SEQ ID NO: 3164451 - protein, 33 aa, Giardia lamblia
NAQSRLRSVPVIWRIARQTRFIVLSSYMLYIGN

SEQ ID NO: 3164452 - protein, 22 aa, Giardia lamblia
NARCKGLSIANTHLYSKALSSG

SEQ ID NO: 3164453 - protein, 17 aa, Giardia lamblia
NARECFCEVGDRTSFTA

SEQ ID NO: 3164454 - protein, 19 aa, Giardia lamblia
NASAVPVEVHFDTSLYVSE

SEQ ID NO: 3164455 - protein, 24 aa, Giardia lamblia
NASDFTISFEILKTFLTKTYLAGK

SEQ ID NO: 3164456 - protein, 18 aa, Giardia lamblia
NASIIWPYISHPTITYKK

SEQ ID NO: 3164457 - protein, 20 aa, Giardia lamblia
NASLRPLIDEVFSMEQRLKA

SEQ ID NO: 3164458 - protein, 26 aa, Giardia lamblia
NASPCDIKLGPTIAGSLKSSSRPTSS

SEQ ID NO: 3164459 - protein, 17 aa, Giardia lamblia
NASPCFNVSLQNSAQQT

SEQ ID NO: 3164460 - protein, 19 aa, Giardia lamblia
NASTAPCARRCGGVMDGRY

SEQ ID NO: 3164461 - protein, 18 aa, Giardia lamblia
NASVCSLDSIQARVYEFP

SEQ ID NO: 3164462 - protein, 25 aa, Giardia lamblia
NATIMALLCRFVRTHRCKVWMTPCR

SEQ ID NO: 3164463 - protein, 25 aa, Giardia lamblia
NATRLPLGHFLWKYGNPSQFSPDQG

SEQ ID NO: 3164464 - protein, 18 aa, Giardia lamblia
NAVEAAVCIDSFNESIQA

SEQ ID NO: 3164465 - protein, 18 aa, Giardia lamblia
NAVECARLLKENEKELKT

SEQ ID NO: 3164466 - protein, 21 aa, Giardia lamblia
NAVEFSLRLLHGNAHNANSFF

SEQ ID NO: 3164467 - protein, 18 aa, Giardia lamblia
NAVFKRSAAGPIDTSEEL

SEQ ID NO: 3164468 - protein, 24 aa, Giardia lamblia
NAVLPVSMACCLAAAREEHISLYQ

SEQ ID NO: 3164469 - protein, 28 aa, Giardia lamblia
NAVQRLIARIMFNLVYLGTRDEFRLESE

SEQ ID NO: 3164470 - protein, 24 aa, Giardia lamblia
NAVRGCDTLALLILRDGTAKIGFV

SEQ ID NO: 3164471 - protein, 23 aa, Giardia lamblia
NAVVDCLRKALTEERSFYQISRI

SEQ ID NO: 3164472 - protein, 24 aa, Giardia lamblia
NAYLSSPVATCFDLVLEEVCKELY

SEQ ID NO: 3164473 - protein, 19 aa, Giardia lamblia
NAYSFCTILSNYTSGGSIS

SEQ ID NO: 3164474 - protein, 31 aa, Giardia lamblia
NCAHTFCAECMYYSLLLWEGKCPICDAHVSH

SEQ ID NO: 3164475 - protein, 22 aa, Giardia lamblia
NCDMRRPPGLRIYDDGLLAVYE

SEQ ID NO: 3164476 - protein, 27 aa, Giardia lamblia
NCERVGYTMYPACSDYWVKHRHSGNDA

SEQ ID NO: 3164477 - protein, 19 aa, Giardia lamblia
NCIIKELYMNGSRYRAIKR

SEQ ID NO: 3164478 - protein, 18 aa, Giardia lamblia
NCIKVMLNTHKFTIDDIT

SEQ ID NO: 3164479 - protein, 24 aa, Giardia lamblia
NCIRYCLTCNPAVSFAGYSVPHPA

SEQ ID NO: 3164480 - protein, 18 aa, Giardia lamblia
NCIVAVKYLLSVEAKRVR

SEQ ID NO: 3164481 - protein, 24 aa, Giardia lamblia
NCKELAEKCDLSYVLCARRIPKQV

SEQ ID NO: 3164482 - protein, 22 aa, Giardia lamblia
NCLGIRLVWDIIQEKTTPADRD

SEQ ID NO: 3164483 - protein, 20 aa, Giardia lamblia
NCLQKCMIEASMQCSYLHTF

SEQ ID NO: 3164484 - protein, 19 aa, Giardia lamblia
NCLTNILSRHGYIKNERVS

SEQ ID NO: 3164485 - protein, 31 aa, Giardia lamblia
NCLVAQKLILCFPTLPILRIHPTCKKSKILT

SEQ ID NO: 3164486 - protein, 27 aa, Giardia lamblia
NCMKVSLMAAHFLWFLNTSSRGVMTTP

SEQ ID NO: 3164487 - protein, 25 aa, Giardia lamblia
NCMLLTFICPHVMSGRQVCLPGSCV

SEQ ID NO: 3164488 - protein, 23 aa, Giardia lamblia
NCMSCTAVSPPLSFYVEPEHKDT

SEQ ID NO: 3164489 - protein, 17 aa, Giardia lamblia
NCRIAVYGCAIELDRTE

SEQ ID NO: 3164490 - protein, 19 aa, Giardia lamblia
NCRIRRIYFADSLYEEDEI

SEQ ID NO: 3164491 - protein, 19 aa, Giardia lamblia
NCSLPSFSATELEEKAVRS

SEQ ID NO: 3164492 - protein, 20 aa, Giardia lamblia
NCTAPHGAGRIMSRIAAKRS

SEQ ID NO: 3164493 - protein, 20 aa, Giardia lamblia
NCTHPLFITIATQLLADIRT

SEQ ID NO: 3164494 - protein, 20 aa, Giardia lamblia
NCVEILLPEECRMTDRVGNT

SEQ ID NO: 3164495 - protein, 19 aa, Giardia lamblia
NCVLLLVERMGPDALNTED

SEQ ID NO: 3164496 - protein, 21 aa, Giardia lamblia
NCVVPSGGLVEVWLTALEKEM

SEQ ID NO: 3164497 - protein, 20 aa, Giardia lamblia
NCYEAVSILAEYETHLRTSK

SEQ ID NO: 3164498 - protein, 19 aa, Giardia lamblia
NDAEMCRMLGPLEKGMFNR

SEQ ID NO: 3164499 - protein, 24 aa, Giardia lamblia
NDAGFKRAIHLAELLCLQNPLFPW

SEQ ID NO: 3164500 - protein, 18 aa, Giardia lamblia
NDAGFKRYAKGSEDYLEK

SEQ ID NO: 3164501 - protein, 20 aa, Giardia lamblia
NDARIKAAIVAHNLIMSLTL

SEQ ID NO: 3164502 - protein, 26 aa, Giardia lamblia
NDAVSFLDCIERMWASLRSENGITLH

SEQ ID NO: 3164503 - protein, 28 aa, Giardia lamblia
NDDLAELSKFWISLGIPPGERDNAYMKV

SEQ ID NO: 3164504 - protein, 22 aa, Giardia lamblia
NDEHRLRNILGRSIQLMNLLRS

SEQ ID NO: 3164505 - protein, 17 aa, Giardia lamblia
NDEIERLKEQLKEKEEF

SEQ ID NO: 3164506 - protein, 20 aa, Giardia lamblia
NDEPMLCSFVTRVGGTIIAT

SEQ ID NO: 3164507 - protein, 25 aa, Giardia lamblia
NDFQWGAGCTALMIACYYGHSDCVR

SEQ ID NO: 3164508 - protein, 19 aa, Giardia lamblia
NDGLAPAFVKTAAIVQPKV

SEQ ID NO: 3164509 - protein, 21 aa, Giardia lamblia
NDHPECVRLLMKEEGGMQTTK

SEQ ID NO: 3164510 - protein, 27 aa, Giardia lamblia
NDHTKVLLCVDCTELSSDIDVYRPCIR

SEQ ID NO: 3164511 - protein, 23 aa, Giardia lamblia
NDIEKAPVFAFLDCVCDEDQLAK

SEQ ID NO: 3164512 - protein, 17 aa, Giardia lamblia
NDIGLGIIAVEPEDTVP

SEQ ID NO: 3164513 - protein, 20 aa, Giardia lamblia
NDIHSVWQLIPQRAGEQDMD

SEQ ID NO: 3164514 - protein, 17 aa, Giardia lamblia
NDILKLLQEQFVPRSTN

SEQ ID NO: 3164515 - protein, 28 aa, Giardia lamblia
NDIWACACILCEILLMKPLFPGANDIDM

SEQ ID NO: 3164516 - protein, 23 aa, Giardia lamblia
NDKCTKFDLYDAIGRKSYTYEFK

SEQ ID NO: 3164517 - protein, 21 aa, Giardia lamblia
NDKGWTALMNAVWGDHIECVE

SEQ ID NO: 3164518 - protein, 24 aa, Giardia lamblia
NDKHPEFQRLLATLDATRLRLLSI

SEQ ID NO: 3164519 - protein, 25 aa, Giardia lamblia
NDKTLIPRVDYRLVANKTLAPEDVY

SEQ ID NO: 3164520 - protein, 24 aa, Giardia lamblia
NDLHIKARFNSRFIALLEYLPRFL

SEQ ID NO: 3164521 - protein, 21 aa, Giardia lamblia
NDLPAIELLLPYELLLKSDNT

SEQ ID NO: 3164522 - protein, 22 aa, Giardia lamblia
NDLVGVWSWLPRQCKYADNQGQ

SEQ ID NO: 3164523 - protein, 22 aa, Giardia lamblia
NDLVRYSRELFYAVVNSDARRE

SEQ ID NO: 3164524 - protein, 18 aa, Giardia lamblia
NDMDEVLRVLLPVEKGAK

SEQ ID NO: 3164525 - protein, 19 aa, Giardia lamblia
NDMEMVRLLADDELNLSNG

SEQ ID NO: 3164526 - protein, 24 aa, Giardia lamblia
NDMQELPIELGILKRLNKLRFDGN

SEQ ID NO: 3164527 - protein, 18 aa, Giardia lamblia
NDNDVLYMHCLKRIVEGA

SEQ ID NO: 3164528 - protein, 21 aa, Giardia lamblia
NDNFFILKLLLGSYILETTLL

SEQ ID NO: 3164529 - protein, 24 aa, Giardia lamblia
NDNLKLTPTYSVGNLRPSSTSRSP

SEQ ID NO: 3164530 - protein, 27 aa, Giardia lamblia
NDPMTLEALFIFTLVWSIGGLIHDQDR

SEQ ID NO: 3164531 - protein, 25 aa, Giardia lamblia
NDPTCMKWNPVLPSTFAVGDSGGNV

SEQ ID NO: 3164532 - protein, 25 aa, Giardia lamblia
NDQIWRVSGKLELLDNILAKLHKTS

SEQ ID NO: 3164533 - protein, 17 aa, Giardia lamblia
NDRGFKLAYSYHNLTHW

SEQ ID NO: 3164534 - protein, 21 aa, Giardia lamblia
NDRIKRERLYGSLRKTTKDTQ

SEQ ID NO: 3164535 - protein, 17 aa, Giardia lamblia
NDSKLAIEIAFEMLHLE

SEQ ID NO: 3164536 - protein, 21 aa, Giardia lamblia
NDSYCSRRGLMVMKYPITPLS

SEQ ID NO: 3164537 - protein, 24 aa, Giardia lamblia
NDTCLSNLPFLVYVIHGAPLAGKT

SEQ ID NO: 3164538 - protein, 20 aa, Giardia lamblia
NDTLAIKLPYLVMLIKNMRK

SEQ ID NO: 3164539 - protein, 17 aa, Giardia lamblia
NDVEAVKALLPIQRGRK

SEQ ID NO: 3164540 - protein, 21 aa, Giardia lamblia
NDVLLLLAPIIHKLSDSQRRT

SEQ ID NO: 3164541 - protein, 22 aa, Giardia lamblia
NDVMKQFRCHSASQMTSASTYG

SEQ ID NO: 3164542 - protein, 23 aa, Giardia lamblia
NEAEAPVPYFAQIEKAIVLKTLT

SEQ ID NO: 3164543 - protein, 27 aa, Giardia lamblia
NEAFGLPCWTERLSFFTTYSPEMLASE

SEQ ID NO: 3164544 - protein, 26 aa, Giardia lamblia
NEAVRFYSPFVLRYEIGLKQMQQKIE

SEQ ID NO: 3164545 - protein, 19 aa, Giardia lamblia
NEAYKCIDVLLGRGSSSAV

SEQ ID NO: 3164546 - protein, 22 aa, Giardia lamblia
NECKDLLAQLGYNSAEEAEAIL

SEQ ID NO: 3164547 - protein, 28 aa, Giardia lamblia
NECRQLDKAVSWNWRMFAGQGSSVASTE

SEQ ID NO: 3164548 - protein, 23 aa, Giardia lamblia
NECYEYLLRMPISTMTKESYRNL

SEQ ID NO: 3164549 - protein, 23 aa, Giardia lamblia
NEDGETALMLAVRNNAMNVVEVL

SEQ ID NO: 3164550 - protein, 23 aa, Giardia lamblia
NEECDNCGLSLATITQRSERIVR

SEQ ID NO: 3164551 - protein, 23 aa, Giardia lamblia
NEECVKLLVDREATLSTTDLSQQ

SEQ ID NO: 3164552 - protein, 17 aa, Giardia lamblia
NEELLLFQERMNTHDKT

SEQ ID NO: 3164553 - protein, 18 aa, Giardia lamblia
NEEPFLTTRAHLLKRFPH

SEQ ID NO: 3164554 - protein, 17 aa, Giardia lamblia
NEFGHPEWIDFPRVGNS

SEQ ID NO: 3164555 - protein, 24 aa, Giardia lamblia
NEFIDRLIDLCVSLVPDSASRRVD

SEQ ID NO: 3164556 - protein, 20 aa, Giardia lamblia
NEFSCKGVLLLKLELTDDTK

SEQ ID NO: 3164557 - protein, 24 aa, Giardia lamblia
NEGETALVKAIRWNAIDMIEVLLR

SEQ ID NO: 3164558 - protein, 24 aa, Giardia lamblia
NEGGTILRFMCCKKGVHRESEIHG

SEQ ID NO: 3164559 - protein, 25 aa, Giardia lamblia
NEGHSALSIAVLARRMDKVERLATL

SEQ ID NO: 3164560 - protein, 22 aa, Giardia lamblia
NEGKNALMFAAEYGCTESVKVL

SEQ ID NO: 3164561 - protein, 29 aa, Giardia lamblia
NEIGIYLSALARRMLKSKLTYQYPTFLMY

SEQ ID NO: 3164562 - protein, 31 aa, Giardia lamblia
NEIKCLKSFVRKLAAYRAKPCINIHSLKCRH

SEQ ID NO: 3164563 - protein, 21 aa, Giardia lamblia
NEILKRLQADLVQTKSNPRSK

SEQ ID NO: 3164564 - protein, 30 aa, Giardia lamblia
NEIPGKIMLSMEFLESGSLSNLIDKYHQCR

SEQ ID NO: 3164565 - protein, 25 aa, Giardia lamblia
NEIRVRVSTVLRLFGRKPSSHRSAR

SEQ ID NO: 3164566 - protein, 22 aa, Giardia lamblia
NEKARFIKLIIEDKLNIKNVPR

SEQ ID NO: 3164567 - protein, 31 aa, Giardia lamblia
NEKERISSHEILLWPEMQTVATLVSGIPART

SEQ ID NO: 3164568 - protein, 20 aa, Giardia lamblia
NEKIDIWALGCALYELCTKQ

SEQ ID NO: 3164569 - protein, 20 aa, Giardia lamblia
NEKIRVIVRVRPSIPEDLHP

SEQ ID NO: 3164570 - protein, 20 aa, Giardia lamblia
NEKRRFLTIDSYIQGQANSM

SEQ ID NO: 3164571 - protein, 27 aa, Giardia lamblia
NEKVDIWSLGCIVCEMCTNRPIFNFSH

SEQ ID NO: 3164572 - protein, 18 aa, Giardia lamblia
NEKYALCMHVGAGVVLHT

SEQ ID NO: 3164573 - protein, 18 aa, Giardia lamblia
NELCRDGSLFSQNEGEIT

SEQ ID NO: 3164574 - protein, 23 aa, Giardia lamblia
NELEIANGFLGAPYEEICKDVSH

SEQ ID NO: 3164575 - protein, 24 aa, Giardia lamblia
NELIKSKYLQSLVKLSETEVIEES

SEQ ID NO: 3164576 - protein, 21 aa, Giardia lamblia
NELKLLISLKHPNIVHFTNVY

SEQ ID NO: 3164577 - protein, 21 aa, Giardia lamblia
NELKRNFCIWLELINGPHRFM

SEQ ID NO: 3164578 - protein, 22 aa, Giardia lamblia
NELKSSLELANSGMLASTTGAT

SEQ ID NO: 3164579 - protein, 20 aa, Giardia lamblia
NELQHRRKILTYKRFLEFDH

SEQ ID NO: 3164580 - protein, 17 aa, Giardia lamblia
NELRQMIEFLADEQKRK

SEQ ID NO: 3164581 - protein, 20 aa, Giardia lamblia
NELRRIVEILSRRTKNNPVL

SEQ ID NO: 3164582 - protein, 30 aa, Giardia lamblia
NELTAAITAFVQRIQKEFSQSLSTIDVKSV

SEQ ID NO: 3164583 - protein, 20 aa, Giardia lamblia
NELVPVCQNLSVLDLSKNRI

SEQ ID NO: 3164584 - protein, 18 aa, Giardia lamblia
NENKRLAAQLEEITQDKL

SEQ ID NO: 3164585 - protein, 19 aa, Giardia lamblia
NEPEALIFLYAIQGEISFK

SEQ ID NO: 3164586 - protein, 18 aa, Giardia lamblia
NEPHCVLRAMWYPENQSS

SEQ ID NO: 3164587 - protein, 25 aa, Giardia lamblia
NEPLRRNSLKSGRVFNDVQHQSRSG

SEQ ID NO: 3164588 - protein, 29 aa, Giardia lamblia
NEQIVSLRAAIAGLRLERASFPLNRIDGR

SEQ ID NO: 3164589 - protein, 24 aa, Giardia lamblia
NEQLECTRLLAPCEAKIQDNFGCT

SEQ ID NO: 3164590 - protein, 24 aa, Giardia lamblia
NERLKKYTCLDFKEKLVAETKEAT

SEQ ID NO: 3164591 - protein, 17 aa, Giardia lamblia
NERLPIYPVYRANLTEL

SEQ ID NO: 3164592 - protein, 26 aa, Giardia lamblia
NERTCKASSRIVWTPEMNDLFVRAYN

SEQ ID NO: 3164593 - protein, 21 aa, Giardia lamblia
NERYIYCGTSEGSVLLFSVLD

SEQ ID NO: 3164594 - protein, 24 aa, Giardia lamblia
NESARTAPLLQIGTPFLAFYEGKA

SEQ ID NO: 3164595 - protein, 17 aa, Giardia lamblia
NESLRRDVIEFKQQLSA

SEQ ID NO: 3164596 - protein, 22 aa, Giardia lamblia
NESRLSDAVGRMFCHCGNEVKI

SEQ ID NO: 3164597 - protein, 25 aa, Giardia lamblia
NESSYAVALRIFFSQEVQCDKKSMF

SEQ ID NO: 3164598 - protein, 25 aa, Giardia lamblia
NESWTCVLCSRVNPYPPNRVPALVF

SEQ ID NO: 3164599 - protein, 26 aa, Giardia lamblia
NETAIEFPLLLSVAQELLREWMHRRL

SEQ ID NO: 3164600 - protein, 20 aa, Giardia lamblia
NETALTMALRAGRIEAAEIL

SEQ ID NO: 3164601 - protein, 20 aa, Giardia lamblia
NETEELLAFKDLQYKQLQKQ

SEQ ID NO: 3164602 - protein, 22 aa, Giardia lamblia
NETELRLLLKHDSDFLRNDFRS

SEQ ID NO: 3164603 - protein, 23 aa, Giardia lamblia
NETKLKYYLSILAMNEKRIQALE

SEQ ID NO: 3164604 - protein, 20 aa, Giardia lamblia
NETPLSFGEIDPFSSQQAVK

SEQ ID NO: 3164605 - protein, 36 aa, Giardia lamblia
NETRLVKMTKILSIFKRKIISLAMPYEKIAESSEGK

SEQ ID NO: 3164606 - protein, 25 aa, Giardia lamblia
NEVANLKSRIVIMTESMDERERRNM

SEQ ID NO: 3164607 - protein, 17 aa, Giardia lamblia
NEVLLLAERVRGLEADN

SEQ ID NO: 3164608 - protein, 23 aa, Giardia lamblia
NEVPKTHACLIVWEDRVLLSNDA

SEQ ID NO: 3164609 - protein, 25 aa, Giardia lamblia
NEVTRRFSGKFVVLSCPELTDSAMI

SEQ ID NO: 3164610 - protein, 25 aa, Giardia lamblia
NEWEAMALTLCGGGSLKEYRANTVV

SEQ ID NO: 3164611 - protein, 22 aa, Giardia lamblia
NEYKASSFYDAFPRDKASIALT

SEQ ID NO: 3164612 - protein, 33 aa, Giardia lamblia
NFDAFREFEGLLSIKGLFLLLKCQRVQPQISLS

SEQ ID NO: 3164613 - protein, 17 aa, Giardia lamblia
NFDREIPYEGTTPHSIP

SEQ ID NO: 3164614 - protein, 23 aa, Giardia lamblia
NFEIKHFVGCLSMANAGPNTNGS

SEQ ID NO: 3164615 - protein, 24 aa, Giardia lamblia
NFESDFWLHVIFEFDDHAKSNYIT

SEQ ID NO: 3164616 - protein, 24 aa, Giardia lamblia
NFKKLCTGEMGFGYKGSTFHRVIP

SEQ ID NO: 3164617 - protein, 22 aa, Giardia lamblia
NFKTRLGRRVGRMIQSMLSREE

SEQ ID NO: 3164618 - protein, 26 aa, Giardia lamblia
NFLEFYRYYGTFPIIGAEDIIEAASR

SEQ ID NO: 3164619 - protein, 32 aa, Giardia lamblia
NFLNLEINCCKWCPRTDVSIIAVCAGDELIFV

SEQ ID NO: 3164620 - protein, 18 aa, Giardia lamblia
NFLNRILKSNGEMSKAQK

SEQ ID NO: 3164621 - protein, 20 aa, Giardia lamblia
NFLPFMAYDLFDMMPEKTLS

SEQ ID NO: 3164622 - protein, 24 aa, Giardia lamblia
NFLTYYDFVCFILAEENRDLDSSL

SEQ ID NO: 3164623 - protein, 18 aa, Giardia lamblia
NFMLCRLLLMEIPALDNR

SEQ ID NO: 3164624 - protein, 24 aa, Giardia lamblia
NFNCKYRLPTSPGYSEDLKRLISV

SEQ ID NO: 3164625 - protein, 19 aa, Giardia lamblia
NFPLPLCNQQAGTERDDEG

SEQ ID NO: 3164626 - protein, 17 aa, Giardia lamblia
NFSIPTAVDVMFSSFPL

SEQ ID NO: 3164627 - protein, 20 aa, Giardia lamblia
NFSKDWTSVRLFSVSVQTDM

SEQ ID NO: 3164628 - protein, 23 aa, Giardia lamblia
NFSRASCALRRAIQIRESQDLPF

SEQ ID NO: 3164629 - protein, 17 aa, Giardia lamblia
NFVDMAASLRVDKCITV

SEQ ID NO: 3164630 - protein, 26 aa, Giardia lamblia
NFYTLCALLSKFPLLQTVILSNNSLQ

SEQ ID NO: 3164631 - protein, 25 aa, Giardia lamblia
NGAINCARLLLKREGGMRQNDNGTA

SEQ ID NO: 3164632 - protein, 18 aa, Giardia lamblia
NGALADGYAVHYFKHSHY

SEQ ID NO: 3164633 - protein, 19 aa, Giardia lamblia
NGAPIECIVVFPGESKDLD

SEQ ID NO: 3164634 - protein, 26 aa, Giardia lamblia
NGASRSALMLSVWHRFYDLALRLTAY

SEQ ID NO: 3164635 - protein, 19 aa, Giardia lamblia
NGCHIPFWFPFLLPPLAEL

SEQ ID NO: 3164636 - protein, 21 aa, Giardia lamblia
NGCQVLFLAAVCLFTNRGNIS

SEQ ID NO: 3164637 - protein, 20 aa, Giardia lamblia
NGCTALMYAAEAGFDTLCGA

SEQ ID NO: 3164638 - protein, 23 aa, Giardia lamblia
NGDEEIAFLLAPRESGIQNINGE

SEQ ID NO: 3164639 - protein, 22 aa, Giardia lamblia
NGDPTKRCGIFITMNPGYAGRV

SEQ ID NO: 3164640 - protein, 19 aa, Giardia lamblia
NGDVWRRFGRYSCLLNIDE

SEQ ID NO: 3164641 - protein, 26 aa, Giardia lamblia
NGELVCPRYIIAEACINAAKCVIDSG

SEQ ID NO: 3164642 - protein, 31 aa, Giardia lamblia
NGERFILCPRCGLRIPLSEIAKEMMINAGPP

SEQ ID NO: 3164643 - protein, 22 aa, Giardia lamblia
NGETALMYAVRNMDAEMTLLLG

SEQ ID NO: 3164644 - protein, 19 aa, Giardia lamblia
NGFSFGSLDGLGGSAGNGG

SEQ ID NO: 3164645 - protein, 17 aa, Giardia lamblia
NGFSPLMRAARNRSMDA

SEQ ID NO: 3164646 - protein, 39 aa, Giardia lamblia
NGFYKFTLEPIDHFVDVFLIKDRFRAALAEGYAKDMTRL

SEQ ID NO: 3164647 - protein, 23 aa, Giardia lamblia
NGGSCSKLGDGARREYLEKRLKH

SEQ ID NO: 3164648 - protein, 25 aa, Giardia lamblia
NGHELVVSILLEFEAGYQNVEGMTA

SEQ ID NO: 3164649 - protein, 20 aa, Giardia lamblia
NGHFRCVEILKESSKEIKRV

SEQ ID NO: 3164650 - protein, 19 aa, Giardia lamblia
NGHKNCVRILATSEKGLQN

SEQ ID NO: 3164651 - protein, 19 aa, Giardia lamblia
NGHLACVDLLLKEARATDN

SEQ ID NO: 3164652 - protein, 27 aa, Giardia lamblia
NGHLDCVKLLLSREIKMVTKISSTALS

SEQ ID NO: 3164653 - protein, 23 aa, Giardia lamblia
NGHLECCKLLAEAGEAGMVDERG

SEQ ID NO: 3164654 - protein, 23 aa, Giardia lamblia
NGHLECVKLLLEYEKGIRMRTTK

SEQ ID NO: 3164655 - protein, 30 aa, Giardia lamblia
NGHSECVRLLLDREAGMTLENGWTALMSAV

SEQ ID NO: 3164656 - protein, 19 aa, Giardia lamblia
NGHTKCIKSLIKESRMKDQ

SEQ ID NO: 3164657 - protein, 23 aa, Giardia lamblia
NGHWEVVEILAPFESGRRPDNGE

SEQ ID NO: 3164658 - protein, 20 aa, Giardia lamblia
NGICEILEILGSIINGFATP

SEQ ID NO: 3164659 - protein, 17 aa, Giardia lamblia
NGICSRKYAQVKTSIAI

SEQ ID NO: 3164660 - protein, 23 aa, Giardia lamblia
NGIPAELATSFGKDFIASLRSSS

SEQ ID NO: 3164661 - protein, 17 aa, Giardia lamblia
NGITFLCNFETGVRLSS

SEQ ID NO: 3164662 - protein, 25 aa, Giardia lamblia
NGITFRSSTKIAWEKMLIHKAPPRK

SEQ ID NO: 3164663 - protein, 18 aa, Giardia lamblia
NGITLLPATMVFNHMQRL

SEQ ID NO: 3164664 - protein, 25 aa, Giardia lamblia
NGKLPEDRLSAALAQDRVQRRSSSY

SEQ ID NO: 3164665 - protein, 26 aa, Giardia lamblia
NGKMIKECFKDSGVVINEIYDGSKSF

SEQ ID NO: 3164666 - protein, 37 aa, Giardia lamblia
NGKPNFLLDERFIYVAPLPCFIIIFIGAEVDTLHDSP

SEQ ID NO: 3164667 - protein, 24 aa, Giardia lamblia
NGKRIAPMKHVRVPRLKSSGRGPR

SEQ ID NO: 3164668 - protein, 39 aa, Giardia lamblia
NGKRPFSLSVSAFIRSLAPFQRLMLLKAINPGRLMFYIP

SEQ ID NO: 3164669 - protein, 24 aa, Giardia lamblia
NGKTALMYAAEWGYISIVRLLILK

SEQ ID NO: 3164670 - protein, 17 aa, Giardia lamblia
NGLAAVPINIWLDVIPQ

SEQ ID NO: 3164671 - protein, 27 aa, Giardia lamblia
NGLADRTRFNAARRRPLSSGDISHSKH

SEQ ID NO: 3164672 - protein, 30 aa, Giardia lamblia
NGLKGIFSTIVKWWSGRSFTTASAADLADE

SEQ ID NO: 3164673 - protein, 19 aa, Giardia lamblia
NGLMAIEVAIRCHNYAIAE

SEQ ID NO: 3164674 - protein, 20 aa, Giardia lamblia
NGLSSMMYAVWNNYTDIVEV

SEQ ID NO: 3164675 - protein, 19 aa, Giardia lamblia
NGLSTELGLLVFLNTSTCE

SEQ ID NO: 3164676 - protein, 22 aa, Giardia lamblia
NGMRDWRFFFSTSKIHDLSDGY

SEQ ID NO: 3164677 - protein, 18 aa, Giardia lamblia
NGNFISSVPLSFNKTHTP

SEQ ID NO: 3164678 - protein, 25 aa, Giardia lamblia
NGNGTYRWAYLGVKYKGEYKNGARN

SEQ ID NO: 3164679 - protein, 31 aa, Giardia lamblia
NGNIKSSTCPKCFKPRLTLVTKHNQDKDDTA

SEQ ID NO: 3164680 - protein, 19 aa, Giardia lamblia
NGNISLWLLEQQFERVYDS

SEQ ID NO: 3164681 - protein, 25 aa, Giardia lamblia
NGNLECLKILMPREYELVQASGKTV

SEQ ID NO: 3164682 - protein, 17 aa, Giardia lamblia
NGNPECVHEVMVRILNT

SEQ ID NO: 3164683 - protein, 27 aa, Giardia lamblia
NGPAMTFAALCDYHILVWNLADNMAPL

SEQ ID NO: 3164684 - protein, 20 aa, Giardia lamblia
NGPMSRAFHCAVPVGEGRLL

SEQ ID NO: 3164685 - protein, 19 aa, Giardia lamblia
NGRTALMMAAERGHTEIAS

SEQ ID NO: 3164686 - protein, 26 aa, Giardia lamblia
NGRVSFLAVYIGCWNKKLIRDIDNQA

SEQ ID NO: 3164687 - protein, 21 aa, Giardia lamblia
NGRYKTLFEEAGVVFSGLSTE

SEQ ID NO: 3164688 - protein, 20 aa, Giardia lamblia
NGSGESFAGIAVSAEDGEII

SEQ ID NO: 3164689 - protein, 17 aa, Giardia lamblia
NGSLCPAEVPSISQVEE

SEQ ID NO: 3164690 - protein, 24 aa, Giardia lamblia
NGSMLRPLVLSQWTKVELTNRTHN

SEQ ID NO: 3164691 - protein, 22 aa, Giardia lamblia
NGSRINPYILYQVDSSGSYYTW

SEQ ID NO: 3164692 - protein, 18 aa, Giardia lamblia
NGSWLGFIDREYVQRLIT

SEQ ID NO: 3164693 - protein, 27 aa, Giardia lamblia
NGTARAWLCGVIARLAKERDNSIVLLE

SEQ ID NO: 3164694 - protein, 18 aa, Giardia lamblia
NGTISLLEIRRGYKVAMG

SEQ ID NO: 3164695 - protein, 17 aa, Giardia lamblia
NGVDSIRLLGPREGKAF

SEQ ID NO: 3164696 - protein, 26 aa, Giardia lamblia
NGVEFLRFPLFYAKRHNTQQVFYLSG

SEQ ID NO: 3164697 - protein, 20 aa, Giardia lamblia
NGVFGDWFLDLVGKYTSSYT

SEQ ID NO: 3164698 - protein, 32 aa, Giardia lamblia
NGVKRELRRVIEYPIKIPKIFRHNVWPTTGLL

SEQ ID NO: 3164699 - protein, 17 aa, Giardia lamblia
NGVLWCPTCQSGKDVVK

SEQ ID NO: 3164700 - protein, 17 aa, Giardia lamblia
NGVTLAESIAFPRLANL

SEQ ID NO: 3164701 - protein, 19 aa, Giardia lamblia
NGVTSFAMIFKGNRTIHQV

SEQ ID NO: 3164702 - protein, 25 aa, Giardia lamblia
NGWHWSEKDFTDWAITEIKKRLTFQ

SEQ ID NO: 3164703 - protein, 24 aa, Giardia lamblia
NGYDCGVYMLLFMKMIARQFGPGY

SEQ ID NO: 3164704 - protein, 18 aa, Giardia lamblia
NGYGYGGFDRSCAPPPSS

SEQ ID NO: 3164705 - protein, 21 aa, Giardia lamblia
NGYPNCVAFLIEREVEVLNHS

SEQ ID NO: 3164706 - protein, 21 aa, Giardia lamblia
NGYTALMWAAKNGDARMVRAL

SEQ ID NO: 3164707 - protein, 22 aa, Giardia lamblia
NGYTCIHNACRHRDYQSMVDIV

SEQ ID NO: 3164708 - protein, 21 aa, Giardia lamblia
NHAAIRMLIMREMRMHTRNGF

SEQ ID NO: 3164709 - protein, 31 aa, Giardia lamblia
NHARKPPVICIGDLYFSRYNPLFHHRDTLQI

SEQ ID NO: 3164710 - protein, 21 aa, Giardia lamblia
NHCPFLKLVLTFDQVIDDIDL

SEQ ID NO: 3164711 - protein, 18 aa, Giardia lamblia
NHGLKYMLCQGSEPNTHM

SEQ ID NO: 3164712 - protein, 24 aa, Giardia lamblia
NHHICAKLLAPYEERCHDLTSKTA

SEQ ID NO: 3164713 - protein, 23 aa, Giardia lamblia
NHHPEALSVIIALQYLLYTAELD

SEQ ID NO: 3164714 - protein, 21 aa, Giardia lamblia
NHKELAAGVTYVLKHTSKDNV

SEQ ID NO: 3164715 - protein, 28 aa, Giardia lamblia
NHKQDRPRAGVKFDRNFKSLLESMDDSC

SEQ ID NO: 3164716 - protein, 17 aa, Giardia lamblia
NHLECTRLLLEEESGMQ

SEQ ID NO: 3164717 - protein, 25 aa, Giardia lamblia
NHLEIKFKWFTILLGRLPRIVEMDG

SEQ ID NO: 3164718 - protein, 17 aa, Giardia lamblia
NHLHVCHYLAPYEGGLR

SEQ ID NO: 3164719 - protein, 25 aa, Giardia lamblia
NHMIKTLPVLITFISNTVMSFSSRC

SEQ ID NO: 3164720 - protein, 26 aa, Giardia lamblia
NHNSFGRERINPVPTLSYGERLPAAS

SEQ ID NO: 3164721 - protein, 27 aa, Giardia lamblia
NIADGLSLCCFFAAPWVQTSPNTPDCS

SEQ ID NO: 3164722 - protein, 24 aa, Giardia lamblia
NIAEIQRLLSFPLTALSSYQYEVP

SEQ ID NO: 3164723 - protein, 22 aa, Giardia lamblia
NIAEMLRGLDIPTINSAESSTH

SEQ ID NO: 3164724 - protein, 23 aa, Giardia lamblia
NICFIKHTDCYLVAASSTNADIN

SEQ ID NO: 3164725 - protein, 17 aa, Giardia lamblia
NICKYCGAYKDLDRYSS

SEQ ID NO: 3164726 - protein, 26 aa, Giardia lamblia
NICLGHTPPYLRFCSYAHLRHLGYTV

SEQ ID NO: 3164727 - protein, 18 aa, Giardia lamblia
NICPLTLIQVRVVKVGER

SEQ ID NO: 3164728 - protein, 18 aa, Giardia lamblia
NIDAGRLFQIILFQRTPA

SEQ ID NO: 3164729 - protein, 24 aa, Giardia lamblia
NIDGGALPLGFAIDNLYFDTNGLI

SEQ ID NO: 3164730 - protein, 23 aa, Giardia lamblia
NIDLSCLRYINGIEVKDATLQRG

SEQ ID NO: 3164731 - protein, 23 aa, Giardia lamblia
NIDTVVVLLPYFGNERDVAGFSA

SEQ ID NO: 3164732 - protein, 19 aa, Giardia lamblia
NIECVRLLAEKEGDVRRTQ

SEQ ID NO: 3164733 - protein, 19 aa, Giardia lamblia
NIEKIKVAVEVAANTMDFW

SEQ ID NO: 3164734 - protein, 23 aa, Giardia lamblia
NIEKLISIRCRDELFDDPIYVNA

SEQ ID NO: 3164735 - protein, 17 aa, Giardia lamblia
NIELRSYLDECATVSKH

SEQ ID NO: 3164736 - protein, 17 aa, Giardia lamblia
NIELSDAKEALQIELAR

SEQ ID NO: 3164737 - protein, 18 aa, Giardia lamblia
NIESVKVFCRFRPFNEKF

SEQ ID NO: 3164738 - protein, 24 aa, Giardia lamblia
NIEVMKVIHPYFALRTDQSGFSAL

SEQ ID NO: 3164739 - protein, 23 aa, Giardia lamblia
NIGKGLVNHAIYSNKIREILSHY

SEQ ID NO: 3164740 - protein, 18 aa, Giardia lamblia
NIIRLIRVVVTRDHTHLI

SEQ ID NO: 3164741 - protein, 23 aa, Giardia lamblia
NIIRLKRKYTRASIITASSIGPV

SEQ ID NO: 3164742 - protein, 17 aa, Giardia lamblia
NIIYNLLYLASFGNNTQ

SEQ ID NO: 3164743 - protein, 21 aa, Giardia lamblia
NIKLSPEMHARMDAVSGCVCI

SEQ ID NO: 3164744 - protein, 18 aa, Giardia lamblia
NIKRAVYVFSNYTKDQYY

SEQ ID NO: 3164745 - protein, 24 aa, Giardia lamblia
NILQFAASFFKSRIMQDYVARSFG

SEQ ID NO: 3164746 - protein, 18 aa, Giardia lamblia
NILRAVSAGNEFSIVAIS

SEQ ID NO: 3164747 - protein, 18 aa, Giardia lamblia
NILRIRSALTTVLSSIDT

SEQ ID NO: 3164748 - protein, 19 aa, Giardia lamblia
NILTLSVDKRTSFTEVRTN

SEQ ID NO: 3164749 - protein, 21 aa, Giardia lamblia
NIMRRSIPIKKLVWVPMSQIQ

SEQ ID NO: 3164750 - protein, 17 aa, Giardia lamblia
NIMYPFHISINSSTQPN

SEQ ID NO: 3164751 - protein, 20 aa, Giardia lamblia
NINAPCVICMGKRCSSILLP

SEQ ID NO: 3164752 - protein, 21 aa, Giardia lamblia
NIPCLAHGLQIAMILHNKELF

SEQ ID NO: 3164753 - protein, 28 aa, Giardia lamblia
NIPEERIWKLFGQLLLALEYCHCPTKEN

SEQ ID NO: 3164754 - protein, 19 aa, Giardia lamblia
NIPLYYGLYSEFKGLHEMR

SEQ ID NO: 3164755 - protein, 27 aa, Giardia lamblia
NIPPGISELIIWVCLALASRRTYPEVE

SEQ ID NO: 3164756 - protein, 25 aa, Giardia lamblia
NIPVDARPALISKFSTDPQIRLFLL

SEQ ID NO: 3164757 - protein, 19 aa, Giardia lamblia
NIPVIIVGGLARLSNLTRR

SEQ ID NO: 3164758 - protein, 23 aa, Giardia lamblia
NIQALFRLICNRPEPELNVEMFI

SEQ ID NO: 3164759 - protein, 25 aa, Giardia lamblia
NIQAPRPLPAPTLGDFVQEEPPPEL

SEQ ID NO: 3164760 - protein, 22 aa, Giardia lamblia
NIRYVVDCGFVRKKQFHHTTGT

SEQ ID NO: 3164761 - protein, 25 aa, Giardia lamblia
NISDLQRWLGCYVYECNFRPISLQE

SEQ ID NO: 3164762 - protein, 24 aa, Giardia lamblia
NISEFLWFREAVIEILHSALTEYK

SEQ ID NO: 3164763 - protein, 24 aa, Giardia lamblia
NISFFKRLLSAMHYSEVFTILSET

SEQ ID NO: 3164764 - protein, 18 aa, Giardia lamblia
NISYLRGLLHLEVGAQDL

SEQ ID NO: 3164765 - protein, 23 aa, Giardia lamblia
NITELKATVSALMTQNGYSENTV

SEQ ID NO: 3164766 - protein, 21 aa, Giardia lamblia
NITILHLLNYVTINSIKSGGT

SEQ ID NO: 3164767 - protein, 18 aa, Giardia lamblia
NITLKFKTDESFVVTLDL

SEQ ID NO: 3164768 - protein, 25 aa, Giardia lamblia
NITPEAPQALSVRHPPRIIPSTAPK

SEQ ID NO: 3164769 - protein, 25 aa, Giardia lamblia
NITRRLRTLGVMYTINFINPTERNY

SEQ ID NO: 3164770 - protein, 18 aa, Giardia lamblia
NIVFPIACRIDAPAITPE

SEQ ID NO: 3164771 - protein, 19 aa, Giardia lamblia
NIVKGFKLDGSIRPSNMWL

SEQ ID NO: 3164772 - protein, 20 aa, Giardia lamblia
NIWSIGAIAYELATLRKPDF

SEQ ID NO: 3164773 - protein, 29 aa, Giardia lamblia
NIYARGLEGVRCLRSFLAELKSRPAQLLE

SEQ ID NO: 3164774 - protein, 24 aa, Giardia lamblia
NIYARPFIFSHIMDVYKMRGEFSV

SEQ ID NO: 3164775 - protein, 23 aa, Giardia lamblia
NKACTTEAILKTIYKAMVECDKK

SEQ ID NO: 3164776 - protein, 17 aa, Giardia lamblia
NKAFIPRRQKPNVSNAE

SEQ ID NO: 3164777 - protein, 19 aa, Giardia lamblia
NKATWPLVRALELSASEEA

SEQ ID NO: 3164778 - protein, 19 aa, Giardia lamblia
NKCKFFYRKYGSLAADLRS

SEQ ID NO: 3164779 - protein, 22 aa, Giardia lamblia
NKDEAFTPLSLRNSTASDGFIA

SEQ ID NO: 3164780 - protein, 19 aa, Giardia lamblia
NKDKAMVEYGFYAEFQSHE

SEQ ID NO: 3164781 - protein, 25 aa, Giardia lamblia
NKDLEIERLRVLLQDSLEKQGIRED

SEQ ID NO: 3164782 - protein, 23 aa, Giardia lamblia
NKEGRWLQFLLAIKGLHDAQKDF

SEQ ID NO: 3164783 - protein, 21 aa, Giardia lamblia
NKELIVAKGRIRTLVSELRAA

SEQ ID NO: 3164784 - protein, 27 aa, Giardia lamblia
NKENITLVCPIEITFSYQQIRSTATVD

SEQ ID NO: 3164785 - protein, 28 aa, Giardia lamblia
NKERLFIDWEMNVFLPIQQRIMNEVADR

SEQ ID NO: 3164786 - protein, 24 aa, Giardia lamblia
NKEVLRLWYSYKRALYDMMRGAID

SEQ ID NO: 3164787 - protein, 28 aa, Giardia lamblia
NKEYKRRELQGFARMAGIRANSRNDELY

SEQ ID NO: 3164788 - protein, 29 aa, Giardia lamblia
NKFFNYRTKLDMLRCLYADNGLTQPLEHV

SEQ ID NO: 3164789 - protein, 19 aa, Giardia lamblia
NKFIKDLRKTPGAYAKIQR

SEQ ID NO: 3164790 - protein, 23 aa, Giardia lamblia
NKFVGMCALSFAIDKKHLHVVRY

SEQ ID NO: 3164791 - protein, 35 aa, Giardia lamblia
NKGFTALMFAARFGFDECVEILAPVEAGEQTPSGW

SEQ ID NO: 3164792 - protein, 18 aa, Giardia lamblia
NKGKARLVVLSADALPLE

SEQ ID NO: 3164793 - protein, 17 aa, Giardia lamblia
NKGYCVCILHIVDSYME

SEQ ID NO: 3164794 - protein, 26 aa, Giardia lamblia
NKGYGIWECRIPFYVNQELNMLHCPI

SEQ ID NO: 3164795 - protein, 24 aa, Giardia lamblia
NKHADCIRLLIDFEQNSRDIYGKA

SEQ ID NO: 3164796 - protein, 21 aa, Giardia lamblia
NKHIYSVYLLYLLSVLEHSIT

SEQ ID NO: 3164797 - protein, 18 aa, Giardia lamblia
NKIIWKAEIEQLDFHHYL

SEQ ID NO: 3164798 - protein, 26 aa, Giardia lamblia
NKILERIHLIPGLKLEMLRSDTEPKR

SEQ ID NO: 3164799 - protein, 21 aa, Giardia lamblia
NKIQCVRMLKDYELGFVNDSG

SEQ ID NO: 3164800 - protein, 18 aa, Giardia lamblia
NKIVYRLNETAVRKQPTL

SEQ ID NO: 3164801 - protein, 29 aa, Giardia lamblia
NKKEDCSISDDFNCFLFRYMKKKYCTSSE

SEQ ID NO: 3164802 - protein, 27 aa, Giardia lamblia
NKKLKSMLIELKRSFNQGNISAIIEDN

SEQ ID NO: 3164803 - protein, 17 aa, Giardia lamblia
NKKLPVHIFDALGKATY

SEQ ID NO: 3164804 - protein, 21 aa, Giardia lamblia
NKKSNAFGTVFVIEKKLVEKF

SEQ ID NO: 3164805 - protein, 27 aa, Giardia lamblia
NKLCSYGAGLTALMIAANFNFAPACSI

SEQ ID NO: 3164806 - protein, 24 aa, Giardia lamblia
NKLDPRFVSNFSVLNISTPIEDSL

SEQ ID NO: 3164807 - protein, 30 aa, Giardia lamblia
NKLFKSLVSILEFRKQAALERQEDHAAEMR

SEQ ID NO: 3164808 - protein, 25 aa, Giardia lamblia
NKLGQGDVWKKCAQISAISCIDSQS

SEQ ID NO: 3164809 - protein, 18 aa, Giardia lamblia
NKLLIKRNTIELNDTGQM

SEQ ID NO: 3164810 - protein, 17 aa, Giardia lamblia
NKLLPGVLSSSSQSKLS

SEQ ID NO: 3164811 - protein, 23 aa, Giardia lamblia
NKLNAMASIFTRDHYTTVKKPVE

SEQ ID NO: 3164812 - protein, 27 aa, Giardia lamblia
NKLRSSCSLREAVNFFTTRQGTFSQSK

SEQ ID NO: 3164813 - protein, 25 aa, Giardia lamblia
NKLVLCSCRLMLFQSILSQLLADLN

SEQ ID NO: 3164814 - protein, 17 aa, Giardia lamblia
NKLVMRLSGKLGNKLSF

SEQ ID NO: 3164815 - protein, 17 aa, Giardia lamblia
NKMPPDLHYFVKFDESI

SEQ ID NO: 3164816 - protein, 27 aa, Giardia lamblia
NKNDTEWPKLACFTLDSGQQVMDLLDY

SEQ ID NO: 3164817 - protein, 23 aa, Giardia lamblia
NKNGRSALMIAVFNNSVDCVDIL

SEQ ID NO: 3164818 - protein, 25 aa, Giardia lamblia
NKNLPRFAVAHAIQGDFNSVVPLPS

SEQ ID NO: 3164819 - protein, 21 aa, Giardia lamblia
NKNRKVCLLEIGCGVRIPTIR

SEQ ID NO: 3164820 - protein, 22 aa, Giardia lamblia
NKNSRTALMIAVEKGSAEAASI

SEQ ID NO: 3164821 - protein, 19 aa, Giardia lamblia
NKPDCVRALAPKYAGATTT

SEQ ID NO: 3164822 - protein, 23 aa, Giardia lamblia
NKPIIKVNCCYIMNPELACKQAK

SEQ ID NO: 3164823 - protein, 19 aa, Giardia lamblia
NKPLISLLCEAEAGISNYM

SEQ ID NO: 3164824 - protein, 19 aa, Giardia lamblia
NKQDCVKLLVKHKRERGAL

SEQ ID NO: 3164825 - protein, 25 aa, Giardia lamblia
NKRCNCGRTALMYATKNAQLAAAKE

SEQ ID NO: 3164826 - protein, 17 aa, Giardia lamblia
NKREKKFAIAELQITQY

SEQ ID NO: 3164827 - protein, 20 aa, Giardia lamblia
NKRVAVRILLPHEYESLNGF

SEQ ID NO: 3164828 - protein, 24 aa, Giardia lamblia
NKSCCKCPYCRTPIETILDLAECN

SEQ ID NO: 3164829 - protein, 29 aa, Giardia lamblia
NKSRLSDRVRMLASMAVFLWKSPALMLQP

SEQ ID NO: 3164830 - protein, 26 aa, Giardia lamblia
NKTIKLFIHYYCEFLATHFIRVAYES

SEQ ID NO: 3164831 - protein, 17 aa, Giardia lamblia
NKTITYNMVKGILSPTH

SEQ ID NO: 3164832 - protein, 17 aa, Giardia lamblia
NKTMMKVAMYIKEDGTA

SEQ ID NO: 3164833 - protein, 37 aa, Giardia lamblia
NKTPMSIGLIYWLLAREVLRLKGSISRTEEWDVKPDL

SEQ ID NO: 3164834 - protein, 23 aa, Giardia lamblia
NKTVDAVAVIFARVIQQNEQYLR

SEQ ID NO: 3164835 - protein, 23 aa, Giardia lamblia
NKVAEPMCSLSFLQEELGQLSTE

SEQ ID NO: 3164836 - protein, 18 aa, Giardia lamblia
NKVDACFTTNIFDSAPHA

SEQ ID NO: 3164837 - protein, 22 aa, Giardia lamblia
NKVHYLVACIFVFLRPDMNYNE

SEQ ID NO: 3164838 - protein, 24 aa, Giardia lamblia
NKVMRFSDQFLARVASQLDLKLLF

SEQ ID NO: 3164839 - protein, 17 aa, Giardia lamblia
NKVPLDFTNLRNETGPK

SEQ ID NO: 3164840 - protein, 19 aa, Giardia lamblia
NLAATWSFPVHVFSPSSMY

SEQ ID NO: 3164841 - protein, 17 aa, Giardia lamblia
NLAELTLLIARKEATDR

SEQ ID NO: 3164842 - protein, 19 aa, Giardia lamblia
NLAIDICLVQEILQGAFLM

SEQ ID NO: 3164843 - protein, 26 aa, Giardia lamblia
NLAKLGYSKARLESSRDNLLPRNTSR

SEQ ID NO: 3164844 - protein, 19 aa, Giardia lamblia
NLARSSSCQDFFAHMKSFS

SEQ ID NO: 3164845 - protein, 19 aa, Giardia lamblia
NLASGALGRLVLTADDKAS

SEQ ID NO: 3164846 - protein, 18 aa, Giardia lamblia
NLASILVRTEGCIRNNYG

SEQ ID NO: 3164847 - protein, 24 aa, Giardia lamblia
NLCKTADGLAIMLAKTPEMQQRIA

SEQ ID NO: 3164848 - protein, 20 aa, Giardia lamblia
NLCRKVELAQEIQRISAQFS

SEQ ID NO: 3164849 - protein, 25 aa, Giardia lamblia
NLDHISCIRFYISTGDLYSAGEAYG

SEQ ID NO: 3164850 - protein, 27 aa, Giardia lamblia
NLDVAIDCLRDCFGLKDVRHGNGDLEQ

SEQ ID NO: 3164851 - protein, 17 aa, Giardia lamblia
NLEGIKLLLETPSEVGA

SEQ ID NO: 3164852 - protein, 22 aa, Giardia lamblia
NLEGMRMCMHLARRRNAQGQTA

SEQ ID NO: 3164853 - protein, 32 aa, Giardia lamblia
NLEGRWARGEVVDLIDFFSRPQVQVLLSDAIR

SEQ ID NO: 3164854 - protein, 19 aa, Giardia lamblia
NLEIYKKGAQSIIFCKTRK

SEQ ID NO: 3164855 - protein, 19 aa, Giardia lamblia
NLEMCRLLVEKEAGMCSHD

SEQ ID NO: 3164856 - protein, 19 aa, Giardia lamblia
NLEPYLKRCNIEIDELTVH

SEQ ID NO: 3164857 - protein, 19 aa, Giardia lamblia
NLGAPAWALKVVQCSSFLV

SEQ ID NO: 3164858 - protein, 23 aa, Giardia lamblia
NLGELWAIADYINPGYFGNRTQF

SEQ ID NO: 3164859 - protein, 17 aa, Giardia lamblia
NLGESWRSALQPALESF

SEQ ID NO: 3164860 - protein, 25 aa, Giardia lamblia
NLGGHVYCRACNGAPASQGVLTEAE

SEQ ID NO: 3164861 - protein, 23 aa, Giardia lamblia
NLGIVRALVYFKAELMLVNNGPY

SEQ ID NO: 3164862 - protein, 19 aa, Giardia lamblia
NLGNTCFMNSGLQVLLSSK

SEQ ID NO: 3164863 - protein, 22 aa, Giardia lamblia
NLGYPCVSQLLLVKTLQRRFFE

SEQ ID NO: 3164864 - protein, 17 aa, Giardia lamblia
NLHAIEVTNLLKSIEQL

SEQ ID NO: 3164865 - protein, 26 aa, Giardia lamblia
NLHATILLLREFKDLKVLSLENNPLV

SEQ ID NO: 3164866 - protein, 18 aa, Giardia lamblia
NLHGTIFSLPAFASKKYL

SEQ ID NO: 3164867 - protein, 17 aa, Giardia lamblia
NLHILPLRQLRSNGQDA

SEQ ID NO: 3164868 - protein, 18 aa, Giardia lamblia
NLIELARSNPHNSILHSA

SEQ ID NO: 3164869 - protein, 26 aa, Giardia lamblia
NLIFFECIQSIYSICRQIEPNYVLDA

SEQ ID NO: 3164870 - protein, 18 aa, Giardia lamblia
NLIGVQVLAGTECGLQDA

SEQ ID NO: 3164871 - protein, 18 aa, Giardia lamblia
NLIKDLRSLKGITHKNIL

SEQ ID NO: 3164872 - protein, 24 aa, Giardia lamblia
NLIKEMKERIAASSVYDTVFLTTS

SEQ ID NO: 3164873 - protein, 17 aa, Giardia lamblia
NLKARFGAKDARKQAEL

SEQ ID NO: 3164874 - protein, 17 aa, Giardia lamblia
NLKEKITECDGLAVKLS

SEQ ID NO: 3164875 - protein, 30 aa, Giardia lamblia
NLKIKIPRCPGCLSPIMPHALMFDEQYVSH

SEQ ID NO: 3164876 - protein, 26 aa, Giardia lamblia
NLKVCELLIERECCYVLRDGTTALML

SEQ ID NO: 3164877 - protein, 27 aa, Giardia lamblia
NLLAAGIKIKTGFGLESRQGVDVDFPS

SEQ ID NO: 3164878 - protein, 21 aa, Giardia lamblia
NLLLACLKSGTSTIKRISDET

SEQ ID NO: 3164879 - protein, 20 aa, Giardia lamblia
NLLLPDLWAPDVTGLMRAAA

SEQ ID NO: 3164880 - protein, 31 aa, Giardia lamblia
NLLPKVDKIIICGGMSFTFLKKLKGMNIANS

SEQ ID NO: 3164881 - protein, 17 aa, Giardia lamblia
NLLPMPMAIDGDLQTQE

SEQ ID NO: 3164882 - protein, 24 aa, Giardia lamblia
NLLQEFPVDFIAHGNYTRLLIAYM

SEQ ID NO: 3164883 - protein, 24 aa, Giardia lamblia
NLLRCSFGTTKFCTSFLDGKQCAN

SEQ ID NO: 3164884 - protein, 17 aa, Giardia lamblia
NLLSVKKRHEFSVLRNP

SEQ ID NO: 3164885 - protein, 23 aa, Giardia lamblia
NLLTDLCSSCFATVTELHATENR

SEQ ID NO: 3164886 - protein, 24 aa, Giardia lamblia
NLLYETLSTLSFAARVKNVKNVAV

SEQ ID NO: 3164887 - protein, 20 aa, Giardia lamblia
NLNLKEPRILSVPEDQDTQK

SEQ ID NO: 3164888 - protein, 23 aa, Giardia lamblia
NLNTPCWKCDLSTYASAGISADF

SEQ ID NO: 3164889 - protein, 17 aa, Giardia lamblia
NLPEISSIVVLDSNRTL

SEQ ID NO: 3164890 - protein, 23 aa, Giardia lamblia
NLPIPRRDSAAGLMPSKGLAYAD

SEQ ID NO: 3164891 - protein, 25 aa, Giardia lamblia
NLPLKDLKPLGVIPMDTKILLAISG

SEQ ID NO: 3164892 - protein, 21 aa, Giardia lamblia
NLPLNTWYLGDRRLMSISSSV

SEQ ID NO: 3164893 - protein, 19 aa, Giardia lamblia
NLPLVKALMKVEGGMQDND

SEQ ID NO: 3164894 - protein, 29 aa, Giardia lamblia
NLPPGPRGSLKIDISFEVDENGLIHVKAV

SEQ ID NO: 3164895 - protein, 29 aa, Giardia lamblia
NLQEVIALPELLKSVGSLTLFSISSIKAL

SEQ ID NO: 3164896 - protein, 27 aa, Giardia lamblia
NLQHFQARLPLSVSNVFSEERVTHISI

SEQ ID NO: 3164897 - protein, 20 aa, Giardia lamblia
NLQLPGLGNLVFDRRTRCYK

SEQ ID NO: 3164898 - protein, 23 aa, Giardia lamblia
NLQRLRNAVNIVVMRNRAQRALR

SEQ ID NO: 3164899 - protein, 26 aa, Giardia lamblia
NLQSVEYRFAVSIVDNASLSINIAST

SEQ ID NO: 3164900 - protein, 19 aa, Giardia lamblia
NLRAFAITTSHAFNQLQSG

SEQ ID NO: 3164901 - protein, 24 aa, Giardia lamblia
NLRRMIKHIYGELDVDAVLEAAGL

SEQ ID NO: 3164902 - protein, 26 aa, Giardia lamblia
NLRRTAIQNIITWSFEMWRRERQAQW

SEQ ID NO: 3164903 - protein, 21 aa, Giardia lamblia
NLRSPICAILGHVDTGKTSLL

SEQ ID NO: 3164904 - protein, 26 aa, Giardia lamblia
NLRYLKKRNVLGWTALMYAAAAGHAD

SEQ ID NO: 3164905 - protein, 17 aa, Giardia lamblia
NLSELFNDCEFTRFDTW

SEQ ID NO: 3164906 - protein, 19 aa, Giardia lamblia
NLSERYFRTSIGRKDLYLI

SEQ ID NO: 3164907 - protein, 24 aa, Giardia lamblia
NLSGRHSRPLLPHHSDGIIFTAVN

SEQ ID NO: 3164908 - protein, 18 aa, Giardia lamblia
NLSQLECDFTLKIEPSRW

SEQ ID NO: 3164909 - protein, 25 aa, Giardia lamblia
NLSQVCREITSLIGRYPIVAIDTEF

SEQ ID NO: 3164910 - protein, 28 aa, Giardia lamblia
NLSRFLLEYSNPILLSIMAPFIEFRDNT

SEQ ID NO: 3164911 - protein, 24 aa, Giardia lamblia
NLTDLKRLTCPTGLKNATTLTKLV

SEQ ID NO: 3164912 - protein, 18 aa, Giardia lamblia
NLTLSVSIMEDGPRPYLG

SEQ ID NO: 3164913 - protein, 20 aa, Giardia lamblia
NLTQEFRLVLSCFSSARLST

SEQ ID NO: 3164914 - protein, 28 aa, Giardia lamblia
NLTTEQFLRFELEREKRKSQQLQQAAIY

SEQ ID NO: 3164915 - protein, 22 aa, Giardia lamblia
NLVATWCYLPIQGGLHDQDGCT

SEQ ID NO: 3164916 - protein, 29 aa, Giardia lamblia
NLVEENYTWAIFCCQRLLGDAASNADTDI

SEQ ID NO: 3164917 - protein, 29 aa, Giardia lamblia
NLVFCAEALPLFCRAFTFRKRVKSLVFTF

SEQ ID NO: 3164918 - protein, 23 aa, Giardia lamblia
NLWTDNIFCLQKYMLTKLQMDKK

SEQ ID NO: 3164919 - protein, 19 aa, Giardia lamblia
NLYTDRILAEWSPESLKKI

SEQ ID NO: 3164920 - protein, 17 aa, Giardia lamblia
NMAGIRSALLGYNGTAS

SEQ ID NO: 3164921 - protein, 17 aa, Giardia lamblia
NMALRRSHIDQGYDPSG

SEQ ID NO: 3164922 - protein, 20 aa, Giardia lamblia
NMECAKLLATYEAGQQDKQG

SEQ ID NO: 3164923 - protein, 17 aa, Giardia lamblia
NMIKARHISVGGQIVNI

SEQ ID NO: 3164924 - protein, 22 aa, Giardia lamblia
NMKDLFKYRPLLTTVDGHMSLM

SEQ ID NO: 3164925 - protein, 25 aa, Giardia lamblia
NMMDEVDYVPGFGPVRFRYTSVTPN

SEQ ID NO: 3164926 - protein, 20 aa, Giardia lamblia
NMPKAMSVASGRRSSTDKSM

SEQ ID NO: 3164927 - protein, 22 aa, Giardia lamblia
NMRKELDDILAPLGPPEGSSVA

SEQ ID NO: 3164928 - protein, 19 aa, Giardia lamblia
NMRPRCMRYTETTTVRSTS

SEQ ID NO: 3164929 - protein, 19 aa, Giardia lamblia
NMSLCRALLAKEIGLQSKY

SEQ ID NO: 3164930 - protein, 19 aa, Giardia lamblia
NMSLLVKEMVEAMYQGVSV

SEQ ID NO: 3164931 - protein, 24 aa, Giardia lamblia
NMVPTRLLKSLPFENQHEIVIAKN

SEQ ID NO: 3164932 - protein, 25 aa, Giardia lamblia
NNAHLKHWICFDSPVDALWIENLNT

SEQ ID NO: 3164933 - protein, 26 aa, Giardia lamblia
NNAIARCVACCRPVALLRQALLLLLG

SEQ ID NO: 3164934 - protein, 17 aa, Giardia lamblia
NNARTALLQKEHDEQLA

SEQ ID NO: 3164935 - protein, 18 aa, Giardia lamblia
NNCCPLFFTPQNIFIDGE

SEQ ID NO: 3164936 - protein, 23 aa, Giardia lamblia
NNDGECAMHMAVKHGYLEIVQLL

SEQ ID NO: 3164937 - protein, 18 aa, Giardia lamblia
NNDHTALMEAARLGNVSR

SEQ ID NO: 3164938 - protein, 22 aa, Giardia lamblia
NNEHAVRFLVKHEANLLTVEGY

SEQ ID NO: 3164939 - protein, 25 aa, Giardia lamblia
NNERALMLGKFCFENVYTLAHTDCL

SEQ ID NO: 3164940 - protein, 23 aa, Giardia lamblia
NNESASWSRLSFIPFEPRKSSAY

SEQ ID NO: 3164941 - protein, 26 aa, Giardia lamblia
NNEVDSLKRLLARKEADLEEVHTRIT

SEQ ID NO: 3164942 - protein, 22 aa, Giardia lamblia
NNEYASACARYEDSTTTCEAGV

SEQ ID NO: 3164943 - protein, 17 aa, Giardia lamblia
NNFCTRKNIDLLVDTAI

SEQ ID NO: 3164944 - protein, 22 aa, Giardia lamblia
NNFELCKLLAIYEKDVLLPNKR

SEQ ID NO: 3164945 - protein, 21 aa, Giardia lamblia
NNFLMEMHNRITATINDIDYD

SEQ ID NO: 3164946 - protein, 19 aa, Giardia lamblia
NNFLSMWRQHFVVAEDMLE

SEQ ID NO: 3164947 - protein, 19 aa, Giardia lamblia
NNFVAFKIFSRMNDRQLED

SEQ ID NO: 3164948 - protein, 23 aa, Giardia lamblia
NNGTCGRADIRLSAEEIEREHEE

SEQ ID NO: 3164949 - protein, 25 aa, Giardia lamblia
NNHPECVKLLLGREAGMHDKYGWTA

SEQ ID NO: 3164950 - protein, 24 aa, Giardia lamblia
NNHVECTMILKPYEAGMQTPSGLT

SEQ ID NO: 3164951 - protein, 24 aa, Giardia lamblia
NNHWECVELLAPREAGLLRPGKHT

SEQ ID NO: 3164952 - protein, 24 aa, Giardia lamblia
NNIACTRAIVDLVRHSQEDFQFAM

SEQ ID NO: 3164953 - protein, 18 aa, Giardia lamblia
NNIKLIMGILKKMTSSCA

SEQ ID NO: 3164954 - protein, 17 aa, Giardia lamblia
NNINTFFSFSRQTGLLR

SEQ ID NO: 3164955 - protein, 18 aa, Giardia lamblia
NNISRVWSLFNDLVPFLV

SEQ ID NO: 3164956 - protein, 35 aa, Giardia lamblia
NNKTPALWLKYSYPCLKPLASYYIDLLDRISFINV

SEQ ID NO: 3164957 - protein, 22 aa, Giardia lamblia
NNLEAAQLLVEYEKGLTTADGS

SEQ ID NO: 3164958 - protein, 21 aa, Giardia lamblia
NNLECARLLFEKEGGMKSSDG

SEQ ID NO: 3164959 - protein, 22 aa, Giardia lamblia
NNLEEYKPFFATLYNSILALLF

SEQ ID NO: 3164960 - protein, 24 aa, Giardia lamblia
NNLHVIPFLLGELGCVNTTGQTAL

SEQ ID NO: 3164961 - protein, 33 aa, Giardia lamblia
NNLLKRSFLLIQSWCLYEARIVGGHSQMLSSYA

SEQ ID NO: 3164962 - protein, 19 aa, Giardia lamblia
NNLQLARALLMYAHAAAGM

SEQ ID NO: 3164963 - protein, 22 aa, Giardia lamblia
NNLRATCIYGSLDQKQRTLALS

SEQ ID NO: 3164964 - protein, 17 aa, Giardia lamblia
NNLRPTYNPFIDDFIPL

SEQ ID NO: 3164965 - protein, 23 aa, Giardia lamblia
NNLWLCLYCGHVGCGRAQAYSEL

SEQ ID NO: 3164966 - protein, 17 aa, Giardia lamblia
NNMDWGKFAEFTTEEDK

SEQ ID NO: 3164967 - protein, 17 aa, Giardia lamblia
NNMLAMVESFRIRTAET

SEQ ID NO: 3164968 - protein, 25 aa, Giardia lamblia
NNNGECIRLLLKKEARMQDRSGMTA

SEQ ID NO: 3164969 - protein, 26 aa, Giardia lamblia
NNNVACIKLLLSREAGLLTNAKFVTG

SEQ ID NO: 3164970 - protein, 24 aa, Giardia lamblia
NNPHWDMIQVFILDMDLLDKLGDA

SEQ ID NO: 3164971 - protein, 26 aa, Giardia lamblia
NNPMFTFKIGQPFGDNALVMAKARII

SEQ ID NO: 3164972 - protein, 18 aa, Giardia lamblia
NNPPARRRSSLFPNQQNT

SEQ ID NO: 3164973 - protein, 24 aa, Giardia lamblia
NNRASCVDILLPLECNMTSNDGST

SEQ ID NO: 3164974 - protein, 17 aa, Giardia lamblia
NNRGICCGSPYCISMDS

SEQ ID NO: 3164975 - protein, 42 aa, Giardia lamblia
NNRIPFFLPAIRVFKGHIADVISCSWSKSNFLATGSLDKTVK

SEQ ID NO: 3164976 - protein, 20 aa, Giardia lamblia
NNRPIFCKILVSAEKSISNY

SEQ ID NO: 3164977 - protein, 17 aa, Giardia lamblia
NNRPMLCRLLAIEEAKL

SEQ ID NO: 3164978 - protein, 20 aa, Giardia lamblia
NNSDCVRLLVKKEGGMQTSY

SEQ ID NO: 3164979 - protein, 21 aa, Giardia lamblia
NNSKFLVPVVSFFEIYGGKLF

SEQ ID NO: 3164980 - protein, 25 aa, Giardia lamblia
NNSLECVKLLLKKEGRMQTNSGETA

SEQ ID NO: 3164981 - protein, 26 aa, Giardia lamblia
NNSSLDRPNPWMARGSGSQWEDRHPR

SEQ ID NO: 3164982 - protein, 26 aa, Giardia lamblia
NNSYWAYRLMCVKNLLTSGEAAYEDE

SEQ ID NO: 3164983 - protein, 18 aa, Giardia lamblia
NNTACCKVLAPLERLVIL

SEQ ID NO: 3164984 - protein, 22 aa, Giardia lamblia
NNTCAFKIAALNGQTEICKILY

SEQ ID NO: 3164985 - protein, 20 aa, Giardia lamblia
NNTDLCRLLAPLESGITTDT

SEQ ID NO: 3164986 - protein, 19 aa, Giardia lamblia
NNTLFCNILLISTLSRCIT

SEQ ID NO: 3164987 - protein, 19 aa, Giardia lamblia
NNTLKYLGLNGNFIGLAGI

SEQ ID NO: 3164988 - protein, 17 aa, Giardia lamblia
NNVKFLASIFTKDLLDF

SEQ ID NO: 3164989 - protein, 26 aa, Giardia lamblia
NNWFRACAQGDISLVERLKARKKGIY

SEQ ID NO: 3164990 - protein, 24 aa, Giardia lamblia
NNWKDLCFQYMKYGDPTQEKLTPD

SEQ ID NO: 3164991 - protein, 26 aa, Giardia lamblia
NNYKLWRYLFCPVPVLEIKTKKTLDL

SEQ ID NO: 3164992 - protein, 25 aa, Giardia lamblia
NNYLEMAQLPFGSAQEWFDAVKRRD

SEQ ID NO: 3164993 - protein, 25 aa, Giardia lamblia
NPANPPNICFKKIGGRRGAMFSFGL

SEQ ID NO: 3164994 - protein, 17 aa, Giardia lamblia
NPCRSKAASALELHLIL

SEQ ID NO: 3164995 - protein, 30 aa, Giardia lamblia
NPDIQRLRMESADLKRQVCTLQTANNSLQA

SEQ ID NO: 3164996 - protein, 30 aa, Giardia lamblia
NPDIRKAVVYCLVDLYYLVGEDFTPYLNRL

SEQ ID NO: 3164997 - protein, 19 aa, Giardia lamblia
NPDMRAVSFFDTDTVDRLV

SEQ ID NO: 3164998 - protein, 24 aa, Giardia lamblia
NPDPKKRPTAFEMRTIPEIANILR

SEQ ID NO: 3164999 - protein, 24 aa, Giardia lamblia
NPDPKLRLQHSIKRLIYHNKTVQE

SEQ ID NO: 3165000 - protein, 17 aa, Giardia lamblia
NPEALSYLSEFIKESGE

SEQ ID NO: 3165001 - protein, 22 aa, Giardia lamblia
NPERKRARTTSRIGSPQFYHIA

SEQ ID NO: 3165002 - protein, 19 aa, Giardia lamblia
NPESIRIAKVPGRSITDSF

SEQ ID NO: 3165003 - protein, 25 aa, Giardia lamblia
NPETLRFLLQNVRWWLQEFKIDGFR

SEQ ID NO: 3165004 - protein, 23 aa, Giardia lamblia
NPFKRRMQMMALSFDEFQEVLAR

SEQ ID NO: 3165005 - protein, 17 aa, Giardia lamblia
NPGKVGVNYAFLRPEMF

SEQ ID NO: 3165006 - protein, 29 aa, Giardia lamblia
NPGMRKRHWYRISREINIDLSCLRYINGI

SEQ ID NO: 3165007 - protein, 27 aa, Giardia lamblia
NPGRECLPKILGGIMGTPVRLPASRQR

SEQ ID NO: 3165008 - protein, 26 aa, Giardia lamblia
NPGSLKANGLWSFGNEVCQWKADRKC

SEQ ID NO: 3165009 - protein, 17 aa, Giardia lamblia
NPHERITVMPLLHILEL

SEQ ID NO: 3165010 - protein, 21 aa, Giardia lamblia
NPHVYPVIILNGGIKNRQEAD

SEQ ID NO: 3165011 - protein, 21 aa, Giardia lamblia
NPILEYYKYIVFGAIEQEMIS

SEQ ID NO: 3165012 - protein, 26 aa, Giardia lamblia
NPILKKRAATILSTYVTKLSFIEALN

SEQ ID NO: 3165013 - protein, 23 aa, Giardia lamblia
NPKERLTASMLMQVLKPQDEFSS

SEQ ID NO: 3165014 - protein, 17 aa, Giardia lamblia
NPKSVKVLEILGQGVGI

SEQ ID NO: 3165015 - protein, 17 aa, Giardia lamblia
NPLHEIFVLCPPITDSK

SEQ ID NO: 3165016 - protein, 17 aa, Giardia lamblia
NPMLVLPLSTRFRGRIE

SEQ ID NO: 3165017 - protein, 20 aa, Giardia lamblia
NPNAEPLFYPSIKADPRHPS

SEQ ID NO: 3165018 - protein, 19 aa, Giardia lamblia
NPNNRCVLVPIPGIVGEVS

SEQ ID NO: 3165019 - protein, 19 aa, Giardia lamblia
NPPCVSFLLPYELHMADKN

SEQ ID NO: 3165020 - protein, 17 aa, Giardia lamblia
NPPRLLFLHGYSFFTDL

SEQ ID NO: 3165021 - protein, 19 aa, Giardia lamblia
NPPSGTRAFGRKAFDLGTS

SEQ ID NO: 3165022 - protein, 30 aa, Giardia lamblia
NPPSPDLLPFECAPYVKSLEDFISAVNTLN

SEQ ID NO: 3165023 - protein, 27 aa, Giardia lamblia
NPRFRNVRFTPALKLVLPNSLCLSNVA

SEQ ID NO: 3165024 - protein, 20 aa, Giardia lamblia
NPRILLLDCPLEYKKAQSMM

SEQ ID NO: 3165025 - protein, 21 aa, Giardia lamblia
NPRIVSAPLLLYDGKNLTGLK

SEQ ID NO: 3165026 - protein, 23 aa, Giardia lamblia
NPRQFKLPMSIPAKGTSDISVTT

SEQ ID NO: 3165027 - protein, 33 aa, Giardia lamblia
NPRQRREAPVFSGRIWFNSLMQFIEAVEQKLQS

SEQ ID NO: 3165028 - protein, 18 aa, Giardia lamblia
NPSAELLRKLSLTELQRV

SEQ ID NO: 3165029 - protein, 22 aa, Giardia lamblia
NPSAHKGIVCLIKVKEIPEIAH

SEQ ID NO: 3165030 - protein, 24 aa, Giardia lamblia
NPSLKAHVYTAAYVDTLCCNSNSS

SEQ ID NO: 3165031 - protein, 24 aa, Giardia lamblia
NPSPETIVFLLGQIVLRLILTTDD

SEQ ID NO: 3165032 - protein, 22 aa, Giardia lamblia
NPSRLRLAVVRFTKTQAQNLGI

SEQ ID NO: 3165033 - protein, 21 aa, Giardia lamblia
NPSSLLIRIYAMFTITTGKPG

SEQ ID NO: 3165034 - protein, 24 aa, Giardia lamblia
NPSVKKASKSVCCSLETHADIEAY

SEQ ID NO: 3165035 - protein, 21 aa, Giardia lamblia
NPTEEFAAFVIFSDGYNATPI

SEQ ID NO: 3165036 - protein, 22 aa, Giardia lamblia
NPTLAGYEWFLLQYQLSIFRLA

SEQ ID NO: 3165037 - protein, 19 aa, Giardia lamblia
NPTVDIYEILAIRSIIGTD

SEQ ID NO: 3165038 - protein, 26 aa, Giardia lamblia
NPTWASIKLGIFLCMNCAGRHRSYGT

SEQ ID NO: 3165039 - protein, 22 aa, Giardia lamblia
NPVGEVFLHPSAIFFLTTNTPL

SEQ ID NO: 3165040 - protein, 22 aa, Giardia lamblia
NPVVFKALYIKESGLLKGDGFT

SEQ ID NO: 3165041 - protein, 20 aa, Giardia lamblia
NPYERLGLLPRSIVELFNLI

SEQ ID NO: 3165042 - protein, 23 aa, Giardia lamblia
NPYKVQTAWYLKEYHTRRGDQVL

SEQ ID NO: 3165043 - protein, 19 aa, Giardia lamblia
NPYLPFVLCSTKLADEAAI

SEQ ID NO: 3165044 - protein, 18 aa, Giardia lamblia
NPYPDLTATFPRTSQAGQ

SEQ ID NO: 3165045 - protein, 20 aa, Giardia lamblia
NPYPPNRVPALVFSAQANAF

SEQ ID NO: 3165046 - protein, 17 aa, Giardia lamblia
NPYPTEGSYHFNSFNQH

SEQ ID NO: 3165047 - protein, 20 aa, Giardia lamblia
NQAIWRRMFESSQPETLPIP

SEQ ID NO: 3165048 - protein, 17 aa, Giardia lamblia
NQASKMLDEYKKLFRDI

SEQ ID NO: 3165049 - protein, 23 aa, Giardia lamblia
NQATIRPSNLIQHNASEANDVYP

SEQ ID NO: 3165050 - protein, 23 aa, Giardia lamblia
NQEFGLKQLKAMLEKANAEIARL

SEQ ID NO: 3165051 - protein, 22 aa, Giardia lamblia
NQEMFDRMKAFFASHQLANSSK

SEQ ID NO: 3165052 - protein, 19 aa, Giardia lamblia
NQFEMVQILLPYELSIKTT

SEQ ID NO: 3165053 - protein, 18 aa, Giardia lamblia
NQFRAEYHALLAKYQLLQ

SEQ ID NO: 3165054 - protein, 19 aa, Giardia lamblia
NQFTPRPMQNPSIRTQPVV

SEQ ID NO: 3165055 - protein, 18 aa, Giardia lamblia
NQFVLLRIHHTHLVSFCN

SEQ ID NO: 3165056 - protein, 43 aa, Giardia lamblia
NQGFRMAKVIIRCIPSMRTAWNVCKLMFIKVRATLSAGMQCLV

SEQ ID NO: 3165057 - protein, 22 aa, Giardia lamblia
NQGRTWKEKKWGSRKDNKFDRA

SEQ ID NO: 3165058 - protein, 18 aa, Giardia lamblia
NQINLCFFDEEYDMRVCT

SEQ ID NO: 3165059 - protein, 18 aa, Giardia lamblia
NQLAEFELGVSQSATLNA

SEQ ID NO: 3165060 - protein, 23 aa, Giardia lamblia
NQLAERRARIAAAQPTQNNHAMD

SEQ ID NO: 3165061 - protein, 24 aa, Giardia lamblia
NQLCLSGTDFIEWLLTEDSASTYE

SEQ ID NO: 3165062 - protein, 23 aa, Giardia lamblia
NQLEVQRNYAFIGELRREELKEC

SEQ ID NO: 3165063 - protein, 21 aa, Giardia lamblia
NQLRLLYRMNDGIIESTYGLD

SEQ ID NO: 3165064 - protein, 26 aa, Giardia lamblia
NQLRLWLTDWADVFINKVPVESVLSS

SEQ ID NO: 3165065 - protein, 21 aa, Giardia lamblia
NQPLPRIGSLSADSAGTKSQA

SEQ ID NO: 3165066 - protein, 20 aa, Giardia lamblia
NQPRWVPWMQTIPEFSIDSL

SEQ ID NO: 3165067 - protein, 21 aa, Giardia lamblia
NQPYRLSRWFSVEIVPENDML

SEQ ID NO: 3165068 - protein, 17 aa, Giardia lamblia
NQQLGLRLNQLQFEYNE

SEQ ID NO: 3165069 - protein, 23 aa, Giardia lamblia
NQQNLCACYQKLTTLIDATVSAL

SEQ ID NO: 3165070 - protein, 25 aa, Giardia lamblia
NQQYMKFCLAKSISLTKLKTGESQK

SEQ ID NO: 3165071 - protein, 26 aa, Giardia lamblia
NQRQSILQKFCKWLNSHTEGAGKLTS

SEQ ID NO: 3165072 - protein, 17 aa, Giardia lamblia
NQRVVGFLIDYENSYID

SEQ ID NO: 3165073 - protein, 22 aa, Giardia lamblia
NQVCCYTAGLLFEKYEGDPGLA

SEQ ID NO: 3165074 - protein, 20 aa, Giardia lamblia
NQVKRCPTFFVRTGSCGIVH

SEQ ID NO: 3165075 - protein, 34 aa, Giardia lamblia
NQVPSVWEATAWPSVIPLSRWIVDLQERVSFIRS

SEQ ID NO: 3165076 - protein, 18 aa, Giardia lamblia
NQWAQYLTVRVCTSQSGH

SEQ ID NO: 3165077 - protein, 22 aa, Giardia lamblia
NQYLNRYGISYTGSVAADEQSQ

SEQ ID NO: 3165078 - protein, 26 aa, Giardia lamblia
NRAEELRTDLIINMQNELILRQRHRF

SEQ ID NO: 3165079 - protein, 21 aa, Giardia lamblia
NRALFELVLQYLLRHPDAPAL

SEQ ID NO: 3165080 - protein, 22 aa, Giardia lamblia
NRANAYFKLGQMNLSYDDADHI

SEQ ID NO: 3165081 - protein, 18 aa, Giardia lamblia
NRCFWKIDDSLDMTDSAT

SEQ ID NO: 3165082 - protein, 18 aa, Giardia lamblia
NRCLAEFEHRSIIKGKIA

SEQ ID NO: 3165083 - protein, 29 aa, Giardia lamblia
NRCRNGYCTHCVVGYIYHRGGCYSNNKEG

SEQ ID NO: 3165084 - protein, 29 aa, Giardia lamblia
NRDELKAGFDILKRAGISKTFYKEYDLLE

SEQ ID NO: 3165085 - protein, 17 aa, Giardia lamblia
NRDIYEVLSRLSMSTSP

SEQ ID NO: 3165086 - protein, 22 aa, Giardia lamblia
NREAVEMLLPYLAKRRNDMQWT

SEQ ID NO: 3165087 - protein, 17 aa, Giardia lamblia
NREPWSTFVKRLNYHRI

SEQ ID NO: 3165088 - protein, 25 aa, Giardia lamblia
NREQAVKFILQMRVTTLKDLETALF

SEQ ID NO: 3165089 - protein, 24 aa, Giardia lamblia
NRFHAASLIEFFELFGTIYNAEDL

SEQ ID NO: 3165090 - protein, 22 aa, Giardia lamblia
NRFKYLAKKFYGRISKAKLWSV

SEQ ID NO: 3165091 - protein, 24 aa, Giardia lamblia
NRFLYRPLSTLNFKEIGGPEIQEQ

SEQ ID NO: 3165092 - protein, 19 aa, Giardia lamblia
NRFRMLYMREVDRKARKVN

SEQ ID NO: 3165093 - protein, 18 aa, Giardia lamblia
NRGDTILDLSGQNIETLA

SEQ ID NO: 3165094 - protein, 24 aa, Giardia lamblia
NRGLLPRILEFMFQQINARHGFTF

SEQ ID NO: 3165095 - protein, 24 aa, Giardia lamblia
NRHNCSICIGLLFFNTYVHVLARM

SEQ ID NO: 3165096 - protein, 20 aa, Giardia lamblia
NRHPASGMGCGRNMHSGYQR

SEQ ID NO: 3165097 - protein, 21 aa, Giardia lamblia
NRIASSVLQNIACIPSESDTI

SEQ ID NO: 3165098 - protein, 21 aa, Giardia lamblia
NRIAYQCLCIDAILCDPPYSI

SEQ ID NO: 3165099 - protein, 18 aa, Giardia lamblia
NRIIPRPTYLLSPEHDTA

SEQ ID NO: 3165100 - protein, 23 aa, Giardia lamblia
NRIKLTHFYGRHLVPEFTTEDQG

SEQ ID NO: 3165101 - protein, 24 aa, Giardia lamblia
NRIRCFLDRARALPECAPNASEPI

SEQ ID NO: 3165102 - protein, 22 aa, Giardia lamblia
NRISIEVLSVVAMQVKSVLDAI

SEQ ID NO: 3165103 - protein, 28 aa, Giardia lamblia
NRITSRFLIPYLKPSDLVALGIDCAEYD

SEQ ID NO: 3165104 - protein, 21 aa, Giardia lamblia
NRLEALKAQYAMFGIGEQAKK

SEQ ID NO: 3165105 - protein, 26 aa, Giardia lamblia
NRLFPETCLHWWSFMLTRTLGNTFSK

SEQ ID NO: 3165106 - protein, 17 aa, Giardia lamblia
NRLGATLYSQGYGKNAS

SEQ ID NO: 3165107 - protein, 17 aa, Giardia lamblia
NRLLLLLSLDAEVVKRA

SEQ ID NO: 3165108 - protein, 24 aa, Giardia lamblia
NRLRQRRGFNTKRVELNRLSQRSV

SEQ ID NO: 3165109 - protein, 27 aa, Giardia lamblia
NRLSQRSVHGISHCSFFQHHFQEKVIN

SEQ ID NO: 3165110 - protein, 27 aa, Giardia lamblia
NRLVEIHGRLGLYKCVNQATGNVKGLG

SEQ ID NO: 3165111 - protein, 27 aa, Giardia lamblia
NRLVSCYNCALDAYLVEYKKLMDTMVA

SEQ ID NO: 3165112 - protein, 18 aa, Giardia lamblia
NRLYKFVVDSTWGPLSSV

SEQ ID NO: 3165113 - protein, 18 aa, Giardia lamblia
NRMEKLSKAHMVEVKPQI

SEQ ID NO: 3165114 - protein, 17 aa, Giardia lamblia
NRMQRHLNFLVFPEMND

SEQ ID NO: 3165115 - protein, 25 aa, Giardia lamblia
NRMRLELLRGEFLRIQVSEHCFPTI

SEQ ID NO: 3165116 - protein, 23 aa, Giardia lamblia
NRNFYGVMYGRYEYLSEANRLEA

SEQ ID NO: 3165117 - protein, 28 aa, Giardia lamblia
NRNIRELSFELARVMRLYNEAIRVFRTK

SEQ ID NO: 3165118 - protein, 33 aa, Giardia lamblia
NRNRELFFFKRFLLPLLSYKYHCQLIEPRILAL

SEQ ID NO: 3165119 - protein, 30 aa, Giardia lamblia
NRPCSTAAMYCKRPLIPVVECALKPPQHGR

SEQ ID NO: 3165120 - protein, 25 aa, Giardia lamblia
NRPEMREWFCAVYGLSDLSLAKPNP

SEQ ID NO: 3165121 - protein, 28 aa, Giardia lamblia
NRPLDPCVLKELRLIQSLIQQKIKDSVP

SEQ ID NO: 3165122 - protein, 19 aa, Giardia lamblia
NRPTWDMAGEISAHQRPTD

SEQ ID NO: 3165123 - protein, 20 aa, Giardia lamblia
NRPVSSCARPGSASTKKATK

SEQ ID NO: 3165124 - protein, 24 aa, Giardia lamblia
NRQISCAVISFKLYYVPFPKEFDS

SEQ ID NO: 3165125 - protein, 24 aa, Giardia lamblia
NRQIYKRLLVSRVLDNASVTSLKL

SEQ ID NO: 3165126 - protein, 19 aa, Giardia lamblia
NRQTLLWSATWPSEVSEVA

SEQ ID NO: 3165127 - protein, 24 aa, Giardia lamblia
NRQVEPFPHLARMPTASLSLPRST

SEQ ID NO: 3165128 - protein, 19 aa, Giardia lamblia
NRRFDAVKQLSLRETGYTD

SEQ ID NO: 3165129 - protein, 31 aa, Giardia lamblia
NRRHHCRRCGRIFCNACCIKPIDILSDTGTD

SEQ ID NO: 3165130 - protein, 17 aa, Giardia lamblia
NRRSVTMSVPSKLRQQI

SEQ ID NO: 3165131 - protein, 18 aa, Giardia lamblia
NRRTELMTAAAHGDVYIV

SEQ ID NO: 3165132 - protein, 19 aa, Giardia lamblia
NRRVESLSIVDQIRRTNEA

SEQ ID NO: 3165133 - protein, 21 aa, Giardia lamblia
NRSALLYALGYDTGMVASSKM

SEQ ID NO: 3165134 - protein, 23 aa, Giardia lamblia
NRSEFPHQLLLLGGCQVDRNCTE

SEQ ID NO: 3165135 - protein, 28 aa, Giardia lamblia
NRSFLRKPLRITFDWEDGIDQGGPRTEF

SEQ ID NO: 3165136 - protein, 20 aa, Giardia lamblia
NRSIYGFYLSFGLIMGFLDM

SEQ ID NO: 3165137 - protein, 17 aa, Giardia lamblia
NRSKPASALCTDSEKAA

SEQ ID NO: 3165138 - protein, 17 aa, Giardia lamblia
NRTALIYAVEHKNTEAM

SEQ ID NO: 3165139 - protein, 25 aa, Giardia lamblia
NRTKLPSLRSCFRDAGLLTSGTTSA

SEQ ID NO: 3165140 - protein, 22 aa, Giardia lamblia
NRTTAPLPFVWSDMEPAIYELS

SEQ ID NO: 3165141 - protein, 20 aa, Giardia lamblia
NRTVFPASLLTTAPQLCAYF

SEQ ID NO: 3165142 - protein, 18 aa, Giardia lamblia
NRTVHSFINLKSHMDETT

SEQ ID NO: 3165143 - protein, 29 aa, Giardia lamblia
NRVKWVRNSIMARCCGVDIHTYMDALAQG

SEQ ID NO: 3165144 - protein, 18 aa, Giardia lamblia
NRVPIIFICNNAHDQKLK

SEQ ID NO: 3165145 - protein, 18 aa, Giardia lamblia
NRVRMALSAHAISPWSDE

SEQ ID NO: 3165146 - protein, 19 aa, Giardia lamblia
NRVSILTDRLVRLQSKIEQ

SEQ ID NO: 3165147 - protein, 24 aa, Giardia lamblia
NRVSSVPLLLEKEAGIKDSSGQMA

SEQ ID NO: 3165148 - protein, 17 aa, Giardia lamblia
NRYLARNDMEFQAFQMH

SEQ ID NO: 3165149 - protein, 21 aa, Giardia lamblia
NRYLSCYEYAIDMRVIDFSDL

SEQ ID NO: 3165150 - protein, 26 aa, Giardia lamblia
NRYMEYLRAIPLVRIEKLTRTLMENS

SEQ ID NO: 3165151 - protein, 23 aa, Giardia lamblia
NSADLCSLLAPLEADIILPDKRD

SEQ ID NO: 3165152 - protein, 24 aa, Giardia lamblia
NSAIRCTNCRASATPRDTHSGRED

SEQ ID NO: 3165153 - protein, 18 aa, Giardia lamblia
NSAREYSEIMSLAVSDAS

SEQ ID NO: 3165154 - protein, 19 aa, Giardia lamblia
NSAVCPDLAASVPNGDCPP

SEQ ID NO: 3165155 - protein, 22 aa, Giardia lamblia
NSAYRLSFNSVLKLMQIEDTSP

SEQ ID NO: 3165156 - protein, 22 aa, Giardia lamblia
NSCAMAAALYTYLCHEAKCGAA

SEQ ID NO: 3165157 - protein, 23 aa, Giardia lamblia
NSDCALEICDLGLARLVDDHAAK

SEQ ID NO: 3165158 - protein, 20 aa, Giardia lamblia
NSDHCLGYFFKYFATSSKKG

SEQ ID NO: 3165159 - protein, 20 aa, Giardia lamblia
NSDVSLVFHPHGMLCVDYEA

SEQ ID NO: 3165160 - protein, 21 aa, Giardia lamblia
NSEAFAVCHIYAGKNDTFIHV

SEQ ID NO: 3165161 - protein, 18 aa, Giardia lamblia
NSEALYLFLSMIAPTCLD

SEQ ID NO: 3165162 - protein, 18 aa, Giardia lamblia
NSEHSIRVQRRLDEEDKR

SEQ ID NO: 3165163 - protein, 18 aa, Giardia lamblia
NSELGAISVRRLDPESLA

SEQ ID NO: 3165164 - protein, 22 aa, Giardia lamblia
NSESLWQFLIKMVDILPPEVLQ

SEQ ID NO: 3165165 - protein, 24 aa, Giardia lamblia
NSFFDRTLCIQLAFMSSDYTAFKS

SEQ ID NO: 3165166 - protein, 24 aa, Giardia lamblia
NSFFTCGYEYMGISTRLVLTPLTD

SEQ ID NO: 3165167 - protein, 29 aa, Giardia lamblia
NSFHNIVCLCLFSEVFAYLPAHALLDNSS

SEQ ID NO: 3165168 - protein, 22 aa, Giardia lamblia
NSFRYKADIVSPVRGTSQNNND

SEQ ID NO: 3165169 - protein, 35 aa, Giardia lamblia
NSGALPALVRIRLDACALHSSLLGIPVPQTILTGS

SEQ ID NO: 3165170 - protein, 26 aa, Giardia lamblia
NSGDIRLTALLPYMASVWMHLSAFNF

SEQ ID NO: 3165171 - protein, 19 aa, Giardia lamblia
NSGLRMELKEALTNKNKIE

SEQ ID NO: 3165172 - protein, 26 aa, Giardia lamblia
NSGRKEDLMIIKYLLSLEEENQRLRQ

SEQ ID NO: 3165173 - protein, 21 aa, Giardia lamblia
NSGTDWSLFVVRYTKAQSAQL

SEQ ID NO: 3165174 - protein, 19 aa, Giardia lamblia
NSHPFYVMFEPSLGCDART

SEQ ID NO: 3165175 - protein, 27 aa, Giardia lamblia
NSHYKFRLREIEALPGALELSNRTVFP

SEQ ID NO: 3165176 - protein, 25 aa, Giardia lamblia
NSIACIPLLLSREAGFKDAEGRAPI

SEQ ID NO: 3165177 - protein, 19 aa, Giardia lamblia
NSIEELFNLLNFIEPEVFP

SEQ ID NO: 3165178 - protein, 24 aa, Giardia lamblia
NSIHSLYLKHCCENSKSSKSLLSE

SEQ ID NO: 3165179 - protein, 29 aa, Giardia lamblia
NSIIRPSPYDLYRICEMDLLNSASHTSVN

SEQ ID NO: 3165180 - protein, 30 aa, Giardia lamblia
NSILRRCAKSDIPCSLFRINPERKRARTTS

SEQ ID NO: 3165181 - protein, 25 aa, Giardia lamblia
NSKHYRKFITMLAQFVRETPYISAG

SEQ ID NO: 3165182 - protein, 18 aa, Giardia lamblia
NSKIVIFVATARQAAFLC

SEQ ID NO: 3165183 - protein, 23 aa, Giardia lamblia
NSKREVRRVFILLDMLSKPPEDA

SEQ ID NO: 3165184 - protein, 26 aa, Giardia lamblia
NSKSWKQIYKTLLLIEHLLINASPDT

SEQ ID NO: 3165185 - protein, 25 aa, Giardia lamblia
NSKVRGLCLNTIFDPSFVSHEAHDA

SEQ ID NO: 3165186 - protein, 26 aa, Giardia lamblia
NSKYRYCPNCQVLVALGEECQLCHYN

SEQ ID NO: 3165187 - protein, 27 aa, Giardia lamblia
NSLDCVKQLIPWEAWVLNEYNRLPSTV

SEQ ID NO: 3165188 - protein, 23 aa, Giardia lamblia
NSLECIPLLLSEMPLRNRMGYTA

SEQ ID NO: 3165189 - protein, 27 aa, Giardia lamblia
NSLECVQCVVLYFKPSPEQIYPVLEEA

SEQ ID NO: 3165190 - protein, 25 aa, Giardia lamblia
NSLHPCLYDLFNVICSLVSQMCSIY

SEQ ID NO: 3165191 - protein, 20 aa, Giardia lamblia
NSLIRGRVAGLRSLLESNNL

SEQ ID NO: 3165192 - protein, 17 aa, Giardia lamblia
NSLLELLSYSVLDDPLF

SEQ ID NO: 3165193 - protein, 17 aa, Giardia lamblia
NSLLFTTGETIAFSLHD

SEQ ID NO: 3165194 - protein, 25 aa, Giardia lamblia
NSLLKSAGNIWGLIKALKSIQVGVL

SEQ ID NO: 3165195 - protein, 25 aa, Giardia lamblia
NSLQFSLKALDSFMKHAVDEREMLL

SEQ ID NO: 3165196 - protein, 26 aa, Giardia lamblia
NSLQQILLRHGWLAPRISRPSPSRSS

SEQ ID NO: 3165197 - protein, 23 aa, Giardia lamblia
NSLRILSFLFDTDVAMPFTTVDN

SEQ ID NO: 3165198 - protein, 19 aa, Giardia lamblia
NSLSSRSHTVFLIEITSYR

SEQ ID NO: 3165199 - protein, 19 aa, Giardia lamblia
NSNAFSCLPTIAEVAEEEN

SEQ ID NO: 3165200 - protein, 19 aa, Giardia lamblia
NSNCVPLASLVSTVDDTRP

SEQ ID NO: 3165201 - protein, 23 aa, Giardia lamblia
NSNMKGPRALTYNDLGQLKEEVS

SEQ ID NO: 3165202 - protein, 26 aa, Giardia lamblia
NSPHLYLPFVRTILRNAEFHLLESYP

SEQ ID NO: 3165203 - protein, 19 aa, Giardia lamblia
NSPISFAFGESAIRPTGNS

SEQ ID NO: 3165204 - protein, 21 aa, Giardia lamblia
NSQFSLFLLPRFIRAARTNET

SEQ ID NO: 3165205 - protein, 31 aa, Giardia lamblia
NSQPCACPLELDMSRGLSRDIVEPLAPKHSK

SEQ ID NO: 3165206 - protein, 17 aa, Giardia lamblia
NSQVFQVYYDISMTMWY

SEQ ID NO: 3165207 - protein, 32 aa, Giardia lamblia
NSREVDGRLSAPLQMPLSFLFETDSLAHASPA

SEQ ID NO: 3165208 - protein, 21 aa, Giardia lamblia
NSRILRFSINMSSKIGTTANP

SEQ ID NO: 3165209 - protein, 24 aa, Giardia lamblia
NSRKDWRLPGGGVRTGEIDPNALT

SEQ ID NO: 3165210 - protein, 24 aa, Giardia lamblia
NSRLKKHFDGLSPDEVELYKKYGL

SEQ ID NO: 3165211 - protein, 28 aa, Giardia lamblia
NSRLRELFWLDFTRERVLTSHTIESVFL

SEQ ID NO: 3165212 - protein, 24 aa, Giardia lamblia
NSRSLRCSPEIPLHGNSASKEIQS

SEQ ID NO: 3165213 - protein, 22 aa, Giardia lamblia
NSRWMPKKGTIGFGKYRIAYSV

SEQ ID NO: 3165214 - protein, 29 aa, Giardia lamblia
NSSAETCNNCKALAAKLAMQTELLAYLNR

SEQ ID NO: 3165215 - protein, 30 aa, Giardia lamblia
NSSALLLRRLPCIMMKLKMVQKIQDGVRFV

SEQ ID NO: 3165216 - protein, 21 aa, Giardia lamblia
NSSIGAAICSFLSELKQKGFE

SEQ ID NO: 3165217 - protein, 22 aa, Giardia lamblia
NSSNCSISFVIEIHEIMPNFPF

SEQ ID NO: 3165218 - protein, 26 aa, Giardia lamblia
NSTADCWKHVVLLAILIIKYSTSSSL

SEQ ID NO: 3165219 - protein, 18 aa, Giardia lamblia
NSTLTARDNWTASTDSMQ

SEQ ID NO: 3165220 - protein, 19 aa, Giardia lamblia
NSVALELFSDISTQTIDKD

SEQ ID NO: 3165221 - protein, 17 aa, Giardia lamblia
NSVALPFCASTAGQIDA

SEQ ID NO: 3165222 - protein, 22 aa, Giardia lamblia
NSVDCVKLLIEREKQLQVAYDS

SEQ ID NO: 3165223 - protein, 27 aa, Giardia lamblia
NSVHYPRLLLVVKRFFTGVYLFSSLSP

SEQ ID NO: 3165224 - protein, 24 aa, Giardia lamblia
NSVMKCILEKIFVLDPGERPTAKE

SEQ ID NO: 3165225 - protein, 23 aa, Giardia lamblia
NSVTLIGLFMVCVLQKSAKDIAD

SEQ ID NO: 3165226 - protein, 21 aa, Giardia lamblia
NSYEIPIRIVEIGGGVRQPST

SEQ ID NO: 3165227 - protein, 29 aa, Giardia lamblia
NSYIILFLLCIFKGPKILICSATAETEAL

SEQ ID NO: 3165228 - protein, 18 aa, Giardia lamblia
NSYLRPGQEITLEVARID

SEQ ID NO: 3165229 - protein, 17 aa, Giardia lamblia
NSYPYVPATRVWGIKRP

SEQ ID NO: 3165230 - protein, 25 aa, Giardia lamblia
NSYRHRMVHNYKDMPLGNVFSTEPL

SEQ ID NO: 3165231 - protein, 20 aa, Giardia lamblia
NSYYAKLCWNNCNLAYLERS

SEQ ID NO: 3165232 - protein, 17 aa, Giardia lamblia
NTALMFAVERENHACVS

SEQ ID NO: 3165233 - protein, 18 aa, Giardia lamblia
NTALMLAAIYGYEECVKI

SEQ ID NO: 3165234 - protein, 17 aa, Giardia lamblia
NTALMYAAELGYQDLVE

SEQ ID NO: 3165235 - protein, 18 aa, Giardia lamblia
NTALMYAVMSHFKKAVEV

SEQ ID NO: 3165236 - protein, 23 aa, Giardia lamblia
NTCFFGAALQCLFRCTVLRTVLL

SEQ ID NO: 3165237 - protein, 38 aa, Giardia lamblia
NTDAEYDKPAAFRVCLFGRAHMADIHLADCYCSRQHAL

SEQ ID NO: 3165238 - protein, 20 aa, Giardia lamblia
NTEFDHVVSINKIIATTKVF

SEQ ID NO: 3165239 - protein, 18 aa, Giardia lamblia
NTELKSRVFELQEQLMTN

SEQ ID NO: 3165240 - protein, 18 aa, Giardia lamblia
NTEQRFGALAKRDPARFE

SEQ ID NO: 3165241 - protein, 30 aa, Giardia lamblia
NTFKARAGDGFKIVNFIGMLSSLHTLLIGD

SEQ ID NO: 3165242 - protein, 21 aa, Giardia lamblia
NTGALFKVWPLDLDESGFEYD

SEQ ID NO: 3165243 - protein, 35 aa, Giardia lamblia
NTGECGLVKVFGCESSRGGVKVQFAVGDRAVSLIN

SEQ ID NO: 3165244 - protein, 27 aa, Giardia lamblia
NTGFVFRLVSWWRRRHSDLTTARIAAK

SEQ ID NO: 3165245 - protein, 26 aa, Giardia lamblia
NTGLLSEARFKAALRNAGFSAPGHMI

SEQ ID NO: 3165246 - protein, 17 aa, Giardia lamblia
NTHAYPLLCEIKPDSSA

SEQ ID NO: 3165247 - protein, 30 aa, Giardia lamblia
NTHFKPLVDMIRAGNDWYLVSVDFESYNEC

SEQ ID NO: 3165248 - protein, 24 aa, Giardia lamblia
NTHKAEGLVSYFVVLADKRDAVTL

SEQ ID NO: 3165249 - protein, 26 aa, Giardia lamblia
NTIELCRVSGLCGSLLLYSGQQIRIL

SEQ ID NO: 3165250 - protein, 24 aa, Giardia lamblia
NTIKLRIAFLQRHLLQYVNTTFPI

SEQ ID NO: 3165251 - protein, 26 aa, Giardia lamblia
NTIQIWDIRVGHSVWSYYGPNVCGES

SEQ ID NO: 3165252 - protein, 24 aa, Giardia lamblia
NTIRKCPTLRSIIAKLKRMQLQNV

SEQ ID NO: 3165253 - protein, 17 aa, Giardia lamblia
NTITTRILIAWIAYRRT

SEQ ID NO: 3165254 - protein, 24 aa, Giardia lamblia
NTKGQELFKVLGQFSKAIMPMNYN

SEQ ID NO: 3165255 - protein, 18 aa, Giardia lamblia
NTKHCVVIGAGYIGVELA

SEQ ID NO: 3165256 - protein, 25 aa, Giardia lamblia
NTKRECPICRSEITSYFQVNAPYDF

SEQ ID NO: 3165257 - protein, 17 aa, Giardia lamblia
NTLDYLFEKGFNFNVAD

SEQ ID NO: 3165258 - protein, 18 aa, Giardia lamblia
NTLIPLFLPYEADIEIHD

SEQ ID NO: 3165259 - protein, 28 aa, Giardia lamblia
NTLKGTVRCCAVRAPGYGDVKKGVLEDL

SEQ ID NO: 3165260 - protein, 37 aa, Giardia lamblia
NTLKLKGIEWPSGGSRVYFNFGLGGLVAQNFFYYYSS

SEQ ID NO: 3165261 - protein, 23 aa, Giardia lamblia
NTLKVLELESGRPFSDLPEVDSY

SEQ ID NO: 3165262 - protein, 23 aa, Giardia lamblia
NTLLLHQKFRAGISHHLKTTTEL

SEQ ID NO: 3165263 - protein, 18 aa, Giardia lamblia
NTLLMFCYNIELMPQADD

SEQ ID NO: 3165264 - protein, 19 aa, Giardia lamblia
NTLPAKYPTILYLAAEAGW

SEQ ID NO: 3165265 - protein, 27 aa, Giardia lamblia
NTMLPCLKCLILRGCNISSLPNNAFSA

SEQ ID NO: 3165266 - protein, 28 aa, Giardia lamblia
NTNCICQDCLRRVFRGSFGAERYPSILF

SEQ ID NO: 3165267 - protein, 27 aa, Giardia lamblia
NTNEAGGYCEAVDPMAVSVRQLRAPLP

SEQ ID NO: 3165268 - protein, 19 aa, Giardia lamblia
NTPSWPVLPDEGAETPLKT

SEQ ID NO: 3165269 - protein, 20 aa, Giardia lamblia
NTRFKEYNASYVKKLAEQTE

SEQ ID NO: 3165270 - protein, 25 aa, Giardia lamblia
NTRFKLHELSIWFMSHIIKAAPGNV

SEQ ID NO: 3165271 - protein, 24 aa, Giardia lamblia
NTRLIRAVAFKSCSDLKAIKQLIK

SEQ ID NO: 3165272 - protein, 24 aa, Giardia lamblia
NTRTRLICRAWVSLLRYTRRAEKI

SEQ ID NO: 3165273 - protein, 24 aa, Giardia lamblia
NTSCPQCGELLISRMTGFDGKVCN

SEQ ID NO: 3165274 - protein, 22 aa, Giardia lamblia
NTSDCPYGAFATYSGQSDIAAG

SEQ ID NO: 3165275 - protein, 25 aa, Giardia lamblia
NTSFREIKPPAVEVVHSRNSAGTTQ

SEQ ID NO: 3165276 - protein, 24 aa, Giardia lamblia
NTSIRPLFDREAGIVFDEQTNEIL

SEQ ID NO: 3165277 - protein, 18 aa, Giardia lamblia
NTTCASCDFSTIKEAQVC

SEQ ID NO: 3165278 - protein, 26 aa, Giardia lamblia
NTTERKSRCAVLYKNKKFYLIHNKFN

SEQ ID NO: 3165279 - protein, 20 aa, Giardia lamblia
NTVLLPRKVQVHGSDATHVV

SEQ ID NO: 3165280 - protein, 30 aa, Giardia lamblia
NTVLRKTFVLRMVDRIRLAKTLGTQEAADK

SEQ ID NO: 3165281 - protein, 18 aa, Giardia lamblia
NTWHRFELRMYKRTFWVT

SEQ ID NO: 3165282 - protein, 25 aa, Giardia lamblia
NTYFRPNYFIGLSFLKDNESLLTSL

SEQ ID NO: 3165283 - protein, 24 aa, Giardia lamblia
NTYREFADILLPIIKEKGYNVIQL

SEQ ID NO: 3165284 - protein, 31 aa, Giardia lamblia
NVAAMGKFFIGLVMCGAWSCFDEFNRIEVEV

SEQ ID NO: 3165285 - protein, 22 aa, Giardia lamblia
NVADKFARKAVEEMADLEYNQK

SEQ ID NO: 3165286 - protein, 26 aa, Giardia lamblia
NVAFGSGLHGWGFTVTHFARIYTKKF

SEQ ID NO: 3165287 - protein, 24 aa, Giardia lamblia
NVASIHLKVRFIKINALGAGFFVN

SEQ ID NO: 3165288 - protein, 19 aa, Giardia lamblia
NVCDWNFFNENLLVTGDDA

SEQ ID NO: 3165289 - protein, 24 aa, Giardia lamblia
NVDAFSVLLPLEYSIANANKEYFT

SEQ ID NO: 3165290 - protein, 19 aa, Giardia lamblia
NVDIARLLISKCAGQTNEN

SEQ ID NO: 3165291 - protein, 21 aa, Giardia lamblia
NVECIPLLIDEGSMVDINGWT

SEQ ID NO: 3165292 - protein, 22 aa, Giardia lamblia
NVEELRREVAIVVSDMQRTITD

SEQ ID NO: 3165293 - protein, 19 aa, Giardia lamblia
NVEFISGFLQSPVLRRGYT

SEQ ID NO: 3165294 - protein, 20 aa, Giardia lamblia
NVEISLPNQVSFVYVLSLMD

SEQ ID NO: 3165295 - protein, 20 aa, Giardia lamblia
NVEPGRAGGRMSLTLLRQRQ

SEQ ID NO: 3165296 - protein, 25 aa, Giardia lamblia
NVEPLKFFLQHRMLLQDDLEAARIL

SEQ ID NO: 3165297 - protein, 20 aa, Giardia lamblia
NVERLSYYLCRERGFHTLAI

SEQ ID NO: 3165298 - protein, 34 aa, Giardia lamblia
NVFMILEVLARLLGISADIKIAMHYKQYGEPPAN

SEQ ID NO: 3165299 - protein, 21 aa, Giardia lamblia
NVFPCSLRVDLHLKTSLEKVI

SEQ ID NO: 3165300 - protein, 23 aa, Giardia lamblia
NVFRARHVYLEREAEKCLDNNLD

SEQ ID NO: 3165301 - protein, 25 aa, Giardia lamblia
NVGAIPYLIAEAGAQDWEGNTALMY

SEQ ID NO: 3165302 - protein, 23 aa, Giardia lamblia
NVGFLSCLTHLLYGISDVNSKVF

SEQ ID NO: 3165303 - protein, 23 aa, Giardia lamblia
NVGKGYTALHLSVYYGHYDLVKL

SEQ ID NO: 3165304 - protein, 19 aa, Giardia lamblia
NVGNASLCSLEIDPTGEFL

SEQ ID NO: 3165305 - protein, 22 aa, Giardia lamblia
NVGSKWGLQAVWDKIVEDGGDL

SEQ ID NO: 3165306 - protein, 19 aa, Giardia lamblia
NVHFVLWELSKPGLDPTYL

SEQ ID NO: 3165307 - protein, 25 aa, Giardia lamblia
NVHVEAFTALLLRTTGFRRFNPTPN

SEQ ID NO: 3165308 - protein, 24 aa, Giardia lamblia
NVIEVPSGLPARIVREEPVEFVKE

SEQ ID NO: 3165309 - protein, 22 aa, Giardia lamblia
NVIPKLIPREAKIVDRDGLTAL

SEQ ID NO: 3165310 - protein, 20 aa, Giardia lamblia
NVIRLRGAVEVGLDGTAALV

SEQ ID NO: 3165311 - protein, 20 aa, Giardia lamblia
NVKAALAYLAREWIYSTSVD

SEQ ID NO: 3165312 - protein, 24 aa, Giardia lamblia
NVKGRESYKVWVPLDEIRRVNYIL

SEQ ID NO: 3165313 - protein, 20 aa, Giardia lamblia
NVKHGRLLAFLNDLTAELAS

SEQ ID NO: 3165314 - protein, 18 aa, Giardia lamblia
NVKIREEMDLLKEELVVL

SEQ ID NO: 3165315 - protein, 27 aa, Giardia lamblia
NVKRIIKHRIGYFITRFNIEGDLQKTG

SEQ ID NO: 3165316 - protein, 18 aa, Giardia lamblia
NVLGSGWRSLRRCSYPQS

SEQ ID NO: 3165317 - protein, 23 aa, Giardia lamblia
NVLIAEFCFGYSIEREMMHYRAA

SEQ ID NO: 3165318 - protein, 17 aa, Giardia lamblia
NVLLRRLFDAGVKTDRG

SEQ ID NO: 3165319 - protein, 23 aa, Giardia lamblia
NVLTEIRQEYGFLPHSSLKRYKT

SEQ ID NO: 3165320 - protein, 19 aa, Giardia lamblia
NVMLRSSFELLQLDVEQQN

SEQ ID NO: 3165321 - protein, 18 aa, Giardia lamblia
NVNCSGFIGDSWSLGCIL

SEQ ID NO: 3165322 - protein, 24 aa, Giardia lamblia
NVPKPPSKGFVFGAPVAPAQQPPP

SEQ ID NO: 3165323 - protein, 35 aa, Giardia lamblia
NVPRHPVMYTRTGYILRLHITNFLTHRDKVVDFEC

SEQ ID NO: 3165324 - protein, 26 aa, Giardia lamblia
NVPTPRFGVSSIRGIVGGTIYVLMKS

SEQ ID NO: 3165325 - protein, 25 aa, Giardia lamblia
NVPVLPSLRSGSLVQNNKRRASDAA

SEQ ID NO: 3165326 - protein, 17 aa, Giardia lamblia
NVQAIKLLSRIEARMTR

SEQ ID NO: 3165327 - protein, 18 aa, Giardia lamblia
NVRPEYMLVNLPFGILGN

SEQ ID NO: 3165328 - protein, 17 aa, Giardia lamblia
NVSALMIAASRGHVPVI

SEQ ID NO: 3165329 - protein, 25 aa, Giardia lamblia
NVSIRFHFHKAYGVPVIYTKNVHVV

SEQ ID NO: 3165330 - protein, 20 aa, Giardia lamblia
NVSMPFGTVINGVYDASQPS

SEQ ID NO: 3165331 - protein, 23 aa, Giardia lamblia
NVSNSVLVPAHLLCDDGDYTHNA

SEQ ID NO: 3165332 - protein, 18 aa, Giardia lamblia
NVSQACKEFILACLSIDY

SEQ ID NO: 3165333 - protein, 17 aa, Giardia lamblia
NVSRCAFNGENISIINV

SEQ ID NO: 3165334 - protein, 25 aa, Giardia lamblia
NVSRERGHLLLVFRDTERKSYHSCV

SEQ ID NO: 3165335 - protein, 19 aa, Giardia lamblia
NVSSPFRQALGLQKGTSED

SEQ ID NO: 3165336 - protein, 18 aa, Giardia lamblia
NVSSRLLFHTIILDCSPV

SEQ ID NO: 3165337 - protein, 23 aa, Giardia lamblia
NVTDLRSSPLINQLQKYVANLHM

SEQ ID NO: 3165338 - protein, 22 aa, Giardia lamblia
NVTPEYDFLAILRALRKNTNDS

SEQ ID NO: 3165339 - protein, 19 aa, Giardia lamblia
NVTPKGFAVGQSFQMREGR

SEQ ID NO: 3165340 - protein, 22 aa, Giardia lamblia
NVVACYIYQILLGLKYLHEQGI

SEQ ID NO: 3165341 - protein, 23 aa, Giardia lamblia
NVVDLFKLLNLSGRHSRPLLPHH

SEQ ID NO: 3165342 - protein, 19 aa, Giardia lamblia
NVVLPPRLPQLAPAMNQRS

SEQ ID NO: 3165343 - protein, 26 aa, Giardia lamblia
NVVRALEVLQSLGLVSFSNGIVRLTP

SEQ ID NO: 3165344 - protein, 19 aa, Giardia lamblia
NVVRFLRPYESHINTSDNR

SEQ ID NO: 3165345 - protein, 24 aa, Giardia lamblia
NVVYMPRLRHVTLQSAIYDETTEM

SEQ ID NO: 3165346 - protein, 20 aa, Giardia lamblia
NVYFYPVVHYVRMDRSISRV

SEQ ID NO: 3165347 - protein, 24 aa, Giardia lamblia
NWDCVRYLSHQEIRMRDCSGWTAL

SEQ ID NO: 3165348 - protein, 18 aa, Giardia lamblia
NWIKHRRVLDEQLYKEIH

SEQ ID NO: 3165349 - protein, 29 aa, Giardia lamblia
NWPTTRLLLCLVCAHLLDATTFGAALAEL

SEQ ID NO: 3165350 - protein, 23 aa, Giardia lamblia
NWSRPPTEVSFLFELLSAAIQRV

SEQ ID NO: 3165351 - protein, 22 aa, Giardia lamblia
NWTERLPLQRNHSGTWFAVLYL

SEQ ID NO: 3165352 - protein, 26 aa, Giardia lamblia
NYASFRFELPYGLLFVDDVLLVTDAG

SEQ ID NO: 3165353 - protein, 17 aa, Giardia lamblia
NYCCKMFSCTSVIGLLP

SEQ ID NO: 3165354 - protein, 33 aa, Giardia lamblia
NYDERCIDCDNLIYKLRYEINISEDRIGVLQGV

SEQ ID NO: 3165355 - protein, 18 aa, Giardia lamblia
NYDFPKRFRDGNIKATSR

SEQ ID NO: 3165356 - protein, 24 aa, Giardia lamblia
NYDVFRPSHHLQKYYAAKKPKPKP

SEQ ID NO: 3165357 - protein, 25 aa, Giardia lamblia
NYEQWKKSRLMALQTAFINESLPPS

SEQ ID NO: 3165358 - protein, 25 aa, Giardia lamblia
NYEYIPFLLGELGMTYSHHRTSLML

SEQ ID NO: 3165359 - protein, 24 aa, Giardia lamblia
NYFASFRFRTLLSKVVDPFLAPEI

SEQ ID NO: 3165360 - protein, 30 aa, Giardia lamblia
NYGRCSLSLLDLLAVIACYPNLETLSFSQL

SEQ ID NO: 3165361 - protein, 24 aa, Giardia lamblia
NYIDCAKLLLVETGLTMANRWDQF

SEQ ID NO: 3165362 - protein, 24 aa, Giardia lamblia
NYIKASSFNPFRSVSDGAALGGSM

SEQ ID NO: 3165363 - protein, 28 aa, Giardia lamblia
NYINIHLKKRFPLLPLDTDRLIFISTSE

SEQ ID NO: 3165364 - protein, 20 aa, Giardia lamblia
NYLGEWCFASKVAEEASPRV

SEQ ID NO: 3165365 - protein, 22 aa, Giardia lamblia
NYLKLMKRTRLLIDEASDVLSG

SEQ ID NO: 3165366 - protein, 26 aa, Giardia lamblia
NYLLHGSFSLSIFGFLAGNSRKIFLG

SEQ ID NO: 3165367 - protein, 20 aa, Giardia lamblia
NYLMDLCSQLSRNSDIRNKP

SEQ ID NO: 3165368 - protein, 26 aa, Giardia lamblia
NYLNFRSAPFNVLPLFDFQAFVHPIL

SEQ ID NO: 3165369 - protein, 32 aa, Giardia lamblia
NYLSDAWTKIGWNTRGLLQFIMKARKLAIEAF

SEQ ID NO: 3165370 - protein, 19 aa, Giardia lamblia
NYLSFCPQELLDFYKTQIT

SEQ ID NO: 3165371 - protein, 24 aa, Giardia lamblia
NYLSFEMFKATYLNSLSLTHGIEA

SEQ ID NO: 3165372 - protein, 23 aa, Giardia lamblia
NYLVWLAEFIQTGILQIVLSNVA

SEQ ID NO: 3165373 - protein, 23 aa, Giardia lamblia
NYNMNKCTLAMVSPQSVSTVQLL

SEQ ID NO: 3165374 - protein, 17 aa, Giardia lamblia
NYNSVYRKYGLFICRRC

SEQ ID NO: 3165375 - protein, 24 aa, Giardia lamblia
NYPDEYHTFFSLAAMSLFNVTLPG

SEQ ID NO: 3165376 - protein, 17 aa, Giardia lamblia
NYQIVDFLLDFEEEIVS

SEQ ID NO: 3165377 - protein, 17 aa, Giardia lamblia
NYSETIASLSLTQKRLT

SEQ ID NO: 3165378 - protein, 23 aa, Giardia lamblia
NYSKIRGAALCDGTIYALVKEPL

SEQ ID NO: 3165379 - protein, 22 aa, Giardia lamblia
NYSMGYLRGDFRADDQDVGCAS

SEQ ID NO: 3165380 - protein, 25 aa, Giardia lamblia
NYSYRAAGNPSYCFTDGGSCINSAL

SEQ ID NO: 3165381 - protein, 18 aa, Giardia lamblia
NYTIFSLIRAFRLGRTVK

SEQ ID NO: 3165382 - protein, 20 aa, Giardia lamblia
NYTPIWKYSGFILHQMDALT

SEQ ID NO: 3165383 - protein, 28 aa, Giardia lamblia
NYYWMPDLTKLAGLIVHSLVAIEPIPFH

SEQ ID NO: 3165384 - protein, 17 aa, Giardia lamblia
PAAAYAFMAHTALVAGI

SEQ ID NO: 3165385 - protein, 36 aa, Giardia lamblia
PAACLSPKKPVVWFYISGRFCELNLLKVKRNQRTLI

SEQ ID NO: 3165386 - protein, 20 aa, Giardia lamblia
PAAHPRVRPTSRSHPPIPEP

SEQ ID NO: 3165387 - protein, 18 aa, Giardia lamblia
PAAHWSQWILSALHCSQL

SEQ ID NO: 3165388 - protein, 20 aa, Giardia lamblia
PAAPCVPSIVTAGSQTIGVR

SEQ ID NO: 3165389 - protein, 17 aa, Giardia lamblia
PAAVARVMALPPVLPPN

SEQ ID NO: 3165390 - protein, 23 aa, Giardia lamblia
PADGYCWRKYGSKRLPNNSHPKS

SEQ ID NO: 3165391 - protein, 19 aa, Giardia lamblia
PADLFKEWGTGYFESLMIR

SEQ ID NO: 3165392 - protein, 32 aa, Giardia lamblia
PADMPRIHRAPSFPGLQPHYYPDPAHNASHQI

SEQ ID NO: 3165393 - protein, 24 aa, Giardia lamblia
PADNSCALMWAASVGNRDICELLL

SEQ ID NO: 3165394 - protein, 20 aa, Giardia lamblia
PADPYDFLYRYYRTLAQESV

SEQ ID NO: 3165395 - protein, 17 aa, Giardia lamblia
PADSAGGDSEEWNGPYI

SEQ ID NO: 3165396 - protein, 24 aa, Giardia lamblia
PADVWSAGACIFAMAMRRPPFNST

SEQ ID NO: 3165397 - protein, 17 aa, Giardia lamblia
PAELSTYSIVLPPVSAG

SEQ ID NO: 3165398 - protein, 18 aa, Giardia lamblia
PAEVKAEPDAGSMNQQYF

SEQ ID NO: 3165399 - protein, 17 aa, Giardia lamblia
PAFDHSLLFNKGSASGL

SEQ ID NO: 3165400 - protein, 17 aa, Giardia lamblia
PAFILEPIMEVVLGALY

SEQ ID NO: 3165401 - protein, 17 aa, Giardia lamblia
PAFMTIIKGCEYFDGTV

SEQ ID NO: 3165402 - protein, 18 aa, Giardia lamblia
PAFVTKLATAAMTFLCVD

SEQ ID NO: 3165403 - protein, 17 aa, Giardia lamblia
PAGMSLAVSGARVAVKT

SEQ ID NO: 3165404 - protein, 19 aa, Giardia lamblia
PAGTAGIYYSAHNLTRRPV

SEQ ID NO: 3165405 - protein, 19 aa, Giardia lamblia
PAGTGRLSKDLSIDAFDKL

SEQ ID NO: 3165406 - protein, 24 aa, Giardia lamblia
PAHTFKTAMLLFVPTPMQIKMIFS

SEQ ID NO: 3165407 - protein, 18 aa, Giardia lamblia
PAISAPICRDSDCSGLAP

SEQ ID NO: 3165408 - protein, 24 aa, Giardia lamblia
PAKPCPNEEPVPIPVSVVSNNLDI

SEQ ID NO: 3165409 - protein, 22 aa, Giardia lamblia
PAKYFRRLISTSFDQLLLGIEQ

SEQ ID NO: 3165410 - protein, 23 aa, Giardia lamblia
PALATAFSECFKAATRPADLYAD

SEQ ID NO: 3165411 - protein, 19 aa, Giardia lamblia
PALCNALFILMGRIATDRT

SEQ ID NO: 3165412 - protein, 20 aa, Giardia lamblia
PALIELFDLTLPVNRPLISL

SEQ ID NO: 3165413 - protein, 17 aa, Giardia lamblia
PALIIWLDKNVFSKEGR

SEQ ID NO: 3165414 - protein, 23 aa, Giardia lamblia
PALLCTIISSLAYRGENLRATHF

SEQ ID NO: 3165415 - protein, 18 aa, Giardia lamblia
PALLLAFPVPCSMEQGVF

SEQ ID NO: 3165416 - protein, 18 aa, Giardia lamblia
PALLRYSYLFTKDPLSLP

SEQ ID NO: 3165417 - protein, 17 aa, Giardia lamblia
PALSESYRTMLADRLNR

SEQ ID NO: 3165418 - protein, 18 aa, Giardia lamblia
PALTACIQYYLQRKGASA

SEQ ID NO: 3165419 - protein, 20 aa, Giardia lamblia
PALVFNLFNVIPIRATAEKE

SEQ ID NO: 3165420 - protein, 20 aa, Giardia lamblia
PALVKLLAKAECAIQTPDTQ

SEQ ID NO: 3165421 - protein, 18 aa, Giardia lamblia
PALVPFRDACMGPCSYGM

SEQ ID NO: 3165422 - protein, 23 aa, Giardia lamblia
PANDALELTRIIELLGPLNEGAT

SEQ ID NO: 3165423 - protein, 18 aa, Giardia lamblia
PANSIPCFDEQEDRFGPP

SEQ ID NO: 3165424 - protein, 25 aa, Giardia lamblia
PAPDCPMPVLAVDGFSAMVNTDQKS

SEQ ID NO: 3165425 - protein, 22 aa, Giardia lamblia
PAPEKHITWRDGLVTAQIPSTY

SEQ ID NO: 3165426 - protein, 22 aa, Giardia lamblia
PAPESTLIRAVKRSDKRLLEVI

SEQ ID NO: 3165427 - protein, 17 aa, Giardia lamblia
PAPFPGPTYDLFDICIA

SEQ ID NO: 3165428 - protein, 20 aa, Giardia lamblia
PAPFPSEMADISSIGLIEGN

SEQ ID NO: 3165429 - protein, 19 aa, Giardia lamblia
PAPMPTRRSLYGMQHRLEP

SEQ ID NO: 3165430 - protein, 23 aa, Giardia lamblia
PAPPPRRGATPAARSASAAPIRV

SEQ ID NO: 3165431 - protein, 20 aa, Giardia lamblia
PAQCNNFYVFPGIGLGAYVC

SEQ ID NO: 3165432 - protein, 18 aa, Giardia lamblia
PAQIAYDLSLLVDMHHQY

SEQ ID NO: 3165433 - protein, 19 aa, Giardia lamblia
PAQLCTASIASSPIPEYAQ

SEQ ID NO: 3165434 - protein, 22 aa, Giardia lamblia
PAQLPLLCLTDMAVPRQFVTRL

SEQ ID NO: 3165435 - protein, 31 aa, Giardia lamblia
PAQLPYSLASFRVYTLVPFFLSRFKHYSVSV

SEQ ID NO: 3165436 - protein, 24 aa, Giardia lamblia
PARAVSIPRYTVIYSTGTTSTSLR

SEQ ID NO: 3165437 - protein, 22 aa, Giardia lamblia
PARKWLEASKHKVLDADSDNEN

SEQ ID NO: 3165438 - protein, 27 aa, Giardia lamblia
PARLDRCRSALQRGCFNDLAEVCEEDW

SEQ ID NO: 3165439 - protein, 27 aa, Giardia lamblia
PARPRAAKSPPLRSAVENLMKGGIFST

SEQ ID NO: 3165440 - protein, 17 aa, Giardia lamblia
PASDVWSLEVIVYELTT

SEQ ID NO: 3165441 - protein, 17 aa, Giardia lamblia
PASDVWSLGAIIYELVT

SEQ ID NO: 3165442 - protein, 27 aa, Giardia lamblia
PASDVWSMGICFCEIIFGCDGSNYTFY

SEQ ID NO: 3165443 - protein, 18 aa, Giardia lamblia
PASIDSLLSLLREGGAVV

SEQ ID NO: 3165444 - protein, 19 aa, Giardia lamblia
PASIPAILDISKLVNLVIL

SEQ ID NO: 3165445 - protein, 20 aa, Giardia lamblia
PASRMVGGGFSVTHDGRSGA

SEQ ID NO: 3165446 - protein, 23 aa, Giardia lamblia
PASRREISNLILSTKKIVYKSAS

SEQ ID NO: 3165447 - protein, 19 aa, Giardia lamblia
PASSPRLLLSGIQGSQLGK

SEQ ID NO: 3165448 - protein, 27 aa, Giardia lamblia
PASVVKRLSAAIPLLFTGNIFTNQLKP

SEQ ID NO: 3165449 - protein, 17 aa, Giardia lamblia
PATALPNHMVQAMFINP

SEQ ID NO: 3165450 - protein, 22 aa, Giardia lamblia
PATGMPVWAIMVPRNLGNDYAR

SEQ ID NO: 3165451 - protein, 26 aa, Giardia lamblia
PATKCPLESWADIFISGVDQYAPTLP

SEQ ID NO: 3165452 - protein, 24 aa, Giardia lamblia
PAVCKSRVYSLLGLESSSDDSSTV

SEQ ID NO: 3165453 - protein, 30 aa, Giardia lamblia
PAVHLTDAFPCMLFSSLLRVSLFLYSRRAV

SEQ ID NO: 3165454 - protein, 28 aa, Giardia lamblia
PAVLKHIWPKVCGYLNDLFRPILGNLKG

SEQ ID NO: 3165455 - protein, 18 aa, Giardia lamblia
PAVNCLKMAQNQWVGKVP

SEQ ID NO: 3165456 - protein, 18 aa, Giardia lamblia
PAVRLLAKFEGTLADASG

SEQ ID NO: 3165457 - protein, 24 aa, Giardia lamblia
PAVRLSKQIVEFLPIYPKELPGSF

SEQ ID NO: 3165458 - protein, 20 aa, Giardia lamblia
PAVTPAAMALYSLKLPKSLM

SEQ ID NO: 3165459 - protein, 18 aa, Giardia lamblia
PAYNISPSKKCNSTDPMV

SEQ ID NO: 3165460 - protein, 17 aa, Giardia lamblia
PAYSAYRRPWPGNYNEK

SEQ ID NO: 3165461 - protein, 18 aa, Giardia lamblia
PCCTAQLLIDLLYANPSD

SEQ ID NO: 3165462 - protein, 24 aa, Giardia lamblia
PCCYFVFALGCLWESIAVNVHTIL

SEQ ID NO: 3165463 - protein, 26 aa, Giardia lamblia
PCDGFDYLLRLILLITEGCNNALAQA

SEQ ID NO: 3165464 - protein, 22 aa, Giardia lamblia
PCDLKNLEVLFEICSSVMFDDL

SEQ ID NO: 3165465 - protein, 21 aa, Giardia lamblia
PCDYLKNFVDMAASLRVDKCI

SEQ ID NO: 3165466 - protein, 24 aa, Giardia lamblia
PCIHLLSRWYGWDAKKLSIASLDK

SEQ ID NO: 3165467 - protein, 20 aa, Giardia lamblia
PCIQYAIFDEVHYLKNTETI

SEQ ID NO: 3165468 - protein, 18 aa, Giardia lamblia
PCITCFSEHISYTFFSHV

SEQ ID NO: 3165469 - protein, 17 aa, Giardia lamblia
PCLIEEVTILKRKLASL

SEQ ID NO: 3165470 - protein, 24 aa, Giardia lamblia
PCLSVEPYTSFGIAGKYAHKSVSI

SEQ ID NO: 3165471 - protein, 19 aa, Giardia lamblia
PCNPENFSDVLARHPTPSL

SEQ ID NO: 3165472 - protein, 25 aa, Giardia lamblia
PCPFGCGKPIWIGACSCINCRQVSP

SEQ ID NO: 3165473 - protein, 23 aa, Giardia lamblia
PCRTRLPHDILVVGHVYVSNYVK

SEQ ID NO: 3165474 - protein, 20 aa, Giardia lamblia
PCSSCGASISEDLRGDRCAK

SEQ ID NO: 3165475 - protein, 20 aa, Giardia lamblia
PCTKCWHGEIERRMADSRLQ

SEQ ID NO: 3165476 - protein, 23 aa, Giardia lamblia
PCVKEAAAWALGYIARHNEHLAQ

SEQ ID NO: 3165477 - protein, 20 aa, Giardia lamblia
PCVLGCAAPPLVPPVGGPVF

SEQ ID NO: 3165478 - protein, 22 aa, Giardia lamblia
PCVRGRGTAVIEARGHSSSASA

SEQ ID NO: 3165479 - protein, 19 aa, Giardia lamblia
PCYPVGFVVETNKHLTSLL

SEQ ID NO: 3165480 - protein, 18 aa, Giardia lamblia
PDAHCIDKTPGLTNSLVS

SEQ ID NO: 3165481 - protein, 26 aa, Giardia lamblia
PDAIEPNDAFGFFGFDDAPSTPAAIS

SEQ ID NO: 3165482 - protein, 22 aa, Giardia lamblia
PDAKAALIWIIGEYANRIEGSE

SEQ ID NO: 3165483 - protein, 25 aa, Giardia lamblia
PDAPAPSCPLVYAIGFQEVDMSAKA

SEQ ID NO: 3165484 - protein, 19 aa, Giardia lamblia
PDASYILTLTRYYKLMRPI

SEQ ID NO: 3165485 - protein, 18 aa, Giardia lamblia
PDAYEILLHPWLQQEMIK

SEQ ID NO: 3165486 - protein, 19 aa, Giardia lamblia
PDCIIPQKYSNTIRIFLDH

SEQ ID NO: 3165487 - protein, 22 aa, Giardia lamblia
PDDFISFISLFLQWDPQRRCTP

SEQ ID NO: 3165488 - protein, 18 aa, Giardia lamblia
PDDVFSRLYNLAETTRKK

SEQ ID NO: 3165489 - protein, 18 aa, Giardia lamblia
PDEARIIRITALTFDTCL

SEQ ID NO: 3165490 - protein, 23 aa, Giardia lamblia
PDECIVVGLGWIAAIRSPRQKVA

SEQ ID NO: 3165491 - protein, 22 aa, Giardia lamblia
PDECLPFVKLLIGLTGIQDENG

SEQ ID NO: 3165492 - protein, 18 aa, Giardia lamblia
PDEFALTNMRVFEEQPLY

SEQ ID NO: 3165493 - protein, 22 aa, Giardia lamblia
PDELKAKIIERHIKEVELNLRQ

SEQ ID NO: 3165494 - protein, 22 aa, Giardia lamblia
PDEPKVYLVVRIRGIVGVAPKV

SEQ ID NO: 3165495 - protein, 17 aa, Giardia lamblia
PDEPLALGNPVSAGMLC

SEQ ID NO: 3165496 - protein, 21 aa, Giardia lamblia
PDEQSHASASSSSDDYTSGTT

SEQ ID NO: 3165497 - protein, 20 aa, Giardia lamblia
PDEQVKSFIMYSDNRIYNFD

SEQ ID NO: 3165498 - protein, 19 aa, Giardia lamblia
PDFEHIEALDLKRLSENLH

SEQ ID NO: 3165499 - protein, 20 aa, Giardia lamblia
PDFHELLLPFSVFPLSGTIY

SEQ ID NO: 3165500 - protein, 19 aa, Giardia lamblia
PDFLEGKDPKDVFVDGWTP

SEQ ID NO: 3165501 - protein, 22 aa, Giardia lamblia
PDGKTALMLACEANYPEIAALL

SEQ ID NO: 3165502 - protein, 18 aa, Giardia lamblia
PDGLLFSMALFRAPVKEK

SEQ ID NO: 3165503 - protein, 23 aa, Giardia lamblia
PDGRKGKTALMFAAINNHTSTVQ

SEQ ID NO: 3165504 - protein, 23 aa, Giardia lamblia
PDGSAYKGTWYNSLRHGQGTHVY

SEQ ID NO: 3165505 - protein, 21 aa, Giardia lamblia
PDHHKRPLSVFPYSTNALSAD

SEQ ID NO: 3165506 - protein, 17 aa, Giardia lamblia
PDHMGVLKDEFRQQCLA

SEQ ID NO: 3165507 - protein, 17 aa, Giardia lamblia
PDHRPSATTDSRSRSGN

SEQ ID NO: 3165508 - protein, 24 aa, Giardia lamblia
PDIHCTNCNAALLPKTRQRASAPD

SEQ ID NO: 3165509 - protein, 17 aa, Giardia lamblia
PDIIKGILMAQMGSLPK

SEQ ID NO: 3165510 - protein, 19 aa, Giardia lamblia
PDIIMGHNIYFHLYNTMWH

SEQ ID NO: 3165511 - protein, 31 aa, Giardia lamblia
PDIPDLVSLSTRLQVVGIPFSSHDAAELQLA

SEQ ID NO: 3165512 - protein, 27 aa, Giardia lamblia
PDIPPDRPYALGGWKPEFIRERARLLE

SEQ ID NO: 3165513 - protein, 19 aa, Giardia lamblia
PDIQEYRLGVQKAEESILR

SEQ ID NO: 3165514 - protein, 27 aa, Giardia lamblia
PDIVKICRSQGFFPLEEAPVIFEANLE

SEQ ID NO: 3165515 - protein, 20 aa, Giardia lamblia
PDKCAGCPSKGSCGSSTESP

SEQ ID NO: 3165516 - protein, 18 aa, Giardia lamblia
PDKCGRTNLMIGALNGDP

SEQ ID NO: 3165517 - protein, 17 aa, Giardia lamblia
PDKKRYLKLAIHNDLTK

SEQ ID NO: 3165518 - protein, 24 aa, Giardia lamblia
PDKSSIKVIDWGSGAMVSETIYSY

SEQ ID NO: 3165519 - protein, 19 aa, Giardia lamblia
PDLAASVPNGDCPPKRTHG

SEQ ID NO: 3165520 - protein, 25 aa, Giardia lamblia
PDLCFAASRIPAAVTETAFSHLRNP

SEQ ID NO: 3165521 - protein, 20 aa, Giardia lamblia
PDLFTGYNIDGFDFSYIFKR

SEQ ID NO: 3165522 - protein, 31 aa, Giardia lamblia
PDLIDFVSCCIKIRFGHETGRETELMEFARI

SEQ ID NO: 3165523 - protein, 19 aa, Giardia lamblia
PDLIEKFVITATDRSTIPD

SEQ ID NO: 3165524 - protein, 19 aa, Giardia lamblia
PDLITRWNAYLWSHPSAYL

SEQ ID NO: 3165525 - protein, 24 aa, Giardia lamblia
PDLKHGRISGILLASAAFQSYNYE

SEQ ID NO: 3165526 - protein, 23 aa, Giardia lamblia
PDLLCQYCRKPLVLLLQHISPGS

SEQ ID NO: 3165527 - protein, 18 aa, Giardia lamblia
PDLLFADLCSAPGGWSYT

SEQ ID NO: 3165528 - protein, 38 aa, Giardia lamblia
PDLNPRGEVVIGIVRPVCIDFFKPVYKHAGQSRGMGHS

SEQ ID NO: 3165529 - protein, 22 aa, Giardia lamblia
PDLREPHGIAVLQLYRALTTKM

SEQ ID NO: 3165530 - protein, 18 aa, Giardia lamblia
PDLRGCIGCLTPLKIQQG

SEQ ID NO: 3165531 - protein, 18 aa, Giardia lamblia
PDLSNLLLLAKYELVDQV

SEQ ID NO: 3165532 - protein, 23 aa, Giardia lamblia
PDLVRPSVRPALVVDTPGPSATV

SEQ ID NO: 3165533 - protein, 17 aa, Giardia lamblia
PDMIVLKPVDTVIKNGK

SEQ ID NO: 3165534 - protein, 17 aa, Giardia lamblia
PDMSYVSFIGFSGHLMR

SEQ ID NO: 3165535 - protein, 22 aa, Giardia lamblia
PDNIDVHICKDLADYSATKEPP

SEQ ID NO: 3165536 - protein, 19 aa, Giardia lamblia
PDNIFPRLLTILMPLAEER

SEQ ID NO: 3165537 - protein, 25 aa, Giardia lamblia
PDNLRARYWLSYAAAIAGMAIDESG

SEQ ID NO: 3165538 - protein, 28 aa, Giardia lamblia
PDNTEFLSLCPFSGTAMISVLSNQTIRL

SEQ ID NO: 3165539 - protein, 21 aa, Giardia lamblia
PDNTGSFLFNLERFSYDLISQ

SEQ ID NO: 3165540 - protein, 20 aa, Giardia lamblia
PDPICSMISLQESKFVITGH

SEQ ID NO: 3165541 - protein, 26 aa, Giardia lamblia
PDPISINRHCVCMSYVEGIPMHAIKD

SEQ ID NO: 3165542 - protein, 25 aa, Giardia lamblia
PDPREEWGISCWLFANTGELYFQQK

SEQ ID NO: 3165543 - protein, 26 aa, Giardia lamblia
PDPRVRTDIPRRVVGPFYPPDNLRIN

SEQ ID NO: 3165544 - protein, 30 aa, Giardia lamblia
PDPSTIGKYDFLRPKGIQRLGRSDGGIATV

SEQ ID NO: 3165545 - protein, 18 aa, Giardia lamblia
PDPTEIYLSGWDISSKNL

SEQ ID NO: 3165546 - protein, 24 aa, Giardia lamblia
PDPVGALLRRIYNPAPVHAEGIHH

SEQ ID NO: 3165547 - protein, 31 aa, Giardia lamblia
PDPVKRPALSILKERIQIHMAPRLSLPESLR

SEQ ID NO: 3165548 - protein, 29 aa, Giardia lamblia
PDPYLKKEWYPVIAPAHFKSRHIGQTPVT

SEQ ID NO: 3165549 - protein, 23 aa, Giardia lamblia
PDQALCALCEYATVALDLEEKRN

SEQ ID NO: 3165550 - protein, 22 aa, Giardia lamblia
PDRLDKALAELVVLDAIRERSG

SEQ ID NO: 3165551 - protein, 23 aa, Giardia lamblia
PDRLPGIMALGFIAAFSETLALS

SEQ ID NO: 3165552 - protein, 17 aa, Giardia lamblia
PDRPCHYYIERGRDHGR

SEQ ID NO: 3165553 - protein, 25 aa, Giardia lamblia
PDSIKCLRTWIQPFKPATPEFESPC

SEQ ID NO: 3165554 - protein, 23 aa, Giardia lamblia
PDSILRARMGPLMDDQALYKEIS

SEQ ID NO: 3165555 - protein, 23 aa, Giardia lamblia
PDSKLGVSSGQVFDGEDLERAER

SEQ ID NO: 3165556 - protein, 23 aa, Giardia lamblia
PDSNFYRVMLADFGVSKVLSNDD

SEQ ID NO: 3165557 - protein, 21 aa, Giardia lamblia
PDSPPAMGYARLSNPYMDYYK

SEQ ID NO: 3165558 - protein, 21 aa, Giardia lamblia
PDSSQRPAVSLGLNDFQTETE

SEQ ID NO: 3165559 - protein, 20 aa, Giardia lamblia
PDSWRSNSLVNITRICPLFL

SEQ ID NO: 3165560 - protein, 17 aa, Giardia lamblia
PDTEGRKGEQFCPASCF

SEQ ID NO: 3165561 - protein, 17 aa, Giardia lamblia
PDTLGRTIFSIVLYCIQ

SEQ ID NO: 3165562 - protein, 23 aa, Giardia lamblia
PDTMECPFCLAISPHLTSIDSKI

SEQ ID NO: 3165563 - protein, 37 aa, Giardia lamblia
PDTPILLSKCRPRRAGTPLLYREGITTILSYDDEDTD

SEQ ID NO: 3165564 - protein, 21 aa, Giardia lamblia
PDTRCKCCDLPYNLCSNKDNV

SEQ ID NO: 3165565 - protein, 18 aa, Giardia lamblia
PDTSLPRDRADCVPPTVH

SEQ ID NO: 3165566 - protein, 22 aa, Giardia lamblia
PDVADFCLSRPITADEEEVRHA

SEQ ID NO: 3165567 - protein, 17 aa, Giardia lamblia
PDVCVESIACKATIFLN

SEQ ID NO: 3165568 - protein, 20 aa, Giardia lamblia
PDVEGGPSLTVFITHLASAA

SEQ ID NO: 3165569 - protein, 20 aa, Giardia lamblia
PDVFSLQFITQVSKYEEGMP

SEQ ID NO: 3165570 - protein, 25 aa, Giardia lamblia
PDVRQRASFYWRLLGVDPTLQTAKG

SEQ ID NO: 3165571 - protein, 26 aa, Giardia lamblia
PDVTIDWLIPRLAGFSSAEISAIASR

SEQ ID NO: 3165572 - protein, 18 aa, Giardia lamblia
PDVTLAIHCKAGKGRAGT

SEQ ID NO: 3165573 - protein, 25 aa, Giardia lamblia
PDYNSRPTLLDVRLSLQLLSNAEKT

SEQ ID NO: 3165574 - protein, 21 aa, Giardia lamblia
PDYPSRVAVLKAHLRKSKVNE

SEQ ID NO: 3165575 - protein, 25 aa, Giardia lamblia
PDYRVDSCIFTYFDLARELVQRQQD

SEQ ID NO: 3165576 - protein, 23 aa, Giardia lamblia
PDYVGTILLCILKACVHENFRSV

SEQ ID NO: 3165577 - protein, 19 aa, Giardia lamblia
PDYWLTHGSEPFPIIERLD

SEQ ID NO: 3165578 - protein, 21 aa, Giardia lamblia
PEADAVYILERIISRAASVNR

SEQ ID NO: 3165579 - protein, 19 aa, Giardia lamblia
PEADVWLIIAQVVSGIHFL

SEQ ID NO: 3165580 - protein, 19 aa, Giardia lamblia
PEAHLLPRLIRAAHTNDTE

SEQ ID NO: 3165581 - protein, 18 aa, Giardia lamblia
PEAILAMVQAMARCSEST

SEQ ID NO: 3165582 - protein, 20 aa, Giardia lamblia
PEAILDQRIHVLDSLTTQTT

SEQ ID NO: 3165583 - protein, 35 aa, Giardia lamblia
PEAIPEYLLTLNAYRRKLFHVMFDLRRLAHAKETA

SEQ ID NO: 3165584 - protein, 24 aa, Giardia lamblia
PEAKRKMGDLAFRSGYLEDAYSLY

SEQ ID NO: 3165585 - protein, 18 aa, Giardia lamblia
PEALEKWNLGIIAKLLPR

SEQ ID NO: 3165586 - protein, 19 aa, Giardia lamblia
PEALRYTLLPRLLGHIELH

SEQ ID NO: 3165587 - protein, 19 aa, Giardia lamblia
PEAMAVIDDLSRKCLFQRK

SEQ ID NO: 3165588 - protein, 20 aa, Giardia lamblia
PEAMGLFVARVLLREIQYMG

SEQ ID NO: 3165589 - protein, 23 aa, Giardia lamblia
PEAPTLPRYVFRFTGNTEETGHN

SEQ ID NO: 3165590 - protein, 21 aa, Giardia lamblia
PEARSRISLLQDIIEDPPTSF

SEQ ID NO: 3165591 - protein, 19 aa, Giardia lamblia
PEASPSCLLTKLDTLTHQR

SEQ ID NO: 3165592 - protein, 28 aa, Giardia lamblia
PEAVASYLLRLALCLGSEDNVTIVLGLG

SEQ ID NO: 3165593 - protein, 21 aa, Giardia lamblia
PEAYRAFITLSITDIVSIFTI

SEQ ID NO: 3165594 - protein, 21 aa, Giardia lamblia
PECVKFLLKREGGKRRNNGTT

SEQ ID NO: 3165595 - protein, 23 aa, Giardia lamblia
PECVKLLLCELGIYNEKGCTASS

SEQ ID NO: 3165596 - protein, 21 aa, Giardia lamblia
PECVSILLKDLHAMTDNSGYT

SEQ ID NO: 3165597 - protein, 17 aa, Giardia lamblia
PEDAEALLLAYPAALLG

SEQ ID NO: 3165598 - protein, 24 aa, Giardia lamblia
PEDDLRRSSNIFVYKESEQRQTEM

SEQ ID NO: 3165599 - protein, 18 aa, Giardia lamblia
PEDLKVAIIDVISSDPTI

SEQ ID NO: 3165600 - protein, 22 aa, Giardia lamblia
PEDRVRHSLRLSAVAPSDELQD

SEQ ID NO: 3165601 - protein, 23 aa, Giardia lamblia
PEDTELFRFYSLNGSNLQTAVHA

SEQ ID NO: 3165602 - protein, 26 aa, Giardia lamblia
PEEEIWRFSSEILLALDYLHTDDHQN

SEQ ID NO: 3165603 - protein, 20 aa, Giardia lamblia
PEEHSALMIAAYNGHVACVR

SEQ ID NO: 3165604 - protein, 20 aa, Giardia lamblia
PEEMGVALANILSKHQTNID

SEQ ID NO: 3165605 - protein, 31 aa, Giardia lamblia
PEETIWCIAAHILLGLSYCHLLCKPDPGSPS

SEQ ID NO: 3165606 - protein, 20 aa, Giardia lamblia
PEFDSTVSIDSGRFAGMVRD

SEQ ID NO: 3165607 - protein, 21 aa, Giardia lamblia
PEFEFSRGYHIPKHNNITEAR

SEQ ID NO: 3165608 - protein, 20 aa, Giardia lamblia
PEFLSAADLLQKWHMQGNSS

SEQ ID NO: 3165609 - protein, 17 aa, Giardia lamblia
PEFRKMFTRDYVLDSDW

SEQ ID NO: 3165610 - protein, 32 aa, Giardia lamblia
PEFTNPLILNCRVISGHVFRVSRPLRDVRDPS

SEQ ID NO: 3165611 - protein, 26 aa, Giardia lamblia
PEGDGHAFVAFSSVLTRSIFLANPIL

SEQ ID NO: 3165612 - protein, 19 aa, Giardia lamblia
PEGGLLSYPCEMYYYINDE

SEQ ID NO: 3165613 - protein, 21 aa, Giardia lamblia
PEGRTALMMAAQLGLNDIVLV

SEQ ID NO: 3165614 - protein, 30 aa, Giardia lamblia
PEGSASEILSCTPMRCKVETEQLRKNRSNN

SEQ ID NO: 3165615 - protein, 23 aa, Giardia lamblia
PEGTLKGPAFSLSGRTGIDAKNT

SEQ ID NO: 3165616 - protein, 21 aa, Giardia lamblia
PEGTRSRFLERYMMTPENEHR

SEQ ID NO: 3165617 - protein, 20 aa, Giardia lamblia
PEHIILEFQGKFSTLCDANL

SEQ ID NO: 3165618 - protein, 21 aa, Giardia lamblia
PEHNIAMSVLVQGYFNYDPYH

SEQ ID NO: 3165619 - protein, 19 aa, Giardia lamblia
PEIDKHMLVVVPSYYMMVC

SEQ ID NO: 3165620 - protein, 24 aa, Giardia lamblia
PEIFICPFCMRYIRKKKTYTAHIQ

SEQ ID NO: 3165621 - protein, 17 aa, Giardia lamblia
PEIKKLHSYLANTASVS

SEQ ID NO: 3165622 - protein, 21 aa, Giardia lamblia
PEIMQLFCGYAPDYLIQLQNL

SEQ ID NO: 3165623 - protein, 20 aa, Giardia lamblia
PEINCTNGIELDARELELDI

SEQ ID NO: 3165624 - protein, 34 aa, Giardia lamblia
PEINCVRYNERTCLMVAASLGFVELVKLLIPYEA

SEQ ID NO: 3165625 - protein, 20 aa, Giardia lamblia
PEIPEGFYSESFFAAPERSR

SEQ ID NO: 3165626 - protein, 21 aa, Giardia lamblia
PEIPNDAWVSNFLTLDPVLRI

SEQ ID NO: 3165627 - protein, 24 aa, Giardia lamblia
PEIPSISGLMAKVGIGAKTQIDKN

SEQ ID NO: 3165628 - protein, 18 aa, Giardia lamblia
PEITWDMAHEEYMKHQTG

SEQ ID NO: 3165629 - protein, 20 aa, Giardia lamblia
PEIVDELILGCSLFTESNRD

SEQ ID NO: 3165630 - protein, 24 aa, Giardia lamblia
PEIVKSNFPYTAWLTPEQQRGFNI

SEQ ID NO: 3165631 - protein, 19 aa, Giardia lamblia
PEKHEAFVTVYESLVNAKE

SEQ ID NO: 3165632 - protein, 26 aa, Giardia lamblia
PEKLEKAHLFRTLRVLDLSNNLIENF

SEQ ID NO: 3165633 - protein, 18 aa, Giardia lamblia
PEKLPVIRQSGTRVFSSL

SEQ ID NO: 3165634 - protein, 20 aa, Giardia lamblia
PEKLRRCLGDVLSKDAYSTI

SEQ ID NO: 3165635 - protein, 17 aa, Giardia lamblia
PEKRPSNAMVVQQYIAS

SEQ ID NO: 3165636 - protein, 19 aa, Giardia lamblia
PEKSIFLFHACAHNPSGID

SEQ ID NO: 3165637 - protein, 25 aa, Giardia lamblia
PELDVAEAACSGHFFLVSTGATTGG

SEQ ID NO: 3165638 - protein, 21 aa, Giardia lamblia
PELILSILRQLAAALAYLHSV

SEQ ID NO: 3165639 - protein, 19 aa, Giardia lamblia
PELLEKAITHINIRTLVGH

SEQ ID NO: 3165640 - protein, 20 aa, Giardia lamblia
PELLEKIHAAADMAQQADLI

SEQ ID NO: 3165641 - protein, 21 aa, Giardia lamblia
PELLRLCDFGSCTTESYDSER

SEQ ID NO: 3165642 - protein, 18 aa, Giardia lamblia
PELPRLGSTAGVVGAVRA

SEQ ID NO: 3165643 - protein, 29 aa, Giardia lamblia
PELQFLVAPPRYLDQPAFMQSPGISAPHL

SEQ ID NO: 3165644 - protein, 20 aa, Giardia lamblia
PELRSSGSFSAKTDIYSMGR

SEQ ID NO: 3165645 - protein, 20 aa, Giardia lamblia
PELVLRVIKYQKELDGTLKV

SEQ ID NO: 3165646 - protein, 22 aa, Giardia lamblia
PEMERLGSFCTTRFMYLIYDAP

SEQ ID NO: 3165647 - protein, 18 aa, Giardia lamblia
PEMWYSVCAECFAHTIAK

SEQ ID NO: 3165648 - protein, 18 aa, Giardia lamblia
PENISGWNEPQELKKRKG

SEQ ID NO: 3165649 - protein, 23 aa, Giardia lamblia
PENKKLRIQFVEKLMSRDSNQNS

SEQ ID NO: 3165650 - protein, 20 aa, Giardia lamblia
PENLCLKYTLSELRTLDTPV

SEQ ID NO: 3165651 - protein, 17 aa, Giardia lamblia
PENRIHTVFAAILINFT

SEQ ID NO: 3165652 - protein, 24 aa, Giardia lamblia
PENVHFLSGLAIRAEDECIRYENA

SEQ ID NO: 3165653 - protein, 19 aa, Giardia lamblia
PEPASTIIAAFKDKLVAPR

SEQ ID NO: 3165654 - protein, 19 aa, Giardia lamblia
PEPCGFTVVQYWTGCVAKV

SEQ ID NO: 3165655 - protein, 27 aa, Giardia lamblia
PEPETSRLCKCADWERPVCKTCGKAHA

SEQ ID NO: 3165656 - protein, 19 aa, Giardia lamblia
PEPLILEILAQVISATAYL

SEQ ID NO: 3165657 - protein, 28 aa, Giardia lamblia
PEPTVPLDPRFDGLRQRLAAMAGPNRTD

SEQ ID NO: 3165658 - protein, 20 aa, Giardia lamblia
PEPVLPKRILLPFNSIPLSL

SEQ ID NO: 3165659 - protein, 23 aa, Giardia lamblia
PERAREQLLRFDSFKDSAAMAED

SEQ ID NO: 3165660 - protein, 22 aa, Giardia lamblia
PERASTCTRLRAKQHERQSESI

SEQ ID NO: 3165661 - protein, 29 aa, Giardia lamblia
PERFQCSPGTVLAAISFVGHVQYTKCLNH

SEQ ID NO: 3165662 - protein, 23 aa, Giardia lamblia
PERICDACKAIMLKTGNSETRAD

SEQ ID NO: 3165663 - protein, 19 aa, Giardia lamblia
PERMEPYTGLAKRLRVRDF

SEQ ID NO: 3165664 - protein, 19 aa, Giardia lamblia
PESAFCSTSIYSDDSTARE

SEQ ID NO: 3165665 - protein, 25 aa, Giardia lamblia
PESGEPGKCIRIIRGKRGKKRAILV

SEQ ID NO: 3165666 - protein, 26 aa, Giardia lamblia
PESNCRWRPSLAYSDHRPRMKEDVPM

SEQ ID NO: 3165667 - protein, 18 aa, Giardia lamblia
PESRAVMQTCSDHDPHRA

SEQ ID NO: 3165668 - protein, 19 aa, Giardia lamblia
PESTLRCYDFLSTNGSLFD

SEQ ID NO: 3165669 - protein, 17 aa, Giardia lamblia
PETLLSFLVKLEDEPDY

SEQ ID NO: 3165670 - protein, 29 aa, Giardia lamblia
PETLSPRIVWDMVKCESMVRDNFIMIASK

SEQ ID NO: 3165671 - protein, 21 aa, Giardia lamblia
PETRPVPSITPRHPKIMRPAA

SEQ ID NO: 3165672 - protein, 26 aa, Giardia lamblia
PETTQPCPHMAWEMHAGVTSGGKSYA

SEQ ID NO: 3165673 - protein, 31 aa, Giardia lamblia
PETVNMLFRCHVCGKVFADYHFLVSHYEKRH

SEQ ID NO: 3165674 - protein, 23 aa, Giardia lamblia
PEVEDWLTIAMGLYLRVRNPVCA

SEQ ID NO: 3165675 - protein, 19 aa, Giardia lamblia
PEVHLSQLRELYKTQVQPS

SEQ ID NO: 3165676 - protein, 22 aa, Giardia lamblia
PEVITATCFALGTGAEGDPETC

SEQ ID NO: 3165677 - protein, 19 aa, Giardia lamblia
PEVKDGFSSFEIVAPSHAT

SEQ ID NO: 3165678 - protein, 19 aa, Giardia lamblia
PEVKFRSSLQQVRDLIAPC

SEQ ID NO: 3165679 - protein, 23 aa, Giardia lamblia
PEVKQGALCTFRGKYTSISTARE

SEQ ID NO: 3165680 - protein, 20 aa, Giardia lamblia
PEVLNCSYSRHLVQMCEKFA

SEQ ID NO: 3165681 - protein, 22 aa, Giardia lamblia
PEVQIKIAHAMRDCLNITNPYL

SEQ ID NO: 3165682 - protein, 20 aa, Giardia lamblia
PEVREKYALDSHSFTCRVCG

SEQ ID NO: 3165683 - protein, 18 aa, Giardia lamblia
PEVRKLPSQFSHKQNENS

SEQ ID NO: 3165684 - protein, 21 aa, Giardia lamblia
PEVTRILILHECRETNKNNQT

SEQ ID NO: 3165685 - protein, 21 aa, Giardia lamblia
PEVVEILAPYECGRRNKNSRT

SEQ ID NO: 3165686 - protein, 22 aa, Giardia lamblia
PEVVKVLVRYECGQRANNRTAL

SEQ ID NO: 3165687 - protein, 20 aa, Giardia lamblia
PEVYTLLKAFHEYKIPISLF

SEQ ID NO: 3165688 - protein, 26 aa, Giardia lamblia
PEWLKRREYVCSIKRPSALYCDSMIK

SEQ ID NO: 3165689 - protein, 17 aa, Giardia lamblia
PEYDAIAGIPQVSPKEL

SEQ ID NO: 3165690 - protein, 21 aa, Giardia lamblia
PEYIDSGSFGKVYRAYSKDTG

SEQ ID NO: 3165691 - protein, 26 aa, Giardia lamblia
PEYLCRMEPDGILSLELEFGDNIQAT

SEQ ID NO: 3165692 - protein, 30 aa, Giardia lamblia
PEYLGVKDGRGWTALMYSCHFKMERLIEMT

SEQ ID NO: 3165693 - protein, 20 aa, Giardia lamblia
PEYRAAIEAEALRQTHAIVP

SEQ ID NO: 3165694 - protein, 19 aa, Giardia lamblia
PEYRPAELHDVYKTIEYNL

SEQ ID NO: 3165695 - protein, 17 aa, Giardia lamblia
PEYVDAVEKILCRMIVT

SEQ ID NO: 3165696 - protein, 20 aa, Giardia lamblia
PFACNTVRNSVAFLSFPMSA

SEQ ID NO: 3165697 - protein, 22 aa, Giardia lamblia
PFADIKYDLGLSNFNSNEHSTS

SEQ ID NO: 3165698 - protein, 24 aa, Giardia lamblia
PFAKLKNLEIFSAVGNNLESILPS

SEQ ID NO: 3165699 - protein, 20 aa, Giardia lamblia
PFAPADPAPNISRFIKKPGP

SEQ ID NO: 3165700 - protein, 24 aa, Giardia lamblia
PFASKLPPLLVPYLAPDVLQGNYY

SEQ ID NO: 3165701 - protein, 25 aa, Giardia lamblia
PFDATCYVKAVGVSGSTRLQLHAAK

SEQ ID NO: 3165702 - protein, 21 aa, Giardia lamblia
PFDLLSGFTISYDNRRPRAAD

SEQ ID NO: 3165703 - protein, 17 aa, Giardia lamblia
PFDPCNYLYGFKEMDIS

SEQ ID NO: 3165704 - protein, 18 aa, Giardia lamblia
PFEPRKSSAYTVYNGIIF

SEQ ID NO: 3165705 - protein, 22 aa, Giardia lamblia
PFFLSRFKHYSVSVYFQGKDPS

SEQ ID NO: 3165706 - protein, 20 aa, Giardia lamblia
PFFTRDEINIVFSNYEVLNR

SEQ ID NO: 3165707 - protein, 18 aa, Giardia lamblia
PFGKGAWIVNGWKQDGSY

SEQ ID NO: 3165708 - protein, 17 aa, Giardia lamblia
PFGNLVLSSSIDKKIKV

SEQ ID NO: 3165709 - protein, 17 aa, Giardia lamblia
PFIKLTFQIPSKDMAGT

SEQ ID NO: 3165710 - protein, 26 aa, Giardia lamblia
PFILLEFKPKWIALFNAKLVIENSTK

SEQ ID NO: 3165711 - protein, 21 aa, Giardia lamblia
PFKAVSPYLYLLQKLYKDETG

SEQ ID NO: 3165712 - protein, 17 aa, Giardia lamblia
PFLESFSLESENSFLNY

SEQ ID NO: 3165713 - protein, 21 aa, Giardia lamblia
PFNFIPGERPIGFTETFAPEE

SEQ ID NO: 3165714 - protein, 22 aa, Giardia lamblia
PFNNCKLALHWTLDQSLSKIEQ

SEQ ID NO: 3165715 - protein, 21 aa, Giardia lamblia
PFPGTEYFQASPLGLSLLEDE

SEQ ID NO: 3165716 - protein, 20 aa, Giardia lamblia
PFPTSSLLIINWQRGTTESI

SEQ ID NO: 3165717 - protein, 18 aa, Giardia lamblia
PFPVSIKVLERFDLLATR

SEQ ID NO: 3165718 - protein, 18 aa, Giardia lamblia
PFSGRPVAKGNLPYFERC

SEQ ID NO: 3165719 - protein, 20 aa, Giardia lamblia
PFSGSILRLIERQTTHLPTY

SEQ ID NO: 3165720 - protein, 25 aa, Giardia lamblia
PFSIKSDIWALGLTILELCTRNRTF

SEQ ID NO: 3165721 - protein, 21 aa, Giardia lamblia
PFTADMRCSTAFLVVSASVSS

SEQ ID NO: 3165722 - protein, 19 aa, Giardia lamblia
PFTGRTIVSVAMQIVEGKY

SEQ ID NO: 3165723 - protein, 24 aa, Giardia lamblia
PFTSPPPYLRKIFPELAAETPVSP

SEQ ID NO: 3165724 - protein, 17 aa, Giardia lamblia
PFWDYLFDSQFRFQSCS

SEQ ID NO: 3165725 - protein, 28 aa, Giardia lamblia
PFYPERIIKTPVDILCLDWHPERSDLLL

SEQ ID NO: 3165726 - protein, 19 aa, Giardia lamblia
PGAARILAPYEYWRRDNNG

SEQ ID NO: 3165727 - protein, 23 aa, Giardia lamblia
PGAKNPPIFSAELSYVVFVSSSY

SEQ ID NO: 3165728 - protein, 18 aa, Giardia lamblia
PGALWGQGLDRCLYTVEA

SEQ ID NO: 3165729 - protein, 17 aa, Giardia lamblia
PGANTSSSIVFMSDNDM

SEQ ID NO: 3165730 - protein, 20 aa, Giardia lamblia
PGARIPSCRPADLGDYHPPA

SEQ ID NO: 3165731 - protein, 24 aa, Giardia lamblia
PGATVLKAAAFGVVDPLKSVSSCV

SEQ ID NO: 3165732 - protein, 19 aa, Giardia lamblia
PGCSDRRTIVFGYPTSNLY

SEQ ID NO: 3165733 - protein, 17 aa, Giardia lamblia
PGDFLSVCVRLTGLWLL

SEQ ID NO: 3165734 - protein, 21 aa, Giardia lamblia
PGDGMHFCIICDRYFISAEAL

SEQ ID NO: 3165735 - protein, 18 aa, Giardia lamblia
PGDRVVVVGIYRLRQTRP

SEQ ID NO: 3165736 - protein, 22 aa, Giardia lamblia
PGDSRYRRAKVIASLGPSCNTE

SEQ ID NO: 3165737 - protein, 19 aa, Giardia lamblia
PGDTLRFGTDLPPFRLEFS

SEQ ID NO: 3165738 - protein, 22 aa, Giardia lamblia
PGEAMGANMINGFMEAIAPDVE

SEQ ID NO: 3165739 - protein, 18 aa, Giardia lamblia
PGEFHIMQDMTFLAAAPL

SEQ ID NO: 3165740 - protein, 21 aa, Giardia lamblia
PGERAIREYFQFFKRDDKRMI

SEQ ID NO: 3165741 - protein, 23 aa, Giardia lamblia
PGGACSCGALLAELQRVCPLLAA

SEQ ID NO: 3165742 - protein, 22 aa, Giardia lamblia
PGGDGRLQLTFQIKGADVTKIV

SEQ ID NO: 3165743 - protein, 19 aa, Giardia lamblia
PGGLGNRGLTALIDAPLQQ

SEQ ID NO: 3165744 - protein, 19 aa, Giardia lamblia
PGGLKEWIEKGMPIDSKRK

SEQ ID NO: 3165745 - protein, 17 aa, Giardia lamblia
PGGPINSMEIVRAPNSE

SEQ ID NO: 3165746 - protein, 19 aa, Giardia lamblia
PGGRLPKHLYYHSDPTDHL

SEQ ID NO: 3165747 - protein, 19 aa, Giardia lamblia
PGGYYCMGSQLLASKNTVT

SEQ ID NO: 3165748 - protein, 25 aa, Giardia lamblia
PGHAVFKRHGPGLVVTTYGSVDDTF

SEQ ID NO: 3165749 - protein, 22 aa, Giardia lamblia
PGIAEKIFYLARFCGSAGSVVD

SEQ ID NO: 3165750 - protein, 21 aa, Giardia lamblia
PGIILREYWIVTSPAVEVSLL

SEQ ID NO: 3165751 - protein, 23 aa, Giardia lamblia
PGIKSDKVLLCKNYMHAKKIVET

SEQ ID NO: 3165752 - protein, 22 aa, Giardia lamblia
PGIPSPSFLAANIVSMYTTKQG

SEQ ID NO: 3165753 - protein, 18 aa, Giardia lamblia
PGIQPSVVYTTPIIHRME

SEQ ID NO: 3165754 - protein, 17 aa, Giardia lamblia
PGIVCYDEDIDLQSDTV

SEQ ID NO: 3165755 - protein, 25 aa, Giardia lamblia
PGKAGMLKLSLKMDGDDVVSTVNCV

SEQ ID NO: 3165756 - protein, 25 aa, Giardia lamblia
PGKRLCIGCPIITTNKVEYIDSLNA

SEQ ID NO: 3165757 - protein, 18 aa, Giardia lamblia
PGKVIKEVSIYGLQEAKL

SEQ ID NO: 3165758 - protein, 24 aa, Giardia lamblia
PGKVKQLPPWRGLIDEPNVDLPSK

SEQ ID NO: 3165759 - protein, 19 aa, Giardia lamblia
PGLDVFLVSLAELYDLAIF

SEQ ID NO: 3165760 - protein, 18 aa, Giardia lamblia
PGLLHKGTVIRPAQVVIN

SEQ ID NO: 3165761 - protein, 18 aa, Giardia lamblia
PGLLKALDLCKITIQGMY

SEQ ID NO: 3165762 - protein, 21 aa, Giardia lamblia
PGMAYRLGIFYSTPENMKSFG

SEQ ID NO: 3165763 - protein, 19 aa, Giardia lamblia
PGNCVYCLDGLRDNIYPYI

SEQ ID NO: 3165764 - protein, 25 aa, Giardia lamblia
PGNLRQAVAYAVRFQSTVTPETKLI

SEQ ID NO: 3165765 - protein, 17 aa, Giardia lamblia
PGNSLAESSYKRITSSV

SEQ ID NO: 3165766 - protein, 23 aa, Giardia lamblia
PGNTCSFPYAEFLCATVEYDVSA

SEQ ID NO: 3165767 - protein, 21 aa, Giardia lamblia
PGPGAALWFKGRVLRDETVLS

SEQ ID NO: 3165768 - protein, 23 aa, Giardia lamblia
PGPGVYVLSLFPAVGVTTANPSA

SEQ ID NO: 3165769 - protein, 26 aa, Giardia lamblia
PGPLRLLFIILKWSCFKCEQEALELH

SEQ ID NO: 3165770 - protein, 18 aa, Giardia lamblia
PGQLTIASNQIRWTQHVA

SEQ ID NO: 3165771 - protein, 18 aa, Giardia lamblia
PGQMKYSSVVLDQKGGNL

SEQ ID NO: 3165772 - protein, 26 aa, Giardia lamblia
PGQRKVLYACFKRNLKTKLKVSQLSG

SEQ ID NO: 3165773 - protein, 20 aa, Giardia lamblia
PGQSHLASFCAPNQNEELIR

SEQ ID NO: 3165774 - protein, 26 aa, Giardia lamblia
PGQSSLPIALYSYRRKLFHTILAGTR

SEQ ID NO: 3165775 - protein, 23 aa, Giardia lamblia
PGRLRPSQPVSLLASLSGSRVSN

SEQ ID NO: 3165776 - protein, 21 aa, Giardia lamblia
PGRTIRVWCAIWMICKQYRES

SEQ ID NO: 3165777 - protein, 20 aa, Giardia lamblia
PGSCRVCGSYHSPEYMLDRA

SEQ ID NO: 3165778 - protein, 17 aa, Giardia lamblia
PGSHPGRLILWTKSAFA

SEQ ID NO: 3165779 - protein, 18 aa, Giardia lamblia
PGSHTLTLFYDLSNIASN

SEQ ID NO: 3165780 - protein, 23 aa, Giardia lamblia
PGSKESRNELALSAGPAKSSERP

SEQ ID NO: 3165781 - protein, 20 aa, Giardia lamblia
PGSLAHLAGFLAHMAQGKTA

SEQ ID NO: 3165782 - protein, 20 aa, Giardia lamblia
PGSLPPWVQTILSIAQQVNL

SEQ ID NO: 3165783 - protein, 20 aa, Giardia lamblia
PGSLRRIFNLLGKQYCQDNG

SEQ ID NO: 3165784 - protein, 20 aa, Giardia lamblia
PGSLTALHICAMKNYAPVAV

SEQ ID NO: 3165785 - protein, 19 aa, Giardia lamblia
PGSMKVCRRYTIPLNAVLD

SEQ ID NO: 3165786 - protein, 30 aa, Giardia lamblia
PGSMLCTWGVCSFCDSRKAPNYLTTTIQDR

SEQ ID NO: 3165787 - protein, 23 aa, Giardia lamblia
PGTARPGERPAILPRTMGADVSV

SEQ ID NO: 3165788 - protein, 25 aa, Giardia lamblia
PGTEILAGLRLDYVLDLHSHSCLSG

SEQ ID NO: 3165789 - protein, 22 aa, Giardia lamblia
PGTSICWRMTKESGGVSSVNED

SEQ ID NO: 3165790 - protein, 18 aa, Giardia lamblia
PGTTALMIAARTGFLDGV

SEQ ID NO: 3165791 - protein, 18 aa, Giardia lamblia
PGVADARMATLAEENSAL

SEQ ID NO: 3165792 - protein, 17 aa, Giardia lamblia
PGVARLLGTAVRATGEF

SEQ ID NO: 3165793 - protein, 18 aa, Giardia lamblia
PGVDGGLQIVTRRSSVDA

SEQ ID NO: 3165794 - protein, 18 aa, Giardia lamblia
PGVLTLPDGTRWVGEFRN

SEQ ID NO: 3165795 - protein, 20 aa, Giardia lamblia
PGVRIPLVLDGAEGKLVHIN

SEQ ID NO: 3165796 - protein, 20 aa, Giardia lamblia
PGVYWVGIVDWMVRIFHGYH

SEQ ID NO: 3165797 - protein, 25 aa, Giardia lamblia
PGYAQRYYLGIGLMDDFPETNQESD

SEQ ID NO: 3165798 - protein, 22 aa, Giardia lamblia
PGYKLLFIGGMEKLDKETEIAH

SEQ ID NO: 3165799 - protein, 17 aa, Giardia lamblia
PHAACEIDLKKSLRECV

SEQ ID NO: 3165800 - protein, 21 aa, Giardia lamblia
PHAPGCLVLALPPGVVPGPGV

SEQ ID NO: 3165801 - protein, 24 aa, Giardia lamblia
PHATCKRKEVSILHIHTSTPRQHN

SEQ ID NO: 3165802 - protein, 22 aa, Giardia lamblia
PHEISPDLLLAHDWVGREERRA

SEQ ID NO: 3165803 - protein, 18 aa, Giardia lamblia
PHEQLELAINAVFRSWTN

SEQ ID NO: 3165804 - protein, 25 aa, Giardia lamblia
PHGDMLCAFGAFYQYLFLTLPPTCC

SEQ ID NO: 3165805 - protein, 20 aa, Giardia lamblia
PHGGAGLGLERIVMLMLGIE

SEQ ID NO: 3165806 - protein, 26 aa, Giardia lamblia
PHGLRECIPLILILRNRLHYANTYAE

SEQ ID NO: 3165807 - protein, 18 aa, Giardia lamblia
PHIAAKSEAPLCRPVTAQ

SEQ ID NO: 3165808 - protein, 24 aa, Giardia lamblia
PHIPDLGLIQAFKCMYSSAAYFKG

SEQ ID NO: 3165809 - protein, 29 aa, Giardia lamblia
PHITTVCSKCLRIAVLVLTPREGEGATLF

SEQ ID NO: 3165810 - protein, 17 aa, Giardia lamblia
PHIWANLTYVFVSLSNL

SEQ ID NO: 3165811 - protein, 27 aa, Giardia lamblia
PHKPFKIPHYPPFKPGARGGAYTNPNM

SEQ ID NO: 3165812 - protein, 25 aa, Giardia lamblia
PHKVCSNGSFDRCFCPHLTIDSPLL

SEQ ID NO: 3165813 - protein, 18 aa, Giardia lamblia
PHLRRLRQGSGPPPCAPT

SEQ ID NO: 3165814 - protein, 25 aa, Giardia lamblia
PHLTLPRMRESIGTDEVDAIVSTGS

SEQ ID NO: 3165815 - protein, 17 aa, Giardia lamblia
PHMAGLALLSFSNSDAS

SEQ ID NO: 3165816 - protein, 19 aa, Giardia lamblia
PHMDLRYQPFIIAKLKGYI

SEQ ID NO: 3165817 - protein, 26 aa, Giardia lamblia
PHNIQIADFFLKYLNIYLSENYSEIV

SEQ ID NO: 3165818 - protein, 19 aa, Giardia lamblia
PHNRSSSWLKDVSEGVDTH

SEQ ID NO: 3165819 - protein, 19 aa, Giardia lamblia
PHPLESKIVIRLQTNPSGF

SEQ ID NO: 3165820 - protein, 17 aa, Giardia lamblia
PHPMVIQVVQLVLRIMV

SEQ ID NO: 3165821 - protein, 20 aa, Giardia lamblia
PHPQFPIGLLQKTLKLTNDP

SEQ ID NO: 3165822 - protein, 23 aa, Giardia lamblia
PHPVMRPQRIVIVVQKVLIPQWK

SEQ ID NO: 3165823 - protein, 17 aa, Giardia lamblia
PHPVSTLDMQRALSESL

SEQ ID NO: 3165824 - protein, 18 aa, Giardia lamblia
PHQAPVSFMELTRPKFKS

SEQ ID NO: 3165825 - protein, 21 aa, Giardia lamblia
PHQRVRYSVLSAIGQLSEDYA

SEQ ID NO: 3165826 - protein, 19 aa, Giardia lamblia
PHRLEEWEEKFGCDEDEPR

SEQ ID NO: 3165827 - protein, 20 aa, Giardia lamblia
PHSHYTPRSSNTMRVSYGPH

SEQ ID NO: 3165828 - protein, 18 aa, Giardia lamblia
PHSTWQFNMLFDETTPLS

SEQ ID NO: 3165829 - protein, 22 aa, Giardia lamblia
PHTACGDPIFAKDADGNEMYAY

SEQ ID NO: 3165830 - protein, 24 aa, Giardia lamblia
PHTGVLDVAMRFRELDLGESVTMN

SEQ ID NO: 3165831 - protein, 17 aa, Giardia lamblia
PHTHVCTILAGISDATM

SEQ ID NO: 3165832 - protein, 22 aa, Giardia lamblia
PHVYMPNLWLGCLQSISYESFL

SEQ ID NO: 3165833 - protein, 18 aa, Giardia lamblia
PHWRDDRLTIKQLLAPYL

SEQ ID NO: 3165834 - protein, 24 aa, Giardia lamblia
PHYLKLAAYNSVALKAFLMPHVPP

SEQ ID NO: 3165835 - protein, 20 aa, Giardia lamblia
PHYREAYGVPSIDLPHSVLE

SEQ ID NO: 3165836 - protein, 17 aa, Giardia lamblia
PIAERPENISGWNEPQE

SEQ ID NO: 3165837 - protein, 18 aa, Giardia lamblia
PIANCMARSAAFDAVTAI

SEQ ID NO: 3165838 - protein, 21 aa, Giardia lamblia
PIAQLHHKLMCAAKEAYTEAK

SEQ ID NO: 3165839 - protein, 18 aa, Giardia lamblia
PIATPGAVLTDVFRGLRE

SEQ ID NO: 3165840 - protein, 18 aa, Giardia lamblia
PICDKCKEKIRSGQYPAG

SEQ ID NO: 3165841 - protein, 30 aa, Giardia lamblia
PICELSLHGCEHLLRAPFTGSINGRAVGGQ

SEQ ID NO: 3165842 - protein, 18 aa, Giardia lamblia
PICQRSVRRAQSMRYMTG

SEQ ID NO: 3165843 - protein, 25 aa, Giardia lamblia
PIDCSICQLYRLYVWGFRTINYSAT

SEQ ID NO: 3165844 - protein, 22 aa, Giardia lamblia
PIDIYCLLFPTGVFQITPDEHL

SEQ ID NO: 3165845 - protein, 19 aa, Giardia lamblia
PIDYVMHALATYKSNSHLK

SEQ ID NO: 3165846 - protein, 23 aa, Giardia lamblia
PIEAGIRSKGGWSALMLATQLGR

SEQ ID NO: 3165847 - protein, 18 aa, Giardia lamblia
PIECGDIFINTLRLASNY

SEQ ID NO: 3165848 - protein, 29 aa, Giardia lamblia
PIEDQEVWIRFSVLCLQSGRVQLARKTLE

SEQ ID NO: 3165849 - protein, 18 aa, Giardia lamblia
PIEETLFIYEFVLSVVLA

SEQ ID NO: 3165850 - protein, 18 aa, Giardia lamblia
PIERCGHCSYCCSSPVEV

SEQ ID NO: 3165851 - protein, 18 aa, Giardia lamblia
PIFKELLDTHYAPALTPP

SEQ ID NO: 3165852 - protein, 19 aa, Giardia lamblia
PIFTTELQPRYTLLESTLD

SEQ ID NO: 3165853 - protein, 18 aa, Giardia lamblia
PIGEFLSFHRPQVAKMNQ

SEQ ID NO: 3165854 - protein, 18 aa, Giardia lamblia
PIGSVSFTTPGNITSLDA

SEQ ID NO: 3165855 - protein, 17 aa, Giardia lamblia
PIGVITRMDLLKSKMRR

SEQ ID NO: 3165856 - protein, 25 aa, Giardia lamblia
PIHISGKCDVIVGVVNYLTSKAEEL

SEQ ID NO: 3165857 - protein, 25 aa, Giardia lamblia
PIIRIRTGLPLSTYFTAGKVLWLYR

SEQ ID NO: 3165858 - protein, 18 aa, Giardia lamblia
PIIYRDDTNFSWSSESGE

SEQ ID NO: 3165859 - protein, 17 aa, Giardia lamblia
PIKAWKRVNECTIEFEV

SEQ ID NO: 3165860 - protein, 20 aa, Giardia lamblia
PILAENLLAAGIKIKTGFGL

SEQ ID NO: 3165861 - protein, 25 aa, Giardia lamblia
PILARARPVLIGMFNGSSESGQYAE

SEQ ID NO: 3165862 - protein, 18 aa, Giardia lamblia
PILEMAMLVELYVQDLTL

SEQ ID NO: 3165863 - protein, 22 aa, Giardia lamblia
PILLSRKLDVLSFYIGTEKTWS

SEQ ID NO: 3165864 - protein, 26 aa, Giardia lamblia
PILLSVFMRCCIEKSISLKVPFRLGN

SEQ ID NO: 3165865 - protein, 24 aa, Giardia lamblia
PINAIKWCGWRNALFTGGSDGDLY

SEQ ID NO: 3165866 - protein, 17 aa, Giardia lamblia
PINCHWGSYIYGYNAYR

SEQ ID NO: 3165867 - protein, 41 aa, Giardia lamblia
PIPEFGKYPPVLTCGNGCIHLCDFNSNLVLFTGYYEEEIDQ

SEQ ID NO: 3165868 - protein, 31 aa, Giardia lamblia
PIPFYRFCPEIFPGPQFKPTVVHLFMRLLEK

SEQ ID NO: 3165869 - protein, 18 aa, Giardia lamblia
PIPQYGISSFVPVDQYAQ

SEQ ID NO: 3165870 - protein, 18 aa, Giardia lamblia
PIPSRIIIEPPLKRRGEL

SEQ ID NO: 3165871 - protein, 23 aa, Giardia lamblia
PIPSYYCNLLLFKNAPATFPYTV

SEQ ID NO: 3165872 - protein, 17 aa, Giardia lamblia
PIPTPTAICHEILEGSG

SEQ ID NO: 3165873 - protein, 21 aa, Giardia lamblia
PIREICFHTSYSTHTLISADS

SEQ ID NO: 3165874 - protein, 21 aa, Giardia lamblia
PIRIRCLTGVPTLAVESDRLA

SEQ ID NO: 3165875 - protein, 19 aa, Giardia lamblia
PISALTRRGSLPGGSYAVM

SEQ ID NO: 3165876 - protein, 18 aa, Giardia lamblia
PISKLLIYSVFLDLLGLA

SEQ ID NO: 3165877 - protein, 25 aa, Giardia lamblia
PISPDLRNALSYSVEDECMGYLRNC

SEQ ID NO: 3165878 - protein, 20 aa, Giardia lamblia
PITAAARYPAFPFNPLSIVT

SEQ ID NO: 3165879 - protein, 20 aa, Giardia lamblia
PITSACIYKNYLMLACSHDH

SEQ ID NO: 3165880 - protein, 19 aa, Giardia lamblia
PIVELSRMTATSGVGDELV

SEQ ID NO: 3165881 - protein, 22 aa, Giardia lamblia
PIYKSNGLTIASRVTLGSPHKS

SEQ ID NO: 3165882 - protein, 31 aa, Giardia lamblia
PKAAESLVRTCILPIKRRNQIFSIRPNVDAN

SEQ ID NO: 3165883 - protein, 34 aa, Giardia lamblia
PKAISFLTRDSWRMLLLIHYLEFVKKAYHKFISE

SEQ ID NO: 3165884 - protein, 17 aa, Giardia lamblia
PKAIVIPQQLQRLASRT

SEQ ID NO: 3165885 - protein, 21 aa, Giardia lamblia
PKAMVLYGYDMPPLLPSKDRQ

SEQ ID NO: 3165886 - protein, 19 aa, Giardia lamblia
PKATIDAFASIITHTKDFL

SEQ ID NO: 3165887 - protein, 18 aa, Giardia lamblia
PKAVSIGLLPDREAVPAP

SEQ ID NO: 3165888 - protein, 17 aa, Giardia lamblia
PKDALAMTPIDTVLDKQ

SEQ ID NO: 3165889 - protein, 29 aa, Giardia lamblia
PKDKPRYLMGVGFPLDLVVCTCLGVDMFD

SEQ ID NO: 3165890 - protein, 19 aa, Giardia lamblia
PKDKWRDINHLLVGFGQTV

SEQ ID NO: 3165891 - protein, 20 aa, Giardia lamblia
PKECYPQFIDWIELLTTHRF

SEQ ID NO: 3165892 - protein, 30 aa, Giardia lamblia
PKEIKNLAMEFLRQDRLVSITVGQIGSSNP

SEQ ID NO: 3165893 - protein, 21 aa, Giardia lamblia
PKELASTLIYRKTVFYESLNL

SEQ ID NO: 3165894 - protein, 21 aa, Giardia lamblia
PKFEEVYTFIYRLFRKAQVEP

SEQ ID NO: 3165895 - protein, 21 aa, Giardia lamblia
PKFKEKLVVLLSDFEDAIKKT

SEQ ID NO: 3165896 - protein, 19 aa, Giardia lamblia
PKFKSYQPLPSSSRRFSDG

SEQ ID NO: 3165897 - protein, 23 aa, Giardia lamblia
PKGFLSLHGRAIFGGVMLSNLMA

SEQ ID NO: 3165898 - protein, 21 aa, Giardia lamblia
PKGKRLSVYQENEFRRRLLDM

SEQ ID NO: 3165899 - protein, 24 aa, Giardia lamblia
PKGLEKKPSPVEWAYVQSSQSPQS

SEQ ID NO: 3165900 - protein, 19 aa, Giardia lamblia
PKHCIDILIMDEATAIKNT

SEQ ID NO: 3165901 - protein, 19 aa, Giardia lamblia
PKHPDRIVVRFLTEEIEGH

SEQ ID NO: 3165902 - protein, 21 aa, Giardia lamblia
PKHWLLDKMGGIWAPRPTNGP

SEQ ID NO: 3165903 - protein, 29 aa, Giardia lamblia
PKIAIPLERFRKSFYLRRVLQEKENNEQA

SEQ ID NO: 3165904 - protein, 23 aa, Giardia lamblia
PKIHPLPCYSSISSINGPIVVVD

SEQ ID NO: 3165905 - protein, 25 aa, Giardia lamblia
PKILKNIPASSSWEPIVEVMNPLAW

SEQ ID NO: 3165906 - protein, 20 aa, Giardia lamblia
PKIPANGLVFGTLRYNPAND

SEQ ID NO: 3165907 - protein, 38 aa, Giardia lamblia
PKIRKEVFAVILIRCGHCIRPDVVMELAWVNRMTDYMM

SEQ ID NO: 3165908 - protein, 21 aa, Giardia lamblia
PKKAHAYAMPGQLLAIHDNTA

SEQ ID NO: 3165909 - protein, 19 aa, Giardia lamblia
PKKFVTAFCNMTYQYDINL

SEQ ID NO: 3165910 - protein, 23 aa, Giardia lamblia
PKKGGNVPIGIIIHRDIKPQNIL

SEQ ID NO: 3165911 - protein, 26 aa, Giardia lamblia
PKKQSAWMAVCIPESAPSLVSGPVPL

SEQ ID NO: 3165912 - protein, 19 aa, Giardia lamblia
PKKVPLKVRLDVSSITPES

SEQ ID NO: 3165913 - protein, 18 aa, Giardia lamblia
PKLFHVVFTSAEKAMKFI

SEQ ID NO: 3165914 - protein, 25 aa, Giardia lamblia
PKLILPGYMLLLSDVFFSMKVPQFP

SEQ ID NO: 3165915 - protein, 17 aa, Giardia lamblia
PKLLPIISSQVLKTEAA

SEQ ID NO: 3165916 - protein, 19 aa, Giardia lamblia
PKLSTVMKRRCYLDNFCVP

SEQ ID NO: 3165917 - protein, 19 aa, Giardia lamblia
PKMVRLLVEQEAKLTNNDG

SEQ ID NO: 3165918 - protein, 25 aa, Giardia lamblia
PKNCRKFNICWGSPKNVSFYSTLVA

SEQ ID NO: 3165919 - protein, 23 aa, Giardia lamblia
PKNLPRWPSKKVTKGISPIAPTD

SEQ ID NO: 3165920 - protein, 18 aa, Giardia lamblia
PKPIEFTAAWPSNYTLLD

SEQ ID NO: 3165921 - protein, 22 aa, Giardia lamblia
PKPPSVNTFLPLAYSTDTPLHD

SEQ ID NO: 3165922 - protein, 17 aa, Giardia lamblia
PKPTAMMGIQPSLHSIP

SEQ ID NO: 3165923 - protein, 19 aa, Giardia lamblia
PKPTEKIVYALGLTEMHDI

SEQ ID NO: 3165924 - protein, 25 aa, Giardia lamblia
PKQIFSLDVCALIGDQPHSLRWQGV

SEQ ID NO: 3165925 - protein, 17 aa, Giardia lamblia
PKQLVACSLVLRRQSIL

SEQ ID NO: 3165926 - protein, 19 aa, Giardia lamblia
PKQQFFVVATRDWELISKI

SEQ ID NO: 3165927 - protein, 21 aa, Giardia lamblia
PKQRLKFRVQDEHLVVSIMAE

SEQ ID NO: 3165928 - protein, 19 aa, Giardia lamblia
PKRQCKHTTGLVFSSVPTS

SEQ ID NO: 3165929 - protein, 19 aa, Giardia lamblia
PKRVLRKEEKAFVEAKQYL

SEQ ID NO: 3165930 - protein, 20 aa, Giardia lamblia
PKSAILCNCVVPFASGEVLT

SEQ ID NO: 3165931 - protein, 17 aa, Giardia lamblia
PKSAVSFTTVSNTSPRS

SEQ ID NO: 3165932 - protein, 18 aa, Giardia lamblia
PKSGGRWRPIAVQETLLV

SEQ ID NO: 3165933 - protein, 24 aa, Giardia lamblia
PKSMRCAACKSSVYCSPGCQAQDW

SEQ ID NO: 3165934 - protein, 26 aa, Giardia lamblia
PKSVTAWPPPLRDYRSSEEVIVTPHP

SEQ ID NO: 3165935 - protein, 24 aa, Giardia lamblia
PKTADKPGSVAFPIFTDTNSTRSK

SEQ ID NO: 3165936 - protein, 22 aa, Giardia lamblia
PKTFRPRLTHAMRCQLTEKQKR

SEQ ID NO: 3165937 - protein, 21 aa, Giardia lamblia
PKTGEKFSYLYGEFLQNAQGE

SEQ ID NO: 3165938 - protein, 19 aa, Giardia lamblia
PKTLQVHLTFWKPVIETIL

SEQ ID NO: 3165939 - protein, 18 aa, Giardia lamblia
PKTVRSTGSVIGKVTGSQ

SEQ ID NO: 3165940 - protein, 22 aa, Giardia lamblia
PKVITEPFLPVLLLHNELAISL

SEQ ID NO: 3165941 - protein, 18 aa, Giardia lamblia
PKVLCIYTGGTIGMKKDS

SEQ ID NO: 3165942 - protein, 18 aa, Giardia lamblia
PKYEAVRWLEALLEQLGI

SEQ ID NO: 3165943 - protein, 17 aa, Giardia lamblia
PKYFAPGSMTLMQESAP

SEQ ID NO: 3165944 - protein, 22 aa, Giardia lamblia
PKYMAPEIMLTIGRTMDNKKTE

SEQ ID NO: 3165945 - protein, 18 aa, Giardia lamblia
PLADTWRAMEQLVEEGLV

SEQ ID NO: 3165946 - protein, 22 aa, Giardia lamblia
PLAEALCYWNMAVEYEAAFLLK

SEQ ID NO: 3165947 - protein, 19 aa, Giardia lamblia
PLAEELLGFLPRDSFPSTY

SEQ ID NO: 3165948 - protein, 18 aa, Giardia lamblia
PLAPEAPASWELAQEKLK

SEQ ID NO: 3165949 - protein, 23 aa, Giardia lamblia
PLASITIYDIFSSVYTFDLSDIQ

SEQ ID NO: 3165950 - protein, 19 aa, Giardia lamblia
PLAVCISLCRPNQSLPNNL

SEQ ID NO: 3165951 - protein, 19 aa, Giardia lamblia
PLCDELTVGFAKLRSLDIL

SEQ ID NO: 3165952 - protein, 17 aa, Giardia lamblia
PLCLRLLSEVSVDANVT

SEQ ID NO: 3165953 - protein, 19 aa, Giardia lamblia
PLDALPPLLSFSLPVLPPK

SEQ ID NO: 3165954 - protein, 20 aa, Giardia lamblia
PLDEWECLHRPLFSNNKLPT

SEQ ID NO: 3165955 - protein, 25 aa, Giardia lamblia
PLDKTCPCLGCKRPKAYLRHLYTTH

SEQ ID NO: 3165956 - protein, 25 aa, Giardia lamblia
PLDLYEVYCICCQQIDKQSVKQMDS

SEQ ID NO: 3165957 - protein, 31 aa, Giardia lamblia
PLDMRSQLLLRHYPPMLCIRLLLCRVQTILC

SEQ ID NO: 3165958 - protein, 24 aa, Giardia lamblia
PLDQLSIGLIKPSVAPIVTAILRS

SEQ ID NO: 3165959 - protein, 19 aa, Giardia lamblia
PLDVRLRHNYYFLTGFVWT

SEQ ID NO: 3165960 - protein, 18 aa, Giardia lamblia
PLDYLYPGETSHNAASVT

SEQ ID NO: 3165961 - protein, 19 aa, Giardia lamblia
PLEDSRMVMFRTKRSQQSP

SEQ ID NO: 3165962 - protein, 23 aa, Giardia lamblia
PLEFCTSTLAFSYFNPCDDSQLT

SEQ ID NO: 3165963 - protein, 20 aa, Giardia lamblia
PLEIYRHLKEAASLPNIKHV

SEQ ID NO: 3165964 - protein, 23 aa, Giardia lamblia
PLEKFVPEERFPELNTDEVYLQY

SEQ ID NO: 3165965 - protein, 18 aa, Giardia lamblia
PLEKMDAYCAAFQCLPSL

SEQ ID NO: 3165966 - protein, 24 aa, Giardia lamblia
PLELEICSQLAFYYAQDASITDLL

SEQ ID NO: 3165967 - protein, 22 aa, Giardia lamblia
PLELRLKVVQLREQQSLPFSTI

SEQ ID NO: 3165968 - protein, 27 aa, Giardia lamblia
PLELVLWLPTLCHKMGVPYAIVRTKGD

SEQ ID NO: 3165969 - protein, 19 aa, Giardia lamblia
PLENPCPRDSSTVRQSTPI

SEQ ID NO: 3165970 - protein, 22 aa, Giardia lamblia
PLEPIGCPLIQLQVLDLSNCSI

SEQ ID NO: 3165971 - protein, 22 aa, Giardia lamblia
PLEPYQSVAVYSFLDHGKAFRY

SEQ ID NO: 3165972 - protein, 20 aa, Giardia lamblia
PLEVWAKIRALSSASLDKAM

SEQ ID NO: 3165973 - protein, 20 aa, Giardia lamblia
PLEYNFLSLVAMYTQAYVRD

SEQ ID NO: 3165974 - protein, 18 aa, Giardia lamblia
PLFGLKYAQQFMYSSGFD

SEQ ID NO: 3165975 - protein, 18 aa, Giardia lamblia
PLFLRGKEKYGFLYMFSK

SEQ ID NO: 3165976 - protein, 21 aa, Giardia lamblia
PLFTGESVAVFGLSRTGSGKT

SEQ ID NO: 3165977 - protein, 24 aa, Giardia lamblia
PLGEGVKNIVCFVFSESRDKLIVS

SEQ ID NO: 3165978 - protein, 19 aa, Giardia lamblia
PLGGCLDSSISHSFGASGD

SEQ ID NO: 3165979 - protein, 18 aa, Giardia lamblia
PLGHMDIGSLPIILDHST

SEQ ID NO: 3165980 - protein, 18 aa, Giardia lamblia
PLGIYKVDARYCREVNDT

SEQ ID NO: 3165981 - protein, 17 aa, Giardia lamblia
PLGPVFKAKRTHDGMTV

SEQ ID NO: 3165982 - protein, 32 aa, Giardia lamblia
PLGRLFSNRALKIWALEIILERHNSFSIPPSF

SEQ ID NO: 3165983 - protein, 18 aa, Giardia lamblia
PLHGQRVYSWVYVAPTED

SEQ ID NO: 3165984 - protein, 19 aa, Giardia lamblia
PLHTECLDISLARMEWSHV

SEQ ID NO: 3165985 - protein, 17 aa, Giardia lamblia
PLIDEVFSMEQRLKAFD

SEQ ID NO: 3165986 - protein, 26 aa, Giardia lamblia
PLIEVSRGVSFLRLSPMEDFSQSFME

SEQ ID NO: 3165987 - protein, 18 aa, Giardia lamblia
PLIGKCTRPPASGTITVT

SEQ ID NO: 3165988 - protein, 18 aa, Giardia lamblia
PLILAARAGNIGCIPFLI

SEQ ID NO: 3165989 - protein, 24 aa, Giardia lamblia
PLKCSICSYLGLVLHKRALPDVVQ

SEQ ID NO: 3165990 - protein, 18 aa, Giardia lamblia
PLKGRPEAILAMVQAMAR

SEQ ID NO: 3165991 - protein, 17 aa, Giardia lamblia
PLKNPSVFYDLRTGTIG

SEQ ID NO: 3165992 - protein, 29 aa, Giardia lamblia
PLKPPSSDCPYLYCTTNYQLCNAINIPDV

SEQ ID NO: 3165993 - protein, 18 aa, Giardia lamblia
PLLCKRLADITNEARNQL

SEQ ID NO: 3165994 - protein, 18 aa, Giardia lamblia
PLLEAISSIDVVRKLVSF

SEQ ID NO: 3165995 - protein, 23 aa, Giardia lamblia
PLLEEAQARMRIFESSYAEKENE

SEQ ID NO: 3165996 - protein, 19 aa, Giardia lamblia
PLLLCGLAALRYQVDLMLL

SEQ ID NO: 3165997 - protein, 26 aa, Giardia lamblia
PLLNLRLIDFQGIRLARDSTYRQTLA

SEQ ID NO: 3165998 - protein, 22 aa, Giardia lamblia
PLLRLLPCLFRLLKGLEQHVWR

SEQ ID NO: 3165999 - protein, 23 aa, Giardia lamblia
PLLSQNCLQAFVAMRHVNITPIY

SEQ ID NO: 3166000 - protein, 18 aa, Giardia lamblia
PLLSSRKAFTDKFTHLQS

SEQ ID NO: 3166001 - protein, 17 aa, Giardia lamblia
PLLTAIMELFNFSIDDA

SEQ ID NO: 3166002 - protein, 18 aa, Giardia lamblia
PLLTDIMRLPRLSDSFRG

SEQ ID NO: 3166003 - protein, 24 aa, Giardia lamblia
PLNEARKRLSILLEQEKNYLEQKN

SEQ ID NO: 3166004 - protein, 31 aa, Giardia lamblia
PLNEATACFIMYHLVKGVAYLHESKVIHRDL

SEQ ID NO: 3166005 - protein, 18 aa, Giardia lamblia
PLNHMAIEALLILVYLQY

SEQ ID NO: 3166006 - protein, 18 aa, Giardia lamblia
PLNILSYVLERLKRAKLV

SEQ ID NO: 3166007 - protein, 18 aa, Giardia lamblia
PLNISAVILLARHEGGMV

SEQ ID NO: 3166008 - protein, 19 aa, Giardia lamblia
PLNPLAIPKNRQISCDLCS

SEQ ID NO: 3166009 - protein, 26 aa, Giardia lamblia
PLNVPRSILNFPLLDSHAMLKLLERA

SEQ ID NO: 3166010 - protein, 22 aa, Giardia lamblia
PLPEHHHRGFAWLIESLTTIKE

SEQ ID NO: 3166011 - protein, 23 aa, Giardia lamblia
PLPELPSTLSQGINNFVFPQSYD

SEQ ID NO: 3166012 - protein, 24 aa, Giardia lamblia
PLPKELRYIFQLAASAYSLIMNDS

SEQ ID NO: 3166013 - protein, 18 aa, Giardia lamblia
PLPKRHSVSMHEPRTEEP

SEQ ID NO: 3166014 - protein, 19 aa, Giardia lamblia
PLPPPSIDATEPFLQSHHQ

SEQ ID NO: 3166015 - protein, 17 aa, Giardia lamblia
PLPQSVSAFGMPQMGMG

SEQ ID NO: 3166016 - protein, 30 aa, Giardia lamblia
PLPRKFVLMFQLEFAQRLAAEPGQDQYSRL

SEQ ID NO: 3166017 - protein, 18 aa, Giardia lamblia
PLPVFIAINHDIRPSFIF

SEQ ID NO: 3166018 - protein, 18 aa, Giardia lamblia
PLQMTFTILPVIKGFMAA

SEQ ID NO: 3166019 - protein, 21 aa, Giardia lamblia
PLQNLVCLFLQENLISKVENL

SEQ ID NO: 3166020 - protein, 28 aa, Giardia lamblia
PLQNNLHELWALLNFISPLIFNVPEDFV

SEQ ID NO: 3166021 - protein, 28 aa, Giardia lamblia
PLQRRIDFYRMWASLFVQPESDLGTGDY

SEQ ID NO: 3166022 - protein, 19 aa, Giardia lamblia
PLQRVCSYVPDLSAGQLAE

SEQ ID NO: 3166023 - protein, 25 aa, Giardia lamblia
PLQRVDGGFAFFAPGGVGPVPAELQ

SEQ ID NO: 3166024 - protein, 22 aa, Giardia lamblia
PLRSLGRIDGSLIYSSLYGSSS

SEQ ID NO: 3166025 - protein, 17 aa, Giardia lamblia
PLSAVIIHRDLKPANIL

SEQ ID NO: 3166026 - protein, 19 aa, Giardia lamblia
PLSELLPYNAFLIAASLYI

SEQ ID NO: 3166027 - protein, 23 aa, Giardia lamblia
PLSHRMIINLIFRVKASDLPIVH

SEQ ID NO: 3166028 - protein, 25 aa, Giardia lamblia
PLSIPRTDYISSLAFSNSGDHIAVG

SEQ ID NO: 3166029 - protein, 25 aa, Giardia lamblia
PLSLRYDLTVPFARYCATHREKSIK

SEQ ID NO: 3166030 - protein, 17 aa, Giardia lamblia
PLSQFSIGRGESKSPAA

SEQ ID NO: 3166031 - protein, 31 aa, Giardia lamblia
PLSRLPGTMIVPPRCLFLLDHITAAYASMLV

SEQ ID NO: 3166032 - protein, 17 aa, Giardia lamblia
PLSSSFVKRKYKQSIEK

SEQ ID NO: 3166033 - protein, 18 aa, Giardia lamblia
PLSTRFRGRIEFIQDGYG

SEQ ID NO: 3166034 - protein, 17 aa, Giardia lamblia
PLSVFPYSTNALSADHV

SEQ ID NO: 3166035 - protein, 27 aa, Giardia lamblia
PLSVVTCSFSLSVEFRAPEYAQRLELL

SEQ ID NO: 3166036 - protein, 19 aa, Giardia lamblia
PLTDRCFITLTSALANFMG

SEQ ID NO: 3166037 - protein, 25 aa, Giardia lamblia
PLTEDCKGTMRLVKPVGSVLQDRWV

SEQ ID NO: 3166038 - protein, 25 aa, Giardia lamblia
PLTSELRETLPLYAEKMIGFTGAEI

SEQ ID NO: 3166039 - protein, 19 aa, Giardia lamblia
PLTSLEFVTPPPASAASSG

SEQ ID NO: 3166040 - protein, 25 aa, Giardia lamblia
PLTTYPYWREYLITVLPHLEKLDGH

SEQ ID NO: 3166041 - protein, 21 aa, Giardia lamblia
PLTYRCVLCDFGSAKQLVPQE

SEQ ID NO: 3166042 - protein, 18 aa, Giardia lamblia
PLVEFLKANIGYMRAWVA

SEQ ID NO: 3166043 - protein, 24 aa, Giardia lamblia
PLVEIVQFYLLILITSQPKPKDLQ

SEQ ID NO: 3166044 - protein, 19 aa, Giardia lamblia
PLVLDKLLYRDLLSCKVLP

SEQ ID NO: 3166045 - protein, 18 aa, Giardia lamblia
PLVLQGRAAHILPVVVGA

SEQ ID NO: 3166046 - protein, 24 aa, Giardia lamblia
PLVRTLFYDSYRQFIAASRYFILD

SEQ ID NO: 3166047 - protein, 17 aa, Giardia lamblia
PLVSLLLPKEGRMKRTD

SEQ ID NO: 3166048 - protein, 17 aa, Giardia lamblia
PLVSSDAVFSCYLSFLR

SEQ ID NO: 3166049 - protein, 21 aa, Giardia lamblia
PLVTTRSMPHVKFRYLPAGQN

SEQ ID NO: 3166050 - protein, 23 aa, Giardia lamblia
PLYEYSVVITLNIKQFSDGEINL

SEQ ID NO: 3166051 - protein, 18 aa, Giardia lamblia
PLYFASTVSLELFANKPG

SEQ ID NO: 3166052 - protein, 19 aa, Giardia lamblia
PLYGRDFPDGCSVVAMLFR

SEQ ID NO: 3166053 - protein, 19 aa, Giardia lamblia
PLYISCYGMNNVLLLSELT

SEQ ID NO: 3166054 - protein, 23 aa, Giardia lamblia
PLYPVPELFRRATKNLVTTYGIG

SEQ ID NO: 3166055 - protein, 18 aa, Giardia lamblia
PLYRCYLENDYLIVEQGL

SEQ ID NO: 3166056 - protein, 19 aa, Giardia lamblia
PMAALGLRGRLEALLCNST

SEQ ID NO: 3166057 - protein, 18 aa, Giardia lamblia
PMASYLPQHARTFPSASP

SEQ ID NO: 3166058 - protein, 19 aa, Giardia lamblia
PMCGLKEGILVAGGIGALA

SEQ ID NO: 3166059 - protein, 23 aa, Giardia lamblia
PMDTCLVVGVPLNLSLRKIVAVF

SEQ ID NO: 3166060 - protein, 18 aa, Giardia lamblia
PMDVLRIGKSLMKAINGD

SEQ ID NO: 3166061 - protein, 24 aa, Giardia lamblia
PMEIPNFSSFCGSLEDKLRAKIAE

SEQ ID NO: 3166062 - protein, 18 aa, Giardia lamblia
PMFIRNRPSPLPLNTPEP

SEQ ID NO: 3166063 - protein, 23 aa, Giardia lamblia
PMFSQKVKQVFGLSKEFSRLESL

SEQ ID NO: 3166064 - protein, 23 aa, Giardia lamblia
PMGMPAFARPSGMVQQPTMGMVQ

SEQ ID NO: 3166065 - protein, 19 aa, Giardia lamblia
PMHIAECYAKSGIPDAVLL

SEQ ID NO: 3166066 - protein, 17 aa, Giardia lamblia
PMIFPSVTMLKIVDCQI

SEQ ID NO: 3166067 - protein, 19 aa, Giardia lamblia
PMKPFRIALVNELILAYGL

SEQ ID NO: 3166068 - protein, 21 aa, Giardia lamblia
PMKVKYKIPGLLIVDTPGHES

SEQ ID NO: 3166069 - protein, 19 aa, Giardia lamblia
PMLLSEALISKRHTLRSIF

SEQ ID NO: 3166070 - protein, 18 aa, Giardia lamblia
PMLTEFAPILPEEGPVSG

SEQ ID NO: 3166071 - protein, 17 aa, Giardia lamblia
PMLYGKRASSITAGNIS

SEQ ID NO: 3166072 - protein, 17 aa, Giardia lamblia
PMMAEMFREMARNPELI

SEQ ID NO: 3166073 - protein, 17 aa, Giardia lamblia
PMMEYMIEAEIRRAESD

SEQ ID NO: 3166074 - protein, 26 aa, Giardia lamblia
PMMPMVIYRTHKVLRMLLDSNYEAGA

SEQ ID NO: 3166075 - protein, 24 aa, Giardia lamblia
PMNLHERVCYVPRFHDETQGAEIL

SEQ ID NO: 3166076 - protein, 29 aa, Giardia lamblia
PMPPGLFSKLRRIIVLAGKEATYVQREQA

SEQ ID NO: 3166077 - protein, 20 aa, Giardia lamblia
PMPRSRLFGMKRTTETAHRP

SEQ ID NO: 3166078 - protein, 24 aa, Giardia lamblia
PMPSLARPTARWLPSPVVATHVTP

SEQ ID NO: 3166079 - protein, 22 aa, Giardia lamblia
PMSLIYWPCRHLYACCDCARSI

SEQ ID NO: 3166080 - protein, 17 aa, Giardia lamblia
PMVAATYVELLENREII

SEQ ID NO: 3166081 - protein, 17 aa, Giardia lamblia
PMVKEISIDNVVFQARE

SEQ ID NO: 3166082 - protein, 27 aa, Giardia lamblia
PMVRFFGFSLLETFIRRSWYVIPTEQQ

SEQ ID NO: 3166083 - protein, 24 aa, Giardia lamblia
PNALCILSETWVGALQHDIPLTYF

SEQ ID NO: 3166084 - protein, 19 aa, Giardia lamblia
PNAQARALVFGKLLREIGR

SEQ ID NO: 3166085 - protein, 19 aa, Giardia lamblia
PNARGGRRLTSEKYSKMVR

SEQ ID NO: 3166086 - protein, 18 aa, Giardia lamblia
PNATMGPAQIQGILPADY

SEQ ID NO: 3166087 - protein, 17 aa, Giardia lamblia
PNCREVDSHLIAHASVY

SEQ ID NO: 3166088 - protein, 23 aa, Giardia lamblia
PNDPPPWLARQSLLLKPSWLQDI

SEQ ID NO: 3166089 - protein, 20 aa, Giardia lamblia
PNDYRYALEKLIEVIQLFDS

SEQ ID NO: 3166090 - protein, 17 aa, Giardia lamblia
PNECDCNGNTALESALL

SEQ ID NO: 3166091 - protein, 41 aa, Giardia lamblia
PNERAMLKYKFRRSLEGAHYISWRRSIRMRAGDEGRAALNT

SEQ ID NO: 3166092 - protein, 19 aa, Giardia lamblia
PNERFGIRNEKQFTDTTEA

SEQ ID NO: 3166093 - protein, 29 aa, Giardia lamblia
PNESGFLRLCSGVGFLIRPKNVTTGSSLS

SEQ ID NO: 3166094 - protein, 30 aa, Giardia lamblia
PNFEFFPQFLYHFRRSEFIQLFGQSPDETA

SEQ ID NO: 3166095 - protein, 17 aa, Giardia lamblia
PNFEPLVCDNNYDINTN

SEQ ID NO: 3166096 - protein, 18 aa, Giardia lamblia
PNGAILYSMEFLKENVHW

SEQ ID NO: 3166097 - protein, 24 aa, Giardia lamblia
PNGDCYTGEWAFNLPQGYGEFYTC

SEQ ID NO: 3166098 - protein, 29 aa, Giardia lamblia
PNGEILRLPSNMKFIFEVTNLMLVPEIFS

SEQ ID NO: 3166099 - protein, 17 aa, Giardia lamblia
PNGLAFDGEHVFVCDIG

SEQ ID NO: 3166100 - protein, 19 aa, Giardia lamblia
PNGPTFDFLNALIKEECHE

SEQ ID NO: 3166101 - protein, 17 aa, Giardia lamblia
PNHPSPSMLPRGSLVDI

SEQ ID NO: 3166102 - protein, 19 aa, Giardia lamblia
PNIDGFLVGGASLKPEFMT

SEQ ID NO: 3166103 - protein, 17 aa, Giardia lamblia
PNIKEVILIEGEGHEGV

SEQ ID NO: 3166104 - protein, 17 aa, Giardia lamblia
PNILRYKAVHQEGDFVY

SEQ ID NO: 3166105 - protein, 24 aa, Giardia lamblia
PNINRYLIRYNISYEPRFPGAHHE

SEQ ID NO: 3166106 - protein, 20 aa, Giardia lamblia
PNKGSFVLFEQGLRSFDTIM

SEQ ID NO: 3166107 - protein, 19 aa, Giardia lamblia
PNLEACPWARSLPPKHEQR

SEQ ID NO: 3166108 - protein, 25 aa, Giardia lamblia
PNLEPRPSSSPCCGYVTVNGIDLQL

SEQ ID NO: 3166109 - protein, 17 aa, Giardia lamblia
PNLFGSYSLHILGRTQS

SEQ ID NO: 3166110 - protein, 19 aa, Giardia lamblia
PNLNADFGLSKPSAPSTAS

SEQ ID NO: 3166111 - protein, 19 aa, Giardia lamblia
PNMEPMLSISSLRNALQSN

SEQ ID NO: 3166112 - protein, 37 aa, Giardia lamblia
PNMRDPIAYRIKYCRHPLTGSAWCIYPSYDFSHCLID

SEQ ID NO: 3166113 - protein, 27 aa, Giardia lamblia
PNMVTLIEFPTLFGVIRDRIRKHFLLS

SEQ ID NO: 3166114 - protein, 19 aa, Giardia lamblia
PNNFFTHALVKIFNKSRAM

SEQ ID NO: 3166115 - protein, 20 aa, Giardia lamblia
PNNSRMCQLLAPIQAGIQDQ

SEQ ID NO: 3166116 - protein, 25 aa, Giardia lamblia
PNPDEYKGLVVKIITCLAKQKNQVV

SEQ ID NO: 3166117 - protein, 26 aa, Giardia lamblia
PNPMILEIIRLLVLYTPALLENSNEL

SEQ ID NO: 3166118 - protein, 22 aa, Giardia lamblia
PNPQIWRETFVPDAISSSRLGS

SEQ ID NO: 3166119 - protein, 20 aa, Giardia lamblia
PNPSAFCGPGSVGHQHPSYK

SEQ ID NO: 3166120 - protein, 18 aa, Giardia lamblia
PNPSEVSFYCTVENGKIL

SEQ ID NO: 3166121 - protein, 27 aa, Giardia lamblia
PNQDKIPKWRGFSRRKAIAKDDNKATY

SEQ ID NO: 3166122 - protein, 19 aa, Giardia lamblia
PNQLCTIMIMHSPVSRTPQ

SEQ ID NO: 3166123 - protein, 17 aa, Giardia lamblia
PNQPVAAALREDGAARL

SEQ ID NO: 3166124 - protein, 20 aa, Giardia lamblia
PNRHKDCVRNTKKRMDSGKY

SEQ ID NO: 3166125 - protein, 19 aa, Giardia lamblia
PNRLNSFSVVSDRTTSPVK

SEQ ID NO: 3166126 - protein, 17 aa, Giardia lamblia
PNSDFILEIPMVVLVVE

SEQ ID NO: 3166127 - protein, 17 aa, Giardia lamblia
PNSSVPIVLAKPEEMKM

SEQ ID NO: 3166128 - protein, 20 aa, Giardia lamblia
PNTCLLRFMDPPVIPPDNAD

SEQ ID NO: 3166129 - protein, 18 aa, Giardia lamblia
PNTLQFLSNYVLRSRNED

SEQ ID NO: 3166130 - protein, 18 aa, Giardia lamblia
PNTRRVFHSISVYNFYVL

SEQ ID NO: 3166131 - protein, 27 aa, Giardia lamblia
PNTVAFYFIKYLRRMHLSKKLIHKPFD

SEQ ID NO: 3166132 - protein, 18 aa, Giardia lamblia
PNVDANKLFISYINSKSL

SEQ ID NO: 3166133 - protein, 17 aa, Giardia lamblia
PNVFWLDAAHNILTSDA

SEQ ID NO: 3166134 - protein, 26 aa, Giardia lamblia
PNVLKKRGEYYYGMVENIYANPIVEA

SEQ ID NO: 3166135 - protein, 26 aa, Giardia lamblia
PNVPRPQLPMNLSISVKDMAVGASMQ

SEQ ID NO: 3166136 - protein, 18 aa, Giardia lamblia
PNVTGSLHIGHALTNSIQ

SEQ ID NO: 3166137 - protein, 21 aa, Giardia lamblia
PNVYRLRRPVDVASLRMSVSP

SEQ ID NO: 3166138 - protein, 24 aa, Giardia lamblia
PNYGGALPSMFVAGLVEGFLTCCG

SEQ ID NO: 3166139 - protein, 40 aa, Giardia lamblia
PNYSVATILSRICSLIGPIPRDMIMSGRMGQRVLTFGLVP

SEQ ID NO: 3166140 - protein, 23 aa, Giardia lamblia
PPAEVRIAAIAVYIPPIVVSQEE

SEQ ID NO: 3166141 - protein, 18 aa, Giardia lamblia
PPAGIRVGTQVDFLLDSQ

SEQ ID NO: 3166142 - protein, 21 aa, Giardia lamblia
PPALELRASGTLASSILAAIP

SEQ ID NO: 3166143 - protein, 25 aa, Giardia lamblia
PPAVVPAGLYLRVLLLPLHPEDTDR

SEQ ID NO: 3166144 - protein, 21 aa, Giardia lamblia
PPCGMRDLLPGQMVLRQAALS

SEQ ID NO: 3166145 - protein, 17 aa, Giardia lamblia
PPCYEGGSKMSLPKTHP

SEQ ID NO: 3166146 - protein, 17 aa, Giardia lamblia
PPDCKPVGVIIGAIAHG

SEQ ID NO: 3166147 - protein, 22 aa, Giardia lamblia
PPDLHYFVKFDESIVIVTGLEG

SEQ ID NO: 3166148 - protein, 18 aa, Giardia lamblia
PPDLVAIIGPKGVGKTTL

SEQ ID NO: 3166149 - protein, 28 aa, Giardia lamblia
PPDRTRIPYKDCLKLLKAPDHLPIQPIR

SEQ ID NO: 3166150 - protein, 26 aa, Giardia lamblia
PPEKLEFGCYVSGLFLEGATWDTARD

SEQ ID NO: 3166151 - protein, 20 aa, Giardia lamblia
PPELMHWRNSVGIIVKDSVR

SEQ ID NO: 3166152 - protein, 28 aa, Giardia lamblia
PPELSKIAFCVIWPLGNIINHMIKTLPV

SEQ ID NO: 3166153 - protein, 21 aa, Giardia lamblia
PPELVKLVLAGVMTLLNRDTD

SEQ ID NO: 3166154 - protein, 23 aa, Giardia lamblia
PPENWFYHLKIAASYGGEQAIRE

SEQ ID NO: 3166155 - protein, 19 aa, Giardia lamblia
PPEQCSSCLLQGNRHVCSD

SEQ ID NO: 3166156 - protein, 24 aa, Giardia lamblia
PPEQKKDHPVFSFGSMSASTTQGF

SEQ ID NO: 3166157 - protein, 21 aa, Giardia lamblia
PPERRNLIIRRAIDTLVRSQS

SEQ ID NO: 3166158 - protein, 25 aa, Giardia lamblia
PPESLKSLNFYSIFKKATLDELADK

SEQ ID NO: 3166159 - protein, 18 aa, Giardia lamblia
PPFPDLGPLSYFRQTQQP

SEQ ID NO: 3166160 - protein, 19 aa, Giardia lamblia
PPFRESRGPGLALSSTSST

SEQ ID NO: 3166161 - protein, 19 aa, Giardia lamblia
PPGAFALPSWQAQGEMVAG

SEQ ID NO: 3166162 - protein, 31 aa, Giardia lamblia
PPGCAKSLLVKACANSCDCTFISVTSSSCVN

SEQ ID NO: 3166163 - protein, 28 aa, Giardia lamblia
PPGCGKTFIGACLAWLFSKVYGSLDHDS

SEQ ID NO: 3166164 - protein, 26 aa, Giardia lamblia
PPGPYPVGRQSFLSSLPQAPPQPLQP

SEQ ID NO: 3166165 - protein, 18 aa, Giardia lamblia
PPGSVGLNMVRPYSNYTA

SEQ ID NO: 3166166 - protein, 20 aa, Giardia lamblia
PPGTIKIIFATNVAETSITI

SEQ ID NO: 3166167 - protein, 29 aa, Giardia lamblia
PPGVAIRNIHLGFDFNHYYIFDEKLPYSK

SEQ ID NO: 3166168 - protein, 20 aa, Giardia lamblia
PPGVPPREYSVLHASIHGVS

SEQ ID NO: 3166169 - protein, 19 aa, Giardia lamblia
PPHPNIIRLIRVVVTRDHT

SEQ ID NO: 3166170 - protein, 34 aa, Giardia lamblia
PPHQIELLPYLRCPMCLCKIRSAMENEPEPGTTS

SEQ ID NO: 3166171 - protein, 18 aa, Giardia lamblia
PPIDVVVSITGKVISNGL

SEQ ID NO: 3166172 - protein, 17 aa, Giardia lamblia
PPINMGPSPNMNYESGL

SEQ ID NO: 3166173 - protein, 23 aa, Giardia lamblia
PPKADLPLSSFKRLVRKRYRLNS

SEQ ID NO: 3166174 - protein, 24 aa, Giardia lamblia
PPKEEIIIRVPLSAFQLFFYNLAI

SEQ ID NO: 3166175 - protein, 25 aa, Giardia lamblia
PPKRKRKTIKMVLPKMEPLRTLKLK

SEQ ID NO: 3166176 - protein, 23 aa, Giardia lamblia
PPKWQPCLIEFRRSRVQCSTFQF

SEQ ID NO: 3166177 - protein, 17 aa, Giardia lamblia
PPLKRSLPLKSINWPAK

SEQ ID NO: 3166178 - protein, 30 aa, Giardia lamblia
PPLPALRQSAALLLHWLRHNYWEPLLNETH

SEQ ID NO: 3166179 - protein, 19 aa, Giardia lamblia
PPLPPRPKSAAIHAQPPRA

SEQ ID NO: 3166180 - protein, 18 aa, Giardia lamblia
PPLTDALSNRMNTLLQHE

SEQ ID NO: 3166181 - protein, 18 aa, Giardia lamblia
PPLTNFQMCAGMLMENLA

SEQ ID NO: 3166182 - protein, 18 aa, Giardia lamblia
PPLVDFGSITLISPETSY

SEQ ID NO: 3166183 - protein, 17 aa, Giardia lamblia
PPMELIALLVNLFISGR

SEQ ID NO: 3166184 - protein, 18 aa, Giardia lamblia
PPMSWKERHRLMLGQSCC

SEQ ID NO: 3166185 - protein, 27 aa, Giardia lamblia
PPNIPIISILIEYCIKHSAKRPFVPLR

SEQ ID NO: 3166186 - protein, 18 aa, Giardia lamblia
PPNLAGGYSPLGKIYFCD

SEQ ID NO: 3166187 - protein, 21 aa, Giardia lamblia
PPNQPCLILDVGCGSGISGQV

SEQ ID NO: 3166188 - protein, 30 aa, Giardia lamblia
PPNRFEFTSLALLTLIRWLETDSLPIYTSF

SEQ ID NO: 3166189 - protein, 17 aa, Giardia lamblia
PPPASFFSQAPFTYVPF

SEQ ID NO: 3166190 - protein, 22 aa, Giardia lamblia
PPPCVLGCAAPPLVPPVGGPVF

SEQ ID NO: 3166191 - protein, 21 aa, Giardia lamblia
PPPDERRELLGKLTGATQEPD

SEQ ID NO: 3166192 - protein, 17 aa, Giardia lamblia
PPPEFAEKGRIIRHNKP

SEQ ID NO: 3166193 - protein, 17 aa, Giardia lamblia
PPPHFLNEIAAGRNRQA

SEQ ID NO: 3166194 - protein, 20 aa, Giardia lamblia
PPPITLSYMESWLEMRSRYN

SEQ ID NO: 3166195 - protein, 17 aa, Giardia lamblia
PPPLLPVTLAQLTAYPP

SEQ ID NO: 3166196 - protein, 19 aa, Giardia lamblia
PPPLPDPFCDPVKELACSS

SEQ ID NO: 3166197 - protein, 24 aa, Giardia lamblia
PPPLPRPNTILDFIHSPLRPIEAS

SEQ ID NO: 3166198 - protein, 20 aa, Giardia lamblia
PPPLYFVPLMNRYNILDYQI

SEQ ID NO: 3166199 - protein, 20 aa, Giardia lamblia
PPPPPARSAAVARARRPYKI

SEQ ID NO: 3166200 - protein, 20 aa, Giardia lamblia
PPPRKCIGYFMSYPDIVMSD

SEQ ID NO: 3166201 - protein, 32 aa, Giardia lamblia
PPPSFPARAALRFIATCFCYDEKDGIFVVGDM

SEQ ID NO: 3166202 - protein, 26 aa, Giardia lamblia
PPQGFLKRLKRAVKYLFSGTYEGDSQ

SEQ ID NO: 3166203 - protein, 17 aa, Giardia lamblia
PPQSVTFIDGFSDDEVI

SEQ ID NO: 3166204 - protein, 18 aa, Giardia lamblia
PPQYPRSAPQQAEGLSSD

SEQ ID NO: 3166205 - protein, 22 aa, Giardia lamblia
PPRDQLYVFVANFFRQLNEERQ

SEQ ID NO: 3166206 - protein, 18 aa, Giardia lamblia
PPREGAYIYGLYMEGARW

SEQ ID NO: 3166207 - protein, 17 aa, Giardia lamblia
PPRGIPPPMWQDLPMQP

SEQ ID NO: 3166208 - protein, 17 aa, Giardia lamblia
PPSEWLCIFSIMSESSF

SEQ ID NO: 3166209 - protein, 18 aa, Giardia lamblia
PPSFPFKPPDLMMITPSG

SEQ ID NO: 3166210 - protein, 19 aa, Giardia lamblia
PPSIVKRGALVMMGYMREC

SEQ ID NO: 3166211 - protein, 24 aa, Giardia lamblia
PPSKQIRNKWAFLSATGKKTMAEI

SEQ ID NO: 3166212 - protein, 21 aa, Giardia lamblia
PPSLMDRLLYASIHSTDSLVL

SEQ ID NO: 3166213 - protein, 22 aa, Giardia lamblia
PPSLSLLDWTGNTIFCRLGCTF

SEQ ID NO: 3166214 - protein, 17 aa, Giardia lamblia
PPSNGLEASRIPLSGSR

SEQ ID NO: 3166215 - protein, 21 aa, Giardia lamblia
PPSSLKLNMVQTFSKITDDQI

SEQ ID NO: 3166216 - protein, 19 aa, Giardia lamblia
PPSTMPLSATYNFEHSGSY

SEQ ID NO: 3166217 - protein, 25 aa, Giardia lamblia
PPTHPIRLGLALNFSVFYYEILASP

SEQ ID NO: 3166218 - protein, 18 aa, Giardia lamblia
PPTIPVLYIYHRSVQCPV

SEQ ID NO: 3166219 - protein, 19 aa, Giardia lamblia
PPTKEYRATVIRKPKPTVW

SEQ ID NO: 3166220 - protein, 18 aa, Giardia lamblia
PPTSCLQNAVLTAELVSR

SEQ ID NO: 3166221 - protein, 22 aa, Giardia lamblia
PPVKHIVDIIGTLAMLSITTTF

SEQ ID NO: 3166222 - protein, 18 aa, Giardia lamblia
PPVLPQIIVPSAANYTED

SEQ ID NO: 3166223 - protein, 19 aa, Giardia lamblia
PPVPPPVALPFTVIAVPSE

SEQ ID NO: 3166224 - protein, 20 aa, Giardia lamblia
PPVSIPFPVINQVATIPRFQ

SEQ ID NO: 3166225 - protein, 19 aa, Giardia lamblia
PPYFSRAFVNRKIRHIQRQ

SEQ ID NO: 3166226 - protein, 17 aa, Giardia lamblia
PPYSGMILSLYTNMSPR

SEQ ID NO: 3166227 - protein, 19 aa, Giardia lamblia
PPYYEIFLTSLGYPGTGYS

SEQ ID NO: 3166228 - protein, 17 aa, Giardia lamblia
PQACKEHSYEIRYNNLL

SEQ ID NO: 3166229 - protein, 21 aa, Giardia lamblia
PQADDIALLWGKVLTTPEDGK

SEQ ID NO: 3166230 - protein, 25 aa, Giardia lamblia
PQAEEIQRLLSLNIREYIPTETFNR

SEQ ID NO: 3166231 - protein, 18 aa, Giardia lamblia
PQAFSRVAAVWGGIYMLN

SEQ ID NO: 3166232 - protein, 19 aa, Giardia lamblia
PQAPGAPSFDAKPANPEPP

SEQ ID NO: 3166233 - protein, 24 aa, Giardia lamblia
PQAYDAFCRAVAQNAVRLSTGCPH

SEQ ID NO: 3166234 - protein, 17 aa, Giardia lamblia
PQDVCAYSGPRLVIDEL

SEQ ID NO: 3166235 - protein, 18 aa, Giardia lamblia
PQECIAGTVVVLSDPCSK

SEQ ID NO: 3166236 - protein, 18 aa, Giardia lamblia
PQELPRANGNSMTREEIS

SEQ ID NO: 3166237 - protein, 20 aa, Giardia lamblia
PQESCFFHRVTALNRDAMCQ

SEQ ID NO: 3166238 - protein, 18 aa, Giardia lamblia
PQGPLSKRLEPLLEARSS

SEQ ID NO: 3166239 - protein, 18 aa, Giardia lamblia
PQHHSFLSPDFIFINEHT

SEQ ID NO: 3166240 - protein, 22 aa, Giardia lamblia
PQIDPPCYIMSWVDYSNRYGFA

SEQ ID NO: 3166241 - protein, 25 aa, Giardia lamblia
PQIIYACRSALKRSMAVDVDENIED

SEQ ID NO: 3166242 - protein, 22 aa, Giardia lamblia
PQILRSTPFSSLADIWSLGLVL

SEQ ID NO: 3166243 - protein, 24 aa, Giardia lamblia
PQIPAYYCPGIIAGQPIQYTVAAL

SEQ ID NO: 3166244 - protein, 17 aa, Giardia lamblia
PQIVTEYKFSDIDYDKL

SEQ ID NO: 3166245 - protein, 17 aa, Giardia lamblia
PQLKVLNWIPLSAEDIS

SEQ ID NO: 3166246 - protein, 26 aa, Giardia lamblia
PQLMPSDQIRFMRVLQQISGNHTPQA

SEQ ID NO: 3166247 - protein, 21 aa, Giardia lamblia
PQLRALRIQALRGCLVTLRSV

SEQ ID NO: 3166248 - protein, 20 aa, Giardia lamblia
PQLRPTSPRSPLVIPALNLQ

SEQ ID NO: 3166249 - protein, 19 aa, Giardia lamblia
PQLSSCPHNDYLNSLTRTQ

SEQ ID NO: 3166250 - protein, 18 aa, Giardia lamblia
PQLTEANNWLVLPLTHTS

SEQ ID NO: 3166251 - protein, 19 aa, Giardia lamblia
PQLTSRVATLSTYSGDALS

SEQ ID NO: 3166252 - protein, 20 aa, Giardia lamblia
PQLVQFLSLLGYFGSVETLK

SEQ ID NO: 3166253 - protein, 19 aa, Giardia lamblia
PQMFGRLDAATGDWTDGIF

SEQ ID NO: 3166254 - protein, 27 aa, Giardia lamblia
PQMKKTCNQWGETGLMISAKEGNLTMA

SEQ ID NO: 3166255 - protein, 20 aa, Giardia lamblia
PQMVAQDFWSIVRQRSKCKE

SEQ ID NO: 3166256 - protein, 25 aa, Giardia lamblia
PQNLPVLIRVGWRASANGQGVDLCA

SEQ ID NO: 3166257 - protein, 24 aa, Giardia lamblia
PQPIPPQFADLVAKNEALLKSLQD

SEQ ID NO: 3166258 - protein, 23 aa, Giardia lamblia
PQPRSNHAIVLWQSRSGNYRLFI

SEQ ID NO: 3166259 - protein, 20 aa, Giardia lamblia
PQQDTRLFLPIYIDRDPSVN

SEQ ID NO: 3166260 - protein, 26 aa, Giardia lamblia
PQQFDLCIRWLYAILDHIRAEPDKSV

SEQ ID NO: 3166261 - protein, 18 aa, Giardia lamblia
PQQSSLPISSPRGPQQSH

SEQ ID NO: 3166262 - protein, 19 aa, Giardia lamblia
PQRCCIALLASDLFLKPFV

SEQ ID NO: 3166263 - protein, 18 aa, Giardia lamblia
PQRPWKPDHRPSATTDSR

SEQ ID NO: 3166264 - protein, 31 aa, Giardia lamblia
PQRRREQVLALIFWKRLGARVVGDCREGGPH

SEQ ID NO: 3166265 - protein, 17 aa, Giardia lamblia
PQRSAMMELNQTVTDDP

SEQ ID NO: 3166266 - protein, 25 aa, Giardia lamblia
PQSKLPGFLALMLGDGRRKVASLVH

SEQ ID NO: 3166267 - protein, 19 aa, Giardia lamblia
PQSTMGMPPVHISQMSATQ

SEQ ID NO: 3166268 - protein, 17 aa, Giardia lamblia
PQTILEFLLLKVQSHKL

SEQ ID NO: 3166269 - protein, 19 aa, Giardia lamblia
PQTRDFGLCTDRLSEPHET

SEQ ID NO: 3166270 - protein, 17 aa, Giardia lamblia
PQVLHVFMEFEFPTYYC

SEQ ID NO: 3166271 - protein, 36 aa, Giardia lamblia
PQVNNRTALQCVMRPICAPFISLFGYVHINTISGAV

SEQ ID NO: 3166272 - protein, 26 aa, Giardia lamblia
PQVPYPFKIIQLYLSLGRTIRPILQK

SEQ ID NO: 3166273 - protein, 24 aa, Giardia lamblia
PQWSAQYLPNMAWIRSATDADAKN

SEQ ID NO: 3166274 - protein, 24 aa, Giardia lamblia
PQYSNGDFATFIRKLNLFRGNGYP

SEQ ID NO: 3166275 - protein, 19 aa, Giardia lamblia
PRAAYPGRFLQSPQCDVGL

SEQ ID NO: 3166276 - protein, 19 aa, Giardia lamblia
PRAGTVHSAYILKNTADNG

SEQ ID NO: 3166277 - protein, 20 aa, Giardia lamblia
PRAPENLELPPLPTDTPTVS

SEQ ID NO: 3166278 - protein, 20 aa, Giardia lamblia
PRAPLSWSHSTHSWMPAEHS

SEQ ID NO: 3166279 - protein, 18 aa, Giardia lamblia
PRASQLLRNPCFKDILSD

SEQ ID NO: 3166280 - protein, 20 aa, Giardia lamblia
PRDEFEAILVAPRGEDVRNE

SEQ ID NO: 3166281 - protein, 21 aa, Giardia lamblia
PRDLLDRLLVIKTLPYQQEDI

SEQ ID NO: 3166282 - protein, 26 aa, Giardia lamblia
PRDLPPPEWRYGIHSAPNEYPMTNVV

SEQ ID NO: 3166283 - protein, 20 aa, Giardia lamblia
PRDPCGTKQCPKRTRVEIVP

SEQ ID NO: 3166284 - protein, 18 aa, Giardia lamblia
PREAEILEEMGLGDASTE

SEQ ID NO: 3166285 - protein, 18 aa, Giardia lamblia
PREATPLAVGARSLLIEA

SEQ ID NO: 3166286 - protein, 21 aa, Giardia lamblia
PRERRLLERYGPGGAAEKPAC

SEQ ID NO: 3166287 - protein, 18 aa, Giardia lamblia
PRERRLLERYGPGGDAEK

SEQ ID NO: 3166288 - protein, 20 aa, Giardia lamblia
PREYRRLRRSLGMTRPPPEF

SEQ ID NO: 3166289 - protein, 18 aa, Giardia lamblia
PRFAEATHVFCTHFDPLH

SEQ ID NO: 3166290 - protein, 17 aa, Giardia lamblia
PRFDSYMSQESGLPRPY

SEQ ID NO: 3166291 - protein, 25 aa, Giardia lamblia
PRFECQDCKNMQDMLTAAQIEVEEL

SEQ ID NO: 3166292 - protein, 18 aa, Giardia lamblia
PRFGLFEYIRHGVRYIDG

SEQ ID NO: 3166293 - protein, 19 aa, Giardia lamblia
PRGAMEITKELGLQSDYDA

SEQ ID NO: 3166294 - protein, 20 aa, Giardia lamblia
PRGHCSTCGVCVLYNNTLPG

SEQ ID NO: 3166295 - protein, 22 aa, Giardia lamblia
PRGRKLIISCKLPSYDQIESSI

SEQ ID NO: 3166296 - protein, 21 aa, Giardia lamblia
PRGSGKMTLLKTCLHRLEKFN

SEQ ID NO: 3166297 - protein, 22 aa, Giardia lamblia
PRGTIIYMTCTFFAGEHPPASK

SEQ ID NO: 3166298 - protein, 19 aa, Giardia lamblia
PRGTMFYDFDSYFNKEMIL

SEQ ID NO: 3166299 - protein, 23 aa, Giardia lamblia
PRGTTCVQIAFTFPYPLNEIFLR

SEQ ID NO: 3166300 - protein, 22 aa, Giardia lamblia
PRGVKGSERMTSLLKKREAIEM

SEQ ID NO: 3166301 - protein, 28 aa, Giardia lamblia
PRHAPGCPYPFHGVCGCGSFDAADNVPQ

SEQ ID NO: 3166302 - protein, 17 aa, Giardia lamblia
PRHKVMMITCKGTTGMF

SEQ ID NO: 3166303 - protein, 17 aa, Giardia lamblia
PRHWEKIFETLKPFAKE

SEQ ID NO: 3166304 - protein, 18 aa, Giardia lamblia
PRIALKDFNTALVAEQSV

SEQ ID NO: 3166305 - protein, 17 aa, Giardia lamblia
PRIKRAGGDVTTLCNEI

SEQ ID NO: 3166306 - protein, 25 aa, Giardia lamblia
PRILRDNALRIAALRKELTFIHAQI

SEQ ID NO: 3166307 - protein, 24 aa, Giardia lamblia
PRIPRALRSLLWPPAPPCPRCSQA

SEQ ID NO: 3166308 - protein, 21 aa, Giardia lamblia
PRIQRAAILNMARILYVYTAK

SEQ ID NO: 3166309 - protein, 19 aa, Giardia lamblia
PRISYPHLNLVQSEVLQAQ

SEQ ID NO: 3166310 - protein, 20 aa, Giardia lamblia
PRKAPKTTHELLAGRGTLSV

SEQ ID NO: 3166311 - protein, 18 aa, Giardia lamblia
PRKDYKIASSGDYAVLSD

SEQ ID NO: 3166312 - protein, 19 aa, Giardia lamblia
PRKMLRPTDLVAVNKDTYF

SEQ ID NO: 3166313 - protein, 21 aa, Giardia lamblia
PRKPETFAVFTGHTGAVTCGG

SEQ ID NO: 3166314 - protein, 19 aa, Giardia lamblia
PRKPKLGLICMDKKAKSEP

SEQ ID NO: 3166315 - protein, 32 aa, Giardia lamblia
PRKSASWMYLSRLAAVREFGFMVALKERSFPV

SEQ ID NO: 3166316 - protein, 22 aa, Giardia lamblia
PRLDAETLLPCTHITPDNQAYW

SEQ ID NO: 3166317 - protein, 21 aa, Giardia lamblia
PRLDLDVIKIPKKVASESDEV

SEQ ID NO: 3166318 - protein, 25 aa, Giardia lamblia
PRLDWLKVRLQASLKIKEDRWRKLM

SEQ ID NO: 3166319 - protein, 17 aa, Giardia lamblia
PRLGMPVATNAHLRCVI

SEQ ID NO: 3166320 - protein, 21 aa, Giardia lamblia
PRLKSGMHYLLLSTLTTMGHK

SEQ ID NO: 3166321 - protein, 17 aa, Giardia lamblia
PRLLFLHGYSFFTDLYA

SEQ ID NO: 3166322 - protein, 17 aa, Giardia lamblia
PRLLPSNPIPNMVDTHE

SEQ ID NO: 3166323 - protein, 17 aa, Giardia lamblia
PRLPGSIERAVNSELRN

SEQ ID NO: 3166324 - protein, 19 aa, Giardia lamblia
PRLPTLDALGRAFLDPVVE

SEQ ID NO: 3166325 - protein, 20 aa, Giardia lamblia
PRLRRQSSLLEARNVKLQTR

SEQ ID NO: 3166326 - protein, 17 aa, Giardia lamblia
PRLRVSLTGSFAGSFTG

SEQ ID NO: 3166327 - protein, 17 aa, Giardia lamblia
PRLSFITRKNERILSVY

SEQ ID NO: 3166328 - protein, 30 aa, Giardia lamblia
PRLSILRPPRTFYLETIIDLQFSKRDFATK

SEQ ID NO: 3166329 - protein, 18 aa, Giardia lamblia
PRLSSFHGSKLVTVALVF

SEQ ID NO: 3166330 - protein, 20 aa, Giardia lamblia
PRLYLPKRFVEEAEAGKMAA

SEQ ID NO: 3166331 - protein, 21 aa, Giardia lamblia
PRNCYQCSMGKQASGAIAFNQ

SEQ ID NO: 3166332 - protein, 18 aa, Giardia lamblia
PRNFAIIDLHYRIDLSKA

SEQ ID NO: 3166333 - protein, 17 aa, Giardia lamblia
PRNFHVWNYQRNLFDRV

SEQ ID NO: 3166334 - protein, 23 aa, Giardia lamblia
PRNMYECQMLKQTMGIPCRNLAY

SEQ ID NO: 3166335 - protein, 19 aa, Giardia lamblia
PRNPQLYDRFIYLQKLSST

SEQ ID NO: 3166336 - protein, 20 aa, Giardia lamblia
PRPKRKRIHGNTIIKTATER

SEQ ID NO: 3166337 - protein, 21 aa, Giardia lamblia
PRPNDFPSFSPQDMQKYKQSL

SEQ ID NO: 3166338 - protein, 27 aa, Giardia lamblia
PRPRYLEVDGTSLFLCGKDGRRKQFSM

SEQ ID NO: 3166339 - protein, 17 aa, Giardia lamblia
PRPSMNFVSVDYNKIYS

SEQ ID NO: 3166340 - protein, 24 aa, Giardia lamblia
PRPSYWQGEFNCMPSRARYVPTAR

SEQ ID NO: 3166341 - protein, 19 aa, Giardia lamblia
PRQEHAIMMPCKASGGMTL

SEQ ID NO: 3166342 - protein, 19 aa, Giardia lamblia
PRQELRMTYNNALRTHSVR

SEQ ID NO: 3166343 - protein, 20 aa, Giardia lamblia
PRQHIELHATSPLRKTTSNE

SEQ ID NO: 3166344 - protein, 20 aa, Giardia lamblia
PRQHLLLGFEDGTLVILCAE

SEQ ID NO: 3166345 - protein, 21 aa, Giardia lamblia
PRQLRSCDIYNGQVMFTDKTI

SEQ ID NO: 3166346 - protein, 21 aa, Giardia lamblia
PRQPHHVRYTSCGCTNTPLQT

SEQ ID NO: 3166347 - protein, 24 aa, Giardia lamblia
PRQRHLKYSLGRIIGHGSFGQVYL

SEQ ID NO: 3166348 - protein, 30 aa, Giardia lamblia
PRRDLTILRYPLFIKVASIFLGHQQLDRVK

SEQ ID NO: 3166349 - protein, 19 aa, Giardia lamblia
PRRILQCHGSYCKGLYCLG

SEQ ID NO: 3166350 - protein, 22 aa, Giardia lamblia
PRRLSMKHALLIYLTLLPDCSV

SEQ ID NO: 3166351 - protein, 24 aa, Giardia lamblia
PRRPKRLTISSVIRKNTPTAMAVK

SEQ ID NO: 3166352 - protein, 26 aa, Giardia lamblia
PRRRISLREAGGFFYISNATCVSVST

SEQ ID NO: 3166353 - protein, 24 aa, Giardia lamblia
PRRSARGTPNFYVLKSSRALFSGL

SEQ ID NO: 3166354 - protein, 20 aa, Giardia lamblia
PRRVLANAFISGAHINEQVL

SEQ ID NO: 3166355 - protein, 22 aa, Giardia lamblia
PRSAGICTRRPLILQLIPTKPG

SEQ ID NO: 3166356 - protein, 19 aa, Giardia lamblia
PRSAQSPAAPLSILSFKNT

SEQ ID NO: 3166357 - protein, 20 aa, Giardia lamblia
PRSFLLLPKLIRAAHTNNTE

SEQ ID NO: 3166358 - protein, 18 aa, Giardia lamblia
PRSGHSVVVQTDLSLLSG

SEQ ID NO: 3166359 - protein, 19 aa, Giardia lamblia
PRSGIPLRLRPVKNRFRAN

SEQ ID NO: 3166360 - protein, 23 aa, Giardia lamblia
PRSILHFSWTPLMCAAADGDIEA

SEQ ID NO: 3166361 - protein, 20 aa, Giardia lamblia
PRSLAHFTPGIAQLVPTGDN

SEQ ID NO: 3166362 - protein, 23 aa, Giardia lamblia
PRSLCSKSMCLAREALQGYDEDS

SEQ ID NO: 3166363 - protein, 18 aa, Giardia lamblia
PRSLEILCVSEGQLATID

SEQ ID NO: 3166364 - protein, 21 aa, Giardia lamblia
PRSLPPPYSRREEQEVSTLPT

SEQ ID NO: 3166365 - protein, 28 aa, Giardia lamblia
PRSSVPLWVGDCFYRKLEHKRDQSRLLS

SEQ ID NO: 3166366 - protein, 21 aa, Giardia lamblia
PRSVPDPAFMASAVESKHRHR

SEQ ID NO: 3166367 - protein, 19 aa, Giardia lamblia
PRTLPRWFVDDEERNCKPE

SEQ ID NO: 3166368 - protein, 28 aa, Giardia lamblia
PRTPPRLRTPSGLSRKAVVDPRCQYAIP

SEQ ID NO: 3166369 - protein, 24 aa, Giardia lamblia
PRTPSYRSGQQVRCIPVRMDPSLL

SEQ ID NO: 3166370 - protein, 20 aa, Giardia lamblia
PRTTLVGSRYGYPQSAVSDP

SEQ ID NO: 3166371 - protein, 17 aa, Giardia lamblia
PRVAALLVEQDSIGHGK

SEQ ID NO: 3166372 - protein, 20 aa, Giardia lamblia
PRVDSLALQWIVGPSEETLP

SEQ ID NO: 3166373 - protein, 21 aa, Giardia lamblia
PRVGRELFRRAAASPAETQVS

SEQ ID NO: 3166374 - protein, 21 aa, Giardia lamblia
PRVLLIHVELQNSNVLWDPVS

SEQ ID NO: 3166375 - protein, 19 aa, Giardia lamblia
PRVLLRLLHEFWMSLREDI

SEQ ID NO: 3166376 - protein, 23 aa, Giardia lamblia
PRVLYRKLLGYKGVFEDLENYDL

SEQ ID NO: 3166377 - protein, 20 aa, Giardia lamblia
PRVPAYCDRILFRGLSQDTL

SEQ ID NO: 3166378 - protein, 18 aa, Giardia lamblia
PRVPPQVRASLIDLFSDY

SEQ ID NO: 3166379 - protein, 33 aa, Giardia lamblia
PRVSGSRPIIYVCTFEKAILVFSKFLQKGLVAH

SEQ ID NO: 3166380 - protein, 19 aa, Giardia lamblia
PRVYFKLASELGYKGIAYC

SEQ ID NO: 3166381 - protein, 19 aa, Giardia lamblia
PRYGIPVGLTNYAAAYATG

SEQ ID NO: 3166382 - protein, 31 aa, Giardia lamblia
PRYSNANNRLAFYWHFIFRTVGLNSESCLTP

SEQ ID NO: 3166383 - protein, 17 aa, Giardia lamblia
PSAEYRTASSIEAESTS

SEQ ID NO: 3166384 - protein, 26 aa, Giardia lamblia
PSAGGPGGWGCLLFNATEMHVFARSY

SEQ ID NO: 3166385 - protein, 26 aa, Giardia lamblia
PSAGRGIKFFLKRLDSELKTVRSNKK

SEQ ID NO: 3166386 - protein, 20 aa, Giardia lamblia
PSAPQPSAMRLVKVVREESS

SEQ ID NO: 3166387 - protein, 22 aa, Giardia lamblia
PSARPSARELLSKPFLSNMSDT

SEQ ID NO: 3166388 - protein, 20 aa, Giardia lamblia
PSAYTGSYCFTSMDTTSDQV

SEQ ID NO: 3166389 - protein, 26 aa, Giardia lamblia
PSDCLKEIVDSLMFSTACICNLHAVV

SEQ ID NO: 3166390 - protein, 26 aa, Giardia lamblia
PSDFDCSLCYSLGAVAAILGCNGKTG

SEQ ID NO: 3166391 - protein, 23 aa, Giardia lamblia
PSDKYTLKVSDWVSTIIPSMNDY

SEQ ID NO: 3166392 - protein, 24 aa, Giardia lamblia
PSDLCDKIGLWALRDRVWHIQGCS

SEQ ID NO: 3166393 - protein, 19 aa, Giardia lamblia
PSDLVALGIDCAEYDLLEK

SEQ ID NO: 3166394 - protein, 18 aa, Giardia lamblia
PSDPQRCCIALLASDLFL

SEQ ID NO: 3166395 - protein, 23 aa, Giardia lamblia
PSDSTEGLTYWFNMKCLIDTKNY

SEQ ID NO: 3166396 - protein, 20 aa, Giardia lamblia
PSEAIRKAFKTGFYETMIVH

SEQ ID NO: 3166397 - protein, 21 aa, Giardia lamblia
PSEAQPALGPFPQCPPQSSAR

SEQ ID NO: 3166398 - protein, 25 aa, Giardia lamblia
PSEHVYKKKVELYADDSHMPHAGQV

SEQ ID NO: 3166399 - protein, 21 aa, Giardia lamblia
PSEILSNLSLLFSKISVDIES

SEQ ID NO: 3166400 - protein, 24 aa, Giardia lamblia
PSEKGLKTLAGWTALMGAVEEKHL

SEQ ID NO: 3166401 - protein, 25 aa, Giardia lamblia
PSEQPRPYMTTKLWYNITSPFFDVR

SEQ ID NO: 3166402 - protein, 17 aa, Giardia lamblia
PSFEQFNCHLDCNPPVP

SEQ ID NO: 3166403 - protein, 33 aa, Giardia lamblia
PSFFPIPDMYLRHCWRSVAVPIELQPISMLYAK

SEQ ID NO: 3166404 - protein, 20 aa, Giardia lamblia
PSFIKWFVKLLEVIEPTVTV

SEQ ID NO: 3166405 - protein, 30 aa, Giardia lamblia
PSFIVEAGMACIHLSLRKKFNYDKGDLSRL

SEQ ID NO: 3166406 - protein, 17 aa, Giardia lamblia
PSFTFGQLLDKGCTIPL

SEQ ID NO: 3166407 - protein, 19 aa, Giardia lamblia
PSGPCSTSSSTVAAPQAPP

SEQ ID NO: 3166408 - protein, 23 aa, Giardia lamblia
PSGRSGGFAVEYPFPIDPTQEQY

SEQ ID NO: 3166409 - protein, 17 aa, Giardia lamblia
PSGTRVPSCKGRSASTS

SEQ ID NO: 3166410 - protein, 24 aa, Giardia lamblia
PSHECLYLLLEVVILCMTPLSSDI

SEQ ID NO: 3166411 - protein, 24 aa, Giardia lamblia
PSHGRSGVRVLAQRSFFITNGRLF

SEQ ID NO: 3166412 - protein, 22 aa, Giardia lamblia
PSHLQPNLSASRIRGFFGQVLP

SEQ ID NO: 3166413 - protein, 17 aa, Giardia lamblia
PSHMPLQPHGTMPSAPN

SEQ ID NO: 3166414 - protein, 20 aa, Giardia lamblia
PSHNSHTLFPSPLIPPHILL

SEQ ID NO: 3166415 - protein, 18 aa, Giardia lamblia
PSHPAFMKEVDVVLHKLQ

SEQ ID NO: 3166416 - protein, 21 aa, Giardia lamblia
PSHRIQMGLQFVEIYTVGDPR

SEQ ID NO: 3166417 - protein, 20 aa, Giardia lamblia
PSIAAKPWRAAESSLGDGSS

SEQ ID NO: 3166418 - protein, 17 aa, Giardia lamblia
PSIAKDLGMTRASVYHW

SEQ ID NO: 3166419 - protein, 21 aa, Giardia lamblia
PSIEPRMLFAACEYKKLYLIH

SEQ ID NO: 3166420 - protein, 21 aa, Giardia lamblia
PSIEYPASFGANYNSLSKSVT

SEQ ID NO: 3166421 - protein, 19 aa, Giardia lamblia
PSIGATRRFSGHAASKPTL

SEQ ID NO: 3166422 - protein, 25 aa, Giardia lamblia
PSIHEAKASMLLREGRFIEALERLR

SEQ ID NO: 3166423 - protein, 20 aa, Giardia lamblia
PSIIFFDEIDAIANKRGDST

SEQ ID NO: 3166424 - protein, 19 aa, Giardia lamblia
PSIRKARDTYYVLKASVEK

SEQ ID NO: 3166425 - protein, 21 aa, Giardia lamblia
PSISRRSAPSTPYIMTDCTAA

SEQ ID NO: 3166426 - protein, 18 aa, Giardia lamblia
PSISSPLLPVAQDLGTKD

SEQ ID NO: 3166427 - protein, 18 aa, Giardia lamblia
PSIVYTGPGFRWTPIYRP

SEQ ID NO: 3166428 - protein, 20 aa, Giardia lamblia
PSIWFEYSYDIACLAAKEGI

SEQ ID NO: 3166429 - protein, 23 aa, Giardia lamblia
PSIYIRLGELYSIAGDEGQAAHY

SEQ ID NO: 3166430 - protein, 19 aa, Giardia lamblia
PSKGLSCMMISGPKPKSLI

SEQ ID NO: 3166431 - protein, 18 aa, Giardia lamblia
PSKKVFTYDAVYPSNSTQ

SEQ ID NO: 3166432 - protein, 31 aa, Giardia lamblia
PSKQFKADVWAMGALLLCLCLGRPLNHRDDC

SEQ ID NO: 3166433 - protein, 24 aa, Giardia lamblia
PSKRLSAAELLMFPIITESLQKLS

SEQ ID NO: 3166434 - protein, 19 aa, Giardia lamblia
PSKVWQMQLYYFLYAHYYT

SEQ ID NO: 3166435 - protein, 19 aa, Giardia lamblia
PSKWTWSVLSDMRSQQSDS

SEQ ID NO: 3166436 - protein, 25 aa, Giardia lamblia
PSLALIPGKPVAPVRVRADKVYTLQ

SEQ ID NO: 3166437 - protein, 21 aa, Giardia lamblia
PSLKLKMSIVPSTRITSFSSH

SEQ ID NO: 3166438 - protein, 21 aa, Giardia lamblia
PSLPVELYFTSILSSIMSNDI

SEQ ID NO: 3166439 - protein, 26 aa, Giardia lamblia
PSLQPGISCYPYLPNNVFPGQFSGSP

SEQ ID NO: 3166440 - protein, 29 aa, Giardia lamblia
PSLSPSRRPSIPFSQSIPISPSRSSPSRS

SEQ ID NO: 3166441 - protein, 22 aa, Giardia lamblia
PSLSVPYALSGRNTADIMRGVQ

SEQ ID NO: 3166442 - protein, 28 aa, Giardia lamblia
PSMSTLHYLGGRLVLCMAEYGDLAPPVV

SEQ ID NO: 3166443 - protein, 24 aa, Giardia lamblia
PSNCNIPGMGREPMRVSKTPATDV

SEQ ID NO: 3166444 - protein, 20 aa, Giardia lamblia
PSNEFSFEAGEQFIEANNPE

SEQ ID NO: 3166445 - protein, 20 aa, Giardia lamblia
PSNENPLLIGKMGHILLDRL

SEQ ID NO: 3166446 - protein, 22 aa, Giardia lamblia
PSNIHIPPRISVVSNGKAVKMP

SEQ ID NO: 3166447 - protein, 26 aa, Giardia lamblia
PSNPACVVCSVPYYILKVKDVPPLSV

SEQ ID NO: 3166448 - protein, 19 aa, Giardia lamblia
PSPEIIKEQKIRRVSQSLV

SEQ ID NO: 3166449 - protein, 19 aa, Giardia lamblia
PSPIHCFHQAVEPVPISAV

SEQ ID NO: 3166450 - protein, 26 aa, Giardia lamblia
PSPKWFENVCLWDKALSGYNRQIDQL

SEQ ID NO: 3166451 - protein, 17 aa, Giardia lamblia
PSPLKENTLIYVPAVTP

SEQ ID NO: 3166452 - protein, 24 aa, Giardia lamblia
PSPSGLLPFKFSMITISDSYVDIQ

SEQ ID NO: 3166453 - protein, 18 aa, Giardia lamblia
PSPVTCLKVSKTLTQGMT

SEQ ID NO: 3166454 - protein, 21 aa, Giardia lamblia
PSQLARLGLQLDYKANDLYFL

SEQ ID NO: 3166455 - protein, 29 aa, Giardia lamblia
PSQRRLGYRYSYDLFRTWCKHTGVDLVLR

SEQ ID NO: 3166456 - protein, 18 aa, Giardia lamblia
PSRFCPNEGQFISSKHPS

SEQ ID NO: 3166457 - protein, 20 aa, Giardia lamblia
PSRHESRQGLPHSLSSKDHV

SEQ ID NO: 3166458 - protein, 24 aa, Giardia lamblia
PSSEMRPRIKKCVKKEQGNIRFAV

SEQ ID NO: 3166459 - protein, 23 aa, Giardia lamblia
PSSFLGRLIFRYYGTYSLDEAAK

SEQ ID NO: 3166460 - protein, 20 aa, Giardia lamblia
PSSGALRYYILATMLLTCGY

SEQ ID NO: 3166461 - protein, 24 aa, Giardia lamblia
PSSLERYAIDWSPAGYLGAGAYGT

SEQ ID NO: 3166462 - protein, 21 aa, Giardia lamblia
PSSLERYAIDWSPTGYLGAGA

SEQ ID NO: 3166463 - protein, 24 aa, Giardia lamblia
PSSLLPSLLSPIAIPKQAVTKTLM

SEQ ID NO: 3166464 - protein, 24 aa, Giardia lamblia
PSSNRAMHSSMYIAQHLSNSAVLG

SEQ ID NO: 3166465 - protein, 25 aa, Giardia lamblia
PSSQTFPSAGLYQVLDYLKVQCYSL

SEQ ID NO: 3166466 - protein, 20 aa, Giardia lamblia
PSSREYKPFTPIDTMTSDFG

SEQ ID NO: 3166467 - protein, 25 aa, Giardia lamblia
PSSSRCCTRTTNGCIPPGGCQCGIA

SEQ ID NO: 3166468 - protein, 19 aa, Giardia lamblia
PSSTRLAVIDALYSLSVNS

SEQ ID NO: 3166469 - protein, 19 aa, Giardia lamblia
PSSVGLDFPPPDMAHRPAC

SEQ ID NO: 3166470 - protein, 20 aa, Giardia lamblia
PSSVHPIDLRKSSKQCGHAH

SEQ ID NO: 3166471 - protein, 20 aa, Giardia lamblia
PSSVNRPGIASGRGGRQGAS

SEQ ID NO: 3166472 - protein, 26 aa, Giardia lamblia
PSSYYYAAFVRPFGVYLARKSASTNI

SEQ ID NO: 3166473 - protein, 19 aa, Giardia lamblia
PSTELRWNGLKADQPVVTR

SEQ ID NO: 3166474 - protein, 20 aa, Giardia lamblia
PSTLIPRIQSPAFGHLSAVR

SEQ ID NO: 3166475 - protein, 17 aa, Giardia lamblia
PSTLPFNDLDKMQLPQL

SEQ ID NO: 3166476 - protein, 20 aa, Giardia lamblia
PSTTKLSATFIFSHMDGTRF

SEQ ID NO: 3166477 - protein, 19 aa, Giardia lamblia
PSTVFYIPQFVQSDGAAPS

SEQ ID NO: 3166478 - protein, 25 aa, Giardia lamblia
PSTVKEFLKNEGLGLFIRGHQSTPF

SEQ ID NO: 3166479 - protein, 25 aa, Giardia lamblia
PSVAELIFIVLKFFPSMTPSAINEK

SEQ ID NO: 3166480 - protein, 20 aa, Giardia lamblia
PSVDIRDTFNIGDLMKKHHW

SEQ ID NO: 3166481 - protein, 19 aa, Giardia lamblia
PSVECIHAAVAQHFSPDST

SEQ ID NO: 3166482 - protein, 24 aa, Giardia lamblia
PSVLLPRYCLKKVLGAGSYGKVYL

SEQ ID NO: 3166483 - protein, 17 aa, Giardia lamblia
PSVMYRAKSVIGTQDPR

SEQ ID NO: 3166484 - protein, 18 aa, Giardia lamblia
PSVPLSMNLLDAATSFSI

SEQ ID NO: 3166485 - protein, 18 aa, Giardia lamblia
PSVPRRGYLRCSAGHKAV

SEQ ID NO: 3166486 - protein, 19 aa, Giardia lamblia
PSVQEAFLRLEAHRLEDHK

SEQ ID NO: 3166487 - protein, 20 aa, Giardia lamblia
PSVSTANLPAQRAHVSMSPE

SEQ ID NO: 3166488 - protein, 24 aa, Giardia lamblia
PSVVQLPGVFPLRSNTASVVHMNE

SEQ ID NO: 3166489 - protein, 17 aa, Giardia lamblia
PSYGGMVQPGMPSGGYG

SEQ ID NO: 3166490 - protein, 20 aa, Giardia lamblia
PSYKDPVGIKKALDDAIFEY

SEQ ID NO: 3166491 - protein, 21 aa, Giardia lamblia
PSYVCSSALLKTARENLPEFR

SEQ ID NO: 3166492 - protein, 19 aa, Giardia lamblia
PTAAMVLEYITYVYNQQAT

SEQ ID NO: 3166493 - protein, 23 aa, Giardia lamblia
PTAELAAIIGYKLTQVHKLTKEL

SEQ ID NO: 3166494 - protein, 19 aa, Giardia lamblia
PTAFVFDGNGSIAWEGYPT

SEQ ID NO: 3166495 - protein, 19 aa, Giardia lamblia
PTAGRRVSGGYAQGGGGGS

SEQ ID NO: 3166496 - protein, 25 aa, Giardia lamblia
PTAICHEILEGSGLCTLHEINYAMC

SEQ ID NO: 3166497 - protein, 19 aa, Giardia lamblia
PTAIRFLRTRENSFRNDEG

SEQ ID NO: 3166498 - protein, 19 aa, Giardia lamblia
PTALLRPSLGAMLVEQPQC

SEQ ID NO: 3166499 - protein, 18 aa, Giardia lamblia
PTALMICALLNHSTQLVQ

SEQ ID NO: 3166500 - protein, 17 aa, Giardia lamblia
PTAMMGIQPSLHSIPST

SEQ ID NO: 3166501 - protein, 21 aa, Giardia lamblia
PTAVCLRVSINNARWKRTQFI

SEQ ID NO: 3166502 - protein, 18 aa, Giardia lamblia
PTCRTCWKSIAHQRSIKK

SEQ ID NO: 3166503 - protein, 18 aa, Giardia lamblia
PTDDMTVDLTGKIEELEK

SEQ ID NO: 3166504 - protein, 23 aa, Giardia lamblia
PTDFNIKFAIKVADIDRTRLHPW

SEQ ID NO: 3166505 - protein, 22 aa, Giardia lamblia
PTDGLVFILFGKVFARYRNGDA

SEQ ID NO: 3166506 - protein, 22 aa, Giardia lamblia
PTDRFVFLSATMKYRASLLENM

SEQ ID NO: 3166507 - protein, 17 aa, Giardia lamblia
PTDSFKPNVPRFPEAQE

SEQ ID NO: 3166508 - protein, 18 aa, Giardia lamblia
PTDYIKRIAAEQHKMDQS

SEQ ID NO: 3166509 - protein, 21 aa, Giardia lamblia
PTEDLHVLNEKYVIEITNLKR

SEQ ID NO: 3166510 - protein, 22 aa, Giardia lamblia
PTEEILKAFRLFDDDATGRISL

SEQ ID NO: 3166511 - protein, 20 aa, Giardia lamblia
PTEHKTFIILEGYSIFQAAT

SEQ ID NO: 3166512 - protein, 21 aa, Giardia lamblia
PTEIFKMAKLNLVDLAGSERV

SEQ ID NO: 3166513 - protein, 21 aa, Giardia lamblia
PTEIWIDSLYYLTGALAASLG

SEQ ID NO: 3166514 - protein, 21 aa, Giardia lamblia
PTENAFRLSNEDIRRDAEICA

SEQ ID NO: 3166515 - protein, 17 aa, Giardia lamblia
PTESTFSLMSRFGRPSV

SEQ ID NO: 3166516 - protein, 19 aa, Giardia lamblia
PTFIYRDLIPIPDIVWDED

SEQ ID NO: 3166517 - protein, 19 aa, Giardia lamblia
PTFKVDRIVDKKGVSKPSL

SEQ ID NO: 3166518 - protein, 19 aa, Giardia lamblia
PTFPCAPSRVSEDIDGVSV

SEQ ID NO: 3166519 - protein, 18 aa, Giardia lamblia
PTFPTPKLDLAIFDLKPD

SEQ ID NO: 3166520 - protein, 27 aa, Giardia lamblia
PTFSPISKIFCLGPCVIGSELSERIKV

SEQ ID NO: 3166521 - protein, 20 aa, Giardia lamblia
PTFVDFLPHHWLLTSVCQGG

SEQ ID NO: 3166522 - protein, 19 aa, Giardia lamblia
PTHESTYHYYLWKRSVAVP

SEQ ID NO: 3166523 - protein, 17 aa, Giardia lamblia
PTHIEIIQLTDLVRDIF

SEQ ID NO: 3166524 - protein, 24 aa, Giardia lamblia
PTHPLRLVLNYSTAHLGGHSGGSS

SEQ ID NO: 3166525 - protein, 17 aa, Giardia lamblia
PTIKSSPKFSMASKPKP

SEQ ID NO: 3166526 - protein, 27 aa, Giardia lamblia
PTISELLCGFFRFYGYQFDSTDSVVSI

SEQ ID NO: 3166527 - protein, 22 aa, Giardia lamblia
PTKDCTRSSPRIQRGSTDKRST

SEQ ID NO: 3166528 - protein, 28 aa, Giardia lamblia
PTKIQACKLPALGMCKIYYSHPRAGTVH

SEQ ID NO: 3166529 - protein, 26 aa, Giardia lamblia
PTKRLLRDLPCYISPSSGIVPAGIAI

SEQ ID NO: 3166530 - protein, 18 aa, Giardia lamblia
PTLAKFMEISGIYNVKDI

SEQ ID NO: 3166531 - protein, 17 aa, Giardia lamblia
PTLALKTFLDCADRVKY

SEQ ID NO: 3166532 - protein, 23 aa, Giardia lamblia
PTLMPAHPIKGGLEYPYYGFSID

SEQ ID NO: 3166533 - protein, 32 aa, Giardia lamblia
PTLPGRGVTLPEMLVTIFSMSFKCTSDVLAIP

SEQ ID NO: 3166534 - protein, 24 aa, Giardia lamblia
PTLPLPRILGYCGDRLLLQYRENI

SEQ ID NO: 3166535 - protein, 17 aa, Giardia lamblia
PTLPLRSASVTKSIIEE

SEQ ID NO: 3166536 - protein, 23 aa, Giardia lamblia
PTLQMLLCPGHEPIYNVERISMF

SEQ ID NO: 3166537 - protein, 17 aa, Giardia lamblia
PTLQYPAPGSVSGGLQQ

SEQ ID NO: 3166538 - protein, 25 aa, Giardia lamblia
PTLRSDCRVRRARFSAVTKAEIQNA

SEQ ID NO: 3166539 - protein, 18 aa, Giardia lamblia
PTLYGFKLFNKQSRGKNI

SEQ ID NO: 3166540 - protein, 18 aa, Giardia lamblia
PTNYFKLMGISETYDIDL

SEQ ID NO: 3166541 - protein, 24 aa, Giardia lamblia
PTPEPAIDRELYIEKELYLALESK

SEQ ID NO: 3166542 - protein, 17 aa, Giardia lamblia
PTPPAGPYDTWMPDDVD

SEQ ID NO: 3166543 - protein, 18 aa, Giardia lamblia
PTPSECLVKVTSTSTTLS

SEQ ID NO: 3166544 - protein, 18 aa, Giardia lamblia
PTPSRFHYLFNLRDLSRV

SEQ ID NO: 3166545 - protein, 24 aa, Giardia lamblia
PTPSRRPSCPSVILWSSSVRSIPS

SEQ ID NO: 3166546 - protein, 18 aa, Giardia lamblia
PTPVSSVLRPKRPGSTGS

SEQ ID NO: 3166547 - protein, 18 aa, Giardia lamblia
PTQPFRWRKQLLDAEAEG

SEQ ID NO: 3166548 - protein, 20 aa, Giardia lamblia
PTQQELFIPLGEFVIVIGEK

SEQ ID NO: 3166549 - protein, 19 aa, Giardia lamblia
PTRFDITGPIAIDARKQTQ

SEQ ID NO: 3166550 - protein, 25 aa, Giardia lamblia
PTRHASWRFVMTLLAVGMKIFELTP

SEQ ID NO: 3166551 - protein, 26 aa, Giardia lamblia
PTRHTEVFRVGKWINYVAPEVFRGQS

SEQ ID NO: 3166552 - protein, 23 aa, Giardia lamblia
PTRKSGGPLFGFLSQALRSCCLG

SEQ ID NO: 3166553 - protein, 18 aa, Giardia lamblia
PTRKSVVGTPFWMAPELI

SEQ ID NO: 3166554 - protein, 18 aa, Giardia lamblia
PTSAPSLRTRRDVYMVNA

SEQ ID NO: 3166555 - protein, 29 aa, Giardia lamblia
PTSDGKCFFFLPKQTDLVFMGSIDSIGTH

SEQ ID NO: 3166556 - protein, 20 aa, Giardia lamblia
PTSELSAAVSQGLRDRLKQQ

SEQ ID NO: 3166557 - protein, 19 aa, Giardia lamblia
PTSFLLLMLYGCCFNAQSE

SEQ ID NO: 3166558 - protein, 24 aa, Giardia lamblia
PTSILKLKLEEQIVQLLKELSSEN

SEQ ID NO: 3166559 - protein, 17 aa, Giardia lamblia
PTSRAKEALELNYMTDY

SEQ ID NO: 3166560 - protein, 19 aa, Giardia lamblia
PTTAASCKREECQAEVLSA

SEQ ID NO: 3166561 - protein, 23 aa, Giardia lamblia
PTTDGYLLRVFVIAFTDRFRFQR

SEQ ID NO: 3166562 - protein, 23 aa, Giardia lamblia
PTTRKLEAWEMDFVDEKKPAGRV

SEQ ID NO: 3166563 - protein, 28 aa, Giardia lamblia
PTVDCLMLKIAESLGYVAHAYVTVDRSI

SEQ ID NO: 3166564 - protein, 20 aa, Giardia lamblia
PTVLCAPLAIADTTAVQETE

SEQ ID NO: 3166565 - protein, 18 aa, Giardia lamblia
PTVSSAHRSRPSSSSLNT

SEQ ID NO: 3166566 - protein, 28 aa, Giardia lamblia
PTVTHLRGLSGLAFSYSFLANQDITNHK

SEQ ID NO: 3166567 - protein, 19 aa, Giardia lamblia
PTYAFLRRIVLAAQNVSYT

SEQ ID NO: 3166568 - protein, 19 aa, Giardia lamblia
PTYCAQCAEQMRANLNSEK

SEQ ID NO: 3166569 - protein, 19 aa, Giardia lamblia
PTYMEICMILDGLRRAINR

SEQ ID NO: 3166570 - protein, 24 aa, Giardia lamblia
PVAHEILAYCLRDRSNQAMDCVYT

SEQ ID NO: 3166571 - protein, 24 aa, Giardia lamblia
PVALARFTPNPSYFVSASGTFLSL

SEQ ID NO: 3166572 - protein, 18 aa, Giardia lamblia
PVCAMVWEGANVVSISRT

SEQ ID NO: 3166573 - protein, 18 aa, Giardia lamblia
PVCASCKAGKYATVDVLP

SEQ ID NO: 3166574 - protein, 21 aa, Giardia lamblia
PVCPYFSFSRDHLCTNHNTFV

SEQ ID NO: 3166575 - protein, 24 aa, Giardia lamblia
PVDEIESVPAIGLLNPVVLTVLIL

SEQ ID NO: 3166576 - protein, 24 aa, Giardia lamblia
PVDFKFRLLFMELPEEVFDEAYLY

SEQ ID NO: 3166577 - protein, 18 aa, Giardia lamblia
PVDHYNLRMECEVKGRSL

SEQ ID NO: 3166578 - protein, 20 aa, Giardia lamblia
PVDLLIRTGCEKRLSNFLPW

SEQ ID NO: 3166579 - protein, 18 aa, Giardia lamblia
PVDLPIQADESAKWTKRG

SEQ ID NO: 3166580 - protein, 43 aa, Giardia lamblia
PVDQKLWGLLLFREVIFFQFCRCLAIFCNLTFKYDSEANIYCC

SEQ ID NO: 3166581 - protein, 24 aa, Giardia lamblia
PVEEPPRRPALIPSPGTIRKYNTW

SEQ ID NO: 3166582 - protein, 23 aa, Giardia lamblia
PVEFCSRRGLFLAPVLSVTRLFN

SEQ ID NO: 3166583 - protein, 23 aa, Giardia lamblia
PVEKYVYVRLRFDSYEDCLYGTI

SEQ ID NO: 3166584 - protein, 26 aa, Giardia lamblia
PVFGNARTGCWYAPDPDQSVLFKSTD

SEQ ID NO: 3166585 - protein, 17 aa, Giardia lamblia
PVFQIATIGKYIFHSEM

SEQ ID NO: 3166586 - protein, 23 aa, Giardia lamblia
PVGEGRLLIHGGEYGKQHDQKLA

SEQ ID NO: 3166587 - protein, 18 aa, Giardia lamblia
PVGHSIAAGGSRGTSAFL

SEQ ID NO: 3166588 - protein, 18 aa, Giardia lamblia
PVGQAIPSRNYVSLQNLF

SEQ ID NO: 3166589 - protein, 19 aa, Giardia lamblia
PVGQMFSKTDSLRWGLTGG

SEQ ID NO: 3166590 - protein, 27 aa, Giardia lamblia
PVGRYELACACVDGLLRFFDFDVDAPV

SEQ ID NO: 3166591 - protein, 25 aa, Giardia lamblia
PVHCINRSPFFGKFFISCADWSCKI

SEQ ID NO: 3166592 - protein, 25 aa, Giardia lamblia
PVIDNFKGVEYYKELLKQKEAEIAR

SEQ ID NO: 3166593 - protein, 26 aa, Giardia lamblia
PVIDPRGSRPLTSRPISSGGAGSKSM

SEQ ID NO: 3166594 - protein, 25 aa, Giardia lamblia
PVIIFWDEIDAVFPTNSFYKYMDRA

SEQ ID NO: 3166595 - protein, 27 aa, Giardia lamblia
PVIKHGLLADSLRCFEQVQKLWLDNEN

SEQ ID NO: 3166596 - protein, 25 aa, Giardia lamblia
PVIRDVCKARGYPTRIVVASGSTLV

SEQ ID NO: 3166597 - protein, 17 aa, Giardia lamblia
PVKLCADATLVFPLLLH

SEQ ID NO: 3166598 - protein, 24 aa, Giardia lamblia
PVKSDAHVPALYDRVNMDWPSREG

SEQ ID NO: 3166599 - protein, 26 aa, Giardia lamblia
PVLARLFPKRLHKPTAIANYTPSKRA

SEQ ID NO: 3166600 - protein, 27 aa, Giardia lamblia
PVLGLVVEPCIERNGAYALRAHYAATM

SEQ ID NO: 3166601 - protein, 20 aa, Giardia lamblia
PVLLPVSLVVPGRRLNPKDG

SEQ ID NO: 3166602 - protein, 26 aa, Giardia lamblia
PVLNRALMRIMRWLNTLVLKNRLAED

SEQ ID NO: 3166603 - protein, 21 aa, Giardia lamblia
PVLQPGLGWGPVVRGCDTGFL

SEQ ID NO: 3166604 - protein, 20 aa, Giardia lamblia
PVLTCNIGLDALRQSEQEGF

SEQ ID NO: 3166605 - protein, 28 aa, Giardia lamblia
PVLTFNTCLTFRPPPMTVLSSVSLANTD

SEQ ID NO: 3166606 - protein, 25 aa, Giardia lamblia
PVLTGEALFSLSFFLRSVFTSCLDQ

SEQ ID NO: 3166607 - protein, 20 aa, Giardia lamblia
PVLTRTDYHTVPSISELQAM

SEQ ID NO: 3166608 - protein, 24 aa, Giardia lamblia
PVNCLCETFQFCTAYPSSLSTLIL

SEQ ID NO: 3166609 - protein, 18 aa, Giardia lamblia
PVNNIPMLVEDETSSLML

SEQ ID NO: 3166610 - protein, 18 aa, Giardia lamblia
PVNPRVAALLVEQDSIGH

SEQ ID NO: 3166611 - protein, 25 aa, Giardia lamblia
PVPEILRLPITGLILAMLKLGASDV

SEQ ID NO: 3166612 - protein, 20 aa, Giardia lamblia
PVPHPMTLLARLEEASKTLE

SEQ ID NO: 3166613 - protein, 26 aa, Giardia lamblia
PVPLAKFVSPDGYYYVHHELTKFIKL

SEQ ID NO: 3166614 - protein, 23 aa, Giardia lamblia
PVPLMHFLCPVGGDGLYPICSSI

SEQ ID NO: 3166615 - protein, 18 aa, Giardia lamblia
PVPSLRRLFYYSDYLSLY

SEQ ID NO: 3166616 - protein, 21 aa, Giardia lamblia
PVPTANPWGATTIDFTTLSLE

SEQ ID NO: 3166617 - protein, 21 aa, Giardia lamblia
PVQDCIPFIVPFEKPSEDEFA

SEQ ID NO: 3166618 - protein, 20 aa, Giardia lamblia
PVQSRCCVLRIMPATQAELI

SEQ ID NO: 3166619 - protein, 19 aa, Giardia lamblia
PVRENRDGTVFVESLSSHI

SEQ ID NO: 3166620 - protein, 18 aa, Giardia lamblia
PVRTGSREQPSFVINIWL

SEQ ID NO: 3166621 - protein, 23 aa, Giardia lamblia
PVRYRKAVEYMSGIGGDPKDINI

SEQ ID NO: 3166622 - protein, 19 aa, Giardia lamblia
PVSDYAYKRAMSIKLQPAS

SEQ ID NO: 3166623 - protein, 19 aa, Giardia lamblia
PVSFARQLAPPGAPRLPRS

SEQ ID NO: 3166624 - protein, 20 aa, Giardia lamblia
PVSGPSRYAPAASPMTNRGS

SEQ ID NO: 3166625 - protein, 18 aa, Giardia lamblia
PVSLTFNLAGEIDFSPKL

SEQ ID NO: 3166626 - protein, 18 aa, Giardia lamblia
PVSPSMCHIMCCLRSDVL

SEQ ID NO: 3166627 - protein, 21 aa, Giardia lamblia
PVSRARAALRSGKADELAAAL

SEQ ID NO: 3166628 - protein, 17 aa, Giardia lamblia
PVSREYLIRTLGLSPDA

SEQ ID NO: 3166629 - protein, 23 aa, Giardia lamblia
PVSRGIGRSVTRAQPVRNQDQTV

SEQ ID NO: 3166630 - protein, 24 aa, Giardia lamblia
PVTGEPWTGLSFAVASGNAKCVSA

SEQ ID NO: 3166631 - protein, 17 aa, Giardia lamblia
PVTLAEVEAFLLQRPDV

SEQ ID NO: 3166632 - protein, 43 aa, Giardia lamblia
PVTLHLRSSLRSCLFISRGGLLQWCSLLGFSSYEFKHASIAAI

SEQ ID NO: 3166633 - protein, 19 aa, Giardia lamblia
PVTPELCTKIFIDPETKAL

SEQ ID NO: 3166634 - protein, 25 aa, Giardia lamblia
PVTQRLAEVLACILIKGSKEEYVWA

SEQ ID NO: 3166635 - protein, 22 aa, Giardia lamblia
PVVKSKGNFKLAIQASTLDCTG

SEQ ID NO: 3166636 - protein, 17 aa, Giardia lamblia
PVVPSSVQQGCPSQESF

SEQ ID NO: 3166637 - protein, 20 aa, Giardia lamblia
PVVSRSGERVLLSDHLTVFQ

SEQ ID NO: 3166638 - protein, 22 aa, Giardia lamblia
PVVVCGWCHRVRVSSPKLAFVV

SEQ ID NO: 3166639 - protein, 19 aa, Giardia lamblia
PVVYICATCGCETNPHMDG

SEQ ID NO: 3166640 - protein, 20 aa, Giardia lamblia
PVYQHLPQFISISAPVLPTV

SEQ ID NO: 3166641 - protein, 19 aa, Giardia lamblia
PVYYDFRRYGLSFHKMKTP

SEQ ID NO: 3166642 - protein, 21 aa, Giardia lamblia
PWEGAVIRLELKFTSEYPTKP

SEQ ID NO: 3166643 - protein, 25 aa, Giardia lamblia
PWHGRPRTRVLLPLRRERREPKRCV

SEQ ID NO: 3166644 - protein, 19 aa, Giardia lamblia
PWHQHYRAGPLELLAVPHN

SEQ ID NO: 3166645 - protein, 33 aa, Giardia lamblia
PWRGTKCGFLKSFDFYVANGLDCFNYMWQQQVY

SEQ ID NO: 3166646 - protein, 19 aa, Giardia lamblia
PWVSLYRAADVVYNPTINY

SEQ ID NO: 3166647 - protein, 20 aa, Giardia lamblia
PYAARPASVRAIRSYSQAFL

SEQ ID NO: 3166648 - protein, 27 aa, Giardia lamblia
PYARLTKYLLPMGIPPVRLVLLDEPLC

SEQ ID NO: 3166649 - protein, 20 aa, Giardia lamblia
PYASMLAKLIGIIGPIPRDM

SEQ ID NO: 3166650 - protein, 22 aa, Giardia lamblia
PYCDGIRRRAEELMNASVAIAK

SEQ ID NO: 3166651 - protein, 18 aa, Giardia lamblia
PYCVGGSLETLLYERRSS

SEQ ID NO: 3166652 - protein, 22 aa, Giardia lamblia
PYDDEMCWILANLIEVETTDGM

SEQ ID NO: 3166653 - protein, 17 aa, Giardia lamblia
PYDFSFLVTDYITAQTT

SEQ ID NO: 3166654 - protein, 25 aa, Giardia lamblia
PYDILLCYFSSYGLAIADKGETGIP

SEQ ID NO: 3166655 - protein, 26 aa, Giardia lamblia
PYEIFADSVVCRRITSTGALKIYVRV

SEQ ID NO: 3166656 - protein, 20 aa, Giardia lamblia
PYERLHKIFEYRIFIKDLRI

SEQ ID NO: 3166657 - protein, 18 aa, Giardia lamblia
PYFLSLRGTVITKTAMVN

SEQ ID NO: 3166658 - protein, 18 aa, Giardia lamblia
PYFQPHFSEQLCVRLETN

SEQ ID NO: 3166659 - protein, 17 aa, Giardia lamblia
PYFSSCFAAFLQHFPFK

SEQ ID NO: 3166660 - protein, 20 aa, Giardia lamblia
PYGCYGGACIAGDDRHPVSS

SEQ ID NO: 3166661 - protein, 19 aa, Giardia lamblia
PYGESRVSNFTSLPENRDT

SEQ ID NO: 3166662 - protein, 26 aa, Giardia lamblia
PYGRFDFPNPIGVDYWGWATDEKLAL

SEQ ID NO: 3166663 - protein, 37 aa, Giardia lamblia
PYHWVKHFPALCYKDMCKFGARVDWRRSMITTDANPY

SEQ ID NO: 3166664 - protein, 18 aa, Giardia lamblia
PYIGEIFTAFLVSQHPMH

SEQ ID NO: 3166665 - protein, 23 aa, Giardia lamblia
PYIGRYDRIGAHMLLAGYRGHLA

SEQ ID NO: 3166666 - protein, 20 aa, Giardia lamblia
PYKIVPYIEFILRGYDIKGS

SEQ ID NO: 3166667 - protein, 18 aa, Giardia lamblia
PYKKGLIFMACCREDIGT

SEQ ID NO: 3166668 - protein, 21 aa, Giardia lamblia
PYKSLEVISGTSFSPASDVWS

SEQ ID NO: 3166669 - protein, 17 aa, Giardia lamblia
PYLARVSFAQCLSQEIS

SEQ ID NO: 3166670 - protein, 22 aa, Giardia lamblia
PYLEAKGREKALIETVTSLRAQ

SEQ ID NO: 3166671 - protein, 21 aa, Giardia lamblia
PYLEPMVAAFFNYLMESERYE

SEQ ID NO: 3166672 - protein, 21 aa, Giardia lamblia
PYLIGGLKFDLRMYVLVVSVA

SEQ ID NO: 3166673 - protein, 28 aa, Giardia lamblia
PYLIVRGFREAVAIPVFLVSINGVDWIE

SEQ ID NO: 3166674 - protein, 23 aa, Giardia lamblia
PYMNGRLHLGHLFSATRAEFAVG

SEQ ID NO: 3166675 - protein, 21 aa, Giardia lamblia
PYNAKGASYIDQFGIEDEARM

SEQ ID NO: 3166676 - protein, 23 aa, Giardia lamblia
PYNISSGIVFRLLEIQPLPRKFV

SEQ ID NO: 3166677 - protein, 18 aa, Giardia lamblia
PYPDGREMSLGSIAPSNF

SEQ ID NO: 3166678 - protein, 17 aa, Giardia lamblia
PYPPSLSLLDWTGNTIF

SEQ ID NO: 3166679 - protein, 33 aa, Giardia lamblia
PYPQRTRELFYYRSSIHGFGLFLAEPAQRKELI

SEQ ID NO: 3166680 - protein, 25 aa, Giardia lamblia
PYPSSACGPWLCHVPAKIAMQSEFK

SEQ ID NO: 3166681 - protein, 17 aa, Giardia lamblia
PYPTNRENPMLAVQSSK

SEQ ID NO: 3166682 - protein, 18 aa, Giardia lamblia
PYQFLPSIWNIFRKDEKL

SEQ ID NO: 3166683 - protein, 19 aa, Giardia lamblia
PYQIPLVAPQSNLRITIPS

SEQ ID NO: 3166684 - protein, 17 aa, Giardia lamblia
PYSLRAASLRDLYYALE

SEQ ID NO: 3166685 - protein, 17 aa, Giardia lamblia
PYSPLPIIEIPDIGTLS

SEQ ID NO: 3166686 - protein, 19 aa, Giardia lamblia
PYTVPRPHPVSTLDMQRAL

SEQ ID NO: 3166687 - protein, 19 aa, Giardia lamblia
PYTYSMLTKFLARIKDHRL

SEQ ID NO: 3166688 - protein, 18 aa, Giardia lamblia
PYVAQDFFACTATTVQSA

SEQ ID NO: 3166689 - protein, 25 aa, Giardia lamblia
PYVKKPRLSSHELVTATFNRRSTVE

SEQ ID NO: 3166690 - protein, 18 aa, Giardia lamblia
PYVLSRAYIFTMLSLLAS

SEQ ID NO: 3166691 - protein, 23 aa, Giardia lamblia
PYVWTADICRTTLGCICQAMDTS

SEQ ID NO: 3166692 - protein, 18 aa, Giardia lamblia
PYVYCLEVSNSHGPDPAK

SEQ ID NO: 3166693 - protein, 17 aa, Giardia lamblia
PYYKVIANIAIFSLLGK

SEQ ID NO: 3166694 - protein, 17 aa, Giardia lamblia
QAACALTLLQSSQNPLF

SEQ ID NO: 3166695 - protein, 18 aa, Giardia lamblia
QAAEGICANAWKDSKPNA

SEQ ID NO: 3166696 - protein, 26 aa, Giardia lamblia
QAAGLRCIGCAWGLGERADVEKADMV

SEQ ID NO: 3166697 - protein, 23 aa, Giardia lamblia
QAAIREKRCRLFSQILHVFYGNE

SEQ ID NO: 3166698 - protein, 17 aa, Giardia lamblia
QAAKAIHETPCIISKAY

SEQ ID NO: 3166699 - protein, 20 aa, Giardia lamblia
QAAKRGDCDAARAHLQDIRR

SEQ ID NO: 3166700 - protein, 19 aa, Giardia lamblia
QAALQAAMVDARFIYASTI

SEQ ID NO: 3166701 - protein, 17 aa, Giardia lamblia
QADESAKWTKRGVALFA

SEQ ID NO: 3166702 - protein, 24 aa, Giardia lamblia
QADHFFTLSLFRRSLASMRWRLHQ

SEQ ID NO: 3166703 - protein, 25 aa, Giardia lamblia
QADHKIGLFGSLIVKASVVPENATS

SEQ ID NO: 3166704 - protein, 22 aa, Giardia lamblia
QADIPGPGAYDYKLRNNGPAFT

SEQ ID NO: 3166705 - protein, 19 aa, Giardia lamblia
QADKCLGCNVETTTPKEIE

SEQ ID NO: 3166706 - protein, 17 aa, Giardia lamblia
QADNLLLKDAFRHQREE

SEQ ID NO: 3166707 - protein, 26 aa, Giardia lamblia
QAECNYAMPRRHRPTAEECSGRAGTT

SEQ ID NO: 3166708 - protein, 18 aa, Giardia lamblia
QAELESKIRCALESEKST

SEQ ID NO: 3166709 - protein, 18 aa, Giardia lamblia
QAERNAKVALRMEKTSQA

SEQ ID NO: 3166710 - protein, 19 aa, Giardia lamblia
QAEVLLFRTTNDGIRKQLK

SEQ ID NO: 3166711 - protein, 26 aa, Giardia lamblia
QAFCTYDAGPNCIVFGFPDDLSRIRK

SEQ ID NO: 3166712 - protein, 28 aa, Giardia lamblia
QAFDAGKVVLEFQLPYGVSATDINVLFA

SEQ ID NO: 3166713 - protein, 19 aa, Giardia lamblia
QAFRTVYESTWGVVYNKDF

SEQ ID NO: 3166714 - protein, 25 aa, Giardia lamblia
QAFSCLKSACKQRMTASTVRNDVSS

SEQ ID NO: 3166715 - protein, 19 aa, Giardia lamblia
QAGGLRALIQANPGADLSK

SEQ ID NO: 3166716 - protein, 25 aa, Giardia lamblia
QAGHLNCVKLLLGEAEIYNSENCTA

SEQ ID NO: 3166717 - protein, 24 aa, Giardia lamblia
QAGYLKTQFFRVCLLSEIEQYKAP

SEQ ID NO: 3166718 - protein, 23 aa, Giardia lamblia
QAHKLKIVQLLAPREASVKLEKG

SEQ ID NO: 3166719 - protein, 26 aa, Giardia lamblia
QAHLPGFRINFQFKDRSVISSTCRYQ

SEQ ID NO: 3166720 - protein, 18 aa, Giardia lamblia
QAHREFLDKYGARLSKAR

SEQ ID NO: 3166721 - protein, 20 aa, Giardia lamblia
QAIAGVMFYPFFSKKLLHKY

SEQ ID NO: 3166722 - protein, 17 aa, Giardia lamblia
QAIAKLRLSDSVSADDV

SEQ ID NO: 3166723 - protein, 26 aa, Giardia lamblia
QAIEENRLLDAWSLSRVQAGLRDPLG

SEQ ID NO: 3166724 - protein, 18 aa, Giardia lamblia
QAIEIPLSTSLLLHSKGD

SEQ ID NO: 3166725 - protein, 21 aa, Giardia lamblia
QAIKLDGERALDSKDTQIAEL

SEQ ID NO: 3166726 - protein, 22 aa, Giardia lamblia
QAIKLLSRIEARMTREAGETAL

SEQ ID NO: 3166727 - protein, 17 aa, Giardia lamblia
QAINVFIDMFARNANAL

SEQ ID NO: 3166728 - protein, 23 aa, Giardia lamblia
QAKKLHESIAFVPRLITKASLYP

SEQ ID NO: 3166729 - protein, 23 aa, Giardia lamblia
QAKQLPFAMAQVGTVFRNEISPR

SEQ ID NO: 3166730 - protein, 25 aa, Giardia lamblia
QAKVFCGNCGLVIMDTLIVNDLIYQ

SEQ ID NO: 3166731 - protein, 23 aa, Giardia lamblia
QALKANLRKALARNTTLVAKLEE

SEQ ID NO: 3166732 - protein, 17 aa, Giardia lamblia
QALKLALVQKMTTKKGK

SEQ ID NO: 3166733 - protein, 23 aa, Giardia lamblia
QALPMPISITTRWSGATEVPMES

SEQ ID NO: 3166734 - protein, 18 aa, Giardia lamblia
QALPPISKRTTFLFTATL

SEQ ID NO: 3166735 - protein, 21 aa, Giardia lamblia
QALRPKNCTPIIEATGRLYNE

SEQ ID NO: 3166736 - protein, 26 aa, Giardia lamblia
QALRSCCLGYTFKLSAIYYEVLRNYY

SEQ ID NO: 3166737 - protein, 25 aa, Giardia lamblia
QALSPRSSNPITFRDNAPKTSIQQF

SEQ ID NO: 3166738 - protein, 25 aa, Giardia lamblia
QALYTLLCEICKNALARTTSAALLD

SEQ ID NO: 3166739 - protein, 19 aa, Giardia lamblia
QAMFFKTQFEQTGALNRSV

SEQ ID NO: 3166740 - protein, 23 aa, Giardia lamblia
QAMSRIRARRAASLNKTYTLDGS

SEQ ID NO: 3166741 - protein, 18 aa, Giardia lamblia
QANASYLFNLKKFLITSF

SEQ ID NO: 3166742 - protein, 23 aa, Giardia lamblia
QAPSTICRLNFYAKKDLPQRYDH

SEQ ID NO: 3166743 - protein, 30 aa, Giardia lamblia
QAPTEWVIMECRVMRALKKLLAEKGSAVSP

SEQ ID NO: 3166744 - protein, 19 aa, Giardia lamblia
QAQAEVVNLISRLPIPQGT

SEQ ID NO: 3166745 - protein, 24 aa, Giardia lamblia
QAQKPRLQSALDRVNKFEDTIATN

SEQ ID NO: 3166746 - protein, 17 aa, Giardia lamblia
QAQVEPYAFLPQVSASQ

SEQ ID NO: 3166747 - protein, 27 aa, Giardia lamblia
QARASQILAGLQFTPAMQLRRTKEFSG

SEQ ID NO: 3166748 - protein, 18 aa, Giardia lamblia
QARGGAKNVTQWKEIGKK

SEQ ID NO: 3166749 - protein, 24 aa, Giardia lamblia
QARIKKFVHNFAYRTRMRNEALVG

SEQ ID NO: 3166750 - protein, 19 aa, Giardia lamblia
QARIYAIRYDYRVQGVEGK

SEQ ID NO: 3166751 - protein, 22 aa, Giardia lamblia
QARKCRSIRRMALEEQGSAGSC

SEQ ID NO: 3166752 - protein, 23 aa, Giardia lamblia
QARKEWPLLKKVEHASVAQIIEV

SEQ ID NO: 3166753 - protein, 17 aa, Giardia lamblia
QARNRFDPLSSKINEVP

SEQ ID NO: 3166754 - protein, 18 aa, Giardia lamblia
QARRCFEVAIWFDNDCVF

SEQ ID NO: 3166755 - protein, 17 aa, Giardia lamblia
QARVPIILIPGLCSTKL

SEQ ID NO: 3166756 - protein, 23 aa, Giardia lamblia
QARVSAMSGASLQLEQAQKDLRT

SEQ ID NO: 3166757 - protein, 20 aa, Giardia lamblia
QASCCGVRLQVHGELDGDIA

SEQ ID NO: 3166758 - protein, 24 aa, Giardia lamblia
QASDPCGHLAVLQAVLQKLNHLTD

SEQ ID NO: 3166759 - protein, 20 aa, Giardia lamblia
QASGKAMAFVAAQQRALHAP

SEQ ID NO: 3166760 - protein, 26 aa, Giardia lamblia
QASHRYECGDCLAIRNELSDPHTSQG

SEQ ID NO: 3166761 - protein, 24 aa, Giardia lamblia
QASLPRTSSAWIESVTFQHSKVAA

SEQ ID NO: 3166762 - protein, 26 aa, Giardia lamblia
QASPILKRNWLDSSVFSVKTPYMSQF

SEQ ID NO: 3166763 - protein, 18 aa, Giardia lamblia
QASSKVAFTHLLKSEKAA

SEQ ID NO: 3166764 - protein, 22 aa, Giardia lamblia
QATLNLLDAVGRDMQAYDSTIT

SEQ ID NO: 3166765 - protein, 23 aa, Giardia lamblia
QATRLPMCTEMGTPESDLFPYKT

SEQ ID NO: 3166766 - protein, 18 aa, Giardia lamblia
QAVAVAIKAPRQGTALDD

SEQ ID NO: 3166767 - protein, 20 aa, Giardia lamblia
QAVKMWSDLMAQRVESEDAK

SEQ ID NO: 3166768 - protein, 25 aa, Giardia lamblia
QAVRIRSLEGFDIIAELSVSQSPLV

SEQ ID NO: 3166769 - protein, 19 aa, Giardia lamblia
QAWDAAKILAKVTVHQEFG

SEQ ID NO: 3166770 - protein, 22 aa, Giardia lamblia
QAYDCKVDIWALGVTLYEIMCR

SEQ ID NO: 3166771 - protein, 18 aa, Giardia lamblia
QCFDELIRHVAINCAERG

SEQ ID NO: 3166772 - protein, 19 aa, Giardia lamblia
QCFSCAKVFQMSEDYKFTS

SEQ ID NO: 3166773 - protein, 18 aa, Giardia lamblia
QCHALTEIYLRKNAITDL

SEQ ID NO: 3166774 - protein, 26 aa, Giardia lamblia
QCHGSYCKGLYCLGNVSGVCTYQVED

SEQ ID NO: 3166775 - protein, 20 aa, Giardia lamblia
QCISVVAAVRIIDTITSISC

SEQ ID NO: 3166776 - protein, 19 aa, Giardia lamblia
QCKEEAASMPPYISDSIED

SEQ ID NO: 3166777 - protein, 18 aa, Giardia lamblia
QCKNPKCNAYHDLDEFSV

SEQ ID NO: 3166778 - protein, 19 aa, Giardia lamblia
QCLCGCPAYSNAIKEALVM

SEQ ID NO: 3166779 - protein, 25 aa, Giardia lamblia
QCLPKDRECIMFIGAKNSVIMKPAY

SEQ ID NO: 3166780 - protein, 21 aa, Giardia lamblia
QCLYHVDMCSARTLYRSMHLL

SEQ ID NO: 3166781 - protein, 26 aa, Giardia lamblia
QCNRGATLHGFVPMNNLAAVYLLAPR

SEQ ID NO: 3166782 - protein, 17 aa, Giardia lamblia
QCNWVMDRDDVDLTVAT

SEQ ID NO: 3166783 - protein, 18 aa, Giardia lamblia
QCPHPFKVSPPFGFPFNA

SEQ ID NO: 3166784 - protein, 18 aa, Giardia lamblia
QCRHGLTALMMAANNGNA

SEQ ID NO: 3166785 - protein, 26 aa, Giardia lamblia
QCSIFFMLCLLIRGYVTPISVAATDP

SEQ ID NO: 3166786 - protein, 20 aa, Giardia lamblia
QCSQEVELLRSFSNADEYVS

SEQ ID NO: 3166787 - protein, 18 aa, Giardia lamblia
QCSWIGCTAIRDRLSYCL

SEQ ID NO: 3166788 - protein, 34 aa, Giardia lamblia
QCSYTPSVPVEWYMLRRFVKFYIKPLQHLIHDLN

SEQ ID NO: 3166789 - protein, 21 aa, Giardia lamblia
QCTAHSWGPGRAVARLPRKHG

SEQ ID NO: 3166790 - protein, 17 aa, Giardia lamblia
QCTCKIFCVPSFTSTGS

SEQ ID NO: 3166791 - protein, 18 aa, Giardia lamblia
QCTGDSPCHCLVGGTCSA

SEQ ID NO: 3166792 - protein, 24 aa, Giardia lamblia
QDACKKGLRRTCDCSRCSRNMNRG

SEQ ID NO: 3166793 - protein, 23 aa, Giardia lamblia
QDAFLKQVEHINCEYSPSKIRTS

SEQ ID NO: 3166794 - protein, 25 aa, Giardia lamblia
QDAKNCALVMLFQRRFYLRAFLKRT

SEQ ID NO: 3166795 - protein, 31 aa, Giardia lamblia
QDALVRWYRMMGYRTLYLPGLDHAGIATQSV

SEQ ID NO: 3166796 - protein, 18 aa, Giardia lamblia
QDATGYTALMWTIRLYTQ

SEQ ID NO: 3166797 - protein, 22 aa, Giardia lamblia
QDAYGKTALMYAVTARHRDAVR

SEQ ID NO: 3166798 - protein, 34 aa, Giardia lamblia
QDCDEVFRPFYLCTIIKPLFFFLDPYHRKRIAIS

SEQ ID NO: 3166799 - protein, 24 aa, Giardia lamblia
QDCEGRTALMYAAESQCTGAVEAL

SEQ ID NO: 3166800 - protein, 18 aa, Giardia lamblia
QDCVKLLLEKEGGMRDRN

SEQ ID NO: 3166801 - protein, 25 aa, Giardia lamblia
QDDEGRTALFYASWHGHTEVARLLV

SEQ ID NO: 3166802 - protein, 17 aa, Giardia lamblia
QDDFEFNLFQGLNEEVE

SEQ ID NO: 3166803 - protein, 24 aa, Giardia lamblia
QDEEGRTALMYAITEGKMNMVQML

SEQ ID NO: 3166804 - protein, 19 aa, Giardia lamblia
QDELCAGDQGIMIGYASQE

SEQ ID NO: 3166805 - protein, 23 aa, Giardia lamblia
QDELLRLARKVAHVEEAKYSARL

SEQ ID NO: 3166806 - protein, 20 aa, Giardia lamblia
QDEPEILGSTVLDSVSLHGL

SEQ ID NO: 3166807 - protein, 28 aa, Giardia lamblia
QDERDVAIAWEFNLWKSAETARFEAELK

SEQ ID NO: 3166808 - protein, 22 aa, Giardia lamblia
QDESFRSCPQFITPSHSISEDR

SEQ ID NO: 3166809 - protein, 20 aa, Giardia lamblia
QDFRALILPCMANQVDDQQS

SEQ ID NO: 3166810 - protein, 21 aa, Giardia lamblia
QDFRVATCIETHRCINGLPAT

SEQ ID NO: 3166811 - protein, 26 aa, Giardia lamblia
QDFSDFRAKKWITYRPVNAPSESEPF

SEQ ID NO: 3166812 - protein, 18 aa, Giardia lamblia
QDFYFLLELLNTYFTSSI

SEQ ID NO: 3166813 - protein, 28 aa, Giardia lamblia
QDGIPYLKICSSLPAFDLRSYPVEQEQV

SEQ ID NO: 3166814 - protein, 27 aa, Giardia lamblia
QDGMVSRLPDPVCYDIYDELERDLRAE

SEQ ID NO: 3166815 - protein, 25 aa, Giardia lamblia
QDGTKACDLFCGLYDKVTGVYPNDE

SEQ ID NO: 3166816 - protein, 21 aa, Giardia lamblia
QDHRGRTALMIAAGCGNSELV

SEQ ID NO: 3166817 - protein, 21 aa, Giardia lamblia
QDIEGRTALLRAIQNKNVTYV

SEQ ID NO: 3166818 - protein, 21 aa, Giardia lamblia
QDIKGWTALHYAAAQNSVLCM

SEQ ID NO: 3166819 - protein, 31 aa, Giardia lamblia
QDKAGWTALMWASHYNLVFLIETLFVEVTMR

SEQ ID NO: 3166820 - protein, 22 aa, Giardia lamblia
QDKRGRTALILAAQSGSIACTR

SEQ ID NO: 3166821 - protein, 25 aa, Giardia lamblia
QDKRGRTALMYAAECGYLAAIDVLS

SEQ ID NO: 3166822 - protein, 23 aa, Giardia lamblia
QDKRGRTALMYAANAGNMECAKL

SEQ ID NO: 3166823 - protein, 24 aa, Giardia lamblia
QDKSKRTALMYAIESGEEGSDQLA

SEQ ID NO: 3166824 - protein, 24 aa, Giardia lamblia
QDLAKFRSVEMARLEAGKASAESS

SEQ ID NO: 3166825 - protein, 17 aa, Giardia lamblia
QDLARLDSSLSLRTALV

SEQ ID NO: 3166826 - protein, 22 aa, Giardia lamblia
QDLARLRAELAHERTLVQQMQL

SEQ ID NO: 3166827 - protein, 17 aa, Giardia lamblia
QDLATLLVEALRKDAHC

SEQ ID NO: 3166828 - protein, 25 aa, Giardia lamblia
QDLDGRTALMYAVQLGSLDLVEMLA

SEQ ID NO: 3166829 - protein, 25 aa, Giardia lamblia
QDLIDARSYLGFRRPNSTVISFPPE

SEQ ID NO: 3166830 - protein, 27 aa, Giardia lamblia
QDLLPECVCSTQLFKQLLIDLGSLGST

SEQ ID NO: 3166831 - protein, 21 aa, Giardia lamblia
QDLRLSDLASMLEAVDDEILL

SEQ ID NO: 3166832 - protein, 17 aa, Giardia lamblia
QDLRMVFENGASLSPGG

SEQ ID NO: 3166833 - protein, 22 aa, Giardia lamblia
QDLSNALGRMFFSLTSSSQYTT

SEQ ID NO: 3166834 - protein, 19 aa, Giardia lamblia
QDMTKRLLAYEQNKSPRSA

SEQ ID NO: 3166835 - protein, 23 aa, Giardia lamblia
QDNCGMTALMFAILCENKHVVEL

SEQ ID NO: 3166836 - protein, 21 aa, Giardia lamblia
QDNCIGLDCKVFTIYDNIYFI

SEQ ID NO: 3166837 - protein, 25 aa, Giardia lamblia
QDPFQRPGAVVLLGHPRFEHFDNSL

SEQ ID NO: 3166838 - protein, 20 aa, Giardia lamblia
QDPIASFFNRERCDYFCFSY

SEQ ID NO: 3166839 - protein, 20 aa, Giardia lamblia
QDPLMYVCMSDIFDMNREDV

SEQ ID NO: 3166840 - protein, 28 aa, Giardia lamblia
QDPSFYECCRRIVSELAVSLHTSPNSSH

SEQ ID NO: 3166841 - protein, 22 aa, Giardia lamblia
QDPYFRLARDLAPRMGHPKNAY

SEQ ID NO: 3166842 - protein, 20 aa, Giardia lamblia
QDPYGIFALVLTPTRELALQ

SEQ ID NO: 3166843 - protein, 21 aa, Giardia lamblia
QDQLRTFELWLLDAHPSTEIP

SEQ ID NO: 3166844 - protein, 17 aa, Giardia lamblia
QDRFDALVKASIDTQLD

SEQ ID NO: 3166845 - protein, 29 aa, Giardia lamblia
QDRLKRIHCSKELAATLLNRALFEISSTR

SEQ ID NO: 3166846 - protein, 17 aa, Giardia lamblia
QDRNGFTALMYAVVMGN

SEQ ID NO: 3166847 - protein, 23 aa, Giardia lamblia
QDSEGRTALMYACEAGHVACARL

SEQ ID NO: 3166848 - protein, 26 aa, Giardia lamblia
QDSEGRTALYFAVKALHYSSIRHLAP

SEQ ID NO: 3166849 - protein, 24 aa, Giardia lamblia
QDSFGRTALSRGLARGTSYDTLLP

SEQ ID NO: 3166850 - protein, 21 aa, Giardia lamblia
QDSIVALTWLSSSANVIVAAT

SEQ ID NO: 3166851 - protein, 25 aa, Giardia lamblia
QDSLGGNCKTIFIANVTPSSSSYQE

SEQ ID NO: 3166852 - protein, 21 aa, Giardia lamblia
QDSRGRTALMHAAYAGHVDIV

SEQ ID NO: 3166853 - protein, 24 aa, Giardia lamblia
QDSSGRTALFYAIESNKVRIVQEL

SEQ ID NO: 3166854 - protein, 17 aa, Giardia lamblia
QDSWGATALMYALHHGK

SEQ ID NO: 3166855 - protein, 24 aa, Giardia lamblia
QDSWLRLYPIYVGKYTEFFGHRAT

SEQ ID NO: 3166856 - protein, 18 aa, Giardia lamblia
QDSYGWTALMRAAENGHT

SEQ ID NO: 3166857 - protein, 25 aa, Giardia lamblia
QDTTLRVAGGWVRDKLLGYESHDID

SEQ ID NO: 3166858 - protein, 21 aa, Giardia lamblia
QDVCRCGASIAALDVSMLLQE

SEQ ID NO: 3166859 - protein, 24 aa, Giardia lamblia
QDVDGWTALMCAAWNGHLDVVKLL

SEQ ID NO: 3166860 - protein, 17 aa, Giardia lamblia
QDVDGYTGLMIAANLGY

SEQ ID NO: 3166861 - protein, 24 aa, Giardia lamblia
QDVNGRTALMLALQNKNFMLCRLL

SEQ ID NO: 3166862 - protein, 21 aa, Giardia lamblia
QDVRKKLSFIVADPQAEEIQR

SEQ ID NO: 3166863 - protein, 24 aa, Giardia lamblia
QDVYGRTALIYAAMNCNLEGIKLL

SEQ ID NO: 3166864 - protein, 21 aa, Giardia lamblia
QDWNERCAIMYAQNRGHVDLV

SEQ ID NO: 3166865 - protein, 21 aa, Giardia lamblia
QDYKGRTALMHAIDSKNETLA

SEQ ID NO: 3166866 - protein, 17 aa, Giardia lamblia
QDYPGIVGMPADRMISA

SEQ ID NO: 3166867 - protein, 22 aa, Giardia lamblia
QEAIVSFLLPYERCMQDAGGQT

SEQ ID NO: 3166868 - protein, 21 aa, Giardia lamblia
QEALDLFSYSKLKSELISDHV

SEQ ID NO: 3166869 - protein, 18 aa, Giardia lamblia
QEAVKLLLCELGYVNTMG

SEQ ID NO: 3166870 - protein, 25 aa, Giardia lamblia
QEAVQKCLFVYFGGPAISCRSEHRV

SEQ ID NO: 3166871 - protein, 25 aa, Giardia lamblia
QEAVSSLKFAARIAGVETMPKHRAP

SEQ ID NO: 3166872 - protein, 25 aa, Giardia lamblia
QECKTRYSINLWKTFKRCFDALPIA

SEQ ID NO: 3166873 - protein, 21 aa, Giardia lamblia
QEDEGSLLLGHDVVASMDSDC

SEQ ID NO: 3166874 - protein, 24 aa, Giardia lamblia
QEDSPRKSPGITQVEPRKDSPVKN

SEQ ID NO: 3166875 - protein, 29 aa, Giardia lamblia
QEEKELRRLLAEEKLRMDKEIERANRKAD

SEQ ID NO: 3166876 - protein, 24 aa, Giardia lamblia
QEELKCNLPNRMAQNKLFKSLVSI

SEQ ID NO: 3166877 - protein, 29 aa, Giardia lamblia
QEELRLMSQHAWNPQQFWGTVDAVKPLIT

SEQ ID NO: 3166878 - protein, 20 aa, Giardia lamblia
QEEYKHLQRLLGSKRKYERH

SEQ ID NO: 3166879 - protein, 18 aa, Giardia lamblia
QEFHGCKSHSEPQVSMSN

SEQ ID NO: 3166880 - protein, 22 aa, Giardia lamblia
QEFQIKLMHLIRKGMSGDQQSL

SEQ ID NO: 3166881 - protein, 18 aa, Giardia lamblia
QEGDSWFTKELLKKLDHY

SEQ ID NO: 3166882 - protein, 23 aa, Giardia lamblia
QEGHIKLGVFGLSATLDELYSLG

SEQ ID NO: 3166883 - protein, 27 aa, Giardia lamblia
QEGVIKEWQTIWGVINDVFFKFYNICA

SEQ ID NO: 3166884 - protein, 21 aa, Giardia lamblia
QEHITSVIGWGCEHTIKALLP

SEQ ID NO: 3166885 - protein, 30 aa, Giardia lamblia
QEHKSICLQTPFDWGSQSWTLAKLLSKLDS

SEQ ID NO: 3166886 - protein, 24 aa, Giardia lamblia
QEIEALKLAYALLRNEIAGTKIQL

SEQ ID NO: 3166887 - protein, 17 aa, Giardia lamblia
QEIENRMTAKYEDEAIK

SEQ ID NO: 3166888 - protein, 31 aa, Giardia lamblia
QEIFSRADAIHFVRTALCGRYNEIMNALMQL

SEQ ID NO: 3166889 - protein, 40 aa, Giardia lamblia
QEIGAFSRRVSLQYGCVPPEMPAPIAGAGINGLGESIIRD

SEQ ID NO: 3166890 - protein, 17 aa, Giardia lamblia
QEIKRLRDELRDAEDAD

SEQ ID NO: 3166891 - protein, 18 aa, Giardia lamblia
QEILDLLNVNTKGSYAVR

SEQ ID NO: 3166892 - protein, 23 aa, Giardia lamblia
QEKDLKMHSGLSIEDLAKQKNAT

SEQ ID NO: 3166893 - protein, 20 aa, Giardia lamblia
QEKKERRLLEEKIATLESQI

SEQ ID NO: 3166894 - protein, 23 aa, Giardia lamblia
QEKKRLPVALSNKLGQGDVWKKC

SEQ ID NO: 3166895 - protein, 22 aa, Giardia lamblia
QEKRFAQQFCKGIKRAQVPLYY

SEQ ID NO: 3166896 - protein, 17 aa, Giardia lamblia
QEKSHLTSISFKSGKVA

SEQ ID NO: 3166897 - protein, 17 aa, Giardia lamblia
QEKTGWTALMMAAKNGY

SEQ ID NO: 3166898 - protein, 19 aa, Giardia lamblia
QEKVNAWVTGLLEKFDDYS

SEQ ID NO: 3166899 - protein, 22 aa, Giardia lamblia
QELCEALESIGCDVTMDRAESL

SEQ ID NO: 3166900 - protein, 20 aa, Giardia lamblia
QELDVMPLLSHPHIVNYKAV

SEQ ID NO: 3166901 - protein, 23 aa, Giardia lamblia
QELEWAQMRMDSMHSDLQKYKSR

SEQ ID NO: 3166902 - protein, 18 aa, Giardia lamblia
QELEYWFSVSTLRETPRH

SEQ ID NO: 3166903 - protein, 20 aa, Giardia lamblia
QELGQHPCIIRLINSYISVA

SEQ ID NO: 3166904 - protein, 28 aa, Giardia lamblia
QELKAIGPCDVWLLGIGHNGHIAFNEPG

SEQ ID NO: 3166905 - protein, 24 aa, Giardia lamblia
QELKARKIVVVSARIHPGEAQSSY

SEQ ID NO: 3166906 - protein, 18 aa, Giardia lamblia
QELLREWMHRRLYMAHLR

SEQ ID NO: 3166907 - protein, 21 aa, Giardia lamblia
QELLRKISLLSNHLSSLLDSR

SEQ ID NO: 3166908 - protein, 18 aa, Giardia lamblia
QELMRRKAEIDIYVSRSK

SEQ ID NO: 3166909 - protein, 33 aa, Giardia lamblia
QELQLPVNIHRWRSLEGSDPAAYELIKKTQYLQ

SEQ ID NO: 3166910 - protein, 18 aa, Giardia lamblia
QELRDAREAGKVATGKLQ

SEQ ID NO: 3166911 - protein, 25 aa, Giardia lamblia
QELSCAFPGFLELLWAAILGESENS

SEQ ID NO: 3166912 - protein, 25 aa, Giardia lamblia
QELTRLKLPHARREPFIETHIDGAM

SEQ ID NO: 3166913 - protein, 18 aa, Giardia lamblia
QELWGQTDLKGRSALTYA

SEQ ID NO: 3166914 - protein, 20 aa, Giardia lamblia
QEMAMPSFLTPEAFYERYRE

SEQ ID NO: 3166915 - protein, 19 aa, Giardia lamblia
QEMLHGLRAEKLRWEEGYK

SEQ ID NO: 3166916 - protein, 24 aa, Giardia lamblia
QEMLIFLKHCYGFSTELGVMTNVS

SEQ ID NO: 3166917 - protein, 20 aa, Giardia lamblia
QEMSDFLITDVLAFERNEEL

SEQ ID NO: 3166918 - protein, 26 aa, Giardia lamblia
QEMTFRADAGLTLKGFTPGEQSPVHA

SEQ ID NO: 3166919 - protein, 26 aa, Giardia lamblia
QENICPSESLDFCCAYSEQLRPLLGS

SEQ ID NO: 3166920 - protein, 17 aa, Giardia lamblia
QENLAALQLDFPDIESI

SEQ ID NO: 3166921 - protein, 23 aa, Giardia lamblia
QENRTLIDRVIKLEAKIQQNETL

SEQ ID NO: 3166922 - protein, 29 aa, Giardia lamblia
QEPGVVYNRARRVLDHFYTLSTAEYSAAL

SEQ ID NO: 3166923 - protein, 25 aa, Giardia lamblia
QEPPRKSLRSHGHIDKQAAEPADGP

SEQ ID NO: 3166924 - protein, 20 aa, Giardia lamblia
QEPRIKLTRIDMLEDQCREY

SEQ ID NO: 3166925 - protein, 27 aa, Giardia lamblia
QEPVFSFKGLLLFVASDMSRIVRFSGH

SEQ ID NO: 3166926 - protein, 25 aa, Giardia lamblia
QEQWKRYAPPEIHFLLLDRGTELSI

SEQ ID NO: 3166927 - protein, 17 aa, Giardia lamblia
QEQYSIRCTALLSQVRA

SEQ ID NO: 3166928 - protein, 24 aa, Giardia lamblia
QERAKEMLSRFKAASAQNRQQQTQ

SEQ ID NO: 3166929 - protein, 21 aa, Giardia lamblia
QERIFKGLQTVTGEKDVIERR

SEQ ID NO: 3166930 - protein, 21 aa, Giardia lamblia
QERILSCWEESYMKYFSSSAQ

SEQ ID NO: 3166931 - protein, 18 aa, Giardia lamblia
QERKLKCISKTYEDFHVL

SEQ ID NO: 3166932 - protein, 22 aa, Giardia lamblia
QERLRMNPAEFVDYHKGYQEQV

SEQ ID NO: 3166933 - protein, 17 aa, Giardia lamblia
QERLSYNPPSVVDKEVL

SEQ ID NO: 3166934 - protein, 19 aa, Giardia lamblia
QESDGWTALMIATRYGHTD

SEQ ID NO: 3166935 - protein, 33 aa, Giardia lamblia
QESGCKIVIEFYSDGLLINGHEPFYPFNSKETE

SEQ ID NO: 3166936 - protein, 17 aa, Giardia lamblia
QESSDWVSEAKFVARNP

SEQ ID NO: 3166937 - protein, 26 aa, Giardia lamblia
QETLEEFKEAFNLFDRNGDGNITTAE

SEQ ID NO: 3166938 - protein, 23 aa, Giardia lamblia
QETLRYLLSNSLLVTLRKMQSNL

SEQ ID NO: 3166939 - protein, 32 aa, Giardia lamblia
QETPRPGDFSTMIEHAQCPKVHGSDDSSNLTD

SEQ ID NO: 3166940 - protein, 22 aa, Giardia lamblia
QETRKVLGIPVFVTVPYCTPRL

SEQ ID NO: 3166941 - protein, 17 aa, Giardia lamblia
QEVAAVCEVAAAYRNFG

SEQ ID NO: 3166942 - protein, 24 aa, Giardia lamblia
QEVPIKLGSYVRVRITGSTRVALI

SEQ ID NO: 3166943 - protein, 21 aa, Giardia lamblia
QEVPQVPAFAGAPGVTQQITP

SEQ ID NO: 3166944 - protein, 24 aa, Giardia lamblia
QEWARRPDQPPGQGAMEKQGMQST

SEQ ID NO: 3166945 - protein, 24 aa, Giardia lamblia
QEYISLKRVMTWKDTFLKESKALG

SEQ ID NO: 3166946 - protein, 27 aa, Giardia lamblia
QEYLFFSLICEISWSDSSLIAGVKTPF

SEQ ID NO: 3166947 - protein, 32 aa, Giardia lamblia
QFAMRLREWMVWHFPELITIVPDNIDYARTVV

SEQ ID NO: 3166948 - protein, 24 aa, Giardia lamblia
QFAPRELRRGVSIYSRSCPTDIRL

SEQ ID NO: 3166949 - protein, 23 aa, Giardia lamblia
QFCNGVNGASVWLSKLGSQVVLT

SEQ ID NO: 3166950 - protein, 17 aa, Giardia lamblia
QFDRCVTLYLNPRQRLR

SEQ ID NO: 3166951 - protein, 26 aa, Giardia lamblia
QFEKYCPRINIVFRSVGGHDFHLVYP

SEQ ID NO: 3166952 - protein, 22 aa, Giardia lamblia
QFERTCFHPMVLIKETATVSDV

SEQ ID NO: 3166953 - protein, 17 aa, Giardia lamblia
QFGRPGTFTEMAADVES

SEQ ID NO: 3166954 - protein, 20 aa, Giardia lamblia
QFGSITFLLCVSQVVRQEDL

SEQ ID NO: 3166955 - protein, 26 aa, Giardia lamblia
QFHARGYFLTAFLCLCVSPDKVTLDL

SEQ ID NO: 3166956 - protein, 17 aa, Giardia lamblia
QFHPSRKHRIILLSHRN

SEQ ID NO: 3166957 - protein, 20 aa, Giardia lamblia
QFISAFARLHYLTVYDDITK

SEQ ID NO: 3166958 - protein, 20 aa, Giardia lamblia
QFITSCTKLFLHVPTIDTQR

SEQ ID NO: 3166959 - protein, 19 aa, Giardia lamblia
QFKTSLESLAALKSLVDNL

SEQ ID NO: 3166960 - protein, 19 aa, Giardia lamblia
QFLSDKVSLGYFAPTTLTG

SEQ ID NO: 3166961 - protein, 17 aa, Giardia lamblia
QFMDACIQTSPLERSLS

SEQ ID NO: 3166962 - protein, 22 aa, Giardia lamblia
QFMPEENRLILGAPLNHTRSAQ

SEQ ID NO: 3166963 - protein, 18 aa, Giardia lamblia
QFPGFKQVYFVGTCGDGF

SEQ ID NO: 3166964 - protein, 24 aa, Giardia lamblia
QFPTHKAFFSNAIFNLLGDYEGLT

SEQ ID NO: 3166965 - protein, 22 aa, Giardia lamblia
QFSKTVICEAVRCHLKSAFRNI

SEQ ID NO: 3166966 - protein, 18 aa, Giardia lamblia
QFTCPSAASSLDIRLLEI

SEQ ID NO: 3166967 - protein, 17 aa, Giardia lamblia
QFVKARQPSLPFYEDTS

SEQ ID NO: 3166968 - protein, 25 aa, Giardia lamblia
QFYYYECFEALPPKDSPFHPLNGGF

SEQ ID NO: 3166969 - protein, 20 aa, Giardia lamblia
QGAGLLLAHECRYRNKEGMT

SEQ ID NO: 3166970 - protein, 19 aa, Giardia lamblia
QGALRGRTAFTPTPTPKPS

SEQ ID NO: 3166971 - protein, 17 aa, Giardia lamblia
QGCAASIPTSLRDLPDG

SEQ ID NO: 3166972 - protein, 19 aa, Giardia lamblia
QGDHLDCYEILYPYEKDVV

SEQ ID NO: 3166973 - protein, 24 aa, Giardia lamblia
QGDIIAVYCYRSLFARLHDEYGQT

SEQ ID NO: 3166974 - protein, 19 aa, Giardia lamblia
QGFIPVFVCRMTLVDLRSA

SEQ ID NO: 3166975 - protein, 39 aa, Giardia lamblia
QGFNLCRIQLLTAHYCFLYRYGRHISWDPCVLSKQESSF

SEQ ID NO: 3166976 - protein, 28 aa, Giardia lamblia
QGGAAKWSYAYMRRLYITQADMDNYVTT

SEQ ID NO: 3166977 - protein, 21 aa, Giardia lamblia
QGHLECIRILVKAETNYSAPN

SEQ ID NO: 3166978 - protein, 23 aa, Giardia lamblia
QGHLGCVELLLGEVGLKTKGGCT

SEQ ID NO: 3166979 - protein, 23 aa, Giardia lamblia
QGHTECVRILSSYEAGMSDVSGV

SEQ ID NO: 3166980 - protein, 23 aa, Giardia lamblia
QGHVRLIARICRLAKTEKDVLSL

SEQ ID NO: 3166981 - protein, 20 aa, Giardia lamblia
QGIEFTRAFYERMLTKNEEL

SEQ ID NO: 3166982 - protein, 20 aa, Giardia lamblia
QGIGGPAIWQMENCRQNKKK

SEQ ID NO: 3166983 - protein, 29 aa, Giardia lamblia
QGIPVLSAREVLAFICSPNIPKTDDMYCR

SEQ ID NO: 3166984 - protein, 31 aa, Giardia lamblia
QGLARVFTLKGWRLRELRLFKNPKTQTSVLA

SEQ ID NO: 3166985 - protein, 19 aa, Giardia lamblia
QGLDPPIYEGQHIQTQEVP

SEQ ID NO: 3166986 - protein, 17 aa, Giardia lamblia
QGLFGHLGKLLAQITEL

SEQ ID NO: 3166987 - protein, 25 aa, Giardia lamblia
QGLHLRAWSPLIAHAHSSAYQDQGR

SEQ ID NO: 3166988 - protein, 24 aa, Giardia lamblia
QGLHQGVVAPGHISEFYKQHIRTV

SEQ ID NO: 3166989 - protein, 18 aa, Giardia lamblia
QGLLKYVLAFTQLGISYA

SEQ ID NO: 3166990 - protein, 22 aa, Giardia lamblia
QGLLLHQGFLVLLGRHHGHLAL

SEQ ID NO: 3166991 - protein, 24 aa, Giardia lamblia
QGLPDLSPLYAMILSEPELMDRSV

SEQ ID NO: 3166992 - protein, 22 aa, Giardia lamblia
QGLPSPITSLAFIRDSHHFLFL

SEQ ID NO: 3166993 - protein, 24 aa, Giardia lamblia
QGMSRLKADFSLTAGAPMPQAIAL

SEQ ID NO: 3166994 - protein, 23 aa, Giardia lamblia
QGNCYTTMIACISLASEHIEETL

SEQ ID NO: 3166995 - protein, 18 aa, Giardia lamblia
QGNYPRMVACRYNDTRIL

SEQ ID NO: 3166996 - protein, 24 aa, Giardia lamblia
QGPEFPPRVVYAFTSNKEYYRVLM

SEQ ID NO: 3166997 - protein, 23 aa, Giardia lamblia
QGPPHGLGFGAGQRKVYGATSSM

SEQ ID NO: 3166998 - protein, 17 aa, Giardia lamblia
QGQESCPHCYPRGHSSA

SEQ ID NO: 3166999 - protein, 31 aa, Giardia lamblia
QGSDKLRCRLTFLALCNIMQTFSHRGVVLPY

SEQ ID NO: 3167000 - protein, 18 aa, Giardia lamblia
QGSGRPGSNYGQSTSSLP

SEQ ID NO: 3167001 - protein, 23 aa, Giardia lamblia
QGSPVKVRHRWSTRDCTPPRDDR

SEQ ID NO: 3167002 - protein, 19 aa, Giardia lamblia
QGVGKTGGNVLVLGATNYP

SEQ ID NO: 3167003 - protein, 20 aa, Giardia lamblia
QGVPDYDALLSMSQSILSKD

SEQ ID NO: 3167004 - protein, 17 aa, Giardia lamblia
QGYPRDVNFTTDESTDQ

SEQ ID NO: 3167005 - protein, 20 aa, Giardia lamblia
QHAPNWRGVNTLASGDFSKH

SEQ ID NO: 3167006 - protein, 21 aa, Giardia lamblia
QHAYFLLPCRHVVYSDKEDFT

SEQ ID NO: 3167007 - protein, 28 aa, Giardia lamblia
QHCLPGCYDFCTLIGFLDLNPQIMSALR

SEQ ID NO: 3167008 - protein, 20 aa, Giardia lamblia
QHDRRVPVPPRLREVQPELE

SEQ ID NO: 3167009 - protein, 24 aa, Giardia lamblia
QHGDAAVCPLTISRILSLWLKGVD

SEQ ID NO: 3167010 - protein, 21 aa, Giardia lamblia
QHGDPRFIGKINQLEVQRNYA

SEQ ID NO: 3167011 - protein, 18 aa, Giardia lamblia
QHGLCVGIRTSGGVALAV

SEQ ID NO: 3167012 - protein, 19 aa, Giardia lamblia
QHGNKECADCTSRSVKWAC

SEQ ID NO: 3167013 - protein, 17 aa, Giardia lamblia
QHHLKWPQLTYVCSVAG

SEQ ID NO: 3167014 - protein, 19 aa, Giardia lamblia
QHIKECIAQLLAPKLADRA

SEQ ID NO: 3167015 - protein, 19 aa, Giardia lamblia
QHMSWDYFELLNLYRAITF

SEQ ID NO: 3167016 - protein, 19 aa, Giardia lamblia
QHNRELCMYLSSVKQYIKQ

SEQ ID NO: 3167017 - protein, 26 aa, Giardia lamblia
QHPHFRFLVSESFTLLYIRDLGAAGT

SEQ ID NO: 3167018 - protein, 28 aa, Giardia lamblia
QHQIHVLKLRLLRTIYLLDGGPKRERRR

SEQ ID NO: 3167019 - protein, 19 aa, Giardia lamblia
QHRAASFSDVYELCSILRG

SEQ ID NO: 3167020 - protein, 24 aa, Giardia lamblia
QHRSRLFLVTEFWDNKTLADLTSA

SEQ ID NO: 3167021 - protein, 18 aa, Giardia lamblia
QHTICQVLPSGALRLNGH

SEQ ID NO: 3167022 - protein, 23 aa, Giardia lamblia
QHYAAEILTAFEYLHYHGIIYRD

SEQ ID NO: 3167023 - protein, 18 aa, Giardia lamblia
QIAAAKRDECEAIKNDAE

SEQ ID NO: 3167024 - protein, 19 aa, Giardia lamblia
QIAAAVAMSARLQMLQNAQ

SEQ ID NO: 3167025 - protein, 22 aa, Giardia lamblia
QIAAINRPFTPITFDQSQYTPA

SEQ ID NO: 3167026 - protein, 19 aa, Giardia lamblia
QIAKILLKVELPLLREAGF

SEQ ID NO: 3167027 - protein, 18 aa, Giardia lamblia
QIAPNVVKKLDFLRDILD

SEQ ID NO: 3167028 - protein, 18 aa, Giardia lamblia
QIDELKYGASNHNALVQE

SEQ ID NO: 3167029 - protein, 26 aa, Giardia lamblia
QIDGFKRIIERSCAELDLKDREIDAY

SEQ ID NO: 3167030 - protein, 32 aa, Giardia lamblia
QIDGVKFLLISWLQKRNVILADDLGVGKTIQT

SEQ ID NO: 3167031 - protein, 35 aa, Giardia lamblia
QIELPLRHPELFKYLGVKPPRGILLTGPPGCGKTT

SEQ ID NO: 3167032 - protein, 18 aa, Giardia lamblia
QIEREFQQMYTLAISPQF

SEQ ID NO: 3167033 - protein, 17 aa, Giardia lamblia
QIFCPSSSLRLPQLLLC

SEQ ID NO: 3167034 - protein, 26 aa, Giardia lamblia
QIGFPRPISIDTFRKPDFFLVAEILH

SEQ ID NO: 3167035 - protein, 24 aa, Giardia lamblia
QIHEILSKVSLHFEEPAVETGWLL

SEQ ID NO: 3167036 - protein, 20 aa, Giardia lamblia
QIIACACFISIMSALSSVNA

SEQ ID NO: 3167037 - protein, 18 aa, Giardia lamblia
QIKEKNCEITRLQDEMRN

SEQ ID NO: 3167038 - protein, 33 aa, Giardia lamblia
QIKESFLLPLQRPDLLKKIGIKPSKGVLLYGVP

SEQ ID NO: 3167039 - protein, 17 aa, Giardia lamblia
QIKICLLYKNIKTCVFE

SEQ ID NO: 3167040 - protein, 18 aa, Giardia lamblia
QILARLIGDMLRALIQQG

SEQ ID NO: 3167041 - protein, 24 aa, Giardia lamblia
QILARRLTSGLGFITAGEPTRRGD

SEQ ID NO: 3167042 - protein, 20 aa, Giardia lamblia
QILEEYRLLIETRACKLVQT

SEQ ID NO: 3167043 - protein, 18 aa, Giardia lamblia
QILKEIYERYSVTLLERK

SEQ ID NO: 3167044 - protein, 25 aa, Giardia lamblia
QILKEYTRKRCVELQHKLLTLYHQE

SEQ ID NO: 3167045 - protein, 17 aa, Giardia lamblia
QILKTIMLMEQCIKGIT

SEQ ID NO: 3167046 - protein, 24 aa, Giardia lamblia
QILLPRFTVSQIMRNDQQVSFRIF

SEQ ID NO: 3167047 - protein, 18 aa, Giardia lamblia
QILLRKLGKPALDFLPVT

SEQ ID NO: 3167048 - protein, 18 aa, Giardia lamblia
QILPGRTRPAMLGESFGG

SEQ ID NO: 3167049 - protein, 22 aa, Giardia lamblia
QILRYGHHKKLPGDVESFDEYV

SEQ ID NO: 3167050 - protein, 32 aa, Giardia lamblia
QILSMRCVHAILPRLDSALFIVNSLCKLYDQA

SEQ ID NO: 3167051 - protein, 18 aa, Giardia lamblia
QILSRLSYISALGQVTRL

SEQ ID NO: 3167052 - protein, 29 aa, Giardia lamblia
QILTELFLCALPRRVFHYLEGPASVVKRL

SEQ ID NO: 3167053 - protein, 17 aa, Giardia lamblia
QILVSWKAHIKALNRNE

SEQ ID NO: 3167054 - protein, 25 aa, Giardia lamblia
QILYPSGSTKPVFFGKGKDTRALVN

SEQ ID NO: 3167055 - protein, 18 aa, Giardia lamblia
QIMYKETTALLFGTFGNP

SEQ ID NO: 3167056 - protein, 35 aa, Giardia lamblia
QINCGHCNTLLPPYCGMCEKCHWQTPICVRTGQPI

SEQ ID NO: 3167057 - protein, 23 aa, Giardia lamblia
QINELYDDFNIVLSPLRHDEVRG

SEQ ID NO: 3167058 - protein, 24 aa, Giardia lamblia
QINNCKSLLVGTNVYKEYEVFRQK

SEQ ID NO: 3167059 - protein, 27 aa, Giardia lamblia
QINVELCPLSIGPIEAFLVINTPSSQY

SEQ ID NO: 3167060 - protein, 24 aa, Giardia lamblia
QIPGKNRIAFWVNEALKYLDLCES

SEQ ID NO: 3167061 - protein, 19 aa, Giardia lamblia
QIPMLGNLLSLWRTAANAQ

SEQ ID NO: 3167062 - protein, 17 aa, Giardia lamblia
QIPRSYQPVGRNSFDHQ

SEQ ID NO: 3167063 - protein, 25 aa, Giardia lamblia
QIPSLRLGTLKDLLFKLISDYEEFF

SEQ ID NO: 3167064 - protein, 23 aa, Giardia lamblia
QIQCLKRKAEVEASMKNLETNYA

SEQ ID NO: 3167065 - protein, 19 aa, Giardia lamblia
QIQLELSKLPYTITPTSIA

SEQ ID NO: 3167066 - protein, 24 aa, Giardia lamblia
QIRKELKDVGGLTSIFDDSICTTI

SEQ ID NO: 3167067 - protein, 26 aa, Giardia lamblia
QIRLFLLTTRVGGLGLNLTAANHVFL

SEQ ID NO: 3167068 - protein, 23 aa, Giardia lamblia
QIRLRPGTEALFPKEKTASTVSL

SEQ ID NO: 3167069 - protein, 25 aa, Giardia lamblia
QIRQLFKLTVDKHGRPRRLTEAELY

SEQ ID NO: 3167070 - protein, 25 aa, Giardia lamblia
QISSRLRADLKFIAAQSQGLIVISS

SEQ ID NO: 3167071 - protein, 20 aa, Giardia lamblia
QITRFFDRKLHIHVRSPTNT

SEQ ID NO: 3167072 - protein, 17 aa, Giardia lamblia
QIVALLIGSEAKIQTAW

SEQ ID NO: 3167073 - protein, 21 aa, Giardia lamblia
QIVCALEAIGIHVSKDKSEAF

SEQ ID NO: 3167074 - protein, 22 aa, Giardia lamblia
QIVCGAIRGALSLIGYNVTVEL

SEQ ID NO: 3167075 - protein, 23 aa, Giardia lamblia
QIVKLLYDREAELSGWTPLFLAA

SEQ ID NO: 3167076 - protein, 24 aa, Giardia lamblia
QIVPPCLQTTIPQPVVQPVAQPVA

SEQ ID NO: 3167077 - protein, 19 aa, Giardia lamblia
QIVSDFLTSILIDKPTDVY

SEQ ID NO: 3167078 - protein, 17 aa, Giardia lamblia
QIVSLLIDKEARMLTKR

SEQ ID NO: 3167079 - protein, 27 aa, Giardia lamblia
QKACIPLLMLEACIQRPDGHTALMGAA

SEQ ID NO: 3167080 - protein, 20 aa, Giardia lamblia
QKAECCVFVALAYSLPNIIS

SEQ ID NO: 3167081 - protein, 28 aa, Giardia lamblia
QKAETYKSCSALLLKINQVGTITGAIDA

SEQ ID NO: 3167082 - protein, 22 aa, Giardia lamblia
QKAFECNTCVKRLHLTGDAGMV

SEQ ID NO: 3167083 - protein, 17 aa, Giardia lamblia
QKAQRPLCLYSCENAGS

SEQ ID NO: 3167084 - protein, 26 aa, Giardia lamblia
QKARLREWGALIPELNEKIYLMTLQL

SEQ ID NO: 3167085 - protein, 17 aa, Giardia lamblia
QKATSCYAKALGYDHLT

SEQ ID NO: 3167086 - protein, 21 aa, Giardia lamblia
QKDKYGWTALMYAIKSNSCYV

SEQ ID NO: 3167087 - protein, 22 aa, Giardia lamblia
QKDPELFTMPSISVKEVNLVDM

SEQ ID NO: 3167088 - protein, 19 aa, Giardia lamblia
QKDPWTWTAPYPCAELKAL

SEQ ID NO: 3167089 - protein, 19 aa, Giardia lamblia
QKDVIQYVLSRPITLVQGP

SEQ ID NO: 3167090 - protein, 24 aa, Giardia lamblia
QKDYPLTSACVFVCDLSSDASVAF

SEQ ID NO: 3167091 - protein, 25 aa, Giardia lamblia
QKEALYCVQELFKGSMRSSVLRQMI

SEQ ID NO: 3167092 - protein, 18 aa, Giardia lamblia
QKEAVRCMAASSFLSVIW

SEQ ID NO: 3167093 - protein, 24 aa, Giardia lamblia
QKEFPLFPGPIVFTSNCLKPPLPS

SEQ ID NO: 3167094 - protein, 23 aa, Giardia lamblia
QKEIPKQSSLYGLDLLEQPSAEL

SEQ ID NO: 3167095 - protein, 26 aa, Giardia lamblia
QKEISWLKEMLRMHEAEKERVALQST

SEQ ID NO: 3167096 - protein, 19 aa, Giardia lamblia
QKEKLIVCGEVMYEDGDRR

SEQ ID NO: 3167097 - protein, 25 aa, Giardia lamblia
QKELLKCAFDLLAKHPSSPRLVCYS

SEQ ID NO: 3167098 - protein, 25 aa, Giardia lamblia
QKESYIRGKILELFQINDYKLFTTM

SEQ ID NO: 3167099 - protein, 24 aa, Giardia lamblia
QKFQDPFRILPILTSSPELQQANE

SEQ ID NO: 3167100 - protein, 26 aa, Giardia lamblia
QKGHIECLKYLLAESRYCDGQDVTAL

SEQ ID NO: 3167101 - protein, 22 aa, Giardia lamblia
QKGHLDVVRMLSAAEMRIKDYA

SEQ ID NO: 3167102 - protein, 26 aa, Giardia lamblia
QKGHRRIIQLLARFEAKRQRVSGETA

SEQ ID NO: 3167103 - protein, 29 aa, Giardia lamblia
QKGSFAFRLGLPEAWRGLRDEALQNVSGY

SEQ ID NO: 3167104 - protein, 22 aa, Giardia lamblia
QKGSKLLGCCILPESYYLLAYT

SEQ ID NO: 3167105 - protein, 22 aa, Giardia lamblia
QKHEIREAFDLFDSDGSGRIDV

SEQ ID NO: 3167106 - protein, 22 aa, Giardia lamblia
QKHEVRAAILLNAIRTSDYSTM

SEQ ID NO: 3167107 - protein, 25 aa, Giardia lamblia
QKHINEAFPFLSLQLQPYGGAVNGI

SEQ ID NO: 3167108 - protein, 19 aa, Giardia lamblia
QKHMEVRFFVPGAYVSNLA

SEQ ID NO: 3167109 - protein, 23 aa, Giardia lamblia
QKHMKRLYGKTMARPPQIQSKVP

SEQ ID NO: 3167110 - protein, 29 aa, Giardia lamblia
QKIEEDFKEGRVCPATAYIPLPQDLAYDA

SEQ ID NO: 3167111 - protein, 26 aa, Giardia lamblia
QKIERLSKAIAHWRAKIQTTTEEFRA

SEQ ID NO: 3167112 - protein, 27 aa, Giardia lamblia
QKIKEYLVKLFELIGSEKRAMAYVQDS

SEQ ID NO: 3167113 - protein, 18 aa, Giardia lamblia
QKIRVGDIIYIEANSGLV

SEQ ID NO: 3167114 - protein, 26 aa, Giardia lamblia
QKIYAACGGWGHAPRIYDSASGKVVY

SEQ ID NO: 3167115 - protein, 24 aa, Giardia lamblia
QKKTKPGLGYCIGSLRGHMGPVLS

SEQ ID NO: 3167116 - protein, 22 aa, Giardia lamblia
QKKVKAAEAFMRAESKKKTKRD

SEQ ID NO: 3167117 - protein, 19 aa, Giardia lamblia
QKLCSVALDSFNFIVASRC

SEQ ID NO: 3167118 - protein, 20 aa, Giardia lamblia
QKLDRCWRGSLETGLLENHA

SEQ ID NO: 3167119 - protein, 29 aa, Giardia lamblia
QKLERIAALESRISFIAAELDARNQSVES

SEQ ID NO: 3167120 - protein, 18 aa, Giardia lamblia
QKLFQLRPTRPLQLLLQD

SEQ ID NO: 3167121 - protein, 19 aa, Giardia lamblia
QKLGGFCLKDINLTIYNDS

SEQ ID NO: 3167122 - protein, 20 aa, Giardia lamblia
QKLHYKILRFLVNASSKDNP

SEQ ID NO: 3167123 - protein, 17 aa, Giardia lamblia
QKLKRSWEVDETAYKEH

SEQ ID NO: 3167124 - protein, 21 aa, Giardia lamblia
QKLPFARLVQELVEQIAQRDG

SEQ ID NO: 3167125 - protein, 24 aa, Giardia lamblia
QKLPRSRYTQGLLHITSQQKSQFN

SEQ ID NO: 3167126 - protein, 20 aa, Giardia lamblia
QKLREEIEILNGRSKTLKGD

SEQ ID NO: 3167127 - protein, 26 aa, Giardia lamblia
QKMRKSRYGYEIPRHATFGCINSMDS

SEQ ID NO: 3167128 - protein, 17 aa, Giardia lamblia
QKNFRPWIVHNLPQITK

SEQ ID NO: 3167129 - protein, 24 aa, Giardia lamblia
QKNGIKEAFVHDSLVPCASADQQL

SEQ ID NO: 3167130 - protein, 24 aa, Giardia lamblia
QKPFGEGCAYLPSKDTVVPEKGQD

SEQ ID NO: 3167131 - protein, 22 aa, Giardia lamblia
QKPLAQKKWRVIMTCGATLDSY

SEQ ID NO: 3167132 - protein, 22 aa, Giardia lamblia
QKPRKGAAPALKKFASEAQETK

SEQ ID NO: 3167133 - protein, 23 aa, Giardia lamblia
QKQILRLPRYLKIASDLSSQMGQ

SEQ ID NO: 3167134 - protein, 30 aa, Giardia lamblia
QKQLQFPILHACYSDHHRTFLFTAGTEIAY

SEQ ID NO: 3167135 - protein, 18 aa, Giardia lamblia
QKQVEVIPSLLAEKEGLA

SEQ ID NO: 3167136 - protein, 26 aa, Giardia lamblia
QKQYHFCVIYGMNFLSMCSTGASARS

SEQ ID NO: 3167137 - protein, 25 aa, Giardia lamblia
QKRISCFGTGFSCHSPLGYLTIRNR

SEQ ID NO: 3167138 - protein, 23 aa, Giardia lamblia
QKRKAKESEAYFHAQLEEITEQN

SEQ ID NO: 3167139 - protein, 30 aa, Giardia lamblia
QKRLYFRSNPGYVYCYWDHCSPRLRRLFQP

SEQ ID NO: 3167140 - protein, 20 aa, Giardia lamblia
QKRMHTLLEYRKLFRTLLQE

SEQ ID NO: 3167141 - protein, 23 aa, Giardia lamblia
QKRSWFKQPLLIISSSTTFESIH

SEQ ID NO: 3167142 - protein, 22 aa, Giardia lamblia
QKRTFFCLHCYTFGLNKEEALT

SEQ ID NO: 3167143 - protein, 19 aa, Giardia lamblia
QKRVIPITEVMKVSSHTTE

SEQ ID NO: 3167144 - protein, 18 aa, Giardia lamblia
QKRWWTSYYAYRADSTRK

SEQ ID NO: 3167145 - protein, 20 aa, Giardia lamblia
QKSIESMAQHIRVLENEIDR

SEQ ID NO: 3167146 - protein, 19 aa, Giardia lamblia
QKSLLPFVRDFVLTAFRLA

SEQ ID NO: 3167147 - protein, 18 aa, Giardia lamblia
QKSLSLICMSVFTHYAIV

SEQ ID NO: 3167148 - protein, 28 aa, Giardia lamblia
QKSRPHIKMNFCKPYMYDKIANFSNTGY

SEQ ID NO: 3167149 - protein, 17 aa, Giardia lamblia
QKTELVALISRSSIILT

SEQ ID NO: 3167150 - protein, 17 aa, Giardia lamblia
QKTVFSIDVMAEELDNK

SEQ ID NO: 3167151 - protein, 18 aa, Giardia lamblia
QKVIGRTVIFAWRHAILD

SEQ ID NO: 3167152 - protein, 19 aa, Giardia lamblia
QKVLKRLQLKLSADEIDAL

SEQ ID NO: 3167153 - protein, 18 aa, Giardia lamblia
QKYDCVVLSPPWGGPGYW

SEQ ID NO: 3167154 - protein, 25 aa, Giardia lamblia
QKYKRIRLATLQKWIETAMTVLAQP

SEQ ID NO: 3167155 - protein, 20 aa, Giardia lamblia
QKYTLKFIMDIHGTSKQPNF

SEQ ID NO: 3167156 - protein, 23 aa, Giardia lamblia
QLACPRLTIDWDEEISACGLVMV

SEQ ID NO: 3167157 - protein, 26 aa, Giardia lamblia
QLACSDFGLACSWEQFYGRKNVYGED

SEQ ID NO: 3167158 - protein, 20 aa, Giardia lamblia
QLAEHKARLDAAERTEAERR

SEQ ID NO: 3167159 - protein, 24 aa, Giardia lamblia
QLAHPFRLPRELTLQQDTLSSSCA

SEQ ID NO: 3167160 - protein, 19 aa, Giardia lamblia
QLAKVLAYNKCYWNGTYLR

SEQ ID NO: 3167161 - protein, 25 aa, Giardia lamblia
QLAPPEWPIIVWAIPPFINENASMH

SEQ ID NO: 3167162 - protein, 21 aa, Giardia lamblia
QLARRNACVLVLLNSTFQQDF

SEQ ID NO: 3167163 - protein, 18 aa, Giardia lamblia
QLAYGERGYPPVIPPKAT

SEQ ID NO: 3167164 - protein, 23 aa, Giardia lamblia
QLCMVYPKVISFLRNDCREEMRT

SEQ ID NO: 3167165 - protein, 22 aa, Giardia lamblia
QLCQVTTAFLKRVINQARDLND

SEQ ID NO: 3167166 - protein, 19 aa, Giardia lamblia
QLCRRLPDETNLRALGTFT

SEQ ID NO: 3167167 - protein, 27 aa, Giardia lamblia
QLDAVWLELAIRICMPQIVASIYNCAS

SEQ ID NO: 3167168 - protein, 19 aa, Giardia lamblia
QLDCGVAINLLAEEETYLE

SEQ ID NO: 3167169 - protein, 18 aa, Giardia lamblia
QLDGLIIVVPSTELNIDK

SEQ ID NO: 3167170 - protein, 26 aa, Giardia lamblia
QLDHLKVATLLLNWEGLDISVYSSEG

SEQ ID NO: 3167171 - protein, 20 aa, Giardia lamblia
QLDISIALRDFFINQLKQFQ

SEQ ID NO: 3167172 - protein, 21 aa, Giardia lamblia
QLDVALYFRELVLAEIIVNRI

SEQ ID NO: 3167173 - protein, 19 aa, Giardia lamblia
QLEAIKAKSTFDYRANELL

SEQ ID NO: 3167174 - protein, 24 aa, Giardia lamblia
QLEARKTRLWSCFRELQRASTGLR

SEQ ID NO: 3167175 - protein, 23 aa, Giardia lamblia
QLELKRLSPLTVSDCPMHKVTSI

SEQ ID NO: 3167176 - protein, 25 aa, Giardia lamblia
QLEQKGRRIFAHLCKSLNVSLRRCG

SEQ ID NO: 3167177 - protein, 28 aa, Giardia lamblia
QLERLTEVWLCVVGQCLIKIQRLLMFYS

SEQ ID NO: 3167178 - protein, 24 aa, Giardia lamblia
QLEVSGMIFSLMLNCMRRDAKKQI

SEQ ID NO: 3167179 - protein, 23 aa, Giardia lamblia
QLEYLDVFLMHWPLAIKHLADRD

SEQ ID NO: 3167180 - protein, 25 aa, Giardia lamblia
QLFIVRGRPKIRVHGRKQPFRYDII

SEQ ID NO: 3167181 - protein, 37 aa, Giardia lamblia
QLFSFFSKLCLWCVRLLDCLISQIFKPDGFSACTYTG

SEQ ID NO: 3167182 - protein, 17 aa, Giardia lamblia
QLHEKRKTFTPFLSSIL

SEQ ID NO: 3167183 - protein, 19 aa, Giardia lamblia
QLHRRRAIQQAQFELVTIS

SEQ ID NO: 3167184 - protein, 22 aa, Giardia lamblia
QLHYRLSSALKDYLHGIDAVYK

SEQ ID NO: 3167185 - protein, 17 aa, Giardia lamblia
QLIEALLNYSIMKKDHE

SEQ ID NO: 3167186 - protein, 20 aa, Giardia lamblia
QLIGKRLVSRGSKRRQSQQK

SEQ ID NO: 3167187 - protein, 25 aa, Giardia lamblia
QLIMPVEFLMKIGWRDKSFFKHVLH

SEQ ID NO: 3167188 - protein, 19 aa, Giardia lamblia
QLIPLKASLTHCFRQSDKS

SEQ ID NO: 3167189 - protein, 25 aa, Giardia lamblia
QLIPQLPAFMSIEVFINKPSKTGYG

SEQ ID NO: 3167190 - protein, 17 aa, Giardia lamblia
QLISYLAPHEVRETNIF

SEQ ID NO: 3167191 - protein, 23 aa, Giardia lamblia
QLIYLSTCRLILQGNGSLIMSEL

SEQ ID NO: 3167192 - protein, 23 aa, Giardia lamblia
QLKARFIHHSGMYSGDENLSLVP

SEQ ID NO: 3167193 - protein, 23 aa, Giardia lamblia
QLKEHCQVLHSVYSVRIQVLQQL

SEQ ID NO: 3167194 - protein, 22 aa, Giardia lamblia
QLKKTYRMILSLQRQKKNDNNS

SEQ ID NO: 3167195 - protein, 22 aa, Giardia lamblia
QLKLQSELEMVRAKSEIIQKTN

SEQ ID NO: 3167196 - protein, 26 aa, Giardia lamblia
QLKMDFARMRIRIISLFQQTEIHHLY

SEQ ID NO: 3167197 - protein, 23 aa, Giardia lamblia
QLKSILSEQAIMFTSILSAKLSS

SEQ ID NO: 3167198 - protein, 26 aa, Giardia lamblia
QLKSIPILLQYEARFMKETGKDPLLL

SEQ ID NO: 3167199 - protein, 21 aa, Giardia lamblia
QLKSRVFELESHMKTLEGSLS

SEQ ID NO: 3167200 - protein, 30 aa, Giardia lamblia
QLLDPRRRPAPRMKEVFSIGTHDLDIQSQE

SEQ ID NO: 3167201 - protein, 22 aa, Giardia lamblia
QLLEMKDATLLVQHSADVATAE

SEQ ID NO: 3167202 - protein, 23 aa, Giardia lamblia
QLLESEKRCTRLLSELDEAKNKQ

SEQ ID NO: 3167203 - protein, 22 aa, Giardia lamblia
QLLILSKHRFSIYNTRTGDFSL

SEQ ID NO: 3167204 - protein, 27 aa, Giardia lamblia
QLLKALKIRGDGCLKPIASLPINELVF

SEQ ID NO: 3167205 - protein, 23 aa, Giardia lamblia
QLLKEFEGSILLCQQSTSSHSST

SEQ ID NO: 3167206 - protein, 17 aa, Giardia lamblia
QLLLPWNAGLISPSGHY

SEQ ID NO: 3167207 - protein, 18 aa, Giardia lamblia
QLLLSKKAAEEFATEMAR

SEQ ID NO: 3167208 - protein, 19 aa, Giardia lamblia
QLLPPPGMTKGEFEMYLNH

SEQ ID NO: 3167209 - protein, 17 aa, Giardia lamblia
QLLPVINIFFNKNINLG

SEQ ID NO: 3167210 - protein, 18 aa, Giardia lamblia
QLLSIKFPRPLDGEECNG

SEQ ID NO: 3167211 - protein, 20 aa, Giardia lamblia
QLLTPLLFYYKAFLDHLNAR

SEQ ID NO: 3167212 - protein, 17 aa, Giardia lamblia
QLMRSAILLAVDRIAPF

SEQ ID NO: 3167213 - protein, 26 aa, Giardia lamblia
QLNEKVAEGFARISAAIEKETIARER

SEQ ID NO: 3167214 - protein, 33 aa, Giardia lamblia
QLNELQKMLVLRCFRPDRLINAIYTFVANSIGA

SEQ ID NO: 3167215 - protein, 18 aa, Giardia lamblia
QLNHIVDIVVSRYKTIEQ

SEQ ID NO: 3167216 - protein, 23 aa, Giardia lamblia
QLNRYKYANLYIFRPDVEEKEMK

SEQ ID NO: 3167217 - protein, 18 aa, Giardia lamblia
QLNSSFKLFIRSFDRRNL

SEQ ID NO: 3167218 - protein, 19 aa, Giardia lamblia
QLPHVFVARELQRVGKPVR

SEQ ID NO: 3167219 - protein, 20 aa, Giardia lamblia
QLPRCSFCGAYINGYNRFTD

SEQ ID NO: 3167220 - protein, 21 aa, Giardia lamblia
QLPTELPQHIVIVADGTGRSS

SEQ ID NO: 3167221 - protein, 21 aa, Giardia lamblia
QLQARYAFILLALAGFDDVDH

SEQ ID NO: 3167222 - protein, 18 aa, Giardia lamblia
QLQPGAFHTFKLRGRVPS

SEQ ID NO: 3167223 - protein, 17 aa, Giardia lamblia
QLRAVYNANEFNDNYSM

SEQ ID NO: 3167224 - protein, 20 aa, Giardia lamblia
QLRDVLCENIDVGPFDDSSP

SEQ ID NO: 3167225 - protein, 20 aa, Giardia lamblia
QLRHPCLLNILDVYHNKPAR

SEQ ID NO: 3167226 - protein, 19 aa, Giardia lamblia
QLRLMACTRTGETRCGLLL

SEQ ID NO: 3167227 - protein, 17 aa, Giardia lamblia
QLRRLARDHLLQVKAEI

SEQ ID NO: 3167228 - protein, 23 aa, Giardia lamblia
QLSCIKKLIPFKLLRELVVTSDD

SEQ ID NO: 3167229 - protein, 25 aa, Giardia lamblia
QLSDLKCVLEEFTIDFSGPTSTIDP

SEQ ID NO: 3167230 - protein, 25 aa, Giardia lamblia
QLSGLRLADLDWKRTKNSVCTGDWD

SEQ ID NO: 3167231 - protein, 18 aa, Giardia lamblia
QLSLFISVYDQIFTGTPD

SEQ ID NO: 3167232 - protein, 26 aa, Giardia lamblia
QLSPTYRAYFWLIIGIAYNVYDIYHD

SEQ ID NO: 3167233 - protein, 23 aa, Giardia lamblia
QLSSKLFVIRGIYLHSMNSAQLN

SEQ ID NO: 3167234 - protein, 22 aa, Giardia lamblia
QLSSLTAHTGWITGVCFPACTA

SEQ ID NO: 3167235 - protein, 19 aa, Giardia lamblia
QLSYGRCFGVDSGLEGEVI

SEQ ID NO: 3167236 - protein, 39 aa, Giardia lamblia
QLTALPWQLVCSIGRARRAESLILYNFFVMPYILPDTEY

SEQ ID NO: 3167237 - protein, 31 aa, Giardia lamblia
QLTCQCFKRQQAFLPLFGYLPDQYIRYITNL

SEQ ID NO: 3167238 - protein, 19 aa, Giardia lamblia
QLTNALAWCVEKEPDAVVT

SEQ ID NO: 3167239 - protein, 17 aa, Giardia lamblia
QLTRPPLTDALSNRMNT

SEQ ID NO: 3167240 - protein, 18 aa, Giardia lamblia
QLTRTMRFYPWLQDTGGF

SEQ ID NO: 3167241 - protein, 18 aa, Giardia lamblia
QLVEDLRAGIATLDDNLA

SEQ ID NO: 3167242 - protein, 18 aa, Giardia lamblia
QLVGPMPKFEIQRRWCLA

SEQ ID NO: 3167243 - protein, 27 aa, Giardia lamblia
QLVIKLWKVCEGVLKCLIEAAKSSFDS

SEQ ID NO: 3167244 - protein, 18 aa, Giardia lamblia
QLVPEAKYFSFLVQALPI

SEQ ID NO: 3167245 - protein, 20 aa, Giardia lamblia
QLVPYCSTQISLALEELDVE

SEQ ID NO: 3167246 - protein, 19 aa, Giardia lamblia
QLYELDFPSILASDATDEL

SEQ ID NO: 3167247 - protein, 25 aa, Giardia lamblia
QLYFKRTGINPVQEWIAGEANANAS

SEQ ID NO: 3167248 - protein, 22 aa, Giardia lamblia
QLYKVCANSPVITPSQPSKAPQ

SEQ ID NO: 3167249 - protein, 26 aa, Giardia lamblia
QLYLEMEYCPGGSLSDLIKSQRVRKQ

SEQ ID NO: 3167250 - protein, 17 aa, Giardia lamblia
QLYLPTSQTLSMFLDIL

SEQ ID NO: 3167251 - protein, 25 aa, Giardia lamblia
QLYQKRIHGGVNIYKPDFGHTEGGH

SEQ ID NO: 3167252 - protein, 32 aa, Giardia lamblia
QLYSPLLQCHMLWRQCFVHQKVFIRGTEHVPV

SEQ ID NO: 3167253 - protein, 26 aa, Giardia lamblia
QMDIYPRLLLLLTLVSMKIKLSEGFF

SEQ ID NO: 3167254 - protein, 25 aa, Giardia lamblia
QMESHFLQKMGYYIAYTRAMALSGS

SEQ ID NO: 3167255 - protein, 24 aa, Giardia lamblia
QMETLDWEVLQGLITASKVTGEEL

SEQ ID NO: 3167256 - protein, 25 aa, Giardia lamblia
QMFPAEPKQLFDLGMHVIENLQVYR

SEQ ID NO: 3167257 - protein, 26 aa, Giardia lamblia
QMGIEPSRGALLWGPPGTGKSLLAKA

SEQ ID NO: 3167258 - protein, 18 aa, Giardia lamblia
QMHHVPSFLNFVPNSMQH

SEQ ID NO: 3167259 - protein, 20 aa, Giardia lamblia
QMLCPTFFVAVPRVLNKLFD

SEQ ID NO: 3167260 - protein, 24 aa, Giardia lamblia
QMLLAICINNVILVYRIYANLKLV

SEQ ID NO: 3167261 - protein, 23 aa, Giardia lamblia
QMLTRCMMLAKYFVSSEYTVDEF

SEQ ID NO: 3167262 - protein, 26 aa, Giardia lamblia
QMPEEFTFELPLLLTFQKQFFNYGRS

SEQ ID NO: 3167263 - protein, 26 aa, Giardia lamblia
QMPGTFCLQCTPDLYVSITPVSFSSH

SEQ ID NO: 3167264 - protein, 18 aa, Giardia lamblia
QMRLKEVEESSFVEREKL

SEQ ID NO: 3167265 - protein, 23 aa, Giardia lamblia
QMSVFDRLAALKAIKDNEEVQKA

SEQ ID NO: 3167266 - protein, 26 aa, Giardia lamblia
QMVHMPMPMMNGMQGQVLAPMQMSPG

SEQ ID NO: 3167267 - protein, 24 aa, Giardia lamblia
QMWAELYGLPCLPLYDRVRSSADP

SEQ ID NO: 3167268 - protein, 21 aa, Giardia lamblia
QMYRRLQPRLIQVFGTSVSIV

SEQ ID NO: 3167269 - protein, 18 aa, Giardia lamblia
QNALKQAQRFAGLSSAEA

SEQ ID NO: 3167270 - protein, 22 aa, Giardia lamblia
QNAMLKDHWTYLKSTLDACSAQ

SEQ ID NO: 3167271 - protein, 17 aa, Giardia lamblia
QNCTESAQIYEQQIAEL

SEQ ID NO: 3167272 - protein, 20 aa, Giardia lamblia
QNDINAVRWVKGEDIEAIAL

SEQ ID NO: 3167273 - protein, 23 aa, Giardia lamblia
QNDPHGFELFSISGDKEILHDLQ

SEQ ID NO: 3167274 - protein, 19 aa, Giardia lamblia
QNEIRYLREELASKENQIS

SEQ ID NO: 3167275 - protein, 18 aa, Giardia lamblia
QNEKGWTALMLAVQTAQS

SEQ ID NO: 3167276 - protein, 24 aa, Giardia lamblia
QNELILFCEIEKFVSYIGTIIKRR

SEQ ID NO: 3167277 - protein, 24 aa, Giardia lamblia
QNERGWTALMWAVHSIKLEAVKLL

SEQ ID NO: 3167278 - protein, 17 aa, Giardia lamblia
QNEYGWTALMWAAENGY

SEQ ID NO: 3167279 - protein, 17 aa, Giardia lamblia
QNFKQDRFDALVKASID

SEQ ID NO: 3167280 - protein, 26 aa, Giardia lamblia
QNGHLECVHLLLIEAGVKTITRETAL

SEQ ID NO: 3167281 - protein, 26 aa, Giardia lamblia
QNGHLECVKLLFEYEKGMRRTTDNRN

SEQ ID NO: 3167282 - protein, 23 aa, Giardia lamblia
QNGHTRAAFALMEEAMIRDKKGR

SEQ ID NO: 3167283 - protein, 17 aa, Giardia lamblia
QNGRTALMVAAELDQLD

SEQ ID NO: 3167284 - protein, 18 aa, Giardia lamblia
QNGSCFDLTHSLRGYVPG

SEQ ID NO: 3167285 - protein, 19 aa, Giardia lamblia
QNGSILKGSYLFSNTSPDA

SEQ ID NO: 3167286 - protein, 17 aa, Giardia lamblia
QNHAIRRFIATSKPSLS

SEQ ID NO: 3167287 - protein, 22 aa, Giardia lamblia
QNHARNVLKQGPIGRQTLDITI

SEQ ID NO: 3167288 - protein, 17 aa, Giardia lamblia
QNIISYKLALNGLKLDA

SEQ ID NO: 3167289 - protein, 22 aa, Giardia lamblia
QNILEYMFSFALPQVPSDAQET

SEQ ID NO: 3167290 - protein, 22 aa, Giardia lamblia
QNIPETFVWDITAQMVLALRYL

SEQ ID NO: 3167291 - protein, 17 aa, Giardia lamblia
QNKEYDMFSGIFRHTAR

SEQ ID NO: 3167292 - protein, 25 aa, Giardia lamblia
QNKHWDVARILYPLESHLLPEVVSD

SEQ ID NO: 3167293 - protein, 22 aa, Giardia lamblia
QNKRLAAVKLLLSTEAAMTNCQ

SEQ ID NO: 3167294 - protein, 22 aa, Giardia lamblia
QNKRVAVRILLPYEYESLNGFT

SEQ ID NO: 3167295 - protein, 17 aa, Giardia lamblia
QNLCKALGISIDDFQPE

SEQ ID NO: 3167296 - protein, 17 aa, Giardia lamblia
QNLLEVLSDAQLMEINA

SEQ ID NO: 3167297 - protein, 20 aa, Giardia lamblia
QNLPLVCVLLQYESALLDYR

SEQ ID NO: 3167298 - protein, 23 aa, Giardia lamblia
QNNASGIGANFSVKQKVPIYTSS

SEQ ID NO: 3167299 - protein, 20 aa, Giardia lamblia
QNPQFFTWFCTLLHSSNYAT

SEQ ID NO: 3167300 - protein, 23 aa, Giardia lamblia
QNQQCPPLVLARFFTLLGSSQLR

SEQ ID NO: 3167301 - protein, 24 aa, Giardia lamblia
QNRAYLGWDYFRVHTGGFLPYNTP

SEQ ID NO: 3167302 - protein, 17 aa, Giardia lamblia
QNRDAPIELKRVDTAVL

SEQ ID NO: 3167303 - protein, 19 aa, Giardia lamblia
QNRQGRTAMMFAAQYNSSK

SEQ ID NO: 3167304 - protein, 24 aa, Giardia lamblia
QNRSGKELYDFIPKTYILPQSASI

SEQ ID NO: 3167305 - protein, 33 aa, Giardia lamblia
QNRSSIRLIQAFAKFNTLCIVSMDSTVLFLNLK

SEQ ID NO: 3167306 - protein, 22 aa, Giardia lamblia
QNRVSVIMECMLRQFSALDDLI

SEQ ID NO: 3167307 - protein, 26 aa, Giardia lamblia
QNSEIRRYLQYAGRFNGDGVTALMIA

SEQ ID NO: 3167308 - protein, 19 aa, Giardia lamblia
QNSHLPCVMKMLPDEHDQM

SEQ ID NO: 3167309 - protein, 18 aa, Giardia lamblia
QNSLEGWQMYSGNLQIDN

SEQ ID NO: 3167310 - protein, 17 aa, Giardia lamblia
QNSNGWTALMRAAEKGY

SEQ ID NO: 3167311 - protein, 24 aa, Giardia lamblia
QNSSLRFVFNPAPYRADYDFSKIL

SEQ ID NO: 3167312 - protein, 17 aa, Giardia lamblia
QNTRHPINYQYNIMNIP

SEQ ID NO: 3167313 - protein, 23 aa, Giardia lamblia
QNTVLRWVPPVQTMLEAGAFTVI

SEQ ID NO: 3167314 - protein, 18 aa, Giardia lamblia
QNVIAVLDFDCFYASIEE

SEQ ID NO: 3167315 - protein, 17 aa, Giardia lamblia
QNVQQWFHRSWKTDNGL

SEQ ID NO: 3167316 - protein, 22 aa, Giardia lamblia
QNWGYPAYNWRKMEEIDGYQWM

SEQ ID NO: 3167317 - protein, 23 aa, Giardia lamblia
QNYYRYYMKYLKPQQKDVIKILE

SEQ ID NO: 3167318 - protein, 24 aa, Giardia lamblia
QPACAKLLAPWEKGFRNTGGLTAL

SEQ ID NO: 3167319 - protein, 17 aa, Giardia lamblia
QPADDGIVFAHKSNLYY

SEQ ID NO: 3167320 - protein, 17 aa, Giardia lamblia
QPAKFSREWKLHQVVKA

SEQ ID NO: 3167321 - protein, 29 aa, Giardia lamblia
QPAVLKHIWPKVCGYLNDLFRPILGNLKG

SEQ ID NO: 3167322 - protein, 19 aa, Giardia lamblia
QPCTLIDGSGRIMSRNFDK

SEQ ID NO: 3167323 - protein, 18 aa, Giardia lamblia
QPDRVVVSADCVEKRADA

SEQ ID NO: 3167324 - protein, 21 aa, Giardia lamblia
QPDSYALAAENEWLEQEIAQM

SEQ ID NO: 3167325 - protein, 23 aa, Giardia lamblia
QPEKYRLHCPLCRKRCDKLNRVY

SEQ ID NO: 3167326 - protein, 25 aa, Giardia lamblia
QPELPYVVVVSGRFDLSGTLTSQLT

SEQ ID NO: 3167327 - protein, 17 aa, Giardia lamblia
QPFMKNVREFEKYIETA

SEQ ID NO: 3167328 - protein, 20 aa, Giardia lamblia
QPGGNCLLIGLGGSGRSSLA

SEQ ID NO: 3167329 - protein, 17 aa, Giardia lamblia
QPGPPRVLIGNWVEEKA

SEQ ID NO: 3167330 - protein, 21 aa, Giardia lamblia
QPGSDGFRVLVLVPTRELADQ

SEQ ID NO: 3167331 - protein, 17 aa, Giardia lamblia
QPGVYWDLLSELMPVVL

SEQ ID NO: 3167332 - protein, 20 aa, Giardia lamblia
QPHILSLRAMISFVGAVHSQ

SEQ ID NO: 3167333 - protein, 28 aa, Giardia lamblia
QPHKASARLDSWLDNTMRSLGSFADEYK

SEQ ID NO: 3167334 - protein, 20 aa, Giardia lamblia
QPIFPLKTLILLARKSEKSF

SEQ ID NO: 3167335 - protein, 17 aa, Giardia lamblia
QPKARAAGLERFTRLLI

SEQ ID NO: 3167336 - protein, 20 aa, Giardia lamblia
QPLHFRFSFLPEEQTCSSAY

SEQ ID NO: 3167337 - protein, 21 aa, Giardia lamblia
QPLPERTIWQIFKGLASALVY

SEQ ID NO: 3167338 - protein, 18 aa, Giardia lamblia
QPLPNGRFSRLGRGRAPA

SEQ ID NO: 3167339 - protein, 22 aa, Giardia lamblia
QPLRCNCIYCNTNVGFGVVCPC

SEQ ID NO: 3167340 - protein, 20 aa, Giardia lamblia
QPLRMRALAVGPEVEFDCDE

SEQ ID NO: 3167341 - protein, 18 aa, Giardia lamblia
QPLSCLLDDVVVTTADHV

SEQ ID NO: 3167342 - protein, 17 aa, Giardia lamblia
QPMHGIPAIPAVYTMPV

SEQ ID NO: 3167343 - protein, 25 aa, Giardia lamblia
QPMSGSPFDIFSMFTGGGRSSNRGP

SEQ ID NO: 3167344 - protein, 17 aa, Giardia lamblia
QPMYGGGAMPGFGGSFS

SEQ ID NO: 3167345 - protein, 18 aa, Giardia lamblia
QPNIVSWKSLGSENANAG

SEQ ID NO: 3167346 - protein, 23 aa, Giardia lamblia
QPNRRRPGLFPGLAEEYANRRDE

SEQ ID NO: 3167347 - protein, 25 aa, Giardia lamblia
QPPLKELRSSAVLFDSKANTLLMQA

SEQ ID NO: 3167348 - protein, 19 aa, Giardia lamblia
QPPPLGRDELRGDSRNGTR

SEQ ID NO: 3167349 - protein, 19 aa, Giardia lamblia
QPPVPEKWEPLDTVQHLPQ

SEQ ID NO: 3167350 - protein, 22 aa, Giardia lamblia
QPRCSIYGTVCYNAPESNRHGL

SEQ ID NO: 3167351 - protein, 25 aa, Giardia lamblia
QPRDSRGSCAVAFDNRMRLELLRGE

SEQ ID NO: 3167352 - protein, 20 aa, Giardia lamblia
QPRELLKSASLDNGPDSLSS

SEQ ID NO: 3167353 - protein, 22 aa, Giardia lamblia
QPRTADLRPHFSLLARTLELLH

SEQ ID NO: 3167354 - protein, 21 aa, Giardia lamblia
QPSAELMHQFQQFQLFQQFQQ

SEQ ID NO: 3167355 - protein, 26 aa, Giardia lamblia
QPSGKLCAIKLLWSQKGNNYNEKEEK

SEQ ID NO: 3167356 - protein, 18 aa, Giardia lamblia
QPSIGTRERIEVVKKYLQ

SEQ ID NO: 3167357 - protein, 17 aa, Giardia lamblia
QPTIALPNMNFFAEEVQ

SEQ ID NO: 3167358 - protein, 24 aa, Giardia lamblia
QPTLAFSIYYFVRLETMPADFTDW

SEQ ID NO: 3167359 - protein, 26 aa, Giardia lamblia
QPTLELRLTKDFGLTFTVSVEGCGSQ

SEQ ID NO: 3167360 - protein, 21 aa, Giardia lamblia
QPVKMELCVPIGFVDGGVDTV

SEQ ID NO: 3167361 - protein, 25 aa, Giardia lamblia
QPVLKNSWCLYSLFRSRSYNMSNTV

SEQ ID NO: 3167362 - protein, 25 aa, Giardia lamblia
QPVLPKSAKRWAIQRNGEGKRDPDS

SEQ ID NO: 3167363 - protein, 18 aa, Giardia lamblia
QPVRAGSNLKLRSVSATL

SEQ ID NO: 3167364 - protein, 19 aa, Giardia lamblia
QPWFAFPLDPSFCSWTTAR

SEQ ID NO: 3167365 - protein, 24 aa, Giardia lamblia
QQAEFPLSSFKGASFTSQSFADEP

SEQ ID NO: 3167366 - protein, 22 aa, Giardia lamblia
QQAHVALTQEVWRMRAENERLS

SEQ ID NO: 3167367 - protein, 21 aa, Giardia lamblia
QQAPCRMFRDKAYLRIFKAVL

SEQ ID NO: 3167368 - protein, 25 aa, Giardia lamblia
QQAREAGELVGSLTLSRFEGGTPVR

SEQ ID NO: 3167369 - protein, 29 aa, Giardia lamblia
QQCFEIDLPFIRKARSNFSHGVVDNLHSD

SEQ ID NO: 3167370 - protein, 17 aa, Giardia lamblia
QQCIGSYGKDLSIETDS

SEQ ID NO: 3167371 - protein, 19 aa, Giardia lamblia
QQDKHGWTALMYAAQNGHT

SEQ ID NO: 3167372 - protein, 26 aa, Giardia lamblia
QQDVDGRTALWFAAMKGHVSCVRELK

SEQ ID NO: 3167373 - protein, 25 aa, Giardia lamblia
QQEAKRLIKLPSLQAKLHPFKDHGQ

SEQ ID NO: 3167374 - protein, 17 aa, Giardia lamblia
QQELCSYIMSFAAQTLS

SEQ ID NO: 3167375 - protein, 19 aa, Giardia lamblia
QQELKKRRRRVSKVSLGDS

SEQ ID NO: 3167376 - protein, 18 aa, Giardia lamblia
QQERESRNYFQLEKDKIF

SEQ ID NO: 3167377 - protein, 19 aa, Giardia lamblia
QQFLACSNKLLYNNILVEL

SEQ ID NO: 3167378 - protein, 22 aa, Giardia lamblia
QQHIKKLTGFIVGHEMGLGKTV

SEQ ID NO: 3167379 - protein, 30 aa, Giardia lamblia
QQIECITALPKLMVENQFSLVIVDSLTALF

SEQ ID NO: 3167380 - protein, 19 aa, Giardia lamblia
QQIGLKYLVTISVLTSCFS

SEQ ID NO: 3167381 - protein, 24 aa, Giardia lamblia
QQIKYRAPAFMNMALHYKVDAFKY

SEQ ID NO: 3167382 - protein, 26 aa, Giardia lamblia
QQIPEEHIWYIAAEVGSALKYLHEPH

SEQ ID NO: 3167383 - protein, 30 aa, Giardia lamblia
QQIRILSLLYRFSAAESYLIPYRIRTGGGY

SEQ ID NO: 3167384 - protein, 21 aa, Giardia lamblia
QQKARAAFIQAARQTSPGTEG

SEQ ID NO: 3167385 - protein, 18 aa, Giardia lamblia
QQKDVIKILEYLVSSVHP

SEQ ID NO: 3167386 - protein, 23 aa, Giardia lamblia
QQKFDIMVVNAFLAMLSTNKFLE

SEQ ID NO: 3167387 - protein, 24 aa, Giardia lamblia
QQLDVPLPFPLFILTPDPYFLSGP

SEQ ID NO: 3167388 - protein, 19 aa, Giardia lamblia
QQLHAHFSNMWSFLEDRVY

SEQ ID NO: 3167389 - protein, 26 aa, Giardia lamblia
QQLPRSVCAYEPYIPEYPSLYGDAKI

SEQ ID NO: 3167390 - protein, 31 aa, Giardia lamblia
QQLSAIVRYTWKHKIDVFVFLGDFSPNRFMY

SEQ ID NO: 3167391 - protein, 20 aa, Giardia lamblia
QQNFFSWLVKQEFVKENPKY

SEQ ID NO: 3167392 - protein, 18 aa, Giardia lamblia
QQNILRSDVLSRYFSNEK

SEQ ID NO: 3167393 - protein, 20 aa, Giardia lamblia
QQNKEGWSALMIALNNRQKE

SEQ ID NO: 3167394 - protein, 33 aa, Giardia lamblia
QQNLKLLLFLSKLLKMERLRNGALILETPAVEF

SEQ ID NO: 3167395 - protein, 23 aa, Giardia lamblia
QQPCAESKFLYSEEELAKIAATS

SEQ ID NO: 3167396 - protein, 25 aa, Giardia lamblia
QQPLELGVALLWRYDTANVMDPASE

SEQ ID NO: 3167397 - protein, 17 aa, Giardia lamblia
QQPSLLLEDDHQAANSS

SEQ ID NO: 3167398 - protein, 18 aa, Giardia lamblia
QQQILYDQFILMIEGTLK

SEQ ID NO: 3167399 - protein, 19 aa, Giardia lamblia
QQQLQCLMNANSQLNDLLN

SEQ ID NO: 3167400 - protein, 23 aa, Giardia lamblia
QQRLKDLFILLITAFLKDVAIVY

SEQ ID NO: 3167401 - protein, 25 aa, Giardia lamblia
QQRLYSSICDLVIKTLIACEPNFYI

SEQ ID NO: 3167402 - protein, 23 aa, Giardia lamblia
QQRRLFLDADFACFHTPYCTLPK

SEQ ID NO: 3167403 - protein, 24 aa, Giardia lamblia
QQRSFRTCLNIIKKHVTSERRKRM

SEQ ID NO: 3167404 - protein, 24 aa, Giardia lamblia
QQSGRFAQPAPFPSHNSLARQTSQ

SEQ ID NO: 3167405 - protein, 23 aa, Giardia lamblia
QQVARAWLAYFKNHAVPCIAFKS

SEQ ID NO: 3167406 - protein, 24 aa, Giardia lamblia
QQVELPTTLSPILFPHNLETTPHI

SEQ ID NO: 3167407 - protein, 22 aa, Giardia lamblia
QQVTVWSCQMHIIDSWFPSDKA

SEQ ID NO: 3167408 - protein, 25 aa, Giardia lamblia
QQYLLRHLQELCRLLDIPYDPISVL

SEQ ID NO: 3167409 - protein, 31 aa, Giardia lamblia
QQYRFCHQICRFPSEEFYLGRLVPAESVRNI

SEQ ID NO: 3167410 - protein, 23 aa, Giardia lamblia
QQYSGREELNFDIHIAEPAALPE

SEQ ID NO: 3167411 - protein, 24 aa, Giardia lamblia
QRAARPGMISLDMSTQNSHRPNSV

SEQ ID NO: 3167412 - protein, 29 aa, Giardia lamblia
QRACKFIADTICKFTPQHMEVLSIINDSY

SEQ ID NO: 3167413 - protein, 29 aa, Giardia lamblia
QRAEELRIRYLRKRELILQERKRTTERIL

SEQ ID NO: 3167414 - protein, 24 aa, Giardia lamblia
QRAKLEQIHRAFPLLTDSPKDAPT

SEQ ID NO: 3167415 - protein, 21 aa, Giardia lamblia
QRAPGRSTLRDELPIDTDTLS

SEQ ID NO: 3167416 - protein, 19 aa, Giardia lamblia
QRAPVKFSAALLNLREKQI

SEQ ID NO: 3167417 - protein, 23 aa, Giardia lamblia
QRAQELSVLKGHMRQLQDDNHAL

SEQ ID NO: 3167418 - protein, 21 aa, Giardia lamblia
QRAYIVMEFCEGGELSEFIRM

SEQ ID NO: 3167419 - protein, 19 aa, Giardia lamblia
QRCPSRSKSPAIYTPQSLH

SEQ ID NO: 3167420 - protein, 19 aa, Giardia lamblia
QRCSVRLSLAAMCTDSSKL

SEQ ID NO: 3167421 - protein, 26 aa, Giardia lamblia
QRCSVSGCKVVERFANLASIDRYMRR

SEQ ID NO: 3167422 - protein, 19 aa, Giardia lamblia
QRDALFFELLGLYEKLLRG

SEQ ID NO: 3167423 - protein, 18 aa, Giardia lamblia
QRDARYGYGGKIVVTQPR

SEQ ID NO: 3167424 - protein, 24 aa, Giardia lamblia
QRDEISRLDSLLVDKNEELKVLTL

SEQ ID NO: 3167425 - protein, 17 aa, Giardia lamblia
QRDGPAILRTMQNKYRD

SEQ ID NO: 3167426 - protein, 20 aa, Giardia lamblia
QRDHCNLGNYTLNYLTGLES

SEQ ID NO: 3167427 - protein, 17 aa, Giardia lamblia
QRDIMLFIDTFSGEHVP

SEQ ID NO: 3167428 - protein, 20 aa, Giardia lamblia
QRDREISKLVTINRTGTAKP

SEQ ID NO: 3167429 - protein, 20 aa, Giardia lamblia
QRDYKKWTALMYAAANGHVN

SEQ ID NO: 3167430 - protein, 25 aa, Giardia lamblia
QREACLIAAGLEVGWDDLLGASSAP

SEQ ID NO: 3167431 - protein, 17 aa, Giardia lamblia
QREAFDLVISRLTGKDV

SEQ ID NO: 3167432 - protein, 17 aa, Giardia lamblia
QRFIAQLQLNYAEKCSE

SEQ ID NO: 3167433 - protein, 17 aa, Giardia lamblia
QRFPYAKAFLDLNEELL

SEQ ID NO: 3167434 - protein, 17 aa, Giardia lamblia
QRFSFDGVYDPSVTTRE

SEQ ID NO: 3167435 - protein, 20 aa, Giardia lamblia
QRFTKELDEVHSMGIYGRDE

SEQ ID NO: 3167436 - protein, 20 aa, Giardia lamblia
QRGAGGLANYPSGSIGGQRP

SEQ ID NO: 3167437 - protein, 20 aa, Giardia lamblia
QRGALVYLVKLRHLLELKAA

SEQ ID NO: 3167438 - protein, 18 aa, Giardia lamblia
QRGARQSSHCKFGPLSTS

SEQ ID NO: 3167439 - protein, 19 aa, Giardia lamblia
QRGDVRGALDLLIQDRSYL

SEQ ID NO: 3167440 - protein, 19 aa, Giardia lamblia
QRGENVLSISLIHSATDID

SEQ ID NO: 3167441 - protein, 19 aa, Giardia lamblia
QRGEWPAILPPEITAKDYS

SEQ ID NO: 3167442 - protein, 19 aa, Giardia lamblia
QRGFKPVALAVVPLLRDRD

SEQ ID NO: 3167443 - protein, 18 aa, Giardia lamblia
QRGGEHYQGLTGRAIFEN

SEQ ID NO: 3167444 - protein, 19 aa, Giardia lamblia
QRGLLKKGCDIVIATPGRL

SEQ ID NO: 3167445 - protein, 19 aa, Giardia lamblia
QRGQEFVIILSEEEYAELQ

SEQ ID NO: 3167446 - protein, 18 aa, Giardia lamblia
QRGTSKFGDPVFSTSIDN

SEQ ID NO: 3167447 - protein, 29 aa, Giardia lamblia
QRIITLKEQLHWRGRLAPDSTNVQYKPDY

SEQ ID NO: 3167448 - protein, 26 aa, Giardia lamblia
QRIKTLEARPLIPEEVERELMALREQ

SEQ ID NO: 3167449 - protein, 20 aa, Giardia lamblia
QRILSYFPDDHVIWEDAYHA

SEQ ID NO: 3167450 - protein, 22 aa, Giardia lamblia
QRIQSWLKSKWMVVKGQILGPL

SEQ ID NO: 3167451 - protein, 26 aa, Giardia lamblia
QRIRHSLHGLSFLLFESISELDRGLA

SEQ ID NO: 3167452 - protein, 23 aa, Giardia lamblia
QRIRSLIRRHMCPDEMEGSVLAR

SEQ ID NO: 3167453 - protein, 23 aa, Giardia lamblia
QRISNIELKYAINVASENRFLEI

SEQ ID NO: 3167454 - protein, 21 aa, Giardia lamblia
QRKAEEFNALSLNYNKQAKDL

SEQ ID NO: 3167455 - protein, 25 aa, Giardia lamblia
QRKAMKKSKSRLVVERAKARLAMGD

SEQ ID NO: 3167456 - protein, 23 aa, Giardia lamblia
QRKGRSLNEVCEGIQTISPGPGH

SEQ ID NO: 3167457 - protein, 23 aa, Giardia lamblia
QRKGYHWTPSRLIWKLGKRINDE

SEQ ID NO: 3167458 - protein, 21 aa, Giardia lamblia
QRKIPIPIATILSVMKQLAAA

SEQ ID NO: 3167459 - protein, 25 aa, Giardia lamblia
QRKVDLFDWRGRRQPYSKLLTTQTK

SEQ ID NO: 3167460 - protein, 23 aa, Giardia lamblia
QRLAYLLCTSRLQKLTEVLPLHA

SEQ ID NO: 3167461 - protein, 26 aa, Giardia lamblia
QRLDELQRLNGILLFDNKALQVKLCE

SEQ ID NO: 3167462 - protein, 20 aa, Giardia lamblia
QRLDVQAVLRACILDSSHQI

SEQ ID NO: 3167463 - protein, 19 aa, Giardia lamblia
QRLEDCVAKIHALERENTM

SEQ ID NO: 3167464 - protein, 25 aa, Giardia lamblia
QRLFDCKLRGVCLTSAAIAIGRQIP

SEQ ID NO: 3167465 - protein, 21 aa, Giardia lamblia
QRLFSCPRVDVPDHVSPNRNY

SEQ ID NO: 3167466 - protein, 17 aa, Giardia lamblia
QRLKQLVLEKDSEIVEL

SEQ ID NO: 3167467 - protein, 18 aa, Giardia lamblia
QRLMPHRTITAAAAGPIN

SEQ ID NO: 3167468 - protein, 23 aa, Giardia lamblia
QRLQNLLKEQSCRSWENKFSNLD

SEQ ID NO: 3167469 - protein, 21 aa, Giardia lamblia
QRLQQFGKFPLPVVSKIIRDV

SEQ ID NO: 3167470 - protein, 19 aa, Giardia lamblia
QRLSDAATRTKRRVLNGMR

SEQ ID NO: 3167471 - protein, 23 aa, Giardia lamblia
QRLSDALLRLPGLQYLDISSNKL

SEQ ID NO: 3167472 - protein, 18 aa, Giardia lamblia
QRLSDFTDRLLGLIEDSI

SEQ ID NO: 3167473 - protein, 26 aa, Giardia lamblia
QRMERLRILLEGELGLTNFVKAYQYI

SEQ ID NO: 3167474 - protein, 18 aa, Giardia lamblia
QRMKCYQDVPGTYRYIPQ

SEQ ID NO: 3167475 - protein, 23 aa, Giardia lamblia
QRMKRFTYINVEGKDMALVQQLI

SEQ ID NO: 3167476 - protein, 18 aa, Giardia lamblia
QRMLESMVLLEALTATRV

SEQ ID NO: 3167477 - protein, 36 aa, Giardia lamblia
QRNLPSYKQLILQAIRFRLLTACPELRNCTFDTDDN

SEQ ID NO: 3167478 - protein, 23 aa, Giardia lamblia
QRNLRISRIRMVRFSENDVNAFY

SEQ ID NO: 3167479 - protein, 18 aa, Giardia lamblia
QRPECVLLPNSALEKDLL

SEQ ID NO: 3167480 - protein, 19 aa, Giardia lamblia
QRPEKRIIAVYASVNGLSL

SEQ ID NO: 3167481 - protein, 30 aa, Giardia lamblia
QRPISLELLIPCFVRLLIAYKSHSLLYNPY

SEQ ID NO: 3167482 - protein, 24 aa, Giardia lamblia
QRPKAVGCFLSRPGPATILDTKFN

SEQ ID NO: 3167483 - protein, 26 aa, Giardia lamblia
QRPRRACVLCGLPGTNLAYYCERCVM

SEQ ID NO: 3167484 - protein, 24 aa, Giardia lamblia
QRQCYGEIVTLRLGNGEIRTGKVL

SEQ ID NO: 3167485 - protein, 27 aa, Giardia lamblia
QRQERELSAKMLLFKEIEKKHTVLKQE

SEQ ID NO: 3167486 - protein, 18 aa, Giardia lamblia
QRQRAIVLLTAMDDRRKL

SEQ ID NO: 3167487 - protein, 32 aa, Giardia lamblia
QRRIYFSIDRMRFVLNKAARVVATYLRKTTDV

SEQ ID NO: 3167488 - protein, 29 aa, Giardia lamblia
QRRLKINRRFTFPFAVDLYRYCSAGLQTS

SEQ ID NO: 3167489 - protein, 17 aa, Giardia lamblia
QRRLLLKAPAFTSPVYR

SEQ ID NO: 3167490 - protein, 19 aa, Giardia lamblia
QRRSACIVRGTTICIDGQT

SEQ ID NO: 3167491 - protein, 23 aa, Giardia lamblia
QRRVTSVIPIACFQRLVRDITCS

SEQ ID NO: 3167492 - protein, 20 aa, Giardia lamblia
QRSACKTGPVYGNKDEIGLD

SEQ ID NO: 3167493 - protein, 21 aa, Giardia lamblia
QRSHIKLVSYPHKVNSEYHDE

SEQ ID NO: 3167494 - protein, 18 aa, Giardia lamblia
QRTILHYICHGLDSQSTV

SEQ ID NO: 3167495 - protein, 18 aa, Giardia lamblia
QRTLACFFLVIRGTVNKG

SEQ ID NO: 3167496 - protein, 18 aa, Giardia lamblia
QRTLTSLCFVLATEQASN

SEQ ID NO: 3167497 - protein, 21 aa, Giardia lamblia
QRTVFRFKPYLVGCKAIVLPL

SEQ ID NO: 3167498 - protein, 17 aa, Giardia lamblia
QRTVLFLPINERAHKTL

SEQ ID NO: 3167499 - protein, 23 aa, Giardia lamblia
QRVACAKILVTVPGELGCSMPDG

SEQ ID NO: 3167500 - protein, 20 aa, Giardia lamblia
QRVAFMGAITLCPPVPAHAS

SEQ ID NO: 3167501 - protein, 20 aa, Giardia lamblia
QRVAILWPEIAYDLITQAST

SEQ ID NO: 3167502 - protein, 23 aa, Giardia lamblia
QRVEDILNRSGAESLTLDPPSLS

SEQ ID NO: 3167503 - protein, 18 aa, Giardia lamblia
QRVLMSMNVIIATPGRLL

SEQ ID NO: 3167504 - protein, 17 aa, Giardia lamblia
QRVRLMWPDDPNLQSTC

SEQ ID NO: 3167505 - protein, 24 aa, Giardia lamblia
QRVSGETALMLAIRHQNVDAIEDL

SEQ ID NO: 3167506 - protein, 31 aa, Giardia lamblia
QRYDFTGREIIAWLRILRPGSILGQQQQFLI

SEQ ID NO: 3167507 - protein, 19 aa, Giardia lamblia
QRYTGITAFDPDQINTSSI

SEQ ID NO: 3167508 - protein, 19 aa, Giardia lamblia
QRYTVRLSIFVSYSSLSSL

SEQ ID NO: 3167509 - protein, 18 aa, Giardia lamblia
QSAERTLLMEKLRLKEEE

SEQ ID NO: 3167510 - protein, 19 aa, Giardia lamblia
QSAFRSCAERDIYTGDSVV

SEQ ID NO: 3167511 - protein, 18 aa, Giardia lamblia
QSAINCGRNYYYQQRLHE

SEQ ID NO: 3167512 - protein, 19 aa, Giardia lamblia
QSAIRKMRLISTISTKTLI

SEQ ID NO: 3167513 - protein, 21 aa, Giardia lamblia
QSALDGFRVCIFAYGQTASGK

SEQ ID NO: 3167514 - protein, 17 aa, Giardia lamblia
QSARDALQRELSLADKR

SEQ ID NO: 3167515 - protein, 24 aa, Giardia lamblia
QSAWTRLPALTTHLQSIINRALEQ

SEQ ID NO: 3167516 - protein, 26 aa, Giardia lamblia
QSAYWCFRIDMELYSGCISAAHGVLA

SEQ ID NO: 3167517 - protein, 17 aa, Giardia lamblia
QSCIFLWTYESGESVVL

SEQ ID NO: 3167518 - protein, 17 aa, Giardia lamblia
QSCYSHAPGEFFNESDP

SEQ ID NO: 3167519 - protein, 28 aa, Giardia lamblia
QSDTLRCFKKNLPVCRLVARSCFNAYSD

SEQ ID NO: 3167520 - protein, 18 aa, Giardia lamblia
QSEHLYILCFSWDKTMLC

SEQ ID NO: 3167521 - protein, 30 aa, Giardia lamblia
QSELTCATMRSCFILTLNVSLEYEKAEANT

SEQ ID NO: 3167522 - protein, 20 aa, Giardia lamblia
QSFWPKRAGNKMARTKHTAR

SEQ ID NO: 3167523 - protein, 25 aa, Giardia lamblia
QSGACKALALLLAYTSIRHTKAGLT

SEQ ID NO: 3167524 - protein, 17 aa, Giardia lamblia
QSGIIQSMFMLFLSNAP

SEQ ID NO: 3167525 - protein, 20 aa, Giardia lamblia
QSGLREVRKAISELPSELIA

SEQ ID NO: 3167526 - protein, 25 aa, Giardia lamblia
QSGSLRAAKELVIIEAGFQDLDGRT

SEQ ID NO: 3167527 - protein, 20 aa, Giardia lamblia
QSGWSSLIFYSGPDSLIAEL

SEQ ID NO: 3167528 - protein, 24 aa, Giardia lamblia
QSHPGIDIRPFIEIIDVNKVAEKA

SEQ ID NO: 3167529 - protein, 23 aa, Giardia lamblia
QSHRFLYDEFVPLQALSESLSEV

SEQ ID NO: 3167530 - protein, 19 aa, Giardia lamblia
QSHVLSTILDRANVDIRYN

SEQ ID NO: 3167531 - protein, 18 aa, Giardia lamblia
QSIAKRLSLDKEETTSHN

SEQ ID NO: 3167532 - protein, 19 aa, Giardia lamblia
QSICGCKYGSHVAECLIKT

SEQ ID NO: 3167533 - protein, 26 aa, Giardia lamblia
QSIMKRFSCTPLMIAVAQNDVKQVSI

SEQ ID NO: 3167534 - protein, 20 aa, Giardia lamblia
QSIPPAWLQVEVDIIKKDTA

SEQ ID NO: 3167535 - protein, 17 aa, Giardia lamblia
QSISCLINSQLQRSDLE

SEQ ID NO: 3167536 - protein, 23 aa, Giardia lamblia
QSKFCSECGSKFASDTAKFCMEC

SEQ ID NO: 3167537 - protein, 24 aa, Giardia lamblia
QSKISLPIPCMLYHEIANLENPRG

SEQ ID NO: 3167538 - protein, 27 aa, Giardia lamblia
QSKLSSCSSCLLPILPYKLKNEKASVL

SEQ ID NO: 3167539 - protein, 20 aa, Giardia lamblia
QSKPGPRHWLNKREANPQLL

SEQ ID NO: 3167540 - protein, 20 aa, Giardia lamblia
QSLAALKAELLGARAIITER

SEQ ID NO: 3167541 - protein, 27 aa, Giardia lamblia
QSLDVAKLLVCLERGMQDYTGKTALIH

SEQ ID NO: 3167542 - protein, 22 aa, Giardia lamblia
QSLELYPVCLCDRNAAITTGSP

SEQ ID NO: 3167543 - protein, 35 aa, Giardia lamblia
QSLLIKASEPFFDYLKHWIIEGSLLSTEYFIQPTT

SEQ ID NO: 3167544 - protein, 20 aa, Giardia lamblia
QSLLLKPSWLQDISIAALNV

SEQ ID NO: 3167545 - protein, 25 aa, Giardia lamblia
QSLLRKGLLGRAWQALLSETSSAAR

SEQ ID NO: 3167546 - protein, 23 aa, Giardia lamblia
QSLQARTGYNFKTVRRTDSSDAN

SEQ ID NO: 3167547 - protein, 22 aa, Giardia lamblia
QSLRASKKYQGMRLSGDAQDAR

SEQ ID NO: 3167548 - protein, 26 aa, Giardia lamblia
QSLRSKPCIYLDMARYNPSVKKASKS

SEQ ID NO: 3167549 - protein, 17 aa, Giardia lamblia
QSLSLPAGIPITMDTTN

SEQ ID NO: 3167550 - protein, 33 aa, Giardia lamblia
QSLSRSPISFRFRYGHKDLQVILPSVSSRDAGR

SEQ ID NO: 3167551 - protein, 31 aa, Giardia lamblia
QSLYLRDWAIPRLLIFHEFQDHLVLSTALMQ

SEQ ID NO: 3167552 - protein, 18 aa, Giardia lamblia
QSMKHGACPQKCTNREII

SEQ ID NO: 3167553 - protein, 24 aa, Giardia lamblia
QSMRAVEILWKYESFLSKATELMR

SEQ ID NO: 3167554 - protein, 20 aa, Giardia lamblia
QSMTGYRGSIQAGRRVEKGR

SEQ ID NO: 3167555 - protein, 23 aa, Giardia lamblia
QSMYLECIRECGIAVSINEADTK

SEQ ID NO: 3167556 - protein, 18 aa, Giardia lamblia
QSNAFPLVLNKFSIETIP

SEQ ID NO: 3167557 - protein, 23 aa, Giardia lamblia
QSNLALQGLRCFSVENHENSEDT

SEQ ID NO: 3167558 - protein, 23 aa, Giardia lamblia
QSNLPFSLPSSMHITRLKNEINE

SEQ ID NO: 3167559 - protein, 18 aa, Giardia lamblia
QSPQWCLEQSKTVRVPLA

SEQ ID NO: 3167560 - protein, 17 aa, Giardia lamblia
QSPSVSVTNRFQANLLI

SEQ ID NO: 3167561 - protein, 22 aa, Giardia lamblia
QSQLKLRFDDTVHHDCFINICD

SEQ ID NO: 3167562 - protein, 18 aa, Giardia lamblia
QSRKHKRHHSSRSSSRKN

SEQ ID NO: 3167563 - protein, 26 aa, Giardia lamblia
QSRLEMLKLFASFCLEYYGSDAPGVE

SEQ ID NO: 3167564 - protein, 18 aa, Giardia lamblia
QSRPFLGSVDSIRSFATN

SEQ ID NO: 3167565 - protein, 17 aa, Giardia lamblia
QSSEPRSNIAIITHCPA

SEQ ID NO: 3167566 - protein, 17 aa, Giardia lamblia
QSSILCTESKKVEELLK

SEQ ID NO: 3167567 - protein, 26 aa, Giardia lamblia
QSSIPGWPGSSLIFFSECSGAANYSR

SEQ ID NO: 3167568 - protein, 26 aa, Giardia lamblia
QSSLEFMCFNSAGSLQQLWQKAYKEL

SEQ ID NO: 3167569 - protein, 24 aa, Giardia lamblia
QSSLEILKAAYIRYRADALKNSSA

SEQ ID NO: 3167570 - protein, 21 aa, Giardia lamblia
QSSQTPFYWTREQAELFDRVH

SEQ ID NO: 3167571 - protein, 19 aa, Giardia lamblia
QSSSVLVVFIGGVTYAELA

SEQ ID NO: 3167572 - protein, 17 aa, Giardia lamblia
QSTDGWTALMAAADSGN

SEQ ID NO: 3167573 - protein, 27 aa, Giardia lamblia
QSTKKEYVFRFSLACLSVNEYISLHSV

SEQ ID NO: 3167574 - protein, 17 aa, Giardia lamblia
QSTLLEFAGSVLPAPSH

SEQ ID NO: 3167575 - protein, 24 aa, Giardia lamblia
QSTSVFPPSCLSVFSLKNPFYPER

SEQ ID NO: 3167576 - protein, 17 aa, Giardia lamblia
QSTVMLANILIQSPISL

SEQ ID NO: 3167577 - protein, 18 aa, Giardia lamblia
QSVAVAILASVLKIVKEE

SEQ ID NO: 3167578 - protein, 28 aa, Giardia lamblia
QSVDLFTFRIHEILEYIHFRTTHIPHEL

SEQ ID NO: 3167579 - protein, 17 aa, Giardia lamblia
QSVHCKRPTAVSHANQP

SEQ ID NO: 3167580 - protein, 38 aa, Giardia lamblia
QSVKAALVKYLYIFPRKTKNCWLNLNVDLYAKICPSSQ

SEQ ID NO: 3167581 - protein, 19 aa, Giardia lamblia
QSVLPKMFDTISIQEILNG

SEQ ID NO: 3167582 - protein, 23 aa, Giardia lamblia
QSVPSLLLKDSIRAVPLAVSSSK

SEQ ID NO: 3167583 - protein, 31 aa, Giardia lamblia
QSVSHCPRCGRVLKPRIVFFGEQLPSEFQLA

SEQ ID NO: 3167584 - protein, 26 aa, Giardia lamblia
QSVSKFLMREGENFTLGKDIFLKGDL

SEQ ID NO: 3167585 - protein, 17 aa, Giardia lamblia
QSVVLPKYVPRSRITKI

SEQ ID NO: 3167586 - protein, 23 aa, Giardia lamblia
QSWSPREVEILNELQLLSCKPVV

SEQ ID NO: 3167587 - protein, 22 aa, Giardia lamblia
QSYLTLRGCSLIAAAITQGKTL

SEQ ID NO: 3167588 - protein, 17 aa, Giardia lamblia
QSYRFFMEEHLFSKVNI

SEQ ID NO: 3167589 - protein, 18 aa, Giardia lamblia
QSYRFFMEEHLFSKVNIK

SEQ ID NO: 3167590 - protein, 18 aa, Giardia lamblia
QSYYCIFDKNLPQLVQFL

SEQ ID NO: 3167591 - protein, 17 aa, Giardia lamblia
QTAECYASLLIAYNQLL

SEQ ID NO: 3167592 - protein, 35 aa, Giardia lamblia
QTAFVAGCIRSFFSEMKICLAAGLPGELNELTLGS

SEQ ID NO: 3167593 - protein, 23 aa, Giardia lamblia
QTAGYGRTGPWQSAAGNLAATWS

SEQ ID NO: 3167594 - protein, 19 aa, Giardia lamblia
QTAHALGPILGRGTFAVDC

SEQ ID NO: 3167595 - protein, 35 aa, Giardia lamblia
QTAIECRSRLVLDCRGEGSYARLLPHDIAQYTIVA

SEQ ID NO: 3167596 - protein, 18 aa, Giardia lamblia
QTALMLAAHFNYAEGCKM

SEQ ID NO: 3167597 - protein, 18 aa, Giardia lamblia
QTALMYAAALGLEDIGLL

SEQ ID NO: 3167598 - protein, 23 aa, Giardia lamblia
QTAPHSIDSCSIVDGARDITAED

SEQ ID NO: 3167599 - protein, 22 aa, Giardia lamblia
QTAPKILNLVLMPQTPELIIEE

SEQ ID NO: 3167600 - protein, 18 aa, Giardia lamblia
QTARTGRVGIYTTIPIYK

SEQ ID NO: 3167601 - protein, 21 aa, Giardia lamblia
QTCIRMLPRPELKKYQQHCSE

SEQ ID NO: 3167602 - protein, 24 aa, Giardia lamblia
QTDARGRTALMYAAEKGHLESVKL

SEQ ID NO: 3167603 - protein, 25 aa, Giardia lamblia
QTDLKGRSALTYAAANGYIDSVKLL

SEQ ID NO: 3167604 - protein, 18 aa, Giardia lamblia
QTDLKVIFPEASVDQFPG

SEQ ID NO: 3167605 - protein, 18 aa, Giardia lamblia
QTEEGWSALMYAAESNQV

SEQ ID NO: 3167606 - protein, 22 aa, Giardia lamblia
QTESLLKYDLFINSMPVSGLFE

SEQ ID NO: 3167607 - protein, 20 aa, Giardia lamblia
QTEYSSLVALDYNDPLYAVN

SEQ ID NO: 3167608 - protein, 23 aa, Giardia lamblia
QTFAGFVLYRLYSVLLNGYQYPP

SEQ ID NO: 3167609 - protein, 18 aa, Giardia lamblia
QTFPRSATMRHLILEKRE

SEQ ID NO: 3167610 - protein, 22 aa, Giardia lamblia
QTGDCFDLSILLASLLIGAGYN

SEQ ID NO: 3167611 - protein, 33 aa, Giardia lamblia
QTGELHVPITCYPRQIAILILKNLELVRKVYEI

SEQ ID NO: 3167612 - protein, 24 aa, Giardia lamblia
QTGVGLCSLSYGRLILGALPCLGY

SEQ ID NO: 3167613 - protein, 38 aa, Giardia lamblia
QTGVPVPEDLVWRILVHANEGLFYYHSVFKSNAPDVRR

SEQ ID NO: 3167614 - protein, 31 aa, Giardia lamblia
QTGYTMAGLERLRVMAPDVARVAELGIVSAQ

SEQ ID NO: 3167615 - protein, 27 aa, Giardia lamblia
QTHSIELPTCMSVPIVLNGYMRGKTLH

SEQ ID NO: 3167616 - protein, 25 aa, Giardia lamblia
QTIGPCDVWLLGIGHNGHIAFNEPG

SEQ ID NO: 3167617 - protein, 23 aa, Giardia lamblia
QTILKPKILLLAQQRVSRIVLHK

SEQ ID NO: 3167618 - protein, 23 aa, Giardia lamblia
QTILKRLDRTIAENYINPEPQEF

SEQ ID NO: 3167619 - protein, 28 aa, Giardia lamblia
QTIMAGACMICECLTKLRCHAMIHCSDG

SEQ ID NO: 3167620 - protein, 19 aa, Giardia lamblia
QTISPFLPSVHAFEAESIV

SEQ ID NO: 3167621 - protein, 26 aa, Giardia lamblia
QTIYEFPSDLLLGLGKIMTMSMCPDF

SEQ ID NO: 3167622 - protein, 23 aa, Giardia lamblia
QTKDKRVVLVTARVHSGEVPSSF

SEQ ID NO: 3167623 - protein, 25 aa, Giardia lamblia
QTKGGNRPALLVSREIESLRSDLAD

SEQ ID NO: 3167624 - protein, 23 aa, Giardia lamblia
QTKPFRLGTDFKPEPGVINHRIG

SEQ ID NO: 3167625 - protein, 23 aa, Giardia lamblia
QTKSRCSHSFMLQRQAFQAMCAI

SEQ ID NO: 3167626 - protein, 19 aa, Giardia lamblia
QTKSVPCTIQLKTEDEFTV

SEQ ID NO: 3167627 - protein, 19 aa, Giardia lamblia
QTLHLKDILLRGSEKKREI

SEQ ID NO: 3167628 - protein, 17 aa, Giardia lamblia
QTLLFRLAEQGNPNSVD

SEQ ID NO: 3167629 - protein, 20 aa, Giardia lamblia
QTLNHDWRGQITKGRPISAD

SEQ ID NO: 3167630 - protein, 25 aa, Giardia lamblia
QTLSLRLSWQIERAIPKQLFKETEA

SEQ ID NO: 3167631 - protein, 17 aa, Giardia lamblia
QTLYSLRAFPPKKVRRA

SEQ ID NO: 3167632 - protein, 25 aa, Giardia lamblia
QTNQMLKDKIEIMSEEAKLASVQAY

SEQ ID NO: 3167633 - protein, 17 aa, Giardia lamblia
QTPEFKSKGGIDVKAYV

SEQ ID NO: 3167634 - protein, 21 aa, Giardia lamblia
QTPELSKLCQRMLSLDPTERI

SEQ ID NO: 3167635 - protein, 23 aa, Giardia lamblia
QTPIKQRRIFGLYHLAADPEASP

SEQ ID NO: 3167636 - protein, 23 aa, Giardia lamblia
QTPLELARALGLTKVVDEITRFH

SEQ ID NO: 3167637 - protein, 19 aa, Giardia lamblia
QTPLRYLMDMGYRPIFQVI

SEQ ID NO: 3167638 - protein, 18 aa, Giardia lamblia
QTPPRPVPKVISAVQSSP

SEQ ID NO: 3167639 - protein, 25 aa, Giardia lamblia
QTQIPHRASTSGAQPGQFVARNMTR

SEQ ID NO: 3167640 - protein, 27 aa, Giardia lamblia
QTRDPNCVQPYFRSCFENINRVKFAPE

SEQ ID NO: 3167641 - protein, 25 aa, Giardia lamblia
QTSLLGVYFVGIWNIAINSWDVDGI

SEQ ID NO: 3167642 - protein, 28 aa, Giardia lamblia
QTSMFGDLWVLDLTTLRWNRGPEGPSPR

SEQ ID NO: 3167643 - protein, 25 aa, Giardia lamblia
QTSPCAVLGALAPRGTTSKAVDDAH

SEQ ID NO: 3167644 - protein, 20 aa, Giardia lamblia
QTVFEFCIIGLKALDYQEAR

SEQ ID NO: 3167645 - protein, 18 aa, Giardia lamblia
QTYPVVVYTKRGWTPVSE

SEQ ID NO: 3167646 - protein, 24 aa, Giardia lamblia
QVAVYPHKVLGLSIISNTEISNIS

SEQ ID NO: 3167647 - protein, 22 aa, Giardia lamblia
QVDAALCLLPSEAGMQSNDGKT

SEQ ID NO: 3167648 - protein, 35 aa, Giardia lamblia
QVDTACIICMSWAVECIFIPCGHACCCRYCLEFSS

SEQ ID NO: 3167649 - protein, 24 aa, Giardia lamblia
QVDYLDLFLVHWPLAFVRNDVGDL

SEQ ID NO: 3167650 - protein, 26 aa, Giardia lamblia
QVEDIRARQAVLIARARELERRIALE

SEQ ID NO: 3167651 - protein, 18 aa, Giardia lamblia
QVEKACLILNTPSPPEQS

SEQ ID NO: 3167652 - protein, 17 aa, Giardia lamblia
QVEVDIIKKDTASLLTY

SEQ ID NO: 3167653 - protein, 20 aa, Giardia lamblia
QVEYPGVFTLFSVPNYAEKN

SEQ ID NO: 3167654 - protein, 19 aa, Giardia lamblia
QVFKELRIKADSEREGSFK

SEQ ID NO: 3167655 - protein, 24 aa, Giardia lamblia
QVGDPRLISIIRPRTTNLRSVIDP

SEQ ID NO: 3167656 - protein, 17 aa, Giardia lamblia
QVIPFLLEEGHLVDETN

SEQ ID NO: 3167657 - protein, 24 aa, Giardia lamblia
QVISAMISPICYRVGESTQPANEA

SEQ ID NO: 3167658 - protein, 18 aa, Giardia lamblia
QVKRRLKKDVGMQDLVGK

SEQ ID NO: 3167659 - protein, 22 aa, Giardia lamblia
QVKSNHLLEVDRLLKEVNSAQQ

SEQ ID NO: 3167660 - protein, 19 aa, Giardia lamblia
QVKTSIAIFGGRRDEDGMT

SEQ ID NO: 3167661 - protein, 25 aa, Giardia lamblia
QVLAYRKILTLAIEKLLFFKHLITM

SEQ ID NO: 3167662 - protein, 20 aa, Giardia lamblia
QVLEFLDFAPKISLYLFDAK

SEQ ID NO: 3167663 - protein, 23 aa, Giardia lamblia
QVLPNCVNYYMVIALKDSTTIQG

SEQ ID NO: 3167664 - protein, 27 aa, Giardia lamblia
QVLQACMKDEVKMCKISRKAFTKETGL

SEQ ID NO: 3167665 - protein, 24 aa, Giardia lamblia
QVLQEMRTTYGLPSCKLNVRVSNA

SEQ ID NO: 3167666 - protein, 25 aa, Giardia lamblia
QVNEAQFLVCGGVTVTPATNQPGTV

SEQ ID NO: 3167667 - protein, 26 aa, Giardia lamblia
QVPKVKFPVCRNLVFNKIDRKMSIAR

SEQ ID NO: 3167668 - protein, 25 aa, Giardia lamblia
QVPQPRPAGFVSPASTSLRPEVELF

SEQ ID NO: 3167669 - protein, 25 aa, Giardia lamblia
QVQKRLMALQVRFEEDVFVSIPAKI

SEQ ID NO: 3167670 - protein, 31 aa, Giardia lamblia
QVRCIPVRMDPSLLPAISFDLDLPLHKRRSD

SEQ ID NO: 3167671 - protein, 17 aa, Giardia lamblia
QVRVKSFGVRKGSYAIT

SEQ ID NO: 3167672 - protein, 25 aa, Giardia lamblia
QVSSTRKSSGWRDGPLAKALFSSPN

SEQ ID NO: 3167673 - protein, 19 aa, Giardia lamblia
QVTTLEWFDIEGPVYAILT

SEQ ID NO: 3167674 - protein, 24 aa, Giardia lamblia
QVVSLKLSKNVLEVICYQDAVIKW

SEQ ID NO: 3167675 - protein, 19 aa, Giardia lamblia
QVVSLRWAMLTDQVINISE

SEQ ID NO: 3167676 - protein, 18 aa, Giardia lamblia
QVYQCTRFLCDHGIKMSS

SEQ ID NO: 3167677 - protein, 32 aa, Giardia lamblia
QWFFNNKCCTCWSCPNYFYKCKNLAAVMEVDT

SEQ ID NO: 3167678 - protein, 17 aa, Giardia lamblia
QWFSIGDLKRFSLQVKN

SEQ ID NO: 3167679 - protein, 18 aa, Giardia lamblia
QWIIEVVSMYLQYSQVDI

SEQ ID NO: 3167680 - protein, 25 aa, Giardia lamblia
QWIKITQLRGSSFVIDGHCFLHAAA

SEQ ID NO: 3167681 - protein, 22 aa, Giardia lamblia
QWKCRRSFLELIDHCLRDKDLL

SEQ ID NO: 3167682 - protein, 22 aa, Giardia lamblia
QWLLERARDVFQRRSSSDDSSD

SEQ ID NO: 3167683 - protein, 23 aa, Giardia lamblia
QYAETLLAMLHICKTSLETTKVA

SEQ ID NO: 3167684 - protein, 18 aa, Giardia lamblia
QYAKSIAKDAYRYDRTFY

SEQ ID NO: 3167685 - protein, 24 aa, Giardia lamblia
QYECAKILCRYERGMKTTVGTTAL

SEQ ID NO: 3167686 - protein, 19 aa, Giardia lamblia
QYELNILQMRLKEVEESSF

SEQ ID NO: 3167687 - protein, 29 aa, Giardia lamblia
QYESVAIPRGVRFFLSISPAAECYFLCCV

SEQ ID NO: 3167688 - protein, 19 aa, Giardia lamblia
QYFMFAGRDRYKMFTLQQA

SEQ ID NO: 3167689 - protein, 19 aa, Giardia lamblia
QYGSLYAYRRGLMSVSVMN

SEQ ID NO: 3167690 - protein, 36 aa, Giardia lamblia
QYHGCPCPWLIISLMRFLRRLAPRLEEAQDKDHGLI

SEQ ID NO: 3167691 - protein, 18 aa, Giardia lamblia
QYIECFYDELPIKIEATS

SEQ ID NO: 3167692 - protein, 27 aa, Giardia lamblia
QYIVLRNDLPWGLGALAAQVAHASVAA

SEQ ID NO: 3167693 - protein, 18 aa, Giardia lamblia
QYKDLLLRPKCLNCNSLA

SEQ ID NO: 3167694 - protein, 26 aa, Giardia lamblia
QYKKEVCDLTARLREVEMQYTTMEQT

SEQ ID NO: 3167695 - protein, 18 aa, Giardia lamblia
QYLCAGLVATVYCPSNIP

SEQ ID NO: 3167696 - protein, 24 aa, Giardia lamblia
QYLNQCCVFLNKFIDLHEEISNHS

SEQ ID NO: 3167697 - protein, 17 aa, Giardia lamblia
QYLNVALNRQLTLLRSY

SEQ ID NO: 3167698 - protein, 23 aa, Giardia lamblia
QYLTILASPWHTVRTPVKAKLRP

SEQ ID NO: 3167699 - protein, 21 aa, Giardia lamblia
QYMAQLFVPRSPPKMCSQDGL

SEQ ID NO: 3167700 - protein, 20 aa, Giardia lamblia
QYMKCYREHGADLVIAPYIE

SEQ ID NO: 3167701 - protein, 17 aa, Giardia lamblia
QYMPDGWVDVTDTKHTE

SEQ ID NO: 3167702 - protein, 23 aa, Giardia lamblia
QYNHKTGRCRYVGEWREGLRHGP

SEQ ID NO: 3167703 - protein, 26 aa, Giardia lamblia
QYPIKCSLCGLFLGMATDAIDQGPTY

SEQ ID NO: 3167704 - protein, 24 aa, Giardia lamblia
QYQARIGDRLRLLDELPSKLKELE

SEQ ID NO: 3167705 - protein, 18 aa, Giardia lamblia
QYQSYAIAKLEEHIQRVC

SEQ ID NO: 3167706 - protein, 20 aa, Giardia lamblia
QYRCPKMISFFMMPDPELSL

SEQ ID NO: 3167707 - protein, 26 aa, Giardia lamblia
QYRHIISGVLSSYVYIGFTDPLVSKT

SEQ ID NO: 3167708 - protein, 22 aa, Giardia lamblia
QYRRLKQANALRVNTEKMSIAQ

SEQ ID NO: 3167709 - protein, 29 aa, Giardia lamblia
QYSKPYVPFDWKELYGLNLENALARNDFR

SEQ ID NO: 3167710 - protein, 26 aa, Giardia lamblia
QYSRILFKSICEMLGDEQLKFLDIDL

SEQ ID NO: 3167711 - protein, 23 aa, Giardia lamblia
QYSRSVLDDSLLDYPFDTSNKLV

SEQ ID NO: 3167712 - protein, 19 aa, Giardia lamblia
QYSVPKTCKVCMEDPSGDV

SEQ ID NO: 3167713 - protein, 20 aa, Giardia lamblia
QYTIAQGFQYFKTMPYSNDG

SEQ ID NO: 3167714 - protein, 21 aa, Giardia lamblia
QYVGEMCWFANKLLVDAGTSG

SEQ ID NO: 3167715 - protein, 18 aa, Giardia lamblia
RAAAIGNLKLCKLLMQSE

SEQ ID NO: 3167716 - protein, 26 aa, Giardia lamblia
RAAALRRIAQSKGRFYDSAEFILKQG

SEQ ID NO: 3167717 - protein, 18 aa, Giardia lamblia
RAAAVLADHQQRHKLAQE

SEQ ID NO: 3167718 - protein, 18 aa, Giardia lamblia
RAAEFAMPSPIDKSISVS

SEQ ID NO: 3167719 - protein, 19 aa, Giardia lamblia
RAAEIQGKLNRDLTMSPTK

SEQ ID NO: 3167720 - protein, 17 aa, Giardia lamblia
RAAFGRCRSTSLQNSQF

SEQ ID NO: 3167721 - protein, 18 aa, Giardia lamblia
RAAFSYNCTIFLDTLPSL

SEQ ID NO: 3167722 - protein, 19 aa, Giardia lamblia
RAAGPRQFSHKGVPMVSVP

SEQ ID NO: 3167723 - protein, 22 aa, Giardia lamblia
RAAHKKAPFWVLNKIKKREEEE

SEQ ID NO: 3167724 - protein, 19 aa, Giardia lamblia
RAAHQAHLAFCAKKDIVLS

SEQ ID NO: 3167725 - protein, 20 aa, Giardia lamblia
RAAILCERYGLYSTIEVDGV

SEQ ID NO: 3167726 - protein, 19 aa, Giardia lamblia
RAAIRGCIETAKLVIKYDG

SEQ ID NO: 3167727 - protein, 18 aa, Giardia lamblia
RAALRAGLVNTRKEIQKV

SEQ ID NO: 3167728 - protein, 19 aa, Giardia lamblia
RAASARSKMAASIAESRLE

SEQ ID NO: 3167729 - protein, 17 aa, Giardia lamblia
RAASVAVANRLMSHTNN

SEQ ID NO: 3167730 - protein, 29 aa, Giardia lamblia
RAATSGQAFPQCVFSHYALIPSSPLQTGS

SEQ ID NO: 3167731 - protein, 19 aa, Giardia lamblia
RACAVPFSPDTEGRKGEQF

SEQ ID NO: 3167732 - protein, 24 aa, Giardia lamblia
RACSQVFRAFGWEVYGTILDSDAA

SEQ ID NO: 3167733 - protein, 21 aa, Giardia lamblia
RADALYGCYRTTTPGVYRGWL

SEQ ID NO: 3167734 - protein, 18 aa, Giardia lamblia
RADDSSFSLVVTRKEKLL

SEQ ID NO: 3167735 - protein, 23 aa, Giardia lamblia
RADEIGIPFAVTIDFQTLEDGSV

SEQ ID NO: 3167736 - protein, 21 aa, Giardia lamblia
RADELSTLFPGTRYVSCATET

SEQ ID NO: 3167737 - protein, 26 aa, Giardia lamblia
RADGKRPGGAMLWHLYGVGQSDRITS

SEQ ID NO: 3167738 - protein, 18 aa, Giardia lamblia
RADHASAGRELREIREAH

SEQ ID NO: 3167739 - protein, 26 aa, Giardia lamblia
RADITGMTALMWAARQGHQGAVEILF

SEQ ID NO: 3167740 - protein, 28 aa, Giardia lamblia
RADIWSFGCVVCELLTGRVLFPNYSVAT

SEQ ID NO: 3167741 - protein, 29 aa, Giardia lamblia
RADLSKYKIRGMRMITRVMKIQALEVPQY

SEQ ID NO: 3167742 - protein, 18 aa, Giardia lamblia
RADMEFSAFEILNLFERR

SEQ ID NO: 3167743 - protein, 20 aa, Giardia lamblia
RADMNRRLLLNLGAIDTYDE

SEQ ID NO: 3167744 - protein, 20 aa, Giardia lamblia
RADMSALFPADIHHIGADVD

SEQ ID NO: 3167745 - protein, 19 aa, Giardia lamblia
RADNTYVMAHLEEYFLAVD

SEQ ID NO: 3167746 - protein, 24 aa, Giardia lamblia
RADPTVLDSLRFGTVTLTNLRLAW

SEQ ID NO: 3167747 - protein, 22 aa, Giardia lamblia
RADVFCIPGATGIPSDQLQTQL

SEQ ID NO: 3167748 - protein, 36 aa, Giardia lamblia
RADVLRGMSAVCCEFCPADERLLIVGYAGSGLDENY

SEQ ID NO: 3167749 - protein, 27 aa, Giardia lamblia
RAEEFTRDFCKTFKPPVRSHLEYGPVY

SEQ ID NO: 3167750 - protein, 20 aa, Giardia lamblia
RAEGFLKQWLFMSRTTEGST

SEQ ID NO: 3167751 - protein, 22 aa, Giardia lamblia
RAEHQKREALLYAKYLRSQNSI

SEQ ID NO: 3167752 - protein, 23 aa, Giardia lamblia
RAEHSFLKLVKYDLVVSQQHYSR

SEQ ID NO: 3167753 - protein, 20 aa, Giardia lamblia
RAEKAWDMVNLQMASLSAKC

SEQ ID NO: 3167754 - protein, 19 aa, Giardia lamblia
RAEKIRAMVALKNRVITRT

SEQ ID NO: 3167755 - protein, 19 aa, Giardia lamblia
RAELARQASSTGQSPRELE

SEQ ID NO: 3167756 - protein, 17 aa, Giardia lamblia
RAELGHYKAENDTLKSR

SEQ ID NO: 3167757 - protein, 24 aa, Giardia lamblia
RAELRKSIRMKMTENKMLKEALIN

SEQ ID NO: 3167758 - protein, 17 aa, Giardia lamblia
RAEVETLRAQKSIVTRL

SEQ ID NO: 3167759 - protein, 20 aa, Giardia lamblia
RAFEIPQLEAVLINSTGDAI

SEQ ID NO: 3167760 - protein, 19 aa, Giardia lamblia
RAFERRFAEVFVAEPNVED

SEQ ID NO: 3167761 - protein, 18 aa, Giardia lamblia
RAFGRKAFDLGTSIMCKI

SEQ ID NO: 3167762 - protein, 19 aa, Giardia lamblia
RAFNAWRQRCIIFVETARH

SEQ ID NO: 3167763 - protein, 22 aa, Giardia lamblia
RAFNCTFCDLFVKATNSTAISV

SEQ ID NO: 3167764 - protein, 19 aa, Giardia lamblia
RAFTFSPLRNHNALLGNVS

SEQ ID NO: 3167765 - protein, 23 aa, Giardia lamblia
RAFTRRDLVLLLFNLRNYIMKTR

SEQ ID NO: 3167766 - protein, 19 aa, Giardia lamblia
RAGADHCSPFVAFTDIMHN

SEQ ID NO: 3167767 - protein, 17 aa, Giardia lamblia
RAGETPLHLAVVEDNLE

SEQ ID NO: 3167768 - protein, 18 aa, Giardia lamblia
RAGHSFRDIVPVTSHHSP

SEQ ID NO: 3167769 - protein, 25 aa, Giardia lamblia
RAGNIECVRLLAPLEQRMRRVDGTT

SEQ ID NO: 3167770 - protein, 30 aa, Giardia lamblia
RAGRGTCRYPDGSVYRGEWLNDVREGNGTF

SEQ ID NO: 3167771 - protein, 25 aa, Giardia lamblia
RAGSLPIVMLLARYEQRLVDTGGHC

SEQ ID NO: 3167772 - protein, 23 aa, Giardia lamblia
RAGTEYYPLVGSIHVMLSVLRSW

SEQ ID NO: 3167773 - protein, 20 aa, Giardia lamblia
RAGVEEGFFILRIPQHDVTL

SEQ ID NO: 3167774 - protein, 19 aa, Giardia lamblia
RAGVGRPAMSVAVPQPPES

SEQ ID NO: 3167775 - protein, 24 aa, Giardia lamblia
RAIAEAKLAAAEGMVEQLQKRVHD

SEQ ID NO: 3167776 - protein, 19 aa, Giardia lamblia
RAIAWDLVGGELKYRAGRA

SEQ ID NO: 3167777 - protein, 20 aa, Giardia lamblia
RAIDDVRQLPTYAESSDDED

SEQ ID NO: 3167778 - protein, 21 aa, Giardia lamblia
RAIIAVLRFPSIRECMDEARV

SEQ ID NO: 3167779 - protein, 21 aa, Giardia lamblia
RAIIFSEFKKFDGLTSRLVTA

SEQ ID NO: 3167780 - protein, 17 aa, Giardia lamblia
RAIKIAKDHGFQNIADY

SEQ ID NO: 3167781 - protein, 24 aa, Giardia lamblia
RAILELYRRILLQLYEQVESSAAG

SEQ ID NO: 3167782 - protein, 19 aa, Giardia lamblia
RAILKDALFPSSITNPGIE

SEQ ID NO: 3167783 - protein, 18 aa, Giardia lamblia
RAISECLLAFQAVHVPII

SEQ ID NO: 3167784 - protein, 19 aa, Giardia lamblia
RAITNFDDFGCQVPDKRAR

SEQ ID NO: 3167785 - protein, 17 aa, Giardia lamblia
RAIVKYKELFSYDRQTR

SEQ ID NO: 3167786 - protein, 17 aa, Giardia lamblia
RAKDVPAGGLADADASQ

SEQ ID NO: 3167787 - protein, 17 aa, Giardia lamblia
RAKEHRGKGLSSYSIAT

SEQ ID NO: 3167788 - protein, 24 aa, Giardia lamblia
RAKFLREKVVFILIPMVNPDGCSA

SEQ ID NO: 3167789 - protein, 19 aa, Giardia lamblia
RAKHINRLVSVRAIVSGTS

SEQ ID NO: 3167790 - protein, 25 aa, Giardia lamblia
RAKHRVCILRPMLSVHVSEISRVVL

SEQ ID NO: 3167791 - protein, 19 aa, Giardia lamblia
RAKISDFDTAIILEEEGVR

SEQ ID NO: 3167792 - protein, 23 aa, Giardia lamblia
RAKLKKYIMMDGGLRKIGNEVVN

SEQ ID NO: 3167793 - protein, 25 aa, Giardia lamblia
RAKLPSQRRTGLFSATFDSVTEADL

SEQ ID NO: 3167794 - protein, 22 aa, Giardia lamblia
RAKRPELVILLVFNKDDGDYDR

SEQ ID NO: 3167795 - protein, 18 aa, Giardia lamblia
RAKSCKGITPSRITLTRD

SEQ ID NO: 3167796 - protein, 18 aa, Giardia lamblia
RAKSDSKLLPSIVREPFP

SEQ ID NO: 3167797 - protein, 17 aa, Giardia lamblia
RAKSHPPDSPYNQCVSM

SEQ ID NO: 3167798 - protein, 19 aa, Giardia lamblia
RAKSVGGRTRKGFHAIDIK

SEQ ID NO: 3167799 - protein, 20 aa, Giardia lamblia
RAKSYPVVMKTLYFGSKQQQ

SEQ ID NO: 3167800 - protein, 26 aa, Giardia lamblia
RAKVYRFADDEWKERGQGEVLIAEDP

SEQ ID NO: 3167801 - protein, 19 aa, Giardia lamblia
RALALLSLFVGCSLPEFTD

SEQ ID NO: 3167802 - protein, 19 aa, Giardia lamblia
RALCFEIHHTEDYTIWVNY

SEQ ID NO: 3167803 - protein, 26 aa, Giardia lamblia
RALEDIRFGYPTALMRAAMENKVDQA

SEQ ID NO: 3167804 - protein, 22 aa, Giardia lamblia
RALGHVYICLGDYCRAFQILSP

SEQ ID NO: 3167805 - protein, 22 aa, Giardia lamblia
RALIFCDYQIIFSMLEHLLSHN

SEQ ID NO: 3167806 - protein, 28 aa, Giardia lamblia
RALKEFIELKRRIIRLLTQRVAPEADVT

SEQ ID NO: 3167807 - protein, 25 aa, Giardia lamblia
RALLEGGSVPWVRVRSLARDDATGS

SEQ ID NO: 3167808 - protein, 21 aa, Giardia lamblia
RALMPGCTHLSIKGIAYESGM

SEQ ID NO: 3167809 - protein, 26 aa, Giardia lamblia
RALQRYIQFDGCIRFPDKSCKDTSNG

SEQ ID NO: 3167810 - protein, 25 aa, Giardia lamblia
RALRSYFPRRIHHYRIGRVPLAFEA

SEQ ID NO: 3167811 - protein, 24 aa, Giardia lamblia
RALSNVYCCLAALVSLEPAMIRAT

SEQ ID NO: 3167812 - protein, 17 aa, Giardia lamblia
RALSVGRRSGRPLVGAI

SEQ ID NO: 3167813 - protein, 27 aa, Giardia lamblia
RALVTIKAMRLTAGLDCVPVSTEADYL

SEQ ID NO: 3167814 - protein, 18 aa, Giardia lamblia
RAMIPDDLGVLYVYSNLQ

SEQ ID NO: 3167815 - protein, 21 aa, Giardia lamblia
RAMMKHGHIPPNLKNRRHNRK

SEQ ID NO: 3167816 - protein, 17 aa, Giardia lamblia
RAMVLMRNGPFFAPLQN

SEQ ID NO: 3167817 - protein, 18 aa, Giardia lamblia
RANFHIVAICGSKSMASS

SEQ ID NO: 3167818 - protein, 17 aa, Giardia lamblia
RANLGLIGIGGLMASGS

SEQ ID NO: 3167819 - protein, 30 aa, Giardia lamblia
RANMGRTALMFAARNCNLIGVQVLAGTECG

SEQ ID NO: 3167820 - protein, 21 aa, Giardia lamblia
RAPALKAYAFGIVAHISEILA

SEQ ID NO: 3167821 - protein, 17 aa, Giardia lamblia
RAPAPRLKDVISDLSQA

SEQ ID NO: 3167822 - protein, 17 aa, Giardia lamblia
RAPEGGRNMVLAKPDFS

SEQ ID NO: 3167823 - protein, 17 aa, Giardia lamblia
RAPEIDKHMLVVVPSYY

SEQ ID NO: 3167824 - protein, 27 aa, Giardia lamblia
RAPEIWRGCFCDSDFLVTLCQDVMQSG

SEQ ID NO: 3167825 - protein, 17 aa, Giardia lamblia
RAPGLKTTIGIIDDDAL

SEQ ID NO: 3167826 - protein, 26 aa, Giardia lamblia
RAPVEIPLKPVAQWADLPTRNVSKAN

SEQ ID NO: 3167827 - protein, 26 aa, Giardia lamblia
RAPVGGLSRLRFKITLNGDNDQFLPT

SEQ ID NO: 3167828 - protein, 24 aa, Giardia lamblia
RAQILKELCIRRDYTHALLATPAA

SEQ ID NO: 3167829 - protein, 17 aa, Giardia lamblia
RAQKKMLGEAFSSERRA

SEQ ID NO: 3167830 - protein, 20 aa, Giardia lamblia
RAQLHLRDERVLTISTQLAE

SEQ ID NO: 3167831 - protein, 19 aa, Giardia lamblia
RAQLLCELIRGATKGAGTD

SEQ ID NO: 3167832 - protein, 17 aa, Giardia lamblia
RAQQIYKPRAIRPAAGH

SEQ ID NO: 3167833 - protein, 19 aa, Giardia lamblia
RAQSNRIIPRPTYLLSPEH

SEQ ID NO: 3167834 - protein, 24 aa, Giardia lamblia
RARAHSMARLRTKDTYERRRSALD

SEQ ID NO: 3167835 - protein, 22 aa, Giardia lamblia
RARASAPCILFLDEFDSLAKRR

SEQ ID NO: 3167836 - protein, 25 aa, Giardia lamblia
RARDFPPLCTILRTLQLTDIISRRS

SEQ ID NO: 3167837 - protein, 24 aa, Giardia lamblia
RARFGEFFIAGLITSASAEPSQKM

SEQ ID NO: 3167838 - protein, 25 aa, Giardia lamblia
RARHRVCILRPMLSVHVSEISRVVL

SEQ ID NO: 3167839 - protein, 26 aa, Giardia lamblia
RARHRVCILRPMLSVHVSEISRVVLH

SEQ ID NO: 3167840 - protein, 20 aa, Giardia lamblia
RARIARIILKDMLKGKLVWI

SEQ ID NO: 3167841 - protein, 17 aa, Giardia lamblia
RARILFQNIRDCLSNEG

SEQ ID NO: 3167842 - protein, 17 aa, Giardia lamblia
RARKARFKFTAKGQPVM

SEQ ID NO: 3167843 - protein, 26 aa, Giardia lamblia
RARKDIPESTIWIFAYQLLNALEYCH

SEQ ID NO: 3167844 - protein, 26 aa, Giardia lamblia
RARLRAFMCLPPVRSFLSVTPLFSSL

SEQ ID NO: 3167845 - protein, 18 aa, Giardia lamblia
RASFPLNRIDGRKQGYAY

SEQ ID NO: 3167846 - protein, 18 aa, Giardia lamblia
RASFSNEELLLFQERMNT

SEQ ID NO: 3167847 - protein, 18 aa, Giardia lamblia
RASGYFYIGNQSIYNVTA

SEQ ID NO: 3167848 - protein, 17 aa, Giardia lamblia
RASLAYHEAQWLCEMDS

SEQ ID NO: 3167849 - protein, 32 aa, Giardia lamblia
RASSGCLRCTLCDLAFKDSLALVQHLSSEAHR

SEQ ID NO: 3167850 - protein, 18 aa, Giardia lamblia
RASSPFNQLTAGFSEHKS

SEQ ID NO: 3167851 - protein, 23 aa, Giardia lamblia
RASSRSRSAFSHCGGGSTLKTEI

SEQ ID NO: 3167852 - protein, 19 aa, Giardia lamblia
RASTAILQRTDFYMVNRSP

SEQ ID NO: 3167853 - protein, 20 aa, Giardia lamblia
RASTGARVFAAMKGAVDAGL

SEQ ID NO: 3167854 - protein, 23 aa, Giardia lamblia
RATAGRCQGSFCSSKLRKLLAAR

SEQ ID NO: 3167855 - protein, 19 aa, Giardia lamblia
RATDGTHIWRIPQSSAPFL

SEQ ID NO: 3167856 - protein, 18 aa, Giardia lamblia
RATDKRRLRETPNDAELE

SEQ ID NO: 3167857 - protein, 24 aa, Giardia lamblia
RATEESRYFISMELCNCDLHDFIR

SEQ ID NO: 3167858 - protein, 18 aa, Giardia lamblia
RATEVIGLPEAHYALAQT

SEQ ID NO: 3167859 - protein, 18 aa, Giardia lamblia
RATFAFAVEHLMNSLAKV

SEQ ID NO: 3167860 - protein, 24 aa, Giardia lamblia
RATHFRSLINIKIMANLEVNRGIL

SEQ ID NO: 3167861 - protein, 28 aa, Giardia lamblia
RATIAGDIVAVWSWLPRQHKWQDINGRT

SEQ ID NO: 3167862 - protein, 18 aa, Giardia lamblia
RATIEGILSRPGDRQREA

SEQ ID NO: 3167863 - protein, 26 aa, Giardia lamblia
RATIKMVDHFKRYLAPSIVTHGGQEY

SEQ ID NO: 3167864 - protein, 23 aa, Giardia lamblia
RATLDSIRGLACLPTKEEEDRIV

SEQ ID NO: 3167865 - protein, 23 aa, Giardia lamblia
RATRLESDLAIASNRIKILTEEK

SEQ ID NO: 3167866 - protein, 21 aa, Giardia lamblia
RATRRHPVVLIDGYDSLTRKL

SEQ ID NO: 3167867 - protein, 19 aa, Giardia lamblia
RATSRPPLQRTYGEEPQAL

SEQ ID NO: 3167868 - protein, 17 aa, Giardia lamblia
RAVCNFQKHGSLDYFQL

SEQ ID NO: 3167869 - protein, 25 aa, Giardia lamblia
RAVDDCGRTALMYAAANNSIDAVEM

SEQ ID NO: 3167870 - protein, 19 aa, Giardia lamblia
RAVDLCAAPGSWSQVLSHK

SEQ ID NO: 3167871 - protein, 21 aa, Giardia lamblia
RAVIDQCAQFWTRIFAAIDSV

SEQ ID NO: 3167872 - protein, 18 aa, Giardia lamblia
RAVIGTREAIGAPFKTLI

SEQ ID NO: 3167873 - protein, 17 aa, Giardia lamblia
RAVKLLIDKEADLVRND

SEQ ID NO: 3167874 - protein, 19 aa, Giardia lamblia
RAVPEPRKLNDNTFVDTLP

SEQ ID NO: 3167875 - protein, 31 aa, Giardia lamblia
RAYLRCSVITWGDCIKLAYYLPDGSRNKPLW

SEQ ID NO: 3167876 - protein, 22 aa, Giardia lamblia
RAYPKLPTYIIDGGIIGLQREA

SEQ ID NO: 3167877 - protein, 21 aa, Giardia lamblia
RCAELLKAKGVPLPTDARGIP

SEQ ID NO: 3167878 - protein, 32 aa, Giardia lamblia
RCATELKGVYGDAIKLLWEPVTVPLLSMDDYQ

SEQ ID NO: 3167879 - protein, 21 aa, Giardia lamblia
RCCECPNWERHGCHCPPNNNV

SEQ ID NO: 3167880 - protein, 17 aa, Giardia lamblia
RCCIYYREMQIISTDGT

SEQ ID NO: 3167881 - protein, 17 aa, Giardia lamblia
RCDKGTDPDGDFVDADT

SEQ ID NO: 3167882 - protein, 25 aa, Giardia lamblia
RCEDAWCPTCINELNMAKRKLLEEM

SEQ ID NO: 3167883 - protein, 23 aa, Giardia lamblia
RCGDEFRGVPSITVGLGTGLAPC

SEQ ID NO: 3167884 - protein, 17 aa, Giardia lamblia
RCGELISAVFEQWPTLE

SEQ ID NO: 3167885 - protein, 25 aa, Giardia lamblia
RCGVGYKVAYGICVHRGCMPDTVYC

SEQ ID NO: 3167886 - protein, 22 aa, Giardia lamblia
RCHPGETPGSYVLEGILKDISK

SEQ ID NO: 3167887 - protein, 25 aa, Giardia lamblia
RCIAEGKFSALLMSRFNQKLRAKGL

SEQ ID NO: 3167888 - protein, 24 aa, Giardia lamblia
RCIKLSDYGFLRFPADVYSHDLSY

SEQ ID NO: 3167889 - protein, 17 aa, Giardia lamblia
RCISEATVPESSLSSVS

SEQ ID NO: 3167890 - protein, 17 aa, Giardia lamblia
RCITRIHMPSIHLSVDD

SEQ ID NO: 3167891 - protein, 20 aa, Giardia lamblia
RCLDFLRLSLLLDPNSESLW

SEQ ID NO: 3167892 - protein, 28 aa, Giardia lamblia
RCLDLVTPLQCCYMPLNYLNKIEQSDNG

SEQ ID NO: 3167893 - protein, 26 aa, Giardia lamblia
RCLLDGKFPIHILRSVVDHFNGAKVL

SEQ ID NO: 3167894 - protein, 17 aa, Giardia lamblia
RCLPALRSNRIETRAVY

SEQ ID NO: 3167895 - protein, 26 aa, Giardia lamblia
RCNTISELFCERISRISRVLSVSQSA

SEQ ID NO: 3167896 - protein, 23 aa, Giardia lamblia
RCPSIWYKLYESHQVGLHVSVPD

SEQ ID NO: 3167897 - protein, 20 aa, Giardia lamblia
RCQDMLSKLVGVVRQTQVKA

SEQ ID NO: 3167898 - protein, 22 aa, Giardia lamblia
RCRQCSKCFWFPNLNISDIPCV

SEQ ID NO: 3167899 - protein, 18 aa, Giardia lamblia
RCSARSSVGGTTFELLTD

SEQ ID NO: 3167900 - protein, 33 aa, Giardia lamblia
RCSVAGCSRITMPLATVCKYHLAGSGAAVFGSC

SEQ ID NO: 3167901 - protein, 22 aa, Giardia lamblia
RCSVSRKVLWRARRRLESKLET

SEQ ID NO: 3167902 - protein, 28 aa, Giardia lamblia
RCSVTSPTRWGGCPASRTPSYDRVRPIS

SEQ ID NO: 3167903 - protein, 19 aa, Giardia lamblia
RCVNDLLLMLKEYDRNTES

SEQ ID NO: 3167904 - protein, 20 aa, Giardia lamblia
RCVNPGAPPKRTRTGTLHPS

SEQ ID NO: 3167905 - protein, 21 aa, Giardia lamblia
RDADYRFADLSKRNAALERKC

SEQ ID NO: 3167906 - protein, 24 aa, Giardia lamblia
RDAELKRYITWLLNHVANNNPEFL

SEQ ID NO: 3167907 - protein, 26 aa, Giardia lamblia
RDAELVCGPDLFKLYSSLMKASTSLQ

SEQ ID NO: 3167908 - protein, 24 aa, Giardia lamblia
RDALGRTALMYAARQGHASCVSLL

SEQ ID NO: 3167909 - protein, 36 aa, Giardia lamblia
RDALGRTAMMYLVMFPRHSTLVLLEECIGYLAQAQQ

SEQ ID NO: 3167910 - protein, 26 aa, Giardia lamblia
RDASLQVWPDVKWWYDVYDRLREKYA

SEQ ID NO: 3167911 - protein, 20 aa, Giardia lamblia
RDAYKQNLRKAIVYVTKLMS

SEQ ID NO: 3167912 - protein, 18 aa, Giardia lamblia
RDCACYYLPIISDHKRSL

SEQ ID NO: 3167913 - protein, 20 aa, Giardia lamblia
RDCSAICWDLIEGRERARCL

SEQ ID NO: 3167914 - protein, 28 aa, Giardia lamblia
RDDELYEDFCCICMDAPVKTVLMPCRHA

SEQ ID NO: 3167915 - protein, 19 aa, Giardia lamblia
RDDLFPIELIWGSDSPSRV

SEQ ID NO: 3167916 - protein, 21 aa, Giardia lamblia
RDDLPLFLLILALWQDNVYAA

SEQ ID NO: 3167917 - protein, 17 aa, Giardia lamblia
RDDLRRMIRTLSKTERD

SEQ ID NO: 3167918 - protein, 23 aa, Giardia lamblia
RDDSRGRWRAIHLPSVLRAQALQ

SEQ ID NO: 3167919 - protein, 27 aa, Giardia lamblia
RDEAERFIPCRGFRVSSAGKLRLPSTI

SEQ ID NO: 3167920 - protein, 18 aa, Giardia lamblia
RDEALKFQVTDSVEEEEQ

SEQ ID NO: 3167921 - protein, 18 aa, Giardia lamblia
RDEEILRLRSLREEQLSL

SEQ ID NO: 3167922 - protein, 19 aa, Giardia lamblia
RDEFIPFLCECVDDDDEIL

SEQ ID NO: 3167923 - protein, 17 aa, Giardia lamblia
RDEIALLTHKHRQELEE

SEQ ID NO: 3167924 - protein, 18 aa, Giardia lamblia
RDELEIEYNYELKNGETA

SEQ ID NO: 3167925 - protein, 21 aa, Giardia lamblia
RDELIKDLLIKTSEIETEQRD

SEQ ID NO: 3167926 - protein, 21 aa, Giardia lamblia
RDELLSSFYVLIGLLNERSSP

SEQ ID NO: 3167927 - protein, 26 aa, Giardia lamblia
RDELYRKFLSVFCVDESWRVRHACAD

SEQ ID NO: 3167928 - protein, 17 aa, Giardia lamblia
RDENKCIALIYAAQTGH

SEQ ID NO: 3167929 - protein, 25 aa, Giardia lamblia
RDEVEFKRAKSCLEYEVETSDGDKE

SEQ ID NO: 3167930 - protein, 18 aa, Giardia lamblia
RDFASRARHRVCILRPML

SEQ ID NO: 3167931 - protein, 24 aa, Giardia lamblia
RDFDICLCDIFLKRLLNSPQRHLY

SEQ ID NO: 3167932 - protein, 19 aa, Giardia lamblia
RDFSPRFRKNPDAFQLLSG

SEQ ID NO: 3167933 - protein, 23 aa, Giardia lamblia
RDFVLRPEYSVGRAEEIATTISS

SEQ ID NO: 3167934 - protein, 24 aa, Giardia lamblia
RDGCTALMRAAERNHEKIIPSLLS

SEQ ID NO: 3167935 - protein, 23 aa, Giardia lamblia
RDGETGLMKAVRSNNVDIARLLI

SEQ ID NO: 3167936 - protein, 20 aa, Giardia lamblia
RDGKSKGFGVLQFATVDDLQ

SEQ ID NO: 3167937 - protein, 17 aa, Giardia lamblia
RDGMSALMYAAQYGYMT

SEQ ID NO: 3167938 - protein, 20 aa, Giardia lamblia
RDGRLACIIFIRDRNHSGQE

SEQ ID NO: 3167939 - protein, 21 aa, Giardia lamblia
RDGRTALIIAAMHEYPEACSI

SEQ ID NO: 3167940 - protein, 17 aa, Giardia lamblia
RDGSGFLDVLYRHATLL

SEQ ID NO: 3167941 - protein, 19 aa, Giardia lamblia
RDGTLPIIMGRTAPSTPVQ

SEQ ID NO: 3167942 - protein, 21 aa, Giardia lamblia
RDGYTALIMAIQLHDLVSVTI

SEQ ID NO: 3167943 - protein, 22 aa, Giardia lamblia
RDHKGRTALMVAASVGNSAAVE

SEQ ID NO: 3167944 - protein, 17 aa, Giardia lamblia
RDHNGYTALMFACENNA

SEQ ID NO: 3167945 - protein, 27 aa, Giardia lamblia
RDIEIERLRSLCEVFFEQSYQQSLKAA

SEQ ID NO: 3167946 - protein, 24 aa, Giardia lamblia
RDIEIKRLRNLVAKAMSDKDEAMA

SEQ ID NO: 3167947 - protein, 20 aa, Giardia lamblia
RDIKPNNILLAFRGDAGEQL

SEQ ID NO: 3167948 - protein, 19 aa, Giardia lamblia
RDILDTELMPVPTSTLEGE

SEQ ID NO: 3167949 - protein, 25 aa, Giardia lamblia
RDILPPYACAIILHFENYTVDPQVL

SEQ ID NO: 3167950 - protein, 26 aa, Giardia lamblia
RDIMKTKTLDFVIAMCRGAGIRNINK

SEQ ID NO: 3167951 - protein, 24 aa, Giardia lamblia
RDISTRIGALKARLTRATAASGGT

SEQ ID NO: 3167952 - protein, 19 aa, Giardia lamblia
RDKISLSFVDQWNHTHAPE

SEQ ID NO: 3167953 - protein, 23 aa, Giardia lamblia
RDKLKKIGIGPIDIHSVYNRFYE

SEQ ID NO: 3167954 - protein, 29 aa, Giardia lamblia
RDKRFIYYRIYKYRIVPLADDAISLLTKT

SEQ ID NO: 3167955 - protein, 23 aa, Giardia lamblia
RDKTYRTPLDFGVLHRRDDLVMS

SEQ ID NO: 3167956 - protein, 25 aa, Giardia lamblia
RDKVDEIVNLLAIIDRVKTEYENYR

SEQ ID NO: 3167957 - protein, 33 aa, Giardia lamblia
RDLCFSIMWMLTGECAPSWYVPSSRAMKKRRAD

SEQ ID NO: 3167958 - protein, 29 aa, Giardia lamblia
RDLCSGTIYKPEVQNVYEIVKTYFEKLRE

SEQ ID NO: 3167959 - protein, 27 aa, Giardia lamblia
RDLENSKRLPLLVATVSEFVEISEDHL

SEQ ID NO: 3167960 - protein, 23 aa, Giardia lamblia
RDLLKCLLGALLENRELAICGEP

SEQ ID NO: 3167961 - protein, 21 aa, Giardia lamblia
RDLLLKLGIPLNYTKGVSPFT

SEQ ID NO: 3167962 - protein, 28 aa, Giardia lamblia
RDLLSCKVLPWLGPVEYVSFLAKTAHTP

SEQ ID NO: 3167963 - protein, 17 aa, Giardia lamblia
RDLSPLWEMTQKGIDTK

SEQ ID NO: 3167964 - protein, 18 aa, Giardia lamblia
RDLVKAYDVYACNTNLYN

SEQ ID NO: 3167965 - protein, 22 aa, Giardia lamblia
RDMSGCTALMYAAERGHADTIR

SEQ ID NO: 3167966 - protein, 21 aa, Giardia lamblia
RDMSIGYPICQRSVRRAQSMR

SEQ ID NO: 3167967 - protein, 32 aa, Giardia lamblia
RDNCIFCGHCGAICPTESISMFGITPESEENA

SEQ ID NO: 3167968 - protein, 18 aa, Giardia lamblia
RDNCRLVVIVMEKILDVL

SEQ ID NO: 3167969 - protein, 27 aa, Giardia lamblia
RDNEELPSREGLDWMTKVFRSSKGNGM

SEQ ID NO: 3167970 - protein, 26 aa, Giardia lamblia
RDNHKCCIEYACLLMKYDDLEENNTY

SEQ ID NO: 3167971 - protein, 18 aa, Giardia lamblia
RDNIDMVFHLAKYESEIG

SEQ ID NO: 3167972 - protein, 25 aa, Giardia lamblia
RDNLLPRPYFSIYLQDDGSNIALTL

SEQ ID NO: 3167973 - protein, 17 aa, Giardia lamblia
RDNNGWTALMFAAHSGH

SEQ ID NO: 3167974 - protein, 24 aa, Giardia lamblia
RDNSGWTALIWAARTGHIDCLELL

SEQ ID NO: 3167975 - protein, 18 aa, Giardia lamblia
RDPLSFTIHRHGFVFPLP

SEQ ID NO: 3167976 - protein, 21 aa, Giardia lamblia
RDPQGRTALMIAAQQGSLEIV

SEQ ID NO: 3167977 - protein, 23 aa, Giardia lamblia
RDQEGRTALMLAAQEGHVEIVEM

SEQ ID NO: 3167978 - protein, 22 aa, Giardia lamblia
RDRCPKCYARVTDILKVEQYKN

SEQ ID NO: 3167979 - protein, 19 aa, Giardia lamblia
RDRLTCLQEEVLKLSINTH

SEQ ID NO: 3167980 - protein, 18 aa, Giardia lamblia
RDRPEYLCRMEPDGILSL

SEQ ID NO: 3167981 - protein, 20 aa, Giardia lamblia
RDRVGWVPCSWRKQDQPLDF

SEQ ID NO: 3167982 - protein, 20 aa, Giardia lamblia
RDSARLGLSEAVVVYVITKL

SEQ ID NO: 3167983 - protein, 22 aa, Giardia lamblia
RDSEPALSLVLFDSADVSGAVT

SEQ ID NO: 3167984 - protein, 23 aa, Giardia lamblia
RDSHGRTALIYAAIDDNIELVAL

SEQ ID NO: 3167985 - protein, 25 aa, Giardia lamblia
RDSIFFKRLFEAHRLKATVERSYIL

SEQ ID NO: 3167986 - protein, 26 aa, Giardia lamblia
RDSKLFCRTGVYLIKLANRKTLRDFI

SEQ ID NO: 3167987 - protein, 19 aa, Giardia lamblia
RDSNGWTALMFAAYNGHTG

SEQ ID NO: 3167988 - protein, 18 aa, Giardia lamblia
RDSNGWTALMHVALSGHT

SEQ ID NO: 3167989 - protein, 20 aa, Giardia lamblia
RDSNSWLALLYQKLKVESGS

SEQ ID NO: 3167990 - protein, 22 aa, Giardia lamblia
RDSRDRTALMLASISGQNKAVE

SEQ ID NO: 3167991 - protein, 21 aa, Giardia lamblia
RDSRGRTALMHAAESGAVGVI

SEQ ID NO: 3167992 - protein, 20 aa, Giardia lamblia
RDSSGWTALMFAAWYGHPEC

SEQ ID NO: 3167993 - protein, 19 aa, Giardia lamblia
RDSSHIAILYFMFRTPTSI

SEQ ID NO: 3167994 - protein, 18 aa, Giardia lamblia
RDSYMLAAQVGAAAALLM

SEQ ID NO: 3167995 - protein, 22 aa, Giardia lamblia
RDTDGLICPPLALKSKDMCSQT

SEQ ID NO: 3167996 - protein, 18 aa, Giardia lamblia
RDTLLPSILEEFNVQLRE

SEQ ID NO: 3167997 - protein, 18 aa, Giardia lamblia
RDTMFSYSHVFGTESTNR

SEQ ID NO: 3167998 - protein, 20 aa, Giardia lamblia
RDVAPEISFAPAARSALEDE

SEQ ID NO: 3167999 - protein, 25 aa, Giardia lamblia
RDVLKRRVGDNGAFYFAEYKSSGGA

SEQ ID NO: 3168000 - protein, 17 aa, Giardia lamblia
RDVPVYLFDGFAPTPYV

SEQ ID NO: 3168001 - protein, 20 aa, Giardia lamblia
RDVQIASLLLPFEHSLLDSR

SEQ ID NO: 3168002 - protein, 22 aa, Giardia lamblia
RDYELIKRLLPLDAGIGNNLGK

SEQ ID NO: 3168003 - protein, 43 aa, Giardia lamblia
RDYGIEPCRAFIDNCQRVVCRFMLDHGFSVGMGDMVSSEHTER

SEQ ID NO: 3168004 - protein, 29 aa, Giardia lamblia
RDYHQLRRFHMLIIMRRRQYVLANNSKCI

SEQ ID NO: 3168005 - protein, 18 aa, Giardia lamblia
RDYIKATKLDGGSDYLKI

SEQ ID NO: 3168006 - protein, 25 aa, Giardia lamblia
RDYLSSSYLLYSLVNQEPVFSFKGL

SEQ ID NO: 3168007 - protein, 17 aa, Giardia lamblia
RDYLVVKYAQPDQDGLP

SEQ ID NO: 3168008 - protein, 25 aa, Giardia lamblia
REAARLCVDMPGGGKVVLRDADAKK

SEQ ID NO: 3168009 - protein, 22 aa, Giardia lamblia
REAEARSALELLGVPTNHIHFL

SEQ ID NO: 3168010 - protein, 17 aa, Giardia lamblia
REAEIERLLSSQTSTCS

SEQ ID NO: 3168011 - protein, 26 aa, Giardia lamblia
REAGDCGWLPSTYTVMLSRGTRPLYE

SEQ ID NO: 3168012 - protein, 17 aa, Giardia lamblia
REAGFSMKSGWTALMSA

SEQ ID NO: 3168013 - protein, 19 aa, Giardia lamblia
REAGIAISNYTRCIINNED

SEQ ID NO: 3168014 - protein, 20 aa, Giardia lamblia
REAGLRMVLQSEACPSGAIS

SEQ ID NO: 3168015 - protein, 22 aa, Giardia lamblia
REAHLPYRYFIGAVTCEKEPAI

SEQ ID NO: 3168016 - protein, 19 aa, Giardia lamblia
REALLGASLTKGRVSTEIE

SEQ ID NO: 3168017 - protein, 24 aa, Giardia lamblia
REALRRELGCSHVLADLLAHMLAW

SEQ ID NO: 3168018 - protein, 26 aa, Giardia lamblia
REAQELAECTFRPAINPESVYYAGER

SEQ ID NO: 3168019 - protein, 18 aa, Giardia lamblia
REATLVLLRPCAQKEELY

SEQ ID NO: 3168020 - protein, 28 aa, Giardia lamblia
REATRCWDFYFKAGIVHDAKCIESFALL

SEQ ID NO: 3168021 - protein, 25 aa, Giardia lamblia
REATRLFSQLGFVRACHSSAGQTTI

SEQ ID NO: 3168022 - protein, 22 aa, Giardia lamblia
RECKGTYSVLSSVFEWRDGCSH

SEQ ID NO: 3168023 - protein, 17 aa, Giardia lamblia
RECLTQRTLEMTASKKD

SEQ ID NO: 3168024 - protein, 17 aa, Giardia lamblia
RECMAVIQPEFPPITTL

SEQ ID NO: 3168025 - protein, 19 aa, Giardia lamblia
RECTSRRVSLFAYDYHQCD

SEQ ID NO: 3168026 - protein, 21 aa, Giardia lamblia
REDHIRSNLLFSAEDLTSKLK

SEQ ID NO: 3168027 - protein, 23 aa, Giardia lamblia
REDSCGFIEHLIGRSIELRYYDC

SEQ ID NO: 3168028 - protein, 18 aa, Giardia lamblia
REEACLAGSFLEQLLTVD

SEQ ID NO: 3168029 - protein, 20 aa, Giardia lamblia
REEDAETGVACKEELGRENA

SEQ ID NO: 3168030 - protein, 20 aa, Giardia lamblia
REEIHRLILSRFKVPEEYID

SEQ ID NO: 3168031 - protein, 21 aa, Giardia lamblia
REEILKAFRLFDEDDTGKISF

SEQ ID NO: 3168032 - protein, 19 aa, Giardia lamblia
REEKTLHGPGEYTVQDSFT

SEQ ID NO: 3168033 - protein, 25 aa, Giardia lamblia
REELDRLRALVISRGIEIANMDRKL

SEQ ID NO: 3168034 - protein, 21 aa, Giardia lamblia
REEMMDEFKERMAAEARSKST

SEQ ID NO: 3168035 - protein, 21 aa, Giardia lamblia
REEQELTAAWIAAIQSKNPEK

SEQ ID NO: 3168036 - protein, 19 aa, Giardia lamblia
REERLNCLKSWKAYAEKRL

SEQ ID NO: 3168037 - protein, 17 aa, Giardia lamblia
REESCDPTLFGVYDGYR

SEQ ID NO: 3168038 - protein, 19 aa, Giardia lamblia
REEVRRLQEDLAKASREAS

SEQ ID NO: 3168039 - protein, 22 aa, Giardia lamblia
REFCDAIKILLPLEEHMKNVAG

SEQ ID NO: 3168040 - protein, 23 aa, Giardia lamblia
REFFEVFAKHLLKVAGEPENNMT

SEQ ID NO: 3168041 - protein, 24 aa, Giardia lamblia
REFITVRVCREVEKVDGRRRLCVA

SEQ ID NO: 3168042 - protein, 17 aa, Giardia lamblia
REFKSKYSHMTIRGKEK

SEQ ID NO: 3168043 - protein, 18 aa, Giardia lamblia
REFRRMGVQMTHPTPAQL

SEQ ID NO: 3168044 - protein, 22 aa, Giardia lamblia
REFVAIIFRTHVTVVGLLSADS

SEQ ID NO: 3168045 - protein, 22 aa, Giardia lamblia
REFYPALKMILYFEEKLGHAPE

SEQ ID NO: 3168046 - protein, 20 aa, Giardia lamblia
REGIVRLLAGMEAGMKTRNG

SEQ ID NO: 3168047 - protein, 24 aa, Giardia lamblia
REGKPRTDKLLALKQSIAEACVVM

SEQ ID NO: 3168048 - protein, 24 aa, Giardia lamblia
REGLKAPLPPDWRVASTADGDIYY

SEQ ID NO: 3168049 - protein, 19 aa, Giardia lamblia
REGMSWTCVCRAEYVPYNG

SEQ ID NO: 3168050 - protein, 31 aa, Giardia lamblia
REGNEVLKELLKYEGDCCLDDGTTPLMAAIC

SEQ ID NO: 3168051 - protein, 23 aa, Giardia lamblia
REGRGELGNVCFSKSDFENAETP

SEQ ID NO: 3168052 - protein, 36 aa, Giardia lamblia
REGRMRVAKSLLQWRFLRPRSRLMSGSFIGGPSIKY

SEQ ID NO: 3168053 - protein, 18 aa, Giardia lamblia
REGSLQAVRRIRKLELDL

SEQ ID NO: 3168054 - protein, 29 aa, Giardia lamblia
REGSLRRAFMNLGKAYAFDNSPYVYCLEV

SEQ ID NO: 3168055 - protein, 25 aa, Giardia lamblia
REHYLKYFRNYREYREITPADMLYE

SEQ ID NO: 3168056 - protein, 20 aa, Giardia lamblia
REIEAFKQSIEIMANDLDRK

SEQ ID NO: 3168057 - protein, 25 aa, Giardia lamblia
REIEKRLYLRPALAALLTLHAQNLA

SEQ ID NO: 3168058 - protein, 29 aa, Giardia lamblia
REIIIVYELYIEKLIELMSASSANDQSNM

SEQ ID NO: 3168059 - protein, 17 aa, Giardia lamblia
REIINLMKPYREEIDSL

SEQ ID NO: 3168060 - protein, 20 aa, Giardia lamblia
REIQILKLLNHPNVIKLYEI

SEQ ID NO: 3168061 - protein, 25 aa, Giardia lamblia
REISLKPTCAVFITMNPGYAGRVEL

SEQ ID NO: 3168062 - protein, 20 aa, Giardia lamblia
REISNAYLLDPDIYLADSTI

SEQ ID NO: 3168063 - protein, 20 aa, Giardia lamblia
REISNMLSLSLKDVANALYF

SEQ ID NO: 3168064 - protein, 26 aa, Giardia lamblia
REKAIPLHVLIASFAPRIHGREDEKL

SEQ ID NO: 3168065 - protein, 20 aa, Giardia lamblia
REKEELLLIVRKQQQLIDVL

SEQ ID NO: 3168066 - protein, 25 aa, Giardia lamblia
REKISELKARIILDQETIKRLNETN

SEQ ID NO: 3168067 - protein, 18 aa, Giardia lamblia
REKRFPVSNNCFIPIVGV

SEQ ID NO: 3168068 - protein, 24 aa, Giardia lamblia
REKYERRFQAKLLLEADLFNRYRQ

SEQ ID NO: 3168069 - protein, 17 aa, Giardia lamblia
RELAVQTFSVFRDLGKD

SEQ ID NO: 3168070 - protein, 22 aa, Giardia lamblia
RELCTLCKSLLDITKKPRLGLS

SEQ ID NO: 3168071 - protein, 19 aa, Giardia lamblia
RELDITMGQCQSAEERVAL

SEQ ID NO: 3168072 - protein, 25 aa, Giardia lamblia
RELDRRKDISGMKFMINTVSLDRVV

SEQ ID NO: 3168073 - protein, 20 aa, Giardia lamblia
RELEEARDANLHSANDERTM

SEQ ID NO: 3168074 - protein, 17 aa, Giardia lamblia
RELEMKELMMVVLSNDL

SEQ ID NO: 3168075 - protein, 25 aa, Giardia lamblia
RELEQRHRLELSRCEEVIAGLREDK

SEQ ID NO: 3168076 - protein, 18 aa, Giardia lamblia
RELERMGIVNSIFNSQFE

SEQ ID NO: 3168077 - protein, 19 aa, Giardia lamblia
RELERRIALEKDQHSKPKE

SEQ ID NO: 3168078 - protein, 17 aa, Giardia lamblia
RELFHPDAHVIAPYDVS

SEQ ID NO: 3168079 - protein, 30 aa, Giardia lamblia
RELFRKSKSSTEWFASAWHDIHYYDIMEGA

SEQ ID NO: 3168080 - protein, 25 aa, Giardia lamblia
RELFSKACLRHDILHEDADGIWLEV

SEQ ID NO: 3168081 - protein, 17 aa, Giardia lamblia
RELKFSIPSSSVYVAND

SEQ ID NO: 3168082 - protein, 19 aa, Giardia lamblia
RELMVAFGQEMSRQIEANR

SEQ ID NO: 3168083 - protein, 26 aa, Giardia lamblia
RELPTVCLAGQFFPAPTFTVQHSKSG

SEQ ID NO: 3168084 - protein, 17 aa, Giardia lamblia
RELRQRSLRLAGSSGAE

SEQ ID NO: 3168085 - protein, 24 aa, Giardia lamblia
RELSEPYQIWTYRYFVEPWPTLTI

SEQ ID NO: 3168086 - protein, 19 aa, Giardia lamblia
RELSLLVHQFLPAYYRSSA

SEQ ID NO: 3168087 - protein, 17 aa, Giardia lamblia
RELSRSFMVGVGFLHDL

SEQ ID NO: 3168088 - protein, 23 aa, Giardia lamblia
RELVADLPTILARLTTLEKELLA

SEQ ID NO: 3168089 - protein, 17 aa, Giardia lamblia
RELVSSILSSSRVSDPL

SEQ ID NO: 3168090 - protein, 25 aa, Giardia lamblia
RELWLTGEDTLAWGRESDATFAVLL

SEQ ID NO: 3168091 - protein, 22 aa, Giardia lamblia
RELWRSLCFEAQVPESLRHAVG

SEQ ID NO: 3168092 - protein, 17 aa, Giardia lamblia
REMAFHSTLATGFSPYY

SEQ ID NO: 3168093 - protein, 21 aa, Giardia lamblia
REMLFNTNFEFCSSREREEGC

SEQ ID NO: 3168094 - protein, 23 aa, Giardia lamblia
REMLHRPPVLLVIGMAGAGKTTF

SEQ ID NO: 3168095 - protein, 25 aa, Giardia lamblia
REMNESWKLARSMRRKVMQNLAEHK

SEQ ID NO: 3168096 - protein, 21 aa, Giardia lamblia
RENHWRMQLLSQREQFGNATT

SEQ ID NO: 3168097 - protein, 22 aa, Giardia lamblia
RENKPGLIIEFFWEQDKEILTY

SEQ ID NO: 3168098 - protein, 32 aa, Giardia lamblia
RENPVRLPLRRKINCFREVDSLLYAGTESGDV

SEQ ID NO: 3168099 - protein, 20 aa, Giardia lamblia
RENQKPLLLLTVHNKGSAPL

SEQ ID NO: 3168100 - protein, 17 aa, Giardia lamblia
RENVIELLFRKLQHNSE

SEQ ID NO: 3168101 - protein, 19 aa, Giardia lamblia
RENYLLRLLFNLFCNLLTL

SEQ ID NO: 3168102 - protein, 18 aa, Giardia lamblia
REPETYLHRIGRSGRFGR

SEQ ID NO: 3168103 - protein, 19 aa, Giardia lamblia
REPPAKWILAGVSLLMAAD

SEQ ID NO: 3168104 - protein, 18 aa, Giardia lamblia
REPPVLQRIDEETLYSQD

SEQ ID NO: 3168105 - protein, 19 aa, Giardia lamblia
REPSFCQRSAPAACSDPSL

SEQ ID NO: 3168106 - protein, 27 aa, Giardia lamblia
REPVAVPCRLPVVPQLCYDYYDVPNYQ

SEQ ID NO: 3168107 - protein, 24 aa, Giardia lamblia
REPWSDLPSVLNFAEISLRKVISK

SEQ ID NO: 3168108 - protein, 20 aa, Giardia lamblia
REQESAQIIKFIASSANDPG

SEQ ID NO: 3168109 - protein, 18 aa, Giardia lamblia
REQKHGWRIDYFVVTSKI

SEQ ID NO: 3168110 - protein, 22 aa, Giardia lamblia
REQQAPGLRARKLGDLVQAKPT

SEQ ID NO: 3168111 - protein, 17 aa, Giardia lamblia
REQWLSKIFNLAATYPN

SEQ ID NO: 3168112 - protein, 17 aa, Giardia lamblia
RERLASWITDLIATLPL

SEQ ID NO: 3168113 - protein, 25 aa, Giardia lamblia
RERLELRDCVKTMVMEQMNPEKLKK

SEQ ID NO: 3168114 - protein, 21 aa, Giardia lamblia
RERLSVLGCNQFDDTLNRPLY

SEQ ID NO: 3168115 - protein, 17 aa, Giardia lamblia
RERRFTFDHLFEPSSTQ

SEQ ID NO: 3168116 - protein, 24 aa, Giardia lamblia
RERVRRLREDKLRVTTELKETAAK

SEQ ID NO: 3168117 - protein, 18 aa, Giardia lamblia
RESFLKKFSGDIARYKQD

SEQ ID NO: 3168118 - protein, 22 aa, Giardia lamblia
RESHKLFTKDLFLFETREAILG

SEQ ID NO: 3168119 - protein, 27 aa, Giardia lamblia
RESKLLYYSLCEFTKVYAPLISPCDTR

SEQ ID NO: 3168120 - protein, 23 aa, Giardia lamblia
RESNEALIARMMRDITGLEKERS

SEQ ID NO: 3168121 - protein, 23 aa, Giardia lamblia
RESPCPRMVRYSSAMMSGAKIPE

SEQ ID NO: 3168122 - protein, 23 aa, Giardia lamblia
RESTEKRFFLGHIKESANTDAEY

SEQ ID NO: 3168123 - protein, 17 aa, Giardia lamblia
RESVSMVLYQRLAYLLC

SEQ ID NO: 3168124 - protein, 17 aa, Giardia lamblia
RETCWQGISWSRHESGR

SEQ ID NO: 3168125 - protein, 18 aa, Giardia lamblia
RETDRYTFVYGLHLETNS

SEQ ID NO: 3168126 - protein, 24 aa, Giardia lamblia
RETHKPIPKRLVLSLVRDLANCLI

SEQ ID NO: 3168127 - protein, 17 aa, Giardia lamblia
RETHSRHILTIKMTDDD

SEQ ID NO: 3168128 - protein, 22 aa, Giardia lamblia
RETLWHLFAVDLAASASSTTQA

SEQ ID NO: 3168129 - protein, 26 aa, Giardia lamblia
RETNIFGWNALMFAAYFDNHDAVKLF

SEQ ID NO: 3168130 - protein, 20 aa, Giardia lamblia
REVALGWNLVDTRGSKSYIA

SEQ ID NO: 3168131 - protein, 24 aa, Giardia lamblia
REVFRRRFTFEAAIQSSDIFHSEE

SEQ ID NO: 3168132 - protein, 27 aa, Giardia lamblia
REVKHEPIWFCEGLPFHERPFFATKIR

SEQ ID NO: 3168133 - protein, 31 aa, Giardia lamblia
REVSSAKDAARCFVNGGILRVTAVTAMNERS

SEQ ID NO: 3168134 - protein, 17 aa, Giardia lamblia
REVSSLKSKLGLTQDPS

SEQ ID NO: 3168135 - protein, 17 aa, Giardia lamblia
REVVFVDAISAKYTNSN

SEQ ID NO: 3168136 - protein, 17 aa, Giardia lamblia
REWFDAIYRGDVECVSQ

SEQ ID NO: 3168137 - protein, 22 aa, Giardia lamblia
REYESKLSILDKLQIISEIVGD

SEQ ID NO: 3168138 - protein, 19 aa, Giardia lamblia
REYHESIMFISNIRPSLTH

SEQ ID NO: 3168139 - protein, 19 aa, Giardia lamblia
REYSEIMSLAVSDASVQTF

SEQ ID NO: 3168140 - protein, 19 aa, Giardia lamblia
REYVMLHIVGYLCGIWDAS

SEQ ID NO: 3168141 - protein, 27 aa, Giardia lamblia
REYYTHPKICLMLTSVHDWFNGICSRK

SEQ ID NO: 3168142 - protein, 23 aa, Giardia lamblia
RFAKLCKYMKEVLGDKVEGVRVG

SEQ ID NO: 3168143 - protein, 23 aa, Giardia lamblia
RFAREWCTNLSLLKASQAKKCVA

SEQ ID NO: 3168144 - protein, 19 aa, Giardia lamblia
RFAYSKDLLRWWLTSPGCK

SEQ ID NO: 3168145 - protein, 23 aa, Giardia lamblia
RFDKLLQICMWFQREYGKSSNVI

SEQ ID NO: 3168146 - protein, 24 aa, Giardia lamblia
RFDLSHLPLLYLLDGDKDGLFSIH

SEQ ID NO: 3168147 - protein, 17 aa, Giardia lamblia
RFDTWKKVRIFYDDVRQ

SEQ ID NO: 3168148 - protein, 19 aa, Giardia lamblia
RFECIKLGVQTSARMLLQA

SEQ ID NO: 3168149 - protein, 20 aa, Giardia lamblia
RFELRMYKRTFWVTCGGNDI

SEQ ID NO: 3168150 - protein, 19 aa, Giardia lamblia
RFENEFSYISRQFLATRSG

SEQ ID NO: 3168151 - protein, 21 aa, Giardia lamblia
RFETDFGKFMMHYASWEKRLQ

SEQ ID NO: 3168152 - protein, 25 aa, Giardia lamblia
RFFADKRGAFMLEHIAKISDKNNTL

SEQ ID NO: 3168153 - protein, 18 aa, Giardia lamblia
RFFDGICAVNLVPQVVTQ

SEQ ID NO: 3168154 - protein, 18 aa, Giardia lamblia
RFFPMPSSKEARRSVHNM

SEQ ID NO: 3168155 - protein, 19 aa, Giardia lamblia
RFFPSFLGKVTVLSSEPAT

SEQ ID NO: 3168156 - protein, 17 aa, Giardia lamblia
RFGRYSCLLNIDEVSDI

SEQ ID NO: 3168157 - protein, 26 aa, Giardia lamblia
RFGTDLPPFRLEFSVDKAIEPLPTPK

SEQ ID NO: 3168158 - protein, 18 aa, Giardia lamblia
RFGTIGFNSPYDWSDPDL

SEQ ID NO: 3168159 - protein, 18 aa, Giardia lamblia
RFGTTLTVAHLKPIIPVV

SEQ ID NO: 3168160 - protein, 18 aa, Giardia lamblia
RFHKNFKVHFYGIGISGG

SEQ ID NO: 3168161 - protein, 20 aa, Giardia lamblia
RFHLKRKNARLEYIRASLRL

SEQ ID NO: 3168162 - protein, 19 aa, Giardia lamblia
RFHSYEGYTPPTLTIFPYV

SEQ ID NO: 3168163 - protein, 20 aa, Giardia lamblia
RFHYNARSAIFGQSGSGNNW

SEQ ID NO: 3168164 - protein, 19 aa, Giardia lamblia
RFIRAALDYLSCVCLSSDQ

SEQ ID NO: 3168165 - protein, 17 aa, Giardia lamblia
RFITFRVVQQGVEHTVS

SEQ ID NO: 3168166 - protein, 23 aa, Giardia lamblia
RFKTPELLFRPELNNSDMDGIHQ

SEQ ID NO: 3168167 - protein, 23 aa, Giardia lamblia
RFLGRGKYGLVYLAREQSSKLVV

SEQ ID NO: 3168168 - protein, 19 aa, Giardia lamblia
RFLHILVHLFDFLRVLHHQ

SEQ ID NO: 3168169 - protein, 19 aa, Giardia lamblia
RFLHLCFLLVRSVAILHSV

SEQ ID NO: 3168170 - protein, 18 aa, Giardia lamblia
RFLLEKQLDVDLIEAKFS

SEQ ID NO: 3168171 - protein, 19 aa, Giardia lamblia
RFLLERAVEAAGDVYTGAG

SEQ ID NO: 3168172 - protein, 18 aa, Giardia lamblia
RFLMKRILASKEERAAGQ

SEQ ID NO: 3168173 - protein, 20 aa, Giardia lamblia
RFLPPELCLLLPDEFDLIRV

SEQ ID NO: 3168174 - protein, 17 aa, Giardia lamblia
RFLRIPVTLQYFIPQVK

SEQ ID NO: 3168175 - protein, 18 aa, Giardia lamblia
RFLSFRTAPGAALTEIFH

SEQ ID NO: 3168176 - protein, 22 aa, Giardia lamblia
RFMKETGKDPLLLALQAHAKSS

SEQ ID NO: 3168177 - protein, 19 aa, Giardia lamblia
RFNELNIRLVGSFEDSWPL

SEQ ID NO: 3168178 - protein, 22 aa, Giardia lamblia
RFNGGWRAIKKHPFFTEHNVDF

SEQ ID NO: 3168179 - protein, 45 aa, Giardia lamblia
RFNSKELFLRLTARISAPVGVIGGSSKLFWGLSILGQAQENRISS

SEQ ID NO: 3168180 - protein, 17 aa, Giardia lamblia
RFPSFVGTLNYFQPMTE

SEQ ID NO: 3168181 - protein, 20 aa, Giardia lamblia
RFQMAVPDLWINMMKHGFDT

SEQ ID NO: 3168182 - protein, 30 aa, Giardia lamblia
RFQREQKEALDLRLAVKAEEARREREEYLA

SEQ ID NO: 3168183 - protein, 24 aa, Giardia lamblia
RFQSALRILAKMTFRSAEKQARNR

SEQ ID NO: 3168184 - protein, 22 aa, Giardia lamblia
RFQTPMSELDWLMKHTPTRISA

SEQ ID NO: 3168185 - protein, 19 aa, Giardia lamblia
RFRYLRMLIPVALNCLLVF

SEQ ID NO: 3168186 - protein, 22 aa, Giardia lamblia
RFSCAFFLCPYEGQLSGITPLM

SEQ ID NO: 3168187 - protein, 23 aa, Giardia lamblia
RFSEQSGELVLSWRDDSRGRWRA

SEQ ID NO: 3168188 - protein, 21 aa, Giardia lamblia
RFSEQTVCIIFGQIASALAYL

SEQ ID NO: 3168189 - protein, 19 aa, Giardia lamblia
RFSNVYVLCTTNLIDTLDP

SEQ ID NO: 3168190 - protein, 17 aa, Giardia lamblia
RFSPRERRAIEADVSNI

SEQ ID NO: 3168191 - protein, 17 aa, Giardia lamblia
RFSRLGRGRAPANDQTS

SEQ ID NO: 3168192 - protein, 20 aa, Giardia lamblia
RFTPCDPLDWVVGKHGITII

SEQ ID NO: 3168193 - protein, 19 aa, Giardia lamblia
RFTPSPVFYYATMVFVLSA

SEQ ID NO: 3168194 - protein, 17 aa, Giardia lamblia
RFTRLLIADTTVDWLKD

SEQ ID NO: 3168195 - protein, 18 aa, Giardia lamblia
RFVARSMLVQAITQSLLS

SEQ ID NO: 3168196 - protein, 29 aa, Giardia lamblia
RFVKDIQKHFPLYTLAALVAHNEFMVRYD

SEQ ID NO: 3168197 - protein, 23 aa, Giardia lamblia
RFVKKYLPTIGVDYGVRALDLEG

SEQ ID NO: 3168198 - protein, 18 aa, Giardia lamblia
RFYDGVVLLADLESSIQD

SEQ ID NO: 3168199 - protein, 20 aa, Giardia lamblia
RGAALDALRTRLVERASIIS

SEQ ID NO: 3168200 - protein, 36 aa, Giardia lamblia
RGADGKTALELALTRGHFKAVRILMSKFTYSWQSLN

SEQ ID NO: 3168201 - protein, 21 aa, Giardia lamblia
RGADLCTAYSQLADQRTSLLS

SEQ ID NO: 3168202 - protein, 21 aa, Giardia lamblia
RGALDLSFIKYLVLDEFDALF

SEQ ID NO: 3168203 - protein, 20 aa, Giardia lamblia
RGALLHKRALSFKKLDTSLS

SEQ ID NO: 3168204 - protein, 20 aa, Giardia lamblia
RGAMEIAGFTTGVAGDKSII

SEQ ID NO: 3168205 - protein, 19 aa, Giardia lamblia
RGAMFSFGLKLYRFSEQSG

SEQ ID NO: 3168206 - protein, 17 aa, Giardia lamblia
RGAYILVRIILHLSQQE

SEQ ID NO: 3168207 - protein, 20 aa, Giardia lamblia
RGDLEFIKQNFQMMKGQKNK

SEQ ID NO: 3168208 - protein, 18 aa, Giardia lamblia
RGDLKSVQVIKQLENILK

SEQ ID NO: 3168209 - protein, 21 aa, Giardia lamblia
RGDMGRPDYLTVVQAQHTNAG

SEQ ID NO: 3168210 - protein, 19 aa, Giardia lamblia
RGDTALILACKRGDRRITK

SEQ ID NO: 3168211 - protein, 19 aa, Giardia lamblia
RGDVRFYFNGARVSDTATP

SEQ ID NO: 3168212 - protein, 26 aa, Giardia lamblia
RGEFSAGAILSRIMKANSLTTITTAT

SEQ ID NO: 3168213 - protein, 25 aa, Giardia lamblia
RGERVYDLPSVQKFTAIIKNETQKR

SEQ ID NO: 3168214 - protein, 20 aa, Giardia lamblia
RGESALMTAIEMNNTDAALM

SEQ ID NO: 3168215 - protein, 22 aa, Giardia lamblia
RGFKLAYSYHNLTHWWINTYLI

SEQ ID NO: 3168216 - protein, 22 aa, Giardia lamblia
RGFLDKCAAYPMPIHAHTQRGC

SEQ ID NO: 3168217 - protein, 17 aa, Giardia lamblia
RGFYLNRTHLGKVKQIF

SEQ ID NO: 3168218 - protein, 19 aa, Giardia lamblia
RGGDDLDWDQMVVKVDIKI

SEQ ID NO: 3168219 - protein, 18 aa, Giardia lamblia
RGGELRWTSRLSDSIDEP

SEQ ID NO: 3168220 - protein, 17 aa, Giardia lamblia
RGGPPTPAADVWALGCV

SEQ ID NO: 3168221 - protein, 22 aa, Giardia lamblia
RGHHHIVKFLLSYTATDFNVLE

SEQ ID NO: 3168222 - protein, 21 aa, Giardia lamblia
RGHIQLLMTLVWSMNTAARVR

SEQ ID NO: 3168223 - protein, 20 aa, Giardia lamblia
RGHLLCVELLLKTEAGRQRW

SEQ ID NO: 3168224 - protein, 25 aa, Giardia lamblia
RGHSLLKKKLDAMTLQLRSLNSQLV

SEQ ID NO: 3168225 - protein, 18 aa, Giardia lamblia
RGIALRKTTAIRLGRSQH

SEQ ID NO: 3168226 - protein, 20 aa, Giardia lamblia
RGICCGSPYCISMDSMLSSH

SEQ ID NO: 3168227 - protein, 25 aa, Giardia lamblia
RGIRHKDDWCSFILFDSRFAEHTER

SEQ ID NO: 3168228 - protein, 19 aa, Giardia lamblia
RGIVLQLLQGVPREFSSSS

SEQ ID NO: 3168229 - protein, 20 aa, Giardia lamblia
RGIWSCCYTALVRITLPNGC

SEQ ID NO: 3168230 - protein, 19 aa, Giardia lamblia
RGKHEFTINEGLQIYYNPK

SEQ ID NO: 3168231 - protein, 17 aa, Giardia lamblia
RGKKALISYDFTNPLLI

SEQ ID NO: 3168232 - protein, 29 aa, Giardia lamblia
RGKKYLCVICNSEGSFLCTQCRSCYCCRE

SEQ ID NO: 3168233 - protein, 17 aa, Giardia lamblia
RGKLRDMENSILNNSYA

SEQ ID NO: 3168234 - protein, 17 aa, Giardia lamblia
RGLCVQPELSDAGRKIQ

SEQ ID NO: 3168235 - protein, 24 aa, Giardia lamblia
RGLDFPRIGLVINFDIPSDLTHYI

SEQ ID NO: 3168236 - protein, 17 aa, Giardia lamblia
RGLIRAIIDDCEEQQQQ

SEQ ID NO: 3168237 - protein, 19 aa, Giardia lamblia
RGLKANLILSYMGLTEELH

SEQ ID NO: 3168238 - protein, 17 aa, Giardia lamblia
RGLRAIDYAKLFDNMEL

SEQ ID NO: 3168239 - protein, 22 aa, Giardia lamblia
RGLRPDALRKFILDQGPSRRNN

SEQ ID NO: 3168240 - protein, 29 aa, Giardia lamblia
RGLSKTRRALLRVFSRRAAETAATAISSS

SEQ ID NO: 3168241 - protein, 25 aa, Giardia lamblia
RGLSMKELKEDLMVLNVLNKELETK

SEQ ID NO: 3168242 - protein, 24 aa, Giardia lamblia
RGLTCLPENVILWISYLMIKTVKT

SEQ ID NO: 3168243 - protein, 18 aa, Giardia lamblia
RGLTHIVHLLKPYEQGLQ

SEQ ID NO: 3168244 - protein, 22 aa, Giardia lamblia
RGLVHCDLRPASTLVSVDGEYF

SEQ ID NO: 3168245 - protein, 20 aa, Giardia lamblia
RGLVWEDCIAMLSSNIQFCF

SEQ ID NO: 3168246 - protein, 21 aa, Giardia lamblia
RGLVYPVTLLRGSGFINGVEK

SEQ ID NO: 3168247 - protein, 23 aa, Giardia lamblia
RGLVYPVTLLRGSGFINGVEKTQ

SEQ ID NO: 3168248 - protein, 17 aa, Giardia lamblia
RGMTALMQAARYKHTDL

SEQ ID NO: 3168249 - protein, 25 aa, Giardia lamblia
RGMTSFLTSFNFRYAPPGASLSSAG

SEQ ID NO: 3168250 - protein, 18 aa, Giardia lamblia
RGNALMWISLKGELQIFS

SEQ ID NO: 3168251 - protein, 24 aa, Giardia lamblia
RGNLDCVKFLMSRESHEDMGPGSP

SEQ ID NO: 3168252 - protein, 19 aa, Giardia lamblia
RGNPELSKIYKIFQQDSYF

SEQ ID NO: 3168253 - protein, 27 aa, Giardia lamblia
RGNPGCTICVWCAIWMICKQYRESQAY

SEQ ID NO: 3168254 - protein, 26 aa, Giardia lamblia
RGNVNVVPFLLCEVGMKNNMGYSALM

SEQ ID NO: 3168255 - protein, 32 aa, Giardia lamblia
RGPDSRFRELLSGSGRPGFTSVTQPLAQQMQR

SEQ ID NO: 3168256 - protein, 21 aa, Giardia lamblia
RGPRRRGCKISSRLRPPCEGC

SEQ ID NO: 3168257 - protein, 18 aa, Giardia lamblia
RGPTRISSRLNDNVLSPL

SEQ ID NO: 3168258 - protein, 23 aa, Giardia lamblia
RGPWAELIKQLQLREDPLRIMGQ

SEQ ID NO: 3168259 - protein, 22 aa, Giardia lamblia
RGQKYAAIVQYVLRNHPQLEST

SEQ ID NO: 3168260 - protein, 18 aa, Giardia lamblia
RGRAGVLRIGDRRISVIL

SEQ ID NO: 3168261 - protein, 28 aa, Giardia lamblia
RGRGSAELAKACYWLKKARDFADNDSQR

SEQ ID NO: 3168262 - protein, 25 aa, Giardia lamblia
RGRILRVVGVLADFKSRRHPDLSRM

SEQ ID NO: 3168263 - protein, 17 aa, Giardia lamblia
RGRIRADQRAMSFHETL

SEQ ID NO: 3168264 - protein, 20 aa, Giardia lamblia
RGRLALAHHGWLYESSLPTP

SEQ ID NO: 3168265 - protein, 28 aa, Giardia lamblia
RGRREALCPGCLRHRPHGCRGERAPDEA

SEQ ID NO: 3168266 - protein, 28 aa, Giardia lamblia
RGRSCQRCGRPLYVPRLHLDASSQVLSA

SEQ ID NO: 3168267 - protein, 24 aa, Giardia lamblia
RGSAKEIMRFSARSVALALQPGNM

SEQ ID NO: 3168268 - protein, 18 aa, Giardia lamblia
RGSALYYRVLHMGVVDFL

SEQ ID NO: 3168269 - protein, 21 aa, Giardia lamblia
RGSEIAERLGLCRVTSETLAD

SEQ ID NO: 3168270 - protein, 24 aa, Giardia lamblia
RGSELELPCLLNIRKQTGLPNYVL

SEQ ID NO: 3168271 - protein, 17 aa, Giardia lamblia
RGSGIFWHDSLIHKDHS

SEQ ID NO: 3168272 - protein, 19 aa, Giardia lamblia
RGSIPVVELNSSTQATEHS

SEQ ID NO: 3168273 - protein, 24 aa, Giardia lamblia
RGSLEACALLLELESMILDGAGRS

SEQ ID NO: 3168274 - protein, 25 aa, Giardia lamblia
RGSPGYKLLSLILLKSQGKSVAHLT

SEQ ID NO: 3168275 - protein, 20 aa, Giardia lamblia
RGSVSAIRFLVDSEAQFRDH

SEQ ID NO: 3168276 - protein, 17 aa, Giardia lamblia
RGTCPGCHTADPRPRHE

SEQ ID NO: 3168277 - protein, 20 aa, Giardia lamblia
RGTDTLLYDNRVDSVTGVST

SEQ ID NO: 3168278 - protein, 23 aa, Giardia lamblia
RGTFIGDNCDLMLTNPQESSSKG

SEQ ID NO: 3168279 - protein, 30 aa, Giardia lamblia
RGTSRSSTWTSIRAAFAIAHMAAKANEHPT

SEQ ID NO: 3168280 - protein, 19 aa, Giardia lamblia
RGTTALMLAASRGHKEIVE

SEQ ID NO: 3168281 - protein, 18 aa, Giardia lamblia
RGTWFRFTYIEQMAVAFA

SEQ ID NO: 3168282 - protein, 20 aa, Giardia lamblia
RGVGFLPATMIKRLFDPIGL

SEQ ID NO: 3168283 - protein, 27 aa, Giardia lamblia
RGVKFTMPVLCRGPLDSASDLAFLKTG

SEQ ID NO: 3168284 - protein, 19 aa, Giardia lamblia
RGVLNLWRERISCMRHAES

SEQ ID NO: 3168285 - protein, 23 aa, Giardia lamblia
RGYDIKGSLCYSDVAILSLVSLF

SEQ ID NO: 3168286 - protein, 22 aa, Giardia lamblia
RGYEDCMNILLPYERDIKTVDG

SEQ ID NO: 3168287 - protein, 19 aa, Giardia lamblia
RGYFSVKIDDDISLDVEST

SEQ ID NO: 3168288 - protein, 20 aa, Giardia lamblia
RGYITTVILRVGSWRPRRPG

SEQ ID NO: 3168289 - protein, 23 aa, Giardia lamblia
RGYLQCVLLLIPIEARIQRTDGV

SEQ ID NO: 3168290 - protein, 20 aa, Giardia lamblia
RGYTALAIAALRNYSSVCLL

SEQ ID NO: 3168291 - protein, 19 aa, Giardia lamblia
RGYTDCVKLLMKKESRMQD

SEQ ID NO: 3168292 - protein, 24 aa, Giardia lamblia
RGYTHCGSLVPWVAGASADGQEWA

SEQ ID NO: 3168293 - protein, 19 aa, Giardia lamblia
RHAHWGMPGPSHYNPNAEP

SEQ ID NO: 3168294 - protein, 24 aa, Giardia lamblia
RHALEHPPPFYAMDLSSLAHLFTD

SEQ ID NO: 3168295 - protein, 17 aa, Giardia lamblia
RHARTCLETFLDLDSPG

SEQ ID NO: 3168296 - protein, 25 aa, Giardia lamblia
RHASSLKELMGFILGLDNRSGLDSL

SEQ ID NO: 3168297 - protein, 18 aa, Giardia lamblia
RHCYARNPLRATNCRRCR

SEQ ID NO: 3168298 - protein, 20 aa, Giardia lamblia
RHDEVRGIANLRDYAETLIK

SEQ ID NO: 3168299 - protein, 24 aa, Giardia lamblia
RHEAGNRNKLGWTALMQAVQDNNI

SEQ ID NO: 3168300 - protein, 24 aa, Giardia lamblia
RHEFIPIISSALFEDGDAIQMKPT

SEQ ID NO: 3168301 - protein, 23 aa, Giardia lamblia
RHENKKLLAKVEMLDTQLQETQK

SEQ ID NO: 3168302 - protein, 18 aa, Giardia lamblia
RHEYLHKLINDFKARSDA

SEQ ID NO: 3168303 - protein, 24 aa, Giardia lamblia
RHGCNDVLLSIVHHFPSHIDYNGY

SEQ ID NO: 3168304 - protein, 18 aa, Giardia lamblia
RHGKCPVIRAIEARKEIT

SEQ ID NO: 3168305 - protein, 18 aa, Giardia lamblia
RHGKGRYTMHCQEDMEDP

SEQ ID NO: 3168306 - protein, 23 aa, Giardia lamblia
RHGQKGIMGIRWRQTDMPFTSSG

SEQ ID NO: 3168307 - protein, 19 aa, Giardia lamblia
RHIALMVAVRLDLRLHTKN

SEQ ID NO: 3168308 - protein, 17 aa, Giardia lamblia
RHIKSVYRSTVLFRTPL

SEQ ID NO: 3168309 - protein, 18 aa, Giardia lamblia
RHKARVAMINVPDGQGLS

SEQ ID NO: 3168310 - protein, 20 aa, Giardia lamblia
RHKHMYPVFLSLYNKHIDSI

SEQ ID NO: 3168311 - protein, 19 aa, Giardia lamblia
RHLCRLDRTVPPDLCTIFM

SEQ ID NO: 3168312 - protein, 21 aa, Giardia lamblia
RHLDPLIAEMEFLEAEVEEKT

SEQ ID NO: 3168313 - protein, 24 aa, Giardia lamblia
RHLRDLASIFSLHLGFFGIPVLGS

SEQ ID NO: 3168314 - protein, 25 aa, Giardia lamblia
RHLREEKRRAALIVDRANYLEHVED

SEQ ID NO: 3168315 - protein, 27 aa, Giardia lamblia
RHNHDIPRHMEYAGCALTNGYTALMFA

SEQ ID NO: 3168316 - protein, 22 aa, Giardia lamblia
RHNRVLSAFAHHMAGDSSAKPM

SEQ ID NO: 3168317 - protein, 17 aa, Giardia lamblia
RHNSFSIPPSFFPIPDM

SEQ ID NO: 3168318 - protein, 25 aa, Giardia lamblia
RHPECPSLGMYARFNQPRDLPPPEW

SEQ ID NO: 3168319 - protein, 27 aa, Giardia lamblia
RHPEELDELCTLAWTTHVELLLTIAKW

SEQ ID NO: 3168320 - protein, 20 aa, Giardia lamblia
RHPILKDFLLISAPDMKIPF

SEQ ID NO: 3168321 - protein, 27 aa, Giardia lamblia
RHPVACAILELAARPLAAPSANMFGSI

SEQ ID NO: 3168322 - protein, 22 aa, Giardia lamblia
RHQQTLLRMCVLAPSDNAHEKL

SEQ ID NO: 3168323 - protein, 18 aa, Giardia lamblia
RHQVLKIFNVLGTLLEEN

SEQ ID NO: 3168324 - protein, 18 aa, Giardia lamblia
RHRIGECVWRTEGENGKD

SEQ ID NO: 3168325 - protein, 28 aa, Giardia lamblia
RHRRLYFPLSGRIDHEFLLLTKTNVSRC

SEQ ID NO: 3168326 - protein, 20 aa, Giardia lamblia
RHRYELYKNILASGDRQVNT

SEQ ID NO: 3168327 - protein, 22 aa, Giardia lamblia
RHTDLRVKAMEARRAAFVTQSK

SEQ ID NO: 3168328 - protein, 27 aa, Giardia lamblia
RHTTVPHLPPPLAIPPGFRGKTSEVPI

SEQ ID NO: 3168329 - protein, 18 aa, Giardia lamblia
RHVFPAYLSSIAGTRQCM

SEQ ID NO: 3168330 - protein, 17 aa, Giardia lamblia
RHVQLQFTARILCLLNF

SEQ ID NO: 3168331 - protein, 26 aa, Giardia lamblia
RHYSPRTECYLVMKGGPMLPGAVRAI

SEQ ID NO: 3168332 - protein, 17 aa, Giardia lamblia
RIAAKRAVLLGELATEF

SEQ ID NO: 3168333 - protein, 18 aa, Giardia lamblia
RIAAKYAEEHAVKGIISL

SEQ ID NO: 3168334 - protein, 18 aa, Giardia lamblia
RIADSCRYFESWFPASFM

SEQ ID NO: 3168335 - protein, 20 aa, Giardia lamblia
RIAELEAALEAAKEQLSEVL

SEQ ID NO: 3168336 - protein, 17 aa, Giardia lamblia
RIAEQLDGLIIVVPSTE

SEQ ID NO: 3168337 - protein, 17 aa, Giardia lamblia
RIAFEFRGFSQELCNLV

SEQ ID NO: 3168338 - protein, 17 aa, Giardia lamblia
RIAIDMCKEGMLTEEEA

SEQ ID NO: 3168339 - protein, 22 aa, Giardia lamblia
RIALVNELILAYGLDEHLNYYT

SEQ ID NO: 3168340 - protein, 31 aa, Giardia lamblia
RIAPARRSRALFRASTRLKSGITEDGAMQKR

SEQ ID NO: 3168341 - protein, 18 aa, Giardia lamblia
RIASSPISNVFIKHTPVA

SEQ ID NO: 3168342 - protein, 24 aa, Giardia lamblia
RIDGCAYLQPQWCFDSLNWGTTLP

SEQ ID NO: 3168343 - protein, 19 aa, Giardia lamblia
RIDIMRIDSLISFYEDCKD

SEQ ID NO: 3168344 - protein, 22 aa, Giardia lamblia
RIDKTNIGEFVFYGDLTPNIIS

SEQ ID NO: 3168345 - protein, 18 aa, Giardia lamblia
RIDRCQRDIMLFIDTFSG

SEQ ID NO: 3168346 - protein, 27 aa, Giardia lamblia
RIDYHNELRHPARIDCHLKQQGPKSLN

SEQ ID NO: 3168347 - protein, 17 aa, Giardia lamblia
RIEAIAILLNREGGLQN

SEQ ID NO: 3168348 - protein, 20 aa, Giardia lamblia
RIEASGGYVHGGRVMGTLSV

SEQ ID NO: 3168349 - protein, 18 aa, Giardia lamblia
RIEILMTVVVQFFERNGI

SEQ ID NO: 3168350 - protein, 21 aa, Giardia lamblia
RIELLDCGIKTLAQIQFISAF

SEQ ID NO: 3168351 - protein, 18 aa, Giardia lamblia
RIEQLIIRSLQAVANDMI

SEQ ID NO: 3168352 - protein, 25 aa, Giardia lamblia
RIFRLSQSCLLGLAGLQTDVLTTYR

SEQ ID NO: 3168353 - protein, 23 aa, Giardia lamblia
RIFTEVRTLFGIDGGSLEALLKH

SEQ ID NO: 3168354 - protein, 21 aa, Giardia lamblia
RIGDIYWNALMSIRDSSTSTK

SEQ ID NO: 3168355 - protein, 30 aa, Giardia lamblia
RIGDLANRCRPRCCVSVGNQLCLSATDCLE

SEQ ID NO: 3168356 - protein, 25 aa, Giardia lamblia
RIGFRCEYCGVVVSRTFCNICNTLC

SEQ ID NO: 3168357 - protein, 17 aa, Giardia lamblia
RIGLFKFYIDYKDSIIP

SEQ ID NO: 3168358 - protein, 19 aa, Giardia lamblia
RIGLLIPGIDGFSKADVPP

SEQ ID NO: 3168359 - protein, 21 aa, Giardia lamblia
RIGPETFFQSNLAAFTMLLDY

SEQ ID NO: 3168360 - protein, 24 aa, Giardia lamblia
RIGSAISPQLGILMRRISGDGAIY

SEQ ID NO: 3168361 - protein, 23 aa, Giardia lamblia
RIGSEKLLELALLKYRSALQLLV

SEQ ID NO: 3168362 - protein, 19 aa, Giardia lamblia
RIHAAYCKAQALPQTDMES

SEQ ID NO: 3168363 - protein, 17 aa, Giardia lamblia
RIHKDSDDLYVFALDSI

SEQ ID NO: 3168364 - protein, 28 aa, Giardia lamblia
RIHPLVINLRSAYPPKYIDSELIDVILR

SEQ ID NO: 3168365 - protein, 25 aa, Giardia lamblia
RIHTCAEHIMAFIAEHTRQATEIEG

SEQ ID NO: 3168366 - protein, 19 aa, Giardia lamblia
RIHTVFAAILINFTRCLEI

SEQ ID NO: 3168367 - protein, 19 aa, Giardia lamblia
RIIADLARCEKPFNCPHGR

SEQ ID NO: 3168368 - protein, 19 aa, Giardia lamblia
RIIAELCIAGPLSAETITR

SEQ ID NO: 3168369 - protein, 18 aa, Giardia lamblia
RIICEAIYTNALPIQISK

SEQ ID NO: 3168370 - protein, 19 aa, Giardia lamblia
RIIELARINTRLEQTNSEL

SEQ ID NO: 3168371 - protein, 24 aa, Giardia lamblia
RIIKDVYSLLDYALANRLYKFVVD

SEQ ID NO: 3168372 - protein, 18 aa, Giardia lamblia
RIIKKSCIDDETARQEIL

SEQ ID NO: 3168373 - protein, 17 aa, Giardia lamblia
RIIKLIVDINGNHCVQR

SEQ ID NO: 3168374 - protein, 25 aa, Giardia lamblia
RIIKLYWSIMRVLRTLYIGAGLVHG

SEQ ID NO: 3168375 - protein, 17 aa, Giardia lamblia
RIIRGGLPLSKFSASII

SEQ ID NO: 3168376 - protein, 21 aa, Giardia lamblia
RIKKWPLDKSSLFTTVTKLTS

SEQ ID NO: 3168377 - protein, 20 aa, Giardia lamblia
RIKMLNKMERLFVSEDYAVP

SEQ ID NO: 3168378 - protein, 19 aa, Giardia lamblia
RILAAVGLLQNFAALQALV

SEQ ID NO: 3168379 - protein, 26 aa, Giardia lamblia
RILASRIPGPMIGYFRRQMLLVKGTP

SEQ ID NO: 3168380 - protein, 17 aa, Giardia lamblia
RILEAVVIELINILQTG

SEQ ID NO: 3168381 - protein, 19 aa, Giardia lamblia
RILFCNLHLSANRTPDGPK

SEQ ID NO: 3168382 - protein, 19 aa, Giardia lamblia
RILFGPSPLDFALPLETKA

SEQ ID NO: 3168383 - protein, 20 aa, Giardia lamblia
RILGSSFDWSRSVFTLDPAR

SEQ ID NO: 3168384 - protein, 17 aa, Giardia lamblia
RILIPMLEYNGHAPHVI

SEQ ID NO: 3168385 - protein, 19 aa, Giardia lamblia
RILLEKEAGISTNWGSTAL

SEQ ID NO: 3168386 - protein, 17 aa, Giardia lamblia
RILLPFNSIPLSLTEAT

SEQ ID NO: 3168387 - protein, 20 aa, Giardia lamblia
RILNALWYLHDLYIIHRDIK

SEQ ID NO: 3168388 - protein, 27 aa, Giardia lamblia
RILNMMARSKLGAMAQLNAITASMTES

SEQ ID NO: 3168389 - protein, 27 aa, Giardia lamblia
RILRAIRFSKRLGFELDKKMYQAVESK

SEQ ID NO: 3168390 - protein, 29 aa, Giardia lamblia
RILRLSLSCTAAFRWNRAIHGESMDFLVI

SEQ ID NO: 3168391 - protein, 26 aa, Giardia lamblia
RILSRQEYKLGLNWRDNHAGVLIDRI

SEQ ID NO: 3168392 - protein, 17 aa, Giardia lamblia
RIMDATCPVVYPKLDPC

SEQ ID NO: 3168393 - protein, 27 aa, Giardia lamblia
RIMEWDWRGSYYPLDFSEYLMIKNQTI

SEQ ID NO: 3168394 - protein, 23 aa, Giardia lamblia
RIMKKDRVSSRMSQNRLKNPVKQ

SEQ ID NO: 3168395 - protein, 19 aa, Giardia lamblia
RIMLTSVIISSRLLIDNPP

SEQ ID NO: 3168396 - protein, 29 aa, Giardia lamblia
RIMSRPYHHYTFSFDVLKYARILNLSQIT

SEQ ID NO: 3168397 - protein, 21 aa, Giardia lamblia
RINDLEMIRLLAPEESGVTNR

SEQ ID NO: 3168398 - protein, 18 aa, Giardia lamblia
RINFYLREGVLPTPKVAP

SEQ ID NO: 3168399 - protein, 18 aa, Giardia lamblia
RINKAENAITCFNEDVSS

SEQ ID NO: 3168400 - protein, 24 aa, Giardia lamblia
RINLPLHWINASIQYELTRWNDFT

SEQ ID NO: 3168401 - protein, 19 aa, Giardia lamblia
RINTIMILFFLKLGLSKLL

SEQ ID NO: 3168402 - protein, 18 aa, Giardia lamblia
RIPAPAAIQPSYFDRATS

SEQ ID NO: 3168403 - protein, 25 aa, Giardia lamblia
RIPGKGKTKHIVFCDDKRIDISRRE

SEQ ID NO: 3168404 - protein, 20 aa, Giardia lamblia
RIPHEYQLAYGCNNLNLGNN

SEQ ID NO: 3168405 - protein, 19 aa, Giardia lamblia
RIPLPNKILVFIAPFTAIN

SEQ ID NO: 3168406 - protein, 17 aa, Giardia lamblia
RIPNMIVPVTKSLETDF

SEQ ID NO: 3168407 - protein, 19 aa, Giardia lamblia
RIPSLDFHRDQGCSTSEST

SEQ ID NO: 3168408 - protein, 25 aa, Giardia lamblia
RIPTVLCACQICYEGKLKQNIVKEA

SEQ ID NO: 3168409 - protein, 32 aa, Giardia lamblia
RIPVRGCTCKHPACFDLETFVTYACETDKWNC

SEQ ID NO: 3168410 - protein, 18 aa, Giardia lamblia
RIQCMQKLSDHYSRLHDS

SEQ ID NO: 3168411 - protein, 18 aa, Giardia lamblia
RIQDLAVRGKALKALVDW

SEQ ID NO: 3168412 - protein, 27 aa, Giardia lamblia
RIQRQLGCPARFPTFLLVEDPQLLLIH

SEQ ID NO: 3168413 - protein, 24 aa, Giardia lamblia
RIQTYPAMEICFSITKSNGSNSDS

SEQ ID NO: 3168414 - protein, 24 aa, Giardia lamblia
RIRHIPLDSVRLALRVQTPLTVTF

SEQ ID NO: 3168415 - protein, 18 aa, Giardia lamblia
RIRHSTIRKLGGRVETAR

SEQ ID NO: 3168416 - protein, 18 aa, Giardia lamblia
RIRHVFIDYYLADRTIQI

SEQ ID NO: 3168417 - protein, 18 aa, Giardia lamblia
RIRIEKLVLNICIGGEGD

SEQ ID NO: 3168418 - protein, 25 aa, Giardia lamblia
RIRLKREIEILPHLVHKHVVRYLES

SEQ ID NO: 3168419 - protein, 21 aa, Giardia lamblia
RIRSKFKMVIKTSSLANLPYN

SEQ ID NO: 3168420 - protein, 19 aa, Giardia lamblia
RIRTIPFFHIRNQGKYTQF

SEQ ID NO: 3168421 - protein, 19 aa, Giardia lamblia
RISEEIIKDIFYQLIKAVA

SEQ ID NO: 3168422 - protein, 18 aa, Giardia lamblia
RISISELVLHPRISAAFK

SEQ ID NO: 3168423 - protein, 24 aa, Giardia lamblia
RISKLIDLFFADYFVDSYEDSDID

SEQ ID NO: 3168424 - protein, 24 aa, Giardia lamblia
RISKNCLRPTRYWNTSEYTIITQA

SEQ ID NO: 3168425 - protein, 25 aa, Giardia lamblia
RISSRDCRLIRRIVRDNNFRGFTAE

SEQ ID NO: 3168426 - protein, 19 aa, Giardia lamblia
RISTHPGVQGLLVLMDDGT

SEQ ID NO: 3168427 - protein, 27 aa, Giardia lamblia
RISTPRIAVTIAEYFAYTLGYHVLVLL

SEQ ID NO: 3168428 - protein, 27 aa, Giardia lamblia
RITELEAKIPFCLRPINVNNEEVLSRT

SEQ ID NO: 3168429 - protein, 21 aa, Giardia lamblia
RITFEFPTFHLVGLLWGVRWG

SEQ ID NO: 3168430 - protein, 21 aa, Giardia lamblia
RITIQYKEAYVWSTALYLSCT

SEQ ID NO: 3168431 - protein, 19 aa, Giardia lamblia
RITKLLAPIEHGICNDRGE

SEQ ID NO: 3168432 - protein, 19 aa, Giardia lamblia
RITMLPIDNLVAFYKAAKE

SEQ ID NO: 3168433 - protein, 18 aa, Giardia lamblia
RITREIQILKLLNHPNVI

SEQ ID NO: 3168434 - protein, 22 aa, Giardia lamblia
RITRRSVSLAAMGRSATVGSLR

SEQ ID NO: 3168435 - protein, 17 aa, Giardia lamblia
RITSCTSPEAFIYQLRR

SEQ ID NO: 3168436 - protein, 20 aa, Giardia lamblia
RITVMPLLHILELYRDNLKK

SEQ ID NO: 3168437 - protein, 25 aa, Giardia lamblia
RITYCGQHAPGHLCNLSRSSLTLPT

SEQ ID NO: 3168438 - protein, 20 aa, Giardia lamblia
RITYKRSFSAQSFLSNMRML

SEQ ID NO: 3168439 - protein, 24 aa, Giardia lamblia
RITYQIAAVLSFLSSGLISIGNAP

SEQ ID NO: 3168440 - protein, 19 aa, Giardia lamblia
RIVAEASLITLRLEVASYF

SEQ ID NO: 3168441 - protein, 20 aa, Giardia lamblia
RIVDGCLWKHQTSLAPPLYT

SEQ ID NO: 3168442 - protein, 27 aa, Giardia lamblia
RIVLLKKRIPVINALTRYGRRFLSNVK

SEQ ID NO: 3168443 - protein, 19 aa, Giardia lamblia
RIVLPNGKTAMMIAATQNH

SEQ ID NO: 3168444 - protein, 25 aa, Giardia lamblia
RIVPPRGPQTFGWDCIFEPLEGGGK

SEQ ID NO: 3168445 - protein, 21 aa, Giardia lamblia
RIVRQRLALFYPDGAARNSIL

SEQ ID NO: 3168446 - protein, 25 aa, Giardia lamblia
RIWDLKDFYPGLTIDVSPNSPSAVY

SEQ ID NO: 3168447 - protein, 17 aa, Giardia lamblia
RIWKEVHPGSRVFYMNG

SEQ ID NO: 3168448 - protein, 31 aa, Giardia lamblia
RIYDRIPPFPGCEAHYLRCIITRIKHGAELA

SEQ ID NO: 3168449 - protein, 19 aa, Giardia lamblia
RIYENWRDYFLFLYNVKGH

SEQ ID NO: 3168450 - protein, 28 aa, Giardia lamblia
RIYGVFELQGLPAFREYLTKLIYQLSIS

SEQ ID NO: 3168451 - protein, 22 aa, Giardia lamblia
RIYQVIDLVGYVFLPHTHVPQE

SEQ ID NO: 3168452 - protein, 26 aa, Giardia lamblia
RKAAELCLQCGVASSLTHLGYMLCRD

SEQ ID NO: 3168453 - protein, 26 aa, Giardia lamblia
RKAAFRKVRPFAECLAEEIMNAAAGA

SEQ ID NO: 3168454 - protein, 18 aa, Giardia lamblia
RKAAKIFIINGPKYHNPS

SEQ ID NO: 3168455 - protein, 17 aa, Giardia lamblia
RKAALEFILTREANFRG

SEQ ID NO: 3168456 - protein, 19 aa, Giardia lamblia
RKADLLREAMEKEQLERIE

SEQ ID NO: 3168457 - protein, 31 aa, Giardia lamblia
RKAKLFMLPFAWNLDRIKAIPKSLHTDALAS

SEQ ID NO: 3168458 - protein, 18 aa, Giardia lamblia
RKALACAVSETVLDQLGG

SEQ ID NO: 3168459 - protein, 18 aa, Giardia lamblia
RKALDVEHLLQEDIRASQ

SEQ ID NO: 3168460 - protein, 19 aa, Giardia lamblia
RKALLLGLLSSNSIEQDHP

SEQ ID NO: 3168461 - protein, 23 aa, Giardia lamblia
RKAPELYCQAGVYYEFQVRDKSR

SEQ ID NO: 3168462 - protein, 20 aa, Giardia lamblia
RKAPFLRYILFKYKQRDLAI

SEQ ID NO: 3168463 - protein, 18 aa, Giardia lamblia
RKAPKAWCSDNKQELVRQ

SEQ ID NO: 3168464 - protein, 28 aa, Giardia lamblia
RKAQELLAKHALAWEANMERASILRKDT

SEQ ID NO: 3168465 - protein, 29 aa, Giardia lamblia
RKAQSTLLKCLRRENSFLRVAASQHQEFH

SEQ ID NO: 3168466 - protein, 18 aa, Giardia lamblia
RKAVEEMADLEYNQKQHL

SEQ ID NO: 3168467 - protein, 36 aa, Giardia lamblia
RKAVVDPRCQYAIPLREDILYVLRKCCIGEDSDKMD

SEQ ID NO: 3168468 - protein, 20 aa, Giardia lamblia
RKDCDDRLRVLMTELNEAKR

SEQ ID NO: 3168469 - protein, 26 aa, Giardia lamblia
RKDDKGRTALMIAARSGHEDIVMHLL

SEQ ID NO: 3168470 - protein, 22 aa, Giardia lamblia
RKDEYYYLLEMELCDQSLEDVI

SEQ ID NO: 3168471 - protein, 17 aa, Giardia lamblia
RKDGWSALMSAARAGLP

SEQ ID NO: 3168472 - protein, 17 aa, Giardia lamblia
RKDMIRLLYPYEHGLLP

SEQ ID NO: 3168473 - protein, 25 aa, Giardia lamblia
RKDNARCLRFYKSIGMGYHTPITAI

SEQ ID NO: 3168474 - protein, 20 aa, Giardia lamblia
RKDQHGFTALIYATRVKSLE

SEQ ID NO: 3168475 - protein, 26 aa, Giardia lamblia
RKDSFIKRRARFVGPNAQTLKAIELL

SEQ ID NO: 3168476 - protein, 37 aa, Giardia lamblia
RKDVLKKPAALLPQHFEVLDLAPMLQRNVTRGKPQSG

SEQ ID NO: 3168477 - protein, 21 aa, Giardia lamblia
RKEAAAYWIIRVYKGHDSYTL

SEQ ID NO: 3168478 - protein, 19 aa, Giardia lamblia
RKEELRALLAEKPDPSKIS

SEQ ID NO: 3168479 - protein, 35 aa, Giardia lamblia
RKEGVALRPGEKVKLWGTLMPIPVVDTIYRINSVF

SEQ ID NO: 3168480 - protein, 24 aa, Giardia lamblia
RKEGVGNMERVACILYQRALCERD

SEQ ID NO: 3168481 - protein, 18 aa, Giardia lamblia
RKEHKAYAVAVLGPQLKV

SEQ ID NO: 3168482 - protein, 22 aa, Giardia lamblia
RKELSSFGALAYKISKDQLDLS

SEQ ID NO: 3168483 - protein, 19 aa, Giardia lamblia
RKERGLKDKSGWTALMHAA

SEQ ID NO: 3168484 - protein, 37 aa, Giardia lamblia
RKFFSLYGLCKESYRICLTRTPYFMKVLECLKGLSNT

SEQ ID NO: 3168485 - protein, 36 aa, Giardia lamblia
RKFGGCPHGGMGLGLERFICWLLGIYTVRDTVLYPR

SEQ ID NO: 3168486 - protein, 20 aa, Giardia lamblia
RKFGPLGYNISYDFTSGDLD

SEQ ID NO: 3168487 - protein, 24 aa, Giardia lamblia
RKFIFPCVRAGYTPGVVAGLSSIA

SEQ ID NO: 3168488 - protein, 19 aa, Giardia lamblia
RKFKGSAFIVFSTLEDCEE

SEQ ID NO: 3168489 - protein, 17 aa, Giardia lamblia
RKFKITVRVEDVPNVRV

SEQ ID NO: 3168490 - protein, 24 aa, Giardia lamblia
RKFRDCGQLEVGPRGRRSKKVVSP

SEQ ID NO: 3168491 - protein, 22 aa, Giardia lamblia
RKGEQFCPASCFGCESHSTALH

SEQ ID NO: 3168492 - protein, 20 aa, Giardia lamblia
RKGGGCIVLSRSSHVIVTAS

SEQ ID NO: 3168493 - protein, 28 aa, Giardia lamblia
RKGGGRPSSGITTWRDDLSINYTTRDMY

SEQ ID NO: 3168494 - protein, 25 aa, Giardia lamblia
RKGKLRSSYDFKIKMNVTYKAADKD

SEQ ID NO: 3168495 - protein, 19 aa, Giardia lamblia
RKGRLVEINKSYYLLSAPE

SEQ ID NO: 3168496 - protein, 20 aa, Giardia lamblia
RKGYARCLRGLLDTEQEFLP

SEQ ID NO: 3168497 - protein, 19 aa, Giardia lamblia
RKHAMFLLRLNKLGANVLP

SEQ ID NO: 3168498 - protein, 17 aa, Giardia lamblia
RKHPRIQTVIERLTAHA

SEQ ID NO: 3168499 - protein, 28 aa, Giardia lamblia
RKIATGASRSWRLIGWGKIQDNPDWENL

SEQ ID NO: 3168500 - protein, 31 aa, Giardia lamblia
RKIESVGFLHYIRILALLQMNQLPLVKREMG

SEQ ID NO: 3168501 - protein, 32 aa, Giardia lamblia
RKIFRELFVREGFSYDYVFDWTLLGIDVDKYH

SEQ ID NO: 3168502 - protein, 24 aa, Giardia lamblia
RKIFWNGGFVVGWFIAHPVQGPKI

SEQ ID NO: 3168503 - protein, 26 aa, Giardia lamblia
RKIGDLDLACVLFGGRIKDERGRKLA

SEQ ID NO: 3168504 - protein, 19 aa, Giardia lamblia
RKIGRYIVNAMKLNMFILE

SEQ ID NO: 3168505 - protein, 19 aa, Giardia lamblia
RKIHAEMPALLSFFDRFCA

SEQ ID NO: 3168506 - protein, 17 aa, Giardia lamblia
RKIHARFKESLGKLDDF

SEQ ID NO: 3168507 - protein, 18 aa, Giardia lamblia
RKILCACLVEDPASRADC

SEQ ID NO: 3168508 - protein, 20 aa, Giardia lamblia
RKILSCLARLYSGSGARSVY

SEQ ID NO: 3168509 - protein, 20 aa, Giardia lamblia
RKILTYKRFLEFDHGKRGRE

SEQ ID NO: 3168510 - protein, 17 aa, Giardia lamblia
RKIPVQILYINKKVHLV

SEQ ID NO: 3168511 - protein, 18 aa, Giardia lamblia
RKIQVAIENKYPSKQAAM

SEQ ID NO: 3168512 - protein, 25 aa, Giardia lamblia
RKIRGLFPLCLIGSLEITNRLSQAF

SEQ ID NO: 3168513 - protein, 19 aa, Giardia lamblia
RKISELTRDYGIRTIGLLS

SEQ ID NO: 3168514 - protein, 18 aa, Giardia lamblia
RKISHLQTQLAQREEKIE

SEQ ID NO: 3168515 - protein, 18 aa, Giardia lamblia
RKITEPWHLSVYVGETVE

SEQ ID NO: 3168516 - protein, 18 aa, Giardia lamblia
RKIVCPPSLGGRYSAPMC

SEQ ID NO: 3168517 - protein, 20 aa, Giardia lamblia
RKIVQEVATYIGAAATSTDK

SEQ ID NO: 3168518 - protein, 19 aa, Giardia lamblia
RKKEEAVALKQEYDRDMHF

SEQ ID NO: 3168519 - protein, 23 aa, Giardia lamblia
RKKNLFKLVLLGAPGAGKGTQAK

SEQ ID NO: 3168520 - protein, 19 aa, Giardia lamblia
RKKQKIARDFIKENKWLAA

SEQ ID NO: 3168521 - protein, 25 aa, Giardia lamblia
RKKYLDGFICITGRTLRVFDEKKRF

SEQ ID NO: 3168522 - protein, 20 aa, Giardia lamblia
RKLAMVPCFVLSRRLYDYHF

SEQ ID NO: 3168523 - protein, 30 aa, Giardia lamblia
RKLAPPESILKCHYMDEAIDMLKGEESFKR

SEQ ID NO: 3168524 - protein, 17 aa, Giardia lamblia
RKLARYEALIKDSTGKS

SEQ ID NO: 3168525 - protein, 17 aa, Giardia lamblia
RKLAYIVTPDFGDCSLA

SEQ ID NO: 3168526 - protein, 23 aa, Giardia lamblia
RKLDECRAELAASQEAAHTHAAS

SEQ ID NO: 3168527 - protein, 22 aa, Giardia lamblia
RKLEDLQSLYAYNAKNEEVLRN

SEQ ID NO: 3168528 - protein, 18 aa, Giardia lamblia
RKLFPSGHRANVGNSPTL

SEQ ID NO: 3168529 - protein, 22 aa, Giardia lamblia
RKLIDFLVSLECYPRNELILTL

SEQ ID NO: 3168530 - protein, 21 aa, Giardia lamblia
RKLKILMEHFPKQVAPMKKYD

SEQ ID NO: 3168531 - protein, 17 aa, Giardia lamblia
RKLKITVTTAIRLLFVD

SEQ ID NO: 3168532 - protein, 21 aa, Giardia lamblia
RKLLEARRPSAVIAGEYVGTS

SEQ ID NO: 3168533 - protein, 22 aa, Giardia lamblia
RKLLSLEEIVSFIGRELPDVWS

SEQ ID NO: 3168534 - protein, 18 aa, Giardia lamblia
RKLLVVCPEKRISISELV

SEQ ID NO: 3168535 - protein, 18 aa, Giardia lamblia
RKLPGMQLTIKDHSTHHS

SEQ ID NO: 3168536 - protein, 17 aa, Giardia lamblia
RKLRLVVKQYSFTQAIV

SEQ ID NO: 3168537 - protein, 19 aa, Giardia lamblia
RKLYTAARHDGVSCLCEEV

SEQ ID NO: 3168538 - protein, 23 aa, Giardia lamblia
RKMEVKFGLCINAVESRNQKRSK

SEQ ID NO: 3168539 - protein, 19 aa, Giardia lamblia
RKMSTIKWIIDPFNADAPV

SEQ ID NO: 3168540 - protein, 20 aa, Giardia lamblia
RKNLPPLFCLEVGAEEATLV

SEQ ID NO: 3168541 - protein, 19 aa, Giardia lamblia
RKPAEVFVDDWSPNLSAIK

SEQ ID NO: 3168542 - protein, 23 aa, Giardia lamblia
RKPAMCRGCNTIGTLVPTGDRSG

SEQ ID NO: 3168543 - protein, 19 aa, Giardia lamblia
RKPDVYSDFELARMRLQAT

SEQ ID NO: 3168544 - protein, 18 aa, Giardia lamblia
RKPGCTDMTLPYIEQPTS

SEQ ID NO: 3168545 - protein, 24 aa, Giardia lamblia
RKPKRRDVTSLIGLAQFSLNNRLK

SEQ ID NO: 3168546 - protein, 24 aa, Giardia lamblia
RKPMMPRRGIGKGRGKGKLAEPVR

SEQ ID NO: 3168547 - protein, 24 aa, Giardia lamblia
RKPPYKRVSSTLVLTKENATTPHH

SEQ ID NO: 3168548 - protein, 30 aa, Giardia lamblia
RKPRATTRSALWLHKLISAITSDRYKELFL

SEQ ID NO: 3168549 - protein, 19 aa, Giardia lamblia
RKPVELQRNPSYELDTIAN

SEQ ID NO: 3168550 - protein, 19 aa, Giardia lamblia
RKQAMLVDELIDFVKEKYR

SEQ ID NO: 3168551 - protein, 21 aa, Giardia lamblia
RKQCKECFIRYDAAPATGRVW

SEQ ID NO: 3168552 - protein, 20 aa, Giardia lamblia
RKQEILKLRALIRKLEAGSV

SEQ ID NO: 3168553 - protein, 32 aa, Giardia lamblia
RKQISWFNCLIDYGFPCVVRGYSQTKIGILLD

SEQ ID NO: 3168554 - protein, 20 aa, Giardia lamblia
RKQKKALPKGMEPVPKEHVA

SEQ ID NO: 3168555 - protein, 17 aa, Giardia lamblia
RKQLDSMAHNFSESTKR

SEQ ID NO: 3168556 - protein, 26 aa, Giardia lamblia
RKQLFTVEMFLPHLHRLIEAENNHQP

SEQ ID NO: 3168557 - protein, 26 aa, Giardia lamblia
RKQMEKFLRNPKFIGVEFPTSRPEGL

SEQ ID NO: 3168558 - protein, 28 aa, Giardia lamblia
RKQMPPIDWEKVYVMRKQISWFNCLIDY

SEQ ID NO: 3168559 - protein, 24 aa, Giardia lamblia
RKQNELWHSFVWNYDRLPYSADFM

SEQ ID NO: 3168560 - protein, 24 aa, Giardia lamblia
RKQPRPATPPDQWPLDIYKNPSPE

SEQ ID NO: 3168561 - protein, 19 aa, Giardia lamblia
RKQQYPVFRLKDNSSPEEF

SEQ ID NO: 3168562 - protein, 23 aa, Giardia lamblia
RKQRWKPHYIFIKITTSSKIMTD

SEQ ID NO: 3168563 - protein, 25 aa, Giardia lamblia
RKQSMPRRLILEVVHQISSALAYLH

SEQ ID NO: 3168564 - protein, 21 aa, Giardia lamblia
RKRAKKAISEIISQFIFPYCG

SEQ ID NO: 3168565 - protein, 22 aa, Giardia lamblia
RKRAYTELLSFIQIYTALDHRG

SEQ ID NO: 3168566 - protein, 17 aa, Giardia lamblia
RKRCMAEIVQTVLNEDK

SEQ ID NO: 3168567 - protein, 22 aa, Giardia lamblia
RKRDECCDMVVNFLRDHMSEVH

SEQ ID NO: 3168568 - protein, 21 aa, Giardia lamblia
RKREYLCRIVSNSVCGIDMDR

SEQ ID NO: 3168569 - protein, 26 aa, Giardia lamblia
RKRFTVKECLDHSWLNPSKYFIPESL

SEQ ID NO: 3168570 - protein, 21 aa, Giardia lamblia
RKRKEFPRDKIIEVLLQVTTG

SEQ ID NO: 3168571 - protein, 22 aa, Giardia lamblia
RKRLATTLPLIFRQTSLANLLI

SEQ ID NO: 3168572 - protein, 17 aa, Giardia lamblia
RKRLGVLTYGHPIRIEC

SEQ ID NO: 3168573 - protein, 23 aa, Giardia lamblia
RKRLLKYVYEHIVKKSGDVAETE

SEQ ID NO: 3168574 - protein, 19 aa, Giardia lamblia
RKRLLPLLEKVCADPQVEG

SEQ ID NO: 3168575 - protein, 18 aa, Giardia lamblia
RKRPRAEQLANLERQRLI

SEQ ID NO: 3168576 - protein, 20 aa, Giardia lamblia
RKRQASFEDIREEVKKSADN

SEQ ID NO: 3168577 - protein, 28 aa, Giardia lamblia
RKRRHEPPRTSVRLDVMGPYTIGSLNYP

SEQ ID NO: 3168578 - protein, 25 aa, Giardia lamblia
RKRRRRGRASGRVMLAEDVLALEGF

SEQ ID NO: 3168579 - protein, 20 aa, Giardia lamblia
RKRSHSQGRMSTRTNHKVSS

SEQ ID NO: 3168580 - protein, 19 aa, Giardia lamblia
RKRSMIFLSKLTEIVRKQR

SEQ ID NO: 3168581 - protein, 18 aa, Giardia lamblia
RKRVCGRTGVPGASDDTL

SEQ ID NO: 3168582 - protein, 21 aa, Giardia lamblia
RKRVSFPRFYFLSNDELLEIL

SEQ ID NO: 3168583 - protein, 21 aa, Giardia lamblia
RKRWVEATVLIIDECSMLQGT

SEQ ID NO: 3168584 - protein, 21 aa, Giardia lamblia
RKRYAVVLFDEIEKAHPKILT

SEQ ID NO: 3168585 - protein, 19 aa, Giardia lamblia
RKSDIWSLGIMLYAMLIGK

SEQ ID NO: 3168586 - protein, 17 aa, Giardia lamblia
RKSESKLGPKHVSPIMS

SEQ ID NO: 3168587 - protein, 24 aa, Giardia lamblia
RKSGECACMLALQANNLSVAKELL

SEQ ID NO: 3168588 - protein, 17 aa, Giardia lamblia
RKSMTPLTFEVKVAKDE

SEQ ID NO: 3168589 - protein, 19 aa, Giardia lamblia
RKSNKGWTALIMAAQNGHA

SEQ ID NO: 3168590 - protein, 18 aa, Giardia lamblia
RKSTGICMVDRIFEHRKT

SEQ ID NO: 3168591 - protein, 20 aa, Giardia lamblia
RKSYVEKYPLLKYVPADIDP

SEQ ID NO: 3168592 - protein, 28 aa, Giardia lamblia
RKTERKTEFCLLTPMATYDHIMSSLQDH

SEQ ID NO: 3168593 - protein, 19 aa, Giardia lamblia
RKTETLMDFRVELIHLLGG

SEQ ID NO: 3168594 - protein, 18 aa, Giardia lamblia
RKTFENRYLPFLQLPDTR

SEQ ID NO: 3168595 - protein, 24 aa, Giardia lamblia
RKTILYTLAGWLTRAGVTTIVADY

SEQ ID NO: 3168596 - protein, 18 aa, Giardia lamblia
RKTITPRLLDATEIYNQY

SEQ ID NO: 3168597 - protein, 23 aa, Giardia lamblia
RKTPNHCLLRLDLASGESSPKTI

SEQ ID NO: 3168598 - protein, 19 aa, Giardia lamblia
RKTSIYANKGFIYTDSDKL

SEQ ID NO: 3168599 - protein, 20 aa, Giardia lamblia
RKTSPIGFTALMYAAINNSI

SEQ ID NO: 3168600 - protein, 28 aa, Giardia lamblia
RKTSSFIPVPVRRSDPILERCYVPTVDS

SEQ ID NO: 3168601 - protein, 19 aa, Giardia lamblia
RKVHGYNTLLTCFAVNDAN

SEQ ID NO: 3168602 - protein, 25 aa, Giardia lamblia
RKVKEEFGDIFELVRERELKKANEE

SEQ ID NO: 3168603 - protein, 17 aa, Giardia lamblia
RKVKTMKLFEGHKYNRH

SEQ ID NO: 3168604 - protein, 21 aa, Giardia lamblia
RKVSEFFKQKGLTTMNPDESV

SEQ ID NO: 3168605 - protein, 19 aa, Giardia lamblia
RKVWRRKDGVWIYFQDNAG

SEQ ID NO: 3168606 - protein, 19 aa, Giardia lamblia
RKVYLPGTVFEGLVEDSYR

SEQ ID NO: 3168607 - protein, 17 aa, Giardia lamblia
RKWAVLPCSAMSRQGLD

SEQ ID NO: 3168608 - protein, 20 aa, Giardia lamblia
RKWIERKYVKQEWARRPDQP

SEQ ID NO: 3168609 - protein, 17 aa, Giardia lamblia
RKYGAAGLPGWTPQMSA

SEQ ID NO: 3168610 - protein, 20 aa, Giardia lamblia
RKYKAHTISGIFGAAIPRIL

SEQ ID NO: 3168611 - protein, 27 aa, Giardia lamblia
RKYKMLLWNLSLFFSVVLERRRFGTIG

SEQ ID NO: 3168612 - protein, 17 aa, Giardia lamblia
RKYLFMSSTPIIKDKSI

SEQ ID NO: 3168613 - protein, 19 aa, Giardia lamblia
RKYLQLGLDYIFIKYLLLQ

SEQ ID NO: 3168614 - protein, 18 aa, Giardia lamblia
RKYSALRALFSHAVEIND

SEQ ID NO: 3168615 - protein, 20 aa, Giardia lamblia
RLAADVLKCGKRRVRFNPAH

SEQ ID NO: 3168616 - protein, 18 aa, Giardia lamblia
RLAAKLAAVSFQGNGIID

SEQ ID NO: 3168617 - protein, 18 aa, Giardia lamblia
RLAAMAGPNRTDGTSKPT

SEQ ID NO: 3168618 - protein, 17 aa, Giardia lamblia
RLADALLQLKRLETETT

SEQ ID NO: 3168619 - protein, 20 aa, Giardia lamblia
RLAEELALKLNRAEKLISGL

SEQ ID NO: 3168620 - protein, 19 aa, Giardia lamblia
RLAEKDARIKDLVEKDKKN

SEQ ID NO: 3168621 - protein, 18 aa, Giardia lamblia
RLAGSLGTSSRLRLESMV

SEQ ID NO: 3168622 - protein, 18 aa, Giardia lamblia
RLAHGRGLALLQPAVLKH

SEQ ID NO: 3168623 - protein, 17 aa, Giardia lamblia
RLAHLLSTLVERMRLEP

SEQ ID NO: 3168624 - protein, 26 aa, Giardia lamblia
RLALMYEMICHAFTNLPLYNPATNTW

SEQ ID NO: 3168625 - protein, 19 aa, Giardia lamblia
RLANEAFRYDGWSSNIISI

SEQ ID NO: 3168626 - protein, 20 aa, Giardia lamblia
RLANLKALLATHGDAEFLAL

SEQ ID NO: 3168627 - protein, 17 aa, Giardia lamblia
RLANLPLLQGIYQTENQ

SEQ ID NO: 3168628 - protein, 24 aa, Giardia lamblia
RLARELEETRIAKVVTESGRNNLV

SEQ ID NO: 3168629 - protein, 28 aa, Giardia lamblia
RLASSVFGRPAVLPSMSLIGRELARVKD

SEQ ID NO: 3168630 - protein, 20 aa, Giardia lamblia
RLATDSFVFSVPFLAITGIA

SEQ ID NO: 3168631 - protein, 20 aa, Giardia lamblia
RLATPYDIIRTPSLQLIPPS

SEQ ID NO: 3168632 - protein, 19 aa, Giardia lamblia
RLATVLGIIRKYLSKTATC

SEQ ID NO: 3168633 - protein, 19 aa, Giardia lamblia
RLAVDSGYYFSVRKRILKN

SEQ ID NO: 3168634 - protein, 18 aa, Giardia lamblia
RLAYAHFPIAATVVDNNK

SEQ ID NO: 3168635 - protein, 26 aa, Giardia lamblia
RLDATDIYLIFSLVIANTWNLRVLFL

SEQ ID NO: 3168636 - protein, 19 aa, Giardia lamblia
RLDIIKLLIDQEAQMSTTD

SEQ ID NO: 3168637 - protein, 40 aa, Giardia lamblia
RLDLNRIERVCRFMSNTTLREWRRIFSFVAKQGKNKGTTN

SEQ ID NO: 3168638 - protein, 18 aa, Giardia lamblia
RLDNGWTALMMAAQNGFL

SEQ ID NO: 3168639 - protein, 19 aa, Giardia lamblia
RLDQICGIPVVYKKKKKSQ

SEQ ID NO: 3168640 - protein, 20 aa, Giardia lamblia
RLDSNTVLYIRKGRFFELYE

SEQ ID NO: 3168641 - protein, 18 aa, Giardia lamblia
RLEAIKCLPSLAEHVFVT

SEQ ID NO: 3168642 - protein, 25 aa, Giardia lamblia
RLEDKICTCSADVARLTEERDGLRQ

SEQ ID NO: 3168643 - protein, 19 aa, Giardia lamblia
RLEESIATKLQSKFADDSC

SEQ ID NO: 3168644 - protein, 17 aa, Giardia lamblia
RLEKEVQANSPLMYIYL

SEQ ID NO: 3168645 - protein, 26 aa, Giardia lamblia
RLELDAYIDCCLIITPAPLTFAVETR

SEQ ID NO: 3168646 - protein, 19 aa, Giardia lamblia
RLEMCYRYLHEHYKRNLLS

SEQ ID NO: 3168647 - protein, 18 aa, Giardia lamblia
RLEMTDGKLCMYANGTTL

SEQ ID NO: 3168648 - protein, 29 aa, Giardia lamblia
RLENTEWMRMFKMFLSINEKAERTAQQAN

SEQ ID NO: 3168649 - protein, 18 aa, Giardia lamblia
RLEQCRDMPVPTIHIQRT

SEQ ID NO: 3168650 - protein, 23 aa, Giardia lamblia
RLEQEVRARDALLHVKDSELESS

SEQ ID NO: 3168651 - protein, 19 aa, Giardia lamblia
RLEQLGLLFRYASLMCPQS

SEQ ID NO: 3168652 - protein, 27 aa, Giardia lamblia
RLERERKRLECSFIPDVPAPLEQVEYK

SEQ ID NO: 3168653 - protein, 19 aa, Giardia lamblia
RLESIPFSLIMPYTSFLDE

SEQ ID NO: 3168654 - protein, 30 aa, Giardia lamblia
RLESLPIREHRLLSCLRDSFHPQFGSITFL

SEQ ID NO: 3168655 - protein, 22 aa, Giardia lamblia
RLFDYPRLGALDSDEIFQLLTD

SEQ ID NO: 3168656 - protein, 19 aa, Giardia lamblia
RLFVEAFVGMGFEQMKTPK

SEQ ID NO: 3168657 - protein, 19 aa, Giardia lamblia
RLGADVVVVYRRRLQDSPA

SEQ ID NO: 3168658 - protein, 23 aa, Giardia lamblia
RLGEDQPRYELSPLFNDSDLPEF

SEQ ID NO: 3168659 - protein, 19 aa, Giardia lamblia
RLGGRRFDPITGNTYHIIY

SEQ ID NO: 3168660 - protein, 27 aa, Giardia lamblia
RLGKARAMDALSIFFGMERDFDGLSVL

SEQ ID NO: 3168661 - protein, 18 aa, Giardia lamblia
RLGPGERLQLQVSLTTRV

SEQ ID NO: 3168662 - protein, 23 aa, Giardia lamblia
RLGQSCFKLGQIEEALEFLFSAV

SEQ ID NO: 3168663 - protein, 19 aa, Giardia lamblia
RLGSEAEVKAAGKVRTEGK

SEQ ID NO: 3168664 - protein, 19 aa, Giardia lamblia
RLGVLDSYSKAHCLCCHTN

SEQ ID NO: 3168665 - protein, 20 aa, Giardia lamblia
RLGYESLVNFLLPYESGQFN

SEQ ID NO: 3168666 - protein, 18 aa, Giardia lamblia
RLGYFLESCIIACGRQAC

SEQ ID NO: 3168667 - protein, 17 aa, Giardia lamblia
RLHLAHIGHPIVGDQLY

SEQ ID NO: 3168668 - protein, 19 aa, Giardia lamblia
RLHSIKIVYDPSFHLINDV

SEQ ID NO: 3168669 - protein, 19 aa, Giardia lamblia
RLIAQSILIDYGLDKSAPF

SEQ ID NO: 3168670 - protein, 18 aa, Giardia lamblia
RLIGRRFNDPEVQADLKH

SEQ ID NO: 3168671 - protein, 17 aa, Giardia lamblia
RLIGRRFTDAEVKRAAK

SEQ ID NO: 3168672 - protein, 17 aa, Giardia lamblia
RLIHFNLNFVTAFCPLP

SEQ ID NO: 3168673 - protein, 19 aa, Giardia lamblia
RLIIFPIEDQEVWIRFSVL

SEQ ID NO: 3168674 - protein, 17 aa, Giardia lamblia
RLIKALFELARAEKQAV

SEQ ID NO: 3168675 - protein, 22 aa, Giardia lamblia
RLIKERNKRKGLNIYGEPLEAT

SEQ ID NO: 3168676 - protein, 17 aa, Giardia lamblia
RLILLLIQMDRLPDIQR

SEQ ID NO: 3168677 - protein, 23 aa, Giardia lamblia
RLIMKSKAGILVLDASDPKDVKC

SEQ ID NO: 3168678 - protein, 17 aa, Giardia lamblia
RLIPTQAALLLAGASTN

SEQ ID NO: 3168679 - protein, 20 aa, Giardia lamblia
RLIRACKRSSYTDAISNLVQ

SEQ ID NO: 3168680 - protein, 19 aa, Giardia lamblia
RLITKASLYPVSNRILRLS

SEQ ID NO: 3168681 - protein, 20 aa, Giardia lamblia
RLKCIKLLAEMESRLKKSGS

SEQ ID NO: 3168682 - protein, 20 aa, Giardia lamblia
RLKELSARELYDLAKVDESL

SEQ ID NO: 3168683 - protein, 17 aa, Giardia lamblia
RLKGVRVGLVDDEVLGS

SEQ ID NO: 3168684 - protein, 29 aa, Giardia lamblia
RLKNEINENCLFYTGFDRALRFLIEEYSE

SEQ ID NO: 3168685 - protein, 27 aa, Giardia lamblia
RLKRFGIECVSEILFSGWKPDGRVHTQ

SEQ ID NO: 3168686 - protein, 21 aa, Giardia lamblia
RLKRLRIVQEVRDQKLRVKRE

SEQ ID NO: 3168687 - protein, 22 aa, Giardia lamblia
RLKSLEKRVDLAMTSSHDSSRE

SEQ ID NO: 3168688 - protein, 25 aa, Giardia lamblia
RLKSRCPGYLIYPGHGPLASISESI

SEQ ID NO: 3168689 - protein, 18 aa, Giardia lamblia
RLKTPGIDALEGRTKNTY

SEQ ID NO: 3168690 - protein, 20 aa, Giardia lamblia
RLKWSAEMSRDLENVYDNLL

SEQ ID NO: 3168691 - protein, 23 aa, Giardia lamblia
RLLAKAGSLLNLAKLPASTLQIL

SEQ ID NO: 3168692 - protein, 21 aa, Giardia lamblia
RLLDIQGLLLYLVANELGGIN

SEQ ID NO: 3168693 - protein, 19 aa, Giardia lamblia
RLLEIYRSLFTTCYTSKRM

SEQ ID NO: 3168694 - protein, 31 aa, Giardia lamblia
RLLERKLHSLNCGFKNYLVEKHLCATTFGQS

SEQ ID NO: 3168695 - protein, 20 aa, Giardia lamblia
RLLETLSTLLSRGVVQRSSE

SEQ ID NO: 3168696 - protein, 25 aa, Giardia lamblia
RLLGAAEVRLGGLLDGREVQAEAPL

SEQ ID NO: 3168697 - protein, 19 aa, Giardia lamblia
RLLIYINVSEWHFGPYRQY

SEQ ID NO: 3168698 - protein, 20 aa, Giardia lamblia
RLLLDLLTDYICKTYPVDNS

SEQ ID NO: 3168699 - protein, 31 aa, Giardia lamblia
RLLLGLEKHIFLFDGRTALHIACESNSNACV

SEQ ID NO: 3168700 - protein, 25 aa, Giardia lamblia
RLLLLKCLSLNPANRPSVLEIAMLP

SEQ ID NO: 3168701 - protein, 17 aa, Giardia lamblia
RLLLMALLLHDGNYELI

SEQ ID NO: 3168702 - protein, 18 aa, Giardia lamblia
RLLLPHEKCRVGASDLMV

SEQ ID NO: 3168703 - protein, 27 aa, Giardia lamblia
RLLLSPTEWRYLLPRITGQGRVHPLSY

SEQ ID NO: 3168704 - protein, 19 aa, Giardia lamblia
RLLMDLERGISEFSTDTKL

SEQ ID NO: 3168705 - protein, 22 aa, Giardia lamblia
RLLNEDAIREFCLTSKEEQSST

SEQ ID NO: 3168706 - protein, 17 aa, Giardia lamblia
RLLNTLMGFIYGQNQVR

SEQ ID NO: 3168707 - protein, 17 aa, Giardia lamblia
RLLPLMHRIAKHITARV

SEQ ID NO: 3168708 - protein, 18 aa, Giardia lamblia
RLLREAIDLHILNNSHLL

SEQ ID NO: 3168709 - protein, 20 aa, Giardia lamblia
RLLSDLKTVKEELAIVVDQK

SEQ ID NO: 3168710 - protein, 21 aa, Giardia lamblia
RLLSLIGGFIVYSAEISYGLK

SEQ ID NO: 3168711 - protein, 18 aa, Giardia lamblia
RLLVCLNKAVGVGVAELE

SEQ ID NO: 3168712 - protein, 18 aa, Giardia lamblia
RLLVHTYDAWLLGIRPYL

SEQ ID NO: 3168713 - protein, 19 aa, Giardia lamblia
RLMECMLVAMGIDPDMMKD

SEQ ID NO: 3168714 - protein, 25 aa, Giardia lamblia
RLMQYRLSYLDSRSTSRVGSMHQSH

SEQ ID NO: 3168715 - protein, 21 aa, Giardia lamblia
RLMRELTECRGTLEQAEQQIR

SEQ ID NO: 3168716 - protein, 21 aa, Giardia lamblia
RLMSNYTIRYYRSWCTESTLN

SEQ ID NO: 3168717 - protein, 24 aa, Giardia lamblia
RLNAEQFTGLNLVYGGGNPYTGQI

SEQ ID NO: 3168718 - protein, 22 aa, Giardia lamblia
RLNCQSMSALMLAARCNNVESV

SEQ ID NO: 3168719 - protein, 29 aa, Giardia lamblia
RLNFLLSSFALSLVEDFISVFLTQGEKFY

SEQ ID NO: 3168720 - protein, 21 aa, Giardia lamblia
RLNFSPGQLVPYCSTQISLAL

SEQ ID NO: 3168721 - protein, 25 aa, Giardia lamblia
RLNHLDCTKLLLSEIGVYVPGSETA

SEQ ID NO: 3168722 - protein, 18 aa, Giardia lamblia
RLNKLFCQCLCLFTKLFL

SEQ ID NO: 3168723 - protein, 18 aa, Giardia lamblia
RLNMFTQVMQRWKPCGLE

SEQ ID NO: 3168724 - protein, 20 aa, Giardia lamblia
RLNPRILRIENLFKTFQAAR

SEQ ID NO: 3168725 - protein, 19 aa, Giardia lamblia
RLNPVTAKIKSIIGDGQGL

SEQ ID NO: 3168726 - protein, 23 aa, Giardia lamblia
RLNRDVINMLKLFNAENTDAPNS

SEQ ID NO: 3168727 - protein, 19 aa, Giardia lamblia
RLNSELGTAINEEEKLNSA

SEQ ID NO: 3168728 - protein, 23 aa, Giardia lamblia
RLNSRLCADIHAIITEQDSMYKL

SEQ ID NO: 3168729 - protein, 17 aa, Giardia lamblia
RLNSYFLTSEFPFSISS

SEQ ID NO: 3168730 - protein, 19 aa, Giardia lamblia
RLNYHSSRFRDELLATCSG

SEQ ID NO: 3168731 - protein, 23 aa, Giardia lamblia
RLNYLHFLIRTCRVYCNDEPRVR

SEQ ID NO: 3168732 - protein, 24 aa, Giardia lamblia
RLPACPEEPPGRVQFRGAPEAPPL

SEQ ID NO: 3168733 - protein, 21 aa, Giardia lamblia
RLPCKVCHAHHIMFTPHDNPR

SEQ ID NO: 3168734 - protein, 25 aa, Giardia lamblia
RLPCNHLACKTCAAIYYVSQTPCLM

SEQ ID NO: 3168735 - protein, 20 aa, Giardia lamblia
RLPDETNLRALGTFTDVVRE

SEQ ID NO: 3168736 - protein, 27 aa, Giardia lamblia
RLPGIYCNRCNFQIAFQECKLSLSSDF

SEQ ID NO: 3168737 - protein, 22 aa, Giardia lamblia
RLPLTELTGAELLLLHIITYDY

SEQ ID NO: 3168738 - protein, 18 aa, Giardia lamblia
RLPNLKVLNLMNNKIVRT

SEQ ID NO: 3168739 - protein, 19 aa, Giardia lamblia
RLPSEKFPEPEVFRMTIYA

SEQ ID NO: 3168740 - protein, 20 aa, Giardia lamblia
RLPTEQGFSLYSTKAEQSYR

SEQ ID NO: 3168741 - protein, 19 aa, Giardia lamblia
RLQAGNCAVGVKPAGKGAP

SEQ ID NO: 3168742 - protein, 18 aa, Giardia lamblia
RLQCPCRERCHPWKRIVE

SEQ ID NO: 3168743 - protein, 26 aa, Giardia lamblia
RLQDMNGRTALMYAAAASRFEAARLL

SEQ ID NO: 3168744 - protein, 30 aa, Giardia lamblia
RLQDPLDELCYWKTRAADLTAVLDQLRSRA

SEQ ID NO: 3168745 - protein, 18 aa, Giardia lamblia
RLQHKALILWRRELMEKR

SEQ ID NO: 3168746 - protein, 20 aa, Giardia lamblia
RLQIPRLYWYDHANGRMFVD

SEQ ID NO: 3168747 - protein, 24 aa, Giardia lamblia
RLQKSVYRYIEFILDHLASVPAAR

SEQ ID NO: 3168748 - protein, 19 aa, Giardia lamblia
RLQNELRRKDAEMDNMSTQ

SEQ ID NO: 3168749 - protein, 26 aa, Giardia lamblia
RLQRRRASLLVIKRYLMDTYRQNTWM

SEQ ID NO: 3168750 - protein, 17 aa, Giardia lamblia
RLRDELRDAEDADELKN

SEQ ID NO: 3168751 - protein, 19 aa, Giardia lamblia
RLREKDSVVDELLGKASKL

SEQ ID NO: 3168752 - protein, 38 aa, Giardia lamblia
RLRLMSLSRLSCYVFYNHICSAFAQLILHILKSSCNSL

SEQ ID NO: 3168753 - protein, 22 aa, Giardia lamblia
RLRMLIKEGIELERRGRDDLSA

SEQ ID NO: 3168754 - protein, 21 aa, Giardia lamblia
RLRNLCINISSSIPYTPNHNL

SEQ ID NO: 3168755 - protein, 19 aa, Giardia lamblia
RLRNYESMLRMKIEQRDEN

SEQ ID NO: 3168756 - protein, 18 aa, Giardia lamblia
RLRQFYRINSQAFALLGV

SEQ ID NO: 3168757 - protein, 23 aa, Giardia lamblia
RLRRHCPRAHPIEAAIKLKTDQR

SEQ ID NO: 3168758 - protein, 25 aa, Giardia lamblia
RLRSFSCFKGHFGTAWQNQQKEFPL

SEQ ID NO: 3168759 - protein, 20 aa, Giardia lamblia
RLRTEILSLAKAVLPSKESL

SEQ ID NO: 3168760 - protein, 19 aa, Giardia lamblia
RLRTIDGIRLTGYARGRIR

SEQ ID NO: 3168761 - protein, 17 aa, Giardia lamblia
RLRTMGLHITIQEQNMI

SEQ ID NO: 3168762 - protein, 17 aa, Giardia lamblia
RLRVIKKALLLTAVRSK

SEQ ID NO: 3168763 - protein, 25 aa, Giardia lamblia
RLSAQDCLRHPWFVNTCPTTAAASA

SEQ ID NO: 3168764 - protein, 22 aa, Giardia lamblia
RLSDISADMWAVAIPHKNSEVK

SEQ ID NO: 3168765 - protein, 24 aa, Giardia lamblia
RLSEINAKIASWIDEMVEFKAVIR

SEQ ID NO: 3168766 - protein, 18 aa, Giardia lamblia
RLSGDRRGEVAFVGPVPS

SEQ ID NO: 3168767 - protein, 18 aa, Giardia lamblia
RLSGTSRLQIPRLYWYDH

SEQ ID NO: 3168768 - protein, 19 aa, Giardia lamblia
RLSIISDVLEAWIICQRQW

SEQ ID NO: 3168769 - protein, 17 aa, Giardia lamblia
RLSKPSYASNVFKDAKS

SEQ ID NO: 3168770 - protein, 24 aa, Giardia lamblia
RLSLPESLRGSFCCHMSESTSCTN

SEQ ID NO: 3168771 - protein, 17 aa, Giardia lamblia
RLSNLFAGLNKRLEDLK

SEQ ID NO: 3168772 - protein, 20 aa, Giardia lamblia
RLSQEAKLAISEIQKKIAVL

SEQ ID NO: 3168773 - protein, 18 aa, Giardia lamblia
RLSRISYYPRLLLKKVGI

SEQ ID NO: 3168774 - protein, 19 aa, Giardia lamblia
RLSSLELIHTLTLACTRLE

SEQ ID NO: 3168775 - protein, 18 aa, Giardia lamblia
RLSSSLVTRTGLFDSGGP

SEQ ID NO: 3168776 - protein, 21 aa, Giardia lamblia
RLSYWDLDSFLLISILGEGRS

SEQ ID NO: 3168777 - protein, 23 aa, Giardia lamblia
RLTALEISAALPVSEASPLQQYR

SEQ ID NO: 3168778 - protein, 20 aa, Giardia lamblia
RLTDSFPPLVDFGSITLISP

SEQ ID NO: 3168779 - protein, 19 aa, Giardia lamblia
RLTGDLGTLSARNSVEEFG

SEQ ID NO: 3168780 - protein, 17 aa, Giardia lamblia
RLTIKEDLFDLNKNIWN

SEQ ID NO: 3168781 - protein, 24 aa, Giardia lamblia
RLTKIELSKSFPIIAVGDSQGVVR

SEQ ID NO: 3168782 - protein, 17 aa, Giardia lamblia
RLTKVGRSFSCAEKFDA

SEQ ID NO: 3168783 - protein, 18 aa, Giardia lamblia
RLTPLDVRKNEERINKPS

SEQ ID NO: 3168784 - protein, 18 aa, Giardia lamblia
RLTPLGIKEIDELEATFA

SEQ ID NO: 3168785 - protein, 17 aa, Giardia lamblia
RLTREEFEDCMGESATY

SEQ ID NO: 3168786 - protein, 24 aa, Giardia lamblia
RLVDPRLASSAGLETRMRSPDMLA

SEQ ID NO: 3168787 - protein, 25 aa, Giardia lamblia
RLVILPDCRTALMIAAEAGSYECCK

SEQ ID NO: 3168788 - protein, 18 aa, Giardia lamblia
RLVLLMLHNLVVARRKRY

SEQ ID NO: 3168789 - protein, 17 aa, Giardia lamblia
RLVPEYVVSAIRDPIAA

SEQ ID NO: 3168790 - protein, 41 aa, Giardia lamblia
RLVSPQGVIKEIKRYAGKCSACLAISPILASPFCKKCGNKT

SEQ ID NO: 3168791 - protein, 24 aa, Giardia lamblia
RLVTARPGAIPKLVHARYQEKPRL

SEQ ID NO: 3168792 - protein, 17 aa, Giardia lamblia
RLVYLHKGTCLRIAGAY

SEQ ID NO: 3168793 - protein, 17 aa, Giardia lamblia
RLWDATSGMWLRDITDS

SEQ ID NO: 3168794 - protein, 25 aa, Giardia lamblia
RLWREEGCTFGLTALMLAVLSGNDP

SEQ ID NO: 3168795 - protein, 20 aa, Giardia lamblia
RLYFQFPALPVVSPKLLELI

SEQ ID NO: 3168796 - protein, 17 aa, Giardia lamblia
RLYKARKLARLELLVLL

SEQ ID NO: 3168797 - protein, 18 aa, Giardia lamblia
RLYLEQLILQGAQQEASS

SEQ ID NO: 3168798 - protein, 19 aa, Giardia lamblia
RLYLRKGRGNNRVAKIYDS

SEQ ID NO: 3168799 - protein, 18 aa, Giardia lamblia
RMADFSIMYEQLKTQKNR

SEQ ID NO: 3168800 - protein, 18 aa, Giardia lamblia
RMAKTLTQRHEFIPIISS

SEQ ID NO: 3168801 - protein, 18 aa, Giardia lamblia
RMAPNVFAESGPVIQESQ

SEQ ID NO: 3168802 - protein, 18 aa, Giardia lamblia
RMASEFDGAALGEEYAGC

SEQ ID NO: 3168803 - protein, 19 aa, Giardia lamblia
RMCPGKCVLITGHDMVDML

SEQ ID NO: 3168804 - protein, 21 aa, Giardia lamblia
RMDLLKSKMRRVILMDHNEFS

SEQ ID NO: 3168805 - protein, 18 aa, Giardia lamblia
RMDMVLRRASLLYQKEEY

SEQ ID NO: 3168806 - protein, 25 aa, Giardia lamblia
RMEMVDLLLKKECNRAMKDGTTALM

SEQ ID NO: 3168807 - protein, 18 aa, Giardia lamblia
RMEPRAFEQLSIIHGATV

SEQ ID NO: 3168808 - protein, 35 aa, Giardia lamblia
RMFLAGKFGMCPREGCKDCPLLPVGASNVPGVSPL

SEQ ID NO: 3168809 - protein, 23 aa, Giardia lamblia
RMGHKSCALVLIKSDRELNKQMA

SEQ ID NO: 3168810 - protein, 27 aa, Giardia lamblia
RMHDACCPCGRSALASLPFFLRDYVIS

SEQ ID NO: 3168811 - protein, 20 aa, Giardia lamblia
RMHTGWALDRVYPRTNVSKF

SEQ ID NO: 3168812 - protein, 25 aa, Giardia lamblia
RMIDKCPLCNMVVPMVVWQLSLTEM

SEQ ID NO: 3168813 - protein, 17 aa, Giardia lamblia
RMIFGCFGSTTGPHLGH

SEQ ID NO: 3168814 - protein, 17 aa, Giardia lamblia
RMITDVCYPTLKPLSSW

SEQ ID NO: 3168815 - protein, 18 aa, Giardia lamblia
RMKELQILESIYLCGSSE

SEQ ID NO: 3168816 - protein, 22 aa, Giardia lamblia
RMKQEYERRLHLLEKERKAVSG

SEQ ID NO: 3168817 - protein, 17 aa, Giardia lamblia
RMKRLAKTLLKRNILPR

SEQ ID NO: 3168818 - protein, 21 aa, Giardia lamblia
RMLAILERWELNQSGCIVPLT

SEQ ID NO: 3168819 - protein, 26 aa, Giardia lamblia
RMLIPVALNCLLVFYKTTLLPGEGEP

SEQ ID NO: 3168820 - protein, 20 aa, Giardia lamblia
RMLVNFAKCCGFNIIQLLPL

SEQ ID NO: 3168821 - protein, 23 aa, Giardia lamblia
RMMDCPRGVKISGNRGYFLTGYG

SEQ ID NO: 3168822 - protein, 23 aa, Giardia lamblia
RMMRLYRTRMSYFSPADQNHLSV

SEQ ID NO: 3168823 - protein, 20 aa, Giardia lamblia
RMMTSKGLTALMYAAVNGHT

SEQ ID NO: 3168824 - protein, 20 aa, Giardia lamblia
RMNTDPCPREITKKEKKGKK

SEQ ID NO: 3168825 - protein, 19 aa, Giardia lamblia
RMPAVPRLYTILREVLIMV

SEQ ID NO: 3168826 - protein, 22 aa, Giardia lamblia
RMPFRPRVARGIQGPGGSMACL

SEQ ID NO: 3168827 - protein, 19 aa, Giardia lamblia
RMPYSRLPHERKAKSRLLA

SEQ ID NO: 3168828 - protein, 22 aa, Giardia lamblia
RMQNWLGRTALMFAAQNGHMDV

SEQ ID NO: 3168829 - protein, 18 aa, Giardia lamblia
RMQSRVFYGLSFENATAM

SEQ ID NO: 3168830 - protein, 18 aa, Giardia lamblia
RMRGVISTLMYAEERLMN

SEQ ID NO: 3168831 - protein, 24 aa, Giardia lamblia
RMRQLEKNLLIYYDKYNQLRVKNG

SEQ ID NO: 3168832 - protein, 19 aa, Giardia lamblia
RMRRADARAARAMKQGLGP

SEQ ID NO: 3168833 - protein, 25 aa, Giardia lamblia
RMSISEAMECPWLANINEFTLQQHE

SEQ ID NO: 3168834 - protein, 21 aa, Giardia lamblia
RMVCKKGKTALIYATEAGANA

SEQ ID NO: 3168835 - protein, 31 aa, Giardia lamblia
RMVRITSLMFDKALKCKFAYEKYGKLGSDFK

SEQ ID NO: 3168836 - protein, 26 aa, Giardia lamblia
RNAEFGLRGNMEWTALMVAAAHGSDG

SEQ ID NO: 3168837 - protein, 26 aa, Giardia lamblia
RNAIKEFSSVWAFSPRLMDWTRMNIA

SEQ ID NO: 3168838 - protein, 31 aa, Giardia lamblia
RNAILSHAPFEWGWADVDGYTALMHAVQADN

SEQ ID NO: 3168839 - protein, 17 aa, Giardia lamblia
RNAVESFAQAMSLQEGR

SEQ ID NO: 3168840 - protein, 20 aa, Giardia lamblia
RNAVMFSVGLLFGHGDMLLF

SEQ ID NO: 3168841 - protein, 17 aa, Giardia lamblia
RNDFHILHISSLSEQND

SEQ ID NO: 3168842 - protein, 24 aa, Giardia lamblia
RNDHPECVRLLLKDEGGMQTTKGW

SEQ ID NO: 3168843 - protein, 22 aa, Giardia lamblia
RNDHPECVRLLMKDEGGMQTTK

SEQ ID NO: 3168844 - protein, 20 aa, Giardia lamblia
RNEAKFDPISIFYESIQTAP

SEQ ID NO: 3168845 - protein, 28 aa, Giardia lamblia
RNEGHSVLPRFLWRYSKNDSSVEYEDTL

SEQ ID NO: 3168846 - protein, 17 aa, Giardia lamblia
RNEGVKDPITYAVVYMS

SEQ ID NO: 3168847 - protein, 17 aa, Giardia lamblia
RNEVFSILRQFAQLHRD

SEQ ID NO: 3168848 - protein, 18 aa, Giardia lamblia
RNFVFGSPIPLLSVSKAW

SEQ ID NO: 3168849 - protein, 21 aa, Giardia lamblia
RNGALTKMLITKDFNPADYSD

SEQ ID NO: 3168850 - protein, 19 aa, Giardia lamblia
RNGETGLMMAVRRSDTQLI

SEQ ID NO: 3168851 - protein, 18 aa, Giardia lamblia
RNGFTALMMAARHNSLDA

SEQ ID NO: 3168852 - protein, 17 aa, Giardia lamblia
RNGHVVLLRPGRGSGSV

SEQ ID NO: 3168853 - protein, 19 aa, Giardia lamblia
RNGPYFLKNGFATLNGKTV

SEQ ID NO: 3168854 - protein, 25 aa, Giardia lamblia
RNGRPECVRLLLDKEGGMKGSNGGT

SEQ ID NO: 3168855 - protein, 18 aa, Giardia lamblia
RNGYGAKLTNIFSTKFTV

SEQ ID NO: 3168856 - protein, 20 aa, Giardia lamblia
RNHVNQCYRVSFSSDSRFLI

SEQ ID NO: 3168857 - protein, 18 aa, Giardia lamblia
RNIQLVSFELLYLDSSSI

SEQ ID NO: 3168858 - protein, 36 aa, Giardia lamblia
RNKACRKLQLTLGEFRRVCIIKGIYPQVPPKKFAGD

SEQ ID NO: 3168859 - protein, 29 aa, Giardia lamblia
RNKLCPLIYLAARFAALFEVSKLYSEINL

SEQ ID NO: 3168860 - protein, 24 aa, Giardia lamblia
RNKLIKCLLFTLIVPDVSGVRAVV

SEQ ID NO: 3168861 - protein, 20 aa, Giardia lamblia
RNLIITSFKVSKAFMHTHSV

SEQ ID NO: 3168862 - protein, 19 aa, Giardia lamblia
RNLLLIANSHYKFRLREIE

SEQ ID NO: 3168863 - protein, 17 aa, Giardia lamblia
RNLLVSIAWRHISSLAK

SEQ ID NO: 3168864 - protein, 28 aa, Giardia lamblia
RNLNSACLKQLFKITGIVTKLTAPRPSI

SEQ ID NO: 3168865 - protein, 21 aa, Giardia lamblia
RNLPFTVYANTIFEAVRDKYP

SEQ ID NO: 3168866 - protein, 18 aa, Giardia lamblia
RNLSLFSIFGIDSPSENV

SEQ ID NO: 3168867 - protein, 29 aa, Giardia lamblia
RNLVLGNGYGRLFWPGYIDLSKEHGTSTV

SEQ ID NO: 3168868 - protein, 19 aa, Giardia lamblia
RNMLYAHYEVVLFSDQATP

SEQ ID NO: 3168869 - protein, 26 aa, Giardia lamblia
RNNHPECVKLLLGREAGMHDKYGWTA

SEQ ID NO: 3168870 - protein, 26 aa, Giardia lamblia
RNNLECVKFLIQHEMTMRLPPSDGHP

SEQ ID NO: 3168871 - protein, 22 aa, Giardia lamblia
RNPCTRCHEPSVLTGLDHNAPV

SEQ ID NO: 3168872 - protein, 19 aa, Giardia lamblia
RNPDFAFEFVFDITGQSGE

SEQ ID NO: 3168873 - protein, 20 aa, Giardia lamblia
RNPLWFKVPQVMHVGEGALA

SEQ ID NO: 3168874 - protein, 18 aa, Giardia lamblia
RNRCPICRAEIENWTQVF

SEQ ID NO: 3168875 - protein, 24 aa, Giardia lamblia
RNRDGRTALMYAAFNGHDQTVKVL

SEQ ID NO: 3168876 - protein, 20 aa, Giardia lamblia
RNRMGITLTTNVFKRRTLEL

SEQ ID NO: 3168877 - protein, 25 aa, Giardia lamblia
RNRVECVKLLMAHEAGMSKTSGYTA

SEQ ID NO: 3168878 - protein, 20 aa, Giardia lamblia
RNRWARCAAAATADLDALRE

SEQ ID NO: 3168879 - protein, 19 aa, Giardia lamblia
RNSANRFIICETILSTTAL

SEQ ID NO: 3168880 - protein, 23 aa, Giardia lamblia
RNSGRYKLPLQLVANTPKPEGTI

SEQ ID NO: 3168881 - protein, 24 aa, Giardia lamblia
RNSIAHVYETHFLPHERYVSKHEL

SEQ ID NO: 3168882 - protein, 18 aa, Giardia lamblia
RNSILSVNMPKAMSVASG

SEQ ID NO: 3168883 - protein, 18 aa, Giardia lamblia
RNSIRARYNLELQDIEAL

SEQ ID NO: 3168884 - protein, 21 aa, Giardia lamblia
RNSLIYTELLFRYESAKQTKD

SEQ ID NO: 3168885 - protein, 19 aa, Giardia lamblia
RNSQLIFCYATSVKKDVER

SEQ ID NO: 3168886 - protein, 18 aa, Giardia lamblia
RNSQTRGALHDALAKQGI

SEQ ID NO: 3168887 - protein, 23 aa, Giardia lamblia
RNSRKAAKDELARVSAELRGQNE

SEQ ID NO: 3168888 - protein, 25 aa, Giardia lamblia
RNSSGRGTLAWQRPSTVRVLVMSSE

SEQ ID NO: 3168889 - protein, 25 aa, Giardia lamblia
RNSVAFSDALGLFLPDEYGPAARGS

SEQ ID NO: 3168890 - protein, 17 aa, Giardia lamblia
RNVKEPMPLMSQTAETL

SEQ ID NO: 3168891 - protein, 18 aa, Giardia lamblia
RNVLTCGAQILSALMYVY

SEQ ID NO: 3168892 - protein, 17 aa, Giardia lamblia
RNVRHIVHICFSEEINV

SEQ ID NO: 3168893 - protein, 19 aa, Giardia lamblia
RNVYSTGLFQLYELPSVEA

SEQ ID NO: 3168894 - protein, 18 aa, Giardia lamblia
RNYFSSTDALIWVVDSTD

SEQ ID NO: 3168895 - protein, 19 aa, Giardia lamblia
RNYLMAILHTVRGCGYESE

SEQ ID NO: 3168896 - protein, 26 aa, Giardia lamblia
RNYVLECKDLGFKRLSLDKPISSNEL

SEQ ID NO: 3168897 - protein, 18 aa, Giardia lamblia
RPADHVIRCIKLSDYGFL

SEQ ID NO: 3168898 - protein, 25 aa, Giardia lamblia
RPAEGELPGLVVMIAPYSVVERFFG

SEQ ID NO: 3168899 - protein, 18 aa, Giardia lamblia
RPAEGFWKETALIRAAAV

SEQ ID NO: 3168900 - protein, 18 aa, Giardia lamblia
RPAGAAFQRDAFPTPDLE

SEQ ID NO: 3168901 - protein, 25 aa, Giardia lamblia
RPAIGEFFCALPIAHTIDRNIFMVH

SEQ ID NO: 3168902 - protein, 18 aa, Giardia lamblia
RPALPRATRIEAISKYQR

SEQ ID NO: 3168903 - protein, 25 aa, Giardia lamblia
RPAMLGESFGGYVLTYYTQPPTEND

SEQ ID NO: 3168904 - protein, 23 aa, Giardia lamblia
RPASMRRTSITSVRDLQDRLHEF

SEQ ID NO: 3168905 - protein, 19 aa, Giardia lamblia
RPATFQILLGHMLASICWS

SEQ ID NO: 3168906 - protein, 19 aa, Giardia lamblia
RPAYFKVFEYCIRVIDCTD

SEQ ID NO: 3168907 - protein, 27 aa, Giardia lamblia
RPCEPALAIWADFVLVPLILTGKIDEA

SEQ ID NO: 3168908 - protein, 24 aa, Giardia lamblia
RPCIPLRYLQKLSLGSNLIGNTVS

SEQ ID NO: 3168909 - protein, 17 aa, Giardia lamblia
RPCRCCVRAQLQEGLLV

SEQ ID NO: 3168910 - protein, 22 aa, Giardia lamblia
RPDARSLFLLDEFGRGTDSTTG

SEQ ID NO: 3168911 - protein, 29 aa, Giardia lamblia
RPDDFCPFRRGVGFLPATMIKRLFDPIGL

SEQ ID NO: 3168912 - protein, 26 aa, Giardia lamblia
RPDERSHAWLKLKKDYLEDVGDSFDL

SEQ ID NO: 3168913 - protein, 20 aa, Giardia lamblia
RPDLEPCMAHFLYDLLFHEV

SEQ ID NO: 3168914 - protein, 19 aa, Giardia lamblia
RPDNECLFCDHTVDQAKDD

SEQ ID NO: 3168915 - protein, 20 aa, Giardia lamblia
RPDNKVEALGLVVLDDPCIN

SEQ ID NO: 3168916 - protein, 17 aa, Giardia lamblia
RPDRVYIAVQLFVASVL

SEQ ID NO: 3168917 - protein, 19 aa, Giardia lamblia
RPDSSVISFFCTEENGKIL

SEQ ID NO: 3168918 - protein, 18 aa, Giardia lamblia
RPDTSYNLTTYIDVYGDQ

SEQ ID NO: 3168919 - protein, 22 aa, Giardia lamblia
RPEAFPAHPGLLIKGPTVREHA

SEQ ID NO: 3168920 - protein, 22 aa, Giardia lamblia
RPEIKSTVPRTVYNGPTVTQDV

SEQ ID NO: 3168921 - protein, 18 aa, Giardia lamblia
RPEIWTRQAKLFYQEIMR

SEQ ID NO: 3168922 - protein, 24 aa, Giardia lamblia
RPEKVMHMYYGYAIIDLQSPKAAE

SEQ ID NO: 3168923 - protein, 17 aa, Giardia lamblia
RPERRPSTDDLIARPPI

SEQ ID NO: 3168924 - protein, 17 aa, Giardia lamblia
RPEVELFDQPPSITHVV

SEQ ID NO: 3168925 - protein, 34 aa, Giardia lamblia
RPEVVEALPTCLHCGKMFGAYEFLLAHHRRRHPG

SEQ ID NO: 3168926 - protein, 19 aa, Giardia lamblia
RPFGCSVLLAGKSMATEHE

SEQ ID NO: 3168927 - protein, 18 aa, Giardia lamblia
RPFGNIAVFAGWDPEQDR

SEQ ID NO: 3168928 - protein, 22 aa, Giardia lamblia
RPFGRLSYDTVISKRIYALVLS

SEQ ID NO: 3168929 - protein, 17 aa, Giardia lamblia
RPFGVSIILAGNDLNGS

SEQ ID NO: 3168930 - protein, 23 aa, Giardia lamblia
RPGARGYLSLCVCTKEAGHALYD

SEQ ID NO: 3168931 - protein, 25 aa, Giardia lamblia
RPGRSGRTTLVWRSWLARVTYDHEV

SEQ ID NO: 3168932 - protein, 52 aa, Giardia lamblia
RPGSLSSPRPSSWIGLSFCPEGHALMCISHRISLLVTFHFTAQFCYLVARQV

SEQ ID NO: 3168933 - protein, 24 aa, Giardia lamblia
RPHGNSGMVRARFYTNLPGQLMGH

SEQ ID NO: 3168934 - protein, 17 aa, Giardia lamblia
RPHHQALDLSEELIDRM

SEQ ID NO: 3168935 - protein, 22 aa, Giardia lamblia
RPHKRIDFKGSSSMTQERLKAV

SEQ ID NO: 3168936 - protein, 19 aa, Giardia lamblia
RPHNVPVPTFMSTTRPLQG

SEQ ID NO: 3168937 - protein, 23 aa, Giardia lamblia
RPHPLAFDFLVNGSFMHTALGDH

SEQ ID NO: 3168938 - protein, 20 aa, Giardia lamblia
RPHSSIPMFHHAFNVDESLY

SEQ ID NO: 3168939 - protein, 20 aa, Giardia lamblia
RPITLAIFKECVGVGGEDII

SEQ ID NO: 3168940 - protein, 20 aa, Giardia lamblia
RPKDRVSIFEVHKLVRDEVR

SEQ ID NO: 3168941 - protein, 24 aa, Giardia lamblia
RPKPFRFCHCLYLTHGGSKVVFSV

SEQ ID NO: 3168942 - protein, 18 aa, Giardia lamblia
RPKVSFSSLHTEKRSEKP

SEQ ID NO: 3168943 - protein, 20 aa, Giardia lamblia
RPLDAVLHGFSISQSETIGR

SEQ ID NO: 3168944 - protein, 19 aa, Giardia lamblia
RPLEAWSGSVGEDVRLHND

SEQ ID NO: 3168945 - protein, 20 aa, Giardia lamblia
RPLLPIRFVDAVTVIQDETK

SEQ ID NO: 3168946 - protein, 20 aa, Giardia lamblia
RPLMCTLNIGRIVRPGYVEY

SEQ ID NO: 3168947 - protein, 17 aa, Giardia lamblia
RPLMSVSVGNQLCLSGT

SEQ ID NO: 3168948 - protein, 23 aa, Giardia lamblia
RPLRIAHTMSSTWASFSLAAYDQ

SEQ ID NO: 3168949 - protein, 22 aa, Giardia lamblia
RPLSSICSTAPHPSHRDYTTER

SEQ ID NO: 3168950 - protein, 17 aa, Giardia lamblia
RPLVLIQGGDGWSYDIG

SEQ ID NO: 3168951 - protein, 17 aa, Giardia lamblia
RPMLCRLLAIEEAKLQA

SEQ ID NO: 3168952 - protein, 18 aa, Giardia lamblia
RPNALRIICEAIYTNALP

SEQ ID NO: 3168953 - protein, 19 aa, Giardia lamblia
RPNDPVRYLGEFLMERSVK

SEQ ID NO: 3168954 - protein, 19 aa, Giardia lamblia
RPNEKFLLLSTDPAHNISD

SEQ ID NO: 3168955 - protein, 20 aa, Giardia lamblia
RPNSIPGVTRLPGPSGDAVA

SEQ ID NO: 3168956 - protein, 20 aa, Giardia lamblia
RPPAVCRDQLALAAQAGGAR

SEQ ID NO: 3168957 - protein, 19 aa, Giardia lamblia
RPPLEKFLVCPPSIQNTPD

SEQ ID NO: 3168958 - protein, 20 aa, Giardia lamblia
RPPVAAAVAAISVRAVLQGE

SEQ ID NO: 3168959 - protein, 17 aa, Giardia lamblia
RPQCKTHTTKFAGVGDL

SEQ ID NO: 3168960 - protein, 20 aa, Giardia lamblia
RPQKEFRQPCQFQNVDSQDH

SEQ ID NO: 3168961 - protein, 19 aa, Giardia lamblia
RPQSARPKPAVGVEKSVKL

SEQ ID NO: 3168962 - protein, 19 aa, Giardia lamblia
RPQTVYVIDELDSLFAFTD

SEQ ID NO: 3168963 - protein, 20 aa, Giardia lamblia
RPRAPARRNAQWYAEQVRRV

SEQ ID NO: 3168964 - protein, 20 aa, Giardia lamblia
RPRFRLLVAKLPRGTSPLQL

SEQ ID NO: 3168965 - protein, 17 aa, Giardia lamblia
RPRSRGDMSMRTKQRST

SEQ ID NO: 3168966 - protein, 19 aa, Giardia lamblia
RPSATELLAHPKFKEYNLT

SEQ ID NO: 3168967 - protein, 19 aa, Giardia lamblia
RPSAYEILCHPLINRWVYR

SEQ ID NO: 3168968 - protein, 19 aa, Giardia lamblia
RPSELRAKHINRLVSVRAI

SEQ ID NO: 3168969 - protein, 17 aa, Giardia lamblia
RPSGHGGPNPRRREYND

SEQ ID NO: 3168970 - protein, 22 aa, Giardia lamblia
RPSIELRPASMGGIQVLSDNVL

SEQ ID NO: 3168971 - protein, 20 aa, Giardia lamblia
RPSLDIPLLNSKVGYVVTGS

SEQ ID NO: 3168972 - protein, 23 aa, Giardia lamblia
RPSLPPWLQRAAEALQFDEDLLG

SEQ ID NO: 3168973 - protein, 17 aa, Giardia lamblia
RPSLRSPCLSPRLSNSV

SEQ ID NO: 3168974 - protein, 17 aa, Giardia lamblia
RPSRPHSHYTPRSSNTM

SEQ ID NO: 3168975 - protein, 20 aa, Giardia lamblia
RPSSAKASLTVHVPRSRALD

SEQ ID NO: 3168976 - protein, 21 aa, Giardia lamblia
RPSSILDIGCADGYILEALGK

SEQ ID NO: 3168977 - protein, 26 aa, Giardia lamblia
RPSTKRPDLHPVIAFQKQEKYVTSQD

SEQ ID NO: 3168978 - protein, 19 aa, Giardia lamblia
RPTALILAAYYNYQSIIEI

SEQ ID NO: 3168979 - protein, 19 aa, Giardia lamblia
RPTDEVFDMPVVSRSGERV

SEQ ID NO: 3168980 - protein, 31 aa, Giardia lamblia
RPTDKSGETFIYFKTTRAMANVRVTVSTTST

SEQ ID NO: 3168981 - protein, 20 aa, Giardia lamblia
RPTQPDHRLVVLGTTTHLKA

SEQ ID NO: 3168982 - protein, 22 aa, Giardia lamblia
RPTRIRSAAISKLVEQITSVNS

SEQ ID NO: 3168983 - protein, 19 aa, Giardia lamblia
RPTSAFLSAQGRPRSFSAS

SEQ ID NO: 3168984 - protein, 20 aa, Giardia lamblia
RPTSSYLHLFLASRGIHITY

SEQ ID NO: 3168985 - protein, 20 aa, Giardia lamblia
RPTYDCRTLIISVINDYIAL

SEQ ID NO: 3168986 - protein, 26 aa, Giardia lamblia
RPVKELRSYCAVALFTPCSSSQSRLL

SEQ ID NO: 3168987 - protein, 30 aa, Giardia lamblia
RPVKLETHIQGFPGWHYSPRMTTMNRPIYT

SEQ ID NO: 3168988 - protein, 17 aa, Giardia lamblia
RPVMVAVYIYGFPLLMY

SEQ ID NO: 3168989 - protein, 20 aa, Giardia lamblia
RPVQPVPSSSIGFFIDSDPH

SEQ ID NO: 3168990 - protein, 21 aa, Giardia lamblia
RPVSDLPLEYQKVFPKRITHF

SEQ ID NO: 3168991 - protein, 20 aa, Giardia lamblia
RPVTEEKLAALMELGQTTDL

SEQ ID NO: 3168992 - protein, 18 aa, Giardia lamblia
RPVVLCIVDGMGYGRVKE

SEQ ID NO: 3168993 - protein, 21 aa, Giardia lamblia
RPVYQYFPLIMMMSATLFASY

SEQ ID NO: 3168994 - protein, 32 aa, Giardia lamblia
RPWCISRQLWWGHRIPCYKFWFGDNPEPSGDK

SEQ ID NO: 3168995 - protein, 21 aa, Giardia lamblia
RPYEIPRAVILEHQPWTQKDE

SEQ ID NO: 3168996 - protein, 23 aa, Giardia lamblia
RPYKEITDIPALSHVLSDTLNDY

SEQ ID NO: 3168997 - protein, 22 aa, Giardia lamblia
RPYLEPVAVYGLNLAVRTPLFF

SEQ ID NO: 3168998 - protein, 19 aa, Giardia lamblia
RPYVEQVKAILALDFRRLR

SEQ ID NO: 3168999 - protein, 20 aa, Giardia lamblia
RPYVLPRLLGTYIPEKLIGL

SEQ ID NO: 3169000 - protein, 21 aa, Giardia lamblia
RQAAALPDHFGRDAAKAHTCL

SEQ ID NO: 3169001 - protein, 27 aa, Giardia lamblia
RQAAERKELLNALAKEEEKARCLEVTY

SEQ ID NO: 3169002 - protein, 24 aa, Giardia lamblia
RQAKKAAIVKLSRMGCIQIKKTED

SEQ ID NO: 3169003 - protein, 19 aa, Giardia lamblia
RQAKLFYQEIMRLRDGYGY

SEQ ID NO: 3169004 - protein, 25 aa, Giardia lamblia
RQALSERVIPCLMLNKVDRVIMELK

SEQ ID NO: 3169005 - protein, 22 aa, Giardia lamblia
RQDLIDSITFVGVFDGHGGDRA

SEQ ID NO: 3169006 - protein, 23 aa, Giardia lamblia
RQDNCGFTALLFATMSGCIDFVK

SEQ ID NO: 3169007 - protein, 24 aa, Giardia lamblia
RQDSIVFRNHVYRKVGPEVVLKEI

SEQ ID NO: 3169008 - protein, 17 aa, Giardia lamblia
RQDWKQAHLEDQSNDNK

SEQ ID NO: 3169009 - protein, 24 aa, Giardia lamblia
RQEALKLPTILAHNQSLITLNFGY

SEQ ID NO: 3169010 - protein, 20 aa, Giardia lamblia
RQEARIYQRDLQKLEKDYAS

SEQ ID NO: 3169011 - protein, 28 aa, Giardia lamblia
RQEEPSPWKPLGGRGGKTFDEIAAETQK

SEQ ID NO: 3169012 - protein, 26 aa, Giardia lamblia
RQELDLKIGVAFTRFQTAHLHAQFAD

SEQ ID NO: 3169013 - protein, 17 aa, Giardia lamblia
RQELRMTYNNALRTQDV

SEQ ID NO: 3169014 - protein, 19 aa, Giardia lamblia
RQEPIPELQIWEILAQIAA

SEQ ID NO: 3169015 - protein, 25 aa, Giardia lamblia
RQFRLEELQRLLCETHDSLESAREE

SEQ ID NO: 3169016 - protein, 25 aa, Giardia lamblia
RQFSTSFLVIFTCPTSIFYEPFRAE

SEQ ID NO: 3169017 - protein, 25 aa, Giardia lamblia
RQFTDLRLGYSITRLQTDKLRSSFI

SEQ ID NO: 3169018 - protein, 22 aa, Giardia lamblia
RQFTHKIARPYPQVNLAAQHWE

SEQ ID NO: 3169019 - protein, 21 aa, Giardia lamblia
RQGDSRPSGQYFLHSKRTREV

SEQ ID NO: 3169020 - protein, 19 aa, Giardia lamblia
RQGEHKILLASDVAGRGID

SEQ ID NO: 3169021 - protein, 21 aa, Giardia lamblia
RQGKVLACEGLGMPVQGLSHE

SEQ ID NO: 3169022 - protein, 19 aa, Giardia lamblia
RQGLSSFIVNPQIELLRKL

SEQ ID NO: 3169023 - protein, 18 aa, Giardia lamblia
RQGQDLYQTPSLKDIRIQ

SEQ ID NO: 3169024 - protein, 20 aa, Giardia lamblia
RQGTASSFGRPVSSASGGKK

SEQ ID NO: 3169025 - protein, 19 aa, Giardia lamblia
RQHCVKYLVDKRHVIVKDL

SEQ ID NO: 3169026 - protein, 25 aa, Giardia lamblia
RQHIKRLSPLDIIRLNSLDCANSPA

SEQ ID NO: 3169027 - protein, 19 aa, Giardia lamblia
RQHVPLLIVRLITYQLARS

SEQ ID NO: 3169028 - protein, 18 aa, Giardia lamblia
RQIEDKVKELAIERQQAE

SEQ ID NO: 3169029 - protein, 20 aa, Giardia lamblia
RQIKELSDIVSLLNSGNSRE

SEQ ID NO: 3169030 - protein, 21 aa, Giardia lamblia
RQITVYAGPGFTKAGRTPLPL

SEQ ID NO: 3169031 - protein, 17 aa, Giardia lamblia
RQKELMDKLMLVDLPKA

SEQ ID NO: 3169032 - protein, 17 aa, Giardia lamblia
RQKLRIEALTDKLDDYE

SEQ ID NO: 3169033 - protein, 25 aa, Giardia lamblia
RQKLTEMRSLLVFYRSISNVYWDAD

SEQ ID NO: 3169034 - protein, 17 aa, Giardia lamblia
RQKQLLFEKALSASPSP

SEQ ID NO: 3169035 - protein, 19 aa, Giardia lamblia
RQKSAACCNARLQDNEYNE

SEQ ID NO: 3169036 - protein, 17 aa, Giardia lamblia
RQLDMYQLFRAVQARGG

SEQ ID NO: 3169037 - protein, 24 aa, Giardia lamblia
RQLDRMAFTLAREANARGSIHNTV

SEQ ID NO: 3169038 - protein, 17 aa, Giardia lamblia
RQLELEASGTTAPEKCI

SEQ ID NO: 3169039 - protein, 18 aa, Giardia lamblia
RQLIEERGFYALDKPGEF

SEQ ID NO: 3169040 - protein, 32 aa, Giardia lamblia
RQLIEGIEILQCMYYRHIVRFYASFGDPEADV

SEQ ID NO: 3169041 - protein, 17 aa, Giardia lamblia
RQLIKLTSIRSYAEHDI

SEQ ID NO: 3169042 - protein, 17 aa, Giardia lamblia
RQLKPPFLESFSLESEN

SEQ ID NO: 3169043 - protein, 20 aa, Giardia lamblia
RQLLSGKMTVWGRGKRGEVL

SEQ ID NO: 3169044 - protein, 20 aa, Giardia lamblia
RQLNALLIRNTRLAYKKNNI

SEQ ID NO: 3169045 - protein, 20 aa, Giardia lamblia
RQLPCKRLSRISYYPRLLLK

SEQ ID NO: 3169046 - protein, 30 aa, Giardia lamblia
RQLPMALEIPEYICPLHICDNNPTLQSLHQ

SEQ ID NO: 3169047 - protein, 22 aa, Giardia lamblia
RQLPNTLYFDGYSTHLRNLIRG

SEQ ID NO: 3169048 - protein, 23 aa, Giardia lamblia
RQLQKMAEYMLEFANEIEPGINY

SEQ ID NO: 3169049 - protein, 24 aa, Giardia lamblia
RQLSELRSSMNLSQAIVSSHTDSV

SEQ ID NO: 3169050 - protein, 19 aa, Giardia lamblia
RQLVDGWTALMFSAKGNFI

SEQ ID NO: 3169051 - protein, 19 aa, Giardia lamblia
RQMCAELVSELVFLAMEVS

SEQ ID NO: 3169052 - protein, 29 aa, Giardia lamblia
RQMLPICYIPGCSFPACLNLIDSSLPISM

SEQ ID NO: 3169053 - protein, 26 aa, Giardia lamblia
RQNIEPRPSLSEYPYRDSSHVSSELE

SEQ ID NO: 3169054 - protein, 21 aa, Giardia lamblia
RQNTFPGMVLNAVSSAKSAAA

SEQ ID NO: 3169055 - protein, 22 aa, Giardia lamblia
RQNWLLVTVMCLITVQKMYDDF

SEQ ID NO: 3169056 - protein, 19 aa, Giardia lamblia
RQPAEVGLLSFRNGNITGE

SEQ ID NO: 3169057 - protein, 24 aa, Giardia lamblia
RQPGSEVLEKLSAYQDALKTKTRQ

SEQ ID NO: 3169058 - protein, 17 aa, Giardia lamblia
RQPRSGKSAKITVQPSR

SEQ ID NO: 3169059 - protein, 24 aa, Giardia lamblia
RQQKLAVETGVWPVFRYNPSKPIG

SEQ ID NO: 3169060 - protein, 20 aa, Giardia lamblia
RQQLKSCLVLFIRSLVVNPS

SEQ ID NO: 3169061 - protein, 18 aa, Giardia lamblia
RQQMAAPVHPFIPSHMPL

SEQ ID NO: 3169062 - protein, 25 aa, Giardia lamblia
RQQSRCSYDSFSFSRDNRSASGLFC

SEQ ID NO: 3169063 - protein, 19 aa, Giardia lamblia
RQRCRSSLDLSWSESHAPH

SEQ ID NO: 3169064 - protein, 17 aa, Giardia lamblia
RQRREESIHVAVDGSTR

SEQ ID NO: 3169065 - protein, 23 aa, Giardia lamblia
RQRSGRTALILAARQGTLTSLHD

SEQ ID NO: 3169066 - protein, 20 aa, Giardia lamblia
RQSAHSSGLFGYQSSLGASS

SEQ ID NO: 3169067 - protein, 25 aa, Giardia lamblia
RQSFIKYLLEKEARMHRSDGVTALQ

SEQ ID NO: 3169068 - protein, 24 aa, Giardia lamblia
RQSIKVGLLPKIFTMLLGACDGNE

SEQ ID NO: 3169069 - protein, 23 aa, Giardia lamblia
RQSKVMRLVRDFVYALIERILSN

SEQ ID NO: 3169070 - protein, 20 aa, Giardia lamblia
RQSLRHIVIFDNPFTIQSSI

SEQ ID NO: 3169071 - protein, 19 aa, Giardia lamblia
RQSNKGWTALMIAADSGAT

SEQ ID NO: 3169072 - protein, 24 aa, Giardia lamblia
RQTFSIPSAHLIKVLPVGMQAVQL

SEQ ID NO: 3169073 - protein, 18 aa, Giardia lamblia
RQTRGRLDKEAKREILRR

SEQ ID NO: 3169074 - protein, 24 aa, Giardia lamblia
RQVAMGLAHLHKWTGSAANGDSVS

SEQ ID NO: 3169075 - protein, 17 aa, Giardia lamblia
RQYDELVRKYAIQENRI

SEQ ID NO: 3169076 - protein, 24 aa, Giardia lamblia
RQYPIKHYFTLEAVKSYQEACVSA

SEQ ID NO: 3169077 - protein, 17 aa, Giardia lamblia
RQYSGKQGMLISVNDRG

SEQ ID NO: 3169078 - protein, 26 aa, Giardia lamblia
RRADHRICMCHSLSYSRLLADGESPC

SEQ ID NO: 3169079 - protein, 20 aa, Giardia lamblia
RRAESLASQVYRIQQRILDD

SEQ ID NO: 3169080 - protein, 21 aa, Giardia lamblia
RRAGFDYTALIYAARNGHTDC

SEQ ID NO: 3169081 - protein, 28 aa, Giardia lamblia
RRAGFIKGRLVVKVVELVGAVLSENAIL

SEQ ID NO: 3169082 - protein, 24 aa, Giardia lamblia
RRAGPKAWSPRATASCHPTSDNRM

SEQ ID NO: 3169083 - protein, 24 aa, Giardia lamblia
RRAGPKAWSPRATVSCHPTSDNRM

SEQ ID NO: 3169084 - protein, 19 aa, Giardia lamblia
RRAIKAMIIAGVRDRSILG

SEQ ID NO: 3169085 - protein, 30 aa, Giardia lamblia
RRALFTEAECAFSIRAKQQILLLQAIGLLL

SEQ ID NO: 3169086 - protein, 23 aa, Giardia lamblia
RRALKAKLYPILIRRTTADLGSL

SEQ ID NO: 3169087 - protein, 19 aa, Giardia lamblia
RRALLHGEFARNSRLTKSQ

SEQ ID NO: 3169088 - protein, 32 aa, Giardia lamblia
RRALRKIVWEISLPCYRHTIQLESYRASRTYQ

SEQ ID NO: 3169089 - protein, 26 aa, Giardia lamblia
RRALRLSHGSFAWGSADISHKARILQ

SEQ ID NO: 3169090 - protein, 18 aa, Giardia lamblia
RRAPARSQVGPPVALPLQ

SEQ ID NO: 3169091 - protein, 17 aa, Giardia lamblia
RRAQAAAQFRERSNVQG

SEQ ID NO: 3169092 - protein, 20 aa, Giardia lamblia
RRASNFSGNIFASKWLHNNV

SEQ ID NO: 3169093 - protein, 17 aa, Giardia lamblia
RRAVLLLRRSCTDARVP

SEQ ID NO: 3169094 - protein, 21 aa, Giardia lamblia
RRAYFKRVLLLRRWIDSYTNP

SEQ ID NO: 3169095 - protein, 17 aa, Giardia lamblia
RRCKVEIARPKKPEYTD

SEQ ID NO: 3169096 - protein, 18 aa, Giardia lamblia
RRCLQRARDVRYLHTDEL

SEQ ID NO: 3169097 - protein, 24 aa, Giardia lamblia
RRCPSGKTALMFAAQQGHTEAVQL

SEQ ID NO: 3169098 - protein, 34 aa, Giardia lamblia
RRDAEICAQLSMLVPLDRSDMIYAPTFTTEASAD

SEQ ID NO: 3169099 - protein, 18 aa, Giardia lamblia
RRDFKFDAVLPHFTTQED

SEQ ID NO: 3169100 - protein, 19 aa, Giardia lamblia
RRDFLGAITVLKFLKSTRN

SEQ ID NO: 3169101 - protein, 18 aa, Giardia lamblia
RRDIYLLFSKVFTHISNN

SEQ ID NO: 3169102 - protein, 24 aa, Giardia lamblia
RRDSGFSPIYGFRPPNILSDNSSK

SEQ ID NO: 3169103 - protein, 23 aa, Giardia lamblia
RRDTFGAPLFEGHNGTIDGYHPK

SEQ ID NO: 3169104 - protein, 26 aa, Giardia lamblia
RREALKSETVFPCIMTILDCFHHKDP

SEQ ID NO: 3169105 - protein, 26 aa, Giardia lamblia
RREELGLSGIRSRSSIVSLAARSSST

SEQ ID NO: 3169106 - protein, 20 aa, Giardia lamblia
RRERCLLSEVVYLREMLEAL

SEQ ID NO: 3169107 - protein, 27 aa, Giardia lamblia
RRESRTNDTLARYGLLYTTMAYSSIEQ

SEQ ID NO: 3169108 - protein, 26 aa, Giardia lamblia
RREYGRLLFRLAYRMEEQGLRLEQLR

SEQ ID NO: 3169109 - protein, 17 aa, Giardia lamblia
RRFAEVFVAEPNVEDTI

SEQ ID NO: 3169110 - protein, 19 aa, Giardia lamblia
RRFDAAAVRHLFEQEKAEV

SEQ ID NO: 3169111 - protein, 22 aa, Giardia lamblia
RRFELKEPIIFQAETIGMKSWL

SEQ ID NO: 3169112 - protein, 17 aa, Giardia lamblia
RRFLHTEAKARLLDGTT

SEQ ID NO: 3169113 - protein, 24 aa, Giardia lamblia
RRFLLVCLHISIQMTRDYELTFWR

SEQ ID NO: 3169114 - protein, 30 aa, Giardia lamblia
RRFNADGIGHCIPALTALIDKYDWIPQRSA

SEQ ID NO: 3169115 - protein, 20 aa, Giardia lamblia
RRFTFDHLFEPSSTQAEVYY

SEQ ID NO: 3169116 - protein, 19 aa, Giardia lamblia
RRGAFSLPVTAIYQLYNSQ

SEQ ID NO: 3169117 - protein, 17 aa, Giardia lamblia
RRGELLPDLDEIREISC

SEQ ID NO: 3169118 - protein, 17 aa, Giardia lamblia
RRGETALLLAASNNHVK

SEQ ID NO: 3169119 - protein, 17 aa, Giardia lamblia
RRGFKLVAMKFFVPSKN

SEQ ID NO: 3169120 - protein, 25 aa, Giardia lamblia
RRGHIACVGALFFAEYSICTVRGES

SEQ ID NO: 3169121 - protein, 24 aa, Giardia lamblia
RRGHLDCVKLLVPEAKKVDIDGYT

SEQ ID NO: 3169122 - protein, 20 aa, Giardia lamblia
RRGYFSVISFFGRFTTTSGH

SEQ ID NO: 3169123 - protein, 17 aa, Giardia lamblia
RRIAGGLKHLMQDRKRV

SEQ ID NO: 3169124 - protein, 20 aa, Giardia lamblia
RRIANRVSNALSFGAVAKAL

SEQ ID NO: 3169125 - protein, 18 aa, Giardia lamblia
RRIHAFLAEYLKIHIEAP

SEQ ID NO: 3169126 - protein, 19 aa, Giardia lamblia
RRIIDEANGRRGVYYSDEH

SEQ ID NO: 3169127 - protein, 23 aa, Giardia lamblia
RRIKQNDCVIVFGKSRIVLKALI

SEQ ID NO: 3169128 - protein, 19 aa, Giardia lamblia
RRIPDLISYQGGLLSPAKV

SEQ ID NO: 3169129 - protein, 17 aa, Giardia lamblia
RRIPPPQVQGAPRGAPR

SEQ ID NO: 3169130 - protein, 22 aa, Giardia lamblia
RRIQSFIQRIEVSKSLCLSQNE

SEQ ID NO: 3169131 - protein, 20 aa, Giardia lamblia
RRIRDKRGKTALQWAQEKPY

SEQ ID NO: 3169132 - protein, 27 aa, Giardia lamblia
RRIVELEARAGSLLHDLKLTEEERDKA

SEQ ID NO: 3169133 - protein, 27 aa, Giardia lamblia
RRIVENWSSVTSFDWAEANQLAQVDSK

SEQ ID NO: 3169134 - protein, 21 aa, Giardia lamblia
RRIYNLGFMVKLSFLEVYCER

SEQ ID NO: 3169135 - protein, 26 aa, Giardia lamblia
RRKAQFYLYIGCTYFLLDQRQTDHSR

SEQ ID NO: 3169136 - protein, 24 aa, Giardia lamblia
RRKDGRTAIDIARELNNTGIIGLL

SEQ ID NO: 3169137 - protein, 20 aa, Giardia lamblia
RRKIPVPIAVILSVMKQVAA

SEQ ID NO: 3169138 - protein, 18 aa, Giardia lamblia
RRKLHYFHYMLPILALER

SEQ ID NO: 3169139 - protein, 21 aa, Giardia lamblia
RRKNCHVKGRVIRMMRAGIYE

SEQ ID NO: 3169140 - protein, 25 aa, Giardia lamblia
RRKPRMLHCGALIRQSDEGYTLVDS

SEQ ID NO: 3169141 - protein, 33 aa, Giardia lamblia
RRKRMELCEPVASPLRMVLTQSISSPEDAVNVT

SEQ ID NO: 3169142 - protein, 17 aa, Giardia lamblia
RRKSLVSCDFFEKVYAA

SEQ ID NO: 3169143 - protein, 17 aa, Giardia lamblia
RRKVDGAQDVAMVTSYF

SEQ ID NO: 3169144 - protein, 20 aa, Giardia lamblia
RRLARDHLLQVKAEISEALE

SEQ ID NO: 3169145 - protein, 22 aa, Giardia lamblia
RRLATSEGRDGDKLSLFGKIGC

SEQ ID NO: 3169146 - protein, 23 aa, Giardia lamblia
RRLCDETPFLSGSRYIHVTAELK

SEQ ID NO: 3169147 - protein, 22 aa, Giardia lamblia
RRLCMLKAQIACLEVSLQSYKK

SEQ ID NO: 3169148 - protein, 19 aa, Giardia lamblia
RRLDGRGKAIASLTEATQP

SEQ ID NO: 3169149 - protein, 19 aa, Giardia lamblia
RRLDTEFDEVRRQADALAS

SEQ ID NO: 3169150 - protein, 18 aa, Giardia lamblia
RRLEAEGVALRQQLEEMR

SEQ ID NO: 3169151 - protein, 18 aa, Giardia lamblia
RRLEREAAEEAARKAAEE

SEQ ID NO: 3169152 - protein, 18 aa, Giardia lamblia
RRLGALSGCTGRSAPPLP

SEQ ID NO: 3169153 - protein, 31 aa, Giardia lamblia
RRLGRLLSWAFLHRRCLPLHLSNLMVALLKF

SEQ ID NO: 3169154 - protein, 17 aa, Giardia lamblia
RRLIPVAGNAQPAHGSR

SEQ ID NO: 3169155 - protein, 17 aa, Giardia lamblia
RRLKKVKANAEKFITQR

SEQ ID NO: 3169156 - protein, 19 aa, Giardia lamblia
RRLLEEKIATLESQIGSTG

SEQ ID NO: 3169157 - protein, 21 aa, Giardia lamblia
RRLLELESFLLRRKNSILNTL

SEQ ID NO: 3169158 - protein, 22 aa, Giardia lamblia
RRLLHDILTAWPLSDQTLANLV

SEQ ID NO: 3169159 - protein, 21 aa, Giardia lamblia
RRLLKTYCEEWLSARSLTPEF

SEQ ID NO: 3169160 - protein, 19 aa, Giardia lamblia
RRLMSISSSVYLKADTQAM

SEQ ID NO: 3169161 - protein, 27 aa, Giardia lamblia
RRLMSWSVRCLPRVFKTLAKRDKLAPP

SEQ ID NO: 3169162 - protein, 20 aa, Giardia lamblia
RRLNSSIPYSVSNSTQSDGQ

SEQ ID NO: 3169163 - protein, 18 aa, Giardia lamblia
RRLPFAIRQHNPLKNPPL

SEQ ID NO: 3169164 - protein, 20 aa, Giardia lamblia
RRLPFTRGIENEIHNFLVSE

SEQ ID NO: 3169165 - protein, 17 aa, Giardia lamblia
RRLPGLKKLDGLPVTDD

SEQ ID NO: 3169166 - protein, 20 aa, Giardia lamblia
RRLPPTLLSALRRLANNQGT

SEQ ID NO: 3169167 - protein, 19 aa, Giardia lamblia
RRLQEDLAKASREASSAID

SEQ ID NO: 3169168 - protein, 19 aa, Giardia lamblia
RRLQFSKSQILTIVTQVSA

SEQ ID NO: 3169169 - protein, 20 aa, Giardia lamblia
RRLQISTGLHYSGFNNAKRL

SEQ ID NO: 3169170 - protein, 24 aa, Giardia lamblia
RRLQRKGIWNSLWVMEYEIKGFHG

SEQ ID NO: 3169171 - protein, 20 aa, Giardia lamblia
RRLRESGAYTSPPETNRFKQ

SEQ ID NO: 3169172 - protein, 20 aa, Giardia lamblia
RRLSDENFFLAGENSVLLGA

SEQ ID NO: 3169173 - protein, 17 aa, Giardia lamblia
RRLSELRPDELGPLRVM

SEQ ID NO: 3169174 - protein, 24 aa, Giardia lamblia
RRLTEAELYLLSKIGDYKSNSTAT

SEQ ID NO: 3169175 - protein, 18 aa, Giardia lamblia
RRLVGLTLEKKCPENVAQ

SEQ ID NO: 3169176 - protein, 18 aa, Giardia lamblia
RRLYSLALREHLQISTTY

SEQ ID NO: 3169177 - protein, 19 aa, Giardia lamblia
RRMKSEMLQQIDGLSSYID

SEQ ID NO: 3169178 - protein, 20 aa, Giardia lamblia
RRMSHPHIIAYYSTIHDQDA

SEQ ID NO: 3169179 - protein, 26 aa, Giardia lamblia
RRNAFSRRRVNVLFSEVVPIHAVTIS

SEQ ID NO: 3169180 - protein, 19 aa, Giardia lamblia
RRNCPMCRAHIEEWKVDLE

SEQ ID NO: 3169181 - protein, 24 aa, Giardia lamblia
RRNICCLTGTWSPDIFALMNNRTL

SEQ ID NO: 3169182 - protein, 33 aa, Giardia lamblia
RRNIKLQAALWKHKRTLLHIDIKDLLEKYNVSN

SEQ ID NO: 3169183 - protein, 24 aa, Giardia lamblia
RRNLPDFFIRSLSSIDHYIGKRVL

SEQ ID NO: 3169184 - protein, 24 aa, Giardia lamblia
RRPGWCLEGRGPALVRLVMVNPYL

SEQ ID NO: 3169185 - protein, 19 aa, Giardia lamblia
RRPIMFVVFVPEWRVPPAQ

SEQ ID NO: 3169186 - protein, 19 aa, Giardia lamblia
RRPLSAASEGVFGALSLHP

SEQ ID NO: 3169187 - protein, 17 aa, Giardia lamblia
RRPNRKSLADARLYVAP

SEQ ID NO: 3169188 - protein, 20 aa, Giardia lamblia
RRPPRWPGVFGPGIRRAIRP

SEQ ID NO: 3169189 - protein, 17 aa, Giardia lamblia
RRPQSAAAMYTQSHEAR

SEQ ID NO: 3169190 - protein, 27 aa, Giardia lamblia
RRPVDIELPPASSLVNFPPAYTRAHES

SEQ ID NO: 3169191 - protein, 17 aa, Giardia lamblia
RRQALQHRFCKLLYDAS

SEQ ID NO: 3169192 - protein, 25 aa, Giardia lamblia
RRQDGKGYTALMWAAVAGDVTMVRL

SEQ ID NO: 3169193 - protein, 23 aa, Giardia lamblia
RRQFPRFYFVSSTDLLDILSKGQ

SEQ ID NO: 3169194 - protein, 19 aa, Giardia lamblia
RRQGIIYKRNEIFIDVVES

SEQ ID NO: 3169195 - protein, 18 aa, Giardia lamblia
RRQGPAAAPLNVHVSDTE

SEQ ID NO: 3169196 - protein, 17 aa, Giardia lamblia
RRQLGCHSLEKLVDDIW

SEQ ID NO: 3169197 - protein, 24 aa, Giardia lamblia
RRQRRRFTPEIAMVKEARQTTDAE

SEQ ID NO: 3169198 - protein, 26 aa, Giardia lamblia
RRQSELFYTRCFLARGLLPSKETPPR

SEQ ID NO: 3169199 - protein, 20 aa, Giardia lamblia
RRQVVLATQILVSWKAHIKA

SEQ ID NO: 3169200 - protein, 28 aa, Giardia lamblia
RRRAASLDQYFVFSLLIFDKFRHNAEAE

SEQ ID NO: 3169201 - protein, 17 aa, Giardia lamblia
RRRCHLRGALKKRRVMM

SEQ ID NO: 3169202 - protein, 17 aa, Giardia lamblia
RRRKRKLTELKTLVDEE

SEQ ID NO: 3169203 - protein, 18 aa, Giardia lamblia
RRRLKIPVGSPVSVNADQ

SEQ ID NO: 3169204 - protein, 18 aa, Giardia lamblia
RRRLPILNPTTREVISDV

SEQ ID NO: 3169205 - protein, 18 aa, Giardia lamblia
RRRLRPIVDPTPNGSYHS

SEQ ID NO: 3169206 - protein, 18 aa, Giardia lamblia
RRRLSSVMMPLRAIGLIA

SEQ ID NO: 3169207 - protein, 18 aa, Giardia lamblia
RRRMPPPVVLWATHGPTF

SEQ ID NO: 3169208 - protein, 23 aa, Giardia lamblia
RRRNLSVIIIATFTMRAEDATFL

SEQ ID NO: 3169209 - protein, 17 aa, Giardia lamblia
RRRRIGKNIKYSGRKDF

SEQ ID NO: 3169210 - protein, 27 aa, Giardia lamblia
RRRRSLPRLRVFFAKRFSIRIRNGVRM

SEQ ID NO: 3169211 - protein, 22 aa, Giardia lamblia
RRRSCRRFLTASAILDDKITMN

SEQ ID NO: 3169212 - protein, 32 aa, Giardia lamblia
RRRYGSCCCFIYHCACGNPKSVTAWPPPLRDY

SEQ ID NO: 3169213 - protein, 25 aa, Giardia lamblia
RRSAMKIAALLAMKVGVEPIKGMLG

SEQ ID NO: 3169214 - protein, 24 aa, Giardia lamblia
RRSDAAEALAMFGVLASAGQSANG

SEQ ID NO: 3169215 - protein, 21 aa, Giardia lamblia
RRSEMFGGILSRFLRIPVTLQ

SEQ ID NO: 3169216 - protein, 18 aa, Giardia lamblia
RRSGALLYFRAFEHADDA

SEQ ID NO: 3169217 - protein, 23 aa, Giardia lamblia
RRSGRARGPYRGEQKIEDSPLIK

SEQ ID NO: 3169218 - protein, 17 aa, Giardia lamblia
RRSGRSWQPIEYTDVKL

SEQ ID NO: 3169219 - protein, 21 aa, Giardia lamblia
RRSRIKLELKDGATAPSVEPS

SEQ ID NO: 3169220 - protein, 33 aa, Giardia lamblia
RRSSRPAIPVPIVKTFARHLLVALGYVHAAGYV

SEQ ID NO: 3169221 - protein, 19 aa, Giardia lamblia
RRSWYCAMENTNLSSHVND

SEQ ID NO: 3169222 - protein, 21 aa, Giardia lamblia
RRTGESSPRIRRSTTGEPGED

SEQ ID NO: 3169223 - protein, 18 aa, Giardia lamblia
RRTHASPGPGDYEIALSH

SEQ ID NO: 3169224 - protein, 21 aa, Giardia lamblia
RRTKYGEFKDIFGSTRGLKLN

SEQ ID NO: 3169225 - protein, 17 aa, Giardia lamblia
RRTNLGREMSWEIEVGE

SEQ ID NO: 3169226 - protein, 19 aa, Giardia lamblia
RRTPARAGSTASRATSQST

SEQ ID NO: 3169227 - protein, 19 aa, Giardia lamblia
RRTRFRAKVFTTIPPDPPP

SEQ ID NO: 3169228 - protein, 23 aa, Giardia lamblia
RRTSFYCFCKGIVQGLINISTGA

SEQ ID NO: 3169229 - protein, 17 aa, Giardia lamblia
RRVDLLSVLVCATDEAT

SEQ ID NO: 3169230 - protein, 19 aa, Giardia lamblia
RRVEEKKQEIAGFLHNNYL

SEQ ID NO: 3169231 - protein, 18 aa, Giardia lamblia
RRVGEWTYTPVLPNNIPI

SEQ ID NO: 3169232 - protein, 19 aa, Giardia lamblia
RRVGFPVFSTLIVANYVAK

SEQ ID NO: 3169233 - protein, 29 aa, Giardia lamblia
RRVGFVRVRLFRPFSIELFSNAIPKSAKV

SEQ ID NO: 3169234 - protein, 23 aa, Giardia lamblia
RRVGPCTEALAADLSSPVFKDLV

SEQ ID NO: 3169235 - protein, 24 aa, Giardia lamblia
RRVLRLPKQRRFVLTDFPRLFYID

SEQ ID NO: 3169236 - protein, 26 aa, Giardia lamblia
RRVLTLYNLRCCYWESASGEVGIHHA

SEQ ID NO: 3169237 - protein, 19 aa, Giardia lamblia
RRVPIKLLTLHASSGNVQA

SEQ ID NO: 3169238 - protein, 23 aa, Giardia lamblia
RRVRGHCGILPPVESTLSVAPFS

SEQ ID NO: 3169239 - protein, 25 aa, Giardia lamblia
RRVSRAAAPLAKWIQANIKYAEVCT

SEQ ID NO: 3169240 - protein, 21 aa, Giardia lamblia
RRVVSPSARSVEKFKALTNYI

SEQ ID NO: 3169241 - protein, 25 aa, Giardia lamblia
RRVYKYDWFARLFLAIILSIPTCDP

SEQ ID NO: 3169242 - protein, 18 aa, Giardia lamblia
RRWKEERIQLKKQGIAED

SEQ ID NO: 3169243 - protein, 20 aa, Giardia lamblia
RRYDPIPSFVNDQAKNLLEA

SEQ ID NO: 3169244 - protein, 21 aa, Giardia lamblia
RRYFCRVCHDPFVKPMTTKCG

SEQ ID NO: 3169245 - protein, 21 aa, Giardia lamblia
RRYIDGVLYFKSNDSAGNARV

SEQ ID NO: 3169246 - protein, 18 aa, Giardia lamblia
RRYIELFLNSLAVEPVAN

SEQ ID NO: 3169247 - protein, 19 aa, Giardia lamblia
RRYITRKGPLVIYNTEDVA

SEQ ID NO: 3169248 - protein, 19 aa, Giardia lamblia
RRYYFLTVFRNARELRENF

SEQ ID NO: 3169249 - protein, 18 aa, Giardia lamblia
RSAAGPIDTSEELREAKE

SEQ ID NO: 3169250 - protein, 20 aa, Giardia lamblia
RSADQRYLLLRIKVDTSNEY

SEQ ID NO: 3169251 - protein, 21 aa, Giardia lamblia
RSAFDVPLACDKCIAEFADKR

SEQ ID NO: 3169252 - protein, 18 aa, Giardia lamblia
RSAIFSFGCVVYALCTCT

SEQ ID NO: 3169253 - protein, 20 aa, Giardia lamblia
RSALAEALIMAADRATDPIS

SEQ ID NO: 3169254 - protein, 23 aa, Giardia lamblia
RSAPKALPTRCIEHITVETQTPR

SEQ ID NO: 3169255 - protein, 18 aa, Giardia lamblia
RSAPPLPELPRLGSTAGV

SEQ ID NO: 3169256 - protein, 17 aa, Giardia lamblia
RSAPRLDPEVDQLLSDA

SEQ ID NO: 3169257 - protein, 26 aa, Giardia lamblia
RSARGAGCSFGLIPVLKFLHDNQLSH

SEQ ID NO: 3169258 - protein, 18 aa, Giardia lamblia
RSARHGLAAEVSHQDDAR

SEQ ID NO: 3169259 - protein, 24 aa, Giardia lamblia
RSASFQPRRRSALTTSLANMRESG

SEQ ID NO: 3169260 - protein, 24 aa, Giardia lamblia
RSAVNCLKILDAEVGLKDNNGETA

SEQ ID NO: 3169261 - protein, 22 aa, Giardia lamblia
RSCEFLTSYGAMFSFNEVTTGV

SEQ ID NO: 3169262 - protein, 27 aa, Giardia lamblia
RSCSAEYPKSLGAVIVYCYTRDETEAV

SEQ ID NO: 3169263 - protein, 23 aa, Giardia lamblia
RSCSKFVCGAACAYRLKYRPPQS

SEQ ID NO: 3169264 - protein, 17 aa, Giardia lamblia
RSDGSNCEYLQSFVQDP

SEQ ID NO: 3169265 - protein, 19 aa, Giardia lamblia
RSDGYLDIYDLFYKVDTPT

SEQ ID NO: 3169266 - protein, 18 aa, Giardia lamblia
RSDIYTYLQMALRKQTQK

SEQ ID NO: 3169267 - protein, 17 aa, Giardia lamblia
RSDKSNMLWSGYMQKII

SEQ ID NO: 3169268 - protein, 20 aa, Giardia lamblia
RSDLEKVFQFLVPNIDRQQR

SEQ ID NO: 3169269 - protein, 21 aa, Giardia lamblia
RSDNLFKFIVMRRQLKYWMAL

SEQ ID NO: 3169270 - protein, 23 aa, Giardia lamblia
RSDRGEFLGTLGLSDSDGEDADY

SEQ ID NO: 3169271 - protein, 20 aa, Giardia lamblia
RSDSIYCPLCESTISTTKCP

SEQ ID NO: 3169272 - protein, 32 aa, Giardia lamblia
RSDVFALGVMLYRMMYFTLPFPDGEVLANFNC

SEQ ID NO: 3169273 - protein, 17 aa, Giardia lamblia
RSECIYVQGLAKQLLSI

SEQ ID NO: 3169274 - protein, 20 aa, Giardia lamblia
RSEKRTDYIFISKPSIDFGL

SEQ ID NO: 3169275 - protein, 26 aa, Giardia lamblia
RSELERRRVSTSGAFSLGQEQPAKPL

SEQ ID NO: 3169276 - protein, 20 aa, Giardia lamblia
RSEMQIAYQAFRGVDLTSEI

SEQ ID NO: 3169277 - protein, 19 aa, Giardia lamblia
RSERLVRLYPFGSYYLGIN

SEQ ID NO: 3169278 - protein, 17 aa, Giardia lamblia
RSEVVELLLPHEGGMRL

SEQ ID NO: 3169279 - protein, 22 aa, Giardia lamblia
RSFFITNGRLFWSANGGCLAII

SEQ ID NO: 3169280 - protein, 19 aa, Giardia lamblia
RSFISLAHIQQPMVMNDSL

SEQ ID NO: 3169281 - protein, 17 aa, Giardia lamblia
RSFIWTIGFILFNMMCS

SEQ ID NO: 3169282 - protein, 28 aa, Giardia lamblia
RSFKRIKCGVALGISREALLGASLTKGR

SEQ ID NO: 3169283 - protein, 18 aa, Giardia lamblia
RSFTSCFSMVPFVIDLSM

SEQ ID NO: 3169284 - protein, 17 aa, Giardia lamblia
RSGACVGALRMVETYAF

SEQ ID NO: 3169285 - protein, 19 aa, Giardia lamblia
RSGDSFGEYNSRTLGAPST

SEQ ID NO: 3169286 - protein, 25 aa, Giardia lamblia
RSGELRCSPHYVALSPTYAQPIAPS

SEQ ID NO: 3169287 - protein, 27 aa, Giardia lamblia
RSGESLKPFSKRCRRLAKTLQSTTQDY

SEQ ID NO: 3169288 - protein, 17 aa, Giardia lamblia
RSGETALSMAIEQAFEP

SEQ ID NO: 3169289 - protein, 20 aa, Giardia lamblia
RSGGSINVFTLAGAKKGKTL

SEQ ID NO: 3169290 - protein, 29 aa, Giardia lamblia
RSGKRTHKEMMRMRFLEAQISKLDSEANQ

SEQ ID NO: 3169291 - protein, 23 aa, Giardia lamblia
RSGLRATSRIPIAGLTRSVSNAD

SEQ ID NO: 3169292 - protein, 17 aa, Giardia lamblia
RSGMRLVKINPEALSNN

SEQ ID NO: 3169293 - protein, 22 aa, Giardia lamblia
RSGPRCELSCTEIHELQNLGNE

SEQ ID NO: 3169294 - protein, 17 aa, Giardia lamblia
RSGPYAPTLHRYPSDQV

SEQ ID NO: 3169295 - protein, 25 aa, Giardia lamblia
RSGSRACTLCQGVIPSSATMTPSRA

SEQ ID NO: 3169296 - protein, 18 aa, Giardia lamblia
RSGWYMRKGTALMMAAAM

SEQ ID NO: 3169297 - protein, 18 aa, Giardia lamblia
RSGWYMRKGTALMVAAAM

SEQ ID NO: 3169298 - protein, 23 aa, Giardia lamblia
RSHARVPIIKGVHSELSLEYDIS

SEQ ID NO: 3169299 - protein, 18 aa, Giardia lamblia
RSHCIFTIHIRSREPGSD

SEQ ID NO: 3169300 - protein, 27 aa, Giardia lamblia
RSHFLRAAYYFKSAAKFIGSLPQAIHN

SEQ ID NO: 3169301 - protein, 18 aa, Giardia lamblia
RSHGVCLRDDMGESFFER

SEQ ID NO: 3169302 - protein, 21 aa, Giardia lamblia
RSHLRCVYSSLVHAASVTSLR

SEQ ID NO: 3169303 - protein, 19 aa, Giardia lamblia
RSHQARHFGPRTMQSQTLD

SEQ ID NO: 3169304 - protein, 25 aa, Giardia lamblia
RSHSAARQRVCIDFSEEGRRAYKEG

SEQ ID NO: 3169305 - protein, 20 aa, Giardia lamblia
RSHVRSVWRNGEWSPLELVN

SEQ ID NO: 3169306 - protein, 22 aa, Giardia lamblia
RSHYGPSYYRRGYYNEELAEML

SEQ ID NO: 3169307 - protein, 25 aa, Giardia lamblia
RSIEKDCYCYTLAPSSPISVPGVIK

SEQ ID NO: 3169308 - protein, 20 aa, Giardia lamblia
RSIICCLMLQDIFGACDKYR

SEQ ID NO: 3169309 - protein, 26 aa, Giardia lamblia
RSILSREMCIFLELYAQRYGTYGTRF

SEQ ID NO: 3169310 - protein, 17 aa, Giardia lamblia
RSIPILNTIVQNYVGDC

SEQ ID NO: 3169311 - protein, 20 aa, Giardia lamblia
RSIPKFKPEHAVLDRVVMRF

SEQ ID NO: 3169312 - protein, 19 aa, Giardia lamblia
RSIRIKFSPQRGGKPSHFG

SEQ ID NO: 3169313 - protein, 17 aa, Giardia lamblia
RSITRSYYRGSCCALLV

SEQ ID NO: 3169314 - protein, 26 aa, Giardia lamblia
RSIVAMRRRAIRFSDIKPLPYSNFQR

SEQ ID NO: 3169315 - protein, 17 aa, Giardia lamblia
RSKDDCQIPSYYGTVRM

SEQ ID NO: 3169316 - protein, 24 aa, Giardia lamblia
RSKDSRCKFTLLIPPPNVTGSLHI

SEQ ID NO: 3169317 - protein, 21 aa, Giardia lamblia
RSKIRCKVFLGYTSNLVSSGL

SEQ ID NO: 3169318 - protein, 22 aa, Giardia lamblia
RSKKELFFLVAATMQKVKKPQH

SEQ ID NO: 3169319 - protein, 25 aa, Giardia lamblia
RSKMKSCSCVHPLGTNDPVRTSSTQ

SEQ ID NO: 3169320 - protein, 30 aa, Giardia lamblia
RSKPRTLVPLDIWKCQAIFQEETTKKIVAQ

SEQ ID NO: 3169321 - protein, 25 aa, Giardia lamblia
RSKRLDCVRYLLPERNIHNTYGRTP

SEQ ID NO: 3169322 - protein, 21 aa, Giardia lamblia
RSKSAAREDLERAVSKADKAL

SEQ ID NO: 3169323 - protein, 24 aa, Giardia lamblia
RSKTASECQLEFPPRSVSVNTLSK

SEQ ID NO: 3169324 - protein, 30 aa, Giardia lamblia
RSLCDTCRRFPTLSFLCSSCHCVLRRPVRL

SEQ ID NO: 3169325 - protein, 18 aa, Giardia lamblia
RSLDVCQSYLPKAKKMAA

SEQ ID NO: 3169326 - protein, 19 aa, Giardia lamblia
RSLLCKHFATEGSPDVFDT

SEQ ID NO: 3169327 - protein, 19 aa, Giardia lamblia
RSLLEKRLASGTTDTFVHT

SEQ ID NO: 3169328 - protein, 27 aa, Giardia lamblia
RSLPCEKLHPVVKLFGSIYGKKFIDQA

SEQ ID NO: 3169329 - protein, 31 aa, Giardia lamblia
RSLRTMYAISLYRRGCAYSPDGSFLVATCGF

SEQ ID NO: 3169330 - protein, 25 aa, Giardia lamblia
RSLRVGALCAIFVPCLEQVHTAVQA

SEQ ID NO: 3169331 - protein, 17 aa, Giardia lamblia
RSLSCSYAAKPIIENFP

SEQ ID NO: 3169332 - protein, 19 aa, Giardia lamblia
RSLTNSFGLDNSMRNMQAM

SEQ ID NO: 3169333 - protein, 20 aa, Giardia lamblia
RSNDKICVAMFRKATEAKTQ

SEQ ID NO: 3169334 - protein, 19 aa, Giardia lamblia
RSNLGRFALYNAASNNHVK

SEQ ID NO: 3169335 - protein, 20 aa, Giardia lamblia
RSNNGMTALMYAARSNKPEV

SEQ ID NO: 3169336 - protein, 17 aa, Giardia lamblia
RSNYFGRTRNAKIGTTE

SEQ ID NO: 3169337 - protein, 19 aa, Giardia lamblia
RSPLDEWMLIASKNRASSK

SEQ ID NO: 3169338 - protein, 19 aa, Giardia lamblia
RSPLGRCPDASAVVTFHPD

SEQ ID NO: 3169339 - protein, 24 aa, Giardia lamblia
RSPLWFEKFHWFFSTDGYLVLSGR

SEQ ID NO: 3169340 - protein, 24 aa, Giardia lamblia
RSPPKMCSQDGLFVVQSRSGSIQV

SEQ ID NO: 3169341 - protein, 25 aa, Giardia lamblia
RSPRQKVAFSIEMVDIISNIQGPIS

SEQ ID NO: 3169342 - protein, 19 aa, Giardia lamblia
RSPSMTFGATLGVPPDHNY

SEQ ID NO: 3169343 - protein, 20 aa, Giardia lamblia
RSPSPMRRLYSTKALLSTAA

SEQ ID NO: 3169344 - protein, 18 aa, Giardia lamblia
RSPVSASLVASAAHSQRI

SEQ ID NO: 3169345 - protein, 17 aa, Giardia lamblia
RSQELAARFHHYSIRDS

SEQ ID NO: 3169346 - protein, 19 aa, Giardia lamblia
RSQGKIVIIYKAARTAEGS

SEQ ID NO: 3169347 - protein, 22 aa, Giardia lamblia
RSRASELLLSMRARLQDAKGLL

SEQ ID NO: 3169348 - protein, 23 aa, Giardia lamblia
RSRDSCVSLAHIFSAVEDQAYYY

SEQ ID NO: 3169349 - protein, 17 aa, Giardia lamblia
RSREFSTTFSHNFLGEV

SEQ ID NO: 3169350 - protein, 23 aa, Giardia lamblia
RSRELGKCFANVTFIKTRAEGSN

SEQ ID NO: 3169351 - protein, 20 aa, Giardia lamblia
RSRLEDIEYAKALQEEEALR

SEQ ID NO: 3169352 - protein, 21 aa, Giardia lamblia
RSRLLSILCECIADINIRIRI

SEQ ID NO: 3169353 - protein, 19 aa, Giardia lamblia
RSRLQILERRALEEDLVSN

SEQ ID NO: 3169354 - protein, 26 aa, Giardia lamblia
RSRNWRASTPLPKRRDAKGKRSSQPT

SEQ ID NO: 3169355 - protein, 21 aa, Giardia lamblia
RSRPPEPMNFAPSPPSVPSSE

SEQ ID NO: 3169356 - protein, 19 aa, Giardia lamblia
RSRSELKASAAAQASVLAR

SEQ ID NO: 3169357 - protein, 21 aa, Giardia lamblia
RSRSKPVASLSIYYRDLSPST

SEQ ID NO: 3169358 - protein, 18 aa, Giardia lamblia
RSRTPSCEQPRPEQTLKE

SEQ ID NO: 3169359 - protein, 23 aa, Giardia lamblia
RSRVPTQVFKLALDRDNVMCPYL

SEQ ID NO: 3169360 - protein, 24 aa, Giardia lamblia
RSRYGRPASGLAVLNASSVHGSKY

SEQ ID NO: 3169361 - protein, 23 aa, Giardia lamblia
RSSAEIHAKCLVRIKDNIKRLSV

SEQ ID NO: 3169362 - protein, 22 aa, Giardia lamblia
RSSELFTNLSASYMNAHSNSDA

SEQ ID NO: 3169363 - protein, 22 aa, Giardia lamblia
RSSFPLNIFLGSDYNLFSGEDL

SEQ ID NO: 3169364 - protein, 19 aa, Giardia lamblia
RSSIIGRSAYSPGTMSDEL

SEQ ID NO: 3169365 - protein, 24 aa, Giardia lamblia
RSSLARLSAFLAEYDLHTIELRKN

SEQ ID NO: 3169366 - protein, 21 aa, Giardia lamblia
RSSLPEGICRTVWGRLQESVG

SEQ ID NO: 3169367 - protein, 24 aa, Giardia lamblia
RSSLQKRFESIINYEETMRMATVA

SEQ ID NO: 3169368 - protein, 17 aa, Giardia lamblia
RSSRPSSARAASRPGSA

SEQ ID NO: 3169369 - protein, 17 aa, Giardia lamblia
RSSSFKCSSYVSERSDS

SEQ ID NO: 3169370 - protein, 26 aa, Giardia lamblia
RSSSMPNIFPERLLATYADDSETHLR

SEQ ID NO: 3169371 - protein, 18 aa, Giardia lamblia
RSSVFKMGRQPKRQRDIL

SEQ ID NO: 3169372 - protein, 18 aa, Giardia lamblia
RSSVFTNDRAEAMQQSAV

SEQ ID NO: 3169373 - protein, 19 aa, Giardia lamblia
RSSVFVEGYFPIRRNGSYV

SEQ ID NO: 3169374 - protein, 20 aa, Giardia lamblia
RSSVNLGEIALWHVTNVPVI

SEQ ID NO: 3169375 - protein, 18 aa, Giardia lamblia
RSTAGCTFGSRLGTPNPR

SEQ ID NO: 3169376 - protein, 20 aa, Giardia lamblia
RSTGCTMSYCEHLRERLKQN

SEQ ID NO: 3169377 - protein, 20 aa, Giardia lamblia
RSTLEVHLANPLCIHATDNN

SEQ ID NO: 3169378 - protein, 17 aa, Giardia lamblia
RSTPCYDTMINIIRVLY

SEQ ID NO: 3169379 - protein, 17 aa, Giardia lamblia
RSTSPYAAYKVNFANDL

SEQ ID NO: 3169380 - protein, 27 aa, Giardia lamblia
RSVAVTDNCLVCIGPRHSSPSARSKSP

SEQ ID NO: 3169381 - protein, 17 aa, Giardia lamblia
RSVDPDSGLAFPLSLSI

SEQ ID NO: 3169382 - protein, 19 aa, Giardia lamblia
RSVDSSSRMSKGVRDLERS

SEQ ID NO: 3169383 - protein, 18 aa, Giardia lamblia
RSVEKFKALTNYILASNQ

SEQ ID NO: 3169384 - protein, 18 aa, Giardia lamblia
RSVFLLSQHVQDFSLFTL

SEQ ID NO: 3169385 - protein, 20 aa, Giardia lamblia
RSVHADSFFDLAREPEFTLE

SEQ ID NO: 3169386 - protein, 30 aa, Giardia lamblia
RSVHDGLCAIRCLIKKGFIIPGGAAVETEI

SEQ ID NO: 3169387 - protein, 18 aa, Giardia lamblia
RSVIELDPAAGCIPKTAD

SEQ ID NO: 3169388 - protein, 20 aa, Giardia lamblia
RSVKLLLDHELGAKDHDGDT

SEQ ID NO: 3169389 - protein, 20 aa, Giardia lamblia
RSVLCPRPISVGTFNGKSYL

SEQ ID NO: 3169390 - protein, 21 aa, Giardia lamblia
RSVLQETMRIVGRSNCRRRFD

SEQ ID NO: 3169391 - protein, 19 aa, Giardia lamblia
RSVVTCSPTRLAIQLLTLP

SEQ ID NO: 3169392 - protein, 17 aa, Giardia lamblia
RSYDELTHMPPKPQSSG

SEQ ID NO: 3169393 - protein, 20 aa, Giardia lamblia
RSYFRSHELTLYRGFPDGKE

SEQ ID NO: 3169394 - protein, 28 aa, Giardia lamblia
RSYRRRSKSEYKYLYASIKEMEARQFEL

SEQ ID NO: 3169395 - protein, 17 aa, Giardia lamblia
RTAAPLTSARCISNRYL

SEQ ID NO: 3169396 - protein, 19 aa, Giardia lamblia
RTACERAKRTLSSSQQASI

SEQ ID NO: 3169397 - protein, 19 aa, Giardia lamblia
RTACGIWTCRSCSKTMAGG

SEQ ID NO: 3169398 - protein, 23 aa, Giardia lamblia
RTADGRTALMIAAISGSTEAMRA

SEQ ID NO: 3169399 - protein, 18 aa, Giardia lamblia
RTAEVFCLFCRATGPIGL

SEQ ID NO: 3169400 - protein, 18 aa, Giardia lamblia
RTAFLHAVANRHSGCVHA

SEQ ID NO: 3169401 - protein, 21 aa, Giardia lamblia
RTAGNLPPWHQHYRAGPLELL

SEQ ID NO: 3169402 - protein, 17 aa, Giardia lamblia
RTALMGATIYGHTDAVK

SEQ ID NO: 3169403 - protein, 19 aa, Giardia lamblia
RTALMIAAICGHVEMARLL

SEQ ID NO: 3169404 - protein, 20 aa, Giardia lamblia
RTALMLAVLCQNSYAFSKLH

SEQ ID NO: 3169405 - protein, 21 aa, Giardia lamblia
RTALVEGRTAMFISADHYDLY

SEQ ID NO: 3169406 - protein, 21 aa, Giardia lamblia
RTAPERILTVFSGERHEKPCY

SEQ ID NO: 3169407 - protein, 18 aa, Giardia lamblia
RTAQDWASTAGHEECAVT

SEQ ID NO: 3169408 - protein, 27 aa, Giardia lamblia
RTCLMIAALSRSLSCVRVLAEQRIGMG

SEQ ID NO: 3169409 - protein, 17 aa, Giardia lamblia
RTDGVIVVLNEECDNCG

SEQ ID NO: 3169410 - protein, 18 aa, Giardia lamblia
RTDIYNMNALDYAVISKS

SEQ ID NO: 3169411 - protein, 17 aa, Giardia lamblia
RTDKALFISPIPTRSSP

SEQ ID NO: 3169412 - protein, 19 aa, Giardia lamblia
RTDLKYDMSSILHADSRSK

SEQ ID NO: 3169413 - protein, 20 aa, Giardia lamblia
RTDNSWCVVKARGVEDAERI

SEQ ID NO: 3169414 - protein, 26 aa, Giardia lamblia
RTELPDNLKALFRPIIMTKPDNAIIA

SEQ ID NO: 3169415 - protein, 33 aa, Giardia lamblia
RTELPDNLKALFRPISMCVPDFAMITEIMLVSN

SEQ ID NO: 3169416 - protein, 18 aa, Giardia lamblia
RTELPKPVRAQLDKQDQY

SEQ ID NO: 3169417 - protein, 18 aa, Giardia lamblia
RTENALRIKVEKAHKKLE

SEQ ID NO: 3169418 - protein, 22 aa, Giardia lamblia
RTENFCCYNHILSFSDPQLEPN

SEQ ID NO: 3169419 - protein, 19 aa, Giardia lamblia
RTEYEKLHTALRKSHENEK

SEQ ID NO: 3169420 - protein, 24 aa, Giardia lamblia
RTFARKTAAEWARTYNFPACAELI

SEQ ID NO: 3169421 - protein, 20 aa, Giardia lamblia
RTFTAFGMNNIVVFAFLSRA

SEQ ID NO: 3169422 - protein, 23 aa, Giardia lamblia
RTFYELSNGTALMIAAAKGHDSC

SEQ ID NO: 3169423 - protein, 20 aa, Giardia lamblia
RTGAFKAKKPISFGPCQVPT

SEQ ID NO: 3169424 - protein, 27 aa, Giardia lamblia
RTGALMCLNCGNIVCQAQGLGPCLFCG

SEQ ID NO: 3169425 - protein, 24 aa, Giardia lamblia
RTGCRINACRSAPCNLLAHNDLLV

SEQ ID NO: 3169426 - protein, 21 aa, Giardia lamblia
RTGGEIDRFLTLKSEIGHIYN

SEQ ID NO: 3169427 - protein, 29 aa, Giardia lamblia
RTGLDVLKTYSLSVLDDFVVAVRELCKDI

SEQ ID NO: 3169428 - protein, 19 aa, Giardia lamblia
RTGVLGAYLLASFNEECDQ

SEQ ID NO: 3169429 - protein, 17 aa, Giardia lamblia
RTHLSTMDGILALLQER

SEQ ID NO: 3169430 - protein, 18 aa, Giardia lamblia
RTIATPILAGVPYPRAGT

SEQ ID NO: 3169431 - protein, 19 aa, Giardia lamblia
RTIINLTPKHTFRDCAVDK

SEQ ID NO: 3169432 - protein, 26 aa, Giardia lamblia
RTIIVKRARFFGLTYPELTSAVYNAG

SEQ ID NO: 3169433 - protein, 23 aa, Giardia lamblia
RTIKRLKMYNTRPVRDEKGKILH

SEQ ID NO: 3169434 - protein, 26 aa, Giardia lamblia
RTIKRYVKESVVWEILYHVLSGLAYL

SEQ ID NO: 3169435 - protein, 23 aa, Giardia lamblia
RTITGPLLFPLRSVIHSESTCFA

SEQ ID NO: 3169436 - protein, 26 aa, Giardia lamblia
RTIVDRCRESGVLYTRYGVEKICKIR

SEQ ID NO: 3169437 - protein, 25 aa, Giardia lamblia
RTKEFSGGWLMRVSLAKALFVAPDI

SEQ ID NO: 3169438 - protein, 22 aa, Giardia lamblia
RTKKGRTALMLAASNGHADIAA

SEQ ID NO: 3169439 - protein, 25 aa, Giardia lamblia
RTKLEAIYPLLSWVPQRSKAYLESM

SEQ ID NO: 3169440 - protein, 24 aa, Giardia lamblia
RTKTIPLLCPFLKRKSISIPAQIT

SEQ ID NO: 3169441 - protein, 24 aa, Giardia lamblia
RTLCGHYYCYNCYMDCRENNWVCF

SEQ ID NO: 3169442 - protein, 19 aa, Giardia lamblia
RTLEMGARFISFDNVTGKW

SEQ ID NO: 3169443 - protein, 19 aa, Giardia lamblia
RTLGGISLGIYVQRPLTLA

SEQ ID NO: 3169444 - protein, 22 aa, Giardia lamblia
RTLHASCLFNEYYVVHGGTSAG

SEQ ID NO: 3169445 - protein, 18 aa, Giardia lamblia
RTLHPERPVALKTTNDAS

SEQ ID NO: 3169446 - protein, 26 aa, Giardia lamblia
RTLKFIPVPLLHWPDSTFTYCPEDKI

SEQ ID NO: 3169447 - protein, 28 aa, Giardia lamblia
RTLKGGDTELVLYCTHSWCPEKKEEASK

SEQ ID NO: 3169448 - protein, 19 aa, Giardia lamblia
RTLKPEVLAHYGPKFVQDL

SEQ ID NO: 3169449 - protein, 19 aa, Giardia lamblia
RTLKSLVDYIGNVLEHDVN

SEQ ID NO: 3169450 - protein, 19 aa, Giardia lamblia
RTLLSVGIKPDFLVCRTDT

SEQ ID NO: 3169451 - protein, 17 aa, Giardia lamblia
RTLPKLLKIDLGGNAVH

SEQ ID NO: 3169452 - protein, 19 aa, Giardia lamblia
RTLSDTCCELQKINGEIKD

SEQ ID NO: 3169453 - protein, 23 aa, Giardia lamblia
RTLSERRDQCLLSDPSKTPLMQS

SEQ ID NO: 3169454 - protein, 18 aa, Giardia lamblia
RTLVDRSPSMTFGATLGV

SEQ ID NO: 3169455 - protein, 17 aa, Giardia lamblia
RTLYQALAIHTEYHAKL

SEQ ID NO: 3169456 - protein, 25 aa, Giardia lamblia
RTMALKFGHSEIADFLSQYPEEQCT

SEQ ID NO: 3169457 - protein, 25 aa, Giardia lamblia
RTMENALRFGKPVMIVNLLEEIDPA

SEQ ID NO: 3169458 - protein, 17 aa, Giardia lamblia
RTNKGYTALMLAAEKNN

SEQ ID NO: 3169459 - protein, 18 aa, Giardia lamblia
RTNKNKCYTLLRKHSDAK

SEQ ID NO: 3169460 - protein, 18 aa, Giardia lamblia
RTNLSTYFRKVGRGQSVQ

SEQ ID NO: 3169461 - protein, 23 aa, Giardia lamblia
RTNPEYACILAFDIEVDKATEDY

SEQ ID NO: 3169462 - protein, 17 aa, Giardia lamblia
RTNYPIDAWHASKGGQF

SEQ ID NO: 3169463 - protein, 19 aa, Giardia lamblia
RTPDCAVSDKLADVSDNTD

SEQ ID NO: 3169464 - protein, 22 aa, Giardia lamblia
RTPDGRTALMLAAEHGSIACID

SEQ ID NO: 3169465 - protein, 17 aa, Giardia lamblia
RTPDLSFMNPDGFINIS

SEQ ID NO: 3169466 - protein, 19 aa, Giardia lamblia
RTPFDIILEKFTRALECIN

SEQ ID NO: 3169467 - protein, 20 aa, Giardia lamblia
RTPGAYTCLLYVVKRLRQGD

SEQ ID NO: 3169468 - protein, 25 aa, Giardia lamblia
RTPHFATNFIKCFEVDNGDTALTEL

SEQ ID NO: 3169469 - protein, 19 aa, Giardia lamblia
RTPKPPVYVRTGADTDLVE

SEQ ID NO: 3169470 - protein, 23 aa, Giardia lamblia
RTPLMYCVMHLALGPSAPANDAL

SEQ ID NO: 3169471 - protein, 19 aa, Giardia lamblia
RTPQEGCLRSSTGSAGSSR

SEQ ID NO: 3169472 - protein, 20 aa, Giardia lamblia
RTQAIFIEFLNFYKSIDREA

SEQ ID NO: 3169473 - protein, 25 aa, Giardia lamblia
RTQAQTAIIDLCFYVSDDSKSSLSL

SEQ ID NO: 3169474 - protein, 22 aa, Giardia lamblia
RTQDSPLRFSRQKDPDAFTTQM

SEQ ID NO: 3169475 - protein, 25 aa, Giardia lamblia
RTQLPPELCGPSFVAFHKQLLLSEI

SEQ ID NO: 3169476 - protein, 20 aa, Giardia lamblia
RTQRHGCPADEHDKDFSRTL

SEQ ID NO: 3169477 - protein, 23 aa, Giardia lamblia
RTRCYKFNMHPSLPHREPTYRHP

SEQ ID NO: 3169478 - protein, 18 aa, Giardia lamblia
RTRDPTLIMHQFTASVYA

SEQ ID NO: 3169479 - protein, 18 aa, Giardia lamblia
RTREEAMQIIKEKDAEIM

SEQ ID NO: 3169480 - protein, 21 aa, Giardia lamblia
RTRIELCSLRQDASIDRPSYR

SEQ ID NO: 3169481 - protein, 20 aa, Giardia lamblia
RTRIPLHNIWRNNVVYMPRL

SEQ ID NO: 3169482 - protein, 19 aa, Giardia lamblia
RTRLMRAAIRGCIETAKLV

SEQ ID NO: 3169483 - protein, 25 aa, Giardia lamblia
RTRLTRSLKETCEYNKYFAGSTSTL

SEQ ID NO: 3169484 - protein, 23 aa, Giardia lamblia
RTRPQERGLLVGFLGAPTGNPNS

SEQ ID NO: 3169485 - protein, 18 aa, Giardia lamblia
RTRSLVSLGGRSTRSSGS

SEQ ID NO: 3169486 - protein, 22 aa, Giardia lamblia
RTSDVCSAKAPLTATALLSTIQ

SEQ ID NO: 3169487 - protein, 18 aa, Giardia lamblia
RTSESIITASSRPSSAAP

SEQ ID NO: 3169488 - protein, 20 aa, Giardia lamblia
RTSGAKLVFYTIHGDNDRLQ

SEQ ID NO: 3169489 - protein, 18 aa, Giardia lamblia
RTSKSILYNSRRLNLSAD

SEQ ID NO: 3169490 - protein, 19 aa, Giardia lamblia
RTSMEIYFPIISTSTLTVI

SEQ ID NO: 3169491 - protein, 24 aa, Giardia lamblia
RTSRELRSTVGIERLDKGDYKNNP

SEQ ID NO: 3169492 - protein, 28 aa, Giardia lamblia
RTSRGIKAELLPSVLLECCKDEPCYAYL

SEQ ID NO: 3169493 - protein, 20 aa, Giardia lamblia
RTSRLRRLQFSKSQILTIVT

SEQ ID NO: 3169494 - protein, 24 aa, Giardia lamblia
RTSSPLRLQTRFERIMHVDDHAMA

SEQ ID NO: 3169495 - protein, 23 aa, Giardia lamblia
RTTERILRALSLLTDAPVVAQPT

SEQ ID NO: 3169496 - protein, 22 aa, Giardia lamblia
RTTGRLALVFELMEMNLYELIK

SEQ ID NO: 3169497 - protein, 21 aa, Giardia lamblia
RTTSRMAMCSHVNNSKLDASR

SEQ ID NO: 3169498 - protein, 19 aa, Giardia lamblia
RTTYSLRVLITLPLVHYIL

SEQ ID NO: 3169499 - protein, 20 aa, Giardia lamblia
RTVACAHISIAGAVRSAFEA

SEQ ID NO: 3169500 - protein, 24 aa, Giardia lamblia
RTVDFLQCRGLLTAGADPEPYVYD

SEQ ID NO: 3169501 - protein, 17 aa, Giardia lamblia
RTVFKGNDLTAAHTAHH

SEQ ID NO: 3169502 - protein, 18 aa, Giardia lamblia
RTVHCPETGLLESIFKRL

SEQ ID NO: 3169503 - protein, 17 aa, Giardia lamblia
RTVTGKTAFDFAEEADN

SEQ ID NO: 3169504 - protein, 20 aa, Giardia lamblia
RTYAFVGFSNIDRSILLSYN

SEQ ID NO: 3169505 - protein, 27 aa, Giardia lamblia
RTYERVLNCKASMLKEALRILQGKVQK

SEQ ID NO: 3169506 - protein, 18 aa, Giardia lamblia
RVAAVWGGIYMLNTPVSE

SEQ ID NO: 3169507 - protein, 19 aa, Giardia lamblia
RVAFLPKCNGLAVSGDEGR

SEQ ID NO: 3169508 - protein, 25 aa, Giardia lamblia
RVALRNAKISLVWRESNDVTEATPL

SEQ ID NO: 3169509 - protein, 18 aa, Giardia lamblia
RVAPHIEYLNFLTRHVPK

SEQ ID NO: 3169510 - protein, 19 aa, Giardia lamblia
RVATIVTHCHESIYDTMSK

SEQ ID NO: 3169511 - protein, 28 aa, Giardia lamblia
RVAVPDKRFEWLCGHFKPKSEVSTFLDI

SEQ ID NO: 3169512 - protein, 24 aa, Giardia lamblia
RVDMLRLLFSAGMNISMQSSQERG

SEQ ID NO: 3169513 - protein, 20 aa, Giardia lamblia
RVDSCLGMLLGKISADCIEL

SEQ ID NO: 3169514 - protein, 21 aa, Giardia lamblia
RVEAAEVYGGFSGQTPSNADS

SEQ ID NO: 3169515 - protein, 22 aa, Giardia lamblia
RVECVKLLVDVEAGLTRTDGKT

SEQ ID NO: 3169516 - protein, 17 aa, Giardia lamblia
RVEKGRMILPAQLPQDY

SEQ ID NO: 3169517 - protein, 22 aa, Giardia lamblia
RVENDLLRHEILLKHSILTLNM

SEQ ID NO: 3169518 - protein, 18 aa, Giardia lamblia
RVFPVTPMGHWHDSLSDL

SEQ ID NO: 3169519 - protein, 19 aa, Giardia lamblia
RVGLKRKQLATLASGIEKP

SEQ ID NO: 3169520 - protein, 21 aa, Giardia lamblia
RVGVCTAPHDIHFSFHLTTTV

SEQ ID NO: 3169521 - protein, 19 aa, Giardia lamblia
RVHNSGGLLTGMSESEAIL

SEQ ID NO: 3169522 - protein, 27 aa, Giardia lamblia
RVHPGEVPSSYILHGLLEFLISNSPVA

SEQ ID NO: 3169523 - protein, 17 aa, Giardia lamblia
RVHRARDRINKKTDDFL

SEQ ID NO: 3169524 - protein, 19 aa, Giardia lamblia
RVIARVRPFLPGEVVPNPA

SEQ ID NO: 3169525 - protein, 22 aa, Giardia lamblia
RVIEASILRNGWNGSGTGVFGD

SEQ ID NO: 3169526 - protein, 17 aa, Giardia lamblia
RVIFEREPDEPLNISKL

SEQ ID NO: 3169527 - protein, 24 aa, Giardia lamblia
RVIGLCGSGSYGKVYRVQHVSTSE

SEQ ID NO: 3169528 - protein, 23 aa, Giardia lamblia
RVIGVELLITVALNYYEATGLKS

SEQ ID NO: 3169529 - protein, 19 aa, Giardia lamblia
RVIISRRGADAFMGVGDST

SEQ ID NO: 3169530 - protein, 28 aa, Giardia lamblia
RVIKYQRVVWREGLLYIFMKRYSQSLDS

SEQ ID NO: 3169531 - protein, 23 aa, Giardia lamblia
RVILCSTGAMITSDIYANIVTAL

SEQ ID NO: 3169532 - protein, 26 aa, Giardia lamblia
RVILRIRPLVRAELMDGGGVSVQARG

SEQ ID NO: 3169533 - protein, 17 aa, Giardia lamblia
RVIPEYTGNYSFTSQMV

SEQ ID NO: 3169534 - protein, 26 aa, Giardia lamblia
RVIQEMWIEKVLVKMAFFGWRDQYII

SEQ ID NO: 3169535 - protein, 21 aa, Giardia lamblia
RVITKATFVGLGFTRKAPKYE

SEQ ID NO: 3169536 - protein, 18 aa, Giardia lamblia
RVITRIPSLTSMSPAELR

SEQ ID NO: 3169537 - protein, 18 aa, Giardia lamblia
RVKDGLINIEGEVHDARQ

SEQ ID NO: 3169538 - protein, 27 aa, Giardia lamblia
RVKESARSLGLVVLRGEEVAFFTQDKD

SEQ ID NO: 3169539 - protein, 21 aa, Giardia lamblia
RVKSPVILYPRIRKVMRYDIA

SEQ ID NO: 3169540 - protein, 25 aa, Giardia lamblia
RVLAHMMAALCYYHTPFKSGASHMG

SEQ ID NO: 3169541 - protein, 19 aa, Giardia lamblia
RVLDHLLLRIMENAPLVEI

SEQ ID NO: 3169542 - protein, 17 aa, Giardia lamblia
RVLDNRAFFIVSVAEPC

SEQ ID NO: 3169543 - protein, 20 aa, Giardia lamblia
RVLIHVCIIIIKNSLYLLNC

SEQ ID NO: 3169544 - protein, 22 aa, Giardia lamblia
RVLNVYIDHVFCQTAIKRDGYL

SEQ ID NO: 3169545 - protein, 23 aa, Giardia lamblia
RVLSEALSMCIAKIKEIEVNMPE

SEQ ID NO: 3169546 - protein, 18 aa, Giardia lamblia
RVLTAGNIDFVFADHRPQ

SEQ ID NO: 3169547 - protein, 19 aa, Giardia lamblia
RVLTIPQLQAGAVTNQQGG

SEQ ID NO: 3169548 - protein, 27 aa, Giardia lamblia
RVMATHRLGLMYSFPTPMAFCPGTNSL

SEQ ID NO: 3169549 - protein, 22 aa, Giardia lamblia
RVNCSPEYFASASIQDKLASVK

SEQ ID NO: 3169550 - protein, 24 aa, Giardia lamblia
RVPELLHLAQIWMRNGRLSRLGSI

SEQ ID NO: 3169551 - protein, 21 aa, Giardia lamblia
RVPSARLRRSSEVFNLHEYDN

SEQ ID NO: 3169552 - protein, 19 aa, Giardia lamblia
RVPSASFWDRVVSRARTKL

SEQ ID NO: 3169553 - protein, 19 aa, Giardia lamblia
RVPSFKLKCLQDMGYSLER

SEQ ID NO: 3169554 - protein, 27 aa, Giardia lamblia
RVPSKIPRRYCHSACGYEGYLAIFGGR

SEQ ID NO: 3169555 - protein, 19 aa, Giardia lamblia
RVQDLFGGSLEFIISNSVI

SEQ ID NO: 3169556 - protein, 20 aa, Giardia lamblia
RVQLPDGECCVCLDKQSTHA

SEQ ID NO: 3169557 - protein, 17 aa, Giardia lamblia
RVQLVVLRRVQNIKDGD

SEQ ID NO: 3169558 - protein, 23 aa, Giardia lamblia
RVQRCTRELLLDVFSGGQTQVGA

SEQ ID NO: 3169559 - protein, 19 aa, Giardia lamblia
RVRCPYIIHYTDVYNEEGS

SEQ ID NO: 3169560 - protein, 31 aa, Giardia lamblia
RVRCRNFPGLVSSCVIDWFSAWNDDALRSVA

SEQ ID NO: 3169561 - protein, 22 aa, Giardia lamblia
RVRDDLGFTGLMYAAWTNDMEM

SEQ ID NO: 3169562 - protein, 19 aa, Giardia lamblia
RVRKACARYKRRAAGIRPM

SEQ ID NO: 3169563 - protein, 18 aa, Giardia lamblia
RVRMKSVAPRAAVSSSSA

SEQ ID NO: 3169564 - protein, 18 aa, Giardia lamblia
RVRPTSRSHPPIPEPPLP

SEQ ID NO: 3169565 - protein, 26 aa, Giardia lamblia
RVRSRGRSLPGLVLSAGFEGAQPPGR

SEQ ID NO: 3169566 - protein, 18 aa, Giardia lamblia
RVRTCYFGHLITKDILGP

SEQ ID NO: 3169567 - protein, 18 aa, Giardia lamblia
RVRVLVLVNHCFGNTGGQ

SEQ ID NO: 3169568 - protein, 22 aa, Giardia lamblia
RVSDMPMHMVAGVLANVEGQVI

SEQ ID NO: 3169569 - protein, 19 aa, Giardia lamblia
RVSDPLAYLHVPLTRDTVC

SEQ ID NO: 3169570 - protein, 26 aa, Giardia lamblia
RVSEKRSASDFALWKAWKETEPEDAK

SEQ ID NO: 3169571 - protein, 19 aa, Giardia lamblia
RVSELAALKRQCAQLEADT

SEQ ID NO: 3169572 - protein, 21 aa, Giardia lamblia
RVSFKIYLPKVELIESHPKKG

SEQ ID NO: 3169573 - protein, 19 aa, Giardia lamblia
RVSFSYPGTMLNALTQTQN

SEQ ID NO: 3169574 - protein, 23 aa, Giardia lamblia
RVSGEYRDSDGLRFVKSSASSAL

SEQ ID NO: 3169575 - protein, 24 aa, Giardia lamblia
RVSLELLFWNGDILKPASLQESKL

SEQ ID NO: 3169576 - protein, 26 aa, Giardia lamblia
RVSLISGQLRWTEAMSSLKNLISGFI

SEQ ID NO: 3169577 - protein, 20 aa, Giardia lamblia
RVSVTEIQRLIMLREKALQH

SEQ ID NO: 3169578 - protein, 24 aa, Giardia lamblia
RVTKPQFGPICRYFESLHKNTQFF

SEQ ID NO: 3169579 - protein, 24 aa, Giardia lamblia
RVTRRYNETLARKNIYKRRFLKIV

SEQ ID NO: 3169580 - protein, 21 aa, Giardia lamblia
RVVAFPSKLTAIASHGTHLVF

SEQ ID NO: 3169581 - protein, 24 aa, Giardia lamblia
RVVAWRLLRIQLFSDRHDKLSLRT

SEQ ID NO: 3169582 - protein, 18 aa, Giardia lamblia
RVVGFLIDYENSYIDSNG

SEQ ID NO: 3169583 - protein, 17 aa, Giardia lamblia
RVVIRKRPINPKELSQN

SEQ ID NO: 3169584 - protein, 22 aa, Giardia lamblia
RVVLTRKAIYFFSQQSPEHNLY

SEQ ID NO: 3169585 - protein, 32 aa, Giardia lamblia
RVVSFRAPKKLDGRLRGFAFVQYATEKEAEVA

SEQ ID NO: 3169586 - protein, 18 aa, Giardia lamblia
RVVVKLYFIKNLGLSEWF

SEQ ID NO: 3169587 - protein, 22 aa, Giardia lamblia
RVWREGKVMLNFVCTTLQRVHV

SEQ ID NO: 3169588 - protein, 19 aa, Giardia lamblia
RVYEFPPLTCSSSDASDHD

SEQ ID NO: 3169589 - protein, 23 aa, Giardia lamblia
RVYENARLLGVIFRMAYMPTTFF

SEQ ID NO: 3169590 - protein, 25 aa, Giardia lamblia
RVYVLKEIRLAGATKKEIESAVSEC

SEQ ID NO: 3169591 - protein, 26 aa, Giardia lamblia
RWANYRSAKELAMRVYAEMKKHQAIV

SEQ ID NO: 3169592 - protein, 24 aa, Giardia lamblia
RWGRPECLQELLGYIDKYTTDNNG

SEQ ID NO: 3169593 - protein, 19 aa, Giardia lamblia
RWIAQLASALWYIHSKGLI

SEQ ID NO: 3169594 - protein, 18 aa, Giardia lamblia
RWKEEHDSASLSLKAKTA

SEQ ID NO: 3169595 - protein, 23 aa, Giardia lamblia
RWLPSTSAFILFKMSDGYITKEQ

SEQ ID NO: 3169596 - protein, 20 aa, Giardia lamblia
RWLPSTSAFVLFQVQEGHIT

SEQ ID NO: 3169597 - protein, 18 aa, Giardia lamblia
RWNEAVDIYARCNAELGF

SEQ ID NO: 3169598 - protein, 28 aa, Giardia lamblia
RWPASKLLTHKWFKTIQKVSARDVLAPI

SEQ ID NO: 3169599 - protein, 19 aa, Giardia lamblia
RWTIQQALGSSWCGDEQTE

SEQ ID NO: 3169600 - protein, 18 aa, Giardia lamblia
RWVDFEERYPKPQVPYSP

SEQ ID NO: 3169601 - protein, 19 aa, Giardia lamblia
RYAELKALAVSLPVDEFAN

SEQ ID NO: 3169602 - protein, 19 aa, Giardia lamblia
RYAGLYFTICCDLNDNELA

SEQ ID NO: 3169603 - protein, 28 aa, Giardia lamblia
RYAVYRLLSKRLLDFEVLDDDGLVPEFT

SEQ ID NO: 3169604 - protein, 18 aa, Giardia lamblia
RYCFCCLSSIKGQPVPCK

SEQ ID NO: 3169605 - protein, 24 aa, Giardia lamblia
RYCHLNRYNLLSGSFYHIGAKSID

SEQ ID NO: 3169606 - protein, 23 aa, Giardia lamblia
RYDCAFSVCVLVVGSTLLSTRDK

SEQ ID NO: 3169607 - protein, 27 aa, Giardia lamblia
RYDFAELPIEIAFKVSWPTNTVALAHD

SEQ ID NO: 3169608 - protein, 17 aa, Giardia lamblia
RYEALAMCGAELQERRK

SEQ ID NO: 3169609 - protein, 23 aa, Giardia lamblia
RYEAVSLLAEYEAGMQDWRGKTA

SEQ ID NO: 3169610 - protein, 19 aa, Giardia lamblia
RYECARLLRSPVVKGYLPI

SEQ ID NO: 3169611 - protein, 18 aa, Giardia lamblia
RYEFGCSDCLPRISDPRA

SEQ ID NO: 3169612 - protein, 31 aa, Giardia lamblia
RYEGEWVKGLMCGQGKLFLVNGAIYSGDFLN

SEQ ID NO: 3169613 - protein, 20 aa, Giardia lamblia
RYEKTEMRGEATPQLSQTEV

SEQ ID NO: 3169614 - protein, 18 aa, Giardia lamblia
RYEQCKRYVESIAPCGDV

SEQ ID NO: 3169615 - protein, 24 aa, Giardia lamblia
RYFCQLLIDREHYFLTSDGKNALI

SEQ ID NO: 3169616 - protein, 29 aa, Giardia lamblia
RYFRTSIGRKDLYLIAAACQTELDLRAQN

SEQ ID NO: 3169617 - protein, 27 aa, Giardia lamblia
RYFVEVWKACGMLGVSKPVVFSTGQKA

SEQ ID NO: 3169618 - protein, 25 aa, Giardia lamblia
RYGCKECYELLITCQAEVKHRNNKK

SEQ ID NO: 3169619 - protein, 17 aa, Giardia lamblia
RYGHLGIAITMVAGDNE

SEQ ID NO: 3169620 - protein, 19 aa, Giardia lamblia
RYGTFQFNLERAIAKVKEN

SEQ ID NO: 3169621 - protein, 22 aa, Giardia lamblia
RYIEVLCLLSVMDFDDCRAAIL

SEQ ID NO: 3169622 - protein, 22 aa, Giardia lamblia
RYIGLRWDADYSITQEDIGDAL

SEQ ID NO: 3169623 - protein, 20 aa, Giardia lamblia
RYIISTCVITLPSPSTEAGA

SEQ ID NO: 3169624 - protein, 25 aa, Giardia lamblia
RYIIYQCVKALKYLHSAEILHRDLK

SEQ ID NO: 3169625 - protein, 18 aa, Giardia lamblia
RYIPQQARMVAKLVRAGM

SEQ ID NO: 3169626 - protein, 19 aa, Giardia lamblia
RYIPSLCYLNEKYRHMIQA

SEQ ID NO: 3169627 - protein, 19 aa, Giardia lamblia
RYKGCGQVVLGCVRTANTS

SEQ ID NO: 3169628 - protein, 22 aa, Giardia lamblia
RYKLTPRGRVVAVRSDRLNEPA

SEQ ID NO: 3169629 - protein, 20 aa, Giardia lamblia
RYLCEFSCKQYVAMFRAGAM

SEQ ID NO: 3169630 - protein, 18 aa, Giardia lamblia
RYLCSLHSGWLAPCKEPP

SEQ ID NO: 3169631 - protein, 18 aa, Giardia lamblia
RYLFSAIMISYDLVCRES

SEQ ID NO: 3169632 - protein, 27 aa, Giardia lamblia
RYLGYPFQEPYIWYVIGQIVNGLAYMH

SEQ ID NO: 3169633 - protein, 19 aa, Giardia lamblia
RYLLRNVYSTGLFQLYELP

SEQ ID NO: 3169634 - protein, 25 aa, Giardia lamblia
RYLMTFNPLIFIPRIPKDGTEQSIL

SEQ ID NO: 3169635 - protein, 18 aa, Giardia lamblia
RYNEKLKEVGELTDAIYR

SEQ ID NO: 3169636 - protein, 18 aa, Giardia lamblia
RYNFFINNCHHFVAAVLK

SEQ ID NO: 3169637 - protein, 35 aa, Giardia lamblia
RYNKFPLQVVKFFAVEILLALGYLHNLGIAYRDLK

SEQ ID NO: 3169638 - protein, 18 aa, Giardia lamblia
RYNKLLALVRVAFQDVGK

SEQ ID NO: 3169639 - protein, 26 aa, Giardia lamblia
RYNSDLKRYLIVELYGRGNLILTDEA

SEQ ID NO: 3169640 - protein, 18 aa, Giardia lamblia
RYPPLYSSTCDSYSPRDS

SEQ ID NO: 3169641 - protein, 19 aa, Giardia lamblia
RYQLKEVVNRGTFRTTYRV

SEQ ID NO: 3169642 - protein, 27 aa, Giardia lamblia
RYREFLESIPSMALKALPIDVLYQCLY

SEQ ID NO: 3169643 - protein, 18 aa, Giardia lamblia
RYRESRIKKDEYFEKPSM

SEQ ID NO: 3169644 - protein, 19 aa, Giardia lamblia
RYRPLYLEISTAYTHKLRQ

SEQ ID NO: 3169645 - protein, 17 aa, Giardia lamblia
RYRQARVYVPGSGISKH

SEQ ID NO: 3169646 - protein, 23 aa, Giardia lamblia
RYSCELDGFIARCLQVDPMYRPS

SEQ ID NO: 3169647 - protein, 26 aa, Giardia lamblia
RYSMTALMWGFKLGFSQVVSHLLDYE

SEQ ID NO: 3169648 - protein, 18 aa, Giardia lamblia
RYSPEHALWLGEPESNDF

SEQ ID NO: 3169649 - protein, 19 aa, Giardia lamblia
RYSSELFMMGLNMSVMAHK

SEQ ID NO: 3169650 - protein, 17 aa, Giardia lamblia
RYSYYGWELGPADVVTL

SEQ ID NO: 3169651 - protein, 18 aa, Giardia lamblia
RYTKGVDMWAIGCILGEM

SEQ ID NO: 3169652 - protein, 17 aa, Giardia lamblia
RYTRLGMVWNVNIPAPH

SEQ ID NO: 3169653 - protein, 20 aa, Giardia lamblia
RYTYRPCVCKRLIYSKLSLS

SEQ ID NO: 3169654 - protein, 24 aa, Giardia lamblia
RYVAYGGAGYGIWMANIPDPTEAP

SEQ ID NO: 3169655 - protein, 19 aa, Giardia lamblia
RYVERTLLSGAVCYCNLQQ

SEQ ID NO: 3169656 - protein, 19 aa, Giardia lamblia
RYVESIAPCGDVNLRLPFV

SEQ ID NO: 3169657 - protein, 17 aa, Giardia lamblia
RYVLLFVNGTLWTPFPG

SEQ ID NO: 3169658 - protein, 18 aa, Giardia lamblia
RYYDCLREDGLSTKVIAY

SEQ ID NO: 3169659 - protein, 22 aa, Giardia lamblia
RYYDFIKGINLHEARKKQLQQE

SEQ ID NO: 3169660 - protein, 20 aa, Giardia lamblia
RYYLSKVQAQICVYSTAREA

SEQ ID NO: 3169661 - protein, 21 aa, Giardia lamblia
RYYPRVVFDDFGFKRHICPKC

SEQ ID NO: 3169662 - protein, 19 aa, Giardia lamblia
RYYYGLAHYHPVRSPKKVF

SEQ ID NO: 3169663 - protein, 19 aa, Giardia lamblia
SAADARTGVQIPVTIPSTI

SEQ ID NO: 3169664 - protein, 17 aa, Giardia lamblia
SAAHVTAIIPYFGYARQ

SEQ ID NO: 3169665 - protein, 18 aa, Giardia lamblia
SAAIAGLKLSCARWDIAD

SEQ ID NO: 3169666 - protein, 17 aa, Giardia lamblia
SAAKFIGSLPQAIHNLM

SEQ ID NO: 3169667 - protein, 33 aa, Giardia lamblia
SAALVKCIWSVHGGEFMVLWGALRANVDLTILA

SEQ ID NO: 3169668 - protein, 24 aa, Giardia lamblia
SAANDELWELLILQNHYHLGVQKA

SEQ ID NO: 3169669 - protein, 17 aa, Giardia lamblia
SAARAALEGGLLPGGGV

SEQ ID NO: 3169670 - protein, 18 aa, Giardia lamblia
SAAVPYKPVDSISKIFGP

SEQ ID NO: 3169671 - protein, 20 aa, Giardia lamblia
SACKAELSLFSKALTQVLDE

SEQ ID NO: 3169672 - protein, 21 aa, Giardia lamblia
SACKKLLLHIATYKASANVEA

SEQ ID NO: 3169673 - protein, 29 aa, Giardia lamblia
SACVNDLWICTGSEWRQIFGHSDTGSSPS

SEQ ID NO: 3169674 - protein, 19 aa, Giardia lamblia
SACVYWPPEDLDLIADPFS

SEQ ID NO: 3169675 - protein, 20 aa, Giardia lamblia
SADAPMFVCGCNLETYDPST

SEQ ID NO: 3169676 - protein, 18 aa, Giardia lamblia
SADDGILSRMSKIELKII

SEQ ID NO: 3169677 - protein, 19 aa, Giardia lamblia
SADDLFGFGPSTLDAQGEP

SEQ ID NO: 3169678 - protein, 24 aa, Giardia lamblia
SADFYKLSDLLAFSYDSISRLRQQ

SEQ ID NO: 3169679 - protein, 20 aa, Giardia lamblia
SADGTLDFWPSVRAGEERWI

SEQ ID NO: 3169680 - protein, 22 aa, Giardia lamblia
SADPDKLLSMISIHPDEIAHIR

SEQ ID NO: 3169681 - protein, 26 aa, Giardia lamblia
SADPRQRGLLLIKFNVQFPSHIPEVN

SEQ ID NO: 3169682 - protein, 18 aa, Giardia lamblia
SADVNVCDWNFFNENLLV

SEQ ID NO: 3169683 - protein, 17 aa, Giardia lamblia
SADVWVELARLFLNPAY

SEQ ID NO: 3169684 - protein, 17 aa, Giardia lamblia
SAEARDAYLSELPSKYK

SEQ ID NO: 3169685 - protein, 21 aa, Giardia lamblia
SAECRAHSAASRLQEVEKEAL

SEQ ID NO: 3169686 - protein, 29 aa, Giardia lamblia
SAEESVMFMWRCIVSLSKTMSKDIVGALK

SEQ ID NO: 3169687 - protein, 18 aa, Giardia lamblia
SAEFKGILQKAAAGAVSQ

SEQ ID NO: 3169688 - protein, 21 aa, Giardia lamblia
SAENHPFFSLENFNKDMAVIV

SEQ ID NO: 3169689 - protein, 25 aa, Giardia lamblia
SAEPGEMLYCFNWDPIFAGTESDPE

SEQ ID NO: 3169690 - protein, 22 aa, Giardia lamblia
SAEVIRAYFRLVIDHLSVEDLD

SEQ ID NO: 3169691 - protein, 28 aa, Giardia lamblia
SAFCPNLRVLKARNCLLTQIDDLSGLSH

SEQ ID NO: 3169692 - protein, 20 aa, Giardia lamblia
SAFESFKLAYSCSVFLEQHI

SEQ ID NO: 3169693 - protein, 19 aa, Giardia lamblia
SAFLAELMCLLKVYTEVDA

SEQ ID NO: 3169694 - protein, 25 aa, Giardia lamblia
SAFLRPRTERELRMVYTSVGSILNA

SEQ ID NO: 3169695 - protein, 23 aa, Giardia lamblia
SAFPEALKGKGYVSVEDLVKNVT

SEQ ID NO: 3169696 - protein, 24 aa, Giardia lamblia
SAFPEILIVKAIRQYFDVSRMRSY

SEQ ID NO: 3169697 - protein, 17 aa, Giardia lamblia
SAFPPNQPVAAALREDG

SEQ ID NO: 3169698 - protein, 18 aa, Giardia lamblia
SAFQEEWTELGRILERDA

SEQ ID NO: 3169699 - protein, 22 aa, Giardia lamblia
SAFRSSGSIFRRVQHFYPLLVY

SEQ ID NO: 3169700 - protein, 20 aa, Giardia lamblia
SAFSTIQAGILWIAVDPGGC

SEQ ID NO: 3169701 - protein, 19 aa, Giardia lamblia
SAFYLNKVDACFTTNIFDS

SEQ ID NO: 3169702 - protein, 20 aa, Giardia lamblia
SAGCLVLAGPVLPNVVKPPV

SEQ ID NO: 3169703 - protein, 19 aa, Giardia lamblia
SAGCVLYTLLVGRLPFDDH

SEQ ID NO: 3169704 - protein, 19 aa, Giardia lamblia
SAGEPCLKLLADDKGILQT

SEQ ID NO: 3169705 - protein, 21 aa, Giardia lamblia
SAGGPRPRPKTPLSDTSGLGG

SEQ ID NO: 3169706 - protein, 26 aa, Giardia lamblia
SAGHLECIKLLLKNEVGMQDNDGETA

SEQ ID NO: 3169707 - protein, 25 aa, Giardia lamblia
SAGLKEILETLLLGAFPKAAYMCCD

SEQ ID NO: 3169708 - protein, 23 aa, Giardia lamblia
SAGLKYAKLRTSSGMTALHMAIY

SEQ ID NO: 3169709 - protein, 18 aa, Giardia lamblia
SAGMEWAQTFLLHTVPLL

SEQ ID NO: 3169710 - protein, 20 aa, Giardia lamblia
SAGQLAECFGLDSRDYIADT

SEQ ID NO: 3169711 - protein, 22 aa, Giardia lamblia
SAHKMHRRCFNDMIMSENITCP

SEQ ID NO: 3169712 - protein, 17 aa, Giardia lamblia
SAHVYLRPPVVDPLALH

SEQ ID NO: 3169713 - protein, 18 aa, Giardia lamblia
SAIANKLLRKIQTRLNEQ

SEQ ID NO: 3169714 - protein, 19 aa, Giardia lamblia
SAIGNLLRFFSTLRANVTK

SEQ ID NO: 3169715 - protein, 19 aa, Giardia lamblia
SAIKQTWSVNKFIQRFTIM

SEQ ID NO: 3169716 - protein, 18 aa, Giardia lamblia
SAILPIRKLYGYSDVLND

SEQ ID NO: 3169717 - protein, 27 aa, Giardia lamblia
SAILYKRVPICINGSLVQSVADLIIPT

SEQ ID NO: 3169718 - protein, 31 aa, Giardia lamblia
SAKDLCSAICGCLWVYKARRLARAATIEKYT

SEQ ID NO: 3169719 - protein, 20 aa, Giardia lamblia
SAKGHLKVVMELRDLEAGGK

SEQ ID NO: 3169720 - protein, 30 aa, Giardia lamblia
SAKICGRLPTKPLKSICASTQQAEEPVNIS

SEQ ID NO: 3169721 - protein, 23 aa, Giardia lamblia
SAKIPSSRFSRVAQEMKEPKAPT

SEQ ID NO: 3169722 - protein, 24 aa, Giardia lamblia
SAKKLLIRACRSVVALSSLFSNHI

SEQ ID NO: 3169723 - protein, 17 aa, Giardia lamblia
SAKPVLAKSGTKASSSK

SEQ ID NO: 3169724 - protein, 18 aa, Giardia lamblia
SAKVVVCTCSTSYDNHLS

SEQ ID NO: 3169725 - protein, 23 aa, Giardia lamblia
SAKYIKELMLISSEAIESVHHLQ

SEQ ID NO: 3169726 - protein, 20 aa, Giardia lamblia
SALDYMPPVMCKYHEAEVTT

SEQ ID NO: 3169727 - protein, 23 aa, Giardia lamblia
SALELPYNMKVEAVLYQEACQES

SEQ ID NO: 3169728 - protein, 18 aa, Giardia lamblia
SALITSVRHDHVYVCRIL

SEQ ID NO: 3169729 - protein, 22 aa, Giardia lamblia
SALKEANWSLTLAQRSVTSGSD

SEQ ID NO: 3169730 - protein, 20 aa, Giardia lamblia
SALLALPFPYHFVDPDRQLE

SEQ ID NO: 3169731 - protein, 26 aa, Giardia lamblia
SALLEARLATYTPLMRAIMKGKASDI

SEQ ID NO: 3169732 - protein, 18 aa, Giardia lamblia
SALLNFKPATALPNHMVQ

SEQ ID NO: 3169733 - protein, 29 aa, Giardia lamblia
SALLPEDCLKEFSKPLTVSRLRESNDLLV

SEQ ID NO: 3169734 - protein, 18 aa, Giardia lamblia
SALMHAVIMDRIEAVKIL

SEQ ID NO: 3169735 - protein, 19 aa, Giardia lamblia
SALMLAAERNFMPGVESLL

SEQ ID NO: 3169736 - protein, 19 aa, Giardia lamblia
SALMYCAQTGLTDIAEALL

SEQ ID NO: 3169737 - protein, 37 aa, Giardia lamblia
SALNAFLFRFLADSPFALVLLRDCHHIPLPKHLLTPI

SEQ ID NO: 3169738 - protein, 24 aa, Giardia lamblia
SALNRMPYKLIVRPTEGMNVGGPS

SEQ ID NO: 3169739 - protein, 17 aa, Giardia lamblia
SALPFSRGRTSATSRSQ

SEQ ID NO: 3169740 - protein, 25 aa, Giardia lamblia
SALQALRLNFEHEIAQLKLELEQVQ

SEQ ID NO: 3169741 - protein, 19 aa, Giardia lamblia
SALQLLVAILVFQKVSFDV

SEQ ID NO: 3169742 - protein, 32 aa, Giardia lamblia
SALRVSKLHYAFPFLHRYIAILYTPSLDLTDS

SEQ ID NO: 3169743 - protein, 28 aa, Giardia lamblia
SALSFLGLYKKKATIVFVGLDNAGKSTL

SEQ ID NO: 3169744 - protein, 25 aa, Giardia lamblia
SALSGEMLCISFAVMMTAQIDYALY

SEQ ID NO: 3169745 - protein, 17 aa, Giardia lamblia
SALVPGYFINIANYFEE

SEQ ID NO: 3169746 - protein, 23 aa, Giardia lamblia
SALYRLPDFIFMHVKPGFISKED

SEQ ID NO: 3169747 - protein, 20 aa, Giardia lamblia
SALYSEEWHGVPMAYVQYGS

SEQ ID NO: 3169748 - protein, 24 aa, Giardia lamblia
SAMKPYIIRTGYAVKCIAVDPMCI

SEQ ID NO: 3169749 - protein, 20 aa, Giardia lamblia
SAMLRYLCELSQDFCSFISR

SEQ ID NO: 3169750 - protein, 26 aa, Giardia lamblia
SAMSRQGLDEAFSWLLSELLIDSGNA

SEQ ID NO: 3169751 - protein, 24 aa, Giardia lamblia
SAMSSCGTAFLPVMSKVDLLGSEL

SEQ ID NO: 3169752 - protein, 29 aa, Giardia lamblia
SANAERFKALVLRYADVDQLGFLKYYTKL

SEQ ID NO: 3169753 - protein, 21 aa, Giardia lamblia
SANELAACLRVKEVSSSHSSP

SEQ ID NO: 3169754 - protein, 24 aa, Giardia lamblia
SANKEMIDLILLKDAVLLKTELHM

SEQ ID NO: 3169755 - protein, 18 aa, Giardia lamblia
SANPRRSYSTDRSMQSAE

SEQ ID NO: 3169756 - protein, 24 aa, Giardia lamblia
SANRRHTWSMTKIDGAWYHTDVIL

SEQ ID NO: 3169757 - protein, 22 aa, Giardia lamblia
SANSYHIWLRIFAESLAQGQGL

SEQ ID NO: 3169758 - protein, 27 aa, Giardia lamblia
SAPAAGAGTCRELAAIMTRTNLNSNEA

SEQ ID NO: 3169759 - protein, 29 aa, Giardia lamblia
SAPARPIGVLFYRYWVDLKSLSFTFQRCD

SEQ ID NO: 3169760 - protein, 18 aa, Giardia lamblia
SAPFLFGDEVERSEISME

SEQ ID NO: 3169761 - protein, 17 aa, Giardia lamblia
SAPLNSLGPSTGPSDNS

SEQ ID NO: 3169762 - protein, 23 aa, Giardia lamblia
SAPLSYDSKKSFFDTLTVQKGTR

SEQ ID NO: 3169763 - protein, 27 aa, Giardia lamblia
SAPNIPTFITVLYLEMLRQFASNLTDG

SEQ ID NO: 3169764 - protein, 23 aa, Giardia lamblia
SAPPEVFNELIFDSEMFDHHLLI

SEQ ID NO: 3169765 - protein, 18 aa, Giardia lamblia
SAPQRGSIIILMATANPD

SEQ ID NO: 3169766 - protein, 21 aa, Giardia lamblia
SAPSVPRTMGYNVPSTLVSTG

SEQ ID NO: 3169767 - protein, 19 aa, Giardia lamblia
SAPVCRRLADVINLTPNNI

SEQ ID NO: 3169768 - protein, 20 aa, Giardia lamblia
SAPYHGFSITEFLKRTKEII

SEQ ID NO: 3169769 - protein, 18 aa, Giardia lamblia
SAQNLRLPQGMYSNDLIG

SEQ ID NO: 3169770 - protein, 22 aa, Giardia lamblia
SAQRLQSPRAFEIVYDQVVGTN

SEQ ID NO: 3169771 - protein, 24 aa, Giardia lamblia
SARAKKAFQASIRRLKAITSTSNG

SEQ ID NO: 3169772 - protein, 24 aa, Giardia lamblia
SARDPRPELGPVVGSGYLGQVRTL

SEQ ID NO: 3169773 - protein, 26 aa, Giardia lamblia
SARISRLEQSAGWVSPSAMQGQGQSH

SEQ ID NO: 3169774 - protein, 26 aa, Giardia lamblia
SARKVDIWCCGLILYELLTAKPAFTV

SEQ ID NO: 3169775 - protein, 24 aa, Giardia lamblia
SARRKRPISLPSIFNESLSKDSFS

SEQ ID NO: 3169776 - protein, 17 aa, Giardia lamblia
SASAIFLPVSEGEDERI

SEQ ID NO: 3169777 - protein, 18 aa, Giardia lamblia
SASALKLGISRITDETVK

SEQ ID NO: 3169778 - protein, 18 aa, Giardia lamblia
SASAPIPYPTNRENPMLA

SEQ ID NO: 3169779 - protein, 22 aa, Giardia lamblia
SASCCYSALIDLMRSANITDVM

SEQ ID NO: 3169780 - protein, 24 aa, Giardia lamblia
SASEPTLTMPFAISTIPLYTMNPA

SEQ ID NO: 3169781 - protein, 20 aa, Giardia lamblia
SASFPPVPLSAALSTTQHNI

SEQ ID NO: 3169782 - protein, 17 aa, Giardia lamblia
SASGLFCNKHVTINLDQ

SEQ ID NO: 3169783 - protein, 25 aa, Giardia lamblia
SASIKFWLCRFCGAYNSKLNLFLPG

SEQ ID NO: 3169784 - protein, 18 aa, Giardia lamblia
SASQGHWATQSSIDKTNL

SEQ ID NO: 3169785 - protein, 23 aa, Giardia lamblia
SASRAGCCDSGIADHLRLSVLPE

SEQ ID NO: 3169786 - protein, 25 aa, Giardia lamblia
SASRFAYVKCMDIDFNWKVLLIETI

SEQ ID NO: 3169787 - protein, 25 aa, Giardia lamblia
SASSLARNGGWGFRVPSAPIVFNIP

SEQ ID NO: 3169788 - protein, 18 aa, Giardia lamblia
SASSLLPPMHFLNACPSS

SEQ ID NO: 3169789 - protein, 28 aa, Giardia lamblia
SASSRALCDLCAWFGRGRLNWESPCKDK

SEQ ID NO: 3169790 - protein, 23 aa, Giardia lamblia
SATDKRLISLFGRAEKSLDGMKV

SEQ ID NO: 3169791 - protein, 24 aa, Giardia lamblia
SATELRVACVEMLECIEGKERLIN

SEQ ID NO: 3169792 - protein, 20 aa, Giardia lamblia
SATLKEKMRALGDLRKQLDT

SEQ ID NO: 3169793 - protein, 25 aa, Giardia lamblia
SATRQPVLLKLRWFQDHLRKDLDRN

SEQ ID NO: 3169794 - protein, 23 aa, Giardia lamblia
SAVADHYKWLVAPNGYKYEFTKV

SEQ ID NO: 3169795 - protein, 23 aa, Giardia lamblia
SAVAVCVSNIFKLDAQKACEAGL

SEQ ID NO: 3169796 - protein, 19 aa, Giardia lamblia
SAVDLRTRFLGPTVSRLEA

SEQ ID NO: 3169797 - protein, 27 aa, Giardia lamblia
SAVGSVHPMLRSSTIIGSRGYVGSAAL

SEQ ID NO: 3169798 - protein, 20 aa, Giardia lamblia
SAVHLRTEMEAQIESTLGLQ

SEQ ID NO: 3169799 - protein, 20 aa, Giardia lamblia
SAVIKQSTVMLANILIQSPI

SEQ ID NO: 3169800 - protein, 25 aa, Giardia lamblia
SAVIRFEAFHVFKVFVANPKKTEPV

SEQ ID NO: 3169801 - protein, 18 aa, Giardia lamblia
SAVKVLAPLEAGMVDPNG

SEQ ID NO: 3169802 - protein, 17 aa, Giardia lamblia
SAVQAFQASNCTFKTKQ

SEQ ID NO: 3169803 - protein, 20 aa, Giardia lamblia
SAVVPPRYKVMVQVFIVPLK

SEQ ID NO: 3169804 - protein, 27 aa, Giardia lamblia
SAVYASCLFYMHYLRGVLKHEREDYTA

SEQ ID NO: 3169805 - protein, 26 aa, Giardia lamblia
SAWLKPAALPRYLQYMPDGWVDVTDT

SEQ ID NO: 3169806 - protein, 23 aa, Giardia lamblia
SAYALFALHAIQFLPTMLSSTGP

SEQ ID NO: 3169807 - protein, 19 aa, Giardia lamblia
SAYEHALAMPFPFISEDRY

SEQ ID NO: 3169808 - protein, 27 aa, Giardia lamblia
SAYIWKPHARPLLSFTGPGRTTGLGMD

SEQ ID NO: 3169809 - protein, 23 aa, Giardia lamblia
SAYKEARQLIALLEKVASINSEF

SEQ ID NO: 3169810 - protein, 18 aa, Giardia lamblia
SAYKELAERLLLHKCSEL

SEQ ID NO: 3169811 - protein, 26 aa, Giardia lamblia
SAYKPEAIPIFKLFLVLTKHPIISPS

SEQ ID NO: 3169812 - protein, 18 aa, Giardia lamblia
SAYPGIQDSLGISIYGAT

SEQ ID NO: 3169813 - protein, 27 aa, Giardia lamblia
SCAACGKAFQIPRTDGVIVVLNEECDN

SEQ ID NO: 3169814 - protein, 20 aa, Giardia lamblia
SCACMPTLEPRHVQCQRSCT

SEQ ID NO: 3169815 - protein, 18 aa, Giardia lamblia
SCAFAVNALAPVFYHGGS

SEQ ID NO: 3169816 - protein, 20 aa, Giardia lamblia
SCAQVSIGWSHRRSPEKLGL

SEQ ID NO: 3169817 - protein, 20 aa, Giardia lamblia
SCASCPSAGSCGATSGYGGF

SEQ ID NO: 3169818 - protein, 18 aa, Giardia lamblia
SCATILEELCMELYGLSG

SEQ ID NO: 3169819 - protein, 20 aa, Giardia lamblia
SCCPAWVNLCEMKYPELLPQ

SEQ ID NO: 3169820 - protein, 26 aa, Giardia lamblia
SCDDILKGLLNVASFVRSPPHMFAGA

SEQ ID NO: 3169821 - protein, 18 aa, Giardia lamblia
SCDISVTICRGILGIETI

SEQ ID NO: 3169822 - protein, 18 aa, Giardia lamblia
SCDLKLLLPSFIVNPTTN

SEQ ID NO: 3169823 - protein, 25 aa, Giardia lamblia
SCERFPIRWFDIVVLLRLGTEELYD

SEQ ID NO: 3169824 - protein, 24 aa, Giardia lamblia
SCETRRVPYCRFLIEEYVSTQAKL

SEQ ID NO: 3169825 - protein, 17 aa, Giardia lamblia
SCEYCGRGFAPDRIDKH

SEQ ID NO: 3169826 - protein, 17 aa, Giardia lamblia
SCFVPELANNVVVQDEI

SEQ ID NO: 3169827 - protein, 18 aa, Giardia lamblia
SCHFKMERLIEMTLEDAG

SEQ ID NO: 3169828 - protein, 21 aa, Giardia lamblia
SCHPRRVTASLSKVFPQAIFP

SEQ ID NO: 3169829 - protein, 24 aa, Giardia lamblia
SCHVSVLVPVRLVHATDFLALSAI

SEQ ID NO: 3169830 - protein, 27 aa, Giardia lamblia
SCIRITEAFAGLVLDIQVEFPDSVVNK

SEQ ID NO: 3169831 - protein, 23 aa, Giardia lamblia
SCITCLKSYLHVAIISYSESFTD

SEQ ID NO: 3169832 - protein, 20 aa, Giardia lamblia
SCIVICRRFSVNTHFEPTNI

SEQ ID NO: 3169833 - protein, 23 aa, Giardia lamblia
SCKEERVILIAALMYYERMLAYK

SEQ ID NO: 3169834 - protein, 26 aa, Giardia lamblia
SCKEIYKFLMLIAHLWWKQRTSEARR

SEQ ID NO: 3169835 - protein, 22 aa, Giardia lamblia
SCKTMPIMWYVARVCCASTNTV

SEQ ID NO: 3169836 - protein, 19 aa, Giardia lamblia
SCLFETHSIPALYIGDQEA

SEQ ID NO: 3169837 - protein, 23 aa, Giardia lamblia
SCLGNSMLYRFDYIPPTTRSIVT

SEQ ID NO: 3169838 - protein, 19 aa, Giardia lamblia
SCLKINLPSKTVCTTINVV

SEQ ID NO: 3169839 - protein, 17 aa, Giardia lamblia
SCLRSGTVTAQLLIILK

SEQ ID NO: 3169840 - protein, 18 aa, Giardia lamblia
SCNYGIFQASFKPLIDAV

SEQ ID NO: 3169841 - protein, 17 aa, Giardia lamblia
SCPHPSNSMDIYSTLWA

SEQ ID NO: 3169842 - protein, 19 aa, Giardia lamblia
SCPLLVPVTLHLRSSLRSC

SEQ ID NO: 3169843 - protein, 19 aa, Giardia lamblia
SCPMVKTVILFDDRYDDRW

SEQ ID NO: 3169844 - protein, 23 aa, Giardia lamblia
SCPNYCYRAGNVAAILEIRETKE

SEQ ID NO: 3169845 - protein, 24 aa, Giardia lamblia
SCRAQVFDGLWVKDAFQKGKISYV

SEQ ID NO: 3169846 - protein, 25 aa, Giardia lamblia
SCSLLIPDMTIGAIASREAQNQKET

SEQ ID NO: 3169847 - protein, 33 aa, Giardia lamblia
SCSPSTNKDQVWRKELLDFGSVLTTGYFQTKFT

SEQ ID NO: 3169848 - protein, 17 aa, Giardia lamblia
SCSPYRVPVARVAAAIA

SEQ ID NO: 3169849 - protein, 29 aa, Giardia lamblia
SCSWKVGACAVFNPQHCKGLLDSVPGPYK

SEQ ID NO: 3169850 - protein, 22 aa, Giardia lamblia
SCVDCGKLAFNLYLGADDMQFS

SEQ ID NO: 3169851 - protein, 23 aa, Giardia lamblia
SCVLFNPFCPGLLASTCIGDRKV

SEQ ID NO: 3169852 - protein, 18 aa, Giardia lamblia
SCVMALVPYEGHIRNKCG

SEQ ID NO: 3169853 - protein, 19 aa, Giardia lamblia
SCYIHRVCQCLLNFQTNCL

SEQ ID NO: 3169854 - protein, 23 aa, Giardia lamblia
SCYLRKLNDYILLEIGLDPGEAM

SEQ ID NO: 3169855 - protein, 18 aa, Giardia lamblia
SDAAVQMIRCRKRAADYP

SEQ ID NO: 3169856 - protein, 20 aa, Giardia lamblia
SDADLAVFHDSFVKCGMKEK

SEQ ID NO: 3169857 - protein, 23 aa, Giardia lamblia
SDADTVAFLARMQRYTDKAKAKQ

SEQ ID NO: 3169858 - protein, 25 aa, Giardia lamblia
SDAEASALPASFVMAQRHVESTPIM

SEQ ID NO: 3169859 - protein, 23 aa, Giardia lamblia
SDAEGVSIFAILSRLLDDPVYGA

SEQ ID NO: 3169860 - protein, 18 aa, Giardia lamblia
SDAEPWILAAHIAEETEG

SEQ ID NO: 3169861 - protein, 18 aa, Giardia lamblia
SDALPHLVGDCIEATDPA

SEQ ID NO: 3169862 - protein, 20 aa, Giardia lamblia
SDAPTYRVVQPYSIDRRCIF

SEQ ID NO: 3169863 - protein, 25 aa, Giardia lamblia
SDASMKAALPALIRPYSDVIVLLME

SEQ ID NO: 3169864 - protein, 19 aa, Giardia lamblia
SDASVFQFLHRLLPDATDH

SEQ ID NO: 3169865 - protein, 38 aa, Giardia lamblia
SDAVLSLPTARWLWKGKRYSSVGGIVWSTEVCNTLQSN

SEQ ID NO: 3169866 - protein, 17 aa, Giardia lamblia
SDCDGDIGECCTQALIR

SEQ ID NO: 3169867 - protein, 22 aa, Giardia lamblia
SDCTRIRNATGWSASTTLRVGM

SEQ ID NO: 3169868 - protein, 23 aa, Giardia lamblia
SDDDFFLRYALGLRGIIQNPIVV

SEQ ID NO: 3169869 - protein, 18 aa, Giardia lamblia
SDDLWAQDSFGWCPLLYA

SEQ ID NO: 3169870 - protein, 25 aa, Giardia lamblia
SDDMLLCGFNNKLLRLYDTRKDKPL

SEQ ID NO: 3169871 - protein, 25 aa, Giardia lamblia
SDDRAQRYYNEWRILTKQTQLQLWT

SEQ ID NO: 3169872 - protein, 26 aa, Giardia lamblia
SDEDHLRFFGSLNFSYLDSYTDQRNS

SEQ ID NO: 3169873 - protein, 28 aa, Giardia lamblia
SDEIAKLLVPLKYDWHAAKQTREDHIRS

SEQ ID NO: 3169874 - protein, 17 aa, Giardia lamblia
SDEKVLITLRVAFFHGM

SEQ ID NO: 3169875 - protein, 19 aa, Giardia lamblia
SDEKVRLLSEIQLLREQLY

SEQ ID NO: 3169876 - protein, 17 aa, Giardia lamblia
SDELKPIYSEVAAMMIK

SEQ ID NO: 3169877 - protein, 19 aa, Giardia lamblia
SDENLKLIMRLLKDDSAVI

SEQ ID NO: 3169878 - protein, 23 aa, Giardia lamblia
SDFASLCAILYIYCIYNAARHAD

SEQ ID NO: 3169879 - protein, 26 aa, Giardia lamblia
SDFDDALCLLFMFSRLSSEHAPQKII

SEQ ID NO: 3169880 - protein, 17 aa, Giardia lamblia
SDFGPRISTKGFLFAFR

SEQ ID NO: 3169881 - protein, 21 aa, Giardia lamblia
SDFILEIPMVVLVVETAQESR

SEQ ID NO: 3169882 - protein, 21 aa, Giardia lamblia
SDFIPWLKARCRSTNVQELTD

SEQ ID NO: 3169883 - protein, 19 aa, Giardia lamblia
SDFLAEGPIRGMTLIGDVC

SEQ ID NO: 3169884 - protein, 21 aa, Giardia lamblia
SDFLSLDAHRKGAIKPLAVDL

SEQ ID NO: 3169885 - protein, 18 aa, Giardia lamblia
SDFTPLMMAIMHKDIDAV

SEQ ID NO: 3169886 - protein, 17 aa, Giardia lamblia
SDGGIATVRIDFLYEDL

SEQ ID NO: 3169887 - protein, 21 aa, Giardia lamblia
SDGHGSLKYASGERYVGNFRD

SEQ ID NO: 3169888 - protein, 21 aa, Giardia lamblia
SDGKRAIDIALQLDHLKVATL

SEQ ID NO: 3169889 - protein, 20 aa, Giardia lamblia
SDGKVDGVVHLYEITCPCMK

SEQ ID NO: 3169890 - protein, 19 aa, Giardia lamblia
SDGLTTLMCAARSGNVDVI

SEQ ID NO: 3169891 - protein, 21 aa, Giardia lamblia
SDGPFRLRLPTEVVQLIVMGQ

SEQ ID NO: 3169892 - protein, 21 aa, Giardia lamblia
SDGPMGLTFVTDGPFSVSPTS

SEQ ID NO: 3169893 - protein, 19 aa, Giardia lamblia
SDGRGIVRVYAYKGSSHFF

SEQ ID NO: 3169894 - protein, 19 aa, Giardia lamblia
SDGRRLWILIDTIVFDVTE

SEQ ID NO: 3169895 - protein, 21 aa, Giardia lamblia
SDGRTALMTAARYGHTDCVRL

SEQ ID NO: 3169896 - protein, 23 aa, Giardia lamblia
SDGTRPKVLLAIDDNSGAKAFKV

SEQ ID NO: 3169897 - protein, 22 aa, Giardia lamblia
SDHRRPSLVCTRQYRPPEAYLG

SEQ ID NO: 3169898 - protein, 17 aa, Giardia lamblia
SDIAIAVNLNFPLELFG

SEQ ID NO: 3169899 - protein, 22 aa, Giardia lamblia
SDIARKLLFRVETCDELKQLLC

SEQ ID NO: 3169900 - protein, 25 aa, Giardia lamblia
SDICIFKWLMEHCYHLYQPSDYPPV

SEQ ID NO: 3169901 - protein, 26 aa, Giardia lamblia
SDIDAWPAVLLWFIKTIIRAPKGSWN

SEQ ID NO: 3169902 - protein, 23 aa, Giardia lamblia
SDIFEPSGYFFPFSNQSNFSRLF

SEQ ID NO: 3169903 - protein, 25 aa, Giardia lamblia
SDIKNALRFAYKNDMMVMSDEVYQT

SEQ ID NO: 3169904 - protein, 21 aa, Giardia lamblia
SDIPLELVKQYFLDHDYGNLT

SEQ ID NO: 3169905 - protein, 21 aa, Giardia lamblia
SDIRLPPCYMRCLKTDPVLSS

SEQ ID NO: 3169906 - protein, 18 aa, Giardia lamblia
SDISCIRITEAFAGLVLD

SEQ ID NO: 3169907 - protein, 19 aa, Giardia lamblia
SDISQAWALIKERTGLTTE

SEQ ID NO: 3169908 - protein, 18 aa, Giardia lamblia
SDITRLQNELRRKDAEMD

SEQ ID NO: 3169909 - protein, 29 aa, Giardia lamblia
SDIVRSTASFGLRSHNYFRAGYVGDAYLS

SEQ ID NO: 3169910 - protein, 19 aa, Giardia lamblia
SDIWMVGCLMYELCTLTPP

SEQ ID NO: 3169911 - protein, 23 aa, Giardia lamblia
SDIWSLGAIIYSVAMLRAPFVAP

SEQ ID NO: 3169912 - protein, 27 aa, Giardia lamblia
SDIYCCADSIQSLPPCVLYTSARVELY

SEQ ID NO: 3169913 - protein, 26 aa, Giardia lamblia
SDIYLIAPCRHLIVTIGSPLVPQRDR

SEQ ID NO: 3169914 - protein, 17 aa, Giardia lamblia
SDKASAHEVFKMDLISL

SEQ ID NO: 3169915 - protein, 25 aa, Giardia lamblia
SDKDISLLMWRRVCADKAYRVDCDC

SEQ ID NO: 3169916 - protein, 25 aa, Giardia lamblia
SDKEAYRYKLLKNIYTIRAVSAMML

SEQ ID NO: 3169917 - protein, 23 aa, Giardia lamblia
SDKKFPASFQPRTTHVAASHSTL

SEQ ID NO: 3169918 - protein, 21 aa, Giardia lamblia
SDKSPIIIFFGVAYKMLITML

SEQ ID NO: 3169919 - protein, 24 aa, Giardia lamblia
SDLADTVLRCHVPFFRQDIIAEAD

SEQ ID NO: 3169920 - protein, 18 aa, Giardia lamblia
SDLCCYFIAVKYGALILE

SEQ ID NO: 3169921 - protein, 24 aa, Giardia lamblia
SDLEDLFMLTPRSYGVLASQQPDF

SEQ ID NO: 3169922 - protein, 24 aa, Giardia lamblia
SDLELYTFYGIFRDIVYGMYLGMD

SEQ ID NO: 3169923 - protein, 18 aa, Giardia lamblia
SDLGYPAHNPFADIKYDL

SEQ ID NO: 3169924 - protein, 18 aa, Giardia lamblia
SDLIEFSIKYFKQLSALR

SEQ ID NO: 3169925 - protein, 17 aa, Giardia lamblia
SDLIPLAAHNDVETRMI

SEQ ID NO: 3169926 - protein, 21 aa, Giardia lamblia
SDLKNRIQRESGFINLNPTTA

SEQ ID NO: 3169927 - protein, 19 aa, Giardia lamblia
SDLLIARKSPLISSSPFWD

SEQ ID NO: 3169928 - protein, 17 aa, Giardia lamblia
SDLPVALQKLREEHARR

SEQ ID NO: 3169929 - protein, 29 aa, Giardia lamblia
SDLQALGCIVYELLTGISLSRDEQLQYYT

SEQ ID NO: 3169930 - protein, 21 aa, Giardia lamblia
SDLQATVGYQEMKAESSVKSR

SEQ ID NO: 3169931 - protein, 32 aa, Giardia lamblia
SDLRKSYLPLRAFKHPWFYISGDRLLLKEDAP

SEQ ID NO: 3169932 - protein, 20 aa, Giardia lamblia
SDLSSVFARHYDAVAIAALC

SEQ ID NO: 3169933 - protein, 18 aa, Giardia lamblia
SDLTWLGVGFGITLDLLN

SEQ ID NO: 3169934 - protein, 20 aa, Giardia lamblia
SDLWSLGAVLYELSTGSKPV

SEQ ID NO: 3169935 - protein, 18 aa, Giardia lamblia
SDLYLRQMCAELVSELVF

SEQ ID NO: 3169936 - protein, 18 aa, Giardia lamblia
SDMVSFLVNHVPVRTDKY

SEQ ID NO: 3169937 - protein, 23 aa, Giardia lamblia
SDNAKFFKGFCESSSSPITLISR

SEQ ID NO: 3169938 - protein, 27 aa, Giardia lamblia
SDNCIYGNCLCKFLEKHGKDNMLSSAN

SEQ ID NO: 3169939 - protein, 21 aa, Giardia lamblia
SDNGKLCRILAEYEADAVLPD

SEQ ID NO: 3169940 - protein, 18 aa, Giardia lamblia
SDNLCQTLNLFLRPPAEV

SEQ ID NO: 3169941 - protein, 24 aa, Giardia lamblia
SDNSPMRLCFRIRNEGGGSLAFLL

SEQ ID NO: 3169942 - protein, 24 aa, Giardia lamblia
SDNWDIVSLMLPYEASVRNAAGDT

SEQ ID NO: 3169943 - protein, 23 aa, Giardia lamblia
SDPAVKLAFKFLRVTDGHGLLPH

SEQ ID NO: 3169944 - protein, 25 aa, Giardia lamblia
SDPDFRKALPPELLDDTLVYLTNQK

SEQ ID NO: 3169945 - protein, 23 aa, Giardia lamblia
SDPEKRKLIFEAYEKDRAMALAA

SEQ ID NO: 3169946 - protein, 24 aa, Giardia lamblia
SDPELLTLYLLTTFVSQYGHNHQL

SEQ ID NO: 3169947 - protein, 26 aa, Giardia lamblia
SDPKIQELYAYFNFQLNSIISHFTIE

SEQ ID NO: 3169948 - protein, 25 aa, Giardia lamblia
SDPLALQYLEFCVSNKIISSDEADR

SEQ ID NO: 3169949 - protein, 17 aa, Giardia lamblia
SDPRSGYIHALIVAPTQ

SEQ ID NO: 3169950 - protein, 21 aa, Giardia lamblia
SDPYKKYGMKHALEDLISQIS

SEQ ID NO: 3169951 - protein, 22 aa, Giardia lamblia
SDRLMRDFSLGVAYALLENPLT

SEQ ID NO: 3169952 - protein, 24 aa, Giardia lamblia
SDRLNEPAPLWVPDGIRTLPLTYE

SEQ ID NO: 3169953 - protein, 18 aa, Giardia lamblia
SDRRHLLGALSDEDISAI

SEQ ID NO: 3169954 - protein, 25 aa, Giardia lamblia
SDRVAYRLVGEVLIKETVKEVKPYL

SEQ ID NO: 3169955 - protein, 27 aa, Giardia lamblia
SDSAGHCFPSHMYIEQINKLIAVIRTL

SEQ ID NO: 3169956 - protein, 24 aa, Giardia lamblia
SDSCSLEIPELGLRLEPGTLGGVY

SEQ ID NO: 3169957 - protein, 28 aa, Giardia lamblia
SDSFERTSCLLFPRVDSMALQEGLSGLH

SEQ ID NO: 3169958 - protein, 18 aa, Giardia lamblia
SDSFLTERLRNLSKLTGY

SEQ ID NO: 3169959 - protein, 24 aa, Giardia lamblia
SDSIPCLMAQLGPVAPLKPESYKD

SEQ ID NO: 3169960 - protein, 26 aa, Giardia lamblia
SDSREMRGAMEMARKIYTSAYSDNKC

SEQ ID NO: 3169961 - protein, 21 aa, Giardia lamblia
SDSRLLFFSKRIVSQALLNLY

SEQ ID NO: 3169962 - protein, 32 aa, Giardia lamblia
SDSRSPALVKKRCLPTYNYVELLKSQRTLEFV

SEQ ID NO: 3169963 - protein, 24 aa, Giardia lamblia
SDSSNSRHPWGLSREEEEETECGA

SEQ ID NO: 3169964 - protein, 24 aa, Giardia lamblia
SDSSRPGPLMTYRTAAPLTSARCI

SEQ ID NO: 3169965 - protein, 25 aa, Giardia lamblia
SDTECAQLLSAVCVPSPQANLLSIS

SEQ ID NO: 3169966 - protein, 21 aa, Giardia lamblia
SDTGLPHILSRSVLCGSDRYP

SEQ ID NO: 3169967 - protein, 17 aa, Giardia lamblia
SDTPSGCLVQFLVDVLH

SEQ ID NO: 3169968 - protein, 19 aa, Giardia lamblia
SDTQLIRLLSEFESRIRSR

SEQ ID NO: 3169969 - protein, 32 aa, Giardia lamblia
SDTTFVRLIPCFRDGVPAGATIYIYALDDNSA

SEQ ID NO: 3169970 - protein, 26 aa, Giardia lamblia
SDVFESCGIIRFLGGAQRLSRSTSND

SEQ ID NO: 3169971 - protein, 20 aa, Giardia lamblia
SDVFNSRAPLSVRMVERELK

SEQ ID NO: 3169972 - protein, 26 aa, Giardia lamblia
SDVGFVIREKCHWMVQCFVEKLVDDD

SEQ ID NO: 3169973 - protein, 18 aa, Giardia lamblia
SDVIPLLLEHEAGMRDAM

SEQ ID NO: 3169974 - protein, 25 aa, Giardia lamblia
SDVLADPWISSVLLQLDLTAISLQV

SEQ ID NO: 3169975 - protein, 25 aa, Giardia lamblia
SDVQACLRCILALLQQNDNKSLLGQ

SEQ ID NO: 3169976 - protein, 17 aa, Giardia lamblia
SDWNIYWAPVAVVQKMF

SEQ ID NO: 3169977 - protein, 24 aa, Giardia lamblia
SDYLINILGVCYPLAASRISGSIY

SEQ ID NO: 3169978 - protein, 20 aa, Giardia lamblia
SDYLKRLRHQLVIPDNTGDY

SEQ ID NO: 3169979 - protein, 23 aa, Giardia lamblia
SDYQRTSPLAGFTSVSGVASTFP

SEQ ID NO: 3169980 - protein, 23 aa, Giardia lamblia
SEAKELRERVSIMSKTLNRGSLS

SEQ ID NO: 3169981 - protein, 24 aa, Giardia lamblia
SEAKFKTFGCGAAIASSSYATSLL

SEQ ID NO: 3169982 - protein, 18 aa, Giardia lamblia
SEAKIWYIFAQLLYALAS

SEQ ID NO: 3169983 - protein, 17 aa, Giardia lamblia
SEAKRLLEEAVVLPMLL

SEQ ID NO: 3169984 - protein, 18 aa, Giardia lamblia
SEAKRLRRIKTLLKNSEQ

SEQ ID NO: 3169985 - protein, 26 aa, Giardia lamblia
SEAKVWKVVDSWFYCRGLAAMQIDSY

SEQ ID NO: 3169986 - protein, 18 aa, Giardia lamblia
SEAPPPWQVAYSDKNESI

SEQ ID NO: 3169987 - protein, 24 aa, Giardia lamblia
SEAQNRLAYYTALVPKPIIPVMNY

SEQ ID NO: 3169988 - protein, 20 aa, Giardia lamblia
SEAQVWFFLEQILAALCYMH

SEQ ID NO: 3169989 - protein, 25 aa, Giardia lamblia
SEASATAASLHWKLEAATKQIAALT

SEQ ID NO: 3169990 - protein, 24 aa, Giardia lamblia
SEATELTTAFTALRRASFGHLERS

SEQ ID NO: 3169991 - protein, 17 aa, Giardia lamblia
SECPVPAPMPTRRSLYG

SEQ ID NO: 3169992 - protein, 17 aa, Giardia lamblia
SECVLNWPTTRLLLCLV

SEQ ID NO: 3169993 - protein, 24 aa, Giardia lamblia
SEDCLLSVPFVVTRSLSLPLFSSA

SEQ ID NO: 3169994 - protein, 17 aa, Giardia lamblia
SEDGVWCVICQASMHEC

SEQ ID NO: 3169995 - protein, 19 aa, Giardia lamblia
SEDKLLLSAYWANNYESTT

SEQ ID NO: 3169996 - protein, 19 aa, Giardia lamblia
SEDLVSFLLPDMVYNPLTN

SEQ ID NO: 3169997 - protein, 26 aa, Giardia lamblia
SEDNGRFALKFACDAIASYLTGRWTA

SEQ ID NO: 3169998 - protein, 24 aa, Giardia lamblia
SEEAEKILGMHGMLDFDLQKVVAE

SEQ ID NO: 3169999 - protein, 19 aa, Giardia lamblia
SEEAELKAAAEAAGNIKLD

SEQ ID NO: 3170000 - protein, 19 aa, Giardia lamblia
SEECVRLLLQDGKEARMQD

SEQ ID NO: 3170001 - protein, 22 aa, Giardia lamblia
SEEFRLKIFTFISKVIEAVLPN

SEQ ID NO: 3170002 - protein, 26 aa, Giardia lamblia
SEEGMKTISGWCAVMSAASNNHRKVV

SEQ ID NO: 3170003 - protein, 20 aa, Giardia lamblia
SEEISLLKGKLVSAQDHIQQ

SEQ ID NO: 3170004 - protein, 20 aa, Giardia lamblia
SEEKCKALGEAVETANASIA

SEQ ID NO: 3170005 - protein, 19 aa, Giardia lamblia
SEELCKRMQQQYTEMRAAM

SEQ ID NO: 3170006 - protein, 17 aa, Giardia lamblia
SEFAIKRAQELMVKPMS

SEQ ID NO: 3170007 - protein, 25 aa, Giardia lamblia
SEFDGAALGEEYAGCTFRITGGNDA

SEQ ID NO: 3170008 - protein, 19 aa, Giardia lamblia
SEFDKGRYSILISTDVAAR

SEQ ID NO: 3170009 - protein, 24 aa, Giardia lamblia
SEFDMWRAAMLELDKQKRLAEIEL

SEQ ID NO: 3170010 - protein, 18 aa, Giardia lamblia
SEFLKEADELIGRNMHPT

SEQ ID NO: 3170011 - protein, 19 aa, Giardia lamblia
SEFSSFYWVLCEASVSTES

SEQ ID NO: 3170012 - protein, 18 aa, Giardia lamblia
SEFYSEFCSESWVMSCAC

SEQ ID NO: 3170013 - protein, 25 aa, Giardia lamblia
SEGACNSVTILLQYYDGMEDRSGRT

SEQ ID NO: 3170014 - protein, 21 aa, Giardia lamblia
SEGARRFRLAVLAQCIASEQS

SEQ ID NO: 3170015 - protein, 22 aa, Giardia lamblia
SEGHTALHLAVRANDLQMVHIL

SEQ ID NO: 3170016 - protein, 21 aa, Giardia lamblia
SEGHTAMMLAAMQDHLPICAY

SEQ ID NO: 3170017 - protein, 20 aa, Giardia lamblia
SEGILPTEGFKTSWGGGTEK

SEQ ID NO: 3170018 - protein, 18 aa, Giardia lamblia
SEGILRKLGVPIALSVSP

SEQ ID NO: 3170019 - protein, 20 aa, Giardia lamblia
SEGKMALMIAKEAGHKIIVN

SEQ ID NO: 3170020 - protein, 22 aa, Giardia lamblia
SEGKRAISPPIVVQRFTYDPFD

SEQ ID NO: 3170021 - protein, 21 aa, Giardia lamblia
SEGKTALMLAIEGRSINRQQH

SEQ ID NO: 3170022 - protein, 18 aa, Giardia lamblia
SEGLNVAAMGKFFIGLVM

SEQ ID NO: 3170023 - protein, 17 aa, Giardia lamblia
SEGQLATIDKDVIKNQC

SEQ ID NO: 3170024 - protein, 21 aa, Giardia lamblia
SEGSHLGLVMVRFEGFAVLVF

SEQ ID NO: 3170025 - protein, 19 aa, Giardia lamblia
SEGYLPIHYACKNGDSNSL

SEQ ID NO: 3170026 - protein, 17 aa, Giardia lamblia
SEHAAMCSPAMSQELIE

SEQ ID NO: 3170027 - protein, 18 aa, Giardia lamblia
SEHASAVAERDRLRRLAE

SEQ ID NO: 3170028 - protein, 20 aa, Giardia lamblia
SEIIGRIRFTSLSPYTAPIP

SEQ ID NO: 3170029 - protein, 20 aa, Giardia lamblia
SEIKDLGFINAHYDANTGHL

SEQ ID NO: 3170030 - protein, 17 aa, Giardia lamblia
SEILEFYTIPSGRCPEP

SEQ ID NO: 3170031 - protein, 20 aa, Giardia lamblia
SEIMGECRKLLQGELTKTQS

SEQ ID NO: 3170032 - protein, 17 aa, Giardia lamblia
SEINLLVALLKVRDTIL

SEQ ID NO: 3170033 - protein, 24 aa, Giardia lamblia
SEIPFIPLCMEIIGNYVFLSGVGG

SEQ ID NO: 3170034 - protein, 23 aa, Giardia lamblia
SEIPRPILVTHPIFPLASTLSGV

SEQ ID NO: 3170035 - protein, 20 aa, Giardia lamblia
SEIPVGQALKVFDPEINAIA

SEQ ID NO: 3170036 - protein, 22 aa, Giardia lamblia
SEIQRFAKIYYWGQQANKQYNG

SEQ ID NO: 3170037 - protein, 17 aa, Giardia lamblia
SEISRVVLHNGLSCVAS

SEQ ID NO: 3170038 - protein, 20 aa, Giardia lamblia
SEIYQRFYTALKTMTGVGNE

SEQ ID NO: 3170039 - protein, 23 aa, Giardia lamblia
SEIYSLEALLYMHLRDIDRAISS

SEQ ID NO: 3170040 - protein, 33 aa, Giardia lamblia
SEKCVLISMDLHFSVPSPLDYRSFFANLPTAGL

SEQ ID NO: 3170041 - protein, 25 aa, Giardia lamblia
SEKDGREYFVYAGLTTRRQADTLSY

SEQ ID NO: 3170042 - protein, 20 aa, Giardia lamblia
SEKIRDLWSSQFFDTSGALY

SEQ ID NO: 3170043 - protein, 21 aa, Giardia lamblia
SEKQIKHILAAALRSSSACYN

SEQ ID NO: 3170044 - protein, 34 aa, Giardia lamblia
SELADPALVYSICYCYADSPASFNEFLHGKDGHN

SEQ ID NO: 3170045 - protein, 24 aa, Giardia lamblia
SELCEVETVLPFYNVVKGIVSEIA

SEQ ID NO: 3170046 - protein, 26 aa, Giardia lamblia
SELDRYDLTLLFSISFHSVPVPHPMT

SEQ ID NO: 3170047 - protein, 19 aa, Giardia lamblia
SELDSEVAIYGAPGMLTTH

SEQ ID NO: 3170048 - protein, 17 aa, Giardia lamblia
SELEAFSLRISPDCLPT

SEQ ID NO: 3170049 - protein, 27 aa, Giardia lamblia
SELEELSLLSGDSFEYLGFYSNDTTSD

SEQ ID NO: 3170050 - protein, 24 aa, Giardia lamblia
SELELKLSSHLGFDVLGYTPITSI

SEQ ID NO: 3170051 - protein, 25 aa, Giardia lamblia
SELELLRKEVDSLKEINKTQASEVD

SEQ ID NO: 3170052 - protein, 26 aa, Giardia lamblia
SELETGLQLWVKKFLTAIGTTDSHVL

SEQ ID NO: 3170053 - protein, 18 aa, Giardia lamblia
SELFAKLTIGDVLRNVDL

SEQ ID NO: 3170054 - protein, 20 aa, Giardia lamblia
SELGSGCRSLVLSRYAKSLT

SEQ ID NO: 3170055 - protein, 34 aa, Giardia lamblia
SELITLPGRPGWHIECSAMAAAVLGKDTGGAFDL

SEQ ID NO: 3170056 - protein, 24 aa, Giardia lamblia
SELKILLEHCKYYDLDHYTGVFTA

SEQ ID NO: 3170057 - protein, 18 aa, Giardia lamblia
SELLTWLANSAGYASISD

SEQ ID NO: 3170058 - protein, 19 aa, Giardia lamblia
SELNIMFNKAMECDAPNTV

SEQ ID NO: 3170059 - protein, 30 aa, Giardia lamblia
SELNLRYSEAFAGAFTRNVGDGKLHYYPEF

SEQ ID NO: 3170060 - protein, 31 aa, Giardia lamblia
SELPDNLKALFRPISMCVPQMQLICEIMILS

SEQ ID NO: 3170061 - protein, 25 aa, Giardia lamblia
SELRAYRSAQKFLTDAGVPSVGRDM

SEQ ID NO: 3170062 - protein, 19 aa, Giardia lamblia
SELRLRRQGLSKELANKKE

SEQ ID NO: 3170063 - protein, 22 aa, Giardia lamblia
SELRTPQGLDILIHGAQRFERQ

SEQ ID NO: 3170064 - protein, 22 aa, Giardia lamblia
SELTSMRAMIVIPRQPPMKLKG

SEQ ID NO: 3170065 - protein, 27 aa, Giardia lamblia
SELVLHPRISAAFKCLQDNNFVVLPGY

SEQ ID NO: 3170066 - protein, 20 aa, Giardia lamblia
SELYSNVVLSGGSSMFAGLP

SEQ ID NO: 3170067 - protein, 19 aa, Giardia lamblia
SEMDLRSAPLNSLGPSTGP

SEQ ID NO: 3170068 - protein, 20 aa, Giardia lamblia
SEMFDHHLLIYQWILLLYYN

SEQ ID NO: 3170069 - protein, 25 aa, Giardia lamblia
SEMIKAATVKACRQCCNNESLGSLK

SEQ ID NO: 3170070 - protein, 19 aa, Giardia lamblia
SEMPLTFPITDDMSQLTGD

SEQ ID NO: 3170071 - protein, 21 aa, Giardia lamblia
SEMQTALMIAAERDHAKIIQI

SEQ ID NO: 3170072 - protein, 24 aa, Giardia lamblia
SENGCLECIDILLCEMTVQTRDGM

SEQ ID NO: 3170073 - protein, 20 aa, Giardia lamblia
SENKLGCTQTLGKTEADTTE

SEQ ID NO: 3170074 - protein, 24 aa, Giardia lamblia
SENKRAWCTKYYLSYKSLEYAKNV

SEQ ID NO: 3170075 - protein, 29 aa, Giardia lamblia
SENRYLRALLCILLGIPPVYDSYGRFCFT

SEQ ID NO: 3170076 - protein, 30 aa, Giardia lamblia
SENYCLIPSEFGWLKQLRYYWHHNDKAKRV

SEQ ID NO: 3170077 - protein, 20 aa, Giardia lamblia
SENYPFCTIDPNHARVAVPD

SEQ ID NO: 3170078 - protein, 21 aa, Giardia lamblia
SEPAIELLEIPSFSGEVPPLI

SEQ ID NO: 3170079 - protein, 20 aa, Giardia lamblia
SEPDAVLLETEWCPDGSLAG

SEQ ID NO: 3170080 - protein, 22 aa, Giardia lamblia
SEPEIPLARGTRWIENNEQFSK

SEQ ID NO: 3170081 - protein, 22 aa, Giardia lamblia
SEPGSFSRAPVRIINVQQEDEE

SEQ ID NO: 3170082 - protein, 32 aa, Giardia lamblia
SEPGSGIVKFRCGRWIWCRPYETTARVLVYSA

SEQ ID NO: 3170083 - protein, 17 aa, Giardia lamblia
SEPLYPKGSVEVWMGNL

SEQ ID NO: 3170084 - protein, 32 aa, Giardia lamblia
SEPNFRLINMPSLRNLRHFIVHKANLYPVEIL

SEQ ID NO: 3170085 - protein, 24 aa, Giardia lamblia
SEPPKPPSVSIFKKLTRPPVTNAP

SEQ ID NO: 3170086 - protein, 20 aa, Giardia lamblia
SEPRSNIAIITHCPAVRLFI

SEQ ID NO: 3170087 - protein, 19 aa, Giardia lamblia
SEPRTSLDTLPIISNLLAT

SEQ ID NO: 3170088 - protein, 18 aa, Giardia lamblia
SEPSSFALKRGYIYVPPQ

SEQ ID NO: 3170089 - protein, 26 aa, Giardia lamblia
SEQARCQLCLELPFNGSFDSAISPAF

SEQ ID NO: 3170090 - protein, 19 aa, Giardia lamblia
SEQEVWELFAQLVSALHYL

SEQ ID NO: 3170091 - protein, 18 aa, Giardia lamblia
SEQLCVRLETNLLIGEDS

SEQ ID NO: 3170092 - protein, 22 aa, Giardia lamblia
SEQLKKDMIMRINDMSYVVHEI

SEQ ID NO: 3170093 - protein, 30 aa, Giardia lamblia
SERIRLQDWCKLLFEVSDLQYASPATVSRC

SEQ ID NO: 3170094 - protein, 23 aa, Giardia lamblia
SERMIKLNRWLAIGTPLEVVSQV

SEQ ID NO: 3170095 - protein, 25 aa, Giardia lamblia
SERMPKDTFAVFCLFAAGSEAEAFK

SEQ ID NO: 3170096 - protein, 25 aa, Giardia lamblia
SERMRGTDGFIVLLPPSLKPQMPYV

SEQ ID NO: 3170097 - protein, 28 aa, Giardia lamblia
SERPERKLRLLIIYAQFLHALCGPRGTI

SEQ ID NO: 3170098 - protein, 21 aa, Giardia lamblia
SERRMEFSMNFMVMSQPPKIL

SEQ ID NO: 3170099 - protein, 23 aa, Giardia lamblia
SERYKLEINRLSLALEERDKPST

SEQ ID NO: 3170100 - protein, 22 aa, Giardia lamblia
SESAKLRLQVAMRPDQTADLSF

SEQ ID NO: 3170101 - protein, 24 aa, Giardia lamblia
SESHLHGLLNLLLCSPISKCQVER

SEQ ID NO: 3170102 - protein, 18 aa, Giardia lamblia
SESIHFYICPKLAEVWAM

SEQ ID NO: 3170103 - protein, 22 aa, Giardia lamblia
SESKAHVSFGDYVGCTMKPRGL

SEQ ID NO: 3170104 - protein, 21 aa, Giardia lamblia
SESKPRYSRFSMLDTLNQTHA

SEQ ID NO: 3170105 - protein, 19 aa, Giardia lamblia
SESLSEMTYIPAPRRTSFY

SEQ ID NO: 3170106 - protein, 18 aa, Giardia lamblia
SESLSLRGAQPCNPPIDN

SEQ ID NO: 3170107 - protein, 20 aa, Giardia lamblia
SESMLWAILVRIVKALRYLH

SEQ ID NO: 3170108 - protein, 21 aa, Giardia lamblia
SESNKSVLLTWCPSNAEITAG

SEQ ID NO: 3170109 - protein, 27 aa, Giardia lamblia
SESNLFYKHYALCFKALTTLADMLMMR

SEQ ID NO: 3170110 - protein, 17 aa, Giardia lamblia
SESPALLQSDLPVENEN

SEQ ID NO: 3170111 - protein, 23 aa, Giardia lamblia
SESRVTELEVLLADYERQEAAYV

SEQ ID NO: 3170112 - protein, 23 aa, Giardia lamblia
SESWTELMIGAAIGDLGLVNQHL

SEQ ID NO: 3170113 - protein, 20 aa, Giardia lamblia
SESYKLLVYHFRPSTAEIQG

SEQ ID NO: 3170114 - protein, 19 aa, Giardia lamblia
SETALCIYTMTSIENFCSS

SEQ ID NO: 3170115 - protein, 27 aa, Giardia lamblia
SETEAFIRLGVCLNRRRNTGIVFYPST

SEQ ID NO: 3170116 - protein, 31 aa, Giardia lamblia
SETHMARELSIRFTMRTAFRAMQKQIDREGQ

SEQ ID NO: 3170117 - protein, 17 aa, Giardia lamblia
SETHQLAMCSVQNKLPP

SEQ ID NO: 3170118 - protein, 22 aa, Giardia lamblia
SETHTASFFGMLSDICLVCTRT

SEQ ID NO: 3170119 - protein, 25 aa, Giardia lamblia
SETLARAEAILSPKRVIPATHGGAH

SEQ ID NO: 3170120 - protein, 26 aa, Giardia lamblia
SETTRFCIICNYPSQIIAPIVSRCAR

SEQ ID NO: 3170121 - protein, 21 aa, Giardia lamblia
SETVREFLPSLSLSTSTNSVT

SEQ ID NO: 3170122 - protein, 17 aa, Giardia lamblia
SETYRRLEHLVRKRPVS

SEQ ID NO: 3170123 - protein, 27 aa, Giardia lamblia
SEVDGYRCEKCGQKTKISMVQNICNTP

SEQ ID NO: 3170124 - protein, 18 aa, Giardia lamblia
SEVIEDFRINFAKNEDLA

SEQ ID NO: 3170125 - protein, 24 aa, Giardia lamblia
SEVIPVILRQAIKNWCSRLDVQGP

SEQ ID NO: 3170126 - protein, 23 aa, Giardia lamblia
SEVKELHAAISAAYPAATLPDIP

SEQ ID NO: 3170127 - protein, 21 aa, Giardia lamblia
SEVKRSAQVVMELNFDDITAQ

SEQ ID NO: 3170128 - protein, 27 aa, Giardia lamblia
SEVLACLKKRWAWVLEAIHRSIKEDAL

SEQ ID NO: 3170129 - protein, 20 aa, Giardia lamblia
SEVPQPFPPPSTSKFSTIYG

SEQ ID NO: 3170130 - protein, 23 aa, Giardia lamblia
SEVVKMLVGKSIDIGKKNKYGYT

SEQ ID NO: 3170131 - protein, 21 aa, Giardia lamblia
SEVVRLLARYELGLKDNEGET

SEQ ID NO: 3170132 - protein, 20 aa, Giardia lamblia
SEVYANCNYLVYLTDIISIE

SEQ ID NO: 3170133 - protein, 21 aa, Giardia lamblia
SEWKIRLETIQGLIREEPSVA

SEQ ID NO: 3170134 - protein, 23 aa, Giardia lamblia
SEWQYSMSQARSLIVEYLRSHSL

SEQ ID NO: 3170135 - protein, 21 aa, Giardia lamblia
SEYKTKLLAANEHNKRISEQY

SEQ ID NO: 3170136 - protein, 29 aa, Giardia lamblia
SEYNRSHIWGAVWLPTARLHRATNKMPPD

SEQ ID NO: 3170137 - protein, 17 aa, Giardia lamblia
SEYPRQHIELHATSPLR

SEQ ID NO: 3170138 - protein, 20 aa, Giardia lamblia
SEYYFYRFIQKQVADGRVNL

SEQ ID NO: 3170139 - protein, 25 aa, Giardia lamblia
SEYYQCFRLLFEANKTAVPTESDFE

SEQ ID NO: 3170140 - protein, 20 aa, Giardia lamblia
SFACSILLAAERDICLNDNS

SEQ ID NO: 3170141 - protein, 19 aa, Giardia lamblia
SFAEEEVWAILAQLVSVLS

SEQ ID NO: 3170142 - protein, 19 aa, Giardia lamblia
SFAESVAKYLPILKKNSEE

SEQ ID NO: 3170143 - protein, 18 aa, Giardia lamblia
SFARGVCLNKTCDSRHIV

SEQ ID NO: 3170144 - protein, 17 aa, Giardia lamblia
SFARKATSLPLLLKAYA

SEQ ID NO: 3170145 - protein, 19 aa, Giardia lamblia
SFAVPEGKPPVVLESPLLV

SEQ ID NO: 3170146 - protein, 18 aa, Giardia lamblia
SFCKQCIPELNTKRECPI

SEQ ID NO: 3170147 - protein, 20 aa, Giardia lamblia
SFCYASCTSQAWAVGGFAEA

SEQ ID NO: 3170148 - protein, 18 aa, Giardia lamblia
SFDAFPVAASSPLDQLSI

SEQ ID NO: 3170149 - protein, 23 aa, Giardia lamblia
SFDAYRKNTIIQLAERDKEIHLL

SEQ ID NO: 3170150 - protein, 27 aa, Giardia lamblia
SFDDVWPLGVAELIAITGISGKYSSIE

SEQ ID NO: 3170151 - protein, 26 aa, Giardia lamblia
SFDEIRLITLALIEICLKIYICTGKR

SEQ ID NO: 3170152 - protein, 22 aa, Giardia lamblia
SFDKRGRTALTIAAENNRIDCV

SEQ ID NO: 3170153 - protein, 24 aa, Giardia lamblia
SFDYATRLLYVFRANFHIVAICGS

SEQ ID NO: 3170154 - protein, 19 aa, Giardia lamblia
SFECLADLSFFPFDSGFDV

SEQ ID NO: 3170155 - protein, 23 aa, Giardia lamblia
SFELRYVTLSSLPALIQQYPSLF

SEQ ID NO: 3170156 - protein, 26 aa, Giardia lamblia
SFERDLLGICLALAPYEHSVLDADGR

SEQ ID NO: 3170157 - protein, 17 aa, Giardia lamblia
SFFPYFIELSEFLRSLV

SEQ ID NO: 3170158 - protein, 27 aa, Giardia lamblia
SFGATSLRFGCFTSLLSKFGEKAENSP

SEQ ID NO: 3170159 - protein, 19 aa, Giardia lamblia
SFGCLVFSMIYGRPPFEAA

SEQ ID NO: 3170160 - protein, 31 aa, Giardia lamblia
SFGKTEFTDACPHGASTRCKTCEILNSDKPK

SEQ ID NO: 3170161 - protein, 18 aa, Giardia lamblia
SFGRIIIYQILNFEPPVP

SEQ ID NO: 3170162 - protein, 26 aa, Giardia lamblia
SFGSILRFVHRINRAIFAVTVGNKTN

SEQ ID NO: 3170163 - protein, 18 aa, Giardia lamblia
SFIHPARIIRIETGHIKL

SEQ ID NO: 3170164 - protein, 18 aa, Giardia lamblia
SFIKHMDLQLAFKAFNCG

SEQ ID NO: 3170165 - protein, 22 aa, Giardia lamblia
SFINCAPLLKSAGVGAFASGEY

SEQ ID NO: 3170166 - protein, 20 aa, Giardia lamblia
SFIRTSLLMLDRAMKDLKSL

SEQ ID NO: 3170167 - protein, 18 aa, Giardia lamblia
SFISQWRLRVQSLATDQR

SEQ ID NO: 3170168 - protein, 17 aa, Giardia lamblia
SFISYTTSLWVLRGKAL

SEQ ID NO: 3170169 - protein, 27 aa, Giardia lamblia
SFKNSQTFCMFSNYVLSRGNASAYGRS

SEQ ID NO: 3170170 - protein, 21 aa, Giardia lamblia
SFLDPVSEFSWMIKKRSETPG

SEQ ID NO: 3170171 - protein, 18 aa, Giardia lamblia
SFLDSCRIPIFGLADGDA

SEQ ID NO: 3170172 - protein, 19 aa, Giardia lamblia
SFLEALKLYDVLYPSKAEI

SEQ ID NO: 3170173 - protein, 24 aa, Giardia lamblia
SFLESRINRICRRLLTSLQPAVGN

SEQ ID NO: 3170174 - protein, 20 aa, Giardia lamblia
SFLFLCNRLGIPCIFVTGRS

SEQ ID NO: 3170175 - protein, 18 aa, Giardia lamblia
SFLKRCIANKVPAFLDAP

SEQ ID NO: 3170176 - protein, 24 aa, Giardia lamblia
SFLLPEIDRRVLISRLKQDQESVG

SEQ ID NO: 3170177 - protein, 22 aa, Giardia lamblia
SFLMKDILDKLVVLSLSNCGLE

SEQ ID NO: 3170178 - protein, 19 aa, Giardia lamblia
SFLRNSRVSLVDMQPTAEV

SEQ ID NO: 3170179 - protein, 18 aa, Giardia lamblia
SFLTAPVGQMFSKTDSLR

SEQ ID NO: 3170180 - protein, 23 aa, Giardia lamblia
SFMADARSALDIAKSTNQDLAAR

SEQ ID NO: 3170181 - protein, 24 aa, Giardia lamblia
SFMSPELPELLALYPEATKQEGWV

SEQ ID NO: 3170182 - protein, 25 aa, Giardia lamblia
SFMSPELPELLALYPEATKQEGWVR

SEQ ID NO: 3170183 - protein, 22 aa, Giardia lamblia
SFMTRQSYSYARLQMSVEDYRC

SEQ ID NO: 3170184 - protein, 21 aa, Giardia lamblia
SFNALSLRNMQAFSLPISSQS

SEQ ID NO: 3170185 - protein, 26 aa, Giardia lamblia
SFNTYRFAEKALKERAGLIMTSSSFW

SEQ ID NO: 3170186 - protein, 23 aa, Giardia lamblia
SFPIPKISGNIMTKARKVCLLRS

SEQ ID NO: 3170187 - protein, 21 aa, Giardia lamblia
SFPPEHLKGLVGVQDEVSTPD

SEQ ID NO: 3170188 - protein, 18 aa, Giardia lamblia
SFQFPRATVTTNFPSNIP

SEQ ID NO: 3170189 - protein, 19 aa, Giardia lamblia
SFRAYLRYLQYVRRPEYSC

SEQ ID NO: 3170190 - protein, 23 aa, Giardia lamblia
SFRFCKCDPLPSFVIFTDTDKDT

SEQ ID NO: 3170191 - protein, 22 aa, Giardia lamblia
SFRKAMKSNFIKAVDSMETGYA

SEQ ID NO: 3170192 - protein, 31 aa, Giardia lamblia
SFRLLGKAYTYLCHYGEALAAYQKAQSLDYS

SEQ ID NO: 3170193 - protein, 17 aa, Giardia lamblia
SFRTCLQEVMGEDRNYY

SEQ ID NO: 3170194 - protein, 18 aa, Giardia lamblia
SFSASPKVGRSFSTEVPR

SEQ ID NO: 3170195 - protein, 23 aa, Giardia lamblia
SFSEQLIACSIIQKDLLRIINTL

SEQ ID NO: 3170196 - protein, 26 aa, Giardia lamblia
SFSIIRCLLDSGVAPSSIFLLIPLDP

SEQ ID NO: 3170197 - protein, 24 aa, Giardia lamblia
SFSKTAVQFTDSWYILHSENVLYR

SEQ ID NO: 3170198 - protein, 18 aa, Giardia lamblia
SFSRIRGPFLAGILDGSS

SEQ ID NO: 3170199 - protein, 20 aa, Giardia lamblia
SFSSYMPSICEGYLCAVKTN

SEQ ID NO: 3170200 - protein, 19 aa, Giardia lamblia
SFTCRVCGCSHADLVSVLH

SEQ ID NO: 3170201 - protein, 19 aa, Giardia lamblia
SFTDAVTLVTAWKRSSHPD

SEQ ID NO: 3170202 - protein, 25 aa, Giardia lamblia
SFTDKGLMPRVFNYLFDQLSAESQQ

SEQ ID NO: 3170203 - protein, 24 aa, Giardia lamblia
SFTDPRLSTPVSSFNSELGAISVR

SEQ ID NO: 3170204 - protein, 25 aa, Giardia lamblia
SFTPMKPFACDVNMIISIRNSGRYK

SEQ ID NO: 3170205 - protein, 20 aa, Giardia lamblia
SFVALHVAILIVQRYGASTP

SEQ ID NO: 3170206 - protein, 18 aa, Giardia lamblia
SFVNRLLTEATKRREFAE

SEQ ID NO: 3170207 - protein, 27 aa, Giardia lamblia
SFYENNVMLLRCLRLLQTAINTLGAGT

SEQ ID NO: 3170208 - protein, 24 aa, Giardia lamblia
SFYGSSFPQVFLSRYPKLESKLIA

SEQ ID NO: 3170209 - protein, 24 aa, Giardia lamblia
SFYNVCYCRAPIVLDASVFAAFLP

SEQ ID NO: 3170210 - protein, 25 aa, Giardia lamblia
SFYVKVLSHRTVIISGSRPFISYYI

SEQ ID NO: 3170211 - protein, 20 aa, Giardia lamblia
SGADVPRPLSTISSSILSTL

SEQ ID NO: 3170212 - protein, 34 aa, Giardia lamblia
SGAFPAIPYYYLKLLVRRLLRAIHHCHQSGVAHL

SEQ ID NO: 3170213 - protein, 20 aa, Giardia lamblia
SGAFPPLPSAMRLSTTATVQ

SEQ ID NO: 3170214 - protein, 24 aa, Giardia lamblia
SGAIKLADFGFCRVLSSTTDMTAT

SEQ ID NO: 3170215 - protein, 23 aa, Giardia lamblia
SGALDRILVYRGLHIKQSAITSP

SEQ ID NO: 3170216 - protein, 21 aa, Giardia lamblia
SGALLLRLATDSFVFSVPFLA

SEQ ID NO: 3170217 - protein, 19 aa, Giardia lamblia
SGALPSFCTAAYFEPSYSM

SEQ ID NO: 3170218 - protein, 19 aa, Giardia lamblia
SGALTGREWAIFKNVEINE

SEQ ID NO: 3170219 - protein, 25 aa, Giardia lamblia
SGAMLKAVCMEAGLVCLRRHGEAVV

SEQ ID NO: 3170220 - protein, 26 aa, Giardia lamblia
SGAMMRLASLCLEQAIILTSDTDIFD

SEQ ID NO: 3170221 - protein, 25 aa, Giardia lamblia
SGAPEATSAWAWHLIEKRDILRDTR

SEQ ID NO: 3170222 - protein, 26 aa, Giardia lamblia
SGASARLSLFDAWLANSLPPIREILT

SEQ ID NO: 3170223 - protein, 24 aa, Giardia lamblia
SGAVFRFELERAMLQGDLAREKYD

SEQ ID NO: 3170224 - protein, 23 aa, Giardia lamblia
SGAYKELFGRLSASASGEIPCYT

SEQ ID NO: 3170225 - protein, 18 aa, Giardia lamblia
SGAYLARNIAMSLCSPMN

SEQ ID NO: 3170226 - protein, 17 aa, Giardia lamblia
SGAYRAVSMLYIQEARY

SEQ ID NO: 3170227 - protein, 27 aa, Giardia lamblia
SGCLPRPVRLTLEMLVRCIPQQCAVTQ

SEQ ID NO: 3170228 - protein, 19 aa, Giardia lamblia
SGDGLPHKYAYAVPVLDSL

SEQ ID NO: 3170229 - protein, 20 aa, Giardia lamblia
SGDKSLSVWSGKRSSYLEQE

SEQ ID NO: 3170230 - protein, 17 aa, Giardia lamblia
SGDLVIRQTNSFFTCGY

SEQ ID NO: 3170231 - protein, 22 aa, Giardia lamblia
SGDSAHCPCCIQYVEQISTMQT

SEQ ID NO: 3170232 - protein, 19 aa, Giardia lamblia
SGDTFSLGYGYMVFLNGTI

SEQ ID NO: 3170233 - protein, 25 aa, Giardia lamblia
SGEDARSGLLRGIKTIADVVATTLG

SEQ ID NO: 3170234 - protein, 21 aa, Giardia lamblia
SGEGKFALLYALEKRHFGIAE

SEQ ID NO: 3170235 - protein, 19 aa, Giardia lamblia
SGEHSFTIAVTRDAGGARL

SEQ ID NO: 3170236 - protein, 23 aa, Giardia lamblia
SGEKCPLDGMIVGERDSYYCITA

SEQ ID NO: 3170237 - protein, 23 aa, Giardia lamblia
SGEKPYIVSVKVAFIPNKPPRPK

SEQ ID NO: 3170238 - protein, 22 aa, Giardia lamblia
SGEKRPPHKLTYDANNPIHHDF

SEQ ID NO: 3170239 - protein, 24 aa, Giardia lamblia
SGELRQEIYPCDQRRWQVYARLAT

SEQ ID NO: 3170240 - protein, 26 aa, Giardia lamblia
SGEMFREGSVWRKCVTQVTAKNSTLH

SEQ ID NO: 3170241 - protein, 22 aa, Giardia lamblia
SGEPQCKLAVFIDALLSRSVAP

SEQ ID NO: 3170242 - protein, 19 aa, Giardia lamblia
SGERVLLSDHLTVFQFPAH

SEQ ID NO: 3170243 - protein, 22 aa, Giardia lamblia
SGESLYLLDICIDNNSVCCFEH

SEQ ID NO: 3170244 - protein, 17 aa, Giardia lamblia
SGETIRLADPVDVTKEV

SEQ ID NO: 3170245 - protein, 34 aa, Giardia lamblia
SGEVFRRRLRMFPSLVGSCTLDLFGDWPTSALEE

SEQ ID NO: 3170246 - protein, 21 aa, Giardia lamblia
SGFAGAPGYRAPEAYYSVAGV

SEQ ID NO: 3170247 - protein, 18 aa, Giardia lamblia
SGFGAPRAVAVQLNIDYK

SEQ ID NO: 3170248 - protein, 27 aa, Giardia lamblia
SGFGRIGRFALRYALTCPNVEIAAINN

SEQ ID NO: 3170249 - protein, 22 aa, Giardia lamblia
SGFLDVLYRHATLLEHTLELHK

SEQ ID NO: 3170250 - protein, 18 aa, Giardia lamblia
SGFLSTLKEYAKVSPHDV

SEQ ID NO: 3170251 - protein, 18 aa, Giardia lamblia
SGFSAMMLGCVYNQSEAV

SEQ ID NO: 3170252 - protein, 26 aa, Giardia lamblia
SGFYKDRDICLSKLTDRLGIEHAQLR

SEQ ID NO: 3170253 - protein, 25 aa, Giardia lamblia
SGGACCFCEGGGPGSGSLEFATDWK

SEQ ID NO: 3170254 - protein, 20 aa, Giardia lamblia
SGGEFDRMLNLSVSLITGSN

SEQ ID NO: 3170255 - protein, 19 aa, Giardia lamblia
SGGELQRFALAYVAMQNTA

SEQ ID NO: 3170256 - protein, 24 aa, Giardia lamblia
SGGKASACTIVLRGASKSTLLEIE

SEQ ID NO: 3170257 - protein, 17 aa, Giardia lamblia
SGGLLKSYQLESLQWLV

SEQ ID NO: 3170258 - protein, 19 aa, Giardia lamblia
SGGNAASLLDTFPTTIPIS

SEQ ID NO: 3170259 - protein, 24 aa, Giardia lamblia
SGGQRSLLALSLIFSLLLYKPCPL

SEQ ID NO: 3170260 - protein, 26 aa, Giardia lamblia
SGHDPRYAEFLLYFSTDEAIEAYYSS

SEQ ID NO: 3170261 - protein, 19 aa, Giardia lamblia
SGHFADFGNSLLFTTGETI

SEQ ID NO: 3170262 - protein, 23 aa, Giardia lamblia
SGHFSVTCSIMFSRVIDRWEGNP

SEQ ID NO: 3170263 - protein, 25 aa, Giardia lamblia
SGHGTIAFSCLQSSVAADRGSASRI

SEQ ID NO: 3170264 - protein, 20 aa, Giardia lamblia
SGHKCTALMLAILNNHLHVC

SEQ ID NO: 3170265 - protein, 23 aa, Giardia lamblia
SGHLSCVKALVQYIDKFKNSSDT

SEQ ID NO: 3170266 - protein, 28 aa, Giardia lamblia
SGHRNCVFTMQVVRRFNTGIIQGYCDIE

SEQ ID NO: 3170267 - protein, 17 aa, Giardia lamblia
SGITEDGAMQKRCAELE

SEQ ID NO: 3170268 - protein, 27 aa, Giardia lamblia
SGIWAFDFPSPLLIATCTQREDICRIL

SEQ ID NO: 3170269 - protein, 27 aa, Giardia lamblia
SGKAYVRGGCDNTFLWTPLKRQTPNSD

SEQ ID NO: 3170270 - protein, 18 aa, Giardia lamblia
SGKEGNYYMRVSTGKGAQ

SEQ ID NO: 3170271 - protein, 20 aa, Giardia lamblia
SGKFDDGWMLIDNQLNEGYN

SEQ ID NO: 3170272 - protein, 23 aa, Giardia lamblia
SGKLCRRFNKHGGAVKCFASLRL

SEQ ID NO: 3170273 - protein, 31 aa, Giardia lamblia
SGKRSMGCTFYRPDMDHVFELPQVDNGQLFR

SEQ ID NO: 3170274 - protein, 22 aa, Giardia lamblia
SGKRVSPGLLHYISKLVNQLEK

SEQ ID NO: 3170275 - protein, 18 aa, Giardia lamblia
SGKSSFVRNLFMMNPFHF

SEQ ID NO: 3170276 - protein, 21 aa, Giardia lamblia
SGKTALMYAAELGYADAIPLL

SEQ ID NO: 3170277 - protein, 22 aa, Giardia lamblia
SGKTCLAKALATESRSVFFCVS

SEQ ID NO: 3170278 - protein, 23 aa, Giardia lamblia
SGKTLAFLVPLIIHMQRVRLMWP

SEQ ID NO: 3170279 - protein, 18 aa, Giardia lamblia
SGKTVRVTPMLSSGNSLL

SEQ ID NO: 3170280 - protein, 24 aa, Giardia lamblia
SGLDENYGAIVLWIPENPFYPNRI

SEQ ID NO: 3170281 - protein, 21 aa, Giardia lamblia
SGLELVSRLSLKTASDTSEAR

SEQ ID NO: 3170282 - protein, 26 aa, Giardia lamblia
SGLFRPEVLLPLGLPEDVQVLAWGLS

SEQ ID NO: 3170283 - protein, 17 aa, Giardia lamblia
SGLGHKVAVKTRLDISD

SEQ ID NO: 3170284 - protein, 17 aa, Giardia lamblia
SGLKNDLYAKAREAELS

SEQ ID NO: 3170285 - protein, 25 aa, Giardia lamblia
SGLKSKEGWTALLYAIDKKNTDAVQ

SEQ ID NO: 3170286 - protein, 20 aa, Giardia lamblia
SGLLGPRISKPSSVISSIDH

SEQ ID NO: 3170287 - protein, 24 aa, Giardia lamblia
SGLLKGDGFTPLMISAALDGKASI

SEQ ID NO: 3170288 - protein, 24 aa, Giardia lamblia
SGLLYWVPGCDTIISLIKEFRQLK

SEQ ID NO: 3170289 - protein, 21 aa, Giardia lamblia
SGLNERLLLNFGMGRDKPTRQ

SEQ ID NO: 3170290 - protein, 21 aa, Giardia lamblia
SGLPLAALREAAIKLFPSLKN

SEQ ID NO: 3170291 - protein, 32 aa, Giardia lamblia
SGLPLLEAPLEFPSDLLAIVFNKYKHTIESMP

SEQ ID NO: 3170292 - protein, 17 aa, Giardia lamblia
SGLPLNCDEPAPTAEHS

SEQ ID NO: 3170293 - protein, 23 aa, Giardia lamblia
SGLQRPEFFSMSSAFSNPYAASE

SEQ ID NO: 3170294 - protein, 18 aa, Giardia lamblia
SGLRCRLLVHFPLFVEYS

SEQ ID NO: 3170295 - protein, 21 aa, Giardia lamblia
SGLSIRVSLRPVNLSTVVVGQ

SEQ ID NO: 3170296 - protein, 19 aa, Giardia lamblia
SGLSMLAISERAWRAMETR

SEQ ID NO: 3170297 - protein, 17 aa, Giardia lamblia
SGLTDCSLDHIFYESSL

SEQ ID NO: 3170298 - protein, 25 aa, Giardia lamblia
SGLTRRYLSEIVMKSLDVKLGGQYV

SEQ ID NO: 3170299 - protein, 20 aa, Giardia lamblia
SGLVRVCSFESNSIVSLVAV

SEQ ID NO: 3170300 - protein, 19 aa, Giardia lamblia
SGMEKLQLLLCFDSHKAVL

SEQ ID NO: 3170301 - protein, 17 aa, Giardia lamblia
SGMYHGYSLMIPVRNTF

SEQ ID NO: 3170302 - protein, 24 aa, Giardia lamblia
SGNGASALEDWKLIYCEKQKLSQY

SEQ ID NO: 3170303 - protein, 19 aa, Giardia lamblia
SGNIRALWREAKRDYHQLR

SEQ ID NO: 3170304 - protein, 25 aa, Giardia lamblia
SGNLDCVKLLASIESGHLSPEGYSA

SEQ ID NO: 3170305 - protein, 18 aa, Giardia lamblia
SGNNSADHNLIWFNDKPV

SEQ ID NO: 3170306 - protein, 20 aa, Giardia lamblia
SGNQFLPRTGQGASMALRAH

SEQ ID NO: 3170307 - protein, 19 aa, Giardia lamblia
SGNRPVVRQSLQAQQREHP

SEQ ID NO: 3170308 - protein, 20 aa, Giardia lamblia
SGNSLLCKVTVCTSGVEDKD

SEQ ID NO: 3170309 - protein, 18 aa, Giardia lamblia
SGNTYTHIGDVFCDLCLT

SEQ ID NO: 3170310 - protein, 35 aa, Giardia lamblia
SGNYRLFILGGRGREGIAAEFWCLNLSKAGLGRED

SEQ ID NO: 3170311 - protein, 19 aa, Giardia lamblia
SGPAETLLMYAWTDAQEVR

SEQ ID NO: 3170312 - protein, 25 aa, Giardia lamblia
SGPLKEHMLRNIAFRILQGLYHIHT

SEQ ID NO: 3170313 - protein, 19 aa, Giardia lamblia
SGPLYWALHTAHYRNIGMN

SEQ ID NO: 3170314 - protein, 29 aa, Giardia lamblia
SGPYGLEAWLRPLLSQPIETFVIPMNLNN

SEQ ID NO: 3170315 - protein, 18 aa, Giardia lamblia
SGQKRLTPLDVRKNEERI

SEQ ID NO: 3170316 - protein, 22 aa, Giardia lamblia
SGQYSDALWMIVKSSIECKLKS

SEQ ID NO: 3170317 - protein, 24 aa, Giardia lamblia
SGRACAQCDPVSFSAVHNLNRNIL

SEQ ID NO: 3170318 - protein, 18 aa, Giardia lamblia
SGRCTLKGVTALMIAAER

SEQ ID NO: 3170319 - protein, 23 aa, Giardia lamblia
SGRFGRKGVAINFVTDKDKQSMQ

SEQ ID NO: 3170320 - protein, 25 aa, Giardia lamblia
SGRGPRLLIRLLKDKLTGEIRDELG

SEQ ID NO: 3170321 - protein, 22 aa, Giardia lamblia
SGRGTTPIFAKWISEILRQTDL

SEQ ID NO: 3170322 - protein, 24 aa, Giardia lamblia
SGRTGDLPAMCVMDNLNTYSIAQT

SEQ ID NO: 3170323 - protein, 23 aa, Giardia lamblia
SGSENLISLSLLSLFSSDGEIFC

SEQ ID NO: 3170324 - protein, 23 aa, Giardia lamblia
SGSFLYKLFDLCHSETRTICAIY

SEQ ID NO: 3170325 - protein, 19 aa, Giardia lamblia
SGSFQILSIIYSYALEHSL

SEQ ID NO: 3170326 - protein, 18 aa, Giardia lamblia
SGSIIDCLNTLSLSIIQL

SEQ ID NO: 3170327 - protein, 23 aa, Giardia lamblia
SGSKRLSGTLAQRHAEGYEQACY

SEQ ID NO: 3170328 - protein, 17 aa, Giardia lamblia
SGSNLAMSRSGEKKYLY

SEQ ID NO: 3170329 - protein, 21 aa, Giardia lamblia
SGSPGNLYAFYELCPSLASND

SEQ ID NO: 3170330 - protein, 23 aa, Giardia lamblia
SGSPRPASEKTPLSRNDGSLRQV

SEQ ID NO: 3170331 - protein, 24 aa, Giardia lamblia
SGSSIRLPLKYQWLNREVPTEITG

SEQ ID NO: 3170332 - protein, 23 aa, Giardia lamblia
SGSSRAQTRFSVNVDIDGADNFY

SEQ ID NO: 3170333 - protein, 20 aa, Giardia lamblia
SGSTLIGIMAYVAPEVLLHN

SEQ ID NO: 3170334 - protein, 20 aa, Giardia lamblia
SGSTLIGIMAYVAPEVLLRN

SEQ ID NO: 3170335 - protein, 23 aa, Giardia lamblia
SGSTRLQLHAAKDLPANAELTLH

SEQ ID NO: 3170336 - protein, 17 aa, Giardia lamblia
SGSVYIWDVCRPDDPFA

SEQ ID NO: 3170337 - protein, 23 aa, Giardia lamblia
SGTEPKVKCYVECVGDTFKQAAE

SEQ ID NO: 3170338 - protein, 23 aa, Giardia lamblia
SGTGSIRAAIEFNAKQDDSSVAA

SEQ ID NO: 3170339 - protein, 20 aa, Giardia lamblia
SGTLPECLVSLIDTCLLAIQ

SEQ ID NO: 3170340 - protein, 17 aa, Giardia lamblia
SGTRLDGTASRKGGGRP

SEQ ID NO: 3170341 - protein, 23 aa, Giardia lamblia
SGTRSSLFLSESAFELLVQKVVR

SEQ ID NO: 3170342 - protein, 24 aa, Giardia lamblia
SGVADGFMKSVLERIFVLEPKERL

SEQ ID NO: 3170343 - protein, 26 aa, Giardia lamblia
SGVDLEAFLALPTVELVACADTRGYV

SEQ ID NO: 3170344 - protein, 18 aa, Giardia lamblia
SGVKLSILRMAEVQQLPS

SEQ ID NO: 3170345 - protein, 18 aa, Giardia lamblia
SGVNIILSKPIDSMMPAT

SEQ ID NO: 3170346 - protein, 23 aa, Giardia lamblia
SGVSLPFIVGHGVENDLRALGLI

SEQ ID NO: 3170347 - protein, 24 aa, Giardia lamblia
SGVSYSYKSSVRFSAILVTPKGHV

SEQ ID NO: 3170348 - protein, 20 aa, Giardia lamblia
SGVVVDAYIPRKCSATNRLI

SEQ ID NO: 3170349 - protein, 18 aa, Giardia lamblia
SGVYCDRNKIVIANASGV

SEQ ID NO: 3170350 - protein, 20 aa, Giardia lamblia
SGVYTEWKALAIGNQCVTII

SEQ ID NO: 3170351 - protein, 17 aa, Giardia lamblia
SGWYMRKGTALMMAAAH

SEQ ID NO: 3170352 - protein, 21 aa, Giardia lamblia
SGYILTRRICSPLISVRDIRL

SEQ ID NO: 3170353 - protein, 19 aa, Giardia lamblia
SGYVLRLYILSTVESTLLA

SEQ ID NO: 3170354 - protein, 31 aa, Giardia lamblia
SHAFRELDPGYPMALFQPHFVQPLERDLIAS

SEQ ID NO: 3170355 - protein, 18 aa, Giardia lamblia
SHAIARLTIESVDTALLD

SEQ ID NO: 3170356 - protein, 18 aa, Giardia lamblia
SHAILIGAQCLKAPEEAK

SEQ ID NO: 3170357 - protein, 19 aa, Giardia lamblia
SHAILQLRIEQKSMDTQQE

SEQ ID NO: 3170358 - protein, 25 aa, Giardia lamblia
SHANYCIHISFLLQRKYHLPPDHLW

SEQ ID NO: 3170359 - protein, 18 aa, Giardia lamblia
SHARHCAIDAAMRQKIAY

SEQ ID NO: 3170360 - protein, 25 aa, Giardia lamblia
SHASARIFLGIGLMNMRQIDVAQQL

SEQ ID NO: 3170361 - protein, 17 aa, Giardia lamblia
SHCTPCGSIRNSPHGGS

SEQ ID NO: 3170362 - protein, 21 aa, Giardia lamblia
SHCYCSDACFERIIKRSSKEG

SEQ ID NO: 3170363 - protein, 17 aa, Giardia lamblia
SHDASFLAVTTRFPGAV

SEQ ID NO: 3170364 - protein, 17 aa, Giardia lamblia
SHEFLARELRPPKRYND

SEQ ID NO: 3170365 - protein, 29 aa, Giardia lamblia
SHELKLISMAGETYFRVYLDPSNMLNVHF

SEQ ID NO: 3170366 - protein, 19 aa, Giardia lamblia
SHELPRYGIPVGLTNYAAA

SEQ ID NO: 3170367 - protein, 29 aa, Giardia lamblia
SHEMNSWRGLSCCKPSGAMYVFPRIHAPP

SEQ ID NO: 3170368 - protein, 20 aa, Giardia lamblia
SHESYPLYLQMQALERENSG

SEQ ID NO: 3170369 - protein, 19 aa, Giardia lamblia
SHEVVAWIRRILEVEKTGH

SEQ ID NO: 3170370 - protein, 33 aa, Giardia lamblia
SHFIPRGISAPALDLERRWTFRPLVKLGDLLSV

SEQ ID NO: 3170371 - protein, 26 aa, Giardia lamblia
SHFTPEDWQSCIFVVGHYPEVIDMII

SEQ ID NO: 3170372 - protein, 20 aa, Giardia lamblia
SHGARICLLIIIKDTGRFLV

SEQ ID NO: 3170373 - protein, 19 aa, Giardia lamblia
SHGAYKFKSESDIRLAIDR

SEQ ID NO: 3170374 - protein, 20 aa, Giardia lamblia
SHGELRVAPFSLYASASQDK

SEQ ID NO: 3170375 - protein, 24 aa, Giardia lamblia
SHGFIKCLSILLPHEKGMQRTDGY

SEQ ID NO: 3170376 - protein, 17 aa, Giardia lamblia
SHGLVAYAPPLVKETRQ

SEQ ID NO: 3170377 - protein, 27 aa, Giardia lamblia
SHGPNWKELRLLHAHLSFNNYFKSELD

SEQ ID NO: 3170378 - protein, 17 aa, Giardia lamblia
SHIKSDALFFLESQEIA

SEQ ID NO: 3170379 - protein, 20 aa, Giardia lamblia
SHIREFKRINGLTSSDGPAQ

SEQ ID NO: 3170380 - protein, 17 aa, Giardia lamblia
SHKRIAFVQSIYTIGPI

SEQ ID NO: 3170381 - protein, 24 aa, Giardia lamblia
SHLAWFKHYSPVIVALLSPALKRR

SEQ ID NO: 3170382 - protein, 17 aa, Giardia lamblia
SHLEALNPMSPRGKANG

SEQ ID NO: 3170383 - protein, 26 aa, Giardia lamblia
SHLEYQFLLHYERLIIYDEGSTLFAI

SEQ ID NO: 3170384 - protein, 19 aa, Giardia lamblia
SHLGLKFMSEIELMIMDLT

SEQ ID NO: 3170385 - protein, 23 aa, Giardia lamblia
SHLKDLHIRKIWGVGDASAQLLS

SEQ ID NO: 3170386 - protein, 19 aa, Giardia lamblia
SHLLFASWGDGHRQREHSV

SEQ ID NO: 3170387 - protein, 19 aa, Giardia lamblia
SHLLNACIKLFKAGKTGAS

SEQ ID NO: 3170388 - protein, 19 aa, Giardia lamblia
SHLLQLLALTTMEAPIDMT

SEQ ID NO: 3170389 - protein, 22 aa, Giardia lamblia
SHLNAFITKLLNACLTDLNSVQ

SEQ ID NO: 3170390 - protein, 20 aa, Giardia lamblia
SHLNISCIAPVHVEQQEQTD

SEQ ID NO: 3170391 - protein, 29 aa, Giardia lamblia
SHLSTRLLPHIGVTPEFHLDKAFFIGYMT

SEQ ID NO: 3170392 - protein, 21 aa, Giardia lamblia
SHLVRISNYILSFSTDSLEET

SEQ ID NO: 3170393 - protein, 17 aa, Giardia lamblia
SHMKRLPNDITNKSAAA

SEQ ID NO: 3170394 - protein, 17 aa, Giardia lamblia
SHMKVFFAASELISTIC

SEQ ID NO: 3170395 - protein, 20 aa, Giardia lamblia
SHNFLGGLYNLYADLYNGVP

SEQ ID NO: 3170396 - protein, 22 aa, Giardia lamblia
SHNRIVRLACTIPTSIRSLDLS

SEQ ID NO: 3170397 - protein, 19 aa, Giardia lamblia
SHPALQPSPRVDLQTQPLR

SEQ ID NO: 3170398 - protein, 24 aa, Giardia lamblia
SHPAPTVRPSVCKDAEVITYTRQA

SEQ ID NO: 3170399 - protein, 24 aa, Giardia lamblia
SHPEGPDFTALMLAVKSGNIEAAE

SEQ ID NO: 3170400 - protein, 17 aa, Giardia lamblia
SHPEYCDDLFLDFIETI

SEQ ID NO: 3170401 - protein, 23 aa, Giardia lamblia
SHPHVLEYFWALQANDFVYLSMW

SEQ ID NO: 3170402 - protein, 19 aa, Giardia lamblia
SHPNILSCKSIFFHGARLC

SEQ ID NO: 3170403 - protein, 21 aa, Giardia lamblia
SHPRTCKFLAHMSHEECTTVS

SEQ ID NO: 3170404 - protein, 19 aa, Giardia lamblia
SHPYKPCIATSVIYPDYSF

SEQ ID NO: 3170405 - protein, 24 aa, Giardia lamblia
SHQCLRGRTVSKLYSLRKLSTVLS

SEQ ID NO: 3170406 - protein, 19 aa, Giardia lamblia
SHQRFSGSMQQTLLLNPVR

SEQ ID NO: 3170407 - protein, 23 aa, Giardia lamblia
SHRDCIQILYKQECNLHAADGSS

SEQ ID NO: 3170408 - protein, 17 aa, Giardia lamblia
SHRLTLREKHHRLKKAK

SEQ ID NO: 3170409 - protein, 22 aa, Giardia lamblia
SHSIEIIALLCYLKLSYPSKIT

SEQ ID NO: 3170410 - protein, 26 aa, Giardia lamblia
SHSNLAHLFFDMEPPLTSTEVTPLMI

SEQ ID NO: 3170411 - protein, 22 aa, Giardia lamblia
SHSSPYIGRYVSLLSEPNLSHR

SEQ ID NO: 3170412 - protein, 25 aa, Giardia lamblia
SHSVTFSAFELFDDVIIDHFAPEDD

SEQ ID NO: 3170413 - protein, 24 aa, Giardia lamblia
SHTFTNCFQGVGIRYLSYQFDEDG

SEQ ID NO: 3170414 - protein, 17 aa, Giardia lamblia
SHTWDYLYGLTRTIVLR

SEQ ID NO: 3170415 - protein, 19 aa, Giardia lamblia
SHVCIRCAILQVPFEEITE

SEQ ID NO: 3170416 - protein, 25 aa, Giardia lamblia
SHVRAHVIEYILLLFISACLHSEGY

SEQ ID NO: 3170417 - protein, 18 aa, Giardia lamblia
SHVSRLQQRIAHNDSFDR

SEQ ID NO: 3170418 - protein, 19 aa, Giardia lamblia
SHWNGERWVHVHIYTNGRE

SEQ ID NO: 3170419 - protein, 24 aa, Giardia lamblia
SIAANVTRFLGLDVNNLDNVEIEY

SEQ ID NO: 3170420 - protein, 19 aa, Giardia lamblia
SIACKSVAFTPQLHVDLSL

SEQ ID NO: 3170421 - protein, 19 aa, Giardia lamblia
SIAELRAVPEAVPSMVASV

SEQ ID NO: 3170422 - protein, 24 aa, Giardia lamblia
SIAEYFCYDIRFAAQARTSISPTS

SEQ ID NO: 3170423 - protein, 18 aa, Giardia lamblia
SIAIRLAAPTAARSKESE

SEQ ID NO: 3170424 - protein, 23 aa, Giardia lamblia
SIAKKLICRELHSSLTGTEEKIL

SEQ ID NO: 3170425 - protein, 25 aa, Giardia lamblia
SIAPECGVADLSICQDLPSMTRITM

SEQ ID NO: 3170426 - protein, 29 aa, Giardia lamblia
SIAQYYHRQELLSLLGAGSLQLTNTEENI

SEQ ID NO: 3170427 - protein, 24 aa, Giardia lamblia
SICCTCKYKDPPGFIDEGEYIEYE

SEQ ID NO: 3170428 - protein, 30 aa, Giardia lamblia
SICDAAGVKVDSIWFTLFANYLEGKNVKEL

SEQ ID NO: 3170429 - protein, 24 aa, Giardia lamblia
SICDEFRVPCLYTHSRMSPEERSR

SEQ ID NO: 3170430 - protein, 17 aa, Giardia lamblia
SICSLLIEQEGMYSDNE

SEQ ID NO: 3170431 - protein, 27 aa, Giardia lamblia
SICSSDFCCLCGILGHNKNTCTTSSMS

SEQ ID NO: 3170432 - protein, 18 aa, Giardia lamblia
SICYLPVRAENQSVHRQN

SEQ ID NO: 3170433 - protein, 27 aa, Giardia lamblia
SIDASNCLRLLFLLYKFSKHKLEKPDA

SEQ ID NO: 3170434 - protein, 25 aa, Giardia lamblia
SIDDILTCLIDPAFNAELLSYLEKS

SEQ ID NO: 3170435 - protein, 20 aa, Giardia lamblia
SIDGKILRLDKLRVENDLLR

SEQ ID NO: 3170436 - protein, 20 aa, Giardia lamblia
SIDLIPKFILSSGDLFYMLR

SEQ ID NO: 3170437 - protein, 24 aa, Giardia lamblia
SIDLREWRRPPLAMNFDIPMYTAS

SEQ ID NO: 3170438 - protein, 26 aa, Giardia lamblia
SIDRDWKEFYNYQGASNFAKKPDFPV

SEQ ID NO: 3170439 - protein, 37 aa, Giardia lamblia
SIDRRCIFFSLALGQLLLKCEVRLAPRRLTTPLDLET

SEQ ID NO: 3170440 - protein, 25 aa, Giardia lamblia
SIDVGRTILDFALRSSFSEVYSVAQ

SEQ ID NO: 3170441 - protein, 24 aa, Giardia lamblia
SIECYLRANLLAAMSNEQQRRLFL

SEQ ID NO: 3170442 - protein, 26 aa, Giardia lamblia
SIEERLRKLLFDRKVDLSHMTYRSGG

SEQ ID NO: 3170443 - protein, 20 aa, Giardia lamblia
SIELEDWALDWAFPSDEEIV

SEQ ID NO: 3170444 - protein, 30 aa, Giardia lamblia
SIELPLRNPDIFKRVGIKPPKSILLYGAPG

SEQ ID NO: 3170445 - protein, 24 aa, Giardia lamblia
SIFRRVQHFYPLLVYALQQEVADP

SEQ ID NO: 3170446 - protein, 26 aa, Giardia lamblia
SIFSLKRMVGTFMAPVVMRHQDKEFS

SEQ ID NO: 3170447 - protein, 18 aa, Giardia lamblia
SIFSYSAPEEVIYSKHSP

SEQ ID NO: 3170448 - protein, 20 aa, Giardia lamblia
SIFVALKLLNYGIPIHRISR

SEQ ID NO: 3170449 - protein, 27 aa, Giardia lamblia
SIGCVLCELYTGLPIFPGDDERDQLGK

SEQ ID NO: 3170450 - protein, 23 aa, Giardia lamblia
SIGGKAMQLILCLDNDREGENIC

SEQ ID NO: 3170451 - protein, 23 aa, Giardia lamblia
SIGHCPEGYSLSELEKLLQQITF

SEQ ID NO: 3170452 - protein, 20 aa, Giardia lamblia
SIGLCNSSTSSLRDDSVKSI

SEQ ID NO: 3170453 - protein, 18 aa, Giardia lamblia
SIGLRLAPKYTEPSAFGL

SEQ ID NO: 3170454 - protein, 20 aa, Giardia lamblia
SIGPARLLVETTMQQKDSEA

SEQ ID NO: 3170455 - protein, 18 aa, Giardia lamblia
SIGVCCLHVTEGSAMLHL

SEQ ID NO: 3170456 - protein, 18 aa, Giardia lamblia
SIGYCIVLAQIGCFVPCE

SEQ ID NO: 3170457 - protein, 20 aa, Giardia lamblia
SIHLYSRLYGGLRDISGQTG

SEQ ID NO: 3170458 - protein, 17 aa, Giardia lamblia
SIHRPDSLGGHRYTGHL

SEQ ID NO: 3170459 - protein, 17 aa, Giardia lamblia
SIHSDICIFKWLMEHCY

SEQ ID NO: 3170460 - protein, 18 aa, Giardia lamblia
SIHVWATPLMNLRSGVTT

SEQ ID NO: 3170461 - protein, 18 aa, Giardia lamblia
SIIFKGIQAPVLLPQGPP

SEQ ID NO: 3170462 - protein, 26 aa, Giardia lamblia
SIILEQRIIFAIAWGLAGSIVAEHKI

SEQ ID NO: 3170463 - protein, 19 aa, Giardia lamblia
SIIPRCALQGAPIDAFVAG

SEQ ID NO: 3170464 - protein, 17 aa, Giardia lamblia
SIIQLLRRFPKIIQPAA

SEQ ID NO: 3170465 - protein, 22 aa, Giardia lamblia
SIIRHGKANWTWDWKADEVEDD

SEQ ID NO: 3170466 - protein, 26 aa, Giardia lamblia
SIIYELRTLLLPNLYTEDWTLGLSKF

SEQ ID NO: 3170467 - protein, 23 aa, Giardia lamblia
SIKEKRVACRELVDVMQRASNIL

SEQ ID NO: 3170468 - protein, 18 aa, Giardia lamblia
SIKFNHRVVDTWDEYTRL

SEQ ID NO: 3170469 - protein, 34 aa, Giardia lamblia
SIKLTRLVQSLGDFTRPIIKISYIAHHIAVLSMD

SEQ ID NO: 3170470 - protein, 19 aa, Giardia lamblia
SIKRRLRHTKNESSLENLL

SEQ ID NO: 3170471 - protein, 18 aa, Giardia lamblia
SILACQRVGVLPQELNFC

SEQ ID NO: 3170472 - protein, 32 aa, Giardia lamblia
SILALCGPCPFFETVLKFYVCYMDEHSGDKGQ

SEQ ID NO: 3170473 - protein, 22 aa, Giardia lamblia
SILEGRASHRASLGSSKLHHCA

SEQ ID NO: 3170474 - protein, 17 aa, Giardia lamblia
SILEMGLPLSECTGPAS

SEQ ID NO: 3170475 - protein, 28 aa, Giardia lamblia
SILERCVKEKRPLLIIASDVTGDALSTL

SEQ ID NO: 3170476 - protein, 24 aa, Giardia lamblia
SILLPCNFNAVLSVDICPKTRRVL

SEQ ID NO: 3170477 - protein, 26 aa, Giardia lamblia
SILNKLSYWLLFAFFVLNERLTASSR

SEQ ID NO: 3170478 - protein, 20 aa, Giardia lamblia
SILNRLQQRLVILRSAEKFY

SEQ ID NO: 3170479 - protein, 20 aa, Giardia lamblia
SILPDGRTPLMLAAERGNLH

SEQ ID NO: 3170480 - protein, 20 aa, Giardia lamblia
SILQKRISQFEVERRGYFSV

SEQ ID NO: 3170481 - protein, 23 aa, Giardia lamblia
SILRGGFSLAEYLVRHISIGEKF

SEQ ID NO: 3170482 - protein, 18 aa, Giardia lamblia
SILRHGRQSCAFRTEDRV

SEQ ID NO: 3170483 - protein, 18 aa, Giardia lamblia
SILRKDTQSILNISTLHR

SEQ ID NO: 3170484 - protein, 19 aa, Giardia lamblia
SILRNCLTVSPDDRISSAR

SEQ ID NO: 3170485 - protein, 23 aa, Giardia lamblia
SILRVVRSPFIIRQYGTYQDDKN

SEQ ID NO: 3170486 - protein, 20 aa, Giardia lamblia
SILSYEWKPSITIKEILLGL

SEQ ID NO: 3170487 - protein, 29 aa, Giardia lamblia
SILTSAGFVPLSMDAVRIYQGDKVTEITK

SEQ ID NO: 3170488 - protein, 43 aa, Giardia lamblia
SILTTKLRVHFGVRGCSTVFPLVFVCKCDFPHIIEQLNVIFTA

SEQ ID NO: 3170489 - protein, 19 aa, Giardia lamblia
SIMILCCHIMDAIDVTKMT

SEQ ID NO: 3170490 - protein, 19 aa, Giardia lamblia
SIMSRMNTDPCPREITKKE

SEQ ID NO: 3170491 - protein, 19 aa, Giardia lamblia
SINEKFLLISMMQQKRKPI

SEQ ID NO: 3170492 - protein, 22 aa, Giardia lamblia
SINPKKSVSVLAEANHEYNGMD

SEQ ID NO: 3170493 - protein, 24 aa, Giardia lamblia
SINQFRMDRILSRQLGAAQQKQAH

SEQ ID NO: 3170494 - protein, 24 aa, Giardia lamblia
SINRVSIVKAFAYFVREVRVLSLI

SEQ ID NO: 3170495 - protein, 24 aa, Giardia lamblia
SINTALPFPRLQLLDLSENKIYQI

SEQ ID NO: 3170496 - protein, 19 aa, Giardia lamblia
SINVFKSFSGLSFEHFHGL

SEQ ID NO: 3170497 - protein, 30 aa, Giardia lamblia
SIPDDLRKTAWRFMLALPNDVDYYDSLVTR

SEQ ID NO: 3170498 - protein, 23 aa, Giardia lamblia
SIPDDVRCIFVAGPSSSSKTTFS

SEQ ID NO: 3170499 - protein, 25 aa, Giardia lamblia
SIPDNFEIIFLFSVEALRYKNRGPL

SEQ ID NO: 3170500 - protein, 23 aa, Giardia lamblia
SIPEKIPRFHILLTTPQMAVKHE

SEQ ID NO: 3170501 - protein, 24 aa, Giardia lamblia
SIPELAERFEVFISCFEVSNAYTE

SEQ ID NO: 3170502 - protein, 25 aa, Giardia lamblia
SIPETRGVAALALLRYLPTLQGVHF

SEQ ID NO: 3170503 - protein, 26 aa, Giardia lamblia
SIPSASPISHAWGHRVVLNQVTANSN

SEQ ID NO: 3170504 - protein, 23 aa, Giardia lamblia
SIPYHRPLCCCTVRVLLVALLAD

SEQ ID NO: 3170505 - protein, 23 aa, Giardia lamblia
SIQARIKPALSRGLLHNLSLSTS

SEQ ID NO: 3170506 - protein, 22 aa, Giardia lamblia
SIQECLNAAVLVGDKSLFHSTL

SEQ ID NO: 3170507 - protein, 18 aa, Giardia lamblia
SIQSIALSLTLAECQILR

SEQ ID NO: 3170508 - protein, 24 aa, Giardia lamblia
SIQSVWKVRVSFLEVYNETLRDLL

SEQ ID NO: 3170509 - protein, 28 aa, Giardia lamblia
SIRARKPECTKLLLAEANMRSGAGESVL

SEQ ID NO: 3170510 - protein, 26 aa, Giardia lamblia
SIRDPRGRTALMLAVEHGNRDAVEFL

SEQ ID NO: 3170511 - protein, 29 aa, Giardia lamblia
SIREIRIRPGSAIPFVIKYKFPDERASDG

SEQ ID NO: 3170512 - protein, 25 aa, Giardia lamblia
SIRSREILKRYLPMIYEANNGEPSS

SEQ ID NO: 3170513 - protein, 26 aa, Giardia lamblia
SISDCKRVLSSAGCSSRSCGKPFPHE

SEQ ID NO: 3170514 - protein, 25 aa, Giardia lamblia
SISFNPKYDWLYAISTDSGIVRLCS

SEQ ID NO: 3170515 - protein, 18 aa, Giardia lamblia
SISKRLADIIKEISNIDM

SEQ ID NO: 3170516 - protein, 21 aa, Giardia lamblia
SISNMGMCFQGQMHHVPSFLN

SEQ ID NO: 3170517 - protein, 18 aa, Giardia lamblia
SISPGYCSIKEDFKFCGS

SEQ ID NO: 3170518 - protein, 19 aa, Giardia lamblia
SISQCRLVIRLLCLTMGTQ

SEQ ID NO: 3170519 - protein, 17 aa, Giardia lamblia
SISQFPAIPSGPVAIQT

SEQ ID NO: 3170520 - protein, 28 aa, Giardia lamblia
SISRACVPLHKLSCEYLVGEETPDLVDM

SEQ ID NO: 3170521 - protein, 17 aa, Giardia lamblia
SISSHKADADWDINQFR

SEQ ID NO: 3170522 - protein, 24 aa, Giardia lamblia
SISTRADYMISYTAPEVFTSNIYN

SEQ ID NO: 3170523 - protein, 18 aa, Giardia lamblia
SITDSFVVRGFVIPTLPR

SEQ ID NO: 3170524 - protein, 17 aa, Giardia lamblia
SITLKWLPLAMGICYRM

SEQ ID NO: 3170525 - protein, 31 aa, Giardia lamblia
SITNRYRIGVALKDTIPLVAYSTRMQMQETY

SEQ ID NO: 3170526 - protein, 19 aa, Giardia lamblia
SITQFALDLEAFFRPEEER

SEQ ID NO: 3170527 - protein, 17 aa, Giardia lamblia
SIVAIVLVLSWLAKMRK

SEQ ID NO: 3170528 - protein, 18 aa, Giardia lamblia
SIVDCVRASVDNPEERAS

SEQ ID NO: 3170529 - protein, 17 aa, Giardia lamblia
SIVKTIFNRCIGNIELN

SEQ ID NO: 3170530 - protein, 17 aa, Giardia lamblia
SIVLPPMSIVALPVVHS

SEQ ID NO: 3170531 - protein, 25 aa, Giardia lamblia
SIVRYEVRIPYQFNPAVTKTLSLAI

SEQ ID NO: 3170532 - protein, 21 aa, Giardia lamblia
SIYNCASVILTLSRNSIRFPS

SEQ ID NO: 3170533 - protein, 19 aa, Giardia lamblia
SIYVPRDEFEAILVAPRGE

SEQ ID NO: 3170534 - protein, 17 aa, Giardia lamblia
SKAARALSVRGNIVPQI

SEQ ID NO: 3170535 - protein, 26 aa, Giardia lamblia
SKAAVSRFCCLVDFPWSNGHDVFREL

SEQ ID NO: 3170536 - protein, 21 aa, Giardia lamblia
SKACFEVICIDASECQCGLDI

SEQ ID NO: 3170537 - protein, 18 aa, Giardia lamblia
SKAGRTAVDIAREMEYAS

SEQ ID NO: 3170538 - protein, 20 aa, Giardia lamblia
SKAILMPGAVTPISQQLNAD

SEQ ID NO: 3170539 - protein, 25 aa, Giardia lamblia
SKAKFSSCCRFLAYVGVEYPTTLIV

SEQ ID NO: 3170540 - protein, 20 aa, Giardia lamblia
SKAKGGISLSALEAHNAAIA

SEQ ID NO: 3170541 - protein, 19 aa, Giardia lamblia
SKAKKARPTDDMTVDLTGK

SEQ ID NO: 3170542 - protein, 19 aa, Giardia lamblia
SKAPLPVIIPKFRSKNKAS

SEQ ID NO: 3170543 - protein, 19 aa, Giardia lamblia
SKAPRLVSYTVDRNKYINS

SEQ ID NO: 3170544 - protein, 32 aa, Giardia lamblia
SKAREASMFRARWKADEGIDRIHWSRTKHQKR

SEQ ID NO: 3170545 - protein, 18 aa, Giardia lamblia
SKASCELLQDGKNLLGYN

SEQ ID NO: 3170546 - protein, 29 aa, Giardia lamblia
SKAVEYYARCIYLSARILFAVDMGYCGPI

SEQ ID NO: 3170547 - protein, 22 aa, Giardia lamblia
SKCSLHGQLLAVKRIKMDSSSK

SEQ ID NO: 3170548 - protein, 19 aa, Giardia lamblia
SKDDICIEFSFCGNYILYY

SEQ ID NO: 3170549 - protein, 20 aa, Giardia lamblia
SKDKCIEFLAGRLVVGEQMD

SEQ ID NO: 3170550 - protein, 19 aa, Giardia lamblia
SKDKISWGIPVPGDSDHVM

SEQ ID NO: 3170551 - protein, 24 aa, Giardia lamblia
SKDMAGTIKFNFKSRSFDTFVSVF

SEQ ID NO: 3170552 - protein, 23 aa, Giardia lamblia
SKDPELVRSLLLQYASALETRDN

SEQ ID NO: 3170553 - protein, 18 aa, Giardia lamblia
SKDPHFAKLMNRKYIECN

SEQ ID NO: 3170554 - protein, 19 aa, Giardia lamblia
SKDSFPYELLKTNQRSKSG

SEQ ID NO: 3170555 - protein, 25 aa, Giardia lamblia
SKDTLGPPGGRKMILFTDELSMPVV

SEQ ID NO: 3170556 - protein, 32 aa, Giardia lamblia
SKEEYCLSCAAICTSLRSGAFLYSGKEYSSFI

SEQ ID NO: 3170557 - protein, 20 aa, Giardia lamblia
SKEFSRLESLFTQKLLEKDI

SEQ ID NO: 3170558 - protein, 19 aa, Giardia lamblia
SKEILSREIVYPEDTELFR

SEQ ID NO: 3170559 - protein, 22 aa, Giardia lamblia
SKEKTCPTFVYGVNHKKINAGN

SEQ ID NO: 3170560 - protein, 25 aa, Giardia lamblia
SKELSIDFRTLWISTLAPSTGVLGK

SEQ ID NO: 3170561 - protein, 23 aa, Giardia lamblia
SKERVAEHYLVFKEHKKILDEDA

SEQ ID NO: 3170562 - protein, 28 aa, Giardia lamblia
SKESSCLSLKYFVGDAVQLSQIMARSAE

SEQ ID NO: 3170563 - protein, 25 aa, Giardia lamblia
SKFGHLRGKIAPFVLSDRASPFPIA

SEQ ID NO: 3170564 - protein, 17 aa, Giardia lamblia
SKFHPHFSGRIVSKGLY

SEQ ID NO: 3170565 - protein, 17 aa, Giardia lamblia
SKFKEALEAAKANHEAK

SEQ ID NO: 3170566 - protein, 21 aa, Giardia lamblia
SKFQLPMSAYSPGSFSGERPP

SEQ ID NO: 3170567 - protein, 26 aa, Giardia lamblia
SKFVAAFFAGCWTVTLIGDRVSDFFS

SEQ ID NO: 3170568 - protein, 24 aa, Giardia lamblia
SKGALKMTFGLSGEQASALLEARL

SEQ ID NO: 3170569 - protein, 21 aa, Giardia lamblia
SKGETALMLALLIEDTTAVEL

SEQ ID NO: 3170570 - protein, 23 aa, Giardia lamblia
SKGETALMWAARHGDLELVHILA

SEQ ID NO: 3170571 - protein, 25 aa, Giardia lamblia
SKGFPLRKAIAYERLHRRALTINSL

SEQ ID NO: 3170572 - protein, 17 aa, Giardia lamblia
SKGKVLKSGQWNTMNDY

SEQ ID NO: 3170573 - protein, 21 aa, Giardia lamblia
SKGLFRIALDDTFRVIECADE

SEQ ID NO: 3170574 - protein, 30 aa, Giardia lamblia
SKGLSVLDLCLKWALEGVSDFEDLDDEAFS

SEQ ID NO: 3170575 - protein, 24 aa, Giardia lamblia
SKGSSILECYAIKNALSTLFKAAN

SEQ ID NO: 3170576 - protein, 21 aa, Giardia lamblia
SKGYTALMICARTNYFEIGRM

SEQ ID NO: 3170577 - protein, 17 aa, Giardia lamblia
SKHDVLNHTGYRIDDFT

SEQ ID NO: 3170578 - protein, 21 aa, Giardia lamblia
SKHLLADCELVFFNDFAHKAT

SEQ ID NO: 3170579 - protein, 28 aa, Giardia lamblia
SKHQCAKMSIPEACILTILRSVAQALAF

SEQ ID NO: 3170580 - protein, 18 aa, Giardia lamblia
SKIELVRESLQLCISSHI

SEQ ID NO: 3170581 - protein, 18 aa, Giardia lamblia
SKIRCALESEKSTFAVEL

SEQ ID NO: 3170582 - protein, 17 aa, Giardia lamblia
SKISFRTNTHILSLLPY

SEQ ID NO: 3170583 - protein, 18 aa, Giardia lamblia
SKITEFLYLSSLTAAQNT

SEQ ID NO: 3170584 - protein, 22 aa, Giardia lamblia
SKKADEAMGFVGGRRLDGRGKA

SEQ ID NO: 3170585 - protein, 17 aa, Giardia lamblia
SKKEIKTQISYAANVRG

SEQ ID NO: 3170586 - protein, 24 aa, Giardia lamblia
SKKRMVPEAAIWGFLAQAIQALTY

SEQ ID NO: 3170587 - protein, 24 aa, Giardia lamblia
SKKRNNFCVAFKLVNPASAIQNDL

SEQ ID NO: 3170588 - protein, 23 aa, Giardia lamblia
SKKSKYIRGYRVIDETEAYANKN

SEQ ID NO: 3170589 - protein, 23 aa, Giardia lamblia
SKKYPDFRPMLMTKVETPLAVLN

SEQ ID NO: 3170590 - protein, 22 aa, Giardia lamblia
SKLAIEIAFEMLHLEIVNVLMP

SEQ ID NO: 3170591 - protein, 28 aa, Giardia lamblia
SKLARSLCLIEMRLEAAPKLQQLDDEIT

SEQ ID NO: 3170592 - protein, 24 aa, Giardia lamblia
SKLASLLLPHSLHICDPRGRTALH

SEQ ID NO: 3170593 - protein, 19 aa, Giardia lamblia
SKLFCVIEPDVTINSFTVF

SEQ ID NO: 3170594 - protein, 20 aa, Giardia lamblia
SKLFEGVSFAQIRSLWMKSR

SEQ ID NO: 3170595 - protein, 33 aa, Giardia lamblia
SKLFTICALLCFKDKHSASRFCKEYCLRYDEAH

SEQ ID NO: 3170596 - protein, 24 aa, Giardia lamblia
SKLFVSDLFICYEMDTPEKYELRF

SEQ ID NO: 3170597 - protein, 17 aa, Giardia lamblia
SKLKLAFDKKLADDRKT

SEQ ID NO: 3170598 - protein, 25 aa, Giardia lamblia
SKLPSLWAKLCLLWIESQKLRSTDP

SEQ ID NO: 3170599 - protein, 19 aa, Giardia lamblia
SKLQPGVADARMATLAEEN

SEQ ID NO: 3170600 - protein, 19 aa, Giardia lamblia
SKLQSAVPDLCLDTDIICG

SEQ ID NO: 3170601 - protein, 18 aa, Giardia lamblia
SKLREQRVSLSKQNVDAT

SEQ ID NO: 3170602 - protein, 25 aa, Giardia lamblia
SKLRSICKAAVFVGRLLELTKSRRG

SEQ ID NO: 3170603 - protein, 17 aa, Giardia lamblia
SKLSHFYERAGRVICLG

SEQ ID NO: 3170604 - protein, 21 aa, Giardia lamblia
SKLTKAICVPPNVRQGSLCCK

SEQ ID NO: 3170605 - protein, 17 aa, Giardia lamblia
SKLTMVLRDSFIGNSQT

SEQ ID NO: 3170606 - protein, 17 aa, Giardia lamblia
SKLYSLRKLSTVLSATL

SEQ ID NO: 3170607 - protein, 17 aa, Giardia lamblia
SKMMAQVVIENRHLRQV

SEQ ID NO: 3170608 - protein, 18 aa, Giardia lamblia
SKMTALPDTMKFRIVREI

SEQ ID NO: 3170609 - protein, 30 aa, Giardia lamblia
SKNIQAAFWKRCLQTGLVAGNGSFVCGAVL

SEQ ID NO: 3170610 - protein, 18 aa, Giardia lamblia
SKNKFLLDEKTQCTKIIK

SEQ ID NO: 3170611 - protein, 28 aa, Giardia lamblia
SKPAILLSFPDCNCCLSDKHMPSETHLD

SEQ ID NO: 3170612 - protein, 17 aa, Giardia lamblia
SKPALAAIERLPVTQFL

SEQ ID NO: 3170613 - protein, 25 aa, Giardia lamblia
SKPARICVEVARLPKDALVEIDAIA

SEQ ID NO: 3170614 - protein, 19 aa, Giardia lamblia
SKPASALCTDSEKAAPKVR

SEQ ID NO: 3170615 - protein, 17 aa, Giardia lamblia
SKPDFRGNYLPSGSRKE

SEQ ID NO: 3170616 - protein, 31 aa, Giardia lamblia
SKPDPAIYLECFKRLSISASEALIFEDSIHG

SEQ ID NO: 3170617 - protein, 21 aa, Giardia lamblia
SKPEIRKAFETVFETKVARVN

SEQ ID NO: 3170618 - protein, 20 aa, Giardia lamblia
SKPNTVEWFNAVAAGSLGEV

SEQ ID NO: 3170619 - protein, 17 aa, Giardia lamblia
SKPPGSVGLNMVRPYSN

SEQ ID NO: 3170620 - protein, 23 aa, Giardia lamblia
SKPRLPADAADSFQYTELLSSCD

SEQ ID NO: 3170621 - protein, 19 aa, Giardia lamblia
SKPSITFEGFVYVDRFVLH

SEQ ID NO: 3170622 - protein, 18 aa, Giardia lamblia
SKPTLPDMGPRTGSRALS

SEQ ID NO: 3170623 - protein, 17 aa, Giardia lamblia
SKPYLIGGLKFDLRMYV

SEQ ID NO: 3170624 - protein, 24 aa, Giardia lamblia
SKQARPKPAFSNARECFCEVGDRT

SEQ ID NO: 3170625 - protein, 19 aa, Giardia lamblia
SKQIDAGMQEMELGTLRKE

SEQ ID NO: 3170626 - protein, 20 aa, Giardia lamblia
SKQMLRFAFDGADSTDSLED

SEQ ID NO: 3170627 - protein, 22 aa, Giardia lamblia
SKQMRAFCSVSRPHCFPVVKGL

SEQ ID NO: 3170628 - protein, 27 aa, Giardia lamblia
SKQSRKFSSPVCSRASSRSRLHQVSQS

SEQ ID NO: 3170629 - protein, 22 aa, Giardia lamblia
SKQSTKSVCFALHVGAETGPIT

SEQ ID NO: 3170630 - protein, 18 aa, Giardia lamblia
SKRISCDEALQHPWFDDL

SEQ ID NO: 3170631 - protein, 24 aa, Giardia lamblia
SKRRGMPYFFSRNEVVFSDFTRYE

SEQ ID NO: 3170632 - protein, 38 aa, Giardia lamblia
SKRSFLPHELWQLFYRNARSNFHVCLCLSPIGESLRRR

SEQ ID NO: 3170633 - protein, 23 aa, Giardia lamblia
SKRSRRALASIGIQRLIDSLPAA

SEQ ID NO: 3170634 - protein, 17 aa, Giardia lamblia
SKSAIQFTTSESVQENV

SEQ ID NO: 3170635 - protein, 22 aa, Giardia lamblia
SKSFACIPCLAAVEARIRDSHN

SEQ ID NO: 3170636 - protein, 28 aa, Giardia lamblia
SKSFARRLPRVHKASNFSFSQVVLSRKS

SEQ ID NO: 3170637 - protein, 31 aa, Giardia lamblia
SKSFKGIPEILCRRYARQILEAIKHMHRQNV

SEQ ID NO: 3170638 - protein, 17 aa, Giardia lamblia
SKSGIELHSRFFKLVSW

SEQ ID NO: 3170639 - protein, 25 aa, Giardia lamblia
SKSGKPIFGKICRPHGNSGMVRARF

SEQ ID NO: 3170640 - protein, 18 aa, Giardia lamblia
SKSHHKSIFGDERSKDHS

SEQ ID NO: 3170641 - protein, 26 aa, Giardia lamblia
SKTCPTMLATAEWKFLCTVHSTDPQD

SEQ ID NO: 3170642 - protein, 19 aa, Giardia lamblia
SKTDIPGVMALPDQKDERC

SEQ ID NO: 3170643 - protein, 26 aa, Giardia lamblia
SKTDSLRWGLTGGKPYLRNITEENVQ

SEQ ID NO: 3170644 - protein, 26 aa, Giardia lamblia
SKTEMKELLTELGLLRERLIQEAARR

SEQ ID NO: 3170645 - protein, 23 aa, Giardia lamblia
SKTFNKMALKLRHKIVTPTRVAV

SEQ ID NO: 3170646 - protein, 24 aa, Giardia lamblia
SKTGHARVGLVGFPSVGKSTLLTK

SEQ ID NO: 3170647 - protein, 21 aa, Giardia lamblia
SKTGRTALIYAAQRNFTDIVR

SEQ ID NO: 3170648 - protein, 20 aa, Giardia lamblia
SKTHYAWYTKQLMDVSISDA

SEQ ID NO: 3170649 - protein, 24 aa, Giardia lamblia
SKTIDGWTALMFAVLYNKLESLPT

SEQ ID NO: 3170650 - protein, 23 aa, Giardia lamblia
SKTKSGKNPTIFGAEDTDTEDSR

SEQ ID NO: 3170651 - protein, 25 aa, Giardia lamblia
SKTKTGFIFALRFSPSLWTRSMERR

SEQ ID NO: 3170652 - protein, 18 aa, Giardia lamblia
SKTLAIEGLLKCTRLFPE

SEQ ID NO: 3170653 - protein, 20 aa, Giardia lamblia
SKTLMCANISPASTNYDETM

SEQ ID NO: 3170654 - protein, 24 aa, Giardia lamblia
SKTQIFPPRTEFFATELSPSSVLL

SEQ ID NO: 3170655 - protein, 25 aa, Giardia lamblia
SKTSPFLLWACGILKKDISINPKTL

SEQ ID NO: 3170656 - protein, 28 aa, Giardia lamblia
SKTVWARMVNSWLAFCRSARNNVQGDAE

SEQ ID NO: 3170657 - protein, 19 aa, Giardia lamblia
SKVATCLDKKLIAISGGGS

SEQ ID NO: 3170658 - protein, 25 aa, Giardia lamblia
SKVHKVCPVCRAPVQTTIAPLFREE

SEQ ID NO: 3170659 - protein, 23 aa, Giardia lamblia
SKVLCYYMIALVRKYSELGSLGY

SEQ ID NO: 3170660 - protein, 29 aa, Giardia lamblia
SKWDEILAILPNRIIHVPLTYTELTNIIS

SEQ ID NO: 3170661 - protein, 25 aa, Giardia lamblia
SKWKDMPFLSFRSGLSCTAKNQIPA

SEQ ID NO: 3170662 - protein, 20 aa, Giardia lamblia
SKYEGEFRLNQPFGKGAWIV

SEQ ID NO: 3170663 - protein, 17 aa, Giardia lamblia
SKYLQKIWVERDKQAHE

SEQ ID NO: 3170664 - protein, 21 aa, Giardia lamblia
SKYLRDRYTPLFQLNLSLSSP

SEQ ID NO: 3170665 - protein, 23 aa, Giardia lamblia
SKYLTLRPAHLVDNVVPLCSGIL

SEQ ID NO: 3170666 - protein, 26 aa, Giardia lamblia
SKYPCKPPLLWADGLLTYSWAKSKIR

SEQ ID NO: 3170667 - protein, 23 aa, Giardia lamblia
SKYPRQEIMMTYNNMLRSRDIQR

SEQ ID NO: 3170668 - protein, 30 aa, Giardia lamblia
SLAAMGRSATVGSLRFSDPDIILSHATMIA

SEQ ID NO: 3170669 - protein, 25 aa, Giardia lamblia
SLAEPLVRCGACREVYCNNFDHKTS

SEQ ID NO: 3170670 - protein, 20 aa, Giardia lamblia
SLAHKSACICLVVFDFVSRP

SEQ ID NO: 3170671 - protein, 19 aa, Giardia lamblia
SLAKIIRPSRRRRSIKSRQ

SEQ ID NO: 3170672 - protein, 17 aa, Giardia lamblia
SLALAEREVPVGCAIVD

SEQ ID NO: 3170673 - protein, 25 aa, Giardia lamblia
SLAPREVDRILSIPCADPDTPTRFK

SEQ ID NO: 3170674 - protein, 29 aa, Giardia lamblia
SLAQRLANRLKPYILRRLKSDVERSLPPK

SEQ ID NO: 3170675 - protein, 24 aa, Giardia lamblia
SLARFLYERIGFYCQMLLEQQIVK

SEQ ID NO: 3170676 - protein, 20 aa, Giardia lamblia
SLARPSTRWWLSARSCLSPN

SEQ ID NO: 3170677 - protein, 17 aa, Giardia lamblia
SLASIYSKLCTKLLVEP

SEQ ID NO: 3170678 - protein, 27 aa, Giardia lamblia
SLCCKDLTKSFPFKCPMINTSNAKTTR

SEQ ID NO: 3170679 - protein, 19 aa, Giardia lamblia
SLCDCMDMSKLMRRGYTMA

SEQ ID NO: 3170680 - protein, 17 aa, Giardia lamblia
SLCINGVSQDGCSERSQ

SEQ ID NO: 3170681 - protein, 19 aa, Giardia lamblia
SLCIPTLKYVLALMNSPSF

SEQ ID NO: 3170682 - protein, 17 aa, Giardia lamblia
SLCLSHEKPHLSLDFYS

SEQ ID NO: 3170683 - protein, 19 aa, Giardia lamblia
SLCRMAFGYPVEALCFNSD

SEQ ID NO: 3170684 - protein, 18 aa, Giardia lamblia
SLCRSVFQSITFCSAFPE

SEQ ID NO: 3170685 - protein, 27 aa, Giardia lamblia
SLCSKGPAMSSIKCGANAVLKVIPSRS

SEQ ID NO: 3170686 - protein, 21 aa, Giardia lamblia
SLCYLELRFSSNLSAFEEVLR

SEQ ID NO: 3170687 - protein, 32 aa, Giardia lamblia
SLDAQGCAFLQPRLGSNLNITGVSPAFPSSLS

SEQ ID NO: 3170688 - protein, 17 aa, Giardia lamblia
SLDCKSFYTDIFTSELY

SEQ ID NO: 3170689 - protein, 26 aa, Giardia lamblia
SLDHRRFSPDLKQFILALRSLCLHDK

SEQ ID NO: 3170690 - protein, 18 aa, Giardia lamblia
SLDIERRIREMKAQLEKE

SEQ ID NO: 3170691 - protein, 19 aa, Giardia lamblia
SLDIHVCAVFLTESFGVPF

SEQ ID NO: 3170692 - protein, 26 aa, Giardia lamblia
SLDPVLTFEFVYEVNLDWSVARRIVK

SEQ ID NO: 3170693 - protein, 24 aa, Giardia lamblia
SLDRSRLAAEQAVAAARSIQSSAE

SEQ ID NO: 3170694 - protein, 19 aa, Giardia lamblia
SLDTPICIGHVESIVGSAA

SEQ ID NO: 3170695 - protein, 24 aa, Giardia lamblia
SLEEFSYFMLCSTFTSKELQPIRE

SEQ ID NO: 3170696 - protein, 20 aa, Giardia lamblia
SLEFRSCSLATLKEHNLDMY

SEQ ID NO: 3170697 - protein, 17 aa, Giardia lamblia
SLEGIDIGNGIKVTTRR

SEQ ID NO: 3170698 - protein, 25 aa, Giardia lamblia
SLEKIRCIWEGTVLAVKEYSSRSGV

SEQ ID NO: 3170699 - protein, 19 aa, Giardia lamblia
SLEPLAICLDEFDPCVKEA

SEQ ID NO: 3170700 - protein, 17 aa, Giardia lamblia
SLERYKPMMKVIGIYSE

SEQ ID NO: 3170701 - protein, 26 aa, Giardia lamblia
SLESLSLCLRCAGRAQVHDDAFSHGA

SEQ ID NO: 3170702 - protein, 27 aa, Giardia lamblia
SLEVAKLLVSYECCLQSKTGLTALMYA

SEQ ID NO: 3170703 - protein, 18 aa, Giardia lamblia
SLEVLKQLVCGGNLPVYV

SEQ ID NO: 3170704 - protein, 26 aa, Giardia lamblia
SLEVLLDMFQCWIVPAINAEGIRVGN

SEQ ID NO: 3170705 - protein, 19 aa, Giardia lamblia
SLEYLPTVSTACRFMGCHG

SEQ ID NO: 3170706 - protein, 18 aa, Giardia lamblia
SLFEARRICDNEKVLVEA

SEQ ID NO: 3170707 - protein, 22 aa, Giardia lamblia
SLFEIKQPPPLEIHTATHDTAV

SEQ ID NO: 3170708 - protein, 25 aa, Giardia lamblia
SLFLAKIRAAFVINKVIRLLYNVLQ

SEQ ID NO: 3170709 - protein, 20 aa, Giardia lamblia
SLFPDSLFKTILMSMSSDLQ

SEQ ID NO: 3170710 - protein, 20 aa, Giardia lamblia
SLFPGCLPTLTSREDQCIMV

SEQ ID NO: 3170711 - protein, 23 aa, Giardia lamblia
SLFRGLCRAATFVSKTLKESSEE

SEQ ID NO: 3170712 - protein, 24 aa, Giardia lamblia
SLFSEPRLALPNANTYARAGMPQA

SEQ ID NO: 3170713 - protein, 25 aa, Giardia lamblia
SLFWNCTRMKLHINAVISEDAIAKS

SEQ ID NO: 3170714 - protein, 23 aa, Giardia lamblia
SLGAEFAEPVPVNFEDIFMNEAK

SEQ ID NO: 3170715 - protein, 24 aa, Giardia lamblia
SLGCILIQLLFDYPAFHSKDRDEN

SEQ ID NO: 3170716 - protein, 25 aa, Giardia lamblia
SLGCPPHLLKLLIHVEAGLTDNMGW

SEQ ID NO: 3170717 - protein, 18 aa, Giardia lamblia
SLGCSICDLIFDVPLFKT

SEQ ID NO: 3170718 - protein, 26 aa, Giardia lamblia
SLGCTIYHVCALRPPFVAVGMGPLIR

SEQ ID NO: 3170719 - protein, 24 aa, Giardia lamblia
SLGGRTALMLAARCNQPQSAAMLL

SEQ ID NO: 3170720 - protein, 27 aa, Giardia lamblia
SLGGSVSMLMGWFWSYHIPYQRIKVIG

SEQ ID NO: 3170721 - protein, 19 aa, Giardia lamblia
SLGKKRMASMPAVGAAPAA

SEQ ID NO: 3170722 - protein, 24 aa, Giardia lamblia
SLGKLLSDMCLLLLPSSPEPPSLP

SEQ ID NO: 3170723 - protein, 29 aa, Giardia lamblia
SLGLLFFEVICGRPLFSCSNDIEYVYKTN

SEQ ID NO: 3170724 - protein, 19 aa, Giardia lamblia
SLGQSLRCLNELEETTDKR

SEQ ID NO: 3170725 - protein, 28 aa, Giardia lamblia
SLGRDVSSIFPLVCRFAATKDIKLKKVV

SEQ ID NO: 3170726 - protein, 25 aa, Giardia lamblia
SLGRILRVTLRIDEQLDFEISKRAP

SEQ ID NO: 3170727 - protein, 18 aa, Giardia lamblia
SLGRMWAVSYNFDVSGVY

SEQ ID NO: 3170728 - protein, 25 aa, Giardia lamblia
SLGSIEIVELLGLNSSVIISETMYI

SEQ ID NO: 3170729 - protein, 18 aa, Giardia lamblia
SLGYASICSLLIEQEGMY

SEQ ID NO: 3170730 - protein, 21 aa, Giardia lamblia
SLGYINSSLMRKALASLDSGQ

SEQ ID NO: 3170731 - protein, 18 aa, Giardia lamblia
SLHDAICVVRRAIRHPRF

SEQ ID NO: 3170732 - protein, 19 aa, Giardia lamblia
SLHELRHANSIALSTYKDF

SEQ ID NO: 3170733 - protein, 18 aa, Giardia lamblia
SLHKAELVSGSASQGHWA

SEQ ID NO: 3170734 - protein, 19 aa, Giardia lamblia
SLHLGHIAKGFGLSEPPSK

SEQ ID NO: 3170735 - protein, 23 aa, Giardia lamblia
SLHLNCLPGLTALMTAVITGQNQ

SEQ ID NO: 3170736 - protein, 18 aa, Giardia lamblia
SLHLPRTAYVKVSVKDEY

SEQ ID NO: 3170737 - protein, 18 aa, Giardia lamblia
SLHPHLYVQSDLPKISFK

SEQ ID NO: 3170738 - protein, 22 aa, Giardia lamblia
SLHPYDALTLYCLDMDTGSSNM

SEQ ID NO: 3170739 - protein, 26 aa, Giardia lamblia
SLICPKCKGKRVMVDMAKIDVHIEPG

SEQ ID NO: 3170740 - protein, 18 aa, Giardia lamblia
SLIDLPLYKFLVPDEAAG

SEQ ID NO: 3170741 - protein, 18 aa, Giardia lamblia
SLIFCSGKVTFTPVRELL

SEQ ID NO: 3170742 - protein, 33 aa, Giardia lamblia
SLIFSLLLYKPCPLYILDEIDAALDLNHTHNIG

SEQ ID NO: 3170743 - protein, 19 aa, Giardia lamblia
SLIGKFRTEHFRKDLESLG

SEQ ID NO: 3170744 - protein, 17 aa, Giardia lamblia
SLIGSRVELIFTTGDKL

SEQ ID NO: 3170745 - protein, 26 aa, Giardia lamblia
SLIHKNILRYLALHQRGDNVLLIEME

SEQ ID NO: 3170746 - protein, 18 aa, Giardia lamblia
SLIHPFAKSIFRSPLHPW

SEQ ID NO: 3170747 - protein, 18 aa, Giardia lamblia
SLIKMFAALRPIYSMVAS

SEQ ID NO: 3170748 - protein, 22 aa, Giardia lamblia
SLIKRMATLRAEAEATGASATH

SEQ ID NO: 3170749 - protein, 20 aa, Giardia lamblia
SLIPCFAYAEIALRDIMDSS

SEQ ID NO: 3170750 - protein, 21 aa, Giardia lamblia
SLIQGLRCLPALRSNRIETRA

SEQ ID NO: 3170751 - protein, 17 aa, Giardia lamblia
SLIRMLKQYLGFDYVFD

SEQ ID NO: 3170752 - protein, 18 aa, Giardia lamblia
SLITPRDVLPLTEMHLYR

SEQ ID NO: 3170753 - protein, 17 aa, Giardia lamblia
SLKAELDTALAHLESRT

SEQ ID NO: 3170754 - protein, 23 aa, Giardia lamblia
SLKAKLKERIHIFAQFEALSNTE

SEQ ID NO: 3170755 - protein, 23 aa, Giardia lamblia
SLKDGRRLGLEHSVPRPSLAEIE

SEQ ID NO: 3170756 - protein, 18 aa, Giardia lamblia
SLKEKKAAATEIAQLAVA

SEQ ID NO: 3170757 - protein, 22 aa, Giardia lamblia
SLKGNTPLALKLVLQDRRYKNR

SEQ ID NO: 3170758 - protein, 23 aa, Giardia lamblia
SLKIPEEDAFKIGILPDAGGVYR

SEQ ID NO: 3170759 - protein, 29 aa, Giardia lamblia
SLKISPWSDVEWSLIPPIVSSSILEIRSG

SEQ ID NO: 3170760 - protein, 18 aa, Giardia lamblia
SLKKLSFEEGNAMDTSTE

SEQ ID NO: 3170761 - protein, 23 aa, Giardia lamblia
SLKLDPVPHFWTRENLQKLVDSL

SEQ ID NO: 3170762 - protein, 17 aa, Giardia lamblia
SLKPLGRIMDRYINEAV

SEQ ID NO: 3170763 - protein, 18 aa, Giardia lamblia
SLKQYERIEDPKVVLDQL

SEQ ID NO: 3170764 - protein, 23 aa, Giardia lamblia
SLKRLRCLFIGNNLIASFGEVER

SEQ ID NO: 3170765 - protein, 25 aa, Giardia lamblia
SLKRSFEHRDILTLTSVGHHPVATK

SEQ ID NO: 3170766 - protein, 22 aa, Giardia lamblia
SLKRSRGWLSELELREHEKAER

SEQ ID NO: 3170767 - protein, 23 aa, Giardia lamblia
SLKTLEQRLAMALEENQMSANQI

SEQ ID NO: 3170768 - protein, 28 aa, Giardia lamblia
SLLAKLDFLLKCKQILSANGIAYTGSEI

SEQ ID NO: 3170769 - protein, 18 aa, Giardia lamblia
SLLCQSSMDIFRMSVTDI

SEQ ID NO: 3170770 - protein, 19 aa, Giardia lamblia
SLLEGLSYLHLLENPTPFL

SEQ ID NO: 3170771 - protein, 23 aa, Giardia lamblia
SLLEIRRGYKVAMGVDIDIPEAS

SEQ ID NO: 3170772 - protein, 19 aa, Giardia lamblia
SLLERKRFGSVAYNNPYEF

SEQ ID NO: 3170773 - protein, 17 aa, Giardia lamblia
SLLERYHTLNSMKELAN

SEQ ID NO: 3170774 - protein, 19 aa, Giardia lamblia
SLLHKALCSQKFLVIPVIC

SEQ ID NO: 3170775 - protein, 26 aa, Giardia lamblia
SLLHRLEMHSEASLPPGMLKNARPAI

SEQ ID NO: 3170776 - protein, 23 aa, Giardia lamblia
SLLHTRTGLVLQQIAASYAKLCI

SEQ ID NO: 3170777 - protein, 24 aa, Giardia lamblia
SLLLADLLCGLLAPSPMQRYTMVE

SEQ ID NO: 3170778 - protein, 30 aa, Giardia lamblia
SLLLKLPITQYLPVMPFDHCSRTVAYGSNL

SEQ ID NO: 3170779 - protein, 19 aa, Giardia lamblia
SLLNAFFGVMPHKITTTYE

SEQ ID NO: 3170780 - protein, 19 aa, Giardia lamblia
SLLPDGRLALITVATDIDP

SEQ ID NO: 3170781 - protein, 25 aa, Giardia lamblia
SLLPEGTTECILWGLGSDGTIGACR

SEQ ID NO: 3170782 - protein, 26 aa, Giardia lamblia
SLLPLWKFATNFKEVLGIKTVKPVSC

SEQ ID NO: 3170783 - protein, 19 aa, Giardia lamblia
SLLQPNLVKYIEAFADKEY

SEQ ID NO: 3170784 - protein, 18 aa, Giardia lamblia
SLLRGHDVIFLLGDLNYR

SEQ ID NO: 3170785 - protein, 25 aa, Giardia lamblia
SLLVTKFLAQGGFAFVYVATNPMNV

SEQ ID NO: 3170786 - protein, 31 aa, Giardia lamblia
SLLYFSKVVAEFRLLCVHRHLQSLSRSPISF

SEQ ID NO: 3170787 - protein, 30 aa, Giardia lamblia
SLMACATFAFFCHFNKEFFKSMAPKADKES

SEQ ID NO: 3170788 - protein, 18 aa, Giardia lamblia
SLMARRGLLDPIGLGDLG

SEQ ID NO: 3170789 - protein, 24 aa, Giardia lamblia
SLMERLRLLSEELLDTSAEKEKAV

SEQ ID NO: 3170790 - protein, 24 aa, Giardia lamblia
SLMIPYRVVIIVSGALNNAAAMKY

SEQ ID NO: 3170791 - protein, 18 aa, Giardia lamblia
SLMLPSIHAGEFRATKLK

SEQ ID NO: 3170792 - protein, 17 aa, Giardia lamblia
SLMSMAWEPYPEMKAQN

SEQ ID NO: 3170793 - protein, 20 aa, Giardia lamblia
SLMWATYGGGIVFYDIRSGK

SEQ ID NO: 3170794 - protein, 25 aa, Giardia lamblia
SLNDLWECTVCLLEETAMTYGIQET

SEQ ID NO: 3170795 - protein, 24 aa, Giardia lamblia
SLNELPLQIYVSWFEQKAIVQFLT

SEQ ID NO: 3170796 - protein, 22 aa, Giardia lamblia
SLNHPFLMRLYGAFQTPTRLIM

SEQ ID NO: 3170797 - protein, 27 aa, Giardia lamblia
SLNHYRKLFSFSAPFTVDQAFRDYIRR

SEQ ID NO: 3170798 - protein, 24 aa, Giardia lamblia
SLNKLLPLMDKWFHAEPEVHRLYF

SEQ ID NO: 3170799 - protein, 34 aa, Giardia lamblia
SLNLEPLEIYGLIGTEFGKLVLKRAPEDVTIGML

SEQ ID NO: 3170800 - protein, 25 aa, Giardia lamblia
SLNPRAYLRPIFRDLGLTPVVCLLA

SEQ ID NO: 3170801 - protein, 18 aa, Giardia lamblia
SLNPRSSKYLSYESNSTQ

SEQ ID NO: 3170802 - protein, 19 aa, Giardia lamblia
SLNRSGPYMSERAVRQVSK

SEQ ID NO: 3170803 - protein, 18 aa, Giardia lamblia
SLNRSVRFAGPIVPIEHQ

SEQ ID NO: 3170804 - protein, 18 aa, Giardia lamblia
SLNSEFMAGGDFVSGIVL

SEQ ID NO: 3170805 - protein, 21 aa, Giardia lamblia
SLNTLCRKIAKVVPPENVIPR

SEQ ID NO: 3170806 - protein, 25 aa, Giardia lamblia
SLNVMKRRGVISAIGSRIGVGKEAD

SEQ ID NO: 3170807 - protein, 19 aa, Giardia lamblia
SLPAKREYLINCGMTSLQR

SEQ ID NO: 3170808 - protein, 33 aa, Giardia lamblia
SLPCILDMYYKVLISSLVTWARLTTQPERLTEL

SEQ ID NO: 3170809 - protein, 21 aa, Giardia lamblia
SLPGDCLTAAAFISYAGGLTG

SEQ ID NO: 3170810 - protein, 17 aa, Giardia lamblia
SLPPIAVSKAEIKAALK

SEQ ID NO: 3170811 - protein, 24 aa, Giardia lamblia
SLPPSSLPATFPLVTSAMESTEAL

SEQ ID NO: 3170812 - protein, 24 aa, Giardia lamblia
SLPQFPCLFLHQFGSKASVMESFE

SEQ ID NO: 3170813 - protein, 19 aa, Giardia lamblia
SLPRSIALERKRRELASVN

SEQ ID NO: 3170814 - protein, 17 aa, Giardia lamblia
SLPSFSLSSRTQTLDKK

SEQ ID NO: 3170815 - protein, 26 aa, Giardia lamblia
SLPSKRYWRHVDLFTSLLSQLFSFST

SEQ ID NO: 3170816 - protein, 23 aa, Giardia lamblia
SLPSTNVADMFHAKYGRLDTESE

SEQ ID NO: 3170817 - protein, 28 aa, Giardia lamblia
SLPTIYAQFAFTILFKLARDPLQHTAEE

SEQ ID NO: 3170818 - protein, 21 aa, Giardia lamblia
SLPYRIHTIVTTFFASLRKFV

SEQ ID NO: 3170819 - protein, 20 aa, Giardia lamblia
SLQDNLRMLLNASKHYGDAA

SEQ ID NO: 3170820 - protein, 17 aa, Giardia lamblia
SLQEEYWILRGRFAKTM

SEQ ID NO: 3170821 - protein, 25 aa, Giardia lamblia
SLQLKRFDIAAAIAGKHNILHIIDR

SEQ ID NO: 3170822 - protein, 18 aa, Giardia lamblia
SLQPLKWYYDQLIVTSAS

SEQ ID NO: 3170823 - protein, 17 aa, Giardia lamblia
SLQRFSFDGVYDPSVTT

SEQ ID NO: 3170824 - protein, 19 aa, Giardia lamblia
SLQRFSMLTRLMRTVISNN

SEQ ID NO: 3170825 - protein, 25 aa, Giardia lamblia
SLQRMLSYVFSIWIQQAREKLGKRI

SEQ ID NO: 3170826 - protein, 23 aa, Giardia lamblia
SLQSSSLCKSCYSMLDCTELQCT

SEQ ID NO: 3170827 - protein, 17 aa, Giardia lamblia
SLQTSVNIMYPFHISIN

SEQ ID NO: 3170828 - protein, 18 aa, Giardia lamblia
SLRKQTCDQEHLIHELQK

SEQ ID NO: 3170829 - protein, 21 aa, Giardia lamblia
SLRPFRDIRFAVFGMGSKNYT

SEQ ID NO: 3170830 - protein, 23 aa, Giardia lamblia
SLRPICRQLLNLWREAYLGVCVL

SEQ ID NO: 3170831 - protein, 21 aa, Giardia lamblia
SLRQKVDLCRLAAAGEQANVD

SEQ ID NO: 3170832 - protein, 19 aa, Giardia lamblia
SLRRETRITTDLEFLLNIS

SEQ ID NO: 3170833 - protein, 24 aa, Giardia lamblia
SLRRFKDTPFKSSNLISVVKLTTA

SEQ ID NO: 3170834 - protein, 24 aa, Giardia lamblia
SLRSRYSYANGPFFAEGERIKASG

SEQ ID NO: 3170835 - protein, 25 aa, Giardia lamblia
SLRTFCITEGMLGAGNFTTRACAVP

SEQ ID NO: 3170836 - protein, 22 aa, Giardia lamblia
SLSEFDCRAILRQNLHSRSIIC

SEQ ID NO: 3170837 - protein, 24 aa, Giardia lamblia
SLSEPECQFVLGFTANGWITAFDW

SEQ ID NO: 3170838 - protein, 23 aa, Giardia lamblia
SLSEYPACLDGDVTQVTDNTLRP

SEQ ID NO: 3170839 - protein, 19 aa, Giardia lamblia
SLSFTFQRCDIFVNFISTS

SEQ ID NO: 3170840 - protein, 19 aa, Giardia lamblia
SLSGCKLEFIDIHDIDDIP

SEQ ID NO: 3170841 - protein, 23 aa, Giardia lamblia
SLSGHKIYGPKGVGALYIKRTDE

SEQ ID NO: 3170842 - protein, 18 aa, Giardia lamblia
SLSGIPVQARGIWDDDFD

SEQ ID NO: 3170843 - protein, 18 aa, Giardia lamblia
SLSGSIIICTREVADTLD

SEQ ID NO: 3170844 - protein, 17 aa, Giardia lamblia
SLSKRGVKMMSDLYLRQ

SEQ ID NO: 3170845 - protein, 23 aa, Giardia lamblia
SLSLFTCALLRKADCCSDTLSTE

SEQ ID NO: 3170846 - protein, 24 aa, Giardia lamblia
SLSNSGIMTLNFEKSISHIVTAAE

SEQ ID NO: 3170847 - protein, 18 aa, Giardia lamblia
SLSPLSVLMRPSVTGNPV

SEQ ID NO: 3170848 - protein, 27 aa, Giardia lamblia
SLSSIKGLPLSSVCAAGGDRGLSSVRS

SEQ ID NO: 3170849 - protein, 18 aa, Giardia lamblia
SLSWFRAQGFDCDLDASF

SEQ ID NO: 3170850 - protein, 20 aa, Giardia lamblia
SLTDRGRLTTDYLFGKEPEF

SEQ ID NO: 3170851 - protein, 18 aa, Giardia lamblia
SLTDVLIVLHVVTIQHNT

SEQ ID NO: 3170852 - protein, 27 aa, Giardia lamblia
SLTIRPLCPCYFCNMVAMDETDLCVDR

SEQ ID NO: 3170853 - protein, 17 aa, Giardia lamblia
SLTKGRVSTEIEEIKQE

SEQ ID NO: 3170854 - protein, 24 aa, Giardia lamblia
SLTLHPFCRVVGGVELVVYGLDYH

SEQ ID NO: 3170855 - protein, 20 aa, Giardia lamblia
SLTLNGWDMLDTNDGVKDPT

SEQ ID NO: 3170856 - protein, 29 aa, Giardia lamblia
SLTNRYSAKLLEWRQSKKIADEKVHSNKV

SEQ ID NO: 3170857 - protein, 24 aa, Giardia lamblia
SLTQRGRICLFAIDEAHLVLEWVS

SEQ ID NO: 3170858 - protein, 17 aa, Giardia lamblia
SLTRARSLLSDKLGANW

SEQ ID NO: 3170859 - protein, 25 aa, Giardia lamblia
SLTRDCIRAVIPQMVVRGAKNLRIV

SEQ ID NO: 3170860 - protein, 24 aa, Giardia lamblia
SLTSPRVLVALARLGLSPEELEHD

SEQ ID NO: 3170861 - protein, 18 aa, Giardia lamblia
SLTVLPYAPHVRPIQKHV

SEQ ID NO: 3170862 - protein, 17 aa, Giardia lamblia
SLVDFLLTCPSQVIRVS

SEQ ID NO: 3170863 - protein, 17 aa, Giardia lamblia
SLVEIYSLITFIQPNIL

SEQ ID NO: 3170864 - protein, 18 aa, Giardia lamblia
SLVFSFPTLPLVVSCSLV

SEQ ID NO: 3170865 - protein, 19 aa, Giardia lamblia
SLVKICAQIALLHGSVAEL

SEQ ID NO: 3170866 - protein, 23 aa, Giardia lamblia
SLVKLLCTHECQMRDTSGRTALM

SEQ ID NO: 3170867 - protein, 26 aa, Giardia lamblia
SLVNEFKPWFLALRKRCPVKDLTRLT

SEQ ID NO: 3170868 - protein, 17 aa, Giardia lamblia
SLVPVLSRHSILSVVDV

SEQ ID NO: 3170869 - protein, 24 aa, Giardia lamblia
SLVQKISCLDFLLRSAQQRDNMPT

SEQ ID NO: 3170870 - protein, 18 aa, Giardia lamblia
SLVSGHGIGTAMSTGVDH

SEQ ID NO: 3170871 - protein, 18 aa, Giardia lamblia
SLVTICSDLERKDGTLCD

SEQ ID NO: 3170872 - protein, 21 aa, Giardia lamblia
SLWSNRLYQQISRISTHMTPT

SEQ ID NO: 3170873 - protein, 20 aa, Giardia lamblia
SLYAAHKCEDEILSLIAAYN

SEQ ID NO: 3170874 - protein, 31 aa, Giardia lamblia
SLYAILKAECMRLKQCLDFNSLPPDAKEVEF

SEQ ID NO: 3170875 - protein, 21 aa, Giardia lamblia
SLYAYGIEDCTPFTTEKLIRN

SEQ ID NO: 3170876 - protein, 17 aa, Giardia lamblia
SLYDFIRDRTWRQFLCA

SEQ ID NO: 3170877 - protein, 18 aa, Giardia lamblia
SLYDIMWNDIAYVSLVLF

SEQ ID NO: 3170878 - protein, 17 aa, Giardia lamblia
SLYGCASGSPGYGASYP

SEQ ID NO: 3170879 - protein, 20 aa, Giardia lamblia
SLYGNIKCLEYLFVNEQTLE

SEQ ID NO: 3170880 - protein, 24 aa, Giardia lamblia
SLYPLFEFSPEVFKEIASSIDVAF

SEQ ID NO: 3170881 - protein, 19 aa, Giardia lamblia
SLYSCVLRYKVPAEQIITE

SEQ ID NO: 3170882 - protein, 18 aa, Giardia lamblia
SLYTQALRSFKATEESLR

SEQ ID NO: 3170883 - protein, 18 aa, Giardia lamblia
SLYTRGLISYPRTETKSY

SEQ ID NO: 3170884 - protein, 19 aa, Giardia lamblia
SMAELRSLLFPVIVQSSIK

SEQ ID NO: 3170885 - protein, 20 aa, Giardia lamblia
SMALTPIGMCLSKIPEDPRL

SEQ ID NO: 3170886 - protein, 25 aa, Giardia lamblia
SMAVLEARLQSFGANMDHFNIEALA

SEQ ID NO: 3170887 - protein, 21 aa, Giardia lamblia
SMCDHFSEASLLFAASDDIQM

SEQ ID NO: 3170888 - protein, 19 aa, Giardia lamblia
SMCKHVAALEKQLHSEVKV

SEQ ID NO: 3170889 - protein, 33 aa, Giardia lamblia
SMDLCRRLRLLMGLNHKCLNRILSVKFVQDMAV

SEQ ID NO: 3170890 - protein, 25 aa, Giardia lamblia
SMEEKLRYLMPLVLDRLYTYQHFTT

SEQ ID NO: 3170891 - protein, 21 aa, Giardia lamblia
SMELGEFWYELVVTCNELTVK

SEQ ID NO: 3170892 - protein, 24 aa, Giardia lamblia
SMEYARLVPNIASVVLARVPDDLF

SEQ ID NO: 3170893 - protein, 17 aa, Giardia lamblia
SMGDAYELLLLILDNIS

SEQ ID NO: 3170894 - protein, 24 aa, Giardia lamblia
SMGPKVRAAIEFTQATGKMSIITS

SEQ ID NO: 3170895 - protein, 17 aa, Giardia lamblia
SMHIRKAGNVLVYAMAW

SEQ ID NO: 3170896 - protein, 19 aa, Giardia lamblia
SMHQSHRTASCSTINSKSS

SEQ ID NO: 3170897 - protein, 18 aa, Giardia lamblia
SMHSELRTPQGLDILIHG

SEQ ID NO: 3170898 - protein, 17 aa, Giardia lamblia
SMIGHLVVFSGIVTFIS

SEQ ID NO: 3170899 - protein, 18 aa, Giardia lamblia
SMIYTCTDIPLLANTLAL

SEQ ID NO: 3170900 - protein, 19 aa, Giardia lamblia
SMKEGRWVLLANVHLTPSF

SEQ ID NO: 3170901 - protein, 27 aa, Giardia lamblia
SMKFRSKGRFCALSWRSPVTGAALCRC

SEQ ID NO: 3170902 - protein, 18 aa, Giardia lamblia
SMKHLRFVNKLRLRRAAQ

SEQ ID NO: 3170903 - protein, 25 aa, Giardia lamblia
SMKILLNILLRRTFESSLGMLNIRS

SEQ ID NO: 3170904 - protein, 25 aa, Giardia lamblia
SMKQGIVISLGFSGIFRPDDIRQAI

SEQ ID NO: 3170905 - protein, 18 aa, Giardia lamblia
SMLDEILRALGVFISNSA

SEQ ID NO: 3170906 - protein, 20 aa, Giardia lamblia
SMLEPSVERKSFDFSANLLS

SEQ ID NO: 3170907 - protein, 17 aa, Giardia lamblia
SMLLVVNPEQRWCIEDL

SEQ ID NO: 3170908 - protein, 19 aa, Giardia lamblia
SMLNRRYDPIPSFVNDQAK

SEQ ID NO: 3170909 - protein, 20 aa, Giardia lamblia
SMLPLAAALFTVFSAGETSN

SEQ ID NO: 3170910 - protein, 30 aa, Giardia lamblia
SMLPVSMSRHLNLPAKLCMSQPLGRNNDES

SEQ ID NO: 3170911 - protein, 28 aa, Giardia lamblia
SMLTKLRFPDLFTLLDIRSISESPASHL

SEQ ID NO: 3170912 - protein, 19 aa, Giardia lamblia
SMMIDHVHHFYKVYFEAAY

SEQ ID NO: 3170913 - protein, 26 aa, Giardia lamblia
SMMVYRLIDFTAIFPITPSSVMAEMI

SEQ ID NO: 3170914 - protein, 28 aa, Giardia lamblia
SMMYDHCLKCKYAYRAYGSLAMDIRKCF

SEQ ID NO: 3170915 - protein, 19 aa, Giardia lamblia
SMNLLDAATSFSIHSLPVS

SEQ ID NO: 3170916 - protein, 21 aa, Giardia lamblia
SMNLQRLGCRSAIATLTCSPL

SEQ ID NO: 3170917 - protein, 19 aa, Giardia lamblia
SMPHVKFRYLPAGQNVIIA

SEQ ID NO: 3170918 - protein, 24 aa, Giardia lamblia
SMPLSFDLMSPLYFQGANDEIHQI

SEQ ID NO: 3170919 - protein, 24 aa, Giardia lamblia
SMPRSIVKADEWNESCDRPDRQLF

SEQ ID NO: 3170920 - protein, 20 aa, Giardia lamblia
SMPTIDCLFPPNKNIQVDVI

SEQ ID NO: 3170921 - protein, 19 aa, Giardia lamblia
SMPVMPEMDLATILEAAGV

SEQ ID NO: 3170922 - protein, 19 aa, Giardia lamblia
SMQELRIYRQLAMAHSQLL

SEQ ID NO: 3170923 - protein, 27 aa, Giardia lamblia
SMQRLYGYRLLYTVSRIFTKKMAIDAQ

SEQ ID NO: 3170924 - protein, 19 aa, Giardia lamblia
SMRFCPPKLLPIISSQVLK

SEQ ID NO: 3170925 - protein, 17 aa, Giardia lamblia
SMRRVWNSFAQSFTQTT

SEQ ID NO: 3170926 - protein, 22 aa, Giardia lamblia
SMSASTTQGFGFKPPADEPKST

SEQ ID NO: 3170927 - protein, 22 aa, Giardia lamblia
SMSDLKPGLRVALRSSDSEIVM

SEQ ID NO: 3170928 - protein, 20 aa, Giardia lamblia
SMSFKCTSDVLAIPLKITPF

SEQ ID NO: 3170929 - protein, 23 aa, Giardia lamblia
SMSKYRVCDYYLYDLKRYETSTT

SEQ ID NO: 3170930 - protein, 23 aa, Giardia lamblia
SMSRSFKFDRIFTPSYPISAFYE

SEQ ID NO: 3170931 - protein, 21 aa, Giardia lamblia
SMSTIVEAYESKAFVDNLART

SEQ ID NO: 3170932 - protein, 25 aa, Giardia lamblia
SMTKRERLMMIKKAAGPRGFVSADL

SEQ ID NO: 3170933 - protein, 17 aa, Giardia lamblia
SMVDLKPASLEDVQEVV

SEQ ID NO: 3170934 - protein, 25 aa, Giardia lamblia
SMVKDMIDYAFQMFPDKNLVVTPPY

SEQ ID NO: 3170935 - protein, 18 aa, Giardia lamblia
SMVVCPRARVPRYVAEQA

SEQ ID NO: 3170936 - protein, 24 aa, Giardia lamblia
SMYLQLYDTIPWNALKYLVASIIY

SEQ ID NO: 3170937 - protein, 21 aa, Giardia lamblia
SMYQYSLQWYVSLFVQAIADA

SEQ ID NO: 3170938 - protein, 21 aa, Giardia lamblia
SNADRGVACFYIDGTDKESHK

SEQ ID NO: 3170939 - protein, 23 aa, Giardia lamblia
SNAEKRRAGGFLKGKKWQQPAKF

SEQ ID NO: 3170940 - protein, 19 aa, Giardia lamblia
SNAIEVFILAWGNAICCYN

SEQ ID NO: 3170941 - protein, 19 aa, Giardia lamblia
SNALCVASSKIVEASTKLL

SEQ ID NO: 3170942 - protein, 19 aa, Giardia lamblia
SNASISVPTWVPANLTQEF

SEQ ID NO: 3170943 - protein, 19 aa, Giardia lamblia
SNDCIVSIVPYDVWVTSYD

SEQ ID NO: 3170944 - protein, 25 aa, Giardia lamblia
SNDKRISLLVLHFLLLENTAAAKDS

SEQ ID NO: 3170945 - protein, 24 aa, Giardia lamblia
SNDPPCLLGSVLHTSVPQDNHSLY

SEQ ID NO: 3170946 - protein, 23 aa, Giardia lamblia
SNDQRTALMFAILKKNAHAVQVL

SEQ ID NO: 3170947 - protein, 17 aa, Giardia lamblia
SNEDIRRDAEICAQLSM

SEQ ID NO: 3170948 - protein, 17 aa, Giardia lamblia
SNEKARSLGDCKKTAKH

SEQ ID NO: 3170949 - protein, 18 aa, Giardia lamblia
SNERRAKVFAQIRSVLNI

SEQ ID NO: 3170950 - protein, 28 aa, Giardia lamblia
SNFAQKVLALVCLEEFSLDLFELRDAAR

SEQ ID NO: 3170951 - protein, 24 aa, Giardia lamblia
SNFLEMLMRASAYNHIRVWFLNTS

SEQ ID NO: 3170952 - protein, 20 aa, Giardia lamblia
SNFPKGSVLIFRKNSAREYS

SEQ ID NO: 3170953 - protein, 17 aa, Giardia lamblia
SNFTQILSFNYNFSCMD

SEQ ID NO: 3170954 - protein, 22 aa, Giardia lamblia
SNFWDLRRQGIIRGNPKSVREE

SEQ ID NO: 3170955 - protein, 22 aa, Giardia lamblia
SNGANRRKLAWDHSAKKYESRM

SEQ ID NO: 3170956 - protein, 24 aa, Giardia lamblia
SNGDSALLRCLRLGELKLAELLTD

SEQ ID NO: 3170957 - protein, 25 aa, Giardia lamblia
SNGGCASCYALASGNLELFSMLKEK

SEQ ID NO: 3170958 - protein, 18 aa, Giardia lamblia
SNGSRFFVWTAETSPQNL

SEQ ID NO: 3170959 - protein, 17 aa, Giardia lamblia
SNGTWKILYTCTTILSG

SEQ ID NO: 3170960 - protein, 20 aa, Giardia lamblia
SNHIWKCISHTTYAIVNSFA

SEQ ID NO: 3170961 - protein, 30 aa, Giardia lamblia
SNIAELWDKVMGYPKSFLCPTKLRESAQTP

SEQ ID NO: 3170962 - protein, 18 aa, Giardia lamblia
SNIARPDTHFENLDSVSG

SEQ ID NO: 3170963 - protein, 25 aa, Giardia lamblia
SNIFKLDLVEGLRFLDYCPQLRALP

SEQ ID NO: 3170964 - protein, 18 aa, Giardia lamblia
SNIGHWRKVVDRLVDASE

SEQ ID NO: 3170965 - protein, 34 aa, Giardia lamblia
SNIKEIINRLLHWIEMVYPLLMLDGRALLSSVCG

SEQ ID NO: 3170966 - protein, 25 aa, Giardia lamblia
SNINLPDMCMVPFDVVEEDELPVAE

SEQ ID NO: 3170967 - protein, 26 aa, Giardia lamblia
SNIRPSLTHYFLRFLADEGILKLILT

SEQ ID NO: 3170968 - protein, 18 aa, Giardia lamblia
SNKPEVVRLLMPLEGGLQ

SEQ ID NO: 3170969 - protein, 19 aa, Giardia lamblia
SNLASLAEFSSSIFSDEET

SEQ ID NO: 3170970 - protein, 19 aa, Giardia lamblia
SNLNPLVAMQLLEQKSEWW

SEQ ID NO: 3170971 - protein, 24 aa, Giardia lamblia
SNLQRELFNTIQLQTRPITIHGCT

SEQ ID NO: 3170972 - protein, 21 aa, Giardia lamblia
SNLRTIPMVCHFFTHQNKNTL

SEQ ID NO: 3170973 - protein, 22 aa, Giardia lamblia
SNLSSLFACFSRQSLVKQSAES

SEQ ID NO: 3170974 - protein, 21 aa, Giardia lamblia
SNLVKLLNCFLSGSVNPNITG

SEQ ID NO: 3170975 - protein, 18 aa, Giardia lamblia
SNNCFIPIVGVTGSGKTT

SEQ ID NO: 3170976 - protein, 18 aa, Giardia lamblia
SNNHAVPVYSEFTELEPQ

SEQ ID NO: 3170977 - protein, 25 aa, Giardia lamblia
SNNIALKGVCHFYGDDKPHLAISRI

SEQ ID NO: 3170978 - protein, 17 aa, Giardia lamblia
SNNICTIVLHRPVEFVV

SEQ ID NO: 3170979 - protein, 17 aa, Giardia lamblia
SNNIWQCRSIDLSTYRT

SEQ ID NO: 3170980 - protein, 26 aa, Giardia lamblia
SNPCLALSSVVSWELLPKMLDDLMDL

SEQ ID NO: 3170981 - protein, 22 aa, Giardia lamblia
SNPQLAELINRIEVTTVELNSL

SEQ ID NO: 3170982 - protein, 23 aa, Giardia lamblia
SNPRTRALHTFRIASEDIGGGDA

SEQ ID NO: 3170983 - protein, 20 aa, Giardia lamblia
SNPTIEILEIYAISLDPPQD

SEQ ID NO: 3170984 - protein, 17 aa, Giardia lamblia
SNQAMDCVYTICQEVPL

SEQ ID NO: 3170985 - protein, 24 aa, Giardia lamblia
SNQEVKSLLELTVANGLLPAHEET

SEQ ID NO: 3170986 - protein, 23 aa, Giardia lamblia
SNRELPWQLIIVRYTKVQASRLR

SEQ ID NO: 3170987 - protein, 25 aa, Giardia lamblia
SNRKACRRFYKEAIIDRDVGRVYRG

SEQ ID NO: 3170988 - protein, 23 aa, Giardia lamblia
SNRLVGICCLFIAAKYEQSYIPS

SEQ ID NO: 3170989 - protein, 18 aa, Giardia lamblia
SNSGYAHHGSFPVMTPNF

SEQ ID NO: 3170990 - protein, 27 aa, Giardia lamblia
SNSPLYPAWNCCTSADISKWLRRPLFV

SEQ ID NO: 3170991 - protein, 23 aa, Giardia lamblia
SNSRTGRTSLMYAASQGREDVVP

SEQ ID NO: 3170992 - protein, 27 aa, Giardia lamblia
SNSVDTCFKTLITITGFDSSLTSLACH

SEQ ID NO: 3170993 - protein, 19 aa, Giardia lamblia
SNSYYKGQRLYFIVLEPTA

SEQ ID NO: 3170994 - protein, 18 aa, Giardia lamblia
SNTCCSHPLASIPSDAEG

SEQ ID NO: 3170995 - protein, 28 aa, Giardia lamblia
SNTIKLVIRRCLERIPYARISSADLLLV

SEQ ID NO: 3170996 - protein, 22 aa, Giardia lamblia
SNTRKYSGYKHALAQQYYTKGK

SEQ ID NO: 3170997 - protein, 25 aa, Giardia lamblia
SNVLDAICFVLGISSLSRIRVTSLT

SEQ ID NO: 3170998 - protein, 23 aa, Giardia lamblia
SNVPFSFSVHPSWEERAGSEDHG

SEQ ID NO: 3170999 - protein, 22 aa, Giardia lamblia
SNVPLERRLLCKSIIHEFINQR

SEQ ID NO: 3171000 - protein, 19 aa, Giardia lamblia
SNVRLVVHYNIPRSMEGFY

SEQ ID NO: 3171001 - protein, 25 aa, Giardia lamblia
SNVVKQCRDTFELLSRADQVDSIYA

SEQ ID NO: 3171002 - protein, 17 aa, Giardia lamblia
SNYAYYFSPSSEMRPRI

SEQ ID NO: 3171003 - protein, 26 aa, Giardia lamblia
SPAELRKYHLLLRVFVSLCKIAVDRC

SEQ ID NO: 3171004 - protein, 20 aa, Giardia lamblia
SPAHLRLLYNTPMTIERENI

SEQ ID NO: 3171005 - protein, 26 aa, Giardia lamblia
SPALPSETYLGVALRSAIDYIASSFQ

SEQ ID NO: 3171006 - protein, 18 aa, Giardia lamblia
SPANELGILFAGMSNGCL

SEQ ID NO: 3171007 - protein, 23 aa, Giardia lamblia
SPAPSPRHTSSWANTPLASIELD

SEQ ID NO: 3171008 - protein, 23 aa, Giardia lamblia
SPARTRIGKSFEFIFTEQEIENF

SEQ ID NO: 3171009 - protein, 20 aa, Giardia lamblia
SPASNLLKGLPWEVTYRLSL

SEQ ID NO: 3171010 - protein, 20 aa, Giardia lamblia
SPATESHGRCTLQDEGDQMN

SEQ ID NO: 3171011 - protein, 31 aa, Giardia lamblia
SPATGGFIDRCFELYAAAYIPAMNVAWTAPA

SEQ ID NO: 3171012 - protein, 25 aa, Giardia lamblia
SPATVSRCGMVWVDTKNLGYEPRFK

SEQ ID NO: 3171013 - protein, 17 aa, Giardia lamblia
SPCFTILSVLLSIQSLL

SEQ ID NO: 3171014 - protein, 24 aa, Giardia lamblia
SPDDLKIALHLARKRQSREIISVL

SEQ ID NO: 3171015 - protein, 19 aa, Giardia lamblia
SPDELRSGKNFTKIMKACN

SEQ ID NO: 3171016 - protein, 25 aa, Giardia lamblia
SPDEVELYKKYGLLAKLREQHKEAE

SEQ ID NO: 3171017 - protein, 35 aa, Giardia lamblia
SPDFSALLERCLRQIMTAFIRYMRVYNLWFNMLAA

SEQ ID NO: 3171018 - protein, 23 aa, Giardia lamblia
SPDFSPPIVQSFNIIRLPPRPVK

SEQ ID NO: 3171019 - protein, 21 aa, Giardia lamblia
SPDGMRFLALTPFGALEYTRE

SEQ ID NO: 3171020 - protein, 42 aa, Giardia lamblia
SPDIIRRCIETFGRIAVKLCLFAERILNVFKSILSALLGESM

SEQ ID NO: 3171021 - protein, 20 aa, Giardia lamblia
SPDLKRGVFAALDTAGVLAK

SEQ ID NO: 3171022 - protein, 21 aa, Giardia lamblia
SPDLRRIIDMMLIKEPEKRPS

SEQ ID NO: 3171023 - protein, 25 aa, Giardia lamblia
SPDRRLKAVVFDPPLPLNGLNTPPR

SEQ ID NO: 3171024 - protein, 18 aa, Giardia lamblia
SPEECVESYIAISQGATD

SEQ ID NO: 3171025 - protein, 25 aa, Giardia lamblia
SPEELNWLLCQAFDNRAVGSTDMNA

SEQ ID NO: 3171026 - protein, 22 aa, Giardia lamblia
SPEERHARLLKVALHETPAPIE

SEQ ID NO: 3171027 - protein, 22 aa, Giardia lamblia
SPEFKRKVPIYNLFHMLNHALM

SEQ ID NO: 3171028 - protein, 25 aa, Giardia lamblia
SPEHVRFKFLRQWIGDHKGDTVADI

SEQ ID NO: 3171029 - protein, 23 aa, Giardia lamblia
SPEKEPCFKRLIDSNEWSEGIIR

SEQ ID NO: 3171030 - protein, 20 aa, Giardia lamblia
SPEKRAALQVLYQKHGSHQS

SEQ ID NO: 3171031 - protein, 20 aa, Giardia lamblia
SPEKRQYLNVALNRQLTLLR

SEQ ID NO: 3171032 - protein, 21 aa, Giardia lamblia
SPERKLSLKITDRGSPSCPGP

SEQ ID NO: 3171033 - protein, 18 aa, Giardia lamblia
SPERYRYSPQDEYLERES

SEQ ID NO: 3171034 - protein, 28 aa, Giardia lamblia
SPESIRLGLRPDGWFNIQLQIEPPPHKT

SEQ ID NO: 3171035 - protein, 19 aa, Giardia lamblia
SPESQWIALRCLRLVASAF

SEQ ID NO: 3171036 - protein, 25 aa, Giardia lamblia
SPEVCAAPRALVCCRQPPCLEIAPA

SEQ ID NO: 3171037 - protein, 19 aa, Giardia lamblia
SPFAHLKWSTSNSQQEQRR

SEQ ID NO: 3171038 - protein, 21 aa, Giardia lamblia
SPGAPAAVTFVHRAGELSHLM

SEQ ID NO: 3171039 - protein, 25 aa, Giardia lamblia
SPGEILELYAYMWSYFSKGLTPNIN

SEQ ID NO: 3171040 - protein, 19 aa, Giardia lamblia
SPGKSEPAHPIIIPAQPKQ

SEQ ID NO: 3171041 - protein, 20 aa, Giardia lamblia
SPHHLRSMYPPPYVEDDGEY

SEQ ID NO: 3171042 - protein, 19 aa, Giardia lamblia
SPHLIKLSISNSVFISRHF

SEQ ID NO: 3171043 - protein, 24 aa, Giardia lamblia
SPHLLDLLFRITHFYSHPSYFARI

SEQ ID NO: 3171044 - protein, 20 aa, Giardia lamblia
SPIDHPRIHAAYCKAQALPQ

SEQ ID NO: 3171045 - protein, 31 aa, Giardia lamblia
SPIEGVPTYLKRLLKSLAELVGALRLLNGCC

SEQ ID NO: 3171046 - protein, 18 aa, Giardia lamblia
SPIPADRTHFKAAKEITG

SEQ ID NO: 3171047 - protein, 19 aa, Giardia lamblia
SPIPEYAQDAAFQSSIQRL

SEQ ID NO: 3171048 - protein, 24 aa, Giardia lamblia
SPIRRYPDDIAHRLLHLGLALERQ

SEQ ID NO: 3171049 - protein, 30 aa, Giardia lamblia
SPISHYCYYEYLPMCLFLAIQTSDALRVYK

SEQ ID NO: 3171050 - protein, 19 aa, Giardia lamblia
SPKAKRPLSNNGLGPKGAI

SEQ ID NO: 3171051 - protein, 20 aa, Giardia lamblia
SPKFQELRYGVPIDSDLTAQ

SEQ ID NO: 3171052 - protein, 26 aa, Giardia lamblia
SPKHDLPFKNRLHIFPFSLREDQSRP

SEQ ID NO: 3171053 - protein, 20 aa, Giardia lamblia
SPKLWRPLSSGLRSLAGPGV

SEQ ID NO: 3171054 - protein, 20 aa, Giardia lamblia
SPKPHISGSMATSVSLPSTN

SEQ ID NO: 3171055 - protein, 37 aa, Giardia lamblia
SPKTGRSIHCAYIGTLDCGRLYMLFADEQHRVYTHYF

SEQ ID NO: 3171056 - protein, 29 aa, Giardia lamblia
SPLCPTALESLDFLAEYDITLNRFALADE

SEQ ID NO: 3171057 - protein, 24 aa, Giardia lamblia
SPLLRELLRYILVLDPEARLSAKE

SEQ ID NO: 3171058 - protein, 22 aa, Giardia lamblia
SPLPIFLLTCTLFTQRLLLRRL

SEQ ID NO: 3171059 - protein, 18 aa, Giardia lamblia
SPLRAQEIWAKFETASKE

SEQ ID NO: 3171060 - protein, 26 aa, Giardia lamblia
SPLRLRVLATRAGARCVFKMSSAVTH

SEQ ID NO: 3171061 - protein, 17 aa, Giardia lamblia
SPLRQAPTLSFDPLTNI

SEQ ID NO: 3171062 - protein, 18 aa, Giardia lamblia
SPLSLAKRHLRYEMLNYI

SEQ ID NO: 3171063 - protein, 25 aa, Giardia lamblia
SPLSRAALYNAFYICYLQAAHQIAN

SEQ ID NO: 3171064 - protein, 26 aa, Giardia lamblia
SPLVAAICYRTFPDVRIAEIAFCAVS

SEQ ID NO: 3171065 - protein, 17 aa, Giardia lamblia
SPNIPKTDDMYCRPANV

SEQ ID NO: 3171066 - protein, 18 aa, Giardia lamblia
SPNMLSNIHVYYQGDFLT

SEQ ID NO: 3171067 - protein, 24 aa, Giardia lamblia
SPPCLSNDLLPCGQEPLPIPDDGL

SEQ ID NO: 3171068 - protein, 23 aa, Giardia lamblia
SPPHIRFDMTFISVLVHYLSIGY

SEQ ID NO: 3171069 - protein, 28 aa, Giardia lamblia
SPPQSPYLCAIECERYCDILVERLHQQT

SEQ ID NO: 3171070 - protein, 21 aa, Giardia lamblia
SPPRHCASCEQIYGQYLAKAV

SEQ ID NO: 3171071 - protein, 19 aa, Giardia lamblia
SPPRRPWPASIPAERSCPS

SEQ ID NO: 3171072 - protein, 23 aa, Giardia lamblia
SPPTLGELLLWISTLPPQNRKFC

SEQ ID NO: 3171073 - protein, 25 aa, Giardia lamblia
SPQECRERWAHVLQYKRTVSVVTDN

SEQ ID NO: 3171074 - protein, 18 aa, Giardia lamblia
SPQMGSLDIHVCAVFLTE

SEQ ID NO: 3171075 - protein, 19 aa, Giardia lamblia
SPRDPLSQIMMVKLADFGT

SEQ ID NO: 3171076 - protein, 21 aa, Giardia lamblia
SPRGFYTVYALLFKTLADEEL

SEQ ID NO: 3171077 - protein, 21 aa, Giardia lamblia
SPRPLEIVEYGVIKTLIDNNV

SEQ ID NO: 3171078 - protein, 17 aa, Giardia lamblia
SPRSVVFPFGIYSIDKQ

SEQ ID NO: 3171079 - protein, 22 aa, Giardia lamblia
SPSCSSSRYGPPVSNSTTQMIA

SEQ ID NO: 3171080 - protein, 18 aa, Giardia lamblia
SPSDGLCRSKSRGTEYSS

SEQ ID NO: 3171081 - protein, 21 aa, Giardia lamblia
SPSLLKDSALINAVRNNDEAQ

SEQ ID NO: 3171082 - protein, 26 aa, Giardia lamblia
SPSLPIPRAISITVDRPINIPTDSRP

SEQ ID NO: 3171083 - protein, 27 aa, Giardia lamblia
SPSLPQSRFQDHIKVSGLPVPMVSETS

SEQ ID NO: 3171084 - protein, 23 aa, Giardia lamblia
SPSPSCLNRDFIHNNRVLSYTSQ

SEQ ID NO: 3171085 - protein, 19 aa, Giardia lamblia
SPSRLKIAQSYEATYKTPI

SEQ ID NO: 3171086 - protein, 17 aa, Giardia lamblia
SPSRSSPRPALSGSTVS

SEQ ID NO: 3171087 - protein, 20 aa, Giardia lamblia
SPTAAHALEEAIICRGISFK

SEQ ID NO: 3171088 - protein, 17 aa, Giardia lamblia
SPTELIPFKPNELLHDV

SEQ ID NO: 3171089 - protein, 24 aa, Giardia lamblia
SPTHPLIIWFWDIVLNVMTQDQRK

SEQ ID NO: 3171090 - protein, 29 aa, Giardia lamblia
SPTHYRTVLEFMVKLIFYPPLKHGQARDR

SEQ ID NO: 3171091 - protein, 20 aa, Giardia lamblia
SPTKRQFLLIDFPGQVECYM

SEQ ID NO: 3171092 - protein, 23 aa, Giardia lamblia
SPTLPSPRHSRAPSGIPHIERPS

SEQ ID NO: 3171093 - protein, 19 aa, Giardia lamblia
SPTLRKVVLDISSLIAKDQ

SEQ ID NO: 3171094 - protein, 29 aa, Giardia lamblia
SPTPQGLLWRILKHLTFASNKNDTEWPKL

SEQ ID NO: 3171095 - protein, 23 aa, Giardia lamblia
SPTREDWPAGYALAERIGYKFPR

SEQ ID NO: 3171096 - protein, 25 aa, Giardia lamblia
SPVAMPPVLDFRSFDTGFPDFSSRS

SEQ ID NO: 3171097 - protein, 20 aa, Giardia lamblia
SPVDCVRLGLQLHPDVELVV

SEQ ID NO: 3171098 - protein, 26 aa, Giardia lamblia
SPVDVWCFGVTILYIMIGAARTEPLY

SEQ ID NO: 3171099 - protein, 23 aa, Giardia lamblia
SPVKSSQALSNWGYGKALSNLMQ

SEQ ID NO: 3171100 - protein, 21 aa, Giardia lamblia
SPVLCKSALCIDDHWLKERCI

SEQ ID NO: 3171101 - protein, 21 aa, Giardia lamblia
SPVRDAMSFSHRIAPISHHPA

SEQ ID NO: 3171102 - protein, 18 aa, Giardia lamblia
SPVSLCYLGGTVYIADQT

SEQ ID NO: 3171103 - protein, 18 aa, Giardia lamblia
SPVSVGFDFGDTIPELTF

SEQ ID NO: 3171104 - protein, 28 aa, Giardia lamblia
SPYKELRSIAELRPLTGRSVNSLNPSDA

SEQ ID NO: 3171105 - protein, 28 aa, Giardia lamblia
SPYRSVVKNILFQLGLAMGYSYSKDLYE

SEQ ID NO: 3171106 - protein, 20 aa, Giardia lamblia
SPYSRWMRDSFLRFLHASHG

SEQ ID NO: 3171107 - protein, 21 aa, Giardia lamblia
SPYVLEGYALHYLYIKELSMF

SEQ ID NO: 3171108 - protein, 22 aa, Giardia lamblia
SQAEALSMLNFLSRCSSYFANP

SEQ ID NO: 3171109 - protein, 31 aa, Giardia lamblia
SQAEVDFGTRLFKFLATNGEYVTADQMGAFL

SEQ ID NO: 3171110 - protein, 17 aa, Giardia lamblia
SQAILLELTVKPLEFYN

SEQ ID NO: 3171111 - protein, 22 aa, Giardia lamblia
SQALALLRYGVIHVPKDIDHSM

SEQ ID NO: 3171112 - protein, 20 aa, Giardia lamblia
SQCCSCDFIDLNAACPQDIA

SEQ ID NO: 3171113 - protein, 18 aa, Giardia lamblia
SQDISLEFIRAMTADTST

SEQ ID NO: 3171114 - protein, 19 aa, Giardia lamblia
SQDVLLRLLCDSARAEYKI

SEQ ID NO: 3171115 - protein, 23 aa, Giardia lamblia
SQDYLRNRFVDAFVAIERNWIGC

SEQ ID NO: 3171116 - protein, 25 aa, Giardia lamblia
SQEAFALCGTFGLLITDLLCGLLDE

SEQ ID NO: 3171117 - protein, 19 aa, Giardia lamblia
SQEFIIPFVSSLCISALSD

SEQ ID NO: 3171118 - protein, 17 aa, Giardia lamblia
SQEKYIKDCEAAILKQH

SEQ ID NO: 3171119 - protein, 19 aa, Giardia lamblia
SQELCLFIDMMLTVDFSKR

SEQ ID NO: 3171120 - protein, 22 aa, Giardia lamblia
SQELERVSALLDQREHDLEVAA

SEQ ID NO: 3171121 - protein, 18 aa, Giardia lamblia
SQELTRFDGKGGPVRERG

SEQ ID NO: 3171122 - protein, 17 aa, Giardia lamblia
SQENYSFDFYKILDETK

SEQ ID NO: 3171123 - protein, 27 aa, Giardia lamblia
SQFRTKIAQSWIKFIDELNIPRSTGEH

SEQ ID NO: 3171124 - protein, 24 aa, Giardia lamblia
SQFTVGFRPSQRLTELQDMLEEQL

SEQ ID NO: 3171125 - protein, 26 aa, Giardia lamblia
SQGATLTRGRLENVLLGRTASALSQS

SEQ ID NO: 3171126 - protein, 17 aa, Giardia lamblia
SQGDMRAAITLLQATVQ

SEQ ID NO: 3171127 - protein, 18 aa, Giardia lamblia
SQGGMSFAGTPIEPSYYH

SEQ ID NO: 3171128 - protein, 20 aa, Giardia lamblia
SQGLPIKFQSVSGLTGPPSH

SEQ ID NO: 3171129 - protein, 18 aa, Giardia lamblia
SQGRYRVFGEALDIAVGN

SEQ ID NO: 3171130 - protein, 17 aa, Giardia lamblia
SQGWPEWFAEHRINDVL

SEQ ID NO: 3171131 - protein, 20 aa, Giardia lamblia
SQGYLLAGIYELLRPQGSAM

SEQ ID NO: 3171132 - protein, 17 aa, Giardia lamblia
SQHFGVQLLEGVASYCL

SEQ ID NO: 3171133 - protein, 25 aa, Giardia lamblia
SQHGRPRLTQIKALGIQRQLIVHVY

SEQ ID NO: 3171134 - protein, 17 aa, Giardia lamblia
SQILTLPTSILKLKLEE

SEQ ID NO: 3171135 - protein, 20 aa, Giardia lamblia
SQIRKLQSAAEWFDAVDSNS

SEQ ID NO: 3171136 - protein, 25 aa, Giardia lamblia
SQISHKRIAESLCTENSALRLELEQ

SEQ ID NO: 3171137 - protein, 20 aa, Giardia lamblia
SQIVKRCNSGLVVLPCGAGK

SEQ ID NO: 3171138 - protein, 32 aa, Giardia lamblia
SQKERLPCLLTIAGIPEALAFDDIKENLDKDE

SEQ ID NO: 3171139 - protein, 24 aa, Giardia lamblia
SQKMLKTIVSFIAFNILPFIQGQS

SEQ ID NO: 3171140 - protein, 19 aa, Giardia lamblia
SQKSIWTPCAIQLGKSQLA

SEQ ID NO: 3171141 - protein, 24 aa, Giardia lamblia
SQLDEKYARRMQLLDTRKRLNKTL

SEQ ID NO: 3171142 - protein, 23 aa, Giardia lamblia
SQLEHKAPLVSDADKVIASYEST

SEQ ID NO: 3171143 - protein, 17 aa, Giardia lamblia
SQLLAFAKSCGRADKLD

SEQ ID NO: 3171144 - protein, 23 aa, Giardia lamblia
SQLPFQTRIPLALTQDSTPHLRV

SEQ ID NO: 3171145 - protein, 24 aa, Giardia lamblia
SQLPRFRMLVVSTICSDSGEVLDI

SEQ ID NO: 3171146 - protein, 18 aa, Giardia lamblia
SQLQDLLSRIALELPTQP

SEQ ID NO: 3171147 - protein, 19 aa, Giardia lamblia
SQLQRCLTTPLSPEKLDAF

SEQ ID NO: 3171148 - protein, 21 aa, Giardia lamblia
SQLRKKMRLLTEENEQLLHQK

SEQ ID NO: 3171149 - protein, 30 aa, Giardia lamblia
SQLRVGFLNCIKYICGLAYTSVTKIGGKAI

SEQ ID NO: 3171150 - protein, 18 aa, Giardia lamblia
SQLTLCIPEVTSVTHVTV

SEQ ID NO: 3171151 - protein, 20 aa, Giardia lamblia
SQLVLREAEIERLLSSQTST

SEQ ID NO: 3171152 - protein, 20 aa, Giardia lamblia
SQLYPIHAFLSTWNEELYAA

SEQ ID NO: 3171153 - protein, 35 aa, Giardia lamblia
SQLYRSSHYTHLVFRWCLINEDFAHYVGSIRRQRR

SEQ ID NO: 3171154 - protein, 18 aa, Giardia lamblia
SQMLFYPRLMGSSVSGIG

SEQ ID NO: 3171155 - protein, 18 aa, Giardia lamblia
SQNELQWYDQAVLRSVCQ

SEQ ID NO: 3171156 - protein, 22 aa, Giardia lamblia
SQNHPYNSFNILWNSETGCRSA

SEQ ID NO: 3171157 - protein, 23 aa, Giardia lamblia
SQPAKAYMLTRLILGHVPNLSLS

SEQ ID NO: 3171158 - protein, 23 aa, Giardia lamblia
SQPDSLVCKGLFAISESILDLAD

SEQ ID NO: 3171159 - protein, 23 aa, Giardia lamblia
SQPEACGALANFVISGTTLSRTY

SEQ ID NO: 3171160 - protein, 24 aa, Giardia lamblia
SQPESRVPYYISQLLNLFQHRIVD

SEQ ID NO: 3171161 - protein, 24 aa, Giardia lamblia
SQPILSRFDLAFVLLDEPNKEVDN

SEQ ID NO: 3171162 - protein, 25 aa, Giardia lamblia
SQPNIKADALLLIDKCLAQCNDEVF

SEQ ID NO: 3171163 - protein, 30 aa, Giardia lamblia
SQQEPACILWYICQYFLMDAQHVSHDDSGF

SEQ ID NO: 3171164 - protein, 17 aa, Giardia lamblia
SQQRFRWTGEFNETILC

SEQ ID NO: 3171165 - protein, 25 aa, Giardia lamblia
SQRFKESFPSFSFCLETTDLLDLVD

SEQ ID NO: 3171166 - protein, 23 aa, Giardia lamblia
SQRLRGSVVLGSYFETDQTRLYI

SEQ ID NO: 3171167 - protein, 26 aa, Giardia lamblia
SQRQFSCKKFPLAKLTSHQIELIRYE

SEQ ID NO: 3171168 - protein, 22 aa, Giardia lamblia
SQRWRKELHAIVSAEPQLQRYR

SEQ ID NO: 3171169 - protein, 23 aa, Giardia lamblia
SQSDEPYTWFVFVGCADNSIHAW

SEQ ID NO: 3171170 - protein, 23 aa, Giardia lamblia
SQSHPFFRYHPFTPASYIPLFQS

SEQ ID NO: 3171171 - protein, 24 aa, Giardia lamblia
SQSKELIVILARVHPCETSGSYVL

SEQ ID NO: 3171172 - protein, 18 aa, Giardia lamblia
SQSPFSVAIQNDAHDCLE

SEQ ID NO: 3171173 - protein, 25 aa, Giardia lamblia
SQSQRYELRCAMIEHYLDNILDLLH

SEQ ID NO: 3171174 - protein, 18 aa, Giardia lamblia
SQSVFGAGVSPFGTQPST

SEQ ID NO: 3171175 - protein, 22 aa, Giardia lamblia
SQTGVGQYCMRAFADAFEIIPL

SEQ ID NO: 3171176 - protein, 17 aa, Giardia lamblia
SQTLPFGPTEFVLRDIN

SEQ ID NO: 3171177 - protein, 18 aa, Giardia lamblia
SQTPLLIMHPAIKAFIEL

SEQ ID NO: 3171178 - protein, 20 aa, Giardia lamblia
SQVARIFSREKITVDGLLRE

SEQ ID NO: 3171179 - protein, 24 aa, Giardia lamblia
SQVCPPRTEIQVMMNNPGDPAAVD

SEQ ID NO: 3171180 - protein, 19 aa, Giardia lamblia
SQVDISYDDPQNFFGATCH

SEQ ID NO: 3171181 - protein, 20 aa, Giardia lamblia
SQVFCCGSSGMLWLQCGRAN

SEQ ID NO: 3171182 - protein, 27 aa, Giardia lamblia
SQVGFRQGYLVRMWRTFNINEVTRTER

SEQ ID NO: 3171183 - protein, 25 aa, Giardia lamblia
SQVLDRIGVLLAEIDCLASFSYVSA

SEQ ID NO: 3171184 - protein, 18 aa, Giardia lamblia
SQVSYRYGINSFKLHRVP

SEQ ID NO: 3171185 - protein, 28 aa, Giardia lamblia
SQVWEVKCANLSLSMKHTLCFNPETGQG

SEQ ID NO: 3171186 - protein, 26 aa, Giardia lamblia
SQYDFASIYCYFKLKELEMNNLVWMY

SEQ ID NO: 3171187 - protein, 17 aa, Giardia lamblia
SQYKRDVLRKFCEACYK

SEQ ID NO: 3171188 - protein, 25 aa, Giardia lamblia
SQYLCSFCDAPFCKSCSELLAEAKV

SEQ ID NO: 3171189 - protein, 25 aa, Giardia lamblia
SQYPCFYCTSWMYPKRKRPLCSVPG

SEQ ID NO: 3171190 - protein, 32 aa, Giardia lamblia
SRADALAAQLLMKRSFKIWRYSSDSSTAILLT

SEQ ID NO: 3171191 - protein, 21 aa, Giardia lamblia
SRADALLYQGEFEFSLIDYYH

SEQ ID NO: 3171192 - protein, 20 aa, Giardia lamblia
SRAIEAWRAVCKTYEADSRA

SEQ ID NO: 3171193 - protein, 19 aa, Giardia lamblia
SRAKDAFIRLVKKEHNLLI

SEQ ID NO: 3171194 - protein, 17 aa, Giardia lamblia
SRALRRRDVPAFNVRIP

SEQ ID NO: 3171195 - protein, 17 aa, Giardia lamblia
SRALYARLCHSFLLPTL

SEQ ID NO: 3171196 - protein, 19 aa, Giardia lamblia
SRARLLQEYHFKRKEFSKD

SEQ ID NO: 3171197 - protein, 22 aa, Giardia lamblia
SRASEVPKSLVLQESNYTESYT

SEQ ID NO: 3171198 - protein, 19 aa, Giardia lamblia
SRCAKILIEKEAGRQDEDG

SEQ ID NO: 3171199 - protein, 22 aa, Giardia lamblia
SRCEIKLESAGIKRVFGPEQYC

SEQ ID NO: 3171200 - protein, 22 aa, Giardia lamblia
SRCFIMAIAPSVRYIILAEHIY

SEQ ID NO: 3171201 - protein, 19 aa, Giardia lamblia
SRCKGRTFITNFQKITRSE

SEQ ID NO: 3171202 - protein, 29 aa, Giardia lamblia
SRCLQCKKPMCVRGCPVQVPIPQFIKKIT

SEQ ID NO: 3171203 - protein, 31 aa, Giardia lamblia
SRCVICYPSRLSFEISQIFHTRYSLFKMAYN

SEQ ID NO: 3171204 - protein, 24 aa, Giardia lamblia
SRDALFRLDPLYSQLQMQELTCTT

SEQ ID NO: 3171205 - protein, 21 aa, Giardia lamblia
SRDGRRLFVGGRLIMKSKAGI

SEQ ID NO: 3171206 - protein, 26 aa, Giardia lamblia
SRDRLIEIIARLTLELAGARNIKAPA

SEQ ID NO: 3171207 - protein, 21 aa, Giardia lamblia
SREAKSLMEECNFYVEKLSKH

SEQ ID NO: 3171208 - protein, 24 aa, Giardia lamblia
SREECPHCGRRFISSRLEKHVSAC

SEQ ID NO: 3171209 - protein, 25 aa, Giardia lamblia
SREGSVYKLRLSVRALELEIDNLKT

SEQ ID NO: 3171210 - protein, 23 aa, Giardia lamblia
SREIRRLCIVLSTRLASMYLPTQ

SEQ ID NO: 3171211 - protein, 21 aa, Giardia lamblia
SREKLKMAESIAKKPSSNPDI

SEQ ID NO: 3171212 - protein, 21 aa, Giardia lamblia
SRELIRADRLVFGKPRNSSGV

SEQ ID NO: 3171213 - protein, 18 aa, Giardia lamblia
SRELPILPHFDTTTSAVR

SEQ ID NO: 3171214 - protein, 27 aa, Giardia lamblia
SRENLEGAIVIPGLIYGYGETSLVPLY

SEQ ID NO: 3171215 - protein, 20 aa, Giardia lamblia
SRERSDLLSSVIQRTLGAQV

SEQ ID NO: 3171216 - protein, 26 aa, Giardia lamblia
SREVPREPLELVLLSGGADVFTYSSP

SEQ ID NO: 3171217 - protein, 28 aa, Giardia lamblia
SREYRGRSELPFSLTKLLRGCFMGRADT

SEQ ID NO: 3171218 - protein, 24 aa, Giardia lamblia
SRFAELKERGSIKMLQLENNDIAI

SEQ ID NO: 3171219 - protein, 29 aa, Giardia lamblia
SRFEAARLLYKLEFGMRGNRGETALMAAA

SEQ ID NO: 3171220 - protein, 19 aa, Giardia lamblia
SRFLRLLRYDFAELPIEIA

SEQ ID NO: 3171221 - protein, 18 aa, Giardia lamblia
SRFSHKFEITRPATRDQA

SEQ ID NO: 3171222 - protein, 28 aa, Giardia lamblia
SRFSPYSTLYPSRLALVKVVLDTLNNKA

SEQ ID NO: 3171223 - protein, 26 aa, Giardia lamblia
SRFTDPELRVCLLVGGEALEKQFTAL

SEQ ID NO: 3171224 - protein, 26 aa, Giardia lamblia
SRFYRAPEVILGLPYGQEIDIWSIGC

SEQ ID NO: 3171225 - protein, 24 aa, Giardia lamblia
SRGHKEIVELLGPKERTMQDVNGR

SEQ ID NO: 3171226 - protein, 24 aa, Giardia lamblia
SRGHWVLLMNCHLLPKWLKTLEKI

SEQ ID NO: 3171227 - protein, 18 aa, Giardia lamblia
SRGIFPIDYAIELNDEEI

SEQ ID NO: 3171228 - protein, 19 aa, Giardia lamblia
SRGLIPCFTYEESIGYSVG

SEQ ID NO: 3171229 - protein, 18 aa, Giardia lamblia
SRGLYTLLGLTSFGTPRR

SEQ ID NO: 3171230 - protein, 18 aa, Giardia lamblia
SRGNPLIFNDRMVDDSGH

SEQ ID NO: 3171231 - protein, 20 aa, Giardia lamblia
SRGQILFNLFSNLVKLSYAN

SEQ ID NO: 3171232 - protein, 19 aa, Giardia lamblia
SRGQSARHRRRPSSATRSR

SEQ ID NO: 3171233 - protein, 27 aa, Giardia lamblia
SRGRGIFCSNDILKLLVLDEHGGTDSE

SEQ ID NO: 3171234 - protein, 21 aa, Giardia lamblia
SRGRSRLGRRHMNSDLDHHQF

SEQ ID NO: 3171235 - protein, 17 aa, Giardia lamblia
SRGSLTGSYYLPPSSSV

SEQ ID NO: 3171236 - protein, 19 aa, Giardia lamblia
SRGTGPITMLTRQPTEGRR

SEQ ID NO: 3171237 - protein, 23 aa, Giardia lamblia
SRGTRPLYELSYEDQLWLENRCL

SEQ ID NO: 3171238 - protein, 19 aa, Giardia lamblia
SRHDACVDILLPHEGEFPD

SEQ ID NO: 3171239 - protein, 21 aa, Giardia lamblia
SRHEALLEMAYHLSPEILKAA

SEQ ID NO: 3171240 - protein, 22 aa, Giardia lamblia
SRHGKWVMAICAAPSASLASWG

SEQ ID NO: 3171241 - protein, 21 aa, Giardia lamblia
SRHPVSMYFIGPVVTVPLQGS

SEQ ID NO: 3171242 - protein, 23 aa, Giardia lamblia
SRHSWDLDVLYLAALEALRYIQK

SEQ ID NO: 3171243 - protein, 18 aa, Giardia lamblia
SRIGVSEMHREDRRQLAE

SEQ ID NO: 3171244 - protein, 29 aa, Giardia lamblia
SRIIIEPPLKRRGELPTTFQCSLQEQTGG

SEQ ID NO: 3171245 - protein, 33 aa, Giardia lamblia
SRIIYASTCLNNFARLHGHPMVFSSGHDGAMAT

SEQ ID NO: 3171246 - protein, 23 aa, Giardia lamblia
SRIKTGEQWLELVNDGNVPLVKA

SEQ ID NO: 3171247 - protein, 17 aa, Giardia lamblia
SRILKHMHHPHIVQCYD

SEQ ID NO: 3171248 - protein, 17 aa, Giardia lamblia
SRILRKNLDLDRITNSI

SEQ ID NO: 3171249 - protein, 19 aa, Giardia lamblia
SRIPAKIADLLGRLPNDTD

SEQ ID NO: 3171250 - protein, 22 aa, Giardia lamblia
SRIPCLRSAVMRVVEEKARPGY

SEQ ID NO: 3171251 - protein, 17 aa, Giardia lamblia
SRIPEVFDVTKKSLRFE

SEQ ID NO: 3171252 - protein, 22 aa, Giardia lamblia
SRIRPAPSPRRYVAIDEENATL

SEQ ID NO: 3171253 - protein, 22 aa, Giardia lamblia
SRISELYAFAFYLIVAFNEYEK

SEQ ID NO: 3171254 - protein, 20 aa, Giardia lamblia
SRIVSGLSVQNYIAATTTVE

SEQ ID NO: 3171255 - protein, 23 aa, Giardia lamblia
SRIYPVLATSGFRTAEIHRGTTR

SEQ ID NO: 3171256 - protein, 19 aa, Giardia lamblia
SRKALTELLTKFKVLTIQL

SEQ ID NO: 3171257 - protein, 25 aa, Giardia lamblia
SRKDGRIYACKEIEYTKMSSKEVSL

SEQ ID NO: 3171258 - protein, 21 aa, Giardia lamblia
SRKDGWTALMSAARNNHLEIV

SEQ ID NO: 3171259 - protein, 21 aa, Giardia lamblia
SRKHPDVLLLLDRKKELQAAL

SEQ ID NO: 3171260 - protein, 21 aa, Giardia lamblia
SRKLECTVILAPYERAYLTPA

SEQ ID NO: 3171261 - protein, 24 aa, Giardia lamblia
SRKSEFRKKPGITPLPGFLPTSAE

SEQ ID NO: 3171262 - protein, 21 aa, Giardia lamblia
SRKYYVWMSQLMVAHHGPIWT

SEQ ID NO: 3171263 - protein, 22 aa, Giardia lamblia
SRLDSETAFVFKITNLPGPESN

SEQ ID NO: 3171264 - protein, 20 aa, Giardia lamblia
SRLEITRTFRMAEAVQGIID

SEQ ID NO: 3171265 - protein, 17 aa, Giardia lamblia
SRLHLERKVRPATAEQI

SEQ ID NO: 3171266 - protein, 23 aa, Giardia lamblia
SRLKEMRLAQLPKIIASLQQEIN

SEQ ID NO: 3171267 - protein, 31 aa, Giardia lamblia
SRLKTCSMCQLPFSCGRVCKRRLAPGEQVAE

SEQ ID NO: 3171268 - protein, 20 aa, Giardia lamblia
SRLLCSLVRLYMLRPDRSIV

SEQ ID NO: 3171269 - protein, 26 aa, Giardia lamblia
SRLLFYRRQICLVKAAFRQWNIRLYQ

SEQ ID NO: 3171270 - protein, 17 aa, Giardia lamblia
SRLLGEDLLRMYKENAV

SEQ ID NO: 3171271 - protein, 22 aa, Giardia lamblia
SRLLYLRSLQALYINRRVEKTV

SEQ ID NO: 3171272 - protein, 23 aa, Giardia lamblia
SRLMKELASARCSSMDSGSSHMH

SEQ ID NO: 3171273 - protein, 24 aa, Giardia lamblia
SRLPFVSDGFMFKEHVRRFNNMQR

SEQ ID NO: 3171274 - protein, 20 aa, Giardia lamblia
SRLPNIPLFVYGTTINSTSD

SEQ ID NO: 3171275 - protein, 26 aa, Giardia lamblia
SRLPVYKCHPAECQLEGTMFSPVLMH

SEQ ID NO: 3171276 - protein, 22 aa, Giardia lamblia
SRLQLEIENAVLNRKLYEADKK

SEQ ID NO: 3171277 - protein, 24 aa, Giardia lamblia
SRLRRELDRVFLLLENENSTRTEQ

SEQ ID NO: 3171278 - protein, 26 aa, Giardia lamblia
SRLSLHSIKTFLKRLEILAEDKERGK

SEQ ID NO: 3171279 - protein, 21 aa, Giardia lamblia
SRLSQEYSRYEALWKEYERVS

SEQ ID NO: 3171280 - protein, 19 aa, Giardia lamblia
SRLSSEYYIADSLASELNH

SEQ ID NO: 3171281 - protein, 17 aa, Giardia lamblia
SRLTARISSLLAASPHV

SEQ ID NO: 3171282 - protein, 20 aa, Giardia lamblia
SRMAMTGAIRKVFVEHPEKF

SEQ ID NO: 3171283 - protein, 24 aa, Giardia lamblia
SRMFADGFLARFDNRALFELVLQY

SEQ ID NO: 3171284 - protein, 18 aa, Giardia lamblia
SRMFKRRDQIQHLEDENR

SEQ ID NO: 3171285 - protein, 19 aa, Giardia lamblia
SRMYSALMMAAELGNLEAS

SEQ ID NO: 3171286 - protein, 21 aa, Giardia lamblia
SRNELLFEIEGLKAEFKNRPS

SEQ ID NO: 3171287 - protein, 22 aa, Giardia lamblia
SRNHMTFITAPMVACIIANPRC

SEQ ID NO: 3171288 - protein, 19 aa, Giardia lamblia
SRNSAYHWYHETYVRHITG

SEQ ID NO: 3171289 - protein, 18 aa, Giardia lamblia
SRNSIMYVYLYIADTQLD

SEQ ID NO: 3171290 - protein, 19 aa, Giardia lamblia
SRNSSCLTGLNLQETLASQ

SEQ ID NO: 3171291 - protein, 19 aa, Giardia lamblia
SRNTCHFHWVLKSISNAFP

SEQ ID NO: 3171292 - protein, 24 aa, Giardia lamblia
SRNTECVRLLEPREHGMRLANGQT

SEQ ID NO: 3171293 - protein, 19 aa, Giardia lamblia
SRNYFQLEKDKIFTLYEVS

SEQ ID NO: 3171294 - protein, 19 aa, Giardia lamblia
SRPDTLLVGSYVQSASPTF

SEQ ID NO: 3171295 - protein, 19 aa, Giardia lamblia
SRPGSALAQQLSTQPQPFS

SEQ ID NO: 3171296 - protein, 20 aa, Giardia lamblia
SRPGSARSRQSIRSTSSRAS

SEQ ID NO: 3171297 - protein, 27 aa, Giardia lamblia
SRPHFLQSLKTIWAILYDIKMSQCIDL

SEQ ID NO: 3171298 - protein, 25 aa, Giardia lamblia
SRPIKCALCGKVEYSVSSDVDEATH

SEQ ID NO: 3171299 - protein, 17 aa, Giardia lamblia
SRPLLTIQRAFPLLSSR

SEQ ID NO: 3171300 - protein, 20 aa, Giardia lamblia
SRPRSATMAKKSRVFADDPT

SEQ ID NO: 3171301 - protein, 19 aa, Giardia lamblia
SRPSDAAVHHFLLSTTSDL

SEQ ID NO: 3171302 - protein, 20 aa, Giardia lamblia
SRPSKHVLLTSPNDSVSETN

SEQ ID NO: 3171303 - protein, 19 aa, Giardia lamblia
SRPSSARAASRPGSAQKSH

SEQ ID NO: 3171304 - protein, 18 aa, Giardia lamblia
SRQECIRLSQGETEQSLV

SEQ ID NO: 3171305 - protein, 19 aa, Giardia lamblia
SRQGLPHSLSSKDHVAKRT

SEQ ID NO: 3171306 - protein, 19 aa, Giardia lamblia
SRQGSRPGTPRVDENTLLM

SEQ ID NO: 3171307 - protein, 23 aa, Giardia lamblia
SRQIFRRVILRDLPPQMVSLFIQ

SEQ ID NO: 3171308 - protein, 29 aa, Giardia lamblia
SRQLTRAVLRLGWKFPTTVQEKVIPIVLA

SEQ ID NO: 3171309 - protein, 31 aa, Giardia lamblia
SRQSPSRMTDFSFKYADRSLARNSMLSPDTA

SEQ ID NO: 3171310 - protein, 26 aa, Giardia lamblia
SRQWQWKKYIQMIGLMIFDELHLVGT

SEQ ID NO: 3171311 - protein, 25 aa, Giardia lamblia
SRRDIYRYTVPLLIQYSYMLEIPAD

SEQ ID NO: 3171312 - protein, 27 aa, Giardia lamblia
SRREQRRRLECLIAKRRDPILEQLRQM

SEQ ID NO: 3171313 - protein, 19 aa, Giardia lamblia
SRREVFGALGQAYGEDSRA

SEQ ID NO: 3171314 - protein, 26 aa, Giardia lamblia
SRRMVKLWAEKEFRNLIRTQQLGSIC

SEQ ID NO: 3171315 - protein, 23 aa, Giardia lamblia
SRRNCFPMLRSLRNASSTNRVPF

SEQ ID NO: 3171316 - protein, 24 aa, Giardia lamblia
SRRPEVYRPIHSVFSKMRAQELSQ

SEQ ID NO: 3171317 - protein, 19 aa, Giardia lamblia
SRRTLSPTIVRPREQSAAD

SEQ ID NO: 3171318 - protein, 25 aa, Giardia lamblia
SRRTVTLPRVMYCNEGYSTTKYNVL

SEQ ID NO: 3171319 - protein, 23 aa, Giardia lamblia
SRRVKRLRGFVKIHKLQKKVRMD

SEQ ID NO: 3171320 - protein, 17 aa, Giardia lamblia
SRSARRVRFVEYGVSKE

SEQ ID NO: 3171321 - protein, 24 aa, Giardia lamblia
SRSCSLAPHRPRQIDYDFLLYAKD

SEQ ID NO: 3171322 - protein, 25 aa, Giardia lamblia
SRSDYELTVGLPLLSGYRNLEVGVS

SEQ ID NO: 3171323 - protein, 20 aa, Giardia lamblia
SRSESPVHLPLCQASSADAD

SEQ ID NO: 3171324 - protein, 19 aa, Giardia lamblia
SRSHTVFLIEITSYRETAK

SEQ ID NO: 3171325 - protein, 21 aa, Giardia lamblia
SRSLLTQFVFIDFHDGVYKIG

SEQ ID NO: 3171326 - protein, 23 aa, Giardia lamblia
SRSSKEHLIRITSVSTKSPDMDD

SEQ ID NO: 3171327 - protein, 18 aa, Giardia lamblia
SRSVYDLTMKAAKIASVS

SEQ ID NO: 3171328 - protein, 24 aa, Giardia lamblia
SRSYRAMRAMAQYYSKELPTENST

SEQ ID NO: 3171329 - protein, 27 aa, Giardia lamblia
SRSYRCPEVILGLPYDGRADVWSLGPI

SEQ ID NO: 3171330 - protein, 24 aa, Giardia lamblia
SRTGGEIDSGLTISDSVVDLAGSA

SEQ ID NO: 3171331 - protein, 20 aa, Giardia lamblia
SRTGLLLSGMGRCMQLTANG

SEQ ID NO: 3171332 - protein, 25 aa, Giardia lamblia
SRTKDPRVCNALEAIQRRYSPDGME

SEQ ID NO: 3171333 - protein, 23 aa, Giardia lamblia
SRTPRNTMCLRPKTEASEICVYE

SEQ ID NO: 3171334 - protein, 18 aa, Giardia lamblia
SRTRALCFEIHHTEDYTI

SEQ ID NO: 3171335 - protein, 19 aa, Giardia lamblia
SRTSHDIKRREIPYVKAMR

SEQ ID NO: 3171336 - protein, 19 aa, Giardia lamblia
SRTVLKLNSIASLQLTNAS

SEQ ID NO: 3171337 - protein, 19 aa, Giardia lamblia
SRVAPRLGSAGLTAGGGLL

SEQ ID NO: 3171338 - protein, 28 aa, Giardia lamblia
SRVCNVNAKPSYNLISFLAPYATTSEDK

SEQ ID NO: 3171339 - protein, 22 aa, Giardia lamblia
SRVDKKVCERLAQPKHPVKKRS

SEQ ID NO: 3171340 - protein, 17 aa, Giardia lamblia
SRVELIFTTGDKLTGTI

SEQ ID NO: 3171341 - protein, 24 aa, Giardia lamblia
SRVIKRIKEEFGLSGASAANEDAA

SEQ ID NO: 3171342 - protein, 23 aa, Giardia lamblia
SRVKRLNNGYMIPPISDAILNIF

SEQ ID NO: 3171343 - protein, 20 aa, Giardia lamblia
SRVLDIYLQDSIVIDERASL

SEQ ID NO: 3171344 - protein, 23 aa, Giardia lamblia
SRVRIGDTFFDLKHIYRTSETPG

SEQ ID NO: 3171345 - protein, 18 aa, Giardia lamblia
SRVSFSMDASTPSKRARS

SEQ ID NO: 3171346 - protein, 20 aa, Giardia lamblia
SRVSLDMLLQAHAMYRSIET

SEQ ID NO: 3171347 - protein, 18 aa, Giardia lamblia
SRVTKEFLTFLRIQQPQN

SEQ ID NO: 3171348 - protein, 19 aa, Giardia lamblia
SRVTPRPGNSLAESSYKRI

SEQ ID NO: 3171349 - protein, 20 aa, Giardia lamblia
SRVYLPHKEFFAVCEPNDDI

SEQ ID NO: 3171350 - protein, 17 aa, Giardia lamblia
SRWGSGHTALMIAAYNG

SEQ ID NO: 3171351 - protein, 25 aa, Giardia lamblia
SRYDLARTYPNVCVNGSMYEALATL

SEQ ID NO: 3171352 - protein, 18 aa, Giardia lamblia
SRYFAPMYIVYVTNSDML

SEQ ID NO: 3171353 - protein, 21 aa, Giardia lamblia
SRYFILDGFVTDHCQILLDIS

SEQ ID NO: 3171354 - protein, 23 aa, Giardia lamblia
SRYLKGEVCFSTPLNVPRSILNF

SEQ ID NO: 3171355 - protein, 24 aa, Giardia lamblia
SRYPSLPGGMLFDKILADVPCSGD

SEQ ID NO: 3171356 - protein, 27 aa, Giardia lamblia
SSAASLYPRRKHIFNYIKKLLKKYQRS

SEQ ID NO: 3171357 - protein, 17 aa, Giardia lamblia
SSAELFTQCPSITNCSV

SEQ ID NO: 3171358 - protein, 27 aa, Giardia lamblia
SSAFLCSFCDILPCYYDNYGGDGEIRI

SEQ ID NO: 3171359 - protein, 27 aa, Giardia lamblia
SSAGKLEVCKVLLPAIGARDDYMMFTA

SEQ ID NO: 3171360 - protein, 18 aa, Giardia lamblia
SSAGKLRLPSTIEKDIVV

SEQ ID NO: 3171361 - protein, 17 aa, Giardia lamblia
SSAGLRKMLMSAARSGS

SEQ ID NO: 3171362 - protein, 19 aa, Giardia lamblia
SSAIATYMECFLAGKHQQM

SEQ ID NO: 3171363 - protein, 21 aa, Giardia lamblia
SSAIFRARSPTGWLAASSTGA

SEQ ID NO: 3171364 - protein, 24 aa, Giardia lamblia
SSAIKADALVKLLTNNTVAVVDYS

SEQ ID NO: 3171365 - protein, 23 aa, Giardia lamblia
SSAKNLPLPAAPVLEEPSLATGT

SEQ ID NO: 3171366 - protein, 24 aa, Giardia lamblia
SSALVSNLCGIDIPVRIAEKRLAV

SEQ ID NO: 3171367 - protein, 22 aa, Giardia lamblia
SSAPDGFEPPDFRELTNEITSP

SEQ ID NO: 3171368 - protein, 20 aa, Giardia lamblia
SSAPVADCLRRADELLSQPV

SEQ ID NO: 3171369 - protein, 17 aa, Giardia lamblia
SSCHCVLRRPVRLVCDH

SEQ ID NO: 3171370 - protein, 22 aa, Giardia lamblia
SSCLISGAVLRRAFGGTPMHIG

SEQ ID NO: 3171371 - protein, 18 aa, Giardia lamblia
SSDACPISSFYSQIDLGS

SEQ ID NO: 3171372 - protein, 29 aa, Giardia lamblia
SSDLPKLRCYKLRSASAYVSRTEPLRPDL

SEQ ID NO: 3171373 - protein, 20 aa, Giardia lamblia
SSDLRVKRRAPIPANYQPEP

SEQ ID NO: 3171374 - protein, 19 aa, Giardia lamblia
SSDMHSWAAINEVDYTAAL

SEQ ID NO: 3171375 - protein, 19 aa, Giardia lamblia
SSDQAVYVAAAARLEAHEL

SEQ ID NO: 3171376 - protein, 18 aa, Giardia lamblia
SSDVRHIFNLKSLHLGHI

SEQ ID NO: 3171377 - protein, 22 aa, Giardia lamblia
SSEADIWIAYYPSYTILGDPHY

SEQ ID NO: 3171378 - protein, 26 aa, Giardia lamblia
SSEAILRIVEYLSLKKLPIFVKRRQI

SEQ ID NO: 3171379 - protein, 17 aa, Giardia lamblia
SSECIKREKLYEADYLA

SEQ ID NO: 3171380 - protein, 17 aa, Giardia lamblia
SSEDWGVFFTKLKMKND

SEQ ID NO: 3171381 - protein, 19 aa, Giardia lamblia
SSELVKFITLLCADSPADR

SEQ ID NO: 3171382 - protein, 21 aa, Giardia lamblia
SSELWYFPPFFTLQQKIEQAD

SEQ ID NO: 3171383 - protein, 30 aa, Giardia lamblia
SSENLYMYGYCLDIRGDLVYYGDCSVNKKA

SEQ ID NO: 3171384 - protein, 24 aa, Giardia lamblia
SSEPLRALVSLVLDRNLELATYRG

SEQ ID NO: 3171385 - protein, 21 aa, Giardia lamblia
SSERRHFFIPGNTFPFCSTSL

SEQ ID NO: 3171386 - protein, 18 aa, Giardia lamblia
SSEVLSGELDYLRKENEN

SEQ ID NO: 3171387 - protein, 21 aa, Giardia lamblia
SSFCKAYRNSLRFRSSGGERK

SEQ ID NO: 3171388 - protein, 17 aa, Giardia lamblia
SSFCMLDYTDLMHYAIK

SEQ ID NO: 3171389 - protein, 25 aa, Giardia lamblia
SSFCREGIDAFQILSFAATNQKKKL

SEQ ID NO: 3171390 - protein, 17 aa, Giardia lamblia
SSFFFGQCLGVFPPFAI

SEQ ID NO: 3171391 - protein, 18 aa, Giardia lamblia
SSFGLYIINVTGMVVYQS

SEQ ID NO: 3171392 - protein, 18 aa, Giardia lamblia
SSFHCSHPHHSRTWPSMH

SEQ ID NO: 3171393 - protein, 25 aa, Giardia lamblia
SSFKCADWPGEWVIFQGNLSIISKG

SEQ ID NO: 3171394 - protein, 19 aa, Giardia lamblia
SSFKGRTPHKLQRLDMDVS

SEQ ID NO: 3171395 - protein, 19 aa, Giardia lamblia
SSFKSLYLEKLVDLKEQHR

SEQ ID NO: 3171396 - protein, 18 aa, Giardia lamblia
SSFRSSVHHYPPSRTSNA

SEQ ID NO: 3171397 - protein, 17 aa, Giardia lamblia
SSFSEFSSFYWVLCEAS

SEQ ID NO: 3171398 - protein, 21 aa, Giardia lamblia
SSGERLRFPVNMNPLEAYFNS

SEQ ID NO: 3171399 - protein, 27 aa, Giardia lamblia
SSGERPIVLILCELFNINPRSIASPEI

SEQ ID NO: 3171400 - protein, 21 aa, Giardia lamblia
SSGPCSVGMAAAYNGLVTYTF

SEQ ID NO: 3171401 - protein, 28 aa, Giardia lamblia
SSGPKARMSDIYALSALQCDPSSCRTED

SEQ ID NO: 3171402 - protein, 25 aa, Giardia lamblia
SSGQARSGFSLAVFAYSQNRRRHSS

SEQ ID NO: 3171403 - protein, 23 aa, Giardia lamblia
SSGSRLFAFSLLSNKRLFAYPTT

SEQ ID NO: 3171404 - protein, 21 aa, Giardia lamblia
SSGVPECSDHAISLAQRQLNA

SEQ ID NO: 3171405 - protein, 25 aa, Giardia lamblia
SSGVTRKGLKQIVNYSFNELLNGCD

SEQ ID NO: 3171406 - protein, 25 aa, Giardia lamblia
SSHNCGDSAVLLSVILQEGTSYAPE

SEQ ID NO: 3171407 - protein, 18 aa, Giardia lamblia
SSHNIMCPNVSRTDYLLI

SEQ ID NO: 3171408 - protein, 24 aa, Giardia lamblia
SSHSSSLKASRIGLNDPPSINVSL

SEQ ID NO: 3171409 - protein, 20 aa, Giardia lamblia
SSHYPNVFFMRKSRAYSQAF

SEQ ID NO: 3171410 - protein, 19 aa, Giardia lamblia
SSIALALSCHGIRPYPGIT

SEQ ID NO: 3171411 - protein, 18 aa, Giardia lamblia
SSIEYSVMVMLKKLQHAA

SEQ ID NO: 3171412 - protein, 23 aa, Giardia lamblia
SSIGNFLLALSINVLERTPIRHI

SEQ ID NO: 3171413 - protein, 31 aa, Giardia lamblia
SSIIEQYRLYGSILIVCEVLLYPVPINDAER

SEQ ID NO: 3171414 - protein, 24 aa, Giardia lamblia
SSIKYKTSILYPRSDDVSAGGPSC

SEQ ID NO: 3171415 - protein, 25 aa, Giardia lamblia
SSILEIRSGMQLVYDMLMNSISSTR

SEQ ID NO: 3171416 - protein, 47 aa, Giardia lamblia
SSILLPCRHMCLCRSCALEFRRKATQCPLCRAEVSSLIDISDISSEL

SEQ ID NO: 3171417 - protein, 17 aa, Giardia lamblia
SSILLSFVATLHEAALS

SEQ ID NO: 3171418 - protein, 21 aa, Giardia lamblia
SSILVPILFDGDVDAIWIESM

SEQ ID NO: 3171419 - protein, 23 aa, Giardia lamblia
SSIQSYFLRTSVFSKGESFERHA

SEQ ID NO: 3171420 - protein, 17 aa, Giardia lamblia
SSIVFRADFPVFTITGP

SEQ ID NO: 3171421 - protein, 24 aa, Giardia lamblia
SSKCEPRDSIGVTISPLSAAAEVL

SEQ ID NO: 3171422 - protein, 19 aa, Giardia lamblia
SSKDLLSYTDFRNVLRYKT

SEQ ID NO: 3171423 - protein, 24 aa, Giardia lamblia
SSKEGRAAFRASKQLFNALLMHIN

SEQ ID NO: 3171424 - protein, 23 aa, Giardia lamblia
SSKFAKVYFEFILKNLPSATNLA

SEQ ID NO: 3171425 - protein, 25 aa, Giardia lamblia
SSKFALSLSVSPLFYDPRQRLDARL

SEQ ID NO: 3171426 - protein, 18 aa, Giardia lamblia
SSKGFCPQPASPAHVITL

SEQ ID NO: 3171427 - protein, 23 aa, Giardia lamblia
SSKKRPSNIVIGRMFDGQVLDMV

SEQ ID NO: 3171428 - protein, 25 aa, Giardia lamblia
SSKLKRIFRRITITMADTIRYLCEF

SEQ ID NO: 3171429 - protein, 17 aa, Giardia lamblia
SSKNFSIMGLDNSEDET

SEQ ID NO: 3171430 - protein, 24 aa, Giardia lamblia
SSKRADVCYSFARGVCLNKTCDSR

SEQ ID NO: 3171431 - protein, 17 aa, Giardia lamblia
SSKRCLAYVRDNFSVNF

SEQ ID NO: 3171432 - protein, 23 aa, Giardia lamblia
SSKSRLTIELKMRELKPEEVETV

SEQ ID NO: 3171433 - protein, 18 aa, Giardia lamblia
SSKVCSRCEIKLESAGIK

SEQ ID NO: 3171434 - protein, 24 aa, Giardia lamblia
SSLCRLLVQLVVRILRIHRDNAIG

SEQ ID NO: 3171435 - protein, 26 aa, Giardia lamblia
SSLEEFYRLATEYAELPDTRCKCCDL

SEQ ID NO: 3171436 - protein, 20 aa, Giardia lamblia
SSLFLLPGLMRAAHTNSTET

SEQ ID NO: 3171437 - protein, 21 aa, Giardia lamblia
SSLHMKAKPGAINHINTFIQF

SEQ ID NO: 3171438 - protein, 27 aa, Giardia lamblia
SSLHRELFKATSLLSVLGNIFPADLSE

SEQ ID NO: 3171439 - protein, 19 aa, Giardia lamblia
SSLIKLAFNTLLGFIQDIL

SEQ ID NO: 3171440 - protein, 24 aa, Giardia lamblia
SSLKAEIDKAWKIVDLAREKEGVQ

SEQ ID NO: 3171441 - protein, 18 aa, Giardia lamblia
SSLKEKNLLISTYQDNER

SEQ ID NO: 3171442 - protein, 17 aa, Giardia lamblia
SSLKQAATLYLTFVAAL

SEQ ID NO: 3171443 - protein, 17 aa, Giardia lamblia
SSLLGIDGTCLRASGLT

SEQ ID NO: 3171444 - protein, 20 aa, Giardia lamblia
SSLLIPFFIAHGSSDDAIFH

SEQ ID NO: 3171445 - protein, 18 aa, Giardia lamblia
SSLLIWSSIQLRTGLSTG

SEQ ID NO: 3171446 - protein, 18 aa, Giardia lamblia
SSLLNWLDARGYYDKSTS

SEQ ID NO: 3171447 - protein, 18 aa, Giardia lamblia
SSLLRVVSTVSLYPIKPA

SEQ ID NO: 3171448 - protein, 25 aa, Giardia lamblia
SSLLSCYDILHFIFCIYRAQEVLLL

SEQ ID NO: 3171449 - protein, 18 aa, Giardia lamblia
SSLMYGIDLSNLYNLCSS

SEQ ID NO: 3171450 - protein, 19 aa, Giardia lamblia
SSLPAPWSVATSLSELRLA

SEQ ID NO: 3171451 - protein, 22 aa, Giardia lamblia
SSLPRPLIIDRLESICYAEMHQ

SEQ ID NO: 3171452 - protein, 17 aa, Giardia lamblia
SSLQCKHDILLQKTASL

SEQ ID NO: 3171453 - protein, 18 aa, Giardia lamblia
SSLQCKITSIIEPTIRQL

SEQ ID NO: 3171454 - protein, 17 aa, Giardia lamblia
SSLRPDVSLTPYQSTYA

SEQ ID NO: 3171455 - protein, 23 aa, Giardia lamblia
SSLRVAFQNLERAVADHGSETVV

SEQ ID NO: 3171456 - protein, 33 aa, Giardia lamblia
SSLSTFCQLNYPEIVDAPAIGAVRNIELGFMPF

SEQ ID NO: 3171457 - protein, 18 aa, Giardia lamblia
SSLVTRVFSTHGMEDLIF

SEQ ID NO: 3171458 - protein, 27 aa, Giardia lamblia
SSMEHWWPFVIGELIVIYSEANFTKGV

SEQ ID NO: 3171459 - protein, 31 aa, Giardia lamblia
SSMMTAILHKIRLVYDMNLLYTGQKALQCRS

SEQ ID NO: 3171460 - protein, 22 aa, Giardia lamblia
SSMPEPAYISAVVFNDLYKLPT

SEQ ID NO: 3171461 - protein, 24 aa, Giardia lamblia
SSMTRLAAHLQRQTVFSIDLAKNY

SEQ ID NO: 3171462 - protein, 32 aa, Giardia lamblia
SSMYLRTSLALLRLFEYYGIASTIKWPNDIIV

SEQ ID NO: 3171463 - protein, 31 aa, Giardia lamblia
SSNAEFAFVFDWLEGNGFTKTQLVLEVESFR

SEQ ID NO: 3171464 - protein, 31 aa, Giardia lamblia
SSNAHPGTLVKRPGSAKPLGSSRNDYKEMGD

SEQ ID NO: 3171465 - protein, 27 aa, Giardia lamblia
SSNAYYRRPMIPRVEQVSSRGIAFTGT

SEQ ID NO: 3171466 - protein, 17 aa, Giardia lamblia
SSNDARVVPRASSELPR

SEQ ID NO: 3171467 - protein, 18 aa, Giardia lamblia
SSNDLATSIGRRKPLISV

SEQ ID NO: 3171468 - protein, 24 aa, Giardia lamblia
SSNFPVPPLDDWNTVAGIRLAVLG

SEQ ID NO: 3171469 - protein, 19 aa, Giardia lamblia
SSNILGHPFTVRHVLQDGS

SEQ ID NO: 3171470 - protein, 23 aa, Giardia lamblia
SSNLKTLSLRDIVLIFYQIAYGL

SEQ ID NO: 3171471 - protein, 23 aa, Giardia lamblia
SSNQVREALDFSRHPECPSLGMY

SEQ ID NO: 3171472 - protein, 17 aa, Giardia lamblia
SSNRTALIYAVEHKNTE

SEQ ID NO: 3171473 - protein, 18 aa, Giardia lamblia
SSNVIYIGYSWNYVKQLV

SEQ ID NO: 3171474 - protein, 30 aa, Giardia lamblia
SSNYFMRFMRSIRVPFIAKKSMPLVDPYNG

SEQ ID NO: 3171475 - protein, 22 aa, Giardia lamblia
SSPANFFLSIALRNLQSVEYRF

SEQ ID NO: 3171476 - protein, 23 aa, Giardia lamblia
SSPEALELSLLIGDSLRCQNNLE

SEQ ID NO: 3171477 - protein, 21 aa, Giardia lamblia
SSPELLKLEAISMLSNLLNSG

SEQ ID NO: 3171478 - protein, 17 aa, Giardia lamblia
SSPELPGSVHANRTFTA

SEQ ID NO: 3171479 - protein, 20 aa, Giardia lamblia
SSPIIKILPIPSMPQCFVAV

SEQ ID NO: 3171480 - protein, 20 aa, Giardia lamblia
SSPISVPGVIKFLNCYFSSV

SEQ ID NO: 3171481 - protein, 20 aa, Giardia lamblia
SSPLKPQWTYVIGERIQQLS

SEQ ID NO: 3171482 - protein, 23 aa, Giardia lamblia
SSPPDLRLASLEPPIYADDSSTS

SEQ ID NO: 3171483 - protein, 21 aa, Giardia lamblia
SSPRPAIQLLNHVANVASGIV

SEQ ID NO: 3171484 - protein, 22 aa, Giardia lamblia
SSPRRSTRISGIRPFLPGDTSR

SEQ ID NO: 3171485 - protein, 21 aa, Giardia lamblia
SSPVGLCSIAMTKPTNTLTGL

SEQ ID NO: 3171486 - protein, 21 aa, Giardia lamblia
SSPYGRYLMPFHKILSDGAPF

SEQ ID NO: 3171487 - protein, 26 aa, Giardia lamblia
SSQFHLLSEWVHLSPLLVLKTDMLLR

SEQ ID NO: 3171488 - protein, 18 aa, Giardia lamblia
SSQFHRLYSNFSNPSKGA

SEQ ID NO: 3171489 - protein, 18 aa, Giardia lamblia
SSQVRRLYDITNILEGMH

SEQ ID NO: 3171490 - protein, 25 aa, Giardia lamblia
SSQVYDILYQILKAISITGNAAQWV

SEQ ID NO: 3171491 - protein, 31 aa, Giardia lamblia
SSRACQICGCYARPAPWNSLITKSKNCPVCE

SEQ ID NO: 3171492 - protein, 32 aa, Giardia lamblia
SSRDDYIFCLTYLRDCVASGKPVHTVSLLNAS

SEQ ID NO: 3171493 - protein, 17 aa, Giardia lamblia
SSRFLYRSMGFDLYEHA

SEQ ID NO: 3171494 - protein, 33 aa, Giardia lamblia
SSRINVLRFYDSFHEVRNVFLLAIQSLSRPKVV

SEQ ID NO: 3171495 - protein, 24 aa, Giardia lamblia
SSRLKHAMDILCSTILSHVETIYL

SEQ ID NO: 3171496 - protein, 21 aa, Giardia lamblia
SSRLWPADVQFLGKDIARFHC

SEQ ID NO: 3171497 - protein, 24 aa, Giardia lamblia
SSRMKDLRYLRALLSRSDLPIGCV

SEQ ID NO: 3171498 - protein, 21 aa, Giardia lamblia
SSRRPMPCLPRTLNATCITNN

SEQ ID NO: 3171499 - protein, 23 aa, Giardia lamblia
SSRSHSVFTIMFKKITIKHNSSG

SEQ ID NO: 3171500 - protein, 20 aa, Giardia lamblia
SSSEEVRSAYQIAQNSGTDW

SEQ ID NO: 3171501 - protein, 34 aa, Giardia lamblia
SSSFMRTPAGSMIRWRPSTGGPRRHQGTRVEAST

SEQ ID NO: 3171502 - protein, 18 aa, Giardia lamblia
SSSFPAILNGYLKMTKDE

SEQ ID NO: 3171503 - protein, 25 aa, Giardia lamblia
SSSFSPMWVRTCLSSAALTYPSPFL

SEQ ID NO: 3171504 - protein, 19 aa, Giardia lamblia
SSSGAWKATQHSSWDDSRN

SEQ ID NO: 3171505 - protein, 17 aa, Giardia lamblia
SSSHLAPHERIRQNMST

SEQ ID NO: 3171506 - protein, 39 aa, Giardia lamblia
SSSIAKPGFLPKMKKMRSFPYAGTNWVRAKGREPLFGGD

SEQ ID NO: 3171507 - protein, 19 aa, Giardia lamblia
SSSIPECVIGHLVGGGSRS

SEQ ID NO: 3171508 - protein, 26 aa, Giardia lamblia
SSSISCFPYLFPYLSFEKDYQGRTAL

SEQ ID NO: 3171509 - protein, 18 aa, Giardia lamblia
SSSKPECTPTRPLSTSSM

SEQ ID NO: 3171510 - protein, 19 aa, Giardia lamblia
SSSLHFIQRVRIVIRHDRT

SEQ ID NO: 3171511 - protein, 27 aa, Giardia lamblia
SSSLRLPQLLLCALLAYCGHSCNSLLA

SEQ ID NO: 3171512 - protein, 17 aa, Giardia lamblia
SSSLVFTPLSDRDFLIE

SEQ ID NO: 3171513 - protein, 19 aa, Giardia lamblia
SSSLVKGSQSVFCSSVYSV

SEQ ID NO: 3171514 - protein, 26 aa, Giardia lamblia
SSSPLLELITKWSRMIRQSRPASPMS

SEQ ID NO: 3171515 - protein, 24 aa, Giardia lamblia
SSSPMKRSPPLLAQKADGSSENIV

SEQ ID NO: 3171516 - protein, 21 aa, Giardia lamblia
SSSPRFSKPSTIIDGTQSPQR

SEQ ID NO: 3171517 - protein, 26 aa, Giardia lamblia
SSSPRQIPFLALLIIRGQDFGQGLLK

SEQ ID NO: 3171518 - protein, 25 aa, Giardia lamblia
SSSQSSPIFLQWLECVYQVMHQRAD

SEQ ID NO: 3171519 - protein, 23 aa, Giardia lamblia
SSSRAQPKVRDCDGWDVEDDDPE

SEQ ID NO: 3171520 - protein, 22 aa, Giardia lamblia
SSSRGGHHLFHYQGCAPRAPLS

SEQ ID NO: 3171521 - protein, 17 aa, Giardia lamblia
SSSRPGSARSRQSIRST

SEQ ID NO: 3171522 - protein, 24 aa, Giardia lamblia
SSSRRFSDGMPLAPFQTELNRDTR

SEQ ID NO: 3171523 - protein, 26 aa, Giardia lamblia
SSSRSHSIFTICLIVKETAPSSNNNT

SEQ ID NO: 3171524 - protein, 26 aa, Giardia lamblia
SSSRVGSSLCAIVFSVGSSPVPVSKQ

SEQ ID NO: 3171525 - protein, 18 aa, Giardia lamblia
SSSRWKSTYTKDYCEGMT

SEQ ID NO: 3171526 - protein, 21 aa, Giardia lamblia
SSSTPHVFVSFCIEGLEEGPK

SEQ ID NO: 3171527 - protein, 18 aa, Giardia lamblia
SSSVPILPSSSWEKHSFA

SEQ ID NO: 3171528 - protein, 18 aa, Giardia lamblia
SSSVPVFLGPAPVVSQLE

SEQ ID NO: 3171529 - protein, 19 aa, Giardia lamblia
SSSVWRPASFYRRDHTSCA

SEQ ID NO: 3171530 - protein, 31 aa, Giardia lamblia
SSTAKLLLIFLEYMVCWTLGIGRKQLLSEQD

SEQ ID NO: 3171531 - protein, 23 aa, Giardia lamblia
SSTARLNAILGVQIGAGGVSLPQ

SEQ ID NO: 3171532 - protein, 22 aa, Giardia lamblia
SSTCPCQACKYSKAYLHALYVA

SEQ ID NO: 3171533 - protein, 23 aa, Giardia lamblia
SSTDAKPRWLVDSSTQLNTMGNG

SEQ ID NO: 3171534 - protein, 22 aa, Giardia lamblia
SSTKLGALLKLVPQLLQEDGRA

SEQ ID NO: 3171535 - protein, 26 aa, Giardia lamblia
SSTLPCLPLSAANMGVSQIVERAAFI

SEQ ID NO: 3171536 - protein, 27 aa, Giardia lamblia
SSTLTELFAIFTIILRKQFNHCVYALE

SEQ ID NO: 3171537 - protein, 27 aa, Giardia lamblia
SSTLVKLRFDVTAKLSMMEKLMNSQGI

SEQ ID NO: 3171538 - protein, 29 aa, Giardia lamblia
SSTPMGYVRILYCFSKNYTFRPKVPAPGS

SEQ ID NO: 3171539 - protein, 22 aa, Giardia lamblia
SSTPVHVTLRFSGDELGPPMST

SEQ ID NO: 3171540 - protein, 25 aa, Giardia lamblia
SSTRRLYLHHVIRYLNKLLISDMQP

SEQ ID NO: 3171541 - protein, 19 aa, Giardia lamblia
SSVDFLSHFIFKAYTDSSD

SEQ ID NO: 3171542 - protein, 49 aa, Giardia lamblia
SSVFPVCTNCGVLARNRCSRCHNVWYCGRKCQKIDWVAGHSKVCKRQDI

SEQ ID NO: 3171543 - protein, 22 aa, Giardia lamblia
SSVPAELILSLYASAALASAVA

SEQ ID NO: 3171544 - protein, 18 aa, Giardia lamblia
SSVPMPSCTLRAKSPSDG

SEQ ID NO: 3171545 - protein, 19 aa, Giardia lamblia
SSVQGRCATMGIRYVEGRP

SEQ ID NO: 3171546 - protein, 24 aa, Giardia lamblia
SSVQMRRGRHMNQRHFTSGDSMDT

SEQ ID NO: 3171547 - protein, 29 aa, Giardia lamblia
SSVRAPPFRKLRALPITSRRRLCVNESVS

SEQ ID NO: 3171548 - protein, 19 aa, Giardia lamblia
SSVTLRGVWHKETEDLDVL

SEQ ID NO: 3171549 - protein, 26 aa, Giardia lamblia
SSVVFVPAFTGLLCPFWCPHARAGIF

SEQ ID NO: 3171550 - protein, 17 aa, Giardia lamblia
SSWHVMNTIHGRLLMDL

SEQ ID NO: 3171551 - protein, 20 aa, Giardia lamblia
SSYILLQLIVVYISERHNVF

SEQ ID NO: 3171552 - protein, 20 aa, Giardia lamblia
SSYIQRLAVVKFINYAESYG

SEQ ID NO: 3171553 - protein, 20 aa, Giardia lamblia
SSYKRGLLKMLKRIHPLVIN

SEQ ID NO: 3171554 - protein, 18 aa, Giardia lamblia
SSYPRIRDIAFPTSSASI

SEQ ID NO: 3171555 - protein, 22 aa, Giardia lamblia
SSYVAPEFVRKLLATSPVDGIV

SEQ ID NO: 3171556 - protein, 49 aa, Giardia lamblia
STAASDKKINWDVCMYNMKLVTLCLDNAFLTKEYNAFIASGRKFIRSFK

SEQ ID NO: 3171557 - protein, 20 aa, Giardia lamblia
STAASTAFRKNTRHGSALPP

SEQ ID NO: 3171558 - protein, 20 aa, Giardia lamblia
STACKVILVGNKVDLRHLRE

SEQ ID NO: 3171559 - protein, 18 aa, Giardia lamblia
STADPLFDAVFSILTGIA

SEQ ID NO: 3171560 - protein, 25 aa, Giardia lamblia
STAELRMLYPFPEISLKYSNELYNV

SEQ ID NO: 3171561 - protein, 17 aa, Giardia lamblia
STAHVQALREEVERVRH

SEQ ID NO: 3171562 - protein, 18 aa, Giardia lamblia
STANSRGSLFHGAGISTA

SEQ ID NO: 3171563 - protein, 17 aa, Giardia lamblia
STAPRLDDMQDLDPDSH

SEQ ID NO: 3171564 - protein, 24 aa, Giardia lamblia
STAREPQKVFGFAADDVVLNKDPA

SEQ ID NO: 3171565 - protein, 19 aa, Giardia lamblia
STARIPGFQVLSDSLSDEN

SEQ ID NO: 3171566 - protein, 17 aa, Giardia lamblia
STARLLPMSPRARRGSI

SEQ ID NO: 3171567 - protein, 19 aa, Giardia lamblia
STARWMNLLWGVTVNVCHR

SEQ ID NO: 3171568 - protein, 36 aa, Giardia lamblia
STAVYCPNCSIFLGCCKRCATIFARSHQAECNNFVA

SEQ ID NO: 3171569 - protein, 24 aa, Giardia lamblia
STCDKEIYVWFPIQQRQLARPSIE

SEQ ID NO: 3171570 - protein, 19 aa, Giardia lamblia
STCKSNGAKKFAFPCHFCH

SEQ ID NO: 3171571 - protein, 23 aa, Giardia lamblia
STCRGQGSSGLLGPRISKPSSVI

SEQ ID NO: 3171572 - protein, 18 aa, Giardia lamblia
STDAARPAFVTKLATAAM

SEQ ID NO: 3171573 - protein, 25 aa, Giardia lamblia
STDALKLMEKLDCYQNDITEFTEKN

SEQ ID NO: 3171574 - protein, 19 aa, Giardia lamblia
STDGRVLWWDARNFSKYTQ

SEQ ID NO: 3171575 - protein, 21 aa, Giardia lamblia
STDLCCFVDFYCIGVISQAKN

SEQ ID NO: 3171576 - protein, 22 aa, Giardia lamblia
STDLKGSPIYNVRASHSENIGT

SEQ ID NO: 3171577 - protein, 32 aa, Giardia lamblia
STDPKREALRVARKFLQEKALAKSMTDTRPPK

SEQ ID NO: 3171578 - protein, 25 aa, Giardia lamblia
STDQCGRTALMYAAEHGYADCVRAI

SEQ ID NO: 3171579 - protein, 18 aa, Giardia lamblia
STDRFRAVHTQRNSTARE

SEQ ID NO: 3171580 - protein, 23 aa, Giardia lamblia
STDRTYFRGSLVFHVKMGGINGN

SEQ ID NO: 3171581 - protein, 24 aa, Giardia lamblia
STDWFRALVRCLGWNVRIRQKAFD

SEQ ID NO: 3171582 - protein, 18 aa, Giardia lamblia
STEGLPVSNFCPKLLLPN

SEQ ID NO: 3171583 - protein, 21 aa, Giardia lamblia
STELTALMWAAANGRTEVVRL

SEQ ID NO: 3171584 - protein, 24 aa, Giardia lamblia
STEPRRVTEMYRDMHNSTGNSYRQ

SEQ ID NO: 3171585 - protein, 25 aa, Giardia lamblia
STESFRFPLQSARMLVRIYSSQGQI

SEQ ID NO: 3171586 - protein, 24 aa, Giardia lamblia
STEVPRFFRTCLAGLPLEKLVLGI

SEQ ID NO: 3171587 - protein, 17 aa, Giardia lamblia
STFDPTLVSSAQRPLNA

SEQ ID NO: 3171588 - protein, 17 aa, Giardia lamblia
STFEHLHDSMVLFGSGA

SEQ ID NO: 3171589 - protein, 23 aa, Giardia lamblia
STFKLENLISLNLHNYAEDVDSI

SEQ ID NO: 3171590 - protein, 25 aa, Giardia lamblia
STFKPGRTAYMIAILKKNFLVMELL

SEQ ID NO: 3171591 - protein, 18 aa, Giardia lamblia
STFKRGTDTLLYDNRVDS

SEQ ID NO: 3171592 - protein, 25 aa, Giardia lamblia
STFPFFPTFNFVNAIISRRSIEKAS

SEQ ID NO: 3171593 - protein, 23 aa, Giardia lamblia
STFVGCGIYELLSLPITEGPGPF

SEQ ID NO: 3171594 - protein, 26 aa, Giardia lamblia
STGIFPFDDLCCLSRSKTASECQLEF

SEQ ID NO: 3171595 - protein, 17 aa, Giardia lamblia
STGIKYVMKVIHIAPLK

SEQ ID NO: 3171596 - protein, 26 aa, Giardia lamblia
STGILRLGLFLPFLLKYEKEEQSTRE

SEQ ID NO: 3171597 - protein, 27 aa, Giardia lamblia
STGLLLLCLRGGCPQATVLPVSVADTA

SEQ ID NO: 3171598 - protein, 17 aa, Giardia lamblia
STGLSALDYAARANHGE

SEQ ID NO: 3171599 - protein, 25 aa, Giardia lamblia
STGQKASVRFVWASEFIRQNSSSYW

SEQ ID NO: 3171600 - protein, 17 aa, Giardia lamblia
STGRTGLEQSIHDVPRS

SEQ ID NO: 3171601 - protein, 25 aa, Giardia lamblia
STHFFRTYRSVLDMATVSLIKQDSL

SEQ ID NO: 3171602 - protein, 26 aa, Giardia lamblia
STICKMLEVCILPSPDKAFIDELLKS

SEQ ID NO: 3171603 - protein, 24 aa, Giardia lamblia
STIKRAHKPLDFPDEPGCEGQLDE

SEQ ID NO: 3171604 - protein, 25 aa, Giardia lamblia
STILLRSRLKSIREGKEDVISRARY

SEQ ID NO: 3171605 - protein, 17 aa, Giardia lamblia
STILNRRVESLSIVDQI

SEQ ID NO: 3171606 - protein, 21 aa, Giardia lamblia
STIPTFCYIENALSQGMKVDV

SEQ ID NO: 3171607 - protein, 32 aa, Giardia lamblia
STIVCCYEAAIIRLCHHYELIGPTVEVIMLLT

SEQ ID NO: 3171608 - protein, 24 aa, Giardia lamblia
STKAAEIEQAYSLLCQEKSRAGAP

SEQ ID NO: 3171609 - protein, 29 aa, Giardia lamblia
STKEGPVHFLWLDFDGNLISESRNPYFQP

SEQ ID NO: 3171610 - protein, 23 aa, Giardia lamblia
STKEHREELSFLPHSDAKIASNI

SEQ ID NO: 3171611 - protein, 23 aa, Giardia lamblia
STKETCKLLLDALELSQRDISSL

SEQ ID NO: 3171612 - protein, 27 aa, Giardia lamblia
STKFVSRWMDLMCNLALEAVSIVARGR

SEQ ID NO: 3171613 - protein, 20 aa, Giardia lamblia
STKILLILRDCDIVAPDEFA

SEQ ID NO: 3171614 - protein, 17 aa, Giardia lamblia
STKLCFRIIGGEQIELP

SEQ ID NO: 3171615 - protein, 27 aa, Giardia lamblia
STKLDVVNLLPYFYYKQGETITLAQLP

SEQ ID NO: 3171616 - protein, 21 aa, Giardia lamblia
STKTFMFNRVFQCDTTQETVF

SEQ ID NO: 3171617 - protein, 27 aa, Giardia lamblia
STLDISGAPGFQLAIMAPRGLCRIVIN

SEQ ID NO: 3171618 - protein, 25 aa, Giardia lamblia
STLECARTAIGTPYYLSPELCEDKP

SEQ ID NO: 3171619 - protein, 33 aa, Giardia lamblia
STLERPLAKHKRGRIPVPITMILSVMKQVAAAL

SEQ ID NO: 3171620 - protein, 22 aa, Giardia lamblia
STLFDYLGFFLSEFQRENASFN

SEQ ID NO: 3171621 - protein, 20 aa, Giardia lamblia
STLIHHFYFQPIRPVDFKFR

SEQ ID NO: 3171622 - protein, 27 aa, Giardia lamblia
STLIPRVPQPILFFKYFGRQTVFVTTG

SEQ ID NO: 3171623 - protein, 18 aa, Giardia lamblia
STLLKDVQLVSASDTQLV

SEQ ID NO: 3171624 - protein, 23 aa, Giardia lamblia
STLLRKDITLTLGVNETIPVDVM

SEQ ID NO: 3171625 - protein, 17 aa, Giardia lamblia
STLMGIMAYMAPEVLLR

SEQ ID NO: 3171626 - protein, 17 aa, Giardia lamblia
STLPQPHKSIFTRIMTN

SEQ ID NO: 3171627 - protein, 18 aa, Giardia lamblia
STLRKRAFHTWKSQTPLL

SEQ ID NO: 3171628 - protein, 31 aa, Giardia lamblia
STLRSARDSLRLVLDVARLHQHPTLIQAIHN

SEQ ID NO: 3171629 - protein, 25 aa, Giardia lamblia
STLSRPRTSYFQRFNQQPAQEYSPH

SEQ ID NO: 3171630 - protein, 26 aa, Giardia lamblia
STLTCKRTNLSISLSFDKLELGGVCG

SEQ ID NO: 3171631 - protein, 18 aa, Giardia lamblia
STLYTGFILAQRIMKDLR

SEQ ID NO: 3171632 - protein, 19 aa, Giardia lamblia
STMAPRPASSGIIYTSAAI

SEQ ID NO: 3171633 - protein, 19 aa, Giardia lamblia
STMCFKIQLYNQANGAIST

SEQ ID NO: 3171634 - protein, 18 aa, Giardia lamblia
STMHIWPLNFNNVLVIDK

SEQ ID NO: 3171635 - protein, 24 aa, Giardia lamblia
STNGRPILCPSLIEALQQVYARIS

SEQ ID NO: 3171636 - protein, 28 aa, Giardia lamblia
STNIRKLSCRTCGLKSLSNDLSLLENLE

SEQ ID NO: 3171637 - protein, 18 aa, Giardia lamblia
STNKFLECLTLNNCGLTV

SEQ ID NO: 3171638 - protein, 25 aa, Giardia lamblia
STNPLAVCRYIDSILSFCETPQHRL

SEQ ID NO: 3171639 - protein, 18 aa, Giardia lamblia
STNRVAFEHAIKRSNINT

SEQ ID NO: 3171640 - protein, 24 aa, Giardia lamblia
STNSDRFGPLFPYTTNTIEPSMLG

SEQ ID NO: 3171641 - protein, 19 aa, Giardia lamblia
STNSNPIYTSRSESQRRSQ

SEQ ID NO: 3171642 - protein, 19 aa, Giardia lamblia
STNSYLAYKKAIMQNVTSA

SEQ ID NO: 3171643 - protein, 23 aa, Giardia lamblia
STPAGLCSSGLLWNPPEHDTVLP

SEQ ID NO: 3171644 - protein, 20 aa, Giardia lamblia
STPEDFERLIQLFLMTETGN

SEQ ID NO: 3171645 - protein, 27 aa, Giardia lamblia
STPEHIRPFSGKGFGSGKIVYDQYGKP

SEQ ID NO: 3171646 - protein, 19 aa, Giardia lamblia
STPLRFIATVFPHIHTGPT

SEQ ID NO: 3171647 - protein, 20 aa, Giardia lamblia
STPMRPGHDQIRRYNIITPV

SEQ ID NO: 3171648 - protein, 23 aa, Giardia lamblia
STPNHLRNSLPLLELAEETAHAE

SEQ ID NO: 3171649 - protein, 17 aa, Giardia lamblia
STPQEWARIYSGFEKCY

SEQ ID NO: 3171650 - protein, 19 aa, Giardia lamblia
STPRHKAIHTERWEFGHGF

SEQ ID NO: 3171651 - protein, 24 aa, Giardia lamblia
STPSLRKKLLLSITDLIQSYALAN

SEQ ID NO: 3171652 - protein, 18 aa, Giardia lamblia
STPTWLGAVLTLVHPADA

SEQ ID NO: 3171653 - protein, 25 aa, Giardia lamblia
STQCPWKPQEQTAYKDVVPHGGDRV

SEQ ID NO: 3171654 - protein, 22 aa, Giardia lamblia
STQFPASNNWLVKQSEIRPHDS

SEQ ID NO: 3171655 - protein, 17 aa, Giardia lamblia
STQKGSFAFRLGLPEAW

SEQ ID NO: 3171656 - protein, 17 aa, Giardia lamblia
STQMTLKSFHHAGLASM

SEQ ID NO: 3171657 - protein, 23 aa, Giardia lamblia
STQPGFSGFGGFGGGSSSQSVFG

SEQ ID NO: 3171658 - protein, 19 aa, Giardia lamblia
STRAGCLGLNLTAANHVII

SEQ ID NO: 3171659 - protein, 17 aa, Giardia lamblia
STRHSRRTVGIQPRSTT

SEQ ID NO: 3171660 - protein, 27 aa, Giardia lamblia
STRLLRCSPECVVCLHRPKNIKLDPCK

SEQ ID NO: 3171661 - protein, 28 aa, Giardia lamblia
STRLPMHKLIRVKIGLYVGKNVYYMGTT

SEQ ID NO: 3171662 - protein, 24 aa, Giardia lamblia
STRPSILTHGDFLHSIDYRILEHT

SEQ ID NO: 3171663 - protein, 18 aa, Giardia lamblia
STRTCPICRTEITQYKEV

SEQ ID NO: 3171664 - protein, 21 aa, Giardia lamblia
STRVIPLLIPYFGNETDKQGY

SEQ ID NO: 3171665 - protein, 25 aa, Giardia lamblia
STRWYRAPELLLHYSGYGPPIDIWA

SEQ ID NO: 3171666 - protein, 24 aa, Giardia lamblia
STSDCYGRTALMLASSHNRISVVK

SEQ ID NO: 3171667 - protein, 25 aa, Giardia lamblia
STSGYGVRGPDCWTDSGDIRPPISA

SEQ ID NO: 3171668 - protein, 22 aa, Giardia lamblia
STSKVRISLIFRAPEARIYEKV

SEQ ID NO: 3171669 - protein, 23 aa, Giardia lamblia
STSLKYADLRLIGNLDGHVHTLS

SEQ ID NO: 3171670 - protein, 18 aa, Giardia lamblia
STSLPMVYPPLGTIMAAP

SEQ ID NO: 3171671 - protein, 18 aa, Giardia lamblia
STSPHMHAMPIVSAADAR

SEQ ID NO: 3171672 - protein, 26 aa, Giardia lamblia
STSVERLKFVIVLGATNFPEAIDQAA

SEQ ID NO: 3171673 - protein, 19 aa, Giardia lamblia
STTEYKPGESMHVSLRDQP

SEQ ID NO: 3171674 - protein, 22 aa, Giardia lamblia
STTFRRLLGYVISGNSLKPLVD

SEQ ID NO: 3171675 - protein, 17 aa, Giardia lamblia
STTISILEKRQEAIIEA

SEQ ID NO: 3171676 - protein, 21 aa, Giardia lamblia
STTKRFPLRHAHWGMPGPSHY

SEQ ID NO: 3171677 - protein, 31 aa, Giardia lamblia
STTSKLSCLPRYLFSLPLSSIVCQILNTMRS

SEQ ID NO: 3171678 - protein, 18 aa, Giardia lamblia
STTVRMIARRMRRGGRKV

SEQ ID NO: 3171679 - protein, 18 aa, Giardia lamblia
STVAIEYSSDLFVTNENY

SEQ ID NO: 3171680 - protein, 17 aa, Giardia lamblia
STVAVPLIRKTATYRSK

SEQ ID NO: 3171681 - protein, 33 aa, Giardia lamblia
STVDIAPSFDIWSLGCVLCEFLSGEPLYADKAQ

SEQ ID NO: 3171682 - protein, 33 aa, Giardia lamblia
STVELKFSIPGGYCFAELGLVAIPCKPSKVDEQ

SEQ ID NO: 3171683 - protein, 24 aa, Giardia lamblia
STVLDFLLRNGFSVGTPDISCNGG

SEQ ID NO: 3171684 - protein, 19 aa, Giardia lamblia
STVNCSRYLSLPQFDEPSK

SEQ ID NO: 3171685 - protein, 19 aa, Giardia lamblia
STVPRRSVSPATVIEQADG

SEQ ID NO: 3171686 - protein, 26 aa, Giardia lamblia
STVRPFLRKIFEAIGDIELEELGEQP

SEQ ID NO: 3171687 - protein, 19 aa, Giardia lamblia
STVSRCPDCSTNREIIDRL

SEQ ID NO: 3171688 - protein, 19 aa, Giardia lamblia
STWMKNLWGNRFLNEKTGK

SEQ ID NO: 3171689 - protein, 17 aa, Giardia lamblia
STWTRPVSQATYQPQNP

SEQ ID NO: 3171690 - protein, 26 aa, Giardia lamblia
STYDYLHRFTVVWPVLSLDPIVDNFG

SEQ ID NO: 3171691 - protein, 17 aa, Giardia lamblia
STYFCCANLEIEEVTES

SEQ ID NO: 3171692 - protein, 31 aa, Giardia lamblia
STYRHAYEYFDLRFARLESMVEALCATEGLG

SEQ ID NO: 3171693 - protein, 25 aa, Giardia lamblia
STYRIKLPSVLGVAPSHFKVRNTNK

SEQ ID NO: 3171694 - protein, 21 aa, Giardia lamblia
STYRSIYVFRIQKKHIYKISF

SEQ ID NO: 3171695 - protein, 18 aa, Giardia lamblia
SVACDRGDAALLVTGDQE

SEQ ID NO: 3171696 - protein, 23 aa, Giardia lamblia
SVAGLCKLLLMAISKGKQFIEVL

SEQ ID NO: 3171697 - protein, 22 aa, Giardia lamblia
SVAHTGLVPWVGIVGPQSSGRK

SEQ ID NO: 3171698 - protein, 24 aa, Giardia lamblia
SVAIPRPPPILSRFTKPGKNTSVF

SEQ ID NO: 3171699 - protein, 25 aa, Giardia lamblia
SVALSIHGGETFPFSQSDIARVHLL

SEQ ID NO: 3171700 - protein, 17 aa, Giardia lamblia
SVALVRCKIYLVDKKVC

SEQ ID NO: 3171701 - protein, 18 aa, Giardia lamblia
SVASGRRSSTDKSMTTGP

SEQ ID NO: 3171702 - protein, 25 aa, Giardia lamblia
SVAVPQPPESFGYLIDTLHIRDISE

SEQ ID NO: 3171703 - protein, 19 aa, Giardia lamblia
SVCAECFAHTIAKVLSNHI

SEQ ID NO: 3171704 - protein, 17 aa, Giardia lamblia
SVCAPMFSNCTAPSIKH

SEQ ID NO: 3171705 - protein, 23 aa, Giardia lamblia
SVCGRGGFRKVLHRYGAMAQRCA

SEQ ID NO: 3171706 - protein, 18 aa, Giardia lamblia
SVCPLSLYRRSLPRCLLM

SEQ ID NO: 3171707 - protein, 18 aa, Giardia lamblia
SVCQRNFLVGPALRRSSV

SEQ ID NO: 3171708 - protein, 25 aa, Giardia lamblia
SVCRSFGDFVYKPSISVVPFVSVYH

SEQ ID NO: 3171709 - protein, 19 aa, Giardia lamblia
SVCSRCRRGTLASFVSAGG

SEQ ID NO: 3171710 - protein, 24 aa, Giardia lamblia
SVDATLKLAGLVPLDESDSENIKS

SEQ ID NO: 3171711 - protein, 24 aa, Giardia lamblia
SVDLKRFVQHTGIQCKKCKQETVV

SEQ ID NO: 3171712 - protein, 32 aa, Giardia lamblia
SVDLTMAAIWPRIVSMLSRRDIYRYTVPLLIQ

SEQ ID NO: 3171713 - protein, 17 aa, Giardia lamblia
SVDPLLFNFLTKNKISL

SEQ ID NO: 3171714 - protein, 20 aa, Giardia lamblia
SVDQFPGLCKKDGATKQAEL

SEQ ID NO: 3171715 - protein, 27 aa, Giardia lamblia
SVDTRLLRRMCRDFVFRNRSADGTLDF

SEQ ID NO: 3171716 - protein, 38 aa, Giardia lamblia
SVEFYCPGCYVEILKKHINGWPMLFPFLTTTEQRQALL

SEQ ID NO: 3171717 - protein, 24 aa, Giardia lamblia
SVEKRAHTSYVRRPNEFEEYYGKS

SEQ ID NO: 3171718 - protein, 23 aa, Giardia lamblia
SVEYRKAYMEKFQKEGEARKAQQ

SEQ ID NO: 3171719 - protein, 28 aa, Giardia lamblia
SVFAQMKLIFCYLFCMIKLSGDSTKAAE

SEQ ID NO: 3171720 - protein, 17 aa, Giardia lamblia
SVFEWRDGCSHFYIIEA

SEQ ID NO: 3171721 - protein, 22 aa, Giardia lamblia
SVFLLQLFNEFIIARLLGGVSL

SEQ ID NO: 3171722 - protein, 23 aa, Giardia lamblia
SVFRRYCLCVSMDMCASIPSQGS

SEQ ID NO: 3171723 - protein, 24 aa, Giardia lamblia
SVFVTCGKFSGSVTVFKFSDGVFT

SEQ ID NO: 3171724 - protein, 20 aa, Giardia lamblia
SVGDWSCSRDQAVFSAVLPN

SEQ ID NO: 3171725 - protein, 18 aa, Giardia lamblia
SVGLSFDPIAFFATELAV

SEQ ID NO: 3171726 - protein, 17 aa, Giardia lamblia
SVHCVDTGLALTVNIPY

SEQ ID NO: 3171727 - protein, 26 aa, Giardia lamblia
SVHDDCIRWGMKLYDSIDRLQVIKVG

SEQ ID NO: 3171728 - protein, 26 aa, Giardia lamblia
SVHLHHLRRSFGLRRGLLLDGQVRKR

SEQ ID NO: 3171729 - protein, 19 aa, Giardia lamblia
SVHLYRIVAEASLITLRLE

SEQ ID NO: 3171730 - protein, 19 aa, Giardia lamblia
SVIGSLGLVLSEPNTVHYA

SEQ ID NO: 3171731 - protein, 17 aa, Giardia lamblia
SVILVFKGPDYALASGA

SEQ ID NO: 3171732 - protein, 18 aa, Giardia lamblia
SVIPLMLFAIDLGSCGDP

SEQ ID NO: 3171733 - protein, 23 aa, Giardia lamblia
SVKDLAKQLGIFCLILNCSEGMD

SEQ ID NO: 3171734 - protein, 21 aa, Giardia lamblia
SVKEYLLRQLMSVVDLPANSN

SEQ ID NO: 3171735 - protein, 20 aa, Giardia lamblia
SVKGCRLIFIPSQGYVIRAP

SEQ ID NO: 3171736 - protein, 23 aa, Giardia lamblia
SVKLRILHHTSILDWGLDKNTFE

SEQ ID NO: 3171737 - protein, 26 aa, Giardia lamblia
SVKNRPHYHPSWRGPEDVQQEVASKI

SEQ ID NO: 3171738 - protein, 27 aa, Giardia lamblia
SVKREQRECLGYVKCTYSRRNVAAITA

SEQ ID NO: 3171739 - protein, 19 aa, Giardia lamblia
SVKSMKDVVVYLVGNKSDL

SEQ ID NO: 3171740 - protein, 28 aa, Giardia lamblia
SVKVLFKRHADLVIDCLTYLRSIRDESR

SEQ ID NO: 3171741 - protein, 26 aa, Giardia lamblia
SVLEAVCGRDVLPRSAGICTRRPLIL

SEQ ID NO: 3171742 - protein, 23 aa, Giardia lamblia
SVLKSCLHVLLLLQAKARQVHPS

SEQ ID NO: 3171743 - protein, 18 aa, Giardia lamblia
SVLLQTYCKIIARCKESI

SEQ ID NO: 3171744 - protein, 32 aa, Giardia lamblia
SVLRDAKHKLRHYLKECEGLLDAQKDLEHSII

SEQ ID NO: 3171745 - protein, 27 aa, Giardia lamblia
SVLSSYAYTVCHLFPTEKGSCITRYNK

SEQ ID NO: 3171746 - protein, 23 aa, Giardia lamblia
SVLYRPINTLSILSLASVDDILK

SEQ ID NO: 3171747 - protein, 25 aa, Giardia lamblia
SVMKKRDWRSGRACLSNIIPASTGA

SEQ ID NO: 3171748 - protein, 17 aa, Giardia lamblia
SVMSIPYLYQYIKKSNM

SEQ ID NO: 3171749 - protein, 24 aa, Giardia lamblia
SVNLSILKFLGFEQILKNSLTTLP

SEQ ID NO: 3171750 - protein, 25 aa, Giardia lamblia
SVNSPCPKSSFGVRSQQRDTVPDNI

SEQ ID NO: 3171751 - protein, 27 aa, Giardia lamblia
SVNYEIIAVSCTWPGEKIKMAQSDVDR

SEQ ID NO: 3171752 - protein, 26 aa, Giardia lamblia
SVPARAAVVAGKWARRETAPVSVFEL

SEQ ID NO: 3171753 - protein, 18 aa, Giardia lamblia
SVPARNGYNLCQVNEAQF

SEQ ID NO: 3171754 - protein, 21 aa, Giardia lamblia
SVPEILDMVVIDRLKVEGIKD

SEQ ID NO: 3171755 - protein, 18 aa, Giardia lamblia
SVPHSAINNVQWLQTSNE

SEQ ID NO: 3171756 - protein, 24 aa, Giardia lamblia
SVPIIRQLIRYEARRKNKNNETAL

SEQ ID NO: 3171757 - protein, 20 aa, Giardia lamblia
SVPLSSLRTNIFSDISDTLG

SEQ ID NO: 3171758 - protein, 28 aa, Giardia lamblia
SVPSFLDSVCKGVILGCSPTLNTECNGD

SEQ ID NO: 3171759 - protein, 32 aa, Giardia lamblia
SVPTDDGVPLWTFDWGSAVYFSEHNIGSAASD

SEQ ID NO: 3171760 - protein, 23 aa, Giardia lamblia
SVQACAAIYLAACVNVKNASLKT

SEQ ID NO: 3171761 - protein, 18 aa, Giardia lamblia
SVQARQAALLSTFQEGFR

SEQ ID NO: 3171762 - protein, 21 aa, Giardia lamblia
SVQLPNRLNAIQQKTKAEPPV

SEQ ID NO: 3171763 - protein, 23 aa, Giardia lamblia
SVQSRTRFGGAFLAHQSSGQARS

SEQ ID NO: 3171764 - protein, 23 aa, Giardia lamblia
SVRALRAVRSCTRVYLDTYTSVI

SEQ ID NO: 3171765 - protein, 17 aa, Giardia lamblia
SVRCYKDDDSITALQSE

SEQ ID NO: 3171766 - protein, 22 aa, Giardia lamblia
SVRELYCFMKQIIPNNWRQYIC

SEQ ID NO: 3171767 - protein, 26 aa, Giardia lamblia
SVRFCIKSALDGYSFYELSLELLSKP

SEQ ID NO: 3171768 - protein, 18 aa, Giardia lamblia
SVRIFRAMDCLGATLYED

SEQ ID NO: 3171769 - protein, 21 aa, Giardia lamblia
SVRQDLRLATDALGSYKAEAT

SEQ ID NO: 3171770 - protein, 27 aa, Giardia lamblia
SVRRTLRSCPSFSRTAFLLRAYARAHQ

SEQ ID NO: 3171771 - protein, 27 aa, Giardia lamblia
SVRSSCELFKAFVVRKMGEVTSQNTLQ

SEQ ID NO: 3171772 - protein, 24 aa, Giardia lamblia
SVSALDFTSLLLAKDAEIHRLQSL

SEQ ID NO: 3171773 - protein, 25 aa, Giardia lamblia
SVSASDRFSSYYSFLYNNDLESAAA

SEQ ID NO: 3171774 - protein, 25 aa, Giardia lamblia
SVSDLMLRNGLYVFRSRGSRNNPIS

SEQ ID NO: 3171775 - protein, 19 aa, Giardia lamblia
SVSDWIIRLYYSFQDDLYL

SEQ ID NO: 3171776 - protein, 22 aa, Giardia lamblia
SVSGRTALMIAAKVDAIQVAKL

SEQ ID NO: 3171777 - protein, 17 aa, Giardia lamblia
SVSGRVFTVFGATHYHK

SEQ ID NO: 3171778 - protein, 26 aa, Giardia lamblia
SVSHRLALSGPDAWEAKGESFFLSPN

SEQ ID NO: 3171779 - protein, 20 aa, Giardia lamblia
SVSIKSGFSPYTRPFSDCQD

SEQ ID NO: 3171780 - protein, 20 aa, Giardia lamblia
SVSKPVPFDSLARYSAGDMS

SEQ ID NO: 3171781 - protein, 18 aa, Giardia lamblia
SVSLAAMINRRCVHSSLS

SEQ ID NO: 3171782 - protein, 22 aa, Giardia lamblia
SVSPGPRKSSLFSKPADTGNDP

SEQ ID NO: 3171783 - protein, 25 aa, Giardia lamblia
SVSRFLMPVCAPLATVSRGLERTSD

SEQ ID NO: 3171784 - protein, 25 aa, Giardia lamblia
SVSRKRPSSGYGMGQSGQLGHTVFG

SEQ ID NO: 3171785 - protein, 23 aa, Giardia lamblia
SVSSSPCFSWPSSTHHSAGRKQQ

SEQ ID NO: 3171786 - protein, 20 aa, Giardia lamblia
SVSVPAQFFQWLNRVLVHVT

SEQ ID NO: 3171787 - protein, 22 aa, Giardia lamblia
SVTEMIDGTFALYTFFNVLSDY

SEQ ID NO: 3171788 - protein, 19 aa, Giardia lamblia
SVTGCTRQPLKPTLSSGMP

SEQ ID NO: 3171789 - protein, 23 aa, Giardia lamblia
SVTGSRISVVFADGTSLQKDNSY

SEQ ID NO: 3171790 - protein, 17 aa, Giardia lamblia
SVTKFLRKYSALRALFS

SEQ ID NO: 3171791 - protein, 26 aa, Giardia lamblia
SVTRPFRGLICFSCAAKKEMEAKRKA

SEQ ID NO: 3171792 - protein, 31 aa, Giardia lamblia
SVTSLEFAKIAPFYIYYSLIFSSQFDSTNRV

SEQ ID NO: 3171793 - protein, 34 aa, Giardia lamblia
SVTTCKLGASLFVPSKICFDYNFGSSGLLFVSNE

SEQ ID NO: 3171794 - protein, 17 aa, Giardia lamblia
SVTYKLRTVVGHDAEMQ

SEQ ID NO: 3171795 - protein, 25 aa, Giardia lamblia
SVVALACEHCLIGVSMRNASIISLL

SEQ ID NO: 3171796 - protein, 22 aa, Giardia lamblia
SVVGFRHAKTVFNKQCAVVNRA

SEQ ID NO: 3171797 - protein, 20 aa, Giardia lamblia
SVVGTPFWMAPELIRGTEYN

SEQ ID NO: 3171798 - protein, 24 aa, Giardia lamblia
SVVHLCMMERLLGPMPDTVIEQMD

SEQ ID NO: 3171799 - protein, 18 aa, Giardia lamblia
SVVIKEFVGKKMSTNAKR

SEQ ID NO: 3171800 - protein, 23 aa, Giardia lamblia
SVVKDVMCCYDPQAVVLQCGADS

SEQ ID NO: 3171801 - protein, 18 aa, Giardia lamblia
SVVKILLNKEHGMHDMQY

SEQ ID NO: 3171802 - protein, 17 aa, Giardia lamblia
SVVPFVITTSSIILKLI

SEQ ID NO: 3171803 - protein, 19 aa, Giardia lamblia
SVVSQALLRWKEVLEDEDR

SEQ ID NO: 3171804 - protein, 20 aa, Giardia lamblia
SVVTCLRNLHRLGIAHRDVK

SEQ ID NO: 3171805 - protein, 18 aa, Giardia lamblia
SVYAGFQLQLGFGLPYTA

SEQ ID NO: 3171806 - protein, 21 aa, Giardia lamblia
SVYDNGLQRYSQAAIPALTSS

SEQ ID NO: 3171807 - protein, 26 aa, Giardia lamblia
SVYFPDRRIDMLPAILTEDICSLRSG

SEQ ID NO: 3171808 - protein, 21 aa, Giardia lamblia
SWDDPCDLLRYPIKTDENTTQ

SEQ ID NO: 3171809 - protein, 19 aa, Giardia lamblia
SWFDCITKRQYTTIRTGLR

SEQ ID NO: 3171810 - protein, 17 aa, Giardia lamblia
SWFSAIEKREYDHVRAN

SEQ ID NO: 3171811 - protein, 19 aa, Giardia lamblia
SWGATALMYALHHGKLDCA

SEQ ID NO: 3171812 - protein, 25 aa, Giardia lamblia
SWKTFMVAVVLDFHSLAAIRNHPAV

SEQ ID NO: 3171813 - protein, 22 aa, Giardia lamblia
SWLCIKADVKALVDKLLDSLPS

SEQ ID NO: 3171814 - protein, 17 aa, Giardia lamblia
SWLQRLESICDAISDRS

SEQ ID NO: 3171815 - protein, 23 aa, Giardia lamblia
SWPEVSQLLPIVSRHDCRAETAE

SEQ ID NO: 3171816 - protein, 24 aa, Giardia lamblia
SWREIFTTLLSMKFVDYREEITQM

SEQ ID NO: 3171817 - protein, 21 aa, Giardia lamblia
SWSAPSATRWPPATTACTSTG

SEQ ID NO: 3171818 - protein, 17 aa, Giardia lamblia
SWSETRSNITLCSMTVD

SEQ ID NO: 3171819 - protein, 24 aa, Giardia lamblia
SYANKHLMLLVVYFLSANKTFFNS

SEQ ID NO: 3171820 - protein, 17 aa, Giardia lamblia
SYAVRKKKIEELPDNLY

SEQ ID NO: 3171821 - protein, 23 aa, Giardia lamblia
SYAVSLWCKYFMGSLDRRTSGTG

SEQ ID NO: 3171822 - protein, 22 aa, Giardia lamblia
SYCKAHGIPSTMVQSTCAELAG

SEQ ID NO: 3171823 - protein, 17 aa, Giardia lamblia
SYCQPLPEFYCGDSDKS

SEQ ID NO: 3171824 - protein, 31 aa, Giardia lamblia
SYDDWCKYHMYRLWTKLRIFHRPICPWDLPL

SEQ ID NO: 3171825 - protein, 24 aa, Giardia lamblia
SYDECLVRERIAVRYTKDIQEVDA

SEQ ID NO: 3171826 - protein, 27 aa, Giardia lamblia
SYDKSHRAGTQFLFRKIYSAKPIYGES

SEQ ID NO: 3171827 - protein, 17 aa, Giardia lamblia
SYEAVMVLSPYLKDKYS

SEQ ID NO: 3171828 - protein, 32 aa, Giardia lamblia
SYEDCLYGTIAEHILPVTLCRISETSDGALQE

SEQ ID NO: 3171829 - protein, 24 aa, Giardia lamblia
SYEDRLASLWVMRELIQSRPTISM

SEQ ID NO: 3171830 - protein, 17 aa, Giardia lamblia
SYEGLYFVTKEDLERVG

SEQ ID NO: 3171831 - protein, 17 aa, Giardia lamblia
SYENALLRCDNRNLMNE

SEQ ID NO: 3171832 - protein, 18 aa, Giardia lamblia
SYESMFILRSCADKDPVM

SEQ ID NO: 3171833 - protein, 17 aa, Giardia lamblia
SYFKAVNTNQAFRINHL

SEQ ID NO: 3171834 - protein, 23 aa, Giardia lamblia
SYFKRFQVQFRRRREGKTDYQAR

SEQ ID NO: 3171835 - protein, 17 aa, Giardia lamblia
SYGKACKNFCIVGDFLI

SEQ ID NO: 3171836 - protein, 19 aa, Giardia lamblia
SYGLFLLGKKQKRQMQDSV

SEQ ID NO: 3171837 - protein, 18 aa, Giardia lamblia
SYGSLLRTKDLEIDRLQK

SEQ ID NO: 3171838 - protein, 19 aa, Giardia lamblia
SYGSLPYPPLLTAELPASP

SEQ ID NO: 3171839 - protein, 20 aa, Giardia lamblia
SYHERFSPKVLQAARSLSTI

SEQ ID NO: 3171840 - protein, 18 aa, Giardia lamblia
SYHTGAVYQLDWSPFYPS

SEQ ID NO: 3171841 - protein, 37 aa, Giardia lamblia
SYIRAGIKMPMFHIKLYTFQFLRGLAYMHSFNIANRD

SEQ ID NO: 3171842 - protein, 23 aa, Giardia lamblia
SYKAFEVLHFICAQFGVSVTLYI

SEQ ID NO: 3171843 - protein, 26 aa, Giardia lamblia
SYKSDRLKVSLVLSVPKTGPSAEETL

SEQ ID NO: 3171844 - protein, 24 aa, Giardia lamblia
SYLELLQQISCFKNAREDILLTLG

SEQ ID NO: 3171845 - protein, 18 aa, Giardia lamblia
SYLLFRDRFAGLKKSLQH

SEQ ID NO: 3171846 - protein, 24 aa, Giardia lamblia
SYLNRFTSIQLWSQLLQGFPVPSL

SEQ ID NO: 3171847 - protein, 18 aa, Giardia lamblia
SYLPKFLHSSLFMNDMET

SEQ ID NO: 3171848 - protein, 25 aa, Giardia lamblia
SYLSELPIACGITPTVTPGIGRHVD

SEQ ID NO: 3171849 - protein, 18 aa, Giardia lamblia
SYLTALVQITSRIKKWPL

SEQ ID NO: 3171850 - protein, 19 aa, Giardia lamblia
SYLWIRYVAFHVDRASIDK

SEQ ID NO: 3171851 - protein, 20 aa, Giardia lamblia
SYLYVLRRILLTLLDRTKEA

SEQ ID NO: 3171852 - protein, 20 aa, Giardia lamblia
SYMESWLEMRSRYNIDEVFS

SEQ ID NO: 3171853 - protein, 19 aa, Giardia lamblia
SYMTTIRSIFMVPFVSTEL

SEQ ID NO: 3171854 - protein, 20 aa, Giardia lamblia
SYPDAAICGTASFDGSCRLW

SEQ ID NO: 3171855 - protein, 20 aa, Giardia lamblia
SYPPSCHPSINPVYNEPSYN

SEQ ID NO: 3171856 - protein, 24 aa, Giardia lamblia
SYQFPPNFFMKVLRDPIRLLREIQ

SEQ ID NO: 3171857 - protein, 22 aa, Giardia lamblia
SYQLLREVRLVGQQDIREPATI

SEQ ID NO: 3171858 - protein, 18 aa, Giardia lamblia
SYQPEPGFPLAANEKDLT

SEQ ID NO: 3171859 - protein, 25 aa, Giardia lamblia
SYRLRDECRVHFGLPERSVVQENWS

SEQ ID NO: 3171860 - protein, 19 aa, Giardia lamblia
SYRSFKYLHDNICMAITNG

SEQ ID NO: 3171861 - protein, 25 aa, Giardia lamblia
SYSALPYRLRIVYRTLPNSTEGAFS

SEQ ID NO: 3171862 - protein, 23 aa, Giardia lamblia
SYSCGKGYTALMFAAQQGNTEII

SEQ ID NO: 3171863 - protein, 17 aa, Giardia lamblia
SYSCTFPELDINLRHFY

SEQ ID NO: 3171864 - protein, 19 aa, Giardia lamblia
SYSFLFAFLGLDKILSLDT

SEQ ID NO: 3171865 - protein, 21 aa, Giardia lamblia
SYSGLLKRIVNLMLNEDPQSR

SEQ ID NO: 3171866 - protein, 22 aa, Giardia lamblia
SYSHLCTKYTFQVHAEEILVSS

SEQ ID NO: 3171867 - protein, 24 aa, Giardia lamblia
SYSKHLAKLIKHMLSINADDRPSV

SEQ ID NO: 3171868 - protein, 25 aa, Giardia lamblia
SYSLRPGKLSLWVKRRNTCPLAEQF

SEQ ID NO: 3171869 - protein, 26 aa, Giardia lamblia
SYSRELYSRMPVIHFLPDEQGKDVDP

SEQ ID NO: 3171870 - protein, 18 aa, Giardia lamblia
SYTNPAWKDVPFPYPDGR

SEQ ID NO: 3171871 - protein, 21 aa, Giardia lamblia
SYTSLMTAIFGLRAECAAILA

SEQ ID NO: 3171872 - protein, 17 aa, Giardia lamblia
SYTSSVMRLSGAQQESF

SEQ ID NO: 3171873 - protein, 17 aa, Giardia lamblia
SYVADMFLKKASSNAPA

SEQ ID NO: 3171874 - protein, 20 aa, Giardia lamblia
SYVCDVNGWSFVKTNSHYYD

SEQ ID NO: 3171875 - protein, 20 aa, Giardia lamblia
SYVEGIPMHAIKDIDIEAAN

SEQ ID NO: 3171876 - protein, 19 aa, Giardia lamblia
SYVIPRLTLGSLLVSTCEV

SEQ ID NO: 3171877 - protein, 19 aa, Giardia lamblia
SYVLTEWVNAVNVWMIPCT

SEQ ID NO: 3171878 - protein, 22 aa, Giardia lamblia
SYVPQCVILEGFTVVDLTGISG

SEQ ID NO: 3171879 - protein, 20 aa, Giardia lamblia
SYVSDNYIFYGFPRSQEVNI

SEQ ID NO: 3171880 - protein, 20 aa, Giardia lamblia
SYVTSCPDVRVKVLVHPDTS

SEQ ID NO: 3171881 - protein, 22 aa, Giardia lamblia
SYWIRRYRYEFGCSDCLPRISD

SEQ ID NO: 3171882 - protein, 17 aa, Giardia lamblia
SYWRMLRKEYRELDTNF

SEQ ID NO: 3171883 - protein, 19 aa, Giardia lamblia
SYYESCLDASINVIIHHSR

SEQ ID NO: 3171884 - protein, 25 aa, Giardia lamblia
SYYRGAHGCLLVFDVTKRTSFEHCT

SEQ ID NO: 3171885 - protein, 17 aa, Giardia lamblia
TAAASWRQMWAELYGLP

SEQ ID NO: 3171886 - protein, 17 aa, Giardia lamblia
TAACILKALQEDSQCDT

SEQ ID NO: 3171887 - protein, 22 aa, Giardia lamblia
TAADFEGAISIADVRSEVRKFL

SEQ ID NO: 3171888 - protein, 25 aa, Giardia lamblia
TAADPKYLYPIWSLEEVESVSKESL

SEQ ID NO: 3171889 - protein, 18 aa, Giardia lamblia
TAAFKEIMANAAKNGPKG

SEQ ID NO: 3171890 - protein, 25 aa, Giardia lamblia
TAAGPTFCITYLMGVLDGLTHRDDS

SEQ ID NO: 3171891 - protein, 26 aa, Giardia lamblia
TAAIKTIREAFEWTGPSIVMAYAPCI

SEQ ID NO: 3171892 - protein, 23 aa, Giardia lamblia
TAALIPQFWTLIGAVATFSLYLD

SEQ ID NO: 3171893 - protein, 20 aa, Giardia lamblia
TAALKRRLIPVAGNAQPAHG

SEQ ID NO: 3171894 - protein, 24 aa, Giardia lamblia
TAAPSTRSTGFWFGDRSETTRNML

SEQ ID NO: 3171895 - protein, 24 aa, Giardia lamblia
TAAPTRPQAQLGFSTMSLKPFFGE

SEQ ID NO: 3171896 - protein, 18 aa, Giardia lamblia
TAAQGIGGPAIWQMENCR

SEQ ID NO: 3171897 - protein, 17 aa, Giardia lamblia
TAARVPAPIPTTLQDGD

SEQ ID NO: 3171898 - protein, 18 aa, Giardia lamblia
TAAYIEITHYLEGFVQSS

SEQ ID NO: 3171899 - protein, 28 aa, Giardia lamblia
TACCGAAPDLWSLGIILYEMMALAKPSH

SEQ ID NO: 3171900 - protein, 24 aa, Giardia lamblia
TACNKIDASFSMRWSTLMEKDTPE

SEQ ID NO: 3171901 - protein, 29 aa, Giardia lamblia
TACSSGIIPGVFYYYWKHYDLPEEELVNA

SEQ ID NO: 3171902 - protein, 24 aa, Giardia lamblia
TACYKTFRRFFGGQSMLRVHIPGR

SEQ ID NO: 3171903 - protein, 24 aa, Giardia lamblia
TADDRGWTALMCATCSGNKSMIAL

SEQ ID NO: 3171904 - protein, 22 aa, Giardia lamblia
TADELTERFGLAPATSSDLLDF

SEQ ID NO: 3171905 - protein, 25 aa, Giardia lamblia
TADSDPWLSLLHEFKQHYTGKTTRF

SEQ ID NO: 3171906 - protein, 18 aa, Giardia lamblia
TADYRNLIITSFKVSKAF

SEQ ID NO: 3171907 - protein, 24 aa, Giardia lamblia
TAEEHVIRFLKRCTDISRWMRHRN

SEQ ID NO: 3171908 - protein, 23 aa, Giardia lamblia
TAEGETALMLAVRSRSQDMVRIL

SEQ ID NO: 3171909 - protein, 20 aa, Giardia lamblia
TAEGIVLCLLGGAKATRFPK

SEQ ID NO: 3171910 - protein, 22 aa, Giardia lamblia
TAEGKTALMLAVYNNATECVEL

SEQ ID NO: 3171911 - protein, 27 aa, Giardia lamblia
TAEIARLRSLLYYNEQKLKAWAKIKSK

SEQ ID NO: 3171912 - protein, 17 aa, Giardia lamblia
TAELCVQTFTVLNVLGR

SEQ ID NO: 3171913 - protein, 18 aa, Giardia lamblia
TAELLRGLESSYCDVQNI

SEQ ID NO: 3171914 - protein, 25 aa, Giardia lamblia
TAELPESLLELDLRSNLICTFESVA

SEQ ID NO: 3171915 - protein, 23 aa, Giardia lamblia
TAEVQRLSDIVTRKDREIDALKR

SEQ ID NO: 3171916 - protein, 22 aa, Giardia lamblia
TAEWLRARLENLATAPSKSKET

SEQ ID NO: 3171917 - protein, 19 aa, Giardia lamblia
TAFCPLPRAMGRNVAFSNM

SEQ ID NO: 3171918 - protein, 18 aa, Giardia lamblia
TAFELAFNRENYQMAMLL

SEQ ID NO: 3171919 - protein, 19 aa, Giardia lamblia
TAFIELPSGNILSGCGTGE

SEQ ID NO: 3171920 - protein, 17 aa, Giardia lamblia
TAFTCLRSTVEEKDKET

SEQ ID NO: 3171921 - protein, 26 aa, Giardia lamblia
TAFVKEVRAGQRLRQTPAVFTTNRVS

SEQ ID NO: 3171922 - protein, 24 aa, Giardia lamblia
TAGDILHKIAFSYIHVLTKDERND

SEQ ID NO: 3171923 - protein, 32 aa, Giardia lamblia
TAGENIKGWGLKGRTALMGAALHNRLEIVEIL

SEQ ID NO: 3171924 - protein, 23 aa, Giardia lamblia
TAGFRIEDSWLLDRPPVTAMEAA

SEQ ID NO: 3171925 - protein, 19 aa, Giardia lamblia
TAGGARYETQVSFPGAAAP

SEQ ID NO: 3171926 - protein, 26 aa, Giardia lamblia
TAGILPPECILWRIIAQTLSVYHYLQ

SEQ ID NO: 3171927 - protein, 18 aa, Giardia lamblia
TAGLSLPLLADRDSLPTS

SEQ ID NO: 3171928 - protein, 17 aa, Giardia lamblia
TAGTLAYLKGYASIAEW

SEQ ID NO: 3171929 - protein, 18 aa, Giardia lamblia
TAGVLVMTTEILRNMLHQ

SEQ ID NO: 3171930 - protein, 17 aa, Giardia lamblia
TAHCVHNNLLIIGTDLG

SEQ ID NO: 3171931 - protein, 21 aa, Giardia lamblia
TAHEYVKLLLPQYAKDKKHLA

SEQ ID NO: 3171932 - protein, 19 aa, Giardia lamblia
TAHGYAWIIREAAVMLVQS

SEQ ID NO: 3171933 - protein, 18 aa, Giardia lamblia
TAHRRLNSSIPYSVSNST

SEQ ID NO: 3171934 - protein, 24 aa, Giardia lamblia
TAIDIVSCLQLNSSFKLFIRSFDR

SEQ ID NO: 3171935 - protein, 30 aa, Giardia lamblia
TAIFKCLIALKTRNCIIFSPHHRAVKSTIH

SEQ ID NO: 3171936 - protein, 17 aa, Giardia lamblia
TAIGCSESTVKNLITAN

SEQ ID NO: 3171937 - protein, 28 aa, Giardia lamblia
TAILGYYSPILFKFLLQSSRLSESLSEM

SEQ ID NO: 3171938 - protein, 25 aa, Giardia lamblia
TAIPLPKTFLGIFFADADPNTLASR

SEQ ID NO: 3171939 - protein, 25 aa, Giardia lamblia
TAITCLMETLPLGFSLAMDIITMSR

SEQ ID NO: 3171940 - protein, 17 aa, Giardia lamblia
TAIYEVMEQGTISVAKA

SEQ ID NO: 3171941 - protein, 19 aa, Giardia lamblia
TAKLKRMVTQYQTNEELLV

SEQ ID NO: 3171942 - protein, 22 aa, Giardia lamblia
TAKLMRFDHIIFILSGKGGAGK

SEQ ID NO: 3171943 - protein, 20 aa, Giardia lamblia
TAKPKKFAINDFLRDPSAKN

SEQ ID NO: 3171944 - protein, 18 aa, Giardia lamblia
TAKPRFDSYMSQESGLPR

SEQ ID NO: 3171945 - protein, 23 aa, Giardia lamblia
TAKRAVCSLCNSLISHAVLDRMM

SEQ ID NO: 3171946 - protein, 17 aa, Giardia lamblia
TAKRIIADLARCEKPFN

SEQ ID NO: 3171947 - protein, 17 aa, Giardia lamblia
TALAIALAKGNLAAAKL

SEQ ID NO: 3171948 - protein, 23 aa, Giardia lamblia
TALCDEARLKLTMQRDSIESSIA

SEQ ID NO: 3171949 - protein, 18 aa, Giardia lamblia
TALCILPVSPAPILVAGD

SEQ ID NO: 3171950 - protein, 17 aa, Giardia lamblia
TALDIARQLGQKKIIAI

SEQ ID NO: 3171951 - protein, 23 aa, Giardia lamblia
TALGLPPLMKRLIDFKISNSITF

SEQ ID NO: 3171952 - protein, 19 aa, Giardia lamblia
TALHLKPLLLPDTPSSSQL

SEQ ID NO: 3171953 - protein, 28 aa, Giardia lamblia
TALHMACKRGHTSIAELLAPIQAGCVQT

SEQ ID NO: 3171954 - protein, 20 aa, Giardia lamblia
TALILYKRVLLFVPADPAIW

SEQ ID NO: 3171955 - protein, 17 aa, Giardia lamblia
TALIRAVFTGDVELVQL

SEQ ID NO: 3171956 - protein, 17 aa, Giardia lamblia
TALLYHFVDAVSPFLTF

SEQ ID NO: 3171957 - protein, 24 aa, Giardia lamblia
TALMCAAWRGSNKAALVLAKVEAG

SEQ ID NO: 3171958 - protein, 17 aa, Giardia lamblia
TALMFAAQYNRPQIVSL

SEQ ID NO: 3171959 - protein, 20 aa, Giardia lamblia
TALMFACRIGNLAAAKMLLP

SEQ ID NO: 3171960 - protein, 18 aa, Giardia lamblia
TALMHAVKYNRQRIVSVL

SEQ ID NO: 3171961 - protein, 17 aa, Giardia lamblia
TALMIAVACGHTQIVQD

SEQ ID NO: 3171962 - protein, 17 aa, Giardia lamblia
TALMICAQLGNLDGARL

SEQ ID NO: 3171963 - protein, 18 aa, Giardia lamblia
TALMLAAAAGAVEFVKGM

SEQ ID NO: 3171964 - protein, 17 aa, Giardia lamblia
TALMLAAVCNEGEACKR

SEQ ID NO: 3171965 - protein, 20 aa, Giardia lamblia
TALMLACEFHQLHIANSLIQ

SEQ ID NO: 3171966 - protein, 17 aa, Giardia lamblia
TALMLAIPTRNEEIIHM

SEQ ID NO: 3171967 - protein, 17 aa, Giardia lamblia
TALMLATRAQDVQMMEL

SEQ ID NO: 3171968 - protein, 18 aa, Giardia lamblia
TALMLAVRSGYSRCIHIL

SEQ ID NO: 3171969 - protein, 25 aa, Giardia lamblia
TALMNACALSLLRASQILVQYEAGQ

SEQ ID NO: 3171970 - protein, 23 aa, Giardia lamblia
TALMQCVCSDYSLGRASIPDIVN

SEQ ID NO: 3171971 - protein, 19 aa, Giardia lamblia
TALMQSVRLFDKHLVQLLL

SEQ ID NO: 3171972 - protein, 18 aa, Giardia lamblia
TALMYACMHGHPECVELL

SEQ ID NO: 3171973 - protein, 17 aa, Giardia lamblia
TALMYAVLAGHTKAIEH

SEQ ID NO: 3171974 - protein, 17 aa, Giardia lamblia
TALSLAAEHGCCALIIG

SEQ ID NO: 3171975 - protein, 21 aa, Giardia lamblia
TALSLALKEEHYQAAKVLREY

SEQ ID NO: 3171976 - protein, 22 aa, Giardia lamblia
TALSQCRGGAYLVTGGGDGRLC

SEQ ID NO: 3171977 - protein, 35 aa, Giardia lamblia
TALTFPSSGAFLFIGDAAGRIFIWNTVSLAFIQEL

SEQ ID NO: 3171978 - protein, 24 aa, Giardia lamblia
TALTPAWVNYEFFIKLSKSLSLET

SEQ ID NO: 3171979 - protein, 25 aa, Giardia lamblia
TALTPKTAWLDFLRKTISRKNNTAS

SEQ ID NO: 3171980 - protein, 18 aa, Giardia lamblia
TALVLMLFNYKSHLCLIF

SEQ ID NO: 3171981 - protein, 25 aa, Giardia lamblia
TALVRRCLMSDSMVRLSSSGVLSAG

SEQ ID NO: 3171982 - protein, 18 aa, Giardia lamblia
TALWSATVDRLVDDPQPW

SEQ ID NO: 3171983 - protein, 17 aa, Giardia lamblia
TAMAHASLRYCHVFYAV

SEQ ID NO: 3171984 - protein, 26 aa, Giardia lamblia
TAMCRDCAAARQCCQVCYCDLSTLMV

SEQ ID NO: 3171985 - protein, 18 aa, Giardia lamblia
TAMFEFRAILIPKESDGY

SEQ ID NO: 3171986 - protein, 24 aa, Giardia lamblia
TAPDIPRPLIVEGPVDTNCNPYRT

SEQ ID NO: 3171987 - protein, 27 aa, Giardia lamblia
TAPGHCFRLYSPGLFQRMHDFPVPEIL

SEQ ID NO: 3171988 - protein, 21 aa, Giardia lamblia
TAPIKRPVSVLQQVIKTRSQS

SEQ ID NO: 3171989 - protein, 23 aa, Giardia lamblia
TAPKFKFTAPFDVEIAMLHGRAE

SEQ ID NO: 3171990 - protein, 19 aa, Giardia lamblia
TAPLKPWKPAHDPYLHTSY

SEQ ID NO: 3171991 - protein, 18 aa, Giardia lamblia
TAPSFYIKHMPKLYDPSP

SEQ ID NO: 3171992 - protein, 19 aa, Giardia lamblia
TAPVETVFTLLSRSPYASS

SEQ ID NO: 3171993 - protein, 18 aa, Giardia lamblia
TAQAFCLDENSALLTESH

SEQ ID NO: 3171994 - protein, 25 aa, Giardia lamblia
TAQEKLCKLQELLDKKEEELLWMSQ

SEQ ID NO: 3171995 - protein, 17 aa, Giardia lamblia
TAQTIAIALNNPALQAV

SEQ ID NO: 3171996 - protein, 24 aa, Giardia lamblia
TAQVYRLLADRLRRITLDDLSDLL

SEQ ID NO: 3171997 - protein, 23 aa, Giardia lamblia
TARELLRYKPFLDLDENSIEQTL

SEQ ID NO: 3171998 - protein, 23 aa, Giardia lamblia
TARELRLAFTAWHMKSQAILALQ

SEQ ID NO: 3171999 - protein, 24 aa, Giardia lamblia
TARMLHTFEREFAFRMNERIKEMM

SEQ ID NO: 3172000 - protein, 22 aa, Giardia lamblia
TARPMSAGSIYAGVGSDRNFSG

SEQ ID NO: 3172001 - protein, 23 aa, Giardia lamblia
TASDLRAQLLLVNNTISPVKEAI

SEQ ID NO: 3172002 - protein, 17 aa, Giardia lamblia
TASDMWSLGIIIYELVS

SEQ ID NO: 3172003 - protein, 22 aa, Giardia lamblia
TASEEKRKLLLQQKEQLEREMA

SEQ ID NO: 3172004 - protein, 27 aa, Giardia lamblia
TASFAPAIYGHWIVKRGIVLQLLQGVP

SEQ ID NO: 3172005 - protein, 27 aa, Giardia lamblia
TASFCILKGMFRICFLTLPNPHPMVIQ

SEQ ID NO: 3172006 - protein, 18 aa, Giardia lamblia
TASFCLNLIDGIYTNVTP

SEQ ID NO: 3172007 - protein, 26 aa, Giardia lamblia
TASIHKSAAISRFYSHDEVKDLLKQL

SEQ ID NO: 3172008 - protein, 28 aa, Giardia lamblia
TASLYHERCEPLSLGKYSFLERHLVLVC

SEQ ID NO: 3172009 - protein, 23 aa, Giardia lamblia
TASNFRATDFFDELAAEESQVCP

SEQ ID NO: 3172010 - protein, 18 aa, Giardia lamblia
TASPEVREKYALDSHSFT

SEQ ID NO: 3172011 - protein, 24 aa, Giardia lamblia
TASQEFFYRQVVSPVVKDFLDGFN

SEQ ID NO: 3172012 - protein, 26 aa, Giardia lamblia
TASQLPSRIDPLIQRYNRALESQQRL

SEQ ID NO: 3172013 - protein, 20 aa, Giardia lamblia
TASRCFYGYISHSASRAQEA

SEQ ID NO: 3172014 - protein, 17 aa, Giardia lamblia
TASTYPRISFGIYGFDI

SEQ ID NO: 3172015 - protein, 26 aa, Giardia lamblia
TASYVWRLAAEIVIPCYPGVPLTAPS

SEQ ID NO: 3172016 - protein, 17 aa, Giardia lamblia
TATECRRASELLTVAQA

SEQ ID NO: 3172017 - protein, 32 aa, Giardia lamblia
TATEPAAIWALGCLAWSFADPQSFYSKEQLAA

SEQ ID NO: 3172018 - protein, 28 aa, Giardia lamblia
TATGPTFCITYLMGVLDGFAHRDDSRRQ

SEQ ID NO: 3172019 - protein, 19 aa, Giardia lamblia
TATKCYRFDHVFDSHATQA

SEQ ID NO: 3172020 - protein, 24 aa, Giardia lamblia
TATLKELQKIGALVVSLRHGVEGC

SEQ ID NO: 3172021 - protein, 18 aa, Giardia lamblia
TATLTLKVMTSFVDYNVA

SEQ ID NO: 3172022 - protein, 24 aa, Giardia lamblia
TATRFPICSLIAARGRGKSASLGL

SEQ ID NO: 3172023 - protein, 17 aa, Giardia lamblia
TATRLAKDMSVALEMLS

SEQ ID NO: 3172024 - protein, 25 aa, Giardia lamblia
TAVFRVPLFFAQRHRLGLPTDRFVF

SEQ ID NO: 3172025 - protein, 19 aa, Giardia lamblia
TAVKLPFYGSYSEKDPVQI

SEQ ID NO: 3172026 - protein, 25 aa, Giardia lamblia
TAVLPRVAYIKMIFNQRRSLLSGNA

SEQ ID NO: 3172027 - protein, 17 aa, Giardia lamblia
TAVPISLHLHVCHADTT

SEQ ID NO: 3172028 - protein, 22 aa, Giardia lamblia
TAVRLLPLVRQWLLEPLKDLVA

SEQ ID NO: 3172029 - protein, 19 aa, Giardia lamblia
TAVSSDWEFIMAFLNTLYL

SEQ ID NO: 3172030 - protein, 24 aa, Giardia lamblia
TAYADLILISAIKAYKQEVVEFIC

SEQ ID NO: 3172031 - protein, 26 aa, Giardia lamblia
TAYKLKLFLYRFGQKAFLYNPELPVS

SEQ ID NO: 3172032 - protein, 26 aa, Giardia lamblia
TAYTCVESSYFLRVLLAGSTKEVSDR

SEQ ID NO: 3172033 - protein, 25 aa, Giardia lamblia
TCAEVDPAFWVTYFSKVTFPIKLTE

SEQ ID NO: 3172034 - protein, 29 aa, Giardia lamblia
TCARDSLLRFWKLPDIYALNDQSVPLHRR

SEQ ID NO: 3172035 - protein, 18 aa, Giardia lamblia
TCDADPPTAMPLNSSLIN

SEQ ID NO: 3172036 - protein, 18 aa, Giardia lamblia
TCFEDWGSTIDSFKRGVE

SEQ ID NO: 3172037 - protein, 18 aa, Giardia lamblia
TCGGGRLALCKYEPPAER

SEQ ID NO: 3172038 - protein, 19 aa, Giardia lamblia
TCGIGPHALLLAKRFNFTN

SEQ ID NO: 3172039 - protein, 19 aa, Giardia lamblia
TCGIPSPVVNHGLKQFSIN

SEQ ID NO: 3172040 - protein, 26 aa, Giardia lamblia
TCIPLRPVYCRAISAGIQGCRVPALT

SEQ ID NO: 3172041 - protein, 26 aa, Giardia lamblia
TCISCGHCASVCRTAAISMFGILPDT

SEQ ID NO: 3172042 - protein, 27 aa, Giardia lamblia
TCLDLDLEEVASCFYPEKACYVQTDGS

SEQ ID NO: 3172043 - protein, 25 aa, Giardia lamblia
TCLKLISIEFTDSWIRRQASKEASL

SEQ ID NO: 3172044 - protein, 18 aa, Giardia lamblia
TCLLKRKAYLDLDAVDNH

SEQ ID NO: 3172045 - protein, 17 aa, Giardia lamblia
TCLPGRRASIVVDGHTL

SEQ ID NO: 3172046 - protein, 21 aa, Giardia lamblia
TCLRGILRTVLLLSAPLCTSS

SEQ ID NO: 3172047 - protein, 19 aa, Giardia lamblia
TCNVPLRNALCGYQTELKT

SEQ ID NO: 3172048 - protein, 22 aa, Giardia lamblia
TCPPVYQAHNWAHGVYIGSSIE

SEQ ID NO: 3172049 - protein, 24 aa, Giardia lamblia
TCPVFLACYQSYYSQEEFDKLRFW

SEQ ID NO: 3172050 - protein, 20 aa, Giardia lamblia
TCQKCARLQAYITALEEENR

SEQ ID NO: 3172051 - protein, 23 aa, Giardia lamblia
TCSEAECSPSFVALKIASKTQRD

SEQ ID NO: 3172052 - protein, 33 aa, Giardia lamblia
TCSIPKFTLESLLHCLSEILGRGASGILYALEG

SEQ ID NO: 3172053 - protein, 21 aa, Giardia lamblia
TCSKASGVLLPGAEESLECGI

SEQ ID NO: 3172054 - protein, 20 aa, Giardia lamblia
TCSNPAFVAGTFYEGGSKVL

SEQ ID NO: 3172055 - protein, 21 aa, Giardia lamblia
TCSPLCVLTVFPYAHRQGFIV

SEQ ID NO: 3172056 - protein, 19 aa, Giardia lamblia
TCSQKHLFFTFDISVDHLF

SEQ ID NO: 3172057 - protein, 31 aa, Giardia lamblia
TCSTPFSKKCWTEWRSTPGPGEYSVQSHKAI

SEQ ID NO: 3172058 - protein, 20 aa, Giardia lamblia
TCSVCLGSLSNIVFYRCNHI

SEQ ID NO: 3172059 - protein, 21 aa, Giardia lamblia
TCTEPSFKAHILLQAQLVRSS

SEQ ID NO: 3172060 - protein, 20 aa, Giardia lamblia
TCTRRLRDATILDVKPYLAA

SEQ ID NO: 3172061 - protein, 20 aa, Giardia lamblia
TCTTKSLPIFGMYAKPATLS

SEQ ID NO: 3172062 - protein, 17 aa, Giardia lamblia
TCVVYSVFLNFLQWIYS

SEQ ID NO: 3172063 - protein, 18 aa, Giardia lamblia
TCYDGFIASLNRYLNTLG

SEQ ID NO: 3172064 - protein, 17 aa, Giardia lamblia
TCYRNSAIMRKVVTDSV

SEQ ID NO: 3172065 - protein, 20 aa, Giardia lamblia
TCYYRIHNVRCRPCEASIPL

SEQ ID NO: 3172066 - protein, 17 aa, Giardia lamblia
TDAFPAALASSGVDNTA

SEQ ID NO: 3172067 - protein, 25 aa, Giardia lamblia
TDAGSLLRRFICYDSSETYEAMLDP

SEQ ID NO: 3172068 - protein, 25 aa, Giardia lamblia
TDAIYRLRADLDFLTEENAHMHVSM

SEQ ID NO: 3172069 - protein, 28 aa, Giardia lamblia
TDAVDMGLRDSHIMREAAGGRFLSSTEY

SEQ ID NO: 3172070 - protein, 33 aa, Giardia lamblia
TDCIFIRELPVIAGWVGCGVWDAAVIMSRYFVK

SEQ ID NO: 3172071 - protein, 18 aa, Giardia lamblia
TDCTRILLEKEGGMQNNG

SEQ ID NO: 3172072 - protein, 18 aa, Giardia lamblia
TDCVKLLLEKEGGMRSDY

SEQ ID NO: 3172073 - protein, 32 aa, Giardia lamblia
TDDDLKIAIVMSRKLKNMYARLLQRHTSIAVC

SEQ ID NO: 3172074 - protein, 25 aa, Giardia lamblia
TDDEVKELMELLGGLQQETQLLRQQ

SEQ ID NO: 3172075 - protein, 18 aa, Giardia lamblia
TDDSDILMYLIRHGCNDV

SEQ ID NO: 3172076 - protein, 20 aa, Giardia lamblia
TDEALFVWRCRVCGESAQSK

SEQ ID NO: 3172077 - protein, 26 aa, Giardia lamblia
TDEASFQPIIKWLHQGIRLKGPKQLK

SEQ ID NO: 3172078 - protein, 28 aa, Giardia lamblia
TDEGYMLKYRLAQMLLYDKSIPKPTVKP

SEQ ID NO: 3172079 - protein, 28 aa, Giardia lamblia
TDELFTWLYHKICLLADSLVMVITDAIP

SEQ ID NO: 3172080 - protein, 23 aa, Giardia lamblia
TDERCILCSDTLSGMEGCATCVS

SEQ ID NO: 3172081 - protein, 30 aa, Giardia lamblia
TDESRFPPGTYLRIELEGIDHEFAQNYSSI

SEQ ID NO: 3172082 - protein, 25 aa, Giardia lamblia
TDFGIHCRYWKTAAISSTKESQYVA

SEQ ID NO: 3172083 - protein, 19 aa, Giardia lamblia
TDFLRRQYCDELSSEEDAL

SEQ ID NO: 3172084 - protein, 25 aa, Giardia lamblia
TDFPLFDFYEPVFGYGVIDSTITAA

SEQ ID NO: 3172085 - protein, 26 aa, Giardia lamblia
TDGAECYRRSLIFALGKVWSELFPQD

SEQ ID NO: 3172086 - protein, 22 aa, Giardia lamblia
TDGCICSWTLVKTDLRLVSKID

SEQ ID NO: 3172087 - protein, 24 aa, Giardia lamblia
TDGHARTALAMKAQTFLTYIQSFE

SEQ ID NO: 3172088 - protein, 25 aa, Giardia lamblia
TDGNGVISFVEFVRLMVTKSRNTDS

SEQ ID NO: 3172089 - protein, 32 aa, Giardia lamblia
TDGPFWRATYQCARYLLALYVAYGSAVLEAGL

SEQ ID NO: 3172090 - protein, 25 aa, Giardia lamblia
TDGRDAFPALGFKFKYDDSIFVCRS

SEQ ID NO: 3172091 - protein, 18 aa, Giardia lamblia
TDGRRSSYVKQYSRSHVR

SEQ ID NO: 3172092 - protein, 24 aa, Giardia lamblia
TDGTRFLLYIPVDFNEPDMTLDLT

SEQ ID NO: 3172093 - protein, 25 aa, Giardia lamblia
TDGYARCCNRGVTTVISRGLFDESP

SEQ ID NO: 3172094 - protein, 22 aa, Giardia lamblia
TDHFRSGLCTPEKYEFDVLDLS

SEQ ID NO: 3172095 - protein, 18 aa, Giardia lamblia
TDICFLKDNILVETERER

SEQ ID NO: 3172096 - protein, 19 aa, Giardia lamblia
TDIERCFDKRMAPILRTLW

SEQ ID NO: 3172097 - protein, 18 aa, Giardia lamblia
TDIGQCFIGIASLLEQLG

SEQ ID NO: 3172098 - protein, 24 aa, Giardia lamblia
TDIIGMSALMWAAHQGHKEVVEFL

SEQ ID NO: 3172099 - protein, 17 aa, Giardia lamblia
TDIILMPVLYKDLFWKL

SEQ ID NO: 3172100 - protein, 23 aa, Giardia lamblia
TDILAGRHVYLFGISEPKLVGKE

SEQ ID NO: 3172101 - protein, 18 aa, Giardia lamblia
TDILSFRGVLNLWRERIS

SEQ ID NO: 3172102 - protein, 18 aa, Giardia lamblia
TDIMLRIDREGLESALAL

SEQ ID NO: 3172103 - protein, 17 aa, Giardia lamblia
TDIPGLLTYMDETPGHS

SEQ ID NO: 3172104 - protein, 17 aa, Giardia lamblia
TDIPRLSFIVGPNGSGK

SEQ ID NO: 3172105 - protein, 20 aa, Giardia lamblia
TDIREIIKVMNFSIQTGTCL

SEQ ID NO: 3172106 - protein, 28 aa, Giardia lamblia
TDIWSFGSLLLHLCKPDLLINQQNESLD

SEQ ID NO: 3172107 - protein, 30 aa, Giardia lamblia
TDIWSLGATLYEFFTLTPLTYLSQLESAGK

SEQ ID NO: 3172108 - protein, 24 aa, Giardia lamblia
TDKDGRTALSYAVSAGNAEATSLL

SEQ ID NO: 3172109 - protein, 18 aa, Giardia lamblia
TDKHKMTALMHAASQGHR

SEQ ID NO: 3172110 - protein, 23 aa, Giardia lamblia
TDKLLFLRDFCALVSQRSSPDTK

SEQ ID NO: 3172111 - protein, 23 aa, Giardia lamblia
TDKRGRTALMIAAENDWPEVLVP

SEQ ID NO: 3172112 - protein, 27 aa, Giardia lamblia
TDKWRVKGLKALYLLVQELLYAITNSF

SEQ ID NO: 3172113 - protein, 22 aa, Giardia lamblia
TDKYGWTALMWAVCNREPGCVR

SEQ ID NO: 3172114 - protein, 23 aa, Giardia lamblia
TDKYSRGALFYAASNLHITTIRI

SEQ ID NO: 3172115 - protein, 22 aa, Giardia lamblia
TDLAHIVGLLVAFPNLQTYNTV

SEQ ID NO: 3172116 - protein, 24 aa, Giardia lamblia
TDLCKSHYTMLILESIVLDDKFLF

SEQ ID NO: 3172117 - protein, 25 aa, Giardia lamblia
TDLECQGQEALLVSELHMMAAQKRA

SEQ ID NO: 3172118 - protein, 19 aa, Giardia lamblia
TDLEFLLNISRGCVTVETL

SEQ ID NO: 3172119 - protein, 26 aa, Giardia lamblia
TDLMKACIEEDAFSLFCHMTQTRATD

SEQ ID NO: 3172120 - protein, 18 aa, Giardia lamblia
TDLMPVFLTIIAFGITNP

SEQ ID NO: 3172121 - protein, 19 aa, Giardia lamblia
TDLMSMKILLNILLRRTFE

SEQ ID NO: 3172122 - protein, 25 aa, Giardia lamblia
TDLPLRVSLKISPKESFSTLHELLL

SEQ ID NO: 3172123 - protein, 24 aa, Giardia lamblia
TDLPRLPFNEMRPSANGKSMTTDQ

SEQ ID NO: 3172124 - protein, 24 aa, Giardia lamblia
TDLPWLCGLYLITGICIDERSFRF

SEQ ID NO: 3172125 - protein, 31 aa, Giardia lamblia
TDLREVVYLRGLRNLSVLWLCENPIADHPQY

SEQ ID NO: 3172126 - protein, 26 aa, Giardia lamblia
TDLRNVYVVVCMHSLKARTRGITASE

SEQ ID NO: 3172127 - protein, 18 aa, Giardia lamblia
TDLYRLHVHPLRVCEEDS

SEQ ID NO: 3172128 - protein, 26 aa, Giardia lamblia
TDMCDLETLPLLSLLANHILGEVATT

SEQ ID NO: 3172129 - protein, 17 aa, Giardia lamblia
TDMLPSHVLEGMEAALC

SEQ ID NO: 3172130 - protein, 25 aa, Giardia lamblia
TDMSYCVVRLTTLLDLASGALVLNL

SEQ ID NO: 3172131 - protein, 24 aa, Giardia lamblia
TDNTMVWKWARPKISEAGSLRLIE

SEQ ID NO: 3172132 - protein, 22 aa, Giardia lamblia
TDPELAISILTAHKFGKKIVKD

SEQ ID NO: 3172133 - protein, 18 aa, Giardia lamblia
TDPLRLIKERNKRKGLNI

SEQ ID NO: 3172134 - protein, 20 aa, Giardia lamblia
TDPRAAPLLEHELLCKDYQS

SEQ ID NO: 3172135 - protein, 19 aa, Giardia lamblia
TDPRLVFVQDWKPDLILVR

SEQ ID NO: 3172136 - protein, 20 aa, Giardia lamblia
TDQALKCNFCCAKRRSLLPC

SEQ ID NO: 3172137 - protein, 19 aa, Giardia lamblia
TDQLGRTALMWAAMHNHGE

SEQ ID NO: 3172138 - protein, 25 aa, Giardia lamblia
TDQLKTYRMYMGEKSPLMPQTEPDF

SEQ ID NO: 3172139 - protein, 20 aa, Giardia lamblia
TDQMLKTMCDTLLIDTQMVA

SEQ ID NO: 3172140 - protein, 19 aa, Giardia lamblia
TDQPELWLNRFDTAHRETL

SEQ ID NO: 3172141 - protein, 25 aa, Giardia lamblia
TDQVKRKMPAYSLAGRTNQARPNTN

SEQ ID NO: 3172142 - protein, 26 aa, Giardia lamblia
TDRNLRYYLTMIMKRQKLYGKLDKEL

SEQ ID NO: 3172143 - protein, 24 aa, Giardia lamblia
TDSAHCSLFLWFNEKLHKLEVVHS

SEQ ID NO: 3172144 - protein, 24 aa, Giardia lamblia
TDSDKVLVSPAWQDKKGVTKVPPV

SEQ ID NO: 3172145 - protein, 24 aa, Giardia lamblia
TDSRMKYSDICDSLKSSGTELSDQ

SEQ ID NO: 3172146 - protein, 17 aa, Giardia lamblia
TDSSLACSAQHFCGQAL

SEQ ID NO: 3172147 - protein, 24 aa, Giardia lamblia
TDSVMPKIQMELVEETIYSESDAN

SEQ ID NO: 3172148 - protein, 24 aa, Giardia lamblia
TDTTLRFESRFESGNLLQATRLPM

SEQ ID NO: 3172149 - protein, 17 aa, Giardia lamblia
TDVCARGLDIPHVSLVI

SEQ ID NO: 3172150 - protein, 27 aa, Giardia lamblia
TDVCYPTLKPLSSWIVDLIDRVQFMAD

SEQ ID NO: 3172151 - protein, 25 aa, Giardia lamblia
TDVGECFKDKLAFMRFMGLSLTSSE

SEQ ID NO: 3172152 - protein, 24 aa, Giardia lamblia
TDVKNLRLELQRVIASNNRELANT

SEQ ID NO: 3172153 - protein, 20 aa, Giardia lamblia
TDVPEGWREPEFRPEDNKSG

SEQ ID NO: 3172154 - protein, 24 aa, Giardia lamblia
TDWFQPWPRQALCDVAIKNLTGFE

SEQ ID NO: 3172155 - protein, 17 aa, Giardia lamblia
TDYHTVPSISELQAMSI

SEQ ID NO: 3172156 - protein, 26 aa, Giardia lamblia
TDYLNGRLGNYYSLNRERFSQKTLSV

SEQ ID NO: 3172157 - protein, 26 aa, Giardia lamblia
TDYLQWMAPLPLCFVTSSKKKLAEFL

SEQ ID NO: 3172158 - protein, 32 aa, Giardia lamblia
TEAFKENRRNGAFYFCHRYVEDGCTVLKFASE

SEQ ID NO: 3172159 - protein, 17 aa, Giardia lamblia
TEAFNLLNPRSLLSAGL

SEQ ID NO: 3172160 - protein, 18 aa, Giardia lamblia
TEAGLCIENGVTALMIAA

SEQ ID NO: 3172161 - protein, 26 aa, Giardia lamblia
TEAGLIPRACRELFQRIEAYEEADPA

SEQ ID NO: 3172162 - protein, 24 aa, Giardia lamblia
TEAGYCFCSKSNKKVCSDDMICCE

SEQ ID NO: 3172163 - protein, 20 aa, Giardia lamblia
TEAKIRLAKYSLRTFYELSN

SEQ ID NO: 3172164 - protein, 18 aa, Giardia lamblia
TEAKLSAGRLDFAGYSAL

SEQ ID NO: 3172165 - protein, 21 aa, Giardia lamblia
TEALLPFTHLEFRERSQSSAS

SEQ ID NO: 3172166 - protein, 25 aa, Giardia lamblia
TEALRFVLCHGGGFACNIQDHRKRT

SEQ ID NO: 3172167 - protein, 17 aa, Giardia lamblia
TEARITNTLGQLAYDIA

SEQ ID NO: 3172168 - protein, 21 aa, Giardia lamblia
TEASDVWSLGCLIYELCTLKR

SEQ ID NO: 3172169 - protein, 24 aa, Giardia lamblia
TEASPPSVLCRWTSPHVTEPDTLH

SEQ ID NO: 3172170 - protein, 22 aa, Giardia lamblia
TEAWYKIPELLSRSTSRRPSCI

SEQ ID NO: 3172171 - protein, 20 aa, Giardia lamblia
TECLLKVGFTSGLLDSIFSL

SEQ ID NO: 3172172 - protein, 20 aa, Giardia lamblia
TECRNRHALFTDGRMLMLRN

SEQ ID NO: 3172173 - protein, 27 aa, Giardia lamblia
TEDAAALKSCYERTLYIALSEELRTIA

SEQ ID NO: 3172174 - protein, 25 aa, Giardia lamblia
TEDGRTALMLAAWKGNYEVMKLLLP

SEQ ID NO: 3172175 - protein, 22 aa, Giardia lamblia
TEDHSFLLLADFGDFRHYFVLR

SEQ ID NO: 3172176 - protein, 19 aa, Giardia lamblia
TEDNMSCMMIAAKNWHNDI

SEQ ID NO: 3172177 - protein, 19 aa, Giardia lamblia
TEDSITCRYQIIKYIRDKL

SEQ ID NO: 3172178 - protein, 17 aa, Giardia lamblia
TEDYAVIKPVLLNQLDP

SEQ ID NO: 3172179 - protein, 23 aa, Giardia lamblia
TEEECWYYICQILLGVASIHALK

SEQ ID NO: 3172180 - protein, 23 aa, Giardia lamblia
TEEGRFTRRNGWTALMCAAYRGH

SEQ ID NO: 3172181 - protein, 27 aa, Giardia lamblia
TEEKLSHLLSPWIEYVVNSIDKEVSES

SEQ ID NO: 3172182 - protein, 25 aa, Giardia lamblia
TEEPFEAYDGFFIHTGISYVPCYVS

SEQ ID NO: 3172183 - protein, 25 aa, Giardia lamblia
TEERVKELIVLGGVRSIIIFTDTCT

SEQ ID NO: 3172184 - protein, 25 aa, Giardia lamblia
TEESDLWSLGALVYCVCALKPPAYS

SEQ ID NO: 3172185 - protein, 22 aa, Giardia lamblia
TEESRTSLILALATLADAYLTR

SEQ ID NO: 3172186 - protein, 24 aa, Giardia lamblia
TEESYAILRRGRQKFLMTLEPLAT

SEQ ID NO: 3172187 - protein, 17 aa, Giardia lamblia
TEFILKLLQLFNTSDPR

SEQ ID NO: 3172188 - protein, 20 aa, Giardia lamblia
TEFKNCLQHLPLPYDLSQEE

SEQ ID NO: 3172189 - protein, 22 aa, Giardia lamblia
TEFQVGLKLIATQVLQKGSCVK

SEQ ID NO: 3172190 - protein, 24 aa, Giardia lamblia
TEFRPRTSNHWERLLQDRDDEIQR

SEQ ID NO: 3172191 - protein, 17 aa, Giardia lamblia
TEFWKDDYHCANWAGCP

SEQ ID NO: 3172192 - protein, 20 aa, Giardia lamblia
TEGAPRVLIPGSQPGSNEGT

SEQ ID NO: 3172193 - protein, 26 aa, Giardia lamblia
TEGEYILKICNIYNVYTEYKASFSPT

SEQ ID NO: 3172194 - protein, 22 aa, Giardia lamblia
TEGFSLKSLRFLIIDEADKMLE

SEQ ID NO: 3172195 - protein, 21 aa, Giardia lamblia
TEGHFLPSLIPLPLLSEHVEL

SEQ ID NO: 3172196 - protein, 21 aa, Giardia lamblia
TEGILLRMLIDAMKGDEGAID

SEQ ID NO: 3172197 - protein, 21 aa, Giardia lamblia
TEGLKALPLDPEREYRDDNEK

SEQ ID NO: 3172198 - protein, 21 aa, Giardia lamblia
TEGRTALIIAAEVDFFNAVRI

SEQ ID NO: 3172199 - protein, 20 aa, Giardia lamblia
TEGYLRDYIFTSGRLALCYC

SEQ ID NO: 3172200 - protein, 26 aa, Giardia lamblia
TEIEFRLGVFEDFLKQRLRPHNQRLV

SEQ ID NO: 3172201 - protein, 33 aa, Giardia lamblia
TEIGRICSYYYVSFRNFCRFISLIKDSVVGRVT

SEQ ID NO: 3172202 - protein, 20 aa, Giardia lamblia
TEIKKRLTFQHTLSGTEVID

SEQ ID NO: 3172203 - protein, 19 aa, Giardia lamblia
TEILHLAAQFARSPAEGVA

SEQ ID NO: 3172204 - protein, 20 aa, Giardia lamblia
TEINLPVLSRSFVNRLLTEA

SEQ ID NO: 3172205 - protein, 24 aa, Giardia lamblia
TEISLGAADAGVWTVPIDTSDQLV

SEQ ID NO: 3172206 - protein, 21 aa, Giardia lamblia
TEISTNITLFIAYFGGHTSVH

SEQ ID NO: 3172207 - protein, 20 aa, Giardia lamblia
TEIVKALLPHYGKLQRSDGE

SEQ ID NO: 3172208 - protein, 20 aa, Giardia lamblia
TEKAFCLYVLHSLAAGNLRL

SEQ ID NO: 3172209 - protein, 18 aa, Giardia lamblia
TEKDCFRSDTFMVTCPVF

SEQ ID NO: 3172210 - protein, 37 aa, Giardia lamblia
TEKERLRLMWSRKISMIRWDCESWEALLRVRRLIIFP

SEQ ID NO: 3172211 - protein, 23 aa, Giardia lamblia
TEKGSCITRYNKIHAIAALHSNI

SEQ ID NO: 3172212 - protein, 18 aa, Giardia lamblia
TEKHIARENELPCSQQTK

SEQ ID NO: 3172213 - protein, 18 aa, Giardia lamblia
TEKIGVCIICLDEFCIVR

SEQ ID NO: 3172214 - protein, 20 aa, Giardia lamblia
TEKINVGGFYELRHGKRAYR

SEQ ID NO: 3172215 - protein, 20 aa, Giardia lamblia
TEKLKGWAVDTVIHDGAPNM

SEQ ID NO: 3172216 - protein, 23 aa, Giardia lamblia
TEKPKPVAYVVCDSRDQAKELAE

SEQ ID NO: 3172217 - protein, 24 aa, Giardia lamblia
TEKSKRLLLKLMRSDYVEYGQTLH

SEQ ID NO: 3172218 - protein, 38 aa, Giardia lamblia
TELAKCVMCTKCRAKSYSFSYCQALLLDLPIKESRTEV

SEQ ID NO: 3172219 - protein, 23 aa, Giardia lamblia
TELKARPTFEYVSDLKHKLDTAS

SEQ ID NO: 3172220 - protein, 26 aa, Giardia lamblia
TELKDNTFRILIGRHAFVGRAEEITI

SEQ ID NO: 3172221 - protein, 20 aa, Giardia lamblia
TELLGAGAFGKVFAADALHS

SEQ ID NO: 3172222 - protein, 19 aa, Giardia lamblia
TELLGRFIADAALDSALVE

SEQ ID NO: 3172223 - protein, 20 aa, Giardia lamblia
TELLKLLNLLLDGLIERASY

SEQ ID NO: 3172224 - protein, 19 aa, Giardia lamblia
TELMQYILGVLMTEKSPRP

SEQ ID NO: 3172225 - protein, 20 aa, Giardia lamblia
TELMRRLRQFYRINSQAFAL

SEQ ID NO: 3172226 - protein, 23 aa, Giardia lamblia
TELQPRYTLLESTLDFGRVSYGM

SEQ ID NO: 3172227 - protein, 21 aa, Giardia lamblia
TELRFYLENYVGMKDKDGMTA

SEQ ID NO: 3172228 - protein, 17 aa, Giardia lamblia
TELRKGVGNDLVKELQY

SEQ ID NO: 3172229 - protein, 24 aa, Giardia lamblia
TELRKVKHMILYQLLDYINSSNNI

SEQ ID NO: 3172230 - protein, 24 aa, Giardia lamblia
TELRLLVETHLRPYVRQCNEVVNR

SEQ ID NO: 3172231 - protein, 20 aa, Giardia lamblia
TELRSAQTADAWSKQTDGIV

SEQ ID NO: 3172232 - protein, 27 aa, Giardia lamblia
TELSPRHNYCFCLCLIGRCHLAQNDKA

SEQ ID NO: 3172233 - protein, 25 aa, Giardia lamblia
TELSRRGFYPLAFVFLSPTDFTRTV

SEQ ID NO: 3172234 - protein, 25 aa, Giardia lamblia
TELYFSRLQYRNSIFEPVQSVFRFP

SEQ ID NO: 3172235 - protein, 24 aa, Giardia lamblia
TELYLKEIIKRLELENKRVSGELA

SEQ ID NO: 3172236 - protein, 19 aa, Giardia lamblia
TELYLRMLRKNLSLTSETK

SEQ ID NO: 3172237 - protein, 20 aa, Giardia lamblia
TEMGELVLYHFTDVSSTRFE

SEQ ID NO: 3172238 - protein, 19 aa, Giardia lamblia
TEMLSACCIHHIQSPQHLQ

SEQ ID NO: 3172239 - protein, 17 aa, Giardia lamblia
TEMPLDELLPLGFGPAN

SEQ ID NO: 3172240 - protein, 21 aa, Giardia lamblia
TEMSLVPGMPSYAIFSSIDGK

SEQ ID NO: 3172241 - protein, 31 aa, Giardia lamblia
TEMYRSMAGYGFKVDMLTLFHIVLLLTADDP

SEQ ID NO: 3172242 - protein, 24 aa, Giardia lamblia
TENKNLRLEVVALQEMLDVQRLLA

SEQ ID NO: 3172243 - protein, 19 aa, Giardia lamblia
TENLCPRCRVRERVLENGD

SEQ ID NO: 3172244 - protein, 22 aa, Giardia lamblia
TENRCMTELMISAKENNIVRVW

SEQ ID NO: 3172245 - protein, 22 aa, Giardia lamblia
TENSRSALMIAAMEGSIDAIIS

SEQ ID NO: 3172246 - protein, 17 aa, Giardia lamblia
TEPIFAFVYDKTVHISY

SEQ ID NO: 3172247 - protein, 23 aa, Giardia lamblia
TEPIPNPLILLLATRAGSPRAPS

SEQ ID NO: 3172248 - protein, 23 aa, Giardia lamblia
TEPKRKRPAAAPVDTKKASAKRG

SEQ ID NO: 3172249 - protein, 17 aa, Giardia lamblia
TEPVIPLSLAVDTDNTT

SEQ ID NO: 3172250 - protein, 17 aa, Giardia lamblia
TEQRGALVYLVKLRHLL

SEQ ID NO: 3172251 - protein, 26 aa, Giardia lamblia
TEQYPRVLFLHGFDFDTTINAPFINA

SEQ ID NO: 3172252 - protein, 21 aa, Giardia lamblia
TEREAKGWPKASDKYDIAQIM

SEQ ID NO: 3172253 - protein, 23 aa, Giardia lamblia
TERERCKAMKLIEKKLEGDTESS

SEQ ID NO: 3172254 - protein, 24 aa, Giardia lamblia
TERFPFLRFDASSYYRGVTPSKDI

SEQ ID NO: 3172255 - protein, 23 aa, Giardia lamblia
TERLRYLYSSARSSGVTTDVLRL

SEQ ID NO: 3172256 - protein, 24 aa, Giardia lamblia
TERRRLTTLFTRERLAATDEMNEL

SEQ ID NO: 3172257 - protein, 29 aa, Giardia lamblia
TESDIRLQLTMARFHFCRQQLNFYRTLCS

SEQ ID NO: 3172258 - protein, 19 aa, Giardia lamblia
TESGCAPPFAPDIGSVAST

SEQ ID NO: 3172259 - protein, 25 aa, Giardia lamblia
TESLTPVFIKRSGITSLIYLHDDNF

SEQ ID NO: 3172260 - protein, 18 aa, Giardia lamblia
TESMIWKTLSQIVSALRY

SEQ ID NO: 3172261 - protein, 22 aa, Giardia lamblia
TESPRDYKLFLPNDSSIIGYQP

SEQ ID NO: 3172262 - protein, 22 aa, Giardia lamblia
TESRWWHAYCTATSSSMLLVTS

SEQ ID NO: 3172263 - protein, 18 aa, Giardia lamblia
TESTFIRILGSELISKYS

SEQ ID NO: 3172264 - protein, 31 aa, Giardia lamblia
TESTWLLFAIPRAHPQLVIYRIVSHASERIY

SEQ ID NO: 3172265 - protein, 22 aa, Giardia lamblia
TETIESLTECISRHGEEIQQIS

SEQ ID NO: 3172266 - protein, 25 aa, Giardia lamblia
TETIRIKALRALRISCKLGISATPV

SEQ ID NO: 3172267 - protein, 32 aa, Giardia lamblia
TETLPSGLLGFWKQTQTILGMDDMEELMALRE

SEQ ID NO: 3172268 - protein, 21 aa, Giardia lamblia
TETLTREFVRAVLQASSCTKI

SEQ ID NO: 3172269 - protein, 25 aa, Giardia lamblia
TETMHAAACRNITFAAREDLRKVTI

SEQ ID NO: 3172270 - protein, 17 aa, Giardia lamblia
TETNWEFDPRFPKSNII

SEQ ID NO: 3172271 - protein, 24 aa, Giardia lamblia
TETRSARDFLGYQIIMVSATMPNN

SEQ ID NO: 3172272 - protein, 23 aa, Giardia lamblia
TETTVSWYLTIPYDSRFDGLFKH

SEQ ID NO: 3172273 - protein, 17 aa, Giardia lamblia
TETYFSGTITTTALCTN

SEQ ID NO: 3172274 - protein, 26 aa, Giardia lamblia
TEVLELGGPIIKRLILHIQACGVDLG

SEQ ID NO: 3172275 - protein, 20 aa, Giardia lamblia
TEVLPVVWPSAGRIFGTLSE

SEQ ID NO: 3172276 - protein, 24 aa, Giardia lamblia
TEVMALKMKFLKTVTAEVSNVSDL

SEQ ID NO: 3172277 - protein, 21 aa, Giardia lamblia
TEVQRLKSLVLSIQAAVNSGL

SEQ ID NO: 3172278 - protein, 23 aa, Giardia lamblia
TEVTPCRGSRYKFIDTGLNPAYF

SEQ ID NO: 3172279 - protein, 20 aa, Giardia lamblia
TEVVKLLLDVEGGMQINGGV

SEQ ID NO: 3172280 - protein, 19 aa, Giardia lamblia
TEVVRLLLKIEGGMQKGRG

SEQ ID NO: 3172281 - protein, 20 aa, Giardia lamblia
TEYGVLPVICDLTRQYSVSD

SEQ ID NO: 3172282 - protein, 48 aa, Giardia lamblia
TEYNVFIKPDFNLKVRFWFYFRVANITPKLPYIFHVLSFSKGKTTFLS

SEQ ID NO: 3172283 - protein, 17 aa, Giardia lamblia
TFAAFAILPDRSGQMTT

SEQ ID NO: 3172284 - protein, 39 aa, Giardia lamblia
TFAEALGDLSLDFMSPLLMPVIKRWVNYYTSTKKNGISG

SEQ ID NO: 3172285 - protein, 21 aa, Giardia lamblia
TFAELRHERNLPIPINPDSIY

SEQ ID NO: 3172286 - protein, 17 aa, Giardia lamblia
TFAEPRSDMSFSDSDYE

SEQ ID NO: 3172287 - protein, 19 aa, Giardia lamblia
TFAEQVMALIYQYKDTLVE

SEQ ID NO: 3172288 - protein, 17 aa, Giardia lamblia
TFAVPAFYVQVQAVLAL

SEQ ID NO: 3172289 - protein, 18 aa, Giardia lamblia
TFEQKRFQAWRVDADAII

SEQ ID NO: 3172290 - protein, 18 aa, Giardia lamblia
TFESFSIIRCLLDSGVAP

SEQ ID NO: 3172291 - protein, 22 aa, Giardia lamblia
TFFADEAMRCLIECIQGAHALL

SEQ ID NO: 3172292 - protein, 24 aa, Giardia lamblia
TFFDALRLYYGHNLNVGFSKIILD

SEQ ID NO: 3172293 - protein, 21 aa, Giardia lamblia
TFFGHHCIHAVYSRVGPCSPF

SEQ ID NO: 3172294 - protein, 19 aa, Giardia lamblia
TFFSHVSTIISWYPVEVLA

SEQ ID NO: 3172295 - protein, 22 aa, Giardia lamblia
TFGETGLMCAVRQGDAETVKIL

SEQ ID NO: 3172296 - protein, 25 aa, Giardia lamblia
TFGYFLGRFACHQLRVFSLSNFTLL

SEQ ID NO: 3172297 - protein, 19 aa, Giardia lamblia
TFHKDLWKKYGSDSERAAY

SEQ ID NO: 3172298 - protein, 32 aa, Giardia lamblia
TFHLVGLLWGVRWGFFSGELIIRGYDYEENAS

SEQ ID NO: 3172299 - protein, 19 aa, Giardia lamblia
TFIKEAQRFLATDGATSNT

SEQ ID NO: 3172300 - protein, 21 aa, Giardia lamblia
TFIKNARISKLTTELTETQTQ

SEQ ID NO: 3172301 - protein, 21 aa, Giardia lamblia
TFITAVAWHPLIPNLIGSAAE

SEQ ID NO: 3172302 - protein, 19 aa, Giardia lamblia
TFIYRLFRKAQVEPECLVA

SEQ ID NO: 3172303 - protein, 29 aa, Giardia lamblia
TFKEINRRINIPLILPKNVPTPRFGVSSI

SEQ ID NO: 3172304 - protein, 35 aa, Giardia lamblia
TFKKNRIELSCSICGKPGALIGCYNKACQFTAHYP

SEQ ID NO: 3172305 - protein, 25 aa, Giardia lamblia
TFKRLCVGCNNIGTEGCMALAEILQ

SEQ ID NO: 3172306 - protein, 17 aa, Giardia lamblia
TFLDCADRVKYLPEPLQ

SEQ ID NO: 3172307 - protein, 18 aa, Giardia lamblia
TFLFCMAIERLLRRLRER

SEQ ID NO: 3172308 - protein, 20 aa, Giardia lamblia
TFLIKCFLKAYLSVMRERAF

SEQ ID NO: 3172309 - protein, 24 aa, Giardia lamblia
TFLLPKEQRIFYLFYNPKSMTAFN

SEQ ID NO: 3172310 - protein, 23 aa, Giardia lamblia
TFLRCPCKYFQRAIDDCRPEIVH

SEQ ID NO: 3172311 - protein, 22 aa, Giardia lamblia
TFLRIEFSSPLTPRIISQLSNQ

SEQ ID NO: 3172312 - protein, 22 aa, Giardia lamblia
TFLRRFGVSYNYDYRGNSYTDT

SEQ ID NO: 3172313 - protein, 19 aa, Giardia lamblia
TFLRSCSKLQSAVPDLCLD

SEQ ID NO: 3172314 - protein, 25 aa, Giardia lamblia
TFLTRSICFNTLYLIIIHENVIIHS

SEQ ID NO: 3172315 - protein, 20 aa, Giardia lamblia
TFMKTCCGSPAYAPPEMIQG

SEQ ID NO: 3172316 - protein, 33 aa, Giardia lamblia
TFNEAVEVDPGRCYRLKPFDEMQDVINSIALMN

SEQ ID NO: 3172317 - protein, 20 aa, Giardia lamblia
TFNRWAPWVYMRNNVALSEA

SEQ ID NO: 3172318 - protein, 20 aa, Giardia lamblia
TFPARLCQVLGVQRVILITD

SEQ ID NO: 3172319 - protein, 18 aa, Giardia lamblia
TFPGAGVFEAVKKVEEEL

SEQ ID NO: 3172320 - protein, 20 aa, Giardia lamblia
TFPRCFDLKIFVDLPPIINH

SEQ ID NO: 3172321 - protein, 28 aa, Giardia lamblia
TFQNAVRALRLWCKRKNIYSNRCGFFGG

SEQ ID NO: 3172322 - protein, 25 aa, Giardia lamblia
TFQPRYSDQFGILFHRFATEEQDTS

SEQ ID NO: 3172323 - protein, 22 aa, Giardia lamblia
TFQSACAFGPKGTFTGLSNITM

SEQ ID NO: 3172324 - protein, 17 aa, Giardia lamblia
TFREIMFLQELDHDNII

SEQ ID NO: 3172325 - protein, 29 aa, Giardia lamblia
TFSAKGVEAYARILCGMFSVRGADSNTSL

SEQ ID NO: 3172326 - protein, 22 aa, Giardia lamblia
TFSDIYSIQSFGFRGEALSSIS

SEQ ID NO: 3172327 - protein, 26 aa, Giardia lamblia
TFSFFIPLRYLSTIFNSGRYFFPSLL

SEQ ID NO: 3172328 - protein, 29 aa, Giardia lamblia
TFSPEVRKSLRTCVEFVVRLYSATKQEIR

SEQ ID NO: 3172329 - protein, 26 aa, Giardia lamblia
TFSRKPVEVRILRFIVKHGTDDYRSM

SEQ ID NO: 3172330 - protein, 17 aa, Giardia lamblia
TFTCIPATANFPMPDDA

SEQ ID NO: 3172331 - protein, 18 aa, Giardia lamblia
TFVGLGFTRKAPKYERFI

SEQ ID NO: 3172332 - protein, 25 aa, Giardia lamblia
TFWRWPELLSNLDLAAYTAMYAEAL

SEQ ID NO: 3172333 - protein, 26 aa, Giardia lamblia
TFYKSCSSFLGLVSMMDFDVTFEDFC

SEQ ID NO: 3172334 - protein, 19 aa, Giardia lamblia
TFYKVDIYATMRGCVAPHA

SEQ ID NO: 3172335 - protein, 19 aa, Giardia lamblia
TGAEGIRLDEARLINLSLS

SEQ ID NO: 3172336 - protein, 20 aa, Giardia lamblia
TGAFGIPLLERMILRGRDTY

SEQ ID NO: 3172337 - protein, 26 aa, Giardia lamblia
TGAGKTVCALLCMLRAFSSDLLLPSD

SEQ ID NO: 3172338 - protein, 18 aa, Giardia lamblia
TGAIPQLPSPEVVPSTTG

SEQ ID NO: 3172339 - protein, 28 aa, Giardia lamblia
TGARFRLWMDAILRMRMFTKFDRPQTPP

SEQ ID NO: 3172340 - protein, 18 aa, Giardia lamblia
TGASALWANTRDFIATTM

SEQ ID NO: 3172341 - protein, 26 aa, Giardia lamblia
TGCEKRLSNFLPWHLAYAEIIFSDLL

SEQ ID NO: 3172342 - protein, 19 aa, Giardia lamblia
TGCTMYKLDAELFAHTSSG

SEQ ID NO: 3172343 - protein, 19 aa, Giardia lamblia
TGDLARWLNVKDISGIFNF

SEQ ID NO: 3172344 - protein, 18 aa, Giardia lamblia
TGDLVVKVVQLLKQSNRK

SEQ ID NO: 3172345 - protein, 23 aa, Giardia lamblia
TGDPKSTFISGWRPDLGDITNSV

SEQ ID NO: 3172346 - protein, 19 aa, Giardia lamblia
TGDSALMFAVKRGDILAAC

SEQ ID NO: 3172347 - protein, 24 aa, Giardia lamblia
TGDTELRYTISVPPKGLVKKSLLE

SEQ ID NO: 3172348 - protein, 17 aa, Giardia lamblia
TGDTVRIKSKFSSADVE

SEQ ID NO: 3172349 - protein, 24 aa, Giardia lamblia
TGECERLKVELAHLAAEKDTELSR

SEQ ID NO: 3172350 - protein, 22 aa, Giardia lamblia
TGEELFHCYDRTFYAKGATVYV

SEQ ID NO: 3172351 - protein, 22 aa, Giardia lamblia
TGEFRKQYISTIGVEIRQLPFY

SEQ ID NO: 3172352 - protein, 17 aa, Giardia lamblia
TGEILVLRKDHLCCFIP

SEQ ID NO: 3172353 - protein, 24 aa, Giardia lamblia
TGERVKELLTDFYMTPTNFELVGD

SEQ ID NO: 3172354 - protein, 26 aa, Giardia lamblia
TGEVKTCCLRIVKYVISLFAPGSQPH

SEQ ID NO: 3172355 - protein, 17 aa, Giardia lamblia
TGFVSKDNFARAFVIAN

SEQ ID NO: 3172356 - protein, 28 aa, Giardia lamblia
TGGDALCMAKLWGCHEIVSLLSNEVLQR

SEQ ID NO: 3172357 - protein, 23 aa, Giardia lamblia
TGGPEGYKECVSRYHDLAATVLG

SEQ ID NO: 3172358 - protein, 17 aa, Giardia lamblia
TGGTAMMAAAERGHVAV

SEQ ID NO: 3172359 - protein, 23 aa, Giardia lamblia
TGHLECFSILLPIEGAMKKSSGW

SEQ ID NO: 3172360 - protein, 29 aa, Giardia lamblia
TGHSLNRFFPLLVIRGDSIIFVTRRRFTS

SEQ ID NO: 3172361 - protein, 31 aa, Giardia lamblia
TGIDCVDELTVKCNLAPTVEEIEALYQSEEL

SEQ ID NO: 3172362 - protein, 27 aa, Giardia lamblia
TGIEGSDLLKFLFADTGKISLLSTDDR

SEQ ID NO: 3172363 - protein, 27 aa, Giardia lamblia
TGIERGQFRLVFRGRIISNLPPGHLIN

SEQ ID NO: 3172364 - protein, 25 aa, Giardia lamblia
TGKDILPLGEFDVYYAIFKESPDKL

SEQ ID NO: 3172365 - protein, 31 aa, Giardia lamblia
TGKDVTIPFARVCEYIMWMGFSRTSDPTYAH

SEQ ID NO: 3172366 - protein, 24 aa, Giardia lamblia
TGKIRLKGLCSWHSSGQISISTRA

SEQ ID NO: 3172367 - protein, 24 aa, Giardia lamblia
TGKIYCKQCSLIINKHIIPSKVLS

SEQ ID NO: 3172368 - protein, 21 aa, Giardia lamblia
TGKRLLKAVMQKFLPAADALL

SEQ ID NO: 3172369 - protein, 25 aa, Giardia lamblia
TGLGHNGPHAWNMVRLEDDWYHVDV

SEQ ID NO: 3172370 - protein, 18 aa, Giardia lamblia
TGLIKLFGEDVVDQGFTD

SEQ ID NO: 3172371 - protein, 34 aa, Giardia lamblia
TGLKRVLDAWLKFRPDFKTFLLARDTMNRGTLPY

SEQ ID NO: 3172372 - protein, 26 aa, Giardia lamblia
TGLLLLCLRGGCPQATVLPVSVADTA

SEQ ID NO: 3172373 - protein, 17 aa, Giardia lamblia
TGLMLAVTYGWIDLVKE

SEQ ID NO: 3172374 - protein, 24 aa, Giardia lamblia
TGLPANNILLMFRETGLLIPDKES

SEQ ID NO: 3172375 - protein, 25 aa, Giardia lamblia
TGLSALMRAACNGSPQIVELLCSLE

SEQ ID NO: 3172376 - protein, 24 aa, Giardia lamblia
TGLSEYRQRISLLDSQLTEEQMTL

SEQ ID NO: 3172377 - protein, 21 aa, Giardia lamblia
TGLSMTCGQLIHLLNLAQKDI

SEQ ID NO: 3172378 - protein, 28 aa, Giardia lamblia
TGMQYQFRSCISKHSILYAGRYPNYVCI

SEQ ID NO: 3172379 - protein, 20 aa, Giardia lamblia
TGNLNLLTFAIKCDGAPGPC

SEQ ID NO: 3172380 - protein, 20 aa, Giardia lamblia
TGNQGGAMVLSRDAGAKQAQ

SEQ ID NO: 3172381 - protein, 27 aa, Giardia lamblia
TGNRSRYAEHLPIMGFVGKKVNQKYRQ

SEQ ID NO: 3172382 - protein, 19 aa, Giardia lamblia
TGNSYRQAKAKRKSGSFSG

SEQ ID NO: 3172383 - protein, 28 aa, Giardia lamblia
TGNVEIGRWFICKGTALMRAAAHGHTRI

SEQ ID NO: 3172384 - protein, 21 aa, Giardia lamblia
TGPAETFILPLVSNLPVHVSG

SEQ ID NO: 3172385 - protein, 21 aa, Giardia lamblia
TGPIRRVMRRTSAKQSLSEPK

SEQ ID NO: 3172386 - protein, 22 aa, Giardia lamblia
TGPNTMYWAGWMAKVARGEVST

SEQ ID NO: 3172387 - protein, 19 aa, Giardia lamblia
TGPTRLVYRNGNTSVKHGM

SEQ ID NO: 3172388 - protein, 17 aa, Giardia lamblia
TGQGASMALRAHNAVAS

SEQ ID NO: 3172389 - protein, 18 aa, Giardia lamblia
TGQNGWTALMSVVSKQYV

SEQ ID NO: 3172390 - protein, 25 aa, Giardia lamblia
TGRESALRFSKAEVVNYCNALLQNI

SEQ ID NO: 3172391 - protein, 22 aa, Giardia lamblia
TGRFDDSICLAQIFRPHSTSVK

SEQ ID NO: 3172392 - protein, 20 aa, Giardia lamblia
TGRMKALVLAAHEAEDRIIS

SEQ ID NO: 3172393 - protein, 19 aa, Giardia lamblia
TGRSYKFFNYFGAPDATAV

SEQ ID NO: 3172394 - protein, 22 aa, Giardia lamblia
TGSEGPLVFSVACDTGQTDDQR

SEQ ID NO: 3172395 - protein, 23 aa, Giardia lamblia
TGSFVIRGKRNFIPQQPLELGVA

SEQ ID NO: 3172396 - protein, 23 aa, Giardia lamblia
TGSGKTLAFLIPLLQRLISLQWQ

SEQ ID NO: 3172397 - protein, 18 aa, Giardia lamblia
TGSIAAPITKSIKQLTQI

SEQ ID NO: 3172398 - protein, 24 aa, Giardia lamblia
TGSMPLCVSFTMISRFDGKEREYE

SEQ ID NO: 3172399 - protein, 24 aa, Giardia lamblia
TGSRAKGCLVTACTPLCGEAHVPQ

SEQ ID NO: 3172400 - protein, 24 aa, Giardia lamblia
TGSSGDKSEPCWTSSKVESTTSDG

SEQ ID NO: 3172401 - protein, 24 aa, Giardia lamblia
TGSSVAAWRKAEYHLKPEYANVAT

SEQ ID NO: 3172402 - protein, 18 aa, Giardia lamblia
TGSYRNLIELARSNPHNS

SEQ ID NO: 3172403 - protein, 25 aa, Giardia lamblia
TGTDGGRSALDFAIDNNQSHIVRLI

SEQ ID NO: 3172404 - protein, 26 aa, Giardia lamblia
TGTDRLCKLCKAVMLVVDGPPNPLAY

SEQ ID NO: 3172405 - protein, 18 aa, Giardia lamblia
TGTEICKRHFMTALSQTK

SEQ ID NO: 3172406 - protein, 23 aa, Giardia lamblia
TGTEKYLIIWNFDKVKAGVVSSS

SEQ ID NO: 3172407 - protein, 25 aa, Giardia lamblia
TGTRMVFKPGMLRGGDVTFSCPLER

SEQ ID NO: 3172408 - protein, 17 aa, Giardia lamblia
TGVEQEGAFALQLKQPL

SEQ ID NO: 3172409 - protein, 19 aa, Giardia lamblia
TGVEVGQYLMGRGGTKEDI

SEQ ID NO: 3172410 - protein, 26 aa, Giardia lamblia
TGVGIPRSLGIPGEDLPGVFTANEFL

SEQ ID NO: 3172411 - protein, 24 aa, Giardia lamblia
TGVIEMYATLLGSFRAAEKKLERL

SEQ ID NO: 3172412 - protein, 26 aa, Giardia lamblia
TGVSQFYFDRVIILEFSRYNSDLKRY

SEQ ID NO: 3172413 - protein, 18 aa, Giardia lamblia
TGYCKNDFTFLAQRNKPV

SEQ ID NO: 3172414 - protein, 28 aa, Giardia lamblia
TGYKALNLCHFFTCGADEVRCWTVRKYT

SEQ ID NO: 3172415 - protein, 18 aa, Giardia lamblia
TGYTFFINSDWRYRCDVV

SEQ ID NO: 3172416 - protein, 24 aa, Giardia lamblia
THAAWGLKLGKIACEMNDFGTVNF

SEQ ID NO: 3172417 - protein, 26 aa, Giardia lamblia
THAGKCPKCDNGCYEGCTCMQKRMRH

SEQ ID NO: 3172418 - protein, 17 aa, Giardia lamblia
THALPPMRTILEILSEI

SEQ ID NO: 3172419 - protein, 22 aa, Giardia lamblia
THARATEFLHRVDPESLKIPEE

SEQ ID NO: 3172420 - protein, 22 aa, Giardia lamblia
THCVLTYPKFHVRTLKENKAAS

SEQ ID NO: 3172421 - protein, 20 aa, Giardia lamblia
THDEILEFKEYINNKQSLEQ

SEQ ID NO: 3172422 - protein, 26 aa, Giardia lamblia
THDGKFHWDECLAVWFIKQLPDYIDA

SEQ ID NO: 3172423 - protein, 26 aa, Giardia lamblia
THDVAIKFIPGYAGKFKDMLTVMVNG

SEQ ID NO: 3172424 - protein, 18 aa, Giardia lamblia
THEILKFIMHNIDITAHV

SEQ ID NO: 3172425 - protein, 20 aa, Giardia lamblia
THEQATCALAEVSVLPRCST

SEQ ID NO: 3172426 - protein, 23 aa, Giardia lamblia
THFIGELQLNIADLCKTYTISRR

SEQ ID NO: 3172427 - protein, 25 aa, Giardia lamblia
THGKSGSVAKFLPSVVPSSAVSSFL

SEQ ID NO: 3172428 - protein, 17 aa, Giardia lamblia
THGRQWKVSEIERLIDL

SEQ ID NO: 3172429 - protein, 28 aa, Giardia lamblia
THIDLYYNFCFCASIQLVGKGGPIQKGS

SEQ ID NO: 3172430 - protein, 18 aa, Giardia lamblia
THIFYILLLENFLSSGAF

SEQ ID NO: 3172431 - protein, 18 aa, Giardia lamblia
THIRHSWETIKRIYDTAS

SEQ ID NO: 3172432 - protein, 17 aa, Giardia lamblia
THKAGGNASRFSEAEAL

SEQ ID NO: 3172433 - protein, 19 aa, Giardia lamblia
THKRRAYRRGPSLLAPAED

SEQ ID NO: 3172434 - protein, 25 aa, Giardia lamblia
THLEIHPSMVLSAITSLIPFPDHNQ

SEQ ID NO: 3172435 - protein, 20 aa, Giardia lamblia
THLNLVFSFFGSVKEVILRD

SEQ ID NO: 3172436 - protein, 24 aa, Giardia lamblia
THLRTSKGWTALMLAAKSGAVQAA

SEQ ID NO: 3172437 - protein, 23 aa, Giardia lamblia
THPAEALALRAATIAYYGNIVEG

SEQ ID NO: 3172438 - protein, 21 aa, Giardia lamblia
THPCRLLSKLRMMSRCKDTYI

SEQ ID NO: 3172439 - protein, 18 aa, Giardia lamblia
THPEAIKRVKTVDMHLLT

SEQ ID NO: 3172440 - protein, 19 aa, Giardia lamblia
THPSITWAPIFEASTQVFR

SEQ ID NO: 3172441 - protein, 19 aa, Giardia lamblia
THPTLVLCDNFVDLMNVVY

SEQ ID NO: 3172442 - protein, 28 aa, Giardia lamblia
THQHSGNCLFTFTSLPCILDMYYKVLIS

SEQ ID NO: 3172443 - protein, 18 aa, Giardia lamblia
THRHLCEFIGLDLEMEIY

SEQ ID NO: 3172444 - protein, 20 aa, Giardia lamblia
THRLLWPSYRDAASHCLHYH

SEQ ID NO: 3172445 - protein, 27 aa, Giardia lamblia
THTLCLRLSSVISCEIECGSSLTDMEV

SEQ ID NO: 3172446 - protein, 17 aa, Giardia lamblia
THTRLAFDDVLAALLGL

SEQ ID NO: 3172447 - protein, 17 aa, Giardia lamblia
THVTCLMLAAQHHSVEL

SEQ ID NO: 3172448 - protein, 27 aa, Giardia lamblia
THYERCLEEAIKVLSLKFWIMNYHAVV

SEQ ID NO: 3172449 - protein, 21 aa, Giardia lamblia
THYRCDVLLFLLGTLALAQFE

SEQ ID NO: 3172450 - protein, 32 aa, Giardia lamblia
THYVRKCPLYHKLNWVIPDDPRDIFIRLYQNA

SEQ ID NO: 3172451 - protein, 37 aa, Giardia lamblia
TIADLRVKDPFTYAFILKIAFLFSGGMTKVQQEKDKL

SEQ ID NO: 3172452 - protein, 24 aa, Giardia lamblia
TIAEDRARLDALSLEVLHTQQELQ

SEQ ID NO: 3172453 - protein, 32 aa, Giardia lamblia
TIAELRAAELRFLELIDWKIGVSSLNPRAYLR

SEQ ID NO: 3172454 - protein, 18 aa, Giardia lamblia
TIAPIRWPVTSGSGDALS

SEQ ID NO: 3172455 - protein, 25 aa, Giardia lamblia
TIARACAPSVVFIDEIDALVCGDSR

SEQ ID NO: 3172456 - protein, 29 aa, Giardia lamblia
TIARLDFPFCRDIFLMGLIPLANRLYSTY

SEQ ID NO: 3172457 - protein, 22 aa, Giardia lamblia
TIARLEALLQLPTPDRALKLAA

SEQ ID NO: 3172458 - protein, 23 aa, Giardia lamblia
TIASELMAQYGILGTQYARDALA

SEQ ID NO: 3172459 - protein, 33 aa, Giardia lamblia
TIASMADFWYVVFRLKVVFIANLTRFIDDERPK

SEQ ID NO: 3172460 - protein, 17 aa, Giardia lamblia
TIASVVFSGIPMLSLST

SEQ ID NO: 3172461 - protein, 26 aa, Giardia lamblia
TICMTSELLGAFISFISAQMMELSST

SEQ ID NO: 3172462 - protein, 21 aa, Giardia lamblia
TICSLSRAAVHYYKVADHLLD

SEQ ID NO: 3172463 - protein, 28 aa, Giardia lamblia
TICTICSKEAAPVFSTRVYELISGGSSI

SEQ ID NO: 3172464 - protein, 19 aa, Giardia lamblia
TIDCMSAMVWEPSLIRINA

SEQ ID NO: 3172465 - protein, 23 aa, Giardia lamblia
TIDFLNPRAVFLIHNTAVDNVVR

SEQ ID NO: 3172466 - protein, 31 aa, Giardia lamblia
TIDGLRCPLCSAINVCGEVPKLLLSSSYLAK

SEQ ID NO: 3172467 - protein, 19 aa, Giardia lamblia
TIDRFLAGAAFTAPGAPTP

SEQ ID NO: 3172468 - protein, 17 aa, Giardia lamblia
TIEEIIRKRLHSCHITI

SEQ ID NO: 3172469 - protein, 23 aa, Giardia lamblia
TIEKRPGLSTGYLSRLQEGSAVF

SEQ ID NO: 3172470 - protein, 26 aa, Giardia lamblia
TIEPMAYKLAFSFFFKQGAYQYASGA

SEQ ID NO: 3172471 - protein, 18 aa, Giardia lamblia
TIESGGCTPSFSTKGAQS

SEQ ID NO: 3172472 - protein, 28 aa, Giardia lamblia
TIESINLLRARNCPFIVALNKIDRLYNW

SEQ ID NO: 3172473 - protein, 18 aa, Giardia lamblia
TIESLRTEIEFLRSEPKY

SEQ ID NO: 3172474 - protein, 18 aa, Giardia lamblia
TIESMPVRVSTPCTDLPS

SEQ ID NO: 3172475 - protein, 21 aa, Giardia lamblia
TIEYLLFCLNQIHPHKGLHID

SEQ ID NO: 3172476 - protein, 26 aa, Giardia lamblia
TIFDEIWVEIGLDFSRIYEFDLHVRL

SEQ ID NO: 3172477 - protein, 21 aa, Giardia lamblia
TIFGQEWTLRVLVPKIATLKQ

SEQ ID NO: 3172478 - protein, 25 aa, Giardia lamblia
TIFSIVLYCIQSLHKRDNIDNSQIT

SEQ ID NO: 3172479 - protein, 26 aa, Giardia lamblia
TIGCNFSCKFCQNWSISMDKPNVQDI

SEQ ID NO: 3172480 - protein, 25 aa, Giardia lamblia
TIHCKRRAKLEYFKTVLSKLKENTG

SEQ ID NO: 3172481 - protein, 17 aa, Giardia lamblia
TIHRHSLLMKSNLPIES

SEQ ID NO: 3172482 - protein, 18 aa, Giardia lamblia
TIHTLALKQTLSFVPPTL

SEQ ID NO: 3172483 - protein, 26 aa, Giardia lamblia
TIIDQWKPLWNFKGMDCVFESKKEGN

SEQ ID NO: 3172484 - protein, 19 aa, Giardia lamblia
TIIEGFRAATDVALKALES

SEQ ID NO: 3172485 - protein, 26 aa, Giardia lamblia
TIIHGRGNALVGFGAGRVGIPGKPVS

SEQ ID NO: 3172486 - protein, 32 aa, Giardia lamblia
TIIICDNCCLKLCVYGEWIKYCHTLYNDKTTG

SEQ ID NO: 3172487 - protein, 22 aa, Giardia lamblia
TIIKGCEYFDGTVSRYVDYDTT

SEQ ID NO: 3172488 - protein, 19 aa, Giardia lamblia
TIINRLSFRISDHPITCKS

SEQ ID NO: 3172489 - protein, 18 aa, Giardia lamblia
TIIQELKDQLAVYQQNVQ

SEQ ID NO: 3172490 - protein, 24 aa, Giardia lamblia
TIKKIRYLIRIPRSISNVYNMISL

SEQ ID NO: 3172491 - protein, 19 aa, Giardia lamblia
TIKPGVPVLSMLARPTTSY

SEQ ID NO: 3172492 - protein, 26 aa, Giardia lamblia
TILERFPRARGVAMSLSADGGKVGLT

SEQ ID NO: 3172493 - protein, 26 aa, Giardia lamblia
TILHRNLSHCCALPTATHPEALTESR

SEQ ID NO: 3172494 - protein, 18 aa, Giardia lamblia
TILIEWFTEIALSKRLPL

SEQ ID NO: 3172495 - protein, 17 aa, Giardia lamblia
TILIITINYTFRTTEAP

SEQ ID NO: 3172496 - protein, 25 aa, Giardia lamblia
TILKYFKCSVTSILLLQESRTYPVV

SEQ ID NO: 3172497 - protein, 18 aa, Giardia lamblia
TILLQFNFPFSLLSEESI

SEQ ID NO: 3172498 - protein, 20 aa, Giardia lamblia
TILRELRLYKARKLARLELL

SEQ ID NO: 3172499 - protein, 25 aa, Giardia lamblia
TILRIIEVMCVDLAAQHQIESYYQG

SEQ ID NO: 3172500 - protein, 23 aa, Giardia lamblia
TILSDYLLTHWGDAHTAKNKTLR

SEQ ID NO: 3172501 - protein, 24 aa, Giardia lamblia
TILYRIARHPGLPILYFSARCHPG

SEQ ID NO: 3172502 - protein, 27 aa, Giardia lamblia
TINEFLDRWILPLLVKLISEYEEDSAI

SEQ ID NO: 3172503 - protein, 19 aa, Giardia lamblia
TINGFHPTMSFRLNIQEDS

SEQ ID NO: 3172504 - protein, 23 aa, Giardia lamblia
TINSIKSGGTFLHAPPEITLFDT

SEQ ID NO: 3172505 - protein, 31 aa, Giardia lamblia
TINVRRTGPELGRYPRHAQFSTPIEENKRGQ

SEQ ID NO: 3172506 - protein, 26 aa, Giardia lamblia
TIPFDRLRTAFVPGYKEELVQPGNVA

SEQ ID NO: 3172507 - protein, 21 aa, Giardia lamblia
TIPGIRIVIDLGLSRVSRYYP

SEQ ID NO: 3172508 - protein, 19 aa, Giardia lamblia
TIPGIRYVIDSGLQKRMVY

SEQ ID NO: 3172509 - protein, 23 aa, Giardia lamblia
TIPKDFPGLVSLTSYPNPDGSSV

SEQ ID NO: 3172510 - protein, 25 aa, Giardia lamblia
TIPKEFRQSIFFMALRGLHYLHSKW

SEQ ID NO: 3172511 - protein, 21 aa, Giardia lamblia
TIPQFALRDLHEWLDSVLNES

SEQ ID NO: 3172512 - protein, 20 aa, Giardia lamblia
TIPSGLIVRLIELLDEGPQF

SEQ ID NO: 3172513 - protein, 23 aa, Giardia lamblia
TIPVLRAYIEWIIPHATKQEQKK

SEQ ID NO: 3172514 - protein, 26 aa, Giardia lamblia
TIQPYILRRVKSVVEKCIPPRKELIL

SEQ ID NO: 3172515 - protein, 18 aa, Giardia lamblia
TIRDSLRLTNAVEDPGYM

SEQ ID NO: 3172516 - protein, 22 aa, Giardia lamblia
TIRGDFGIDVGRNIIHGSANLD

SEQ ID NO: 3172517 - protein, 22 aa, Giardia lamblia
TIRIVFPVLVSAHFLGMPNLVN

SEQ ID NO: 3172518 - protein, 23 aa, Giardia lamblia
TIRKSDIPELAMVEIPRIDRVDT

SEQ ID NO: 3172519 - protein, 27 aa, Giardia lamblia
TIRNCAPEIFKLLKYTEKIDIWALGCA

SEQ ID NO: 3172520 - protein, 18 aa, Giardia lamblia
TISDFHFLISSVKSLRPL

SEQ ID NO: 3172521 - protein, 30 aa, Giardia lamblia
TISDFQLHYCTGCGFFFDGIEYEEYVIVTG

SEQ ID NO: 3172522 - protein, 24 aa, Giardia lamblia
TISRKRLLVRMLLGVEGGLQDNVG

SEQ ID NO: 3172523 - protein, 18 aa, Giardia lamblia
TISRRYLQRLTFQRISFC

SEQ ID NO: 3172524 - protein, 24 aa, Giardia lamblia
TISTLRFAQRASFIKNTSSINLLN

SEQ ID NO: 3172525 - protein, 19 aa, Giardia lamblia
TITALDIWQNYLVTGSKDG

SEQ ID NO: 3172526 - protein, 19 aa, Giardia lamblia
TITKRCAYGKPLVTIDDIC

SEQ ID NO: 3172527 - protein, 24 aa, Giardia lamblia
TITLLLCLKVNYPARIYLLRGNHE

SEQ ID NO: 3172528 - protein, 25 aa, Giardia lamblia
TITLSLKAVCRMILIQIPPSLKLAT

SEQ ID NO: 3172529 - protein, 34 aa, Giardia lamblia
TITQIILCKNISRFPVRFQWLLQMAQGSDKFKYD

SEQ ID NO: 3172530 - protein, 20 aa, Giardia lamblia
TITRLCLFYLKDVKKNEDEV

SEQ ID NO: 3172531 - protein, 26 aa, Giardia lamblia
TITRNIMLKICFELERTGSYRNLIEL

SEQ ID NO: 3172532 - protein, 20 aa, Giardia lamblia
TITSISCHPMGNIVAVACTD

SEQ ID NO: 3172533 - protein, 29 aa, Giardia lamblia
TITSLYAALRMVWTISRYYNTEDRLLPLM

SEQ ID NO: 3172534 - protein, 28 aa, Giardia lamblia
TITTLCWNREKHGLLGWSGVDQTVSVGF

SEQ ID NO: 3172535 - protein, 24 aa, Giardia lamblia
TIVESLAIQSVRLFADIVNSVSTS

SEQ ID NO: 3172536 - protein, 19 aa, Giardia lamblia
TIVGLPIFKHNKCLYTEMN

SEQ ID NO: 3172537 - protein, 18 aa, Giardia lamblia
TIVKEGAKSQMEFEERFI

SEQ ID NO: 3172538 - protein, 24 aa, Giardia lamblia
TIVKLWIHETFREFTDSRSRVFYR

SEQ ID NO: 3172539 - protein, 31 aa, Giardia lamblia
TIVLRMDRDIVFKRTLNFGNFVLLSQTKGDE

SEQ ID NO: 3172540 - protein, 24 aa, Giardia lamblia
TIVSMCLKCAKILETLKLSHSGHT

SEQ ID NO: 3172541 - protein, 25 aa, Giardia lamblia
TIWEGCTLRVYMFFPEDYPIAPPKV

SEQ ID NO: 3172542 - protein, 24 aa, Giardia lamblia
TIYAELKVGGYLSSSAGDLVLEDF

SEQ ID NO: 3172543 - protein, 21 aa, Giardia lamblia
TIYAWCIYLSKSLHITGDAWK

SEQ ID NO: 3172544 - protein, 24 aa, Giardia lamblia
TIYRRALENGREFYARAKNGDEHY

SEQ ID NO: 3172545 - protein, 24 aa, Giardia lamblia
TIYYKDGRNALMIAAEAGAMNACL

SEQ ID NO: 3172546 - protein, 19 aa, Giardia lamblia
TKADARFGKPLVRETKRTR

SEQ ID NO: 3172547 - protein, 26 aa, Giardia lamblia
TKAFLQRKTVSFGVRLSAAGSSSEET

SEQ ID NO: 3172548 - protein, 24 aa, Giardia lamblia
TKAFPGCRCPLLVTPAFILERRSI

SEQ ID NO: 3172549 - protein, 25 aa, Giardia lamblia
TKAFQIPIQFREIFHPRRISHVILT

SEQ ID NO: 3172550 - protein, 23 aa, Giardia lamblia
TKAKQDPSHFFLRFINDSDAVVQ

SEQ ID NO: 3172551 - protein, 19 aa, Giardia lamblia
TKAKWIVALSAMVAVAGLQ

SEQ ID NO: 3172552 - protein, 23 aa, Giardia lamblia
TKAMKKAAPIVGFNNNFQPEEYM

SEQ ID NO: 3172553 - protein, 18 aa, Giardia lamblia
TKAPIVFLGTGEKIEDLE

SEQ ID NO: 3172554 - protein, 18 aa, Giardia lamblia
TKAVTCNDLPYSKKDFDE

SEQ ID NO: 3172555 - protein, 25 aa, Giardia lamblia
TKAYLYLRLIDGCALDDISFNDIDD

SEQ ID NO: 3172556 - protein, 24 aa, Giardia lamblia
TKDDMRPYISILVPGSIQPLMKQL

SEQ ID NO: 3172557 - protein, 24 aa, Giardia lamblia
TKDFLPNRHLPILQSPSAPDSSQS

SEQ ID NO: 3172558 - protein, 21 aa, Giardia lamblia
TKDKIRCLFALADYSAVQEEA

SEQ ID NO: 3172559 - protein, 20 aa, Giardia lamblia
TKDRCMRPLYSTNLQQQKLP

SEQ ID NO: 3172560 - protein, 19 aa, Giardia lamblia
TKDSLSIGSWLSCDSGCRS

SEQ ID NO: 3172561 - protein, 20 aa, Giardia lamblia
TKDVCSLLNEILMRLSEAET

SEQ ID NO: 3172562 - protein, 23 aa, Giardia lamblia
TKDYSSLQLYSGMFDGGNQKSVT

SEQ ID NO: 3172563 - protein, 18 aa, Giardia lamblia
TKEAGCKTVSVDGKTALM

SEQ ID NO: 3172564 - protein, 25 aa, Giardia lamblia
TKEGARKGLPDLVNRPGVEKSTESG

SEQ ID NO: 3172565 - protein, 19 aa, Giardia lamblia
TKEGMNALMYAIQVGSKPC

SEQ ID NO: 3172566 - protein, 24 aa, Giardia lamblia
TKENRAGGCDWSYFMNNSDVSLVF

SEQ ID NO: 3172567 - protein, 20 aa, Giardia lamblia
TKEPQEFVRFAGASNTEDVI

SEQ ID NO: 3172568 - protein, 21 aa, Giardia lamblia
TKEQLRKLLVVRDTSLQAENK

SEQ ID NO: 3172569 - protein, 20 aa, Giardia lamblia
TKFAIIRLVSVMAEASRDND

SEQ ID NO: 3172570 - protein, 17 aa, Giardia lamblia
TKFALTIAEKEVIYRFY

SEQ ID NO: 3172571 - protein, 28 aa, Giardia lamblia
TKFASVGLIPRFIVQLFDALASIQSVWK

SEQ ID NO: 3172572 - protein, 17 aa, Giardia lamblia
TKFCSEITKYREGKSTP

SEQ ID NO: 3172573 - protein, 33 aa, Giardia lamblia
TKFEYYSYIKLCQLRFNMSIGTAKNCKWKSSDD

SEQ ID NO: 3172574 - protein, 25 aa, Giardia lamblia
TKFIPRCTKESLEVVVKLLGESTHK

SEQ ID NO: 3172575 - protein, 24 aa, Giardia lamblia
TKFKSFNVNSIWVRLEALKRLADA

SEQ ID NO: 3172576 - protein, 22 aa, Giardia lamblia
TKFSSGAGIGFILVFVHYNGKI

SEQ ID NO: 3172577 - protein, 17 aa, Giardia lamblia
TKGLPLPQLFLKKWKLY

SEQ ID NO: 3172578 - protein, 18 aa, Giardia lamblia
TKGRLLFADLLALKESFL

SEQ ID NO: 3172579 - protein, 22 aa, Giardia lamblia
TKGVALCPHDSLLQRAVLANLQ

SEQ ID NO: 3172580 - protein, 20 aa, Giardia lamblia
TKGYRGLVRRVLLEESDSSH

SEQ ID NO: 3172581 - protein, 18 aa, Giardia lamblia
TKHLPRPSLSTIDDPTAE

SEQ ID NO: 3172582 - protein, 17 aa, Giardia lamblia
TKHSVVAARCLRDKIIV

SEQ ID NO: 3172583 - protein, 25 aa, Giardia lamblia
TKIAECKAEMCAFGNTLTATSDKIM

SEQ ID NO: 3172584 - protein, 22 aa, Giardia lamblia
TKIKMGHPLLLKTANLDPVPED

SEQ ID NO: 3172585 - protein, 26 aa, Giardia lamblia
TKIKSLYMLDCEFASLVTLLKPFQRV

SEQ ID NO: 3172586 - protein, 17 aa, Giardia lamblia
TKILDCFIREFKPNEFN

SEQ ID NO: 3172587 - protein, 25 aa, Giardia lamblia
TKIRELCDLYPILLGTTSAELDTQA

SEQ ID NO: 3172588 - protein, 24 aa, Giardia lamblia
TKISKVVASKVGFLRAEGSDASGV

SEQ ID NO: 3172589 - protein, 24 aa, Giardia lamblia
TKIVEVVELNRIISVKSDQLEWVA

SEQ ID NO: 3172590 - protein, 26 aa, Giardia lamblia
TKKAPVRYLITLSCLCIAQRGRVVDM

SEQ ID NO: 3172591 - protein, 17 aa, Giardia lamblia
TKKEWKPVYDLGTVLTS

SEQ ID NO: 3172592 - protein, 17 aa, Giardia lamblia
TKKIFGRFLKRKEEDRL

SEQ ID NO: 3172593 - protein, 25 aa, Giardia lamblia
TKLAAFMCGYGIFEITLSRSYGENE

SEQ ID NO: 3172594 - protein, 19 aa, Giardia lamblia
TKLASSIAGYTTFQITITR

SEQ ID NO: 3172595 - protein, 24 aa, Giardia lamblia
TKLHKVCPVNVFADVTRQLDIEDF

SEQ ID NO: 3172596 - protein, 21 aa, Giardia lamblia
TKLKCRNHRLLPFLLASNQVN

SEQ ID NO: 3172597 - protein, 17 aa, Giardia lamblia
TKLKPMLEYVGTLIKSP

SEQ ID NO: 3172598 - protein, 22 aa, Giardia lamblia
TKLPYVRIDWDRWVDEGEDENT

SEQ ID NO: 3172599 - protein, 17 aa, Giardia lamblia
TKLQAAVKYLKAKLLAD

SEQ ID NO: 3172600 - protein, 20 aa, Giardia lamblia
TKLRKFCDENGIANPDSAVF

SEQ ID NO: 3172601 - protein, 19 aa, Giardia lamblia
TKLSLGLSDCYLIMEGLLA

SEQ ID NO: 3172602 - protein, 20 aa, Giardia lamblia
TKLTALTAIAGFPPNYTRQG

SEQ ID NO: 3172603 - protein, 22 aa, Giardia lamblia
TKLVQCIHAFDLVVLGTGPAGL

SEQ ID NO: 3172604 - protein, 18 aa, Giardia lamblia
TKLVYSLKLIRKLSDHYF

SEQ ID NO: 3172605 - protein, 17 aa, Giardia lamblia
TKMDVWALGCLIYEICL

SEQ ID NO: 3172606 - protein, 33 aa, Giardia lamblia
TKMKGSRIDLTYCITRLRYLTFKISSILNLARV

SEQ ID NO: 3172607 - protein, 23 aa, Giardia lamblia
TKNFFPCILKFLYETDETMLTVP

SEQ ID NO: 3172608 - protein, 19 aa, Giardia lamblia
TKNGECFRADKLIESYLEK

SEQ ID NO: 3172609 - protein, 32 aa, Giardia lamblia
TKNPCKLMTYRIADFPFFRALFAFASVDPKVP

SEQ ID NO: 3172610 - protein, 27 aa, Giardia lamblia
TKPGTLRVYGVKKWACENIYTIEASVY

SEQ ID NO: 3172611 - protein, 17 aa, Giardia lamblia
TKPHAFKDVVPDLPRSI

SEQ ID NO: 3172612 - protein, 20 aa, Giardia lamblia
TKPRSLINISQFLDGNYTLL

SEQ ID NO: 3172613 - protein, 17 aa, Giardia lamblia
TKPSVPLAKALMGHPKT

SEQ ID NO: 3172614 - protein, 21 aa, Giardia lamblia
TKPYKPVVVEFVIANPSGNPF

SEQ ID NO: 3172615 - protein, 22 aa, Giardia lamblia
TKQCLPSSASDTFLFASSTSGL

SEQ ID NO: 3172616 - protein, 18 aa, Giardia lamblia
TKQCPKRTRVEIVPFEYL

SEQ ID NO: 3172617 - protein, 18 aa, Giardia lamblia
TKQFWSLDDCFKEYAKSS

SEQ ID NO: 3172618 - protein, 23 aa, Giardia lamblia
TKQGEVIAAVIINLVLKELQTIF

SEQ ID NO: 3172619 - protein, 22 aa, Giardia lamblia
TKQHRTAISLQHFIKNSRRTLL

SEQ ID NO: 3172620 - protein, 29 aa, Giardia lamblia
TKQKNRYRIAYTRLLEMYSEDIAAVNRIL

SEQ ID NO: 3172621 - protein, 27 aa, Giardia lamblia
TKRRCTPLMLSFCFIIRNAVRRAKNMS

SEQ ID NO: 3172622 - protein, 18 aa, Giardia lamblia
TKRRSKKSAVERATTPSV

SEQ ID NO: 3172623 - protein, 24 aa, Giardia lamblia
TKRSFRIGCFLIGLYDICKVTNIL

SEQ ID NO: 3172624 - protein, 22 aa, Giardia lamblia
TKRSRLSTKLFLSMKNQEHGDV

SEQ ID NO: 3172625 - protein, 25 aa, Giardia lamblia
TKRVRSLITMEVCKQKLLITPQDLD

SEQ ID NO: 3172626 - protein, 17 aa, Giardia lamblia
TKSALLHNLLKDTGVDS

SEQ ID NO: 3172627 - protein, 17 aa, Giardia lamblia
TKSPEIILDITPRAQHF

SEQ ID NO: 3172628 - protein, 19 aa, Giardia lamblia
TKSPLCACVSGHYKENSAF

SEQ ID NO: 3172629 - protein, 18 aa, Giardia lamblia
TKSVALRIGRPFRPIYLV

SEQ ID NO: 3172630 - protein, 21 aa, Giardia lamblia
TKTELESGVGNLTFLENSIQV

SEQ ID NO: 3172631 - protein, 24 aa, Giardia lamblia
TKTGTEPFCIILAAAGNIVCVYTV

SEQ ID NO: 3172632 - protein, 26 aa, Giardia lamblia
TKTVERPLCRVRYGPTGAVLAIAYGD

SEQ ID NO: 3172633 - protein, 18 aa, Giardia lamblia
TKTWSAQVNPGFTKVEIV

SEQ ID NO: 3172634 - protein, 17 aa, Giardia lamblia
TKVAVAQFCKGMLTGMP

SEQ ID NO: 3172635 - protein, 19 aa, Giardia lamblia
TKVCSLLVESEKRMMTSKG

SEQ ID NO: 3172636 - protein, 23 aa, Giardia lamblia
TKVDCWSLGIVVLELCESLPPHM

SEQ ID NO: 3172637 - protein, 19 aa, Giardia lamblia
TKVKQGARPAIPSHYSSDL

SEQ ID NO: 3172638 - protein, 18 aa, Giardia lamblia
TKVPALRLNIAVRQYKMT

SEQ ID NO: 3172639 - protein, 25 aa, Giardia lamblia
TKVQSGLKFGKIIGADGKKVEVQSI

SEQ ID NO: 3172640 - protein, 17 aa, Giardia lamblia
TKYACKQDGAGMTALMH

SEQ ID NO: 3172641 - protein, 25 aa, Giardia lamblia
TKYAPCGKCQHKAGILSGNHPIECA

SEQ ID NO: 3172642 - protein, 27 aa, Giardia lamblia
TKYKSTCAIPTPLILRKHLAYHVHICI

SEQ ID NO: 3172643 - protein, 19 aa, Giardia lamblia
TKYLTEINNVQALRTSAIY

SEQ ID NO: 3172644 - protein, 21 aa, Giardia lamblia
TKYYGHAGIYAAAAYIYHDTY

SEQ ID NO: 3172645 - protein, 19 aa, Giardia lamblia
TLACKDLEVKLANAEDALT

SEQ ID NO: 3172646 - protein, 28 aa, Giardia lamblia
TLADLLCCIILCKIKGFATKDRISEVYD

SEQ ID NO: 3172647 - protein, 17 aa, Giardia lamblia
TLAFLLPVLTKLFTDYQ

SEQ ID NO: 3172648 - protein, 18 aa, Giardia lamblia
TLAGRISLPYALIDVRHE

SEQ ID NO: 3172649 - protein, 25 aa, Giardia lamblia
TLAKPLSFNAQNYWSQNIRAQSESL

SEQ ID NO: 3172650 - protein, 25 aa, Giardia lamblia
TLAKRFLELHPDYRYVNVSDLVHSS

SEQ ID NO: 3172651 - protein, 26 aa, Giardia lamblia
TLALTPRAKYGLGLVLPHHYYDEMHR

SEQ ID NO: 3172652 - protein, 27 aa, Giardia lamblia
TLARHDLGRCIKLLIRTQEGAQDAYGK

SEQ ID NO: 3172653 - protein, 17 aa, Giardia lamblia
TLARLLLLSADIRDFLC

SEQ ID NO: 3172654 - protein, 24 aa, Giardia lamblia
TLARLPGEVCVYRIEVHSDRKTLC

SEQ ID NO: 3172655 - protein, 17 aa, Giardia lamblia
TLATVIATKAWEVVHSN

SEQ ID NO: 3172656 - protein, 19 aa, Giardia lamblia
TLCDPIWLQRNPEVFYGFW

SEQ ID NO: 3172657 - protein, 20 aa, Giardia lamblia
TLCFALPILQELSQDPYGIF

SEQ ID NO: 3172658 - protein, 19 aa, Giardia lamblia
TLCIVHELLPMIIKVKCHG

SEQ ID NO: 3172659 - protein, 32 aa, Giardia lamblia
TLCQKPILFPSMKLAPGKGFNTEDDWITYIKE

SEQ ID NO: 3172660 - protein, 24 aa, Giardia lamblia
TLCSVSRTVSMLSINEYADTLKML

SEQ ID NO: 3172661 - protein, 22 aa, Giardia lamblia
TLDAKLKMWADIISNAMDLPYY

SEQ ID NO: 3172662 - protein, 24 aa, Giardia lamblia
TLDCTGCQVCSQVCPTREKGTLKM

SEQ ID NO: 3172663 - protein, 23 aa, Giardia lamblia
TLDDRSKRLFSLFRNVNLSALRS

SEQ ID NO: 3172664 - protein, 23 aa, Giardia lamblia
TLDIWSCGCVIFEILTGRTLFRT

SEQ ID NO: 3172665 - protein, 17 aa, Giardia lamblia
TLDRARFAMSDGASVDN

SEQ ID NO: 3172666 - protein, 28 aa, Giardia lamblia
TLDRWGERLRPMLVSGLTDKVAVTILSK

SEQ ID NO: 3172667 - protein, 32 aa, Giardia lamblia
TLDSMYIYSLDFFKMLFTRTLSKLQSLADETS

SEQ ID NO: 3172668 - protein, 24 aa, Giardia lamblia
TLDTMPRVSLRACNKNFSGGQVRE

SEQ ID NO: 3172669 - protein, 29 aa, Giardia lamblia
TLDYPLGFDYPAIVAPIECGDIFINTLRL

SEQ ID NO: 3172670 - protein, 23 aa, Giardia lamblia
TLEEIRRRYGVPVMNAKKVRDIK

SEQ ID NO: 3172671 - protein, 22 aa, Giardia lamblia
TLEIRFLSAWAKPDRASSKSVR

SEQ ID NO: 3172672 - protein, 19 aa, Giardia lamblia
TLELNGHVLVGIWENGEPK

SEQ ID NO: 3172673 - protein, 19 aa, Giardia lamblia
TLEPIDLVLPNPIRANPIC

SEQ ID NO: 3172674 - protein, 25 aa, Giardia lamblia
TLEYEPVRHLEILSVETSDAVSQCY

SEQ ID NO: 3172675 - protein, 19 aa, Giardia lamblia
TLEYLHFISATYKKVAMAQ

SEQ ID NO: 3172676 - protein, 17 aa, Giardia lamblia
TLFDIYVAIACEVSNVL

SEQ ID NO: 3172677 - protein, 25 aa, Giardia lamblia
TLFDTLRLLRSHSVHRLPIIDDGGS

SEQ ID NO: 3172678 - protein, 18 aa, Giardia lamblia
TLFEGGLFRAELRFPDNY

SEQ ID NO: 3172679 - protein, 18 aa, Giardia lamblia
TLFLEPRGKQSFLEQNTA

SEQ ID NO: 3172680 - protein, 17 aa, Giardia lamblia
TLFPHLLPYKVHEILSR

SEQ ID NO: 3172681 - protein, 34 aa, Giardia lamblia
TLFSFLSLVASYSCCYSRRLIIPLEFTSYERILR

SEQ ID NO: 3172682 - protein, 18 aa, Giardia lamblia
TLGDLVLDMKARMQAGAY

SEQ ID NO: 3172683 - protein, 24 aa, Giardia lamblia
TLGKTEPLMAKWNMVGATEPVSQE

SEQ ID NO: 3172684 - protein, 17 aa, Giardia lamblia
TLGLRMGEVLIKRYSAN

SEQ ID NO: 3172685 - protein, 22 aa, Giardia lamblia
TLHFFPPYLPSIISRLSSTPMG

SEQ ID NO: 3172686 - protein, 18 aa, Giardia lamblia
TLHKKGRVFSKKRMGDQS

SEQ ID NO: 3172687 - protein, 24 aa, Giardia lamblia
TLHRMSVDMISYWLTDHPQERTAI

SEQ ID NO: 3172688 - protein, 17 aa, Giardia lamblia
TLIAVKFDLYLPGSDYI

SEQ ID NO: 3172689 - protein, 18 aa, Giardia lamblia
TLIELVYNQFNSMAIDLR

SEQ ID NO: 3172690 - protein, 28 aa, Giardia lamblia
TLIKLCLLPKMRFVAAACRDPILKMSFL

SEQ ID NO: 3172691 - protein, 19 aa, Giardia lamblia
TLIRSCLQLDSNARPTAEE

SEQ ID NO: 3172692 - protein, 34 aa, Giardia lamblia
TLIRYCLEVLSLPVLNWIHGFEILDEPPGSPVQP

SEQ ID NO: 3172693 - protein, 22 aa, Giardia lamblia
TLKAKLLMKDKFIQQIMQSKSE

SEQ ID NO: 3172694 - protein, 19 aa, Giardia lamblia
TLKCDLCNIRSVEFLEPLT

SEQ ID NO: 3172695 - protein, 18 aa, Giardia lamblia
TLKCKAGAQVNEQAILHM

SEQ ID NO: 3172696 - protein, 24 aa, Giardia lamblia
TLKHPRFSRRDLLEGPVVDFLGYT

SEQ ID NO: 3172697 - protein, 32 aa, Giardia lamblia
TLKKEALRITASIKHMAGHLIAADIDARLAKY

SEQ ID NO: 3172698 - protein, 21 aa, Giardia lamblia
TLKRQGIALLDLEPVGTECSG

SEQ ID NO: 3172699 - protein, 17 aa, Giardia lamblia
TLKSLGIPSDELLFDEH

SEQ ID NO: 3172700 - protein, 25 aa, Giardia lamblia
TLLAKAIAMQAGFTFFSASASVIES

SEQ ID NO: 3172701 - protein, 20 aa, Giardia lamblia
TLLDEFCQYYPFDSTDNLHV

SEQ ID NO: 3172702 - protein, 25 aa, Giardia lamblia
TLLDIRPARLPKIRSPTEHTLRHIL

SEQ ID NO: 3172703 - protein, 24 aa, Giardia lamblia
TLLEARKEFIPGYREAEEKPPESV

SEQ ID NO: 3172704 - protein, 18 aa, Giardia lamblia
TLLEKFIFNEELDRLIAQ

SEQ ID NO: 3172705 - protein, 28 aa, Giardia lamblia
TLLEVAELFSLAFLQARALLAMRLILHR

SEQ ID NO: 3172706 - protein, 19 aa, Giardia lamblia
TLLEYRKLFRTLLQERIIC

SEQ ID NO: 3172707 - protein, 21 aa, Giardia lamblia
TLLGDNEWCCYALTGYSAREI

SEQ ID NO: 3172708 - protein, 17 aa, Giardia lamblia
TLLGEGSYGRAYLATDN

SEQ ID NO: 3172709 - protein, 32 aa, Giardia lamblia
TLLGMPFLRMHRMVIDLAIYQIRIGDVSLPIM

SEQ ID NO: 3172710 - protein, 20 aa, Giardia lamblia
TLLHKACREYIKDPTDENLM

SEQ ID NO: 3172711 - protein, 18 aa, Giardia lamblia
TLLKKAAAEIARLKELLT

SEQ ID NO: 3172712 - protein, 18 aa, Giardia lamblia
TLLMEKLRLKEEEYRIPQ

SEQ ID NO: 3172713 - protein, 23 aa, Giardia lamblia
TLLNCLDGFDCDERIKVLASTNR

SEQ ID NO: 3172714 - protein, 19 aa, Giardia lamblia
TLLNLDFFICLYQVHNVVI

SEQ ID NO: 3172715 - protein, 27 aa, Giardia lamblia
TLLNPLRLLACADSKLVRDEAIASAVR

SEQ ID NO: 3172716 - protein, 18 aa, Giardia lamblia
TLLPIIIPSVPPRRPSLA

SEQ ID NO: 3172717 - protein, 25 aa, Giardia lamblia
TLLQLKGELLRRMASGMRDTEQDYE

SEQ ID NO: 3172718 - protein, 18 aa, Giardia lamblia
TLLSFGASIATLVAEKGS

SEQ ID NO: 3172719 - protein, 17 aa, Giardia lamblia
TLLSRCPYGDLYVANSR

SEQ ID NO: 3172720 - protein, 19 aa, Giardia lamblia
TLMKEVLEYSLYYQNAYFF

SEQ ID NO: 3172721 - protein, 34 aa, Giardia lamblia
TLMNCFCPNCYHLKFFRLFKETDRELAINALNRL

SEQ ID NO: 3172722 - protein, 17 aa, Giardia lamblia
TLMRIWKSNIAYDEIVR

SEQ ID NO: 3172723 - protein, 18 aa, Giardia lamblia
TLMTRLMSNYTIRYYRSW

SEQ ID NO: 3172724 - protein, 18 aa, Giardia lamblia
TLNGEPIAAFRQAAISQM

SEQ ID NO: 3172725 - protein, 22 aa, Giardia lamblia
TLNGKCAKNTFELNTFSAAMGV

SEQ ID NO: 3172726 - protein, 21 aa, Giardia lamblia
TLNKACLVSGGPAQAMKQNDS

SEQ ID NO: 3172727 - protein, 25 aa, Giardia lamblia
TLNKNVRGCFVLHGLDGNLSGFDEQ

SEQ ID NO: 3172728 - protein, 19 aa, Giardia lamblia
TLPAFGWSLSLYLPGLHDT

SEQ ID NO: 3172729 - protein, 22 aa, Giardia lamblia
TLPDKRTALMQAAATGSVSCVR

SEQ ID NO: 3172730 - protein, 18 aa, Giardia lamblia
TLPESLRGQIFYSEASVH

SEQ ID NO: 3172731 - protein, 23 aa, Giardia lamblia
TLPNGCYHEGIGVGNAENTRLQA

SEQ ID NO: 3172732 - protein, 17 aa, Giardia lamblia
TLPQGGCVVAWMEDGQN

SEQ ID NO: 3172733 - protein, 32 aa, Giardia lamblia
TLPQWEAEFAKWIPSFQVLTVIGDKFQREEII

SEQ ID NO: 3172734 - protein, 18 aa, Giardia lamblia
TLPTVYCFESHYYRKSRD

SEQ ID NO: 3172735 - protein, 20 aa, Giardia lamblia
TLQDALRIAEEDKRVLELEG

SEQ ID NO: 3172736 - protein, 20 aa, Giardia lamblia
TLQLPIFYVVAIHLADNDLD

SEQ ID NO: 3172737 - protein, 17 aa, Giardia lamblia
TLQPGERSAIYITCFPP

SEQ ID NO: 3172738 - protein, 17 aa, Giardia lamblia
TLQQCRFLAEHSTSEEA

SEQ ID NO: 3172739 - protein, 17 aa, Giardia lamblia
TLQRQSVILVFKGPDYA

SEQ ID NO: 3172740 - protein, 46 aa, Giardia lamblia
TLQSELQFPGLVVLEIFAHWCDVCKSIDPIFRNHFVDLATRKLKFV

SEQ ID NO: 3172741 - protein, 21 aa, Giardia lamblia
TLRDKIVIHKKVLVDIQQQGF

SEQ ID NO: 3172742 - protein, 18 aa, Giardia lamblia
TLRECVMNAILNLASNKV

SEQ ID NO: 3172743 - protein, 27 aa, Giardia lamblia
TLRHEFPCYSNGLLSLALLEPSMASDW

SEQ ID NO: 3172744 - protein, 19 aa, Giardia lamblia
TLRPDSKYYRNTYVSKNKI

SEQ ID NO: 3172745 - protein, 25 aa, Giardia lamblia
TLRQRSDFRTNCTILTKQSETYTEM

SEQ ID NO: 3172746 - protein, 20 aa, Giardia lamblia
TLSARGVEFLHIVGVDNPLI

SEQ ID NO: 3172747 - protein, 22 aa, Giardia lamblia
TLSDAHSGIMLEDLQSLTDAER

SEQ ID NO: 3172748 - protein, 24 aa, Giardia lamblia
TLSDECARYLIGTSDVDIETCNTA

SEQ ID NO: 3172749 - protein, 20 aa, Giardia lamblia
TLSEAIKLPYVIKPEKNNAV

SEQ ID NO: 3172750 - protein, 23 aa, Giardia lamblia
TLSELQGIIARLAEENKLVNQQL

SEQ ID NO: 3172751 - protein, 23 aa, Giardia lamblia
TLSLRELLSFSQLDVVRFDLSHL

SEQ ID NO: 3172752 - protein, 17 aa, Giardia lamblia
TLSNLFHDLAMDYRTRQ

SEQ ID NO: 3172753 - protein, 26 aa, Giardia lamblia
TLSVSISAAMARRAFEKQANDRALNA

SEQ ID NO: 3172754 - protein, 32 aa, Giardia lamblia
TLSWFYWPMRFHCRCIEKMCRNFVFGSPIPLL

SEQ ID NO: 3172755 - protein, 23 aa, Giardia lamblia
TLSYRMICLISNLSDFRSLTRLN

SEQ ID NO: 3172756 - protein, 24 aa, Giardia lamblia
TLTKICSIPGLPGRVVEPQMITSP

SEQ ID NO: 3172757 - protein, 24 aa, Giardia lamblia
TLTPCARIAAALSVLQNEHSFLIS

SEQ ID NO: 3172758 - protein, 23 aa, Giardia lamblia
TLTREAVYLIVRYLPIALAEPDN

SEQ ID NO: 3172759 - protein, 25 aa, Giardia lamblia
TLTRNEIWARLSIKQEAHGVLMLAM

SEQ ID NO: 3172760 - protein, 25 aa, Giardia lamblia
TLTTLLPFVICKTVYLCSDAEVVLF

SEQ ID NO: 3172761 - protein, 25 aa, Giardia lamblia
TLTVMPLIWRRPDAVISQIAPHYPD

SEQ ID NO: 3172762 - protein, 18 aa, Giardia lamblia
TLVMLRKPFSLHTAENLL

SEQ ID NO: 3172763 - protein, 22 aa, Giardia lamblia
TLVPPFILAKSMLSDISVASSL

SEQ ID NO: 3172764 - protein, 25 aa, Giardia lamblia
TLVSRTVFIHGWFAIKSEFVVTGSL

SEQ ID NO: 3172765 - protein, 20 aa, Giardia lamblia
TLWYRCPSVLLGCRKYGGAL

SEQ ID NO: 3172766 - protein, 17 aa, Giardia lamblia
TLYCLKLLETTGVCGVP

SEQ ID NO: 3172767 - protein, 24 aa, Giardia lamblia
TLYEIMCRKALFKLSDDEFIKKSI

SEQ ID NO: 3172768 - protein, 23 aa, Giardia lamblia
TLYESAVSFGIRKTLLAEQGKAE

SEQ ID NO: 3172769 - protein, 24 aa, Giardia lamblia
TLYIKGWPLGFTVDTIRIFFRDVL

SEQ ID NO: 3172770 - protein, 19 aa, Giardia lamblia
TLYLAHLSRFCFKDNDPLL

SEQ ID NO: 3172771 - protein, 20 aa, Giardia lamblia
TLYRLVCQDPFIALRPVYQY

SEQ ID NO: 3172772 - protein, 21 aa, Giardia lamblia
TMANGRIAYHSTLPLEKELSL

SEQ ID NO: 3172773 - protein, 17 aa, Giardia lamblia
TMARAATSFGGFGLPII

SEQ ID NO: 3172774 - protein, 17 aa, Giardia lamblia
TMAVYCDCLLKARYTLQ

SEQ ID NO: 3172775 - protein, 24 aa, Giardia lamblia
TMDLVGGQRAMFMAHHLKVDPNFL

SEQ ID NO: 3172776 - protein, 24 aa, Giardia lamblia
TMDRYKDYFGFSVSHTTRAPRPGE

SEQ ID NO: 3172777 - protein, 26 aa, Giardia lamblia
TMEGKTQGKCLLPMSSDIDMIYEFLC

SEQ ID NO: 3172778 - protein, 27 aa, Giardia lamblia
TMFETWNLILDYRVLKQWVANTKQDGC

SEQ ID NO: 3172779 - protein, 19 aa, Giardia lamblia
TMGLDRPDDVFSRLYNLAE

SEQ ID NO: 3172780 - protein, 24 aa, Giardia lamblia
TMGNAAACELLYAREAKLSLQNKR

SEQ ID NO: 3172781 - protein, 18 aa, Giardia lamblia
TMHLKFVPSYLLPNAEGI

SEQ ID NO: 3172782 - protein, 17 aa, Giardia lamblia
TMICAASPFPPGSSVSG

SEQ ID NO: 3172783 - protein, 23 aa, Giardia lamblia
TMIKDIASALAFLHNPINFTTID

SEQ ID NO: 3172784 - protein, 23 aa, Giardia lamblia
TMLGHLLLEMALMRPLEKGTANS

SEQ ID NO: 3172785 - protein, 18 aa, Giardia lamblia
TMLRRSLGGLRRIITTRQ

SEQ ID NO: 3172786 - protein, 18 aa, Giardia lamblia
TMPMMVITMGGRFFDCKD

SEQ ID NO: 3172787 - protein, 25 aa, Giardia lamblia
TMRELGFKWRIGGLNASKYYDSNIG

SEQ ID NO: 3172788 - protein, 20 aa, Giardia lamblia
TMRPCPLSFTLTHSALSDTH

SEQ ID NO: 3172789 - protein, 17 aa, Giardia lamblia
TMRRTVFNHLPGNGTLH

SEQ ID NO: 3172790 - protein, 24 aa, Giardia lamblia
TMRRYDNATALSLALKMQNWELAE

SEQ ID NO: 3172791 - protein, 25 aa, Giardia lamblia
TMSDKRIEPAVAIMHLGLVLCTLSK

SEQ ID NO: 3172792 - protein, 18 aa, Giardia lamblia
TMSKRCSFVGTPYWLSPE

SEQ ID NO: 3172793 - protein, 25 aa, Giardia lamblia
TMSSRSHCIVFLRILDTATGQASGL

SEQ ID NO: 3172794 - protein, 21 aa, Giardia lamblia
TMYEYEARAVIGTREAIGAPF

SEQ ID NO: 3172795 - protein, 24 aa, Giardia lamblia
TMYILGTDGVDLWFFKVPLNQFSV

SEQ ID NO: 3172796 - protein, 17 aa, Giardia lamblia
TMYPKPYTQFRERIEKY

SEQ ID NO: 3172797 - protein, 23 aa, Giardia lamblia
TNAKRLAMEECALLSKMNNPNIV

SEQ ID NO: 3172798 - protein, 18 aa, Giardia lamblia
TNALFARVSVICKDGQEK

SEQ ID NO: 3172799 - protein, 17 aa, Giardia lamblia
TNAMAYGYVNWPQAISL

SEQ ID NO: 3172800 - protein, 25 aa, Giardia lamblia
TNARPSWLKTMRTLLNLKHCNVSSY

SEQ ID NO: 3172801 - protein, 39 aa, Giardia lamblia
TNCLHTVCYSCFLRNRVLCGRKACLLCSDVIKNAIIYKK

SEQ ID NO: 3172802 - protein, 23 aa, Giardia lamblia
TNDDLRLLLGLFNRGDVDTEGLT

SEQ ID NO: 3172803 - protein, 27 aa, Giardia lamblia
TNDFFKRFMIQFGMYDARTKRYVKDSL

SEQ ID NO: 3172804 - protein, 26 aa, Giardia lamblia
TNDGWTALMIAIKFNAIGCVELLAGC

SEQ ID NO: 3172805 - protein, 20 aa, Giardia lamblia
TNDRCMLVYDLNNKLVNQKQ

SEQ ID NO: 3172806 - protein, 17 aa, Giardia lamblia
TNEGWTALMVAAFHNSV

SEQ ID NO: 3172807 - protein, 23 aa, Giardia lamblia
TNEKRASLELKKLKTQVATLTRQ

SEQ ID NO: 3172808 - protein, 17 aa, Giardia lamblia
TNFLDMDRELWLEKYPA

SEQ ID NO: 3172809 - protein, 24 aa, Giardia lamblia
TNFLRAHHAVPFDMHACKISQSRT

SEQ ID NO: 3172810 - protein, 23 aa, Giardia lamblia
TNFPEAIDQAAFRRFDKRIFISL

SEQ ID NO: 3172811 - protein, 17 aa, Giardia lamblia
TNGRTPLTYAVAKGNTD

SEQ ID NO: 3172812 - protein, 18 aa, Giardia lamblia
TNGTLPIQFEAVKDQFNH

SEQ ID NO: 3172813 - protein, 18 aa, Giardia lamblia
TNGYEFSLSIAIPHKTLV

SEQ ID NO: 3172814 - protein, 31 aa, Giardia lamblia
TNHIRFEFNIDLCRKLGVIVHPSIGHIHAGA

SEQ ID NO: 3172815 - protein, 18 aa, Giardia lamblia
TNICKILLSEAGMRKIDG

SEQ ID NO: 3172816 - protein, 19 aa, Giardia lamblia
TNIEWKLIYELNYELDDRM

SEQ ID NO: 3172817 - protein, 29 aa, Giardia lamblia
TNIFTILAILYCKYMWIVRKTDPQRLQTY

SEQ ID NO: 3172818 - protein, 21 aa, Giardia lamblia
TNIKYSPFLLLGSYKTIVSDY

SEQ ID NO: 3172819 - protein, 24 aa, Giardia lamblia
TNILPQRVGVMLVGLGGSNGSTLV

SEQ ID NO: 3172820 - protein, 18 aa, Giardia lamblia
TNILPYLYHPSFPELMYK

SEQ ID NO: 3172821 - protein, 24 aa, Giardia lamblia
TNIPALAVYHSFNSVFWSSTIRSE

SEQ ID NO: 3172822 - protein, 24 aa, Giardia lamblia
TNIPKKRPVSNFAKTVEKKAQLAP

SEQ ID NO: 3172823 - protein, 21 aa, Giardia lamblia
TNIPSSVVVKLRYDGDPKISY

SEQ ID NO: 3172824 - protein, 20 aa, Giardia lamblia
TNLRPLWFIITKGPVATAVV

SEQ ID NO: 3172825 - protein, 21 aa, Giardia lamblia
TNLRSLLSLRTAGMDRAISLV

SEQ ID NO: 3172826 - protein, 19 aa, Giardia lamblia
TNLSSAYHLLRLSQEATTS

SEQ ID NO: 3172827 - protein, 18 aa, Giardia lamblia
TNMAHKLSEATYLAEKYE

SEQ ID NO: 3172828 - protein, 26 aa, Giardia lamblia
TNNKGKAAIHYAELGGHSGVMAILTE

SEQ ID NO: 3172829 - protein, 25 aa, Giardia lamblia
TNNLDCLKALLQHFVVSQDDLTFMI

SEQ ID NO: 3172830 - protein, 25 aa, Giardia lamblia
TNNPRAGQMFKQFIAYIKTVQEEIP

SEQ ID NO: 3172831 - protein, 23 aa, Giardia lamblia
TNPFAVSVPTVFLHGAQETPGIL

SEQ ID NO: 3172832 - protein, 23 aa, Giardia lamblia
TNPFRLNSDFDIYKVRADDQREK

SEQ ID NO: 3172833 - protein, 31 aa, Giardia lamblia
TNPFSLSLCRVSDCGTPLCFGNASVEYYKKN

SEQ ID NO: 3172834 - protein, 18 aa, Giardia lamblia
TNPLPFPQMDIYPRLLLL

SEQ ID NO: 3172835 - protein, 24 aa, Giardia lamblia
TNPSRADCSVSFTPNQRIFIDDLS

SEQ ID NO: 3172836 - protein, 19 aa, Giardia lamblia
TNPYLLSRRLFGEQSACDQ

SEQ ID NO: 3172837 - protein, 21 aa, Giardia lamblia
TNPYTGLPCGSQMLSTGQVYN

SEQ ID NO: 3172838 - protein, 18 aa, Giardia lamblia
TNQNGCFTLVLLPGPYKP

SEQ ID NO: 3172839 - protein, 24 aa, Giardia lamblia
TNRFFVVYFTYWELYNEELKDLLA

SEQ ID NO: 3172840 - protein, 22 aa, Giardia lamblia
TNRVADRLYVEFNNEEFVIPDL

SEQ ID NO: 3172841 - protein, 27 aa, Giardia lamblia
TNRVPFHICRAFSKLIRSLCAQQASAI

SEQ ID NO: 3172842 - protein, 24 aa, Giardia lamblia
TNSLEVWSRILMKRALSDEEIQRF

SEQ ID NO: 3172843 - protein, 24 aa, Giardia lamblia
TNSRLKRIAALTIDTTSSPHSEQA

SEQ ID NO: 3172844 - protein, 18 aa, Giardia lamblia
TNSVLFKMSPSINQGAVP

SEQ ID NO: 3172845 - protein, 17 aa, Giardia lamblia
TNTEFQVGLKLIATQVL

SEQ ID NO: 3172846 - protein, 24 aa, Giardia lamblia
TNTEIQWRTRLTLIESVERLVQVK

SEQ ID NO: 3172847 - protein, 25 aa, Giardia lamblia
TNTLAENCRLFWKSHGSQSGEPGPL

SEQ ID NO: 3172848 - protein, 20 aa, Giardia lamblia
TNVFAAIMFAAKRRAVAATQ

SEQ ID NO: 3172849 - protein, 18 aa, Giardia lamblia
TNVFKRRTLELLGTKLGC

SEQ ID NO: 3172850 - protein, 17 aa, Giardia lamblia
TNVHFGTVVRKCSDLSL

SEQ ID NO: 3172851 - protein, 20 aa, Giardia lamblia
TNVLRPLSQFSIGRGESKSP

SEQ ID NO: 3172852 - protein, 25 aa, Giardia lamblia
TNVSGRLYLFDSFGDVVGFISSAGN

SEQ ID NO: 3172853 - protein, 27 aa, Giardia lamblia
TNYKAGEVILLYGIGWCDIIGASGHIE

SEQ ID NO: 3172854 - protein, 24 aa, Giardia lamblia
TNYPEIVNILLKYEEAMQDEDGWT

SEQ ID NO: 3172855 - protein, 18 aa, Giardia lamblia
TPADVAVKAGHPELVALL

SEQ ID NO: 3172856 - protein, 17 aa, Giardia lamblia
TPALRKLPAWQLAFEHL

SEQ ID NO: 3172857 - protein, 22 aa, Giardia lamblia
TPAQPAIIPGIMSAPPQVPVTM

SEQ ID NO: 3172858 - protein, 24 aa, Giardia lamblia
TPASDFKFSFGYIPDQEPPRKSLR

SEQ ID NO: 3172859 - protein, 19 aa, Giardia lamblia
TPDELKMGLPGSGMTDKCP

SEQ ID NO: 3172860 - protein, 17 aa, Giardia lamblia
TPDGLTAYMLSVINGHW

SEQ ID NO: 3172861 - protein, 23 aa, Giardia lamblia
TPDIPALLLMEIENMPNCIGENF

SEQ ID NO: 3172862 - protein, 20 aa, Giardia lamblia
TPDLCGAALTSAEGVIHNML

SEQ ID NO: 3172863 - protein, 22 aa, Giardia lamblia
TPDLFLHVLKLFEGMTEEERVA

SEQ ID NO: 3172864 - protein, 21 aa, Giardia lamblia
TPDLFQKRMQPICELSLHGCE

SEQ ID NO: 3172865 - protein, 25 aa, Giardia lamblia
TPDQALCALCEYAAVAPNLEEKRNA

SEQ ID NO: 3172866 - protein, 23 aa, Giardia lamblia
TPDTCPEHLSAILQALQSLVDIS

SEQ ID NO: 3172867 - protein, 31 aa, Giardia lamblia
TPEARFLVAEVAYRRSIPLVHAAAVRFTVTL

SEQ ID NO: 3172868 - protein, 23 aa, Giardia lamblia
TPEFGLVFSQVFFSDSRCVNDLL

SEQ ID NO: 3172869 - protein, 18 aa, Giardia lamblia
TPEFQRRAIKRIRLTAKP

SEQ ID NO: 3172870 - protein, 18 aa, Giardia lamblia
TPEMNDLFVRAYNSIIGE

SEQ ID NO: 3172871 - protein, 24 aa, Giardia lamblia
TPENMYCYCTFWGPIVPANTGFLF

SEQ ID NO: 3172872 - protein, 25 aa, Giardia lamblia
TPEPPRPSPYVPLQEVYTHWHPVFQ

SEQ ID NO: 3172873 - protein, 25 aa, Giardia lamblia
TPERVCELYVLFSLQNMKTNHALLA

SEQ ID NO: 3172874 - protein, 27 aa, Giardia lamblia
TPEYARFSAEITLVFLSGEKVVIDWSA

SEQ ID NO: 3172875 - protein, 17 aa, Giardia lamblia
TPGKLSISDLMYGERRQ

SEQ ID NO: 3172876 - protein, 25 aa, Giardia lamblia
TPGPKSFLSVISFNPAVISNHQRIL

SEQ ID NO: 3172877 - protein, 17 aa, Giardia lamblia
TPHGYLLGRLMREYHAL

SEQ ID NO: 3172878 - protein, 17 aa, Giardia lamblia
TPHSFDFASPNEYLLNV

SEQ ID NO: 3172879 - protein, 17 aa, Giardia lamblia
TPILRDTPELVFSSVQD

SEQ ID NO: 3172880 - protein, 26 aa, Giardia lamblia
TPINFSLPGPRYSRSRATSGSSSGSS

SEQ ID NO: 3172881 - protein, 21 aa, Giardia lamblia
TPIPCHFYTPILRENDDTVLR

SEQ ID NO: 3172882 - protein, 19 aa, Giardia lamblia
TPITLSWWKGNQVTRKTLL

SEQ ID NO: 3172883 - protein, 19 aa, Giardia lamblia
TPITPIGRIPRPVSEEDDT

SEQ ID NO: 3172884 - protein, 18 aa, Giardia lamblia
TPKAELCPEMGASQEKQP

SEQ ID NO: 3172885 - protein, 24 aa, Giardia lamblia
TPKDLCPLCSAQLGCIQYDNLDKL

SEQ ID NO: 3172886 - protein, 23 aa, Giardia lamblia
TPKPLLRTPHRTILETQIQSLYE

SEQ ID NO: 3172887 - protein, 23 aa, Giardia lamblia
TPKPPPKRMYFTKVENWAPGPDA

SEQ ID NO: 3172888 - protein, 21 aa, Giardia lamblia
TPKPRLAILPGANRTFCSLPH

SEQ ID NO: 3172889 - protein, 28 aa, Giardia lamblia
TPKTKMRFSREVSFAELQRVTNCMAKHE

SEQ ID NO: 3172890 - protein, 20 aa, Giardia lamblia
TPKVSSRVAALVDNTEPNRI

SEQ ID NO: 3172891 - protein, 31 aa, Giardia lamblia
TPKWSLAVAACLRKSKQYRDAIYEYKHILKR

SEQ ID NO: 3172892 - protein, 19 aa, Giardia lamblia
TPLFCYLAHKLRDCACYYL

SEQ ID NO: 3172893 - protein, 31 aa, Giardia lamblia
TPLFNQRAYPSVTYPCCAYPLAQAADVVDLV

SEQ ID NO: 3172894 - protein, 23 aa, Giardia lamblia
TPLHFACAFGCDSFIYDKRNTLV

SEQ ID NO: 3172895 - protein, 18 aa, Giardia lamblia
TPLMLAVQECNTVLTRTI

SEQ ID NO: 3172896 - protein, 25 aa, Giardia lamblia
TPLYELPAQFFLQVNSPLGASPPPN

SEQ ID NO: 3172897 - protein, 20 aa, Giardia lamblia
TPMQIKMIFSTAREVLDRPD

SEQ ID NO: 3172898 - protein, 18 aa, Giardia lamblia
TPMRVVSTKAYIAMNTPT

SEQ ID NO: 3172899 - protein, 19 aa, Giardia lamblia
TPNGLPVKIENSSVTVTLP

SEQ ID NO: 3172900 - protein, 17 aa, Giardia lamblia
TPNGRRITIIDAPGHKG

SEQ ID NO: 3172901 - protein, 25 aa, Giardia lamblia
TPNHEGLVVRCCSHLFNKAAEENTD

SEQ ID NO: 3172902 - protein, 24 aa, Giardia lamblia
TPPELPSDTWIGSTERGFRTIRKS

SEQ ID NO: 3172903 - protein, 25 aa, Giardia lamblia
TPPENQLSCLASFYQNCEDKRKSQP

SEQ ID NO: 3172904 - protein, 17 aa, Giardia lamblia
TPPIKSQEKAVCHKNSA

SEQ ID NO: 3172905 - protein, 22 aa, Giardia lamblia
TPPISCSFVAYDLDLSGIRPGD

SEQ ID NO: 3172906 - protein, 22 aa, Giardia lamblia
TPPQCVHSPFAQGYVAVSSPFS

SEQ ID NO: 3172907 - protein, 25 aa, Giardia lamblia
TPQDRRPAIKRGKEMSADDVKDAHP

SEQ ID NO: 3172908 - protein, 25 aa, Giardia lamblia
TPQIKCVLCGAVSPPTSICPSCGVN

SEQ ID NO: 3172909 - protein, 25 aa, Giardia lamblia
TPQLKLSGSSGFNCQTKIGRARTAR

SEQ ID NO: 3172910 - protein, 17 aa, Giardia lamblia
TPRAVAAACDQKAIQTE

SEQ ID NO: 3172911 - protein, 23 aa, Giardia lamblia
TPRCTPSRMIFPCITDGHMYTLL

SEQ ID NO: 3172912 - protein, 20 aa, Giardia lamblia
TPRDWTVKGVFARLYQNAEE

SEQ ID NO: 3172913 - protein, 19 aa, Giardia lamblia
TPRGSMLLVGYGGSGRRSL

SEQ ID NO: 3172914 - protein, 28 aa, Giardia lamblia
TPRNMSPEISFFCNKGFVLSNYLTIHLQ

SEQ ID NO: 3172915 - protein, 20 aa, Giardia lamblia
TPRRRCLGTREFLARNDENP

SEQ ID NO: 3172916 - protein, 26 aa, Giardia lamblia
TPSQGECSLPWAVVMLFYSCVETSTM

SEQ ID NO: 3172917 - protein, 20 aa, Giardia lamblia
TPSVPFKPVVMEPTGSANSA

SEQ ID NO: 3172918 - protein, 22 aa, Giardia lamblia
TPSVVSRRPLFITPVKKTGAAT

SEQ ID NO: 3172919 - protein, 24 aa, Giardia lamblia
TPTEYSSRLAAAGIIYDEVPPQQA

SEQ ID NO: 3172920 - protein, 30 aa, Giardia lamblia
TPTLLRPHGLLSFKLILPAVNCLKMAQNQW

SEQ ID NO: 3172921 - protein, 18 aa, Giardia lamblia
TPTLSPPASVVFPRTSQP

SEQ ID NO: 3172922 - protein, 22 aa, Giardia lamblia
TPVQQTCPIRCSTEERGVQSMA

SEQ ID NO: 3172923 - protein, 24 aa, Giardia lamblia
TPVSPELVLSVLRQLAAALAYLHG

SEQ ID NO: 3172924 - protein, 34 aa, Giardia lamblia
TPVTERICVIPAVKLECHGKFRLVTSAILKDLAR

SEQ ID NO: 3172925 - protein, 17 aa, Giardia lamblia
TPWTTDFIFTVFPPSSY

SEQ ID NO: 3172926 - protein, 24 aa, Giardia lamblia
TPYEHAKELVLHHVFRDSPLANPI

SEQ ID NO: 3172927 - protein, 19 aa, Giardia lamblia
TPYLAEGGTDVFTIYREAF

SEQ ID NO: 3172928 - protein, 24 aa, Giardia lamblia
TPYLECANIVDVLKKVEGNIPPNG

SEQ ID NO: 3172929 - protein, 18 aa, Giardia lamblia
TQAAIEYFDIEMVSKKHK

SEQ ID NO: 3172930 - protein, 23 aa, Giardia lamblia
TQAKKVPRTFTFDAVYDQTSCNY

SEQ ID NO: 3172931 - protein, 18 aa, Giardia lamblia
TQAPRIPVVAARIYPKLS

SEQ ID NO: 3172932 - protein, 25 aa, Giardia lamblia
TQDTLKLQASMGIHVADKIIAHTGS

SEQ ID NO: 3172933 - protein, 27 aa, Giardia lamblia
TQDVPVYWVPWFGVWIYHGCECTRDLG

SEQ ID NO: 3172934 - protein, 41 aa, Giardia lamblia
TQELRKMAFEHAEPISDCLKWLKTARSTFDPTLVSSAQRPL

SEQ ID NO: 3172935 - protein, 18 aa, Giardia lamblia
TQEMLDWDVEIRQIPKPK

SEQ ID NO: 3172936 - protein, 17 aa, Giardia lamblia
TQENLYLRTRLEQSKVL

SEQ ID NO: 3172937 - protein, 20 aa, Giardia lamblia
TQFLLRASFLQLYKEQLQDL

SEQ ID NO: 3172938 - protein, 23 aa, Giardia lamblia
TQFPRLRSLSLAYNDIVDISQLE

SEQ ID NO: 3172939 - protein, 20 aa, Giardia lamblia
TQGFLTGCLQNFARKYVIAI

SEQ ID NO: 3172940 - protein, 23 aa, Giardia lamblia
TQGMIQLYCFSRAYTRMLSGQCV

SEQ ID NO: 3172941 - protein, 32 aa, Giardia lamblia
TQGREIRCCLHCGFPILPGFLSSRRGMTSFLT

SEQ ID NO: 3172942 - protein, 23 aa, Giardia lamblia
TQHGALQLLRWLRAPTTDLAVIS

SEQ ID NO: 3172943 - protein, 27 aa, Giardia lamblia
TQICERLRVSVALAKRVMRQLVKSGDF

SEQ ID NO: 3172944 - protein, 26 aa, Giardia lamblia
TQIEPFTAFVCLRILETRCPSLFKDV

SEQ ID NO: 3172945 - protein, 25 aa, Giardia lamblia
TQIHLPLGVAKGMQLHKSFPDVSSK

SEQ ID NO: 3172946 - protein, 18 aa, Giardia lamblia
TQIQLVFLLEYIKKGIKR

SEQ ID NO: 3172947 - protein, 21 aa, Giardia lamblia
TQKGWTALMWAVASGNTEGVE

SEQ ID NO: 3172948 - protein, 19 aa, Giardia lamblia
TQKYSSWELTAFDSACFPC

SEQ ID NO: 3172949 - protein, 23 aa, Giardia lamblia
TQLCSSYVLVALVSLQLVRHIQI

SEQ ID NO: 3172950 - protein, 22 aa, Giardia lamblia
TQLEGLQKLYAANVEQTRLQDA

SEQ ID NO: 3172951 - protein, 26 aa, Giardia lamblia
TQLGELCLAGRMLSLGYYAGDALYQY

SEQ ID NO: 3172952 - protein, 17 aa, Giardia lamblia
TQLIFPPFVQFQSNLRT

SEQ ID NO: 3172953 - protein, 26 aa, Giardia lamblia
TQLKEGAESLAWLKAATARYIEAVQQ

SEQ ID NO: 3172954 - protein, 21 aa, Giardia lamblia
TQLLSALCFGTMLRIEEQKIS

SEQ ID NO: 3172955 - protein, 17 aa, Giardia lamblia
TQLLVGVFLRIELPDAT

SEQ ID NO: 3172956 - protein, 20 aa, Giardia lamblia
TQLQRVVAMLEEIRLNELSV

SEQ ID NO: 3172957 - protein, 25 aa, Giardia lamblia
TQLRKCLRTPYAVSRYAGVQCTAHS

SEQ ID NO: 3172958 - protein, 25 aa, Giardia lamblia
TQLYNDAMCLARIDLLQKEGDDNLS

SEQ ID NO: 3172959 - protein, 19 aa, Giardia lamblia
TQMKVCDSVVSLPISNTIE

SEQ ID NO: 3172960 - protein, 28 aa, Giardia lamblia
TQMNASLLKRFVCLRDQFNSVVPLLQLL

SEQ ID NO: 3172961 - protein, 21 aa, Giardia lamblia
TQPRRIAAIGVSSRIAEELGQ

SEQ ID NO: 3172962 - protein, 22 aa, Giardia lamblia
TQPRSNTGLCVRQEIEYPAETE

SEQ ID NO: 3172963 - protein, 18 aa, Giardia lamblia
TQRLSGSRTQYSAKRKRQ

SEQ ID NO: 3172964 - protein, 20 aa, Giardia lamblia
TQRWYNFNTAIGLFDKLHAE

SEQ ID NO: 3172965 - protein, 18 aa, Giardia lamblia
TQSCFIPLLNEYKAQIKY

SEQ ID NO: 3172966 - protein, 18 aa, Giardia lamblia
TQSLLYLPLWVWQVYEQN

SEQ ID NO: 3172967 - protein, 23 aa, Giardia lamblia
TQSPRFVLEYVKAHPQNPSNLIA

SEQ ID NO: 3172968 - protein, 32 aa, Giardia lamblia
TQTDIPIIWLYRGSWNRFTLGEASLVICGTYD

SEQ ID NO: 3172969 - protein, 25 aa, Giardia lamblia
TQTKSEFLMKICQLENNLAELRNEN

SEQ ID NO: 3172970 - protein, 20 aa, Giardia lamblia
TQTLKQPPFFNVRPVNDLID

SEQ ID NO: 3172971 - protein, 23 aa, Giardia lamblia
TQTMASSIVAFVYSPLELSVDKE

SEQ ID NO: 3172972 - protein, 23 aa, Giardia lamblia
TQTSMLIDVCERSIQSDIQTDNT

SEQ ID NO: 3172973 - protein, 18 aa, Giardia lamblia
TQTYKTKQFWSLDDCFKE

SEQ ID NO: 3172974 - protein, 21 aa, Giardia lamblia
TQVGACWHCNADGRPMLSVNR

SEQ ID NO: 3172975 - protein, 23 aa, Giardia lamblia
TQVPLVVCDDLTHAQLLTMMYKC

SEQ ID NO: 3172976 - protein, 25 aa, Giardia lamblia
TQYDLTAPEPLVWADETVIVTFCDG

SEQ ID NO: 3172977 - protein, 17 aa, Giardia lamblia
TQYRPVPLMHFLCPVGG

SEQ ID NO: 3172978 - protein, 19 aa, Giardia lamblia
TRAEFAVGYHLMRGDSSLF

SEQ ID NO: 3172979 - protein, 18 aa, Giardia lamblia
TRAFAALSVSSMEYYAAI

SEQ ID NO: 3172980 - protein, 19 aa, Giardia lamblia
TRAGFLKSQFFRVTFDRNI

SEQ ID NO: 3172981 - protein, 17 aa, Giardia lamblia
TRAHLLKRFPHIFKNTP

SEQ ID NO: 3172982 - protein, 33 aa, Giardia lamblia
TRAKFNMMCLMARKCLLLFGSFIKPDSPDLLSS

SEQ ID NO: 3172983 - protein, 23 aa, Giardia lamblia
TRAKNAVRQFCLAKIDNIRNNQL

SEQ ID NO: 3172984 - protein, 18 aa, Giardia lamblia
TRARSRRIINSKDSKDNK

SEQ ID NO: 3172985 - protein, 20 aa, Giardia lamblia
TRAYMAGFVPSLNDHIMYTH

SEQ ID NO: 3172986 - protein, 20 aa, Giardia lamblia
TRCLLKEAEERWASEIREKG

SEQ ID NO: 3172987 - protein, 21 aa, Giardia lamblia
TRCYMEWEDAFLKYIGKTRED

SEQ ID NO: 3172988 - protein, 24 aa, Giardia lamblia
TRDALGRAPLHYAVLSRAPHVVQL

SEQ ID NO: 3172989 - protein, 20 aa, Giardia lamblia
TRDDIKTIGDMGCGKAALAQ

SEQ ID NO: 3172990 - protein, 18 aa, Giardia lamblia
TRDFCIDVSVLDYLHSKA

SEQ ID NO: 3172991 - protein, 17 aa, Giardia lamblia
TRDGAPGVSGWQRRTDP

SEQ ID NO: 3172992 - protein, 18 aa, Giardia lamblia
TRDHADWKLEKYSKRGIS

SEQ ID NO: 3172993 - protein, 25 aa, Giardia lamblia
TRDIYGRTALDYCVYADAFQAAEAY

SEQ ID NO: 3172994 - protein, 19 aa, Giardia lamblia
TRDLPIRLNYNLKTQASLP

SEQ ID NO: 3172995 - protein, 19 aa, Giardia lamblia
TRDMPVYDQLMLAENAVKA

SEQ ID NO: 3172996 - protein, 19 aa, Giardia lamblia
TREAILFPSSHTLVYHDCR

SEQ ID NO: 3172997 - protein, 31 aa, Giardia lamblia
TREEMKIWYSRLVAEPGLKRDVAHGSYSSTM

SEQ ID NO: 3172998 - protein, 26 aa, Giardia lamblia
TREHDSYRTDHCPVPVKAKIHGAELI

SEQ ID NO: 3172999 - protein, 17 aa, Giardia lamblia
TRELAKDALEFFNGFTV

SEQ ID NO: 3173000 - protein, 24 aa, Giardia lamblia
TRELCVQIGGVIRKLSRFTDPELR

SEQ ID NO: 3173001 - protein, 22 aa, Giardia lamblia
TREMPIRAAFQIPASKDDICIE

SEQ ID NO: 3173002 - protein, 18 aa, Giardia lamblia
TRERLMRNKRRVLAAKKA

SEQ ID NO: 3173003 - protein, 20 aa, Giardia lamblia
TRESSKCTLILTEGDSAKAL

SEQ ID NO: 3173004 - protein, 28 aa, Giardia lamblia
TREYCPNCGPGIRIARHADRCHCGRCGF

SEQ ID NO: 3173005 - protein, 18 aa, Giardia lamblia
TRFESRTALMFATHNRNY

SEQ ID NO: 3173006 - protein, 17 aa, Giardia lamblia
TRFKNKWNGEKKRAIIR

SEQ ID NO: 3173007 - protein, 17 aa, Giardia lamblia
TRFKNLRSLEIGSLPTP

SEQ ID NO: 3173008 - protein, 24 aa, Giardia lamblia
TRFPIVRLSYELRRDMVRIYAEFP

SEQ ID NO: 3173009 - protein, 27 aa, Giardia lamblia
TRFRSVKPFIWYRLNPRRARIYVMQDL

SEQ ID NO: 3173010 - protein, 20 aa, Giardia lamblia
TRFTIRNHLDVLSADPNVRE

SEQ ID NO: 3173011 - protein, 19 aa, Giardia lamblia
TRFTVPIELPSSAANVTSA

SEQ ID NO: 3173012 - protein, 23 aa, Giardia lamblia
TRFYMVHSIICDFISSRAASTMV

SEQ ID NO: 3173013 - protein, 23 aa, Giardia lamblia
TRGFNWAVCRFPDAVYFQNIARG

SEQ ID NO: 3173014 - protein, 19 aa, Giardia lamblia
TRGGWKRPNSGYLRQSCNR

SEQ ID NO: 3173015 - protein, 22 aa, Giardia lamblia
TRGRGRCKTFPPDVQGAPIHLT

SEQ ID NO: 3173016 - protein, 19 aa, Giardia lamblia
TRGTCPGCHTADPRPRHEL

SEQ ID NO: 3173017 - protein, 28 aa, Giardia lamblia
TRHDMIVACLYLRVSGKLSAELEVKTHS

SEQ ID NO: 3173018 - protein, 17 aa, Giardia lamblia
TRIKAVHRFSDFDERLL

SEQ ID NO: 3173019 - protein, 17 aa, Giardia lamblia
TRILSRKTLEYEPVRHL

SEQ ID NO: 3173020 - protein, 25 aa, Giardia lamblia
TRIPAYSCFGFKPGVSYRVATAINS

SEQ ID NO: 3173021 - protein, 17 aa, Giardia lamblia
TRIPCGELDPQARNSSN

SEQ ID NO: 3173022 - protein, 17 aa, Giardia lamblia
TRISDGVVRLTFVAGER

SEQ ID NO: 3173023 - protein, 19 aa, Giardia lamblia
TRISVLVAQLLTKNVAALY

SEQ ID NO: 3173024 - protein, 23 aa, Giardia lamblia
TRIYERAQLKLGLDNLIIQTGNF

SEQ ID NO: 3173025 - protein, 23 aa, Giardia lamblia
TRKAALRTEMIRLAKQIETGKAN

SEQ ID NO: 3173026 - protein, 23 aa, Giardia lamblia
TRKAMSADSLALVQDYLDAEHEL

SEQ ID NO: 3173027 - protein, 24 aa, Giardia lamblia
TRKGCMDIFEHIYLHSSHPRQLIT

SEQ ID NO: 3173028 - protein, 18 aa, Giardia lamblia
TRKLAGLIVDLKTNARLL

SEQ ID NO: 3173029 - protein, 24 aa, Giardia lamblia
TRKQLSTAMLHYFDVARAADIEKY

SEQ ID NO: 3173030 - protein, 24 aa, Giardia lamblia
TRKRADLLAVLHCHGVKNNDGHTA

SEQ ID NO: 3173031 - protein, 17 aa, Giardia lamblia
TRKVSILERTLFNLQRD

SEQ ID NO: 3173032 - protein, 20 aa, Giardia lamblia
TRLAFDDVLAALLGLQEGGE

SEQ ID NO: 3173033 - protein, 20 aa, Giardia lamblia
TRLAFSGAYGDTFSIDDIAR

SEQ ID NO: 3173034 - protein, 21 aa, Giardia lamblia
TRLAKDMSVALEMLSDYHNKH

SEQ ID NO: 3173035 - protein, 17 aa, Giardia lamblia
TRLAYILVKSHSRNAKL

SEQ ID NO: 3173036 - protein, 21 aa, Giardia lamblia
TRLGHMHLVILLAQHEAGFVD

SEQ ID NO: 3173037 - protein, 25 aa, Giardia lamblia
TRLITDCRVSYPWITDALARHVRYC

SEQ ID NO: 3173038 - protein, 23 aa, Giardia lamblia
TRLKEMREAFTAALDRANDETIA

SEQ ID NO: 3173039 - protein, 26 aa, Giardia lamblia
TRLLNARSALFLANHYTIMKVSDQLE

SEQ ID NO: 3173040 - protein, 23 aa, Giardia lamblia
TRLNLEILQYVAYCTLTEAEKAA

SEQ ID NO: 3173041 - protein, 24 aa, Giardia lamblia
TRLPRLSQVTMLCRDCGAEMGPFN

SEQ ID NO: 3173042 - protein, 22 aa, Giardia lamblia
TRLRCSDKFVFRDLAMLPAKQH

SEQ ID NO: 3173043 - protein, 23 aa, Giardia lamblia
TRLRKLEAEAKMAEAKAKNATDI

SEQ ID NO: 3173044 - protein, 21 aa, Giardia lamblia
TRLRQLVPLVNLIGQAIMYNA

SEQ ID NO: 3173045 - protein, 19 aa, Giardia lamblia
TRLSRLSSVGGYTDLSKLS

SEQ ID NO: 3173046 - protein, 18 aa, Giardia lamblia
TRLTRWPFYSTPISMLQA

SEQ ID NO: 3173047 - protein, 30 aa, Giardia lamblia
TRLTVLMDHRCKHCISIICTLRAETVLLST

SEQ ID NO: 3173048 - protein, 19 aa, Giardia lamblia
TRLVPGYFPLSDDLKTHKY

SEQ ID NO: 3173049 - protein, 25 aa, Giardia lamblia
TRMLNAGVIYSNFGGLFSSSQNLTV

SEQ ID NO: 3173050 - protein, 18 aa, Giardia lamblia
TRNEEIIHMLIGLEAGHV

SEQ ID NO: 3173051 - protein, 28 aa, Giardia lamblia
TRPAPRSCFLGRFHRPFISMSLSHAVSY

SEQ ID NO: 3173052 - protein, 24 aa, Giardia lamblia
TRPFFKNRLLSVTMCCPAGIHLVE

SEQ ID NO: 3173053 - protein, 23 aa, Giardia lamblia
TRPILCGATTMFSSEGTNMLLGF

SEQ ID NO: 3173054 - protein, 20 aa, Giardia lamblia
TRPITIHGCTSEEHKQKLEE

SEQ ID NO: 3173055 - protein, 24 aa, Giardia lamblia
TRPKRIFEKLALQRPRSSYYLLHR

SEQ ID NO: 3173056 - protein, 20 aa, Giardia lamblia
TRPNYSITPNEGWVEQDPKR

SEQ ID NO: 3173057 - protein, 19 aa, Giardia lamblia
TRPRLTNTPSLSESSDPVV

SEQ ID NO: 3173058 - protein, 18 aa, Giardia lamblia
TRPRVPITKTTKFEGVTY

SEQ ID NO: 3173059 - protein, 17 aa, Giardia lamblia
TRPTGWTALMEAAYHGQ

SEQ ID NO: 3173060 - protein, 25 aa, Giardia lamblia
TRQALEMVKGLGLSSDIFPIESQAS

SEQ ID NO: 3173061 - protein, 19 aa, Giardia lamblia
TRQVTSFPLKYTSVTDYVA

SEQ ID NO: 3173062 - protein, 19 aa, Giardia lamblia
TRRAIFWNAALTLYMYEYC

SEQ ID NO: 3173063 - protein, 23 aa, Giardia lamblia
TRRAKIGFTPLMHAITTGNPDEV

SEQ ID NO: 3173064 - protein, 20 aa, Giardia lamblia
TRRAPAFSFSRRHYIYQNIV

SEQ ID NO: 3173065 - protein, 19 aa, Giardia lamblia
TRRELKRIKAQLEKAHEAT

SEQ ID NO: 3173066 - protein, 19 aa, Giardia lamblia
TRRIECLPGVTIAMSTNVK

SEQ ID NO: 3173067 - protein, 20 aa, Giardia lamblia
TRRKAMRRNTSWPRWTNIFF

SEQ ID NO: 3173068 - protein, 18 aa, Giardia lamblia
TRRKPRRASTSSGDAQSS

SEQ ID NO: 3173069 - protein, 23 aa, Giardia lamblia
TRRPRILEFLQDFDKLRRGFVSV

SEQ ID NO: 3173070 - protein, 25 aa, Giardia lamblia
TRRSLRLLLFHALSYLPYAGAISTD

SEQ ID NO: 3173071 - protein, 17 aa, Giardia lamblia
TRRTAMALISFAEMDSS

SEQ ID NO: 3173072 - protein, 17 aa, Giardia lamblia
TRSAILIDPGWEAPVID

SEQ ID NO: 3173073 - protein, 25 aa, Giardia lamblia
TRSLDLSLKYAYRNPGTYSLCIDKF

SEQ ID NO: 3173074 - protein, 17 aa, Giardia lamblia
TRSLERCAKIGSMFPSA

SEQ ID NO: 3173075 - protein, 18 aa, Giardia lamblia
TRSNITLCSMTVDRTDLT

SEQ ID NO: 3173076 - protein, 19 aa, Giardia lamblia
TRSPFRRLFNTSRDGRRDY

SEQ ID NO: 3173077 - protein, 20 aa, Giardia lamblia
TRSQLLATLMDGIAPSCKLC

SEQ ID NO: 3173078 - protein, 23 aa, Giardia lamblia
TRSQSSVFLFRFIMSLHSQLSSH

SEQ ID NO: 3173079 - protein, 20 aa, Giardia lamblia
TRSYWLLRFAFASDKDAWAW

SEQ ID NO: 3173080 - protein, 23 aa, Giardia lamblia
TRTARSVLTFADLAGSENVTKSH

SEQ ID NO: 3173081 - protein, 17 aa, Giardia lamblia
TRTAYSDVMKQLSGLNT

SEQ ID NO: 3173082 - protein, 20 aa, Giardia lamblia
TRTDMKIGICGEQTDPASIL

SEQ ID NO: 3173083 - protein, 22 aa, Giardia lamblia
TRTEFLCQEILYTRFSPRERRA

SEQ ID NO: 3173084 - protein, 25 aa, Giardia lamblia
TRTGETRCGLLLKGLFPEKDVVPLT

SEQ ID NO: 3173085 - protein, 22 aa, Giardia lamblia
TRTGKPWFSFLLDDDSSDVKVD

SEQ ID NO: 3173086 - protein, 22 aa, Giardia lamblia
TRTPRTAGVIVEHSTPLNYHVA

SEQ ID NO: 3173087 - protein, 20 aa, Giardia lamblia
TRTRLHVIMEPFFKTLQNLI

SEQ ID NO: 3173088 - protein, 26 aa, Giardia lamblia
TRTSQLSIMWCYDEMPKLSSNKRKRN

SEQ ID NO: 3173089 - protein, 20 aa, Giardia lamblia
TRTTTMPGLAMSQSGAEPES

SEQ ID NO: 3173090 - protein, 24 aa, Giardia lamblia
TRTYIPRPFVPFVNPKNLAHVAEW

SEQ ID NO: 3173091 - protein, 26 aa, Giardia lamblia
TRTYVELCSIFPDIKERILKRKYIEE

SEQ ID NO: 3173092 - protein, 23 aa, Giardia lamblia
TRVKSLECCRLLVDERDILCNQG

SEQ ID NO: 3173093 - protein, 17 aa, Giardia lamblia
TRVRARISDSIDVSGHG

SEQ ID NO: 3173094 - protein, 23 aa, Giardia lamblia
TRVVNMPWLYGARITKSDSRGNG

SEQ ID NO: 3173095 - protein, 21 aa, Giardia lamblia
TRYFNCAPLYGSFVHVKRLIP

SEQ ID NO: 3173096 - protein, 29 aa, Giardia lamblia
TRYKYIRSSFELAYFYLLRNHSGSILSFL

SEQ ID NO: 3173097 - protein, 18 aa, Giardia lamblia
TRYLSILLTMQAQLSDGL

SEQ ID NO: 3173098 - protein, 23 aa, Giardia lamblia
TRYSSWISLKTGRHLLAGGDAAP

SEQ ID NO: 3173099 - protein, 20 aa, Giardia lamblia
TRYSYYTVRLISLIHYLRKE

SEQ ID NO: 3173100 - protein, 19 aa, Giardia lamblia
TRYVSCATETIPHIDYEDE

SEQ ID NO: 3173101 - protein, 18 aa, Giardia lamblia
TRYYKLMRPIAEHANDHD

SEQ ID NO: 3173102 - protein, 20 aa, Giardia lamblia
TSAERYGEQWVRKRDALARR

SEQ ID NO: 3173103 - protein, 26 aa, Giardia lamblia
TSAESIRLALSLSLHGMPHDRVFGVY

SEQ ID NO: 3173104 - protein, 26 aa, Giardia lamblia
TSAGLRYLTLLGMKGLCAYAEHCYKL

SEQ ID NO: 3173105 - protein, 22 aa, Giardia lamblia
TSAPCSPPLQLSHHIDSHDQEG

SEQ ID NO: 3173106 - protein, 23 aa, Giardia lamblia
TSAPWRSIPFVPNMVYTTETNVE

SEQ ID NO: 3173107 - protein, 31 aa, Giardia lamblia
TSATIPPMYCFRLSDDSSRIFDLIEVIQSTN

SEQ ID NO: 3173108 - protein, 23 aa, Giardia lamblia
TSAVDHLLVFPAYKDNIFLDVVE

SEQ ID NO: 3173109 - protein, 20 aa, Giardia lamblia
TSAYDRHSRVSVNMDSSDDE

SEQ ID NO: 3173110 - protein, 27 aa, Giardia lamblia
TSCDLLWPVTFEVSRLMTLEHASAVFD

SEQ ID NO: 3173111 - protein, 17 aa, Giardia lamblia
TSCEFDLHISSYMEEIR

SEQ ID NO: 3173112 - protein, 26 aa, Giardia lamblia
TSCHAGLLLRIGYRSLVALHTKLALW

SEQ ID NO: 3173113 - protein, 18 aa, Giardia lamblia
TSCHPELLYRNTGSPLIA

SEQ ID NO: 3173114 - protein, 26 aa, Giardia lamblia
TSCILPCLLESELFYKHFAEDEQAIS

SEQ ID NO: 3173115 - protein, 17 aa, Giardia lamblia
TSCTCEPVSAPAHEQQK

SEQ ID NO: 3173116 - protein, 25 aa, Giardia lamblia
TSDFMKRLFIDSALPPAQDADIDDY

SEQ ID NO: 3173117 - protein, 23 aa, Giardia lamblia
TSDIKSDLLVSGQATPDITSATK

SEQ ID NO: 3173118 - protein, 18 aa, Giardia lamblia
TSDLLGIRCTIVCPETAP

SEQ ID NO: 3173119 - protein, 17 aa, Giardia lamblia
TSDLSRCRCVCPSDDAD

SEQ ID NO: 3173120 - protein, 26 aa, Giardia lamblia
TSDYSIALQKAWPLILKFHDHVHDTL

SEQ ID NO: 3173121 - protein, 22 aa, Giardia lamblia
TSEARTLLPMLVNLTKDKIRCL

SEQ ID NO: 3173122 - protein, 22 aa, Giardia lamblia
TSEGRSALMFAAANGHVEAVNI

SEQ ID NO: 3173123 - protein, 19 aa, Giardia lamblia
TSEHVRWTIQQALGSSWCG

SEQ ID NO: 3173124 - protein, 22 aa, Giardia lamblia
TSEIYACKEICYTNMGAKERGI

SEQ ID NO: 3173125 - protein, 36 aa, Giardia lamblia
TSEKIPYHRFPMFVPWRINDTWYFVEKAVRLTNVIH

SEQ ID NO: 3173126 - protein, 17 aa, Giardia lamblia
TSEKLELEKELEVLTRA

SEQ ID NO: 3173127 - protein, 36 aa, Giardia lamblia
TSEKYLRRRDAAIILIQACWRRYKAMCRADSIRVER

SEQ ID NO: 3173128 - protein, 19 aa, Giardia lamblia
TSEPCRRALGHVYICLGDY

SEQ ID NO: 3173129 - protein, 18 aa, Giardia lamblia
TSERECIFSNVLVGEDGR

SEQ ID NO: 3173130 - protein, 19 aa, Giardia lamblia
TSFAVNPSLAAVVLSSGDS

SEQ ID NO: 3173131 - protein, 26 aa, Giardia lamblia
TSFHPESWNPTWGIRNIIIGLRSLFD

SEQ ID NO: 3173132 - protein, 21 aa, Giardia lamblia
TSFHPESWSPIITFTDIIVGF

SEQ ID NO: 3173133 - protein, 25 aa, Giardia lamblia
TSFPETVHLWLARSGGDGIPVFAPR

SEQ ID NO: 3173134 - protein, 19 aa, Giardia lamblia
TSFTRPSTSVSVYPLSTTG

SEQ ID NO: 3173135 - protein, 27 aa, Giardia lamblia
TSGHLSFSCPCNGLYYVALHIDNKDIM

SEQ ID NO: 3173136 - protein, 18 aa, Giardia lamblia
TSGHSWAYHSDKMISHVD

SEQ ID NO: 3173137 - protein, 22 aa, Giardia lamblia
TSGPAADIWSLGLIILDLASTL

SEQ ID NO: 3173138 - protein, 18 aa, Giardia lamblia
TSGRCLLCAASNHNIQTD

SEQ ID NO: 3173139 - protein, 17 aa, Giardia lamblia
TSGRPQPSIPILLTSGS

SEQ ID NO: 3173140 - protein, 17 aa, Giardia lamblia
TSGVGLAHLVFKRCTTS

SEQ ID NO: 3173141 - protein, 23 aa, Giardia lamblia
TSHGITALMFAAAMGNVRAVQHL

SEQ ID NO: 3173142 - protein, 26 aa, Giardia lamblia
TSHSDYRSDCILPQLVPVKIDDINNI

SEQ ID NO: 3173143 - protein, 22 aa, Giardia lamblia
TSIKKRFVCSQLIVSNNHFFLC

SEQ ID NO: 3173144 - protein, 19 aa, Giardia lamblia
TSIMSGRTLGGISLGIYVQ

SEQ ID NO: 3173145 - protein, 26 aa, Giardia lamblia
TSINECREVINVAALRSVEDLYTMAT

SEQ ID NO: 3173146 - protein, 26 aa, Giardia lamblia
TSINISKLLLVYSVDLTQLNSYMRSK

SEQ ID NO: 3173147 - protein, 19 aa, Giardia lamblia
TSINSTPSWLDAEVDHGIA

SEQ ID NO: 3173148 - protein, 17 aa, Giardia lamblia
TSIPCCYFVFALGCLWE

SEQ ID NO: 3173149 - protein, 24 aa, Giardia lamblia
TSIPLPEKFVWTAIDPHDDGHMAD

SEQ ID NO: 3173150 - protein, 17 aa, Giardia lamblia
TSIPNTIGQQVILTDLV

SEQ ID NO: 3173151 - protein, 22 aa, Giardia lamblia
TSIRFAPPNGLTFQFTTLSQVI

SEQ ID NO: 3173152 - protein, 18 aa, Giardia lamblia
TSKHGFVPNNYLIGKILP

SEQ ID NO: 3173153 - protein, 24 aa, Giardia lamblia
TSKLEAMAFIGAGIRTVSGIRGII

SEQ ID NO: 3173154 - protein, 24 aa, Giardia lamblia
TSKTELKSPIGFRQTAAPATDMTR

SEQ ID NO: 3173155 - protein, 22 aa, Giardia lamblia
TSKTFRSIVDFLVRAFQSYKDE

SEQ ID NO: 3173156 - protein, 30 aa, Giardia lamblia
TSKTRRGVMTAARCLLQFYREQAPDKLEAR

SEQ ID NO: 3173157 - protein, 17 aa, Giardia lamblia
TSKVRRVKLQKTKRSSF

SEQ ID NO: 3173158 - protein, 20 aa, Giardia lamblia
TSLFRVLRGKFLTKYKSTCA

SEQ ID NO: 3173159 - protein, 28 aa, Giardia lamblia
TSLFRYYCPFFYWMHSFGLILLNHIKPG

SEQ ID NO: 3173160 - protein, 27 aa, Giardia lamblia
TSLGGLRRRLLALFLQFAETPEFNPGT

SEQ ID NO: 3173161 - protein, 20 aa, Giardia lamblia
TSLGPVWFAPCTELDKEKMY

SEQ ID NO: 3173162 - protein, 36 aa, Giardia lamblia
TSLHARLPLHAVAGAWSCLVFDLMEITRSCFPNSEF

SEQ ID NO: 3173163 - protein, 25 aa, Giardia lamblia
TSLKDCYETFYINRIPLLTSPQVFG

SEQ ID NO: 3173164 - protein, 24 aa, Giardia lamblia
TSLKLFKSDLFQLFTYNQPDVPIN

SEQ ID NO: 3173165 - protein, 24 aa, Giardia lamblia
TSLKSYLPCIVTDALAQIKTDYRN

SEQ ID NO: 3173166 - protein, 24 aa, Giardia lamblia
TSLMAASRLGYFEIASVLVSHESR

SEQ ID NO: 3173167 - protein, 20 aa, Giardia lamblia
TSLNRPICIVSASGQVIVYL

SEQ ID NO: 3173168 - protein, 20 aa, Giardia lamblia
TSLPLFPGAPIMPRSGPPPI

SEQ ID NO: 3173169 - protein, 26 aa, Giardia lamblia
TSLQAACISCSDGAVFLEGDVSFLRT

SEQ ID NO: 3173170 - protein, 23 aa, Giardia lamblia
TSLRMCREHESLISRLDAALGSI

SEQ ID NO: 3173171 - protein, 25 aa, Giardia lamblia
TSLRPRCLRHVYAVFDEAINTAILV

SEQ ID NO: 3173172 - protein, 17 aa, Giardia lamblia
TSLRSSHTYVITSCILP

SEQ ID NO: 3173173 - protein, 26 aa, Giardia lamblia
TSLSELRLAWQYPRRVASPRELVALG

SEQ ID NO: 3173174 - protein, 18 aa, Giardia lamblia
TSLYDCYVPGASFSTIEQ

SEQ ID NO: 3173175 - protein, 21 aa, Giardia lamblia
TSLYSCFSSVLAKLRSECSKV

SEQ ID NO: 3173176 - protein, 19 aa, Giardia lamblia
TSMGHVFCVLAVPCQHSLI

SEQ ID NO: 3173177 - protein, 18 aa, Giardia lamblia
TSMIKLLLPHEVTCKTKE

SEQ ID NO: 3173178 - protein, 20 aa, Giardia lamblia
TSMLIRDILDCIPLPDKSNK

SEQ ID NO: 3173179 - protein, 22 aa, Giardia lamblia
TSMLRSPGLRRFAGEVYKHLLL

SEQ ID NO: 3173180 - protein, 26 aa, Giardia lamblia
TSMVHCLAEVIPLLITCIKEETSKTL

SEQ ID NO: 3173181 - protein, 21 aa, Giardia lamblia
TSMYKDCIGIEDCTIEKESIM

SEQ ID NO: 3173182 - protein, 20 aa, Giardia lamblia
TSNRRACFFNLPMLLNEDFG

SEQ ID NO: 3173183 - protein, 17 aa, Giardia lamblia
TSPCYPVGFVVETNKHL

SEQ ID NO: 3173184 - protein, 21 aa, Giardia lamblia
TSPFLLGHAVNEMFSSTDEGQ

SEQ ID NO: 3173185 - protein, 27 aa, Giardia lamblia
TSPFSDCMPCTSILELHGSKTGNCVVQ

SEQ ID NO: 3173186 - protein, 19 aa, Giardia lamblia
TSPIFSPYYRWHGKADCGE

SEQ ID NO: 3173187 - protein, 17 aa, Giardia lamblia
TSPSLKVSYYDTTTLDS

SEQ ID NO: 3173188 - protein, 24 aa, Giardia lamblia
TSPVYRVSFCKYTTDRLITGGRTH

SEQ ID NO: 3173189 - protein, 23 aa, Giardia lamblia
TSPYRKAFSKSPIKALVKADQQT

SEQ ID NO: 3173190 - protein, 17 aa, Giardia lamblia
TSQLPLMVEYCPMHTEL

SEQ ID NO: 3173191 - protein, 18 aa, Giardia lamblia
TSQNRIGSLMAQTSEQAK

SEQ ID NO: 3173192 - protein, 18 aa, Giardia lamblia
TSQPQVRLEVPPILTSTS

SEQ ID NO: 3173193 - protein, 18 aa, Giardia lamblia
TSRHVTCGVVSGLDQPPI

SEQ ID NO: 3173194 - protein, 21 aa, Giardia lamblia
TSRIAPVVPRAPSIGANSVRP

SEQ ID NO: 3173195 - protein, 19 aa, Giardia lamblia
TSRRPSCIDDKSGNTEDDQ

SEQ ID NO: 3173196 - protein, 18 aa, Giardia lamblia
TSSFRFPIAAAKSLIRCV

SEQ ID NO: 3173197 - protein, 20 aa, Giardia lamblia
TSSGLCKLTDFGLSQRLQDV

SEQ ID NO: 3173198 - protein, 17 aa, Giardia lamblia
TSSGSFLAPSFVAVVIE

SEQ ID NO: 3173199 - protein, 18 aa, Giardia lamblia
TSSIAIKRSNYFGRTRNA

SEQ ID NO: 3173200 - protein, 25 aa, Giardia lamblia
TSSPRSGSYKSVMALDKGDISPARS

SEQ ID NO: 3173201 - protein, 23 aa, Giardia lamblia
TSSRLRLESMVLAPSAKHSLPPP

SEQ ID NO: 3173202 - protein, 17 aa, Giardia lamblia
TSSRSHAILQLRIEQKS

SEQ ID NO: 3173203 - protein, 23 aa, Giardia lamblia
TSSRSHSVLNIFLETEDRLSGAK

SEQ ID NO: 3173204 - protein, 20 aa, Giardia lamblia
TSSRVIPLVESIGLSTLSTA

SEQ ID NO: 3173205 - protein, 23 aa, Giardia lamblia
TSSTEWPTIVSIYEKLSGVAFDS

SEQ ID NO: 3173206 - protein, 18 aa, Giardia lamblia
TSSVIKRMFTDANFLDDL

SEQ ID NO: 3173207 - protein, 22 aa, Giardia lamblia
TSTELCTLPSCQSTGANDNVKC

SEQ ID NO: 3173208 - protein, 25 aa, Giardia lamblia
TSTGKLFAYRKFRSAIQGLKLYPNG

SEQ ID NO: 3173209 - protein, 19 aa, Giardia lamblia
TSTLRTILKYFKCSVTSIL

SEQ ID NO: 3173210 - protein, 25 aa, Giardia lamblia
TSTMYLNRVHSFFIQYFRDTRAFYE

SEQ ID NO: 3173211 - protein, 26 aa, Giardia lamblia
TSTTLPGFVFRQESLLNDPHRGITRG

SEQ ID NO: 3173212 - protein, 23 aa, Giardia lamblia
TSTVKIGLFGLEVDGFLNKRDMF

SEQ ID NO: 3173213 - protein, 23 aa, Giardia lamblia
TSVDLRLLGPIISRLKTCSMCQL

SEQ ID NO: 3173214 - protein, 19 aa, Giardia lamblia
TSVLSRFMLGSTIRAVNER

SEQ ID NO: 3173215 - protein, 21 aa, Giardia lamblia
TSVLVLEYWLGPGRYNAKQRI

SEQ ID NO: 3173216 - protein, 20 aa, Giardia lamblia
TSVPDEWMRIAAAYEETTGM

SEQ ID NO: 3173217 - protein, 17 aa, Giardia lamblia
TSVSDFGFAIRNEQLEY

SEQ ID NO: 3173218 - protein, 24 aa, Giardia lamblia
TSVSSRKWVHMRFSNTEPIIRIIS

SEQ ID NO: 3173219 - protein, 21 aa, Giardia lamblia
TSWPGGGIISGHLHTPMLAFP

SEQ ID NO: 3173220 - protein, 24 aa, Giardia lamblia
TSWPVPNARLRSCMDAYLQLTCPH

SEQ ID NO: 3173221 - protein, 27 aa, Giardia lamblia
TSYAIRFANHYLKEMLSLAMNLPPNKL

SEQ ID NO: 3173222 - protein, 19 aa, Giardia lamblia
TSYDPVLIIPDFYQTPLCV

SEQ ID NO: 3173223 - protein, 26 aa, Giardia lamblia
TSYERILRWVSAYGSYILGGHAETTK

SEQ ID NO: 3173224 - protein, 19 aa, Giardia lamblia
TSYGAHHFVTFGSKHELLG

SEQ ID NO: 3173225 - protein, 23 aa, Giardia lamblia
TSYKCPYRAIHIHIVKKGKKYTT

SEQ ID NO: 3173226 - protein, 27 aa, Giardia lamblia
TSYWLASEAKLLFALHELTPLAQEELC

SEQ ID NO: 3173227 - protein, 19 aa, Giardia lamblia
TTAFLLAKRHGHIKIAESL

SEQ ID NO: 3173228 - protein, 17 aa, Giardia lamblia
TTAIIFTVLKFFGQRTF

SEQ ID NO: 3173229 - protein, 19 aa, Giardia lamblia
TTAMRCMQRNSGLFMPSQE

SEQ ID NO: 3173230 - protein, 24 aa, Giardia lamblia
TTAQGNVCINEWIIQRTIGRGAYA

SEQ ID NO: 3173231 - protein, 18 aa, Giardia lamblia
TTAVDIWNLGLLLFNCLA

SEQ ID NO: 3173232 - protein, 26 aa, Giardia lamblia
TTAVIAFSWAAGQTFQEILDIDRSQF

SEQ ID NO: 3173233 - protein, 22 aa, Giardia lamblia
TTCKAKVKTLRAFLTSAQSATL

SEQ ID NO: 3173234 - protein, 17 aa, Giardia lamblia
TTCSPAEVAKCDYKQVV

SEQ ID NO: 3173235 - protein, 20 aa, Giardia lamblia
TTCTLVYRAPESTLRCYDFL

SEQ ID NO: 3173236 - protein, 18 aa, Giardia lamblia
TTCYEVLAAARARAKKAY

SEQ ID NO: 3173237 - protein, 19 aa, Giardia lamblia
TTDATWSTPVARPQRPVHM

SEQ ID NO: 3173238 - protein, 27 aa, Giardia lamblia
TTDCYPRGCGWTPLFEAVYNGYPNCVA

SEQ ID NO: 3173239 - protein, 28 aa, Giardia lamblia
TTDMCARGVDLPIVHWVVHFDCPDGVIT

SEQ ID NO: 3173240 - protein, 22 aa, Giardia lamblia
TTECVKLLAPVEGGITTTNGVT

SEQ ID NO: 3173241 - protein, 23 aa, Giardia lamblia
TTEGLKNYSLQRMDAYNAYFLLQ

SEQ ID NO: 3173242 - protein, 31 aa, Giardia lamblia
TTEGLSIKGLSCAGGRVTELMQAARQNDVVA

SEQ ID NO: 3173243 - protein, 21 aa, Giardia lamblia
TTELAFNRVRKALATRTPEQS

SEQ ID NO: 3173244 - protein, 18 aa, Giardia lamblia
TTERCIRYMIDKMGDPVG

SEQ ID NO: 3173245 - protein, 24 aa, Giardia lamblia
TTFDGTPVFPTRCPQDPSDTIHAS

SEQ ID NO: 3173246 - protein, 23 aa, Giardia lamblia
TTFTDIHAFFTIFLPDILADLLN

SEQ ID NO: 3173247 - protein, 23 aa, Giardia lamblia
TTGKRPDFLAGRNPEDVFTKDWK

SEQ ID NO: 3173248 - protein, 23 aa, Giardia lamblia
TTGSGKAAIHFGLDSDNWDIVSL

SEQ ID NO: 3173249 - protein, 23 aa, Giardia lamblia
TTHAFFYALKFCKVQKKVIGSTM

SEQ ID NO: 3173250 - protein, 24 aa, Giardia lamblia
TTHKSIMTQIKWIVDDDSLHQALQ

SEQ ID NO: 3173251 - protein, 28 aa, Giardia lamblia
TTHLSALFDCCIMALSSVGLCVVSQLSK

SEQ ID NO: 3173252 - protein, 25 aa, Giardia lamblia
TTIAFCFRGGILLAVDSRSTQGQFV

SEQ ID NO: 3173253 - protein, 18 aa, Giardia lamblia
TTIAPALSYSVFKAMGTH

SEQ ID NO: 3173254 - protein, 20 aa, Giardia lamblia
TTIEYFKWKDSKASLQHYTN

SEQ ID NO: 3173255 - protein, 30 aa, Giardia lamblia
TTIFQLLGISAWCVHASMPQRQRYKNVDRL

SEQ ID NO: 3173256 - protein, 17 aa, Giardia lamblia
TTIISRQKLRIEALTDK

SEQ ID NO: 3173257 - protein, 22 aa, Giardia lamblia
TTILRICKYYIQKSSKHYKNIL

SEQ ID NO: 3173258 - protein, 19 aa, Giardia lamblia
TTILYKLMLGEVVTTVPTI

SEQ ID NO: 3173259 - protein, 18 aa, Giardia lamblia
TTIMPVQSFKFSEVSPSF

SEQ ID NO: 3173260 - protein, 19 aa, Giardia lamblia
TTIPELFNNLDPCYSSLSG

SEQ ID NO: 3173261 - protein, 17 aa, Giardia lamblia
TTIPISAKQRTDLSYLS

SEQ ID NO: 3173262 - protein, 24 aa, Giardia lamblia
TTIQRRLRSPIKFSGIEELNAQIK

SEQ ID NO: 3173263 - protein, 18 aa, Giardia lamblia
TTIVIPRLYLMALAASIW

SEQ ID NO: 3173264 - protein, 20 aa, Giardia lamblia
TTKRFSVPLSSLRTNIFSDI

SEQ ID NO: 3173265 - protein, 21 aa, Giardia lamblia
TTKTRPVLKMAKRGPEDLSES

SEQ ID NO: 3173266 - protein, 23 aa, Giardia lamblia
TTLFPTHMDRVIIGQTLSGSHNV

SEQ ID NO: 3173267 - protein, 32 aa, Giardia lamblia
TTLIERKKFGSLGWCIPYEFSLPDFTASVQFL

SEQ ID NO: 3173268 - protein, 17 aa, Giardia lamblia
TTLKRPDFLKGKDPKDV

SEQ ID NO: 3173269 - protein, 24 aa, Giardia lamblia
TTLPRLQLFRSLMMVLTSLIYFGS

SEQ ID NO: 3173270 - protein, 17 aa, Giardia lamblia
TTLREVAILKALNAKQR

SEQ ID NO: 3173271 - protein, 19 aa, Giardia lamblia
TTLRPAILADPALCDAGFL

SEQ ID NO: 3173272 - protein, 18 aa, Giardia lamblia
TTLRRPDFLEGKDPKDVF

SEQ ID NO: 3173273 - protein, 19 aa, Giardia lamblia
TTLRVELEAERQKVIDLQA

SEQ ID NO: 3173274 - protein, 25 aa, Giardia lamblia
TTLSGDHGFMFICDGAVHNTDEAVP

SEQ ID NO: 3173275 - protein, 28 aa, Giardia lamblia
TTLTASRVNPGFMGRLGPEYPDVYDHRY

SEQ ID NO: 3173276 - protein, 24 aa, Giardia lamblia
TTLTKIALKHGWEVQSLSTRQTFN

SEQ ID NO: 3173277 - protein, 19 aa, Giardia lamblia
TTLVPALRHPHIIPQLQTE

SEQ ID NO: 3173278 - protein, 18 aa, Giardia lamblia
TTLYKGASALAIAVARGH

SEQ ID NO: 3173279 - protein, 18 aa, Giardia lamblia
TTLYRFLKDPSLSVESKA

SEQ ID NO: 3173280 - protein, 18 aa, Giardia lamblia
TTMDRYFANWDIVERGYL

SEQ ID NO: 3173281 - protein, 25 aa, Giardia lamblia
TTMRFVERITKQLGHLKGVVESSQG

SEQ ID NO: 3173282 - protein, 22 aa, Giardia lamblia
TTNIPIFLNFSARTGANQTQDF

SEQ ID NO: 3173283 - protein, 17 aa, Giardia lamblia
TTNIRFNVISRPESTLR

SEQ ID NO: 3173284 - protein, 24 aa, Giardia lamblia
TTNTSGNVWLQWSQKSIWTPCAIQ

SEQ ID NO: 3173285 - protein, 25 aa, Giardia lamblia
TTNVREIYEILGIEAARALFIKQIR

SEQ ID NO: 3173286 - protein, 25 aa, Giardia lamblia
TTPFFKAYYKIGAQSGVERISADTV

SEQ ID NO: 3173287 - protein, 18 aa, Giardia lamblia
TTPGIFGYFYGRNLINLS

SEQ ID NO: 3173288 - protein, 24 aa, Giardia lamblia
TTPKSYRQACEYSYFKVAANTALT

SEQ ID NO: 3173289 - protein, 23 aa, Giardia lamblia
TTPKTPMLFTLNGTKSRLSSTIH

SEQ ID NO: 3173290 - protein, 25 aa, Giardia lamblia
TTPPWIYMRPACFTLKAMTQGEIVL

SEQ ID NO: 3173291 - protein, 24 aa, Giardia lamblia
TTPQRCILELSYYLPGVYAPILRI

SEQ ID NO: 3173292 - protein, 30 aa, Giardia lamblia
TTPSYRAPEMIDFFAKFPITIRSDVFALGV

SEQ ID NO: 3173293 - protein, 22 aa, Giardia lamblia
TTPVFRAFFNRSLEEYMTSAGS

SEQ ID NO: 3173294 - protein, 37 aa, Giardia lamblia
TTQDFSCIAVFKGESYQTAFLTCVSWSPHGDMLCAFG

SEQ ID NO: 3173295 - protein, 18 aa, Giardia lamblia
TTQGACYRAPRANSAAPA

SEQ ID NO: 3173296 - protein, 23 aa, Giardia lamblia
TTQKRLADVISRGYGTFFSNVHA

SEQ ID NO: 3173297 - protein, 30 aa, Giardia lamblia
TTQSSLRYSRLPPLPSCVLTPGPAVQPVPQ

SEQ ID NO: 3173298 - protein, 18 aa, Giardia lamblia
TTQWCFFDVDGVLVHECG

SEQ ID NO: 3173299 - protein, 17 aa, Giardia lamblia
TTRHGVTALMFAAAAGH

SEQ ID NO: 3173300 - protein, 20 aa, Giardia lamblia
TTRILIAWIAYRRTPRNSPT

SEQ ID NO: 3173301 - protein, 17 aa, Giardia lamblia
TTRPGTEVEYRVEFSDT

SEQ ID NO: 3173302 - protein, 30 aa, Giardia lamblia
TTRVKPFICTMPLCLGPGFNQIQFNLTDFT

SEQ ID NO: 3173303 - protein, 19 aa, Giardia lamblia
TTRVYKFVSSLPMRVQSRF

SEQ ID NO: 3173304 - protein, 25 aa, Giardia lamblia
TTRYLRLSAKMSLDVLSFGDYNEVV

SEQ ID NO: 3173305 - protein, 20 aa, Giardia lamblia
TTSARSCTRETPKRDKQHVS

SEQ ID NO: 3173306 - protein, 19 aa, Giardia lamblia
TTSIFKFKPSEIAAGCIAM

SEQ ID NO: 3173307 - protein, 26 aa, Giardia lamblia
TTSSSRFSSVFKRLDDLSLIKEMISE

SEQ ID NO: 3173308 - protein, 17 aa, Giardia lamblia
TTSTALRPPGIHTSMLQ

SEQ ID NO: 3173309 - protein, 26 aa, Giardia lamblia
TTSVCVLAGEILRQAQQLLAKRMHPM

SEQ ID NO: 3173310 - protein, 17 aa, Giardia lamblia
TTSVVIFASEFLKEADE

SEQ ID NO: 3173311 - protein, 19 aa, Giardia lamblia
TTTARVVKRSVAVTDNCLV

SEQ ID NO: 3173312 - protein, 32 aa, Giardia lamblia
TTTCVKFGAYYKRKGWRVGLVCCDTFRTGAFD

SEQ ID NO: 3173313 - protein, 23 aa, Giardia lamblia
TTTKRGVLTFVDLAGSERVSKTM

SEQ ID NO: 3173314 - protein, 25 aa, Giardia lamblia
TTVEMVRILAPLEWNVSSSNGTYPI

SEQ ID NO: 3173315 - protein, 18 aa, Giardia lamblia
TTVGRFNINLSYQQVTVW

SEQ ID NO: 3173316 - protein, 19 aa, Giardia lamblia
TTVIPWLKKYPCLRCLYRA

SEQ ID NO: 3173317 - protein, 22 aa, Giardia lamblia
TTVLECDSIYIAGRYLKHQRYI

SEQ ID NO: 3173318 - protein, 17 aa, Giardia lamblia
TTVPVSRKETFTTYADN

SEQ ID NO: 3173319 - protein, 18 aa, Giardia lamblia
TTVTDAMHLIHEYCVRAA

SEQ ID NO: 3173320 - protein, 17 aa, Giardia lamblia
TTWPGVTALPDWKQSFP

SEQ ID NO: 3173321 - protein, 23 aa, Giardia lamblia
TTYLRRGISLLSYLWSAQGAESI

SEQ ID NO: 3173322 - protein, 24 aa, Giardia lamblia
TVAARKFLLFLLGPTERLAVDNEI

SEQ ID NO: 3173323 - protein, 18 aa, Giardia lamblia
TVAETIYPKVLPHLYSLD

SEQ ID NO: 3173324 - protein, 30 aa, Giardia lamblia
TVARRILEDFIRGRIPHFVIPYTREEVDEY

SEQ ID NO: 3173325 - protein, 25 aa, Giardia lamblia
TVATCSRDRFVSFWRPCSDSPDYDC

SEQ ID NO: 3173326 - protein, 19 aa, Giardia lamblia
TVCVPRVLSQPIFPLKTLI

SEQ ID NO: 3173327 - protein, 25 aa, Giardia lamblia
TVDKFEKARVLFTLSSKMVSEEYMS

SEQ ID NO: 3173328 - protein, 22 aa, Giardia lamblia
TVDLKKTFCFGGGGHYPISPMH

SEQ ID NO: 3173329 - protein, 23 aa, Giardia lamblia
TVDLREILPISFVKDVLALGTRV

SEQ ID NO: 3173330 - protein, 24 aa, Giardia lamblia
TVDLRPTIHYEPLLSLLSRATVSL

SEQ ID NO: 3173331 - protein, 37 aa, Giardia lamblia
TVDVDKRFTIDIIRAHPWFTVNLPKHLLISFDSDPSD

SEQ ID NO: 3173332 - protein, 19 aa, Giardia lamblia
TVDVSLPVVSLFINNDKSR

SEQ ID NO: 3173333 - protein, 25 aa, Giardia lamblia
TVECVRGGGLILFLLNNMHDLSQLH

SEQ ID NO: 3173334 - protein, 17 aa, Giardia lamblia
TVEWLKTSWEDILSKIC

SEQ ID NO: 3173335 - protein, 23 aa, Giardia lamblia
TVFLDTRLNMIDIFTKFSSLKVP

SEQ ID NO: 3173336 - protein, 19 aa, Giardia lamblia
TVGEAFELINLYTGKNPVQ

SEQ ID NO: 3173337 - protein, 18 aa, Giardia lamblia
TVGEWRLQGLPTDQLSTE

SEQ ID NO: 3173338 - protein, 31 aa, Giardia lamblia
TVGGGWPMLSLHIQDFFHYFAPKNIDATMEY

SEQ ID NO: 3173339 - protein, 20 aa, Giardia lamblia
TVGTRLFLSLARKKNNDDYT

SEQ ID NO: 3173340 - protein, 17 aa, Giardia lamblia
TVICSRYAYSGVAYTAA

SEQ ID NO: 3173341 - protein, 23 aa, Giardia lamblia
TVIPRISNREALRAESPDFSPPI

SEQ ID NO: 3173342 - protein, 27 aa, Giardia lamblia
TVKDGCFFCVGCKAYAYVKESATLMNT

SEQ ID NO: 3173343 - protein, 17 aa, Giardia lamblia
TVKDLSPPISTPAYNSA

SEQ ID NO: 3173344 - protein, 25 aa, Giardia lamblia
TVLAKPCKHIFSLPCEKIDSNNLNL

SEQ ID NO: 3173345 - protein, 17 aa, Giardia lamblia
TVLAYICGPTVYDSTHL

SEQ ID NO: 3173346 - protein, 19 aa, Giardia lamblia
TVLERRVLELLQRNDELKK

SEQ ID NO: 3173347 - protein, 28 aa, Giardia lamblia
TVLEVGKKLHVSFQCLPKDRECIMFIGA

SEQ ID NO: 3173348 - protein, 24 aa, Giardia lamblia
TVLHRECAELGANLQAEKERYFLL

SEQ ID NO: 3173349 - protein, 17 aa, Giardia lamblia
TVLIARHIVSPEIYTSP

SEQ ID NO: 3173350 - protein, 20 aa, Giardia lamblia
TVLIERIIRAVFDHASSKQG

SEQ ID NO: 3173351 - protein, 24 aa, Giardia lamblia
TVLILEFIDLLPPEKQIKILHKQP

SEQ ID NO: 3173352 - protein, 23 aa, Giardia lamblia
TVLRGGSAPARGSFGLSDTGFKE

SEQ ID NO: 3173353 - protein, 26 aa, Giardia lamblia
TVLRNARSWIKPNGYVFVREHDATSN

SEQ ID NO: 3173354 - protein, 18 aa, Giardia lamblia
TVLWTPEKHEAFVTVYES

SEQ ID NO: 3173355 - protein, 24 aa, Giardia lamblia
TVMRVMPFTVSYLMSSYKKTVDSG

SEQ ID NO: 3173356 - protein, 18 aa, Giardia lamblia
TVNFSLDTIEVLVLDEGD

SEQ ID NO: 3173357 - protein, 17 aa, Giardia lamblia
TVNMADFEKAYSIVVSK

SEQ ID NO: 3173358 - protein, 30 aa, Giardia lamblia
TVNRARALLSHGFLRDIIKYARSLNRSGPY

SEQ ID NO: 3173359 - protein, 17 aa, Giardia lamblia
TVNRIRSGTSFYSNCYP

SEQ ID NO: 3173360 - protein, 18 aa, Giardia lamblia
TVPLRKGSLRNYPTTSLL

SEQ ID NO: 3173361 - protein, 26 aa, Giardia lamblia
TVPYCTPRLSLIILADIFLHYFGATS

SEQ ID NO: 3173362 - protein, 24 aa, Giardia lamblia
TVQCGSSIWLGRLHDLLLVDPQTL

SEQ ID NO: 3173363 - protein, 25 aa, Giardia lamblia
TVQEARKGLQSEFVSGNLLQFVKRL

SEQ ID NO: 3173364 - protein, 24 aa, Giardia lamblia
TVQREQKQYIAIFFVGADGLTGKV

SEQ ID NO: 3173365 - protein, 24 aa, Giardia lamblia
TVRELNHLKPLMKSLETENSGLKA

SEQ ID NO: 3173366 - protein, 18 aa, Giardia lamblia
TVRSRDALIKDLSDGLTE

SEQ ID NO: 3173367 - protein, 19 aa, Giardia lamblia
TVSACYTLAASNAKAIHHS

SEQ ID NO: 3173368 - protein, 20 aa, Giardia lamblia
TVSAMGVSILHLLSLSNSPI

SEQ ID NO: 3173369 - protein, 17 aa, Giardia lamblia
TVSELRHRLDVAQNDNV

SEQ ID NO: 3173370 - protein, 23 aa, Giardia lamblia
TVSEVEPFCIAMARHVLEIVQSY

SEQ ID NO: 3173371 - protein, 21 aa, Giardia lamblia
TVSFHLRIMAIFNYLIHLIDP

SEQ ID NO: 3173372 - protein, 25 aa, Giardia lamblia
TVSKLRVAVHVITFLSRLEQTMGDH

SEQ ID NO: 3173373 - protein, 28 aa, Giardia lamblia
TVSVLAGYPRPGLQFRTIGRDPYQFLPS

SEQ ID NO: 3173374 - protein, 17 aa, Giardia lamblia
TVSYVVALRSIFRETMR

SEQ ID NO: 3173375 - protein, 17 aa, Giardia lamblia
TVTFEIWFSSYGGSNSK

SEQ ID NO: 3173376 - protein, 24 aa, Giardia lamblia
TVTGLPYPIGISAVHGCNVYFRDP

SEQ ID NO: 3173377 - protein, 18 aa, Giardia lamblia
TVTPMFTEAHVRTVTDTE

SEQ ID NO: 3173378 - protein, 17 aa, Giardia lamblia
TVVFGGEPVGQVKDNFS

SEQ ID NO: 3173379 - protein, 23 aa, Giardia lamblia
TVVKMPSLELSQYVFQINELEQI

SEQ ID NO: 3173380 - protein, 30 aa, Giardia lamblia
TVVTALLCLKLCFPDRVFLLRGNHETVSMN

SEQ ID NO: 3173381 - protein, 19 aa, Giardia lamblia
TVYCFESHYYRKSRDYAKK

SEQ ID NO: 3173382 - protein, 21 aa, Giardia lamblia
TVYESTWGVVYNKDFDPKNAS

SEQ ID NO: 3173383 - protein, 17 aa, Giardia lamblia
TVYPSDLTWLGVGFGIT

SEQ ID NO: 3173384 - protein, 18 aa, Giardia lamblia
TWASFSLAAYDQFMIDSE

SEQ ID NO: 3173385 - protein, 26 aa, Giardia lamblia
TWCDKLVSVVGMCLSDPKTTEYIQYL

SEQ ID NO: 3173386 - protein, 21 aa, Giardia lamblia
TWDHILTAIGMFTFTGLTPEH

SEQ ID NO: 3173387 - protein, 20 aa, Giardia lamblia
TWEPPERHILEDNIRKLNQL

SEQ ID NO: 3173388 - protein, 19 aa, Giardia lamblia
TWHSSVCVFVVRADGTIDT

SEQ ID NO: 3173389 - protein, 17 aa, Giardia lamblia
TWLKKSLSENIREKEIN

SEQ ID NO: 3173390 - protein, 18 aa, Giardia lamblia
TWSVNKFIQRFTIMKNMY

SEQ ID NO: 3173391 - protein, 20 aa, Giardia lamblia
TWVTASWISKLSKLRPTIAF

SEQ ID NO: 3173392 - protein, 29 aa, Giardia lamblia
TYDEKCDIWSLGGVMHFLASKLVPYLAKT

SEQ ID NO: 3173393 - protein, 22 aa, Giardia lamblia
TYEECCMDSAPIVFARMRQGLA

SEQ ID NO: 3173394 - protein, 24 aa, Giardia lamblia
TYELPSVYIPSAGRVMSEYSDANA

SEQ ID NO: 3173395 - protein, 26 aa, Giardia lamblia
TYERAIKGLVLFLGHKISRLRDTACD

SEQ ID NO: 3173396 - protein, 24 aa, Giardia lamblia
TYFLRPCGKKRVLAKKSRVDKKVC

SEQ ID NO: 3173397 - protein, 17 aa, Giardia lamblia
TYGGGIVFYDIRSGKTL

SEQ ID NO: 3173398 - protein, 19 aa, Giardia lamblia
TYHEFFFDRFISGSIGVCF

SEQ ID NO: 3173399 - protein, 25 aa, Giardia lamblia
TYHKMSVQLVNLWYQLPPSKNPINV

SEQ ID NO: 3173400 - protein, 23 aa, Giardia lamblia
TYHNPRMMRVWALAFSGDGRFLL

SEQ ID NO: 3173401 - protein, 20 aa, Giardia lamblia
TYHYYLWKRSVAVPLSTVSS

SEQ ID NO: 3173402 - protein, 18 aa, Giardia lamblia
TYIEKYPACFSAGKINII

SEQ ID NO: 3173403 - protein, 18 aa, Giardia lamblia
TYIKLAASLYKLASSTFL

SEQ ID NO: 3173404 - protein, 21 aa, Giardia lamblia
TYKFPEITAYSAIQYSRDGRR

SEQ ID NO: 3173405 - protein, 20 aa, Giardia lamblia
TYKIVLWFDLERFHVKEFEK

SEQ ID NO: 3173406 - protein, 21 aa, Giardia lamblia
TYKYKPVLKHPFNPNNLEEGL

SEQ ID NO: 3173407 - protein, 17 aa, Giardia lamblia
TYLAEFFVHAETQADLH

SEQ ID NO: 3173408 - protein, 26 aa, Giardia lamblia
TYLLYRNLLWRIHIFVNDCPPVNIQN

SEQ ID NO: 3173409 - protein, 18 aa, Giardia lamblia
TYLSEFVNSLFLYVQFIL

SEQ ID NO: 3173410 - protein, 24 aa, Giardia lamblia
TYLSLMGTIGLRFSHLKTTLHDTA

SEQ ID NO: 3173411 - protein, 27 aa, Giardia lamblia
TYLSSLCKPGRSVAVYSLDNLDFQAYG

SEQ ID NO: 3173412 - protein, 21 aa, Giardia lamblia
TYMMRCLYYELIVRGNMRPYK

SEQ ID NO: 3173413 - protein, 24 aa, Giardia lamblia
TYNARLAKLSSIYAAMERAHSLVY

SEQ ID NO: 3173414 - protein, 22 aa, Giardia lamblia
TYNLRVSMCTRNSWEDVKEEPY

SEQ ID NO: 3173415 - protein, 26 aa, Giardia lamblia
TYNSIRFNIKPGYTLEQALRPKNCTP

SEQ ID NO: 3173416 - protein, 18 aa, Giardia lamblia
TYPLHLVAASGYTEALRF

SEQ ID NO: 3173417 - protein, 27 aa, Giardia lamblia
TYQYLADVCEWQFRKGLVSTLADKTCG

SEQ ID NO: 3173418 - protein, 19 aa, Giardia lamblia
TYSEIDIAYLVFRFLCSPA

SEQ ID NO: 3173419 - protein, 20 aa, Giardia lamblia
TYSKIDIVYLVFRFLCSPAG

SEQ ID NO: 3173420 - protein, 25 aa, Giardia lamblia
TYSKPSIIIEPGFYMHATRFDWSKA

SEQ ID NO: 3173421 - protein, 26 aa, Giardia lamblia
TYSLRLKQLGLFTVLCFCVLLQDAEA

SEQ ID NO: 3173422 - protein, 18 aa, Giardia lamblia
TYTGVGVLNNVERSLDDA

SEQ ID NO: 3173423 - protein, 19 aa, Giardia lamblia
TYTILKDVVFLFVTKFSND

SEQ ID NO: 3173424 - protein, 20 aa, Giardia lamblia
TYTISRRRLPILNPTTREVI

SEQ ID NO: 3173425 - protein, 28 aa, Giardia lamblia
TYYITFARAFLRISVKLSDEAAMDEKRK

SEQ ID NO: 3173426 - protein, 18 aa, Giardia lamblia
TYYRGAHGIMVVYDVTSR

SEQ ID NO: 3173427 - protein, 22 aa, Giardia lamblia
TYYSAWTPFVPVSEVQSLTFDP

SEQ ID NO: 3173428 - protein, 26 aa, Giardia lamblia
VAAAELRGATTLVRLFSACIAPDSLA

SEQ ID NO: 3173429 - protein, 26 aa, Giardia lamblia
VAAAELRGATTLVRLFSACIAPDSPA

SEQ ID NO: 3173430 - protein, 24 aa, Giardia lamblia
VAAAINLAAAKIFSGIGNHYDATR

SEQ ID NO: 3173431 - protein, 18 aa, Giardia lamblia
VAAECGLSSVVIALKQSC

SEQ ID NO: 3173432 - protein, 46 aa, Giardia lamblia
VAAELCAYPLFHFCFPNVISLPLTCVLLRGWRKLLIDLASEEQIDH

SEQ ID NO: 3173433 - protein, 20 aa, Giardia lamblia
VAAFYLMMRAFKLDHNDFLT

SEQ ID NO: 3173434 - protein, 18 aa, Giardia lamblia
VAAGAPRLPVKRTSSAPA

SEQ ID NO: 3173435 - protein, 20 aa, Giardia lamblia
VAAGHAELCYILASRERHIL

SEQ ID NO: 3173436 - protein, 26 aa, Giardia lamblia
VAAGVRTIACTWGFHGTDILAAENPT

SEQ ID NO: 3173437 - protein, 20 aa, Giardia lamblia
VAAIKCVNALILYGDSDDED

SEQ ID NO: 3173438 - protein, 19 aa, Giardia lamblia
VAAKERLNMGLAPTDEIEH

SEQ ID NO: 3173439 - protein, 17 aa, Giardia lamblia
VAARVQLVVLRRVQNIK

SEQ ID NO: 3173440 - protein, 29 aa, Giardia lamblia
VAAVIVRKAKRANFNLVEMQPTNVSLLMS

SEQ ID NO: 3173441 - protein, 18 aa, Giardia lamblia
VAAVKPYLRGGGDVTSLV

SEQ ID NO: 3173442 - protein, 26 aa, Giardia lamblia
VAAWHCYPRCVALLMHTEAPRYAERA

SEQ ID NO: 3173443 - protein, 26 aa, Giardia lamblia
VACETILKYGVGWTPLQLERAAEHAN

SEQ ID NO: 3173444 - protein, 21 aa, Giardia lamblia
VACGYIELVLFSLCPAEDSIF

SEQ ID NO: 3173445 - protein, 19 aa, Giardia lamblia
VADAYKYGFLPALNGTYHY

SEQ ID NO: 3173446 - protein, 27 aa, Giardia lamblia
VADIRMKKAFRVCLGLLDLSEKGDLLT

SEQ ID NO: 3173447 - protein, 23 aa, Giardia lamblia
VADISNCWIRNSSPLNKYNADMV

SEQ ID NO: 3173448 - protein, 18 aa, Giardia lamblia
VADLCKKHRDNVVDIQRN

SEQ ID NO: 3173449 - protein, 26 aa, Giardia lamblia
VADLCSRLGVVRGCALLQQLETAVLQ

SEQ ID NO: 3173450 - protein, 31 aa, Giardia lamblia
VADLKVYMSEYLKSIFPIQAVSYDHSACFVV

SEQ ID NO: 3173451 - protein, 19 aa, Giardia lamblia
VADSIYLDFVQPLMSCTNP

SEQ ID NO: 3173452 - protein, 20 aa, Giardia lamblia
VADVEPVFVVYPYRLTLQPG

SEQ ID NO: 3173453 - protein, 26 aa, Giardia lamblia
VADVWSIGCILFEMAAGYHPLDRYVD

SEQ ID NO: 3173454 - protein, 21 aa, Giardia lamblia
VAEECRYDRIEAVRTAARLLI

SEQ ID NO: 3173455 - protein, 28 aa, Giardia lamblia
VAEGGWLMDACFSFPQLYAAKDDFETKA

SEQ ID NO: 3173456 - protein, 24 aa, Giardia lamblia
VAEKLRKAEGLEVEPIERVNGTRT

SEQ ID NO: 3173457 - protein, 18 aa, Giardia lamblia
VAELQSFENSVRMIVEVV

SEQ ID NO: 3173458 - protein, 24 aa, Giardia lamblia
VAERHGPMARRMFNIIRARGMMEA

SEQ ID NO: 3173459 - protein, 19 aa, Giardia lamblia
VAESLASMYSSLLLQGHGL

SEQ ID NO: 3173460 - protein, 17 aa, Giardia lamblia
VAEYEFTTLTAIPGTFV

SEQ ID NO: 3173461 - protein, 17 aa, Giardia lamblia
VAFGDVFGLPIGTNTIY

SEQ ID NO: 3173462 - protein, 24 aa, Giardia lamblia
VAFGSGFAPFRAYHELRSAIASMD

SEQ ID NO: 3173463 - protein, 19 aa, Giardia lamblia
VAFHLSRRILEAASGAGTF

SEQ ID NO: 3173464 - protein, 17 aa, Giardia lamblia
VAFPEMGHFEMLQSKEV

SEQ ID NO: 3173465 - protein, 22 aa, Giardia lamblia
VAGDEAKETWAPIEELHALGIA

SEQ ID NO: 3173466 - protein, 22 aa, Giardia lamblia
VAGKTALMLAVEMEDYTLCDML

SEQ ID NO: 3173467 - protein, 19 aa, Giardia lamblia
VAGPREFTLTCDRVLSAGF

SEQ ID NO: 3173468 - protein, 23 aa, Giardia lamblia
VAGTEYYYGAGIQSEPAGQTHFG

SEQ ID NO: 3173469 - protein, 22 aa, Giardia lamblia
VAGTLPRPLVYKNVAQPRSEMQ

SEQ ID NO: 3173470 - protein, 28 aa, Giardia lamblia
VAGTVSMCYCMRMTFSAVADFFKANTIE

SEQ ID NO: 3173471 - protein, 18 aa, Giardia lamblia
VAGVDGFLLSIGSTLQKS

SEQ ID NO: 3173472 - protein, 17 aa, Giardia lamblia
VAGVTLKACRISETPEL

SEQ ID NO: 3173473 - protein, 21 aa, Giardia lamblia
VAHHCGCTFIRVSGSELLSKY

SEQ ID NO: 3173474 - protein, 23 aa, Giardia lamblia
VAHISEILAFFTRVTDGISQTAF

SEQ ID NO: 3173475 - protein, 19 aa, Giardia lamblia
VAHMDLRLENCLLDNNGCV

SEQ ID NO: 3173476 - protein, 17 aa, Giardia lamblia
VAICGSKSMASSNVSDR

SEQ ID NO: 3173477 - protein, 19 aa, Giardia lamblia
VAISELRAELGHYKAENDT

SEQ ID NO: 3173478 - protein, 25 aa, Giardia lamblia
VAITRAVSHLIVFQSYQFSGDNLSS

SEQ ID NO: 3173479 - protein, 18 aa, Giardia lamblia
VAKALCKDVIAIPASMEK

SEQ ID NO: 3173480 - protein, 20 aa, Giardia lamblia
VAKCRGCGHKYRQALVSGLD

SEQ ID NO: 3173481 - protein, 17 aa, Giardia lamblia
VAKGNYGAVSGFPDMRT

SEQ ID NO: 3173482 - protein, 24 aa, Giardia lamblia
VAKPLYKMGYLFAPRSVCLAGVST

SEQ ID NO: 3173483 - protein, 19 aa, Giardia lamblia
VALIEAFKILISAGPLCEE

SEQ ID NO: 3173484 - protein, 19 aa, Giardia lamblia
VALKAFLMPHVPPRQTDSS

SEQ ID NO: 3173485 - protein, 17 aa, Giardia lamblia
VALKGTGLYGFVDASED

SEQ ID NO: 3173486 - protein, 21 aa, Giardia lamblia
VALKKSFPIQLYLDAATHTFV

SEQ ID NO: 3173487 - protein, 25 aa, Giardia lamblia
VALKTDRRGALFLTDESLIYHGNNF

SEQ ID NO: 3173488 - protein, 27 aa, Giardia lamblia
VALKYSSLPYRAWSLTPCLDRGDNLNI

SEQ ID NO: 3173489 - protein, 22 aa, Giardia lamblia
VALLDRRYLIIQPAALSKYVEK

SEQ ID NO: 3173490 - protein, 31 aa, Giardia lamblia
VALPVVHSPLRFLLDMILKLNLTVKPIFPCL

SEQ ID NO: 3173491 - protein, 25 aa, Giardia lamblia
VALQWMMMGNYAFREELLPMADQKA

SEQ ID NO: 3173492 - protein, 17 aa, Giardia lamblia
VALRHLREEAIQIRENC

SEQ ID NO: 3173493 - protein, 21 aa, Giardia lamblia
VALRIGRPFRPIYLVDAGPQQ

SEQ ID NO: 3173494 - protein, 25 aa, Giardia lamblia
VALRNIQIGFDFNHYYIFDEKLPYS

SEQ ID NO: 3173495 - protein, 34 aa, Giardia lamblia
VALSPNKRKFICLSSFLTWCRTELPPRQLEDKEE

SEQ ID NO: 3173496 - protein, 18 aa, Giardia lamblia
VALVKLLFSYEKDLQLAD

SEQ ID NO: 3173497 - protein, 27 aa, Giardia lamblia
VALVLKSCAPIVGADVFCFETEQELLL

SEQ ID NO: 3173498 - protein, 18 aa, Giardia lamblia
VAMDRWRLIHSYLMTESI

SEQ ID NO: 3173499 - protein, 18 aa, Giardia lamblia
VAMEGGKNIYEYDENGTA

SEQ ID NO: 3173500 - protein, 19 aa, Giardia lamblia
VAMRLAISRFEHAFVASAS

SEQ ID NO: 3173501 - protein, 19 aa, Giardia lamblia
VANALPILGHRGCGSNKIH

SEQ ID NO: 3173502 - protein, 25 aa, Giardia lamblia
VANARPTSRPDFMTKRIDEQARRLS

SEQ ID NO: 3173503 - protein, 17 aa, Giardia lamblia
VANDYHAVCLYRSDAGK

SEQ ID NO: 3173504 - protein, 18 aa, Giardia lamblia
VANPRFILTLSTKHNVCE

SEQ ID NO: 3173505 - protein, 18 aa, Giardia lamblia
VANPSKWVSENVSLECSS

SEQ ID NO: 3173506 - protein, 28 aa, Giardia lamblia
VAPAARLCHWPGRISNFRLNEEVPGTRG

SEQ ID NO: 3173507 - protein, 24 aa, Giardia lamblia
VAPEGCIPILVSNMECRYLPNEVS

SEQ ID NO: 3173508 - protein, 17 aa, Giardia lamblia
VAPEISFAPAARSALKD

SEQ ID NO: 3173509 - protein, 26 aa, Giardia lamblia
VAPEKELMGWGTWFGEGMSTYDKEKL

SEQ ID NO: 3173510 - protein, 23 aa, Giardia lamblia
VAPESMRGFILRQHSMLFTEGEV

SEQ ID NO: 3173511 - protein, 19 aa, Giardia lamblia
VAPLPRAPSAHVLSPTGDS

SEQ ID NO: 3173512 - protein, 17 aa, Giardia lamblia
VAPSKGLSCMMISGPKP

SEQ ID NO: 3173513 - protein, 24 aa, Giardia lamblia
VAQALRLSGLYGLSVHLRTAKQRY

SEQ ID NO: 3173514 - protein, 17 aa, Giardia lamblia
VAQLLTKLEGADVSSFS

SEQ ID NO: 3173515 - protein, 27 aa, Giardia lamblia
VAQRKNAELVFLVRYMDLLVQAYQLSI

SEQ ID NO: 3173516 - protein, 24 aa, Giardia lamblia
VARFYMSQCCACINEIHKNNSFYR

SEQ ID NO: 3173517 - protein, 24 aa, Giardia lamblia
VARKFQCCYCGDALTGEDRVAGPF

SEQ ID NO: 3173518 - protein, 24 aa, Giardia lamblia
VARMARLKMGGFNASAFTSSADKY

SEQ ID NO: 3173519 - protein, 23 aa, Giardia lamblia
VARSNAGLVLRLPPRPVHPHATY

SEQ ID NO: 3173520 - protein, 25 aa, Giardia lamblia
VASDVQGCFAAFMKRNGITLLPATM

SEQ ID NO: 3173521 - protein, 17 aa, Giardia lamblia
VASEVADVFQSAYERHL

SEQ ID NO: 3173522 - protein, 23 aa, Giardia lamblia
VASGNAKCVSALAAYEAQTYGEA

SEQ ID NO: 3173523 - protein, 17 aa, Giardia lamblia
VASIFLGHQQLDRVKNF

SEQ ID NO: 3173524 - protein, 22 aa, Giardia lamblia
VASKRPRTFAFLVHAASVLCLV

SEQ ID NO: 3173525 - protein, 18 aa, Giardia lamblia
VASQEFKGHIDGQRNMAN

SEQ ID NO: 3173526 - protein, 27 aa, Giardia lamblia
VASQLDLKLLFRFQGLSQRTYEAGYQV

SEQ ID NO: 3173527 - protein, 17 aa, Giardia lamblia
VASRLTFPEVVTARNRD

SEQ ID NO: 3173528 - protein, 17 aa, Giardia lamblia
VASSLMSSFSFASKDLG

SEQ ID NO: 3173529 - protein, 22 aa, Giardia lamblia
VASTECAYCFLNRYNSQGLYLC

SEQ ID NO: 3173530 - protein, 18 aa, Giardia lamblia
VASVAFRNWFLLFSENSI

SEQ ID NO: 3173531 - protein, 17 aa, Giardia lamblia
VATDAVFCLTHHRASVC

SEQ ID NO: 3173532 - protein, 17 aa, Giardia lamblia
VATGLPPSLVFNSVAGY

SEQ ID NO: 3173533 - protein, 17 aa, Giardia lamblia
VATGYEGKGDMKLSKET

SEQ ID NO: 3173534 - protein, 23 aa, Giardia lamblia
VATNPKFRNFFAAGIPTAVLACF

SEQ ID NO: 3173535 - protein, 27 aa, Giardia lamblia
VATPGRLRYYLADGLVSLKDLEILIID

SEQ ID NO: 3173536 - protein, 25 aa, Giardia lamblia
VATSRSAGGMGVFKIPVRRRQTVNC

SEQ ID NO: 3173537 - protein, 23 aa, Giardia lamblia
VATWAELLLPLLQSLGQGGDTQP

SEQ ID NO: 3173538 - protein, 17 aa, Giardia lamblia
VAVDAVFRVADLQRNDV

SEQ ID NO: 3173539 - protein, 20 aa, Giardia lamblia
VAVELVRQGKAYVCDQTVEE

SEQ ID NO: 3173540 - protein, 35 aa, Giardia lamblia
VAVIAGRQLLLWRAKPRLAPGFSDQTLTYDLLEDP

SEQ ID NO: 3173541 - protein, 18 aa, Giardia lamblia
VAVLAGQVLIELHCWIAG

SEQ ID NO: 3173542 - protein, 18 aa, Giardia lamblia
VAVLAPLEAKRYCCHGKT

SEQ ID NO: 3173543 - protein, 24 aa, Giardia lamblia
VAVLPRILSLHSRERPSNENPPRR

SEQ ID NO: 3173544 - protein, 18 aa, Giardia lamblia
VAVLQAFTALRFSNYKYI

SEQ ID NO: 3173545 - protein, 17 aa, Giardia lamblia
VAVLRRALRVIEDDYRD

SEQ ID NO: 3173546 - protein, 20 aa, Giardia lamblia
VAVSCYRATEVIGLPEAHYA

SEQ ID NO: 3173547 - protein, 24 aa, Giardia lamblia
VAVSEKDLDCVLANMQYAGIVNDF

SEQ ID NO: 3173548 - protein, 24 aa, Giardia lamblia
VAVSPDCRSFVTGSFSDKFHIYGT

SEQ ID NO: 3173549 - protein, 19 aa, Giardia lamblia
VAWSCLLLHNTMPWQMLTD

SEQ ID NO: 3173550 - protein, 17 aa, Giardia lamblia
VAYAIALRTGIRGADSL

SEQ ID NO: 3173551 - protein, 17 aa, Giardia lamblia
VAYDMYSNAYVKIFNGF

SEQ ID NO: 3173552 - protein, 38 aa, Giardia lamblia
VAYHKGYREPVDIWSLGCVIVNMCTRMAPQVIRNKSYD

SEQ ID NO: 3173553 - protein, 17 aa, Giardia lamblia
VAYKMLITMLDFIHSLQ

SEQ ID NO: 3173554 - protein, 18 aa, Giardia lamblia
VAYPCINYSAPLQSAHPG

SEQ ID NO: 3173555 - protein, 24 aa, Giardia lamblia
VAYPDIVSFCIDTYISKIIVPQQS

SEQ ID NO: 3173556 - protein, 18 aa, Giardia lamblia
VCACDSFRSGAVEQLQEH

SEQ ID NO: 3173557 - protein, 19 aa, Giardia lamblia
VCDGEQRPILPLLDDNKLS

SEQ ID NO: 3173558 - protein, 24 aa, Giardia lamblia
VCDHRLPCDDSWHSHPNRISKNLW

SEQ ID NO: 3173559 - protein, 17 aa, Giardia lamblia
VCEAEALVLDTSEPQPL

SEQ ID NO: 3173560 - protein, 20 aa, Giardia lamblia
VCGAEDFCCYDEYVKKVSEI

SEQ ID NO: 3173561 - protein, 17 aa, Giardia lamblia
VCGCGSFDAADNVPQWN

SEQ ID NO: 3173562 - protein, 29 aa, Giardia lamblia
VCGHYTILTCLRVLEGLKLDVKKELLFYT

SEQ ID NO: 3173563 - protein, 19 aa, Giardia lamblia
VCHIVEAIQTLDAELDEVR

SEQ ID NO: 3173564 - protein, 23 aa, Giardia lamblia
VCHKDAWLGTVTIRRVRDLPLLE

SEQ ID NO: 3173565 - protein, 24 aa, Giardia lamblia
VCIFKIGNKFPIELLLHRSPIVSL

SEQ ID NO: 3173566 - protein, 24 aa, Giardia lamblia
VCKDRPDDVLSYLIHKFASYSPLA

SEQ ID NO: 3173567 - protein, 25 aa, Giardia lamblia
VCKGVQRVPLTFVINAHLQDDKVAN

SEQ ID NO: 3173568 - protein, 24 aa, Giardia lamblia
VCKIKRPNNFFIIRGNHETTDLQP

SEQ ID NO: 3173569 - protein, 19 aa, Giardia lamblia
VCKSLKELSTGLAHISLKG

SEQ ID NO: 3173570 - protein, 38 aa, Giardia lamblia
VCLDIPSAHAYYKAICQMILRFNNILLRTSQAQHNGLL

SEQ ID NO: 3173571 - protein, 29 aa, Giardia lamblia
VCLELPLYRKNIRALYGIPANCFLFCTFN

SEQ ID NO: 3173572 - protein, 17 aa, Giardia lamblia
VCMDRLSDCVLMPCRHV

SEQ ID NO: 3173573 - protein, 18 aa, Giardia lamblia
VCMMSSMGIINRDLKIEN

SEQ ID NO: 3173574 - protein, 23 aa, Giardia lamblia
VCMSRQPDCVLLPCRHLVICSFC

SEQ ID NO: 3173575 - protein, 17 aa, Giardia lamblia
VCNHQWISASGWKDLVK

SEQ ID NO: 3173576 - protein, 17 aa, Giardia lamblia
VCNLCSKALDILSQGYL

SEQ ID NO: 3173577 - protein, 20 aa, Giardia lamblia
VCNQLAPSFRTMLLQRKETV

SEQ ID NO: 3173578 - protein, 27 aa, Giardia lamblia
VCNTPSAIELIAFSTPYFVGRGPKTHA

SEQ ID NO: 3173579 - protein, 26 aa, Giardia lamblia
VCPDCAQIYPCRICHDNLVPGHTLDR

SEQ ID NO: 3173580 - protein, 17 aa, Giardia lamblia
VCPEKRISISELVLHPR

SEQ ID NO: 3173581 - protein, 20 aa, Giardia lamblia
VCPSGEGWCVLLHSQNSPLS

SEQ ID NO: 3173582 - protein, 27 aa, Giardia lamblia
VCQHRSGLYAINFTNPYIKSTFQGNFN

SEQ ID NO: 3173583 - protein, 25 aa, Giardia lamblia
VCQQLSYFIACKFYNYLIENNNLHV

SEQ ID NO: 3173584 - protein, 17 aa, Giardia lamblia
VCQRNFLVGPALRRSSV

SEQ ID NO: 3173585 - protein, 21 aa, Giardia lamblia
VCQSHLRLVAGVLPSLLGEIN

SEQ ID NO: 3173586 - protein, 17 aa, Giardia lamblia
VCRMEHYQPSELCKEHM

SEQ ID NO: 3173587 - protein, 17 aa, Giardia lamblia
VCRPRPVYMISADEDMD

SEQ ID NO: 3173588 - protein, 22 aa, Giardia lamblia
VCSELASELLVVTCFDREINLR

SEQ ID NO: 3173589 - protein, 21 aa, Giardia lamblia
VCSLLYQAGCRNADGTTALMI

SEQ ID NO: 3173590 - protein, 18 aa, Giardia lamblia
VCSRCRRGTLASFVSAGG

SEQ ID NO: 3173591 - protein, 21 aa, Giardia lamblia
VCSSPWPYGLGQRDTRGQKTQ

SEQ ID NO: 3173592 - protein, 21 aa, Giardia lamblia
VCSVAGKVVGYVMGKIDDEDN

SEQ ID NO: 3173593 - protein, 20 aa, Giardia lamblia
VCTHCGYTSIGFQHGIGLSL

SEQ ID NO: 3173594 - protein, 28 aa, Giardia lamblia
VCTKVLGCGYYTIYCLDGIRRRCHLRGA

SEQ ID NO: 3173595 - protein, 20 aa, Giardia lamblia
VCVEACPKDALAMTPIDTVL

SEQ ID NO: 3173596 - protein, 25 aa, Giardia lamblia
VCVRLTGLWLLFKRLTVVDLEDSKG

SEQ ID NO: 3173597 - protein, 18 aa, Giardia lamblia
VCYPHVLDISPYIEDQSD

SEQ ID NO: 3173598 - protein, 17 aa, Giardia lamblia
VCYTKLYGRELVREIDE

SEQ ID NO: 3173599 - protein, 25 aa, Giardia lamblia
VDAGKLYADLWLFDLQENKWHSVTI

SEQ ID NO: 3173600 - protein, 23 aa, Giardia lamblia
VDAHTALMYSAKFGKVHCISLLL

SEQ ID NO: 3173601 - protein, 24 aa, Giardia lamblia
VDALRSYLLRCLNSDGGFGTTPGD

SEQ ID NO: 3173602 - protein, 21 aa, Giardia lamblia
VDAPVFGKNTCVLRSEKSIVG

SEQ ID NO: 3173603 - protein, 25 aa, Giardia lamblia
VDARGRTALMYAAEMGRSSIVELLK

SEQ ID NO: 3173604 - protein, 21 aa, Giardia lamblia
VDARVSGPVQARILELRAAHA

SEQ ID NO: 3173605 - protein, 26 aa, Giardia lamblia
VDAVKRYIHYQARMVARFVTAGMVEI

SEQ ID NO: 3173606 - protein, 28 aa, Giardia lamblia
VDAVKRYIPYQARMMARFVKAGRVEIYD

SEQ ID NO: 3173607 - protein, 23 aa, Giardia lamblia
VDAVKRYIPYQARMVAKLVKTGR

SEQ ID NO: 3173608 - protein, 17 aa, Giardia lamblia
VDCKRKIVLATNIAETS

SEQ ID NO: 3173609 - protein, 18 aa, Giardia lamblia
VDCVKILADHEIGVSLPD

SEQ ID NO: 3173610 - protein, 20 aa, Giardia lamblia
VDCYLAEGWRVLPPTRAVCR

SEQ ID NO: 3173611 - protein, 32 aa, Giardia lamblia
VDDELWIILEFCSAGAISDLMRGCHKTLTEEQ

SEQ ID NO: 3173612 - protein, 19 aa, Giardia lamblia
VDDIIRFIAHKKCKRSIIF

SEQ ID NO: 3173613 - protein, 17 aa, Giardia lamblia
VDDLRTQVGLKLSVDPS

SEQ ID NO: 3173614 - protein, 26 aa, Giardia lamblia
VDDLVASPCRLYAYVVKTPIDWQRIA

SEQ ID NO: 3173615 - protein, 23 aa, Giardia lamblia
VDDTRPAILQALGTSYLTRSLED

SEQ ID NO: 3173616 - protein, 18 aa, Giardia lamblia
VDDWSFSSSSPWNTSAMK

SEQ ID NO: 3173617 - protein, 24 aa, Giardia lamblia
VDEAREKMQLVGRVPTEPGAADTA

SEQ ID NO: 3173618 - protein, 30 aa, Giardia lamblia
VDEDQCLGILKGGIKHLFMLDSQNETHEMD

SEQ ID NO: 3173619 - protein, 24 aa, Giardia lamblia
VDEFWKITVQLIYILILFSTIEGR

SEQ ID NO: 3173620 - protein, 23 aa, Giardia lamblia
VDEFYHYGLALPIYTHFTSPIRR

SEQ ID NO: 3173621 - protein, 19 aa, Giardia lamblia
VDENMVFRALNLVGSPRNV

SEQ ID NO: 3173622 - protein, 24 aa, Giardia lamblia
VDESCVLDAPSVLRQEVTTVTKPT

SEQ ID NO: 3173623 - protein, 17 aa, Giardia lamblia
VDFAEAYIPPVLTTAQF

SEQ ID NO: 3173624 - protein, 17 aa, Giardia lamblia
VDFKKRPSATELLAHPK

SEQ ID NO: 3173625 - protein, 19 aa, Giardia lamblia
VDFQGAVALGSRYPADQRD

SEQ ID NO: 3173626 - protein, 18 aa, Giardia lamblia
VDGETALMIAAKHNSLEV

SEQ ID NO: 3173627 - protein, 23 aa, Giardia lamblia
VDGEYFIIAGLELCKDALWSEST

SEQ ID NO: 3173628 - protein, 18 aa, Giardia lamblia
VDGFREWAASRSFGLGTK

SEQ ID NO: 3173629 - protein, 18 aa, Giardia lamblia
VDGHLSLSALSQRSKVSS

SEQ ID NO: 3173630 - protein, 29 aa, Giardia lamblia
VDGMSGMELLWLGLVEYKELRRLGKDERE

SEQ ID NO: 3173631 - protein, 17 aa, Giardia lamblia
VDGRTALMIACQNSHLP

SEQ ID NO: 3173632 - protein, 22 aa, Giardia lamblia
VDGSGLRKTHFMVGDGTKFDGE

SEQ ID NO: 3173633 - protein, 19 aa, Giardia lamblia
VDGTTCLFVALKNKCSFSY

SEQ ID NO: 3173634 - protein, 26 aa, Giardia lamblia
VDHCEIRPFLIFALSIKMASSIMSDL

SEQ ID NO: 3173635 - protein, 24 aa, Giardia lamblia
VDHGKESAEIILLNATLQELREQL

SEQ ID NO: 3173636 - protein, 20 aa, Giardia lamblia
VDHPYAFHAFQLVREKCALA

SEQ ID NO: 3173637 - protein, 18 aa, Giardia lamblia
VDHTEAILGRGLVVDSDY

SEQ ID NO: 3173638 - protein, 17 aa, Giardia lamblia
VDICPKTRRVLVYTDAG

SEQ ID NO: 3173639 - protein, 26 aa, Giardia lamblia
VDIDAFSGFGNFIVYCLPDPARSALL

SEQ ID NO: 3173640 - protein, 17 aa, Giardia lamblia
VDIDLSMHLRHWPDIEK

SEQ ID NO: 3173641 - protein, 17 aa, Giardia lamblia
VDIMPLTSLEFVTPPPA

SEQ ID NO: 3173642 - protein, 24 aa, Giardia lamblia
VDIPCPVVSIPSALPPSAPSNSSS

SEQ ID NO: 3173643 - protein, 18 aa, Giardia lamblia
VDIRRAYDKLSVENSSNE

SEQ ID NO: 3173644 - protein, 20 aa, Giardia lamblia
VDIWSLGCTLFEYGSNKPFI

SEQ ID NO: 3173645 - protein, 18 aa, Giardia lamblia
VDIWSLGMTALFLCESHY

SEQ ID NO: 3173646 - protein, 18 aa, Giardia lamblia
VDIWSLGTTLFFIAAFQS

SEQ ID NO: 3173647 - protein, 20 aa, Giardia lamblia
VDIYARCNAELGFLIKVTPS

SEQ ID NO: 3173648 - protein, 20 aa, Giardia lamblia
VDIYSGLLIYQGPISGEMVF

SEQ ID NO: 3173649 - protein, 23 aa, Giardia lamblia
VDKKGRTALMYAAAQNYRAAAEQ

SEQ ID NO: 3173650 - protein, 27 aa, Giardia lamblia
VDKKSIIDWCYRIGAMAANKCDEERRP

SEQ ID NO: 3173651 - protein, 18 aa, Giardia lamblia
VDKRTSFTEVRTNFLQVP

SEQ ID NO: 3173652 - protein, 23 aa, Giardia lamblia
VDKSRFFAFGRVFSGVVQTGQKV

SEQ ID NO: 3173653 - protein, 17 aa, Giardia lamblia
VDKVIELDKAWVSKDYE

SEQ ID NO: 3173654 - protein, 25 aa, Giardia lamblia
VDLCALMKIPPIGVMCMAYVAQSLK

SEQ ID NO: 3173655 - protein, 22 aa, Giardia lamblia
VDLFEMCTWWSQQLNYHNRQFS

SEQ ID NO: 3173656 - protein, 21 aa, Giardia lamblia
VDLFKALSMELSLEKFEDCAG

SEQ ID NO: 3173657 - protein, 25 aa, Giardia lamblia
VDLFRAKYGPGFLVCGIGGGSPCDS

SEQ ID NO: 3173658 - protein, 22 aa, Giardia lamblia
VDLKSTIYSTAQFIARLSKDAC

SEQ ID NO: 3173659 - protein, 17 aa, Giardia lamblia
VDLLCLESGLLSVRSSC

SEQ ID NO: 3173660 - protein, 17 aa, Giardia lamblia
VDLPENYGFQDSSKPNE

SEQ ID NO: 3173661 - protein, 24 aa, Giardia lamblia
VDLQEGRFRTSWDTPSFSRKLISS

SEQ ID NO: 3173662 - protein, 17 aa, Giardia lamblia
VDLRPGGKLFFNLTHNY

SEQ ID NO: 3173663 - protein, 17 aa, Giardia lamblia
VDLSFLYALLNKDCSNH

SEQ ID NO: 3173664 - protein, 37 aa, Giardia lamblia
VDMRHIRLLADIMCFRGRVLGFTRFGLTKMKADSVIM

SEQ ID NO: 3173665 - protein, 29 aa, Giardia lamblia
VDMSDCFCKSRKRRALPPLSQRPSSKERS

SEQ ID NO: 3173666 - protein, 25 aa, Giardia lamblia
VDMWSMGCIMYFLANKRALFQVRKD

SEQ ID NO: 3173667 - protein, 27 aa, Giardia lamblia
VDNAGRTALSHAIRFKQRPVIDLLTRY

SEQ ID NO: 3173668 - protein, 24 aa, Giardia lamblia
VDNEGRSALMYAVLLEPDECLPFV

SEQ ID NO: 3173669 - protein, 25 aa, Giardia lamblia
VDNKPGLRPPLSLSSRSSSSRRAYS

SEQ ID NO: 3173670 - protein, 21 aa, Giardia lamblia
VDNNGRTALDLAKEAGHGSVI

SEQ ID NO: 3173671 - protein, 23 aa, Giardia lamblia
VDPDSGLAFPLSLSIGSVIGDYS

SEQ ID NO: 3173672 - protein, 28 aa, Giardia lamblia
VDPGEIWPRYDAGYADYLRYMGKGMGPW

SEQ ID NO: 3173673 - protein, 25 aa, Giardia lamblia
VDPIRFPSIEVVYYRGIEVDDPSKV

SEQ ID NO: 3173674 - protein, 17 aa, Giardia lamblia
VDPSHYPFMLSEANLVS

SEQ ID NO: 3173675 - protein, 35 aa, Giardia lamblia
VDPWPKYGAKLPLSLSLFRLRSFVINFRTKQVNIE

SEQ ID NO: 3173676 - protein, 20 aa, Giardia lamblia
VDQEFLYFILDIMRASGGYR

SEQ ID NO: 3173677 - protein, 24 aa, Giardia lamblia
VDQFIEMMGCFNLFDIGPHCIARK

SEQ ID NO: 3173678 - protein, 19 aa, Giardia lamblia
VDQINRFVARSMLVQAITQ

SEQ ID NO: 3173679 - protein, 24 aa, Giardia lamblia
VDRDECKRDLLGPNTIHIGVFRSD

SEQ ID NO: 3173680 - protein, 19 aa, Giardia lamblia
VDREARLVKKNGYSSLMVA

SEQ ID NO: 3173681 - protein, 24 aa, Giardia lamblia
VDREGRSALILSILHQRVACAKIL

SEQ ID NO: 3173682 - protein, 26 aa, Giardia lamblia
VDRGSFSIECLVVLLGLKILFPNAVY

SEQ ID NO: 3173683 - protein, 25 aa, Giardia lamblia
VDRGSRGLACVLFIYVLKYLYPRNV

SEQ ID NO: 3173684 - protein, 19 aa, Giardia lamblia
VDRIAPFIMIDKTDIQDIQ

SEQ ID NO: 3173685 - protein, 24 aa, Giardia lamblia
VDRKDRGGITFSIGIPGGEELKNL

SEQ ID NO: 3173686 - protein, 24 aa, Giardia lamblia
VDRVRIPYTPFIRLRRTMHERRDF

SEQ ID NO: 3173687 - protein, 17 aa, Giardia lamblia
VDSDLSSVFARHYDAVA

SEQ ID NO: 3173688 - protein, 23 aa, Giardia lamblia
VDSFISEDLFAWIKDIDENSLLD

SEQ ID NO: 3173689 - protein, 17 aa, Giardia lamblia
VDSFKTSMSIYLAQNFN

SEQ ID NO: 3173690 - protein, 20 aa, Giardia lamblia
VDSILRFLYNLCFDDTARHT

SEQ ID NO: 3173691 - protein, 26 aa, Giardia lamblia
VDSKDVRLCLRFVRSMTETYVKSTIG

SEQ ID NO: 3173692 - protein, 21 aa, Giardia lamblia
VDSKLRYVPRDVPNAPKSSFL

SEQ ID NO: 3173693 - protein, 27 aa, Giardia lamblia
VDSLKEELIEIRVDMVKFLVETFEDPC

SEQ ID NO: 3173694 - protein, 24 aa, Giardia lamblia
VDSPSKYTASFIKNAIREASSISS

SEQ ID NO: 3173695 - protein, 18 aa, Giardia lamblia
VDSSGWILDAFQDTVNDD

SEQ ID NO: 3173696 - protein, 25 aa, Giardia lamblia
VDSSLKLKAILAEYEQNIKLSTDKI

SEQ ID NO: 3173697 - protein, 24 aa, Giardia lamblia
VDSVKSFAKRYACSLNNKGETALH

SEQ ID NO: 3173698 - protein, 19 aa, Giardia lamblia
VDTGGHCALIYSLKARWPM

SEQ ID NO: 3173699 - protein, 29 aa, Giardia lamblia
VDTGLALTVNIPYCWKEKVNSQTQTQTHI

SEQ ID NO: 3173700 - protein, 17 aa, Giardia lamblia
VDTHLVVIDDLKFEIET

SEQ ID NO: 3173701 - protein, 25 aa, Giardia lamblia
VDTIKLELAALFTLFHPGVIKYHQV

SEQ ID NO: 3173702 - protein, 27 aa, Giardia lamblia
VDTQKFRELWAYHERRIAESLRDLLLA

SEQ ID NO: 3173703 - protein, 23 aa, Giardia lamblia
VDTQLRGFAWVRIPKDAYSPLPS

SEQ ID NO: 3173704 - protein, 17 aa, Giardia lamblia
VDTSGVTALIWAAFAGQ

SEQ ID NO: 3173705 - protein, 17 aa, Giardia lamblia
VDVALTLKQKRKEERER

SEQ ID NO: 3173706 - protein, 19 aa, Giardia lamblia
VDVKGAGRYGIFTHSTNMS

SEQ ID NO: 3173707 - protein, 25 aa, Giardia lamblia
VDVLPRARMEAVTFDFVDVPVVERL

SEQ ID NO: 3173708 - protein, 19 aa, Giardia lamblia
VDVLYRYKLKLKEVKQRKP

SEQ ID NO: 3173709 - protein, 19 aa, Giardia lamblia
VDVPSGWSVDAQEWGLNTD

SEQ ID NO: 3173710 - protein, 17 aa, Giardia lamblia
VDVSRMLYTLIGLYNQD

SEQ ID NO: 3173711 - protein, 19 aa, Giardia lamblia
VDYATLCDPIWLQRNPEVF

SEQ ID NO: 3173712 - protein, 18 aa, Giardia lamblia
VDYDPEFNEPLDIGSLIY

SEQ ID NO: 3173713 - protein, 25 aa, Giardia lamblia
VDYEECPRCGPNCICKVKEDIITTH

SEQ ID NO: 3173714 - protein, 24 aa, Giardia lamblia
VDYRKRSALMLAAYFGHLSVVQLL

SEQ ID NO: 3173715 - protein, 25 aa, Giardia lamblia
VDYRNLWLAKIALKEKFHGPEAGMN

SEQ ID NO: 3173716 - protein, 25 aa, Giardia lamblia
VEAEVLKSRIIELEATVAQTLKDQL

SEQ ID NO: 3173717 - protein, 17 aa, Giardia lamblia
VEALAPLEGGLCVTALS

SEQ ID NO: 3173718 - protein, 17 aa, Giardia lamblia
VEALESIAFSLTLGDNV

SEQ ID NO: 3173719 - protein, 22 aa, Giardia lamblia
VEAREVEKFYSLADNVSVKTDD

SEQ ID NO: 3173720 - protein, 19 aa, Giardia lamblia
VEARSPFVAGPGAATEKTQ

SEQ ID NO: 3173721 - protein, 18 aa, Giardia lamblia
VEARSVRCAGNFGANGEL

SEQ ID NO: 3173722 - protein, 21 aa, Giardia lamblia
VEARTAEAIFLAMTSMIKELS

SEQ ID NO: 3173723 - protein, 20 aa, Giardia lamblia
VEATMGFMVPASFSRTIISF

SEQ ID NO: 3173724 - protein, 18 aa, Giardia lamblia
VEAVAMRLAISRFEHAFV

SEQ ID NO: 3173725 - protein, 18 aa, Giardia lamblia
VEAVKLLLMEAGIADNWG

SEQ ID NO: 3173726 - protein, 17 aa, Giardia lamblia
VECCLLLIDHEKRRQDG

SEQ ID NO: 3173727 - protein, 24 aa, Giardia lamblia
VECPEGRPLFACLLDKTMVVAVYD

SEQ ID NO: 3173728 - protein, 17 aa, Giardia lamblia
VECPLFVTWHTALRTGD

SEQ ID NO: 3173729 - protein, 19 aa, Giardia lamblia
VECPPGWRKPGPVDCKSFS

SEQ ID NO: 3173730 - protein, 21 aa, Giardia lamblia
VEDACGIRGKEFARGNLKSYM

SEQ ID NO: 3173731 - protein, 22 aa, Giardia lamblia
VEDAWCRRSLMTGFSQQKPAPR

SEQ ID NO: 3173732 - protein, 25 aa, Giardia lamblia
VEDFPGKRKFTCIQQVYEVLLELQR

SEQ ID NO: 3173733 - protein, 25 aa, Giardia lamblia
VEDPELFPSHCLEDIEGSVPSTQNQ

SEQ ID NO: 3173734 - protein, 18 aa, Giardia lamblia
VEEANLKAGITIQLVVNL

SEQ ID NO: 3173735 - protein, 22 aa, Giardia lamblia
VEEKARPGYTIQIDKTVNPDTA

SEQ ID NO: 3173736 - protein, 22 aa, Giardia lamblia
VEELCSILGSEIYLYMRRAIHG

SEQ ID NO: 3173737 - protein, 27 aa, Giardia lamblia
VEELLKQRINNCLDELVAARTESAEKS

SEQ ID NO: 3173738 - protein, 18 aa, Giardia lamblia
VEEVCLDPLSPMQNKPNL

SEQ ID NO: 3173739 - protein, 32 aa, Giardia lamblia
VEEVIPPLIKKGTCCLEDLNEIFLSILESTPN

SEQ ID NO: 3173740 - protein, 21 aa, Giardia lamblia
VEFDKACGIGVTYTEKEISSA

SEQ ID NO: 3173741 - protein, 17 aa, Giardia lamblia
VEFGRRGVVSAVCTFLT

SEQ ID NO: 3173742 - protein, 36 aa, Giardia lamblia
VEFVELLELANWVHACPILSHRGKVLPWTYPEDEEE

SEQ ID NO: 3173743 - protein, 18 aa, Giardia lamblia
VEGALPVADTVWDYKVDH

SEQ ID NO: 3173744 - protein, 24 aa, Giardia lamblia
VEGEIFPRALLLLRDKDSITSRNA

SEQ ID NO: 3173745 - protein, 18 aa, Giardia lamblia
VEGFHLQGIRQLKSSSSK

SEQ ID NO: 3173746 - protein, 27 aa, Giardia lamblia
VEGGCSCANGWTALMSAARFNKVACVE

SEQ ID NO: 3173747 - protein, 23 aa, Giardia lamblia
VEGNCVVDFVFLLTLDPYMLEFG

SEQ ID NO: 3173748 - protein, 23 aa, Giardia lamblia
VEGPSLPLRFDFSKPDYTVSIAT

SEQ ID NO: 3173749 - protein, 23 aa, Giardia lamblia
VEGSPYWLAPEVINEEGVSTKSD

SEQ ID NO: 3173750 - protein, 26 aa, Giardia lamblia
VEGVPKVVWFSGFSYPQAFLTGILQN

SEQ ID NO: 3173751 - protein, 26 aa, Giardia lamblia
VEHARKSLTQQSAWQKGRAEGGVIIR

SEQ ID NO: 3173752 - protein, 18 aa, Giardia lamblia
VEHCMPLVIEAASGGVRM

SEQ ID NO: 3173753 - protein, 20 aa, Giardia lamblia
VEHHLPILLLKFTSTHPNFT

SEQ ID NO: 3173754 - protein, 23 aa, Giardia lamblia
VEHRPGQYLAIFVRSPEHFQHQQ

SEQ ID NO: 3173755 - protein, 31 aa, Giardia lamblia
VEIALKLYYYDACFILLMLHPDKSFENRVKR

SEQ ID NO: 3173756 - protein, 21 aa, Giardia lamblia
VEICSCLFAKSIGLSLPLQQP

SEQ ID NO: 3173757 - protein, 18 aa, Giardia lamblia
VEIKRKALDVEHLLQEDI

SEQ ID NO: 3173758 - protein, 17 aa, Giardia lamblia
VEILAPYERGRRNKNSR

SEQ ID NO: 3173759 - protein, 17 aa, Giardia lamblia
VEILLDLEKCMASPSTD

SEQ ID NO: 3173760 - protein, 24 aa, Giardia lamblia
VEIPCGYGKLLAAVRQKYPEADLL

SEQ ID NO: 3173761 - protein, 19 aa, Giardia lamblia
VEIPGWKKLDLRYFENLSG

SEQ ID NO: 3173762 - protein, 19 aa, Giardia lamblia
VEKAHGKHLYQTCSGQTED

SEQ ID NO: 3173763 - protein, 17 aa, Giardia lamblia
VEKKAKQTISFDNSKLK

SEQ ID NO: 3173764 - protein, 17 aa, Giardia lamblia
VEKLKLVKVEGVDKVVF

SEQ ID NO: 3173765 - protein, 24 aa, Giardia lamblia
VEKLSVRAAFAIAHMAAEANEHPT

SEQ ID NO: 3173766 - protein, 19 aa, Giardia lamblia
VEKVIYIFTEFCNKGDLFQ

SEQ ID NO: 3173767 - protein, 36 aa, Giardia lamblia
VEKVSPSCPCARTKHAACLVRWNHKDYLYIYGGIDG

SEQ ID NO: 3173768 - protein, 18 aa, Giardia lamblia
VELAQEIQRISAQFSDVS

SEQ ID NO: 3173769 - protein, 17 aa, Giardia lamblia
VELDFLQQMWTIGRLGH

SEQ ID NO: 3173770 - protein, 32 aa, Giardia lamblia
VELEGIYINKCEEYDRLIAISAQLREKNEIMK

SEQ ID NO: 3173771 - protein, 22 aa, Giardia lamblia
VELKMKSLVKLAKRIFIQSETI

SEQ ID NO: 3173772 - protein, 19 aa, Giardia lamblia
VELLIPFQKARMAKGAVKV

SEQ ID NO: 3173773 - protein, 17 aa, Giardia lamblia
VELLLPYEAHIRATKGF

SEQ ID NO: 3173774 - protein, 19 aa, Giardia lamblia
VELPLAMFLEKLYSETGEK

SEQ ID NO: 3173775 - protein, 23 aa, Giardia lamblia
VELPNGTVEYIFLQPYLSALYIH

SEQ ID NO: 3173776 - protein, 21 aa, Giardia lamblia
VELPVIRNGHELSRKHMVYGV

SEQ ID NO: 3173777 - protein, 17 aa, Giardia lamblia
VELQRVRDRYAVDCLNN

SEQ ID NO: 3173778 - protein, 20 aa, Giardia lamblia
VELQSRISVFFGSSIKPHIH

SEQ ID NO: 3173779 - protein, 22 aa, Giardia lamblia
VELVKILGFFENGMVNGEGKTA

SEQ ID NO: 3173780 - protein, 21 aa, Giardia lamblia
VEMARAVGMTDPSLLQGDVAK

SEQ ID NO: 3173781 - protein, 19 aa, Giardia lamblia
VEMARLLVEREARIQDNCG

SEQ ID NO: 3173782 - protein, 18 aa, Giardia lamblia
VEMLMRYEAGFISNDGAT

SEQ ID NO: 3173783 - protein, 27 aa, Giardia lamblia
VEMSRPRIADINKWIGVFITSTTRRVK

SEQ ID NO: 3173784 - protein, 24 aa, Giardia lamblia
VENMWLRDLAAFEAAYEVDRHMEQ

SEQ ID NO: 3173785 - protein, 20 aa, Giardia lamblia
VENPPGFPFITPEERHTTVP

SEQ ID NO: 3173786 - protein, 27 aa, Giardia lamblia
VENYPMCFLCAYIVGSVEKLNELSSLT

SEQ ID NO: 3173787 - protein, 22 aa, Giardia lamblia
VEPEITYDLALREYTYYQSSGK

SEQ ID NO: 3173788 - protein, 26 aa, Giardia lamblia
VEPGRKLLCMDLVFKNVVMDAVQEIT

SEQ ID NO: 3173789 - protein, 24 aa, Giardia lamblia
VEPGVNCAPFLQALSRAIFSCSTE

SEQ ID NO: 3173790 - protein, 17 aa, Giardia lamblia
VEPLEIFGARSKIVEVG

SEQ ID NO: 3173791 - protein, 31 aa, Giardia lamblia
VEPLKNLCRIFSWIFALDLPKTMLKQQAAEL

SEQ ID NO: 3173792 - protein, 17 aa, Giardia lamblia
VEQEGAFALQLKQPLVI

SEQ ID NO: 3173793 - protein, 23 aa, Giardia lamblia
VEQKSAFIASEFGKDEYSFELFK

SEQ ID NO: 3173794 - protein, 24 aa, Giardia lamblia
VEQSRRFACLSLLKKHYKENPVST

SEQ ID NO: 3173795 - protein, 25 aa, Giardia lamblia
VEQTRPGWISKRPVVPIIGYEFKEI

SEQ ID NO: 3173796 - protein, 21 aa, Giardia lamblia
VERAAQCLLTQFSNYNIYTSS

SEQ ID NO: 3173797 - protein, 24 aa, Giardia lamblia
VERCPTMAPAPKIVAKVAANTKYR

SEQ ID NO: 3173798 - protein, 30 aa, Giardia lamblia
VERDEMIGRLSLQLEEEIKARKAVEDRMLF

SEQ ID NO: 3173799 - protein, 17 aa, Giardia lamblia
VEREIMIMKMARHPHII

SEQ ID NO: 3173800 - protein, 18 aa, Giardia lamblia
VERLMGWMGSLGMLTPRL

SEQ ID NO: 3173801 - protein, 19 aa, Giardia lamblia
VERLRLFSNKLMQVIDKYP

SEQ ID NO: 3173802 - protein, 21 aa, Giardia lamblia
VERPLRLSVVGATASLSDFLQ

SEQ ID NO: 3173803 - protein, 21 aa, Giardia lamblia
VERPMFYRDLEAIEEILKHGY

SEQ ID NO: 3173804 - protein, 27 aa, Giardia lamblia
VERQLRMGFLPEINYVWTAIDNELILV

SEQ ID NO: 3173805 - protein, 21 aa, Giardia lamblia
VESCPRTPRLSKKEQAKTPKK

SEQ ID NO: 3173806 - protein, 22 aa, Giardia lamblia
VESEGGVPLVQFLKRLQDPPTR

SEQ ID NO: 3173807 - protein, 17 aa, Giardia lamblia
VESFRRLNTKEFDYAPY

SEQ ID NO: 3173808 - protein, 17 aa, Giardia lamblia
VESGLAIKAIMQAVIGT

SEQ ID NO: 3173809 - protein, 18 aa, Giardia lamblia
VESGMVVFCKWDGADPYF

SEQ ID NO: 3173810 - protein, 31 aa, Giardia lamblia
VESLKHLQICWHFYLKPAIMKTTFTDLTDPE

SEQ ID NO: 3173811 - protein, 17 aa, Giardia lamblia
VESLLSFFDQVSYNHDM

SEQ ID NO: 3173812 - protein, 18 aa, Giardia lamblia
VESNSIIEFLDSVRERAA

SEQ ID NO: 3173813 - protein, 22 aa, Giardia lamblia
VESNWHSIDWFKTQSERLLEVI

SEQ ID NO: 3173814 - protein, 19 aa, Giardia lamblia
VETALRYMAIIPTMLNPEI

SEQ ID NO: 3173815 - protein, 26 aa, Giardia lamblia
VETLEKLCALFCIKPSSLTDAESMKA

SEQ ID NO: 3173816 - protein, 17 aa, Giardia lamblia
VETLIGCVQSVMEFSQI

SEQ ID NO: 3173817 - protein, 17 aa, Giardia lamblia
VETRTGSIYEGKLVSVE

SEQ ID NO: 3173818 - protein, 20 aa, Giardia lamblia
VETVRALVEFEHGLRDSHGH

SEQ ID NO: 3173819 - protein, 19 aa, Giardia lamblia
VEVERCLNEDDTLTEEELD

SEQ ID NO: 3173820 - protein, 17 aa, Giardia lamblia
VEVKKPPQLEGHTIELQ

SEQ ID NO: 3173821 - protein, 17 aa, Giardia lamblia
VEVLAPLEYSIFLPNGR

SEQ ID NO: 3173822 - protein, 24 aa, Giardia lamblia
VEVLTVPILLRLDNVDVMNRDEHM

SEQ ID NO: 3173823 - protein, 24 aa, Giardia lamblia
VEVRHIVLAGGCFWGLQALMDSFK

SEQ ID NO: 3173824 - protein, 20 aa, Giardia lamblia
VEVVDLYYLLLRRGESYAKH

SEQ ID NO: 3173825 - protein, 17 aa, Giardia lamblia
VEWPMPLAITEFSFSED

SEQ ID NO: 3173826 - protein, 22 aa, Giardia lamblia
VEYCKKRYDSIVSQLKLYLENV

SEQ ID NO: 3173827 - protein, 23 aa, Giardia lamblia
VEYIRAVQEFAFMGGSLGCAEGE

SEQ ID NO: 3173828 - protein, 18 aa, Giardia lamblia
VFAFDLTKKVTFRKLSIN

SEQ ID NO: 3173829 - protein, 26 aa, Giardia lamblia
VFAHGYRGTYCDLRLMSNCLMQYAIV

SEQ ID NO: 3173830 - protein, 18 aa, Giardia lamblia
VFAIRKVDEVLVMLRILD

SEQ ID NO: 3173831 - protein, 19 aa, Giardia lamblia
VFCVPATRPCRCCVRAQLQ

SEQ ID NO: 3173832 - protein, 20 aa, Giardia lamblia
VFDAYCSKNSLQRGDVRFYF

SEQ ID NO: 3173833 - protein, 26 aa, Giardia lamblia
VFDITLARMLFQWLIDGNKILDAIIK

SEQ ID NO: 3173834 - protein, 22 aa, Giardia lamblia
VFDLGGCLLFPYIGDSRSGLSI

SEQ ID NO: 3173835 - protein, 28 aa, Giardia lamblia
VFDRISFDRCLSRLLCLSSQSLWIHLLQ

SEQ ID NO: 3173836 - protein, 18 aa, Giardia lamblia
VFEQWPTLEAILLTLPSA

SEQ ID NO: 3173837 - protein, 18 aa, Giardia lamblia
VFERCGYISNISRFNEFI

SEQ ID NO: 3173838 - protein, 18 aa, Giardia lamblia
VFFDACVAHILRISRIIR

SEQ ID NO: 3173839 - protein, 24 aa, Giardia lamblia
VFFEQRKKWLVTRKIPERINFNPK

SEQ ID NO: 3173840 - protein, 20 aa, Giardia lamblia
VFFHPDIHPYILSASDDNTA

SEQ ID NO: 3173841 - protein, 18 aa, Giardia lamblia
VFHAGLLAFVRKYNTAMT

SEQ ID NO: 3173842 - protein, 19 aa, Giardia lamblia
VFHSMKKVLCEWEKDKGRK

SEQ ID NO: 3173843 - protein, 18 aa, Giardia lamblia
VFIHQDLKPDSILVSADE

SEQ ID NO: 3173844 - protein, 25 aa, Giardia lamblia
VFIHTRVCPQWPFVTLDKSYVATFF

SEQ ID NO: 3173845 - protein, 27 aa, Giardia lamblia
VFKGRQELIDGLSLFILTGLKKQERLS

SEQ ID NO: 3173846 - protein, 19 aa, Giardia lamblia
VFKQLKYPIIIPDKHIDEP

SEQ ID NO: 3173847 - protein, 23 aa, Giardia lamblia
VFLKCLESLGAHPSEGIIFEDSL

SEQ ID NO: 3173848 - protein, 19 aa, Giardia lamblia
VFLKSCKDLEMTFKDIGLT

SEQ ID NO: 3173849 - protein, 28 aa, Giardia lamblia
VFLPEPLIWRFAYNITLAILCLHSKGCS

SEQ ID NO: 3173850 - protein, 22 aa, Giardia lamblia
VFLPNTHNLLINGLEMVCQHRS

SEQ ID NO: 3173851 - protein, 19 aa, Giardia lamblia
VFMDSVLTYGWAFGSKAVI

SEQ ID NO: 3173852 - protein, 17 aa, Giardia lamblia
VFPKISLVDPCYQLYLP

SEQ ID NO: 3173853 - protein, 23 aa, Giardia lamblia
VFQGCGTPCILTLPEDFDIIPEN

SEQ ID NO: 3173854 - protein, 24 aa, Giardia lamblia
VFQKSMCAPELFDSFIPDVRSDLY

SEQ ID NO: 3173855 - protein, 18 aa, Giardia lamblia
VFQSITFCSAFPEMMDLR

SEQ ID NO: 3173856 - protein, 20 aa, Giardia lamblia
VFQTIFVRKLDHVVADTTEN

SEQ ID NO: 3173857 - protein, 18 aa, Giardia lamblia
VFQVFDLVLHQVALSIVV

SEQ ID NO: 3173858 - protein, 22 aa, Giardia lamblia
VFRDIKLANIYLREVDYTNNSS

SEQ ID NO: 3173859 - protein, 29 aa, Giardia lamblia
VFRGECLESLLRRNALSFFKTVDISKPDA

SEQ ID NO: 3173860 - protein, 19 aa, Giardia lamblia
VFRLLRAEACIPHEKIMAV

SEQ ID NO: 3173861 - protein, 20 aa, Giardia lamblia
VFRRMKLVPLEFNLERALIR

SEQ ID NO: 3173862 - protein, 17 aa, Giardia lamblia
VFSVPFLAITGIACDAI

SEQ ID NO: 3173863 - protein, 24 aa, Giardia lamblia
VFTTWCPPCRGMIPHLAELPTKYP

SEQ ID NO: 3173864 - protein, 18 aa, Giardia lamblia
VFTVRRFLLVCLHISIQM

SEQ ID NO: 3173865 - protein, 31 aa, Giardia lamblia
VFVIEHIEPFPLSVCLPGMAYRLGIFYSTPE

SEQ ID NO: 3173866 - protein, 25 aa, Giardia lamblia
VFVNPRFWFSRLLDIERICTKQSSI

SEQ ID NO: 3173867 - protein, 18 aa, Giardia lamblia
VFVPEWRVPPAQYHLDLE

SEQ ID NO: 3173868 - protein, 19 aa, Giardia lamblia
VFVQLPIGLMAVFDECGKM

SEQ ID NO: 3173869 - protein, 18 aa, Giardia lamblia
VFVSFCIEGLEEGPKRDL

SEQ ID NO: 3173870 - protein, 21 aa, Giardia lamblia
VFVVSTGLKYVIFRRNTLFTP

SEQ ID NO: 3173871 - protein, 20 aa, Giardia lamblia
VFVYLEHLYLAAGDDEGYVH

SEQ ID NO: 3173872 - protein, 17 aa, Giardia lamblia
VFYCISPSITVNMISYF

SEQ ID NO: 3173873 - protein, 18 aa, Giardia lamblia
VFYFRAVVQSMDPSFPAD

SEQ ID NO: 3173874 - protein, 18 aa, Giardia lamblia
VFYGLSFENATAMMIAAY

SEQ ID NO: 3173875 - protein, 33 aa, Giardia lamblia
VGALRLLNGCCVRDLEGIFAWIDEHSFEKAQEQ

SEQ ID NO: 3173876 - protein, 25 aa, Giardia lamblia
VGATDAVRFLMNFEAGMKGRDGITA

SEQ ID NO: 3173877 - protein, 19 aa, Giardia lamblia
VGCASAWALTTMDNVVPEI

SEQ ID NO: 3173878 - protein, 25 aa, Giardia lamblia
VGCNLRLQEMLQIMAAERNGRLGAM

SEQ ID NO: 3173879 - protein, 17 aa, Giardia lamblia
VGCVGGTVFRLFDCAPQ

SEQ ID NO: 3173880 - protein, 21 aa, Giardia lamblia
VGCVIYEFLTGHILFPTVDMS

SEQ ID NO: 3173881 - protein, 18 aa, Giardia lamblia
VGDGRKVADFGVQANTGT

SEQ ID NO: 3173882 - protein, 24 aa, Giardia lamblia
VGDIGNVWCLRSQAGLTDKDGTTA

SEQ ID NO: 3173883 - protein, 20 aa, Giardia lamblia
VGDLALLYGAPRAATVITTV

SEQ ID NO: 3173884 - protein, 19 aa, Giardia lamblia
VGDLGLCASLGLQSTAVSC

SEQ ID NO: 3173885 - protein, 22 aa, Giardia lamblia
VGDPSYFPDLVVSKGRVGRAIC

SEQ ID NO: 3173886 - protein, 21 aa, Giardia lamblia
VGEDGRPYWDGMYYGKSKNDM

SEQ ID NO: 3173887 - protein, 18 aa, Giardia lamblia
VGEFKSLLHLSFIPTGLW

SEQ ID NO: 3173888 - protein, 27 aa, Giardia lamblia
VGEMGDKTILCFSGRFHSYEGYTPPTL

SEQ ID NO: 3173889 - protein, 33 aa, Giardia lamblia
VGFGIYRRLARCVDIRLLGVAAHTFRECQDSNS

SEQ ID NO: 3173890 - protein, 25 aa, Giardia lamblia
VGFMKGLKVLLEYEARKRCKNIYKY

SEQ ID NO: 3173891 - protein, 23 aa, Giardia lamblia
VGFPVHICDDAICFCHNRHGTGF

SEQ ID NO: 3173892 - protein, 17 aa, Giardia lamblia
VGFRSLVRIYRLGIPVY

SEQ ID NO: 3173893 - protein, 20 aa, Giardia lamblia
VGFSALSWATIRGHHEAAAV

SEQ ID NO: 3173894 - protein, 21 aa, Giardia lamblia
VGFVRACDILAQFEMEALHAR

SEQ ID NO: 3173895 - protein, 26 aa, Giardia lamblia
VGGARGRYSVRYVRVLKDSELASLVS

SEQ ID NO: 3173896 - protein, 18 aa, Giardia lamblia
VGGDGLYPICSSIDKNKI

SEQ ID NO: 3173897 - protein, 22 aa, Giardia lamblia
VGGTVLRSGYYVINRSPDNRQQ

SEQ ID NO: 3173898 - protein, 17 aa, Giardia lamblia
VGHGIILTDIEKLDTFV

SEQ ID NO: 3173899 - protein, 25 aa, Giardia lamblia
VGHGRSAPYLTVGFGIYRRLARCVD

SEQ ID NO: 3173900 - protein, 19 aa, Giardia lamblia
VGIAEPFIKAIIRAPPQFN

SEQ ID NO: 3173901 - protein, 24 aa, Giardia lamblia
VGICSFSYKIPYSVGSSRPSDAAV

SEQ ID NO: 3173902 - protein, 19 aa, Giardia lamblia
VGIFKPVLQDIIPRDLGLL

SEQ ID NO: 3173903 - protein, 22 aa, Giardia lamblia
VGIPPKHVHQLHHCQHARSMLQ

SEQ ID NO: 3173904 - protein, 19 aa, Giardia lamblia
VGIYKCKEDALDLIMDLSG

SEQ ID NO: 3173905 - protein, 26 aa, Giardia lamblia
VGKNPRPLCIGGFRGSSCQCKIAKSL

SEQ ID NO: 3173906 - protein, 18 aa, Giardia lamblia
VGKSLTFSTLTKVQVPSE

SEQ ID NO: 3173907 - protein, 21 aa, Giardia lamblia
VGKVPASWGIIYKSTKSLAPW

SEQ ID NO: 3173908 - protein, 18 aa, Giardia lamblia
VGLPEISPTAAHALEEAI

SEQ ID NO: 3173909 - protein, 17 aa, Giardia lamblia
VGLQYALRCGQLDIAHM

SEQ ID NO: 3173910 - protein, 17 aa, Giardia lamblia
VGLRCLAEDSASSEANA

SEQ ID NO: 3173911 - protein, 20 aa, Giardia lamblia
VGLRYGPLLLVDHFERRTLK

SEQ ID NO: 3173912 - protein, 21 aa, Giardia lamblia
VGLSVKKFGKLVYKSLPLRSA

SEQ ID NO: 3173913 - protein, 19 aa, Giardia lamblia
VGLTLEKKCPENVAQAYHE

SEQ ID NO: 3173914 - protein, 30 aa, Giardia lamblia
VGMPGAPAPMLPPCLPFPPTADSRPTGHFR

SEQ ID NO: 3173915 - protein, 17 aa, Giardia lamblia
VGMPNKGSFVLFEQGLR

SEQ ID NO: 3173916 - protein, 17 aa, Giardia lamblia
VGMRCRLSGDRRGEVAF

SEQ ID NO: 3173917 - protein, 19 aa, Giardia lamblia
VGMSETWGWAAGEISYLSG

SEQ ID NO: 3173918 - protein, 25 aa, Giardia lamblia
VGMSRIGLIALEWFQVAADRDETSN

SEQ ID NO: 3173919 - protein, 25 aa, Giardia lamblia
VGNADLWIAYCNFHLGRHEEALEIY

SEQ ID NO: 3173920 - protein, 32 aa, Giardia lamblia
VGNPALDLSLSFSLIDAHRFPGGQADSLTQTK

SEQ ID NO: 3173921 - protein, 26 aa, Giardia lamblia
VGNTIPGIRYNFFIANFTKTSSQYSD

SEQ ID NO: 3173922 - protein, 31 aa, Giardia lamblia
VGPQHISTFCLPRVHGWMSLDSVVIDAASSR

SEQ ID NO: 3173923 - protein, 26 aa, Giardia lamblia
VGQERARRAAGIIYQLICDGKLAGRA

SEQ ID NO: 3173924 - protein, 25 aa, Giardia lamblia
VGRAAIRKLQWLTMAKILVITAASP

SEQ ID NO: 3173925 - protein, 17 aa, Giardia lamblia
VGRARLIDHTSIPVLSH

SEQ ID NO: 3173926 - protein, 22 aa, Giardia lamblia
VGRCNACSFHVSYIPVLSNGKE

SEQ ID NO: 3173927 - protein, 21 aa, Giardia lamblia
VGSKPCIEYILRKYPKEKTIT

SEQ ID NO: 3173928 - protein, 17 aa, Giardia lamblia
VGSKVISILCDSIRCDT

SEQ ID NO: 3173929 - protein, 24 aa, Giardia lamblia
VGSLKSYWLGGLSLPTAFLTALQQ

SEQ ID NO: 3173930 - protein, 23 aa, Giardia lamblia
VGSRIKKVPMLKLYETACSSTSN

SEQ ID NO: 3173931 - protein, 18 aa, Giardia lamblia
VGSVIADSMPVMPEMDLA

SEQ ID NO: 3173932 - protein, 19 aa, Giardia lamblia
VGTCFKLRDATFHADAIHR

SEQ ID NO: 3173933 - protein, 25 aa, Giardia lamblia
VGTIPFRRLCIHYGCEITLCEMVFA

SEQ ID NO: 3173934 - protein, 25 aa, Giardia lamblia
VGTIPLRGPESFSVAPPSAQQDNNG

SEQ ID NO: 3173935 - protein, 24 aa, Giardia lamblia
VGTLKRKIALICSNKYSSFGDCMA

SEQ ID NO: 3173936 - protein, 21 aa, Giardia lamblia
VGTMCCFIYVYSPGFTQVLVT

SEQ ID NO: 3173937 - protein, 19 aa, Giardia lamblia
VGTSLYYLVLGCRSNCHFN

SEQ ID NO: 3173938 - protein, 21 aa, Giardia lamblia
VGVICFCPMRTCELAEQGKKV

SEQ ID NO: 3173939 - protein, 17 aa, Giardia lamblia
VGVSLTVARCWEIACHA

SEQ ID NO: 3173940 - protein, 18 aa, Giardia lamblia
VGVVPHCNIKPSNILIGS

SEQ ID NO: 3173941 - protein, 25 aa, Giardia lamblia
VGWYHSHPGYFAWLSHIDQNTHKSF

SEQ ID NO: 3173942 - protein, 17 aa, Giardia lamblia
VGYTGRYGEYFDEPQSA

SEQ ID NO: 3173943 - protein, 17 aa, Giardia lamblia
VHAEKYWVFNLCSEVKR

SEQ ID NO: 3173944 - protein, 25 aa, Giardia lamblia
VHAGARYAGWTALARAAENGFAEAV

SEQ ID NO: 3173945 - protein, 18 aa, Giardia lamblia
VHAKEILKLREEHSEGIK

SEQ ID NO: 3173946 - protein, 18 aa, Giardia lamblia
VHALQSFYRLKSYKDSPV

SEQ ID NO: 3173947 - protein, 20 aa, Giardia lamblia
VHAVKCVSFGASISPKREFA

SEQ ID NO: 3173948 - protein, 25 aa, Giardia lamblia
VHDFSGKQTDRWTFKQLKCTYVRSI

SEQ ID NO: 3173949 - protein, 17 aa, Giardia lamblia
VHDPVLLAYSFSMQTIG

SEQ ID NO: 3173950 - protein, 18 aa, Giardia lamblia
VHELQDWVNAMGIKYYIT

SEQ ID NO: 3173951 - protein, 22 aa, Giardia lamblia
VHEVLRQLYPFICEANSIAEYF

SEQ ID NO: 3173952 - protein, 19 aa, Giardia lamblia
VHFSRYIISTCVITLPSPS

SEQ ID NO: 3173953 - protein, 17 aa, Giardia lamblia
VHGDCKDLVYMHKVDPA

SEQ ID NO: 3173954 - protein, 19 aa, Giardia lamblia
VHGKLMYAGSKGYLYREEI

SEQ ID NO: 3173955 - protein, 25 aa, Giardia lamblia
VHHIFRRWDAYEGIQADNFWLYQTS

SEQ ID NO: 3173956 - protein, 17 aa, Giardia lamblia
VHIFDALGKATYKPRAF

SEQ ID NO: 3173957 - protein, 23 aa, Giardia lamblia
VHKKRMAEALGYIEEAHIPKQAS

SEQ ID NO: 3173958 - protein, 25 aa, Giardia lamblia
VHKLLFAVLVAIRIKHHAGDLNTNE

SEQ ID NO: 3173959 - protein, 18 aa, Giardia lamblia
VHLGCDVYEPGLCDLNGW

SEQ ID NO: 3173960 - protein, 19 aa, Giardia lamblia
VHLMLKLAHDNILKPIEFF

SEQ ID NO: 3173961 - protein, 17 aa, Giardia lamblia
VHLMSWFPIAGITRKCP

SEQ ID NO: 3173962 - protein, 26 aa, Giardia lamblia
VHLNSPLRKKYRGMYVDEDTFCDFPG

SEQ ID NO: 3173963 - protein, 22 aa, Giardia lamblia
VHLTFPYTLHFVKVSSYKGTRQ

SEQ ID NO: 3173964 - protein, 18 aa, Giardia lamblia
VHLTFWKPVIETILEEVV

SEQ ID NO: 3173965 - protein, 18 aa, Giardia lamblia
VHPTLNCMLLTFICPHVM

SEQ ID NO: 3173966 - protein, 25 aa, Giardia lamblia
VHQLSIIPCINWVQILVYNLPYKYE

SEQ ID NO: 3173967 - protein, 17 aa, Giardia lamblia
VHRDLRPANIFINADGE

SEQ ID NO: 3173968 - protein, 28 aa, Giardia lamblia
VHRESGRICAHMRIPLSTLTDSSRSLVD

SEQ ID NO: 3173969 - protein, 17 aa, Giardia lamblia
VHSELSLEYDISFNSPH

SEQ ID NO: 3173970 - protein, 26 aa, Giardia lamblia
VHSGGAWIVSELIVFLRCSLQSMNVI

SEQ ID NO: 3173971 - protein, 27 aa, Giardia lamblia
VHSGSKLRPSLHYSISVSSTSDTYTDR

SEQ ID NO: 3173972 - protein, 22 aa, Giardia lamblia
VHSKWPDCIFQFEDFSNDTAFT

SEQ ID NO: 3173973 - protein, 24 aa, Giardia lamblia
VHSLGPLLDAYGFVSAVSLQPFMK

SEQ ID NO: 3173974 - protein, 18 aa, Giardia lamblia
VHSLIYYNGSLFTIVEQS

SEQ ID NO: 3173975 - protein, 21 aa, Giardia lamblia
VHTDLLLKRIREFTLVEPIAT

SEQ ID NO: 3173976 - protein, 25 aa, Giardia lamblia
VHVDLGRPFLGFALALSSGAVAFVA

SEQ ID NO: 3173977 - protein, 25 aa, Giardia lamblia
VHVILGRNGWIWISEMRNPSDTRET

SEQ ID NO: 3173978 - protein, 25 aa, Giardia lamblia
VHVKRLIPATSLWDAILDRYVTGRE

SEQ ID NO: 3173979 - protein, 23 aa, Giardia lamblia
VHVYDLASGFSYAVVTNHLAAVT

SEQ ID NO: 3173980 - protein, 26 aa, Giardia lamblia
VHYPNRRALRKGCYVNLQLLADLSYF

SEQ ID NO: 3173981 - protein, 24 aa, Giardia lamblia
VIACSLGGQLAGWIIKPKDLVTGL

SEQ ID NO: 3173982 - protein, 22 aa, Giardia lamblia
VIADFKNAILIDSVKNRVDLSS

SEQ ID NO: 3173983 - protein, 18 aa, Giardia lamblia
VIAGLKGLFTALVAGARH

SEQ ID NO: 3173984 - protein, 27 aa, Giardia lamblia
VIALSMKYQVCILSFLAPMNLICSQDA

SEQ ID NO: 3173985 - protein, 29 aa, Giardia lamblia
VIAMAEPLLKCGIHPILITQGYQKALDFL

SEQ ID NO: 3173986 - protein, 25 aa, Giardia lamblia
VIANCANCTIFLIAPCSHVVIANCR

SEQ ID NO: 3173987 - protein, 24 aa, Giardia lamblia
VIANKPVDVWSLAAIQARLHDEYG

SEQ ID NO: 3173988 - protein, 24 aa, Giardia lamblia
VIAQECKKTDFVRSYVKIKPIHQE

SEQ ID NO: 3173989 - protein, 24 aa, Giardia lamblia
VIARELFLSIPMRIKPSYPDTQRL

SEQ ID NO: 3173990 - protein, 23 aa, Giardia lamblia
VIASRWYMRKGIALMMAAASGHA

SEQ ID NO: 3173991 - protein, 24 aa, Giardia lamblia
VICTNGGGIPCKRENKVISGVDAV

SEQ ID NO: 3173992 - protein, 18 aa, Giardia lamblia
VIDDLKFEIETLRAKPVV

SEQ ID NO: 3173993 - protein, 19 aa, Giardia lamblia
VIDELKNTVIHRENEINNM

SEQ ID NO: 3173994 - protein, 19 aa, Giardia lamblia
VIDGCIFRGHGMAFPAISS

SEQ ID NO: 3173995 - protein, 25 aa, Giardia lamblia
VIDGHCFLHAAAILDPKALVLKNNI

SEQ ID NO: 3173996 - protein, 25 aa, Giardia lamblia
VIDNRGYCALHWAVQMGNAALFNIL

SEQ ID NO: 3173997 - protein, 25 aa, Giardia lamblia
VIDSVCYEPIVVLCYDISGRVYEVI

SEQ ID NO: 3173998 - protein, 25 aa, Giardia lamblia
VIEACRRISVGEGLAYLAVGMESMS

SEQ ID NO: 3173999 - protein, 22 aa, Giardia lamblia
VIEAYILLVVCIYGEKEDSVRG

SEQ ID NO: 3174000 - protein, 24 aa, Giardia lamblia
VIEIHEIMPNFPFLPDLDSSEVSL

SEQ ID NO: 3174001 - protein, 25 aa, Giardia lamblia
VIEREKFIYRLEVSLMTTEDKLGAL

SEQ ID NO: 3174002 - protein, 21 aa, Giardia lamblia
VIFCILKGYISNVAKLSNDHR

SEQ ID NO: 3174003 - protein, 17 aa, Giardia lamblia
VIGDRSGNILVYGTHEV

SEQ ID NO: 3174004 - protein, 25 aa, Giardia lamblia
VIGKRTQIPLGLAYALSIHKCQGMT

SEQ ID NO: 3174005 - protein, 18 aa, Giardia lamblia
VIGPSLLNTIAYRDKNDE

SEQ ID NO: 3174006 - protein, 17 aa, Giardia lamblia
VIHRRVPVIRLLIDQEA

SEQ ID NO: 3174007 - protein, 17 aa, Giardia lamblia
VIIDFVFVQSNLYILTS

SEQ ID NO: 3174008 - protein, 24 aa, Giardia lamblia
VIIHMLRYLVVRSVALHYKEFRKI

SEQ ID NO: 3174009 - protein, 18 aa, Giardia lamblia
VIIPLGCPMARAVPHSNT

SEQ ID NO: 3174010 - protein, 23 aa, Giardia lamblia
VIKILKPVRRKKIYREIKILTNL

SEQ ID NO: 3174011 - protein, 18 aa, Giardia lamblia
VIKLCDFGFAREIDFDNS

SEQ ID NO: 3174012 - protein, 21 aa, Giardia lamblia
VIKSFLYQLINGVNFCHSRRC

SEQ ID NO: 3174013 - protein, 19 aa, Giardia lamblia
VIKSSYFEPPVSYPKMQSA

SEQ ID NO: 3174014 - protein, 26 aa, Giardia lamblia
VILIQAWCLYEAHILGSHSQMLNSYA

SEQ ID NO: 3174015 - protein, 31 aa, Giardia lamblia
VILMKKRLCKHPISCLEVFVYLEHLYLAAGD

SEQ ID NO: 3174016 - protein, 19 aa, Giardia lamblia
VILNKDLCELLNVLDIDHS

SEQ ID NO: 3174017 - protein, 26 aa, Giardia lamblia
VILQCSRGALKYSDMIYLKKLCEAAL

SEQ ID NO: 3174018 - protein, 17 aa, Giardia lamblia
VILTTDLEFERAIPGNQ

SEQ ID NO: 3174019 - protein, 17 aa, Giardia lamblia
VILVYRIYANLKLVEVL

SEQ ID NO: 3174020 - protein, 31 aa, Giardia lamblia
VINDVFFKFYNICAMTLPGIPEHSFNPGDPM

SEQ ID NO: 3174021 - protein, 20 aa, Giardia lamblia
VINIAEGFVGYRHTFNVKIK

SEQ ID NO: 3174022 - protein, 25 aa, Giardia lamblia
VINRSEPAFSLSGRYDVTKTNETPG

SEQ ID NO: 3174023 - protein, 19 aa, Giardia lamblia
VIPFECVTSASSILSQILY

SEQ ID NO: 3174024 - protein, 18 aa, Giardia lamblia
VIPSRSNTVVPRKADDEA

SEQ ID NO: 3174025 - protein, 17 aa, Giardia lamblia
VIQPCIGASLGVSLSKS

SEQ ID NO: 3174026 - protein, 19 aa, Giardia lamblia
VIQRICASLLPFNHPTLEC

SEQ ID NO: 3174027 - protein, 26 aa, Giardia lamblia
VIRGFFRCFPVYSHIFSVKFRLSIYE

SEQ ID NO: 3174028 - protein, 25 aa, Giardia lamblia
VISALKATLLYAVELSFSVISACGR

SEQ ID NO: 3174029 - protein, 18 aa, Giardia lamblia
VISILCDSIRCDTEDAIH

SEQ ID NO: 3174030 - protein, 24 aa, Giardia lamblia
VISMDRIRMALIEAAKAGHLDFLR

SEQ ID NO: 3174031 - protein, 20 aa, Giardia lamblia
VITEPLDIYKDLLFQPPKSL

SEQ ID NO: 3174032 - protein, 20 aa, Giardia lamblia
VITFLRGWKVFADGDDAHQH

SEQ ID NO: 3174033 - protein, 19 aa, Giardia lamblia
VITVWSYVEVQHGLRDEDG

SEQ ID NO: 3174034 - protein, 31 aa, Giardia lamblia
VIVRKGRPSMDYLRDHCEPLVYQALQDLVTN

SEQ ID NO: 3174035 - protein, 24 aa, Giardia lamblia
VIYELCALQPPFVASNIESLKTKV

SEQ ID NO: 3174036 - protein, 24 aa, Giardia lamblia
VIYELCALQPPFVASNMDSLKAKV

SEQ ID NO: 3174037 - protein, 19 aa, Giardia lamblia
VIYERGCKTIPSLKHPLHI

SEQ ID NO: 3174038 - protein, 26 aa, Giardia lamblia
VIYHLLKSRWTFMLNRKRERLSKGLK

SEQ ID NO: 3174039 - protein, 19 aa, Giardia lamblia
VKAEKLLLEEKIRTLHDEL

SEQ ID NO: 3174040 - protein, 18 aa, Giardia lamblia
VKAIIYYRSMQILVQEHL

SEQ ID NO: 3174041 - protein, 23 aa, Giardia lamblia
VKAIKRDLCCSAYVFDETDGTKS

SEQ ID NO: 3174042 - protein, 20 aa, Giardia lamblia
VKAIKYAYMALTFKPNAYTE

SEQ ID NO: 3174043 - protein, 27 aa, Giardia lamblia
VKAILALDFRRLRSLLPSFDLPHFTEN

SEQ ID NO: 3174044 - protein, 24 aa, Giardia lamblia
VKAKAESQLTHIIHMLSTKLDVEE

SEQ ID NO: 3174045 - protein, 20 aa, Giardia lamblia
VKALDSWRTLITNGITKEKI

SEQ ID NO: 3174046 - protein, 19 aa, Giardia lamblia
VKALFVFISPPSVELLEQR

SEQ ID NO: 3174047 - protein, 18 aa, Giardia lamblia
VKALRYLHDPAKHGGRVI

SEQ ID NO: 3174048 - protein, 17 aa, Giardia lamblia
VKALSIYYDARRDEHGL

SEQ ID NO: 3174049 - protein, 17 aa, Giardia lamblia
VKASRYLVRDVPDAITV

SEQ ID NO: 3174050 - protein, 23 aa, Giardia lamblia
VKAVCSSILRARAGLSRPTQPLG

SEQ ID NO: 3174051 - protein, 22 aa, Giardia lamblia
VKAVKRYIPYQARMVAKLVKAG

SEQ ID NO: 3174052 - protein, 23 aa, Giardia lamblia
VKAVKRYIPYQARMVAKLVKAGR

SEQ ID NO: 3174053 - protein, 24 aa, Giardia lamblia
VKAVKRYIPYQARMVARFVTAGRV

SEQ ID NO: 3174054 - protein, 19 aa, Giardia lamblia
VKCQVYLKNMDDFAKVNEV

SEQ ID NO: 3174055 - protein, 20 aa, Giardia lamblia
VKCSFFEIYMERIRDLLAEE

SEQ ID NO: 3174056 - protein, 21 aa, Giardia lamblia
VKCTELLLRELGIHGAGGATS

SEQ ID NO: 3174057 - protein, 20 aa, Giardia lamblia
VKCVRLLAEHEACILDSGGW

SEQ ID NO: 3174058 - protein, 21 aa, Giardia lamblia
VKDGDSYIGYIDRFTFVHWAA

SEQ ID NO: 3174059 - protein, 18 aa, Giardia lamblia
VKDILRFVNPPDRFHSPS

SEQ ID NO: 3174060 - protein, 23 aa, Giardia lamblia
VKDRCAMMAIRFVEGRAPQRGTR

SEQ ID NO: 3174061 - protein, 26 aa, Giardia lamblia
VKDRDSWTSFMVMFAQTLLRMAAGVV

SEQ ID NO: 3174062 - protein, 25 aa, Giardia lamblia
VKDSACFVSWALARVYSSSVQLRDV

SEQ ID NO: 3174063 - protein, 29 aa, Giardia lamblia
VKDSQRLDARLELLAAVKEEMKAKALTLE

SEQ ID NO: 3174064 - protein, 22 aa, Giardia lamblia
VKDYPSGIVCDASFNSYWENTT

SEQ ID NO: 3174065 - protein, 23 aa, Giardia lamblia
VKEDCSWHSDMVTFAEPRSDMSF

SEQ ID NO: 3174066 - protein, 19 aa, Giardia lamblia
VKEKYRLDHTIAEVVGVVG

SEQ ID NO: 3174067 - protein, 22 aa, Giardia lamblia
VKELCCRVYFDGIFNGVDSSSI

SEQ ID NO: 3174068 - protein, 22 aa, Giardia lamblia
VKELKESIVYMDRYVDKLRVKF

SEQ ID NO: 3174069 - protein, 23 aa, Giardia lamblia
VKELKVAMRALGFEPKREELKRM

SEQ ID NO: 3174070 - protein, 17 aa, Giardia lamblia
VKELLSFELPFVHQPDG

SEQ ID NO: 3174071 - protein, 19 aa, Giardia lamblia
VKEPFSIKPIVTVHGRNRM

SEQ ID NO: 3174072 - protein, 18 aa, Giardia lamblia
VKEPMPLMSQTAETLAMV

SEQ ID NO: 3174073 - protein, 18 aa, Giardia lamblia
VKERLLNTLMGFIYGQNQ

SEQ ID NO: 3174074 - protein, 19 aa, Giardia lamblia
VKEVDRLLVEIKRKQAEET

SEQ ID NO: 3174075 - protein, 17 aa, Giardia lamblia
VKFDESIVIVTGLEGNN

SEQ ID NO: 3174076 - protein, 20 aa, Giardia lamblia
VKGDDSIDLLGLRTSGQKRY

SEQ ID NO: 3174077 - protein, 22 aa, Giardia lamblia
VKGLSESLCASTMEDVVDTISS

SEQ ID NO: 3174078 - protein, 21 aa, Giardia lamblia
VKGNILHRLSSERKISPLRNV

SEQ ID NO: 3174079 - protein, 24 aa, Giardia lamblia
VKHKRERGALGWTNLICAACIGDA

SEQ ID NO: 3174080 - protein, 23 aa, Giardia lamblia
VKHKRLDSTTARKFFQQIISALS

SEQ ID NO: 3174081 - protein, 22 aa, Giardia lamblia
VKHLRAQLLEMHRQKNSNELLL

SEQ ID NO: 3174082 - protein, 21 aa, Giardia lamblia
VKHNTSICAMICYPNQSDVLQ

SEQ ID NO: 3174083 - protein, 25 aa, Giardia lamblia
VKHYDVMTAEFFSRIEANAEAESST

SEQ ID NO: 3174084 - protein, 20 aa, Giardia lamblia
VKIFRADIIYHLYDMFVEHL

SEQ ID NO: 3174085 - protein, 30 aa, Giardia lamblia
VKIGSKFEVRRFAKSVGAALNMTFRVPEQE

SEQ ID NO: 3174086 - protein, 22 aa, Giardia lamblia
VKIIDCKDAEIQELRLLIDTLQ

SEQ ID NO: 3174087 - protein, 18 aa, Giardia lamblia
VKILAPIEMDLTLKGGAT

SEQ ID NO: 3174088 - protein, 20 aa, Giardia lamblia
VKIRIPYAAKLMIQELISMG

SEQ ID NO: 3174089 - protein, 26 aa, Giardia lamblia
VKIVHPEIPYLIAIRDHSNISPEEKK

SEQ ID NO: 3174090 - protein, 24 aa, Giardia lamblia
VKKAERKEMYLAVAPSDQEARLHE

SEQ ID NO: 3174091 - protein, 22 aa, Giardia lamblia
VKKDFLRISVPLTIDDGLASPG

SEQ ID NO: 3174092 - protein, 22 aa, Giardia lamblia
VKKDVFKAVIFEPGAAERNADD

SEQ ID NO: 3174093 - protein, 18 aa, Giardia lamblia
VKKIVKMCEGIVSLEDDL

SEQ ID NO: 3174094 - protein, 26 aa, Giardia lamblia
VKKSGVPDWVPWVSFTESLQPLTTDE

SEQ ID NO: 3174095 - protein, 25 aa, Giardia lamblia
VKKSIKFRQCGKFKMFKIKDSDSWF

SEQ ID NO: 3174096 - protein, 18 aa, Giardia lamblia
VKKTEVLMEHFRRAIGLR

SEQ ID NO: 3174097 - protein, 21 aa, Giardia lamblia
VKKYLWLSFEQLPYKSFDELL

SEQ ID NO: 3174098 - protein, 21 aa, Giardia lamblia
VKLADFGTCKHIDPKLVNMDH

SEQ ID NO: 3174099 - protein, 27 aa, Giardia lamblia
VKLISDHLFRYMGYVSAYVIIAGVDYK

SEQ ID NO: 3174100 - protein, 43 aa, Giardia lamblia
VKLKCGHFYCYNCALDSLKMSWPCLGCGVRLSLCDLDLDTSFS

SEQ ID NO: 3174101 - protein, 17 aa, Giardia lamblia
VKLLIKCSERKVFLPEP

SEQ ID NO: 3174102 - protein, 17 aa, Giardia lamblia
VKLLLAEATSQDEQGRT

SEQ ID NO: 3174103 - protein, 20 aa, Giardia lamblia
VKLLLCELGIVGSNELTALD

SEQ ID NO: 3174104 - protein, 20 aa, Giardia lamblia
VKLLLCELGYVNTMGYTALL

SEQ ID NO: 3174105 - protein, 17 aa, Giardia lamblia
VKLLLEKEGGMRDRNGK

SEQ ID NO: 3174106 - protein, 20 aa, Giardia lamblia
VKLLMRCEGGMRDSEEWTAL

SEQ ID NO: 3174107 - protein, 17 aa, Giardia lamblia
VKLLMRCEGGMRSSNEW

SEQ ID NO: 3174108 - protein, 17 aa, Giardia lamblia
VKLLMRCEGGMRSSNGW

SEQ ID NO: 3174109 - protein, 21 aa, Giardia lamblia
VKLLTDFEYPFTLPDTRTALM

SEQ ID NO: 3174110 - protein, 23 aa, Giardia lamblia
VKLQFLEDEILRLLATSSGSLLD

SEQ ID NO: 3174111 - protein, 20 aa, Giardia lamblia
VKLRCLKEAVEAATRAADPE

SEQ ID NO: 3174112 - protein, 19 aa, Giardia lamblia
VKLSKLSVEDELRKSKEQI

SEQ ID NO: 3174113 - protein, 23 aa, Giardia lamblia
VKLWNIRKFICITTISLPKTMKT

SEQ ID NO: 3174114 - protein, 17 aa, Giardia lamblia
VKMILRTDALLVHCDTD

SEQ ID NO: 3174115 - protein, 21 aa, Giardia lamblia
VKMPLEFLDGFSSTRTTTMPG

SEQ ID NO: 3174116 - protein, 32 aa, Giardia lamblia
VKMRSIEVVRILKLKSLRIAMRCGYTALMECC

SEQ ID NO: 3174117 - protein, 24 aa, Giardia lamblia
VKNAEKLPPFLSMEEKTRVANPPV

SEQ ID NO: 3174118 - protein, 19 aa, Giardia lamblia
VKNLITVWLQRLRGEKADR

SEQ ID NO: 3174119 - protein, 26 aa, Giardia lamblia
VKNNNMDLVRRFWPVEAGVQNNRGES

SEQ ID NO: 3174120 - protein, 24 aa, Giardia lamblia
VKNPWGLSGAYKLLSTPADIETKS

SEQ ID NO: 3174121 - protein, 19 aa, Giardia lamblia
VKNQMSFLEIIVRQVSSIN

SEQ ID NO: 3174122 - protein, 20 aa, Giardia lamblia
VKPDLLAGCKLIVTGTLVAK

SEQ ID NO: 3174123 - protein, 24 aa, Giardia lamblia
VKPIDRIHEVIGFNPSGYMYEKGR

SEQ ID NO: 3174124 - protein, 18 aa, Giardia lamblia
VKPKLTVFATKLKEMGAF

SEQ ID NO: 3174125 - protein, 22 aa, Giardia lamblia
VKPKYPCFCGSLYCRGYIDAPK

SEQ ID NO: 3174126 - protein, 18 aa, Giardia lamblia
VKPLEFYNLEFTKDTVSL

SEQ ID NO: 3174127 - protein, 20 aa, Giardia lamblia
VKPPHTTFCDAPVARNFLGA

SEQ ID NO: 3174128 - protein, 19 aa, Giardia lamblia
VKPQDWLNICQDIEANYAA

SEQ ID NO: 3174129 - protein, 19 aa, Giardia lamblia
VKPRECSGVVELQTSTNLN

SEQ ID NO: 3174130 - protein, 20 aa, Giardia lamblia
VKPYGDVVELDFQRNNIDLL

SEQ ID NO: 3174131 - protein, 20 aa, Giardia lamblia
VKPYLRGGGDVTSLVGETGM

SEQ ID NO: 3174132 - protein, 21 aa, Giardia lamblia
VKQAPISWAYVAKRSSLPEGI

SEQ ID NO: 3174133 - protein, 22 aa, Giardia lamblia
VKQEGIEFCLLNCYAARTEVLT

SEQ ID NO: 3174134 - protein, 23 aa, Giardia lamblia
VKQGQARIALVGFPSVGKSTFLT

SEQ ID NO: 3174135 - protein, 21 aa, Giardia lamblia
VKQPGIMPGAIAVGVPGAPPV

SEQ ID NO: 3174136 - protein, 24 aa, Giardia lamblia
VKQRLKLCKAEFDACFRQLQYDKA

SEQ ID NO: 3174137 - protein, 17 aa, Giardia lamblia
VKQRPRIQLSEELNENI

SEQ ID NO: 3174138 - protein, 24 aa, Giardia lamblia
VKREKEAREELAILRAERDRLHKT

SEQ ID NO: 3174139 - protein, 25 aa, Giardia lamblia
VKRGPSKKKTVCFNMDVDTASNAQH

SEQ ID NO: 3174140 - protein, 17 aa, Giardia lamblia
VKRIFRCLNSYYEIQFD

SEQ ID NO: 3174141 - protein, 20 aa, Giardia lamblia
VKRIKMILKTAYKFTPALPK

SEQ ID NO: 3174142 - protein, 20 aa, Giardia lamblia
VKRLPPPRFRGYVNPTSSSV

SEQ ID NO: 3174143 - protein, 22 aa, Giardia lamblia
VKRRNTCPLAEQFNRLLTWYRC

SEQ ID NO: 3174144 - protein, 25 aa, Giardia lamblia
VKSDQLEWVADAALKAHLSGTDVRD

SEQ ID NO: 3174145 - protein, 20 aa, Giardia lamblia
VKSECLVEQIAQLKAQLKAL

SEQ ID NO: 3174146 - protein, 18 aa, Giardia lamblia
VKSFELQGSYAFGKATIY

SEQ ID NO: 3174147 - protein, 25 aa, Giardia lamblia
VKSLCESISPSASRKNLKSPAAGDA

SEQ ID NO: 3174148 - protein, 20 aa, Giardia lamblia
VKSLVFTFVKLVTSFVPAVQ

SEQ ID NO: 3174149 - protein, 23 aa, Giardia lamblia
VKSPGEIMSLLIKSTENRRVAET

SEQ ID NO: 3174150 - protein, 21 aa, Giardia lamblia
VKSQGRLTVNFGHQTSSDSSS

SEQ ID NO: 3174151 - protein, 17 aa, Giardia lamblia
VKTASRLHDISVKLDKI

SEQ ID NO: 3174152 - protein, 25 aa, Giardia lamblia
VKTEKRFTQFWSFFADSYNDYLKLA

SEQ ID NO: 3174153 - protein, 26 aa, Giardia lamblia
VKTELLDMILCLALYIPYDGTYYEVE

SEQ ID NO: 3174154 - protein, 20 aa, Giardia lamblia
VKTRTEIVMYAFDILFLNSR

SEQ ID NO: 3174155 - protein, 17 aa, Giardia lamblia
VKTSGLSHVAIRCLDGV

SEQ ID NO: 3174156 - protein, 20 aa, Giardia lamblia
VKTWKRRGAIDYDTTIESKD

SEQ ID NO: 3174157 - protein, 24 aa, Giardia lamblia
VKVFYSYYGYREIAVYDNGLGISG

SEQ ID NO: 3174158 - protein, 20 aa, Giardia lamblia
VKVSVDFARAIKEVAPIATF

SEQ ID NO: 3174159 - protein, 17 aa, Giardia lamblia
VKVTWLVPHRFQLDVPD

SEQ ID NO: 3174160 - protein, 20 aa, Giardia lamblia
VKVWDLIRNALLHTHAQLAP

SEQ ID NO: 3174161 - protein, 17 aa, Giardia lamblia
VKVWDPSFTDFLDVSGM

SEQ ID NO: 3174162 - protein, 17 aa, Giardia lamblia
VKYKVCLNEDTADPSEA

SEQ ID NO: 3174163 - protein, 17 aa, Giardia lamblia
VKYSFDLYCHRYGLLYE

SEQ ID NO: 3174164 - protein, 32 aa, Giardia lamblia
VLAACKLATEFLRMHGTFITKIFRSADHDALL

SEQ ID NO: 3174165 - protein, 17 aa, Giardia lamblia
VLAAQLINKACRPKNGN

SEQ ID NO: 3174166 - protein, 18 aa, Giardia lamblia
VLACKKLKQRVVIATSER

SEQ ID NO: 3174167 - protein, 20 aa, Giardia lamblia
VLACVLPGFSPEEYGDEGRK

SEQ ID NO: 3174168 - protein, 25 aa, Giardia lamblia
VLAIPLKITPFLSLNVFTDTIQTEL

SEQ ID NO: 3174169 - protein, 17 aa, Giardia lamblia
VLANRIPAPAAIQPSYF

SEQ ID NO: 3174170 - protein, 22 aa, Giardia lamblia
VLATKGRLGMVRAYEADFNEQI

SEQ ID NO: 3174171 - protein, 18 aa, Giardia lamblia
VLCCFSKLSRIYAHVPWS

SEQ ID NO: 3174172 - protein, 19 aa, Giardia lamblia
VLCCVCFQEPATLDPALRG

SEQ ID NO: 3174173 - protein, 20 aa, Giardia lamblia
VLCDCPGLVFAVKGSPRPLQ

SEQ ID NO: 3174174 - protein, 22 aa, Giardia lamblia
VLCLRWQRLERPLSRPVDKTLD

SEQ ID NO: 3174175 - protein, 20 aa, Giardia lamblia
VLCLVRKILCACLVEDPASR

SEQ ID NO: 3174176 - protein, 26 aa, Giardia lamblia
VLCMACNGWVMGAAYDFTMREHRAYL

SEQ ID NO: 3174177 - protein, 17 aa, Giardia lamblia
VLCTNSLSSSSRRDSLS

SEQ ID NO: 3174178 - protein, 20 aa, Giardia lamblia
VLDALVYCHSPFKFNPATSK

SEQ ID NO: 3174179 - protein, 25 aa, Giardia lamblia
VLDEWCKMQQTWLYLESIFAPDDIR

SEQ ID NO: 3174180 - protein, 24 aa, Giardia lamblia
VLDKCAVESKSLRQSMVPLGPDAA

SEQ ID NO: 3174181 - protein, 32 aa, Giardia lamblia
VLDMKARMQAGAYMWHYERFGVTPTVIRDALI

SEQ ID NO: 3174182 - protein, 25 aa, Giardia lamblia
VLDQCLKCKYVYSVYGHLAADFRKT

SEQ ID NO: 3174183 - protein, 24 aa, Giardia lamblia
VLDRVVMRFFAWFMEDVFESQSEK

SEQ ID NO: 3174184 - protein, 22 aa, Giardia lamblia
VLEACTGWVKTLVQFEGDNPIV

SEQ ID NO: 3174185 - protein, 17 aa, Giardia lamblia
VLEALGIIIKQQGPHYE

SEQ ID NO: 3174186 - protein, 19 aa, Giardia lamblia
VLEIWYNKNSCIQLHKLLV

SEQ ID NO: 3174187 - protein, 23 aa, Giardia lamblia
VLELRKEDGFGYTIDCILVNGEL

SEQ ID NO: 3174188 - protein, 19 aa, Giardia lamblia
VLEQSSCGYAYIDFSIATF

SEQ ID NO: 3174189 - protein, 27 aa, Giardia lamblia
VLERLKRAKLVAEEVVNNVCFVYPLAP

SEQ ID NO: 3174190 - protein, 24 aa, Giardia lamblia
VLESLIYYWVVSYYNWLSNLNHDT

SEQ ID NO: 3174191 - protein, 25 aa, Giardia lamblia
VLETGNDIIFFWVARMVMLSLELYN

SEQ ID NO: 3174192 - protein, 22 aa, Giardia lamblia
VLEVICYQDAVIKWRENKSTSL

SEQ ID NO: 3174193 - protein, 18 aa, Giardia lamblia
VLEYKNGQVYKGRFYQDL

SEQ ID NO: 3174194 - protein, 17 aa, Giardia lamblia
VLFGEVKCITMSNEDNL

SEQ ID NO: 3174195 - protein, 22 aa, Giardia lamblia
VLFGMLCAHILQGHDMSMKALN

SEQ ID NO: 3174196 - protein, 27 aa, Giardia lamblia
VLFIHNGVCLVAGYSDGSVRFFSVYYD

SEQ ID NO: 3174197 - protein, 17 aa, Giardia lamblia
VLFPNLLLPDLWAPDVT

SEQ ID NO: 3174198 - protein, 26 aa, Giardia lamblia
VLFRLCPEKASTEFFTRALRVYLRFS

SEQ ID NO: 3174199 - protein, 24 aa, Giardia lamblia
VLGAGCAETAMANAIEKAAMKTQG

SEQ ID NO: 3174200 - protein, 17 aa, Giardia lamblia
VLGCDFHTIRSLNNPVK

SEQ ID NO: 3174201 - protein, 23 aa, Giardia lamblia
VLGKFRVSMEYRYSTVHTLNASE

SEQ ID NO: 3174202 - protein, 20 aa, Giardia lamblia
VLGNLTRKQMEKFLRNPKFI

SEQ ID NO: 3174203 - protein, 24 aa, Giardia lamblia
VLHAHGHKGYGFAEFLTKAAAQEA

SEQ ID NO: 3174204 - protein, 18 aa, Giardia lamblia
VLHRDIKPANLLVNHSGA

SEQ ID NO: 3174205 - protein, 19 aa, Giardia lamblia
VLHREVALIKRLRHPLLVH

SEQ ID NO: 3174206 - protein, 17 aa, Giardia lamblia
VLIGIIFPHCSEQHIRS

SEQ ID NO: 3174207 - protein, 27 aa, Giardia lamblia
VLIKLSLAKNRIRSIIAPSIYQYNLLH

SEQ ID NO: 3174208 - protein, 17 aa, Giardia lamblia
VLISNDMRFRFFPPEQT

SEQ ID NO: 3174209 - protein, 17 aa, Giardia lamblia
VLKDEFRQQCLAIHEKI

SEQ ID NO: 3174210 - protein, 26 aa, Giardia lamblia
VLKDSKFPALQIMRWEDVKASTADLS

SEQ ID NO: 3174211 - protein, 24 aa, Giardia lamblia
VLKEKGCRVYMPYDVLSEASPAER

SEQ ID NO: 3174212 - protein, 20 aa, Giardia lamblia
VLKESLQLAHKCILNSFYGY

SEQ ID NO: 3174213 - protein, 24 aa, Giardia lamblia
VLKGALNILRYGYRTKTPSDSMLV

SEQ ID NO: 3174214 - protein, 32 aa, Giardia lamblia
VLKKIDARNGISISDILPVLIHFSASIEHAIA

SEQ ID NO: 3174215 - protein, 18 aa, Giardia lamblia
VLKNSSNCSISFVIEIHE

SEQ ID NO: 3174216 - protein, 19 aa, Giardia lamblia
VLKRLTVCVNDVYQELEYY

SEQ ID NO: 3174217 - protein, 17 aa, Giardia lamblia
VLKSCTDLLYAQNPQLL

SEQ ID NO: 3174218 - protein, 27 aa, Giardia lamblia
VLKTDMLLRSATGWFTAIANGSVDIVR

SEQ ID NO: 3174219 - protein, 20 aa, Giardia lamblia
VLLCSRLAVDSGYYFSVRKR

SEQ ID NO: 3174220 - protein, 18 aa, Giardia lamblia
VLLEALWLSQFEADINRI

SEQ ID NO: 3174221 - protein, 22 aa, Giardia lamblia
VLLELCTLRVPPVYVSESSEFE

SEQ ID NO: 3174222 - protein, 23 aa, Giardia lamblia
VLLELEAPIKICGDIHGQFYDLL

SEQ ID NO: 3174223 - protein, 17 aa, Giardia lamblia
VLLETEAGLILRDGTSA

SEQ ID NO: 3174224 - protein, 21 aa, Giardia lamblia
VLLETEWCPDGSLAGLLRRQR

SEQ ID NO: 3174225 - protein, 24 aa, Giardia lamblia
VLLGEKRLSLGHLDTIDDISTLKV

SEQ ID NO: 3174226 - protein, 19 aa, Giardia lamblia
VLLPAAEGLLLFNGATSES

SEQ ID NO: 3174227 - protein, 24 aa, Giardia lamblia
VLLPCRHLIVCLACVDRIYANKSC

SEQ ID NO: 3174228 - protein, 25 aa, Giardia lamblia
VLLPKWKANEILRWIESEANKLTTK

SEQ ID NO: 3174229 - protein, 23 aa, Giardia lamblia
VLLPNKRTPLMLAADSGCTESVK

SEQ ID NO: 3174230 - protein, 18 aa, Giardia lamblia
VLLQDSLEKQGIREDENN

SEQ ID NO: 3174231 - protein, 24 aa, Giardia lamblia
VLLRGSSMFSRYYVPGETFYENIH

SEQ ID NO: 3174232 - protein, 17 aa, Giardia lamblia
VLLRPSIFNNDYLILNG

SEQ ID NO: 3174233 - protein, 19 aa, Giardia lamblia
VLLSKGYAQTVDWMLDSAS

SEQ ID NO: 3174234 - protein, 17 aa, Giardia lamblia
VLLSLKYTQSVIKSTYL

SEQ ID NO: 3174235 - protein, 17 aa, Giardia lamblia
VLLSRFIYQRGMRDSNG

SEQ ID NO: 3174236 - protein, 17 aa, Giardia lamblia
VLLSRLVAKLVETSTKP

SEQ ID NO: 3174237 - protein, 18 aa, Giardia lamblia
VLNACLSIDPAERPCLEN

SEQ ID NO: 3174238 - protein, 17 aa, Giardia lamblia
VLNAHTPPGRMFPHAPN

SEQ ID NO: 3174239 - protein, 23 aa, Giardia lamblia
VLNDELYCVVPIDSEFYTVEGVA

SEQ ID NO: 3174240 - protein, 19 aa, Giardia lamblia
VLNETFAFMACSARNSVSV

SEQ ID NO: 3174241 - protein, 21 aa, Giardia lamblia
VLNGLLAPFIQGYNCTAFAYG

SEQ ID NO: 3174242 - protein, 22 aa, Giardia lamblia
VLNKRFNCIQLLLRQETGLRDI

SEQ ID NO: 3174243 - protein, 24 aa, Giardia lamblia
VLPDLLCQIKLISAQSAYYSNVAN

SEQ ID NO: 3174244 - protein, 18 aa, Giardia lamblia
VLPKRLVRHASYLSCEQI

SEQ ID NO: 3174245 - protein, 24 aa, Giardia lamblia
VLPKYVPRSRITKIEARSPRRSDA

SEQ ID NO: 3174246 - protein, 25 aa, Giardia lamblia
VLPLFPRGDLARFIRHNRETPIPEP

SEQ ID NO: 3174247 - protein, 19 aa, Giardia lamblia
VLPPKLKGKSAWETGASDP

SEQ ID NO: 3174248 - protein, 34 aa, Giardia lamblia
VLPPPGVPVAIAIPCCHMIIDPKRSVKLASNPVC

SEQ ID NO: 3174249 - protein, 25 aa, Giardia lamblia
VLPSARPVYQYDLSIHISNQGYSLD

SEQ ID NO: 3174250 - protein, 18 aa, Giardia lamblia
VLPSDCLFGPATTVHPQM

SEQ ID NO: 3174251 - protein, 25 aa, Giardia lamblia
VLQALEHFSRALAMDLISTSPELTE

SEQ ID NO: 3174252 - protein, 25 aa, Giardia lamblia
VLQETGLHCSLGFGDSLFAAQIATK

SEQ ID NO: 3174253 - protein, 23 aa, Giardia lamblia
VLQKELSTHYGLSVTDSAVHTVR

SEQ ID NO: 3174254 - protein, 20 aa, Giardia lamblia
VLQREAFLRLVRHNEARTSD

SEQ ID NO: 3174255 - protein, 21 aa, Giardia lamblia
VLRCIQPCPGFAIVEMGAPQD

SEQ ID NO: 3174256 - protein, 20 aa, Giardia lamblia
VLRCYQVLCDGEFIYVVVDC

SEQ ID NO: 3174257 - protein, 23 aa, Giardia lamblia
VLRKKLPLIDFKMIRHASTLEPM

SEQ ID NO: 3174258 - protein, 22 aa, Giardia lamblia
VLRKSVEALESFTPPLRLSEDQ

SEQ ID NO: 3174259 - protein, 19 aa, Giardia lamblia
VLRKYEIIHRVGKGAYGVV

SEQ ID NO: 3174260 - protein, 24 aa, Giardia lamblia
VLRLKTRAPGIFNYSFENEVRISI

SEQ ID NO: 3174261 - protein, 21 aa, Giardia lamblia
VLRPAFKYNCAEWIGVIDIEF

SEQ ID NO: 3174262 - protein, 25 aa, Giardia lamblia
VLRPKSVGFCSCRIDPDFENFRNTV

SEQ ID NO: 3174263 - protein, 24 aa, Giardia lamblia
VLRQQEEMLARITVLEQRFDSFAE

SEQ ID NO: 3174264 - protein, 21 aa, Giardia lamblia
VLRRDKFRASAAMVKKVMNEK

SEQ ID NO: 3174265 - protein, 27 aa, Giardia lamblia
VLRSNVAKRIWVPRLYVHFWGEDPRIY

SEQ ID NO: 3174266 - protein, 24 aa, Giardia lamblia
VLRVIRYNPRVHVILMSATLDEVQ

SEQ ID NO: 3174267 - protein, 24 aa, Giardia lamblia
VLSLYSFKSIQHFTLSGAKSPPTL

SEQ ID NO: 3174268 - protein, 23 aa, Giardia lamblia
VLSRAPHVVQLILQYPNDISHDD

SEQ ID NO: 3174269 - protein, 18 aa, Giardia lamblia
VLSRRHVKRSASAMSSAM

SEQ ID NO: 3174270 - protein, 22 aa, Giardia lamblia
VLSSFIPGLSFSKCGHPMGAEL

SEQ ID NO: 3174271 - protein, 31 aa, Giardia lamblia
VLSSIIIKPLICYGPQCACCNGSSMQFMTNN

SEQ ID NO: 3174272 - protein, 17 aa, Giardia lamblia
VLSSKLFTDLDVLSTTY

SEQ ID NO: 3174273 - protein, 18 aa, Giardia lamblia
VLTFLREHHAHLIEANAR

SEQ ID NO: 3174274 - protein, 31 aa, Giardia lamblia
VLTKEIVELLASRPAMPASYDRLLTEHAKSG

SEQ ID NO: 3174275 - protein, 18 aa, Giardia lamblia
VLTPSVRYDSFLRPVLQL

SEQ ID NO: 3174276 - protein, 19 aa, Giardia lamblia
VLTQQWLAALPRLLREAID

SEQ ID NO: 3174277 - protein, 24 aa, Giardia lamblia
VLTTIWRPIELAMPAFANEENMQR

SEQ ID NO: 3174278 - protein, 17 aa, Giardia lamblia
VLVELREALLTALTAST

SEQ ID NO: 3174279 - protein, 21 aa, Giardia lamblia
VLVFYDVIIDFVFVQSNLYIL

SEQ ID NO: 3174280 - protein, 17 aa, Giardia lamblia
VLVHLRIQSELGKNRVK

SEQ ID NO: 3174281 - protein, 20 aa, Giardia lamblia
VLVLVRRIWAIDGRIFPSVF

SEQ ID NO: 3174282 - protein, 19 aa, Giardia lamblia
VLVPIPGIVGEVSILLMKR

SEQ ID NO: 3174283 - protein, 22 aa, Giardia lamblia
VLVQECMRYNKLLINIKKSLQD

SEQ ID NO: 3174284 - protein, 20 aa, Giardia lamblia
VLVRLWAKMRTPFMQLISLA

SEQ ID NO: 3174285 - protein, 25 aa, Giardia lamblia
VLVRRFFVVPAFEIYGGVAGLYDLG

SEQ ID NO: 3174286 - protein, 17 aa, Giardia lamblia
VLVSAHFLGMPNLVNDC

SEQ ID NO: 3174287 - protein, 21 aa, Giardia lamblia
VLYAYCKHLWVSSNENVLEKL

SEQ ID NO: 3174288 - protein, 24 aa, Giardia lamblia
VLYLIRAACLQAVIEENSDFESIT

SEQ ID NO: 3174289 - protein, 24 aa, Giardia lamblia
VLYLRRITSLRSFRDLQRSVQRIF

SEQ ID NO: 3174290 - protein, 18 aa, Giardia lamblia
VLYYMHFVQSLHRLVKSA

SEQ ID NO: 3174291 - protein, 18 aa, Giardia lamblia
VMAAKLLNIDSVLGALQR

SEQ ID NO: 3174292 - protein, 26 aa, Giardia lamblia
VMAGYAPRFPISWLSNISPEIKTALE

SEQ ID NO: 3174293 - protein, 19 aa, Giardia lamblia
VMDVCPVQEILDFCQTSPR

SEQ ID NO: 3174294 - protein, 23 aa, Giardia lamblia
VMEEIRKQIRLMERGEITERARA

SEQ ID NO: 3174295 - protein, 22 aa, Giardia lamblia
VMEGRIGFLLTVLNGILGTLDK

SEQ ID NO: 3174296 - protein, 17 aa, Giardia lamblia
VMELYRLEDYRSNAMSE

SEQ ID NO: 3174297 - protein, 17 aa, Giardia lamblia
VMETLRKSPNMSLNKPR

SEQ ID NO: 3174298 - protein, 19 aa, Giardia lamblia
VMFQHGRMLAEVILDARHN

SEQ ID NO: 3174299 - protein, 18 aa, Giardia lamblia
VMGLLCVSQGVSMTGGGV

SEQ ID NO: 3174300 - protein, 19 aa, Giardia lamblia
VMGTCKTICDIPVSQQTIT

SEQ ID NO: 3174301 - protein, 18 aa, Giardia lamblia
VMHALSFFVRKVSKPNIN

SEQ ID NO: 3174302 - protein, 35 aa, Giardia lamblia
VMIFSDIHAALKLKRRLREVFPDTVFTKNIENEML

SEQ ID NO: 3174303 - protein, 25 aa, Giardia lamblia
VMKRRCYLDNFCVPFAGYHIETFNV

SEQ ID NO: 3174304 - protein, 21 aa, Giardia lamblia
VMKRRECRGLTSAGRKARGLH

SEQ ID NO: 3174305 - protein, 21 aa, Giardia lamblia
VMLAYRNSQVFQVYYDISMTM

SEQ ID NO: 3174306 - protein, 25 aa, Giardia lamblia
VMLSLELYNVLPFREVYLHALVRDA

SEQ ID NO: 3174307 - protein, 19 aa, Giardia lamblia
VMLTRSSQVYDILYQILKA

SEQ ID NO: 3174308 - protein, 23 aa, Giardia lamblia
VMSCSKKIIEFVYAFCKERDLLG

SEQ ID NO: 3174309 - protein, 19 aa, Giardia lamblia
VMSLFFKAPLPRTADRSDI

SEQ ID NO: 3174310 - protein, 26 aa, Giardia lamblia
VMSSLPLGRRKLRESRMHISWPSGPI

SEQ ID NO: 3174311 - protein, 41 aa, Giardia lamblia
VMTDGVAVMRCIRKFWPITCRGIITGGFNWTITEEEEKRRN

SEQ ID NO: 3174312 - protein, 17 aa, Giardia lamblia
VMVHIYIGLAVLNETSD

SEQ ID NO: 3174313 - protein, 18 aa, Giardia lamblia
VMVHYSISYCISPALCNA

SEQ ID NO: 3174314 - protein, 17 aa, Giardia lamblia
VNAADIWVSTDYRASLI

SEQ ID NO: 3174315 - protein, 17 aa, Giardia lamblia
VNAIALHTAERVGVFTP

SEQ ID NO: 3174316 - protein, 19 aa, Giardia lamblia
VNAIEFSRAYAKSIEKSLL

SEQ ID NO: 3174317 - protein, 17 aa, Giardia lamblia
VNARCVALTEQLEKEKQ

SEQ ID NO: 3174318 - protein, 17 aa, Giardia lamblia
VNDCILFMLKGSNFTQI

SEQ ID NO: 3174319 - protein, 18 aa, Giardia lamblia
VNDFRTSTLRICDYTSDL

SEQ ID NO: 3174320 - protein, 28 aa, Giardia lamblia
VNDHVYYLVDSCQYLSSFCTAKSQRSQE

SEQ ID NO: 3174321 - protein, 20 aa, Giardia lamblia
VNDIKVFLSLGNSIGRRDEH

SEQ ID NO: 3174322 - protein, 24 aa, Giardia lamblia
VNDLLKSLCGDLVIDVSDIPRALS

SEQ ID NO: 3174323 - protein, 21 aa, Giardia lamblia
VNDLYRLIDISAIAKSALVSI

SEQ ID NO: 3174324 - protein, 31 aa, Giardia lamblia
VNDRIYSLACVISYNLGCHYESLGQDRNALN

SEQ ID NO: 3174325 - protein, 22 aa, Giardia lamblia
VNEFATPLALTFVANVANAEMA

SEQ ID NO: 3174326 - protein, 20 aa, Giardia lamblia
VNEIDVMRLLKMSTSQTSAH

SEQ ID NO: 3174327 - protein, 20 aa, Giardia lamblia
VNEIICKFRLVPAEEGAGVV

SEQ ID NO: 3174328 - protein, 19 aa, Giardia lamblia
VNERGRTALMLAASLGHRS

SEQ ID NO: 3174329 - protein, 20 aa, Giardia lamblia
VNFKAPQKCRYHIDEKDLQN

SEQ ID NO: 3174330 - protein, 23 aa, Giardia lamblia
VNFRRFGDGILYSDGRYEYYVGR

SEQ ID NO: 3174331 - protein, 18 aa, Giardia lamblia
VNFWFVKFKQLVDTGKEE

SEQ ID NO: 3174332 - protein, 17 aa, Giardia lamblia
VNGEGKTAIMIAAEANK

SEQ ID NO: 3174333 - protein, 18 aa, Giardia lamblia
VNGLYPLRSRTSLISLCL

SEQ ID NO: 3174334 - protein, 24 aa, Giardia lamblia
VNGSHVPHALKMHSSKVALQAVAG

SEQ ID NO: 3174335 - protein, 35 aa, Giardia lamblia
VNGTLWTPFPGVFVRPNCYSNYFATLTSSLKNIIN

SEQ ID NO: 3174336 - protein, 18 aa, Giardia lamblia
VNHIFAFMTYLHCGLPFE

SEQ ID NO: 3174337 - protein, 20 aa, Giardia lamblia
VNHLAAALKYVGLSYQKKVG

SEQ ID NO: 3174338 - protein, 23 aa, Giardia lamblia
VNHSACPTLWGYSRQQAISKTTA

SEQ ID NO: 3174339 - protein, 19 aa, Giardia lamblia
VNILRRLEAGISDERGCTA

SEQ ID NO: 3174340 - protein, 24 aa, Giardia lamblia
VNILYNLGVLLARQASSPDQKENV

SEQ ID NO: 3174341 - protein, 25 aa, Giardia lamblia
VNIPLERTIEAFDPLLPVPVKEAQI

SEQ ID NO: 3174342 - protein, 23 aa, Giardia lamblia
VNKVSCCLQAFQSLTSDIFIEDE

SEQ ID NO: 3174343 - protein, 22 aa, Giardia lamblia
VNKYLYYFGKRLNFMEKKPLNH

SEQ ID NO: 3174344 - protein, 20 aa, Giardia lamblia
VNLAIIRLLRLHEARIQDKR

SEQ ID NO: 3174345 - protein, 17 aa, Giardia lamblia
VNLEEMFRISKEEAARI

SEQ ID NO: 3174346 - protein, 23 aa, Giardia lamblia
VNLICELPCKYQSIIDQLSNAKG

SEQ ID NO: 3174347 - protein, 18 aa, Giardia lamblia
VNLISRLPIPQGTVSVPG

SEQ ID NO: 3174348 - protein, 18 aa, Giardia lamblia
VNLLGCHRATTGIRGLVI

SEQ ID NO: 3174349 - protein, 29 aa, Giardia lamblia
VNLLIWAFDAWKLRVSLYNGLNLFAATLP

SEQ ID NO: 3174350 - protein, 17 aa, Giardia lamblia
VNLSERIIEVIQGHVHS

SEQ ID NO: 3174351 - protein, 17 aa, Giardia lamblia
VNMESFRAKATIAADAP

SEQ ID NO: 3174352 - protein, 26 aa, Giardia lamblia
VNMHRVRMNAINEWERSENFKIIQDV

SEQ ID NO: 3174353 - protein, 25 aa, Giardia lamblia
VNMPKKWSISPAFLQFMETNFNGFL

SEQ ID NO: 3174354 - protein, 17 aa, Giardia lamblia
VNNSLLINNARFYLGPG

SEQ ID NO: 3174355 - protein, 23 aa, Giardia lamblia
VNPEEVGAILALELQKEEGEVNT

SEQ ID NO: 3174356 - protein, 27 aa, Giardia lamblia
VNPEQRWCIEDLLMLPTVRGYMESLNL

SEQ ID NO: 3174357 - protein, 24 aa, Giardia lamblia
VNPIEKVRLIYELYLKRKNSWYSD

SEQ ID NO: 3174358 - protein, 23 aa, Giardia lamblia
VNPKELLTLFGTLHPSLIKPQLN

SEQ ID NO: 3174359 - protein, 20 aa, Giardia lamblia
VNQITSPKVSWGPSPEDMDD

SEQ ID NO: 3174360 - protein, 18 aa, Giardia lamblia
VNQLDYPTSGLMVIASSR

SEQ ID NO: 3174361 - protein, 19 aa, Giardia lamblia
VNQVVKWVRLPDLEARQLK

SEQ ID NO: 3174362 - protein, 22 aa, Giardia lamblia
VNSCAVAALLLSAETGQLDKTG

SEQ ID NO: 3174363 - protein, 24 aa, Giardia lamblia
VNSHKETAFYLALYHNNLSTAKIL

SEQ ID NO: 3174364 - protein, 17 aa, Giardia lamblia
VNSHNILSMNDIPMAEQ

SEQ ID NO: 3174365 - protein, 21 aa, Giardia lamblia
VNSICALLVLLTEVELLLVTD

SEQ ID NO: 3174366 - protein, 32 aa, Giardia lamblia
VNSKVVALKLCLKFSLNCKEYFVNTYKSVLSM

SEQ ID NO: 3174367 - protein, 19 aa, Giardia lamblia
VNSLCLLPLSGDGHILLAA

SEQ ID NO: 3174368 - protein, 30 aa, Giardia lamblia
VNSLTIRCPIPMFVVFSWGTILNLALVPVG

SEQ ID NO: 3174369 - protein, 23 aa, Giardia lamblia
VNSLYIIICIFWENTIGYRPTAP

SEQ ID NO: 3174370 - protein, 22 aa, Giardia lamblia
VNTDLLVNVPLDFIRDTFNHAD

SEQ ID NO: 3174371 - protein, 17 aa, Giardia lamblia
VNTDLSWMLSPDYNAHA

SEQ ID NO: 3174372 - protein, 26 aa, Giardia lamblia
VNTLLKERPEVLKSDRSIPAISGFKS

SEQ ID NO: 3174373 - protein, 17 aa, Giardia lamblia
VNVALKMLELGDRCLVG

SEQ ID NO: 3174374 - protein, 18 aa, Giardia lamblia
VNVHPRLIIRVLSEALSM

SEQ ID NO: 3174375 - protein, 19 aa, Giardia lamblia
VNVPDRFKNPSNFSTQKVS

SEQ ID NO: 3174376 - protein, 20 aa, Giardia lamblia
VNVPKFLSNDVILFGNIVKD

SEQ ID NO: 3174377 - protein, 26 aa, Giardia lamblia
VNVYYEITSSFSLLFTGMINNNVVYG

SEQ ID NO: 3174378 - protein, 17 aa, Giardia lamblia
VPAAPLHWDWIFEECYD

SEQ ID NO: 3174379 - protein, 23 aa, Giardia lamblia
VPAAVKYLAEFEAGKTRSDGKRA

SEQ ID NO: 3174380 - protein, 26 aa, Giardia lamblia
VPAPPRLSLPAADDKYALSVFLGDNS

SEQ ID NO: 3174381 - protein, 23 aa, Giardia lamblia
VPCNHLIDLAYFVMKSHGEKSIS

SEQ ID NO: 3174382 - protein, 30 aa, Giardia lamblia
VPCRHMILCKACAPLASKKCPYCRKKVSDT

SEQ ID NO: 3174383 - protein, 19 aa, Giardia lamblia
VPCTCELPVGKFLTNKSAH

SEQ ID NO: 3174384 - protein, 18 aa, Giardia lamblia
VPCTIQLKTEDEFTVGVP

SEQ ID NO: 3174385 - protein, 23 aa, Giardia lamblia
VPDERAIHLLQEFFERKNPVTAA

SEQ ID NO: 3174386 - protein, 25 aa, Giardia lamblia
VPDESRGVSILQSWQQKVDLANSAT

SEQ ID NO: 3174387 - protein, 29 aa, Giardia lamblia
VPDIYCFLECFTRAPPHLAYYDLLLRCSE

SEQ ID NO: 3174388 - protein, 20 aa, Giardia lamblia
VPDSGLLCDLLWSDPEPGIT

SEQ ID NO: 3174389 - protein, 24 aa, Giardia lamblia
VPDVRAGAAMGCFTIGICKDPDDF

SEQ ID NO: 3174390 - protein, 21 aa, Giardia lamblia
VPEHAPHLIFEGMHSKLGARL

SEQ ID NO: 3174391 - protein, 18 aa, Giardia lamblia
VPEILKCLQQDDGCMVKE

SEQ ID NO: 3174392 - protein, 24 aa, Giardia lamblia
VPEKGGVVVPHLIGATIGTRIHQD

SEQ ID NO: 3174393 - protein, 22 aa, Giardia lamblia
VPELDKAIGEGLVYAYPSGEKP

SEQ ID NO: 3174394 - protein, 23 aa, Giardia lamblia
VPESYNLTSTVTPMFTEAHVRTV

SEQ ID NO: 3174395 - protein, 17 aa, Giardia lamblia
VPFDLDEEVVFLEQDGN

SEQ ID NO: 3174396 - protein, 22 aa, Giardia lamblia
VPFPGPSFTGANTFLTGTDYIQ

SEQ ID NO: 3174397 - protein, 21 aa, Giardia lamblia
VPFRDACMGPCSYGMTVADCL

SEQ ID NO: 3174398 - protein, 23 aa, Giardia lamblia
VPFTRTNYPVLFEKVSQQINHLL

SEQ ID NO: 3174399 - protein, 24 aa, Giardia lamblia
VPGKRFQPPAPIARQAMPTPTTTA

SEQ ID NO: 3174400 - protein, 28 aa, Giardia lamblia
VPGLSKLRFCLFISSPIFFVKPMDTCLV

SEQ ID NO: 3174401 - protein, 21 aa, Giardia lamblia
VPGPFALSVFIQPNITGKTPL

SEQ ID NO: 3174402 - protein, 23 aa, Giardia lamblia
VPHDSLLRMARYLNEKEEELFII

SEQ ID NO: 3174403 - protein, 19 aa, Giardia lamblia
VPHRLPLPPLLSAPTPSGP

SEQ ID NO: 3174404 - protein, 24 aa, Giardia lamblia
VPHRRRRLEGSTRDALRIVKTHMP

SEQ ID NO: 3174405 - protein, 19 aa, Giardia lamblia
VPIIRLVINGVFIDISSAR

SEQ ID NO: 3174406 - protein, 17 aa, Giardia lamblia
VPIKYSFFIGTTEVRGS

SEQ ID NO: 3174407 - protein, 19 aa, Giardia lamblia
VPIPDCPPEVIMNNFKTRL

SEQ ID NO: 3174408 - protein, 17 aa, Giardia lamblia
VPIQLFLQREFGEATCF

SEQ ID NO: 3174409 - protein, 19 aa, Giardia lamblia
VPITGLRSNKNFVRANIIN

SEQ ID NO: 3174410 - protein, 22 aa, Giardia lamblia
VPKEAVRLASRRRVALSEIEEL

SEQ ID NO: 3174411 - protein, 33 aa, Giardia lamblia
VPKGVFPINFGERAGCLLEILIRRVHNKGHNIP

SEQ ID NO: 3174412 - protein, 23 aa, Giardia lamblia
VPKSHVYPKFSLIARQHREIYFA

SEQ ID NO: 3174413 - protein, 26 aa, Giardia lamblia
VPKTLRMLVMLAQAAKLFKVRSNSSQ

SEQ ID NO: 3174414 - protein, 26 aa, Giardia lamblia
VPLASDDFLMEWLRSASRFAYVKCMD

SEQ ID NO: 3174415 - protein, 19 aa, Giardia lamblia
VPLAYTLYVARLSCIRNRT

SEQ ID NO: 3174416 - protein, 26 aa, Giardia lamblia
VPLKGNVWLYKVCKNEASKQKPIIYI

SEQ ID NO: 3174417 - protein, 24 aa, Giardia lamblia
VPLKPKREICLPVMSTNLIAKIKR

SEQ ID NO: 3174418 - protein, 18 aa, Giardia lamblia
VPLLKRIHRQDIAANSCT

SEQ ID NO: 3174419 - protein, 23 aa, Giardia lamblia
VPLMSACNIGCFMFDVDGMHVKV

SEQ ID NO: 3174420 - protein, 19 aa, Giardia lamblia
VPLPPPLENAWYFRFTSAG

SEQ ID NO: 3174421 - protein, 25 aa, Giardia lamblia
VPLPQVRPNPIIARYFVIIVTAFIS

SEQ ID NO: 3174422 - protein, 19 aa, Giardia lamblia
VPLSAGLKFYFHANGNTPV

SEQ ID NO: 3174423 - protein, 40 aa, Giardia lamblia
VPLSLKMQFRPVDLFCKHHYGSFCMPNLPAKDPSNVVATL

SEQ ID NO: 3174424 - protein, 17 aa, Giardia lamblia
VPMALRATFEGVHSDSV

SEQ ID NO: 3174425 - protein, 22 aa, Giardia lamblia
VPMKEALGLLVHGKTPAEQAKE

SEQ ID NO: 3174426 - protein, 25 aa, Giardia lamblia
VPNDNYCLFEDWIIPIFDECVEQQR

SEQ ID NO: 3174427 - protein, 21 aa, Giardia lamblia
VPNGDCPPKRTHGLQQTPDTC

SEQ ID NO: 3174428 - protein, 20 aa, Giardia lamblia
VPNISWKSALMRSGQLGNSM

SEQ ID NO: 3174429 - protein, 18 aa, Giardia lamblia
VPNPVIVAGINRIGTLDP

SEQ ID NO: 3174430 - protein, 20 aa, Giardia lamblia
VPPDDILAALDMVLLLIYAH

SEQ ID NO: 3174431 - protein, 18 aa, Giardia lamblia
VPPGKPYFIPLFGILPNK

SEQ ID NO: 3174432 - protein, 21 aa, Giardia lamblia
VPPPCLVASLQDLRGKLERLM

SEQ ID NO: 3174433 - protein, 23 aa, Giardia lamblia
VPPPDLFSEAGFFTEAVARDGTK

SEQ ID NO: 3174434 - protein, 26 aa, Giardia lamblia
VPQGNYPAAMVFFKLVSSKPKITSGG

SEQ ID NO: 3174435 - protein, 19 aa, Giardia lamblia
VPQMQLICEIMILSEGFAT

SEQ ID NO: 3174436 - protein, 22 aa, Giardia lamblia
VPRAVVKIFDLIALQSGDKTVP

SEQ ID NO: 3174437 - protein, 19 aa, Giardia lamblia
VPRKTCSMSGRSQEEKAIE

SEQ ID NO: 3174438 - protein, 22 aa, Giardia lamblia
VPRPSEKYTHFVLEKAGLDTMQ

SEQ ID NO: 3174439 - protein, 23 aa, Giardia lamblia
VPRTDFRSTYELNPAIEDVLNEA

SEQ ID NO: 3174440 - protein, 20 aa, Giardia lamblia
VPRTMTVHIRKEGVALRPGE

SEQ ID NO: 3174441 - protein, 20 aa, Giardia lamblia
VPSARLSHKMYLIKPHTVFL

SEQ ID NO: 3174442 - protein, 17 aa, Giardia lamblia
VPSENYPFCTIDPNHAR

SEQ ID NO: 3174443 - protein, 25 aa, Giardia lamblia
VPSFTSTGSILCWDPTGRWSTLKLD

SEQ ID NO: 3174444 - protein, 17 aa, Giardia lamblia
VPSGVVHMRAHKLETNS

SEQ ID NO: 3174445 - protein, 30 aa, Giardia lamblia
VPSKLRNSFRRYIDFSFWFIRDTSCEDKNG

SEQ ID NO: 3174446 - protein, 19 aa, Giardia lamblia
VPSPHLIPYMQLEKSYKVM

SEQ ID NO: 3174447 - protein, 19 aa, Giardia lamblia
VPSSYEYMDVIWLSCLQYM

SEQ ID NO: 3174448 - protein, 25 aa, Giardia lamblia
VPSVLYKLLAPRVVPSFPSHDSQHQ

SEQ ID NO: 3174449 - protein, 18 aa, Giardia lamblia
VPSYVEWRNALEQFSPVS

SEQ ID NO: 3174450 - protein, 18 aa, Giardia lamblia
VPTHRLIYTLSISYSSFI

SEQ ID NO: 3174451 - protein, 17 aa, Giardia lamblia
VPTSIAITGQTSTGEAI

SEQ ID NO: 3174452 - protein, 18 aa, Giardia lamblia
VPVACDFGKAIDASLFTL

SEQ ID NO: 3174453 - protein, 17 aa, Giardia lamblia
VPVFLKIRAGDLRGDWT

SEQ ID NO: 3174454 - protein, 32 aa, Giardia lamblia
VPVGDIRLLIVMPKDLEMCWIGHASLTDILGI

SEQ ID NO: 3174455 - protein, 18 aa, Giardia lamblia
VPVHTGPLRSFKYCNWSL

SEQ ID NO: 3174456 - protein, 19 aa, Giardia lamblia
VPVLICCPSNTAAESLTLA

SEQ ID NO: 3174457 - protein, 27 aa, Giardia lamblia
VPVPVHWRLRNGRFLSEHVPKYTVASK

SEQ ID NO: 3174458 - protein, 21 aa, Giardia lamblia
VPVSSRIPCQTMDELYGLLES

SEQ ID NO: 3174459 - protein, 18 aa, Giardia lamblia
VPVTIWLSKRDSYVGTKR

SEQ ID NO: 3174460 - protein, 29 aa, Giardia lamblia
VPVYCGKPFPLSHINRLPMEEHEGVNKDV

SEQ ID NO: 3174461 - protein, 17 aa, Giardia lamblia
VPYGVSNIFSPYFNSSR

SEQ ID NO: 3174462 - protein, 19 aa, Giardia lamblia
VPYVCSLALHALFFDFSNY

SEQ ID NO: 3174463 - protein, 27 aa, Giardia lamblia
VQAKAFLKNPYCIMIKHVVDSQEIPFK

SEQ ID NO: 3174464 - protein, 22 aa, Giardia lamblia
VQALRTGWFQVMAHMDFIKVVV

SEQ ID NO: 3174465 - protein, 21 aa, Giardia lamblia
VQARFQSMIERYKKEIIEKTR

SEQ ID NO: 3174466 - protein, 27 aa, Giardia lamblia
VQASSLCLLVWEWIRRYEETASNATVE

SEQ ID NO: 3174467 - protein, 18 aa, Giardia lamblia
VQATEPLLLPHSHPTVHT

SEQ ID NO: 3174468 - protein, 18 aa, Giardia lamblia
VQCARLLKEKEARMRRTM

SEQ ID NO: 3174469 - protein, 24 aa, Giardia lamblia
VQCLAGLSYIHNWKNLDGLHSFPH

SEQ ID NO: 3174470 - protein, 19 aa, Giardia lamblia
VQCNACLSYNTLLSRDGRM

SEQ ID NO: 3174471 - protein, 20 aa, Giardia lamblia
VQCRGYRPVTEEKLAALMEL

SEQ ID NO: 3174472 - protein, 19 aa, Giardia lamblia
VQCTMRLSPVGGMNMLIDC

SEQ ID NO: 3174473 - protein, 18 aa, Giardia lamblia
VQCTPGIDYEQLLIAKNA

SEQ ID NO: 3174474 - protein, 24 aa, Giardia lamblia
VQDEIVLGWTLFRYEDKGIRRIES

SEQ ID NO: 3174475 - protein, 23 aa, Giardia lamblia
VQDLRLRLEEAISTGQAVEARTA

SEQ ID NO: 3174476 - protein, 17 aa, Giardia lamblia
VQDLSVSLIRSDELTLS

SEQ ID NO: 3174477 - protein, 17 aa, Giardia lamblia
VQDMVSSECIKREKLYE

SEQ ID NO: 3174478 - protein, 26 aa, Giardia lamblia
VQEEKRALLEFDRPDLSAIPGTPIAL

SEQ ID NO: 3174479 - protein, 19 aa, Giardia lamblia
VQEKTPLMWAAHMGATATV

SEQ ID NO: 3174480 - protein, 18 aa, Giardia lamblia
VQELRPSYEKPIVTEVAE

SEQ ID NO: 3174481 - protein, 31 aa, Giardia lamblia
VQELWRTTRPELYRLVLKYGAVREQIRLLMK

SEQ ID NO: 3174482 - protein, 26 aa, Giardia lamblia
VQENIKGLRLNKEFNDLGVQEHASEL

SEQ ID NO: 3174483 - protein, 19 aa, Giardia lamblia
VQFEKRFNREPSRTEKEAL

SEQ ID NO: 3174484 - protein, 17 aa, Giardia lamblia
VQFISDFCELLEKYNNN

SEQ ID NO: 3174485 - protein, 17 aa, Giardia lamblia
VQFLKRLQDPPTRTTTP

SEQ ID NO: 3174486 - protein, 24 aa, Giardia lamblia
VQFRCLRGRWSVNNFDKSGLATIC

SEQ ID NO: 3174487 - protein, 18 aa, Giardia lamblia
VQFRVCLSGHTNWVYSAR

SEQ ID NO: 3174488 - protein, 26 aa, Giardia lamblia
VQGLPRFLNRFFPFSFTQSLFSSAAN

SEQ ID NO: 3174489 - protein, 31 aa, Giardia lamblia
VQGLRMTIMFRPGIFRFFLKTYKTVAIIIST

SEQ ID NO: 3174490 - protein, 21 aa, Giardia lamblia
VQGTFLWYFPTQELLDQYRHI

SEQ ID NO: 3174491 - protein, 19 aa, Giardia lamblia
VQGVSEFDDPIAISTDLLV

SEQ ID NO: 3174492 - protein, 19 aa, Giardia lamblia
VQIAALKRYIARLMGPLSI

SEQ ID NO: 3174493 - protein, 18 aa, Giardia lamblia
VQIEECTKTLAAQESLVS

SEQ ID NO: 3174494 - protein, 17 aa, Giardia lamblia
VQIHGMIDTVTTILRIC

SEQ ID NO: 3174495 - protein, 20 aa, Giardia lamblia
VQKCMDWKARLFAQDPAESK

SEQ ID NO: 3174496 - protein, 19 aa, Giardia lamblia
VQKELRALEISKKETEALL

SEQ ID NO: 3174497 - protein, 24 aa, Giardia lamblia
VQKSEFSAQIALLEAHAQSDAEQL

SEQ ID NO: 3174498 - protein, 22 aa, Giardia lamblia
VQLERRACFEALIKHESGLKSS

SEQ ID NO: 3174499 - protein, 30 aa, Giardia lamblia
VQLFEFFCRYCVLLFSLSFSTANPFPNSSL

SEQ ID NO: 3174500 - protein, 17 aa, Giardia lamblia
VQLGPFRLLPDFEDDFD

SEQ ID NO: 3174501 - protein, 35 aa, Giardia lamblia
VQLKAVLLRRNCSVGKCLGCKAVLTRAGPDVPCQV

SEQ ID NO: 3174502 - protein, 17 aa, Giardia lamblia
VQLLKSKEAGLCDKNGT

SEQ ID NO: 3174503 - protein, 17 aa, Giardia lamblia
VQLLMPFEGHIYTREGN

SEQ ID NO: 3174504 - protein, 22 aa, Giardia lamblia
VQLRKQFRLWLLADLHYQVLTL

SEQ ID NO: 3174505 - protein, 18 aa, Giardia lamblia
VQLSSALLRSSGIAQGFM

SEQ ID NO: 3174506 - protein, 19 aa, Giardia lamblia
VQMGRGVVVVPDYFTPQTR

SEQ ID NO: 3174507 - protein, 36 aa, Giardia lamblia
VQNFDMYPVRRLSRHKHLRMRSAGAVDDVFKELSDD

SEQ ID NO: 3174508 - protein, 26 aa, Giardia lamblia
VQNKLPPSKMKGGPVDRRSDKRHANE

SEQ ID NO: 3174509 - protein, 18 aa, Giardia lamblia
VQNSCLYVFGGADRYQQT

SEQ ID NO: 3174510 - protein, 26 aa, Giardia lamblia
VQPAILRLLLEIAFVVPCDDDYIHHF

SEQ ID NO: 3174511 - protein, 23 aa, Giardia lamblia
VQPSMALHTCVYGFKKVLLSLVS

SEQ ID NO: 3174512 - protein, 27 aa, Giardia lamblia
VQQKVCPRLTWLLPFVPYAHILFLLDG

SEQ ID NO: 3174513 - protein, 19 aa, Giardia lamblia
VQQNACRNLGFMLAGISNG

SEQ ID NO: 3174514 - protein, 17 aa, Giardia lamblia
VQRCLDFLRLSLLLDPN

SEQ ID NO: 3174515 - protein, 39 aa, Giardia lamblia
VQRMAIAFCLEKYGHCHGLCLTCFCFPLNSTIVQTGAIT

SEQ ID NO: 3174516 - protein, 17 aa, Giardia lamblia
VQRVLSLGAEFVLTEDP

SEQ ID NO: 3174517 - protein, 19 aa, Giardia lamblia
VQRVRELAQNLSINNQKIK

SEQ ID NO: 3174518 - protein, 20 aa, Giardia lamblia
VQSLCMVDGLPWFDTYGPPS

SEQ ID NO: 3174519 - protein, 17 aa, Giardia lamblia
VQSLLAFQQRFQDYYSE

SEQ ID NO: 3174520 - protein, 25 aa, Giardia lamblia
VQSRDGWTALMWAAKNGHAGCVRLL

SEQ ID NO: 3174521 - protein, 22 aa, Giardia lamblia
VQSRFASLISAVAEFPGCSLPP

SEQ ID NO: 3174522 - protein, 24 aa, Giardia lamblia
VQSSCPALCELVKAVIEKKDVEIR

SEQ ID NO: 3174523 - protein, 30 aa, Giardia lamblia
VQTDVCPEMGPAELISSVLQAPRFEEALRE

SEQ ID NO: 3174524 - protein, 25 aa, Giardia lamblia
VQTFIDRFRYNAARASLVQSRIKML

SEQ ID NO: 3174525 - protein, 27 aa, Giardia lamblia
VQTGFGFGKPMFKPAFNDPAAKEEADK

SEQ ID NO: 3174526 - protein, 19 aa, Giardia lamblia
VQTTYPYGFEYLGNTSRLV

SEQ ID NO: 3174527 - protein, 19 aa, Giardia lamblia
VQVLDEFYLSLFRENKPNT

SEQ ID NO: 3174528 - protein, 17 aa, Giardia lamblia
VQVRGECVLLKQQVQSG

SEQ ID NO: 3174529 - protein, 18 aa, Giardia lamblia
VQVRYAVKCNMHPLLLRS

SEQ ID NO: 3174530 - protein, 20 aa, Giardia lamblia
VQVTAPWPFTDRTLGEVQMH

SEQ ID NO: 3174531 - protein, 26 aa, Giardia lamblia
VRAAFKAADVSMCLNKLDTEAPFSAA

SEQ ID NO: 3174532 - protein, 17 aa, Giardia lamblia
VRADKKTALALAIQNDF

SEQ ID NO: 3174533 - protein, 20 aa, Giardia lamblia
VRAEEQRRLAVADLNKETGK

SEQ ID NO: 3174534 - protein, 19 aa, Giardia lamblia
VRAGITGCLVVGKIQSELK

SEQ ID NO: 3174535 - protein, 19 aa, Giardia lamblia
VRASIRALGTVAIRVPAAA

SEQ ID NO: 3174536 - protein, 18 aa, Giardia lamblia
VRATQSLLIRSLASTGLS

SEQ ID NO: 3174537 - protein, 27 aa, Giardia lamblia
VRCKIYLVDKKVCLRMDLVGPSKESIM

SEQ ID NO: 3174538 - protein, 18 aa, Giardia lamblia
VRDGLRSGAISRKHSVAS

SEQ ID NO: 3174539 - protein, 23 aa, Giardia lamblia
VRDIKEKLCFVALDYESVLAASM

SEQ ID NO: 3174540 - protein, 23 aa, Giardia lamblia
VRDKRIVWVSARVHPGEVPSSYI

SEQ ID NO: 3174541 - protein, 21 aa, Giardia lamblia
VRDLVEMRRPTSLSSPVRDAM

SEQ ID NO: 3174542 - protein, 25 aa, Giardia lamblia
VRDRYAVDCLNNYGMIVQGSISENE

SEQ ID NO: 3174543 - protein, 21 aa, Giardia lamblia
VREAIPIGDLFSAEPVNPQPE

SEQ ID NO: 3174544 - protein, 19 aa, Giardia lamblia
VRELFSRKFLSNVRETEKG

SEQ ID NO: 3174545 - protein, 19 aa, Giardia lamblia
VRENSCLSTGLPTTCHTFN

SEQ ID NO: 3174546 - protein, 20 aa, Giardia lamblia
VRETHGLSWPRLHVGCSISG

SEQ ID NO: 3174547 - protein, 22 aa, Giardia lamblia
VREYEVRQAPKMTAEQKRVKEE

SEQ ID NO: 3174548 - protein, 25 aa, Giardia lamblia
VRFHLPQRLPIAIAKNICLQMARGV

SEQ ID NO: 3174549 - protein, 26 aa, Giardia lamblia
VRFLAGKLKLGVIVDGEGNLSDEFCR

SEQ ID NO: 3174550 - protein, 19 aa, Giardia lamblia
VRFLDKWNPLSVFASLLTG

SEQ ID NO: 3174551 - protein, 17 aa, Giardia lamblia
VRGALDLLIQDRSYLSA

SEQ ID NO: 3174552 - protein, 19 aa, Giardia lamblia
VRGELHKKMLLLANSLNVD

SEQ ID NO: 3174553 - protein, 19 aa, Giardia lamblia
VRGGCSFYENNVMLLRCLR

SEQ ID NO: 3174554 - protein, 27 aa, Giardia lamblia
VRGKALKALVDWKGFPASDPRSEENWL

SEQ ID NO: 3174555 - protein, 17 aa, Giardia lamblia
VRGLRTYLGSVFAGSLL

SEQ ID NO: 3174556 - protein, 21 aa, Giardia lamblia
VRGNELLRLERESVLAHRKRE

SEQ ID NO: 3174557 - protein, 18 aa, Giardia lamblia
VRGSSLILDDGCHNASLG

SEQ ID NO: 3174558 - protein, 19 aa, Giardia lamblia
VRGTFTCCGERCSRNSLAG

SEQ ID NO: 3174559 - protein, 23 aa, Giardia lamblia
VRGVGWPALILAAQCGRSGIRSN

SEQ ID NO: 3174560 - protein, 21 aa, Giardia lamblia
VRHCSTCRTCISREDYDTHVC

SEQ ID NO: 3174561 - protein, 29 aa, Giardia lamblia
VRHEALCCIARVIPLYFQSFLALATSDLI

SEQ ID NO: 3174562 - protein, 26 aa, Giardia lamblia
VRHIPRIVQQDVFFSAMSSFGGILSC

SEQ ID NO: 3174563 - protein, 25 aa, Giardia lamblia
VRHKWPDSLSFVLSFDSHVMSSQEL

SEQ ID NO: 3174564 - protein, 19 aa, Giardia lamblia
VRHPPRIIPSTAPKATIEN

SEQ ID NO: 3174565 - protein, 18 aa, Giardia lamblia
VRICSLIGQGIPQFYLIE

SEQ ID NO: 3174566 - protein, 18 aa, Giardia lamblia
VRILRIHRDNAIGVIQPC

SEQ ID NO: 3174567 - protein, 19 aa, Giardia lamblia
VRINPRIESVLINNHSIRD

SEQ ID NO: 3174568 - protein, 17 aa, Giardia lamblia
VRIRPSAVPGRQEVAEL

SEQ ID NO: 3174569 - protein, 18 aa, Giardia lamblia
VRISLRRAYGLPPTGALS

SEQ ID NO: 3174570 - protein, 25 aa, Giardia lamblia
VRKAIIKLIKYFGIAEHMLKIADMN

SEQ ID NO: 3174571 - protein, 17 aa, Giardia lamblia
VRKFLVNKVLGFNTQKI

SEQ ID NO: 3174572 - protein, 25 aa, Giardia lamblia
VRKFSLQLLIAFAYARKLRIIHADV

SEQ ID NO: 3174573 - protein, 21 aa, Giardia lamblia
VRKKRAFSPSVWVAKKVDALN

SEQ ID NO: 3174574 - protein, 24 aa, Giardia lamblia
VRKRIKYWKTLKGLMTNQSIHISR

SEQ ID NO: 3174575 - protein, 17 aa, Giardia lamblia
VRKRPYLEDFLASVAKD

SEQ ID NO: 3174576 - protein, 17 aa, Giardia lamblia
VRLAQLANRRSYVESAL

SEQ ID NO: 3174577 - protein, 17 aa, Giardia lamblia
VRLDGILNCLPDTEKFS

SEQ ID NO: 3174578 - protein, 19 aa, Giardia lamblia
VRLETMPADFTDWRNHIQM

SEQ ID NO: 3174579 - protein, 17 aa, Giardia lamblia
VRLFIQEQVLEHLVSLK

SEQ ID NO: 3174580 - protein, 19 aa, Giardia lamblia
VRLIPAPRGAGIVASPTVA

SEQ ID NO: 3174581 - protein, 18 aa, Giardia lamblia
VRLKRRVNELVAYSKKIR

SEQ ID NO: 3174582 - protein, 25 aa, Giardia lamblia
VRLLKQPFVLSAALVKCIWSVHGGE

SEQ ID NO: 3174583 - protein, 19 aa, Giardia lamblia
VRLPVPCMNIINGGKHAGN

SEQ ID NO: 3174584 - protein, 20 aa, Giardia lamblia
VRLRGFVRHQLDFMAVRDLV

SEQ ID NO: 3174585 - protein, 20 aa, Giardia lamblia
VRLRNICAYYEKLYSLEGIR

SEQ ID NO: 3174586 - protein, 19 aa, Giardia lamblia
VRLSTCFTSSELLVKLPYT

SEQ ID NO: 3174587 - protein, 28 aa, Giardia lamblia
VRLTSFDCFIRFILLADYRMAHAFMDLY

SEQ ID NO: 3174588 - protein, 25 aa, Giardia lamblia
VRLVCDHIVCRTCACIHLASEIPCL

SEQ ID NO: 3174589 - protein, 19 aa, Giardia lamblia
VRLWQRLPLEVDISTTDLY

SEQ ID NO: 3174590 - protein, 21 aa, Giardia lamblia
VRLWTHECLRVYHDRLVETDR

SEQ ID NO: 3174591 - protein, 22 aa, Giardia lamblia
VRLYEVFFNLLVVPTPYLKQED

SEQ ID NO: 3174592 - protein, 38 aa, Giardia lamblia
VRLYKNELLRKFLLDKFLFKIVPMVNVDGVIVGNSRVD

SEQ ID NO: 3174593 - protein, 24 aa, Giardia lamblia
VRMKPVDRYKIFSTAMSFDEIEAN

SEQ ID NO: 3174594 - protein, 29 aa, Giardia lamblia
VRMRSDIWFNIGICFLHLSDMGAAKNCFT

SEQ ID NO: 3174595 - protein, 27 aa, Giardia lamblia
VRNAAGDTLLHWAVRVRAKSCIPKLLV

SEQ ID NO: 3174596 - protein, 26 aa, Giardia lamblia
VRNIFRRLFRVYAHIFMCHYGTLVEK

SEQ ID NO: 3174597 - protein, 18 aa, Giardia lamblia
VRNLKIADFLALGEFGDA

SEQ ID NO: 3174598 - protein, 18 aa, Giardia lamblia
VRNLRAFGAEVTKREDNL

SEQ ID NO: 3174599 - protein, 20 aa, Giardia lamblia
VRNMDAEMTLLLGPLECGAV

SEQ ID NO: 3174600 - protein, 18 aa, Giardia lamblia
VRNNWIYKQNVILLCAQN

SEQ ID NO: 3174601 - protein, 22 aa, Giardia lamblia
VRNPVCAEIGACRFFLGKHHFK

SEQ ID NO: 3174602 - protein, 28 aa, Giardia lamblia
VRNRDIEMVRLLGCFEHSLVNNDGYTAL

SEQ ID NO: 3174603 - protein, 27 aa, Giardia lamblia
VRPLIPGPLYIPLSIKIGYLERLILPI

SEQ ID NO: 3174604 - protein, 21 aa, Giardia lamblia
VRQKDTWGRTALIHAALCNSP

SEQ ID NO: 3174605 - protein, 21 aa, Giardia lamblia
VRQRAEHCFNIYHTHAETLFP

SEQ ID NO: 3174606 - protein, 18 aa, Giardia lamblia
VRRCLQRSNMTGSQPLAS

SEQ ID NO: 3174607 - protein, 23 aa, Giardia lamblia
VRREVLFCRTIGLAVRGLVQNMS

SEQ ID NO: 3174608 - protein, 21 aa, Giardia lamblia
VRRHPEILLRLTKEEAYSAVA

SEQ ID NO: 3174609 - protein, 26 aa, Giardia lamblia
VRRLEGPCKHCLQLVKAELISIAKSI

SEQ ID NO: 3174610 - protein, 26 aa, Giardia lamblia
VRRMRKERSVCLGISPQSLFSLMETK

SEQ ID NO: 3174611 - protein, 19 aa, Giardia lamblia
VRRTFRSPFVYGGKEQGQW

SEQ ID NO: 3174612 - protein, 18 aa, Giardia lamblia
VRSIRIGPAGAITLMKRL

SEQ ID NO: 3174613 - protein, 30 aa, Giardia lamblia
VRSLYERCCALRLSLKKMSYVLKRFYNFEK

SEQ ID NO: 3174614 - protein, 24 aa, Giardia lamblia
VRSNARPCGMINLSDMSAVHSARD

SEQ ID NO: 3174615 - protein, 25 aa, Giardia lamblia
VRSNRWPGMLNVCFNHSNGDPLVYT

SEQ ID NO: 3174616 - protein, 22 aa, Giardia lamblia
VRSPWRGVLLFGPPGTGKTLLA

SEQ ID NO: 3174617 - protein, 25 aa, Giardia lamblia
VRSYDCVPMIKSYLELFVGAHNQEI

SEQ ID NO: 3174618 - protein, 23 aa, Giardia lamblia
VRTADLKKIMILFYQVVDALCYM

SEQ ID NO: 3174619 - protein, 19 aa, Giardia lamblia
VRTILSLLRLRQINNAVFM

SEQ ID NO: 3174620 - protein, 24 aa, Giardia lamblia
VRTLTLITPCVWDGSLKTTFEKNN

SEQ ID NO: 3174621 - protein, 17 aa, Giardia lamblia
VRTPLRMPPHSEMDVSV

SEQ ID NO: 3174622 - protein, 22 aa, Giardia lamblia
VRTRKLWFYPGREDSCGFIEHL

SEQ ID NO: 3174623 - protein, 20 aa, Giardia lamblia
VRVIADCYTELFYTCQYQSY

SEQ ID NO: 3174624 - protein, 19 aa, Giardia lamblia
VRVRPLIEREIRAREEEVI

SEQ ID NO: 3174625 - protein, 24 aa, Giardia lamblia
VRVSSPKLAFVVLRDGTGYCQLVL

SEQ ID NO: 3174626 - protein, 17 aa, Giardia lamblia
VRVWSLLPLQGGLVDQE

SEQ ID NO: 3174627 - protein, 17 aa, Giardia lamblia
VRVYSLLPAQGRMQDSN

SEQ ID NO: 3174628 - protein, 25 aa, Giardia lamblia
VRYLRKCAFYAMLSRYLDLHKRLNA

SEQ ID NO: 3174629 - protein, 17 aa, Giardia lamblia
VSAAPEFVKNVMIPATT

SEQ ID NO: 3174630 - protein, 26 aa, Giardia lamblia
VSAGMLCNLASLYRAGVLLQENLSPP

SEQ ID NO: 3174631 - protein, 18 aa, Giardia lamblia
VSAGNEFSIVAISTNSDR

SEQ ID NO: 3174632 - protein, 36 aa, Giardia lamblia
VSAIKECIRNGYDRGLCITVGSIIRKSRLLASKAVS

SEQ ID NO: 3174633 - protein, 18 aa, Giardia lamblia
VSAISLARYVDRCMSPHC

SEQ ID NO: 3174634 - protein, 25 aa, Giardia lamblia
VSALDRLGFRVGETALNVCLQKAKY

SEQ ID NO: 3174635 - protein, 26 aa, Giardia lamblia
VSALFKLSLDILPRIVNLFCKSLGSL

SEQ ID NO: 3174636 - protein, 24 aa, Giardia lamblia
VSARLPPFRYDWEATAKRKAEESR

SEQ ID NO: 3174637 - protein, 26 aa, Giardia lamblia
VSATGRTALYMAVAAGHAELCYILAS

SEQ ID NO: 3174638 - protein, 23 aa, Giardia lamblia
VSATRLPLGDGITLDLLTCNVTY

SEQ ID NO: 3174639 - protein, 24 aa, Giardia lamblia
VSAVKRLIERGVYDTSILNDLDYT

SEQ ID NO: 3174640 - protein, 30 aa, Giardia lamblia
VSAVLQICKDCKSGDILVFMPGELEIRNVV

SEQ ID NO: 3174641 - protein, 24 aa, Giardia lamblia
VSCAPGAQILACSDGRGIVRVYAY

SEQ ID NO: 3174642 - protein, 26 aa, Giardia lamblia
VSDARSSLDHPLSFGTQTGVQVLDRA

SEQ ID NO: 3174643 - protein, 27 aa, Giardia lamblia
VSDAVCHPEIKIAFTRLYNYALSLEHL

SEQ ID NO: 3174644 - protein, 26 aa, Giardia lamblia
VSDEAAYERAFRAIIESGCYPAVNQA

SEQ ID NO: 3174645 - protein, 25 aa, Giardia lamblia
VSDELFREIIDWFKRKGRLVEINKS

SEQ ID NO: 3174646 - protein, 21 aa, Giardia lamblia
VSDGCKQLFEDPHGCQNLDPV

SEQ ID NO: 3174647 - protein, 17 aa, Giardia lamblia
VSDHGYWGISHDTPQTR

SEQ ID NO: 3174648 - protein, 20 aa, Giardia lamblia
VSDSNFLSWLGFSSAVRQRG

SEQ ID NO: 3174649 - protein, 18 aa, Giardia lamblia
VSDVLKFTAQTALALAYL

SEQ ID NO: 3174650 - protein, 17 aa, Giardia lamblia
VSEELDEVILLKKELLS

SEQ ID NO: 3174651 - protein, 24 aa, Giardia lamblia
VSEFKDKYPSVAYYEGKKPWECFE

SEQ ID NO: 3174652 - protein, 21 aa, Giardia lamblia
VSEIESLGSLIANAEQQLFQL

SEQ ID NO: 3174653 - protein, 18 aa, Giardia lamblia
VSEIPYVIDVLLYTFDGA

SEQ ID NO: 3174654 - protein, 19 aa, Giardia lamblia
VSEKLVYPMFEEMRHAPPF

SEQ ID NO: 3174655 - protein, 20 aa, Giardia lamblia
VSEKRLADVLSTTDTTGQID

SEQ ID NO: 3174656 - protein, 26 aa, Giardia lamblia
VSELILAWHWTRWGTSGTYSVIPKSS

SEQ ID NO: 3174657 - protein, 21 aa, Giardia lamblia
VSELLGSGAFAKVRLATRKDT

SEQ ID NO: 3174658 - protein, 24 aa, Giardia lamblia
VSENAFRISDEVTLLVRSYLLKHM

SEQ ID NO: 3174659 - protein, 21 aa, Giardia lamblia
VSEPRRVAAISLAGYQQQALP

SEQ ID NO: 3174660 - protein, 19 aa, Giardia lamblia
VSFKPDLTLSRIGSSRYKD

SEQ ID NO: 3174661 - protein, 21 aa, Giardia lamblia
VSGDMARRTALQLALINGHSA

SEQ ID NO: 3174662 - protein, 28 aa, Giardia lamblia
VSGIYCKLVCIPFCHTFGLPTLAIKLLE

SEQ ID NO: 3174663 - protein, 31 aa, Giardia lamblia
VSGLERFELCVAYVIGCLYPTVVDQHKAFNP

SEQ ID NO: 3174664 - protein, 20 aa, Giardia lamblia
VSGLLEFTDALPVLGGPQSV

SEQ ID NO: 3174665 - protein, 28 aa, Giardia lamblia
VSGLRYELRRLFSAFGMVRDVSIVVNKM

SEQ ID NO: 3174666 - protein, 24 aa, Giardia lamblia
VSGNGVYVSCHFSHLTLGDDFVGQ

SEQ ID NO: 3174667 - protein, 26 aa, Giardia lamblia
VSGPFRFLIEFRHKLDLPETYESRRF

SEQ ID NO: 3174668 - protein, 23 aa, Giardia lamblia
VSGRFSRACFRNMGDLFDPSTRM

SEQ ID NO: 3174669 - protein, 23 aa, Giardia lamblia
VSGSALPPPIAYPVFECSTSGKG

SEQ ID NO: 3174670 - protein, 18 aa, Giardia lamblia
VSGSVLVKRATMSNKKVS

SEQ ID NO: 3174671 - protein, 22 aa, Giardia lamblia
VSHCNKSMMALLINKITLTEAM

SEQ ID NO: 3174672 - protein, 22 aa, Giardia lamblia
VSHLDLCICKAMSALEPLNRCI

SEQ ID NO: 3174673 - protein, 26 aa, Giardia lamblia
VSIFPSYKYKPTMAHHFFKILEDRGL

SEQ ID NO: 3174674 - protein, 24 aa, Giardia lamblia
VSIISIRARHLFDGVSSLALCLLL

SEQ ID NO: 3174675 - protein, 22 aa, Giardia lamblia
VSIKVLERFDLLATRGKSSSYR

SEQ ID NO: 3174676 - protein, 25 aa, Giardia lamblia
VSILAPLECGMCLDNGDTALILALR

SEQ ID NO: 3174677 - protein, 38 aa, Giardia lamblia
VSILLMKRFLSVFVLSTRTARYFYHMHPIQYYSTPTGR

SEQ ID NO: 3174678 - protein, 19 aa, Giardia lamblia
VSINNARWKRTQFIIQTCK

SEQ ID NO: 3174679 - protein, 19 aa, Giardia lamblia
VSIPLRPYLETVSRLDDPV

SEQ ID NO: 3174680 - protein, 23 aa, Giardia lamblia
VSISGYCHNGVFKAPLGAQKIES

SEQ ID NO: 3174681 - protein, 20 aa, Giardia lamblia
VSISRVFNWDVQRVKTSGDI

SEQ ID NO: 3174682 - protein, 17 aa, Giardia lamblia
VSIVPYDVWVTSYDRVF

SEQ ID NO: 3174683 - protein, 28 aa, Giardia lamblia
VSKAAKSLCMWCRAIDIYAKVFAEIEPK

SEQ ID NO: 3174684 - protein, 25 aa, Giardia lamblia
VSKDRTAYVLADFGLCRVLERNQYA

SEQ ID NO: 3174685 - protein, 55 aa, Giardia lamblia
VSKETCPNYLAACKKREIGWGFKCPQEEKTGYCEFRHCLPPGYVIEEKKKVEVID

SEQ ID NO: 3174686 - protein, 27 aa, Giardia lamblia
VSKKSRGRMPVFTALSVEDEVQERTKH

SEQ ID NO: 3174687 - protein, 18 aa, Giardia lamblia
VSKLVERKVFLDLSEPSI

SEQ ID NO: 3174688 - protein, 26 aa, Giardia lamblia
VSKPKKARLKAVRNIANAGGHRLHKD

SEQ ID NO: 3174689 - protein, 30 aa, Giardia lamblia
VSKSGRFGFKIAALQGRREICRLLMEKERN

SEQ ID NO: 3174690 - protein, 18 aa, Giardia lamblia
VSLAELYDLAIFTYAIKE

SEQ ID NO: 3174691 - protein, 19 aa, Giardia lamblia
VSLCVIPMVNYAPLVEITS

SEQ ID NO: 3174692 - protein, 29 aa, Giardia lamblia
VSLFTAKTLQGWTLCKVVGQIYSRITTPL

SEQ ID NO: 3174693 - protein, 17 aa, Giardia lamblia
VSLGLYAIYVFLASSWV

SEQ ID NO: 3174694 - protein, 18 aa, Giardia lamblia
VSLGNIFRHQARYKECLV

SEQ ID NO: 3174695 - protein, 18 aa, Giardia lamblia
VSLHFSEAQGAVLLPNSS

SEQ ID NO: 3174696 - protein, 21 aa, Giardia lamblia
VSLILGVVVSKYFNPVTKTLD

SEQ ID NO: 3174697 - protein, 18 aa, Giardia lamblia
VSLKDIDTLVAFYETLLK

SEQ ID NO: 3174698 - protein, 21 aa, Giardia lamblia
VSLLLPRLLNYGTLQTQFTEL

SEQ ID NO: 3174699 - protein, 17 aa, Giardia lamblia
VSLPAIKSLIGYAHHTY

SEQ ID NO: 3174700 - protein, 24 aa, Giardia lamblia
VSLRGFCYPAMYLNADRFSTGASE

SEQ ID NO: 3174701 - protein, 36 aa, Giardia lamblia
VSLRIYRYRVRGCLKKAYFFTLAVWDLEFTYLDNGL

SEQ ID NO: 3174702 - protein, 20 aa, Giardia lamblia
VSLRRCGELVIARNEAELNA

SEQ ID NO: 3174703 - protein, 21 aa, Giardia lamblia
VSLRSKHSFSRKSITKLTALT

SEQ ID NO: 3174704 - protein, 17 aa, Giardia lamblia
VSLTGSFAGSFTGSFVG

SEQ ID NO: 3174705 - protein, 21 aa, Giardia lamblia
VSLTRGIWNPEVIKGINPQHG

SEQ ID NO: 3174706 - protein, 19 aa, Giardia lamblia
VSLYPRFIAQYGEDRLSTL

SEQ ID NO: 3174707 - protein, 32 aa, Giardia lamblia
VSMATHSCPYCQKFIPEFSVELEALQQQTEKV

SEQ ID NO: 3174708 - protein, 20 aa, Giardia lamblia
VSMATVLWRAYGGSISGDSS

SEQ ID NO: 3174709 - protein, 18 aa, Giardia lamblia
VSMHKMLLLHSVPGCGKT

SEQ ID NO: 3174710 - protein, 18 aa, Giardia lamblia
VSMLRCRVSLAKTEEGGH

SEQ ID NO: 3174711 - protein, 17 aa, Giardia lamblia
VSMQWREINIYGDPPSK

SEQ ID NO: 3174712 - protein, 19 aa, Giardia lamblia
VSNALSFGAVAKALRALDD

SEQ ID NO: 3174713 - protein, 22 aa, Giardia lamblia
VSNFSYAMVWGRSAQHCPQRVG

SEQ ID NO: 3174714 - protein, 19 aa, Giardia lamblia
VSNHFGFEGVSDYDLTSVA

SEQ ID NO: 3174715 - protein, 19 aa, Giardia lamblia
VSNLGALLFELCTLSSKGT

SEQ ID NO: 3174716 - protein, 27 aa, Giardia lamblia
VSNLPGIWPTGICQGAPHTIPSLQPGI

SEQ ID NO: 3174717 - protein, 24 aa, Giardia lamblia
VSNPFTCIICRLKFNTFEDQRLHF

SEQ ID NO: 3174718 - protein, 22 aa, Giardia lamblia
VSNSMSLYRFLSLTPAVARINL

SEQ ID NO: 3174719 - protein, 19 aa, Giardia lamblia
VSNWARYTDMWDVQGGLDD

SEQ ID NO: 3174720 - protein, 21 aa, Giardia lamblia
VSPCLSEFSSFIAAGSDSGAS

SEQ ID NO: 3174721 - protein, 22 aa, Giardia lamblia
VSPDSAFVWFYLNGVFYELDLH

SEQ ID NO: 3174722 - protein, 18 aa, Giardia lamblia
VSPDYPQRVQGLSDEDIR

SEQ ID NO: 3174723 - protein, 18 aa, Giardia lamblia
VSPINTWNPYKQGKTPNL

SEQ ID NO: 3174724 - protein, 20 aa, Giardia lamblia
VSPIRRVVRRVPKKGDDTVI

SEQ ID NO: 3174725 - protein, 17 aa, Giardia lamblia
VSPLRLIYATSDISMVS

SEQ ID NO: 3174726 - protein, 17 aa, Giardia lamblia
VSPNMVTLIEFPTLFGV

SEQ ID NO: 3174727 - protein, 17 aa, Giardia lamblia
VSPPRGGTPIVTTPSMV

SEQ ID NO: 3174728 - protein, 18 aa, Giardia lamblia
VSPRPRFTSSSNVSRSQR

SEQ ID NO: 3174729 - protein, 24 aa, Giardia lamblia
VSPSFRMILVSSLDVFVPSDLSQH

SEQ ID NO: 3174730 - protein, 17 aa, Giardia lamblia
VSPSRKASVPAEPASPT

SEQ ID NO: 3174731 - protein, 20 aa, Giardia lamblia
VSPVSRGGVDYGDSKSISPA

SEQ ID NO: 3174732 - protein, 24 aa, Giardia lamblia
VSQAKAACLPTHMTASSADMPYTA

SEQ ID NO: 3174733 - protein, 21 aa, Giardia lamblia
VSQPKRTVCSVDRSVAASRAQ

SEQ ID NO: 3174734 - protein, 25 aa, Giardia lamblia
VSQTPCLMCGRLLENIADAKSDLRT

SEQ ID NO: 3174735 - protein, 22 aa, Giardia lamblia
VSRCVQELQGFFVSPNQLHPSE

SEQ ID NO: 3174736 - protein, 25 aa, Giardia lamblia
VSRLDMMIHKILSFQLYLLARIGPD

SEQ ID NO: 3174737 - protein, 19 aa, Giardia lamblia
VSRRSHLNISCIAPVHVEQ

SEQ ID NO: 3174738 - protein, 26 aa, Giardia lamblia
VSRSIICIGYASGLVRVYGSTGRILD

SEQ ID NO: 3174739 - protein, 25 aa, Giardia lamblia
VSRSQVYRIIRLKGIKPNNRDENKR

SEQ ID NO: 3174740 - protein, 22 aa, Giardia lamblia
VSRYNYHHHGMFMNSLNKSLHG

SEQ ID NO: 3174741 - protein, 19 aa, Giardia lamblia
VSSDADWVAITALGTDQAN

SEQ ID NO: 3174742 - protein, 20 aa, Giardia lamblia
VSSDAVFSCYLSFLRLAYFY

SEQ ID NO: 3174743 - protein, 25 aa, Giardia lamblia
VSSELAAGVTICIAKPTAANLKVKT

SEQ ID NO: 3174744 - protein, 18 aa, Giardia lamblia
VSSERKALLLGLLSSNSI

SEQ ID NO: 3174745 - protein, 26 aa, Giardia lamblia
VSSIAEYRRLFGLPPCSEEGFADEAK

SEQ ID NO: 3174746 - protein, 20 aa, Giardia lamblia
VSSLNFLKIFRVLVRDAANA

SEQ ID NO: 3174747 - protein, 21 aa, Giardia lamblia
VSSLRSPAMRERHWQQLASTT

SEQ ID NO: 3174748 - protein, 19 aa, Giardia lamblia
VSSPGQFLRHYSPRTECYL

SEQ ID NO: 3174749 - protein, 24 aa, Giardia lamblia
VSSPTGLMKACIKGDRNTAKKLLS

SEQ ID NO: 3174750 - protein, 28 aa, Giardia lamblia
VSSQRFVPMPLKFIEKAIGQHEVSLGAD

SEQ ID NO: 3174751 - protein, 19 aa, Giardia lamblia
VSSSSGALLLRLATDSFVF

SEQ ID NO: 3174752 - protein, 24 aa, Giardia lamblia
VSSSSRSGVDLAFADRASMTAGDD

SEQ ID NO: 3174753 - protein, 40 aa, Giardia lamblia
VSTDISPRRVCLIWGPMGLRFKGNYTSRCIHFNTHTELFG

SEQ ID NO: 3174754 - protein, 25 aa, Giardia lamblia
VSTDSLFQRHRHSSVRHKTIAERTY

SEQ ID NO: 3174755 - protein, 19 aa, Giardia lamblia
VSTEITALIDELSQLESRT

SEQ ID NO: 3174756 - protein, 21 aa, Giardia lamblia
VSTHLDSFVSFIQRKQIESAR

SEQ ID NO: 3174757 - protein, 18 aa, Giardia lamblia
VSTIISWYPVEVLALPDD

SEQ ID NO: 3174758 - protein, 21 aa, Giardia lamblia
VSTKWEDGVTCYECGDPADAR

SEQ ID NO: 3174759 - protein, 19 aa, Giardia lamblia
VSTSSRFKDFYLATERYTK

SEQ ID NO: 3174760 - protein, 21 aa, Giardia lamblia
VSVAASCTDGWIVNLDMSTLI

SEQ ID NO: 3174761 - protein, 28 aa, Giardia lamblia
VSVAGKSLCLWVRAVYEYACVYKVVKPK

SEQ ID NO: 3174762 - protein, 20 aa, Giardia lamblia
VSVCTAETISLVGCKISSLE

SEQ ID NO: 3174763 - protein, 17 aa, Giardia lamblia
VSVKETKQTSCMQMNLS

SEQ ID NO: 3174764 - protein, 22 aa, Giardia lamblia
VSVKKRKGEVVAERTNLMKAAW

SEQ ID NO: 3174765 - protein, 29 aa, Giardia lamblia
VSVKPRPGEPVALFGFGYLRSGLQRPEFF

SEQ ID NO: 3174766 - protein, 28 aa, Giardia lamblia
VSVLFGVEPFCRFHFARGATNRRLASNI

SEQ ID NO: 3174767 - protein, 26 aa, Giardia lamblia
VSVLKPCKTIVPNILRLNEQLKLVGQ

SEQ ID NO: 3174768 - protein, 18 aa, Giardia lamblia
VSVLTRFPPEPNGYLHLG

SEQ ID NO: 3174769 - protein, 17 aa, Giardia lamblia
VSVRGCFWMGSSLSAAI

SEQ ID NO: 3174770 - protein, 24 aa, Giardia lamblia
VSVRQLRAPLPLTDTSSVEEKYKI

SEQ ID NO: 3174771 - protein, 19 aa, Giardia lamblia
VSVTNRFQANLLIVSTAEN

SEQ ID NO: 3174772 - protein, 33 aa, Giardia lamblia
VSVYHFRTYDAWIVIACDGCWDSISDIDAAMLL

SEQ ID NO: 3174773 - protein, 24 aa, Giardia lamblia
VSWKHEITDIIAIANKAPQISKEK

SEQ ID NO: 3174774 - protein, 23 aa, Giardia lamblia
VSYDHKTAFVLAAENGHTDIVQC

SEQ ID NO: 3174775 - protein, 25 aa, Giardia lamblia
VSYDHSACFVVGCSVSAVDMTLPPS

SEQ ID NO: 3174776 - protein, 25 aa, Giardia lamblia
VSYNHDMSWTILPVCYEDVHESVHA

SEQ ID NO: 3174777 - protein, 17 aa, Giardia lamblia
VSYRTSRIITEKLFEKI

SEQ ID NO: 3174778 - protein, 17 aa, Giardia lamblia
VSYVYEWHADSYPLAQD

SEQ ID NO: 3174779 - protein, 18 aa, Giardia lamblia
VTAFASRVDTALMDVSPN

SEQ ID NO: 3174780 - protein, 17 aa, Giardia lamblia
VTAIIPYFGYARQDRKA

SEQ ID NO: 3174781 - protein, 17 aa, Giardia lamblia
VTALIWAAFAGQVEVAE

SEQ ID NO: 3174782 - protein, 23 aa, Giardia lamblia
VTALMLAARLGFVNIVKELAPYE

SEQ ID NO: 3174783 - protein, 20 aa, Giardia lamblia
VTALPDWKQSFPKFRGKTLK

SEQ ID NO: 3174784 - protein, 33 aa, Giardia lamblia
VTAPTCGACGIVPGCMYYFYSEYKVPDDVILDA

SEQ ID NO: 3174785 - protein, 23 aa, Giardia lamblia
VTARGCPAMVMWAIIDGLLPGFD

SEQ ID NO: 3174786 - protein, 18 aa, Giardia lamblia
VTDGCKHKNWRIRETSLR

SEQ ID NO: 3174787 - protein, 28 aa, Giardia lamblia
VTDGCSIPSGFLSPYFALGGSRYLELTN

SEQ ID NO: 3174788 - protein, 20 aa, Giardia lamblia
VTDGQKRVHFLSPIPTQSDD

SEQ ID NO: 3174789 - protein, 26 aa, Giardia lamblia
VTDHLIRFGVSSGRAMIVSYASNSSF

SEQ ID NO: 3174790 - protein, 23 aa, Giardia lamblia
VTDLPKWNINYYKGLGSSNTTDA

SEQ ID NO: 3174791 - protein, 19 aa, Giardia lamblia
VTDVRWTRDNYLLVSSEDT

SEQ ID NO: 3174792 - protein, 27 aa, Giardia lamblia
VTEGILLNWVRPGGAFLSSIGVLILDE

SEQ ID NO: 3174793 - protein, 25 aa, Giardia lamblia
VTENMCKYCAVVAGGNDPPVYGGFG

SEQ ID NO: 3174794 - protein, 21 aa, Giardia lamblia
VTESCCLVAKIASGKYVVLTD

SEQ ID NO: 3174795 - protein, 25 aa, Giardia lamblia
VTEVMLRNEFGAICSVQAVHMGRNG

SEQ ID NO: 3174796 - protein, 19 aa, Giardia lamblia
VTFNPRFYNTYLSRFAEQC

SEQ ID NO: 3174797 - protein, 24 aa, Giardia lamblia
VTFYRLICEWKKKQAKKFSEYTSL

SEQ ID NO: 3174798 - protein, 33 aa, Giardia lamblia
VTGCSEPGCVAFIDSRYNVFMLFVPRYSPEHAL

SEQ ID NO: 3174799 - protein, 18 aa, Giardia lamblia
VTGGGIPFMGKTESKEAG

SEQ ID NO: 3174800 - protein, 17 aa, Giardia lamblia
VTGKLGAIISVTPRSVT

SEQ ID NO: 3174801 - protein, 18 aa, Giardia lamblia
VTHDEILIPRVIDISALP

SEQ ID NO: 3174802 - protein, 19 aa, Giardia lamblia
VTHKALRLRYAYPEDTVDQ

SEQ ID NO: 3174803 - protein, 19 aa, Giardia lamblia
VTICRGILGIETIKDALRE

SEQ ID NO: 3174804 - protein, 24 aa, Giardia lamblia
VTILKRKLASLKKTYVDITSLIEE

SEQ ID NO: 3174805 - protein, 17 aa, Giardia lamblia
VTILSAFWNINAFDQPG

SEQ ID NO: 3174806 - protein, 24 aa, Giardia lamblia
VTIPRMTICALKFSATARSRIEKA

SEQ ID NO: 3174807 - protein, 26 aa, Giardia lamblia
VTITARLTISITAHFYKANQTALSIE

SEQ ID NO: 3174808 - protein, 26 aa, Giardia lamblia
VTIYSICLSLFMAGFYRDLAYLINAK

SEQ ID NO: 3174809 - protein, 17 aa, Giardia lamblia
VTLDKSYVATFFSADLG

SEQ ID NO: 3174810 - protein, 23 aa, Giardia lamblia
VTLDSRNALMFAAAANAADAAEI

SEQ ID NO: 3174811 - protein, 17 aa, Giardia lamblia
VTLGCPSLHLLYDTAVL

SEQ ID NO: 3174812 - protein, 21 aa, Giardia lamblia
VTLLRILRMLASITYHNKPYN

SEQ ID NO: 3174813 - protein, 25 aa, Giardia lamblia
VTLNRRKWVLSREAIDFHCSEKVYV

SEQ ID NO: 3174814 - protein, 19 aa, Giardia lamblia
VTLPAGIQKLVFLDECDAM

SEQ ID NO: 3174815 - protein, 19 aa, Giardia lamblia
VTLTNLRLAWNSRGDPNGH

SEQ ID NO: 3174816 - protein, 17 aa, Giardia lamblia
VTLVTAWKRSSHPDPSD

SEQ ID NO: 3174817 - protein, 17 aa, Giardia lamblia
VTLYLNPRQRLRKEEDM

SEQ ID NO: 3174818 - protein, 18 aa, Giardia lamblia
VTLYSTGTINVRRTGPEL

SEQ ID NO: 3174819 - protein, 19 aa, Giardia lamblia
VTMPACVICLDRERTHVLM

SEQ ID NO: 3174820 - protein, 17 aa, Giardia lamblia
VTMPELYGEFNSISHDW

SEQ ID NO: 3174821 - protein, 24 aa, Giardia lamblia
VTNECYKSGIGVTALIIAIRHNHL

SEQ ID NO: 3174822 - protein, 27 aa, Giardia lamblia
VTNEVTNFFLCTSFPPSTKSTPQFERI

SEQ ID NO: 3174823 - protein, 19 aa, Giardia lamblia
VTNMPITWSTVGMKKSASG

SEQ ID NO: 3174824 - protein, 26 aa, Giardia lamblia
VTNPYSVPCTVAIFLNFDQTRMTPQA

SEQ ID NO: 3174825 - protein, 23 aa, Giardia lamblia
VTPEGRDALMLGSEAGCSDMVSF

SEQ ID NO: 3174826 - protein, 21 aa, Giardia lamblia
VTPHLRSIKGSLCTPAPSTAT

SEQ ID NO: 3174827 - protein, 24 aa, Giardia lamblia
VTPLTIVVPLLFEKGVMVSSYNPI

SEQ ID NO: 3174828 - protein, 17 aa, Giardia lamblia
VTPLYPHDCERFRTYNL

SEQ ID NO: 3174829 - protein, 19 aa, Giardia lamblia
VTPTALWRECGLPVTDEKK

SEQ ID NO: 3174830 - protein, 23 aa, Giardia lamblia
VTPTKIRIGSMLAPADLTTARVC

SEQ ID NO: 3174831 - protein, 34 aa, Giardia lamblia
VTPVREFSWPFAAEFTCLLWSTSDSIIAGFEDGS

SEQ ID NO: 3174832 - protein, 22 aa, Giardia lamblia
VTQPRRVAAISLALRVAQERGA

SEQ ID NO: 3174833 - protein, 17 aa, Giardia lamblia
VTQYVCMLKEDRYKLKL

SEQ ID NO: 3174834 - protein, 17 aa, Giardia lamblia
VTRACLHPVYNKLVMRL

SEQ ID NO: 3174835 - protein, 25 aa, Giardia lamblia
VTRDGSQMLKMWLMNPLYDVETIQL

SEQ ID NO: 3174836 - protein, 18 aa, Giardia lamblia
VTRFPPRSQSPAVSDSID

SEQ ID NO: 3174837 - protein, 19 aa, Giardia lamblia
VTRQDLLASIEAIEQQSGS

SEQ ID NO: 3174838 - protein, 24 aa, Giardia lamblia
VTSERRKRMTILLRDVLIALGNDR

SEQ ID NO: 3174839 - protein, 26 aa, Giardia lamblia
VTSFLKREIKALLRVILLGASQTMFY

SEQ ID NO: 3174840 - protein, 26 aa, Giardia lamblia
VTSFSDLILLLAIRLKSPSPDSTFNL

SEQ ID NO: 3174841 - protein, 24 aa, Giardia lamblia
VTSINLPELWSLDASLYDILAYRE

SEQ ID NO: 3174842 - protein, 20 aa, Giardia lamblia
VTSLLFGRRAMSIVQAPKVN

SEQ ID NO: 3174843 - protein, 17 aa, Giardia lamblia
VTSLLSVCDHRLPCDDS

SEQ ID NO: 3174844 - protein, 19 aa, Giardia lamblia
VTSLPSLVTLLVHESYRVF

SEQ ID NO: 3174845 - protein, 21 aa, Giardia lamblia
VTSNAFCFDRQVHAISLESNP

SEQ ID NO: 3174846 - protein, 20 aa, Giardia lamblia
VTSQIFWLFRHIPSVDNSLI

SEQ ID NO: 3174847 - protein, 25 aa, Giardia lamblia
VTTADYMAGPGFTALMDAARLGNIA

SEQ ID NO: 3174848 - protein, 19 aa, Giardia lamblia
VTTKVFKIILLKYWLGNAV

SEQ ID NO: 3174849 - protein, 29 aa, Giardia lamblia
VTVEARQWFDWFVRLVFKLVSDHSRSLTE

SEQ ID NO: 3174850 - protein, 24 aa, Giardia lamblia
VTVFKFSDGVFTRHAVFSLPISST

SEQ ID NO: 3174851 - protein, 19 aa, Giardia lamblia
VTVKLLDVLGSFKGLVESV

SEQ ID NO: 3174852 - protein, 18 aa, Giardia lamblia
VTVKPELETPLLERLEGG

SEQ ID NO: 3174853 - protein, 25 aa, Giardia lamblia
VTVPWRLERSYALKAAKYRPLVLQG

SEQ ID NO: 3174854 - protein, 23 aa, Giardia lamblia
VTVRPVWRRYVFNERTLPRHPRV

SEQ ID NO: 3174855 - protein, 20 aa, Giardia lamblia
VTWLAWLLSMISGIQINKRS

SEQ ID NO: 3174856 - protein, 19 aa, Giardia lamblia
VTYEPKLIDFCLFPVMVNS

SEQ ID NO: 3174857 - protein, 20 aa, Giardia lamblia
VTYSDFFRDLSFTQNLNLGY

SEQ ID NO: 3174858 - protein, 18 aa, Giardia lamblia
VTYSFKFGSTSEDTKSNT

SEQ ID NO: 3174859 - protein, 37 aa, Giardia lamblia
VVAEQRLRENADYRVLCGICRRWGDREHLNAHDGFTP

SEQ ID NO: 3174860 - protein, 20 aa, Giardia lamblia
VVAICVTISIGLNTTGHKDI

SEQ ID NO: 3174861 - protein, 18 aa, Giardia lamblia
VVAPRLYQMIKHVHTSMK

SEQ ID NO: 3174862 - protein, 17 aa, Giardia lamblia
VVAYARFLYILSTDDLG

SEQ ID NO: 3174863 - protein, 18 aa, Giardia lamblia
VVCGHKFDLRIYCLVESF

SEQ ID NO: 3174864 - protein, 26 aa, Giardia lamblia
VVCPCGACAHFDCVRQLLSHDDNLSC

SEQ ID NO: 3174865 - protein, 37 aa, Giardia lamblia
VVDARFPLAHLPVSILRYAKICVRPVIIVLNKIDLAE

SEQ ID NO: 3174866 - protein, 21 aa, Giardia lamblia
VVDESKLQFALQCTTRELTDL

SEQ ID NO: 3174867 - protein, 25 aa, Giardia lamblia
VVDPKEIIDGLAMLAQKRLYFRSNP

SEQ ID NO: 3174868 - protein, 20 aa, Giardia lamblia
VVDVVFRYNLAEAEFTKKTL

SEQ ID NO: 3174869 - protein, 21 aa, Giardia lamblia
VVEAAGPFLDWLEKQGDEEYD

SEQ ID NO: 3174870 - protein, 22 aa, Giardia lamblia
VVEALVGVECKVMDYSGKTAAV

SEQ ID NO: 3174871 - protein, 33 aa, Giardia lamblia
VVEKCIPPRKELILRIHMTPLQISCSEWLLEQN

SEQ ID NO: 3174872 - protein, 22 aa, Giardia lamblia
VVERYLRYFIPWFQRPQTILEF

SEQ ID NO: 3174873 - protein, 17 aa, Giardia lamblia
VVETCAILEAFSHLSSR

SEQ ID NO: 3174874 - protein, 23 aa, Giardia lamblia
VVFASAIGGWGFTISSFAQILAE

SEQ ID NO: 3174875 - protein, 22 aa, Giardia lamblia
VVGEATLRCVCLDKASMEAAPN

SEQ ID NO: 3174876 - protein, 17 aa, Giardia lamblia
VVGFVGEYILSRKTLSF

SEQ ID NO: 3174877 - protein, 17 aa, Giardia lamblia
VVGHSMGGLLVTTYMRL

SEQ ID NO: 3174878 - protein, 20 aa, Giardia lamblia
VVGYNCRFSLGFNVDMRLLA

SEQ ID NO: 3174879 - protein, 17 aa, Giardia lamblia
VVHCRFRAEQSATPTAV

SEQ ID NO: 3174880 - protein, 19 aa, Giardia lamblia
VVHKCGYDGVQLHTAHGYL

SEQ ID NO: 3174881 - protein, 25 aa, Giardia lamblia
VVHKEMKDLILLCINKDPSARPSAR

SEQ ID NO: 3174882 - protein, 18 aa, Giardia lamblia
VVHQRVAFMGAITLCPPV

SEQ ID NO: 3174883 - protein, 18 aa, Giardia lamblia
VVHYVRMDRSISRVAISR

SEQ ID NO: 3174884 - protein, 18 aa, Giardia lamblia
VVIDPRIIVVDGPIGAGK

SEQ ID NO: 3174885 - protein, 19 aa, Giardia lamblia
VVIQYDFPLSLDVHIHRVG

SEQ ID NO: 3174886 - protein, 20 aa, Giardia lamblia
VVIRAGAVAPPMSFEENIAL

SEQ ID NO: 3174887 - protein, 24 aa, Giardia lamblia
VVKAVRRFAADRVETYALQLELSV

SEQ ID NO: 3174888 - protein, 19 aa, Giardia lamblia
VVKGLRRIFYILPHGPIEN

SEQ ID NO: 3174889 - protein, 33 aa, Giardia lamblia
VVKKAPLMFQMIIKWGGYLSIAGLRQSFLMGKQ

SEQ ID NO: 3174890 - protein, 19 aa, Giardia lamblia
VVLERRRFGTIGFNSPYDW

SEQ ID NO: 3174891 - protein, 26 aa, Giardia lamblia
VVLLGLKILFPNAVYLLRGNHETRAC

SEQ ID NO: 3174892 - protein, 32 aa, Giardia lamblia
VVLPCGAGKSLLGVACACRLGHSCIVVTNGNL

SEQ ID NO: 3174893 - protein, 19 aa, Giardia lamblia
VVLRVPVCRGGINKIGINE

SEQ ID NO: 3174894 - protein, 26 aa, Giardia lamblia
VVMRQLKRPFSHAGHIHTRASDVEEV

SEQ ID NO: 3174895 - protein, 19 aa, Giardia lamblia
VVNDWCGFVGRDTSATEIS

SEQ ID NO: 3174896 - protein, 19 aa, Giardia lamblia
VVNENGERFILCPRCGLRI

SEQ ID NO: 3174897 - protein, 21 aa, Giardia lamblia
VVNISLGAVVMEFSHKDLDYA

SEQ ID NO: 3174898 - protein, 24 aa, Giardia lamblia
VVNLRFINFSSISYHEFFGYYSFS

SEQ ID NO: 3174899 - protein, 24 aa, Giardia lamblia
VVPCSKSIPINRLPDLSVSAPIDT

SEQ ID NO: 3174900 - protein, 18 aa, Giardia lamblia
VVPLRGVTRFLLGSPEVH

SEQ ID NO: 3174901 - protein, 25 aa, Giardia lamblia
VVPSYYMMVCIVRVLKLLAYSNIVW

SEQ ID NO: 3174902 - protein, 25 aa, Giardia lamblia
VVQDARLSIHLRRILESHFDETYVR

SEQ ID NO: 3174903 - protein, 18 aa, Giardia lamblia
VVQPYSIDRRCIFFSLAL

SEQ ID NO: 3174904 - protein, 19 aa, Giardia lamblia
VVRDFLKEHLPSMIDSAQY

SEQ ID NO: 3174905 - protein, 17 aa, Giardia lamblia
VVRKCSDLSLDDLTASP

SEQ ID NO: 3174906 - protein, 18 aa, Giardia lamblia
VVRKGRRLLHDILTAWPL

SEQ ID NO: 3174907 - protein, 18 aa, Giardia lamblia
VVRLRPNLESALDVGYKD

SEQ ID NO: 3174908 - protein, 18 aa, Giardia lamblia
VVRLSADVRAMIEPVRTL

SEQ ID NO: 3174909 - protein, 17 aa, Giardia lamblia
VVRSLCDTCRRFPTLSF

SEQ ID NO: 3174910 - protein, 27 aa, Giardia lamblia
VVRVFKLSPNLLRRHVVEQPKARGPNV

SEQ ID NO: 3174911 - protein, 29 aa, Giardia lamblia
VVRVNCYGILWIGRLCELEPFRPNTFVLG

SEQ ID NO: 3174912 - protein, 25 aa, Giardia lamblia
VVSFFEIYGGKLFDLLNNRQRLQAL

SEQ ID NO: 3174913 - protein, 26 aa, Giardia lamblia
VVSGDLARAWALLPIQHGVRDKHGKT

SEQ ID NO: 3174914 - protein, 17 aa, Giardia lamblia
VVSHCYCSDACFERIIK

SEQ ID NO: 3174915 - protein, 30 aa, Giardia lamblia
VVSILRNEVHYFKLGWIAVMNRSQKDIDAQ

SEQ ID NO: 3174916 - protein, 17 aa, Giardia lamblia
VVSKSFKDVIFLIEDSD

SEQ ID NO: 3174917 - protein, 20 aa, Giardia lamblia
VVSLLLELEGGMINNFGETA

SEQ ID NO: 3174918 - protein, 22 aa, Giardia lamblia
VVSMKGWTALMYAVRENHVECV

SEQ ID NO: 3174919 - protein, 18 aa, Giardia lamblia
VVSPAYKDMIFRLYPNIK

SEQ ID NO: 3174920 - protein, 24 aa, Giardia lamblia
VVSSPRLSLPYQVGDVGGVEVDSG

SEQ ID NO: 3174921 - protein, 19 aa, Giardia lamblia
VVSSTGWRSTAQRPTHARL

SEQ ID NO: 3174922 - protein, 18 aa, Giardia lamblia
VVSTVSLYPIKPAEDGAT

SEQ ID NO: 3174923 - protein, 19 aa, Giardia lamblia
VVSVHILQVFPGIREGHAV

SEQ ID NO: 3174924 - protein, 26 aa, Giardia lamblia
VVSYPMRPSPKWSFRSSDYPTDNKVI

SEQ ID NO: 3174925 - protein, 18 aa, Giardia lamblia
VVTADGWNQVSIHEPKVK

SEQ ID NO: 3174926 - protein, 26 aa, Giardia lamblia
VVTETCRYGLPFTFFTPLIVCNNEIS

SEQ ID NO: 3174927 - protein, 26 aa, Giardia lamblia
VVTFPELWLGGHLIRQRTEVSLKPVL

SEQ ID NO: 3174928 - protein, 18 aa, Giardia lamblia
VVTLGCHNGSLIIWDTRS

SEQ ID NO: 3174929 - protein, 28 aa, Giardia lamblia
VVTQEPWLYTAPCTYTYSKVTDRSLNEL

SEQ ID NO: 3174930 - protein, 18 aa, Giardia lamblia
VVTRLAFELYVPLRPRQG

SEQ ID NO: 3174931 - protein, 22 aa, Giardia lamblia
VVTRPRPPARLIRHMVDEHRKY

SEQ ID NO: 3174932 - protein, 26 aa, Giardia lamblia
VVTTRLEYDLSLALKQGDLVQVLTTS

SEQ ID NO: 3174933 - protein, 20 aa, Giardia lamblia
VVVEAGKAYALPFLEPPPAT

SEQ ID NO: 3174934 - protein, 18 aa, Giardia lamblia
VVVKALYPLSSHLKKMYP

SEQ ID NO: 3174935 - protein, 17 aa, Giardia lamblia
VVVPHYRESKSLLSPAK

SEQ ID NO: 3174936 - protein, 19 aa, Giardia lamblia
VVVPISRDSTWKVPESYNL

SEQ ID NO: 3174937 - protein, 17 aa, Giardia lamblia
VVVWFDLKNYIVTTLKE

SEQ ID NO: 3174938 - protein, 23 aa, Giardia lamblia
VVYELCTLRRPFIELEGESLVDV

SEQ ID NO: 3174939 - protein, 18 aa, Giardia lamblia
VVYPCAPQVPDLQPVNTG

SEQ ID NO: 3174940 - protein, 24 aa, Giardia lamblia
VVYRRRLQDSPARFEEIESAEAEG

SEQ ID NO: 3174941 - protein, 19 aa, Giardia lamblia
VWCAIWMICKQYRESQVYQ

SEQ ID NO: 3174942 - protein, 28 aa, Giardia lamblia
VWIEKGIPICFWISGFFFTQGFLTGCLQ

SEQ ID NO: 3174943 - protein, 20 aa, Giardia lamblia
VWKLFMELFDHLPIAAIVDN

SEQ ID NO: 3174944 - protein, 26 aa, Giardia lamblia
VWKMYMELFDQLPLVAIIDERIFCVH

SEQ ID NO: 3174945 - protein, 17 aa, Giardia lamblia
VWPSAGRIFGTLSETAG

SEQ ID NO: 3174946 - protein, 29 aa, Giardia lamblia
VWQSSTCIQCMLCVTACPHAVIRPYLVSS

SEQ ID NO: 3174947 - protein, 17 aa, Giardia lamblia
VWRMHHEAFVTGTDSVV

SEQ ID NO: 3174948 - protein, 18 aa, Giardia lamblia
VWRNGEWSPLELVNEPTF

SEQ ID NO: 3174949 - protein, 18 aa, Giardia lamblia
VWSLGAIAYELATLRKPD

SEQ ID NO: 3174950 - protein, 18 aa, Giardia lamblia
VYAGKPFILYLYLKAAVS

SEQ ID NO: 3174951 - protein, 23 aa, Giardia lamblia
VYAILDYYPKYLLDILNSRKAYG

SEQ ID NO: 3174952 - protein, 22 aa, Giardia lamblia
VYCFNYLFDRTVLFQSLSNQPL

SEQ ID NO: 3174953 - protein, 23 aa, Giardia lamblia
VYCNPKMALARLVKHGQADKSSH

SEQ ID NO: 3174954 - protein, 22 aa, Giardia lamblia
VYDLSNIFLVFEYCHVDLDQYL

SEQ ID NO: 3174955 - protein, 20 aa, Giardia lamblia
VYEDLEFLRPSSAKKPRRRS

SEQ ID NO: 3174956 - protein, 17 aa, Giardia lamblia
VYEECLTGFKWLGTLSE

SEQ ID NO: 3174957 - protein, 23 aa, Giardia lamblia
VYELCTLTPLFTARSVNDMLQDL

SEQ ID NO: 3174958 - protein, 24 aa, Giardia lamblia
VYFHKCILTRAGRSFSHDAAEEPE

SEQ ID NO: 3174959 - protein, 23 aa, Giardia lamblia
VYGELRQLIIHFFLADDTVEVLE

SEQ ID NO: 3174960 - protein, 18 aa, Giardia lamblia
VYGRTALMRAMKHGYIDC

SEQ ID NO: 3174961 - protein, 26 aa, Giardia lamblia
VYGTCVQPTLAPLVCRKLLMDYSDKV

SEQ ID NO: 3174962 - protein, 19 aa, Giardia lamblia
VYHDLSICYLPVRAENQSV

SEQ ID NO: 3174963 - protein, 18 aa, Giardia lamblia
VYHEAYVIPGERCLLEME

SEQ ID NO: 3174964 - protein, 20 aa, Giardia lamblia
VYHMTRFRRLLSTINNSVDL

SEQ ID NO: 3174965 - protein, 27 aa, Giardia lamblia
VYHSFSFDYPRSYSSVFGQGTDFLEFK

SEQ ID NO: 3174966 - protein, 18 aa, Giardia lamblia
VYHYKPKDPFFLEDNKVH

SEQ ID NO: 3174967 - protein, 18 aa, Giardia lamblia
VYIAPMKALIRERYNDWA

SEQ ID NO: 3174968 - protein, 18 aa, Giardia lamblia
VYICEYCFTMLTTERIYK

SEQ ID NO: 3174969 - protein, 26 aa, Giardia lamblia
VYICLPRYCWTLSAIIAISDIKNKRF

SEQ ID NO: 3174970 - protein, 27 aa, Giardia lamblia
VYIFPCGSRWIGGFLGCEMHGEGHFID

SEQ ID NO: 3174971 - protein, 18 aa, Giardia lamblia
VYIILDFIQGGELFYHLR

SEQ ID NO: 3174972 - protein, 22 aa, Giardia lamblia
VYLFRMRMLFIQTYKKQIYDLF

SEQ ID NO: 3174973 - protein, 17 aa, Giardia lamblia
VYLPIPLGYTTGGPVKK

SEQ ID NO: 3174974 - protein, 18 aa, Giardia lamblia
VYLSCLYLPGTPKYSVAQ

SEQ ID NO: 3174975 - protein, 17 aa, Giardia lamblia
VYMFSIKNNYVIDATLK

SEQ ID NO: 3174976 - protein, 24 aa, Giardia lamblia
VYPAAQAKRGMWYLVYATEAATDT

SEQ ID NO: 3174977 - protein, 25 aa, Giardia lamblia
VYPDLFSHVFCKIRNFKSRMASKLM

SEQ ID NO: 3174978 - protein, 27 aa, Giardia lamblia
VYPKACIPQDMITVWSPSLSCIQSNRL

SEQ ID NO: 3174979 - protein, 17 aa, Giardia lamblia
VYPKIVYIAPMKALIRE

SEQ ID NO: 3174980 - protein, 18 aa, Giardia lamblia
VYPTYDFACPIVDSVEGI

SEQ ID NO: 3174981 - protein, 18 aa, Giardia lamblia
VYPYRLTLQPGERSAIYI

SEQ ID NO: 3174982 - protein, 21 aa, Giardia lamblia
VYPYVRYTSEPSFVLLGVSKG

SEQ ID NO: 3174983 - protein, 26 aa, Giardia lamblia
VYQLPFNMSFIPTWTKKLVVVTEPGV

SEQ ID NO: 3174984 - protein, 23 aa, Giardia lamblia
VYQPACGFIHSCIAQTNGSSSKS

SEQ ID NO: 3174985 - protein, 18 aa, Giardia lamblia
VYRDKVLSVMQCLGNSSP

SEQ ID NO: 3174986 - protein, 22 aa, Giardia lamblia
VYSHDLSYCLYQMAHHPPELLE

SEQ ID NO: 3174987 - protein, 24 aa, Giardia lamblia
VYSRKLKAIILGVAHYLSSAVGSV

SEQ ID NO: 3174988 - protein, 21 aa, Giardia lamblia
VYSSLRYTSIMSGRTLGGISL

SEQ ID NO: 3174989 - protein, 29 aa, Giardia lamblia
VYTAVWCPFKSTCLISGTRAGSVEIWDIA

SEQ ID NO: 3174990 - protein, 19 aa, Giardia lamblia
VYTDDTILMALKLHNSDVL

SEQ ID NO: 3174991 - protein, 22 aa, Giardia lamblia
VYTGPGFRWTPIYRPPEVFGST

SEQ ID NO: 3174992 - protein, 19 aa, Giardia lamblia
VYTKRGWTPVSERTIYGLP

SEQ ID NO: 3174993 - protein, 24 aa, Giardia lamblia
VYTLCPRYLAGFCPEGPNCTMQHP

SEQ ID NO: 3174994 - protein, 24 aa, Giardia lamblia
VYVPKLVAALGMNSARRLVQSAHK

SEQ ID NO: 3174995 - protein, 25 aa, Giardia lamblia
VYVWNWCQYERNIAKQQYDMLVYGH

SEQ ID NO: 3174996 - protein, 24 aa, Giardia lamblia
VYYDISMTMWYLGKTTSEIIQLIT

SEQ ID NO: 3174997 - protein, 23 aa, Giardia lamblia
WAAEKGYHEIVHFMSETQARCQD

SEQ ID NO: 3174998 - protein, 19 aa, Giardia lamblia
WAALFGRTEVVKLLLDVEG

SEQ ID NO: 3174999 - protein, 23 aa, Giardia lamblia
WADECDVSHVMHLFKEYTANILG

SEQ ID NO: 3175000 - protein, 25 aa, Giardia lamblia
WADKHPRCVNGIFIGLLDYVMGASP

SEQ ID NO: 3175001 - protein, 21 aa, Giardia lamblia
WADSRAPPPLKRDTPQCQVDP

SEQ ID NO: 3175002 - protein, 20 aa, Giardia lamblia
WAELMVRARNTLKCKAGAQV

SEQ ID NO: 3175003 - protein, 17 aa, Giardia lamblia
WAIDGRIFPSVFLDGEL

SEQ ID NO: 3175004 - protein, 20 aa, Giardia lamblia
WAINCHKSVDPTCKNRIIQI

SEQ ID NO: 3175005 - protein, 18 aa, Giardia lamblia
WALAILHRILSLKFPISL

SEQ ID NO: 3175006 - protein, 18 aa, Giardia lamblia
WALDWAFPSDEEIVSKTG

SEQ ID NO: 3175007 - protein, 18 aa, Giardia lamblia
WALGCLIYEICLRKKPSF

SEQ ID NO: 3175008 - protein, 19 aa, Giardia lamblia
WANPEGYTALMLAALNDAE

SEQ ID NO: 3175009 - protein, 27 aa, Giardia lamblia
WAQDSFGWCPLLYAIGFNRAYAVRCIL

SEQ ID NO: 3175010 - protein, 18 aa, Giardia lamblia
WAQTFLLHTVPLLEQTIK

SEQ ID NO: 3175011 - protein, 17 aa, Giardia lamblia
WAQVWSGYDIDERVCDI

SEQ ID NO: 3175012 - protein, 17 aa, Giardia lamblia
WASCRITEVAKLESSIR

SEQ ID NO: 3175013 - protein, 23 aa, Giardia lamblia
WASGYLPPLHRLRSRIRNLRSDV

SEQ ID NO: 3175014 - protein, 27 aa, Giardia lamblia
WASTVKFRAELYLKMGADAKKDEGTTS

SEQ ID NO: 3175015 - protein, 26 aa, Giardia lamblia
WATEFQTWFPNFSILLYKGDQEQRAK

SEQ ID NO: 3175016 - protein, 17 aa, Giardia lamblia
WATELNRNAILEDMKEY

SEQ ID NO: 3175017 - protein, 19 aa, Giardia lamblia
WAVLSHPQMTFPLSDSDPD

SEQ ID NO: 3175018 - protein, 17 aa, Giardia lamblia
WCAIWMICKQYRESQAY

SEQ ID NO: 3175019 - protein, 18 aa, Giardia lamblia
WCDNFVLTMMLAYKNWIF

SEQ ID NO: 3175020 - protein, 24 aa, Giardia lamblia
WCGEDRPLLWWNLLSRVVQNEGGG

SEQ ID NO: 3175021 - protein, 21 aa, Giardia lamblia
WCIYPSYDFSHCLIDAFEHIT

SEQ ID NO: 3175022 - protein, 20 aa, Giardia lamblia
WCLGCVLYSLCILQPPQFAP

SEQ ID NO: 3175023 - protein, 21 aa, Giardia lamblia
WCPDGSLAGLLRRQRRAGPFS

SEQ ID NO: 3175024 - protein, 21 aa, Giardia lamblia
WCQAIPLYTYHGSHQQRRQKL

SEQ ID NO: 3175025 - protein, 17 aa, Giardia lamblia
WCTESTLNIAMEAGLCS

SEQ ID NO: 3175026 - protein, 19 aa, Giardia lamblia
WDAAVIMSRYFVKNPEPLS

SEQ ID NO: 3175027 - protein, 19 aa, Giardia lamblia
WDAQRLYGLLTEYVNLFAL

SEQ ID NO: 3175028 - protein, 21 aa, Giardia lamblia
WDAYPTAISRIVFLCRTIPVV

SEQ ID NO: 3175029 - protein, 25 aa, Giardia lamblia
WDDEWKTCFLKAVLSLGIGNAKTMS

SEQ ID NO: 3175030 - protein, 19 aa, Giardia lamblia
WDGDLALFKALLRPSKVSA

SEQ ID NO: 3175031 - protein, 24 aa, Giardia lamblia
WDHCSPRLRRLFQPPHYFRDHYSR

SEQ ID NO: 3175032 - protein, 24 aa, Giardia lamblia
WDHENRTALMYAVRQGHLEATMLL

SEQ ID NO: 3175033 - protein, 21 aa, Giardia lamblia
WDKKGGCIRDSILKDLFPELP

SEQ ID NO: 3175034 - protein, 20 aa, Giardia lamblia
WDLGCLLFALIFQKYPFRKP

SEQ ID NO: 3175035 - protein, 18 aa, Giardia lamblia
WDLNTAKCIATFSNVHSG

SEQ ID NO: 3175036 - protein, 17 aa, Giardia lamblia
WDPMLLHIFSVSTEVLP

SEQ ID NO: 3175037 - protein, 20 aa, Giardia lamblia
WDQTLRYVLVNLITGNMCGT

SEQ ID NO: 3175038 - protein, 20 aa, Giardia lamblia
WDSTGLRLVLAAGKNIYIAT

SEQ ID NO: 3175039 - protein, 17 aa, Giardia lamblia
WDTRSQLLATLMDGIAP

SEQ ID NO: 3175040 - protein, 42 aa, Giardia lamblia
WDYLFDSQFRFQSCSLLFWHAFIFLLRVIRWASSQGPRHNVW

SEQ ID NO: 3175041 - protein, 17 aa, Giardia lamblia
WDYYLARLSGAIYKIIV

SEQ ID NO: 3175042 - protein, 17 aa, Giardia lamblia
WEAAGFFSPDMQKNIRS

SEQ ID NO: 3175043 - protein, 20 aa, Giardia lamblia
WEALLRVRRLIIFPIEDQEV

SEQ ID NO: 3175044 - protein, 20 aa, Giardia lamblia
WEALTRDRLKIIHSEEEEVK

SEQ ID NO: 3175045 - protein, 18 aa, Giardia lamblia
WEDAFLKYIGKTREDLQM

SEQ ID NO: 3175046 - protein, 17 aa, Giardia lamblia
WEENFRSAHALYLTSTV

SEQ ID NO: 3175047 - protein, 20 aa, Giardia lamblia
WEGKCPICDAHVSHLPHVDE

SEQ ID NO: 3175048 - protein, 18 aa, Giardia lamblia
WEICGELVSTLLHLRTCL

SEQ ID NO: 3175049 - protein, 25 aa, Giardia lamblia
WEILYHVLSGLAYLHMYARNTIPWA

SEQ ID NO: 3175050 - protein, 26 aa, Giardia lamblia
WEINCDELRSAASMLNARACKLAWDV

SEQ ID NO: 3175051 - protein, 18 aa, Giardia lamblia
WEITRIGVAILDALEYLH

SEQ ID NO: 3175052 - protein, 20 aa, Giardia lamblia
WEKDKGRKGPALFSFHSVSK

SEQ ID NO: 3175053 - protein, 18 aa, Giardia lamblia
WEKNSCSSLFPRTRQDNH

SEQ ID NO: 3175054 - protein, 19 aa, Giardia lamblia
WEKSLELPGGKNPLMVCIE

SEQ ID NO: 3175055 - protein, 22 aa, Giardia lamblia
WELRARALRLYQIKQKATHTTQ

SEQ ID NO: 3175056 - protein, 22 aa, Giardia lamblia
WEMRQRTELILWATSYPEGPTV

SEQ ID NO: 3175057 - protein, 23 aa, Giardia lamblia
WENGKLCIRMKFPNEYPIKPPSV

SEQ ID NO: 3175058 - protein, 25 aa, Giardia lamblia
WENGKMCGHGKFVYREGDIYEGEFL

SEQ ID NO: 3175059 - protein, 17 aa, Giardia lamblia
WENRSMYCVMTIFGVSI

SEQ ID NO: 3175060 - protein, 24 aa, Giardia lamblia
WEPIVEVMNPLAWTPHAIQVVTKL

SEQ ID NO: 3175061 - protein, 18 aa, Giardia lamblia
WEPMLTLRRHRHPISSVA

SEQ ID NO: 3175062 - protein, 22 aa, Giardia lamblia
WERDTVAAFETCVILLSTYQSW

SEQ ID NO: 3175063 - protein, 17 aa, Giardia lamblia
WERLSVLGAGKQGGRPW

SEQ ID NO: 3175064 - protein, 25 aa, Giardia lamblia
WESMQRRRIATIIGQGHQLSAEYDM

SEQ ID NO: 3175065 - protein, 21 aa, Giardia lamblia
WEVLTQMLLALTFLHSSEGKS

SEQ ID NO: 3175066 - protein, 34 aa, Giardia lamblia
WEYPDELDIHPAFELRTLLKGWRGLKSMRTSPWR

SEQ ID NO: 3175067 - protein, 17 aa, Giardia lamblia
WFDCLLSDLAAKYSGRL

SEQ ID NO: 3175068 - protein, 18 aa, Giardia lamblia
WFECALAGNAASIRNAKK

SEQ ID NO: 3175069 - protein, 18 aa, Giardia lamblia
WFKAVLNHDLLNVEESLS

SEQ ID NO: 3175070 - protein, 17 aa, Giardia lamblia
WFLCQVCEDEGDYVQQG

SEQ ID NO: 3175071 - protein, 20 aa, Giardia lamblia
WFLHKCPPLPQMAGLLGELR

SEQ ID NO: 3175072 - protein, 18 aa, Giardia lamblia
WFLPELQGAVNVFERSRR

SEQ ID NO: 3175073 - protein, 21 aa, Giardia lamblia
WFQDETRVFLVLEVAPYGELY

SEQ ID NO: 3175074 - protein, 17 aa, Giardia lamblia
WFSIFPFEKDTSPCYPV

SEQ ID NO: 3175075 - protein, 24 aa, Giardia lamblia
WFSQLKYYLELVGSDFDQPSNKKK

SEQ ID NO: 3175076 - protein, 24 aa, Giardia lamblia
WFSSLLAPKCVILKDSLEVEEAGF

SEQ ID NO: 3175077 - protein, 26 aa, Giardia lamblia
WFTSLATRCGVLWLNRSLTFGGKDPK

SEQ ID NO: 3175078 - protein, 25 aa, Giardia lamblia
WFYVNEIRPMYSLQVDNSPCGRLLI

SEQ ID NO: 3175079 - protein, 17 aa, Giardia lamblia
WGCVPDACVTEYADGVR

SEQ ID NO: 3175080 - protein, 18 aa, Giardia lamblia
WGDYDSWKTRFRVDKMNG

SEQ ID NO: 3175081 - protein, 17 aa, Giardia lamblia
WGGATFDTSLRFLDENP

SEQ ID NO: 3175082 - protein, 23 aa, Giardia lamblia
WGGKRLQLTGSLLADKFRFEYEL

SEQ ID NO: 3175083 - protein, 19 aa, Giardia lamblia
WGSQGFKVGLCNNKPPHAD

SEQ ID NO: 3175084 - protein, 18 aa, Giardia lamblia
WHANLPICQEASGFQPVG

SEQ ID NO: 3175085 - protein, 30 aa, Giardia lamblia
WHERLPSKFTALILACYHGRLKAATILLPF

SEQ ID NO: 3175086 - protein, 17 aa, Giardia lamblia
WHGANMALGELIRHGYL

SEQ ID NO: 3175087 - protein, 19 aa, Giardia lamblia
WHPNSCYFSPMPVYNLPQV

SEQ ID NO: 3175088 - protein, 18 aa, Giardia lamblia
WHSRSCLTTDSFKNTILA

SEQ ID NO: 3175089 - protein, 18 aa, Giardia lamblia
WHTGVVEEVCYSRALFES

SEQ ID NO: 3175090 - protein, 21 aa, Giardia lamblia
WHYRLSALLYAGLRVERPVHR

SEQ ID NO: 3175091 - protein, 23 aa, Giardia lamblia
WIALRCLRLVASAFINQEQENPF

SEQ ID NO: 3175092 - protein, 23 aa, Giardia lamblia
WICREGFARFSLRPFTANADTRD

SEQ ID NO: 3175093 - protein, 17 aa, Giardia lamblia
WIGAMARSVDGNGETAL

SEQ ID NO: 3175094 - protein, 25 aa, Giardia lamblia
WIHCYKTGLWGPAVPIAERPENISG

SEQ ID NO: 3175095 - protein, 20 aa, Giardia lamblia
WIKASPWYLLILTFVPVNKY

SEQ ID NO: 3175096 - protein, 23 aa, Giardia lamblia
WIPKQNSVCLVSSLNFLKIFRVL

SEQ ID NO: 3175097 - protein, 18 aa, Giardia lamblia
WIRERFDNSLSRRSLDDT

SEQ ID NO: 3175098 - protein, 25 aa, Giardia lamblia
WISKLSKLRPTIAFHASIEHPFGRN

SEQ ID NO: 3175099 - protein, 25 aa, Giardia lamblia
WISSMPLNALQVLYSRGPGMLPSII

SEQ ID NO: 3175100 - protein, 17 aa, Giardia lamblia
WIVPAINAEGIRVGNYR

SEQ ID NO: 3175101 - protein, 26 aa, Giardia lamblia
WKDAFSDLLLVLGLYPSGRVQRLFIT

SEQ ID NO: 3175102 - protein, 17 aa, Giardia lamblia
WKDSYSIIDSATMNKYG

SEQ ID NO: 3175103 - protein, 21 aa, Giardia lamblia
WKEIGKKLGLPASVTNAGYTL

SEQ ID NO: 3175104 - protein, 20 aa, Giardia lamblia
WKIIAHKMSSYRGGHKPCNS

SEQ ID NO: 3175105 - protein, 21 aa, Giardia lamblia
WKKDTALMMTARYGILKICSE

SEQ ID NO: 3175106 - protein, 19 aa, Giardia lamblia
WKKTVIKTFSRKGEKVVNM

SEQ ID NO: 3175107 - protein, 17 aa, Giardia lamblia
WKLIYELNYELDDRMQS

SEQ ID NO: 3175108 - protein, 20 aa, Giardia lamblia
WKPGRHHSRSNFQMINYSYD

SEQ ID NO: 3175109 - protein, 17 aa, Giardia lamblia
WKPYLLLQTDPQMILDI

SEQ ID NO: 3175110 - protein, 20 aa, Giardia lamblia
WKQEISRWCQAIPLYTYHGS

SEQ ID NO: 3175111 - protein, 27 aa, Giardia lamblia
WKQPNLDTAYLLSIRMDLDAAFSSCLQ

SEQ ID NO: 3175112 - protein, 17 aa, Giardia lamblia
WKSALMRSGQLGNSMTA

SEQ ID NO: 3175113 - protein, 24 aa, Giardia lamblia
WKSLKSACLNKYVRLTGVVTTKST

SEQ ID NO: 3175114 - protein, 20 aa, Giardia lamblia
WKSNRLPIVGRFAALSPNAS

SEQ ID NO: 3175115 - protein, 17 aa, Giardia lamblia
WKSSRYIIRELKHKEQQ

SEQ ID NO: 3175116 - protein, 18 aa, Giardia lamblia
WKTHGMIYTAVFITTNEP

SEQ ID NO: 3175117 - protein, 26 aa, Giardia lamblia
WKTMARGLLLLGRINSYYSKKAAASG

SEQ ID NO: 3175118 - protein, 17 aa, Giardia lamblia
WKVASQLLKALVDLYAI

SEQ ID NO: 3175119 - protein, 21 aa, Giardia lamblia
WKVLYDICRGLLYLHSKVRTT

SEQ ID NO: 3175120 - protein, 19 aa, Giardia lamblia
WKYTLEYANILRRHNRLVE

SEQ ID NO: 3175121 - protein, 19 aa, Giardia lamblia
WLAALPRLLREAIDLHILN

SEQ ID NO: 3175122 - protein, 21 aa, Giardia lamblia
WLAGDCQGFLRAFHMRPDGSV

SEQ ID NO: 3175123 - protein, 22 aa, Giardia lamblia
WLARFRTLCLVYREKTGSFDKP

SEQ ID NO: 3175124 - protein, 20 aa, Giardia lamblia
WLEMRSRYNIDEVFSPLTPR

SEQ ID NO: 3175125 - protein, 18 aa, Giardia lamblia
WLGPGDYMLVEFLSTKSQ

SEQ ID NO: 3175126 - protein, 17 aa, Giardia lamblia
WLGPGRYNAKQRIQEAE

SEQ ID NO: 3175127 - protein, 28 aa, Giardia lamblia
WLGTAGAVVSCLWAYPELSKLTHILIMN

SEQ ID NO: 3175128 - protein, 19 aa, Giardia lamblia
WLHQGIRLKGPKQLKTAYL

SEQ ID NO: 3175129 - protein, 26 aa, Giardia lamblia
WLKGDRATKWYSYHAALATDLLLVHA

SEQ ID NO: 3175130 - protein, 23 aa, Giardia lamblia
WLKKYPCLRCLYRAIPSRELRQV

SEQ ID NO: 3175131 - protein, 19 aa, Giardia lamblia
WLLIVLCITETYFSGTITT

SEQ ID NO: 3175132 - protein, 20 aa, Giardia lamblia
WLNQLGVIFRFVKRPEDEFV

SEQ ID NO: 3175133 - protein, 19 aa, Giardia lamblia
WLNSYNCAMSISGKSTTNA

SEQ ID NO: 3175134 - protein, 19 aa, Giardia lamblia
WLPRQHKWQDINGRTALMC

SEQ ID NO: 3175135 - protein, 19 aa, Giardia lamblia
WLPSADFLLSKDGANLIPE

SEQ ID NO: 3175136 - protein, 27 aa, Giardia lamblia
WLQRNPEVFYGFWGYCFNSYRDTTPHE

SEQ ID NO: 3175137 - protein, 18 aa, Giardia lamblia
WLQRSRITLDTDVKKFTF

SEQ ID NO: 3175138 - protein, 23 aa, Giardia lamblia
WLQRSWGATVSMFYRGLSKTRRA

SEQ ID NO: 3175139 - protein, 17 aa, Giardia lamblia
WLRGRAGVLRIGDRRIS

SEQ ID NO: 3175140 - protein, 20 aa, Giardia lamblia
WLRTHEIPSFINAKPNQGHI

SEQ ID NO: 3175141 - protein, 17 aa, Giardia lamblia
WLSDYIFDKKNKKKGKK

SEQ ID NO: 3175142 - protein, 25 aa, Giardia lamblia
WLTKGRPNSYWLSGYFNPQGFLTSV

SEQ ID NO: 3175143 - protein, 17 aa, Giardia lamblia
WLVVRSSINTHMLDFIL

SEQ ID NO: 3175144 - protein, 21 aa, Giardia lamblia
WMKSHCKYDAKGPNRSNITGF

SEQ ID NO: 3175145 - protein, 29 aa, Giardia lamblia
WMLQARAGKRTGFAMVRIAIDMCKEGMLT

SEQ ID NO: 3175146 - protein, 20 aa, Giardia lamblia
WMQRRLKHAELFFDCVRLDH

SEQ ID NO: 3175147 - protein, 18 aa, Giardia lamblia
WMSQLMVAHHGPIWTSEF

SEQ ID NO: 3175148 - protein, 22 aa, Giardia lamblia
WNAEALAGVAMYELNSIHPAFL

SEQ ID NO: 3175149 - protein, 17 aa, Giardia lamblia
WNALKYLVASIIYGGRV

SEQ ID NO: 3175150 - protein, 22 aa, Giardia lamblia
WNFCTMHKACQCVRTRKINSIC

SEQ ID NO: 3175151 - protein, 18 aa, Giardia lamblia
WNGDIWFHVDKHSSAHVY

SEQ ID NO: 3175152 - protein, 17 aa, Giardia lamblia
WNGLKFVGPSSIFLTPD

SEQ ID NO: 3175153 - protein, 26 aa, Giardia lamblia
WNIRDGPWIPTLRLLQRYPTLLPVLL

SEQ ID NO: 3175154 - protein, 19 aa, Giardia lamblia
WNLLIERATFAFAVEHLMN

SEQ ID NO: 3175155 - protein, 20 aa, Giardia lamblia
WNMAVEYEAAFLLKEAIAYF

SEQ ID NO: 3175156 - protein, 18 aa, Giardia lamblia
WNMTDFGPLLAASERPSG

SEQ ID NO: 3175157 - protein, 18 aa, Giardia lamblia
WNRCECVKVLAPTEAIIS

SEQ ID NO: 3175158 - protein, 18 aa, Giardia lamblia
WNTALAFANVDVDQVAKA

SEQ ID NO: 3175159 - protein, 17 aa, Giardia lamblia
WPIPPEYEERYFVAPQK

SEQ ID NO: 3175160 - protein, 18 aa, Giardia lamblia
WPITRYPKRTTIEDVVSS

SEQ ID NO: 3175161 - protein, 23 aa, Giardia lamblia
WPKDRRGSLRRQLGCHSLEKLVD

SEQ ID NO: 3175162 - protein, 20 aa, Giardia lamblia
WPLLSCTIGYHPTRAAELVT

SEQ ID NO: 3175163 - protein, 25 aa, Giardia lamblia
WPMTPRATVFLNIMAPDLTQSLHNI

SEQ ID NO: 3175164 - protein, 20 aa, Giardia lamblia
WPRCDTEGLCLAAANTSLYA

SEQ ID NO: 3175165 - protein, 18 aa, Giardia lamblia
WPSASRGESTFNSDASRQ

SEQ ID NO: 3175166 - protein, 17 aa, Giardia lamblia
WPSFVSPLDYRVVAYTH

SEQ ID NO: 3175167 - protein, 26 aa, Giardia lamblia
WPSIFGEPSGLCFSHDASFLAVTTRF

SEQ ID NO: 3175168 - protein, 21 aa, Giardia lamblia
WPSNLYPIRFFVLASSTSNES

SEQ ID NO: 3175169 - protein, 20 aa, Giardia lamblia
WPTIYDFLLDFSSLRIPLGK

SEQ ID NO: 3175170 - protein, 21 aa, Giardia lamblia
WPVEFWSKHDVSVWLSSIDMK

SEQ ID NO: 3175171 - protein, 17 aa, Giardia lamblia
WPVFRYNPSKPIGDRMK

SEQ ID NO: 3175172 - protein, 17 aa, Giardia lamblia
WPVLEYYTSYPPNYGGA

SEQ ID NO: 3175173 - protein, 26 aa, Giardia lamblia
WQDCCLIAKCLVRILGAYIVESLDSD

SEQ ID NO: 3175174 - protein, 33 aa, Giardia lamblia
WQDINGRTALMCAVESKASLAIIKLLVPLEAGV

SEQ ID NO: 3175175 - protein, 17 aa, Giardia lamblia
WQGTALIKAARKGHVEC

SEQ ID NO: 3175176 - protein, 22 aa, Giardia lamblia
WQIFKGLASALVYLHSPEKKPT

SEQ ID NO: 3175177 - protein, 28 aa, Giardia lamblia
WQIKGYVPKTFWIGAFFFPHGLLTAELQ

SEQ ID NO: 3175178 - protein, 21 aa, Giardia lamblia
WQKGRAEGGVIIRPSEGLQAE

SEQ ID NO: 3175179 - protein, 17 aa, Giardia lamblia
WQKRFGRRLDYEERKRK

SEQ ID NO: 3175180 - protein, 17 aa, Giardia lamblia
WQLSGKFVAVTLQAEPV

SEQ ID NO: 3175181 - protein, 18 aa, Giardia lamblia
WQPLRLATPYDIIRTPSL

SEQ ID NO: 3175182 - protein, 27 aa, Giardia lamblia
WQPQKIKPLKKMRYVVTPIPLPAATVS

SEQ ID NO: 3175183 - protein, 17 aa, Giardia lamblia
WQQPAKFSREWKLHQVV

SEQ ID NO: 3175184 - protein, 17 aa, Giardia lamblia
WQRDVAPEISFAPAARS

SEQ ID NO: 3175185 - protein, 19 aa, Giardia lamblia
WQSLNKASLFVKRQNLAEF

SEQ ID NO: 3175186 - protein, 18 aa, Giardia lamblia
WQTGKGIVISWFNMGNPD

SEQ ID NO: 3175187 - protein, 17 aa, Giardia lamblia
WQTSGPAADIWSLGLII

SEQ ID NO: 3175188 - protein, 33 aa, Giardia lamblia
WQYDAHGLHRRFLCEVCGELFYYGQKVFDKHFL

SEQ ID NO: 3175189 - protein, 17 aa, Giardia lamblia
WRDDLSINYTTRDMYHS

SEQ ID NO: 3175190 - protein, 18 aa, Giardia lamblia
WREPEFRPEDNKSGALLD

SEQ ID NO: 3175191 - protein, 17 aa, Giardia lamblia
WRGVNTLASGDFSKHIP

SEQ ID NO: 3175192 - protein, 19 aa, Giardia lamblia
WRLWAEVVPKCEYPPKTET

SEQ ID NO: 3175193 - protein, 17 aa, Giardia lamblia
WRRIGDVAVKSGLQPKD

SEQ ID NO: 3175194 - protein, 22 aa, Giardia lamblia
WRSELLCALFSILRAGGALNQQ

SEQ ID NO: 3175195 - protein, 20 aa, Giardia lamblia
WRSISNRSFLRKPLRITFDW

SEQ ID NO: 3175196 - protein, 26 aa, Giardia lamblia
WRSLRRCSYPQSIAISLGQVYKIQAV

SEQ ID NO: 3175197 - protein, 18 aa, Giardia lamblia
WRTPVKPIRRSCRTTAIK

SEQ ID NO: 3175198 - protein, 19 aa, Giardia lamblia
WRVVAALCDAARFMHSEEK

SEQ ID NO: 3175199 - protein, 19 aa, Giardia lamblia
WRVVVPSPRPLEIVEYGVI

SEQ ID NO: 3175200 - protein, 20 aa, Giardia lamblia
WSALMYAAAYGYGDCVEYLL

SEQ ID NO: 3175201 - protein, 17 aa, Giardia lamblia
WSCAQLLEHPWIKSVDN

SEQ ID NO: 3175202 - protein, 17 aa, Giardia lamblia
WSCFKCEQEALELHISR

SEQ ID NO: 3175203 - protein, 29 aa, Giardia lamblia
WSDICKRAPVYCYHCFAMKDIKAQQSKPK

SEQ ID NO: 3175204 - protein, 23 aa, Giardia lamblia
WSEPFAPKFYRFLTLAYALSDYE

SEQ ID NO: 3175205 - protein, 17 aa, Giardia lamblia
WSEYIDVFSTGPCIALE

SEQ ID NO: 3175206 - protein, 25 aa, Giardia lamblia
WSFGLLLWTMCTLRHPLFNLDEVTE

SEQ ID NO: 3175207 - protein, 19 aa, Giardia lamblia
WSFMCRYIPVGILDEPQKL

SEQ ID NO: 3175208 - protein, 22 aa, Giardia lamblia
WSFSSSSPWNTSAMKVMIGHDL

SEQ ID NO: 3175209 - protein, 19 aa, Giardia lamblia
WSGAIKMPWTDGSKSKGAQ

SEQ ID NO: 3175210 - protein, 21 aa, Giardia lamblia
WSGSTLIGIMAYVAPEVLLHN

SEQ ID NO: 3175211 - protein, 17 aa, Giardia lamblia
WSGVPVVGFVGEYILSR

SEQ ID NO: 3175212 - protein, 20 aa, Giardia lamblia
WSILSGFSLPKGVFDFIDEG

SEQ ID NO: 3175213 - protein, 17 aa, Giardia lamblia
WSKAIPPTAFSNRLRTE

SEQ ID NO: 3175214 - protein, 17 aa, Giardia lamblia
WSLGIMLYAMLIGKLPF

SEQ ID NO: 3175215 - protein, 28 aa, Giardia lamblia
WSLGITLYEICSFRLPYPSPTIDDLQKR

SEQ ID NO: 3175216 - protein, 18 aa, Giardia lamblia
WSLGMLIYTMCTLQAPEG

SEQ ID NO: 3175217 - protein, 20 aa, Giardia lamblia
WSLSDRKLLYVFTGHTDYVR

SEQ ID NO: 3175218 - protein, 21 aa, Giardia lamblia
WSLTPCLDRGDNLNIDECADL

SEQ ID NO: 3175219 - protein, 18 aa, Giardia lamblia
WSNLTSWLLHALANICPS

SEQ ID NO: 3175220 - protein, 37 aa, Giardia lamblia
WSNPSLLPRFVVGNVIKRFFIRTISDFQLHYCTGCGF

SEQ ID NO: 3175221 - protein, 36 aa, Giardia lamblia
WSPDLASVSWLAQFVFPFVKFWERDTVAAFETCVIL

SEQ ID NO: 3175222 - protein, 17 aa, Giardia lamblia
WSPIITFTDIIVGFTSL

SEQ ID NO: 3175223 - protein, 17 aa, Giardia lamblia
WSPPLIDTVIHEYLKLL

SEQ ID NO: 3175224 - protein, 18 aa, Giardia lamblia
WSQILSRMAANTSTGFTQ

SEQ ID NO: 3175225 - protein, 23 aa, Giardia lamblia
WSQLSHPCLLKIHEVLHEVQSKQ

SEQ ID NO: 3175226 - protein, 19 aa, Giardia lamblia
WSSFLARLRQEAVDPKLEG

SEQ ID NO: 3175227 - protein, 19 aa, Giardia lamblia
WSTACRTLGNLMINTDGPF

SEQ ID NO: 3175228 - protein, 23 aa, Giardia lamblia
WSTPETHRGRLLSRLPNIPLFVY

SEQ ID NO: 3175229 - protein, 20 aa, Giardia lamblia
WSTPVARPQRPVHMSKNSTM

SEQ ID NO: 3175230 - protein, 26 aa, Giardia lamblia
WSVARRIVKGKMPFISSQLMTKGYRV

SEQ ID NO: 3175231 - protein, 24 aa, Giardia lamblia
WSVGCIIYEMCCLRRPPWDAKTLE

SEQ ID NO: 3175232 - protein, 25 aa, Giardia lamblia
WSYCKAKTVHLGYCPVKDYNGPASV

SEQ ID NO: 3175233 - protein, 18 aa, Giardia lamblia
WTALMWAAENGYVDCVKL

SEQ ID NO: 3175234 - protein, 20 aa, Giardia lamblia
WTALMWAALFGRTEVVKLLL

SEQ ID NO: 3175235 - protein, 19 aa, Giardia lamblia
WTALMWAALFGRTEVVRLL

SEQ ID NO: 3175236 - protein, 24 aa, Giardia lamblia
WTASLRYKLEFIYERISKISRVLG

SEQ ID NO: 3175237 - protein, 34 aa, Giardia lamblia
WTEKEVKEFYTILVRWGSLQFKKISSVLQPDEEG

SEQ ID NO: 3175238 - protein, 24 aa, Giardia lamblia
WTFKQLKCTYVRSIGGIPSNEAVL

SEQ ID NO: 3175239 - protein, 18 aa, Giardia lamblia
WTGAFIVCPDCAQIYPCR

SEQ ID NO: 3175240 - protein, 19 aa, Giardia lamblia
WTGNTIFCRLGCTFEPKIT

SEQ ID NO: 3175241 - protein, 32 aa, Giardia lamblia
WTKGNCARCNFRLEPPITYLGCGHAFHGNCLQ

SEQ ID NO: 3175242 - protein, 18 aa, Giardia lamblia
WTKHCIGTLEGHNDMIVD

SEQ ID NO: 3175243 - protein, 17 aa, Giardia lamblia
WTLRVLVPKIATLKQNS

SEQ ID NO: 3175244 - protein, 30 aa, Giardia lamblia
WTMCGTPNFLPSEVIYSHIMKRKASGRGPD

SEQ ID NO: 3175245 - protein, 19 aa, Giardia lamblia
WTNSEIMCLASMVSSVTSW

SEQ ID NO: 3175246 - protein, 18 aa, Giardia lamblia
WTPIYRPPEVFGSTLEVG

SEQ ID NO: 3175247 - protein, 17 aa, Giardia lamblia
WTPLMCAAADGDIEAVK

SEQ ID NO: 3175248 - protein, 26 aa, Giardia lamblia
WTRETRLWGEYAYLLAASRDFDKAVV

SEQ ID NO: 3175249 - protein, 17 aa, Giardia lamblia
WTTHVELLLTIAKWEAR

SEQ ID NO: 3175250 - protein, 18 aa, Giardia lamblia
WTTLMIGTVFTFTELNKN

SEQ ID NO: 3175251 - protein, 17 aa, Giardia lamblia
WTTRWMQEMVRGKNSQI

SEQ ID NO: 3175252 - protein, 19 aa, Giardia lamblia
WTVTLIGDRVSDFFSSLVD

SEQ ID NO: 3175253 - protein, 20 aa, Giardia lamblia
WVATMRGDMLLFDFTSNKIL

SEQ ID NO: 3175254 - protein, 28 aa, Giardia lamblia
WVELARLFLNPAYNCFNTATAEDALAKA

SEQ ID NO: 3175255 - protein, 21 aa, Giardia lamblia
WVFVSSINPLIIFQWTSPYLR

SEQ ID NO: 3175256 - protein, 18 aa, Giardia lamblia
WVITDAFGAYTYAAATEF

SEQ ID NO: 3175257 - protein, 24 aa, Giardia lamblia
WVNEALKYLDLCESLSQESIGQEN

SEQ ID NO: 3175258 - protein, 18 aa, Giardia lamblia
WVQEHLIPKGIVDSVDDV

SEQ ID NO: 3175259 - protein, 23 aa, Giardia lamblia
WVRMAYCSPEHNIAMSVLVQGYF

SEQ ID NO: 3175260 - protein, 17 aa, Giardia lamblia
WVRVKYIIPHSIKQAVE

SEQ ID NO: 3175261 - protein, 18 aa, Giardia lamblia
WYEMGAHYTRIFQKVAND

SEQ ID NO: 3175262 - protein, 26 aa, Giardia lamblia
WYGHIECVKLLLAEMGLQDKLGYTAL

SEQ ID NO: 3175263 - protein, 27 aa, Giardia lamblia
WYHLQFIYELLLRFIFAANQHPQHSEY

SEQ ID NO: 3175264 - protein, 25 aa, Giardia lamblia
WYMAPELRRAFSRYGSLCQLSTKCD

SEQ ID NO: 3175265 - protein, 17 aa, Giardia lamblia
WYMIGMRTVHHLDLAFR

SEQ ID NO: 3175266 - protein, 17 aa, Giardia lamblia
WYVSLFVQAIADAEQAD

SEQ ID NO: 3175267 - protein, 19 aa, Giardia lamblia
WYYDGIKYISMDGERSSDR

SEQ ID NO: 3175268 - protein, 24 aa, Giardia lamblia
YAAHPFGYFAVRKIVFSDCKGYVV

SEQ ID NO: 3175269 - protein, 18 aa, Giardia lamblia
YAANVVEFIELHSFLTKG

SEQ ID NO: 3175270 - protein, 26 aa, Giardia lamblia
YACKSSGTYICRACHLALFSSGDKFD

SEQ ID NO: 3175271 - protein, 24 aa, Giardia lamblia
YACVDYLRKAECGMKRNDGKCALI

SEQ ID NO: 3175272 - protein, 28 aa, Giardia lamblia
YADLKRLFWISCGQLGLIPNLGMENMVS

SEQ ID NO: 3175273 - protein, 20 aa, Giardia lamblia
YADQEFRFYSSREKASTVDK

SEQ ID NO: 3175274 - protein, 21 aa, Giardia lamblia
YADSIGKWRSRILAENAEGTL

SEQ ID NO: 3175275 - protein, 17 aa, Giardia lamblia
YAEFLCATVEYDVSANL

SEQ ID NO: 3175276 - protein, 27 aa, Giardia lamblia
YAEKTIREYDLKLGDKFEKSIGDSRPS

SEQ ID NO: 3175277 - protein, 20 aa, Giardia lamblia
YAFEIVRNGGVFPFLPSGSL

SEQ ID NO: 3175278 - protein, 17 aa, Giardia lamblia
YAFLLKGGQVFDKSQQP

SEQ ID NO: 3175279 - protein, 17 aa, Giardia lamblia
YAFLRLLTENGRYHELL

SEQ ID NO: 3175280 - protein, 21 aa, Giardia lamblia
YAGDLPLPLGNFSIVECNSQV

SEQ ID NO: 3175281 - protein, 17 aa, Giardia lamblia
YAGISVFALHPIYIRCE

SEQ ID NO: 3175282 - protein, 29 aa, Giardia lamblia
YAGNALACKKLALRLAIYDSNHHPEKNNL

SEQ ID NO: 3175283 - protein, 17 aa, Giardia lamblia
YAGNCAIVSLGAGLDTL

SEQ ID NO: 3175284 - protein, 18 aa, Giardia lamblia
YAGNFARYSELWLEDMRG

SEQ ID NO: 3175285 - protein, 21 aa, Giardia lamblia
YAGSKGYLYREEIDALVMEIS

SEQ ID NO: 3175286 - protein, 17 aa, Giardia lamblia
YAGWSALVWAASSPEAS

SEQ ID NO: 3175287 - protein, 24 aa, Giardia lamblia
YAHGCFFEPTFFRCEPHMRHYIKA

SEQ ID NO: 3175288 - protein, 26 aa, Giardia lamblia
YAHILWSNSVVFYFIAYGKKLNKSSN

SEQ ID NO: 3175289 - protein, 18 aa, Giardia lamblia
YAHYEVVLFSDQATPPHP

SEQ ID NO: 3175290 - protein, 23 aa, Giardia lamblia
YAIDPRVSLGLLLSLGADTISVY

SEQ ID NO: 3175291 - protein, 18 aa, Giardia lamblia
YAIVTGRLLPAFEKAIGA

SEQ ID NO: 3175292 - protein, 19 aa, Giardia lamblia
YAKKTDFSPPFTMMPRGPI

SEQ ID NO: 3175293 - protein, 19 aa, Giardia lamblia
YALAERIGYKFPRATQSRQ

SEQ ID NO: 3175294 - protein, 22 aa, Giardia lamblia
YALEESSCFVGPNADTINSCAG

SEQ ID NO: 3175295 - protein, 18 aa, Giardia lamblia
YALEKLIEVIQLFDSETE

SEQ ID NO: 3175296 - protein, 17 aa, Giardia lamblia
YALHFPGEHGIRPGRRF

SEQ ID NO: 3175297 - protein, 25 aa, Giardia lamblia
YAMKYKYKHIVAVLAPLESCLVSSA

SEQ ID NO: 3175298 - protein, 19 aa, Giardia lamblia
YANECYRCGGPHSGLVCPE

SEQ ID NO: 3175299 - protein, 17 aa, Giardia lamblia
YANESRFNHALVKINAT

SEQ ID NO: 3175300 - protein, 18 aa, Giardia lamblia
YANLIYRKAKNASSAANT

SEQ ID NO: 3175301 - protein, 17 aa, Giardia lamblia
YANQTLWWGDDGHALVC

SEQ ID NO: 3175302 - protein, 17 aa, Giardia lamblia
YANRFMRFCRVIFQVPV

SEQ ID NO: 3175303 - protein, 25 aa, Giardia lamblia
YANSVGLPEVWSLVGSAQLEKASAY

SEQ ID NO: 3175304 - protein, 19 aa, Giardia lamblia
YAPDIVDRLVIDFLNNHDI

SEQ ID NO: 3175305 - protein, 22 aa, Giardia lamblia
YAPEVFPALLASSYEQIQYLGT

SEQ ID NO: 3175306 - protein, 17 aa, Giardia lamblia
YAPLPSSVSEGMKLLIS

SEQ ID NO: 3175307 - protein, 24 aa, Giardia lamblia
YAPQHRFTFDRVFGPSTTQEEIFD

SEQ ID NO: 3175308 - protein, 19 aa, Giardia lamblia
YAPYPGACTYLIFEDAEVM

SEQ ID NO: 3175309 - protein, 17 aa, Giardia lamblia
YAQDAAFQSSIQRLNNA

SEQ ID NO: 3175310 - protein, 30 aa, Giardia lamblia
YAQKAHYWISLALYCRSQILNKMLSLATAF

SEQ ID NO: 3175311 - protein, 18 aa, Giardia lamblia
YAQPEFNSKLAGAIRHEH

SEQ ID NO: 3175312 - protein, 30 aa, Giardia lamblia
YARDCWDCDCLLSCGWTEIVGIADRSAYDL

SEQ ID NO: 3175313 - protein, 23 aa, Giardia lamblia
YARFPRDCAIVGSRERLFAYSDR

SEQ ID NO: 3175314 - protein, 17 aa, Giardia lamblia
YARICRFTSMMYDHCLK

SEQ ID NO: 3175315 - protein, 22 aa, Giardia lamblia
YARLVCALLDIPVGESLIESLH

SEQ ID NO: 3175316 - protein, 24 aa, Giardia lamblia
YARRLNEIEVIKLLDEGAEIDLFT

SEQ ID NO: 3175317 - protein, 25 aa, Giardia lamblia
YASCLGNAIMRCCIDQAREVTPLQT

SEQ ID NO: 3175318 - protein, 20 aa, Giardia lamblia
YASLLLPEQWIQPRELVEQY

SEQ ID NO: 3175319 - protein, 17 aa, Giardia lamblia
YASLSIRANEAGMDPKQ

SEQ ID NO: 3175320 - protein, 20 aa, Giardia lamblia
YASNHLKPSLVTQMESMVMT

SEQ ID NO: 3175321 - protein, 30 aa, Giardia lamblia
YASPKSIRTPEQWVGIPFSFASDTFALGTF

SEQ ID NO: 3175322 - protein, 23 aa, Giardia lamblia
YASSMLGHKLWFLIERLPKQPAT

SEQ ID NO: 3175323 - protein, 17 aa, Giardia lamblia
YATAFAAIHVRSYWSSL

SEQ ID NO: 3175324 - protein, 17 aa, Giardia lamblia
YATRVARMGGAFFDGGV

SEQ ID NO: 3175325 - protein, 24 aa, Giardia lamblia
YAVARPLYDFLFKLLEIASQVSDS

SEQ ID NO: 3175326 - protein, 17 aa, Giardia lamblia
YAVCASVPCTTVTNTKI

SEQ ID NO: 3175327 - protein, 24 aa, Giardia lamblia
YAVIYEYLDSIPILAKYLKDVPDP

SEQ ID NO: 3175328 - protein, 23 aa, Giardia lamblia
YAVKCNMHPLLLRSLHLLGAGFD

SEQ ID NO: 3175329 - protein, 25 aa, Giardia lamblia
YAVLPCGRTALMLAAQKNSAQYVQF

SEQ ID NO: 3175330 - protein, 18 aa, Giardia lamblia
YAVMRIFESMIVTHTMSF

SEQ ID NO: 3175331 - protein, 25 aa, Giardia lamblia
YAYYLKSGGFLFVCSDLQDLYLYMC

SEQ ID NO: 3175332 - protein, 20 aa, Giardia lamblia
YCAQCEQTLHPGGCVRAGVC

SEQ ID NO: 3175333 - protein, 18 aa, Giardia lamblia
YCCRRMLLTHVDLIDDLL

SEQ ID NO: 3175334 - protein, 19 aa, Giardia lamblia
YCDDLFLDFIETIMRIDPR

SEQ ID NO: 3175335 - protein, 24 aa, Giardia lamblia
YCDIHACGALKYLISQHTLTHQTM

SEQ ID NO: 3175336 - protein, 24 aa, Giardia lamblia
YCGAYKDLDRYSSMNIERYAVAMQ

SEQ ID NO: 3175337 - protein, 21 aa, Giardia lamblia
YCGPSGMIPDATIKQCFTNPY

SEQ ID NO: 3175338 - protein, 20 aa, Giardia lamblia
YCGTVKIPFILKHLKETPNH

SEQ ID NO: 3175339 - protein, 23 aa, Giardia lamblia
YCHPNNLPGFTASAFYKESSSPL

SEQ ID NO: 3175340 - protein, 18 aa, Giardia lamblia
YCHRFGICHRDLKFENVL

SEQ ID NO: 3175341 - protein, 17 aa, Giardia lamblia
YCIPPGYAHLYSEHVIT

SEQ ID NO: 3175342 - protein, 18 aa, Giardia lamblia
YCKCCTPTGTLGRSTSSL

SEQ ID NO: 3175343 - protein, 17 aa, Giardia lamblia
YCKKSLHGHSYEKTIAD

SEQ ID NO: 3175344 - protein, 18 aa, Giardia lamblia
YCLDGIRRRCHLRGALKK

SEQ ID NO: 3175345 - protein, 26 aa, Giardia lamblia
YCNGKRLSEAAIWDYIAQITDALIYL

SEQ ID NO: 3175346 - protein, 18 aa, Giardia lamblia
YCQLFVYRVTPFDLGSSL

SEQ ID NO: 3175347 - protein, 26 aa, Giardia lamblia
YCRGGSLWGLMAWMRKSDMRFSEQEV

SEQ ID NO: 3175348 - protein, 18 aa, Giardia lamblia
YCSGDALFNLLFQTLVPA

SEQ ID NO: 3175349 - protein, 19 aa, Giardia lamblia
YCVLSRSKGPIIRSSAKGF

SEQ ID NO: 3175350 - protein, 24 aa, Giardia lamblia
YCVYCKDVYLPLSHDVLKGELVDG

SEQ ID NO: 3175351 - protein, 26 aa, Giardia lamblia
YDACTRLISAISFLHNRLWVINTATI

SEQ ID NO: 3175352 - protein, 17 aa, Giardia lamblia
YDAIAGIPQVSPKELDA

SEQ ID NO: 3175353 - protein, 25 aa, Giardia lamblia
YDALAEEYVRLMGTLRVEDIADTSS

SEQ ID NO: 3175354 - protein, 26 aa, Giardia lamblia
YDALFYMARSKVCIPPEILRKMQEYL

SEQ ID NO: 3175355 - protein, 18 aa, Giardia lamblia
YDALLSMSQSILSKDEEI

SEQ ID NO: 3175356 - protein, 17 aa, Giardia lamblia
YDCETCGFDQSTEVEES

SEQ ID NO: 3175357 - protein, 17 aa, Giardia lamblia
YDCPEGTYVKLLQYNIL

SEQ ID NO: 3175358 - protein, 19 aa, Giardia lamblia
YDCSEGMRALAKSCLDAKK

SEQ ID NO: 3175359 - protein, 26 aa, Giardia lamblia
YDCTFKELKAPFARIVPVSNAEVVQG

SEQ ID NO: 3175360 - protein, 21 aa, Giardia lamblia
YDDIARKGVFISQTDRLSRQF

SEQ ID NO: 3175361 - protein, 25 aa, Giardia lamblia
YDDIYMCRIILSLCARHVPVQDCIP

SEQ ID NO: 3175362 - protein, 19 aa, Giardia lamblia
YDDLRCLLVTVATDNVVRI

SEQ ID NO: 3175363 - protein, 22 aa, Giardia lamblia
YDEALRKLAILSLEHEKLQNAT

SEQ ID NO: 3175364 - protein, 20 aa, Giardia lamblia
YDEGIKFGLQNWFYEDAAEC

SEQ ID NO: 3175365 - protein, 24 aa, Giardia lamblia
YDEIKLSALLSVSSYSVFINNRSR

SEQ ID NO: 3175366 - protein, 20 aa, Giardia lamblia
YDFIDGASWDNFKSSADKQG

SEQ ID NO: 3175367 - protein, 18 aa, Giardia lamblia
YDFQRICDDYDKAIVQAA

SEQ ID NO: 3175368 - protein, 31 aa, Giardia lamblia
YDGHGILARLLIKEDWSYFVIDVDKNTGALF

SEQ ID NO: 3175369 - protein, 20 aa, Giardia lamblia
YDGVLVLGCATRTMTREKAL

SEQ ID NO: 3175370 - protein, 17 aa, Giardia lamblia
YDGVQLHTAHGYLMSDI

SEQ ID NO: 3175371 - protein, 20 aa, Giardia lamblia
YDHIYLFLGDYVDRGSFSIE

SEQ ID NO: 3175372 - protein, 20 aa, Giardia lamblia
YDHLKCLVERQIYATKHADK

SEQ ID NO: 3175373 - protein, 24 aa, Giardia lamblia
YDHLRIISELDLISAEHCYLTDKG

SEQ ID NO: 3175374 - protein, 24 aa, Giardia lamblia
YDILAYRELCLFLQSSTSSRHAPF

SEQ ID NO: 3175375 - protein, 17 aa, Giardia lamblia
YDIRSGKTLADLHGGGR

SEQ ID NO: 3175376 - protein, 35 aa, Giardia lamblia
YDKACDIWSLGALCYELICGTAPFYHDEIKITRQN

SEQ ID NO: 3175377 - protein, 22 aa, Giardia lamblia
YDKALRAICHAIEITPDDVSLY

SEQ ID NO: 3175378 - protein, 19 aa, Giardia lamblia
YDKCPHVKLNYAIFGNLAR

SEQ ID NO: 3175379 - protein, 23 aa, Giardia lamblia
YDKDIKPVLSILLSPIPARRLPA

SEQ ID NO: 3175380 - protein, 17 aa, Giardia lamblia
YDKKIRFLDKFSTKKAF

SEQ ID NO: 3175381 - protein, 28 aa, Giardia lamblia
YDKVGNWSFPCLIIHGACDNIVPVHNAI

SEQ ID NO: 3175382 - protein, 21 aa, Giardia lamblia
YDLHPPPLVSFSRVFDELCKL

SEQ ID NO: 3175383 - protein, 23 aa, Giardia lamblia
YDLKKRFLGARMHQPRTADLRPH

SEQ ID NO: 3175384 - protein, 33 aa, Giardia lamblia
YDLLDASLLEFCNQTGLAPAHWSALSTPDVHLD

SEQ ID NO: 3175385 - protein, 27 aa, Giardia lamblia
YDLPGEVMWQYPMYKLLTQKPVPEHHS

SEQ ID NO: 3175386 - protein, 17 aa, Giardia lamblia
YDLPMLLSEALISKRHT

SEQ ID NO: 3175387 - protein, 19 aa, Giardia lamblia
YDLTDVDCCDLLFEQYLLI

SEQ ID NO: 3175388 - protein, 19 aa, Giardia lamblia
YDLVKLLYPKEHHILDADG

SEQ ID NO: 3175389 - protein, 19 aa, Giardia lamblia
YDMFSGIFRHTARSYSEVV

SEQ ID NO: 3175390 - protein, 17 aa, Giardia lamblia
YDMNFRLFMTTKLPNPS

SEQ ID NO: 3175391 - protein, 25 aa, Giardia lamblia
YDNLLRVYPFRVFKTPLATESYVSA

SEQ ID NO: 3175392 - protein, 17 aa, Giardia lamblia
YDQTSCNYGIFQASFKP

SEQ ID NO: 3175393 - protein, 22 aa, Giardia lamblia
YDRDELFFKQIIDTYLITAMGP

SEQ ID NO: 3175394 - protein, 21 aa, Giardia lamblia
YDRRKYCLKLMYMHILGHNID

SEQ ID NO: 3175395 - protein, 18 aa, Giardia lamblia
YDRVEKIHQFPIPFCKSL

SEQ ID NO: 3175396 - protein, 32 aa, Giardia lamblia
YDRWYLSIRWLMYSFMCPCLVSRDCISNASVL

SEQ ID NO: 3175397 - protein, 28 aa, Giardia lamblia
YDSEANIYCCIHSLFGGVVSKGVHTENY

SEQ ID NO: 3175398 - protein, 30 aa, Giardia lamblia
YDSEIICSGCGWRPFVGMVDNVLVVKPGSL

SEQ ID NO: 3175399 - protein, 19 aa, Giardia lamblia
YDSFAHINLGCTYSKTNQW

SEQ ID NO: 3175400 - protein, 24 aa, Giardia lamblia
YDSFKPATAVVFFELQLCLKISEA

SEQ ID NO: 3175401 - protein, 22 aa, Giardia lamblia
YDSFLRPVLQLADSVDLIKLGS

SEQ ID NO: 3175402 - protein, 24 aa, Giardia lamblia
YDSLMTALSFEWVLGHFLAITGTI

SEQ ID NO: 3175403 - protein, 20 aa, Giardia lamblia
YDSPCYLINPLGERKEGGKF

SEQ ID NO: 3175404 - protein, 31 aa, Giardia lamblia
YDSPELRAARQPKFLDPALFVGPGREDVIHD

SEQ ID NO: 3175405 - protein, 24 aa, Giardia lamblia
YDSRRLQVIDVHYPNRRALRKGCY

SEQ ID NO: 3175406 - protein, 24 aa, Giardia lamblia
YDSVCPACGLRIPITKQPGLLESH

SEQ ID NO: 3175407 - protein, 22 aa, Giardia lamblia
YDSVRLLLEREACMQDQDGWTA

SEQ ID NO: 3175408 - protein, 25 aa, Giardia lamblia
YDTASKCVKCVFIADTPLENGADMP

SEQ ID NO: 3175409 - protein, 31 aa, Giardia lamblia
YDTATGDFVWKVRLGFDGAFDSFEDYVRVFT

SEQ ID NO: 3175410 - protein, 23 aa, Giardia lamblia
YDTAVLGPRMMRLYRTRMSYFSP

SEQ ID NO: 3175411 - protein, 17 aa, Giardia lamblia
YDTNAGVCPACDQESCG

SEQ ID NO: 3175412 - protein, 20 aa, Giardia lamblia
YDTRSVVLLTERRAKSCKGI

SEQ ID NO: 3175413 - protein, 17 aa, Giardia lamblia
YDTVTCDFYSALQNNGL

SEQ ID NO: 3175414 - protein, 17 aa, Giardia lamblia
YDTYIWLQRRFLNQSTD

SEQ ID NO: 3175415 - protein, 26 aa, Giardia lamblia
YDTYRIWKRNCIILYDLCISHILVFP

SEQ ID NO: 3175416 - protein, 17 aa, Giardia lamblia
YDVLFSKKERKRIYENW

SEQ ID NO: 3175417 - protein, 20 aa, Giardia lamblia
YDVSWEYLDLNNIMRGPFPS

SEQ ID NO: 3175418 - protein, 17 aa, Giardia lamblia
YDYRPCPLPGETNHANI

SEQ ID NO: 3175419 - protein, 20 aa, Giardia lamblia
YEAACLGLSHLMARNNVSYD

SEQ ID NO: 3175420 - protein, 17 aa, Giardia lamblia
YEACCNRLGAISDGEFK

SEQ ID NO: 3175421 - protein, 23 aa, Giardia lamblia
YEAEKATTIALLTSALKTMEDQN

SEQ ID NO: 3175422 - protein, 17 aa, Giardia lamblia
YEAGAVWSGPRELPGTE

SEQ ID NO: 3175423 - protein, 26 aa, Giardia lamblia
YEAKLARPDGWTALMAAATLNNFTVV

SEQ ID NO: 3175424 - protein, 26 aa, Giardia lamblia
YEALICTKDGVSPLVLAIRVGNEILV

SEQ ID NO: 3175425 - protein, 19 aa, Giardia lamblia
YEALWKEYERVSTEFHNVE

SEQ ID NO: 3175426 - protein, 19 aa, Giardia lamblia
YEARVPYIIIRAISDSGSG

SEQ ID NO: 3175427 - protein, 17 aa, Giardia lamblia
YEAVLKCLATLEEKTST

SEQ ID NO: 3175428 - protein, 17 aa, Giardia lamblia
YEAYAVYKLFLERQKRR

SEQ ID NO: 3175429 - protein, 18 aa, Giardia lamblia
YEDAVFARILVKQGNMSK

SEQ ID NO: 3175430 - protein, 24 aa, Giardia lamblia
YEDECICALPALKHLCTVVHHLEL

SEQ ID NO: 3175431 - protein, 17 aa, Giardia lamblia
YEDIAELLIEFEAGQAN

SEQ ID NO: 3175432 - protein, 19 aa, Giardia lamblia
YEEELRCVIPNDIRDLFGK

SEQ ID NO: 3175433 - protein, 31 aa, Giardia lamblia
YEEHIQKCLKRLPFVQIYPLPKGCPDPYYSI

SEQ ID NO: 3175434 - protein, 18 aa, Giardia lamblia
YEEMDTLVAALIAEQNET

SEQ ID NO: 3175435 - protein, 20 aa, Giardia lamblia
YEEQFIKFVGVNIMKTDFAK

SEQ ID NO: 3175436 - protein, 25 aa, Giardia lamblia
YEERLKGAFKTIAEDRARLDALSLE

SEQ ID NO: 3175437 - protein, 26 aa, Giardia lamblia
YEFHGTCMDWQCSRSCRIDSIYRLPF

SEQ ID NO: 3175438 - protein, 20 aa, Giardia lamblia
YEGGSEFSGPIIGLKRTVTN

SEQ ID NO: 3175439 - protein, 22 aa, Giardia lamblia
YEGKLTQIPLYFGGHTRSIPTV

SEQ ID NO: 3175440 - protein, 19 aa, Giardia lamblia
YEGPEPVYVRESSSKDLQL

SEQ ID NO: 3175441 - protein, 18 aa, Giardia lamblia
YEGTALIRAAVYGYTEIV

SEQ ID NO: 3175442 - protein, 18 aa, Giardia lamblia
YEGYSLPHAVLRSEIAGK

SEQ ID NO: 3175443 - protein, 19 aa, Giardia lamblia
YEHFYVIYCKFWELDENHD

SEQ ID NO: 3175444 - protein, 17 aa, Giardia lamblia
YEIAALLYDYEKQMRRK

SEQ ID NO: 3175445 - protein, 18 aa, Giardia lamblia
YEIYKTIFEDSAFSVTLK

SEQ ID NO: 3175446 - protein, 19 aa, Giardia lamblia
YEKSLEMIEQLKLAEVAAR

SEQ ID NO: 3175447 - protein, 19 aa, Giardia lamblia
YELAAGVYAKAMIPKSDQV

SEQ ID NO: 3175448 - protein, 17 aa, Giardia lamblia
YELCTKTLLFRAKNISD

SEQ ID NO: 3175449 - protein, 22 aa, Giardia lamblia
YELCTLKRFVERANTVSEASSF

SEQ ID NO: 3175450 - protein, 18 aa, Giardia lamblia
YELCTLTLFTKIPSSEVI

SEQ ID NO: 3175451 - protein, 19 aa, Giardia lamblia
YELCVQKQLFAAASEEEMV

SEQ ID NO: 3175452 - protein, 24 aa, Giardia lamblia
YELKGQLNYVFKHRMVVSDKPGAS

SEQ ID NO: 3175453 - protein, 24 aa, Giardia lamblia
YELLTCRKYLERSVDSHWCPRQLP

SEQ ID NO: 3175454 - protein, 20 aa, Giardia lamblia
YELTSSISLQDAYPNAVSEP

SEQ ID NO: 3175455 - protein, 17 aa, Giardia lamblia
YEMKQLLTLLRDTPGAE

SEQ ID NO: 3175456 - protein, 18 aa, Giardia lamblia
YENASLALKEYWRVGNVP

SEQ ID NO: 3175457 - protein, 17 aa, Giardia lamblia
YENLLLLVLFEAERALG

SEQ ID NO: 3175458 - protein, 21 aa, Giardia lamblia
YEPGFRKIRCGLIEAPKPVSR

SEQ ID NO: 3175459 - protein, 17 aa, Giardia lamblia
YEPVFIFQIQIIRTREG

SEQ ID NO: 3175460 - protein, 18 aa, Giardia lamblia
YEQSYIPSLRHFVEALTQ

SEQ ID NO: 3175461 - protein, 17 aa, Giardia lamblia
YERAEGFLKQWLFMSRT

SEQ ID NO: 3175462 - protein, 25 aa, Giardia lamblia
YERARFSARNSLVINSPVRLSGAWG

SEQ ID NO: 3175463 - protein, 19 aa, Giardia lamblia
YERLFAKPWLFPHLGEDLD

SEQ ID NO: 3175464 - protein, 19 aa, Giardia lamblia
YESEVSRYVAAKGAPALIA

SEQ ID NO: 3175465 - protein, 17 aa, Giardia lamblia
YESKAFVDNLARTTVGT

SEQ ID NO: 3175466 - protein, 18 aa, Giardia lamblia
YESLGFRKMRLFSNYYMN

SEQ ID NO: 3175467 - protein, 25 aa, Giardia lamblia
YESLRIYVIDYFRPASLANVASQHV

SEQ ID NO: 3175468 - protein, 17 aa, Giardia lamblia
YESQWLLGIAAAKLGEL

SEQ ID NO: 3175469 - protein, 26 aa, Giardia lamblia
YESTVRVSSGFTFRVENYVEAEAVER

SEQ ID NO: 3175470 - protein, 18 aa, Giardia lamblia
YETFAVYLAEKFGYKEGL

SEQ ID NO: 3175471 - protein, 18 aa, Giardia lamblia
YEVARILYELEGRVRNVN

SEQ ID NO: 3175472 - protein, 24 aa, Giardia lamblia
YEVGKAGVTDLMFYAQTGNLDALL

SEQ ID NO: 3175473 - protein, 17 aa, Giardia lamblia
YEVILIDPFHPWIRNDP

SEQ ID NO: 3175474 - protein, 20 aa, Giardia lamblia
YEVNLDWSVARRIVKGKMPF

SEQ ID NO: 3175475 - protein, 31 aa, Giardia lamblia
YEVVKVLTELGPRAPSLQRIGPREWIVEKNG

SEQ ID NO: 3175476 - protein, 20 aa, Giardia lamblia
YEVYASLLAQSRGAGLVTRI

SEQ ID NO: 3175477 - protein, 21 aa, Giardia lamblia
YEYGENFLISDLVFDMRPFPA

SEQ ID NO: 3175478 - protein, 25 aa, Giardia lamblia
YEYNCRDGYGRTALMLAASQGHVEC

SEQ ID NO: 3175479 - protein, 22 aa, Giardia lamblia
YEYTLYVYCMDVLQLLLEKQVV

SEQ ID NO: 3175480 - protein, 17 aa, Giardia lamblia
YFAPGSMTLMQESAPPS

SEQ ID NO: 3175481 - protein, 18 aa, Giardia lamblia
YFATWIVERCPAVKKHRL

SEQ ID NO: 3175482 - protein, 32 aa, Giardia lamblia
YFCAECAARLVLRSGRCALCRQPVVQMRCGGE

SEQ ID NO: 3175483 - protein, 26 aa, Giardia lamblia
YFENFLLQYLHRLLVWITDEMGADPQ

SEQ ID NO: 3175484 - protein, 17 aa, Giardia lamblia
YFERCIEKVLSFNYHEE

SEQ ID NO: 3175485 - protein, 25 aa, Giardia lamblia
YFFAFSYPFTYSMLTKFNSRLINHK

SEQ ID NO: 3175486 - protein, 22 aa, Giardia lamblia
YFFGTCNRKLWDPNQSSANAKA

SEQ ID NO: 3175487 - protein, 18 aa, Giardia lamblia
YFGGSALTETFLASLLAS

SEQ ID NO: 3175488 - protein, 18 aa, Giardia lamblia
YFGVTGCNIAVMPPPDMM

SEQ ID NO: 3175489 - protein, 27 aa, Giardia lamblia
YFKEEIIRFNLEWLQTMGIDLDEVTLI

SEQ ID NO: 3175490 - protein, 22 aa, Giardia lamblia
YFLEHYEKGIGMFIPSLGAFFF

SEQ ID NO: 3175491 - protein, 24 aa, Giardia lamblia
YFNSVLRSAPFIVFVTTQSEVIPV

SEQ ID NO: 3175492 - protein, 17 aa, Giardia lamblia
YFRCVEILLEKEAGMSV

SEQ ID NO: 3175493 - protein, 19 aa, Giardia lamblia
YFRGSEVDGYRCEKCGQKT

SEQ ID NO: 3175494 - protein, 25 aa, Giardia lamblia
YFRLEALNLPDLVFLPGVEITTENL

SEQ ID NO: 3175495 - protein, 22 aa, Giardia lamblia
YFRQILPVFNLFYTRNINIGDS

SEQ ID NO: 3175496 - protein, 18 aa, Giardia lamblia
YFRSIMVAIFTYCKVRPS

SEQ ID NO: 3175497 - protein, 18 aa, Giardia lamblia
YFSEPFKDHIDVFVQVLS

SEQ ID NO: 3175498 - protein, 17 aa, Giardia lamblia
YFSKAAKEFYMIMDYCN

SEQ ID NO: 3175499 - protein, 23 aa, Giardia lamblia
YFSSELLGTMGIIMLYAGKQDHL

SEQ ID NO: 3175500 - protein, 26 aa, Giardia lamblia
YFSSKHIKSAIAVLKFLELAATADQQ

SEQ ID NO: 3175501 - protein, 26 aa, Giardia lamblia
YFVNSCRDRLHVVLSMNPVGNTLRVR

SEQ ID NO: 3175502 - protein, 19 aa, Giardia lamblia
YFVQIGMRRINAFVFFNEL

SEQ ID NO: 3175503 - protein, 20 aa, Giardia lamblia
YFVREVRVLSLIISKTSEDI

SEQ ID NO: 3175504 - protein, 22 aa, Giardia lamblia
YFYCAAKVRGRFFPPEPKSIFD

SEQ ID NO: 3175505 - protein, 19 aa, Giardia lamblia
YGAGCTPADVAVKAGHPEL

SEQ ID NO: 3175506 - protein, 19 aa, Giardia lamblia
YGASTPWLTALVCQDTKMS

SEQ ID NO: 3175507 - protein, 17 aa, Giardia lamblia
YGAVKYADLSSHRIKDY

SEQ ID NO: 3175508 - protein, 19 aa, Giardia lamblia
YGCLPLRQAVSLRNESAVT

SEQ ID NO: 3175509 - protein, 17 aa, Giardia lamblia
YGCVGCLQCLAVCTHDA

SEQ ID NO: 3175510 - protein, 31 aa, Giardia lamblia
YGDCLNWKQLPLIISPFFLYSHIVRSNRLCT

SEQ ID NO: 3175511 - protein, 17 aa, Giardia lamblia
YGDFFLRYLEADEQAPA

SEQ ID NO: 3175512 - protein, 25 aa, Giardia lamblia
YGDFPPGVCQFCLEECGQQEDMALN

SEQ ID NO: 3175513 - protein, 22 aa, Giardia lamblia
YGDGVYCPYRNLFNQTRDVENC

SEQ ID NO: 3175514 - protein, 18 aa, Giardia lamblia
YGDHLIKLLSTEALQSLV

SEQ ID NO: 3175515 - protein, 18 aa, Giardia lamblia
YGDIGSDIRRVFREPVAR

SEQ ID NO: 3175516 - protein, 24 aa, Giardia lamblia
YGDIKRLSAELSQKETDLCDALKK

SEQ ID NO: 3175517 - protein, 17 aa, Giardia lamblia
YGDPTAGLSSMMPQAGV

SEQ ID NO: 3175518 - protein, 18 aa, Giardia lamblia
YGEQWVRKRDALARRAMQ

SEQ ID NO: 3175519 - protein, 25 aa, Giardia lamblia
YGESFLKPEHCSFVEFNPRDTDDER

SEQ ID NO: 3175520 - protein, 40 aa, Giardia lamblia
YGGGAMPGFGGSFSGPMPFMPQSYPGMPVVGQYKPVTGGG

SEQ ID NO: 3175521 - protein, 20 aa, Giardia lamblia
YGGKSSSFGLYIINVTGMVV

SEQ ID NO: 3175522 - protein, 17 aa, Giardia lamblia
YGGTALMRAAMNGHLGA

SEQ ID NO: 3175523 - protein, 24 aa, Giardia lamblia
YGHLECVKSLLEYEDCVADRDGMT

SEQ ID NO: 3175524 - protein, 19 aa, Giardia lamblia
YGIPKFRLPKQIVAHEINS

SEQ ID NO: 3175525 - protein, 20 aa, Giardia lamblia
YGISMPLLLMNSFNTEKDTK

SEQ ID NO: 3175526 - protein, 36 aa, Giardia lamblia
YGKEYIRRLAYGHCRLRVAWEITATAILACETVSNK

SEQ ID NO: 3175527 - protein, 17 aa, Giardia lamblia
YGKNRAVPEPRKLNDNT

SEQ ID NO: 3175528 - protein, 21 aa, Giardia lamblia
YGKRLKYLFKDEELANYETKM

SEQ ID NO: 3175529 - protein, 26 aa, Giardia lamblia
YGKVCREKLNFLYLIYSYICDTAGLH

SEQ ID NO: 3175530 - protein, 29 aa, Giardia lamblia
YGLFEKTAICFKTIYLLIPPRMVLGQAHQ

SEQ ID NO: 3175531 - protein, 19 aa, Giardia lamblia
YGLLTEYVNLFALKTSYYV

SEQ ID NO: 3175532 - protein, 21 aa, Giardia lamblia
YGLSEAVPLLVPTEATMRRYD

SEQ ID NO: 3175533 - protein, 18 aa, Giardia lamblia
YGLTCQRPFTGKLMELLP

SEQ ID NO: 3175534 - protein, 23 aa, Giardia lamblia
YGNGEPNTTCLLIGNMENRSVSI

SEQ ID NO: 3175535 - protein, 24 aa, Giardia lamblia
YGNIECAKLLLPKEADMKQPNGKT

SEQ ID NO: 3175536 - protein, 18 aa, Giardia lamblia
YGQAGIPVVERVDTPPEL

SEQ ID NO: 3175537 - protein, 26 aa, Giardia lamblia
YGQGCDALGCTALEYAVLSKSSETLR

SEQ ID NO: 3175538 - protein, 27 aa, Giardia lamblia
YGQIQGCLAAGCSAEDVVQCVFRALMA

SEQ ID NO: 3175539 - protein, 18 aa, Giardia lamblia
YGQTALSFAVRRGDTKII

SEQ ID NO: 3175540 - protein, 23 aa, Giardia lamblia
YGRTECVRLLLSKERTLKDLNGW

SEQ ID NO: 3175541 - protein, 23 aa, Giardia lamblia
YGSGMGSLAFKFSVYPNQMPCVL

SEQ ID NO: 3175542 - protein, 26 aa, Giardia lamblia
YGSNRIWRLCCDVFDALPLAATVDDT

SEQ ID NO: 3175543 - protein, 26 aa, Giardia lamblia
YGSQFFLKFVGLFTVLKSSQEISDSA

SEQ ID NO: 3175544 - protein, 23 aa, Giardia lamblia
YGTESLRKMWGLIVLDDGRACIT

SEQ ID NO: 3175545 - protein, 17 aa, Giardia lamblia
YGTYAFEIVRNGGVFPF

SEQ ID NO: 3175546 - protein, 26 aa, Giardia lamblia
YGVEKICKIRRSLELLSSEALLGRPL

SEQ ID NO: 3175547 - protein, 17 aa, Giardia lamblia
YGVIIFSDIEMCVLQRK

SEQ ID NO: 3175548 - protein, 18 aa, Giardia lamblia
YGVLRPNELIVCDIYPRC

SEQ ID NO: 3175549 - protein, 18 aa, Giardia lamblia
YGVPVIYTKNVHVVVHYP

SEQ ID NO: 3175550 - protein, 19 aa, Giardia lamblia
YGVTAVPTWVFLRDGQELG

SEQ ID NO: 3175551 - protein, 22 aa, Giardia lamblia
YGVVYKCKRKLDSRVYVLKEIR

SEQ ID NO: 3175552 - protein, 17 aa, Giardia lamblia
YGWTALCFAVMNHHALA

SEQ ID NO: 3175553 - protein, 25 aa, Giardia lamblia
YGYEECVKILIPREAGLKRNTDGVT

SEQ ID NO: 3175554 - protein, 24 aa, Giardia lamblia
YGYGIRYSYGMFKQTIRDGCQEEF

SEQ ID NO: 3175555 - protein, 17 aa, Giardia lamblia
YHAKGVMYGPAKASNAG

SEQ ID NO: 3175556 - protein, 18 aa, Giardia lamblia
YHALRANTSLKYREEMMD

SEQ ID NO: 3175557 - protein, 18 aa, Giardia lamblia
YHAPEILNALATPTPPGI

SEQ ID NO: 3175558 - protein, 24 aa, Giardia lamblia
YHDVDLRSLVLVLGSTIQFYERKA

SEQ ID NO: 3175559 - protein, 24 aa, Giardia lamblia
YHDWSSFVRYSFALFELRDLTPAE

SEQ ID NO: 3175560 - protein, 17 aa, Giardia lamblia
YHIANTLAALKSVPDED

SEQ ID NO: 3175561 - protein, 27 aa, Giardia lamblia
YHLIDCKHPSLLVYLTLINDRSRCSYS

SEQ ID NO: 3175562 - protein, 18 aa, Giardia lamblia
YHMGVPTSSLIKRDSSSK

SEQ ID NO: 3175563 - protein, 24 aa, Giardia lamblia
YHNLISANMPLNFYELEAHSKINH

SEQ ID NO: 3175564 - protein, 23 aa, Giardia lamblia
YHPETWSPALNFKHIIIGFLSLF

SEQ ID NO: 3175565 - protein, 20 aa, Giardia lamblia
YHPPAIFFSGAVCREQLARV

SEQ ID NO: 3175566 - protein, 29 aa, Giardia lamblia
YHPSFPELMYKPTHYLKHLVLSMKEKESL

SEQ ID NO: 3175567 - protein, 19 aa, Giardia lamblia
YHPTMQFLKLELSVTRDES

SEQ ID NO: 3175568 - protein, 26 aa, Giardia lamblia
YHQDLKAILPMNAWGPMPIGPYDFLS

SEQ ID NO: 3175569 - protein, 20 aa, Giardia lamblia
YHSFSMQLVRSLKVDENAIY

SEQ ID NO: 3175570 - protein, 21 aa, Giardia lamblia
YHTDVILCLRGMVDAYIPSAF

SEQ ID NO: 3175571 - protein, 18 aa, Giardia lamblia
YHTYCYAALQALQMYGQY

SEQ ID NO: 3175572 - protein, 26 aa, Giardia lamblia
YHVPEWDEMWAVKRIQDLAVRGKALK

SEQ ID NO: 3175573 - protein, 18 aa, Giardia lamblia
YHVVSMSPGSGPLHRGVP

SEQ ID NO: 3175574 - protein, 18 aa, Giardia lamblia
YIACRLVVLDSFELENTI

SEQ ID NO: 3175575 - protein, 17 aa, Giardia lamblia
YIALLALSAGIDARIVW

SEQ ID NO: 3175576 - protein, 20 aa, Giardia lamblia
YICSRFYRAPELVIGNQNYT

SEQ ID NO: 3175577 - protein, 17 aa, Giardia lamblia
YIDHGYKNLMDVVSSAA

SEQ ID NO: 3175578 - protein, 27 aa, Giardia lamblia
YIDLLDRISFINVWIEKGIPICFWISG

SEQ ID NO: 3175579 - protein, 17 aa, Giardia lamblia
YIDSILASIEWLGHKPF

SEQ ID NO: 3175580 - protein, 23 aa, Giardia lamblia
YIDSLLRMGHYVIGKSTVMMISA

SEQ ID NO: 3175581 - protein, 26 aa, Giardia lamblia
YIEAPVRPGYESSLLSYVKVSSDPTT

SEQ ID NO: 3175582 - protein, 27 aa, Giardia lamblia
YIEAQLRFGADFQMLMFMSSGVTRKGL

SEQ ID NO: 3175583 - protein, 24 aa, Giardia lamblia
YIEARMLAVAPNFTRIVGSIVGVR

SEQ ID NO: 3175584 - protein, 20 aa, Giardia lamblia
YIEKELYLALESKVSGLSKE

SEQ ID NO: 3175585 - protein, 24 aa, Giardia lamblia
YIERCASIFNSIRIDNAHSTDKTL

SEQ ID NO: 3175586 - protein, 20 aa, Giardia lamblia
YIFTSGRLALCYCESNTEKL

SEQ ID NO: 3175587 - protein, 18 aa, Giardia lamblia
YIGAEGYKGPSVREQPSC

SEQ ID NO: 3175588 - protein, 22 aa, Giardia lamblia
YIGDSRSGLSITAEPVIEIVTP

SEQ ID NO: 3175589 - protein, 18 aa, Giardia lamblia
YIHRVGRTCRAGRDGCAI

SEQ ID NO: 3175590 - protein, 24 aa, Giardia lamblia
YIHWKKDLFKVLGLSEQPVISTNK

SEQ ID NO: 3175591 - protein, 28 aa, Giardia lamblia
YIHYCRRCVCSECISKIEQKDCFIKLEA

SEQ ID NO: 3175592 - protein, 30 aa, Giardia lamblia
YIIAAEMLARFVTRPDLRDTLLPSILEEFN

SEQ ID NO: 3175593 - protein, 25 aa, Giardia lamblia
YIIFKQLRLNHGLYPRNGIKFGCDY

SEQ ID NO: 3175594 - protein, 20 aa, Giardia lamblia
YIILELVDFGSLQTLIKQYD

SEQ ID NO: 3175595 - protein, 23 aa, Giardia lamblia
YIKDVAFDLAYKYDREDAEAQLK

SEQ ID NO: 3175596 - protein, 24 aa, Giardia lamblia
YIKEKRFFATEGLGDYLASVGLEQ

SEQ ID NO: 3175597 - protein, 24 aa, Giardia lamblia
YIKGICAGFVRFKLARPPTKDVAW

SEQ ID NO: 3175598 - protein, 27 aa, Giardia lamblia
YIKNFQWLYDFSRYIMTVLFSDKFQEL

SEQ ID NO: 3175599 - protein, 18 aa, Giardia lamblia
YIKSFYYNDFRSLQSEED

SEQ ID NO: 3175600 - protein, 24 aa, Giardia lamblia
YIKYIAKGAIGKVFVHEAKVVNLV

SEQ ID NO: 3175601 - protein, 20 aa, Giardia lamblia
YILRILRKWLGEAAAHENAQ

SEQ ID NO: 3175602 - protein, 19 aa, Giardia lamblia
YIMPAEKPYMYSYTEQSSI

SEQ ID NO: 3175603 - protein, 20 aa, Giardia lamblia
YIMQNARFFKFTDMALTRDD

SEQ ID NO: 3175604 - protein, 24 aa, Giardia lamblia
YIMTDCTAAHTFIETVPFAANASI

SEQ ID NO: 3175605 - protein, 17 aa, Giardia lamblia
YIMTVLFSDKFQELRGN

SEQ ID NO: 3175606 - protein, 20 aa, Giardia lamblia
YIMYKEAMDLFSKEASAATE

SEQ ID NO: 3175607 - protein, 25 aa, Giardia lamblia
YINRVTCALIYGYEGLHISNVKEID

SEQ ID NO: 3175608 - protein, 17 aa, Giardia lamblia
YIPGVTLFELCKQCYDR

SEQ ID NO: 3175609 - protein, 17 aa, Giardia lamblia
YIPNEALTAATLTSKID

SEQ ID NO: 3175610 - protein, 32 aa, Giardia lamblia
YIPQQAGMVAKFFRARMVDIHGGTALMVAAVL

SEQ ID NO: 3175611 - protein, 18 aa, Giardia lamblia
YIQARSAFDVPLACDKCI

SEQ ID NO: 3175612 - protein, 19 aa, Giardia lamblia
YIRARRNPLFYNIFPDPLV

SEQ ID NO: 3175613 - protein, 17 aa, Giardia lamblia
YIRELMPSIALTICAKA

SEQ ID NO: 3175614 - protein, 24 aa, Giardia lamblia
YIRTHVEKILSFKPDLVITEKGVA

SEQ ID NO: 3175615 - protein, 18 aa, Giardia lamblia
YISNISRFNEFISVSDLM

SEQ ID NO: 3175616 - protein, 27 aa, Giardia lamblia
YISRILECLSIVAGTLPQLFAPHIDPL

SEQ ID NO: 3175617 - protein, 18 aa, Giardia lamblia
YISTLRPVQPVPSSSIGF

SEQ ID NO: 3175618 - protein, 25 aa, Giardia lamblia
YISTRWYRSPECLLTDGVYGPEMDL

SEQ ID NO: 3175619 - protein, 18 aa, Giardia lamblia
YITAMAFTQSGMFLATGS

SEQ ID NO: 3175620 - protein, 35 aa, Giardia lamblia
YITPPLFLSFIRLFKRIFAKSVGKLKVRESILQSG

SEQ ID NO: 3175621 - protein, 18 aa, Giardia lamblia
YIVERFTNFIIDGPSISS

SEQ ID NO: 3175622 - protein, 17 aa, Giardia lamblia
YIVVVWFDLKNYIVTTL

SEQ ID NO: 3175623 - protein, 21 aa, Giardia lamblia
YIYNRYEVIETVTTVEQVRDE

SEQ ID NO: 3175624 - protein, 18 aa, Giardia lamblia
YIYVPLILVLRALVSTTD

SEQ ID NO: 3175625 - protein, 34 aa, Giardia lamblia
YKAAKYFFEFVGDWSRLSLTLVKLRCLKEAVEAA

SEQ ID NO: 3175626 - protein, 21 aa, Giardia lamblia
YKAGCTHVMRFIDHRGSNLHN

SEQ ID NO: 3175627 - protein, 20 aa, Giardia lamblia
YKAGDYVLGVVVGQDATGKP

SEQ ID NO: 3175628 - protein, 19 aa, Giardia lamblia
YKALLSRMGKQHNIRIYKP

SEQ ID NO: 3175629 - protein, 24 aa, Giardia lamblia
YKALRPENILIAGIGVYKLCDCWC

SEQ ID NO: 3175630 - protein, 19 aa, Giardia lamblia
YKAPEVLMHKPCDEKQDIW

SEQ ID NO: 3175631 - protein, 26 aa, Giardia lamblia
YKAPPYLIIHLKRFDQVFDNCGRFYL

SEQ ID NO: 3175632 - protein, 18 aa, Giardia lamblia
YKASEVFLDSKRLASSYS

SEQ ID NO: 3175633 - protein, 19 aa, Giardia lamblia
YKASFSPTSSERFSVSPSS

SEQ ID NO: 3175634 - protein, 20 aa, Giardia lamblia
YKATLTVPRSIMFRSSSTSL

SEQ ID NO: 3175635 - protein, 32 aa, Giardia lamblia
YKDAMTAWASRRATCREFIDALSEGAGLKPSA

SEQ ID NO: 3175636 - protein, 24 aa, Giardia lamblia
YKDDLFRWAAIIIGPSQTPWEGAV

SEQ ID NO: 3175637 - protein, 17 aa, Giardia lamblia
YKDGRDCLMLAAEVADL

SEQ ID NO: 3175638 - protein, 19 aa, Giardia lamblia
YKDKVLRLRVHAEESGNYI

SEQ ID NO: 3175639 - protein, 24 aa, Giardia lamblia
YKDLYRRAFNVVERMKVKEREMKN

SEQ ID NO: 3175640 - protein, 20 aa, Giardia lamblia
YKDMIFRLYPNIKALYDTVS

SEQ ID NO: 3175641 - protein, 20 aa, Giardia lamblia
YKDQFYKLQEKLHCQSRPFH

SEQ ID NO: 3175642 - protein, 20 aa, Giardia lamblia
YKDSFTYSLVTAIRETDNAL

SEQ ID NO: 3175643 - protein, 23 aa, Giardia lamblia
YKDYARRNACHRLWELNKDDSDF

SEQ ID NO: 3175644 - protein, 18 aa, Giardia lamblia
YKEAFLLHTDERGSLFEA

SEQ ID NO: 3175645 - protein, 20 aa, Giardia lamblia
YKEICIGYIPIMLRSNRCIL

SEQ ID NO: 3175646 - protein, 20 aa, Giardia lamblia
YKELDAALIQKTQARAEYEK

SEQ ID NO: 3175647 - protein, 20 aa, Giardia lamblia
YKELSILYLHTGDYKKCEQS

SEQ ID NO: 3175648 - protein, 20 aa, Giardia lamblia
YKFPLLVGLSGVCYHGRNAC

SEQ ID NO: 3175649 - protein, 20 aa, Giardia lamblia
YKFSCIGLASSTFDRRRPRP

SEQ ID NO: 3175650 - protein, 23 aa, Giardia lamblia
YKFVSKKGAGAFSDVIKAQCVKT

SEQ ID NO: 3175651 - protein, 27 aa, Giardia lamblia
YKFVSSLPMRVQSRFTYELVDTMQNLS

SEQ ID NO: 3175652 - protein, 23 aa, Giardia lamblia
YKGASALAIAVARGHHHIVKFLL

SEQ ID NO: 3175653 - protein, 21 aa, Giardia lamblia
YKGCHTCLIHLASEMGIQSWS

SEQ ID NO: 3175654 - protein, 25 aa, Giardia lamblia
YKGHLECVKILLPYEYHMRDKSGLS

SEQ ID NO: 3175655 - protein, 41 aa, Giardia lamblia
YKGIPAGATALLIAATRGHAGCVSLLYPMEQSTSGWNDLFL

SEQ ID NO: 3175656 - protein, 18 aa, Giardia lamblia
YKGNTCFVNMLKKRESRL

SEQ ID NO: 3175657 - protein, 21 aa, Giardia lamblia
YKGPARNGTYIFIGQPLDLYD

SEQ ID NO: 3175658 - protein, 18 aa, Giardia lamblia
YKHLDCYTWYHSLDSVRC

SEQ ID NO: 3175659 - protein, 25 aa, Giardia lamblia
YKIAMRTVFVARMRRPLSIRTTESR

SEQ ID NO: 3175660 - protein, 21 aa, Giardia lamblia
YKIDLLYAALFPGEGAPKPKA

SEQ ID NO: 3175661 - protein, 25 aa, Giardia lamblia
YKIIQRLPAMIGRHNFMDAEQALEQ

SEQ ID NO: 3175662 - protein, 21 aa, Giardia lamblia
YKIKYPQLFYMRKSVTGTVLT

SEQ ID NO: 3175663 - protein, 21 aa, Giardia lamblia
YKIRITEKFVALDSASLSASV

SEQ ID NO: 3175664 - protein, 21 aa, Giardia lamblia
YKISRELPALESRVQGFTQAV

SEQ ID NO: 3175665 - protein, 25 aa, Giardia lamblia
YKKAGLAVPEPVLWNTVAQITVALN

SEQ ID NO: 3175666 - protein, 17 aa, Giardia lamblia
YKKEIIEKTRACEEANR

SEQ ID NO: 3175667 - protein, 30 aa, Giardia lamblia
YKKEYRRIIEISARFAQFIKKNAILDFNSS

SEQ ID NO: 3175668 - protein, 24 aa, Giardia lamblia
YKKKLAELTAELGVLRAVRASDDG

SEQ ID NO: 3175669 - protein, 26 aa, Giardia lamblia
YKKLHASAFPKIGLFTRPFINRDKNQ

SEQ ID NO: 3175670 - protein, 18 aa, Giardia lamblia
YKKTISIIREVCVRAENE

SEQ ID NO: 3175671 - protein, 19 aa, Giardia lamblia
YKLASSTFLAGFIRSDSNT

SEQ ID NO: 3175672 - protein, 25 aa, Giardia lamblia
YKLKRFTITANERFIFAVDNRNNGS

SEQ ID NO: 3175673 - protein, 26 aa, Giardia lamblia
YKLRNWKFNCCSALMMAAWHGHTNIV

SEQ ID NO: 3175674 - protein, 19 aa, Giardia lamblia
YKLVEVLFYHTCFGCPPQL

SEQ ID NO: 3175675 - protein, 21 aa, Giardia lamblia
YKMEDIVRAFTVFGADEAVGV

SEQ ID NO: 3175676 - protein, 19 aa, Giardia lamblia
YKNRCCGDVLAAREREHPF

SEQ ID NO: 3175677 - protein, 27 aa, Giardia lamblia
YKNRYKEICSSSLFKHTYPNEEVTGAA

SEQ ID NO: 3175678 - protein, 20 aa, Giardia lamblia
YKPKDPFFLEDNKVHLSNTD

SEQ ID NO: 3175679 - protein, 22 aa, Giardia lamblia
YKPLRLPPHLRPMELNLNSQDY

SEQ ID NO: 3175680 - protein, 18 aa, Giardia lamblia
YKPPCSRTSKQRLPQPLA

SEQ ID NO: 3175681 - protein, 23 aa, Giardia lamblia
YKPPILPGECSLYSFAQEYGLDS

SEQ ID NO: 3175682 - protein, 28 aa, Giardia lamblia
YKPTDVTAAYGFKVFKQERGGDFLLSED

SEQ ID NO: 3175683 - protein, 18 aa, Giardia lamblia
YKPVDSISKIFGPTYAES

SEQ ID NO: 3175684 - protein, 38 aa, Giardia lamblia
YKQEVVEFICKRFVIGSWPRPSPLFFAAISGNTYILDV

SEQ ID NO: 3175685 - protein, 19 aa, Giardia lamblia
YKQLCVKYDSMKLFLETEA

SEQ ID NO: 3175686 - protein, 17 aa, Giardia lamblia
YKQNLLLDHENDTHERT

SEQ ID NO: 3175687 - protein, 22 aa, Giardia lamblia
YKQPAFSFRVGNVLQGPGDDNI

SEQ ID NO: 3175688 - protein, 17 aa, Giardia lamblia
YKQRVNTYYTRGAVIHE

SEQ ID NO: 3175689 - protein, 17 aa, Giardia lamblia
YKRAMSIKLQPASSSAP

SEQ ID NO: 3175690 - protein, 20 aa, Giardia lamblia
YKRFLGLFSSRVSVVCTSPS

SEQ ID NO: 3175691 - protein, 24 aa, Giardia lamblia
YKRFYYPGNCVIAFHGNIPLEDEL

SEQ ID NO: 3175692 - protein, 23 aa, Giardia lamblia
YKRIVRCDFSFPGSISVSEDLKN

SEQ ID NO: 3175693 - protein, 22 aa, Giardia lamblia
YKRLEPYYRSSVEPFETIYALC

SEQ ID NO: 3175694 - protein, 22 aa, Giardia lamblia
YKRMSNLYCDLQAKFKLFERVD

SEQ ID NO: 3175695 - protein, 27 aa, Giardia lamblia
YKSAESLRLITGLVVEGFHLQGIRQLK

SEQ ID NO: 3175696 - protein, 24 aa, Giardia lamblia
YKSFILDRHVDGVIIANAVDGSAT

SEQ ID NO: 3175697 - protein, 18 aa, Giardia lamblia
YKSLGLFHRFLGRLNCQS

SEQ ID NO: 3175698 - protein, 17 aa, Giardia lamblia
YKSLQLEKIKLEADSLD

SEQ ID NO: 3175699 - protein, 23 aa, Giardia lamblia
YKSLRTMVRRVYIWALQLKHNEL

SEQ ID NO: 3175700 - protein, 27 aa, Giardia lamblia
YKTALDYACLQDKLDVLKFMLDKVPSV

SEQ ID NO: 3175701 - protein, 19 aa, Giardia lamblia
YKTAYSCFQKVASKLPSYG

SEQ ID NO: 3175702 - protein, 23 aa, Giardia lamblia
YKTPARTGLNYIFTIKLPTDANP

SEQ ID NO: 3175703 - protein, 19 aa, Giardia lamblia
YKVIFPLIKDFVSYAKANP

SEQ ID NO: 3175704 - protein, 20 aa, Giardia lamblia
YKVLHACLAYDEFLSSSRDD

SEQ ID NO: 3175705 - protein, 23 aa, Giardia lamblia
YKVLMRLLKSVGCTEMRFRRGPK

SEQ ID NO: 3175706 - protein, 18 aa, Giardia lamblia
YKVLNHKFSLAIVKEAQE

SEQ ID NO: 3175707 - protein, 25 aa, Giardia lamblia
YKVQGMCVGPLLSFVGSSTSPESQW

SEQ ID NO: 3175708 - protein, 19 aa, Giardia lamblia
YKVRIPYLDLFRFAINILD

SEQ ID NO: 3175709 - protein, 19 aa, Giardia lamblia
YKVRQLSSGVLRAMKTELE

SEQ ID NO: 3175710 - protein, 20 aa, Giardia lamblia
YKWIKDSLGFHNITMYLTSM

SEQ ID NO: 3175711 - protein, 19 aa, Giardia lamblia
YKYAPRAVVTSELLPITSC

SEQ ID NO: 3175712 - protein, 19 aa, Giardia lamblia
YKYGFLPALNGTYHYAGDL

SEQ ID NO: 3175713 - protein, 21 aa, Giardia lamblia
YKYQAAALMSELAAVKKDLET

SEQ ID NO: 3175714 - protein, 17 aa, Giardia lamblia
YLAAQLTDYCIVCLSLV

SEQ ID NO: 3175715 - protein, 19 aa, Giardia lamblia
YLAEMVLAFDSLYMLGDIS

SEQ ID NO: 3175716 - protein, 17 aa, Giardia lamblia
YLAVEKRGACIYVAECC

SEQ ID NO: 3175717 - protein, 20 aa, Giardia lamblia
YLCELSQDFCSFISRAADSG

SEQ ID NO: 3175718 - protein, 24 aa, Giardia lamblia
YLDDCCKVSALRRGLMSALALAAS

SEQ ID NO: 3175719 - protein, 25 aa, Giardia lamblia
YLDERIHFLSEAFAKAYPPEACELI

SEQ ID NO: 3175720 - protein, 20 aa, Giardia lamblia
YLDKTCHGIYGFPTHIRHSW

SEQ ID NO: 3175721 - protein, 18 aa, Giardia lamblia
YLDLFRFAINILDQPANT

SEQ ID NO: 3175722 - protein, 27 aa, Giardia lamblia
YLDQKRIPFSYLKLSTTLSLTFGNLSP

SEQ ID NO: 3175723 - protein, 28 aa, Giardia lamblia
YLEGLRVIIDMNCCSSLSVYIQFDEPDN

SEQ ID NO: 3175724 - protein, 29 aa, Giardia lamblia
YLEKARYSIKHMFVFDIFLGLRIADGVSD

SEQ ID NO: 3175725 - protein, 18 aa, Giardia lamblia
YLELAKKYNVSWLNYVVE

SEQ ID NO: 3175726 - protein, 17 aa, Giardia lamblia
YLESKRLAFPRFFFLSN

SEQ ID NO: 3175727 - protein, 21 aa, Giardia lamblia
YLETPLLLGGYKFDIRQWVFV

SEQ ID NO: 3175728 - protein, 18 aa, Giardia lamblia
YLFEQANDGTECYVPSLL

SEQ ID NO: 3175729 - protein, 19 aa, Giardia lamblia
YLFQSCAVIHPNLVRHRDM

SEQ ID NO: 3175730 - protein, 27 aa, Giardia lamblia
YLFVLKYPACRGFKPILLDNTIIRIRN

SEQ ID NO: 3175731 - protein, 27 aa, Giardia lamblia
YLGDFLFDTHNPFSFYYKKAVAQGDTD

SEQ ID NO: 3175732 - protein, 17 aa, Giardia lamblia
YLGKGCVLLSTRTHAQI

SEQ ID NO: 3175733 - protein, 17 aa, Giardia lamblia
YLGKRALKHETKIQNLE

SEQ ID NO: 3175734 - protein, 19 aa, Giardia lamblia
YLHEPHEKMMIDWYSAEIP

SEQ ID NO: 3175735 - protein, 25 aa, Giardia lamblia
YLHKCVSKVRVKWQAISKDIGITGR

SEQ ID NO: 3175736 - protein, 20 aa, Giardia lamblia
YLHMYARNTIPWAETIVHGA

SEQ ID NO: 3175737 - protein, 17 aa, Giardia lamblia
YLHNEARIHVGQIGSTT

SEQ ID NO: 3175738 - protein, 19 aa, Giardia lamblia
YLHSKWILHRDIKLSNILI

SEQ ID NO: 3175739 - protein, 18 aa, Giardia lamblia
YLIDCCREELELCAGCTT

SEQ ID NO: 3175740 - protein, 21 aa, Giardia lamblia
YLIEDCLKLKASERLTAGDIY

SEQ ID NO: 3175741 - protein, 17 aa, Giardia lamblia
YLINPLGERKEGGKFQT

SEQ ID NO: 3175742 - protein, 18 aa, Giardia lamblia
YLIPPRLSLTNRYSAKLL

SEQ ID NO: 3175743 - protein, 24 aa, Giardia lamblia
YLIPYRIRTGGGYTGGFSGDSESL

SEQ ID NO: 3175744 - protein, 24 aa, Giardia lamblia
YLIYRFLLESGYVHAAFMFGHESG

SEQ ID NO: 3175745 - protein, 22 aa, Giardia lamblia
YLKLCLPDLDPGFFDYLKTLSW

SEQ ID NO: 3175746 - protein, 28 aa, Giardia lamblia
YLKTYKFIYRRYVKSLRSLMLKMHRAPM

SEQ ID NO: 3175747 - protein, 30 aa, Giardia lamblia
YLKVQCYSLFQCIYEISRYIVTAIQVKSSG

SEQ ID NO: 3175748 - protein, 20 aa, Giardia lamblia
YLLCCLPLLQYERSIVDSHG

SEQ ID NO: 3175749 - protein, 18 aa, Giardia lamblia
YLLLGLDAEAIFDGDNLA

SEQ ID NO: 3175750 - protein, 19 aa, Giardia lamblia
YLLMGRVVPFLDCRLLQMV

SEQ ID NO: 3175751 - protein, 18 aa, Giardia lamblia
YLLNNPFTRHQMLFMLKE

SEQ ID NO: 3175752 - protein, 26 aa, Giardia lamblia
YLLPSHKGILASWYFENFLLQYLHRL

SEQ ID NO: 3175753 - protein, 18 aa, Giardia lamblia
YLLSESLKPLGRIMDRYI

SEQ ID NO: 3175754 - protein, 24 aa, Giardia lamblia
YLLSKCFDIYMAVPFGTLPKPPTL

SEQ ID NO: 3175755 - protein, 23 aa, Giardia lamblia
YLLSRAFTPVDVIGEDVTGLVHH

SEQ ID NO: 3175756 - protein, 27 aa, Giardia lamblia
YLLYMRKRYEQITGWRFDMKSPSEYRF

SEQ ID NO: 3175757 - protein, 29 aa, Giardia lamblia
YLMDMGYRPIFQVIRRGIRFSDLGQPSID

SEQ ID NO: 3175758 - protein, 23 aa, Giardia lamblia
YLMGHFDIAIFLSIRGYNCTPGI

SEQ ID NO: 3175759 - protein, 17 aa, Giardia lamblia
YLMGWLRASNHQKVYAI

SEQ ID NO: 3175760 - protein, 18 aa, Giardia lamblia
YLNIMAIYLDAVFCPALL

SEQ ID NO: 3175761 - protein, 20 aa, Giardia lamblia
YLNPLLMKTEKAFCLYVLHS

SEQ ID NO: 3175762 - protein, 19 aa, Giardia lamblia
YLNTLKADFLAVSTSILNT

SEQ ID NO: 3175763 - protein, 18 aa, Giardia lamblia
YLPGVCRTDVCIAALGEY

SEQ ID NO: 3175764 - protein, 24 aa, Giardia lamblia
YLPTHIRRAFKEHLHPVNVVLSMR

SEQ ID NO: 3175765 - protein, 34 aa, Giardia lamblia
YLQHGISSIKAGAWRRSELMLAKARSMLPGDERP

SEQ ID NO: 3175766 - protein, 21 aa, Giardia lamblia
YLQKCKEILDNVSYENRSIYG

SEQ ID NO: 3175767 - protein, 17 aa, Giardia lamblia
YLQKIWVERDKQAHEKK

SEQ ID NO: 3175768 - protein, 18 aa, Giardia lamblia
YLQLSGLSARVHVPDVQL

SEQ ID NO: 3175769 - protein, 36 aa, Giardia lamblia
YLQQGHNLWVCIGLIHAGCHSISVAIGKYMVDKQIN

SEQ ID NO: 3175770 - protein, 21 aa, Giardia lamblia
YLQRINALFFIQELAAASKSN

SEQ ID NO: 3175771 - protein, 25 aa, Giardia lamblia
YLQTIKIFIHRTALLLSDPAVSIFI

SEQ ID NO: 3175772 - protein, 19 aa, Giardia lamblia
YLRAMKFCQLFAKLNRLVI

SEQ ID NO: 3175773 - protein, 24 aa, Giardia lamblia
YLREHPELKAITTWFISEVIYMQP

SEQ ID NO: 3175774 - protein, 18 aa, Giardia lamblia
YLRLDGTIADVSERDRIC

SEQ ID NO: 3175775 - protein, 24 aa, Giardia lamblia
YLRSKLDAFMLRHQVLKIFNVLGT

SEQ ID NO: 3175776 - protein, 19 aa, Giardia lamblia
YLSAMLYRHAKTISGKNQL

SEQ ID NO: 3175777 - protein, 24 aa, Giardia lamblia
YLSGCPLVNVLDIEWYIKSQIIPP

SEQ ID NO: 3175778 - protein, 17 aa, Giardia lamblia
YLSLLSCPSVPGQPLEA

SEQ ID NO: 3175779 - protein, 21 aa, Giardia lamblia
YLSLYTLKGTDKFMAEEIDAE

SEQ ID NO: 3175780 - protein, 18 aa, Giardia lamblia
YLSQRYPTPRGYHADDYR

SEQ ID NO: 3175781 - protein, 18 aa, Giardia lamblia
YLSRRLQISTGLHYSGFN

SEQ ID NO: 3175782 - protein, 18 aa, Giardia lamblia
YLTCYRQPLFSIAVSVLD

SEQ ID NO: 3175783 - protein, 25 aa, Giardia lamblia
YLVEEGLRSGHSYSAVWNEVIRYSS

SEQ ID NO: 3175784 - protein, 23 aa, Giardia lamblia
YLVIRYRYPTIIFVKTIDQAKNF

SEQ ID NO: 3175785 - protein, 22 aa, Giardia lamblia
YLVMKHQYQVAAEQERRVMEEQ

SEQ ID NO: 3175786 - protein, 17 aa, Giardia lamblia
YLVRDVPDAITVRDPLS

SEQ ID NO: 3175787 - protein, 19 aa, Giardia lamblia
YLVSCVLMQKMGAGLHSSA

SEQ ID NO: 3175788 - protein, 20 aa, Giardia lamblia
YLVSMDFHTLIPLFAENIQL

SEQ ID NO: 3175789 - protein, 17 aa, Giardia lamblia
YLYELIFKKRPFTTGRE

SEQ ID NO: 3175790 - protein, 20 aa, Giardia lamblia
YLYIRMTYYPETLRDIITSH

SEQ ID NO: 3175791 - protein, 27 aa, Giardia lamblia
YLYRPPKIVYKDICKCIANKDLESLTA

SEQ ID NO: 3175792 - protein, 17 aa, Giardia lamblia
YLYSGPLGPVFKAKRTH

SEQ ID NO: 3175793 - protein, 21 aa, Giardia lamblia
YMAAIKVKISYTIQQYSFSNN

SEQ ID NO: 3175794 - protein, 24 aa, Giardia lamblia
YMASVWMHLSAFNFSTIRCPTSLT

SEQ ID NO: 3175795 - protein, 26 aa, Giardia lamblia
YMDGQHSGFCFVEFTSHESALRCLLA

SEQ ID NO: 3175796 - protein, 22 aa, Giardia lamblia
YMDVIWLSCLQYMHLFVHQLHI

SEQ ID NO: 3175797 - protein, 20 aa, Giardia lamblia
YMERECKKAMLSNKIKLTAM

SEQ ID NO: 3175798 - protein, 18 aa, Giardia lamblia
YMFDVRFAIAKEFSIAAE

SEQ ID NO: 3175799 - protein, 17 aa, Giardia lamblia
YMFFKDLSPPEAASPRL

SEQ ID NO: 3175800 - protein, 18 aa, Giardia lamblia
YMGELDMLAGVKPTQQSD

SEQ ID NO: 3175801 - protein, 17 aa, Giardia lamblia
YMGMPSDVWQFGVALYS

SEQ ID NO: 3175802 - protein, 18 aa, Giardia lamblia
YMIRKIELIGDVCRNLQI

SEQ ID NO: 3175803 - protein, 20 aa, Giardia lamblia
YMKYNCAYIHRGYVTEDSIE

SEQ ID NO: 3175804 - protein, 18 aa, Giardia lamblia
YMLEFGILDFKAFTLDAE

SEQ ID NO: 3175805 - protein, 23 aa, Giardia lamblia
YMLGPYCTPRLGMPVATNAHLRC

SEQ ID NO: 3175806 - protein, 24 aa, Giardia lamblia
YMLLRDLFDNCLVFVHAVDVFETP

SEQ ID NO: 3175807 - protein, 18 aa, Giardia lamblia
YMMFTALHYAAASGHKDV

SEQ ID NO: 3175808 - protein, 24 aa, Giardia lamblia
YMNMVFRLSIYCVREQSKRLLRRL

SEQ ID NO: 3175809 - protein, 18 aa, Giardia lamblia
YMNPLLKWNNTNIIDFDE

SEQ ID NO: 3175810 - protein, 27 aa, Giardia lamblia
YMPHCRGTERCKFCFQRHMSRDCPDLK

SEQ ID NO: 3175811 - protein, 19 aa, Giardia lamblia
YMQTLICENDILLVDCDNQ

SEQ ID NO: 3175812 - protein, 19 aa, Giardia lamblia
YMRLHEMQDAQALGYSVPE

SEQ ID NO: 3175813 - protein, 22 aa, Giardia lamblia
YMRTLCVHIGLLVGHEAYMLEL

SEQ ID NO: 3175814 - protein, 20 aa, Giardia lamblia
YMSSEFGTAVSKYIEDCERA

SEQ ID NO: 3175815 - protein, 18 aa, Giardia lamblia
YMSWLKVLSNLGFSGSKL

SEQ ID NO: 3175816 - protein, 17 aa, Giardia lamblia
YMTCEVVSGAMYAFPRL

SEQ ID NO: 3175817 - protein, 18 aa, Giardia lamblia
YMVCNLCSSASARNQLRT

SEQ ID NO: 3175818 - protein, 21 aa, Giardia lamblia
YMVEKRISAVPVKDGDSYIGY

SEQ ID NO: 3175819 - protein, 24 aa, Giardia lamblia
YMVIPRLFHYLTPKKSFVCTEHSQ

SEQ ID NO: 3175820 - protein, 17 aa, Giardia lamblia
YMVNALVEKLHMATNDL

SEQ ID NO: 3175821 - protein, 18 aa, Giardia lamblia
YMYRAYDRMALFARRLLT

SEQ ID NO: 3175822 - protein, 19 aa, Giardia lamblia
YNAFKARDYLVVKYAQPDQ

SEQ ID NO: 3175823 - protein, 24 aa, Giardia lamblia
YNALCFTNSSLLRAVFDSYVSNRK

SEQ ID NO: 3175824 - protein, 18 aa, Giardia lamblia
YNALRAGAAIPQGAHGET

SEQ ID NO: 3175825 - protein, 26 aa, Giardia lamblia
YNAPRCLRFLLENEYMEDVRGADGKT

SEQ ID NO: 3175826 - protein, 18 aa, Giardia lamblia
YNAYVCIGYADKMLTEQQ

SEQ ID NO: 3175827 - protein, 26 aa, Giardia lamblia
YNCAEWIGVIDIEFLGSYVRPYMCYR

SEQ ID NO: 3175828 - protein, 17 aa, Giardia lamblia
YNCDVSIDSIFTVPDMR

SEQ ID NO: 3175829 - protein, 25 aa, Giardia lamblia
YNCKELQKLLLIVARDHDQSLLSAA

SEQ ID NO: 3175830 - protein, 24 aa, Giardia lamblia
YNDIPRYINEAGMQCISPVKLITK

SEQ ID NO: 3175831 - protein, 20 aa, Giardia lamblia
YNDQCFEWFSQLKYYLELVG

SEQ ID NO: 3175832 - protein, 23 aa, Giardia lamblia
YNELKSLLIGTVRRACLEVEDST

SEQ ID NO: 3175833 - protein, 21 aa, Giardia lamblia
YNEQKLKAWAKIKSKKFRKVH

SEQ ID NO: 3175834 - protein, 18 aa, Giardia lamblia
YNERNMLCLYHTPFKIID

SEQ ID NO: 3175835 - protein, 23 aa, Giardia lamblia
YNETHLRRISGIKMSAEDKKIIK

SEQ ID NO: 3175836 - protein, 20 aa, Giardia lamblia
YNFLQHLNLFLEIVPKPITS

SEQ ID NO: 3175837 - protein, 19 aa, Giardia lamblia
YNGCKGVFGVLRYMVMADS

SEQ ID NO: 3175838 - protein, 20 aa, Giardia lamblia
YNGFLEKHWEKVLLRTFYMI

SEQ ID NO: 3175839 - protein, 25 aa, Giardia lamblia
YNGHLECIRLLLSEEGGMQDNKGRT

SEQ ID NO: 3175840 - protein, 19 aa, Giardia lamblia
YNGIIFCFGGRNAIKEFSS

SEQ ID NO: 3175841 - protein, 25 aa, Giardia lamblia
YNHKECAYFLMKHELKGYDDSISAV

SEQ ID NO: 3175842 - protein, 18 aa, Giardia lamblia
YNIDEVFSPLTPRLGEDQ

SEQ ID NO: 3175843 - protein, 25 aa, Giardia lamblia
YNILEERVVFGLMATNIVKDFNKAF

SEQ ID NO: 3175844 - protein, 23 aa, Giardia lamblia
YNIMNIPVAFAARTPHVVGPNAT

SEQ ID NO: 3175845 - protein, 18 aa, Giardia lamblia
YNISEPMASYLPQHARTF

SEQ ID NO: 3175846 - protein, 24 aa, Giardia lamblia
YNISYEPRFPGAHHEVFASTAGNI

SEQ ID NO: 3175847 - protein, 18 aa, Giardia lamblia
YNIYAILEECCNRAENGH

SEQ ID NO: 3175848 - protein, 19 aa, Giardia lamblia
YNKACQFTAHYPCVVSKGL

SEQ ID NO: 3175849 - protein, 19 aa, Giardia lamblia
YNKDDIVLLGLKRDHIENF

SEQ ID NO: 3175850 - protein, 26 aa, Giardia lamblia
YNKDFKAFCTEIAQYVVEACTRSAIQ

SEQ ID NO: 3175851 - protein, 23 aa, Giardia lamblia
YNKEYPPVAGFPLFLEAAQFLMF

SEQ ID NO: 3175852 - protein, 17 aa, Giardia lamblia
YNKIRAICERYNVVVET

SEQ ID NO: 3175853 - protein, 31 aa, Giardia lamblia
YNKNSCIQLHKLLVCAGVTFIDSLYDTTAPL

SEQ ID NO: 3175854 - protein, 19 aa, Giardia lamblia
YNLHELGDLFDFVPANFIL

SEQ ID NO: 3175855 - protein, 18 aa, Giardia lamblia
YNLHSFLKLLQMGNGHVS

SEQ ID NO: 3175856 - protein, 18 aa, Giardia lamblia
YNLKRLFMTVPFEAVATD

SEQ ID NO: 3175857 - protein, 18 aa, Giardia lamblia
YNLTCKQGLVSTDEIDRL

SEQ ID NO: 3175858 - protein, 21 aa, Giardia lamblia
YNNEVLPVISLGSLYKQFDEA

SEQ ID NO: 3175859 - protein, 25 aa, Giardia lamblia
YNNHARIVSRLCPYEVRQSDNSGKA

SEQ ID NO: 3175860 - protein, 22 aa, Giardia lamblia
YNNIKLAVSYFCDKHGLPKKEV

SEQ ID NO: 3175861 - protein, 18 aa, Giardia lamblia
YNNLKLFRHENLRTYDHF

SEQ ID NO: 3175862 - protein, 25 aa, Giardia lamblia
YNPAELFNTLLLTDSFRAFIESRSL

SEQ ID NO: 3175863 - protein, 22 aa, Giardia lamblia
YNPDVIRCFPSYSVTAKTMPLA

SEQ ID NO: 3175864 - protein, 18 aa, Giardia lamblia
YNPNFRVYLVTSLPNPKY

SEQ ID NO: 3175865 - protein, 27 aa, Giardia lamblia
YNPVTRLAFLLVDFLADYSIFAEGQDA

SEQ ID NO: 3175866 - protein, 24 aa, Giardia lamblia
YNQKCTQCDLLAKESEGLRVSLQH

SEQ ID NO: 3175867 - protein, 19 aa, Giardia lamblia
YNRAECCEVLAPVEGNRKG

SEQ ID NO: 3175868 - protein, 18 aa, Giardia lamblia
YNRLAQPVITDFINGFNC

SEQ ID NO: 3175869 - protein, 19 aa, Giardia lamblia
YNRLPKFEEVYTFIYRLFR

SEQ ID NO: 3175870 - protein, 25 aa, Giardia lamblia
YNRNLIYLCFHGFYDFGYLVKAVTM

SEQ ID NO: 3175871 - protein, 17 aa, Giardia lamblia
YNRQRIVSVLSTCEKEM

SEQ ID NO: 3175872 - protein, 19 aa, Giardia lamblia
YNRRCALPTDSAVDKRRAF

SEQ ID NO: 3175873 - protein, 17 aa, Giardia lamblia
YNSFKRQLFRNKNRKVC

SEQ ID NO: 3175874 - protein, 32 aa, Giardia lamblia
YNSFLEFFSNPGYRPNIMYLLITRNTMSSNSM

SEQ ID NO: 3175875 - protein, 20 aa, Giardia lamblia
YNSLEYKQNLLLDHENDTHE

SEQ ID NO: 3175876 - protein, 18 aa, Giardia lamblia
YNSTLLRNACEAALVGSD

SEQ ID NO: 3175877 - protein, 23 aa, Giardia lamblia
YNTRLRLISHFFEKMGLEQFALT

SEQ ID NO: 3175878 - protein, 23 aa, Giardia lamblia
YNVCVLAYGCTGSGKTFTLIGDD

SEQ ID NO: 3175879 - protein, 18 aa, Giardia lamblia
YNVRPRIVEIAGYTPRSR

SEQ ID NO: 3175880 - protein, 19 aa, Giardia lamblia
YNVSNCAKAAVNFYHSCSP

SEQ ID NO: 3175881 - protein, 25 aa, Giardia lamblia
YNVSNILCDACKQLNRLDVMRNKAF

SEQ ID NO: 3175882 - protein, 17 aa, Giardia lamblia
YNYITGVFINFKPTGPK

SEQ ID NO: 3175883 - protein, 22 aa, Giardia lamblia
YPCCIHSKSNVRAMSMALLLDF

SEQ ID NO: 3175884 - protein, 17 aa, Giardia lamblia
YPCKTGLSLDVIATLQN

SEQ ID NO: 3175885 - protein, 19 aa, Giardia lamblia
YPDAIKRTIPIWCLVWSTV

SEQ ID NO: 3175886 - protein, 21 aa, Giardia lamblia
YPDKIEEAGACTQTDPMLEIK

SEQ ID NO: 3175887 - protein, 30 aa, Giardia lamblia
YPEARWTGKQVFSMFVPRGVFYRSGDPKDI

SEQ ID NO: 3175888 - protein, 26 aa, Giardia lamblia
YPECLDLRTAKTFSVAIPTTSGTGSE

SEQ ID NO: 3175889 - protein, 22 aa, Giardia lamblia
YPECVSVVRALMDLMKNDPDSA

SEQ ID NO: 3175890 - protein, 21 aa, Giardia lamblia
YPEIVKVLASVECNLVASDGR

SEQ ID NO: 3175891 - protein, 21 aa, Giardia lamblia
YPETFPKYMDPIIAKLNDIFN

SEQ ID NO: 3175892 - protein, 29 aa, Giardia lamblia
YPETHLKRMVTFAVMWSFGAVLDLEERTK

SEQ ID NO: 3175893 - protein, 18 aa, Giardia lamblia
YPFAEEWLSRIAACCPLD

SEQ ID NO: 3175894 - protein, 19 aa, Giardia lamblia
YPFEIVTAISEDFSCMYDV

SEQ ID NO: 3175895 - protein, 19 aa, Giardia lamblia
YPFMTELHVQSKLQKLRQI

SEQ ID NO: 3175896 - protein, 39 aa, Giardia lamblia
YPFTLPDTRTALMLAIKHRRYRLVPLMTERLSRLTNRHG

SEQ ID NO: 3175897 - protein, 21 aa, Giardia lamblia
YPGIDSRIGGASPFDKTAKNV

SEQ ID NO: 3175898 - protein, 18 aa, Giardia lamblia
YPGIVGMPADRMISAEDG

SEQ ID NO: 3175899 - protein, 18 aa, Giardia lamblia
YPGQEVRMHLGILPNNAK

SEQ ID NO: 3175900 - protein, 17 aa, Giardia lamblia
YPGWPANMESVFLKQAI

SEQ ID NO: 3175901 - protein, 19 aa, Giardia lamblia
YPHGDLGAYIRKRAQEQDH

SEQ ID NO: 3175902 - protein, 18 aa, Giardia lamblia
YPHVKLREDFPFLRIILY

SEQ ID NO: 3175903 - protein, 28 aa, Giardia lamblia
YPIDIRDGMNCFRELLISTYGVSLAPLS

SEQ ID NO: 3175904 - protein, 20 aa, Giardia lamblia
YPIEPSAFLTAIQIALLSLR

SEQ ID NO: 3175905 - protein, 17 aa, Giardia lamblia
YPKELPGSFEVVELRND

SEQ ID NO: 3175906 - protein, 21 aa, Giardia lamblia
YPKIISTPLIDPARSSCSSTQ

SEQ ID NO: 3175907 - protein, 29 aa, Giardia lamblia
YPKLTSVHIYWALFGLLFWCTCAKCEQVF

SEQ ID NO: 3175908 - protein, 19 aa, Giardia lamblia
YPKNCLETGISTIDILTSI

SEQ ID NO: 3175909 - protein, 19 aa, Giardia lamblia
YPKRLPGQRTRMMNACMNA

SEQ ID NO: 3175910 - protein, 22 aa, Giardia lamblia
YPLMTSSLLLKRHLCNEKGGVP

SEQ ID NO: 3175911 - protein, 20 aa, Giardia lamblia
YPLQLRRYIELFLNSLAVEP

SEQ ID NO: 3175912 - protein, 18 aa, Giardia lamblia
YPLYVTKYAPCGKCQHKA

SEQ ID NO: 3175913 - protein, 24 aa, Giardia lamblia
YPMFEEMRHAPPFTPLYSCTLNIL

SEQ ID NO: 3175914 - protein, 21 aa, Giardia lamblia
YPMIAEALNTIGIPVEKRNEL

SEQ ID NO: 3175915 - protein, 18 aa, Giardia lamblia
YPMSCNSLTGLTGSASQS

SEQ ID NO: 3175916 - protein, 26 aa, Giardia lamblia
YPMSKLQHIVCLSRQALDDVPNSSAR

SEQ ID NO: 3175917 - protein, 18 aa, Giardia lamblia
YPNFCSSSIYPSITNPNF

SEQ ID NO: 3175918 - protein, 18 aa, Giardia lamblia
YPNSIIRLLLSYSGDIPK

SEQ ID NO: 3175919 - protein, 17 aa, Giardia lamblia
YPPLKIMCHQADLFLWD

SEQ ID NO: 3175920 - protein, 17 aa, Giardia lamblia
YPPPGLLQAGHQGPLNL

SEQ ID NO: 3175921 - protein, 19 aa, Giardia lamblia
YPQTCKYIQTILEQVMRRF

SEQ ID NO: 3175922 - protein, 18 aa, Giardia lamblia
YPRISFGIYGFDIMLQSN

SEQ ID NO: 3175923 - protein, 18 aa, Giardia lamblia
YPRMVACRYNDTRILRLL

SEQ ID NO: 3175924 - protein, 18 aa, Giardia lamblia
YPSMEAISIGPTIRNPHS

SEQ ID NO: 3175925 - protein, 17 aa, Giardia lamblia
YPSRFSPYSTLYPSRLA

SEQ ID NO: 3175926 - protein, 17 aa, Giardia lamblia
YPSSMGGKFTDEQLEER

SEQ ID NO: 3175927 - protein, 26 aa, Giardia lamblia
YPSSVCLYDPLVLRNPHIVFPLRVPS

SEQ ID NO: 3175928 - protein, 20 aa, Giardia lamblia
YPTEGSYHFNSFNQHDNNFI

SEQ ID NO: 3175929 - protein, 17 aa, Giardia lamblia
YPTILLYIVDSERCLNP

SEQ ID NO: 3175930 - protein, 17 aa, Giardia lamblia
YPTKLGINYRTRSRRDK

SEQ ID NO: 3175931 - protein, 20 aa, Giardia lamblia
YPTMRKLKLAADVYKADIQL

SEQ ID NO: 3175932 - protein, 18 aa, Giardia lamblia
YPTPRGYHADDYRIDGLG

SEQ ID NO: 3175933 - protein, 19 aa, Giardia lamblia
YPVCADRLWTKLTEVAQQL

SEQ ID NO: 3175934 - protein, 28 aa, Giardia lamblia
YPVGSTLCRSALAIQCQRLQMKAKQAGT

SEQ ID NO: 3175935 - protein, 19 aa, Giardia lamblia
YPVYRFGCINTKDKSVLPL

SEQ ID NO: 3175936 - protein, 21 aa, Giardia lamblia
YPVYRFGCLNTKDQSVLPLLY

SEQ ID NO: 3175937 - protein, 23 aa, Giardia lamblia
YQACAKASCFALAQVNSVSFDPG

SEQ ID NO: 3175938 - protein, 26 aa, Giardia lamblia
YQASLLHKLFVTKTCTAIDKQEIDDL

SEQ ID NO: 3175939 - protein, 31 aa, Giardia lamblia
YQCKGTTRWGDSLVFDARFEAGNLFSAARVL

SEQ ID NO: 3175940 - protein, 23 aa, Giardia lamblia
YQCPSCKKLILYSTMRAEFEVRM

SEQ ID NO: 3175941 - protein, 26 aa, Giardia lamblia
YQDVSLRFAAQVCALRFNSRSKQKKL

SEQ ID NO: 3175942 - protein, 19 aa, Giardia lamblia
YQEIMRLRDGYGYFVITPV

SEQ ID NO: 3175943 - protein, 22 aa, Giardia lamblia
YQESPKGIALFYGDSAAAERAL

SEQ ID NO: 3175944 - protein, 20 aa, Giardia lamblia
YQGCAPRAPLSWSHSTHSWM

SEQ ID NO: 3175945 - protein, 25 aa, Giardia lamblia
YQGKICSIKGGTAHNAIPMDCSACL

SEQ ID NO: 3175946 - protein, 18 aa, Giardia lamblia
YQGLDWLSDYIFDKKNKK

SEQ ID NO: 3175947 - protein, 22 aa, Giardia lamblia
YQGRTALDHAVIQRKFSCVMYL

SEQ ID NO: 3175948 - protein, 17 aa, Giardia lamblia
YQHLYLKRIFPADQKLK

SEQ ID NO: 3175949 - protein, 19 aa, Giardia lamblia
YQIVFPEFQLLFDQSSIVS

SEQ ID NO: 3175950 - protein, 18 aa, Giardia lamblia
YQLAKAFYKGLGEDVTSV

SEQ ID NO: 3175951 - protein, 24 aa, Giardia lamblia
YQLAVEVMQHCIERAIQGTIADNE

SEQ ID NO: 3175952 - protein, 18 aa, Giardia lamblia
YQLINGVNFCHSRRCLHR

SEQ ID NO: 3175953 - protein, 34 aa, Giardia lamblia
YQLLPEEFLVHMKLFARPYRSMAYRPTPNSTSYM

SEQ ID NO: 3175954 - protein, 17 aa, Giardia lamblia
YQMKRGKKPTGFKSKKR

SEQ ID NO: 3175955 - protein, 25 aa, Giardia lamblia
YQNGVVCSSSLVAQKCITTLKLKMR

SEQ ID NO: 3175956 - protein, 31 aa, Giardia lamblia
YQNSEGWTALMLSIRYQMHRIATRLVNDEQG

SEQ ID NO: 3175957 - protein, 24 aa, Giardia lamblia
YQNVDALLARQAYDPLGHPEVGGL

SEQ ID NO: 3175958 - protein, 17 aa, Giardia lamblia
YQPKEFYSTVDIAPSFD

SEQ ID NO: 3175959 - protein, 23 aa, Giardia lamblia
YQPYWRLHKLRRLIVTTEALGKK

SEQ ID NO: 3175960 - protein, 25 aa, Giardia lamblia
YQQRGPSSFKREEWASKVLIVSPTK

SEQ ID NO: 3175961 - protein, 17 aa, Giardia lamblia
YQSVCSGATDAAEAVAI

SEQ ID NO: 3175962 - protein, 23 aa, Giardia lamblia
YQSVECLLLMLVCKIKRPNNFFI

SEQ ID NO: 3175963 - protein, 25 aa, Giardia lamblia
YQTEAGDYFLVWTLACENEKISTIY

SEQ ID NO: 3175964 - protein, 17 aa, Giardia lamblia
YQTLLLPSVQRLYATSG

SEQ ID NO: 3175965 - protein, 21 aa, Giardia lamblia
YQTNMRNLWIVKPIGLNRGRG

SEQ ID NO: 3175966 - protein, 18 aa, Giardia lamblia
YQTPSLKDIRIQDGKTVN

SEQ ID NO: 3175967 - protein, 21 aa, Giardia lamblia
YQVGYKIVVSKSFKDVIFLIE

SEQ ID NO: 3175968 - protein, 20 aa, Giardia lamblia
YQVIEYKGLIYVVTDRYNKT

SEQ ID NO: 3175969 - protein, 22 aa, Giardia lamblia
YQVKPCLRTHVESITKALESNT

SEQ ID NO: 3175970 - protein, 26 aa, Giardia lamblia
YQVLPSYLPYKALRVLSNLGDTVTQP

SEQ ID NO: 3175971 - protein, 17 aa, Giardia lamblia
YQVRTPLRMPPHSEMDV

SEQ ID NO: 3175972 - protein, 17 aa, Giardia lamblia
YQWPTIYDFLLDFSSLR

SEQ ID NO: 3175973 - protein, 24 aa, Giardia lamblia
YRADYDFSKILSITDIFCPNELEA

SEQ ID NO: 3175974 - protein, 18 aa, Giardia lamblia
YRAGRAVCYCAIKDRDIQ

SEQ ID NO: 3175975 - protein, 17 aa, Giardia lamblia
YRAHHNCFSSCASCDVS

SEQ ID NO: 3175976 - protein, 21 aa, Giardia lamblia
YRALRELRPAAKIPGNVMDSL

SEQ ID NO: 3175977 - protein, 19 aa, Giardia lamblia
YRAPELLRTGVATTKSDIW

SEQ ID NO: 3175978 - protein, 18 aa, Giardia lamblia
YRAVELFLKDSSYSAKND

SEQ ID NO: 3175979 - protein, 19 aa, Giardia lamblia
YRCASVCSTCQNLYMNNTV

SEQ ID NO: 3175980 - protein, 24 aa, Giardia lamblia
YRDHEGPRGPAFSFSGREGVEYAN

SEQ ID NO: 3175981 - protein, 17 aa, Giardia lamblia
YRDSRLVNWDCSLQTAV

SEQ ID NO: 3175982 - protein, 20 aa, Giardia lamblia
YREEFKRYQVIRDMLLEYWN

SEQ ID NO: 3175983 - protein, 18 aa, Giardia lamblia
YREGDIYEGEFLDDERHG

SEQ ID NO: 3175984 - protein, 25 aa, Giardia lamblia
YRELSSPMPYVFVTHVPPEHGLLIQ

SEQ ID NO: 3175985 - protein, 18 aa, Giardia lamblia
YRESKSLLSPAKPSHKIL

SEQ ID NO: 3175986 - protein, 17 aa, Giardia lamblia
YRETALMRAAEKGYPEC

SEQ ID NO: 3175987 - protein, 17 aa, Giardia lamblia
YRFDHVFDSHATQADVF

SEQ ID NO: 3175988 - protein, 24 aa, Giardia lamblia
YRGHIDIVKLLLCEVKLQNEKGWT

SEQ ID NO: 3175989 - protein, 20 aa, Giardia lamblia
YRGTSALMIAAMRGHPENVA

SEQ ID NO: 3175990 - protein, 18 aa, Giardia lamblia
YRGVDFRKAYLSPDTLIT

SEQ ID NO: 3175991 - protein, 23 aa, Giardia lamblia
YRGWLYNLYETVLFGDPNEARIP

SEQ ID NO: 3175992 - protein, 17 aa, Giardia lamblia
YRHATLLEHTLELHKIV

SEQ ID NO: 3175993 - protein, 18 aa, Giardia lamblia
YRILLRRQISSFAKTESE

SEQ ID NO: 3175994 - protein, 24 aa, Giardia lamblia
YRINSVFYAEGWAYLNAAEAIGVS

SEQ ID NO: 3175995 - protein, 21 aa, Giardia lamblia
YRIVLPNVRRSRAAIEDLKSE

SEQ ID NO: 3175996 - protein, 22 aa, Giardia lamblia
YRIYTKEAWPALNAAQQRKPRA

SEQ ID NO: 3175997 - protein, 17 aa, Giardia lamblia
YRKAIKEKVAEALTPLC

SEQ ID NO: 3175998 - protein, 25 aa, Giardia lamblia
YRKYGLFICRRCFKENAGKIGFVKL

SEQ ID NO: 3175999 - protein, 20 aa, Giardia lamblia
YRLLIETRACKLVQTDRKRR

SEQ ID NO: 3176000 - protein, 25 aa, Giardia lamblia
YRLLTRRYGVELAWTPMHSTNTLVT

SEQ ID NO: 3176001 - protein, 17 aa, Giardia lamblia
YRLLVAFDVKQPFFSNI

SEQ ID NO: 3176002 - protein, 22 aa, Giardia lamblia
YRLNSLLLPCITCFSEHISYTF

SEQ ID NO: 3176003 - protein, 25 aa, Giardia lamblia
YRLSEIKAEILASDSLRKYFSQQSK

SEQ ID NO: 3176004 - protein, 18 aa, Giardia lamblia
YRMAHAFMDLYKQGVVTR

SEQ ID NO: 3176005 - protein, 27 aa, Giardia lamblia
YRMSSARLSYSVGRGRVFSSLPRFSSA

SEQ ID NO: 3176006 - protein, 27 aa, Giardia lamblia
YRMVHILKQHEAGCCDNRGYTALMLAA

SEQ ID NO: 3176007 - protein, 22 aa, Giardia lamblia
YRNGCTYSLISLFPPLDKLYQL

SEQ ID NO: 3176008 - protein, 23 aa, Giardia lamblia
YRNGCTYSLISLFPPLDKLYQLF

SEQ ID NO: 3176009 - protein, 26 aa, Giardia lamblia
YRNKERLGAAMLRRCANEIGGEFDTD

SEQ ID NO: 3176010 - protein, 25 aa, Giardia lamblia
YRNPGTYSLCIDKFLANPFVVDQSY

SEQ ID NO: 3176011 - protein, 17 aa, Giardia lamblia
YRPCPLPGETNHANITK

SEQ ID NO: 3176012 - protein, 17 aa, Giardia lamblia
YRPGMSYMVEAFATWCP

SEQ ID NO: 3176013 - protein, 18 aa, Giardia lamblia
YRPICSREEPLFLSYSDL

SEQ ID NO: 3176014 - protein, 17 aa, Giardia lamblia
YRPIRTPSIESSTTHES

SEQ ID NO: 3176015 - protein, 17 aa, Giardia lamblia
YRPMVAATYVELLENRE

SEQ ID NO: 3176016 - protein, 26 aa, Giardia lamblia
YRPNTLPIIDFRSLSPLHREKLARIK

SEQ ID NO: 3176017 - protein, 18 aa, Giardia lamblia
YRPPEAYLGLPFDQTLDI

SEQ ID NO: 3176018 - protein, 17 aa, Giardia lamblia
YRPVPAVSQDLKNTAMR

SEQ ID NO: 3176019 - protein, 18 aa, Giardia lamblia
YRRALVIDPSCIDIDAIS

SEQ ID NO: 3176020 - protein, 20 aa, Giardia lamblia
YRRCNCNNLMRIYKIVENKN

SEQ ID NO: 3176021 - protein, 19 aa, Giardia lamblia
YRRGICSPPVYSWSTPETH

SEQ ID NO: 3176022 - protein, 19 aa, Giardia lamblia
YRRLLQLKSVHDRSKGADC

SEQ ID NO: 3176023 - protein, 21 aa, Giardia lamblia
YRRQHKYHFVKSSTIGSKRRA

SEQ ID NO: 3176024 - protein, 17 aa, Giardia lamblia
YRRSGMRLVKINPEALS

SEQ ID NO: 3176025 - protein, 27 aa, Giardia lamblia
YRSAQELLRDLLLIAFNARRYNSLDHF

SEQ ID NO: 3176026 - protein, 23 aa, Giardia lamblia
YRSKDSPLRRFLIPGENIIYSID

SEQ ID NO: 3176027 - protein, 19 aa, Giardia lamblia
YRSSDFAGVVIDTFSAPHQ

SEQ ID NO: 3176028 - protein, 26 aa, Giardia lamblia
YRSTANWASVLAMGMDCMAVNPYSFL

SEQ ID NO: 3176029 - protein, 17 aa, Giardia lamblia
YRTEVMTRLEATRLMYA

SEQ ID NO: 3176030 - protein, 19 aa, Giardia lamblia
YRTLQHGVLSTKPLRPHTT

SEQ ID NO: 3176031 - protein, 21 aa, Giardia lamblia
YRTRRTMCAVGDTSVCITSPA

SEQ ID NO: 3176032 - protein, 17 aa, Giardia lamblia
YRTSRIITEKLFEKIEL

SEQ ID NO: 3176033 - protein, 27 aa, Giardia lamblia
YRTYIDGVKEFPIWCYLGEELDEMGDP

SEQ ID NO: 3176034 - protein, 27 aa, Giardia lamblia
YRVLKACLYGDLGLYHWLNNDLLSASL

SEQ ID NO: 3176035 - protein, 21 aa, Giardia lamblia
YRVTGKVQGVFFRKYTKKEAD

SEQ ID NO: 3176036 - protein, 25 aa, Giardia lamblia
YRYFIDVFEGLSFLDPSTDMSARNP

SEQ ID NO: 3176037 - protein, 24 aa, Giardia lamblia
YRYFVEPWPTLTIFAESNEEIVGC

SEQ ID NO: 3176038 - protein, 21 aa, Giardia lamblia
YRYLEGFIMVANWSTLHSGVA

SEQ ID NO: 3176039 - protein, 25 aa, Giardia lamblia
YRYPNGQLKLTFYGLRTDSQSDNIY

SEQ ID NO: 3176040 - protein, 17 aa, Giardia lamblia
YRYQGCDSLVLGTEDGL

SEQ ID NO: 3176041 - protein, 21 aa, Giardia lamblia
YRYQHCDADLRIRTIPFFHIR

SEQ ID NO: 3176042 - protein, 18 aa, Giardia lamblia
YRYSYPPPTIFPDIGHGT

SEQ ID NO: 3176043 - protein, 17 aa, Giardia lamblia
YRYTTFSFPLRNWEKRM

SEQ ID NO: 3176044 - protein, 24 aa, Giardia lamblia
YRYVRETYPEYKLIFMGRSIGSVT

SEQ ID NO: 3176045 - protein, 19 aa, Giardia lamblia
YRYYDPPARAAAVKQSLEQ

SEQ ID NO: 3176046 - protein, 29 aa, Giardia lamblia
YSAAALRGTCCFFVMYGLGTISAMYQYSL

SEQ ID NO: 3176047 - protein, 19 aa, Giardia lamblia
YSAAYIVACAMECMTDTQR

SEQ ID NO: 3176048 - protein, 26 aa, Giardia lamblia
YSAECSAAINCHRESVSMVLYQRLAY

SEQ ID NO: 3176049 - protein, 24 aa, Giardia lamblia
YSAEDIPKFHAFKNQPNVISVIES

SEQ ID NO: 3176050 - protein, 24 aa, Giardia lamblia
YSAEIPIGPVVHGYLTPSDIFISR

SEQ ID NO: 3176051 - protein, 27 aa, Giardia lamblia
YSAGSFSQAGCHGSVLSTRSITESMPV

SEQ ID NO: 3176052 - protein, 23 aa, Giardia lamblia
YSALFCRPESTALILQSSVSSEV

SEQ ID NO: 3176053 - protein, 17 aa, Giardia lamblia
YSALYHCEVAAFHSGQE

SEQ ID NO: 3176054 - protein, 19 aa, Giardia lamblia
YSARSSTSYTARRSYADNK

SEQ ID NO: 3176055 - protein, 22 aa, Giardia lamblia
YSCDCKRCSGRIMSNVASMEVS

SEQ ID NO: 3176056 - protein, 31 aa, Giardia lamblia
YSDACNLSLEKPEILAPPSWDMPTGQTQVLP

SEQ ID NO: 3176057 - protein, 17 aa, Giardia lamblia
YSDAMSESFREGTNLFA

SEQ ID NO: 3176058 - protein, 19 aa, Giardia lamblia
YSDGKFILVGPSAVSALDI

SEQ ID NO: 3176059 - protein, 17 aa, Giardia lamblia
YSDGSVYEGSWHNDVKH

SEQ ID NO: 3176060 - protein, 25 aa, Giardia lamblia
YSDLWSDVVSLSFPTKEKVVTKSVA

SEQ ID NO: 3176061 - protein, 18 aa, Giardia lamblia
YSDNKCGDFLLSAEIVRL

SEQ ID NO: 3176062 - protein, 18 aa, Giardia lamblia
YSDRIEDIRLLRAKITDL

SEQ ID NO: 3176063 - protein, 20 aa, Giardia lamblia
YSDRTVKIFYNADGKLETRQ

SEQ ID NO: 3176064 - protein, 23 aa, Giardia lamblia
YSDVAKRFKELFVSHLNDSLDFV

SEQ ID NO: 3176065 - protein, 22 aa, Giardia lamblia
YSEDLKRLISVSLVKDPMQRAD

SEQ ID NO: 3176066 - protein, 22 aa, Giardia lamblia
YSEDVLEWILTVLDIFFPAKIR

SEQ ID NO: 3176067 - protein, 27 aa, Giardia lamblia
YSEHVITMPGCFICPSHSMHYSNAILL

SEQ ID NO: 3176068 - protein, 17 aa, Giardia lamblia
YSEKLEAVQMLKFGQLI

SEQ ID NO: 3176069 - protein, 19 aa, Giardia lamblia
YSETLTWLVHSCLLVDPTE

SEQ ID NO: 3176070 - protein, 25 aa, Giardia lamblia
YSFLGDGCPYLADGKEISRREFNLL

SEQ ID NO: 3176071 - protein, 26 aa, Giardia lamblia
YSGHLGCVQALIPREAGLTMDDGWTA

SEQ ID NO: 3176072 - protein, 29 aa, Giardia lamblia
YSGSFTYEYRLKLVYEHWCLEVVDKHIPS

SEQ ID NO: 3176073 - protein, 19 aa, Giardia lamblia
YSHDEVKDLLKQLSDKEAE

SEQ ID NO: 3176074 - protein, 22 aa, Giardia lamblia
YSHSCFLAAIRSHFYHHFPYNT

SEQ ID NO: 3176075 - protein, 18 aa, Giardia lamblia
YSHSRKGSRFIANSDSEE

SEQ ID NO: 3176076 - protein, 18 aa, Giardia lamblia
YSHSSRMRPITSHSNSAV

SEQ ID NO: 3176077 - protein, 19 aa, Giardia lamblia
YSHTEFSLKESPAVLHQED

SEQ ID NO: 3176078 - protein, 23 aa, Giardia lamblia
YSIMSKRHLQWFVEEGLVEGWFD

SEQ ID NO: 3176079 - protein, 19 aa, Giardia lamblia
YSIRCAGFLMQKEIDYFRI

SEQ ID NO: 3176080 - protein, 22 aa, Giardia lamblia
YSIRELLFFSLLIRFSSTTGLE

SEQ ID NO: 3176081 - protein, 18 aa, Giardia lamblia
YSKAHCLCCHTNVKKVLL

SEQ ID NO: 3176082 - protein, 30 aa, Giardia lamblia
YSKIKDFLRRMCYLVEGIIAGSALFPMQNT

SEQ ID NO: 3176083 - protein, 17 aa, Giardia lamblia
YSKMRRRVFTRLHRAVE

SEQ ID NO: 3176084 - protein, 35 aa, Giardia lamblia
YSKPCLGGLMGKRARVGLGYGRWVEGLAEADVFTN

SEQ ID NO: 3176085 - protein, 21 aa, Giardia lamblia
YSLEYLIRITGRFEPSPQDQN

SEQ ID NO: 3176086 - protein, 17 aa, Giardia lamblia
YSLLSYPGPYLSLIKEI

SEQ ID NO: 3176087 - protein, 18 aa, Giardia lamblia
YSLPFYWNGIEDIHKDLK

SEQ ID NO: 3176088 - protein, 31 aa, Giardia lamblia
YSLVLRLPPGGSRFYSGPGYQSFLELSIRKD

SEQ ID NO: 3176089 - protein, 28 aa, Giardia lamblia
YSMVISRCIAAKFLLLMVKVVDGDQLCT

SEQ ID NO: 3176090 - protein, 26 aa, Giardia lamblia
YSMWHSLNFDCYVQPPGRKSALEHDF

SEQ ID NO: 3176091 - protein, 24 aa, Giardia lamblia
YSNCARSLLRKEICMQDNNGTTAL

SEQ ID NO: 3176092 - protein, 18 aa, Giardia lamblia
YSNLCGILSEQEETIRSL

SEQ ID NO: 3176093 - protein, 21 aa, Giardia lamblia
YSNTIRIFLDHTLVLDPSKRL

SEQ ID NO: 3176094 - protein, 23 aa, Giardia lamblia
YSNVRLSLKLGLLSLGSGVVSRL

SEQ ID NO: 3176095 - protein, 39 aa, Giardia lamblia
YSPESKKWLQAHCQARYAILQACLKWAPETIEFPETGDG

SEQ ID NO: 3176096 - protein, 24 aa, Giardia lamblia
YSPIGPWPSCPAEQVFFPLHTREL

SEQ ID NO: 3176097 - protein, 17 aa, Giardia lamblia
YSPLHLALLLNHIQLAK

SEQ ID NO: 3176098 - protein, 17 aa, Giardia lamblia
YSPSMLFDIALLGERHI

SEQ ID NO: 3176099 - protein, 23 aa, Giardia lamblia
YSQALRDLVYWCLRMNATGRPDV

SEQ ID NO: 3176100 - protein, 19 aa, Giardia lamblia
YSQGKSAARACLKTISQVS

SEQ ID NO: 3176101 - protein, 23 aa, Giardia lamblia
YSREKEDVLVLGKLINNIIMQST

SEQ ID NO: 3176102 - protein, 27 aa, Giardia lamblia
YSRFNSIALTGYRWKYLGEDLHMDKTL

SEQ ID NO: 3176103 - protein, 21 aa, Giardia lamblia
YSRHLYWYLICGTANCTELKD

SEQ ID NO: 3176104 - protein, 17 aa, Giardia lamblia
YSRPFSRLTADRQSQFH

SEQ ID NO: 3176105 - protein, 21 aa, Giardia lamblia
YSRPPAVLCTNSLSSSSRRDS

SEQ ID NO: 3176106 - protein, 18 aa, Giardia lamblia
YSRSRAGSRALSLSRRSV

SEQ ID NO: 3176107 - protein, 24 aa, Giardia lamblia
YSSANSCSVWALLEKKMAFISPGT

SEQ ID NO: 3176108 - protein, 20 aa, Giardia lamblia
YSSDCPTSILSSGIQGSGIS

SEQ ID NO: 3176109 - protein, 21 aa, Giardia lamblia
YSSLQLYSGMFDAPDEEPEKP

SEQ ID NO: 3176110 - protein, 17 aa, Giardia lamblia
YSSQYAGYRIQHKEVEA

SEQ ID NO: 3176111 - protein, 25 aa, Giardia lamblia
YSSSLDCLMYAAARSRKSANRVNQA

SEQ ID NO: 3176112 - protein, 28 aa, Giardia lamblia
YSTDAWRAGFNHLKEVIYRDIYEERAAT

SEQ ID NO: 3176113 - protein, 24 aa, Giardia lamblia
YSTIKTQRNSSCLSFQRPTVNISH

SEQ ID NO: 3176114 - protein, 24 aa, Giardia lamblia
YSTKGIECSFGFDSSTKVYAELIG

SEQ ID NO: 3176115 - protein, 30 aa, Giardia lamblia
YSTMHLCAACSLHNFRTAFNQWASRQRMRP

SEQ ID NO: 3176116 - protein, 18 aa, Giardia lamblia
YSTMRLGDLLVSVKSNTM

SEQ ID NO: 3176117 - protein, 18 aa, Giardia lamblia
YSTPGTQFSIQWSLNLLV

SEQ ID NO: 3176118 - protein, 23 aa, Giardia lamblia
YSTRGRLPPRTVKDLSPPISTPA

SEQ ID NO: 3176119 - protein, 22 aa, Giardia lamblia
YSVIHEICERRGWRQVGESDDW

SEQ ID NO: 3176120 - protein, 18 aa, Giardia lamblia
YSVPITAMCYGETEETVI

SEQ ID NO: 3176121 - protein, 18 aa, Giardia lamblia
YSYMLYRYFIDVFEGLSF

SEQ ID NO: 3176122 - protein, 18 aa, Giardia lamblia
YTAELLATLSAYQKHPVL

SEQ ID NO: 3176123 - protein, 35 aa, Giardia lamblia
YTALMAAAEWSFIKCVRALLPREHDIRHSSGKTAI

SEQ ID NO: 3176124 - protein, 26 aa, Giardia lamblia
YTALMFAASLGNYVACELLLHAEGAI

SEQ ID NO: 3176125 - protein, 17 aa, Giardia lamblia
YTASCSVIFEHDYSKLI

SEQ ID NO: 3176126 - protein, 22 aa, Giardia lamblia
YTCPLCRKLFLKGKSLEEVTSQ

SEQ ID NO: 3176127 - protein, 21 aa, Giardia lamblia
YTDLHTFKFDHVFNEQSDNQE

SEQ ID NO: 3176128 - protein, 19 aa, Giardia lamblia
YTECVKLLLEEEGCMQKSG

SEQ ID NO: 3176129 - protein, 22 aa, Giardia lamblia
YTEFYQCASILIQKGGAKGELG

SEQ ID NO: 3176130 - protein, 18 aa, Giardia lamblia
YTEICKVLAPLEKHVTLP

SEQ ID NO: 3176131 - protein, 17 aa, Giardia lamblia
YTENRPTLLSSNLTYCY

SEQ ID NO: 3176132 - protein, 17 aa, Giardia lamblia
YTFSSDMWSLGVIAYEL

SEQ ID NO: 3176133 - protein, 17 aa, Giardia lamblia
YTFVYGLHLETNSYAYK

SEQ ID NO: 3176134 - protein, 18 aa, Giardia lamblia
YTGLAKRLRVRDFPYYKA

SEQ ID NO: 3176135 - protein, 20 aa, Giardia lamblia
YTGLRMAYKSMIIVRDLNFG

SEQ ID NO: 3176136 - protein, 20 aa, Giardia lamblia
YTGVMSIFMDRCAARKPITI

SEQ ID NO: 3176137 - protein, 18 aa, Giardia lamblia
YTHICYMLPFISPTASEA

SEQ ID NO: 3176138 - protein, 23 aa, Giardia lamblia
YTHLTATCKYNFTSNVAQVCMEA

SEQ ID NO: 3176139 - protein, 27 aa, Giardia lamblia
YTHPEARPVIKSAYLSECEEDLLHYPQ

SEQ ID NO: 3176140 - protein, 23 aa, Giardia lamblia
YTHPKAEAILGMSQVEHERYNAL

SEQ ID NO: 3176141 - protein, 21 aa, Giardia lamblia
YTIGCIIHRSITPSNVLIAEN

SEQ ID NO: 3176142 - protein, 17 aa, Giardia lamblia
YTIKILPHDGFQPMADA

SEQ ID NO: 3176143 - protein, 23 aa, Giardia lamblia
YTIKPDTLRTWFATEMAGKQTHE

SEQ ID NO: 3176144 - protein, 27 aa, Giardia lamblia
YTIKQGCLFSMGFSWRVSEAPIVGFRS

SEQ ID NO: 3176145 - protein, 17 aa, Giardia lamblia
YTILVAMCQSMRYIMAA

SEQ ID NO: 3176146 - protein, 18 aa, Giardia lamblia
YTIYKRYGGTSILMPFTF

SEQ ID NO: 3176147 - protein, 24 aa, Giardia lamblia
YTKILVRRGRLYLDRGDYQASYAD

SEQ ID NO: 3176148 - protein, 26 aa, Giardia lamblia
YTKMIYLLHLLRKVCDNPCELSTEDA

SEQ ID NO: 3176149 - protein, 23 aa, Giardia lamblia
YTKPCPVPKGAPLPMETTQQVAN

SEQ ID NO: 3176150 - protein, 17 aa, Giardia lamblia
YTLFMSRSLQKSLKTFA

SEQ ID NO: 3176151 - protein, 30 aa, Giardia lamblia
YTLNLPCEGRVSCKFARQHIIIQHTVRPDS

SEQ ID NO: 3176152 - protein, 28 aa, Giardia lamblia
YTPEVFAKACIINFTIIKEGLTDQLLGA

SEQ ID NO: 3176153 - protein, 20 aa, Giardia lamblia
YTPIGFRFSSNVLQTLNALI

SEQ ID NO: 3176154 - protein, 20 aa, Giardia lamblia
YTPIGFRFSSTVLQTLTALI

SEQ ID NO: 3176155 - protein, 28 aa, Giardia lamblia
YTPKVPARWCSSSGFTFGSRHRQTTETL

SEQ ID NO: 3176156 - protein, 26 aa, Giardia lamblia
YTPMPKGSWLIGFGLDDNGLRRGWAH

SEQ ID NO: 3176157 - protein, 17 aa, Giardia lamblia
YTQGEPAVMWLSGLHIP

SEQ ID NO: 3176158 - protein, 17 aa, Giardia lamblia
YTQLARFYCPEVDIDDF

SEQ ID NO: 3176159 - protein, 26 aa, Giardia lamblia
YTRSEPTAVSWYPLGKSIIAVGFTDG

SEQ ID NO: 3176160 - protein, 17 aa, Giardia lamblia
YTSEPSFVLLGVSKGSP

SEQ ID NO: 3176161 - protein, 21 aa, Giardia lamblia
YTTDELFYFAYQIADALYHIH

SEQ ID NO: 3176162 - protein, 25 aa, Giardia lamblia
YTTHELTGLLLVAAHNVTWIKRFLL

SEQ ID NO: 3176163 - protein, 21 aa, Giardia lamblia
YTVCRRDVGSLNLLVDGVLSK

SEQ ID NO: 3176164 - protein, 20 aa, Giardia lamblia
YTYEHEQLWINSLIHKNMLQ

SEQ ID NO: 3176165 - protein, 18 aa, Giardia lamblia
YVAAKGAPALIAQEAAKA

SEQ ID NO: 3176166 - protein, 25 aa, Giardia lamblia
YVAMFRAGAMWKVKSFSTSDVRSYH

SEQ ID NO: 3176167 - protein, 17 aa, Giardia lamblia
YVAPEVLGGRGFSDRSD

SEQ ID NO: 3176168 - protein, 24 aa, Giardia lamblia
YVATRWYRSPEILLGCTRYTKGVD

SEQ ID NO: 3176169 - protein, 17 aa, Giardia lamblia
YVAVSSIKSFLLPTQTK

SEQ ID NO: 3176170 - protein, 27 aa, Giardia lamblia
YVCDVKIYRLRLARHCLRIQSHRYKEA

SEQ ID NO: 3176171 - protein, 27 aa, Giardia lamblia
YVCIECRRNPRSFTFAAHCEFSSEREV

SEQ ID NO: 3176172 - protein, 23 aa, Giardia lamblia
YVCRELKYQYLVRKWIPGQTTDG

SEQ ID NO: 3176173 - protein, 19 aa, Giardia lamblia
YVDCVKLLLEKEGGMKDNY

SEQ ID NO: 3176174 - protein, 19 aa, Giardia lamblia
YVDCVKLLLEKEGGMQDSW

SEQ ID NO: 3176175 - protein, 24 aa, Giardia lamblia
YVDFKKYFLDKGWVVNPDKDTPTD

SEQ ID NO: 3176176 - protein, 25 aa, Giardia lamblia
YVDGRCCLYRTALLESGTLGQKANM

SEQ ID NO: 3176177 - protein, 19 aa, Giardia lamblia
YVELYRRCNCNNLMRIYKI

SEQ ID NO: 3176178 - protein, 17 aa, Giardia lamblia
YVERLRQAIFLRDQTES

SEQ ID NO: 3176179 - protein, 19 aa, Giardia lamblia
YVFRVLKDRVYYMSQQLEK

SEQ ID NO: 3176180 - protein, 26 aa, Giardia lamblia
YVFVKNLPDGLTWREVQDEVFSLYKK

SEQ ID NO: 3176181 - protein, 17 aa, Giardia lamblia
YVGHILVGLVNYISKIS

SEQ ID NO: 3176182 - protein, 18 aa, Giardia lamblia
YVGLDSYFTELLCYRAEA

SEQ ID NO: 3176183 - protein, 26 aa, Giardia lamblia
YVGSRCVFNGLSLTLLDVFDMINNKQ

SEQ ID NO: 3176184 - protein, 18 aa, Giardia lamblia
YVHECDIFPTVISALQLY

SEQ ID NO: 3176185 - protein, 19 aa, Giardia lamblia
YVHMCTLCSVAKMHAEKRI

SEQ ID NO: 3176186 - protein, 18 aa, Giardia lamblia
YVIDSGLQKRMVYLPEHS

SEQ ID NO: 3176187 - protein, 20 aa, Giardia lamblia
YVIELVKKLEFSSAEDIVLK

SEQ ID NO: 3176188 - protein, 17 aa, Giardia lamblia
YVIIKCLMEDLVRKITA

SEQ ID NO: 3176189 - protein, 22 aa, Giardia lamblia
YVIRRKPCTNWAPEEDEALIKV

SEQ ID NO: 3176190 - protein, 17 aa, Giardia lamblia
YVKGMTGLDAILRSFGG

SEQ ID NO: 3176191 - protein, 27 aa, Giardia lamblia
YVKHLRARFFHRWVRYVKEKNQSAVHL

SEQ ID NO: 3176192 - protein, 19 aa, Giardia lamblia
YVLECLPFKPRKKMFRFQG

SEQ ID NO: 3176193 - protein, 17 aa, Giardia lamblia
YVLLKYVLYEALKRVVE

SEQ ID NO: 3176194 - protein, 17 aa, Giardia lamblia
YVPATRVWGIKRPLEAW

SEQ ID NO: 3176195 - protein, 18 aa, Giardia lamblia
YVPAVERLLGYNLGLVDS

SEQ ID NO: 3176196 - protein, 18 aa, Giardia lamblia
YVPEDTRGSFSHSDLGGV

SEQ ID NO: 3176197 - protein, 25 aa, Giardia lamblia
YVPGGELFFHLKKKVTFDESYVKLV

SEQ ID NO: 3176198 - protein, 20 aa, Giardia lamblia
YVPLCCDDALIATSMAAASF

SEQ ID NO: 3176199 - protein, 22 aa, Giardia lamblia
YVPLHSPAPIILQPESLTFDQI

SEQ ID NO: 3176200 - protein, 26 aa, Giardia lamblia
YVPSGRLPRSIPVILRNHLIDKCKSG

SEQ ID NO: 3176201 - protein, 27 aa, Giardia lamblia
YVRNGWYKRIYLFAGEVACRDVNGDDA

SEQ ID NO: 3176202 - protein, 19 aa, Giardia lamblia
YVRYLSILVRLVLTDTSGS

SEQ ID NO: 3176203 - protein, 21 aa, Giardia lamblia
YVSAVILSFLRHLCMSSFTSD

SEQ ID NO: 3176204 - protein, 20 aa, Giardia lamblia
YVSDILIWVNTLLKERPEVL

SEQ ID NO: 3176205 - protein, 19 aa, Giardia lamblia
YVSFIGFSGHLMRGLFLMP

SEQ ID NO: 3176206 - protein, 24 aa, Giardia lamblia
YVSFPSEYICRICLEPMRKPVRFS

SEQ ID NO: 3176207 - protein, 26 aa, Giardia lamblia
YVSKFKLPPVIPADYMVDPQIQTLLS

SEQ ID NO: 3176208 - protein, 18 aa, Giardia lamblia
YVSKRLNTELSRYYSRQL

SEQ ID NO: 3176209 - protein, 17 aa, Giardia lamblia
YVSSLGFGPMERIKNLL

SEQ ID NO: 3176210 - protein, 25 aa, Giardia lamblia
YVTIEPCIMCAAALSIVGLTNIIYF

SEQ ID NO: 3176211 - protein, 18 aa, Giardia lamblia
YVTRARVSLAAKEQTPSG

SEQ ID NO: 3176212 - protein, 17 aa, Giardia lamblia
YVTRLLGTLARVPIYDK

SEQ ID NO: 3176213 - protein, 18 aa, Giardia lamblia
YVVANAYFNGNRLSNTAT

SEQ ID NO: 3176214 - protein, 23 aa, Giardia lamblia
YVVDSAGKIIGLFKNQPPAQLAQ

SEQ ID NO: 3176215 - protein, 25 aa, Giardia lamblia
YVVKRLRQGDSYHFVVGMFSFPLKT

SEQ ID NO: 3176216 - protein, 18 aa, Giardia lamblia
YVYKRPYVDEFLETMAKY

SEQ ID NO: 3176217 - protein, 19 aa, Giardia lamblia
YWDADHRCFLLLPHKAKLI

SEQ ID NO: 3176218 - protein, 18 aa, Giardia lamblia
YWHNPHCYLSRQKTITPL

SEQ ID NO: 3176219 - protein, 18 aa, Giardia lamblia
YWIAPECVRSTLYDIFKA

SEQ ID NO: 3176220 - protein, 23 aa, Giardia lamblia
YWKFKRECDALYTSLQRKARMVS

SEQ ID NO: 3176221 - protein, 27 aa, Giardia lamblia
YWKKVAKEYPEFITAVGTNTCIMTTTV

SEQ ID NO: 3176222 - protein, 26 aa, Giardia lamblia
YWLAKTRISGPMWLHVTQIDWDFYKA

SEQ ID NO: 3176223 - protein, 28 aa, Giardia lamblia
YWMRVMNIARSFTVPRMQRCSTIMGRTE

SEQ ID NO: 3176224 - protein, 18 aa, Giardia lamblia
YWNSFPLPRDYLDKTAAH

SEQ ID NO: 3176225 - protein, 17 aa, Giardia lamblia
YWRIAECERIMHQLDKS

SEQ ID NO: 3176226 - protein, 23 aa, Giardia lamblia
YWTGCVAKVLAAKYCGALSSDLS

SEQ ID NO: 3176227 - protein, 31 aa, Giardia lamblia
YYARAVPHLDCFRWVRRDSYLPQGSQGLKAV

SEQ ID NO: 3176228 - protein, 30 aa, Giardia lamblia
YYDFSKLVDIYQCLRFVSIHYDKLAYMDSF

SEQ ID NO: 3176229 - protein, 25 aa, Giardia lamblia
YYDICGAQLHASWSVEPPSRSHVNV

SEQ ID NO: 3176230 - protein, 21 aa, Giardia lamblia
YYDVPHCFRAPEVTKYKHSLK

SEQ ID NO: 3176231 - protein, 21 aa, Giardia lamblia
YYDVVKVLIGREGGYQTRRGQ

SEQ ID NO: 3176232 - protein, 27 aa, Giardia lamblia
YYEACALADGFCTLLRMAGVNLTNEQI

SEQ ID NO: 3176233 - protein, 26 aa, Giardia lamblia
YYFCISENYVGFLFYKSLRDAMIRDG

SEQ ID NO: 3176234 - protein, 25 aa, Giardia lamblia
YYFNVLKEFCERNALRDDQRRALLG

SEQ ID NO: 3176235 - protein, 30 aa, Giardia lamblia
YYGLWYTALFKKHYYEVVARYHISQYSTPD

SEQ ID NO: 3176236 - protein, 17 aa, Giardia lamblia
YYGPDYSLLVPRINLPN

SEQ ID NO: 3176237 - protein, 17 aa, Giardia lamblia
YYILATMLLTCGYTLTI

SEQ ID NO: 3176238 - protein, 25 aa, Giardia lamblia
YYIRTRSGALINTWLTGETHTLQSY

SEQ ID NO: 3176239 - protein, 20 aa, Giardia lamblia
YYKASHLTGKELIDIPQDCR

SEQ ID NO: 3176240 - protein, 23 aa, Giardia lamblia
YYKGETGFARQIILGHKIEKIQS

SEQ ID NO: 3176241 - protein, 20 aa, Giardia lamblia
YYLCRERGFHTLAISHQASM

SEQ ID NO: 3176242 - protein, 19 aa, Giardia lamblia
YYLIDLSKLARSLCLIEMR

SEQ ID NO: 3176243 - protein, 18 aa, Giardia lamblia
YYLSPEICRSEKYNQKSD

SEQ ID NO: 3176244 - protein, 26 aa, Giardia lamblia
YYMCTGQPCFWGRTPSELADNVASGK

SEQ ID NO: 3176245 - protein, 19 aa, Giardia lamblia
YYMLMEFCDKGDLSDLIKH

SEQ ID NO: 3176246 - protein, 18 aa, Giardia lamblia
YYNCEVRDFASRARHRVC

SEQ ID NO: 3176247 - protein, 18 aa, Giardia lamblia
YYPDPRRDLTILRYPLFI

SEQ ID NO: 3176248 - protein, 17 aa, Giardia lamblia
YYPGEAILSIGTIGCNF

SEQ ID NO: 3176249 - protein, 18 aa, Giardia lamblia
YYQGRPGIQPSVVYTTPI

SEQ ID NO: 3176250 - protein, 25 aa, Giardia lamblia
YYRGRRMQCDFGRFGKYKLTVVPPS

SEQ ID NO: 3176251 - protein, 23 aa, Giardia lamblia
YYRLAKDEGWRARSAYKLLQLDE

SEQ ID NO: 3176252 - protein, 19 aa, Giardia lamblia
YYRPMPRYSRRASGSRSRS

SEQ ID NO: 3176253 - protein, 19 aa, Giardia lamblia
YYRWHGKADCGEAIVSAIL

SEQ ID NO: 3176254 - protein, 26 aa, Giardia lamblia
YYSEKRVSPGTGFHRFAYTASGDAHT

SEQ ID NO: 3176255 - protein, 27 aa, Giardia lamblia
YYSIIPLLLEKEGRMTMIRAYKYRGVR

SEQ ID NO: 3176256 - protein, 18 aa, Giardia lamblia
YYSQCGDFRMLDSNRSYP

SEQ ID NO: 3176257 - protein, 29 aa, Giardia lamblia
YYSSEGGGLCGGRSVEWRGIRSSDAQEET

SEQ ID NO: 3176258 - protein, 18 aa, Giardia lamblia
YYSSEYDLNCGVTSLLSR

SEQ ID NO: 3176259 - protein, 19 aa, Giardia lamblia
YYTKIYVIYHLLKSRWTFM

SEQ ID NO: 3176260 - protein, 25 aa, Giardia lamblia
YYTSRLPVPILDLGIISVPYLAEYL

SEQ ID NO: 3176261 - protein, 17 aa, Giardia lamblia
YYVEILFPEDLQKEKLR

SEQ ID NO: 3176262 - protein, 20 aa, Giardia lamblia
YYVHHELTKFIKLVNTSSLP

SEQ ID NO: 3176263 - protein, 19 aa, Giardia lamblia
GRIPVPITMILSVMKQVAA

SEQ ID NO: 3176264 - protein, 21 aa, Giardia lamblia
IPFPRLHFFLVGFAPLTSRGS

SEQ ID NO: 3176265 - protein, 18 aa, Giardia lamblia
VVPAEMDTTWTLRHVPNV

SEQ ID NO: 3176266 - protein, 17 aa, Giardia lamblia
YFIIAGLELCKDALWSE

SEQ ID NO: 3176267 - protein, 23 aa, Giardia lamblia
AAAELRGATTLVRLFSACIAPDS

SEQ ID NO: 3176268 - protein, 19 aa, Giardia lamblia
AADGLRGSATWAPSEAQPA

SEQ ID NO: 3176269 - protein, 25 aa, Giardia lamblia
ALMRPGRFEVHLEIGLPDCRGREQI

SEQ ID NO: 3176270 - protein, 18 aa, Giardia lamblia
ATMIKRLFDPIGLGDLGA

SEQ ID NO: 3176271 - protein, 17 aa, Giardia lamblia
ATPCCKCPHLYVCGPGS

SEQ ID NO: 3176272 - protein, 20 aa, Giardia lamblia
CAATGRPLCVVNLLADDVEG

SEQ ID NO: 3176273 - protein, 17 aa, Giardia lamblia
CCADFRIAYLGPYPLAR

SEQ ID NO: 3176274 - protein, 19 aa, Giardia lamblia
CIRSKRTAKDWDVLVLSRA

SEQ ID NO: 3176275 - protein, 17 aa, Giardia lamblia
CRPRLAQISLELANNNM

SEQ ID NO: 3176276 - protein, 20 aa, Giardia lamblia
GKGSFKYAWVLDQLKDERER

SEQ ID NO: 3176277 - protein, 17 aa, Giardia lamblia
GNCLLELPVPAFIKPAI

SEQ ID NO: 3176278 - protein, 18 aa, Giardia lamblia
GWVRGVVHISAFLFEETA

SEQ ID NO: 3176279 - protein, 18 aa, Giardia lamblia
HEGRRPIGWCGSGPITRM

SEQ ID NO: 3176280 - protein, 18 aa, Giardia lamblia
HGKYMACCMMYRGDVVPK

SEQ ID NO: 3176281 - protein, 18 aa, Giardia lamblia
HRHVLRTAIDWKKIARAL

SEQ ID NO: 3176282 - protein, 18 aa, Giardia lamblia
KRTAKDWDVLVLSRAKAR

SEQ ID NO: 3176283 - protein, 21 aa, Giardia lamblia
LLHSYMLKTSVDWHWISNEVG

SEQ ID NO: 3176284 - protein, 22 aa, Giardia lamblia
NHPECVKLLLGREAGMHDKYGW

SEQ ID NO: 3176285 - protein, 20 aa, Giardia lamblia
PRPKHSLFWKEVHSSGQPAQ

SEQ ID NO: 3176286 - protein, 17 aa, Giardia lamblia
PYPFGFGVPLTYVPVLI

SEQ ID NO: 3176287 - protein, 19 aa, Giardia lamblia
RRPIGWCGSGPITRMQHPC

SEQ ID NO: 3176288 - protein, 17 aa, Giardia lamblia
STDCTWAAFAWRREAQT

SEQ ID NO: 3176289 - protein, 25 aa, Giardia lamblia
SVIAKRLGCEFVRIISAEQLVMRTS

SEQ ID NO: 3176290 - protein, 21 aa, Giardia lamblia
TNGRIFACKEIDYAKMSEKEK

SEQ ID NO: 3176291 - protein, 20 aa, Giardia lamblia
VMAMLEFRAILIPKESDGYR

SEQ ID NO: 3176292 - protein, 17 aa, Giardia lamblia
VYKELRYRITLVAQGHV

SEQ ID NO: 3176293 - protein, 17 aa, Giardia lamblia
WAAFAWRREAQTDGTQR

SEQ ID NO: 3176294 - protein, 22 aa, Giardia lamblia
YEAYELFELIGIKVPEFRYFPL

SEQ ID NO: 3176295 - protein, 24 aa, Giardia lamblia
AAAEKRPGLVWLYINQANARDSKG

SEQ ID NO: 3176296 - protein, 19 aa, Giardia lamblia
AACAIYAQCTIHWLDLLNY

SEQ ID NO: 3176297 - protein, 17 aa, Giardia lamblia
AACGSLLGMQLGGSVCR

SEQ ID NO: 3176298 - protein, 24 aa, Giardia lamblia
AACLSPKKPVVWFYISGRFCELNL

SEQ ID NO: 3176299 - protein, 20 aa, Giardia lamblia
AADFKILWLQILDYKPAPLY

SEQ ID NO: 3176300 - protein, 26 aa, Giardia lamblia
AAELCAYPLFHFCFPNVISLPLTCVL

SEQ ID NO: 3176301 - protein, 18 aa, Giardia lamblia
AAELCLQCGVASSLTHLG

SEQ ID NO: 3176302 - protein, 18 aa, Giardia lamblia
AAFRKVRPFAECLAEEIM

SEQ ID NO: 3176303 - protein, 19 aa, Giardia lamblia
AAGAGTCRELAAIMTRTNL

SEQ ID NO: 3176304 - protein, 24 aa, Giardia lamblia
AAGLRCIGCAWGLGERADVEKADM

SEQ ID NO: 3176305 - protein, 19 aa, Giardia lamblia
AAIKRRLNDLLGIVESHKL

SEQ ID NO: 3176306 - protein, 20 aa, Giardia lamblia
AAKSLCMWCRAIDIYAKVFA

SEQ ID NO: 3176307 - protein, 17 aa, Giardia lamblia
AALAKWFQSIVVQDYEY

SEQ ID NO: 3176308 - protein, 25 aa, Giardia lamblia
AALLAFDSVTLWSWIPNIFNYTQST

SEQ ID NO: 3176309 - protein, 24 aa, Giardia lamblia
AALNLCFVCDLPILYVGTGQSYPD

SEQ ID NO: 3176310 - protein, 18 aa, Giardia lamblia
AALVKYLYIFPRKTKNCW

SEQ ID NO: 3176311 - protein, 23 aa, Giardia lamblia
AALWKHKRTLLHIDIKDLLEKYN

SEQ ID NO: 3176312 - protein, 20 aa, Giardia lamblia
AARLLYKLEFGMRGNRGETA

SEQ ID NO: 3176313 - protein, 24 aa, Giardia lamblia
AASDKKINWDVCMYNMKLVTLCLD

SEQ ID NO: 3176314 - protein, 23 aa, Giardia lamblia
AASRLFRRMDLFWATNYLCYDHI

SEQ ID NO: 3176315 - protein, 19 aa, Giardia lamblia
AATMSDLFDLGRLFVSHRL

SEQ ID NO: 3176316 - protein, 24 aa, Giardia lamblia
AATTGRPVWRPKIISYDSSQSNAD

SEQ ID NO: 3176317 - protein, 20 aa, Giardia lamblia
AAVKILICYETGLVNPYTGA

SEQ ID NO: 3176318 - protein, 21 aa, Giardia lamblia
AAYLLRYCVDIGALSGCDLYR

SEQ ID NO: 3176319 - protein, 17 aa, Giardia lamblia
ACCCPVCEYRVVYQSTY

SEQ ID NO: 3176320 - protein, 18 aa, Giardia lamblia
ACDNCGFKSIEVKSAGAI

SEQ ID NO: 3176321 - protein, 19 aa, Giardia lamblia
ACFPCLAQWGATISVHDEF

SEQ ID NO: 3176322 - protein, 20 aa, Giardia lamblia
ACKNFCIVGDFLICAGDSKY

SEQ ID NO: 3176323 - protein, 17 aa, Giardia lamblia
ACKPCGVTQGFNKFLSI

SEQ ID NO: 3176324 - protein, 17 aa, Giardia lamblia
ACKTCACDQYLKASCPV

SEQ ID NO: 3176325 - protein, 24 aa, Giardia lamblia
ACLLRKLYVFKVFPMINPDGVILG

SEQ ID NO: 3176326 - protein, 20 aa, Giardia lamblia
ACRSHWCTYEHFLLDSESIH

SEQ ID NO: 3176327 - protein, 19 aa, Giardia lamblia
ACSLFHRFLSICQIKKTEI

SEQ ID NO: 3176328 - protein, 18 aa, Giardia lamblia
ACTLCRECIAAFTDEQNQ

SEQ ID NO: 3176329 - protein, 23 aa, Giardia lamblia
ACVPLHKLSCEYLVGEETPDLVD

SEQ ID NO: 3176330 - protein, 17 aa, Giardia lamblia
ADALLLIDKCLAQCNDE

SEQ ID NO: 3176331 - protein, 17 aa, Giardia lamblia
ADARSALDIAKSTNQDL

SEQ ID NO: 3176332 - protein, 19 aa, Giardia lamblia
ADAVARLVPESGLISDDGW

SEQ ID NO: 3176333 - protein, 18 aa, Giardia lamblia
ADCSVSFTPNQRIFIDDL

SEQ ID NO: 3176334 - protein, 17 aa, Giardia lamblia
ADEAMGFVGGRRLDGRG

SEQ ID NO: 3176335 - protein, 24 aa, Giardia lamblia
ADGKRPGGAMLWHLYGVGQSDRIT

SEQ ID NO: 3176336 - protein, 24 aa, Giardia lamblia
ADGTYCLKRLRTLSLRGASEGDVD

SEQ ID NO: 3176337 - protein, 19 aa, Giardia lamblia
ADHRICMCHSLSYSRLLAD

SEQ ID NO: 3176338 - protein, 18 aa, Giardia lamblia
ADIAFGFNIYPLIMPICR

SEQ ID NO: 3176339 - protein, 23 aa, Giardia lamblia
ADIANLRLQWELTLNAIEKRSAN

SEQ ID NO: 3176340 - protein, 18 aa, Giardia lamblia
ADIWSIGCLFIEMFTTYP

SEQ ID NO: 3176341 - protein, 23 aa, Giardia lamblia
ADKHPRCVNGIFIGLLDYVMGAS

SEQ ID NO: 3176342 - protein, 19 aa, Giardia lamblia
ADLSRCFDERMAPILRTLW

SEQ ID NO: 3176343 - protein, 18 aa, Giardia lamblia
ADMPRIHRAPSFPGLQPH

SEQ ID NO: 3176344 - protein, 22 aa, Giardia lamblia
ADNPEVCLCLLDLEGHILLKDL

SEQ ID NO: 3176345 - protein, 18 aa, Giardia lamblia
ADRYKYRYAVLAEKYSKM

SEQ ID NO: 3176346 - protein, 22 aa, Giardia lamblia
ADSDPWLSLLHEFKQHYTGKTT

SEQ ID NO: 3176347 - protein, 17 aa, Giardia lamblia
ADSRLSVDIQRTIVPEA

SEQ ID NO: 3176348 - protein, 18 aa, Giardia lamblia
ADTRIRSASQFSLDPATM

SEQ ID NO: 3176349 - protein, 17 aa, Giardia lamblia
ADVCYSFARGVCLNKTC

SEQ ID NO: 3176350 - protein, 25 aa, Giardia lamblia
ADYRVLCGICRRWGDREHLNAHDGF

SEQ ID NO: 3176351 - protein, 19 aa, Giardia lamblia
AEAPLVWAGAEIGRVAARI

SEQ ID NO: 3176352 - protein, 17 aa, Giardia lamblia
AECSPSFVALKIASKTQ

SEQ ID NO: 3176353 - protein, 17 aa, Giardia lamblia
AECVKLLLEKEGGMQRR

SEQ ID NO: 3176354 - protein, 18 aa, Giardia lamblia
AEETRIIMHLDRWSEQRH

SEQ ID NO: 3176355 - protein, 22 aa, Giardia lamblia
AEFGLRGNMEWTALMVAAAHGS

SEQ ID NO: 3176356 - protein, 17 aa, Giardia lamblia
AEFKRSLQGGAFPTTQS

SEQ ID NO: 3176357 - protein, 20 aa, Giardia lamblia
AEFLMGFLLSAPVPLQRTVL

SEQ ID NO: 3176358 - protein, 19 aa, Giardia lamblia
AEFRRARATRREAEREFAM

SEQ ID NO: 3176359 - protein, 20 aa, Giardia lamblia
AEFYLWCKICDISRHEFQRI

SEQ ID NO: 3176360 - protein, 19 aa, Giardia lamblia
AEGELPGLVVMIAPYSVVE

SEQ ID NO: 3176361 - protein, 25 aa, Giardia lamblia
AEGGWLMDACFSFPQLYAAKDDFET

SEQ ID NO: 3176362 - protein, 18 aa, Giardia lamblia
AEGKFSALLMSRFNQKLR

SEQ ID NO: 3176363 - protein, 18 aa, Giardia lamblia
AEGLIGLILDSSSKITMC

SEQ ID NO: 3176364 - protein, 18 aa, Giardia lamblia
AEIDKAWKIVDLAREKEG

SEQ ID NO: 3176365 - protein, 21 aa, Giardia lamblia
AEIDRLNVCIAKLHTQTAELD

SEQ ID NO: 3176366 - protein, 17 aa, Giardia lamblia
AEILCDMFANVVTASDS

SEQ ID NO: 3176367 - protein, 23 aa, Giardia lamblia
AEINRLNDELTWINGQILEERSK

SEQ ID NO: 3176368 - protein, 17 aa, Giardia lamblia
AEITLVFLSGEKVVIDW

SEQ ID NO: 3176369 - protein, 21 aa, Giardia lamblia
AEKLKKCKGGCFAVLADTTQH

SEQ ID NO: 3176370 - protein, 22 aa, Giardia lamblia
AEKLRLSNLMLLKREACNTSVI

SEQ ID NO: 3176371 - protein, 18 aa, Giardia lamblia
AELPPIVVKGSLEEANDK

SEQ ID NO: 3176372 - protein, 17 aa, Giardia lamblia
AELVCGPDLFKLYSSLM

SEQ ID NO: 3176373 - protein, 21 aa, Giardia lamblia
AEMLARFVTRPDLRDTLLPSI

SEQ ID NO: 3176374 - protein, 18 aa, Giardia lamblia
AEPKQLFDLGMHVIENLQ

SEQ ID NO: 3176375 - protein, 17 aa, Giardia lamblia
AERRLYLGLYSTNLLSK

SEQ ID NO: 3176376 - protein, 23 aa, Giardia lamblia
AERRRPRISVAFGAITMPNAPSS

SEQ ID NO: 3176377 - protein, 21 aa, Giardia lamblia
AESGHLCGFLGPTHLRALALF

SEQ ID NO: 3176378 - protein, 19 aa, Giardia lamblia
AESIRLALSLSLHGMPHDR

SEQ ID NO: 3176379 - protein, 17 aa, Giardia lamblia
AEVSKRPAAACTKYLLG

SEQ ID NO: 3176380 - protein, 22 aa, Giardia lamblia
AEWQCYLAWAVLRASIHTADAE

SEQ ID NO: 3176381 - protein, 22 aa, Giardia lamblia
AFAQNCTWVYIGNPGVKKGQGN

SEQ ID NO: 3176382 - protein, 19 aa, Giardia lamblia
AFCLEKYGHCHGLCLTCFC

SEQ ID NO: 3176383 - protein, 17 aa, Giardia lamblia
AFEELFLSLSLSPNCIG

SEQ ID NO: 3176384 - protein, 19 aa, Giardia lamblia
AFFNCPARRTITFFYSLSS

SEQ ID NO: 3176385 - protein, 20 aa, Giardia lamblia
AFGNLACTTWPVAVAATQAM

SEQ ID NO: 3176386 - protein, 25 aa, Giardia lamblia
AFGSWKRRYVCVVSMEIRADEHYRR

SEQ ID NO: 3176387 - protein, 17 aa, Giardia lamblia
AFKAADVSMCLNKLDTE

SEQ ID NO: 3176388 - protein, 23 aa, Giardia lamblia
AFLCSFCDILPCYYDNYGGDGEI

SEQ ID NO: 3176389 - protein, 17 aa, Giardia lamblia
AFLSGLDSFLAREVEHR

SEQ ID NO: 3176390 - protein, 18 aa, Giardia lamblia
AFQIPRTDGVIVVLNEEC

SEQ ID NO: 3176391 - protein, 19 aa, Giardia lamblia
AFRGCLRPTTFALHRDAAY

SEQ ID NO: 3176392 - protein, 18 aa, Giardia lamblia
AFSCLKSACKQRMTASTV

SEQ ID NO: 3176393 - protein, 26 aa, Giardia lamblia
AFVAKAADCLLRLYDNWSLGESCVYL

SEQ ID NO: 3176394 - protein, 18 aa, Giardia lamblia
AFVKEVRAGQRLRQTPAV

SEQ ID NO: 3176395 - protein, 17 aa, Giardia lamblia
AFYCFSCGGVIESSVLE

SEQ ID NO: 3176396 - protein, 18 aa, Giardia lamblia
AGARYAGWTALARAAENG

SEQ ID NO: 3176397 - protein, 18 aa, Giardia lamblia
AGDGFKIVNFIGMLSSLH

SEQ ID NO: 3176398 - protein, 19 aa, Giardia lamblia
AGFIKGRLVVKVVELVGAV

SEQ ID NO: 3176399 - protein, 20 aa, Giardia lamblia
AGFNEMYIRLAYSSNKGNVI

SEQ ID NO: 3176400 - protein, 18 aa, Giardia lamblia
AGFNHLKEVIYRDIYEER

SEQ ID NO: 3176401 - protein, 17 aa, Giardia lamblia
AGGMGVFKIPVRRRQTV

SEQ ID NO: 3176402 - protein, 21 aa, Giardia lamblia
AGGPRIHWDGSLVSLLQNSGP

SEQ ID NO: 3176403 - protein, 20 aa, Giardia lamblia
AGLLLRIGYRSLVALHTKLA

SEQ ID NO: 3176404 - protein, 17 aa, Giardia lamblia
AGLRYLTLLGMKGLCAY

SEQ ID NO: 3176405 - protein, 20 aa, Giardia lamblia
AGNRNKLGWTALMQAVQDNN

SEQ ID NO: 3176406 - protein, 22 aa, Giardia lamblia
AGYAPRFPISWLSNISPEIKTA

SEQ ID NO: 3176407 - protein, 17 aa, Giardia lamblia
AHACLKYDWDATVKVLE

SEQ ID NO: 3176408 - protein, 19 aa, Giardia lamblia
AHLCANWLSVLPSWLMESS

SEQ ID NO: 3176409 - protein, 24 aa, Giardia lamblia
AHVFPLPVCLLVVMEELISEEQFQ

SEQ ID NO: 3176410 - protein, 18 aa, Giardia lamblia
AHYISWRRSIRMRAGDEG

SEQ ID NO: 3176411 - protein, 21 aa, Giardia lamblia
AHYWISLALYCRSQILNKMLS

SEQ ID NO: 3176412 - protein, 19 aa, Giardia lamblia
AICHAPAPFSARFSAQTEE

SEQ ID NO: 3176413 - protein, 17 aa, Giardia lamblia
AICHEILEGSGLCTLHE

SEQ ID NO: 3176414 - protein, 22 aa, Giardia lamblia
AIEPNDAFGFFGFDDAPSTPAA

SEQ ID NO: 3176415 - protein, 17 aa, Giardia lamblia
AIFRSVLKFSVEQVADV

SEQ ID NO: 3176416 - protein, 17 aa, Giardia lamblia
AIGEFFCALPIAHTIDR

SEQ ID NO: 3176417 - protein, 22 aa, Giardia lamblia
AIHRGCTCIHTLEPGMTPTDIA

SEQ ID NO: 3176418 - protein, 22 aa, Giardia lamblia
AIKALCWQPYYRLLFSGGVDGL

SEQ ID NO: 3176419 - protein, 17 aa, Giardia lamblia
AIKEFSSVWAFSPRLMD

SEQ ID NO: 3176420 - protein, 17 aa, Giardia lamblia
AIKTIREAFEWTGPSIV

SEQ ID NO: 3176421 - protein, 18 aa, Giardia lamblia
AILEAFSHLSSRPAFRRS

SEQ ID NO: 3176422 - protein, 19 aa, Giardia lamblia
AILQIALKYTKSGKEYSRI

SEQ ID NO: 3176423 - protein, 17 aa, Giardia lamblia
AIPEYRGKFTIIHKDFT

SEQ ID NO: 3176424 - protein, 18 aa, Giardia lamblia
AIPIFKLFLVLTKHPIIS

SEQ ID NO: 3176425 - protein, 18 aa, Giardia lamblia
AIRMLREAFLILVEHDSR

SEQ ID NO: 3176426 - protein, 24 aa, Giardia lamblia
AIRRRFEKRIEIVLPDAAARKNIL

SEQ ID NO: 3176427 - protein, 17 aa, Giardia lamblia
AIRTLKMSYIWQKASTE

SEQ ID NO: 3176428 - protein, 17 aa, Giardia lamblia
AIYEVCKGYQLFYNEAI

SEQ ID NO: 3176429 - protein, 18 aa, Giardia lamblia
AKASMLLREGRFIEALER

SEQ ID NO: 3176430 - protein, 21 aa, Giardia lamblia
AKCALLVMRILRLSFWSKSSQ

SEQ ID NO: 3176431 - protein, 21 aa, Giardia lamblia
AKDAARCFVNGGILRVTAVTA

SEQ ID NO: 3176432 - protein, 17 aa, Giardia lamblia
AKDEGWRARSAYKLLQL

SEQ ID NO: 3176433 - protein, 19 aa, Giardia lamblia
AKDMTRLHAYLAQQLKAAA

SEQ ID NO: 3176434 - protein, 17 aa, Giardia lamblia
AKEVSRLKVEISDVLSL

SEQ ID NO: 3176435 - protein, 17 aa, Giardia lamblia
AKFSLDLLPFVQSSHGA

SEQ ID NO: 3176436 - protein, 17 aa, Giardia lamblia
AKGCLVTACTPLCGEAH

SEQ ID NO: 3176437 - protein, 17 aa, Giardia lamblia
AKGGVIERVYCDVTQPL

SEQ ID NO: 3176438 - protein, 20 aa, Giardia lamblia
AKHSFPRVASHFVFRLKNFA

SEQ ID NO: 3176439 - protein, 19 aa, Giardia lamblia
AKIPFCLRPINVNNEEVLS

SEQ ID NO: 3176440 - protein, 18 aa, Giardia lamblia
AKISLVWRESNDVTEATP

SEQ ID NO: 3176441 - protein, 17 aa, Giardia lamblia
AKKSGATGLQFKEMVGI

SEQ ID NO: 3176442 - protein, 21 aa, Giardia lamblia
AKLEQIHRAFPLLTDSPKDAP

SEQ ID NO: 3176443 - protein, 17 aa, Giardia lamblia
AKLHTWIGPAFKLPTNT

SEQ ID NO: 3176444 - protein, 25 aa, Giardia lamblia
AKLKQRLGTAFSRSKFRNFLFEKVL

SEQ ID NO: 3176445 - protein, 18 aa, Giardia lamblia
AKLLEWRQSKKIADEKVH

SEQ ID NO: 3176446 - protein, 19 aa, Giardia lamblia
AKMSIPEACILTILRSVAQ

SEQ ID NO: 3176447 - protein, 17 aa, Giardia lamblia
AKMSYLLMEHFTLGDLA

SEQ ID NO: 3176448 - protein, 21 aa, Giardia lamblia
AKMTLGTFICRTWKLTDATAL

SEQ ID NO: 3176449 - protein, 17 aa, Giardia lamblia
AKNWRKIADFIYINGHN

SEQ ID NO: 3176450 - protein, 18 aa, Giardia lamblia
AKQTGAFSFQVSTPPVQF

SEQ ID NO: 3176451 - protein, 20 aa, Giardia lamblia
AKSCYWRFSAHKSYITAMAF

SEQ ID NO: 3176452 - protein, 20 aa, Giardia lamblia
AKSRCLFVTNSPASVTKGVV

SEQ ID NO: 3176453 - protein, 17 aa, Giardia lamblia
AKSSIIEGWRCGKENHQ

SEQ ID NO: 3176454 - protein, 22 aa, Giardia lamblia
AKTGEAAFCFNSNIPQITVIRH

SEQ ID NO: 3176455 - protein, 19 aa, Giardia lamblia
AKTLQGWTLCKVVGQIYSR

SEQ ID NO: 3176456 - protein, 20 aa, Giardia lamblia
AKTRISGPMWLHVTQIDWDF

SEQ ID NO: 3176457 - protein, 23 aa, Giardia lamblia
AKVFCGNCGLVIMDTLIVNDLIY

SEQ ID NO: 3176458 - protein, 21 aa, Giardia lamblia
AKVLIPREVCMVNKAGLTALM

SEQ ID NO: 3176459 - protein, 21 aa, Giardia lamblia
AKYFFEFVGDWSRLSLTLVKL

SEQ ID NO: 3176460 - protein, 18 aa, Giardia lamblia
AKYGPGFLVCGIGGGSPC

SEQ ID NO: 3176461 - protein, 17 aa, Giardia lamblia
AKYGRLDVVTFLLEAES

SEQ ID NO: 3176462 - protein, 25 aa, Giardia lamblia
ALCGLRGLFNMHIFEEIFLYILNTS

SEQ ID NO: 3176463 - protein, 18 aa, Giardia lamblia
ALCSWRGGCIIRMNLLTP

SEQ ID NO: 3176464 - protein, 18 aa, Giardia lamblia
ALDRISTTLGYKVIFPLI

SEQ ID NO: 3176465 - protein, 22 aa, Giardia lamblia
ALEEPCIFCSMCLLHARVKRVF

SEQ ID NO: 3176466 - protein, 17 aa, Giardia lamblia
ALFDCCIMALSSVGLCV

SEQ ID NO: 3176467 - protein, 18 aa, Giardia lamblia
ALFSLSFFLRSVFTSCLD

SEQ ID NO: 3176468 - protein, 25 aa, Giardia lamblia
ALFTEAECAFSIRAKQQILLLQAIG

SEQ ID NO: 3176469 - protein, 32 aa, Giardia lamblia
ALGRTAMMYLVMFPRHSTLVLLEECIGYLAQA

SEQ ID NO: 3176470 - protein, 18 aa, Giardia lamblia
ALIKRLRHPLLVHYLSVL

SEQ ID NO: 3176471 - protein, 20 aa, Giardia lamblia
ALIRAIRWSRPEAVQELVKD

SEQ ID NO: 3176472 - protein, 19 aa, Giardia lamblia
ALISRFDILFVIRDKIHEE

SEQ ID NO: 3176473 - protein, 18 aa, Giardia lamblia
ALISYDFTNPLLIKQHTI

SEQ ID NO: 3176474 - protein, 20 aa, Giardia lamblia
ALKYRIACAIGNDKLAYQAL

SEQ ID NO: 3176475 - protein, 23 aa, Giardia lamblia
ALLDNIKGIIAFHYHGREDAYQP

SEQ ID NO: 3176476 - protein, 25 aa, Giardia lamblia
ALLFFVRWRLTSCIHQWVTFVYETV

SEQ ID NO: 3176477 - protein, 19 aa, Giardia lamblia
ALLRLFFRMHHIPFSVYPT

SEQ ID NO: 3176478 - protein, 18 aa, Giardia lamblia
ALLSKFPLLQTVILSNNS

SEQ ID NO: 3176479 - protein, 18 aa, Giardia lamblia
ALMWGFKLGFSQVVSHLL

SEQ ID NO: 3176480 - protein, 17 aa, Giardia lamblia
ALMYEMICHAFTNLPLY

SEQ ID NO: 3176481 - protein, 26 aa, Giardia lamblia
ALPALVRIRLDACALHSSLLGIPVPQ

SEQ ID NO: 3176482 - protein, 22 aa, Giardia lamblia
ALPSETYLGVALRSAIDYIASS

SEQ ID NO: 3176483 - protein, 19 aa, Giardia lamblia
ALPVFRKAFNFTLYPMFHI

SEQ ID NO: 3176484 - protein, 19 aa, Giardia lamblia
ALQALRLNFEHEIAQLKLE

SEQ ID NO: 3176485 - protein, 24 aa, Giardia lamblia
ALRPSAYHALQWFKRIHAGVDLSC

SEQ ID NO: 3176486 - protein, 24 aa, Giardia lamblia
ALRQSAALLLHWLRHNYWEPLLNE

SEQ ID NO: 3176487 - protein, 24 aa, Giardia lamblia
ALSGLRLTPFNNLILISITYQRGH

SEQ ID NO: 3176488 - protein, 18 aa, Giardia lamblia
ALSILKERIQIHMAPRLS

SEQ ID NO: 3176489 - protein, 17 aa, Giardia lamblia
ALSPSFRQLALLEMLQL

SEQ ID NO: 3176490 - protein, 18 aa, Giardia lamblia
ALTRCWEQLSKLIVDKSK

SEQ ID NO: 3176491 - protein, 23 aa, Giardia lamblia
ALTRGHFKAVRILMSKFTYSWQS

SEQ ID NO: 3176492 - protein, 17 aa, Giardia lamblia
ALVKAIRWNAIDMIEVL

SEQ ID NO: 3176493 - protein, 18 aa, Giardia lamblia
ALVNELILAYGLDEHLNY

SEQ ID NO: 3176494 - protein, 25 aa, Giardia lamblia
ALWLHKPECLTAFLKLMFSTETTLQ

SEQ ID NO: 3176495 - protein, 17 aa, Giardia lamblia
ALYYAIEFNKPECVKLL

SEQ ID NO: 3176496 - protein, 18 aa, Giardia lamblia
AMCRGCNTIGTLVPTGDR

SEQ ID NO: 3176497 - protein, 17 aa, Giardia lamblia
AMDAAFCIKYFLVCTLK

SEQ ID NO: 3176498 - protein, 20 aa, Giardia lamblia
AMHYACYFNHLQVVQKLFDF

SEQ ID NO: 3176499 - protein, 17 aa, Giardia lamblia
AMLSSNIQFCFLSATVP

SEQ ID NO: 3176500 - protein, 24 aa, Giardia lamblia
AMRRELRCASCMGHVYKPENQHEW

SEQ ID NO: 3176501 - protein, 26 aa, Giardia lamblia
ANAERFKALVLRYADVDQLGFLKYYT

SEQ ID NO: 3176502 - protein, 17 aa, Giardia lamblia
ANDIARAWCLRFQAGAR

SEQ ID NO: 3176503 - protein, 23 aa, Giardia lamblia
ANFRAKCSFCAPELLSEIDEYDE

SEQ ID NO: 3176504 - protein, 19 aa, Giardia lamblia
ANIYCCIHSLFGGVVSKGV

SEQ ID NO: 3176505 - protein, 23 aa, Giardia lamblia
ANKGDVCKRLVAYEVNTTYGDFQ

SEQ ID NO: 3176506 - protein, 25 aa, Giardia lamblia
ANNRLAFYWHFIFRTVGLNSESCLT

SEQ ID NO: 3176507 - protein, 19 aa, Giardia lamblia
APCPNCPAVLEPRDNPAPS

SEQ ID NO: 3176508 - protein, 27 aa, Giardia lamblia
APFLKPGEAPYRYTGVIKLAGTDLRTQ

SEQ ID NO: 3176509 - protein, 17 aa, Giardia lamblia
APILKFLATTGFAAHAD

SEQ ID NO: 3176510 - protein, 25 aa, Giardia lamblia
APKKYGSICNFFFNIVRQCLRINPV

SEQ ID NO: 3176511 - protein, 17 aa, Giardia lamblia
APLMFQMIIKWGGYLSI

SEQ ID NO: 3176512 - protein, 18 aa, Giardia lamblia
APLPCFIIIFIGAEVDTL

SEQ ID NO: 3176513 - protein, 19 aa, Giardia lamblia
APRCLRFLLENEYMEDVRG

SEQ ID NO: 3176514 - protein, 17 aa, Giardia lamblia
APRELRRGVSIYSRSCP

SEQ ID NO: 3176515 - protein, 17 aa, Giardia lamblia
APTRPQAQLGFSTMSLK

SEQ ID NO: 3176516 - protein, 20 aa, Giardia lamblia
APVLRPLLLPPLGLVDTHAS

SEQ ID NO: 3176517 - protein, 19 aa, Giardia lamblia
APVYCYHCFAMKDIKAQQS

SEQ ID NO: 3176518 - protein, 21 aa, Giardia lamblia
APYEIPLGWIAEGGRRSASRR

SEQ ID NO: 3176519 - protein, 18 aa, Giardia lamblia
AQALRLSGLYGLSVHLRT

SEQ ID NO: 3176520 - protein, 20 aa, Giardia lamblia
AQARVLYRLALLYKESNRQA

SEQ ID NO: 3176521 - protein, 23 aa, Giardia lamblia
AQEKLCKLQELLDKKEEELLWMS

SEQ ID NO: 3176522 - protein, 23 aa, Giardia lamblia
AQFRRLRFGDAPLHMSQPELSSF

SEQ ID NO: 3176523 - protein, 19 aa, Giardia lamblia
AQGRFCILQACLKWAPNSI

SEQ ID NO: 3176524 - protein, 19 aa, Giardia lamblia
AQKSYLFYRQRYRKIDPIP

SEQ ID NO: 3176525 - protein, 19 aa, Giardia lamblia
AQLCIPLGCGARDAVGATA

SEQ ID NO: 3176526 - protein, 17 aa, Giardia lamblia
AQLCKAAGLLLEKFYSC

SEQ ID NO: 3176527 - protein, 18 aa, Giardia lamblia
AQLIPLVRNFLRGGLTTR

SEQ ID NO: 3176528 - protein, 23 aa, Giardia lamblia
AQMKLIFCYLFCMIKLSGDSTKA

SEQ ID NO: 3176529 - protein, 19 aa, Giardia lamblia
AQNRLAYYTALVPKPIIPV

SEQ ID NO: 3176530 - protein, 17 aa, Giardia lamblia
AQVLFQIISACFNQEQI

SEQ ID NO: 3176531 - protein, 19 aa, Giardia lamblia
ARAALRFIATCFCYDEKDG

SEQ ID NO: 3176532 - protein, 21 aa, Giardia lamblia
ARACKLAWDVANCERVQKRQR

SEQ ID NO: 3176533 - protein, 17 aa, Giardia lamblia
ARAVAVLNLMRAKNNSA

SEQ ID NO: 3176534 - protein, 22 aa, Giardia lamblia
ARAWLCGVIARLAKERDNSIVL

SEQ ID NO: 3176535 - protein, 17 aa, Giardia lamblia
ARCLLQFYREQAPDKLE

SEQ ID NO: 3176536 - protein, 20 aa, Giardia lamblia
ARCNFRLEPPITYLGCGHAF

SEQ ID NO: 3176537 - protein, 21 aa, Giardia lamblia
ARCQLCLELPFNGSFDSAISP

SEQ ID NO: 3176538 - protein, 19 aa, Giardia lamblia
AREASMFRARWKADEGIDR

SEQ ID NO: 3176539 - protein, 18 aa, Giardia lamblia
AREKMQLVGRVPTEPGAA

SEQ ID NO: 3176540 - protein, 17 aa, Giardia lamblia
ARETSCFLSKSRVPEEL

SEQ ID NO: 3176541 - protein, 17 aa, Giardia lamblia
ARGEVVDLIDFFSRPQV

SEQ ID NO: 3176542 - protein, 17 aa, Giardia lamblia
ARGTPNFYVLKSSRALF

SEQ ID NO: 3176543 - protein, 20 aa, Giardia lamblia
ARIFLGIGLMNMRQIDVAQQ

SEQ ID NO: 3176544 - protein, 17 aa, Giardia lamblia
ARIKPALSRGLLHNLSL

SEQ ID NO: 3176545 - protein, 17 aa, Giardia lamblia
ARIPSDITATIKRLQDA

SEQ ID NO: 3176546 - protein, 18 aa, Giardia lamblia
ARISPCYVAPAGPFRSPM

SEQ ID NO: 3176547 - protein, 24 aa, Giardia lamblia
ARISRLEQSAGWVSPSAMQGQGQS

SEQ ID NO: 3176548 - protein, 22 aa, Giardia lamblia
ARKNMFDDYRWKKIEELKSMGV

SEQ ID NO: 3176549 - protein, 23 aa, Giardia lamblia
ARKPECTKLLLAEANMRSGAGES

SEQ ID NO: 3176550 - protein, 21 aa, Giardia lamblia
ARLEAPLVYIGKRDDIFNTYN

SEQ ID NO: 3176551 - protein, 20 aa, Giardia lamblia
ARLFLNPAYNCFNTATAEDA

SEQ ID NO: 3176552 - protein, 22 aa, Giardia lamblia
ARLGKTCKLEFLTFDDPRAREV

SEQ ID NO: 3176553 - protein, 18 aa, Giardia lamblia
ARLPGEVCVYRIEVHSDR

SEQ ID NO: 3176554 - protein, 17 aa, Giardia lamblia
ARMEWIFAKAIFPLQKY

SEQ ID NO: 3176555 - protein, 18 aa, Giardia lamblia
ARMSDIYALSALQCDPSS

SEQ ID NO: 3176556 - protein, 18 aa, Giardia lamblia
ARNGISISDILPVLIHFS

SEQ ID NO: 3176557 - protein, 17 aa, Giardia lamblia
ARPELFLVCVGQRISDL

SEQ ID NO: 3176558 - protein, 24 aa, Giardia lamblia
ARPIGVLFYRYWVDLKSLSFTFQR

SEQ ID NO: 3176559 - protein, 17 aa, Giardia lamblia
ARQAVLIARARELERRI

SEQ ID NO: 3176560 - protein, 18 aa, Giardia lamblia
ARQLRMMFGLSRVSEANG

SEQ ID NO: 3176561 - protein, 27 aa, Giardia lamblia
ARRCCPDCTRYSPVLVYGFEQLAARAA

SEQ ID NO: 3176562 - protein, 19 aa, Giardia lamblia
ARSALFLANHYTIMKVSDQ

SEQ ID NO: 3176563 - protein, 19 aa, Giardia lamblia
ARTKHAACLVRWNHKDYLY

SEQ ID NO: 3176564 - protein, 19 aa, Giardia lamblia
ARTVIFAFLALRMIVETLR

SEQ ID NO: 3176565 - protein, 20 aa, Giardia lamblia
ARVCEYIMWMGFSRTSDPTY

SEQ ID NO: 3176566 - protein, 18 aa, Giardia lamblia
ARVLCTIASIFAAQDSAT

SEQ ID NO: 3176567 - protein, 17 aa, Giardia lamblia
ARWQDIIILGRLAASFN

SEQ ID NO: 3176568 - protein, 20 aa, Giardia lamblia
ASAGSWCGAEIYLLDMTHYN

SEQ ID NO: 3176569 - protein, 18 aa, Giardia lamblia
ASASSNWDAVASIDEEVT

SEQ ID NO: 3176570 - protein, 17 aa, Giardia lamblia
ASCGFFYTRCTELLNAV

SEQ ID NO: 3176571 - protein, 20 aa, Giardia lamblia
ASDFKFSFGYIPDQEPPRKS

SEQ ID NO: 3176572 - protein, 18 aa, Giardia lamblia
ASDLFAHLDMNRDCFDSK

SEQ ID NO: 3176573 - protein, 18 aa, Giardia lamblia
ASEFITYAYKRVCNPLEH

SEQ ID NO: 3176574 - protein, 20 aa, Giardia lamblia
ASEILSCTPMRCKVETEQLR

SEQ ID NO: 3176575 - protein, 23 aa, Giardia lamblia
ASFRFELPYGLLFVDDVLLVTDA

SEQ ID NO: 3176576 - protein, 17 aa, Giardia lamblia
ASGYLDKAVSCTEIDLG

SEQ ID NO: 3176577 - protein, 21 aa, Giardia lamblia
ASIPCPRRFFIHGWWTINHQK

SEQ ID NO: 3176578 - protein, 21 aa, Giardia lamblia
ASLGHRSICDFLARFEGRQTT

SEQ ID NO: 3176579 - protein, 23 aa, Giardia lamblia
ASLLEIIKLLAPREARFISTRDK

SEQ ID NO: 3176580 - protein, 20 aa, Giardia lamblia
ASLRGRCPYCQRAVTEHFEI

SEQ ID NO: 3176581 - protein, 21 aa, Giardia lamblia
ASLSRLPWKPGTTVQIDNLPL

SEQ ID NO: 3176582 - protein, 24 aa, Giardia lamblia
ASNMRAFRALKCLLTAPQTALSQD

SEQ ID NO: 3176583 - protein, 19 aa, Giardia lamblia
ASNTVCFQELFKPAIGLFM

SEQ ID NO: 3176584 - protein, 25 aa, Giardia lamblia
ASPHETAWCSFIWPRCDTEGLCLAA

SEQ ID NO: 3176585 - protein, 23 aa, Giardia lamblia
ASRASCLTGLLPRSVSASVRVNP

SEQ ID NO: 3176586 - protein, 21 aa, Giardia lamblia
ASSLCLLVWEWIRRYEETASN

SEQ ID NO: 3176587 - protein, 20 aa, Giardia lamblia
ASTECAYCFLNRYNSQGLYL

SEQ ID NO: 3176588 - protein, 18 aa, Giardia lamblia
ASTKRIGARLSIDDKPAE

SEQ ID NO: 3176589 - protein, 18 aa, Giardia lamblia
ASTNLVFPDLPPPQFSNY

SEQ ID NO: 3176590 - protein, 25 aa, Giardia lamblia
ASVFCLNCQGWLCSRCEANIHHNKL

SEQ ID NO: 3176591 - protein, 17 aa, Giardia lamblia
ASVQMLLEFGCDPLMAD

SEQ ID NO: 3176592 - protein, 25 aa, Giardia lamblia
ASVSWLAQFVFPFVKFWERDTVAAF

SEQ ID NO: 3176593 - protein, 18 aa, Giardia lamblia
ATAALCYKEAGILYSVDQ

SEQ ID NO: 3176594 - protein, 23 aa, Giardia lamblia
ATCFDVYCSLHLPKQISVKHVLG

SEQ ID NO: 3176595 - protein, 18 aa, Giardia lamblia
ATDCLEWLLDENIARDAG

SEQ ID NO: 3176596 - protein, 17 aa, Giardia lamblia
ATEFLRMHGTFITKIFR

SEQ ID NO: 3176597 - protein, 17 aa, Giardia lamblia
ATFRKGKSLDILCESYA

SEQ ID NO: 3176598 - protein, 17 aa, Giardia lamblia
ATGALWLSRTFSFVSTL

SEQ ID NO: 3176599 - protein, 17 aa, Giardia lamblia
ATGFPRVFTVFTHLDEF

SEQ ID NO: 3176600 - protein, 25 aa, Giardia lamblia
ATHSCPYCQKFIPEFSVELEALQQQ

SEQ ID NO: 3176601 - protein, 25 aa, Giardia lamblia
ATIAGDIVAVWSWLPRQHKWQDING

SEQ ID NO: 3176602 - protein, 23 aa, Giardia lamblia
ATIMALLCRFVRTHRCKVWMTPC

SEQ ID NO: 3176603 - protein, 26 aa, Giardia lamblia
ATKDFPCKRCEQYLNLFACKMTVTDQ

SEQ ID NO: 3176604 - protein, 17 aa, Giardia lamblia
ATLKLAGLVPLDESDSE

SEQ ID NO: 3176605 - protein, 24 aa, Giardia lamblia
ATLRRPMGICISSTKPGVVYITDT

SEQ ID NO: 3176606 - protein, 19 aa, Giardia lamblia
ATLYSYWIPCRKIVAANDF

SEQ ID NO: 3176607 - protein, 22 aa, Giardia lamblia
ATMALKAPRIFEGETALMQVAR

SEQ ID NO: 3176608 - protein, 19 aa, Giardia lamblia
ATSFLAGRVRLPYSPINII

SEQ ID NO: 3176609 - protein, 18 aa, Giardia lamblia
ATSLRFGCFTSLLSKFGE

SEQ ID NO: 3176610 - protein, 19 aa, Giardia lamblia
ATYCLEYYKKIAFSGDLTL

SEQ ID NO: 3176611 - protein, 24 aa, Giardia lamblia
AVAEARAAYRSSLIYLFDYAVIKK

SEQ ID NO: 3176612 - protein, 19 aa, Giardia lamblia
AVAGAWSCLVFDLMEITRS

SEQ ID NO: 3176613 - protein, 18 aa, Giardia lamblia
AVAYGIYYLCHGGCSDLR

SEQ ID NO: 3176614 - protein, 26 aa, Giardia lamblia
AVEFPLKSPELFAALNIQPPNAVLLH

SEQ ID NO: 3176615 - protein, 17 aa, Giardia lamblia
AVFRFELERAMLQGDLA

SEQ ID NO: 3176616 - protein, 20 aa, Giardia lamblia
AVFSCLRYSQLYIVLERAIM

SEQ ID NO: 3176617 - protein, 21 aa, Giardia lamblia
AVGICLYELIFGHPPHHKLSP

SEQ ID NO: 3176618 - protein, 19 aa, Giardia lamblia
AVGISGVFNHLVLREVTLL

SEQ ID NO: 3176619 - protein, 23 aa, Giardia lamblia
AVIRFEAFHVFKVFVANPKKTEP

SEQ ID NO: 3176620 - protein, 20 aa, Giardia lamblia
AVIYRARYMFFKDLSPPEAA

SEQ ID NO: 3176621 - protein, 20 aa, Giardia lamblia
AVKFTEAWMCKNFQTAVEHA

SEQ ID NO: 3176622 - protein, 19 aa, Giardia lamblia
AVLKHIWPKVCGYLNDLFR

SEQ ID NO: 3176623 - protein, 22 aa, Giardia lamblia
AVLPCGRTALMLAAQKNSAQYV

SEQ ID NO: 3176624 - protein, 19 aa, Giardia lamblia
AVLRLGWKFPTTVQEKVIP

SEQ ID NO: 3176625 - protein, 19 aa, Giardia lamblia
AVQLWLLKFLNIHYPLFTH

SEQ ID NO: 3176626 - protein, 18 aa, Giardia lamblia
AVRGCDTLALLILRDGTA

SEQ ID NO: 3176627 - protein, 21 aa, Giardia lamblia
AVRRKAPAYTLAGRTAAHRPE

SEQ ID NO: 3176628 - protein, 20 aa, Giardia lamblia
AVSFLDCIERMWASLRSENG

SEQ ID NO: 3176629 - protein, 18 aa, Giardia lamblia
AVSPDCRSFVTGSFSDKF

SEQ ID NO: 3176630 - protein, 18 aa, Giardia lamblia
AVSSLKFAARIAGVETMP

SEQ ID NO: 3176631 - protein, 18 aa, Giardia lamblia
AVTVPIEIFEFGKIAQGK

SEQ ID NO: 3176632 - protein, 18 aa, Giardia lamblia
AWHCYPRCVALLMHTEAP

SEQ ID NO: 3176633 - protein, 21 aa, Giardia lamblia
AYFRIEEAFSLFVQIVSGVAY

SEQ ID NO: 3176634 - protein, 18 aa, Giardia lamblia
AYGYFAREFLRKRLAGHR

SEQ ID NO: 3176635 - protein, 19 aa, Giardia lamblia
AYIRCSWNKLGYGRQKLEA

SEQ ID NO: 3176636 - protein, 19 aa, Giardia lamblia
AYLGWDYFRVHTGGFLPYN

SEQ ID NO: 3176637 - protein, 18 aa, Giardia lamblia
AYLVKWLTDKGMVNTLKV

SEQ ID NO: 3176638 - protein, 17 aa, Giardia lamblia
AYPRTLIEFAMKNDLHY

SEQ ID NO: 3176639 - protein, 18 aa, Giardia lamblia
AYQRAGLYVARRVSDSSI

SEQ ID NO: 3176640 - protein, 18 aa, Giardia lamblia
AYRKDSCCVLEIKNQTAL

SEQ ID NO: 3176641 - protein, 19 aa, Giardia lamblia
AYSLLCWLVKLLTTAEQSV

SEQ ID NO: 3176642 - protein, 19 aa, Giardia lamblia
AYSRLKVKFLQKLAAFRSS

SEQ ID NO: 3176643 - protein, 18 aa, Giardia lamblia
AYSSSLGFKCITLDGDVV

SEQ ID NO: 3176644 - protein, 23 aa, Giardia lamblia
AYWCFRIDMELYSGCISAAHGVL

SEQ ID NO: 3176645 - protein, 17 aa, Giardia lamblia
CACGNPKSVTAWPPPLR

SEQ ID NO: 3176646 - protein, 19 aa, Giardia lamblia
CAEAWVFRAEFEMAIFRRN

SEQ ID NO: 3176647 - protein, 23 aa, Giardia lamblia
CAECLRKKITLDRCAEDLETVKE

SEQ ID NO: 3176648 - protein, 17 aa, Giardia lamblia
CAEWIGVIDIEFLGSYV

SEQ ID NO: 3176649 - protein, 19 aa, Giardia lamblia
CAFIIPILHRIATEKLKLY

SEQ ID NO: 3176650 - protein, 17 aa, Giardia lamblia
CAHVQGWKGRRMARSLI

SEQ ID NO: 3176651 - protein, 17 aa, Giardia lamblia
CALQPPFVASNIESLKT

SEQ ID NO: 3176652 - protein, 19 aa, Giardia lamblia
CAMIDKLRILQAITNTEQA

SEQ ID NO: 3176653 - protein, 22 aa, Giardia lamblia
CASLKLSQLYSFFGESLSSIPA

SEQ ID NO: 3176654 - protein, 20 aa, Giardia lamblia
CATMRSCFILTLNVSLEYEK

SEQ ID NO: 3176655 - protein, 19 aa, Giardia lamblia
CCCCKCTRPEVDMQGFNLC

SEQ ID NO: 3176656 - protein, 23 aa, Giardia lamblia
CCEFCPADERLLIVGYAGSGLDE

SEQ ID NO: 3176657 - protein, 17 aa, Giardia lamblia
CCKWCPRTDVSIIAVCA

SEQ ID NO: 3176658 - protein, 17 aa, Giardia lamblia
CCLRIVKYVISLFAPGS

SEQ ID NO: 3176659 - protein, 17 aa, Giardia lamblia
CCRHCYDTNAGVCPACD

SEQ ID NO: 3176660 - protein, 18 aa, Giardia lamblia
CCYVCSASIDGSILCLIH

SEQ ID NO: 3176661 - protein, 17 aa, Giardia lamblia
CDAAGVKVDSIWFTLFA

SEQ ID NO: 3176662 - protein, 24 aa, Giardia lamblia
CDELKQLLCKLSWSGSIDECSLEY

SEQ ID NO: 3176663 - protein, 18 aa, Giardia lamblia
CDFTLKIEPSRWVFDHEG

SEQ ID NO: 3176664 - protein, 20 aa, Giardia lamblia
CDIWSLGGVMHFLASKLVPY

SEQ ID NO: 3176665 - protein, 18 aa, Giardia lamblia
CDLCSKRATLQCLACRSH

SEQ ID NO: 3176666 - protein, 22 aa, Giardia lamblia
CDLETLPLLSLLANHILGEVAT

SEQ ID NO: 3176667 - protein, 17 aa, Giardia lamblia
CDLFCGLYDKVTGVYPN

SEQ ID NO: 3176668 - protein, 21 aa, Giardia lamblia
CDLPPQFAYFFQFSHLSATRN

SEQ ID NO: 3176669 - protein, 21 aa, Giardia lamblia
CDPRGRTALHYAVEAKNTNFL

SEQ ID NO: 3176670 - protein, 18 aa, Giardia lamblia
CDVIREIKQQMTAFKAEF

SEQ ID NO: 3176671 - protein, 19 aa, Giardia lamblia
CEACYKIQLTYVRDLDTSR

SEQ ID NO: 3176672 - protein, 17 aa, Giardia lamblia
CEAHYLRCIITRIKHGA

SEQ ID NO: 3176673 - protein, 18 aa, Giardia lamblia
CEECWKRFGSQEIETEEA

SEQ ID NO: 3176674 - protein, 18 aa, Giardia lamblia
CEEYDRLIAISAQLREKN

SEQ ID NO: 3176675 - protein, 17 aa, Giardia lamblia
CEKRLSNFLPWHLAYAE

SEQ ID NO: 3176676 - protein, 19 aa, Giardia lamblia
CEMCKGRLFKNGFCNTCGN

SEQ ID NO: 3176677 - protein, 18 aa, Giardia lamblia
CESSFMRDPLEAMSSVTK

SEQ ID NO: 3176678 - protein, 19 aa, Giardia lamblia
CEWRYTFKNAKQHIVTQQT

SEQ ID NO: 3176679 - protein, 20 aa, Giardia lamblia
CFEIDLPFIRKARSNFSHGV

SEQ ID NO: 3176680 - protein, 18 aa, Giardia lamblia
CFFFLPKQTDLVFMGSID

SEQ ID NO: 3176681 - protein, 21 aa, Giardia lamblia
CGAAPDLWSLGIILYEMMALA

SEQ ID NO: 3176682 - protein, 18 aa, Giardia lamblia
CGACLESSFFCYNDPIAV

SEQ ID NO: 3176683 - protein, 21 aa, Giardia lamblia
CGDSGRFQANIAFITRLRAAI

SEQ ID NO: 3176684 - protein, 20 aa, Giardia lamblia
CGHCNTLLPPYCGMCEKCHW

SEQ ID NO: 3176685 - protein, 17 aa, Giardia lamblia
CGPDLFKLYSSLMKAST

SEQ ID NO: 3176686 - protein, 20 aa, Giardia lamblia
CGRLPTKPLKSICASTQQAE

SEQ ID NO: 3176687 - protein, 17 aa, Giardia lamblia
CGYFVPALVDKVLTSLS

SEQ ID NO: 3176688 - protein, 19 aa, Giardia lamblia
CHLTFKFTLQLGSKKVSLS

SEQ ID NO: 3176689 - protein, 23 aa, Giardia lamblia
CICQDCLRRVFRGSFGAERYPSI

SEQ ID NO: 3176690 - protein, 17 aa, Giardia lamblia
CIDPRSRASVTYICGLE

SEQ ID NO: 3176691 - protein, 21 aa, Giardia lamblia
CIECRRNPRSFTFAAHCEFSS

SEQ ID NO: 3176692 - protein, 18 aa, Giardia lamblia
CIEPLRLSYPIAKESQVG

SEQ ID NO: 3176693 - protein, 19 aa, Giardia lamblia
CIEYACLLMKYDDLEENNT

SEQ ID NO: 3176694 - protein, 21 aa, Giardia lamblia
CIKCSGIHRSLGRHISKVKSL

SEQ ID NO: 3176695 - protein, 20 aa, Giardia lamblia
CILPCLLESELFYKHFAEDE

SEQ ID NO: 3176696 - protein, 18 aa, Giardia lamblia
CILQACLKWAPNSIKLVE

SEQ ID NO: 3176697 - protein, 18 aa, Giardia lamblia
CILRCLRPDRVYIAVQLF

SEQ ID NO: 3176698 - protein, 18 aa, Giardia lamblia
CIPLLMLEACIQRPDGHT

SEQ ID NO: 3176699 - protein, 19 aa, Giardia lamblia
CKAKTVHLGYCPVKDYNGP

SEQ ID NO: 3176700 - protein, 17 aa, Giardia lamblia
CKARCFTNALIAVDAEA

SEQ ID NO: 3176701 - protein, 20 aa, Giardia lamblia
CKELQKLLLIVARDHDQSLL

SEQ ID NO: 3176702 - protein, 17 aa, Giardia lamblia
CKFCQNWSISMDKPNVQ

SEQ ID NO: 3176703 - protein, 19 aa, Giardia lamblia
CKGTTRWGDSLVFDARFEA

SEQ ID NO: 3176704 - protein, 17 aa, Giardia lamblia
CKHPACFDLETFVTYAC

SEQ ID NO: 3176705 - protein, 18 aa, Giardia lamblia
CKIKRPNNFFIIRGNHET

SEQ ID NO: 3176706 - protein, 19 aa, Giardia lamblia
CKIYLVDKKVCLRMDLVGP

SEQ ID NO: 3176707 - protein, 25 aa, Giardia lamblia
CKKCKTLDWTMCRIEDGFLCCTSCA

SEQ ID NO: 3176708 - protein, 20 aa, Giardia lamblia
CKLVCIPFCHTFGLPTLAIK

SEQ ID NO: 3176709 - protein, 19 aa, Giardia lamblia
CKMQQTWLYLESIFAPDDI

SEQ ID NO: 3176710 - protein, 22 aa, Giardia lamblia
CKRLCREWDAFIAATGCLVRAF

SEQ ID NO: 3176711 - protein, 19 aa, Giardia lamblia
CKRSIIFFGSITDLNSFYS

SEQ ID NO: 3176712 - protein, 17 aa, Giardia lamblia
CKSIDPIFRNHFVDLAT

SEQ ID NO: 3176713 - protein, 17 aa, Giardia lamblia
CKVKLASCTEAQREIDL

SEQ ID NO: 3176714 - protein, 17 aa, Giardia lamblia
CKVRLGDTLGRVFSKFS

SEQ ID NO: 3176715 - protein, 21 aa, Giardia lamblia
CKYHMYRLWTKLRIFHRPICP

SEQ ID NO: 3176716 - protein, 17 aa, Giardia lamblia
CLDVMLHIGIKFHSMRS

SEQ ID NO: 3176717 - protein, 17 aa, Giardia lamblia
CLFAERILNVFKSILSA

SEQ ID NO: 3176718 - protein, 19 aa, Giardia lamblia
CLFISRGGLLQWCSLLGFS

SEQ ID NO: 3176719 - protein, 18 aa, Giardia lamblia
CLFSEVFAYLPAHALLDN

SEQ ID NO: 3176720 - protein, 17 aa, Giardia lamblia
CLFYTGFDRALRFLIEE

SEQ ID NO: 3176721 - protein, 17 aa, Giardia lamblia
CLGNAIMRCCIDQAREV

SEQ ID NO: 3176722 - protein, 20 aa, Giardia lamblia
CLHTVCYSCFLRNRVLCGRK

SEQ ID NO: 3176723 - protein, 18 aa, Giardia lamblia
CLKILMPREYELVQASGK

SEQ ID NO: 3176724 - protein, 18 aa, Giardia lamblia
CLKTLCHGRVPIQYVSDG

SEQ ID NO: 3176725 - protein, 19 aa, Giardia lamblia
CLKYLPKPLETIPIRTEIG

SEQ ID NO: 3176726 - protein, 19 aa, Giardia lamblia
CLMARKCLLLFGSFIKPDS

SEQ ID NO: 3176727 - protein, 19 aa, Giardia lamblia
CLMSACATDNLAIAKMFIK

SEQ ID NO: 3176728 - protein, 18 aa, Giardia lamblia
CLNWKQLPLIISPFFLYS

SEQ ID NO: 3176729 - protein, 18 aa, Giardia lamblia
CLSLKYFVGDAVQLSQIM

SEQ ID NO: 3176730 - protein, 19 aa, Giardia lamblia
CLTGFKWLGTLSESARSRG

SEQ ID NO: 3176731 - protein, 28 aa, Giardia lamblia
CLTSQCPRCGVHLTILPRNAVESFAQAM

SEQ ID NO: 3176732 - protein, 20 aa, Giardia lamblia
CMACNGWVMGAAYDFTMREH

SEQ ID NO: 3176733 - protein, 17 aa, Giardia lamblia
CMLLWNVHSFYKSPGPL

SEQ ID NO: 3176734 - protein, 21 aa, Giardia lamblia
CMTSELLGAFISFISAQMMEL

SEQ ID NO: 3176735 - protein, 20 aa, Giardia lamblia
CNAGGWKYDELKAHMTACGL

SEQ ID NO: 3176736 - protein, 18 aa, Giardia lamblia
CNLPNRMAQNKLFKSLVS

SEQ ID NO: 3176737 - protein, 17 aa, Giardia lamblia
CNYLNLYPTEFVTAAET

SEQ ID NO: 3176738 - protein, 19 aa, Giardia lamblia
CPECIKQLLKKEGNMQDND

SEQ ID NO: 3176739 - protein, 18 aa, Giardia lamblia
CPEGRPLFACLLDKTMVV

SEQ ID NO: 3176740 - protein, 22 aa, Giardia lamblia
CPHCLYFLPCILKIRDRSHLIV

SEQ ID NO: 3176741 - protein, 21 aa, Giardia lamblia
CPHCSLCRSTLRAALDEVTAL

SEQ ID NO: 3176742 - protein, 17 aa, Giardia lamblia
CPLELDMSRGLSRDIVE

SEQ ID NO: 3176743 - protein, 17 aa, Giardia lamblia
CPMHPSLALPISICCRL

SEQ ID NO: 3176744 - protein, 22 aa, Giardia lamblia
CPNCYHLKFFRLFKETDRELAI

SEQ ID NO: 3176745 - protein, 18 aa, Giardia lamblia
CPQLRALPDLVFSILKTD

SEQ ID NO: 3176746 - protein, 20 aa, Giardia lamblia
CPRINIVFRSVGGHDFHLVY

SEQ ID NO: 3176747 - protein, 18 aa, Giardia lamblia
CPSPEDWFSAAINQEYAS

SEQ ID NO: 3176748 - protein, 18 aa, Giardia lamblia
CQHRSGLYAINFTNPYIK

SEQ ID NO: 3176749 - protein, 17 aa, Giardia lamblia
CQLRFNMSIGTAKNCKW

SEQ ID NO: 3176750 - protein, 17 aa, Giardia lamblia
CQLYRLYVWGFRTINYS

SEQ ID NO: 3176751 - protein, 19 aa, Giardia lamblia
CQRCGCLRKQLIYLSSQFH

SEQ ID NO: 3176752 - protein, 19 aa, Giardia lamblia
CQRCGRPLYVPRLHLDASS

SEQ ID NO: 3176753 - protein, 20 aa, Giardia lamblia
CREKLNFLYLIYSYICDTAG

SEQ ID NO: 3176754 - protein, 24 aa, Giardia lamblia
CRGGSLWGLMAWMRKSDMRFSEQE

SEQ ID NO: 3176755 - protein, 18 aa, Giardia lamblia
CRGSVCCTRFNSGVSDFY

SEQ ID NO: 3176756 - protein, 20 aa, Giardia lamblia
CRGTERCKFCFQRHMSRDCP

SEQ ID NO: 3176757 - protein, 20 aa, Giardia lamblia
CRGYCGACMSFIPGEECLLE

SEQ ID NO: 3176758 - protein, 19 aa, Giardia lamblia
CRIQLLTAHYCFLYRYGRH

SEQ ID NO: 3176759 - protein, 18 aa, Giardia lamblia
CRLLRTIWASAIVYNTVY

SEQ ID NO: 3176760 - protein, 18 aa, Giardia lamblia
CRVSYPWITDALARHVRY

SEQ ID NO: 3176761 - protein, 19 aa, Giardia lamblia
CSCANGWTALMSAARFNKV

SEQ ID NO: 3176762 - protein, 22 aa, Giardia lamblia
CSCCGWPVHYCKYRKPSKQAEL

SEQ ID NO: 3176763 - protein, 21 aa, Giardia lamblia
CSFCARLRRGTLYTHCQKLGI

SEQ ID NO: 3176764 - protein, 20 aa, Giardia lamblia
CSFCDAPFCKSCSELLAEAK

SEQ ID NO: 3176765 - protein, 19 aa, Giardia lamblia
CSFGTTKFCTSFLDGKQCA

SEQ ID NO: 3176766 - protein, 21 aa, Giardia lamblia
CSICGKPGALIGCYNKACQFT

SEQ ID NO: 3176767 - protein, 21 aa, Giardia lamblia
CSISDDFNCFLFRYMKKKYCT

SEQ ID NO: 3176768 - protein, 17 aa, Giardia lamblia
CSLEFPFQAMTHADLAR

SEQ ID NO: 3176769 - protein, 18 aa, Giardia lamblia
CSLLEVLKQDILGCTARL

SEQ ID NO: 3176770 - protein, 21 aa, Giardia lamblia
CSLSLLDLLAVIACYPNLETL

SEQ ID NO: 3176771 - protein, 21 aa, Giardia lamblia
CSRCSSRLGLQFGASPTRTFT

SEQ ID NO: 3176772 - protein, 23 aa, Giardia lamblia
CSSDFCCLCGILGHNKNTCTTSS

SEQ ID NO: 3176773 - protein, 17 aa, Giardia lamblia
CSSSRYGPPVSNSTTQM

SEQ ID NO: 3176774 - protein, 18 aa, Giardia lamblia
CSTYRFLQQYTRRRSSRP

SEQ ID NO: 3176775 - protein, 20 aa, Giardia lamblia
CSVSGCKVVERFANLASIDR

SEQ ID NO: 3176776 - protein, 17 aa, Giardia lamblia
CSVSRTVSMLSINEYAD

SEQ ID NO: 3176777 - protein, 18 aa, Giardia lamblia
CTAEIFPIHGYTVSVSQS

SEQ ID NO: 3176778 - protein, 18 aa, Giardia lamblia
CTCNYQVCAFCFDKVKGG

SEQ ID NO: 3176779 - protein, 18 aa, Giardia lamblia
CTERGWTALMYAACHNNA

SEQ ID NO: 3176780 - protein, 20 aa, Giardia lamblia
CTHTFHRICLIRWLHYDNTS

SEQ ID NO: 3176781 - protein, 27 aa, Giardia lamblia
CTKCNSLVFCNECWKDLKAIDICCPKC

SEQ ID NO: 3176782 - protein, 17 aa, Giardia lamblia
CTLCQGVIPSSATMTPS

SEQ ID NO: 3176783 - protein, 18 aa, Giardia lamblia
CTLQHAFEAQNMKGLVVK

SEQ ID NO: 3176784 - protein, 19 aa, Giardia lamblia
CTNLSRFGASIIHPILEVI

SEQ ID NO: 3176785 - protein, 23 aa, Giardia lamblia
CTRDAKIVFLYSFTKYGRVQADT

SEQ ID NO: 3176786 - protein, 18 aa, Giardia lamblia
CTVRCLPCSHDVACPSCV

SEQ ID NO: 3176787 - protein, 19 aa, Giardia lamblia
CVFPDIRQCATTMWNDTII

SEQ ID NO: 3176788 - protein, 27 aa, Giardia lamblia
CVICYPSRLSFEISQIFHTRYSLFKMA

SEQ ID NO: 3176789 - protein, 17 aa, Giardia lamblia
CVMCTKCRAKSYSFSYC

SEQ ID NO: 3176790 - protein, 19 aa, Giardia lamblia
CVQKGCIRRNPNTVDLTSS

SEQ ID NO: 3176791 - protein, 20 aa, Giardia lamblia
CVQPTLAPLVCRKLLMDYSD

SEQ ID NO: 3176792 - protein, 24 aa, Giardia lamblia
CVVLRPLARIILCDEFERLPQQHN

SEQ ID NO: 3176793 - protein, 18 aa, Giardia lamblia
CWIYPRLGCYCFNFNKHL

SEQ ID NO: 3176794 - protein, 18 aa, Giardia lamblia
CYAYSIGKITGWDKSKSI

SEQ ID NO: 3176795 - protein, 22 aa, Giardia lamblia
CYDPVLVIMVFRLVQALRLASL

SEQ ID NO: 3176796 - protein, 20 aa, Giardia lamblia
CYIPGCSFPACLNLIDSSLP

SEQ ID NO: 3176797 - protein, 18 aa, Giardia lamblia
CYNLPSFDTFWLQFDLSA

SEQ ID NO: 3176798 - protein, 23 aa, Giardia lamblia
CYPRGCGWTPLFEAVYNGYPNCV

SEQ ID NO: 3176799 - protein, 18 aa, Giardia lamblia
CYPTLKPLSSWIVDLIDR

SEQ ID NO: 3176800 - protein, 19 aa, Giardia lamblia
CYSCFLRNRVLCGRKACLL

SEQ ID NO: 3176801 - protein, 18 aa, Giardia lamblia
CYVEILKKHINGWPMLFP

SEQ ID NO: 3176802 - protein, 19 aa, Giardia lamblia
DAAEALAMFGVLASAGQSA

SEQ ID NO: 3176803 - protein, 18 aa, Giardia lamblia
DAAMHWKRVFSRLRNDYI

SEQ ID NO: 3176804 - protein, 19 aa, Giardia lamblia
DAAPIFVASGMDCFTELAE

SEQ ID NO: 3176805 - protein, 18 aa, Giardia lamblia
DAELKRYITWLLNHVANN

SEQ ID NO: 3176806 - protein, 23 aa, Giardia lamblia
DAEYDKPAAFRVCLFGRAHMADI

SEQ ID NO: 3176807 - protein, 18 aa, Giardia lamblia
DAFGRTALYYAEHPYWRV

SEQ ID NO: 3176808 - protein, 17 aa, Giardia lamblia
DAFSDLLLVLGLYPSGR

SEQ ID NO: 3176809 - protein, 18 aa, Giardia lamblia
DAICKRVQEEAYMASQGR

SEQ ID NO: 3176810 - protein, 21 aa, Giardia lamblia
DAIEYWAKITLPRLTTEEQER

SEQ ID NO: 3176811 - protein, 19 aa, Giardia lamblia
DAIFLPRLAQYLFPLMALQ

SEQ ID NO: 3176812 - protein, 23 aa, Giardia lamblia
DAILCPRPGFPLYASTIVYYGGK

SEQ ID NO: 3176813 - protein, 22 aa, Giardia lamblia
DALCMAKLWGCHEIVSLLSNEV

SEQ ID NO: 3176814 - protein, 19 aa, Giardia lamblia
DALGLATLVDREFLETPVT

SEQ ID NO: 3176815 - protein, 26 aa, Giardia lamblia
DAQGCAFLQPRLGSNLNITGVSPAFP

SEQ ID NO: 3176816 - protein, 21 aa, Giardia lamblia
DARGRNALQYAVRAGQPECVK

SEQ ID NO: 3176817 - protein, 20 aa, Giardia lamblia
DARGRTALMYAAEKGHLESV

SEQ ID NO: 3176818 - protein, 23 aa, Giardia lamblia
DASNCLRLLFLLYKFSKHKLEKP

SEQ ID NO: 3176819 - protein, 22 aa, Giardia lamblia
DATDIYLIFSLVIANTWNLRVL

SEQ ID NO: 3176820 - protein, 18 aa, Giardia lamblia
DAWIVIACDGCWDSISDI

SEQ ID NO: 3176821 - protein, 20 aa, Giardia lamblia
DAYTRPFLREIYKSYERLKC

SEQ ID NO: 3176822 - protein, 18 aa, Giardia lamblia
DAYYLDFGKRISALEVKL

SEQ ID NO: 3176823 - protein, 17 aa, Giardia lamblia
DCCARIAIDVSMGLQAI

SEQ ID NO: 3176824 - protein, 25 aa, Giardia lamblia
DCDEVFRPFYLCTIIKPLFFFLDPY

SEQ ID NO: 3176825 - protein, 17 aa, Giardia lamblia
DCDNLIYKLRYEINISE

SEQ ID NO: 3176826 - protein, 17 aa, Giardia lamblia
DCFKSVLLETVILPQQR

SEQ ID NO: 3176827 - protein, 22 aa, Giardia lamblia
DCGECWKLLQKYGSAIAATEKF

SEQ ID NO: 3176828 - protein, 20 aa, Giardia lamblia
DCGWLPSTYTVMLSRGTRPL

SEQ ID NO: 3176829 - protein, 20 aa, Giardia lamblia
DCKHPSLLVYLTLINDRSRC

SEQ ID NO: 3176830 - protein, 18 aa, Giardia lamblia
DCLKEIVDSLMFSTACIC

SEQ ID NO: 3176831 - protein, 20 aa, Giardia lamblia
DCPMPVLAVDGFSAMVNTDQ

SEQ ID NO: 3176832 - protein, 17 aa, Giardia lamblia
DCPSCLGILPYCSQESF

SEQ ID NO: 3176833 - protein, 18 aa, Giardia lamblia
DCRTALMIAAEAGSYECC

SEQ ID NO: 3176834 - protein, 20 aa, Giardia lamblia
DCTIIPSSILLKLHLDTCAE

SEQ ID NO: 3176835 - protein, 20 aa, Giardia lamblia
DCVKLLLPHEYSFCKAHIIN

SEQ ID NO: 3176836 - protein, 22 aa, Giardia lamblia
DDAESWLPLALTPSVFVANSSF

SEQ ID NO: 3176837 - protein, 24 aa, Giardia lamblia
DDEESCAMLLRWEKSLELPGGKNP

SEQ ID NO: 3176838 - protein, 20 aa, Giardia lamblia
DDEWKTCFLKAVLSLGIGNA

SEQ ID NO: 3176839 - protein, 19 aa, Giardia lamblia
DDFFFGFVYRSKYVLLLYH

SEQ ID NO: 3176840 - protein, 17 aa, Giardia lamblia
DDHWLKERCILKSNTIK

SEQ ID NO: 3176841 - protein, 17 aa, Giardia lamblia
DDILTCLIDPAFNAELL

SEQ ID NO: 3176842 - protein, 17 aa, Giardia lamblia
DDKRTGFIFTVHDKLDF

SEQ ID NO: 3176843 - protein, 18 aa, Giardia lamblia
DDLFRWAAIIIGPSQTPW

SEQ ID NO: 3176844 - protein, 19 aa, Giardia lamblia
DDLPICWDAHLHALKGCYT

SEQ ID NO: 3176845 - protein, 18 aa, Giardia lamblia
DDQLRFLLFQNELTSERV

SEQ ID NO: 3176846 - protein, 17 aa, Giardia lamblia
DDYLLGWSLFQVQSGLQ

SEQ ID NO: 3176847 - protein, 22 aa, Giardia lamblia
DEARAAMMSYMFKREKSLKEAE

SEQ ID NO: 3176848 - protein, 17 aa, Giardia lamblia
DEARLKLTMQRDSIESS

SEQ ID NO: 3176849 - protein, 22 aa, Giardia lamblia
DEEGRTALMYAITEGKMNMVQM

SEQ ID NO: 3176850 - protein, 17 aa, Giardia lamblia
DEFYPYLLAFLISHDTK

SEQ ID NO: 3176851 - protein, 22 aa, Giardia lamblia
DEGRTALFYASWHGHTEVARLL

SEQ ID NO: 3176852 - protein, 17 aa, Giardia lamblia
DEIDAVFPTNSFYKYMD

SEQ ID NO: 3176853 - protein, 19 aa, Giardia lamblia
DELCYWKTRAADLTAVLDQ

SEQ ID NO: 3176854 - protein, 18 aa, Giardia lamblia
DELQRLNGILLFDNKALQ

SEQ ID NO: 3176855 - protein, 21 aa, Giardia lamblia
DELTVKCNLAPTVEEIEALYQ

SEQ ID NO: 3176856 - protein, 21 aa, Giardia lamblia
DENELRYAIPGGLIAIGTFID

SEQ ID NO: 3176857 - protein, 19 aa, Giardia lamblia
DERCIDCDNLIYKLRYEIN

SEQ ID NO: 3176858 - protein, 23 aa, Giardia lamblia
DERCWNCIILGPAGTAWENGKLC

SEQ ID NO: 3176859 - protein, 22 aa, Giardia lamblia
DESRLTTGLAFARRPTEGPGFC

SEQ ID NO: 3176860 - protein, 20 aa, Giardia lamblia
DEVDYVPGFGPVRFRYTSVT

SEQ ID NO: 3176861 - protein, 17 aa, Giardia lamblia
DEVELYKKYGLLAKLRE

SEQ ID NO: 3176862 - protein, 22 aa, Giardia lamblia
DEVKELMELLGGLQQETQLLRQ

SEQ ID NO: 3176863 - protein, 19 aa, Giardia lamblia
DFDAAMSFVKRYAGRKSGD

SEQ ID NO: 3176864 - protein, 22 aa, Giardia lamblia
DFGIHCRYWKTAAISSTKESQY

SEQ ID NO: 3176865 - protein, 21 aa, Giardia lamblia
DFIKENKWLAAHPDLIHEVPP

SEQ ID NO: 3176866 - protein, 19 aa, Giardia lamblia
DFLCSACSQVVRHPCRLRC

SEQ ID NO: 3176867 - protein, 17 aa, Giardia lamblia
DFPPGVCQFCLEECGQQ

SEQ ID NO: 3176868 - protein, 25 aa, Giardia lamblia
DFQLHYCTGCGFFFDGIEYEEYVIV

SEQ ID NO: 3176869 - protein, 17 aa, Giardia lamblia
DFSRPWRRVPIIETLEQ

SEQ ID NO: 3176870 - protein, 17 aa, Giardia lamblia
DFTRPIIKISYIAHHIA

SEQ ID NO: 3176871 - protein, 18 aa, Giardia lamblia
DFYCCLSDVITTMMTTEQ

SEQ ID NO: 3176872 - protein, 21 aa, Giardia lamblia
DGCFFCVGCKAYAYVKESATL

SEQ ID NO: 3176873 - protein, 18 aa, Giardia lamblia
DGDCALAFALDRRDIKSI

SEQ ID NO: 3176874 - protein, 22 aa, Giardia lamblia
DGEIPFLFTFESLLPFTVSPIT

SEQ ID NO: 3176875 - protein, 18 aa, Giardia lamblia
DGIGHCIPALTALIDKYD

SEQ ID NO: 3176876 - protein, 19 aa, Giardia lamblia
DGIHRYGRWNIFNPTALML

SEQ ID NO: 3176877 - protein, 18 aa, Giardia lamblia
DGLLRPDALISLTVPKNC

SEQ ID NO: 3176878 - protein, 22 aa, Giardia lamblia
DGNYRAGALLSDIVDVDMSRAA

SEQ ID NO: 3176879 - protein, 23 aa, Giardia lamblia
DGQHSGFCFVEFTSHESALRCLL

SEQ ID NO: 3176880 - protein, 18 aa, Giardia lamblia
DGRCCLYRTALLESGTLG

SEQ ID NO: 3176881 - protein, 22 aa, Giardia lamblia
DGRTALMSACFAGRFYAVKRLV

SEQ ID NO: 3176882 - protein, 18 aa, Giardia lamblia
DGSIRPSNMWLYNERNML

SEQ ID NO: 3176883 - protein, 18 aa, Giardia lamblia
DGTCLRASGLTPLMRAVI

SEQ ID NO: 3176884 - protein, 17 aa, Giardia lamblia
DGTECYVPSLLNRLTKG

SEQ ID NO: 3176885 - protein, 21 aa, Giardia lamblia
DGTRFLLYIPVDFNEPDMTLD

SEQ ID NO: 3176886 - protein, 35 aa, Giardia lamblia
DGVAVMRCIRKFWPITCRGIITGGFNWTITEEEEK

SEQ ID NO: 3176887 - protein, 18 aa, Giardia lamblia
DGVQWRIFVLIAKIYFIR

SEQ ID NO: 3176888 - protein, 19 aa, Giardia lamblia
DGWTALMWAAKNGHAGCVR

SEQ ID NO: 3176889 - protein, 21 aa, Giardia lamblia
DHHPVCLLSTINVRVLDDAKL

SEQ ID NO: 3176890 - protein, 18 aa, Giardia lamblia
DHISCIRFYISTGDLYSA

SEQ ID NO: 3176891 - protein, 19 aa, Giardia lamblia
DHLDYRYCQVFGDCCDPLS

SEQ ID NO: 3176892 - protein, 20 aa, Giardia lamblia
DHLIRFGVSSGRAMIVSYAS

SEQ ID NO: 3176893 - protein, 22 aa, Giardia lamblia
DHRRFSPDLKQFILALRSLCLH

SEQ ID NO: 3176894 - protein, 26 aa, Giardia lamblia
DIAEMMGRFSWPILSSCMGFLRKNDG

SEQ ID NO: 3176895 - protein, 23 aa, Giardia lamblia
DIDAWPAVLLWFIKTIIRAPKGS

SEQ ID NO: 3176896 - protein, 17 aa, Giardia lamblia
DIELLKRNFEVFPREHQ

SEQ ID NO: 3176897 - protein, 23 aa, Giardia lamblia
DIFLPRCEFCLGWGAIDVLPALF

SEQ ID NO: 3176898 - protein, 18 aa, Giardia lamblia
DIFSRWRFLYAMRRDQLN

SEQ ID NO: 3176899 - protein, 17 aa, Giardia lamblia
DIININFFFARQGIPVL

SEQ ID NO: 3176900 - protein, 21 aa, Giardia lamblia
DIKQRHVLSFALNVSTVEPLK

SEQ ID NO: 3176901 - protein, 18 aa, Giardia lamblia
DILLCYFSSYGLAIADKG

SEQ ID NO: 3176902 - protein, 24 aa, Giardia lamblia
DIMCFRGRVLGFTRFGLTKMKADS

SEQ ID NO: 3176903 - protein, 26 aa, Giardia lamblia
DIRKAVVYCLVDLYYLVGEDFTPYLN

SEQ ID NO: 3176904 - protein, 24 aa, Giardia lamblia
DIRNACRLGMDWIALSFVQTKADV

SEQ ID NO: 3176905 - protein, 24 aa, Giardia lamblia
DISPRRVCLIWGPMGLRFKGNYTS

SEQ ID NO: 3176906 - protein, 22 aa, Giardia lamblia
DITLARMLFQWLIDGNKILDAI

SEQ ID NO: 3176907 - protein, 21 aa, Giardia lamblia
DKANEMMSMFVAQLTGMISKL

SEQ ID NO: 3176908 - protein, 20 aa, Giardia lamblia
DKCKDYDALLSKLANAEAEL

SEQ ID NO: 3176909 - protein, 17 aa, Giardia lamblia
DKDVRFFSDDALPQAPA

SEQ ID NO: 3176910 - protein, 18 aa, Giardia lamblia
DKICTCSADVARLTEERD

SEQ ID NO: 3176911 - protein, 19 aa, Giardia lamblia
DKIPKWRGFSRRKAIAKDD

SEQ ID NO: 3176912 - protein, 22 aa, Giardia lamblia
DKIRFPCLFPSATRVDPSDPRR

SEQ ID NO: 3176913 - protein, 17 aa, Giardia lamblia
DKLRAVKVFSLAKLDED

SEQ ID NO: 3176914 - protein, 17 aa, Giardia lamblia
DKMLFLWRVRDWEPMLT

SEQ ID NO: 3176915 - protein, 18 aa, Giardia lamblia
DKSEPCWTSSKVESTTSD

SEQ ID NO: 3176916 - protein, 22 aa, Giardia lamblia
DKSKRTALMYAIESGEEGSDQL

SEQ ID NO: 3176917 - protein, 18 aa, Giardia lamblia
DKSRYLLDVFIAEYSTPS

SEQ ID NO: 3176918 - protein, 25 aa, Giardia lamblia
DLAEKAALCALELMEQRGFYKIEQA

SEQ ID NO: 3176919 - protein, 25 aa, Giardia lamblia
DLAELSKFWISLGIPPGERDNAYMK

SEQ ID NO: 3176920 - protein, 19 aa, Giardia lamblia
DLAWKCLRVLPINLLSRIS

SEQ ID NO: 3176921 - protein, 18 aa, Giardia lamblia
DLCPGCLRHRPHGCRGER

SEQ ID NO: 3176922 - protein, 23 aa, Giardia lamblia
DLCRRLRLLMGLNHKCLNRILSV

SEQ ID NO: 3176923 - protein, 22 aa, Giardia lamblia
DLDGRTALMYAVQLGSLDLVEM

SEQ ID NO: 3176924 - protein, 24 aa, Giardia lamblia
DLEPSFKVEQFFKVDHSPKTTRDP

SEQ ID NO: 3176925 - protein, 18 aa, Giardia lamblia
DLFRKCLDPVDRVLRDSK

SEQ ID NO: 3176926 - protein, 17 aa, Giardia lamblia
DLHEVHDVYSLPFNKNL

SEQ ID NO: 3176927 - protein, 18 aa, Giardia lamblia
DLIPRLMSAYYRVIRKKI

SEQ ID NO: 3176928 - protein, 20 aa, Giardia lamblia
DLIRRMLCIDPRSRASVTYI

SEQ ID NO: 3176929 - protein, 19 aa, Giardia lamblia
DLLCSTDHLPAHIIKNPAT

SEQ ID NO: 3176930 - protein, 20 aa, Giardia lamblia
DLLGRISFDKVFLLSLKRRS

SEQ ID NO: 3176931 - protein, 18 aa, Giardia lamblia
DLLRREGKALTELEHSKY

SEQ ID NO: 3176932 - protein, 19 aa, Giardia lamblia
DLPKNASCRLVLHAHGHKG

SEQ ID NO: 3176933 - protein, 20 aa, Giardia lamblia
DLPPNCLHSAEFTTVPEGVE

SEQ ID NO: 3176934 - protein, 21 aa, Giardia lamblia
DLPPPEWRYGIHSAPNEYPMT

SEQ ID NO: 3176935 - protein, 20 aa, Giardia lamblia
DLRPVPLLNFVASHTTYFSG

SEQ ID NO: 3176936 - protein, 18 aa, Giardia lamblia
DLRRSSNIFVYKESEQRQ

SEQ ID NO: 3176937 - protein, 19 aa, Giardia lamblia
DLSNIGFRLIFPKASIVEC

SEQ ID NO: 3176938 - protein, 24 aa, Giardia lamblia
DLSRKCLFQRKLIIQISDKHAAER

SEQ ID NO: 3176939 - protein, 20 aa, Giardia lamblia
DLVASPCRLYAYVVKTPIDW

SEQ ID NO: 3176940 - protein, 21 aa, Giardia lamblia
DLYSFAFPWAWDTQTAIHSFT

SEQ ID NO: 3176941 - protein, 29 aa, Giardia lamblia
DMRDELPCLWPLCVLCIIHRLSVPRAKLL

SEQ ID NO: 3176942 - protein, 24 aa, Giardia lamblia
DMRHIRLLADIMCFRGRVLGFTRF

SEQ ID NO: 3176943 - protein, 18 aa, Giardia lamblia
DMRLSALSSTKCSSTMEQ

SEQ ID NO: 3176944 - protein, 18 aa, Giardia lamblia
DNAFLTKEYNAFIASGRK

SEQ ID NO: 3176945 - protein, 21 aa, Giardia lamblia
DNARCLRFYKSIGMGYHTPIT

SEQ ID NO: 3176946 - protein, 17 aa, Giardia lamblia
DNCLVCIGPRHSSPSAR

SEQ ID NO: 3176947 - protein, 22 aa, Giardia lamblia
DNEGRSALMYAVLLEPDECLPF

SEQ ID NO: 3176948 - protein, 19 aa, Giardia lamblia
DNFFPSFGFLAKHSPSDRL

SEQ ID NO: 3176949 - protein, 23 aa, Giardia lamblia
DNGIYVLACFDILEYLRVYNGSQ

SEQ ID NO: 3176950 - protein, 21 aa, Giardia lamblia
DNGRFALKFACDAIASYLTGR

SEQ ID NO: 3176951 - protein, 20 aa, Giardia lamblia
DNHKCCIEYACLLMKYDDLE

SEQ ID NO: 3176952 - protein, 23 aa, Giardia lamblia
DNIRLKLVSVFAEDKKLRIGRLK

SEQ ID NO: 3176953 - protein, 19 aa, Giardia lamblia
DNLLPRPYFSIYLQDDGSN

SEQ ID NO: 3176954 - protein, 23 aa, Giardia lamblia
DNQEMLRCYPIDYVNSVNLANQR

SEQ ID NO: 3176955 - protein, 21 aa, Giardia lamblia
DNQLAGAMVLDFSHFPSTLQF

SEQ ID NO: 3176956 - protein, 26 aa, Giardia lamblia
DPAIYLECFKRLSISASEALIFEDSI

SEQ ID NO: 3176957 - protein, 19 aa, Giardia lamblia
DPALFCAALAVAEARAAYR

SEQ ID NO: 3176958 - protein, 17 aa, Giardia lamblia
DPARSALLSEVLRLRVI

SEQ ID NO: 3176959 - protein, 21 aa, Giardia lamblia
DPELFPSHCLEDIEGSVPSTQ

SEQ ID NO: 3176960 - protein, 19 aa, Giardia lamblia
DPFAAIVYRLCMIQRARTS

SEQ ID NO: 3176961 - protein, 26 aa, Giardia lamblia
DPGEIWPRYDAGYADYLRYMGKGMGP

SEQ ID NO: 3176962 - protein, 18 aa, Giardia lamblia
DPLGRTALMLAAQRGSVS

SEQ ID NO: 3176963 - protein, 19 aa, Giardia lamblia
DPPQFKFGFVPASTDDKNP

SEQ ID NO: 3176964 - protein, 22 aa, Giardia lamblia
DPPSKRYGAMMGFLDTSIIVAG

SEQ ID NO: 3176965 - protein, 24 aa, Giardia lamblia
DPYGWTALMSAVWNNHGSVAELLI

SEQ ID NO: 3176966 - protein, 18 aa, Giardia lamblia
DQLLLEWFVDNYKNYGAS

SEQ ID NO: 3176967 - protein, 18 aa, Giardia lamblia
DQRRLNVGLTRCRCALII

SEQ ID NO: 3176968 - protein, 23 aa, Giardia lamblia
DQVKRKMPAYSLAGRTNQARPNT

SEQ ID NO: 3176969 - protein, 22 aa, Giardia lamblia
DQYGRTALMYAILYTAQDAAGV

SEQ ID NO: 3176970 - protein, 24 aa, Giardia lamblia
DRCGCALRIIGFLVDCLKDTSCED

SEQ ID NO: 3176971 - protein, 17 aa, Giardia lamblia
DRCLLMIKQYFKRNMAQ

SEQ ID NO: 3176972 - protein, 19 aa, Giardia lamblia
DRDICLSKLTDRLGIEHAQ

SEQ ID NO: 3176973 - protein, 23 aa, Giardia lamblia
DRDWKEFYNYQGASNFAKKPDFP

SEQ ID NO: 3176974 - protein, 18 aa, Giardia lamblia
DREGRSALILSILHQRVA

SEQ ID NO: 3176975 - protein, 23 aa, Giardia lamblia
DRFISGSIGVCFGRVDKRKTPRS

SEQ ID NO: 3176976 - protein, 19 aa, Giardia lamblia
DRFLGCLSQLLTTQNDQEP

SEQ ID NO: 3176977 - protein, 22 aa, Giardia lamblia
DRIPPFPGCEAHYLRCIITRIK

SEQ ID NO: 3176978 - protein, 20 aa, Giardia lamblia
DRIWRIFAQLLIAMEYCHSV

SEQ ID NO: 3176979 - protein, 18 aa, Giardia lamblia
DRLIDLCVSLVPDSASRR

SEQ ID NO: 3176980 - protein, 20 aa, Giardia lamblia
DRLRKYFGVVAIFRALVDIL

SEQ ID NO: 3176981 - protein, 17 aa, Giardia lamblia
DRLRLATTPAPVRTLVA

SEQ ID NO: 3176982 - protein, 23 aa, Giardia lamblia
DRNLRYYLTMIMKRQKLYGKLDK

SEQ ID NO: 3176983 - protein, 19 aa, Giardia lamblia
DRRGRSALHYATEAARHAN

SEQ ID NO: 3176984 - protein, 21 aa, Giardia lamblia
DRRLKAVVFDPPLPLNGLNTP

SEQ ID NO: 3176985 - protein, 21 aa, Giardia lamblia
DRVAYRLVGEVLIKETVKEVK

SEQ ID NO: 3176986 - protein, 23 aa, Giardia lamblia
DSALPEHVVWEFMYSMLSAVKEA

SEQ ID NO: 3176987 - protein, 23 aa, Giardia lamblia
DSCDKSRCLLKLVGKPHSYTNRS

SEQ ID NO: 3176988 - protein, 17 aa, Giardia lamblia
DSDEAKQIWSFGPVGAS

SEQ ID NO: 3176989 - protein, 23 aa, Giardia lamblia
DSEGRTALYFAVKALHYSSIRHL

SEQ ID NO: 3176990 - protein, 18 aa, Giardia lamblia
DSFHEVRNVFLLAIQSLS

SEQ ID NO: 3176991 - protein, 20 aa, Giardia lamblia
DSGRGAVLFAIARGKLSEGI

SEQ ID NO: 3176992 - protein, 19 aa, Giardia lamblia
DSIFFKRLFEAHRLKATVE

SEQ ID NO: 3176993 - protein, 22 aa, Giardia lamblia
DSIKCLRTWIQPFKPATPEFES

SEQ ID NO: 3176994 - protein, 18 aa, Giardia lamblia
DSLVCCICLDKLRNVILY

SEQ ID NO: 3176995 - protein, 23 aa, Giardia lamblia
DSPFPRLRILNNLIITVDDYDRA

SEQ ID NO: 3176996 - protein, 19 aa, Giardia lamblia
DSRCKFTLLIPPPNVTGSL

SEQ ID NO: 3176997 - protein, 21 aa, Giardia lamblia
DSRGWTALMYAAFLSFNSSIP

SEQ ID NO: 3176998 - protein, 17 aa, Giardia lamblia
DSVMPKIQMELVEETIY

SEQ ID NO: 3176999 - protein, 18 aa, Giardia lamblia
DTKVSWRWMVYSPGIDMY

SEQ ID NO: 3177000 - protein, 19 aa, Giardia lamblia
DTLRCFKKNLPVCRLVARS

SEQ ID NO: 3177001 - protein, 22 aa, Giardia lamblia
DTRLLRRMCRDFVFRNRSADGT

SEQ ID NO: 3177002 - protein, 22 aa, Giardia lamblia
DTSNRIAVFVARMLIKCSQIKN

SEQ ID NO: 3177003 - protein, 22 aa, Giardia lamblia
DVDGRTALWFAAMKGHVSCVRE

SEQ ID NO: 3177004 - protein, 24 aa, Giardia lamblia
DVDKRFTIDIIRAHPWFTVNLPKH

SEQ ID NO: 3177005 - protein, 18 aa, Giardia lamblia
DVEGRSALFYATLHNHPS

SEQ ID NO: 3177006 - protein, 18 aa, Giardia lamblia
DVIEFKQQLSALASQGVG

SEQ ID NO: 3177007 - protein, 17 aa, Giardia lamblia
DVLLEFLEQVVLELLEV

SEQ ID NO: 3177008 - protein, 23 aa, Giardia lamblia
DVQGRTALMYAVLGGSLKCVRLL

SEQ ID NO: 3177009 - protein, 18 aa, Giardia lamblia
DVRFLLSVMLCMDPAERI

SEQ ID NO: 3177010 - protein, 23 aa, Giardia lamblia
DVRKSAEISLDYGMFQREYTRLQ

SEQ ID NO: 3177011 - protein, 21 aa, Giardia lamblia
DVSSIFPLVCRFAATKDIKLK

SEQ ID NO: 3177012 - protein, 17 aa, Giardia lamblia
DVVSLSFPTKEKVVTKS

SEQ ID NO: 3177013 - protein, 21 aa, Giardia lamblia
DVYTVWCLRSLQGGLTDLSGR

SEQ ID NO: 3177014 - protein, 17 aa, Giardia lamblia
DWYRCFESFMRENIHTV

SEQ ID NO: 3177015 - protein, 17 aa, Giardia lamblia
DYACKLTLFAPINPDES

SEQ ID NO: 3177016 - protein, 20 aa, Giardia lamblia
DYHCANWAGCPFRLSIRHYK

SEQ ID NO: 3177017 - protein, 24 aa, Giardia lamblia
DYLNGRLGNYYSLNRERFSQKTLS

SEQ ID NO: 3177018 - protein, 17 aa, Giardia lamblia
DYMISYTAPEVFTSNIY

SEQ ID NO: 3177019 - protein, 21 aa, Giardia lamblia
DYTGEFIIRVRSMLEIEYNYL

SEQ ID NO: 3177020 - protein, 24 aa, Giardia lamblia
EAAIIRLCHHYELIGPTVEVIMLL

SEQ ID NO: 3177021 - protein, 23 aa, Giardia lamblia
EADLANFLLKYVISIIFPSQQEP

SEQ ID NO: 3177022 - protein, 24 aa, Giardia lamblia
EAERFIPCRGFRVSSAGKLRLPST

SEQ ID NO: 3177023 - protein, 17 aa, Giardia lamblia
EAFPAHPGLLIKGPTVR

SEQ ID NO: 3177024 - protein, 20 aa, Giardia lamblia
EAFTALLLRTTGFRRFNPTP

SEQ ID NO: 3177025 - protein, 23 aa, Giardia lamblia
EAGCSAFMRLEWSIVKNRLDMAD

SEQ ID NO: 3177026 - protein, 22 aa, Giardia lamblia
EAGMQCARGYTALMYAAAAGHK

SEQ ID NO: 3177027 - protein, 20 aa, Giardia lamblia
EALCPGCLRHRPHGCRGERA

SEQ ID NO: 3177028 - protein, 18 aa, Giardia lamblia
EALFKKKVLGVVSKELEH

SEQ ID NO: 3177029 - protein, 25 aa, Giardia lamblia
EALPTCLHCGKMFGAYEFLLAHHRR

SEQ ID NO: 3177030 - protein, 20 aa, Giardia lamblia
EALRNKILMRLGIVDSVEDY

SEQ ID NO: 3177031 - protein, 17 aa, Giardia lamblia
EALYCVQELFKGSMRSS

SEQ ID NO: 3177032 - protein, 21 aa, Giardia lamblia
EALYVPGRFNAVFSECMKILH

SEQ ID NO: 3177033 - protein, 24 aa, Giardia lamblia
EAPLEFPSDLLAIVFNKYKHTIES

SEQ ID NO: 3177034 - protein, 23 aa, Giardia lamblia
EAPVRPGYESSLLSYVKVSSDPT

SEQ ID NO: 3177035 - protein, 18 aa, Giardia lamblia
EARARIRFSNFVTANDIL

SEQ ID NO: 3177036 - protein, 21 aa, Giardia lamblia
EARFKRMLSHLLPCLSKYCPE

SEQ ID NO: 3177037 - protein, 23 aa, Giardia lamblia
EARSRIYALVYHYSKKVYLWAVH

SEQ ID NO: 3177038 - protein, 22 aa, Giardia lamblia
EASALYDRVFKDLAPTASSSTV

SEQ ID NO: 3177039 - protein, 21 aa, Giardia lamblia
EASDIFSCWYQPLNASEIDPS

SEQ ID NO: 3177040 - protein, 18 aa, Giardia lamblia
EASSYLCFRNSRTSMEIY

SEQ ID NO: 3177041 - protein, 19 aa, Giardia lamblia
EASYRICNSLALILESETP

SEQ ID NO: 3177042 - protein, 24 aa, Giardia lamblia
EATDSWVFRPRILVVANTNVAVDN

SEQ ID NO: 3177043 - protein, 19 aa, Giardia lamblia
EATSAWAWHLIEKRDILRD

SEQ ID NO: 3177044 - protein, 25 aa, Giardia lamblia
EAVKARIGLCLSNPIFDGIEENDEA

SEQ ID NO: 3177045 - protein, 19 aa, Giardia lamblia
EAVSNNWRRSMLSTSLSTP

SEQ ID NO: 3177046 - protein, 18 aa, Giardia lamblia
ECAARLVLRSGRCALCRQ

SEQ ID NO: 3177047 - protein, 20 aa, Giardia lamblia
ECCFLLAPYEALICTKDGVS

SEQ ID NO: 3177048 - protein, 17 aa, Giardia lamblia
ECIRLLLKKEARMQDRS

SEQ ID NO: 3177049 - protein, 20 aa, Giardia lamblia
ECKRAFRVSDYLYLQVTRYH

SEQ ID NO: 3177050 - protein, 23 aa, Giardia lamblia
ECLDLRTAKTFSVAIPTTSGTGS

SEQ ID NO: 3177051 - protein, 19 aa, Giardia lamblia
ECPICRSEITSYFQVNAPY

SEQ ID NO: 3177052 - protein, 18 aa, Giardia lamblia
ECVFKCFIDIIQDMHKMV

SEQ ID NO: 3177053 - protein, 18 aa, Giardia lamblia
ECYLRANLLAAMSNEQQR

SEQ ID NO: 3177054 - protein, 18 aa, Giardia lamblia
ECYLSLIAGRGWLCNEAE

SEQ ID NO: 3177055 - protein, 18 aa, Giardia lamblia
EDAWCPTCINELNMAKRK

SEQ ID NO: 3177056 - protein, 20 aa, Giardia lamblia
EDHLRFFGSLNFSYLDSYTD

SEQ ID NO: 3177057 - protein, 20 aa, Giardia lamblia
EDKLGALIRLRERVRRLRED

SEQ ID NO: 3177058 - protein, 21 aa, Giardia lamblia
EDLCKILLSYESAYTLADGTT

SEQ ID NO: 3177059 - protein, 18 aa, Giardia lamblia
EDLKVLAYLVKWLTDKGM

SEQ ID NO: 3177060 - protein, 19 aa, Giardia lamblia
EDLMIIKYLLSLEEENQRL

SEQ ID NO: 3177061 - protein, 20 aa, Giardia lamblia
EDSPVLCDVVARIATPPASV

SEQ ID NO: 3177062 - protein, 21 aa, Giardia lamblia
EEFTFELPLLLTFQKQFFNYG

SEQ ID NO: 3177063 - protein, 17 aa, Giardia lamblia
EEIDSFLIKAAAEKGDK

SEQ ID NO: 3177064 - protein, 18 aa, Giardia lamblia
EEIPRVLLRLVIGSLTSP

SEQ ID NO: 3177065 - protein, 17 aa, Giardia lamblia
EELKLKLEEEIHRRTKL

SEQ ID NO: 3177066 - protein, 23 aa, Giardia lamblia
EELLWRIFYCLLHAIQHLELNKI

SEQ ID NO: 3177067 - protein, 17 aa, Giardia lamblia
EELRIALAAAYEEQKRL

SEQ ID NO: 3177068 - protein, 17 aa, Giardia lamblia
EELRLMSQHAWNPQQFW

SEQ ID NO: 3177069 - protein, 23 aa, Giardia lamblia
EELSRLKIYLARAEEDIRAYKTT

SEQ ID NO: 3177070 - protein, 17 aa, Giardia lamblia
EEPSPWKPLGGRGGKTF

SEQ ID NO: 3177071 - protein, 21 aa, Giardia lamblia
EERLRKLLFDRKVDLSHMTYR

SEQ ID NO: 3177072 - protein, 20 aa, Giardia lamblia
EFAKTLSWERCMVIEKNSSL

SEQ ID NO: 3177073 - protein, 22 aa, Giardia lamblia
EFIKRVYTPFGIDFALSLSLRP

SEQ ID NO: 3177074 - protein, 26 aa, Giardia lamblia
EFNKPECVKLLLPHLFTDTYRGLRPL

SEQ ID NO: 3177075 - protein, 22 aa, Giardia lamblia
EFPEKFIPCILQRVKPEYINKT

SEQ ID NO: 3177076 - protein, 23 aa, Giardia lamblia
EGFRCGFIWGVRFYDPDPSCAVA

SEQ ID NO: 3177077 - protein, 20 aa, Giardia lamblia
EGGLYRCARLVMADNAESLE

SEQ ID NO: 3177078 - protein, 20 aa, Giardia lamblia
EGHALMCISHRISLLVTFHF

SEQ ID NO: 3177079 - protein, 17 aa, Giardia lamblia
EGKSGICGVRYNDNGKL

SEQ ID NO: 3177080 - protein, 17 aa, Giardia lamblia
EGLVSYFVVLADKRDAV

SEQ ID NO: 3177081 - protein, 18 aa, Giardia lamblia
EGMLRLSLQSNKRLLMHR

SEQ ID NO: 3177082 - protein, 17 aa, Giardia lamblia
EGMRMCMHLARRRNAQG

SEQ ID NO: 3177083 - protein, 17 aa, Giardia lamblia
EGRLLIHGGEYGKQHDQ

SEQ ID NO: 3177084 - protein, 17 aa, Giardia lamblia
EGRRPRRNSLYSSDMAD

SEQ ID NO: 3177085 - protein, 25 aa, Giardia lamblia
EGYMLKYRLAQMLLYDKSIPKPTVK

SEQ ID NO: 3177086 - protein, 19 aa, Giardia lamblia
EHIRPFSGKGFGSGKIVYD

SEQ ID NO: 3177087 - protein, 18 aa, Giardia lamblia
EHKICIASGIVYICSQMP

SEQ ID NO: 3177088 - protein, 17 aa, Giardia lamblia
EHVYKKKVELYADDSHM

SEQ ID NO: 3177089 - protein, 17 aa, Giardia lamblia
EICLKIYICTGKRHEPY

SEQ ID NO: 3177090 - protein, 19 aa, Giardia lamblia
EIEIRLGYYSKYRRLPPTL

SEQ ID NO: 3177091 - protein, 21 aa, Giardia lamblia
EIEKRLYLRPALAALLTLHAQ

SEQ ID NO: 3177092 - protein, 23 aa, Giardia lamblia
EIHPFYRYWFNIMYDKDHFKIAL

SEQ ID NO: 3177093 - protein, 21 aa, Giardia lamblia
EIIALRRRLSMGIPYEKVLSD

SEQ ID NO: 3177094 - protein, 21 aa, Giardia lamblia
EIIAVSCTWPGEKIKMAQSDV

SEQ ID NO: 3177095 - protein, 20 aa, Giardia lamblia
EILELYAYMWSYFSKGLTPN

SEQ ID NO: 3177096 - protein, 18 aa, Giardia lamblia
EILLRSSLFGKQAILNTI

SEQ ID NO: 3177097 - protein, 17 aa, Giardia lamblia
EILRLNQELELVVISNE

SEQ ID NO: 3177098 - protein, 22 aa, Giardia lamblia
EIMPRLGALYPYHQERLSQCSD

SEQ ID NO: 3177099 - protein, 20 aa, Giardia lamblia
EINCDELRSAASMLNARACK

SEQ ID NO: 3177100 - protein, 20 aa, Giardia lamblia
EINENCLFYTGFDRALRFLI

SEQ ID NO: 3177101 - protein, 24 aa, Giardia lamblia
EIRLHSRLALISGIQPEMDNIEAM

SEQ ID NO: 3177102 - protein, 18 aa, Giardia lamblia
EIRLLKWYKVLLAAEQAA

SEQ ID NO: 3177103 - protein, 17 aa, Giardia lamblia
EISRLKEEIAILEERIQ

SEQ ID NO: 3177104 - protein, 18 aa, Giardia lamblia
EISWLKEMLRMHEAEKER

SEQ ID NO: 3177105 - protein, 19 aa, Giardia lamblia
EIVLKLVLMQAGLQNIDGV

SEQ ID NO: 3177106 - protein, 27 aa, Giardia lamblia
EIVMQIRLSPLFAFDWWFKTRTEDEIA

SEQ ID NO: 3177107 - protein, 19 aa, Giardia lamblia
EIVQFYLLILITSQPKPKD

SEQ ID NO: 3177108 - protein, 19 aa, Giardia lamblia
EIWMKIGMGDAWNATDTAD

SEQ ID NO: 3177109 - protein, 20 aa, Giardia lamblia
EIYMDPAFCQSVYRETGLVC

SEQ ID NO: 3177110 - protein, 25 aa, Giardia lamblia
EKCRGCTALSFAACYGRLDCVKLLL

SEQ ID NO: 3177111 - protein, 20 aa, Giardia lamblia
EKDVLKWTFLMCAAAKGDVA

SEQ ID NO: 3177112 - protein, 19 aa, Giardia lamblia
EKELMGWGTWFGEGMSTYD

SEQ ID NO: 3177113 - protein, 23 aa, Giardia lamblia
EKERLRLMWSRKISMIRWDCESW

SEQ ID NO: 3177114 - protein, 20 aa, Giardia lamblia
EKEVKEFYTILVRWGSLQFK

SEQ ID NO: 3177115 - protein, 17 aa, Giardia lamblia
EKHIPPLLALLSEEHPF

SEQ ID NO: 3177116 - protein, 29 aa, Giardia lamblia
EKIPYHRFPMFVPWRINDTWYFVEKAVRL

SEQ ID NO: 3177117 - protein, 23 aa, Giardia lamblia
EKISELKARIILDQETIKRLNET

SEQ ID NO: 3177118 - protein, 17 aa, Giardia lamblia
EKLHPVVKLFGSIYGKK

SEQ ID NO: 3177119 - protein, 20 aa, Giardia lamblia
EKNPIYAGHLFKVCTRDRNY

SEQ ID NO: 3177120 - protein, 21 aa, Giardia lamblia
EKRLKCSRTPLSEKFSMCIDK

SEQ ID NO: 3177121 - protein, 17 aa, Giardia lamblia
EKRMRGHVGSYRYAEKD

SEQ ID NO: 3177122 - protein, 18 aa, Giardia lamblia
EKRRAALIVDRANYLEHV

SEQ ID NO: 3177123 - protein, 23 aa, Giardia lamblia
EKTAICFKTIYLLIPPRMVLGQA

SEQ ID NO: 3177124 - protein, 17 aa, Giardia lamblia
EKVAEGFARISAAIEKE

SEQ ID NO: 3177125 - protein, 17 aa, Giardia lamblia
EKVRLIYELYLKRKNSW

SEQ ID NO: 3177126 - protein, 27 aa, Giardia lamblia
EKVSKAGLCLYDWVTAMVKYYAVAKDV

SEQ ID NO: 3177127 - protein, 17 aa, Giardia lamblia
EKYCPRINIVFRSVGGH

SEQ ID NO: 3177128 - protein, 17 aa, Giardia lamblia
ELAYRKPKFIFTIGDGT

SEQ ID NO: 3177129 - protein, 18 aa, Giardia lamblia
ELCIRFKRENMLLWILEY

SEQ ID NO: 3177130 - protein, 19 aa, Giardia lamblia
ELCTFCIYCGLKFHPDAVF

SEQ ID NO: 3177131 - protein, 22 aa, Giardia lamblia
ELDAYIDCCLIITPAPLTFAVE

SEQ ID NO: 3177132 - protein, 20 aa, Giardia lamblia
ELDIHPAFELRTLLKGWRGL

SEQ ID NO: 3177133 - protein, 22 aa, Giardia lamblia
ELDLKIGVAFTRFQTAHLHAQF

SEQ ID NO: 3177134 - protein, 23 aa, Giardia lamblia
ELDMPMCVGCVFQTMKAKLEPLV

SEQ ID NO: 3177135 - protein, 23 aa, Giardia lamblia
ELEFFKEKFLLLQQLDAVWLELA

SEQ ID NO: 3177136 - protein, 18 aa, Giardia lamblia
ELEKRNRLLAARELEVSK

SEQ ID NO: 3177137 - protein, 23 aa, Giardia lamblia
ELEYYKRRCAALEHQVETLREAL

SEQ ID NO: 3177138 - protein, 20 aa, Giardia lamblia
ELFAIFTIILRKQFNHCVYA

SEQ ID NO: 3177139 - protein, 19 aa, Giardia lamblia
ELFNTLLLTDSFRAFIESR

SEQ ID NO: 3177140 - protein, 22 aa, Giardia lamblia
ELFSKACLRHDILHEDADGIWL

SEQ ID NO: 3177141 - protein, 18 aa, Giardia lamblia
ELIAEILALIGIANALNY

SEQ ID NO: 3177142 - protein, 19 aa, Giardia lamblia
ELIDPCPHHSRQILYELAK

SEQ ID NO: 3177143 - protein, 24 aa, Giardia lamblia
ELIPRLESLVVHWTRQIKELLSGV

SEQ ID NO: 3177144 - protein, 22 aa, Giardia lamblia
ELKVLTLRLADLEFKLTESELM

SEQ ID NO: 3177145 - protein, 22 aa, Giardia lamblia
ELLDMILCLALYIPYDGTYYEV

SEQ ID NO: 3177146 - protein, 20 aa, Giardia lamblia
ELLHPARLAFHLLKQALDGK

SEQ ID NO: 3177147 - protein, 19 aa, Giardia lamblia
ELLKCAFDLLAKHPSSPRL

SEQ ID NO: 3177148 - protein, 21 aa, Giardia lamblia
ELLRSRFIFFYVHNEVQIKQV

SEQ ID NO: 3177149 - protein, 22 aa, Giardia lamblia
ELLSKLRAMLKFGVREYAESII

SEQ ID NO: 3177150 - protein, 17 aa, Giardia lamblia
ELNTCRAYRTFQSTINS

SEQ ID NO: 3177151 - protein, 38 aa, Giardia lamblia
ELQEMKLRYSLLMKGMLKVCHRFSVSVDMFYSDPFESA

SEQ ID NO: 3177152 - protein, 25 aa, Giardia lamblia
ELQKMLVLRCFRPDRLINAIYTFVA

SEQ ID NO: 3177153 - protein, 17 aa, Giardia lamblia
ELQRLLCETHDSLESAR

SEQ ID NO: 3177154 - protein, 18 aa, Giardia lamblia
ELRHCIQGPFAIVRIGTC

SEQ ID NO: 3177155 - protein, 22 aa, Giardia lamblia
ELRIRYLRKRELILQERKRTTE

SEQ ID NO: 3177156 - protein, 18 aa, Giardia lamblia
ELRRLLAEEKLRMDKEIE

SEQ ID NO: 3177157 - protein, 22 aa, Giardia lamblia
ELSRALCCQIDFSVQRITKLEF

SEQ ID NO: 3177158 - protein, 21 aa, Giardia lamblia
ELSSPMPYVFVTHVPPEHGLL

SEQ ID NO: 3177159 - protein, 18 aa, Giardia lamblia
ELTFGGSFIKTAGFTDAP

SEQ ID NO: 3177160 - protein, 21 aa, Giardia lamblia
ELYSRMPVIHFLPDEQGKDVD

SEQ ID NO: 3177161 - protein, 20 aa, Giardia lamblia
EMDLRFSFELDGSGGIFLKR

SEQ ID NO: 3177162 - protein, 19 aa, Giardia lamblia
EMEYCPGGSLSDLIKSQRV

SEQ ID NO: 3177163 - protein, 22 aa, Giardia lamblia
EMKGSIRVIVRMRPMLQHEKEE

SEQ ID NO: 3177164 - protein, 20 aa, Giardia lamblia
EMNESWKLARSMRRKVMQNL

SEQ ID NO: 3177165 - protein, 18 aa, Giardia lamblia
EMPRNWLLAMHRVLETFA

SEQ ID NO: 3177166 - protein, 19 aa, Giardia lamblia
EMREWFCAVYGLSDLSLAK

SEQ ID NO: 3177167 - protein, 22 aa, Giardia lamblia
ENAICFKVKMTTALSKVFDAYC

SEQ ID NO: 3177168 - protein, 19 aa, Giardia lamblia
ENCKTCISVGVYDMGKPRW

SEQ ID NO: 3177169 - protein, 17 aa, Giardia lamblia
ENDGVGCAILFIDEIDC

SEQ ID NO: 3177170 - protein, 20 aa, Giardia lamblia
ENDVYWKTALEYAILGSKQR

SEQ ID NO: 3177171 - protein, 17 aa, Giardia lamblia
ENECHKMYLTLQGLTKL

SEQ ID NO: 3177172 - protein, 18 aa, Giardia lamblia
ENFNLPPLVEGHSVPVDK

SEQ ID NO: 3177173 - protein, 17 aa, Giardia lamblia
ENQRYNNIFAMAYVCSG

SEQ ID NO: 3177174 - protein, 23 aa, Giardia lamblia
ENQYQKIFLFKAIFDEIIDKACM

SEQ ID NO: 3177175 - protein, 17 aa, Giardia lamblia
ENRAGGCDWSYFMNNSD

SEQ ID NO: 3177176 - protein, 20 aa, Giardia lamblia
ENRRNGAFYFCHRYVEDGCT

SEQ ID NO: 3177177 - protein, 25 aa, Giardia lamblia
ENSCSFCGVSYLILHEVERLKRRIA

SEQ ID NO: 3177178 - protein, 25 aa, Giardia lamblia
ENYPMCFLCAYIVGSVEKLNELSSL

SEQ ID NO: 3177179 - protein, 23 aa, Giardia lamblia
ENYTWAIFCCQRLLGDAASNADT

SEQ ID NO: 3177180 - protein, 19 aa, Giardia lamblia
EPCRLCQLIYIGVRTRFQL

SEQ ID NO: 3177181 - protein, 24 aa, Giardia lamblia
EPELHSWPVFYEIVSLLIYPCCIH

SEQ ID NO: 3177182 - protein, 19 aa, Giardia lamblia
EPFAPKFYRFLTLAYALSD

SEQ ID NO: 3177183 - protein, 18 aa, Giardia lamblia
EPISDCLKWLKTARSTFD

SEQ ID NO: 3177184 - protein, 20 aa, Giardia lamblia
EPLDYLAMMRLWKGLYYLLW

SEQ ID NO: 3177185 - protein, 21 aa, Giardia lamblia
EPLIWRFAYNITLAILCLHSK

SEQ ID NO: 3177186 - protein, 18 aa, Giardia lamblia
EPLKFFLQHRMLLQDDLE

SEQ ID NO: 3177187 - protein, 17 aa, Giardia lamblia
EPLMAKWNMVGATEPVS

SEQ ID NO: 3177188 - protein, 22 aa, Giardia lamblia
EPLRRNSLKSGRVFNDVQHQSR

SEQ ID NO: 3177189 - protein, 18 aa, Giardia lamblia
EPNFRLINMPSLRNLRHF

SEQ ID NO: 3177190 - protein, 17 aa, Giardia lamblia
EPPRKGDIFKRVTRKPP

SEQ ID NO: 3177191 - protein, 17 aa, Giardia lamblia
EPPRPSPYVPLQEVYTH

SEQ ID NO: 3177192 - protein, 19 aa, Giardia lamblia
EPPRRPALIPSPGTIRKYN

SEQ ID NO: 3177193 - protein, 25 aa, Giardia lamblia
EPVFSFKGLLLFVASDMSRIVRFSG

SEQ ID NO: 3177194 - protein, 21 aa, Giardia lamblia
EQAVKFILQMRVTTLKDLETA

SEQ ID NO: 3177195 - protein, 24 aa, Giardia lamblia
EQAYCLMAQFMARYLIPKEEAKEL

SEQ ID NO: 3177196 - protein, 21 aa, Giardia lamblia
EQCVRMLLPLEWHIMHSNGLT

SEQ ID NO: 3177197 - protein, 19 aa, Giardia lamblia
EQFLRFELEREKRKSQQLQ

SEQ ID NO: 3177198 - protein, 24 aa, Giardia lamblia
EQILRCAMPYNIFNAMFSVKRFIY

SEQ ID NO: 3177199 - protein, 22 aa, Giardia lamblia
EQIMRHVVRFGAEQLTKMDHNA

SEQ ID NO: 3177200 - protein, 22 aa, Giardia lamblia
EQLECTRLLAPCEAKIQDNFGC

SEQ ID NO: 3177201 - protein, 17 aa, Giardia lamblia
EQSHASASSSSDDYTSG

SEQ ID NO: 3177202 - protein, 18 aa, Giardia lamblia
EQVMRRFVAMPGVLSGLY

SEQ ID NO: 3177203 - protein, 22 aa, Giardia lamblia
EQYPRVLFLHGFDFDTTINAPF

SEQ ID NO: 3177204 - protein, 25 aa, Giardia lamblia
EQYQSCAIESWFLSSFLDKFHIRSS

SEQ ID NO: 3177205 - protein, 22 aa, Giardia lamblia
ERAIKGLVLFLGHKISRLRDTA

SEQ ID NO: 3177206 - protein, 23 aa, Giardia lamblia
ERAKELQERLGLLSIPQQNTRHP

SEQ ID NO: 3177207 - protein, 23 aa, Giardia lamblia
ERARKRITAFVLTKERFDEFREE

SEQ ID NO: 3177208 - protein, 17 aa, Giardia lamblia
ERARRAAGIIYQLICDG

SEQ ID NO: 3177209 - protein, 19 aa, Giardia lamblia
ERERCLAEALADLKKLKAD

SEQ ID NO: 3177210 - protein, 18 aa, Giardia lamblia
ERGKVCTERGWTALMYAA

SEQ ID NO: 3177211 - protein, 20 aa, Giardia lamblia
ERINKAWLLKTLLYQAKQVN

SEQ ID NO: 3177212 - protein, 18 aa, Giardia lamblia
ERINPVPTLSYGERLPAA

SEQ ID NO: 3177213 - protein, 17 aa, Giardia lamblia
ERIQIHMAPRLSLPESL

SEQ ID NO: 3177214 - protein, 20 aa, Giardia lamblia
ERKISWIVIRSFGRINESEA

SEQ ID NO: 3177215 - protein, 22 aa, Giardia lamblia
ERKTEFCLLTPMATYDHIMSSL

SEQ ID NO: 3177216 - protein, 19 aa, Giardia lamblia
ERLGAAMLRRCANEIGGEF

SEQ ID NO: 3177217 - protein, 18 aa, Giardia lamblia
ERLPCLLTIAGIPEALAF

SEQ ID NO: 3177218 - protein, 17 aa, Giardia lamblia
ERLRKLVQMLLSINPLD

SEQ ID NO: 3177219 - protein, 21 aa, Giardia lamblia
ERPVKPLLWLGQWFLSNNRKK

SEQ ID NO: 3177220 - protein, 20 aa, Giardia lamblia
ERSPRPSLPVYALEEPYSQR

SEQ ID NO: 3177221 - protein, 18 aa, Giardia lamblia
ERTIEAFDPLLPVPVKEA

SEQ ID NO: 3177222 - protein, 17 aa, Giardia lamblia
ERVKELIVLGGVRSIII

SEQ ID NO: 3177223 - protein, 25 aa, Giardia lamblia
ERVMCAQCGVYLGKIQKRPCMVCAS

SEQ ID NO: 3177224 - protein, 17 aa, Giardia lamblia
ERWLRKQMRAVEKLIEK

SEQ ID NO: 3177225 - protein, 22 aa, Giardia lamblia
ESARSALWLEIEQFLRLEFNIS

SEQ ID NO: 3177226 - protein, 24 aa, Giardia lamblia
ESEWHLKHIFAWFSRKSIAVYVDP

SEQ ID NO: 3177227 - protein, 20 aa, Giardia lamblia
ESGRICAHMRIPLSTLTDSS

SEQ ID NO: 3177228 - protein, 20 aa, Giardia lamblia
ESGSAFAIHAIHEMQKPTEQ

SEQ ID NO: 3177229 - protein, 22 aa, Giardia lamblia
ESLKPFSKRCRRLAKTLQSTTQ

SEQ ID NO: 3177230 - protein, 20 aa, Giardia lamblia
ESLKSLNFYSIFKKATLDEL

SEQ ID NO: 3177231 - protein, 18 aa, Giardia lamblia
ESLLPRFVDSILKEEFTT

SEQ ID NO: 3177232 - protein, 18 aa, Giardia lamblia
ESLSEVFINFGRGKKKLG

SEQ ID NO: 3177233 - protein, 19 aa, Giardia lamblia
ESLSLCLRCAGRAQVHDDA

SEQ ID NO: 3177234 - protein, 20 aa, Giardia lamblia
ESQARLGLELKQRIEERFRA

SEQ ID NO: 3177235 - protein, 23 aa, Giardia lamblia
ESSIKWYMWQLLHAVRIAHASGT

SEQ ID NO: 3177236 - protein, 17 aa, Giardia lamblia
ESTFLLDLFESVIQDEA

SEQ ID NO: 3177237 - protein, 18 aa, Giardia lamblia
ESTLFRVILRQCLSSKSC

SEQ ID NO: 3177238 - protein, 24 aa, Giardia lamblia
ESVLGIPGFLVWSAVPIMISHYSN

SEQ ID NO: 3177239 - protein, 25 aa, Giardia lamblia
ESVRLCPSYHKAWFRLGNIRESAGN

SEQ ID NO: 3177240 - protein, 24 aa, Giardia lamblia
ESVWRCAICLILAVAYLHSSHAKD

SEQ ID NO: 3177241 - protein, 24 aa, Giardia lamblia
ESWYRDVFRICPTRRDASTGEEKP

SEQ ID NO: 3177242 - protein, 17 aa, Giardia lamblia
ESYIRGKILELFQINDY

SEQ ID NO: 3177243 - protein, 18 aa, Giardia lamblia
ETALMIAVDLSFMDAVRV

SEQ ID NO: 3177244 - protein, 21 aa, Giardia lamblia
ETCNNCKALAAKLAMQTELLA

SEQ ID NO: 3177245 - protein, 18 aa, Giardia lamblia
ETFIPVYLPNLFSTGLLR

SEQ ID NO: 3177246 - protein, 18 aa, Giardia lamblia
ETFRASLTRVLRRTANVQ

SEQ ID NO: 3177247 - protein, 20 aa, Giardia lamblia
ETHIQGFPGWHYSPRMTTMN

SEQ ID NO: 3177248 - protein, 25 aa, Giardia lamblia
ETHLKRMVTFAVMWSFGAVLDLEER

SEQ ID NO: 3177249 - protein, 22 aa, Giardia lamblia
ETLEEFKEAFNLFDRNGDGNIT

SEQ ID NO: 3177250 - protein, 23 aa, Giardia lamblia
ETLPSCKFVHKWLESSSAKDMLP

SEQ ID NO: 3177251 - protein, 20 aa, Giardia lamblia
ETNIPFLLGYYYVGKILNDY

SEQ ID NO: 3177252 - protein, 17 aa, Giardia lamblia
ETVFPCIMTILDCFHHK

SEQ ID NO: 3177253 - protein, 19 aa, Giardia lamblia
EVCAAPRALVCCRQPPCLE

SEQ ID NO: 3177254 - protein, 24 aa, Giardia lamblia
EVDGCGRTALMYAAEYGHLECVKS

SEQ ID NO: 3177255 - protein, 21 aa, Giardia lamblia
EVDSLKRLLARKEADLEEVHT

SEQ ID NO: 3177256 - protein, 17 aa, Giardia lamblia
EVGKAGVTDLMFYAQTG

SEQ ID NO: 3177257 - protein, 22 aa, Giardia lamblia
EVLLDMFQCWIVPAINAEGIRV

SEQ ID NO: 3177258 - protein, 18 aa, Giardia lamblia
EVLPALIKTVSRATTDRH

SEQ ID NO: 3177259 - protein, 19 aa, Giardia lamblia
EVLPPCLPSFFELGTSPLE

SEQ ID NO: 3177260 - protein, 19 aa, Giardia lamblia
EVNNKLFLVHKVTLSNIGR

SEQ ID NO: 3177261 - protein, 21 aa, Giardia lamblia
EVPNDVSLCLAVRTLFDFPNL

SEQ ID NO: 3177262 - protein, 17 aa, Giardia lamblia
EVQELKEAISLLTTTNE

SEQ ID NO: 3177263 - protein, 18 aa, Giardia lamblia
EVTQLKYEIRACVEQITA

SEQ ID NO: 3177264 - protein, 19 aa, Giardia lamblia
EVVRILKLKSLRIAMRCGY

SEQ ID NO: 3177265 - protein, 21 aa, Giardia lamblia
EVVYLRGLRNLSVLWLCENPI

SEQ ID NO: 3177266 - protein, 17 aa, Giardia lamblia
EVYACMEIDYSIISTEE

SEQ ID NO: 3177267 - protein, 20 aa, Giardia lamblia
EWMRMFKMFLSINEKAERTA

SEQ ID NO: 3177268 - protein, 20 aa, Giardia lamblia
EWQTIWGVINDVFFKFYNIC

SEQ ID NO: 3177269 - protein, 18 aa, Giardia lamblia
EWQWKYRIHISLEELHNS

SEQ ID NO: 3177270 - protein, 20 aa, Giardia lamblia
EWYMLRRFVKFYIKPLQHLI

SEQ ID NO: 3177271 - protein, 19 aa, Giardia lamblia
EYARFSAEITLVFLSGEKV

SEQ ID NO: 3177272 - protein, 18 aa, Giardia lamblia
EYEVWLSYIQIFNEIGYD

SEQ ID NO: 3177273 - protein, 17 aa, Giardia lamblia
EYGRLLFRLAYRMEEQG

SEQ ID NO: 3177274 - protein, 25 aa, Giardia lamblia
EYLFFSLICEISWSDSSLIAGVKTP

SEQ ID NO: 3177275 - protein, 17 aa, Giardia lamblia
EYLRLLPSRALKCYLMQ

SEQ ID NO: 3177276 - protein, 20 aa, Giardia lamblia
EYMDLVIIILRTGGLAMDNY

SEQ ID NO: 3177277 - protein, 24 aa, Giardia lamblia
EYRIPQESLIKMAFYLREKGDEVT

SEQ ID NO: 3177278 - protein, 21 aa, Giardia lamblia
FAAEFTCLLWSTSDSIIAGFE

SEQ ID NO: 3177279 - protein, 18 aa, Giardia lamblia
FADDEWKERGQGEVLIAE

SEQ ID NO: 3177280 - protein, 20 aa, Giardia lamblia
FADEVFKEFLAQNSSTIQDS

SEQ ID NO: 3177281 - protein, 18 aa, Giardia lamblia
FADGVLLAEVIHHFLPKL

SEQ ID NO: 3177282 - protein, 17 aa, Giardia lamblia
FAERILQVFPRIFIDEL

SEQ ID NO: 3177283 - protein, 21 aa, Giardia lamblia
FAFVFDWLEGNGFTKTQLVLE

SEQ ID NO: 3177284 - protein, 17 aa, Giardia lamblia
FAHACLKNQFSQNEVSE

SEQ ID NO: 3177285 - protein, 21 aa, Giardia lamblia
FAKACIINFTIIKEGLTDQLL

SEQ ID NO: 3177286 - protein, 17 aa, Giardia lamblia
FAKAYYAYSRLKVKFLQ

SEQ ID NO: 3177287 - protein, 19 aa, Giardia lamblia
FAKTLSWERCMVIEKNSSL

SEQ ID NO: 3177288 - protein, 18 aa, Giardia lamblia
FAPACSILYESESTFYQS

SEQ ID NO: 3177289 - protein, 21 aa, Giardia lamblia
FAPAIYGHWIVKRGIVLQLLQ

SEQ ID NO: 3177290 - protein, 18 aa, Giardia lamblia
FARPTALMIASRSGSAAA

SEQ ID NO: 3177291 - protein, 19 aa, Giardia lamblia
FASALKFPPIEVMMPLVGG

SEQ ID NO: 3177292 - protein, 17 aa, Giardia lamblia
FATNFKEVLGIKTVKPV

SEQ ID NO: 3177293 - protein, 22 aa, Giardia lamblia
FATWCPPCRGMIPHLAKIPTKY

SEQ ID NO: 3177294 - protein, 18 aa, Giardia lamblia
FAVAELWSQWIDPKTHNG

SEQ ID NO: 3177295 - protein, 18 aa, Giardia lamblia
FCDFPGIGIPLVSEEAFI

SEQ ID NO: 3177296 - protein, 22 aa, Giardia lamblia
FCDHWFCDGHRIFLYAALAAFP

SEQ ID NO: 3177297 - protein, 22 aa, Giardia lamblia
FCISENYVGFLFYKSLRDAMIR

SEQ ID NO: 3177298 - protein, 20 aa, Giardia lamblia
FCIVPSKMRLALLISTLAFE

SEQ ID NO: 3177299 - protein, 21 aa, Giardia lamblia
FCIYCGLKFHPDAVFCGNCGS

SEQ ID NO: 3177300 - protein, 19 aa, Giardia lamblia
FCLHRYKTLPFLLLDEVDK

SEQ ID NO: 3177301 - protein, 18 aa, Giardia lamblia
FCLQRKCRRRVLLDYFNS

SEQ ID NO: 3177302 - protein, 19 aa, Giardia lamblia
FCQCLCLFTKLFLDSKTLF

SEQ ID NO: 3177303 - protein, 22 aa, Giardia lamblia
FCSNCGNSLHSRCIQLFHQHAR

SEQ ID NO: 3177304 - protein, 17 aa, Giardia lamblia
FCYPAMYLNADRFSTGA

SEQ ID NO: 3177305 - protein, 19 aa, Giardia lamblia
FDAFREFEGLLSIKGLFLL

SEQ ID NO: 3177306 - protein, 20 aa, Giardia lamblia
FDDALCLLFMFSRLSSEHAP

SEQ ID NO: 3177307 - protein, 19 aa, Giardia lamblia
FDFCPRKVVLRGLVDIPPA

SEQ ID NO: 3177308 - protein, 17 aa, Giardia lamblia
FDRCLSRLLCLSSQSLW

SEQ ID NO: 3177309 - protein, 17 aa, Giardia lamblia
FDRVIILEFSRYNSDLK

SEQ ID NO: 3177310 - protein, 17 aa, Giardia lamblia
FDWRGRRQPYSKLLTTQ

SEQ ID NO: 3177311 - protein, 17 aa, Giardia lamblia
FDYPRSYSSVFGQGTDF

SEQ ID NO: 3177312 - protein, 17 aa, Giardia lamblia
FEAECFWVEKGGLQPLE

SEQ ID NO: 3177313 - protein, 21 aa, Giardia lamblia
FEAEPFKSCGVELFEGQAKLM

SEQ ID NO: 3177314 - protein, 19 aa, Giardia lamblia
FECELKAAISRQISEKDAT

SEQ ID NO: 3177315 - protein, 20 aa, Giardia lamblia
FEGLLSIKGLFLLLKCQRVQ

SEQ ID NO: 3177316 - protein, 19 aa, Giardia lamblia
FELCMRRPYVTGWTRQQVL

SEQ ID NO: 3177317 - protein, 18 aa, Giardia lamblia
FENVCLWDKALSGYNRQI

SEQ ID NO: 3177318 - protein, 22 aa, Giardia lamblia
FEPICLCNAYLLQKLERMAPPP

SEQ ID NO: 3177319 - protein, 18 aa, Giardia lamblia
FESCGIIRFLGGAQRLSR

SEQ ID NO: 3177320 - protein, 17 aa, Giardia lamblia
FEYELFLRRLARKLHDT

SEQ ID NO: 3177321 - protein, 18 aa, Giardia lamblia
FFAVEILLALGYLHNLGI

SEQ ID NO: 3177322 - protein, 18 aa, Giardia lamblia
FFEDLLIKYFAKNVTIQQ

SEQ ID NO: 3177323 - protein, 18 aa, Giardia lamblia
FFFCLNGPVDAVWIENLN

SEQ ID NO: 3177324 - protein, 21 aa, Giardia lamblia
FFGKHKFCLATLPYTRVELGL

SEQ ID NO: 3177325 - protein, 17 aa, Giardia lamblia
FFIPLRYLSTIFNSGRY

SEQ ID NO: 3177326 - protein, 22 aa, Giardia lamblia
FFISCADWSCKIWADDIRTPIL

SEQ ID NO: 3177327 - protein, 17 aa, Giardia lamblia
FFLQHRMLLQDDLEAAR

SEQ ID NO: 3177328 - protein, 18 aa, Giardia lamblia
FFRTYRSVLDMATVSLIK

SEQ ID NO: 3177329 - protein, 27 aa, Giardia lamblia
FFSKLCLWCVRLLDCLISQIFKPDGFS

SEQ ID NO: 3177330 - protein, 17 aa, Giardia lamblia
FFTGLAMSGAWSCFDEF

SEQ ID NO: 3177331 - protein, 26 aa, Giardia lamblia
FGAERYPSILFCKFCGNEIGTLSETD

SEQ ID NO: 3177332 - protein, 17 aa, Giardia lamblia
FGDGILYSDGRYEYYVG

SEQ ID NO: 3177333 - protein, 17 aa, Giardia lamblia
FGEGCAYLPSKDTVVPE

SEQ ID NO: 3177334 - protein, 18 aa, Giardia lamblia
FGERAGCLLEILIRRVHN

SEQ ID NO: 3177335 - protein, 19 aa, Giardia lamblia
FGFDECVEILAPVEAGEQT

SEQ ID NO: 3177336 - protein, 20 aa, Giardia lamblia
FGFGKPMFKPAFNDPAAKEE

SEQ ID NO: 3177337 - protein, 31 aa, Giardia lamblia
FGGCPHGGMGLGLERFICWLLGIYTVRDTVL

SEQ ID NO: 3177338 - protein, 25 aa, Giardia lamblia
FGHIDCVRMLIPKEIRLRDRRGRSA

SEQ ID NO: 3177339 - protein, 19 aa, Giardia lamblia
FGLPCWTERLSFFTTYSPE

SEQ ID NO: 3177340 - protein, 21 aa, Giardia lamblia
FGLRLPEEWKVIVAAYKRRFG

SEQ ID NO: 3177341 - protein, 19 aa, Giardia lamblia
FGNLCLRFLAKFAPCDCNK

SEQ ID NO: 3177342 - protein, 20 aa, Giardia lamblia
FGSAYPFPLGVVYYSTESLC

SEQ ID NO: 3177343 - protein, 17 aa, Giardia lamblia
FGSSIKGLGRFMEKQEL

SEQ ID NO: 3177344 - protein, 20 aa, Giardia lamblia
FGVEPFCRFHFARGATNRRL

SEQ ID NO: 3177345 - protein, 18 aa, Giardia lamblia
FGVSSIRGIVGGTIYVLM

SEQ ID NO: 3177346 - protein, 17 aa, Giardia lamblia
FHLPQRLPIAIAKNICL

SEQ ID NO: 3177347 - protein, 18 aa, Giardia lamblia
FHLVGLLWGVRWGFFSGE

SEQ ID NO: 3177348 - protein, 18 aa, Giardia lamblia
FHPESWNPTWGIRNIIIG

SEQ ID NO: 3177349 - protein, 17 aa, Giardia lamblia
FHVKLCVLDYHKQTATP

SEQ ID NO: 3177350 - protein, 18 aa, Giardia lamblia
FIDWEMNVFLPIQQRIMN

SEQ ID NO: 3177351 - protein, 17 aa, Giardia lamblia
FIEREITTAVARKLIEV

SEQ ID NO: 3177352 - protein, 24 aa, Giardia lamblia
FIIFKKRGAALCAMEYYNSLKNQA

SEQ ID NO: 3177353 - protein, 17 aa, Giardia lamblia
FIKYLRRMHLSKKLIHK

SEQ ID NO: 3177354 - protein, 17 aa, Giardia lamblia
FIMYHLVKGVAYLHESK

SEQ ID NO: 3177355 - protein, 18 aa, Giardia lamblia
FINFSSISYHEFFGYYSF

SEQ ID NO: 3177356 - protein, 21 aa, Giardia lamblia
FINGFNCTIFAYGQTGSGKSY

SEQ ID NO: 3177357 - protein, 22 aa, Giardia lamblia
FIQGYNCTAFAYGQTGAGKSYT

SEQ ID NO: 3177358 - protein, 17 aa, Giardia lamblia
FIRKARSNFSHGVVDNL

SEQ ID NO: 3177359 - protein, 19 aa, Giardia lamblia
FITQCLKPAISERITARKA

SEQ ID NO: 3177360 - protein, 21 aa, Giardia lamblia
FIYELLLRFIFAANQHPQHSE

SEQ ID NO: 3177361 - protein, 20 aa, Giardia lamblia
FKACGVGLWNRGGNKGGLAA

SEQ ID NO: 3177362 - protein, 21 aa, Giardia lamblia
FKADVWAMGALLLCLCLGRPL

SEQ ID NO: 3177363 - protein, 21 aa, Giardia lamblia
FKALNRLSPYFSIKDCRYSIG

SEQ ID NO: 3177364 - protein, 19 aa, Giardia lamblia
FKANVAFISRLRLTVDKLS

SEQ ID NO: 3177365 - protein, 18 aa, Giardia lamblia
FKCADWPGEWVIFQGNLS

SEQ ID NO: 3177366 - protein, 25 aa, Giardia lamblia
FKGHIADVISCSWSKSNFLATGSLD

SEQ ID NO: 3177367 - protein, 20 aa, Giardia lamblia
FKGYSAILYAIKWGYVEVVK

SEQ ID NO: 3177368 - protein, 17 aa, Giardia lamblia
FKLCQYIFCMPDTDEAT

SEQ ID NO: 3177369 - protein, 19 aa, Giardia lamblia
FKLPPVIPADYMVDPQIQT

SEQ ID NO: 3177370 - protein, 23 aa, Giardia lamblia
FKLTFYLKAGLIWEFQRLFRRIR

SEQ ID NO: 3177371 - protein, 17 aa, Giardia lamblia
FKPGMLRGGDVTFSCPL

SEQ ID NO: 3177372 - protein, 20 aa, Giardia lamblia
FKPLRAVLELEYTRWTTTDK

SEQ ID NO: 3177373 - protein, 17 aa, Giardia lamblia
FKRECDALYTSLQRKAR

SEQ ID NO: 3177374 - protein, 21 aa, Giardia lamblia
FKRFCGLIVQLLYKLTIRAED

SEQ ID NO: 3177375 - protein, 19 aa, Giardia lamblia
FKRIFAKSVGKLKVRESIL

SEQ ID NO: 3177376 - protein, 24 aa, Giardia lamblia
FKRIKCGVALGISREALLGASLTK

SEQ ID NO: 3177377 - protein, 25 aa, Giardia lamblia
FKSECFRIDSSVAFSQDWLSLRQQL

SEQ ID NO: 3177378 - protein, 20 aa, Giardia lamblia
FKSIQCLLCSGNEPRCTSES

SEQ ID NO: 3177379 - protein, 18 aa, Giardia lamblia
FKTTRAMANVRVTVSTTS

SEQ ID NO: 3177380 - protein, 19 aa, Giardia lamblia
FKVLPTLCRYLAKKHLKAK

SEQ ID NO: 3177381 - protein, 23 aa, Giardia lamblia
FLADCKYPGFSFTDIFMPAFKRY

SEQ ID NO: 3177382 - protein, 17 aa, Giardia lamblia
FLAVEPCNFLMIGHEDG

SEQ ID NO: 3177383 - protein, 18 aa, Giardia lamblia
FLDRFYKAMGAFLKEKEL

SEQ ID NO: 3177384 - protein, 19 aa, Giardia lamblia
FLDRWILPLLVKLISEYEE

SEQ ID NO: 3177385 - protein, 19 aa, Giardia lamblia
FLDSVCKGVILGCSPTLNT

SEQ ID NO: 3177386 - protein, 18 aa, Giardia lamblia
FLEHVPLPIFIRYLGANH

SEQ ID NO: 3177387 - protein, 19 aa, Giardia lamblia
FLEIRLVKRINLSQRFAFL

SEQ ID NO: 3177388 - protein, 19 aa, Giardia lamblia
FLHSSCLDRGLSLTTQGFT

SEQ ID NO: 3177389 - protein, 17 aa, Giardia lamblia
FLHTCKLPNHGFRFQSA

SEQ ID NO: 3177390 - protein, 19 aa, Giardia lamblia
FLKNLGVSVLTRFPPEPNG

SEQ ID NO: 3177391 - protein, 20 aa, Giardia lamblia
FLKNPYCIMIKHVVDSQEIP

SEQ ID NO: 3177392 - protein, 17 aa, Giardia lamblia
FLLCIFKGPKILICSAT

SEQ ID NO: 3177393 - protein, 21 aa, Giardia lamblia
FLPDGRTPLMLAVEAGSIDCV

SEQ ID NO: 3177394 - protein, 20 aa, Giardia lamblia
FLPHELWQLFYRNARSNFHV

SEQ ID NO: 3177395 - protein, 17 aa, Giardia lamblia
FLQYIMHLHSTYKLAAD

SEQ ID NO: 3177396 - protein, 17 aa, Giardia lamblia
FLRICGLADNEARPSDD

SEQ ID NO: 3177397 - protein, 20 aa, Giardia lamblia
FLRKIFEAIGDIELEELGEQ

SEQ ID NO: 3177398 - protein, 20 aa, Giardia lamblia
FLRMHRMVIDLAIYQIRIGD

SEQ ID NO: 3177399 - protein, 23 aa, Giardia lamblia
FLRNKWKTLCKLINGAGATITEQ

SEQ ID NO: 3177400 - protein, 19 aa, Giardia lamblia
FLSLCPFSGTAMISVLSNQ

SEQ ID NO: 3177401 - protein, 17 aa, Giardia lamblia
FLSVISFNPAVISNHQR

SEQ ID NO: 3177402 - protein, 25 aa, Giardia lamblia
FLTDDLFYRFEFIWNEFSHINRDVS

SEQ ID NO: 3177403 - protein, 23 aa, Giardia lamblia
FLTRSICFNTLYLIIIHENVIIH

SEQ ID NO: 3177404 - protein, 18 aa, Giardia lamblia
FLVFLGLPCLDQALHPCM

SEQ ID NO: 3177405 - protein, 18 aa, Giardia lamblia
FLVHMKLFARPYRSMAYR

SEQ ID NO: 3177406 - protein, 17 aa, Giardia lamblia
FLWNCSRVMDFLTTAHP

SEQ ID NO: 3177407 - protein, 18 aa, Giardia lamblia
FMKGLKVLLEYEARKRCK

SEQ ID NO: 3177408 - protein, 20 aa, Giardia lamblia
FMLPCGFFKHRISTVHELKT

SEQ ID NO: 3177409 - protein, 17 aa, Giardia lamblia
FMRCCIEKSISLKVPFR

SEQ ID NO: 3177410 - protein, 18 aa, Giardia lamblia
FMSPELPELLALYPEATK

SEQ ID NO: 3177411 - protein, 17 aa, Giardia lamblia
FNERVAVLFACKQAVVE

SEQ ID NO: 3177412 - protein, 19 aa, Giardia lamblia
FNFPSWCGLALSLSSMLAS

SEQ ID NO: 3177413 - protein, 24 aa, Giardia lamblia
FNKVKRTSCELVFPLMLAQNCATF

SEQ ID NO: 3177414 - protein, 22 aa, Giardia lamblia
FNNKCCTCWSCPNYFYKCKNLA

SEQ ID NO: 3177415 - protein, 21 aa, Giardia lamblia
FNTCLTFRPPPMTVLSSVSLA

SEQ ID NO: 3177416 - protein, 17 aa, Giardia lamblia
FNWKTGRLVRSYEGHTG

SEQ ID NO: 3177417 - protein, 17 aa, Giardia lamblia
FNWKVLLIETIDKFIGW

SEQ ID NO: 3177418 - protein, 19 aa, Giardia lamblia
FPCGSRWIGGFLGCEMHGE

SEQ ID NO: 3177419 - protein, 17 aa, Giardia lamblia
FPDRRIDMLPAILTEDI

SEQ ID NO: 3177420 - protein, 17 aa, Giardia lamblia
FPFKIMPQRVFSAYTQT

SEQ ID NO: 3177421 - protein, 23 aa, Giardia lamblia
FPGLVSSCVIDWFSAWNDDALRS

SEQ ID NO: 3177422 - protein, 28 aa, Giardia lamblia
FPIPDMYLRHCWRSVAVPIELQPISMLY

SEQ ID NO: 3177423 - protein, 18 aa, Giardia lamblia
FPLFPGPIVFTSNCLKPP

SEQ ID NO: 3177424 - protein, 17 aa, Giardia lamblia
FPLGSFYVVVRVRPFNS

SEQ ID NO: 3177425 - protein, 17 aa, Giardia lamblia
FPLQSARMLVRIYSSQG

SEQ ID NO: 3177426 - protein, 17 aa, Giardia lamblia
FPLRKAIAYERLHRRAL

SEQ ID NO: 3177427 - protein, 17 aa, Giardia lamblia
FPPIEVMMPLVGGYYTG

SEQ ID NO: 3177428 - protein, 25 aa, Giardia lamblia
FPSMTELFLRNGYMVDILLILQLFP

SEQ ID NO: 3177429 - protein, 17 aa, Giardia lamblia
FPTLFGVIRDRIRKHFL

SEQ ID NO: 3177430 - protein, 18 aa, Giardia lamblia
FPTLPILRIHPTCKKSKI

SEQ ID NO: 3177431 - protein, 19 aa, Giardia lamblia
FPTLRFLLEMQDYILDRQP

SEQ ID NO: 3177432 - protein, 17 aa, Giardia lamblia
FQANIAFITRLRAAILN

SEQ ID NO: 3177433 - protein, 19 aa, Giardia lamblia
FQARLPLSVSNVFSEERVT

SEQ ID NO: 3177434 - protein, 19 aa, Giardia lamblia
FQEFVDYLSVNGLYPLRSR

SEQ ID NO: 3177435 - protein, 24 aa, Giardia lamblia
FQEGLRIVADFVARILRFQPLTTL

SEQ ID NO: 3177436 - protein, 18 aa, Giardia lamblia
FQPIIKWLHQGIRLKGPK

SEQ ID NO: 3177437 - protein, 24 aa, Giardia lamblia
FQQINARHGFTFDLQFSALEIYNE

SEQ ID NO: 3177438 - protein, 22 aa, Giardia lamblia
FQRISFCILELLRIPQATRLID

SEQ ID NO: 3177439 - protein, 17 aa, Giardia lamblia
FQWFKWFFDQNYKGSKS

SEQ ID NO: 3177440 - protein, 22 aa, Giardia lamblia
FQWGAGCTALMIACYYGHSDCV

SEQ ID NO: 3177441 - protein, 17 aa, Giardia lamblia
FRFENRIKKILKLTEDA

SEQ ID NO: 3177442 - protein, 17 aa, Giardia lamblia
FRGEALSSISYVSRMIV

SEQ ID NO: 3177443 - protein, 21 aa, Giardia lamblia
FRIVSFKSLRQVAQIPGREPP

SEQ ID NO: 3177444 - protein, 19 aa, Giardia lamblia
FRKLLKWREKVIAHICEIT

SEQ ID NO: 3177445 - protein, 19 aa, Giardia lamblia
FRKSCIFAGNRGCDPSTYI

SEQ ID NO: 3177446 - protein, 21 aa, Giardia lamblia
FRLINMPSLRNLRHFIVHKAN

SEQ ID NO: 3177447 - protein, 20 aa, Giardia lamblia
FRLKNFAFIYAMESASLHLS

SEQ ID NO: 3177448 - protein, 17 aa, Giardia lamblia
FRLPRCIDKILALENAN

SEQ ID NO: 3177449 - protein, 20 aa, Giardia lamblia
FRMLEPRSGFSTVPPGPYPV

SEQ ID NO: 3177450 - protein, 17 aa, Giardia lamblia
FRQLALLEMLQLVNKEL

SEQ ID NO: 3177451 - protein, 24 aa, Giardia lamblia
FRRFFWRWHHIFSLACEQRSLEKG

SEQ ID NO: 3177452 - protein, 17 aa, Giardia lamblia
FRRGYALLRKTEKPLDR

SEQ ID NO: 3177453 - protein, 19 aa, Giardia lamblia
FRRIRYCMLNAFASTATDD

SEQ ID NO: 3177454 - protein, 20 aa, Giardia lamblia
FRRRLRMFPSLVGSCTLDLF

SEQ ID NO: 3177455 - protein, 17 aa, Giardia lamblia
FRRVCIIKGIYPQVPPK

SEQ ID NO: 3177456 - protein, 17 aa, Giardia lamblia
FRSACKAVEDMSVRLRV

SEQ ID NO: 3177457 - protein, 24 aa, Giardia lamblia
FRSFNYRNAFIFKDEHTLQLKLPY

SEQ ID NO: 3177458 - protein, 23 aa, Giardia lamblia
FRSKGRFCALSWRSPVTGAALCR

SEQ ID NO: 3177459 - protein, 19 aa, Giardia lamblia
FRSVLKFSVEQVADVFALY

SEQ ID NO: 3177460 - protein, 20 aa, Giardia lamblia
FRVPLFFAQRHRLGLPTDRF

SEQ ID NO: 3177461 - protein, 21 aa, Giardia lamblia
FRYGALPAREIVPILSQCTEE

SEQ ID NO: 3177462 - protein, 18 aa, Giardia lamblia
FRYHHVFDPLSFEVVPFH

SEQ ID NO: 3177463 - protein, 19 aa, Giardia lamblia
FRYRSCFRVIGVELLITVA

SEQ ID NO: 3177464 - protein, 18 aa, Giardia lamblia
FSAHKSYITAMAFTQSGM

SEQ ID NO: 3177465 - protein, 21 aa, Giardia lamblia
FSAIKKSFCGSGRDGRSRSRS

SEQ ID NO: 3177466 - protein, 17 aa, Giardia lamblia
FSARNSLVINSPVRLSG

SEQ ID NO: 3177467 - protein, 17 aa, Giardia lamblia
FSASDLYSFPALRDYYA

SEQ ID NO: 3177468 - protein, 19 aa, Giardia lamblia
FSCCLPGGINFEFSSDSGA

SEQ ID NO: 3177469 - protein, 18 aa, Giardia lamblia
FSCIIKFKINYGVSMQHV

SEQ ID NO: 3177470 - protein, 20 aa, Giardia lamblia
FSFFRGWKSQCLFDSLNSFV

SEQ ID NO: 3177471 - protein, 18 aa, Giardia lamblia
FSGMYFVSIRVCLQQYRN

SEQ ID NO: 3177472 - protein, 20 aa, Giardia lamblia
FSKEHLFMFAKDYQTQTGTD

SEQ ID NO: 3177473 - protein, 17 aa, Giardia lamblia
FSLILKEDYYHMLATAY

SEQ ID NO: 3177474 - protein, 17 aa, Giardia lamblia
FSLTRGFEKLRSMLPNA

SEQ ID NO: 3177475 - protein, 17 aa, Giardia lamblia
FSNPGYRPNIMYLLITR

SEQ ID NO: 3177476 - protein, 17 aa, Giardia lamblia
FSPLRLVLFSADESGAI

SEQ ID NO: 3177477 - protein, 17 aa, Giardia lamblia
FSPSRARIRHLSLECNR

SEQ ID NO: 3177478 - protein, 20 aa, Giardia lamblia
FSREHSRYLPAVREIVSSYM

SEQ ID NO: 3177479 - protein, 17 aa, Giardia lamblia
FSSEAWSAAASRSITYS

SEQ ID NO: 3177480 - protein, 21 aa, Giardia lamblia
FSSPRWYGAYIKRASRFSNPT

SEQ ID NO: 3177481 - protein, 19 aa, Giardia lamblia
FSTEVFWDCSAQLILAVDV

SEQ ID NO: 3177482 - protein, 18 aa, Giardia lamblia
FSTMSLRNALGIHVEGGG

SEQ ID NO: 3177483 - protein, 23 aa, Giardia lamblia
FSTVCPRLKIILCSDNDAKRLLA

SEQ ID NO: 3177484 - protein, 18 aa, Giardia lamblia
FSVCKAVAFAAADNTLLM

SEQ ID NO: 3177485 - protein, 17 aa, Giardia lamblia
FSVFYIRVYGGAGAWIF

SEQ ID NO: 3177486 - protein, 19 aa, Giardia lamblia
FSYKCLHLIFSFVGDGAHE

SEQ ID NO: 3177487 - protein, 25 aa, Giardia lamblia
FTAHLIGTCRLCLKDIIFKDVHVQG

SEQ ID NO: 3177488 - protein, 23 aa, Giardia lamblia
FTALMCAARLGFVQAVELLVKKE

SEQ ID NO: 3177489 - protein, 17 aa, Giardia lamblia
FTALMFAARFGFDECVE

SEQ ID NO: 3177490 - protein, 17 aa, Giardia lamblia
FTARLSGIAQYNAIYSS

SEQ ID NO: 3177491 - protein, 17 aa, Giardia lamblia
FTDRVPVSIALSKDYVA

SEQ ID NO: 3177492 - protein, 21 aa, Giardia lamblia
FTGLPEEWQKLGLIPESMIST

SEQ ID NO: 3177493 - protein, 22 aa, Giardia lamblia
FTIICVTDLFYAEPIRRNQIRS

SEQ ID NO: 3177494 - protein, 24 aa, Giardia lamblia
FTILAILYCKYMWIVRKTDPQRLQ

SEQ ID NO: 3177495 - protein, 25 aa, Giardia lamblia
FTLPDTRTALMLAIKHRRYRLVPLM

SEQ ID NO: 3177496 - protein, 18 aa, Giardia lamblia
FTNPLILNCRVISGHVFR

SEQ ID NO: 3177497 - protein, 22 aa, Giardia lamblia
FTPEDWQSCIFVVGHYPEVIDM

SEQ ID NO: 3177498 - protein, 24 aa, Giardia lamblia
FTPFLSSILIEFSKVSPLHIAPVA

SEQ ID NO: 3177499 - protein, 18 aa, Giardia lamblia
FTPLMVCALYNCVDVAII

SEQ ID NO: 3177500 - protein, 19 aa, Giardia lamblia
FTRDFCKTFKPPVRSHLEY

SEQ ID NO: 3177501 - protein, 18 aa, Giardia lamblia
FTSLATRCGVLWLNRSLT

SEQ ID NO: 3177502 - protein, 17 aa, Giardia lamblia
FTTLGFFSRAVIVGNEV

SEQ ID NO: 3177503 - protein, 18 aa, Giardia lamblia
FTVLKFFGQRTFQEVQNI

SEQ ID NO: 3177504 - protein, 19 aa, Giardia lamblia
FVAAWSWALPAIYFENKRF

SEQ ID NO: 3177505 - protein, 17 aa, Giardia lamblia
FVAMPGVLSGLYEECIE

SEQ ID NO: 3177506 - protein, 18 aa, Giardia lamblia
FVASCTWPEGCVHGTPST

SEQ ID NO: 3177507 - protein, 23 aa, Giardia lamblia
FVEPLGVAALCFTEVATGETFKL

SEQ ID NO: 3177508 - protein, 23 aa, Giardia lamblia
FVEVWKACGMLGVSKPVVFSTGQ

SEQ ID NO: 3177509 - protein, 20 aa, Giardia lamblia
FVGVCIPEFLSLYETERLVQ

SEQ ID NO: 3177510 - protein, 22 aa, Giardia lamblia
FVHKRLAAVELFTLCYKDKVLR

SEQ ID NO: 3177511 - protein, 17 aa, Giardia lamblia
FVKNLPDGLTWREVQDE

SEQ ID NO: 3177512 - protein, 18 aa, Giardia lamblia
FVLIAKIYFIRSCKSNVS

SEQ ID NO: 3177513 - protein, 17 aa, Giardia lamblia
FVLKYPACRGFKPILLD

SEQ ID NO: 3177514 - protein, 17 aa, Giardia lamblia
FVQHTGIQCKKCKQETV

SEQ ID NO: 3177515 - protein, 18 aa, Giardia lamblia
FVRPNCYSNYFATLTSSL

SEQ ID NO: 3177516 - protein, 17 aa, Giardia lamblia
FVSDLFICYEMDTPEKY

SEQ ID NO: 3177517 - protein, 20 aa, Giardia lamblia
FVSLFRFFLHTCKLPNHGFR

SEQ ID NO: 3177518 - protein, 19 aa, Giardia lamblia
FVVGNVIKRFFIRTISDFQ

SEQ ID NO: 3177519 - protein, 19 aa, Giardia lamblia
FVWKVRLGFDGAFDSFEDY

SEQ ID NO: 3177520 - protein, 18 aa, Giardia lamblia
FWLCRFCGAYNSKLNLFL

SEQ ID NO: 3177521 - protein, 19 aa, Giardia lamblia
FYAAFLILELWCYYITSRD

SEQ ID NO: 3177522 - protein, 20 aa, Giardia lamblia
FYICPKLAEVWAMSFVPGRY

SEQ ID NO: 3177523 - protein, 18 aa, Giardia lamblia
FYNICAMTLPGIPEHSFN

SEQ ID NO: 3177524 - protein, 18 aa, Giardia lamblia
FYPALKMILYFEEKLGHA

SEQ ID NO: 3177525 - protein, 18 aa, Giardia lamblia
FYPYLLAFLISHDTKKAL

SEQ ID NO: 3177526 - protein, 19 aa, Giardia lamblia
FYQKRLGILRGILDSLSTV

SEQ ID NO: 3177527 - protein, 22 aa, Giardia lamblia
FYQLKTLQTWIAFRKYKRYCRN

SEQ ID NO: 3177528 - protein, 22 aa, Giardia lamblia
FYRFCPEIFPGPQFKPTVVHLF

SEQ ID NO: 3177529 - protein, 19 aa, Giardia lamblia
FYSDGLLINGHEPFYPFNS

SEQ ID NO: 3177530 - protein, 19 aa, Giardia lamblia
FYTERKCEQCVINAETIQK

SEQ ID NO: 3177531 - protein, 20 aa, Giardia lamblia
FYVFRVLKVILAYSRFNSSL

SEQ ID NO: 3177532 - protein, 23 aa, Giardia lamblia
FYVNEIRPMYSLQVDNSPCGRLL

SEQ ID NO: 3177533 - protein, 22 aa, Giardia lamblia
GAARPSSLLSFDIVQIHEAQIG

SEQ ID NO: 3177534 - protein, 17 aa, Giardia lamblia
GACCFCEGGGPGSGSLE

SEQ ID NO: 3177535 - protein, 17 aa, Giardia lamblia
GAECYRRSLIFALGKVW

SEQ ID NO: 3177536 - protein, 22 aa, Giardia lamblia
GAINCARLLLKREGGMRQNDNG

SEQ ID NO: 3177537 - protein, 23 aa, Giardia lamblia
GALHLGHLLPFIFTKYLQDAFKC

SEQ ID NO: 3177538 - protein, 18 aa, Giardia lamblia
GALIKHLRKTPVLDTYFA

SEQ ID NO: 3177539 - protein, 17 aa, Giardia lamblia
GALPSMFVAGLVEGFLT

SEQ ID NO: 3177540 - protein, 17 aa, Giardia lamblia
GALSIGCTVMFAGTDHA

SEQ ID NO: 3177541 - protein, 24 aa, Giardia lamblia
GAPAPMLPPCLPFPPTADSRPTGH

SEQ ID NO: 3177542 - protein, 22 aa, Giardia lamblia
GARGRYSVRYVRVLKDSELASL

SEQ ID NO: 3177543 - protein, 19 aa, Giardia lamblia
GASALAIAVARGHHHIVKF

SEQ ID NO: 3177544 - protein, 18 aa, Giardia lamblia
GASARLSLFDAWLANSLP

SEQ ID NO: 3177545 - protein, 22 aa, Giardia lamblia
GASGFCKDCFFINLLTMESVYA

SEQ ID NO: 3177546 - protein, 23 aa, Giardia lamblia
GASRSALMLSVWHRFYDLALRLT

SEQ ID NO: 3177547 - protein, 18 aa, Giardia lamblia
GATALLIAATRGHAGCVS

SEQ ID NO: 3177548 - protein, 17 aa, Giardia lamblia
GATGFWCGSIKGLTNDI

SEQ ID NO: 3177549 - protein, 20 aa, Giardia lamblia
GATLYEFFTLTPLTYLSQLE

SEQ ID NO: 3177550 - protein, 17 aa, Giardia lamblia
GAVKGIASFMNSKKSLW

SEQ ID NO: 3177551 - protein, 20 aa, Giardia lamblia
GAVVSCLWAYPELSKLTHIL

SEQ ID NO: 3177552 - protein, 17 aa, Giardia lamblia
GAWRRSELMLAKARSML

SEQ ID NO: 3177553 - protein, 21 aa, Giardia lamblia
GCASCKCALRDSPICPKCQET

SEQ ID NO: 3177554 - protein, 19 aa, Giardia lamblia
GCDALGCTALEYAVLSKSS

SEQ ID NO: 3177555 - protein, 17 aa, Giardia lamblia
GCGETAYITHVTRLFGS

SEQ ID NO: 3177556 - protein, 19 aa, Giardia lamblia
GCGKTFIGACLAWLFSKVY

SEQ ID NO: 3177557 - protein, 19 aa, Giardia lamblia
GCIVYELLTGISLSRDEQL

SEQ ID NO: 3177558 - protein, 20 aa, Giardia lamblia
GCKMIKGWTAMMCCVCRASS

SEQ ID NO: 3177559 - protein, 19 aa, Giardia lamblia
GCQFSFYDFHVLTETTVSW

SEQ ID NO: 3177560 - protein, 18 aa, Giardia lamblia
GCTICVWCAIWMICKQYR

SEQ ID NO: 3177561 - protein, 27 aa, Giardia lamblia
GCVLDCKRIPMTSAWLYTPSLLIKPDP

SEQ ID NO: 3177562 - protein, 25 aa, Giardia lamblia
GCVMFEITALFPLFPGKDELDQITR

SEQ ID NO: 3177563 - protein, 21 aa, Giardia lamblia
GCVPPEMPAPIAGAGINGLGE

SEQ ID NO: 3177564 - protein, 18 aa, Giardia lamblia
GDCPRVAGMLAVSRAIGD

SEQ ID NO: 3177565 - protein, 17 aa, Giardia lamblia
GDEIYLKSSRPLDCEKL

SEQ ID NO: 3177566 - protein, 17 aa, Giardia lamblia
GDMKLAWSLIPLQAGLQ

SEQ ID NO: 3177567 - protein, 17 aa, Giardia lamblia
GDRCAKCQLPFCVSCSP

SEQ ID NO: 3177568 - protein, 19 aa, Giardia lamblia
GDTISTCWQPSLKSNISSV

SEQ ID NO: 3177569 - protein, 17 aa, Giardia lamblia
GDWLLKSEEVIGRLEGE

SEQ ID NO: 3177570 - protein, 22 aa, Giardia lamblia
GECKNMFAPKLLRLALQHLTGQ

SEQ ID NO: 3177571 - protein, 20 aa, Giardia lamblia
GECSLPWAVVMLFYSCVETS

SEQ ID NO: 3177572 - protein, 23 aa, Giardia lamblia
GEDARSGLLRGIKTIADVVATTL

SEQ ID NO: 3177573 - protein, 19 aa, Giardia lamblia
GEGYCACMIAAKKNNLESL

SEQ ID NO: 3177574 - protein, 26 aa, Giardia lamblia
GEHGIRPGRRFIHCQLKPSNIFLSQA

SEQ ID NO: 3177575 - protein, 25 aa, Giardia lamblia
GEILRLPSNMKFIFEVTNLMLVPEI

SEQ ID NO: 3177576 - protein, 21 aa, Giardia lamblia
GELLKVWFYRPYQAGKQDHHG

SEQ ID NO: 3177577 - protein, 17 aa, Giardia lamblia
GELQSFFSILRIHKAGI

SEQ ID NO: 3177578 - protein, 17 aa, Giardia lamblia
GEPWTGLSFAVASGNAK

SEQ ID NO: 3177579 - protein, 23 aa, Giardia lamblia
GERPIVLILCELFNINPRSIASP

SEQ ID NO: 3177580 - protein, 19 aa, Giardia lamblia
GETALMFAAINGYTELVRM

SEQ ID NO: 3177581 - protein, 17 aa, Giardia lamblia
GETALMLAIRHQNVDAI

SEQ ID NO: 3177582 - protein, 20 aa, Giardia lamblia
GETALMWAVRLNQVEMIHLL

SEQ ID NO: 3177583 - protein, 21 aa, Giardia lamblia
GETFIYFKTTRAMANVRVTVS

SEQ ID NO: 3177584 - protein, 19 aa, Giardia lamblia
GEVRRLKELFARGTDASGN

SEQ ID NO: 3177585 - protein, 18 aa, Giardia lamblia
GEVVIGIVRPVCIDFFKP

SEQ ID NO: 3177586 - protein, 21 aa, Giardia lamblia
GEYILKICNIYNVYTEYKASF

SEQ ID NO: 3177587 - protein, 20 aa, Giardia lamblia
GFCSFKIKTDRTIFCTNKYN

SEQ ID NO: 3177588 - protein, 17 aa, Giardia lamblia
GFGPLNWNSLSVDDYLE

SEQ ID NO: 3177589 - protein, 17 aa, Giardia lamblia
GFHPTIYASGFFGAFRL

SEQ ID NO: 3177590 - protein, 17 aa, Giardia lamblia
GFRCEYCGVVVSRTFCN

SEQ ID NO: 3177591 - protein, 17 aa, Giardia lamblia
GFTNRWLASHIDSESTF

SEQ ID NO: 3177592 - protein, 18 aa, Giardia lamblia
GGCASCYALASGNLELFS

SEQ ID NO: 3177593 - protein, 24 aa, Giardia lamblia
GGFPGGMPPGGFPGGFPGGMPGGA

SEQ ID NO: 3177594 - protein, 17 aa, Giardia lamblia
GGGRPSSGITTWRDDLS

SEQ ID NO: 3177595 - protein, 19 aa, Giardia lamblia
GGLLQWCSLLGFSSYEFKH

SEQ ID NO: 3177596 - protein, 19 aa, Giardia lamblia
GGLPLSKFSASIIYQLAKL

SEQ ID NO: 3177597 - protein, 18 aa, Giardia lamblia
GGLSRLRFKITLNGDNDQ

SEQ ID NO: 3177598 - protein, 24 aa, Giardia lamblia
GGMTLRLPILLVLRSILLPCNFNA

SEQ ID NO: 3177599 - protein, 20 aa, Giardia lamblia
GGPGGWGCLLFNATEMHVFA

SEQ ID NO: 3177600 - protein, 21 aa, Giardia lamblia
GGQCPHCRTVYDPKVYRRLTP

SEQ ID NO: 3177601 - protein, 17 aa, Giardia lamblia
GGSRVYFNFGLGGLVAQ

SEQ ID NO: 3177602 - protein, 18 aa, Giardia lamblia
GGVDFLIQDSVGWTALHY

SEQ ID NO: 3177603 - protein, 18 aa, Giardia lamblia
GGVGVRFNPTTTIAPASG

SEQ ID NO: 3177604 - protein, 17 aa, Giardia lamblia
GHCHGLCLTCFCFPLNS

SEQ ID NO: 3177605 - protein, 23 aa, Giardia lamblia
GHDPRYAEFLLYFSTDEAIEAYY

SEQ ID NO: 3177606 - protein, 23 aa, Giardia lamblia
GHELVVSILLEFEAGYQNVEGMT

SEQ ID NO: 3177607 - protein, 20 aa, Giardia lamblia
GHFYCYNCALDSLKMSWPCL

SEQ ID NO: 3177608 - protein, 19 aa, Giardia lamblia
GHHECVRLLLLESDISGCT

SEQ ID NO: 3177609 - protein, 20 aa, Giardia lamblia
GHIECVKLLLAEMGLQDKLG

SEQ ID NO: 3177610 - protein, 23 aa, Giardia lamblia
GHIECVRILAPYEACLTDSEDKT

SEQ ID NO: 3177611 - protein, 23 aa, Giardia lamblia
GHIGCVQLLIGFEVRLVNKQYET

SEQ ID NO: 3177612 - protein, 20 aa, Giardia lamblia
GHKFVICNGLVIPKDLLEDK

SEQ ID NO: 3177613 - protein, 24 aa, Giardia lamblia
GHLDCVKLLLSREIKMVTKISSTA

SEQ ID NO: 3177614 - protein, 18 aa, Giardia lamblia
GHLDCVRLLMKDGAGSTT

SEQ ID NO: 3177615 - protein, 18 aa, Giardia lamblia
GHLDCVRLLSPHEKDIHD

SEQ ID NO: 3177616 - protein, 22 aa, Giardia lamblia
GHLECIRLLLSEEGGMQDNKGR

SEQ ID NO: 3177617 - protein, 22 aa, Giardia lamblia
GHLECVHLLLIEAGVKTITRET

SEQ ID NO: 3177618 - protein, 22 aa, Giardia lamblia
GHLECVKILLPYEYHMRDKSGL

SEQ ID NO: 3177619 - protein, 22 aa, Giardia lamblia
GHLECVKLLFEYEKGMRRTTDN

SEQ ID NO: 3177620 - protein, 21 aa, Giardia lamblia
GHLECVKLLLEKEGGMQNEDG

SEQ ID NO: 3177621 - protein, 22 aa, Giardia lamblia
GHLECVKLLLSEIGIQKHTSVT

SEQ ID NO: 3177622 - protein, 22 aa, Giardia lamblia
GHLECVKLLYLREYPVLIRNNF

SEQ ID NO: 3177623 - protein, 18 aa, Giardia lamblia
GHLQLVELLACFKNGVEL

SEQ ID NO: 3177624 - protein, 20 aa, Giardia lamblia
GHPDCIKLFLEKEGGMADYY

SEQ ID NO: 3177625 - protein, 19 aa, Giardia lamblia
GHPDVLLSCYICKEHSELC

SEQ ID NO: 3177626 - protein, 22 aa, Giardia lamblia
GHPECIKLLLEKEGGMKKNDFF

SEQ ID NO: 3177627 - protein, 21 aa, Giardia lamblia
GHPECIKLLLEKEGGMQTSGG

SEQ ID NO: 3177628 - protein, 20 aa, Giardia lamblia
GHSALSIAVLARRMDKVERL

SEQ ID NO: 3177629 - protein, 22 aa, Giardia lamblia
GHSVLPRFLWRYSKNDSSVEYE

SEQ ID NO: 3177630 - protein, 22 aa, Giardia lamblia
GHYECVRLLLIEAGYVDLENKT

SEQ ID NO: 3177631 - protein, 19 aa, Giardia lamblia
GHYEICKLLAPKEIGKTRR

SEQ ID NO: 3177632 - protein, 17 aa, Giardia lamblia
GIARLLLPYEGFAYEED

SEQ ID NO: 3177633 - protein, 17 aa, Giardia lamblia
GICAGFVRFKLARPPTK

SEQ ID NO: 3177634 - protein, 19 aa, Giardia lamblia
GIEPSRGALLWGPPGTGKS

SEQ ID NO: 3177635 - protein, 18 aa, Giardia lamblia
GIFYYKFIRDSSISTKKQ

SEQ ID NO: 3177636 - protein, 18 aa, Giardia lamblia
GILARLLIKEDWSYFVID

SEQ ID NO: 3177637 - protein, 23 aa, Giardia lamblia
GILPPECILWRIIAQTLSVYHYL

SEQ ID NO: 3177638 - protein, 17 aa, Giardia lamblia
GIRTVHFLLFGLKELDA

SEQ ID NO: 3177639 - protein, 25 aa, Giardia lamblia
GISAPALDLERRWTFRPLVKLGDLL

SEQ ID NO: 3177640 - protein, 18 aa, Giardia lamblia
GITFRSSTKIAWEKMLIH

SEQ ID NO: 3177641 - protein, 21 aa, Giardia lamblia
GIYMKNVWPAAAIMHMNAGNT

SEQ ID NO: 3177642 - protein, 20 aa, Giardia lamblia
GKALKLLLPHEAKMQSKDGH

SEQ ID NO: 3177643 - protein, 24 aa, Giardia lamblia
GKARAMDALSIFFGMERDFDGLSV

SEQ ID NO: 3177644 - protein, 21 aa, Giardia lamblia
GKAYVRGGCDNTFLWTPLKRQ

SEQ ID NO: 3177645 - protein, 19 aa, Giardia lamblia
GKCACKWNTEEIAFFINTQ

SEQ ID NO: 3177646 - protein, 17 aa, Giardia lamblia
GKCALILAVNAREEQCV

SEQ ID NO: 3177647 - protein, 18 aa, Giardia lamblia
GKELYDFIPKTYILPQSA

SEQ ID NO: 3177648 - protein, 21 aa, Giardia lamblia
GKFFIGLVMCGAWSCFDEFNR

SEQ ID NO: 3177649 - protein, 17 aa, Giardia lamblia
GKFHWDECLAVWFIKQL

SEQ ID NO: 3177650 - protein, 17 aa, Giardia lamblia
GKFRVSMEYRYSTVHTL

SEQ ID NO: 3177651 - protein, 25 aa, Giardia lamblia
GKFVRWRMTGCFSVVDLKTIQITDL

SEQ ID NO: 3177652 - protein, 24 aa, Giardia lamblia
GKGRAGTVAICILLAMAYMQDSAR

SEQ ID NO: 3177653 - protein, 24 aa, Giardia lamblia
GKHPCPFEFSAPFLRSYSTPTSFV

SEQ ID NO: 3177654 - protein, 22 aa, Giardia lamblia
GKIYCKQCSLIINKHIIPSKVL

SEQ ID NO: 3177655 - protein, 19 aa, Giardia lamblia
GKKKACYHFLVMMYFIGAI

SEQ ID NO: 3177656 - protein, 17 aa, Giardia lamblia
GKKRAWRCLRRHEKALR

SEQ ID NO: 3177657 - protein, 17 aa, Giardia lamblia
GKLEVCKVLLPAIGARD

SEQ ID NO: 3177658 - protein, 22 aa, Giardia lamblia
GKLPNLFGAIIFFYHGQLFVAG

SEQ ID NO: 3177659 - protein, 19 aa, Giardia lamblia
GKLSLAGFEAFFRTGLPAS

SEQ ID NO: 3177660 - protein, 17 aa, Giardia lamblia
GKPIFGKICRPHGNSGM

SEQ ID NO: 3177661 - protein, 18 aa, Giardia lamblia
GKQTDRWTFKQLKCTYVR

SEQ ID NO: 3177662 - protein, 17 aa, Giardia lamblia
GKRKFTCIQQVYEVLLE

SEQ ID NO: 3177663 - protein, 23 aa, Giardia lamblia
GKRLCIGCPIITTNKVEYIDSLN

SEQ ID NO: 3177664 - protein, 18 aa, Giardia lamblia
GKSALLLRLCDKIFNASY

SEQ ID NO: 3177665 - protein, 18 aa, Giardia lamblia
GKSLLGVACACRLGHSCI

SEQ ID NO: 3177666 - protein, 22 aa, Giardia lamblia
GKTVCALLCMLRAFSSDLLLPS

SEQ ID NO: 3177667 - protein, 19 aa, Giardia lamblia
GKVVLEFQLPYGVSATDIN

SEQ ID NO: 3177668 - protein, 20 aa, Giardia lamblia
GLCVYRFKRSDFIPPFPKAY

SEQ ID NO: 3177669 - protein, 18 aa, Giardia lamblia
GLERLRVMAPDVARVAEL

SEQ ID NO: 3177670 - protein, 23 aa, Giardia lamblia
GLHRVCPDRCFLWQVSSTRKSSG

SEQ ID NO: 3177671 - protein, 17 aa, Giardia lamblia
GLIKFFYVYTGRGNESP

SEQ ID NO: 3177672 - protein, 17 aa, Giardia lamblia
GLLPFEFLAHARAGRDG

SEQ ID NO: 3177673 - protein, 21 aa, Giardia lamblia
GLLWGVRWGFFSGELIIRGYD

SEQ ID NO: 3177674 - protein, 26 aa, Giardia lamblia
GLMKAVRLRYPVLIKLLAPYEAGMTN

SEQ ID NO: 3177675 - protein, 17 aa, Giardia lamblia
GLMYSFPTPMAFCPGTN

SEQ ID NO: 3177676 - protein, 18 aa, Giardia lamblia
GLQNPWMAIGFSRPISQA

SEQ ID NO: 3177677 - protein, 18 aa, Giardia lamblia
GLRLNKEFNDLGVQEHAS

SEQ ID NO: 3177678 - protein, 20 aa, Giardia lamblia
GLRRRLLALFLQFAETPEFN

SEQ ID NO: 3177679 - protein, 27 aa, Giardia lamblia
GLSFKAFCFSRLLSLDAHRSSSLSTGM

SEQ ID NO: 3177680 - protein, 23 aa, Giardia lamblia
GLSKLRFCLFISSPIFFVKPMDT

SEQ ID NO: 3177681 - protein, 17 aa, Giardia lamblia
GLVKVFGCESSRGGVKV

SEQ ID NO: 3177682 - protein, 24 aa, Giardia lamblia
GLVKYWISTCCGYDFSFSGLFTQA

SEQ ID NO: 3177683 - protein, 20 aa, Giardia lamblia
GMEPRASYSHAQRIPACVDE

SEQ ID NO: 3177684 - protein, 18 aa, Giardia lamblia
GMGPRPGFSMGKPAGGAG

SEQ ID NO: 3177685 - protein, 18 aa, Giardia lamblia
GMLFNWQEVQALLTALTS

SEQ ID NO: 3177686 - protein, 17 aa, Giardia lamblia
GMVLRLSLYPSMKDSGI

SEQ ID NO: 3177687 - protein, 18 aa, Giardia lamblia
GNAIMRCCIDQAREVTPL

SEQ ID NO: 3177688 - protein, 19 aa, Giardia lamblia
GNARTGCWYAPDPDQSVLF

SEQ ID NO: 3177689 - protein, 19 aa, Giardia lamblia
GNCLCKFLEKHGKDNMLSS

SEQ ID NO: 3177690 - protein, 18 aa, Giardia lamblia
GNEVLKELLKYEGDCCLD

SEQ ID NO: 3177691 - protein, 19 aa, Giardia lamblia
GNGVISFVEFVRLMVTKSR

SEQ ID NO: 3177692 - protein, 21 aa, Giardia lamblia
GNGYGRLFWPGYIDLSKEHGT

SEQ ID NO: 3177693 - protein, 18 aa, Giardia lamblia
GNIECVRLLAPLEQRMRR

SEQ ID NO: 3177694 - protein, 28 aa, Giardia lamblia
GNIKSSTCPKCFKPRLTLVTKHNQDKDD

SEQ ID NO: 3177695 - protein, 20 aa, Giardia lamblia
GNLDCVKFLMSRESHEDMGP

SEQ ID NO: 3177696 - protein, 19 aa, Giardia lamblia
GNLEICKLLAPKEANMQYK

SEQ ID NO: 3177697 - protein, 20 aa, Giardia lamblia
GNLRQAVAYAVRFQSTVTPE

SEQ ID NO: 3177698 - protein, 19 aa, Giardia lamblia
GNMKACMNGGVIVGTMDGA

SEQ ID NO: 3177699 - protein, 17 aa, Giardia lamblia
GNPALDLSLSFSLIDAH

SEQ ID NO: 3177700 - protein, 21 aa, Giardia lamblia
GNPRECFELLSPIGSGSYGAV

SEQ ID NO: 3177701 - protein, 17 aa, Giardia lamblia
GNTIGMYACSYACSVSN

SEQ ID NO: 3177702 - protein, 19 aa, Giardia lamblia
GNVDCVRALLSREAGMQRY

SEQ ID NO: 3177703 - protein, 18 aa, Giardia lamblia
GNVWCLRSQAGLTDKDGT

SEQ ID NO: 3177704 - protein, 17 aa, Giardia lamblia
GNVWLQWSQKSIWTPCA

SEQ ID NO: 3177705 - protein, 18 aa, Giardia lamblia
GNVWLYKVCKNEASKQKP

SEQ ID NO: 3177706 - protein, 17 aa, Giardia lamblia
GPCLVFLVKFMEEIIGF

SEQ ID NO: 3177707 - protein, 24 aa, Giardia lamblia
GPDIKELLNRLSICRPTTSEANGA

SEQ ID NO: 3177708 - protein, 17 aa, Giardia lamblia
GPDWYRCFESFMRENIH

SEQ ID NO: 3177709 - protein, 17 aa, Giardia lamblia
GPFPSVTMWKWYKQGSL

SEQ ID NO: 3177710 - protein, 22 aa, Giardia lamblia
GPFRFLIEFRHKLDLPETYESR

SEQ ID NO: 3177711 - protein, 19 aa, Giardia lamblia
GPLPTGWTRLMVCTIANKV

SEQ ID NO: 3177712 - protein, 23 aa, Giardia lamblia
GPNWKELRLLHAHLSFNNYFKSE

SEQ ID NO: 3177713 - protein, 21 aa, Giardia lamblia
GPQIPRYVMRVSHCAFLSIVD

SEQ ID NO: 3177714 - protein, 18 aa, Giardia lamblia
GPQTFGWDCIFEPLEGGG

SEQ ID NO: 3177715 - protein, 22 aa, Giardia lamblia
GPRGSLKIDISFEVDENGLIHV

SEQ ID NO: 3177716 - protein, 23 aa, Giardia lamblia
GPRICLVMGPAYYKQMLTQREMV

SEQ ID NO: 3177717 - protein, 18 aa, Giardia lamblia
GPTRIAPRLALKIEQKSG

SEQ ID NO: 3177718 - protein, 24 aa, Giardia lamblia
GPWCLRATLELRLLQIVLHGVHTF

SEQ ID NO: 3177719 - protein, 19 aa, Giardia lamblia
GPWSFIFFPLAHRIECHGL

SEQ ID NO: 3177720 - protein, 23 aa, Giardia lamblia
GQAFPQCVFSHYALIPSSPLQTG

SEQ ID NO: 3177721 - protein, 22 aa, Giardia lamblia
GQARSGFSLAVFAYSQNRRRHS

SEQ ID NO: 3177722 - protein, 24 aa, Giardia lamblia
GQFVCFTARLALLFQVATRFCEIR

SEQ ID NO: 3177723 - protein, 17 aa, Giardia lamblia
GQGACSVIYTLDALPGE

SEQ ID NO: 3177724 - protein, 18 aa, Giardia lamblia
GQGISLRLPRLLRARPDK

SEQ ID NO: 3177725 - protein, 23 aa, Giardia lamblia
GQKAGVTALCFDRSSDGVIAACS

SEQ ID NO: 3177726 - protein, 22 aa, Giardia lamblia
GQKLRRVCWDRFPGADYSEVSD

SEQ ID NO: 3177727 - protein, 17 aa, Giardia lamblia
GQLKLTFYGLRTDSQSD

SEQ ID NO: 3177728 - protein, 21 aa, Giardia lamblia
GQRVPGIVFMRGGSVGVLPVL

SEQ ID NO: 3177729 - protein, 17 aa, Giardia lamblia
GQSCFKLGQIEEALEFL

SEQ ID NO: 3177730 - protein, 26 aa, Giardia lamblia
GQVSLVASMIWWVFDAESAFKDLEAG

SEQ ID NO: 3177731 - protein, 20 aa, Giardia lamblia
GRCLSSLIFEQDFCYIVSGC

SEQ ID NO: 3177732 - protein, 19 aa, Giardia lamblia
GRECLPKILGGIMGTPVRL

SEQ ID NO: 3177733 - protein, 27 aa, Giardia lamblia
GREIRCCLHCGFPILPGFLSSRRGMTS

SEQ ID NO: 3177734 - protein, 24 aa, Giardia lamblia
GRFGFKIAALQGRREICRLLMEKE

SEQ ID NO: 3177735 - protein, 17 aa, Giardia lamblia
GRFNAVFSECMKILHKG

SEQ ID NO: 3177736 - protein, 19 aa, Giardia lamblia
GRFRFAIGLLLSARNLDRV

SEQ ID NO: 3177737 - protein, 17 aa, Giardia lamblia
GRFSLLLEYARFFARIV

SEQ ID NO: 3177738 - protein, 20 aa, Giardia lamblia
GRFYLPMTFVRGGSLRDWMV

SEQ ID NO: 3177739 - protein, 18 aa, Giardia lamblia
GRGPRLLIRLLKDKLTGE

SEQ ID NO: 3177740 - protein, 25 aa, Giardia lamblia
GRGYDICWIPGFRLTTATLRGKLGL

SEQ ID NO: 3177741 - protein, 21 aa, Giardia lamblia
GRHPEHLDMTGPGPGAYATPE

SEQ ID NO: 3177742 - protein, 18 aa, Giardia lamblia
GRIGRFALRYALTCPNVE

SEQ ID NO: 3177743 - protein, 19 aa, Giardia lamblia
GRILRVVGVLADFKSRRHP

SEQ ID NO: 3177744 - protein, 20 aa, Giardia lamblia
GRIMWSRILLNRVRVPFTRF

SEQ ID NO: 3177745 - protein, 19 aa, Giardia lamblia
GRLLPPIIHRDIKPENILV

SEQ ID NO: 3177746 - protein, 18 aa, Giardia lamblia
GRMYIPFIYALHEINLID

SEQ ID NO: 3177747 - protein, 18 aa, Giardia lamblia
GRNGWIWISEMRNPSDTR

SEQ ID NO: 3177748 - protein, 17 aa, Giardia lamblia
GRPECLQELLGYIDKYT

SEQ ID NO: 3177749 - protein, 20 aa, Giardia lamblia
GRPECVRLLLDKEGGMKGSN

SEQ ID NO: 3177750 - protein, 17 aa, Giardia lamblia
GRPFLGFALALSSGAVA

SEQ ID NO: 3177751 - protein, 19 aa, Giardia lamblia
GRSALILSILHQRVACAKI

SEQ ID NO: 3177752 - protein, 17 aa, Giardia lamblia
GRSSFSGGIPMPQSNAV

SEQ ID NO: 3177753 - protein, 17 aa, Giardia lamblia
GRTALMIAARAGDLNGV

SEQ ID NO: 3177754 - protein, 17 aa, Giardia lamblia
GRTALMLAAAANNPEIC

SEQ ID NO: 3177755 - protein, 17 aa, Giardia lamblia
GRTALMLAVEKNSMEAA

SEQ ID NO: 3177756 - protein, 17 aa, Giardia lamblia
GRTALMYAAEMGRSSIV

SEQ ID NO: 3177757 - protein, 17 aa, Giardia lamblia
GRTALSYAVSAGNAEAT

SEQ ID NO: 3177758 - protein, 17 aa, Giardia lamblia
GRTALYMAVAAGHAELC

SEQ ID NO: 3177759 - protein, 21 aa, Giardia lamblia
GRTRLAKYFVHYDADQRHQLE

SEQ ID NO: 3177760 - protein, 22 aa, Giardia lamblia
GRYELACACVDGLLRFFDFDVD

SEQ ID NO: 3177761 - protein, 19 aa, Giardia lamblia
GSCAICLDSLPSIVYLPCR

SEQ ID NO: 3177762 - protein, 19 aa, Giardia lamblia
GSCVKVFRTKFDRNHKGNI

SEQ ID NO: 3177763 - protein, 18 aa, Giardia lamblia
GSDLLKFLFADTGKISLL

SEQ ID NO: 3177764 - protein, 25 aa, Giardia lamblia
GSFAFRLGLPEAWRGLRDEALQNVS

SEQ ID NO: 3177765 - protein, 18 aa, Giardia lamblia
GSGSIRWTGVSISNDITS

SEQ ID NO: 3177766 - protein, 17 aa, Giardia lamblia
GSIEIVELLGLNSSVII

SEQ ID NO: 3177767 - protein, 23 aa, Giardia lamblia
GSILRFVHRINRAIFAVTVGNKT

SEQ ID NO: 3177768 - protein, 18 aa, Giardia lamblia
GSILSFLVEVDFTSMHTR

SEQ ID NO: 3177769 - protein, 24 aa, Giardia lamblia
GSKLVYRLVRYAAIVLLECVESQG

SEQ ID NO: 3177770 - protein, 21 aa, Giardia lamblia
GSKRGGLLFRYTLRQARKNPQ

SEQ ID NO: 3177771 - protein, 20 aa, Giardia lamblia
GSKTKYGWTALMFATVQNYL

SEQ ID NO: 3177772 - protein, 21 aa, Giardia lamblia
GSLDAVMCLVSLEAELRDSNN

SEQ ID NO: 3177773 - protein, 20 aa, Giardia lamblia
GSLLRRFICYDSSETYEAML

SEQ ID NO: 3177774 - protein, 26 aa, Giardia lamblia
GSLSSPRPSSWIGLSFCPEGHALMCI

SEQ ID NO: 3177775 - protein, 22 aa, Giardia lamblia
GSMPLCVSFTMISRFDGKEREY

SEQ ID NO: 3177776 - protein, 21 aa, Giardia lamblia
GSNIRVSLCFAKDELNEGELN

SEQ ID NO: 3177777 - protein, 24 aa, Giardia lamblia
GSNSCLWFYFCVNSIVINKPFLFH

SEQ ID NO: 3177778 - protein, 20 aa, Giardia lamblia
GSPFDIFSMFTGGGRSSNRG

SEQ ID NO: 3177779 - protein, 17 aa, Giardia lamblia
GSPLVNVFTYIIRDTQL

SEQ ID NO: 3177780 - protein, 23 aa, Giardia lamblia
GSPRSGALLTRFSDFNLREEVLQ

SEQ ID NO: 3177781 - protein, 21 aa, Giardia lamblia
GSQFFLKFVGLFTVLKSSQEI

SEQ ID NO: 3177782 - protein, 20 aa, Giardia lamblia
GSQMLKMWLMNPLYDVETIQ

SEQ ID NO: 3177783 - protein, 18 aa, Giardia lamblia
GSSIWLGRLHDLLLVDPQ

SEQ ID NO: 3177784 - protein, 18 aa, Giardia lamblia
GSSRCILCASAGARVSEG

SEQ ID NO: 3177785 - protein, 19 aa, Giardia lamblia
GSTALCFAAVLGYRDIAEI

SEQ ID NO: 3177786 - protein, 17 aa, Giardia lamblia
GSTKPVFFGKGKDTRAL

SEQ ID NO: 3177787 - protein, 25 aa, Giardia lamblia
GTAQCAGCFAAIYGAWSRFSGIAVQ

SEQ ID NO: 3177788 - protein, 19 aa, Giardia lamblia
GTDLPPFRLEFSVDKAIEP

SEQ ID NO: 3177789 - protein, 24 aa, Giardia lamblia
GTDRLCKLCKAVMLVVDGPPNPLA

SEQ ID NO: 3177790 - protein, 26 aa, Giardia lamblia
GTERPADWAWRLFIGLFTDQLSGDEW

SEQ ID NO: 3177791 - protein, 19 aa, Giardia lamblia
GTERTRWRALPEENLLDEF

SEQ ID NO: 3177792 - protein, 20 aa, Giardia lamblia
GTFRCASCGEVIPNVAQDYK

SEQ ID NO: 3177793 - protein, 24 aa, Giardia lamblia
GTGFYECPFCYAVVCDISECVCCG

SEQ ID NO: 3177794 - protein, 20 aa, Giardia lamblia
GTIAFSCLQSSVAADRGSAS

SEQ ID NO: 3177795 - protein, 22 aa, Giardia lamblia
GTIPLRGPESFSVAPPSAQQDN

SEQ ID NO: 3177796 - protein, 24 aa, Giardia lamblia
GTRFYNPICPLEIAKRICVNGFLS

SEQ ID NO: 3177797 - protein, 17 aa, Giardia lamblia
GTSPHCVALAWHVKKWN

SEQ ID NO: 3177798 - protein, 24 aa, Giardia lamblia
GVEFLRFPLFYAKRHNTQQVFYLS

SEQ ID NO: 3177799 - protein, 19 aa, Giardia lamblia
GVFCSEFKGAVSVMELSED

SEQ ID NO: 3177800 - protein, 18 aa, Giardia lamblia
GVIKEWQTIWGVINDVFF

SEQ ID NO: 3177801 - protein, 19 aa, Giardia lamblia
GVPGCGGMLVPVFTSSMLR

SEQ ID NO: 3177802 - protein, 26 aa, Giardia lamblia
GVPWRIRPRHSGLWTYCYDQNVELAV

SEQ ID NO: 3177803 - protein, 18 aa, Giardia lamblia
GVRTIACTWGFHGTDILA

SEQ ID NO: 3177804 - protein, 24 aa, Giardia lamblia
GVTLPEMLVTIFSMSFKCTSDVLA

SEQ ID NO: 3177805 - protein, 19 aa, Giardia lamblia
GVVCSSSLVAQKCITTLKL

SEQ ID NO: 3177806 - protein, 21 aa, Giardia lamblia
GWLKDMLAGVGMEASPNGVSG

SEQ ID NO: 3177807 - protein, 17 aa, Giardia lamblia
GWMCSPVLKVLASVLEI

SEQ ID NO: 3177808 - protein, 17 aa, Giardia lamblia
GWTALMFAAQAGYADIV

SEQ ID NO: 3177809 - protein, 20 aa, Giardia lamblia
GWVDGCREFIYQAGRHVRHT

SEQ ID NO: 3177810 - protein, 17 aa, Giardia lamblia
GWYLAGTKLFIDIYTPE

SEQ ID NO: 3177811 - protein, 18 aa, Giardia lamblia
GYEAFTWDNDETKVKKFI

SEQ ID NO: 3177812 - protein, 18 aa, Giardia lamblia
GYFLTAFLCLCVSPDKVT

SEQ ID NO: 3177813 - protein, 17 aa, Giardia lamblia
GYHWTPSRLIWKLGKRI

SEQ ID NO: 3177814 - protein, 20 aa, Giardia lamblia
GYNWQLAPMVLRFKYATRVE

SEQ ID NO: 3177815 - protein, 18 aa, Giardia lamblia
GYNWRIIRHAAKHILFDN

SEQ ID NO: 3177816 - protein, 17 aa, Giardia lamblia
GYPALGIAIELDAPELV

SEQ ID NO: 3177817 - protein, 23 aa, Giardia lamblia
GYRPMRGYFNWTRDIAKEVPTTP

SEQ ID NO: 3177818 - protein, 19 aa, Giardia lamblia
GYVELALRFLHTLLVIIPE

SEQ ID NO: 3177819 - protein, 18 aa, Giardia lamblia
GYVKLIIDLEGAAVGDFQ

SEQ ID NO: 3177820 - protein, 17 aa, Giardia lamblia
HAAACRNITFAAREDLR

SEQ ID NO: 3177821 - protein, 20 aa, Giardia lamblia
HAAEHGFDIIVHLLAGSEAG

SEQ ID NO: 3177822 - protein, 19 aa, Giardia lamblia
HADCIRLLIDFEQNSRDIY

SEQ ID NO: 3177823 - protein, 21 aa, Giardia lamblia
HAFFSGVNWSWFEKKVVKAPI

SEQ ID NO: 3177824 - protein, 17 aa, Giardia lamblia
HAGACLSCCSFYSSQGR

SEQ ID NO: 3177825 - protein, 19 aa, Giardia lamblia
HAGACLYILSRKEIKTFIP

SEQ ID NO: 3177826 - protein, 20 aa, Giardia lamblia
HARIVSRLCPYEVRQSDNSG

SEQ ID NO: 3177827 - protein, 27 aa, Giardia lamblia
HASHSYRWFRFACGLAYPCDTCHSKAC

SEQ ID NO: 3177828 - protein, 23 aa, Giardia lamblia
HAVCVGAGFAALVEFNGEKCAIT

SEQ ID NO: 3177829 - protein, 24 aa, Giardia lamblia
HCKCGGDGHSCCLDARRKNGLPDT

SEQ ID NO: 3177830 - protein, 21 aa, Giardia lamblia
HCLAEVIPLLITCIKEETSKT

SEQ ID NO: 3177831 - protein, 21 aa, Giardia lamblia
HDACCPCGRSALASLPFFLRD

SEQ ID NO: 3177832 - protein, 22 aa, Giardia lamblia
HDCQRVSADLSFHFISLQCHFC

SEQ ID NO: 3177833 - protein, 23 aa, Giardia lamblia
HDDCIRWGMKLYDSIDRLQVIKV

SEQ ID NO: 3177834 - protein, 20 aa, Giardia lamblia
HDLQLRWIRHSSERMRGTDG

SEQ ID NO: 3177835 - protein, 17 aa, Giardia lamblia
HEACIFPPVTTKLSSTL

SEQ ID NO: 3177836 - protein, 17 aa, Giardia lamblia
HEAGNRNKLGWTALMQA

SEQ ID NO: 3177837 - protein, 25 aa, Giardia lamblia
HEALCCIARVIPLYFQSFLALATSD

SEQ ID NO: 3177838 - protein, 17 aa, Giardia lamblia
HEDIRLVPPQVFESMLQ

SEQ ID NO: 3177839 - protein, 19 aa, Giardia lamblia
HEIREAFDLFDADRSGRID

SEQ ID NO: 3177840 - protein, 17 aa, Giardia lamblia
HEITDIIAIANKAPQIS

SEQ ID NO: 3177841 - protein, 20 aa, Giardia lamblia
HEMRFKKGAVLAGRYEIYKT

SEQ ID NO: 3177842 - protein, 19 aa, Giardia lamblia
HENRTALMYAVRQGHLEAT

SEQ ID NO: 3177843 - protein, 18 aa, Giardia lamblia
HEPPRTSVRLDVMGPYTI

SEQ ID NO: 3177844 - protein, 18 aa, Giardia lamblia
HERCCLADIIVFYHSHKK

SEQ ID NO: 3177845 - protein, 25 aa, Giardia lamblia
HEVGIRCFMGWTALTWGLDCQNPAA

SEQ ID NO: 3177846 - protein, 23 aa, Giardia lamblia
HEVSLALCAPCFLYDNLHSFYTL

SEQ ID NO: 3177847 - protein, 22 aa, Giardia lamblia
HEYPEACSILAPYEKMVTLPDK

SEQ ID NO: 3177848 - protein, 29 aa, Giardia lamblia
HFACCFPDFIFCRRELRFTAMQGKVSQNP

SEQ ID NO: 3177849 - protein, 17 aa, Giardia lamblia
HFEVLDLAPMLQRNVTR

SEQ ID NO: 3177850 - protein, 22 aa, Giardia lamblia
HFPPKVCLHTNMSRTHKTSEVS

SEQ ID NO: 3177851 - protein, 20 aa, Giardia lamblia
HGACAGCGETAYITHVTRLF

SEQ ID NO: 3177852 - protein, 24 aa, Giardia lamblia
HGHPECVELLYAREILIQDNKGNK

SEQ ID NO: 3177853 - protein, 19 aa, Giardia lamblia
HGLSCSRSLTTLAMENCAL

SEQ ID NO: 3177854 - protein, 24 aa, Giardia lamblia
HGRLKAATILLPFEGGMKDSIGRG

SEQ ID NO: 3177855 - protein, 24 aa, Giardia lamblia
HGRRECLRLLLAEAGQVNSDGETA

SEQ ID NO: 3177856 - protein, 23 aa, Giardia lamblia
HGRYCYDSRMALIIAAEKHYEEL

SEQ ID NO: 3177857 - protein, 17 aa, Giardia lamblia
HGSCPLSVLRVCSAITS

SEQ ID NO: 3177858 - protein, 19 aa, Giardia lamblia
HGTCMDWQCSRSCRIDSIY

SEQ ID NO: 3177859 - protein, 17 aa, Giardia lamblia
HIAYCLGYKPYIINPTY

SEQ ID NO: 3177860 - protein, 18 aa, Giardia lamblia
HIDLKYMIGYSVDEDTSL

SEQ ID NO: 3177861 - protein, 20 aa, Giardia lamblia
HIEPFPLSVCLPGMAYRLGI

SEQ ID NO: 3177862 - protein, 17 aa, Giardia lamblia
HILLVEYAHDWLAHEKR

SEQ ID NO: 3177863 - protein, 22 aa, Giardia lamblia
HINEAFPFLSLQLQPYGGAVNG

SEQ ID NO: 3177864 - protein, 21 aa, Giardia lamblia
HKGSRWAESIARKLESNKSLS

SEQ ID NO: 3177865 - protein, 18 aa, Giardia lamblia
HKIGLFGSLIVKASVVPE

SEQ ID NO: 3177866 - protein, 18 aa, Giardia lamblia
HKLCKACLRKMFDQLNDE

SEQ ID NO: 3177867 - protein, 18 aa, Giardia lamblia
HKLMFSFQLCTSIITTEY

SEQ ID NO: 3177868 - protein, 18 aa, Giardia lamblia
HKLVPLEGCIHSRNGTTA

SEQ ID NO: 3177869 - protein, 24 aa, Giardia lamblia
HKRKRLEKQLALIREKEPQFTDAF

SEQ ID NO: 3177870 - protein, 21 aa, Giardia lamblia
HKTLCKLYFKACIQKIEDLIL

SEQ ID NO: 3177871 - protein, 23 aa, Giardia lamblia
HKVCSNGSFDRCFCPHLTIDSPL

SEQ ID NO: 3177872 - protein, 20 aa, Giardia lamblia
HKWPDSLSFVLSFDSHVMSS

SEQ ID NO: 3177873 - protein, 18 aa, Giardia lamblia
HKYREFLHAAFILGGVDN

SEQ ID NO: 3177874 - protein, 17 aa, Giardia lamblia
HLDCARLLLETDEKTAD

SEQ ID NO: 3177875 - protein, 18 aa, Giardia lamblia
HLDCTKLLLSEIGVYVPG

SEQ ID NO: 3177876 - protein, 19 aa, Giardia lamblia
HLECIKLLLEKEGGMRDSG

SEQ ID NO: 3177877 - protein, 20 aa, Giardia lamblia
HLECIKLLLEKEGRMKDSND

SEQ ID NO: 3177878 - protein, 21 aa, Giardia lamblia
HLECIKLLLKNEVGMQDNDGE

SEQ ID NO: 3177879 - protein, 25 aa, Giardia lamblia
HLECVKCLLCELGIRTSLGNTALMF

SEQ ID NO: 3177880 - protein, 23 aa, Giardia lamblia
HLFLRTSRVLAWVALPSEFLFTK

SEQ ID NO: 3177881 - protein, 18 aa, Giardia lamblia
HLGNTVFYKPGLEKYERQ

SEQ ID NO: 3177882 - protein, 21 aa, Giardia lamblia
HLKGRTALMFACRKNHLNCVF

SEQ ID NO: 3177883 - protein, 24 aa, Giardia lamblia
HLLLKLPFSYTIESMIERIGDALN

SEQ ID NO: 3177884 - protein, 18 aa, Giardia lamblia
HLNKSLKQLLAWSKAYAN

SEQ ID NO: 3177885 - protein, 22 aa, Giardia lamblia
HLPGFRINFQFKDRSVISSTCR

SEQ ID NO: 3177886 - protein, 17 aa, Giardia lamblia
HLQVLPLSASFRTLSAS

SEQ ID NO: 3177887 - protein, 21 aa, Giardia lamblia
HLRARFFHRWVRYVKEKNQSA

SEQ ID NO: 3177888 - protein, 26 aa, Giardia lamblia
HLRKFLRIITDFTMWYSYRDFCCSGC

SEQ ID NO: 3177889 - protein, 17 aa, Giardia lamblia
HLTCINIGLTEDLQAKT

SEQ ID NO: 3177890 - protein, 26 aa, Giardia lamblia
HLTPKVMYRFVTWLPAVVKRSLDSEF

SEQ ID NO: 3177891 - protein, 25 aa, Giardia lamblia
HLVFRWCLINEDFAHYVGSIRRQRR

SEQ ID NO: 3177892 - protein, 24 aa, Giardia lamblia
HLYKYKPALCKLVLEHPTETISII

SEQ ID NO: 3177893 - protein, 19 aa, Giardia lamblia
HNGPHAWNMVRLEDDWYHV

SEQ ID NO: 3177894 - protein, 23 aa, Giardia lamblia
HNHIECARILIAYERACRDANGM

SEQ ID NO: 3177895 - protein, 20 aa, Giardia lamblia
HNLWVCIGLIHAGCHSISVA

SEQ ID NO: 3177896 - protein, 17 aa, Giardia lamblia
HNNLRGQMIFDHDSDSD

SEQ ID NO: 3177897 - protein, 18 aa, Giardia lamblia
HPAIFCWIARVINMVLDT

SEQ ID NO: 3177898 - protein, 17 aa, Giardia lamblia
HPECVRLLLKDEGGMQT

SEQ ID NO: 3177899 - protein, 18 aa, Giardia lamblia
HPEIKIAFTRLYNYALSL

SEQ ID NO: 3177900 - protein, 25 aa, Giardia lamblia
HPICPHCKYYLRPRVLMFDDAMFME

SEQ ID NO: 3177901 - protein, 23 aa, Giardia lamblia
HQARSRPGFSYNFVDRTKDFYLN

SEQ ID NO: 3177902 - protein, 24 aa, Giardia lamblia
HQDLKAILPMNAWGPMPIGPYDFL

SEQ ID NO: 3177903 - protein, 23 aa, Giardia lamblia
HQDLSWKGMKAFLSQSGVLRTIA

SEQ ID NO: 3177904 - protein, 23 aa, Giardia lamblia
HQHSGNCLFTFTSLPCILDMYYK

SEQ ID NO: 3177905 - protein, 21 aa, Giardia lamblia
HQMLFMLKEMIAAFDMHSLLS

SEQ ID NO: 3177906 - protein, 17 aa, Giardia lamblia
HRAKWRPDPSLKLQNGD

SEQ ID NO: 3177907 - protein, 19 aa, Giardia lamblia
HREFSLKLGKPAIDMAKVH

SEQ ID NO: 3177908 - protein, 17 aa, Giardia lamblia
HRLALSGPDAWEAKGES

SEQ ID NO: 3177909 - protein, 19 aa, Giardia lamblia
HRPAFRFSLWSRPSCITFN

SEQ ID NO: 3177910 - protein, 22 aa, Giardia lamblia
HRPEERYALLLAHDYLHSPAAA

SEQ ID NO: 3177911 - protein, 22 aa, Giardia lamblia
HRRINRCIFRLSSLKKFLHDSY

SEQ ID NO: 3177912 - protein, 18 aa, Giardia lamblia
HRRYRLVPLMTERLSRLT

SEQ ID NO: 3177913 - protein, 18 aa, Giardia lamblia
HRSGISYVRREFRHHEEP

SEQ ID NO: 3177914 - protein, 20 aa, Giardia lamblia
HRSMKSIGILLEFLTTEKNG

SEQ ID NO: 3177915 - protein, 21 aa, Giardia lamblia
HSACYKELLALHSRCEAFQSF

SEQ ID NO: 3177916 - protein, 19 aa, Giardia lamblia
HSCPFAFVGEGTTNLMVAA

SEQ ID NO: 3177917 - protein, 24 aa, Giardia lamblia
HSECLCILTAFLALLQEVGTQYPN

SEQ ID NO: 3177918 - protein, 22 aa, Giardia lamblia
HSECVRLLLDREAGMTLENGWT

SEQ ID NO: 3177919 - protein, 19 aa, Giardia lamblia
HSICESCFYNLSGQVYMGQ

SEQ ID NO: 3177920 - protein, 17 aa, Giardia lamblia
HSLLKKKLDAMTLQLRS

SEQ ID NO: 3177921 - protein, 18 aa, Giardia lamblia
HSPLRFLLDMILKLNLTV

SEQ ID NO: 3177922 - protein, 24 aa, Giardia lamblia
HSSIIWDCCWHCTGTSVVTCSQDT

SEQ ID NO: 3177923 - protein, 18 aa, Giardia lamblia
HSTLRPLLKILKGSARLE

SEQ ID NO: 3177924 - protein, 22 aa, Giardia lamblia
HSVLRFPPLIKLAGCAHMTTAA

SEQ ID NO: 3177925 - protein, 21 aa, Giardia lamblia
HTCPGILPLCVKDLFNNLQSV

SEQ ID NO: 3177926 - protein, 17 aa, Giardia lamblia
HTECVRILSSYEAGMSD

SEQ ID NO: 3177927 - protein, 22 aa, Giardia lamblia
HTERWEFGHGFIDSMANKAEDA

SEQ ID NO: 3177928 - protein, 24 aa, Giardia lamblia
HTLPMKRVNLIAGELRLLQHKIGV

SEQ ID NO: 3177929 - protein, 18 aa, Giardia lamblia
HVDYLVSIMARFYRAASM

SEQ ID NO: 3177930 - protein, 19 aa, Giardia lamblia
HVECIPLLLAESYATTAAG

SEQ ID NO: 3177931 - protein, 19 aa, Giardia lamblia
HVECIPRFFKLGDCCGDII

SEQ ID NO: 3177932 - protein, 22 aa, Giardia lamblia
HVECVRALMLKEARMQDDEGRT

SEQ ID NO: 3177933 - protein, 19 aa, Giardia lamblia
HVECVRLLADRELSMRCAN

SEQ ID NO: 3177934 - protein, 25 aa, Giardia lamblia
HVFCADCVHYLFALWERTCPICNER

SEQ ID NO: 3177935 - protein, 17 aa, Giardia lamblia
HVFKCLPLFTSQRSWLM

SEQ ID NO: 3177936 - protein, 22 aa, Giardia lamblia
HVIDHYCHFCRNAAMASPLLTY

SEQ ID NO: 3177937 - protein, 20 aa, Giardia lamblia
HVRFKFLRQWIGDHKGDTVA

SEQ ID NO: 3177938 - protein, 17 aa, Giardia lamblia
HVRQWLHICGPIDALWI

SEQ ID NO: 3177939 - protein, 25 aa, Giardia lamblia
HVSLAVLCRLNYSFGFVLLPYTTQA

SEQ ID NO: 3177940 - protein, 17 aa, Giardia lamblia
HVTASLCMHCNRMGKTK

SEQ ID NO: 3177941 - protein, 22 aa, Giardia lamblia
HVWIPKQSVCLIVCRNMGILAV

SEQ ID NO: 3177942 - protein, 25 aa, Giardia lamblia
HYCFLYRYGRHISWDPCVLSKQESS

SEQ ID NO: 3177943 - protein, 18 aa, Giardia lamblia
HYDCVRILCETQKPTLEN

SEQ ID NO: 3177944 - protein, 18 aa, Giardia lamblia
HYLVPVDILLDWDSKSST

SEQ ID NO: 3177945 - protein, 18 aa, Giardia lamblia
HYMLRAGILPAFHVRFAI

SEQ ID NO: 3177946 - protein, 20 aa, Giardia lamblia
HYRKFITMLAQFVRETPYIS

SEQ ID NO: 3177947 - protein, 18 aa, Giardia lamblia
IAAKFLLLMVKVVDGDQL

SEQ ID NO: 3177948 - protein, 20 aa, Giardia lamblia
IAALESRISFIAAELDARNQ

SEQ ID NO: 3177949 - protein, 17 aa, Giardia lamblia
IAAMLAHFAEWPDVIFV

SEQ ID NO: 3177950 - protein, 17 aa, Giardia lamblia
IAASRGYSDIVLQLLPK

SEQ ID NO: 3177951 - protein, 18 aa, Giardia lamblia
IADFFLKYLNIYLSENYS

SEQ ID NO: 3177952 - protein, 18 aa, Giardia lamblia
IAEAVSLLEGLKERLSAL

SEQ ID NO: 3177953 - protein, 20 aa, Giardia lamblia
IAEYCPFKPPADVWSLGTCL

SEQ ID NO: 3177954 - protein, 21 aa, Giardia lamblia
IAFCFRGGILLAVDSRSTQGQ

SEQ ID NO: 3177955 - protein, 20 aa, Giardia lamblia
IAGDLKLTFSDGGLAQVLTP

SEQ ID NO: 3177956 - protein, 28 aa, Giardia lamblia
IAKKCLQDACGLSTNFLAPVAHATGFAE

SEQ ID NO: 3177957 - protein, 23 aa, Giardia lamblia
IAKLLVPLKYDWHAAKQTREDHI

SEQ ID NO: 3177958 - protein, 25 aa, Giardia lamblia
IAKSLFPSLGYYYWFLGNVADTTIL

SEQ ID NO: 3177959 - protein, 25 aa, Giardia lamblia
IALKLYYYDACFILLMLHPDKSFEN

SEQ ID NO: 3177960 - protein, 18 aa, Giardia lamblia
IALLRDFRPSNFFLSSRG

SEQ ID NO: 3177961 - protein, 19 aa, Giardia lamblia
IALQKAWPLILKFHDHVHD

SEQ ID NO: 3177962 - protein, 17 aa, Giardia lamblia
IANPVICCLNFELEWQA

SEQ ID NO: 3177963 - protein, 22 aa, Giardia lamblia
IAPDCIKCTFDVATITSPSTPV

SEQ ID NO: 3177964 - protein, 17 aa, Giardia lamblia
IARCVACCRPVALLRQA

SEQ ID NO: 3177965 - protein, 19 aa, Giardia lamblia
IARFHCVYWLAFLMGASIP

SEQ ID NO: 3177966 - protein, 24 aa, Giardia lamblia
IARLDFPFCRDIFLMGLIPLANRL

SEQ ID NO: 3177967 - protein, 21 aa, Giardia lamblia
IARLLGGVSLHFEFAPVAKSG

SEQ ID NO: 3177968 - protein, 17 aa, Giardia lamblia
IASCALGPVAASRLLTE

SEQ ID NO: 3177969 - protein, 17 aa, Giardia lamblia
IAVCLALLWERLSVLGA

SEQ ID NO: 3177970 - protein, 23 aa, Giardia lamblia
ICAEKRKPFVLVMNKVDLVPQQV

SEQ ID NO: 3177971 - protein, 20 aa, Giardia lamblia
ICALLKAGIKYQYDHEEMKH

SEQ ID NO: 3177972 - protein, 18 aa, Giardia lamblia
ICCVNCKMVAQLPIQLQC

SEQ ID NO: 3177973 - protein, 24 aa, Giardia lamblia
ICDWNSFVEPEMVSRVGVTMTEVT

SEQ ID NO: 3177974 - protein, 23 aa, Giardia lamblia
ICERLRVSVALAKRVMRQLVKSG

SEQ ID NO: 3177975 - protein, 17 aa, Giardia lamblia
ICFKRSIFPPSAFGIKR

SEQ ID NO: 3177976 - protein, 24 aa, Giardia lamblia
ICGCYARPAPWNSLITKSKNCPVC

SEQ ID NO: 3177977 - protein, 18 aa, Giardia lamblia
ICKAAVFVGRLLELTKSR

SEQ ID NO: 3177978 - protein, 23 aa, Giardia lamblia
ICKMLEVCILPSPDKAFIDELLK

SEQ ID NO: 3177979 - protein, 18 aa, Giardia lamblia
ICMKLPHCVNIIDRACNW

SEQ ID NO: 3177980 - protein, 17 aa, Giardia lamblia
ICPTESISMFGITPESE

SEQ ID NO: 3177981 - protein, 22 aa, Giardia lamblia
ICRFKECMRKVFLDKSTHGSSA

SEQ ID NO: 3177982 - protein, 18 aa, Giardia lamblia
ICRLCTSLFCKRTGKDNQ

SEQ ID NO: 3177983 - protein, 20 aa, Giardia lamblia
ICSFDCYHHGWPCFGCGAPI

SEQ ID NO: 3177984 - protein, 19 aa, Giardia lamblia
ICSKEAAPVFSTRVYELIS

SEQ ID NO: 3177985 - protein, 21 aa, Giardia lamblia
ICTACTRIAIRPVRLPCNHLA

SEQ ID NO: 3177986 - protein, 17 aa, Giardia lamblia
ICVIPAVKLECHGKFRL

SEQ ID NO: 3177987 - protein, 19 aa, Giardia lamblia
ICVKKCPFDAIRIINLPSS

SEQ ID NO: 3177988 - protein, 17 aa, Giardia lamblia
ICYKMLISINYHKMADA

SEQ ID NO: 3177989 - protein, 23 aa, Giardia lamblia
IDASECQCGLDIIKKLSQAGIPC

SEQ ID NO: 3177990 - protein, 23 aa, Giardia lamblia
IDEFRLLRHFGWTTLMIGTVFTF

SEQ ID NO: 3177991 - protein, 18 aa, Giardia lamblia
IDESFFLGCLLFPSACVY

SEQ ID NO: 3177992 - protein, 19 aa, Giardia lamblia
IDESLCLASSMSLTGELDI

SEQ ID NO: 3177993 - protein, 21 aa, Giardia lamblia
IDFDFSFKLCQYIFCMPDTDE

SEQ ID NO: 3177994 - protein, 17 aa, Giardia lamblia
IDFFKPVYKHAGQSRGM

SEQ ID NO: 3177995 - protein, 21 aa, Giardia lamblia
IDFYKILGLETWPGDGEAKKA

SEQ ID NO: 3177996 - protein, 18 aa, Giardia lamblia
IDGLFVTACELFRNFDIN

SEQ ID NO: 3177997 - protein, 17 aa, Giardia lamblia
IDGRTALMMAAERNHVD

SEQ ID NO: 3177998 - protein, 19 aa, Giardia lamblia
IDIPQDCRSLFTVEQDKAV

SEQ ID NO: 3177999 - protein, 17 aa, Giardia lamblia
IDIVKLLLCEVKLQNEK

SEQ ID NO: 3178000 - protein, 21 aa, Giardia lamblia
IDKWPAVDVIIGFHSKGFPLR

SEQ ID NO: 3178001 - protein, 24 aa, Giardia lamblia
IDLLDRISFINVWIEKGIPICFWI

SEQ ID NO: 3178002 - protein, 19 aa, Giardia lamblia
IDNCQRVVCRFMLDHGFSV

SEQ ID NO: 3178003 - protein, 18 aa, Giardia lamblia
IDNCRAFFDSLMIPYRVV

SEQ ID NO: 3178004 - protein, 20 aa, Giardia lamblia
IDPGCPPRSFSQCSPRPGPR

SEQ ID NO: 3178005 - protein, 20 aa, Giardia lamblia
IDPGCPPRSFSQCSPRPGSR

SEQ ID NO: 3178006 - protein, 24 aa, Giardia lamblia
IDPTVRIPRTFKRFCGLIVQLLYK

SEQ ID NO: 3178007 - protein, 19 aa, Giardia lamblia
IDRLRACLQTPPLSSFSVQ

SEQ ID NO: 3178008 - protein, 20 aa, Giardia lamblia
IDRRRICNFIKQLPAAAKQD

SEQ ID NO: 3178009 - protein, 17 aa, Giardia lamblia
IDWLIPRLAGFSSAEIS

SEQ ID NO: 3178010 - protein, 25 aa, Giardia lamblia
IEAQLRFGADFQMLMFMSSGVTRKG

SEQ ID NO: 3178011 - protein, 17 aa, Giardia lamblia
IECAKLLLPKEADMKQP

SEQ ID NO: 3178012 - protein, 18 aa, Giardia lamblia
IECARLAAREGYRQIASW

SEQ ID NO: 3178013 - protein, 17 aa, Giardia lamblia
IECSLCRYLYVQGNIYK

SEQ ID NO: 3178014 - protein, 24 aa, Giardia lamblia
IEDQEVWIRFSVLCLQSGRVQLAR

SEQ ID NO: 3178015 - protein, 24 aa, Giardia lamblia
IEEGYCKKCMLASLTRFGVSSPPG

SEQ ID NO: 3178016 - protein, 18 aa, Giardia lamblia
IEELKFRGAYVMTEDEKQ

SEQ ID NO: 3178017 - protein, 22 aa, Giardia lamblia
IEELRYRFSLLDADKSGSITFD

SEQ ID NO: 3178018 - protein, 22 aa, Giardia lamblia
IEGLRSRCFLLSFNALTSKDIL

SEQ ID NO: 3178019 - protein, 21 aa, Giardia lamblia
IEIKRLTAMYSKLESELTVKA

SEQ ID NO: 3178020 - protein, 21 aa, Giardia lamblia
IEIVQSIYILPGLRNNKLTTW

SEQ ID NO: 3178021 - protein, 21 aa, Giardia lamblia
IEKDCYCYTLAPSSPISVPGV

SEQ ID NO: 3178022 - protein, 18 aa, Giardia lamblia
IELIKILLPYEAGIRVLD

SEQ ID NO: 3178023 - protein, 19 aa, Giardia lamblia
IELKPSFGKGFLRKADALA

SEQ ID NO: 3178024 - protein, 20 aa, Giardia lamblia
IELLKRLKVEAVRRKQRHLQ

SEQ ID NO: 3178025 - protein, 19 aa, Giardia lamblia
IELPTCMSVPIVLNGYMRG

SEQ ID NO: 3178026 - protein, 20 aa, Giardia lamblia
IELRKNYGIPEWRDDLKKIL

SEQ ID NO: 3178027 - protein, 17 aa, Giardia lamblia
IEMMGCFNLFDIGPHCI

SEQ ID NO: 3178028 - protein, 23 aa, Giardia lamblia
IEPMAYKLAFSFFFKQGAYQYAS

SEQ ID NO: 3178029 - protein, 21 aa, Giardia lamblia
IEPRPSLSEYPYRDSSHVSSE

SEQ ID NO: 3178030 - protein, 23 aa, Giardia lamblia
IERGQFRLVFRGRIISNLPPGHL

SEQ ID NO: 3178031 - protein, 17 aa, Giardia lamblia
IERLRSLCEVFFEQSYQ

SEQ ID NO: 3178032 - protein, 22 aa, Giardia lamblia
IERLSKAIAHWRAKIQTTTEEF

SEQ ID NO: 3178033 - protein, 17 aa, Giardia lamblia
IESYTLLGYVVGLIPYP

SEQ ID NO: 3178034 - protein, 19 aa, Giardia lamblia
IFASKSCKASVRLGDPLLD

SEQ ID NO: 3178035 - protein, 17 aa, Giardia lamblia
IFCFNREAFVGLSNGEI

SEQ ID NO: 3178036 - protein, 23 aa, Giardia lamblia
IFDEIWVEIGLDFSRIYEFDLHV

SEQ ID NO: 3178037 - protein, 23 aa, Giardia lamblia
IFHFCPLERFGIIISDRATDFSP

SEQ ID NO: 3178038 - protein, 17 aa, Giardia lamblia
IFKGPKILICSATAETE

SEQ ID NO: 3178039 - protein, 21 aa, Giardia lamblia
IFKSEHPLTDFIVFDKTIIAI

SEQ ID NO: 3178040 - protein, 21 aa, Giardia lamblia
IFPFDDLCCLSRSKTASECQL

SEQ ID NO: 3178041 - protein, 17 aa, Giardia lamblia
IFRELFVREGFSYDYVF

SEQ ID NO: 3178042 - protein, 21 aa, Giardia lamblia
IFRRLFRVYAHIFMCHYGTLV

SEQ ID NO: 3178043 - protein, 31 aa, Giardia lamblia
IFSDIHAALKLKRRLREVFPDTVFTKNIENE

SEQ ID NO: 3178044 - protein, 17 aa, Giardia lamblia
IGCDICVKKCPFDAIRI

SEQ ID NO: 3178045 - protein, 17 aa, Giardia lamblia
IGCTVMFAGTDHATPLV

SEQ ID NO: 3178046 - protein, 20 aa, Giardia lamblia
IGFEFLHLWMPKAEFYMPST

SEQ ID NO: 3178047 - protein, 22 aa, Giardia lamblia
IGFPRPISIDTFRKPDFFLVAE

SEQ ID NO: 3178048 - protein, 31 aa, Giardia lamblia
IGGNCKTYLLACIRPEPEFLLDTISTLRFAQ

SEQ ID NO: 3178049 - protein, 21 aa, Giardia lamblia
IGGSSKLFWGLSILGQAQENR

SEQ ID NO: 3178050 - protein, 24 aa, Giardia lamblia
IGHKRFISSLAWQPLPLLPVENIP

SEQ ID NO: 3178051 - protein, 18 aa, Giardia lamblia
IGIKCKWVDKVLDRLFRI

SEQ ID NO: 3178052 - protein, 20 aa, Giardia lamblia
IGIYLSALARRMLKSKLTYQ

SEQ ID NO: 3178053 - protein, 20 aa, Giardia lamblia
IGRIVFRLCFRNWTGPGDCS

SEQ ID NO: 3178054 - protein, 19 aa, Giardia lamblia
IGRPVVWNLSGLDAFAEKC

SEQ ID NO: 3178055 - protein, 19 aa, Giardia lamblia
IGTLDCGRLYMLFADEQHR

SEQ ID NO: 3178056 - protein, 25 aa, Giardia lamblia
IGVLRRQLRHVGCVRPDGTTALMLA

SEQ ID NO: 3178057 - protein, 19 aa, Giardia lamblia
IHCMLKYKLEFDSDFVPLL

SEQ ID NO: 3178058 - protein, 18 aa, Giardia lamblia
IHERRTPGVLAFLAVTPS

SEQ ID NO: 3178059 - protein, 23 aa, Giardia lamblia
IHGYRPVFRFLDAHHKPLLVKVL

SEQ ID NO: 3178060 - protein, 17 aa, Giardia lamblia
IHLLVVYHMTRFRRLLS

SEQ ID NO: 3178061 - protein, 18 aa, Giardia lamblia
IHQFPIPFCKSLCFTNAG

SEQ ID NO: 3178062 - protein, 18 aa, Giardia lamblia
IHTRVCPQWPFVTLDKSY

SEQ ID NO: 3178063 - protein, 20 aa, Giardia lamblia
IHWKKDLFKVLGLSEQPVIS

SEQ ID NO: 3178064 - protein, 25 aa, Giardia lamblia
IHYTCPRCRVIFCRPHPGIQYPQLL

SEQ ID NO: 3178065 - protein, 17 aa, Giardia lamblia
IIARLTLELAGARNIKA

SEQ ID NO: 3178066 - protein, 17 aa, Giardia lamblia
IIARVYLTAAFQFHQSE

SEQ ID NO: 3178067 - protein, 24 aa, Giardia lamblia
IIDQWKPLWNFKGMDCVFESKKEG

SEQ ID NO: 3178068 - protein, 23 aa, Giardia lamblia
IIDRACNWACALFEKYFILTIEK

SEQ ID NO: 3178069 - protein, 17 aa, Giardia lamblia
IIEQYRLYGSILIVCEV

SEQ ID NO: 3178070 - protein, 17 aa, Giardia lamblia
IIGICFLMRGEPTEEGF

SEQ ID NO: 3178071 - protein, 24 aa, Giardia lamblia
IIKELLKLEVLLLIASDNKVQMKD

SEQ ID NO: 3178072 - protein, 23 aa, Giardia lamblia
IILEQRIIFAIAWGLAGSIVAEH

SEQ ID NO: 3178073 - protein, 18 aa, Giardia lamblia
IIPLFPASTILYFITEEP

SEQ ID NO: 3178074 - protein, 17 aa, Giardia lamblia
IIRRCIETFGRIAVKLC

SEQ ID NO: 3178075 - protein, 23 aa, Giardia lamblia
IITPNCRYRIFTIGLPVENIGHN

SEQ ID NO: 3178076 - protein, 19 aa, Giardia lamblia
IIVTFKFPAARAHKNVSSQ

SEQ ID NO: 3178077 - protein, 23 aa, Giardia lamblia
IIYASTCLNNFARLHGHPMVFSS

SEQ ID NO: 3178078 - protein, 23 aa, Giardia lamblia
IIYQLLLCFAHAGVSTSSRFKDF

SEQ ID NO: 3178079 - protein, 17 aa, Giardia lamblia
IIYVCTFEKAILVFSKF

SEQ ID NO: 3178080 - protein, 19 aa, Giardia lamblia
IKCVLCGAVSPPTSICPSC

SEQ ID NO: 3178081 - protein, 22 aa, Giardia lamblia
IKDLRIVLIAPRYQCMITDVTT

SEQ ID NO: 3178082 - protein, 17 aa, Giardia lamblia
IKDRFRAALAEGYAKDM

SEQ ID NO: 3178083 - protein, 17 aa, Giardia lamblia
IKDSDSWFSAVSEGKAK

SEQ ID NO: 3178084 - protein, 17 aa, Giardia lamblia
IKECIRNGYDRGLCITV

SEQ ID NO: 3178085 - protein, 27 aa, Giardia lamblia
IKEIKRYAGKCSACLAISPILASPFCK

SEQ ID NO: 3178086 - protein, 23 aa, Giardia lamblia
IKGRSQWVRRFFAQGVLAASQLF

SEQ ID NO: 3178087 - protein, 18 aa, Giardia lamblia
IKHFFTIESLRILADPLI

SEQ ID NO: 3178088 - protein, 24 aa, Giardia lamblia
IKHKLELQSRIGFLERVVKDKDEA

SEQ ID NO: 3178089 - protein, 25 aa, Giardia lamblia
IKHTWPRFIYLLFRGSLPVYVSDPG

SEQ ID NO: 3178090 - protein, 24 aa, Giardia lamblia
IKIPRCPGCLSPIMPHALMFDEQY

SEQ ID NO: 3178091 - protein, 18 aa, Giardia lamblia
IKISCEYYNLGMTKVVYG

SEQ ID NO: 3178092 - protein, 20 aa, Giardia lamblia
IKKLLKSMFEWLALKTNEAG

SEQ ID NO: 3178093 - protein, 19 aa, Giardia lamblia
IKLGMPVPLGFTITCQTCV

SEQ ID NO: 3178094 - protein, 17 aa, Giardia lamblia
IKLLWEPVTVPLLSMDD

SEQ ID NO: 3178095 - protein, 20 aa, Giardia lamblia
IKMTPRFAKPCVALIGLRPS

SEQ ID NO: 3178096 - protein, 17 aa, Giardia lamblia
IKPIFARMYARMHSLLK

SEQ ID NO: 3178097 - protein, 17 aa, Giardia lamblia
IKPPAVEVVHSRNSAGT

SEQ ID NO: 3178098 - protein, 24 aa, Giardia lamblia
IKRGFCPWCILRVSLWDDISLCGF

SEQ ID NO: 3178099 - protein, 21 aa, Giardia lamblia
IKRLKEAMFSREEVIAKVSYI

SEQ ID NO: 3178100 - protein, 17 aa, Giardia lamblia
IKSAIAVLKFLELAATA

SEQ ID NO: 3178101 - protein, 23 aa, Giardia lamblia
IKSPKAVVYFAEFTQKVYTRCTA

SEQ ID NO: 3178102 - protein, 19 aa, Giardia lamblia
IKTGLLLQCFGGVQKDSYR

SEQ ID NO: 3178103 - protein, 18 aa, Giardia lamblia
IKTPINWRKIATALNQDR

SEQ ID NO: 3178104 - protein, 19 aa, Giardia lamblia
IKVLERFDLLATRGKSSSY

SEQ ID NO: 3178105 - protein, 17 aa, Giardia lamblia
IKYICGLAYTSVTKIGG

SEQ ID NO: 3178106 - protein, 23 aa, Giardia lamblia
ILARARPVLIGMFNGSSESGQYA

SEQ ID NO: 3178107 - protein, 21 aa, Giardia lamblia
ILARLCMRRQLLMLNIIHEYI

SEQ ID NO: 3178108 - protein, 17 aa, Giardia lamblia
ILARRLTSGLGFITAGE

SEQ ID NO: 3178109 - protein, 20 aa, Giardia lamblia
ILAWHWTRWGTSGTYSVIPK

SEQ ID NO: 3178110 - protein, 18 aa, Giardia lamblia
ILCSIGFTDLMTSAFFGD

SEQ ID NO: 3178111 - protein, 18 aa, Giardia lamblia
ILDRRGYCALNYCIENYK

SEQ ID NO: 3178112 - protein, 18 aa, Giardia lamblia
ILDVTSFYTSYCKDTQAI

SEQ ID NO: 3178113 - protein, 18 aa, Giardia lamblia
ILEDFIRGRIPHFVIPYT

SEQ ID NO: 3178114 - protein, 21 aa, Giardia lamblia
ILEIRSGMQLVYDMLMNSISS

SEQ ID NO: 3178115 - protein, 18 aa, Giardia lamblia
ILFDRVLEPWLLDPSACL

SEQ ID NO: 3178116 - protein, 17 aa, Giardia lamblia
ILFPNAVYLLRGNHETR

SEQ ID NO: 3178117 - protein, 20 aa, Giardia lamblia
ILGCHGCQLVGYSELTGGGL

SEQ ID NO: 3178118 - protein, 17 aa, Giardia lamblia
ILKDMLKGKLVWISLPS

SEQ ID NO: 3178119 - protein, 23 aa, Giardia lamblia
ILKEWKRVWYLGGHGGVLIEIAT

SEQ ID NO: 3178120 - protein, 17 aa, Giardia lamblia
ILKHGYEAFTWDNDETK

SEQ ID NO: 3178121 - protein, 21 aa, Giardia lamblia
ILKKRAATILSTYVTKLSFIE

SEQ ID NO: 3178122 - protein, 18 aa, Giardia lamblia
ILKPSWKNSLLLMNQAGF

SEQ ID NO: 3178123 - protein, 18 aa, Giardia lamblia
ILKRLSLYRRGTEPHNQS

SEQ ID NO: 3178124 - protein, 22 aa, Giardia lamblia
ILLEFKPKWIALFNAKLVIENS

SEQ ID NO: 3178125 - protein, 23 aa, Giardia lamblia
ILLKRVPSLIGLHLNNLIDVDAL

SEQ ID NO: 3178126 - protein, 18 aa, Giardia lamblia
ILLYRLMYRRLPFPDNDL

SEQ ID NO: 3178127 - protein, 24 aa, Giardia lamblia
ILMPFTFPVGLFVKLKELSPSIPM

SEQ ID NO: 3178128 - protein, 18 aa, Giardia lamblia
ILNTPAFVEPQMATFIRI

SEQ ID NO: 3178129 - protein, 19 aa, Giardia lamblia
ILRRIPLFADHAFMTIGEV

SEQ ID NO: 3178130 - protein, 20 aa, Giardia lamblia
ILRTWCLRFQAGLHNTDGTT

SEQ ID NO: 3178131 - protein, 17 aa, Giardia lamblia
ILSDFLYCFSKLALYDS

SEQ ID NO: 3178132 - protein, 17 aa, Giardia lamblia
ILSRGYVELALRFLHTL

SEQ ID NO: 3178133 - protein, 23 aa, Giardia lamblia
ILSRQEYKLGLNWRDNHAGVLID

SEQ ID NO: 3178134 - protein, 18 aa, Giardia lamblia
ILYECLTGMPAFMGDVEL

SEQ ID NO: 3178135 - protein, 22 aa, Giardia lamblia
IMELKRALLIKIREIYKIKLGL

SEQ ID NO: 3178136 - protein, 20 aa, Giardia lamblia
IMPICRRLFEITTRLNCVDI

SEQ ID NO: 3178137 - protein, 18 aa, Giardia lamblia
IMTQIKWIVDDDSLHQAL

SEQ ID NO: 3178138 - protein, 19 aa, Giardia lamblia
IMTTPLVDRLCLFMYGIAR

SEQ ID NO: 3178139 - protein, 19 aa, Giardia lamblia
INCGIRFLTVYAFSTENWS

SEQ ID NO: 3178140 - protein, 25 aa, Giardia lamblia
INHDIRPSFIFKLLDHFLSVFPGVA

SEQ ID NO: 3178141 - protein, 22 aa, Giardia lamblia
INIHLKKRFPLLPLDTDRLIFI

SEQ ID NO: 3178142 - protein, 20 aa, Giardia lamblia
INISKLLLVYSVDLTQLNSY

SEQ ID NO: 3178143 - protein, 17 aa, Giardia lamblia
INLEAALPHSSLTDATL

SEQ ID NO: 3178144 - protein, 19 aa, Giardia lamblia
INLFICTQITLSTYSISQD

SEQ ID NO: 3178145 - protein, 18 aa, Giardia lamblia
INQFRMDRILSRQLGAAQ

SEQ ID NO: 3178146 - protein, 21 aa, Giardia lamblia
INRRINIPLILPKNVPTPRFG

SEQ ID NO: 3178147 - protein, 23 aa, Giardia lamblia
INYCYEMVRYLAPFEGGYQDRSG

SEQ ID NO: 3178148 - protein, 20 aa, Giardia lamblia
IPAIKVKWIFSQGTTSEHDD

SEQ ID NO: 3178149 - protein, 22 aa, Giardia lamblia
IPARLRRRMGIVFMDEDPRDAE

SEQ ID NO: 3178150 - protein, 20 aa, Giardia lamblia
IPEFTRPSLMNFSSSQVGNP

SEQ ID NO: 3178151 - protein, 21 aa, Giardia lamblia
IPEILCRRYARQILEAIKHMH

SEQ ID NO: 3178152 - protein, 18 aa, Giardia lamblia
IPEPQIWWLLAQMGSALR

SEQ ID NO: 3178153 - protein, 18 aa, Giardia lamblia
IPESTIWIFAYQLLNALE

SEQ ID NO: 3178154 - protein, 17 aa, Giardia lamblia
IPFKGFAGPNGLLWVTG

SEQ ID NO: 3178155 - protein, 22 aa, Giardia lamblia
IPGWPGSSLIFFSECSGAANYS

SEQ ID NO: 3178156 - protein, 22 aa, Giardia lamblia
IPKSLCWYGNVVPRHKLKTQSR

SEQ ID NO: 3178157 - protein, 19 aa, Giardia lamblia
IPLKITPFLSLNVFTDTIQ

SEQ ID NO: 3178158 - protein, 22 aa, Giardia lamblia
IPPDRPYALGGWKPEFIRERAR

SEQ ID NO: 3178159 - protein, 26 aa, Giardia lamblia
IPPLIKKGTCCLEDLNEIFLSILEST

SEQ ID NO: 3178160 - protein, 18 aa, Giardia lamblia
IPQFALRDLHEWLDSVLN

SEQ ID NO: 3178161 - protein, 18 aa, Giardia lamblia
IPRGVRFFLSISPAAECY

SEQ ID NO: 3178162 - protein, 18 aa, Giardia lamblia
IPRKDWQASISKVCNLCS

SEQ ID NO: 3178163 - protein, 23 aa, Giardia lamblia
IPSASPISHAWGHRVVLNQVTAN

SEQ ID NO: 3178164 - protein, 18 aa, Giardia lamblia
IPSEFGWLKQLRYYWHHN

SEQ ID NO: 3178165 - protein, 24 aa, Giardia lamblia
IPSRKCPYDGWPLILHMAEATQKR

SEQ ID NO: 3178166 - protein, 17 aa, Giardia lamblia
IPTVLCACQICYEGKLK

SEQ ID NO: 3178167 - protein, 21 aa, Giardia lamblia
IPVDARPALISKFSTDPQIRL

SEQ ID NO: 3178168 - protein, 17 aa, Giardia lamblia
IPYLIAIRDHSNISPEE

SEQ ID NO: 3178169 - protein, 19 aa, Giardia lamblia
IQAAYAIRSRWASLLSIVK

SEQ ID NO: 3178170 - protein, 20 aa, Giardia lamblia
IQADALFRRSRHRSDGIEIC

SEQ ID NO: 3178171 - protein, 18 aa, Giardia lamblia
IQAWCLYEAHILGSHSQM

SEQ ID NO: 3178172 - protein, 19 aa, Giardia lamblia
IQCDEFLRRLGIAPEAETI

SEQ ID NO: 3178173 - protein, 17 aa, Giardia lamblia
IQGCLAAGCSAEDVVQC

SEQ ID NO: 3178174 - protein, 25 aa, Giardia lamblia
IQKCLKRLPFVQIYPLPKGCPDPYY

SEQ ID NO: 3178175 - protein, 23 aa, Giardia lamblia
IQKLPWIPGGWMFTADRRVIRLS

SEQ ID NO: 3178176 - protein, 23 aa, Giardia lamblia
IQNLEFVRLYLSNTFEKNDAVKS

SEQ ID NO: 3178177 - protein, 22 aa, Giardia lamblia
IQRKFSCVMYLLNHKIFTKRDL

SEQ ID NO: 3178178 - protein, 18 aa, Giardia lamblia
IRAARLRFFLSRLRAALK

SEQ ID NO: 3178179 - protein, 24 aa, Giardia lamblia
IRAFLECWDSIDVLGRVGEMVGIN

SEQ ID NO: 3178180 - protein, 19 aa, Giardia lamblia
IRATLLMQIFEVLSRFDPR

SEQ ID NO: 3178181 - protein, 20 aa, Giardia lamblia
IRCPRAFRNVIFPSTTELFS

SEQ ID NO: 3178182 - protein, 18 aa, Giardia lamblia
IREAFEWTGPSIVMAYAP

SEQ ID NO: 3178183 - protein, 24 aa, Giardia lamblia
IREIYKIKLGLGIVNTVQDEILKS

SEQ ID NO: 3178184 - protein, 18 aa, Giardia lamblia
IREKCHWMVQCFVEKLVD

SEQ ID NO: 3178185 - protein, 21 aa, Giardia lamblia
IRFANHYLKEMLSLAMNLPPN

SEQ ID NO: 3178186 - protein, 23 aa, Giardia lamblia
IRFEFNIDLCRKLGVIVHPSIGH

SEQ ID NO: 3178187 - protein, 17 aa, Giardia lamblia
IRGRYTLHCLIGKGAFA

SEQ ID NO: 3178188 - protein, 23 aa, Giardia lamblia
IRKLSCRTCGLKSLSNDLSLLEN

SEQ ID NO: 3178189 - protein, 19 aa, Giardia lamblia
IRLARLVMRNMLLLSGKYW

SEQ ID NO: 3178190 - protein, 17 aa, Giardia lamblia
IRLGYPYICPTMSFKNP

SEQ ID NO: 3178191 - protein, 17 aa, Giardia lamblia
IRLLLKKEARMQDRSGM

SEQ ID NO: 3178192 - protein, 17 aa, Giardia lamblia
IRLPFLAHRGWRYYKPI

SEQ ID NO: 3178193 - protein, 21 aa, Giardia lamblia
IRLQLTMARFHFCRQQLNFYR

SEQ ID NO: 3178194 - protein, 20 aa, Giardia lamblia
IRLTALLPYMASVWMHLSAF

SEQ ID NO: 3178195 - protein, 21 aa, Giardia lamblia
IRPSNMWLYNERNMLCLYHTP

SEQ ID NO: 3178196 - protein, 22 aa, Giardia lamblia
IRQLHRYRLFLDQLISIKDREL

SEQ ID NO: 3178197 - protein, 17 aa, Giardia lamblia
IRRLEMQNACFQEALFH

SEQ ID NO: 3178198 - protein, 19 aa, Giardia lamblia
IRRRFEKRIEIVLPDAAAR

SEQ ID NO: 3178199 - protein, 21 aa, Giardia lamblia
IRRYYFVSAHARLLHLFWETI

SEQ ID NO: 3178200 - protein, 17 aa, Giardia lamblia
IRSEGRPLITLPIHPFV

SEQ ID NO: 3178201 - protein, 20 aa, Giardia lamblia
IRTPEQWVGIPFSFASDTFA

SEQ ID NO: 3178202 - protein, 18 aa, Giardia lamblia
IRTVLALKDGSIFPGAQP

SEQ ID NO: 3178203 - protein, 18 aa, Giardia lamblia
IRVFGLRLPEEWKVIVAA

SEQ ID NO: 3178204 - protein, 17 aa, Giardia lamblia
IRWLYAILDHIRAEPDK

SEQ ID NO: 3178205 - protein, 20 aa, Giardia lamblia
ISARFGWLVINLKPAKQTLI

SEQ ID NO: 3178206 - protein, 20 aa, Giardia lamblia
ISCFPYLFPYLSFEKDYQGR

SEQ ID NO: 3178207 - protein, 22 aa, Giardia lamblia
ISCNLCKGYIPPVKDLVLTEWQ

SEQ ID NO: 3178208 - protein, 19 aa, Giardia lamblia
ISDHLFRYMGYVSAYVIIA

SEQ ID NO: 3178209 - protein, 20 aa, Giardia lamblia
ISDLQRWLGCYVYECNFRPI

SEQ ID NO: 3178210 - protein, 18 aa, Giardia lamblia
ISEFPDMHLPLIINVMLG

SEQ ID NO: 3178211 - protein, 23 aa, Giardia lamblia
ISELLCGFFRFYGYQFDSTDSVV

SEQ ID NO: 3178212 - protein, 21 aa, Giardia lamblia
ISETCLLRFLDLYVGQNMNDL

SEQ ID NO: 3178213 - protein, 21 aa, Giardia lamblia
ISFNPKYDWLYAISTDSGIVR

SEQ ID NO: 3178214 - protein, 19 aa, Giardia lamblia
ISGRLGGIPGEGGYPADLT

SEQ ID NO: 3178215 - protein, 20 aa, Giardia lamblia
ISHIRCCFVGKGQLLFTRSS

SEQ ID NO: 3178216 - protein, 23 aa, Giardia lamblia
ISKRIPVIRIRWANYRSAKELAM

SEQ ID NO: 3178217 - protein, 19 aa, Giardia lamblia
ISKVVASKVGFLRAEGSDA

SEQ ID NO: 3178218 - protein, 17 aa, Giardia lamblia
ISLGAADAGVWTVPIDT

SEQ ID NO: 3178219 - protein, 20 aa, Giardia lamblia
ISNDLPLCYCLRRLQQGLVD

SEQ ID NO: 3178220 - protein, 19 aa, Giardia lamblia
ISNIELKYAINVASENRFL

SEQ ID NO: 3178221 - protein, 23 aa, Giardia lamblia
ISRGRRSALLIAMELPRRDCADL

SEQ ID NO: 3178222 - protein, 21 aa, Giardia lamblia
ISRIRYPGLPFMTKPVPRSSL

SEQ ID NO: 3178223 - protein, 20 aa, Giardia lamblia
ISTLRFAQRASFIKNTSSIN

SEQ ID NO: 3178224 - protein, 18 aa, Giardia lamblia
ISTTLGYKVIFPLIKDFV

SEQ ID NO: 3178225 - protein, 26 aa, Giardia lamblia
ISVTLEFKELFAVAIDHGFSVTEMID

SEQ ID NO: 3178226 - protein, 18 aa, Giardia lamblia
ISWSHHWQALHLIGSHPT

SEQ ID NO: 3178227 - protein, 27 aa, Giardia lamblia
ITAFDWPFRIPKAIYRRRLHGSDITAA

SEQ ID NO: 3178228 - protein, 21 aa, Giardia lamblia
ITGNIPLLIRRIRLSFLQLAE

SEQ ID NO: 3178229 - protein, 18 aa, Giardia lamblia
ITKSCLRLEISVTSMDVA

SEQ ID NO: 3178230 - protein, 17 aa, Giardia lamblia
ITLECDEILSGVRDYDT

SEQ ID NO: 3178231 - protein, 22 aa, Giardia lamblia
ITLKCGHTFCKGCLSSKRQKAC

SEQ ID NO: 3178232 - protein, 19 aa, Giardia lamblia
IVAAYCFKDQYYSSNINGM

SEQ ID NO: 3178233 - protein, 17 aa, Giardia lamblia
IVCLCLFSEVFAYLPAH

SEQ ID NO: 3178234 - protein, 23 aa, Giardia lamblia
IVDLKKVYSGFAIDKSSFSTENS

SEQ ID NO: 3178235 - protein, 17 aa, Giardia lamblia
IVELLGLNSSVIISETM

SEQ ID NO: 3178236 - protein, 23 aa, Giardia lamblia
IVENWSSVTSFDWAEANQLAQVD

SEQ ID NO: 3178237 - protein, 17 aa, Giardia lamblia
IVFRLCPVAAIGCRNNS

SEQ ID NO: 3178238 - protein, 20 aa, Giardia lamblia
IVHPEIPYLIAIRDHSNISP

SEQ ID NO: 3178239 - protein, 18 aa, Giardia lamblia
IVISLGFSGIFRPDDIRQ

SEQ ID NO: 3178240 - protein, 18 aa, Giardia lamblia
IVKFRCGRWIWCRPYETT

SEQ ID NO: 3178241 - protein, 22 aa, Giardia lamblia
IVSNCWDELPVLRAKHLSKALK

SEQ ID NO: 3178242 - protein, 18 aa, Giardia lamblia
IVSWTCSTIRGGFKLRFN

SEQ ID NO: 3178243 - protein, 17 aa, Giardia lamblia
IVVPLLFEKGVMVSSYN

SEQ ID NO: 3178244 - protein, 23 aa, Giardia lamblia
IWACACILCEILLMKPLFPGAND

SEQ ID NO: 3178245 - protein, 26 aa, Giardia lamblia
IWCIAAHILLGLSYCHLLCKPDPGSP

SEQ ID NO: 3178246 - protein, 20 aa, Giardia lamblia
IWKPHARPLLSFTGPGRTTG

SEQ ID NO: 3178247 - protein, 20 aa, Giardia lamblia
IYAACGGWGHAPRIYDSASG

SEQ ID NO: 3178248 - protein, 18 aa, Giardia lamblia
IYAHVPWSYPLFQPPVHE

SEQ ID NO: 3178249 - protein, 21 aa, Giardia lamblia
IYAQCTIHWLDLLNYLNARAG

SEQ ID NO: 3178250 - protein, 26 aa, Giardia lamblia
IYARGLEGVRCLRSFLAELKSRPAQL

SEQ ID NO: 3178251 - protein, 24 aa, Giardia lamblia
IYEICLRKKPSFEVLRQERPAFSS

SEQ ID NO: 3178252 - protein, 18 aa, Giardia lamblia
IYEILGIEAARALFIKQI

SEQ ID NO: 3178253 - protein, 18 aa, Giardia lamblia
IYRCPAYRTLARAGVLST

SEQ ID NO: 3178254 - protein, 20 aa, Giardia lamblia
IYRLPFYYRFNINKQTMRCS

SEQ ID NO: 3178255 - protein, 20 aa, Giardia lamblia
IYSICLSLFMAGFYRDLAYL

SEQ ID NO: 3178256 - protein, 19 aa, Giardia lamblia
KAACLPTHMTASSADMPYT

SEQ ID NO: 3178257 - protein, 20 aa, Giardia lamblia
KACIPQDMITVWSPSLSCIQ

SEQ ID NO: 3178258 - protein, 20 aa, Giardia lamblia
KAECIPALLVETAEIDNKGM

SEQ ID NO: 3178259 - protein, 24 aa, Giardia lamblia
KAECMRLKQCLDFNSLPPDAKEVE

SEQ ID NO: 3178260 - protein, 26 aa, Giardia lamblia
KAGIMLNSRFVKLVAWYDNEFGYANK

SEQ ID NO: 3178261 - protein, 21 aa, Giardia lamblia
KAGMLKLSLKMDGDDVVSTVN

SEQ ID NO: 3178262 - protein, 20 aa, Giardia lamblia
KAHMTACGLPVFPQVDRGSR

SEQ ID NO: 3178263 - protein, 17 aa, Giardia lamblia
KAIKEDGSGLGYTALMV

SEQ ID NO: 3178264 - protein, 17 aa, Giardia lamblia
KALFRPISMCVPDFAMI

SEQ ID NO: 3178265 - protein, 17 aa, Giardia lamblia
KALFRPISMCVPQMQLI

SEQ ID NO: 3178266 - protein, 17 aa, Giardia lamblia
KALLAGRPWPGLTNKIF

SEQ ID NO: 3178267 - protein, 18 aa, Giardia lamblia
KALLPVEGIYTFPVPADG

SEQ ID NO: 3178268 - protein, 24 aa, Giardia lamblia
KALNRESWKYAFAMDTSEEEREKG

SEQ ID NO: 3178269 - protein, 24 aa, Giardia lamblia
KARQAAPCVLFFDEIESITQHRGT

SEQ ID NO: 3178270 - protein, 23 aa, Giardia lamblia
KARYSIKHMFVFDIFLGLRIADG

SEQ ID NO: 3178271 - protein, 21 aa, Giardia lamblia
KASARLDSWLDNTMRSLGSFA

SEQ ID NO: 3178272 - protein, 19 aa, Giardia lamblia
KASSCSKCKLLMAQNTALT

SEQ ID NO: 3178273 - protein, 20 aa, Giardia lamblia
KASYKWICIVSVLRIRVGGE

SEQ ID NO: 3178274 - protein, 21 aa, Giardia lamblia
KATQCPLCRAEVSSLIDISDI

SEQ ID NO: 3178275 - protein, 20 aa, Giardia lamblia
KCANGVVLMCHKAAENPLVD

SEQ ID NO: 3178276 - protein, 17 aa, Giardia lamblia
KCDKGWSALMLAVKLRR

SEQ ID NO: 3178277 - protein, 19 aa, Giardia lamblia
KCGTLYWRRTELRTICGDS

SEQ ID NO: 3178278 - protein, 18 aa, Giardia lamblia
KCKMCGSVGTLVRHISFV

SEQ ID NO: 3178279 - protein, 22 aa, Giardia lamblia
KCLIALKTRNCIIFSPHHRAVK

SEQ ID NO: 3178280 - protein, 19 aa, Giardia lamblia
KCLIDLCAAPGSWSQVAAM

SEQ ID NO: 3178281 - protein, 18 aa, Giardia lamblia
KCQLPFCVSCSPLRDQIF

SEQ ID NO: 3178282 - protein, 24 aa, Giardia lamblia
KDCRTVRGKGCIDFAKNDLVVRFI

SEQ ID NO: 3178283 - protein, 23 aa, Giardia lamblia
KDDKGRTALMIAARSGHEDIVMH

SEQ ID NO: 3178284 - protein, 20 aa, Giardia lamblia
KDELRIAFIASEYSSPSRLK

SEQ ID NO: 3178285 - protein, 22 aa, Giardia lamblia
KDEYRAAAALLCCKEELERISR

SEQ ID NO: 3178286 - protein, 17 aa, Giardia lamblia
KDFFTRYHCDAIRNDQK

SEQ ID NO: 3178287 - protein, 24 aa, Giardia lamblia
KDFLRRMCYLVEGIIAGSALFPMQ

SEQ ID NO: 3178288 - protein, 17 aa, Giardia lamblia
KDFSAIIWLIANTVSSE

SEQ ID NO: 3178289 - protein, 20 aa, Giardia lamblia
KDGRIYACKEIEYTKMSSKE

SEQ ID NO: 3178290 - protein, 17 aa, Giardia lamblia
KDIPESTIWIFAYQLLN

SEQ ID NO: 3178291 - protein, 20 aa, Giardia lamblia
KDKIHFCKWISRLQYICRTK

SEQ ID NO: 3178292 - protein, 17 aa, Giardia lamblia
KDKRVVLVTARVHSGEV

SEQ ID NO: 3178293 - protein, 25 aa, Giardia lamblia
KDLCSAICGCLWVYKARRLARAATI

SEQ ID NO: 3178294 - protein, 17 aa, Giardia lamblia
KDLLGIFAAESFFKDMA

SEQ ID NO: 3178295 - protein, 19 aa, Giardia lamblia
KDLYGWSSLIYSCLSNNLQ

SEQ ID NO: 3178296 - protein, 18 aa, Giardia lamblia
KDNGWSCLMTAAKLGNFE

SEQ ID NO: 3178297 - protein, 19 aa, Giardia lamblia
KDPRVCNALEAIQRRYSPD

SEQ ID NO: 3178298 - protein, 19 aa, Giardia lamblia
KDRDSWTSFMVMFAQTLLR

SEQ ID NO: 3178299 - protein, 19 aa, Giardia lamblia
KDRTAYVLADFGLCRVLER

SEQ ID NO: 3178300 - protein, 19 aa, Giardia lamblia
KDSCPYCRTTIKDKDTVDY

SEQ ID NO: 3178301 - protein, 17 aa, Giardia lamblia
KDSDGWTALRCAAQNGK

SEQ ID NO: 3178302 - protein, 17 aa, Giardia lamblia
KDSFGWTALIYAVSNGS

SEQ ID NO: 3178303 - protein, 23 aa, Giardia lamblia
KDSKFPALQIMRWEDVKASTADL

SEQ ID NO: 3178304 - protein, 23 aa, Giardia lamblia
KDSRGRTALMYAASFGKAECIPA

SEQ ID NO: 3178305 - protein, 22 aa, Giardia lamblia
KDWKRYKDAFIFLDRSSNLRQA

SEQ ID NO: 3178306 - protein, 25 aa, Giardia lamblia
KEALKEAVILPMMFPQLFQGKREPW

SEQ ID NO: 3178307 - protein, 17 aa, Giardia lamblia
KEAYRYKLLKNIYTIRA

SEQ ID NO: 3178308 - protein, 19 aa, Giardia lamblia
KEDINTFAMNWCVENLNGN

SEQ ID NO: 3178309 - protein, 23 aa, Giardia lamblia
KEEIIRFNLEWLQTMGIDLDEVT

SEQ ID NO: 3178310 - protein, 20 aa, Giardia lamblia
KEELIEIRVDMVKFLVETFE

SEQ ID NO: 3178311 - protein, 17 aa, Giardia lamblia
KEFRRGYALLRKTEKPL

SEQ ID NO: 3178312 - protein, 21 aa, Giardia lamblia
KEFSSVWAFSPRLMDWTRMNI

SEQ ID NO: 3178313 - protein, 24 aa, Giardia lamblia
KEICMLKEMLARLYAKPEGIQPGS

SEQ ID NO: 3178314 - protein, 19 aa, Giardia lamblia
KEIIDGLAMLAQKRLYFRS

SEQ ID NO: 3178315 - protein, 19 aa, Giardia lamblia
KEIRRRTAYDFSDEDDDTI

SEQ ID NO: 3178316 - protein, 22 aa, Giardia lamblia
KEIYKFLMLIAHLWWKQRTSEA

SEQ ID NO: 3178317 - protein, 22 aa, Giardia lamblia
KELFLRLTARISAPVGVIGGSS

SEQ ID NO: 3178318 - protein, 18 aa, Giardia lamblia
KELIRLILRDGPQAESQN

SEQ ID NO: 3178319 - protein, 21 aa, Giardia lamblia
KELKRRRFLELQDCEREQQRQ

SEQ ID NO: 3178320 - protein, 17 aa, Giardia lamblia
KELRERVSIMSKTLNRG

SEQ ID NO: 3178321 - protein, 21 aa, Giardia lamblia
KELRSYCAVALFTPCSSSQSR

SEQ ID NO: 3178322 - protein, 17 aa, Giardia lamblia
KELRYRITLVAQGHVFR

SEQ ID NO: 3178323 - protein, 20 aa, Giardia lamblia
KELSMFAIAIIKQGLTVSGA

SEQ ID NO: 3178324 - protein, 18 aa, Giardia lamblia
KENCIQCGFCSVQCPHAA

SEQ ID NO: 3178325 - protein, 20 aa, Giardia lamblia
KENTRLRLSLSEMQSQIGHI

SEQ ID NO: 3178326 - protein, 24 aa, Giardia lamblia
KERWRAGQMLDFMVRASGAREIDN

SEQ ID NO: 3178327 - protein, 17 aa, Giardia lamblia
KEVYKQYTLLNELVGLR

SEQ ID NO: 3178328 - protein, 17 aa, Giardia lamblia
KEWELEKQLGFGGTFGI

SEQ ID NO: 3178329 - protein, 20 aa, Giardia lamblia
KEYDIEISRVFTMLLLFVKN

SEQ ID NO: 3178330 - protein, 23 aa, Giardia lamblia
KEYRRIIEISARFAQFIKKNAIL

SEQ ID NO: 3178331 - protein, 18 aa, Giardia lamblia
KFAKVYFEFILKNLPSAT

SEQ ID NO: 3178332 - protein, 18 aa, Giardia lamblia
KFALSLSVSPLFYDPRQR

SEQ ID NO: 3178333 - protein, 17 aa, Giardia lamblia
KFCYEMLNHYYVYDEYT

SEQ ID NO: 3178334 - protein, 19 aa, Giardia lamblia
KFEKARVLFTLSSKMVSEE

SEQ ID NO: 3178335 - protein, 24 aa, Giardia lamblia
KFGYKEGLNLFAFTYDWRQALHIA

SEQ ID NO: 3178336 - protein, 20 aa, Giardia lamblia
KFKIAEETIHFACKSGGNDY

SEQ ID NO: 3178337 - protein, 24 aa, Giardia lamblia
KFLQNLRCLVSFDMSTLLTISIIT

SEQ ID NO: 3178338 - protein, 18 aa, Giardia lamblia
KFLSVFCVDESWRVRHAC

SEQ ID NO: 3178339 - protein, 19 aa, Giardia lamblia
KFRAELYLKMGADAKKDEG

SEQ ID NO: 3178340 - protein, 20 aa, Giardia lamblia
KFRELWAYHERRIAESLRDL

SEQ ID NO: 3178341 - protein, 18 aa, Giardia lamblia
KFRPDFKTFLLARDTMNR

SEQ ID NO: 3178342 - protein, 37 aa, Giardia lamblia
KFVRVQHAFVPWLRRYHGRCRPTFLFFVGGSLKEIVE

SEQ ID NO: 3178343 - protein, 22 aa, Giardia lamblia
KFYRIPLIVGCETYKVTDQIYI

SEQ ID NO: 3178344 - protein, 18 aa, Giardia lamblia
KGAIGMLGRMEMIKEDRM

SEQ ID NO: 3178345 - protein, 19 aa, Giardia lamblia
KGFRILRSVLRKNGCVTAF

SEQ ID NO: 3178346 - protein, 18 aa, Giardia lamblia
KGGNRPALLVSREIESLR

SEQ ID NO: 3178347 - protein, 24 aa, Giardia lamblia
KGHIECLKYLLAESRYCDGQDVTA

SEQ ID NO: 3178348 - protein, 21 aa, Giardia lamblia
KGHKACARFLSKYEEHLTVAY

SEQ ID NO: 3178349 - protein, 24 aa, Giardia lamblia
KGHRRIIQLLARFEAKRQRVSGET

SEQ ID NO: 3178350 - protein, 18 aa, Giardia lamblia
KGKSLDILCESYADSSAA

SEQ ID NO: 3178351 - protein, 23 aa, Giardia lamblia
KGLINMNECFNRVLGSSLLGRLR

SEQ ID NO: 3178352 - protein, 25 aa, Giardia lamblia
KGLSVLDLCLKWALEGVSDFEDLDD

SEQ ID NO: 3178353 - protein, 17 aa, Giardia lamblia
KGNCARCNFRLEPPITY

SEQ ID NO: 3178354 - protein, 18 aa, Giardia lamblia
KGRMGICEMSKLGSALTF

SEQ ID NO: 3178355 - protein, 23 aa, Giardia lamblia
KGRQELIDGLSLFILTGLKKQER

SEQ ID NO: 3178356 - protein, 18 aa, Giardia lamblia
KGSMTGYGKPAGYSALDI

SEQ ID NO: 3178357 - protein, 21 aa, Giardia lamblia
KGTCLRIAGAYWRTGYAREHC

SEQ ID NO: 3178358 - protein, 18 aa, Giardia lamblia
KGVFPINFGERAGCLLEI

SEQ ID NO: 3178359 - protein, 20 aa, Giardia lamblia
KGVLPHYWPRVGNVRGKGGT

SEQ ID NO: 3178360 - protein, 21 aa, Giardia lamblia
KHALFRAAIHYERHLLLQEGF

SEQ ID NO: 3178361 - protein, 18 aa, Giardia lamblia
KHCLELILSEIINANSQC

SEQ ID NO: 3178362 - protein, 20 aa, Giardia lamblia
KHCPEQLVWSIIRQVAEAFN

SEQ ID NO: 3178363 - protein, 21 aa, Giardia lamblia
KHEPIWFCEGLPFHERPFFAT

SEQ ID NO: 3178364 - protein, 17 aa, Giardia lamblia
KHGYEAFTWDNDETKVK

SEQ ID NO: 3178365 - protein, 20 aa, Giardia lamblia
KHHYGSFCMPNLPAKDPSNV

SEQ ID NO: 3178366 - protein, 19 aa, Giardia lamblia
KHLGGWAIIFNLAESSPSA

SEQ ID NO: 3178367 - protein, 20 aa, Giardia lamblia
KHPFRLSFDINHHQPEKLEA

SEQ ID NO: 3178368 - protein, 25 aa, Giardia lamblia
KHSPRLCPATTLWAQYRCCRPVADL

SEQ ID NO: 3178369 - protein, 21 aa, Giardia lamblia
KIANLIKRWLHVIVVKLSDVV

SEQ ID NO: 3178370 - protein, 25 aa, Giardia lamblia
KIEEDFKEGRVCPATAYIPLPQDLA

SEQ ID NO: 3178371 - protein, 17 aa, Giardia lamblia
KIFKKFFYYYGFYLGNI

SEQ ID NO: 3178372 - protein, 19 aa, Giardia lamblia
KIGCTPLMFAAGGGHKELV

SEQ ID NO: 3178373 - protein, 23 aa, Giardia lamblia
KIGTAVCYRVFKAYLYGAMGLVK

SEQ ID NO: 3178374 - protein, 19 aa, Giardia lamblia
KIIICGGMSFTFLKKLKGM

SEQ ID NO: 3178375 - protein, 19 aa, Giardia lamblia
KIILLKYWLGNAVKSLYNP

SEQ ID NO: 3178376 - protein, 23 aa, Giardia lamblia
KIIQRLPAMIGRHNFMDAEQALE

SEQ ID NO: 3178377 - protein, 19 aa, Giardia lamblia
KIKFGRKALNESYQLDKDK

SEQ ID NO: 3178378 - protein, 17 aa, Giardia lamblia
KILYVLCQYSPRLIMNL

SEQ ID NO: 3178379 - protein, 18 aa, Giardia lamblia
KIMRISSCFIKRHPEELD

SEQ ID NO: 3178380 - protein, 19 aa, Giardia lamblia
KIPLLWGPMANEFEKVQKS

SEQ ID NO: 3178381 - protein, 19 aa, Giardia lamblia
KIPVPIAMILSVLRQVAAA

SEQ ID NO: 3178382 - protein, 25 aa, Giardia lamblia
KIQACKLPALGMCKIYYSHPRAGTV

SEQ ID NO: 3178383 - protein, 19 aa, Giardia lamblia
KIQELYAYFNFQLNSIISH

SEQ ID NO: 3178384 - protein, 18 aa, Giardia lamblia
KIRAAFVINKVIRLLYNV

SEQ ID NO: 3178385 - protein, 23 aa, Giardia lamblia
KIRCPTCQAVEFCSGFCSLEQNT

SEQ ID NO: 3178386 - protein, 22 aa, Giardia lamblia
KIRELCDLYPILLGTTSAELDT

SEQ ID NO: 3178387 - protein, 19 aa, Giardia lamblia
KIRGDGCLKPIASLPINEL

SEQ ID NO: 3178388 - protein, 25 aa, Giardia lamblia
KIRKEVFAVILIRCGHCIRPDVVME

SEQ ID NO: 3178389 - protein, 17 aa, Giardia lamblia
KKDHPVFSFGSMSASTT

SEQ ID NO: 3178390 - protein, 19 aa, Giardia lamblia
KKEALRITASIKHMAGHLI

SEQ ID NO: 3178391 - protein, 17 aa, Giardia lamblia
KKEVCDLTARLREVEMQ

SEQ ID NO: 3178392 - protein, 19 aa, Giardia lamblia
KKGRTALMYAAKRGSHGLV

SEQ ID NO: 3178393 - protein, 19 aa, Giardia lamblia
KKKECLILIEEYCRAKGVN

SEQ ID NO: 3178394 - protein, 18 aa, Giardia lamblia
KKNLPVCRLVARSCFNAY

SEQ ID NO: 3178395 - protein, 21 aa, Giardia lamblia
KKPMCVRGCPVQVPIPQFIKK

SEQ ID NO: 3178396 - protein, 18 aa, Giardia lamblia
KKRGLPIPECYFTRINEL

SEQ ID NO: 3178397 - protein, 24 aa, Giardia lamblia
KKSGVPDWVPWVSFTESLQPLTTD

SEQ ID NO: 3178398 - protein, 22 aa, Giardia lamblia
KKVAKEYPEFITAVGTNTCIMT

SEQ ID NO: 3178399 - protein, 19 aa, Giardia lamblia
KKVHAVIHMPWFVNPDAGR

SEQ ID NO: 3178400 - protein, 21 aa, Giardia lamblia
KKVYRNSANFARQIGVSTHDP

SEQ ID NO: 3178401 - protein, 17 aa, Giardia lamblia
KKYFLDKGWVVNPDKDT

SEQ ID NO: 3178402 - protein, 18 aa, Giardia lamblia
KKYIQMIGLMIFDELHLV

SEQ ID NO: 3178403 - protein, 20 aa, Giardia lamblia
KLAEVWAMSFVPGRYESIED

SEQ ID NO: 3178404 - protein, 17 aa, Giardia lamblia
KLASLKKTYVDITSLIE

SEQ ID NO: 3178405 - protein, 20 aa, Giardia lamblia
KLCDCWCGGISMSATIDETN

SEQ ID NO: 3178406 - protein, 18 aa, Giardia lamblia
KLDGRLRGFAFVQYATEK

SEQ ID NO: 3178407 - protein, 21 aa, Giardia lamblia
KLDVSSCIPILLPYLSDCRRD

SEQ ID NO: 3178408 - protein, 20 aa, Giardia lamblia
KLEKAHLFRTLRVLDLSNNL

SEQ ID NO: 3178409 - protein, 24 aa, Giardia lamblia
KLHKEMPDVIGFIFILKALYRPSW

SEQ ID NO: 3178410 - protein, 18 aa, Giardia lamblia
KLIKCLLFTLIVPDVSGV

SEQ ID NO: 3178411 - protein, 21 aa, Giardia lamblia
KLKAALLELGRRYKALQATGV

SEQ ID NO: 3178412 - protein, 19 aa, Giardia lamblia
KLKLEEEIHRRTKLSSEVD

SEQ ID NO: 3178413 - protein, 18 aa, Giardia lamblia
KLKSLRIAMRCGYTALME

SEQ ID NO: 3178414 - protein, 17 aa, Giardia lamblia
KLKSMLIELKRSFNQGN

SEQ ID NO: 3178415 - protein, 21 aa, Giardia lamblia
KLLCGRQHLFLSLCDLVVHLP

SEQ ID NO: 3178416 - protein, 18 aa, Giardia lamblia
KLLFAVLVAIRIKHHAGD

SEQ ID NO: 3178417 - protein, 19 aa, Giardia lamblia
KLMEKLDCYQNDITEFTEK

SEQ ID NO: 3178418 - protein, 22 aa, Giardia lamblia
KLPEDRLSAALAQDRVQRRSSS

SEQ ID NO: 3178419 - protein, 21 aa, Giardia lamblia
KLRASLRVLLAFKEDFECELK

SEQ ID NO: 3178420 - protein, 24 aa, Giardia lamblia
KLRNWKFNCCSALMMAAWHGHTNI

SEQ ID NO: 3178421 - protein, 19 aa, Giardia lamblia
KLRYLMPLVLDRLYTYQHF

SEQ ID NO: 3178422 - protein, 19 aa, Giardia lamblia
KLSALLSVSSYSVFINNRS

SEQ ID NO: 3178423 - protein, 25 aa, Giardia lamblia
KLSCLPRYLFSLPLSSIVCQILNTM

SEQ ID NO: 3178424 - protein, 19 aa, Giardia lamblia
KLSEIKRWLFAFRRDVLAD

SEQ ID NO: 3178425 - protein, 24 aa, Giardia lamblia
KLSNPEWVRYIFLPAHIYVSAMGI

SEQ ID NO: 3178426 - protein, 18 aa, Giardia lamblia
KLTSQFFKGRYFKTDADS

SEQ ID NO: 3178427 - protein, 19 aa, Giardia lamblia
KLVAALGMNSARRLVQSAH

SEQ ID NO: 3178428 - protein, 19 aa, Giardia lamblia
KLVDDIRAGIVVLDDNLSA

SEQ ID NO: 3178429 - protein, 21 aa, Giardia lamblia
KLWGLLLFREVIFFQFCRCLA

SEQ ID NO: 3178430 - protein, 23 aa, Giardia lamblia
KMIKECFKDSGVVINEIYDGSKS

SEQ ID NO: 3178431 - protein, 18 aa, Giardia lamblia
KMYMELFDQLPLVAIIDE

SEQ ID NO: 3178432 - protein, 23 aa, Giardia lamblia
KNARPIRPLVRIRESDLDVCDLT

SEQ ID NO: 3178433 - protein, 20 aa, Giardia lamblia
KNERVCIILTTYAMISNDGE

SEQ ID NO: 3178434 - protein, 22 aa, Giardia lamblia
KNFQWLYDFSRYIMTVLFSDKF

SEQ ID NO: 3178435 - protein, 25 aa, Giardia lamblia
KNISRFPVRFQWLLQMAQGSDKFKY

SEQ ID NO: 3178436 - protein, 24 aa, Giardia lamblia
KNNYRLARLLARWEGGYQNTHGMT

SEQ ID NO: 3178437 - protein, 20 aa, Giardia lamblia
KNSQTFCMFSNYVLSRGNAS

SEQ ID NO: 3178438 - protein, 17 aa, Giardia lamblia
KPAFVRILLPLEHTLCL

SEQ ID NO: 3178439 - protein, 18 aa, Giardia lamblia
KPELCAKTAKSLASDIRK

SEQ ID NO: 3178440 - protein, 23 aa, Giardia lamblia
KPHSSLRVGFRFVSNSILTTKLR

SEQ ID NO: 3178441 - protein, 17 aa, Giardia lamblia
KPIPKRLVLSLVRDLAN

SEQ ID NO: 3178442 - protein, 21 aa, Giardia lamblia
KPKLRHCFNFPAKHVGSPSSL

SEQ ID NO: 3178443 - protein, 19 aa, Giardia lamblia
KPKPVAYVVCDSRDQAKEL

SEQ ID NO: 3178444 - protein, 18 aa, Giardia lamblia
KPQRLSWHGITNVKQGGT

SEQ ID NO: 3178445 - protein, 27 aa, Giardia lamblia
KPSIAEVFFSYRFFDVYGESLTDPPQY

SEQ ID NO: 3178446 - protein, 17 aa, Giardia lamblia
KPYPKFSALSDHLSAPL

SEQ ID NO: 3178447 - protein, 17 aa, Giardia lamblia
KPYRLSSILIDLTNTLL

SEQ ID NO: 3178448 - protein, 22 aa, Giardia lamblia
KPYVPFDWKELYGLNLENALAR

SEQ ID NO: 3178449 - protein, 24 aa, Giardia lamblia
KQDRPRAGVKFDRNFKSLLESMDD

SEQ ID NO: 3178450 - protein, 20 aa, Giardia lamblia
KQENLRLVTALSDYESIITE

SEQ ID NO: 3178451 - protein, 20 aa, Giardia lamblia
KQGCLFSMGFSWRVSEAPIV

SEQ ID NO: 3178452 - protein, 18 aa, Giardia lamblia
KQLPPWRGLIDEPNVDLP

SEQ ID NO: 3178453 - protein, 22 aa, Giardia lamblia
KQNELWHSFVWNYDRLPYSADF

SEQ ID NO: 3178454 - protein, 22 aa, Giardia lamblia
KQNRDGWSALMFAAQQGNMRAV

SEQ ID NO: 3178455 - protein, 19 aa, Giardia lamblia
KQPRTVYVAGWTPNLSAIK

SEQ ID NO: 3178456 - protein, 20 aa, Giardia lamblia
KQRINNCLDELVAARTESAE

SEQ ID NO: 3178457 - protein, 24 aa, Giardia lamblia
KQTFPQRLIFSIIRQVAMGLAHLH

SEQ ID NO: 3178458 - protein, 19 aa, Giardia lamblia
KRAACRRYQFELGVPLQHP

SEQ ID NO: 3178459 - protein, 21 aa, Giardia lamblia
KRALRCFGEGLGNNITSDSAT

SEQ ID NO: 3178460 - protein, 22 aa, Giardia lamblia
KRARVGLGYGRWVEGLAEADVF

SEQ ID NO: 3178461 - protein, 19 aa, Giardia lamblia
KRCQEFYGNVAMYNLSPVM

SEQ ID NO: 3178462 - protein, 20 aa, Giardia lamblia
KRDAVVLVLDFLRAEGYVTA

SEQ ID NO: 3178463 - protein, 21 aa, Giardia lamblia
KREAIEMTRLIAIANSVYSLI

SEQ ID NO: 3178464 - protein, 18 aa, Giardia lamblia
KREDMTMCIVIRQTTSIL

SEQ ID NO: 3178465 - protein, 19 aa, Giardia lamblia
KRFAQQFCKGIKRAQVPLY

SEQ ID NO: 3178466 - protein, 18 aa, Giardia lamblia
KRGAFMLEHIAKISDKNN

SEQ ID NO: 3178467 - protein, 20 aa, Giardia lamblia
KRGRTALMYAAECGYLAAID

SEQ ID NO: 3178468 - protein, 23 aa, Giardia lamblia
KRGSLEIVELLAPKESGMLNSEG

SEQ ID NO: 3178469 - protein, 21 aa, Giardia lamblia
KRHICPKCGTLYWRRTELRTI

SEQ ID NO: 3178470 - protein, 19 aa, Giardia lamblia
KRIEPAVAIMHLGLVLCTL

SEQ ID NO: 3178471 - protein, 20 aa, Giardia lamblia
KRIFLPPVFLTLLLEITRYE

SEQ ID NO: 3178472 - protein, 21 aa, Giardia lamblia
KRIGDCFLWEIPLYKCMLLWN

SEQ ID NO: 3178473 - protein, 24 aa, Giardia lamblia
KRIIKHRIGYFITRFNIEGDLQKT

SEQ ID NO: 3178474 - protein, 18 aa, Giardia lamblia
KRIPVINALTRYGRRFLS

SEQ ID NO: 3178475 - protein, 17 aa, Giardia lamblia
KRIWVPRLYVHFWGEDP

SEQ ID NO: 3178476 - protein, 17 aa, Giardia lamblia
KRLGCSYQTLTIGNEER

SEQ ID NO: 3178477 - protein, 19 aa, Giardia lamblia
KRLKSFKVDARSRSPEDID

SEQ ID NO: 3178478 - protein, 22 aa, Giardia lamblia
KRLPCTTIRLLLEYCSGGNCVK

SEQ ID NO: 3178479 - protein, 20 aa, Giardia lamblia
KRLSLAVVRILAPFECGEVH

SEQ ID NO: 3178480 - protein, 20 aa, Giardia lamblia
KRLSNFLPWHLAYAEIIFSD

SEQ ID NO: 3178481 - protein, 24 aa, Giardia lamblia
KRPECARLLLEYEGSMKHNGMNVL

SEQ ID NO: 3178482 - protein, 21 aa, Giardia lamblia
KRPPVELLLDYALLHTPALVQ

SEQ ID NO: 3178483 - protein, 17 aa, Giardia lamblia
KRPVSNFAKTVEKKAQL

SEQ ID NO: 3178484 - protein, 27 aa, Giardia lamblia
KRQKACKICRLRYRITPNINICLHHIV

SEQ ID NO: 3178485 - protein, 17 aa, Giardia lamblia
KRRLEELQRSCRRSYRQ

SEQ ID NO: 3178486 - protein, 19 aa, Giardia lamblia
KRRLEKRIYIPLPDFESRK

SEQ ID NO: 3178487 - protein, 18 aa, Giardia lamblia
KRRSLCYPLLLLQLFSSR

SEQ ID NO: 3178488 - protein, 20 aa, Giardia lamblia
KRSATPVAVGAPWPSSYESA

SEQ ID NO: 3178489 - protein, 20 aa, Giardia lamblia
KRSSSCILFGGVHRAQMSPW

SEQ ID NO: 3178490 - protein, 20 aa, Giardia lamblia
KRTGFIFTVHDKLDFQRFYR

SEQ ID NO: 3178491 - protein, 23 aa, Giardia lamblia
KRTHKEMMRMRFLEAQISKLDSE

SEQ ID NO: 3178492 - protein, 24 aa, Giardia lamblia
KRYIARLMGPLSIYPYWKGAPVTA

SEQ ID NO: 3178493 - protein, 23 aa, Giardia lamblia
KSCIPKLLVQFGLLKNNDGLTAA

SEQ ID NO: 3178494 - protein, 23 aa, Giardia lamblia
KSDRLKVSLVLSVPKTGPSAEET

SEQ ID NO: 3178495 - protein, 20 aa, Giardia lamblia
KSGATGLQFKEMVGINSGLL

SEQ ID NO: 3178496 - protein, 18 aa, Giardia lamblia
KSGSVAKFLPSVVPSSAV

SEQ ID NO: 3178497 - protein, 22 aa, Giardia lamblia
KSIPILLQYEARFMKETGKDPL

SEQ ID NO: 3178498 - protein, 17 aa, Giardia lamblia
KSISLKVPFRLGNVQPT

SEQ ID NO: 3178499 - protein, 19 aa, Giardia lamblia
KSKRLLLKLMRSDYVEYGQ

SEQ ID NO: 3178500 - protein, 17 aa, Giardia lamblia
KSLAPWSRDFIKRVEQL

SEQ ID NO: 3178501 - protein, 20 aa, Giardia lamblia
KSLKQLLAWSKAYANSKLVT

SEQ ID NO: 3178502 - protein, 20 aa, Giardia lamblia
KSLLRPGARVGPPLPMNFGK

SEQ ID NO: 3178503 - protein, 18 aa, Giardia lamblia
KSLNWLVSFVDNVFRARH

SEQ ID NO: 3178504 - protein, 21 aa, Giardia lamblia
KSNLLVVLTFKFNSFKENQRR

SEQ ID NO: 3178505 - protein, 20 aa, Giardia lamblia
KSPSEYRFTLSIVKEQPEFR

SEQ ID NO: 3178506 - protein, 18 aa, Giardia lamblia
KSRCPGYLIYPGHGPLAS

SEQ ID NO: 3178507 - protein, 22 aa, Giardia lamblia
KSRGRMPVFTALSVEDEVQERT

SEQ ID NO: 3178508 - protein, 19 aa, Giardia lamblia
KSSICSRFAKDFFATSYKQ

SEQ ID NO: 3178509 - protein, 24 aa, Giardia lamblia
KSTCVWRLLIILKEIYGVDVSHGM

SEQ ID NO: 3178510 - protein, 18 aa, Giardia lamblia
KSYYRCAFFNCPARRTIT

SEQ ID NO: 3178511 - protein, 18 aa, Giardia lamblia
KTADGLAIMLAKTPEMQQ

SEQ ID NO: 3178512 - protein, 19 aa, Giardia lamblia
KTALMAAAFCGHLQVVRFL

SEQ ID NO: 3178513 - protein, 19 aa, Giardia lamblia
KTDMLLRSATGWFTAIANG

SEQ ID NO: 3178514 - protein, 19 aa, Giardia lamblia
KTDSLRWGLTGGKPYLRNI

SEQ ID NO: 3178515 - protein, 23 aa, Giardia lamblia
KTEKRFTQFWSFFADSYNDYLKL

SEQ ID NO: 3178516 - protein, 24 aa, Giardia lamblia
KTEMKELLTELGLLRERLIQEAAR

SEQ ID NO: 3178517 - protein, 18 aa, Giardia lamblia
KTFKCAMAGSVLQPNVRI

SEQ ID NO: 3178518 - protein, 17 aa, Giardia lamblia
KTFSEPFLWAILLDISS

SEQ ID NO: 3178519 - protein, 22 aa, Giardia lamblia
KTFWARLCLSWIAFRRAPRNDP

SEQ ID NO: 3178520 - protein, 20 aa, Giardia lamblia
KTFWRELANLISPEKQVLWK

SEQ ID NO: 3178521 - protein, 17 aa, Giardia lamblia
KTKHIVFCDDKRIDISR

SEQ ID NO: 3178522 - protein, 17 aa, Giardia lamblia
KTPAFEIHKDFRLYLTT

SEQ ID NO: 3178523 - protein, 17 aa, Giardia lamblia
KTVESLRGMPAFTITSL

SEQ ID NO: 3178524 - protein, 19 aa, Giardia lamblia
KTVLCQMCRSLATMGKTHL

SEQ ID NO: 3178525 - protein, 17 aa, Giardia lamblia
KVAFQVTFCYSFINAEV

SEQ ID NO: 3178526 - protein, 17 aa, Giardia lamblia
KVCREKLNFLYLIYSYI

SEQ ID NO: 3178527 - protein, 18 aa, Giardia lamblia
KVEFVRYLLSAVMSDEEI

SEQ ID NO: 3178528 - protein, 18 aa, Giardia lamblia
KVIKDDKCICIVMDRYDC

SEQ ID NO: 3178529 - protein, 18 aa, Giardia lamblia
KVKFARPALRRNLEEGVD

SEQ ID NO: 3178530 - protein, 17 aa, Giardia lamblia
KVLFPNDRVMIINHNTK

SEQ ID NO: 3178531 - protein, 17 aa, Giardia lamblia
KVLLCVDCTELSSDIDV

SEQ ID NO: 3178532 - protein, 19 aa, Giardia lamblia
KVPCGDAFIVDFDDQTVTR

SEQ ID NO: 3178533 - protein, 21 aa, Giardia lamblia
KVRFWFYFRVANITPKLPYIF

SEQ ID NO: 3178534 - protein, 17 aa, Giardia lamblia
KVRGLCLNTIFDPSFVS

SEQ ID NO: 3178535 - protein, 25 aa, Giardia lamblia
KVSLIKCTVCGLGVDISAAQPGSLV

SEQ ID NO: 3178536 - protein, 25 aa, Giardia lamblia
KVVALKLCLKFSLNCKEYFVNTYKS

SEQ ID NO: 3178537 - protein, 20 aa, Giardia lamblia
KVVFTCLSYYLLKRHVIEDS

SEQ ID NO: 3178538 - protein, 19 aa, Giardia lamblia
KVVWFSGFSYPQAFLTGIL

SEQ ID NO: 3178539 - protein, 20 aa, Giardia lamblia
KWRVKGLKALYLLVQELLYA

SEQ ID NO: 3178540 - protein, 20 aa, Giardia lamblia
KWVRNSIMARCCGVDIHTYM

SEQ ID NO: 3178541 - protein, 18 aa, Giardia lamblia
KYCRHPLTGSAWCIYPSY

SEQ ID NO: 3178542 - protein, 25 aa, Giardia lamblia
KYGSFKCAFSYIFQYFLREEILYSP

SEQ ID NO: 3178543 - protein, 19 aa, Giardia lamblia
KYHHARSIILIGVPYLYSG

SEQ ID NO: 3178544 - protein, 20 aa, Giardia lamblia
KYISLLFCDGFAAPATPNTT

SEQ ID NO: 3178545 - protein, 22 aa, Giardia lamblia
KYKRIRLATLQKWIETAMTVLA

SEQ ID NO: 3178546 - protein, 18 aa, Giardia lamblia
KYLDGFICITGRTLRVFD

SEQ ID NO: 3178547 - protein, 18 aa, Giardia lamblia
KYLRALVLSAKFGALKEL

SEQ ID NO: 3178548 - protein, 20 aa, Giardia lamblia
KYQRVVWREGLLYIFMKRYS

SEQ ID NO: 3178549 - protein, 20 aa, Giardia lamblia
KYRSVCGSLNLFVYLSDTTL

SEQ ID NO: 3178550 - protein, 20 aa, Giardia lamblia
KYSYPCLKPLASYYIDLLDR

SEQ ID NO: 3178551 - protein, 24 aa, Giardia lamblia
LAACKKREIGWGFKCPQEEKTGYC

SEQ ID NO: 3178552 - protein, 24 aa, Giardia lamblia
LAADTRLAAAFVHLHSLRNKKGET

SEQ ID NO: 3178553 - protein, 23 aa, Giardia lamblia
LAAGIKIKTGFGLESRQGVDVDF

SEQ ID NO: 3178554 - protein, 17 aa, Giardia lamblia
LACVLFGGRIKDERGRK

SEQ ID NO: 3178555 - protein, 18 aa, Giardia lamblia
LADLFIKREEEIYAATEG

SEQ ID NO: 3178556 - protein, 21 aa, Giardia lamblia
LAENCRLFWKSHGSQSGEPGP

SEQ ID NO: 3178557 - protein, 19 aa, Giardia lamblia
LAERVRFSLILKEDYYHML

SEQ ID NO: 3178558 - protein, 24 aa, Giardia lamblia
LAFACLNLPSLVCLNLRDNFIGSK

SEQ ID NO: 3178559 - protein, 23 aa, Giardia lamblia
LAHFAEWPDVIFVIFDDVPLTVT

SEQ ID NO: 3178560 - protein, 18 aa, Giardia lamblia
LAHPFRLPRELTLQQDTL

SEQ ID NO: 3178561 - protein, 18 aa, Giardia lamblia
LAHRCLPKTVSVYNNPLT

SEQ ID NO: 3178562 - protein, 18 aa, Giardia lamblia
LAKKAEAPLLLWPINPMN

SEQ ID NO: 3178563 - protein, 19 aa, Giardia lamblia
LALACYVNYGRLFFSSKSA

SEQ ID NO: 3178564 - protein, 23 aa, Giardia lamblia
LALEAFAGLDFVALFVVPTTHLL

SEQ ID NO: 3178565 - protein, 17 aa, Giardia lamblia
LALSLSLHGMPHDRVFG

SEQ ID NO: 3178566 - protein, 20 aa, Giardia lamblia
LALSSVVSWELLPKMLDDLM

SEQ ID NO: 3178567 - protein, 24 aa, Giardia lamblia
LALTPRAKYGLGLVLPHHYYDEMH

SEQ ID NO: 3178568 - protein, 18 aa, Giardia lamblia
LAPGKGFNTEDDWITYIK

SEQ ID NO: 3178569 - protein, 18 aa, Giardia lamblia
LARNRCSRCHNVWYCGRK

SEQ ID NO: 3178570 - protein, 17 aa, Giardia lamblia
LARRLVTEIKRSEVASA

SEQ ID NO: 3178571 - protein, 24 aa, Giardia lamblia
LASIKDSISFIRRCAEATVEGGED

SEQ ID NO: 3178572 - protein, 18 aa, Giardia lamblia
LAVDSGYYFSVRKRILKN

SEQ ID NO: 3178573 - protein, 19 aa, Giardia lamblia
LAYLACLSRVWGLELDIQN

SEQ ID NO: 3178574 - protein, 21 aa, Giardia lamblia
LCAILGSLLCKPEAVFTTLDR

SEQ ID NO: 3178575 - protein, 20 aa, Giardia lamblia
LCALGDVIAALSRKKVASYV

SEQ ID NO: 3178576 - protein, 18 aa, Giardia lamblia
LCALQPPFVASNMDSLKA

SEQ ID NO: 3178577 - protein, 18 aa, Giardia lamblia
LCDIGRSTVLLKWKKKQY

SEQ ID NO: 3178578 - protein, 18 aa, Giardia lamblia
LCDLCTSGVQPFESKDYQ

SEQ ID NO: 3178579 - protein, 23 aa, Giardia lamblia
LCDLWLRYMTMYSVNGKTAMANI

SEQ ID NO: 3178580 - protein, 24 aa, Giardia lamblia
LCEHCSLNIKKMCPICRHTVTDTI

SEQ ID NO: 3178581 - protein, 19 aa, Giardia lamblia
LCELRQFIVSMFVPEEYQR

SEQ ID NO: 3178582 - protein, 22 aa, Giardia lamblia
LCETMRMAAEMGLGVPYLVSGS

SEQ ID NO: 3178583 - protein, 25 aa, Giardia lamblia
LCFGLRLAELLDWPHIFASSRTGAF

SEQ ID NO: 3178584 - protein, 20 aa, Giardia lamblia
LCFLPGIGAPLNWVGSTFPA

SEQ ID NO: 3178585 - protein, 19 aa, Giardia lamblia
LCGEYGLKCKREIYRARYM

SEQ ID NO: 3178586 - protein, 18 aa, Giardia lamblia
LCGLRLGLQTNTAFNPDG

SEQ ID NO: 3178587 - protein, 17 aa, Giardia lamblia
LCLLPKMRFVAAACRDP

SEQ ID NO: 3178588 - protein, 21 aa, Giardia lamblia
LCLSGTDFIEWLLTEDSASTY

SEQ ID NO: 3178589 - protein, 22 aa, Giardia lamblia
LCPSLPLRYLFSVNSIFPELGY

SEQ ID NO: 3178590 - protein, 26 aa, Giardia lamblia
LCSGCPLNSRRVCLINIPPSGVVALN

SEQ ID NO: 3178591 - protein, 18 aa, Giardia lamblia
LCTIIKPLFFFLDPYHRK

SEQ ID NO: 3178592 - protein, 17 aa, Giardia lamblia
LCTISGLAQFEYLLPKA

SEQ ID NO: 3178593 - protein, 17 aa, Giardia lamblia
LCTNSKFTAGAGLTALM

SEQ ID NO: 3178594 - protein, 21 aa, Giardia lamblia
LCYRYTPAVSLDFENFCEKKI

SEQ ID NO: 3178595 - protein, 19 aa, Giardia lamblia
LDAALSVVCGELFLQQHPD

SEQ ID NO: 3178596 - protein, 24 aa, Giardia lamblia
LDCARAGVCFGGVLILHEDMNTTW

SEQ ID NO: 3178597 - protein, 23 aa, Giardia lamblia
LDCVKQLIPWEAWVLNEYNRLPS

SEQ ID NO: 3178598 - protein, 20 aa, Giardia lamblia
LDELCTLAWTTHVELLLTIA

SEQ ID NO: 3178599 - protein, 24 aa, Giardia lamblia
LDEYAFKLAHDFLYDPCCAAAFSM

SEQ ID NO: 3178600 - protein, 18 aa, Giardia lamblia
LDFRRLRSLLPSFDLPHF

SEQ ID NO: 3178601 - protein, 20 aa, Giardia lamblia
LDGFNCTLFAYGQTGTGKTY

SEQ ID NO: 3178602 - protein, 18 aa, Giardia lamblia
LDGKFPIHILRSVVDHFN

SEQ ID NO: 3178603 - protein, 17 aa, Giardia lamblia
LDGLIAFCIEYKGSRSL

SEQ ID NO: 3178604 - protein, 24 aa, Giardia lamblia
LDHLKVATLLLNWEGLDISVYSSE

SEQ ID NO: 3178605 - protein, 17 aa, Giardia lamblia
LDHPLSFGTQTGVQVLD

SEQ ID NO: 3178606 - protein, 22 aa, Giardia lamblia
LDHRRYEIVVAIRGSYSLADMV

SEQ ID NO: 3178607 - protein, 21 aa, Giardia lamblia
LDICKAVSAATGFPSPESCNY

SEQ ID NO: 3178608 - protein, 19 aa, Giardia lamblia
LDKAVSWNWRMFAGQGSSV

SEQ ID NO: 3178609 - protein, 19 aa, Giardia lamblia
LDKYWRVIFFGAYLEMLQG

SEQ ID NO: 3178610 - protein, 17 aa, Giardia lamblia
LDLDLEEVASCFYPEKA

SEQ ID NO: 3178611 - protein, 22 aa, Giardia lamblia
LDLECSLWGPARVKLEEPNLAI

SEQ ID NO: 3178612 - protein, 20 aa, Giardia lamblia
LDLLQFILLPHKQYFADDEH

SEQ ID NO: 3178613 - protein, 17 aa, Giardia lamblia
LDLRTCIWMHWAQIQAL

SEQ ID NO: 3178614 - protein, 17 aa, Giardia lamblia
LDPALLRTGRADRKIFM

SEQ ID NO: 3178615 - protein, 21 aa, Giardia lamblia
LDPNGLCVHRLYRDSCIQSNG

SEQ ID NO: 3178616 - protein, 24 aa, Giardia lamblia
LDPRITFPTVLEMRSAPEIVPHEN

SEQ ID NO: 3178617 - protein, 26 aa, Giardia lamblia
LDPRRRPAPRMKEVFSIGTHDLDIQS

SEQ ID NO: 3178618 - protein, 21 aa, Giardia lamblia
LDQRGRSAIYYATDGSVYKDV

SEQ ID NO: 3178619 - protein, 17 aa, Giardia lamblia
LDRILVYRGLHIKQSAI

SEQ ID NO: 3178620 - protein, 19 aa, Giardia lamblia
LDRLRALVISRGIEIANMD

SEQ ID NO: 3178621 - protein, 18 aa, Giardia lamblia
LDRRKDISGMKFMINTVS

SEQ ID NO: 3178622 - protein, 19 aa, Giardia lamblia
LDVGSWVRLQYALRLMRDR

SEQ ID NO: 3178623 - protein, 18 aa, Giardia lamblia
LDVLLQVKWCLKEFDCDL

SEQ ID NO: 3178624 - protein, 17 aa, Giardia lamblia
LDWLKVRLQASLKIKED

SEQ ID NO: 3178625 - protein, 20 aa, Giardia lamblia
LDYIFLLELFHAIECKSETK

SEQ ID NO: 3178626 - protein, 18 aa, Giardia lamblia
LEADFGFADESGFLVPVA

SEQ ID NO: 3178627 - protein, 20 aa, Giardia lamblia
LEAIYPLLSWVPQRSKAYLE

SEQ ID NO: 3178628 - protein, 18 aa, Giardia lamblia
LEALKAVLLLPYAVYSRK

SEQ ID NO: 3178629 - protein, 17 aa, Giardia lamblia
LEARAGIIAAANPVSGQ

SEQ ID NO: 3178630 - protein, 20 aa, Giardia lamblia
LEARAGSLLHDLKLTEEERD

SEQ ID NO: 3178631 - protein, 25 aa, Giardia lamblia
LEAVLRLNLSFVRVLGRLEFDLLLG

SEQ ID NO: 3178632 - protein, 18 aa, Giardia lamblia
LECFTRAPPHLAYYDLLL

SEQ ID NO: 3178633 - protein, 18 aa, Giardia lamblia
LEDAIAWMYHWHTDRSTW

SEQ ID NO: 3178634 - protein, 18 aa, Giardia lamblia
LEDNCVFPFISRADSNEP

SEQ ID NO: 3178635 - protein, 21 aa, Giardia lamblia
LEERKRLLGRYMSQLNQIAVI

SEQ ID NO: 3178636 - protein, 22 aa, Giardia lamblia
LEESLCGFSYTFTHLNKEKVTI

SEQ ID NO: 3178637 - protein, 21 aa, Giardia lamblia
LEGPCKHCLQLVKAELISIAK

SEQ ID NO: 3178638 - protein, 18 aa, Giardia lamblia
LEHVFKHLLSYSAGAIID

SEQ ID NO: 3178639 - protein, 24 aa, Giardia lamblia
LEIARPLLRPSLWDTFFYNSFLEF

SEQ ID NO: 3178640 - protein, 19 aa, Giardia lamblia
LEIAYLLAPKERGMRTKKG

SEQ ID NO: 3178641 - protein, 20 aa, Giardia lamblia
LEIKGQAPAQGWNMKKATIA

SEQ ID NO: 3178642 - protein, 19 aa, Giardia lamblia
LEIPEYICPLHICDNNPTL

SEQ ID NO: 3178643 - protein, 17 aa, Giardia lamblia
LEIQMIYSLYLGKDTLE

SEQ ID NO: 3178644 - protein, 21 aa, Giardia lamblia
LEKIRCIWEGTVLAVKEYSSR

SEQ ID NO: 3178645 - protein, 19 aa, Giardia lamblia
LELARCFTENTVPAAHQLI

SEQ ID NO: 3178646 - protein, 17 aa, Giardia lamblia
LELDMSRGLSRDIVEPL

SEQ ID NO: 3178647 - protein, 19 aa, Giardia lamblia
LELEICSQLAFYYAQDASI

SEQ ID NO: 3178648 - protein, 17 aa, Giardia lamblia
LELKKCRDRAHRLMLEM

SEQ ID NO: 3178649 - protein, 22 aa, Giardia lamblia
LELMPVPVPLDYVTFLRSEYED

SEQ ID NO: 3178650 - protein, 17 aa, Giardia lamblia
LEMTDYLLTHPPTGPTP

SEQ ID NO: 3178651 - protein, 21 aa, Giardia lamblia
LENFPNFRLFQTIFLGHTNLA

SEQ ID NO: 3178652 - protein, 24 aa, Giardia lamblia
LEPEPQVLHLLKFTYTPSGFMASG

SEQ ID NO: 3178653 - protein, 17 aa, Giardia lamblia
LEPHSFVGTTLVSPEKF

SEQ ID NO: 3178654 - protein, 18 aa, Giardia lamblia
LEPIDHFVDVFLIKDRFR

SEQ ID NO: 3178655 - protein, 19 aa, Giardia lamblia
LEQYIQWRLEKDAKSEVQI

SEQ ID NO: 3178656 - protein, 25 aa, Giardia lamblia
LERCVKEKRPLLIIASDVTGDALST

SEQ ID NO: 3178657 - protein, 18 aa, Giardia lamblia
LERDCLRESLGLQHDRDP

SEQ ID NO: 3178658 - protein, 23 aa, Giardia lamblia
LESCFKQAIAFSAHLVLPILAEN

SEQ ID NO: 3178659 - protein, 17 aa, Giardia lamblia
LESIPSMALKALPIDVL

SEQ ID NO: 3178660 - protein, 21 aa, Giardia lamblia
LESLLHCLSEILGRGASGILY

SEQ ID NO: 3178661 - protein, 23 aa, Giardia lamblia
LETLPSLFVFLLFVTSTLESITL

SEQ ID NO: 3178662 - protein, 19 aa, Giardia lamblia
LETPCGYFVPALVDKVLTS

SEQ ID NO: 3178663 - protein, 22 aa, Giardia lamblia
LEVRALRCLILFVRNSRIVSLS

SEQ ID NO: 3178664 - protein, 19 aa, Giardia lamblia
LEVRKRIFIWLSDEREDTC

SEQ ID NO: 3178665 - protein, 19 aa, Giardia lamblia
LEYQFLLHYERLIIYDEGS

SEQ ID NO: 3178666 - protein, 24 aa, Giardia lamblia
LEYRNYLKFCEFWTTRNAALAATA

SEQ ID NO: 3178667 - protein, 17 aa, Giardia lamblia
LFADHAFMTIGEVFSGL

SEQ ID NO: 3178668 - protein, 17 aa, Giardia lamblia
LFARPYRSMAYRPTPNS

SEQ ID NO: 3178669 - protein, 19 aa, Giardia lamblia
LFCALSLALKAGHWSCVKQ

SEQ ID NO: 3178670 - protein, 19 aa, Giardia lamblia
LFCRTGVYLIKLANRKTLR

SEQ ID NO: 3178671 - protein, 17 aa, Giardia lamblia
LFEASDIFSCWYQPLNA

SEQ ID NO: 3178672 - protein, 23 aa, Giardia lamblia
LFEFFCRYCVLLFSLSFSTANPF

SEQ ID NO: 3178673 - protein, 22 aa, Giardia lamblia
LFFRLSSLIPFCAVTHTLCLRL

SEQ ID NO: 3178674 - protein, 23 aa, Giardia lamblia
LFGMAELRLSIPPAVLQQMVALA

SEQ ID NO: 3178675 - protein, 19 aa, Giardia lamblia
LFIVRGRPKIRVHGRKQPF

SEQ ID NO: 3178676 - protein, 20 aa, Giardia lamblia
LFKYCINFYAAFLILELWCY

SEQ ID NO: 3178677 - protein, 20 aa, Giardia lamblia
LFLCALPRRVFHYLEGPASV

SEQ ID NO: 3178678 - protein, 21 aa, Giardia lamblia
LFLSYCMVCGYTLSPNTTADA

SEQ ID NO: 3178679 - protein, 25 aa, Giardia lamblia
LFPAAYFCALFWRYYENLKGNKDKS

SEQ ID NO: 3178680 - protein, 22 aa, Giardia lamblia
LFRLAEAHARLHLRKSVTKDDG

SEQ ID NO: 3178681 - protein, 17 aa, Giardia lamblia
LFTSIGLKHIFYADCFE

SEQ ID NO: 3178682 - protein, 18 aa, Giardia lamblia
LFTWLYHKICLLADSLVM

SEQ ID NO: 3178683 - protein, 17 aa, Giardia lamblia
LFWISCGQLGLIPNLGM

SEQ ID NO: 3178684 - protein, 17 aa, Giardia lamblia
LGAADAGVWTVPIDTSD

SEQ ID NO: 3178685 - protein, 22 aa, Giardia lamblia
LGARSRFPLLIDELVERYAGMQ

SEQ ID NO: 3178686 - protein, 21 aa, Giardia lamblia
LGCFMYEFYLGVPYIQGTCLS

SEQ ID NO: 3178687 - protein, 18 aa, Giardia lamblia
LGCTAPGPGRCTRCPSDK

SEQ ID NO: 3178688 - protein, 21 aa, Giardia lamblia
LGELCLAGRMLSLGYYAGDAL

SEQ ID NO: 3178689 - protein, 17 aa, Giardia lamblia
LGFCFARCITPMGTLPE

SEQ ID NO: 3178690 - protein, 18 aa, Giardia lamblia
LGFWKQTQTILGMDDMEE

SEQ ID NO: 3178691 - protein, 24 aa, Giardia lamblia
LGGKLGRTVVCFNCDTSIERSDLS

SEQ ID NO: 3178692 - protein, 22 aa, Giardia lamblia
LGGRLSTLLNQWSNYRTQDGFS

SEQ ID NO: 3178693 - protein, 17 aa, Giardia lamblia
LGIFSKFYSYRHETRTY

SEQ ID NO: 3178694 - protein, 17 aa, Giardia lamblia
LGIRLVWDIIQEKTTPA

SEQ ID NO: 3178695 - protein, 20 aa, Giardia lamblia
LGISAWCVHASMPQRQRYKN

SEQ ID NO: 3178696 - protein, 26 aa, Giardia lamblia
LGKFLRVCPRIDPRLYSVASLPHPDE

SEQ ID NO: 3178697 - protein, 18 aa, Giardia lamblia
LGRGCTALIYAASVQDAD

SEQ ID NO: 3178698 - protein, 21 aa, Giardia lamblia
LGRGRCVAILMHHEAQMRSSL

SEQ ID NO: 3178699 - protein, 23 aa, Giardia lamblia
LGRICAARRSLFNNWLAKYKDLI

SEQ ID NO: 3178700 - protein, 27 aa, Giardia lamblia
LGRLFSNRALKIWALEIILERHNSFSI

SEQ ID NO: 3178701 - protein, 18 aa, Giardia lamblia
LGRVSAFIEKPCFVAVES

SEQ ID NO: 3178702 - protein, 19 aa, Giardia lamblia
LGSLECVRLLKPYELGMKN

SEQ ID NO: 3178703 - protein, 18 aa, Giardia lamblia
LGSNLNITGVSPAFPSSL

SEQ ID NO: 3178704 - protein, 17 aa, Giardia lamblia
LGVRLLHHISRRVYKYD

SEQ ID NO: 3178705 - protein, 23 aa, Giardia lamblia
LGYPFQEPYIWYVIGQIVNGLAY

SEQ ID NO: 3178706 - protein, 22 aa, Giardia lamblia
LGYRYSYDLFRTWCKHTGVDLV

SEQ ID NO: 3178707 - protein, 17 aa, Giardia lamblia
LHASAFPKIGLFTRPFI

SEQ ID NO: 3178708 - protein, 21 aa, Giardia lamblia
LHCPARGAAYLLSLACQKKGD

SEQ ID NO: 3178709 - protein, 23 aa, Giardia lamblia
LHGILKPFLLRRVKTEVLAQLPP

SEQ ID NO: 3178710 - protein, 24 aa, Giardia lamblia
LHKEARPLLFARIGGEYTETPVLH

SEQ ID NO: 3178711 - protein, 17 aa, Giardia lamblia
LHKTDIGGIMLFKDRSN

SEQ ID NO: 3178712 - protein, 19 aa, Giardia lamblia
LHKVCPVNVFADVTRQLDI

SEQ ID NO: 3178713 - protein, 22 aa, Giardia lamblia
LHLRTCLAHYGLSLYLESLAST

SEQ ID NO: 3178714 - protein, 18 aa, Giardia lamblia
LHPCDHWPGPVPQKPEYV

SEQ ID NO: 3178715 - protein, 18 aa, Giardia lamblia
LHPVWKYLFAFYAALYKA

SEQ ID NO: 3178716 - protein, 18 aa, Giardia lamblia
LHRAELRALAAVSTELRH

SEQ ID NO: 3178717 - protein, 24 aa, Giardia lamblia
LHRELFKATSLLSVLGNIFPADLS

SEQ ID NO: 3178718 - protein, 22 aa, Giardia lamblia
LHRMSVDMISYWLTDHPQERTA

SEQ ID NO: 3178719 - protein, 18 aa, Giardia lamblia
LIANCLYKDINIIDTRPS

SEQ ID NO: 3178720 - protein, 18 aa, Giardia lamblia
LICARLVDCTSYIPVYPL

SEQ ID NO: 3178721 - protein, 25 aa, Giardia lamblia
LIGKYREIVCCLARLPDAKLPKTLA

SEQ ID NO: 3178722 - protein, 23 aa, Giardia lamblia
LIKEIKENFLLAFLDLIENSSVW

SEQ ID NO: 3178723 - protein, 17 aa, Giardia lamblia
LILRDDLDFVYLPLENK

SEQ ID NO: 3178724 - protein, 20 aa, Giardia lamblia
LILREWRYALLLRRMERVTA

SEQ ID NO: 3178725 - protein, 19 aa, Giardia lamblia
LILRGNPFGAFGLGEIGAG

SEQ ID NO: 3178726 - protein, 17 aa, Giardia lamblia
LINLLIFINGRRVQYPR

SEQ ID NO: 3178727 - protein, 18 aa, Giardia lamblia
LIPVALNCLLVFYKTTLL

SEQ ID NO: 3178728 - protein, 20 aa, Giardia lamblia
LIPVCYRIIYGSLTPVIEGD

SEQ ID NO: 3178729 - protein, 17 aa, Giardia lamblia
LIQSWCLYEARIVGGHS

SEQ ID NO: 3178730 - protein, 18 aa, Giardia lamblia
LIRLCDFGLSMALQAGNP

SEQ ID NO: 3178731 - protein, 21 aa, Giardia lamblia
LITEFFRFMGLHSTAGTLEVE

SEQ ID NO: 3178732 - protein, 19 aa, Giardia lamblia
LITLKEFRIRAGSSSCAAS

SEQ ID NO: 3178733 - protein, 21 aa, Giardia lamblia
LITLPGRPGWHIECSAMAAAV

SEQ ID NO: 3178734 - protein, 17 aa, Giardia lamblia
LIVILARVHPCETSGSY

SEQ ID NO: 3178735 - protein, 24 aa, Giardia lamblia
LIYWLLAREVLRLKGSISRTEEWD

SEQ ID NO: 3178736 - protein, 18 aa, Giardia lamblia
LKAGFDILKRAGISKTFY

SEQ ID NO: 3178737 - protein, 24 aa, Giardia lamblia
LKAIGPCDVWLLGIGHNGHIAFNE

SEQ ID NO: 3178738 - protein, 18 aa, Giardia lamblia
LKALDSFMKHAVDEREML

SEQ ID NO: 3178739 - protein, 17 aa, Giardia lamblia
LKALKIRGDGCLKPIAS

SEQ ID NO: 3178740 - protein, 20 aa, Giardia lamblia
LKALRPGFHPTIYASGFFGA

SEQ ID NO: 3178741 - protein, 20 aa, Giardia lamblia
LKAPLPPDWRVASTADGDIY

SEQ ID NO: 3178742 - protein, 19 aa, Giardia lamblia
LKARKIVVVSARIHPGEAQ

SEQ ID NO: 3178743 - protein, 18 aa, Giardia lamblia
LKASILAACEAELTSKLT

SEQ ID NO: 3178744 - protein, 19 aa, Giardia lamblia
LKATLLYAVELSFSVISAC

SEQ ID NO: 3178745 - protein, 17 aa, Giardia lamblia
LKAVCRMILIQIPPSLK

SEQ ID NO: 3178746 - protein, 19 aa, Giardia lamblia
LKDSMNFQRMRQLEKNLLI

SEQ ID NO: 3178747 - protein, 21 aa, Giardia lamblia
LKEAKEIFMYTVSMKNDEIER

SEQ ID NO: 3178748 - protein, 17 aa, Giardia lamblia
LKEKRKILASFDMSIHM

SEQ ID NO: 3178749 - protein, 18 aa, Giardia lamblia
LKEQLHWRGRLAPDSTNV

SEQ ID NO: 3178750 - protein, 18 aa, Giardia lamblia
LKERCILKSNTIKSKKSV

SEQ ID NO: 3178751 - protein, 18 aa, Giardia lamblia
LKESIVYMDRYVDKLRVK

SEQ ID NO: 3178752 - protein, 25 aa, Giardia lamblia
LKEYGLEMCVNFPPELNALIDEVSA

SEQ ID NO: 3178753 - protein, 18 aa, Giardia lamblia
LKFLEVFEEQFLKQDFNT

SEQ ID NO: 3178754 - protein, 19 aa, Giardia lamblia
LKFPVCALHGLMTLDQRIY

SEQ ID NO: 3178755 - protein, 17 aa, Giardia lamblia
LKGCCYDPVLVIMVFRL

SEQ ID NO: 3178756 - protein, 18 aa, Giardia lamblia
LKGHPWFNGINWDKLYRK

SEQ ID NO: 3178757 - protein, 23 aa, Giardia lamblia
LKGIFSTIVKWWSGRSFTTASAA

SEQ ID NO: 3178758 - protein, 17 aa, Giardia lamblia
LKHAMDILCSTILSHVE

SEQ ID NO: 3178759 - protein, 22 aa, Giardia lamblia
LKHILLHPSLRYTLASVPNLTL

SEQ ID NO: 3178760 - protein, 17 aa, Giardia lamblia
LKIAIVMSRKLKNMYAR

SEQ ID NO: 3178761 - protein, 18 aa, Giardia lamblia
LKIFCLLPYQSREKDEDG

SEQ ID NO: 3178762 - protein, 17 aa, Giardia lamblia
LKIPFAVYIESEVMEYA

SEQ ID NO: 3178763 - protein, 22 aa, Giardia lamblia
LKKEWYPVIAPAHFKSRHIGQT

SEQ ID NO: 3178764 - protein, 17 aa, Giardia lamblia
LKKIRLPLIITTYSKKL

SEQ ID NO: 3178765 - protein, 20 aa, Giardia lamblia
LKKLEMEDALKLAASLKTLS

SEQ ID NO: 3178766 - protein, 17 aa, Giardia lamblia
LKLAYALLRNEIAGTKI

SEQ ID NO: 3178767 - protein, 17 aa, Giardia lamblia
LKLPYGVASQENYSFDF

SEQ ID NO: 3178768 - protein, 18 aa, Giardia lamblia
LKMLPSFRAQFYGYLTHQ

SEQ ID NO: 3178769 - protein, 17 aa, Giardia lamblia
LKNSVAIISAFKDAFSG

SEQ ID NO: 3178770 - protein, 17 aa, Giardia lamblia
LKNYCRFLENEVAALRS

SEQ ID NO: 3178771 - protein, 18 aa, Giardia lamblia
LKPGSMVMLWSCNSPEWI

SEQ ID NO: 3178772 - protein, 19 aa, Giardia lamblia
LKPLLSISCLKLIVIKHNS

SEQ ID NO: 3178773 - protein, 19 aa, Giardia lamblia
LKPPLPSYRDRVFVMDCVG

SEQ ID NO: 3178774 - protein, 17 aa, Giardia lamblia
LKPQMPYVAQRWTSHPA

SEQ ID NO: 3178775 - protein, 18 aa, Giardia lamblia
LKQLKLFYKMGANPEVVQ

SEQ ID NO: 3178776 - protein, 17 aa, Giardia lamblia
LKQTALMIACERNNAAI

SEQ ID NO: 3178777 - protein, 19 aa, Giardia lamblia
LKRSFLLIQSWCLYEARIV

SEQ ID NO: 3178778 - protein, 19 aa, Giardia lamblia
LKSKEGWTALLYAIDKKNT

SEQ ID NO: 3178779 - protein, 17 aa, Giardia lamblia
LKSPIGFRQTAAPATDM

SEQ ID NO: 3178780 - protein, 25 aa, Giardia lamblia
LKSVIKAEAFLVEFPNKKLALQTSI

SEQ ID NO: 3178781 - protein, 20 aa, Giardia lamblia
LKTLMLRFLIGQMEEIQNPT

SEQ ID NO: 3178782 - protein, 17 aa, Giardia lamblia
LKVEISDVLSLLHSSGL

SEQ ID NO: 3178783 - protein, 17 aa, Giardia lamblia
LKVQLSRLVICETLEVA

SEQ ID NO: 3178784 - protein, 21 aa, Giardia lamblia
LKYPACRGFKPILLDNTIIRI

SEQ ID NO: 3178785 - protein, 18 aa, Giardia lamblia
LLAGYLVHRFHWPPHRAL

SEQ ID NO: 3178786 - protein, 24 aa, Giardia lamblia
LLARELWRKLGCEVILCIGVQKRA

SEQ ID NO: 3178787 - protein, 18 aa, Giardia lamblia
LLCTRLAVDSGYYFSVRK

SEQ ID NO: 3178788 - protein, 18 aa, Giardia lamblia
LLDCFCYLQLGLAQQRDY

SEQ ID NO: 3178789 - protein, 18 aa, Giardia lamblia
LLEARLATYTPLMRAIMK

SEQ ID NO: 3178790 - protein, 17 aa, Giardia lamblia
LLEDIGVQWRRYVSSLE

SEQ ID NO: 3178791 - protein, 25 aa, Giardia lamblia
LLEKTARIPICYRIVGMSATLSNIS

SEQ ID NO: 3178792 - protein, 18 aa, Giardia lamblia
LLERCLRQIMTAFIRYMR

SEQ ID NO: 3178793 - protein, 17 aa, Giardia lamblia
LLESELFYKHFAEDEQA

SEQ ID NO: 3178794 - protein, 19 aa, Giardia lamblia
LLEVPICFSERVNGSSSLS

SEQ ID NO: 3178795 - protein, 22 aa, Giardia lamblia
LLFWHAFIFLLRVIRWASSQGP

SEQ ID NO: 3178796 - protein, 18 aa, Giardia lamblia
LLGICLALAPYEHSVLDA

SEQ ID NO: 3178797 - protein, 17 aa, Giardia lamblia
LLIETIDKFIGWSSVGG

SEQ ID NO: 3178798 - protein, 18 aa, Giardia lamblia
LLIFHEFQDHLVLSTALM

SEQ ID NO: 3178799 - protein, 21 aa, Giardia lamblia
LLIKYPLEWLELNPTKIQACK

SEQ ID NO: 3178800 - protein, 21 aa, Giardia lamblia
LLISWLQKRNVILADDLGVGK

SEQ ID NO: 3178801 - protein, 17 aa, Giardia lamblia
LLKKRIPVINALTRYGR

SEQ ID NO: 3178802 - protein, 17 aa, Giardia lamblia
LLKYVYEHIVKKSGDVA

SEQ ID NO: 3178803 - protein, 17 aa, Giardia lamblia
LLLCLRGGCPQATVLPV

SEQ ID NO: 3178804 - protein, 18 aa, Giardia lamblia
LLLEIAFVVPCDDDYIHH

SEQ ID NO: 3178805 - protein, 17 aa, Giardia lamblia
LLLEKEGGMKKNDFFSN

SEQ ID NO: 3178806 - protein, 19 aa, Giardia lamblia
LLLELGLTRLVAWFEQCYL

SEQ ID NO: 3178807 - protein, 18 aa, Giardia lamblia
LLLFLSKLLKMERLRNGA

SEQ ID NO: 3178808 - protein, 18 aa, Giardia lamblia
LLLHQGFLVLLGRHHGHL

SEQ ID NO: 3178809 - protein, 24 aa, Giardia lamblia
LLLIFLEYMVCWTLGIGRKQLLSE

SEQ ID NO: 3178810 - protein, 19 aa, Giardia lamblia
LLLIHECQLFQAVLNEVSK

SEQ ID NO: 3178811 - protein, 18 aa, Giardia lamblia
LLLKCEVRLAPRRLTTPL

SEQ ID NO: 3178812 - protein, 17 aa, Giardia lamblia
LLLRKGRQSVVITDFGL

SEQ ID NO: 3178813 - protein, 19 aa, Giardia lamblia
LLLRRLCAFINQGTLSLSD

SEQ ID NO: 3178814 - protein, 17 aa, Giardia lamblia
LLLSEIVQFCFQASHKP

SEQ ID NO: 3178815 - protein, 18 aa, Giardia lamblia
LLLVYSVDLTQLNSYMRS

SEQ ID NO: 3178816 - protein, 19 aa, Giardia lamblia
LLLYKPCPLYILDEIDAAL

SEQ ID NO: 3178817 - protein, 17 aa, Giardia lamblia
LLMRALRDMNLPKFVFE

SEQ ID NO: 3178818 - protein, 17 aa, Giardia lamblia
LLNPRSLLSAGLSIAAQ

SEQ ID NO: 3178819 - protein, 25 aa, Giardia lamblia
LLPAILSRCCAFRFLPVPRESCLLM

SEQ ID NO: 3178820 - protein, 18 aa, Giardia lamblia
LLPEEFLVHMKLFARPYR

SEQ ID NO: 3178821 - protein, 23 aa, Giardia lamblia
LLPGGIPDLDWAARNCIRDWNRG

SEQ ID NO: 3178822 - protein, 22 aa, Giardia lamblia
LLPKCRCGKTFISKDTLLHHMK

SEQ ID NO: 3178823 - protein, 18 aa, Giardia lamblia
LLPQEVWFGKSIIFSYAR

SEQ ID NO: 3178824 - protein, 25 aa, Giardia lamblia
LLQTDIRPSFLLSHCDPAASQGQIP

SEQ ID NO: 3178825 - protein, 18 aa, Giardia lamblia
LLRCSFGTTKFCTSFLDG

SEQ ID NO: 3178826 - protein, 18 aa, Giardia lamblia
LLREKVVVLQEEFSKEHD

SEQ ID NO: 3178827 - protein, 19 aa, Giardia lamblia
LLRFWKLPDIYALNDQSVP

SEQ ID NO: 3178828 - protein, 18 aa, Giardia lamblia
LLRLILRLTGYKLAITGY

SEQ ID NO: 3178829 - protein, 23 aa, Giardia lamblia
LLRRLPCIMMKLKMVQKIQDGVR

SEQ ID NO: 3178830 - protein, 21 aa, Giardia lamblia
LLRVRRKYLLWVSYMQIYNES

SEQ ID NO: 3178831 - protein, 18 aa, Giardia lamblia
LLSELCLHLGIPNYAVLS

SEQ ID NO: 3178832 - protein, 25 aa, Giardia lamblia
LLSFRPRTAPAFGMLPLHSPAHLRL

SEQ ID NO: 3178833 - protein, 17 aa, Giardia lamblia
LLSHGFLRDIIKYARSL

SEQ ID NO: 3178834 - protein, 24 aa, Giardia lamblia
LLSLHCRARFGVHIVELVERMTRT

SEQ ID NO: 3178835 - protein, 22 aa, Giardia lamblia
LLSRPPFKYILDICKAVSAATG

SEQ ID NO: 3178836 - protein, 23 aa, Giardia lamblia
LLSRSEFLSVFGLVLEAQSADSQ

SEQ ID NO: 3178837 - protein, 22 aa, Giardia lamblia
LLTAEAELRCLRAEREQQHPVS

SEQ ID NO: 3178838 - protein, 18 aa, Giardia lamblia
LLTCRKYLERSVDSHWCP

SEQ ID NO: 3178839 - protein, 24 aa, Giardia lamblia
LLTKASGKMIQWFKERPKDMPNAL

SEQ ID NO: 3178840 - protein, 19 aa, Giardia lamblia
LLTLRRLYCYTPFDLFVYE

SEQ ID NO: 3178841 - protein, 18 aa, Giardia lamblia
LLVKACANSCDCTFISVT

SEQ ID NO: 3178842 - protein, 17 aa, Giardia lamblia
LLVQLVVRILRIHRDNA

SEQ ID NO: 3178843 - protein, 18 aa, Giardia lamblia
LLVRRLLRAIHHCHQSGV

SEQ ID NO: 3178844 - protein, 21 aa, Giardia lamblia
LLYELCTFKPLFIAPSHMDKK

SEQ ID NO: 3178845 - protein, 17 aa, Giardia lamblia
LMCGRLLENIADAKSDL

SEQ ID NO: 3178846 - protein, 19 aa, Giardia lamblia
LMETLPLGFSLAMDIITMS

SEQ ID NO: 3178847 - protein, 21 aa, Giardia lamblia
LMFQMIIKWGGYLSIAGLRQS

SEQ ID NO: 3178848 - protein, 17 aa, Giardia lamblia
LMGCTLCNKDVSDRRPR

SEQ ID NO: 3178849 - protein, 18 aa, Giardia lamblia
LMHCLRRWQLFSLMESDK

SEQ ID NO: 3178850 - protein, 23 aa, Giardia lamblia
LMHLKSRLRTMSARGFTSADRLQ

SEQ ID NO: 3178851 - protein, 19 aa, Giardia lamblia
LMNCLKTALDVAAFESRPN

SEQ ID NO: 3178852 - protein, 25 aa, Giardia lamblia
LMQCLRPSMTSSFFQEGLRIVADFV

SEQ ID NO: 3178853 - protein, 18 aa, Giardia lamblia
LMQYRLSYLDSRSTSRVG

SEQ ID NO: 3178854 - protein, 26 aa, Giardia lamblia
LMRAARAGFADIVWLLAPQEAGMQLI

SEQ ID NO: 3178855 - protein, 18 aa, Giardia lamblia
LMRIMRWLNTLVLKNRLA

SEQ ID NO: 3178856 - protein, 19 aa, Giardia lamblia
LMVATQLIFRRYPERYEGI

SEQ ID NO: 3178857 - protein, 17 aa, Giardia lamblia
LMYCVMHLALGPSAPAN

SEQ ID NO: 3178858 - protein, 17 aa, Giardia lamblia
LNARSALFLANHYTIMK

SEQ ID NO: 3178859 - protein, 17 aa, Giardia lamblia
LNCPPRAILTGHTGGVI

SEQ ID NO: 3178860 - protein, 18 aa, Giardia lamblia
LNELKKDRSLIHMTGERV

SEQ ID NO: 3178861 - protein, 19 aa, Giardia lamblia
LNFAIPLLISREGKMTTTT

SEQ ID NO: 3178862 - protein, 18 aa, Giardia lamblia
LNHLKPLMKSLETENSGL

SEQ ID NO: 3178863 - protein, 20 aa, Giardia lamblia
LNILLFWKLLPPILEGSPYN

SEQ ID NO: 3178864 - protein, 18 aa, Giardia lamblia
LNIVPVRRGFWGGKLGDP

SEQ ID NO: 3178865 - protein, 23 aa, Giardia lamblia
LNKLSYWLLFAFFVLNERLTASS

SEQ ID NO: 3178866 - protein, 17 aa, Giardia lamblia
LNLRLNTNLPFPAQFTQ

SEQ ID NO: 3178867 - protein, 20 aa, Giardia lamblia
LNMYIAWDIIRQITMVLDWL

SEQ ID NO: 3178868 - protein, 18 aa, Giardia lamblia
LNMYRHLLIKCPCCCACP

SEQ ID NO: 3178869 - protein, 18 aa, Giardia lamblia
LNNRLAIRNTLLLAEYLR

SEQ ID NO: 3178870 - protein, 20 aa, Giardia lamblia
LNRFFPLLVIRGDSIIFVTR

SEQ ID NO: 3178871 - protein, 22 aa, Giardia lamblia
LNSACLKQLFKITGIVTKLTAP

SEQ ID NO: 3178872 - protein, 17 aa, Giardia lamblia
LNSLLLPCITCFSEHIS

SEQ ID NO: 3178873 - protein, 18 aa, Giardia lamblia
LNTNLPFPAQFTQSTSKT

SEQ ID NO: 3178874 - protein, 20 aa, Giardia lamblia
LNVGLTRCRCALIIVGNATA

SEQ ID NO: 3178875 - protein, 23 aa, Giardia lamblia
LNVSWPASTLGFWLSDVTNRCTQ

SEQ ID NO: 3178876 - protein, 18 aa, Giardia lamblia
LPAFMSIEVFINKPSKTG

SEQ ID NO: 3178877 - protein, 17 aa, Giardia lamblia
LPAQFFLQVNSPLGASP

SEQ ID NO: 3178878 - protein, 17 aa, Giardia lamblia
LPARWSAVASHLSSFLQ

SEQ ID NO: 3178879 - protein, 18 aa, Giardia lamblia
LPCLKCLILRGCNISSLP

SEQ ID NO: 3178880 - protein, 19 aa, Giardia lamblia
LPCTWPIIMLDGSIDPLWI

SEQ ID NO: 3178881 - protein, 18 aa, Giardia lamblia
LPDGLTWREVQDEVFSLY

SEQ ID NO: 3178882 - protein, 17 aa, Giardia lamblia
LPDGRNALMLAAEAGCV

SEQ ID NO: 3178883 - protein, 19 aa, Giardia lamblia
LPEQCQAALNDIRKVVYFW

SEQ ID NO: 3178884 - protein, 17 aa, Giardia lamblia
LPFARLVQELVEQIAQR

SEQ ID NO: 3178885 - protein, 17 aa, Giardia lamblia
LPFNEMRPSANGKSMTT

SEQ ID NO: 3178886 - protein, 22 aa, Giardia lamblia
LPGEVMWQYPMYKLLTQKPVPE

SEQ ID NO: 3178887 - protein, 19 aa, Giardia lamblia
LPGFISRIVMIRKFLGDKL

SEQ ID NO: 3178888 - protein, 21 aa, Giardia lamblia
LPGVWSYRFQLGLQDKRGYTA

SEQ ID NO: 3178889 - protein, 18 aa, Giardia lamblia
LPIPRAISITVDRPINIP

SEQ ID NO: 3178890 - protein, 21 aa, Giardia lamblia
LPKDRECIMFIGAKNSVIMKP

SEQ ID NO: 3178891 - protein, 19 aa, Giardia lamblia
LPKELRYIFQLAASAYSLI

SEQ ID NO: 3178892 - protein, 20 aa, Giardia lamblia
LPKKLSLVFQRDILPENIKE

SEQ ID NO: 3178893 - protein, 19 aa, Giardia lamblia
LPLACLINSIALCIHGGIH

SEQ ID NO: 3178894 - protein, 17 aa, Giardia lamblia
LPLCWCVIHGCSIFDIL

SEQ ID NO: 3178895 - protein, 17 aa, Giardia lamblia
LPLSVSNVFSEERVTHI

SEQ ID NO: 3178896 - protein, 23 aa, Giardia lamblia
LPLTCVLLRGWRKLLIDLASEEQ

SEQ ID NO: 3178897 - protein, 17 aa, Giardia lamblia
LPMSPRARRGSINPQNF

SEQ ID NO: 3178898 - protein, 18 aa, Giardia lamblia
LPPYACAIILHFENYTVD

SEQ ID NO: 3178899 - protein, 24 aa, Giardia lamblia
LPPYCGMCEKCHWQTPICVRTGQP

SEQ ID NO: 3178900 - protein, 18 aa, Giardia lamblia
LPQFPCLFLHQFGSKASV

SEQ ID NO: 3178901 - protein, 17 aa, Giardia lamblia
LPQRLPIAIAKNICLQM

SEQ ID NO: 3178902 - protein, 20 aa, Giardia lamblia
LPQVRPNPIIARYFVIIVTA

SEQ ID NO: 3178903 - protein, 21 aa, Giardia lamblia
LPRFLNRFFPFSFTQSLFSSA

SEQ ID NO: 3178904 - protein, 20 aa, Giardia lamblia
LPRFRMLVVSTICSDSGEVL

SEQ ID NO: 3178905 - protein, 18 aa, Giardia lamblia
LPRGWRPNPAIPLYSTLV

SEQ ID NO: 3178906 - protein, 18 aa, Giardia lamblia
LPRYCLKKVLGAGSYGKV

SEQ ID NO: 3178907 - protein, 21 aa, Giardia lamblia
LPSAFRFLAVEPCNFLMIGHE

SEQ ID NO: 3178908 - protein, 21 aa, Giardia lamblia
LPSKFTALILACYHGRLKAAT

SEQ ID NO: 3178909 - protein, 20 aa, Giardia lamblia
LPSREGLDWMTKVFRSSKGN

SEQ ID NO: 3178910 - protein, 17 aa, Giardia lamblia
LPTLCVFDKGILKKKFL

SEQ ID NO: 3178911 - protein, 18 aa, Giardia lamblia
LPTPYLKRFACILLSIDG

SEQ ID NO: 3178912 - protein, 20 aa, Giardia lamblia
LPVIAGWVGCGVWDAAVIMS

SEQ ID NO: 3178913 - protein, 19 aa, Giardia lamblia
LPVLIRVGWRASANGQGVD

SEQ ID NO: 3178914 - protein, 17 aa, Giardia lamblia
LPVYKCHPAECQLEGTM

SEQ ID NO: 3178915 - protein, 25 aa, Giardia lamblia
LPYLRCPMCLCKIRSAMENEPEPGT

SEQ ID NO: 3178916 - protein, 17 aa, Giardia lamblia
LPYSLASFRVYTLVPFF

SEQ ID NO: 3178917 - protein, 24 aa, Giardia lamblia
LQCHMLWRQCFVHQKVFIRGTEHV

SEQ ID NO: 3178918 - protein, 19 aa, Giardia lamblia
LQCLNCVSIDPSTIRQNRL

SEQ ID NO: 3178919 - protein, 19 aa, Giardia lamblia
LQDWCKLLFEVSDLQYASP

SEQ ID NO: 3178920 - protein, 19 aa, Giardia lamblia
LQEVTPMKGLSIVVPISDS

SEQ ID NO: 3178921 - protein, 20 aa, Giardia lamblia
LQFPILHACYSDHHRTFLFT

SEQ ID NO: 3178922 - protein, 17 aa, Giardia lamblia
LQGAVTMFRMERDEATS

SEQ ID NO: 3178923 - protein, 18 aa, Giardia lamblia
LQGCSLRTLIDLNVESDQ

SEQ ID NO: 3178924 - protein, 18 aa, Giardia lamblia
LQGLPAFREYLTKLIYQL

SEQ ID NO: 3178925 - protein, 18 aa, Giardia lamblia
LQHRLALRLEQLKRAAPG

SEQ ID NO: 3178926 - protein, 18 aa, Giardia lamblia
LQITEFYQTLLLPSVQRL

SEQ ID NO: 3178927 - protein, 17 aa, Giardia lamblia
LQKCVQRKLWDAKEIEG

SEQ ID NO: 3178928 - protein, 17 aa, Giardia lamblia
LQLFFSVPSAGERSIQV

SEQ ID NO: 3178929 - protein, 22 aa, Giardia lamblia
LQLKRFDIAAAIAGKHNILHII

SEQ ID NO: 3178930 - protein, 25 aa, Giardia lamblia
LQPHVLRWPGLEPHHPITLALKRKA

SEQ ID NO: 3178931 - protein, 20 aa, Giardia lamblia
LQPIKARLWSAITNDHYIYT

SEQ ID NO: 3178932 - protein, 17 aa, Giardia lamblia
LQPRVSLPPCIQADALF

SEQ ID NO: 3178933 - protein, 24 aa, Giardia lamblia
LQRPRSSYYLLHRMRLSMCGISNS

SEQ ID NO: 3178934 - protein, 19 aa, Giardia lamblia
LQSRFGAVSALTFDILNDI

SEQ ID NO: 3178935 - protein, 19 aa, Giardia lamblia
LRAAKELVIIEAGFQDLDG

SEQ ID NO: 3178936 - protein, 17 aa, Giardia lamblia
LRAAVGADRVFRDIQPQ

SEQ ID NO: 3178937 - protein, 21 aa, Giardia lamblia
LRADKVISCYPEKLPVIRQSG

SEQ ID NO: 3178938 - protein, 23 aa, Giardia lamblia
LRAMKAVLLTAGMLKRSHPEYPE

SEQ ID NO: 3178939 - protein, 19 aa, Giardia lamblia
LRARYWLSYAAAIAGMAID

SEQ ID NO: 3178940 - protein, 17 aa, Giardia lamblia
LRAVKVFSLAKLDEDQR

SEQ ID NO: 3178941 - protein, 18 aa, Giardia lamblia
LRCSPEIPLHGNSASKEI

SEQ ID NO: 3178942 - protein, 19 aa, Giardia lamblia
LRDFCCVGCKQLLRLPVKL

SEQ ID NO: 3178943 - protein, 22 aa, Giardia lamblia
LRDGRDALMLAAFMANYEAVSV

SEQ ID NO: 3178944 - protein, 17 aa, Giardia lamblia
LRELFWLDFTRERVLTS

SEQ ID NO: 3178945 - protein, 17 aa, Giardia lamblia
LRESLGLQHDRDPDRTR

SEQ ID NO: 3178946 - protein, 17 aa, Giardia lamblia
LRFAAQVCALRFNSRSK

SEQ ID NO: 3178947 - protein, 17 aa, Giardia lamblia
LRFFLSRLRAALKEGKP

SEQ ID NO: 3178948 - protein, 20 aa, Giardia lamblia
LRFGDKPIRCEYLIHDADFT

SEQ ID NO: 3178949 - protein, 17 aa, Giardia lamblia
LRFKSVFDDGLYDNQDL

SEQ ID NO: 3178950 - protein, 20 aa, Giardia lamblia
LRFLELIDWKIGVSSLNPRA

SEQ ID NO: 3178951 - protein, 19 aa, Giardia lamblia
LRGIIPLGVPTPYTTVSAF

SEQ ID NO: 3178952 - protein, 17 aa, Giardia lamblia
LRGSATWAPSEAQPALG

SEQ ID NO: 3178953 - protein, 19 aa, Giardia lamblia
LRHPHCFPTLRFLLEMQDY

SEQ ID NO: 3178954 - protein, 18 aa, Giardia lamblia
LRHVDCLHYLEFGRVAGA

SEQ ID NO: 3178955 - protein, 24 aa, Giardia lamblia
LRHWHRLIFGVAFFYSSLLERKRF

SEQ ID NO: 3178956 - protein, 21 aa, Giardia lamblia
LRHYLKECEGLLDAQKDLEHS

SEQ ID NO: 3178957 - protein, 21 aa, Giardia lamblia
LRIFFIVGYVLKYAERHNGRP

SEQ ID NO: 3178958 - protein, 21 aa, Giardia lamblia
LRIIEVMCVDLAAQHQIESYY

SEQ ID NO: 3178959 - protein, 20 aa, Giardia lamblia
LRIITVPGWLRGPFESESGS

SEQ ID NO: 3178960 - protein, 17 aa, Giardia lamblia
LRISPSLSKRFTNPPRN

SEQ ID NO: 3178961 - protein, 17 aa, Giardia lamblia
LRKCLRTPYAVSRYAGV

SEQ ID NO: 3178962 - protein, 18 aa, Giardia lamblia
LRKDHLCCFIPSDMIFGQ

SEQ ID NO: 3178963 - protein, 17 aa, Giardia lamblia
LRKFLLDKFLFKIVPMV

SEQ ID NO: 3178964 - protein, 18 aa, Giardia lamblia
LRKTAWRFMLALPNDVDY

SEQ ID NO: 3178965 - protein, 24 aa, Giardia lamblia
LRLDFFCILARLLLNTELLSPEMT

SEQ ID NO: 3178966 - protein, 17 aa, Giardia lamblia
LRLHYCIGIKAFANGRM

SEQ ID NO: 3178967 - protein, 20 aa, Giardia lamblia
LRLLFIILKWSCFKCEQEAL

SEQ ID NO: 3178968 - protein, 17 aa, Giardia lamblia
LRLLPFSQAVIFARDIS

SEQ ID NO: 3178969 - protein, 21 aa, Giardia lamblia
LRLMSQHAWNPQQFWGTVDAV

SEQ ID NO: 3178970 - protein, 17 aa, Giardia lamblia
LRLNTNLPFPAQFTQST

SEQ ID NO: 3178971 - protein, 19 aa, Giardia lamblia
LRLPDGRNALILAAQHNAL

SEQ ID NO: 3178972 - protein, 20 aa, Giardia lamblia
LRLPQLLLCALLAYCGHSCN

SEQ ID NO: 3178973 - protein, 17 aa, Giardia lamblia
LRLQHSIKRLIYHNKTV

SEQ ID NO: 3178974 - protein, 20 aa, Giardia lamblia
LRLSSVISCEIECGSSLTDM

SEQ ID NO: 3178975 - protein, 17 aa, Giardia lamblia
LRLSWQIERAIPKQLFK

SEQ ID NO: 3178976 - protein, 19 aa, Giardia lamblia
LRLTKDFGLTFTVSVEGCG

SEQ ID NO: 3178977 - protein, 17 aa, Giardia lamblia
LRLTPITKFLAAKESGI

SEQ ID NO: 3178978 - protein, 23 aa, Giardia lamblia
LRLWLTDWADVFINKVPVESVLS

SEQ ID NO: 3178979 - protein, 17 aa, Giardia lamblia
LRLWYSYKRALYDMMRG

SEQ ID NO: 3178980 - protein, 20 aa, Giardia lamblia
LRMRELRALYPVTEEQLNDE

SEQ ID NO: 3178981 - protein, 20 aa, Giardia lamblia
LRMVINWLLMQSFPDQLAFR

SEQ ID NO: 3178982 - protein, 20 aa, Giardia lamblia
LRNDLPWGLGALAAQVAHAS

SEQ ID NO: 3178983 - protein, 18 aa, Giardia lamblia
LRNIIALKDFQVFDRISF

SEQ ID NO: 3178984 - protein, 18 aa, Giardia lamblia
LRNPDIFKRVGIKPPKSI

SEQ ID NO: 3178985 - protein, 18 aa, Giardia lamblia
LRPLSYPGAHVFLLCFSV

SEQ ID NO: 3178986 - protein, 19 aa, Giardia lamblia
LRPRCLRHVYAVFDEAINT

SEQ ID NO: 3178987 - protein, 20 aa, Giardia lamblia
LRQSKSFFSYVLKSIIRQFK

SEQ ID NO: 3178988 - protein, 20 aa, Giardia lamblia
LRQSLCLAYGPAFISKCFIT

SEQ ID NO: 3178989 - protein, 19 aa, Giardia lamblia
LRRVFHILVSRGWWDAIGG

SEQ ID NO: 3178990 - protein, 20 aa, Giardia lamblia
LRSFKHLFLKHVYYADPGTK

SEQ ID NO: 3178991 - protein, 18 aa, Giardia lamblia
LRSKPCIYLDMARYNPSV

SEQ ID NO: 3178992 - protein, 17 aa, Giardia lamblia
LRSSAVLFDSKANTLLM

SEQ ID NO: 3178993 - protein, 18 aa, Giardia lamblia
LRSVFPYMHTDTVKKRYR

SEQ ID NO: 3178994 - protein, 19 aa, Giardia lamblia
LRSYCKIGLTATPLREDDE

SEQ ID NO: 3178995 - protein, 19 aa, Giardia lamblia
LRTCIWMHWAQIQALGGQP

SEQ ID NO: 3178996 - protein, 20 aa, Giardia lamblia
LRTSFDYIYLPLLKAPSYTK

SEQ ID NO: 3178997 - protein, 18 aa, Giardia lamblia
LRVAVHVITFLSRLEQTM

SEQ ID NO: 3178998 - protein, 19 aa, Giardia lamblia
LRVIIDMNCCSSLSVYIQF

SEQ ID NO: 3178999 - protein, 17 aa, Giardia lamblia
LRVPIPINEDPRCLDVT

SEQ ID NO: 3179000 - protein, 17 aa, Giardia lamblia
LRVYLRFSGDGSISISD

SEQ ID NO: 3179001 - protein, 17 aa, Giardia lamblia
LRWIKFGNLCLRFLAKF

SEQ ID NO: 3179002 - protein, 24 aa, Giardia lamblia
LRYELRRLFSAFGMVRDVSIVVNK

SEQ ID NO: 3179003 - protein, 19 aa, Giardia lamblia
LRYLSLQFERISAIGVQLS

SEQ ID NO: 3179004 - protein, 20 aa, Giardia lamblia
LRYNYRAEFSFQDKRVKYSD

SEQ ID NO: 3179005 - protein, 18 aa, Giardia lamblia
LRYRITLVAQGHVFRRPN

SEQ ID NO: 3179006 - protein, 24 aa, Giardia lamblia
LRYSEAFAGAFTRNVGDGKLHYYP

SEQ ID NO: 3179007 - protein, 18 aa, Giardia lamblia
LSAFFPSLEFRSCSLATL

SEQ ID NO: 3179008 - protein, 17 aa, Giardia lamblia
LSAFLAEYDLHTIELRK

SEQ ID NO: 3179009 - protein, 20 aa, Giardia lamblia
LSAKGKLDFVYALPCTVTHL

SEQ ID NO: 3179010 - protein, 19 aa, Giardia lamblia
LSAQDCLRHPWFVNTCPTT

SEQ ID NO: 3179011 - protein, 17 aa, Giardia lamblia
LSAREVLAFICSPNIPK

SEQ ID NO: 3179012 - protein, 17 aa, Giardia lamblia
LSCLVCATAWPAPYIAY

SEQ ID NO: 3179013 - protein, 23 aa, Giardia lamblia
LSDILFRRALRSIGIHGPVELLN

SEQ ID NO: 3179014 - protein, 20 aa, Giardia lamblia
LSDLFPPIVMPFIQAIKHEL

SEQ ID NO: 3179015 - protein, 24 aa, Giardia lamblia
LSDRVCPMLPPLFSNIICSLNPAV

SEQ ID NO: 3179016 - protein, 18 aa, Giardia lamblia
LSEAAIWDYIAQITDALI

SEQ ID NO: 3179017 - protein, 26 aa, Giardia lamblia
LSELRKSLQLELKRLNSFSVANDSMQ

SEQ ID NO: 3179018 - protein, 17 aa, Giardia lamblia
LSFGPLVKRVHTEGFCA

SEQ ID NO: 3179019 - protein, 17 aa, Giardia lamblia
LSFLKIDLFKAVTGLSE

SEQ ID NO: 3179020 - protein, 17 aa, Giardia lamblia
LSGEMLCISFAVMMTAQ

SEQ ID NO: 3179021 - protein, 19 aa, Giardia lamblia
LSGLMWPKILRYINKELQL

SEQ ID NO: 3179022 - protein, 17 aa, Giardia lamblia
LSGSSGFNCQTKIGRAR

SEQ ID NO: 3179023 - protein, 19 aa, Giardia lamblia
LSHLLSPWIEYVVNSIDKE

SEQ ID NO: 3179024 - protein, 18 aa, Giardia lamblia
LSHLPLLYLLDGDKDGLF

SEQ ID NO: 3179025 - protein, 20 aa, Giardia lamblia
LSIDFRTLWISTLAPSTGVL

SEQ ID NO: 3179026 - protein, 24 aa, Giardia lamblia
LSIFKRKIISLAMPYEKIAESSEG

SEQ ID NO: 3179027 - protein, 17 aa, Giardia lamblia
LSIGCTVMFAGTDHATP

SEQ ID NO: 3179028 - protein, 20 aa, Giardia lamblia
LSIIPCINWVQILVYNLPYK

SEQ ID NO: 3179029 - protein, 17 aa, Giardia lamblia
LSIPPPCLPQWGTPFSI

SEQ ID NO: 3179030 - protein, 25 aa, Giardia lamblia
LSKCRPRRAGTPLLYREGITTILSY

SEQ ID NO: 3179031 - protein, 21 aa, Giardia lamblia
LSKRGMCGQMILKKSRTIKSR

SEQ ID NO: 3179032 - protein, 23 aa, Giardia lamblia
LSKYKIRGMRMITRVMKIQALEV

SEQ ID NO: 3179033 - protein, 19 aa, Giardia lamblia
LSLEKPEILAPPSWDMPTG

SEQ ID NO: 3179034 - protein, 20 aa, Giardia lamblia
LSLHSIKTFLKRLEILAEDK

SEQ ID NO: 3179035 - protein, 20 aa, Giardia lamblia
LSLLKYLLCFHFEDMAKALM

SEQ ID NO: 3179036 - protein, 17 aa, Giardia lamblia
LSLPKKLSLVFQRDILP

SEQ ID NO: 3179037 - protein, 17 aa, Giardia lamblia
LSLTGAILLQFKTPHIT

SEQ ID NO: 3179038 - protein, 20 aa, Giardia lamblia
LSMRCVHAILPRLDSALFIV

SEQ ID NO: 3179039 - protein, 25 aa, Giardia lamblia
LSPEMTKRLLICFALISRNSTYRMN

SEQ ID NO: 3179040 - protein, 22 aa, Giardia lamblia
LSPRSSNPITFRDNAPKTSIQQ

SEQ ID NO: 3179041 - protein, 25 aa, Giardia lamblia
LSPWKRYSSLIINWACFEVRHIAAL

SEQ ID NO: 3179042 - protein, 18 aa, Giardia lamblia
LSPYFSIKDCRYSIGKQK

SEQ ID NO: 3179043 - protein, 22 aa, Giardia lamblia
LSQARLKAWVPLDCNFQNNKML

SEQ ID NO: 3179044 - protein, 17 aa, Giardia lamblia
LSQNCLQAFVAMRHVNI

SEQ ID NO: 3179045 - protein, 22 aa, Giardia lamblia
LSQRSVHGISHCSFFQHHFQEK

SEQ ID NO: 3179046 - protein, 25 aa, Giardia lamblia
LSRALELYSIYKFHVLPVINSQDQC

SEQ ID NO: 3179047 - protein, 18 aa, Giardia lamblia
LSRLSCYVFYNHICSAFA

SEQ ID NO: 3179048 - protein, 19 aa, Giardia lamblia
LSRLTICTNLSRFGASIIH

SEQ ID NO: 3179049 - protein, 22 aa, Giardia lamblia
LSRRGFYPLAFVFLSPTDFTRT

SEQ ID NO: 3179050 - protein, 22 aa, Giardia lamblia
LSSCALWELFPVTWFDINNPST

SEQ ID NO: 3179051 - protein, 19 aa, Giardia lamblia
LSSCSSCLLPILPYKLKNE

SEQ ID NO: 3179052 - protein, 24 aa, Giardia lamblia
LSSFKRFVFFAAYGSRRKALLAGR

SEQ ID NO: 3179053 - protein, 24 aa, Giardia lamblia
LSSIKGLPLSSVCAAGGDRGLSSV

SEQ ID NO: 3179054 - protein, 17 aa, Giardia lamblia
LSSPVLINALRDMQSEY

SEQ ID NO: 3179055 - protein, 23 aa, Giardia lamblia
LSSYAYTVCHLFPTEKGSCITRY

SEQ ID NO: 3179056 - protein, 17 aa, Giardia lamblia
LSTAMLHYFDVARAADI

SEQ ID NO: 3179057 - protein, 22 aa, Giardia lamblia
LSTRTARYFYHMHPIQYYSTPT

SEQ ID NO: 3179058 - protein, 18 aa, Giardia lamblia
LSVCLPGMAYRLGIFYST

SEQ ID NO: 3179059 - protein, 17 aa, Giardia lamblia
LSVESVRHFSPPSTPQL

SEQ ID NO: 3179060 - protein, 24 aa, Giardia lamblia
LSVLECLRSIIITLIRCGNLQDIV

SEQ ID NO: 3179061 - protein, 18 aa, Giardia lamblia
LSVRGCNVHHSFLSSLLE

SEQ ID NO: 3179062 - protein, 17 aa, Giardia lamblia
LSWAFLHRRCLPLHLSN

SEQ ID NO: 3179063 - protein, 28 aa, Giardia lamblia
LSYSEFLAAWGLKPVRIFIQKDPDTSME

SEQ ID NO: 3179064 - protein, 22 aa, Giardia lamblia
LSYYCLRPRPFSSLSVSIFPSY

SEQ ID NO: 3179065 - protein, 24 aa, Giardia lamblia
LTALPWQLVCSIGRARRAESLILY

SEQ ID NO: 3179066 - protein, 19 aa, Giardia lamblia
LTCGNGCIHLCDFNSNLVL

SEQ ID NO: 3179067 - protein, 21 aa, Giardia lamblia
LTDLKRLTCPTGLKNATTLTK

SEQ ID NO: 3179068 - protein, 18 aa, Giardia lamblia
LTDYCIVCLSLVPHHENL

SEQ ID NO: 3179069 - protein, 20 aa, Giardia lamblia
LTELRQRLLLMKEVNLQILE

SEQ ID NO: 3179070 - protein, 20 aa, Giardia lamblia
LTFFRLILCYNGTKYTKFAK

SEQ ID NO: 3179071 - protein, 17 aa, Giardia lamblia
LTGEALFSLSFFLRSVF

SEQ ID NO: 3179072 - protein, 20 aa, Giardia lamblia
LTGECAPSWYVPSSRAMKKR

SEQ ID NO: 3179073 - protein, 25 aa, Giardia lamblia
LTHWRLICYKKRYMRVFEDAHDAVA

SEQ ID NO: 3179074 - protein, 24 aa, Giardia lamblia
LTKLRFPDLFTLLDIRSISESPAS

SEQ ID NO: 3179075 - protein, 18 aa, Giardia lamblia
LTLLRRAGAILKRGDGEA

SEQ ID NO: 3179076 - protein, 18 aa, Giardia lamblia
LTNGSFFSRSSWTNEGIV

SEQ ID NO: 3179077 - protein, 19 aa, Giardia lamblia
LTNPEYFVDLGIEPPRSCI

SEQ ID NO: 3179078 - protein, 24 aa, Giardia lamblia
LTPDGRTALMLAIEGKYLEGIDLL

SEQ ID NO: 3179079 - protein, 17 aa, Giardia lamblia
LTPITKFLAAKESGIID

SEQ ID NO: 3179080 - protein, 19 aa, Giardia lamblia
LTPKTAWLDFLRKTISRKN

SEQ ID NO: 3179081 - protein, 17 aa, Giardia lamblia
LTRLAIRPLVQKALQKQ

SEQ ID NO: 3179082 - protein, 24 aa, Giardia lamblia
LTRRLKYAVLRARELEGKLKSQEK

SEQ ID NO: 3179083 - protein, 17 aa, Giardia lamblia
LTSACVFVCDLSSDASV

SEQ ID NO: 3179084 - protein, 17 aa, Giardia lamblia
LTSFNFRYAPPGASLSS

SEQ ID NO: 3179085 - protein, 22 aa, Giardia lamblia
LTTKLRVHFGVRGCSTVFPLVF

SEQ ID NO: 3179086 - protein, 21 aa, Giardia lamblia
LTTLLPFVICKTVYLCSDAEV

SEQ ID NO: 3179087 - protein, 19 aa, Giardia lamblia
LTTPEGWTSLMSAAKNGFT

SEQ ID NO: 3179088 - protein, 18 aa, Giardia lamblia
LTYYDFVCFILAEENRDL

SEQ ID NO: 3179089 - protein, 18 aa, Giardia lamblia
LVCPLNLLIARPIIVIAP

SEQ ID NO: 3179090 - protein, 23 aa, Giardia lamblia
LVCRMLIRLGAWYSDLLTPLDHK

SEQ ID NO: 3179091 - protein, 21 aa, Giardia lamblia
LVDALDFLIEYVRYGEEGHAS

SEQ ID NO: 3179092 - protein, 17 aa, Giardia lamblia
LVDIYQCLRFVSIHYDK

SEQ ID NO: 3179093 - protein, 17 aa, Giardia lamblia
LVDWCVYHITNLISKKF

SEQ ID NO: 3179094 - protein, 22 aa, Giardia lamblia
LVEIHGRLGLYKCVNQATGNVK

SEQ ID NO: 3179095 - protein, 20 aa, Giardia lamblia
LVILPDCRTALMIAAEAGSY

SEQ ID NO: 3179096 - protein, 22 aa, Giardia lamblia
LVMAGDFLSCFVESAISELVLS

SEQ ID NO: 3179097 - protein, 18 aa, Giardia lamblia
LVPESGLISDDGWSALML

SEQ ID NO: 3179098 - protein, 21 aa, Giardia lamblia
LVQWCLICASFHILQNYNMIG

SEQ ID NO: 3179099 - protein, 25 aa, Giardia lamblia
LVRLSEAFARLCLATAITKEHVKKA

SEQ ID NO: 3179100 - protein, 22 aa, Giardia lamblia
LVRRDWCPISRTISKRALEIIM

SEQ ID NO: 3179101 - protein, 18 aa, Giardia lamblia
LVRRGRLYLDRGDYQASY

SEQ ID NO: 3179102 - protein, 18 aa, Giardia lamblia
LVRSRLCNYLNLYPTEFV

SEQ ID NO: 3179103 - protein, 20 aa, Giardia lamblia
LVSLPVKVRQAATVMAKYHD

SEQ ID NO: 3179104 - protein, 20 aa, Giardia lamblia
LVTIKAMRLTAGLDCVPVST

SEQ ID NO: 3179105 - protein, 18 aa, Giardia lamblia
LVTLCLDNAFLTKEYNAF

SEQ ID NO: 3179106 - protein, 23 aa, Giardia lamblia
LVVPFCLNVAFILMDFDDTGKLL

SEQ ID NO: 3179107 - protein, 17 aa, Giardia lamblia
LVVRCCSHLFNKAAEEN

SEQ ID NO: 3179108 - protein, 19 aa, Giardia lamblia
LWALLNFISPLIFNVPEDF

SEQ ID NO: 3179109 - protein, 25 aa, Giardia lamblia
LWKGKRYSSVGGIVWSTEVCNTLQS

SEQ ID NO: 3179110 - protein, 23 aa, Giardia lamblia
LWRAKPRLAPGFSDQTLTYDLLE

SEQ ID NO: 3179111 - protein, 19 aa, Giardia lamblia
LWTPFPGVFVRPNCYSNYF

SEQ ID NO: 3179112 - protein, 17 aa, Giardia lamblia
LWTYVRMLDRMRSKTQD

SEQ ID NO: 3179113 - protein, 17 aa, Giardia lamblia
LWVGDCFYRKLEHKRDQ

SEQ ID NO: 3179114 - protein, 17 aa, Giardia lamblia
LWYICQYFLMDAQHVSH

SEQ ID NO: 3179115 - protein, 23 aa, Giardia lamblia
LYAALRMVWTISRYYNTEDRLLP

SEQ ID NO: 3179116 - protein, 18 aa, Giardia lamblia
LYAYAIKTPINWRKIATA

SEQ ID NO: 3179117 - protein, 19 aa, Giardia lamblia
LYDNWSLGESCVYLQEALA

SEQ ID NO: 3179118 - protein, 21 aa, Giardia lamblia
LYEDFCCICMDAPVKTVLMPC

SEQ ID NO: 3179119 - protein, 18 aa, Giardia lamblia
LYELPAQFFLQVNSPLGA

SEQ ID NO: 3179120 - protein, 17 aa, Giardia lamblia
LYFPLSGRIDHEFLLLT

SEQ ID NO: 3179121 - protein, 19 aa, Giardia lamblia
LYFSRLQYRNSIFEPVQSV

SEQ ID NO: 3179122 - protein, 19 aa, Giardia lamblia
LYGTTLLGLCLGFSMVAKP

SEQ ID NO: 3179123 - protein, 18 aa, Giardia lamblia
LYKKYGLLAKLREQHKEA

SEQ ID NO: 3179124 - protein, 18 aa, Giardia lamblia
LYKYNWRTGTGFLSTIDD

SEQ ID NO: 3179125 - protein, 18 aa, Giardia lamblia
LYLFDSFGDVVGFISSAG

SEQ ID NO: 3179126 - protein, 18 aa, Giardia lamblia
LYLLLEVVILCMTPLSSD

SEQ ID NO: 3179127 - protein, 26 aa, Giardia lamblia
LYLLSYRSVYVFSFLEIRLVKRINLS

SEQ ID NO: 3179128 - protein, 20 aa, Giardia lamblia
LYLLTMSGRMYIPFIYALHE

SEQ ID NO: 3179129 - protein, 17 aa, Giardia lamblia
LYLPFVRTILRNAEFHL

SEQ ID NO: 3179130 - protein, 17 aa, Giardia lamblia
LYLTLPIIRFKPQEAKK

SEQ ID NO: 3179131 - protein, 24 aa, Giardia lamblia
LYMRKRYEQITGWRFDMKSPSEYR

SEQ ID NO: 3179132 - protein, 18 aa, Giardia lamblia
LYPLLPFKACYYCNKLMH

SEQ ID NO: 3179133 - protein, 17 aa, Giardia lamblia
LYPRKPQRLSWHGITNV

SEQ ID NO: 3179134 - protein, 19 aa, Giardia lamblia
LYPSGSTKPVFFGKGKDTR

SEQ ID NO: 3179135 - protein, 18 aa, Giardia lamblia
LYPSRLALVKVVLDTLNN

SEQ ID NO: 3179136 - protein, 18 aa, Giardia lamblia
LYRRAFNVVERMKVKERE

SEQ ID NO: 3179137 - protein, 19 aa, Giardia lamblia
LYRRFLKYLHQWAPKQPSQ

SEQ ID NO: 3179138 - protein, 18 aa, Giardia lamblia
LYSFPALRDYYAPASEGW

SEQ ID NO: 3179139 - protein, 17 aa, Giardia lamblia
LYYKHWLYFSNTGKLAM

SEQ ID NO: 3179140 - protein, 25 aa, Giardia lamblia
MAAIWPRIVSMLSRRDIYRYTVPLL

SEQ ID NO: 3179141 - protein, 17 aa, Giardia lamblia
MAARAEFLSVRRRYLAA

SEQ ID NO: 3179142 - protein, 22 aa, Giardia lamblia
MAEPLLKCGIHPILITQGYQKA

SEQ ID NO: 3179143 - protein, 23 aa, Giardia lamblia
MAISTRLLVAVAFTDGDVCLFSS

SEQ ID NO: 3179144 - protein, 25 aa, Giardia lamblia
MALPDGRTALFLAIELKYMDIAEEL

SEQ ID NO: 3179145 - protein, 22 aa, Giardia lamblia
MALVRLQAIILCLQKNNEKNIR

SEQ ID NO: 3179146 - protein, 20 aa, Giardia lamblia
MANPRLTDILGYVTAAVHVV

SEQ ID NO: 3179147 - protein, 18 aa, Giardia lamblia
MAQLPFGSAQEWFDAVKR

SEQ ID NO: 3179148 - protein, 25 aa, Giardia lamblia
MASFLRSRFTLIPTSGMQHMSSIAL

SEQ ID NO: 3179149 - protein, 18 aa, Giardia lamblia
MASYRAGIIELRQKLLEQ

SEQ ID NO: 3179150 - protein, 18 aa, Giardia lamblia
MAYSKVYECWVTLDENGD

SEQ ID NO: 3179151 - protein, 24 aa, Giardia lamblia
MCISHRISLLVTFHFTAQFCYLVA

SEQ ID NO: 3179152 - protein, 23 aa, Giardia lamblia
MCLEEFRAFLLLCSSLQRVKLLL

SEQ ID NO: 3179153 - protein, 17 aa, Giardia lamblia
MCQLPFSCGRVCKRRLA

SEQ ID NO: 3179154 - protein, 22 aa, Giardia lamblia
MDFARMRIRIISLFQQTEIHHL

SEQ ID NO: 3179155 - protein, 18 aa, Giardia lamblia
MDHDLRINVAISIFDNLL

SEQ ID NO: 3179156 - protein, 24 aa, Giardia lamblia
MDIYPRLLLLLTLVSMKIKLSEGF

SEQ ID NO: 3179157 - protein, 18 aa, Giardia lamblia
MDKGKVYTWYFNTWSNKT

SEQ ID NO: 3179158 - protein, 17 aa, Giardia lamblia
MECPFCLAISPHLTSID

SEQ ID NO: 3179159 - protein, 21 aa, Giardia lamblia
MECPRGGSLRAHFDESIAILR

SEQ ID NO: 3179160 - protein, 18 aa, Giardia lamblia
MEIPSLDFFLGVQFHPEL

SEQ ID NO: 3179161 - protein, 22 aa, Giardia lamblia
MEVKRLLEHANILRAEHMASLT

SEQ ID NO: 3179162 - protein, 21 aa, Giardia lamblia
MEYLRAIPLVRIEKLTRTLME

SEQ ID NO: 3179163 - protein, 18 aa, Giardia lamblia
MFMWRCIVSLSKTMSKDI

SEQ ID NO: 3179164 - protein, 22 aa, Giardia lamblia
MFSGLCQTGAWSCFDEFNRLYV

SEQ ID NO: 3179165 - protein, 17 aa, Giardia lamblia
MGAGFYPAFKAYSQNKF

SEQ ID NO: 3179166 - protein, 21 aa, Giardia lamblia
MGCLRLPLLTKRELFELSGKL

SEQ ID NO: 3179167 - protein, 25 aa, Giardia lamblia
MGCTFYRPDMDHVFELPQVDNGQLF

SEQ ID NO: 3179168 - protein, 20 aa, Giardia lamblia
MGDKTILCFSGRFHSYEGYT

SEQ ID NO: 3179169 - protein, 17 aa, Giardia lamblia
MGLGMFWCGFLLAAVAS

SEQ ID NO: 3179170 - protein, 18 aa, Giardia lamblia
MGLRDSHIMREAAGGRFL

SEQ ID NO: 3179171 - protein, 19 aa, Giardia lamblia
MGLSVTLYDIWGRDLSNEQ

SEQ ID NO: 3179172 - protein, 21 aa, Giardia lamblia
MGPKVRAAIEFTQATGKMSII

SEQ ID NO: 3179173 - protein, 21 aa, Giardia lamblia
MGSCLRCLAVIIAYLQDNDIA

SEQ ID NO: 3179174 - protein, 18 aa, Giardia lamblia
MHAPSGWTAMMFASSEGN

SEQ ID NO: 3179175 - protein, 18 aa, Giardia lamblia
MIEQLKLAEVAARQRLLL

SEQ ID NO: 3179176 - protein, 19 aa, Giardia lamblia
MIGRLSLQLEEEIKARKAV

SEQ ID NO: 3179177 - protein, 23 aa, Giardia lamblia
MILCKACAPLASKKCPYCRKKVS

SEQ ID NO: 3179178 - protein, 19 aa, Giardia lamblia
MIPELKASILAACEAELTS

SEQ ID NO: 3179179 - protein, 20 aa, Giardia lamblia
MIVACLYLRVSGKFNAELEV

SEQ ID NO: 3179180 - protein, 20 aa, Giardia lamblia
MIVACLYLRVSGKLSAELEV

SEQ ID NO: 3179181 - protein, 19 aa, Giardia lamblia
MKAALPALIRPYSDVIVLL

SEQ ID NO: 3179182 - protein, 20 aa, Giardia lamblia
MKADSVIMLASFEKTGEHLF

SEQ ID NO: 3179183 - protein, 21 aa, Giardia lamblia
MKCRRGCLSLSHFINHLTQQG

SEQ ID NO: 3179184 - protein, 22 aa, Giardia lamblia
MKIWYSRLVAEPGLKRDVAHGS

SEQ ID NO: 3179185 - protein, 17 aa, Giardia lamblia
MKLILSKGGASFMADAR

SEQ ID NO: 3179186 - protein, 20 aa, Giardia lamblia
MKNRFSCLNAFYGDMAIRLV

SEQ ID NO: 3179187 - protein, 19 aa, Giardia lamblia
MKRFSCTPLMIAVAQNDVK

SEQ ID NO: 3179188 - protein, 19 aa, Giardia lamblia
MKTISGWCAVMSAASNNHR

SEQ ID NO: 3179189 - protein, 20 aa, Giardia lamblia
MKTKRLNSLAGISVKSRTAL

SEQ ID NO: 3179190 - protein, 21 aa, Giardia lamblia
MKVSLMAAHFLWFLNTSSRGV

SEQ ID NO: 3179191 - protein, 18 aa, Giardia lamblia
MLATAEWKFLCTVHSTDP

SEQ ID NO: 3179192 - protein, 23 aa, Giardia lamblia
MLDWYRLGIQFSHRSGLSGPGGV

SEQ ID NO: 3179193 - protein, 21 aa, Giardia lamblia
MLERINLWTGCPIQCTELIYG

SEQ ID NO: 3179194 - protein, 17 aa, Giardia lamblia
MLGESFGGYVLTYYTQP

SEQ ID NO: 3179195 - protein, 19 aa, Giardia lamblia
MLHYCSFKNIMTIAHLSDS

SEQ ID NO: 3179196 - protein, 17 aa, Giardia lamblia
MLLEIQMIYSLYLGKDT

SEQ ID NO: 3179197 - protein, 20 aa, Giardia lamblia
MLLPIAQFVTLISFLLRRQF

SEQ ID NO: 3179198 - protein, 19 aa, Giardia lamblia
MLPFAWNLDRIKAIPKSLH

SEQ ID NO: 3179199 - protein, 22 aa, Giardia lamblia
MLQRFARRCLYGLVKRKIGVNF

SEQ ID NO: 3179200 - protein, 24 aa, Giardia lamblia
MLRGKMAILQACCFVPGKSEGSAE

SEQ ID NO: 3179201 - protein, 20 aa, Giardia lamblia
MLSYVFSIWIQQAREKLGKR

SEQ ID NO: 3179202 - protein, 27 aa, Giardia lamblia
MMTAILHKIRLVYDMNLLYTGQKALQC

SEQ ID NO: 3179203 - protein, 23 aa, Giardia lamblia
MMVYRLIDFTAIFPITPSSVMAE

SEQ ID NO: 3179204 - protein, 26 aa, Giardia lamblia
MNDLLHRCSHAWRAAGVNIFRLNEAQ

SEQ ID NO: 3179205 - protein, 17 aa, Giardia lamblia
MNGRTALMYAAAASRFE

SEQ ID NO: 3179206 - protein, 17 aa, Giardia lamblia
MNTRLPANISELDRYDL

SEQ ID NO: 3179207 - protein, 20 aa, Giardia lamblia
MPKGSWLIGFGLDDNGLRRG

SEQ ID NO: 3179208 - protein, 17 aa, Giardia lamblia
MPKKWSISPAFLQFMET

SEQ ID NO: 3179209 - protein, 17 aa, Giardia lamblia
MPKPRFSLRQYAPLDKK

SEQ ID NO: 3179210 - protein, 17 aa, Giardia lamblia
MPPCIINSFVSRNFFIE

SEQ ID NO: 3179211 - protein, 17 aa, Giardia lamblia
MPPIDWEKVYVMRKQIS

SEQ ID NO: 3179212 - protein, 17 aa, Giardia lamblia
MPRSRLFGMKRTTETAH

SEQ ID NO: 3179213 - protein, 20 aa, Giardia lamblia
MPSPEVFKAALSLSSSLQDA

SEQ ID NO: 3179214 - protein, 25 aa, Giardia lamblia
MQMGHPELRGCWAMNGDMCHICGHS

SEQ ID NO: 3179215 - protein, 17 aa, Giardia lamblia
MQRIAVKALQKFTQQGT

SEQ ID NO: 3179216 - protein, 17 aa, Giardia lamblia
MQTALMIAAERDHAKII

SEQ ID NO: 3179217 - protein, 17 aa, Giardia lamblia
MQTCCGWTALMFAAKAG

SEQ ID NO: 3179218 - protein, 21 aa, Giardia lamblia
MQVEMVKLLGVELTDMHDRCA

SEQ ID NO: 3179219 - protein, 17 aa, Giardia lamblia
MQWLRTAWESFVVDGAT

SEQ ID NO: 3179220 - protein, 17 aa, Giardia lamblia
MREGENFTLGKDIFLKG

SEQ ID NO: 3179221 - protein, 20 aa, Giardia lamblia
MRFWSCNRPGTLLHDIFHHS

SEQ ID NO: 3179222 - protein, 19 aa, Giardia lamblia
MRHITKVAGALSCQVIEVS

SEQ ID NO: 3179223 - protein, 22 aa, Giardia lamblia
MRKPVRFSHCMHVFCADCVHYL

SEQ ID NO: 3179224 - protein, 27 aa, Giardia lamblia
MRLREWMVWHFPELITIVPDNIDYART

SEQ ID NO: 3179225 - protein, 19 aa, Giardia lamblia
MRPFPAIHVEFGYAPYELV

SEQ ID NO: 3179226 - protein, 18 aa, Giardia lamblia
MRPYISILVPGSIQPLMK

SEQ ID NO: 3179227 - protein, 26 aa, Giardia lamblia
MRQEGKSYCELALWQVAAQLIDTMTY

SEQ ID NO: 3179228 - protein, 22 aa, Giardia lamblia
MRQLKRPFSHAGHIHTRASDVE

SEQ ID NO: 3179229 - protein, 21 aa, Giardia lamblia
MRQSLRLARRIGLELKHHNII

SEQ ID NO: 3179230 - protein, 19 aa, Giardia lamblia
MRRAAECSRTLELENNSYK

SEQ ID NO: 3179231 - protein, 18 aa, Giardia lamblia
MRSIEVVRILKLKSLRIA

SEQ ID NO: 3179232 - protein, 18 aa, Giardia lamblia
MRTTYGLPSCKLNVRVSN

SEQ ID NO: 3179233 - protein, 25 aa, Giardia lamblia
MSMQCKAIERMSRFVSMESSSYSDS

SEQ ID NO: 3179234 - protein, 20 aa, Giardia lamblia
MSNGCLVAWDMRYEPSPLAR

SEQ ID NO: 3179235 - protein, 17 aa, Giardia lamblia
MSPELPELLALYPEATK

SEQ ID NO: 3179236 - protein, 17 aa, Giardia lamblia
MSPLLMPVIKRWVNYYT

SEQ ID NO: 3179237 - protein, 22 aa, Giardia lamblia
MSRIGLIALEWFQVAADRDETS

SEQ ID NO: 3179238 - protein, 23 aa, Giardia lamblia
MSRPRIADINKWIGVFITSTTRR

SEQ ID NO: 3179239 - protein, 17 aa, Giardia lamblia
MSSTLFIKMTPRFAKPC

SEQ ID NO: 3179240 - protein, 25 aa, Giardia lamblia
MTALLYACEFGCRYCVHLLKDEAHI

SEQ ID NO: 3179241 - protein, 20 aa, Giardia lamblia
MTFRADAGLTLKGFTPGEQS

SEQ ID NO: 3179242 - protein, 27 aa, Giardia lamblia
MTMLSEWRGATALMWAARLGHYEACEL

SEQ ID NO: 3179243 - protein, 20 aa, Giardia lamblia
MTTDCGWNPLMHSIIRQNMH

SEQ ID NO: 3179244 - protein, 17 aa, Giardia lamblia
MTYRSLCKFLVGKFRLP

SEQ ID NO: 3179245 - protein, 17 aa, Giardia lamblia
MVCGYTLSPNTTADAFR

SEQ ID NO: 3179246 - protein, 19 aa, Giardia lamblia
MVDHFKRYLAPSIVTHGGQ

SEQ ID NO: 3179247 - protein, 17 aa, Giardia lamblia
MVFKPGMLRGGDVTFSC

SEQ ID NO: 3179248 - protein, 18 aa, Giardia lamblia
MVHILKQHEAGCCDNRGY

SEQ ID NO: 3179249 - protein, 23 aa, Giardia lamblia
MVPARPDLLASLVREYYPTLPEI

SEQ ID NO: 3179250 - protein, 19 aa, Giardia lamblia
MVQMLLKFGVNPLVRDNNG

SEQ ID NO: 3179251 - protein, 26 aa, Giardia lamblia
MVQRVVEMYIVFSLVWAFGGSLDSDG

SEQ ID NO: 3179252 - protein, 22 aa, Giardia lamblia
MVSRLPDPVCYDIYDELERDLR

SEQ ID NO: 3179253 - protein, 19 aa, Giardia lamblia
MVTLIEFPTLFGVIRDRIR

SEQ ID NO: 3179254 - protein, 19 aa, Giardia lamblia
MWLERRLCLLKIPVDKLKE

SEQ ID NO: 3179255 - protein, 21 aa, Giardia lamblia
MWSMGCIMYFLANKRALFQVR

SEQ ID NO: 3179256 - protein, 18 aa, Giardia lamblia
MWYCSGATGFWCGSIKGL

SEQ ID NO: 3179257 - protein, 23 aa, Giardia lamblia
MYIYSLDFFKMLFTRTLSKLQSL

SEQ ID NO: 3179258 - protein, 25 aa, Giardia lamblia
MYRFSRPLLRMAICTLSPKGHIRVK

SEQ ID NO: 3179259 - protein, 24 aa, Giardia lamblia
NAAGDTLLHWAVRVRAKSCIPKLL

SEQ ID NO: 3179260 - protein, 19 aa, Giardia lamblia
NACKSCWSLDSGKIAMGDV

SEQ ID NO: 3179261 - protein, 20 aa, Giardia lamblia
NADHAFPLVFVRFDKFVRSG

SEQ ID NO: 3179262 - protein, 23 aa, Giardia lamblia
NAHLKHWICFDSPVDALWIENLN

SEQ ID NO: 3179263 - protein, 19 aa, Giardia lamblia
NAIGCVELLAGCEAGIQDR

SEQ ID NO: 3179264 - protein, 25 aa, Giardia lamblia
NAILSHAPFEWGWADVDGYTALMHA

SEQ ID NO: 3179265 - protein, 20 aa, Giardia lamblia
NAISCAFTLLPSERKKTDLT

SEQ ID NO: 3179266 - protein, 25 aa, Giardia lamblia
NALACKKLALRLAIYDSNHHPEKNN

SEQ ID NO: 3179267 - protein, 17 aa, Giardia lamblia
NALRFILHQPLPHQNNN

SEQ ID NO: 3179268 - protein, 17 aa, Giardia lamblia
NAVCSPAIYAKISTRME

SEQ ID NO: 3179269 - protein, 19 aa, Giardia lamblia
NAYCELCLTLLACNISVQS

SEQ ID NO: 3179270 - protein, 21 aa, Giardia lamblia
NCANCTIFLIAPCSHVVIANC

SEQ ID NO: 3179271 - protein, 20 aa, Giardia lamblia
NCDQAFCGSNLFAEILISAL

SEQ ID NO: 3179272 - protein, 17 aa, Giardia lamblia
NCFCTMGGGIAASISSR

SEQ ID NO: 3179273 - protein, 18 aa, Giardia lamblia
NCIAKVAVMLARLGDVEG

SEQ ID NO: 3179274 - protein, 17 aa, Giardia lamblia
NCKYRLPTSPGYSEDLK

SEQ ID NO: 3179275 - protein, 18 aa, Giardia lamblia
NCTMIRYKKAITLPIRLR

SEQ ID NO: 3179276 - protein, 17 aa, Giardia lamblia
NCTRMKLHINAVISEDA

SEQ ID NO: 3179277 - protein, 24 aa, Giardia lamblia
NDFFKRFMIQFGMYDARTKRYVKD

SEQ ID NO: 3179278 - protein, 19 aa, Giardia lamblia
NDFWLYDSVSMQWREINIY

SEQ ID NO: 3179279 - protein, 18 aa, Giardia lamblia
NDIIFFWVARMVMLSLEL

SEQ ID NO: 3179280 - protein, 26 aa, Giardia lamblia
NDIRWKLKCLCALYCIRNNNAEQALN

SEQ ID NO: 3179281 - protein, 23 aa, Giardia lamblia
NDKRISLLVLHFLLLENTAAAKD

SEQ ID NO: 3179282 - protein, 20 aa, Giardia lamblia
NDLRLKYNVLYKEYQELQST

SEQ ID NO: 3179283 - protein, 22 aa, Giardia lamblia
NDLWLKPDRNIGVTSCIIIAPH

SEQ ID NO: 3179284 - protein, 18 aa, Giardia lamblia
NDNYCLFEDWIIPIFDEC

SEQ ID NO: 3179285 - protein, 25 aa, Giardia lamblia
NDRIYSLACVISYNLGCHYESLGQD

SEQ ID NO: 3179286 - protein, 18 aa, Giardia lamblia
NDRLKKKIALMLDGESVE

SEQ ID NO: 3179287 - protein, 24 aa, Giardia lamblia
NDSYFPVTVAFIFDSMLHGLAELT

SEQ ID NO: 3179288 - protein, 17 aa, Giardia lamblia
NDTEWPKLACFTLDSGQ

SEQ ID NO: 3179289 - protein, 17 aa, Giardia lamblia
NDTWYFVEKAVRLTNVI

SEQ ID NO: 3179290 - protein, 21 aa, Giardia lamblia
NEAQFLVCGGVTVTPATNQPG

SEQ ID NO: 3179291 - protein, 19 aa, Giardia lamblia
NECVLFWKPGLQAPYQRWP

SEQ ID NO: 3179292 - protein, 17 aa, Giardia lamblia
NEFKPWFLALRKRCPVK

SEQ ID NO: 3179293 - protein, 18 aa, Giardia lamblia
NELLRVCATLLLPFIPQK

SEQ ID NO: 3179294 - protein, 19 aa, Giardia lamblia
NELRQEYKTVIDLLSTLQG

SEQ ID NO: 3179295 - protein, 18 aa, Giardia lamblia
NEPAPLWVPDGIRTLPLT

SEQ ID NO: 3179296 - protein, 25 aa, Giardia lamblia
NERTCLMVAASLGFVELVKLLIPYE

SEQ ID NO: 3179297 - protein, 17 aa, Giardia lamblia
NESFAPYDPVSMIQESQ

SEQ ID NO: 3179298 - protein, 24 aa, Giardia lamblia
NEVCQWKADRKCLTHSKGYELAPQ

SEQ ID NO: 3179299 - protein, 18 aa, Giardia lamblia
NEVYELRKRFDYMRERFE

SEQ ID NO: 3179300 - protein, 20 aa, Giardia lamblia
NFHGRTALHFAVELGNFEVA

SEQ ID NO: 3179301 - protein, 21 aa, Giardia lamblia
NFIDVPPLYAFPGARLNATNG

SEQ ID NO: 3179302 - protein, 22 aa, Giardia lamblia
NFIRFSFTPDYMKFGMTSGLDR

SEQ ID NO: 3179303 - protein, 23 aa, Giardia lamblia
NFITCLRGALQLDLTKASPIRYR

SEQ ID NO: 3179304 - protein, 19 aa, Giardia lamblia
NFPNLRILYLQGNRIQDVR

SEQ ID NO: 3179305 - protein, 18 aa, Giardia lamblia
NFYLLMEFCNGGEFAEVL

SEQ ID NO: 3179306 - protein, 21 aa, Giardia lamblia
NGCIHLCDFNSNLVLFTGYYE

SEQ ID NO: 3179307 - protein, 27 aa, Giardia lamblia
NGFLSHCWKLYPNHKWELLPVQKNGPM

SEQ ID NO: 3179308 - protein, 17 aa, Giardia lamblia
NGFSFGSLDGLGGSAGN

SEQ ID NO: 3179309 - protein, 23 aa, Giardia lamblia
NGHLECIRLLLSEEGGMQDNKGR

SEQ ID NO: 3179310 - protein, 19 aa, Giardia lamblia
NGHLECTRILASVEGGIVD

SEQ ID NO: 3179311 - protein, 23 aa, Giardia lamblia
NGHPECVRLLLGRESGMKNDKGW

SEQ ID NO: 3179312 - protein, 21 aa, Giardia lamblia
NGHPECVRLLLKEEGGMRNNK

SEQ ID NO: 3179313 - protein, 17 aa, Giardia lamblia
NGIKEAFVHDSLVPCAS

SEQ ID NO: 3179314 - protein, 20 aa, Giardia lamblia
NGLTALDWAINCHKSVDPTC

SEQ ID NO: 3179315 - protein, 22 aa, Giardia lamblia
NGSRAIEILMMISKQLMEEAKG

SEQ ID NO: 3179316 - protein, 19 aa, Giardia lamblia
NGVLLCLSLRYAMIHSQYG

SEQ ID NO: 3179317 - protein, 17 aa, Giardia lamblia
NGYSEMICHLISEAGMQ

SEQ ID NO: 3179318 - protein, 17 aa, Giardia lamblia
NHDIPRHMEYAGCALTN

SEQ ID NO: 3179319 - protein, 18 aa, Giardia lamblia
NHDMSWTILPVCYEDVHE

SEQ ID NO: 3179320 - protein, 17 aa, Giardia lamblia
NHEECCFLLAPYEALIC

SEQ ID NO: 3179321 - protein, 19 aa, Giardia lamblia
NHLACKTCAAIYYVSQTPC

SEQ ID NO: 3179322 - protein, 22 aa, Giardia lamblia
NICPSESLDFCCAYSEQLRPLL

SEQ ID NO: 3179323 - protein, 23 aa, Giardia lamblia
NIFKGLAQSGAWGCFDEFNRISI

SEQ ID NO: 3179324 - protein, 21 aa, Giardia lamblia
NIKRCFVCLNVFVSKLHKVLV

SEQ ID NO: 3179325 - protein, 18 aa, Giardia lamblia
NIKRMVTPIARLRDPSRS

SEQ ID NO: 3179326 - protein, 17 aa, Giardia lamblia
NIQAAFWKRCLQTGLVA

SEQ ID NO: 3179327 - protein, 24 aa, Giardia lamblia
NIRELSFELARVMRLYNEAIRVFR

SEQ ID NO: 3179328 - protein, 18 aa, Giardia lamblia
NIVFSFSPKCVGFHHFKV

SEQ ID NO: 3179329 - protein, 19 aa, Giardia lamblia
NIVKALMCYELGIKDRNGW

SEQ ID NO: 3179330 - protein, 20 aa, Giardia lamblia
NIYLGWCRRYPIVSFEDPFD

SEQ ID NO: 3179331 - protein, 18 aa, Giardia lamblia
NKALGCSFMQPYIIVAYH

SEQ ID NO: 3179332 - protein, 23 aa, Giardia lamblia
NKEGLTALCFACMYGSIDCVRVL

SEQ ID NO: 3179333 - protein, 20 aa, Giardia lamblia
NKGKAAIHYAELGGHSGVMA

SEQ ID NO: 3179334 - protein, 17 aa, Giardia lamblia
NKGRSALMYAAELGNAV

SEQ ID NO: 3179335 - protein, 21 aa, Giardia lamblia
NKNVRGCFVLHGLDGNLSGFD

SEQ ID NO: 3179336 - protein, 19 aa, Giardia lamblia
NKPGLRPPLSLSSRSSSSR

SEQ ID NO: 3179337 - protein, 18 aa, Giardia lamblia
NKPVDVWSLAAIQARLHD

SEQ ID NO: 3179338 - protein, 27 aa, Giardia lamblia
NKRKFICLSSFLTWCRTELPPRQLEDK

SEQ ID NO: 3179339 - protein, 22 aa, Giardia lamblia
NKRLRADLVLARERVSEKRLAD

SEQ ID NO: 3179340 - protein, 19 aa, Giardia lamblia
NKSKLCRRLVHFEGDLTGG

SEQ ID NO: 3179341 - protein, 25 aa, Giardia lamblia
NLCPRLLDWLIRLALKYIESPEEFK

SEQ ID NO: 3179342 - protein, 17 aa, Giardia lamblia
NLCRKRTLVAIGTHDLD

SEQ ID NO: 3179343 - protein, 19 aa, Giardia lamblia
NLCRRLVVVGIPFPNLGDP

SEQ ID NO: 3179344 - protein, 22 aa, Giardia lamblia
NLDCVKLLASIESGHLSPEGYS

SEQ ID NO: 3179345 - protein, 22 aa, Giardia lamblia
NLESIPSYWLERLQKTRAGLSR

SEQ ID NO: 3179346 - protein, 19 aa, Giardia lamblia
NLLISRFVDHMHRIQSQLE

SEQ ID NO: 3179347 - protein, 23 aa, Giardia lamblia
NLLPRLLCAGGFLKTYILPNSNK

SEQ ID NO: 3179348 - protein, 17 aa, Giardia lamblia
NLLQLSFNVQFKLVSVR

SEQ ID NO: 3179349 - protein, 18 aa, Giardia lamblia
NLLRAKRFITCFMDDDVV

SEQ ID NO: 3179350 - protein, 26 aa, Giardia lamblia
NLLRIPRRPAWCVGMSKEELQSREQE

SEQ ID NO: 3179351 - protein, 24 aa, Giardia lamblia
NLPCEGRVSCKFARQHIIIQHTVR

SEQ ID NO: 3179352 - protein, 22 aa, Giardia lamblia
NLPKAVWLPALFNPQSFLRAVL

SEQ ID NO: 3179353 - protein, 20 aa, Giardia lamblia
NMAPILPCYLKLLKQQRINA

SEQ ID NO: 3179354 - protein, 22 aa, Giardia lamblia
NMGRTALMFAARNCNLIGVQVL

SEQ ID NO: 3179355 - protein, 23 aa, Giardia lamblia
NNARLNVFFKFCVEELLVHLPAN

SEQ ID NO: 3179356 - protein, 22 aa, Giardia lamblia
NNIALKGVCHFYGDDKPHLAIS

SEQ ID NO: 3179357 - protein, 23 aa, Giardia lamblia
NNLECVKFLIQHEMTMRLPPSDG

SEQ ID NO: 3179358 - protein, 21 aa, Giardia lamblia
NNLECVRLLASKEGDIKTTHN

SEQ ID NO: 3179359 - protein, 24 aa, Giardia lamblia
NPKDFPCIFFLHNCCDKGDKCKYS

SEQ ID NO: 3179360 - protein, 20 aa, Giardia lamblia
NPKLRVVVMSATIAAASFVR

SEQ ID NO: 3179361 - protein, 23 aa, Giardia lamblia
NPLTVWCLIPLQGRVQDWSGKTA

SEQ ID NO: 3179362 - protein, 19 aa, Giardia lamblia
NPRGGLTMRDKCLVLDSSA

SEQ ID NO: 3179363 - protein, 23 aa, Giardia lamblia
NPTVLRFSGFRGITELALSKVGS

SEQ ID NO: 3179364 - protein, 25 aa, Giardia lamblia
NPVRLPLRRKINCFREVDSLLYAGT

SEQ ID NO: 3179365 - protein, 20 aa, Giardia lamblia
NRHLDCVRWLAKKEGGIQDS

SEQ ID NO: 3179366 - protein, 19 aa, Giardia lamblia
NRKTPKYGVLFSAPQVSKV

SEQ ID NO: 3179367 - protein, 17 aa, Giardia lamblia
NRLGEIEAKASTDESLA

SEQ ID NO: 3179368 - protein, 17 aa, Giardia lamblia
NRLTHCASQFITANLPF

SEQ ID NO: 3179369 - protein, 18 aa, Giardia lamblia
NRQISCDLCSKRATLQCL

SEQ ID NO: 3179370 - protein, 18 aa, Giardia lamblia
NRRVLCALAIGYPAVQMP

SEQ ID NO: 3179371 - protein, 22 aa, Giardia lamblia
NRTFCSLPHIIKAGLGRVGVVY

SEQ ID NO: 3179372 - protein, 20 aa, Giardia lamblia
NRVECVKLLMAHEAGMSKTS

SEQ ID NO: 3179373 - protein, 18 aa, Giardia lamblia
NRVVYRGGVDFLIQDSVG

SEQ ID NO: 3179374 - protein, 19 aa, Giardia lamblia
NRYRFSCLVDRMLPISQLR

SEQ ID NO: 3179375 - protein, 17 aa, Giardia lamblia
NSCSVWALLEKKMAFIS

SEQ ID NO: 3179376 - protein, 24 aa, Giardia lamblia
NSEIRRYLQYAGRFNGDGVTALMI

SEQ ID NO: 3179377 - protein, 20 aa, Giardia lamblia
NSFPHCVLRPFIIVITNSFT

SEQ ID NO: 3179378 - protein, 24 aa, Giardia lamblia
NSGVSFHESVLWKVASQLLKALVD

SEQ ID NO: 3179379 - protein, 24 aa, Giardia lamblia
NSHLECIKLLLAREGGLQDIEGWT

SEQ ID NO: 3179380 - protein, 17 aa, Giardia lamblia
NSIAHVYETHFLPHERY

SEQ ID NO: 3179381 - protein, 24 aa, Giardia lamblia
NSIIKLCMRFHISIETWSKRYKEE

SEQ ID NO: 3179382 - protein, 22 aa, Giardia lamblia
NSIRFNIKPGYTLEQALRPKNC

SEQ ID NO: 3179383 - protein, 17 aa, Giardia lamblia
NSKELFLRLTARISAPV

SEQ ID NO: 3179384 - protein, 23 aa, Giardia lamblia
NSLKHILAIYAYRVLDNKEFSVQ

SEQ ID NO: 3179385 - protein, 20 aa, Giardia lamblia
NSLQRRWDCILRQLDDYEAL

SEQ ID NO: 3179386 - protein, 21 aa, Giardia lamblia
NSPCGRLLIRGDYTSQTSCIL

SEQ ID NO: 3179387 - protein, 19 aa, Giardia lamblia
NSVCCFEHLMTAFTNIPNS

SEQ ID NO: 3179388 - protein, 19 aa, Giardia lamblia
NSVFYAEGWAYLNAAEAIG

SEQ ID NO: 3179389 - protein, 18 aa, Giardia lamblia
NSVTILLQYYDGMEDRSG

SEQ ID NO: 3179390 - protein, 17 aa, Giardia lamblia
NTCSFPYAEFLCATVEY

SEQ ID NO: 3179391 - protein, 24 aa, Giardia lamblia
NTHYIFIVVHFWDFQPLVSRAIEF

SEQ ID NO: 3179392 - protein, 23 aa, Giardia lamblia
NTIPGIRYNFFIANFTKTSSQYS

SEQ ID NO: 3179393 - protein, 18 aa, Giardia lamblia
NTLPIIDFRSLSPLHREK

SEQ ID NO: 3179394 - protein, 17 aa, Giardia lamblia
NTRVCAQEHALLVTALK

SEQ ID NO: 3179395 - protein, 19 aa, Giardia lamblia
NVACIKLLLSREAGLLTNA

SEQ ID NO: 3179396 - protein, 19 aa, Giardia lamblia
NVCWWDCSACKLLGKIKLQ

SEQ ID NO: 3179397 - protein, 18 aa, Giardia lamblia
NVEGRTALMLAAAANNPE

SEQ ID NO: 3179398 - protein, 20 aa, Giardia lamblia
NVFIKPDFNLKVRFWFYFRV

SEQ ID NO: 3179399 - protein, 18 aa, Giardia lamblia
NVGFKYGVSLLLNEELSL

SEQ ID NO: 3179400 - protein, 17 aa, Giardia lamblia
NVIGVDWTGPITGKPNL

SEQ ID NO: 3179401 - protein, 17 aa, Giardia lamblia
NVLRIITVPGWLRGPFE

SEQ ID NO: 3179402 - protein, 19 aa, Giardia lamblia
NVNVVPFLLCEVGMKNNMG

SEQ ID NO: 3179403 - protein, 22 aa, Giardia lamblia
NVVKQCRDTFELLSRADQVDSI

SEQ ID NO: 3179404 - protein, 22 aa, Giardia lamblia
NVWCPGCDSSLIYAIKANKLPF

SEQ ID NO: 3179405 - protein, 22 aa, Giardia lamblia
NWERGYCDLCCLSLSKAFMLGC

SEQ ID NO: 3179406 - protein, 18 aa, Giardia lamblia
NYCGVEWDSSVGKYDGEY

SEQ ID NO: 3179407 - protein, 34 aa, Giardia lamblia
NYHVVELWKGQSIVLRFGITWSMYRHTYSEMSAG

SEQ ID NO: 3179408 - protein, 23 aa, Giardia lamblia
NYKAGEVILLYGIGWCDIIGASG

SEQ ID NO: 3179409 - protein, 24 aa, Giardia lamblia
NYKLWRYLFCPVPVLEIKTKKTLD

SEQ ID NO: 3179410 - protein, 23 aa, Giardia lamblia
NYRTKLDMLRCLYADNGLTQPLE

SEQ ID NO: 3179411 - protein, 20 aa, Giardia lamblia
NYSGICKALIPYEKAICTPD

SEQ ID NO: 3179412 - protein, 17 aa, Giardia lamblia
PAFEIHKDFRLYLTTIP

SEQ ID NO: 3179413 - protein, 18 aa, Giardia lamblia
PAILRLLLEIAFVVPCDD

SEQ ID NO: 3179414 - protein, 23 aa, Giardia lamblia
PAKYFADPAVKEWLLDSKNGILL

SEQ ID NO: 3179415 - protein, 23 aa, Giardia lamblia
PALDLSLSFSLIDAHRFPGGQAD

SEQ ID NO: 3179416 - protein, 18 aa, Giardia lamblia
PALVYSICYCYADSPASF

SEQ ID NO: 3179417 - protein, 22 aa, Giardia lamblia
PAPPEWEPWILPPKVSLAEYNN

SEQ ID NO: 3179418 - protein, 18 aa, Giardia lamblia
PAVPRMAFSIVVQLDVDG

SEQ ID NO: 3179419 - protein, 17 aa, Giardia lamblia
PAYNISPSKKCNSTDPM

SEQ ID NO: 3179420 - protein, 19 aa, Giardia lamblia
PCDVWLLGIGHNGHIAFNE

SEQ ID NO: 3179421 - protein, 20 aa, Giardia lamblia
PCFYCTSWMYPKRKRPLCSV

SEQ ID NO: 3179422 - protein, 23 aa, Giardia lamblia
PCGMSISCGFLFSSRIPEQGIKQ

SEQ ID NO: 3179423 - protein, 19 aa, Giardia lamblia
PCIINSFVSRNFFIENTGD

SEQ ID NO: 3179424 - protein, 17 aa, Giardia lamblia
PCLALSSVVSWELLPKM

SEQ ID NO: 3179425 - protein, 26 aa, Giardia lamblia
PCRLRCGHLVCRSCAVTYYVGRMGCL

SEQ ID NO: 3179426 - protein, 20 aa, Giardia lamblia
PCSTKPLPACFFHLLDPIQK

SEQ ID NO: 3179427 - protein, 17 aa, Giardia lamblia
PCYRCSREAIIDTEESI

SEQ ID NO: 3179428 - protein, 18 aa, Giardia lamblia
PDDLKIALHLARKRQSRE

SEQ ID NO: 3179429 - protein, 21 aa, Giardia lamblia
PDESRGVSILQSWQQKVDLAN

SEQ ID NO: 3179430 - protein, 18 aa, Giardia lamblia
PDFGRLGPEFDMTVLHSD

SEQ ID NO: 3179431 - protein, 19 aa, Giardia lamblia
PDFRPRPHLLLSPSNIIVG

SEQ ID NO: 3179432 - protein, 23 aa, Giardia lamblia
PDKEPDTCYSWWIGSPAYILLDY

SEQ ID NO: 3179433 - protein, 17 aa, Giardia lamblia
PDKLCTQLDILASLASS

SEQ ID NO: 3179434 - protein, 17 aa, Giardia lamblia
PDKLSQRLGHLFYLEPN

SEQ ID NO: 3179435 - protein, 20 aa, Giardia lamblia
PDKRFEWLCGHFKPKSEVST

SEQ ID NO: 3179436 - protein, 18 aa, Giardia lamblia
PDLARFALIAEFCGALTP

SEQ ID NO: 3179437 - protein, 17 aa, Giardia lamblia
PDLTAAMAMQPRSGDAP

SEQ ID NO: 3179438 - protein, 18 aa, Giardia lamblia
PDMRGFREMVQKNKDKLG

SEQ ID NO: 3179439 - protein, 24 aa, Giardia lamblia
PDRTRIPYKDCLKLLKAPDHLPIQ

SEQ ID NO: 3179440 - protein, 21 aa, Giardia lamblia
PDSCNLVLIKILFGSPEFTRF

SEQ ID NO: 3179441 - protein, 25 aa, Giardia lamblia
PDTMKFRIVREIIRMINPICDDSMI

SEQ ID NO: 3179442 - protein, 23 aa, Giardia lamblia
PDVARFSRRVLCMGVIPKKAIPN

SEQ ID NO: 3179443 - protein, 21 aa, Giardia lamblia
PDVRAGAAMGCFTIGICKDPD

SEQ ID NO: 3179444 - protein, 18 aa, Giardia lamblia
PEAKRSSSSFGFHSPTWG

SEQ ID NO: 3179445 - protein, 17 aa, Giardia lamblia
PEARPVIKSAYLSECEE

SEQ ID NO: 3179446 - protein, 19 aa, Giardia lamblia
PEASIALVTGCRFLAVRDG

SEQ ID NO: 3179447 - protein, 21 aa, Giardia lamblia
PECVCSTQLFKQLLIDLGSLG

SEQ ID NO: 3179448 - protein, 18 aa, Giardia lamblia
PECVKFLLKREGGKRRNN

SEQ ID NO: 3179449 - protein, 18 aa, Giardia lamblia
PEDPRLGSVLFEAASRGT

SEQ ID NO: 3179450 - protein, 26 aa, Giardia lamblia
PEDQIWDWFVQICMALKHVHDRKILH

SEQ ID NO: 3179451 - protein, 18 aa, Giardia lamblia
PEEHIWYIAAEVGSALKY

SEQ ID NO: 3179452 - protein, 18 aa, Giardia lamblia
PEELDELCTLAWTTHVEL

SEQ ID NO: 3179453 - protein, 23 aa, Giardia lamblia
PEELNWLLCQAFDNRAVGSTDMN

SEQ ID NO: 3179454 - protein, 22 aa, Giardia lamblia
PEGMPALSGRIMWSRILLNRVR

SEQ ID NO: 3179455 - protein, 17 aa, Giardia lamblia
PEHWAELQGFFSAAERV

SEQ ID NO: 3179456 - protein, 18 aa, Giardia lamblia
PELNDFLARCLDKDPDSR

SEQ ID NO: 3179457 - protein, 18 aa, Giardia lamblia
PEPYRPASCVPSGNGVLS

SEQ ID NO: 3179458 - protein, 17 aa, Giardia lamblia
PERGCFVSFKAKWVDSK

SEQ ID NO: 3179459 - protein, 19 aa, Giardia lamblia
PERLCLLSASVYRELEAYP

SEQ ID NO: 3179460 - protein, 23 aa, Giardia lamblia
PERVCELYVLFSLQNMKTNHALL

SEQ ID NO: 3179461 - protein, 24 aa, Giardia lamblia
PETSRLCKCADWERPVCKTCGKAH

SEQ ID NO: 3179462 - protein, 19 aa, Giardia lamblia
PEVLSHPWFRDGIGSTELV

SEQ ID NO: 3179463 - protein, 18 aa, Giardia lamblia
PEVLSVESVRHFSPPSTP

SEQ ID NO: 3179464 - protein, 22 aa, Giardia lamblia
PEVRKSLRTCVEFVVRLYSATK

SEQ ID NO: 3179465 - protein, 20 aa, Giardia lamblia
PFDRLRTAFVPGYKEELVQP

SEQ ID NO: 3179466 - protein, 19 aa, Giardia lamblia
PFGGLSCRLTMSYLNKLYN

SEQ ID NO: 3179467 - protein, 18 aa, Giardia lamblia
PFIFSHIMDVYKMRGEFS

SEQ ID NO: 3179468 - protein, 19 aa, Giardia lamblia
PFISYYIELGMDGRRLHIS

SEQ ID NO: 3179469 - protein, 17 aa, Giardia lamblia
PFLCSGCPLNSRRVCLI

SEQ ID NO: 3179470 - protein, 17 aa, Giardia lamblia
PFLGFALALSSGAVAFV

SEQ ID NO: 3179471 - protein, 23 aa, Giardia lamblia
PFLPLFSRWAKSLARGVDPFSVP

SEQ ID NO: 3179472 - protein, 19 aa, Giardia lamblia
PFNCPHGRPVLRFLDLAPR

SEQ ID NO: 3179473 - protein, 17 aa, Giardia lamblia
PFPIGKISCHFSLHTDG

SEQ ID NO: 3179474 - protein, 23 aa, Giardia lamblia
PFSDCMPCTSILELHGSKTGNCV

SEQ ID NO: 3179475 - protein, 17 aa, Giardia lamblia
PFSIPRFNFRCLSPAER

SEQ ID NO: 3179476 - protein, 20 aa, Giardia lamblia
PFSLSLCRVSDCGTPLCFGN

SEQ ID NO: 3179477 - protein, 19 aa, Giardia lamblia
PFVSDGFMFKEHVRRFNNM

SEQ ID NO: 3179478 - protein, 20 aa, Giardia lamblia
PGCYDFCTLIGFLDLNPQIM

SEQ ID NO: 3179479 - protein, 19 aa, Giardia lamblia
PGHCFRLYSPGLFQRMHDF

SEQ ID NO: 3179480 - protein, 20 aa, Giardia lamblia
PGISELIIWVCLALASRRTY

SEQ ID NO: 3179481 - protein, 19 aa, Giardia lamblia
PGISVVDPWGGAGHIIDSL

SEQ ID NO: 3179482 - protein, 22 aa, Giardia lamblia
PGIYCNRCNFQIAFQECKLSLS

SEQ ID NO: 3179483 - protein, 22 aa, Giardia lamblia
PGKIMLSMEFLESGSLSNLIDK

SEQ ID NO: 3179484 - protein, 18 aa, Giardia lamblia
PGLLRPGRFDKIIYIPLP

SEQ ID NO: 3179485 - protein, 17 aa, Giardia lamblia
PGPEFFEDLLIKYFAKN

SEQ ID NO: 3179486 - protein, 22 aa, Giardia lamblia
PGRKLLCMDLVFKNVVMDAVQE

SEQ ID NO: 3179487 - protein, 24 aa, Giardia lamblia
PGSLKANGLWSFGNEVCQWKADRK

SEQ ID NO: 3179488 - protein, 21 aa, Giardia lamblia
PGTFCLQCTPDLYVSITPVSF

SEQ ID NO: 3179489 - protein, 19 aa, Giardia lamblia
PGTMIPRPTQLLKNQINLL

SEQ ID NO: 3179490 - protein, 18 aa, Giardia lamblia
PGTPRWSLLQTDPEATKT

SEQ ID NO: 3179491 - protein, 27 aa, Giardia lamblia
PGVPVAIAIPCCHMIIDPKRSVKLASN

SEQ ID NO: 3179492 - protein, 17 aa, Giardia lamblia
PGYKLLSLILLKSQGKS

SEQ ID NO: 3179493 - protein, 17 aa, Giardia lamblia
PGYPMALFQPHFVQPLE

SEQ ID NO: 3179494 - protein, 17 aa, Giardia lamblia
PHCVNIIDRACNWACAL

SEQ ID NO: 3179495 - protein, 17 aa, Giardia lamblia
PHFAGWRPKSLRGPSTP

SEQ ID NO: 3179496 - protein, 20 aa, Giardia lamblia
PHGRPVLRFLDLAPRADSTD

SEQ ID NO: 3179497 - protein, 24 aa, Giardia lamblia
PHLLPYKLAFAGFLRRESRTNDTL

SEQ ID NO: 3179498 - protein, 17 aa, Giardia lamblia
PHLRKLRKKDLGLPNVA

SEQ ID NO: 3179499 - protein, 20 aa, Giardia lamblia
PHTNLLKTVRWFISVVERLL

SEQ ID NO: 3179500 - protein, 18 aa, Giardia lamblia
PIECVTVVDVLRRGGVSV

SEQ ID NO: 3179501 - protein, 18 aa, Giardia lamblia
PIFQVIRRGIRFSDLGQP

SEQ ID NO: 3179502 - protein, 25 aa, Giardia lamblia
PIKHPEVFKRLGIPMPKGVLLYGAP

SEQ ID NO: 3179503 - protein, 19 aa, Giardia lamblia
PILKRNWLDSSVFSVKTPY

SEQ ID NO: 3179504 - protein, 18 aa, Giardia lamblia
PIRFSSCVDATNQLWEMI

SEQ ID NO: 3179505 - protein, 24 aa, Giardia lamblia
PISLELLIPCFVRLLIAYKSHSLL

SEQ ID NO: 3179506 - protein, 24 aa, Giardia lamblia
PITCYPRQIAILILKNLELVRKVY

SEQ ID NO: 3179507 - protein, 17 aa, Giardia lamblia
PIVRRMEILVDRLCLIC

SEQ ID NO: 3179508 - protein, 18 aa, Giardia lamblia
PKEIKWLLKHVQKNMAQD

SEQ ID NO: 3179509 - protein, 18 aa, Giardia lamblia
PKIYPVWEHRAFVFHRLL

SEQ ID NO: 3179510 - protein, 17 aa, Giardia lamblia
PKKRPVSNFAKTVEKKA

SEQ ID NO: 3179511 - protein, 20 aa, Giardia lamblia
PKLRCYKLRSASAYVSRTEP

SEQ ID NO: 3179512 - protein, 17 aa, Giardia lamblia
PKLRLQHSIKRLIYHNK

SEQ ID NO: 3179513 - protein, 23 aa, Giardia lamblia
PKLSEWYSGPSFLDLLDELKVPK

SEQ ID NO: 3179514 - protein, 25 aa, Giardia lamblia
PKREALRVARKFLQEKALAKSMTDT

SEQ ID NO: 3179515 - protein, 19 aa, Giardia lamblia
PKSLMWRKILDVYILGCLK

SEQ ID NO: 3179516 - protein, 17 aa, Giardia lamblia
PKSSFGVRSQQRDTVPD

SEQ ID NO: 3179517 - protein, 19 aa, Giardia lamblia
PKSTLPIFLPFLDEAESSI

SEQ ID NO: 3179518 - protein, 20 aa, Giardia lamblia
PKSVGFCSCRIDPDFENFRN

SEQ ID NO: 3179519 - protein, 23 aa, Giardia lamblia
PKSYKARVAYPFSDKRIMRLGTI

SEQ ID NO: 3179520 - protein, 21 aa, Giardia lamblia
PKVPARWCSSSGFTFGSRHRQ

SEQ ID NO: 3179521 - protein, 23 aa, Giardia lamblia
PLEIYGLIGTEFGKLVLKRAPED

SEQ ID NO: 3179522 - protein, 21 aa, Giardia lamblia
PLEKGIYCLHGLTAYNLLIKE

SEQ ID NO: 3179523 - protein, 24 aa, Giardia lamblia
PLEKSIRFSTRIEVIEEGENGVIE

SEQ ID NO: 3179524 - protein, 18 aa, Giardia lamblia
PLESWADIFISGVDQYAP

SEQ ID NO: 3179525 - protein, 17 aa, Giardia lamblia
PLETIPIRTEIGVEDTL

SEQ ID NO: 3179526 - protein, 23 aa, Giardia lamblia
PLFQYYLEAVVSFSNILSSCLRS

SEQ ID NO: 3179527 - protein, 17 aa, Giardia lamblia
PLGEFAVSLGLLKLPNH

SEQ ID NO: 3179528 - protein, 21 aa, Giardia lamblia
PLGILACALFGYTYRDYGVKY

SEQ ID NO: 3179529 - protein, 18 aa, Giardia lamblia
PLHVCGAMSQGFIGYMMS

SEQ ID NO: 3179530 - protein, 19 aa, Giardia lamblia
PLIYLAARFAALFEVSKLY

SEQ ID NO: 3179531 - protein, 19 aa, Giardia lamblia
PLKELRSSAVLFDSKANTL

SEQ ID NO: 3179532 - protein, 21 aa, Giardia lamblia
PLKNLCRIFSWIFALDLPKTM

SEQ ID NO: 3179533 - protein, 20 aa, Giardia lamblia
PLLELITKWSRMIRQSRPAS

SEQ ID NO: 3179534 - protein, 17 aa, Giardia lamblia
PLLLPPLGLVDTHASPS

SEQ ID NO: 3179535 - protein, 18 aa, Giardia lamblia
PLLPFTIGLSYIFQDVYT

SEQ ID NO: 3179536 - protein, 23 aa, Giardia lamblia
PLQRVDGGFAFFAPGGVGPVPAE

SEQ ID NO: 3179537 - protein, 25 aa, Giardia lamblia
PLRHPELFKYLGVKPPRGILLTGPP

SEQ ID NO: 3179538 - protein, 17 aa, Giardia lamblia
PLSLSLFRLRSFVINFR

SEQ ID NO: 3179539 - protein, 19 aa, Giardia lamblia
PLVDFYNHFKVILANNTFL

SEQ ID NO: 3179540 - protein, 21 aa, Giardia lamblia
PLVDRLCLFMYGIARVLQIKM

SEQ ID NO: 3179541 - protein, 19 aa, Giardia lamblia
PLVRCGACREVYCNNFDHK

SEQ ID NO: 3179542 - protein, 17 aa, Giardia lamblia
PLYELSYEDQLWLENRC

SEQ ID NO: 3179543 - protein, 22 aa, Giardia lamblia
PLYKFPVLFLSTAVVMNIAKSA

SEQ ID NO: 3179544 - protein, 20 aa, Giardia lamblia
PLYRKNIRALYGIPANCFLF

SEQ ID NO: 3179545 - protein, 27 aa, Giardia lamblia
PMEVLRCIGNLLSICFPQVEASSTAFR

SEQ ID NO: 3179546 - protein, 23 aa, Giardia lamblia
PMFTFKIGQPFGDNALVMAKARI

SEQ ID NO: 3179547 - protein, 22 aa, Giardia lamblia
PMILEIIRLLVLYTPALLENSN

SEQ ID NO: 3179548 - protein, 23 aa, Giardia lamblia
PMTPRATVFLNIMAPDLTQSLHN

SEQ ID NO: 3179549 - protein, 19 aa, Giardia lamblia
PMYCFRLSDDSSRIFDLIE

SEQ ID NO: 3179550 - protein, 17 aa, Giardia lamblia
PNDFPSFSPQDMQKYKQ

SEQ ID NO: 3179551 - protein, 23 aa, Giardia lamblia
PNGIPLPCCPIISPRYFIYPISP

SEQ ID NO: 3179552 - protein, 19 aa, Giardia lamblia
PNLRVLKARNCLLTQIDDL

SEQ ID NO: 3179553 - protein, 17 aa, Giardia lamblia
PNNFFIIRGNHETTDLQ

SEQ ID NO: 3179554 - protein, 17 aa, Giardia lamblia
PNNLPGFTASAFYKESS

SEQ ID NO: 3179555 - protein, 24 aa, Giardia lamblia
PNRFEFTSLALLTLIRWLETDSLP

SEQ ID NO: 3179556 - protein, 18 aa, Giardia lamblia
PNRSGSVMKLDLTLPSIS

SEQ ID NO: 3179557 - protein, 18 aa, Giardia lamblia
PPCLPQWGTPFSIQQIPS

SEQ ID NO: 3179558 - protein, 22 aa, Giardia lamblia
PPDLFLRRICKGIIEGLVVLEA

SEQ ID NO: 3179559 - protein, 19 aa, Giardia lamblia
PPGVCQFCLEECGQQEDMA

SEQ ID NO: 3179560 - protein, 17 aa, Giardia lamblia
PPHGLGFGAGQRKVYGA

SEQ ID NO: 3179561 - protein, 18 aa, Giardia lamblia
PPHTVYVGTRWYRAVELF

SEQ ID NO: 3179562 - protein, 17 aa, Giardia lamblia
PPISCKFIESFMQGNHY

SEQ ID NO: 3179563 - protein, 17 aa, Giardia lamblia
PPLRDYRSSEEVIVTPH

SEQ ID NO: 3179564 - protein, 19 aa, Giardia lamblia
PPLRLFLQYIMHLHSTYKL

SEQ ID NO: 3179565 - protein, 22 aa, Giardia lamblia
PPPGQYRPAFGLATANQDTILR

SEQ ID NO: 3179566 - protein, 17 aa, Giardia lamblia
PPPIRELPDEVIVPPTV

SEQ ID NO: 3179567 - protein, 17 aa, Giardia lamblia
PPPRRKGALFTLTSVSA

SEQ ID NO: 3179568 - protein, 21 aa, Giardia lamblia
PPRIRKIFASKSCKASVRLGD

SEQ ID NO: 3179569 - protein, 22 aa, Giardia lamblia
PPSSDCPYLYCTTNYQLCNAIN

SEQ ID NO: 3179570 - protein, 23 aa, Giardia lamblia
PPTCVDCNTFLAGTLDQKSGSRG

SEQ ID NO: 3179571 - protein, 18 aa, Giardia lamblia
PPYKGSRGDFEWYSYAQV

SEQ ID NO: 3179572 - protein, 24 aa, Giardia lamblia
PPYSPELIGIWGLVFSPEDPNLVA

SEQ ID NO: 3179573 - protein, 17 aa, Giardia lamblia
PQAMCPMHVAGGRHADV

SEQ ID NO: 3179574 - protein, 18 aa, Giardia lamblia
PQCGELLISRMTGFDGKV

SEQ ID NO: 3179575 - protein, 27 aa, Giardia lamblia
PQFMRVCPILYWSYVDVWDFLKRFRIH

SEQ ID NO: 3179576 - protein, 23 aa, Giardia lamblia
PQGNYPAAMVFFKLVSSKPKITS

SEQ ID NO: 3179577 - protein, 27 aa, Giardia lamblia
PQHRLLYLAIRFRLELISTDDNYQSLF

SEQ ID NO: 3179578 - protein, 20 aa, Giardia lamblia
PQQRLRNIFITWKAHVSELN

SEQ ID NO: 3179579 - protein, 19 aa, Giardia lamblia
PQRRISLSQVDKVTALSVH

SEQ ID NO: 3179580 - protein, 24 aa, Giardia lamblia
PQSPYLCAIECERYCDILVERLHQ

SEQ ID NO: 3179581 - protein, 20 aa, Giardia lamblia
PRAGQMFKQFIAYIKTVQEE

SEQ ID NO: 3179582 - protein, 20 aa, Giardia lamblia
PREIPAWITRMSKWNKPAVT

SEQ ID NO: 3179583 - protein, 19 aa, Giardia lamblia
PRFDCFENVSFSWSLLSVP

SEQ ID NO: 3179584 - protein, 20 aa, Giardia lamblia
PRFSLVPSISNSVSRRESRQ

SEQ ID NO: 3179585 - protein, 19 aa, Giardia lamblia
PRFWFSRLLDIERICTKQS

SEQ ID NO: 3179586 - protein, 22 aa, Giardia lamblia
PRGEWRLVGFSCCLPGGINFEF

SEQ ID NO: 3179587 - protein, 18 aa, Giardia lamblia
PRGLPCYIPLPQNVADVK

SEQ ID NO: 3179588 - protein, 23 aa, Giardia lamblia
PRIDCPRSLDGISIRSSSVSRSY

SEQ ID NO: 3179589 - protein, 20 aa, Giardia lamblia
PRIRKVMRYDIAPSAKAGEL

SEQ ID NO: 3179590 - protein, 20 aa, Giardia lamblia
PRIVWDMVKCESMVRDNFIM

SEQ ID NO: 3179591 - protein, 18 aa, Giardia lamblia
PRKWKRITPDAAMLGKNY

SEQ ID NO: 3179592 - protein, 21 aa, Giardia lamblia
PRLTEKLVLCSYDLLHEVNAY

SEQ ID NO: 3179593 - protein, 21 aa, Giardia lamblia
PRMAGLQGRSGWTALMAAATS

SEQ ID NO: 3179594 - protein, 18 aa, Giardia lamblia
PRMLHCGALIRQSDEGYT

SEQ ID NO: 3179595 - protein, 24 aa, Giardia lamblia
PRNAWPQECLWMISTYNGLYIRAF

SEQ ID NO: 3179596 - protein, 20 aa, Giardia lamblia
PRNGIKFGCDYTVYRVPTPE

SEQ ID NO: 3179597 - protein, 20 aa, Giardia lamblia
PRPLPAPTLGDFVQEEPPPE

SEQ ID NO: 3179598 - protein, 19 aa, Giardia lamblia
PRPRLPLFEEHIKLYNTSR

SEQ ID NO: 3179599 - protein, 21 aa, Giardia lamblia
PRQIPFLALLIIRGQDFGQGL

SEQ ID NO: 3179600 - protein, 23 aa, Giardia lamblia
PRQYKLPDFYGAISPQSLFSSDG

SEQ ID NO: 3179601 - protein, 20 aa, Giardia lamblia
PRRLHDLRELVADLPTILAR

SEQ ID NO: 3179602 - protein, 17 aa, Giardia lamblia
PRTDYISSLAFSNSGDH

SEQ ID NO: 3179603 - protein, 19 aa, Giardia lamblia
PRTPSEWSLSFHVNLRREK

SEQ ID NO: 3179604 - protein, 20 aa, Giardia lamblia
PRVASHFVFRLKNFAFIYAM

SEQ ID NO: 3179605 - protein, 19 aa, Giardia lamblia
PRVPPNIGDALRFLQALSK

SEQ ID NO: 3179606 - protein, 18 aa, Giardia lamblia
PRYGCSMVPTADGIQIFG

SEQ ID NO: 3179607 - protein, 22 aa, Giardia lamblia
PRYLEVDGTSLFLCGKDGRRKQ

SEQ ID NO: 3179608 - protein, 20 aa, Giardia lamblia
PRYLMGVGFPLDLVVCTCLG

SEQ ID NO: 3179609 - protein, 17 aa, Giardia lamblia
PSADLWSTGIILYAMLC

SEQ ID NO: 3179610 - protein, 19 aa, Giardia lamblia
PSCPCARTKHAACLVRWNH

SEQ ID NO: 3179611 - protein, 26 aa, Giardia lamblia
PSDHKMLRWWSLREHPTINMWAAGHD

SEQ ID NO: 3179612 - protein, 17 aa, Giardia lamblia
PSGLPARIVREEPVEFV

SEQ ID NO: 3179613 - protein, 17 aa, Giardia lamblia
PSISGLMAKVGIGAKTQ

SEQ ID NO: 3179614 - protein, 17 aa, Giardia lamblia
PSIWYKLYESHQVGLHV

SEQ ID NO: 3179615 - protein, 17 aa, Giardia lamblia
PSKGFVFGAPVAPAQQP

SEQ ID NO: 3179616 - protein, 18 aa, Giardia lamblia
PSKIPRRYCHSACGYEGY

SEQ ID NO: 3179617 - protein, 17 aa, Giardia lamblia
PSKMKGGPVDRRSDKRH

SEQ ID NO: 3179618 - protein, 17 aa, Giardia lamblia
PSLRFCPNLVNLDLSRN

SEQ ID NO: 3179619 - protein, 18 aa, Giardia lamblia
PSLRSCFRDAGLLTSGTT

SEQ ID NO: 3179620 - protein, 19 aa, Giardia lamblia
PSMDYLRDHCEPLVYQALQ

SEQ ID NO: 3179621 - protein, 19 aa, Giardia lamblia
PSPRSFDCSMGIVLDDLVA

SEQ ID NO: 3179622 - protein, 20 aa, Giardia lamblia
PSPYDLYRICEMDLLNSASH

SEQ ID NO: 3179623 - protein, 19 aa, Giardia lamblia
PSPYFKPLVYTLAFFHATI

SEQ ID NO: 3179624 - protein, 22 aa, Giardia lamblia
PSRPLLCCSICDISVRYRKNKT

SEQ ID NO: 3179625 - protein, 21 aa, Giardia lamblia
PSSACGPWLCHVPAKIAMQSE

SEQ ID NO: 3179626 - protein, 17 aa, Giardia lamblia
PSSGYGMGQSGQLGHTV

SEQ ID NO: 3179627 - protein, 23 aa, Giardia lamblia
PSSVCLYDPLVLRNPHIVFPLRV

SEQ ID NO: 3179628 - protein, 23 aa, Giardia lamblia
PSTEIPDVLPFVIISIKIQQLRS

SEQ ID NO: 3179629 - protein, 20 aa, Giardia lamblia
PSTRSTGFWFGDRSETTRNM

SEQ ID NO: 3179630 - protein, 30 aa, Giardia lamblia
PSVIYGGACFTRFKSPVCFLTHSRSDKNGP

SEQ ID NO: 3179631 - protein, 21 aa, Giardia lamblia
PSVPYQWLMYWLPAAGSGQPV

SEQ ID NO: 3179632 - protein, 18 aa, Giardia lamblia
PSYKSTMSVKAFGDSKIG

SEQ ID NO: 3179633 - protein, 17 aa, Giardia lamblia
PTAAMLLEHPFIKGADL

SEQ ID NO: 3179634 - protein, 17 aa, Giardia lamblia
PTAVSWYPLGKSIIAVG

SEQ ID NO: 3179635 - protein, 19 aa, Giardia lamblia
PTDFCICKEGSIPTAVVGC

SEQ ID NO: 3179636 - protein, 22 aa, Giardia lamblia
PTDVTAAYGFKVFKQERGGDFL

SEQ ID NO: 3179637 - protein, 21 aa, Giardia lamblia
PTECQCRIALVSKLGVLGEHF

SEQ ID NO: 3179638 - protein, 17 aa, Giardia lamblia
PTIHYEPLLSLLSRATV

SEQ ID NO: 3179639 - protein, 27 aa, Giardia lamblia
PTILVCLAGCYRVDFVIFGKQRPTVQL

SEQ ID NO: 3179640 - protein, 17 aa, Giardia lamblia
PTLPRYVFRFTGNTEET

SEQ ID NO: 3179641 - protein, 17 aa, Giardia lamblia
PTLRRLRVKSKRTPMSR

SEQ ID NO: 3179642 - protein, 18 aa, Giardia lamblia
PTNMLLPIAQFVTLISFL

SEQ ID NO: 3179643 - protein, 18 aa, Giardia lamblia
PTPWKGVKVLTLIAKYGG

SEQ ID NO: 3179644 - protein, 23 aa, Giardia lamblia
PTRPKRCITAYFKRLYKSRHSGL

SEQ ID NO: 3179645 - protein, 23 aa, Giardia lamblia
PTSDIKPAGAFFINKKILGPIDS

SEQ ID NO: 3179646 - protein, 20 aa, Giardia lamblia
PTTARFALVKVDSRFKAANE

SEQ ID NO: 3179647 - protein, 19 aa, Giardia lamblia
PTTCHPTKFVARLTAHTWC

SEQ ID NO: 3179648 - protein, 17 aa, Giardia lamblia
PTVPKSFVHPGHGESTY

SEQ ID NO: 3179649 - protein, 24 aa, Giardia lamblia
PTVPLDPRFDGLRQRLAAMAGPNR

SEQ ID NO: 3179650 - protein, 23 aa, Giardia lamblia
PTVRCVLKAPGLYCTQVEDTTAA

SEQ ID NO: 3179651 - protein, 18 aa, Giardia lamblia
PVAELISGLSEVDMDASA

SEQ ID NO: 3179652 - protein, 20 aa, Giardia lamblia
PVASPLRMVLTQSISSPEDA

SEQ ID NO: 3179653 - protein, 21 aa, Giardia lamblia
PVCAMGRLFQCIVLKPFAIFG

SEQ ID NO: 3179654 - protein, 18 aa, Giardia lamblia
PVCPYFSFSRDHLCTNHN

SEQ ID NO: 3179655 - protein, 24 aa, Giardia lamblia
PVDVWCFGVTILYIMIGAARTEPL

SEQ ID NO: 3179656 - protein, 18 aa, Giardia lamblia
PVEIPLKPVAQWADLPTR

SEQ ID NO: 3179657 - protein, 21 aa, Giardia lamblia
PVGAVSWGGGPAFLAEAAPFH

SEQ ID NO: 3179658 - protein, 25 aa, Giardia lamblia
PVGPCLYCGSPIYGLPGRVSAATGD

SEQ ID NO: 3179659 - protein, 19 aa, Giardia lamblia
PVHCCFGALVAMNINVDET

SEQ ID NO: 3179660 - protein, 18 aa, Giardia lamblia
PVHFLWLDFDGNLISESR

SEQ ID NO: 3179661 - protein, 17 aa, Giardia lamblia
PVIKRWVNYYTSTKKNG

SEQ ID NO: 3179662 - protein, 20 aa, Giardia lamblia
PVLKNSWCLYSLFRSRSYNM

SEQ ID NO: 3179663 - protein, 18 aa, Giardia lamblia
PVPGKLHFTASVYDPLTD

SEQ ID NO: 3179664 - protein, 20 aa, Giardia lamblia
PVRMDPSLLPAISFDLDLPL

SEQ ID NO: 3179665 - protein, 17 aa, Giardia lamblia
PVSIPFPVINQVATIPR

SEQ ID NO: 3179666 - protein, 23 aa, Giardia lamblia
PVTRLAFLLVDFLADYSIFAEGQ

SEQ ID NO: 3179667 - protein, 17 aa, Giardia lamblia
PWTGLSFAVASGNAKCV

SEQ ID NO: 3179668 - protein, 17 aa, Giardia lamblia
PYCLSCMHVSGPMWLGD

SEQ ID NO: 3179669 - protein, 18 aa, Giardia lamblia
PYIRALRIMSHIVKNFDD

SEQ ID NO: 3179670 - protein, 20 aa, Giardia lamblia
PYLKICSSLPAFDLRSYPVE

SEQ ID NO: 3179671 - protein, 19 aa, Giardia lamblia
PYLSALYIHFKREVKHEPI

SEQ ID NO: 3179672 - protein, 24 aa, Giardia lamblia
PYPLRRFSLTYVQNRVVLIGGSQY

SEQ ID NO: 3179673 - protein, 18 aa, Giardia lamblia
PYRLRIVYRTLPNSTEGA

SEQ ID NO: 3179674 - protein, 20 aa, Giardia lamblia
PYRMYWDLKFHHMTTAFVRR

SEQ ID NO: 3179675 - protein, 17 aa, Giardia lamblia
PYVKAMRIMSRVVSRFD

SEQ ID NO: 3179676 - protein, 23 aa, Giardia lamblia
PYYFSCPPFPYSAGSLHSQPPVH

SEQ ID NO: 3179677 - protein, 17 aa, Giardia lamblia
PYYGLPQPDFESFNHSI

SEQ ID NO: 3179678 - protein, 23 aa, Giardia lamblia
QAAFWKRCLQTGLVAGNGSFVCG

SEQ ID NO: 3179679 - protein, 17 aa, Giardia lamblia
QADCLLVASVLDLICGV

SEQ ID NO: 3179680 - protein, 20 aa, Giardia lamblia
QADKCAGCDCSLATTSQEEQ

SEQ ID NO: 3179681 - protein, 20 aa, Giardia lamblia
QADTLWKQHFEKVEEDMRTL

SEQ ID NO: 3179682 - protein, 23 aa, Giardia lamblia
QAEEIQRLLSLNIREYIPTETFN

SEQ ID NO: 3179683 - protein, 19 aa, Giardia lamblia
QAGIPCFYGLLTSLPLFIK

SEQ ID NO: 3179684 - protein, 19 aa, Giardia lamblia
QALCALCEYAAVAPNLEEK

SEQ ID NO: 3179685 - protein, 21 aa, Giardia lamblia
QALEHFSRALAMDLISTSPEL

SEQ ID NO: 3179686 - protein, 19 aa, Giardia lamblia
QALEWKQRVSAFDAESVLR

SEQ ID NO: 3179687 - protein, 24 aa, Giardia lamblia
QAYYKRLTLLLSYRHQYDEAMLNR

SEQ ID NO: 3179688 - protein, 18 aa, Giardia lamblia
QCHFCYSCNCRFLYVLDF

SEQ ID NO: 3179689 - protein, 17 aa, Giardia lamblia
QCVASLRGRCPYCQRAV

SEQ ID NO: 3179690 - protein, 19 aa, Giardia lamblia
QDAEGWSAMMMAVLDNQAE

SEQ ID NO: 3179691 - protein, 21 aa, Giardia lamblia
QDCRGRTALMYAVQQDNPKMV

SEQ ID NO: 3179692 - protein, 23 aa, Giardia lamblia
QDGFFPLHRLMRIAPKTLDAQLF

SEQ ID NO: 3179693 - protein, 26 aa, Giardia lamblia
QDGYELLEGIPLKGLVPLSQERYLKA

SEQ ID NO: 3179694 - protein, 17 aa, Giardia lamblia
QDMNGRTALMYAAAASR

SEQ ID NO: 3179695 - protein, 23 aa, Giardia lamblia
QDSRGRTALMYAAYAGNLRVVEL

SEQ ID NO: 3179696 - protein, 20 aa, Giardia lamblia
QEERSVCYLATFCYGGILNI

SEQ ID NO: 3179697 - protein, 20 aa, Giardia lamblia
QEFQCLRAAAYVAHALSTVG

SEQ ID NO: 3179698 - protein, 19 aa, Giardia lamblia
QELCCIYCIVSGSHPPGPD

SEQ ID NO: 3179699 - protein, 17 aa, Giardia lamblia
QELMVATQLIFRRYPER

SEQ ID NO: 3179700 - protein, 18 aa, Giardia lamblia
QEYKTVIDLLSTLQGKSL

SEQ ID NO: 3179701 - protein, 24 aa, Giardia lamblia
QFASPCIRSSICMRLFDSSLIKLA

SEQ ID NO: 3179702 - protein, 22 aa, Giardia lamblia
QFCRCLAIFCNLTFKYDSEANI

SEQ ID NO: 3179703 - protein, 20 aa, Giardia lamblia
QFDLCIRWLYAILDHIRAEP

SEQ ID NO: 3179704 - protein, 17 aa, Giardia lamblia
QFIEMMGCFNLFDIGPH

SEQ ID NO: 3179705 - protein, 22 aa, Giardia lamblia
QFLRLEFNISLLPSSLYMTSPS

SEQ ID NO: 3179706 - protein, 23 aa, Giardia lamblia
QFTDLRLGYSITRLQTDKLRSSF

SEQ ID NO: 3179707 - protein, 23 aa, Giardia lamblia
QGHLECVKLLIASERKYKNNLNY

SEQ ID NO: 3179708 - protein, 22 aa, Giardia lamblia
QGHSSIFLPSWINLANSTAAMA

SEQ ID NO: 3179709 - protein, 19 aa, Giardia lamblia
QGLDEAFSWLLSELLIDSG

SEQ ID NO: 3179710 - protein, 21 aa, Giardia lamblia
QGLLWRILKHLTFASNKNDTE

SEQ ID NO: 3179711 - protein, 20 aa, Giardia lamblia
QGRKEIVAFLAPRMAGLQGR

SEQ ID NO: 3179712 - protein, 17 aa, Giardia lamblia
QGSKAFTAQKCVEKSSF

SEQ ID NO: 3179713 - protein, 20 aa, Giardia lamblia
QGSLAWKGLLVYGSPGSGKT

SEQ ID NO: 3179714 - protein, 19 aa, Giardia lamblia
QHARLPPRVKSLEREKPSS

SEQ ID NO: 3179715 - protein, 17 aa, Giardia lamblia
QHIELHATSPLRKTTSN

SEQ ID NO: 3179716 - protein, 17 aa, Giardia lamblia
QHPCNHALISFGYIISM

SEQ ID NO: 3179717 - protein, 24 aa, Giardia lamblia
QHVRCLSELLLPCTSCDLLWPVTF

SEQ ID NO: 3179718 - protein, 27 aa, Giardia lamblia
QIDFSVTILTRFDLVFMLKDKQSPERD

SEQ ID NO: 3179719 - protein, 25 aa, Giardia lamblia
QIHVLKLRLLRTIYLLDGGPKRERR

SEQ ID NO: 3179720 - protein, 19 aa, Giardia lamblia
QILTCRICAAEAEQQILKA

SEQ ID NO: 3179721 - protein, 25 aa, Giardia lamblia
QISWFNCLIDYGFPCVVRGYSQTKI

SEQ ID NO: 3179722 - protein, 24 aa, Giardia lamblia
QIVSLRAAIAGLRLERASFPLNRI

SEQ ID NO: 3179723 - protein, 18 aa, Giardia lamblia
QIYKTLLLIEHLLINASP

SEQ ID NO: 3179724 - protein, 17 aa, Giardia lamblia
QKFCKWLNSHTEGAGKL

SEQ ID NO: 3179725 - protein, 23 aa, Giardia lamblia
QKISFAGSFMAMFGDKSKADTRP

SEQ ID NO: 3179726 - protein, 20 aa, Giardia lamblia
QKKVRIGGLYKPDFAPGSGM

SEQ ID NO: 3179727 - protein, 21 aa, Giardia lamblia
QKLILCFPTLPILRIHPTCKK

SEQ ID NO: 3179728 - protein, 22 aa, Giardia lamblia
QKPPSGACTFAFTPDLSRVFCG

SEQ ID NO: 3179729 - protein, 18 aa, Giardia lamblia
QKQVHLFQSMKLFFQNKP

SEQ ID NO: 3179730 - protein, 21 aa, Giardia lamblia
QKRIAEFAVYFSTYFYSMMSY

SEQ ID NO: 3179731 - protein, 23 aa, Giardia lamblia
QKRIIELLSEFLLKASVEACQQI

SEQ ID NO: 3179732 - protein, 18 aa, Giardia lamblia
QKVAFSIEMVDIISNIQG

SEQ ID NO: 3179733 - protein, 17 aa, Giardia lamblia
QKYAAIVQYVLRNHPQL

SEQ ID NO: 3179734 - protein, 17 aa, Giardia lamblia
QKYWRRALAKSKVNAMK

SEQ ID NO: 3179735 - protein, 18 aa, Giardia lamblia
QLCADVCWVTDRSFSVLG

SEQ ID NO: 3179736 - protein, 23 aa, Giardia lamblia
QLDCVKALIPHCLAIKRNDGFTS

SEQ ID NO: 3179737 - protein, 23 aa, Giardia lamblia
QLDRARIAILLAKVIPDQTTPDG

SEQ ID NO: 3179738 - protein, 17 aa, Giardia lamblia
QLECMYYSYPFMKDVPH

SEQ ID NO: 3179739 - protein, 17 aa, Giardia lamblia
QLFKLTVDKHGRPRRLT

SEQ ID NO: 3179740 - protein, 23 aa, Giardia lamblia
QLKEGAESLAWLKAATARYIEAV

SEQ ID NO: 3179741 - protein, 20 aa, Giardia lamblia
QLLQHFGIVVNRLVDLSDLL

SEQ ID NO: 3179742 - protein, 22 aa, Giardia lamblia
QLPPELCGPSFVAFHKQLLLSE

SEQ ID NO: 3179743 - protein, 19 aa, Giardia lamblia
QLSELRSSMNLSQAIVSSH

SEQ ID NO: 3179744 - protein, 24 aa, Giardia lamblia
QLSGDEWLRFCDHWFCDGHRIFLY

SEQ ID NO: 3179745 - protein, 24 aa, Giardia lamblia
QLTLSILPVWSYRDLLFKLSHSGS

SEQ ID NO: 3179746 - protein, 19 aa, Giardia lamblia
QLTRAVLRLGWKFPTTVQE

SEQ ID NO: 3179747 - protein, 18 aa, Giardia lamblia
QLVKRIQCCIQEKEVELL

SEQ ID NO: 3179748 - protein, 23 aa, Giardia lamblia
QLYNDAMCLARIDLLQKEGDDNL

SEQ ID NO: 3179749 - protein, 26 aa, Giardia lamblia
QMNASLLKRFVCLRDQFNSVVPLLQL

SEQ ID NO: 3179750 - protein, 24 aa, Giardia lamblia
QMSLLRWNPLYGYESCQLQHDPDC

SEQ ID NO: 3179751 - protein, 23 aa, Giardia lamblia
QNFMFYKGRLRLIDFGISKAMQQ

SEQ ID NO: 3179752 - protein, 24 aa, Giardia lamblia
QNNLRELFTLLGLIHPAVFCDYDR

SEQ ID NO: 3179753 - protein, 18 aa, Giardia lamblia
QPASIRLSGMRGQPQMHS

SEQ ID NO: 3179754 - protein, 22 aa, Giardia lamblia
QPNLKFPGLNSFVGQSKIIDPC

SEQ ID NO: 3179755 - protein, 20 aa, Giardia lamblia
QPVLLKLRWFQDHLRKDLDR

SEQ ID NO: 3179756 - protein, 24 aa, Giardia lamblia
QPYDRKFCAPYSFAEPDKRLYALS

SEQ ID NO: 3179757 - protein, 17 aa, Giardia lamblia
QQEEMLARITVLEQRFD

SEQ ID NO: 3179758 - protein, 25 aa, Giardia lamblia
QQKVCPRLTWLLPFVPYAHILFLLD

SEQ ID NO: 3179759 - protein, 17 aa, Giardia lamblia
QQLEKRSGGSIVNAFQY

SEQ ID NO: 3179760 - protein, 18 aa, Giardia lamblia
QQLPLVFHAGLLAFVRKY

SEQ ID NO: 3179761 - protein, 22 aa, Giardia lamblia
QQYMKFCLAKSISLTKLKTGES

SEQ ID NO: 3179762 - protein, 17 aa, Giardia lamblia
QRANLSWESSLRTLQTT

SEQ ID NO: 3179763 - protein, 17 aa, Giardia lamblia
QRCLELHGPSLLSELVR

SEQ ID NO: 3179764 - protein, 20 aa, Giardia lamblia
QREAELRILLPYELTILDKQ

SEQ ID NO: 3179765 - protein, 21 aa, Giardia lamblia
QRFPSYLVWDCFKQKACKDIA

SEQ ID NO: 3179766 - protein, 17 aa, Giardia lamblia
QRKKWLVTRKIPERINF

SEQ ID NO: 3179767 - protein, 19 aa, Giardia lamblia
QRLRGSVVLGSYFETDQTR

SEQ ID NO: 3179768 - protein, 20 aa, Giardia lamblia
QRLYSSICDLVIKTLIACEP

SEQ ID NO: 3179769 - protein, 23 aa, Giardia lamblia
QRNPEVFYGFWGYCFNSYRDTTP

SEQ ID NO: 3179770 - protein, 20 aa, Giardia lamblia
QRRPLCFGEDNLGKASVVSG

SEQ ID NO: 3179771 - protein, 25 aa, Giardia lamblia
QRSYQWLHMCWGCRPVLHPGNIDSM

SEQ ID NO: 3179772 - protein, 21 aa, Giardia lamblia
QRVVCRFMLDHGFSVGMGDMV

SEQ ID NO: 3179773 - protein, 23 aa, Giardia lamblia
QRWPARMIAVVGCKSYIAILTLK

SEQ ID NO: 3179774 - protein, 22 aa, Giardia lamblia
QRYRDLCSWVFVASVELSLMVI

SEQ ID NO: 3179775 - protein, 19 aa, Giardia lamblia
QRYYLGIGLMDDFPETNQE

SEQ ID NO: 3179776 - protein, 19 aa, Giardia lamblia
QSPRFVLEYVKAHPQNPSN

SEQ ID NO: 3179777 - protein, 24 aa, Giardia lamblia
QSSRAHCIYTIYLKQRSRVDETAP

SEQ ID NO: 3179778 - protein, 17 aa, Giardia lamblia
QSSSVSFGADFKSTGTG

SEQ ID NO: 3179779 - protein, 17 aa, Giardia lamblia
QSSWRLVVPMPKILEFS

SEQ ID NO: 3179780 - protein, 22 aa, Giardia lamblia
QSVEYRFAVSIVDNASLSINIA

SEQ ID NO: 3179781 - protein, 17 aa, Giardia lamblia
QTLRSCDVIREIKQQMT

SEQ ID NO: 3179782 - protein, 17 aa, Giardia lamblia
QTQTILGMDDMEELMAL

SEQ ID NO: 3179783 - protein, 18 aa, Giardia lamblia
QTVFAVKFTEAWMCKNFQ

SEQ ID NO: 3179784 - protein, 18 aa, Giardia lamblia
QVEPFPHLARMPTASLSL

SEQ ID NO: 3179785 - protein, 17 aa, Giardia lamblia
QVGLKLIATQVLQKGSC

SEQ ID NO: 3179786 - protein, 18 aa, Giardia lamblia
QVLFKFFAFYSAFDFTNN

SEQ ID NO: 3179787 - protein, 24 aa, Giardia lamblia
QVSFKSWFNFCIFSPSSQPISEQL

SEQ ID NO: 3179788 - protein, 18 aa, Giardia lamblia
QVVIEWLLSYGRYEVLSD

SEQ ID NO: 3179789 - protein, 17 aa, Giardia lamblia
QVVRFLLSCEGRMQTRF

SEQ ID NO: 3179790 - protein, 19 aa, Giardia lamblia
QWPFNVHAFIPLKLLPGFD

SEQ ID NO: 3179791 - protein, 18 aa, Giardia lamblia
QYCSACFITLTSGMYKKK

SEQ ID NO: 3179792 - protein, 23 aa, Giardia lamblia
QYDLTAPEPLVWADETVIVTFCD

SEQ ID NO: 3179793 - protein, 24 aa, Giardia lamblia
QYLADVCEWQFRKGLVSTLADKTC

SEQ ID NO: 3179794 - protein, 19 aa, Giardia lamblia
QYLHSWCQKGYLGIVHRDI

SEQ ID NO: 3179795 - protein, 22 aa, Giardia lamblia
QYPLRPTWRLYNWSSMSSVTFH

SEQ ID NO: 3179796 - protein, 22 aa, Giardia lamblia
QYSLDLCKNCRCIIESKYMASH

SEQ ID NO: 3179797 - protein, 18 aa, Giardia lamblia
RAAGLERFTRLLIADTTV

SEQ ID NO: 3179798 - protein, 18 aa, Giardia lamblia
RAARPGMISLDMSTQNSH

SEQ ID NO: 3179799 - protein, 17 aa, Giardia lamblia
RACAQCDPVSFSAVHNL

SEQ ID NO: 3179800 - protein, 18 aa, Giardia lamblia
RACQICGCYARPAPWNSL

SEQ ID NO: 3179801 - protein, 25 aa, Giardia lamblia
RADRCINFVAGMCVGASMVFGAQFL

SEQ ID NO: 3179802 - protein, 24 aa, Giardia lamblia
RAEELRTDLIINMQNELILRQRHR

SEQ ID NO: 3179803 - protein, 17 aa, Giardia lamblia
RAGQRLRQTPAVFTTNR

SEQ ID NO: 3179804 - protein, 18 aa, Giardia lamblia
RAGTQFLFRKIYSAKPIY

SEQ ID NO: 3179805 - protein, 17 aa, Giardia lamblia
RAIRFSKRLGFELDKKM

SEQ ID NO: 3179806 - protein, 22 aa, Giardia lamblia
RAKCTPIGWIPYYEDLKSLFRS

SEQ ID NO: 3179807 - protein, 19 aa, Giardia lamblia
RAKIGFTPLMHAITTGNPD

SEQ ID NO: 3179808 - protein, 27 aa, Giardia lamblia
RAKSAWRFVKFRVCVKYGYIKKLVPQF

SEQ ID NO: 3179809 - protein, 19 aa, Giardia lamblia
RALASWLVSMYISSGQAEH

SEQ ID NO: 3179810 - protein, 19 aa, Giardia lamblia
RALLEFDRPDLSAIPGTPI

SEQ ID NO: 3179811 - protein, 18 aa, Giardia lamblia
RANSFALKYAGTVLEVLG

SEQ ID NO: 3179812 - protein, 19 aa, Giardia lamblia
RAPVSLALLAYVGGVHANY

SEQ ID NO: 3179813 - protein, 19 aa, Giardia lamblia
RARAPSCIFIDEIDAIMSA

SEQ ID NO: 3179814 - protein, 20 aa, Giardia lamblia
RARCLGHPDVLLSCYICKEH

SEQ ID NO: 3179815 - protein, 19 aa, Giardia lamblia
RASEAIVRMNMVAEEDKQE

SEQ ID NO: 3179816 - protein, 20 aa, Giardia lamblia
RASLRLYDWIVTKELLGQKK

SEQ ID NO: 3179817 - protein, 18 aa, Giardia lamblia
RASTCTRLRAKQHERQSE

SEQ ID NO: 3179818 - protein, 17 aa, Giardia lamblia
RATKWYSYHAALATDLL

SEQ ID NO: 3179819 - protein, 25 aa, Giardia lamblia
RATYQCARYLLALYVAYGSAVLEAG

SEQ ID NO: 3179820 - protein, 30 aa, Giardia lamblia
RAYAERLAWFLLLRTRFIGLLSARDQYVRR

SEQ ID NO: 3179821 - protein, 21 aa, Giardia lamblia
RAYDYYKGCCHQTVGQGPFTR

SEQ ID NO: 3179822 - protein, 17 aa, Giardia lamblia
RCFNWKTGRLVRSYEGH

SEQ ID NO: 3179823 - protein, 20 aa, Giardia lamblia
RCLFHPILLGKKVPIVLDDV

SEQ ID NO: 3179824 - protein, 21 aa, Giardia lamblia
RCLGLRLAYIFSELATNNYRI

SEQ ID NO: 3179825 - protein, 21 aa, Giardia lamblia
RCNCGRTALMYATKNAQLAAA

SEQ ID NO: 3179826 - protein, 20 aa, Giardia lamblia
RCQLEPLFYCHAADADARKR

SEQ ID NO: 3179827 - protein, 20 aa, Giardia lamblia
RCSNCTHVILPPSDPVPGII

SEQ ID NO: 3179828 - protein, 17 aa, Giardia lamblia
RCSVLAAANPVYGFFDP

SEQ ID NO: 3179829 - protein, 18 aa, Giardia lamblia
RCSYPQSIAISLGQVYKI

SEQ ID NO: 3179830 - protein, 21 aa, Giardia lamblia
RCTPLMLSFCFIIRNAVRRAK

SEQ ID NO: 3179831 - protein, 23 aa, Giardia lamblia
RCVLRATLFGNWALCNLRMKDYA

SEQ ID NO: 3179832 - protein, 22 aa, Giardia lamblia
RCWDFYFKAGIVHDAKCIESFA

SEQ ID NO: 3179833 - protein, 17 aa, Giardia lamblia
RDACPRCAAPLKALPPS

SEQ ID NO: 3179834 - protein, 21 aa, Giardia lamblia
RDAFNRSALDYAIQSGHSAIV

SEQ ID NO: 3179835 - protein, 25 aa, Giardia lamblia
RDALMLHRLLLRWKRNARLEASHNH

SEQ ID NO: 3179836 - protein, 17 aa, Giardia lamblia
RDDLGFTGLMYAAWTND

SEQ ID NO: 3179837 - protein, 18 aa, Giardia lamblia
RDECCDMVVNFLRDHMSE

SEQ ID NO: 3179838 - protein, 24 aa, Giardia lamblia
RDFCCSGCRGLLRFPVRTLCGHYY

SEQ ID NO: 3179839 - protein, 23 aa, Giardia lamblia
RDFYEVCAILGPYEADVRTADGR

SEQ ID NO: 3179840 - protein, 18 aa, Giardia lamblia
RDGVPAGATIYIYALDDN

SEQ ID NO: 3179841 - protein, 18 aa, Giardia lamblia
RDIVFKRTLNFGNFVLLS

SEQ ID NO: 3179842 - protein, 17 aa, Giardia lamblia
RDLPCYISPSSGIVPAG

SEQ ID NO: 3179843 - protein, 19 aa, Giardia lamblia
RDLYRLYADFVVKNPFFVP

SEQ ID NO: 3179844 - protein, 18 aa, Giardia lamblia
RDPAEVFVDGWRPDLSGI

SEQ ID NO: 3179845 - protein, 22 aa, Giardia lamblia
RDPRGRTALMLAVEHGNRDAVE

SEQ ID NO: 3179846 - protein, 23 aa, Giardia lamblia
RDRAGRMAFNFAKTEEVRNIISD

SEQ ID NO: 3179847 - protein, 17 aa, Giardia lamblia
RDRLRSVKKTELIKQIE

SEQ ID NO: 3179848 - protein, 23 aa, Giardia lamblia
RDSCGRTALYRAIELGYLGLVQV

SEQ ID NO: 3179849 - protein, 23 aa, Giardia lamblia
RDSLRLVLDVARLHQHPTLIQAI

SEQ ID NO: 3179850 - protein, 22 aa, Giardia lamblia
RDTRFCYCAVLSLTILLKRVPS

SEQ ID NO: 3179851 - protein, 21 aa, Giardia lamblia
RDVAIAWEFNLWKSAETARFE

SEQ ID NO: 3179852 - protein, 21 aa, Giardia lamblia
RDVNGRTALMWAAMNGHKEVV

SEQ ID NO: 3179853 - protein, 21 aa, Giardia lamblia
RDWAIPRLLIFHEFQDHLVLS

SEQ ID NO: 3179854 - protein, 17 aa, Giardia lamblia
REAEIQRYIGFLRHVEV

SEQ ID NO: 3179855 - protein, 18 aa, Giardia lamblia
REALARKRMRAYSRLKQL

SEQ ID NO: 3179856 - protein, 21 aa, Giardia lamblia
REDFLNWCKWSIAKVSRNSYT

SEQ ID NO: 3179857 - protein, 21 aa, Giardia lamblia
REEDLRLAAMLRQKEIEERKK

SEQ ID NO: 3179858 - protein, 17 aa, Giardia lamblia
REFLRKRLAGHRIHLEI

SEQ ID NO: 3179859 - protein, 19 aa, Giardia lamblia
REGCKDCPLLPVGASNVPG

SEQ ID NO: 3179860 - protein, 17 aa, Giardia lamblia
REHPELKAITTWFISEV

SEQ ID NO: 3179861 - protein, 25 aa, Giardia lamblia
REIRIRPGSAIPFVIKYKFPDERAS

SEQ ID NO: 3179862 - protein, 19 aa, Giardia lamblia
REKFIYRLEVSLMTTEDKL

SEQ ID NO: 3179863 - protein, 17 aa, Giardia lamblia
REKHGLLGWSGVDQTVS

SEQ ID NO: 3179864 - protein, 24 aa, Giardia lamblia
RELFFFKRFLLPLLSYKYHCQLIE

SEQ ID NO: 3179865 - protein, 19 aa, Giardia lamblia
RELGFKWRIGGLNASKYYD

SEQ ID NO: 3179866 - protein, 17 aa, Giardia lamblia
RELLRYKPFLDLDENSI

SEQ ID NO: 3179867 - protein, 20 aa, Giardia lamblia
RELSAKMLLFKEIEKKHTVL

SEQ ID NO: 3179868 - protein, 19 aa, Giardia lamblia
RELSIRFTMRTAFRAMQKQ

SEQ ID NO: 3179869 - protein, 17 aa, Giardia lamblia
REMLYLLTMSGRMYIPF

SEQ ID NO: 3179870 - protein, 20 aa, Giardia lamblia
RENMLLWILEYCSRHSKLET

SEQ ID NO: 3179871 - protein, 20 aa, Giardia lamblia
REPFELIPRLFPLASAIYLR

SEQ ID NO: 3179872 - protein, 19 aa, Giardia lamblia
REPLELVLLSGGADVFTYS

SEQ ID NO: 3179873 - protein, 24 aa, Giardia lamblia
REPTLLCLRDLWRFLTLHDYDQKL

SEQ ID NO: 3179874 - protein, 19 aa, Giardia lamblia
REPVDIWSLGCVIVNMCTR

SEQ ID NO: 3179875 - protein, 22 aa, Giardia lamblia
REQRRRLECLIAKRRDPILEQL

SEQ ID NO: 3179876 - protein, 23 aa, Giardia lamblia
RERGFCMACPTLIINSSGNLQPY

SEQ ID NO: 3179877 - protein, 21 aa, Giardia lamblia
RERRLLKVLPTVYYRITGQQN

SEQ ID NO: 3179878 - protein, 17 aa, Giardia lamblia
RETLPLYAEKMIGFTGA

SEQ ID NO: 3179879 - protein, 25 aa, Giardia lamblia
REVDGRLSAPLQMPLSFLFETDSLA

SEQ ID NO: 3179880 - protein, 19 aa, Giardia lamblia
REVLAFICSPNIPKTDDMY

SEQ ID NO: 3179881 - protein, 17 aa, Giardia lamblia
REVLFCRTIGLAVRGLV

SEQ ID NO: 3179882 - protein, 17 aa, Giardia lamblia
REVPAVERFHFPKNQIV

SEQ ID NO: 3179883 - protein, 21 aa, Giardia lamblia
REVQRLKLLLLDRDSQIQRVR

SEQ ID NO: 3179884 - protein, 24 aa, Giardia lamblia
REYCPNCGPGIRIARHADRCHCGR

SEQ ID NO: 3179885 - protein, 24 aa, Giardia lamblia
REYKLALFGVCHFRGNVVASQGTL

SEQ ID NO: 3179886 - protein, 17 aa, Giardia lamblia
RFACLSLLKKHYKENPV

SEQ ID NO: 3179887 - protein, 25 aa, Giardia lamblia
RFAKVAARFLMNYGFTIGIDDVMPS

SEQ ID NO: 3179888 - protein, 23 aa, Giardia lamblia
RFESCVLCVVVLNVDMCQKELGH

SEQ ID NO: 3179889 - protein, 22 aa, Giardia lamblia
RFGRKGLSVSLLIAENQKCMDD

SEQ ID NO: 3179890 - protein, 18 aa, Giardia lamblia
RFLCFSTSHALLILEQES

SEQ ID NO: 3179891 - protein, 22 aa, Giardia lamblia
RFLLEYSNPILLSIMAPFIEFR

SEQ ID NO: 3179892 - protein, 18 aa, Giardia lamblia
RFLLLRQRCLELHGPSLL

SEQ ID NO: 3179893 - protein, 21 aa, Giardia lamblia
RFLYLPDFCHVCCRDKSSFGR

SEQ ID NO: 3179894 - protein, 18 aa, Giardia lamblia
RFMRSIRVPFIAKKSMPL

SEQ ID NO: 3179895 - protein, 20 aa, Giardia lamblia
RFNFLPPYLFVVINRFLWEE

SEQ ID NO: 3179896 - protein, 18 aa, Giardia lamblia
RFQFCLKDKVSVREISPA

SEQ ID NO: 3179897 - protein, 18 aa, Giardia lamblia
RFRKAKCPVVERLTNSLM

SEQ ID NO: 3179898 - protein, 17 aa, Giardia lamblia
RFSEIFHRITGGKARLT

SEQ ID NO: 3179899 - protein, 18 aa, Giardia lamblia
RFTVKECLDHSWLNPSKY

SEQ ID NO: 3179900 - protein, 21 aa, Giardia lamblia
RFVPMPLKFIEKAIGQHEVSL

SEQ ID NO: 3179901 - protein, 21 aa, Giardia lamblia
RGAGCSFGLIPVLKFLHDNQL

SEQ ID NO: 3179902 - protein, 18 aa, Giardia lamblia
RGDLARFIRHNRETPIPE

SEQ ID NO: 3179903 - protein, 18 aa, Giardia lamblia
RGDYEWYSYLDVLRMSSE

SEQ ID NO: 3179904 - protein, 19 aa, Giardia lamblia
RGHAGCVSLLYPMEQSTSG

SEQ ID NO: 3179905 - protein, 24 aa, Giardia lamblia
RGKALKALVDWKGFPASDPRSEEN

SEQ ID NO: 3179906 - protein, 17 aa, Giardia lamblia
RGLAGWRTPFGPFGVSH

SEQ ID NO: 3179907 - protein, 24 aa, Giardia lamblia
RGLDFPSVCLIINYDIPRCAEYYV

SEQ ID NO: 3179908 - protein, 18 aa, Giardia lamblia
RGLFPLCLIGSLEITNRL

SEQ ID NO: 3179909 - protein, 17 aa, Giardia lamblia
RGLFRYGALPAREIVPI

SEQ ID NO: 3179910 - protein, 22 aa, Giardia lamblia
RGPSKKKTVCFNMDVDTASNAQ

SEQ ID NO: 3179911 - protein, 21 aa, Giardia lamblia
RGVMTAARCLLQFYREQAPDK

SEQ ID NO: 3179912 - protein, 17 aa, Giardia lamblia
RGVSFLRLSPMEDFSQS

SEQ ID NO: 3179913 - protein, 23 aa, Giardia lamblia
RHDLGRCIKLLIRTQEGAQDAYG

SEQ ID NO: 3179914 - protein, 24 aa, Giardia lamblia
RHDREVLRFYAIWDNRHLVYGELR

SEQ ID NO: 3179915 - protein, 27 aa, Giardia lamblia
RHHCRRCGRIFCNACCIKPIDILSDTG

SEQ ID NO: 3179916 - protein, 20 aa, Giardia lamblia
RHILHAYVLFLERLAASGCV

SEQ ID NO: 3179917 - protein, 19 aa, Giardia lamblia
RHKDDWCSFILFDSRFAEH

SEQ ID NO: 3179918 - protein, 24 aa, Giardia lamblia
RHMVYKKLKLVGAVNKVFRNTAFI

SEQ ID NO: 3179919 - protein, 20 aa, Giardia lamblia
RHNCSICIGLLFFNTYVHVL

SEQ ID NO: 3179920 - protein, 18 aa, Giardia lamblia
RHNYCFCLCLIGRCHLAQ

SEQ ID NO: 3179921 - protein, 19 aa, Giardia lamblia
RHTEVFRVGKWINYVAPEV

SEQ ID NO: 3179922 - protein, 19 aa, Giardia lamblia
RHTWSMTKIDGAWYHTDVI

SEQ ID NO: 3179923 - protein, 21 aa, Giardia lamblia
RIDFYRMWASLFVQPESDLGT

SEQ ID NO: 3179924 - protein, 20 aa, Giardia lamblia
RIEDGFLCCTSCAQSETGKW

SEQ ID NO: 3179925 - protein, 19 aa, Giardia lamblia
RIEDIFKRRLQSVIVESKL

SEQ ID NO: 3179926 - protein, 20 aa, Giardia lamblia
RIGTEYNHFLLLYRIAFAVQ

SEQ ID NO: 3179927 - protein, 21 aa, Giardia lamblia
RIHRAPSFPGLQPHYYPDPAH

SEQ ID NO: 3179928 - protein, 19 aa, Giardia lamblia
RIKKFVHNFAYRTRMRNEA

SEQ ID NO: 3179929 - protein, 19 aa, Giardia lamblia
RILECLSIVAGTLPQLFAP

SEQ ID NO: 3179930 - protein, 19 aa, Giardia lamblia
RILRETNMRYGLGNMEPNN

SEQ ID NO: 3179931 - protein, 25 aa, Giardia lamblia
RIPFFLPAIRVFKGHIADVISCSWS

SEQ ID NO: 3179932 - protein, 18 aa, Giardia lamblia
RISCFGTGFSCHSPLGYL

SEQ ID NO: 3179933 - protein, 19 aa, Giardia lamblia
RISKSVIFLSSFADHFCMT

SEQ ID NO: 3179934 - protein, 22 aa, Giardia lamblia
RITEAFAGLVLDIQVEFPDSVV

SEQ ID NO: 3179935 - protein, 20 aa, Giardia lamblia
RITLPDAIHVCFDISKDKQS

SEQ ID NO: 3179936 - protein, 20 aa, Giardia lamblia
RIVQQDVFFSAMSSFGGILS

SEQ ID NO: 3179937 - protein, 17 aa, Giardia lamblia
RKAFNMLAFKRVGKLKV

SEQ ID NO: 3179938 - protein, 19 aa, Giardia lamblia
RKAHLVFKAARLWPNSRQI

SEQ ID NO: 3179939 - protein, 17 aa, Giardia lamblia
RKAMSADSLALVQDYLD

SEQ ID NO: 3179940 - protein, 20 aa, Giardia lamblia
RKDIEIARLNERVELLLNTS

SEQ ID NO: 3179941 - protein, 21 aa, Giardia lamblia
RKDWRLPGGGVRTGEIDPNAL

SEQ ID NO: 3179942 - protein, 19 aa, Giardia lamblia
RKFFTSLCVNVFAKLNVVE

SEQ ID NO: 3179943 - protein, 20 aa, Giardia lamblia
RKFQCCYCGDALTGEDRVAG

SEQ ID NO: 3179944 - protein, 18 aa, Giardia lamblia
RKIHEILCISTCPVCGHV

SEQ ID NO: 3179945 - protein, 21 aa, Giardia lamblia
RKKKCPRVVLSVVFGSSQNQW

SEQ ID NO: 3179946 - protein, 17 aa, Giardia lamblia
RKLTLSDDAIWGIIAQV

SEQ ID NO: 3179947 - protein, 17 aa, Giardia lamblia
RKMSAEFDFNYSFLHQT

SEQ ID NO: 3179948 - protein, 20 aa, Giardia lamblia
RKNAELVFLVRYMDLLVQAY

SEQ ID NO: 3179949 - protein, 23 aa, Giardia lamblia
RKNIYKRRFLKIVSTLRSARDSL

SEQ ID NO: 3179950 - protein, 23 aa, Giardia lamblia
RKNIYSNRCGFFGGINCIILVAN

SEQ ID NO: 3179951 - protein, 22 aa, Giardia lamblia
RKPPVICIGDLYFSRYNPLFHH

SEQ ID NO: 3179952 - protein, 24 aa, Giardia lamblia
RKQDGRTALKFALERGHTECVDLL

SEQ ID NO: 3179953 - protein, 19 aa, Giardia lamblia
RKQLKELLVNSAYSTTSAS

SEQ ID NO: 3179954 - protein, 21 aa, Giardia lamblia
RKRLATTLPLIFRQTSLANLL

SEQ ID NO: 3179955 - protein, 17 aa, Giardia lamblia
RKSSGWRDGPLAKALFS

SEQ ID NO: 3179956 - protein, 20 aa, Giardia lamblia
RKTKNCWLNLNVDLYAKICP

SEQ ID NO: 3179957 - protein, 23 aa, Giardia lamblia
RKTMKICRIRAFYMLKVKFTQNT

SEQ ID NO: 3179958 - protein, 19 aa, Giardia lamblia
RKVDIWCCGLILYELLTAK

SEQ ID NO: 3179959 - protein, 19 aa, Giardia lamblia
RLAAREGYRQIASWLDNWL

SEQ ID NO: 3179960 - protein, 17 aa, Giardia lamblia
RLACPRLSRTLLPEDVQ

SEQ ID NO: 3179961 - protein, 19 aa, Giardia lamblia
RLAEVLACILIKGSKEEYV

SEQ ID NO: 3179962 - protein, 19 aa, Giardia lamblia
RLAFNCLRIVLEIITNQAE

SEQ ID NO: 3179963 - protein, 24 aa, Giardia lamblia
RLANRLKPYILRRLKSDVERSLPP

SEQ ID NO: 3179964 - protein, 19 aa, Giardia lamblia
RLASLCLEQAIILTSDTDI

SEQ ID NO: 3179965 - protein, 18 aa, Giardia lamblia
RLASLWVMRELIQSRPTI

SEQ ID NO: 3179966 - protein, 18 aa, Giardia lamblia
RLATYTPLMRAIMKGKAS

SEQ ID NO: 3179967 - protein, 18 aa, Giardia lamblia
RLECSFIPDVPAPLEQVE

SEQ ID NO: 3179968 - protein, 26 aa, Giardia lamblia
RLEHFAALFTRIMKRAALDTFVQNCR

SEQ ID NO: 3179969 - protein, 24 aa, Giardia lamblia
RLFPETCLHWWSFMLTRTLGNTFS

SEQ ID NO: 3179970 - protein, 17 aa, Giardia lamblia
RLIEIIARLTLELAGAR

SEQ ID NO: 3179971 - protein, 20 aa, Giardia lamblia
RLIPGASMGLSFGISFGSST

SEQ ID NO: 3179972 - protein, 19 aa, Giardia lamblia
RLIRVTAFCYDRVKDIGEH

SEQ ID NO: 3179973 - protein, 18 aa, Giardia lamblia
RLLACADSKLVRDEAIAS

SEQ ID NO: 3179974 - protein, 27 aa, Giardia lamblia
RLLDLRRCPSCGGKVKSIEFINELTSI

SEQ ID NO: 3179975 - protein, 17 aa, Giardia lamblia
RLLGKVCTIRIGAKTEL

SEQ ID NO: 3179976 - protein, 22 aa, Giardia lamblia
RLLHWIEMVYPLLMLDGRALLS

SEQ ID NO: 3179977 - protein, 19 aa, Giardia lamblia
RLLIKEDWSYFVIDVDKNT

SEQ ID NO: 3179978 - protein, 19 aa, Giardia lamblia
RLLMSISFFSWRKVHGYNT

SEQ ID NO: 3179979 - protein, 20 aa, Giardia lamblia
RLLPSRALKCYLMQKSDRLM

SEQ ID NO: 3179980 - protein, 20 aa, Giardia lamblia
RLLRCYGCRVNPRRDTVTLF

SEQ ID NO: 3179981 - protein, 20 aa, Giardia lamblia
RLLTRRYGVELAWTPMHSTN

SEQ ID NO: 3179982 - protein, 17 aa, Giardia lamblia
RLMSAYYRVIRKKIEDS

SEQ ID NO: 3179983 - protein, 20 aa, Giardia lamblia
RLMTLWFRYGSYDEVETEII

SEQ ID NO: 3179984 - protein, 18 aa, Giardia lamblia
RLNERVELLLNTSPEAGD

SEQ ID NO: 3179985 - protein, 17 aa, Giardia lamblia
RLNFALLTFQTLPSLLI

SEQ ID NO: 3179986 - protein, 19 aa, Giardia lamblia
RLQGMKSRISSLCEGLGEI

SEQ ID NO: 3179987 - protein, 24 aa, Giardia lamblia
RLQKIIFFPPFRVCVDQRHLGNVS

SEQ ID NO: 3179988 - protein, 22 aa, Giardia lamblia
RLQRLAPMLLERGILTADQLPP

SEQ ID NO: 3179989 - protein, 20 aa, Giardia lamblia
RLRARISRRCKVATSQAEVL

SEQ ID NO: 3179990 - protein, 23 aa, Giardia lamblia
RLRARRILCQMVMLSLPSDDTKA

SEQ ID NO: 3179991 - protein, 17 aa, Giardia lamblia
RLRCLFIGNNLIASFGE

SEQ ID NO: 3179992 - protein, 18 aa, Giardia lamblia
RLRDECRVHFGLPERSVV

SEQ ID NO: 3179993 - protein, 19 aa, Giardia lamblia
RLRRRSRPYPAGRRGHIMV

SEQ ID NO: 3179994 - protein, 19 aa, Giardia lamblia
RLRTLGVMYTINFINPTER

SEQ ID NO: 3179995 - protein, 28 aa, Giardia lamblia
RLSCALRECQPCTRPLLLETQVNAIWNF

SEQ ID NO: 3179996 - protein, 24 aa, Giardia lamblia
RLSLSCTAAFRWNRAIHGESMDFL

SEQ ID NO: 3179997 - protein, 19 aa, Giardia lamblia
RLSRDGIHPVAFSYEIQIS

SEQ ID NO: 3179998 - protein, 22 aa, Giardia lamblia
RLSRPDGWFALMFATQKGSIES

SEQ ID NO: 3179999 - protein, 19 aa, Giardia lamblia
RLVKMTKILSIFKRKIISL

SEQ ID NO: 3180000 - protein, 19 aa, Giardia lamblia
RLVPDFSRIITLFSYLLRY

SEQ ID NO: 3180001 - protein, 24 aa, Giardia lamblia
RLVSCYNCALDAYLVEYKKLMDTM

SEQ ID NO: 3180002 - protein, 19 aa, Giardia lamblia
RLYGSILIVCEVLLYPVPI

SEQ ID NO: 3180003 - protein, 19 aa, Giardia lamblia
RLYGYRLLYTVSRIFTKKM

SEQ ID NO: 3180004 - protein, 18 aa, Giardia lamblia
RLYYAYLNMMQWSPPLID

SEQ ID NO: 3180005 - protein, 18 aa, Giardia lamblia
RMAFWEIGESFVTTPGVM

SEQ ID NO: 3180006 - protein, 17 aa, Giardia lamblia
RMLYPFPEISLKYSNEL

SEQ ID NO: 3180007 - protein, 26 aa, Giardia lamblia
RMRSDIWFNIGICFLHLSDMGAAKNC

SEQ ID NO: 3180008 - protein, 17 aa, Giardia lamblia
RMVGTFMAPVVMRHQDK

SEQ ID NO: 3180009 - protein, 23 aa, Giardia lamblia
RNAFSRRRVNVLFSEVVPIHAVT

SEQ ID NO: 3180010 - protein, 18 aa, Giardia lamblia
RNALSYSVEDECMGYLRN

SEQ ID NO: 3180011 - protein, 18 aa, Giardia lamblia
RNAMTLLSLCERYNSKAE

SEQ ID NO: 3180012 - protein, 23 aa, Giardia lamblia
RNCVFTMQVVRRFNTGIIQGYCD

SEQ ID NO: 3180013 - protein, 23 aa, Giardia lamblia
RNDKLRASIGFKIYATDLETAIP

SEQ ID NO: 3180014 - protein, 19 aa, Giardia lamblia
RNEANIAYKARVDAEERLR

SEQ ID NO: 3180015 - protein, 17 aa, Giardia lamblia
RNEFGDTISTCWQPSLK

SEQ ID NO: 3180016 - protein, 21 aa, Giardia lamblia
RNFPLRMGYRFRENEYSRLLH

SEQ ID NO: 3180017 - protein, 24 aa, Giardia lamblia
RNGWYKRIYLFAGEVACRDVNGDD

SEQ ID NO: 3180018 - protein, 21 aa, Giardia lamblia
RNKRLPTALIHDVKQETVRIQ

SEQ ID NO: 3180019 - protein, 26 aa, Giardia lamblia
RNRDIEMVRLLGCFEHSLVNNDGYTA

SEQ ID NO: 3180020 - protein, 25 aa, Giardia lamblia
RNRVLCGRKACLLCSDVIKNAIIYK

SEQ ID NO: 3180021 - protein, 18 aa, Giardia lamblia
RNTPNWAVKLCQVQQYFA

SEQ ID NO: 3180022 - protein, 18 aa, Giardia lamblia
RNTSWPRWTNIFFSATKA

SEQ ID NO: 3180023 - protein, 18 aa, Giardia lamblia
RPAIKRGKEMSADDVKDA

SEQ ID NO: 3180024 - protein, 19 aa, Giardia lamblia
RPAIPVPIVKTFARHLLVA

SEQ ID NO: 3180025 - protein, 25 aa, Giardia lamblia
RPERKLRLLIIYAQFLHALCGPRGT

SEQ ID NO: 3180026 - protein, 18 aa, Giardia lamblia
RPGMKRSSSCILFGGVHR

SEQ ID NO: 3180027 - protein, 20 aa, Giardia lamblia
RPHIKMNFCKPYMYDKIANF

SEQ ID NO: 3180028 - protein, 22 aa, Giardia lamblia
RPIKCALCGKVEYSVSSDVDEA

SEQ ID NO: 3180029 - protein, 18 aa, Giardia lamblia
RPLALAIFLKCYDMVRFF

SEQ ID NO: 3180030 - protein, 19 aa, Giardia lamblia
RPLCIGGFRGSSCQCKIAK

SEQ ID NO: 3180031 - protein, 19 aa, Giardia lamblia
RPLCPCYFCNMVAMDETDL

SEQ ID NO: 3180032 - protein, 22 aa, Giardia lamblia
RPLEVFPCSVINRFGYTDGFKW

SEQ ID NO: 3180033 - protein, 18 aa, Giardia lamblia
RPLFDREAGIVFDEQTNE

SEQ ID NO: 3180034 - protein, 17 aa, Giardia lamblia
RPLLGARLLMRPQLFRP

SEQ ID NO: 3180035 - protein, 17 aa, Giardia lamblia
RPLWTYVRMLDRMRSKT

SEQ ID NO: 3180036 - protein, 25 aa, Giardia lamblia
RPMGMPRPAGAIPMPANPMQRMQQP

SEQ ID NO: 3180037 - protein, 20 aa, Giardia lamblia
RPQLPMNLSISVKDMAVGAS

SEQ ID NO: 3180038 - protein, 17 aa, Giardia lamblia
RPSSSPCCGYVTVNGID

SEQ ID NO: 3180039 - protein, 20 aa, Giardia lamblia
RPSYWQGEFNCMPSRARYVP

SEQ ID NO: 3180040 - protein, 17 aa, Giardia lamblia
RPYERFYTERKCEQCVI

SEQ ID NO: 3180041 - protein, 20 aa, Giardia lamblia
RPYMRIGIGEVIGRAMLTID

SEQ ID NO: 3180042 - protein, 23 aa, Giardia lamblia
RQAFPTLVSLRFDAGDMLLFEPV

SEQ ID NO: 3180043 - protein, 18 aa, Giardia lamblia
RQDGKGYTALMWAAVAGD

SEQ ID NO: 3180044 - protein, 22 aa, Giardia lamblia
RQFSCKKFPLAKLTSHQIELIR

SEQ ID NO: 3180045 - protein, 18 aa, Giardia lamblia
RQGPRPGSGVTRNRFSHG

SEQ ID NO: 3180046 - protein, 23 aa, Giardia lamblia
RQLGAPCNRCLCVSGNATWARDQ

SEQ ID NO: 3180047 - protein, 23 aa, Giardia lamblia
RQLRMGFLPEINYVWTAIDNELI

SEQ ID NO: 3180048 - protein, 23 aa, Giardia lamblia
RQNDVVALWSFLPVQSGLQDAQG

SEQ ID NO: 3180049 - protein, 17 aa, Giardia lamblia
RQRASFYWRLLGVDPTL

SEQ ID NO: 3180050 - protein, 19 aa, Giardia lamblia
RQWFDWFVRLVFKLVSDHS

SEQ ID NO: 3180051 - protein, 19 aa, Giardia lamblia
RQWLHICGPIDALWIESMN

SEQ ID NO: 3180052 - protein, 18 aa, Giardia lamblia
RQWQWKKYIQMIGLMIFD

SEQ ID NO: 3180053 - protein, 20 aa, Giardia lamblia
RRAESLILYNFFVMPYILPD

SEQ ID NO: 3180054 - protein, 21 aa, Giardia lamblia
RRCIETFGRIAVKLCLFAERI

SEQ ID NO: 3180055 - protein, 26 aa, Giardia lamblia
RRDAEICAQLSMLVPLDRSDMIYAPT

SEQ ID NO: 3180056 - protein, 24 aa, Giardia lamblia
RRDARGRTALMYAAEAGHLVIAEA

SEQ ID NO: 3180057 - protein, 17 aa, Giardia lamblia
RRDCADLLLSSKKERMI

SEQ ID NO: 3180058 - protein, 20 aa, Giardia lamblia
RRDRLCLVRSRLCNYLNLYP

SEQ ID NO: 3180059 - protein, 25 aa, Giardia lamblia
RRDRMLKRRTEIMIDRDMKQNVLLR

SEQ ID NO: 3180060 - protein, 20 aa, Giardia lamblia
RRELQGFARMAGIRANSRND

SEQ ID NO: 3180061 - protein, 19 aa, Giardia lamblia
RREQVLALIFWKRLGARVV

SEQ ID NO: 3180062 - protein, 20 aa, Giardia lamblia
RRFFVVPAFEIYGGVAGLYD

SEQ ID NO: 3180063 - protein, 17 aa, Giardia lamblia
RRFGDGILYSDGRYEYY

SEQ ID NO: 3180064 - protein, 17 aa, Giardia lamblia
RRFLFFLVFSTRRKAMR

SEQ ID NO: 3180065 - protein, 17 aa, Giardia lamblia
RRFTFPFAVDLYRYCSA

SEQ ID NO: 3180066 - protein, 20 aa, Giardia lamblia
RRGYCALNYCIENYKVTFYP

SEQ ID NO: 3180067 - protein, 24 aa, Giardia lamblia
RRIARFKYNLIRRIVENWSSVTSF

SEQ ID NO: 3180068 - protein, 19 aa, Giardia lamblia
RRICPRTSEDFQLLYDEVA

SEQ ID NO: 3180069 - protein, 17 aa, Giardia lamblia
RRIDMLPAILTEDICSL

SEQ ID NO: 3180070 - protein, 17 aa, Giardia lamblia
RRKLFHVMFDLRRLAHA

SEQ ID NO: 3180071 - protein, 18 aa, Giardia lamblia
RRLPRVHKASNFSFSQVV

SEQ ID NO: 3180072 - protein, 18 aa, Giardia lamblia
RRLSMGIPYEKVLSDNQI

SEQ ID NO: 3180073 - protein, 21 aa, Giardia lamblia
RRLVTEIKRSEVASAVSAQAS

SEQ ID NO: 3180074 - protein, 24 aa, Giardia lamblia
RRMRKERSVCLGISPQSLFSLMET

SEQ ID NO: 3180075 - protein, 25 aa, Giardia lamblia
RRNCSVGKCLGCKAVLTRAGPDVPC

SEQ ID NO: 3180076 - protein, 23 aa, Giardia lamblia
RRNFKLAKYIIDWLRDRRKDSKK

SEQ ID NO: 3180077 - protein, 18 aa, Giardia lamblia
RRNWRVIEQCLKAVTVPI

SEQ ID NO: 3180078 - protein, 17 aa, Giardia lamblia
RRPKRLTISSVIRKNTP

SEQ ID NO: 3180079 - protein, 17 aa, Giardia lamblia
RRPKWFVAINEKAQRVL

SEQ ID NO: 3180080 - protein, 18 aa, Giardia lamblia
RRPLPKCYSEKLTSVIDL

SEQ ID NO: 3180081 - protein, 21 aa, Giardia lamblia
RRPLRVAPLYVIKNIVTEIIS

SEQ ID NO: 3180082 - protein, 18 aa, Giardia lamblia
RRPPCANFAVQVRPRSDF

SEQ ID NO: 3180083 - protein, 20 aa, Giardia lamblia
RRQLTRRLGFLFGLNDTIPS

SEQ ID NO: 3180084 - protein, 20 aa, Giardia lamblia
RRRGRASGRVMLAEDVLALE

SEQ ID NO: 3180085 - protein, 18 aa, Giardia lamblia
RRRIAISSTANFLAQTVL

SEQ ID NO: 3180086 - protein, 17 aa, Giardia lamblia
RRSFGLRRGLLLDGQVR

SEQ ID NO: 3180087 - protein, 19 aa, Giardia lamblia
RRSIGCFRLLLEAEAGMQG

SEQ ID NO: 3180088 - protein, 17 aa, Giardia lamblia
RRVLDHFYTLSTAEYSA

SEQ ID NO: 3180089 - protein, 20 aa, Giardia lamblia
RRVLGCLIGTCSEGTVRVTT

SEQ ID NO: 3180090 - protein, 19 aa, Giardia lamblia
RRVSCHICISYWRQHFIEA

SEQ ID NO: 3180091 - protein, 20 aa, Giardia lamblia
RRWRLVEASRGFKLEATMSL

SEQ ID NO: 3180092 - protein, 19 aa, Giardia lamblia
RSAALLAWKSIKETNAGKE

SEQ ID NO: 3180093 - protein, 17 aa, Giardia lamblia
RSAEKFYNLGIKRELQD

SEQ ID NO: 3180094 - protein, 17 aa, Giardia lamblia
RSAESGSAFAIHAIHEM

SEQ ID NO: 3180095 - protein, 17 aa, Giardia lamblia
RSCRRFLTASAILDDKI

SEQ ID NO: 3180096 - protein, 20 aa, Giardia lamblia
RSCTALRLIVQDVHYEDNAI

SEQ ID NO: 3180097 - protein, 17 aa, Giardia lamblia
RSDLMALKLELEAERDS

SEQ ID NO: 3180098 - protein, 18 aa, Giardia lamblia
RSDSIYCPLCESTISTTK

SEQ ID NO: 3180099 - protein, 17 aa, Giardia lamblia
RSEAAITMWEPMNNTVQ

SEQ ID NO: 3180100 - protein, 25 aa, Giardia lamblia
RSFFSEMKICLAAGLPGELNELTLG

SEQ ID NO: 3180101 - protein, 17 aa, Giardia lamblia
RSFQEFVDYLSVNGLYP

SEQ ID NO: 3180102 - protein, 19 aa, Giardia lamblia
RSGIIPLLIKEEAKLCDSY

SEQ ID NO: 3180103 - protein, 19 aa, Giardia lamblia
RSKSEYKYLYASIKEMEAR

SEQ ID NO: 3180104 - protein, 22 aa, Giardia lamblia
RSLPRLRVFFAKRFSIRIRNGV

SEQ ID NO: 3180105 - protein, 17 aa, Giardia lamblia
RSLRLLLFHALSYLPYA

SEQ ID NO: 3180106 - protein, 27 aa, Giardia lamblia
RSLSDRRRPICTWDELMSVSDGTAQRR

SEQ ID NO: 3180107 - protein, 26 aa, Giardia lamblia
RSLSVHLYRRCKIYRRAACEKNQQGA

SEQ ID NO: 3180108 - protein, 18 aa, Giardia lamblia
RSMTHLFGITASRRNTLQ

SEQ ID NO: 3180109 - protein, 18 aa, Giardia lamblia
RSNFHVCLCLSPIGESLR

SEQ ID NO: 3180110 - protein, 20 aa, Giardia lamblia
RSNPGYVYCYWDHCSPRLRR

SEQ ID NO: 3180111 - protein, 19 aa, Giardia lamblia
RSPISFRFRYGHKDLQVIL

SEQ ID NO: 3180112 - protein, 17 aa, Giardia lamblia
RSQVYRIIRLKGIKPNN

SEQ ID NO: 3180113 - protein, 23 aa, Giardia lamblia
RSRMWKRMHEWRIFEDRLMVSSW

SEQ ID NO: 3180114 - protein, 19 aa, Giardia lamblia
RSRVRRIAIGSGHTIEEVL

SEQ ID NO: 3180115 - protein, 19 aa, Giardia lamblia
RSSIHGFGLFLAEPAQRKE

SEQ ID NO: 3180116 - protein, 18 aa, Giardia lamblia
RSSLRSCLFISRGGLLQW

SEQ ID NO: 3180117 - protein, 27 aa, Giardia lamblia
RSVKWACFNHGTFVCIKCSGIHRSLGR

SEQ ID NO: 3180118 - protein, 17 aa, Giardia lamblia
RSVVLLAGYLVHRFHWP

SEQ ID NO: 3180119 - protein, 18 aa, Giardia lamblia
RSWFKQPLLIISSSTTFE

SEQ ID NO: 3180120 - protein, 18 aa, Giardia lamblia
RSYFPRRIHHYRIGRVPL

SEQ ID NO: 3180121 - protein, 24 aa, Giardia lamblia
RSYRCPEVILGLPYDGRADVWSLG

SEQ ID NO: 3180122 - protein, 24 aa, Giardia lamblia
RSYSPEFRKIFSLFVSPGIYIQEN

SEQ ID NO: 3180123 - protein, 19 aa, Giardia lamblia
RSYYRGSCCALLVYDITRR

SEQ ID NO: 3180124 - protein, 17 aa, Giardia lamblia
RTALMRAARAGFADIVW

SEQ ID NO: 3180125 - protein, 17 aa, Giardia lamblia
RTDIPRRVVGPFYPPDN

SEQ ID NO: 3180126 - protein, 17 aa, Giardia lamblia
RTGFRPCSLTDRLKLPI

SEQ ID NO: 3180127 - protein, 18 aa, Giardia lamblia
RTGLPLSTYFTAGKVLWL

SEQ ID NO: 3180128 - protein, 17 aa, Giardia lamblia
RTICYKMLISINYHKMA

SEQ ID NO: 3180129 - protein, 22 aa, Giardia lamblia
RTKDGRGAWDFATTKAARDALK

SEQ ID NO: 3180130 - protein, 19 aa, Giardia lamblia
RTKECSLDAAKDCINSPLY

SEQ ID NO: 3180131 - protein, 19 aa, Giardia lamblia
RTLLLPNLYTEDWTLGLSK

SEQ ID NO: 3180132 - protein, 21 aa, Giardia lamblia
RTLVPLDIWKCQAIFQEETTK

SEQ ID NO: 3180133 - protein, 19 aa, Giardia lamblia
RTMYAISLYRRGCAYSPDG

SEQ ID NO: 3180134 - protein, 17 aa, Giardia lamblia
RTSKGWTALMLAAKSGA

SEQ ID NO: 3180135 - protein, 17 aa, Giardia lamblia
RTVLYIPSFEDLDPVEG

SEQ ID NO: 3180136 - protein, 17 aa, Giardia lamblia
RTYIPRPFVPFVNPKNL

SEQ ID NO: 3180137 - protein, 19 aa, Giardia lamblia
RVACDRSKYAIRFPLPPLI

SEQ ID NO: 3180138 - protein, 29 aa, Giardia lamblia
RVAKSLLQWRFLRPRSRLMSGSFIGGPSI

SEQ ID NO: 3180139 - protein, 22 aa, Giardia lamblia
RVGFLNCIKYICGLAYTSVTKI

SEQ ID NO: 3180140 - protein, 25 aa, Giardia lamblia
RVGNEILVEMLLEFCEDTETQGTLS

SEQ ID NO: 3180141 - protein, 19 aa, Giardia lamblia
RVGNSWSYHYCRRQWNLDY

SEQ ID NO: 3180142 - protein, 17 aa, Giardia lamblia
RVIDLLIDYECGMQTPE

SEQ ID NO: 3180143 - protein, 17 aa, Giardia lamblia
RVIKHLFRSAGLNVDNP

SEQ ID NO: 3180144 - protein, 19 aa, Giardia lamblia
RVIPLKLLVQVGRELEIEL

SEQ ID NO: 3180145 - protein, 23 aa, Giardia lamblia
RVLTLYNLRCCYWESASGEVGIH

SEQ ID NO: 3180146 - protein, 18 aa, Giardia lamblia
RVLVSFETLPLCWCVIHG

SEQ ID NO: 3180147 - protein, 19 aa, Giardia lamblia
RVNECTIEFEVDGPYSCMV

SEQ ID NO: 3180148 - protein, 20 aa, Giardia lamblia
RVPFHICRAFSKLIRSLCAQ

SEQ ID NO: 3180149 - protein, 26 aa, Giardia lamblia
RVPVKRGKQFICLLKMHHRLIELKVR

SEQ ID NO: 3180150 - protein, 17 aa, Giardia lamblia
RVRCLSEQLALLKGQES

SEQ ID NO: 3180151 - protein, 18 aa, Giardia lamblia
RVRMNAINEWERSENFKI

SEQ ID NO: 3180152 - protein, 20 aa, Giardia lamblia
RVRSLITMEVCKQKLLITPQ

SEQ ID NO: 3180153 - protein, 19 aa, Giardia lamblia
RVSPGTGFHRFAYTASGDA

SEQ ID NO: 3180154 - protein, 23 aa, Giardia lamblia
RVSRAAAPLAKWIQANIKYAEVC

SEQ ID NO: 3180155 - protein, 19 aa, Giardia lamblia
RVVCPSAMAYLCLRPERRR

SEQ ID NO: 3180156 - protein, 25 aa, Giardia lamblia
RVVGHPGILCWLQFHMNLRSEFTMD

SEQ ID NO: 3180157 - protein, 19 aa, Giardia lamblia
RVVGVLADFKSRRHPDLSR

SEQ ID NO: 3180158 - protein, 18 aa, Giardia lamblia
RVVNPRTGIDMGNGAVNR

SEQ ID NO: 3180159 - protein, 17 aa, Giardia lamblia
RVYGGAGAWIFMTGEVT

SEQ ID NO: 3180160 - protein, 18 aa, Giardia lamblia
RWDCESWEALLRVRRLII

SEQ ID NO: 3180161 - protein, 23 aa, Giardia lamblia
RWYRAPEIILGWPQYGKPVDIFS

SEQ ID NO: 3180162 - protein, 25 aa, Giardia lamblia
RYCLEVLSLPVLNWIHGFEILDEPP

SEQ ID NO: 3180163 - protein, 23 aa, Giardia lamblia
RYDGLRTAPLFLFLNVVAAGFWM

SEQ ID NO: 3180164 - protein, 19 aa, Giardia lamblia
RYDLTLLFSISFHSVPVPH

SEQ ID NO: 3180165 - protein, 18 aa, Giardia lamblia
RYEGIIGILCETIVTLDD

SEQ ID NO: 3180166 - protein, 17 aa, Giardia lamblia
RYEGISCVMQEMSGLTD

SEQ ID NO: 3180167 - protein, 25 aa, Giardia lamblia
RYELDRMRYAFAIAKFNSIQTASNI

SEQ ID NO: 3180168 - protein, 18 aa, Giardia lamblia
RYFESWFPASFMALINEK

SEQ ID NO: 3180169 - protein, 18 aa, Giardia lamblia
RYFIDVFEGLSFLDPSTD

SEQ ID NO: 3180170 - protein, 18 aa, Giardia lamblia
RYIDFSFWFIRDTSCEDK

SEQ ID NO: 3180171 - protein, 17 aa, Giardia lamblia
RYITIPVLTGFLTQCEV

SEQ ID NO: 3180172 - protein, 21 aa, Giardia lamblia
RYLIRLRYRFSRGVPLEAVVA

SEQ ID NO: 3180173 - protein, 18 aa, Giardia lamblia
RYPDGSVYRGEWLNDVRE

SEQ ID NO: 3180174 - protein, 22 aa, Giardia lamblia
RYPVKGCVVFRPYGFFMENAIM

SEQ ID NO: 3180175 - protein, 19 aa, Giardia lamblia
RYRRCWGTRASEQGSICTE

SEQ ID NO: 3180176 - protein, 17 aa, Giardia lamblia
RYTCIWPAWVDKYNNTY

SEQ ID NO: 3180177 - protein, 18 aa, Giardia lamblia
RYTCIWPAWVDKYNNTYI

SEQ ID NO: 3180178 - protein, 18 aa, Giardia lamblia
RYYCPFFYWMHSFGLILL

SEQ ID NO: 3180179 - protein, 27 aa, Giardia lamblia
SAAALRGTCCFFVMYGLGTISAMYQYS

SEQ ID NO: 3180180 - protein, 20 aa, Giardia lamblia
SAAKRCVKDLWSQVPKGLLS

SEQ ID NO: 3180181 - protein, 22 aa, Giardia lamblia
SAARIMLRFAKVAARFLMNYGF

SEQ ID NO: 3180182 - protein, 19 aa, Giardia lamblia
SACSQVVRHPCRLRCGHLV

SEQ ID NO: 3180183 - protein, 18 aa, Giardia lamblia
SAECSAAINCHRESVSMV

SEQ ID NO: 3180184 - protein, 18 aa, Giardia lamblia
SAEKAALVNLKFLAMQEN

SEQ ID NO: 3180185 - protein, 19 aa, Giardia lamblia
SAESLRLITGLVVEGFHLQ

SEQ ID NO: 3180186 - protein, 19 aa, Giardia lamblia
SAEVPLYLALQLFDTQQAT

SEQ ID NO: 3180187 - protein, 17 aa, Giardia lamblia
SAEYPKSLGAVIVYCYT

SEQ ID NO: 3180188 - protein, 17 aa, Giardia lamblia
SAGHCFPSHMYIEQINK

SEQ ID NO: 3180189 - protein, 18 aa, Giardia lamblia
SAHVWKYLNYQAGLQDEE

SEQ ID NO: 3180190 - protein, 17 aa, Giardia lamblia
SAICAICHAPAPFSARF

SEQ ID NO: 3180191 - protein, 19 aa, Giardia lamblia
SAIRPCVFVLAFNKREHIV

SEQ ID NO: 3180192 - protein, 21 aa, Giardia lamblia
SAIYFKANWALKFSKDDTKML

SEQ ID NO: 3180193 - protein, 18 aa, Giardia lamblia
SAKRWAIQRNGEGKRDPD

SEQ ID NO: 3180194 - protein, 19 aa, Giardia lamblia
SALDRLGFRVGETALNVCL

SEQ ID NO: 3180195 - protein, 17 aa, Giardia lamblia
SALELLVTYGFTEGDSV

SEQ ID NO: 3180196 - protein, 17 aa, Giardia lamblia
SALKATLLYAVELSFSV

SEQ ID NO: 3180197 - protein, 18 aa, Giardia lamblia
SALLRLSTSYARASPLSE

SEQ ID NO: 3180198 - protein, 23 aa, Giardia lamblia
SALPRLRLIGLMTIGAPDASEYS

SEQ ID NO: 3180199 - protein, 18 aa, Giardia lamblia
SALSFLGLYKKKATIVFV

SEQ ID NO: 3180200 - protein, 18 aa, Giardia lamblia
SAPFNVLPLFDFQAFVHP

SEQ ID NO: 3180201 - protein, 24 aa, Giardia lamblia
SAQELLRDLLLIAFNARRYNSLDH

SEQ ID NO: 3180202 - protein, 20 aa, Giardia lamblia
SASRLRTAIYLLHSNLSWTV

SEQ ID NO: 3180203 - protein, 19 aa, Giardia lamblia
SAWKLEMTDYLLTHPPTGP

SEQ ID NO: 3180204 - protein, 18 aa, Giardia lamblia
SAYKGTWYNSLRHGQGTH

SEQ ID NO: 3180205 - protein, 18 aa, Giardia lamblia
SCAFPGFLELLWAAILGE

SEQ ID NO: 3180206 - protein, 19 aa, Giardia lamblia
SCAPIVGADVFCFETEQEL

SEQ ID NO: 3180207 - protein, 21 aa, Giardia lamblia
SCDWRTVEIINRISSQSPDIY

SEQ ID NO: 3180208 - protein, 18 aa, Giardia lamblia
SCEAEGLIGLILDSSSKI

SEQ ID NO: 3180209 - protein, 19 aa, Giardia lamblia
SCELFKAFVVRKMGEVTSQ

SEQ ID NO: 3180210 - protein, 19 aa, Giardia lamblia
SCHRPGLFVGDWDVELPAE

SEQ ID NO: 3180211 - protein, 26 aa, Giardia lamblia
SCIQLHKLLVCAGVTFIDSLYDTTAP

SEQ ID NO: 3180212 - protein, 20 aa, Giardia lamblia
SCKVLPWLGPVEYVSFLAKT

SEQ ID NO: 3180213 - protein, 19 aa, Giardia lamblia
SCMTIDWFANWNAEALAGV

SEQ ID NO: 3180214 - protein, 20 aa, Giardia lamblia
SCPSSVWARRGPWQSSRECT

SEQ ID NO: 3180215 - protein, 21 aa, Giardia lamblia
SCQRCGRPLYVPRLHLDASSQ

SEQ ID NO: 3180216 - protein, 17 aa, Giardia lamblia
SCSKLAATVICCPEALS

SEQ ID NO: 3180217 - protein, 18 aa, Giardia lamblia
SDECARYLIGTSDVDIET

SEQ ID NO: 3180218 - protein, 20 aa, Giardia lamblia
SDFGLACSWEQFYGRKNVYG

SEQ ID NO: 3180219 - protein, 21 aa, Giardia lamblia
SDFMKRLFIDSALPPAQDADI

SEQ ID NO: 3180220 - protein, 17 aa, Giardia lamblia
SDFRKARDKVLYKKIQE

SEQ ID NO: 3180221 - protein, 20 aa, Giardia lamblia
SDGKTAWLIAFDGGFKEVLD

SEQ ID NO: 3180222 - protein, 27 aa, Giardia lamblia
SDGRRAVQFAAEWGCLACVDMLMDYEG

SEQ ID NO: 3180223 - protein, 19 aa, Giardia lamblia
SDGTCALMWAASKGNEAIC

SEQ ID NO: 3180224 - protein, 21 aa, Giardia lamblia
SDIEWRWLYRHGIDKFYRSRT

SEQ ID NO: 3180225 - protein, 19 aa, Giardia lamblia
SDIWSFGCVIYYMCTGQPC

SEQ ID NO: 3180226 - protein, 24 aa, Giardia lamblia
SDKLRCRLTFLALCNIMQTFSHRG

SEQ ID NO: 3180227 - protein, 17 aa, Giardia lamblia
SDKRIEPAVAIMHLGLV

SEQ ID NO: 3180228 - protein, 19 aa, Giardia lamblia
SDLKCVLEEFTIDFSGPTS

SEQ ID NO: 3180229 - protein, 21 aa, Giardia lamblia
SDLMLRNGLYVFRSRGSRNNP

SEQ ID NO: 3180230 - protein, 17 aa, Giardia lamblia
SDLRISPSLSKRFTNPP

SEQ ID NO: 3180231 - protein, 25 aa, Giardia lamblia
SDNRLGIHHFIKFNCTILRLSSNLV

SEQ ID NO: 3180232 - protein, 19 aa, Giardia lamblia
SDQIRFMRVLQQISGNHTP

SEQ ID NO: 3180233 - protein, 22 aa, Giardia lamblia
SDRRPRCAILLPTPAVLLLHTT

SEQ ID NO: 3180234 - protein, 17 aa, Giardia lamblia
SDRVMLHYCSFKNIMTI

SEQ ID NO: 3180235 - protein, 17 aa, Giardia lamblia
SDVCNREQLLLVCRGVL

SEQ ID NO: 3180236 - protein, 22 aa, Giardia lamblia
SDVKKRRAVVEMSQAITDLDDL

SEQ ID NO: 3180237 - protein, 17 aa, Giardia lamblia
SDVWQFGVALYSVLIGK

SEQ ID NO: 3180238 - protein, 21 aa, Giardia lamblia
SDYRSDCILPQLVPVKIDDIN

SEQ ID NO: 3180239 - protein, 18 aa, Giardia lamblia
SECTARHAISMTPGSMGA

SEQ ID NO: 3180240 - protein, 18 aa, Giardia lamblia
SEGGVPLVQFLKRLQDPP

SEQ ID NO: 3180241 - protein, 26 aa, Giardia lamblia
SEIICSGCGWRPFVGMVDNVLVVKPG

SEQ ID NO: 3180242 - protein, 21 aa, Giardia lamblia
SEIQYRLHLGLRYKAKGDRTL

SEQ ID NO: 3180243 - protein, 23 aa, Giardia lamblia
SEKRSASDFALWKAWKETEPEDA

SEQ ID NO: 3180244 - protein, 17 aa, Giardia lamblia
SELFKRRLEELQRSCRR

SEQ ID NO: 3180245 - protein, 18 aa, Giardia lamblia
SELILAWHWTRWGTSGTY

SEQ ID NO: 3180246 - protein, 21 aa, Giardia lamblia
SELQFPGLVVLEIFAHWCDVC

SEQ ID NO: 3180247 - protein, 23 aa, Giardia lamblia
SELRRKFRVLSHVIDQLKSEIQT

SEQ ID NO: 3180248 - protein, 19 aa, Giardia lamblia
SEPAFSLSGRYDVTKTNET

SEQ ID NO: 3180249 - protein, 17 aa, Giardia lamblia
SEPFFDYLKHWIIEGSL

SEQ ID NO: 3180250 - protein, 18 aa, Giardia lamblia
SEPPRKLCLDGLIDILLD

SEQ ID NO: 3180251 - protein, 19 aa, Giardia lamblia
SERVIPCLMLNKVDRVIME

SEQ ID NO: 3180252 - protein, 20 aa, Giardia lamblia
SESFAKMRLSPVVTVEDVEY

SEQ ID NO: 3180253 - protein, 19 aa, Giardia lamblia
SEYPFLFALAQREEQVRDG

SEQ ID NO: 3180254 - protein, 17 aa, Giardia lamblia
SEYPPELTFEFVEGTGD

SEQ ID NO: 3180255 - protein, 20 aa, Giardia lamblia
SEYRQRISLLDSQLTEEQMT

SEQ ID NO: 3180256 - protein, 18 aa, Giardia lamblia
SFCNWHFQGDYIVTVCTD

SEQ ID NO: 3180257 - protein, 25 aa, Giardia lamblia
SFCPICFDKIRLCYSTAIFALQNGM

SEQ ID NO: 3180258 - protein, 22 aa, Giardia lamblia
SFEEYPLIYGYDFRFSSLDGAK

SEQ ID NO: 3180259 - protein, 17 aa, Giardia lamblia
SFIKYLLEKEARMHRSD

SEQ ID NO: 3180260 - protein, 20 aa, Giardia lamblia
SFIRLFKRIFAKSVGKLKVR

SEQ ID NO: 3180261 - protein, 19 aa, Giardia lamblia
SFISVQWLVVRSSINTHML

SEQ ID NO: 3180262 - protein, 21 aa, Giardia lamblia
SFLKREIKALLRVILLGASQT

SEQ ID NO: 3180263 - protein, 24 aa, Giardia lamblia
SFLRKPLRITFDWEDGIDQGGPRT

SEQ ID NO: 3180264 - protein, 21 aa, Giardia lamblia
SFLTRDSWRMLLLIHYLEFVK

SEQ ID NO: 3180265 - protein, 19 aa, Giardia lamblia
SFNASAWKELLCVQRSIFD

SEQ ID NO: 3180266 - protein, 21 aa, Giardia lamblia
SFPECNRCLIAGTGHCYHKSE

SEQ ID NO: 3180267 - protein, 22 aa, Giardia lamblia
SFPETVHLWLARSGGDGIPVFA

SEQ ID NO: 3180268 - protein, 24 aa, Giardia lamblia
SFSMLDMVRFYLAALRLLRDSDPG

SEQ ID NO: 3180269 - protein, 17 aa, Giardia lamblia
SFSPMWVRTCLSSAALT

SEQ ID NO: 3180270 - protein, 19 aa, Giardia lamblia
SFSQAGCHGSVLSTRSITE

SEQ ID NO: 3180271 - protein, 25 aa, Giardia lamblia
SFTYEYRLKLVYEHWCLEVVDKHIP

SEQ ID NO: 3180272 - protein, 23 aa, Giardia lamblia
SGACKALALLLAYTSIRHTKAGL

SEQ ID NO: 3180273 - protein, 25 aa, Giardia lamblia
SGADMAGLCAYDILRYAIAAAKEGE

SEQ ID NO: 3180274 - protein, 19 aa, Giardia lamblia
SGAEFGFDIIMLCPEGSDA

SEQ ID NO: 3180275 - protein, 22 aa, Giardia lamblia
SGANMGMGMGMQRPMGMPRPAG

SEQ ID NO: 3180276 - protein, 17 aa, Giardia lamblia
SGAPGFQLAIMAPRGLC

SEQ ID NO: 3180277 - protein, 20 aa, Giardia lamblia
SGDHGFMFICDGAVHNTDEA

SEQ ID NO: 3180278 - protein, 21 aa, Giardia lamblia
SGDLARAWALLPIQHGVRDKH

SEQ ID NO: 3180279 - protein, 22 aa, Giardia lamblia
SGESFQKILLILANVTRSMNPA

SEQ ID NO: 3180280 - protein, 19 aa, Giardia lamblia
SGFCLIRFVNPSGAEKCVR

SEQ ID NO: 3180281 - protein, 25 aa, Giardia lamblia
SGFLRLCSGVGFLIRPKNVTTGSSL

SEQ ID NO: 3180282 - protein, 23 aa, Giardia lamblia
SGKLCAIKLLWSQKGNNYNEKEE

SEQ ID NO: 3180283 - protein, 26 aa, Giardia lamblia
SGLIDYEAFLGLFAFKGDIPPEAERG

SEQ ID NO: 3180284 - protein, 19 aa, Giardia lamblia
SGLLPFKFSMITISDSYVD

SEQ ID NO: 3180285 - protein, 17 aa, Giardia lamblia
SGLSFGPLVKRVHTEGF

SEQ ID NO: 3180286 - protein, 22 aa, Giardia lamblia
SGMELLWLGLVEYKELRRLGKD

SEQ ID NO: 3180287 - protein, 19 aa, Giardia lamblia
SGNAVWLMRLLKASCESDG

SEQ ID NO: 3180288 - protein, 20 aa, Giardia lamblia
SGRLPRSIPVILRNHLIDKC

SEQ ID NO: 3180289 - protein, 18 aa, Giardia lamblia
SGSGRPGFTSVTQPLAQQ

SEQ ID NO: 3180290 - protein, 21 aa, Giardia lamblia
SGSIRKSAALAFRTSDAQTEA

SEQ ID NO: 3180291 - protein, 24 aa, Giardia lamblia
SGSKLRPSLHYSISVSSTSDTYTD

SEQ ID NO: 3180292 - protein, 18 aa, Giardia lamblia
SGTFSFSFSKSMKSPRSF

SEQ ID NO: 3180293 - protein, 23 aa, Giardia lamblia
SGTGSKAYIGWKLAIEQRQRARS

SEQ ID NO: 3180294 - protein, 18 aa, Giardia lamblia
SGTLPVFLVVGMGEAAEL

SEQ ID NO: 3180295 - protein, 18 aa, Giardia lamblia
SGVFTIWDRRSHLRCVYS

SEQ ID NO: 3180296 - protein, 24 aa, Giardia lamblia
SGVLRFKMFLEYVIVASVQKEFEP

SEQ ID NO: 3180297 - protein, 17 aa, Giardia lamblia
SHGRTALIYAAIDDNIE

SEQ ID NO: 3180298 - protein, 18 aa, Giardia lamblia
SHLSSRPAFRRSVEKKTL

SEQ ID NO: 3180299 - protein, 17 aa, Giardia lamblia
SHLYLLRGVFGSGKSRV

SEQ ID NO: 3180300 - protein, 18 aa, Giardia lamblia
SHPLELFDIAALPNTLQF

SEQ ID NO: 3180301 - protein, 24 aa, Giardia lamblia
SHPLSEYRSASVLRTSSGDEKIPS

SEQ ID NO: 3180302 - protein, 23 aa, Giardia lamblia
SHRLICLLSGWTRAPLRVLGNGR

SEQ ID NO: 3180303 - protein, 18 aa, Giardia lamblia
SHRSAWYFVLSELVRLFI

SEQ ID NO: 3180304 - protein, 22 aa, Giardia lamblia
SHRYECGDCLAIRNELSDPHTS

SEQ ID NO: 3180305 - protein, 23 aa, Giardia lamblia
SIACIPLLLSREAGFKDAEGRAP

SEQ ID NO: 3180306 - protein, 21 aa, Giardia lamblia
SICLGEGLLAINLLIETNRYI

SEQ ID NO: 3180307 - protein, 18 aa, Giardia lamblia
SICRPRRLLYLAVDGPAP

SEQ ID NO: 3180308 - protein, 17 aa, Giardia lamblia
SIDCVRLLLNYYGMERD

SEQ ID NO: 3180309 - protein, 18 aa, Giardia lamblia
SIEIIALLCYLKLSYPSK

SEQ ID NO: 3180310 - protein, 23 aa, Giardia lamblia
SIIEAWPAPTFFLTDLRIKHMQA

SEQ ID NO: 3180311 - protein, 17 aa, Giardia lamblia
SIKRYSIGRVYRRDKPV

SEQ ID NO: 3180312 - protein, 19 aa, Giardia lamblia
SILHFSWTPLMCAAADGDI

SEQ ID NO: 3180313 - protein, 22 aa, Giardia lamblia
SILLMKRFLSVFVLSTRTARYF

SEQ ID NO: 3180314 - protein, 18 aa, Giardia lamblia
SILNFPLLDSHAMLKLLE

SEQ ID NO: 3180315 - protein, 17 aa, Giardia lamblia
SILPLFWSLGLNKIVNY

SEQ ID NO: 3180316 - protein, 18 aa, Giardia lamblia
SIRLRLTAMQKRAIKRNE

SEQ ID NO: 3180317 - protein, 17 aa, Giardia lamblia
SIVKAFAYFVREVRVLS

SEQ ID NO: 3180318 - protein, 25 aa, Giardia lamblia
SIVKPPEAWFWYPITSRLCRTALDK

SEQ ID NO: 3180319 - protein, 18 aa, Giardia lamblia
SIYWLPSFLQAGTMNEIS

SEQ ID NO: 3180320 - protein, 20 aa, Giardia lamblia
SKDVRLCLRFVRSMTETYVK

SEQ ID NO: 3180321 - protein, 18 aa, Giardia lamblia
SKEEYVWASIREYIEQKF

SEQ ID NO: 3180322 - protein, 25 aa, Giardia lamblia
SKEIRKSIDLALRFLIKNSTHGEEL

SEQ ID NO: 3180323 - protein, 18 aa, Giardia lamblia
SKGGDIGIAMLMENKNLT

SEQ ID NO: 3180324 - protein, 18 aa, Giardia lamblia
SKHIKSAIAVLKFLELAA

SEQ ID NO: 3180325 - protein, 19 aa, Giardia lamblia
SKIPATKDFPCKRCEQYLN

SEQ ID NO: 3180326 - protein, 19 aa, Giardia lamblia
SKLAATVICCPEALSQQLI

SEQ ID NO: 3180327 - protein, 17 aa, Giardia lamblia
SKLDMGLFSEAHQPTSD

SEQ ID NO: 3180328 - protein, 23 aa, Giardia lamblia
SKLHYAFPFLHRYIAILYTPSLD

SEQ ID NO: 3180329 - protein, 18 aa, Giardia lamblia
SKLIDLFFADYFVDSYED

SEQ ID NO: 3180330 - protein, 21 aa, Giardia lamblia
SKLKEFLFRFDAECYTAALDR

SEQ ID NO: 3180331 - protein, 22 aa, Giardia lamblia
SKLLYYSLCEFTKVYAPLISPC

SEQ ID NO: 3180332 - protein, 19 aa, Giardia lamblia
SKLRACGMSGVSDTSAVRA

SEQ ID NO: 3180333 - protein, 18 aa, Giardia lamblia
SKLSKLRPTIAFHASIEH

SEQ ID NO: 3180334 - protein, 23 aa, Giardia lamblia
SKMKSCSCVHPLGTNDPVRTSST

SEQ ID NO: 3180335 - protein, 20 aa, Giardia lamblia
SKPRVRECVFKCFIDIIQDM

SEQ ID NO: 3180336 - protein, 18 aa, Giardia lamblia
SKPWVFVCDSGWKFHELR

SEQ ID NO: 3180337 - protein, 19 aa, Giardia lamblia
SKRLDCVRYLLPERNIHNT

SEQ ID NO: 3180338 - protein, 20 aa, Giardia lamblia
SKRLPLLVATVSEFVEISED

SEQ ID NO: 3180339 - protein, 23 aa, Giardia lamblia
SKRPAAACTKYLLGWQPVNRLKN

SEQ ID NO: 3180340 - protein, 19 aa, Giardia lamblia
SKSFVPCRIIFALVEASSP

SEQ ID NO: 3180341 - protein, 17 aa, Giardia lamblia
SKTEFWCMSSLDTPVSS

SEQ ID NO: 3180342 - protein, 19 aa, Giardia lamblia
SKTELKSPIGFRQTAAPAT

SEQ ID NO: 3180343 - protein, 19 aa, Giardia lamblia
SKTVFFPFIVSINLKSHAV

SEQ ID NO: 3180344 - protein, 23 aa, Giardia lamblia
SKYRYCPNCQVLVALGEECQLCH

SEQ ID NO: 3180345 - protein, 17 aa, Giardia lamblia
SLAEPLVRCGACREVYC

SEQ ID NO: 3180346 - protein, 17 aa, Giardia lamblia
SLAHLRLDTSLSELLIF

SEQ ID NO: 3180347 - protein, 19 aa, Giardia lamblia
SLARPTARWLPSPVVATHV

SEQ ID NO: 3180348 - protein, 17 aa, Giardia lamblia
SLCNLLFNGSSRCKSHA

SEQ ID NO: 3180349 - protein, 18 aa, Giardia lamblia
SLECGRCLIKQAGMRSRD

SEQ ID NO: 3180350 - protein, 19 aa, Giardia lamblia
SLECVKLLLKKEGRMQTNS

SEQ ID NO: 3180351 - protein, 18 aa, Giardia lamblia
SLEGFDIIAELSVSQSPL

SEQ ID NO: 3180352 - protein, 17 aa, Giardia lamblia
SLFDAWLANSLPPIREI

SEQ ID NO: 3180353 - protein, 19 aa, Giardia lamblia
SLFGKIGCYWVFRAETDAY

SEQ ID NO: 3180354 - protein, 21 aa, Giardia lamblia
SLGGNCKTIFIANVTPSSSSY

SEQ ID NO: 3180355 - protein, 24 aa, Giardia lamblia
SLGNLEICKLLAPYENSFSTVSAT

SEQ ID NO: 3180356 - protein, 19 aa, Giardia lamblia
SLHIQDFFHYFAPKNIDAT

SEQ ID NO: 3180357 - protein, 28 aa, Giardia lamblia
SLKHLQICWHFYLKPAIMKTTFTDLTDP

SEQ ID NO: 3180358 - protein, 24 aa, Giardia lamblia
SLKIKLDRCLPRRFCSVVYCKDGT

SEQ ID NO: 3180359 - protein, 17 aa, Giardia lamblia
SLKMQFRPVDLFCKHHY

SEQ ID NO: 3180360 - protein, 23 aa, Giardia lamblia
SLLCKRIMPCIIDLQKHCRELYS

SEQ ID NO: 3180361 - protein, 18 aa, Giardia lamblia
SLLFPVIVQSSIKGFDIM

SEQ ID NO: 3180362 - protein, 20 aa, Giardia lamblia
SLLHKLFVTKTCTAIDKQEI

SEQ ID NO: 3180363 - protein, 17 aa, Giardia lamblia
SLLLWLTANGFKLRTFP

SEQ ID NO: 3180364 - protein, 18 aa, Giardia lamblia
SLMFDKALKCKFAYEKYG

SEQ ID NO: 3180365 - protein, 17 aa, Giardia lamblia
SLPETLSTLAFAERCKS

SEQ ID NO: 3180366 - protein, 33 aa, Giardia lamblia
SLPFSRPFMVLAFPLLWCLNGEYISDEERRLAR

SEQ ID NO: 3180367 - protein, 19 aa, Giardia lamblia
SLPGPRYSRSRATSGSSSG

SEQ ID NO: 3180368 - protein, 19 aa, Giardia lamblia
SLPRKLIWMNPVYREPFND

SEQ ID NO: 3180369 - protein, 22 aa, Giardia lamblia
SLPTARWLWKGKRYSSVGGIVW

SEQ ID NO: 3180370 - protein, 24 aa, Giardia lamblia
SLSELRLAWQYPRRVASPRELVAL

SEQ ID NO: 3180371 - protein, 25 aa, Giardia lamblia
SLSSPEFLPLILLMDLSRVCTILQN

SEQ ID NO: 3180372 - protein, 18 aa, Giardia lamblia
SLVASYSCCYSRRLIIPL

SEQ ID NO: 3180373 - protein, 20 aa, Giardia lamblia
SLVRLKGFRILRSVLRKNGC

SEQ ID NO: 3180374 - protein, 17 aa, Giardia lamblia
SLWQFLIKMVDILPPEV

SEQ ID NO: 3180375 - protein, 19 aa, Giardia lamblia
SMCAPELFDSFIPDVRSDL

SEQ ID NO: 3180376 - protein, 20 aa, Giardia lamblia
SMCLPCLRARVNITKGIDTE

SEQ ID NO: 3180377 - protein, 26 aa, Giardia lamblia
SMKIKLSEGFFAFFLSPRVVDMVETL

SEQ ID NO: 3180378 - protein, 23 aa, Giardia lamblia
SMKMCPVHSLLSINDRGASYYRM

SEQ ID NO: 3180379 - protein, 24 aa, Giardia lamblia
SMLCTWGVCSFCDSRKAPNYLTTT

SEQ ID NO: 3180380 - protein, 18 aa, Giardia lamblia
SMQCSRLLPLQGQQHYTL

SEQ ID NO: 3180381 - protein, 19 aa, Giardia lamblia
SMTPLWPRIHGGTIGMRPV

SEQ ID NO: 3180382 - protein, 17 aa, Giardia lamblia
SNARPCGMINLSDMSAV

SEQ ID NO: 3180383 - protein, 25 aa, Giardia lamblia
SNCGLEKVPACLRALPCLQELDLSR

SEQ ID NO: 3180384 - protein, 22 aa, Giardia lamblia
SNCRWRPSLAYSDHRPRMKEDV

SEQ ID NO: 3180385 - protein, 23 aa, Giardia lamblia
SNFRCCAELLAPYEGGIVNNVGE

SEQ ID NO: 3180386 - protein, 20 aa, Giardia lamblia
SNILFCSSVTGLIRIYNYDV

SEQ ID NO: 3180387 - protein, 19 aa, Giardia lamblia
SNIQFCFLSATVPNASEFA

SEQ ID NO: 3180388 - protein, 18 aa, Giardia lamblia
SNKFLDFFITPIVRCTQA

SEQ ID NO: 3180389 - protein, 17 aa, Giardia lamblia
SNKRSLLDFVWDQEGHE

SEQ ID NO: 3180390 - protein, 21 aa, Giardia lamblia
SNPKILLSIRIWRTREEAQLH

SEQ ID NO: 3180391 - protein, 23 aa, Giardia lamblia
SNRYPCPVYRTSLRRGVLTTTGH

SEQ ID NO: 3180392 - protein, 23 aa, Giardia lamblia
SNSLDCVRLLLPLEEGLQTNNLH

SEQ ID NO: 3180393 - protein, 17 aa, Giardia lamblia
SNSRHPWGLSREEEEET

SEQ ID NO: 3180394 - protein, 17 aa, Giardia lamblia
SNSRLLFTLARADIVLN

SEQ ID NO: 3180395 - protein, 22 aa, Giardia lamblia
SNTTLREWRRIFSFVAKQGKNK

SEQ ID NO: 3180396 - protein, 20 aa, Giardia lamblia
SNVPMLLGIVSVYAGCRNHV

SEQ ID NO: 3180397 - protein, 19 aa, Giardia lamblia
SNWLPKCFTKLYLLKLKPY

SEQ ID NO: 3180398 - protein, 19 aa, Giardia lamblia
SPECSRCLGYWIAALENSG

SEQ ID NO: 3180399 - protein, 22 aa, Giardia lamblia
SPEGRCALEYAILEEQLKSIPI

SEQ ID NO: 3180400 - protein, 18 aa, Giardia lamblia
SPEISFFCNKGFVLSNYL

SEQ ID NO: 3180401 - protein, 21 aa, Giardia lamblia
SPELRELILLCLEHSPKDRIT

SEQ ID NO: 3180402 - protein, 18 aa, Giardia lamblia
SPFALVLLRDCHHIPLPK

SEQ ID NO: 3180403 - protein, 19 aa, Giardia lamblia
SPGTVLAAISFVGHVQYTK

SEQ ID NO: 3180404 - protein, 19 aa, Giardia lamblia
SPHCVALAWHVKKWNTSMY

SEQ ID NO: 3180405 - protein, 18 aa, Giardia lamblia
SPILFKFLLQSSRLSESL

SEQ ID NO: 3180406 - protein, 17 aa, Giardia lamblia
SPLDLVFFDACVAHILR

SEQ ID NO: 3180407 - protein, 24 aa, Giardia lamblia
SPLIKAARMGDAFGVRMNMERWKR

SEQ ID NO: 3180408 - protein, 17 aa, Giardia lamblia
SPMIFLKLGCKFKKMER

SEQ ID NO: 3180409 - protein, 18 aa, Giardia lamblia
SPMKRSPPLLAQKADGSS

SEQ ID NO: 3180410 - protein, 20 aa, Giardia lamblia
SPPSVLCRWTSPHVTEPDTL

SEQ ID NO: 3180411 - protein, 18 aa, Giardia lamblia
SPQLLGICLKKIRGLQHV

SEQ ID NO: 3180412 - protein, 22 aa, Giardia lamblia
SPQNKSDCTWSFTTEAAQDPTQ

SEQ ID NO: 3180413 - protein, 22 aa, Giardia lamblia
SPREKACVMHFLLMIADRHEAQ

SEQ ID NO: 3180414 - protein, 18 aa, Giardia lamblia
SPSDLFTCGVHFKANAVF

SEQ ID NO: 3180415 - protein, 19 aa, Giardia lamblia
SPSSTWKPERGCFVSFKAK

SEQ ID NO: 3180416 - protein, 19 aa, Giardia lamblia
SPWSDVEWSLIPPIVSSSI

SEQ ID NO: 3180417 - protein, 17 aa, Giardia lamblia
SQAPRIFAFTSFLCNMI

SEQ ID NO: 3180418 - protein, 17 aa, Giardia lamblia
SQGHLVIPVAFTSDAFE

SEQ ID NO: 3180419 - protein, 17 aa, Giardia lamblia
SQGRTALIYAIQSGQSQ

SEQ ID NO: 3180420 - protein, 23 aa, Giardia lamblia
SQLDLKLLFRFQGLSQRTYEAGY

SEQ ID NO: 3180421 - protein, 24 aa, Giardia lamblia
SQLLCLATALGVPVSSRIPCQTMD

SEQ ID NO: 3180422 - protein, 23 aa, Giardia lamblia
SQLPSRIDPLIQRYNRALESQQR

SEQ ID NO: 3180423 - protein, 19 aa, Giardia lamblia
SQLSIMWCYDEMPKLSSNK

SEQ ID NO: 3180424 - protein, 17 aa, Giardia lamblia
SQRRLGYRYSYDLFRTW

SEQ ID NO: 3180425 - protein, 23 aa, Giardia lamblia
SQYAINCCRVWLTQWKKKGLLCP

SEQ ID NO: 3180426 - protein, 18 aa, Giardia lamblia
SRAAFPVLFSTYRAACIS

SEQ ID NO: 3180427 - protein, 19 aa, Giardia lamblia
SRCHNVWYCGRKCQKIDWV

SEQ ID NO: 3180428 - protein, 19 aa, Giardia lamblia
SRCRFIFCRFFNVYGPRQD

SEQ ID NO: 3180429 - protein, 20 aa, Giardia lamblia
SREILKRYLPMIYEANNGEP

SEQ ID NO: 3180430 - protein, 22 aa, Giardia lamblia
SREMRGAMEMARKIYTSAYSDN

SEQ ID NO: 3180431 - protein, 18 aa, Giardia lamblia
SRFFAFGRVFSGVVQTGQ

SEQ ID NO: 3180432 - protein, 18 aa, Giardia lamblia
SRFKICVSVTIIGQKGQG

SEQ ID NO: 3180433 - protein, 21 aa, Giardia lamblia
SRFPFGCIYKGMWNADRRHGL

SEQ ID NO: 3180434 - protein, 19 aa, Giardia lamblia
SRGALKYSDMIYLKKLCEA

SEQ ID NO: 3180435 - protein, 17 aa, Giardia lamblia
SRGALLWGPPGTGKSLL

SEQ ID NO: 3180436 - protein, 18 aa, Giardia lamblia
SRGENALFWAIRNNDLTY

SEQ ID NO: 3180437 - protein, 18 aa, Giardia lamblia
SRGFRLNNLIPMCDSSWT

SEQ ID NO: 3180438 - protein, 25 aa, Giardia lamblia
SRGIKAELLPSVLLECCKDEPCYAY

SEQ ID NO: 3180439 - protein, 17 aa, Giardia lamblia
SRGLACVLFIYVLKYLY

SEQ ID NO: 3180440 - protein, 18 aa, Giardia lamblia
SRIDLTYCITRLRYLTFK

SEQ ID NO: 3180441 - protein, 19 aa, Giardia lamblia
SRIRRKACIVFNPSDTKRI

SEQ ID NO: 3180442 - protein, 25 aa, Giardia lamblia
SRKKRLRTLLSYKCMEEINLYYGGN

SEQ ID NO: 3180443 - protein, 21 aa, Giardia lamblia
SRLEFIPGYSADLFLLLTQML

SEQ ID NO: 3180444 - protein, 24 aa, Giardia lamblia
SRLEMLKLFASFCLEYYGSDAPGV

SEQ ID NO: 3180445 - protein, 20 aa, Giardia lamblia
SRLHSKMGYTALMLAAQNNH

SEQ ID NO: 3180446 - protein, 21 aa, Giardia lamblia
SRLKERCSVMEGCNKDLQARA

SEQ ID NO: 3180447 - protein, 17 aa, Giardia lamblia
SRLPRPILTDDLSLAAH

SEQ ID NO: 3180448 - protein, 20 aa, Giardia lamblia
SRLWPSFIFLIRLLDFSPAF

SEQ ID NO: 3180449 - protein, 19 aa, Giardia lamblia
SRPDFVAQLAVELRNYDTL

SEQ ID NO: 3180450 - protein, 18 aa, Giardia lamblia
SRPHCFPVVKGLVESEHE

SEQ ID NO: 3180451 - protein, 20 aa, Giardia lamblia
SRRPSIPFSQSIPISPSRSS

SEQ ID NO: 3180452 - protein, 22 aa, Giardia lamblia
SRSHSIFTICLIVKETAPSSNN

SEQ ID NO: 3180453 - protein, 18 aa, Giardia lamblia
SRSYLVPKFFDLAHTLGK

SEQ ID NO: 3180454 - protein, 18 aa, Giardia lamblia
SRTPLSEKFSMCIDKLLL

SEQ ID NO: 3180455 - protein, 18 aa, Giardia lamblia
SRTPWSLASSRMHTSARL

SEQ ID NO: 3180456 - protein, 23 aa, Giardia lamblia
SRVGSSLCAIVFSVGSSPVPVSK

SEQ ID NO: 3180457 - protein, 17 aa, Giardia lamblia
SRVKLRVPIPINEDPRC

SEQ ID NO: 3180458 - protein, 18 aa, Giardia lamblia
SRVPYYISQLLNLFQHRI

SEQ ID NO: 3180459 - protein, 20 aa, Giardia lamblia
SRYAEHLPIMGFVGKKVNQK

SEQ ID NO: 3180460 - protein, 18 aa, Giardia lamblia
SRYGRPASGLAVLNASSV

SEQ ID NO: 3180461 - protein, 17 aa, Giardia lamblia
SRYGYEIPRHATFGCIN

SEQ ID NO: 3180462 - protein, 22 aa, Giardia lamblia
SSEISLRLARGISLEKPVLLPV

SEQ ID NO: 3180463 - protein, 21 aa, Giardia lamblia
SSELAAGVTICIAKPTAANLK

SEQ ID NO: 3180464 - protein, 18 aa, Giardia lamblia
SSFPQVFLSRYPKLESKL

SEQ ID NO: 3180465 - protein, 27 aa, Giardia lamblia
SSFPRGLFLRRLRTLLIGRINLPLHWI

SEQ ID NO: 3180466 - protein, 17 aa, Giardia lamblia
SSFSGGIPMPQSNAVQQ

SEQ ID NO: 3180467 - protein, 21 aa, Giardia lamblia
SSGIIPGVFYYYWKHYDLPEE

SEQ ID NO: 3180468 - protein, 20 aa, Giardia lamblia
SSHEILLWPEMQTVATLVSG

SEQ ID NO: 3180469 - protein, 23 aa, Giardia lamblia
SSHMKLKVANLITHTSDHTELEN

SEQ ID NO: 3180470 - protein, 23 aa, Giardia lamblia
SSIAEYRRLFGLPPCSEEGFADE

SEQ ID NO: 3180471 - protein, 25 aa, Giardia lamblia
SSIIIKPLICYGPQCACCNGSSMQF

SEQ ID NO: 3180472 - protein, 17 aa, Giardia lamblia
SSIKGLGRFMEKQELAR

SEQ ID NO: 3180473 - protein, 18 aa, Giardia lamblia
SSILLKLHLDTCAEDTPE

SEQ ID NO: 3180474 - protein, 20 aa, Giardia lamblia
SSIRLPLKYQWLNREVPTEI

SEQ ID NO: 3180475 - protein, 17 aa, Giardia lamblia
SSIWRRCTKREGEWFFF

SEQ ID NO: 3180476 - protein, 19 aa, Giardia lamblia
SSLARLSAFLAEYDLHTIE

SEQ ID NO: 3180477 - protein, 20 aa, Giardia lamblia
SSLCIPYMHGFYIDKALYDK

SEQ ID NO: 3180478 - protein, 21 aa, Giardia lamblia
SSLCKPGRSVAVYSLDNLDFQ

SEQ ID NO: 3180479 - protein, 19 aa, Giardia lamblia
SSLDCLMYAAARSRKSANR

SEQ ID NO: 3180480 - protein, 24 aa, Giardia lamblia
SSLDKKVEMGFYWSTQLYNDAMCL

SEQ ID NO: 3180481 - protein, 22 aa, Giardia lamblia
SSLDRPNPWMARGSGSQWEDRH

SEQ ID NO: 3180482 - protein, 18 aa, Giardia lamblia
SSLFPFGFHVTGMPICGA

SEQ ID NO: 3180483 - protein, 17 aa, Giardia lamblia
SSLKELMGFILGLDNRS

SEQ ID NO: 3180484 - protein, 17 aa, Giardia lamblia
SSLKRYKTILALHETTE

SEQ ID NO: 3180485 - protein, 17 aa, Giardia lamblia
SSLPGLRRGKAVGAATS

SEQ ID NO: 3180486 - protein, 19 aa, Giardia lamblia
SSLRPVAFRSPFQFLHVSR

SEQ ID NO: 3180487 - protein, 20 aa, Giardia lamblia
SSMNTRGSGLFDYPVSTDSL

SEQ ID NO: 3180488 - protein, 20 aa, Giardia lamblia
SSPIFLQWLECVYQVMHQRA

SEQ ID NO: 3180489 - protein, 22 aa, Giardia lamblia
SSQRPASVFLPRSHPLSEYRSA

SEQ ID NO: 3180490 - protein, 23 aa, Giardia lamblia
SSRALCDLCAWFGRGRLNWESPC

SEQ ID NO: 3180491 - protein, 23 aa, Giardia lamblia
SSRELGIAVGRQFNVSIMTILEA

SEQ ID NO: 3180492 - protein, 23 aa, Giardia lamblia
SSRFWPGCIYYVFARTLIWGSAY

SEQ ID NO: 3180493 - protein, 20 aa, Giardia lamblia
SSRSHCIVFLRILDTATGQA

SEQ ID NO: 3180494 - protein, 20 aa, Giardia lamblia
SSSFCDDGPFLAEELADQME

SEQ ID NO: 3180495 - protein, 22 aa, Giardia lamblia
SSSLRYAMQLLFPAFVVAKLEA

SEQ ID NO: 3180496 - protein, 22 aa, Giardia lamblia
SSSRFSSVFKRLDDLSLIKEMI

SEQ ID NO: 3180497 - protein, 18 aa, Giardia lamblia
SSSSFGFHSPTWGSPAVK

SEQ ID NO: 3180498 - protein, 17 aa, Giardia lamblia
SSSSPWNTSAMKVMIGH

SEQ ID NO: 3180499 - protein, 17 aa, Giardia lamblia
SSTKIAWEKMLIHKAPP

SEQ ID NO: 3180500 - protein, 22 aa, Giardia lamblia
SSTKRLASIIVETLLSDYSAVI

SEQ ID NO: 3180501 - protein, 18 aa, Giardia lamblia
SSVFGRPAVLPSMSLIGR

SEQ ID NO: 3180502 - protein, 19 aa, Giardia lamblia
SSVPLWVGDCFYRKLEHKR

SEQ ID NO: 3180503 - protein, 19 aa, Giardia lamblia
SSVVFLLFCFMHRDLDPDK

SEQ ID NO: 3180504 - protein, 22 aa, Giardia lamblia
SSYLCARLMLKFSTTDHPLDRD

SEQ ID NO: 3180505 - protein, 17 aa, Giardia lamblia
STADCFSCPSSEEISNE

SEQ ID NO: 3180506 - protein, 33 aa, Giardia lamblia
STAVYCPNCSIFLGCCKRCATIFARSHQAECNN

SEQ ID NO: 3180507 - protein, 19 aa, Giardia lamblia
STCKFEYPKILGILKQKDH

SEQ ID NO: 3180508 - protein, 24 aa, Giardia lamblia
STFLKEMLRRIFVVKPENRVSAKE

SEQ ID NO: 3180509 - protein, 25 aa, Giardia lamblia
STHPFKLLTHWGIHAHLYMHFTSPI

SEQ ID NO: 3180510 - protein, 18 aa, Giardia lamblia
STIVEAYESKAFVDNLAR

SEQ ID NO: 3180511 - protein, 17 aa, Giardia lamblia
STLGFYVFRVLKVILAY

SEQ ID NO: 3180512 - protein, 21 aa, Giardia lamblia
STLLKCLRRENSFLRVAASQH

SEQ ID NO: 3180513 - protein, 25 aa, Giardia lamblia
STPFSKKCWTEWRSTPGPGEYSVQS

SEQ ID NO: 3180514 - protein, 24 aa, Giardia lamblia
STPRIAVTIAEYFAYTLGYHVLVL

SEQ ID NO: 3180515 - protein, 19 aa, Giardia lamblia
STSRPGLSMNISVRQDVKI

SEQ ID NO: 3180516 - protein, 18 aa, Giardia lamblia
STVLLKWKKKQYIDKGPN

SEQ ID NO: 3180517 - protein, 18 aa, Giardia lamblia
STYPLGYMFFGMTVYLTV

SEQ ID NO: 3180518 - protein, 22 aa, Giardia lamblia
SVAELLVDCAFGLPNGIFPEYS

SEQ ID NO: 3180519 - protein, 19 aa, Giardia lamblia
SVALLKWVRIYLLMGRVVP

SEQ ID NO: 3180520 - protein, 18 aa, Giardia lamblia
SVCDSCDPYALKVYTDGS

SEQ ID NO: 3180521 - protein, 18 aa, Giardia lamblia
SVDTCFKTLITITGFDSS

SEQ ID NO: 3180522 - protein, 18 aa, Giardia lamblia
SVECIKLLLGELAIQNSM

SEQ ID NO: 3180523 - protein, 20 aa, Giardia lamblia
SVEIMPCCTLLRVFTVKTCP

SEQ ID NO: 3180524 - protein, 17 aa, Giardia lamblia
SVFDRLAALKAIKDNEE

SEQ ID NO: 3180525 - protein, 20 aa, Giardia lamblia
SVGLPEVWSLVGSAQLEKAS

SEQ ID NO: 3180526 - protein, 27 aa, Giardia lamblia
SVHDGLCAIRCLIKKGFIIPGGAAVET

SEQ ID NO: 3180527 - protein, 22 aa, Giardia lamblia
SVHGGEFMVLWGALRANVDLTI

SEQ ID NO: 3180528 - protein, 19 aa, Giardia lamblia
SVRCLPRVFKTLAKRDKLA

SEQ ID NO: 3180529 - protein, 18 aa, Giardia lamblia
SVRQLRAPLPLTDTSSVE

SEQ ID NO: 3180530 - protein, 20 aa, Giardia lamblia
SVSTKKEWFASILAHRYETV

SEQ ID NO: 3180531 - protein, 19 aa, Giardia lamblia
SVTMWKWYKQGSLPNTLRI

SEQ ID NO: 3180532 - protein, 17 aa, Giardia lamblia
SVVCRRITSTGALKIYV

SEQ ID NO: 3180533 - protein, 24 aa, Giardia lamblia
SVVKRLSAAIPLLFTGNIFTNQLK

SEQ ID NO: 3180534 - protein, 18 aa, Giardia lamblia
SWDKRILCFSIVDRTIVD

SEQ ID NO: 3180535 - protein, 18 aa, Giardia lamblia
SWKHEITDIIAIANKAPQ

SEQ ID NO: 3180536 - protein, 20 aa, Giardia lamblia
SWRMLLLIHYLEFVKKAYHK

SEQ ID NO: 3180537 - protein, 17 aa, Giardia lamblia
SYAGMPVLERFRIDDRK

SEQ ID NO: 3180538 - protein, 22 aa, Giardia lamblia
SYECCKELLGFLGPERDSNGMG

SEQ ID NO: 3180539 - protein, 19 aa, Giardia lamblia
SYEEFCQWASSTGTCMVNS

SEQ ID NO: 3180540 - protein, 17 aa, Giardia lamblia
SYFIACKFYNYLIENNN

SEQ ID NO: 3180541 - protein, 23 aa, Giardia lamblia
SYGRFCFTDLFPAESGQMEGQTS

SEQ ID NO: 3180542 - protein, 18 aa, Giardia lamblia
SYLKWRKAIMFQILTEVY

SEQ ID NO: 3180543 - protein, 25 aa, Giardia lamblia
SYLSYWKRRICEVLVRNTTSEISLF

SEQ ID NO: 3180544 - protein, 17 aa, Giardia lamblia
SYQTAFLTCVSWSPHGD

SEQ ID NO: 3180545 - protein, 23 aa, Giardia lamblia
SYRAPEMIDFFAKFPITIRSDVF

SEQ ID NO: 3180546 - protein, 18 aa, Giardia lamblia
SYTLLGYVVGLIPYPHHN

SEQ ID NO: 3180547 - protein, 23 aa, Giardia lamblia
SYVWRLAAEIVIPCYPGVPLTAP

SEQ ID NO: 3180548 - protein, 19 aa, Giardia lamblia
SYWAYRLMCVKNLLTSGEA

SEQ ID NO: 3180549 - protein, 18 aa, Giardia lamblia
SYYYAAFVRPFGVYLARK

SEQ ID NO: 3180550 - protein, 25 aa, Giardia lamblia
SYYYVSFRNFCRFISLIKDSVVGRV

SEQ ID NO: 3180551 - protein, 23 aa, Giardia lamblia
TADCWKHVVLLAILIIKYSTSSS

SEQ ID NO: 3180552 - protein, 18 aa, Giardia lamblia
TADLWILVCTDVLARGLD

SEQ ID NO: 3180553 - protein, 17 aa, Giardia lamblia
TAFKSSFTCFTRRVKKE

SEQ ID NO: 3180554 - protein, 17 aa, Giardia lamblia
TALHFAVELGNFEVAQE

SEQ ID NO: 3180555 - protein, 20 aa, Giardia lamblia
TALKRTTCPLSLDTLDDHWN

SEQ ID NO: 3180556 - protein, 20 aa, Giardia lamblia
TALMKCKRATYPEIYDYLRS

SEQ ID NO: 3180557 - protein, 17 aa, Giardia lamblia
TALPFPRLQLLDLSENK

SEQ ID NO: 3180558 - protein, 18 aa, Giardia lamblia
TALWKGVLLLPFINSSEL

SEQ ID NO: 3180559 - protein, 18 aa, Giardia lamblia
TALYMAVAAGHAELCYIL

SEQ ID NO: 3180560 - protein, 20 aa, Giardia lamblia
TAPFYVESLVGFNMFPGCEH

SEQ ID NO: 3180561 - protein, 17 aa, Giardia lamblia
TAPRFSLVPSISNSVSR

SEQ ID NO: 3180562 - protein, 22 aa, Giardia lamblia
TARKRRSALHMAVERANVDTVR

SEQ ID NO: 3180563 - protein, 20 aa, Giardia lamblia
TARLTISITAHFYKANQTAL

SEQ ID NO: 3180564 - protein, 17 aa, Giardia lamblia
TASIKHMAGHLIAADID

SEQ ID NO: 3180565 - protein, 23 aa, Giardia lamblia
TASRVNPGFMGRLGPEYPDVYDH

SEQ ID NO: 3180566 - protein, 19 aa, Giardia lamblia
TAVGPEWQSMTGYRGSIQA

SEQ ID NO: 3180567 - protein, 25 aa, Giardia lamblia
TAVWCPFKSTCLISGTRAGSVEIWD

SEQ ID NO: 3180568 - protein, 25 aa, Giardia lamblia
TCAYLWGFNVSWGYVHMCTLCSVAK

SEQ ID NO: 3180569 - protein, 23 aa, Giardia lamblia
TCGACGIVPGCMYYFYSEYKVPD

SEQ ID NO: 3180570 - protein, 21 aa, Giardia lamblia
TCGDGFVPFRCATGMGITEDQ

SEQ ID NO: 3180571 - protein, 17 aa, Giardia lamblia
TCIKHNFPHYSMLINDV

SEQ ID NO: 3180572 - protein, 22 aa, Giardia lamblia
TCLCLRVSGKLNRSWKSRPTAT

SEQ ID NO: 3180573 - protein, 20 aa, Giardia lamblia
TCPCLGCKRPKAYLRHLYTT

SEQ ID NO: 3180574 - protein, 18 aa, Giardia lamblia
TCQCFKRQQAFLPLFGYL

SEQ ID NO: 3180575 - protein, 19 aa, Giardia lamblia
TDAFPCMLFSSLLRVSLFL

SEQ ID NO: 3180576 - protein, 19 aa, Giardia lamblia
TDAKPRWLVDSSTQLNTMG

SEQ ID NO: 3180577 - protein, 22 aa, Giardia lamblia
TDARGRTALMYAAAAGHTDVVK

SEQ ID NO: 3180578 - protein, 18 aa, Giardia lamblia
TDATALMMAACYGYADIV

SEQ ID NO: 3180579 - protein, 17 aa, Giardia lamblia
TDAWRAGFNHLKEVIYR

SEQ ID NO: 3180580 - protein, 19 aa, Giardia lamblia
TDCLGRCALMYAIETHNAT

SEQ ID NO: 3180581 - protein, 18 aa, Giardia lamblia
TDGGRSALDFAIDNNQSH

SEQ ID NO: 3180582 - protein, 19 aa, Giardia lamblia
TDIDPRLGNSLVRQYNAHR

SEQ ID NO: 3180583 - protein, 23 aa, Giardia lamblia
TDIPIIWLYRGSWNRFTLGEASL

SEQ ID NO: 3180584 - protein, 23 aa, Giardia lamblia
TDLAKMYLCLEKEAKKYSSLLSV

SEQ ID NO: 3180585 - protein, 19 aa, Giardia lamblia
TDLGELVCIEFCLNLEANM

SEQ ID NO: 3180586 - protein, 25 aa, Giardia lamblia
TDLPLFFNYCWDKFYIHQSAFPYSL

SEQ ID NO: 3180587 - protein, 19 aa, Giardia lamblia
TDLQKLCILRCLRPDRVYI

SEQ ID NO: 3180588 - protein, 19 aa, Giardia lamblia
TDLRIKHMQAIPVTTQPER

SEQ ID NO: 3180589 - protein, 20 aa, Giardia lamblia
TDPELRVCLLVGGEALEKQF

SEQ ID NO: 3180590 - protein, 22 aa, Giardia lamblia
TDQCGRTALMYAAEHGYADCVR

SEQ ID NO: 3180591 - protein, 23 aa, Giardia lamblia
TDTRGRTALMYGAMKGSVEATEL

SEQ ID NO: 3180592 - protein, 21 aa, Giardia lamblia
TEAFIRLGVCLNRRRNTGIVF

SEQ ID NO: 3180593 - protein, 22 aa, Giardia lamblia
TEFAFSAVCFMSGKAYDMHDTI

SEQ ID NO: 3180594 - protein, 17 aa, Giardia lamblia
TEFRIPYMMARSPAAFR

SEQ ID NO: 3180595 - protein, 17 aa, Giardia lamblia
TEGLTYWFNMKCLIDTK

SEQ ID NO: 3180596 - protein, 21 aa, Giardia lamblia
TEIELTWGLCKSSYIEEFVAQ

SEQ ID NO: 3180597 - protein, 23 aa, Giardia lamblia
TEILEIFSSLYLAQRRIGDHINI

SEQ ID NO: 3180598 - protein, 23 aa, Giardia lamblia
TEIRLLSGVCIFIATKFEENYGE

SEQ ID NO: 3180599 - protein, 22 aa, Giardia lamblia
TEPEILRRISVLNRSINNAVAA

SEQ ID NO: 3180600 - protein, 19 aa, Giardia lamblia
TEYSSRLAAAGIIYDEVPP

SEQ ID NO: 3180601 - protein, 19 aa, Giardia lamblia
TFARAFLRISVKLSDEAAM

SEQ ID NO: 3180602 - protein, 18 aa, Giardia lamblia
TFCLPRVHGWMSLDSVVI

SEQ ID NO: 3180603 - protein, 25 aa, Giardia lamblia
TFISLCFMVSCWLVIKTRYAQIDEW

SEQ ID NO: 3180604 - protein, 19 aa, Giardia lamblia
TFKELKAPFARIVPVSNAE

SEQ ID NO: 3180605 - protein, 18 aa, Giardia lamblia
TFLCKCVAAAAGVSFFIV

SEQ ID NO: 3180606 - protein, 19 aa, Giardia lamblia
TFRIHEILEYIHFRTTHIP

SEQ ID NO: 3180607 - protein, 20 aa, Giardia lamblia
TFSAFELFDDVIIDHFAPED

SEQ ID NO: 3180608 - protein, 18 aa, Giardia lamblia
TGAPRLQLFFSVPSAGER

SEQ ID NO: 3180609 - protein, 18 aa, Giardia lamblia
TGASRSWRLIGWGKIQDN

SEQ ID NO: 3180610 - protein, 19 aa, Giardia lamblia
TGCILPFGGLSCRLTMSYL

SEQ ID NO: 3180611 - protein, 20 aa, Giardia lamblia
TGEFRPRRFFSIDRVYRNET

SEQ ID NO: 3180612 - protein, 24 aa, Giardia lamblia
TGILRLGLFLPFLLKYEKEEQSTR

SEQ ID NO: 3180613 - protein, 17 aa, Giardia lamblia
TGKLFCKVCNQRFQMEG

SEQ ID NO: 3180614 - protein, 26 aa, Giardia lamblia
TGLALTVNIPYCWKEKVNSQTQTQTH

SEQ ID NO: 3180615 - protein, 18 aa, Giardia lamblia
TGLIPDMRAFTASSADTT

SEQ ID NO: 3180616 - protein, 21 aa, Giardia lamblia
TGLRLSQLMIYDFTVTAEEAL

SEQ ID NO: 3180617 - protein, 18 aa, Giardia lamblia
TGPELGRYPRHAQFSTPI

SEQ ID NO: 3180618 - protein, 17 aa, Giardia lamblia
TGPFLPLFSRWAKSLAR

SEQ ID NO: 3180619 - protein, 19 aa, Giardia lamblia
TGTEPFCIILAAAGNIVCV

SEQ ID NO: 3180620 - protein, 23 aa, Giardia lamblia
THLRGLSGLAFSYSFLANQDITN

SEQ ID NO: 3180621 - protein, 18 aa, Giardia lamblia
THPLIIWFWDIVLNVMTQ

SEQ ID NO: 3180622 - protein, 17 aa, Giardia lamblia
THYRTALMIACEANNIE

SEQ ID NO: 3180623 - protein, 18 aa, Giardia lamblia
TIDVSGRFTIMVVSNFGD

SEQ ID NO: 3180624 - protein, 18 aa, Giardia lamblia
TIESLTECISRHGEEIQQ

SEQ ID NO: 3180625 - protein, 18 aa, Giardia lamblia
TIILGFRKSCIFAGNRGC

SEQ ID NO: 3180626 - protein, 21 aa, Giardia lamblia
TIKQRFEEIAGMVTSLQESLA

SEQ ID NO: 3180627 - protein, 17 aa, Giardia lamblia
TILCTKCNSLVFCNECW

SEQ ID NO: 3180628 - protein, 17 aa, Giardia lamblia
TILRYPLFIKVASIFLG

SEQ ID NO: 3180629 - protein, 19 aa, Giardia lamblia
TIPDLDLLGSMSYIPDLNS

SEQ ID NO: 3180630 - protein, 21 aa, Giardia lamblia
TIRCPIPMFVVFSWGTILNLA

SEQ ID NO: 3180631 - protein, 17 aa, Giardia lamblia
TIWAVPMSFSLIDNNYK

SEQ ID NO: 3180632 - protein, 19 aa, Giardia lamblia
TIYKPEVQNVYEIVKTYFE

SEQ ID NO: 3180633 - protein, 18 aa, Giardia lamblia
TKDGRTALMLAVEKNSME

SEQ ID NO: 3180634 - protein, 17 aa, Giardia lamblia
TKEHRIALEQALQSLTA

SEQ ID NO: 3180635 - protein, 20 aa, Giardia lamblia
TKIAQSWIKFIDELNIPRST

SEQ ID NO: 3180636 - protein, 20 aa, Giardia lamblia
TKICSIPGLPGRVVEPQMIT

SEQ ID NO: 3180637 - protein, 17 aa, Giardia lamblia
TKIELSKSFPIIAVGDS

SEQ ID NO: 3180638 - protein, 17 aa, Giardia lamblia
TKILKMCRGELDDDDEE

SEQ ID NO: 3180639 - protein, 21 aa, Giardia lamblia
TKKEYVFRFSLACLSVNEYIS

SEQ ID NO: 3180640 - protein, 26 aa, Giardia lamblia
TKKRRIRVCLDYCKYSVIHEICERRG

SEQ ID NO: 3180641 - protein, 21 aa, Giardia lamblia
TKRPDLHPVIAFQKQEKYVTS

SEQ ID NO: 3180642 - protein, 21 aa, Giardia lamblia
TKRTSFEHCTEWLTELRNASA

SEQ ID NO: 3180643 - protein, 18 aa, Giardia lamblia
TKVMKYKLLVDSIQVEIK

SEQ ID NO: 3180644 - protein, 18 aa, Giardia lamblia
TKYLLPMGIPPVRLVLLD

SEQ ID NO: 3180645 - protein, 18 aa, Giardia lamblia
TLCLRLSSVISCEIECGS

SEQ ID NO: 3180646 - protein, 20 aa, Giardia lamblia
TLCWNREKHGLLGWSGVDQT

SEQ ID NO: 3180647 - protein, 22 aa, Giardia lamblia
TLECARTAIGTPYYLSPELCED

SEQ ID NO: 3180648 - protein, 22 aa, Giardia lamblia
TLEKLCALFCIKPSSLTDAESM

SEQ ID NO: 3180649 - protein, 25 aa, Giardia lamblia
TLFLHPRYHKVAGLERFLGGLTLLR

SEQ ID NO: 3180650 - protein, 18 aa, Giardia lamblia
TLIEFAMKNDLHYRVTQQ

SEQ ID NO: 3180651 - protein, 24 aa, Giardia lamblia
TLLRPHGLLSFKLILPAVNCLKMA

SEQ ID NO: 3180652 - protein, 17 aa, Giardia lamblia
TLNSILCVGEFKVSPKE

SEQ ID NO: 3180653 - protein, 17 aa, Giardia lamblia
TLPCLPLSAANMGVSQI

SEQ ID NO: 3180654 - protein, 22 aa, Giardia lamblia
TLRERLAKCFFYEPDGLLISPM

SEQ ID NO: 3180655 - protein, 25 aa, Giardia lamblia
TLRKAPDIWPRWSPHGGLSLHPLQL

SEQ ID NO: 3180656 - protein, 24 aa, Giardia lamblia
TLSGCCSCATLIVLGHQSRDYVEK

SEQ ID NO: 3180657 - protein, 18 aa, Giardia lamblia
TLSTLAFAERCKSLPDRS

SEQ ID NO: 3180658 - protein, 17 aa, Giardia lamblia
TLSWFYWPMRFHCRCIE

SEQ ID NO: 3180659 - protein, 23 aa, Giardia lamblia
TLTCKRTNLSISLSFDKLELGGV

SEQ ID NO: 3180660 - protein, 17 aa, Giardia lamblia
TLTELFAIFTIILRKQF

SEQ ID NO: 3180661 - protein, 22 aa, Giardia lamblia
TLTKQRLEEVVALQERISVKEK

SEQ ID NO: 3180662 - protein, 18 aa, Giardia lamblia
TLVKLRFDVTAKLSMMEK

SEQ ID NO: 3180663 - protein, 20 aa, Giardia lamblia
TLYEICSFRLPYPSPTIDDL

SEQ ID NO: 3180664 - protein, 22 aa, Giardia lamblia
TMENALRFGKPVMIVNLLEEID

SEQ ID NO: 3180665 - protein, 17 aa, Giardia lamblia
TMLSIVCPFCSRVKISE

SEQ ID NO: 3180666 - protein, 22 aa, Giardia lamblia
TMNCPLFRFIEAVFNQNNYFVN

SEQ ID NO: 3180667 - protein, 27 aa, Giardia lamblia
TMPLPGFRWPLAVAFLPCLADFHSLKH

SEQ ID NO: 3180668 - protein, 23 aa, Giardia lamblia
TNFPWKLDGPILRRFTNRVYIGL

SEQ ID NO: 3180669 - protein, 17 aa, Giardia lamblia
TNLARFCRDLLASLSSP

SEQ ID NO: 3180670 - protein, 18 aa, Giardia lamblia
TNVREIYEILGIEAARAL

SEQ ID NO: 3180671 - protein, 18 aa, Giardia lamblia
TNYWRIWAKTVVQGPVGF

SEQ ID NO: 3180672 - protein, 22 aa, Giardia lamblia
TPAEWEECPGRDHVHNAVEVKF

SEQ ID NO: 3180673 - protein, 17 aa, Giardia lamblia
TPAIFWQHHTDLLDLDK

SEQ ID NO: 3180674 - protein, 23 aa, Giardia lamblia
TPAWPAACGSVWCPGACEEDEGF

SEQ ID NO: 3180675 - protein, 23 aa, Giardia lamblia
TPEEISFIWAFTLIHEVLRYHRD

SEQ ID NO: 3180676 - protein, 25 aa, Giardia lamblia
TPFEACLACTGILHPLPFTRSIDNS

SEQ ID NO: 3180677 - protein, 23 aa, Giardia lamblia
TPGRLRYYLADGLVSLKDLEILI

SEQ ID NO: 3180678 - protein, 18 aa, Giardia lamblia
TPRFGVSSIRGIVGGTIY

SEQ ID NO: 3180679 - protein, 20 aa, Giardia lamblia
TPVELWRLLSPVISALAYLH

SEQ ID NO: 3180680 - protein, 19 aa, Giardia lamblia
TPVLKSWALQILEALNYMH

SEQ ID NO: 3180681 - protein, 17 aa, Giardia lamblia
TQADGWTALMWAASEGQ

SEQ ID NO: 3180682 - protein, 17 aa, Giardia lamblia
TQILKHLFPTGGKSAKR

SEQ ID NO: 3180683 - protein, 23 aa, Giardia lamblia
TQQATICMPEWLKLDRTRTYINN

SEQ ID NO: 3180684 - protein, 18 aa, Giardia lamblia
TQRFKSLLQEAADSNEQL

SEQ ID NO: 3180685 - protein, 18 aa, Giardia lamblia
TRASALPVIRILAEYEAC

SEQ ID NO: 3180686 - protein, 17 aa, Giardia lamblia
TRASVLLELAKQVVAAR

SEQ ID NO: 3180687 - protein, 17 aa, Giardia lamblia
TRFCLACNNISKVIEPV

SEQ ID NO: 3180688 - protein, 17 aa, Giardia lamblia
TRFSPVMSMKGSRTEVF

SEQ ID NO: 3180689 - protein, 20 aa, Giardia lamblia
TRGRTALMIAAAWGKINVVR

SEQ ID NO: 3180690 - protein, 26 aa, Giardia lamblia
TRGYRLVFHTGQFRYLFSDMLLGRPT

SEQ ID NO: 3180691 - protein, 21 aa, Giardia lamblia
TRLFSQLGFVRACHSSAGQTT

SEQ ID NO: 3180692 - protein, 19 aa, Giardia lamblia
TRLKLPHARREPFIETHID

SEQ ID NO: 3180693 - protein, 23 aa, Giardia lamblia
TRLLLCLVCAHLLDATTFGAALA

SEQ ID NO: 3180694 - protein, 20 aa, Giardia lamblia
TRLLPHIGVTPEFHLDKAFF

SEQ ID NO: 3180695 - protein, 22 aa, Giardia lamblia
TRLSLKLGAIRFICCKKDKIRS

SEQ ID NO: 3180696 - protein, 26 aa, Giardia lamblia
TRMLLYTIVCYLRLGKSLHFFQLHRA

SEQ ID NO: 3180697 - protein, 22 aa, Giardia lamblia
TRNEIWARLSIKQEAHGVLMLA

SEQ ID NO: 3180698 - protein, 22 aa, Giardia lamblia
TRNIMLKICFELERTGSYRNLI

SEQ ID NO: 3180699 - protein, 22 aa, Giardia lamblia
TRPFRGLICFSCAAKKEMEAKR

SEQ ID NO: 3180700 - protein, 17 aa, Giardia lamblia
TRPHGWTALMDAASRNL

SEQ ID NO: 3180701 - protein, 20 aa, Giardia lamblia
TRRALLRVFSRRAAETAATA

SEQ ID NO: 3180702 - protein, 19 aa, Giardia lamblia
TRSALWLHKLISAITSDRY

SEQ ID NO: 3180703 - protein, 21 aa, Giardia lamblia
TRYCATCKILSLMPLDYETFV

SEQ ID NO: 3180704 - protein, 17 aa, Giardia lamblia
TRYSINLWKTFKRCFDA

SEQ ID NO: 3180705 - protein, 19 aa, Giardia lamblia
TSCCPLCTQFARNGVTVEQ

SEQ ID NO: 3180706 - protein, 21 aa, Giardia lamblia
TSFDCFIRFILLADYRMAHAF

SEQ ID NO: 3180707 - protein, 23 aa, Giardia lamblia
TSFSDLILLLAIRLKSPSPDSTF

SEQ ID NO: 3180708 - protein, 21 aa, Giardia lamblia
TSINLPELWSLDASLYDILAY

SEQ ID NO: 3180709 - protein, 21 aa, Giardia lamblia
TSIRAEVQWVFTAMASHFPGD

SEQ ID NO: 3180710 - protein, 22 aa, Giardia lamblia
TSKYFLCPLIESMLAGDSWFSE

SEQ ID NO: 3180711 - protein, 17 aa, Giardia lamblia
TSLCALGDVIAALSRKK

SEQ ID NO: 3180712 - protein, 25 aa, Giardia lamblia
TSLFKAKLLPALARYVVANAYFNGN

SEQ ID NO: 3180713 - protein, 17 aa, Giardia lamblia
TSLLRTIAALKHETDAF

SEQ ID NO: 3180714 - protein, 18 aa, Giardia lamblia
TSQVYKEFIQMKVRHDIL

SEQ ID NO: 3180715 - protein, 19 aa, Giardia lamblia
TSQYMCCCCKCTRPEVDMQ

SEQ ID NO: 3180716 - protein, 19 aa, Giardia lamblia
TSRFLRFCSYIGGTFTEAS

SEQ ID NO: 3180717 - protein, 23 aa, Giardia lamblia
TTERKSRCAVLYKNKKFYLIHNK

SEQ ID NO: 3180718 - protein, 25 aa, Giardia lamblia
TTFVERRFGFSVPRQYPGARGALDV

SEQ ID NO: 3180719 - protein, 21 aa, Giardia lamblia
TTGLCKAAAAGDLEMVKILFE

SEQ ID NO: 3180720 - protein, 22 aa, Giardia lamblia
TTNFRGGMKLKKWVQADLCNNG

SEQ ID NO: 3180721 - protein, 22 aa, Giardia lamblia
TTQPCPHMAWEMHAGVTSGGKS

SEQ ID NO: 3180722 - protein, 23 aa, Giardia lamblia
TTTGRTALFWALLNGYDACAEIL

SEQ ID NO: 3180723 - protein, 18 aa, Giardia lamblia
TVAFYFIKYLRRMHLSKK

SEQ ID NO: 3180724 - protein, 17 aa, Giardia lamblia
TVCDIWRTYRRVISHNE

SEQ ID NO: 3180725 - protein, 30 aa, Giardia lamblia
TVELKFSIPGGYCFAELGLVAIPCKPSKVD

SEQ ID NO: 3180726 - protein, 22 aa, Giardia lamblia
TVPHLPPPLAIPPGFRGKTSEV

SEQ ID NO: 3180727 - protein, 21 aa, Giardia lamblia
TVRAQHSFSMFMVPSTDNAIM

SEQ ID NO: 3180728 - protein, 21 aa, Giardia lamblia
TVRPDSKCFFELYRNVSTDAG

SEQ ID NO: 3180729 - protein, 19 aa, Giardia lamblia
TVRPFLRKIFEAIGDIELE

SEQ ID NO: 3180730 - protein, 18 aa, Giardia lamblia
TVRPSVCKDAEVITYTRQ

SEQ ID NO: 3180731 - protein, 20 aa, Giardia lamblia
TVYHCMACSYFITQQADSDK

SEQ ID NO: 3180732 - protein, 21 aa, Giardia lamblia
TWCPPCRAMIPHLSKMAKKYK

SEQ ID NO: 3180733 - protein, 20 aa, Giardia lamblia
TWCPPCRGMIPHLAELPTKY

SEQ ID NO: 3180734 - protein, 25 aa, Giardia lamblia
TYAFILKIAFLFSGGMTKVQQEKDK

SEQ ID NO: 3180735 - protein, 23 aa, Giardia lamblia
TYCKTCHSRGRLRSVPLDTLLAR

SEQ ID NO: 3180736 - protein, 23 aa, Giardia lamblia
TYFRPNYFIGLSFLKDNESLLTS

SEQ ID NO: 3180737 - protein, 18 aa, Giardia lamblia
TYIDGVKEFPIWCYLGEE

SEQ ID NO: 3180738 - protein, 20 aa, Giardia lamblia
TYKDLLCLLNEKMKRVDQLN

SEQ ID NO: 3180739 - protein, 20 aa, Giardia lamblia
TYKSEIRTVLALKDGSIFPG

SEQ ID NO: 3180740 - protein, 22 aa, Giardia lamblia
TYLEVFFFFALAWGVGSNIATE

SEQ ID NO: 3180741 - protein, 18 aa, Giardia lamblia
TYLPYWSEQVFKLPEPGS

SEQ ID NO: 3180742 - protein, 24 aa, Giardia lamblia
TYPNKVLCLLSWFFDCSKYSHIQQ

SEQ ID NO: 3180743 - protein, 19 aa, Giardia lamblia
VAARCLRDKIIVVTARTFF

SEQ ID NO: 3180744 - protein, 17 aa, Giardia lamblia
VADFCLSRPITADEEEV

SEQ ID NO: 3180745 - protein, 17 aa, Giardia lamblia
VAEPGLKRDVAHGSYSS

SEQ ID NO: 3180746 - protein, 17 aa, Giardia lamblia
VAESFGFDADLRAATSG

SEQ ID NO: 3180747 - protein, 28 aa, Giardia lamblia
VAFLKYPSCTVGLFLRVEFTHQMDAIFA

SEQ ID NO: 3180748 - protein, 17 aa, Giardia lamblia
VAGCSRITMPLATVCKY

SEQ ID NO: 3180749 - protein, 17 aa, Giardia lamblia
VAGGWVRDKLLGYESHD

SEQ ID NO: 3180750 - protein, 23 aa, Giardia lamblia
VAICKHLDFLIANCLYKDINIID

SEQ ID NO: 3180751 - protein, 20 aa, Giardia lamblia
VALACEHCLIGVSMRNASII

SEQ ID NO: 3180752 - protein, 23 aa, Giardia lamblia
VALKAVGISGVFNHLVLREVTLL

SEQ ID NO: 3180753 - protein, 19 aa, Giardia lamblia
VALRNAKISLVWRESNDVT

SEQ ID NO: 3180754 - protein, 24 aa, Giardia lamblia
VALRPGEKVKLWGTLMPIPVVDTI

SEQ ID NO: 3180755 - protein, 22 aa, Giardia lamblia
VAMPPVLDFRSFDTGFPDFSSR

SEQ ID NO: 3180756 - protein, 18 aa, Giardia lamblia
VAPPNWRNTGLNEDLEAF

SEQ ID NO: 3180757 - protein, 24 aa, Giardia lamblia
VASIGVGCSLVWMHFGYMRPFNLD

SEQ ID NO: 3180758 - protein, 20 aa, Giardia lamblia
VASYLLRLALCLGSEDNVTI

SEQ ID NO: 3180759 - protein, 20 aa, Giardia lamblia
VAVFRNNYLLLFGGVDAGKL

SEQ ID NO: 3180760 - protein, 19 aa, Giardia lamblia
VAVPLKLSAFFPSLEFRSC

SEQ ID NO: 3180761 - protein, 22 aa, Giardia lamblia
VAWILLRLHPGLSFLAETPQFQ

SEQ ID NO: 3180762 - protein, 18 aa, Giardia lamblia
VCAFCFDKVKGGQCPHCR

SEQ ID NO: 3180763 - protein, 18 aa, Giardia lamblia
VCDSGWKFHELRMEMMKH

SEQ ID NO: 3180764 - protein, 19 aa, Giardia lamblia
VCELLIERECCYVLRDGTT

SEQ ID NO: 3180765 - protein, 17 aa, Giardia lamblia
VCKVLLPAIGARDDYMM

SEQ ID NO: 3180766 - protein, 17 aa, Giardia lamblia
VCLPFSIIVLIPITVNS

SEQ ID NO: 3180767 - protein, 22 aa, Giardia lamblia
VCLPGSCVLKLKQPRDSRGSCA

SEQ ID NO: 3180768 - protein, 21 aa, Giardia lamblia
VCLQNCHLCLSWMPNLARFVE

SEQ ID NO: 3180769 - protein, 24 aa, Giardia lamblia
VCPEMGPAELISSVLQAPRFEEAL

SEQ ID NO: 3180770 - protein, 18 aa, Giardia lamblia
VCPQWPFVTLDKSYVATF

SEQ ID NO: 3180771 - protein, 23 aa, Giardia lamblia
VCSKCLRIAVLVLTPREGEGATL

SEQ ID NO: 3180772 - protein, 19 aa, Giardia lamblia
VDAGRPLWTYVRMLDRMRS

SEQ ID NO: 3180773 - protein, 20 aa, Giardia lamblia
VDCLDYRAGYAPVLYNDEDN

SEQ ID NO: 3180774 - protein, 21 aa, Giardia lamblia
VDDCGRTALMYAAANNSIDAV

SEQ ID NO: 3180775 - protein, 21 aa, Giardia lamblia
VDELRTSFQQHWDKLENGTPA

SEQ ID NO: 3180776 - protein, 17 aa, Giardia lamblia
VDHGRRSWVHWNEVLPR

SEQ ID NO: 3180777 - protein, 18 aa, Giardia lamblia
VDHYGWFALLYAIDGACI

SEQ ID NO: 3180778 - protein, 17 aa, Giardia lamblia
VDIELPPASSLVNFPPA

SEQ ID NO: 3180779 - protein, 17 aa, Giardia lamblia
VDILLDWDSKSSTSAPT

SEQ ID NO: 3180780 - protein, 17 aa, Giardia lamblia
VDILRLLLCESRNTNLI

SEQ ID NO: 3180781 - protein, 20 aa, Giardia lamblia
VDKHIGICISGIYADAYKML

SEQ ID NO: 3180782 - protein, 17 aa, Giardia lamblia
VDKNGLTALDWAINCHK

SEQ ID NO: 3180783 - protein, 18 aa, Giardia lamblia
VDLGRPFLGFALALSSGA

SEQ ID NO: 3180784 - protein, 18 aa, Giardia lamblia
VDPAFWVTYFSKVTFPIK

SEQ ID NO: 3180785 - protein, 18 aa, Giardia lamblia
VDPKEIIDGLAMLAQKRL

SEQ ID NO: 3180786 - protein, 19 aa, Giardia lamblia
VDPMYRPSILELLLEPQIN

SEQ ID NO: 3180787 - protein, 20 aa, Giardia lamblia
VDRWGRTALMYAARAGHSEI

SEQ ID NO: 3180788 - protein, 17 aa, Giardia lamblia
VDSAGKIIGLFKNQPPA

SEQ ID NO: 3180789 - protein, 19 aa, Giardia lamblia
VDSTLPYRVLHGLSAWISD

SEQ ID NO: 3180790 - protein, 25 aa, Giardia lamblia
VDVWDFLKRFRIHYCTLYDQGYTSL

SEQ ID NO: 3180791 - protein, 19 aa, Giardia lamblia
VEAYARILCGMFSVRGADS

SEQ ID NO: 3180792 - protein, 20 aa, Giardia lamblia
VECVRLLASKEICIVNSAGH

SEQ ID NO: 3180793 - protein, 18 aa, Giardia lamblia
VEIGRWFICKGTALMRAA

SEQ ID NO: 3180794 - protein, 21 aa, Giardia lamblia
VEIYEPCVLCLSKMVQYNNQA

SEQ ID NO: 3180795 - protein, 18 aa, Giardia lamblia
VEKLWAIALLITDVVTSN

SEQ ID NO: 3180796 - protein, 21 aa, Giardia lamblia
VEKSCKFIPTLILRGNPFGAF

SEQ ID NO: 3180797 - protein, 17 aa, Giardia lamblia
VELEARAGSLLHDLKLT

SEQ ID NO: 3180798 - protein, 17 aa, Giardia lamblia
VELLLPYEYLIKTGDQK

SEQ ID NO: 3180799 - protein, 19 aa, Giardia lamblia
VELRPAWAQTIDFSKAAYD

SEQ ID NO: 3180800 - protein, 20 aa, Giardia lamblia
VELVKILGFFENGMVNGEGK

SEQ ID NO: 3180801 - protein, 19 aa, Giardia lamblia
VEPEAGMTMLSEWRGATAL

SEQ ID NO: 3180802 - protein, 24 aa, Giardia lamblia
VEQDCWQCFKTMYEYEARAVIGTR

SEQ ID NO: 3180803 - protein, 22 aa, Giardia lamblia
VERLKFVIVLGATNFPEAIDQA

SEQ ID NO: 3180804 - protein, 22 aa, Giardia lamblia
VESIWKCPYCRALIENMFVLQE

SEQ ID NO: 3180805 - protein, 19 aa, Giardia lamblia
VESLVGFNMFPGCEHVETV

SEQ ID NO: 3180806 - protein, 18 aa, Giardia lamblia
VETVLPFYNVVKGIVSEI

SEQ ID NO: 3180807 - protein, 27 aa, Giardia lamblia
VEVCLLKEIMCLRAIVVGYLEYTDTWH

SEQ ID NO: 3180808 - protein, 23 aa, Giardia lamblia
VEVDPGRCYRLKPFDEMQDVINS

SEQ ID NO: 3180809 - protein, 23 aa, Giardia lamblia
VFCAEALPLFCRAFTFRKRVKSL

SEQ ID NO: 3180810 - protein, 18 aa, Giardia lamblia
VFCDLCLTISNAMTFNKS

SEQ ID NO: 3180811 - protein, 18 aa, Giardia lamblia
VFDLRPALRYGEGLSLTQ

SEQ ID NO: 3180812 - protein, 20 aa, Giardia lamblia
VFELLVSFMGIRPCTGIHKS

SEQ ID NO: 3180813 - protein, 20 aa, Giardia lamblia
VFHPKRPWVIFSCQNGVVEL

SEQ ID NO: 3180814 - protein, 20 aa, Giardia lamblia
VFKYKSGYLRKAIQLRESED

SEQ ID NO: 3180815 - protein, 24 aa, Giardia lamblia
VFLYLCINCGIRALKITGLGHNGP

SEQ ID NO: 3180816 - protein, 18 aa, Giardia lamblia
VFNGLSLTLLDVFDMINN

SEQ ID NO: 3180817 - protein, 23 aa, Giardia lamblia
VFPLPRRRFSVTLMQAGKEVCAL

SEQ ID NO: 3180818 - protein, 24 aa, Giardia lamblia
VFPVCTNCGVLARNRCSRCHNVWY

SEQ ID NO: 3180819 - protein, 25 aa, Giardia lamblia
VFTLKGWRLRELRLFKNPKTQTSVL

SEQ ID NO: 3180820 - protein, 17 aa, Giardia lamblia
VFTLLALPIVKDKLKFF

SEQ ID NO: 3180821 - protein, 18 aa, Giardia lamblia
VGCAILFIDEIDCIAGNR

SEQ ID NO: 3180822 - protein, 27 aa, Giardia lamblia
VGCLRCLRILLEYGQCFEMSEFDEALA

SEQ ID NO: 3180823 - protein, 17 aa, Giardia lamblia
VGCNNIGTEGCMALAEI

SEQ ID NO: 3180824 - protein, 17 aa, Giardia lamblia
VGDRLLLSGYFRDDPPN

SEQ ID NO: 3180825 - protein, 20 aa, Giardia lamblia
VGFTSGFKWKDFVTDLESVL

SEQ ID NO: 3180826 - protein, 17 aa, Giardia lamblia
VGFVIREKCHWMVQCFV

SEQ ID NO: 3180827 - protein, 20 aa, Giardia lamblia
VGFVRVRLFRPFSIELFSNA

SEQ ID NO: 3180828 - protein, 18 aa, Giardia lamblia
VGLIPRFIVQLFDALASI

SEQ ID NO: 3180829 - protein, 22 aa, Giardia lamblia
VGNWSFPCLIIHGACDNIVPVH

SEQ ID NO: 3180830 - protein, 23 aa, Giardia lamblia
VGYSLECPPFYTAFFEMDVIKAT

SEQ ID NO: 3180831 - protein, 20 aa, Giardia lamblia
VHAFIPLKLLPGFDFVTAIN

SEQ ID NO: 3180832 - protein, 19 aa, Giardia lamblia
VHAILPRLDSALFIVNSLC

SEQ ID NO: 3180833 - protein, 17 aa, Giardia lamblia
VHCCFGALVAMNINVDE

SEQ ID NO: 3180834 - protein, 19 aa, Giardia lamblia
VHFILKRARWQDIIILGRL

SEQ ID NO: 3180835 - protein, 21 aa, Giardia lamblia
VHLCMMERLLGPMPDTVIEQM

SEQ ID NO: 3180836 - protein, 18 aa, Giardia lamblia
VHVTDLYLAQGLQALAPN

SEQ ID NO: 3180837 - protein, 18 aa, Giardia lamblia
VHYPRLLLVVKRFFTGVY

SEQ ID NO: 3180838 - protein, 18 aa, Giardia lamblia
VIAFSWAAGQTFQEILDI

SEQ ID NO: 3180839 - protein, 18 aa, Giardia lamblia
VICLPTIHRYNSPQLLSS

SEQ ID NO: 3180840 - protein, 23 aa, Giardia lamblia
VIGSWPRPSPLFFAAISGNTYIL

SEQ ID NO: 3180841 - protein, 23 aa, Giardia lamblia
VILPFKFPQLFQGKREPWRGILL

SEQ ID NO: 3180842 - protein, 17 aa, Giardia lamblia
VILPRRYPHLFEGGNGQ

SEQ ID NO: 3180843 - protein, 21 aa, Giardia lamblia
VIMECRVMRALKKLLAEKGSA

SEQ ID NO: 3180844 - protein, 17 aa, Giardia lamblia
VIPGFGFPPSARGQPKI

SEQ ID NO: 3180845 - protein, 17 aa, Giardia lamblia
VIRCAKGIHGTEGSTMG

SEQ ID NO: 3180846 - protein, 18 aa, Giardia lamblia
VITATCFALGTGAEGDPE

SEQ ID NO: 3180847 - protein, 20 aa, Giardia lamblia
VITMPGCFICPSHSMHYSNA

SEQ ID NO: 3180848 - protein, 19 aa, Giardia lamblia
VKAFMYAQVWGILHHRELN

SEQ ID NO: 3180849 - protein, 21 aa, Giardia lamblia
VKAHLPVAESFGFDADLRAAT

SEQ ID NO: 3180850 - protein, 32 aa, Giardia lamblia
VKCKIVDLSEGWFPDILTRLVLDSVTPSLHTV

SEQ ID NO: 3180851 - protein, 19 aa, Giardia lamblia
VKDGRGWTALMYSCHFKME

SEQ ID NO: 3180852 - protein, 26 aa, Giardia lamblia
VKFGAYYKRKGWRVGLVCCDTFRTGA

SEQ ID NO: 3180853 - protein, 18 aa, Giardia lamblia
VKGLMCGQGKLFLVNGAI

SEQ ID NO: 3180854 - protein, 17 aa, Giardia lamblia
VKIGRWVIRDGTALMIA

SEQ ID NO: 3180855 - protein, 21 aa, Giardia lamblia
VKKRCLPTYNYVELLKSQRTL

SEQ ID NO: 3180856 - protein, 17 aa, Giardia lamblia
VKLIDFGICKELVDCSV

SEQ ID NO: 3180857 - protein, 17 aa, Giardia lamblia
VKLLAPREGDLYAEDAL

SEQ ID NO: 3180858 - protein, 17 aa, Giardia lamblia
VKLLLKKEGRMQTNSGE

SEQ ID NO: 3180859 - protein, 17 aa, Giardia lamblia
VKLLLKREKNVGGMSAL

SEQ ID NO: 3180860 - protein, 17 aa, Giardia lamblia
VKLLMAHEAGMSKTSGY

SEQ ID NO: 3180861 - protein, 20 aa, Giardia lamblia
VKLLYRYECGLLYVDKETQE

SEQ ID NO: 3180862 - protein, 17 aa, Giardia lamblia
VKLWAEKEFRNLIRTQQ

SEQ ID NO: 3180863 - protein, 18 aa, Giardia lamblia
VKNIVCFVFSESRDKLIV

SEQ ID NO: 3180864 - protein, 23 aa, Giardia lamblia
VKNRPHYHPSWRGPEDVQQEVAS

SEQ ID NO: 3180865 - protein, 25 aa, Giardia lamblia
VKPRPGEPVALFGFGYLRSGLQRPE

SEQ ID NO: 3180866 - protein, 21 aa, Giardia lamblia
VKRYIHYQARMVARFVTAGMV

SEQ ID NO: 3180867 - protein, 17 aa, Giardia lamblia
VKTLECFQSEWLEVNAQ

SEQ ID NO: 3180868 - protein, 19 aa, Giardia lamblia
VKVDSIWFTLFANYLEGKN

SEQ ID NO: 3180869 - protein, 19 aa, Giardia lamblia
VKVLYKYLYLREALTAAIM

SEQ ID NO: 3180870 - protein, 17 aa, Giardia lamblia
VKVRQAATVMAKYHDWS

SEQ ID NO: 3180871 - protein, 23 aa, Giardia lamblia
VLACLKKRWAWVLEAIHRSIKED

SEQ ID NO: 3180872 - protein, 17 aa, Giardia lamblia
VLCKWPIMQHFWFGNII

SEQ ID NO: 3180873 - protein, 20 aa, Giardia lamblia
VLHPRISAAFKCLQDNNFVV

SEQ ID NO: 3180874 - protein, 23 aa, Giardia lamblia
VLKACLYGDLGLYHWLNNDLLSA

SEQ ID NO: 3180875 - protein, 17 aa, Giardia lamblia
VLKHIWPKVCGYLNDLF

SEQ ID NO: 3180876 - protein, 23 aa, Giardia lamblia
VLKREDEALWALVYPHLNRDDVN

SEQ ID NO: 3180877 - protein, 19 aa, Giardia lamblia
VLKTYSLSVLDDFVVAVRE

SEQ ID NO: 3180878 - protein, 23 aa, Giardia lamblia
VLLPGEMKPVLTVGSSRFANPSL

SEQ ID NO: 3180879 - protein, 17 aa, Giardia lamblia
VLNKLCAVTTFPDHNVG

SEQ ID NO: 3180880 - protein, 17 aa, Giardia lamblia
VLPDGRTPLMLAAAAGA

SEQ ID NO: 3180881 - protein, 23 aa, Giardia lamblia
VLPEDWTRFLIAEIILGLEGLHS

SEQ ID NO: 3180882 - protein, 19 aa, Giardia lamblia
VLPKSAKRWAIQRNGEGKR

SEQ ID NO: 3180883 - protein, 22 aa, Giardia lamblia
VLPRARMEAVTFDFVDVPVVER

SEQ ID NO: 3180884 - protein, 18 aa, Giardia lamblia
VLRGMSAVCCEFCPADER

SEQ ID NO: 3180885 - protein, 18 aa, Giardia lamblia
VLRTNLWARFSFTESADE

SEQ ID NO: 3180886 - protein, 21 aa, Giardia lamblia
VLSLDVCFCFSPGLDAGNTFL

SEQ ID NO: 3180887 - protein, 17 aa, Giardia lamblia
VLSRIGAKYGNSRIAAS

SEQ ID NO: 3180888 - protein, 18 aa, Giardia lamblia
VLVRRFFVVPAFEIYGGV

SEQ ID NO: 3180889 - protein, 18 aa, Giardia lamblia
VMALKMKFLKTVTAEVSN

SEQ ID NO: 3180890 - protein, 17 aa, Giardia lamblia
VMLGFRSDPLLTVYYYL

SEQ ID NO: 3180891 - protein, 19 aa, Giardia lamblia
VMLLRCLRLLQTAINTLGA

SEQ ID NO: 3180892 - protein, 21 aa, Giardia lamblia
VNCYGILWIGRLCELEPFRPN

SEQ ID NO: 3180893 - protein, 17 aa, Giardia lamblia
VNGRTALMLALQNKNFM

SEQ ID NO: 3180894 - protein, 20 aa, Giardia lamblia
VNGRTALMWAAYRGNSMLVR

SEQ ID NO: 3180895 - protein, 19 aa, Giardia lamblia
VNIHRWRSLEGSDPAAYEL

SEQ ID NO: 3180896 - protein, 19 aa, Giardia lamblia
VNMLFRCHVCGKVFADYHF

SEQ ID NO: 3180897 - protein, 19 aa, Giardia lamblia
VNPMLGFRGVRLGIVYPEI

SEQ ID NO: 3180898 - protein, 20 aa, Giardia lamblia
VNSPCPKSSFGVRSQQRDTV

SEQ ID NO: 3180899 - protein, 19 aa, Giardia lamblia
VNVYEFFESIQLIYSTCEK

SEQ ID NO: 3180900 - protein, 18 aa, Giardia lamblia
VNYEIIAVSCTWPGEKIK

SEQ ID NO: 3180901 - protein, 23 aa, Giardia lamblia
VPARAAVVAGKWARRETAPVSVF

SEQ ID NO: 3180902 - protein, 19 aa, Giardia lamblia
VPEPVPLVHRGPLTFAAEL

SEQ ID NO: 3180903 - protein, 24 aa, Giardia lamblia
VPETCKVRYPRLPIPSGDVGETDS

SEQ ID NO: 3180904 - protein, 17 aa, Giardia lamblia
VPFLDCRLLQMVAENLD

SEQ ID NO: 3180905 - protein, 22 aa, Giardia lamblia
VPFPPRTGHVWVLDIGCGTGSL

SEQ ID NO: 3180906 - protein, 19 aa, Giardia lamblia
VPGCGKTSIATALAQELSV

SEQ ID NO: 3180907 - protein, 17 aa, Giardia lamblia
VPGPFLIVVPISTLSAW

SEQ ID NO: 3180908 - protein, 24 aa, Giardia lamblia
VPHLDCFRWVRRDSYLPQGSQGLK

SEQ ID NO: 3180909 - protein, 17 aa, Giardia lamblia
VPISARFGWLVINLKPA

SEQ ID NO: 3180910 - protein, 24 aa, Giardia lamblia
VPKVKFPVCRNLVFNKIDRKMSIA

SEQ ID NO: 3180911 - protein, 20 aa, Giardia lamblia
VPMNRIRVLRGYYYDEGKNF

SEQ ID NO: 3180912 - protein, 21 aa, Giardia lamblia
VPMNRIRVLRGYYYDEGKNTN

SEQ ID NO: 3180913 - protein, 18 aa, Giardia lamblia
VPPLDDWNTVAGIRLAVL

SEQ ID NO: 3180914 - protein, 21 aa, Giardia lamblia
VPQPRPAGFVSPASTSLRPEV

SEQ ID NO: 3180915 - protein, 17 aa, Giardia lamblia
VPSKICFDYNFGSSGLL

SEQ ID NO: 3180916 - protein, 17 aa, Giardia lamblia
VPSMRYLLGLSEESESQ

SEQ ID NO: 3180917 - protein, 20 aa, Giardia lamblia
VPSRCLFYIRNLGYKHNVKL

SEQ ID NO: 3180918 - protein, 22 aa, Giardia lamblia
VPTYLKRLLKSLAELVGALRLL

SEQ ID NO: 3180919 - protein, 22 aa, Giardia lamblia
VQACLRCILALLQQNDNKSLLG

SEQ ID NO: 3180920 - protein, 17 aa, Giardia lamblia
VQALIPREAGLTMDDGW

SEQ ID NO: 3180921 - protein, 17 aa, Giardia lamblia
VQGCFAAFMKRNGITLL

SEQ ID NO: 3180922 - protein, 20 aa, Giardia lamblia
VQGMCVGPLLSFVGSSTSPE

SEQ ID NO: 3180923 - protein, 22 aa, Giardia lamblia
VQKRLMALQVRFEEDVFVSIPA

SEQ ID NO: 3180924 - protein, 17 aa, Giardia lamblia
VQLPIFFPHIQKYFHPD

SEQ ID NO: 3180925 - protein, 17 aa, Giardia lamblia
VQLVNLWYQLPPSKNPI

SEQ ID NO: 3180926 - protein, 18 aa, Giardia lamblia
VQMLLEFGCDPLMADDEG

SEQ ID NO: 3180927 - protein, 21 aa, Giardia lamblia
VQSGLKFGKIIGADGKKVEVQ

SEQ ID NO: 3180928 - protein, 23 aa, Giardia lamblia
VRALELYAKFQFKVIPVVNAEGS

SEQ ID NO: 3180929 - protein, 22 aa, Giardia lamblia
VRALEVLQSLGLVSFSNGIVRL

SEQ ID NO: 3180930 - protein, 21 aa, Giardia lamblia
VRCDLFWRRGRKLEIEGRLKE

SEQ ID NO: 3180931 - protein, 25 aa, Giardia lamblia
VRDCEGRTALDWAVAAGQVDAVRVL

SEQ ID NO: 3180932 - protein, 17 aa, Giardia lamblia
VRDLRLGTDPALAQYSD

SEQ ID NO: 3180933 - protein, 24 aa, Giardia lamblia
VRENGLRYTIAFNLGFLNANISNK

SEQ ID NO: 3180934 - protein, 20 aa, Giardia lamblia
VRHGYPLKGLIVLATGLGKT

SEQ ID NO: 3180935 - protein, 20 aa, Giardia lamblia
VRHIPRIVQQDVFFSAMSSF

SEQ ID NO: 3180936 - protein, 17 aa, Giardia lamblia
VRHPCRLRCGHLVCRSC

SEQ ID NO: 3180937 - protein, 20 aa, Giardia lamblia
VRIRRLLLMEAYEVYASLLA

SEQ ID NO: 3180938 - protein, 20 aa, Giardia lamblia
VRLIPCFRDGVPAGATIYIY

SEQ ID NO: 3180939 - protein, 17 aa, Giardia lamblia
VRLLAPLEQRMRRVDGT

SEQ ID NO: 3180940 - protein, 17 aa, Giardia lamblia
VRLLHHISRRVYKYDWF

SEQ ID NO: 3180941 - protein, 17 aa, Giardia lamblia
VRLSLKLGLLSLGSGVV

SEQ ID NO: 3180942 - protein, 18 aa, Giardia lamblia
VRRLPISRVRAICRTVPT

SEQ ID NO: 3180943 - protein, 18 aa, Giardia lamblia
VRVHRPAFRFSLWSRPSC

SEQ ID NO: 3180944 - protein, 21 aa, Giardia lamblia
VRVSSGFTFRVENYVEAEAVE

SEQ ID NO: 3180945 - protein, 18 aa, Giardia lamblia
VRVSTVLRLFGRKPSSHR

SEQ ID NO: 3180946 - protein, 19 aa, Giardia lamblia
VSASDRFSSYYSFLYNNDL

SEQ ID NO: 3180947 - protein, 23 aa, Giardia lamblia
VSCCIKIRFGHETGRETELMEFA

SEQ ID NO: 3180948 - protein, 22 aa, Giardia lamblia
VSESDMIRWNIARARAMVGARE

SEQ ID NO: 3180949 - protein, 17 aa, Giardia lamblia
VSGETALMLAIRHQNVD

SEQ ID NO: 3180950 - protein, 20 aa, Giardia lamblia
VSGFREAIRFGILSEKEEES

SEQ ID NO: 3180951 - protein, 19 aa, Giardia lamblia
VSGLFEFSDALKFSIQRRS

SEQ ID NO: 3180952 - protein, 17 aa, Giardia lamblia
VSGWPRRRIAISSTANF

SEQ ID NO: 3180953 - protein, 25 aa, Giardia lamblia
VSHCPRCGRVLKPRIVFFGEQLPSE

SEQ ID NO: 3180954 - protein, 17 aa, Giardia lamblia
VSHLIVFQSYQFSGDNL

SEQ ID NO: 3180955 - protein, 18 aa, Giardia lamblia
VSILEFRKQAALERQEDH

SEQ ID NO: 3180956 - protein, 18 aa, Giardia lamblia
VSILNCYEDMQLIDMFLL

SEQ ID NO: 3180957 - protein, 20 aa, Giardia lamblia
VSISAAMARRAFEKQANDRA

SEQ ID NO: 3180958 - protein, 20 aa, Giardia lamblia
VSKFLMREGENFTLGKDIFL

SEQ ID NO: 3180959 - protein, 24 aa, Giardia lamblia
VSLCLRLPLEVGLEGFLGAQGSHS

SEQ ID NO: 3180960 - protein, 18 aa, Giardia lamblia
VSLIKDFKFPIALSPALL

SEQ ID NO: 3180961 - protein, 18 aa, Giardia lamblia
VSLPPCIQADALFRRSRH

SEQ ID NO: 3180962 - protein, 17 aa, Giardia lamblia
VSLYYKHWLYFSNTGKL

SEQ ID NO: 3180963 - protein, 19 aa, Giardia lamblia
VSMLMGWFWSYHIPYQRIK

SEQ ID NO: 3180964 - protein, 18 aa, Giardia lamblia
VSQLKALRFEYLTKEQLR

SEQ ID NO: 3180965 - protein, 18 aa, Giardia lamblia
VSSVPLLLEKEAGIKDSS

SEQ ID NO: 3180966 - protein, 18 aa, Giardia lamblia
VSTAIYLRRMRQMIDNDS

SEQ ID NO: 3180967 - protein, 23 aa, Giardia lamblia
VSTPRGSHHFRIPGAPVTPEVDG

SEQ ID NO: 3180968 - protein, 18 aa, Giardia lamblia
VSYFRLNKITGMYEVSAS

SEQ ID NO: 3180969 - protein, 25 aa, Giardia lamblia
VSYPMRPSPKWSFRSSDYPTDNKVI

SEQ ID NO: 3180970 - protein, 20 aa, Giardia lamblia
VTAEWGWTATMSKIMKHQAL

SEQ ID NO: 3180971 - protein, 25 aa, Giardia lamblia
VTALLCLKLCFPDRVFLLRGNHETV

SEQ ID NO: 3180972 - protein, 17 aa, Giardia lamblia
VTAPRLFTSIGLKHIFY

SEQ ID NO: 3180973 - protein, 21 aa, Giardia lamblia
VTARPGAIPKLVHARYQEKPR

SEQ ID NO: 3180974 - protein, 23 aa, Giardia lamblia
VTEESRPRLAIAVRQLADLQIIS

SEQ ID NO: 3180975 - protein, 20 aa, Giardia lamblia
VTFPELWLGGHLIRQRTEVS

SEQ ID NO: 3180976 - protein, 17 aa, Giardia lamblia
VTGEPWTGLSFAVASGN

SEQ ID NO: 3180977 - protein, 17 aa, Giardia lamblia
VTLYDIWGRDLSNEQRD

SEQ ID NO: 3180978 - protein, 21 aa, Giardia lamblia
VTNFFLCTSFPPSTKSTPQFE

SEQ ID NO: 3180979 - protein, 20 aa, Giardia lamblia
VTNLVCEVCSLIATHGRDSA

SEQ ID NO: 3180980 - protein, 18 aa, Giardia lamblia
VTRSFCWGILPGIGVYSP

SEQ ID NO: 3180981 - protein, 18 aa, Giardia lamblia
VTSLEFAKIAPFYIYYSL

SEQ ID NO: 3180982 - protein, 19 aa, Giardia lamblia
VTSPTRWGGCPASRTPSYD

SEQ ID NO: 3180983 - protein, 17 aa, Giardia lamblia
VTSVIPIACFQRLVRDI

SEQ ID NO: 3180984 - protein, 20 aa, Giardia lamblia
VVCKALRLFDSRLLLSALQS

SEQ ID NO: 3180985 - protein, 20 aa, Giardia lamblia
VVDLISIIACHRVVDVFYPG

SEQ ID NO: 3180986 - protein, 19 aa, Giardia lamblia
VVEGFKACGVGLWNRGGNK

SEQ ID NO: 3180987 - protein, 21 aa, Giardia lamblia
VVFRLKVVFIANLTRFIDDER

SEQ ID NO: 3180988 - protein, 17 aa, Giardia lamblia
VVHISAFLFEETAPGSG

SEQ ID NO: 3180989 - protein, 20 aa, Giardia lamblia
VVKICFNWVRDPKICDSMID

SEQ ID NO: 3180990 - protein, 19 aa, Giardia lamblia
VVKNLEWIPATSFQNNEAF

SEQ ID NO: 3180991 - protein, 24 aa, Giardia lamblia
VVNFKRIEAMLGIRMEPYTPDFSE

SEQ ID NO: 3180992 - protein, 23 aa, Giardia lamblia
VVSCLRAAGVFPRRTKELEIEAL

SEQ ID NO: 3180993 - protein, 17 aa, Giardia lamblia
VVVPPRYLAESLSAPYH

SEQ ID NO: 3180994 - protein, 24 aa, Giardia lamblia
VWCLGRIAFELCCVGFPGFVGSGC

SEQ ID NO: 3180995 - protein, 18 aa, Giardia lamblia
VWDTEWKDRELLVDETLT

SEQ ID NO: 3180996 - protein, 18 aa, Giardia lamblia
VWFGKSIIFSYARLDYSA

SEQ ID NO: 3180997 - protein, 17 aa, Giardia lamblia
VWNWCQYERNIAKQQYD

SEQ ID NO: 3180998 - protein, 18 aa, Giardia lamblia
VWPDVKWWYDVYDRLREK

SEQ ID NO: 3180999 - protein, 22 aa, Giardia lamblia
VYFKQPWMLMNIYLDLQTMCPE

SEQ ID NO: 3181000 - protein, 17 aa, Giardia lamblia
VYLTAAFQFHQSELEAV

SEQ ID NO: 3181001 - protein, 18 aa, Giardia lamblia
VYNRARRVLDHFYTLSTA

SEQ ID NO: 3181002 - protein, 19 aa, Giardia lamblia
VYRYARPALHLSQADDLLV

SEQ ID NO: 3181003 - protein, 22 aa, Giardia lamblia
VYYEITSSFSLLFTGMINNNVV

SEQ ID NO: 3181004 - protein, 18 aa, Giardia lamblia
WAENAVFLSIIGDFNFWD

SEQ ID NO: 3181005 - protein, 20 aa, Giardia lamblia
WAGCPFRLSIRHYKKRPDVY

SEQ ID NO: 3181006 - protein, 17 aa, Giardia lamblia
WAKSLARGVDPFSVPPS

SEQ ID NO: 3181007 - protein, 20 aa, Giardia lamblia
WAVLSVRNFLTAGVQIIVTG

SEQ ID NO: 3181008 - protein, 18 aa, Giardia lamblia
WCERGFLPALDRSECVLP

SEQ ID NO: 3181009 - protein, 18 aa, Giardia lamblia
WCSLLGFSSYEFKHASIA

SEQ ID NO: 3181010 - protein, 17 aa, Giardia lamblia
WCSSSGFTFGSRHRQTT

SEQ ID NO: 3181011 - protein, 23 aa, Giardia lamblia
WCVIHGCSIFDILALEPRNQQSF

SEQ ID NO: 3181012 - protein, 17 aa, Giardia lamblia
WDCFKQKACKDIAHDTE

SEQ ID NO: 3181013 - protein, 17 aa, Giardia lamblia
WDECLAVWFIKQLPDYI

SEQ ID NO: 3181014 - protein, 18 aa, Giardia lamblia
WDICDGLGDIPIWVEAAG

SEQ ID NO: 3181015 - protein, 23 aa, Giardia lamblia
WDIKDRWYAGASALHFAAHGNQK

SEQ ID NO: 3181016 - protein, 17 aa, Giardia lamblia
WDRFCKIQYDIFVNSSG

SEQ ID NO: 3181017 - protein, 18 aa, Giardia lamblia
WEAEFAKWIPSFQVLTVI

SEQ ID NO: 3181018 - protein, 20 aa, Giardia lamblia
WEIPLYKCMLLWNVHSFYKS

SEQ ID NO: 3181019 - protein, 17 aa, Giardia lamblia
WEQLKMPIMERLDLFAV

SEQ ID NO: 3181020 - protein, 17 aa, Giardia lamblia
WFDPRFPTVQGLMRRGL

SEQ ID NO: 3181021 - protein, 17 aa, Giardia lamblia
WFGRLTDLLPFNADLYP

SEQ ID NO: 3181022 - protein, 19 aa, Giardia lamblia
WGDCIKLAYYLPDGSRNKP

SEQ ID NO: 3181023 - protein, 17 aa, Giardia lamblia
WGDSLVFDARFEAGNLF

SEQ ID NO: 3181024 - protein, 18 aa, Giardia lamblia
WGGGPAFLAEAAPFHSQF

SEQ ID NO: 3181025 - protein, 19 aa, Giardia lamblia
WGHELCIPDSLLLNCKQKE

SEQ ID NO: 3181026 - protein, 18 aa, Giardia lamblia
WGTTALMWACQFGHIDCV

SEQ ID NO: 3181027 - protein, 22 aa, Giardia lamblia
WHRRSPEAFRCLGTYFSYVTPV

SEQ ID NO: 3181028 - protein, 20 aa, Giardia lamblia
WICTGSEWRQIFGHSDTGSS

SEQ ID NO: 3181029 - protein, 18 aa, Giardia lamblia
WIRSMPRVIDWRPCSLAE

SEQ ID NO: 3181030 - protein, 18 aa, Giardia lamblia
WKELLCVQRSIFDQATLS

SEQ ID NO: 3181031 - protein, 18 aa, Giardia lamblia
WKKSRLMALQTAFINESL

SEQ ID NO: 3181032 - protein, 17 aa, Giardia lamblia
WKNEFMRVFADRLICPE

SEQ ID NO: 3181033 - protein, 19 aa, Giardia lamblia
WKQLPLIISPFFLYSHIVR

SEQ ID NO: 3181034 - protein, 17 aa, Giardia lamblia
WKTALEYAILGSKQRNL

SEQ ID NO: 3181035 - protein, 18 aa, Giardia lamblia
WKTFMVAVVLDFHSLAAI

SEQ ID NO: 3181036 - protein, 20 aa, Giardia lamblia
WKVGACAVFNPQHCKGLLDS

SEQ ID NO: 3181037 - protein, 18 aa, Giardia lamblia
WKVVDSWFYCRGLAAMQI

SEQ ID NO: 3181038 - protein, 19 aa, Giardia lamblia
WLEGNGFTKTQLVLEVESF

SEQ ID NO: 3181039 - protein, 25 aa, Giardia lamblia
WLEMVRSWWPLTRCILLNRASAVAY

SEQ ID NO: 3181040 - protein, 19 aa, Giardia lamblia
WLKEMLRMHEAEKERVALQ

SEQ ID NO: 3181041 - protein, 17 aa, Giardia lamblia
WLLKFLNIHYPLFTHLF

SEQ ID NO: 3181042 - protein, 19 aa, Giardia lamblia
WLLMPAICCVNCKMVAQLP

SEQ ID NO: 3181043 - protein, 17 aa, Giardia lamblia
WLLWNLSKEKSYLTDVT

SEQ ID NO: 3181044 - protein, 19 aa, Giardia lamblia
WLPPHLNLSLGQMKHLEYI

SEQ ID NO: 3181045 - protein, 17 aa, Giardia lamblia
WLRILRPGSILGQQQQF

SEQ ID NO: 3181046 - protein, 17 aa, Giardia lamblia
WLRKQMRAVEKLIEKEN

SEQ ID NO: 3181047 - protein, 18 aa, Giardia lamblia
WLRLYPIYVGKYTEFFGH

SEQ ID NO: 3181048 - protein, 20 aa, Giardia lamblia
WLYHKICLLADSLVMVITDA

SEQ ID NO: 3181049 - protein, 17 aa, Giardia lamblia
WLYRHGIDKFYRSRTRN

SEQ ID NO: 3181050 - protein, 17 aa, Giardia lamblia
WLYTAPCTYTYSKVTDR

SEQ ID NO: 3181051 - protein, 23 aa, Giardia lamblia
WMPDLTKLAGLIVHSLVAIEPIP

SEQ ID NO: 3181052 - protein, 19 aa, Giardia lamblia
WNIARARAMVGAREAVAAA

SEQ ID NO: 3181053 - protein, 23 aa, Giardia lamblia
WNLGAWSSFFAFRLITQEEFQNV

SEQ ID NO: 3181054 - protein, 23 aa, Giardia lamblia
WNRNEKGCLIPGYYTQSKFTLIH

SEQ ID NO: 3181055 - protein, 20 aa, Giardia lamblia
WPFVDVRAAAYGMDLLDEIG

SEQ ID NO: 3181056 - protein, 18 aa, Giardia lamblia
WPSSCMEDLLAANDVVDL

SEQ ID NO: 3181057 - protein, 18 aa, Giardia lamblia
WPVMKRIMAAVLVAFGKA

SEQ ID NO: 3181058 - protein, 20 aa, Giardia lamblia
WRASTPLPKRRDAKGKRSSQ

SEQ ID NO: 3181059 - protein, 19 aa, Giardia lamblia
WRFSSEILLALDYLHTDDH

SEQ ID NO: 3181060 - protein, 18 aa, Giardia lamblia
WRGGCIIRMNLLTPLADF

SEQ ID NO: 3181061 - protein, 19 aa, Giardia lamblia
WRGMTALMFAARNGNHGIV

SEQ ID NO: 3181062 - protein, 24 aa, Giardia lamblia
WRGTKCGFLKSFDFYVANGLDCFN

SEQ ID NO: 3181063 - protein, 18 aa, Giardia lamblia
WRIREILQAIGLEPTDEE

SEQ ID NO: 3181064 - protein, 19 aa, Giardia lamblia
WRKCKKPSLIREIKLACLD

SEQ ID NO: 3181065 - protein, 18 aa, Giardia lamblia
WRKQCLDALAHILSYTNE

SEQ ID NO: 3181066 - protein, 17 aa, Giardia lamblia
WRRIFSFVAKQGKNKGT

SEQ ID NO: 3181067 - protein, 17 aa, Giardia lamblia
WRRSELMLAKARSMLPG

SEQ ID NO: 3181068 - protein, 18 aa, Giardia lamblia
WRWPELLSNLDLAAYTAM

SEQ ID NO: 3181069 - protein, 18 aa, Giardia lamblia
WRYALLLRRMERVTASRH

SEQ ID NO: 3181070 - protein, 20 aa, Giardia lamblia
WSALKFSWLQTRSHVRSVWR

SEQ ID NO: 3181071 - protein, 18 aa, Giardia lamblia
WSEQVFKLPEPGSEDNGR

SEQ ID NO: 3181072 - protein, 19 aa, Giardia lamblia
WSFGCVVCELLTGRVLFPN

SEQ ID NO: 3181073 - protein, 17 aa, Giardia lamblia
WSFGSLLLHLCKPDLLI

SEQ ID NO: 3181074 - protein, 24 aa, Giardia lamblia
WSFIKCVRALLPREHDIRHSSGKT

SEQ ID NO: 3181075 - protein, 17 aa, Giardia lamblia
WSISPAFLQFMETNFNG

SEQ ID NO: 3181076 - protein, 18 aa, Giardia lamblia
WSLGALLYELCTFKPLFI

SEQ ID NO: 3181077 - protein, 17 aa, Giardia lamblia
WSLGALVYCVCALKPPA

SEQ ID NO: 3181078 - protein, 24 aa, Giardia lamblia
WTALMWASHYNLVFLIETLFVEVT

SEQ ID NO: 3181079 - protein, 23 aa, Giardia lamblia
WTCSTIRGGFKLRFNGISSQPDY

SEQ ID NO: 3181080 - protein, 18 aa, Giardia lamblia
WTSFMVMFAQTLLRMAAG

SEQ ID NO: 3181081 - protein, 17 aa, Giardia lamblia
WVAMVNLTFGIHPLVPD

SEQ ID NO: 3181082 - protein, 20 aa, Giardia lamblia
WVFRAEFEMAIFRRNAAIDA

SEQ ID NO: 3181083 - protein, 26 aa, Giardia lamblia
WVKHFPALCYKDMCKFGARVDWRRSM

SEQ ID NO: 3181084 - protein, 18 aa, Giardia lamblia
WWAFGVLIYEMLTGSPPF

SEQ ID NO: 3181085 - protein, 18 aa, Giardia lamblia
WYDLKMRGVLPFKNVGIV

SEQ ID NO: 3181086 - protein, 21 aa, Giardia lamblia
WYHSHPGYFAWLSHIDQNTHK

SEQ ID NO: 3181087 - protein, 20 aa, Giardia lamblia
YAATCKLILMAESISGLIPP

SEQ ID NO: 3181088 - protein, 17 aa, Giardia lamblia
YAPCGKCQHKAGILSGN

SEQ ID NO: 3181089 - protein, 22 aa, Giardia lamblia
YAPVRCSGCSAVLSPFTYVDYQ

SEQ ID NO: 3181090 - protein, 20 aa, Giardia lamblia
YAVYKYCCRGLFTRHKILLS

SEQ ID NO: 3181091 - protein, 20 aa, Giardia lamblia
YCIELCKILYVLCQYSPRLI

SEQ ID NO: 3181092 - protein, 17 aa, Giardia lamblia
YDDRWFLHKAWAHATKI

SEQ ID NO: 3181093 - protein, 18 aa, Giardia lamblia
YDELKAHMTACGLPVFPQ

SEQ ID NO: 3181094 - protein, 24 aa, Giardia lamblia
YDFAELPIEIAFKVSWPTNTVALA

SEQ ID NO: 3181095 - protein, 24 aa, Giardia lamblia
YDFTGREIIAWLRILRPGSILGQQ

SEQ ID NO: 3181096 - protein, 20 aa, Giardia lamblia
YDHSACFVVGCSVSAVDMTL

SEQ ID NO: 3181097 - protein, 17 aa, Giardia lamblia
YDISMTMWYLGKTTSEI

SEQ ID NO: 3181098 - protein, 22 aa, Giardia lamblia
YDLRSVYSLALIDFIGRALKAS

SEQ ID NO: 3181099 - protein, 23 aa, Giardia lamblia
YDNCIKFFESMCTIKGLCEDASV

SEQ ID NO: 3181100 - protein, 21 aa, Giardia lamblia
YDNNICLYKRCIEVADELGEE

SEQ ID NO: 3181101 - protein, 25 aa, Giardia lamblia
YDVLPIRNCPGVEDCTDYLSVQSKS

SEQ ID NO: 3181102 - protein, 17 aa, Giardia lamblia
YDWFARLFLAIILSIPT

SEQ ID NO: 3181103 - protein, 23 aa, Giardia lamblia
YDYLHRFTVVWPVLSLDPIVDNF

SEQ ID NO: 3181104 - protein, 20 aa, Giardia lamblia
YECCRRIVSELAVSLHTSPN

SEQ ID NO: 3181105 - protein, 22 aa, Giardia lamblia
YEECPRCGPNCICKVKEDIITT

SEQ ID NO: 3181106 - protein, 21 aa, Giardia lamblia
YEECVKILIPREAGLKRNTDG

SEQ ID NO: 3181107 - protein, 20 aa, Giardia lamblia
YEFPSDLLLGLGKIMTMSMC

SEQ ID NO: 3181108 - protein, 22 aa, Giardia lamblia
YEGKAFHFEPYFARLKKEKLKD

SEQ ID NO: 3181109 - protein, 18 aa, Giardia lamblia
YEICKILAPFEARDTLPD

SEQ ID NO: 3181110 - protein, 20 aa, Giardia lamblia
YELCTFRPFCLALNPMDALQ

SEQ ID NO: 3181111 - protein, 18 aa, Giardia lamblia
YELRCAMIEHYLDNILDL

SEQ ID NO: 3181112 - protein, 17 aa, Giardia lamblia
YERAFRAIIESGCYPAV

SEQ ID NO: 3181113 - protein, 17 aa, Giardia lamblia
YESRLHSKMGYTALMLA

SEQ ID NO: 3181114 - protein, 18 aa, Giardia lamblia
YESTWGVVYNKDFDPKNA

SEQ ID NO: 3181115 - protein, 20 aa, Giardia lamblia
YEYFDLRFARLESMVEALCA

SEQ ID NO: 3181116 - protein, 20 aa, Giardia lamblia
YEYICPVVSLSFHLTKEEET

SEQ ID NO: 3181117 - protein, 25 aa, Giardia lamblia
YFKALCDFHVLFPLLQDIRSVVAQI

SEQ ID NO: 3181118 - protein, 24 aa, Giardia lamblia
YFSHGFPLEKSRVIRKPEELNPVI

SEQ ID NO: 3181119 - protein, 17 aa, Giardia lamblia
YFVEPWPTLTIFAESNE

SEQ ID NO: 3181120 - protein, 19 aa, Giardia lamblia
YFVLIAMFCKFQLRLTLTG

SEQ ID NO: 3181121 - protein, 19 aa, Giardia lamblia
YGAWSRFSGIAVQSLDFMQ

SEQ ID NO: 3181122 - protein, 23 aa, Giardia lamblia
YGDHEFYCMLLAIASQYSSSKVS

SEQ ID NO: 3181123 - protein, 18 aa, Giardia lamblia
YGDMGADLSRCFDERMAP

SEQ ID NO: 3181124 - protein, 20 aa, Giardia lamblia
YGELLFGHMLYDYSHSAAHK

SEQ ID NO: 3181125 - protein, 17 aa, Giardia lamblia
YGGTSILMPFTFPVGLF

SEQ ID NO: 3181126 - protein, 23 aa, Giardia lamblia
YGLPDICKILAPREHTIITPEGQ

SEQ ID NO: 3181127 - protein, 21 aa, Giardia lamblia
YGTAFGSIFIRQIVPGEEISS

SEQ ID NO: 3181128 - protein, 17 aa, Giardia lamblia
YGVELAWTPMHSTNTLV

SEQ ID NO: 3181129 - protein, 19 aa, Giardia lamblia
YGYCLDIRGDLVYYGDCSV

SEQ ID NO: 3181130 - protein, 17 aa, Giardia lamblia
YHFCVIYGMNFLSMCST

SEQ ID NO: 3181131 - protein, 30 aa, Giardia lamblia
YHGCPCPWLIISLMRFLRRLAPRLEEAQDK

SEQ ID NO: 3181132 - protein, 25 aa, Giardia lamblia
YHHGWPCFGCGAPITFLGLSFSRLR

SEQ ID NO: 3181133 - protein, 18 aa, Giardia lamblia
YHHYTFSFDVLKYARILN

SEQ ID NO: 3181134 - protein, 18 aa, Giardia lamblia
YHKMSVQLVNLWYQLPPS

SEQ ID NO: 3181135 - protein, 19 aa, Giardia lamblia
YHLEAFSFSSLREIIADTS

SEQ ID NO: 3181136 - protein, 23 aa, Giardia lamblia
YHLLKSRWTFMLNRKRERLSKGL

SEQ ID NO: 3181137 - protein, 18 aa, Giardia lamblia
YHPHWPKFVPLSLTVKTH

SEQ ID NO: 3181138 - protein, 17 aa, Giardia lamblia
YHQGCFALFCYRGETGK

SEQ ID NO: 3181139 - protein, 23 aa, Giardia lamblia
YHQLRRFHMLIIMRRRQYVLANN

SEQ ID NO: 3181140 - protein, 20 aa, Giardia lamblia
YHRQELLSLLGAGSLQLTNT

SEQ ID NO: 3181141 - protein, 18 aa, Giardia lamblia
YHTFFSLAAMSLFNVTLP

SEQ ID NO: 3181142 - protein, 20 aa, Giardia lamblia
YIEWLRLLVIKYLVYGTNIS

SEQ ID NO: 3181143 - protein, 26 aa, Giardia lamblia
YIFLIKWQRKAHCHATWELEDYLMHL

SEQ ID NO: 3181144 - protein, 21 aa, Giardia lamblia
YIGVELAEAFGLKNQPCTLID

SEQ ID NO: 3181145 - protein, 17 aa, Giardia lamblia
YIMPRRIFMVSETRCKL

SEQ ID NO: 3181146 - protein, 25 aa, Giardia lamblia
YIPQSLGRVGWRVCLVVDSSPKEAF

SEQ ID NO: 3181147 - protein, 17 aa, Giardia lamblia
YIRASLRLYDWIVTKEL

SEQ ID NO: 3181148 - protein, 18 aa, Giardia lamblia
YISRDFADGVLLAEVIHH

SEQ ID NO: 3181149 - protein, 21 aa, Giardia lamblia
YKALNLCHFFTCGADEVRCWT

SEQ ID NO: 3181150 - protein, 19 aa, Giardia lamblia
YKAYPRPSTVAGYGSGQLT

SEQ ID NO: 3181151 - protein, 17 aa, Giardia lamblia
YKCMEEINLYYGGNDLQ

SEQ ID NO: 3181152 - protein, 17 aa, Giardia lamblia
YKCMLLWNVHSFYKSPG

SEQ ID NO: 3181153 - protein, 18 aa, Giardia lamblia
YKDYKWERFCDIITVFHY

SEQ ID NO: 3181154 - protein, 21 aa, Giardia lamblia
YKERAEFEVCTFKPELSARTE

SEQ ID NO: 3181155 - protein, 17 aa, Giardia lamblia
YKFKLGTTVARLKRLHL

SEQ ID NO: 3181156 - protein, 18 aa, Giardia lamblia
YKIASLLVAEEIRLQTTN

SEQ ID NO: 3181157 - protein, 17 aa, Giardia lamblia
YKITEDWFNGIAGDIQK

SEQ ID NO: 3181158 - protein, 17 aa, Giardia lamblia
YKMLISINYHKMADAPL

SEQ ID NO: 3181159 - protein, 18 aa, Giardia lamblia
YKNTCYRYSVNVCDVRQG

SEQ ID NO: 3181160 - protein, 20 aa, Giardia lamblia
YKRVPICINGSLVQSVADLI

SEQ ID NO: 3181161 - protein, 21 aa, Giardia lamblia
YKSCSSFLGLVSMMDFDVTFE

SEQ ID NO: 3181162 - protein, 17 aa, Giardia lamblia
YKSRTTILFGLTNRKEQ

SEQ ID NO: 3181163 - protein, 24 aa, Giardia lamblia
YKYIRSSFELAYFYLLRNHSGSIL

SEQ ID NO: 3181164 - protein, 19 aa, Giardia lamblia
YKYLYLREALTAAIMILPE

SEQ ID NO: 3181165 - protein, 18 aa, Giardia lamblia
YLALSFAVAELWSQWIDP

SEQ ID NO: 3181166 - protein, 19 aa, Giardia lamblia
YLCHYGEALAAYQKAQSLD

SEQ ID NO: 3181167 - protein, 20 aa, Giardia lamblia
YLHNTWMGICLVMVKMRIRV

SEQ ID NO: 3181168 - protein, 18 aa, Giardia lamblia
YLIRAACLQAVIEENSDF

SEQ ID NO: 3181169 - protein, 17 aa, Giardia lamblia
YLLKETCFLEWRYHAYI

SEQ ID NO: 3181170 - protein, 17 aa, Giardia lamblia
YLLRYPTQWYDKRGFSV

SEQ ID NO: 3181171 - protein, 18 aa, Giardia lamblia
YLNMMQWSPPLIDTVIHE

SEQ ID NO: 3181172 - protein, 23 aa, Giardia lamblia
YLPELRPSASVLRDLCARRSASA

SEQ ID NO: 3181173 - protein, 26 aa, Giardia lamblia
YLQRRIPLHVAENFCRLIIMLVRSPV

SEQ ID NO: 3181174 - protein, 18 aa, Giardia lamblia
YLQTCIKVRHEVRYVVSI

SEQ ID NO: 3181175 - protein, 23 aa, Giardia lamblia
YLQWMAPLPLCFVTSSKKKLAEF

SEQ ID NO: 3181176 - protein, 23 aa, Giardia lamblia
YLSELPIACGITPTVTPGIGRHV

SEQ ID NO: 3181177 - protein, 20 aa, Giardia lamblia
YLSFGKRMIKVFPNLNITNA

SEQ ID NO: 3181178 - protein, 17 aa, Giardia lamblia
YLSSSYLLYSLVNQEPV

SEQ ID NO: 3181179 - protein, 23 aa, Giardia lamblia
YLTLECKGWLTGIVAELCRDEEN

SEQ ID NO: 3181180 - protein, 18 aa, Giardia lamblia
YLTLLGMKGLCAYAEHCY

SEQ ID NO: 3181181 - protein, 19 aa, Giardia lamblia
YLVKLFELIGSEKRAMAYV

SEQ ID NO: 3181182 - protein, 18 aa, Giardia lamblia
YMAGPGFTALMDAARLGN

SEQ ID NO: 3181183 - protein, 23 aa, Giardia lamblia
YMCTGQPCFWGRTPSELADNVAS

SEQ ID NO: 3181184 - protein, 21 aa, Giardia lamblia
YNARLAKLSSIYAAMERAHSL

SEQ ID NO: 3181185 - protein, 17 aa, Giardia lamblia
YNETLARKNIYKRRFLK

SEQ ID NO: 3181186 - protein, 18 aa, Giardia lamblia
YNGSPGLYVTRLESTCRE

SEQ ID NO: 3181187 - protein, 27 aa, Giardia lamblia
YNHLLRTCCRTCLNRCLATGIEGSDLL

SEQ ID NO: 3181188 - protein, 19 aa, Giardia lamblia
YNISIRAPLDFLFEKSPVH

SEQ ID NO: 3181189 - protein, 23 aa, Giardia lamblia
YNLGHSLLYMGIRAVEAGTNLKT

SEQ ID NO: 3181190 - protein, 24 aa, Giardia lamblia
YNRSHIWGAVWLPTARLHRATNKM

SEQ ID NO: 3181191 - protein, 17 aa, Giardia lamblia
YPALCITAGFKSQAIKD

SEQ ID NO: 3181192 - protein, 24 aa, Giardia lamblia
YPIKCSLCGLFLGMATDAIDQGPT

SEQ ID NO: 3181193 - protein, 21 aa, Giardia lamblia
YPKWMYNPPVIKRKKQKIARD

SEQ ID NO: 3181194 - protein, 21 aa, Giardia lamblia
YPNQMPCVLKIKRVAAPPSEG

SEQ ID NO: 3181195 - protein, 19 aa, Giardia lamblia
YPPELTFEFVEGTGDLVVK

SEQ ID NO: 3181196 - protein, 17 aa, Giardia lamblia
YPSRVAVLKAHLRKSKV

SEQ ID NO: 3181197 - protein, 18 aa, Giardia lamblia
YQFRSCISKHSILYAGRY

SEQ ID NO: 3181198 - protein, 19 aa, Giardia lamblia
YQKRIHGGVNIYKPDFGHT

SEQ ID NO: 3181199 - protein, 24 aa, Giardia lamblia
YQTEAGDYFLVWTLACENEKISTI

SEQ ID NO: 3181200 - protein, 17 aa, Giardia lamblia
YQVCILSFLAPMNLICS

SEQ ID NO: 3181201 - protein, 20 aa, Giardia lamblia
YRADYSKAFVAIWKRNVQFI

SEQ ID NO: 3181202 - protein, 18 aa, Giardia lamblia
YRAPEVILGLPFDEKADV

SEQ ID NO: 3181203 - protein, 17 aa, Giardia lamblia
YRDFCSALASALTDSGR

SEQ ID NO: 3181204 - protein, 18 aa, Giardia lamblia
YRELYSLLSCMLIINPDK

SEQ ID NO: 3181205 - protein, 23 aa, Giardia lamblia
YRGADRFRLKFSFSQPLSQVKTI

SEQ ID NO: 3181206 - protein, 19 aa, Giardia lamblia
YRGCFLEQNYLYIILELVD

SEQ ID NO: 3181207 - protein, 18 aa, Giardia lamblia
YRGESFSFFRGWKSQCLF

SEQ ID NO: 3181208 - protein, 23 aa, Giardia lamblia
YRHFIKFELPYSFTVDGDCSNKI

SEQ ID NO: 3181209 - protein, 20 aa, Giardia lamblia
YRIGVALKDTIPLVAYSTRM

SEQ ID NO: 3181210 - protein, 19 aa, Giardia lamblia
YRITWSFVKTFFARVFDSV

SEQ ID NO: 3181211 - protein, 18 aa, Giardia lamblia
YRKFCKQLVILAAEQQKL

SEQ ID NO: 3181212 - protein, 19 aa, Giardia lamblia
YRKLFSFSAPFTVDQAFRD

SEQ ID NO: 3181213 - protein, 22 aa, Giardia lamblia
YRKRPDLAKARRVIATMDVLGM

SEQ ID NO: 3181214 - protein, 17 aa, Giardia lamblia
YRLLYTVSRIFTKKMAI

SEQ ID NO: 3181215 - protein, 17 aa, Giardia lamblia
YRLSGLFFAHYYTYMLP

SEQ ID NO: 3181216 - protein, 18 aa, Giardia lamblia
YRLSLFFEKCTQYLYERI

SEQ ID NO: 3181217 - protein, 17 aa, Giardia lamblia
YRLSYLDSRSTSRVGSM

SEQ ID NO: 3181218 - protein, 17 aa, Giardia lamblia
YRMICLISNLSDFRSLT

SEQ ID NO: 3181219 - protein, 19 aa, Giardia lamblia
YRNLLWRIHIFVNDCPPVN

SEQ ID NO: 3181220 - protein, 17 aa, Giardia lamblia
YRPASCVPSGNGVLSGL

SEQ ID NO: 3181221 - protein, 17 aa, Giardia lamblia
YRQAVVLTEKMGQFCAQ

SEQ ID NO: 3181222 - protein, 17 aa, Giardia lamblia
YRQYKFVRFDGSVKDVD

SEQ ID NO: 3181223 - protein, 18 aa, Giardia lamblia
YRRSLIFALGKVWSELFP

SEQ ID NO: 3181224 - protein, 21 aa, Giardia lamblia
YRSAKELAMRVYAEMKKHQAI

SEQ ID NO: 3181225 - protein, 17 aa, Giardia lamblia
YRSDFSFIRSGIYSTKE

SEQ ID NO: 3181226 - protein, 24 aa, Giardia lamblia
YRTVLEFMVKLIFYPPLKHGQARD

SEQ ID NO: 3181227 - protein, 18 aa, Giardia lamblia
YRVLHGLSAWISDEGVEY

SEQ ID NO: 3181228 - protein, 22 aa, Giardia lamblia
YRVMCGVPMLLLAYGVTSAGKT

SEQ ID NO: 3181229 - protein, 18 aa, Giardia lamblia
YRYCQVFGDCCDPLSIPR

SEQ ID NO: 3181230 - protein, 26 aa, Giardia lamblia
YRYRVRGCLKKAYFFTLAVWDLEFTY

SEQ ID NO: 3181231 - protein, 21 aa, Giardia lamblia
YSAIELLKLAGLYEDVADILQ

SEQ ID NO: 3181232 - protein, 27 aa, Giardia lamblia
YSDCFLRLYPRFNLRSGCIASIVCRPR

SEQ ID NO: 3181233 - protein, 18 aa, Giardia lamblia
YSDQFGILFHRFATEEQD

SEQ ID NO: 3181234 - protein, 17 aa, Giardia lamblia
YSFAYYYVGLCMRTDAK

SEQ ID NO: 3181235 - protein, 17 aa, Giardia lamblia
YSFTLKWSCSLPNAQTG

SEQ ID NO: 3181236 - protein, 17 aa, Giardia lamblia
YSIGRVYRRDKPVMEKG

SEQ ID NO: 3181237 - protein, 17 aa, Giardia lamblia
YSKALGLEEVFHNIQNK

SEQ ID NO: 3181238 - protein, 21 aa, Giardia lamblia
YSLASFRVYTLVPFFLSRFKH

SEQ ID NO: 3181239 - protein, 22 aa, Giardia lamblia
YSLYSFFSFCLQRKCRRRVLLD

SEQ ID NO: 3181240 - protein, 21 aa, Giardia lamblia
YSPRLPVLIFVASRRQTRRTA

SEQ ID NO: 3181241 - protein, 19 aa, Giardia lamblia
YTILVRWGSLQFKKISSVL

SEQ ID NO: 3181242 - protein, 18 aa, Giardia lamblia
YTKACIMVSLAYGHYQIA

SEQ ID NO: 3181243 - protein, 19 aa, Giardia lamblia
YTLLCEICKNALARTTSAA

SEQ ID NO: 3181244 - protein, 25 aa, Giardia lamblia
YTPRLRKFLGVCLRFDVTKRHLTNG

SEQ ID NO: 3181245 - protein, 21 aa, Giardia lamblia
YTVRFCEILRSFTYQLKPGNF

SEQ ID NO: 3181246 - protein, 18 aa, Giardia lamblia
YVKESVVWEILYHVLSGL

SEQ ID NO: 3181247 - protein, 18 aa, Giardia lamblia
YVLGLRIEDIFKRRLQSV

SEQ ID NO: 3181248 - protein, 18 aa, Giardia lamblia
YVLKEIRLAGATKKEIES

SEQ ID NO: 3181249 - protein, 23 aa, Giardia lamblia
YVRKCPLYHKLNWVIPDDPRDIF

SEQ ID NO: 3181250 - protein, 17 aa, Giardia lamblia
YVTRIGRIVFRLCFRNW

SEQ ID NO: 3181251 - protein, 21 aa, Giardia lamblia
YWLASEAKLLFALHELTPLAQ

SEQ ID NO: 3181252 - protein, 20 aa, Giardia lamblia
YWPMRFHCRCIEKMCRNFVF

SEQ ID NO: 3181253 - protein, 21 aa, Giardia lamblia
YWSYFICGFFRYPYSAVPRFT

SEQ ID NO: 3181254 - protein, 24 aa, Giardia lamblia
YYERCCLMDVILFYRMKERVIPEE

SEQ ID NO: 3181255 - protein, 24 aa, Giardia lamblia
YYIKLWIKRQCGYVLELSKGTVSI

SEQ ID NO: 3181256 - protein, 20 aa, Giardia lamblia
YYQCFRLLFEANKTAVPTES

SEQ ID NO: 3181257 - protein, 22 aa, Giardia lamblia
YYTKLGDCIIHLAEQGVLSADT

SEQ ID NO: 3181258 - protein, 17 aa, Giardia lamblia
YYYECFEALPPKDSPFH

SEQ ID NO: 3181259 - protein, 20 aa, Giardia lamblia
YYYPEIMAFLSPFEGHIADS

SEQ ID NO: 3181260 - protein, 21 aa, Giardia lamblia
APMHLQVIPAPMVYVRGAPTT

SEQ ID NO: 3181261 - protein, 22 aa, Giardia lamblia
APNLVCMPCKHYVLCKDCGKDV

SEQ ID NO: 3181262 - protein, 24 aa, Giardia lamblia
EQFTAMFRRKAFLHWYTGEGMDEM

SEQ ID NO: 3181263 - protein, 24 aa, Giardia lamblia
EVLKAFLEVVLRDSLTYTEHGQRK

SEQ ID NO: 3181264 - protein, 20 aa, Giardia lamblia
GEYFIIAGLELCKDALWSES

SEQ ID NO: 3181265 - protein, 17 aa, Giardia lamblia
GRYLTAAAMFRGRMSTK

SEQ ID NO: 3181266 - protein, 24 aa, Giardia lamblia
KCLGEIRKLLNSKKYTKCVKCRAN

SEQ ID NO: 3181267 - protein, 17 aa, Giardia lamblia
KEKDTLGGITKPAIRRL

SEQ ID NO: 3181268 - protein, 32 aa, Giardia lamblia
KRGRIPVPITMILSVMKQVAAALAYLHGLSGA

SEQ ID NO: 3181269 - protein, 23 aa, Giardia lamblia
LQLTRSPLLPLCTLLECLHCSSH

SEQ ID NO: 3181270 - protein, 36 aa, Giardia lamblia
NADLRKLAVNLIPFPRLHFFLVGFAPLTSRGSQIYR

SEQ ID NO: 3181271 - protein, 26 aa, Giardia lamblia
NEALYDICFRTLKLTCPTYGDLNHLV

SEQ ID NO: 3181272 - protein, 17 aa, Giardia lamblia
RVQRPVKMRLHAGGQQG

SEQ ID NO: 3181273 - protein, 17 aa, Giardia lamblia
TIRVQRPVKMRLHAGGQ

SEQ ID NO: 3181274 - protein, 28 aa, Giardia lamblia
TLGGITKPAIRRLARRGGVKRISSTIYQ

SEQ ID NO: 3181275 - protein, 17 aa, Giardia lamblia
TSSIWVAVIKQQRCLVA

SEQ ID NO: 3181276 - protein, 19 aa, Giardia lamblia
VPHVPGPVRISVHLVKRAS

SEQ ID NO: 3181277 - protein, 24 aa, Giardia lamblia
VQEKQARYYFPKELSRASDAVSSS

SEQ ID NO: 3181278 - protein, 25 aa, Giardia lamblia
WVFDRPSPKLLAFLSKVYDMHDFKA

SEQ ID NO: 3181279 - protein, 19 aa, Giardia lamblia
AIEYSLRGFVCRRSIMLAD

SEQ ID NO: 3181280 - protein, 19 aa, Giardia lamblia
AMMQEIPSQFAFIKKLGYL

SEQ ID NO: 3181281 - protein, 18 aa, Giardia lamblia
ANGYKGVANCIQCQAPQS

SEQ ID NO: 3181282 - protein, 28 aa, Giardia lamblia
ARRFVLGCRLLRLQYYFSSVAELGLLDY

SEQ ID NO: 3181283 - protein, 22 aa, Giardia lamblia
ATCTACQDGYYKNSQTCERCDE

SEQ ID NO: 3181284 - protein, 24 aa, Giardia lamblia
CCKCPHLYVCGPGSAISPEQCLYI

SEQ ID NO: 3181285 - protein, 18 aa, Giardia lamblia
CECAFLQDTFPLCLSQAA

SEQ ID NO: 3181286 - protein, 26 aa, Giardia lamblia
CEKYGVKKVPSWVVLRGGKEIGRIVE

SEQ ID NO: 3181287 - protein, 25 aa, Giardia lamblia
CSGLQGFLIFHSFGGGTGAGFGSLF

SEQ ID NO: 3181288 - protein, 17 aa, Giardia lamblia
CTFCKAGKYLDGDQCAD

SEQ ID NO: 3181289 - protein, 17 aa, Giardia lamblia
DAGAVKALLPIQRGRKT

SEQ ID NO: 3181290 - protein, 25 aa, Giardia lamblia
DDAAPVSCFILGSSGLLKDKLHDLD

SEQ ID NO: 3181291 - protein, 30 aa, Giardia lamblia
DDGSAFYGHLLRRLLAAPRAARRFVLGCRL

SEQ ID NO: 3181292 - protein, 28 aa, Giardia lamblia
DGDTALIYAARFWATDALSLLRTEARLQ

SEQ ID NO: 3181293 - protein, 26 aa, Giardia lamblia
DLRRELDALRRAAPVEPLAAAAPADD

SEQ ID NO: 3181294 - protein, 25 aa, Giardia lamblia
DNVDGSHFLNQARNKCLLCSDDKTN

SEQ ID NO: 3181295 - protein, 24 aa, Giardia lamblia
DSEEWTALMWAALVGRTEVVRLLL

SEQ ID NO: 3181296 - protein, 20 aa, Giardia lamblia
DSLCWQMMPSGELVLPDIQR

SEQ ID NO: 3181297 - protein, 17 aa, Giardia lamblia
EFQTNLVPYPRIHFPLC

SEQ ID NO: 3181298 - protein, 21 aa, Giardia lamblia
EKILPSRRSPLLLASGRAPGL

SEQ ID NO: 3181299 - protein, 23 aa, Giardia lamblia
ENAPITIHQKLILVSLCVVPMVS

SEQ ID NO: 3181300 - protein, 24 aa, Giardia lamblia
EPRRYLLGTFFYAFDHRSYYGCAE

SEQ ID NO: 3181301 - protein, 20 aa, Giardia lamblia
ERGIAFLAYADDIVGFHDEG

SEQ ID NO: 3181302 - protein, 21 aa, Giardia lamblia
EWPPLFPVAGWLAKYTRRTRL

SEQ ID NO: 3181303 - protein, 21 aa, Giardia lamblia
EYVMYIGFRHAAPLQKFAEAC

SEQ ID NO: 3181304 - protein, 26 aa, Giardia lamblia
FADPEQLHLVLLISAASVSLCVTETK

SEQ ID NO: 3181305 - protein, 23 aa, Giardia lamblia
FEPRTFEFFPDSTVGDLRKKVAE

SEQ ID NO: 3181306 - protein, 18 aa, Giardia lamblia
FPIGRIHRHLREGRYAER

SEQ ID NO: 3181307 - protein, 20 aa, Giardia lamblia
GCLVLALPPGVVPGPGVLPL

SEQ ID NO: 3181308 - protein, 26 aa, Giardia lamblia
GELDFSFLYAILSTFAILHELHILPV

SEQ ID NO: 3181309 - protein, 24 aa, Giardia lamblia
GGGGTLYFCFKYREGKEASSAKWF

SEQ ID NO: 3181310 - protein, 21 aa, Giardia lamblia
GHAPIVGLLAPLEHGLRNDAG

SEQ ID NO: 3181311 - protein, 39 aa, Giardia lamblia
GHLSTTKALLAFDQERPYLAEPLLAALDLNEPALRAHVA

SEQ ID NO: 3181312 - protein, 24 aa, Giardia lamblia
GHTGTVKYLLPYEKDIRSDTGWTA

SEQ ID NO: 3181313 - protein, 25 aa, Giardia lamblia
GKRRRVAGLLSPRRAYQPGTDATQG

SEQ ID NO: 3181314 - protein, 28 aa, Giardia lamblia
GMHDKYGWTALIWAIDNNNIECVRLLAE

SEQ ID NO: 3181315 - protein, 19 aa, Giardia lamblia
GRKSKLEFVVYPSPQIATA

SEQ ID NO: 3181316 - protein, 23 aa, Giardia lamblia
GTGVALPAIRGLDALVGSCQRAP

SEQ ID NO: 3181317 - protein, 30 aa, Giardia lamblia
GVLRRHPRMRTMTPRWRRTWSAPPTAGSMI

SEQ ID NO: 3181318 - protein, 20 aa, Giardia lamblia
GWACCCWYTLYTQQQSYQSQ

SEQ ID NO: 3181319 - protein, 18 aa, Giardia lamblia
HALFRHFNEAFFDNCLRD

SEQ ID NO: 3181320 - protein, 28 aa, Giardia lamblia
HKRHETYATYIYKVLRSENIRSEADTDL

SEQ ID NO: 3181321 - protein, 27 aa, Giardia lamblia
HTAHIACQFQLFLQKLDKRTLKPEMEN

SEQ ID NO: 3181322 - protein, 17 aa, Giardia lamblia
HVYLLNATDPTQFEDLA

SEQ ID NO: 3181323 - protein, 24 aa, Giardia lamblia
IAAYFGCLECVKLLLEKEKYISSR

SEQ ID NO: 3181324 - protein, 18 aa, Giardia lamblia
IALFTDTHLGFTAPSARP

SEQ ID NO: 3181325 - protein, 40 aa, Giardia lamblia
ICIVSHGAVLNLFMCLITSAPLSKFWMFYGDACSISQVDM

SEQ ID NO: 3181326 - protein, 19 aa, Giardia lamblia
IIINWIRCQQVPDERLYQA

SEQ ID NO: 3181327 - protein, 25 aa, Giardia lamblia
INSMSRITVPLWPQYKRVRLFNAER

SEQ ID NO: 3181328 - protein, 23 aa, Giardia lamblia
IPDGLSPFLLRRLPQHTTNPSVT

SEQ ID NO: 3181329 - protein, 24 aa, Giardia lamblia
IQKLTAVIAAMPRTHEPQDITDAA

SEQ ID NO: 3181330 - protein, 24 aa, Giardia lamblia
ISDWSPNLVLRFNEDRDLLLEVLH

SEQ ID NO: 3181331 - protein, 23 aa, Giardia lamblia
ISMLIDDMWICNKRLSDTLKKAT

SEQ ID NO: 3181332 - protein, 19 aa, Giardia lamblia
KCNRWIIMMRSTRQFRVPW

SEQ ID NO: 3181333 - protein, 25 aa, Giardia lamblia
KELNRFYTDLLKQTQPAQAPEPLTQ

SEQ ID NO: 3181334 - protein, 18 aa, Giardia lamblia
KFDAIFYSRIPRAKETAE

SEQ ID NO: 3181335 - protein, 17 aa, Giardia lamblia
KGLMFPLLEQMADALAY

SEQ ID NO: 3181336 - protein, 20 aa, Giardia lamblia
KIPGFILDTIRSLCPCALSI

SEQ ID NO: 3181337 - protein, 17 aa, Giardia lamblia
KLEFVVYPSPQIATAVV

SEQ ID NO: 3181338 - protein, 23 aa, Giardia lamblia
KLILVSLCVVPMVSYAPLVEVTS

SEQ ID NO: 3181339 - protein, 19 aa, Giardia lamblia
KPLRLPIQDVYKISGVGTV

SEQ ID NO: 3181340 - protein, 20 aa, Giardia lamblia
KRPTDKPLRLPIQDVYKISG

SEQ ID NO: 3181341 - protein, 19 aa, Giardia lamblia
KTGDLLFSAAFDGADPFSN

SEQ ID NO: 3181342 - protein, 17 aa, Giardia lamblia
KVLRWLATEIINAIHPE

SEQ ID NO: 3181343 - protein, 29 aa, Giardia lamblia
KYQKSTDLLIRKLPFSKLVRDIVTSGLSK

SEQ ID NO: 3181344 - protein, 18 aa, Giardia lamblia
LAALRRDAAENAAALREA

SEQ ID NO: 3181345 - protein, 26 aa, Giardia lamblia
LADEIRAKVRLISDSRFKICVSVTII

SEQ ID NO: 3181346 - protein, 18 aa, Giardia lamblia
LAPGMKVVFAPTSQVSEV

SEQ ID NO: 3181347 - protein, 21 aa, Giardia lamblia
LAPREMVVAVLRQVGAGLAYL

SEQ ID NO: 3181348 - protein, 20 aa, Giardia lamblia
LATRLLGKQVIIPPGTSKYT

SEQ ID NO: 3181349 - protein, 18 aa, Giardia lamblia
LELYLQQVNIPDGLSPFL

SEQ ID NO: 3181350 - protein, 26 aa, Giardia lamblia
LESIISRVVFFLPLEHDNPRTNNNSS

SEQ ID NO: 3181351 - protein, 17 aa, Giardia lamblia
LGRTPLHYAALSPRDPT

SEQ ID NO: 3181352 - protein, 19 aa, Giardia lamblia
LMATRYEKVQVRHLLIATT

SEQ ID NO: 3181353 - protein, 20 aa, Giardia lamblia
LSGSRKGLSLSAIPPRQPEV

SEQ ID NO: 3181354 - protein, 17 aa, Giardia lamblia
LTEFQTNLVPYPRIHFP

SEQ ID NO: 3181355 - protein, 18 aa, Giardia lamblia
LVALDTLLGRHTVSMVAI

SEQ ID NO: 3181356 - protein, 21 aa, Giardia lamblia
MDSNPLLDFFAAPPPTSQELE

SEQ ID NO: 3181357 - protein, 19 aa, Giardia lamblia
MPDLIDEMSNLIRSGSLGR

SEQ ID NO: 3181358 - protein, 25 aa, Giardia lamblia
MQTTREWFGFPPGTTALDIARRHGH

SEQ ID NO: 3181359 - protein, 26 aa, Giardia lamblia
NEDRDLLLEVLHLYLNMIEAGMAGRG

SEQ ID NO: 3181360 - protein, 24 aa, Giardia lamblia
NEKCFEGCFNLNTAPLLFVRQCVT

SEQ ID NO: 3181361 - protein, 25 aa, Giardia lamblia
NREEPLIHVLLANGFRAVGLPDVCL

SEQ ID NO: 3181362 - protein, 28 aa, Giardia lamblia
NTAGPQSSLFLLPRLMRAAHTNGMETVR

SEQ ID NO: 3181363 - protein, 18 aa, Giardia lamblia
NYNRVREAYVRLGRDMNA

SEQ ID NO: 3181364 - protein, 21 aa, Giardia lamblia
PELDCQVPEGATSSGTPLQKQ

SEQ ID NO: 3181365 - protein, 21 aa, Giardia lamblia
PEVMAMLEFRAILIPKESDGY

SEQ ID NO: 3181366 - protein, 24 aa, Giardia lamblia
PGQHKCFQCIHYYSRMTCQSSGTS

SEQ ID NO: 3181367 - protein, 18 aa, Giardia lamblia
PHAPGCLVLALPPGVVPG

SEQ ID NO: 3181368 - protein, 23 aa, Giardia lamblia
PLSTFLFCMATERLLRRLEERGI

SEQ ID NO: 3181369 - protein, 18 aa, Giardia lamblia
PPCVLGCAAPPLVPPVGG

SEQ ID NO: 3181370 - protein, 25 aa, Giardia lamblia
PPSPGARWQALFPAGTALGLSPFEA

SEQ ID NO: 3181371 - protein, 19 aa, Giardia lamblia
PSGQPFRRPLPGHVVARLA

SEQ ID NO: 3181372 - protein, 25 aa, Giardia lamblia
PTPYPFGFGVPLTYVPVLIQSPGHT

SEQ ID NO: 3181373 - protein, 20 aa, Giardia lamblia
PTVQLRWPMIWNADTSATVM

SEQ ID NO: 3181374 - protein, 21 aa, Giardia lamblia
PVCRRLVLFGQDRELYEARLE

SEQ ID NO: 3181375 - protein, 26 aa, Giardia lamblia
QEIGKPVALMLAIVAKSVRCLKWLGE

SEQ ID NO: 3181376 - protein, 17 aa, Giardia lamblia
QKTALMYCIDRQSLRLI

SEQ ID NO: 3181377 - protein, 20 aa, Giardia lamblia
QKYRDAIGFLKEELAYKDHE

SEQ ID NO: 3181378 - protein, 23 aa, Giardia lamblia
QQQPYIKLLNLQSVPLSLDINGQ

SEQ ID NO: 3181379 - protein, 20 aa, Giardia lamblia
QRNFLVGPALRRSSVYAYAE

SEQ ID NO: 3181380 - protein, 23 aa, Giardia lamblia
QSVRVWMVLLHSGPSVHTVTQPR

SEQ ID NO: 3181381 - protein, 30 aa, Giardia lamblia
QTNLVPYPRIHFPLCSYAPIISSEKAYHEK

SEQ ID NO: 3181382 - protein, 27 aa, Giardia lamblia
RDPTVSVTLLADLYRGTRDASGKTPLM

SEQ ID NO: 3181383 - protein, 26 aa, Giardia lamblia
RERGITINIALWKFETKKYIVTIIDA

SEQ ID NO: 3181384 - protein, 17 aa, Giardia lamblia
RKIAMSRHLFDFHDRAV

SEQ ID NO: 3181385 - protein, 18 aa, Giardia lamblia
RLAFDDVLAALLGLQEGG

SEQ ID NO: 3181386 - protein, 23 aa, Giardia lamblia
RNLPSSLSLVPPFAPTPSAAPNV

SEQ ID NO: 3181387 - protein, 22 aa, Giardia lamblia
RNVYVVVCMHSLKARTRGITAS

SEQ ID NO: 3181388 - protein, 23 aa, Giardia lamblia
RPSSPLQPPPLPGAFRDLQAEYG

SEQ ID NO: 3181389 - protein, 33 aa, Giardia lamblia
RRKPQHVPYRDSQLTYLLQPALGGNSMTCMIAA

SEQ ID NO: 3181390 - protein, 18 aa, Giardia lamblia
RSGAGEWPPLFPVAGWLA

SEQ ID NO: 3181391 - protein, 18 aa, Giardia lamblia
RVHNVFLYMLGHLSTLQV

SEQ ID NO: 3181392 - protein, 24 aa, Giardia lamblia
RVTPMMWASHLYGPKVLWEAYHQI

SEQ ID NO: 3181393 - protein, 24 aa, Giardia lamblia
SAEAPTIRLILNASILNDDGILLS

SEQ ID NO: 3181394 - protein, 17 aa, Giardia lamblia
SELGGQCVMLRYKCGAL

SEQ ID NO: 3181395 - protein, 20 aa, Giardia lamblia
SKLSALVYKAVGRAPVVFDD

SEQ ID NO: 3181396 - protein, 21 aa, Giardia lamblia
SLPTLPARIAGAVLSIPMMDL

SEQ ID NO: 3181397 - protein, 22 aa, Giardia lamblia
SPIVIILSAPLLQYRSQHDLLD

SEQ ID NO: 3181398 - protein, 18 aa, Giardia lamblia
SPLPWGLLETSQEGGLLP

SEQ ID NO: 3181399 - protein, 25 aa, Giardia lamblia
SQHTRRIHAFLAEYLKIHIEAPDRG

SEQ ID NO: 3181400 - protein, 20 aa, Giardia lamblia
SSLVAGLLDPLGHPLCPGVH

SEQ ID NO: 3181401 - protein, 30 aa, Giardia lamblia
SSYGNFLHRYYLKFLQINSMSRITVPLWPQ

SEQ ID NO: 3181402 - protein, 24 aa, Giardia lamblia
TCSECLSGFYLEDACKTCDANCAV

SEQ ID NO: 3181403 - protein, 25 aa, Giardia lamblia
TDVHMVNWWFFSLADRTLACNGYLH

SEQ ID NO: 3181404 - protein, 19 aa, Giardia lamblia
TGCTACEYNPVTKKPKCTA

SEQ ID NO: 3181405 - protein, 33 aa, Giardia lamblia
TGTTAMMFAAHRGFLEIVGALAPFEANLQSTAP

SEQ ID NO: 3181406 - protein, 17 aa, Giardia lamblia
TRVAVRGSRLPLHRSSS

SEQ ID NO: 3181407 - protein, 18 aa, Giardia lamblia
TSFGSPLPWGLLETSQEG

SEQ ID NO: 3181408 - protein, 23 aa, Giardia lamblia
TTNCYFPLTTDRLGIMVFTPPTR

SEQ ID NO: 3181409 - protein, 23 aa, Giardia lamblia
TVTQALYVWSCPTVPVVGYGQPD

SEQ ID NO: 3181410 - protein, 25 aa, Giardia lamblia
VEHGKLEFLIAWRADKHMLAFMARQ

SEQ ID NO: 3181411 - protein, 19 aa, Giardia lamblia
VFMDSVLTYGWAFGSKAVI

SEQ ID NO: 3181412 - protein, 27 aa, Giardia lamblia
VKSHNMAIFRSFFEAFYSLSCSGIDQG

SEQ ID NO: 3181413 - protein, 18 aa, Giardia lamblia
VLFGQDRELYEARLEELR

SEQ ID NO: 3181414 - protein, 19 aa, Giardia lamblia
VRGLLHLLRRCTDAGYPNV

SEQ ID NO: 3181415 - protein, 19 aa, Giardia lamblia
VRIQPVLDRAKANAVLNLV

SEQ ID NO: 3181416 - protein, 20 aa, Giardia lamblia
VSRWYYETHLRHILTIKMTN

SEQ ID NO: 3181417 - protein, 21 aa, Giardia lamblia
VVEFASLRLLLDKDPLSPGVV

SEQ ID NO: 3181418 - protein, 25 aa, Giardia lamblia
VVRGVLAHLLVLEPERRLTAAALVE

SEQ ID NO: 3181419 - protein, 18 aa, Giardia lamblia
VYPIPGVYPAPGAVPYLQ

SEQ ID NO: 3181420 - protein, 17 aa, Giardia lamblia
VYRAARKIAMSRHLFDF

SEQ ID NO: 3181421 - protein, 18 aa, Giardia lamblia
VYVGTLCSLPRPARPRLL

SEQ ID NO: 3181422 - protein, 17 aa, Giardia lamblia
WIIMMRSTRQFRVPWRP

SEQ ID NO: 3181423 - protein, 23 aa, Giardia lamblia
WSLGVIIYELVTLRRPDFLGGKE

SEQ ID NO: 3181424 - protein, 28 aa, Giardia lamblia
WSRMDHKFDLMYAKRAFVHWYVGEGMEE

SEQ ID NO: 3181425 - protein, 20 aa, Giardia lamblia
YKGVANCIQCQAPQSAGAAT

SEQ ID NO: 3181426 - protein, 30 aa, Giardia lamblia
YRNGCTYSLISLFPPLDKLYQLFADAQPAL

SEQ ID NO: 3181427 - protein, 26 aa, Giardia lamblia
AAAAEDFLLADRYKIAYDALGSLLVD

SEQ ID NO: 3181428 - protein, 18 aa, Giardia lamblia
AAAALALLRILSAQVAEE

SEQ ID NO: 3181429 - protein, 30 aa, Giardia lamblia
AAADNNLVATWCYLPIQGGLHDQDGCTALM

SEQ ID NO: 3181430 - protein, 30 aa, Giardia lamblia
AAAHGDVYIVFNLLGLQAKLQDSEGRTALM

SEQ ID NO: 3181431 - protein, 20 aa, Giardia lamblia
AAAHILKLKHLRLIGTEGTS

SEQ ID NO: 3181432 - protein, 29 aa, Giardia lamblia
AAAHPDSCNLVLIKILFGSPEFTRFSHEF

SEQ ID NO: 3181433 - protein, 17 aa, Giardia lamblia
AAALLLPKEACLLNREG

SEQ ID NO: 3181434 - protein, 25 aa, Giardia lamblia
AAANNRPIFCKILVSAEKSISNYRG

SEQ ID NO: 3181435 - protein, 32 aa, Giardia lamblia
AAAPSCPAPPYWPYYSMPPNPGVYSGPEPGAM

SEQ ID NO: 3181436 - protein, 28 aa, Giardia lamblia
AAAQDDIVTCYLLISLQGRLVDESGRTA

SEQ ID NO: 3181437 - protein, 25 aa, Giardia lamblia
AAARAAAVGLLPRGSRESSESAQHQ

SEQ ID NO: 3181438 - protein, 24 aa, Giardia lamblia
AACNGKLNVVNYLIRYKQEITDME

SEQ ID NO: 3181439 - protein, 17 aa, Giardia lamblia
AADAAEILICDLGKTRD

SEQ ID NO: 3181440 - protein, 25 aa, Giardia lamblia
AADALLEMIIVHLPSPKKAQQYRVD

SEQ ID NO: 3181441 - protein, 18 aa, Giardia lamblia
AADIWSLGLIILDLASTL

SEQ ID NO: 3181442 - protein, 29 aa, Giardia lamblia
AADLLPNMEPLMARFDYANRLRSPSPMRQ

SEQ ID NO: 3181443 - protein, 27 aa, Giardia lamblia
AADSGYILTRRICSPLISVRDIRLTSS

SEQ ID NO: 3181444 - protein, 27 aa, Giardia lamblia
AADTPPNLFLSPFFILISDEERMKLQI

SEQ ID NO: 3181445 - protein, 21 aa, Giardia lamblia
AADYRLFNELASRAKDTISAL

SEQ ID NO: 3181446 - protein, 28 aa, Giardia lamblia
AAEAGTMTFYRSRLYLFLVGSEGKKPVI

SEQ ID NO: 3181447 - protein, 25 aa, Giardia lamblia
AAEINRLLMKTENLTRKPLPIQYSD

SEQ ID NO: 3181448 - protein, 24 aa, Giardia lamblia
AAEKRVGLFLTPPKQKLLTNQIDT

SEQ ID NO: 3181449 - protein, 19 aa, Giardia lamblia
AAELLRRVRYEAAAAQFIP

SEQ ID NO: 3181450 - protein, 28 aa, Giardia lamblia
AAENNDVYAVWSLIPTQGALQDAEGITA

SEQ ID NO: 3181451 - protein, 19 aa, Giardia lamblia
AAESYLIPYRIRTGGGYTG

SEQ ID NO: 3181452 - protein, 26 aa, Giardia lamblia
AAEVLIYEAIYLLIAPSLHTNEKLLF

SEQ ID NO: 3181453 - protein, 17 aa, Giardia lamblia
AAEWSFIKCVRALLPRE

SEQ ID NO: 3181454 - protein, 20 aa, Giardia lamblia
AAFEEFVLAQIIRILAPQEG

SEQ ID NO: 3181455 - protein, 17 aa, Giardia lamblia
AAFISYAGGLTGRFRSY

SEQ ID NO: 3181456 - protein, 18 aa, Giardia lamblia
AAFSKRPLGIYKVDARYC

SEQ ID NO: 3181457 - protein, 17 aa, Giardia lamblia
AAFSYNCTIFLDTLPSL

SEQ ID NO: 3181458 - protein, 24 aa, Giardia lamblia
AAGDFQSMILYLGSARDIIHDAID

SEQ ID NO: 3181459 - protein, 23 aa, Giardia lamblia
AAGDLQLAKSFLSQARMSNNDGM

SEQ ID NO: 3181460 - protein, 23 aa, Giardia lamblia
AAGGEYLVMLYRAIYDQLDYQVN

SEQ ID NO: 3181461 - protein, 25 aa, Giardia lamblia
AAGLMPSKGLAYADIPYSASKLQVA

SEQ ID NO: 3181462 - protein, 26 aa, Giardia lamblia
AAGLVLLICIIGDYPFRDVSTFEIVP

SEQ ID NO: 3181463 - protein, 21 aa, Giardia lamblia
AAGMPPGGFPGGMPPGGFPGG

SEQ ID NO: 3181464 - protein, 23 aa, Giardia lamblia
AAGPRLGDPELLVKWSTCRWASC

SEQ ID NO: 3181465 - protein, 26 aa, Giardia lamblia
AAGTPALGKALTSFYSKRIKGLKTSL

SEQ ID NO: 3181466 - protein, 24 aa, Giardia lamblia
AAHHPSLFALSQRPSVRTSYSVGP

SEQ ID NO: 3181467 - protein, 19 aa, Giardia lamblia
AAHIAEPAMRRFYRNYFHA

SEQ ID NO: 3181468 - protein, 27 aa, Giardia lamblia
AAHNNYYSIIPLLLEKEGRMTMIRAYK

SEQ ID NO: 3181469 - protein, 24 aa, Giardia lamblia
AAHNPRPPLPSYLESPPTVDLPGS

SEQ ID NO: 3181470 - protein, 18 aa, Giardia lamblia
AAHWSQWILSALHCSQLS

SEQ ID NO: 3181471 - protein, 29 aa, Giardia lamblia
AAIHIAVFLEDVALVKLLFSYEKDLQLAD

SEQ ID NO: 3181472 - protein, 17 aa, Giardia lamblia
AAIHYAELGGHSGVMAI

SEQ ID NO: 3181473 - protein, 28 aa, Giardia lamblia
AAIIECLPPENWFYHLKIAASYGGEQAI

SEQ ID NO: 3181474 - protein, 27 aa, Giardia lamblia
AAIKSLTDIYPHLSYYLDLLSQDLSKI

SEQ ID NO: 3181475 - protein, 27 aa, Giardia lamblia
AAILHNNYLCIPPLLRYERSITTPDGS

SEQ ID NO: 3181476 - protein, 25 aa, Giardia lamblia
AAINAHPRIYIFQAHLPQNRDAPIE

SEQ ID NO: 3181477 - protein, 27 aa, Giardia lamblia
AAINRDFRLFLTSLPTSKFPQSVLSSS

SEQ ID NO: 3181478 - protein, 17 aa, Giardia lamblia
AAIQSKNPEKRARSTKL

SEQ ID NO: 3181479 - protein, 27 aa, Giardia lamblia
AAISNDLPLCYCLRRLQQGLVDQEKNT

SEQ ID NO: 3181480 - protein, 17 aa, Giardia lamblia
AAIVLPYDMPEYRELPI

SEQ ID NO: 3181481 - protein, 19 aa, Giardia lamblia
AAKIKGNYPTSLPFIVPHA

SEQ ID NO: 3181482 - protein, 18 aa, Giardia lamblia
AAKKKLMPPFYVLSCSCD

SEQ ID NO: 3181483 - protein, 17 aa, Giardia lamblia
AAKLLIDYEGHLTLNMG

SEQ ID NO: 3181484 - protein, 25 aa, Giardia lamblia
AAKNRTHFLILYSLSAAANNPRKAV

SEQ ID NO: 3181485 - protein, 22 aa, Giardia lamblia
AAKRAIVKIHRGMNSDSALEVF

SEQ ID NO: 3181486 - protein, 37 aa, Giardia lamblia
AAKRAYAERLAWFLLLRTRFIGLLSARDQYVRRIRSM

SEQ ID NO: 3181487 - protein, 17 aa, Giardia lamblia
AAKSNALDALRLLCAEE

SEQ ID NO: 3181488 - protein, 22 aa, Giardia lamblia
AAKYIPLKKHREVTGSALSTSA

SEQ ID NO: 3181489 - protein, 32 aa, Giardia lamblia
AALAEGYAKDMTRLHAYLAQQLKAAATVQPSY

SEQ ID NO: 3181490 - protein, 31 aa, Giardia lamblia
AALAKWFQSIVVQDYEYILANLRMAKSCNSE

SEQ ID NO: 3181491 - protein, 30 aa, Giardia lamblia
AALCALPKNRFIQFYPLVFDGDDGYIVMEK

SEQ ID NO: 3181492 - protein, 17 aa, Giardia lamblia
AALCREAGHRCVCRIMQ

SEQ ID NO: 3181493 - protein, 19 aa, Giardia lamblia
AALEKTPWDRFCKIQYDIF

SEQ ID NO: 3181494 - protein, 19 aa, Giardia lamblia
AALEPLYALAKSLAGPSDE

SEQ ID NO: 3181495 - protein, 19 aa, Giardia lamblia
AALEQKLKMEIGVNVRSRL

SEQ ID NO: 3181496 - protein, 21 aa, Giardia lamblia
AALERLPVSQFLLGKVRGSKR

SEQ ID NO: 3181497 - protein, 22 aa, Giardia lamblia
AALEYIIRSPVFKSHTGYNLTS

SEQ ID NO: 3181498 - protein, 18 aa, Giardia lamblia
AALLAMKVGVEPIKGMLG

SEQ ID NO: 3181499 - protein, 23 aa, Giardia lamblia
AALLQQLDDMRLLVSQYAEEESA

SEQ ID NO: 3181500 - protein, 20 aa, Giardia lamblia
AALNIFEHMLVSINGSEEAL

SEQ ID NO: 3181501 - protein, 35 aa, Giardia lamblia
AALPLHVAVRPHGISKHMLLERFENNRKADSELFK

SEQ ID NO: 3181502 - protein, 26 aa, Giardia lamblia
AALPPDEYLREVFRRRFTFEAAIQSS

SEQ ID NO: 3181503 - protein, 32 aa, Giardia lamblia
AALQQIIDAYRVKYLLALKRTTSSGKDADSLC

SEQ ID NO: 3181504 - protein, 19 aa, Giardia lamblia
AAMIKLGMPVPLGFTITCQ

SEQ ID NO: 3181505 - protein, 22 aa, Giardia lamblia
AAMSIVPFNYAFIAIAQSLLDT

SEQ ID NO: 3181506 - protein, 26 aa, Giardia lamblia
AANDELWELLILQNHYHLGVQKALSL

SEQ ID NO: 3181507 - protein, 29 aa, Giardia lamblia
AANKGHINAIRLLLPYEQDLRDKKGRSAA

SEQ ID NO: 3181508 - protein, 23 aa, Giardia lamblia
AANPTIFLRSLPCSKRNGLYGSE

SEQ ID NO: 3181509 - protein, 21 aa, Giardia lamblia
AANPYLVANPYLKPTTQPKNI

SEQ ID NO: 3181510 - protein, 26 aa, Giardia lamblia
AANSYSFLFAFLGLDKILSLDTYLSL

SEQ ID NO: 3181511 - protein, 23 aa, Giardia lamblia
AAPHGYVPMSYPPPPASFFSQAP

SEQ ID NO: 3181512 - protein, 27 aa, Giardia lamblia
AAPSASLSRLPWKPGTTVQIDNLPLPT

SEQ ID NO: 3181513 - protein, 23 aa, Giardia lamblia
AAQGNLPNILFAGGPGLGKTTIA

SEQ ID NO: 3181514 - protein, 24 aa, Giardia lamblia
AAQIYDSLAIKAWAMRMATDTACN

SEQ ID NO: 3181515 - protein, 18 aa, Giardia lamblia
AAQLLDCVVYLHSMFKAN

SEQ ID NO: 3181516 - protein, 24 aa, Giardia lamblia
AAQNGFVNIVKLLCPFEEKIITDK

SEQ ID NO: 3181517 - protein, 25 aa, Giardia lamblia
AAQSLSSLFLILRTRTKNGHASYSL

SEQ ID NO: 3181518 - protein, 22 aa, Giardia lamblia
AAQYHYYIIPTMTNTYVSDSSS

SEQ ID NO: 3181519 - protein, 29 aa, Giardia lamblia
AARAGNIGCIPFLITDSLLVRDCEGRTAL

SEQ ID NO: 3181520 - protein, 17 aa, Giardia lamblia
AARALFIKQIRATLDKV

SEQ ID NO: 3181521 - protein, 17 aa, Giardia lamblia
AARGDTGMVRLLIPVQK

SEQ ID NO: 3181522 - protein, 17 aa, Giardia lamblia
AARGYDVLFSKKERKRI

SEQ ID NO: 3181523 - protein, 28 aa, Giardia lamblia
AARHCCMPALEILLPYEMCYASECLAVA

SEQ ID NO: 3181524 - protein, 23 aa, Giardia lamblia
AARILAPYEYWRRDNNGRTALMM

SEQ ID NO: 3181525 - protein, 17 aa, Giardia lamblia
AARLLIGQLKIELPKRR

SEQ ID NO: 3181526 - protein, 21 aa, Giardia lamblia
AARMNLPGFSLLFLTDQEQGF

SEQ ID NO: 3181527 - protein, 27 aa, Giardia lamblia
AARNRSMDALPILIKTHAPALRDFQGY

SEQ ID NO: 3181528 - protein, 29 aa, Giardia lamblia
AARRPPRWPGVFGPGIRRAIRPSLQFVTV

SEQ ID NO: 3181529 - protein, 27 aa, Giardia lamblia
AARSGHLAVVKLLLPLQQGIVSDTGLT

SEQ ID NO: 3181530 - protein, 27 aa, Giardia lamblia
AARSRPLPLAQLLSKFIRPAAPVSVYS

SEQ ID NO: 3181531 - protein, 24 aa, Giardia lamblia
AASAPALSWLRQPHVLVCRGPAAV

SEQ ID NO: 3181532 - protein, 17 aa, Giardia lamblia
AASARRLSHIASSIPHP

SEQ ID NO: 3181533 - protein, 19 aa, Giardia lamblia
AASFLPPMALSPKPGERIL

SEQ ID NO: 3181534 - protein, 20 aa, Giardia lamblia
AASGLNFDFAEGGKFHNFRA

SEQ ID NO: 3181535 - protein, 25 aa, Giardia lamblia
AASHGNIGLVRKLLFQAKRVKQGGW

SEQ ID NO: 3181536 - protein, 20 aa, Giardia lamblia
AASHLLTRFADSLLLQSPED

SEQ ID NO: 3181537 - protein, 20 aa, Giardia lamblia
AASILSRFLSTNFEGGRHAA

SEQ ID NO: 3181538 - protein, 25 aa, Giardia lamblia
AASKGYLDFVQLLLEKEAGLQANSG

SEQ ID NO: 3181539 - protein, 20 aa, Giardia lamblia
AASPPPPCVLGCAAPPLVPP

SEQ ID NO: 3181540 - protein, 18 aa, Giardia lamblia
AASRDGRLSYWDLDSFLL

SEQ ID NO: 3181541 - protein, 24 aa, Giardia lamblia
AASSLLKRDLTLTPPSHLGSKLKA

SEQ ID NO: 3181542 - protein, 25 aa, Giardia lamblia
AASWRQMWAELYGLPCLPLYDRVRS

SEQ ID NO: 3181543 - protein, 26 aa, Giardia lamblia
AASYDLLALMSLLNKLRRSQPVPSDH

SEQ ID NO: 3181544 - protein, 23 aa, Giardia lamblia
AATCSLSSTLRSALEKSAIHSME

SEQ ID NO: 3181545 - protein, 27 aa, Giardia lamblia
AATLHPHPPPPLYAPGARLPVDYQQDH

SEQ ID NO: 3181546 - protein, 30 aa, Giardia lamblia
AATMSDLFDLGRLFVSHRLPKGDNFVIVTN

SEQ ID NO: 3181547 - protein, 26 aa, Giardia lamblia
AATSVPVWPIVFVSPQFIDQAPSTIC

SEQ ID NO: 3181548 - protein, 29 aa, Giardia lamblia
AATTIQLASLRFLNSLRLQRRRASLLVIK

SEQ ID NO: 3181549 - protein, 27 aa, Giardia lamblia
AATVTLLHGPILTPVYMPVGTQGTLKG

SEQ ID NO: 3181550 - protein, 24 aa, Giardia lamblia
AATWLLKADQPLLGLSAFICAGKF

SEQ ID NO: 3181551 - protein, 26 aa, Giardia lamblia
AATWSFPVHVFSPSSMYLRTSLALLR

SEQ ID NO: 3181552 - protein, 18 aa, Giardia lamblia
AATYAYPASAFSEPSMTP

SEQ ID NO: 3181553 - protein, 29 aa, Giardia lamblia
AAVARVMALPPVLPPNIPAKIVSSPTGLM

SEQ ID NO: 3181554 - protein, 22 aa, Giardia lamblia
AAVFSCLRYSQLYIVLERAIMR

SEQ ID NO: 3181555 - protein, 18 aa, Giardia lamblia
AAVQYHPLYPPKLDVERL

SEQ ID NO: 3181556 - protein, 19 aa, Giardia lamblia
AAVTAELNRRMGRRRDIRV

SEQ ID NO: 3181557 - protein, 25 aa, Giardia lamblia
AAWNGHYSVVKFLMGAEARVMDPYG

SEQ ID NO: 3181558 - protein, 27 aa, Giardia lamblia
AAYNSVALKAFLMPHVPPRQTDSSPTL

SEQ ID NO: 3181559 - protein, 27 aa, Giardia lamblia
ACAQRDIFLLSLLLKLLVAVVSFCDNT

SEQ ID NO: 3181560 - protein, 31 aa, Giardia lamblia
ACCVYAILDYYPKYLLDILNSRKAYGTAVDL

SEQ ID NO: 3181561 - protein, 23 aa, Giardia lamblia
ACDGILELLLITSPPNDATVKRA

SEQ ID NO: 3181562 - protein, 24 aa, Giardia lamblia
ACDRQHLNIVKLLKHREGGLVNNV

SEQ ID NO: 3181563 - protein, 30 aa, Giardia lamblia
ACDRSKYAIRFPLPPLIDPLVSLMQVDDRP

SEQ ID NO: 3181564 - protein, 25 aa, Giardia lamblia
ACEECPVFASILKKNGLPPDTSGIV

SEQ ID NO: 3181565 - protein, 22 aa, Giardia lamblia
ACETILKYGVGWTPLQLERAAE

SEQ ID NO: 3181566 - protein, 18 aa, Giardia lamblia
ACFITLTSGMYKKKNRRI

SEQ ID NO: 3181567 - protein, 26 aa, Giardia lamblia
ACGCYPPMLRLYDLGNTGLKVQRNTD

SEQ ID NO: 3181568 - protein, 25 aa, Giardia lamblia
ACHQLRVFSLSNFTLLAKFVNNPMG

SEQ ID NO: 3181569 - protein, 18 aa, Giardia lamblia
ACHYYLQQMYRRLQPRLI

SEQ ID NO: 3181570 - protein, 17 aa, Giardia lamblia
ACIEPLRLSYPIAKESQ

SEQ ID NO: 3181571 - protein, 26 aa, Giardia lamblia
ACKEFILACLSIDYTFRPSAQSLLQA

SEQ ID NO: 3181572 - protein, 18 aa, Giardia lamblia
ACKTPYLSEWVRGSKLAP

SEQ ID NO: 3181573 - protein, 24 aa, Giardia lamblia
ACLKQLFKITGIVTKLTAPRPSIS

SEQ ID NO: 3181574 - protein, 39 aa, Giardia lamblia
ACLLANWDVIRYFIFEKEISGMTWLMIYAAVGDIEQVKN

SEQ ID NO: 3181575 - protein, 26 aa, Giardia lamblia
ACLYGDLGLYHWLNNDLLSASLALEQ

SEQ ID NO: 3181576 - protein, 32 aa, Giardia lamblia
ACMEPNFVDVYTDLLFALLDNPRGRTVQGDKD

SEQ ID NO: 3181577 - protein, 22 aa, Giardia lamblia
ACNWRLKYEKANAERKEMRARA

SEQ ID NO: 3181578 - protein, 19 aa, Giardia lamblia
ACPTKIRKLPPSDFRLFYD

SEQ ID NO: 3181579 - protein, 25 aa, Giardia lamblia
ACSKLPIYYNPLHTGAIEVTTPDDA

SEQ ID NO: 3181580 - protein, 26 aa, Giardia lamblia
ACSNYSLLWQGYPRGFYLNRTHLGKV

SEQ ID NO: 3181581 - protein, 19 aa, Giardia lamblia
ACSVIYTLDALPGEVLKEI

SEQ ID NO: 3181582 - protein, 29 aa, Giardia lamblia
ACSVPLDRVYPYSYPYPYSGEYAHNFAPD

SEQ ID NO: 3181583 - protein, 19 aa, Giardia lamblia
ACVYYFYGAEVQTLSLRLS

SEQ ID NO: 3181584 - protein, 32 aa, Giardia lamblia
ADACPRPPRGIPPPMWQDLPMQPLKDLEIVES

SEQ ID NO: 3181585 - protein, 24 aa, Giardia lamblia
ADAHYREAPLYRKIGTAVCYRVFK

SEQ ID NO: 3181586 - protein, 28 aa, Giardia lamblia
ADALAPLRSLLQRALLACTFAGPNDHDD

SEQ ID NO: 3181587 - protein, 18 aa, Giardia lamblia
ADALFRRSRHRSDGIEIC

SEQ ID NO: 3181588 - protein, 37 aa, Giardia lamblia
ADALVLKRQYFVLFPNLLLPDLWAPDVTGLMRAAATN

SEQ ID NO: 3181589 - protein, 30 aa, Giardia lamblia
ADAPNNLRIFFIVGYVLKYAERHNGRPIPN

SEQ ID NO: 3181590 - protein, 25 aa, Giardia lamblia
ADAVFFQFPVHWYSSPPSLKVFMDS

SEQ ID NO: 3181591 - protein, 22 aa, Giardia lamblia
ADAVQLLLQLTTLEARKQMETK

SEQ ID NO: 3181592 - protein, 22 aa, Giardia lamblia
ADAYLIDLRSNSIIKAANLPYP

SEQ ID NO: 3181593 - protein, 20 aa, Giardia lamblia
ADCIHECVFLASILDCTLRA

SEQ ID NO: 3181594 - protein, 21 aa, Giardia lamblia
ADCTIIPSSILLKLHLDTCAE

SEQ ID NO: 3181595 - protein, 25 aa, Giardia lamblia
ADDEGLLIYWQSIGVAKAKLYFSDQ

SEQ ID NO: 3181596 - protein, 24 aa, Giardia lamblia
ADDFAMFPSLKECLVRFAKAMELT

SEQ ID NO: 3181597 - protein, 19 aa, Giardia lamblia
ADDKERWRAGQMLDFMVRA

SEQ ID NO: 3181598 - protein, 29 aa, Giardia lamblia
ADDTAYLDILIAAFPRELLPQSIADDVLH

SEQ ID NO: 3181599 - protein, 26 aa, Giardia lamblia
ADDYKEYYYQLKGIWIHLTLTESMEI

SEQ ID NO: 3181600 - protein, 17 aa, Giardia lamblia
ADELRAKIVTMLNLEVS

SEQ ID NO: 3181601 - protein, 44 aa, Giardia lamblia
ADEYTVGFLMARFLVLFCIPLQEYKYIPLPATVVELRAVYPNHT

SEQ ID NO: 3181602 - protein, 20 aa, Giardia lamblia
ADFYHTCVEPLLKDSRPLPP

SEQ ID NO: 3181603 - protein, 25 aa, Giardia lamblia
ADGANFPEQLILKALKLYESIGEYD

SEQ ID NO: 3181604 - protein, 23 aa, Giardia lamblia
ADGKRGFTIIIDDPLDASFIKNV

SEQ ID NO: 3181605 - protein, 23 aa, Giardia lamblia
ADGKRLPSFLKVANVPSGVTFDD

SEQ ID NO: 3181606 - protein, 26 aa, Giardia lamblia
ADGLITKALFNRPTGLASACSGRIIL

SEQ ID NO: 3181607 - protein, 18 aa, Giardia lamblia
ADGLLTRISRRAIDADAA

SEQ ID NO: 3181608 - protein, 22 aa, Giardia lamblia
ADGLVFAFDLTKKVTFRKLSIN

SEQ ID NO: 3181609 - protein, 25 aa, Giardia lamblia
ADGRTALMRAARAGFADIVWLLAPQ

SEQ ID NO: 3181610 - protein, 31 aa, Giardia lamblia
ADGSTALCLALLKGNMPVAKFLTPYEGLDFS

SEQ ID NO: 3181611 - protein, 33 aa, Giardia lamblia
ADGTPYPTTYPIQALFTGWVHAQYHIVPEDRRQ

SEQ ID NO: 3181612 - protein, 21 aa, Giardia lamblia
ADGTVRLWDMRLDNLDQGKAK

SEQ ID NO: 3181613 - protein, 20 aa, Giardia lamblia
ADHKIGLFGSLIVKASVVPE

SEQ ID NO: 3181614 - protein, 17 aa, Giardia lamblia
ADHLIIITMLHASPCSY

SEQ ID NO: 3181615 - protein, 32 aa, Giardia lamblia
ADHVIRCIKLSDYGFLRFPADVYSHDLSYCLY

SEQ ID NO: 3181616 - protein, 34 aa, Giardia lamblia
ADIAFGFNIYPLIMPICRRLFEITTRLNCVDIVT

SEQ ID NO: 3181617 - protein, 19 aa, Giardia lamblia
ADIELYLKKSLDEVIRACK

SEQ ID NO: 3181618 - protein, 22 aa, Giardia lamblia
ADIHDLIKELTVLSDQIRIKEK

SEQ ID NO: 3181619 - protein, 30 aa, Giardia lamblia
ADIIVQPYNSILTLQRLALCADAVVVLDNT

SEQ ID NO: 3181620 - protein, 25 aa, Giardia lamblia
ADIIYHLYDMFVEHLKQYKLERREA

SEQ ID NO: 3181621 - protein, 30 aa, Giardia lamblia
ADILCPHCLYFLPCILKIRDRSHLIVVFFE

SEQ ID NO: 3181622 - protein, 29 aa, Giardia lamblia
ADIRELIDWDYYLARLSGAIYKIIVVPSG

SEQ ID NO: 3181623 - protein, 24 aa, Giardia lamblia
ADISLHLILGINFETPFTDSDLPE

SEQ ID NO: 3181624 - protein, 21 aa, Giardia lamblia
ADIVELLLPYEAHIRATKGFT

SEQ ID NO: 3181625 - protein, 22 aa, Giardia lamblia
ADIVQILIPYERGMMRVDGGIA

SEQ ID NO: 3181626 - protein, 28 aa, Giardia lamblia
ADIWSLGCVIFHLCSLEFPFQAMTHADL

SEQ ID NO: 3181627 - protein, 32 aa, Giardia lamblia
ADIWSLGITLYEICSFRLPYPSPTIDDLQKRI

SEQ ID NO: 3181628 - protein, 17 aa, Giardia lamblia
ADKFLWSAASLMDRLQH

SEQ ID NO: 3181629 - protein, 26 aa, Giardia lamblia
ADKFRFEYELFLRRLARKLHDTGSIL

SEQ ID NO: 3181630 - protein, 25 aa, Giardia lamblia
ADKIKLIKNLLPKVDKIIICGGMSF

SEQ ID NO: 3181631 - protein, 22 aa, Giardia lamblia
ADKISAWRYAAVPVLAPLLNGQ

SEQ ID NO: 3181632 - protein, 20 aa, Giardia lamblia
ADKSAIIQNLERRLQEIRNS

SEQ ID NO: 3181633 - protein, 26 aa, Giardia lamblia
ADLDTLRMLVPYSLNSSLPTNEDAPD

SEQ ID NO: 3181634 - protein, 23 aa, Giardia lamblia
ADLEEILPIKRPSIYINRSDIER

SEQ ID NO: 3181635 - protein, 19 aa, Giardia lamblia
ADLETDSMFGFDSPPAPAD

SEQ ID NO: 3181636 - protein, 25 aa, Giardia lamblia
ADLGSWPLLGPRYRVDILGACTEAF

SEQ ID NO: 3181637 - protein, 32 aa, Giardia lamblia
ADLMNQSHFPRLTDVPLPLNCYSRMYVPLDPV

SEQ ID NO: 3181638 - protein, 23 aa, Giardia lamblia
ADLPTILARLTTLEKELLANKDM

SEQ ID NO: 3181639 - protein, 18 aa, Giardia lamblia
ADLSFLQATVIRLEEEKS

SEQ ID NO: 3181640 - protein, 22 aa, Giardia lamblia
ADLVNISVFLKLKADILEVLQK

SEQ ID NO: 3181641 - protein, 17 aa, Giardia lamblia
ADMAIDIDSMISAALVP

SEQ ID NO: 3181642 - protein, 31 aa, Giardia lamblia
ADMPRIHRAPSFPGLQPHYYPDPAHNASHQI

SEQ ID NO: 3181643 - protein, 24 aa, Giardia lamblia
ADMWSLGIVLYELSSKLKTPFLLE

SEQ ID NO: 3181644 - protein, 21 aa, Giardia lamblia
ADMWSLGVILYELATKNRPEF

SEQ ID NO: 3181645 - protein, 25 aa, Giardia lamblia
ADNAFLTDFVLDTKLFSSGLDEATL

SEQ ID NO: 3181646 - protein, 25 aa, Giardia lamblia
ADNAILPKIRKLGILLDGKLNKLLL

SEQ ID NO: 3181647 - protein, 23 aa, Giardia lamblia
ADNALTESLTLNGWDMLDTNDGV

SEQ ID NO: 3181648 - protein, 25 aa, Giardia lamblia
ADNANPHYFFVGPTGFMTAVEEQLK

SEQ ID NO: 3181649 - protein, 23 aa, Giardia lamblia
ADNEEGFLFKCKRDRKVINVNPT

SEQ ID NO: 3181650 - protein, 17 aa, Giardia lamblia
ADNEQLLLDIRGGACVK

SEQ ID NO: 3181651 - protein, 24 aa, Giardia lamblia
ADNERFALYSILDPTILITDQTIL

SEQ ID NO: 3181652 - protein, 17 aa, Giardia lamblia
ADNKKLVTIIQAKEANI

SEQ ID NO: 3181653 - protein, 17 aa, Giardia lamblia
ADNLLLKDAFRHQREER

SEQ ID NO: 3181654 - protein, 17 aa, Giardia lamblia
ADNLRQFFLQNDKAKTG

SEQ ID NO: 3181655 - protein, 22 aa, Giardia lamblia
ADPFSPLRRGLFGLICDYDSKT

SEQ ID NO: 3181656 - protein, 22 aa, Giardia lamblia
ADQLGHPLPPHGPPQLQKNYVT

SEQ ID NO: 3181657 - protein, 24 aa, Giardia lamblia
ADQPMPHIYPLGASLLTEEFLAKA

SEQ ID NO: 3181658 - protein, 19 aa, Giardia lamblia
ADRASRALALLVRAYVGRD

SEQ ID NO: 3181659 - protein, 17 aa, Giardia lamblia
ADRFINNMKFIVSTATS

SEQ ID NO: 3181660 - protein, 18 aa, Giardia lamblia
ADRKVLLAAGFSATTVYD

SEQ ID NO: 3181661 - protein, 20 aa, Giardia lamblia
ADRSVPVGALLTLLEKGMQL

SEQ ID NO: 3181662 - protein, 26 aa, Giardia lamblia
ADSAMSHTLLFKLGTTEDLMAHTEVT

SEQ ID NO: 3181663 - protein, 25 aa, Giardia lamblia
ADSDPWLSLLHEFKQHYTGKTTRFP

SEQ ID NO: 3181664 - protein, 26 aa, Giardia lamblia
ADSVHKWVNVATMLRPLAIGTVKTHV

SEQ ID NO: 3181665 - protein, 19 aa, Giardia lamblia
ADTAILVISARKGEFESGF

SEQ ID NO: 3181666 - protein, 24 aa, Giardia lamblia
ADTGLYAYSTFLSAPSLIERLIFV

SEQ ID NO: 3181667 - protein, 33 aa, Giardia lamblia
ADTNIFVENLGWDPIPLTDRIHLMSAGYLVGDK

SEQ ID NO: 3181668 - protein, 25 aa, Giardia lamblia
ADTQSFLLRVAKLLIKIYYDILQLP

SEQ ID NO: 3181669 - protein, 24 aa, Giardia lamblia
ADTVLALIDFKLPTSPHMFANSPF

SEQ ID NO: 3181670 - protein, 24 aa, Giardia lamblia
ADVDQLGFLKYYTKLGDCIIHLAE

SEQ ID NO: 3181671 - protein, 20 aa, Giardia lamblia
ADVFALYARTEGCYLFENVA

SEQ ID NO: 3181672 - protein, 19 aa, Giardia lamblia
ADVLCWEPLYDGGRFLLKQ

SEQ ID NO: 3181673 - protein, 21 aa, Giardia lamblia
ADVLKGCTFNWMPTKELPRHT

SEQ ID NO: 3181674 - protein, 20 aa, Giardia lamblia
ADVLSFCHTPDKSYFPELGV

SEQ ID NO: 3181675 - protein, 27 aa, Giardia lamblia
ADWLKIETYMIGRIVLLLCDLSPVMLA

SEQ ID NO: 3181676 - protein, 23 aa, Giardia lamblia
ADYDQLLRKLVLAEARKLDNDGC

SEQ ID NO: 3181677 - protein, 27 aa, Giardia lamblia
AEAGHLPLVSLLLPKEGRMKRTDGTTA

SEQ ID NO: 3181678 - protein, 34 aa, Giardia lamblia
AEAGLLFKKLARLIPFKGFAGPNGLLWVTGSTLY

SEQ ID NO: 3181679 - protein, 18 aa, Giardia lamblia
AEAGLLKCTIHHPVGPEA

SEQ ID NO: 3181680 - protein, 20 aa, Giardia lamblia
AEAKRKLALSLSMSIAAQDV

SEQ ID NO: 3181681 - protein, 24 aa, Giardia lamblia
AEAKRMATETLAEIAKLRLAREKE

SEQ ID NO: 3181682 - protein, 37 aa, Giardia lamblia
AEALLPYEDFIVVALLMNLVVLPRKDFLALLQTSSDT

SEQ ID NO: 3181683 - protein, 22 aa, Giardia lamblia
AEALLVHFLSAMNALRLTDDRT

SEQ ID NO: 3181684 - protein, 41 aa, Giardia lamblia
AEALSMLNFLSRCSSYFANPQLFFRCTAQFLTYRGSLNASS

SEQ ID NO: 3181685 - protein, 19 aa, Giardia lamblia
AEARLSRPDGWFALMFATQ

SEQ ID NO: 3181686 - protein, 17 aa, Giardia lamblia
AEAYVVYRSLRREYYTH

SEQ ID NO: 3181687 - protein, 28 aa, Giardia lamblia
AECDSVESLIILMLYERRLGDTKGMTAL

SEQ ID NO: 3181688 - protein, 23 aa, Giardia lamblia
AECGWVDIVRTLMPREARLRDDF

SEQ ID NO: 3181689 - protein, 24 aa, Giardia lamblia
AECVRLWREQYTKPCPVPKGAPLP

SEQ ID NO: 3181690 - protein, 29 aa, Giardia lamblia
AEDAQARTQFWGYRPYGASLLIGGIDTRN

SEQ ID NO: 3181691 - protein, 30 aa, Giardia lamblia
AEDKCLTCKTGFFLVEVTQPAGKCVSCSDT

SEQ ID NO: 3181692 - protein, 24 aa, Giardia lamblia
AEDKVWAILAQLLDAAAACQRLYR

SEQ ID NO: 3181693 - protein, 24 aa, Giardia lamblia
AEDKYPVLEALELGMKTLETIMIQ

SEQ ID NO: 3181694 - protein, 17 aa, Giardia lamblia
AEDLPTENAFRLSNEDI

SEQ ID NO: 3181695 - protein, 24 aa, Giardia lamblia
AEDRLLLMALLLHDGNYELIQSKY

SEQ ID NO: 3181696 - protein, 23 aa, Giardia lamblia
AEDSWFMYLKQECFYTRETTALV

SEQ ID NO: 3181697 - protein, 20 aa, Giardia lamblia
AEEIKSLLHRAELRALAAVS

SEQ ID NO: 3181698 - protein, 27 aa, Giardia lamblia
AEEKAKWYLILESWKDSLKDYNTGTLL

SEQ ID NO: 3181699 - protein, 27 aa, Giardia lamblia
AEEKEGLLKLVSQLKLTINELTLAKQE

SEQ ID NO: 3181700 - protein, 25 aa, Giardia lamblia
AEEKHLYILDEFNDLFENSDEDEYY

SEQ ID NO: 3181701 - protein, 26 aa, Giardia lamblia
AEEKIWSVFVQLLHALNYCHSIHSED

SEQ ID NO: 3181702 - protein, 27 aa, Giardia lamblia
AEEKIWSVFVQLLHALNYCHSLHKHDD

SEQ ID NO: 3181703 - protein, 21 aa, Giardia lamblia
AEELLGFLPRDSFPSTYPVFK

SEQ ID NO: 3181704 - protein, 19 aa, Giardia lamblia
AEEMIWGYIAQLAEVLSVM

SEQ ID NO: 3181705 - protein, 29 aa, Giardia lamblia
AEERERCLAEALADLKKLKADMGYLQTEL

SEQ ID NO: 3181706 - protein, 18 aa, Giardia lamblia
AEERLLAANRFLTQRERE

SEQ ID NO: 3181707 - protein, 25 aa, Giardia lamblia
AEFDFNYSFLHQTLTDLKKIMLTAS

SEQ ID NO: 3181708 - protein, 21 aa, Giardia lamblia
AEFDPAVHVLEAALRQAEIMN

SEQ ID NO: 3181709 - protein, 34 aa, Giardia lamblia
AEFGAMFYMHSLTLQNFPLILRAIETSEPGQRAT

SEQ ID NO: 3181710 - protein, 17 aa, Giardia lamblia
AEFLTYLASKNIAIGIA

SEQ ID NO: 3181711 - protein, 19 aa, Giardia lamblia
AEGFARISAAIEKETIARE

SEQ ID NO: 3181712 - protein, 18 aa, Giardia lamblia
AEGLSYMSLQKYVDNRNL

SEQ ID NO: 3181713 - protein, 22 aa, Giardia lamblia
AEGNYGCILCRTGKEPVGIGKL

SEQ ID NO: 3181714 - protein, 20 aa, Giardia lamblia
AEGPVLRLFAMAPTTDTSVV

SEQ ID NO: 3181715 - protein, 25 aa, Giardia lamblia
AEGRRRILYSFMSPELPELLALYPE

SEQ ID NO: 3181716 - protein, 23 aa, Giardia lamblia
AEGVIHNMLDFVKLLYNERIVKA

SEQ ID NO: 3181717 - protein, 24 aa, Giardia lamblia
AEHELNLYSLIEHPVRNGPAPSED

SEQ ID NO: 3181718 - protein, 17 aa, Giardia lamblia
AEHSSIIWDCCWHCTGT

SEQ ID NO: 3181719 - protein, 29 aa, Giardia lamblia
AEHYRKDMIRLLYPYEHGLLPDAEKIVLA

SEQ ID NO: 3181720 - protein, 26 aa, Giardia lamblia
AEIEEARLRATLEKKERAREARLREE

SEQ ID NO: 3181721 - protein, 22 aa, Giardia lamblia
AEIETLHKQESLLRNLRAQDSG

SEQ ID NO: 3181722 - protein, 26 aa, Giardia lamblia
AEIGRLQNLLMLMADRSLDNDAAKNS

SEQ ID NO: 3181723 - protein, 25 aa, Giardia lamblia
AEIHAKCLVRIKDNIKRLSVSKAQI

SEQ ID NO: 3181724 - protein, 32 aa, Giardia lamblia
AEIHSKFEAVTKKLLYFSMHAQQLVSLHHTFI

SEQ ID NO: 3181725 - protein, 24 aa, Giardia lamblia
AEIKILKSLYYRPSVTQKFDEVIM

SEQ ID NO: 3181726 - protein, 18 aa, Giardia lamblia
AEILICDLGKTRDALGRA

SEQ ID NO: 3181727 - protein, 18 aa, Giardia lamblia
AEILLKSLSVDCAIFSAV

SEQ ID NO: 3181728 - protein, 24 aa, Giardia lamblia
AEINRLNDELTWINGQILEERSKV

SEQ ID NO: 3181729 - protein, 23 aa, Giardia lamblia
AEIQRLLSFPLTALSSYQYEVPP

SEQ ID NO: 3181730 - protein, 29 aa, Giardia lamblia
AEIQTRLNLLDMKLLFAQMRVSTSSASTQ

SEQ ID NO: 3181731 - protein, 24 aa, Giardia lamblia
AEIVLYLRVKGGIIPAPNALGPKI

SEQ ID NO: 3181732 - protein, 27 aa, Giardia lamblia
AEKALLPIVCLLWNRARLEPSSTRLAV

SEQ ID NO: 3181733 - protein, 19 aa, Giardia lamblia
AEKCDLSYVLCARRIPKQV

SEQ ID NO: 3181734 - protein, 27 aa, Giardia lamblia
AEKGYKKLIRLLLQLEAKIHDKHGLTA

SEQ ID NO: 3181735 - protein, 28 aa, Giardia lamblia
AEKIGHIIRSYWPQPQVLHVFMEFEFPT

SEQ ID NO: 3181736 - protein, 17 aa, Giardia lamblia
AEKKLLVDELSRAKTEA

SEQ ID NO: 3181737 - protein, 20 aa, Giardia lamblia
AEKKLPSLASFPEGIPSLGQ

SEQ ID NO: 3181738 - protein, 24 aa, Giardia lamblia
AEKNDLVTVWILIPNEGCIQDSRG

SEQ ID NO: 3181739 - protein, 28 aa, Giardia lamblia
AEKRKVSRLPAPSAEFRSSARSADLHLP

SEQ ID NO: 3181740 - protein, 23 aa, Giardia lamblia
AEKRLQSEHLYILCFSWDKTMLC

SEQ ID NO: 3181741 - protein, 19 aa, Giardia lamblia
AEKSGGFIDYASIRLVKPG

SEQ ID NO: 3181742 - protein, 25 aa, Giardia lamblia
AEKSPITRVLGLAQPILSTASIQNR

SEQ ID NO: 3181743 - protein, 32 aa, Giardia lamblia
AEKSVLMAYLVIRYRYPTIIFVKTIDQAKNFT

SEQ ID NO: 3181744 - protein, 18 aa, Giardia lamblia
AELAALKPHILTVAGRMA

SEQ ID NO: 3181745 - protein, 17 aa, Giardia lamblia
AELAGATTGLRAVTDDD

SEQ ID NO: 3181746 - protein, 22 aa, Giardia lamblia
AELDEVLTVLPSPGPPGSPPEA

SEQ ID NO: 3181747 - protein, 23 aa, Giardia lamblia
AELDTMIAAERARWRQLAGDRPD

SEQ ID NO: 3181748 - protein, 25 aa, Giardia lamblia
AELEELRAYHDFIKPQVMEQKLEEM

SEQ ID NO: 3181749 - protein, 27 aa, Giardia lamblia
AELGRNEFILYLLPFENGREINGATAL

SEQ ID NO: 3181750 - protein, 25 aa, Giardia lamblia
AELGYLLCCLPLLQYERSIVDSHGC

SEQ ID NO: 3181751 - protein, 22 aa, Giardia lamblia
AELHPYSWYFEAPQDVLDGYGL

SEQ ID NO: 3181752 - protein, 23 aa, Giardia lamblia
AELIARKPLFPGRDYIHQLHLIL

SEQ ID NO: 3181753 - protein, 18 aa, Giardia lamblia
AELIKQLQLREDPLRIMG

SEQ ID NO: 3181754 - protein, 17 aa, Giardia lamblia
AELKLKDKVISGLLSTI

SEQ ID NO: 3181755 - protein, 17 aa, Giardia lamblia
AELLGHPLLADIRKNLG

SEQ ID NO: 3181756 - protein, 17 aa, Giardia lamblia
AELPLKTHLGETALSLA

SEQ ID NO: 3181757 - protein, 21 aa, Giardia lamblia
AELQSLSCVFFIAVEKHISKE

SEQ ID NO: 3181758 - protein, 30 aa, Giardia lamblia
AELQWMSPGLLLQRSLIVCTLPTTLSKERV

SEQ ID NO: 3181759 - protein, 27 aa, Giardia lamblia
AELSQFQIKLLTKLLTKFPSALLVSYS

SEQ ID NO: 3181760 - protein, 22 aa, Giardia lamblia
AELSRLTNLLEATRKDYVQRLE

SEQ ID NO: 3181761 - protein, 20 aa, Giardia lamblia
AELYKIRITIPEEQVAMLSR

SEQ ID NO: 3181762 - protein, 18 aa, Giardia lamblia
AEMKLPYVRFSTSMSIVE

SEQ ID NO: 3181763 - protein, 25 aa, Giardia lamblia
AENFCRLIIMLVRSPVRLKKLQQHI

SEQ ID NO: 3181764 - protein, 17 aa, Giardia lamblia
AENFDQLTWREKVRIEK

SEQ ID NO: 3181765 - protein, 24 aa, Giardia lamblia
AENGELLRENLMLKDIISQKELHI

SEQ ID NO: 3181766 - protein, 25 aa, Giardia lamblia
AENIALPDSLLSRYDLVFLVRDDHT

SEQ ID NO: 3181767 - protein, 24 aa, Giardia lamblia
AENKPPVLAALFSGSADISSGSHG

SEQ ID NO: 3181768 - protein, 20 aa, Giardia lamblia
AENPLVVFSPRAEEYITQVS

SEQ ID NO: 3181769 - protein, 24 aa, Giardia lamblia
AENQRIHRQISSVKPTHSVQKLEA

SEQ ID NO: 3181770 - protein, 30 aa, Giardia lamblia
AEPEVHRLYFRTYYRVLKACLYGDLGLYHW

SEQ ID NO: 3181771 - protein, 21 aa, Giardia lamblia
AEQLDPILTPILEKDIRDSSG

SEQ ID NO: 3181772 - protein, 17 aa, Giardia lamblia
AERDAMNLTYKLVAFVL

SEQ ID NO: 3181773 - protein, 21 aa, Giardia lamblia
AERGIFFYRVSAKDLSLTSLF

SEQ ID NO: 3181774 - protein, 24 aa, Giardia lamblia
AERLLLHKCSELWQLALVGVMNED

SEQ ID NO: 3181775 - protein, 24 aa, Giardia lamblia
AERQYNFIIAELPTFKCSKNAHGN

SEQ ID NO: 3181776 - protein, 20 aa, Giardia lamblia
AERSIYIVDPMLATAGSVIA

SEQ ID NO: 3181777 - protein, 26 aa, Giardia lamblia
AESDYVRFLFLTTSTAIFCVPLPTSK

SEQ ID NO: 3181778 - protein, 17 aa, Giardia lamblia
AESIRLALSLSLHGMPH

SEQ ID NO: 3181779 - protein, 25 aa, Giardia lamblia
AESLARRPLLLHRHVLRTAIDWKKI

SEQ ID NO: 3181780 - protein, 27 aa, Giardia lamblia
AESLILYNFFVMPYILPDTEYKTHEQS

SEQ ID NO: 3181781 - protein, 22 aa, Giardia lamblia
AESLKLVMDAPITHHAKLTLAR

SEQ ID NO: 3181782 - protein, 25 aa, Giardia lamblia
AESLRFQGAFPVARERPLQPGVGRP

SEQ ID NO: 3181783 - protein, 25 aa, Giardia lamblia
AESVAKYLPILKKNSEERRFNQMMM

SEQ ID NO: 3181784 - protein, 23 aa, Giardia lamblia
AETALLRHAILAVRRVVQPMMLA

SEQ ID NO: 3181785 - protein, 23 aa, Giardia lamblia
AETCLRFISYMKKSPIENVKEEL

SEQ ID NO: 3181786 - protein, 28 aa, Giardia lamblia
AETEHYHYQMYLPNLLKYIISLDHTYFS

SEQ ID NO: 3181787 - protein, 35 aa, Giardia lamblia
AETKRYLAILYTNLGLIYYRIGIPTYYKQARRCFE

SEQ ID NO: 3181788 - protein, 22 aa, Giardia lamblia
AETLHEHLISPQSIKSAPNSTE

SEQ ID NO: 3181789 - protein, 25 aa, Giardia lamblia
AETPSIPILKLAPGESINALLYARK

SEQ ID NO: 3181790 - protein, 18 aa, Giardia lamblia
AETRKWLLQAALHSFVVQ

SEQ ID NO: 3181791 - protein, 18 aa, Giardia lamblia
AEVALEQKLTLPSSFADL

SEQ ID NO: 3181792 - protein, 18 aa, Giardia lamblia
AEVLYPLEQAKAKITPLM

SEQ ID NO: 3181793 - protein, 18 aa, Giardia lamblia
AEVQLFLRPPATSLEEIC

SEQ ID NO: 3181794 - protein, 27 aa, Giardia lamblia
AEVSCNASFLLPLKPLFGALSEQMDPV

SEQ ID NO: 3181795 - protein, 33 aa, Giardia lamblia
AEVSKRPAAACTKYLLGWQPVNRLKNTKSASMS

SEQ ID NO: 3181796 - protein, 25 aa, Giardia lamblia
AEVVNLISRLPIPQGTVSVPGEENP

SEQ ID NO: 3181797 - protein, 18 aa, Giardia lamblia
AEWLFQTGQYDKATQHYL

SEQ ID NO: 3181798 - protein, 27 aa, Giardia lamblia
AEWYNPDLLAVLPASCFDLCRKLLEFD

SEQ ID NO: 3181799 - protein, 18 aa, Giardia lamblia
AEYIVVLVANFHFYSHYA

SEQ ID NO: 3181800 - protein, 18 aa, Giardia lamblia
AEYRKTLSAKGLLHDEVQ

SEQ ID NO: 3181801 - protein, 28 aa, Giardia lamblia
AEYRTSLPDFVKFRTLYKSLPIDEIDAM

SEQ ID NO: 3181802 - protein, 26 aa, Giardia lamblia
AFAKHKSILFLNNISTALLKMEKITE

SEQ ID NO: 3181803 - protein, 18 aa, Giardia lamblia
AFALTCLFHNKRKTIEDC

SEQ ID NO: 3181804 - protein, 17 aa, Giardia lamblia
AFAQLILHILKSSCNSL

SEQ ID NO: 3181805 - protein, 23 aa, Giardia lamblia
AFAVVLLYHTARKIRGLFPLCLI

SEQ ID NO: 3181806 - protein, 18 aa, Giardia lamblia
AFDIAMDNNFVFLARLIA

SEQ ID NO: 3181807 - protein, 17 aa, Giardia lamblia
AFDKATGKLFCKVCNQR

SEQ ID NO: 3181808 - protein, 20 aa, Giardia lamblia
AFDRLIKFYRKSGHMFRNLS

SEQ ID NO: 3181809 - protein, 17 aa, Giardia lamblia
AFEDILVHTRRIVAILN

SEQ ID NO: 3181810 - protein, 20 aa, Giardia lamblia
AFEIIPLTLAENAGLSPITT

SEQ ID NO: 3181811 - protein, 26 aa, Giardia lamblia
AFFETDDFPRIFFYANSRDDLCITHL

SEQ ID NO: 3181812 - protein, 21 aa, Giardia lamblia
AFGALQTDYEEKCGFIVQLEQ

SEQ ID NO: 3181813 - protein, 17 aa, Giardia lamblia
AFGERLVIFTTFASLNR

SEQ ID NO: 3181814 - protein, 24 aa, Giardia lamblia
AFGEYFINHYLNFNAKVPSLNELT

SEQ ID NO: 3181815 - protein, 23 aa, Giardia lamblia
AFHFEPYFARLKKEKLKDILSEN

SEQ ID NO: 3181816 - protein, 36 aa, Giardia lamblia
AFHKRLQRNFPSITLPKLPQDRPWALGGNKLKFVQE

SEQ ID NO: 3181817 - protein, 20 aa, Giardia lamblia
AFHVPMQRPPSQAVPFIGSM

SEQ ID NO: 3181818 - protein, 19 aa, Giardia lamblia
AFIGSLIEKGYALPVTVIE

SEQ ID NO: 3181819 - protein, 18 aa, Giardia lamblia
AFILLKMSEKIRNALLNF

SEQ ID NO: 3181820 - protein, 34 aa, Giardia lamblia
AFISALHNHFHVPGPFLIVVPISTLSAWQMALSD

SEQ ID NO: 3181821 - protein, 28 aa, Giardia lamblia
AFIYSTYTHICYMLPFISPTASEANRLA

SEQ ID NO: 3181822 - protein, 24 aa, Giardia lamblia
AFKTEPLPQFAMNYPALCITAGFK

SEQ ID NO: 3181823 - protein, 19 aa, Giardia lamblia
AFKTVYRAFDLIAGREVAW

SEQ ID NO: 3181824 - protein, 19 aa, Giardia lamblia
AFLQLRHAAPLDSVPRGPE

SEQ ID NO: 3181825 - protein, 18 aa, Giardia lamblia
AFNIQPYDTYHNPRMMRV

SEQ ID NO: 3181826 - protein, 19 aa, Giardia lamblia
AFNSTPVDALLYAAPETVL

SEQ ID NO: 3181827 - protein, 19 aa, Giardia lamblia
AFPLVLNKFSIETIPCSVT

SEQ ID NO: 3181828 - protein, 27 aa, Giardia lamblia
AFPQCVFSHYALIPSSPLQTGSQAQGI

SEQ ID NO: 3181829 - protein, 26 aa, Giardia lamblia
AFQALYDFDFSLFDLTIFAADYLTRY

SEQ ID NO: 3181830 - protein, 18 aa, Giardia lamblia
AFRLYPMKDAVEATEAAF

SEQ ID NO: 3181831 - protein, 30 aa, Giardia lamblia
AFRYRELYSLLSCMLIINPDKRPPVELLLD

SEQ ID NO: 3181832 - protein, 34 aa, Giardia lamblia
AFSIRAKQQILLLQAIGLLLMKDFNIKLAEERDK

SEQ ID NO: 3181833 - protein, 18 aa, Giardia lamblia
AFSLLNRTLTDLSISQSG

SEQ ID NO: 3181834 - protein, 22 aa, Giardia lamblia
AFSLLSNKRLFAYPTTGNQVMH

SEQ ID NO: 3181835 - protein, 23 aa, Giardia lamblia
AFSNPFLLTYPSFAEPLTIFCNN

SEQ ID NO: 3181836 - protein, 19 aa, Giardia lamblia
AFSRFVHAFLAPGSHPRHV

SEQ ID NO: 3181837 - protein, 23 aa, Giardia lamblia
AFSSLPRPLIIDRLESICYAEMH

SEQ ID NO: 3181838 - protein, 24 aa, Giardia lamblia
AFTERFPFLRFDASSYYRGVTPSK

SEQ ID NO: 3181839 - protein, 21 aa, Giardia lamblia
AFTIGMLQRIDIGLKSPQAII

SEQ ID NO: 3181840 - protein, 39 aa, Giardia lamblia
AFVAFSSVLTRSIFLANPILFMASLLSLSLSSPEFLPLI

SEQ ID NO: 3181841 - protein, 19 aa, Giardia lamblia
AFVEIYRILRPAGKALVTL

SEQ ID NO: 3181842 - protein, 25 aa, Giardia lamblia
AFVGTWFRPDHVYLLNATDPTQFED

SEQ ID NO: 3181843 - protein, 19 aa, Giardia lamblia
AFVNLTRWLNTVQALSGVS

SEQ ID NO: 3181844 - protein, 18 aa, Giardia lamblia
AFVRASCPSSVWARRGPW

SEQ ID NO: 3181845 - protein, 21 aa, Giardia lamblia
AGAQRQLPVGVAPISQVSLNN

SEQ ID NO: 3181846 - protein, 18 aa, Giardia lamblia
AGAQYRGQFEERLKAILD

SEQ ID NO: 3181847 - protein, 20 aa, Giardia lamblia
AGASVFCLNCQGWLCSRCEA

SEQ ID NO: 3181848 - protein, 20 aa, Giardia lamblia
AGAVPFLIAAAQEPELSLKR

SEQ ID NO: 3181849 - protein, 24 aa, Giardia lamblia
AGAWSCLVFDLMEITRSCFPNSEF

SEQ ID NO: 3181850 - protein, 22 aa, Giardia lamblia
AGAYPYRKLSPLDAKIVSVARP

SEQ ID NO: 3181851 - protein, 20 aa, Giardia lamblia
AGCNGTIFCYGQTGAGKSYT

SEQ ID NO: 3181852 - protein, 27 aa, Giardia lamblia
AGDAADSFLFKMTLDPIKNMQALLSDS

SEQ ID NO: 3181853 - protein, 31 aa, Giardia lamblia
AGDDRTIMIWNLTPPIRAFKFVGHNDTVVGS

SEQ ID NO: 3181854 - protein, 21 aa, Giardia lamblia
AGDLLIPIEEGVFSADRVIGE

SEQ ID NO: 3181855 - protein, 18 aa, Giardia lamblia
AGDLLQLPFIQRIMQEKI

SEQ ID NO: 3181856 - protein, 18 aa, Giardia lamblia
AGDSEGCLYFLNISQIIS

SEQ ID NO: 3181857 - protein, 40 aa, Giardia lamblia
AGDTLLHWAVRVRAKSCIPKLLVQFGLLKNNDGLTAAQLA

SEQ ID NO: 3181858 - protein, 25 aa, Giardia lamblia
AGEGTYFNRLLTHTPASGQSGGVLT

SEQ ID NO: 3181859 - protein, 20 aa, Giardia lamblia
AGEIDFSPKLYLTEFRELHK

SEQ ID NO: 3181860 - protein, 20 aa, Giardia lamblia
AGELRLLQHKIGVAETELIQ

SEQ ID NO: 3181861 - protein, 17 aa, Giardia lamblia
AGEQYVLKHLSVSDLKV

SEQ ID NO: 3181862 - protein, 25 aa, Giardia lamblia
AGFADIVWLLAPQEAGMQLINDTEL

SEQ ID NO: 3181863 - protein, 32 aa, Giardia lamblia
AGFDNRTLLSVKQLLYELTGFNLLGHQDGFTE

SEQ ID NO: 3181864 - protein, 21 aa, Giardia lamblia
AGFINFKKGLYPGSSLLVINP

SEQ ID NO: 3181865 - protein, 17 aa, Giardia lamblia
AGFNPMASFQRMMDHMN

SEQ ID NO: 3181866 - protein, 49 aa, Giardia lamblia
AGFVGRWHERLPSKFTALILACYHGRLKAATILLPFEGGMKDSIGRGPK

SEQ ID NO: 3181867 - protein, 24 aa, Giardia lamblia
AGGARLRVWAWKPDLSNFSQTYEW

SEQ ID NO: 3181868 - protein, 26 aa, Giardia lamblia
AGGEDFLCFYELDIQGRVFRENPVRL

SEQ ID NO: 3181869 - protein, 28 aa, Giardia lamblia
AGGGPALPRRVPWARGLRGRPSDPCSAR

SEQ ID NO: 3181870 - protein, 17 aa, Giardia lamblia
AGGLRRTMIPPVQRKRK

SEQ ID NO: 3181871 - protein, 27 aa, Giardia lamblia
AGHAELLLLAFLGRRYSCSPPSHLYMQ

SEQ ID NO: 3181872 - protein, 26 aa, Giardia lamblia
AGHDGLLLVWQKLDGGWRIGAEHKFQ

SEQ ID NO: 3181873 - protein, 25 aa, Giardia lamblia
AGHIGCVQLLIGFEVRLVNKQYETA

SEQ ID NO: 3181874 - protein, 18 aa, Giardia lamblia
AGHKAAVAALAPFEAGIQ

SEQ ID NO: 3181875 - protein, 23 aa, Giardia lamblia
AGHKQIVALLIGSEAKIQTAWGT

SEQ ID NO: 3181876 - protein, 22 aa, Giardia lamblia
AGHLDFLRILLSICGRTKNISA

SEQ ID NO: 3181877 - protein, 22 aa, Giardia lamblia
AGHLPAIKILAPIEATMTVQQN

SEQ ID NO: 3181878 - protein, 25 aa, Giardia lamblia
AGHLVIAEALLPREKAMISHDEKTA

SEQ ID NO: 3181879 - protein, 21 aa, Giardia lamblia
AGHTPLMYYAMHSHKGLFAFD

SEQ ID NO: 3181880 - protein, 18 aa, Giardia lamblia
AGIAVYRNAARRARTISK

SEQ ID NO: 3181881 - protein, 28 aa, Giardia lamblia
AGICTRRPLILQLIPTKPGQFVKDEKGK

SEQ ID NO: 3181882 - protein, 26 aa, Giardia lamblia
AGIHGCRIFIVYALLVNGETPKACMD

SEQ ID NO: 3181883 - protein, 33 aa, Giardia lamblia
AGIKMPMFHIKLYTFQFLRGLAYMHSFNIANRD

SEQ ID NO: 3181884 - protein, 18 aa, Giardia lamblia
AGILRLLQMNLDHISCIR

SEQ ID NO: 3181885 - protein, 18 aa, Giardia lamblia
AGILVYTPSQHKKGWRRM

SEQ ID NO: 3181886 - protein, 20 aa, Giardia lamblia
AGIRPRVGIDRPASSTTRQV

SEQ ID NO: 3181887 - protein, 36 aa, Giardia lamblia
AGIVFSPPYLLMQAPVRSMRLWRTPMIMKVESEMLH

SEQ ID NO: 3181888 - protein, 51 aa, Giardia lamblia
AGIYVINPALLLAFPVPCSMEQGVFPILLSRKLDVLSFYIGTEKTWSDMGT

SEQ ID NO: 3181889 - protein, 24 aa, Giardia lamblia
AGKAAARLIGMPEGTTSILTNAAS

SEQ ID NO: 3181890 - protein, 23 aa, Giardia lamblia
AGKIKVAPLELIGLSTDVIRNIE

SEQ ID NO: 3181891 - protein, 27 aa, Giardia lamblia
AGKKLAIYKVWLARFRTLCLVYREKTG

SEQ ID NO: 3181892 - protein, 25 aa, Giardia lamblia
AGKNPHLLKRVLTGPQKKVVAPTVV

SEQ ID NO: 3181893 - protein, 20 aa, Giardia lamblia
AGLAVPEPVLWNTVAQITVA

SEQ ID NO: 3181894 - protein, 23 aa, Giardia lamblia
AGLGLERIVMLMLGIENCRQTCL

SEQ ID NO: 3181895 - protein, 24 aa, Giardia lamblia
AGLLNAPVDAFIKLADHNTAVAAF

SEQ ID NO: 3181896 - protein, 18 aa, Giardia lamblia
AGLTALQLALQTNNLKIA

SEQ ID NO: 3181897 - protein, 19 aa, Giardia lamblia
AGLTALSIAALENNFELCK

SEQ ID NO: 3181898 - protein, 20 aa, Giardia lamblia
AGLYYNIFVVLRQGAQADAS

SEQ ID NO: 3181899 - protein, 19 aa, Giardia lamblia
AGMCVGASMVFGAQFLQTV

SEQ ID NO: 3181900 - protein, 24 aa, Giardia lamblia
AGMLRSCGRYLLPGTALMHAVVCG

SEQ ID NO: 3181901 - protein, 17 aa, Giardia lamblia
AGMTALMFAVNKGNLKL

SEQ ID NO: 3181902 - protein, 23 aa, Giardia lamblia
AGNGNIPLVRLLDPLEAGFQDKA

SEQ ID NO: 3181903 - protein, 27 aa, Giardia lamblia
AGNLKMAHILIPYEAGLVSTSGYTALM

SEQ ID NO: 3181904 - protein, 26 aa, Giardia lamblia
AGNLQLAHLLTPLEGYQLPLTHEMLV

SEQ ID NO: 3181905 - protein, 24 aa, Giardia lamblia
AGNLRKFIPLIHELLDEMIDNGDV

SEQ ID NO: 3181906 - protein, 17 aa, Giardia lamblia
AGPFFNRGRPEDYEPIT

SEQ ID NO: 3181907 - protein, 24 aa, Giardia lamblia
AGQNGFVKIWKYINKAQVHVEPCK

SEQ ID NO: 3181908 - protein, 27 aa, Giardia lamblia
AGQRIVPPQTIKPPARPARPIPPPNHN

SEQ ID NO: 3181909 - protein, 22 aa, Giardia lamblia
AGRAEKLLCWCVWQTDRERGKR

SEQ ID NO: 3181910 - protein, 27 aa, Giardia lamblia
AGREPSIAYPPWYNDEDIRRFELVRRI

SEQ ID NO: 3181911 - protein, 18 aa, Giardia lamblia
AGRYIPSLCYLNEKYRHM

SEQ ID NO: 3181912 - protein, 29 aa, Giardia lamblia
AGSHRTHRLVLLYPARDIPWPIRNLSAER

SEQ ID NO: 3181913 - protein, 21 aa, Giardia lamblia
AGSMIRWRPSTGGPRRHQGTR

SEQ ID NO: 3181914 - protein, 25 aa, Giardia lamblia
AGSPRSGALLTRFSDFNLREEVLQA

SEQ ID NO: 3181915 - protein, 24 aa, Giardia lamblia
AGSQMKVDFLRKGLTDFFWDSEEG

SEQ ID NO: 3181916 - protein, 22 aa, Giardia lamblia
AGSVDILRLLLCESRNTNLIGE

SEQ ID NO: 3181917 - protein, 19 aa, Giardia lamblia
AGSVPLLLSVSSVGQVCHW

SEQ ID NO: 3181918 - protein, 22 aa, Giardia lamblia
AGTDPLPGRKWIDVDSAASCLS

SEQ ID NO: 3181919 - protein, 25 aa, Giardia lamblia
AGTSVLMRLMRGLVKPSSSTIEQQL

SEQ ID NO: 3181920 - protein, 23 aa, Giardia lamblia
AGTTYQPHILLPSSASPAGEDLF

SEQ ID NO: 3181921 - protein, 24 aa, Giardia lamblia
AGTTYQPHILLPSSASPAGEDLFV

SEQ ID NO: 3181922 - protein, 19 aa, Giardia lamblia
AGVEVTPPPILELSAKFCQ

SEQ ID NO: 3181923 - protein, 26 aa, Giardia lamblia
AGVKVDSIWFTLFANYLEGKNVKELL

SEQ ID NO: 3181924 - protein, 21 aa, Giardia lamblia
AGVTLIRMQLAAPGVVTGKAR

SEQ ID NO: 3181925 - protein, 19 aa, Giardia lamblia
AGVTQFPRLRSLSLAYNDI

SEQ ID NO: 3181926 - protein, 18 aa, Giardia lamblia
AGYLEFYMSSFQGTLCLR

SEQ ID NO: 3181927 - protein, 25 aa, Giardia lamblia
AGYLKTQFFRVCLLSEIEQYKAPIN

SEQ ID NO: 3181928 - protein, 23 aa, Giardia lamblia
AGYRGHLAIIRMADKHLLSEVHL

SEQ ID NO: 3181929 - protein, 20 aa, Giardia lamblia
AHAFWKDMRLFSCITEFFEE

SEQ ID NO: 3181930 - protein, 26 aa, Giardia lamblia
AHAGVWKLFMELFDHLPIAAIVDNSI

SEQ ID NO: 3181931 - protein, 21 aa, Giardia lamblia
AHAIKPVRVLRLRNARPVSQE

SEQ ID NO: 3181932 - protein, 19 aa, Giardia lamblia
AHAKWTKNVFERLAPDVRV

SEQ ID NO: 3181933 - protein, 24 aa, Giardia lamblia
AHALCPRIVPEEIMYSFASARAVL

SEQ ID NO: 3181934 - protein, 17 aa, Giardia lamblia
AHALSTLAGCSLTIPIS

SEQ ID NO: 3181935 - protein, 24 aa, Giardia lamblia
AHDHYMWKVLKTPRLGPLQLTVED

SEQ ID NO: 3181936 - protein, 32 aa, Giardia lamblia
AHDPTASFLFISPKIFVIPPNGGTKIVTFAVF

SEQ ID NO: 3181937 - protein, 17 aa, Giardia lamblia
AHDYILFHYGPAEDIKE

SEQ ID NO: 3181938 - protein, 28 aa, Giardia lamblia
AHENLSYYRKINLLVLILNMVSNVSQYL

SEQ ID NO: 3181939 - protein, 26 aa, Giardia lamblia
AHERTINLDLLIGLLGRICAARRSLF

SEQ ID NO: 3181940 - protein, 35 aa, Giardia lamblia
AHGLSYKITYFKGVPHGKACAIFLIAYLNICKQHS

SEQ ID NO: 3181941 - protein, 27 aa, Giardia lamblia
AHGNYTRLLIAYMTRMRPTKLDYLLLT

SEQ ID NO: 3181942 - protein, 25 aa, Giardia lamblia
AHHGAIVQISWNPKVPRICCTASQD

SEQ ID NO: 3181943 - protein, 28 aa, Giardia lamblia
AHIVNQVCCILYQMATFRDLTHGVDRAS

SEQ ID NO: 3181944 - protein, 19 aa, Giardia lamblia
AHKLKIVQLLAPREASVKL

SEQ ID NO: 3181945 - protein, 19 aa, Giardia lamblia
AHLHTFLSAIKSLIFCSGK

SEQ ID NO: 3181946 - protein, 26 aa, Giardia lamblia
AHLNQYLFNLLPTTQSLLLGYKDIEL

SEQ ID NO: 3181947 - protein, 25 aa, Giardia lamblia
AHMCPKLFELGNRSVVPLSKVKAIP

SEQ ID NO: 3181948 - protein, 19 aa, Giardia lamblia
AHMPPEMLLLQSDYSARKV

SEQ ID NO: 3181949 - protein, 22 aa, Giardia lamblia
AHPIIPKLCFLGNSTDQRPANL

SEQ ID NO: 3181950 - protein, 30 aa, Giardia lamblia
AHPSNYASPTLPISPLPSAPQVILETATKE

SEQ ID NO: 3181951 - protein, 24 aa, Giardia lamblia
AHQMYLKSVPLINSALHAIKELVT

SEQ ID NO: 3181952 - protein, 19 aa, Giardia lamblia
AHREFLTVLNFRELPKAEG

SEQ ID NO: 3181953 - protein, 30 aa, Giardia lamblia
AHSNIIRYHGLFVHAYYVYNVTQFCATPLS

SEQ ID NO: 3181954 - protein, 26 aa, Giardia lamblia
AHSSTLGFYVFRVLKVILAYSRFNSS

SEQ ID NO: 3181955 - protein, 28 aa, Giardia lamblia
AHTFCAECMYYSLLLWEGKCPICDAHVS

SEQ ID NO: 3181956 - protein, 25 aa, Giardia lamblia
AHVAEWQCYLAWAVLRASIHTADAE

SEQ ID NO: 3181957 - protein, 24 aa, Giardia lamblia
AHVAIFVMRNIYKRVINPSGKTAL

SEQ ID NO: 3181958 - protein, 35 aa, Giardia lamblia
AHWEEMTPWFRILFDRVLEPWLLDPSACLAEVEDD

SEQ ID NO: 3181959 - protein, 17 aa, Giardia lamblia
AHYYNLAPARAVAYAFH

SEQ ID NO: 3181960 - protein, 20 aa, Giardia lamblia
AIAAERFSCAFFLCPYEGQL

SEQ ID NO: 3181961 - protein, 32 aa, Giardia lamblia
AIAGVMFYPFFSKKLLHKYNFPKDLHIYMDNG

SEQ ID NO: 3181962 - protein, 27 aa, Giardia lamblia
AIAKGALMMVWPMGLPDYDPAKELLDA

SEQ ID NO: 3181963 - protein, 20 aa, Giardia lamblia
AIANSKYLEKIAAKNQELLR

SEQ ID NO: 3181964 - protein, 27 aa, Giardia lamblia
AIAPVERPLLLFVLEGTHVCPSGEGWC

SEQ ID NO: 3181965 - protein, 17 aa, Giardia lamblia
AIARLCAYNPSVWSYLT

SEQ ID NO: 3181966 - protein, 24 aa, Giardia lamblia
AIAYATLLDWMLKDKSTPFNLILL

SEQ ID NO: 3181967 - protein, 18 aa, Giardia lamblia
AICAIPKTLAKSAGLDPQ

SEQ ID NO: 3181968 - protein, 17 aa, Giardia lamblia
AICFILDNLVVSANCGD

SEQ ID NO: 3181969 - protein, 20 aa, Giardia lamblia
AICHPFVVLRGAAICSLSLP

SEQ ID NO: 3181970 - protein, 26 aa, Giardia lamblia
AICLDSLPSIVYLPCRHLSICELCNN

SEQ ID NO: 3181971 - protein, 17 aa, Giardia lamblia
AIDACTKTALMYAAENN

SEQ ID NO: 3181972 - protein, 23 aa, Giardia lamblia
AIDAIILLMTLPEKLLCGRQHLF

SEQ ID NO: 3181973 - protein, 23 aa, Giardia lamblia
AIDCTLFFARFPHSRPDSPRRLP

SEQ ID NO: 3181974 - protein, 25 aa, Giardia lamblia
AIDDYSTIYPVRTVSPFLLRERGFT

SEQ ID NO: 3181975 - protein, 18 aa, Giardia lamblia
AIDFLDDSPDRLPTPPAG

SEQ ID NO: 3181976 - protein, 17 aa, Giardia lamblia
AIDFLVSTLQRVVHDAN

SEQ ID NO: 3181977 - protein, 23 aa, Giardia lamblia
AIDKKHLHVVRYLLKYEKDCVDG

SEQ ID NO: 3181978 - protein, 19 aa, Giardia lamblia
AIDLMLKLMEYDPQKRITA

SEQ ID NO: 3181979 - protein, 32 aa, Giardia lamblia
AIDNNWYHLQFIYELLLRFIFAANQHPQHSEY

SEQ ID NO: 3181980 - protein, 18 aa, Giardia lamblia
AIDQWIAAMLAHFAEWPD

SEQ ID NO: 3181981 - protein, 26 aa, Giardia lamblia
AIEGRRAALKKLYDAEFRAYQDAVKA

SEQ ID NO: 3181982 - protein, 29 aa, Giardia lamblia
AIELGKPTGYIFAAPRRQGFSSSGTLHNN

SEQ ID NO: 3181983 - protein, 19 aa, Giardia lamblia
AIERDVAIFNLRIRAFLPS

SEQ ID NO: 3181984 - protein, 25 aa, Giardia lamblia
AIESRRLYDLINVLEALGIIIKQQG

SEQ ID NO: 3181985 - protein, 27 aa, Giardia lamblia
AIEVDSLPCVQLLAALEFYINHPNGDS

SEQ ID NO: 3181986 - protein, 17 aa, Giardia lamblia
AIEYVIFADVLYGACNI

SEQ ID NO: 3181987 - protein, 19 aa, Giardia lamblia
AIEYWAKITLPRLTTEEQE

SEQ ID NO: 3181988 - protein, 20 aa, Giardia lamblia
AIFYHASMFRTLMTKDSLNP

SEQ ID NO: 3181989 - protein, 29 aa, Giardia lamblia
AIGAPFKTLILSILRNNSIRILENMSALL

SEQ ID NO: 3181990 - protein, 18 aa, Giardia lamblia
AIGAYLIELVKLRYPSHR

SEQ ID NO: 3181991 - protein, 20 aa, Giardia lamblia
AIGLAIVEAAKAKLAKWCEE

SEQ ID NO: 3181992 - protein, 22 aa, Giardia lamblia
AIGNLLRFFSTLRANVTKLVES

SEQ ID NO: 3181993 - protein, 19 aa, Giardia lamblia
AIIGRRILCVHGCLASNFS

SEQ ID NO: 3181994 - protein, 33 aa, Giardia lamblia
AIIHGNVEPLKFFLQHRMLLQDDLEAARILASE

SEQ ID NO: 3181995 - protein, 17 aa, Giardia lamblia
AIISTLKKDLTNLRAEL

SEQ ID NO: 3181996 - protein, 25 aa, Giardia lamblia
AIKRKDFSAIIWLIANTVSSEWEKI

SEQ ID NO: 3181997 - protein, 17 aa, Giardia lamblia
AIKTYEDSCTFIEDIRQ

SEQ ID NO: 3181998 - protein, 20 aa, Giardia lamblia
AILALAPFKAIFKDPHLYLS

SEQ ID NO: 3181999 - protein, 20 aa, Giardia lamblia
AILALQPRLHHLTAKTFRTL

SEQ ID NO: 3182000 - protein, 19 aa, Giardia lamblia
AILATAKVIWACHDHINDP

SEQ ID NO: 3182001 - protein, 17 aa, Giardia lamblia
AILERTLSKLPNKRPSC

SEQ ID NO: 3182002 - protein, 20 aa, Giardia lamblia
AILNHPLRCVVPASNPVVSN

SEQ ID NO: 3182003 - protein, 18 aa, Giardia lamblia
AILPGNFVRPILVAGHTQ

SEQ ID NO: 3182004 - protein, 27 aa, Giardia lamblia
AILRTPEQYMMLYRAIQRRVRKSLLSR

SEQ ID NO: 3182005 - protein, 18 aa, Giardia lamblia
AILVKIFIDEEIRNRADS

SEQ ID NO: 3182006 - protein, 29 aa, Giardia lamblia
AILVLVDSIIRFICLLELKLKELDELFCN

SEQ ID NO: 3182007 - protein, 17 aa, Giardia lamblia
AIMLGYNPYLQHNQSGD

SEQ ID NO: 3182008 - protein, 25 aa, Giardia lamblia
AIMNACIQSLPIYYSDELSAFICAM

SEQ ID NO: 3182009 - protein, 25 aa, Giardia lamblia
AINCCRVWLTQWKKKGLLCPQNPNR

SEQ ID NO: 3182010 - protein, 25 aa, Giardia lamblia
AINGGTVTISLNTAIWTCRTADIER

SEQ ID NO: 3182011 - protein, 24 aa, Giardia lamblia
AINHALPFLLSLKTATMDENRYLI

SEQ ID NO: 3182012 - protein, 26 aa, Giardia lamblia
AINLMIRALVHDPVAFYPAGISLITI

SEQ ID NO: 3182013 - protein, 30 aa, Giardia lamblia
AINLTFTVLMRLAVDYFLNPAYLKQDERNI

SEQ ID NO: 3182014 - protein, 26 aa, Giardia lamblia
AINSIPVIQYLLPPAHVLCNKSLLAG

SEQ ID NO: 3182015 - protein, 25 aa, Giardia lamblia
AINSLFPLHKALLDKWQPVRINLAV

SEQ ID NO: 3182016 - protein, 29 aa, Giardia lamblia
AINTRTIKPVLLLLLTYADMFGLTRDVIH

SEQ ID NO: 3182017 - protein, 19 aa, Giardia lamblia
AIPGVYKPQFPMSPQTIDG

SEQ ID NO: 3182018 - protein, 18 aa, Giardia lamblia
AIPLFQRSVDSLGQTALM

SEQ ID NO: 3182019 - protein, 24 aa, Giardia lamblia
AIPPLKYLLHICKYGEYKGLKLHS

SEQ ID NO: 3182020 - protein, 24 aa, Giardia lamblia
AIPVYSAHKPLYKVGSLFAPQSVV

SEQ ID NO: 3182021 - protein, 31 aa, Giardia lamblia
AIQDTFAAIPYFFRLIYLPQSLCRALERFCN

SEQ ID NO: 3182022 - protein, 25 aa, Giardia lamblia
AIQIFNIINIPPFDDLFKQVYAQAP

SEQ ID NO: 3182023 - protein, 29 aa, Giardia lamblia
AIQNDFYEAIKILLPLEGIDISQNNVIAT

SEQ ID NO: 3182024 - protein, 19 aa, Giardia lamblia
AIQRLQGTRFSFSTADLES

SEQ ID NO: 3182025 - protein, 27 aa, Giardia lamblia
AIQYCPSLPQDSLPLAYSALDNTDVAM

SEQ ID NO: 3182026 - protein, 18 aa, Giardia lamblia
AIRALLFQTAHTEAFSSR

SEQ ID NO: 3182027 - protein, 20 aa, Giardia lamblia
AIRDTYLPAFQLLAPPEQCS

SEQ ID NO: 3182028 - protein, 23 aa, Giardia lamblia
AIRGHLNACKLLLPFEKQMQNTI

SEQ ID NO: 3182029 - protein, 22 aa, Giardia lamblia
AIRLHKVIRLLTMGLGGEGYLT

SEQ ID NO: 3182030 - protein, 18 aa, Giardia lamblia
AIRLSLAGKNRTADSEYA

SEQ ID NO: 3182031 - protein, 26 aa, Giardia lamblia
AIRPAGVRTLKTPPLSRAGDSAVPLL

SEQ ID NO: 3182032 - protein, 21 aa, Giardia lamblia
AIRRAQWIKITQLRGSSFVID

SEQ ID NO: 3182033 - protein, 19 aa, Giardia lamblia
AISIYKRSSDWLAEKKLFT

SEQ ID NO: 3182034 - protein, 20 aa, Giardia lamblia
AISPILASPFCKKCGNKTMM

SEQ ID NO: 3182035 - protein, 32 aa, Giardia lamblia
AISRGHWVLLMNCHLLPKWLKTLEKILEGPMN

SEQ ID NO: 3182036 - protein, 26 aa, Giardia lamblia
AISYTALLRQLYPQNFYVAAAAGPIT

SEQ ID NO: 3182037 - protein, 22 aa, Giardia lamblia
AITFLDRFYKAMGAFLKEKELA

SEQ ID NO: 3182038 - protein, 18 aa, Giardia lamblia
AITFRHYLLRHPLDAESE

SEQ ID NO: 3182039 - protein, 26 aa, Giardia lamblia
AITGDEKWLLATAQTILLVYPTTTAD

SEQ ID NO: 3182040 - protein, 20 aa, Giardia lamblia
AITNLGDVLIFAGPSFIGAI

SEQ ID NO: 3182041 - protein, 30 aa, Giardia lamblia
AITQTDIPIIWLYRGSWNRFTLGEASLVIC

SEQ ID NO: 3182042 - protein, 19 aa, Giardia lamblia
AITTPWAYSILSNYFCIAV

SEQ ID NO: 3182043 - protein, 18 aa, Giardia lamblia
AIVLLQEQIATLAVSNAS

SEQ ID NO: 3182044 - protein, 36 aa, Giardia lamblia
AIVNMDWDHIKAADLYVVLHSFLPATGKLEHVRVFM

SEQ ID NO: 3182045 - protein, 18 aa, Giardia lamblia
AIVPPLATTIPDDEGRRL

SEQ ID NO: 3182046 - protein, 17 aa, Giardia lamblia
AIVQILFTRIQSSSKRE

SEQ ID NO: 3182047 - protein, 17 aa, Giardia lamblia
AIVRAGLLLGLRVGIAA

SEQ ID NO: 3182048 - protein, 18 aa, Giardia lamblia
AIVRNFMALQIATITNIL

SEQ ID NO: 3182049 - protein, 20 aa, Giardia lamblia
AIVTILQRLPNLKVLNLMNN

SEQ ID NO: 3182050 - protein, 28 aa, Giardia lamblia
AIVTYYDDLWVGPSTPLLIPDSAVHLGE

SEQ ID NO: 3182051 - protein, 17 aa, Giardia lamblia
AIYGARQPILNHTPMRP

SEQ ID NO: 3182052 - protein, 51 aa, Giardia lamblia
AIYMDLLYTRQETALLYHFVDAVSPFLTFDPLPRYLVVKPPDSTHNEEHIG

SEQ ID NO: 3182053 - protein, 17 aa, Giardia lamblia
AKAIAMQAGFTFFSASA

SEQ ID NO: 3182054 - protein, 17 aa, Giardia lamblia
AKAKFVRIISEKEFYDL

SEQ ID NO: 3182055 - protein, 25 aa, Giardia lamblia
AKAKITPLMWESFVGNVAAVHQYIQ

SEQ ID NO: 3182056 - protein, 27 aa, Giardia lamblia
AKALMYNNTLKYLGLNGNFIGLAGIDG

SEQ ID NO: 3182057 - protein, 17 aa, Giardia lamblia
AKASYLTPFLATGGTDQ

SEQ ID NO: 3182058 - protein, 21 aa, Giardia lamblia
AKAVAYYKRELLAREESYNKR

SEQ ID NO: 3182059 - protein, 22 aa, Giardia lamblia
AKAVIFCLGSREKHRFNAAIPG

SEQ ID NO: 3182060 - protein, 18 aa, Giardia lamblia
AKAYLRDLDEVDPSLYAI

SEQ ID NO: 3182061 - protein, 25 aa, Giardia lamblia
AKAYMLTRLILGHVPNLSLSSKEAK

SEQ ID NO: 3182062 - protein, 19 aa, Giardia lamblia
AKAYQFLADLFIKREEEIY

SEQ ID NO: 3182063 - protein, 19 aa, Giardia lamblia
AKDDWFTELLKHMEIHGFI

SEQ ID NO: 3182064 - protein, 25 aa, Giardia lamblia
AKDLCSAICGCLWVYKARRLARAAT

SEQ ID NO: 3182065 - protein, 29 aa, Giardia lamblia
AKDMQLHPVWKYLFAFYAALYKAHGENGA

SEQ ID NO: 3182066 - protein, 29 aa, Giardia lamblia
AKDNFNYELPILSILRTLLNDPTIQFSQA

SEQ ID NO: 3182067 - protein, 18 aa, Giardia lamblia
AKDPKGLLITPDPVGPLI

SEQ ID NO: 3182068 - protein, 30 aa, Giardia lamblia
AKDTCSIPKFTLESLLHCLSEILGRGASGI

SEQ ID NO: 3182069 - protein, 22 aa, Giardia lamblia
AKDVVEYLSGAYPLRKDADGHS

SEQ ID NO: 3182070 - protein, 36 aa, Giardia lamblia
AKEAARRRASITPLLSFFHKHYLRVFVLVNKRNKCK

SEQ ID NO: 3182071 - protein, 22 aa, Giardia lamblia
AKEALDFFNANITSNSAALNRA

SEQ ID NO: 3182072 - protein, 26 aa, Giardia lamblia
AKEERLAEAIAINKSLTALSSVICSL

SEQ ID NO: 3182073 - protein, 22 aa, Giardia lamblia
AKEGYFLLPDADDSHQSVIPCG

SEQ ID NO: 3182074 - protein, 20 aa, Giardia lamblia
AKEKISYHELLYTDQKKMLE

SEQ ID NO: 3182075 - protein, 24 aa, Giardia lamblia
AKEKRSRLLGKMRCFICGARDHYQ

SEQ ID NO: 3182076 - protein, 21 aa, Giardia lamblia
AKERIKLIERLIAESPASENN

SEQ ID NO: 3182077 - protein, 25 aa, Giardia lamblia
AKFCQALQNHVRLLSDYRYGGFAMS

SEQ ID NO: 3182078 - protein, 22 aa, Giardia lamblia
AKFLREKVVFILIPMVNPDGCS

SEQ ID NO: 3182079 - protein, 30 aa, Giardia lamblia
AKIKSLREALGSLKIAYRSLLENMNETTAI

SEQ ID NO: 3182080 - protein, 20 aa, Giardia lamblia
AKILKQYKYLDKTVKLQAAD

SEQ ID NO: 3182081 - protein, 17 aa, Giardia lamblia
AKILPPSGLSLLPGKRT

SEQ ID NO: 3182082 - protein, 32 aa, Giardia lamblia
AKIQQNLKLLLFLSKLLKMERLRNGALILETP

SEQ ID NO: 3182083 - protein, 17 aa, Giardia lamblia
AKKHGIKKLFRAHEAIQ

SEQ ID NO: 3182084 - protein, 26 aa, Giardia lamblia
AKKNIHSVIPILLPVENKIQDKTGWT

SEQ ID NO: 3182085 - protein, 28 aa, Giardia lamblia
AKKVAGLIIQRRLFISPTLSDEDLRIEI

SEQ ID NO: 3182086 - protein, 17 aa, Giardia lamblia
AKKYPFNRIIYSNIGNP

SEQ ID NO: 3182087 - protein, 22 aa, Giardia lamblia
AKKYWHFIRLMGRSASHITLEC

SEQ ID NO: 3182088 - protein, 17 aa, Giardia lamblia
AKLPYVARYGDYPPPDL

SEQ ID NO: 3182089 - protein, 26 aa, Giardia lamblia
AKLSQYFNYGFDEATWRLYCKLRKEE

SEQ ID NO: 3182090 - protein, 26 aa, Giardia lamblia
AKLSVPDFFFLEPTFTFEYGKDAYIE

SEQ ID NO: 3182091 - protein, 17 aa, Giardia lamblia
AKLTLVFEYLDMDLKKY

SEQ ID NO: 3182092 - protein, 23 aa, Giardia lamblia
AKLTNLMIAALKNDIRAAKRYIQ

SEQ ID NO: 3182093 - protein, 24 aa, Giardia lamblia
AKLVPELLPYFRTGSDNQEKEDDV

SEQ ID NO: 3182094 - protein, 17 aa, Giardia lamblia
AKMFIVMEYCENGDLAK

SEQ ID NO: 3182095 - protein, 18 aa, Giardia lamblia
AKNAISCAFTLLPSERKK

SEQ ID NO: 3182096 - protein, 26 aa, Giardia lamblia
AKNARLNIVPVRRGFWGGKLGDPHTV

SEQ ID NO: 3182097 - protein, 23 aa, Giardia lamblia
AKNILVMLKSPRDPLSQIMMVKL

SEQ ID NO: 3182098 - protein, 27 aa, Giardia lamblia
AKNWHNDIVRILLPLQARQATREGYTA

SEQ ID NO: 3182099 - protein, 18 aa, Giardia lamblia
AKNWRKIADFIYINGHNL

SEQ ID NO: 3182100 - protein, 24 aa, Giardia lamblia
AKPPQLLYESKLYKILVGGVGIPY

SEQ ID NO: 3182101 - protein, 17 aa, Giardia lamblia
AKPQLRPTSPRSPLVIP

SEQ ID NO: 3182102 - protein, 20 aa, Giardia lamblia
AKPRDLKLDDLAPSGSMTPV

SEQ ID NO: 3182103 - protein, 26 aa, Giardia lamblia
AKQKRLLVLSATRALVPLLSSKEGRA

SEQ ID NO: 3182104 - protein, 19 aa, Giardia lamblia
AKQQVPITFLLSLGSDPTS

SEQ ID NO: 3182105 - protein, 23 aa, Giardia lamblia
AKQSAYWCFRIDMELYSGCISAA

SEQ ID NO: 3182106 - protein, 25 aa, Giardia lamblia
AKRHQLPLVSLLLPQEKNMQDKDGY

SEQ ID NO: 3182107 - protein, 22 aa, Giardia lamblia
AKRLLNFFSAFISAAGPSELLS

SEQ ID NO: 3182108 - protein, 22 aa, Giardia lamblia
AKRQELVGLYKLLCNELDIPID

SEQ ID NO: 3182109 - protein, 17 aa, Giardia lamblia
AKRSTVSSIQRGDPPLS

SEQ ID NO: 3182110 - protein, 28 aa, Giardia lamblia
AKRTIVPPFSYFRDPERLVKFTTELFDV

SEQ ID NO: 3182111 - protein, 26 aa, Giardia lamblia
AKRVPCVAGMFLLAAEDLISLLLIKF

SEQ ID NO: 3182112 - protein, 23 aa, Giardia lamblia
AKSDIPCSLFRINPERKRARTTS

SEQ ID NO: 3182113 - protein, 24 aa, Giardia lamblia
AKSFNDMRLLYIEENKILKEENTL

SEQ ID NO: 3182114 - protein, 19 aa, Giardia lamblia
AKSIALWNTVKAFAKKCID

SEQ ID NO: 3182115 - protein, 17 aa, Giardia lamblia
AKSIYCYLLLTREYICL

SEQ ID NO: 3182116 - protein, 24 aa, Giardia lamblia
AKSNRALLEAQAVARRLITLTKEI

SEQ ID NO: 3182117 - protein, 33 aa, Giardia lamblia
AKSPPTLGELLLWISTLPPQNRKFCIATPAPIP

SEQ ID NO: 3182118 - protein, 26 aa, Giardia lamblia
AKSTPAIIDFLQFLFSHVTFAKAGER

SEQ ID NO: 3182119 - protein, 23 aa, Giardia lamblia
AKSYIINVLPFAKTNRIKDHIID

SEQ ID NO: 3182120 - protein, 18 aa, Giardia lamblia
AKTGYISEDGFILAVISL

SEQ ID NO: 3182121 - protein, 26 aa, Giardia lamblia
AKTLETLLVSFFTPSLPGLTKNSIDT

SEQ ID NO: 3182122 - protein, 24 aa, Giardia lamblia
AKTLNSDYLMILTDVLNACINYKK

SEQ ID NO: 3182123 - protein, 24 aa, Giardia lamblia
AKVEPLRLEAMYTKAHAAIRANPQ

SEQ ID NO: 3182124 - protein, 26 aa, Giardia lamblia
AKVEVQPYIQYLPPGSMAGFPISIKF

SEQ ID NO: 3182125 - protein, 24 aa, Giardia lamblia
AKVKLLIQALDKVAFRRLLELESF

SEQ ID NO: 3182126 - protein, 38 aa, Giardia lamblia
AKVLHEHLFLRTSRVLAWVALPSEFLFTKASAIAMFSF

SEQ ID NO: 3182127 - protein, 19 aa, Giardia lamblia
AKVQHARLPPRVKSLEREK

SEQ ID NO: 3182128 - protein, 22 aa, Giardia lamblia
AKVSLILVRVYVIIKCLMEDLV

SEQ ID NO: 3182129 - protein, 28 aa, Giardia lamblia
AKVTPSVIPPPPPAVFLPHASTAPPAPA

SEQ ID NO: 3182130 - protein, 32 aa, Giardia lamblia
AKWCPAACVVLRPLARIILCDEFERLPQQHND

SEQ ID NO: 3182131 - protein, 22 aa, Giardia lamblia
AKYRPLVLQGRAAHILPVVVGA

SEQ ID NO: 3182132 - protein, 24 aa, Giardia lamblia
AKYSLRTFYELSNGTALMIAAAKG

SEQ ID NO: 3182133 - protein, 25 aa, Giardia lamblia
ALAAPDYVPRLLPSNPIPNMVDTHE

SEQ ID NO: 3182134 - protein, 19 aa, Giardia lamblia
ALAESRLRRPKQPNPSEVS

SEQ ID NO: 3182135 - protein, 23 aa, Giardia lamblia
ALAEYDCFFISTLSIFGDMSIEK

SEQ ID NO: 3182136 - protein, 19 aa, Giardia lamblia
ALAGILYNSISYLFANDAS

SEQ ID NO: 3182137 - protein, 30 aa, Giardia lamblia
ALAKNLPHIPYRDSKLTRILQHALGGSCHT

SEQ ID NO: 3182138 - protein, 18 aa, Giardia lamblia
ALAKRYFDITIEPLKSAA

SEQ ID NO: 3182139 - protein, 24 aa, Giardia lamblia
ALALEYCHSPNKPGFKPGEIVIHR

SEQ ID NO: 3182140 - protein, 18 aa, Giardia lamblia
ALALVPYEGPEPVYVRES

SEQ ID NO: 3182141 - protein, 20 aa, Giardia lamblia
ALARKRMRAYSRLKQLTTKA

SEQ ID NO: 3182142 - protein, 17 aa, Giardia lamblia
ALAYDHAPPPPPESFST

SEQ ID NO: 3182143 - protein, 30 aa, Giardia lamblia
ALCCIARVIPLYFQSFLALATSDLIVAYDM

SEQ ID NO: 3182144 - protein, 25 aa, Giardia lamblia
ALCEAPQYFYVPPMTTVRCMSASSL

SEQ ID NO: 3182145 - protein, 29 aa, Giardia lamblia
ALCFSDRPRFNIFLHGFQPVLSHLDDKLS

SEQ ID NO: 3182146 - protein, 17 aa, Giardia lamblia
ALCLINVMNYIVVGYEF

SEQ ID NO: 3182147 - protein, 19 aa, Giardia lamblia
ALCLLNNPQIRILVCAPSN

SEQ ID NO: 3182148 - protein, 20 aa, Giardia lamblia
ALCPGCLRHRPHGCRGERAP

SEQ ID NO: 3182149 - protein, 25 aa, Giardia lamblia
ALDIGAYIVLPTICAYYAANPTIFL

SEQ ID NO: 3182150 - protein, 22 aa, Giardia lamblia
ALDKYRAVVPAPMQLPPADILE

SEQ ID NO: 3182151 - protein, 20 aa, Giardia lamblia
ALDMVLLLIYAHLPDYRPPS

SEQ ID NO: 3182152 - protein, 23 aa, Giardia lamblia
ALDRIARYLLISNTPAPGLNIER

SEQ ID NO: 3182153 - protein, 20 aa, Giardia lamblia
ALDRILVYRGLHIKQSAITS

SEQ ID NO: 3182154 - protein, 23 aa, Giardia lamblia
ALDRTPIMRAVILGGPVTIDPRY

SEQ ID NO: 3182155 - protein, 21 aa, Giardia lamblia
ALDTYLRRGYNTTGSVRPVNL

SEQ ID NO: 3182156 - protein, 26 aa, Giardia lamblia
ALDVAWSCLLLHNTMPWQMLTDYLLK

SEQ ID NO: 3182157 - protein, 28 aa, Giardia lamblia
ALDVTPNRLLTTPLPNLRRSETALPSCP

SEQ ID NO: 3182158 - protein, 23 aa, Giardia lamblia
ALEAETCLLSQKLEFYHSIIEKA

SEQ ID NO: 3182159 - protein, 21 aa, Giardia lamblia
ALEFFNGFTVILRGQKITFSA

SEQ ID NO: 3182160 - protein, 33 aa, Giardia lamblia
ALENTHYIFIVVHFWDFQPLVSRAIEFNGTRRQ

SEQ ID NO: 3182161 - protein, 31 aa, Giardia lamblia
ALEQHMLRLYKQLFFRAFHLRVIYIQNMLRL

SEQ ID NO: 3182162 - protein, 23 aa, Giardia lamblia
ALEQKLTLPSSFADLVEPAEAQV

SEQ ID NO: 3182163 - protein, 27 aa, Giardia lamblia
ALEQSIRILPTHLSLQRLSYLAIQRND

SEQ ID NO: 3182164 - protein, 17 aa, Giardia lamblia
ALEQYLFSLPRVALPKD

SEQ ID NO: 3182165 - protein, 20 aa, Giardia lamblia
ALESLFIPDTFFSHTETLTA

SEQ ID NO: 3182166 - protein, 19 aa, Giardia lamblia
ALEYAILGSKQRNLQILIE

SEQ ID NO: 3182167 - protein, 20 aa, Giardia lamblia
ALEYALQSGYSDAIRILLPI

SEQ ID NO: 3182168 - protein, 17 aa, Giardia lamblia
ALFDAYLTRVKANIHLV

SEQ ID NO: 3182169 - protein, 19 aa, Giardia lamblia
ALFDFHWEQHNYGTDPWLV

SEQ ID NO: 3182170 - protein, 28 aa, Giardia lamblia
ALFESYFQRRAFWTWARRLRHLNQAEVE

SEQ ID NO: 3182171 - protein, 18 aa, Giardia lamblia
ALFFLSKINPSDCSDWFY

SEQ ID NO: 3182172 - protein, 21 aa, Giardia lamblia
ALFQSGFLRIYDDATGVLAPS

SEQ ID NO: 3182173 - protein, 44 aa, Giardia lamblia
ALFSEHYAEKYQYILNIYAQYGILKEFLADCKYPGFSFTDIFMP

SEQ ID NO: 3182174 - protein, 20 aa, Giardia lamblia
ALFSGLPQSELFLQTIWSIF

SEQ ID NO: 3182175 - protein, 19 aa, Giardia lamblia
ALFSQVSHLNAFITKLLNA

SEQ ID NO: 3182176 - protein, 17 aa, Giardia lamblia
ALFSRRKSERLRACNRV

SEQ ID NO: 3182177 - protein, 21 aa, Giardia lamblia
ALGAPLAPGLGLRPRGRRGRA

SEQ ID NO: 3182178 - protein, 19 aa, Giardia lamblia
ALGCTIYEVCVGEPLFKGV

SEQ ID NO: 3182179 - protein, 26 aa, Giardia lamblia
ALGELATLKAKLLMKDKFIQQIMQSK

SEQ ID NO: 3182180 - protein, 25 aa, Giardia lamblia
ALGLTHLSYLKWRKAIMFQILTEVY

SEQ ID NO: 3182181 - protein, 24 aa, Giardia lamblia
ALGTIIYELLTGSPPFYSDDKRAM

SEQ ID NO: 3182182 - protein, 20 aa, Giardia lamblia
ALHAIQFLPTMLSSTGPFAT

SEQ ID NO: 3182183 - protein, 17 aa, Giardia lamblia
ALHDLAWCYNLAGEYED

SEQ ID NO: 3182184 - protein, 19 aa, Giardia lamblia
ALHFCDKYNILAVKIGSKF

SEQ ID NO: 3182185 - protein, 30 aa, Giardia lamblia
ALHGSLDVVILLTPILWAKSDEGYKTALDY

SEQ ID NO: 3182186 - protein, 35 aa, Giardia lamblia
ALHHTTFVTSFSDLILLLAIRLKSPSPDSTFNLTV

SEQ ID NO: 3182187 - protein, 28 aa, Giardia lamblia
ALIARVNIPRLPLLSRYTPKVRDTPIVP

SEQ ID NO: 3182188 - protein, 21 aa, Giardia lamblia
ALICSWQGRTPLMCAAEHGHV

SEQ ID NO: 3182189 - protein, 22 aa, Giardia lamblia
ALIDLVIHCSSEDWYNTCTEYT

SEQ ID NO: 3182190 - protein, 19 aa, Giardia lamblia
ALIEAFKILISAGPLCEEP

SEQ ID NO: 3182191 - protein, 33 aa, Giardia lamblia
ALIFAAQSGACKALALLLAYTSIRHTKAGLTAL

SEQ ID NO: 3182192 - protein, 21 aa, Giardia lamblia
ALIIAAINNLGPLCAILAPLE

SEQ ID NO: 3182193 - protein, 20 aa, Giardia lamblia
ALIIAAMHEYPEACSILAPY

SEQ ID NO: 3182194 - protein, 20 aa, Giardia lamblia
ALIIAAMRDSSDVIPLLLEH

SEQ ID NO: 3182195 - protein, 32 aa, Giardia lamblia
ALILAIELRKPAFVRILLPLEHTLCLENGSSP

SEQ ID NO: 3182196 - protein, 18 aa, Giardia lamblia
ALINANIIRKNNIGTVPV

SEQ ID NO: 3182197 - protein, 17 aa, Giardia lamblia
ALIQRILSKNLCTNEDG

SEQ ID NO: 3182198 - protein, 20 aa, Giardia lamblia
ALISNLVRIVSSAIYECFAA

SEQ ID NO: 3182199 - protein, 25 aa, Giardia lamblia
ALISRFDILFVIRDKIHEEEDMNLS

SEQ ID NO: 3182200 - protein, 25 aa, Giardia lamblia
ALISRIHSVSFFLLGADMLSKNGGL

SEQ ID NO: 3182201 - protein, 18 aa, Giardia lamblia
ALISYDFTNPLLIKQHTI

SEQ ID NO: 3182202 - protein, 19 aa, Giardia lamblia
ALKALVDWKGFPASDPRSE

SEQ ID NO: 3182203 - protein, 18 aa, Giardia lamblia
ALKDKLSLSDVTQKKIAA

SEQ ID NO: 3182204 - protein, 26 aa, Giardia lamblia
ALKFPPIEVMMPLVGGYYTGATNPGL

SEQ ID NO: 3182205 - protein, 43 aa, Giardia lamblia
ALKKEGIIGRIYYLFDLRDATPLLLLSVRVLDYILFDQTSSPV

SEQ ID NO: 3182206 - protein, 23 aa, Giardia lamblia
ALKKSFPIQLYLDAATHTFVEEF

SEQ ID NO: 3182207 - protein, 19 aa, Giardia lamblia
ALKLICQKLRDKNRALERQ

SEQ ID NO: 3182208 - protein, 17 aa, Giardia lamblia
ALKLIEEEIWAFVDAEE

SEQ ID NO: 3182209 - protein, 18 aa, Giardia lamblia
ALKLPQQSSLPISSPRGP

SEQ ID NO: 3182210 - protein, 24 aa, Giardia lamblia
ALKPVFPPERPPANLSLPILESQC

SEQ ID NO: 3182211 - protein, 27 aa, Giardia lamblia
ALLAELQRVCPLLAASPEVCAAPRALV

SEQ ID NO: 3182212 - protein, 17 aa, Giardia lamblia
ALLARQAYDPLGHPEVG

SEQ ID NO: 3182213 - protein, 18 aa, Giardia lamblia
ALLDAKNKMINKLEVELD

SEQ ID NO: 3182214 - protein, 22 aa, Giardia lamblia
ALLKNHLVAQFLFQGSTAVVSR

SEQ ID NO: 3182215 - protein, 24 aa, Giardia lamblia
ALLNALHAFHDYAVSFSIAPQPLY

SEQ ID NO: 3182216 - protein, 26 aa, Giardia lamblia
ALLNRYLTGGFFFNADLAPKAQQPVY

SEQ ID NO: 3182217 - protein, 21 aa, Giardia lamblia
ALLREQLLKTTQLLANYPTSR

SEQ ID NO: 3182218 - protein, 26 aa, Giardia lamblia
ALLVHAGARYAGWTALARAAENGFAE

SEQ ID NO: 3182219 - protein, 18 aa, Giardia lamblia
ALLYALEKRHFGIAEALV

SEQ ID NO: 3182220 - protein, 24 aa, Giardia lamblia
ALMFAVRYGHLECVKLLLEKEKNI

SEQ ID NO: 3182221 - protein, 27 aa, Giardia lamblia
ALMHYVRNGWYKRIYLFAGEVACRDVN

SEQ ID NO: 3182222 - protein, 20 aa, Giardia lamblia
ALMIAAKYYRATTAYILLDL

SEQ ID NO: 3182223 - protein, 22 aa, Giardia lamblia
ALMIALLGRDKILEEIISLILG

SEQ ID NO: 3182224 - protein, 17 aa, Giardia lamblia
ALMIATRYGHTDCVGLL

SEQ ID NO: 3182225 - protein, 17 aa, Giardia lamblia
ALMIAVLVGNKQVIPFL

SEQ ID NO: 3182226 - protein, 21 aa, Giardia lamblia
ALMICAYNNYKGFVPLFVERE

SEQ ID NO: 3182227 - protein, 26 aa, Giardia lamblia
ALMISAKMGFAQITNLLLERECKFQT

SEQ ID NO: 3182228 - protein, 18 aa, Giardia lamblia
ALMISISTGFLEAARFLA

SEQ ID NO: 3182229 - protein, 38 aa, Giardia lamblia
ALMLAAERNFMPGVESLLYYEKDLRLPDGRNALILAAQ

SEQ ID NO: 3182230 - protein, 19 aa, Giardia lamblia
ALMLAAHAGNMSLCRALLA

SEQ ID NO: 3182231 - protein, 20 aa, Giardia lamblia
ALMLAAQYGFVDLVKQLIPA

SEQ ID NO: 3182232 - protein, 19 aa, Giardia lamblia
ALMLAIPTRNEEIIHMLIG

SEQ ID NO: 3182233 - protein, 31 aa, Giardia lamblia
ALMLAKTRDIAMHLLCEANLLRKGGLTALMT

SEQ ID NO: 3182234 - protein, 28 aa, Giardia lamblia
ALMLATRYYYPEIMAFLSPFEGHIADST

SEQ ID NO: 3182235 - protein, 27 aa, Giardia lamblia
ALMLAVINKNVEMVHILLPYEKQMQDK

SEQ ID NO: 3182236 - protein, 25 aa, Giardia lamblia
ALMMAAQLGYLRIVQELSPLEAHIL

SEQ ID NO: 3182237 - protein, 23 aa, Giardia lamblia
ALMNACALSLLRASQILVQYEAG

SEQ ID NO: 3182238 - protein, 21 aa, Giardia lamblia
ALMRAAIYNHCDVIRLLLQKE

SEQ ID NO: 3182239 - protein, 18 aa, Giardia lamblia
ALMWAVRLNQVEMIHLLI

SEQ ID NO: 3182240 - protein, 18 aa, Giardia lamblia
ALMYAAVCNNPNAILQLL

SEQ ID NO: 3182241 - protein, 28 aa, Giardia lamblia
ALMYATISRKRLLVRMLLGVEGGLQDNV

SEQ ID NO: 3182242 - protein, 22 aa, Giardia lamblia
ALMYNALLYEEILDPILLNEAG

SEQ ID NO: 3182243 - protein, 20 aa, Giardia lamblia
ALNALRQHFVLRTDIYNMNA

SEQ ID NO: 3182244 - protein, 18 aa, Giardia lamblia
ALNDLAIPLLGTKTTQLL

SEQ ID NO: 3182245 - protein, 20 aa, Giardia lamblia
ALNGDPFMVFCHLGQVGLVD

SEQ ID NO: 3182246 - protein, 37 aa, Giardia lamblia
ALNRNEAIIKKNYLLCLLRLTFHTWLSTFLHRKETYE

SEQ ID NO: 3182247 - protein, 23 aa, Giardia lamblia
ALNYVRGLTLIKGKPAFAFGAFG

SEQ ID NO: 3182248 - protein, 18 aa, Giardia lamblia
ALPAQPLLEPSAHSDAFS

SEQ ID NO: 3182249 - protein, 25 aa, Giardia lamblia
ALPHGIGVLLFFLPADNYLGEAVLA

SEQ ID NO: 3182250 - protein, 21 aa, Giardia lamblia
ALPILTAHVIKYNLLGRVSVQ

SEQ ID NO: 3182251 - protein, 17 aa, Giardia lamblia
ALPKIANISPPPLDWKR

SEQ ID NO: 3182252 - protein, 17 aa, Giardia lamblia
ALPLRVPADDNALLKAI

SEQ ID NO: 3182253 - protein, 19 aa, Giardia lamblia
ALPPDEYLREVFRRRFTFE

SEQ ID NO: 3182254 - protein, 22 aa, Giardia lamblia
ALPTHNMIILSHDQLEKIINEK

SEQ ID NO: 3182255 - protein, 28 aa, Giardia lamblia
ALQAALFYVLGLRISCALPLPLDPDTVV

SEQ ID NO: 3182256 - protein, 23 aa, Giardia lamblia
ALQDIQMVCPYLTYFSILSSKHP

SEQ ID NO: 3182257 - protein, 23 aa, Giardia lamblia
ALQEELLCLLGYSNIDVIGSLLT

SEQ ID NO: 3182258 - protein, 25 aa, Giardia lamblia
ALQEMLDVQRLLARISPRTTSGDDS

SEQ ID NO: 3182259 - protein, 21 aa, Giardia lamblia
ALQLLALPPNQPCLILDVGCG

SEQ ID NO: 3182260 - protein, 18 aa, Giardia lamblia
ALQLWDAFHNDVMPPNIF

SEQ ID NO: 3182261 - protein, 35 aa, Giardia lamblia
ALQRLDALSQTNKKLRMLMADRKLDGYLESSSGIA

SEQ ID NO: 3182262 - protein, 24 aa, Giardia lamblia
ALQSNLQVFLKELSEFRKLHQADI

SEQ ID NO: 3182263 - protein, 21 aa, Giardia lamblia
ALQTTPLMYKVALGQPISTTD

SEQ ID NO: 3182264 - protein, 27 aa, Giardia lamblia
ALQTTTYIPYRNSKLTRILKDSLGGAS

SEQ ID NO: 3182265 - protein, 32 aa, Giardia lamblia
ALRDIRMILKMLGHDPQLFDIKLINCADRLEH

SEQ ID NO: 3182266 - protein, 23 aa, Giardia lamblia
ALREEALIKLIAYQINKHERDLK

SEQ ID NO: 3182267 - protein, 24 aa, Giardia lamblia
ALREKSPVLPPRRPRSSAEPGAGD

SEQ ID NO: 3182268 - protein, 25 aa, Giardia lamblia
ALRGKAFVVFLCFPDAVACAARLHG

SEQ ID NO: 3182269 - protein, 17 aa, Giardia lamblia
ALRLLLLNIKRGVLRSK

SEQ ID NO: 3182270 - protein, 19 aa, Giardia lamblia
ALRMVWTISRYYNTEDRLL

SEQ ID NO: 3182271 - protein, 17 aa, Giardia lamblia
ALRNILKTIPAKVERWE

SEQ ID NO: 3182272 - protein, 27 aa, Giardia lamblia
ALRPGEKVKLWGTLMPIPVVDTIYRIN

SEQ ID NO: 3182273 - protein, 20 aa, Giardia lamblia
ALRSGPFIIQPSLLHLAPQE

SEQ ID NO: 3182274 - protein, 20 aa, Giardia lamblia
ALRSIAFDNVLPGKRVVIFG

SEQ ID NO: 3182275 - protein, 22 aa, Giardia lamblia
ALRSIKRWMAVLGAADNLTVMA

SEQ ID NO: 3182276 - protein, 26 aa, Giardia lamblia
ALSADNLFERVPAIRFINPEKRRKHI

SEQ ID NO: 3182277 - protein, 24 aa, Giardia lamblia
ALSAGRILFGKHLLGSASSGYKDG

SEQ ID NO: 3182278 - protein, 37 aa, Giardia lamblia
ALSDAFECLAITTFQPFRPMQLNYALLDAVFAAIQLS

SEQ ID NO: 3182279 - protein, 21 aa, Giardia lamblia
ALSDLLDYLRTADFLLYITVY

SEQ ID NO: 3182280 - protein, 23 aa, Giardia lamblia
ALSDVFESCGIIRFLGGAQRLSR

SEQ ID NO: 3182281 - protein, 26 aa, Giardia lamblia
ALSEIKRFELIFLSTEDALNRQHVRI

SEQ ID NO: 3182282 - protein, 17 aa, Giardia lamblia
ALSERVIPCLMLNKVDR

SEQ ID NO: 3182283 - protein, 25 aa, Giardia lamblia
ALSGRIMWSRILLNRVRVPFTRFEV

SEQ ID NO: 3182284 - protein, 17 aa, Giardia lamblia
ALSHLVKLHRMLRTPRG

SEQ ID NO: 3182285 - protein, 21 aa, Giardia lamblia
ALSIAVLARRMDKVERLATLE

SEQ ID NO: 3182286 - protein, 17 aa, Giardia lamblia
ALSILMKELSRLKEMRL

SEQ ID NO: 3182287 - protein, 21 aa, Giardia lamblia
ALSLHPYDALTLYCLDMDTGS

SEQ ID NO: 3182288 - protein, 25 aa, Giardia lamblia
ALSNGSLFILHIQSFLASGTAASAQ

SEQ ID NO: 3182289 - protein, 19 aa, Giardia lamblia
ALSNINLMINQKPHQIYFS

SEQ ID NO: 3182290 - protein, 25 aa, Giardia lamblia
ALSNRILAHQPILGANYQGLAAYAT

SEQ ID NO: 3182291 - protein, 28 aa, Giardia lamblia
ALSQELQLPVNIHRWRSLEGSDPAAYEL

SEQ ID NO: 3182292 - protein, 26 aa, Giardia lamblia
ALSRYDTYIWLQRRFLNQSTDDHEQK

SEQ ID NO: 3182293 - protein, 27 aa, Giardia lamblia
ALSSFKRFVFFAAYGSRRKALLAGRPW

SEQ ID NO: 3182294 - protein, 25 aa, Giardia lamblia
ALSSLKDMFIRCTSVHLVYTTSPRT

SEQ ID NO: 3182295 - protein, 25 aa, Giardia lamblia
ALSVRHPPRIIPSTAPKATIENLSA

SEQ ID NO: 3182296 - protein, 20 aa, Giardia lamblia
ALTDRLRSYLGMGGGVGGLR

SEQ ID NO: 3182297 - protein, 26 aa, Giardia lamblia
ALTLRKRSMTHLFGITASRRNTLQAF

SEQ ID NO: 3182298 - protein, 26 aa, Giardia lamblia
ALTPAWVNYEFFIKLSKSLSLETETT

SEQ ID NO: 3182299 - protein, 26 aa, Giardia lamblia
ALTPKTAWLDFLRKTISRKNNTASSL

SEQ ID NO: 3182300 - protein, 28 aa, Giardia lamblia
ALTTNRLYLILIALGLNPTLAGYEWFLL

SEQ ID NO: 3182301 - protein, 30 aa, Giardia lamblia
ALTTPVLKSWALQILEALNYMHTCQPKIIH

SEQ ID NO: 3182302 - protein, 17 aa, Giardia lamblia
ALTYRRVKALFNPRRRC

SEQ ID NO: 3182303 - protein, 19 aa, Giardia lamblia
ALVDKLLDSLPSALLIITP

SEQ ID NO: 3182304 - protein, 22 aa, Giardia lamblia
ALVDTYLLSISYILQLENVGTN

SEQ ID NO: 3182305 - protein, 28 aa, Giardia lamblia
ALVELFCHHIIWLLFASDNKHDYVGELS

SEQ ID NO: 3182306 - protein, 20 aa, Giardia lamblia
ALVKKRCLPTYNYVELLKSQ

SEQ ID NO: 3182307 - protein, 17 aa, Giardia lamblia
ALVKVGPSKGFVSVRQH

SEQ ID NO: 3182308 - protein, 17 aa, Giardia lamblia
ALVLFCEDLLAAVWKEP

SEQ ID NO: 3182309 - protein, 19 aa, Giardia lamblia
ALVLTYYNTRPAPRSCFLG

SEQ ID NO: 3182310 - protein, 24 aa, Giardia lamblia
ALVPYYRQLLPVINIFFNKNINLG

SEQ ID NO: 3182311 - protein, 41 aa, Giardia lamblia
ALVQQLIQKYLLIPQPSHKVTWLAWLLSMISGIQINKRSDN

SEQ ID NO: 3182312 - protein, 17 aa, Giardia lamblia
ALVRFTNDTLIDLIITH

SEQ ID NO: 3182313 - protein, 17 aa, Giardia lamblia
ALVRYMHSLGCSVYKFY

SEQ ID NO: 3182314 - protein, 18 aa, Giardia lamblia
ALVSIDPEEFMRLQQTNH

SEQ ID NO: 3182315 - protein, 17 aa, Giardia lamblia
ALVTLLLDKIKYNNIQN

SEQ ID NO: 3182316 - protein, 25 aa, Giardia lamblia
ALVTLRTFHLLKDNVDFLTPANDHV

SEQ ID NO: 3182317 - protein, 30 aa, Giardia lamblia
ALWLEIEQFLRLEFNISLLPSSLYMTSPSS

SEQ ID NO: 3182318 - protein, 27 aa, Giardia lamblia
ALYARLCHSFLLPTLRHQKLGVRLLHH

SEQ ID NO: 3182319 - protein, 36 aa, Giardia lamblia
ALYMMQRYDFTGREIIAWLRILRPGSILGQQQQFLI

SEQ ID NO: 3182320 - protein, 18 aa, Giardia lamblia
ALYTPLTPSIRYSTTNMA

SEQ ID NO: 3182321 - protein, 17 aa, Giardia lamblia
AMAAALYTYLCHEAKCG

SEQ ID NO: 3182322 - protein, 21 aa, Giardia lamblia
AMEAAYRYLYSLGAISDSMAL

SEQ ID NO: 3182323 - protein, 21 aa, Giardia lamblia
AMEALLQELAASNKITYAAIA

SEQ ID NO: 3182324 - protein, 18 aa, Giardia lamblia
AMEKAILPAMRDPNSKVD

SEQ ID NO: 3182325 - protein, 18 aa, Giardia lamblia
AMELAPIEAGIRSKGGWS

SEQ ID NO: 3182326 - protein, 25 aa, Giardia lamblia
AMEPPPYFPRFPSVAPPPQMVPPYM

SEQ ID NO: 3182327 - protein, 28 aa, Giardia lamblia
AMGLNLPARAIIFSEFKKFDGLTSRLVT

SEQ ID NO: 3182328 - protein, 35 aa, Giardia lamblia
AMHEYPEACSILAPYEKMVTLPDKRTALMQAAATG

SEQ ID NO: 3182329 - protein, 21 aa, Giardia lamblia
AMHLALLHRHINVAEVLAPVE

SEQ ID NO: 3182330 - protein, 18 aa, Giardia lamblia
AMHSFLSSDELIASIKDR

SEQ ID NO: 3182331 - protein, 21 aa, Giardia lamblia
AMHVCRNIILDPRLVIGGGCF

SEQ ID NO: 3182332 - protein, 17 aa, Giardia lamblia
AMIDNLPLHIYLQRSEK

SEQ ID NO: 3182333 - protein, 19 aa, Giardia lamblia
AMIPKSDQVSLWLGSHVMV

SEQ ID NO: 3182334 - protein, 17 aa, Giardia lamblia
AMKHGYIDCFHALLSHE

SEQ ID NO: 3182335 - protein, 24 aa, Giardia lamblia
AMKYDLEAYFPGSNTYRELVSCSN

SEQ ID NO: 3182336 - protein, 19 aa, Giardia lamblia
AMLCLLIQQTPEFKSKGGI

SEQ ID NO: 3182337 - protein, 27 aa, Giardia lamblia
AMLKELAKLPFFVNQPIRVMPDCHSGK

SEQ ID NO: 3182338 - protein, 22 aa, Giardia lamblia
AMLKYKFRRSLEGAHYISWRRS

SEQ ID NO: 3182339 - protein, 22 aa, Giardia lamblia
AMLTSILDWALTNGIGFSNFIS

SEQ ID NO: 3182340 - protein, 18 aa, Giardia lamblia
AMMDLIRSNPMMAEMFRE

SEQ ID NO: 3182341 - protein, 28 aa, Giardia lamblia
AMMLAAMQDHLPICAYLGPLEKNVIGAN

SEQ ID NO: 3182342 - protein, 19 aa, Giardia lamblia
AMMSYMFKREKSLKEAELN

SEQ ID NO: 3182343 - protein, 25 aa, Giardia lamblia
AMNPDAFYIYKPALGARGEGIRLLS

SEQ ID NO: 3182344 - protein, 19 aa, Giardia lamblia
AMPKKRLYQSGFPKEYCTV

SEQ ID NO: 3182345 - protein, 20 aa, Giardia lamblia
AMQISTHLSLLLADLLCGLL

SEQ ID NO: 3182346 - protein, 19 aa, Giardia lamblia
AMQTELLAYLNRLVNTFYQ

SEQ ID NO: 3182347 - protein, 20 aa, Giardia lamblia
AMQTQPKRFTRLAPLVLNRV

SEQ ID NO: 3182348 - protein, 25 aa, Giardia lamblia
AMRKLLERALPSLPQKNLIFFECIQ

SEQ ID NO: 3182349 - protein, 27 aa, Giardia lamblia
AMSLINGFALKIPFIKYITARNFQASS

SEQ ID NO: 3182350 - protein, 19 aa, Giardia lamblia
AMVPARPDLLASLVREYYP

SEQ ID NO: 3182351 - protein, 18 aa, Giardia lamblia
AMYYATHCSSIVTPEKKE

SEQ ID NO: 3182352 - protein, 26 aa, Giardia lamblia
ANAHSLLRWHAVPLSVHPSFHSLECL

SEQ ID NO: 3182353 - protein, 29 aa, Giardia lamblia
ANAICDDPKMYWITRSKERQQKEMDRLEM

SEQ ID NO: 3182354 - protein, 26 aa, Giardia lamblia
ANAIDYEKFLRICGLADNEARPSDDL

SEQ ID NO: 3182355 - protein, 19 aa, Giardia lamblia
ANAPVIPPNIDELTPLMIA

SEQ ID NO: 3182356 - protein, 33 aa, Giardia lamblia
ANAPYRLSGLFFAHYYTYMLPHVIEPLDMFAKH

SEQ ID NO: 3182357 - protein, 27 aa, Giardia lamblia
ANAVKNIIFCFTNARSTFYKPGDTYTP

SEQ ID NO: 3182358 - protein, 20 aa, Giardia lamblia
ANCSLTPEEDLVLAKAMEAL

SEQ ID NO: 3182359 - protein, 28 aa, Giardia lamblia
ANDFKRKSIALSMPIPTREMTMALTNKD

SEQ ID NO: 3182360 - protein, 26 aa, Giardia lamblia
ANDLLIMYRRILAERVRFSLILKEDY

SEQ ID NO: 3182361 - protein, 25 aa, Giardia lamblia
ANEAVLISFSARLKKVPIQDVKHYG

SEQ ID NO: 3182362 - protein, 21 aa, Giardia lamblia
ANEGAAYLIFRAVEEKGDVER

SEQ ID NO: 3182363 - protein, 26 aa, Giardia lamblia
ANEHLTKLIRRAGPKAWSPRATVSCH

SEQ ID NO: 3182364 - protein, 27 aa, Giardia lamblia
ANEHPTKLIRRAGPKAWSPRATASCHP

SEQ ID NO: 3182365 - protein, 30 aa, Giardia lamblia
ANELLRVCATLLLPFIPQKAPLILDQLGVS

SEQ ID NO: 3182366 - protein, 25 aa, Giardia lamblia
ANELNRIILTMTSLDELRNIVIETN

SEQ ID NO: 3182367 - protein, 21 aa, Giardia lamblia
ANESFFHCIAIFDSYLSRVVV

SEQ ID NO: 3182368 - protein, 36 aa, Giardia lamblia
ANFGTPEFLLGLKIKGLLVDIYQYLNVLGSLLAVDE

SEQ ID NO: 3182369 - protein, 26 aa, Giardia lamblia
ANGFDEIVSVLLPLEKKMQTVDGRTA

SEQ ID NO: 3182370 - protein, 26 aa, Giardia lamblia
ANHNDIDMVNLLFSLEFAISEPKLNE

SEQ ID NO: 3182371 - protein, 37 aa, Giardia lamblia
ANIAQVISPIWAIGVPWRIRPRHSGLWTYCYDQNVEL

SEQ ID NO: 3182372 - protein, 36 aa, Giardia lamblia
ANIGPKHNNYILPQTFLTRYIFYARMMRPQLTKECQ

SEQ ID NO: 3182373 - protein, 19 aa, Giardia lamblia
ANIHHNKLFVRHERVSALD

SEQ ID NO: 3182374 - protein, 21 aa, Giardia lamblia
ANILLDIFEYDWNQQVFWADI

SEQ ID NO: 3182375 - protein, 19 aa, Giardia lamblia
ANIMLTDEGVIKLCDFGFA

SEQ ID NO: 3182376 - protein, 26 aa, Giardia lamblia
ANIQQGMYNLGHSLLYMGIRAVEAGT

SEQ ID NO: 3182377 - protein, 25 aa, Giardia lamblia
ANITDVMTCLIILFMKVNACAKDPE

SEQ ID NO: 3182378 - protein, 25 aa, Giardia lamblia
ANKEYFTMLLSRLDPDTAALFCPLM

SEQ ID NO: 3182379 - protein, 24 aa, Giardia lamblia
ANKTLLTSLLNNRANAYFKLGQMN

SEQ ID NO: 3182380 - protein, 19 aa, Giardia lamblia
ANLFSRLAHRCLPKTVSVY

SEQ ID NO: 3182381 - protein, 17 aa, Giardia lamblia
ANLIYRKAKNASSAANT

SEQ ID NO: 3182382 - protein, 27 aa, Giardia lamblia
ANLLSYRSIYYDPPLSTLTILTEIPGQ

SEQ ID NO: 3182383 - protein, 27 aa, Giardia lamblia
ANLNTCINLLYSPYILKQLNAKSSSAT

SEQ ID NO: 3182384 - protein, 18 aa, Giardia lamblia
ANLPKFLVDDIELFMGII

SEQ ID NO: 3182385 - protein, 17 aa, Giardia lamblia
ANLPPVDLLIRTGCEKR

SEQ ID NO: 3182386 - protein, 17 aa, Giardia lamblia
ANLYRQKAVRAEEQRRL

SEQ ID NO: 3182387 - protein, 18 aa, Giardia lamblia
ANNASLSGFINFSPEKSN

SEQ ID NO: 3182388 - protein, 20 aa, Giardia lamblia
ANNGWTCSMSLAAKGRVDLL

SEQ ID NO: 3182389 - protein, 22 aa, Giardia lamblia
ANNLLIVNTWLAHSGPINGIFL

SEQ ID NO: 3182390 - protein, 20 aa, Giardia lamblia
ANNNVAIARLLLPIQKCLKD

SEQ ID NO: 3182391 - protein, 19 aa, Giardia lamblia
ANNWLVLPLTHTSVEEAHQ

SEQ ID NO: 3182392 - protein, 21 aa, Giardia lamblia
ANPGIHYPLASAHKPVLTRTD

SEQ ID NO: 3182393 - protein, 26 aa, Giardia lamblia
ANQVRMLFCMVPYSASLDYSISMMDA

SEQ ID NO: 3182394 - protein, 32 aa, Giardia lamblia
ANRCSNSYYKGQRLYFIVLEPTAKGASVGLKA

SEQ ID NO: 3182395 - protein, 18 aa, Giardia lamblia
ANSFPHCVLRPFIIVITN

SEQ ID NO: 3182396 - protein, 24 aa, Giardia lamblia
ANSIAEYFCYDIRFAAQARTSISP

SEQ ID NO: 3182397 - protein, 23 aa, Giardia lamblia
ANSKYDVMLLPDYCILQPPDPPE

SEQ ID NO: 3182398 - protein, 25 aa, Giardia lamblia
ANSLSLVHQLLRWEYGHVAFDQLTS

SEQ ID NO: 3182399 - protein, 18 aa, Giardia lamblia
ANSTPLIEAVKMGDLPGL

SEQ ID NO: 3182400 - protein, 24 aa, Giardia lamblia
ANTATDKLLFLRDFCALVSQRSSP

SEQ ID NO: 3182401 - protein, 26 aa, Giardia lamblia
ANTLPAKYPTILYLAAEAGWVDGCRE

SEQ ID NO: 3182402 - protein, 19 aa, Giardia lamblia
ANTMDFWCQVNYDDSESDD

SEQ ID NO: 3182403 - protein, 22 aa, Giardia lamblia
ANTPSLPVADRLKPWTYHFGSN

SEQ ID NO: 3182404 - protein, 25 aa, Giardia lamblia
ANVRPEYMLVNLPFGILGNVSDVNA

SEQ ID NO: 3182405 - protein, 25 aa, Giardia lamblia
ANWVHACPILSHRGKVLPWTYPEDE

SEQ ID NO: 3182406 - protein, 22 aa, Giardia lamblia
ANYEYIPFLLGELGMTYSHHRT

SEQ ID NO: 3182407 - protein, 22 aa, Giardia lamblia
ANYIKDVAFDLAYKYDREDAEA

SEQ ID NO: 3182408 - protein, 20 aa, Giardia lamblia
ANYKNLFRDRSRALEKTTFL

SEQ ID NO: 3182409 - protein, 31 aa, Giardia lamblia
APARDYLALATEAFVLLFSISLQKILAVLTY

SEQ ID NO: 3182410 - protein, 35 aa, Giardia lamblia
APAVLRHWHRLIFGVAFFYSSLLERKRFGSVAYNN

SEQ ID NO: 3182411 - protein, 19 aa, Giardia lamblia
APCILFLDEFDSLAKRRGS

SEQ ID NO: 3182412 - protein, 20 aa, Giardia lamblia
APCPGPRWSGLAAPRHHCAP

SEQ ID NO: 3182413 - protein, 24 aa, Giardia lamblia
APDAFLKTLFLDMGVPPTLASQAL

SEQ ID NO: 3182414 - protein, 18 aa, Giardia lamblia
APDAIKRAYRKQALRWHP

SEQ ID NO: 3182415 - protein, 26 aa, Giardia lamblia
APDCFDSRRWIWTRELKYRIHKDSDD

SEQ ID NO: 3182416 - protein, 17 aa, Giardia lamblia
APDGYIKVWSLQCVDRD

SEQ ID NO: 3182417 - protein, 19 aa, Giardia lamblia
APEATSAWAWHLIEKRDIL

SEQ ID NO: 3182418 - protein, 25 aa, Giardia lamblia
APEKELMGWGTWFGEGMSTYDKEKL

SEQ ID NO: 3182419 - protein, 23 aa, Giardia lamblia
APETLLRGIITPASNIWSIGAIA

SEQ ID NO: 3182420 - protein, 20 aa, Giardia lamblia
APEVLLKKKYSPASDMWSLG

SEQ ID NO: 3182421 - protein, 19 aa, Giardia lamblia
APEVLQTYKHLPASDIWSL

SEQ ID NO: 3182422 - protein, 17 aa, Giardia lamblia
APFIGDVTCWMMDHSRE

SEQ ID NO: 3182423 - protein, 18 aa, Giardia lamblia
APFVPVEAPIHLTTSKPR

SEQ ID NO: 3182424 - protein, 17 aa, Giardia lamblia
APGDSLLLESPFEEGCN

SEQ ID NO: 3182425 - protein, 25 aa, Giardia lamblia
APGSHPGRLILWTKSAFASLDDVYA

SEQ ID NO: 3182426 - protein, 18 aa, Giardia lamblia
APHEAKLKKRDGFTALME

SEQ ID NO: 3182427 - protein, 19 aa, Giardia lamblia
APHEVRETNIFGWNALMFA

SEQ ID NO: 3182428 - protein, 25 aa, Giardia lamblia
APHVRSYKYRYRGASLHSGGLGGGH

SEQ ID NO: 3182429 - protein, 20 aa, Giardia lamblia
APIFQFNMDSLPHLKSKKIN

SEQ ID NO: 3182430 - protein, 21 aa, Giardia lamblia
APIFTLGILSEAFYGVTMRIQ

SEQ ID NO: 3182431 - protein, 27 aa, Giardia lamblia
APIQNNFITNLPFISTAPVMSFSYPKN

SEQ ID NO: 3182432 - protein, 22 aa, Giardia lamblia
APIQQLQMLTPQQMMAMSPEQL

SEQ ID NO: 3182433 - protein, 20 aa, Giardia lamblia
APISALTRRGSLPGGSYAVM

SEQ ID NO: 3182434 - protein, 26 aa, Giardia lamblia
APKEAGLFHLKGHSALLLAARSNYHE

SEQ ID NO: 3182435 - protein, 17 aa, Giardia lamblia
APKKLDGRLRGFAFVQY

SEQ ID NO: 3182436 - protein, 26 aa, Giardia lamblia
APKNILYVGMMLYDGDLHLPKNYLVS

SEQ ID NO: 3182437 - protein, 27 aa, Giardia lamblia
APLDNLLRYIVVPFGNMLLKQLTIVTQ

SEQ ID NO: 3182438 - protein, 26 aa, Giardia lamblia
APLDPDILLAKLAPGQRIFCEIYCHK

SEQ ID NO: 3182439 - protein, 37 aa, Giardia lamblia
APLEAKIQRKDGCTALFLAVFWNHIECARILAPLEAG

SEQ ID NO: 3182440 - protein, 18 aa, Giardia lamblia
APLEANLKRREGNTIGMY

SEQ ID NO: 3182441 - protein, 17 aa, Giardia lamblia
APLEKGITLPDGRNALM

SEQ ID NO: 3182442 - protein, 18 aa, Giardia lamblia
APLTLLRAIARCSKDIVA

SEQ ID NO: 3182443 - protein, 22 aa, Giardia lamblia
APMGCLRLPLLTKRELFELSGK

SEQ ID NO: 3182444 - protein, 24 aa, Giardia lamblia
APMRSEHYLLPSRRKYQQNYTLNL

SEQ ID NO: 3182445 - protein, 18 aa, Giardia lamblia
APMVLALETGCLDVVATI

SEQ ID NO: 3182446 - protein, 24 aa, Giardia lamblia
APNHPMWHEPVQNIAPLKNATPKP

SEQ ID NO: 3182447 - protein, 25 aa, Giardia lamblia
APNIPTFITVLYLEMLRQFASNLTD

SEQ ID NO: 3182448 - protein, 23 aa, Giardia lamblia
APNQTPPPYAISPALNKAGIQET

SEQ ID NO: 3182449 - protein, 21 aa, Giardia lamblia
APNVYRLRRPVDVASLRMSVS

SEQ ID NO: 3182450 - protein, 20 aa, Giardia lamblia
APPDASQFYRDSYNSLLEKH

SEQ ID NO: 3182451 - protein, 24 aa, Giardia lamblia
APPPFLALPVPGVRFTGPNGTTCT

SEQ ID NO: 3182452 - protein, 23 aa, Giardia lamblia
APPSLKPVLPLTMPALNTDTSKE

SEQ ID NO: 3182453 - protein, 26 aa, Giardia lamblia
APQLPPLITTIAPNLIYVPFEPSSAL

SEQ ID NO: 3182454 - protein, 24 aa, Giardia lamblia
APRCISTIQLLKLGRYFFENGFTV

SEQ ID NO: 3182455 - protein, 23 aa, Giardia lamblia
APRGPLSGLPSPSPTWLQRRTST

SEQ ID NO: 3182456 - protein, 24 aa, Giardia lamblia
APRHLRYKLAFDAPAFRYVKAYSN

SEQ ID NO: 3182457 - protein, 30 aa, Giardia lamblia
APRMVITVEPGLYFVPGFLARAYDDPIIAP

SEQ ID NO: 3182458 - protein, 28 aa, Giardia lamblia
APRQCYVYAIILLRRFMSRNRFYPLTIN

SEQ ID NO: 3182459 - protein, 18 aa, Giardia lamblia
APRQSIMNRPIKEPSKSN

SEQ ID NO: 3182460 - protein, 18 aa, Giardia lamblia
APSCIFIDEIDAIMSARG

SEQ ID NO: 3182461 - protein, 28 aa, Giardia lamblia
APSDHKMLRWWSLREHPTINMWAAGHDG

SEQ ID NO: 3182462 - protein, 26 aa, Giardia lamblia
APSDPAEYLFYLYRDCLLHKHGLSRL

SEQ ID NO: 3182463 - protein, 21 aa, Giardia lamblia
APSFPPNLELMKFGEVGIGFI

SEQ ID NO: 3182464 - protein, 17 aa, Giardia lamblia
APSIIFFDEIDAIANKR

SEQ ID NO: 3182465 - protein, 30 aa, Giardia lamblia
APSMLQIIETLMSVLPRLESPRNPQLYDRF

SEQ ID NO: 3182466 - protein, 19 aa, Giardia lamblia
APSMQPMHGIPAIPAVYTM

SEQ ID NO: 3182467 - protein, 23 aa, Giardia lamblia
APSVKPFTIVKRTVLWKDPETVE

SEQ ID NO: 3182468 - protein, 36 aa, Giardia lamblia
APSYKTLNAYIPAYSAYRRPWPGNYNEKFSSGAVGL

SEQ ID NO: 3182469 - protein, 17 aa, Giardia lamblia
APTIFLSASADRSIKIW

SEQ ID NO: 3182470 - protein, 17 aa, Giardia lamblia
APTLPRYVFRFTGNTEE

SEQ ID NO: 3182471 - protein, 24 aa, Giardia lamblia
APVAKALESLLGKPVTLLKDCCGP

SEQ ID NO: 3182472 - protein, 19 aa, Giardia lamblia
APVFAFLDCVCDEDQLAKV

SEQ ID NO: 3182473 - protein, 22 aa, Giardia lamblia
APVKSIAIPSLNDALTGPLSSA

SEQ ID NO: 3182474 - protein, 24 aa, Giardia lamblia
APVPIVHVMIDPLLKDVTPTARMQ

SEQ ID NO: 3182475 - protein, 28 aa, Giardia lamblia
APVPLKPKREICLPVMSTNLIAKIKREA

SEQ ID NO: 3182476 - protein, 17 aa, Giardia lamblia
APWNAPTPVIDAYDPII

SEQ ID NO: 3182477 - protein, 32 aa, Giardia lamblia
AQAIKTRNDHFPLLSDPKLPHTRENFNLPPLV

SEQ ID NO: 3182478 - protein, 26 aa, Giardia lamblia
AQARVLYRLALLYKESNRQALGAKAA

SEQ ID NO: 3182479 - protein, 25 aa, Giardia lamblia
AQATGPIRRVMRRTSAKQSLSEPKP

SEQ ID NO: 3182480 - protein, 28 aa, Giardia lamblia
AQAVKELLSFELPFVHQPDGSCLDLAIR

SEQ ID NO: 3182481 - protein, 25 aa, Giardia lamblia
AQCNNFYVFPGIGLGAYVCRAKKIT

SEQ ID NO: 3182482 - protein, 25 aa, Giardia lamblia
AQDRQIVLRKKFLNLAYTLAVSEEN

SEQ ID NO: 3182483 - protein, 23 aa, Giardia lamblia
AQDWANESWYSNSRTRDLIYEYG

SEQ ID NO: 3182484 - protein, 39 aa, Giardia lamblia
AQEIRLLTQDLSAVRLELKKRRIYIEKLKIRCDILTDRV

SEQ ID NO: 3182485 - protein, 26 aa, Giardia lamblia
AQELAMLYDVLTIISGLFLEVDEDLA

SEQ ID NO: 3182486 - protein, 27 aa, Giardia lamblia
AQELLREWMHRRLYMAHLRASRVHNVS

SEQ ID NO: 3182487 - protein, 28 aa, Giardia lamblia
AQEQYVLPYLIILITRLLPTAMELCEPQ

SEQ ID NO: 3182488 - protein, 17 aa, Giardia lamblia
AQFGVSVTLYIPVITEC

SEQ ID NO: 3182489 - protein, 21 aa, Giardia lamblia
AQGSLPQPYSYRSRANLSAAS

SEQ ID NO: 3182490 - protein, 24 aa, Giardia lamblia
AQIAALLSTCHVSIIPTQSLPTAT

SEQ ID NO: 3182491 - protein, 22 aa, Giardia lamblia
AQILSLQMNMQLAKSFEVVGGI

SEQ ID NO: 3182492 - protein, 21 aa, Giardia lamblia
AQKEKDVIDLTRALQAAQNAQ

SEQ ID NO: 3182493 - protein, 17 aa, Giardia lamblia
AQKPLTLHFEYSPRRVG

SEQ ID NO: 3182494 - protein, 24 aa, Giardia lamblia
AQKTIELMLLTKRGTRQDYINIIE

SEQ ID NO: 3182495 - protein, 18 aa, Giardia lamblia
AQLAIIHHNLQSSRWNMT

SEQ ID NO: 3182496 - protein, 26 aa, Giardia lamblia
AQLAKKFYRAFPGKRLLVGVFDEWAT

SEQ ID NO: 3182497 - protein, 21 aa, Giardia lamblia
AQLCKAAGLLLEKFYSCGCYC

SEQ ID NO: 3182498 - protein, 18 aa, Giardia lamblia
AQLESCGVTVKRAAAVLA

SEQ ID NO: 3182499 - protein, 20 aa, Giardia lamblia
AQMAPGERALFLQRLPDLQN

SEQ ID NO: 3182500 - protein, 23 aa, Giardia lamblia
AQMAYISLILVEPPANICPPSPA

SEQ ID NO: 3182501 - protein, 35 aa, Giardia lamblia
AQNKHWDVARILYPLESHLLPEVVSDLIPDPAKLS

SEQ ID NO: 3182502 - protein, 36 aa, Giardia lamblia
AQNLCIYTEIGKTGKLYLWNQNLLEVLSDAQLMEIN

SEQ ID NO: 3182503 - protein, 19 aa, Giardia lamblia
AQNLTFPEIVTSRNIRFLR

SEQ ID NO: 3182504 - protein, 25 aa, Giardia lamblia
AQNRLAYYTALVPKPIIPVMNYAYF

SEQ ID NO: 3182505 - protein, 30 aa, Giardia lamblia
AQPGQLPPALTPYAPLPPPIHLSPEHEAAL

SEQ ID NO: 3182506 - protein, 20 aa, Giardia lamblia
AQPLSIFQPVKEEALSYAHF

SEQ ID NO: 3182507 - protein, 17 aa, Giardia lamblia
AQQIMETIDLYFKPYYH

SEQ ID NO: 3182508 - protein, 20 aa, Giardia lamblia
AQQSPALAASMRLSSLHDNG

SEQ ID NO: 3182509 - protein, 18 aa, Giardia lamblia
AQQYYTKGKRPPSCQRTN

SEQ ID NO: 3182510 - protein, 25 aa, Giardia lamblia
AQRDLFNALIPPLNHVYPHVLYAYC

SEQ ID NO: 3182511 - protein, 26 aa, Giardia lamblia
AQRIAHLLFLMMIKVYKELRYRITLV

SEQ ID NO: 3182512 - protein, 25 aa, Giardia lamblia
AQRKANFYLFPPISQNQLLEMDSTD

SEQ ID NO: 3182513 - protein, 17 aa, Giardia lamblia
AQRKDVVYMRLSVSSAT

SEQ ID NO: 3182514 - protein, 33 aa, Giardia lamblia
AQRKNAELVFLVRYMDLLVQAYQLSIAAIKQNV

SEQ ID NO: 3182515 - protein, 19 aa, Giardia lamblia
AQRYLTWFHPDAVMDLYTS

SEQ ID NO: 3182516 - protein, 18 aa, Giardia lamblia
AQRYYLGIGLMDDFPETN

SEQ ID NO: 3182517 - protein, 19 aa, Giardia lamblia
AQSCHLIVATPGRLLSLLQ

SEQ ID NO: 3182518 - protein, 19 aa, Giardia lamblia
AQSLTLLEYVRNLSKNYTE

SEQ ID NO: 3182519 - protein, 25 aa, Giardia lamblia
AQSNFLEIVLLLCDVEDMYQDSRGR

SEQ ID NO: 3182520 - protein, 24 aa, Giardia lamblia
AQSTLLKCLRRENSFLRVAASQHQ

SEQ ID NO: 3182521 - protein, 17 aa, Giardia lamblia
AQSWLDKCTAELVLERN

SEQ ID NO: 3182522 - protein, 22 aa, Giardia lamblia
AQSYDICAMIKAIDISRKGMEN

SEQ ID NO: 3182523 - protein, 24 aa, Giardia lamblia
AQVEQTLLRMIPHGAILSKSAVLR

SEQ ID NO: 3182524 - protein, 19 aa, Giardia lamblia
AQVKMLKHVIIGLKRKLKV

SEQ ID NO: 3182525 - protein, 20 aa, Giardia lamblia
AQVLGILLKSPIADKEVSLV

SEQ ID NO: 3182526 - protein, 19 aa, Giardia lamblia
AQVLKALQYLHSWCQKGYL

SEQ ID NO: 3182527 - protein, 21 aa, Giardia lamblia
AQYSFMRISFPDQAGTVCCFR

SEQ ID NO: 3182528 - protein, 30 aa, Giardia lamblia
ARAAFRKLDVPFFPPPGFVSEMYRPEEIMK

SEQ ID NO: 3182529 - protein, 18 aa, Giardia lamblia
ARAKSQFMKVRPLSSTQQ

SEQ ID NO: 3182530 - protein, 18 aa, Giardia lamblia
ARALNAYPEKLNTAILLL

SEQ ID NO: 3182531 - protein, 28 aa, Giardia lamblia
ARAQFLENWSFMCRYIPVGILDEPQKLN

SEQ ID NO: 3182532 - protein, 17 aa, Giardia lamblia
ARARTENALRIKVEKAH

SEQ ID NO: 3182533 - protein, 24 aa, Giardia lamblia
ARASQILAGLQFTPAMQLRRTKEF

SEQ ID NO: 3182534 - protein, 27 aa, Giardia lamblia
ARCLQVDPMYRPSILELLLEPQINDVM

SEQ ID NO: 3182535 - protein, 19 aa, Giardia lamblia
ARCVDIRLLGVAAHTFREC

SEQ ID NO: 3182536 - protein, 20 aa, Giardia lamblia
ARDALLFMAIRNNDLPDVVA

SEQ ID NO: 3182537 - protein, 26 aa, Giardia lamblia
ARDDELYLEILLPTKTIVSEIMLLIL

SEQ ID NO: 3182538 - protein, 30 aa, Giardia lamblia
ARDFDICLCDIFLKRLLNSPQRHLYSEFQF

SEQ ID NO: 3182539 - protein, 23 aa, Giardia lamblia
ARDFLGYQIIMVSATMPNNLAVF

SEQ ID NO: 3182540 - protein, 26 aa, Giardia lamblia
ARDKRFIYYRIYKYRIVPLADDAISL

SEQ ID NO: 3182541 - protein, 22 aa, Giardia lamblia
ARDLGKVIVIYKSGRTPQGSSA

SEQ ID NO: 3182542 - protein, 26 aa, Giardia lamblia
ARDLLEKYLRALVLSAKFGALKELKY

SEQ ID NO: 3182543 - protein, 23 aa, Giardia lamblia
ARDQTLIELLISKELRTQVVSLQ

SEQ ID NO: 3182544 - protein, 17 aa, Giardia lamblia
AREFIQSGWKLSRNQEL

SEQ ID NO: 3182545 - protein, 18 aa, Giardia lamblia
ARELGAKLIIVFSKSGNS

SEQ ID NO: 3182546 - protein, 22 aa, Giardia lamblia
ARERSLALYRRFASMQYREITS

SEQ ID NO: 3182547 - protein, 28 aa, Giardia lamblia
ARFFSKRILNALWYLHDLYIIHRDIKTS

SEQ ID NO: 3182548 - protein, 23 aa, Giardia lamblia
ARFGEFFIAGLITSASAEPSQKM

SEQ ID NO: 3182549 - protein, 21 aa, Giardia lamblia
ARFIYASTILNDFADKHPQIR

SEQ ID NO: 3182550 - protein, 20 aa, Giardia lamblia
ARFKHIYSTLPLSTSLTVNS

SEQ ID NO: 3182551 - protein, 22 aa, Giardia lamblia
ARFLRILTNRKFSRSRKSDITV

SEQ ID NO: 3182552 - protein, 20 aa, Giardia lamblia
ARFVFLFRSLCNAMIAQIKT

SEQ ID NO: 3182553 - protein, 23 aa, Giardia lamblia
ARFVIQVIGIIYKLVFKDKTSKA

SEQ ID NO: 3182554 - protein, 17 aa, Giardia lamblia
ARFYTNLPGQLMGHKVR

SEQ ID NO: 3182555 - protein, 26 aa, Giardia lamblia
ARGAQHICELLLLVKDDSTIEANLLP

SEQ ID NO: 3182556 - protein, 25 aa, Giardia lamblia
ARGDTSLFILSRPEQKVYHMYNDLS

SEQ ID NO: 3182557 - protein, 20 aa, Giardia lamblia
ARGKLVLYTVPQDQLRTTKR

SEQ ID NO: 3182558 - protein, 25 aa, Giardia lamblia
ARGRDLGLYSPITKLKARAVLIDME

SEQ ID NO: 3182559 - protein, 25 aa, Giardia lamblia
ARGTPNFYVLKSSRALFSGLEVGLT

SEQ ID NO: 3182560 - protein, 26 aa, Giardia lamblia
ARHANRFTWPVPTYTPDAVAGIRASY

SEQ ID NO: 3182561 - protein, 23 aa, Giardia lamblia
ARHEIYLWVDGIPLSRSKGYISR

SEQ ID NO: 3182562 - protein, 18 aa, Giardia lamblia
ARHGSCDVLKYLIPLEKH

SEQ ID NO: 3182563 - protein, 21 aa, Giardia lamblia
ARHLEDLLGVPVRPSVNPGAL

SEQ ID NO: 3182564 - protein, 19 aa, Giardia lamblia
ARHRDAVRYLLDLTTTEIN

SEQ ID NO: 3182565 - protein, 23 aa, Giardia lamblia
ARIAQSLIDRLDAPSAPGTPNRT

SEQ ID NO: 3182566 - protein, 27 aa, Giardia lamblia
ARIEQRVRLLNNYMPIGTYPDIELHEF

SEQ ID NO: 3182567 - protein, 20 aa, Giardia lamblia
ARINDILKAGRKWSGLIIEM

SEQ ID NO: 3182568 - protein, 25 aa, Giardia lamblia
ARITQPLMSVYPTLALKTFLDCADR

SEQ ID NO: 3182569 - protein, 27 aa, Giardia lamblia
ARKAKIDQALLLELNPLEAAQSVKGNS

SEQ ID NO: 3182570 - protein, 29 aa, Giardia lamblia
ARKALQHPWLCDPLPHIVPLSGTQSQLER

SEQ ID NO: 3182571 - protein, 31 aa, Giardia lamblia
ARKDIPESTIWIFAYQLLNALEYCHSPFKEN

SEQ ID NO: 3182572 - protein, 23 aa, Giardia lamblia
ARKDNFLSVKFTIDGRYIYVPLI

SEQ ID NO: 3182573 - protein, 27 aa, Giardia lamblia
ARKGITIPTRILPLSGLSPKDLGDIRN

SEQ ID NO: 3182574 - protein, 20 aa, Giardia lamblia
ARKLYNWLNSYNCAMSISGK

SEQ ID NO: 3182575 - protein, 30 aa, Giardia lamblia
ARKNIYKRRFLKIVSTLRSARDSLRLVLDV

SEQ ID NO: 3182576 - protein, 31 aa, Giardia lamblia
ARKPPVICIGDLYFSRYNPLFHHRDTLQIQR

SEQ ID NO: 3182577 - protein, 28 aa, Giardia lamblia
ARKRICTALYHLLPKRVVAETFLLVVPR

SEQ ID NO: 3182578 - protein, 17 aa, Giardia lamblia
ARKRYVQVPPPRETKAT

SEQ ID NO: 3182579 - protein, 19 aa, Giardia lamblia
ARKSYVFKVPRKDDTYGRF

SEQ ID NO: 3182580 - protein, 19 aa, Giardia lamblia
ARKTRLWSCFRELQRASTG

SEQ ID NO: 3182581 - protein, 31 aa, Giardia lamblia
ARKVDIWCCGLILYELLTAKPAFTVAKSMDG

SEQ ID NO: 3182582 - protein, 19 aa, Giardia lamblia
ARKWLARKGLLVRGVLEDS

SEQ ID NO: 3182583 - protein, 20 aa, Giardia lamblia
ARLCAYNPSVWSYLTSKKWT

SEQ ID NO: 3182584 - protein, 18 aa, Giardia lamblia
ARLDSWLDNTMRSLGSFA

SEQ ID NO: 3182585 - protein, 21 aa, Giardia lamblia
ARLHMVYVELAEQRKVLKKRL

SEQ ID NO: 3182586 - protein, 27 aa, Giardia lamblia
ARLHRQLCMVYPKVISFLRNDCREEMR

SEQ ID NO: 3182587 - protein, 22 aa, Giardia lamblia
ARLIRVHPLPTWYDSTSLGELE

SEQ ID NO: 3182588 - protein, 18 aa, Giardia lamblia
ARLLVPYEVMLQDAKRNT

SEQ ID NO: 3182589 - protein, 21 aa, Giardia lamblia
ARLMMWYKIYKKGLAERYRVH

SEQ ID NO: 3182590 - protein, 18 aa, Giardia lamblia
ARLNPLIQNKLELSDFET

SEQ ID NO: 3182591 - protein, 26 aa, Giardia lamblia
ARLPDAKLPKTLAGLSKFLSSRMKKA

SEQ ID NO: 3182592 - protein, 19 aa, Giardia lamblia
ARLPKRPISAVPTKPVPTA

SEQ ID NO: 3182593 - protein, 26 aa, Giardia lamblia
ARLRARRILCQMVMLSLPSDDTKAYL

SEQ ID NO: 3182594 - protein, 28 aa, Giardia lamblia
ARLTKVYFIVMAYFPYNLHDLLYCNDVR

SEQ ID NO: 3182595 - protein, 21 aa, Giardia lamblia
ARLVCFYDNRLSLLTVPHGRY

SEQ ID NO: 3182596 - protein, 26 aa, Giardia lamblia
ARLVMFHDAILHFSRLFRVITQPRGH

SEQ ID NO: 3182597 - protein, 18 aa, Giardia lamblia
ARMFYGCCVFNLTKNQLI

SEQ ID NO: 3182598 - protein, 23 aa, Giardia lamblia
ARMRRTMRDSWEGQTALMFAAQA

SEQ ID NO: 3182599 - protein, 24 aa, Giardia lamblia
ARNGHAAVCKLLVGLEKGCKLPNG

SEQ ID NO: 3182600 - protein, 19 aa, Giardia lamblia
ARNGHVECLKLLLDKEEGM

SEQ ID NO: 3182601 - protein, 26 aa, Giardia lamblia
ARNGVQALLPPLRVKLLKIESSTTAD

SEQ ID NO: 3182602 - protein, 20 aa, Giardia lamblia
ARPDNQGILFDLLGDLSTRF

SEQ ID NO: 3182603 - protein, 18 aa, Giardia lamblia
ARPLLTHEKAFYLDTIHP

SEQ ID NO: 3182604 - protein, 17 aa, Giardia lamblia
ARPPPPPFSPDRSFLRK

SEQ ID NO: 3182605 - protein, 35 aa, Giardia lamblia
ARPRLSTLQFYGKFLGSQALLKRRARRLQSLLDET

SEQ ID NO: 3182606 - protein, 19 aa, Giardia lamblia
ARQFSIPTKVSAFKLNSFY

SEQ ID NO: 3182607 - protein, 22 aa, Giardia lamblia
ARQGQFNRLCSLSASCIKSRDS

SEQ ID NO: 3182608 - protein, 25 aa, Giardia lamblia
ARQKRLLQERVSQISLVDAMKKTNE

SEQ ID NO: 3182609 - protein, 18 aa, Giardia lamblia
ARQPILNHTPMRPASQQL

SEQ ID NO: 3182610 - protein, 21 aa, Giardia lamblia
ARQPRIIQIIQNDLNTSASSR

SEQ ID NO: 3182611 - protein, 18 aa, Giardia lamblia
ARRIGLELKHHNIIHAMK

SEQ ID NO: 3182612 - protein, 26 aa, Giardia lamblia
ARRIHTNLRGIIPLGVPTPYTTVSAF

SEQ ID NO: 3182613 - protein, 30 aa, Giardia lamblia
ARRISAATFVTFPPALWALHRVEQAAPSAV

SEQ ID NO: 3182614 - protein, 17 aa, Giardia lamblia
ARRTALNKLLPFQREDF

SEQ ID NO: 3182615 - protein, 19 aa, Giardia lamblia
ARRVLWAPETSKLPKKFVT

SEQ ID NO: 3182616 - protein, 24 aa, Giardia lamblia
ARRYNRFFGSFYGGVRSGPGVLYT

SEQ ID NO: 3182617 - protein, 32 aa, Giardia lamblia
ARSKLDAAAYWLFTQPYFYGLIIDQHGCFVVE

SEQ ID NO: 3182618 - protein, 23 aa, Giardia lamblia
ARSLLYQLFISHEIEHVYIDLVG

SEQ ID NO: 3182619 - protein, 22 aa, Giardia lamblia
ARSRGSLTGSYYLPPSSSVRMR

SEQ ID NO: 3182620 - protein, 24 aa, Giardia lamblia
ARSRIYALVYHYSKKVYLWAVHDY

SEQ ID NO: 3182621 - protein, 22 aa, Giardia lamblia
ARTLANLNTWKGGLNTTLVSTT

SEQ ID NO: 3182622 - protein, 22 aa, Giardia lamblia
ARTNVYPIIADARHPYKYRMIV

SEQ ID NO: 3182623 - protein, 18 aa, Giardia lamblia
ARTQSLYKTAYSLVGNIE

SEQ ID NO: 3182624 - protein, 27 aa, Giardia lamblia
ARTSSGLIVLLWGAKAADLRPVLVGLA

SEQ ID NO: 3182625 - protein, 32 aa, Giardia lamblia
ARVDIAARRVMYRQLMFPRSQSERRPRRQQHT

SEQ ID NO: 3182626 - protein, 17 aa, Giardia lamblia
ARVFAAREKYILAASEW

SEQ ID NO: 3182627 - protein, 26 aa, Giardia lamblia
ARVLLEDRMWTAPGPGYYSNESTLVK

SEQ ID NO: 3182628 - protein, 25 aa, Giardia lamblia
ARVNTLITPLGLKKAFIRLAPDVQA

SEQ ID NO: 3182629 - protein, 27 aa, Giardia lamblia
ARWLELHGPPRTDILSFRGVLNLWRER

SEQ ID NO: 3182630 - protein, 26 aa, Giardia lamblia
ARYCEPGFVIHPPLKFVKEKYVPFEA

SEQ ID NO: 3182631 - protein, 17 aa, Giardia lamblia
ARYFMPCAAIYLDHRRY

SEQ ID NO: 3182632 - protein, 18 aa, Giardia lamblia
ARYVALGLVYRDMRNFYD

SEQ ID NO: 3182633 - protein, 25 aa, Giardia lamblia
ASAAHVTAIIPYFGYARQDRKAASR

SEQ ID NO: 3182634 - protein, 24 aa, Giardia lamblia
ASAGIFESPFIKLTFQIPSKDMAG

SEQ ID NO: 3182635 - protein, 23 aa, Giardia lamblia
ASAKICGRLPTKPLKSICASTQQ

SEQ ID NO: 3182636 - protein, 30 aa, Giardia lamblia
ASASPLSELLPYNAFLIAASLYIRHVEVDA

SEQ ID NO: 3182637 - protein, 19 aa, Giardia lamblia
ASATFRGSSFLKLARTHAS

SEQ ID NO: 3182638 - protein, 25 aa, Giardia lamblia
ASATHRVYLVVILHNIPPEPSEIPR

SEQ ID NO: 3182639 - protein, 25 aa, Giardia lamblia
ASCEILNSYTPLMKAIIAGNNSAVS

SEQ ID NO: 3182640 - protein, 25 aa, Giardia lamblia
ASDDALYRQPLPGFPVTVSTTTTTQ

SEQ ID NO: 3182641 - protein, 23 aa, Giardia lamblia
ASDDFLMEWLRSASRFAYVKCMD

SEQ ID NO: 3182642 - protein, 17 aa, Giardia lamblia
ASDEFWTSLTKTKLPYV

SEQ ID NO: 3182643 - protein, 27 aa, Giardia lamblia
ASDHNMPIFPTIEIALLLNAKGKMYLC

SEQ ID NO: 3182644 - protein, 26 aa, Giardia lamblia
ASDIDGRIHSLLFPDSLKDKCLRIIE

SEQ ID NO: 3182645 - protein, 31 aa, Giardia lamblia
ASDIWSFGVLLLELCTFKQPNWKPSLLKVAP

SEQ ID NO: 3182646 - protein, 29 aa, Giardia lamblia
ASDIWSLGAIIYSVAMLRAPFVAPTKDDT

SEQ ID NO: 3182647 - protein, 35 aa, Giardia lamblia
ASDIWSLGALLYELCTFKPLFIAPSHMDKKDVAGL

SEQ ID NO: 3182648 - protein, 22 aa, Giardia lamblia
ASDLFACYRNFSASGLLGPSPY

SEQ ID NO: 3182649 - protein, 24 aa, Giardia lamblia
ASDNPQYALPIDGGLDKATEKQPL

SEQ ID NO: 3182650 - protein, 26 aa, Giardia lamblia
ASDNRPIPVMLGYYMYMGKTVHSDRA

SEQ ID NO: 3182651 - protein, 18 aa, Giardia lamblia
ASDPPQATAKYLLYMVHR

SEQ ID NO: 3182652 - protein, 17 aa, Giardia lamblia
ASDRPWTPPSAEGCARP

SEQ ID NO: 3182653 - protein, 25 aa, Giardia lamblia
ASDWDGDLALFKALLRPSKVSADKN

SEQ ID NO: 3182654 - protein, 21 aa, Giardia lamblia
ASEAAFYRQSLAALKAELLGA

SEQ ID NO: 3182655 - protein, 24 aa, Giardia lamblia
ASELAYLYRNIDIFEVVFAAERSL

SEQ ID NO: 3182656 - protein, 30 aa, Giardia lamblia
ASENRYLRALLCILLGIPPVYDSYGRFCFT

SEQ ID NO: 3182657 - protein, 25 aa, Giardia lamblia
ASESARYAVYRLLSKRLLDFEVLDD

SEQ ID NO: 3182658 - protein, 55 aa, Giardia lamblia
ASEVYIGMLCPSLPLRYLFSVNSIFPELGYGCFRLFKYLPVIVRGSYPHAEPDSM

SEQ ID NO: 3182659 - protein, 17 aa, Giardia lamblia
ASFFGLRGYYNCEVRDF

SEQ ID NO: 3182660 - protein, 25 aa, Giardia lamblia
ASFKSYMFLRIVDTPQVPLMATITA

SEQ ID NO: 3182661 - protein, 17 aa, Giardia lamblia
ASFLLREARFDHDPLLK

SEQ ID NO: 3182662 - protein, 34 aa, Giardia lamblia
ASGGMTLRLPILLVLRSILLPCNFNAVLSVDICP

SEQ ID NO: 3182663 - protein, 21 aa, Giardia lamblia
ASGLIAAPYGYNLRMPFRPRV

SEQ ID NO: 3182664 - protein, 21 aa, Giardia lamblia
ASGLTTLYPLPDNWKEIIDQS

SEQ ID NO: 3182665 - protein, 29 aa, Giardia lamblia
ASGPLFGRLSFSSLTLHILCDYVSAKCIC

SEQ ID NO: 3182666 - protein, 24 aa, Giardia lamblia
ASGSFLEIFRYVHKKRPSMAVLSC

SEQ ID NO: 3182667 - protein, 31 aa, Giardia lamblia
ASGTTALILALWYEDTTIVRLLLPEANIADN

SEQ ID NO: 3182668 - protein, 24 aa, Giardia lamblia
ASGWTNLIYFAYLGDVCAVKENLH

SEQ ID NO: 3182669 - protein, 28 aa, Giardia lamblia
ASHERSLVLKIFTTKLKPMLEYVGTLIK

SEQ ID NO: 3182670 - protein, 17 aa, Giardia lamblia
ASHIYKAYPRPSTVAGY

SEQ ID NO: 3182671 - protein, 18 aa, Giardia lamblia
ASHPFIKKGRRPVVLCIV

SEQ ID NO: 3182672 - protein, 36 aa, Giardia lamblia
ASHVQRIFDLNDPIRRLYLLYLSQQADITEVEVCLL

SEQ ID NO: 3182673 - protein, 24 aa, Giardia lamblia
ASIASISRLCAIRSPTSGQRSSTR

SEQ ID NO: 3182674 - protein, 19 aa, Giardia lamblia
ASIIWPYISHPTITYKKCV

SEQ ID NO: 3182675 - protein, 26 aa, Giardia lamblia
ASIPAILDISKLVNLVILVVNAKIGL

SEQ ID NO: 3182676 - protein, 25 aa, Giardia lamblia
ASIPGHLLDVIYADVLRTLGEYGQD

SEQ ID NO: 3182677 - protein, 20 aa, Giardia lamblia
ASIQLLPRDSGALIAISDQI

SEQ ID NO: 3182678 - protein, 20 aa, Giardia lamblia
ASIRVRLQGQRPSVGSIEAA

SEQ ID NO: 3182679 - protein, 32 aa, Giardia lamblia
ASITQVLNNLWQPTAPFINQLKQQLLSELQES

SEQ ID NO: 3182680 - protein, 30 aa, Giardia lamblia
ASKAFCPPQDFNKVLRPKSVGFCSCRIDPD

SEQ ID NO: 3182681 - protein, 31 aa, Giardia lamblia
ASKAHLTPKVMYRFVTWLPAVVKRSLDSEFI

SEQ ID NO: 3182682 - protein, 19 aa, Giardia lamblia
ASKALAVSAVLPTSSLALS

SEQ ID NO: 3182683 - protein, 23 aa, Giardia lamblia
ASKDFELQSLRRVVEQLNQAFAD

SEQ ID NO: 3182684 - protein, 22 aa, Giardia lamblia
ASKGGLLEKPELTPHARLADSE

SEQ ID NO: 3182685 - protein, 26 aa, Giardia lamblia
ASKHELAPLTLFEDADRRLADFEKAL

SEQ ID NO: 3182686 - protein, 17 aa, Giardia lamblia
ASKKDISMLQRAVLKLT

SEQ ID NO: 3182687 - protein, 22 aa, Giardia lamblia
ASKTIDYIFRKSQELQAKEELI

SEQ ID NO: 3182688 - protein, 17 aa, Giardia lamblia
ASKTIMIANVSPAAYHF

SEQ ID NO: 3182689 - protein, 26 aa, Giardia lamblia
ASLERRRSLILQKLAGAQARTAEMEQ

SEQ ID NO: 3182690 - protein, 41 aa, Giardia lamblia
ASLGLIMAVSPYIESFLKTQNFYLYFRYLEKRSNDKICVAM

SEQ ID NO: 3182691 - protein, 19 aa, Giardia lamblia
ASLGVWRTIASNRKELLSI

SEQ ID NO: 3182692 - protein, 22 aa, Giardia lamblia
ASLIEFFELFGTIYNAEDLTIY

SEQ ID NO: 3182693 - protein, 24 aa, Giardia lamblia
ASLISAVAEFPGCSLPPCTENGSL

SEQ ID NO: 3182694 - protein, 20 aa, Giardia lamblia
ASLLVPYEKDRIGSEGKTAL

SEQ ID NO: 3182695 - protein, 39 aa, Giardia lamblia
ASLTNTARFNWLPKAVYLATMIRRAILFDFGVIKGDSKD

SEQ ID NO: 3182696 - protein, 26 aa, Giardia lamblia
ASLVDNLLNTIWRPYDQELINSCVER

SEQ ID NO: 3182697 - protein, 24 aa, Giardia lamblia
ASLVTTMYPDPIKYSQLDAPPINE

SEQ ID NO: 3182698 - protein, 21 aa, Giardia lamblia
ASLWVMRELIQSRPTISMIPL

SEQ ID NO: 3182699 - protein, 30 aa, Giardia lamblia
ASLYPRRKHIFNYIKKLLKKYQRSLTHEQA

SEQ ID NO: 3182700 - protein, 27 aa, Giardia lamblia
ASMCNTPVLFPLLREELLLLDSHGRSA

SEQ ID NO: 3182701 - protein, 21 aa, Giardia lamblia
ASMLKEALRILQGKVQKMLPE

SEQ ID NO: 3182702 - protein, 32 aa, Giardia lamblia
ASMQSFLMKDILDKLVVLSLSNCGLEKVPACL

SEQ ID NO: 3182703 - protein, 26 aa, Giardia lamblia
ASMVWEYLLMMIFRGLLDECPKVTGI

SEQ ID NO: 3182704 - protein, 20 aa, Giardia lamblia
ASNELIILTRLMRAAHTNST

SEQ ID NO: 3182705 - protein, 18 aa, Giardia lamblia
ASNFVLIRSIQAYNMLLM

SEQ ID NO: 3182706 - protein, 29 aa, Giardia lamblia
ASNNPQLLFALLSHIYIHNVLINAAEIFR

SEQ ID NO: 3182707 - protein, 24 aa, Giardia lamblia
ASNSALQPVLPKSAKRWAIQRNGE

SEQ ID NO: 3182708 - protein, 35 aa, Giardia lamblia
ASNSLIQEILARMRILYTSLFNLYTNSNKVMLAYR

SEQ ID NO: 3182709 - protein, 26 aa, Giardia lamblia
ASNTTLGSVSLFLAQKTESPVCIQQH

SEQ ID NO: 3182710 - protein, 29 aa, Giardia lamblia
ASPDAFLQAFLTFCERFHLGKKLGLFLTD

SEQ ID NO: 3182711 - protein, 26 aa, Giardia lamblia
ASPDIYMYVPLLGQVFSRRVSNKPLT

SEQ ID NO: 3182712 - protein, 19 aa, Giardia lamblia
ASPDPVPAPAPRAPAADPK

SEQ ID NO: 3182713 - protein, 17 aa, Giardia lamblia
ASPILKRNWLDSSVFSV

SEQ ID NO: 3182714 - protein, 26 aa, Giardia lamblia
ASPIRYRSFFLLTEESRLVLLYEKFH

SEQ ID NO: 3182715 - protein, 23 aa, Giardia lamblia
ASPPVHLQVPLISINKPEKKTTS

SEQ ID NO: 3182716 - protein, 23 aa, Giardia lamblia
ASPSECYRLIRLCKHLGANLVGF

SEQ ID NO: 3182717 - protein, 24 aa, Giardia lamblia
ASPSLPIPRAISITVDRPINIPTD

SEQ ID NO: 3182718 - protein, 25 aa, Giardia lamblia
ASQEFFYRQVVSPVVKDFLDGFNCT

SEQ ID NO: 3182719 - protein, 23 aa, Giardia lamblia
ASQKMEAYRRGVATGYEGKGDMK

SEQ ID NO: 3182720 - protein, 22 aa, Giardia lamblia
ASQLDEKYARRMQLLDTRKRLN

SEQ ID NO: 3182721 - protein, 32 aa, Giardia lamblia
ASQVPFISRSLFASIFSYFVNKRKGTPLMPCM

SEQ ID NO: 3182722 - protein, 25 aa, Giardia lamblia
ASRDALFRLDPLYSQLQMQELTCTT

SEQ ID NO: 3182723 - protein, 31 aa, Giardia lamblia
ASRETIYVSKFKLPPVIPADYMVDPQIQTLL

SEQ ID NO: 3182724 - protein, 34 aa, Giardia lamblia
ASRKNHVPYRASMLTKILRTPFENGYVTFLATVN

SEQ ID NO: 3182725 - protein, 30 aa, Giardia lamblia
ASRLGKLSGLMWPKILRYINKELQLRDVFE

SEQ ID NO: 3182726 - protein, 25 aa, Giardia lamblia
ASRPISHFNPGTVPPPMYSNPRYRT

SEQ ID NO: 3182727 - protein, 19 aa, Giardia lamblia
ASRYYDIGVLAPHLANMRD

SEQ ID NO: 3182728 - protein, 20 aa, Giardia lamblia
ASRYYDIGVLAPHLANMRDH

SEQ ID NO: 3182729 - protein, 26 aa, Giardia lamblia
ASSAARLLVPIQLQCRDKYGNTALMY

SEQ ID NO: 3182730 - protein, 25 aa, Giardia lamblia
ASSDAVVMVYNLPQSITKEKMREIV

SEQ ID NO: 3182731 - protein, 24 aa, Giardia lamblia
ASSDGLYRITDLRAPESPLYEHNF

SEQ ID NO: 3182732 - protein, 25 aa, Giardia lamblia
ASSESMLSAILPIRKLYGYSDVLND

SEQ ID NO: 3182733 - protein, 19 aa, Giardia lamblia
ASSFNPFRSVSDGAALGGS

SEQ ID NO: 3182734 - protein, 18 aa, Giardia lamblia
ASSKRWSTHTPLMDAVLF

SEQ ID NO: 3182735 - protein, 25 aa, Giardia lamblia
ASSRALCDLCAWFGRGRLNWESPCK

SEQ ID NO: 3182736 - protein, 22 aa, Giardia lamblia
ASSRSHVILDLKITINSGMSGS

SEQ ID NO: 3182737 - protein, 24 aa, Giardia lamblia
ASSRYVVMDLVPTLRRLRVKSKRT

SEQ ID NO: 3182738 - protein, 28 aa, Giardia lamblia
ASSVFGRPAVLPSMSLIGRELARVKDNN

SEQ ID NO: 3182739 - protein, 25 aa, Giardia lamblia
ASTCSALLALPFPYHFVDPDRQLEK

SEQ ID NO: 3182740 - protein, 25 aa, Giardia lamblia
ASTIEWLTHEFPVEASPSLFGLHAN

SEQ ID NO: 3182741 - protein, 21 aa, Giardia lamblia
ASTQLYLQNLALQGELDSLKS

SEQ ID NO: 3182742 - protein, 25 aa, Giardia lamblia
ASTSNRFLYRPLSTLNFKEIGGPEI

SEQ ID NO: 3182743 - protein, 23 aa, Giardia lamblia
ASTTPAIYWKKVAKEYPEFITAV

SEQ ID NO: 3182744 - protein, 17 aa, Giardia lamblia
ASTTRLYLRKGRGNNRV

SEQ ID NO: 3182745 - protein, 17 aa, Giardia lamblia
ASVAEMLPPNLGKIIRQ

SEQ ID NO: 3182746 - protein, 24 aa, Giardia lamblia
ASVEDMLRRIPFSSGLQSNIPPSP

SEQ ID NO: 3182747 - protein, 23 aa, Giardia lamblia
ASVEVESLLKKALNAREADYKDL

SEQ ID NO: 3182748 - protein, 21 aa, Giardia lamblia
ASVLPDLLCQIKLISAQSAYY

SEQ ID NO: 3182749 - protein, 29 aa, Giardia lamblia
ASVNKFYAQKLFDYVFGSLSNPFLGSLTL

SEQ ID NO: 3182750 - protein, 26 aa, Giardia lamblia
ASVPPITLSTLLPLVNNRLWGSAYDS

SEQ ID NO: 3182751 - protein, 25 aa, Giardia lamblia
ASVTTSSLPPYRPITQANQATRLQA

SEQ ID NO: 3182752 - protein, 25 aa, Giardia lamblia
ASVVFSGIPMLSLSTVPKAPVSPST

SEQ ID NO: 3182753 - protein, 18 aa, Giardia lamblia
ASVVTLKLQLKSAQEKNK

SEQ ID NO: 3182754 - protein, 24 aa, Giardia lamblia
ASVYHSFSFDYPRSYSSVFGQGTD

SEQ ID NO: 3182755 - protein, 27 aa, Giardia lamblia
ASYDGLYYQVPIPHTIYFSKDPVQSFI

SEQ ID NO: 3182756 - protein, 25 aa, Giardia lamblia
ASYEANLIPEFTRPSLMNFSSSQVG

SEQ ID NO: 3182757 - protein, 17 aa, Giardia lamblia
ASYIPLFQSRNITAVIR

SEQ ID NO: 3182758 - protein, 19 aa, Giardia lamblia
ASYMFQPENGILAVAFYDD

SEQ ID NO: 3182759 - protein, 21 aa, Giardia lamblia
ASYYSTYQSERSRYGRPASGL

SEQ ID NO: 3182760 - protein, 23 aa, Giardia lamblia
ATAASLHWKLEAATKQIAALTNE

SEQ ID NO: 3182761 - protein, 22 aa, Giardia lamblia
ATADRLVYLCRQLIAYQREKVA

SEQ ID NO: 3182762 - protein, 20 aa, Giardia lamblia
ATAFALHHNAKHPSLSALST

SEQ ID NO: 3182763 - protein, 21 aa, Giardia lamblia
ATAFRRLCLEYQNAQWKIVKR

SEQ ID NO: 3182764 - protein, 32 aa, Giardia lamblia
ATAFSIAQYYHRQELLSLLGAGSLQLTNTEEN

SEQ ID NO: 3182765 - protein, 23 aa, Giardia lamblia
ATASLFSGPAPPAPITASIAPGM

SEQ ID NO: 3182766 - protein, 26 aa, Giardia lamblia
ATASTFPFFPTFNFVNAIISRRSIEK

SEQ ID NO: 3182767 - protein, 18 aa, Giardia lamblia
ATCKILSLMPLDYETFVH

SEQ ID NO: 3182768 - protein, 20 aa, Giardia lamblia
ATCQELCCIYCIVSGSHPPG

SEQ ID NO: 3182769 - protein, 26 aa, Giardia lamblia
ATCTDMQMLRLFTLIDPRSPLSPRES

SEQ ID NO: 3182770 - protein, 27 aa, Giardia lamblia
ATCYRYTTFSFPLRNWEKRMQRFTVDV

SEQ ID NO: 3182771 - protein, 26 aa, Giardia lamblia
ATDAQKIRKLLQLLANSTITSNRLLA

SEQ ID NO: 3182772 - protein, 17 aa, Giardia lamblia
ATDLLLVHAATEKPYGF

SEQ ID NO: 3182773 - protein, 24 aa, Giardia lamblia
ATDTLLASPPLSLGGVVITWKKRN

SEQ ID NO: 3182774 - protein, 22 aa, Giardia lamblia
ATDWLFAHLPACAGHSQMVCPG

SEQ ID NO: 3182775 - protein, 23 aa, Giardia lamblia
ATEAIMTLLRPIIRNETDAILCP

SEQ ID NO: 3182776 - protein, 23 aa, Giardia lamblia
ATEHTPLMQAVLVNNIDAAHRAL

SEQ ID NO: 3182777 - protein, 24 aa, Giardia lamblia
ATELQVLVAHLGVSVSSILSSQQE

SEQ ID NO: 3182778 - protein, 26 aa, Giardia lamblia
ATETVRDILPNKPLYISSASDKEYVM

SEQ ID NO: 3182779 - protein, 17 aa, Giardia lamblia
ATFAKEVTFPVVMKIVS

SEQ ID NO: 3182780 - protein, 24 aa, Giardia lamblia
ATGDVKIGRWPICKGTALMRAAAR

SEQ ID NO: 3182781 - protein, 24 aa, Giardia lamblia
ATGERPNLPLQWRQTDAAMHWKRV

SEQ ID NO: 3182782 - protein, 24 aa, Giardia lamblia
ATGNVEIGRWFICKGTALMRAAAH

SEQ ID NO: 3182783 - protein, 29 aa, Giardia lamblia
ATHTIIDNLLYMVIGFSDGMILVCTCNSS

SEQ ID NO: 3182784 - protein, 18 aa, Giardia lamblia
ATIKLWSLSDRKLLYVFT

SEQ ID NO: 3182785 - protein, 28 aa, Giardia lamblia
ATILELCTAVFYLNLSNNKLRSAPFVKK

SEQ ID NO: 3182786 - protein, 26 aa, Giardia lamblia
ATIQKLPQLMPSDQIRFMRVLQQISG

SEQ ID NO: 3182787 - protein, 24 aa, Giardia lamblia
ATIVQWLRFHLKRKNARLEYIRAS

SEQ ID NO: 3182788 - protein, 28 aa, Giardia lamblia
ATKADMLYVPVIAHLLPGKASFLEKFID

SEQ ID NO: 3182789 - protein, 25 aa, Giardia lamblia
ATKDCHLYVYRMSSARLSYSVGRGR

SEQ ID NO: 3182790 - protein, 26 aa, Giardia lamblia
ATKMLLRHIQYVTDDLGWTALDHAAN

SEQ ID NO: 3182791 - protein, 18 aa, Giardia lamblia
ATKRVFLKKCQYPEFNFA

SEQ ID NO: 3182792 - protein, 21 aa, Giardia lamblia
ATLDRVGYVFDRLYDMSKRQR

SEQ ID NO: 3182793 - protein, 19 aa, Giardia lamblia
ATLLGLHLRVNSWEDLDIC

SEQ ID NO: 3182794 - protein, 28 aa, Giardia lamblia
ATLRAAALPPMQIPTTARFALVKVDSRF

SEQ ID NO: 3182795 - protein, 25 aa, Giardia lamblia
ATNDPLLSLLLALHSFESALFLCNK

SEQ ID NO: 3182796 - protein, 33 aa, Giardia lamblia
ATNHQILATLLYQVLPSYLPYKALRVLSNLGDT

SEQ ID NO: 3182797 - protein, 19 aa, Giardia lamblia
ATNKELIAEIDRLKTLLDK

SEQ ID NO: 3182798 - protein, 42 aa, Giardia lamblia
ATNVNSLTIRCPIPMFVVFSWGTILNLALVPVGSSLLSFQAL

SEQ ID NO: 3182799 - protein, 27 aa, Giardia lamblia
ATPGPKSFLSVISFNPAVISNHQRILN

SEQ ID NO: 3182800 - protein, 32 aa, Giardia lamblia
ATPLSPMSSPIIKILPIPSMPQCFVAVAESGL

SEQ ID NO: 3182801 - protein, 24 aa, Giardia lamblia
ATPPTPLTPAMWSPGTSPSVEIMA

SEQ ID NO: 3182802 - protein, 20 aa, Giardia lamblia
ATPQILRHDRVLAPAPSSVN

SEQ ID NO: 3182803 - protein, 30 aa, Giardia lamblia
ATPSALQPLPSVPALLTLPLMILGSTERGF

SEQ ID NO: 3182804 - protein, 24 aa, Giardia lamblia
ATPTAVCFLPRPPYYVSTLTEEER

SEQ ID NO: 3182805 - protein, 21 aa, Giardia lamblia
ATPWYHWYENCEVQNVSTTIP

SEQ ID NO: 3182806 - protein, 24 aa, Giardia lamblia
ATQALERATLYKDELLARITDLEC

SEQ ID NO: 3182807 - protein, 25 aa, Giardia lamblia
ATQKRTFFCLHCYTFGLNKEEALTQ

SEQ ID NO: 3182808 - protein, 25 aa, Giardia lamblia
ATQKYKVTYLNTLKADFLAVSTSIL

SEQ ID NO: 3182809 - protein, 26 aa, Giardia lamblia
ATQSRQIFRRVILRDLPPQMVSLFIQ

SEQ ID NO: 3182810 - protein, 19 aa, Giardia lamblia
ATRDLLDLIARRLDTEFDE

SEQ ID NO: 3182811 - protein, 22 aa, Giardia lamblia
ATRLPLGHFLWKYGNPSQFSPD

SEQ ID NO: 3182812 - protein, 22 aa, Giardia lamblia
ATRNFRSGHPPVMSLRHLVSKN

SEQ ID NO: 3182813 - protein, 23 aa, Giardia lamblia
ATRWIKRLFFEAPEYSKTDVGNV

SEQ ID NO: 3182814 - protein, 24 aa, Giardia lamblia
ATSFLSLLQRMLESMVLLEALTAT

SEQ ID NO: 3182815 - protein, 20 aa, Giardia lamblia
ATVLQSISLDTIPLGSIAST

SEQ ID NO: 3182816 - protein, 23 aa, Giardia lamblia
ATVLTMIKDIASALAFLHNPINF

SEQ ID NO: 3182817 - protein, 35 aa, Giardia lamblia
ATVQCGSSIWLGRLHDLLLVDPQTLPLGTRLNTRS

SEQ ID NO: 3182818 - protein, 28 aa, Giardia lamblia
ATVSNYRVSYLQRLLSQLINEGVAAGVY

SEQ ID NO: 3182819 - protein, 17 aa, Giardia lamblia
ATVYIKLGISDLSFFVS

SEQ ID NO: 3182820 - protein, 28 aa, Giardia lamblia
ATYRSCLATFRKRLLTPGVLDKCAVESK

SEQ ID NO: 3182821 - protein, 34 aa, Giardia lamblia
ATYYEQLLAPRLNARLFMRYLTQDEPLSKRQLSA

SEQ ID NO: 3182822 - protein, 24 aa, Giardia lamblia
ATYYHRILNPLKLARIGFCTKPKA

SEQ ID NO: 3182823 - protein, 26 aa, Giardia lamblia
AVAAGSFIFPPPPKTAFLITDYGTND

SEQ ID NO: 3182824 - protein, 22 aa, Giardia lamblia
AVALLRHGFTSIATTYIDANLY

SEQ ID NO: 3182825 - protein, 24 aa, Giardia lamblia
AVAQQILRLRTELSERESCIVTLQ

SEQ ID NO: 3182826 - protein, 23 aa, Giardia lamblia
AVAVFVFVVNYCCKMFSCTSVIG

SEQ ID NO: 3182827 - protein, 28 aa, Giardia lamblia
AVCRTCGTALLWHKSYPFTYCVDCAEKV

SEQ ID NO: 3182828 - protein, 23 aa, Giardia lamblia
AVDARLKNEIKLRQLQRQERELS

SEQ ID NO: 3182829 - protein, 27 aa, Giardia lamblia
AVDASQHDKLLLEKLRVKELEVENLRK

SEQ ID NO: 3182830 - protein, 29 aa, Giardia lamblia
AVDDPVKIATFPQYLYPVALERYAEIADY

SEQ ID NO: 3182831 - protein, 30 aa, Giardia lamblia
AVDEDNLDLLPFLIPLQKGLRTLSEEAIGS

SEQ ID NO: 3182832 - protein, 19 aa, Giardia lamblia
AVDIFCLYMSRLFSILKDN

SEQ ID NO: 3182833 - protein, 23 aa, Giardia lamblia
AVDLFRAKYGPGFLVCGIGGGSP

SEQ ID NO: 3182834 - protein, 21 aa, Giardia lamblia
AVDLYVFQRSILALCGPCPFF

SEQ ID NO: 3182835 - protein, 26 aa, Giardia lamblia
AVDPMAVSVRQLRAPLPLTDTSSVEE

SEQ ID NO: 3182836 - protein, 24 aa, Giardia lamblia
AVDTCIPLRPVYCRAISAGIQGCR

SEQ ID NO: 3182837 - protein, 18 aa, Giardia lamblia
AVDYFSTWTPPDTSSFPS

SEQ ID NO: 3182838 - protein, 28 aa, Giardia lamblia
AVEAGSIDCVRLLLNYYGMERDNHNLTA

SEQ ID NO: 3182839 - protein, 32 aa, Giardia lamblia
AVEAKNTNFLELFLIRTWLKRDEDGMSPIETA

SEQ ID NO: 3182840 - protein, 19 aa, Giardia lamblia
AVECPEGRPLFACLLDKTM

SEQ ID NO: 3182841 - protein, 25 aa, Giardia lamblia
AVEETSYWLASEAKLLFALHELTPL

SEQ ID NO: 3182842 - protein, 20 aa, Giardia lamblia
AVEHSGMLVTYRAKSTLNNP

SEQ ID NO: 3182843 - protein, 18 aa, Giardia lamblia
AVEILTSYDWPVLTTTEI

SEQ ID NO: 3182844 - protein, 27 aa, Giardia lamblia
AVELDAFNFPSWCGLALSLSSMLASHV

SEQ ID NO: 3182845 - protein, 17 aa, Giardia lamblia
AVELDFLQQMWTIGRLG

SEQ ID NO: 3182846 - protein, 19 aa, Giardia lamblia
AVEMLLPFESGLQDWNERC

SEQ ID NO: 3182847 - protein, 22 aa, Giardia lamblia
AVEQLAPLAGFLRCSTGTSIPK

SEQ ID NO: 3182848 - protein, 26 aa, Giardia lamblia
AVEQLHDSSLLFYKGGRRGIPVVLQR

SEQ ID NO: 3182849 - protein, 23 aa, Giardia lamblia
AVETGWLLQYSVSLSLIVPGPSN

SEQ ID NO: 3182850 - protein, 35 aa, Giardia lamblia
AVEVLSMYLQLYDTIPWNALKYLVASIIYGGRVID

SEQ ID NO: 3182851 - protein, 19 aa, Giardia lamblia
AVEYYKKLVDDIRAGIVVL

SEQ ID NO: 3182852 - protein, 28 aa, Giardia lamblia
AVFAGLRDLLDFILDFRFSDDDISYLKL

SEQ ID NO: 3182853 - protein, 28 aa, Giardia lamblia
AVFEHASPIMNYLMDLCSQLSRNSDIRN

SEQ ID NO: 3182854 - protein, 33 aa, Giardia lamblia
AVFLKTDYLQWMAPLPLCFVTSSKKKLAEFLHA

SEQ ID NO: 3182855 - protein, 17 aa, Giardia lamblia
AVFLLYGVRVYMVSEPV

SEQ ID NO: 3182856 - protein, 19 aa, Giardia lamblia
AVGFTALMLAAERDYFKII

SEQ ID NO: 3182857 - protein, 23 aa, Giardia lamblia
AVGGLVGGMPPLGPGAQSYLHGL

SEQ ID NO: 3182858 - protein, 19 aa, Giardia lamblia
AVGKSCLLLRFVEQKFIPL

SEQ ID NO: 3182859 - protein, 26 aa, Giardia lamblia
AVGNKRYRIVRKSDYLRIFKEQSMKS

SEQ ID NO: 3182860 - protein, 20 aa, Giardia lamblia
AVGPPTLEPALPAVQPPQFL

SEQ ID NO: 3182861 - protein, 25 aa, Giardia lamblia
AVGRSTSVIGLPLSPTANIDTASTL

SEQ ID NO: 3182862 - protein, 31 aa, Giardia lamblia; identical to SEQ ID NO: 3150105

SEQ ID NO: 3182863 - protein, 24 aa, Giardia lamblia
AVHQRNYMLVERYADRFASSVNSH

SEQ ID NO: 3182864 - protein, 18 aa, Giardia lamblia
AVIECLFLLVQHTDGSVA

SEQ ID NO: 3182865 - protein, 17 aa, Giardia lamblia
AVIFFDYAPGQSKSFVI

SEQ ID NO: 3182866 - protein, 17 aa, Giardia lamblia
AVILSFLRHLCMSSFTS

SEQ ID NO: 3182867 - protein, 17 aa, Giardia lamblia
AVIVDILSTAAVLIDGP

SEQ ID NO: 3182868 - protein, 24 aa, Giardia lamblia
AVKDQFNHVASCTKSLLLTQDLDK

SEQ ID NO: 3182869 - protein, 24 aa, Giardia lamblia
AVKIVHPEIPYLIAIRDHSNISPE

SEQ ID NO: 3182870 - protein, 17 aa, Giardia lamblia
AVKLFHEHLKRQTLKDG

SEQ ID NO: 3182871 - protein, 24 aa, Giardia lamblia
AVKLLLPAEEYMPRVRSRAIAYGA

SEQ ID NO: 3182872 - protein, 50 aa, Giardia lamblia
AVKLLTDFEYPFTLPDTRTALMLAIKHRRYRLVPLMTERLSRLTNRHGYN

SEQ ID NO: 3182873 - protein, 17 aa, Giardia lamblia
AVKLSNMNQRVSRFHDK

SEQ ID NO: 3182874 - protein, 26 aa, Giardia lamblia
AVKNTFLSFIQLPNGAPIECIVVFPG

SEQ ID NO: 3182875 - protein, 17 aa, Giardia lamblia
AVKPTCLLGLSTVGKSF

SEQ ID NO: 3182876 - protein, 22 aa, Giardia lamblia
AVKRVLVESLFPDESTLTNADL

SEQ ID NO: 3182877 - protein, 17 aa, Giardia lamblia
AVKYLKAKLLADDNDYK

SEQ ID NO: 3182878 - protein, 37 aa, Giardia lamblia
AVLAEDAVVFFDWSRSFKFLCQVNVTATSLIWSGAGD

SEQ ID NO: 3182879 - protein, 28 aa, Giardia lamblia
AVLDGDMKLAWSLIPLQAGLQDEEGRTA

SEQ ID NO: 3182880 - protein, 25 aa, Giardia lamblia
AVLHQPTILAFTLACGVSVQVCPLE

SEQ ID NO: 3182881 - protein, 24 aa, Giardia lamblia
AVLPSEFTQVKTLFIPVSSSRQQS

SEQ ID NO: 3182882 - protein, 26 aa, Giardia lamblia
AVLRHFYPFYMIYNEFIHLLVVYHMT

SEQ ID NO: 3182883 - protein, 18 aa, Giardia lamblia
AVLRLIFHEILGGSIVGL

SEQ ID NO: 3182884 - protein, 25 aa, Giardia lamblia
AVLRLNLSFVRVLGRLEFDLLLGQD

SEQ ID NO: 3182885 - protein, 19 aa, Giardia lamblia
AVLSFSLTRGFEKLRSMLP

SEQ ID NO: 3182886 - protein, 43 aa, Giardia lamblia
AVLSMDGYIVVYYPDPRRDLTILRYPLFIKVASIFLGHQQLDR

SEQ ID NO: 3182887 - protein, 30 aa, Giardia lamblia
AVLSVNHIFAFMTYLHCGLPFETVAKMVIP

SEQ ID NO: 3182888 - protein, 27 aa, Giardia lamblia
AVLTRSRLPLLVPLRLPPDPSTTAGTH

SEQ ID NO: 3182889 - protein, 27 aa, Giardia lamblia
AVNFTFLSYPFLLDPMIKVQILCAECC

SEQ ID NO: 3182890 - protein, 22 aa, Giardia lamblia
AVNKLALLDDLAPDLATHRDEL

SEQ ID NO: 3182891 - protein, 19 aa, Giardia lamblia
AVNLPLIEGVAVKPLGNSD

SEQ ID NO: 3182892 - protein, 22 aa, Giardia lamblia
AVNMSLYRKFSPLYISGQADDD

SEQ ID NO: 3182893 - protein, 25 aa, Giardia lamblia
AVNRAKIQSIWRDRLRSVKKTELIK

SEQ ID NO: 3182894 - protein, 25 aa, Giardia lamblia
AVNRYGVHKWGAISSLLVGRSPQEC

SEQ ID NO: 3182895 - protein, 18 aa, Giardia lamblia
AVNVINGLLLLKLAVLIK

SEQ ID NO: 3182896 - protein, 19 aa, Giardia lamblia
AVPLTAPPLVPAPTPTPVP

SEQ ID NO: 3182897 - protein, 27 aa, Giardia lamblia
AVPNSDAALPPPFPQSYKAAVIDRAIE

SEQ ID NO: 3182898 - protein, 18 aa, Giardia lamblia
AVPRACCSSTLWPIRGRP

SEQ ID NO: 3182899 - protein, 23 aa, Giardia lamblia
AVPSFHHFFDKHKHRLLQPCFAV

SEQ ID NO: 3182900 - protein, 19 aa, Giardia lamblia
AVPSLPPLSQPMVDVAPQP

SEQ ID NO: 3182901 - protein, 30 aa, Giardia lamblia
AVPVEALERLAISETFIKLQEELQFTYLMP

SEQ ID NO: 3182902 - protein, 41 aa, Giardia lamblia
AVQETLLVAFHRLLLRRTPALRKLPAWQLAFEHLAQMKAIR

SEQ ID NO: 3182903 - protein, 32 aa, Giardia lamblia
AVQGINRAIILGPLLHGRPVRSAELSHQCLRG

SEQ ID NO: 3182904 - protein, 19 aa, Giardia lamblia
AVQLLLPYEAGQQTPRGTT

SEQ ID NO: 3182905 - protein, 19 aa, Giardia lamblia
AVQMLKFGQLIDIAKLDSA

SEQ ID NO: 3182906 - protein, 45 aa, Giardia lamblia
AVQQESHFIEYLPPAKFDNSSFVQKLILHNLLPGTANYERRMLAM

SEQ ID NO: 3182907 - protein, 27 aa, Giardia lamblia
AVQREDVPSLRILLRHPGLALEDLQCV

SEQ ID NO: 3182908 - protein, 23 aa, Giardia lamblia
AVQSIPYKARLPEKPIARTGRDA

SEQ ID NO: 3182909 - protein, 24 aa, Giardia lamblia
AVQYILFTVDYLERHYGHKAKCFI

SEQ ID NO: 3182910 - protein, 22 aa, Giardia lamblia
AVREFGFMVALKERSFPVPDPI

SEQ ID NO: 3182911 - protein, 17 aa, Giardia lamblia
AVRFLMNFEAGMKGRDG

SEQ ID NO: 3182912 - protein, 27 aa, Giardia lamblia
AVRGCDTLALLILRDGTAKIGFVNELM

SEQ ID NO: 3182913 - protein, 19 aa, Giardia lamblia
AVRILARYESRFKTADGMA

SEQ ID NO: 3182914 - protein, 20 aa, Giardia lamblia
AVRILHDYVSAFSLLHDECA

SEQ ID NO: 3182915 - protein, 27 aa, Giardia lamblia
AVRKQPTLIQYREKFRFLHTEDRSSPD

SEQ ID NO: 3182916 - protein, 26 aa, Giardia lamblia
AVRLTNVIHFIVINVLYNAWTKVRAE

SEQ ID NO: 3182917 - protein, 23 aa, Giardia lamblia
AVRNDDLLSIRKYLYRSGEVNTE

SEQ ID NO: 3182918 - protein, 30 aa, Giardia lamblia
AVRNIELGFMPFISGKLFAGTLSFVAHETN

SEQ ID NO: 3182919 - protein, 31 aa, Giardia lamblia
AVRQCKYPHELILEKLPTKAFLTILSGSSYP

SEQ ID NO: 3182920 - protein, 31 aa, Giardia lamblia
AVRQYPVSATLYPRKPQRLSWHGITNVKQGG

SEQ ID NO: 3182921 - protein, 23 aa, Giardia lamblia
AVSDQGILKYGKRLKYLFKDEEL

SEQ ID NO: 3182922 - protein, 24 aa, Giardia lamblia
AVSFLEALKLYDVLYPSKAEIDDC

SEQ ID NO: 3182923 - protein, 31 aa, Giardia lamblia
AVSGTMDIFSTYVLALLGGAGLFPEEVVKNL

SEQ ID NO: 3182924 - protein, 20 aa, Giardia lamblia
AVSHLIVFQSYQFSGDNLSS

SEQ ID NO: 3182925 - protein, 25 aa, Giardia lamblia
AVSHVLDFIALYKVTSDRAYIRTYK

SEQ ID NO: 3182926 - protein, 25 aa, Giardia lamblia
AVSIPEEFIWFLLVAVAEMLAELHD

SEQ ID NO: 3182927 - protein, 24 aa, Giardia lamblia
AVSPLLKSIDLLALSFDPVPVTVP

SEQ ID NO: 3182928 - protein, 20 aa, Giardia lamblia
AVSQTRLLYTHPKAEAILGM

SEQ ID NO: 3182929 - protein, 34 aa, Giardia lamblia
AVSSAAELLPYPTLPLPRILGYCGDRLLLQYREN

SEQ ID NO: 3182930 - protein, 26 aa, Giardia lamblia
AVSSQRFVPMPLKFIEKAIGQHEVSL

SEQ ID NO: 3182931 - protein, 25 aa, Giardia lamblia
AVTAAVLPTSPLGINSFRSPPPSQD

SEQ ID NO: 3182932 - protein, 17 aa, Giardia lamblia
AVTNNPMFTFKIGQPFG

SEQ ID NO: 3182933 - protein, 30 aa, Giardia lamblia
AVTPGLLIDATLPTFVTPGTVLEPATEGNG

SEQ ID NO: 3182934 - protein, 38 aa, Giardia lamblia
AVTPLNIAFVLKAARSVYLKMLPSFRAQFYGYLTHQDL

SEQ ID NO: 3182935 - protein, 23 aa, Giardia lamblia
AVTPTHLSTIQRPLRGTPIAWKM

SEQ ID NO: 3182936 - protein, 23 aa, Giardia lamblia
AVTPTIPPFTFKELHERLNGVLG

SEQ ID NO: 3182937 - protein, 26 aa, Giardia lamblia
AVTSEQIVPLLTKLASQQLKEAEKND

SEQ ID NO: 3182938 - protein, 45 aa, Giardia lamblia
AVTSNARIIFILLLEHKTTQSLLYLPLWVWQVYEQNLLEKDHKSK

SEQ ID NO: 3182939 - protein, 19 aa, Giardia lamblia
AVTTRFPGAVYFIMMEMDA

SEQ ID NO: 3182940 - protein, 22 aa, Giardia lamblia
AVTVPIEIFEFGKIAQGKKKAC

SEQ ID NO: 3182941 - protein, 31 aa, Giardia lamblia
AVTYPSIRAIISRLLVLNPSSRITAKELCDV

SEQ ID NO: 3182942 - protein, 39 aa, Giardia lamblia
AVVAIIKRQFLLFDHLNGILYILLGMQGDFIPSLCSILS

SEQ ID NO: 3182943 - protein, 25 aa, Giardia lamblia
AVVARTLSQLWKVPLLAVNHCVAHI

SEQ ID NO: 3182944 - protein, 18 aa, Giardia lamblia
AVVGRINELFSTNGFREG

SEQ ID NO: 3182945 - protein, 26 aa, Giardia lamblia
AVVSCLWAYPELSKLTHILIMNGDVV

SEQ ID NO: 3182946 - protein, 20 aa, Giardia lamblia
AVVYSILPWVDASAAIGQYV

SEQ ID NO: 3182947 - protein, 28 aa, Giardia lamblia
AVYADIGEMSILRPPPLVAELTASRREG

SEQ ID NO: 3182948 - protein, 33 aa, Giardia lamblia
AVYKYCCRGLFTRHKILLSLHMCVKILESYGRI

SEQ ID NO: 3182949 - protein, 24 aa, Giardia lamblia
AVYNLFYVARLHDVLFRLCPEKAS

SEQ ID NO: 3182950 - protein, 26 aa, Giardia lamblia
AVYQQNGMLRLWDATSGMWLRDITDS

SEQ ID NO: 3182951 - protein, 17 aa, Giardia lamblia
AVYVPSVARYNSVLPVS

SEQ ID NO: 3182952 - protein, 37 aa, Giardia lamblia
AVYYTPQYGDTYIEWLRLLVIKYLVYGTNISSVVRQC

SEQ ID NO: 3182953 - protein, 23 aa, Giardia lamblia
AWCTKYYLSYKSLEYAKNVYRQL

SEQ ID NO: 3182954 - protein, 25 aa, Giardia lamblia
AWDFAVDKKPLVFGGIRVGIDIEKT

SEQ ID NO: 3182955 - protein, 17 aa, Giardia lamblia
AWGVDAFGQNTLVLAAC

SEQ ID NO: 3182956 - protein, 26 aa, Giardia lamblia
AWIPDKAWLNIIALSALNIFTSLPNQ

SEQ ID NO: 3182957 - protein, 19 aa, Giardia lamblia
AWKLEMTDYLLTHPPTGPT

SEQ ID NO: 3182958 - protein, 17 aa, Giardia lamblia
AWLQTVNPSLRPFRDIR

SEQ ID NO: 3182959 - protein, 21 aa, Giardia lamblia
AWNVCKLMFIKVRATLSAGMQ

SEQ ID NO: 3182960 - protein, 17 aa, Giardia lamblia
AWQRPFGNIAVFAGWDP

SEQ ID NO: 3182961 - protein, 19 aa, Giardia lamblia
AWVNSLRESTEKRFFLGHI

SEQ ID NO: 3182962 - protein, 17 aa, Giardia lamblia
AWYLREGFCALRELYKY

SEQ ID NO: 3182963 - protein, 20 aa, Giardia lamblia
AYADPIPDYFSLVERARQSG

SEQ ID NO: 3182964 - protein, 17 aa, Giardia lamblia
AYAPVGNTLLLHQKFRA

SEQ ID NO: 3182965 - protein, 30 aa, Giardia lamblia
AYCETVRKQFYVFEPLIVEAIRIVLNTTLA

SEQ ID NO: 3182966 - protein, 25 aa, Giardia lamblia
AYCKRMFLTRICTETGLTKIDRFAE

SEQ ID NO: 3182967 - protein, 17 aa, Giardia lamblia
AYDAFCRAVAQNAVRLS

SEQ ID NO: 3182968 - protein, 24 aa, Giardia lamblia
AYDAYTTPVYIRGAIQEHSAFAST

SEQ ID NO: 3182969 - protein, 20 aa, Giardia lamblia
AYDIWSLGCSLYELATGAKY

SEQ ID NO: 3182970 - protein, 24 aa, Giardia lamblia
AYDVTPIPCHFYTPILRENDDTVL

SEQ ID NO: 3182971 - protein, 24 aa, Giardia lamblia
AYEKFTTTVLMPRPGENPLADGVT

SEQ ID NO: 3182972 - protein, 23 aa, Giardia lamblia
AYEPGFPMFALGTPVPNQDETKD

SEQ ID NO: 3182973 - protein, 27 aa, Giardia lamblia
AYFKEICGPSLLLIIMESVQGTCFCDL

SEQ ID NO: 3182974 - protein, 42 aa, Giardia lamblia
AYFRIEEAFSLFVQIVSGVAYLHAFNLIHRDISAKNILVMLK

SEQ ID NO: 3182975 - protein, 21 aa, Giardia lamblia
AYGAPTDVLPPWRNDSSQDTA

SEQ ID NO: 3182976 - protein, 23 aa, Giardia lamblia
AYGHYQIAAYLLRYCVDIGALSG

SEQ ID NO: 3182977 - protein, 21 aa, Giardia lamblia
AYIDGIPLPDKVSHSGFCESA

SEQ ID NO: 3182978 - protein, 20 aa, Giardia lamblia
AYIKMIFNQRRSLLSGNAIV

SEQ ID NO: 3182979 - protein, 17 aa, Giardia lamblia
AYIRELMPSIALTICAK

SEQ ID NO: 3182980 - protein, 20 aa, Giardia lamblia
AYIYEYGYLRLTSAKYSLDT

SEQ ID NO: 3182981 - protein, 22 aa, Giardia lamblia
AYKNGEQIILEKVKCPCCDDII

SEQ ID NO: 3182982 - protein, 24 aa, Giardia lamblia
AYKQNLRKAIVYVTKLMSLRTHGA

SEQ ID NO: 3182983 - protein, 19 aa, Giardia lamblia
AYLMDICAARLYASDVRAL

SEQ ID NO: 3182984 - protein, 18 aa, Giardia lamblia
AYLRNLHLFGQWGNPRYT

SEQ ID NO: 3182985 - protein, 27 aa, Giardia lamblia
AYLTTLPFVILNEFLDYMAYLNQKPCQ

SEQ ID NO: 3182986 - protein, 17 aa, Giardia lamblia
AYMLDPVEKEQLLAGIK

SEQ ID NO: 3182987 - protein, 17 aa, Giardia lamblia
AYNIQYKKYAIATLSGK

SEQ ID NO: 3182988 - protein, 25 aa, Giardia lamblia
AYNNRPMLCRLLAIEEAKLQAYVHT

SEQ ID NO: 3182989 - protein, 31 aa, Giardia lamblia
AYNSGLPLMHDLVRNRILLADAKKLGQAAYQ

SEQ ID NO: 3182990 - protein, 25 aa, Giardia lamblia
AYPGHMPLMGYNWRIIRHAAKHILF

SEQ ID NO: 3182991 - protein, 18 aa, Giardia lamblia
AYPRTLIEFAMKNDLHYR

SEQ ID NO: 3182992 - protein, 19 aa, Giardia lamblia
AYRCYAYSIGKITGWDKSK

SEQ ID NO: 3182993 - protein, 26 aa, Giardia lamblia
AYRVPRALIILDGIESIIQYTPIGFR

SEQ ID NO: 3182994 - protein, 21 aa, Giardia lamblia
AYSCIIFVDICTCTTQTPLQQ

SEQ ID NO: 3182995 - protein, 18 aa, Giardia lamblia
AYSFCTILSNYTSGGSIS

SEQ ID NO: 3182996 - protein, 25 aa, Giardia lamblia
AYSILSNYFCIAVCSSFCICDHPID

SEQ ID NO: 3182997 - protein, 19 aa, Giardia lamblia
AYSLPIPDTIMNLWEPQFI

SEQ ID NO: 3182998 - protein, 27 aa, Giardia lamblia
AYSSLLLMDIPSYLGLLLRAHQTQIEP

SEQ ID NO: 3182999 - protein, 19 aa, Giardia lamblia
AYSSWVKLTPPIITEAINE

SEQ ID NO: 3183000 - protein, 23 aa, Giardia lamblia
AYTMYGKFIYQADPWLVCQDTQD

SEQ ID NO: 3183001 - protein, 24 aa, Giardia lamblia
AYTNPNMEGVFTRILQRAEELRIR

SEQ ID NO: 3183002 - protein, 18 aa, Giardia lamblia
AYTWIKSIAKWPHGEVYL

SEQ ID NO: 3183003 - protein, 26 aa, Giardia lamblia
AYVALNPLTTFNLPQSFFSGTLSNAL

SEQ ID NO: 3183004 - protein, 26 aa, Giardia lamblia
AYVGVKALWLEGNGFFKIENLEPLQN

SEQ ID NO: 3183005 - protein, 25 aa, Giardia lamblia
AYVKSVFVRNIYLPGSSYGDSMTRS

SEQ ID NO: 3183006 - protein, 35 aa, Giardia lamblia
AYVVYRSLRREYYTHPKICLMLTSVHDWFNGICSR

SEQ ID NO: 3183007 - protein, 21 aa, Giardia lamblia
AYWVFYIGPEGLCIDPQLCGK

SEQ ID NO: 3183008 - protein, 25 aa, Giardia lamblia
CAADQTYFLMLRPDTNSTGNTQWYY

SEQ ID NO: 3183009 - protein, 19 aa, Giardia lamblia
CAALDLECSLWGPARVKLE

SEQ ID NO: 3183010 - protein, 20 aa, Giardia lamblia
CAAMLSEPLRRSLVTSLRSS

SEQ ID NO: 3183011 - protein, 27 aa, Giardia lamblia
CAAPGSWSQVAAMKMPVGSLIVSVDLD

SEQ ID NO: 3183012 - protein, 25 aa, Giardia lamblia
CACVDGLLRFFDFDVDAPVQAIALP

SEQ ID NO: 3183013 - protein, 18 aa, Giardia lamblia
CADWPGEWVIFQGNLSII

SEQ ID NO: 3183014 - protein, 17 aa, Giardia lamblia
CADWSCKIWADDIRTPI

SEQ ID NO: 3183015 - protein, 30 aa, Giardia lamblia
CAEAWVFRAEFEMAIFRRNAAIDAITEGLR

SEQ ID NO: 3183016 - protein, 25 aa, Giardia lamblia
CAEKRKPFVLVMNKVDLVPQQVARA

SEQ ID NO: 3183017 - protein, 24 aa, Giardia lamblia
CAELKALFQHIMSVAHTGLVPWVG

SEQ ID NO: 3183018 - protein, 24 aa, Giardia lamblia
CAGSKWVFISYKNTCYRYSVNVCD

SEQ ID NO: 3183019 - protein, 22 aa, Giardia lamblia
CAICHRPWLILNSAGVCRTCHC

SEQ ID NO: 3183020 - protein, 31 aa, Giardia lamblia
CAILDQYDLRSVYSLALIDFIGRALKASVEV

SEQ ID NO: 3183021 - protein, 24 aa, Giardia lamblia
CAINDIRWKLKCLCALYCIRNNNA

SEQ ID NO: 3183022 - protein, 24 aa, Giardia lamblia
CAITKTIRLLDPFCPKNDEPMLCS

SEQ ID NO: 3183023 - protein, 29 aa, Giardia lamblia
CAIYAQCTIHWLDLLNYLNARAGSISEQQ

SEQ ID NO: 3183024 - protein, 25 aa, Giardia lamblia
CAMGRLFQCIVLKPFAIFGDDNLEE

SEQ ID NO: 3183025 - protein, 23 aa, Giardia lamblia
CAMIEHYLDNILDLLHTEDDTRT

SEQ ID NO: 3183026 - protein, 24 aa, Giardia lamblia
CANPAPGSIFLLENLRFHKEETNE

SEQ ID NO: 3183027 - protein, 22 aa, Giardia lamblia
CAPEIFKLLKYTEKIDIWALGC

SEQ ID NO: 3183028 - protein, 17 aa, Giardia lamblia
CARILTAWEARLTDKTH

SEQ ID NO: 3183029 - protein, 30 aa, Giardia lamblia
CARRVMATHRLGLMYSFPTPMAFCPGTNSL

SEQ ID NO: 3183030 - protein, 23 aa, Giardia lamblia
CARTAIGTPYYLSPELCEDKPYN

SEQ ID NO: 3183031 - protein, 18 aa, Giardia lamblia
CASSTLRSFPSRSNQQRP

SEQ ID NO: 3183032 - protein, 30 aa, Giardia lamblia
CASVLSLWYPSGYWMTPTPTALHLSDSALL

SEQ ID NO: 3183033 - protein, 20 aa, Giardia lamblia
CATKYHPFPRLQDPLDELCY

SEQ ID NO: 3183034 - protein, 24 aa, Giardia lamblia
CATMRSCFILTLNVSLEYEKAEAN

SEQ ID NO: 3183035 - protein, 22 aa, Giardia lamblia
CATRTMTREKALADFFQRHIYV

SEQ ID NO: 3183036 - protein, 19 aa, Giardia lamblia
CCALLVYDITRRASFEHVA

SEQ ID NO: 3183037 - protein, 20 aa, Giardia lamblia
CCFFAAPWVQTSPNTPDCSL

SEQ ID NO: 3183038 - protein, 30 aa, Giardia lamblia
CCGAAPDLWSLGIILYEMMALAKPSHTNQT

SEQ ID NO: 3183039 - protein, 25 aa, Giardia lamblia
CCGFNIIQLLPLQDTITGPILSPSG

SEQ ID NO: 3183040 - protein, 33 aa, Giardia lamblia
CCQQTRLLIKPASLLQMLYLVTPSNPFSETTAR

SEQ ID NO: 3183041 - protein, 23 aa, Giardia lamblia
CCRLMLRLEALPDGTLLNCLIDG

SEQ ID NO: 3183042 - protein, 25 aa, Giardia lamblia
CCTAQLLIDLLYANPSDRVVLHEEL

SEQ ID NO: 3183043 - protein, 27 aa, Giardia lamblia
CCVCIDRPAFVIIRPCMHMCICSQCVA

SEQ ID NO: 3183044 - protein, 18 aa, Giardia lamblia
CCVDSITASLRLLQTDQK

SEQ ID NO: 3183045 - protein, 17 aa, Giardia lamblia
CDCPGLVFAVKGSPRPL

SEQ ID NO: 3183046 - protein, 25 aa, Giardia lamblia
CDDIPVILFQCRLEDIIRGSVPLID

SEQ ID NO: 3183047 - protein, 24 aa, Giardia lamblia
CDELTRLPPAYSALLRNVNMTRPE

SEQ ID NO: 3183048 - protein, 17 aa, Giardia lamblia
CDFGFAREIDFDNSAMT

SEQ ID NO: 3183049 - protein, 19 aa, Giardia lamblia
CDFNSNLVLFTGYYEEEID

SEQ ID NO: 3183050 - protein, 27 aa, Giardia lamblia
CDHALYWEMRQRTELILWATSYPEGPT

SEQ ID NO: 3183051 - protein, 19 aa, Giardia lamblia
CDIFPTVISALQLYKHGPS

SEQ ID NO: 3183052 - protein, 24 aa, Giardia lamblia
CDIGRSTVLLKWKKKQYIDKGPNA

SEQ ID NO: 3183053 - protein, 30 aa, Giardia lamblia
CDLNVDYLKRIIWQRLQLVRIYTKKRNCPA

SEQ ID NO: 3183054 - protein, 19 aa, Giardia lamblia
CDLTNKQLSLLLTKGLYHE

SEQ ID NO: 3183055 - protein, 25 aa, Giardia lamblia
CDLVIKTLIACEPNFYILGHKARTA

SEQ ID NO: 3183056 - protein, 26 aa, Giardia lamblia
CDNFVLTMMLAYKNWIFGGKPTSFST

SEQ ID NO: 3183057 - protein, 26 aa, Giardia lamblia
CDQIFDHYRLILDKYLFISTSSKSMT

SEQ ID NO: 3183058 - protein, 24 aa, Giardia lamblia
CDSARLEWVQGLITAQVLLGKVHQ

SEQ ID NO: 3183059 - protein, 18 aa, Giardia lamblia
CDSFIKRLCLTKLSHDRE

SEQ ID NO: 3183060 - protein, 23 aa, Giardia lamblia
CDSIGPDRYFKYPIPGENCETHA

SEQ ID NO: 3183061 - protein, 24 aa, Giardia lamblia
CDTEGFFHFTQIRRTDPTVRVKRV

SEQ ID NO: 3183062 - protein, 17 aa, Giardia lamblia
CDVLKYLIPLEKHMRSS

SEQ ID NO: 3183063 - protein, 18 aa, Giardia lamblia
CEANYPEIAALLIPLEAG

SEQ ID NO: 3183064 - protein, 29 aa, Giardia lamblia
CEDEQLIRYNRTKLPSLRSCFRDAGLLTS

SEQ ID NO: 3183065 - protein, 25 aa, Giardia lamblia
CEDTLLAVPIMVDMICFAALLANVE

SEQ ID NO: 3183066 - protein, 32 aa, Giardia lamblia
CEESVRLCPSYHKAWFRLGNIRESAGNKPEAY

SEQ ID NO: 3183067 - protein, 23 aa, Giardia lamblia
CEGFAKAYQLLCSMIGIQATCVR

SEQ ID NO: 3183068 - protein, 18 aa, Giardia lamblia
CEGLGEIITLPPLTDNMT

SEQ ID NO: 3183069 - protein, 19 aa, Giardia lamblia
CEHLRERLKQNRRPRNPHL

SEQ ID NO: 3183070 - protein, 29 aa, Giardia lamblia
CEIESYTLLGYVVGLIPYPHHNQSPRNCY

SEQ ID NO: 3183071 - protein, 28 aa, Giardia lamblia
CEKRLSNFLPWHLAYAEIIFSDLLWPEF

SEQ ID NO: 3183072 - protein, 27 aa, Giardia lamblia
CELGISREEFLFLGSPPEIKKLVNEDL

SEQ ID NO: 3183073 - protein, 23 aa, Giardia lamblia
CELLMAREDFLNWCKWSIAKVSR

SEQ ID NO: 3183074 - protein, 20 aa, Giardia lamblia
CELVFPLMLAQNCATFGALN

SEQ ID NO: 3183075 - protein, 25 aa, Giardia lamblia
CEMVHTFVVPIFRDEDKFWKENFRT

SEQ ID NO: 3183076 - protein, 18 aa, Giardia lamblia
CENGPFRSLFPRNEKARN

SEQ ID NO: 3183077 - protein, 23 aa, Giardia lamblia
CEPSKAAAFLIHRACEGKRGDFR

SEQ ID NO: 3183078 - protein, 17 aa, Giardia lamblia
CERFAMEMLLFESTIED

SEQ ID NO: 3183079 - protein, 24 aa, Giardia lamblia
CERGWLAKALMGAHLLTPDCVDIF

SEQ ID NO: 3183080 - protein, 22 aa, Giardia lamblia
CERLGLPHLFDSSFRRFSLNTR

SEQ ID NO: 3183081 - protein, 20 aa, Giardia lamblia
CERLRVSVALAKRVMRQLVK

SEQ ID NO: 3183082 - protein, 17 aa, Giardia lamblia
CERLYDLQTSNTPYSVM

SEQ ID NO: 3183083 - protein, 33 aa, Giardia lamblia
CESLPPHMEMQPLKAVFKIVTSPAPSFKKPSQW

SEQ ID NO: 3183084 - protein, 18 aa, Giardia lamblia
CESSFMRDPLEAMSSVTK

SEQ ID NO: 3183085 - protein, 22 aa, Giardia lamblia
CETLPGPSRATLLEHEKPTVGR

SEQ ID NO: 3183086 - protein, 25 aa, Giardia lamblia
CETPQHRLLYLAIRFRLELISTDDN

SEQ ID NO: 3183087 - protein, 20 aa, Giardia lamblia
CFAIYMHMALCYYKLGDYLK

SEQ ID NO: 3183088 - protein, 18 aa, Giardia lamblia
CFATCRTIVEISSYLEFI

SEQ ID NO: 3183089 - protein, 21 aa, Giardia lamblia
CFDKIRLCYSTAIFALQNGMT

SEQ ID NO: 3183090 - protein, 25 aa, Giardia lamblia
CFGLTDELFLRCRSDPLLKACTYLA

SEQ ID NO: 3183091 - protein, 17 aa, Giardia lamblia
CFILDNLVVSANCGDSR

SEQ ID NO: 3183092 - protein, 18 aa, Giardia lamblia
CFIMYHLVKGVAYLHESK

SEQ ID NO: 3183093 - protein, 27 aa, Giardia lamblia
CFLAAIRSHFYHHFPYNTATFSQVHSS

SEQ ID NO: 3183094 - protein, 22 aa, Giardia lamblia
CFLCGHYYPTLSNLLTKRDCHL

SEQ ID NO: 3183095 - protein, 18 aa, Giardia lamblia
CFMTSTDYRRQIAKAILS

SEQ ID NO: 3183096 - protein, 24 aa, Giardia lamblia
CFPDFIFCRRELRFTAMQGKVSQN

SEQ ID NO: 3183097 - protein, 17 aa, Giardia lamblia
CFPLIVFAFGKKKCETY

SEQ ID NO: 3183098 - protein, 31 aa, Giardia lamblia
CFPSHMYIEQINKLIAVIRTLIGIEGGMKNN

SEQ ID NO: 3183099 - protein, 18 aa, Giardia lamblia
CFQCKGLCTFQRKEERHS

SEQ ID NO: 3183100 - protein, 17 aa, Giardia lamblia
CFTNPYTGLPCGSQMLS

SEQ ID NO: 3183101 - protein, 28 aa, Giardia lamblia
CFTRAPPHLAYYDLLLRCSESLLDTKVC

SEQ ID NO: 3183102 - protein, 19 aa, Giardia lamblia
CFVYGDRLQSYLLAIIVPN

SEQ ID NO: 3183103 - protein, 27 aa, Giardia lamblia
CGCTVLSATLLIYMDLRGLIDVEQELS

SEQ ID NO: 3183104 - protein, 23 aa, Giardia lamblia
CGCVIFEILTGRTLFRTHNSVVH

SEQ ID NO: 3183105 - protein, 29 aa, Giardia lamblia
CGDIHGQFYDLLRLFEYGGFPPATNYIFL

SEQ ID NO: 3183106 - protein, 26 aa, Giardia lamblia
CGEHGMVLRLSLYPSMKDSGISEEAA

SEQ ID NO: 3183107 - protein, 22 aa, Giardia lamblia
CGELVPFLRNIICTGVPVEVWL

SEQ ID NO: 3183108 - protein, 19 aa, Giardia lamblia
CGERHHFGKYYYSPNERYE

SEQ ID NO: 3183109 - protein, 28 aa, Giardia lamblia
CGHVNLANFSVLPLHLMTSHSPTEPGSS

SEQ ID NO: 3183110 - protein, 23 aa, Giardia lamblia
CGHYTILTCLRVLEGLKLDVKKE

SEQ ID NO: 3183111 - protein, 24 aa, Giardia lamblia
CGIGPHALLLAKRFNFTNLICNDL

SEQ ID NO: 3183112 - protein, 23 aa, Giardia lamblia
CGIVPGCMYYFYSEYKVPDDVIL

SEQ ID NO: 3183113 - protein, 26 aa, Giardia lamblia
CGIYTGSVIPLMLFAIDLGSCGDPSL

SEQ ID NO: 3183114 - protein, 17 aa, Giardia lamblia
CGKGDLLKFVKEYPQKI

SEQ ID NO: 3183115 - protein, 25 aa, Giardia lamblia
CGKTFIGACLAWLFSKVYGSLDHDS

SEQ ID NO: 3183116 - protein, 23 aa, Giardia lamblia
CGLEGRILAMRPAPIQISYWTHG

SEQ ID NO: 3183117 - protein, 24 aa, Giardia lamblia
CGMRVMSMRFTPDELFLVVAGNSN

SEQ ID NO: 3183118 - protein, 21 aa, Giardia lamblia
CGNLDAVRLLLPLEANKRCNC

SEQ ID NO: 3183119 - protein, 27 aa, Giardia lamblia
CGNRRHICELVFPTLLAKKCLAFGAIR

SEQ ID NO: 3183120 - protein, 19 aa, Giardia lamblia
CGPCPFFETVLKFYVCYMD

SEQ ID NO: 3183121 - protein, 17 aa, Giardia lamblia
CGRTRGHYRAKCTPIGW

SEQ ID NO: 3183122 - protein, 22 aa, Giardia lamblia
CGSIFTDILYFITEKVRSAIQT

SEQ ID NO: 3183123 - protein, 23 aa, Giardia lamblia
CGSTKLMTIIDNLKLTVSEYESI

SEQ ID NO: 3183124 - protein, 17 aa, Giardia lamblia
CGTYFVTRNSYLFVLKY

SEQ ID NO: 3183125 - protein, 29 aa, Giardia lamblia
CGYSRVLATFIISCLTFPHSIDLAGTTSG

SEQ ID NO: 3183126 - protein, 26 aa, Giardia lamblia
CHDNLELLLCEVGVFLNKHISHLSLC

SEQ ID NO: 3183127 - protein, 26 aa, Giardia lamblia
CHGLCLTCFCFPLNSTIVQTGAITPY

SEQ ID NO: 3183128 - protein, 21 aa, Giardia lamblia
CHGTIHPLIPARTGALMCLNC

SEQ ID NO: 3183129 - protein, 26 aa, Giardia lamblia
CHGVKSFIILLDRLSLEKEKITITEE

SEQ ID NO: 3183130 - protein, 18 aa, Giardia lamblia
CHIFSVKCDILVPTILHA

SEQ ID NO: 3183131 - protein, 31 aa, Giardia lamblia
CHPTKFVARLTAHTWCIEQKSKPYVVYTFTI

SEQ ID NO: 3183132 - protein, 29 aa, Giardia lamblia
CHRESVSMVLYQRLAYLLCTSRLQKLTEV

SEQ ID NO: 3183133 - protein, 28 aa, Giardia lamblia
CIDESFFLGCLLFPSACVYYFYGAEVQT

SEQ ID NO: 3183134 - protein, 17 aa, Giardia lamblia
CIDIIFNVLDPITHPDA

SEQ ID NO: 3183135 - protein, 21 aa, Giardia lamblia
CIEHGGTNALPLLLEAYGQGC

SEQ ID NO: 3183136 - protein, 28 aa, Giardia lamblia
CIEKMCRNFVFGSPIPLLSVSKAWNILN

SEQ ID NO: 3183137 - protein, 27 aa, Giardia lamblia
CIESFALLYVLFLARYSFIDTNRKHQL

SEQ ID NO: 3183138 - protein, 20 aa, Giardia lamblia
CIHILAPREASLRNNQYMTA

SEQ ID NO: 3183139 - protein, 17 aa, Giardia lamblia
CIIAKNGLSPLMIACDY

SEQ ID NO: 3183140 - protein, 17 aa, Giardia lamblia
CIKVMLNTHKFTIDDIT

SEQ ID NO: 3183141 - protein, 22 aa, Giardia lamblia
CILDMYYKVLISSLVTWARLTT

SEQ ID NO: 3183142 - protein, 23 aa, Giardia lamblia
CILDSGGWCALAYAIYAEFTDCI

SEQ ID NO: 3183143 - protein, 26 aa, Giardia lamblia
CILIITSFIKHMDLQLAFKAFNCGLV

SEQ ID NO: 3183144 - protein, 20 aa, Giardia lamblia
CILPIKRRNQIFSIRPNVDA

SEQ ID NO: 3183145 - protein, 18 aa, Giardia lamblia
CIMEPIAFALQELHPRIE

SEQ ID NO: 3183146 - protein, 26 aa, Giardia lamblia
CINAFCWALNMMRPDCAWKVPILVDL

SEQ ID NO: 3183147 - protein, 19 aa, Giardia lamblia
CIPKPLFITTTMIGLEFIG

SEQ ID NO: 3183148 - protein, 20 aa, Giardia lamblia
CIPTLKYVLALMNSPSFNVI

SEQ ID NO: 3183149 - protein, 17 aa, Giardia lamblia
CIPVRMDPSLLPAISFD

SEQ ID NO: 3183150 - protein, 28 aa, Giardia lamblia
CIQKIEDLILFITFLKETGLWGVKSLVT

SEQ ID NO: 3183151 - protein, 22 aa, Giardia lamblia
CIQYLSRIALPIAAQAALLFGD

SEQ ID NO: 3183152 - protein, 20 aa, Giardia lamblia
CIRGLFLGKHNASTATYTLL

SEQ ID NO: 3183153 - protein, 36 aa, Giardia lamblia
CIRSSICMRLFDSSLIKLAFNTLLGFIQDILTTNDR

SEQ ID NO: 3183154 - protein, 19 aa, Giardia lamblia
CIRWLLMDFVPTLAEKDIN

SEQ ID NO: 3183155 - protein, 17 aa, Giardia lamblia
CISALMLELETACDESG

SEQ ID NO: 3183156 - protein, 17 aa, Giardia lamblia
CITAYAHAYFREHVFSW

SEQ ID NO: 3183157 - protein, 25 aa, Giardia lamblia
CITSPAGIFYYKFIRDSSISTKKQD

SEQ ID NO: 3183158 - protein, 17 aa, Giardia lamblia
CIVYELITLKRPNFVGT

SEQ ID NO: 3183159 - protein, 18 aa, Giardia lamblia
CKAYLYLENSKLANIGFY

SEQ ID NO: 3183160 - protein, 27 aa, Giardia lamblia
CKDAIMRSLLAAMLLAFQQSICVIHAL

SEQ ID NO: 3183161 - protein, 27 aa, Giardia lamblia
CKDNPLIEGPPLAALLPPYAITSRDIC

SEQ ID NO: 3183162 - protein, 20 aa, Giardia lamblia
CKEAANIYSLQFAIPLALTI

SEQ ID NO: 3183163 - protein, 22 aa, Giardia lamblia
CKELYKLRTLAQMLLQRRTDLE

SEQ ID NO: 3183164 - protein, 27 aa, Giardia lamblia
CKHASHSYRWFRFACGLAYPCDTCHSK

SEQ ID NO: 3183165 - protein, 28 aa, Giardia lamblia
CKHPISCLEVFVYLEHLYLAAGDDEGYV

SEQ ID NO: 3183166 - protein, 20 aa, Giardia lamblia
CKKCKKVFRIDVTKFDPQAD

SEQ ID NO: 3183167 - protein, 27 aa, Giardia lamblia
CKKCKTLDWTMCRIEDGFLCCTSCAQS

SEQ ID NO: 3183168 - protein, 19 aa, Giardia lamblia
CKKLALRLAIYDSNHHPEK

SEQ ID NO: 3183169 - protein, 24 aa, Giardia lamblia
CKKRGLPIPECYFTRINELFGPID

SEQ ID NO: 3183170 - protein, 25 aa, Giardia lamblia
CKKSTLSLTSFWSRSLAMKSGSMEA

SEQ ID NO: 3183171 - protein, 19 aa, Giardia lamblia
CKLARLRRIMLRSLAEVNR

SEQ ID NO: 3183172 - protein, 23 aa, Giardia lamblia
CKLYDQAKPLQPLCLRLLSEVSV

SEQ ID NO: 3183173 - protein, 24 aa, Giardia lamblia
CKMRASGHLLTLRDLSEVELEDIV

SEQ ID NO: 3183174 - protein, 24 aa, Giardia lamblia
CKPSGAMYVFPRIHAPPAAIEAAR

SEQ ID NO: 3183175 - protein, 22 aa, Giardia lamblia
CKPYTNLIHPNLVRYYSVTIEQ

SEQ ID NO: 3183176 - protein, 27 aa, Giardia lamblia
CKQLLRLPVKLKCGHFYCYNCALDSLK

SEQ ID NO: 3183177 - protein, 24 aa, Giardia lamblia
CKRKFGDTPVFERLTRPPERPASA

SEQ ID NO: 3183178 - protein, 23 aa, Giardia lamblia
CKRLIYSKLSLSLLSQLHLNISL

SEQ ID NO: 3183179 - protein, 32 aa, Giardia lamblia
CKYVVEICSCLFAKSIGLSLPLQQPPALGGTG

SEQ ID NO: 3183180 - protein, 25 aa, Giardia lamblia
CLACTGILHPLPFTRSIDNSSPECP

SEQ ID NO: 3183181 - protein, 20 aa, Giardia lamblia
CLAVWFIKQLPDYIDARIMR

SEQ ID NO: 3183182 - protein, 38 aa, Giardia lamblia
CLDDLYIAFIVQYPLAQSTILYLLDLMSPTPELYQYVQ

SEQ ID NO: 3183183 - protein, 23 aa, Giardia lamblia
CLDILQSQWSPCFTILSVLLSIQ

SEQ ID NO: 3183184 - protein, 19 aa, Giardia lamblia
CLDSPPLRYCHLNRYNLLS

SEQ ID NO: 3183185 - protein, 20 aa, Giardia lamblia
CLEDLNEIFLSILESTPNAS

SEQ ID NO: 3183186 - protein, 17 aa, Giardia lamblia
CLEIAYLLAPKERGMRT

SEQ ID NO: 3183187 - protein, 20 aa, Giardia lamblia
CLESLLRRNALSFFKTVDIS

SEQ ID NO: 3183188 - protein, 19 aa, Giardia lamblia
CLFEDWIIPIFDECVEQQR

SEQ ID NO: 3183189 - protein, 25 aa, Giardia lamblia
CLGYTFKLSAIYYEVLRNYYGDGPV

SEQ ID NO: 3183190 - protein, 24 aa, Giardia lamblia
CLHCGKMFGAYEFLLAHHRRRHPG

SEQ ID NO: 3183191 - protein, 17 aa, Giardia lamblia
CLHIYEPVTADVVLGRV

SEQ ID NO: 3183192 - protein, 21 aa, Giardia lamblia
CLILKQKLMVLEKDYLDLKAS

SEQ ID NO: 3183193 - protein, 25 aa, Giardia lamblia
CLIVSSRFWPGCIYYVFARTLIWGS

SEQ ID NO: 3183194 - protein, 21 aa, Giardia lamblia
CLKCKYAYRAYGSLAMDIRKC

SEQ ID NO: 3183195 - protein, 17 aa, Giardia lamblia
CLKFSLNCKEYFVNTYK

SEQ ID NO: 3183196 - protein, 20 aa, Giardia lamblia
CLKLCVYGEWIKYCHTLYND

SEQ ID NO: 3183197 - protein, 34 aa, Giardia lamblia
CLLDLEGHILLKDLYTAYNVAHWSRSYRAMRAMA

SEQ ID NO: 3183198 - protein, 17 aa, Giardia lamblia
CLLKEIMCLRAIVVGYL

SEQ ID NO: 3183199 - protein, 27 aa, Giardia lamblia
CLLPRPPMELIALLVNLFISGRTTLPV

SEQ ID NO: 3183200 - protein, 17 aa, Giardia lamblia
CLLVWEWIRRYEETASN

SEQ ID NO: 3183201 - protein, 24 aa, Giardia lamblia
CLMAIVRRAFLLSIASFCDQDAPT

SEQ ID NO: 3183202 - protein, 18 aa, Giardia lamblia
CLMAQFMARYLIPKEEAK

SEQ ID NO: 3183203 - protein, 29 aa, Giardia lamblia
CLNWKQLPLIISPFFLYSHIVRSNRLCTI

SEQ ID NO: 3183204 - protein, 35 aa, Giardia lamblia
CLPENYPIKYFLQHHLKWPQLTYVCSVAGKVVGYV

SEQ ID NO: 3183205 - protein, 25 aa, Giardia lamblia
CLPKDRECIMFIGAKNSVIMKPAYS

SEQ ID NO: 3183206 - protein, 29 aa, Giardia lamblia
CLPTYNYVELLKSQRTLEFVPSPPDSPKP

SEQ ID NO: 3183207 - protein, 25 aa, Giardia lamblia
CLRDKIIVVTARTFFFISAHNKIKA

SEQ ID NO: 3183208 - protein, 22 aa, Giardia lamblia
CLRIAGAYWRTGYAREHCTPNY

SEQ ID NO: 3183209 - protein, 24 aa, Giardia lamblia
CLRSIIITLIRCGNLQDIVLSTFL

SEQ ID NO: 3183210 - protein, 23 aa, Giardia lamblia
CLSAPLTPVLRPQSTPVLPVGTS

SEQ ID NO: 3183211 - protein, 21 aa, Giardia lamblia
CLSDKVCKVLWRIVSEKKTVL

SEQ ID NO: 3183212 - protein, 18 aa, Giardia lamblia
CLTHHRASVCRVVWVPPA

SEQ ID NO: 3183213 - protein, 18 aa, Giardia lamblia
CLTLNLKTSYFAKHVTAL

SEQ ID NO: 3183214 - protein, 17 aa, Giardia lamblia
CLVAWDMRYEPSPLARV

SEQ ID NO: 3183215 - protein, 19 aa, Giardia lamblia
CLVLALPPGVVPGPGVLPL

SEQ ID NO: 3183216 - protein, 17 aa, Giardia lamblia
CLVLLISTQSYSITYRY

SEQ ID NO: 3183217 - protein, 26 aa, Giardia lamblia
CLVNFRQAYAYPKRRAGDTLIEVHPL

SEQ ID NO: 3183218 - protein, 26 aa, Giardia lamblia
CLVSSLNFLKIFRVLVRDAANAAVKG

SEQ ID NO: 3183219 - protein, 27 aa, Giardia lamblia
CLYASPMLMEPFYLVDILAPEGCMGGI

SEQ ID NO: 3183220 - protein, 18 aa, Giardia lamblia
CLYDWVTAMVKYYAVAKD

SEQ ID NO: 3183221 - protein, 27 aa, Giardia lamblia
CMDACMSLCFMGTDLRPFILQAAKISC

SEQ ID NO: 3183222 - protein, 19 aa, Giardia lamblia
CMDIFEHIYLHSSHPRQLI

SEQ ID NO: 3183223 - protein, 24 aa, Giardia lamblia
CMEDMGIRPLVKEPQYSSNTLSGD

SEQ ID NO: 3183224 - protein, 32 aa, Giardia lamblia
CMENTEYLLDLYSFAFPWAWDTQTAIHSFTGL

SEQ ID NO: 3183225 - protein, 19 aa, Giardia lamblia
CMLLPQRKLTREIILPRDP

SEQ ID NO: 3183226 - protein, 18 aa, Giardia lamblia
CMLRAFSSDLLLPSDDKP

SEQ ID NO: 3183227 - protein, 18 aa, Giardia lamblia
CMQLVTYLTPYVATLQSA

SEQ ID NO: 3183228 - protein, 24 aa, Giardia lamblia
CMTREKIFIVFENKVFVYNLSDMR

SEQ ID NO: 3183229 - protein, 18 aa, Giardia lamblia
CMYNMKLVTLCLDNAFLT

SEQ ID NO: 3183230 - protein, 26 aa, Giardia lamblia
CNDLPAIELLLPYELLLKSDNTLMAL

SEQ ID NO: 3183231 - protein, 24 aa, Giardia lamblia
CNFRLEPPITYLGCGHAFHGNCLQ

SEQ ID NO: 3183232 - protein, 19 aa, Giardia lamblia
CNGKTGYMASLRNLVRPPA

SEQ ID NO: 3183233 - protein, 17 aa, Giardia lamblia
CNIGQEFLPVQDIKARP

SEQ ID NO: 3183234 - protein, 35 aa, Giardia lamblia
CNIKRFTHEILPAKQLLFYKNSPHYLKLAAYNSVA

SEQ ID NO: 3183235 - protein, 20 aa, Giardia lamblia
CNILGLTRKLYTKKDQVFLK

SEQ ID NO: 3183236 - protein, 20 aa, Giardia lamblia
CNISRIIRVIKNRSTLFSLR

SEQ ID NO: 3183237 - protein, 26 aa, Giardia lamblia
CNNGMRDWRFFFSTSKIHDLSDGYTV

SEQ ID NO: 3183238 - protein, 18 aa, Giardia lamblia
CNNKLECAMLLLEKERCM

SEQ ID NO: 3183239 - protein, 22 aa, Giardia lamblia
CNNPNAILQLLERESGMRTNKG

SEQ ID NO: 3183240 - protein, 26 aa, Giardia lamblia
CNREQLLLVCRGVLSLAFVESEYVNR

SEQ ID NO: 3183241 - protein, 18 aa, Giardia lamblia
CNRQSMVLVPIYDSLSAH

SEQ ID NO: 3183242 - protein, 27 aa, Giardia lamblia
CNRTFNAPITLKCGHTFCKGCLSSKRQ

SEQ ID NO: 3183243 - protein, 24 aa, Giardia lamblia
CNSNQLKLFFLAAEALLAAESMNP

SEQ ID NO: 3183244 - protein, 30 aa, Giardia lamblia
CNSSPLETYLRLFADIFLSDEEYVYFMLAI

SEQ ID NO: 3183245 - protein, 39 aa, Giardia lamblia
CNTLQSNFIWDTGKPTILVCLAGCYRVDFVIFGKQRPTV

SEQ ID NO: 3183246 - protein, 21 aa, Giardia lamblia
CNTNPNHKVLYKKRASRPLVY

SEQ ID NO: 3183247 - protein, 24 aa, Giardia lamblia
CNTPSAIELIAFSTPYFVGRGPKT

SEQ ID NO: 3183248 - protein, 18 aa, Giardia lamblia
CPDGSLAGLLRRQRRAGP

SEQ ID NO: 3183249 - protein, 17 aa, Giardia lamblia
CPDTIYVLESGVAQLGP

SEQ ID NO: 3183250 - protein, 17 aa, Giardia lamblia
CPGCLRHRPHGCRGERA

SEQ ID NO: 3183251 - protein, 24 aa, Giardia lamblia
CPHDFVPKLPTFPTPKLDLAIFDL

SEQ ID NO: 3183252 - protein, 20 aa, Giardia lamblia
CPHHSRQILYELAKRYKAQA

SEQ ID NO: 3183253 - protein, 36 aa, Giardia lamblia
CPHLTIDSPLLGGSIFFYVFPTTHNLELFLSFLSDV

SEQ ID NO: 3183254 - protein, 27 aa, Giardia lamblia
CPLTISRILSLWLKGVDLLPNATRLPL

SEQ ID NO: 3183255 - protein, 26 aa, Giardia lamblia
CPNCYHLKFFRLFKETDRELAINALN

SEQ ID NO: 3183256 - protein, 18 aa, Giardia lamblia
CPNYLAACKKREIGWGFK

SEQ ID NO: 3183257 - protein, 22 aa, Giardia lamblia
CPPRQWKMIANYVKGRTDIQVR

SEQ ID NO: 3183258 - protein, 34 aa, Giardia lamblia
CQEVPLSQAAWEAILLFIFDQQYSNFFKEKFSAI

SEQ ID NO: 3183259 - protein, 17 aa, Giardia lamblia
CQFQCKIPIHVLASETS

SEQ ID NO: 3183260 - protein, 28 aa, Giardia lamblia
CQHRSGLYAINFTNPYIKSTFQGNFNSV

SEQ ID NO: 3183261 - protein, 18 aa, Giardia lamblia
CQICGCYARPAPWNSLIT

SEQ ID NO: 3183262 - protein, 24 aa, Giardia lamblia
CQLSTKCDIWSLGILLLDMVSLAL

SEQ ID NO: 3183263 - protein, 20 aa, Giardia lamblia
CQQPWVVQGLFSGELALYDW

SEQ ID NO: 3183264 - protein, 25 aa, Giardia lamblia
CQSILKKILLTLKPDKYISEAILEG

SEQ ID NO: 3183265 - protein, 23 aa, Giardia lamblia
CQSTILSHFVLFSSSAGASPLPI

SEQ ID NO: 3183266 - protein, 25 aa, Giardia lamblia
CQTSPRRVLSLLRTLPLHQYDKLRD

SEQ ID NO: 3183267 - protein, 20 aa, Giardia lamblia
CQVLLHCDATVDDLIDVVEG

SEQ ID NO: 3183268 - protein, 31 aa, Giardia lamblia
CRAKSYSFSYCQALLLDLPIKESRTEVKKTK

SEQ ID NO: 3183269 - protein, 38 aa, Giardia lamblia
CRARSESLLLWLTANGFKLRTFPFLSPPSLCNLAAAYD

SEQ ID NO: 3183270 - protein, 26 aa, Giardia lamblia
CRATGIPYQSPLQLAIQRASAAESAT

SEQ ID NO: 3183271 - protein, 23 aa, Giardia lamblia
CRDDRLTFTLHIADRDTCPLETN

SEQ ID NO: 3183272 - protein, 20 aa, Giardia lamblia
CREYLAMIKVLDSRITQISI

SEQ ID NO: 3183273 - protein, 18 aa, Giardia lamblia
CRICLEPMRKPVRFSHCM

SEQ ID NO: 3183274 - protein, 18 aa, Giardia lamblia
CRIDPDFENFRNTVLRLL

SEQ ID NO: 3183275 - protein, 19 aa, Giardia lamblia
CRIYQKLFPLLIDEGELIN

SEQ ID NO: 3183276 - protein, 30 aa, Giardia lamblia
CRLHDLASLLLVLYEMLLYIAGADRYSVPI

SEQ ID NO: 3183277 - protein, 23 aa, Giardia lamblia
CRNPLLFRSSDLVQYMKEIGLRQ

SEQ ID NO: 3183278 - protein, 43 aa, Giardia lamblia
CRNRKSITKSLFLSRPHFLQSLKTIWAILYDIKMSQCIDLRAT

SEQ ID NO: 3183279 - protein, 34 aa, Giardia lamblia
CRPQDILVSGLRYELRRLFSAFGMVRDVSIVVNK

SEQ ID NO: 3183280 - protein, 28 aa, Giardia lamblia
CRPVALLRQALLLLLGPLGDHKQARKCR

SEQ ID NO: 3183281 - protein, 29 aa, Giardia lamblia
CRQLDKAVSWNWRMFAGQGSSVASTEQGH

SEQ ID NO: 3183282 - protein, 18 aa, Giardia lamblia
CRVSGLCGSLLLYSGQQI

SEQ ID NO: 3183283 - protein, 21 aa, Giardia lamblia
CRYIGNIVEPLLLIGNTVINV

SEQ ID NO: 3183284 - protein, 18 aa, Giardia lamblia
CSCCGWPVHYCKYRKPSK

SEQ ID NO: 3183285 - protein, 18 aa, Giardia lamblia
CSCICGLLVVYLTSKGTK

SEQ ID NO: 3183286 - protein, 17 aa, Giardia lamblia
CSDGDLEGVLYLSKRYQ

SEQ ID NO: 3183287 - protein, 34 aa, Giardia lamblia
CSDGLSEIYLWKIVKYLLDTFVRLHDPYAWPDFR

SEQ ID NO: 3183288 - protein, 17 aa, Giardia lamblia
CSDLLDLLPLNSELAYN

SEQ ID NO: 3183289 - protein, 27 aa, Giardia lamblia
CSDYLINILGVCYPLAASRISGSIYMV

SEQ ID NO: 3183290 - protein, 29 aa, Giardia lamblia
CSEEILNKSLLISIPYFKECLLMCSACDN

SEQ ID NO: 3183291 - protein, 22 aa, Giardia lamblia
CSFCGILRRNSLSYGSLQTQCT

SEQ ID NO: 3183292 - protein, 27 aa, Giardia lamblia
CSGHPTEPIFAFVYDKTVHISYCGRDA

SEQ ID NO: 3183293 - protein, 28 aa, Giardia lamblia
CSILGSEIYLYMRRAIHGPLRALIDQYV

SEQ ID NO: 3183294 - protein, 31 aa, Giardia lamblia
CSIPSGFLSPYFALGGSRYLELTNPLVVITD

SEQ ID NO: 3183295 - protein, 19 aa, Giardia lamblia
CSKTLLLTDYLSRGTMSVP

SEQ ID NO: 3183296 - protein, 29 aa, Giardia lamblia
CSLGSIIGLSLKIKLDRCLPRRFCSVVYC

SEQ ID NO: 3183297 - protein, 19 aa, Giardia lamblia
CSLHNFRTAFNQWASRQRM

SEQ ID NO: 3183298 - protein, 17 aa, Giardia lamblia
CSLNELPLQIYVSWFEQ

SEQ ID NO: 3183299 - protein, 19 aa, Giardia lamblia
CSLPWAVVMLFYSCVETST

SEQ ID NO: 3183300 - protein, 22 aa, Giardia lamblia
CSMLQNTLYFLSNGRLYSTELN

SEQ ID NO: 3183301 - protein, 27 aa, Giardia lamblia
CSNGDSALLRCLRLGELKLAELLTDDE

SEQ ID NO: 3183302 - protein, 17 aa, Giardia lamblia
CSPMNNICKRCMVQIGY

SEQ ID NO: 3183303 - protein, 27 aa, Giardia lamblia
CSQPNEFIQLLGNTAFPSSSATLEMYI

SEQ ID NO: 3183304 - protein, 25 aa, Giardia lamblia
CSQSLAILTHYFDLSTNPNGLTALD

SEQ ID NO: 3183305 - protein, 25 aa, Giardia lamblia
CSRDRFVSFWRPCSDSPDYDCIGLF

SEQ ID NO: 3183306 - protein, 21 aa, Giardia lamblia
CSRRRREDDAIWAKVMESKAI

SEQ ID NO: 3183307 - protein, 26 aa, Giardia lamblia
CSSGIIPGVFYYYWKHYDLPEEELVN

SEQ ID NO: 3183308 - protein, 36 aa, Giardia lamblia
CSSILRARAGLSRPTQPLGSFLFLGSSGVGKTYLAK

SEQ ID NO: 3183309 - protein, 22 aa, Giardia lamblia
CSSIYGFSFPFSPYTKNAKGQG

SEQ ID NO: 3183310 - protein, 23 aa, Giardia lamblia
CSSLICLVTPLYPHDCERFRTYN

SEQ ID NO: 3183311 - protein, 26 aa, Giardia lamblia
CSSVVFLLFCFMHRDLDPDKLLAQYS

SEQ ID NO: 3183312 - protein, 23 aa, Giardia lamblia
CSVLSFEGIYYIFGDLYMKSEIQ

SEQ ID NO: 3183313 - protein, 30 aa, Giardia lamblia
CSWSPYDAALYFLLDILQDCRLDVLYFLHQ

SEQ ID NO: 3183314 - protein, 26 aa, Giardia lamblia
CSYTLASTLLGLRYLHKQHVIHRDIK

SEQ ID NO: 3183315 - protein, 26 aa, Giardia lamblia
CTAAHTFIETVPFAANASILGTVPGA

SEQ ID NO: 3183316 - protein, 27 aa, Giardia lamblia
CTAIYTFWYDDLCDVFLELVKPIIASM

SEQ ID NO: 3183317 - protein, 18 aa, Giardia lamblia
CTFKPKIIKAPSSIRKIV

SEQ ID NO: 3183318 - protein, 24 aa, Giardia lamblia
CTGTLVFFPSYRIVEKIRDRFLIF

SEQ ID NO: 3183319 - protein, 22 aa, Giardia lamblia
CTIIDQWKPLWNFKGMDCVFES

SEQ ID NO: 3183320 - protein, 22 aa, Giardia lamblia
CTITKVMLLPTNEVLYTVRFCE

SEQ ID NO: 3183321 - protein, 26 aa, Giardia lamblia
CTKIKSLYMLDCEFASLVTLLKPFQR

SEQ ID NO: 3183322 - protein, 19 aa, Giardia lamblia
CTMILEPYALQLRVHRVAR

SEQ ID NO: 3183323 - protein, 17 aa, Giardia lamblia
CTQYLYERIFEGAAGSE

SEQ ID NO: 3183324 - protein, 22 aa, Giardia lamblia
CTRMLSMMKDYAAVFRAFNVFD

SEQ ID NO: 3183325 - protein, 22 aa, Giardia lamblia
CTRMYAKYPDRLVVSAFMGGLT

SEQ ID NO: 3183326 - protein, 24 aa, Giardia lamblia
CTSRDLLLSLHKQGLLRPIRSDDL

SEQ ID NO: 3183327 - protein, 17 aa, Giardia lamblia
CTSVFPFHAVTQNWLMT

SEQ ID NO: 3183328 - protein, 29 aa, Giardia lamblia
CTTWDRETELLSWIFERIAGEKGDACLGL

SEQ ID NO: 3183329 - protein, 19 aa, Giardia lamblia
CVCDPFYAGTFCEECAPDA

SEQ ID NO: 3183330 - protein, 27 aa, Giardia lamblia
CVDAGLPIKRYYWYLDSRKFGGCPHGG

SEQ ID NO: 3183331 - protein, 23 aa, Giardia lamblia
CVDIFERPPPIRGVYETTALIQA

SEQ ID NO: 3183332 - protein, 21 aa, Giardia lamblia
CVEGEIFPRALLLLRDKDSIT

SEQ ID NO: 3183333 - protein, 18 aa, Giardia lamblia
CVEILLPEECRMTDRVGN

SEQ ID NO: 3183334 - protein, 24 aa, Giardia lamblia
CVENHLKTITLPRSLPPPYSRREE

SEQ ID NO: 3183335 - protein, 23 aa, Giardia lamblia
CVESLLHECPFDTSARMAAAENA

SEQ ID NO: 3183336 - protein, 17 aa, Giardia lamblia
CVFNLTAYMKQYAHERY

SEQ ID NO: 3183337 - protein, 24 aa, Giardia lamblia
CVGLKDLAFILPGHTFFSVLTSTE

SEQ ID NO: 3183338 - protein, 20 aa, Giardia lamblia
CVHYLFALWERTCPICNERS

SEQ ID NO: 3183339 - protein, 20 aa, Giardia lamblia
CVIHLRQPVPVYSPPLLTEY

SEQ ID NO: 3183340 - protein, 18 aa, Giardia lamblia
CVIIRYTDMVPANYTRLM

SEQ ID NO: 3183341 - protein, 17 aa, Giardia lamblia
CVIRWACQCLANLAKHP

SEQ ID NO: 3183342 - protein, 19 aa, Giardia lamblia
CVKLLLPHEYSFCKAHIIN

SEQ ID NO: 3183343 - protein, 20 aa, Giardia lamblia
CVKTLLFETGLRNTVKETAL

SEQ ID NO: 3183344 - protein, 22 aa, Giardia lamblia
CVLCELYTGLPIFPGDDERDQL

SEQ ID NO: 3183345 - protein, 20 aa, Giardia lamblia
CVLCKRPIPALKQPIIDILS

SEQ ID NO: 3183346 - protein, 22 aa, Giardia lamblia
CVLRPFIIVITNSFTQESDLLK

SEQ ID NO: 3183347 - protein, 18 aa, Giardia lamblia
CVLYFSSTISRDALRDAF

SEQ ID NO: 3183348 - protein, 24 aa, Giardia lamblia
CVNDLWICTGSEWRQIFGHSDTGS

SEQ ID NO: 3183349 - protein, 17 aa, Giardia lamblia
CVNPNLAGPYPLRRTVL

SEQ ID NO: 3183350 - protein, 33 aa, Giardia lamblia
CVPIKVLSLSEVLPHYLLPHKDVLFFAQLACPR

SEQ ID NO: 3183351 - protein, 32 aa, Giardia lamblia
CVPRVLSQPIFPLKTLILLARKSEKSFLHALA

SEQ ID NO: 3183352 - protein, 19 aa, Giardia lamblia
CVPSFTSTGSILCWDPTGR

SEQ ID NO: 3183353 - protein, 27 aa, Giardia lamblia
CVQNKWVSWWTDRVLNWALQKTAATLQ

SEQ ID NO: 3183354 - protein, 24 aa, Giardia lamblia
CVRALLSREAGMQRYDGWTALMTA

SEQ ID NO: 3183355 - protein, 18 aa, Giardia lamblia
CVRALYTIARACAPSVVF

SEQ ID NO: 3183356 - protein, 26 aa, Giardia lamblia
CVSLLRRSFLATRVVNMPWLYGARIT

SEQ ID NO: 3183357 - protein, 18 aa, Giardia lamblia
CVTEYADGVRRVCAGFGH

SEQ ID NO: 3183358 - protein, 18 aa, Giardia lamblia
CVTIIEFLEKKLKEGEPQ

SEQ ID NO: 3183359 - protein, 17 aa, Giardia lamblia
CVTQPPLPQHLPDAKSY

SEQ ID NO: 3183360 - protein, 19 aa, Giardia lamblia
CVTVAPRILRAFAEASLVL

SEQ ID NO: 3183361 - protein, 22 aa, Giardia lamblia
CVVCELLTGRVLFPNYSVATIL

SEQ ID NO: 3183362 - protein, 23 aa, Giardia lamblia
CVVRLTTLLDLASGALVLNLQQL

SEQ ID NO: 3183363 - protein, 27 aa, Giardia lamblia
CVVVKGLRRIFYILPHGPIENCDTKTM

SEQ ID NO: 3183364 - protein, 27 aa, Giardia lamblia
CWKHVVLLAILIIKYSTSSSLVYLIQL

SEQ ID NO: 3183365 - protein, 17 aa, Giardia lamblia
CWPRCFQASTLRDASSQ

SEQ ID NO: 3183366 - protein, 19 aa, Giardia lamblia
CYDTMINIIRVLYTLPSIA

SEQ ID NO: 3183367 - protein, 22 aa, Giardia lamblia
CYEAAIIRLCHHYELIGPTVEV

SEQ ID NO: 3183368 - protein, 19 aa, Giardia lamblia
CYEGFVLMFGDLLSTVWSA

SEQ ID NO: 3183369 - protein, 31 aa, Giardia lamblia
CYEVLGFDIMIDSLFKPWLIEVNHSPSFTCD

SEQ ID NO: 3183370 - protein, 39 aa, Giardia lamblia
CYFMTAALDLFKIIIPVKPYFYIQAPVENYLFIQERLLL

SEQ ID NO: 3183371 - protein, 24 aa, Giardia lamblia
CYFVGRVSLLKWISELLNEPVKKV

SEQ ID NO: 3183372 - protein, 27 aa, Giardia lamblia
CYGGILNIYGVLMSPICNFITSVVYGN

SEQ ID NO: 3183373 - protein, 24 aa, Giardia lamblia
CYHTNPLIIPAKQSSNAYLSTIHF

SEQ ID NO: 3183374 - protein, 17 aa, Giardia lamblia
CYKTFRRFFGGQSMLRV

SEQ ID NO: 3183375 - protein, 19 aa, Giardia lamblia
CYLLLTREYICLASRDSMQ

SEQ ID NO: 3183376 - protein, 27 aa, Giardia lamblia
CYPTLKPLSSWIVDLIDRVQFMADWIE

SEQ ID NO: 3183377 - protein, 26 aa, Giardia lamblia
CYRGYTALMWAVYTNSAHFTKLLVEE

SEQ ID NO: 3183378 - protein, 19 aa, Giardia lamblia
CYTKGFYTGIMKMGPFAGQ

SEQ ID NO: 3183379 - protein, 18 aa, Giardia lamblia
CYVYGLYMEGARWCMETS

SEQ ID NO: 3183380 - protein, 17 aa, Giardia lamblia
CYYRAFQCPGSGTIYLI

SEQ ID NO: 3183381 - protein, 24 aa, Giardia lamblia
DAAAILERSALTGSKLLLVPAVTS

SEQ ID NO: 3183382 - protein, 24 aa, Giardia lamblia
DAADLIKRLLTKDPTKRFNGGWRA

SEQ ID NO: 3183383 - protein, 19 aa, Giardia lamblia
DAALPLQEYIEGLRNAYSE

SEQ ID NO: 3183384 - protein, 21 aa, Giardia lamblia
DAASILFHKYLVDGATMATKS

SEQ ID NO: 3183385 - protein, 19 aa, Giardia lamblia
DACAYFSLDRPVLAASYSP

SEQ ID NO: 3183386 - protein, 25 aa, Giardia lamblia
DACLAPLLDIPVLSSKLFTDLDVLS

SEQ ID NO: 3183387 - protein, 24 aa, Giardia lamblia
DADISYLRYIGMLHQLIDSSNYTA

SEQ ID NO: 3183388 - protein, 27 aa, Giardia lamblia
DADLAYKADYGLLPGKLPLAEGIDDNN

SEQ ID NO: 3183389 - protein, 25 aa, Giardia lamblia
DADPSLINVTLLDSFKGSCANLESW

SEQ ID NO: 3183390 - protein, 24 aa, Giardia lamblia
DADRLMKCKLLDDVLKIIIPRNFP

SEQ ID NO: 3183391 - protein, 35 aa, Giardia lamblia
DAEAVRVIADCYTELFYTCQYQSYAIAKLEEHIQR

SEQ ID NO: 3183392 - protein, 25 aa, Giardia lamblia
DAEDLCKILLSYESAYTLADGTTAL

SEQ ID NO: 3183393 - protein, 24 aa, Giardia lamblia
DAEFQMALTRLINYGLIVITEDNK

SEQ ID NO: 3183394 - protein, 24 aa, Giardia lamblia
DAEFRYSHEYLGCTARLVITPLTD

SEQ ID NO: 3183395 - protein, 21 aa, Giardia lamblia
DAEGRAPILFAKTKETRDLLL

SEQ ID NO: 3183396 - protein, 24 aa, Giardia lamblia
DAEIHRLLAENLEASRFISATSKG

SEQ ID NO: 3183397 - protein, 22 aa, Giardia lamblia
DAEIQELRLLIDTLQNRKPISD

SEQ ID NO: 3183398 - protein, 21 aa, Giardia lamblia
DAEISLLRKQTTDGATYKDLL

SEQ ID NO: 3183399 - protein, 21 aa, Giardia lamblia
DAEKNLILKRVYYSVGGGALQ

SEQ ID NO: 3183400 - protein, 25 aa, Giardia lamblia
DAEKTSMLLILGTSLTVAPFNFLAE

SEQ ID NO: 3183401 - protein, 21 aa, Giardia lamblia
DAELLSKLRAMLKFGVREYAE

SEQ ID NO: 3183402 - protein, 25 aa, Giardia lamblia
DAEMTLRSLLRALEDIRFGYPTALM

SEQ ID NO: 3183403 - protein, 25 aa, Giardia lamblia
DAENTPYNIVFPIACRIDAPAITPE

SEQ ID NO: 3183404 - protein, 25 aa, Giardia lamblia
DAEVRLISDLSELFFGLLNRQLAEV

SEQ ID NO: 3183405 - protein, 29 aa, Giardia lamblia
DAFIEPERILRLVQLTEFLIDLPNPFKTG

SEQ ID NO: 3183406 - protein, 29 aa, Giardia lamblia
DAFNRDTIFPLFRAINARYKFVMPGNTDF

SEQ ID NO: 3183407 - protein, 31 aa, Giardia lamblia
DAFREFEGLLSIKGLFLLLKCQRVQPQISLS

SEQ ID NO: 3183408 - protein, 18 aa, Giardia lamblia
DAFTPMGQNWGYPAYNWR

SEQ ID NO: 3183409 - protein, 18 aa, Giardia lamblia
DAFYKFVLALDPADLPRL

SEQ ID NO: 3183410 - protein, 17 aa, Giardia lamblia
DAFYKFVLALEPADLPR

SEQ ID NO: 3183411 - protein, 24 aa, Giardia lamblia
DAGDYITGFAWSEFQSKLYASSAD

SEQ ID NO: 3183412 - protein, 30 aa, Giardia lamblia
DAGLIHLCPYIYVFGTFAKKRWYERSLLKV

SEQ ID NO: 3183413 - protein, 23 aa, Giardia lamblia
DAGQVLCMSLRSFEICGSRFLSL

SEQ ID NO: 3183414 - protein, 26 aa, Giardia lamblia
DAGRGWRVVVPSPRPLEIVEYGVIKT

SEQ ID NO: 3183415 - protein, 23 aa, Giardia lamblia
DAHAELLTLFRNLQRSGSSQQAG

SEQ ID NO: 3183416 - protein, 33 aa, Giardia lamblia
DAHCHFSPAFIGTWFRPDHVYLLNATDPTQFED

SEQ ID NO: 3183417 - protein, 25 aa, Giardia lamblia
DAHDPDLFNYLYNQSAKVISDKVTV

SEQ ID NO: 3183418 - protein, 24 aa, Giardia lamblia
DAHIQCLPPQFQGHLRTSGHYMCY

SEQ ID NO: 3183419 - protein, 21 aa, Giardia lamblia
DAICFVLGISSLSRIRVTSLT

SEQ ID NO: 3183420 - protein, 26 aa, Giardia lamblia
DAIFSRFYFFEDECMPDPLFGGESKP

SEQ ID NO: 3183421 - protein, 17 aa, Giardia lamblia
DAIINLEACLRILKHRD

SEQ ID NO: 3183422 - protein, 27 aa, Giardia lamblia
DAIKRTIPIWCLVWSTVLSGSNPSELD

SEQ ID NO: 3183423 - protein, 24 aa, Giardia lamblia
DAIKTRLTVILTLSHPGVLKHHQV

SEQ ID NO: 3183424 - protein, 18 aa, Giardia lamblia
DAILLGGERNKFEALLPD

SEQ ID NO: 3183425 - protein, 24 aa, Giardia lamblia
DAIMSKITEFLYLSSLTAAQNTEL

SEQ ID NO: 3183426 - protein, 24 aa, Giardia lamblia
DAIMWLENWLVNFPQDKLVIVVSH

SEQ ID NO: 3183427 - protein, 17 aa, Giardia lamblia
DAIRKMMSSPFTNSLLI

SEQ ID NO: 3183428 - protein, 17 aa, Giardia lamblia
DAIVSRDYHTVQEGISL

SEQ ID NO: 3183429 - protein, 27 aa, Giardia lamblia
DAIYDSTILRLYIISPLLGDARELVSR

SEQ ID NO: 3183430 - protein, 31 aa, Giardia lamblia
DAKCICIFSIHGGGLIRLMRQRPTVPVVVMT

SEQ ID NO: 3183431 - protein, 29 aa, Giardia lamblia
DAKITGNIPLLIRRIRLSFLQLAECEDSE

SEQ ID NO: 3183432 - protein, 24 aa, Giardia lamblia
DAKRRQFPRFYFVSSTDLLDILSK

SEQ ID NO: 3183433 - protein, 25 aa, Giardia lamblia
DAKVFYYKMQGDYYRYLAEYSSGED

SEQ ID NO: 3183434 - protein, 26 aa, Giardia lamblia
DALCRGDARLILLRKYIKNLKTISSN

SEQ ID NO: 3183435 - protein, 18 aa, Giardia lamblia
DALDFLIEYVRYGEEGHA

SEQ ID NO: 3183436 - protein, 24 aa, Giardia lamblia
DALDLLKKLLQFNPNKRLTAEQAL

SEQ ID NO: 3183437 - protein, 21 aa, Giardia lamblia
DALEKIINPKRPVFVEPQPHK

SEQ ID NO: 3183438 - protein, 25 aa, Giardia lamblia
DALFHCKPLVFEIPMRTYPVAIHYE

SEQ ID NO: 3183439 - protein, 24 aa, Giardia lamblia
DALGKLPEFYALNSPNKNIQALFL

SEQ ID NO: 3183440 - protein, 38 aa, Giardia lamblia
DALGRTAMMYLVMFPRHSTLVLLEECIGYLAQAQQGAI

SEQ ID NO: 3183441 - protein, 31 aa, Giardia lamblia
DALKVNLDTLYYFISLLSIGLAINEALLDQD

SEQ ID NO: 3183442 - protein, 20 aa, Giardia lamblia
DALLEAPKQFLPEQTLQNYA

SEQ ID NO: 3183443 - protein, 17 aa, Giardia lamblia
DALLHILKSRFSFTNMT

SEQ ID NO: 3183444 - protein, 18 aa, Giardia lamblia
DALLRPGRIDRKVEFPLP

SEQ ID NO: 3183445 - protein, 18 aa, Giardia lamblia
DALLRSLAGLLPEGTEPA

SEQ ID NO: 3183446 - protein, 21 aa, Giardia lamblia
DALLSTLGIRNASELDLLFTH

SEQ ID NO: 3183447 - protein, 18 aa, Giardia lamblia
DALLTRKAEKPVTDSAIF

SEQ ID NO: 3183448 - protein, 29 aa, Giardia lamblia
DALREDILSFWPVTTLAPPYLPLQGVHTS

SEQ ID NO: 3183449 - protein, 29 aa, Giardia lamblia
DALVRWYRMMGYRTLYLPGLDHAGIATQS

SEQ ID NO: 3183450 - protein, 34 aa, Giardia lamblia
DAMYKSLRTMVRRVYIWALQLKHNELEIANGFLG

SEQ ID NO: 3183451 - protein, 25 aa, Giardia lamblia
DANDKMLAGLARMARIFKYSGKLDP

SEQ ID NO: 3183452 - protein, 27 aa, Giardia lamblia
DANEELLLMRALRDMNLPKFVFEDVPL

SEQ ID NO: 3183453 - protein, 24 aa, Giardia lamblia
DAPFRTKLIKIYNKKYRAPKPIKP

SEQ ID NO: 3183454 - protein, 23 aa, Giardia lamblia
DAPPVVVKLLSIATVPIGCREEL

SEQ ID NO: 3183455 - protein, 25 aa, Giardia lamblia
DAPSFIKWFVKLLEVIEPTVTVESV

SEQ ID NO: 3183456 - protein, 23 aa, Giardia lamblia
DAPSIHLYSRLYGGLRDISGQTG

SEQ ID NO: 3183457 - protein, 23 aa, Giardia lamblia
DAQEQLLSLKDRYDCAVAEMEDM

SEQ ID NO: 3183458 - protein, 17 aa, Giardia lamblia
DAQIKLYTELKANYESA

SEQ ID NO: 3183459 - protein, 17 aa, Giardia lamblia
DAQKYILAATESASYRL

SEQ ID NO: 3183460 - protein, 17 aa, Giardia lamblia
DAQLARLNPLIQNKLEL

SEQ ID NO: 3183461 - protein, 18 aa, Giardia lamblia
DAQLAYDQLYIDYEQLMD

SEQ ID NO: 3183462 - protein, 27 aa, Giardia lamblia
DAQQAETLFPAAIATLATMANAALAQA

SEQ ID NO: 3183463 - protein, 23 aa, Giardia lamblia
DAQSYFMNTFFQIKHLLTTTTVH

SEQ ID NO: 3183464 - protein, 24 aa, Giardia lamblia
DAQTSLCELLINAILDATAKAAAE

SEQ ID NO: 3183465 - protein, 27 aa, Giardia lamblia
DAQVEWHMLPVCPLLLTLTLSCNDLEE

SEQ ID NO: 3183466 - protein, 20 aa, Giardia lamblia
DARFYALLLHRNTSEVLACL

SEQ ID NO: 3183467 - protein, 17 aa, Giardia lamblia
DARGLLCRAAIDSLTKV

SEQ ID NO: 3183468 - protein, 25 aa, Giardia lamblia
DARSPLDEWMLIASKNRASSKRWST

SEQ ID NO: 3183469 - protein, 28 aa, Giardia lamblia
DARTDKALFISPIPTRSSPLRSSRSVNS

SEQ ID NO: 3183470 - protein, 23 aa, Giardia lamblia
DASFLRTSRFLRFCSYIGGTFTE

SEQ ID NO: 3183471 - protein, 22 aa, Giardia lamblia
DASGWTALMYAAARGYEAIVEL

SEQ ID NO: 3183472 - protein, 23 aa, Giardia lamblia
DASLYDILAYRELCLFLQSSTSS

SEQ ID NO: 3183473 - protein, 37 aa, Giardia lamblia
DASMKAALPALIRPYSDVIVLLMEGLSSFLHTGRSTA

SEQ ID NO: 3183474 - protein, 27 aa, Giardia lamblia
DASPPFTPFNIWACHHLYSVLESHEKD

SEQ ID NO: 3183475 - protein, 26 aa, Giardia lamblia
DASQRLRILLLIQDSLFDICQNLHGT

SEQ ID NO: 3183476 - protein, 26 aa, Giardia lamblia
DASRHKFMLYGKDNRIKFLMGCIAQS

SEQ ID NO: 3183477 - protein, 28 aa, Giardia lamblia
DASSIYRRPLRVAPLYVIKNIVTEIISM

SEQ ID NO: 3183478 - protein, 21 aa, Giardia lamblia
DASVMLYQFITTITSGDGTAL

SEQ ID NO: 3183479 - protein, 25 aa, Giardia lamblia
DASVYKYLCYLEFLLKLQRRCHGSQ

SEQ ID NO: 3183480 - protein, 17 aa, Giardia lamblia
DASWFLEHPGQLPAYSA

SEQ ID NO: 3183481 - protein, 26 aa, Giardia lamblia
DATDEPLALKPILLPDLKAIVSKTPV

SEQ ID NO: 3183482 - protein, 25 aa, Giardia lamblia
DATDTLRLMNLLNTTNIWDTDTFRD

SEQ ID NO: 3183483 - protein, 24 aa, Giardia lamblia
DATIRSRPSISSPLLPVAQDLGTK

SEQ ID NO: 3183484 - protein, 25 aa, Giardia lamblia
DATLIKLCLLPKMRFVAAACRDPIL

SEQ ID NO: 3183485 - protein, 17 aa, Giardia lamblia
DATPPIEQHMLSNYTRI

SEQ ID NO: 3183486 - protein, 20 aa, Giardia lamblia
DAVAIAALCSLLMGLDDEHV

SEQ ID NO: 3183487 - protein, 33 aa, Giardia lamblia
DAVATYYLYRKYVHPFIFALGTILPLNPDDILR

SEQ ID NO: 3183488 - protein, 21 aa, Giardia lamblia
DAVIRMNDQIIRQLKAENTTL

SEQ ID NO: 3183489 - protein, 20 aa, Giardia lamblia
DAVLLTMIAYPNCSICHFLG

SEQ ID NO: 3183490 - protein, 18 aa, Giardia lamblia
DAVLPPQYPRSAPQQAEG

SEQ ID NO: 3183491 - protein, 23 aa, Giardia lamblia
DAVLTPLLHLYSLSDYSIEKHNE

SEQ ID NO: 3183492 - protein, 24 aa, Giardia lamblia
DAVRAILPLHRYTADSLGATALVY

SEQ ID NO: 3183493 - protein, 17 aa, Giardia lamblia
DAVRLFTEPAAPVSYDM

SEQ ID NO: 3183494 - protein, 25 aa, Giardia lamblia
DAVRLLKQPFVLSAALVKCIWSVHG

SEQ ID NO: 3183495 - protein, 23 aa, Giardia lamblia
DAVSVYCLLPSQGGLVDVDGKTA

SEQ ID NO: 3183496 - protein, 36 aa, Giardia lamblia
DAVYIKNFQWLYDFSRYIMTVLFSDKFQELRGNKPA

SEQ ID NO: 3183497 - protein, 18 aa, Giardia lamblia
DAYKMLRLLRDECTEYTY

SEQ ID NO: 3183498 - protein, 23 aa, Giardia lamblia
DAYLAEMVLAFDSLYMLGDISNK

SEQ ID NO: 3183499 - protein, 19 aa, Giardia lamblia
DCCLSTILKNHYKFSKPTC

SEQ ID NO: 3183500 - protein, 18 aa, Giardia lamblia
DCDELGMSLKQYERIEDP

SEQ ID NO: 3183501 - protein, 18 aa, Giardia lamblia
DCDTPFAMLAHLAHKRFL

SEQ ID NO: 3183502 - protein, 24 aa, Giardia lamblia
DCDTVFVTMLLAYLGNENDVYWKT

SEQ ID NO: 3183503 - protein, 25 aa, Giardia lamblia
DCFHHKDPLIIGVRIDKGSLHPQQP

SEQ ID NO: 3183504 - protein, 25 aa, Giardia lamblia
DCFTIRKYIGFTYSSSYQKTSLEYL

SEQ ID NO: 3183505 - protein, 18 aa, Giardia lamblia
DCFYEYICPVVSLSFHLT

SEQ ID NO: 3183506 - protein, 24 aa, Giardia lamblia
DCGRIRLHRPFGDDIMQDVSATLE

SEQ ID NO: 3183507 - protein, 22 aa, Giardia lamblia
DCHHIPLPKHLLTPILASATLL

SEQ ID NO: 3183508 - protein, 22 aa, Giardia lamblia
DCIYISFSTGDILRLNYPQLNI

SEQ ID NO: 3183509 - protein, 22 aa, Giardia lamblia
DCKGTMRLVKPVGSVLQDRWVS

SEQ ID NO: 3183510 - protein, 50 aa, Giardia lamblia
DCKYPGFSFTDIFMPAFKRYKAQLHNISEFLWFREAVIEILHSALTEYKT

SEQ ID NO: 3183511 - protein, 32 aa, Giardia lamblia
DCMAVNPYSFLLTPFSSFVQISIPFDKSFTPD

SEQ ID NO: 3183512 - protein, 28 aa, Giardia lamblia
DCMFNDVYTLLFIPLLEPQRELSMLSSV

SEQ ID NO: 3183513 - protein, 18 aa, Giardia lamblia
DCMIRIYNLRRHKHVAVL

SEQ ID NO: 3183514 - protein, 35 aa, Giardia lamblia
DCNSKYDHLNPKSTLPIFLPFLDEAESSIYSLVLP

SEQ ID NO: 3183515 - protein, 24 aa, Giardia lamblia
DCQLQIEVLIPYFDAMITAELEPM

SEQ ID NO: 3183516 - protein, 21 aa, Giardia lamblia
DCRAILRQNLHSRSIICCLML

SEQ ID NO: 3183517 - protein, 18 aa, Giardia lamblia
DCRPLLVLIDGPPCLVTI

SEQ ID NO: 3183518 - protein, 18 aa, Giardia lamblia
DCSMAELRSLLFPVIVQS

SEQ ID NO: 3183519 - protein, 18 aa, Giardia lamblia
DCVFFYLLGQTTCSEILS

SEQ ID NO: 3183520 - protein, 18 aa, Giardia lamblia
DCVNIILSSQRISNIELK

SEQ ID NO: 3183521 - protein, 22 aa, Giardia lamblia
DCVVLCAGKRWFAATGAADKCL

SEQ ID NO: 3183522 - protein, 20 aa, Giardia lamblia
DCYHHGWPCFGCGAPITFLG

SEQ ID NO: 3183523 - protein, 53 aa, Giardia lamblia
DCYSQALRDLVYWCLRMNATGRPDVFTLLALPIVKDKLKFFNLKTPKDIELSI

SEQ ID NO: 3183524 - protein, 23 aa, Giardia lamblia
DDAESWLPLALTPSVFVANSSFL

SEQ ID NO: 3183525 - protein, 17 aa, Giardia lamblia
DDAFKTLLAHMVRKVDS

SEQ ID NO: 3183526 - protein, 27 aa, Giardia lamblia
DDAIWGIIAQVFNGLYFYHQTDINGFC

SEQ ID NO: 3183527 - protein, 23 aa, Giardia lamblia
DDAKVMRAIYVNGGLFSIVSIRT

SEQ ID NO: 3183528 - protein, 25 aa, Giardia lamblia
DDALLSYFTEFAYTCKLNSIPYHKF

SEQ ID NO: 3183529 - protein, 24 aa, Giardia lamblia
DDAVEKNILLAKLRDTGSAKDREI

SEQ ID NO: 3183530 - protein, 22 aa, Giardia lamblia
DDDFMRIYDLVDILNLVGCTKN

SEQ ID NO: 3183531 - protein, 26 aa, Giardia lamblia
DDDKLKNLLPYIKLNVAFVFTNGDTS

SEQ ID NO: 3183532 - protein, 22 aa, Giardia lamblia
DDDTFIYIFGSVVKDVMCCYDP

SEQ ID NO: 3183533 - protein, 24 aa, Giardia lamblia
DDDVTDTWFSSGLFPFSCFADSER

SEQ ID NO: 3183534 - protein, 23 aa, Giardia lamblia
DDEDKVIFCILKGYISNVAKLSN

SEQ ID NO: 3183535 - protein, 24 aa, Giardia lamblia
DDEDRTYFIPISRSTSTGNTHRIA

SEQ ID NO: 3183536 - protein, 27 aa, Giardia lamblia
DDEESCAMLLRWEKSLELPGGKNPLMV

SEQ ID NO: 3183537 - protein, 25 aa, Giardia lamblia
DDELTFFRLILCYNGTKYTKFAKNF

SEQ ID NO: 3183538 - protein, 24 aa, Giardia lamblia
DDETSPIFSPYYRWHGKADCGEAI

SEQ ID NO: 3183539 - protein, 20 aa, Giardia lamblia
DDEWKTCFLKAVLSLGIGNA

SEQ ID NO: 3183540 - protein, 26 aa, Giardia lamblia
DDFRKQPLFQQIQYLYEMVGGSLAGR

SEQ ID NO: 3183541 - protein, 23 aa, Giardia lamblia
DDGDAGVVFFVPGGRRPARSSQS

SEQ ID NO: 3183542 - protein, 26 aa, Giardia lamblia
DDGNFAIRLFSALYVPQQKGALQYGV

SEQ ID NO: 3183543 - protein, 25 aa, Giardia lamblia
DDGNKLLIVMDFIAGGSLASLSKSF

SEQ ID NO: 3183544 - protein, 21 aa, Giardia lamblia
DDHAAAFLATKLDACTHTLAK

SEQ ID NO: 3183545 - protein, 25 aa, Giardia lamblia
DDICYPIHVIGKRTLYPAGSNPRLQ

SEQ ID NO: 3183546 - protein, 20 aa, Giardia lamblia
DDILIIPMNMRDGILVCKGL

SEQ ID NO: 3183547 - protein, 27 aa, Giardia lamblia
DDIQMATELLFFINRECIPYNSPNSSL

SEQ ID NO: 3183548 - protein, 37 aa, Giardia lamblia
DDKDLIMELKRALLIKIREIYKIKLGLGIVNTVQDEI

SEQ ID NO: 3183549 - protein, 26 aa, Giardia lamblia
DDKRINIIGVFLFPLDTVPAEITECG

SEQ ID NO: 3183550 - protein, 25 aa, Giardia lamblia
DDKRTGFIFTVHDKLDFQRFYRLRL

SEQ ID NO: 3183551 - protein, 26 aa, Giardia lamblia
DDKSEAMFFYYQMIASLIPSDESHSF

SEQ ID NO: 3183552 - protein, 30 aa, Giardia lamblia
DDLEALAYVFLYFLRGFLPWQGLKANTKRQ

SEQ ID NO: 3183553 - protein, 23 aa, Giardia lamblia
DDLGELRALRPLGADTELITSRI

SEQ ID NO: 3183554 - protein, 18 aa, Giardia lamblia
DDLKKILMTAGVDNKQIV

SEQ ID NO: 3183555 - protein, 19 aa, Giardia lamblia
DDLKRELYVPSDIARKLLF

SEQ ID NO: 3183556 - protein, 26 aa, Giardia lamblia
DDLLKALDLVLLMTVEPGFGGQKYIP

SEQ ID NO: 3183557 - protein, 18 aa, Giardia lamblia
DDLLLYTPKARQARAAEQ

SEQ ID NO: 3183558 - protein, 23 aa, Giardia lamblia
DDLLPRAILEPDNIMFAGDGRRV

SEQ ID NO: 3183559 - protein, 20 aa, Giardia lamblia
DDLMSFQWRLLAIDEAHSLK

SEQ ID NO: 3183560 - protein, 21 aa, Giardia lamblia
DDLPICWDAHLHALKGCYTNI

SEQ ID NO: 3183561 - protein, 22 aa, Giardia lamblia
DDLPPHHSPLNPAFSSELQDSL

SEQ ID NO: 3183562 - protein, 19 aa, Giardia lamblia
DDLSGILVEILVTATAAPS

SEQ ID NO: 3183563 - protein, 22 aa, Giardia lamblia
DDLTCVILTYTSWVDNASHIYP

SEQ ID NO: 3183564 - protein, 24 aa, Giardia lamblia
DDMINSLIYMYLRQFENVYTLEDA

SEQ ID NO: 3183565 - protein, 24 aa, Giardia lamblia
DDNDIVSIWEFVRRLDPDRTDIRY

SEQ ID NO: 3183566 - protein, 22 aa, Giardia lamblia
DDNHLLVPMAPSNPLKLTLPDT

SEQ ID NO: 3183567 - protein, 23 aa, Giardia lamblia
DDNILLRHRQLPDTLSSDTSEQL

SEQ ID NO: 3183568 - protein, 20 aa, Giardia lamblia
DDPCEVLYQSTRSKHLRDPV

SEQ ID NO: 3183569 - protein, 19 aa, Giardia lamblia
DDPFTCQYTYLPSLEVSHD

SEQ ID NO: 3183570 - protein, 26 aa, Giardia lamblia
DDPKQKRVLSPVWFKAVETGAHVAIF

SEQ ID NO: 3183571 - protein, 22 aa, Giardia lamblia
DDPLDIYKLEFSADGAVLAAGY

SEQ ID NO: 3183572 - protein, 27 aa, Giardia lamblia
DDPNTVAFYFIKYLRRMHLSKKLIHKP

SEQ ID NO: 3183573 - protein, 26 aa, Giardia lamblia
DDPSAEFLVFLGLPCLDQALHPCMLS

SEQ ID NO: 3183574 - protein, 23 aa, Giardia lamblia
DDPVFVFYGGEPLLNRPYVCRVM

SEQ ID NO: 3183575 - protein, 18 aa, Giardia lamblia
DDQIAFKSELTPSSVQEI

SEQ ID NO: 3183576 - protein, 26 aa, Giardia lamblia
DDQQCFEIDLPFIRKARSNFSHGVVD

SEQ ID NO: 3183577 - protein, 20 aa, Giardia lamblia
DDQYSLPFQPVKKAAPVAQP

SEQ ID NO: 3183578 - protein, 29 aa, Giardia lamblia
DDRARAIVKLLDVMALAPNPTTAVYSSLR

SEQ ID NO: 3183579 - protein, 25 aa, Giardia lamblia
DDRVRKLIFRLIEKGALLSVDSVIN

SEQ ID NO: 3183580 - protein, 27 aa, Giardia lamblia
DDSIKTHIPWRDSKLTRLLKNVLGGNS

SEQ ID NO: 3183581 - protein, 23 aa, Giardia lamblia
DDTFVVFVPCNHLIDLAYFVMKS

SEQ ID NO: 3183582 - protein, 22 aa, Giardia lamblia
DDTMFPDMRGFREMVQKNKDKL

SEQ ID NO: 3183583 - protein, 19 aa, Giardia lamblia
DDTYSTLMYASRAKAIKVN

SEQ ID NO: 3183584 - protein, 26 aa, Giardia lamblia
DDVGFVRVMYPMLPNLNGGQAHRINS

SEQ ID NO: 3183585 - protein, 17 aa, Giardia lamblia
DDVPMFSPEKLRRCLGD

SEQ ID NO: 3183586 - protein, 25 aa, Giardia lamblia
DDWHQHIFRFIAIGPPYDNSSAYMA

SEQ ID NO: 3183587 - protein, 25 aa, Giardia lamblia
DDWKYDAIPYFYKGKNILDFITVDE

SEQ ID NO: 3183588 - protein, 21 aa, Giardia lamblia
DDYHCANWAGCPFRLSIRHYK

SEQ ID NO: 3183589 - protein, 19 aa, Giardia lamblia
DDYLLIDFAGQVELFTYYD

SEQ ID NO: 3183590 - protein, 26 aa, Giardia lamblia
DDYSRLLIYINVSEWHFGPYRQYGVS

SEQ ID NO: 3183591 - protein, 24 aa, Giardia lamblia
DDYVFHALALVRRLGTGFTTAFDK

SEQ ID NO: 3183592 - protein, 22 aa, Giardia lamblia
DDYVIPTIPYHPNAPNPPNPRG

SEQ ID NO: 3183593 - protein, 18 aa, Giardia lamblia
DDYVQIYHTPLAPVTGLL

SEQ ID NO: 3183594 - protein, 26 aa, Giardia lamblia
DEAALVADLEDLFQGLRAIRNPGHSN

SEQ ID NO: 3183595 - protein, 24 aa, Giardia lamblia
DEAITAIPIYSINKTRAHIIRVTS

SEQ ID NO: 3183596 - protein, 24 aa, Giardia lamblia
DEAKRFEEFLLMQSDEHKQRIQAE

SEQ ID NO: 3183597 - protein, 17 aa, Giardia lamblia
DEARMRRDRKHVAPLTE

SEQ ID NO: 3183598 - protein, 25 aa, Giardia lamblia
DEATARLREMLIAANQRIAQLEGQI

SEQ ID NO: 3183599 - protein, 17 aa, Giardia lamblia
DEAYRAVFASLLAERAA

SEQ ID NO: 3183600 - protein, 18 aa, Giardia lamblia
DEDALFATPLPFTEITNV

SEQ ID NO: 3183601 - protein, 20 aa, Giardia lamblia
DEDIVFLASAFPYTYTDLNR

SEQ ID NO: 3183602 - protein, 18 aa, Giardia lamblia
DEEIAFLLAPRESGIQNI

SEQ ID NO: 3183603 - protein, 22 aa, Giardia lamblia
DEEIHRLNLTISSLEERHRTTI

SEQ ID NO: 3183604 - protein, 20 aa, Giardia lamblia
DEELLRCMVVPDIPSVPEKT

SEQ ID NO: 3183605 - protein, 26 aa, Giardia lamblia
DEEQSAQSALGRFLAEHSLESGSEPE

SEQ ID NO: 3183606 - protein, 27 aa, Giardia lamblia
DEETGLLYPMFLLHTLTPKTEDAAALK

SEQ ID NO: 3183607 - protein, 27 aa, Giardia lamblia
DEFDCAPFPSLETLILHHNRIRDIRNL

SEQ ID NO: 3183608 - protein, 18 aa, Giardia lamblia
DEFLQFLCDKKVPEHIVH

SEQ ID NO: 3183609 - protein, 20 aa, Giardia lamblia
DEFNGLTRILFSKKNKTLGA

SEQ ID NO: 3183610 - protein, 21 aa, Giardia lamblia
DEFWTSLTKTKLPYVRIDWDR

SEQ ID NO: 3183611 - protein, 21 aa, Giardia lamblia
DEGFPLPNVPHELVANAKHKL

SEQ ID NO: 3183612 - protein, 24 aa, Giardia lamblia
DEGFTALMYALRAHAPELAEQLVE

SEQ ID NO: 3183613 - protein, 24 aa, Giardia lamblia
DEGRTALFYASWHGHTEVARLLVD

SEQ ID NO: 3183614 - protein, 33 aa, Giardia lamblia
DEIFSVRTYGFRGNALMWISLKGELQIFSRGSD

SEQ ID NO: 3183615 - protein, 18 aa, Giardia lamblia
DEIKTLRRAIEAAIAAKA

SEQ ID NO: 3183616 - protein, 17 aa, Giardia lamblia
DEIPLLQKILEALTVFS

SEQ ID NO: 3183617 - protein, 19 aa, Giardia lamblia
DEITRFHQQRFRLSGSASM

SEQ ID NO: 3183618 - protein, 28 aa, Giardia lamblia
DEIVYLRRAVRFLAGKLKLGVIVDGEGN

SEQ ID NO: 3183619 - protein, 23 aa, Giardia lamblia
DEKALAAYDLAIDDAAFAAIERD

SEQ ID NO: 3183620 - protein, 26 aa, Giardia lamblia
DEKARLRYLEHLVASQERAAGAAVDD

SEQ ID NO: 3183621 - protein, 17 aa, Giardia lamblia
DEKFFHEFVEKISTFHK

SEQ ID NO: 3183622 - protein, 26 aa, Giardia lamblia
DEKIMLKELIAKWNKAWAFKAFAAKS

SEQ ID NO: 3183623 - protein, 18 aa, Giardia lamblia
DEKLSGLCMNWLSDTVNY

SEQ ID NO: 3183624 - protein, 25 aa, Giardia lamblia
DEKLSLSFLDLLETANGPMSASSVQ

SEQ ID NO: 3183625 - protein, 30 aa, Giardia lamblia
DEKVDIYAFGMLLLELITRDTPYLECANIV

SEQ ID NO: 3183626 - protein, 29 aa, Giardia lamblia
DEKYRALEREYFLVRDRCNFLEQQLNLGR

SEQ ID NO: 3183627 - protein, 25 aa, Giardia lamblia
DELDPRPRLPLFEEHIKLYNTSRRK

SEQ ID NO: 3183628 - protein, 20 aa, Giardia lamblia
DELKQLLCKLSWSGSIDECS

SEQ ID NO: 3183629 - protein, 20 aa, Giardia lamblia
DELNRLNGALDAKESLIADL

SEQ ID NO: 3183630 - protein, 24 aa, Giardia lamblia
DELPYCLDVMLHIGIKFHSMRSSD

SEQ ID NO: 3183631 - protein, 26 aa, Giardia lamblia
DELQRLNGILLFDNKALQVKLCEDEK

SEQ ID NO: 3183632 - protein, 24 aa, Giardia lamblia
DELSSWLISAPSGSILFTASSVPA

SEQ ID NO: 3183633 - protein, 28 aa, Giardia lamblia
DEMDDQIFALHDKIRRMRQARADLEAAE

SEQ ID NO: 3183634 - protein, 28 aa, Giardia lamblia
DEMQKIKEYLVKLFELIGSEKRAMAYVQ

SEQ ID NO: 3183635 - protein, 24 aa, Giardia lamblia
DEMRDIVTNLLWSDPFEYTDKQDS

SEQ ID NO: 3183636 - protein, 24 aa, Giardia lamblia
DENLKLIMRLLKDDSAVIRFEAFH

SEQ ID NO: 3183637 - protein, 26 aa, Giardia lamblia
DENRYLIRLRYRFSRGVPLEAVVAHH

SEQ ID NO: 3183638 - protein, 30 aa, Giardia lamblia
DENYGAIVLWIPENPFYPNRILYTRSEPTA

SEQ ID NO: 3183639 - protein, 22 aa, Giardia lamblia
DEQKILKICDLIISSEIPEVMS

SEQ ID NO: 3183640 - protein, 28 aa, Giardia lamblia
DEQPTWPSNLYPIRFFVLASSTSNESDQ

SEQ ID NO: 3183641 - protein, 24 aa, Giardia lamblia
DEQYRPHVLPSTRSNETSTERAER

SEQ ID NO: 3183642 - protein, 41 aa, Giardia lamblia
DERETDLHSLFDKIVLLYNAYKLEYQLDSISIVSGGKAVTR

SEQ ID NO: 3183643 - protein, 29 aa, Giardia lamblia
DERKKPSWRIPWMEVPVPGVKRFLEEAIE

SEQ ID NO: 3183644 - protein, 23 aa, Giardia lamblia
DERSIRIHILGYTIKILPHDGFQ

SEQ ID NO: 3183645 - protein, 22 aa, Giardia lamblia
DERVMQLFTLINNLLMNDSYCS

SEQ ID NO: 3183646 - protein, 20 aa, Giardia lamblia
DESKRYFQVDFDFGEFQTAL

SEQ ID NO: 3183647 - protein, 22 aa, Giardia lamblia
DESRVYLPHKEFFAVCEPNDDI

SEQ ID NO: 3183648 - protein, 35 aa, Giardia lamblia
DEVFRPFYLCTIIKPLFFFLDPYHRKRIAISDLLI

SEQ ID NO: 3183649 - protein, 23 aa, Giardia lamblia
DEVKELMELLGGLQQETQLLRQQ

SEQ ID NO: 3183650 - protein, 33 aa, Giardia lamblia
DEVLKKLVAQKKPYKYLVSCTLMQKTGAGLHTG

SEQ ID NO: 3183651 - protein, 24 aa, Giardia lamblia
DEVLVMLRILDFRQLPQTRRTVMT

SEQ ID NO: 3183652 - protein, 22 aa, Giardia lamblia
DEVSVVQFLTSLYYSNQSLNKV

SEQ ID NO: 3183653 - protein, 20 aa, Giardia lamblia
DEVTSLPSLVTLLVHESYRV

SEQ ID NO: 3183654 - protein, 22 aa, Giardia lamblia
DEWDVFMDATRRKRAFKLMLDA

SEQ ID NO: 3183655 - protein, 32 aa, Giardia lamblia
DEYHTFFSLAAMSLFNVTLPGLGKLCPMHPSL

SEQ ID NO: 3183656 - protein, 25 aa, Giardia lamblia
DEYLKLERPVRNIPPYTNNGYIFPL

SEQ ID NO: 3183657 - protein, 17 aa, Giardia lamblia
DEYLLITSLTTLAELFT

SEQ ID NO: 3183658 - protein, 21 aa, Giardia lamblia
DEYLREVFRRRFTFEAAIQSS

SEQ ID NO: 3183659 - protein, 36 aa, Giardia lamblia
DEYYGLFEKTAICFKTIYLLIPPRMVLGQAHQLDIE

SEQ ID NO: 3183660 - protein, 19 aa, Giardia lamblia
DEYYYLLEMELCDQSLEDV

SEQ ID NO: 3183661 - protein, 17 aa, Giardia lamblia
DFAAIGYGLLAIRPDDY

SEQ ID NO: 3183662 - protein, 20 aa, Giardia lamblia
DFAELRKLLKLYKEEAAAKD

SEQ ID NO: 3183663 - protein, 24 aa, Giardia lamblia
DFATGAPRLQLFFSVPSAGERSIQ

SEQ ID NO: 3183664 - protein, 18 aa, Giardia lamblia
DFCELCIRTLNPLAFEVM

SEQ ID NO: 3183665 - protein, 17 aa, Giardia lamblia
DFDILNMKLGSSGNKMV

SEQ ID NO: 3183666 - protein, 20 aa, Giardia lamblia
DFDQLAIANSKYLEKIAAKN

SEQ ID NO: 3183667 - protein, 24 aa, Giardia lamblia
DFDYRLSLFFEKCTQYLYERIFEG

SEQ ID NO: 3183668 - protein, 24 aa, Giardia lamblia
DFFGSNLVLFHPIVLGSSACDFVR

SEQ ID NO: 3183669 - protein, 21 aa, Giardia lamblia
DFFQEILAQIPNTTYTALYDR

SEQ ID NO: 3183670 - protein, 30 aa, Giardia lamblia
DFFRGNPIPFYRFCPEIFPGPQFKPTVVHL

SEQ ID NO: 3183671 - protein, 28 aa, Giardia lamblia
DFGNPMVQFYLHKLIDFMNYKASEVFLD

SEQ ID NO: 3183672 - protein, 25 aa, Giardia lamblia
DFGNRLRLPNNLFTKTHSPSSSIPD

SEQ ID NO: 3183673 - protein, 22 aa, Giardia lamblia
DFGQGLLKYVLAFTQLGISYAP

SEQ ID NO: 3183674 - protein, 20 aa, Giardia lamblia
DFGYMYMGFSSGTALMMAAR

SEQ ID NO: 3183675 - protein, 24 aa, Giardia lamblia
DFHELKVAMRALGFDVKKEEIQRI

SEQ ID NO: 3183676 - protein, 17 aa, Giardia lamblia
DFIFLLSTRSGGQGINL

SEQ ID NO: 3183677 - protein, 20 aa, Giardia lamblia
DFIGRRLSHSYSGAEKKGFG

SEQ ID NO: 3183678 - protein, 19 aa, Giardia lamblia
DFIMRVYRTTLSARTFKTT

SEQ ID NO: 3183679 - protein, 26 aa, Giardia lamblia
DFITQFFKLNIFDILFDNTAGLNLDI

SEQ ID NO: 3183680 - protein, 17 aa, Giardia lamblia
DFKGYSAILYAIKWGYV

SEQ ID NO: 3183681 - protein, 20 aa, Giardia lamblia
DFKRMFPGEKVPSCILKRER

SEQ ID NO: 3183682 - protein, 22 aa, Giardia lamblia
DFLTSSLLIKSPYGEKLIDAAW

SEQ ID NO: 3183683 - protein, 21 aa, Giardia lamblia
DFLYNEAMLEMIYASTLNLAN

SEQ ID NO: 3183684 - protein, 19 aa, Giardia lamblia
DFMEWTMLMCAAALGDTDL

SEQ ID NO: 3183685 - protein, 19 aa, Giardia lamblia
DFNCYPFVPRHTIVNIGVD

SEQ ID NO: 3183686 - protein, 18 aa, Giardia lamblia
DFNDFIMRVYRTTLSART

SEQ ID NO: 3183687 - protein, 23 aa, Giardia lamblia
DFNPNNPIYQWKHAEQPVASGCT

SEQ ID NO: 3183688 - protein, 28 aa, Giardia lamblia
DFPSAPALHLLYIYQVALTLDHPNLVRH

SEQ ID NO: 3183689 - protein, 17 aa, Giardia lamblia
DFPVFTITGPAPLQTTL

SEQ ID NO: 3183690 - protein, 24 aa, Giardia lamblia
DFRDLTFEVALAEALYFDSNDTPA

SEQ ID NO: 3183691 - protein, 17 aa, Giardia lamblia
DFRGNYLPSGSRKESTD

SEQ ID NO: 3183692 - protein, 17 aa, Giardia lamblia
DFSDPIVVLFRTKTSRA

SEQ ID NO: 3183693 - protein, 18 aa, Giardia lamblia
DFSIMYEQLKTQKNRLAR

SEQ ID NO: 3183694 - protein, 19 aa, Giardia lamblia
DFSLFTLFTAHTGSRPYTP

SEQ ID NO: 3183695 - protein, 24 aa, Giardia lamblia
DFSNNFIEFQFEEIRLRDYMQARN

SEQ ID NO: 3183696 - protein, 28 aa, Giardia lamblia
DFSQLKPASYWWFDGLVQETYVMEHKAG

SEQ ID NO: 3183697 - protein, 20 aa, Giardia lamblia
DFSRPWRRVPIIETLEQLLS

SEQ ID NO: 3183698 - protein, 17 aa, Giardia lamblia
DFSVTILTRFDLVFMLK

SEQ ID NO: 3183699 - protein, 18 aa, Giardia lamblia
DFSYLYSGPLGPVFKAKR

SEQ ID NO: 3183700 - protein, 23 aa, Giardia lamblia
DFTGKPIPVPHKLSARVPGVDEL

SEQ ID NO: 3183701 - protein, 25 aa, Giardia lamblia
DFTISFEILKTFLTKTYLAGKDIPW

SEQ ID NO: 3183702 - protein, 30 aa, Giardia lamblia
DFTIVADQRIVYSRLLLPGPAAAMPLEKDL

SEQ ID NO: 3183703 - protein, 31 aa, Giardia lamblia
DFVAEFEYWHDYLDLRFTFHSLMKCCGTLGS

SEQ ID NO: 3183704 - protein, 19 aa, Giardia lamblia
DFVCLVADTVFKHSILVLK

SEQ ID NO: 3183705 - protein, 26 aa, Giardia lamblia
DFVIEYSPEQYPLLSVTRGGVQLVLN

SEQ ID NO: 3183706 - protein, 17 aa, Giardia lamblia
DFVIRPNSEEKTISVSL

SEQ ID NO: 3183707 - protein, 20 aa, Giardia lamblia
DFVPHVIPTSSPRSGSYKSV

SEQ ID NO: 3183708 - protein, 26 aa, Giardia lamblia
DGATYKDLLCLLNEKMKRVDQLNADV

SEQ ID NO: 3183709 - protein, 24 aa, Giardia lamblia
DGCRLVIEPYKRGPGRIAHRQARS

SEQ ID NO: 3183710 - protein, 32 aa, Giardia lamblia
DGCVRMFDFRLRLLSWYENLACGPITSVSIAM

SEQ ID NO: 3183711 - protein, 36 aa, Giardia lamblia
DGDGKGFFAPYPLAGYIALKIPGGSPLFLLISASIL

SEQ ID NO: 3183712 - protein, 26 aa, Giardia lamblia
DGDIVKVWSLLPYQKRMTDATGRTSL

SEQ ID NO: 3183713 - protein, 21 aa, Giardia lamblia
DGDLAFLQPKLLQALNELQSG

SEQ ID NO: 3183714 - protein, 23 aa, Giardia lamblia
DGDTGLLLATKSGLVKVVSVLAR

SEQ ID NO: 3183715 - protein, 28 aa, Giardia lamblia
DGDVDKLLEILAFKQGRLLKGGEPDTRT

SEQ ID NO: 3183716 - protein, 24 aa, Giardia lamblia
DGEHVFVCDIGNQNIRMITFGAVT

SEQ ID NO: 3183717 - protein, 31 aa, Giardia lamblia
DGEKKIKFFSVFYIRVYGGAGAWIFMTGEVT

SEQ ID NO: 3183718 - protein, 24 aa, Giardia lamblia
DGEQRPILPLLDDNKLSPSAEPDL

SEQ ID NO: 3183719 - protein, 17 aa, Giardia lamblia
DGETALVIAARKGYREI

SEQ ID NO: 3183720 - protein, 29 aa, Giardia lamblia
DGEYINELLIWEYIAQLVDITLFIVSQVG

SEQ ID NO: 3183721 - protein, 20 aa, Giardia lamblia
DGEYYDIYPPQDLIALYEEG

SEQ ID NO: 3183722 - protein, 29 aa, Giardia lamblia
DGGLEKLLEKLMVPVLKSSAEVLGTSIPG

SEQ ID NO: 3183723 - protein, 23 aa, Giardia lamblia
DGGRFITLTIAISGLPISCEEGQ

SEQ ID NO: 3183724 - protein, 23 aa, Giardia lamblia
DGGSALMWAAYNGNPECVKLLLM

SEQ ID NO: 3183725 - protein, 23 aa, Giardia lamblia
DGHGILARLLIKEDWSYFVIDVD

SEQ ID NO: 3183726 - protein, 17 aa, Giardia lamblia
DGHGLIDAFRAMHPHRI

SEQ ID NO: 3183727 - protein, 20 aa, Giardia lamblia
DGHTALILAACYDHHEICDV

SEQ ID NO: 3183728 - protein, 20 aa, Giardia lamblia
DGHTWFLPITSVLNPQHPRI

SEQ ID NO: 3183729 - protein, 17 aa, Giardia lamblia
DGIFRSLTLGKVQAREL

SEQ ID NO: 3183730 - protein, 26 aa, Giardia lamblia
DGIHRYGRWNIFNPTALMLAAAYNNV

SEQ ID NO: 3183731 - protein, 22 aa, Giardia lamblia
DGIVMQCTQLKDFLSSSNAEIH

SEQ ID NO: 3183732 - protein, 17 aa, Giardia lamblia
DGKILRLDKLRVENDLL

SEQ ID NO: 3183733 - protein, 22 aa, Giardia lamblia
DGKTALMYAAYKGNTCFVNMLK

SEQ ID NO: 3183734 - protein, 27 aa, Giardia lamblia
DGLESLLLKLPITQYLPVMPFDHCSRT

SEQ ID NO: 3183735 - protein, 23 aa, Giardia lamblia
DGLHRQLVALKNSLGQNAELYEQ

SEQ ID NO: 3183736 - protein, 30 aa, Giardia lamblia
DGLMRVLNYRHFIKFELPYSFTVDGDCSNK

SEQ ID NO: 3183737 - protein, 21 aa, Giardia lamblia
DGLRELLGLPLPTQDIYDDDV

SEQ ID NO: 3183738 - protein, 23 aa, Giardia lamblia
DGLSAIFYAVYANALDAVKLLLD

SEQ ID NO: 3183739 - protein, 25 aa, Giardia lamblia
DGLSALMFATLAEQLEIADLLISDE

SEQ ID NO: 3183740 - protein, 18 aa, Giardia lamblia
DGLSLFILTGLKKQERLS

SEQ ID NO: 3183741 - protein, 26 aa, Giardia lamblia
DGLSSFLFHNFTLPQAILAIHAFFET

SEQ ID NO: 3183742 - protein, 33 aa, Giardia lamblia
DGMILISRIRYPGLPFMTKPVPRSSLGLNHIVR

SEQ ID NO: 3183743 - protein, 30 aa, Giardia lamblia
DGMSPLKGPCLVFLVKFMEEIIGFKNTPKG

SEQ ID NO: 3183744 - protein, 24 aa, Giardia lamblia
DGMTALAIALYNKNLDMAMLLSDY

SEQ ID NO: 3183745 - protein, 35 aa, Giardia lamblia
DGNTALLYAISSSNMQLISYLAPHEVRETNIFGWN

SEQ ID NO: 3183746 - protein, 24 aa, Giardia lamblia
DGNTALMYAIYRNSLIYTELLFRY

SEQ ID NO: 3183747 - protein, 28 aa, Giardia lamblia
DGNTIIARDFLSLKLWDIRSEGRPLITL

SEQ ID NO: 3183748 - protein, 26 aa, Giardia lamblia
DGNVSLVMLYLAERFTAISSPRALFG

SEQ ID NO: 3183749 - protein, 23 aa, Giardia lamblia
DGQQSFLFQLSFPNSSVSNTTDQ

SEQ ID NO: 3183750 - protein, 24 aa, Giardia lamblia
DGQRDLSYSFLLGASMLGENSNTP

SEQ ID NO: 3183751 - protein, 19 aa, Giardia lamblia
DGRCCLYRTALLESGTLGQ

SEQ ID NO: 3183752 - protein, 23 aa, Giardia lamblia
DGRDALMLAAFMANYEAVSVLVR

SEQ ID NO: 3183753 - protein, 20 aa, Giardia lamblia
DGRFIRVHPLLQADENEPEK

SEQ ID NO: 3183754 - protein, 24 aa, Giardia lamblia
DGRGYTALMWAAQNGRTECVKLLL

SEQ ID NO: 3183755 - protein, 20 aa, Giardia lamblia
DGRHIFMYPGKLEHAELKQP

SEQ ID NO: 3183756 - protein, 19 aa, Giardia lamblia
DGRIQRQLGCPARFPTFLL

SEQ ID NO: 3183757 - protein, 22 aa, Giardia lamblia
DGRLLQVEYAIKAVTIAAPCLA

SEQ ID NO: 3183758 - protein, 30 aa, Giardia lamblia
DGRLNKLFCQCLCLFTKLFLDSKTLFYDTD

SEQ ID NO: 3183759 - protein, 24 aa, Giardia lamblia
DGRTALMIACQNSHLPCVMKMLPD

SEQ ID NO: 3183760 - protein, 27 aa, Giardia lamblia
DGRVHYKPLRLPPHLRPMELNLNSQDY

SEQ ID NO: 3183761 - protein, 33 aa, Giardia lamblia
DGSDFELYSLYSFFSFCLQRKCRRRVLLDYFNS

SEQ ID NO: 3183762 - protein, 28 aa, Giardia lamblia
DGSDGRRLWILIDTIVFDVTEYLNKHPG

SEQ ID NO: 3183763 - protein, 25 aa, Giardia lamblia
DGSDQFVFLLEAKAAKNRTHFLILY

SEQ ID NO: 3183764 - protein, 24 aa, Giardia lamblia
DGSPMDYLILSKDVFMLVLSNGTA

SEQ ID NO: 3183765 - protein, 32 aa, Giardia lamblia
DGSTPPVVLAIPPLPHYLLGGVKYATAISCMA

SEQ ID NO: 3183766 - protein, 23 aa, Giardia lamblia
DGSVKVWDLIRNALLHTHAQLAP

SEQ ID NO: 3183767 - protein, 32 aa, Giardia lamblia
DGTLLYINSLFQRYCPPILPFNCGSLGFLTPF

SEQ ID NO: 3183768 - protein, 23 aa, Giardia lamblia
DGTTALMLAAVNGSLNALELLLP

SEQ ID NO: 3183769 - protein, 22 aa, Giardia lamblia
DGTTRVWSTFSPSIPCEILPEG

SEQ ID NO: 3183770 - protein, 25 aa, Giardia lamblia
DGVKEFPIWCYLGEELDEMGDPDLD

SEQ ID NO: 3183771 - protein, 22 aa, Giardia lamblia
DGVLIYVDNLSEFIVRNPQELF

SEQ ID NO: 3183772 - protein, 29 aa, Giardia lamblia
DGVLTTGYLELFRILWPSMPVEVEMLIST

SEQ ID NO: 3183773 - protein, 19 aa, Giardia lamblia
DGVMGFRRQLLEVTGIDAF

SEQ ID NO: 3183774 - protein, 27 aa, Giardia lamblia
DGVQWRIFVLIAKIYFIRSCKSNVSDY

SEQ ID NO: 3183775 - protein, 24 aa, Giardia lamblia
DGVSPLVLAIRVGNEILVEMLLEF

SEQ ID NO: 3183776 - protein, 23 aa, Giardia lamblia
DGVTALMIAAMRNNLEAAQLLVE

SEQ ID NO: 3183777 - protein, 22 aa, Giardia lamblia
DGVTALMRFADSGNLWFTRLYL

SEQ ID NO: 3183778 - protein, 26 aa, Giardia lamblia
DGVTEALVPFFYSKSLRVPTSIAITG

SEQ ID NO: 3183779 - protein, 23 aa, Giardia lamblia
DGVTRLMLAAQKGLTAVVQHLLS

SEQ ID NO: 3183780 - protein, 17 aa, Giardia lamblia
DGWSALMFAAQQGNMRA

SEQ ID NO: 3183781 - protein, 20 aa, Giardia lamblia
DGWTALMFAAQAGYADIVSL

SEQ ID NO: 3183782 - protein, 18 aa, Giardia lamblia
DGWTALMIAVMHADLEMV

SEQ ID NO: 3183783 - protein, 17 aa, Giardia lamblia
DGWTALMSAARNNHLEI

SEQ ID NO: 3183784 - protein, 23 aa, Giardia lamblia
DGYAALHRAILSRKLECTVILAP

SEQ ID NO: 3183785 - protein, 21 aa, Giardia lamblia
DGYTAIMWAAQTGSAGLVKLL

SEQ ID NO: 3183786 - protein, 20 aa, Giardia lamblia
DGYTLLANGILKAAIKYSNN

SEQ ID NO: 3183787 - protein, 18 aa, Giardia lamblia
DHAKIIQIILPNEVMRRD

SEQ ID NO: 3183788 - protein, 18 aa, Giardia lamblia
DHANIFLYTAFYLDENTI

SEQ ID NO: 3183789 - protein, 28 aa, Giardia lamblia
DHASIKELLSIVHPYMLRVMEIIYDQEV

SEQ ID NO: 3183790 - protein, 17 aa, Giardia lamblia
DHCCRIARILSSPSGHA

SEQ ID NO: 3183791 - protein, 22 aa, Giardia lamblia
DHCLGYFFKYFATSSKKGNTDN

SEQ ID NO: 3183792 - protein, 27 aa, Giardia lamblia
DHDSLVLYIVLPFLGAKTLQAAIESAK

SEQ ID NO: 3183793 - protein, 25 aa, Giardia lamblia
DHEGHTALYYALLSRNMVVAEILKE

SEQ ID NO: 3183794 - protein, 18 aa, Giardia lamblia
DHERLLGDLGYYKGLVTE

SEQ ID NO: 3183795 - protein, 17 aa, Giardia lamblia
DHFLLTNKLLQSQHVTP

SEQ ID NO: 3183796 - protein, 31 aa, Giardia lamblia
DHFNDDLLHVFKARISPCYVAPAGPFRSPMV

SEQ ID NO: 3183797 - protein, 24 aa, Giardia lamblia
DHFSLLHRTVNVFNFDPASETIPY

SEQ ID NO: 3183798 - protein, 22 aa, Giardia lamblia
DHHRTFLFTAGTEIAYYQTVGN

SEQ ID NO: 3183799 - protein, 21 aa, Giardia lamblia
DHLCTLPSPRVARFVRYTILE

SEQ ID NO: 3183800 - protein, 23 aa, Giardia lamblia
DHLDCYEILYPYEKDVVQLDGTT

SEQ ID NO: 3183801 - protein, 19 aa, Giardia lamblia
DHLIPLLPEMFSVKLIDLG

SEQ ID NO: 3183802 - protein, 23 aa, Giardia lamblia
DHLSLLYALVGPLPKTGMASQSY

SEQ ID NO: 3183803 - protein, 25 aa, Giardia lamblia
DHMDGDLILTTFSKATPEATQINDD

SEQ ID NO: 3183804 - protein, 30 aa, Giardia lamblia
DHPLFLRGKEKYGFLYMFSKQGNVTLVDIY

SEQ ID NO: 3183805 - protein, 20 aa, Giardia lamblia
DHPNILKYKTIRKDEYYYLL

SEQ ID NO: 3183806 - protein, 23 aa, Giardia lamblia
DHPYAFHAFQLVREKCALALASL

SEQ ID NO: 3183807 - protein, 20 aa, Giardia lamblia
DHQQVISAMISPICYRVGES

SEQ ID NO: 3183808 - protein, 29 aa, Giardia lamblia
DHRRFSPDLKQFILALRSLCLHDKPVVSN

SEQ ID NO: 3183809 - protein, 21 aa, Giardia lamblia
DHRVYRQNNVFLYNGKKLVGA

SEQ ID NO: 3183810 - protein, 28 aa, Giardia lamblia
DHSDRDGDLPSFVLGEEALKGLVVPVRD

SEQ ID NO: 3183811 - protein, 21 aa, Giardia lamblia
DHSFLLLADFGDFRHYFVLRY

SEQ ID NO: 3183812 - protein, 32 aa, Giardia lamblia
DHSTVDYYLIARGALVKPWIFQEIKEGRRIDM

SEQ ID NO: 3183813 - protein, 23 aa, Giardia lamblia
DHTKGFGLALGLEEDENEAKEAL

SEQ ID NO: 3183814 - protein, 30 aa, Giardia lamblia
DHTVAVFRNNYLLLFGGVDAGKLYADLWLF

SEQ ID NO: 3183815 - protein, 20 aa, Giardia lamblia
DHVPDLRGPLAAPHQIHGTG

SEQ ID NO: 3183816 - protein, 19 aa, Giardia lamblia
DHVSPKSVYPIFVADFSDV

SEQ ID NO: 3183817 - protein, 18 aa, Giardia lamblia
DIAALPNTLQFLSNYVLR

SEQ ID NO: 3183818 - protein, 18 aa, Giardia lamblia
DIAGIKAHIATDAGKKNR

SEQ ID NO: 3183819 - protein, 33 aa, Giardia lamblia
DIALCIDVVQGTFLWYFPTQELLDQYRHIISGV

SEQ ID NO: 3183820 - protein, 23 aa, Giardia lamblia
DIAMLYSMYLSQRYPTPRGYHAD

SEQ ID NO: 3183821 - protein, 19 aa, Giardia lamblia
DIATIELLAPYFCGLKNKR

SEQ ID NO: 3183822 - protein, 36 aa, Giardia lamblia
DIATNLVELLVYLHKHHLLAWSGLSPSFVHLTTQNE

SEQ ID NO: 3183823 - protein, 25 aa, Giardia lamblia
DICKWRLMLLYFGQEIERSGAPIER

SEQ ID NO: 3183824 - protein, 20 aa, Giardia lamblia
DICSLTALFVDKAPQTNIRY

SEQ ID NO: 3183825 - protein, 31 aa, Giardia lamblia
DIDDMDSIPMLLFKNLLSKGRALKPLHKKAM

SEQ ID NO: 3183826 - protein, 21 aa, Giardia lamblia
DIDKLCDEAVRFGFTAVCVNG

SEQ ID NO: 3183827 - protein, 18 aa, Giardia lamblia
DIDTPPFDLVMKLVSNSV

SEQ ID NO: 3183828 - protein, 30 aa, Giardia lamblia
DIEAGMIGQLFILKAISLDLQNVWIGAVNI

SEQ ID NO: 3183829 - protein, 17 aa, Giardia lamblia
DIELPPASSLVNFPPAY

SEQ ID NO: 3183830 - protein, 25 aa, Giardia lamblia
DIENYFRLDILERDVVQLALEISML

SEQ ID NO: 3183831 - protein, 27 aa, Giardia lamblia
DIESEWHLKHIFAWFSRKSIAVYVDPL

SEQ ID NO: 3183832 - protein, 34 aa, Giardia lamblia
DIETSLFRYYCPFFYWMHSFGLILLNHIKPGAYS

SEQ ID NO: 3183833 - protein, 23 aa, Giardia lamblia
DIEWHFIGHLQTNKARDVAFIPN

SEQ ID NO: 3183834 - protein, 21 aa, Giardia lamblia
DIFLPRCEFCLGWGAIDVLPA

SEQ ID NO: 3183835 - protein, 19 aa, Giardia lamblia
DIFMPYRLDVYVPEEAVET

SEQ ID NO: 3183836 - protein, 19 aa, Giardia lamblia
DIFSIIKYIPQQSEQLWLG

SEQ ID NO: 3183837 - protein, 28 aa, Giardia lamblia
DIHEPIPSKLMLSLLGQLAGALAHLHGF

SEQ ID NO: 3183838 - protein, 25 aa, Giardia lamblia
DIHPAFELRTLLKGWRGLKSMRTSP

SEQ ID NO: 3183839 - protein, 28 aa, Giardia lamblia
DIIACELSLFFRLSSLIPFCAVTHTLCL

SEQ ID NO: 3183840 - protein, 20 aa, Giardia lamblia
DIIAVYCYRSLFARLHDEYG

SEQ ID NO: 3183841 - protein, 17 aa, Giardia lamblia
DIIFNVLDPITHPDALK

SEQ ID NO: 3183842 - protein, 24 aa, Giardia lamblia
DIIKSLNIHSLFSGAPSFLSFQPP

SEQ ID NO: 3183843 - protein, 24 aa, Giardia lamblia
DIIRDHILSFILPSELHELLYAEQ

SEQ ID NO: 3183844 - protein, 19 aa, Giardia lamblia
DIISVWCLASMQASLQDEN

SEQ ID NO: 3183845 - protein, 23 aa, Giardia lamblia
DIITALHDLGFVRFHAILHKYYS

SEQ ID NO: 3183846 - protein, 27 aa, Giardia lamblia
DIITHMMMMALPAGPTAWFRMTNVYTH

SEQ ID NO: 3183847 - protein, 37 aa, Giardia lamblia
DIKIYPKLTSVHIYWALFGLLFWCTCAKCEQVFPLQD

SEQ ID NO: 3183848 - protein, 26 aa, Giardia lamblia
DIKLKKVVYLFVLNYHKMNPDTPVQV

SEQ ID NO: 3183849 - protein, 25 aa, Giardia lamblia
DIKNRLFEIVPGMQLEPGVSVHSPS

SEQ ID NO: 3183850 - protein, 18 aa, Giardia lamblia
DIKRFCRIEKIPGATVED

SEQ ID NO: 3183851 - protein, 26 aa, Giardia lamblia
DIKTNALRFILHQPLPHQNNNYNQVS

SEQ ID NO: 3183852 - protein, 19 aa, Giardia lamblia
DILCLDWHPERSDLLLVGL

SEQ ID NO: 3183853 - protein, 23 aa, Giardia lamblia
DILDRVIFLSMLPMKVEHIRRYL

SEQ ID NO: 3183854 - protein, 20 aa, Giardia lamblia
DILKSIKHIWLAASKAADAL

SEQ ID NO: 3183855 - protein, 21 aa, Giardia lamblia
DILNYFNVLGSPLTKNYLFLG

SEQ ID NO: 3183856 - protein, 24 aa, Giardia lamblia
DILPPYACAIILHFENYTVDPQVL

SEQ ID NO: 3183857 - protein, 32 aa, Giardia lamblia
DILVDESYLYVLRRILLTLLDRTKEAELEFEH

SEQ ID NO: 3183858 - protein, 23 aa, Giardia lamblia
DIMFLRIEQLIIRSLQAVANDMI

SEQ ID NO: 3183859 - protein, 23 aa, Giardia lamblia
DINSHLYTLLQSPSLRMTIYEFA

SEQ ID NO: 3183860 - protein, 18 aa, Giardia lamblia
DINTTDILAARRLIQPHT

SEQ ID NO: 3183861 - protein, 19 aa, Giardia lamblia
DIPEWHLDVSATDMVTGFG

SEQ ID NO: 3183862 - protein, 27 aa, Giardia lamblia
DIQALRPTIFIAVPRILNRLFEGIMAS

SEQ ID NO: 3183863 - protein, 17 aa, Giardia lamblia
DIQFTTEVLPDISLVAV

SEQ ID NO: 3183864 - protein, 18 aa, Giardia lamblia
DIQIVPKTLDFPLINRQT

SEQ ID NO: 3183865 - protein, 22 aa, Giardia lamblia
DIQKHFQSIGPITEIRLLLKED

SEQ ID NO: 3183866 - protein, 18 aa, Giardia lamblia
DIQLSFKTYYKGVAMHGA

SEQ ID NO: 3183867 - protein, 17 aa, Giardia lamblia
DIQLTLFPKSADYDSPE

SEQ ID NO: 3183868 - protein, 18 aa, Giardia lamblia
DIQNKLSYALSKTPTFTP

SEQ ID NO: 3183869 - protein, 18 aa, Giardia lamblia
DIQNLRAFAITTSHAFNQ

SEQ ID NO: 3183870 - protein, 28 aa, Giardia lamblia
DIREDAVIRMIYFYKQLKRSRKIGFLTT

SEQ ID NO: 3183871 - protein, 17 aa, Giardia lamblia
DIRGYIADLFKYIEKDP

SEQ ID NO: 3183872 - protein, 21 aa, Giardia lamblia
DIRLLEIYRSLFTTCYTSKRM

SEQ ID NO: 3183873 - protein, 17 aa, Giardia lamblia
DIRPPISAPHRSHVAFT

SEQ ID NO: 3183874 - protein, 34 aa, Giardia lamblia
DIRVRAMQILTELFLCALPRRVFHYLEGPASVVK

SEQ ID NO: 3183875 - protein, 25 aa, Giardia lamblia
DISGMKFMINTVSLDRVVPSKTSSR

SEQ ID NO: 3183876 - protein, 23 aa, Giardia lamblia
DISIALRDFFINQLKQFQREFKN

SEQ ID NO: 3183877 - protein, 27 aa, Giardia lamblia
DISKFMPKYNTYMSDAGLMTDARLRHF

SEQ ID NO: 3183878 - protein, 26 aa, Giardia lamblia
DISKLLNWFEIWIVPAINAEGIRCGH

SEQ ID NO: 3183879 - protein, 33 aa, Giardia lamblia
DISKLNSSALLLRRLPCIMMKLKMVQKIQDGVR

SEQ ID NO: 3183880 - protein, 21 aa, Giardia lamblia
DISLLMWRRVCADKAYRVDCD

SEQ ID NO: 3183881 - protein, 19 aa, Giardia lamblia
DISLLPKALDSVAVLTSSY

SEQ ID NO: 3183882 - protein, 32 aa, Giardia lamblia
DISLPTIYAQFAFTILFKLARDPLQHTAEEQG

SEQ ID NO: 3183883 - protein, 18 aa, Giardia lamblia
DISLVSEMIKIHARTRTE

SEQ ID NO: 3183884 - protein, 25 aa, Giardia lamblia
DISSRDDYIFCLTYLRDCVASGKPV

SEQ ID NO: 3183885 - protein, 19 aa, Giardia lamblia
DITGAVLLTFLKDAGIPVN

SEQ ID NO: 3183886 - protein, 23 aa, Giardia lamblia
DITGIVYSLKDYPSLVVKVAPLG

SEQ ID NO: 3183887 - protein, 24 aa, Giardia lamblia
DITRNNLQLARALLMYAHAAAGMN

SEQ ID NO: 3183888 - protein, 20 aa, Giardia lamblia
DIVDLLRYEVLQRRAILTTD

SEQ ID NO: 3183889 - protein, 17 aa, Giardia lamblia
DIVGFDMDKLSLSLKAK

SEQ ID NO: 3183890 - protein, 26 aa, Giardia lamblia
DIVLLRNKFRLCTRRRMPVLTPLEVR

SEQ ID NO: 3183891 - protein, 22 aa, Giardia lamblia
DIVQIILKYNPDMRILNDAGLS

SEQ ID NO: 3183892 - protein, 28 aa, Giardia lamblia
DIVQLLIPREKMMVMRDGSSALMLAVCT

SEQ ID NO: 3183893 - protein, 23 aa, Giardia lamblia
DIVRVYCFRHVQGGLRDMSGCTA

SEQ ID NO: 3183894 - protein, 23 aa, Giardia lamblia
DIVTKKIIVILSILAVELVGNSK

SEQ ID NO: 3183895 - protein, 23 aa, Giardia lamblia
DIWSLGCIIYELCTFQAPFVATD

SEQ ID NO: 3183896 - protein, 39 aa, Giardia lamblia
DIWSLGCTIYHVCALRPPFVAVGMGPLIRMIRSGVYPEM

SEQ ID NO: 3183897 - protein, 23 aa, Giardia lamblia
DIWSLGCVLLELCTLRVPPVYVS

SEQ ID NO: 3183898 - protein, 22 aa, Giardia lamblia
DIWSLGCVLYEICTLQHAFEAQ

SEQ ID NO: 3183899 - protein, 19 aa, Giardia lamblia
DIWSLGKLLSDMCLLLLPS

SEQ ID NO: 3183900 - protein, 28 aa, Giardia lamblia
DIYALGCIIYQLCTLRNFADVFKNDISY

SEQ ID NO: 3183901 - protein, 24 aa, Giardia lamblia
DIYAMGVTTYLLLGGVLPYEERDA

SEQ ID NO: 3183902 - protein, 25 aa, Giardia lamblia
DIYKDVHYLMYESPLKFDAVYWQLD

SEQ ID NO: 3183903 - protein, 22 aa, Giardia lamblia
DIYLIFSLVIANTWNLRVLFLH

SEQ ID NO: 3183904 - protein, 21 aa, Giardia lamblia
DIYLVHESSLRTLFIALYDDN

SEQ ID NO: 3183905 - protein, 22 aa, Giardia lamblia
DIYPSLFYVCHRDGYLREAGRV

SEQ ID NO: 3183906 - protein, 20 aa, Giardia lamblia
DIYPVRTFALPIPGQEDQEV

SEQ ID NO: 3183907 - protein, 34 aa, Giardia lamblia
DIYRYTVPLLIQYSYMLEIPADQLYILLEPIVLA

SEQ ID NO: 3183908 - protein, 26 aa, Giardia lamblia
DKAGGRLVILGLEEVLVKSPGEIMSL

SEQ ID NO: 3183909 - protein, 35 aa, Giardia lamblia
DKAGWTALMWASHYNLVFLIETLFVEVTMRDIYGR

SEQ ID NO: 3183910 - protein, 23 aa, Giardia lamblia
DKARYICRELSYACLTPTQQERL

SEQ ID NO: 3183911 - protein, 22 aa, Giardia lamblia
DKDCLTALHLYIQAQGCCESTL

SEQ ID NO: 3183912 - protein, 23 aa, Giardia lamblia
DKDEELVYGYITRSFLASVSPDA

SEQ ID NO: 3183913 - protein, 27 aa, Giardia lamblia
DKDENYFFAFTYPYTYSMLTKFLARIK

SEQ ID NO: 3183914 - protein, 24 aa, Giardia lamblia
DKDKYETFLKQFGKSIKLGIHEDS

SEQ ID NO: 3183915 - protein, 26 aa, Giardia lamblia
DKDRCIYYYHIITGRGLHSSSGPAIK

SEQ ID NO: 3183916 - protein, 19 aa, Giardia lamblia
DKDYAFLCGAISGNKQPPI

SEQ ID NO: 3183917 - protein, 18 aa, Giardia lamblia
DKEEEWLPYVLTSVNRIF

SEQ ID NO: 3183918 - protein, 24 aa, Giardia lamblia
DKFGVWKNVFQTLPNGAKGRVVLL

SEQ ID NO: 3183919 - protein, 21 aa, Giardia lamblia
DKFSLDLLEKALSGISPPKVS

SEQ ID NO: 3183920 - protein, 26 aa, Giardia lamblia
DKGKVYTWYFNTWSNKTLGPRMSAED

SEQ ID NO: 3183921 - protein, 20 aa, Giardia lamblia
DKGSLFSLVNHYLSLIEASD

SEQ ID NO: 3183922 - protein, 21 aa, Giardia lamblia
DKIFHSFITPNDIVFNTSGVV

SEQ ID NO: 3183923 - protein, 25 aa, Giardia lamblia
DKITALWLHKPECLTAFLKLMFSTE

SEQ ID NO: 3183924 - protein, 19 aa, Giardia lamblia
DKKEEELLWMSQASKKSEE

SEQ ID NO: 3183925 - protein, 20 aa, Giardia lamblia
DKKTWGKMALNNCLRMSYFS

SEQ ID NO: 3183926 - protein, 25 aa, Giardia lamblia
DKLAKFFVVIFRRLKVDPHVVAYAL

SEQ ID NO: 3183927 - protein, 20 aa, Giardia lamblia
DKLALPLAPDSKCPYCLSCM

SEQ ID NO: 3183928 - protein, 22 aa, Giardia lamblia
DKLGPACILALPPEPARGLADA

SEQ ID NO: 3183929 - protein, 21 aa, Giardia lamblia
DKLRCRLTFLALCNIMQTFSH

SEQ ID NO: 3183930 - protein, 23 aa, Giardia lamblia
DKMVMEYRWLLEDAPGEYVFTHL

SEQ ID NO: 3183931 - protein, 21 aa, Giardia lamblia
DKMWVVRRNLAKQIVITVSIP

SEQ ID NO: 3183932 - protein, 26 aa, Giardia lamblia
DKPEHLFPHYREAYGVPSIDLPHSVL

SEQ ID NO: 3183933 - protein, 17 aa, Giardia lamblia
DKRLLEVILPRNTQFGS

SEQ ID NO: 3183934 - protein, 22 aa, Giardia lamblia
DKRPKPIILRLSPETAQEIGAT

SEQ ID NO: 3183935 - protein, 26 aa, Giardia lamblia
DKRPQPLIFNFFKPSKSKQEGDGVAV

SEQ ID NO: 3183936 - protein, 21 aa, Giardia lamblia
DKRTYLPYWSEQVFKLPEPGS

SEQ ID NO: 3183937 - protein, 20 aa, Giardia lamblia
DKSRFFAFGRVFSGVVQTGQ

SEQ ID NO: 3183938 - protein, 22 aa, Giardia lamblia
DKSRILIELYLSTNKTFECLLV

SEQ ID NO: 3183939 - protein, 24 aa, Giardia lamblia
DKSRRIFYVIMKYYSNGSIANSIS

SEQ ID NO: 3183940 - protein, 30 aa, Giardia lamblia
DKSVSPLITELYLRMLRKNLSLTSETKLTI

SEQ ID NO: 3183941 - protein, 24 aa, Giardia lamblia
DKTDQRLVLTPRNPTVLSAERTML

SEQ ID NO: 3183942 - protein, 40 aa, Giardia lamblia
DKTGNYLYLLSYRSVYVFSFLEIRLVKRINLSQRFAFLPR

SEQ ID NO: 3183943 - protein, 21 aa, Giardia lamblia
DKTVKIWSPIKGSCLEILTHN

SEQ ID NO: 3183944 - protein, 18 aa, Giardia lamblia
DKVALAHFYAIYVRSLPL

SEQ ID NO: 3183945 - protein, 25 aa, Giardia lamblia
DKVANFLSIMGFNPSSQGYTFAVQQ

SEQ ID NO: 3183946 - protein, 34 aa, Giardia lamblia
DKVAQSDIIFLRTYVPITIIKFCYEMLNHYYVYD

SEQ ID NO: 3183947 - protein, 24 aa, Giardia lamblia
DKVAYIFRLGQLWTDKKSIVARIP

SEQ ID NO: 3183948 - protein, 24 aa, Giardia lamblia
DKVKITPLMWAAFVGDVSTVQEEI

SEQ ID NO: 3183949 - protein, 23 aa, Giardia lamblia
DKWKDIYIELFRTQVSYTPGAIE

SEQ ID NO: 3183950 - protein, 27 aa, Giardia lamblia
DKYDYDVLYYLTKGINLMLHMAPSITK

SEQ ID NO: 3183951 - protein, 21 aa, Giardia lamblia
DKYRETSLYSCFSSVLAKLRS

SEQ ID NO: 3183952 - protein, 23 aa, Giardia lamblia
DKYVKDIILPAVTRKFANIGTKD

SEQ ID NO: 3183953 - protein, 18 aa, Giardia lamblia
DLADQLPLRGSLIKEDLE

SEQ ID NO: 3183954 - protein, 26 aa, Giardia lamblia
DLAEFNSFFKVLFFTRTDAENGVIYG

SEQ ID NO: 3183955 - protein, 17 aa, Giardia lamblia
DLALHFCDKYNILAVKI

SEQ ID NO: 3183956 - protein, 26 aa, Giardia lamblia
DLALHFPQSFTVTQLQPLIKMNEMKT

SEQ ID NO: 3183957 - protein, 19 aa, Giardia lamblia
DLALLAMGSLRSALYLRTR

SEQ ID NO: 3183958 - protein, 18 aa, Giardia lamblia
DLALLMRNPHVVKLYNAA

SEQ ID NO: 3183959 - protein, 32 aa, Giardia lamblia
DLAPPVVHHILLNSGLLRSYSAILSSVGSSGS

SEQ ID NO: 3183960 - protein, 23 aa, Giardia lamblia
DLARAWALLPIQHGVRDKHGKTA

SEQ ID NO: 3183961 - protein, 24 aa, Giardia lamblia
DLCDAIGMMLIKDPQRRPSAGELL

SEQ ID NO: 3183962 - protein, 25 aa, Giardia lamblia
DLCDKIGLWALRDRVWHIQGCSALT

SEQ ID NO: 3183963 - protein, 19 aa, Giardia lamblia
DLCNRILALGFDIGINGCS

SEQ ID NO: 3183964 - protein, 18 aa, Giardia lamblia
DLCTIHIISPYRAGESVA

SEQ ID NO: 3183965 - protein, 26 aa, Giardia lamblia
DLDANGELIRKLPPPSVHVSTQRPKD

SEQ ID NO: 3183966 - protein, 31 aa, Giardia lamblia
DLDDSFVEYILPSYDRLLREKSEEIERLRAM

SEQ ID NO: 3183967 - protein, 27 aa, Giardia lamblia
DLDHDDLLLSSTLPLIQDYDLQSNSLI

SEQ ID NO: 3183968 - protein, 19 aa, Giardia lamblia
DLDILAKIDDLTVLCAPLN

SEQ ID NO: 3183969 - protein, 20 aa, Giardia lamblia
DLDKLLYFTVRYKNADKLKI

SEQ ID NO: 3183970 - protein, 25 aa, Giardia lamblia
DLDNKYWFENIISNIFTIDKQIIHE

SEQ ID NO: 3183971 - protein, 20 aa, Giardia lamblia
DLDRFLLKYGIDRQLTDCEY

SEQ ID NO: 3183972 - protein, 25 aa, Giardia lamblia
DLDTALYDVAVLRRALRVIEDDYRD

SEQ ID NO: 3183973 - protein, 35 aa, Giardia lamblia
DLDVGYLKEPRLMDLYLTLPIIRFKPQEAKKKTAK

SEQ ID NO: 3183974 - protein, 26 aa, Giardia lamblia
DLEAYAAAHFALHGLPVLAAQLINKA

SEQ ID NO: 3183975 - protein, 36 aa, Giardia lamblia
DLECFSFLNKAMESPLAPVIIFATNRGICEIRGSGG

SEQ ID NO: 3183976 - protein, 24 aa, Giardia lamblia
DLEDALYDMLRVRCPYIIHYTDVY

SEQ ID NO: 3183977 - protein, 26 aa, Giardia lamblia
DLEDLRFQNFWLYQTEAGDYFLVWTL

SEQ ID NO: 3183978 - protein, 19 aa, Giardia lamblia
DLEGRWHLVYDTTYLRRGI

SEQ ID NO: 3183979 - protein, 25 aa, Giardia lamblia
DLEKAQRLPLPKLLELIRQKEVALG

SEQ ID NO: 3183980 - protein, 24 aa, Giardia lamblia
DLENRIMGFAKEYENLLKQYKSNV

SEQ ID NO: 3183981 - protein, 26 aa, Giardia lamblia
DLEQTKPIFSLLERNLNSGRKEDLMI

SEQ ID NO: 3183982 - protein, 23 aa, Giardia lamblia
DLFDWRGRRQPYSKLLTTQTKGA

SEQ ID NO: 3183983 - protein, 29 aa, Giardia lamblia
DLFGINYLFGGMDPVLCFSPAVSRPGAPF

SEQ ID NO: 3183984 - protein, 17 aa, Giardia lamblia
DLFPVAFADALNSVLYA

SEQ ID NO: 3183985 - protein, 28 aa, Giardia lamblia
DLFSLFNTVPMFGVWINTPLIQSILTDE

SEQ ID NO: 3183986 - protein, 29 aa, Giardia lamblia
DLGALLRLDFFCILARLLLNTELLSPEMT

SEQ ID NO: 3183987 - protein, 22 aa, Giardia lamblia
DLGHAPLHITALILSECLGLIK

SEQ ID NO: 3183988 - protein, 18 aa, Giardia lamblia
DLGLFYGTPTPADTQKLI

SEQ ID NO: 3183989 - protein, 19 aa, Giardia lamblia
DLGRLFLQAPEILDMQPNI

SEQ ID NO: 3183990 - protein, 36 aa, Giardia lamblia
DLGRREGFWCGEDRPLLWWNLLSRVVQDEGGGGTLY

SEQ ID NO: 3183991 - protein, 36 aa, Giardia lamblia
DLGRREGFWCGEDRPLLWWNLLSRVVQNEGGGGTLY

SEQ ID NO: 3183992 - protein, 25 aa, Giardia lamblia
DLHAEIDNYLRPGALDELETRREVI

SEQ ID NO: 3183993 - protein, 20 aa, Giardia lamblia
DLHAYLFNLTTLSLEYVISR

SEQ ID NO: 3183994 - protein, 35 aa, Giardia lamblia
DLIAVYSRLFYAKYRSLLIKKINPTLIMPGGRTYQ

SEQ ID NO: 3183995 - protein, 20 aa, Giardia lamblia
DLIFRWSTSITILPVFVPIA

SEQ ID NO: 3183996 - protein, 28 aa, Giardia lamblia
DLINALDPRITFPTVLEMRSAPEIVPHE

SEQ ID NO: 3183997 - protein, 24 aa, Giardia lamblia
DLISRLLYLRSLQALYINRRVEKT

SEQ ID NO: 3183998 - protein, 20 aa, Giardia lamblia
DLKARLLGRRDYTGDTALIY

SEQ ID NO: 3183999 - protein, 24 aa, Giardia lamblia
DLKPENILLTKNKLIKLSDFGLSN

SEQ ID NO: 3184000 - protein, 29 aa, Giardia lamblia
DLKRVCGTQYFRPYSFPVIERATALYKAG

SEQ ID NO: 3184001 - protein, 23 aa, Giardia lamblia
DLKRYLIVELYGRGNLILTDEAY

SEQ ID NO: 3184002 - protein, 31 aa, Giardia lamblia
DLKSGLIDYEAFLGLFAFKGDIPPEAERGTS

SEQ ID NO: 3184003 - protein, 21 aa, Giardia lamblia
DLKTQHFPVPMLPSELSKNPS

SEQ ID NO: 3184004 - protein, 31 aa, Giardia lamblia
DLKVALHAILPRNEYFLDYMAVTAKGIDALA

SEQ ID NO: 3184005 - protein, 18 aa, Giardia lamblia
DLLASYEAIKAKSSELAT

SEQ ID NO: 3184006 - protein, 20 aa, Giardia lamblia
DLLAYVRLARINNTTPCTKC

SEQ ID NO: 3184007 - protein, 25 aa, Giardia lamblia
DLLFEQYLLINIPKEDTRAKFNMMC

SEQ ID NO: 3184008 - protein, 20 aa, Giardia lamblia
DLLLKAKLYDEAASAVIDVT

SEQ ID NO: 3184009 - protein, 18 aa, Giardia lamblia
DLLLSKYQEKHKSFFVAL

SEQ ID NO: 3184010 - protein, 21 aa, Giardia lamblia
DLLPRFIARLDAHGEMARIVV

SEQ ID NO: 3184011 - protein, 21 aa, Giardia lamblia
DLLQLAFSYFYVDSSSISDLI

SEQ ID NO: 3184012 - protein, 20 aa, Giardia lamblia
DLLRLLLERYELLSQNGSCF

SEQ ID NO: 3184013 - protein, 17 aa, Giardia lamblia
DLLSEYKTKLLAANEHN

SEQ ID NO: 3184014 - protein, 25 aa, Giardia lamblia
DLLTDTRLLVITGSPDYAFCIFDNE

SEQ ID NO: 3184015 - protein, 22 aa, Giardia lamblia
DLLTLPSNLDLLARPLVLIQGG

SEQ ID NO: 3184016 - protein, 27 aa, Giardia lamblia
DLMDLTIDKLFPPPRAYRDKLWKAYSE

SEQ ID NO: 3184017 - protein, 20 aa, Giardia lamblia
DLMGRTALMYAAEAGQFEAA

SEQ ID NO: 3184018 - protein, 19 aa, Giardia lamblia
DLNDYLIANGLRAYLTDLS

SEQ ID NO: 3184019 - protein, 19 aa, Giardia lamblia
DLNPAALDPLLDTAPGLAD

SEQ ID NO: 3184020 - protein, 22 aa, Giardia lamblia
DLNVLLTAELILLCLPAVDAAT

SEQ ID NO: 3184021 - protein, 18 aa, Giardia lamblia
DLNVQLCFSLFHVYNIDS

SEQ ID NO: 3184022 - protein, 22 aa, Giardia lamblia
DLPGSIFLNAGAMTRIITGPTG

SEQ ID NO: 3184023 - protein, 19 aa, Giardia lamblia
DLPKLRCYKLRSASAYVSR

SEQ ID NO: 3184024 - protein, 18 aa, Giardia lamblia
DLPKWNINYYKGLGSSNT

SEQ ID NO: 3184025 - protein, 20 aa, Giardia lamblia
DLPKWRAVPDEQYAALKTNA

SEQ ID NO: 3184026 - protein, 17 aa, Giardia lamblia
DLPLVQRIRDSKAMHQQ

SEQ ID NO: 3184027 - protein, 23 aa, Giardia lamblia
DLPSDILMNLLPSGVMGRSGLDS

SEQ ID NO: 3184028 - protein, 27 aa, Giardia lamblia
DLQDTELLPLLRRIKPLKDFHPSKKEI

SEQ ID NO: 3184029 - protein, 36 aa, Giardia lamblia
DLQEISRLEFIPGYSADLFLLLTQMLAVDEAARISA

SEQ ID NO: 3184030 - protein, 24 aa, Giardia lamblia
DLQFSKRDFATKCQAALQAAMVDA

SEQ ID NO: 3184031 - protein, 24 aa, Giardia lamblia
DLQKDFRRDRLCLVRSRLCNYLNL

SEQ ID NO: 3184032 - protein, 24 aa, Giardia lamblia
DLQKLYDENPWLSSTAVSEGDILA

SEQ ID NO: 3184033 - protein, 29 aa, Giardia lamblia
DLQVDYLDLFLVHWPLAFVRNDVGDLFPK

SEQ ID NO: 3184034 - protein, 26 aa, Giardia lamblia
DLREALRNKILMRLGIVDSVEDYRRY

SEQ ID NO: 3184035 - protein, 24 aa, Giardia lamblia
DLREILPISFVKDVLALGTRVLAS

SEQ ID NO: 3184036 - protein, 21 aa, Giardia lamblia
DLREVVYLRGLRNLSVLWLCE

SEQ ID NO: 3184037 - protein, 23 aa, Giardia lamblia
DLRLCSLLEVLKQDILGCTARLS

SEQ ID NO: 3184038 - protein, 18 aa, Giardia lamblia
DLRLWALFETGKLCIYNI

SEQ ID NO: 3184039 - protein, 19 aa, Giardia lamblia
DLRPHFSLLARTLELLHGD

SEQ ID NO: 3184040 - protein, 19 aa, Giardia lamblia
DLRPVPLLNFVASHTTYFS

SEQ ID NO: 3184041 - protein, 34 aa, Giardia lamblia
DLRRGRMIRNALTHWRLICYKKRYMRVFEDAHDA

SEQ ID NO: 3184042 - protein, 21 aa, Giardia lamblia
DLRRQYDELVRKYAIQENRIN

SEQ ID NO: 3184043 - protein, 23 aa, Giardia lamblia
DLRTFRKTLLSPHKMMIINSVTL

SEQ ID NO: 3184044 - protein, 33 aa, Giardia lamblia
DLRVKDPFTYAFILKIAFLFSGGMTKVQQEKDK

SEQ ID NO: 3184045 - protein, 23 aa, Giardia lamblia
DLSEGWFPDILTRLVLDSVTPSL

SEQ ID NO: 3184046 - protein, 31 aa, Giardia lamblia
DLSKLHLEYARKFRSLLFLEGQLRANDVREQ

SEQ ID NO: 3184047 - protein, 18 aa, Giardia lamblia
DLSLFTTLAIRCTGSTSV

SEQ ID NO: 3184048 - protein, 19 aa, Giardia lamblia
DLSLKYAYRNPGTYSLCID

SEQ ID NO: 3184049 - protein, 31 aa, Giardia lamblia
DLSQARIIKLYWSIMRVLRTLYIGAGLVHGD

SEQ ID NO: 3184050 - protein, 26 aa, Giardia lamblia
DLSRHSWDLDVLYLAALEALRYIQKC

SEQ ID NO: 3184051 - protein, 18 aa, Giardia lamblia
DLSRLRADHIRTKRTQDG

SEQ ID NO: 3184052 - protein, 21 aa, Giardia lamblia
DLSSILLVDLLVQGVLPNECA

SEQ ID NO: 3184053 - protein, 19 aa, Giardia lamblia
DLSVVVKALYPLSSHLKKM

SEQ ID NO: 3184054 - protein, 26 aa, Giardia lamblia
DLTALFIKREVRFLEGMGATLALGIL

SEQ ID NO: 3184055 - protein, 25 aa, Giardia lamblia
DLTNTVFLSITRKFSTRLLAALLSH

SEQ ID NO: 3184056 - protein, 27 aa, Giardia lamblia
DLTRVRQIYNYGLIALGRMLSVEIRQA

SEQ ID NO: 3184057 - protein, 31 aa, Giardia lamblia
DLTRVSIINANFFLLSMLKAYRTEVMTRLEA

SEQ ID NO: 3184058 - protein, 24 aa, Giardia lamblia
DLVETLVASIPWWLNQSSCTAMSA

SEQ ID NO: 3184059 - protein, 17 aa, Giardia lamblia
DLVGYRTPVSETALCIY

SEQ ID NO: 3184060 - protein, 23 aa, Giardia lamblia
DLVNAMIDCLYAKAIPYVTDCVI

SEQ ID NO: 3184061 - protein, 22 aa, Giardia lamblia
DLVPVAAWMGTGKRTGVLGAYL

SEQ ID NO: 3184062 - protein, 20 aa, Giardia lamblia
DLVSTLTRKTPILTSKCMEK

SEQ ID NO: 3184063 - protein, 20 aa, Giardia lamblia
DLVVDPLLQLLRDCFKTDRG

SEQ ID NO: 3184064 - protein, 18 aa, Giardia lamblia
DLVYVRPGLITMGYPATS

SEQ ID NO: 3184065 - protein, 28 aa, Giardia lamblia
DLWSTGIILYAMLCGCLPFEGSTTQSLY

SEQ ID NO: 3184066 - protein, 18 aa, Giardia lamblia
DLYFKVVSLNLYDPTIDP

SEQ ID NO: 3184067 - protein, 17 aa, Giardia lamblia
DLYISWSTALQRCQLQS

SEQ ID NO: 3184068 - protein, 18 aa, Giardia lamblia
DLYQIYVGSHKGKGEVMD

SEQ ID NO: 3184069 - protein, 20 aa, Giardia lamblia
DLYRAICMLYLGQMGDAREL

SEQ ID NO: 3184070 - protein, 17 aa, Giardia lamblia
DLYYPTWTSQRSTDARE

SEQ ID NO: 3184071 - protein, 24 aa, Giardia lamblia
DMAIRLVRLKISVSMVLMPASSVS

SEQ ID NO: 3184072 - protein, 25 aa, Giardia lamblia
DMALNMYRHLLIKCPCCCACPACEA

SEQ ID NO: 3184073 - protein, 43 aa, Giardia lamblia
DMANDLVDWLFKRKYMPSIKIMRKSEMLYPWDPKPGEPVIRNK

SEQ ID NO: 3184074 - protein, 27 aa, Giardia lamblia
DMANRKIATLTRGLVPAAILSDKLRPT

SEQ ID NO: 3184075 - protein, 23 aa, Giardia lamblia
DMCQLIEPYIGSTPPVHSSTYSD

SEQ ID NO: 3184076 - protein, 25 aa, Giardia lamblia
DMELYLEYFVRPLPTTFRVSAAHKP

SEQ ID NO: 3184077 - protein, 22 aa, Giardia lamblia
DMEMIRILMPVEAKLTNKDGLT

SEQ ID NO: 3184078 - protein, 19 aa, Giardia lamblia
DMFHAKYPNTQLYAHGTYV

SEQ ID NO: 3184079 - protein, 24 aa, Giardia lamblia
DMGKTALILSIQNGYHACAQILLP

SEQ ID NO: 3184080 - protein, 22 aa, Giardia lamblia
DMGLLPQPKNQLPYSFYVDNSQ

SEQ ID NO: 3184081 - protein, 23 aa, Giardia lamblia
DMGPLVHRNIKPSKVFLAADGYC

SEQ ID NO: 3184082 - protein, 24 aa, Giardia lamblia
DMGPWCLRATLELRLLQIVLHGVH

SEQ ID NO: 3184083 - protein, 17 aa, Giardia lamblia
DMGYRPIFQVIRRGIRF

SEQ ID NO: 3184084 - protein, 20 aa, Giardia lamblia
DMHIVEDVPPFTAGMRAIDM

SEQ ID NO: 3184085 - protein, 18 aa, Giardia lamblia
DMHSLLSVPRFDCFENVS

SEQ ID NO: 3184086 - protein, 18 aa, Giardia lamblia
DMIDSDLLEYSKFGHLRG

SEQ ID NO: 3184087 - protein, 17 aa, Giardia lamblia
DMIFGQIVLRDPIFETT

SEQ ID NO: 3184088 - protein, 18 aa, Giardia lamblia
DMIKFTHRLLLHQHLLQS

SEQ ID NO: 3184089 - protein, 20 aa, Giardia lamblia
DMKEFFRKNVGIKLCKGYTN

SEQ ID NO: 3184090 - protein, 25 aa, Giardia lamblia
DMLAANGIFALRRVKRRNMERITLC

SEQ ID NO: 3184091 - protein, 18 aa, Giardia lamblia
DMLAGLLFALRRSSVALT

SEQ ID NO: 3184092 - protein, 20 aa, Giardia lamblia
DMLVVLWDLSTRAKLQTLVE

SEQ ID NO: 3184093 - protein, 29 aa, Giardia lamblia
DMNLHPDLLFGIFTYGYKIPSAIQSQAIV

SEQ ID NO: 3184094 - protein, 18 aa, Giardia lamblia
DMPIKPGAKVLYLGAASG

SEQ ID NO: 3184095 - protein, 19 aa, Giardia lamblia
DMQINLDSIIRAQIERRLS

SEQ ID NO: 3184096 - protein, 32 aa, Giardia lamblia
DMQKFTAFIPNLPALIKLLFAIKNEFELPTCV

SEQ ID NO: 3184097 - protein, 19 aa, Giardia lamblia
DMQTQKQERRISISAAADG

SEQ ID NO: 3184098 - protein, 28 aa, Giardia lamblia
DMRDELPCLWPLCVLCIIHRLSVPRAKL

SEQ ID NO: 3184099 - protein, 27 aa, Giardia lamblia
DMRHNGEYSLLLRIIRGQTSLTDRVAK

SEQ ID NO: 3184100 - protein, 32 aa, Giardia lamblia
DMRSQLLLRHYPPMLCIRLLLCRVQTILCTCS

SEQ ID NO: 3184101 - protein, 19 aa, Giardia lamblia
DMRYLFRVIQNSAGWMGID

SEQ ID NO: 3184102 - protein, 19 aa, Giardia lamblia
DMSILGRPIESVIILDNCA

SEQ ID NO: 3184103 - protein, 24 aa, Giardia lamblia
DMSQFCMKLQFLSKVKGPMLQTID

SEQ ID NO: 3184104 - protein, 18 aa, Giardia lamblia
DMTGPGPGAYATPEGTLK

SEQ ID NO: 3184105 - protein, 18 aa, Giardia lamblia
DMTLPYIEQPTSAPSLFQ

SEQ ID NO: 3184106 - protein, 18 aa, Giardia lamblia
DMTSEILHFMADPVIRVP

SEQ ID NO: 3184107 - protein, 18 aa, Giardia lamblia
DMVAKDKALLKSKAEIAG

SEQ ID NO: 3184108 - protein, 17 aa, Giardia lamblia
DMVLRKVSYSQFNIMLI

SEQ ID NO: 3184109 - protein, 24 aa, Giardia lamblia
DMVQSHLLQLLALTTMEAPIDMTA

SEQ ID NO: 3184110 - protein, 18 aa, Giardia lamblia
DMVYGARPLRRFIEREIT

SEQ ID NO: 3184111 - protein, 24 aa, Giardia lamblia
DNAKCSAVIQFTNLYNGICANANG

SEQ ID NO: 3184112 - protein, 31 aa, Giardia lamblia
DNCRAFFDSLMIPYRVVIIVSGALNNAAAMK

SEQ ID NO: 3184113 - protein, 33 aa, Giardia lamblia
DNDDFEFLSEFLLLISDLFFSPERITATQITGE

SEQ ID NO: 3184114 - protein, 26 aa, Giardia lamblia
DNEWTDVLPMARLLKIPAHMEQILSS

SEQ ID NO: 3184115 - protein, 20 aa, Giardia lamblia
DNFITRSLDLSLKYAYRNPG

SEQ ID NO: 3184116 - protein, 31 aa, Giardia lamblia
DNGVTLAESIAFPRLANLLPRSRTKDPRVCN

SEQ ID NO: 3184117 - protein, 19 aa, Giardia lamblia
DNGWTSLMLAAEMGNIRLV

SEQ ID NO: 3184118 - protein, 27 aa, Giardia lamblia
DNHGQTALMWVAGYSPIEAIKSVLERG

SEQ ID NO: 3184119 - protein, 22 aa, Giardia lamblia
DNIIASLQLLLQEKTDRTEAQH

SEQ ID NO: 3184120 - protein, 26 aa, Giardia lamblia
DNIKAKMIFNIDALLRFITVCINPKV

SEQ ID NO: 3184121 - protein, 25 aa, Giardia lamblia
DNKASLQQVSIPSSLPAAPLESGLM

SEQ ID NO: 3184122 - protein, 22 aa, Giardia lamblia
DNKGRSALMYAAELGNAVLAAL

SEQ ID NO: 3184123 - protein, 40 aa, Giardia lamblia
DNKIDIWSLGCVLYEILTFNPLFSGGNFFAIMNKIQKYES

SEQ ID NO: 3184124 - protein, 23 aa, Giardia lamblia
DNKPLLTELFGRVISRILTTDPL

SEQ ID NO: 3184125 - protein, 25 aa, Giardia lamblia
DNKVLLSYLCNPQTILRIIEVMCVD

SEQ ID NO: 3184126 - protein, 26 aa, Giardia lamblia
DNLCQTLNLFLRPPAEVLSKDLETPC

SEQ ID NO: 3184127 - protein, 20 aa, Giardia lamblia
DNLFRLTQILTFELVSRSLN

SEQ ID NO: 3184128 - protein, 18 aa, Giardia lamblia
DNLGLTALMLAVINKNVE

SEQ ID NO: 3184129 - protein, 30 aa, Giardia lamblia
DNLIRLTQENLYLRTRLEQSKVLLRDITNA

SEQ ID NO: 3184130 - protein, 26 aa, Giardia lamblia
DNLMRKLPRFPSFVGTLNYFQPMTEN

SEQ ID NO: 3184131 - protein, 19 aa, Giardia lamblia
DNLRMLLNASKHYGDAAPI

SEQ ID NO: 3184132 - protein, 17 aa, Giardia lamblia
DNLVLLLNSRNAEVERK

SEQ ID NO: 3184133 - protein, 23 aa, Giardia lamblia
DNMKIDLPWDRPASKAPIPSRTS

SEQ ID NO: 3184134 - protein, 24 aa, Giardia lamblia
DNMPKIHIYSLRHKARVAMINVPD

SEQ ID NO: 3184135 - protein, 17 aa, Giardia lamblia
DNMTALLFAIRGNKPDL

SEQ ID NO: 3184136 - protein, 24 aa, Giardia lamblia
DNNARFFILSQYTASIRKTSAPWR

SEQ ID NO: 3184137 - protein, 25 aa, Giardia lamblia
DNNERLFMLVQRASPIILSIYIDFH

SEQ ID NO: 3184138 - protein, 25 aa, Giardia lamblia
DNNGSYYLFPKLPSEQEYTIPKLII

SEQ ID NO: 3184139 - protein, 25 aa, Giardia lamblia
DNNMNAVLDTLLPYAGRRTDTGETA

SEQ ID NO: 3184140 - protein, 25 aa, Giardia lamblia
DNNSRPITVFVPTLMKTICSSNVSE

SEQ ID NO: 3184141 - protein, 23 aa, Giardia lamblia
DNNVRIELTRRLSRILYDMGVVD

SEQ ID NO: 3184142 - protein, 19 aa, Giardia lamblia
DNPEVCLCLLDLEGHILLK

SEQ ID NO: 3184143 - protein, 26 aa, Giardia lamblia
DNPGIQDPLLLKIYRERQAAAQNADN

SEQ ID NO: 3184144 - protein, 24 aa, Giardia lamblia
DNPLHEIFVLCPPITDSKRIPTVL

SEQ ID NO: 3184145 - protein, 27 aa, Giardia lamblia
DNRHLTPLDYFIYGEALISTLGTMYDK

SEQ ID NO: 3184146 - protein, 22 aa, Giardia lamblia
DNRIKFLMGCIAQSISFLSRPN

SEQ ID NO: 3184147 - protein, 23 aa, Giardia lamblia
DNRKHLYDILSCQSTILSHFVLF

SEQ ID NO: 3184148 - protein, 17 aa, Giardia lamblia
DNRLLGVFSTAIPVLNG

SEQ ID NO: 3184149 - protein, 22 aa, Giardia lamblia
DNRYTPLMLAALHNDIEAVWRY

SEQ ID NO: 3184150 - protein, 32 aa, Giardia lamblia
DNSAQIRLVPQLTPLLLASYSTGSLHLSETSA

SEQ ID NO: 3184151 - protein, 33 aa, Giardia lamblia
DNSDSIIEAWPAPTFFLTDLRIKHMQAIPVTTQ

SEQ ID NO: 3184152 - protein, 22 aa, Giardia lamblia
DNSGYTALMYAATKGYTACVEL

SEQ ID NO: 3184153 - protein, 22 aa, Giardia lamblia
DNSIELIPPLLALADVACLAGA

SEQ ID NO: 3184154 - protein, 17 aa, Giardia lamblia
DNSIIMRALASVKSPVG

SEQ ID NO: 3184155 - protein, 24 aa, Giardia lamblia
DNSTINPAILNGGLHLLVKSDQGT

SEQ ID NO: 3184156 - protein, 22 aa, Giardia lamblia
DNSVFDLLIYEEAGNMNNEGHS

SEQ ID NO: 3184157 - protein, 26 aa, Giardia lamblia
DNTARLLRQHPPGSSFRPLTTSLTSM

SEQ ID NO: 3184158 - protein, 21 aa, Giardia lamblia
DNTLELFKQENLRLVTALSDY

SEQ ID NO: 3184159 - protein, 18 aa, Giardia lamblia
DNVALSMRIFGHVLTICM

SEQ ID NO: 3184160 - protein, 24 aa, Giardia lamblia
DNVRSFQIAQIRRLLRGKAELLAG

SEQ ID NO: 3184161 - protein, 27 aa, Giardia lamblia
DNVTNLRPLWFIITKGPVATAVVYSIL

SEQ ID NO: 3184162 - protein, 21 aa, Giardia lamblia
DNWRDWFIGLNDNFLGKYPGY

SEQ ID NO: 3184163 - protein, 26 aa, Giardia lamblia
DPADLKLYDILITRLTALGRLEWANE

SEQ ID NO: 3184164 - protein, 46 aa, Giardia lamblia
DPAITALTFPSSGAFLFIGDAAGRIFIWNTVSLAFIQELMATSRSG

SEQ ID NO: 3184165 - protein, 18 aa, Giardia lamblia
DPAKLLDFDYRLSLFFEK

SEQ ID NO: 3184166 - protein, 22 aa, Giardia lamblia
DPALFPTKVLESNIPRGAWILY

SEQ ID NO: 3184167 - protein, 18 aa, Giardia lamblia
DPALSPHGSRSLTSPRVL

SEQ ID NO: 3184168 - protein, 26 aa, Giardia lamblia
DPARLRFRQHLPKQLAHYARDCWDCD

SEQ ID NO: 3184169 - protein, 30 aa, Giardia lamblia
DPASCPTLVLTYAGYWDCGERHHFGKYYYS

SEQ ID NO: 3184170 - protein, 24 aa, Giardia lamblia
DPATLIELVYNQFNSMAIDLRDSL

SEQ ID NO: 3184171 - protein, 19 aa, Giardia lamblia
DPAVLWTHYLPSDCLCFRI

SEQ ID NO: 3184172 - protein, 26 aa, Giardia lamblia
DPCGHLAVLQAVLQKLNHLTDRVDQL

SEQ ID NO: 3184173 - protein, 25 aa, Giardia lamblia
DPDAKAALIWIIGEYANRIEGSEEV

SEQ ID NO: 3184174 - protein, 19 aa, Giardia lamblia
DPDFENFRNTVLRLLANVQ

SEQ ID NO: 3184175 - protein, 28 aa, Giardia lamblia
DPDLSNIGFRLIFPKASIVECAQGGDRG

SEQ ID NO: 3184176 - protein, 35 aa, Giardia lamblia
DPDPLLPGDGMHFCIICDRYFISAEALETHKATGK

SEQ ID NO: 3184177 - protein, 26 aa, Giardia lamblia
DPDSGYIFLAGPFLLSVSERRRKEAE

SEQ ID NO: 3184178 - protein, 25 aa, Giardia lamblia
DPDSMHFTLHFIISSGLMVHAESIA

SEQ ID NO: 3184179 - protein, 24 aa, Giardia lamblia
DPELAPIFQRLVQKLGPQLSSMLG

SEQ ID NO: 3184180 - protein, 18 aa, Giardia lamblia
DPELLAYAQYQQHLLEKH

SEQ ID NO: 3184181 - protein, 26 aa, Giardia lamblia
DPESQLWISNLPITITVSTPSKVSIG

SEQ ID NO: 3184182 - protein, 26 aa, Giardia lamblia
DPETKALPPILIYIPTWATQSDTPDS

SEQ ID NO: 3184183 - protein, 25 aa, Giardia lamblia
DPEVQADLKHFPFKVICGPDEKPQI

SEQ ID NO: 3184184 - protein, 32 aa, Giardia lamblia
DPFIALRPVYQYFPLIMMMSATLFASYECTDT

SEQ ID NO: 3184185 - protein, 22 aa, Giardia lamblia
DPFNKRPPDTALPTLPSHIKQY

SEQ ID NO: 3184186 - protein, 19 aa, Giardia lamblia
DPFQALPEHGLDASLNASL

SEQ ID NO: 3184187 - protein, 23 aa, Giardia lamblia
DPFSYASLDIERRIREMKAQLEK

SEQ ID NO: 3184188 - protein, 20 aa, Giardia lamblia
DPGCTPEDHLEAEELVIINV

SEQ ID NO: 3184189 - protein, 30 aa, Giardia lamblia
DPGEIWPRYDAGYADYLRYMGKGMGPWDGN

SEQ ID NO: 3184190 - protein, 34 aa, Giardia lamblia
DPGELENFPNFRLFQTIFLGHTNLAYSSFPFTIE

SEQ ID NO: 3184191 - protein, 30 aa, Giardia lamblia
DPGKSYPFGYLWRFSYKVIPSYLADKSEAD

SEQ ID NO: 3184192 - protein, 39 aa, Giardia lamblia
DPGKYFPIDEGYLQRLQYEISAIRRYMNLNISARDAELA

SEQ ID NO: 3184193 - protein, 22 aa, Giardia lamblia
DPGLAILIPTLLANATELIGVV

SEQ ID NO: 3184194 - protein, 17 aa, Giardia lamblia
DPGYLALDTGTCSHVKC

SEQ ID NO: 3184195 - protein, 17 aa, Giardia lamblia
DPHFLKYLKQKSNPKIT

SEQ ID NO: 3184196 - protein, 24 aa, Giardia lamblia
DPHPQFPIGLLQKTLKLTNDPASG

SEQ ID NO: 3184197 - protein, 21 aa, Giardia lamblia
DPILERCYVPTVDSAYLKLTD

SEQ ID NO: 3184198 - protein, 19 aa, Giardia lamblia
DPILRKYGLNKNVLLALES

SEQ ID NO: 3184199 - protein, 17 aa, Giardia lamblia
DPINRLMEFDQVSLIKL

SEQ ID NO: 3184200 - protein, 25 aa, Giardia lamblia
DPKIPLTPEIFLDTKPYKPVVVEFV

SEQ ID NO: 3184201 - protein, 22 aa, Giardia lamblia
DPKPPVPSFAPLPRPCQCCIHE

SEQ ID NO: 3184202 - protein, 26 aa, Giardia lamblia
DPKTTEYIQYLAHKYPNIEKAYRDFC

SEQ ID NO: 3184203 - protein, 17 aa, Giardia lamblia
DPLDSILAIPAYDPFSG

SEQ ID NO: 3184204 - protein, 18 aa, Giardia lamblia
DPLKIAYVADRKYKMLLW

SEQ ID NO: 3184205 - protein, 28 aa, Giardia lamblia
DPLTKADDQLRFLLFQNELTSERVDLEY

SEQ ID NO: 3184206 - protein, 25 aa, Giardia lamblia
DPLVLARRELANNAIPIIIRRHLPD

SEQ ID NO: 3184207 - protein, 22 aa, Giardia lamblia
DPNVLALNAAINLAEERAKRAE

SEQ ID NO: 3184208 - protein, 24 aa, Giardia lamblia
DPPHILHFAALANGSLLLAVTGLK

SEQ ID NO: 3184209 - protein, 25 aa, Giardia lamblia
DPPIKVRVLYESRYNNHYPPTELTR

SEQ ID NO: 3184210 - protein, 35 aa, Giardia lamblia
DPQGAIFYLAFLLRTAVDPLYIARRLIISASEDIG

SEQ ID NO: 3184211 - protein, 23 aa, Giardia lamblia
DPQIRLFLLTTRVGGLGLNLTAA

SEQ ID NO: 3184212 - protein, 32 aa, Giardia lamblia
DPQLMLSPWKRYSSLIINWACFEVRHIAALRG

SEQ ID NO: 3184213 - protein, 20 aa, Giardia lamblia
DPQRMLVYELLDRKLANRHG

SEQ ID NO: 3184214 - protein, 23 aa, Giardia lamblia
DPQVLQLWDLLVTNKIYNCLGTS

SEQ ID NO: 3184215 - protein, 23 aa, Giardia lamblia
DPRAMHCKLEVPDAIRKEIFAQI

SEQ ID NO: 3184216 - protein, 30 aa, Giardia lamblia
DPRCQYAIPLREDILYVLRKCCIGEDSDKM

SEQ ID NO: 3184217 - protein, 26 aa, Giardia lamblia
DPRSEENWLPLDGLHPRYIDDYCKRN

SEQ ID NO: 3184218 - protein, 23 aa, Giardia lamblia
DPRTMLSIFQKQKQYPALKVMNV

SEQ ID NO: 3184219 - protein, 29 aa, Giardia lamblia
DPRTRPDWREIFNYPWIASRVALVDEAGH

SEQ ID NO: 3184220 - protein, 24 aa, Giardia lamblia
DPSDPLWINRDRFVLSNGHASPLI

SEQ ID NO: 3184221 - protein, 21 aa, Giardia lamblia
DPSHFFLRFINDSDAVVQKNK

SEQ ID NO: 3184222 - protein, 23 aa, Giardia lamblia
DPSIFRTSFYLIIVSSIAERFTR

SEQ ID NO: 3184223 - protein, 18 aa, Giardia lamblia
DPSIPHYLYVMPYERLHK

SEQ ID NO: 3184224 - protein, 28 aa, Giardia lamblia
DPSMGIYGMDFYVVLSRPGFRVNKRRAQ

SEQ ID NO: 3184225 - protein, 28 aa, Giardia lamblia
DPSPGIFNYLNYVNLLKSRELPILPHFD

SEQ ID NO: 3184226 - protein, 33 aa, Giardia lamblia
DPSPLHVPFGERFLSLFDPNSPYLLHPGDKYAA

SEQ ID NO: 3184227 - protein, 26 aa, Giardia lamblia
DPSVNVFVWSRGIRHVPRRIRLEVRL

SEQ ID NO: 3184228 - protein, 26 aa, Giardia lamblia
DPTGLYQVLLDRYLSIGGSPNAVKVC

SEQ ID NO: 3184229 - protein, 24 aa, Giardia lamblia
DPTGYNGMLLLDLKCPVPMESSKG

SEQ ID NO: 3184230 - protein, 21 aa, Giardia lamblia
DPTLIVPRQYTPKTDAKGRPL

SEQ ID NO: 3184231 - protein, 23 aa, Giardia lamblia
DPTLSLQDLLFDGSLQTSKSGTK

SEQ ID NO: 3184232 - protein, 34 aa, Giardia lamblia
DPTPELLDPPYDPNYLLFQARIYAIRYDYRVQGV

SEQ ID NO: 3184233 - protein, 17 aa, Giardia lamblia
DPTRPRTPPRLRTPSGL

SEQ ID NO: 3184234 - protein, 18 aa, Giardia lamblia
DPTYLMETFFSPGTTSDI

SEQ ID NO: 3184235 - protein, 22 aa, Giardia lamblia
DPVITIPGGIAYINELIQAAIE

SEQ ID NO: 3184236 - protein, 24 aa, Giardia lamblia
DPVSKTQIFPPRTEFFATELSPSS

SEQ ID NO: 3184237 - protein, 26 aa, Giardia lamblia
DPVVFQLYGLLPPPYTEDMVPDLLVP

SEQ ID NO: 3184238 - protein, 18 aa, Giardia lamblia
DPWNALFFCSTPAIKRHD

SEQ ID NO: 3184239 - protein, 30 aa, Giardia lamblia
DPWPKYGAKLPLSLSLFRLRSFVINFRTKQ

SEQ ID NO: 3184240 - protein, 24 aa, Giardia lamblia
DPYGGWTPNPHSKLLEICKRHYAD

SEQ ID NO: 3184241 - protein, 28 aa, Giardia lamblia
DPYKPKYEAVRWLEALLEQLGINESEYT

SEQ ID NO: 3184242 - protein, 22 aa, Giardia lamblia
DPYLLREYLRVNSKRLQQSTPL

SEQ ID NO: 3184243 - protein, 21 aa, Giardia lamblia
DPYTGLRMAYKSMIIVRDLNF

SEQ ID NO: 3184244 - protein, 26 aa, Giardia lamblia
DQAKNFTTIFQLLGISAWCVHASMPQ

SEQ ID NO: 3184245 - protein, 20 aa, Giardia lamblia
DQDKMQWLRTAWESFVVDGA

SEQ ID NO: 3184246 - protein, 23 aa, Giardia lamblia
DQDMVHLGFYKFLSTTHCISTNV

SEQ ID NO: 3184247 - protein, 23 aa, Giardia lamblia
DQDRPYILSYYPDTREIDMYEVA

SEQ ID NO: 3184248 - protein, 24 aa, Giardia lamblia
DQEIAILRRLVETNWFMKDLDEKL

SEQ ID NO: 3184249 - protein, 32 aa, Giardia lamblia
DQELPVLNRALMRIMRWLNTLVLKNRLAEDHD

SEQ ID NO: 3184250 - protein, 24 aa, Giardia lamblia
DQGHTALYYALKGGSLEIAKILIP

SEQ ID NO: 3184251 - protein, 24 aa, Giardia lamblia
DQGTSALFLQFYDKEIKGAMQNQE

SEQ ID NO: 3184252 - protein, 23 aa, Giardia lamblia
DQHHPFLLCFHGINNVTGTYWAK

SEQ ID NO: 3184253 - protein, 25 aa, Giardia lamblia
DQHRSRLFLVTEFWDNKTLADLTSA

SEQ ID NO: 3184254 - protein, 25 aa, Giardia lamblia
DQHVHTQIFNFLKKAKFVPTEEIIR

SEQ ID NO: 3184255 - protein, 18 aa, Giardia lamblia
DQIEKTIREFERPGDLFL

SEQ ID NO: 3184256 - protein, 25 aa, Giardia lamblia
DQIESSIDFFRWKKYGHKPQTDTRL

SEQ ID NO: 3184257 - protein, 23 aa, Giardia lamblia
DQIGSFLLKLFLERPPQERTYRE

SEQ ID NO: 3184258 - protein, 23 aa, Giardia lamblia
DQISRAMLAPHKTSLNLLSFEAA

SEQ ID NO: 3184259 - protein, 19 aa, Giardia lamblia
DQITRIHAILGTPPKELIQ

SEQ ID NO: 3184260 - protein, 38 aa, Giardia lamblia
DQIVKLLYDREAELSGWTPLFLAAYNVDFGALNTAFSS

SEQ ID NO: 3184261 - protein, 23 aa, Giardia lamblia
DQKNIVLYGFKTSFGGGHTVGFC

SEQ ID NO: 3184262 - protein, 17 aa, Giardia lamblia
DQKNTAYLIDFFGTVPS

SEQ ID NO: 3184263 - protein, 30 aa, Giardia lamblia
DQLHDDIYLMLNTIPWKSSFVRVMPYISNY

SEQ ID NO: 3184264 - protein, 18 aa, Giardia lamblia
DQLIPWESGLVSNNGWTA

SEQ ID NO: 3184265 - protein, 19 aa, Giardia lamblia
DQLLYEKQLLKTELNSYRG

SEQ ID NO: 3184266 - protein, 28 aa, Giardia lamblia
DQLVQTARLCHWLLSQLGISVQGVSEFD

SEQ ID NO: 3184267 - protein, 17 aa, Giardia lamblia
DQLYIDYEQLMDKLGED

SEQ ID NO: 3184268 - protein, 19 aa, Giardia lamblia
DQMCGCRIYQKLFPLLIDE

SEQ ID NO: 3184269 - protein, 23 aa, Giardia lamblia
DQNCVFLVMEYITGGSLRDEINF

SEQ ID NO: 3184270 - protein, 25 aa, Giardia lamblia
DQNFDKFIYTVYAPVSIVSEGASST

SEQ ID NO: 3184271 - protein, 25 aa, Giardia lamblia
DQPAKDPLKLLSKEQLRDVLCENID

SEQ ID NO: 3184272 - protein, 29 aa, Giardia lamblia
DQPETLIHPIPLQFLNGLVSKSIRQAQQK

SEQ ID NO: 3184273 - protein, 25 aa, Giardia lamblia
DQQEKLGFLLTINAPITGTTFKSNL

SEQ ID NO: 3184274 - protein, 17 aa, Giardia lamblia
DQQMSAWKLEMTDYLLT

SEQ ID NO: 3184275 - protein, 20 aa, Giardia lamblia
DQQQLIYEIAKLLKDQQSTA

SEQ ID NO: 3184276 - protein, 17 aa, Giardia lamblia
DQRCINAILSCIINPEL

SEQ ID NO: 3184277 - protein, 17 aa, Giardia lamblia
DQRRHYNTLFYYDLVNG

SEQ ID NO: 3184278 - protein, 23 aa, Giardia lamblia
DQSTDIIMDLPCPTSSVPAKPCP

SEQ ID NO: 3184279 - protein, 23 aa, Giardia lamblia
DQTALILAHHWLCDPGQAAAYIC

SEQ ID NO: 3184280 - protein, 22 aa, Giardia lamblia
DQTFYSIKILDPSTTTLISLAA

SEQ ID NO: 3184281 - protein, 39 aa, Giardia lamblia
DQTLLSIGRYQWPFNVHAFIPLKLLPGFDFVTAINRADF

SEQ ID NO: 3184282 - protein, 26 aa, Giardia lamblia
DQVVSPLSILQALLRHYCRNNATTKY

SEQ ID NO: 3184283 - protein, 23 aa, Giardia lamblia
DQYILNKLQPVCNILGLTRKLYT

SEQ ID NO: 3184284 - protein, 33 aa, Giardia lamblia
DRACNWACALFEKYFILTIEKILSDFPVNAKDK

SEQ ID NO: 3184285 - protein, 19 aa, Giardia lamblia
DRAIETRGPYLLKKTTAEK

SEQ ID NO: 3184286 - protein, 25 aa, Giardia lamblia
DRAIHLLYDIYIGEILELSLNNGLL

SEQ ID NO: 3184287 - protein, 26 aa, Giardia lamblia
DRCQRDIMLFIDTFSGEHVPRLRRQS

SEQ ID NO: 3184288 - protein, 26 aa, Giardia lamblia
DRDDSPSIWSIYESSLRKTQIHLPLG

SEQ ID NO: 3184289 - protein, 26 aa, Giardia lamblia
DRDIVNRMLLIYETVAFHLSRRILEA

SEQ ID NO: 3184290 - protein, 21 aa, Giardia lamblia
DRDWWWLGPGCLSWHAGQRGV

SEQ ID NO: 3184291 - protein, 30 aa, Giardia lamblia
DREAGIQDSFLWTALFYAAQNGHLVCVSML

SEQ ID NO: 3184292 - protein, 27 aa, Giardia lamblia
DRELTLLLPVRPKGKRHISMEPIVLVF

SEQ ID NO: 3184293 - protein, 35 aa, Giardia lamblia
DRENFQEHPILRFYLRVLTFYEGRYSFTLKWSCSL

SEQ ID NO: 3184294 - protein, 22 aa, Giardia lamblia
DRFCECFLTPKNVKTLYPNVWS

SEQ ID NO: 3184295 - protein, 18 aa, Giardia lamblia
DRFIDRALTWVDACNKVP

SEQ ID NO: 3184296 - protein, 25 aa, Giardia lamblia
DRFIQGMSRLKADFSLTAGAPMPQA

SEQ ID NO: 3184297 - protein, 19 aa, Giardia lamblia
DRFLDALLTRKAEKPVTDS

SEQ ID NO: 3184298 - protein, 31 aa, Giardia lamblia
DRFTKQVVFLEGFIPLLQQSRQRFLQADHFF

SEQ ID NO: 3184299 - protein, 26 aa, Giardia lamblia
DRFTYPTLYRHTGVPYPSLIMPLSTN

SEQ ID NO: 3184300 - protein, 28 aa, Giardia lamblia
DRGSFSIEIFIVLLAIKIARPDAVHLLR

SEQ ID NO: 3184301 - protein, 19 aa, Giardia lamblia
DRGYLLPSYSGFDGIRDSL

SEQ ID NO: 3184302 - protein, 22 aa, Giardia lamblia
DRGYQSVECLLLMLVCKIKRPN

SEQ ID NO: 3184303 - protein, 23 aa, Giardia lamblia
DRHFIALSCKPLTRLTGHAKPVN

SEQ ID NO: 3184304 - protein, 24 aa, Giardia lamblia
DRIANRKMYVLFEEQLKCNTKTDH

SEQ ID NO: 3184305 - protein, 18 aa, Giardia lamblia
DRIDPAFNSYIEAPVRPG

SEQ ID NO: 3184306 - protein, 17 aa, Giardia lamblia
DRIKYDMMAAHYSKLCI

SEQ ID NO: 3184307 - protein, 20 aa, Giardia lamblia
DRINYVRFLAHFRCINRGNA

SEQ ID NO: 3184308 - protein, 25 aa, Giardia lamblia
DRKEREFITPRALLATIRISQAIAK

SEQ ID NO: 3184309 - protein, 20 aa, Giardia lamblia
DRLHHDPLELLPLVSTYCSL

SEQ ID NO: 3184310 - protein, 22 aa, Giardia lamblia
DRLKLKPMSTLALAKNSLALLK

SEQ ID NO: 3184311 - protein, 22 aa, Giardia lamblia
DRLLSFLHQNAILHRVVASHRV

SEQ ID NO: 3184312 - protein, 26 aa, Giardia lamblia
DRLQSYLLAIIVPNFTELRAVLSATP

SEQ ID NO: 3184313 - protein, 18 aa, Giardia lamblia
DRLVRLQSKIEQNRLTKI

SEQ ID NO: 3184314 - protein, 23 aa, Giardia lamblia
DRMKREMELVMQARVDNSAELRE

SEQ ID NO: 3184315 - protein, 17 aa, Giardia lamblia
DRMSKMPMRELFDRSHQ

SEQ ID NO: 3184316 - protein, 27 aa, Giardia lamblia
DRMTLRNIMLLLRDTLTTVYLNRTRIP

SEQ ID NO: 3184317 - protein, 19 aa, Giardia lamblia
DRMVRITSLMFDKALKCKF

SEQ ID NO: 3184318 - protein, 22 aa, Giardia lamblia
DRNKLKYMRRALFKAREEASTK

SEQ ID NO: 3184319 - protein, 17 aa, Giardia lamblia
DRPIPTTMIFDTQVKRI

SEQ ID NO: 3184320 - protein, 24 aa, Giardia lamblia
DRPSNMFYPSRALSGAEYHAYDMN

SEQ ID NO: 3184321 - protein, 21 aa, Giardia lamblia
DRQLFTVTLRLQRRGLGAPAC

SEQ ID NO: 3184322 - protein, 24 aa, Giardia lamblia
DRQSQFHVPPNPNLIYQGTPAPEL

SEQ ID NO: 3184323 - protein, 18 aa, Giardia lamblia
DRQYVPIAVPTRGSPSPP

SEQ ID NO: 3184324 - protein, 25 aa, Giardia lamblia
DRRHGLGRVIFPNGDVFIGTFSSDY

SEQ ID NO: 3184325 - protein, 25 aa, Giardia lamblia
DRRNLYYRIMYVGPNSSKIALLLDY

SEQ ID NO: 3184326 - protein, 19 aa, Giardia lamblia
DRRSFLLCKILAGSVAVDQ

SEQ ID NO: 3184327 - protein, 27 aa, Giardia lamblia
DRRTAYYQILLGLEYLHRNHISHFDLK

SEQ ID NO: 3184328 - protein, 24 aa, Giardia lamblia
DRSIHARIKLSGLTRMIVLNSSQS

SEQ ID NO: 3184329 - protein, 23 aa, Giardia lamblia
DRSILESFPSFYEKFEPVIRSFD

SEQ ID NO: 3184330 - protein, 23 aa, Giardia lamblia
DRSIRFSMQCTHKHFVNVLKRRS

SEQ ID NO: 3184331 - protein, 25 aa, Giardia lamblia
DRSMQRVRLIIQKLSLVRNLSEKQI

SEQ ID NO: 3184332 - protein, 17 aa, Giardia lamblia
DRSQAVTILTRLYARLK

SEQ ID NO: 3184333 - protein, 17 aa, Giardia lamblia
DRTALPRHSLQPGQSHF

SEQ ID NO: 3184334 - protein, 26 aa, Giardia lamblia
DRTATLLSLMFLAYGLNKFTSDILPR

SEQ ID NO: 3184335 - protein, 23 aa, Giardia lamblia
DRTIVDNAIFAPGPGLTSHNDFV

SEQ ID NO: 3184336 - protein, 20 aa, Giardia lamblia
DRTLLAFRSFTYSSLPINVG

SEQ ID NO: 3184337 - protein, 22 aa, Giardia lamblia
DRTVRLWDGVTGKHISIFRNHV

SEQ ID NO: 3184338 - protein, 17 aa, Giardia lamblia
DRVFKQILDDYYEHGYI

SEQ ID NO: 3184339 - protein, 27 aa, Giardia lamblia
DRVGQFFHRISKPRKWQISDGSFVDVM

SEQ ID NO: 3184340 - protein, 30 aa, Giardia lamblia
DRVTIEELITYPWIQKNWALNHDGRSEPIL

SEQ ID NO: 3184341 - protein, 22 aa, Giardia lamblia
DRVVMRFFAWFMEDVFESQSEK

SEQ ID NO: 3184342 - protein, 21 aa, Giardia lamblia
DRVVSICRPRRLLYLAVDGPA

SEQ ID NO: 3184343 - protein, 19 aa, Giardia lamblia
DRYKYRYAVLAEKYSKMRE

SEQ ID NO: 3184344 - protein, 26 aa, Giardia lamblia
DRYLANLIILRQLSFCYLPSDLKHEH

SEQ ID NO: 3184345 - protein, 29 aa, Giardia lamblia
DSAKNLNWSFLAQPTLALAASGLPKSVQP

SEQ ID NO: 3184346 - protein, 23 aa, Giardia lamblia
DSAKSYVLALKPSAPQDLSQKFP

SEQ ID NO: 3184347 - protein, 28 aa, Giardia lamblia
DSALKFATIPRIPDMRQRPHRLNTDVSD

SEQ ID NO: 3184348 - protein, 28 aa, Giardia lamblia
DSALNDHHLLLKLPFSYTIESMIERIGD

SEQ ID NO: 3184349 - protein, 23 aa, Giardia lamblia
DSALYARRRVTSTSALITPSHDL

SEQ ID NO: 3184350 - protein, 18 aa, Giardia lamblia
DSALYLSAGSLPPTQSMR

SEQ ID NO: 3184351 - protein, 18 aa, Giardia lamblia
DSAPILCIVTNRSNPQKP

SEQ ID NO: 3184352 - protein, 22 aa, Giardia lamblia
DSAPPIHPKLLGLLTLGHEVLT

SEQ ID NO: 3184353 - protein, 24 aa, Giardia lamblia
DSARKLVYLWANECTRVLPDKFTT

SEQ ID NO: 3184354 - protein, 17 aa, Giardia lamblia
DSASFRMLEPRSGFSTV

SEQ ID NO: 3184355 - protein, 29 aa, Giardia lamblia
DSASVHSLKLVFLPPAAVPVSFCEDEQLI

SEQ ID NO: 3184356 - protein, 25 aa, Giardia lamblia
DSAVQTDLLLPPSADFHDTIDRLAS

SEQ ID NO: 3184357 - protein, 25 aa, Giardia lamblia
DSCGPTVVVIYLGPSQAYSCIIFVD

SEQ ID NO: 3184358 - protein, 24 aa, Giardia lamblia
DSCIERLVALLYVSPNTLYPQLVQ

SEQ ID NO: 3184359 - protein, 22 aa, Giardia lamblia
DSDDLYVFALDSITPYSYDYQG

SEQ ID NO: 3184360 - protein, 23 aa, Giardia lamblia
DSDHVMYVWIDALAIYLTAADST

SEQ ID NO: 3184361 - protein, 31 aa, Giardia lamblia
DSDKMDYLSWREIFTTLLSMKFVDYREEITQ

SEQ ID NO: 3184362 - protein, 25 aa, Giardia lamblia
DSDRVAYRLVGEVLIKETVKEVKPY

SEQ ID NO: 3184363 - protein, 17 aa, Giardia lamblia
DSDWYQRRLVVKQSLDL

SEQ ID NO: 3184364 - protein, 17 aa, Giardia lamblia
DSEELRKLLDRASLEAF

SEQ ID NO: 3184365 - protein, 29 aa, Giardia lamblia
DSEFIRKQGYFALLIDVFCRTIIDDLDNP

SEQ ID NO: 3184366 - protein, 22 aa, Giardia lamblia
DSEIVDFHFLSDDYQLMALVEI

SEQ ID NO: 3184367 - protein, 43 aa, Giardia lamblia
DSEMFDHHLLIYQWILLLYYNLLDVYLPIPLGYTTGGPVKKYP

SEQ ID NO: 3184368 - protein, 22 aa, Giardia lamblia
DSETAFVFKITNLPGPESNYFL

SEQ ID NO: 3184369 - protein, 33 aa, Giardia lamblia
DSEYVFNFIQKQILRLPRYLKIASDLSSQMGQP

SEQ ID NO: 3184370 - protein, 24 aa, Giardia lamblia
DSFAEKFNRLLARISKSRSNSPEY

SEQ ID NO: 3184371 - protein, 19 aa, Giardia lamblia
DSFCAFFEISIGDPVLTVA

SEQ ID NO: 3184372 - protein, 20 aa, Giardia lamblia
DSFDDVIYLASGIAPRIHRL

SEQ ID NO: 3184373 - protein, 19 aa, Giardia lamblia
DSFLGDIRHLPNSSPVPDV

SEQ ID NO: 3184374 - protein, 20 aa, Giardia lamblia
DSFLIKAAAEKGDKVELALA

SEQ ID NO: 3184375 - protein, 23 aa, Giardia lamblia
DSFPLYVDSLPTNSNLSNSLLTT

SEQ ID NO: 3184376 - protein, 33 aa, Giardia lamblia
DSFPRFCKDVMNYLHLILSNPVFLQFSPSVQAC

SEQ ID NO: 3184377 - protein, 31 aa, Giardia lamblia
DSFSVHLVMDYLGLLSGFRCLDLVTPLQCCY

SEQ ID NO: 3184378 - protein, 20 aa, Giardia lamblia
DSGIPLRYLSTMVGVGLSYN

SEQ ID NO: 3184379 - protein, 32 aa, Giardia lamblia
DSGRFQANIAFITRLRAAILNAAEVQQAVKNG

SEQ ID NO: 3184380 - protein, 18 aa, Giardia lamblia
DSGRRPRYNARDAVWFML

SEQ ID NO: 3184381 - protein, 27 aa, Giardia lamblia
DSGSIPSVLFPYIRYSGGGYRASESAA

SEQ ID NO: 3184382 - protein, 26 aa, Giardia lamblia
DSGVSYTFQLSYPGSFVLCQNGNRAF

SEQ ID NO: 3184383 - protein, 23 aa, Giardia lamblia
DSHPVYIYRIKRDKLKTMELVDM

SEQ ID NO: 3184384 - protein, 20 aa, Giardia lamblia
DSHRMLYTTLLTTPDVFQVF

SEQ ID NO: 3184385 - protein, 22 aa, Giardia lamblia
DSIDVVIVVIPSKAVLAAAKEC

SEQ ID NO: 3184386 - protein, 19 aa, Giardia lamblia
DSIHSYDGTTYCEISCWGA

SEQ ID NO: 3184387 - protein, 26 aa, Giardia lamblia
DSILAIPAYDPFSGGYSLLSYPGPYL

SEQ ID NO: 3184388 - protein, 25 aa, Giardia lamblia
DSILASIEWLGHKPFKFTHTSDYFQ

SEQ ID NO: 3184389 - protein, 25 aa, Giardia lamblia
DSILKDLFPELPPIYLKAVTADKAD

SEQ ID NO: 3184390 - protein, 27 aa, Giardia lamblia
DSISIDRYSLTALPLLKSSDPAVIKLS

SEQ ID NO: 3184391 - protein, 27 aa, Giardia lamblia
DSIVKTFDIWGTPLPEKRTIDFTGKPI

SEQ ID NO: 3184392 - protein, 19 aa, Giardia lamblia
DSIYFLECKKYTRLILESS

SEQ ID NO: 3184393 - protein, 24 aa, Giardia lamblia
DSIYQVLHMISILHALNLPFSYDT

SEQ ID NO: 3184394 - protein, 24 aa, Giardia lamblia
DSKALKVMQLTLASQERQLKANDE

SEQ ID NO: 3184395 - protein, 25 aa, Giardia lamblia
DSKGWTALIWAAFHNKPRAVELLMA

SEQ ID NO: 3184396 - protein, 33 aa, Giardia lamblia
DSKLLNKYIDRLAILSYYHQLYKELFAAREKCK

SEQ ID NO: 3184397 - protein, 18 aa, Giardia lamblia
DSKNGILLSLYGYNSNIY

SEQ ID NO: 3184398 - protein, 32 aa, Giardia lamblia
DSKRYDRWYLSIRWLMYSFMCPCLVSRDCISN

SEQ ID NO: 3184399 - protein, 20 aa, Giardia lamblia
DSLCYEIIIYFSIVGHQMTG

SEQ ID NO: 3184400 - protein, 17 aa, Giardia lamblia
DSLFTDAMLMCLQFDDN

SEQ ID NO: 3184401 - protein, 17 aa, Giardia lamblia
DSLFWNCTRMKLHINAV

SEQ ID NO: 3184402 - protein, 24 aa, Giardia lamblia
DSLGKILHPNLYASLVCKLVHVSE

SEQ ID NO: 3184403 - protein, 21 aa, Giardia lamblia
DSLGPYLAPITFTIGLCTERY

SEQ ID NO: 3184404 - protein, 20 aa, Giardia lamblia
DSLKRLTIVLFSYLCENISD

SEQ ID NO: 3184405 - protein, 25 aa, Giardia lamblia
DSLNVHVILGRNGWIWISEMRNPSD

SEQ ID NO: 3184406 - protein, 24 aa, Giardia lamblia
DSLRTELAYFRAVKASATTGDLAT

SEQ ID NO: 3184407 - protein, 26 aa, Giardia lamblia
DSLSSSLPIVPRPPVAAAVAAISVRA

SEQ ID NO: 3184408 - protein, 22 aa, Giardia lamblia
DSLVYCFYISMVNVVYYVEVAL

SEQ ID NO: 3184409 - protein, 17 aa, Giardia lamblia
DSMPVMPEMDLATILEA

SEQ ID NO: 3184410 - protein, 25 aa, Giardia lamblia
DSMYQYSLQWYVSLFVQAIADAEQA

SEQ ID NO: 3184411 - protein, 23 aa, Giardia lamblia
DSNELLLSLHAYGEQLATVIQVI

SEQ ID NO: 3184412 - protein, 17 aa, Giardia lamblia
DSNILFCSSVTGLIRIY

SEQ ID NO: 3184413 - protein, 24 aa, Giardia lamblia
DSNIPMVELLLPQEKRLQAYDGQT

SEQ ID NO: 3184414 - protein, 28 aa, Giardia lamblia
DSNPITIPLKQWKITLYGQVPISPIPEP

SEQ ID NO: 3184415 - protein, 18 aa, Giardia lamblia
DSNRFLLRVPQTLDLTPD

SEQ ID NO: 3184416 - protein, 23 aa, Giardia lamblia
DSNSWLALLYQKLKVESGSAAYS

SEQ ID NO: 3184417 - protein, 26 aa, Giardia lamblia
DSNTPTFSLSSIKGLPLSSVCAAGGD

SEQ ID NO: 3184418 - protein, 17 aa, Giardia lamblia
DSPDRLPTPPAGPYDTW

SEQ ID NO: 3184419 - protein, 25 aa, Giardia lamblia
DSPKKLIVFFMTCSMSQYMSFAFTH

SEQ ID NO: 3184420 - protein, 24 aa, Giardia lamblia
DSPQGFLFFSSLGGGTGSGLGSKL

SEQ ID NO: 3184421 - protein, 22 aa, Giardia lamblia
DSPRHILHAYVLFLERLAASGC

SEQ ID NO: 3184422 - protein, 28 aa, Giardia lamblia
DSQERYLALSFAVAELWSQWIDPKTHNG

SEQ ID NO: 3184423 - protein, 25 aa, Giardia lamblia
DSQISILFVAPDRLPKWADAASRCP

SEQ ID NO: 3184424 - protein, 31 aa, Giardia lamblia
DSQKHAIDPLLWQEYVKQLEFLTTSIKLSSE

SEQ ID NO: 3184425 - protein, 23 aa, Giardia lamblia
DSQSALIYATIRDNPEALSYLSE

SEQ ID NO: 3184426 - protein, 22 aa, Giardia lamblia
DSRAFLPSYISIVDPLQVINNL

SEQ ID NO: 3184427 - protein, 18 aa, Giardia lamblia
DSRFRELLSGSGRPGFTS

SEQ ID NO: 3184428 - protein, 25 aa, Giardia lamblia
DSRGRSALFYLIDNPHVHGLTGEAR

SEQ ID NO: 3184429 - protein, 29 aa, Giardia lamblia
DSRGWTALMYAAFLSFNSSIPLLSEEYGM

SEQ ID NO: 3184430 - protein, 27 aa, Giardia lamblia
DSRLLFFSKRIVSQALLNLYYNSSSTV

SEQ ID NO: 3184431 - protein, 27 aa, Giardia lamblia
DSSDCQPLVLSLLLFIEHNKMHEADGK

SEQ ID NO: 3184432 - protein, 28 aa, Giardia lamblia
DSSDLLRHIQFLRYSRSRYILDVKAITY

SEQ ID NO: 3184433 - protein, 20 aa, Giardia lamblia
DSSIALCALLRHPDIPHRST

SEQ ID NO: 3184434 - protein, 31 aa, Giardia lamblia
DSSKALLTYRILSQFWILPSKTELPSYYHAI

SEQ ID NO: 3184435 - protein, 24 aa, Giardia lamblia
DSSLKLKAILAEYEQNIKLSTDKI

SEQ ID NO: 3184436 - protein, 24 aa, Giardia lamblia
DSSLSPLRTISPHSPLQAATNVTS

SEQ ID NO: 3184437 - protein, 25 aa, Giardia lamblia
DSSSRSFLVVDQRQLSTLVVAITLK

SEQ ID NO: 3184438 - protein, 24 aa, Giardia lamblia
DSSTDWFRALVRCLGWNVRIRQKA

SEQ ID NO: 3184439 - protein, 22 aa, Giardia lamblia
DSSWTPLMRAALAGDITTVKKY

SEQ ID NO: 3184440 - protein, 25 aa, Giardia lamblia
DSSYLYSNVTPYYQYKRQLTKSISQ

SEQ ID NO: 3184441 - protein, 20 aa, Giardia lamblia
DSTALGTQLELLEQNRKLKE

SEQ ID NO: 3184442 - protein, 24 aa, Giardia lamblia
DSTESMGLIIDRSRAATGASKVGL

SEQ ID NO: 3184443 - protein, 20 aa, Giardia lamblia
DSTFKLENLISLNLHNYAED

SEQ ID NO: 3184444 - protein, 21 aa, Giardia lamblia
DSTLVYYPFEQDFGPLNLGQT

SEQ ID NO: 3184445 - protein, 23 aa, Giardia lamblia
DSTPTWLGAVLTLVHPADADASE

SEQ ID NO: 3184446 - protein, 18 aa, Giardia lamblia
DSTVLFLNLKKLGECSKK

SEQ ID NO: 3184447 - protein, 24 aa, Giardia lamblia
DSTVNLLTLVPRLAHTALNVLVVL

SEQ ID NO: 3184448 - protein, 28 aa, Giardia lamblia
DSVEDYRRYIDGVLYFKSNDSAGNARVA

SEQ ID NO: 3184449 - protein, 18 aa, Giardia lamblia
DSVFRGFNATILAYGQTG

SEQ ID NO: 3184450 - protein, 18 aa, Giardia lamblia
DSVGGYTALMFAAKRGST

SEQ ID NO: 3184451 - protein, 17 aa, Giardia lamblia
DSVLRILGVTKGKVHTT

SEQ ID NO: 3184452 - protein, 25 aa, Giardia lamblia
DSVTELLWGKYQFHPSRKHRIILLS

SEQ ID NO: 3184453 - protein, 26 aa, Giardia lamblia
DSVWEPLFVGVFLRLDDTLRLKNIQS

SEQ ID NO: 3184454 - protein, 25 aa, Giardia lamblia
DSYFPVTVAFIFDSMLHGLAELTHA

SEQ ID NO: 3184455 - protein, 29 aa, Giardia lamblia
DSYKQEGSLLPLWKFATNFKEVLGIKTVK

SEQ ID NO: 3184456 - protein, 32 aa, Giardia lamblia
DSYQAFSPGSKPPLPSIYTPQGELIDPCPHHS

SEQ ID NO: 3184457 - protein, 25 aa, Giardia lamblia
DTALLAEHSLLLKELRKLEWTALGL

SEQ ID NO: 3184458 - protein, 27 aa, Giardia lamblia
DTAVQTLYTRFFNSMRKIVAATTGQSH

SEQ ID NO: 3184459 - protein, 20 aa, Giardia lamblia
DTAVTLKSILHKHIIRYHEV

SEQ ID NO: 3184460 - protein, 18 aa, Giardia lamblia
DTCFLYALKQSGVLSDDE

SEQ ID NO: 3184461 - protein, 27 aa, Giardia lamblia
DTCLSNLPFLVYVIHGAPLAGKTTLAN

SEQ ID NO: 3184462 - protein, 19 aa, Giardia lamblia
DTCTLLMELIAKPEPFQLS

SEQ ID NO: 3184463 - protein, 25 aa, Giardia lamblia
DTDAILISAIYFKANWALKFSKDDT

SEQ ID NO: 3184464 - protein, 20 aa, Giardia lamblia
DTDCLLKYNIYAILEECCNR

SEQ ID NO: 3184465 - protein, 30 aa, Giardia lamblia
DTDGKSAYRIWWLLNFFSHPKVSIYPGGLK

SEQ ID NO: 3184466 - protein, 19 aa, Giardia lamblia
DTDIHMPFIEGTRVTKLRP

SEQ ID NO: 3184467 - protein, 33 aa, Giardia lamblia
DTDLLKRFLEHVPLPIFIRYLGANHSNYLITKL

SEQ ID NO: 3184468 - protein, 25 aa, Giardia lamblia
DTDPLSTTLLIRNALEKDSSDYYRR

SEQ ID NO: 3184469 - protein, 35 aa, Giardia lamblia
DTECLCLNRLNRSLYTIVLLLNANKSTPEEARQSS

SEQ ID NO: 3184470 - protein, 23 aa, Giardia lamblia
DTEDYYLKFISDNQKRNVQLISI

SEQ ID NO: 3184471 - protein, 17 aa, Giardia lamblia
DTEFACLKYLPKPLETI

SEQ ID NO: 3184472 - protein, 24 aa, Giardia lamblia
DTEFDVRTMAAWWTVSKAYSLVDM

SEQ ID NO: 3184473 - protein, 22 aa, Giardia lamblia
DTEIELTWGLCKSSYIEEFVAQ

SEQ ID NO: 3184474 - protein, 29 aa, Giardia lamblia
DTELARLRLRLDESLPALDTLRSEVELLK

SEQ ID NO: 3184475 - protein, 18 aa, Giardia lamblia
DTGMVRLLIPVQKGIKDS

SEQ ID NO: 3184476 - protein, 28 aa, Giardia lamblia
DTIITSDALLLQAVLLCYSGSIIDCLNT

SEQ ID NO: 3184477 - protein, 19 aa, Giardia lamblia
DTIKLELAALFTLFHPGVI

SEQ ID NO: 3184478 - protein, 23 aa, Giardia lamblia
DTIKQFLPHLTTKQINHALRAMI

SEQ ID NO: 3184479 - protein, 21 aa, Giardia lamblia
DTILIPNSPVVVSTIELPLPT

SEQ ID NO: 3184480 - protein, 19 aa, Giardia lamblia
DTIPSTYRIKLPSVLGVAP

SEQ ID NO: 3184481 - protein, 20 aa, Giardia lamblia
DTISILRGLSGRYQSHHQIR

SEQ ID NO: 3184482 - protein, 18 aa, Giardia lamblia
DTIVRRFLAGDEGELLLP

SEQ ID NO: 3184483 - protein, 18 aa, Giardia lamblia
DTIYRINSVFYAEGWAYL

SEQ ID NO: 3184484 - protein, 23 aa, Giardia lamblia
DTKGMTALMYAAIHGNVDCVKLL

SEQ ID NO: 3184485 - protein, 25 aa, Giardia lamblia
DTKKGFFFVTFNSPDAAKLALMGDV

SEQ ID NO: 3184486 - protein, 25 aa, Giardia lamblia
DTKLQIIELLGLAEWNVIVRKGRPS

SEQ ID NO: 3184487 - protein, 26 aa, Giardia lamblia
DTKTALKYIKSFYYNDFRSLQSEEDQ

SEQ ID NO: 3184488 - protein, 24 aa, Giardia lamblia
DTKVSWRWMVYSPGIDMYPRNAPI

SEQ ID NO: 3184489 - protein, 25 aa, Giardia lamblia
DTLDLAVQLLLNILTTTSFPLHILI

SEQ ID NO: 3184490 - protein, 23 aa, Giardia lamblia
DTLKRAMTAPRFVPHILAVCNVE

SEQ ID NO: 3184491 - protein, 21 aa, Giardia lamblia
DTLKRLLPFLTNIIPETSEEV

SEQ ID NO: 3184492 - protein, 20 aa, Giardia lamblia
DTLKRWYDQQLASERTRADA

SEQ ID NO: 3184493 - protein, 18 aa, Giardia lamblia
DTLMELYNRRLEHAAKLV

SEQ ID NO: 3184494 - protein, 30 aa, Giardia lamblia
DTLQAYFRLEALNLPDLVFLPGVEITTENL

SEQ ID NO: 3184495 - protein, 21 aa, Giardia lamblia
DTLRNVFVWTPGASVIAGLLA

SEQ ID NO: 3184496 - protein, 33 aa, Giardia lamblia
DTLTELLPIPIKRILKYMLGPYCTPRLGMPVAT

SEQ ID NO: 3184497 - protein, 23 aa, Giardia lamblia
DTLYRIVLPNVRRSRAAIEDLKS

SEQ ID NO: 3184498 - protein, 24 aa, Giardia lamblia
DTMNGCQVLFLAAVCLFTNRGNIS

SEQ ID NO: 3184499 - protein, 17 aa, Giardia lamblia
DTMSKFVAAFFAGCWTV

SEQ ID NO: 3184500 - protein, 26 aa, Giardia lamblia
DTNDREQFLLRNLPKHLIEEEPDLPR

SEQ ID NO: 3184501 - protein, 24 aa, Giardia lamblia
DTNDRVPLIPPSVPDSVLVDTLKR

SEQ ID NO: 3184502 - protein, 26 aa, Giardia lamblia
DTNEQRFEIFRILKKRLHKLQHDAKK

SEQ ID NO: 3184503 - protein, 22 aa, Giardia lamblia
DTNIQRIVWYHVAPENRNIVKE

SEQ ID NO: 3184504 - protein, 24 aa, Giardia lamblia
DTNLLSLYCGLLRIHDKPIRQLVY

SEQ ID NO: 3184505 - protein, 18 aa, Giardia lamblia
DTPIFKSVLASEPSKRQG

SEQ ID NO: 3184506 - protein, 27 aa, Giardia lamblia
DTPSQSNIFSQPKLYMSRLHQDLKKAR

SEQ ID NO: 3184507 - protein, 24 aa, Giardia lamblia
DTPTYSNPMSFRKEVPQRQATAPQ

SEQ ID NO: 3184508 - protein, 20 aa, Giardia lamblia
DTQLLLLRKWRRRTNLGREM

SEQ ID NO: 3184509 - protein, 22 aa, Giardia lamblia
DTRVKMIKDAIAHLDRLIQTES

SEQ ID NO: 3184510 - protein, 17 aa, Giardia lamblia
DTSALPAYLKRMTDGDT

SEQ ID NO: 3184511 - protein, 51 aa, Giardia lamblia
DTSALSGLRLTPFNNLILISITYQRGHQLSRDLQFYLLDPDELNAVHLNLT

SEQ ID NO: 3184512 - protein, 24 aa, Giardia lamblia
DTSGVTALIWAAFAGQVEVAELLT

SEQ ID NO: 3184513 - protein, 23 aa, Giardia lamblia
DTSHDLFPLGLATPSEHHIMDPK

SEQ ID NO: 3184514 - protein, 22 aa, Giardia lamblia
DTSIYRYMTSTQKSRFAELKER

SEQ ID NO: 3184515 - protein, 27 aa, Giardia lamblia
DTSNMFRFAYSKDLLRWWLTSPGCKPE

SEQ ID NO: 3184516 - protein, 17 aa, Giardia lamblia
DTSPLMLMSDLAITSLG

SEQ ID NO: 3184517 - protein, 26 aa, Giardia lamblia
DTSYDPVLIIPDFYQTPLCVAPLINL

SEQ ID NO: 3184518 - protein, 25 aa, Giardia lamblia
DTSYDSVLIYMLQNGFTLLDSRFYT

SEQ ID NO: 3184519 - protein, 23 aa, Giardia lamblia
DTTCKLWNIATQQQVLELAEHSS

SEQ ID NO: 3184520 - protein, 21 aa, Giardia lamblia
DTTFVRLIPCFRDGVPAGATI

SEQ ID NO: 3184521 - protein, 25 aa, Giardia lamblia
DTTPKTPMLFTLNGTKSRLSSTIHH

SEQ ID NO: 3184522 - protein, 33 aa, Giardia lamblia
DTTQSSLRYSRLPPLPSCVLTPGPAVQPVPQPK

SEQ ID NO: 3184523 - protein, 24 aa, Giardia lamblia
DTVRRNIKLQAALWKHKRTLLHID

SEQ ID NO: 3184524 - protein, 28 aa, Giardia lamblia
DTVRSSYLVRKLLLNGFPVLAVGQTGTG

SEQ ID NO: 3184525 - protein, 23 aa, Giardia lamblia
DTWALGIIALALLRGRPEKVSVD

SEQ ID NO: 3184526 - protein, 20 aa, Giardia lamblia
DTWFKCAFVGDKDRMSSLVD

SEQ ID NO: 3184527 - protein, 43 aa, Giardia lamblia
DTWKSYLANIRPWCISRQLWWGHRIPCYKFWFGDNPEPSGDKT

SEQ ID NO: 3184528 - protein, 21 aa, Giardia lamblia
DTWSLACLLLELCNLCKPKFV

SEQ ID NO: 3184529 - protein, 24 aa, Giardia lamblia
DTYEVYKGIFEKHQFHFANGTYRP

SEQ ID NO: 3184530 - protein, 25 aa, Giardia lamblia
DTYRQLLAYHRELQTLIPELEREKD

SEQ ID NO: 3184531 - protein, 30 aa, Giardia lamblia
DVAAPLTTTPLLFNMYRLAFDSNVPTALIL

SEQ ID NO: 3184532 - protein, 27 aa, Giardia lamblia
DVAIFNLRIRAFLPSILQQSKKFRTII

SEQ ID NO: 3184533 - protein, 26 aa, Giardia lamblia
DVAPDDAILIPPLTFKEDLNSTEGTT

SEQ ID NO: 3184534 - protein, 21 aa, Giardia lamblia
DVARLLAERSALKKRIEDLEG

SEQ ID NO: 3184535 - protein, 24 aa, Giardia lamblia
DVATIRLVVNYNPPVKWVNNGDEV

SEQ ID NO: 3184536 - protein, 24 aa, Giardia lamblia
DVCARISVEMYRKEAEKKKKKGKA

SEQ ID NO: 3184537 - protein, 20 aa, Giardia lamblia
DVCICTMPLPYDKEDWCKEE

SEQ ID NO: 3184538 - protein, 21 aa, Giardia lamblia
DVCRLAALGQNFLIKSDLSLS

SEQ ID NO: 3184539 - protein, 24 aa, Giardia lamblia
DVCRNLQILLLQNNKIRRIENLST

SEQ ID NO: 3184540 - protein, 18 aa, Giardia lamblia
DVCTVGTVFTIEPGLYYP

SEQ ID NO: 3184541 - protein, 20 aa, Giardia lamblia
DVDFSLIKRQQSLPAVQELE

SEQ ID NO: 3184542 - protein, 24 aa, Giardia lamblia
DVDITLDFLLRNYIEMNRFWVRTQ

SEQ ID NO: 3184543 - protein, 37 aa, Giardia lamblia
DVDPQTKFASVGLIPRFIVQLFDALASIQSVWKVRVS

SEQ ID NO: 3184544 - protein, 20 aa, Giardia lamblia
DVEAVRYNLPTYQKSVDRQG

SEQ ID NO: 3184545 - protein, 23 aa, Giardia lamblia
DVEKNLIRLWIHENMRVYYDRLV

SEQ ID NO: 3184546 - protein, 17 aa, Giardia lamblia
DVELARLVTPGFDTTKD

SEQ ID NO: 3184547 - protein, 21 aa, Giardia lamblia
DVFLVSLAELYDLAIFTYAIK

SEQ ID NO: 3184548 - protein, 34 aa, Giardia lamblia
DVGGRLWFGRLTDLLPFNADLYPLGTRPTRGSIV

SEQ ID NO: 3184549 - protein, 27 aa, Giardia lamblia
DVGIGLERIPWLLNRSVTSYITAFPTA

SEQ ID NO: 3184550 - protein, 25 aa, Giardia lamblia
DVIARELFLSIPMRIKPSYPDTQRL

SEQ ID NO: 3184551 - protein, 28 aa, Giardia lamblia
DVIDKRVVAWRLLRIQLFSDRHDKLSLR

SEQ ID NO: 3184552 - protein, 26 aa, Giardia lamblia
DVIISDLICIHLFKIHVFPAIVANLK

SEQ ID NO: 3184553 - protein, 38 aa, Giardia lamblia
DVIRSQRYLGYPFQEPYIWYVIGQIVNGLAYMHSQSIT

SEQ ID NO: 3184554 - protein, 31 aa, Giardia lamblia
DVISIRPLSNAITYQLFIPVSGRNRTTFEQL

SEQ ID NO: 3184555 - protein, 24 aa, Giardia lamblia
DVKELKVAMRALGFEPKREELKRM

SEQ ID NO: 3184556 - protein, 26 aa, Giardia lamblia
DVKNSQSMWLKAQTELVLCQKKRDEE

SEQ ID NO: 3184557 - protein, 35 aa, Giardia lamblia
DVKPVSCLLGSYYTLSFSYIFKYAGDIVYFAHTYP

SEQ ID NO: 3184558 - protein, 24 aa, Giardia lamblia
DVKVEMFLFSLLDLVYANLAKQME

SEQ ID NO: 3184559 - protein, 17 aa, Giardia lamblia
DVLAAIRATDTFAKSAL

SEQ ID NO: 3184560 - protein, 26 aa, Giardia lamblia
DVLEAWIICQRQWLYLEGIFSGSEDL

SEQ ID NO: 3184561 - protein, 31 aa, Giardia lamblia
DVLEEYIFRIPLHQLFFEMLFDPKQFCFVSS

SEQ ID NO: 3184562 - protein, 32 aa, Giardia lamblia
DVLLCREYWLSGTSSMLPFSLGIQHSKACAEV

SEQ ID NO: 3184563 - protein, 17 aa, Giardia lamblia
DVLNLQEKLDQQLKVRQ

SEQ ID NO: 3184564 - protein, 22 aa, Giardia lamblia
DVLQLPIFPVSERVTRPSWAFS

SEQ ID NO: 3184565 - protein, 17 aa, Giardia lamblia
DVLRDVMERAFCTLYHQ

SEQ ID NO: 3184566 - protein, 17 aa, Giardia lamblia
DVLRKFARDFAKESPPP

SEQ ID NO: 3184567 - protein, 19 aa, Giardia lamblia
DVLSFLIKREATCLAPGGL

SEQ ID NO: 3184568 - protein, 17 aa, Giardia lamblia
DVLVRLITMIRAALDGK

SEQ ID NO: 3184569 - protein, 25 aa, Giardia lamblia
DVMERAFCTLYHQIQLKADADQVRR

SEQ ID NO: 3184570 - protein, 23 aa, Giardia lamblia
DVMGVVIHYLYYKLRYGAQVAKN

SEQ ID NO: 3184571 - protein, 23 aa, Giardia lamblia
DVMLLPSRIEAHRRLLVEMGICN

SEQ ID NO: 3184572 - protein, 27 aa, Giardia lamblia
DVNESLLMSLFFNGKLWTQGPIIHNSE

SEQ ID NO: 3184573 - protein, 35 aa, Giardia lamblia
DVNKITITFWIPLNEVQFILYGSALRAKAFQEIYC

SEQ ID NO: 3184574 - protein, 21 aa, Giardia lamblia
DVNLAIIRLLRLHEARIQDKR

SEQ ID NO: 3184575 - protein, 17 aa, Giardia lamblia
DVPGYTVILAFSTKTYK

SEQ ID NO: 3184576 - protein, 22 aa, Giardia lamblia
DVPLDRYLKIGRQILTTASPHP

SEQ ID NO: 3184577 - protein, 33 aa, Giardia lamblia
DVPWLPQEQLLKLANLPYLTRLNLEILQYVAYC

SEQ ID NO: 3184578 - protein, 17 aa, Giardia lamblia
DVQRCEPMLIMLSEEEV

SEQ ID NO: 3184579 - protein, 24 aa, Giardia lamblia
DVQRTILTLWHKIASFYPTDDNDN

SEQ ID NO: 3184580 - protein, 24 aa, Giardia lamblia
DVRDLCFSIMWMLTGECAPSWYVP

SEQ ID NO: 3184581 - protein, 22 aa, Giardia lamblia
DVRDRAKILQLTKAQNIKVDIE

SEQ ID NO: 3184582 - protein, 23 aa, Giardia lamblia
DVRDTDGLICPPLALKSKDMCSQ

SEQ ID NO: 3184583 - protein, 17 aa, Giardia lamblia
DVRFYFNGARVSDTATP

SEQ ID NO: 3184584 - protein, 20 aa, Giardia lamblia
DVRIGKLIIYGGTALMIAAA

SEQ ID NO: 3184585 - protein, 23 aa, Giardia lamblia
DVRLPVPCMNIINGGKHAGNKLG

SEQ ID NO: 3184586 - protein, 23 aa, Giardia lamblia
DVRQQYIFLNIIGSGSFGKVHKV

SEQ ID NO: 3184587 - protein, 27 aa, Giardia lamblia
DVRQRASFYWRLLGVDPTLQTAKGVLF

SEQ ID NO: 3184588 - protein, 26 aa, Giardia lamblia
DVRVHRPAFRFSLWSRPSCITFNNYY

SEQ ID NO: 3184589 - protein, 24 aa, Giardia lamblia
DVSIPIALANMLPISTSYNGSTTY

SEQ ID NO: 3184590 - protein, 22 aa, Giardia lamblia
DVSLLASYALAYARTTSALGRT

SEQ ID NO: 3184591 - protein, 18 aa, Giardia lamblia
DVSLTPYQSTYASKALAV

SEQ ID NO: 3184592 - protein, 38 aa, Giardia lamblia
DVSNKYPVEIALKLYYYDACFILLMLHPDKSFENRVKR

SEQ ID NO: 3184593 - protein, 24 aa, Giardia lamblia
DVTLPPITLTYLPTGQQITTKSEI

SEQ ID NO: 3184594 - protein, 25 aa, Giardia lamblia
DVTQLLVGVFLRIELPDATPPDDFQ

SEQ ID NO: 3184595 - protein, 23 aa, Giardia lamblia
DVTRSFCWGILPGIGVYSPLDTR

SEQ ID NO: 3184596 - protein, 18 aa, Giardia lamblia
DVTSLIGLAQFSLNNRLK

SEQ ID NO: 3184597 - protein, 25 aa, Giardia lamblia
DVTSLQIKQLLRQLVKEVISLKPMA

SEQ ID NO: 3184598 - protein, 26 aa, Giardia lamblia
DVTVMILYALCLLDKLARLGYKLTGS

SEQ ID NO: 3184599 - protein, 17 aa, Giardia lamblia
DVTVTQMILTFAADSHV

SEQ ID NO: 3184600 - protein, 21 aa, Giardia lamblia
DVVLIENPHLKVLRSLLERLC

SEQ ID NO: 3184601 - protein, 30 aa, Giardia lamblia
DVVRRKYLTIFTLIALYTYPSSYSTFLSDV

SEQ ID NO: 3184602 - protein, 28 aa, Giardia lamblia
DVVYICLPRYCWTLSAIIAISDIKNKRF

SEQ ID NO: 3184603 - protein, 21 aa, Giardia lamblia
DVWALGCIIYELATLSRPSFA

SEQ ID NO: 3184604 - protein, 22 aa, Giardia lamblia
DVWALGCVLVELCTLRAPCWDP

SEQ ID NO: 3184605 - protein, 17 aa, Giardia lamblia
DVWSLGVILYEMATLRR

SEQ ID NO: 3184606 - protein, 19 aa, Giardia lamblia
DVYIRPPASYLLLASEDHI

SEQ ID NO: 3184607 - protein, 27 aa, Giardia lamblia
DVYSLGLLFFEVICGRPLFSCSNDIEY

SEQ ID NO: 3184608 - protein, 17 aa, Giardia lamblia
DVYYAILARNTLYNMVK

SEQ ID NO: 3184609 - protein, 19 aa, Giardia lamblia
DWENKLNAMASIFTRDHYT

SEQ ID NO: 3184610 - protein, 25 aa, Giardia lamblia
DWQTKPIRILKHYKRYHADPLGEDI

SEQ ID NO: 3184611 - protein, 19 aa, Giardia lamblia
DWSALKFSWLQTRSHVRSV

SEQ ID NO: 3184612 - protein, 19 aa, Giardia lamblia
DWVSYCGFILGIANSLTLL

SEQ ID NO: 3184613 - protein, 17 aa, Giardia lamblia
DYALRRLTDGSDLLGGM

SEQ ID NO: 3184614 - protein, 24 aa, Giardia lamblia
DYCSLWEILLKLLDGDRPSATLHR

SEQ ID NO: 3184615 - protein, 27 aa, Giardia lamblia
DYDDNTLWLVFPLYKHGSLSDVLERFR

SEQ ID NO: 3184616 - protein, 26 aa, Giardia lamblia
DYDKLRPLSYPGAHVFLLCFSVVSST

SEQ ID NO: 3184617 - protein, 17 aa, Giardia lamblia
DYELTLLNRATIKMVDH

SEQ ID NO: 3184618 - protein, 23 aa, Giardia lamblia
DYEWYSYLDVLRMSSELFYGLQA

SEQ ID NO: 3184619 - protein, 18 aa, Giardia lamblia
DYFGARIGFLKFSAEAYS

SEQ ID NO: 3184620 - protein, 19 aa, Giardia lamblia
DYFICAEVYTYKDLKRLGS

SEQ ID NO: 3184621 - protein, 19 aa, Giardia lamblia
DYGMFQREYTRLQGLMVVE

SEQ ID NO: 3184622 - protein, 29 aa, Giardia lamblia
DYIARSLGSLLYYLTTGMELKLPLSNTDQ

SEQ ID NO: 3184623 - protein, 22 aa, Giardia lamblia
DYILVIMASILEALAFLHTPNA

SEQ ID NO: 3184624 - protein, 24 aa, Giardia lamblia
DYKKSVYKQMLSFENFVLGTSEAL

SEQ ID NO: 3184625 - protein, 22 aa, Giardia lamblia
DYKLRNNGPAFTMRSRSPVKQY

SEQ ID NO: 3184626 - protein, 22 aa, Giardia lamblia
DYKSAFFNFALPSLQLSEPGPC

SEQ ID NO: 3184627 - protein, 30 aa, Giardia lamblia
DYLDKMIGDKPWLDLLLERDPQYFCYHQTE

SEQ ID NO: 3184628 - protein, 30 aa, Giardia lamblia
DYLESKRLAFPRFFFLSNDELLQILAQTTE

SEQ ID NO: 3184629 - protein, 23 aa, Giardia lamblia
DYLKVQCYSLFQCIYEISRYIVT

SEQ ID NO: 3184630 - protein, 18 aa, Giardia lamblia
DYMMFTALHYAAASGHKD

SEQ ID NO: 3184631 - protein, 25 aa, Giardia lamblia
DYPALLTHLSTNAELLPLRNKITAY

SEQ ID NO: 3184632 - protein, 27 aa, Giardia lamblia
DYPHKPPEIVFLTSSGRFETNRYICTS

SEQ ID NO: 3184633 - protein, 21 aa, Giardia lamblia
DYQNVDALLARQAYDPLGHPE

SEQ ID NO: 3184634 - protein, 17 aa, Giardia lamblia
DYRLTSVKLVAVIKALN

SEQ ID NO: 3184635 - protein, 22 aa, Giardia lamblia
DYSDAVRRILSASRSSLDRSGR

SEQ ID NO: 3184636 - protein, 19 aa, Giardia lamblia
DYSGQFLQEHDCAPPLMSE

SEQ ID NO: 3184637 - protein, 30 aa, Giardia lamblia
DYSSRMKDLRYLRALLSRSDLPIGCVSNTL

SEQ ID NO: 3184638 - protein, 19 aa, Giardia lamblia
DYSTLKIVSRLPSASDHVL

SEQ ID NO: 3184639 - protein, 23 aa, Giardia lamblia
DYSVPLYTFKGTTSAIWDLVLPG

SEQ ID NO: 3184640 - protein, 19 aa, Giardia lamblia
DYTAMCQQLMLNRDELANL

SEQ ID NO: 3184641 - protein, 43 aa, Giardia lamblia
DYTKALKFLEKYMSSLALLFRKIPVQILYINKKVHLVIEQIGA

SEQ ID NO: 3184642 - protein, 24 aa, Giardia lamblia
DYTLELMCYIPRPSSPMKVQADVG

SEQ ID NO: 3184643 - protein, 35 aa, Giardia lamblia
DYVDRGYFSVETFLLLIAFKVKFPTRISLLRGNHE

SEQ ID NO: 3184644 - protein, 24 aa, Giardia lamblia
DYVRSVFFHPDIHPYILSASDDNT

SEQ ID NO: 3184645 - protein, 18 aa, Giardia lamblia
DYVRVFNIPLSNPGIINQ

SEQ ID NO: 3184646 - protein, 18 aa, Giardia lamblia
DYVRVLNWCPGCHAQELI

SEQ ID NO: 3184647 - protein, 28 aa, Giardia lamblia
DYVYDELYKLLWTSRKRPQPLKIAAPNL

SEQ ID NO: 3184648 - protein, 20 aa, Giardia lamblia
EAAAYWIIRVYKGHDSYTLS

SEQ ID NO: 3184649 - protein, 22 aa, Giardia lamblia
EAAEILFPHEKQIRRAHGPSIE

SEQ ID NO: 3184650 - protein, 34 aa, Giardia lamblia
EAAFLLKEAIAYFRKFIFPCVRAGYTPGVVAGLS

SEQ ID NO: 3184651 - protein, 22 aa, Giardia lamblia
EAAIPPSIFTKSCAIVTDVLND

SEQ ID NO: 3184652 - protein, 23 aa, Giardia lamblia
EAAIRRLVVEPFPAEPPDSQRAM

SEQ ID NO: 3184653 - protein, 19 aa, Giardia lamblia
EAAIWDYIAQITDALIYLH

SEQ ID NO: 3184654 - protein, 24 aa, Giardia lamblia
EAAKKFNLGIKGSPYWIAPECVRS

SEQ ID NO: 3184655 - protein, 46 aa, Giardia lamblia
EAALLYICRELVPKTWRLLVFVATKHHCEYLTSILQANNLRATCIY

SEQ ID NO: 3184656 - protein, 28 aa, Giardia lamblia
EAALPRTLLNPLATIFTMPRLQHIARQI

SEQ ID NO: 3184657 - protein, 27 aa, Giardia lamblia
EAAQTAHFYIIAQPGPLVFVLRGRDDD

SEQ ID NO: 3184658 - protein, 31 aa, Giardia lamblia
EAAQVILWHYRLSALLYAGLRVERPVHRPAP

SEQ ID NO: 3184659 - protein, 26 aa, Giardia lamblia
EAARKGDMIALRQNLRQQARLKDNLG

SEQ ID NO: 3184660 - protein, 19 aa, Giardia lamblia
EAARLLYKLEFGMRGNRGE

SEQ ID NO: 3184661 - protein, 25 aa, Giardia lamblia
EAASFMISGFCRYYRQLRLIRQHLE

SEQ ID NO: 3184662 - protein, 39 aa, Giardia lamblia
EAASVWRGLTTYFWIFCFPACCAGSMGFRPRELAWAVCS

SEQ ID NO: 3184663 - protein, 26 aa, Giardia lamblia
EACKLLMSFELDSILPDGRTPLMLAA

SEQ ID NO: 3184664 - protein, 31 aa, Giardia lamblia
EACKRLVPYEMNLVLPDGRTPLMLAAAAGAV

SEQ ID NO: 3184665 - protein, 25 aa, Giardia lamblia
EADELEDYFLFPNGLRTTDPLATLT

SEQ ID NO: 3184666 - protein, 17 aa, Giardia lamblia
EADFARLSNLFAGLNKR

SEQ ID NO: 3184667 - protein, 28 aa, Giardia lamblia
EADIWKYTYQLLSALHYLHDPSTEAWYK

SEQ ID NO: 3184668 - protein, 35 aa, Giardia lamblia
EADKAPVRIVLSKRGIPITSLTKGSHPLPVVHEEN

SEQ ID NO: 3184669 - protein, 17 aa, Giardia lamblia
EADLLAQLYSPLLQCHM

SEQ ID NO: 3184670 - protein, 33 aa, Giardia lamblia
EADLVYRPNTLPIIDFRSLSPLHREKLARIKMS

SEQ ID NO: 3184671 - protein, 24 aa, Giardia lamblia
EADRMTIMLVFNLLGNENFTPEAK

SEQ ID NO: 3184672 - protein, 30 aa, Giardia lamblia
EADTIKGPLALLFLALRANAAIITSNLGMT

SEQ ID NO: 3184673 - protein, 24 aa, Giardia lamblia
EAEKATTIALLTSALKTMEDQNTL

SEQ ID NO: 3184674 - protein, 25 aa, Giardia lamblia
EAEKLRLSNLMLLKREACNTSVIRN

SEQ ID NO: 3184675 - protein, 26 aa, Giardia lamblia
EAELRHYRRLYFSLKAHYEAMVNLLP

SEQ ID NO: 3184676 - protein, 30 aa, Giardia lamblia
EAEPFASKLPPLLVPYLAPDVLQGNYYSAS

SEQ ID NO: 3184677 - protein, 19 aa, Giardia lamblia
EAERLRAIHGTREEKREIA

SEQ ID NO: 3184678 - protein, 37 aa, Giardia lamblia
EAESYFRRRFSYFNLLQSVMFHKLFYTSENVIIGCPT

SEQ ID NO: 3184679 - protein, 27 aa, Giardia lamblia
EAETVIDLMYTFSPLMLSMVPELAKCI

SEQ ID NO: 3184680 - protein, 22 aa, Giardia lamblia
EAEWFRAIMDRNYLRVKASVND

SEQ ID NO: 3184681 - protein, 28 aa, Giardia lamblia
EAFATWCPPCRGMIPHLAKIPTKYPNVY

SEQ ID NO: 3184682 - protein, 29 aa, Giardia lamblia
EAFKDVDYCLLFGAFPRKAGMERAELLSK

SEQ ID NO: 3184683 - protein, 30 aa, Giardia lamblia
EAGAMDAICILAPGWPVRRTTEGIAAIDIA

SEQ ID NO: 3184684 - protein, 25 aa, Giardia lamblia
EAGEQGFWFNKGSTALIFASRHCRL

SEQ ID NO: 3184685 - protein, 24 aa, Giardia lamblia
EAGHKIIVIILEPTDTFGDTRLMR

SEQ ID NO: 3184686 - protein, 33 aa, Giardia lamblia
EAGMALPDGRTALFLAIELKYMDIAEELRPYEG

SEQ ID NO: 3184687 - protein, 17 aa, Giardia lamblia
EAGMRLCSGSTALMIAA

SEQ ID NO: 3184688 - protein, 26 aa, Giardia lamblia
EAGRLLDCFCYLQLGLAQQRDYRQYT

SEQ ID NO: 3184689 - protein, 28 aa, Giardia lamblia
EAGSIHALRVLFFHYGNESDNMGLTALD

SEQ ID NO: 3184690 - protein, 27 aa, Giardia lamblia
EAHQIKAVRLILRGWVHMVRADVDEAL

SEQ ID NO: 3184691 - protein, 26 aa, Giardia lamblia
EAHRLVPFSLAVINWLGSHYIKNELY

SEQ ID NO: 3184692 - protein, 29 aa, Giardia lamblia
EAHYALAQTALYLSLAPKSNSAGTALNNA

SEQ ID NO: 3184693 - protein, 19 aa, Giardia lamblia
EAIINLFPEDIFANNTFVQ

SEQ ID NO: 3184694 - protein, 29 aa, Giardia lamblia
EAIKAIMDSLLPLYQYTQLYLSRIQSSVQ

SEQ ID NO: 3184695 - protein, 19 aa, Giardia lamblia
EAILAYTHGYADNLRQFFL

SEQ ID NO: 3184696 - protein, 30 aa, Giardia lamblia
EAILRIVEYLSLKKLPIFVKRRQISNYSQC

SEQ ID NO: 3184697 - protein, 17 aa, Giardia lamblia
EAIPKRCSWRRYTGEDL

SEQ ID NO: 3184698 - protein, 18 aa, Giardia lamblia
EAIRVFRTKLNEAGLPVG

SEQ ID NO: 3184699 - protein, 24 aa, Giardia lamblia
EAKELLIALCALMKRVDDEACALA

SEQ ID NO: 3184700 - protein, 21 aa, Giardia lamblia
EAKILSKLKHPYIVGYHESFA

SEQ ID NO: 3184701 - protein, 24 aa, Giardia lamblia
EAKKKEFWDILVDKLAGSGEASLL

SEQ ID NO: 3184702 - protein, 24 aa, Giardia lamblia
EAKLKALRMSFQDLARIHHPNIVH

SEQ ID NO: 3184703 - protein, 33 aa, Giardia lamblia
EAKMSYLLMEHFTLGDLADVIRFYRKEHTQIEE

SEQ ID NO: 3184704 - protein, 24 aa, Giardia lamblia
EAKQASFELLLEKETRLLQNIDLL

SEQ ID NO: 3184705 - protein, 26 aa, Giardia lamblia
EAKVWKVVDSWFYCRGLAAMQIDSYN

SEQ ID NO: 3184706 - protein, 25 aa, Giardia lamblia
EALEKWNLGIIAKLLPRHTEIIFEI

SEQ ID NO: 3184707 - protein, 34 aa, Giardia lamblia
EALFDSLELLETESLWYPAASVLYSRTSLSGKTL

SEQ ID NO: 3184708 - protein, 19 aa, Giardia lamblia
EALFSLYYPNNKADALIGN

SEQ ID NO: 3184709 - protein, 25 aa, Giardia lamblia
EALGGLRYGTLPKLNYPLSNDANDS

SEQ ID NO: 3184710 - protein, 19 aa, Giardia lamblia
EALGIIIKQQGPHYEFIGL

SEQ ID NO: 3184711 - protein, 35 aa, Giardia lamblia
EALGLLSEFPTFVPKLLGLQLPRRAAKQTVIGLIG

SEQ ID NO: 3184712 - protein, 29 aa, Giardia lamblia
EALKEAVILPMMFPQLFQGKREPWRGILL

SEQ ID NO: 3184713 - protein, 17 aa, Giardia lamblia
EALLYYHSPQKDNTDMG

SEQ ID NO: 3184714 - protein, 17 aa, Giardia lamblia
EALRPIGKLKITYKSVV

SEQ ID NO: 3184715 - protein, 25 aa, Giardia lamblia
EALRPLYVEYKTLKVFLPDDDDDDK

SEQ ID NO: 3184716 - protein, 17 aa, Giardia lamblia
EALYARCMVAESLASMY

SEQ ID NO: 3184717 - protein, 25 aa, Giardia lamblia
EALYYAFAVLPRRFEFARAVTCTQD

SEQ ID NO: 3184718 - protein, 27 aa, Giardia lamblia
EAMDAKRQELLLLKEQYGLVRHQNESQ

SEQ ID NO: 3184719 - protein, 29 aa, Giardia lamblia
EAMNLCPRLLDWLIRLALKYIESPEEFKA

SEQ ID NO: 3184720 - protein, 30 aa, Giardia lamblia
EANAELSLLLVFPFCELDLKTYLKHGSLYS

SEQ ID NO: 3184721 - protein, 23 aa, Giardia lamblia
EANKLPRAYSANAALKAKRDLAT

SEQ ID NO: 3184722 - protein, 32 aa, Giardia lamblia
EANLWTDNIFCLQKYMLTKLQMDKKTVSTALG

SEQ ID NO: 3184723 - protein, 23 aa, Giardia lamblia
EANPVLLDILLKSQLATGLIDAA

SEQ ID NO: 3184724 - protein, 37 aa, Giardia lamblia
EAPEKQVLGIIQPFLLMQLFIPKDQIFSLNLGVADCS

SEQ ID NO: 3184725 - protein, 17 aa, Giardia lamblia
EAPLPSFKAIQCELLQP

SEQ ID NO: 3184726 - protein, 30 aa, Giardia lamblia
EAQNTVYMPMRSFAPRALASKPLIEACPFK

SEQ ID NO: 3184727 - protein, 19 aa, Giardia lamblia
EAQPFLLGLVRDGIPILGE

SEQ ID NO: 3184728 - protein, 23 aa, Giardia lamblia
EAQRAYIQHHFPPENYRVPGSED

SEQ ID NO: 3184729 - protein, 24 aa, Giardia lamblia
EAQRRLASVEAAYARYHSMNDKDA

SEQ ID NO: 3184730 - protein, 27 aa, Giardia lamblia
EAQVNGHFFLLNLTRKAPDNDQIDIIG

SEQ ID NO: 3184731 - protein, 23 aa, Giardia lamblia
EARDDAIQQLNLRLNKTGDAVEA

SEQ ID NO: 3184732 - protein, 20 aa, Giardia lamblia
EARDPPQFKFGFVPASTDDK

SEQ ID NO: 3184733 - protein, 20 aa, Giardia lamblia
EAREELAILRAERDRLHKTV

SEQ ID NO: 3184734 - protein, 17 aa, Giardia lamblia
EARIIRITALTFDTCLA

SEQ ID NO: 3184735 - protein, 20 aa, Giardia lamblia
EARKVVPAYRFSTATWRNVS

SEQ ID NO: 3184736 - protein, 21 aa, Giardia lamblia
EARKYIDMGLDIAKAAGQNDK

SEQ ID NO: 3184737 - protein, 24 aa, Giardia lamblia
EARLTFMDNVFPGILPLTNVTNQS

SEQ ID NO: 3184738 - protein, 24 aa, Giardia lamblia
EARRKIIPALLLAQKTVIDVGSEG

SEQ ID NO: 3184739 - protein, 27 aa, Giardia lamblia
EARTAEAIFLAMTSMIKELSLQEEKNI

SEQ ID NO: 3184740 - protein, 23 aa, Giardia lamblia
EARTLLGRVHTMELLLDQSAHTI

SEQ ID NO: 3184741 - protein, 25 aa, Giardia lamblia
EASDEFFRWAISSPGGIIDAHINMR

SEQ ID NO: 3184742 - protein, 23 aa, Giardia lamblia
EASKSLLERTKLLELRAIKAEDE

SEQ ID NO: 3184743 - protein, 26 aa, Giardia lamblia
EASLNSNLLDILKSLFARVLDNTLGY

SEQ ID NO: 3184744 - protein, 23 aa, Giardia lamblia
EASQYLILANLISRPRLRGFYRP

SEQ ID NO: 3184745 - protein, 27 aa, Giardia lamblia
EASSMYCDLFMYLEAIRLCKRCGDMDA

SEQ ID NO: 3184746 - protein, 19 aa, Giardia lamblia
EASVRYELPPFVFENDPHA

SEQ ID NO: 3184747 - protein, 26 aa, Giardia lamblia
EATAWPSVIPLSRWIVDLQERVSFIR

SEQ ID NO: 3184748 - protein, 20 aa, Giardia lamblia
EATLVLMTLEPRKIGRYIVN

SEQ ID NO: 3184749 - protein, 19 aa, Giardia lamblia
EATRYLSILLTMQAQLSDG

SEQ ID NO: 3184750 - protein, 31 aa, Giardia lamblia
EATTSTIIIRLIVVLPTAAIRIYLVEPPGQF

SEQ ID NO: 3184751 - protein, 17 aa, Giardia lamblia
EATVRACLQMPWLKSQP

SEQ ID NO: 3184752 - protein, 22 aa, Giardia lamblia
EAVDFFRKWNYQPTADILCTRL

SEQ ID NO: 3184753 - protein, 30 aa, Giardia lamblia
EAVLCDNLGILRLLLTRDFTMEQVLQALRT

SEQ ID NO: 3184754 - protein, 23 aa, Giardia lamblia
EAVPDSVFRYLSAWHSVHVAALG

SEQ ID NO: 3184755 - protein, 24 aa, Giardia lamblia
EAVPKDTAIWLKGDRATKWYSYHA

SEQ ID NO: 3184756 - protein, 25 aa, Giardia lamblia
EAVPSPIVVVFAPARELASQIYMEI

SEQ ID NO: 3184757 - protein, 17 aa, Giardia lamblia
EAVRLLLKWESIDQSQY

SEQ ID NO: 3184758 - protein, 25 aa, Giardia lamblia
EAVVKLQRLNLAEFYLWCKICDISR

SEQ ID NO: 3184759 - protein, 23 aa, Giardia lamblia
EAWYKIPELLSRSTSRRPSCIDD

SEQ ID NO: 3184760 - protein, 19 aa, Giardia lamblia
EAYALLYSLHLEKSTEFIL

SEQ ID NO: 3184761 - protein, 29 aa, Giardia lamblia
EAYDGFFIHTGISYVPCYVSSSSGALLLR

SEQ ID NO: 3184762 - protein, 24 aa, Giardia lamblia
EAYDRLCFYGLIDRPPDSVGLRVC

SEQ ID NO: 3184763 - protein, 23 aa, Giardia lamblia
EAYFRLDPPVVLSALRRLELYAN

SEQ ID NO: 3184764 - protein, 27 aa, Giardia lamblia
EAYNRFMRPPLVGIVLFDDALSHLVKL

SEQ ID NO: 3184765 - protein, 19 aa, Giardia lamblia
EAYRELALGRRTALMQGKG

SEQ ID NO: 3184766 - protein, 21 aa, Giardia lamblia
EAYRILKETALKRALPPPVQP

SEQ ID NO: 3184767 - protein, 26 aa, Giardia lamblia
ECANAGFYQGAGLLLAHECRYRNKEG

SEQ ID NO: 3184768 - protein, 19 aa, Giardia lamblia
ECDGLAVKLSLLEDEHEVL

SEQ ID NO: 3184769 - protein, 25 aa, Giardia lamblia
ECEKLRNAFLNAPTTRTVIDEASST

SEQ ID NO: 3184770 - protein, 22 aa, Giardia lamblia
ECGVAYAGYWLQLEALRTGAIP

SEQ ID NO: 3184771 - protein, 27 aa, Giardia lamblia
ECITLIDRALVHIPILEDMIAPEKATL

SEQ ID NO: 3184772 - protein, 20 aa, Giardia lamblia
ECLLTSLPPLYRCYLENDYL

SEQ ID NO: 3184773 - protein, 23 aa, Giardia lamblia
ECLPKILGGIMGTPVRLPASRQR

SEQ ID NO: 3184774 - protein, 22 aa, Giardia lamblia
ECLVRERIAVRYTKDIQEVDAL

SEQ ID NO: 3184775 - protein, 27 aa, Giardia lamblia
ECMESLQRFSMLTRLMRTVISNNIMLA

SEQ ID NO: 3184776 - protein, 24 aa, Giardia lamblia
ECMRLKQCLDFNSLPPDAKEVEFK

SEQ ID NO: 3184777 - protein, 24 aa, Giardia lamblia
ECNGFLVSLLERLDLECKPPLTTA

SEQ ID NO: 3184778 - protein, 22 aa, Giardia lamblia
ECQAFYIQEPYAPSPNPYIDLN

SEQ ID NO: 3184779 - protein, 19 aa, Giardia lamblia
ECQFVLGFTANGWITAFDW

SEQ ID NO: 3184780 - protein, 27 aa, Giardia lamblia
ECQLCHYNGFAWIMFQPLSTELDEPRL

SEQ ID NO: 3184781 - protein, 26 aa, Giardia lamblia
ECQPCTRPLLLETQVNAIWNFSNDAF

SEQ ID NO: 3184782 - protein, 19 aa, Giardia lamblia
ECQQILVLSSFLSADSLAN

SEQ ID NO: 3184783 - protein, 26 aa, Giardia lamblia
ECRGSLQPLKWYYDQLIVTSASGTEL

SEQ ID NO: 3184784 - protein, 25 aa, Giardia lamblia
ECRYQIVANGEWRGMTALMFAARNG

SEQ ID NO: 3184785 - protein, 20 aa, Giardia lamblia
ECSRCLGYWIAALENSGVAE

SEQ ID NO: 3184786 - protein, 19 aa, Giardia lamblia
ECSVLAPFPSAHVPAAVAV

SEQ ID NO: 3184787 - protein, 22 aa, Giardia lamblia
ECVELLLGERQLMTVYDYCGYP

SEQ ID NO: 3184788 - protein, 22 aa, Giardia lamblia
ECVKILYQYTQAKGIPLLLTGG

SEQ ID NO: 3184789 - protein, 18 aa, Giardia lamblia
ECVRFLHSSCLDRGLSLT

SEQ ID NO: 3184790 - protein, 19 aa, Giardia lamblia
ECVRGGGLILFLLNNMHDL

SEQ ID NO: 3184791 - protein, 17 aa, Giardia lamblia
ECVRLLLIEAGYVDLEN

SEQ ID NO: 3184792 - protein, 33 aa, Giardia lamblia
EDAASPFLVCPLNLLIARPIIVIAPVPNRLCDE

SEQ ID NO: 3184793 - protein, 34 aa, Giardia lamblia
EDAIRRYYFVSAHARLLHLFWETIHEDTDRTNGY

SEQ ID NO: 3184794 - protein, 17 aa, Giardia lamblia
EDAKAVIECLFLLVQHT

SEQ ID NO: 3184795 - protein, 25 aa, Giardia lamblia
EDALDIVVYALPALTIDIHDFLISC

SEQ ID NO: 3184796 - protein, 41 aa, Giardia lamblia
EDALYILMREFEADLANFLLKYVISIIFPSQQEPACILWYI

SEQ ID NO: 3184797 - protein, 26 aa, Giardia lamblia
EDARRRDRLALLQRLDDRLASIQAMS

SEQ ID NO: 3184798 - protein, 31 aa, Giardia lamblia
EDASEPLTLVTVAKKLKLLGEGLQGLPTVVI

SEQ ID NO: 3184799 - protein, 22 aa, Giardia lamblia
EDCTLRNGIWTDQKRIYTTFRP

SEQ ID NO: 3184800 - protein, 32 aa, Giardia lamblia
EDDGKVIEPFYYAPILPMVLINGSDGIGTGFS

SEQ ID NO: 3184801 - protein, 17 aa, Giardia lamblia
EDDLLVTVLRRRDLDIL

SEQ ID NO: 3184802 - protein, 17 aa, Giardia lamblia
EDEALWALVYPHLNRDD

SEQ ID NO: 3184803 - protein, 25 aa, Giardia lamblia
EDEFDYYNKYFPGTQLLLSCKANND

SEQ ID NO: 3184804 - protein, 24 aa, Giardia lamblia
EDEKSRLQVLLDEKTKEVGQSAHK

SEQ ID NO: 3184805 - protein, 25 aa, Giardia lamblia
EDESFRAYLRYLQYVRRPEYSCYVK

SEQ ID NO: 3184806 - protein, 23 aa, Giardia lamblia
EDFPPLIKAVHEDNLFKVYCLLQ

SEQ ID NO: 3184807 - protein, 17 aa, Giardia lamblia
EDFTCKIWKRDRATPVY

SEQ ID NO: 3184808 - protein, 23 aa, Giardia lamblia
EDFTPYLNRLSASQLKLVTIYVV

SEQ ID NO: 3184809 - protein, 25 aa, Giardia lamblia
EDFTTKLDVFLLGVTLITLTIRNQC

SEQ ID NO: 3184810 - protein, 25 aa, Giardia lamblia
EDGFYRSFLPLFKELKDLHGKDISR

SEQ ID NO: 3184811 - protein, 18 aa, Giardia lamblia
EDGGLVDLVPLLKRAQRP

SEQ ID NO: 3184812 - protein, 31 aa, Giardia lamblia
EDGIRFDAAQLLHRLFPYQSVKQHYNGSTIC

SEQ ID NO: 3184813 - protein, 18 aa, Giardia lamblia
EDGLLLLYNSIASLIETS

SEQ ID NO: 3184814 - protein, 23 aa, Giardia lamblia
EDGSFIKRYSIQTIQWNRQYNSM

SEQ ID NO: 3184815 - protein, 22 aa, Giardia lamblia
EDGVTAWYLAYKVQSPDLCMIL

SEQ ID NO: 3184816 - protein, 20 aa, Giardia lamblia
EDHLTCAICYGLFSHPVVLT

SEQ ID NO: 3184817 - protein, 25 aa, Giardia lamblia
EDIEAFFRRLFHAKTPPENQLSCLA

SEQ ID NO: 3184818 - protein, 23 aa, Giardia lamblia
EDILVHTRRIVAILNDASSLLST

SEQ ID NO: 3184819 - protein, 18 aa, Giardia lamblia
EDIPLLEADTLLCIGRAY

SEQ ID NO: 3184820 - protein, 25 aa, Giardia lamblia
EDIQETLRYLLSNSLLVTLRKMQSN

SEQ ID NO: 3184821 - protein, 20 aa, Giardia lamblia
EDIRFGYPTALMRAAMENKV

SEQ ID NO: 3184822 - protein, 33 aa, Giardia lamblia
EDKGAVLLDESLLRILSLLPTTPAEDEFLSLPR

SEQ ID NO: 3184823 - protein, 17 aa, Giardia lamblia
EDKQYIMRMAPNVFAES

SEQ ID NO: 3184824 - protein, 31 aa, Giardia lamblia
EDKTDKFLMNYLQSQAWLQDEVSERSSTDLK

SEQ ID NO: 3184825 - protein, 24 aa, Giardia lamblia
EDLEAPIPAQFTEGPRLSNYVQQM

SEQ ID NO: 3184826 - protein, 22 aa, Giardia lamblia
EDLFCQLVILANYLVESVPEEW

SEQ ID NO: 3184827 - protein, 30 aa, Giardia lamblia
EDLKKQIQNLLPKTLAALRLKLTEMATTLP

SEQ ID NO: 3184828 - protein, 18 aa, Giardia lamblia
EDLLAFIVCLLSTAKRES

SEQ ID NO: 3184829 - protein, 27 aa, Giardia lamblia
EDLLAPETLLIIARVYLTAAFQFHQSE

SEQ ID NO: 3184830 - protein, 17 aa, Giardia lamblia
EDLLKAERIRCVLSDIQ

SEQ ID NO: 3184831 - protein, 21 aa, Giardia lamblia
EDLLPVLIPSSSGMATENGEY

SEQ ID NO: 3184832 - protein, 24 aa, Giardia lamblia
EDLPLCCIKYRSAAPYIPRKLQGT

SEQ ID NO: 3184833 - protein, 18 aa, Giardia lamblia
EDLRLVRLTLEEEIAALQ

SEQ ID NO: 3184834 - protein, 25 aa, Giardia lamblia
EDLTQSMDLCRRLRLLMGLNHKCLN

SEQ ID NO: 3184835 - protein, 22 aa, Giardia lamblia
EDLYFNLLNALFSRAKLLMNNQ

SEQ ID NO: 3184836 - protein, 23 aa, Giardia lamblia
EDMKKLFLMAGVDNQAVCFLLSD

SEQ ID NO: 3184837 - protein, 23 aa, Giardia lamblia
EDMTALMLITIHGSVNSAKTLLE

SEQ ID NO: 3184838 - protein, 24 aa, Giardia lamblia
EDNDLLLGRIASLARELDTTKREN

SEQ ID NO: 3184839 - protein, 25 aa, Giardia lamblia
EDNFCVQGYSMYFLLSVMSEYWKPD

SEQ ID NO: 3184840 - protein, 27 aa, Giardia lamblia
EDNIVAVWCLIPHQGGLRDEEGFTALM

SEQ ID NO: 3184841 - protein, 25 aa, Giardia lamblia
EDNKALFLEVEHLRMVASFVPEKEE

SEQ ID NO: 3184842 - protein, 29 aa, Giardia lamblia
EDNSLNFNRFKYLAKKFYGRISKAKLWSV

SEQ ID NO: 3184843 - protein, 18 aa, Giardia lamblia
EDPLSDIYQLLFSHMMRT

SEQ ID NO: 3184844 - protein, 27 aa, Giardia lamblia
EDPNTDIILLYLESIVDGRKFLEQIPT

SEQ ID NO: 3184845 - protein, 25 aa, Giardia lamblia
EDQKREIYVLRVALRAKIAAITEGT

SEQ ID NO: 3184846 - protein, 18 aa, Giardia lamblia
EDQLAKVLAYNKCYWNGT

SEQ ID NO: 3184847 - protein, 23 aa, Giardia lamblia
EDRDQLYREFEGFKASDDVITSQ

SEQ ID NO: 3184848 - protein, 23 aa, Giardia lamblia
EDRLRLATTPAPVRTLVAGCFKD

SEQ ID NO: 3184849 - protein, 17 aa, Giardia lamblia
EDRLSAIMTGFIELNSR

SEQ ID NO: 3184850 - protein, 25 aa, Giardia lamblia
EDRNLRPIVVLRGMLRRGIAVHHSG

SEQ ID NO: 3184851 - protein, 20 aa, Giardia lamblia
EDRSIKIALAEKTMYCFDNE

SEQ ID NO: 3184852 - protein, 24 aa, Giardia lamblia
EDRSLLLSPWSSAYSHCLRRLLTD

SEQ ID NO: 3184853 - protein, 43 aa, Giardia lamblia
EDSGNRVVVKLYFIKNLGLSEWFYQKRLGILRGILDSLSTVSH

SEQ ID NO: 3184854 - protein, 25 aa, Giardia lamblia
EDSICRRFIALHANPEYSKPWVFVC

SEQ ID NO: 3184855 - protein, 25 aa, Giardia lamblia
EDSLISFMRCKYVYKFLHLPVQSGS

SEQ ID NO: 3184856 - protein, 22 aa, Giardia lamblia
EDSPFYIKSVVKKIEDILYAEY

SEQ ID NO: 3184857 - protein, 18 aa, Giardia lamblia
EDSQLRSLMVRLGEAIET

SEQ ID NO: 3184858 - protein, 30 aa, Giardia lamblia
EDTALNIALQLAFYNSAQLLMRSSKERELI

SEQ ID NO: 3184859 - protein, 18 aa, Giardia lamblia
EDTFLLIDTLTKLSGELH

SEQ ID NO: 3184860 - protein, 19 aa, Giardia lamblia
EDTGRRLIRPALDGYNCSI

SEQ ID NO: 3184861 - protein, 23 aa, Giardia lamblia
EDTKQPQHIPYTPTYKLGSETQH

SEQ ID NO: 3184862 - protein, 26 aa, Giardia lamblia
EDVGPLLPLQPLLLESSISSLQAIQT

SEQ ID NO: 3184863 - protein, 22 aa, Giardia lamblia
EDVLNSEFWLSKTVIVNALDNV

SEQ ID NO: 3184864 - protein, 18 aa, Giardia lamblia
EDVPNVRVRMLKKSIFQA

SEQ ID NO: 3184865 - protein, 25 aa, Giardia lamblia
EDVSSLLRRLLPETNLKAVIFSLPE

SEQ ID NO: 3184866 - protein, 17 aa, Giardia lamblia
EDVVIFGILVLNSKQRK

SEQ ID NO: 3184867 - protein, 21 aa, Giardia lamblia
EDWKIGIFVVGYHINMIRYLV

SEQ ID NO: 3184868 - protein, 26 aa, Giardia lamblia
EEAAILNRFLALASVLLVRRERPVVL

SEQ ID NO: 3184869 - protein, 18 aa, Giardia lamblia
EEAALLSFFEPLVDDRHN

SEQ ID NO: 3184870 - protein, 34 aa, Giardia lamblia
EEAARIQEIYDKKIRFLDKFSTKKAFIIAHALHT

SEQ ID NO: 3184871 - protein, 18 aa, Giardia lamblia
EEAIICRGISFKRSTEKP

SEQ ID NO: 3184872 - protein, 28 aa, Giardia lamblia
EEALPNLVMSFMRLLLEAVTDYSDLISC

SEQ ID NO: 3184873 - protein, 22 aa, Giardia lamblia
EEALRHPFFKDIGEIVRLKAPT

SEQ ID NO: 3184874 - protein, 17 aa, Giardia lamblia
EEARLQFSIRVRDMAAY

SEQ ID NO: 3184875 - protein, 29 aa, Giardia lamblia
EEASFMKQLIKENGYLKQRLNQIALGSDE

SEQ ID NO: 3184876 - protein, 18 aa, Giardia lamblia
EEATYLTKIATKVYMVLR

SEQ ID NO: 3184877 - protein, 20 aa, Giardia lamblia
EEAYNILKQEFAGYKKDVSA

SEQ ID NO: 3184878 - protein, 35 aa, Giardia lamblia
EECIIIRENYLLRLLFNLFCNLLTLDPLSSTITLP

SEQ ID NO: 3184879 - protein, 24 aa, Giardia lamblia
EEDAFKIGILPDAGGVYRYARPAL

SEQ ID NO: 3184880 - protein, 21 aa, Giardia lamblia
EEDFIPLCQICSHSILKNQLS

SEQ ID NO: 3184881 - protein, 24 aa, Giardia lamblia
EEDKLVLYINSKLGTRASSLDDLK

SEQ ID NO: 3184882 - protein, 26 aa, Giardia lamblia
EEDLVRLFTSLYFSNATLDKYALVKY

SEQ ID NO: 3184883 - protein, 25 aa, Giardia lamblia
EEDMASFLRSRFTLIPTSGMQHMSS

SEQ ID NO: 3184884 - protein, 40 aa, Giardia lamblia
EEDMDSMLPTLPNRSLLTPYPTFCAMTIRTGTRRINGLTF

SEQ ID NO: 3184885 - protein, 24 aa, Giardia lamblia
EEDWKVKNLITVWLQRLRGEKADR

SEQ ID NO: 3184886 - protein, 24 aa, Giardia lamblia
EEEFRLFSYRLNKVDSAPILCIVT

SEQ ID NO: 3184887 - protein, 19 aa, Giardia lamblia
EEELREAFRVFDRNGDGYV

SEQ ID NO: 3184888 - protein, 18 aa, Giardia lamblia
EEEQFFMTLTGSIAVEIP

SEQ ID NO: 3184889 - protein, 24 aa, Giardia lamblia
EEERKQFLPQLTKPDKRTAEWYSE

SEQ ID NO: 3184890 - protein, 24 aa, Giardia lamblia
EEERRRYETYLTGEYRTGKSSNSP

SEQ ID NO: 3184891 - protein, 19 aa, Giardia lamblia
EEEVESLRQALLAKDGELE

SEQ ID NO: 3184892 - protein, 23 aa, Giardia lamblia
EEEVWAILAQLVSVLSYLHSSIK

SEQ ID NO: 3184893 - protein, 37 aa, Giardia lamblia
EEFMLLGNCLVAQKLILCFPTLPILRIHPTCKKSKIL

SEQ ID NO: 3184894 - protein, 20 aa, Giardia lamblia
EEFPDYWLTHGSEPFPIIER

SEQ ID NO: 3184895 - protein, 28 aa, Giardia lamblia
EEFSSTKLGALLKLVPQLLQEDGRAELL

SEQ ID NO: 3184896 - protein, 18 aa, Giardia lamblia
EEGAGFTALMLAAKLGHT

SEQ ID NO: 3184897 - protein, 26 aa, Giardia lamblia
EEGVCGIFFNRLFHKLQYGPQKHNFA

SEQ ID NO: 3184898 - protein, 20 aa, Giardia lamblia
EEHILLFRGYNKHAVLLSLC

SEQ ID NO: 3184899 - protein, 25 aa, Giardia lamblia
EEHLAFREQIALLQTDNGILSKDVM

SEQ ID NO: 3184900 - protein, 25 aa, Giardia lamblia
EEIARLVREISLLRASLSEAQENAA

SEQ ID NO: 3184901 - protein, 23 aa, Giardia lamblia
EEIATLLLPYEKHRFCYRGYTAL

SEQ ID NO: 3184902 - protein, 19 aa, Giardia lamblia
EEICAMLRPYELNLTKDDG

SEQ ID NO: 3184903 - protein, 26 aa, Giardia lamblia
EEIDLILHMLNWSPYIRYTSDQCLSH

SEQ ID NO: 3184904 - protein, 20 aa, Giardia lamblia
EEIHRLILSRFKVPEEYIDY

SEQ ID NO: 3184905 - protein, 27 aa, Giardia lamblia
EEILRLRSLREEQLSLALPASDATNEL

SEQ ID NO: 3184906 - protein, 26 aa, Giardia lamblia
EEILVRVFTLLHYYVNSPVASPALNS

SEQ ID NO: 3184907 - protein, 22 aa, Giardia lamblia
EEIMRTTLESRRKFYNMSIIDK

SEQ ID NO: 3184908 - protein, 19 aa, Giardia lamblia
EEIVFPYSKLVTGKPIHIN

SEQ ID NO: 3184909 - protein, 28 aa, Giardia lamblia
EEIYSLKNISFLDTLYARIAEMMAKEGK

SEQ ID NO: 3184910 - protein, 40 aa, Giardia lamblia
EEKAELLGESPLVILDKLRASLRVLLAFKEDFECELKAAI

SEQ ID NO: 3184911 - protein, 24 aa, Giardia lamblia
EEKEDEALFKKKVLGVVSKELEHV

SEQ ID NO: 3184912 - protein, 24 aa, Giardia lamblia
EEKKLLRFKTIFSLLSLIDQRSST

SEQ ID NO: 3184913 - protein, 25 aa, Giardia lamblia
EEKLELFIYDFFRTAPGDTQYAAVK

SEQ ID NO: 3184914 - protein, 17 aa, Giardia lamblia
EEKRALLEFDRPDLSAI

SEQ ID NO: 3184915 - protein, 24 aa, Giardia lamblia
EELDELCTLAWTTHVELLLTIAKW

SEQ ID NO: 3184916 - protein, 23 aa, Giardia lamblia
EELDEVILLKKELLSRNEVIQLM

SEQ ID NO: 3184917 - protein, 25 aa, Giardia lamblia
EELDTIPDLDLLGSMSYIPDLNSTS

SEQ ID NO: 3184918 - protein, 27 aa, Giardia lamblia
EELIEIRVDMVKFLVETFEDPCSFTNP

SEQ ID NO: 3184919 - protein, 21 aa, Giardia lamblia
EELKHRIAYKNLTDKEFVIYY

SEQ ID NO: 3184920 - protein, 35 aa, Giardia lamblia
EELKMLSASYNVKHGRLLAFLNDLTAELASVQTFA

SEQ ID NO: 3184921 - protein, 26 aa, Giardia lamblia
EELLLVACLVLYGPDWKTMEKHIPDR

SEQ ID NO: 3184922 - protein, 17 aa, Giardia lamblia
EELPDNLYYVVDSAGKI

SEQ ID NO: 3184923 - protein, 29 aa, Giardia lamblia
EELSDLFPPIVMPFIQAIKHELDIYQQLI

SEQ ID NO: 3184924 - protein, 24 aa, Giardia lamblia
EELSKNLIVLKLDSWKAGSKKGKQ

SEQ ID NO: 3184925 - protein, 24 aa, Giardia lamblia
EELVGYLGYGLERRHIAATKLNSL

SEQ ID NO: 3184926 - protein, 21 aa, Giardia lamblia
EELVRLSRLPKFKRSYTATSP

SEQ ID NO: 3184927 - protein, 22 aa, Giardia lamblia
EENFADIPVSLPGQVAASNDLD

SEQ ID NO: 3184928 - protein, 25 aa, Giardia lamblia
EENGDKLLIYLGLSNQRTLTESASS

SEQ ID NO: 3184929 - protein, 23 aa, Giardia lamblia
EEPFTILMIAALKNDIDLIKENR

SEQ ID NO: 3184930 - protein, 34 aa, Giardia lamblia
EEPLLSMTAIPLPKTFLGIFFADADPNTLASRLF

SEQ ID NO: 3184931 - protein, 23 aa, Giardia lamblia
EEQHAELEALKKALAASNELNTD

SEQ ID NO: 3184932 - protein, 25 aa, Giardia lamblia
EEQPLYTAMFLANDAPIQGLCLRLE

SEQ ID NO: 3184933 - protein, 34 aa, Giardia lamblia
EEQRVEGHGKFWFPNGDIYIGDYYEEGPIRKRHG

SEQ ID NO: 3184934 - protein, 30 aa, Giardia lamblia
EERCVLRATLFGNWALCNLRMKDYADCCSH

SEQ ID NO: 3184935 - protein, 25 aa, Giardia lamblia
EERDAVVRTILLRRLSYACICSSTR

SEQ ID NO: 3184936 - protein, 22 aa, Giardia lamblia
EERGAYILVRIILHLSQQECER

SEQ ID NO: 3184937 - protein, 29 aa, Giardia lamblia
EERHTTVPHLPPPLAIPPGFRGKTSEVPI

SEQ ID NO: 3184938 - protein, 26 aa, Giardia lamblia
EERIWSLLEQALKALDYLHTAEKRIV

SEQ ID NO: 3184939 - protein, 25 aa, Giardia lamblia
EERKRLLGRYMSQLNQIAVIRTSQV

SEQ ID NO: 3184940 - protein, 17 aa, Giardia lamblia
EERLELEEAYKTRRINF

SEQ ID NO: 3184941 - protein, 19 aa, Giardia lamblia
EERMLIMARCVQNRVSSLR

SEQ ID NO: 3184942 - protein, 18 aa, Giardia lamblia
EERPPPYRIGNVDNLSAI

SEQ ID NO: 3184943 - protein, 26 aa, Giardia lamblia
EERQYLAYMALMAEIDEEHGVVARPL

SEQ ID NO: 3184944 - protein, 23 aa, Giardia lamblia
EERSFLYDKPSIQLPTDSFKPNV

SEQ ID NO: 3184945 - protein, 27 aa, Giardia lamblia
EERSFYQISRIYPVLATSGFRTAEIHR

SEQ ID NO: 3184946 - protein, 19 aa, Giardia lamblia
EERVVTILSAFWNINAFDQ

SEQ ID NO: 3184947 - protein, 25 aa, Giardia lamblia
EESIPNYVLLKYVLYEALKRVVEEL

SEQ ID NO: 3184948 - protein, 26 aa, Giardia lamblia
EESRDRLIEIIARLTLELAGARNIKA

SEQ ID NO: 3184949 - protein, 24 aa, Giardia lamblia
EETDPHIYRVPVKRGKQFICLLKM

SEQ ID NO: 3184950 - protein, 19 aa, Giardia lamblia
EETGILYKPPYAGEWAQGL

SEQ ID NO: 3184951 - protein, 27 aa, Giardia lamblia
EETQLYLGPFLWDPYCYYHQDLKAILP

SEQ ID NO: 3184952 - protein, 25 aa, Giardia lamblia
EETRRLMKKIIALEAGYFGTSSNHS

SEQ ID NO: 3184953 - protein, 24 aa, Giardia lamblia
EEVDAIVNAFWYDEKLYLTGAEAK

SEQ ID NO: 3184954 - protein, 20 aa, Giardia lamblia
EEVDNLLLSGKLKALQSISL

SEQ ID NO: 3184955 - protein, 28 aa, Giardia lamblia
EEVEVQSILRIYIALDGSASSYHVCDLT

SEQ ID NO: 3184956 - protein, 22 aa, Giardia lamblia
EEVHAFKAFLDIGLARASTGAR

SEQ ID NO: 3184957 - protein, 29 aa, Giardia lamblia
EEVIRKHAMFLLRLNKLGANVLPQYSRNL

SEQ ID NO: 3184958 - protein, 25 aa, Giardia lamblia
EEVQAILAHPFRPSGAPIVAKPVPK

SEQ ID NO: 3184959 - protein, 28 aa, Giardia lamblia
EEVVNNVCFVYPLAPLFGSRSFHSKAKL

SEQ ID NO: 3184960 - protein, 17 aa, Giardia lamblia
EEWGISCWLFANTGELY

SEQ ID NO: 3184961 - protein, 25 aa, Giardia lamblia
EEYARLVCALLDIPVGESLIESLHM

SEQ ID NO: 3184962 - protein, 22 aa, Giardia lamblia
EEYKGIPAGATALLIAATRGHA

SEQ ID NO: 3184963 - protein, 29 aa, Giardia lamblia
EEYNPDLIFVKLWVSDPVLAVILSDQFTD

SEQ ID NO: 3184964 - protein, 37 aa, Giardia lamblia
EEYQQYDFIIFDRWLPSTSAFILFKMSDGYITKEQGQ

SEQ ID NO: 3184965 - protein, 20 aa, Giardia lamblia
EEYRRTVLSLGIIDLETKTA

SEQ ID NO: 3184966 - protein, 22 aa, Giardia lamblia
EEYVRYLSILVRLVLTDTSGSV

SEQ ID NO: 3184967 - protein, 23 aa, Giardia lamblia
EFACLKYLPKPLETIPIRTEIGV

SEQ ID NO: 3184968 - protein, 27 aa, Giardia lamblia
EFAGSFVRLLPFYFKYENIHSTQPDSK

SEQ ID NO: 3184969 - protein, 27 aa, Giardia lamblia
EFCINTPVHILRRLPLDKFNVVNTGFP

SEQ ID NO: 3184970 - protein, 30 aa, Giardia lamblia
EFCNGISSPLMLAVLKSYLASASKFDYCAM

SEQ ID NO: 3184971 - protein, 25 aa, Giardia lamblia
EFDERKISWIVIRSFGRINESEARA

SEQ ID NO: 3184972 - protein, 25 aa, Giardia lamblia
EFEGTREFTMPLTENLRGIGENKDS

SEQ ID NO: 3184973 - protein, 33 aa, Giardia lamblia
EFEKKRFLYRRFLKYLHQWAPKQPSQLVPFIES

SEQ ID NO: 3184974 - protein, 18 aa, Giardia lamblia
EFEKYFKSASLLEKSSDM

SEQ ID NO: 3184975 - protein, 19 aa, Giardia lamblia
EFFGYYSFSDWIDGIIARL

SEQ ID NO: 3184976 - protein, 26 aa, Giardia lamblia
EFHLDKAFFIGYMTNLLLQTVVGRRS

SEQ ID NO: 3184977 - protein, 17 aa, Giardia lamblia
EFHQGSFGPERLCLLSA

SEQ ID NO: 3184978 - protein, 25 aa, Giardia lamblia
EFIAHRLGLIPLRTAGSLSAISYWY

SEQ ID NO: 3184979 - protein, 22 aa, Giardia lamblia
EFIAQGLAFDKATGKLFCKVCN

SEQ ID NO: 3184980 - protein, 18 aa, Giardia lamblia
EFIIRVRSMLEIEYNYLL

SEQ ID NO: 3184981 - protein, 23 aa, Giardia lamblia
EFILNVCLHFRTAGRRRSSTVGM

SEQ ID NO: 3184982 - protein, 22 aa, Giardia lamblia
EFILRSFRPTYRAWHLAAQAAD

SEQ ID NO: 3184983 - protein, 17 aa, Giardia lamblia
EFIPDRLYYATITGSSS

SEQ ID NO: 3184984 - protein, 26 aa, Giardia lamblia
EFIQPLDPYMTFIGLRRESDLKELID

SEQ ID NO: 3184985 - protein, 20 aa, Giardia lamblia
EFIYADQILHRYANLKTTHA

SEQ ID NO: 3184986 - protein, 22 aa, Giardia lamblia
EFIYECLLALKNSDSAAYEAAV

SEQ ID NO: 3184987 - protein, 26 aa, Giardia lamblia
EFKDTIFNGIYAFPGPCGTYFVTRNS

SEQ ID NO: 3184988 - protein, 26 aa, Giardia lamblia
EFKESASVLKLFYSQSSDLIIIVLVN

SEQ ID NO: 3184989 - protein, 26 aa, Giardia lamblia
EFKRLQLMPPRYMFVDFDGIDLSEWE

SEQ ID NO: 3184990 - protein, 24 aa, Giardia lamblia
EFLAAGVYQAMHPSLADGLKVDKK

SEQ ID NO: 3184991 - protein, 23 aa, Giardia lamblia
EFLATSFRNSPFVALKVVTAGSA

SEQ ID NO: 3184992 - protein, 20 aa, Giardia lamblia
EFLDANLSLLPLPVSVDNEG

SEQ ID NO: 3184993 - protein, 19 aa, Giardia lamblia
EFLFKTGRITWNDVIAWMN

SEQ ID NO: 3184994 - protein, 17 aa, Giardia lamblia
EFMLLANRLAAEYTLEK

SEQ ID NO: 3184995 - protein, 24 aa, Giardia lamblia
EFNEDKRWWLDQTADWYESFRWDT

SEQ ID NO: 3184996 - protein, 19 aa, Giardia lamblia
EFNKVCELGISREEFLFLG

SEQ ID NO: 3184997 - protein, 32 aa, Giardia lamblia
EFNLRRTAIQNIITWSFEMWRRERQAQWEGEM

SEQ ID NO: 3184998 - protein, 21 aa, Giardia lamblia
EFNTRWLVRESTNNDFLVLMR

SEQ ID NO: 3184999 - protein, 26 aa, Giardia lamblia
EFPIDKKILKPSWKNSLLLMNQAGFL

SEQ ID NO: 3185000 - protein, 24 aa, Giardia lamblia
EFPKADIIHFLDIYLGCANPVVES

SEQ ID NO: 3185001 - protein, 23 aa, Giardia lamblia
EFQHKIYIDCLTRVTKPQFGPIC

SEQ ID NO: 3185002 - protein, 20 aa, Giardia lamblia
EFQIKLMHLIRKGMSGDQQS

SEQ ID NO: 3185003 - protein, 17 aa, Giardia lamblia
EFQIRNWLKNYDERCID

SEQ ID NO: 3185004 - protein, 23 aa, Giardia lamblia
EFRLGVFEDFLKQRLRPHNQRLV

SEQ ID NO: 3185005 - protein, 20 aa, Giardia lamblia
EFRPRRFFSIDRVYRNETLD

SEQ ID NO: 3185006 - protein, 23 aa, Giardia lamblia
EFRRACDLIAKQVAHLRDLSPLW

SEQ ID NO: 3185007 - protein, 22 aa, Giardia lamblia
EFRRVCIIKGIYPQVPPKKFAG

SEQ ID NO: 3185008 - protein, 18 aa, Giardia lamblia
EFRYFPLHSSLASQIKTF

SEQ ID NO: 3185009 - protein, 21 aa, Giardia lamblia
EFSAHLLAALTVRGYEPEYEI

SEQ ID NO: 3185010 - protein, 24 aa, Giardia lamblia
EFSPRVYLNFRKTFKKNRIELSCS

SEQ ID NO: 3185011 - protein, 17 aa, Giardia lamblia
EFTKINRLFISIELQLI

SEQ ID NO: 3185012 - protein, 24 aa, Giardia lamblia
EFTSYERILRWVSAYGSYILGGHA

SEQ ID NO: 3185013 - protein, 17 aa, Giardia lamblia
EFYLSLFRENKPNTDLA

SEQ ID NO: 3185014 - protein, 25 aa, Giardia lamblia
EFYNEAEFYPIPFTDPRKMSASGAL

SEQ ID NO: 3185015 - protein, 26 aa, Giardia lamblia
EFYSDTQGLLLIFDMSNRDSFTALEK

SEQ ID NO: 3185016 - protein, 25 aa, Giardia lamblia
EGAAWLAILTLDKFPRKVSYTIRDV

SEQ ID NO: 3185017 - protein, 29 aa, Giardia lamblia
EGACNCKKCWIYPRLGCYCFNFNKHLATH

SEQ ID NO: 3185018 - protein, 19 aa, Giardia lamblia
EGAKAMYSFNKLSDKCRRY

SEQ ID NO: 3185019 - protein, 28 aa, Giardia lamblia
EGAPRQQRILTRHNLLSERPQVGESQSY

SEQ ID NO: 3185020 - protein, 24 aa, Giardia lamblia
EGATALMFAAWYGQSEAAKVLLGR

SEQ ID NO: 3185021 - protein, 24 aa, Giardia lamblia
EGCKLDNLTIIYTPAENLRKDGTM

SEQ ID NO: 3185022 - protein, 24 aa, Giardia lamblia
EGCTLRVYMFFPEDYPIAPPKVQF

SEQ ID NO: 3185023 - protein, 20 aa, Giardia lamblia
EGDFALRRAVHKRMRGVIST

SEQ ID NO: 3185024 - protein, 17 aa, Giardia lamblia
EGDLHFALAPDLEAPES

SEQ ID NO: 3185025 - protein, 25 aa, Giardia lamblia
EGDLIKLGYFSLHQVLGSNSLIRDA

SEQ ID NO: 3185026 - protein, 34 aa, Giardia lamblia
EGDMPIVRKDGCTPLFQAVFWNKPDCVRALAPKY

SEQ ID NO: 3185027 - protein, 18 aa, Giardia lamblia
EGDWVCLQNCHLCLSWMP

SEQ ID NO: 3185028 - protein, 28 aa, Giardia lamblia
EGENQPRWVPWMQTIPEFSIDSLGTGPN

SEQ ID NO: 3185029 - protein, 31 aa, Giardia lamblia
EGETALVKAIRWNAIDMIEVLLREKHVLTNN

SEQ ID NO: 3185030 - protein, 17 aa, Giardia lamblia
EGETYVILELITEFFRF

SEQ ID NO: 3185031 - protein, 26 aa, Giardia lamblia
EGEVWKVLYDICRGLLYLHSKVRTTE

SEQ ID NO: 3185032 - protein, 29 aa, Giardia lamblia
EGFICTYRKLLYDHYLALVCKRHVNIADI

SEQ ID NO: 3185033 - protein, 23 aa, Giardia lamblia
EGFTALMILAQQSPITKGHIDVL

SEQ ID NO: 3185034 - protein, 26 aa, Giardia lamblia
EGFVRALVHPLALLLSKLIQADAGPH

SEQ ID NO: 3185035 - protein, 24 aa, Giardia lamblia
EGGRDPLVLLSKDRFFTIIDIDKT

SEQ ID NO: 3185036 - protein, 29 aa, Giardia lamblia
EGGYNISIRAPLDFLFEKSPVHDTLQTIY

SEQ ID NO: 3185037 - protein, 21 aa, Giardia lamblia
EGHIKLGVFGLSATLDELYSL

SEQ ID NO: 3185038 - protein, 22 aa, Giardia lamblia
EGHMKCVQLLYGEINLGGFTML

SEQ ID NO: 3185039 - protein, 24 aa, Giardia lamblia
EGHTGPVVCILLSQNKRHMYTGSW

SEQ ID NO: 3185040 - protein, 22 aa, Giardia lamblia
EGIEFCLLNCYAARTEVLTLQP

SEQ ID NO: 3185041 - protein, 26 aa, Giardia lamblia
EGIEREHSMLYSKFSSLITSTKEFLL

SEQ ID NO: 3185042 - protein, 24 aa, Giardia lamblia
EGIFAHLGLLFTPSFESVVLDRRQ

SEQ ID NO: 3185043 - protein, 25 aa, Giardia lamblia
EGIQADNFWLYQTSDFMTASPSSAT

SEQ ID NO: 3185044 - protein, 28 aa, Giardia lamblia
EGITEPCRLCQLIYIGVRTRFQLLKLGR

SEQ ID NO: 3185045 - protein, 23 aa, Giardia lamblia
EGKETARPIFWIHAAHNSRVRAF

SEQ ID NO: 3185046 - protein, 17 aa, Giardia lamblia
EGKKLLELLQNNGLLEN

SEQ ID NO: 3185047 - protein, 20 aa, Giardia lamblia
EGKLFQVEYAFRAVKTSGLS

SEQ ID NO: 3185048 - protein, 35 aa, Giardia lamblia
EGKLLDTLYEHILTSYLELLQQISCFKNAREDILL

SEQ ID NO: 3185049 - protein, 19 aa, Giardia lamblia
EGKLLKQGIQTPLMNAASH

SEQ ID NO: 3185050 - protein, 17 aa, Giardia lamblia
EGKPYRYKPIVVTQDEV

SEQ ID NO: 3185051 - protein, 24 aa, Giardia lamblia
EGLCMALPEKFPTFASLVKLWKNE

SEQ ID NO: 3185052 - protein, 17 aa, Giardia lamblia
EGLLGPSPPPRGRRILC

SEQ ID NO: 3185053 - protein, 17 aa, Giardia lamblia
EGLLPLELAVRTENFEA

SEQ ID NO: 3185054 - protein, 22 aa, Giardia lamblia
EGLNLFAFTYDWRQALHIASIQ

SEQ ID NO: 3185055 - protein, 17 aa, Giardia lamblia
EGLNQPIRQYITNLQQE

SEQ ID NO: 3185056 - protein, 34 aa, Giardia lamblia
EGLPPAACLSPKKPVVWFYISGRFCELNLLKVKR

SEQ ID NO: 3185057 - protein, 21 aa, Giardia lamblia
EGLRLLGMAYEGRGPWAELIK

SEQ ID NO: 3185058 - protein, 18 aa, Giardia lamblia
EGLVSRLVRWYNITYNHV

SEQ ID NO: 3185059 - protein, 17 aa, Giardia lamblia
EGLYRSMVEELSELTLT

SEQ ID NO: 3185060 - protein, 23 aa, Giardia lamblia
EGMTALMLAAQNGHLECCKLLCS

SEQ ID NO: 3185061 - protein, 22 aa, Giardia lamblia
EGMVTRTIRYLFQQRQAREGSA

SEQ ID NO: 3185062 - protein, 20 aa, Giardia lamblia
EGNPIFVEFLNNLFKSDNAR

SEQ ID NO: 3185063 - protein, 20 aa, Giardia lamblia
EGNSILFIDEIHTLIGAGGS

SEQ ID NO: 3185064 - protein, 19 aa, Giardia lamblia
EGPCRRRSLSSKGSEGRVS

SEQ ID NO: 3185065 - protein, 21 aa, Giardia lamblia
EGPFLQHMQGFIPVFVCRMTL

SEQ ID NO: 3185066 - protein, 19 aa, Giardia lamblia
EGPFYSKRKILQTVLELVQ

SEQ ID NO: 3185067 - protein, 26 aa, Giardia lamblia
EGPIEVRRIWRTPHSTGRPVPTPQTD

SEQ ID NO: 3185068 - protein, 25 aa, Giardia lamblia
EGPKQRIFLMNLWESSLSLIVKAFF

SEQ ID NO: 3185069 - protein, 17 aa, Giardia lamblia
EGRFLHVSLPSFELIHV

SEQ ID NO: 3185070 - protein, 29 aa, Giardia lamblia
EGRGPALVRLVMVNPYLLLMDHSAPLLRH

SEQ ID NO: 3185071 - protein, 21 aa, Giardia lamblia
EGRLTYAKFKESNAMFSVTAA

SEQ ID NO: 3185072 - protein, 23 aa, Giardia lamblia
EGRLVYLHKGTCLRIAGAYWRTG

SEQ ID NO: 3185073 - protein, 23 aa, Giardia lamblia
EGRRRILYSFMSPELPELLALYP

SEQ ID NO: 3185074 - protein, 37 aa, Giardia lamblia
EGRSALMYAVLLEPDECLPFVKLLIGLTGIQDENGET

SEQ ID NO: 3185075 - protein, 23 aa, Giardia lamblia
EGRTMPLSRFTNPPPPPQRQAKQ

SEQ ID NO: 3185076 - protein, 28 aa, Giardia lamblia
EGRVPYITWRMPSMPVVSLKGAAKAGSL

SEQ ID NO: 3185077 - protein, 31 aa, Giardia lamblia
EGSAEIQFVVSFLELYLDNTYDLLDDKPPVQ

SEQ ID NO: 3185078 - protein, 21 aa, Giardia lamblia
EGSELAAYPLQLDCCGLIRQA

SEQ ID NO: 3185079 - protein, 25 aa, Giardia lamblia
EGSKHIPYRDSKLTRLLQDSLGGNS

SEQ ID NO: 3185080 - protein, 24 aa, Giardia lamblia
EGSKRYMALLSYNYKCTLEDYLRE

SEQ ID NO: 3185081 - protein, 18 aa, Giardia lamblia
EGSLRKRALDAEKELQIV

SEQ ID NO: 3185082 - protein, 27 aa, Giardia lamblia
EGSSEADIWIAYYPSYTILGDPHYNVL

SEQ ID NO: 3185083 - protein, 25 aa, Giardia lamblia
EGSTALIKNTALAAPRKPASPTQNR

SEQ ID NO: 3185084 - protein, 23 aa, Giardia lamblia
EGTLKGPAFSLSGRTGIDAKNTN

SEQ ID NO: 3185085 - protein, 23 aa, Giardia lamblia
EGTNMLLGFLQSKELALICVDIG

SEQ ID NO: 3185086 - protein, 18 aa, Giardia lamblia
EGTTALMLALLFGHVKCC

SEQ ID NO: 3185087 - protein, 21 aa, Giardia lamblia
EGTTTIMRYQLRSEPPPIKSA

SEQ ID NO: 3185088 - protein, 31 aa, Giardia lamblia
EGTYPIHVAIKHGFIDLALYLLEYNSDVLDR

SEQ ID NO: 3185089 - protein, 17 aa, Giardia lamblia
EGVLTLILATTSSPYTA

SEQ ID NO: 3185090 - protein, 17 aa, Giardia lamblia
EGVPFPGPSFTGANTFL

SEQ ID NO: 3185091 - protein, 26 aa, Giardia lamblia
EGVTATIPVLLPYYGTMKDANGWTPL

SEQ ID NO: 3185092 - protein, 27 aa, Giardia lamblia
EGYARSFLFLCNRLGIPCIFVTGRSNG

SEQ ID NO: 3185093 - protein, 24 aa, Giardia lamblia
EGYGALFHALPYSALSTLSFEHSP

SEQ ID NO: 3185094 - protein, 24 aa, Giardia lamblia
EGYTALMLAALNDAEDLCKILLSY

SEQ ID NO: 3185095 - protein, 31 aa, Giardia lamblia
EGYTPPTLTIFPYVACYLGARIYIVTNAAGG

SEQ ID NO: 3185096 - protein, 25 aa, Giardia lamblia
EHAEPISDCLKWLKTARSTFDPTLV

SEQ ID NO: 3185097 - protein, 24 aa, Giardia lamblia
EHDATPLLYLVAVVSHCYCSDACF

SEQ ID NO: 3185098 - protein, 26 aa, Giardia lamblia
EHDKLQLLYNFYLMKAKSFSARHKAE

SEQ ID NO: 3185099 - protein, 18 aa, Giardia lamblia
EHDLVRFLDKWNPLSVFA

SEQ ID NO: 3185100 - protein, 20 aa, Giardia lamblia
EHFAALFTRIMKRAALDTFV

SEQ ID NO: 3185101 - protein, 23 aa, Giardia lamblia
EHFSDVFYMMDAKWVYDLVEKQE

SEQ ID NO: 3185102 - protein, 18 aa, Giardia lamblia
EHFTITYTATDNKYVLAC

SEQ ID NO: 3185103 - protein, 24 aa, Giardia lamblia
EHFVIADFGLCKDALWSGSTLMGV

SEQ ID NO: 3185104 - protein, 29 aa, Giardia lamblia
EHFVIADFGLCRDALWSESTLMGIMAYMA

SEQ ID NO: 3185105 - protein, 21 aa, Giardia lamblia
EHGLPLVGTLQRDAIKHYRFL

SEQ ID NO: 3185106 - protein, 17 aa, Giardia lamblia
EHIAKLEEQLLARDKAL

SEQ ID NO: 3185107 - protein, 24 aa, Giardia lamblia
EHIQKLSFLFRCYERLALDAIDHV

SEQ ID NO: 3185108 - protein, 18 aa, Giardia lamblia
EHLELRQDLVDRESILAL

SEQ ID NO: 3185109 - protein, 25 aa, Giardia lamblia
EHLYAIRRRCLPLIYARLTEDQADA

SEQ ID NO: 3185110 - protein, 25 aa, Giardia lamblia
EHMAYSLLCWLVKLLTTAEQSVAVA

SEQ ID NO: 3185111 - protein, 25 aa, Giardia lamblia
EHNELALSFVALKESLQKAESLRLE

SEQ ID NO: 3185112 - protein, 23 aa, Giardia lamblia
EHNLTTFFTSLIDLLRAQYQNNL

SEQ ID NO: 3185113 - protein, 18 aa, Giardia lamblia
EHPALFIKGKLIIPKKYG

SEQ ID NO: 3185114 - protein, 41 aa, Giardia lamblia
EHPTLMKVYDIFYAPYKSTFTLVTEYLPRSLYSVVEDGYCN

SEQ ID NO: 3185115 - protein, 23 aa, Giardia lamblia
EHRAYLRCSVITWGDCIKLAYYL

SEQ ID NO: 3185116 - protein, 23 aa, Giardia lamblia
EHSDIKMAFLGLQEENKKLLQEQ

SEQ ID NO: 3185117 - protein, 22 aa, Giardia lamblia
EHSMGLTFRHAKGSATIDPDEF

SEQ ID NO: 3185118 - protein, 34 aa, Giardia lamblia
EHSQAADWWTLGIFIYECLYGVTPFMSKGASLDT

SEQ ID NO: 3185119 - protein, 25 aa, Giardia lamblia
EHSTSASAFLLSGKFVRLLSPQIET

SEQ ID NO: 3185120 - protein, 46 aa, Giardia lamblia
EHVDKSIVYVFLLQDLLFIEAMRETVLALLPRLFKKLQKMMDAYEL

SEQ ID NO: 3185121 - protein, 19 aa, Giardia lamblia
EHVNTCTFILRGGADQFIQ

SEQ ID NO: 3185122 - protein, 27 aa, Giardia lamblia
EHYSGMQPLYLRGAVVVLLCYDMTNRL

SEQ ID NO: 3185123 - protein, 31 aa, Giardia lamblia
EIADGFLKDILRRLLVLNPTNRLSAIDLANM

SEQ ID NO: 3185124 - protein, 21 aa, Giardia lamblia
EIADLRLRLGQLEKENLALRK

SEQ ID NO: 3185125 - protein, 28 aa, Giardia lamblia
EIAEELLWRIFYCLLHAIQHLELNKIST

SEQ ID NO: 3185126 - protein, 31 aa, Giardia lamblia
EIAKEMMINAGPPAFLFNNSPAAVPTKRGME

SEQ ID NO: 3185127 - protein, 29 aa, Giardia lamblia
EIAKRICVNGFLSKILHLMETNPSMSTLH

SEQ ID NO: 3185128 - protein, 37 aa, Giardia lamblia
EIARPLLRPSLWDTFFYNSFLEFFSNPGYRPNIMYLL

SEQ ID NO: 3185129 - protein, 17 aa, Giardia lamblia
EIASLLRGSTPSVNGCN

SEQ ID NO: 3185130 - protein, 24 aa, Giardia lamblia
EIAVALRRVLKLPATQICAPLLSL

SEQ ID NO: 3185131 - protein, 20 aa, Giardia lamblia
EIAYLLAPKERGMRTKKGRT

SEQ ID NO: 3185132 - protein, 18 aa, Giardia lamblia
EIDILQRSIKAKDAIIDS

SEQ ID NO: 3185133 - protein, 26 aa, Giardia lamblia
EIDNILNQYLNRYGISYTGSVAADEQ

SEQ ID NO: 3185134 - protein, 24 aa, Giardia lamblia
EIDRLKKQLAYQENPILERTAINE

SEQ ID NO: 3185135 - protein, 29 aa, Giardia lamblia
EIDRLLRINSQLNERLLQPPRSRVSPSTR

SEQ ID NO: 3185136 - protein, 24 aa, Giardia lamblia
EIDRLRACLQTPPLSSFSVQPSLT

SEQ ID NO: 3185137 - protein, 21 aa, Giardia lamblia
EIDSVPLDPSLLTAPGILVQH

SEQ ID NO: 3185138 - protein, 28 aa, Giardia lamblia
EIEALKTKVMKYKLLVDSIQVEIKQFCG

SEQ ID NO: 3185139 - protein, 24 aa, Giardia lamblia
EIECLRRQLQVMKSLPISRSATPA

SEQ ID NO: 3185140 - protein, 32 aa, Giardia lamblia
EIEGRRLMYVSARRLCMLKAQIACLEVSLQSY

SEQ ID NO: 3185141 - protein, 28 aa, Giardia lamblia
EIEHLRKELRRMQIISMALLDEELTHSA

SEQ ID NO: 3185142 - protein, 37 aa, Giardia lamblia
EIEIRLGYYSKYRRLPPTLLSALRRLANNQGTISFSI

SEQ ID NO: 3185143 - protein, 25 aa, Giardia lamblia
EIEKRDQLLLKAKLSIQSLSSENDT

SEQ ID NO: 3185144 - protein, 23 aa, Giardia lamblia
EIEPYAMLIINTPHFTRLRYLSQ

SEQ ID NO: 3185145 - protein, 23 aa, Giardia lamblia
EIEQFFAYVITKYDLQLRTINGL

SEQ ID NO: 3185146 - protein, 18 aa, Giardia lamblia
EIESLRTALSLLTRKHEV

SEQ ID NO: 3185147 - protein, 31 aa, Giardia lamblia
EIETQVFYDKKIHTSVLPFLMSTNITHRQLI

SEQ ID NO: 3185148 - protein, 33 aa, Giardia lamblia
EIEYNIFNVYRWRPTWHDLKGWGDPHPLPSIAD

SEQ ID NO: 3185149 - protein, 17 aa, Giardia lamblia
EIFAELLKPKRTKKIRS

SEQ ID NO: 3185150 - protein, 28 aa, Giardia lamblia
EIFCSVLPADTLLDIRPARLPKIRSPTE

SEQ ID NO: 3185151 - protein, 23 aa, Giardia lamblia
EIFICPFCMRYIRKKKTYTAHIQ

SEQ ID NO: 3185152 - protein, 17 aa, Giardia lamblia
EIFNSAAGDFQSMILYL

SEQ ID NO: 3185153 - protein, 25 aa, Giardia lamblia
EIGGLSIPIFLRSEGWRLINEAIEV

SEQ ID NO: 3185154 - protein, 24 aa, Giardia lamblia
EIGGRVLIIRPYSDRPPERDNAQK

SEQ ID NO: 3185155 - protein, 20 aa, Giardia lamblia
EIGYLKAINGHALPPPPPYL

SEQ ID NO: 3185156 - protein, 20 aa, Giardia lamblia
EIHLFQQLDGKLTTRYLRVL

SEQ ID NO: 3185157 - protein, 19 aa, Giardia lamblia
EIHRKAQSTLLKCLRRENS

SEQ ID NO: 3185158 - protein, 36 aa, Giardia lamblia
EIIEISDSIYPLSALTSMVMTFFAKGVELSNAVNLA

SEQ ID NO: 3185159 - protein, 31 aa, Giardia lamblia
EIIELLSKDPTFKFLMKDLLIATESFSKELA

SEQ ID NO: 3185160 - protein, 21 aa, Giardia lamblia
EIIETLKRKLAEYEKGGTLGS

SEQ ID NO: 3185161 - protein, 24 aa, Giardia lamblia
EIIKDIFYQLIKAVAYIHKRNILH

SEQ ID NO: 3185162 - protein, 22 aa, Giardia lamblia
EIIKLKGLPDYSDGKFILVGPS

SEQ ID NO: 3185163 - protein, 19 aa, Giardia lamblia
EIIMAQYDMSIPGVAVYNT

SEQ ID NO: 3185164 - protein, 19 aa, Giardia lamblia
EIITLPPLTDNMTGDFSRL

SEQ ID NO: 3185165 - protein, 19 aa, Giardia lamblia
EIKFLTFGMKKKLTAEQIS

SEQ ID NO: 3185166 - protein, 23 aa, Giardia lamblia
EIKLHLLEKLSSPLVWSVEYVDG

SEQ ID NO: 3185167 - protein, 17 aa, Giardia lamblia
EILAHYRELGIPNCIKQ

SEQ ID NO: 3185168 - protein, 19 aa, Giardia lamblia
EILAIRSIIGTDRFIQGMS

SEQ ID NO: 3185169 - protein, 19 aa, Giardia lamblia
EILELRKQLTMVQSGILDS

SEQ ID NO: 3185170 - protein, 19 aa, Giardia lamblia
EILHFMADPVIRVPFKTVP

SEQ ID NO: 3185171 - protein, 28 aa, Giardia lamblia
EILMHQSEIGLLKKELYLRDEETRRLMK

SEQ ID NO: 3185172 - protein, 18 aa, Giardia lamblia
EILNVEILTPGDNKPRVG

SEQ ID NO: 3185173 - protein, 26 aa, Giardia lamblia
EILPEADVLALLWRAMELLSEEPTVI

SEQ ID NO: 3185174 - protein, 18 aa, Giardia lamblia
EILPLMEQIIRSATNRDA

SEQ ID NO: 3185175 - protein, 25 aa, Giardia lamblia
EILQCMYYRHIVRFYASFGDPEADV

SEQ ID NO: 3185176 - protein, 25 aa, Giardia lamblia
EILSSLYELAYRKPKFIFTIGDGTV

SEQ ID NO: 3185177 - protein, 20 aa, Giardia lamblia
EIMALQITLDKASTIVSPKF

SEQ ID NO: 3185178 - protein, 44 aa, Giardia lamblia
EIMEIPSLDFFLGVQFHPELLSRPLKPHPLFVGLIGAALAKKRG

SEQ ID NO: 3185179 - protein, 18 aa, Giardia lamblia
EIMIHRLKHITLVWAAKF

SEQ ID NO: 3185180 - protein, 28 aa, Giardia lamblia
EIMLTDLMPVFLTIIAFGITNPVTYEFI

SEQ ID NO: 3185181 - protein, 18 aa, Giardia lamblia
EIMREKYPFMTELHVQSK

SEQ ID NO: 3185182 - protein, 26 aa, Giardia lamblia
EINRRINIPLILPKNVPTPRFGVSSI

SEQ ID NO: 3185183 - protein, 24 aa, Giardia lamblia
EINSCTHLLRFTNRLGKTALMVAA

SEQ ID NO: 3185184 - protein, 17 aa, Giardia lamblia
EIPALTAIQSRVMSRDI

SEQ ID NO: 3185185 - protein, 19 aa, Giardia lamblia
EIPDLPLLKNPLKSSKPSK

SEQ ID NO: 3185186 - protein, 24 aa, Giardia lamblia
EIPGFWVQTVANLYARLLRAHRVP

SEQ ID NO: 3185187 - protein, 24 aa, Giardia lamblia
EIQADCLLVASVLDLICGVTQLRQ

SEQ ID NO: 3185188 - protein, 24 aa, Giardia lamblia
EIQCDEFLRRLGIAPEAETIERSV

SEQ ID NO: 3185189 - protein, 18 aa, Giardia lamblia
EIQCLYFDIIGPSSGEFE

SEQ ID NO: 3185190 - protein, 17 aa, Giardia lamblia
EIQELTRKLGTLEAQLG

SEQ ID NO: 3185191 - protein, 22 aa, Giardia lamblia
EIQRLQSLLLHTADVRAASLTY

SEQ ID NO: 3185192 - protein, 22 aa, Giardia lamblia
EIRMRDCSGWTALMSAAWNGHL

SEQ ID NO: 3185193 - protein, 23 aa, Giardia lamblia
EIRNYLTPQLSQKGIKYAGQLNS

SEQ ID NO: 3185194 - protein, 27 aa, Giardia lamblia
EIRVRVSTVLRLFGRKPSSHRSARPVS

SEQ ID NO: 3185195 - protein, 31 aa, Giardia lamblia
EISAFDMAYLLEGLMMLLPPSHTRKPDRAEP

SEQ ID NO: 3185196 - protein, 18 aa, Giardia lamblia
EISFLLIGSLICLFEERN

SEQ ID NO: 3185197 - protein, 21 aa, Giardia lamblia
EISIIDAFVQLVKRIQCCIQE

SEQ ID NO: 3185198 - protein, 21 aa, Giardia lamblia
EISKRIPVIRIRWANYRSAKE

SEQ ID NO: 3185199 - protein, 29 aa, Giardia lamblia
EISQQLPPTHPIRLGLALNFSVFYYEILA

SEQ ID NO: 3185200 - protein, 23 aa, Giardia lamblia
EISRLQLQIDNLGEALLQAQIEY

SEQ ID NO: 3185201 - protein, 26 aa, Giardia lamblia
EISRVLAPIEACIIAKNGLSPLMIAC

SEQ ID NO: 3185202 - protein, 24 aa, Giardia lamblia
EISRYYVEILFPEDLQKEKLRVSC

SEQ ID NO: 3185203 - protein, 27 aa, Giardia lamblia
EISVLRTTLAEKLQLIESLTAEAQVSK

SEQ ID NO: 3185204 - protein, 31 aa, Giardia lamblia
EITGINQRLYFQFPALPVVSPKLLELIDKQV

SEQ ID NO: 3185205 - protein, 26 aa, Giardia lamblia
EITGRSYKFFNYFGAPDATAVVIIMG

SEQ ID NO: 3185206 - protein, 23 aa, Giardia lamblia
EITKLQFMGNPRDNIWSISGTET

SEQ ID NO: 3185207 - protein, 24 aa, Giardia lamblia
EIVALTNIFLLQESALFSETYGFT

SEQ ID NO: 3185208 - protein, 18 aa, Giardia lamblia
EIVDIFSNEICSSSSRSA

SEQ ID NO: 3185209 - protein, 19 aa, Giardia lamblia
EIVERFIHPATLSTGDALA

SEQ ID NO: 3185210 - protein, 24 aa, Giardia lamblia
EIVKEYIVTFPAKESTVYHIHFDI

SEQ ID NO: 3185211 - protein, 24 aa, Giardia lamblia
EIVKGTIKLLLICGLQEVTAKFAQ

SEQ ID NO: 3185212 - protein, 30 aa, Giardia lamblia
EIVMQIRLSPLFAFDWWFKTRTEDEIAHRA

SEQ ID NO: 3185213 - protein, 19 aa, Giardia lamblia
EIVSKFFGSAYPTILLYIV

SEQ ID NO: 3185214 - protein, 29 aa, Giardia lamblia
EIVTNSAYRTVFWLWEEQLVDKDLINVLS

SEQ ID NO: 3185215 - protein, 19 aa, Giardia lamblia
EIYKNRYLFVFLAQKKDEE

SEQ ID NO: 3185216 - protein, 20 aa, Giardia lamblia
EIYLLTEYCGKGDLLKFVKE

SEQ ID NO: 3185217 - protein, 20 aa, Giardia lamblia
EIYQYAAKPLIRSVFEGKNC

SEQ ID NO: 3185218 - protein, 24 aa, Giardia lamblia
EKAEYKPKELFSKPPSRFLADENI

SEQ ID NO: 3185219 - protein, 26 aa, Giardia lamblia
EKAIPLHVLIASFAPRIHGREDEKLA

SEQ ID NO: 3185220 - protein, 41 aa, Giardia lamblia
EKALADFFQRHIYVPLPDYNTRLRLISHFFEKMGLEQFALT

SEQ ID NO: 3185221 - protein, 24 aa, Giardia lamblia
EKAPFDVLVTFQPAMAAKLPEVKQ

SEQ ID NO: 3185222 - protein, 24 aa, Giardia lamblia
EKCVVRFHGLLLDDTYIPADFACF

SEQ ID NO: 3185223 - protein, 20 aa, Giardia lamblia
EKDALLAQFNEQLIAANDEV

SEQ ID NO: 3185224 - protein, 23 aa, Giardia lamblia
EKDREIEAFKQSIEIMANDLDRK

SEQ ID NO: 3185225 - protein, 26 aa, Giardia lamblia
EKEACRFLCQLLNGLHFLHSRRIVHR

SEQ ID NO: 3185226 - protein, 27 aa, Giardia lamblia
EKEEVLRQFMLSWELPPVVYETQHKEF

SEQ ID NO: 3185227 - protein, 21 aa, Giardia lamblia
EKEIAKLRDRLAARDQDVQDL

SEQ ID NO: 3185228 - protein, 17 aa, Giardia lamblia
EKEIRALRKELAINQEA

SEQ ID NO: 3185229 - protein, 24 aa, Giardia lamblia
EKEKKKIPLLWGPMANEFEKVQKS

SEQ ID NO: 3185230 - protein, 26 aa, Giardia lamblia
EKELKDRVFKYKSGYLRKAIQLRESE

SEQ ID NO: 3185231 - protein, 23 aa, Giardia lamblia
EKELVKLCLPPQTAPPGTRIVPS

SEQ ID NO: 3185232 - protein, 32 aa, Giardia lamblia
EKERDIRALNERLTAVPSPTGDAALLADYENK

SEQ ID NO: 3185233 - protein, 26 aa, Giardia lamblia
EKESIMLNLRTRSELIPLTNREPSGT

SEQ ID NO: 3185234 - protein, 25 aa, Giardia lamblia
EKETAFLSGLDSFLAREVEHRTHAL

SEQ ID NO: 3185235 - protein, 27 aa, Giardia lamblia
EKEVKEFYTILVRWGSLQFKKISSVLQ

SEQ ID NO: 3185236 - protein, 25 aa, Giardia lamblia
EKEVLSFSLLALQKPLQVQIDPPRT

SEQ ID NO: 3185237 - protein, 24 aa, Giardia lamblia
EKGDASFPGLAYASPEFLNREYTE

SEQ ID NO: 3185238 - protein, 23 aa, Giardia lamblia
EKGPLYRENYFTCKLRLQALDAS

SEQ ID NO: 3185239 - protein, 32 aa, Giardia lamblia
EKGQTALILSVLALRVPPLPLVQAEAAMQDFA

SEQ ID NO: 3185240 - protein, 23 aa, Giardia lamblia
EKGRFREFYQCDLDIVYEPNTQA

SEQ ID NO: 3185241 - protein, 23 aa, Giardia lamblia
EKHDLGWLLRQDGCFLEIDIEVV

SEQ ID NO: 3185242 - protein, 25 aa, Giardia lamblia
EKHDLGWLLRQDGCFLEIDIQIVPK

SEQ ID NO: 3185243 - protein, 23 aa, Giardia lamblia
EKHKSFFVALVRCSHSHASMVFS

SEQ ID NO: 3185244 - protein, 20 aa, Giardia lamblia
EKHLPDVLLLLNKDSSSQES

SEQ ID NO: 3185245 - protein, 17 aa, Giardia lamblia
EKHVTLPDGRTALMLCA

SEQ ID NO: 3185246 - protein, 28 aa, Giardia lamblia
EKHWEKVLLRTFYMIPNFPWSNCHDEFK

SEQ ID NO: 3185247 - protein, 25 aa, Giardia lamblia
EKIHQFPIPFCKSLCFTNAGNLLVA

SEQ ID NO: 3185248 - protein, 25 aa, Giardia lamblia
EKIRERILLPYTAPAHPFTRGRVGR

SEQ ID NO: 3185249 - protein, 27 aa, Giardia lamblia
EKITDAYPLSFKFLMELYTCVDSSSIY

SEQ ID NO: 3185250 - protein, 25 aa, Giardia lamblia
EKITKLLEIFLEVPIPYSQGKSAAR

SEQ ID NO: 3185251 - protein, 24 aa, Giardia lamblia
EKKAMNLWNIVFQKTLELTSDDTR

SEQ ID NO: 3185252 - protein, 21 aa, Giardia lamblia
EKKDFMDIPNDKLTVPYVTVS

SEQ ID NO: 3185253 - protein, 21 aa, Giardia lamblia
EKKMRIQAADDLLKKRAQEEE

SEQ ID NO: 3185254 - protein, 23 aa, Giardia lamblia
EKKRKTLFCPANQRKSFYVFIDD

SEQ ID NO: 3185255 - protein, 24 aa, Giardia lamblia
EKKRLLLCYDGTYVTVLYVCHERV

SEQ ID NO: 3185256 - protein, 17 aa, Giardia lamblia
EKLAELNTFLYQHRIEL

SEQ ID NO: 3185257 - protein, 17 aa, Giardia lamblia
EKLEAVQMLKFGQLIDI

SEQ ID NO: 3185258 - protein, 22 aa, Giardia lamblia
EKLKRQIADLLKRVAAAEAERD

SEQ ID NO: 3185259 - protein, 18 aa, Giardia lamblia
EKLPDPPFLPRRGHTCVS

SEQ ID NO: 3185260 - protein, 27 aa, Giardia lamblia
EKLPPVHPPLHLTSAKKKSLIKLVQDT

SEQ ID NO: 3185261 - protein, 25 aa, Giardia lamblia
EKLQLLLCFDSHKAVLYALTGLRLS

SEQ ID NO: 3185262 - protein, 24 aa, Giardia lamblia
EKLRLKRYFILFDQEQRTARIETA

SEQ ID NO: 3185263 - protein, 23 aa, Giardia lamblia
EKLSFAEELLSTVLTAPSSVKLD

SEQ ID NO: 3185264 - protein, 32 aa, Giardia lamblia
EKLSVFRRFLFFLVFSTRRKAMRRNTSWPRWT

SEQ ID NO: 3185265 - protein, 28 aa, Giardia lamblia
EKLVYGDHHDFFYPAQECGLTGPLGSRF

SEQ ID NO: 3185266 - protein, 18 aa, Giardia lamblia
EKMAGFLAKLLQLEELAA

SEQ ID NO: 3185267 - protein, 26 aa, Giardia lamblia
EKMAVQDFFFQPHYNNPWNTLNVAAI

SEQ ID NO: 3185268 - protein, 26 aa, Giardia lamblia
EKMIQFLEIAYSQILMKWSKKLELYI

SEQ ID NO: 3185269 - protein, 18 aa, Giardia lamblia
EKMLAYRKSQRAILQNLC

SEQ ID NO: 3185270 - protein, 25 aa, Giardia lamblia
EKNAELEVLLLQNDATFKDKLAIIE

SEQ ID NO: 3185271 - protein, 17 aa, Giardia lamblia
EKNITALVSLLIDRDQT

SEQ ID NO: 3185272 - protein, 25 aa, Giardia lamblia
EKNKLVKHTLLVYGYVRGTYMDPAQ

SEQ ID NO: 3185273 - protein, 29 aa, Giardia lamblia
EKNPYERLGLLPRSIVELFNLIEADTSQS

SEQ ID NO: 3185274 - protein, 19 aa, Giardia lamblia
EKQLGFGGTFGIWHMYSGR

SEQ ID NO: 3185275 - protein, 24 aa, Giardia lamblia
EKRMLNLRYLLAEEEKIRMECTKE

SEQ ID NO: 3185276 - protein, 29 aa, Giardia lamblia
EKTINSYIILFLLCIFKGPKILICSATAE

SEQ ID NO: 3185277 - protein, 17 aa, Giardia lamblia
EKTIREFERPGDLFLAL

SEQ ID NO: 3185278 - protein, 26 aa, Giardia lamblia
EKTKRSFRIGCFLIGLYDICKVTNIL

SEQ ID NO: 3185279 - protein, 24 aa, Giardia lamblia
EKTSNIINVIFGNLYRSKSTGNRD

SEQ ID NO: 3185280 - protein, 22 aa, Giardia lamblia
EKVEIQLTFAPRLDLNRIERVC

SEQ ID NO: 3185281 - protein, 19 aa, Giardia lamblia
EKVFLLGALTIRQSCNIST

SEQ ID NO: 3185282 - protein, 23 aa, Giardia lamblia
EKVGGWAALVFAARCDRSNDPLV

SEQ ID NO: 3185283 - protein, 21 aa, Giardia lamblia
EKVGRYYLVPHGTHVYFVCND

SEQ ID NO: 3185284 - protein, 24 aa, Giardia lamblia
EKVMPRVYFKLASELGYKGIAYCC

SEQ ID NO: 3185285 - protein, 23 aa, Giardia lamblia
EKVRELDTLRLLMDDSTSTAAKA

SEQ ID NO: 3185286 - protein, 17 aa, Giardia lamblia
ELAALKKDFEVAKKELE

SEQ ID NO: 3185287 - protein, 25 aa, Giardia lamblia
ELAAQLAEALAFLHSPLKARGVLAH

SEQ ID NO: 3185288 - protein, 25 aa, Giardia lamblia
ELAATLLNRALFEISSTREILLRYE

SEQ ID NO: 3185289 - protein, 17 aa, Giardia lamblia
ELAKCFYLQGNYPSVIA

SEQ ID NO: 3185290 - protein, 17 aa, Giardia lamblia
ELALWQVAAQLIDTMTY

SEQ ID NO: 3185291 - protein, 23 aa, Giardia lamblia
ELAPMKIHLLSPFVGKMSNTTPV

SEQ ID NO: 3185292 - protein, 17 aa, Giardia lamblia
ELARLVTPGFDTTKDQI

SEQ ID NO: 3185293 - protein, 28 aa, Giardia lamblia
ELARTYDFLVYPYCSLAANSPVPYIPSS

SEQ ID NO: 3185294 - protein, 26 aa, Giardia lamblia
ELASHIRGLDLMSHQLNKIIDNLTGC

SEQ ID NO: 3185295 - protein, 41 aa, Giardia lamblia
ELATGIRPNFRRTTDPRLVFVQDWKPDLILVRDKEIKKIIE

SEQ ID NO: 3185296 - protein, 20 aa, Giardia lamblia
ELATLRKPDFLGGREPEDVF

SEQ ID NO: 3185297 - protein, 40 aa, Giardia lamblia
ELCAYPLFHFCFPNVISLPLTCVLLRGWRKLLIDLASEEQ

SEQ ID NO: 3185298 - protein, 25 aa, Giardia lamblia
ELCDILAPLEWPLTLSDGKDALILA

SEQ ID NO: 3185299 - protein, 27 aa, Giardia lamblia
ELCEKRGWMFIPPYNSFDVIEGQGTIA

SEQ ID NO: 3185300 - protein, 19 aa, Giardia lamblia
ELCIQLSPRKPALYYAIRG

SEQ ID NO: 3185301 - protein, 29 aa, Giardia lamblia
ELCIRFKRENMLLWILEYCSRHSKLETAA

SEQ ID NO: 3185302 - protein, 19 aa, Giardia lamblia
ELCLLLPDEFDLIRVQALQ

SEQ ID NO: 3185303 - protein, 17 aa, Giardia lamblia
ELCRTYLEQYKDLLLRP

SEQ ID NO: 3185304 - protein, 19 aa, Giardia lamblia
ELCSIFPDIKERILKRKYI

SEQ ID NO: 3185305 - protein, 24 aa, Giardia lamblia
ELCTFRPFCLALNPMDALQKLGKL

SEQ ID NO: 3185306 - protein, 25 aa, Giardia lamblia
ELDAMNGEILIQRSALSSAQRDISA

SEQ ID NO: 3185307 - protein, 27 aa, Giardia lamblia
ELDASIQPVFPLSFYNPTHTCLQMQNA

SEQ ID NO: 3185308 - protein, 24 aa, Giardia lamblia
ELDEAMLNAILNQALCTTDYSGLL

SEQ ID NO: 3185309 - protein, 21 aa, Giardia lamblia
ELDFIPKLEQAGVQPVLLQPQ

SEQ ID NO: 3185310 - protein, 26 aa, Giardia lamblia
ELDKEKMYAMPLYTTTLRYGVLSTTG

SEQ ID NO: 3185311 - protein, 25 aa, Giardia lamblia
ELDKVKIGTLLYPKPITSIEQERED

SEQ ID NO: 3185312 - protein, 21 aa, Giardia lamblia
ELDLIFNYLKAYHVLDEIIMN

SEQ ID NO: 3185313 - protein, 23 aa, Giardia lamblia
ELDLLKCFRPSLSDPGTVVIISC

SEQ ID NO: 3185314 - protein, 18 aa, Giardia lamblia
ELDRLRALVISRGIEIAN

SEQ ID NO: 3185315 - protein, 29 aa, Giardia lamblia
ELDRYDLTLLFSISFHSVPVPHPMTLLAR

SEQ ID NO: 3185316 - protein, 23 aa, Giardia lamblia
ELDSPRSILACQRVGVLPQELNF

SEQ ID NO: 3185317 - protein, 34 aa, Giardia lamblia
ELDVDEFWKITVQLIYILILFSTIEGRRNTVGLD

SEQ ID NO: 3185318 - protein, 19 aa, Giardia lamblia
ELEAYPFAGTMKDIIFTMW

SEQ ID NO: 3185319 - protein, 22 aa, Giardia lamblia
ELEDVVINYLLNDGFPGAQKAL

SEQ ID NO: 3185320 - protein, 19 aa, Giardia lamblia
ELEGYKSKLALKEERLRTT

SEQ ID NO: 3185321 - protein, 18 aa, Giardia lamblia
ELEIHRLNLELNAASEIL

SEQ ID NO: 3185322 - protein, 19 aa, Giardia lamblia
ELEKLRPYERFYTERKCEQ

SEQ ID NO: 3185323 - protein, 23 aa, Giardia lamblia
ELEKPIMALTPIPDALKEKLNVD

SEQ ID NO: 3185324 - protein, 25 aa, Giardia lamblia
ELEKPMIFNQFLIGKPGPVAIDQWI

SEQ ID NO: 3185325 - protein, 17 aa, Giardia lamblia
ELELITFHGPWCKDCQY

SEQ ID NO: 3185326 - protein, 22 aa, Giardia lamblia
ELELKVSRLREVCTMLAGALAE

SEQ ID NO: 3185327 - protein, 20 aa, Giardia lamblia
ELELLLLRDENERLRKRSAF

SEQ ID NO: 3185328 - protein, 18 aa, Giardia lamblia
ELEMEVEMLKEDLDLREE

SEQ ID NO: 3185329 - protein, 20 aa, Giardia lamblia
ELERLKLLHHYRSRADEGAL

SEQ ID NO: 3185330 - protein, 18 aa, Giardia lamblia
ELERLRILTSDNATFFRK

SEQ ID NO: 3185331 - protein, 24 aa, Giardia lamblia
ELESFLLRRKNSILNTLKLDLLVF

SEQ ID NO: 3185332 - protein, 25 aa, Giardia lamblia
ELETIAMILNLPMELVRKASDYYAN

SEQ ID NO: 3185333 - protein, 20 aa, Giardia lamblia
ELFMDLIPCITGKSPSTTGA

SEQ ID NO: 3185334 - protein, 21 aa, Giardia lamblia
ELFSYKCLHLIFSFVGDGAHE

SEQ ID NO: 3185335 - protein, 20 aa, Giardia lamblia
ELGIKYATFSPNLTLFCVTA

SEQ ID NO: 3185336 - protein, 19 aa, Giardia lamblia
ELGIVFRLCPVAAIGCRNN

SEQ ID NO: 3185337 - protein, 23 aa, Giardia lamblia
ELGIVLYELCAKQRPFSGYDRQQ

SEQ ID NO: 3185338 - protein, 27 aa, Giardia lamblia
ELGLVSKELGIKLTLLKKAAAEIARLK

SEQ ID NO: 3185339 - protein, 25 aa, Giardia lamblia
ELGPQFTLKLKWLQKGLFDPHNEEY

SEQ ID NO: 3185340 - protein, 32 aa, Giardia lamblia
ELGRSITNIPLLPIIKALRLSPALIARTGCEV

SEQ ID NO: 3185341 - protein, 20 aa, Giardia lamblia
ELHILPVQRATYGYHELRMC

SEQ ID NO: 3185342 - protein, 22 aa, Giardia lamblia
ELHRLLTIITSLHRLERLEIGG

SEQ ID NO: 3185343 - protein, 21 aa, Giardia lamblia
ELHVYFDDNYFFISRARSGIT

SEQ ID NO: 3185344 - protein, 19 aa, Giardia lamblia
ELIDNFEWIQKLSVHLRVI

SEQ ID NO: 3185345 - protein, 24 aa, Giardia lamblia
ELIKKTQYLQRRLIQKSEECSTKN

SEQ ID NO: 3185346 - protein, 19 aa, Giardia lamblia
ELIKSKYLQSLVKLSETEV

SEQ ID NO: 3185347 - protein, 20 aa, Giardia lamblia
ELILALLEEVSIVLDLSLGN

SEQ ID NO: 3185348 - protein, 18 aa, Giardia lamblia
ELILGCSLFTESNRDLLK

SEQ ID NO: 3185349 - protein, 24 aa, Giardia lamblia
ELIQLPVIAKLLQGLAYDPARNCR

SEQ ID NO: 3185350 - protein, 21 aa, Giardia lamblia
ELITEFFRFMGLHSTAGTLEV

SEQ ID NO: 3185351 - protein, 18 aa, Giardia lamblia
ELITLQRIKALSSTILSV

SEQ ID NO: 3185352 - protein, 27 aa, Giardia lamblia
ELIVRRAADAVLLLLPTVLPVRNVFKG

SEQ ID NO: 3185353 - protein, 23 aa, Giardia lamblia
ELKEHLRPLLGARLLMRPQLFRP

SEQ ID NO: 3185354 - protein, 24 aa, Giardia lamblia
ELKFQEEYIVRLKMALKARASDLK

SEQ ID NO: 3185355 - protein, 24 aa, Giardia lamblia
ELKGHPWFNGINWDKLYRKEYTIP

SEQ ID NO: 3185356 - protein, 29 aa, Giardia lamblia
ELKGLPINYEKYRLYSDATYRQIGSGPFS

SEQ ID NO: 3185357 - protein, 18 aa, Giardia lamblia
ELKGLQLQGLPMLGARQK

SEQ ID NO: 3185358 - protein, 25 aa, Giardia lamblia
ELKHRIRKLPGIPLMSVLRGRYGIE

SEQ ID NO: 3185359 - protein, 24 aa, Giardia lamblia
ELKKEKRRIAYEQRAQLEYLSEEE

SEQ ID NO: 3185360 - protein, 24 aa, Giardia lamblia
ELKPSFGKGFLRKADALAAMGKRE

SEQ ID NO: 3185361 - protein, 38 aa, Giardia lamblia
ELKYGSFKCAFSYIFQYFLREEILYSPLSLLSFELMMR

SEQ ID NO: 3185362 - protein, 22 aa, Giardia lamblia
ELKYPSRFSPYSTLYPSRLALV

SEQ ID NO: 3185363 - protein, 22 aa, Giardia lamblia
ELLDMILCLALYIPYDGTYYEV

SEQ ID NO: 3185364 - protein, 19 aa, Giardia lamblia
ELLDRRRALKDKVVQLRTS

SEQ ID NO: 3185365 - protein, 17 aa, Giardia lamblia
ELLEIKRGIKESAFHAE

SEQ ID NO: 3185366 - protein, 30 aa, Giardia lamblia
ELLKHWENYLVWLAEFIQTGILQIVLSNVA

SEQ ID NO: 3185367 - protein, 38 aa, Giardia lamblia
ELLKILLSKYRDSFERYLYFYMSHTLTIPNFETMDSPL

SEQ ID NO: 3185368 - protein, 17 aa, Giardia lamblia
ELLLLKSVWDVVDLVFS

SEQ ID NO: 3185369 - protein, 17 aa, Giardia lamblia
ELLLPFQARRNTGCVEL

SEQ ID NO: 3185370 - protein, 19 aa, Giardia lamblia
ELLLPQEVRMKDSLGCSAL

SEQ ID NO: 3185371 - protein, 27 aa, Giardia lamblia
ELLNKLPLDLILDVQPTSWPGGGIISG

SEQ ID NO: 3185372 - protein, 18 aa, Giardia lamblia
ELLNMYYGESERAIRNVF

SEQ ID NO: 3185373 - protein, 17 aa, Giardia lamblia
ELLRASNAQIRKSVRPA

SEQ ID NO: 3185374 - protein, 17 aa, Giardia lamblia
ELLSSFYVLIGLLNERS

SEQ ID NO: 3185375 - protein, 19 aa, Giardia lamblia
ELMCLLKVYTEVDAILEIS

SEQ ID NO: 3185376 - protein, 18 aa, Giardia lamblia
ELMEGQYRIFMTELKRRL

SEQ ID NO: 3185377 - protein, 26 aa, Giardia lamblia
ELMRRDTHPFFLPTDYDKDGRIKDCM

SEQ ID NO: 3185378 - protein, 24 aa, Giardia lamblia
ELNDLRLKYNVLYKEYQELQSTHS

SEQ ID NO: 3185379 - protein, 29 aa, Giardia lamblia
ELNETNIPFLLGYYYVGKILNDYVHENRL

SEQ ID NO: 3185380 - protein, 20 aa, Giardia lamblia
ELNITTPRRLSSGGLSENKV

SEQ ID NO: 3185381 - protein, 25 aa, Giardia lamblia
ELNKSTSYLLKSSYQPPVIADGRSP

SEQ ID NO: 3185382 - protein, 21 aa, Giardia lamblia
ELNLELALSLILFELYGDEPS

SEQ ID NO: 3185383 - protein, 28 aa, Giardia lamblia
ELNLVCTSLAPLPMAPPYRTLEAAVREL

SEQ ID NO: 3185384 - protein, 24 aa, Giardia lamblia
ELNQSGCIVPLTLSLDDWCARLCA

SEQ ID NO: 3185385 - protein, 23 aa, Giardia lamblia
ELPADFPFFSVSAFNDAVIQLRS

SEQ ID NO: 3185386 - protein, 18 aa, Giardia lamblia
ELPADGYCWRKYGSKRLP

SEQ ID NO: 3185387 - protein, 26 aa, Giardia lamblia
ELPCTWPIIMLDGSIDPLWIEALNSV

SEQ ID NO: 3185388 - protein, 20 aa, Giardia lamblia
ELPFLSKQLQPPYYFNDPAL

SEQ ID NO: 3185389 - protein, 19 aa, Giardia lamblia
ELPFSLCLTLVPLESVDQN

SEQ ID NO: 3185390 - protein, 20 aa, Giardia lamblia
ELPIELGILKRLNKLRFDGN

SEQ ID NO: 3185391 - protein, 17 aa, Giardia lamblia
ELPINHPIAAFIATAAT

SEQ ID NO: 3185392 - protein, 25 aa, Giardia lamblia
ELPKQLEVDILLKRISIATDAMEKC

SEQ ID NO: 3185393 - protein, 34 aa, Giardia lamblia
ELPNGTVEYIFLQPYLSALYIHFKREVKHEPIWF

SEQ ID NO: 3185394 - protein, 25 aa, Giardia lamblia
ELPQKPIANSLLLSTGLLSDRKPNE

SEQ ID NO: 3185395 - protein, 35 aa, Giardia lamblia
ELPSYYHAIPYPRSLAYIYYKLITLSYLSLHEFVA

SEQ ID NO: 3185396 - protein, 25 aa, Giardia lamblia
ELPYRLLTRRYGVELAWTPMHSTNT

SEQ ID NO: 3185397 - protein, 23 aa, Giardia lamblia
ELQARELLAKLPYSTAEQAQMVA

SEQ ID NO: 3185398 - protein, 20 aa, Giardia lamblia
ELQEEMLELKEGFELQMRGD

SEQ ID NO: 3185399 - protein, 31 aa, Giardia lamblia
ELQEMKLRYSLLMKGMLKVCHRFSVSVDMFY

SEQ ID NO: 3185400 - protein, 32 aa, Giardia lamblia
ELQIPSLRLGTLKDLLFKLISDYEEFFLNSNA

SEQ ID NO: 3185401 - protein, 20 aa, Giardia lamblia
ELQKMYKDIGMPLMEVREDV

SEQ ID NO: 3185402 - protein, 28 aa, Giardia lamblia
ELQLNRYKYANLYIFRPDVEEKEMKEMV

SEQ ID NO: 3185403 - protein, 21 aa, Giardia lamblia
ELQSFRYYCTRSLFVSLGPAE

SEQ ID NO: 3185404 - protein, 23 aa, Giardia lamblia
ELRAKIVTMLNLEVSKTNALKAQ

SEQ ID NO: 3185405 - protein, 28 aa, Giardia lamblia
ELRAVVERLQYTVDVLARQVRELEASRG

SEQ ID NO: 3185406 - protein, 24 aa, Giardia lamblia
ELRKVKHMILYQLLDYINSSNNIF

SEQ ID NO: 3185407 - protein, 31 aa, Giardia lamblia
ELRLMSQHAWNPQQFWGTVDAVKPLITQDAD

SEQ ID NO: 3185408 - protein, 27 aa, Giardia lamblia
ELRPLEFLHSLPTFLAIPCDLGASSGL

SEQ ID NO: 3185409 - protein, 22 aa, Giardia lamblia
ELRQEARIYQRDLQKLEKDYAS

SEQ ID NO: 3185410 - protein, 27 aa, Giardia lamblia
ELRQEYKTVIDLLSTLQGKSLASAVAE

SEQ ID NO: 3185411 - protein, 25 aa, Giardia lamblia
ELRQYIDDTFLEFSSLKGQVQESMT

SEQ ID NO: 3185412 - protein, 23 aa, Giardia lamblia
ELRSLHFEVLEDRGIYDKAPLQF

SEQ ID NO: 3185413 - protein, 17 aa, Giardia lamblia
ELRYLSLQFERISAIGV

SEQ ID NO: 3185414 - protein, 17 aa, Giardia lamblia
ELSAFICAMLKPDPSAR

SEQ ID NO: 3185415 - protein, 31 aa, Giardia lamblia
ELSIRQLHRYRLFLDQLISIKDRELLVGRRE

SEQ ID NO: 3185416 - protein, 18 aa, Giardia lamblia
ELSKELVRKISFSAFQPI

SEQ ID NO: 3185417 - protein, 30 aa, Giardia lamblia
ELSKIQILGRYFVEVWKACGMLGVSKPVVF

SEQ ID NO: 3185418 - protein, 24 aa, Giardia lamblia
ELSLHLLSFLTIFSQNFHKLQEFS

SEQ ID NO: 3185419 - protein, 22 aa, Giardia lamblia
ELSLIPCFAYAEIALRDIMDSS

SEQ ID NO: 3185420 - protein, 31 aa, Giardia lamblia
ELSLKLFSDQQIPLGYFLGASKIFTAGLGQS

SEQ ID NO: 3185421 - protein, 21 aa, Giardia lamblia
ELSLSTFYLTRREKFSACIEL

SEQ ID NO: 3185422 - protein, 19 aa, Giardia lamblia
ELSLYNLITKHFLATVSPD

SEQ ID NO: 3185423 - protein, 18 aa, Giardia lamblia
ELSNILFASQIFARSIEG

SEQ ID NO: 3185424 - protein, 22 aa, Giardia lamblia
ELSNVLILSYSITPAAIFTSTS

SEQ ID NO: 3185425 - protein, 25 aa, Giardia lamblia
ELSPSLLNLPPIGSTITLPYIYTEN

SEQ ID NO: 3185426 - protein, 30 aa, Giardia lamblia
ELSPYSRWMRDSFLRFLHASHGPNWKELRL

SEQ ID NO: 3185427 - protein, 27 aa, Giardia lamblia
ELSRKHPDVLLLLDRKKELQAALESLK

SEQ ID NO: 3185428 - protein, 24 aa, Giardia lamblia
ELSRLKEMRLAQLPKIIASLQQEI

SEQ ID NO: 3185429 - protein, 29 aa, Giardia lamblia
ELSYSEFLAAWGLKPVRIFIQKDPDTSME

SEQ ID NO: 3185430 - protein, 24 aa, Giardia lamblia
ELTDLLRLVTARPGAIPKLVHARY

SEQ ID NO: 3185431 - protein, 25 aa, Giardia lamblia
ELTIQLFTLLLNRSPSYSALPYRLR

SEQ ID NO: 3185432 - protein, 23 aa, Giardia lamblia
ELTKALMVTKPSFHPPDLQKYID

SEQ ID NO: 3185433 - protein, 18 aa, Giardia lamblia
ELTLKVRYWYQMHTKAHT

SEQ ID NO: 3185434 - protein, 17 aa, Giardia lamblia
ELTLLNRATIKMVDHFK

SEQ ID NO: 3185435 - protein, 20 aa, Giardia lamblia
ELTLYLMKSISRETAYTCVE

SEQ ID NO: 3185436 - protein, 24 aa, Giardia lamblia
ELTNQFIYCPINYREAALLYICRE

SEQ ID NO: 3185437 - protein, 24 aa, Giardia lamblia
ELTRLREQLWQKHKYTTEYEPDFN

SEQ ID NO: 3185438 - protein, 34 aa, Giardia lamblia
ELTTLNLHLGALFTSLGALRKKRLAISTTGSTFS

SEQ ID NO: 3185439 - protein, 29 aa, Giardia lamblia
ELTTSLPRKLIWMNPVYREPFNDVRDLCF

SEQ ID NO: 3185440 - protein, 24 aa, Giardia lamblia
ELVATLLQQTPLLKNIRGLEAMIK

SEQ ID NO: 3185441 - protein, 27 aa, Giardia lamblia
ELVGKRIMTILNLKPRPMAGGAIVSNA

SEQ ID NO: 3185442 - protein, 29 aa, Giardia lamblia
ELVHPLQVLFKFFAFYSAFDFTNNTITAF

SEQ ID NO: 3185443 - protein, 17 aa, Giardia lamblia
ELVQMAAINLAVQYKRL

SEQ ID NO: 3185444 - protein, 27 aa, Giardia lamblia
ELVSMLSPERPPFRPVRNRANVIMFVG

SEQ ID NO: 3185445 - protein, 28 aa, Giardia lamblia
ELVWMHAPFYKEQARFVFLFRSLCNAMI

SEQ ID NO: 3185446 - protein, 22 aa, Giardia lamblia
ELYGLLESLYQQARIYQIKLGI

SEQ ID NO: 3185447 - protein, 30 aa, Giardia lamblia
ELYLQTDGSDLLWILTQPEVDFTRTWTTNV

SEQ ID NO: 3185448 - protein, 17 aa, Giardia lamblia
EMDLFMTHKYAPGAPMF

SEQ ID NO: 3185449 - protein, 23 aa, Giardia lamblia
EMDLPTHPISILNTGRVSASYAI

SEQ ID NO: 3185450 - protein, 29 aa, Giardia lamblia
EMDLTLKGGATALMKCKRATYPEIYDYLR

SEQ ID NO: 3185451 - protein, 17 aa, Giardia lamblia
EMEAGLYSALEEACKKL

SEQ ID NO: 3185452 - protein, 30 aa, Giardia lamblia
EMERRERRLLKVLPTVYYRITGQQNGNSED

SEQ ID NO: 3185453 - protein, 22 aa, Giardia lamblia
EMESLVFFDQNITLPTTHSTEA

SEQ ID NO: 3185454 - protein, 26 aa, Giardia lamblia
EMGALDTLALLAPLEAKILSPEGRCA

SEQ ID NO: 3185455 - protein, 27 aa, Giardia lamblia
EMGIILPRLPRQYKLPDFYGAISPQSL

SEQ ID NO: 3185456 - protein, 29 aa, Giardia lamblia
EMGMLKIAMLLAPYELMIRGRDGMFPLEY

SEQ ID NO: 3185457 - protein, 20 aa, Giardia lamblia
EMGRRRSWSPSPPPDYRYTS

SEQ ID NO: 3185458 - protein, 28 aa, Giardia lamblia
EMIDGTFALYTFFNVLSDYYEEKKLKKS

SEQ ID NO: 3185459 - protein, 20 aa, Giardia lamblia
EMIIQPFCDVQLPFTFTPKS

SEQ ID NO: 3185460 - protein, 18 aa, Giardia lamblia
EMILKLEMALDDLSSKTS

SEQ ID NO: 3185461 - protein, 24 aa, Giardia lamblia
EMKDLILLCINKDPSARPSARELL

SEQ ID NO: 3185462 - protein, 23 aa, Giardia lamblia
EMKNIIVQLENKLFEMGAKRDDI

SEQ ID NO: 3185463 - protein, 29 aa, Giardia lamblia
EMLDVTQILLPYFDLSPDSNGLTPIDYAI

SEQ ID NO: 3185464 - protein, 23 aa, Giardia lamblia
EMLGFKAVILLSSAFYENVLSLI

SEQ ID NO: 3185465 - protein, 26 aa, Giardia lamblia
EMLISTAVLPLLYLIDQPAQPDMLET

SEQ ID NO: 3185466 - protein, 22 aa, Giardia lamblia
EMLLADIQTCIGCLLYDTNRPG

SEQ ID NO: 3185467 - protein, 18 aa, Giardia lamblia
EMLPPNLGKIIRQSQQDT

SEQ ID NO: 3185468 - protein, 20 aa, Giardia lamblia
EMLSILSQRTKPPLTLSTLM

SEQ ID NO: 3185469 - protein, 20 aa, Giardia lamblia
EMLVTIFSMSFKCTSDVLAI

SEQ ID NO: 3185470 - protein, 21 aa, Giardia lamblia
EMMERLIRHGLPVATADQINR

SEQ ID NO: 3185471 - protein, 19 aa, Giardia lamblia
EMMRLEQIIDSCSSSPRSS

SEQ ID NO: 3185472 - protein, 32 aa, Giardia lamblia
EMMRYAIEGDVLKIFCLLPYQSREKDEDGNTS

SEQ ID NO: 3185473 - protein, 26 aa, Giardia lamblia
EMNNRYFCQLLIDREHYFLTSDGKNA

SEQ ID NO: 3185474 - protein, 24 aa, Giardia lamblia
EMNNTAGVLFGMLCAHILQGHDMS

SEQ ID NO: 3185475 - protein, 27 aa, Giardia lamblia
EMPDNIFPRLLTILMPLAEERCMLITG

SEQ ID NO: 3185476 - protein, 28 aa, Giardia lamblia
EMQRFGKFDWVPLLKPQNIRDMVVLEPM

SEQ ID NO: 3185477 - protein, 17 aa, Giardia lamblia
EMRLHRVENLLIDHMAQ

SEQ ID NO: 3185478 - protein, 23 aa, Giardia lamblia
EMRLIRTAFAGVKQFIDAVTNYA

SEQ ID NO: 3185479 - protein, 20 aa, Giardia lamblia
EMRLQKCVQRKLWDAKEIEG

SEQ ID NO: 3185480 - protein, 17 aa, Giardia lamblia
EMRQVVDMLYMMNKTPP

SEQ ID NO: 3185481 - protein, 18 aa, Giardia lamblia
EMSLASTIEWLTHEFPVE

SEQ ID NO: 3185482 - protein, 24 aa, Giardia lamblia
EMTNYMNLSLYAYGIEDCTPFTTE

SEQ ID NO: 3185483 - protein, 19 aa, Giardia lamblia
EMVGILSNEIYSVSTMSAC

SEQ ID NO: 3185484 - protein, 24 aa, Giardia lamblia
EMVIQMNMLLILKELLSDGNQAVV

SEQ ID NO: 3185485 - protein, 33 aa, Giardia lamblia
ENAIRRYELDRMRYAFAIAKFNSIQTASNIYSQ

SEQ ID NO: 3185486 - protein, 31 aa, Giardia lamblia
ENAPLVEIVQFYLLILITSQPKPKDLQIIRS

SEQ ID NO: 3185487 - protein, 26 aa, Giardia lamblia
ENAQLKVKILNLERLLANSASETADL

SEQ ID NO: 3185488 - protein, 18 aa, Giardia lamblia
ENARLQRVILSKDASTQK

SEQ ID NO: 3185489 - protein, 24 aa, Giardia lamblia
ENCVGWYHSHPGYFAWLSHIDQNT

SEQ ID NO: 3185490 - protein, 26 aa, Giardia lamblia
ENDETLFDQYLTQLSFRTNSGRTALM

SEQ ID NO: 3185491 - protein, 18 aa, Giardia lamblia
ENDTLRHRLQSVETLLSE

SEQ ID NO: 3185492 - protein, 28 aa, Giardia lamblia
ENEFSYLYSVYPIGLLLEQDPSFRIGER

SEQ ID NO: 3185493 - protein, 24 aa, Giardia lamblia
ENEFTSFKAFLEYNQLKTAHENAL

SEQ ID NO: 3185494 - protein, 36 aa, Giardia lamblia
ENEHRHMIYLLNKCDLVPTWVTASWISKLSKLRPTI

SEQ ID NO: 3185495 - protein, 25 aa, Giardia lamblia
ENEHVYIFLIKWQRKAHCHATWELE

SEQ ID NO: 3185496 - protein, 23 aa, Giardia lamblia
ENEILYIVMDFYERGDLSKLIRE

SEQ ID NO: 3185497 - protein, 27 aa, Giardia lamblia
ENEKLRHDMQLLQNLEKYLPGGHVYEE

SEQ ID NO: 3185498 - protein, 24 aa, Giardia lamblia
ENFEATVDLLYYGQPHSLASLTRA

SEQ ID NO: 3185499 - protein, 22 aa, Giardia lamblia
ENFEQVIALLARYCEPGFVIHP

SEQ ID NO: 3185500 - protein, 17 aa, Giardia lamblia
ENFPAYNKALISQGFYS

SEQ ID NO: 3185501 - protein, 27 aa, Giardia lamblia
ENGVEFLRFPLFYAKRHNTQQVFYLSG

SEQ ID NO: 3185502 - protein, 19 aa, Giardia lamblia
ENIIYSIDVVKRRVLRLPK

SEQ ID NO: 3185503 - protein, 17 aa, Giardia lamblia
ENILDIFFAVIDPTSKN

SEQ ID NO: 3185504 - protein, 17 aa, Giardia lamblia
ENILKPVELAEGKVLFP

SEQ ID NO: 3185505 - protein, 21 aa, Giardia lamblia
ENIRKIIAPALIGMPVRDQRA

SEQ ID NO: 3185506 - protein, 25 aa, Giardia lamblia
ENISAIKVLAPFERNIRSLSGLAPL

SEQ ID NO: 3185507 - protein, 30 aa, Giardia lamblia
ENIVTFLNSLPPVELLVIGSLRNLTSMFDP

SEQ ID NO: 3185508 - protein, 27 aa, Giardia lamblia
ENKHASQFLGYTISPTGINFPASAMHH

SEQ ID NO: 3185509 - protein, 26 aa, Giardia lamblia
ENLAYQKQILELTNKLSLTAGTPSEK

SEQ ID NO: 3185510 - protein, 26 aa, Giardia lamblia
ENLEIFNILVPYNPSLLDIRSLSLFT

SEQ ID NO: 3185511 - protein, 21 aa, Giardia lamblia
ENLIASLYGKNRAVPEPRKLN

SEQ ID NO: 3185512 - protein, 21 aa, Giardia lamblia
ENLSTLKKLKYLNLAINRVTK

SEQ ID NO: 3185513 - protein, 27 aa, Giardia lamblia
ENNDLVGVWSWLPRQCKYADNQGQTAF

SEQ ID NO: 3185514 - protein, 24 aa, Giardia lamblia
ENNILACILTFPCFHRMGIGSLLI

SEQ ID NO: 3185515 - protein, 24 aa, Giardia lamblia
ENPILGLELGFFTGPSPLIDEAAS

SEQ ID NO: 3185516 - protein, 27 aa, Giardia lamblia
ENPLLIGKMGHILLDRLFADFCERLDK

SEQ ID NO: 3185517 - protein, 17 aa, Giardia lamblia
ENPVIVSLIHKIVPLHG

SEQ ID NO: 3185518 - protein, 23 aa, Giardia lamblia
ENRGKLAKLLRYYSTKSKDKRTS

SEQ ID NO: 3185519 - protein, 34 aa, Giardia lamblia
ENRRVGFVRVRLFRPFSIELFSNAIPKSAKVVVA

SEQ ID NO: 3185520 - protein, 25 aa, Giardia lamblia
ENSCSFCGVSYLILHEVERLKRRIA

SEQ ID NO: 3185521 - protein, 24 aa, Giardia lamblia
ENSLQNFIALFRSVVTAGKSIESA

SEQ ID NO: 3185522 - protein, 25 aa, Giardia lamblia
ENTKIDIFLLSLDILTCEPPVDPGL

SEQ ID NO: 3185523 - protein, 23 aa, Giardia lamblia
ENTNILAYFNKPPSNPKLSQVVQ

SEQ ID NO: 3185524 - protein, 27 aa, Giardia lamblia
ENTSQTLHFFPPYLPSIISRLSSTPMG

SEQ ID NO: 3185525 - protein, 24 aa, Giardia lamblia
ENVSAIHIIPPKPPINTFNKATEE

SEQ ID NO: 3185526 - protein, 27 aa, Giardia lamblia
ENVTVVIQYDFPLSLDVHIHRVGRTGR

SEQ ID NO: 3185527 - protein, 40 aa, Giardia lamblia
ENVVGTLLGMPFLRMHRMVIDLAIYQIRIGDVSLPIMSDA

SEQ ID NO: 3185528 - protein, 25 aa, Giardia lamblia
ENVVMSHIFAVREENKRLRADLVLA

SEQ ID NO: 3185529 - protein, 22 aa, Giardia lamblia
ENWAPGPDALLPPPTEDQYNKK

SEQ ID NO: 3185530 - protein, 31 aa, Giardia lamblia
ENYCLIPSEFGWLKQLRYYWHHNDKAKRVAH

SEQ ID NO: 3185531 - protein, 18 aa, Giardia lamblia
ENYERCIRWLLMDFVPTL

SEQ ID NO: 3185532 - protein, 34 aa, Giardia lamblia
ENYGSIPDDLRKTAWRFMLALPNDVDYYDSLVTR

SEQ ID NO: 3185533 - protein, 17 aa, Giardia lamblia
ENYQMAMLLAPIEGPRA

SEQ ID NO: 3185534 - protein, 21 aa, Giardia lamblia
EPAFLAVMVDNVDALQFIIQN

SEQ ID NO: 3185535 - protein, 31 aa, Giardia lamblia
EPAILDFSIYALIELLLNYYIDSAPITINDL

SEQ ID NO: 3185536 - protein, 23 aa, Giardia lamblia
EPAPRTRYIPQDEQMPAASSALL

SEQ ID NO: 3185537 - protein, 24 aa, Giardia lamblia
EPARPYLEPVAVYGLNLAVRTPLF

SEQ ID NO: 3185538 - protein, 23 aa, Giardia lamblia
EPASETSYRPIRTPSIESSTTHE

SEQ ID NO: 3185539 - protein, 24 aa, Giardia lamblia
EPATLFHGDFLKCGDGNGAYYVFV

SEQ ID NO: 3185540 - protein, 17 aa, Giardia lamblia
EPAYLLIAFDNVLGPLQ

SEQ ID NO: 3185541 - protein, 20 aa, Giardia lamblia
EPCFTFSALIIASLSAGGTV

SEQ ID NO: 3185542 - protein, 21 aa, Giardia lamblia
EPCPFGCGKPIWIGACSCINC

SEQ ID NO: 3185543 - protein, 31 aa, Giardia lamblia
EPCSISIYVHRLYGIKPLYNANVHAVVHKPA

SEQ ID NO: 3185544 - protein, 21 aa, Giardia lamblia
EPCYAYLLSELAKAVERHKSR

SEQ ID NO: 3185545 - protein, 23 aa, Giardia lamblia
EPDDSVLLKLGQLNIQINALTKE

SEQ ID NO: 3185546 - protein, 26 aa, Giardia lamblia
EPDFNPYITPSKWGTIGLLTGGTSGI

SEQ ID NO: 3185547 - protein, 26 aa, Giardia lamblia
EPDLVFNLLMRAMDSLPLVAIIGRRI

SEQ ID NO: 3185548 - protein, 24 aa, Giardia lamblia
EPDNLRARYWLSYAAAIAGMAIDE

SEQ ID NO: 3185549 - protein, 29 aa, Giardia lamblia
EPDSIELLRKMQVHMKLAANMIATLKEQN

SEQ ID NO: 3185550 - protein, 20 aa, Giardia lamblia
EPDVPYVQFAGKVAIMVSPS

SEQ ID NO: 3185551 - protein, 17 aa, Giardia lamblia
EPEKPVPPPPLKEPHYP

SEQ ID NO: 3185552 - protein, 28 aa, Giardia lamblia
EPELHSWPVFYEIVSLLIYPCCIHSKSN

SEQ ID NO: 3185553 - protein, 22 aa, Giardia lamblia
EPEPRQPILYEPDPNVTSKEVE

SEQ ID NO: 3185554 - protein, 18 aa, Giardia lamblia
EPERLFINLVSFLNNHSN

SEQ ID NO: 3185555 - protein, 20 aa, Giardia lamblia
EPFKLIHHVVIQTSQPTLHK

SEQ ID NO: 3185556 - protein, 25 aa, Giardia lamblia
EPFLTTRAHLLKRFPHIFKNTPSSL

SEQ ID NO: 3185557 - protein, 21 aa, Giardia lamblia
EPGKCIRIIRGKRGKKRAILV

SEQ ID NO: 3185558 - protein, 28 aa, Giardia lamblia
EPHELAYNILLILFQSKTIFKSEILCEI

SEQ ID NO: 3185559 - protein, 17 aa, Giardia lamblia
EPKPVMTLAATNLPWDL

SEQ ID NO: 3185560 - protein, 17 aa, Giardia lamblia
EPKRRIFSVVEPAPCCT

SEQ ID NO: 3185561 - protein, 31 aa, Giardia lamblia
EPKTGPAETFILPLVSNLPVHVSGDIGFSAV

SEQ ID NO: 3185562 - protein, 21 aa, Giardia lamblia
EPLCYMVDGCQKYIPAPPAPA

SEQ ID NO: 3185563 - protein, 28 aa, Giardia lamblia
EPLSPTHPLIIWFWDIVLNVMTQDQRKA

SEQ ID NO: 3185564 - protein, 18 aa, Giardia lamblia
EPLVVFRAGSDLTFKYLH

SEQ ID NO: 3185565 - protein, 38 aa, Giardia lamblia
EPMEHSIDLLPFYSGIKLNFIDVPPLYAFPGARLNATN

SEQ ID NO: 3185566 - protein, 33 aa, Giardia lamblia
EPNAKGFILNSFYTGLLPFEFLAHARAGRDGVI

SEQ ID NO: 3185567 - protein, 25 aa, Giardia lamblia
EPNDAFGFFGFDDAPSTPAAISEAP

SEQ ID NO: 3185568 - protein, 23 aa, Giardia lamblia
EPNKQMLLLLGEVEGRVVNSIGR

SEQ ID NO: 3185569 - protein, 18 aa, Giardia lamblia
EPNLEACPWARSLPPKHE

SEQ ID NO: 3185570 - protein, 25 aa, Giardia lamblia
EPPAPTSYPLIPKPTQLMDDGSAMH

SEQ ID NO: 3185571 - protein, 18 aa, Giardia lamblia
EPPFRKPAATVIVEAYYK

SEQ ID NO: 3185572 - protein, 26 aa, Giardia lamblia
EPPKPPSVSIFKKLTRPPVTNAPAVT

SEQ ID NO: 3185573 - protein, 26 aa, Giardia lamblia
EPQEYKIPDLYLREDPSRPESQEFQV

SEQ ID NO: 3185574 - protein, 25 aa, Giardia lamblia
EPQYEDMTILPAAEPYYGLPQPDFE

SEQ ID NO: 3185575 - protein, 25 aa, Giardia lamblia
EPRAYEYPPRGENPLYKSRIQTKLV

SEQ ID NO: 3185576 - protein, 24 aa, Giardia lamblia
EPSLDALPVHASPRGPQIIEPTPA

SEQ ID NO: 3185577 - protein, 17 aa, Giardia lamblia
EPSSFALKRGYIYVPPQ

SEQ ID NO: 3185578 - protein, 29 aa, Giardia lamblia
EPSTKGRLLFADLLALKESFLATNDLTDT

SEQ ID NO: 3185579 - protein, 27 aa, Giardia lamblia
EPTAAIDFLFTAVVYFVARFQNADIIK

SEQ ID NO: 3185580 - protein, 17 aa, Giardia lamblia
EPTIRQLIGSREALIFD

SEQ ID NO: 3185581 - protein, 20 aa, Giardia lamblia
EPTLLLPIPEHVTLTHFFRQ

SEQ ID NO: 3185582 - protein, 24 aa, Giardia lamblia
EPTNAVPASLLQRHPRCCFYVDEA

SEQ ID NO: 3185583 - protein, 33 aa, Giardia lamblia
EPVDIIVMGNPFPFIVSYWDGKNRFIVPYATLK

SEQ ID NO: 3185584 - protein, 27 aa, Giardia lamblia
EPVEEPPRRPALIPSPGTIRKYNTWRT

SEQ ID NO: 3185585 - protein, 23 aa, Giardia lamblia
EPVHKALPSFFKRVGPPKPHAPD

SEQ ID NO: 3185586 - protein, 19 aa, Giardia lamblia
EPVIPMRAHLRPFKSHFEP

SEQ ID NO: 3185587 - protein, 22 aa, Giardia lamblia
EPVPFTILAINVNGIRSAFSKG

SEQ ID NO: 3185588 - protein, 26 aa, Giardia lamblia
EPYHIPRAFYFALVDMAPSLQRNRIV

SEQ ID NO: 3185589 - protein, 29 aa, Giardia lamblia
EPYKDLERVVIYLALPPGAFYAAVTNLGE

SEQ ID NO: 3185590 - protein, 25 aa, Giardia lamblia
EPYKKELYRLQRDLLDERAKTRALS

SEQ ID NO: 3185591 - protein, 20 aa, Giardia lamblia
EQAGYYLGWALTYSLDSAQC

SEQ ID NO: 3185592 - protein, 23 aa, Giardia lamblia
EQALTIEYILAQLPPSDKYTLKV

SEQ ID NO: 3185593 - protein, 18 aa, Giardia lamblia
EQCKVLYAHYGNLAKDIR

SEQ ID NO: 3185594 - protein, 27 aa, Giardia lamblia
EQDDNIILAAIFYYVGDYNTIDLNWHI

SEQ ID NO: 3185595 - protein, 24 aa, Giardia lamblia
EQDPLSDYMFYLSPTRISSEMDRL

SEQ ID NO: 3185596 - protein, 27 aa, Giardia lamblia
EQDVFSILPCIRLLTILSTRDRVSVYI

SEQ ID NO: 3185597 - protein, 38 aa, Giardia lamblia
EQEFGTFYAPKKIQTIRLLLDLLTDYICKTYPVDNSNY

SEQ ID NO: 3185598 - protein, 24 aa, Giardia lamblia
EQEGAFALQLKQPLVIAGSLGSQN

SEQ ID NO: 3185599 - protein, 25 aa, Giardia lamblia
EQEGCMLPYLTFLADANAFAAQATQ

SEQ ID NO: 3185600 - protein, 28 aa, Giardia lamblia
EQEKFYNQQQLLMRMHIENLQRAHNKEV

SEQ ID NO: 3185601 - protein, 25 aa, Giardia lamblia
EQELYDFILDGYRSYSSSLDCLMYA

SEQ ID NO: 3185602 - protein, 24 aa, Giardia lamblia
EQERSWLVSYIATKSQQMGETPPI

SEQ ID NO: 3185603 - protein, 18 aa, Giardia lamblia
EQESAQIIKFIASSANDP

SEQ ID NO: 3185604 - protein, 24 aa, Giardia lamblia
EQEVFCTIFTFDQLRKRAYTELLS

SEQ ID NO: 3185605 - protein, 27 aa, Giardia lamblia
EQFLNDPGIGLLFPEDVLALCDYASNS

SEQ ID NO: 3185606 - protein, 24 aa, Giardia lamblia
EQGLNENLLFRVISTPSACVLKLS

SEQ ID NO: 3185607 - protein, 25 aa, Giardia lamblia
EQGQFDMVSKMQLEIKRLARELDET

SEQ ID NO: 3185608 - protein, 30 aa, Giardia lamblia
EQGQYLHYLIDHYMLRAGILPAFHVRFAID

SEQ ID NO: 3185609 - protein, 24 aa, Giardia lamblia
EQHRDILRSLAKYIERNNPHHPPF

SEQ ID NO: 3185610 - protein, 41 aa, Giardia lamblia
EQIAVLQKQVEVIPSLLAEKEGLALDLRKSTDSLKAATDTI

SEQ ID NO: 3185611 - protein, 27 aa, Giardia lamblia
EQIDALLLRLIHHNTYFNLISYGMGIS

SEQ ID NO: 3185612 - protein, 29 aa, Giardia lamblia
EQIEPITLEFVLPPELYVARILTAEEAVY

SEQ ID NO: 3185613 - protein, 28 aa, Giardia lamblia
EQINRENHILLRRIDYHNELRHPARIDC

SEQ ID NO: 3185614 - protein, 21 aa, Giardia lamblia
EQIRQLFKLTVDKHGRPRRLT

SEQ ID NO: 3185615 - protein, 21 aa, Giardia lamblia
EQITYLSHKLQEVADAAIIVQ

SEQ ID NO: 3185616 - protein, 17 aa, Giardia lamblia
EQIWKSNRLPIVGRFAA

SEQ ID NO: 3185617 - protein, 23 aa, Giardia lamblia
EQKAKDLFFVNAYSLEAPMQSVV

SEQ ID NO: 3185618 - protein, 17 aa, Giardia lamblia
EQKKQRLNFLKYRLQQL

SEQ ID NO: 3185619 - protein, 27 aa, Giardia lamblia
EQKQYPIKCSLCGLFLGMATDAIDQGP

SEQ ID NO: 3185620 - protein, 20 aa, Giardia lamblia
EQKRTFCARILATAETRIQD

SEQ ID NO: 3185621 - protein, 28 aa, Giardia lamblia
EQLDAMIKHKLELQSRIGFLERVVKDKD

SEQ ID NO: 3185622 - protein, 26 aa, Giardia lamblia
EQLDTILVFLLNHATNFPRLWKITYE

SEQ ID NO: 3185623 - protein, 26 aa, Giardia lamblia
EQLINDWLDLDFWPATRAKALEMLAN

SEQ ID NO: 3185624 - protein, 23 aa, Giardia lamblia
EQLKNLNKMGPLQKIASMVPGFS

SEQ ID NO: 3185625 - protein, 18 aa, Giardia lamblia
EQLLHKLTVQLLARLHRQ

SEQ ID NO: 3185626 - protein, 23 aa, Giardia lamblia
EQLLHSCNILLNIDHPLLTRVVD

SEQ ID NO: 3185627 - protein, 21 aa, Giardia lamblia
EQLMNEILNSKIRLSKLEQTG

SEQ ID NO: 3185628 - protein, 31 aa, Giardia lamblia
EQLNPPADLLNDPLLGHNLGPGVLISSNVRP

SEQ ID NO: 3185629 - protein, 24 aa, Giardia lamblia
EQLSMPFCELPDPIRAFPVMETNT

SEQ ID NO: 3185630 - protein, 22 aa, Giardia lamblia
EQLSSMLLTPWIERERPIIYTE

SEQ ID NO: 3185631 - protein, 18 aa, Giardia lamblia
EQLVIKLWKVCEGVLKCL

SEQ ID NO: 3185632 - protein, 26 aa, Giardia lamblia
EQLVRQLINLYPKLALNRQDGTGWTA

SEQ ID NO: 3185633 - protein, 32 aa, Giardia lamblia
EQLWISYNMIEKLAPLISLKRLRCLFIGNNLI

SEQ ID NO: 3185634 - protein, 26 aa, Giardia lamblia
EQNMIDAAFPWLLHEFSLEHVQYFGK

SEQ ID NO: 3185635 - protein, 28 aa, Giardia lamblia
EQPAAPDPVLYVPNRLLAAYIQEPEQLQ

SEQ ID NO: 3185636 - protein, 18 aa, Giardia lamblia
EQPALESLFIPDTFFSHT

SEQ ID NO: 3185637 - protein, 22 aa, Giardia lamblia
EQPSFVINIWLHSGYDKPAKWV

SEQ ID NO: 3185638 - protein, 25 aa, Giardia lamblia
EQQKTISFDPLFDRSPDEAKTISDA

SEQ ID NO: 3185639 - protein, 18 aa, Giardia lamblia
EQRFLPIALGEIISPRQI

SEQ ID NO: 3185640 - protein, 19 aa, Giardia lamblia
EQRHRLELSRCEEVIAGLR

SEQ ID NO: 3185641 - protein, 21 aa, Giardia lamblia
EQRIMKLGELDDEALAIIRAE

SEQ ID NO: 3185642 - protein, 22 aa, Giardia lamblia
EQRLGFIPKAIRIPINKHTEKP

SEQ ID NO: 3185643 - protein, 20 aa, Giardia lamblia
EQRMKIMDILATPATRQSIE

SEQ ID NO: 3185644 - protein, 23 aa, Giardia lamblia
EQSFFQKLLSRFYNQAAASVAAG

SEQ ID NO: 3185645 - protein, 21 aa, Giardia lamblia
EQSFIDLHMVELMLMPSRLDV

SEQ ID NO: 3185646 - protein, 19 aa, Giardia lamblia
EQSPVYFIHGHKARDSSIA

SEQ ID NO: 3185647 - protein, 26 aa, Giardia lamblia
EQTDPASILFLHKIGLNYVSCSPYRV

SEQ ID NO: 3185648 - protein, 24 aa, Giardia lamblia
EQTEILEIFSSLYLAQRRIGDHIN

SEQ ID NO: 3185649 - protein, 24 aa, Giardia lamblia
EQTSWILRYVGLDSYFTELLCYRA

SEQ ID NO: 3185650 - protein, 21 aa, Giardia lamblia
EQVELPLHRTAFKGATMAKYL

SEQ ID NO: 3185651 - protein, 18 aa, Giardia lamblia
EQVFGQHVLIYHPTYKSP

SEQ ID NO: 3185652 - protein, 28 aa, Giardia lamblia
EQVKAILALDFRRLRSLLPSFDLPHFTE

SEQ ID NO: 3185653 - protein, 43 aa, Giardia lamblia
EQVKRLLEDFKTYTPPFMAARAEFLSVRRRYLAASKSPLTVYD

SEQ ID NO: 3185654 - protein, 23 aa, Giardia lamblia
EQVKWFSPPTFGNYTYRAFPGTV

SEQ ID NO: 3185655 - protein, 22 aa, Giardia lamblia
EQVMALIYQYKDTLVEDRLALT

SEQ ID NO: 3185656 - protein, 18 aa, Giardia lamblia
EQWGINLNRPYIKAILVE

SEQ ID NO: 3185657 - protein, 19 aa, Giardia lamblia
EQWLARKKARQEKVKIDML

SEQ ID NO: 3185658 - protein, 21 aa, Giardia lamblia
EQYKRLYYVYKTRLNSSTAES

SEQ ID NO: 3185659 - protein, 30 aa, Giardia lamblia
EQYLKKYNIPDLFDYLLSQIVINLPEDPWT

SEQ ID NO: 3185660 - protein, 42 aa, Giardia lamblia
EQYSPAYNAPIGIGYPALPQPIYLPQPPQPVQIIAPPQSNHS

SEQ ID NO: 3185661 - protein, 24 aa, Giardia lamblia
ERAESLVFFVAEIRLRRDRHHVSS

SEQ ID NO: 3185662 - protein, 30 aa, Giardia lamblia
ERAFRAHIGKILLHLSPELLAKKLDEVHLA

SEQ ID NO: 3185663 - protein, 23 aa, Giardia lamblia
ERAIDDFVFLTFLVGNDFLPHIQ

SEQ ID NO: 3185664 - protein, 18 aa, Giardia lamblia
ERAQQWVAQLKGLKIVSS

SEQ ID NO: 3185665 - protein, 25 aa, Giardia lamblia
ERCCLMDVILFYRMKERVIPEETVW

SEQ ID NO: 3185666 - protein, 17 aa, Giardia lamblia
ERDEASALTFQPNIRRA

SEQ ID NO: 3185667 - protein, 25 aa, Giardia lamblia
ERDHEAVVLLLLATEGRMHVLLPDG

SEQ ID NO: 3185668 - protein, 19 aa, Giardia lamblia
ERDILHTKLRKFCDENGIA

SEQ ID NO: 3185669 - protein, 25 aa, Giardia lamblia
ERDVYLKLNWPQSEWYTPCITLIWK

SEQ ID NO: 3185670 - protein, 26 aa, Giardia lamblia
EREFHRMRLLRDRQIAEFNFENIRPE

SEQ ID NO: 3185671 - protein, 32 aa, Giardia lamblia
EREKLMERFDKLLQICMWFQREYGKSSNVIHE

SEQ ID NO: 3185672 - protein, 34 aa, Giardia lamblia
EREKVRQHLLLYRKLYSDIVPTLVYLNSAMFGQS

SEQ ID NO: 3185673 - protein, 17 aa, Giardia lamblia
ERELYMKCYIHLFVRVC

SEQ ID NO: 3185674 - protein, 21 aa, Giardia lamblia
ERENELLRSLPPQNMGMMGTN

SEQ ID NO: 3185675 - protein, 25 aa, Giardia lamblia
ERENHWRMQLLSQREQFGNATTASL

SEQ ID NO: 3185676 - protein, 19 aa, Giardia lamblia
ERERTLDLLRLENADLREV

SEQ ID NO: 3185677 - protein, 25 aa, Giardia lamblia
ERESRNYFQLEKDKIFTLYEVSAAQ

SEQ ID NO: 3185678 - protein, 18 aa, Giardia lamblia
ERFIIAGLGLCKDALWSE

SEQ ID NO: 3185679 - protein, 25 aa, Giardia lamblia
ERFSRPLKLIPIAPFQTLSSVITAD

SEQ ID NO: 3185680 - protein, 27 aa, Giardia lamblia
ERFVIADFGLCRNTLWSESTIAGMAVY

SEQ ID NO: 3185681 - protein, 33 aa, Giardia lamblia
ERGVGYYLEYFVLIAMFCKFQLRLTLTGVTNDN

SEQ ID NO: 3185682 - protein, 26 aa, Giardia lamblia
ERGYDSLVSLLIPKEARMADVNGFTA

SEQ ID NO: 3185683 - protein, 19 aa, Giardia lamblia
ERHARLLKVALHETPAPIE

SEQ ID NO: 3185684 - protein, 18 aa, Giardia lamblia
ERIIVRLTKLAGSLEKLT

SEQ ID NO: 3185685 - protein, 17 aa, Giardia lamblia
ERILKRKYIEEDIALFK

SEQ ID NO: 3185686 - protein, 37 aa, Giardia lamblia
ERIPPIESFYKILNQKRSWFKQPLLIISSSTTFESIH

SEQ ID NO: 3185687 - protein, 17 aa, Giardia lamblia
ERIQLAFKLLLLHDRRG

SEQ ID NO: 3185688 - protein, 32 aa, Giardia lamblia
ERISLFFEIQKLFQLRPTRPLQLLLQDLCRLT

SEQ ID NO: 3185689 - protein, 26 aa, Giardia lamblia
ERITGAFMRRGIMPIFLDSSKTSFSL

SEQ ID NO: 3185690 - protein, 17 aa, Giardia lamblia
ERKNLLFVCSLHPFNPD

SEQ ID NO: 3185691 - protein, 25 aa, Giardia lamblia
ERKQLFTVEMFLPHLHRLIEAENNH

SEQ ID NO: 3185692 - protein, 31 aa, Giardia lamblia
ERKRIYENWRDYFLFLYNVKGHDIPANVVEG

SEQ ID NO: 3185693 - protein, 25 aa, Giardia lamblia
ERKRLECSFIPDVPAPLEQVEYKLI

SEQ ID NO: 3185694 - protein, 27 aa, Giardia lamblia
ERKRVSFPRFYFLSNDELLEILAQSKN

SEQ ID NO: 3185695 - protein, 17 aa, Giardia lamblia
ERKSRCAVLYKNKKFYL

SEQ ID NO: 3185696 - protein, 17 aa, Giardia lamblia
ERLHTQENILRDAEIFM

SEQ ID NO: 3185697 - protein, 18 aa, Giardia lamblia
ERLIQEAARRIVLTNTFD

SEQ ID NO: 3185698 - protein, 24 aa, Giardia lamblia
ERLKLRFPDLQHVIGHLLDSFISY

SEQ ID NO: 3185699 - protein, 19 aa, Giardia lamblia
ERLLRELHLLSREAGVILT

SEQ ID NO: 3185700 - protein, 23 aa, Giardia lamblia
ERLLSQFLYSFYKTFEASGTGEE

SEQ ID NO: 3185701 - protein, 22 aa, Giardia lamblia
ERLPYFSVYQMILSGVMGLIHY

SEQ ID NO: 3185702 - protein, 18 aa, Giardia lamblia
ERLRLQVASLTIGAHILD

SEQ ID NO: 3185703 - protein, 28 aa, Giardia lamblia
ERLRSLCEVFFEQSYQQSLKAAAPVPTL

SEQ ID NO: 3185704 - protein, 24 aa, Giardia lamblia
ERLSRAEELIWSFLHATDSASQEK

SEQ ID NO: 3185705 - protein, 37 aa, Giardia lamblia
ERMRGTDGFIVLLPPSLKPQMPYVAQRWTSHPAVIMH

SEQ ID NO: 3185706 - protein, 27 aa, Giardia lamblia
ERNFVWATLCFVLYKHPDAIFIPRSGN

SEQ ID NO: 3185707 - protein, 30 aa, Giardia lamblia
ERNHSNFRFYILLCTYISTAGLTVKINQRT

SEQ ID NO: 3185708 - protein, 21 aa, Giardia lamblia
ERNIRSLSGLAPLDYIPQKSQ

SEQ ID NO: 3185709 - protein, 23 aa, Giardia lamblia
ERNNYIGFLEGQLDKIAATSEFT

SEQ ID NO: 3185710 - protein, 24 aa, Giardia lamblia
ERNSLLLVCSREIKVFQLIGAEVN

SEQ ID NO: 3185711 - protein, 26 aa, Giardia lamblia
ERNYYDIADAFIKVIDMAESNDVRIR

SEQ ID NO: 3185712 - protein, 36 aa, Giardia lamblia
ERPGQSSLPIALYSYRRKLFHTILAGTRQAKEAKSK

SEQ ID NO: 3185713 - protein, 21 aa, Giardia lamblia
ERPKAIRYWPLYKSKEHDPIY

SEQ ID NO: 3185714 - protein, 17 aa, Giardia lamblia
ERPRIFSANPKFKARSR

SEQ ID NO: 3185715 - protein, 17 aa, Giardia lamblia
ERPSLFDSKDSPSCPGG

SEQ ID NO: 3185716 - protein, 18 aa, Giardia lamblia
ERPTFQPVLISSSKSRHR

SEQ ID NO: 3185717 - protein, 28 aa, Giardia lamblia
ERQKELMDKLMLVDLPKAAEALNYRAPS

SEQ ID NO: 3185718 - protein, 27 aa, Giardia lamblia
ERQQQYATFLSLAAFAGAPVLFDQCSQ

SEQ ID NO: 3185719 - protein, 25 aa, Giardia lamblia
ERRDFLGAITVLKFLKSTRNTAEVG

SEQ ID NO: 3185720 - protein, 23 aa, Giardia lamblia
ERRHNDMFILGEAESAPVVPSND

SEQ ID NO: 3185721 - protein, 24 aa, Giardia lamblia
ERRKFWKHGPPFSHFIKGRGHHGP

SEQ ID NO: 3185722 - protein, 21 aa, Giardia lamblia
ERRKKLFFSSPKQQNSPPTEK

SEQ ID NO: 3185723 - protein, 17 aa, Giardia lamblia
ERRKVTYLLKKLHEGPA

SEQ ID NO: 3185724 - protein, 25 aa, Giardia lamblia
ERRPTARGLVRLLQMLNGPPDEQEA

SEQ ID NO: 3185725 - protein, 24 aa, Giardia lamblia
ERSDLLSSVIQRTLGAQVETSLPV

SEQ ID NO: 3185726 - protein, 22 aa, Giardia lamblia
ERSDLPVLLVVSGLLSHLSFST

SEQ ID NO: 3185727 - protein, 26 aa, Giardia lamblia
ERTKEFPMKVKYKIPGLLIVDTPGHE

SEQ ID NO: 3185728 - protein, 35 aa, Giardia lamblia
ERTNAIYDILTSKGQYIFTALMRATIMNDVRTVKT

SEQ ID NO: 3185729 - protein, 25 aa, Giardia lamblia
ERTQAIFIEFLNFYKSIDREARSQP

SEQ ID NO: 3185730 - protein, 30 aa, Giardia lamblia
ERTRRSLLVLYDTHYLYLYIKPTDDMDSLT

SEQ ID NO: 3185731 - protein, 24 aa, Giardia lamblia
ERTSSFVMLTKKIFGRFLKRKEED

SEQ ID NO: 3185732 - protein, 26 aa, Giardia lamblia
ERTVSSLCMSLSPKLAAKSPMRSVVG

SEQ ID NO: 3185733 - protein, 26 aa, Giardia lamblia
ERVMCVNPTLFTLGLDFDGLLGKELS

SEQ ID NO: 3185734 - protein, 41 aa, Giardia lamblia
ERVRFSLILKEDYYHMLATAYPVFFKNLGVLMFDYLDNSTM

SEQ ID NO: 3185735 - protein, 27 aa, Giardia lamblia
ERVTAWFCQWLNQLGVIFRFVKRPEDE

SEQ ID NO: 3185736 - protein, 20 aa, Giardia lamblia
ERVTIKGQWFSIGDLKRFSL

SEQ ID NO: 3185737 - protein, 19 aa, Giardia lamblia
ERWRAGQMLDFMVRASGAR

SEQ ID NO: 3185738 - protein, 31 aa, Giardia lamblia
ERYDGLRTAPLFLFLNVVAAGFWMDDVMPSF

SEQ ID NO: 3185739 - protein, 31 aa, Giardia lamblia
ERYDKIVFATGSWPIIPDIPGIKSDKVLLCK

SEQ ID NO: 3185740 - protein, 30 aa, Giardia lamblia
ERYEQELKAIGPCDVWLLGIGHNGHIAFNE

SEQ ID NO: 3185741 - protein, 17 aa, Giardia lamblia
ERYRDRLVAPVDSLSVK

SEQ ID NO: 3185742 - protein, 20 aa, Giardia lamblia
ERYRLVLRETLHRQARPKTA

SEQ ID NO: 3185743 - protein, 24 aa, Giardia lamblia
ESADKFLWNCSRVMDFLTTAHPSI

SEQ ID NO: 3185744 - protein, 22 aa, Giardia lamblia
ESAPDFGPLLKARDIEIERLRS

SEQ ID NO: 3185745 - protein, 24 aa, Giardia lamblia
ESAPYIVRLMGMLATYMPAPHLKY

SEQ ID NO: 3185746 - protein, 24 aa, Giardia lamblia
ESAQKFWPELVARRQSYMHDSYSA

SEQ ID NO: 3185747 - protein, 29 aa, Giardia lamblia
ESARLVRDLFAYAKLKKPCLLMIDEVDAI

SEQ ID NO: 3185748 - protein, 39 aa, Giardia lamblia
ESATGVFHLLTGISAPFLPGLLRVPVKDRIWVTTTAQGN

SEQ ID NO: 3185749 - protein, 25 aa, Giardia lamblia
ESCEGCYFPLDPPLSGMRTKLGKDR

SEQ ID NO: 3185750 - protein, 21 aa, Giardia lamblia
ESCLSLLNKAMELKLAREAGL

SEQ ID NO: 3185751 - protein, 23 aa, Giardia lamblia
ESDALLLSERFLAENLSARSIEE

SEQ ID NO: 3185752 - protein, 20 aa, Giardia lamblia
ESDFKYFPESKLINGDLVIL

SEQ ID NO: 3185753 - protein, 23 aa, Giardia lamblia
ESDGFLLKVYDTTGMLLYQRHSP

SEQ ID NO: 3185754 - protein, 60 aa, Giardia lamblia
ESDLLIARKSPLISSSPFWDYLFDSQFRFQSCSLLFWHAFIFLLRVIRWASSQGPRHNVW

SEQ ID NO: 3185755 - protein, 21 aa, Giardia lamblia
ESDLVHIYLLCYQIAYENEHC

SEQ ID NO: 3185756 - protein, 19 aa, Giardia lamblia
ESDNGPLEAMLSNLGKEIG

SEQ ID NO: 3185757 - protein, 26 aa, Giardia lamblia
ESDPDPRLIFFPLNTQSIESYCYTSS

SEQ ID NO: 3185758 - protein, 24 aa, Giardia lamblia
ESEISILEGKYFRWEGPPDSSIAG

SEQ ID NO: 3185759 - protein, 29 aa, Giardia lamblia
ESELATLFLNLFVRAVQPVILLNPERRST

SEQ ID NO: 3185760 - protein, 18 aa, Giardia lamblia
ESELLTTFSYLQKPIVAH

SEQ ID NO: 3185761 - protein, 17 aa, Giardia lamblia
ESERIFVQQLGRGLRKY

SEQ ID NO: 3185762 - protein, 17 aa, Giardia lamblia
ESESPPSSPPLPLGASN

SEQ ID NO: 3185763 - protein, 27 aa, Giardia lamblia
ESFDEILQFMPEENRLILGAPLNHTRS

SEQ ID NO: 3185764 - protein, 33 aa, Giardia lamblia
ESFDEYVHLILQAYLTFRYHHVFDPLSFEVVPF

SEQ ID NO: 3185765 - protein, 17 aa, Giardia lamblia
ESFRIFSLSPSSAAPGT

SEQ ID NO: 3185766 - protein, 27 aa, Giardia lamblia
ESFSTLHELLLKRPFSASILSEVGKKS

SEQ ID NO: 3185767 - protein, 32 aa, Giardia lamblia
ESGCKIVIEFYSDGLLINGHEPFYPFNSKETE

SEQ ID NO: 3185768 - protein, 29 aa, Giardia lamblia
ESGEFVVSSYPLTDLPKRALQRSEREVAA

SEQ ID NO: 3185769 - protein, 23 aa, Giardia lamblia
ESGFLRLCSGVGFLIRPKNVTTG

SEQ ID NO: 3185770 - protein, 26 aa, Giardia lamblia
ESGIFYLNICFPSDYPFKPPKVTFET

SEQ ID NO: 3185771 - protein, 24 aa, Giardia lamblia
ESGLLPLARLQTCQSALGSLRSKI

SEQ ID NO: 3185772 - protein, 33 aa, Giardia lamblia
ESGLMLAAYFNQLDIVKALLYFEYTLGNSDGYT

SEQ ID NO: 3185773 - protein, 22 aa, Giardia lamblia
ESGLPRPYGGRAPFAPADPAPN

SEQ ID NO: 3185774 - protein, 24 aa, Giardia lamblia
ESGRTALMYAAMNGASSAARLLVP

SEQ ID NO: 3185775 - protein, 20 aa, Giardia lamblia
ESHKLFTKDLFLFETREAIL

SEQ ID NO: 3185776 - protein, 26 aa, Giardia lamblia
ESHLHGLLNLLLCSPISKCQVERDSV

SEQ ID NO: 3185777 - protein, 26 aa, Giardia lamblia
ESIHAIPELGMLFRKADTTASKFITS

SEQ ID NO: 3185778 - protein, 22 aa, Giardia lamblia
ESIPPICVTYMLTTRRLERDLR

SEQ ID NO: 3185779 - protein, 24 aa, Giardia lamblia
ESITLYIDLLYADTPQIRMCLEEF

SEQ ID NO: 3185780 - protein, 17 aa, Giardia lamblia
ESIVRLLIPYECKMHES

SEQ ID NO: 3185781 - protein, 18 aa, Giardia lamblia
ESIYKLIMNSCYGKSILK

SEQ ID NO: 3185782 - protein, 26 aa, Giardia lamblia
ESKASLAIIKLLVPLEAGVVDFSGRT

SEQ ID NO: 3185783 - protein, 27 aa, Giardia lamblia
ESKKKHKFIPYRDSQLTYLLQDALGGN

SEQ ID NO: 3185784 - protein, 28 aa, Giardia lamblia
ESKMHTAPLKPWKPAHDPYLHTSYASQT

SEQ ID NO: 3185785 - protein, 23 aa, Giardia lamblia
ESLALLDHVLGLVEDVLEAIRKK

SEQ ID NO: 3185786 - protein, 24 aa, Giardia lamblia
ESLARRPLLLHRHVLRTAIDWKKI

SEQ ID NO: 3185787 - protein, 21 aa, Giardia lamblia
ESLHMLFINYLDVQDNLKLAQ

SEQ ID NO: 3185788 - protein, 35 aa, Giardia lamblia
ESLIHATIKHTWPRFIYLLFRGSLPVYVSDPGVRY

SEQ ID NO: 3185789 - protein, 22 aa, Giardia lamblia
ESLIRLATALTKLSFPPREVEP

SEQ ID NO: 3185790 - protein, 28 aa, Giardia lamblia
ESLKHLQICWHFYLKPAIMKTTFTDLTD

SEQ ID NO: 3185791 - protein, 26 aa, Giardia lamblia
ESLKKEMLPLRYAITRAIQLGGVPVL

SEQ ID NO: 3185792 - protein, 32 aa, Giardia lamblia
ESLNLFCTNILPYLYHPSFPELMYKPTHYLKH

SEQ ID NO: 3185793 - protein, 17 aa, Giardia lamblia
ESLRLLAPREGQITNFR

SEQ ID NO: 3185794 - protein, 32 aa, Giardia lamblia
ESLYDFIRDRTWRQFLCAIDRLLPKEAGLQNN

SEQ ID NO: 3185795 - protein, 31 aa, Giardia lamblia
ESMIVTHTMSFILRFLFSPIQTGHQSKNSFI

SEQ ID NO: 3185796 - protein, 18 aa, Giardia lamblia
ESMLAPSALGLGYLEAGS

SEQ ID NO: 3185797 - protein, 19 aa, Giardia lamblia
ESMLNRRYDPIPSFVNDQA

SEQ ID NO: 3185798 - protein, 29 aa, Giardia lamblia
ESNARKKRIGLFKFYIDYKDSIIPNPGSW

SEQ ID NO: 3185799 - protein, 21 aa, Giardia lamblia
ESNEALIARMMRDITGLEKER

SEQ ID NO: 3185800 - protein, 22 aa, Giardia lamblia
ESNILITDIAWNNVLSLRNGQV

SEQ ID NO: 3185801 - protein, 27 aa, Giardia lamblia
ESNPKYDAWRRQYLSRDPKADKKHQWF

SEQ ID NO: 3185802 - protein, 24 aa, Giardia lamblia
ESPDAPLYVWYNPTDIEDAPEILQ

SEQ ID NO: 3185803 - protein, 24 aa, Giardia lamblia
ESPKLTLLYERLRDTLKTMFFSGL

SEQ ID NO: 3185804 - protein, 20 aa, Giardia lamblia
ESPLKFDAVYWQLDVEWDSP

SEQ ID NO: 3185805 - protein, 25 aa, Giardia lamblia
ESPRDYKLFLPNDSSIIGYQPEFVP

SEQ ID NO: 3185806 - protein, 25 aa, Giardia lamblia
ESPSWTPLMCAAFIGDVKVARRYLS

SEQ ID NO: 3185807 - protein, 20 aa, Giardia lamblia
ESQILTLPTSILKLKLEEQI

SEQ ID NO: 3185808 - protein, 23 aa, Giardia lamblia
ESQKQRKIIFSLEKEREMFSQKS

SEQ ID NO: 3185809 - protein, 41 aa, Giardia lamblia
ESQLPIPAQLPYSLASFRVYTLVPFFLSRFKHYSVSVYFQG

SEQ ID NO: 3185810 - protein, 25 aa, Giardia lamblia
ESQRQIYMSWLKVLSNLGFSGSKLV

SEQ ID NO: 3185811 - protein, 21 aa, Giardia lamblia
ESRAPRPLTSQPLLGDRHITE

SEQ ID NO: 3185812 - protein, 19 aa, Giardia lamblia
ESRGFILGGIVANSLGVGF

SEQ ID NO: 3185813 - protein, 19 aa, Giardia lamblia
ESRRYYFLTVFRNARELRE

SEQ ID NO: 3185814 - protein, 23 aa, Giardia lamblia
ESRYRLYNQQRVLRPMLDQSTGY

SEQ ID NO: 3185815 - protein, 23 aa, Giardia lamblia
ESRYRNQFGDTALMFAAVSGHCS

SEQ ID NO: 3185816 - protein, 24 aa, Giardia lamblia
ESSADYLQLIANLVTRFINIIEHH

SEQ ID NO: 3185817 - protein, 18 aa, Giardia lamblia
ESSFHRTALMAAAYFNHA

SEQ ID NO: 3185818 - protein, 22 aa, Giardia lamblia
ESSLTYMQKIDQLESLLMAKDN

SEQ ID NO: 3185819 - protein, 23 aa, Giardia lamblia
ESSRQFYQRAYNLAIRSGDFEHA

SEQ ID NO: 3185820 - protein, 21 aa, Giardia lamblia
ESSYFINMIYVLVSGQTAECY

SEQ ID NO: 3185821 - protein, 24 aa, Giardia lamblia
ESSYKRGLLKMLKRIHPLVINLRS

SEQ ID NO: 3185822 - protein, 22 aa, Giardia lamblia
ESTLFRVILRQCLSSKSCCYKY

SEQ ID NO: 3185823 - protein, 17 aa, Giardia lamblia
ESTLIRAVKRSDKRLLE

SEQ ID NO: 3185824 - protein, 18 aa, Giardia lamblia
ESTLLVLINYPTLVCTKA

SEQ ID NO: 3185825 - protein, 18 aa, Giardia lamblia
ESTLRCYDFLSTNGSLFD

SEQ ID NO: 3185826 - protein, 24 aa, Giardia lamblia
ESTRAPLTLGMANELLNTALKLEE

SEQ ID NO: 3185827 - protein, 24 aa, Giardia lamblia
ESVALACITYLDAGYSQCEFLFDK

SEQ ID NO: 3185828 - protein, 21 aa, Giardia lamblia
ESVALFKLHSFLPLTEQNSCL

SEQ ID NO: 3185829 - protein, 19 aa, Giardia lamblia
ESVKLLLSEACLLDHTGYT

SEQ ID NO: 3185830 - protein, 23 aa, Giardia lamblia
ESVKVFCRFRPFNEKFEPISNPC

SEQ ID NO: 3185831 - protein, 26 aa, Giardia lamblia
ESVSLCLRLPLEVGLEGFLGAQGSHS

SEQ ID NO: 3185832 - protein, 20 aa, Giardia lamblia
ESVSVLRRLLSPDRKTVAKA

SEQ ID NO: 3185833 - protein, 20 aa, Giardia lamblia
ESYILPYEEILCNEFPQMEF

SEQ ID NO: 3185834 - protein, 29 aa, Giardia lamblia
ESYIRGKILELFQINDYKLFTTMITGIYG

SEQ ID NO: 3185835 - protein, 28 aa, Giardia lamblia
ESYLRKVVMPLEYLLKSYKRIFVKDSSI

SEQ ID NO: 3185836 - protein, 25 aa, Giardia lamblia
ESYVRVLDVVHLPLTLKNVGLTSAR

SEQ ID NO: 3185837 - protein, 18 aa, Giardia lamblia
ETAFQRAPVKFSAALLNL

SEQ ID NO: 3185838 - protein, 25 aa, Giardia lamblia
ETAGDLLELIFDDAFKTLLAHMVRK

SEQ ID NO: 3185839 - protein, 24 aa, Giardia lamblia
ETALIIAMQAHKLKIVQLLAPREA

SEQ ID NO: 3185840 - protein, 18 aa, Giardia lamblia
ETALILAAKLNHPDIVEA

SEQ ID NO: 3185841 - protein, 22 aa, Giardia lamblia
ETALMIACRMNNANLASILIPS

SEQ ID NO: 3185842 - protein, 26 aa, Giardia lamblia
ETALVIAIDNNLFMGIELLARNEANS

SEQ ID NO: 3185843 - protein, 25 aa, Giardia lamblia
ETASGYWFVFLTRPESKPLSDELQA

SEQ ID NO: 3185844 - protein, 29 aa, Giardia lamblia
ETAYTCVESSYFLRVLLAGSTKEVSDRII

SEQ ID NO: 3185845 - protein, 28 aa, Giardia lamblia
ETDAALAFVPLLNKTLAPFASASLMVFH

SEQ ID NO: 3185846 - protein, 26 aa, Giardia lamblia
ETDPDTIKYLAPLLKEYKSIVQAIDE

SEQ ID NO: 3185847 - protein, 18 aa, Giardia lamblia
ETDRYTFVYGLHLETNSY

SEQ ID NO: 3185848 - protein, 20 aa, Giardia lamblia
ETEAERLRKLAELNDFAAEQ

SEQ ID NO: 3185849 - protein, 20 aa, Giardia lamblia
ETEALLKREQGELTLRYSAE

SEQ ID NO: 3185850 - protein, 18 aa, Giardia lamblia
ETENVIMLPIDSTSLCSY

SEQ ID NO: 3185851 - protein, 25 aa, Giardia lamblia
ETEPIPNPLILLLATRAGSPRAPSL

SEQ ID NO: 3185852 - protein, 30 aa, Giardia lamblia
ETEPSSLIYVPLFGLKYAQQFMYSSGFDSS

SEQ ID NO: 3185853 - protein, 22 aa, Giardia lamblia
ETEVMALKMKFLKTVTAEVSNV

SEQ ID NO: 3185854 - protein, 21 aa, Giardia lamblia
ETFFQSNLAAFTMLLDYISDI

SEQ ID NO: 3185855 - protein, 17 aa, Giardia lamblia
ETFIRRSWYVIPTEQQQ

SEQ ID NO: 3185856 - protein, 18 aa, Giardia lamblia
ETFKLFEFTLVSYTKKEI

SEQ ID NO: 3185857 - protein, 20 aa, Giardia lamblia
ETFRLAELAVLLPVMELCQV

SEQ ID NO: 3185858 - protein, 20 aa, Giardia lamblia
ETFTLLMPGSPHRQSRKGNL

SEQ ID NO: 3185859 - protein, 17 aa, Giardia lamblia
ETFVWDITAQMVLALRY

SEQ ID NO: 3185860 - protein, 17 aa, Giardia lamblia
ETGAHVAIFVMRNIYKR

SEQ ID NO: 3185861 - protein, 23 aa, Giardia lamblia
ETGKANVHRLLAELEWRSKDSES

SEQ ID NO: 3185862 - protein, 28 aa, Giardia lamblia
ETGKAYIDFIPLTYLLPSESTMFAEELK

SEQ ID NO: 3185863 - protein, 25 aa, Giardia lamblia
ETGKEFLNGLIKSSAILSSLDSKID

SEQ ID NO: 3185864 - protein, 22 aa, Giardia lamblia
ETGLIDWRSYLTAVTDILWQND

SEQ ID NO: 3185865 - protein, 26 aa, Giardia lamblia
ETGNDIIFFWVARMVMLSLELYNVLP

SEQ ID NO: 3185866 - protein, 23 aa, Giardia lamblia
ETGPFVKDLTYSPNGRFLAITGD

SEQ ID NO: 3185867 - protein, 23 aa, Giardia lamblia
ETGRYMVVQFDNPDLAAAAIEAL

SEQ ID NO: 3185868 - protein, 27 aa, Giardia lamblia
ETGSQINSFLIPIKRKNSIADIAYDTA

SEQ ID NO: 3185869 - protein, 19 aa, Giardia lamblia
ETHLRMQELFNMKSPDRHI

SEQ ID NO: 3185870 - protein, 34 aa, Giardia lamblia
ETHRSHPHLYPDGFARFLLFCRHPTVISEQRLIS

SEQ ID NO: 3185871 - protein, 26 aa, Giardia lamblia
ETIGMKSWLVPYQFTPLFASDQNERN

SEQ ID NO: 3185872 - protein, 18 aa, Giardia lamblia
ETILCAYKYLGSESARPV

SEQ ID NO: 3185873 - protein, 21 aa, Giardia lamblia
ETILGYIEKHPLARILIMVVK

SEQ ID NO: 3185874 - protein, 18 aa, Giardia lamblia
ETILRCVSFRHLARNKTA

SEQ ID NO: 3185875 - protein, 23 aa, Giardia lamblia
ETILYSKLYLESPYSCLYVYQNL

SEQ ID NO: 3185876 - protein, 23 aa, Giardia lamblia
ETIYPKVLPHLYSLDPQISMHFH

SEQ ID NO: 3185877 - protein, 23 aa, Giardia lamblia
ETKAKWIVALSAMVAVAGLQRSC

SEQ ID NO: 3185878 - protein, 21 aa, Giardia lamblia
ETKDFLPNRHLPILQSPSAPD

SEQ ID NO: 3185879 - protein, 27 aa, Giardia lamblia
ETKEILLSYVRTLTLITPCVWDGSLKT

SEQ ID NO: 3185880 - protein, 30 aa, Giardia lamblia
ETKLSEIKRWLFAFRRDVLADPQAALTIGD

SEQ ID NO: 3185881 - protein, 21 aa, Giardia lamblia
ETKRFIYFYVGQLAFLIFKSG

SEQ ID NO: 3185882 - protein, 23 aa, Giardia lamblia
ETKTAQIIALTEKISRLESTIES

SEQ ID NO: 3185883 - protein, 21 aa, Giardia lamblia
ETLCLQALRNLQFQVVKKPGE

SEQ ID NO: 3185884 - protein, 20 aa, Giardia lamblia
ETLDWEVLQGLITASKVTGE

SEQ ID NO: 3185885 - protein, 23 aa, Giardia lamblia
ETLEQLLSIKFPRPLDGEECNGF

SEQ ID NO: 3185886 - protein, 25 aa, Giardia lamblia
ETLERFIAKAWLLRNGTRLSSASEM

SEQ ID NO: 3185887 - protein, 17 aa, Giardia lamblia
ETLIFSEARTKQCVTQL

SEQ ID NO: 3185888 - protein, 37 aa, Giardia lamblia
ETLKIVGPRLSILRPPRTFYLETIIDLQFSKRDFATK

SEQ ID NO: 3185889 - protein, 32 aa, Giardia lamblia
ETLLPANQIFYTTLFPILPMDHDLRINVAISI

SEQ ID NO: 3185890 - protein, 25 aa, Giardia lamblia
ETLSTRTYVNLLDKIPGIVDQELKE

SEQ ID NO: 3185891 - protein, 23 aa, Giardia lamblia
ETLYAIWEKYSLLRLDELVYFHS

SEQ ID NO: 3185892 - protein, 27 aa, Giardia lamblia
ETMAKYYELAIFTASLRVYCDAVMEKL

SEQ ID NO: 3185893 - protein, 17 aa, Giardia lamblia
ETMRELGFKWRIGGLNA

SEQ ID NO: 3185894 - protein, 26 aa, Giardia lamblia
ETPDGRFRFAIGLLLSARNLDRVTAA

SEQ ID NO: 3185895 - protein, 21 aa, Giardia lamblia
ETQILGILRDPSFPEYVDAVE

SEQ ID NO: 3185896 - protein, 22 aa, Giardia lamblia
ETRERLIHMVCIDGMNVQSAVK

SEQ ID NO: 3185897 - protein, 28 aa, Giardia lamblia
ETREYEVWLSYIQIFNEIGYDLLGIPGE

SEQ ID NO: 3185898 - protein, 22 aa, Giardia lamblia
ETRFMLPCGFFKHRISTVHELK

SEQ ID NO: 3185899 - protein, 17 aa, Giardia lamblia
ETRYLLAVALTNQIKLY

SEQ ID NO: 3185900 - protein, 34 aa, Giardia lamblia
ETSSVVFVPAFTGLLCPFWCPHARAGIFNLSYST

SEQ ID NO: 3185901 - protein, 26 aa, Giardia lamblia
ETTNTDYLYIYLPDEYKGWSLTEPLP

SEQ ID NO: 3185902 - protein, 23 aa, Giardia lamblia
ETTQLSILLPLSHLPEDTRRNFS

SEQ ID NO: 3185903 - protein, 23 aa, Giardia lamblia
ETVFPCIMTILDCFHHKDPLIIG

SEQ ID NO: 3185904 - protein, 18 aa, Giardia lamblia
ETVILPQQRLRNIFITWK

SEQ ID NO: 3185905 - protein, 23 aa, Giardia lamblia
ETVLDLKIAFQTLNDKLVDQLTS

SEQ ID NO: 3185906 - protein, 23 aa, Giardia lamblia
ETVSIRLWDTMKGEYMGGVSSLA

SEQ ID NO: 3185907 - protein, 26 aa, Giardia lamblia
ETYKSCSALLLKINQVGTITGAIDAA

SEQ ID NO: 3185908 - protein, 17 aa, Giardia lamblia
ETYYELNLLKKDDLDMT

SEQ ID NO: 3185909 - protein, 18 aa, Giardia lamblia
EVAKARTNVYPIIADARH

SEQ ID NO: 3185910 - protein, 25 aa, Giardia lamblia
EVALELLTISQLRWVPRAASVLYKA

SEQ ID NO: 3185911 - protein, 24 aa, Giardia lamblia
EVALNRIKLTHFYGRHLVPEFTTE

SEQ ID NO: 3185912 - protein, 18 aa, Giardia lamblia
EVAQADHKIGLFGSLIVK

SEQ ID NO: 3185913 - protein, 25 aa, Giardia lamblia
EVARILYYREAGITRPDGWTAMMYA

SEQ ID NO: 3185914 - protein, 25 aa, Giardia lamblia
EVARRIYRCPAYRTLARAGVLSTTG

SEQ ID NO: 3185915 - protein, 24 aa, Giardia lamblia
EVAVADAYKYGFLPALNGTYHYAG

SEQ ID NO: 3185916 - protein, 25 aa, Giardia lamblia
EVCKVLLPAIGARDDYMMFTALHYA

SEQ ID NO: 3185917 - protein, 17 aa, Giardia lamblia
EVCPADVFDFPSGAKVV

SEQ ID NO: 3185918 - protein, 26 aa, Giardia lamblia
EVDFGTRLFKFLATNGEYVTADQMGA

SEQ ID NO: 3185919 - protein, 26 aa, Giardia lamblia
EVDISGVILLIMAPIPYGYPSEQPRP

SEQ ID NO: 3185920 - protein, 24 aa, Giardia lamblia
EVDKRSALLDAIIQTFIPQCEVAK

SEQ ID NO: 3185921 - protein, 24 aa, Giardia lamblia
EVDLLAEVDALKRELRNKRDEADK

SEQ ID NO: 3185922 - protein, 39 aa, Giardia lamblia
EVDMQGFNLCRIQLLTAHYCFLYRYGRHISWDPCVLSKQ

SEQ ID NO: 3185923 - protein, 24 aa, Giardia lamblia
EVDRLAYPIALKRQVLLQMKEAGH

SEQ ID NO: 3185924 - protein, 21 aa, Giardia lamblia
EVDSLKRLLARKEADLEEVHT

SEQ ID NO: 3185925 - protein, 26 aa, Giardia lamblia
EVENLQEMIPLLKAKDVQIIQLTEQI

SEQ ID NO: 3185926 - protein, 26 aa, Giardia lamblia
EVERRLEPYRSLFPSVNPSGQPVTAS

SEQ ID NO: 3185927 - protein, 29 aa, Giardia lamblia
EVERTLKLENLGLTRRLKYAVLRARELEG

SEQ ID NO: 3185928 - protein, 31 aa, Giardia lamblia
EVESGLRCRLLVHFPLFVEYSENRPAIKKRA

SEQ ID NO: 3185929 - protein, 17 aa, Giardia lamblia
EVETLRKSNPQLAELIN

SEQ ID NO: 3185930 - protein, 23 aa, Giardia lamblia
EVFAKACIINFTIIKEGLTDQLL

SEQ ID NO: 3185931 - protein, 17 aa, Giardia lamblia
EVFLPICERLKDPLMAG

SEQ ID NO: 3185932 - protein, 17 aa, Giardia lamblia
EVFRRRLRMFPSLVGSC

SEQ ID NO: 3185933 - protein, 21 aa, Giardia lamblia
EVGIGFIKPKGVKVKTQAGVS

SEQ ID NO: 3185934 - protein, 24 aa, Giardia lamblia
EVGRDLIDFVYKMQNSLVQLQNQV

SEQ ID NO: 3185935 - protein, 24 aa, Giardia lamblia
EVHTVFLLEKILGEYTLIPKFSFS

SEQ ID NO: 3185936 - protein, 27 aa, Giardia lamblia
EVHYSKLYYYGLWTDYSIPDNFEIIFL

SEQ ID NO: 3185937 - protein, 19 aa, Giardia lamblia
EVIASGWYMRTGTALMMAA

SEQ ID NO: 3185938 - protein, 18 aa, Giardia lamblia
EVIPFINQLRQSRHYDMV

SEQ ID NO: 3185939 - protein, 17 aa, Giardia lamblia
EVIPRIPFGTQPFDVDF

SEQ ID NO: 3185940 - protein, 17 aa, Giardia lamblia
EVIPRTLLQNCGGNIIR

SEQ ID NO: 3185941 - protein, 18 aa, Giardia lamblia
EVISRWALTTQGKKGRGD

SEQ ID NO: 3185942 - protein, 18 aa, Giardia lamblia
EVKAFRASLAKLADIYCN

SEQ ID NO: 3185943 - protein, 28 aa, Giardia lamblia
EVKHEPIWFCEGLPFHERPFFATKIREL

SEQ ID NO: 3185944 - protein, 17 aa, Giardia lamblia
EVKLNMAQLRQSDVLEK

SEQ ID NO: 3185945 - protein, 17 aa, Giardia lamblia
EVKTCCVIGFPLGCMTT

SEQ ID NO: 3185946 - protein, 21 aa, Giardia lamblia
EVLAILQQYLSNNAKVSLKSR

SEQ ID NO: 3185947 - protein, 18 aa, Giardia lamblia
EVLCSALAAFEGHVYSSI

SEQ ID NO: 3185948 - protein, 25 aa, Giardia lamblia
EVLEYMPVGILTDDDLQYLPLEVQE

SEQ ID NO: 3185949 - protein, 25 aa, Giardia lamblia
EVLKLRDEIALLTHKHRQELEEREN

SEQ ID NO: 3185950 - protein, 17 aa, Giardia lamblia
EVLKNSKTRLLYENYRE

SEQ ID NO: 3185951 - protein, 18 aa, Giardia lamblia
EVLKSDRSIPAISGFKSL

SEQ ID NO: 3185952 - protein, 18 aa, Giardia lamblia
EVLLFDRTMTLSQSGRSN

SEQ ID NO: 3185953 - protein, 18 aa, Giardia lamblia
EVLLQVTTGLMYLHSPNK

SEQ ID NO: 3185954 - protein, 26 aa, Giardia lamblia
EVLNAHLHSLLPWGNHKVLICQNWTI

SEQ ID NO: 3185955 - protein, 18 aa, Giardia lamblia
EVLSYPNTTSLLFSPNGH

SEQ ID NO: 3185956 - protein, 20 aa, Giardia lamblia
EVLYVIMEFCTNGDLSSIMM

SEQ ID NO: 3185957 - protein, 26 aa, Giardia lamblia
EVMRENVIELLFRKLQHNSEEIECLR

SEQ ID NO: 3185958 - protein, 25 aa, Giardia lamblia
EVNLRSFRFFSWNNNYHRLPDTITK

SEQ ID NO: 3185959 - protein, 26 aa, Giardia lamblia
EVNNKLFLVHKVTLSNIGRLGIESLA

SEQ ID NO: 3185960 - protein, 17 aa, Giardia lamblia
EVNRAISIYKRSSDWLA

SEQ ID NO: 3185961 - protein, 29 aa, Giardia lamblia
EVPGGVRRCWCERGFLPALDRSECVLPTE

SEQ ID NO: 3185962 - protein, 23 aa, Giardia lamblia
EVPLCERILPYILREESMHAEDV

SEQ ID NO: 3185963 - protein, 21 aa, Giardia lamblia
EVPLKLKEQITYLSHKLQEVA

SEQ ID NO: 3185964 - protein, 29 aa, Giardia lamblia
EVPPNQLLTPLLFYYKAFLDHLNARMYSL

SEQ ID NO: 3185965 - protein, 20 aa, Giardia lamblia
EVPQPFPPPSTSKFSTIYGL

SEQ ID NO: 3185966 - protein, 36 aa, Giardia lamblia
EVQGLRMTIMFRPGIFRFFLKTYKTVAIIISTLGTQ

SEQ ID NO: 3185967 - protein, 24 aa, Giardia lamblia
EVQRLKGELTLSKAALADTIVQKT

SEQ ID NO: 3185968 - protein, 24 aa, Giardia lamblia
EVRERTRFLLNARPETTQPCPHMA

SEQ ID NO: 3185969 - protein, 29 aa, Giardia lamblia
EVSMVLYPPELLFEPMLAAARPLSTKGGE

SEQ ID NO: 3185970 - protein, 23 aa, Giardia lamblia
EVSRIELLGPVPMATSFNSQLLT

SEQ ID NO: 3185971 - protein, 25 aa, Giardia lamblia
EVSTELELFLQKLPTKNIQSVDLFT

SEQ ID NO: 3185972 - protein, 25 aa, Giardia lamblia
EVSTWIRIFATYTRADFRQLHKMYS

SEQ ID NO: 3185973 - protein, 24 aa, Giardia lamblia
EVTDIIYTGPSLYSQYLASQVGSG

SEQ ID NO: 3185974 - protein, 19 aa, Giardia lamblia
EVTIYCAIAAGIAAQRPSL

SEQ ID NO: 3185975 - protein, 23 aa, Giardia lamblia
EVTKLLGDIKRLEKEKMQFLSKM

SEQ ID NO: 3185976 - protein, 17 aa, Giardia lamblia
EVTLIADVWAGGGNLGP

SEQ ID NO: 3185977 - protein, 21 aa, Giardia lamblia
EVVAPLPRAPSAHVLSPTGDS

SEQ ID NO: 3185978 - protein, 19 aa, Giardia lamblia
EVVAWIRRILEVEKTGHSG

SEQ ID NO: 3185979 - protein, 23 aa, Giardia lamblia
EVVELLLPYEYLIKTGDQKSALY

SEQ ID NO: 3185980 - protein, 20 aa, Giardia lamblia
EVVLAYLYRCLEPSAAKLAI

SEQ ID NO: 3185981 - protein, 25 aa, Giardia lamblia
EVVPSSLRFFPCRVKILTAMTRLAE

SEQ ID NO: 3185982 - protein, 23 aa, Giardia lamblia
EVWELFAQLVSALHYLHKTNEHI

SEQ ID NO: 3185983 - protein, 18 aa, Giardia lamblia
EVYSLLRDLRDNCPRNLG

SEQ ID NO: 3185984 - protein, 20 aa, Giardia lamblia
EVYYMLMEFCDKGDLSDLIK

SEQ ID NO: 3185985 - protein, 27 aa, Giardia lamblia
EWAALVCSSPWPYGLGQRDTRGQKTQT

SEQ ID NO: 3185986 - protein, 22 aa, Giardia lamblia
EWLVYTHPILFTSISPHNPPAS

SEQ ID NO: 3185987 - protein, 26 aa, Giardia lamblia
EWREHPNIQYIARFLTQLKGPGASSL

SEQ ID NO: 3185988 - protein, 26 aa, Giardia lamblia
EWSIDLIPKFILSSGDLFYMLRHVDC

SEQ ID NO: 3185989 - protein, 21 aa, Giardia lamblia
EWTALMWAALFGRTEVVRLLL

SEQ ID NO: 3185990 - protein, 17 aa, Giardia lamblia
EWYALLSALSSRDILYF

SEQ ID NO: 3185991 - protein, 27 aa, Giardia lamblia
EYADTLKMLFIQLPTNTANDLLDKFNL

SEQ ID NO: 3185992 - protein, 23 aa, Giardia lamblia
EYAQALGFILPDDNDLLYIAREG

SEQ ID NO: 3185993 - protein, 29 aa, Giardia lamblia
EYCRGGSLWGLMAWMRKSDMRFSEQEVWE

SEQ ID NO: 3185994 - protein, 27 aa, Giardia lamblia
EYDKENMLLWDYSLQIADRYGSYTWAC

SEQ ID NO: 3185995 - protein, 21 aa, Giardia lamblia
EYDSQLPFQTRIPLALTQDST

SEQ ID NO: 3185996 - protein, 25 aa, Giardia lamblia
EYEALAYLSKFLQPITYASARIVDT

SEQ ID NO: 3185997 - protein, 25 aa, Giardia lamblia
EYEEHELWRLLTQLSEIVMHIGFLY

SEQ ID NO: 3185998 - protein, 18 aa, Giardia lamblia
EYEERGVFVGAIRSYKLA

SEQ ID NO: 3185999 - protein, 20 aa, Giardia lamblia
EYEGTRIYRPFLEKPQDSED

SEQ ID NO: 3186000 - protein, 17 aa, Giardia lamblia
EYFLLYLATAAPKTEYV

SEQ ID NO: 3186001 - protein, 19 aa, Giardia lamblia
EYFYVVMEFVPNSLDQIIA

SEQ ID NO: 3186002 - protein, 18 aa, Giardia lamblia
EYGKPPVLVFASTSDRVF

SEQ ID NO: 3186003 - protein, 24 aa, Giardia lamblia
EYGKQLLSLQHLLCRSRIAVAEGI

SEQ ID NO: 3186004 - protein, 24 aa, Giardia lamblia
EYGVLDICTFLPSTYFCCANLEIE

SEQ ID NO: 3186005 - protein, 24 aa, Giardia lamblia
EYHLKLETLYPSRIISKQIVISVP

SEQ ID NO: 3186006 - protein, 20 aa, Giardia lamblia
EYKDALNERFDWTYNSDPGE

SEQ ID NO: 3186007 - protein, 23 aa, Giardia lamblia
EYKEALYMYIQLQDLVTARHNQQ

SEQ ID NO: 3186008 - protein, 23 aa, Giardia lamblia
EYKKLYLIHGGLTSYWNACSKVD

SEQ ID NO: 3186009 - protein, 27 aa, Giardia lamblia
EYLDQLLLEIGFYKYVKTTPLMSAALS

SEQ ID NO: 3186010 - protein, 23 aa, Giardia lamblia
EYLRGYYMIQDAASFLPPMALSP

SEQ ID NO: 3186011 - protein, 17 aa, Giardia lamblia
EYLRRRPPYSATHVPED

SEQ ID NO: 3186012 - protein, 21 aa, Giardia lamblia
EYMEYMLKYDTVHGRFDGTIA

SEQ ID NO: 3186013 - protein, 20 aa, Giardia lamblia
EYMSDRELLLQLGRATAKKY

SEQ ID NO: 3186014 - protein, 20 aa, Giardia lamblia
EYNLLYLNKKLYLIDMGQSV

SEQ ID NO: 3186015 - protein, 23 aa, Giardia lamblia
EYNPDFNLYLATRKRQPNYNPDI

SEQ ID NO: 3186016 - protein, 26 aa, Giardia lamblia
EYNRSHIWGAVWLPTARLHRATNKMP

SEQ ID NO: 3186017 - protein, 25 aa, Giardia lamblia
EYPPSYFPNSLTLPSINFTLGDCQV

SEQ ID NO: 3186018 - protein, 33 aa, Giardia lamblia
EYQSPFAMPTDLLDRLLIIHTDAFTEDQIREIL

SEQ ID NO: 3186019 - protein, 23 aa, Giardia lamblia
EYRALMIKQLLRSYINASIPQLA

SEQ ID NO: 3186020 - protein, 19 aa, Giardia lamblia
EYRHHLLLHSIADYSIENL

SEQ ID NO: 3186021 - protein, 26 aa, Giardia lamblia
EYRTSFLLATLFRVKPGGIWTNEDDR

SEQ ID NO: 3186022 - protein, 17 aa, Giardia lamblia
EYRYFFMLRVDEKEHQA

SEQ ID NO: 3186023 - protein, 18 aa, Giardia lamblia
EYSKMMTYLLSYVSHNSS

SEQ ID NO: 3186024 - protein, 20 aa, Giardia lamblia
EYSLWKCTYYDPSKLEEDWK

SEQ ID NO: 3186025 - protein, 19 aa, Giardia lamblia
EYTIIPKPNIFAKYVTMAG

SEQ ID NO: 3186026 - protein, 23 aa, Giardia lamblia
EYVDLNGKLLDPDKLRNSNLLPG

SEQ ID NO: 3186027 - protein, 29 aa, Giardia lamblia
EYVKDASYFIVLIQLKEAPLTCVKVPCKP

SEQ ID NO: 3186028 - protein, 20 aa, Giardia lamblia
EYVLFSTPCASVKVLYKYLY

SEQ ID NO: 3186029 - protein, 19 aa, Giardia lamblia
EYVPPCYRHILISAPTSAG

SEQ ID NO: 3186030 - protein, 26 aa, Giardia lamblia
EYVRSLLDIFIADHSILTLDVGSWVR

SEQ ID NO: 3186031 - protein, 46 aa, Giardia lamblia
EYVSKPYLIGGLKFDLRMYVLVVSVAPILRLLVYEDGMARFATEPY

SEQ ID NO: 3186032 - protein, 27 aa, Giardia lamblia
EYWDPRKCLFGITRLFEQLTSRSTLIY

SEQ ID NO: 3186033 - protein, 26 aa, Giardia lamblia
EYYRVLMDPTLLYGASFQTSGASSRF

SEQ ID NO: 3186034 - protein, 26 aa, Giardia lamblia
FAACYGRLDCVKLLLKREKNVGGMSA

SEQ ID NO: 3186035 - protein, 19 aa, Giardia lamblia
FAAIFARDYEKIKSDLGIY

SEQ ID NO: 3186036 - protein, 25 aa, Giardia lamblia
FAAKFAMLAGNYKLAKILIGYEKDL

SEQ ID NO: 3186037 - protein, 26 aa, Giardia lamblia
FAALCDYHILVWNLADNMAPLAVLVS

SEQ ID NO: 3186038 - protein, 24 aa, Giardia lamblia
FACDVNMIISIRNSGRYKLPLQLV

SEQ ID NO: 3186039 - protein, 29 aa, Giardia lamblia
FACLFICDQTLAISYLLNQFIMTGDNDGA

SEQ ID NO: 3186040 - protein, 26 aa, Giardia lamblia
FADNDISMLAVNRLALRQTFGVQKWP

SEQ ID NO: 3186041 - protein, 32 aa, Giardia lamblia
FADYGQRLTLVLPPEVFQGQGILPVSDMWMLG

SEQ ID NO: 3186042 - protein, 32 aa, Giardia lamblia
FAEAYIPPVLTTAQFRRLRFGDAPLHMSQPEL

SEQ ID NO: 3186043 - protein, 23 aa, Giardia lamblia
FAFARGFLDKCAAYPMPIHAHTQ

SEQ ID NO: 3186044 - protein, 34 aa, Giardia lamblia
FAGEPVIIVRGPLLLCQLLESTLLVLINYPTLVC

SEQ ID NO: 3186045 - protein, 30 aa, Giardia lamblia
FAGTMKDIIFTMWMGYDISKSLMALFSSVR

SEQ ID NO: 3186046 - protein, 17 aa, Giardia lamblia
FAHLKWSTSNSQQEQRR

SEQ ID NO: 3186047 - protein, 41 aa, Giardia lamblia
FAIASLICNDLLKYIIDDLKSPGLLFYFTSESHLHGLLNLL

SEQ ID NO: 3186048 - protein, 18 aa, Giardia lamblia
FAILRRPCDTPIDKDTPS

SEQ ID NO: 3186049 - protein, 26 aa, Giardia lamblia
FAKDIYSIYIIALLLCDLCTSGVQPF

SEQ ID NO: 3186050 - protein, 26 aa, Giardia lamblia
FAKHVTALMLAAWKGNILIAGHLLTE

SEQ ID NO: 3186051 - protein, 18 aa, Giardia lamblia
FAKKRWYERSLLKVLCEE

SEQ ID NO: 3186052 - protein, 32 aa, Giardia lamblia
FALCGTFGLLITDLLCGLLDEIPSHRYTLFEC

SEQ ID NO: 3186053 - protein, 19 aa, Giardia lamblia
FALPSLQLSEPGPCTFVEC

SEQ ID NO: 3186054 - protein, 24 aa, Giardia lamblia
FALSLSVSPLFYDPRQRLDARLNR

SEQ ID NO: 3186055 - protein, 25 aa, Giardia lamblia
FAMTSWGGYLLGLSDGSLLLGQRES

SEQ ID NO: 3186056 - protein, 17 aa, Giardia lamblia
FANFLAALRQEGLPTQV

SEQ ID NO: 3186057 - protein, 28 aa, Giardia lamblia
FAPAIYGHWIVKRGIVLQLLQGVPREFS

SEQ ID NO: 3186058 - protein, 20 aa, Giardia lamblia
FAPVRPPPYYTLVNEDTPPP

SEQ ID NO: 3186059 - protein, 26 aa, Giardia lamblia
FAQADYQHLWNLITSLRSQLEQHCVT

SEQ ID NO: 3186060 - protein, 18 aa, Giardia lamblia
FAQALMYPGAFANEEEEL

SEQ ID NO: 3186061 - protein, 20 aa, Giardia lamblia
FAQIEKAIVLKTLTELSRTQ

SEQ ID NO: 3186062 - protein, 20 aa, Giardia lamblia
FAQKIYQALVVIRAAMRQYR

SEQ ID NO: 3186063 - protein, 27 aa, Giardia lamblia
FAQRNSTIGTPYWLSPQQIKGEPYGFK

SEQ ID NO: 3186064 - protein, 40 aa, Giardia lamblia
FAQTKSRIYITPPLFLSFIRLFKRIFAKSVGKLKVRESIL

SEQ ID NO: 3186065 - protein, 25 aa, Giardia lamblia
FARGNLKSYMRTPAAFYVAQLLSQE

SEQ ID NO: 3186066 - protein, 17 aa, Giardia lamblia
FARIHLPELDILLTMEV

SEQ ID NO: 3186067 - protein, 18 aa, Giardia lamblia
FARKFRRHGMANLTTYNR

SEQ ID NO: 3186068 - protein, 18 aa, Giardia lamblia
FARMLVPYEGTLASKAGR

SEQ ID NO: 3186069 - protein, 28 aa, Giardia lamblia
FASRHPVSMYFIGPVVTVPLQGSTKIYC

SEQ ID NO: 3186070 - protein, 18 aa, Giardia lamblia
FATILTPTALGSINQEVR

SEQ ID NO: 3186071 - protein, 26 aa, Giardia lamblia
FATINGHLQLVKWLAPYEYSIRDNKK

SEQ ID NO: 3186072 - protein, 18 aa, Giardia lamblia
FATKIRELCDLYPILLGT

SEQ ID NO: 3186073 - protein, 20 aa, Giardia lamblia
FATPLPFTEITNVSIALCNE

SEQ ID NO: 3186074 - protein, 18 aa, Giardia lamblia
FATPRKVIGLMRTPLDGA

SEQ ID NO: 3186075 - protein, 28 aa, Giardia lamblia
FAVAKVKEVLGFVRILKAAVPKKKRSLQ

SEQ ID NO: 3186076 - protein, 24 aa, Giardia lamblia
FAVDRSIAFVPPDGEFQLMAFRVT

SEQ ID NO: 3186077 - protein, 18 aa, Giardia lamblia
FAVKVMTYTNPEGKTRQL

SEQ ID NO: 3186078 - protein, 26 aa, Giardia lamblia
FCAACIYACTLYWRQHTCPICMEHLP

SEQ ID NO: 3186079 - protein, 17 aa, Giardia lamblia
FCCAYSEQLRPLLGSGV

SEQ ID NO: 3186080 - protein, 17 aa, Giardia lamblia
FCCHMSESTSCTNQLIL

SEQ ID NO: 3186081 - protein, 18 aa, Giardia lamblia
FCCYNHILSFSDPQLEPN

SEQ ID NO: 3186082 - protein, 21 aa, Giardia lamblia
FCEIIFGCDGSNYTFYDMVSY

SEQ ID NO: 3186083 - protein, 22 aa, Giardia lamblia
FCIKYFLVCTLKTKTGNYSGDT

SEQ ID NO: 3186084 - protein, 27 aa, Giardia lamblia
FCISENYVGFLFYKSLRDAMIRDGILE

SEQ ID NO: 3186085 - protein, 26 aa, Giardia lamblia
FCLKYLKEVLPIVYTPTVGTACSNYS

SEQ ID NO: 3186086 - protein, 18 aa, Giardia lamblia
FCPEGHALMCISHRISLL

SEQ ID NO: 3186087 - protein, 17 aa, Giardia lamblia
FCRAVAQNAVRLSTGCP

SEQ ID NO: 3186088 - protein, 26 aa, Giardia lamblia
FCSRRGLFLAPVLSVTRLFNDPQDFS

SEQ ID NO: 3186089 - protein, 20 aa, Giardia lamblia
FCTLLDFVILSDNQELRDSI

SEQ ID NO: 3186090 - protein, 23 aa, Giardia lamblia
FCTMHKACQCVRTRKINSICVEN

SEQ ID NO: 3186091 - protein, 25 aa, Giardia lamblia
FCYSCNCRFLYVLDFMPSELTSEIE

SEQ ID NO: 3186092 - protein, 20 aa, Giardia lamblia
FDACFRQLQYDKALRAICHA

SEQ ID NO: 3186093 - protein, 24 aa, Giardia lamblia
FDAGKVVLEFQLPYGVSATDINVL

SEQ ID NO: 3186094 - protein, 25 aa, Giardia lamblia
FDDNNPWERYWLNAPRPDATVDAAS

SEQ ID NO: 3186095 - protein, 30 aa, Giardia lamblia
FDDSPRGFYTVYALLFKTLADEELRAAKRR

SEQ ID NO: 3186096 - protein, 19 aa, Giardia lamblia
FDEAYLYLQNLRQQSIQNI

SEQ ID NO: 3186097 - protein, 18 aa, Giardia lamblia
FDEEYIWHLMERIVNSLT

SEQ ID NO: 3186098 - protein, 26 aa, Giardia lamblia
FDEKEKMYLPTLAFGILMTSSNYDDT

SEQ ID NO: 3186099 - protein, 19 aa, Giardia lamblia
FDERLLPPDSETLLYVVKG

SEQ ID NO: 3186100 - protein, 24 aa, Giardia lamblia
FDERSLVWSIGYLVLSMCIYSRRE

SEQ ID NO: 3186101 - protein, 25 aa, Giardia lamblia
FDFYNIDNWCICLMTQELVDLRARQ

SEQ ID NO: 3186102 - protein, 28 aa, Giardia lamblia
FDHSGALPFLFSLFPNFNRPVYTTEATK

SEQ ID NO: 3186103 - protein, 26 aa, Giardia lamblia
FDHVRQWLHICGPIDALWIESMNTVL

SEQ ID NO: 3186104 - protein, 25 aa, Giardia lamblia
FDITLARMLFQWLIDGNKILDAIIK

SEQ ID NO: 3186105 - protein, 18 aa, Giardia lamblia
FDKIVKAIKRDLCCSAYV

SEQ ID NO: 3186106 - protein, 19 aa, Giardia lamblia
FDKLRFWTPGIAFTETNDP

SEQ ID NO: 3186107 - protein, 25 aa, Giardia lamblia
FDKNLPQLVQFLSLLGYFGSVETLK

SEQ ID NO: 3186108 - protein, 24 aa, Giardia lamblia
FDKRLMQYRLSYLDSRSTSRVGSM

SEQ ID NO: 3186109 - protein, 19 aa, Giardia lamblia
FDKYHPGYFGKLGMRNYHV

SEQ ID NO: 3186110 - protein, 23 aa, Giardia lamblia
FDLMLQLAEKLILDGLAYCDKTP

SEQ ID NO: 3186111 - protein, 17 aa, Giardia lamblia
FDNTFFKSALDLSRELS

SEQ ID NO: 3186112 - protein, 42 aa, Giardia lamblia
FDPMNPLGLPKYYDAKVIQFPTHKAFFSNAIFNLLGDYEGLT

SEQ ID NO: 3186113 - protein, 20 aa, Giardia lamblia
FDPQDFIINCLTLQKYYTTN

SEQ ID NO: 3186114 - protein, 26 aa, Giardia lamblia
FDPVTRAHILLVEYAHDWLAHEKRSI

SEQ ID NO: 3186115 - protein, 19 aa, Giardia lamblia
FDQEFLKHLSPWGVTPRAL

SEQ ID NO: 3186116 - protein, 17 aa, Giardia lamblia
FDRKLHIHVRSPTNTYP

SEQ ID NO: 3186117 - protein, 33 aa, Giardia lamblia
FDRNPKSLMWRKILDVYILGCLKPVGGSSNKLD

SEQ ID NO: 3186118 - protein, 21 aa, Giardia lamblia
FDRQTHILSILKIRELQKSSS

SEQ ID NO: 3186119 - protein, 22 aa, Giardia lamblia
FDSHIVLALLFPKQTQVGINHD

SEQ ID NO: 3186120 - protein, 25 aa, Giardia lamblia
FDSLLSKGYIYFYREDELAIVDTGE

SEQ ID NO: 3186121 - protein, 24 aa, Giardia lamblia
FDSLMHASFIICSLLANGCTSPVR

SEQ ID NO: 3186122 - protein, 18 aa, Giardia lamblia
FDSNDMSLLLYASSPSRD

SEQ ID NO: 3186123 - protein, 21 aa, Giardia lamblia
FDSRRTLSLLLGARVIRCIDT

SEQ ID NO: 3186124 - protein, 17 aa, Giardia lamblia
FDTWKKVRIFYDDVRQA

SEQ ID NO: 3186125 - protein, 35 aa, Giardia lamblia
FDTYWNGLARSNKFLDFFITPIVRCTQARNMKTFY

SEQ ID NO: 3186126 - protein, 24 aa, Giardia lamblia
FDVDFTKLLPKYSQFSYQSILGSI

SEQ ID NO: 3186127 - protein, 28 aa, Giardia lamblia
FDVDKDSLMPSLLPPHATGGVKRPARSA

SEQ ID NO: 3186128 - protein, 26 aa, Giardia lamblia
FDWGSQSWTLAKLLSKLDSKQRKIAI

SEQ ID NO: 3186129 - protein, 27 aa, Giardia lamblia
FDYCAMSALIMIQFSIRCRHLTQRSPM

SEQ ID NO: 3186130 - protein, 25 aa, Giardia lamblia
FDYTTPLAIYLDILYGTPRGNQEFD

SEQ ID NO: 3186131 - protein, 24 aa, Giardia lamblia
FEAICRRLYGRLFISSHPVECDDL

SEQ ID NO: 3186132 - protein, 19 aa, Giardia lamblia
FEAPTVFYFTVDELKTFLF

SEQ ID NO: 3186133 - protein, 27 aa, Giardia lamblia
FEARDPYLISWNTAALEKTPWDRFCKI

SEQ ID NO: 3186134 - protein, 26 aa, Giardia lamblia
FEDGPPMFILIAKVDPASVGSVFFNT

SEQ ID NO: 3186135 - protein, 22 aa, Giardia lamblia
FEDIFLRLAQLGPMQDFLVAEN

SEQ ID NO: 3186136 - protein, 20 aa, Giardia lamblia
FEDPMVTKIFLLVKDMKRPQ

SEQ ID NO: 3186137 - protein, 23 aa, Giardia lamblia
FEDRFLMKRILASKEERAAGQRS

SEQ ID NO: 3186138 - protein, 17 aa, Giardia lamblia
FEEFLSKILVYDPKRRW

SEQ ID NO: 3186139 - protein, 26 aa, Giardia lamblia
FEESQVLRWIAQLASALWYIHSKGLI

SEQ ID NO: 3186140 - protein, 26 aa, Giardia lamblia
FEFDTNSLNFFSAQTAAAVSAAVSAA

SEQ ID NO: 3186141 - protein, 26 aa, Giardia lamblia
FEGCKSILMDFFRGPTITAMAHASLR

SEQ ID NO: 3186142 - protein, 22 aa, Giardia lamblia
FEGFVEIIITLATLLGPQVLAS

SEQ ID NO: 3186143 - protein, 21 aa, Giardia lamblia
FEHRSIIKGKIAYVNMRMADL

SEQ ID NO: 3186144 - protein, 19 aa, Giardia lamblia
FEIKHFVGCLSMANAGPNT

SEQ ID NO: 3186145 - protein, 18 aa, Giardia lamblia
FEILVKRVRSLLDRSIRE

SEQ ID NO: 3186146 - protein, 17 aa, Giardia lamblia
FEISQIFHTRYSLFKMA

SEQ ID NO: 3186147 - protein, 31 aa, Giardia lamblia
FEIVRNGGVFPFLPSGSLYYHDYSTNTLQYI

SEQ ID NO: 3186148 - protein, 30 aa, Giardia lamblia
FEKAILVFSKFLQKGLVAHLGLLVFDEIHL

SEQ ID NO: 3186149 - protein, 30 aa, Giardia lamblia
FEKLIPDVSFAEHYFLLTRATLLGAQMFNY

SEQ ID NO: 3186150 - protein, 26 aa, Giardia lamblia
FEKNLDIWRQLWRVVERSDILFQVVD

SEQ ID NO: 3186151 - protein, 34 aa, Giardia lamblia
FEKPTPPLIPAVHFPVLPDPPGAPLLELFDLDTE

SEQ ID NO: 3186152 - protein, 24 aa, Giardia lamblia
FELAKARVISFLDSYKQPLPTEER

SEQ ID NO: 3186153 - protein, 17 aa, Giardia lamblia
FELAVMASNGIFGMTGK

SEQ ID NO: 3186154 - protein, 24 aa, Giardia lamblia
FELESKMILPNNKTLLMISAEAGA

SEQ ID NO: 3186155 - protein, 28 aa, Giardia lamblia
FELTVNVSWFEALKYMVEKRISAVPVKD

SEQ ID NO: 3186156 - protein, 23 aa, Giardia lamblia
FEPVFPATILKNIVFISQVLPDG

SEQ ID NO: 3186157 - protein, 26 aa, Giardia lamblia
FEQFLSKIQLLLFYDHLEAPDPISIG

SEQ ID NO: 3186158 - protein, 19 aa, Giardia lamblia
FEQKLLFNAAVVRRKSLFF

SEQ ID NO: 3186159 - protein, 25 aa, Giardia lamblia
FEQTAFCAAHYWLCEPSKAAAFLIH

SEQ ID NO: 3186160 - protein, 26 aa, Giardia lamblia
FERRGFKLVAMKFFVPSKNLVEEHYK

SEQ ID NO: 3186161 - protein, 25 aa, Giardia lamblia
FESFSIIRCLLDSGVAPSSIFLLIP

SEQ ID NO: 3186162 - protein, 27 aa, Giardia lamblia
FESVLGIPGFLVWSAVPIMISHYSNIN

SEQ ID NO: 3186163 - protein, 18 aa, Giardia lamblia
FETQLARTQFRMMPLVTP

SEQ ID NO: 3186164 - protein, 22 aa, Giardia lamblia
FEVCTFKPELSARTEKIMAKKN

SEQ ID NO: 3186165 - protein, 21 aa, Giardia lamblia
FEVHKLLFAVLVAIRIKHHAG

SEQ ID NO: 3186166 - protein, 18 aa, Giardia lamblia
FEVLHFICAQFGVSVTLY

SEQ ID NO: 3186167 - protein, 20 aa, Giardia lamblia
FFAFFLSPRVVDMVETLFWL

SEQ ID NO: 3186168 - protein, 18 aa, Giardia lamblia
FFAIMNKIQKYESFTDSR

SEQ ID NO: 3186169 - protein, 17 aa, Giardia lamblia
FFAKRRLVTIFSAPNYC

SEQ ID NO: 3186170 - protein, 17 aa, Giardia lamblia
FFALAHASLLGPTAFTC

SEQ ID NO: 3186171 - protein, 20 aa, Giardia lamblia
FFASLRKFVLTPDFVQSLTS

SEQ ID NO: 3186172 - protein, 19 aa, Giardia lamblia
FFCALPIAHTIDRNIFMVH

SEQ ID NO: 3186173 - protein, 20 aa, Giardia lamblia
FFDPSRFVSVMLGYGDIVGL

SEQ ID NO: 3186174 - protein, 19 aa, Giardia lamblia
FFHGFNFYSNLYAPFLNKL

SEQ ID NO: 3186175 - protein, 30 aa, Giardia lamblia
FFNIETMAWDPMLLHIFSVSTEVLPVVWPS

SEQ ID NO: 3186176 - protein, 18 aa, Giardia lamblia
FFNIVRQCLRINPVGPCL

SEQ ID NO: 3186177 - protein, 17 aa, Giardia lamblia
FFNLPMLLNEDFGSHAV

SEQ ID NO: 3186178 - protein, 25 aa, Giardia lamblia
FFNSGPYRHMLISDTLRQIIIIGTT

SEQ ID NO: 3186179 - protein, 20 aa, Giardia lamblia
FFNTIIWRCEGFNHETVVDG

SEQ ID NO: 3186180 - protein, 17 aa, Giardia lamblia
FFNTSRYGHFGRSEFPW

SEQ ID NO: 3186181 - protein, 59 aa, Giardia lamblia
FFQEGLRIVADFVARILRFQPLTTLLAIYKAIIGLYCDLLGQYDPNLYFNGDIFTEDWA

SEQ ID NO: 3186182 - protein, 26 aa, Giardia lamblia
FFSDNYRWLVITGNTNFYHLFDLETG

SEQ ID NO: 3186183 - protein, 32 aa, Giardia lamblia
FFYVGRAAIRKLQWLTMAKILVITAASPDIYM

SEQ ID NO: 3186184 - protein, 17 aa, Giardia lamblia
FGALSIAILLDNIDTVT

SEQ ID NO: 3186185 - protein, 20 aa, Giardia lamblia
FGAMIWGINDISFSASFASK

SEQ ID NO: 3186186 - protein, 21 aa, Giardia lamblia
FGAQLRFKPDFYLSDSILGSE

SEQ ID NO: 3186187 - protein, 29 aa, Giardia lamblia
FGASIHPDLLSYLLKFKPVRSMDYFNDAG

SEQ ID NO: 3186188 - protein, 21 aa, Giardia lamblia
FGDFRHYFVLRYKDPKRGTPQ

SEQ ID NO: 3186189 - protein, 27 aa, Giardia lamblia
FGDRKKNLFKLVLLGAPGAGKGTQAKH

SEQ ID NO: 3186190 - protein, 24 aa, Giardia lamblia
FGDSTIEVPPTFGLILVSMCDIHI

SEQ ID NO: 3186191 - protein, 22 aa, Giardia lamblia
FGDSTVKWFSLPLSAETTPLNI

SEQ ID NO: 3186192 - protein, 20 aa, Giardia lamblia
FGDWFLDLVGKYTSSYTIFQ

SEQ ID NO: 3186193 - protein, 17 aa, Giardia lamblia
FGEVGIGFIKPKGVKVK

SEQ ID NO: 3186194 - protein, 17 aa, Giardia lamblia
FGFIQRINQKAAALGKR

SEQ ID NO: 3186195 - protein, 18 aa, Giardia lamblia
FGFLSQALRSCCLGYTFK

SEQ ID NO: 3186196 - protein, 24 aa, Giardia lamblia
FGGRDQSLIWLTDLGSVYTPDHTS

SEQ ID NO: 3186197 - protein, 33 aa, Giardia lamblia
FGHIDCVRMLIPKEIRLRDRRGRSALHYATEAA

SEQ ID NO: 3186198 - protein, 25 aa, Giardia lamblia
FGHTPLWPMIIVLKNTIGQSRKKHI

SEQ ID NO: 3186199 - protein, 17 aa, Giardia lamblia
FGIFRYIDGNTKALTFA

SEQ ID NO: 3186200 - protein, 17 aa, Giardia lamblia
FGILPDRKTMDVINAEK

SEQ ID NO: 3186201 - protein, 32 aa, Giardia lamblia
FGKDEYSFELFKSWVSRRFPFQFREGNFPLRH

SEQ ID NO: 3186202 - protein, 24 aa, Giardia lamblia
FGKGFEGIFYGIENTRLFAEYGPL

SEQ ID NO: 3186203 - protein, 17 aa, Giardia lamblia
FGKPAREISLYKVAKPL

SEQ ID NO: 3186204 - protein, 29 aa, Giardia lamblia
FGLDSDNWDIVSLMLPYEASVRNAAGDTL

SEQ ID NO: 3186205 - protein, 21 aa, Giardia lamblia
FGLNRDFFEKLLYDLTELSDP

SEQ ID NO: 3186206 - protein, 42 aa, Giardia lamblia
FGLQVLTIKLIPYTITQLLLFFDRLFFFLEVRHLGPKISEFM

SEQ ID NO: 3186207 - protein, 25 aa, Giardia lamblia
FGMQYSFLELLGKTDVLLIKGSTGS

SEQ ID NO: 3186208 - protein, 18 aa, Giardia lamblia
FGNFLGTDIFCPHCGKYV

SEQ ID NO: 3186209 - protein, 17 aa, Giardia lamblia
FGNFVYKNQFKYYQHLG

SEQ ID NO: 3186210 - protein, 31 aa, Giardia lamblia
FGNTGLLSEARFKAALRNAGFSAPGHMIQKA

SEQ ID NO: 3186211 - protein, 23 aa, Giardia lamblia
FGNTVEALLIDSNKKKPVALNLT

SEQ ID NO: 3186212 - protein, 17 aa, Giardia lamblia
FGPGNETMFARDKIFTG

SEQ ID NO: 3186213 - protein, 25 aa, Giardia lamblia
FGPIDFHAFITACEKPRPLTIRVNS

SEQ ID NO: 3186214 - protein, 39 aa, Giardia lamblia
FGPNTRRVFHSISVYNFYVLYNLELLFNYVHVKIGEIAK

SEQ ID NO: 3186215 - protein, 24 aa, Giardia lamblia
FGQEWTLRVLVPKIATLKQNSNYL

SEQ ID NO: 3186216 - protein, 17 aa, Giardia lamblia
FGQYILRSIMLVMCPTG

SEQ ID NO: 3186217 - protein, 17 aa, Giardia lamblia
FGRIAVKLCLFAERILN

SEQ ID NO: 3186218 - protein, 17 aa, Giardia lamblia
FGRIMCYVTAFAKALPQ

SEQ ID NO: 3186219 - protein, 20 aa, Giardia lamblia
FGRTGLIPDMRAFTASSADT

SEQ ID NO: 3186220 - protein, 18 aa, Giardia lamblia
FGSFSKPGFGAPPAPQPP

SEQ ID NO: 3186221 - protein, 17 aa, Giardia lamblia
FGSRYYTTVIDIWSFGC

SEQ ID NO: 3186222 - protein, 18 aa, Giardia lamblia
FGSSKLMMEIPSAGVPME

SEQ ID NO: 3186223 - protein, 35 aa, Giardia lamblia
FGSVFEVLLFLHFLCAQVTRWFLPELQGAVNVFER

SEQ ID NO: 3186224 - protein, 17 aa, Giardia lamblia
FGTISLALPVFHPGLIN

SEQ ID NO: 3186225 - protein, 17 aa, Giardia lamblia
FGTQKLVILIGTNDAEM

SEQ ID NO: 3186226 - protein, 19 aa, Giardia lamblia
FGVGRILYSILEHSFYTRN

SEQ ID NO: 3186227 - protein, 17 aa, Giardia lamblia
FHAVMRLSDEVSAQFVE

SEQ ID NO: 3186228 - protein, 25 aa, Giardia lamblia
FHCQRRYALFKKSLPKKHNPPLKVS

SEQ ID NO: 3186229 - protein, 21 aa, Giardia lamblia
FHDLHWITFPSEANAIACCPH

SEQ ID NO: 3186230 - protein, 18 aa, Giardia lamblia
FHEHLKRQTLKDGTTALM

SEQ ID NO: 3186231 - protein, 19 aa, Giardia lamblia
FHEVRNVFLLAIQSLSRPK

SEQ ID NO: 3186232 - protein, 19 aa, Giardia lamblia
FHFCRQQLNFYRTLCSTNS

SEQ ID NO: 3186233 - protein, 22 aa, Giardia lamblia
FHFTGSHVWIPKQSVCLIVCRN

SEQ ID NO: 3186234 - protein, 19 aa, Giardia lamblia
FHHAVPNISWKSALMRSGQ

SEQ ID NO: 3186235 - protein, 30 aa, Giardia lamblia
FHKEAYKLRRLFLNLILSYKGYAQYSRKED

SEQ ID NO: 3186236 - protein, 19 aa, Giardia lamblia
FHLPKNWDKMITDKNWKER

SEQ ID NO: 3186237 - protein, 18 aa, Giardia lamblia
FHNLLDIAEMMGRFSWPI

SEQ ID NO: 3186238 - protein, 24 aa, Giardia lamblia
FHPESWSPIITFTDIIVGFTSLFS

SEQ ID NO: 3186239 - protein, 18 aa, Giardia lamblia
FHPPDLQKYIDWGAAFGS

SEQ ID NO: 3186240 - protein, 19 aa, Giardia lamblia
FHQQRFRLSGSASMIAATR

SEQ ID NO: 3186241 - protein, 28 aa, Giardia lamblia
FHQTEHYALLDYKPFGADSTATLWRVSH

SEQ ID NO: 3186242 - protein, 20 aa, Giardia lamblia
FHSDVYFTYAGSNAIRFFKR

SEQ ID NO: 3186243 - protein, 17 aa, Giardia lamblia
FHSVFSIGLNSIKIYDG

SEQ ID NO: 3186244 - protein, 22 aa, Giardia lamblia
FHTAPFSWKILGTHKLRKSSAN

SEQ ID NO: 3186245 - protein, 17 aa, Giardia lamblia
FHTPYCTLPKKMHALLY

SEQ ID NO: 3186246 - protein, 23 aa, Giardia lamblia
FHYGERFLPKLHRSNLGPVVLNP

SEQ ID NO: 3186247 - protein, 18 aa, Giardia lamblia
FIAASRYFILDGFVTDHC

SEQ ID NO: 3186248 - protein, 31 aa, Giardia lamblia
FIALEIIQKVNKMLYWNGFPHYGPKPDLPGS

SEQ ID NO: 3186249 - protein, 33 aa, Giardia lamblia
FIAQKVRRALKAKLYPILIRRTTADLGSLDVNK

SEQ ID NO: 3186250 - protein, 26 aa, Giardia lamblia
FIASLPLHNKPIFSVDWVSDATIVSG

SEQ ID NO: 3186251 - protein, 22 aa, Giardia lamblia
FICISCVFLKYADKLALLIHTR

SEQ ID NO: 3186252 - protein, 17 aa, Giardia lamblia
FIDALYKDINTLESEVR

SEQ ID NO: 3186253 - protein, 31 aa, Giardia lamblia
FIDFSYTNNYKLWRYLFCPVPVLEIKTKKTL

SEQ ID NO: 3186254 - protein, 17 aa, Giardia lamblia
FIDIFRLTHMEQPMGKN

SEQ ID NO: 3186255 - protein, 29 aa, Giardia lamblia
FIDSRYNVFMLFVPRYSPEHALWLGEPES

SEQ ID NO: 3186256 - protein, 23 aa, Giardia lamblia
FIDTEFILKLLQLFNTSDPRERD

SEQ ID NO: 3186257 - protein, 19 aa, Giardia lamblia
FIDYASIRLVKPGAYRERI

SEQ ID NO: 3186258 - protein, 26 aa, Giardia lamblia
FIEDILDPKSCTILIRGPTRHTLEQI

SEQ ID NO: 3186259 - protein, 27 aa, Giardia lamblia
FIEFRSHKIIYRRYAGLYFTICCDLND

SEQ ID NO: 3186260 - protein, 25 aa, Giardia lamblia
FIELKRRIIRLLTQRVAPEADVTVK

SEQ ID NO: 3186261 - protein, 19 aa, Giardia lamblia
FIEQFIIKTADAGLDVFRV

SEQ ID NO: 3186262 - protein, 42 aa, Giardia lamblia
FIGGLQIVGPLPPFQQDRNLFYFAISFMKSLMQRDERGFTVL

SEQ ID NO: 3186263 - protein, 23 aa, Giardia lamblia
FIGSGMMVLFKRAAPGVSEQMLQ

SEQ ID NO: 3186264 - protein, 17 aa, Giardia lamblia
FIILSLLNRDNLAHLCL

SEQ ID NO: 3186265 - protein, 18 aa, Giardia lamblia
FIIQPSLLHLAPQESREV

SEQ ID NO: 3186266 - protein, 26 aa, Giardia lamblia
FIKAIIRAPPQFNIQNLLACFERMRC

SEQ ID NO: 3186267 - protein, 18 aa, Giardia lamblia
FILKMLRPYKRVELSHVS

SEQ ID NO: 3186268 - protein, 25 aa, Giardia lamblia
FILKRARWQDIIILGRLAASFNAFE

SEQ ID NO: 3186269 - protein, 17 aa, Giardia lamblia
FINAASNICHFFFLCEE

SEQ ID NO: 3186270 - protein, 24 aa, Giardia lamblia
FIPESLFMLEYINSRSYLFAMDAK

SEQ ID NO: 3186271 - protein, 19 aa, Giardia lamblia
FIPKYIDRGIFKVDPFVTL

SEQ ID NO: 3186272 - protein, 18 aa, Giardia lamblia
FIPPFPKAYDRSLAALCA

SEQ ID NO: 3186273 - protein, 19 aa, Giardia lamblia
FIPTIPAYQALKLDEDLIN

SEQ ID NO: 3186274 - protein, 20 aa, Giardia lamblia
FIQELSLYEQKKRIQQELRE

SEQ ID NO: 3186275 - protein, 26 aa, Giardia lamblia
FIQGGELFYHLRRYNKFPLQVVKFFA

SEQ ID NO: 3186276 - protein, 24 aa, Giardia lamblia
FIRNLDIYLRCVCNHPFTALEHDK

SEQ ID NO: 3186277 - protein, 22 aa, Giardia lamblia
FIRNSKCTPAIFWQHHTDLLDL

SEQ ID NO: 3186278 - protein, 17 aa, Giardia lamblia
FIRRAPRLFTTITGLYK

SEQ ID NO: 3186279 - protein, 17 aa, Giardia lamblia
FIRRCAEATVEGGEDAE

SEQ ID NO: 3186280 - protein, 28 aa, Giardia lamblia
FIRSTQIQLVFLLEYIKKGIKRTGTPLT

SEQ ID NO: 3186281 - protein, 20 aa, Giardia lamblia
FISTPTRISAFTSALRSPEC

SEQ ID NO: 3186282 - protein, 30 aa, Giardia lamblia
FIVERLHGILKPFLLRRVKTEVLAQLPPKE

SEQ ID NO: 3186283 - protein, 17 aa, Giardia lamblia
FIVMVPDVPPPVSKTDR

SEQ ID NO: 3186284 - protein, 18 aa, Giardia lamblia
FIYVIERCHMKDLSSNLK

SEQ ID NO: 3186285 - protein, 22 aa, Giardia lamblia
FKAKLPILCPRKKKNETKDVVL

SEQ ID NO: 3186286 - protein, 25 aa, Giardia lamblia
FKAQPNNFLMLDASIRLWGAEFKQY

SEQ ID NO: 3186287 - protein, 20 aa, Giardia lamblia
FKDISISNIALIFPGGNGPN

SEQ ID NO: 3186288 - protein, 24 aa, Giardia lamblia
FKDKLAFMRFMGLSLTSSEKNKVR

SEQ ID NO: 3186289 - protein, 18 aa, Giardia lamblia
FKDLHGCTALMMAVKDKR

SEQ ID NO: 3186290 - protein, 23 aa, Giardia lamblia
FKDNLCRRLVVVGIPFPNLGDPI

SEQ ID NO: 3186291 - protein, 17 aa, Giardia lamblia
FKDPLAVRQCKYPHELI

SEQ ID NO: 3186292 - protein, 24 aa, Giardia lamblia
FKDTLSCDLKLLLPSFIVNPTTNK

SEQ ID NO: 3186293 - protein, 19 aa, Giardia lamblia
FKEEIDSFLIKAAAEKGDK

SEQ ID NO: 3186294 - protein, 18 aa, Giardia lamblia
FKGITALMIAVLMNSKEE

SEQ ID NO: 3186295 - protein, 23 aa, Giardia lamblia
FKGTPRAIAWAPGSDWFVISTQD

SEQ ID NO: 3186296 - protein, 20 aa, Giardia lamblia
FKHIIIGFLSLFNEYSESAI

SEQ ID NO: 3186297 - protein, 21 aa, Giardia lamblia
FKKLHQYLVEFLTKVSANKKK

SEQ ID NO: 3186298 - protein, 18 aa, Giardia lamblia
FKLLTVIVRDGLSGLLVF

SEQ ID NO: 3186299 - protein, 22 aa, Giardia lamblia
FKNCLQHLPLPYDLSQEEIEGR

SEQ ID NO: 3186300 - protein, 24 aa, Giardia lamblia
FKPATAVVFFELQLCLKISEAEIL

SEQ ID NO: 3186301 - protein, 17 aa, Giardia lamblia
FKPDFYLSDSILGSEDL

SEQ ID NO: 3186302 - protein, 27 aa, Giardia lamblia
FKPIAQLPQLLIMAISLESDTFIDAVT

SEQ ID NO: 3186303 - protein, 19 aa, Giardia lamblia
FKPRKKMFRFQGPGPASVN

SEQ ID NO: 3186304 - protein, 32 aa, Giardia lamblia
FKPVNNLMPVMSLFFKAPLPRTADRSDIVNAF

SEQ ID NO: 3186305 - protein, 29 aa, Giardia lamblia
FKQAESDILEKLNPLLFHHMSEESNSSKE

SEQ ID NO: 3186306 - protein, 17 aa, Giardia lamblia
FKQILDDYYEHGYIAKE

SEQ ID NO: 3186307 - protein, 23 aa, Giardia lamblia
FKQSIIGFLTCNVSVTLPTIRPV

SEQ ID NO: 3186308 - protein, 23 aa, Giardia lamblia
FKRHICPKCGTLYWRRTELRTIC

SEQ ID NO: 3186309 - protein, 18 aa, Giardia lamblia
FKRQLFRNKNRKVCLLEI

SEQ ID NO: 3186310 - protein, 20 aa, Giardia lamblia
FKRSDFIPPFPKAYDRSLAA

SEQ ID NO: 3186311 - protein, 30 aa, Giardia lamblia
FKSRRHPDLSRMFYLELLKKDISVAYGYSD

SEQ ID NO: 3186312 - protein, 27 aa, Giardia lamblia
FKTRRFEGYGYLLRYIDRDLIIQLNVS

SEQ ID NO: 3186313 - protein, 26 aa, Giardia lamblia
FKTVREILSIFTANQVRMLFCMVPYS

SEQ ID NO: 3186314 - protein, 28 aa, Giardia lamblia
FLADFVARYMLLAYASFPPGTSDLSGGE

SEQ ID NO: 3186315 - protein, 19 aa, Giardia lamblia
FLADVSSIDDLSRKVRELE

SEQ ID NO: 3186316 - protein, 20 aa, Giardia lamblia
FLARAALLGLPVVIRRPYIS

SEQ ID NO: 3186317 - protein, 18 aa, Giardia lamblia
FLDFIETIMRIDPRKRPT

SEQ ID NO: 3186318 - protein, 25 aa, Giardia lamblia
FLDGNYTLLPDQLLNIKTSLYTDGV

SEQ ID NO: 3186319 - protein, 18 aa, Giardia lamblia
FLDLFKRTYDIFIVSSDY

SEQ ID NO: 3186320 - protein, 25 aa, Giardia lamblia
FLDQNPQFFTWFCTLLHSSNYATRR

SEQ ID NO: 3186321 - protein, 19 aa, Giardia lamblia
FLEHPGQLPAYSALKGQIC

SEQ ID NO: 3186322 - protein, 17 aa, Giardia lamblia
FLELSKCLLQLEDEHRE

SEQ ID NO: 3186323 - protein, 18 aa, Giardia lamblia
FLETFARCLARLAGRLTG

SEQ ID NO: 3186324 - protein, 18 aa, Giardia lamblia
FLEWRYHAYIRRERAKQL

SEQ ID NO: 3186325 - protein, 18 aa, Giardia lamblia
FLEYEENYLFSSKLLGII

SEQ ID NO: 3186326 - protein, 20 aa, Giardia lamblia
FLFSAQSFLLTISSVLCHFP

SEQ ID NO: 3186327 - protein, 27 aa, Giardia lamblia
FLFTKASAIAMFSFVAGIQRGYCVQRP

SEQ ID NO: 3186328 - protein, 18 aa, Giardia lamblia
FLGFSIRVPRGTTCVQIA

SEQ ID NO: 3186329 - protein, 23 aa, Giardia lamblia
FLGNDAACKLLLPLQAGCTDNMG

SEQ ID NO: 3186330 - protein, 20 aa, Giardia lamblia
FLHVFLEFIPPIIRAVSESN

SEQ ID NO: 3186331 - protein, 20 aa, Giardia lamblia
FLHVPPAGLLYYGQEYRPVP

SEQ ID NO: 3186332 - protein, 19 aa, Giardia lamblia
FLHVSLPSFELIHVYAPNS

SEQ ID NO: 3186333 - protein, 18 aa, Giardia lamblia
FLIAACDVVLDFDYCNNR

SEQ ID NO: 3186334 - protein, 25 aa, Giardia lamblia
FLKAELDRYLLQPLKNPERFERLGL

SEQ ID NO: 3186335 - protein, 18 aa, Giardia lamblia
FLKDIIYCLKMRSQEQSN

SEQ ID NO: 3186336 - protein, 19 aa, Giardia lamblia
FLKIRCPTCQAVEFCSGFC

SEQ ID NO: 3186337 - protein, 18 aa, Giardia lamblia
FLKQMFGGFAGFGEEPAT

SEQ ID NO: 3186338 - protein, 27 aa, Giardia lamblia
FLKREIKALLRVILLGASQTMFYRVID

SEQ ID NO: 3186339 - protein, 17 aa, Giardia lamblia
FLKYPSCTVGLFLRVEF

SEQ ID NO: 3186340 - protein, 18 aa, Giardia lamblia
FLLALSINVLERTPIRHI

SEQ ID NO: 3186341 - protein, 19 aa, Giardia lamblia
FLLSTWIHVTKLAQGSHPP

SEQ ID NO: 3186342 - protein, 18 aa, Giardia lamblia
FLNLKKLGECSKKISNLS

SEQ ID NO: 3186343 - protein, 27 aa, Giardia lamblia
FLNMGEPPVYNFPLLDRDMGCKVYLKM

SEQ ID NO: 3186344 - protein, 24 aa, Giardia lamblia
FLNSLKHILAIYAYRVLDNKEFSV

SEQ ID NO: 3186345 - protein, 31 aa, Giardia lamblia
FLNTAILGYYSPILFKFLLQSSRLSESLSEM

SEQ ID NO: 3186346 - protein, 17 aa, Giardia lamblia
FLPAIFVGYQRSRAKQR

SEQ ID NO: 3186347 - protein, 24 aa, Giardia lamblia
FLPEVLRIITSHPAALGLKELSDE

SEQ ID NO: 3186348 - protein, 28 aa, Giardia lamblia
FLQTREIMKIVKLLRRFGTTTNAHIQQI

SEQ ID NO: 3186349 - protein, 23 aa, Giardia lamblia
FLRELQSFPLVKDLAAMGTEYID

SEQ ID NO: 3186350 - protein, 19 aa, Giardia lamblia
FLRGQLRLLPRAGAPADPP

SEQ ID NO: 3186351 - protein, 18 aa, Giardia lamblia
FLRRQLHLSQKDYSSKQH

SEQ ID NO: 3186352 - protein, 30 aa, Giardia lamblia
FLSAPSLIERLIFVVTAYIYRTVSFGFQQP

SEQ ID NO: 3186353 - protein, 27 aa, Giardia lamblia
FLSDEEYVYFMLAIANTGRIETKGGAI

SEQ ID NO: 3186354 - protein, 26 aa, Giardia lamblia
FLSIKEFPYFMKAVCSPLPPELEERV

SEQ ID NO: 3186355 - protein, 19 aa, Giardia lamblia
FLSKVGFSTSLRYAIQLIT

SEQ ID NO: 3186356 - protein, 20 aa, Giardia lamblia
FLSVFPGVAFHSAISCAAYA

SEQ ID NO: 3186357 - protein, 24 aa, Giardia lamblia
FLSVLKFAAWTLKLDGHLVFWMPY

SEQ ID NO: 3186358 - protein, 18 aa, Giardia lamblia
FLTLFNISSKSRLSLDNF

SEQ ID NO: 3186359 - protein, 17 aa, Giardia lamblia
FLTPLRLLVECVPGFKE

SEQ ID NO: 3186360 - protein, 24 aa, Giardia lamblia
FLVGARLIEYHDFSHIISEQSVRT

SEQ ID NO: 3186361 - protein, 32 aa, Giardia lamblia
FLVNHVPVRTDKYSRGALFYAASNLHITTIRI

SEQ ID NO: 3186362 - protein, 18 aa, Giardia lamblia
FLYESKLSDFIKLEPKLQ

SEQ ID NO: 3186363 - protein, 19 aa, Giardia lamblia
FLYRDRMFTRSLEDCIVAS

SEQ ID NO: 3186364 - protein, 17 aa, Giardia lamblia
FLYYQFEVFEVWLFCHA

SEQ ID NO: 3186365 - protein, 17 aa, Giardia lamblia
FMDSRGFVLNGAIVEDM

SEQ ID NO: 3186366 - protein, 24 aa, Giardia lamblia
FMETNFNGFLSIKPTAGVVAAQSI

SEQ ID NO: 3186367 - protein, 25 aa, Giardia lamblia
FMGHRVKVLPYSTYRLNLSATSSYN

SEQ ID NO: 3186368 - protein, 17 aa, Giardia lamblia
FMGIELLARNEANSTGY

SEQ ID NO: 3186369 - protein, 18 aa, Giardia lamblia
FMIVFAGIGLSHEQAMFF

SEQ ID NO: 3186370 - protein, 20 aa, Giardia lamblia
FMLGRYFTTLKNRLKRHGYQ

SEQ ID NO: 3186371 - protein, 24 aa, Giardia lamblia
FMTHNMPLASLLYEKEMEATFGDR

SEQ ID NO: 3186372 - protein, 18 aa, Giardia lamblia
FMTYRGCPFLSKKVLKDA

SEQ ID NO: 3186373 - protein, 24 aa, Giardia lamblia
FMVDVPHKWPQIPPRFLCGYRRMF

SEQ ID NO: 3186374 - protein, 17 aa, Giardia lamblia
FMVFCHLGQVGLVDNDG

SEQ ID NO: 3186375 - protein, 25 aa, Giardia lamblia
FNADSIDIMLIQAIALIDDTEKDIN

SEQ ID NO: 3186376 - protein, 28 aa, Giardia lamblia
FNDMSMPTILVMLFSEINPKDLNARSTS

SEQ ID NO: 3186377 - protein, 21 aa, Giardia lamblia
FNEFFTLRELNLGYCGIDPLL

SEQ ID NO: 3186378 - protein, 19 aa, Giardia lamblia
FNEMRKLLAPSPASLFLTL

SEQ ID NO: 3186379 - protein, 20 aa, Giardia lamblia
FNEQWLDACHTNHLVGVLNA

SEQ ID NO: 3186380 - protein, 19 aa, Giardia lamblia
FNERIDRAIKLCEPELARM

SEQ ID NO: 3186381 - protein, 28 aa, Giardia lamblia
FNHKTALAILIYLVRKLHNSLWCSQPFV

SEQ ID NO: 3186382 - protein, 36 aa, Giardia lamblia
FNKAFQLTLSILPVWSYRDLLFKLSHSGSGCIIRNV

SEQ ID NO: 3186383 - protein, 21 aa, Giardia lamblia
FNKFLSIIQVTFRRDPENLRP

SEQ ID NO: 3186384 - protein, 20 aa, Giardia lamblia
FNKREIIMDLPMTDYTRLEQ

SEQ ID NO: 3186385 - protein, 27 aa, Giardia lamblia
FNLELYDLLLGYFLTASTPSLTEKPPH

SEQ ID NO: 3186386 - protein, 28 aa, Giardia lamblia
FNLPTEKDLLIFFFTHIRTARPNIFATF

SEQ ID NO: 3186387 - protein, 20 aa, Giardia lamblia
FNMIHFTPINRFGSSGSCYS

SEQ ID NO: 3186388 - protein, 18 aa, Giardia lamblia
FNNAILNHPLRCVVPASN

SEQ ID NO: 3186389 - protein, 26 aa, Giardia lamblia
FNNKHKDIITMLLKYEKDSSWTSLMC

SEQ ID NO: 3186390 - protein, 18 aa, Giardia lamblia
FNPRRRCHKLSSTKRKGP

SEQ ID NO: 3186391 - protein, 18 aa, Giardia lamblia
FNPYEQLLAVMPPASAAL

SEQ ID NO: 3186392 - protein, 26 aa, Giardia lamblia
FNRAAALRRIAQSKGRFYDSAEFILK

SEQ ID NO: 3186393 - protein, 24 aa, Giardia lamblia
FNSDVWDTITRWPKSLLAPDISVE

SEQ ID NO: 3186394 - protein, 20 aa, Giardia lamblia
FNSFTAMHYACYFNHLQVVQ

SEQ ID NO: 3186395 - protein, 25 aa, Giardia lamblia
FNSGRYFFPSLLRGNGEMTLSIRSV

SEQ ID NO: 3186396 - protein, 18 aa, Giardia lamblia
FNSLYPNIIREYSLCFTT

SEQ ID NO: 3186397 - protein, 25 aa, Giardia lamblia
FNTELSLKLTQVPPLLSNTFGEQRN

SEQ ID NO: 3186398 - protein, 27 aa, Giardia lamblia
FNTSLGLNNLFYPYHLKGAIANDYQRL

SEQ ID NO: 3186399 - protein, 24 aa, Giardia lamblia
FNVAFNCRIGAALIPAIETVLFVN

SEQ ID NO: 3186400 - protein, 25 aa, Giardia lamblia
FNYINTTDIHLVLSGVLRAEYLEFP

SEQ ID NO: 3186401 - protein, 21 aa, Giardia lamblia
FPADPATILPPPTLAQMKGSS

SEQ ID NO: 3186402 - protein, 19 aa, Giardia lamblia
FPAVYLDCQWKFDPALSAD

SEQ ID NO: 3186403 - protein, 29 aa, Giardia lamblia
FPDSYAMYRFSRPLLRMAICTLSPKGHIR

SEQ ID NO: 3186404 - protein, 18 aa, Giardia lamblia
FPEAIDQAAFRRFDKRIF

SEQ ID NO: 3186405 - protein, 20 aa, Giardia lamblia
FPEDKEYILRILRKWLGEAA

SEQ ID NO: 3186406 - protein, 27 aa, Giardia lamblia
FPEDQIWDWFVQICMALKHVHDRKILH

SEQ ID NO: 3186407 - protein, 27 aa, Giardia lamblia
FPEERIWAIISQILQSLAYLHARMKAN

SEQ ID NO: 3186408 - protein, 27 aa, Giardia lamblia
FPEIVTSRNIRFLRELILNGKTYPGAN

SEQ ID NO: 3186409 - protein, 18 aa, Giardia lamblia
FPELGIYGEHRYTALMAA

SEQ ID NO: 3186410 - protein, 25 aa, Giardia lamblia
FPEVQVPLTPSLRATPKSFDGARLD

SEQ ID NO: 3186411 - protein, 20 aa, Giardia lamblia
FPGAVYFIMMEMDAHVIVAS

SEQ ID NO: 3186412 - protein, 20 aa, Giardia lamblia
FPGFKQVYFVGTCGDGFVPF

SEQ ID NO: 3186413 - protein, 17 aa, Giardia lamblia
FPGGMPPGGFPGGFPGG

SEQ ID NO: 3186414 - protein, 24 aa, Giardia lamblia
FPGMDEMWSFINLIKLIDTNEYST

SEQ ID NO: 3186415 - protein, 22 aa, Giardia lamblia
FPGQEIGVIFKLIKVVIASNQP

SEQ ID NO: 3186416 - protein, 19 aa, Giardia lamblia
FPHLARMPTASLSLPRSTT

SEQ ID NO: 3186417 - protein, 33 aa, Giardia lamblia
FPKIDEIHPFYRYWFNIMYDKDHFKIALGQLHQ

SEQ ID NO: 3186418 - protein, 22 aa, Giardia lamblia
FPLGSFYVVVRVRPFNSKELAQ

SEQ ID NO: 3186419 - protein, 17 aa, Giardia lamblia
FPLNIFGLVHEIIGANI

SEQ ID NO: 3186420 - protein, 18 aa, Giardia lamblia
FPNTMQLIQPGIPAPLSV

SEQ ID NO: 3186421 - protein, 17 aa, Giardia lamblia
FPPLCTILRTLQLTDII

SEQ ID NO: 3186422 - protein, 37 aa, Giardia lamblia
FPPMELIYSIQDQLLKYLESLFLRSVLELIEALKDCG

SEQ ID NO: 3186423 - protein, 17 aa, Giardia lamblia
FPRIGLVINFDIPSDLT

SEQ ID NO: 3186424 - protein, 55 aa, Giardia lamblia
FPVMTPNFGMMSLPVMPMMPMVSPMCMTSISGAPYPHILPTTPLQGQIFPQYVTP

SEQ ID NO: 3186425 - protein, 22 aa, Giardia lamblia
FPYLESLAYCEISQAYFGDELI

SEQ ID NO: 3186426 - protein, 24 aa, Giardia lamblia
FQAQDLITHCRICRALQAEASSAG

SEQ ID NO: 3186427 - protein, 19 aa, Giardia lamblia
FQCSPGTVLAAISFVGHVQ

SEQ ID NO: 3186428 - protein, 24 aa, Giardia lamblia
FQDRVSPMIFLKLGCKFKKMERRL

SEQ ID NO: 3186429 - protein, 24 aa, Giardia lamblia
FQGQGYIPIFPDMPHTELGLMDCM

SEQ ID NO: 3186430 - protein, 19 aa, Giardia lamblia
FQHNGWSLLMQLLHYTTDG

SEQ ID NO: 3186431 - protein, 18 aa, Giardia lamblia
FQIKYDRTPRDWTVKGVF

SEQ ID NO: 3186432 - protein, 19 aa, Giardia lamblia
FQISYTLLDTLNTAFRTIN

SEQ ID NO: 3186433 - protein, 27 aa, Giardia lamblia
FQKLDQMLCYLLTIPESLLKVPMELFD

SEQ ID NO: 3186434 - protein, 20 aa, Giardia lamblia
FQNKMTFALWQKVGADCCGL

SEQ ID NO: 3186435 - protein, 19 aa, Giardia lamblia
FQNQRLPLSTARPSIETPI

SEQ ID NO: 3186436 - protein, 17 aa, Giardia lamblia
FQSMIERYKKEIIEKTR

SEQ ID NO: 3186437 - protein, 26 aa, Giardia lamblia
FQTSGPFDVFSPAATAFSIAQYYHRQ

SEQ ID NO: 3186438 - protein, 18 aa, Giardia lamblia
FQVDFDFGEFQTALGEGL

SEQ ID NO: 3186439 - protein, 23 aa, Giardia lamblia
FQVTTFKLYPFSEKFESALCEAL

SEQ ID NO: 3186440 - protein, 24 aa, Giardia lamblia
FRAACLYYCPTLEVINDIPVTDVD

SEQ ID NO: 3186441 - protein, 18 aa, Giardia lamblia
FRADFPVFTITGPAPLQT

SEQ ID NO: 3186442 - protein, 23 aa, Giardia lamblia
FRADNFSLLLIAGGDHNSYDIET

SEQ ID NO: 3186443 - protein, 30 aa, Giardia lamblia
FRAFTRRDLVLLLFNLRNYIMKTRELQFNY

SEQ ID NO: 3186444 - protein, 20 aa, Giardia lamblia
FRAIHDVVLIATPDERLKLA

SEQ ID NO: 3186445 - protein, 25 aa, Giardia lamblia
FRCGRWIWCRPYETTARVLVYSAED

SEQ ID NO: 3186446 - protein, 28 aa, Giardia lamblia
FRDATTIHFLITRFWIAVADTSHYFGVK

SEQ ID NO: 3186447 - protein, 27 aa, Giardia lamblia
FRDKAYLRIFKAVLYSSLGACLVSMHR

SEQ ID NO: 3186448 - protein, 18 aa, Giardia lamblia
FRDKLAYLKAVSLAKDEI

SEQ ID NO: 3186449 - protein, 18 aa, Giardia lamblia
FRELLISTYGVSLAPLSM

SEQ ID NO: 3186450 - protein, 18 aa, Giardia lamblia
FRENPVRLPLRRKINCFR

SEQ ID NO: 3186451 - protein, 30 aa, Giardia lamblia
FRFNAKGSRAYPFCIIMSPTRELVQQTAKA

SEQ ID NO: 3186452 - protein, 24 aa, Giardia lamblia
FRGINYDVVFLQWVIGHLVDRDVV

SEQ ID NO: 3186453 - protein, 37 aa, Giardia lamblia
FRGNEYLVLLIKSTAKLYALAPGQPPRYLDKATIYER

SEQ ID NO: 3186454 - protein, 19 aa, Giardia lamblia
FRGYNKHAVLLSLCTLALT

SEQ ID NO: 3186455 - protein, 26 aa, Giardia lamblia
FRGYSIELALIGYRMLYTQGSIRFLV

SEQ ID NO: 3186456 - protein, 41 aa, Giardia lamblia
FRIGKGVRTLGPINPFILGQLIFMLIDGQWKHPMNLSELES

SEQ ID NO: 3186457 - protein, 32 aa, Giardia lamblia
FRKELYDEVYGSYKLRNFLTSGTGLTLEEIRR

SEQ ID NO: 3186458 - protein, 25 aa, Giardia lamblia
FRKIKVIPFTHFTLISFRRLEDLEE

SEQ ID NO: 3186459 - protein, 18 aa, Giardia lamblia
FRKYKRYCRNRKSITKSL

SEQ ID NO: 3186460 - protein, 18 aa, Giardia lamblia
FRLKNGSTAFYMVKKEKN

SEQ ID NO: 3186461 - protein, 28 aa, Giardia lamblia
FRLLHQSLQRLILYDLPSHLVEKVHDMA

SEQ ID NO: 3186462 - protein, 21 aa, Giardia lamblia
FRRIDLYTQSLSRFGQSPFIY

SEQ ID NO: 3186463 - protein, 19 aa, Giardia lamblia
FRSLKARNRKTPKYGVLFS

SEQ ID NO: 3186464 - protein, 24 aa, Giardia lamblia
FRSLQRLHYAAARSALRKPVSDMS

SEQ ID NO: 3186465 - protein, 22 aa, Giardia lamblia
FRSLVRIYRLGIPVYKGRVFLG

SEQ ID NO: 3186466 - protein, 20 aa, Giardia lamblia
FRVLGMATVLYPSTLASLRS

SEQ ID NO: 3186467 - protein, 17 aa, Giardia lamblia
FRVNCSPEYFASASIQD

SEQ ID NO: 3186468 - protein, 25 aa, Giardia lamblia
FRVPSAPIVFNIPDSSWMPIQSTIP

SEQ ID NO: 3186469 - protein, 20 aa, Giardia lamblia
FRVVVRIRPLIDREKSAGDR

SEQ ID NO: 3186470 - protein, 17 aa, Giardia lamblia
FRYCTVGISEKLRLKRY

SEQ ID NO: 3186471 - protein, 19 aa, Giardia lamblia
FSALMYAIKSGNVNSALLL

SEQ ID NO: 3186472 - protein, 18 aa, Giardia lamblia
FSASSSTALLPDPSLTGG

SEQ ID NO: 3186473 - protein, 24 aa, Giardia lamblia
FSCKQYVAMFRAGAMWKVKSFSTS

SEQ ID NO: 3186474 - protein, 20 aa, Giardia lamblia
FSCPCNGLYYVALHIDNKDI

SEQ ID NO: 3186475 - protein, 17 aa, Giardia lamblia
FSDDGLFLFAGTASSEI

SEQ ID NO: 3186476 - protein, 18 aa, Giardia lamblia
FSDIKKWCFANDKTLYEF

SEQ ID NO: 3186477 - protein, 18 aa, Giardia lamblia
FSDKRIMRLGTIGKMAFL

SEQ ID NO: 3186478 - protein, 20 aa, Giardia lamblia
FSDLFCHPPLTTGPGMKLTG

SEQ ID NO: 3186479 - protein, 19 aa, Giardia lamblia
FSEDKLLLSAYWANNYEST

SEQ ID NO: 3186480 - protein, 28 aa, Giardia lamblia
FSEISYYPAALSFIGYIFCNSGKADEFI

SEQ ID NO: 3186481 - protein, 17 aa, Giardia lamblia
FSFFACSMIIVAVGFGP

SEQ ID NO: 3186482 - protein, 25 aa, Giardia lamblia
FSGENRFGICLPGRSSELVKLVEAM

SEQ ID NO: 3186483 - protein, 26 aa, Giardia lamblia
FSGFLDLLNKAVFLNGPLAGAKGGNG

SEQ ID NO: 3186484 - protein, 18 aa, Giardia lamblia
FSGFQAIEIPLSTSLLLH

SEQ ID NO: 3186485 - protein, 21 aa, Giardia lamblia
FSGLTPTKFMRTHTGFLLFAN

SEQ ID NO: 3186486 - protein, 29 aa, Giardia lamblia
FSHLPHPATPVYFLLPVSVTPVASPHQTT

SEQ ID NO: 3186487 - protein, 17 aa, Giardia lamblia
FSIQRRSIPFFTKRTVL

SEQ ID NO: 3186488 - protein, 21 aa, Giardia lamblia
FSIVRLLLSELGIRSPAGWTA

SEQ ID NO: 3186489 - protein, 19 aa, Giardia lamblia
FSKKCWTEWRSTPGPGEYS

SEQ ID NO: 3186490 - protein, 27 aa, Giardia lamblia
FSKTKTGFIFALRFSPSLWTRSMERRT

SEQ ID NO: 3186491 - protein, 24 aa, Giardia lamblia
FSLAEYLVRHISIGEKFLCVELDY

SEQ ID NO: 3186492 - protein, 27 aa, Giardia lamblia
FSNIDRSILLSYNKYRKVLSPIPTREV

SEQ ID NO: 3186493 - protein, 24 aa, Giardia lamblia
FSNLTVFLVELLKEKHIAKTAILE

SEQ ID NO: 3186494 - protein, 25 aa, Giardia lamblia
FSPDGRIFQIEYALKSVTLSPTALA

SEQ ID NO: 3186495 - protein, 17 aa, Giardia lamblia
FSPDLRLTLSSTKIGLK

SEQ ID NO: 3186496 - protein, 18 aa, Giardia lamblia
FSPIIKRNATIPTRKTQT

SEQ ID NO: 3186497 - protein, 18 aa, Giardia lamblia
FSPKLYLTEFRELHKTRS

SEQ ID NO: 3186498 - protein, 23 aa, Giardia lamblia
FSPRHFLDLVADYAYVLYDDAAA

SEQ ID NO: 3186499 - protein, 27 aa, Giardia lamblia
FSQAPFTYVPFILTAPRAGGCVSPAPQ

SEQ ID NO: 3186500 - protein, 17 aa, Giardia lamblia
FSQQRAIFDSEIANRDA

SEQ ID NO: 3186501 - protein, 19 aa, Giardia lamblia
FSRIRGPFLAGILDGSSGY

SEQ ID NO: 3186502 - protein, 17 aa, Giardia lamblia
FSRPVRPLLAHTSVPPH

SEQ ID NO: 3186503 - protein, 18 aa, Giardia lamblia
FSRTLKDTAPKYYEQPAP

SEQ ID NO: 3186504 - protein, 24 aa, Giardia lamblia
FSSEGYLFAAGISLYKAVKLISSL

SEQ ID NO: 3186505 - protein, 17 aa, Giardia lamblia
FSSFYRAAPQGGALIES

SEQ ID NO: 3186506 - protein, 21 aa, Giardia lamblia
FSSLMYDLSLASHLEYQFLLH

SEQ ID NO: 3186507 - protein, 18 aa, Giardia lamblia
FSSQIPFVAGIKARALRM

SEQ ID NO: 3186508 - protein, 26 aa, Giardia lamblia
FSSSDLTWCLGLFLSSLCLLKEPKDI

SEQ ID NO: 3186509 - protein, 20 aa, Giardia lamblia
FSSVFKRLDDLSLIKEMISE

SEQ ID NO: 3186510 - protein, 18 aa, Giardia lamblia
FSTKVPLTLIYSTAVDRS

SEQ ID NO: 3186511 - protein, 23 aa, Giardia lamblia
FSTLVSNFHLTPVIQTGGSSLQT

SEQ ID NO: 3186512 - protein, 18 aa, Giardia lamblia
FSTSLRYAIQLITTSHII

SEQ ID NO: 3186513 - protein, 23 aa, Giardia lamblia
FSTSSFRFPIAAAKSLIRCVSSK

SEQ ID NO: 3186514 - protein, 22 aa, Giardia lamblia
FSTWVDPIKRTLLSVKSKVPDQ

SEQ ID NO: 3186515 - protein, 25 aa, Giardia lamblia
FSVLGDGYIIILSFHSEDKTLRLNG

SEQ ID NO: 3186516 - protein, 19 aa, Giardia lamblia
FSVYPNQMPCVLKIKRVAA

SEQ ID NO: 3186517 - protein, 22 aa, Giardia lamblia
FSYDDIKIIQLLCLIRLETIGH

SEQ ID NO: 3186518 - protein, 18 aa, Giardia lamblia
FSYEYLSERTKEFPMKVK

SEQ ID NO: 3186519 - protein, 18 aa, Giardia lamblia
FSYTAILQPSILFSSLSP

SEQ ID NO: 3186520 - protein, 20 aa, Giardia lamblia
FTAFEVVYKHLATVKPRVAV

SEQ ID NO: 3186521 - protein, 23 aa, Giardia lamblia
FTAGDILHKIAFSYIHVLTKDER

SEQ ID NO: 3186522 - protein, 24 aa, Giardia lamblia
FTAHLIGTCRLCLKDIIFKDVHVQ

SEQ ID NO: 3186523 - protein, 18 aa, Giardia lamblia
FTALMYAAINNSIESVLL

SEQ ID NO: 3186524 - protein, 18 aa, Giardia lamblia
FTAQTALALAYLHSPYKV

SEQ ID NO: 3186525 - protein, 18 aa, Giardia lamblia
FTARILCLLNFRDVICRA

SEQ ID NO: 3186526 - protein, 17 aa, Giardia lamblia
FTDAFLDSITPTGRSLK

SEQ ID NO: 3186527 - protein, 29 aa, Giardia lamblia
FTDKGLMPRVFNYLFDQLSAESQQEIFTH

SEQ ID NO: 3186528 - protein, 32 aa, Giardia lamblia
FTEEECWYYICQILLGVASIHALKIIHRDIKS

SEQ ID NO: 3186529 - protein, 17 aa, Giardia lamblia
FTELLKHMEIHGFIILR

SEQ ID NO: 3186530 - protein, 19 aa, Giardia lamblia
FTELMIAIMAASYKTFRQY

SEQ ID NO: 3186531 - protein, 19 aa, Giardia lamblia
FTEPPMGAGLRRNKQRQSS

SEQ ID NO: 3186532 - protein, 24 aa, Giardia lamblia
FTEYYGNLPPLFTSMLRLARNDEE

SEQ ID NO: 3186533 - protein, 23 aa, Giardia lamblia
FTGSNNIALLYPAGIFGSRARGG

SEQ ID NO: 3186534 - protein, 35 aa, Giardia lamblia
FTGTKYQPFPHKPFKIPHYPPFKPGARGGAYTNPN

SEQ ID NO: 3186535 - protein, 31 aa, Giardia lamblia
FTHIRPNPSFRGRIPKRFTLSSPPALCSQTQ

SEQ ID NO: 3186536 - protein, 20 aa, Giardia lamblia
FTHRLLLHQHLLQSLPSHNS

SEQ ID NO: 3186537 - protein, 21 aa, Giardia lamblia
FTHTLIFNTSLGLNNLFYPYH

SEQ ID NO: 3186538 - protein, 28 aa, Giardia lamblia
FTIDGRYIYVPLILVLRALVSTTDKEIY

SEQ ID NO: 3186539 - protein, 19 aa, Giardia lamblia
FTKDWKAPLGDIYDPDLRL

SEQ ID NO: 3186540 - protein, 21 aa, Giardia lamblia
FTKRLLLGRPSNNNTLVPWVD

SEQ ID NO: 3186541 - protein, 28 aa, Giardia lamblia
FTLLDSRFYTQFQYISLATFAEATHLAD

SEQ ID NO: 3186542 - protein, 21 aa, Giardia lamblia
FTLLMTQIGFPRPISIDTFRK

SEQ ID NO: 3186543 - protein, 24 aa, Giardia lamblia
FTLNKADFIAKPPPDSLLLADQTI

SEQ ID NO: 3186544 - protein, 18 aa, Giardia lamblia
FTLRFAFISDTGTVVYTK

SEQ ID NO: 3186545 - protein, 17 aa, Giardia lamblia
FTMWYSYRDFCCSGCRG

SEQ ID NO: 3186546 - protein, 18 aa, Giardia lamblia
FTNFYNELTRVVKSSSRQ

SEQ ID NO: 3186547 - protein, 27 aa, Giardia lamblia
FTNSTILRAFRITRLTLAPLGEPPEWS

SEQ ID NO: 3186548 - protein, 17 aa, Giardia lamblia
FTPALFQTPKGAAEQLR

SEQ ID NO: 3186549 - protein, 28 aa, Giardia lamblia
FTPDINNMKYLLSVLKDLPTDKSTLPGN

SEQ ID NO: 3186550 - protein, 23 aa, Giardia lamblia
FTPDYILNLKIKIPELTDRMFSA

SEQ ID NO: 3186551 - protein, 17 aa, Giardia lamblia
FTQFLNSGKWGTGKIER

SEQ ID NO: 3186552 - protein, 30 aa, Giardia lamblia
FTQQVLRVTFIRPLNYIDDCACPASLGSGL

SEQ ID NO: 3186553 - protein, 20 aa, Giardia lamblia
FTQYVPPMQVSMWPMTPRAT

SEQ ID NO: 3186554 - protein, 20 aa, Giardia lamblia
FTRLDPFEKALRNHKIRKEL

SEQ ID NO: 3186555 - protein, 26 aa, Giardia lamblia
FTRLFCLSKMYVTRIGRIVFRLCFRN

SEQ ID NO: 3186556 - protein, 21 aa, Giardia lamblia
FTTLGFFSRAVIVGNEVLALA

SEQ ID NO: 3186557 - protein, 23 aa, Giardia lamblia
FTTPLLHKLSDYTPLQILENVAV

SEQ ID NO: 3186558 - protein, 24 aa, Giardia lamblia
FTTQSMQCIQVTGLAPIFNTHVIV

SEQ ID NO: 3186559 - protein, 24 aa, Giardia lamblia
FTTWCPPCRGMIPHLAELPTKYPN

SEQ ID NO: 3186560 - protein, 18 aa, Giardia lamblia
FTWREPGAIPKSMKIHDV

SEQ ID NO: 3186561 - protein, 19 aa, Giardia lamblia
FTYPQKETLNRWLFDMLAT

SEQ ID NO: 3186562 - protein, 27 aa, Giardia lamblia
FVAFARSYFFGYATLCLSAAIAGLKLS

SEQ ID NO: 3186563 - protein, 17 aa, Giardia lamblia
FVAKAIRKELLLMGRRV

SEQ ID NO: 3186564 - protein, 17 aa, Giardia lamblia
FVALRKAGKLPGDVCKC

SEQ ID NO: 3186565 - protein, 21 aa, Giardia lamblia
FVCFTARLALLFQVATRFCEI

SEQ ID NO: 3186566 - protein, 33 aa, Giardia lamblia
FVDERRYCQVIRILEMVALPKLFHVVFTSAEKA

SEQ ID NO: 3186567 - protein, 24 aa, Giardia lamblia
FVDVMTPYSLRAASLRDLYYALEE

SEQ ID NO: 3186568 - protein, 19 aa, Giardia lamblia
FVELKLNEHLLSEEIRRLR

SEQ ID NO: 3186569 - protein, 29 aa, Giardia lamblia
FVETKDVLFIWDVISGYKKYVPPAGVSKV

SEQ ID NO: 3186570 - protein, 19 aa, Giardia lamblia
FVFLGDFSPNRFMYESPPK

SEQ ID NO: 3186571 - protein, 17 aa, Giardia lamblia
FVFVGWTRDPMCPDANA

SEQ ID NO: 3186572 - protein, 23 aa, Giardia lamblia
FVGCNGCRFLISAIGICIEHEQT

SEQ ID NO: 3186573 - protein, 25 aa, Giardia lamblia
FVHGFLDHLMRKLAKSFKLIGEDHP

SEQ ID NO: 3186574 - protein, 17 aa, Giardia lamblia
FVHPPDNILSPLHNKQK

SEQ ID NO: 3186575 - protein, 18 aa, Giardia lamblia
FVIGGMTQSGLAGDVWRL

SEQ ID NO: 3186576 - protein, 26 aa, Giardia lamblia
FVKRNYVLECKDLGFKRLSLDKPISS

SEQ ID NO: 3186577 - protein, 28 aa, Giardia lamblia
FVLSRRLYDYHFVPPSPLFFTEADLDLE

SEQ ID NO: 3186578 - protein, 18 aa, Giardia lamblia
FVLTYSLNSEGLVGPLKA

SEQ ID NO: 3186579 - protein, 18 aa, Giardia lamblia
FVPKLFVISIDKIKSGDS

SEQ ID NO: 3186580 - protein, 33 aa, Giardia lamblia
FVPLTEDFIKLNRILADFPYNAALNAKLSPRTA

SEQ ID NO: 3186581 - protein, 19 aa, Giardia lamblia
FVPPGLIPINGQSGLDPSP

SEQ ID NO: 3186582 - protein, 27 aa, Giardia lamblia
FVQAGTKLFIHRLSSLELIHTLTLACT

SEQ ID NO: 3186583 - protein, 18 aa, Giardia lamblia
FVRALTAAKLKQMFAKPF

SEQ ID NO: 3186584 - protein, 20 aa, Giardia lamblia
FVRELLSSDAFYKFVLALDP

SEQ ID NO: 3186585 - protein, 20 aa, Giardia lamblia
FVRELLSSDAFYKFVLALEP

SEQ ID NO: 3186586 - protein, 17 aa, Giardia lamblia
FVRYTILENFGGSGAYT

SEQ ID NO: 3186587 - protein, 25 aa, Giardia lamblia
FVSGNLLQFVKRLLDASVSSTAALL

SEQ ID NO: 3186588 - protein, 23 aa, Giardia lamblia
FVSLKIDFVVPSLFDAVPSLRSM

SEQ ID NO: 3186589 - protein, 41 aa, Giardia lamblia
FVSLKQLSMYRAKAPDFFAKLSHFLMQMGLEYVNQMNKQND

SEQ ID NO: 3186590 - protein, 21 aa, Giardia lamblia
FVSREQLIQMLVERDMKIAAI

SEQ ID NO: 3186591 - protein, 17 aa, Giardia lamblia
FVSVYHFRTYDAWIVIA

SEQ ID NO: 3186592 - protein, 18 aa, Giardia lamblia
FVTLISEQLHYRLSSALK

SEQ ID NO: 3186593 - protein, 19 aa, Giardia lamblia
FVTSARFCPVINGQTLLTT

SEQ ID NO: 3186594 - protein, 20 aa, Giardia lamblia
FVVAIGPYKGLLGLTQSYAK

SEQ ID NO: 3186595 - protein, 25 aa, Giardia lamblia
FVVDLIDPLIRLLNQKGACYETSAD

SEQ ID NO: 3186596 - protein, 25 aa, Giardia lamblia
FVVEHDFLMALYLADSVVVFTGTPG

SEQ ID NO: 3186597 - protein, 25 aa, Giardia lamblia
FVYCFNYLFDRTVLFQSLSNQPLIL

SEQ ID NO: 3186598 - protein, 29 aa, Giardia lamblia
FYAASNLHITTIRILLESGKMPQSHVRDA

SEQ ID NO: 3186599 - protein, 21 aa, Giardia lamblia
FYARLPSLPALSPSKHLHYVP

SEQ ID NO: 3186600 - protein, 33 aa, Giardia lamblia
FYCRRKLHYFHYMLPILALERLITRDQLEKNQV

SEQ ID NO: 3186601 - protein, 19 aa, Giardia lamblia
FYDRLLAASSPRTILSTRD

SEQ ID NO: 3186602 - protein, 19 aa, Giardia lamblia
FYFTVDELKTFLFKFAIVH

SEQ ID NO: 3186603 - protein, 18 aa, Giardia lamblia
FYGRISKAKLWSVAKEID

SEQ ID NO: 3186604 - protein, 46 aa, Giardia lamblia
FYLEVELHILERLFKYCINFYAAFLILELWCYYITSRDGHLPGYYL

SEQ ID NO: 3186605 - protein, 20 aa, Giardia lamblia
FYMLSDADKHVWEKFWHKMD

SEQ ID NO: 3186606 - protein, 28 aa, Giardia lamblia
FYNNGYDNFILLYKKLYESAVESLLSFF

SEQ ID NO: 3186607 - protein, 23 aa, Giardia lamblia
FYNPLFPTFYFGLHHPMKPFRIA

SEQ ID NO: 3186608 - protein, 18 aa, Giardia lamblia
FYPHIDLKYMIGYSVDED

SEQ ID NO: 3186609 - protein, 26 aa, Giardia lamblia
FYPLDAIGNTIYRRALENGREFYARA

SEQ ID NO: 3186610 - protein, 19 aa, Giardia lamblia
FYQFPPIERMDASLSTLKG

SEQ ID NO: 3186611 - protein, 24 aa, Giardia lamblia
FYRAPEVILGLPYGQEIDIWSIGC

SEQ ID NO: 3186612 - protein, 17 aa, Giardia lamblia
FYRTRGIFAEHAKSLWQ

SEQ ID NO: 3186613 - protein, 26 aa, Giardia lamblia
FYSSTILSRRKYVTVLLGTTYTTPEP

SEQ ID NO: 3186614 - protein, 26 aa, Giardia lamblia
FYVKHLRARFFHRWVRYVKEKNQSAV

SEQ ID NO: 3186615 - protein, 20 aa, Giardia lamblia
FYVPELGPSPVFAAFLDDLA

SEQ ID NO: 3186616 - protein, 18 aa, Giardia lamblia
FYYKRNPHKRPLSPTVAA

SEQ ID NO: 3186617 - protein, 25 aa, Giardia lamblia
GAALQCLFRCTVLRTVLLYMLPARA

SEQ ID NO: 3186618 - protein, 25 aa, Giardia lamblia
GAARESYLVKGFALHQSRASLQMPS

SEQ ID NO: 3186619 - protein, 23 aa, Giardia lamblia
GAARQFIRAINWLSFHAHRKNLS

SEQ ID NO: 3186620 - protein, 20 aa, Giardia lamblia
GACIFAMAMRRPPFNSTNVE

SEQ ID NO: 3186621 - protein, 26 aa, Giardia lamblia
GACNSVTILLQYYDGMEDRSGRTPLD

SEQ ID NO: 3186622 - protein, 24 aa, Giardia lamblia
GADFQMLMFMSSGVTRKGLKQIVN

SEQ ID NO: 3186623 - protein, 20 aa, Giardia lamblia
GAEDGNSWIFDFSKDPRKPE

SEQ ID NO: 3186624 - protein, 31 aa, Giardia lamblia
GAEELHQMIILKEWKRVWYLGGHGGVLIEIA

SEQ ID NO: 3186625 - protein, 25 aa, Giardia lamblia
GAELANIYLGWCRRYPIVSFEDPFD

SEQ ID NO: 3186626 - protein, 25 aa, Giardia lamblia
GAELLLLHIITYDYLAKKIRIENGA

SEQ ID NO: 3186627 - protein, 23 aa, Giardia lamblia
GAFSLPVTAIYQLYNSQYPVAIN

SEQ ID NO: 3186628 - protein, 23 aa, Giardia lamblia
GAGFFVNKLKIKTLPTLCVFDKG

SEQ ID NO: 3186629 - protein, 30 aa, Giardia lamblia
GAGLAERMIILAEYTYYPHIVDPNVVTCYT

SEQ ID NO: 3186630 - protein, 24 aa, Giardia lamblia
GAGLKPSAFIEQLGLEEGLPAATY

SEQ ID NO: 3186631 - protein, 36 aa, Giardia lamblia
GAGSYNLSFASLRPLSRSQLNTYIPPLSHTAQHTSR

SEQ ID NO: 3186632 - protein, 26 aa, Giardia lamblia
GAHHGVLPLHGPPLHRRHPRGRGGDP

SEQ ID NO: 3186633 - protein, 18 aa, Giardia lamblia
GAIIYELVTLRRPDFLGG

SEQ ID NO: 3186634 - protein, 18 aa, Giardia lamblia
GAILTVSRPKPQTDPGFI

SEQ ID NO: 3186635 - protein, 22 aa, Giardia lamblia
GAKFPMELLRRTVVEEACLPLC

SEQ ID NO: 3186636 - protein, 17 aa, Giardia lamblia
GALATRLLGKQVIIPPG

SEQ ID NO: 3186637 - protein, 24 aa, Giardia lamblia
GALCTFRGKYTSISTAREPQKVFG

SEQ ID NO: 3186638 - protein, 26 aa, Giardia lamblia
GALDLSFIKYLVLDEFDALFKEEDNF

SEQ ID NO: 3186639 - protein, 17 aa, Giardia lamblia
GALFRAVRVQDGVVVAV

SEQ ID NO: 3186640 - protein, 28 aa, Giardia lamblia
GALHLGHLLPFIFTKYLQDAFKCYVVIQ

SEQ ID NO: 3186641 - protein, 24 aa, Giardia lamblia
GALKYSDMIYLKKLCEAALEKHPD

SEQ ID NO: 3186642 - protein, 18 aa, Giardia lamblia
GALLLSYAFTCSANFIPA

SEQ ID NO: 3186643 - protein, 24 aa, Giardia lamblia
GALQGLAYLHSPLAKPVLVHGAIS

SEQ ID NO: 3186644 - protein, 17 aa, Giardia lamblia
GALQRFQCLFPATMEKC

SEQ ID NO: 3186645 - protein, 28 aa, Giardia lamblia
GALRYYILATMLLTCGYTLTILGNTCSG

SEQ ID NO: 3186646 - protein, 27 aa, Giardia lamblia
GALTPKSVLLLSTGKIRLKGLCSWHSS

SEQ ID NO: 3186647 - protein, 19 aa, Giardia lamblia
GAMAFLPPEVLTSSTLYTT

SEQ ID NO: 3186648 - protein, 21 aa, Giardia lamblia
GANMAYLLAHKDVELENLNTE

SEQ ID NO: 3186649 - protein, 26 aa, Giardia lamblia
GANTPKRRPLPLPELKKLRQAERAYN

SEQ ID NO: 3186650 - protein, 18 aa, Giardia lamblia
GANVLPQYSRNLLIPVRV

SEQ ID NO: 3186651 - protein, 17 aa, Giardia lamblia
GAPGFQLAIMAPRGLCR

SEQ ID NO: 3186652 - protein, 17 aa, Giardia lamblia
GAPIECIVVFPGESKDL

SEQ ID NO: 3186653 - protein, 21 aa, Giardia lamblia
GAPLNILSYVLERLKRAKLVA

SEQ ID NO: 3186654 - protein, 25 aa, Giardia lamblia
GAQMFNYFVCILLTNSYSIEDKTGQ

SEQ ID NO: 3186655 - protein, 26 aa, Giardia lamblia
GAQRILAAYSLLSKLSSPGLVGCTIV

SEQ ID NO: 3186656 - protein, 22 aa, Giardia lamblia
GAQSIIFCKTRKFVDECYRVMK

SEQ ID NO: 3186657 - protein, 25 aa, Giardia lamblia
GARISYIFQSVLPKMFDTISIQEIL

SEQ ID NO: 3186658 - protein, 30 aa, Giardia lamblia
GARPFHTMDIWSLGATLFELCMRRPYVTGW

SEQ ID NO: 3186659 - protein, 22 aa, Giardia lamblia
GARVLIFSIAIDRPEGPARPIE

SEQ ID NO: 3186660 - protein, 22 aa, Giardia lamblia
GASALLLERFMLSSDDFLAYVC

SEQ ID NO: 3186661 - protein, 27 aa, Giardia lamblia
GASARLSLFDAWLANSLPPIREILTKK

SEQ ID NO: 3186662 - protein, 27 aa, Giardia lamblia
GASDGVVHLVGLYPPIHYGVFCSEFKG

SEQ ID NO: 3186663 - protein, 34 aa, Giardia lamblia
GASKSFFGGLQLILCGDFLQLPPVVRSNNPLVWL

SEQ ID NO: 3186664 - protein, 28 aa, Giardia lamblia
GASPWNRRLPNEPILPPPQNQFQITEEK

SEQ ID NO: 3186665 - protein, 26 aa, Giardia lamblia
GASRWKDYEPLLIAMQARHQAKRSLT

SEQ ID NO: 3186666 - protein, 24 aa, Giardia lamblia
GASTYYWCFASKRSQAARTELARL

SEQ ID NO: 3186667 - protein, 24 aa, Giardia lamblia
GATALMLAAYLDRAQIAEKLGPLE

SEQ ID NO: 3186668 - protein, 22 aa, Giardia lamblia
GATALMYALHHGKLDCAELLLD

SEQ ID NO: 3186669 - protein, 24 aa, Giardia lamblia
GATALMYAVLFNREELIPLLIEKE

SEQ ID NO: 3186670 - protein, 25 aa, Giardia lamblia
GATDAVQALLPYQKGRRDARGRTAL

SEQ ID NO: 3186671 - protein, 23 aa, Giardia lamblia
GATHIPYRDSKLTRLLQDSLGGN

SEQ ID NO: 3186672 - protein, 17 aa, Giardia lamblia
GATIYIYALDDNSAILY

SEQ ID NO: 3186673 - protein, 32 aa, Giardia lamblia
GATKPSYGSLPYPPLLTAELPASPLPSGPKDI

SEQ ID NO: 3186674 - protein, 25 aa, Giardia lamblia
GAVNKVFRNTAFIEKLFTSKLEAMA

SEQ ID NO: 3186675 - protein, 24 aa, Giardia lamblia
GAVSELITLPGRPGWHIECSAMAA

SEQ ID NO: 3186676 - protein, 25 aa, Giardia lamblia
GAVVFHLVRILEEPFFLIIDDSEDN

SEQ ID NO: 3186677 - protein, 25 aa, Giardia lamblia
GAVYQLDWSPFYPSYILSGSEDSRV

SEQ ID NO: 3186678 - protein, 19 aa, Giardia lamblia
GAWLKSLLRILQLHATYHS

SEQ ID NO: 3186679 - protein, 29 aa, Giardia lamblia
GAYETALDPIMPKPPSFSLKSRTTQESQN

SEQ ID NO: 3186680 - protein, 24 aa, Giardia lamblia
GAYGCLLKLRLNGSAILFSYDDSR

SEQ ID NO: 3186681 - protein, 21 aa, Giardia lamblia
GAYPPPVSIPLRPYLETVSRL

SEQ ID NO: 3186682 - protein, 19 aa, Giardia lamblia
GCAFLQPRLGSNLNITGVS

SEQ ID NO: 3186683 - protein, 29 aa, Giardia lamblia
GCAGSGKTFLIRRLIRQLSGRINFFELNC

SEQ ID NO: 3186684 - protein, 20 aa, Giardia lamblia
GCATQFYFGSKDEALRKTLS

SEQ ID NO: 3186685 - protein, 18 aa, Giardia lamblia
GCCDNRGYTALMLAAEAD

SEQ ID NO: 3186686 - protein, 25 aa, Giardia lamblia
GCCVRDLEGIFAWIDEHSFEKAQEQ

SEQ ID NO: 3186687 - protein, 26 aa, Giardia lamblia
GCDFVDRNYLMAILHTVRGCGYESEV

SEQ ID NO: 3186688 - protein, 20 aa, Giardia lamblia
GCDLFIVGAICPPRCNDNLM

SEQ ID NO: 3186689 - protein, 23 aa, Giardia lamblia
GCEGAPWCVMGSKNAVSTGDPVG

SEQ ID NO: 3186690 - protein, 24 aa, Giardia lamblia
GCEITLCEMVFARDILHGDAQELR

SEQ ID NO: 3186691 - protein, 27 aa, Giardia lamblia
GCGIFDLTFLLACCSYLSQLRLDLECM

SEQ ID NO: 3186692 - protein, 22 aa, Giardia lamblia
GCIVYELCTLTPLFTARSVNDM

SEQ ID NO: 3186693 - protein, 26 aa, Giardia lamblia
GCKLSKIPFSLLKPGLKALILSDNNI

SEQ ID NO: 3186694 - protein, 21 aa, Giardia lamblia
GCKSYIAILTLKTNTSGTRKH

SEQ ID NO: 3186695 - protein, 22 aa, Giardia lamblia
GCLAFPVMSWGRNFRADDKRIG

SEQ ID NO: 3186696 - protein, 19 aa, Giardia lamblia
GCLDNHYFRTVHSGGAWIV

SEQ ID NO: 3186697 - protein, 19 aa, Giardia lamblia
GCLIWKHDLAFSAMRSRCN

SEQ ID NO: 3186698 - protein, 18 aa, Giardia lamblia
GCLKKYLKKNPTALTTPV

SEQ ID NO: 3186699 - protein, 17 aa, Giardia lamblia
GCLKPIASLPINELVFP

SEQ ID NO: 3186700 - protein, 28 aa, Giardia lamblia
GCLMLINDQMSLLRWNPLYGYESCQLQH

SEQ ID NO: 3186701 - protein, 36 aa, Giardia lamblia
GCPARFPTFLLVEDPQLLLIHECQLFQAVLNEVSKG

SEQ ID NO: 3186702 - protein, 22 aa, Giardia lamblia
GCPSTTRLLYEEPLRELRKLVI

SEQ ID NO: 3186703 - protein, 29 aa, Giardia lamblia
GCRVPALTRSYFAALPSFTAPMYVHLGSC

SEQ ID NO: 3186704 - protein, 24 aa, Giardia lamblia
GCSFGLIPVLKFLHDNQLSHILRS

SEQ ID NO: 3186705 - protein, 23 aa, Giardia lamblia
GCSFPACLNLIDSSLPISMMTQG

SEQ ID NO: 3186706 - protein, 30 aa, Giardia lamblia
GCTALMISVRLRLTPITKFLAAKESGIIDL

SEQ ID NO: 3186707 - protein, 22 aa, Giardia lamblia
GCTICVWCAIWMICKQYRESQA

SEQ ID NO: 3186708 - protein, 25 aa, Giardia lamblia
GCTTDWFQPWPRQALCDVAIKNLTG

SEQ ID NO: 3186709 - protein, 25 aa, Giardia lamblia
GCVAYELCTLTLFTKIPSSEVIRQS

SEQ ID NO: 3186710 - protein, 23 aa, Giardia lamblia
GCVESLTILLNHFGFERDRNGYT

SEQ ID NO: 3186711 - protein, 19 aa, Giardia lamblia
GCVILELCSLHKPKPRDPI

SEQ ID NO: 3186712 - protein, 25 aa, Giardia lamblia
GCVMFEITALFPLFPGKDELDQITR

SEQ ID NO: 3186713 - protein, 18 aa, Giardia lamblia
GCVPPEMPAPIAGAGING

SEQ ID NO: 3186714 - protein, 21 aa, Giardia lamblia
GCVQALIPREAGLTMDDGWTA

SEQ ID NO: 3186715 - protein, 26 aa, Giardia lamblia
GDALSPSFRQLALLEMLQLVNKELSK

SEQ ID NO: 3186716 - protein, 26 aa, Giardia lamblia
GDDKPLRGFTVGFFRDYMLRGNMAEE

SEQ ID NO: 3186717 - protein, 35 aa, Giardia lamblia
GDDRAITEPLLPLQQAWLVIPGQRKSPADSLTPLP

SEQ ID NO: 3186718 - protein, 37 aa, Giardia lamblia
GDDYTRRIYPDMLVFVNPRFWFSRLLDIERICTKQSS

SEQ ID NO: 3186719 - protein, 20 aa, Giardia lamblia
GDEAVLQDLLPECVCSTQLF

SEQ ID NO: 3186720 - protein, 26 aa, Giardia lamblia
GDENVLRIITVPGWLRGPFESESGST

SEQ ID NO: 3186721 - protein, 29 aa, Giardia lamblia
GDERPLVNLSLLFRLRPQDLYPDSLARAV

SEQ ID NO: 3186722 - protein, 22 aa, Giardia lamblia
GDFEWYSYAQVYKMTVELALGL

SEQ ID NO: 3186723 - protein, 20 aa, Giardia lamblia
GDFFDWPFVDVRAAAYGMDL

SEQ ID NO: 3186724 - protein, 25 aa, Giardia lamblia
GDFLREALGILFSMSAAADAKRIKA

SEQ ID NO: 3186725 - protein, 24 aa, Giardia lamblia
GDFQMTPLMLAAEHGSTAAVSNLL

SEQ ID NO: 3186726 - protein, 32 aa, Giardia lamblia
GDHDTLIEFFKTLQPHVLRWPGLEPHHPITLA

SEQ ID NO: 3186727 - protein, 19 aa, Giardia lamblia
GDHEFYCMLLAIASQYSSS

SEQ ID NO: 3186728 - protein, 18 aa, Giardia lamblia
GDHPPIMPTGLIPHDVSS

SEQ ID NO: 3186729 - protein, 25 aa, Giardia lamblia
GDIASIQLLLPYEGIQFLTSKNLDE

SEQ ID NO: 3186730 - protein, 23 aa, Giardia lamblia
GDIDAIVEALPTYAKKKNSRGDT

SEQ ID NO: 3186731 - protein, 18 aa, Giardia lamblia
GDISVLKSAIIAEKRRTA

SEQ ID NO: 3186732 - protein, 22 aa, Giardia lamblia
GDIVTAWCLLPYQSNKADHLGK

SEQ ID NO: 3186733 - protein, 23 aa, Giardia lamblia
GDKQIRKLLLSSSRLYNVEGSDS

SEQ ID NO: 3186734 - protein, 23 aa, Giardia lamblia
GDLDFVSILTNRKLSYTQSHSIC

SEQ ID NO: 3186735 - protein, 19 aa, Giardia lamblia
GDLLHAAPLYYTMEHAKRA

SEQ ID NO: 3186736 - protein, 18 aa, Giardia lamblia
GDLMGLLIRVDLFPEPVA

SEQ ID NO: 3186737 - protein, 19 aa, Giardia lamblia
GDLMQDLEPGCIGLACACN

SEQ ID NO: 3186738 - protein, 21 aa, Giardia lamblia
GDLRGALYRFEGIPIGTTVAQ

SEQ ID NO: 3186739 - protein, 31 aa, Giardia lamblia
GDLSLDFMSPLLMPVIKRWVNYYTSTKKNGI

SEQ ID NO: 3186740 - protein, 20 aa, Giardia lamblia
GDMIVVCGVYRHIYDGKLNR

SEQ ID NO: 3186741 - protein, 32 aa, Giardia lamblia
GDMLCAFGAFYQYLFLTLPPTCCKTYIGESER

SEQ ID NO: 3186742 - protein, 26 aa, Giardia lamblia
GDNLHRYLLEDLLNQKLEHLLEADPL

SEQ ID NO: 3186743 - protein, 17 aa, Giardia lamblia
GDPFSACLPLLEILRAD

SEQ ID NO: 3186744 - protein, 22 aa, Giardia lamblia
GDPTRLGLTPVPFSAVPNGTQK

SEQ ID NO: 3186745 - protein, 25 aa, Giardia lamblia
GDQEGRLLAYDLRQPRHPFATTVAF

SEQ ID NO: 3186746 - protein, 22 aa, Giardia lamblia
GDRVGLLFISLAGRLCGVDVTS

SEQ ID NO: 3186747 - protein, 23 aa, Giardia lamblia
GDRWYRDFTVRILPVEWKVAKQS

SEQ ID NO: 3186748 - protein, 25 aa, Giardia lamblia
GDSAHVWKYLNYQAGLQDEEGKTAL

SEQ ID NO: 3186749 - protein, 24 aa, Giardia lamblia
GDSAVLLSVILQEGTSYAPENPDG

SEQ ID NO: 3186750 - protein, 17 aa, Giardia lamblia
GDSGVGKSALLLRLCDK

SEQ ID NO: 3186751 - protein, 23 aa, Giardia lamblia
GDSTMVQMLLKFGVNPLVRDNNG

SEQ ID NO: 3186752 - protein, 23 aa, Giardia lamblia
GDSWFTKELLKKLDHYRACEQCV

SEQ ID NO: 3186753 - protein, 29 aa, Giardia lamblia
GDSWSLGCILIQLLFDYPAFHSKDRDENT

SEQ ID NO: 3186754 - protein, 23 aa, Giardia lamblia
GDTDMVSLLIPYQGKLQTVGEEA

SEQ ID NO: 3186755 - protein, 22 aa, Giardia lamblia
GDTPLMLAVTKNQSLKGLLAYA

SEQ ID NO: 3186756 - protein, 17 aa, Giardia lamblia
GDTSYFLRKDIVHLFHD

SEQ ID NO: 3186757 - protein, 22 aa, Giardia lamblia
GDTTIRIWDSLTLTCKHVLRGH

SEQ ID NO: 3186758 - protein, 22 aa, Giardia lamblia
GDTTLPVLFLSEVCLSYLDADS

SEQ ID NO: 3186759 - protein, 24 aa, Giardia lamblia
GDVAPYMYIKPKNQAQNTYVGQSL

SEQ ID NO: 3186760 - protein, 17 aa, Giardia lamblia
GDVFVVAIGPYKGLLGL

SEQ ID NO: 3186761 - protein, 26 aa, Giardia lamblia
GDVGALLSYWWSDPLDLQCRLLHDAL

SEQ ID NO: 3186762 - protein, 24 aa, Giardia lamblia
GDVNTAIMLFFDSGVAASPDPVPA

SEQ ID NO: 3186763 - protein, 29 aa, Giardia lamblia
GDVSNSMSLYRFLSLTPAVARINLTTELS

SEQ ID NO: 3186764 - protein, 19 aa, Giardia lamblia
GDYCFSDLVPDTRIFDAIM

SEQ ID NO: 3186765 - protein, 19 aa, Giardia lamblia
GDYFYIMKTGHCNIYKTEN

SEQ ID NO: 3186766 - protein, 28 aa, Giardia lamblia
GEAAALYYLHTKALAFNDLLDRAEAHDR

SEQ ID NO: 3186767 - protein, 26 aa, Giardia lamblia
GEARANISSILLLLSSELSLVGPKGL

SEQ ID NO: 3186768 - protein, 29 aa, Giardia lamblia
GEDAVRRKAPAYTLAGRTAAHRPEDTPGP

SEQ ID NO: 3186769 - protein, 31 aa, Giardia lamblia
GEDPDFHELLLPFSVFPLSGTIYPSSKCTFT

SEQ ID NO: 3186770 - protein, 35 aa, Giardia lamblia
GEDRKYLQLGLDYIFIKYLLLQKKKYAATRLFPDF

SEQ ID NO: 3186771 - protein, 24 aa, Giardia lamblia
GEDRLIKFSGLLKKTCSTIVLRGA

SEQ ID NO: 3186772 - protein, 28 aa, Giardia lamblia
GEEERLCLHALMLSIPNLSGLPLLEAPL

SEQ ID NO: 3186773 - protein, 26 aa, Giardia lamblia
GEEGYIRFTISTYTKLKVLIGTEVLK

SEQ ID NO: 3186774 - protein, 32 aa, Giardia lamblia
GEELLKMSLRLRKYHFWVTVRRRDKLVRENRH

SEQ ID NO: 3186775 - protein, 21 aa, Giardia lamblia
GEFHIMQDMTFLAAAPLPGGG

SEQ ID NO: 3186776 - protein, 30 aa, Giardia lamblia
GEFKSLLHLSFIPTGLWYDKTHIVAYNDTN

SEQ ID NO: 3186777 - protein, 35 aa, Giardia lamblia
GEFQTALGEGLPTDLFRYTPPLIEDLQREHLESIR

SEQ ID NO: 3186778 - protein, 24 aa, Giardia lamblia
GEFRKILMFAIELNDYELLQDAIR

SEQ ID NO: 3186779 - protein, 23 aa, Giardia lamblia
GEFRLNQPFGKGAWIVNGWKQDG

SEQ ID NO: 3186780 - protein, 18 aa, Giardia lamblia
GEGTRATFFYLEALKELC

SEQ ID NO: 3186781 - protein, 25 aa, Giardia lamblia
GEGYSPLHLALLLNHIQLAKYLDAS

SEQ ID NO: 3186782 - protein, 30 aa, Giardia lamblia
GEHISEAKIWYIFAQLLYALASIHDPVENQ

SEQ ID NO: 3186783 - protein, 26 aa, Giardia lamblia
GEILELYAYMWSYFSKGLTPNINRAG

SEQ ID NO: 3186784 - protein, 18 aa, Giardia lamblia
GELFRRPTPQAGTRSNSI

SEQ ID NO: 3186785 - protein, 32 aa, Giardia lamblia
GELHVPITCYPRQIAILILKNLELVRKVYEIS

SEQ ID NO: 3186786 - protein, 19 aa, Giardia lamblia
GELQDILYSQSRLSENATL

SEQ ID NO: 3186787 - protein, 25 aa, Giardia lamblia
GELRQLIIHFFLADDTVEVLEVLPQ

SEQ ID NO: 3186788 - protein, 19 aa, Giardia lamblia
GELSTWMKNLWGNRFLNEK

SEQ ID NO: 3186789 - protein, 26 aa, Giardia lamblia
GELTALNLLSVFKPGATFASLASHAY

SEQ ID NO: 3186790 - protein, 23 aa, Giardia lamblia
GELTDAIYRLRADLDFLTEENAH

SEQ ID NO: 3186791 - protein, 17 aa, Giardia lamblia
GELTPLMEAVINPTVQL

SEQ ID NO: 3186792 - protein, 23 aa, Giardia lamblia
GELVDYHNICYEKLLVHPQEPDF

SEQ ID NO: 3186793 - protein, 34 aa, Giardia lamblia
GELVSTLLHLRTCLAHYGLSLYLESLASTNIVLD

SEQ ID NO: 3186794 - protein, 19 aa, Giardia lamblia
GEMCWFANKLLVDAGTSGL

SEQ ID NO: 3186795 - protein, 19 aa, Giardia lamblia
GEMTYLLHGSLTPSNILFD

SEQ ID NO: 3186796 - protein, 17 aa, Giardia lamblia
GEMYMNPTKPKLPGHAL

SEQ ID NO: 3186797 - protein, 22 aa, Giardia lamblia
GENAILTAIRYDQPGCVSDMCM

SEQ ID NO: 3186798 - protein, 25 aa, Giardia lamblia
GENFTLGKDIFLKGDLPISTSCDMA

SEQ ID NO: 3186799 - protein, 24 aa, Giardia lamblia
GENPWLKLVRLAENTSFKGAPELV

SEQ ID NO: 3186800 - protein, 25 aa, Giardia lamblia
GENSLRILSFLFDTDVAMPFTTVDN

SEQ ID NO: 3186801 - protein, 18 aa, Giardia lamblia
GEPIAAFRQAAISQMQLS

SEQ ID NO: 3186802 - protein, 20 aa, Giardia lamblia
GEPLDIFVPRLKSGVPDYLK

SEQ ID NO: 3186803 - protein, 25 aa, Giardia lamblia
GEPRRYLLGTFFYAFDHRSYYGCAE

SEQ ID NO: 3186804 - protein, 19 aa, Giardia lamblia
GEPYGFKADVWALGITAIE

SEQ ID NO: 3186805 - protein, 24 aa, Giardia lamblia
GERDWKPYLLLQTDPQMILDIEHL

SEQ ID NO: 3186806 - protein, 28 aa, Giardia lamblia
GERFVIADFGLCKDALWSGSTLIGIMAY

SEQ ID NO: 3186807 - protein, 29 aa, Giardia lamblia
GERFVIADFGLCRDALWSGSTLIGIMAYV

SEQ ID NO: 3186808 - protein, 24 aa, Giardia lamblia
GERSDLPVLLVVSGLLSHLSFSTI

SEQ ID NO: 3186809 - protein, 25 aa, Giardia lamblia
GERYLYIRMTYYPETLRDIITSHTS

SEQ ID NO: 3186810 - protein, 26 aa, Giardia lamblia
GESKMLWKEVVIAYEPVWSIGTGVVA

SEQ ID NO: 3186811 - protein, 25 aa, Giardia lamblia
GESVTMNMLLKLSANEIRNYLTPQL

SEQ ID NO: 3186812 - protein, 26 aa, Giardia lamblia
GETALLWAAFFNNSDLCRLLVDKEAK

SEQ ID NO: 3186813 - protein, 22 aa, Giardia lamblia
GETALMIAVCRGLVDCVKILAD

SEQ ID NO: 3186814 - protein, 23 aa, Giardia lamblia
GETAMIIAIRNKRPECARLLLEY

SEQ ID NO: 3186815 - protein, 18 aa, Giardia lamblia
GETLPWKLATELGLSEIA

SEQ ID NO: 3186816 - protein, 21 aa, Giardia lamblia
GETTWPIYYAFNNDQCQLVYE

SEQ ID NO: 3186817 - protein, 25 aa, Giardia lamblia
GEVDKLLDLPLESDFKYFPESKLIN

SEQ ID NO: 3186818 - protein, 36 aa, Giardia lamblia
GEVIAMAEPLLKCGIHPILITQGYQKALDFLLSEAE

SEQ ID NO: 3186819 - protein, 25 aa, Giardia lamblia
GEVRTRKLWFYPGREDSCGFIEHLI

SEQ ID NO: 3186820 - protein, 23 aa, Giardia lamblia
GEVTALCILPVSPAPILVAGDSE

SEQ ID NO: 3186821 - protein, 26 aa, Giardia lamblia
GEYPKDMQATLGDRLYLAAQLTDYCI

SEQ ID NO: 3186822 - protein, 24 aa, Giardia lamblia
GFAPPGPGAALWFKGRVLRDETVL

SEQ ID NO: 3186823 - protein, 24 aa, Giardia lamblia
GFCPWCILRVSLWDDISLCGFSCE

SEQ ID NO: 3186824 - protein, 19 aa, Giardia lamblia
GFDDSITLAYTLLEHLLEQ

SEQ ID NO: 3186825 - protein, 23 aa, Giardia lamblia
GFDFNHYYIFDEKLPYSKTYVNN

SEQ ID NO: 3186826 - protein, 36 aa, Giardia lamblia
GFDTGKVCIFKIGNKFPIELLLHRSPIVSLDISPDR

SEQ ID NO: 3186827 - protein, 20 aa, Giardia lamblia
GFDYRFQMAVPDLWINMMKH

SEQ ID NO: 3186828 - protein, 17 aa, Giardia lamblia
GFERLRKILNEREADLL

SEQ ID NO: 3186829 - protein, 32 aa, Giardia lamblia
GFESWSEPFAPKFYRFLTLAYALSDYEMLIQA

SEQ ID NO: 3186830 - protein, 23 aa, Giardia lamblia
GFFAETISFTKLLTILADYVKTI

SEQ ID NO: 3186831 - protein, 20 aa, Giardia lamblia
GFFSFETRLGYTVKASLACP

SEQ ID NO: 3186832 - protein, 24 aa, Giardia lamblia
GFGIRLNKRPPLIKVDRKDRGGIT

SEQ ID NO: 3186833 - protein, 23 aa, Giardia lamblia
GFHDKIVIVLDFNSLYPNIIREY

SEQ ID NO: 3186834 - protein, 20 aa, Giardia lamblia
GFHHFKVGLVIYPTSKPGIK

SEQ ID NO: 3186835 - protein, 25 aa, Giardia lamblia
GFIYKYNPMLVLPLSTRFRGRIEFI

SEQ ID NO: 3186836 - protein, 17 aa, Giardia lamblia
GFLAEHINAAVGSYPAL

SEQ ID NO: 3186837 - protein, 26 aa, Giardia lamblia
GFLARTHLMGIWKSPLRTPISRPNSI

SEQ ID NO: 3186838 - protein, 20 aa, Giardia lamblia
GFLCEQLCPDRVLIGVGINV

SEQ ID NO: 3186839 - protein, 20 aa, Giardia lamblia
GFLKPWDICAFMGIAHSLNI

SEQ ID NO: 3186840 - protein, 19 aa, Giardia lamblia
GFLMQKEIDYFRIALSEPK

SEQ ID NO: 3186841 - protein, 19 aa, Giardia lamblia
GFLSILYAVGSKPLQIWSK

SEQ ID NO: 3186842 - protein, 20 aa, Giardia lamblia
GFNFGGALPSAFSKPSDNAA

SEQ ID NO: 3186843 - protein, 18 aa, Giardia lamblia
GFNIYSAVSRYISEIWAS

SEQ ID NO: 3186844 - protein, 35 aa, Giardia lamblia
GFPRPISIDTFRKPDFFLVAEILHYITTVVAPSNA

SEQ ID NO: 3186845 - protein, 18 aa, Giardia lamblia
GFRILRSVLRKNGCVTAF

SEQ ID NO: 3186846 - protein, 25 aa, Giardia lamblia
GFRMAKVIIRCIPSMRTAWNVCKLM

SEQ ID NO: 3186847 - protein, 17 aa, Giardia lamblia
GFRRPNSTVISFPPEVY

SEQ ID NO: 3186848 - protein, 22 aa, Giardia lamblia
GFSAKYMNMVFRLSIYCVREQS

SEQ ID NO: 3186849 - protein, 18 aa, Giardia lamblia
GFSLKSLRFLIIDEADKM

SEQ ID NO: 3186850 - protein, 27 aa, Giardia lamblia
GFSNGTWGSFNLLSGEHLLMVDCFPAD

SEQ ID NO: 3186851 - protein, 19 aa, Giardia lamblia
GFSYDYVFDWTLLGIDVDK

SEQ ID NO: 3186852 - protein, 20 aa, Giardia lamblia
GFTALIYGLTSSVPADTKLQ

SEQ ID NO: 3186853 - protein, 22 aa, Giardia lamblia
GFTAMLEYYGPLGRIVGCPVES

SEQ ID NO: 3186854 - protein, 33 aa, Giardia lamblia
GFTANGWITAFDWPFRIPKAIYRRRLHGSDITA

SEQ ID NO: 3186855 - protein, 22 aa, Giardia lamblia
GFTKLHRAYTEKTLLTLAAAQT

SEQ ID NO: 3186856 - protein, 20 aa, Giardia lamblia
GFTLYNGILEIPLLCTSVNG

SEQ ID NO: 3186857 - protein, 20 aa, Giardia lamblia
GFVRHQLDFMAVRDLVPILA

SEQ ID NO: 3186858 - protein, 24 aa, Giardia lamblia
GGAAKWSYAYMRRLYITQADMDNY

SEQ ID NO: 3186859 - protein, 24 aa, Giardia lamblia
GGARLRRHCPRAHPIEAAIKLKTD

SEQ ID NO: 3186860 - protein, 34 aa, Giardia lamblia
GGASKMNIPNLADFLILFLKRYADLARSKEFFEH

SEQ ID NO: 3186861 - protein, 28 aa, Giardia lamblia
GGAWIVSELIVFLRCSLQSMNVISVDDA

SEQ ID NO: 3186862 - protein, 18 aa, Giardia lamblia
GGCIIRMNLLTPLADFYK

SEQ ID NO: 3186863 - protein, 17 aa, Giardia lamblia
GGDHLCTLPSPRVARFV

SEQ ID NO: 3186864 - protein, 17 aa, Giardia lamblia
GGDPIFHGAPWLILIST

SEQ ID NO: 3186865 - protein, 19 aa, Giardia lamblia
GGDPSLLHTVGTGSKLSGT

SEQ ID NO: 3186866 - protein, 32 aa, Giardia lamblia
GGESTFISLCFMVSCWLVIKTRYAQIDEWDVF

SEQ ID NO: 3186867 - protein, 20 aa, Giardia lamblia
GGFDRSCAPPPSSTYVMDRA

SEQ ID NO: 3186868 - protein, 26 aa, Giardia lamblia
GGFFSNGWTALMWAVSCSQIECARLL

SEQ ID NO: 3186869 - protein, 18 aa, Giardia lamblia
GGFISPLEAAVTGSFVPY

SEQ ID NO: 3186870 - protein, 21 aa, Giardia lamblia
GGFNGNFYFNPATFKTIDCDS

SEQ ID NO: 3186871 - protein, 29 aa, Giardia lamblia
GGFVSFDATFLMFFSYCCAGIRNGALSEV

SEQ ID NO: 3186872 - protein, 26 aa, Giardia lamblia
GGGVWYRLFVDVKPAFQALCFSDRPR

SEQ ID NO: 3186873 - protein, 27 aa, Giardia lamblia
GGHQECVQLLLPYEAALQHSSGRTAAD

SEQ ID NO: 3186874 - protein, 25 aa, Giardia lamblia
GGHSEVVKLLLPFETKMKTTAGRTA

SEQ ID NO: 3186875 - protein, 43 aa, Giardia lamblia
GGILRRSFITSFDEIRLITLALIEICLKIYICTGKRHEPYKLG

SEQ ID NO: 3186876 - protein, 27 aa, Giardia lamblia
GGISLGIYVQRPLTLAELAMDICKYMI

SEQ ID NO: 3186877 - protein, 25 aa, Giardia lamblia
GGKDSSVMLHILHTLRLRCQDVYDG

SEQ ID NO: 3186878 - protein, 17 aa, Giardia lamblia
GGKDTMIIVWESKTLLP

SEQ ID NO: 3186879 - protein, 22 aa, Giardia lamblia
GGLASLFNLIKMEILTESPNVR

SEQ ID NO: 3186880 - protein, 21 aa, Giardia lamblia
GGLLQWCSLLGFSSYEFKHAS

SEQ ID NO: 3186881 - protein, 30 aa, Giardia lamblia
GGLSLHPLQLRILLRSLQLLKVGGTLVYST

SEQ ID NO: 3186882 - protein, 27 aa, Giardia lamblia
GGLVLPPLIAPIHVVIIPIGCGKKNNQ

SEQ ID NO: 3186883 - protein, 19 aa, Giardia lamblia
GGNCVKLLIKCSERKVFLP

SEQ ID NO: 3186884 - protein, 22 aa, Giardia lamblia
GGNDYACKLTLFAPINPDESKY

SEQ ID NO: 3186885 - protein, 29 aa, Giardia lamblia
GGNVLSSLGTFPYFWASKAEYEEYGISIL

SEQ ID NO: 3186886 - protein, 27 aa, Giardia lamblia
GGPNYAPTLLNPLRLLACADSKLVRDE

SEQ ID NO: 3186887 - protein, 24 aa, Giardia lamblia
GGPVSCVLFNPFCPGLLASTCIGD

SEQ ID NO: 3186888 - protein, 30 aa, Giardia lamblia
GGQRSRLNFALLTFQTLPSLLILDEPTNHL

SEQ ID NO: 3186889 - protein, 26 aa, Giardia lamblia
GGQYSPLLHSFFDCTLNHPALYFYTH

SEQ ID NO: 3186890 - protein, 24 aa, Giardia lamblia
GGRLSTLLNQWSNYRTQDGFSVPD

SEQ ID NO: 3186891 - protein, 23 aa, Giardia lamblia
GGRPWVVIPFHSKIPAQQAMYPF

SEQ ID NO: 3186892 - protein, 23 aa, Giardia lamblia
GGRSLLVTKFLAQGGFAFVYVAT

SEQ ID NO: 3186893 - protein, 26 aa, Giardia lamblia
GGRVFFKVTLYSLLAKAGVGYLTDKA

SEQ ID NO: 3186894 - protein, 20 aa, Giardia lamblia
GGSPLFLLISASILPEKGID

SEQ ID NO: 3186895 - protein, 37 aa, Giardia lamblia
GGTAGHAFYLPISHDLGIFSKFYSYRHETRTYAFVGF

SEQ ID NO: 3186896 - protein, 21 aa, Giardia lamblia
GGTFGIWHMYSGRNKKSNAFG

SEQ ID NO: 3186897 - protein, 25 aa, Giardia lamblia
GGTVFRLFDCAPQRRISLSQVDKVT

SEQ ID NO: 3186898 - protein, 24 aa, Giardia lamblia
GGVDGMLKLWNAVQGNTLVTIKPA

SEQ ID NO: 3186899 - protein, 24 aa, Giardia lamblia
GGVLNYGIPKFRLPKQIVAHEINS

SEQ ID NO: 3186900 - protein, 19 aa, Giardia lamblia
GGYTALMFAAKRGSTESVA

SEQ ID NO: 3186901 - protein, 23 aa, Giardia lamblia
GHEEIANLLLPFEGGMQLKNGGT

SEQ ID NO: 3186902 - protein, 38 aa, Giardia lamblia
GHFKAVRILMSKFTYSWQSLNKASLFVKRQNLAEFEEL

SEQ ID NO: 3186903 - protein, 23 aa, Giardia lamblia
GHFTLDFGTIFRQALETTKSGCK

SEQ ID NO: 3186904 - protein, 27 aa, Giardia lamblia
GHGESTYLIDYIPPAKGGIADTIVYSR

SEQ ID NO: 3186905 - protein, 18 aa, Giardia lamblia
GHIDAVKLLIADLSPRIL

SEQ ID NO: 3186906 - protein, 32 aa, Giardia lamblia
GHILQFDQVSLYYKHWLYFSNTGKLAMDPSTT

SEQ ID NO: 3186907 - protein, 18 aa, Giardia lamblia
GHIMVGLDECQLLFGGDL

SEQ ID NO: 3186908 - protein, 17 aa, Giardia lamblia
GHITTKTKFLEAANNEL

SEQ ID NO: 3186909 - protein, 17 aa, Giardia lamblia
GHKDVCEYLLNESVYEL

SEQ ID NO: 3186910 - protein, 24 aa, Giardia lamblia
GHLECVKLLIASERKYKNNLNYDA

SEQ ID NO: 3186911 - protein, 26 aa, Giardia lamblia
GHLETFRLISPFETKALLSCGYTNLM

SEQ ID NO: 3186912 - protein, 21 aa, Giardia lamblia
GHLNIPFPYDNNGIISVFRCL

SEQ ID NO: 3186913 - protein, 21 aa, Giardia lamblia
GHLQLVELLACFKNGVELGLQ

SEQ ID NO: 3186914 - protein, 18 aa, Giardia lamblia
GHMYTLLQTQTLACYYRA

SEQ ID NO: 3186915 - protein, 19 aa, Giardia lamblia
GHNAEYAYSLPIPDTIMNL

SEQ ID NO: 3186916 - protein, 29 aa, Giardia lamblia
GHPLSTYQLLFTKAALFIMALKLERDVFH

SEQ ID NO: 3186917 - protein, 17 aa, Giardia lamblia
GHPTFPPTLACTEPKKI

SEQ ID NO: 3186918 - protein, 22 aa, Giardia lamblia
GHQDCVKLLLPYESGLVSNDGS

SEQ ID NO: 3186919 - protein, 21 aa, Giardia lamblia
GHQLIGDWLVFVLGGSVVVRS

SEQ ID NO: 3186920 - protein, 24 aa, Giardia lamblia
GHRDVTMLLMDYEKDAAGWTMLMC

SEQ ID NO: 3186921 - protein, 27 aa, Giardia lamblia
GHRKAKLFMLPFAWNLDRIKAIPKSLH

SEQ ID NO: 3186922 - protein, 18 aa, Giardia lamblia
GHRRPAKQHLSRSASSDR

SEQ ID NO: 3186923 - protein, 36 aa, Giardia lamblia
GHRVLIFSQLIKTLDILERYCFYKKYKFQRLQGSMT

SEQ ID NO: 3186924 - protein, 21 aa, Giardia lamblia
GHSNIMRILAAKEVAICTATG

SEQ ID NO: 3186925 - protein, 22 aa, Giardia lamblia
GHSVWLDVMPPMIVTLGCPSLH

SEQ ID NO: 3186926 - protein, 27 aa, Giardia lamblia
GHTALMYAALCNHSIIVSLLVNREGHM

SEQ ID NO: 3186927 - protein, 21 aa, Giardia lamblia
GHTGLLHLSVRMLCYTNPSVL

SEQ ID NO: 3186928 - protein, 23 aa, Giardia lamblia
GHTPPYLRFCSYAHLRHLGYTVD

SEQ ID NO: 3186929 - protein, 17 aa, Giardia lamblia
GHVACVQALYPLEKDLL

SEQ ID NO: 3186930 - protein, 23 aa, Giardia lamblia
GHVDLVSMLLPFEGKIRDKLGNT

SEQ ID NO: 3186931 - protein, 22 aa, Giardia lamblia
GHYTAFVRDVTSGVWYLVDDSI

SEQ ID NO: 3186932 - protein, 19 aa, Giardia lamblia
GHYTALCYGCNDKYYYCND

SEQ ID NO: 3186933 - protein, 21 aa, Giardia lamblia
GIAAEFWCLNLSKAGLGREDY

SEQ ID NO: 3186934 - protein, 28 aa, Giardia lamblia
GIAPQNMQFLILQDGLIKAVSIFSLKRM

SEQ ID NO: 3186935 - protein, 26 aa, Giardia lamblia
GIASRSIIFKGIQAPVLLPQGPPRND

SEQ ID NO: 3186936 - protein, 20 aa, Giardia lamblia
GIDASVQSSCPALCELVKAV

SEQ ID NO: 3186937 - protein, 19 aa, Giardia lamblia
GIDCVFYVADWFAALNNKC

SEQ ID NO: 3186938 - protein, 30 aa, Giardia lamblia
GIDEWVRLGLHPVLCKYLVRAGYTKPRAIQ

SEQ ID NO: 3186939 - protein, 29 aa, Giardia lamblia
GIDFIDNKVPFLVHERLSTAASGRSCNNI

SEQ ID NO: 3186940 - protein, 19 aa, Giardia lamblia
GIDLLTRMLTLDPLKRITV

SEQ ID NO: 3186941 - protein, 18 aa, Giardia lamblia
GIDYEQLLIAKNAEIKRL

SEQ ID NO: 3186942 - protein, 28 aa, Giardia lamblia
GIEGSDLLKFLFADTGKISLLSTDDRKY

SEQ ID NO: 3186943 - protein, 30 aa, Giardia lamblia
GIESGYLLTKLIYFAPWPAIEDILVFMSIR

SEQ ID NO: 3186944 - protein, 24 aa, Giardia lamblia
GIESSLMQLISKHDPSTANAGRGT

SEQ ID NO: 3186945 - protein, 18 aa, Giardia lamblia
GIFALVLTPTRELALQIE

SEQ ID NO: 3186946 - protein, 27 aa, Giardia lamblia
GIFCRLRSILLSYRNMLLNTVRGTKAA

SEQ ID NO: 3186947 - protein, 19 aa, Giardia lamblia
GIFDLIRTSLGPRGLDKMV

SEQ ID NO: 3186948 - protein, 20 aa, Giardia lamblia
GIFSSIWRRCTKREGEWFFF

SEQ ID NO: 3186949 - protein, 23 aa, Giardia lamblia
GIGAMKYHRPLLLPDLVEGIDVT

SEQ ID NO: 3186950 - protein, 24 aa, Giardia lamblia
GIGGLLRWQVDLVEAARFMQESDE

SEQ ID NO: 3186951 - protein, 35 aa, Giardia lamblia
GIGHCIPALTALIDKYDWIPQRSAAIPASDPPLTA

SEQ ID NO: 3186952 - protein, 24 aa, Giardia lamblia
GIGQTPLLSMLRFLAQKEGKETAR

SEQ ID NO: 3186953 - protein, 23 aa, Giardia lamblia
GIGTGALGLFNKAKGWLGLGEAR

SEQ ID NO: 3186954 - protein, 35 aa, Giardia lamblia
GIHPANIFLYADGARIRLGYPYICPTMSFKNPGNY

SEQ ID NO: 3186955 - protein, 31 aa, Giardia lamblia
GIIDQLEIIPPYYEIFLTSLGYPGTGYSISH

SEQ ID NO: 3186956 - protein, 40 aa, Giardia lamblia
GIILPQTFIIQRNKLCPLIYLAARFAALFEVSKLYSEINL

SEQ ID NO: 3186957 - protein, 20 aa, Giardia lamblia
GIISEYLIPDVSYTSVSRIS

SEQ ID NO: 3186958 - protein, 25 aa, Giardia lamblia
GIKDSFGWTALIYAVSNGSIDAVRL

SEQ ID NO: 3186959 - protein, 18 aa, Giardia lamblia
GIKQVRLHLLFDGRDVGE

SEQ ID NO: 3186960 - protein, 19 aa, Giardia lamblia
GILELRRYTLEMLESKDRV

SEQ ID NO: 3186961 - protein, 19 aa, Giardia lamblia
GILLKKRQYDDLDFDILNM

SEQ ID NO: 3186962 - protein, 28 aa, Giardia lamblia
GILNSIMSSVAFWKKPLPTDKNKQPIAS

SEQ ID NO: 3186963 - protein, 26 aa, Giardia lamblia
GILSTDPIFESIQRRSAEEYCPPNVP

SEQ ID NO: 3186964 - protein, 17 aa, Giardia lamblia
GILVVFLKSCKDLEMTF

SEQ ID NO: 3186965 - protein, 24 aa, Giardia lamblia
GIMPYLLNALTNEDLLVSLLGSCE

SEQ ID NO: 3186966 - protein, 37 aa, Giardia lamblia
GIMTTPLVDRLCLFMYGIARVLQIKMGGRYYGKAILE

SEQ ID NO: 3186967 - protein, 17 aa, Giardia lamblia
GINDISFSASFASKRQG

SEQ ID NO: 3186968 - protein, 23 aa, Giardia lamblia
GINPDLPILKYAPDIVDRLVIDF

SEQ ID NO: 3186969 - protein, 22 aa, Giardia lamblia
GINPRTGLFEEISPFEYQQPRV

SEQ ID NO: 3186970 - protein, 22 aa, Giardia lamblia
GINVMHYPQLPLVTTRSMPHVK

SEQ ID NO: 3186971 - protein, 21 aa, Giardia lamblia
GINVPLSILQKTRNLSLTAAA

SEQ ID NO: 3186972 - protein, 25 aa, Giardia lamblia
GIPIDIYCLLFPTGVFQITPDEHLT

SEQ ID NO: 3186973 - protein, 19 aa, Giardia lamblia
GIPIEVMGLLLGTFVDKYT

SEQ ID NO: 3186974 - protein, 17 aa, Giardia lamblia
GIPIKRPPFKSAQRGVS

SEQ ID NO: 3186975 - protein, 19 aa, Giardia lamblia
GIPYVLLSNGGVLPELLVR

SEQ ID NO: 3186976 - protein, 19 aa, Giardia lamblia
GIQLCNYLTDLYASGVGFE

SEQ ID NO: 3186977 - protein, 21 aa, Giardia lamblia
GIQPIQPPPFKPPPASQQNHC

SEQ ID NO: 3186978 - protein, 17 aa, Giardia lamblia
GIQPSVVYTTPIIHRME

SEQ ID NO: 3186979 - protein, 24 aa, Giardia lamblia
GIQRQLIVHVYTKAPRKILTEMLL

SEQ ID NO: 3186980 - protein, 18 aa, Giardia lamblia
GIRASLVSNLLFGPKHTK

SEQ ID NO: 3186981 - protein, 21 aa, Giardia lamblia
GIRPMLRRSLPDKVTMPACVI

SEQ ID NO: 3186982 - protein, 18 aa, Giardia lamblia
GISALVEGLLAPASARLS

SEQ ID NO: 3186983 - protein, 24 aa, Giardia lamblia
GISISDILPVLIHFSASIEHAIAS

SEQ ID NO: 3186984 - protein, 24 aa, Giardia lamblia
GISNGVVLLHYFADRLATVYEPVT

SEQ ID NO: 3186985 - protein, 17 aa, Giardia lamblia
GISRLVIHLSRDSPLFK

SEQ ID NO: 3186986 - protein, 25 aa, Giardia lamblia
GISSLLRVVSTVSLYPIKPAEDGAT

SEQ ID NO: 3186987 - protein, 18 aa, Giardia lamblia
GISSVRRFIEDKATLFDI

SEQ ID NO: 3186988 - protein, 22 aa, Giardia lamblia
GISVLVQIISEMPLTFPITDDM

SEQ ID NO: 3186989 - protein, 19 aa, Giardia lamblia
GISYIKCVGSQLIRKYIGE

SEQ ID NO: 3186990 - protein, 17 aa, Giardia lamblia
GITPLMAAALHGSLDVV

SEQ ID NO: 3186991 - protein, 22 aa, Giardia lamblia
GITYLNSLDPVYRRLRATHISK

SEQ ID NO: 3186992 - protein, 33 aa, Giardia lamblia
GIVILNLLERLQKIIFFPPFRVCVDQRHLGNVS

SEQ ID NO: 3186993 - protein, 18 aa, Giardia lamblia
GIVLPPKLKGKSAWETGA

SEQ ID NO: 3186994 - protein, 23 aa, Giardia lamblia
GIVRPVCIDFFKPVYKHAGQSRG

SEQ ID NO: 3186995 - protein, 26 aa, Giardia lamblia
GIVSTNLFPLPLSALQVLILTANYEY

SEQ ID NO: 3186996 - protein, 17 aa, Giardia lamblia
GIVVDRCEDAWCPTCIN

SEQ ID NO: 3186997 - protein, 29 aa, Giardia lamblia
GIWSNASLKTFWRELANLISPEKQVLWKA

SEQ ID NO: 3186998 - protein, 24 aa, Giardia lamblia
GKASFLEKFIDYGLINIGKVSRVS

SEQ ID NO: 3186999 - protein, 29 aa, Giardia lamblia
GKAYTSLLSCPTLVIIKTTIGYGTAKQGT

SEQ ID NO: 3187000 - protein, 17 aa, Giardia lamblia
GKDFVCLVADTVFKHSI

SEQ ID NO: 3187001 - protein, 17 aa, Giardia lamblia
GKDGVCRILLDMEARMV

SEQ ID NO: 3187002 - protein, 30 aa, Giardia lamblia
GKDIARFHCVYWLAFLMGASIPCPRRFFIH

SEQ ID NO: 3187003 - protein, 26 aa, Giardia lamblia
GKDSWTLLHVLLDIAKRSPVKFTVIP

SEQ ID NO: 3187004 - protein, 29 aa, Giardia lamblia
GKDVPKTLRMLVMLAQAAKLFKVRSNSSQ

SEQ ID NO: 3187005 - protein, 32 aa, Giardia lamblia
GKDVTIPFARVCEYIMWMGFSRTSDPTYAHKL

SEQ ID NO: 3187006 - protein, 24 aa, Giardia lamblia
GKELHTHMLYLPNSAHPFFQRSCS

SEQ ID NO: 3187007 - protein, 23 aa, Giardia lamblia
GKESAEIILLNATLQELREQLQQ

SEQ ID NO: 3187008 - protein, 20 aa, Giardia lamblia
GKFEQILGYKMRLPEIDVLL

SEQ ID NO: 3187009 - protein, 22 aa, Giardia lamblia
GKFGHAISIFLPCTDRQMVDAL

SEQ ID NO: 3187010 - protein, 17 aa, Giardia lamblia
GKFLTKYKSTCAIPTPL

SEQ ID NO: 3187011 - protein, 36 aa, Giardia lamblia
GKFPKPERYNLYSKALLLRLDTLINSPLYAPLVSLI

SEQ ID NO: 3187012 - protein, 20 aa, Giardia lamblia
GKFPLFARSGFIDNIELSYS

SEQ ID NO: 3187013 - protein, 21 aa, Giardia lamblia
GKFRLVTSAILKDLARLMRRR

SEQ ID NO: 3187014 - protein, 18 aa, Giardia lamblia
GKFRVSMEYRYSTVHTLN

SEQ ID NO: 3187015 - protein, 19 aa, Giardia lamblia
GKFVRWRMTGCFSVVDLKT

SEQ ID NO: 3187016 - protein, 23 aa, Giardia lamblia
GKGFELLPRDKIVNSLRAFAAEV

SEQ ID NO: 3187017 - protein, 24 aa, Giardia lamblia
GKGIFICGYSDLYTWFNTEFQAKA

SEQ ID NO: 3187018 - protein, 20 aa, Giardia lamblia
GKGKTAVFVLSLLHMIDPQA

SEQ ID NO: 3187019 - protein, 26 aa, Giardia lamblia
GKGKTKHIVFCDDKRIDISRRETKVN

SEQ ID NO: 3187020 - protein, 20 aa, Giardia lamblia
GKHAAIIIGGLQPCSRPHSR

SEQ ID NO: 3187021 - protein, 24 aa, Giardia lamblia
GKHAVLLKIQGLRALYDTLVKENA

SEQ ID NO: 3187022 - protein, 26 aa, Giardia lamblia
GKHEVFRITQGNFFVFFVARRGSRVK

SEQ ID NO: 3187023 - protein, 35 aa, Giardia lamblia
GKHIDLIQDVWLRNLVMQLLAFNPAERLTVEELLM

SEQ ID NO: 3187024 - protein, 17 aa, Giardia lamblia
GKHNILHIIDRELSVYL

SEQ ID NO: 3187025 - protein, 18 aa, Giardia lamblia
GKHYHLQLVIKNVPILIA

SEQ ID NO: 3187026 - protein, 24 aa, Giardia lamblia
GKIDKMIDFWRKESLLCNEIEDKV

SEQ ID NO: 3187027 - protein, 26 aa, Giardia lamblia
GKIESLYDIFKYSLPIKETEIIDYFF

SEQ ID NO: 3187028 - protein, 21 aa, Giardia lamblia
GKIMLSMEFLESGSLSNLIDK

SEQ ID NO: 3187029 - protein, 26 aa, Giardia lamblia
GKIRDIYGILMKLFEPSMTAEIRAAA

SEQ ID NO: 3187030 - protein, 31 aa, Giardia lamblia
GKKISHVPYRDSLLTKLLKPSLAGESRMVAI

SEQ ID NO: 3187031 - protein, 29 aa, Giardia lamblia
GKKKACYHFLVMMYFIGAIHSGTAKNIAF

SEQ ID NO: 3187032 - protein, 23 aa, Giardia lamblia
GKKYYGVFPLRGKVINVRNESID

SEQ ID NO: 3187033 - protein, 26 aa, Giardia lamblia
GKLAEKALNWPYVRARELFKNPAVID

SEQ ID NO: 3187034 - protein, 25 aa, Giardia lamblia
GKLDKELIRLILRDGPQAESQNMSL

SEQ ID NO: 3187035 - protein, 24 aa, Giardia lamblia
GKLLSDMCLLLLPSSPEPPSLPTD

SEQ ID NO: 3187036 - protein, 24 aa, Giardia lamblia
GKLNYYLFNLKWPKMALKDIGVVL

SEQ ID NO: 3187037 - protein, 29 aa, Giardia lamblia
GKLPNLFGAIIFFYHGQLFVAGGSARRPK

SEQ ID NO: 3187038 - protein, 22 aa, Giardia lamblia
GKLPNPSLRRYHGLALDGGVLQ

SEQ ID NO: 3187039 - protein, 18 aa, Giardia lamblia
GKNQLIFEAIAKALEIIP

SEQ ID NO: 3187040 - protein, 27 aa, Giardia lamblia
GKPILGLKPSLFHQRDFSRKSLVVCQI

SEQ ID NO: 3187041 - protein, 22 aa, Giardia lamblia
GKQIQYHAALARPSMLRRLQIR

SEQ ID NO: 3187042 - protein, 22 aa, Giardia lamblia
GKQLLDPRRRPAPRMKEVFSIG

SEQ ID NO: 3187043 - protein, 29 aa, Giardia lamblia
GKQSLECIILLLCYKIKYPENFFMLRGNH

SEQ ID NO: 3187044 - protein, 26 aa, Giardia lamblia
GKQVLDALVYCHSPFKFNPATSKGPS

SEQ ID NO: 3187045 - protein, 35 aa, Giardia lamblia
GKRFDPEMKMFSKLLFILLRRYHTFFGTERFEGTS

SEQ ID NO: 3187046 - protein, 26 aa, Giardia lamblia
GKRPGGAMLWHLYGVGQSDRITSSGY

SEQ ID NO: 3187047 - protein, 17 aa, Giardia lamblia
GKRRAHLNPNGFEDGFI

SEQ ID NO: 3187048 - protein, 23 aa, Giardia lamblia
GKSGLRILNLNPSSLSLLKRSLS

SEQ ID NO: 3187049 - protein, 19 aa, Giardia lamblia
GKSILPWPERNREIANVEF

SEQ ID NO: 3187050 - protein, 21 aa, Giardia lamblia
GKSLCLWVRAVYEYACVYKVV

SEQ ID NO: 3187051 - protein, 28 aa, Giardia lamblia
GKSLDLSLIQFPDLIDRTMWRSSAQLSQ

SEQ ID NO: 3187052 - protein, 20 aa, Giardia lamblia
GKSLIHKNILRYLALHQRGD

SEQ ID NO: 3187053 - protein, 17 aa, Giardia lamblia
GKSQFRLYSKTNTLIQN

SEQ ID NO: 3187054 - protein, 17 aa, Giardia lamblia
GKSYFQLINLNLSWHFW

SEQ ID NO: 3187055 - protein, 21 aa, Giardia lamblia
GKTAAFGISLLSLVNPQKSIC

SEQ ID NO: 3187056 - protein, 20 aa, Giardia lamblia
GKTALMHAVEQKRTFCARIL

SEQ ID NO: 3187057 - protein, 22 aa, Giardia lamblia
GKTALMHAVSAFSDTFDGRAVP

SEQ ID NO: 3187058 - protein, 21 aa, Giardia lamblia
GKTCLLFVYANNSFPEDYLPT

SEQ ID NO: 3187059 - protein, 26 aa, Giardia lamblia
GKTGKPYTIPQPFNLSYEMSARKSAF

SEQ ID NO: 3187060 - protein, 25 aa, Giardia lamblia
GKTHAFSIPALLHAAAQPPTSEAVP

SEQ ID NO: 3187061 - protein, 30 aa, Giardia lamblia
GKTNIYDAILFATLFPDPRVRISDGYISAG

SEQ ID NO: 3187062 - protein, 30 aa, Giardia lamblia
GKTTIIINLFRLLNEIYRYSHIIYVAANYR

SEQ ID NO: 3187063 - protein, 26 aa, Giardia lamblia
GKTVTNIFHRVLLKRLIKHANYLSCE

SEQ ID NO: 3187064 - protein, 20 aa, Giardia lamblia
GKVDNYGWSALMFAARDSNI

SEQ ID NO: 3187065 - protein, 23 aa, Giardia lamblia
GKVEIYHIPLKFTAYTNGTYKFD

SEQ ID NO: 3187066 - protein, 22 aa, Giardia lamblia
GKVKLKLRTAKYLYTLTVPNAD

SEQ ID NO: 3187067 - protein, 25 aa, Giardia lamblia
GKVPASWGIIYKSTKSLAPWSRDFI

SEQ ID NO: 3187068 - protein, 25 aa, Giardia lamblia
GLAAVPINIWLDVIPQLIARLHSPQ

SEQ ID NO: 3187069 - protein, 18 aa, Giardia lamblia
GLAEWNVIVRKGRPSMDY

SEQ ID NO: 3187070 - protein, 20 aa, Giardia lamblia
GLAKLSRMFLAGKFGMCPRE

SEQ ID NO: 3187071 - protein, 24 aa, Giardia lamblia
GLAKRLIDLILGKPVSPGLFSETS

SEQ ID NO: 3187072 - protein, 18 aa, Giardia lamblia
GLCIAHYYNLAPARAVAY

SEQ ID NO: 3187073 - protein, 18 aa, Giardia lamblia
GLCLGFQMMVCEFARNVC

SEQ ID NO: 3187074 - protein, 24 aa, Giardia lamblia
GLCSLSYGRLILGALPCLGYTSTI

SEQ ID NO: 3187075 - protein, 19 aa, Giardia lamblia
GLDEGLVPVLDRLLTNVST

SEQ ID NO: 3187076 - protein, 30 aa, Giardia lamblia
GLDEYRSISLYLPFQQFYTDNLGRTALMVA

SEQ ID NO: 3187077 - protein, 18 aa, Giardia lamblia
GLDLNAPNLFSSPSIVID

SEQ ID NO: 3187078 - protein, 26 aa, Giardia lamblia
GLDSKLLTCSIIIDSPISPVKSYRQT

SEQ ID NO: 3187079 - protein, 18 aa, Giardia lamblia
GLDYKAMGKFFTGLAMSG

SEQ ID NO: 3187080 - protein, 18 aa, Giardia lamblia
GLEEIGIVSLLRTRGVPL

SEQ ID NO: 3187081 - protein, 24 aa, Giardia lamblia
GLEKHIPPLLALLSEEHPFNITHI

SEQ ID NO: 3187082 - protein, 26 aa, Giardia lamblia
GLEKNLLGCTLLTKLAADTLRMIFGC

SEQ ID NO: 3187083 - protein, 24 aa, Giardia lamblia
GLERFLGGLTLLRLIRCRITNIEE

SEQ ID NO: 3187084 - protein, 17 aa, Giardia lamblia
GLFEIVPPNTDLIYDIH

SEQ ID NO: 3187085 - protein, 34 aa, Giardia lamblia
GLGGRINTIMILFFLKLGLSKLLDFDVACEDMKA

SEQ ID NO: 3187086 - protein, 17 aa, Giardia lamblia
GLGLCKDALWSESTLMG

SEQ ID NO: 3187087 - protein, 25 aa, Giardia lamblia
GLGLRNMHDFFWKNLSGLASPVLRE

SEQ ID NO: 3187088 - protein, 25 aa, Giardia lamblia
GLGSEGYYTIPKPSIHTTAHALRRD

SEQ ID NO: 3187089 - protein, 17 aa, Giardia lamblia
GLGVPYLVSGSLELVLE

SEQ ID NO: 3187090 - protein, 27 aa, Giardia lamblia
GLHHPMKPFRIALVNELILAYGLDEHL

SEQ ID NO: 3187091 - protein, 21 aa, Giardia lamblia
GLIAIWDMRSFRVPVTTLSHS

SEQ ID NO: 3187092 - protein, 29 aa, Giardia lamblia
GLIDAFRAMHPHRINYSWFSNFGRAREQK

SEQ ID NO: 3187093 - protein, 19 aa, Giardia lamblia
GLIEELIVSEIPYVIDVLL

SEQ ID NO: 3187094 - protein, 19 aa, Giardia lamblia
GLIFKRHPFFRGTNNINQL

SEQ ID NO: 3187095 - protein, 26 aa, Giardia lamblia
GLILGSLLLSFFPQKATRILHEAMLS

SEQ ID NO: 3187096 - protein, 22 aa, Giardia lamblia
GLILVSMCDIHIPPDSFGDFTV

SEQ ID NO: 3187097 - protein, 19 aa, Giardia lamblia
GLIRAIYAHKLASVEILAA

SEQ ID NO: 3187098 - protein, 17 aa, Giardia lamblia
GLIVHSLVAIEPIPFHN

SEQ ID NO: 3187099 - protein, 17 aa, Giardia lamblia
GLIVRKNGPKGKVTLTV

SEQ ID NO: 3187100 - protein, 23 aa, Giardia lamblia
GLIYNALKYILNNSPDKLSLAAL

SEQ ID NO: 3187101 - protein, 25 aa, Giardia lamblia
GLKALYLLVQELLYAITNSFHAQLS

SEQ ID NO: 3187102 - protein, 18 aa, Giardia lamblia
GLKRRDAGRLFVDALRHH

SEQ ID NO: 3187103 - protein, 18 aa, Giardia lamblia
GLLAIHIAALKGHATVVR

SEQ ID NO: 3187104 - protein, 27 aa, Giardia lamblia
GLLDIATRLFPYEKLIVRKDGSTALMT

SEQ ID NO: 3187105 - protein, 17 aa, Giardia lamblia
GLLGRICAARRSLFNNW

SEQ ID NO: 3187106 - protein, 17 aa, Giardia lamblia
GLLIDFSEKPLSKSNDR

SEQ ID NO: 3187107 - protein, 25 aa, Giardia lamblia
GLLKDKRATCYPAMKDGLVANGAQF

SEQ ID NO: 3187108 - protein, 19 aa, Giardia lamblia
GLLLIARESGHQDKIGCSA

SEQ ID NO: 3187109 - protein, 24 aa, Giardia lamblia
GLLRPDLVIFLDVDASAVAVRTGF

SEQ ID NO: 3187110 - protein, 29 aa, Giardia lamblia
GLMCGQGKLFLVNGAIYSGDFLNCKRHGT

SEQ ID NO: 3187111 - protein, 18 aa, Giardia lamblia
GLNDIVLVLQKEEAGKRA

SEQ ID NO: 3187112 - protein, 29 aa, Giardia lamblia
GLNDNFLGKYPGYKLLFIGGMEKLDKETE

SEQ ID NO: 3187113 - protein, 25 aa, Giardia lamblia
GLNPFEGIRLIYLIAKARSQGKIVI

SEQ ID NO: 3187114 - protein, 34 aa, Giardia lamblia
GLNPRDRDAFLLKLYGQRDLLRMASQALLVEESM

SEQ ID NO: 3187115 - protein, 31 aa, Giardia lamblia
GLNVAAMGKFFIGLVMCGAWSCFDEFNRIEV

SEQ ID NO: 3187116 - protein, 21 aa, Giardia lamblia
GLPEAIFMRHITKVAGALSCQ

SEQ ID NO: 3187117 - protein, 19 aa, Giardia lamblia
GLPIPAFSSAMTYLDMIQT

SEQ ID NO: 3187118 - protein, 35 aa, Giardia lamblia
GLPVRIMATPPELCTFCIYCGLKFHPDAVFCGNCG

SEQ ID NO: 3187119 - protein, 17 aa, Giardia lamblia
GLQLRLTENDFTKERSI

SEQ ID NO: 3187120 - protein, 21 aa, Giardia lamblia
GLQQALELLRASNAQIRKSVR

SEQ ID NO: 3187121 - protein, 26 aa, Giardia lamblia
GLRATTLLYRAMREPGFFINLQPHKE

SEQ ID NO: 3187122 - protein, 26 aa, Giardia lamblia
GLRECIPLILILRNRLHYANTYAETS

SEQ ID NO: 3187123 - protein, 23 aa, Giardia lamblia
GLRFLDYCPQLRALPDLVFSILK

SEQ ID NO: 3187124 - protein, 29 aa, Giardia lamblia
GLRGLFNMHIFEEIFLYILNTSMNKELNV

SEQ ID NO: 3187125 - protein, 20 aa, Giardia lamblia
GLRTTLPSFEQFNCHLDCNP

SEQ ID NO: 3187126 - protein, 18 aa, Giardia lamblia
GLRYGPLLLVDHFERRTL

SEQ ID NO: 3187127 - protein, 20 aa, Giardia lamblia
GLSALMIASFFNSVDCVKLL

SEQ ID NO: 3187128 - protein, 20 aa, Giardia lamblia
GLSCRLTMSYLNKLYNRYSS

SEQ ID NO: 3187129 - protein, 25 aa, Giardia lamblia
GLSFHEIMIRIIAPRKSRILQDELY

SEQ ID NO: 3187130 - protein, 28 aa, Giardia lamblia
GLSHTKLSGLYWVLCSIFILHGRQPTDV

SEQ ID NO: 3187131 - protein, 17 aa, Giardia lamblia
GLSLARHASVIPPACVD

SEQ ID NO: 3187132 - protein, 21 aa, Giardia lamblia
GLSNIFHDTFMKTCCGSPAYA

SEQ ID NO: 3187133 - protein, 28 aa, Giardia lamblia
GLSRELLAELLFLRQECKRLSTVLDAKE

SEQ ID NO: 3187134 - protein, 17 aa, Giardia lamblia
GLSSFIVNPQIELLRKL

SEQ ID NO: 3187135 - protein, 23 aa, Giardia lamblia
GLSTLSTAPLIGGVPLIDREIDA

SEQ ID NO: 3187136 - protein, 17 aa, Giardia lamblia
GLSTYFSEILLARSGDM

SEQ ID NO: 3187137 - protein, 24 aa, Giardia lamblia
GLTALMYAAQWNYPEIVKVLASVE

SEQ ID NO: 3187138 - protein, 19 aa, Giardia lamblia
GLTALMYSAWSGHSEIVAL

SEQ ID NO: 3187139 - protein, 22 aa, Giardia lamblia
GLTGLMLAVQNDDPKMVRLLVE

SEQ ID NO: 3187140 - protein, 24 aa, Giardia lamblia
GLTKRKHDFIRLNYPNPDMVGHCG

SEQ ID NO: 3187141 - protein, 27 aa, Giardia lamblia
GLTVGESCWFLFETGIVGSITLSRVQN

SEQ ID NO: 3187142 - protein, 18 aa, Giardia lamblia
GLVFNTYVRTLPPTLNPE

SEQ ID NO: 3187143 - protein, 33 aa, Giardia lamblia
GLVQQISSMLIALRQREVLKHPDLFINDLISGS

SEQ ID NO: 3187144 - protein, 30 aa, Giardia lamblia
GLVSETHIFYILLLENFLSSGAFVDRFLTK

SEQ ID NO: 3187145 - protein, 17 aa, Giardia lamblia
GLVSFSNGIVRLTPRGR

SEQ ID NO: 3187146 - protein, 23 aa, Giardia lamblia
GLVTPVVLVLTSSAYRICDMGSV

SEQ ID NO: 3187147 - protein, 18 aa, Giardia lamblia
GLVTYTFLTRVEGLHAAA

SEQ ID NO: 3187148 - protein, 18 aa, Giardia lamblia
GLVYDYRAFQTWAKKHGI

SEQ ID NO: 3187149 - protein, 30 aa, Giardia lamblia
GLYENSNRLLLPIFPRIWSSSNRGANLLFY

SEQ ID NO: 3187150 - protein, 23 aa, Giardia lamblia
GLYHGIIHLPQDYPHKPPEIVFL

SEQ ID NO: 3187151 - protein, 19 aa, Giardia lamblia
GLYQMRLRYREIAVHAFQI

SEQ ID NO: 3187152 - protein, 24 aa, Giardia lamblia
GLYSHPTAYQEGIRALMKSAYTNP

SEQ ID NO: 3187153 - protein, 25 aa, Giardia lamblia
GLYSTYPHHAVPKQSIRPPANLMKA

SEQ ID NO: 3187154 - protein, 20 aa, Giardia lamblia
GMATTFLMGIGYPEKIEVTN

SEQ ID NO: 3187155 - protein, 22 aa, Giardia lamblia
GMAYRLGIFYSTPENMKSFGKM

SEQ ID NO: 3187156 - protein, 24 aa, Giardia lamblia
GMEQRLIAKQVARRKRCMAEIVQT

SEQ ID NO: 3187157 - protein, 18 aa, Giardia lamblia
GMEWAQTFLLHTVPLLEQ

SEQ ID NO: 3187158 - protein, 18 aa, Giardia lamblia
GMFVIRLPNKLLEPYEGK

SEQ ID NO: 3187159 - protein, 18 aa, Giardia lamblia
GMGAAGMPPGGFPGGMPP

SEQ ID NO: 3187160 - protein, 28 aa, Giardia lamblia
GMGHIHLVCFPLMAAVKLPFIESAGMQI

SEQ ID NO: 3187161 - protein, 31 aa, Giardia lamblia
GMGHSKPIQLLSLLPAPPLPFLDPTDETKNS

SEQ ID NO: 3187162 - protein, 30 aa, Giardia lamblia
GMGLGLERFICWLLGIYTVRDTVLYPRAPG

SEQ ID NO: 3187163 - protein, 17 aa, Giardia lamblia
GMHLITIINQRGSKPSY

SEQ ID NO: 3187164 - protein, 33 aa, Giardia lamblia
GMIYCDLSDIEWRWLYRHGIDKFYRSRTRNELV

SEQ ID NO: 3187165 - protein, 26 aa, Giardia lamblia
GMKLLISEMLKPDYNSRPTLLDVRLS

SEQ ID NO: 3187166 - protein, 23 aa, Giardia lamblia
GMKSLKLLTVAQQAPVRTLDTSD

SEQ ID NO: 3187167 - protein, 32 aa, Giardia lamblia
GMLPSIIYELRTLLLPNLYTEDWTLGLSKFEL

SEQ ID NO: 3187168 - protein, 18 aa, Giardia lamblia
GMLVTYRAKSTLNNPTKV

SEQ ID NO: 3187169 - protein, 35 aa, Giardia lamblia
GMLWLQCGRANGSILRALPLPIPATACYLYERKDI

SEQ ID NO: 3187170 - protein, 17 aa, Giardia lamblia
GMMTSLMYTAQKGHIEC

SEQ ID NO: 3187171 - protein, 21 aa, Giardia lamblia
GMPAFTITSLKLHPSGRHLLV

SEQ ID NO: 3187172 - protein, 19 aa, Giardia lamblia
GMPTLLREYLKADGVLYAT

SEQ ID NO: 3187173 - protein, 20 aa, Giardia lamblia
GMPVVGQYKPVTGGGIPFMG

SEQ ID NO: 3187174 - protein, 25 aa, Giardia lamblia
GMQRPDGWTALMMAALRGHAECVKL

SEQ ID NO: 3187175 - protein, 18 aa, Giardia lamblia
GMRIGEMEKDAFIAHGAT

SEQ ID NO: 3187176 - protein, 21 aa, Giardia lamblia
GMSFSRPFSRLNSNIPFYMPD

SEQ ID NO: 3187177 - protein, 19 aa, Giardia lamblia
GMTALLYACEFGCRYCVHL

SEQ ID NO: 3187178 - protein, 24 aa, Giardia lamblia
GMTALMFAVERNFLEAVKVLAPLE

SEQ ID NO: 3187179 - protein, 20 aa, Giardia lamblia
GMVMELNRKLIFMRDHPILA

SEQ ID NO: 3187180 - protein, 20 aa, Giardia lamblia
GNALALRHRSPAYRFSTQPR

SEQ ID NO: 3187181 - protein, 23 aa, Giardia lamblia
GNAPVRRVPIKLLTLHASSGNVQ

SEQ ID NO: 3187182 - protein, 17 aa, Giardia lamblia
GNAQVLGILLKSPIADK

SEQ ID NO: 3187183 - protein, 19 aa, Giardia lamblia
GNCIYSLHSFSHDSTVSLL

SEQ ID NO: 3187184 - protein, 36 aa, Giardia lamblia
GNCKTYLLACIRPEPEFLLDTISTLRFAQRASFIKN

SEQ ID NO: 3187185 - protein, 19 aa, Giardia lamblia
GNCLFTFTSLPCILDMYYK

SEQ ID NO: 3187186 - protein, 26 aa, Giardia lamblia
GNDQPLPYIHLYPSQLSQILVEGGDI

SEQ ID NO: 3187187 - protein, 22 aa, Giardia lamblia
GNEEQFYFIHSAHSAPAAPGFT

SEQ ID NO: 3187188 - protein, 17 aa, Giardia lamblia
GNENDVYWKTALEYAIL

SEQ ID NO: 3187189 - protein, 27 aa, Giardia lamblia
GNEQNVLAYPLQLAITPWVCTAILEDA

SEQ ID NO: 3187190 - protein, 25 aa, Giardia lamblia
GNIDTVVVLLPYFGNERDVAGFSAL

SEQ ID NO: 3187191 - protein, 24 aa, Giardia lamblia
GNIEALFKVLIRTKLFILDEPMSN

SEQ ID NO: 3187192 - protein, 19 aa, Giardia lamblia
GNIECAKLLLPKEADMKQP

SEQ ID NO: 3187193 - protein, 26 aa, Giardia lamblia
GNIKAAEFFLWQVGAKDNYGYTALMT

SEQ ID NO: 3187194 - protein, 24 aa, Giardia lamblia
GNIYQTMFPYALFGPSENAFEMHA

SEQ ID NO: 3187195 - protein, 23 aa, Giardia lamblia
GNKLLGKIGLSLDNFKLAKNADG

SEQ ID NO: 3187196 - protein, 30 aa, Giardia lamblia
GNLETTNALVPFFELARPSTGLSALDYAAR

SEQ ID NO: 3187197 - protein, 25 aa, Giardia lamblia
GNLIATLRAFFARLGMTQLKFKATY

SEQ ID NO: 3187198 - protein, 18 aa, Giardia lamblia
GNLKPTNILLADSGLLSL

SEQ ID NO: 3187199 - protein, 26 aa, Giardia lamblia
GNLLQTAQFILPFDVALKPTHVLLEV

SEQ ID NO: 3187200 - protein, 26 aa, Giardia lamblia
GNNIELIKILLPYEAGIRVLDDKDFI

SEQ ID NO: 3187201 - protein, 19 aa, Giardia lamblia
GNNLELVKLLQAYETSRQN

SEQ ID NO: 3187202 - protein, 35 aa, Giardia lamblia
GNNSKTLLFANISPLPNLLYETLSTLSFAARVKNV

SEQ ID NO: 3187203 - protein, 28 aa, Giardia lamblia
GNPALDLSLSFSLIDAHRFPGGQADSLT

SEQ ID NO: 3187204 - protein, 43 aa, Giardia lamblia
GNPELSKIYKIFQQDSYFVNLSFDLLYSTDAWRAGFNHLKEVI

SEQ ID NO: 3187205 - protein, 26 aa, Giardia lamblia
GNPGHPYYFSCPPFPYSAGSLHSQPP

SEQ ID NO: 3187206 - protein, 20 aa, Giardia lamblia
GNPLPIPKSRYKKLVKEWEA

SEQ ID NO: 3187207 - protein, 31 aa, Giardia lamblia
GNPVSAGMLCNLASLYRAGVLLQENLSPPEG

SEQ ID NO: 3187208 - protein, 28 aa, Giardia lamblia
GNQDMIRLLAPLEGGLRRKDGKLALHLA

SEQ ID NO: 3187209 - protein, 24 aa, Giardia lamblia
GNRPNRLLILPGDPGSKIPYTAQL

SEQ ID NO: 3187210 - protein, 25 aa, Giardia lamblia
GNSKEYLLAGSYKLPFTKQNVRARL

SEQ ID NO: 3187211 - protein, 22 aa, Giardia lamblia
GNSPLIHVLLKYGVEHCQEIFT

SEQ ID NO: 3187212 - protein, 27 aa, Giardia lamblia
GNSWSYHYCRRQWNLDYWGKDGQTTRY

SEQ ID NO: 3187213 - protein, 24 aa, Giardia lamblia
GNTEAVKLLFPREKLMKDAESQTA

SEQ ID NO: 3187214 - protein, 18 aa, Giardia lamblia
GNTGLMCAVLENDPHMVQ

SEQ ID NO: 3187215 - protein, 19 aa, Giardia lamblia
GNTLEFNKLNDDLASRDEE

SEQ ID NO: 3187216 - protein, 23 aa, Giardia lamblia
GNTLLIHAALHGYSYLVYRLISE

SEQ ID NO: 3187217 - protein, 20 aa, Giardia lamblia
GNTLLLHQKFRAGISHHLKT

SEQ ID NO: 3187218 - protein, 17 aa, Giardia lamblia
GNTPLMLAIYNNDISEL

SEQ ID NO: 3187219 - protein, 23 aa, Giardia lamblia
GNVALIYAALDRNKPLISLLCEA

SEQ ID NO: 3187220 - protein, 23 aa, Giardia lamblia
GNVLVYAMAWMCYNSALRCQDML

SEQ ID NO: 3187221 - protein, 21 aa, Giardia lamblia
GNVRELFSRKFLSNVRETEKG

SEQ ID NO: 3187222 - protein, 30 aa, Giardia lamblia
GNVRKHTRYTFKILNFVKPTSMFLEGAGIL

SEQ ID NO: 3187223 - protein, 22 aa, Giardia lamblia
GNYDLINAIISWKTVYLKVTQN

SEQ ID NO: 3187224 - protein, 20 aa, Giardia lamblia
GNYEYVLANLSVYARSRAED

SEQ ID NO: 3187225 - protein, 24 aa, Giardia lamblia
GNYGSQFFLKFVGLFTVLKSSQEI

SEQ ID NO: 3187226 - protein, 22 aa, Giardia lamblia
GNYLASVLFQRSTATPFPHLPA

SEQ ID NO: 3187227 - protein, 20 aa, Giardia lamblia
GNYNSVYRKYGLFICRRCFK

SEQ ID NO: 3187228 - protein, 23 aa, Giardia lamblia
GPAGYIALHKPIIVVGRSADCDI

SEQ ID NO: 3187229 - protein, 24 aa, Giardia lamblia
GPAKSSERPLGLGPSVISRTSQYK

SEQ ID NO: 3187230 - protein, 20 aa, Giardia lamblia
GPAQYYNVPLNSGLQGTGQL

SEQ ID NO: 3187231 - protein, 23 aa, Giardia lamblia
GPARAVYSAIQPLPAHAITCEEI

SEQ ID NO: 3187232 - protein, 28 aa, Giardia lamblia
GPARNGTYIFIGQPLDLYDQVMRLSPDG

SEQ ID NO: 3187233 - protein, 32 aa, Giardia lamblia
GPATVFQYLVSMDFHTLIPLFAENIQLTEADF

SEQ ID NO: 3187234 - protein, 17 aa, Giardia lamblia
GPAVSLLLPRLLNYGTL

SEQ ID NO: 3187235 - protein, 36 aa, Giardia lamblia
GPCNCAQCITFPHLPYKCIPFQQQLYTHRVRTNIHR

SEQ ID NO: 3187236 - protein, 20 aa, Giardia lamblia
GPDWYRCFESFMRENIHTVE

SEQ ID NO: 3187237 - protein, 23 aa, Giardia lamblia
GPEVDAHRISWEKFRLGTSIYSS

SEQ ID NO: 3187238 - protein, 19 aa, Giardia lamblia
GPFFAEGERIKASGGYLHH

SEQ ID NO: 3187239 - protein, 20 aa, Giardia lamblia
GPFISLLEIKGQAPAQGWNM

SEQ ID NO: 3187240 - protein, 25 aa, Giardia lamblia
GPGAPEYCAAPSSLTLHCTVGRDAA

SEQ ID NO: 3187241 - protein, 28 aa, Giardia lamblia
GPGAYAMQSTLGGPASSLAGRTPLHKPE

SEQ ID NO: 3187242 - protein, 33 aa, Giardia lamblia
GPGFLNHPSVPYQWLMYWLPAAGSGQPVMGVPP

SEQ ID NO: 3187243 - protein, 19 aa, Giardia lamblia
GPHYEFIGLAFVDQAVQAF

SEQ ID NO: 3187244 - protein, 25 aa, Giardia lamblia
GPIEETLFIYEFVLSVVLATGTASD

SEQ ID NO: 3187245 - protein, 22 aa, Giardia lamblia
GPLIHIGKFLHPCTNDGYNVAV

SEQ ID NO: 3187246 - protein, 17 aa, Giardia lamblia
GPLSIVALKYSSLPYRA

SEQ ID NO: 3187247 - protein, 23 aa, Giardia lamblia
GPLSTLLFKMIQKDPELFTMPSI

SEQ ID NO: 3187248 - protein, 19 aa, Giardia lamblia
GPNFVETSSLIYLQSRRLK

SEQ ID NO: 3187249 - protein, 25 aa, Giardia lamblia
GPNIVLQTLINHIILLLDSMMNIKD

SEQ ID NO: 3187250 - protein, 19 aa, Giardia lamblia
GPPCQCVMQHRQMPRKDGL

SEQ ID NO: 3187251 - protein, 23 aa, Giardia lamblia
GPPRGTPAWPAACGSVWCPGACE

SEQ ID NO: 3187252 - protein, 21 aa, Giardia lamblia
GPPSHYVVENPLMDPSLQHSA

SEQ ID NO: 3187253 - protein, 19 aa, Giardia lamblia
GPQHISTFCLPRVHGWMSL

SEQ ID NO: 3187254 - protein, 26 aa, Giardia lamblia
GPQTIEYLRRKLLADMQPAGPAFHVP

SEQ ID NO: 3187255 - protein, 18 aa, Giardia lamblia
GPRHNVWLDFLNSALHGN

SEQ ID NO: 3187256 - protein, 36 aa, Giardia lamblia
GPSEPNFRLINMPSLRNLRHFIVHKANLYPVEILAI

SEQ ID NO: 3187257 - protein, 28 aa, Giardia lamblia
GPSMSRSIPELLFYRFSSTKGCNDKLHV

SEQ ID NO: 3187258 - protein, 18 aa, Giardia lamblia
GPSPPPRGRRILCVRLCA

SEQ ID NO: 3187259 - protein, 24 aa, Giardia lamblia
GPTELEFLYHYVYDNYIRVVDAVD

SEQ ID NO: 3187260 - protein, 19 aa, Giardia lamblia
GPTGTVLYLLTAKTLYSVT

SEQ ID NO: 3187261 - protein, 25 aa, Giardia lamblia
GPTSRRYNILPPDAPFTCATLAGEL

SEQ ID NO: 3187262 - protein, 27 aa, Giardia lamblia
GPTYDLFDICIAPYFKDKCRPVTEGNT

SEQ ID NO: 3187263 - protein, 25 aa, Giardia lamblia
GPVCGPLVYGIAWMPAEVYQTGILE

SEQ ID NO: 3187264 - protein, 30 aa, Giardia lamblia
GPVHCINRSPFFGKFFISCADWSCKIWADD

SEQ ID NO: 3187265 - protein, 24 aa, Giardia lamblia
GPVINFLNFGTLKRPVADDSSYSD

SEQ ID NO: 3187266 - protein, 19 aa, Giardia lamblia
GPVLPRCNMNLESELRKLQ

SEQ ID NO: 3187267 - protein, 35 aa, Giardia lamblia
GQALSLNFLDSLGFIMFLCTQKWHKLLTPAGRYIP

SEQ ID NO: 3187268 - protein, 24 aa, Giardia lamblia
GQAPHFHWAVLSVRNFLTAGVQII

SEQ ID NO: 3187269 - protein, 23 aa, Giardia lamblia
GQARVVQMLALDLAGRQLIEEDG

SEQ ID NO: 3187270 - protein, 27 aa, Giardia lamblia
GQDGVFYIDMLYQKKMLSLYQRVYHFE

SEQ ID NO: 3187271 - protein, 21 aa, Giardia lamblia
GQEFLPVQDIKARPLDYSRTK

SEQ ID NO: 3187272 - protein, 24 aa, Giardia lamblia
GQGKALKLLLPHEAKMQSKDGHTA

SEQ ID NO: 3187273 - protein, 25 aa, Giardia lamblia
GQGKPLFPPKLKSTTLTKLMAAARS

SEQ ID NO: 3187274 - protein, 23 aa, Giardia lamblia
GQGPQIRVLTIPQLQAGAVTNQQ

SEQ ID NO: 3187275 - protein, 25 aa, Giardia lamblia
GQGSLAWKGLLVYGSPGSGKTCLAK

SEQ ID NO: 3187276 - protein, 18 aa, Giardia lamblia
GQIMSIQLYNNSMFTICC

SEQ ID NO: 3187277 - protein, 24 aa, Giardia lamblia
GQKDLMLHLNIKVEDLAGISDSQT

SEQ ID NO: 3187278 - protein, 25 aa, Giardia lamblia
GQKECIQALFPFEGSLRNSQGDLLY

SEQ ID NO: 3187279 - protein, 37 aa, Giardia lamblia
GQKQVLAYRKILTLAIEKLLFFKHLITMTRTALPSQV

SEQ ID NO: 3187280 - protein, 23 aa, Giardia lamblia
GQKRVHFLSPIPTQSDDSICLKP

SEQ ID NO: 3187281 - protein, 26 aa, Giardia lamblia
GQLAGWIIKPKDLVTGLPLLALDDET

SEQ ID NO: 3187282 - protein, 18 aa, Giardia lamblia
GQLGIWFRVSIFDMTNRL

SEQ ID NO: 3187283 - protein, 29 aa, Giardia lamblia
GQLLDKGCTIPLVPTLFAVSKNIKPLFLK

SEQ ID NO: 3187284 - protein, 27 aa, Giardia lamblia
GQLPHANFRLILTTDPHPQFPIGLLQK

SEQ ID NO: 3187285 - protein, 21 aa, Giardia lamblia
GQLRAQPIRRQEAAGVTDPST

SEQ ID NO: 3187286 - protein, 18 aa, Giardia lamblia
GQLRDIIQLVLPDATVDV

SEQ ID NO: 3187287 - protein, 24 aa, Giardia lamblia
GQMTTFINFHDCPVRITLNAIGPD

SEQ ID NO: 3187288 - protein, 24 aa, Giardia lamblia
GQPDVAYAIALRTGIRGADSLFQQ

SEQ ID NO: 3187289 - protein, 25 aa, Giardia lamblia
GQPETYGLARDFFKRSMPRSYSASA

SEQ ID NO: 3187290 - protein, 30 aa, Giardia lamblia
GQPQNMHTYQWWYPLNLSTMRAQNKLYDLT

SEQ ID NO: 3187291 - protein, 17 aa, Giardia lamblia
GQQRQLLRGVNARHVRV

SEQ ID NO: 3187292 - protein, 20 aa, Giardia lamblia
GQQVILTDLVDWYGNTRLMQ

SEQ ID NO: 3187293 - protein, 20 aa, Giardia lamblia
GQRANLLLLLLSHAGPAVHE

SEQ ID NO: 3187294 - protein, 19 aa, Giardia lamblia
GQRFQTLCFASLDDFKIAN

SEQ ID NO: 3187295 - protein, 29 aa, Giardia lamblia
GQRIQSWLKSKWMVVKGQILGPLARYDPR

SEQ ID NO: 3187296 - protein, 24 aa, Giardia lamblia
GQRKVLYACFKRNLKTKLKVSQLS

SEQ ID NO: 3187297 - protein, 23 aa, Giardia lamblia
GQRQVLDLGYYTSELRNLITATN

SEQ ID NO: 3187298 - protein, 19 aa, Giardia lamblia
GQRVYSWVYVAPTEDLQMG

SEQ ID NO: 3187299 - protein, 27 aa, Giardia lamblia
GQSSGIPMPYILAQPKDRSPPQQADPI

SEQ ID NO: 3187300 - protein, 25 aa, Giardia lamblia
GQTDGFIVFPVFYKISFTDKREQTD

SEQ ID NO: 3187301 - protein, 17 aa, Giardia lamblia
GQTFILKHIEHPTLMKV

SEQ ID NO: 3187302 - protein, 26 aa, Giardia lamblia
GQTHVKGLLLYGPPGTGKTLTARKIG

SEQ ID NO: 3187303 - protein, 27 aa, Giardia lamblia
GQTHVKGLLLYGPPGTGKTLTARKIGE

SEQ ID NO: 3187304 - protein, 27 aa, Giardia lamblia
GQTQHFFINLNQRPLHNIDSPFPRLRI

SEQ ID NO: 3187305 - protein, 31 aa, Giardia lamblia
GQVCTSYEISYWKMAPATAMMIAAMNGSIDC

SEQ ID NO: 3187306 - protein, 23 aa, Giardia lamblia
GQVDLIVIVIKKQQALISELDVK

SEQ ID NO: 3187307 - protein, 23 aa, Giardia lamblia
GQVIIHMLRYLVVRSVALHYKEF

SEQ ID NO: 3187308 - protein, 22 aa, Giardia lamblia
GQVRRLDWGLKLLLPVLDSSRA

SEQ ID NO: 3187309 - protein, 24 aa, Giardia lamblia
GQYEAFMVDLWRLVHLQDNHLTNI

SEQ ID NO: 3187310 - protein, 30 aa, Giardia lamblia
GQYGRLVTVELAIFPSPRGSDLLLQSLLVR

SEQ ID NO: 3187311 - protein, 18 aa, Giardia lamblia
GRAFGISGPCRAPVRRLT

SEQ ID NO: 3187312 - protein, 18 aa, Giardia lamblia
GRCLYANQTLWWGDDGHA

SEQ ID NO: 3187313 - protein, 18 aa, Giardia lamblia
GRDAAWQCDCPQGDYLTY

SEQ ID NO: 3187314 - protein, 17 aa, Giardia lamblia
GREAGMHDKYGWTALIW

SEQ ID NO: 3187315 - protein, 18 aa, Giardia lamblia
GREDVVPLLLLSEKMMQD

SEQ ID NO: 3187316 - protein, 22 aa, Giardia lamblia
GREEMALLLLEYEKSVLSGAPA

SEQ ID NO: 3187317 - protein, 22 aa, Giardia lamblia
GREIDLYLSITRLPRPIELPTR

SEQ ID NO: 3187318 - protein, 20 aa, Giardia lamblia
GRENLDIVFLAFAEKLRTGR

SEQ ID NO: 3187319 - protein, 22 aa, Giardia lamblia
GREQWLSKIFNLAATYPNKVLC

SEQ ID NO: 3187320 - protein, 21 aa, Giardia lamblia
GRFCILQACLKWAPNSIKLVE

SEQ ID NO: 3187321 - protein, 29 aa, Giardia lamblia
GRFPTVTGIYRKLIDFLVSLECYPRNELI

SEQ ID NO: 3187322 - protein, 19 aa, Giardia lamblia
GRGAYGIAWLAKDTETGAS

SEQ ID NO: 3187323 - protein, 25 aa, Giardia lamblia
GRGKMRNRRYITRKGPLVIYNTEDV

SEQ ID NO: 3187324 - protein, 24 aa, Giardia lamblia
GRGRYALIRDLARQAHRLDHESIT

SEQ ID NO: 3187325 - protein, 20 aa, Giardia lamblia
GRHEVVQLLLPYEGGKQTSE

SEQ ID NO: 3187326 - protein, 30 aa, Giardia lamblia
GRICSYYYVSFRNFCRFISLIKDSVVGRVT

SEQ ID NO: 3187327 - protein, 28 aa, Giardia lamblia
GRINSALQTAFFLLSGVLPPDQAIDIWK

SEQ ID NO: 3187328 - protein, 30 aa, Giardia lamblia
GRIRKSDLLRFLRALGLPFTLKDVADYTSQ

SEQ ID NO: 3187329 - protein, 19 aa, Giardia lamblia
GRISVFQKLLLVRCLREDR

SEQ ID NO: 3187330 - protein, 25 aa, Giardia lamblia
GRKAAKIFIINGPKYHNPSALMLAA

SEQ ID NO: 3187331 - protein, 20 aa, Giardia lamblia
GRLALAHHGWLYESSLPTPR

SEQ ID NO: 3187332 - protein, 17 aa, Giardia lamblia
GRLLLLMQKMKVYNRVA

SEQ ID NO: 3187333 - protein, 22 aa, Giardia lamblia
GRLLPPIIHRDIKPENILVSKD

SEQ ID NO: 3187334 - protein, 23 aa, Giardia lamblia
GRLLPQEVWFGKSIIFSYARLDY

SEQ ID NO: 3187335 - protein, 33 aa, Giardia lamblia
GRLNPDIFTLYAKMLHILGLPRSASIMSELVSI

SEQ ID NO: 3187336 - protein, 30 aa, Giardia lamblia
GRLPSGLLGASIFVALKLLNYGIPIHRISR

SEQ ID NO: 3187337 - protein, 17 aa, Giardia lamblia
GRLRYYLADGLVSLKDL

SEQ ID NO: 3187338 - protein, 24 aa, Giardia lamblia
GRLSSLPKLGIKGGALTLEERERV

SEQ ID NO: 3187339 - protein, 23 aa, Giardia lamblia
GRNMLLCPGFAEFGIDYSSNLCT

SEQ ID NO: 3187340 - protein, 21 aa, Giardia lamblia
GRPIESVIILDNCAASYMFQP

SEQ ID NO: 3187341 - protein, 17 aa, Giardia lamblia
GRPIQKFKTMTSTLLSS

SEQ ID NO: 3187342 - protein, 25 aa, Giardia lamblia
GRQAMNLYYMPTHPGAYIASVIFED

SEQ ID NO: 3187343 - protein, 26 aa, Giardia lamblia
GRRNNLLAAALLYIVGRQHNLSHLLI

SEQ ID NO: 3187344 - protein, 21 aa, Giardia lamblia
GRRRLCVANTSWQPANLAEII

SEQ ID NO: 3187345 - protein, 24 aa, Giardia lamblia
GRSAPPLPELPRLGSTAGVVGAVR

SEQ ID NO: 3187346 - protein, 26 aa, Giardia lamblia
GRSDIYTYLQMALRKQTQKAEEQEVE

SEQ ID NO: 3187347 - protein, 18 aa, Giardia lamblia
GRTALIYAAIDDNIELVA

SEQ ID NO: 3187348 - protein, 17 aa, Giardia lamblia
GRTALMHYAITGGSVSL

SEQ ID NO: 3187349 - protein, 22 aa, Giardia lamblia
GRTALMLAAAANNPEICKILVT

SEQ ID NO: 3187350 - protein, 20 aa, Giardia lamblia
GRTDIIGMSALMWAAHQGHK

SEQ ID NO: 3187351 - protein, 26 aa, Giardia lamblia
GRTICVWCAIWMICKQYRESQVYQCT

SEQ ID NO: 3187352 - protein, 18 aa, Giardia lamblia
GRVDIQLTLFPKSADYDS

SEQ ID NO: 3187353 - protein, 29 aa, Giardia lamblia
GRVISRGLHFSVPFSFKLSKDNSSAFLPL

SEQ ID NO: 3187354 - protein, 27 aa, Giardia lamblia
GRVLAVYNLHSFLKLLQMGNGHVSGAA

SEQ ID NO: 3187355 - protein, 26 aa, Giardia lamblia
GRVLYHEAGYLPLRTFSLAMVQMASN

SEQ ID NO: 3187356 - protein, 25 aa, Giardia lamblia
GRVLYHINLAIQVRLPYTSSHVLAL

SEQ ID NO: 3187357 - protein, 19 aa, Giardia lamblia
GRVPVLGETTWPIYYAFNN

SEQ ID NO: 3187358 - protein, 22 aa, Giardia lamblia
GRVYHLFIRPGEAANRVLTVGD

SEQ ID NO: 3187359 - protein, 28 aa, Giardia lamblia
GRWQQEAFHGTHLPGWRGDPRAGPVPLH

SEQ ID NO: 3187360 - protein, 19 aa, Giardia lamblia
GRWVAKNKGYLQIISVEES

SEQ ID NO: 3187361 - protein, 24 aa, Giardia lamblia
GRWVLLANVHLTPSFFSVLEQLVE

SEQ ID NO: 3187362 - protein, 19 aa, Giardia lamblia
GRYCYDSRMALIIAAEKHY

SEQ ID NO: 3187363 - protein, 25 aa, Giardia lamblia
GRYRNFSYTPFVDNLLLVSKTHDRT

SEQ ID NO: 3187364 - protein, 25 aa, Giardia lamblia
GSACTTLFWIPLGPSAPLQKTGPRE

SEQ ID NO: 3187365 - protein, 26 aa, Giardia lamblia
GSADRAPFSQIFLGSIPGQGSTYPRD

SEQ ID NO: 3187366 - protein, 21 aa, Giardia lamblia
GSANLYNHLLRTCCRTCLNRC

SEQ ID NO: 3187367 - protein, 26 aa, Giardia lamblia
GSAQHAYFLLPCRHVVYSDKEDFTFD

SEQ ID NO: 3187368 - protein, 26 aa, Giardia lamblia
GSASAPQLPLTLPIREADDSKEHINV

SEQ ID NO: 3187369 - protein, 18 aa, Giardia lamblia
GSATHQFLPRSKSAIQFT

SEQ ID NO: 3187370 - protein, 19 aa, Giardia lamblia
GSDAFLIINICRTTAYYTM

SEQ ID NO: 3187371 - protein, 19 aa, Giardia lamblia
GSDLYSTLFSACEAAPNLT

SEQ ID NO: 3187372 - protein, 18 aa, Giardia lamblia
GSDPMLTVYIAKVSLHFS

SEQ ID NO: 3187373 - protein, 24 aa, Giardia lamblia
GSDPYTILNKLDPLVFKSLSTRQQ

SEQ ID NO: 3187374 - protein, 23 aa, Giardia lamblia
GSDSAISPIWKGAVKGIASFMNS

SEQ ID NO: 3187375 - protein, 19 aa, Giardia lamblia
GSDSFVDCLVPCSLGSVPA

SEQ ID NO: 3187376 - protein, 48 aa, Giardia lamblia
GSDTNFYRGYYQLAQAYFVAGLFEEALVYYYRAYRKRPDIQEYRLGVQ

SEQ ID NO: 3187377 - protein, 33 aa, Giardia lamblia
GSEAKIQTAWGTTALMWACQFGHIDCVRMLIPK

SEQ ID NO: 3187378 - protein, 26 aa, Giardia lamblia
GSEKQSHLPRWTFALYQHQEVDDSTS

SEQ ID NO: 3187379 - protein, 17 aa, Giardia lamblia
GSELAAFSLLNRTLTDL

SEQ ID NO: 3187380 - protein, 27 aa, Giardia lamblia
GSEVMLKFFELLPSYLALDGHCVTVAI

SEQ ID NO: 3187381 - protein, 23 aa, Giardia lamblia
GSFAELCRFIFRATRRHPVVLID

SEQ ID NO: 3187382 - protein, 24 aa, Giardia lamblia
GSFGPERLCLLSASVYRELEAYPF

SEQ ID NO: 3187383 - protein, 30 aa, Giardia lamblia
GSFILAIPSIRRFIRLLSELCLHLGIPNYA

SEQ ID NO: 3187384 - protein, 17 aa, Giardia lamblia
GSFTLSRTPVDPGPMLA

SEQ ID NO: 3187385 - protein, 26 aa, Giardia lamblia
GSGCDFIRSVLAPSFQQYFEGLTGSG

SEQ ID NO: 3187386 - protein, 23 aa, Giardia lamblia
GSGFAFLVLATHSDAVALVSSVK

SEQ ID NO: 3187387 - protein, 23 aa, Giardia lamblia
GSGIPWTAQVPVNLYLSKSRADE

SEQ ID NO: 3187388 - protein, 29 aa, Giardia lamblia
GSGKSRVLTALLLLLLEALPEATDSWVFR

SEQ ID NO: 3187389 - protein, 28 aa, Giardia lamblia
GSGKTLAFLLPVLTKLFTDYQQRGPSSF

SEQ ID NO: 3187390 - protein, 38 aa, Giardia lamblia
GSGKTLAFLVPLIIHMQRVRLMWPDDPNLQSTCYALVL

SEQ ID NO: 3187391 - protein, 21 aa, Giardia lamblia
GSGLPDYDILLSAAADGRIVE

SEQ ID NO: 3187392 - protein, 24 aa, Giardia lamblia
GSGTSVISLLIPPGEQLSSVTGML

SEQ ID NO: 3187393 - protein, 26 aa, Giardia lamblia
GSHIKGLLINLFDTYWNGLARSNKFL

SEQ ID NO: 3187394 - protein, 32 aa, Giardia lamblia
GSHRTHRLVLLYPARDIPWPIRSLSAERCGAA

SEQ ID NO: 3187395 - protein, 21 aa, Giardia lamblia
GSICNFFFNIVRQCLRINPVG

SEQ ID NO: 3187396 - protein, 33 aa, Giardia lamblia
GSIDKLLSELARFLYYSFKTHLLDNPSASAVLD

SEQ ID NO: 3187397 - protein, 23 aa, Giardia lamblia
GSIEFIHVCADRYVIIGGTDGLI

SEQ ID NO: 3187398 - protein, 17 aa, Giardia lamblia
GSILKRIQQLMRLVLRI

SEQ ID NO: 3187399 - protein, 24 aa, Giardia lamblia
GSIQLLFDAPPPGTIKIIFATNVA

SEQ ID NO: 3187400 - protein, 33 aa, Giardia lamblia
GSKLLGCCILPESYYLLAYTSTGLMALYCIQNC

SEQ ID NO: 3187401 - protein, 33 aa, Giardia lamblia
GSKVLIKYRHDLLMFLYIGQQRLKLTKIFLDVD

SEQ ID NO: 3187402 - protein, 25 aa, Giardia lamblia
GSLEKYYSLGPLLVKIEELSFGTST

SEQ ID NO: 3187403 - protein, 17 aa, Giardia lamblia
GSLESLAILIRFEALHY

SEQ ID NO: 3187404 - protein, 21 aa, Giardia lamblia
GSLGRILAAVGLLQNFAALQA

SEQ ID NO: 3187405 - protein, 27 aa, Giardia lamblia
GSLIANAEQQLFQLRNMYIEAVEQRNY

SEQ ID NO: 3187406 - protein, 25 aa, Giardia lamblia
GSLKAVLDKIPQLTPFTPKAVEGAP

SEQ ID NO: 3187407 - protein, 27 aa, Giardia lamblia
GSLLDRPLVVATPGRLRYYLADGLVSL

SEQ ID NO: 3187408 - protein, 26 aa, Giardia lamblia
GSLNALELLLPYLADCRDHQHQTALT

SEQ ID NO: 3187409 - protein, 21 aa, Giardia lamblia
GSLTKLRPPTPPRKLEELAAE

SEQ ID NO: 3187410 - protein, 32 aa, Giardia lamblia
GSLYRDRHWLWAVFPELFPLPPHYKGDLDTET

SEQ ID NO: 3187411 - protein, 28 aa, Giardia lamblia
GSMSLLAKLDFLLKCKQILSANGIAYTG

SEQ ID NO: 3187412 - protein, 26 aa, Giardia lamblia
GSNPTVLRFSGFRGITELALSKVGSL

SEQ ID NO: 3187413 - protein, 24 aa, Giardia lamblia
GSNPYAYAYGLPEDNAYNDPQELH

SEQ ID NO: 3187414 - protein, 21 aa, Giardia lamblia
GSPDSLLYRLPSPVLNERTRS

SEQ ID NO: 3187415 - protein, 21 aa, Giardia lamblia
GSPGYKLLSLILLKSQGKSVA

SEQ ID NO: 3187416 - protein, 25 aa, Giardia lamblia
GSPKDALLLLDKLASRYEKQYGERS

SEQ ID NO: 3187417 - protein, 17 aa, Giardia lamblia
GSPTFVAYVLLYEYTAI

SEQ ID NO: 3187418 - protein, 20 aa, Giardia lamblia
GSQFLLLSDTLFSYGGGEKA

SEQ ID NO: 3187419 - protein, 35 aa, Giardia lamblia
GSRHDLTVLLLSLRNLTLRLFTLVNAARTLCQKPI

SEQ ID NO: 3187420 - protein, 20 aa, Giardia lamblia
GSRIFVNRSVSPMLSSSLDE

SEQ ID NO: 3187421 - protein, 23 aa, Giardia lamblia
GSRPPMAYIPNNLANLMEFLRGD

SEQ ID NO: 3187422 - protein, 23 aa, Giardia lamblia
GSRYKFIDTGLNPAYFNPGVENP

SEQ ID NO: 3187423 - protein, 33 aa, Giardia lamblia
GSSALMIAIVRRNFKLAKYIIDWLRDRRKDSKK

SEQ ID NO: 3187424 - protein, 18 aa, Giardia lamblia
GSSCISFFRSRGLSVACF

SEQ ID NO: 3187425 - protein, 17 aa, Giardia lamblia
GSSFFMLTAHNSPFCSV

SEQ ID NO: 3187426 - protein, 19 aa, Giardia lamblia
GSSFRPLTTSLTSMAPPST

SEQ ID NO: 3187427 - protein, 29 aa, Giardia lamblia
GSSFYELGTRLWYQMLTRSFSETLGNERD

SEQ ID NO: 3187428 - protein, 26 aa, Giardia lamblia
GSSIRLPLKYQWLNREVPTEITGCTA

SEQ ID NO: 3187429 - protein, 22 aa, Giardia lamblia
GSSITPALPPLGSTGSVQPGQP

SEQ ID NO: 3187430 - protein, 17 aa, Giardia lamblia
GSSLADIAILVVDLMHG

SEQ ID NO: 3187431 - protein, 25 aa, Giardia lamblia
GSSMPLSFDLMSPLYFQGANDEIHQ

SEQ ID NO: 3187432 - protein, 24 aa, Giardia lamblia
GSSNMSPAYLLFPDLKAIGMDGCI

SEQ ID NO: 3187433 - protein, 24 aa, Giardia lamblia
GSSPIIEHSLDLQFAPLTRATIEA

SEQ ID NO: 3187434 - protein, 25 aa, Giardia lamblia
GSSPSLLQPLLKGIKEKAKAIGKIS

SEQ ID NO: 3187435 - protein, 23 aa, Giardia lamblia
GSTALCFAAVLGYRDIAEILLPY

SEQ ID NO: 3187436 - protein, 29 aa, Giardia lamblia
GSTNFTPVHRTWLGRLLIRAQRSAEAFDL

SEQ ID NO: 3187437 - protein, 25 aa, Giardia lamblia
GSTRGLLNSVKPLVPLGPRVCTEER

SEQ ID NO: 3187438 - protein, 20 aa, Giardia lamblia
GSVDIVQLLLDLEKGKSYFS

SEQ ID NO: 3187439 - protein, 17 aa, Giardia lamblia
GSVPKLPTLTRTPPART

SEQ ID NO: 3187440 - protein, 19 aa, Giardia lamblia
GSVTTYGWTALCFAVMNHH

SEQ ID NO: 3187441 - protein, 20 aa, Giardia lamblia
GSYCIMGFTPDMRGYIIDGK

SEQ ID NO: 3187442 - protein, 20 aa, Giardia lamblia
GSYFLQLERYEEAALLSFFE

SEQ ID NO: 3187443 - protein, 29 aa, Giardia lamblia
GSYLSYVSDNYIFYGFPRSQEVNIDIYRR

SEQ ID NO: 3187444 - protein, 26 aa, Giardia lamblia
GSYSFHSLIAYLRYYHNHISLEGSLH

SEQ ID NO: 3187445 - protein, 31 aa, Giardia lamblia
GSYVTGGVYIFPCGSRWIGGFLGCEMHGEGH

SEQ ID NO: 3187446 - protein, 18 aa, Giardia lamblia
GTALMRAAMNGHLGAVRL

SEQ ID NO: 3187447 - protein, 25 aa, Giardia lamblia
GTARAWLCGVIARLAKERDNSIVLL

SEQ ID NO: 3187448 - protein, 26 aa, Giardia lamblia
GTAVDTLLTEVERWFRDAELDIKNIV

SEQ ID NO: 3187449 - protein, 24 aa, Giardia lamblia
GTAVLFVDGFPRSDDQARAYLLHF

SEQ ID NO: 3187450 - protein, 19 aa, Giardia lamblia
GTCCFFVMYGLGTISAMYQ

SEQ ID NO: 3187451 - protein, 19 aa, Giardia lamblia
GTCIFLYPKYVAENEMLIN

SEQ ID NO: 3187452 - protein, 24 aa, Giardia lamblia
GTDGNITTLLRPVSYSSSEDDFLL

SEQ ID NO: 3187453 - protein, 21 aa, Giardia lamblia
GTDLLEAKYLLNLDSEDLGVV

SEQ ID NO: 3187454 - protein, 21 aa, Giardia lamblia
GTDLLSLLREKLNGPLEKLIL

SEQ ID NO: 3187455 - protein, 33 aa, Giardia lamblia
GTDYYSLYCAHFALLGMHKLAAYLVNCACNDKG

SEQ ID NO: 3187456 - protein, 32 aa, Giardia lamblia
GTELDHYERLFAKPWLFPHLGEDLDTDGALYT

SEQ ID NO: 3187457 - protein, 26 aa, Giardia lamblia
GTEPYTQPIIIPISTPTGRGDAITAK

SEQ ID NO: 3187458 - protein, 26 aa, Giardia lamblia
GTESALIHILFRDYGIEPCRAFIDNC

SEQ ID NO: 3187459 - protein, 25 aa, Giardia lamblia
GTETGVLLIYHSFSMQLVRSLKVDE

SEQ ID NO: 3187460 - protein, 22 aa, Giardia lamblia
GTEYDVAVLQSALTVADDIIND

SEQ ID NO: 3187461 - protein, 29 aa, Giardia lamblia
GTFDKVLLKNIWYFFEDRIVQFEQKTSNA

SEQ ID NO: 3187462 - protein, 21 aa, Giardia lamblia
GTFLSLWDLRYNCRPVTSANM

SEQ ID NO: 3187463 - protein, 27 aa, Giardia lamblia
GTFRLLDNVILSSTIFGTLGFCPPEVL

SEQ ID NO: 3187464 - protein, 24 aa, Giardia lamblia
GTGKTGSFLIPILQMVNPAKDHIQ

SEQ ID NO: 3187465 - protein, 22 aa, Giardia lamblia
GTGLLLLCLRGGCPQATVLPVS

SEQ ID NO: 3187466 - protein, 28 aa, Giardia lamblia
GTGSYESTLLILWKIDRPKDPAAGPEAE

SEQ ID NO: 3187467 - protein, 17 aa, Giardia lamblia
GTHIWRIPQSSAPFLLS

SEQ ID NO: 3187468 - protein, 31 aa, Giardia lamblia
GTHSLEVIIYLFLLKIKYPKSIYLLRGNHED

SEQ ID NO: 3187469 - protein, 21 aa, Giardia lamblia
GTISNVLLATESFWRGLHIDT

SEQ ID NO: 3187470 - protein, 24 aa, Giardia lamblia
GTKDRCMRPLYSTNLQQQKLPRSR

SEQ ID NO: 3187471 - protein, 28 aa, Giardia lamblia
GTKIQLELLYLFPWLKSAHITEDLLIDT

SEQ ID NO: 3187472 - protein, 23 aa, Giardia lamblia
GTLAPLPSALPPQQHYYSEDAVS

SEQ ID NO: 3187473 - protein, 40 aa, Giardia lamblia
GTLHSKVSLYQILLRKLGKPALDFLPVTYILTVPHERDKF

SEQ ID NO: 3187474 - protein, 17 aa, Giardia lamblia
GTMLYRTGDTYSGTWFN

SEQ ID NO: 3187475 - protein, 25 aa, Giardia lamblia
GTNDFFIDTPPLSEPLRVGRTHDVA

SEQ ID NO: 3187476 - protein, 21 aa, Giardia lamblia
GTNKLFALKYIDLKMSTEKAR

SEQ ID NO: 3187477 - protein, 32 aa, Giardia lamblia
GTNRGFRVFNTVPFRPLYGRDFPDGCSVVAML

SEQ ID NO: 3187478 - protein, 17 aa, Giardia lamblia
GTNYYGLFSIFCPPSSA

SEQ ID NO: 3187479 - protein, 19 aa, Giardia lamblia
GTPFLGRAPPPLVATTKEY

SEQ ID NO: 3187480 - protein, 22 aa, Giardia lamblia
GTPGAFLFDKDGKLIWHGVPSS

SEQ ID NO: 3187481 - protein, 29 aa, Giardia lamblia
GTPHQVSFKSWFNFCIFSPSSQPISEQLL

SEQ ID NO: 3187482 - protein, 26 aa, Giardia lamblia
GTPIVSRYSSICRTPLSFKSIRSLGS

SEQ ID NO: 3187483 - protein, 17 aa, Giardia lamblia
GTPSFGFSIKPLNFESL

SEQ ID NO: 3187484 - protein, 27 aa, Giardia lamblia
GTPYRIALIIMSAKCIALSLTEGRYIC

SEQ ID NO: 3187485 - protein, 25 aa, Giardia lamblia
GTQVPPCMVPLPNTISPIYVVPEHQ

SEQ ID NO: 3187486 - protein, 25 aa, Giardia lamblia
GTRALSNYLFTNGIWHPIVTSSYDV

SEQ ID NO: 3187487 - protein, 26 aa, Giardia lamblia
GTRDSILVLAPLEAGLRDLDGKLAID

SEQ ID NO: 3187488 - protein, 23 aa, Giardia lamblia
GTRFCVPDYYKVTKALGAGAYGV

SEQ ID NO: 3187489 - protein, 22 aa, Giardia lamblia
GTRFIEFLQKCVFDMAPFTKDE

SEQ ID NO: 3187490 - protein, 25 aa, Giardia lamblia
GTSDPSGLVIKPAARQHFDGAGGQA

SEQ ID NO: 3187491 - protein, 28 aa, Giardia lamblia
GTSEYKLALYKATNIIKFFTMRRDELLR

SEQ ID NO: 3187492 - protein, 22 aa, Giardia lamblia
GTSFYSNCYPAGSAAIAGLWTD

SEQ ID NO: 3187493 - protein, 26 aa, Giardia lamblia
GTSRLQIPRLYWYDHANGRMFVDGFN

SEQ ID NO: 3187494 - protein, 18 aa, Giardia lamblia
GTTALMLAAIYDNKEAVE

SEQ ID NO: 3187495 - protein, 24 aa, Giardia lamblia
GTTALMLAVILRNHPIAEVLMPFE

SEQ ID NO: 3187496 - protein, 35 aa, Giardia lamblia
GTTALMLAVKFMNIPAIEILYPMEYKLIDKENRTA

SEQ ID NO: 3187497 - protein, 17 aa, Giardia lamblia
GTTALMYAARRGKLESV

SEQ ID NO: 3187498 - protein, 22 aa, Giardia lamblia
GTTCLFVALKNKCSFSYKYLIS

SEQ ID NO: 3187499 - protein, 27 aa, Giardia lamblia
GTTGLMLAAQYGLSEAVPLLVPTEATM

SEQ ID NO: 3187500 - protein, 23 aa, Giardia lamblia
GTTMRIIKLPAGPTLTFRLKDYS

SEQ ID NO: 3187501 - protein, 30 aa, Giardia lamblia
GTTNDLGRSFKPYPKFSALSDHLSAPLYEK

SEQ ID NO: 3187502 - protein, 26 aa, Giardia lamblia
GTVAVNWLQLYELDFPSILASDATDE

SEQ ID NO: 3187503 - protein, 24 aa, Giardia lamblia
GTVLTYLAALIPASLTVPALVATL

SEQ ID NO: 3187504 - protein, 21 aa, Giardia lamblia
GTVPIYCKLINYSPITKAEVS

SEQ ID NO: 3187505 - protein, 21 aa, Giardia lamblia
GTVQVWHLLGLGSAATRDNPT

SEQ ID NO: 3187506 - protein, 17 aa, Giardia lamblia
GTVTFEIWFSSYGGSNS

SEQ ID NO: 3187507 - protein, 20 aa, Giardia lamblia
GTVVHLPKFLTLESVENSNT

SEQ ID NO: 3187508 - protein, 22 aa, Giardia lamblia
GTYVKLLQYNILLSCLHYVVIS

SEQ ID NO: 3187509 - protein, 29 aa, Giardia lamblia
GVAAPGIILREYWIVTSPAVEVSLLSLED

SEQ ID NO: 3187510 - protein, 19 aa, Giardia lamblia
GVALPAIRGLNALVGGLED

SEQ ID NO: 3187511 - protein, 18 aa, Giardia lamblia
GVALPMSLWKPDEKEKIM

SEQ ID NO: 3187512 - protein, 20 aa, Giardia lamblia
GVALTYLRTGAASGVAAKHL

SEQ ID NO: 3187513 - protein, 21 aa, Giardia lamblia
GVDAFGQNTLVLAACKLATEF

SEQ ID NO: 3187514 - protein, 31 aa, Giardia lamblia
GVDAGKLYADLWLFDLQENKWHSVTITGLAP

SEQ ID NO: 3187515 - protein, 24 aa, Giardia lamblia
GVEQSYVLWILDLQPESSECVLNW

SEQ ID NO: 3187516 - protein, 21 aa, Giardia lamblia
GVESTFLLDLFESVIQDEARL

SEQ ID NO: 3187517 - protein, 27 aa, Giardia lamblia
GVETLAPYLLLLSIPHAEPQLLEELRR

SEQ ID NO: 3187518 - protein, 29 aa, Giardia lamblia
GVETYMVIPRLFHYLTPKKSFVCTEHSQT

SEQ ID NO: 3187519 - protein, 26 aa, Giardia lamblia
GVFDDVPLIFFVHGAGFSGLSFGPLV

SEQ ID NO: 3187520 - protein, 21 aa, Giardia lamblia
GVFIIAPERIYLKKNEKRAFI

SEQ ID NO: 3187521 - protein, 25 aa, Giardia lamblia
GVFKSSVTPCLIHRLSPSHASSARQ

SEQ ID NO: 3187522 - protein, 18 aa, Giardia lamblia
GVFPPFAIIRAVAHIEHK

SEQ ID NO: 3187523 - protein, 26 aa, Giardia lamblia
GVGKSALLLRLCDKIFNASYITTIGV

SEQ ID NO: 3187524 - protein, 26 aa, Giardia lamblia
GVGRAQLSPLILLQIENIKLKKQLND

SEQ ID NO: 3187525 - protein, 18 aa, Giardia lamblia
GVHFKANAVFKKHVLRPN

SEQ ID NO: 3187526 - protein, 26 aa, Giardia lamblia
GVIGKFLTILYVLNNKQAILPPLGTT

SEQ ID NO: 3187527 - protein, 23 aa, Giardia lamblia
GVIKFLNCYFSSVLILFTHVNTS

SEQ ID NO: 3187528 - protein, 25 aa, Giardia lamblia
GVIKNLKVLQSIHGILRILNAVADQ

SEQ ID NO: 3187529 - protein, 27 aa, Giardia lamblia
GVILSVMKQLAAALAYLHGLSGVGANG

SEQ ID NO: 3187530 - protein, 23 aa, Giardia lamblia
GVILSVMKQLTAALAYLHSVNGA

SEQ ID NO: 3187531 - protein, 27 aa, Giardia lamblia
GVIRTYLRDYVQCNACLSYNTLLSRDG

SEQ ID NO: 3187532 - protein, 22 aa, Giardia lamblia
GVKIDRWRMTGGTALMTAAEYG

SEQ ID NO: 3187533 - protein, 18 aa, Giardia lamblia
GVKRLRWEKNSCSSLFPR

SEQ ID NO: 3187534 - protein, 31 aa, Giardia lamblia
GVMLSNLMAIVFPQGTWYTLSPDEFALTNMR

SEQ ID NO: 3187535 - protein, 24 aa, Giardia lamblia
GVNIRLLDPPLHEFLPHTRDLQKK

SEQ ID NO: 3187536 - protein, 26 aa, Giardia lamblia
GVNLGDIVILYPAQNLPYHKRIKVIP

SEQ ID NO: 3187537 - protein, 25 aa, Giardia lamblia
GVNQYIPTCIFIKKVYRNSANFARQ

SEQ ID NO: 3187538 - protein, 24 aa, Giardia lamblia
GVNRDPTWGPMIMVGQGGIYANYI

SEQ ID NO: 3187539 - protein, 26 aa, Giardia lamblia
GVPDLLAVLVGFTQLLMEDKIAVHYS

SEQ ID NO: 3187540 - protein, 26 aa, Giardia lamblia
GVPLPPPLENAWYFRFTSAGDLKTPM

SEQ ID NO: 3187541 - protein, 33 aa, Giardia lamblia
GVQRLPIYINISSLPDKLLHVSLLEYTHELARG

SEQ ID NO: 3187542 - protein, 25 aa, Giardia lamblia
GVRGVGWPALILAAQCGRSGIRSND

SEQ ID NO: 3187543 - protein, 28 aa, Giardia lamblia
GVRSASIKFWLCRFCGAYNSKLNLFLPG

SEQ ID NO: 3187544 - protein, 17 aa, Giardia lamblia
GVSAASPAFYKTKSMRL

SEQ ID NO: 3187545 - protein, 25 aa, Giardia lamblia
GVSGRKQLFCIPTNELQEMGTVLDK

SEQ ID NO: 3187546 - protein, 20 aa, Giardia lamblia
GVSKTFIKNLVREVLDEMGI

SEQ ID NO: 3187547 - protein, 20 aa, Giardia lamblia
GVSNELFNFVLNLRSKKRDY

SEQ ID NO: 3187548 - protein, 25 aa, Giardia lamblia
GVSQFYFDRVIILEFSRYNSDLKRY

SEQ ID NO: 3187549 - protein, 24 aa, Giardia lamblia
GVSRSQVYRIIRLKGIKPNNRDEN

SEQ ID NO: 3187550 - protein, 18 aa, Giardia lamblia
GVTDLMFYAQTGNLDALL

SEQ ID NO: 3187551 - protein, 19 aa, Giardia lamblia
GVTLITLTIRNQCRHSIVS

SEQ ID NO: 3187552 - protein, 26 aa, Giardia lamblia
GVTPLTIVVPLLFEKGVMVSSYNPIC

SEQ ID NO: 3187553 - protein, 24 aa, Giardia lamblia
GVTSCIIIAPHLRKLRKKDLGLPN

SEQ ID NO: 3187554 - protein, 28 aa, Giardia lamblia
GVTYGFEYKMRLAYAHFPIAATVVDNNK

SEQ ID NO: 3187555 - protein, 26 aa, Giardia lamblia
GVVAPLAAYIWVKESSSAFAPIIRRV

SEQ ID NO: 3187556 - protein, 22 aa, Giardia lamblia
GVVQLGPFRLLPDFEDDFDNLQ

SEQ ID NO: 3187557 - protein, 23 aa, Giardia lamblia
GVVTFKNPFLTSSLLRFEYENSP

SEQ ID NO: 3187558 - protein, 28 aa, Giardia lamblia
GVVYSSWSLFHTLFIFLAAVTGSVHDDL

SEQ ID NO: 3187559 - protein, 26 aa, Giardia lamblia
GVYGDAIKLLWEPVTVPLLSMDDYQG

SEQ ID NO: 3187560 - protein, 33 aa, Giardia lamblia
GVYIEQISFLLGLKNQYLLSYDKLTSGIATGRF

SEQ ID NO: 3187561 - protein, 18 aa, Giardia lamblia
GWEPISVLPNMAIISIGF

SEQ ID NO: 3187562 - protein, 19 aa, Giardia lamblia
GWNPLMHSIIRQNMHEFNK

SEQ ID NO: 3187563 - protein, 28 aa, Giardia lamblia
GWNTRGLLQFIMKARKLAIEAFALTCLF

SEQ ID NO: 3187564 - protein, 19 aa, Giardia lamblia
GWPRRRIAISSTANFLAQT

SEQ ID NO: 3187565 - protein, 18 aa, Giardia lamblia
GWTALMRAAENGHTACIK

SEQ ID NO: 3187566 - protein, 23 aa, Giardia lamblia
GWYLAGTKLFIDIYTPELTEGEI

SEQ ID NO: 3187567 - protein, 17 aa, Giardia lamblia
GYAWIIREAAVMLVQSI

SEQ ID NO: 3187568 - protein, 23 aa, Giardia lamblia
GYCVSLWCPKMKVGIPRYRIVST

SEQ ID NO: 3187569 - protein, 24 aa, Giardia lamblia
GYEFSLSIAIPHKTLVPRTEWIQD

SEQ ID NO: 3187570 - protein, 22 aa, Giardia lamblia
GYEPRFKRWIRERFDNSLSRRS

SEQ ID NO: 3187571 - protein, 21 aa, Giardia lamblia
GYERRIADLKVEQSRLLAEIN

SEQ ID NO: 3187572 - protein, 25 aa, Giardia lamblia
GYETHSWTPLMRAALTGDTKTVRKH

SEQ ID NO: 3187573 - protein, 20 aa, Giardia lamblia
GYFMSYPDIVMSDTTSLFGS

SEQ ID NO: 3187574 - protein, 17 aa, Giardia lamblia
GYGMKLFNKVFDAKEQG

SEQ ID NO: 3187575 - protein, 21 aa, Giardia lamblia
GYIPQSDLWSLGATLYACCTG

SEQ ID NO: 3187576 - protein, 27 aa, Giardia lamblia
GYISEDGFILAVISLVGHPPIQDFLLQ

SEQ ID NO: 3187577 - protein, 20 aa, Giardia lamblia
GYKHALAQQYYTKGKRPPSC

SEQ ID NO: 3187578 - protein, 20 aa, Giardia lamblia
GYLAAWPSVGDPYQLIAYPN

SEQ ID NO: 3187579 - protein, 20 aa, Giardia lamblia
GYLHGLSSHFNRYQLIKAAV

SEQ ID NO: 3187580 - protein, 19 aa, Giardia lamblia
GYLMDWACAVTDLCKAYLY

SEQ ID NO: 3187581 - protein, 34 aa, Giardia lamblia
GYLPRRLSMKHALLIYLTLLPDCSVRAFVCSFLQ

SEQ ID NO: 3187582 - protein, 20 aa, Giardia lamblia
GYLSLVRLYRDILLQQRHKI

SEQ ID NO: 3187583 - protein, 23 aa, Giardia lamblia
GYMIQSTIGKAPAFSLRGRHKES

SEQ ID NO: 3187584 - protein, 25 aa, Giardia lamblia
GYNGRFNYFQLLDKINVHAIPGTRR

SEQ ID NO: 3187585 - protein, 21 aa, Giardia lamblia
GYNLFKYEFDVDKDSLMPSLL

SEQ ID NO: 3187586 - protein, 18 aa, Giardia lamblia
GYNYTLFAYGQTGSGKSY

SEQ ID NO: 3187587 - protein, 20 aa, Giardia lamblia
GYNYTLFAYGQTGSGKSYSM

SEQ ID NO: 3187588 - protein, 18 aa, Giardia lamblia
GYPTALMRAAMENKVDQA

SEQ ID NO: 3187589 - protein, 23 aa, Giardia lamblia
GYQWMQRRLKHAELFFDCVRLDH

SEQ ID NO: 3187590 - protein, 24 aa, Giardia lamblia
GYRPEAFPKERHCLSRGSRSSSSH

SEQ ID NO: 3187591 - protein, 17 aa, Giardia lamblia
GYSHHGAECLACDVANL

SEQ ID NO: 3187592 - protein, 17 aa, Giardia lamblia
GYSREFADLIRRMLCID

SEQ ID NO: 3187593 - protein, 22 aa, Giardia lamblia
GYSRVKLRVPIPINEDPRCLDV

SEQ ID NO: 3187594 - protein, 22 aa, Giardia lamblia
GYSYLYSDDFPITSFPSLDLEV

SEQ ID NO: 3187595 - protein, 23 aa, Giardia lamblia
GYTKVCSLLVESEKRMMTSKGLT

SEQ ID NO: 3187596 - protein, 17 aa, Giardia lamblia
GYTPLIIAAANGSTRVI

SEQ ID NO: 3187597 - protein, 23 aa, Giardia lamblia
GYVLRLYILSTVESTLLALDNIT

SEQ ID NO: 3187598 - protein, 18 aa, Giardia lamblia
GYVLWPENLLLNLYEDIE

SEQ ID NO: 3187599 - protein, 20 aa, Giardia lamblia
GYYVDSDACLLFFDVTNRVT

SEQ ID NO: 3187600 - protein, 33 aa, Giardia lamblia
HAACLVRWNHKDYLYIYGGIDGTRYLSDFWRCD

SEQ ID NO: 3187601 - protein, 23 aa, Giardia lamblia
HAACNYLPISDGCRLLISAEACC

SEQ ID NO: 3187602 - protein, 18 aa, Giardia lamblia
HAALKLKRRLREVFPDTV

SEQ ID NO: 3187603 - protein, 18 aa, Giardia lamblia
HAALYFSSLGIPTSLIAD

SEQ ID NO: 3187604 - protein, 19 aa, Giardia lamblia
HAAQIQGFFPSSIPFDHID

SEQ ID NO: 3187605 - protein, 23 aa, Giardia lamblia
HAARPFFAGLCKFLSSGPVCAMV

SEQ ID NO: 3187606 - protein, 24 aa, Giardia lamblia
HAAYTKALFLLNHALDINPLHGDA

SEQ ID NO: 3187607 - protein, 22 aa, Giardia lamblia
HADAWQTGVMLFHSLTGLVRRT

SEQ ID NO: 3187608 - protein, 31 aa, Giardia lamblia
HADIALLLREHEAPSWTPLMCAAFTGDVTMV

SEQ ID NO: 3187609 - protein, 27 aa, Giardia lamblia
HAEDQILFFLMRIEAELRLGLFQQARE

SEQ ID NO: 3187610 - protein, 21 aa, Giardia lamblia
HAELYTLPHGLEKLVNRLSAG

SEQ ID NO: 3187611 - protein, 21 aa, Giardia lamblia
HAGETPLLYALKSGDKRLATI

SEQ ID NO: 3187612 - protein, 27 aa, Giardia lamblia
HAGVWKMYMELFDQLPLVAIIDERIFC

SEQ ID NO: 3187613 - protein, 24 aa, Giardia lamblia
HAIELRDIVASLKRLRELSSDYEL

SEQ ID NO: 3187614 - protein, 26 aa, Giardia lamblia
HAISHDFLSVVEPLLRVSPPLATEKD

SEQ ID NO: 3187615 - protein, 20 aa, Giardia lamblia
HAKAIKRLLPYNKRVWDHEN

SEQ ID NO: 3187616 - protein, 23 aa, Giardia lamblia
HAKAMFISFNYALLNNGKTYLRM

SEQ ID NO: 3187617 - protein, 24 aa, Giardia lamblia
HAKLALRPYYGRKQPRPATPPDQW

SEQ ID NO: 3187618 - protein, 21 aa, Giardia lamblia
HAKRDYSLELQRIHESLSQVR

SEQ ID NO: 3187619 - protein, 30 aa, Giardia lamblia
HAKRLEDAIAWMYHWHTDRSTWTFDKKQQT

SEQ ID NO: 3187620 - protein, 33 aa, Giardia lamblia
HAKVLLEYEQWRKFFSLYGLCKESYRICLTRTP

SEQ ID NO: 3187621 - protein, 19 aa, Giardia lamblia
HAKVTYPLISSYQLDLRLA

SEQ ID NO: 3187622 - protein, 17 aa, Giardia lamblia
HALKIIHRDIKSLNIFL

SEQ ID NO: 3187623 - protein, 25 aa, Giardia lamblia
HALLQQRFFECKFAENEPLSSVKDQ

SEQ ID NO: 3187624 - protein, 24 aa, Giardia lamblia
HALSQLLVSAWKHSLRAQKLIVEE

SEQ ID NO: 3187625 - protein, 22 aa, Giardia lamblia
HALTEIYLRKNAITDLREVVYL

SEQ ID NO: 3187626 - protein, 17 aa, Giardia lamblia
HALYLAIVSGNAEVLCS

SEQ ID NO: 3187627 - protein, 18 aa, Giardia lamblia
HAMIADKVSAYKLQLAED

SEQ ID NO: 3187628 - protein, 22 aa, Giardia lamblia
HANLVFIYIESHRTNYFRSIMV

SEQ ID NO: 3187629 - protein, 33 aa, Giardia lamblia
HANYCIHISFLLQRKYHLPPDHLWTAQTSLTNA

SEQ ID NO: 3187630 - protein, 39 aa, Giardia lamblia
HAPENDEVLKLLPYSTPDLFFRQFNDSVLAYVKDAQILE

SEQ ID NO: 3187631 - protein, 20 aa, Giardia lamblia
HAPLAPQIASLLLAYSTHTC

SEQ ID NO: 3187632 - protein, 22 aa, Giardia lamblia
HAPPFTPLYSCTLNILAEYMKY

SEQ ID NO: 3187633 - protein, 24 aa, Giardia lamblia
HAPSVPLSMNLLDAATSFSIHSLP

SEQ ID NO: 3187634 - protein, 27 aa, Giardia lamblia
HARLRSYFHFVLTYLKSCSKRKTTLKP

SEQ ID NO: 3187635 - protein, 23 aa, Giardia lamblia
HASIPDCFLFGNSVFENGLPSVP

SEQ ID NO: 3187636 - protein, 21 aa, Giardia lamblia
HASNPLIHPIARKSSQQTALI

SEQ ID NO: 3187637 - protein, 28 aa, Giardia lamblia
HATASKKSLWIAPLPHQPVSNSTQQPLC

SEQ ID NO: 3187638 - protein, 30 aa, Giardia lamblia
HATDFLALSAIKYCFLKKSANYAPGYMHSY

SEQ ID NO: 3187639 - protein, 28 aa, Giardia lamblia
HATLLQRLEIDPFFYAMSALNLYDDGEI

SEQ ID NO: 3187640 - protein, 17 aa, Giardia lamblia
HATNFPRLWKITYEISC

SEQ ID NO: 3187641 - protein, 27 aa, Giardia lamblia
HATVDSMYPYSVYASPPGTDTPWDLDS

SEQ ID NO: 3187642 - protein, 29 aa, Giardia lamblia
HAVIQRKFSCVMYLLNHKIFTKRDLEHAM

SEQ ID NO: 3187643 - protein, 19 aa, Giardia lamblia
HAVPVERLRLFSNKLMQVI

SEQ ID NO: 3187644 - protein, 25 aa, Giardia lamblia
HAVRLTKVLLLRQLRLKVFSDRHTL

SEQ ID NO: 3187645 - protein, 29 aa, Giardia lamblia
HAVRNRDIEMVRLLGCFEHSLVNNDGYTA

SEQ ID NO: 3187646 - protein, 30 aa, Giardia lamblia
HCASQFITANLPFLKVLDLSDNYLTDVGEL

SEQ ID NO: 3187647 - protein, 25 aa, Giardia lamblia
HCFMERPMRCFFSQFGKVLQVRVSR

SEQ ID NO: 3187648 - protein, 18 aa, Giardia lamblia
HCIFTIHIRSREPGSDVV

SEQ ID NO: 3187649 - protein, 31 aa, Giardia lamblia
HCIKNLVTCDPFLRSYPRYPTPDSVGVTASS

SEQ ID NO: 3187650 - protein, 22 aa, Giardia lamblia
HCKRRAKLEYFKTVLSKLKENT

SEQ ID NO: 3187651 - protein, 17 aa, Giardia lamblia
HCLQYIQHPRLLRCYGC

SEQ ID NO: 3187652 - protein, 17 aa, Giardia lamblia
HCNKSMMALLINKITLT

SEQ ID NO: 3187653 - protein, 17 aa, Giardia lamblia
HCNRMGKTKLLFVDIPK

SEQ ID NO: 3187654 - protein, 17 aa, Giardia lamblia
HCNTLLPPYCGMCEKCH

SEQ ID NO: 3187655 - protein, 17 aa, Giardia lamblia
HCPSPEDWFSAAINQEY

SEQ ID NO: 3187656 - protein, 50 aa, Giardia lamblia
HCSPSWPQFMRVCPILYWSYVDVWDFLKRFRIHYCTLYDQGYTSLGSATH

SEQ ID NO: 3187657 - protein, 17 aa, Giardia lamblia
HCSVLAEDAIRQAIDDY

SEQ ID NO: 3187658 - protein, 22 aa, Giardia lamblia
HCTVMRLRLYDHLAPQECTAVY

SEQ ID NO: 3187659 - protein, 29 aa, Giardia lamblia
HCYRSAEVPLYLALQLFDTQQATICMPEW

SEQ ID NO: 3187660 - protein, 19 aa, Giardia lamblia
HDCLKLVLAKERYIPDDDG

SEQ ID NO: 3187661 - protein, 23 aa, Giardia lamblia
HDDHELRCLILMELPAIHASGGM

SEQ ID NO: 3187662 - protein, 17 aa, Giardia lamblia
HDDLEWYKQYYGVPKNF

SEQ ID NO: 3187663 - protein, 24 aa, Giardia lamblia
HDDRVIAPSYWKLSGLASEDPIGL

SEQ ID NO: 3187664 - protein, 20 aa, Giardia lamblia
HDDYMRLKNDPNIPQQTALG

SEQ ID NO: 3187665 - protein, 26 aa, Giardia lamblia
HDEIQRFRPKQIFSLDVCALIGDQPH

SEQ ID NO: 3187666 - protein, 21 aa, Giardia lamblia
HDFLYGVEALAPLLIEVSGKR

SEQ ID NO: 3187667 - protein, 19 aa, Giardia lamblia
HDFSQRVMLYRSRLPVFEK

SEQ ID NO: 3187668 - protein, 23 aa, Giardia lamblia
HDGKYFMAPKRPPQPTNEIDEVD

SEQ ID NO: 3187669 - protein, 19 aa, Giardia lamblia
HDGVVQYLSKFSKALQLRS

SEQ ID NO: 3187670 - protein, 22 aa, Giardia lamblia
HDIGFYIHLLEWNNTEALLPAS

SEQ ID NO: 3187671 - protein, 30 aa, Giardia lamblia
HDKLDFQRFYRLRLPFERASDRSLAEYLSE

SEQ ID NO: 3187672 - protein, 17 aa, Giardia lamblia
HDLQLPGSRIKHLLESV

SEQ ID NO: 3187673 - protein, 24 aa, Giardia lamblia
HDNKDFLRLVTQTIMYDLQQVNEF

SEQ ID NO: 3187674 - protein, 25 aa, Giardia lamblia
HDNNFIVHYAIMPPSLQLTQDPAVS

SEQ ID NO: 3187675 - protein, 18 aa, Giardia lamblia
HDPLPRKPAVYRQHYYKA

SEQ ID NO: 3187676 - protein, 25 aa, Giardia lamblia
HDREVLRFYAIWDNRHLVYGELRQL

SEQ ID NO: 3187677 - protein, 17 aa, Giardia lamblia
HDRRVPVPPRLGEVQRR

SEQ ID NO: 3187678 - protein, 25 aa, Giardia lamblia
HDRRVPVPPRLREVQRRAGGQDPQP

SEQ ID NO: 3187679 - protein, 23 aa, Giardia lamblia
HDSLLRMARYLNEKEEELFIIVE

SEQ ID NO: 3187680 - protein, 25 aa, Giardia lamblia
HDTTKLDRPRPVITQDDIVQLRQKH

SEQ ID NO: 3187681 - protein, 27 aa, Giardia lamblia
HDVAELMLREMLYLLTMSGRMYIPFIY

SEQ ID NO: 3187682 - protein, 37 aa, Giardia lamblia
HDYKFKRIYKFLTDDLFYRFEFIWNEFSHINRDVSLV

SEQ ID NO: 3187683 - protein, 17 aa, Giardia lamblia
HDYTPPPFLFEMTDAKA

SEQ ID NO: 3187684 - protein, 19 aa, Giardia lamblia
HDYVPLNLVISLSGIRHGS

SEQ ID NO: 3187685 - protein, 35 aa, Giardia lamblia
HEAKDTQFLLRASFLQLYKEQLQDLLDTRTKNLRI

SEQ ID NO: 3187686 - protein, 19 aa, Giardia lamblia
HECFSTRSLKELPLPSIQA

SEQ ID NO: 3187687 - protein, 24 aa, Giardia lamblia
HEDKIYFSHGFPLEKSRVIRKPEE

SEQ ID NO: 3187688 - protein, 26 aa, Giardia lamblia
HEDNLFKVYCLLQTQARITDSKGRTA

SEQ ID NO: 3187689 - protein, 31 aa, Giardia lamblia
HEEARAFAALYDSPIFFICGLTGIGTNQVIA

SEQ ID NO: 3187690 - protein, 18 aa, Giardia lamblia
HEERFRSIKYHELVNVLT

SEQ ID NO: 3187691 - protein, 25 aa, Giardia lamblia
HEEYVRTILAIQTKEKLISGETASS

SEQ ID NO: 3187692 - protein, 19 aa, Giardia lamblia
HEHRAEISLLTAKNADLLA

SEQ ID NO: 3187693 - protein, 33 aa, Giardia lamblia
HEHYEAFAILHKTLLLLNFLKREMSLTVNYNTL

SEQ ID NO: 3187694 - protein, 23 aa, Giardia lamblia
HEILQQLTLPPPLLDTTERRFED

SEQ ID NO: 3187695 - protein, 25 aa, Giardia lamblia
HEIPDLRLFIDTLSIIWDENFNQPV

SEQ ID NO: 3187696 - protein, 25 aa, Giardia lamblia
HEIVLKHKHEMVKLKKAPNDSPFSL

SEQ ID NO: 3187697 - protein, 18 aa, Giardia lamblia
HEKDFMEWTMLMCAAALG

SEQ ID NO: 3187698 - protein, 26 aa, Giardia lamblia
HEKGCTDITWMTALMRAAQRGHQGAV

SEQ ID NO: 3187699 - protein, 23 aa, Giardia lamblia
HEKQIQLAVTFLSSLYSTVLYSF

SEQ ID NO: 3187700 - protein, 25 aa, Giardia lamblia
HELESKIMQLELKLASLHDESSIVI

SEQ ID NO: 3187701 - protein, 19 aa, Giardia lamblia
HELLQLPFEALTRNISKLT

SEQ ID NO: 3187702 - protein, 24 aa, Giardia lamblia
HELNFVCWAFSFIRLSILSERDDF

SEQ ID NO: 3187703 - protein, 23 aa, Giardia lamblia
HELSLLINDLTAARNRIIMFAER

SEQ ID NO: 3187704 - protein, 18 aa, Giardia lamblia
HENITILHLLNYVTINSI

SEQ ID NO: 3187705 - protein, 18 aa, Giardia lamblia
HEPHEKMMIDWYSAEIPI

SEQ ID NO: 3187706 - protein, 27 aa, Giardia lamblia
HEQCVQLLVPFELKIQDDMGWTALMSA

SEQ ID NO: 3187707 - protein, 18 aa, Giardia lamblia
HEQFLLQRDFWNCQVIFF

SEQ ID NO: 3187708 - protein, 18 aa, Giardia lamblia
HEQPYSDPIYSAITDRNN

SEQ ID NO: 3187709 - protein, 17 aa, Giardia lamblia
HEQRAMDLLSRGVFIIA

SEQ ID NO: 3187710 - protein, 25 aa, Giardia lamblia
HERAHGFLYSSLLPNNLRPETGDVE

SEQ ID NO: 3187711 - protein, 22 aa, Giardia lamblia
HERLIEIITKPDDTPYFYDPKT

SEQ ID NO: 3187712 - protein, 23 aa, Giardia lamblia
HERRDFKFDAVLPHFTTQEDTYE

SEQ ID NO: 3187713 - protein, 28 aa, Giardia lamblia
HERTIRNRYLELLSLQIQLLGHLEEPFT

SEQ ID NO: 3187714 - protein, 25 aa, Giardia lamblia
HESDFYRASFLDRALYRGHVYSYDA

SEQ ID NO: 3187715 - protein, 18 aa, Giardia lamblia
HESVLWKVASQLLKALVD

SEQ ID NO: 3187716 - protein, 17 aa, Giardia lamblia
HETFFCLAKTLDTARHI

SEQ ID NO: 3187717 - protein, 24 aa, Giardia lamblia
HETGTLFITFNVVEPKLLTEEQRM

SEQ ID NO: 3187718 - protein, 27 aa, Giardia lamblia
HEVGIRCFMGWTALTWGLDCQNPAAID

SEQ ID NO: 3187719 - protein, 18 aa, Giardia lamblia
HEVIGTSSKFWLVMDYHA

SEQ ID NO: 3187720 - protein, 17 aa, Giardia lamblia
HEVLAELVGDSSLDLFR

SEQ ID NO: 3187721 - protein, 28 aa, Giardia lamblia
HEYNGMDHNLFLAVHHSSNLNDDKRLES

SEQ ID NO: 3187722 - protein, 30 aa, Giardia lamblia
HEYSIRSREILKRYLPMIYEANNGEPSSLN

SEQ ID NO: 3187723 - protein, 18 aa, Giardia lamblia
HEYVVSMCVFMCRTEVDW

SEQ ID NO: 3187724 - protein, 25 aa, Giardia lamblia
HFAEWPDVIFVIFDDVPLTVTADMA

SEQ ID NO: 3187725 - protein, 35 aa, Giardia lamblia
HFDGLSPDEVELYKKYGLLAKLREQHKEAETALSD

SEQ ID NO: 3187726 - protein, 25 aa, Giardia lamblia
HFEDFYINLYNIIIENLLNLAKSPK

SEQ ID NO: 3187727 - protein, 17 aa, Giardia lamblia
HFFLVSTGATTGGSLSC

SEQ ID NO: 3187728 - protein, 27 aa, Giardia lamblia
HFIIAGLELCRNILWSGSTLIGIGAHT

SEQ ID NO: 3187729 - protein, 19 aa, Giardia lamblia
HFPSTLQFLSLRNNKLTSI

SEQ ID NO: 3187730 - protein, 26 aa, Giardia lamblia
HFRDSYALITAPLSKFGKMFNLDVHK

SEQ ID NO: 3187731 - protein, 26 aa, Giardia lamblia
HFRDSYALITAPLSKFGKMFNLNVHK

SEQ ID NO: 3187732 - protein, 17 aa, Giardia lamblia
HFRIALKADIRLNMPAD

SEQ ID NO: 3187733 - protein, 21 aa, Giardia lamblia
HFRTTHIPHELFYQATKPVLL

SEQ ID NO: 3187734 - protein, 17 aa, Giardia lamblia
HFSDVWADGIRRGLKQT

SEQ ID NO: 3187735 - protein, 23 aa, Giardia lamblia
HFSMTLHDWFRAAEIGDTDYIKE

SEQ ID NO: 3187736 - protein, 20 aa, Giardia lamblia
HFSRLFRVITQPRGHMLMIG

SEQ ID NO: 3187737 - protein, 19 aa, Giardia lamblia
HFTRLRYLSQLGSTRYIYS

SEQ ID NO: 3187738 - protein, 26 aa, Giardia lamblia
HFVDDQWAMFPPVITEFARVTMQNFT

SEQ ID NO: 3187739 - protein, 19 aa, Giardia lamblia
HGAFLLMSILGNSRTPGAY

SEQ ID NO: 3187740 - protein, 27 aa, Giardia lamblia
HGAGSFPPFKPLRAVLELEYTRWTTTD

SEQ ID NO: 3187741 - protein, 20 aa, Giardia lamblia
HGASFFGLRGYYNCEVRDFA

SEQ ID NO: 3187742 - protein, 23 aa, Giardia lamblia
HGDARPYYGGSALFRSVDDMVVA

SEQ ID NO: 3187743 - protein, 32 aa, Giardia lamblia
HGEYNLTPAVLWSLIVMTLTSYGLTMFTEDDC

SEQ ID NO: 3187744 - protein, 20 aa, Giardia lamblia
HGFDIIVHLLAGSEAGMQDV

SEQ ID NO: 3187745 - protein, 20 aa, Giardia lamblia
HGFDPRLYQVLDASKNILNN

SEQ ID NO: 3187746 - protein, 43 aa, Giardia lamblia
HGFHHSYKYDLTLPFFPHLLPYKLAFAGFLRRESRTNDTLARY

SEQ ID NO: 3187747 - protein, 20 aa, Giardia lamblia
HGFIPRAADRLLFPRTHEDV

SEQ ID NO: 3187748 - protein, 28 aa, Giardia lamblia
HGFVPMNNLAAVYLLAPRLSNIRDQNGR

SEQ ID NO: 3187749 - protein, 17 aa, Giardia lamblia
HGGYFIPTPIPHAHVAV

SEQ ID NO: 3187750 - protein, 25 aa, Giardia lamblia
HGHAALIPFLLSEVRLQIISRDSPA

SEQ ID NO: 3187751 - protein, 29 aa, Giardia lamblia
HGHAFHHAVFYSEALKILFAGDGLGFSFS

SEQ ID NO: 3187752 - protein, 18 aa, Giardia lamblia
HGHLCPAALFITHEGQVK

SEQ ID NO: 3187753 - protein, 24 aa, Giardia lamblia
HGHPECVELLYAREILIQDNKGNK

SEQ ID NO: 3187754 - protein, 23 aa, Giardia lamblia
HGHQLYFLRTAGMPKKYIQKYKS

SEQ ID NO: 3187755 - protein, 17 aa, Giardia lamblia
HGHRKCSLLLLSEACIS

SEQ ID NO: 3187756 - protein, 25 aa, Giardia lamblia
HGHVDICKILLAKERGLYTNKAFRH

SEQ ID NO: 3187757 - protein, 19 aa, Giardia lamblia
HGIDFVPKLFVISIDKIKS

SEQ ID NO: 3187758 - protein, 33 aa, Giardia lamblia
HGIDNPPRLLFLHGYSFFTDLYATLLNELCTHF

SEQ ID NO: 3187759 - protein, 23 aa, Giardia lamblia
HGKKRAWRCLRRHEKALRDQLAT

SEQ ID NO: 3187760 - protein, 28 aa, Giardia lamblia
HGKLPADLMELLNKRPPKRKEHILGGCV

SEQ ID NO: 3187761 - protein, 23 aa, Giardia lamblia
HGKSALFVLPALASSRIAVVIMP

SEQ ID NO: 3187762 - protein, 24 aa, Giardia lamblia
HGNNFSFHVPLRDITLHEASAGIF

SEQ ID NO: 3187763 - protein, 24 aa, Giardia lamblia
HGNVFDYLIVLDTGILVLDTPNLL

SEQ ID NO: 3187764 - protein, 17 aa, Giardia lamblia
HGPIWTSEFSRDMSFFA

SEQ ID NO: 3187765 - protein, 18 aa, Giardia lamblia
HGQIWPSNILRTATNKFV

SEQ ID NO: 3187766 - protein, 23 aa, Giardia lamblia
HGRLIQIPMVLLVLANDLAAMGV

SEQ ID NO: 3187767 - protein, 17 aa, Giardia lamblia
HGRLNEFNYYTYNTYLK

SEQ ID NO: 3187768 - protein, 26 aa, Giardia lamblia
HGSKRGGLLFRYTLRQARKNPQALFR

SEQ ID NO: 3187769 - protein, 25 aa, Giardia lamblia
HGSLESLMRLYRRRKQSMPRRLILE

SEQ ID NO: 3187770 - protein, 26 aa, Giardia lamblia
HGSRSLTSPRVLVALARLGLSPEELE

SEQ ID NO: 3187771 - protein, 25 aa, Giardia lamblia
HGSSFLIYAVLLASGYYSQLSTIAP

SEQ ID NO: 3187772 - protein, 30 aa, Giardia lamblia
HGSTAAVSNLLPYLKAKTDARGRTALMYAA

SEQ ID NO: 3187773 - protein, 24 aa, Giardia lamblia
HGTTTIAFCFRGGILLAVDSRSTQ

SEQ ID NO: 3187774 - protein, 28 aa, Giardia lamblia
HGVALLDRRYLIIQPAALSKYVEKTYGL

SEQ ID NO: 3187775 - protein, 17 aa, Giardia lamblia
HGYSYLVYRLISENTET

SEQ ID NO: 3187776 - protein, 20 aa, Giardia lamblia
HGYTALMYAASEGNLEMCRL

SEQ ID NO: 3187777 - protein, 18 aa, Giardia lamblia
HHDDISKFMPKYNTYMSD

SEQ ID NO: 3187778 - protein, 27 aa, Giardia lamblia
HHDDTPLMRAVLSNAPIGVLRRQLRHV

SEQ ID NO: 3187779 - protein, 19 aa, Giardia lamblia
HHELTKFIKLVNTSSLPGK

SEQ ID NO: 3187780 - protein, 36 aa, Giardia lamblia
HHGGLRPYGVSFLFGGWDAHLGFQLYQTDPSGNYSA

SEQ ID NO: 3187781 - protein, 27 aa, Giardia lamblia
HHGHLALTIHYLLTDTAPKLIMCAEAR

SEQ ID NO: 3187782 - protein, 22 aa, Giardia lamblia
HHIKTCDIVGLAFDFCVRYSAI

SEQ ID NO: 3187783 - protein, 24 aa, Giardia lamblia
HHLYLPVFHQLQAWCTLLKCADGS

SEQ ID NO: 3187784 - protein, 23 aa, Giardia lamblia
HHMHKRYIMPAEKPYMYSYTEQS

SEQ ID NO: 3187785 - protein, 21 aa, Giardia lamblia
HHRASVCRVVWVPPAYGNFII

SEQ ID NO: 3187786 - protein, 19 aa, Giardia lamblia
HHRGFAWLIESLTTIKEVP

SEQ ID NO: 3187787 - protein, 21 aa, Giardia lamblia
HHRQHIIGLIERALLEAEISS

SEQ ID NO: 3187788 - protein, 18 aa, Giardia lamblia
HHSDHLAPLILDSVLRVS

SEQ ID NO: 3187789 - protein, 19 aa, Giardia lamblia
HHSGLLPWAKEIIEILFVE

SEQ ID NO: 3187790 - protein, 30 aa, Giardia lamblia
HHSLEIQNYYRYYMKYLKPQQKDVIKILEY

SEQ ID NO: 3187791 - protein, 28 aa, Giardia lamblia
HHVVRSNKIDFVPYLAPLLAQKCDDAGR

SEQ ID NO: 3187792 - protein, 18 aa, Giardia lamblia
HHYCMALNLVYPGQVNMH

SEQ ID NO: 3187793 - protein, 26 aa, Giardia lamblia
HHYGIKLYREGTASSIKLLLLEPTHE

SEQ ID NO: 3187794 - protein, 22 aa, Giardia lamblia
HIAKMESMGRLIEELRSRPQVT

SEQ ID NO: 3187795 - protein, 18 aa, Giardia lamblia
HIDCVKLLLQKEAGMRQN

SEQ ID NO: 3187796 - protein, 23 aa, Giardia lamblia
HIDSLLWHRAIERLLLGYNPSVI

SEQ ID NO: 3187797 - protein, 19 aa, Giardia lamblia
HIEHLGPRKLRNLGSCGAE

SEQ ID NO: 3187798 - protein, 24 aa, Giardia lamblia
HIEPFPLSVCLPGMAYRLGIFYST

SEQ ID NO: 3187799 - protein, 22 aa, Giardia lamblia
HIETLTFLWSLVAHGKFYTRGG

SEQ ID NO: 3187800 - protein, 18 aa, Giardia lamblia
HIFDLKTPFGTLVTYRKE

SEQ ID NO: 3187801 - protein, 20 aa, Giardia lamblia
HIFYKALCLMIDDRNLKVVD

SEQ ID NO: 3187802 - protein, 19 aa, Giardia lamblia
HIIATFAGLTADARVLIDR

SEQ ID NO: 3187803 - protein, 17 aa, Giardia lamblia
HIIKLQTLGVGREVALG

SEQ ID NO: 3187804 - protein, 18 aa, Giardia lamblia
HIISRNFAEKLYTYVSRG

SEQ ID NO: 3187805 - protein, 23 aa, Giardia lamblia
HIKLGMTIFDTTFNRCKVAHAKD

SEQ ID NO: 3187806 - protein, 18 aa, Giardia lamblia
HIKMRLDERRRQSTSRRA

SEQ ID NO: 3187807 - protein, 23 aa, Giardia lamblia
HILIMNGDVVCRYPFSSLISTYK

SEQ ID NO: 3187808 - protein, 29 aa, Giardia lamblia
HIMGAIKRLFAPFFGLRHIKDIISEMLLL

SEQ ID NO: 3187809 - protein, 19 aa, Giardia lamblia
HIMYRYELVSKLGSGSFGK

SEQ ID NO: 3187810 - protein, 17 aa, Giardia lamblia
HINIMEINLQEPGVVYN

SEQ ID NO: 3187811 - protein, 17 aa, Giardia lamblia
HIPSILLLLPEEHAVRD

SEQ ID NO: 3187812 - protein, 18 aa, Giardia lamblia
HIPYRDSKLTKLLQDSLG

SEQ ID NO: 3187813 - protein, 24 aa, Giardia lamblia
HIRCPRAFRNVIFPSTTELFSALT

SEQ ID NO: 3187814 - protein, 26 aa, Giardia lamblia
HIRDRLLMSISFFSWRKVHGYNTLLT

SEQ ID NO: 3187815 - protein, 23 aa, Giardia lamblia
HIRGVELPLAMFLEKLYSETGEK

SEQ ID NO: 3187816 - protein, 18 aa, Giardia lamblia
HISEFYKQHIRTVTEPLL

SEQ ID NO: 3187817 - protein, 17 aa, Giardia lamblia
HISPGGFRLWILSLLEL

SEQ ID NO: 3187818 - protein, 30 aa, Giardia lamblia
HISPVLATMWKSVASIPPFTYTTGDTVIHS

SEQ ID NO: 3187819 - protein, 18 aa, Giardia lamblia
HISTFKRGTDTLLYDNRV

SEQ ID NO: 3187820 - protein, 31 aa, Giardia lamblia
HITATALEILPLGIEFLLGYKSFFQITGIDY

SEQ ID NO: 3187821 - protein, 23 aa, Giardia lamblia
HIVPLRCWNPACLSFNTAPIDDK

SEQ ID NO: 3187822 - protein, 17 aa, Giardia lamblia
HIWRIPQSSAPFLLSNA

SEQ ID NO: 3187823 - protein, 35 aa, Giardia lamblia
HIYAVHPTHFKPMRKKWKASEPPSLPPPPSSDDTL

SEQ ID NO: 3187824 - protein, 21 aa, Giardia lamblia
HIYFDSFGVLKIGNLAQSCIN

SEQ ID NO: 3187825 - protein, 20 aa, Giardia lamblia
HIYKAYPRPSTVAGYGSGQL

SEQ ID NO: 3187826 - protein, 24 aa, Giardia lamblia
HIYNNVDVLYRYKLKLKEVKQRKP

SEQ ID NO: 3187827 - protein, 21 aa, Giardia lamblia
HKALILWRRELMEKRIIEYIA

SEQ ID NO: 3187828 - protein, 29 aa, Giardia lamblia
HKAQPVCLPFSIIVLIPITVNSINSGVLA

SEQ ID NO: 3187829 - protein, 27 aa, Giardia lamblia
HKDAHSLSRLFPISDRRLLVRLQKTCT

SEQ ID NO: 3187830 - protein, 17 aa, Giardia lamblia
HKDIVQLLIPREKMMVM

SEQ ID NO: 3187831 - protein, 21 aa, Giardia lamblia
HKDLAVLFDELQRQIKADKSA

SEQ ID NO: 3187832 - protein, 27 aa, Giardia lamblia
HKELDNDYMRMFRSAKITADCLKDLAE

SEQ ID NO: 3187833 - protein, 29 aa, Giardia lamblia
HKELVRFQTPMSELDWLMKHTPTRISAVV

SEQ ID NO: 3187834 - protein, 21 aa, Giardia lamblia
HKGHLSDRLTCLRASLHKLQA

SEQ ID NO: 3187835 - protein, 28 aa, Giardia lamblia
HKKFHIKITALPLLAVFAPYRIRITPAS

SEQ ID NO: 3187836 - protein, 18 aa, Giardia lamblia
HKKLRDFTGLPCRARSVL

SEQ ID NO: 3187837 - protein, 17 aa, Giardia lamblia
HKKNRLYREFFNCITPQ

SEQ ID NO: 3187838 - protein, 28 aa, Giardia lamblia
HKQKTAPRKYLFMSSTPIIKDKSIEQEI

SEQ ID NO: 3187839 - protein, 21 aa, Giardia lamblia
HKQLAQMFRLYEAQLSYCVHQ

SEQ ID NO: 3187840 - protein, 24 aa, Giardia lamblia
HKRGEVPAYLKRFQKQHAAEEAQK

SEQ ID NO: 3187841 - protein, 19 aa, Giardia lamblia
HKRIAFVQSIYTIGPIGYI

SEQ ID NO: 3187842 - protein, 29 aa, Giardia lamblia
HKRREYGRLLFRLAYRMEEQGLRLEQLRP

SEQ ID NO: 3187843 - protein, 28 aa, Giardia lamblia
HKRYIIYQCVKALKYLHSAEILHRDLKP

SEQ ID NO: 3187844 - protein, 17 aa, Giardia lamblia
HKTEVACFALSPDGIYL

SEQ ID NO: 3187845 - protein, 22 aa, Giardia lamblia
HKTGLKTLRQYSLMPGTRSVQG

SEQ ID NO: 3187846 - protein, 27 aa, Giardia lamblia
HKVDWWSMGAILYECVFGYPPFGSDNP

SEQ ID NO: 3187847 - protein, 19 aa, Giardia lamblia
HKVKSIGTKLSLLGRKEKQ

SEQ ID NO: 3187848 - protein, 19 aa, Giardia lamblia
HKVPLMRVPAHYNVLIETF

SEQ ID NO: 3187849 - protein, 19 aa, Giardia lamblia
HKYRQALVSGLDAIVLPTT

SEQ ID NO: 3187850 - protein, 22 aa, Giardia lamblia
HLACIKVLAPYEAALSGGLAIV

SEQ ID NO: 3187851 - protein, 17 aa, Giardia lamblia
HLAPLILDSVLRVSDSD

SEQ ID NO: 3187852 - protein, 19 aa, Giardia lamblia
HLCLSWMPNLARFVENLAT

SEQ ID NO: 3187853 - protein, 19 aa, Giardia lamblia
HLDCVHILIRKENGMVCSN

SEQ ID NO: 3187854 - protein, 17 aa, Giardia lamblia
HLDPVILSTAIDAAIKH

SEQ ID NO: 3187855 - protein, 22 aa, Giardia lamblia
HLDQTMQLFYTSLPSRSDQGVH

SEQ ID NO: 3187856 - protein, 18 aa, Giardia lamblia
HLEAARFLAPTQTGAVTT

SEQ ID NO: 3187857 - protein, 18 aa, Giardia lamblia
HLECFSILLPIEGAMKKS

SEQ ID NO: 3187858 - protein, 23 aa, Giardia lamblia
HLECIKLLLAREGGLQDIEGWTS

SEQ ID NO: 3187859 - protein, 29 aa, Giardia lamblia
HLEEDDLPLPVFPAPDPDSKPYVDAPRRV

SEQ ID NO: 3187860 - protein, 19 aa, Giardia lamblia
HLEIVHLLVHMENSMRHSS

SEQ ID NO: 3187861 - protein, 27 aa, Giardia lamblia
HLEPCIHLLSRWYGWDAKKLSIASLDK

SEQ ID NO: 3187862 - protein, 17 aa, Giardia lamblia
HLESNLATLAAKGTLTA

SEQ ID NO: 3187863 - protein, 17 aa, Giardia lamblia
HLFFDMEPPLTSTEVTP

SEQ ID NO: 3187864 - protein, 17 aa, Giardia lamblia
HLFLTYVGRKDPQALLL

SEQ ID NO: 3187865 - protein, 24 aa, Giardia lamblia
HLGYSCTTAYPLFYSTTRQTFSIP

SEQ ID NO: 3187866 - protein, 23 aa, Giardia lamblia
HLHQQMLQMSLTQQLTPYQQEAH

SEQ ID NO: 3187867 - protein, 29 aa, Giardia lamblia
HLIDCKHPSLLVYLTLINDRSRCSYSLVS

SEQ ID NO: 3187868 - protein, 25 aa, Giardia lamblia
HLKEAGANFVVCQWGFDDEANHLLM

SEQ ID NO: 3187869 - protein, 20 aa, Giardia lamblia
HLKIATFLIPYEGFKEQEAD

SEQ ID NO: 3187870 - protein, 24 aa, Giardia lamblia
HLKKAETYLYKDALEPVITMHLMQ

SEQ ID NO: 3187871 - protein, 20 aa, Giardia lamblia
HLKRLWDENPNISRDVFLSS

SEQ ID NO: 3187872 - protein, 17 aa, Giardia lamblia
HLLNYKKVAIVRRNPLW

SEQ ID NO: 3187873 - protein, 17 aa, Giardia lamblia
HLLPFHSQHYLKRMLGI

SEQ ID NO: 3187874 - protein, 17 aa, Giardia lamblia
HLLPIYSTHSRDIISKG

SEQ ID NO: 3187875 - protein, 18 aa, Giardia lamblia
HLLVHMENSMRHSSGKSA

SEQ ID NO: 3187876 - protein, 17 aa, Giardia lamblia
HLLYLGMSIARELDPTD

SEQ ID NO: 3187877 - protein, 17 aa, Giardia lamblia
HLNAFITKLLNACLTDL

SEQ ID NO: 3187878 - protein, 24 aa, Giardia lamblia
HLNINPSNILLTDDFNVILTGFTN

SEQ ID NO: 3187879 - protein, 26 aa, Giardia lamblia
HLPERSVWYILSQFIDLLSYLHDVGP

SEQ ID NO: 3187880 - protein, 17 aa, Giardia lamblia
HLQILANKIENYKALLL

SEQ ID NO: 3187881 - protein, 20 aa, Giardia lamblia
HLQLCISHYCKLALHGNPSN

SEQ ID NO: 3187882 - protein, 18 aa, Giardia lamblia
HLQRPRRPDSSVISFFCT

SEQ ID NO: 3187883 - protein, 18 aa, Giardia lamblia
HLRIVLRSYIELGVVMDV

SEQ ID NO: 3187884 - protein, 19 aa, Giardia lamblia
HLSAILQALQSLVDISRNN

SEQ ID NO: 3187885 - protein, 17 aa, Giardia lamblia
HLSLDFYSSAISVYKED

SEQ ID NO: 3187886 - protein, 18 aa, Giardia lamblia
HLSLRKKFNYDKGDLSRL

SEQ ID NO: 3187887 - protein, 18 aa, Giardia lamblia
HLSLVQLLGPVEGELYAE

SEQ ID NO: 3187888 - protein, 25 aa, Giardia lamblia
HLSMKLAVLKLPRNYNCGYLFRKLG

SEQ ID NO: 3187889 - protein, 18 aa, Giardia lamblia
HLSNALLVLINRATSEGQ

SEQ ID NO: 3187890 - protein, 17 aa, Giardia lamblia
HLSRTKTIPLLCPFLKR

SEQ ID NO: 3187891 - protein, 17 aa, Giardia lamblia
HLSSSSAFLCHPSAVIF

SEQ ID NO: 3187892 - protein, 25 aa, Giardia lamblia
HLSTIFAFTLLDDYLISSGEDKVLV

SEQ ID NO: 3187893 - protein, 25 aa, Giardia lamblia
HLSVDDIILMATRFKNLRSLEIGSL

SEQ ID NO: 3187894 - protein, 34 aa, Giardia lamblia
HLTDAFPCMLFSSLLRVSLFLYSRRAVGLSTETI

SEQ ID NO: 3187895 - protein, 19 aa, Giardia lamblia
HLTPFTTDLLCGCLALDPV

SEQ ID NO: 3187896 - protein, 20 aa, Giardia lamblia
HLYGHPHWQFPDDSVVFQAP

SEQ ID NO: 3187897 - protein, 17 aa, Giardia lamblia
HMAVIDPELVLTVPASL

SEQ ID NO: 3187898 - protein, 26 aa, Giardia lamblia
HMDLRYQPFIIAKLKGYIPLANSKYD

SEQ ID NO: 3187899 - protein, 26 aa, Giardia lamblia
HMESIDDILTCLIDPAFNAELLSYLE

SEQ ID NO: 3187900 - protein, 19 aa, Giardia lamblia
HMFLSSTGNFLNSNLVLSE

SEQ ID NO: 3187901 - protein, 17 aa, Giardia lamblia
HMHAAPALSKRPSSAKL

SEQ ID NO: 3187902 - protein, 21 aa, Giardia lamblia
HMHILTDFIVVFWAKKSKKMG

SEQ ID NO: 3187903 - protein, 19 aa, Giardia lamblia
HMIKTLPVLITFISNTVMS

SEQ ID NO: 3187904 - protein, 18 aa, Giardia lamblia
HMLATDILALLHSMPPLS

SEQ ID NO: 3187905 - protein, 20 aa, Giardia lamblia
HMLIIMRRRQYVLANNSKCI

SEQ ID NO: 3187906 - protein, 24 aa, Giardia lamblia
HMLNIECHSFLNRALESELSPIII

SEQ ID NO: 3187907 - protein, 24 aa, Giardia lamblia
HMLRDLDMLRAVRNLLAAQKEKDY

SEQ ID NO: 3187908 - protein, 17 aa, Giardia lamblia
HMNYLHATAPYSPPVRT

SEQ ID NO: 3187909 - protein, 24 aa, Giardia lamblia
HMPPIRLNITIYYELMHQLISAVN

SEQ ID NO: 3187910 - protein, 18 aa, Giardia lamblia
HMRMVRLLLDSEARTTTR

SEQ ID NO: 3187911 - protein, 22 aa, Giardia lamblia
HMRRAIYSVPFPIVSSSGTVGA

SEQ ID NO: 3187912 - protein, 30 aa, Giardia lamblia
HMSRHLIKHLPLEVRKRIFIWLSDEREDTC

SEQ ID NO: 3187913 - protein, 26 aa, Giardia lamblia
HMSWDYFELLNLYRAITFAGLSYLSG

SEQ ID NO: 3187914 - protein, 19 aa, Giardia lamblia
HMTERGRELWAKHTRGLSL

SEQ ID NO: 3187915 - protein, 24 aa, Giardia lamblia
HMTHHPLCPLCKRPQYDNDSYKDH

SEQ ID NO: 3187916 - protein, 17 aa, Giardia lamblia
HNCIVAVKYLLSVEAKR

SEQ ID NO: 3187917 - protein, 17 aa, Giardia lamblia
HNCSICIGLLFFNTYVH

SEQ ID NO: 3187918 - protein, 24 aa, Giardia lamblia
HNDAIAALRKEALKSLNDLETGIA

SEQ ID NO: 3187919 - protein, 20 aa, Giardia lamblia
HNDLRNLIKQKLIGMSEPAS

SEQ ID NO: 3187920 - protein, 28 aa, Giardia lamblia
HNDTAILELFDAHLKTTLKSCLPAYLQS

SEQ ID NO: 3187921 - protein, 36 aa, Giardia lamblia
HNEYTFPRFISNPPQFATLAFLPLLSPTSPLDLRAL

SEQ ID NO: 3187922 - protein, 17 aa, Giardia lamblia
HNGSLIIWDTRSKAHSI

SEQ ID NO: 3187923 - protein, 17 aa, Giardia lamblia
HNHELKATLMLKDSEIA

SEQ ID NO: 3187924 - protein, 20 aa, Giardia lamblia
HNKLFVRHERVSALDYMPPV

SEQ ID NO: 3187925 - protein, 19 aa, Giardia lamblia
HNKMMSIRAFLECWDSIDV

SEQ ID NO: 3187926 - protein, 23 aa, Giardia lamblia
HNLMEAIINFDSCSDPPIFDTAA

SEQ ID NO: 3187927 - protein, 25 aa, Giardia lamblia
HNRELCMYLSSVKQYIKQKLQGRGV

SEQ ID NO: 3187928 - protein, 21 aa, Giardia lamblia
HNRLLDIQGLLLYLVANELGG

SEQ ID NO: 3187929 - protein, 31 aa, Giardia lamblia
HNSFSIPPSFFPIPDMYLRHCWRSVAVPIEL

SEQ ID NO: 3187930 - protein, 26 aa, Giardia lamblia
HNSMQIICDYLLKHNIRSSVKSREGF

SEQ ID NO: 3187931 - protein, 21 aa, Giardia lamblia
HNTALLLAIQNYHAESAIILI

SEQ ID NO: 3187932 - protein, 21 aa, Giardia lamblia
HNTTWLLSDSSLQDNLRMLLN

SEQ ID NO: 3187933 - protein, 25 aa, Giardia lamblia
HNVSQSSFAELLKYAPNAPPQAGRV

SEQ ID NO: 3187934 - protein, 23 aa, Giardia lamblia
HNWDAVNLLLPYEAQHSPDLAGL

SEQ ID NO: 3187935 - protein, 22 aa, Giardia lamblia
HPCIFTIHDCVLSLAETAWSGM

SEQ ID NO: 3187936 - protein, 19 aa, Giardia lamblia
HPDANVRFIIAPHAGLVYS

SEQ ID NO: 3187937 - protein, 24 aa, Giardia lamblia
HPEAVLTMPVSIPTPIRACSRYIE

SEQ ID NO: 3187938 - protein, 41 aa, Giardia lamblia
HPECPSLGMYARFNQPRDLPPPEWRYGIHSAPNEYPMTNVV

SEQ ID NO: 3187939 - protein, 17 aa, Giardia lamblia
HPECVELFLEKEGGLRD

SEQ ID NO: 3187940 - protein, 25 aa, Giardia lamblia
HPELQFLVAPPRYLDQPAFMQSPGI

SEQ ID NO: 3187941 - protein, 18 aa, Giardia lamblia
HPGILKYHQVVEDEGLIY

SEQ ID NO: 3187942 - protein, 20 aa, Giardia lamblia
HPGLPLLQGRVLPHGIPDQR

SEQ ID NO: 3187943 - protein, 24 aa, Giardia lamblia
HPGTASHLFLTDSTVPPALSHASD

SEQ ID NO: 3187944 - protein, 18 aa, Giardia lamblia
HPGVIKYHQVVEDESFFY

SEQ ID NO: 3187945 - protein, 18 aa, Giardia lamblia
HPGVLRYHQVIEHMNFVY

SEQ ID NO: 3187946 - protein, 22 aa, Giardia lamblia
HPHCFPTLRFLLEMQDYILDRQ

SEQ ID NO: 3187947 - protein, 27 aa, Giardia lamblia
HPIETVAWIRSMPRVIDWRPCSLAEVY

SEQ ID NO: 3187948 - protein, 26 aa, Giardia lamblia
HPLARILIMVVKSFLKKRGLNQPYTG

SEQ ID NO: 3187949 - protein, 19 aa, Giardia lamblia
HPLRFARALRMIAESACAV

SEQ ID NO: 3187950 - protein, 23 aa, Giardia lamblia
HPNILSCKSIFFHGARLCFALEL

SEQ ID NO: 3187951 - protein, 29 aa, Giardia lamblia
HPNVVRLYEVFFNLLVVPTPYLKQEDVNT

SEQ ID NO: 3187952 - protein, 17 aa, Giardia lamblia
HPPRSLLKTLLDDGLDT

SEQ ID NO: 3187953 - protein, 25 aa, Giardia lamblia
HPQLSGPITIYTRQVMKKPGYIGHC

SEQ ID NO: 3187954 - protein, 30 aa, Giardia lamblia
HPRALEVKAWKLIRDLSSALLYLQQHTKKG

SEQ ID NO: 3187955 - protein, 19 aa, Giardia lamblia
HPRCAVECPEGRPLFACLL

SEQ ID NO: 3187956 - protein, 27 aa, Giardia lamblia
HPRGRSLAFLPVPCPASIKCYSVGYLG

SEQ ID NO: 3187957 - protein, 25 aa, Giardia lamblia
HPSRKHRIILLSHRNLINKRQALKI

SEQ ID NO: 3187958 - protein, 18 aa, Giardia lamblia
HPSYKQPAFSFRVGNVLQ

SEQ ID NO: 3187959 - protein, 25 aa, Giardia lamblia
HPVRQMLPICYIPGCSFPACLNLID

SEQ ID NO: 3187960 - protein, 27 aa, Giardia lamblia
HPVTQDYITPTRLFPVVRHKARTTAEM

SEQ ID NO: 3187961 - protein, 35 aa, Giardia lamblia
HPVTTLPRLQLFRSLMMVLTSLIYFGSGVDGLSES

SEQ ID NO: 3187962 - protein, 23 aa, Giardia lamblia
HPYIVGYHESFADTRYLHIVMEY

SEQ ID NO: 3187963 - protein, 33 aa, Giardia lamblia
HQAPGYYYRTPAPMHFLAILARIYETRSQLESN

SEQ ID NO: 3187964 - protein, 21 aa, Giardia lamblia
HQAVINACHRGLQMRNSLTKE

SEQ ID NO: 3187965 - protein, 25 aa, Giardia lamblia
HQEFGLADLWKFAIASLICNDLLKY

SEQ ID NO: 3187966 - protein, 22 aa, Giardia lamblia
HQFFDPLQNFLPFMAYDLFDMM

SEQ ID NO: 3187967 - protein, 26 aa, Giardia lamblia
HQGPLNLMFALPFQTVPYGSHYPLIT

SEQ ID NO: 3187968 - protein, 29 aa, Giardia lamblia
HQIDGVKFLLISWLQKRNVILADDLGVGK

SEQ ID NO: 3187969 - protein, 29 aa, Giardia lamblia
HQIPEESPYRLLFSEMIFPIMLQNNKENY

SEQ ID NO: 3187970 - protein, 23 aa, Giardia lamblia
HQISSLPTMPIVSTSPSKLESIL

SEQ ID NO: 3187971 - protein, 26 aa, Giardia lamblia
HQNLTLFPHLLPYKVHEILSRGYVEL

SEQ ID NO: 3187972 - protein, 19 aa, Giardia lamblia
HQNRTWLKKSLSENIREKE

SEQ ID NO: 3187973 - protein, 24 aa, Giardia lamblia
HQQLEKPVCRLLKDVLKCSSEAEA

SEQ ID NO: 3187974 - protein, 36 aa, Giardia lamblia
HQQLPPLPALRQSAALLLHWLRHNYWEPLLNETHEN

SEQ ID NO: 3187975 - protein, 26 aa, Giardia lamblia
HQRRMDMVHILIRNPQLLTVQDMDEA

SEQ ID NO: 3187976 - protein, 18 aa, Giardia lamblia
HQTELLNRSLRHELLETE

SEQ ID NO: 3187977 - protein, 17 aa, Giardia lamblia
HQTPRSVRLKGSKTRLC

SEQ ID NO: 3187978 - protein, 25 aa, Giardia lamblia
HQTSALMMAIDRNFPETALLLIEQE

SEQ ID NO: 3187979 - protein, 27 aa, Giardia lamblia
HQVIEHMNFVYFITDRYNKTLGRLLIE

SEQ ID NO: 3187980 - protein, 33 aa, Giardia lamblia
HQYHGCPCPWLIISLMRFLRRLAPRLEEAQDKD

SEQ ID NO: 3187981 - protein, 21 aa, Giardia lamblia
HRALRVLTPRCTPSRMIFPCI

SEQ ID NO: 3187982 - protein, 20 aa, Giardia lamblia
HRDISAKNILVMLKSPRDPL

SEQ ID NO: 3187983 - protein, 17 aa, Giardia lamblia
HRDLKPSNLLLNSECHM

SEQ ID NO: 3187984 - protein, 23 aa, Giardia lamblia
HRDLQFLTWNFCTMHKACQCVRT

SEQ ID NO: 3187985 - protein, 31 aa, Giardia lamblia
HRDPKPVRPASARLAKLFQLPANAITQRMID

SEQ ID NO: 3187986 - protein, 26 aa, Giardia lamblia
HREELLNMVPTRLLKSLPFENQHEIV

SEQ ID NO: 3187987 - protein, 25 aa, Giardia lamblia
HRGQRFLHILVHLFDFLRVLHHQSS

SEQ ID NO: 3187988 - protein, 23 aa, Giardia lamblia
HRHGDIRILVRTVQNLRVLAGTA

SEQ ID NO: 3187989 - protein, 17 aa, Giardia lamblia
HRIGVGSAVLQKFARHE

SEQ ID NO: 3187990 - protein, 24 aa, Giardia lamblia
HRLLQPCFAVIFRLTVWSNSLIEK

SEQ ID NO: 3187991 - protein, 31 aa, Giardia lamblia
HRNLRPENILLKLNGLIGLATLRLAEEQELP

SEQ ID NO: 3187992 - protein, 18 aa, Giardia lamblia
HRPGQYLAIFVRSPEHFQ

SEQ ID NO: 3187993 - protein, 21 aa, Giardia lamblia
HRPRNLVTSRRLLSAQLKGSS

SEQ ID NO: 3187994 - protein, 29 aa, Giardia lamblia
HRPRQIDYDFLLYAKDQEILRLQTLLVQL

SEQ ID NO: 3187995 - protein, 23 aa, Giardia lamblia
HRRTGEFYALKLVAYHGMSTKLY

SEQ ID NO: 3187996 - protein, 33 aa, Giardia lamblia
HRRTRFRAKVFTTIPPDPPPLPVDDRYSEATVI

SEQ ID NO: 3187997 - protein, 28 aa, Giardia lamblia
HRSIKEDALLLLLADQILYMLLDDIDQD

SEQ ID NO: 3187998 - protein, 31 aa, Giardia lamblia
HRVPLRYIRALRRVIPLKLLVQVGRELEIEL

SEQ ID NO: 3187999 - protein, 26 aa, Giardia lamblia
HRVQSDLLIGLIYNAFYMLRGGGSNI

SEQ ID NO: 3188000 - protein, 24 aa, Giardia lamblia
HRYLRMLHHPPITNDNLIFSLSYE

SEQ ID NO: 3188001 - protein, 25 aa, Giardia lamblia
HSAKRPFVPLRRPAEGFWKETALIR

SEQ ID NO: 3188002 - protein, 26 aa, Giardia lamblia
HSANHAFFVFRMPAGSSLYSIVTAST

SEQ ID NO: 3188003 - protein, 17 aa, Giardia lamblia
HSARVLTGKLSYCAPEV

SEQ ID NO: 3188004 - protein, 29 aa, Giardia lamblia
HSASEHIKLWSLLLLSELMHNLTTTVTDT

SEQ ID NO: 3188005 - protein, 20 aa, Giardia lamblia
HSAYEHWLDVIEKLFMGPWS

SEQ ID NO: 3188006 - protein, 28 aa, Giardia lamblia
HSDIDLLSFLSHPMILSALIKFDNINLQ

SEQ ID NO: 3188007 - protein, 29 aa, Giardia lamblia
HSDVWSMIAPDIPFLSPLIMKHIPNPDHR

SEQ ID NO: 3188008 - protein, 18 aa, Giardia lamblia
HSFSRYRVKFNADSIDIM

SEQ ID NO: 3188009 - protein, 30 aa, Giardia lamblia
HSGLLCSFELPFNMLAFDIVGVAVEGPTAP

SEQ ID NO: 3188010 - protein, 22 aa, Giardia lamblia
HSGLLLGLHPGLPLLQGRVLPH

SEQ ID NO: 3188011 - protein, 24 aa, Giardia lamblia
HSGTAKNIAFAYPIEAPLKEFLQS

SEQ ID NO: 3188012 - protein, 28 aa, Giardia lamblia
HSHAKIASYLHAIAAKKVSPGSISSYEA

SEQ ID NO: 3188013 - protein, 26 aa, Giardia lamblia
HSHESYPLYLQMQALERENSGLRAKI

SEQ ID NO: 3188014 - protein, 17 aa, Giardia lamblia
HSIDPNRQLLDTATLQR

SEQ ID NO: 3188015 - protein, 20 aa, Giardia lamblia
HSIEDMLTIPRFQKLMRPFS

SEQ ID NO: 3188016 - protein, 27 aa, Giardia lamblia
HSIEIIALLCYLKLSYPSKITLLRGNH

SEQ ID NO: 3188017 - protein, 17 aa, Giardia lamblia
HSIIPYPPTSSMSRRLN

SEQ ID NO: 3188018 - protein, 24 aa, Giardia lamblia
HSIKEYIIPSLWSILGLSKCLVVE

SEQ ID NO: 3188019 - protein, 33 aa, Giardia lamblia
HSILTLDVGSWVRLQYALRLMRDRLAEGVGPTP

SEQ ID NO: 3188020 - protein, 23 aa, Giardia lamblia
HSIQLSLFKRTLGDTWPITRYPK

SEQ ID NO: 3188021 - protein, 31 aa, Giardia lamblia
HSIRDIGLLANYKHIRTISLAHLRLDTSLSE

SEQ ID NO: 3188022 - protein, 21 aa, Giardia lamblia
HSISPYPPSLSLLDWTGNTIF

SEQ ID NO: 3188023 - protein, 27 aa, Giardia lamblia
HSKESTMRALITRFTNFYNELTRVVKS

SEQ ID NO: 3188024 - protein, 25 aa, Giardia lamblia
HSKHQTLYRLVCQDPFIALRPVYQY

SEQ ID NO: 3188025 - protein, 24 aa, Giardia lamblia
HSLELQIPFLAHVFANQIEAGTVK

SEQ ID NO: 3188026 - protein, 20 aa, Giardia lamblia
HSLLTERIAALQQKTLETIK

SEQ ID NO: 3188027 - protein, 18 aa, Giardia lamblia
HSLVYMLDTIEYFEEKFM

SEQ ID NO: 3188028 - protein, 17 aa, Giardia lamblia
HSNLLATPSLSSSLMTP

SEQ ID NO: 3188029 - protein, 20 aa, Giardia lamblia
HSNTLLIYGAPGVGKTLLSR

SEQ ID NO: 3188030 - protein, 18 aa, Giardia lamblia
HSPLPLPGKKAGFLLHLG

SEQ ID NO: 3188031 - protein, 23 aa, Giardia lamblia
HSPRLCPATTLWAQYRCCRPVAD

SEQ ID NO: 3188032 - protein, 21 aa, Giardia lamblia
HSQILIFNISDGAPSRYVCSY

SEQ ID NO: 3188033 - protein, 23 aa, Giardia lamblia
HSQYGSLYAYRRGLMSVSVMNLS

SEQ ID NO: 3188034 - protein, 32 aa, Giardia lamblia
HSSDAVLSLPTARWLWKGKRYSSVGGIVWSTE

SEQ ID NO: 3188035 - protein, 20 aa, Giardia lamblia
HSSLLGIPVPQTILTGSLTE

SEQ ID NO: 3188036 - protein, 25 aa, Giardia lamblia
HSSLMQLLKALAYLHSKVKPDSDVG

SEQ ID NO: 3188037 - protein, 19 aa, Giardia lamblia
HSSLPTYRLDRCFEPNDLF

SEQ ID NO: 3188038 - protein, 24 aa, Giardia lamblia
HSSLQHGALLYLKMERDLGSDSDS

SEQ ID NO: 3188039 - protein, 18 aa, Giardia lamblia
HSSNYILDVLLPSNEHVN

SEQ ID NO: 3188040 - protein, 36 aa, Giardia lamblia
HSSPFLDRFISHRTALALLFQFLAQNYSSTLTTDRV

SEQ ID NO: 3188041 - protein, 17 aa, Giardia lamblia
HSSSAILPLLERKDTEI

SEQ ID NO: 3188042 - protein, 31 aa, Giardia lamblia
HSSSFLHNILSIYWLPSFLQAGTMNEISNHL

SEQ ID NO: 3188043 - protein, 20 aa, Giardia lamblia
HSTSLFYPYHNACADTIRAV

SEQ ID NO: 3188044 - protein, 24 aa, Giardia lamblia
HSTSVCDVYLLVGVKLRKCVPVCH

SEQ ID NO: 3188045 - protein, 21 aa, Giardia lamblia
HSVILFALRRAGVVQPTVAYI

SEQ ID NO: 3188046 - protein, 21 aa, Giardia lamblia
HSVRHKWPDSLSFVLSFDSHV

SEQ ID NO: 3188047 - protein, 19 aa, Giardia lamblia
HSVVLTAILERTLSKLPNK

SEQ ID NO: 3188048 - protein, 17 aa, Giardia lamblia
HTALMLAAWHGHKDCVK

SEQ ID NO: 3188049 - protein, 28 aa, Giardia lamblia
HTANLGPHEPLIIDLAPIQEPASEFLAD

SEQ ID NO: 3188050 - protein, 23 aa, Giardia lamblia
HTARIYEYLFRSTSDLSRCRCVC

SEQ ID NO: 3188051 - protein, 20 aa, Giardia lamblia
HTAVFLEPMIYVFGGSDGIT

SEQ ID NO: 3188052 - protein, 22 aa, Giardia lamblia
HTDIALLLQGYETHSWTPLMRA

SEQ ID NO: 3188053 - protein, 36 aa, Giardia lamblia
HTDIALLLREHEAPSWTLLMCAAFTGDATMARRHLH

SEQ ID NO: 3188054 - protein, 23 aa, Giardia lamblia
HTDLAHIVGLLVAFPNLQTYNTV

SEQ ID NO: 3188055 - protein, 32 aa, Giardia lamblia
HTDVVKLLVVREKEIVSYDHKTAFVLAAENGH

SEQ ID NO: 3188056 - protein, 19 aa, Giardia lamblia
HTEIVQLLAPLEADMHIVE

SEQ ID NO: 3188057 - protein, 22 aa, Giardia lamblia
HTFPVLSPIYHPTSLPGFQCPH

SEQ ID NO: 3188058 - protein, 22 aa, Giardia lamblia
HTHRHLCEFIGLDLEMEIYESY

SEQ ID NO: 3188059 - protein, 25 aa, Giardia lamblia
HTHTFLCQCAEKVMPRVYFKLASEL

SEQ ID NO: 3188060 - protein, 28 aa, Giardia lamblia
HTKRELIELIQYPIRYKEKYQQMGIEPS

SEQ ID NO: 3188061 - protein, 17 aa, Giardia lamblia
HTLSKHIISLFFMAFYY

SEQ ID NO: 3188062 - protein, 24 aa, Giardia lamblia
HTNKLLISARLLAPAIAWEESQGY

SEQ ID NO: 3188063 - protein, 24 aa, Giardia lamblia
HTNSTETVWMLLEERLGVGQRDAQ

SEQ ID NO: 3188064 - protein, 19 aa, Giardia lamblia
HTNWVYSARLSPDGRLIAS

SEQ ID NO: 3188065 - protein, 22 aa, Giardia lamblia
HTPYDVIAAEFLLETIANAVML

SEQ ID NO: 3188066 - protein, 31 aa, Giardia lamblia
HTQIEEDRIWRIFAQLLIAMEYCHSVRKPNA

SEQ ID NO: 3188067 - protein, 18 aa, Giardia lamblia
HTQKNILHLKQYCDRHGL

SEQ ID NO: 3188068 - protein, 23 aa, Giardia lamblia
HTRKPVGDPIPLLFHCKCGGDGH

SEQ ID NO: 3188069 - protein, 23 aa, Giardia lamblia
HTSKRYYLNLITKHYRCLQDSAS

SEQ ID NO: 3188070 - protein, 23 aa, Giardia lamblia
HTSSAFPPVSQDLLNSIRVQQET

SEQ ID NO: 3188071 - protein, 17 aa, Giardia lamblia
HTVIRDVNAYRFHFFAA

SEQ ID NO: 3188072 - protein, 24 aa, Giardia lamblia
HTVPVIFSIINKNLPRFAVAHAIQ

SEQ ID NO: 3188073 - protein, 27 aa, Giardia lamblia
HTWSVTKFLRKYSALRALFSHAVEIND

SEQ ID NO: 3188074 - protein, 20 aa, Giardia lamblia
HTYCYAALQALQMYGQYLAG

SEQ ID NO: 3188075 - protein, 20 aa, Giardia lamblia
HTYDIPWPSIFGEPSGLCFS

SEQ ID NO: 3188076 - protein, 28 aa, Giardia lamblia
HVAEGDACFRLGLFQKAISSYTAALDIR

SEQ ID NO: 3188077 - protein, 26 aa, Giardia lamblia
HVAKPKLVVDFRPFAGYRWRRKGLIN

SEQ ID NO: 3188078 - protein, 25 aa, Giardia lamblia
HVDFFDKLYAFLRLLTENGRYHELL

SEQ ID NO: 3188079 - protein, 17 aa, Giardia lamblia
HVDFFGLAVGPLSGTRF

SEQ ID NO: 3188080 - protein, 26 aa, Giardia lamblia
HVDLGRPFLGFALALSSGAVAFVAET

SEQ ID NO: 3188081 - protein, 20 aa, Giardia lamblia
HVDLIDDLLLYTPKARQARA

SEQ ID NO: 3188082 - protein, 18 aa, Giardia lamblia
HVEILKLLVPVQTRRKSN

SEQ ID NO: 3188083 - protein, 25 aa, Giardia lamblia
HVEKMFEYFQCKLQEIIASNEKNIE

SEQ ID NO: 3188084 - protein, 17 aa, Giardia lamblia
HVFLLCFSVVSSTSFAN

SEQ ID NO: 3188085 - protein, 19 aa, Giardia lamblia
HVILFRSPSNRRLSYSQVN

SEQ ID NO: 3188086 - protein, 17 aa, Giardia lamblia
HVILSKLRNLDATDPFA

SEQ ID NO: 3188087 - protein, 22 aa, Giardia lamblia
HVKTLLERVLSESLYDGSPDSL

SEQ ID NO: 3188088 - protein, 17 aa, Giardia lamblia
HVLICTPGRLVDHLATT

SEQ ID NO: 3188089 - protein, 17 aa, Giardia lamblia
HVLILSYAPTRKSQANL

SEQ ID NO: 3188090 - protein, 17 aa, Giardia lamblia
HVLLTLTVERRYSTTTK

SEQ ID NO: 3188091 - protein, 17 aa, Giardia lamblia
HVLRHRPYTMLEEIQES

SEQ ID NO: 3188092 - protein, 17 aa, Giardia lamblia
HVLVLLSDIFNYADALR

SEQ ID NO: 3188093 - protein, 19 aa, Giardia lamblia
HVMELIVDRFGNYVFQYSL

SEQ ID NO: 3188094 - protein, 19 aa, Giardia lamblia
HVMIQNEYMILEAKLDEVQ

SEQ ID NO: 3188095 - protein, 29 aa, Giardia lamblia
HVMSSQELIYLLLNVPSLYIDNRVIPHDH

SEQ ID NO: 3188096 - protein, 24 aa, Giardia lamblia
HVNSTQYWAPIDPLAISNNGFDSQ

SEQ ID NO: 3188097 - protein, 21 aa, Giardia lamblia
HVPVPPRLGEVQRRPGGQDPQ

SEQ ID NO: 3188098 - protein, 19 aa, Giardia lamblia
HVPYPLPQGNDIYGPYSTG

SEQ ID NO: 3188099 - protein, 34 aa, Giardia lamblia
HVPYYSRRFDDDPTLFPILPSASAARILGYLDSL

SEQ ID NO: 3188100 - protein, 27 aa, Giardia lamblia
HVRETWPELFQKPEALPYNLDLTEPEI

SEQ ID NO: 3188101 - protein, 24 aa, Giardia lamblia
HVRGYTHCGSLVPWVAGASADGQE

SEQ ID NO: 3188102 - protein, 24 aa, Giardia lamblia
HVSALPMFTYTFNASAIRQGYQDE

SEQ ID NO: 3188103 - protein, 27 aa, Giardia lamblia
HVSLRDQPAPPLAYRPDFVPLHVLHPP

SEQ ID NO: 3188104 - protein, 18 aa, Giardia lamblia
HVSLSTQERRRRVEEKKQ

SEQ ID NO: 3188105 - protein, 23 aa, Giardia lamblia
HVSLTILPKRRAGFYKDIDLNLY

SEQ ID NO: 3188106 - protein, 17 aa, Giardia lamblia
HVTDLYLAQGLQALAPN

SEQ ID NO: 3188107 - protein, 18 aa, Giardia lamblia
HVTLLRILRMLASITYHN

SEQ ID NO: 3188108 - protein, 20 aa, Giardia lamblia
HVTPITGLDFKLLRQDIIDV

SEQ ID NO: 3188109 - protein, 17 aa, Giardia lamblia
HVYYLVDSCQYLSSFCT

SEQ ID NO: 3188110 - protein, 30 aa, Giardia lamblia
HWSNSPHLYLPFVRTILRNAEFHLLESYPF

SEQ ID NO: 3188111 - protein, 18 aa, Giardia lamblia
HYCQQLFMESLGKNYTRE

SEQ ID NO: 3188112 - protein, 17 aa, Giardia lamblia
HYECVRLLLIEAGYVDL

SEQ ID NO: 3188113 - protein, 18 aa, Giardia lamblia
HYEKGIGMFIPSLGAFFF

SEQ ID NO: 3188114 - protein, 27 aa, Giardia lamblia
HYENIKQKLLALSKSRELSIYKTQIET

SEQ ID NO: 3188115 - protein, 25 aa, Giardia lamblia
HYEYLNILQATGFPRVFTVFTHLDE

SEQ ID NO: 3188116 - protein, 25 aa, Giardia lamblia
HYGEVRPFGCSLLIAGYDSIASADE

SEQ ID NO: 3188117 - protein, 24 aa, Giardia lamblia
HYGTWDFSLRKLNLQFLLGLQTSK

SEQ ID NO: 3188118 - protein, 18 aa, Giardia lamblia
HYISWRRSIRMRAGDEGR

SEQ ID NO: 3188119 - protein, 19 aa, Giardia lamblia
HYMCYIDPAAGSRYGLSDQ

SEQ ID NO: 3188120 - protein, 30 aa, Giardia lamblia
HYPRLLLVVKRFFTGVYLFSSLSPVYSASI

SEQ ID NO: 3188121 - protein, 33 aa, Giardia lamblia
HYQEKLHTELPLNTFLLSTIDHDLPSTLPFNDL

SEQ ID NO: 3188122 - protein, 30 aa, Giardia lamblia
HYRAKCTPIGWIPYYEDLKSLFRSELDTDY

SEQ ID NO: 3188123 - protein, 30 aa, Giardia lamblia
HYSPQLRETLFSLLSLLPDSRPAAGDLLKS

SEQ ID NO: 3188124 - protein, 24 aa, Giardia lamblia
HYVKFVCLPCNHLIIHRVRENKIH

SEQ ID NO: 3188125 - protein, 27 aa, Giardia lamblia
HYVVRVGYLVTYWRALLDYQKKLMTQA

SEQ ID NO: 3188126 - protein, 19 aa, Giardia lamblia
IAAAKMLVISFARVQDPEG

SEQ ID NO: 3188127 - protein, 17 aa, Giardia lamblia
IAAAMSIVPFNYAFIAI

SEQ ID NO: 3188128 - protein, 26 aa, Giardia lamblia
IAAEKRLQLNPLLDPSMYSKGSTASR

SEQ ID NO: 3188129 - protein, 17 aa, Giardia lamblia
IAAELNKSKLCRRLVHF

SEQ ID NO: 3188130 - protein, 23 aa, Giardia lamblia
IAAICDDVAIIPLLLEHEKGLHD

SEQ ID NO: 3188131 - protein, 30 aa, Giardia lamblia
IAAIRALIREGRLPHMIFYGKPGTGKTTLI

SEQ ID NO: 3188132 - protein, 18 aa, Giardia lamblia
IAAPCLAILAQDGIVFVA

SEQ ID NO: 3188133 - protein, 17 aa, Giardia lamblia
IAAPVQPTPIAAPVQPV

SEQ ID NO: 3188134 - protein, 24 aa, Giardia lamblia
IAARMDAAILANKASFELRIAQLE

SEQ ID NO: 3188135 - protein, 25 aa, Giardia lamblia
IAASKNFVEIVRLLYRMESEMKDIY

SEQ ID NO: 3188136 - protein, 28 aa, Giardia lamblia
IAAYMGRSGIIPLLIKEEAKLCDSYGRT

SEQ ID NO: 3188137 - protein, 19 aa, Giardia lamblia
IACFQRLVRDITCSLPSGG

SEQ ID NO: 3188138 - protein, 21 aa, Giardia lamblia
IACVGALFFAEYSICTVRGES

SEQ ID NO: 3188139 - protein, 17 aa, Giardia lamblia
IADARHPYKYRMIVPEV

SEQ ID NO: 3188140 - protein, 17 aa, Giardia lamblia
IADFAMFGALVPVYGAV

SEQ ID NO: 3188141 - protein, 33 aa, Giardia lamblia
IADLIDQWAALPSERLSLIPKIGHPNTIVLVSR

SEQ ID NO: 3188142 - protein, 17 aa, Giardia lamblia
IADRYGSYTWACSNISV

SEQ ID NO: 3188143 - protein, 25 aa, Giardia lamblia
IADSLANCKWLIDLQKEFKAALDHY

SEQ ID NO: 3188144 - protein, 17 aa, Giardia lamblia
IADTILQSKISLPIPCM

SEQ ID NO: 3188145 - protein, 20 aa, Giardia lamblia
IAEHILPVTLCRISETSDGA

SEQ ID NO: 3188146 - protein, 26 aa, Giardia lamblia
IAERDRRIQCLIAALQNQEQSFKSLR

SEQ ID NO: 3188147 - protein, 19 aa, Giardia lamblia
IAFHGPWCKDCQYSIPVFN

SEQ ID NO: 3188148 - protein, 20 aa, Giardia lamblia
IAGLLGNILPRLKTGTPEDF

SEQ ID NO: 3188149 - protein, 23 aa, Giardia lamblia
IAGYNLFMHSLLVHSHRLSDISA

SEQ ID NO: 3188150 - protein, 17 aa, Giardia lamblia
IAHTIDRNIFMVHGGVP

SEQ ID NO: 3188151 - protein, 26 aa, Giardia lamblia
IAIDNTMVPYPIYLNASRNSKDDMVD

SEQ ID NO: 3188152 - protein, 34 aa, Giardia lamblia
IAIEQFIRLLSAMMYYRRSFPWYTSSIVAGIDSE

SEQ ID NO: 3188153 - protein, 18 aa, Giardia lamblia
IAIFLSIRGYNCTPGIIS

SEQ ID NO: 3188154 - protein, 17 aa, Giardia lamblia
IAILTKTITDLKAEIQI

SEQ ID NO: 3188155 - protein, 24 aa, Giardia lamblia
IAIQSAWTRLPALTTHLQSIINRA

SEQ ID NO: 3188156 - protein, 17 aa, Giardia lamblia
IAISERDKVIAQLVHEF

SEQ ID NO: 3188157 - protein, 19 aa, Giardia lamblia
IAKLIRTHVPLGRGGIGAV

SEQ ID NO: 3188158 - protein, 19 aa, Giardia lamblia
IALAEKTMYCFDNEAIRFL

SEQ ID NO: 3188159 - protein, 18 aa, Giardia lamblia
IALHLLLNMLNLSVKDKS

SEQ ID NO: 3188160 - protein, 21 aa, Giardia lamblia
IALLRDFRPSNFFLSSRGIIQ

SEQ ID NO: 3188161 - protein, 28 aa, Giardia lamblia
IALQLDHLKVATLLLNWEGLDISVYSSE

SEQ ID NO: 3188162 - protein, 35 aa, Giardia lamblia
IALSLTLAECQILRSLNFLLKHLISENQKVAAQDS

SEQ ID NO: 3188163 - protein, 28 aa, Giardia lamblia
IAMEAFAKALRSIPVIIANNGGYDGEEL

SEQ ID NO: 3188164 - protein, 25 aa, Giardia lamblia
IANEAGAYFFLLNGAEIMSSMAGES

SEQ ID NO: 3188165 - protein, 23 aa, Giardia lamblia
IANLQFVLSNFESCRKLPPPSRS

SEQ ID NO: 3188166 - protein, 27 aa, Giardia lamblia
IANLQVKDLLPWQSELLLKTVPLETQK

SEQ ID NO: 3188167 - protein, 30 aa, Giardia lamblia
IANSFFIGQIPQGWLRFAPQTLKMLSNWIQ

SEQ ID NO: 3188168 - protein, 20 aa, Giardia lamblia
IAPEVLLGDKLTPAADMWSL

SEQ ID NO: 3188169 - protein, 32 aa, Giardia lamblia
IAPQINHRIALNDPLPQDLTIGPISSYHTDYS

SEQ ID NO: 3188170 - protein, 32 aa, Giardia lamblia
IAPYYSVPIGYTSLLFAILCKDAYSVQLLNSE

SEQ ID NO: 3188171 - protein, 19 aa, Giardia lamblia
IAQIMHPPRNIYGCKKQMK

SEQ ID NO: 3188172 - protein, 21 aa, Giardia lamblia
IAQITCRAVIKLELCPHKAAR

SEQ ID NO: 3188173 - protein, 23 aa, Giardia lamblia
IAQKSIQFFYRPSGSMSPSGSTR

SEQ ID NO: 3188174 - protein, 26 aa, Giardia lamblia
IARDFEVYFLQPISLTYGKPGVDFVE

SEQ ID NO: 3188175 - protein, 24 aa, Giardia lamblia
IARDYPLMKNLLYSLKASAMKEER

SEQ ID NO: 3188176 - protein, 25 aa, Giardia lamblia
IARHKTLCKLYFKACIQKIEDLILF

SEQ ID NO: 3188177 - protein, 19 aa, Giardia lamblia
IARIILKDMLKGKLVWISL

SEQ ID NO: 3188178 - protein, 18 aa, Giardia lamblia
IARLLPGVTETILPGLSL

SEQ ID NO: 3188179 - protein, 17 aa, Giardia lamblia
IARQIIVTSFSLLRHGL

SEQ ID NO: 3188180 - protein, 25 aa, Giardia lamblia
IASGRKFIRSFKAYNYQFYQVKQGY

SEQ ID NO: 3188181 - protein, 29 aa, Giardia lamblia
IASIERINKAWLLKTLLYQAKQVNNHGKT

SEQ ID NO: 3188182 - protein, 17 aa, Giardia lamblia
IASLRSSSFLQLRPTTE

SEQ ID NO: 3188183 - protein, 28 aa, Giardia lamblia
IASMADFWYVVFRLKVVFIANLTRFIDD

SEQ ID NO: 3188184 - protein, 22 aa, Giardia lamblia
IASRRGLFSIVRLLLSELGIRS

SEQ ID NO: 3188185 - protein, 24 aa, Giardia lamblia
IASRSWDIMLHCYEYLHDNKTYYT

SEQ ID NO: 3188186 - protein, 17 aa, Giardia lamblia
IASRVTLGSPHKSQHKS

SEQ ID NO: 3188187 - protein, 19 aa, Giardia lamblia
IATRKNLLRIPRRPAWCVG

SEQ ID NO: 3188188 - protein, 24 aa, Giardia lamblia
IATSCHAGLLLRIGYRSLVALHTK

SEQ ID NO: 3188189 - protein, 23 aa, Giardia lamblia
IATSILQSLSLPAGIPITMDTTN

SEQ ID NO: 3188190 - protein, 23 aa, Giardia lamblia
IATTPYVMVALNKLLISGKDVSE

SEQ ID NO: 3188191 - protein, 19 aa, Giardia lamblia
IAVKKGLISLAEALIPYEA

SEQ ID NO: 3188192 - protein, 18 aa, Giardia lamblia
IAVKLLRKLEAKMTLGTF

SEQ ID NO: 3188193 - protein, 26 aa, Giardia lamblia
IAWTASLRYKLEFIYERISKISRVLG

SEQ ID NO: 3188194 - protein, 21 aa, Giardia lamblia
IAYCLILQIFTLLNNELDTEN

SEQ ID NO: 3188195 - protein, 21 aa, Giardia lamblia
IAYRIKYCRHPLTGSAWCIYP

SEQ ID NO: 3188196 - protein, 19 aa, Giardia lamblia
ICAARRSLFNNWLAKYKDL

SEQ ID NO: 3188197 - protein, 31 aa, Giardia lamblia
ICAGDSKYIIVYLYKTWPYTLVGKYQITIDK

SEQ ID NO: 3188198 - protein, 25 aa, Giardia lamblia
ICAQLSMLVPLDRSDMIYAPTFTTE

SEQ ID NO: 3188199 - protein, 17 aa, Giardia lamblia
ICEYLPALCDANMFLRT

SEQ ID NO: 3188200 - protein, 18 aa, Giardia lamblia
ICFKVKMTTALSKVFDAY

SEQ ID NO: 3188201 - protein, 35 aa, Giardia lamblia
ICFYTSVCAPIFSIDLPYVPFYTAGSGNYLVCASS

SEQ ID NO: 3188202 - protein, 30 aa, Giardia lamblia
ICIEFSFCGNYILYYALPTDVEINLFRLGS

SEQ ID NO: 3188203 - protein, 21 aa, Giardia lamblia
ICIGLLFFNTYVHVLARMSPS

SEQ ID NO: 3188204 - protein, 26 aa, Giardia lamblia
ICISNHLITFPYTDPTKFKPLTEKIY

SEQ ID NO: 3188205 - protein, 23 aa, Giardia lamblia
ICKMLEVCILPSPDKAFIDELLK

SEQ ID NO: 3188206 - protein, 17 aa, Giardia lamblia
ICLQTPFDWGSQSWTLA

SEQ ID NO: 3188207 - protein, 23 aa, Giardia lamblia
ICLSDLCIMTCIPCGHRCACIAC

SEQ ID NO: 3188208 - protein, 32 aa, Giardia lamblia
ICNFYSERLRKLVQMLLSINPLDRPSAAELLG

SEQ ID NO: 3188209 - protein, 29 aa, Giardia lamblia
ICPISKLLIYSVFLDLLGLATYLFTITDD

SEQ ID NO: 3188210 - protein, 26 aa, Giardia lamblia
ICPYLSIVTNLAFWNKLRDFCCVGCK

SEQ ID NO: 3188211 - protein, 32 aa, Giardia lamblia
ICQIMFETFAVPAFYVQVQAVLALYSSGRTTG

SEQ ID NO: 3188212 - protein, 29 aa, Giardia lamblia
ICQRIELVKAIIRFLYLPDFCHVCCRDKS

SEQ ID NO: 3188213 - protein, 24 aa, Giardia lamblia
ICRALALAKHRCLVLRYARLEKWF

SEQ ID NO: 3188214 - protein, 26 aa, Giardia lamblia
ICRICRYPLYKPVVLNCAHTFCAECM

SEQ ID NO: 3188215 - protein, 20 aa, Giardia lamblia
ICRSQGFFPLEEAPVIFEAN

SEQ ID NO: 3188216 - protein, 23 aa, Giardia lamblia
ICSKLIRYVSKWCYTDIRRGREF

SEQ ID NO: 3188217 - protein, 19 aa, Giardia lamblia
ICSLFPGCLPTLTSREDQC

SEQ ID NO: 3188218 - protein, 18 aa, Giardia lamblia
ICSLIGPIPRDMIMSGRM

SEQ ID NO: 3188219 - protein, 20 aa, Giardia lamblia
ICTSLRSGAFLYSGKEYSSF

SEQ ID NO: 3188220 - protein, 19 aa, Giardia lamblia
ICTTACDNVYFTSDKVPIL

SEQ ID NO: 3188221 - protein, 18 aa, Giardia lamblia
ICVLFRPKDYFIAGGILA

SEQ ID NO: 3188222 - protein, 21 aa, Giardia lamblia
ICYDCLSAKKYWHFIRLMGRS

SEQ ID NO: 3188223 - protein, 20 aa, Giardia lamblia
ICYEARVPYIIIRAISDSGS

SEQ ID NO: 3188224 - protein, 27 aa, Giardia lamblia
IDAGRLFQIILFQRTPAELRYETFASA

SEQ ID NO: 3188225 - protein, 23 aa, Giardia lamblia
IDALGRRFLLQPTKFTASFIYQS

SEQ ID NO: 3188226 - protein, 32 aa, Giardia lamblia
IDALILAARHNDVISTWTLLKTHARYQDDQGR

SEQ ID NO: 3188227 - protein, 41 aa, Giardia lamblia
IDALKELISRPPLTEKLLSRPPFKYILDICKAVSAATGFPS

SEQ ID NO: 3188228 - protein, 18 aa, Giardia lamblia
IDALLEYFSGHKRLTRYL

SEQ ID NO: 3188229 - protein, 18 aa, Giardia lamblia
IDALWLLHISNSVHYPRL

SEQ ID NO: 3188230 - protein, 23 aa, Giardia lamblia
IDANGMCYLITTPSSTQPAGLTT

SEQ ID NO: 3188231 - protein, 17 aa, Giardia lamblia
IDANRILGKSYTDEDLR

SEQ ID NO: 3188232 - protein, 30 aa, Giardia lamblia
IDCSICQLYRLYVWGFRTINYSATDLLAHG

SEQ ID NO: 3188233 - protein, 23 aa, Giardia lamblia
IDDALALMILGLSTTVQLVGVSC

SEQ ID NO: 3188234 - protein, 18 aa, Giardia lamblia
IDDIIDKAPLLYSRDRQG

SEQ ID NO: 3188235 - protein, 28 aa, Giardia lamblia
IDDLEAFAQLAFLKQDPLFETADTSIRA

SEQ ID NO: 3188236 - protein, 19 aa, Giardia lamblia
IDDLTVLCAPLNRMISIVR

SEQ ID NO: 3188237 - protein, 27 aa, Giardia lamblia
IDDYSSRRFFPSFLGKVTVLSSEPATI

SEQ ID NO: 3188238 - protein, 26 aa, Giardia lamblia
IDECSLEYLFNILRSLPLTESVVRTV

SEQ ID NO: 3188239 - protein, 26 aa, Giardia lamblia
IDELFAKYMDFDALKRAKLDGAPLEA

SEQ ID NO: 3188240 - protein, 24 aa, Giardia lamblia
IDELRTIRMPQYRSILLRYENIPI

SEQ ID NO: 3188241 - protein, 24 aa, Giardia lamblia
IDENDGLYLDDAGNWRRIGDVAVK

SEQ ID NO: 3188242 - protein, 25 aa, Giardia lamblia
IDERYLKTSFFLPFYDVTADEMRQI

SEQ ID NO: 3188243 - protein, 29 aa, Giardia lamblia
IDEVFGPITGYYFTVKLHPNVTPKGFAVG

SEQ ID NO: 3188244 - protein, 19 aa, Giardia lamblia
IDEWASLKMPEYKVRIPYL

SEQ ID NO: 3188245 - protein, 21 aa, Giardia lamblia
IDFAKNDLVVRFIQGLAVKQK

SEQ ID NO: 3188246 - protein, 17 aa, Giardia lamblia
IDFGLAQTLREVREFPL

SEQ ID NO: 3188247 - protein, 24 aa, Giardia lamblia
IDGAALDWGLLTRKIFSVAATQDL

SEQ ID NO: 3188248 - protein, 18 aa, Giardia lamblia
IDGIIDSMRQSCDFVYVS

SEQ ID NO: 3188249 - protein, 22 aa, Giardia lamblia
IDGKDYLAQLTPFDGSTPNHLR

SEQ ID NO: 3188250 - protein, 27 aa, Giardia lamblia
IDGKKGGRFLSFRTAPGAALTEIFHGR

SEQ ID NO: 3188251 - protein, 27 aa, Giardia lamblia
IDGWTALMFAVLYNKLESLPTLAATEA

SEQ ID NO: 3188252 - protein, 20 aa, Giardia lamblia
IDHEFLLLTKTNVSRCAFNG

SEQ ID NO: 3188253 - protein, 18 aa, Giardia lamblia
IDIDSMISAALVPQQPSP

SEQ ID NO: 3188254 - protein, 19 aa, Giardia lamblia
IDILFSFLKSKSNSKIVIF

SEQ ID NO: 3188255 - protein, 35 aa, Giardia lamblia
IDIVSCLQLNSSFKLFIRSFDRRNLYYRIMYVGPN

SEQ ID NO: 3188256 - protein, 19 aa, Giardia lamblia
IDIVTEGFMFLAVTFEHPQ

SEQ ID NO: 3188257 - protein, 26 aa, Giardia lamblia
IDIWALGCAIYRFCHGTDIFSQPQKA

SEQ ID NO: 3188258 - protein, 24 aa, Giardia lamblia
IDKDLTPLLVSSLAPREVDRILSI

SEQ ID NO: 3188259 - protein, 21 aa, Giardia lamblia
IDKDRIIDFGLVAFSFSSSKD

SEQ ID NO: 3188260 - protein, 26 aa, Giardia lamblia
IDKISGYIYLVKWRDLPYSQVTDEYY

SEQ ID NO: 3188261 - protein, 20 aa, Giardia lamblia
IDKMAYIYKLCKQILEALKE

SEQ ID NO: 3188262 - protein, 18 aa, Giardia lamblia
IDLIEPIYIKLVETAMLL

SEQ ID NO: 3188263 - protein, 26 aa, Giardia lamblia
IDLLSEEYLAWLLRYNKSTITNGHLG

SEQ ID NO: 3188264 - protein, 26 aa, Giardia lamblia
IDLNRSTLLQYNLHVKELKRRRFLEL

SEQ ID NO: 3188265 - protein, 23 aa, Giardia lamblia
IDLPTIIPYIFTSDRVMLHYCSF

SEQ ID NO: 3188266 - protein, 30 aa, Giardia lamblia
IDMLEGSIRPLRLLAIKFFDTLAQRVTAFA

SEQ ID NO: 3188267 - protein, 17 aa, Giardia lamblia
IDMNPSLLKPGSLAPEN

SEQ ID NO: 3188268 - protein, 27 aa, Giardia lamblia
IDNIRLADAALFIQNLIRGAAAQVRLY

SEQ ID NO: 3188269 - protein, 34 aa, Giardia lamblia
IDNKTQLAVMAFSRALLAIPRQLAVNSALDATKL

SEQ ID NO: 3188270 - protein, 23 aa, Giardia lamblia
IDNMVHYISVVGFRHAKTVFNKQ

SEQ ID NO: 3188271 - protein, 26 aa, Giardia lamblia
IDNNPGAILIRRSGPYAPTLHRYPSD

SEQ ID NO: 3188272 - protein, 23 aa, Giardia lamblia
IDNTLTMMDLQPAYKNGKIVLTP

SEQ ID NO: 3188273 - protein, 25 aa, Giardia lamblia
IDPAFNAELLSYLEKSKLTSTTNVS

SEQ ID NO: 3188274 - protein, 23 aa, Giardia lamblia
IDPALFSCFSQLTPLTASSAYYR

SEQ ID NO: 3188275 - protein, 28 aa, Giardia lamblia
IDPHDPKLLLHLLMAKELFCTALPRMPR

SEQ ID NO: 3188276 - protein, 59 aa, Giardia lamblia
IDPIFRNHFVDLATRKLKFVRVQHAFVPWLRRYHGRCRPTFLFFVGGSLKEIVEGIDTP

SEQ ID NO: 3188277 - protein, 28 aa, Giardia lamblia
IDPSFNLSPLMFHKSIGPGLLGLSFRQD

SEQ ID NO: 3188278 - protein, 24 aa, Giardia lamblia
IDQAPKNIKPLTAPYTSSLDAARH

SEQ ID NO: 3188279 - protein, 25 aa, Giardia lamblia
IDQPPKVLFVPLPLLHLDATNDVYT

SEQ ID NO: 3188280 - protein, 19 aa, Giardia lamblia
IDRFTFVHWAAQYAKKSMA

SEQ ID NO: 3188281 - protein, 22 aa, Giardia lamblia
IDRKIYVGLPDLTARRQIFKIH

SEQ ID NO: 3188282 - protein, 30 aa, Giardia lamblia
IDRLKTLLDKAQAEVLLFRTTNDGIRKQLK

SEQ ID NO: 3188283 - protein, 21 aa, Giardia lamblia
IDRLKYIISAYSVNIAQEQPA

SEQ ID NO: 3188284 - protein, 36 aa, Giardia lamblia
IDRTMANIGVIILGIDNLYLRCLATSKIGREYESKL

SEQ ID NO: 3188285 - protein, 21 aa, Giardia lamblia
IDSGFFYDAFFENSLKMEPES

SEQ ID NO: 3188286 - protein, 18 aa, Giardia lamblia
IDSLQRLLLQVEPQLVFW

SEQ ID NO: 3188287 - protein, 20 aa, Giardia lamblia
IDSYMKILNLYLHFSENITT

SEQ ID NO: 3188288 - protein, 21 aa, Giardia lamblia
IDSYPAIRYFFNLADGDHDGL

SEQ ID NO: 3188289 - protein, 28 aa, Giardia lamblia
IDTAGIQYLITLQGILEIVREDAPFSIK

SEQ ID NO: 3188290 - protein, 25 aa, Giardia lamblia
IDTANILDITLLKKEYSKAIMECER

SEQ ID NO: 3188291 - protein, 20 aa, Giardia lamblia
IDTIAPVLVRIVLLLKASTG

SEQ ID NO: 3188292 - protein, 17 aa, Giardia lamblia
IDTIPGPGAYSIATHLS

SEQ ID NO: 3188293 - protein, 25 aa, Giardia lamblia
IDTLVAFYETLLKHSVNTDAFHAIS

SEQ ID NO: 3188294 - protein, 24 aa, Giardia lamblia
IDTPRLDTLIPQLAPENEVPLEKF

SEQ ID NO: 3188295 - protein, 29 aa, Giardia lamblia
IDTVIRAPHPLLYTSLPSPLMALQRNSIN

SEQ ID NO: 3188296 - protein, 35 aa, Giardia lamblia
IDVFMDIPTTDGYLLRVFVIAFTDRFRFQRRKNCH

SEQ ID NO: 3188297 - protein, 28 aa, Giardia lamblia
IDVMRSEHKPPMVPSFHAGATDVMGRCD

SEQ ID NO: 3188298 - protein, 22 aa, Giardia lamblia
IDVQDFLTMYDAIALRGSVKGR

SEQ ID NO: 3188299 - protein, 18 aa, Giardia lamblia
IDYARTKADIRKILQGLE

SEQ ID NO: 3188300 - protein, 21 aa, Giardia lamblia
IDYIFLRLHYCIGIKAFANGR

SEQ ID NO: 3188301 - protein, 26 aa, Giardia lamblia
IDYSTLFDYLGFFLSEFQRENASFNS

SEQ ID NO: 3188302 - protein, 29 aa, Giardia lamblia
IEADIANLRLQWELTLNAIEKRSANIRTI

SEQ ID NO: 3188303 - protein, 17 aa, Giardia lamblia
IEALPTTLRLMTLWFRY

SEQ ID NO: 3188304 - protein, 22 aa, Giardia lamblia
IEANVVLPPRLPQLAPAMNQRS

SEQ ID NO: 3188305 - protein, 25 aa, Giardia lamblia
IEARLEVAGILWGLGISVGMSCKEG

SEQ ID NO: 3188306 - protein, 26 aa, Giardia lamblia
IEARTLLGRVHTMELLLDQSAQTIGE

SEQ ID NO: 3188307 - protein, 24 aa, Giardia lamblia
IEATAEIVLNETFAFMACSARNSV

SEQ ID NO: 3188308 - protein, 27 aa, Giardia lamblia
IEAVKMGDLPGLKRYLQEHSGFVDDLG

SEQ ID NO: 3188309 - protein, 24 aa, Giardia lamblia
IECGDIFINTLRLASNYKKELRSK

SEQ ID NO: 3188310 - protein, 20 aa, Giardia lamblia
IECITALPKLMVENQFSLVI

SEQ ID NO: 3188311 - protein, 19 aa, Giardia lamblia
IECKLPNQIIRLKSELTPA

SEQ ID NO: 3188312 - protein, 25 aa, Giardia lamblia
IECSLCRYLYVQGNIYKIPTGEHVA

SEQ ID NO: 3188313 - protein, 25 aa, Giardia lamblia
IECTFLLKTTLLEPAGYEKLYEKVS

SEQ ID NO: 3188314 - protein, 24 aa, Giardia lamblia
IEDKSMQINFLVNSLDIINAQLIE

SEQ ID NO: 3188315 - protein, 19 aa, Giardia lamblia
IEDLIIQRIAELHKSVHHR

SEQ ID NO: 3188316 - protein, 25 aa, Giardia lamblia
IEDTLSWIVSLIRDCYLYLQLTSAI

SEQ ID NO: 3188317 - protein, 25 aa, Giardia lamblia
IEEATFMNTGLLPKAVNKLSSGYAH

SEQ ID NO: 3188318 - protein, 21 aa, Giardia lamblia
IEEFMLVFFEASLNSNLLDIL

SEQ ID NO: 3188319 - protein, 17 aa, Giardia lamblia
IEEKDALLAQFNEQLIA

SEQ ID NO: 3188320 - protein, 37 aa, Giardia lamblia
IEEKTIWGFIADLLDLLQFILLPHKQYFADDEHIDFI

SEQ ID NO: 3188321 - protein, 29 aa, Giardia lamblia
IEFIKRVYTPFGIDFALSLSLRPEKKMGS

SEQ ID NO: 3188322 - protein, 17 aa, Giardia lamblia
IEFVYAFCKERDLLGRI

SEQ ID NO: 3188323 - protein, 18 aa, Giardia lamblia
IEGCLRINPTSRLTITEV

SEQ ID NO: 3188324 - protein, 26 aa, Giardia lamblia
IEGNVPPDLLYATDYRDAPYSMKTQS

SEQ ID NO: 3188325 - protein, 26 aa, Giardia lamblia
IEGYALACNPVRSLWLAGDCQGFLRA

SEQ ID NO: 3188326 - protein, 25 aa, Giardia lamblia
IEHLDNLFINKIDPGKYFPIDEGYL

SEQ ID NO: 3188327 - protein, 29 aa, Giardia lamblia
IEHPDGIRIPWPEYIIDLPKLDRYGASQD

SEQ ID NO: 3188328 - protein, 17 aa, Giardia lamblia
IEIAFEMLHLEIVNVLM

SEQ ID NO: 3188329 - protein, 18 aa, Giardia lamblia
IEIAKFLENVMNNIIFID

SEQ ID NO: 3188330 - protein, 20 aa, Giardia lamblia
IEICKRFHVPGRPTAMELYM

SEQ ID NO: 3188331 - protein, 26 aa, Giardia lamblia
IEIESLFEGIDFFTNITRAKFEDLCI

SEQ ID NO: 3188332 - protein, 18 aa, Giardia lamblia
IEILEIYAISLDPPQDDG

SEQ ID NO: 3188333 - protein, 17 aa, Giardia lamblia
IEINLVPTCGFFITMNP

SEQ ID NO: 3188334 - protein, 28 aa, Giardia lamblia
IEISRVFTMLLLFVKNQINLCFFDEEYD

SEQ ID NO: 3188335 - protein, 29 aa, Giardia lamblia
IEKADAIFFQYPVYWYNCPASMKAFLDCV

SEQ ID NO: 3188336 - protein, 28 aa, Giardia lamblia
IEKAHPKILTILLQILDEGRLTDGKGNC

SEQ ID NO: 3188337 - protein, 21 aa, Giardia lamblia
IEKFATWCPPCRAMIPHLSKM

SEQ ID NO: 3188338 - protein, 18 aa, Giardia lamblia
IEKLMEKLSKLKKTSQVA

SEQ ID NO: 3188339 - protein, 17 aa, Giardia lamblia
IEKMRLETEWKGVLEQC

SEQ ID NO: 3188340 - protein, 26 aa, Giardia lamblia
IEKTDQFFFVVMKYYPKSLDQLIKTA

SEQ ID NO: 3188341 - protein, 26 aa, Giardia lamblia
IEKWVVNLLPSRLFGHIILTTSQGIM

SEQ ID NO: 3188342 - protein, 19 aa, Giardia lamblia
IELANDYKTLRTLGIDVSN

SEQ ID NO: 3188343 - protein, 31 aa, Giardia lamblia
IELAQLISALPRLRLIGLMTIGAPDASEYSF

SEQ ID NO: 3188344 - protein, 17 aa, Giardia lamblia
IELGSIENIYFGTHLLY

SEQ ID NO: 3188345 - protein, 25 aa, Giardia lamblia
IELNGMLVFCLLTLISDTILTNHFC

SEQ ID NO: 3188346 - protein, 25 aa, Giardia lamblia
IELNPRFLDGYLARGVLYAELHRFE

SEQ ID NO: 3188347 - protein, 24 aa, Giardia lamblia
IEMRQKILNLEKLNKMLQIQARSD

SEQ ID NO: 3188348 - protein, 17 aa, Giardia lamblia
IEMVEVPMMPMVIYRTH

SEQ ID NO: 3188349 - protein, 23 aa, Giardia lamblia
IENDPLYNPLPERLQENALTAEE

SEQ ID NO: 3188350 - protein, 40 aa, Giardia lamblia
IENFTVQSIYQLPLLIKHVPALVFNLFNVIPIRATAEKEA

SEQ ID NO: 3188351 - protein, 26 aa, Giardia lamblia
IENGACGCFFILSRSRWSYLTTYLDP

SEQ ID NO: 3188352 - protein, 18 aa, Giardia lamblia
IENGLAQALTLADRTRFR

SEQ ID NO: 3188353 - protein, 25 aa, Giardia lamblia
IENTFKLFFIDIAQDVKLGSIQAHV

SEQ ID NO: 3188354 - protein, 18 aa, Giardia lamblia
IENVYLWDNVRIKNGAYG

SEQ ID NO: 3188355 - protein, 25 aa, Giardia lamblia
IEPCKGLLFYGSPGSGKTLTARAVA

SEQ ID NO: 3188356 - protein, 25 aa, Giardia lamblia
IEPGFYMHATRFDWSKAIPPTAFSN

SEQ ID NO: 3188357 - protein, 28 aa, Giardia lamblia
IEPMAYKLAFSFFFKQGAYQYASGAMMR

SEQ ID NO: 3188358 - protein, 18 aa, Giardia lamblia
IEPPVIPSTSSIFSKREV

SEQ ID NO: 3188359 - protein, 26 aa, Giardia lamblia
IEPSRGALLWGPPGTGKSLLAKAIAN

SEQ ID NO: 3188360 - protein, 21 aa, Giardia lamblia
IEPVSEFYIPSDVLYCNDCET

SEQ ID NO: 3188361 - protein, 25 aa, Giardia lamblia
IEQADGPALHHRKPGRLITSEGEEI

SEQ ID NO: 3188362 - protein, 20 aa, Giardia lamblia
IEQCHIEYDKARWVNADPSE

SEQ ID NO: 3188363 - protein, 23 aa, Giardia lamblia
IEQDPYFRLARDLAPRMGHPKNA

SEQ ID NO: 3188364 - protein, 27 aa, Giardia lamblia
IEQKFQDPFRILPILTSSPELQQANEQ

SEQ ID NO: 3188365 - protein, 25 aa, Giardia lamblia
IEQLIPSIRSIMDARRGYLHQKLKA

SEQ ID NO: 3188366 - protein, 19 aa, Giardia lamblia
IEQLVGKLRPCELGLPKHS

SEQ ID NO: 3188367 - protein, 17 aa, Giardia lamblia
IEQYREMLLKQKDIIIS

SEQ ID NO: 3188368 - protein, 23 aa, Giardia lamblia
IERDRFLAVMRLIIRRCSATSNK

SEQ ID NO: 3188369 - protein, 20 aa, Giardia lamblia
IERGLRVKNFELPYSCFSTT

SEQ ID NO: 3188370 - protein, 19 aa, Giardia lamblia
IERKKLYDKHDKEIAVLEY

SEQ ID NO: 3188371 - protein, 17 aa, Giardia lamblia
IERLQLWGETQKLDIAR

SEQ ID NO: 3188372 - protein, 27 aa, Giardia lamblia
IERMQMAVLLRIVAERHGPMARRMFNI

SEQ ID NO: 3188373 - protein, 24 aa, Giardia lamblia
IERNRQEIDLLRASLSTKDKRVTS

SEQ ID NO: 3188374 - protein, 17 aa, Giardia lamblia
IERPLMCTLNIGRIVRP

SEQ ID NO: 3188375 - protein, 23 aa, Giardia lamblia
IERQTLLFSATFPKEIKNLAMEF

SEQ ID NO: 3188376 - protein, 22 aa, Giardia lamblia
IERVCRFMSNTTLREWRRIFSF

SEQ ID NO: 3188377 - protein, 21 aa, Giardia lamblia
IERVYCDVTQPLKIDKKKEAK

SEQ ID NO: 3188378 - protein, 23 aa, Giardia lamblia
IESDQILDRQISLSPKTVTSDVS

SEQ ID NO: 3188379 - protein, 24 aa, Giardia lamblia
IESHPIRIRCLTGVPTLAVESDRL

SEQ ID NO: 3188380 - protein, 26 aa, Giardia lamblia
IESLNKLLPLMDKWFHAEPEVHRLYF

SEQ ID NO: 3188381 - protein, 18 aa, Giardia lamblia
IESMLKYDSSSRSFLVVD

SEQ ID NO: 3188382 - protein, 25 aa, Giardia lamblia
IESTVLGMIPELKASILAACEAELT

SEQ ID NO: 3188383 - protein, 22 aa, Giardia lamblia
IESVRMPPIQPAASASLVVDMD

SEQ ID NO: 3188384 - protein, 25 aa, Giardia lamblia
IETLADLRSFLSPQIKQLDISNNRL

SEQ ID NO: 3188385 - protein, 18 aa, Giardia lamblia
IETPIDFYRQCKGAFRIT

SEQ ID NO: 3188386 - protein, 18 aa, Giardia lamblia
IETRACKLVQTDRKRRTF

SEQ ID NO: 3188387 - protein, 21 aa, Giardia lamblia
IETRFCHFDFVLPDPSTRRVM

SEQ ID NO: 3188388 - protein, 18 aa, Giardia lamblia
IEVCSLLLKKEQCLRTQD

SEQ ID NO: 3188389 - protein, 18 aa, Giardia lamblia
IEVLHQRLDELQRLNGIL

SEQ ID NO: 3188390 - protein, 24 aa, Giardia lamblia
IEVYGRLFMYQTPYMDIPMDKSTK

SEQ ID NO: 3188391 - protein, 30 aa, Giardia lamblia; identical to SEQ ID NO: 3157664

SEQ ID NO: 3188392 - protein, 20 aa, Giardia lamblia
IEYSLMHALIQSGELMNFVV

SEQ ID NO: 3188393 - protein, 24 aa, Giardia lamblia
IEYYETQILQRIALLSLCAESERR

SEQ ID NO: 3188394 - protein, 25 aa, Giardia lamblia
IFANAKLLKPFSGSILRLIERQTTH

SEQ ID NO: 3188395 - protein, 17 aa, Giardia lamblia
IFASKWLHNNVTTIPTL

SEQ ID NO: 3188396 - protein, 18 aa, Giardia lamblia
IFDELHLVGTTRGYVLES

SEQ ID NO: 3188397 - protein, 18 aa, Giardia lamblia
IFDIIGFELCLSENYVLI

SEQ ID NO: 3188398 - protein, 17 aa, Giardia lamblia
IFEREPKYIPIFERMLE

SEQ ID NO: 3188399 - protein, 20 aa, Giardia lamblia
IFEYDWNQQVFWADIPSLLD

SEQ ID NO: 3188400 - protein, 18 aa, Giardia lamblia
IFGIRRRPRQMATDTSSV

SEQ ID NO: 3188401 - protein, 30 aa, Giardia lamblia
IFIAQRLGDPLVLLRLLIQQGSWSQVEALG

SEQ ID NO: 3188402 - protein, 19 aa, Giardia lamblia
IFIDCGECWKLLQKYGSAI

SEQ ID NO: 3188403 - protein, 17 aa, Giardia lamblia
IFIIAATNRIDIIDPGL

SEQ ID NO: 3188404 - protein, 17 aa, Giardia lamblia
IFKAFLESYYNKDTLNQ

SEQ ID NO: 3188405 - protein, 17 aa, Giardia lamblia
IFKLLRDGMSAASCKDY

SEQ ID NO: 3188406 - protein, 19 aa, Giardia lamblia
IFKYIIVGDSAVGKSCLLL

SEQ ID NO: 3188407 - protein, 25 aa, Giardia lamblia
IFLSQALTVFIVDPLGVAFSSYCWA

SEQ ID NO: 3188408 - protein, 20 aa, Giardia lamblia
IFLTSLVTPLQAPPVFITDA

SEQ ID NO: 3188409 - protein, 21 aa, Giardia lamblia
IFNCYNTCLLCLESQHYFLIM

SEQ ID NO: 3188410 - protein, 21 aa, Giardia lamblia
IFNRQIYKRLLVSRVLDNASV

SEQ ID NO: 3188411 - protein, 25 aa, Giardia lamblia
IFNVPRHPVMYTRTGYILRLHITNF

SEQ ID NO: 3188412 - protein, 18 aa, Giardia lamblia
IFPMDLKESLRQAYLNTD

SEQ ID NO: 3188413 - protein, 26 aa, Giardia lamblia
IFRDTLTVMPLIWRRPDAVISQIAPH

SEQ ID NO: 3188414 - protein, 32 aa, Giardia lamblia
IFSEECFHLSLYMRLFTARVLTIMEQDKLSTV

SEQ ID NO: 3188415 - protein, 17 aa, Giardia lamblia
IFSMFTGGGRSSNRGPK

SEQ ID NO: 3188416 - protein, 17 aa, Giardia lamblia
IFSPYFNSSRYTSFETL

SEQ ID NO: 3188417 - protein, 21 aa, Giardia lamblia
IFSRWRFLYAMRRDQLNDAIN

SEQ ID NO: 3188418 - protein, 25 aa, Giardia lamblia
IFTGCLDKFLRVYIPGSREPLCSHY

SEQ ID NO: 3188419 - protein, 17 aa, Giardia lamblia
IFVLGLLLSISSSDFCA

SEQ ID NO: 3188420 - protein, 18 aa, Giardia lamblia
IFVRPRESTVRRVDLGIG

SEQ ID NO: 3188421 - protein, 40 aa, Giardia lamblia
IFYTTLQWEESNLFLFFVSLFRFFLHTCKLPNHGFRFQSA

SEQ ID NO: 3188422 - protein, 20 aa, Giardia lamblia
IGAIAYELATLRKPDFLGGR

SEQ ID NO: 3188423 - protein, 19 aa, Giardia lamblia
IGDFLPRRSRREINTVNDL

SEQ ID NO: 3188424 - protein, 20 aa, Giardia lamblia
IGESLRRRLRMFPALSSCMT

SEQ ID NO: 3188425 - protein, 25 aa, Giardia lamblia
IGEVNLVKFLAPGFGNRIVTCSNDR

SEQ ID NO: 3188426 - protein, 32 aa, Giardia lamblia
IGEVPTPVRILRFMSPFYPDLTQKHVQSKLQK

SEQ ID NO: 3188427 - protein, 32 aa, Giardia lamblia
IGFAPAAYILFKEFLQFDPSDPLWINRDRFVL

SEQ ID NO: 3188428 - protein, 25 aa, Giardia lamblia
IGFDFNHYYIFDEKLPYSKAYVNHA

SEQ ID NO: 3188429 - protein, 21 aa, Giardia lamblia
IGFQHGIGLSLPLPSAPDSGL

SEQ ID NO: 3188430 - protein, 18 aa, Giardia lamblia
IGGHRSFKRIKCGVALGI

SEQ ID NO: 3188431 - protein, 18 aa, Giardia lamblia
IGGLQPCSRPHSRPMTGP

SEQ ID NO: 3188432 - protein, 19 aa, Giardia lamblia
IGGMFFAPTSLADVQNLLP

SEQ ID NO: 3188433 - protein, 19 aa, Giardia lamblia
IGGVIRKLSRFTDPELRVC

SEQ ID NO: 3188434 - protein, 17 aa, Giardia lamblia
IGGYLYGAGSGSTFAFG

SEQ ID NO: 3188435 - protein, 23 aa, Giardia lamblia
IGIDRLVMLLTNSSTIREVIAFP

SEQ ID NO: 3188436 - protein, 18 aa, Giardia lamblia
IGIIIHRDIKPQNILIGN

SEQ ID NO: 3188437 - protein, 24 aa, Giardia lamblia
IGINTALFHVFGIDPSTGMLVGVA

SEQ ID NO: 3188438 - protein, 23 aa, Giardia lamblia
IGKLEALLNAKFTSIKKAGRPFI

SEQ ID NO: 3188439 - protein, 26 aa, Giardia lamblia
IGKLVKYINGLWTWESPPSKVVLVTK

SEQ ID NO: 3188440 - protein, 25 aa, Giardia lamblia
IGKRTQIPLGLAYALSIHKCQGMTL

SEQ ID NO: 3188441 - protein, 18 aa, Giardia lamblia
IGLCFTQLLDYEAATVAF

SEQ ID NO: 3188442 - protein, 17 aa, Giardia lamblia
IGLFTGFCESTMPEMYS

SEQ ID NO: 3188443 - protein, 28 aa, Giardia lamblia
IGLLLSPHYIQLLSKMFKVLLSLKYTQS

SEQ ID NO: 3188444 - protein, 18 aa, Giardia lamblia
IGLSLPLPSAPDSGLVSP

SEQ ID NO: 3188445 - protein, 23 aa, Giardia lamblia
IGLYDILRRIPLFADHAFMTIGE

SEQ ID NO: 3188446 - protein, 23 aa, Giardia lamblia
IGNAEILHILLSSNPLDDDERNR

SEQ ID NO: 3188447 - protein, 21 aa, Giardia lamblia
IGNSRFISMLKKWHIRPGHTV

SEQ ID NO: 3188448 - protein, 23 aa, Giardia lamblia
IGNTLYDAIVLPGGPGWKEMQTN

SEQ ID NO: 3188449 - protein, 25 aa, Giardia lamblia
IGPEPWKYLVQQWVTFNHGSISNLV

SEQ ID NO: 3188450 - protein, 22 aa, Giardia lamblia
IGPGPPMSWKERHRLMLGQSCC

SEQ ID NO: 3188451 - protein, 25 aa, Giardia lamblia
IGPITEIRLLLKEDGTSRRVAYVGF

SEQ ID NO: 3188452 - protein, 29 aa, Giardia lamblia
IGRDSIVAIVLVLSWLAKMRKLHGERPIS

SEQ ID NO: 3188453 - protein, 17 aa, Giardia lamblia
IGRMHAKFQPVGTAWYK

SEQ ID NO: 3188454 - protein, 30 aa, Giardia lamblia
IGRNNLLKRSFLLIQSWCLYEARIVGGHSQ

SEQ ID NO: 3188455 - protein, 24 aa, Giardia lamblia
IGSKLVYRLVRYAAIVLLECVESQ

SEQ ID NO: 3188456 - protein, 30 aa, Giardia lamblia
IGSKRRAKALTACSPRRLSFVSSSSPATSI

SEQ ID NO: 3188457 - protein, 21 aa, Giardia lamblia
IGSLDVLFTVLKRCIENSALE

SEQ ID NO: 3188458 - protein, 35 aa, Giardia lamblia
IGSPLQLILTSPNDLMFYFYCNITDQMLKTMCDTL

SEQ ID NO: 3188459 - protein, 22 aa, Giardia lamblia
IGSPRVISLKDALQLENHALAT

SEQ ID NO: 3188460 - protein, 24 aa, Giardia lamblia
IGSSFKKAYYSSNTVWIVVEKNTI

SEQ ID NO: 3188461 - protein, 18 aa, Giardia lamblia
IGSYNRDLVWYVKDFPIG

SEQ ID NO: 3188462 - protein, 26 aa, Giardia lamblia
IGTEYNHFLLLYRIAFAVQAMEDLFS

SEQ ID NO: 3188463 - protein, 19 aa, Giardia lamblia
IGTNLDYQLALLAELLDTK

SEQ ID NO: 3188464 - protein, 31 aa, Giardia lamblia
IGTNTIYSLIRMLKQYLGFDYVFDVNFGADE

SEQ ID NO: 3188465 - protein, 28 aa, Giardia lamblia
IGVGCSLVWMHFGYMRPFNLDSDSRGIA

SEQ ID NO: 3188466 - protein, 18 aa, Giardia lamblia
IGVRIDKGSLHPQQPICF

SEQ ID NO: 3188467 - protein, 26 aa, Giardia lamblia
IGVSLHRIVCLLSYPYTKTSQRLVSQ

SEQ ID NO: 3188468 - protein, 25 aa, Giardia lamblia
IGYEQSVFYMIYKPGFKSTAVDLRP

SEQ ID NO: 3188469 - protein, 25 aa, Giardia lamblia
IHAEMPALLSFFDRFCALIMENLTG

SEQ ID NO: 3188470 - protein, 35 aa, Giardia lamblia
IHALNPLLSRRIPLPNKILVFIAPFTAINMDDRMR

SEQ ID NO: 3188471 - protein, 28 aa, Giardia lamblia
IHCDLKPQNFMFYKGRLRLIDFGISKAM

SEQ ID NO: 3188472 - protein, 20 aa, Giardia lamblia
IHCYKTGLWGPAVPIAERPE

SEQ ID NO: 3188473 - protein, 28 aa, Giardia lamblia
IHDRYQVINPLFWAWHELEKPTNKLHFR

SEQ ID NO: 3188474 - protein, 23 aa, Giardia lamblia
IHDTYVGFIRPYSKIGAGLQVVV

SEQ ID NO: 3188475 - protein, 23 aa, Giardia lamblia
IHERPLYVLFEPQLGCDPLTDHQ

SEQ ID NO: 3188476 - protein, 22 aa, Giardia lamblia
IHETYGFPLELVRDAVASAGDD

SEQ ID NO: 3188477 - protein, 25 aa, Giardia lamblia
IHEVSQKRWWTSYYAYRADSTRKVV

SEQ ID NO: 3188478 - protein, 19 aa, Giardia lamblia
IHFLSEAFAKAYPPEACEL

SEQ ID NO: 3188479 - protein, 17 aa, Giardia lamblia
IHFNTILTFTVGSKNRQ

SEQ ID NO: 3188480 - protein, 18 aa, Giardia lamblia
IHGLFLDAAAWDKKNNRL

SEQ ID NO: 3188481 - protein, 20 aa, Giardia lamblia
IHHLALFARTEVFDKLTKYI

SEQ ID NO: 3188482 - protein, 26 aa, Giardia lamblia
IHIAVFLEDVALVKLLFSYEKDLQLA

SEQ ID NO: 3188483 - protein, 19 aa, Giardia lamblia
IHIESLISEITKLRGELLE

SEQ ID NO: 3188484 - protein, 18 aa, Giardia lamblia
IHIFKQLLQSPKTDTHEL

SEQ ID NO: 3188485 - protein, 27 aa, Giardia lamblia
IHKKLENFITPLKRPDSKYLKMVRGNL

SEQ ID NO: 3188486 - protein, 22 aa, Giardia lamblia
IHLQGHFVFCFDSMRAINTRTI

SEQ ID NO: 3188487 - protein, 20 aa, Giardia lamblia
IHLTAFLGYKAGCTHVMRFI

SEQ ID NO: 3188488 - protein, 36 aa, Giardia lamblia
IHMDTVYECYLLAKDLLFMLPWESPEIKAPSEQAML

SEQ ID NO: 3188489 - protein, 19 aa, Giardia lamblia
IHMHLYREVVVDDNLFCET

SEQ ID NO: 3188490 - protein, 18 aa, Giardia lamblia
IHNFPPSTEWYRSGDCGL

SEQ ID NO: 3188491 - protein, 17 aa, Giardia lamblia
IHPLMLSYELQVSGLLY

SEQ ID NO: 3188492 - protein, 17 aa, Giardia lamblia
IHRDIKPGNFLFERKTG

SEQ ID NO: 3188493 - protein, 30 aa, Giardia lamblia
IHRVRLLRHAFMIWHFFTVRLINNDSRISN

SEQ ID NO: 3188494 - protein, 23 aa, Giardia lamblia
IHSANILNAPFLKPGEAPYRYTG

SEQ ID NO: 3188495 - protein, 18 aa, Giardia lamblia
IHSIHCRYWYVGQNGLCS

SEQ ID NO: 3188496 - protein, 27 aa, Giardia lamblia
IHSKNMYVLCHVYVDAFFISSSLSFLS

SEQ ID NO: 3188497 - protein, 18 aa, Giardia lamblia
IHTLALKQTLSFVPPTLT

SEQ ID NO: 3188498 - protein, 18 aa, Giardia lamblia
IHTLTTEMLMLPTQEDIL

SEQ ID NO: 3188499 - protein, 25 aa, Giardia lamblia
IHVGSIVHRNIIPSNIFVGEGDLIK

SEQ ID NO: 3188500 - protein, 18 aa, Giardia lamblia
IHWDLDNWLSSESLILTF

SEQ ID NO: 3188501 - protein, 19 aa, Giardia lamblia
IIAILTYRQSPSNPHSILS

SEQ ID NO: 3188502 - protein, 17 aa, Giardia lamblia
IIAKIFFQTTNKVMRFS

SEQ ID NO: 3188503 - protein, 17 aa, Giardia lamblia
IIAQVVSGIHFLCSTHN

SEQ ID NO: 3188504 - protein, 24 aa, Giardia lamblia
IIASPYKDDLFRWAAIIIGPSQTP

SEQ ID NO: 3188505 - protein, 28 aa, Giardia lamblia
IIATHDGKFHWDECLAVWFIKQLPDYID

SEQ ID NO: 3188506 - protein, 25 aa, Giardia lamblia
IICEAIYTNALPIQISKRKGERSLG

SEQ ID NO: 3188507 - protein, 18 aa, Giardia lamblia
IICIPEGKYFIIAVTSMD

SEQ ID NO: 3188508 - protein, 19 aa, Giardia lamblia
IIDILQKRRYDRAPSTVAV

SEQ ID NO: 3188509 - protein, 26 aa, Giardia lamblia
IIDSEKVIAFLTKTFSKITPAKDHKF

SEQ ID NO: 3188510 - protein, 23 aa, Giardia lamblia
IIDSMRQSCDFVYVSSAISASAK

SEQ ID NO: 3188511 - protein, 19 aa, Giardia lamblia
IIDTLEGYGMKLFNKVFDA

SEQ ID NO: 3188512 - protein, 18 aa, Giardia lamblia
IIDTNWSTKLPMLVSVDL

SEQ ID NO: 3188513 - protein, 18 aa, Giardia lamblia
IIEAALNRTYSDGPFRLR

SEQ ID NO: 3188514 - protein, 18 aa, Giardia lamblia
IIEAKACRISIKQSSKAS

SEQ ID NO: 3188515 - protein, 26 aa, Giardia lamblia
IIEALSLARAFVVRKLATIVQDDVVL

SEQ ID NO: 3188516 - protein, 26 aa, Giardia lamblia
IIEEIFSMVFNWYDGIPIDIYCLLFP

SEQ ID NO: 3188517 - protein, 19 aa, Giardia lamblia
IIEELKDKLAFADSGDIVA

SEQ ID NO: 3188518 - protein, 25 aa, Giardia lamblia
IIENFKGFKYIDIISLPVESATQAE

SEQ ID NO: 3188519 - protein, 18 aa, Giardia lamblia
IIEPGLVYYHYLDDLSKS

SEQ ID NO: 3188520 - protein, 29 aa, Giardia lamblia
IIEVWLQVQQQWLYLEPVFSSPDISRQLP

SEQ ID NO: 3188521 - protein, 32 aa, Giardia lamblia
IIGFELCLSENYVLIFSFPSLFGQTLTEEDFR

SEQ ID NO: 3188522 - protein, 25 aa, Giardia lamblia
IIHGHYDIVLLLAPTEAHIAIHRGC

SEQ ID NO: 3188523 - protein, 30 aa, Giardia lamblia
IIHLHAEIDLYIMGAGFYPAFKAYSQNKFT

SEQ ID NO: 3188524 - protein, 20 aa, Giardia lamblia
IIHSLEQELVHLRSGSAAGS

SEQ ID NO: 3188525 - protein, 24 aa, Giardia lamblia
IIICGGMSFTFLKKLKGMNIANSL

SEQ ID NO: 3188526 - protein, 18 aa, Giardia lamblia
IIIKQQGPHYEFIGLAFV

SEQ ID NO: 3188527 - protein, 29 aa, Giardia lamblia
IILAIARDFYPVCARLFELESKMILPNNK

SEQ ID NO: 3188528 - protein, 21 aa, Giardia lamblia
IILDNCAASYMFQPENGILAV

SEQ ID NO: 3188529 - protein, 31 aa, Giardia lamblia
IILKLINLQIPAFMITLFKRFPEHSNLHFVI

SEQ ID NO: 3188530 - protein, 19 aa, Giardia lamblia
IILLSPLAAGYVEPTNKRS

SEQ ID NO: 3188531 - protein, 29 aa, Giardia lamblia
IILQGIYDRSILLPNFRKVARSKLCADYP

SEQ ID NO: 3188532 - protein, 17 aa, Giardia lamblia
IIMACDGVWDVVTDQQS

SEQ ID NO: 3188533 - protein, 17 aa, Giardia lamblia
IIMDLPMTDYTRLEQVI

SEQ ID NO: 3188534 - protein, 17 aa, Giardia lamblia
IIMEPYINKCLCDVIDQ

SEQ ID NO: 3188535 - protein, 26 aa, Giardia lamblia
IIMGHNIYFHLYNTMWHSRSCLTTDS

SEQ ID NO: 3188536 - protein, 31 aa, Giardia lamblia
IINEKVTMRLIEFQKSLYDQTYAEVRLRNLE

SEQ ID NO: 3188537 - protein, 25 aa, Giardia lamblia
IINLKANLHLREEEFRRASARVSAL

SEQ ID NO: 3188538 - protein, 30 aa, Giardia lamblia
IINNFRINMFYDFKYNLYRPPYYNELPQPD

SEQ ID NO: 3188539 - protein, 17 aa, Giardia lamblia
IINTPHFTRLRYLSQLG

SEQ ID NO: 3188540 - protein, 17 aa, Giardia lamblia
IIPIRDFNNWAKSVLIK

SEQ ID NO: 3188541 - protein, 24 aa, Giardia lamblia
IIPNPGSWAFPERYSIHGLQFLDD

SEQ ID NO: 3188542 - protein, 26 aa, Giardia lamblia
IIQEYALDTPIFFNTSRYGHFGRSEF

SEQ ID NO: 3188543 - protein, 19 aa, Giardia lamblia
IIQNLERRLQEIRNSPNGP

SEQ ID NO: 3188544 - protein, 18 aa, Giardia lamblia
IIQYTPIGFRFSSNVLQT

SEQ ID NO: 3188545 - protein, 19 aa, Giardia lamblia
IIQYTPIGFRFSSTVLQTL

SEQ ID NO: 3188546 - protein, 19 aa, Giardia lamblia
IIRIRSMCYYFSGGSPPKS

SEQ ID NO: 3188547 - protein, 20 aa, Giardia lamblia
IIRSLKRTIATVRLENVSLS

SEQ ID NO: 3188548 - protein, 27 aa, Giardia lamblia
IISAFKDAFSGFLPILVELEAGCSAFM

SEQ ID NO: 3188549 - protein, 20 aa, Giardia lamblia
IISETCLLRFLDLYVGQNMN

SEQ ID NO: 3188550 - protein, 35 aa, Giardia lamblia
IISETMYILGTDGVDLWFFKVPLNQFSVEVNVSDT

SEQ ID NO: 3188551 - protein, 20 aa, Giardia lamblia
IISFLMPATLHVVTPGKLPL

SEQ ID NO: 3188552 - protein, 23 aa, Giardia lamblia
IISHSLGLLINLTSTSNKQFASA

SEQ ID NO: 3188553 - protein, 20 aa, Giardia lamblia
IISIRARHLFDGVSSLALCL

SEQ ID NO: 3188554 - protein, 18 aa, Giardia lamblia
IISRMVYTLSPRCQILLY

SEQ ID NO: 3188555 - protein, 17 aa, Giardia lamblia
IISVPYLAEYLFHILRH

SEQ ID NO: 3188556 - protein, 18 aa, Giardia lamblia
IISWYPVEVLALPDDKIT

SEQ ID NO: 3188557 - protein, 17 aa, Giardia lamblia
IITEKLFEKIELVKHHH

SEQ ID NO: 3188558 - protein, 25 aa, Giardia lamblia
IITKIDLSLKPYLYDNSKTLEKLSK

SEQ ID NO: 3188559 - protein, 21 aa, Giardia lamblia
IITLYNIFPVNRGERVYDLPS

SEQ ID NO: 3188560 - protein, 26 aa, Giardia lamblia
IITPRTRLIIRIAGHTYHIAFTFPPG

SEQ ID NO: 3188561 - protein, 31 aa, Giardia lamblia
IIVKMGLNMMSLIKPFPVDAPVFGKNTCVLR

SEQ ID NO: 3188562 - protein, 18 aa, Giardia lamblia
IIVRRDYLHFVQKYKRYE

SEQ ID NO: 3188563 - protein, 17 aa, Giardia lamblia
IIVYCNPKMALARLVKH

SEQ ID NO: 3188564 - protein, 19 aa, Giardia lamblia
IIYEMCCLRRPPWDAKTLE

SEQ ID NO: 3188565 - protein, 17 aa, Giardia lamblia
IKAASHLLTRFADSLLL

SEQ ID NO: 3188566 - protein, 18 aa, Giardia lamblia
IKAEHIPSILLLLPEEHA

SEQ ID NO: 3188567 - protein, 27 aa, Giardia lamblia
IKAFVLRIYAVIYAFVMGKKPALGSNH

SEQ ID NO: 3188568 - protein, 20 aa, Giardia lamblia
IKAIDVLIPLQKGARDNKGM

SEQ ID NO: 3188569 - protein, 26 aa, Giardia lamblia
IKANKWNLGAWSSFFAFRLITQEEFQ

SEQ ID NO: 3188570 - protein, 25 aa, Giardia lamblia
IKASEPFFDYLKHWIIEGSLLSTEY

SEQ ID NO: 3188571 - protein, 18 aa, Giardia lamblia
IKAVTIAAPCLAILAQDG

SEQ ID NO: 3188572 - protein, 17 aa, Giardia lamblia
IKDFRVISEANGEILWP

SEQ ID NO: 3188573 - protein, 21 aa, Giardia lamblia
IKDSISFIRRCAEATVEGGED

SEQ ID NO: 3188574 - protein, 25 aa, Giardia lamblia
IKDVYSLLDYALANRLYKFVVDSTW

SEQ ID NO: 3188575 - protein, 26 aa, Giardia lamblia
IKEIKENFLLAFLDLIENSSVWRKQC

SEQ ID NO: 3188576 - protein, 17 aa, Giardia lamblia
IKEYLLDAIPRQCISLL

SEQ ID NO: 3188577 - protein, 18 aa, Giardia lamblia
IKEYQLAKAFYKGLGEDV

SEQ ID NO: 3188578 - protein, 17 aa, Giardia lamblia
IKFYRKSGHMFRNLSRR

SEQ ID NO: 3188579 - protein, 18 aa, Giardia lamblia
IKGFYKNLKEGTAQCAGC

SEQ ID NO: 3188580 - protein, 25 aa, Giardia lamblia
IKGITNTRLIPTQAALLLAGASTNA

SEQ ID NO: 3188581 - protein, 20 aa, Giardia lamblia
IKGWTALHYAAAQNSVLCMN

SEQ ID NO: 3188582 - protein, 31 aa, Giardia lamblia
IKHRHTEITKLLLWYENDPSWTALMCAAVTG

SEQ ID NO: 3188583 - protein, 18 aa, Giardia lamblia
IKKIYDLYEKVGIDAKIS

SEQ ID NO: 3188584 - protein, 21 aa, Giardia lamblia
IKKLQDRIILLESYLQDNTGQ

SEQ ID NO: 3188585 - protein, 21 aa, Giardia lamblia
IKKSIYLVQIPVTGSATYKHL

SEQ ID NO: 3188586 - protein, 17 aa, Giardia lamblia
IKKWCFANDKTLYEFVY

SEQ ID NO: 3188587 - protein, 31 aa, Giardia lamblia
IKLEPKLQRMFKLVRPLLPIRFVDAVTVIQD

SEQ ID NO: 3188588 - protein, 27 aa, Giardia lamblia
IKLGISDLSFFVSPSLHLSICANVKIP

SEQ ID NO: 3188589 - protein, 20 aa, Giardia lamblia
IKLGSWMALYHPRFPLDVDN

SEQ ID NO: 3188590 - protein, 17 aa, Giardia lamblia
IKLIRILMEHESSLLSK

SEQ ID NO: 3188591 - protein, 26 aa, Giardia lamblia
IKLLSYLIYAQLTTNVPRFLSVSSSS

SEQ ID NO: 3188592 - protein, 28 aa, Giardia lamblia
IKLQEELQFTYLMPEPNREELDKLQMTD

SEQ ID NO: 3188593 - protein, 17 aa, Giardia lamblia
IKNIDDQIAFKSELTPS

SEQ ID NO: 3188594 - protein, 26 aa, Giardia lamblia
IKPAARLVFPVPPKRHQLTPRERQAL

SEQ ID NO: 3188595 - protein, 24 aa, Giardia lamblia
IKPARIRDFIGCDTYIAPSSQETE

SEQ ID NO: 3188596 - protein, 25 aa, Giardia lamblia
IKQDDYLSFDSLAPTLHDIIHSDMV

SEQ ID NO: 3188597 - protein, 21 aa, Giardia lamblia
IKQQYAGWSALVWAASSPEAS

SEQ ID NO: 3188598 - protein, 18 aa, Giardia lamblia
IKQYTLTYILSDCSVFVD

SEQ ID NO: 3188599 - protein, 19 aa, Giardia lamblia
IKRAYRKQALRWHPDKNRD

SEQ ID NO: 3188600 - protein, 22 aa, Giardia lamblia
IKRDGYLLAPPLSEYVIPQRGS

SEQ ID NO: 3188601 - protein, 30 aa, Giardia lamblia
IKRILTAIPAAKIDISLLSSLAAIPLDILR

SEQ ID NO: 3188602 - protein, 19 aa, Giardia lamblia
IKRIRLTAKPHQLLKEIEF

SEQ ID NO: 3188603 - protein, 23 aa, Giardia lamblia
IKRKSPILDLLYDAHNSTVVIKY

SEQ ID NO: 3188604 - protein, 25 aa, Giardia lamblia
IKRTTAPFRKTGRLRGRSLPLTIAR

SEQ ID NO: 3188605 - protein, 24 aa, Giardia lamblia
IKSFTLMRPDLITGILQLAPHVGH

SEQ ID NO: 3188606 - protein, 19 aa, Giardia lamblia
IKSGIGFEFLYPDYSIDDI

SEQ ID NO: 3188607 - protein, 20 aa, Giardia lamblia
IKSHLGEAPAWSLKGRHPQK

SEQ ID NO: 3188608 - protein, 18 aa, Giardia lamblia
IKSLLQPVCFEADDSGLL

SEQ ID NO: 3188609 - protein, 21 aa, Giardia lamblia
IKSVLERIFVLDPVKRPTARE

SEQ ID NO: 3188610 - protein, 18 aa, Giardia lamblia
IKSVLETLLVPNPSDRPS

SEQ ID NO: 3188611 - protein, 21 aa, Giardia lamblia
IKSVYRSTVLFRTPLMCAAAC

SEQ ID NO: 3188612 - protein, 18 aa, Giardia lamblia
IKTLQDALRIAEEDKRVL

SEQ ID NO: 3188613 - protein, 23 aa, Giardia lamblia
IKTPIQAGYFNTVAFFKTEEEVI

SEQ ID NO: 3188614 - protein, 28 aa, Giardia lamblia
IKTSMMALLRHNIAFFVELPVIRNGHEL

SEQ ID NO: 3188615 - protein, 25 aa, Giardia lamblia
IKTVNLEYNTFRKTILDMSVCNSDL

SEQ ID NO: 3188616 - protein, 27 aa, Giardia lamblia
IKVLSLKFWIMNYHAVVSSIYLIDLAK

SEQ ID NO: 3188617 - protein, 17 aa, Giardia lamblia
IKVPVPLQSYVGADFLP

SEQ ID NO: 3188618 - protein, 29 aa, Giardia lamblia
IKVVPTITNPTYLPQQHIKASPPPADNTN

SEQ ID NO: 3188619 - protein, 18 aa, Giardia lamblia
ILAACYDHHEICDVIAPF

SEQ ID NO: 3188620 - protein, 19 aa, Giardia lamblia
ILAAMDQVIGLKIDPFIEA

SEQ ID NO: 3188621 - protein, 19 aa, Giardia lamblia
ILAATESASYRLAAQCSAI

SEQ ID NO: 3188622 - protein, 18 aa, Giardia lamblia
ILAGLSRLNPRILRIENL

SEQ ID NO: 3188623 - protein, 18 aa, Giardia lamblia
ILANYKKLTIDAAQKRSV

SEQ ID NO: 3188624 - protein, 25 aa, Giardia lamblia
ILAPDPSCFFITKASLYPTIRHVSI

SEQ ID NO: 3188625 - protein, 26 aa, Giardia lamblia
ILAQDRRLFHWLETEHPKDVIQALLR

SEQ ID NO: 3188626 - protein, 18 aa, Giardia lamblia
ILAQLEYSLVTPSGNSVL

SEQ ID NO: 3188627 - protein, 24 aa, Giardia lamblia
ILASNMPMFASLIANGWELCGDAL

SEQ ID NO: 3188628 - protein, 27 aa, Giardia lamblia
ILATEVMTPRRYFLDSEAVKEYIEGIK

SEQ ID NO: 3188629 - protein, 25 aa, Giardia lamblia
ILATHESQWIFAEKKTLLMLAASAN

SEQ ID NO: 3188630 - protein, 20 aa, Giardia lamblia
ILAWAMNVTARLLPGTVVQR

SEQ ID NO: 3188631 - protein, 19 aa, Giardia lamblia
ILCGQLSEQFLNDPGIGLL

SEQ ID NO: 3188632 - protein, 17 aa, Giardia lamblia
ILCNCVVPFASGEVLTQ

SEQ ID NO: 3188633 - protein, 23 aa, Giardia lamblia
ILDANDCLFLIAAYKCFSDAVVD

SEQ ID NO: 3188634 - protein, 19 aa, Giardia lamblia
ILDRRYVTTGWNWGSLAVS

SEQ ID NO: 3188635 - protein, 17 aa, Giardia lamblia
ILDRYRYGIIRCENLRR

SEQ ID NO: 3188636 - protein, 25 aa, Giardia lamblia
ILDSRPHILIATPGRLAYMLESAAA

SEQ ID NO: 3188637 - protein, 19 aa, Giardia lamblia
ILDVLLPSNEHVNKWIRLG

SEQ ID NO: 3188638 - protein, 18 aa, Giardia lamblia
ILDWVRQIRTVLSSSPDD

SEQ ID NO: 3188639 - protein, 27 aa, Giardia lamblia
ILECSRLSNYIKLLSSFAISEFICTAC

SEQ ID NO: 3188640 - protein, 27 aa, Giardia lamblia
ILEDCKQLHLLVAPLLDATSTRDSGTA

SEQ ID NO: 3188641 - protein, 22 aa, Giardia lamblia
ILEDFIRGRIPHFVIPYTREEV

SEQ ID NO: 3188642 - protein, 18 aa, Giardia lamblia
ILEDGFQLTIRNLFESKY

SEQ ID NO: 3188643 - protein, 23 aa, Giardia lamblia
ILEDRGLVRFIYTQNIDELEIFA

SEQ ID NO: 3188644 - protein, 17 aa, Giardia lamblia
ILELCTRNRTFVGEPVM

SEQ ID NO: 3188645 - protein, 20 aa, Giardia lamblia
ILELSAKFCQALQNHVRLLS

SEQ ID NO: 3188646 - protein, 18 aa, Giardia lamblia
ILENFRSLSPRTVMLRRS

SEQ ID NO: 3188647 - protein, 20 aa, Giardia lamblia
ILERCHPSIQAYLSTKGYYT

SEQ ID NO: 3188648 - protein, 26 aa, Giardia lamblia
ILERNGCIPIRLFVFQSELEYSKSSY

SEQ ID NO: 3188649 - protein, 23 aa, Giardia lamblia
ILETQGLPMLPLNSQLVADQGAE

SEQ ID NO: 3188650 - protein, 26 aa, Giardia lamblia
ILFDRTTGRLALVFELMEMNLYELIK

SEQ ID NO: 3188651 - protein, 20 aa, Giardia lamblia
ILFRQNGGIYGLLTLIGSTD

SEQ ID NO: 3188652 - protein, 18 aa, Giardia lamblia
ILFTVKPTCEGRINQLIK

SEQ ID NO: 3188653 - protein, 17 aa, Giardia lamblia
ILGHDILQRLLDKNIIE

SEQ ID NO: 3188654 - protein, 35 aa, Giardia lamblia
ILGQDLVNPALIQNLEFVRLYLSNTFEKNDAVKSL

SEQ ID NO: 3188655 - protein, 23 aa, Giardia lamblia
ILHKIRLVYDMNLLYTGQKALQC

SEQ ID NO: 3188656 - protein, 17 aa, Giardia lamblia
ILHLCESALMTNTVLIF

SEQ ID NO: 3188657 - protein, 17 aa, Giardia lamblia
ILHLKQYCDRHGLTASM

SEQ ID NO: 3188658 - protein, 23 aa, Giardia lamblia
ILHNNPVVFKALYIKESGLLKGD

SEQ ID NO: 3188659 - protein, 25 aa, Giardia lamblia
ILHTLDFQLAMPTILTFLRRYARIS

SEQ ID NO: 3188660 - protein, 19 aa, Giardia lamblia
ILICKRRRIRHIAATYNEP

SEQ ID NO: 3188661 - protein, 20 aa, Giardia lamblia
ILICQLYSQAVLNIPKILSA

SEQ ID NO: 3188662 - protein, 30 aa, Giardia lamblia
ILIENTGGRFPFWISPRQIVVIPLHGEDIV

SEQ ID NO: 3188663 - protein, 19 aa, Giardia lamblia
ILIITINYTFRTTEAPNLL

SEQ ID NO: 3188664 - protein, 17 aa, Giardia lamblia
ILIKYELEKPGYAQRYY

SEQ ID NO: 3188665 - protein, 20 aa, Giardia lamblia
ILIPHEFGMRMITGDSLNGA

SEQ ID NO: 3188666 - protein, 17 aa, Giardia lamblia
ILIYIHNSELLEKLEQA

SEQ ID NO: 3188667 - protein, 19 aa, Giardia lamblia
ILKCFQLHKKNRLYREFFN

SEQ ID NO: 3188668 - protein, 21 aa, Giardia lamblia
ILKFHVIIPTIKSSPKFSMAS

SEQ ID NO: 3188669 - protein, 30 aa, Giardia lamblia
ILKKHCPEQLVWSIIRQVAEAFNYIHSRHY

SEQ ID NO: 3188670 - protein, 20 aa, Giardia lamblia
ILKKKIRALEELQERHYQGS

SEQ ID NO: 3188671 - protein, 27 aa, Giardia lamblia
ILKRIQQLMRLVLRIPSHSAYSAIDTD

SEQ ID NO: 3188672 - protein, 30 aa, Giardia lamblia
ILKYEKTTEFFLLKLLRINHLVVSGEALSI

SEQ ID NO: 3188673 - protein, 18 aa, Giardia lamblia
ILKYYRPFDETSFPEINS

SEQ ID NO: 3188674 - protein, 34 aa, Giardia lamblia
ILLNCRDIYTPFQALYVFLAYYSSFDYDRDIVHP

SEQ ID NO: 3188675 - protein, 20 aa, Giardia lamblia
ILMGIHFISSSPMDISAIIF

SEQ ID NO: 3188676 - protein, 39 aa, Giardia lamblia
ILMKWSKKLELYIIKLMKPLFFTVFPRVFTRNTSYASQA

SEQ ID NO: 3188677 - protein, 27 aa, Giardia lamblia
ILNNAKMPVFPFPEPAIHATGAVLKYR

SEQ ID NO: 3188678 - protein, 19 aa, Giardia lamblia
ILNNMNISFFGVEGESLML

SEQ ID NO: 3188679 - protein, 19 aa, Giardia lamblia
ILNSFYGYAMRKGSRWYSL

SEQ ID NO: 3188680 - protein, 21 aa, Giardia lamblia
ILNSPLYLMEFKHLGVIGLLK

SEQ ID NO: 3188681 - protein, 17 aa, Giardia lamblia
ILPLVQFMQVYGKIQRL

SEQ ID NO: 3188682 - protein, 24 aa, Giardia lamblia
ILPTKRHMYLSSNYIYTMFNLTAA

SEQ ID NO: 3188683 - protein, 25 aa, Giardia lamblia
ILPVSDMWMLGCLLFEGCNGSNPFL

SEQ ID NO: 3188684 - protein, 21 aa, Giardia lamblia
ILQEQVNVVRFLRPYESHINT

SEQ ID NO: 3188685 - protein, 25 aa, Giardia lamblia
ILQNRRMILILREWRYALLLRRMER

SEQ ID NO: 3188686 - protein, 22 aa, Giardia lamblia
ILQNYNMIGDFLPRRSRREINT

SEQ ID NO: 3188687 - protein, 19 aa, Giardia lamblia
ILQQARYINQSLFYLEQVI

SEQ ID NO: 3188688 - protein, 18 aa, Giardia lamblia
ILQTSLQGNCYTTMIACI

SEQ ID NO: 3188689 - protein, 22 aa, Giardia lamblia
ILRAVIYCDFLPTKLVEGGRDP

SEQ ID NO: 3188690 - protein, 35 aa, Giardia lamblia
ILRDLVPSKYLDWDLLSKIYFLDSRVKTLLSNMHD

SEQ ID NO: 3188691 - protein, 17 aa, Giardia lamblia
ILRDRLLFSSDVSEFLV

SEQ ID NO: 3188692 - protein, 21 aa, Giardia lamblia
ILREAYGPTSPFLATVYINMG

SEQ ID NO: 3188693 - protein, 26 aa, Giardia lamblia
ILREDEIVFFYMAALFDVDKPALSYV

SEQ ID NO: 3188694 - protein, 19 aa, Giardia lamblia
ILRLLVFTPPQDLDKQATL

SEQ ID NO: 3188695 - protein, 17 aa, Giardia lamblia
ILRLLVLKYSCDNTIGL

SEQ ID NO: 3188696 - protein, 25 aa, Giardia lamblia
ILRPHNVPVPTFMSTTRPLQGSTVT

SEQ ID NO: 3188697 - protein, 28 aa, Giardia lamblia
ILRQRHRFNTLLSQKIPKVLFSHNTKDA

SEQ ID NO: 3188698 - protein, 27 aa, Giardia lamblia
ILSFLPRGRRSSLRDIYTALRTVLENP

SEQ ID NO: 3188699 - protein, 27 aa, Giardia lamblia
ILSHNAYRLIIYALSKYNSGVLIDHRN

SEQ ID NO: 3188700 - protein, 25 aa, Giardia lamblia
ILSKLRTRVIPLSDLLLRLQNGHNS

SEQ ID NO: 3188701 - protein, 19 aa, Giardia lamblia
ILSMRELLKGWMRNLNTVQ

SEQ ID NO: 3188702 - protein, 25 aa, Giardia lamblia
ILSQGYLLAGIYELLRPQGSAMHGT

SEQ ID NO: 3188703 - protein, 26 aa, Giardia lamblia
ILSSNATLLYTKQPRAAPKGTPAAIY

SEQ ID NO: 3188704 - protein, 18 aa, Giardia lamblia
ILSTIFAGGAPQANDVAF

SEQ ID NO: 3188705 - protein, 25 aa, Giardia lamblia
ILTDNTLLFIIKGSKPTVYSLIFQR

SEQ ID NO: 3188706 - protein, 24 aa, Giardia lamblia
ILTGEVLIPPRYAKKTDFSPPFTM

SEQ ID NO: 3188707 - protein, 28 aa, Giardia lamblia
ILTIRDRVLNYILSSLPEKQLESGQIAE

SEQ ID NO: 3188708 - protein, 17 aa, Giardia lamblia
ILVEATAFGYNPLEDSN

SEQ ID NO: 3188709 - protein, 18 aa, Giardia lamblia
ILVITAASPDIYMYVPLL

SEQ ID NO: 3188710 - protein, 23 aa, Giardia lamblia
ILVKLELMYREQIRSLLKIEHET

SEQ ID NO: 3188711 - protein, 32 aa, Giardia lamblia
ILVKSVPCRMNISFISPIFRSGDSFWEENLST

SEQ ID NO: 3188712 - protein, 25 aa, Giardia lamblia
ILVSSYLMGWLRASNHQKVYAISEG

SEQ ID NO: 3188713 - protein, 18 aa, Giardia lamblia
ILYAARARNIINVPVACH

SEQ ID NO: 3188714 - protein, 17 aa, Giardia lamblia
ILYLAEHVTRLRKSLLG

SEQ ID NO: 3188715 - protein, 20 aa, Giardia lamblia
IMALPHCFDMKEDNARIQTS

SEQ ID NO: 3188716 - protein, 23 aa, Giardia lamblia
IMARNAQRFANFGRGSNSGSEDQ

SEQ ID NO: 3188717 - protein, 18 aa, Giardia lamblia
IMCFRGRVLGFTRFGLTK

SEQ ID NO: 3188718 - protein, 19 aa, Giardia lamblia
IMCLELNNDLYFINTGDSR

SEQ ID NO: 3188719 - protein, 26 aa, Giardia lamblia
IMDRDLYDRQWGLGPTALLKKQLIKN

SEQ ID NO: 3188720 - protein, 31 aa, Giardia lamblia
IMGLPRDELVTMRYIPLSVTFGHLDKRRIGL

SEQ ID NO: 3188721 - protein, 17 aa, Giardia lamblia
IMIANVSPAAYHFDDTY

SEQ ID NO: 3188722 - protein, 19 aa, Giardia lamblia
IMIQKACIAAMELIRRGKT

SEQ ID NO: 3188723 - protein, 18 aa, Giardia lamblia
IMLELKPFGFSSGSYSIP

SEQ ID NO: 3188724 - protein, 18 aa, Giardia lamblia
IMLFSDWRDDLTFEDLNG

SEQ ID NO: 3188725 - protein, 28 aa, Giardia lamblia
IMLNSRFVKLVAWYDNEFGYANKLVELA

SEQ ID NO: 3188726 - protein, 17 aa, Giardia lamblia
IMNSAVMRGMPTDSSFS

SEQ ID NO: 3188727 - protein, 19 aa, Giardia lamblia
IMPQLSHPNILRYKAVHQE

SEQ ID NO: 3188728 - protein, 17 aa, Giardia lamblia
IMQSTIEHIFVTQSREL

SEQ ID NO: 3188729 - protein, 29 aa, Giardia lamblia
IMREAVSDMALHFLKKLKITVIDDIEREE

SEQ ID NO: 3188730 - protein, 21 aa, Giardia lamblia
IMREKAVTIDALERNLKTLKV

SEQ ID NO: 3188731 - protein, 30 aa, Giardia lamblia
IMSGQVARAYIRCSWNKLGYGRQKLEAQRK

SEQ ID NO: 3188732 - protein, 21 aa, Giardia lamblia
IMSPYQLYVFVQRTTIVIPRL

SEQ ID NO: 3188733 - protein, 17 aa, Giardia lamblia
IMTGFIELNSRVDQLVI

SEQ ID NO: 3188734 - protein, 26 aa, Giardia lamblia
IMTGVISTIFAIFLEQLRTIDLTADL

SEQ ID NO: 3188735 - protein, 27 aa, Giardia lamblia
IMTRWAADLEALQKHFEALKRHEANKI

SEQ ID NO: 3188736 - protein, 46 aa, Giardia lamblia
IMVDHHQLAMFMPKYNKYIHLSTLSPTVRQFLINNKFLLNDLVVER

SEQ ID NO: 3188737 - protein, 47 aa, Giardia lamblia
IMVQLLVSRLDSTLRKRAFHTWKSQTPLLIMHPAIKAFIELHASRAD

SEQ ID NO: 3188738 - protein, 17 aa, Giardia lamblia
INAALMCYGVTGSGKTY

SEQ ID NO: 3188739 - protein, 25 aa, Giardia lamblia
INADEYFWSLQLPPSTNKIVCMPTC

SEQ ID NO: 3188740 - protein, 25 aa, Giardia lamblia
INADTGLVLPFQYLSRREKDILKAQ

SEQ ID NO: 3188741 - protein, 21 aa, Giardia lamblia
INAMDAAFCIKYFLVCTLKTK

SEQ ID NO: 3188742 - protein, 26 aa, Giardia lamblia
INDDQLSWALSSLPPNFQRLASSELN

SEQ ID NO: 3188743 - protein, 30 aa, Giardia lamblia
INDLKPTFFVLPNPLPLPKSLTGASPKPSD

SEQ ID NO: 3188744 - protein, 17 aa, Giardia lamblia
INDLLLDPVTGMPAPVR

SEQ ID NO: 3188745 - protein, 28 aa, Giardia lamblia
INDSIDSGLNFVLPPSLTATAEAIDEMP

SEQ ID NO: 3188746 - protein, 22 aa, Giardia lamblia
INEAFPFLSLQLQPYGGAVNGI

SEQ ID NO: 3188747 - protein, 17 aa, Giardia lamblia
INELFSTNGFREGIVNM

SEQ ID NO: 3188748 - protein, 25 aa, Giardia lamblia
INENCLFYTGFDRALRFLIEEYSES

SEQ ID NO: 3188749 - protein, 23 aa, Giardia lamblia
INEPSDYFSASDYLARFPKNTVQ

SEQ ID NO: 3188750 - protein, 21 aa, Giardia lamblia
INFCPLLCTTPTQFDATAWRK

SEQ ID NO: 3188751 - protein, 37 aa, Giardia lamblia
INGENCLKALRPGFHPTIYASGFFGAFRLIDMCVGPD

SEQ ID NO: 3188752 - protein, 18 aa, Giardia lamblia
INGFLFDATYRDCKVPAI

SEQ ID NO: 3188753 - protein, 27 aa, Giardia lamblia
INGHSALFVYLLPERGIRGIYGRTMLH

SEQ ID NO: 3188754 - protein, 25 aa, Giardia lamblia
INGIKLLLPHESGMHDRYGATALMK

SEQ ID NO: 3188755 - protein, 23 aa, Giardia lamblia
INGKKFLLSPLTKTSFPCLLHFD

SEQ ID NO: 3188756 - protein, 17 aa, Giardia lamblia
INGLEMVCQHRSGLYAI

SEQ ID NO: 3188757 - protein, 18 aa, Giardia lamblia
INGLLIVQKLQAIIHDKY

SEQ ID NO: 3188758 - protein, 22 aa, Giardia lamblia
INGLLLLKLAVLIKGQSSTNQS

SEQ ID NO: 3188759 - protein, 30 aa, Giardia lamblia
INHDIRPSFIFKLLDHFLSVFPGVAFHSAI

SEQ ID NO: 3188760 - protein, 20 aa, Giardia lamblia
INHQINQNILLAPSTSAVAQ

SEQ ID NO: 3188761 - protein, 23 aa, Giardia lamblia
INHSGVRVLLTQAQFLPMILGTS

SEQ ID NO: 3188762 - protein, 39 aa, Giardia lamblia
INIALTPAYLLSKCFDIYMAVPFGTLPKPPTLPRKRVVV

SEQ ID NO: 3188763 - protein, 34 aa, Giardia lamblia
INIIKIHDYFYFREHLLLKFTLLGEDLYTHFNRR

SEQ ID NO: 3188764 - protein, 17 aa, Giardia lamblia
INIMVFPATGMPIGINI

SEQ ID NO: 3188765 - protein, 20 aa, Giardia lamblia
INIVFRSVGGHDFHLVYPVE

SEQ ID NO: 3188766 - protein, 23 aa, Giardia lamblia
INKPFLFHIIGFSKITTTFQTEQ

SEQ ID NO: 3188767 - protein, 18 aa, Giardia lamblia
INKYKKILIYIHNSELLE

SEQ ID NO: 3188768 - protein, 20 aa, Giardia lamblia
INLLLSQDHLLPFLAKERCI

SEQ ID NO: 3188769 - protein, 18 aa, Giardia lamblia
INLLNRYYDSLPNQTTST

SEQ ID NO: 3188770 - protein, 28 aa, Giardia lamblia
INLSLSALGLVISKLVEGATHIPYRDSK

SEQ ID NO: 3188771 - protein, 17 aa, Giardia lamblia
INLVPGHGLPNVPFYES

SEQ ID NO: 3188772 - protein, 30 aa, Giardia lamblia
INNFATSFRSRFLRLLRYDFAELPIEIAFK

SEQ ID NO: 3188773 - protein, 23 aa, Giardia lamblia
INNTFTQLFSKRAYLQNYIDSMV

SEQ ID NO: 3188774 - protein, 26 aa, Giardia lamblia
INNYIQLTMPWVLIKKAETKNGHEFV

SEQ ID NO: 3188775 - protein, 20 aa, Giardia lamblia
INPLTNNILFNARISKVPDK

SEQ ID NO: 3188776 - protein, 25 aa, Giardia lamblia
INPYTVLIHCMLKYKLEFDSDFVPL

SEQ ID NO: 3188777 - protein, 18 aa, Giardia lamblia
INQIYTQEAWQRPFGNIA

SEQ ID NO: 3188778 - protein, 20 aa, Giardia lamblia
INRFCRSLRHYRMSGVKPGD

SEQ ID NO: 3188779 - protein, 19 aa, Giardia lamblia
INRGTWFRFTYIEQMAVAF

SEQ ID NO: 3188780 - protein, 22 aa, Giardia lamblia
INRLMEFDQVSLIKLSELQQLM

SEQ ID NO: 3188781 - protein, 18 aa, Giardia lamblia
INRSEPAFSLSGRYDVTK

SEQ ID NO: 3188782 - protein, 19 aa, Giardia lamblia
INRYLIRYNISYEPRFPGA

SEQ ID NO: 3188783 - protein, 18 aa, Giardia lamblia
INSKLWSTIISSPFIVYQ

SEQ ID NO: 3188784 - protein, 23 aa, Giardia lamblia
INSPLYAPLVSLISRELTLQEER

SEQ ID NO: 3188785 - protein, 20 aa, Giardia lamblia
INSVLRPVILQKTRSIAGIL

SEQ ID NO: 3188786 - protein, 28 aa, Giardia lamblia
INTALPFPRLQLLDLSENKIYQITAELP

SEQ ID NO: 3188787 - protein, 37 aa, Giardia lamblia
INTDGPFWRATYQCARYLLALYVAYGSAVLEAGLSEI

SEQ ID NO: 3188788 - protein, 30 aa, Giardia lamblia
INTGLQTLLDKLLLVKAPPLSELQTKKGFE

SEQ ID NO: 3188789 - protein, 21 aa, Giardia lamblia
INTSASLLVRLLSFLDDQHAD

SEQ ID NO: 3188790 - protein, 17 aa, Giardia lamblia
INTSLQHLSGLKNDLYA

SEQ ID NO: 3188791 - protein, 22 aa, Giardia lamblia
INTYTYLLTDYSRPSNLSRIIS

SEQ ID NO: 3188792 - protein, 22 aa, Giardia lamblia
INVATLLPRFINAASNICHFFF

SEQ ID NO: 3188793 - protein, 27 aa, Giardia lamblia
INVFVNRQLIYDVPMQALSKKGIMVIE

SEQ ID NO: 3188794 - protein, 20 aa, Giardia lamblia
INVNLFEKIKMLGKGAFGSV

SEQ ID NO: 3188795 - protein, 17 aa, Giardia lamblia
INVYHKHRHPFMANIGI

SEQ ID NO: 3188796 - protein, 25 aa, Giardia lamblia
INYDPFQWTYIFLGNASEYNFIQQG

SEQ ID NO: 3188797 - protein, 27 aa, Giardia lamblia
INYVNTQDLMLLPKTLNFNEEEIVHDA

SEQ ID NO: 3188798 - protein, 19 aa, Giardia lamblia
IPANPPYKAKIYNLSQLTC

SEQ ID NO: 3188799 - protein, 31 aa, Giardia lamblia
IPANYQPEPLTLYIKGWPLGFTVDTIRIFFR

SEQ ID NO: 3188800 - protein, 32 aa, Giardia lamblia
IPATVHSILLDIWILILQLDLNDKMLAEQAAP

SEQ ID NO: 3188801 - protein, 25 aa, Giardia lamblia
IPCPRRFFIHGWWTINHQKIGKSLG

SEQ ID NO: 3188802 - protein, 27 aa, Giardia lamblia
IPCSELLPYLRDIQAYVPPQILVLCVV

SEQ ID NO: 3188803 - protein, 17 aa, Giardia lamblia
IPCVVLNRRRQAADGSV

SEQ ID NO: 3188804 - protein, 24 aa, Giardia lamblia
IPDPSLIPNSYYLRTQAQHAPNWR

SEQ ID NO: 3188805 - protein, 26 aa, Giardia lamblia
IPDVNIFLRQVAYLTASKFSNVPKPK

SEQ ID NO: 3188806 - protein, 24 aa, Giardia lamblia
IPEATILTIIDHVTSALAYLHDPN

SEQ ID NO: 3188807 - protein, 26 aa, Giardia lamblia
IPEEQIWAILYSVCAGLSYCHSNSKH

SEQ ID NO: 3188808 - protein, 32 aa, Giardia lamblia
IPEETIWCIAAHILLGLSYCHLLCKPDPGSPS

SEQ ID NO: 3188809 - protein, 27 aa, Giardia lamblia
IPEETVWYILSHLAEALLYYHSPQKDN

SEQ ID NO: 3188810 - protein, 25 aa, Giardia lamblia
IPELKKLLKSFQDALRRLYTEHSCC

SEQ ID NO: 3188811 - protein, 17 aa, Giardia lamblia
IPESQRGMLLLVLSELY

SEQ ID NO: 3188812 - protein, 31 aa, Giardia lamblia
IPEYDNLLPRLLCAGGFLKTYILPNSNKHIC

SEQ ID NO: 3188813 - protein, 18 aa, Giardia lamblia
IPGFILDTIRSLCPCALS

SEQ ID NO: 3188814 - protein, 17 aa, Giardia lamblia
IPGKIMLSMEFLESGSL

SEQ ID NO: 3188815 - protein, 25 aa, Giardia lamblia
IPGPGVYVLSLFPAVGVTTANPSAH

SEQ ID NO: 3188816 - protein, 24 aa, Giardia lamblia
IPGQKILYRLYTSTHTPFVDLIAR

SEQ ID NO: 3188817 - protein, 31 aa, Giardia lamblia
IPHTNRLLDMLLDAIKLRTMSRHKLSPKELD

SEQ ID NO: 3188818 - protein, 17 aa, Giardia lamblia
IPHYTPILNTLKHYFII

SEQ ID NO: 3188819 - protein, 20 aa, Giardia lamblia
IPIKLSTYVRFNTSGGILSV

SEQ ID NO: 3188820 - protein, 25 aa, Giardia lamblia
IPILPDLIFEILADERQFSIALPYT

SEQ ID NO: 3188821 - protein, 18 aa, Giardia lamblia
IPIQHPVRQMLPICYIPG

SEQ ID NO: 3188822 - protein, 21 aa, Giardia lamblia
IPKDVGIGANVWRLSPSPPDV

SEQ ID NO: 3188823 - protein, 44 aa, Giardia lamblia
IPKEFRQSIFFMALRGLHYLHSKWILHRDIKLSNILIAHDGTIK

SEQ ID NO: 3188824 - protein, 17 aa, Giardia lamblia
IPLDLAIELSALYAVRR

SEQ ID NO: 3188825 - protein, 21 aa, Giardia lamblia
IPLFVAGPDKTIAIQRGRGVP

SEQ ID NO: 3188826 - protein, 17 aa, Giardia lamblia
IPLIINIAKRRSGSGVA

SEQ ID NO: 3188827 - protein, 17 aa, Giardia lamblia
IPLLMLEACIQRPDGHT

SEQ ID NO: 3188828 - protein, 24 aa, Giardia lamblia
IPNESVAGLCKLLLMAISKGKQFI

SEQ ID NO: 3188829 - protein, 21 aa, Giardia lamblia
IPPETLKFIKDKLILEQEKLD

SEQ ID NO: 3188830 - protein, 22 aa, Giardia lamblia
IPPNQLFTLPFHFRETPLLAPK

SEQ ID NO: 3188831 - protein, 26 aa, Giardia lamblia
IPQEYLFFSLICEISWSDSSLIAGVK

SEQ ID NO: 3188832 - protein, 17 aa, Giardia lamblia
IPQISAQLPYNSKLLQS

SEQ ID NO: 3188833 - protein, 17 aa, Giardia lamblia
IPQSLGRVGWRVCLVVD

SEQ ID NO: 3188834 - protein, 20 aa, Giardia lamblia
IPRALLVNNMAYFRNILANK

SEQ ID NO: 3188835 - protein, 21 aa, Giardia lamblia
IPRPPPILSRFTKPGKNTSVF

SEQ ID NO: 3188836 - protein, 27 aa, Giardia lamblia
IPSGTIPFLIRLLQIALTPHVYQKLEL

SEQ ID NO: 3188837 - protein, 27 aa, Giardia lamblia
IPSLQPGISCYPYLPNNVFPGQFSGSP

SEQ ID NO: 3188838 - protein, 17 aa, Giardia lamblia
IPSLRHSVLTQQSIEKL

SEQ ID NO: 3188839 - protein, 25 aa, Giardia lamblia
IPTKAFQIPIQFREIFHPRRISHVI

SEQ ID NO: 3188840 - protein, 26 aa, Giardia lamblia
IPTSKYNLPIIYRDDTNFSWSSESGE

SEQ ID NO: 3188841 - protein, 18 aa, Giardia lamblia
IPVFAPIPVRLAAEVADA

SEQ ID NO: 3188842 - protein, 18 aa, Giardia lamblia
IPVFNRIMTYVTNDKIKV

SEQ ID NO: 3188843 - protein, 17 aa, Giardia lamblia
IPVGYSRERPQSSHNNP

SEQ ID NO: 3188844 - protein, 21 aa, Giardia lamblia
IPVLRAYIEWIIPHATKQEQK

SEQ ID NO: 3188845 - protein, 17 aa, Giardia lamblia
IPVLYIYHRSVQCPVLY

SEQ ID NO: 3188846 - protein, 31 aa, Giardia lamblia
IPVPKVRVITPLAYILLYRRISGDLDNTERE

SEQ ID NO: 3188847 - protein, 29 aa, Giardia lamblia
IPVRNTFMQLLMNYLIKPPVVIATPSNQT

SEQ ID NO: 3188848 - protein, 19 aa, Giardia lamblia
IPYGVPKRVRFTLFSENEK

SEQ ID NO: 3188849 - protein, 22 aa, Giardia lamblia
IPYGYIVREKGLRGSSASISKP

SEQ ID NO: 3188850 - protein, 25 aa, Giardia lamblia
IQAEVPIIRLVINGVFIDISSARPV

SEQ ID NO: 3188851 - protein, 24 aa, Giardia lamblia
IQAKLEEFLAIRASAKQKKPELVT

SEQ ID NO: 3188852 - protein, 32 aa, Giardia lamblia
IQAVLQNQFEMVQILLPYELSIKTTGTDGGRS

SEQ ID NO: 3188853 - protein, 25 aa, Giardia lamblia
IQCATILVRAFPPTKKELVSCIDMA

SEQ ID NO: 3188854 - protein, 17 aa, Giardia lamblia
IQDFINQDLKPFPGLSA

SEQ ID NO: 3188855 - protein, 23 aa, Giardia lamblia
IQELYAYFNFQLNSIISHFTIEI

SEQ ID NO: 3188856 - protein, 31 aa, Giardia lamblia
IQETKRTDKYGWTALMWAVCNREPGCVRLLK

SEQ ID NO: 3188857 - protein, 17 aa, Giardia lamblia
IQFAHRCRNIINQPRVS

SEQ ID NO: 3188858 - protein, 22 aa, Giardia lamblia
IQFIRSNLPRQSYRELLVHEAK

SEQ ID NO: 3188859 - protein, 20 aa, Giardia lamblia
IQGFFPSSIPFDHIDGYLVF

SEQ ID NO: 3188860 - protein, 22 aa, Giardia lamblia
IQGIMKAVVQLKSPVILQCSRG

SEQ ID NO: 3188861 - protein, 18 aa, Giardia lamblia
IQHPRYIKYIAKGAIGKV

SEQ ID NO: 3188862 - protein, 17 aa, Giardia lamblia
IQIAKILLKVELPLLRE

SEQ ID NO: 3188863 - protein, 21 aa, Giardia lamblia
IQIIKPLYDTVDTKLISCIIT

SEQ ID NO: 3188864 - protein, 17 aa, Giardia lamblia
IQIILPNEVMRRDSRDR

SEQ ID NO: 3188865 - protein, 18 aa, Giardia lamblia
IQIIRRSETLNFILKMLR

SEQ ID NO: 3188866 - protein, 28 aa, Giardia lamblia
IQKCLKRLPFVQIYPLPKGCPDPYYSIL

SEQ ID NO: 3188867 - protein, 28 aa, Giardia lamblia
IQKLAFRLQLDIFSKQPSLPLFLHCRDA

SEQ ID NO: 3188868 - protein, 24 aa, Giardia lamblia
IQLANAIFIAFGSKPWSLFICKGS

SEQ ID NO: 3188869 - protein, 31 aa, Giardia lamblia
IQLLQFHARGYFLTAFLCLCVSPDKVTLDLA

SEQ ID NO: 3188870 - protein, 20 aa, Giardia lamblia
IQNDLIIGLTLYIAIDQSNH

SEQ ID NO: 3188871 - protein, 19 aa, Giardia lamblia
IQNKIGWTALMYACSRDHL

SEQ ID NO: 3188872 - protein, 18 aa, Giardia lamblia
IQNLFERESKREKALEQR

SEQ ID NO: 3188873 - protein, 23 aa, Giardia lamblia
IQPNSTLIYMNPSATFSAPIQKA

SEQ ID NO: 3188874 - protein, 18 aa, Giardia lamblia
IQQALLKVKTELAQVSAA

SEQ ID NO: 3188875 - protein, 26 aa, Giardia lamblia
IQRLSDALLRLPGLQYLDISSNKLDT

SEQ ID NO: 3188876 - protein, 33 aa, Giardia lamblia
IQRNRILAQAYYKRLTLLLSYRHQYDEAMLNRR

SEQ ID NO: 3188877 - protein, 18 aa, Giardia lamblia
IQRRGYVLDLFGGAGGQA

SEQ ID NO: 3188878 - protein, 17 aa, Giardia lamblia
IQSLHQRAPGRSTLRDE

SEQ ID NO: 3188879 - protein, 25 aa, Giardia lamblia
IQSNEAGFKLCRVQKIFLGDKGMPY

SEQ ID NO: 3188880 - protein, 18 aa, Giardia lamblia
IQSQLESLFAKYNATKEK

SEQ ID NO: 3188881 - protein, 25 aa, Giardia lamblia
IQSVDLFTFRIHEILEYIHFRTTHI

SEQ ID NO: 3188882 - protein, 47 aa, Giardia lamblia
IQTMCYHYIDGLIWVFRYYFLPKVEDWGWYYPYHHSPLLADLASASQ

SEQ ID NO: 3188883 - protein, 27 aa, Giardia lamblia
IQVLYSEYYFYRFIQKQVADGRVNLAR

SEQ ID NO: 3188884 - protein, 19 aa, Giardia lamblia
IQYESIIPVGYSRERPQSS

SEQ ID NO: 3188885 - protein, 46 aa, Giardia lamblia
IRACSRYIENLTGSILYIVSGNLSFFWVGSLVPEELRRGLFGAQSH

SEQ ID NO: 3188886 - protein, 25 aa, Giardia lamblia
IRADPVMMYTLKLSAETAKKQFSEK

SEQ ID NO: 3188887 - protein, 19 aa, Giardia lamblia
IRADYVTWMKHAFSYLITN

SEQ ID NO: 3188888 - protein, 24 aa, Giardia lamblia
IRAKRPELVILLVFNKDDGDYDRL

SEQ ID NO: 3188889 - protein, 26 aa, Giardia lamblia
IRALKRNIMLFRRLGRETFFDLLNPN

SEQ ID NO: 3188890 - protein, 19 aa, Giardia lamblia
IRAQFHKLLKERDKEIDRL

SEQ ID NO: 3188891 - protein, 18 aa, Giardia lamblia
IRCLIKKGFIIPGGAAVE

SEQ ID NO: 3188892 - protein, 31 aa, Giardia lamblia
IRDGLARILVCFYLHDFKAGILRLLQMNLDH

SEQ ID NO: 3188893 - protein, 18 aa, Giardia lamblia
IRDILDCIPLPDKSNKGK

SEQ ID NO: 3188894 - protein, 23 aa, Giardia lamblia
IRDNPYVFPVGCSEPREATPLAV

SEQ ID NO: 3188895 - protein, 18 aa, Giardia lamblia
IRDYAFAVVLLYHTARKI

SEQ ID NO: 3188896 - protein, 22 aa, Giardia lamblia
IREIIKVMNFSIQTGTCLLPEE

SEQ ID NO: 3188897 - protein, 20 aa, Giardia lamblia
IRELCDLYPILLGTTSAELD

SEQ ID NO: 3188898 - protein, 25 aa, Giardia lamblia
IRENMSQIMFLNEELDRAKSAAVDA

SEQ ID NO: 3188899 - protein, 40 aa, Giardia lamblia
IREQIELPLRHPELFKYLGVKPPRGILLTGPPGCGKTTIG

SEQ ID NO: 3188900 - protein, 26 aa, Giardia lamblia
IRERNFEHLLLLMATALPAEYVSICK

SEQ ID NO: 3188901 - protein, 23 aa, Giardia lamblia
IRESLELPLLHPQRFTNLGIEPC

SEQ ID NO: 3188902 - protein, 17 aa, Giardia lamblia
IRGCDLFIVGAICPPRC

SEQ ID NO: 3188903 - protein, 20 aa, Giardia lamblia
IRGIHRLMKMYYARRRNELG

SEQ ID NO: 3188904 - protein, 27 aa, Giardia lamblia
IRGKFEKDFMRLIESIESSKRAYHSVI

SEQ ID NO: 3188905 - protein, 34 aa, Giardia lamblia
IRGKRNFIPQQPLELGVALLWRYDTANVMDPASE

SEQ ID NO: 3188906 - protein, 17 aa, Giardia lamblia
IRHGLPVATADQINRAA

SEQ ID NO: 3188907 - protein, 18 aa, Giardia lamblia
IRHGSIPHIVQELLKIKL

SEQ ID NO: 3188908 - protein, 25 aa, Giardia lamblia
IRIKALRALRISCKLGISATPVQNS

SEQ ID NO: 3188909 - protein, 18 aa, Giardia lamblia
IRILAVKLIGRLCSLNPA

SEQ ID NO: 3188910 - protein, 26 aa, Giardia lamblia
IRIQSSKIPILSQLKFVLKSMRKDGY

SEQ ID NO: 3188911 - protein, 20 aa, Giardia lamblia
IRKSIDLALRFLIKNSTHGE

SEQ ID NO: 3188912 - protein, 21 aa, Giardia lamblia
IRKVVYFWNEIRMSNHLIDAL

SEQ ID NO: 3188913 - protein, 18 aa, Giardia lamblia
IRLHSRLALISGIQPEMD

SEQ ID NO: 3188914 - protein, 17 aa, Giardia lamblia
IRLKGLCSWHSSGQISI

SEQ ID NO: 3188915 - protein, 18 aa, Giardia lamblia
IRLVGPNCLGIVTPNLNC

SEQ ID NO: 3188916 - protein, 24 aa, Giardia lamblia
IRMRTTKWDFGFSALSWAAMNGHV

SEQ ID NO: 3188917 - protein, 17 aa, Giardia lamblia
IRNAAGLGAIHVCKKHK

SEQ ID NO: 3188918 - protein, 23 aa, Giardia lamblia
IRNACRLGMDWIALSFVQTKADV

SEQ ID NO: 3188919 - protein, 19 aa, Giardia lamblia
IRNDYADQIKLCELRQFIV

SEQ ID NO: 3188920 - protein, 26 aa, Giardia lamblia
IRNEAKFDPISIFYESIQTAPSAREI

SEQ ID NO: 3188921 - protein, 19 aa, Giardia lamblia
IRNIPPKLITLRAGSIYVL

SEQ ID NO: 3188922 - protein, 26 aa, Giardia lamblia
IRNRPSPLPLNTPEPQLRRALPTESD

SEQ ID NO: 3188923 - protein, 24 aa, Giardia lamblia
IRPPSPRSMIARSISPGSTLLDAA

SEQ ID NO: 3188924 - protein, 23 aa, Giardia lamblia
IRPSIDLTRTPLHRPPSGAATGA

SEQ ID NO: 3188925 - protein, 28 aa, Giardia lamblia
IRQFTHEIITLWYRPPEILLGSRHYSTS

SEQ ID NO: 3188926 - protein, 17 aa, Giardia lamblia
IRQLVDRLTLAEESLRT

SEQ ID NO: 3188927 - protein, 19 aa, Giardia lamblia
IRQLYYQLYNDSLGDVVRK

SEQ ID NO: 3188928 - protein, 22 aa, Giardia lamblia
IRRDYTHALLATPAAVCRARRA

SEQ ID NO: 3188929 - protein, 22 aa, Giardia lamblia
IRRYLQYAGRFNGDGVTALMIA

SEQ ID NO: 3188930 - protein, 23 aa, Giardia lamblia
IRSILNHVLGEFHKLVISNVIFD

SEQ ID NO: 3188931 - protein, 18 aa, Giardia lamblia
IRSLIRRHMCPDEMEGSV

SEQ ID NO: 3188932 - protein, 33 aa, Giardia lamblia
IRSLPTVHRFIVFLFSVIFRHSMLSKKSAMATD

SEQ ID NO: 3188933 - protein, 17 aa, Giardia lamblia
IRSLRNLGRVLLAVGDY

SEQ ID NO: 3188934 - protein, 32 aa, Giardia lamblia
IRSWTVEGVPKVVWFSGFSYPQAFLTGILQNY

SEQ ID NO: 3188935 - protein, 30 aa, Giardia lamblia
IRTAGECKNMFAPKLLRLALQHLTGQESDV

SEQ ID NO: 3188936 - protein, 22 aa, Giardia lamblia
IRTIYIDMYSYPGFSLDTMHYG

SEQ ID NO: 3188937 - protein, 18 aa, Giardia lamblia
IRVGTFIPAIGAIAKSEK

SEQ ID NO: 3188938 - protein, 27 aa, Giardia lamblia
IRVPELLHLAQIWMRNGRLSRLGSILL

SEQ ID NO: 3188939 - protein, 25 aa, Giardia lamblia
IRVPLSAFQLFFYNLAIANGRAMTN

SEQ ID NO: 3188940 - protein, 30 aa, Giardia lamblia
IRYENALQTIGPCDVWLLGIGHNGHIAFNE

SEQ ID NO: 3188941 - protein, 35 aa, Giardia lamblia
ISALMLAIRLQREAELRILLPYELTILDKQDEQPL

SEQ ID NO: 3188942 - protein, 24 aa, Giardia lamblia
ISAMDLGGRYLVKVSGLLSIDDSN

SEQ ID NO: 3188943 - protein, 23 aa, Giardia lamblia
ISAQNYAIADMLIPYEGYSSEEL

SEQ ID NO: 3188944 - protein, 26 aa, Giardia lamblia
ISASADIWMIGAILYELLTLQQLDLD

SEQ ID NO: 3188945 - protein, 21 aa, Giardia lamblia
ISATFFAYLFDEDFSHAQAVF

SEQ ID NO: 3188946 - protein, 19 aa, Giardia lamblia
ISCEGGCVRLYRISKDFDL

SEQ ID NO: 3188947 - protein, 26 aa, Giardia lamblia
ISDFASLCAILYIYCIYNAARHADHM

SEQ ID NO: 3188948 - protein, 30 aa, Giardia lamblia
ISDPRAFYLEALLSKLLLASSFNAADSFDA

SEQ ID NO: 3188949 - protein, 23 aa, Giardia lamblia
ISDQIPCKIVLDKQVLPDTAIGG

SEQ ID NO: 3188950 - protein, 22 aa, Giardia lamblia
ISEAIGFVSLIIHPSRIIYAST

SEQ ID NO: 3188951 - protein, 18 aa, Giardia lamblia
ISEHIVDLKKVYSGFAID

SEQ ID NO: 3188952 - protein, 25 aa, Giardia lamblia
ISEITGIYLLIPKDTPNILGPASGG

SEQ ID NO: 3188953 - protein, 25 aa, Giardia lamblia
ISEKYIDRPDLIEKFVITATDRSTI

SEQ ID NO: 3188954 - protein, 24 aa, Giardia lamblia
ISEPFRQYFVLKDNPQSSGSCSCG

SEQ ID NO: 3188955 - protein, 31 aa, Giardia lamblia
ISESLVDKLIARGVEWIFISSGDNLGAVVDP

SEQ ID NO: 3188956 - protein, 17 aa, Giardia lamblia
ISFFGVEGESLMLGLDD

SEQ ID NO: 3188957 - protein, 18 aa, Giardia lamblia
ISFIWAFTLIHEVLRYHR

SEQ ID NO: 3188958 - protein, 19 aa, Giardia lamblia
ISFKRHPLRFARALRMIAE

SEQ ID NO: 3188959 - protein, 29 aa, Giardia lamblia
ISFMAQVLLPLHRIMYVKTILPQLSYCVS

SEQ ID NO: 3188960 - protein, 23 aa, Giardia lamblia
ISGFGRIGRFALRYALTCPNVEI

SEQ ID NO: 3188961 - protein, 25 aa, Giardia lamblia
ISGLIPPIVSRCFCIRVPGFSDEEI

SEQ ID NO: 3188962 - protein, 26 aa, Giardia lamblia
ISGLTMVIYRLVYFQEEIFLIDTDTA

SEQ ID NO: 3188963 - protein, 23 aa, Giardia lamblia
ISGPLPPERCYLSPEVWADRISS

SEQ ID NO: 3188964 - protein, 28 aa, Giardia lamblia
ISGVLTQQWLAALPRLLREAIDLHILNN

SEQ ID NO: 3188965 - protein, 26 aa, Giardia lamblia
ISGYTSLMFFATTRAVLKNFDAYKSQ

SEQ ID NO: 3188966 - protein, 24 aa, Giardia lamblia
ISHDDVSLLLDYAKEYGYDTIIQM

SEQ ID NO: 3188967 - protein, 31 aa, Giardia lamblia
ISHLRTSFDYIYLPLLKAPSYTKNWPSVLVT

SEQ ID NO: 3188968 - protein, 27 aa, Giardia lamblia
ISHYCYYEYLPMCLFLAIQTSDALRVY

SEQ ID NO: 3188969 - protein, 26 aa, Giardia lamblia
ISIEEVIMLIDLIKRGAPNESFEEID

SEQ ID NO: 3188970 - protein, 23 aa, Giardia lamblia
ISIHPPIKVLFNIAVLHANSLVK

SEQ ID NO: 3188971 - protein, 18 aa, Giardia lamblia
ISIIALGIGIGPFTSYSE

SEQ ID NO: 3188972 - protein, 17 aa, Giardia lamblia
ISIKSGTIITLLSAAST

SEQ ID NO: 3188973 - protein, 18 aa, Giardia lamblia
ISILRNEILMHQSEIGLL

SEQ ID NO: 3188974 - protein, 19 aa, Giardia lamblia
ISIMCYLPTFARTPNRNGE

SEQ ID NO: 3188975 - protein, 27 aa, Giardia lamblia
ISIPYECRPFINKLSNAPLQVLTSPAA

SEQ ID NO: 3188976 - protein, 20 aa, Giardia lamblia
ISIYLHKYREFLHAAFILGG

SEQ ID NO: 3188977 - protein, 28 aa, Giardia lamblia
ISKAEAALYPHLRFPNVTSAPSTPRGGL

SEQ ID NO: 3188978 - protein, 21 aa, Giardia lamblia
ISKALLPVEGIYTFPVPADGA

SEQ ID NO: 3188979 - protein, 24 aa, Giardia lamblia
ISKLSKLRPTIAFHASIEHPFGRN

SEQ ID NO: 3188980 - protein, 27 aa, Giardia lamblia
ISKSKGPFFLPYLSQLPVIRDVCKARG

SEQ ID NO: 3188981 - protein, 30 aa, Giardia lamblia
ISKYQRRIYFSIDRMRFVLNKAARVVATYL

SEQ ID NO: 3188982 - protein, 32 aa, Giardia lamblia
ISLAHLRLDTSLSELLIFLGDADKFPMVKEIS

SEQ ID NO: 3188983 - protein, 20 aa, Giardia lamblia
ISLKDRFFLLESFKVDVLAN

SEQ ID NO: 3188984 - protein, 24 aa, Giardia lamblia
ISMDETWFITIGEDNWIIAHSLDE

SEQ ID NO: 3188985 - protein, 22 aa, Giardia lamblia
ISMLLEIQMIYSLYLGKDTLEY

SEQ ID NO: 3188986 - protein, 18 aa, Giardia lamblia
ISMTSLLEDAPLLLSNER

SEQ ID NO: 3188987 - protein, 37 aa, Giardia lamblia
ISMTSQPYQQLPPAPQHPLPYNMQIPNPGCINCAKLT

SEQ ID NO: 3188988 - protein, 32 aa, Giardia lamblia
ISNDIYRVMCGVPMLLLAYGVTSAGKTYTLFG

SEQ ID NO: 3188989 - protein, 26 aa, Giardia lamblia
ISNDMRFRFFPPEQTILPSKPINSIG

SEQ ID NO: 3188990 - protein, 20 aa, Giardia lamblia
ISNLIWRAFKQRVCGYDFIR

SEQ ID NO: 3188991 - protein, 25 aa, Giardia lamblia
ISPGTLLYHDVDLRSLVLVLGSTIQ

SEQ ID NO: 3188992 - protein, 29 aa, Giardia lamblia
ISPIEGVPTYLKRLLKSLAELVGALRLLN

SEQ ID NO: 3188993 - protein, 18 aa, Giardia lamblia
ISPLELALKHDLTRYIGI

SEQ ID NO: 3188994 - protein, 30 aa, Giardia lamblia
ISPSSYYYAAFVRPFGVYLARKSASTNIQG

SEQ ID NO: 3188995 - protein, 18 aa, Giardia lamblia
ISQAPIPRSPEADTRQSY

SEQ ID NO: 3188996 - protein, 20 aa, Giardia lamblia
ISQIFHTRYSLFKMAYNSPA

SEQ ID NO: 3188997 - protein, 28 aa, Giardia lamblia
ISQIKESFLLPLQRPDLLKKIGIKPSKG

SEQ ID NO: 3188998 - protein, 25 aa, Giardia lamblia
ISQILFPTVIPESFLKKESDHIKGF

SEQ ID NO: 3188999 - protein, 23 aa, Giardia lamblia
ISQPILRIPPHIYAYKRCDALHF

SEQ ID NO: 3189000 - protein, 21 aa, Giardia lamblia
ISQRMERLRILLEGELGLTNF

SEQ ID NO: 3189001 - protein, 23 aa, Giardia lamblia
ISQTAFNLLVNLKARFGAKDARK

SEQ ID NO: 3189002 - protein, 23 aa, Giardia lamblia
ISRHKHMYPVFLSLYNKHIDSIN

SEQ ID NO: 3189003 - protein, 17 aa, Giardia lamblia
ISRISRVLSVSQSAEAF

SEQ ID NO: 3189004 - protein, 26 aa, Giardia lamblia
ISSAFRYYLNYLLATDKRLTPIQQGD

SEQ ID NO: 3189005 - protein, 26 aa, Giardia lamblia
ISSEERFYISIWFIGAMKLSGDDLRK

SEQ ID NO: 3189006 - protein, 17 aa, Giardia lamblia
ISSFLIVHDERIQRYAD

SEQ ID NO: 3189007 - protein, 24 aa, Giardia lamblia
ISSGGLISLARQLEMPAPNIPQNI

SEQ ID NO: 3189008 - protein, 17 aa, Giardia lamblia
ISSGITPWQLARDSGFM

SEQ ID NO: 3189009 - protein, 24 aa, Giardia lamblia
ISSILPRPSVFGYSLEFYDKYDDL

SEQ ID NO: 3189010 - protein, 20 aa, Giardia lamblia
ISSLYNILEERVVFGLMATN

SEQ ID NO: 3189011 - protein, 29 aa, Giardia lamblia
ISSTFVAAWSWALPAIYFENKRFDTVPEP

SEQ ID NO: 3189012 - protein, 26 aa, Giardia lamblia
ISTFASVLKVLFRTGARDFLCSACSQ

SEQ ID NO: 3189013 - protein, 20 aa, Giardia lamblia
ISTGELVKPLNVPCLEEVVE

SEQ ID NO: 3189014 - protein, 23 aa, Giardia lamblia
ISTHSRLFNPHLLVPIACGESNM

SEQ ID NO: 3189015 - protein, 17 aa, Giardia lamblia
ISTIYTVFLFDADDNIV

SEQ ID NO: 3189016 - protein, 18 aa, Giardia lamblia
ISTLKKDLTNLRAELLSS

SEQ ID NO: 3189017 - protein, 24 aa, Giardia lamblia
ISTQLLYGDFRSLSDPQYHTYCYA

SEQ ID NO: 3189018 - protein, 25 aa, Giardia lamblia
ISTSTLTVILLQKLTVYGLGSQLEQ

SEQ ID NO: 3189019 - protein, 18 aa, Giardia lamblia
ISTTFGWTDLMYAAATND

SEQ ID NO: 3189020 - protein, 27 aa, Giardia lamblia
ISTTLGYKVIFPLIKDFVSYAKANPTV

SEQ ID NO: 3189021 - protein, 24 aa, Giardia lamblia
ISTVTKLALMLTTLGFEVGVVHGS

SEQ ID NO: 3189022 - protein, 24 aa, Giardia lamblia
ISVFEDSSFGPCLCFGLGGTAIEY

SEQ ID NO: 3189023 - protein, 17 aa, Giardia lamblia
ISVILRPELVLASKACS

SEQ ID NO: 3189024 - protein, 18 aa, Giardia lamblia
ISVKIPRDYPLSPPECNF

SEQ ID NO: 3189025 - protein, 25 aa, Giardia lamblia
ISVSYYQIYLEQVYDLLAFEAGETG

SEQ ID NO: 3189026 - protein, 25 aa, Giardia lamblia
ISVYAGFQLQLGFGLPYTATAIGSS

SEQ ID NO: 3189027 - protein, 24 aa, Giardia lamblia
ISVYVHNYLLDCASKLSKAATALC

SEQ ID NO: 3189028 - protein, 30 aa, Giardia lamblia
ISYELLSIPPPCLPQWGTPFSIQQIPSSSI

SEQ ID NO: 3189029 - protein, 18 aa, Giardia lamblia
ISYHEFFGYYSFSDWIDG

SEQ ID NO: 3189030 - protein, 25 aa, Giardia lamblia
ISYLANVHFVLWELSKPGLDPTYLM

SEQ ID NO: 3189031 - protein, 18 aa, Giardia lamblia
ISYSLTRSLQLPLNTSLY

SEQ ID NO: 3189032 - protein, 19 aa, Giardia lamblia
ISYYQQLVEDLRAGIATLD

SEQ ID NO: 3189033 - protein, 17 aa, Giardia lamblia
ITADLLSKFTALQEAHD

SEQ ID NO: 3189034 - protein, 18 aa, Giardia lamblia
ITAFIDIFRLTHMEQPMG

SEQ ID NO: 3189035 - protein, 24 aa, Giardia lamblia
ITAKLMRFDHIIFILSGKGGAGKS

SEQ ID NO: 3189036 - protein, 30 aa, Giardia lamblia
ITCDSALTSFSLAGLWMLIPEIANSTPREY

SEQ ID NO: 3189037 - protein, 25 aa, Giardia lamblia
ITCRYQIIKYIRDKLHSLFPELQLI

SEQ ID NO: 3189038 - protein, 20 aa, Giardia lamblia
ITDIPRLSFIVGPNGSGKTN

SEQ ID NO: 3189039 - protein, 27 aa, Giardia lamblia
ITDPTLQLDFFTALPLTTRRALKAASV

SEQ ID NO: 3189040 - protein, 23 aa, Giardia lamblia
ITDSCVPLHLLELQDTLPGSVLE

SEQ ID NO: 3189041 - protein, 29 aa, Giardia lamblia
ITDSFVVRGFVIPTLPRGAVQRMQNCRIA

SEQ ID NO: 3189042 - protein, 24 aa, Giardia lamblia
ITDTPAYQFLPDYSLLQSEDLNES

SEQ ID NO: 3189043 - protein, 22 aa, Giardia lamblia
ITEDIYEILRKLSPNIPDSNVV

SEQ ID NO: 3189044 - protein, 33 aa, Giardia lamblia
ITEKVDIWSLGTTLFFIAAFQSVWISSDYASIV

SEQ ID NO: 3189045 - protein, 18 aa, Giardia lamblia
ITEKVILSTYSRPPSSFK

SEQ ID NO: 3189046 - protein, 19 aa, Giardia lamblia
ITELQNIISYKLALNGLKL

SEQ ID NO: 3189047 - protein, 24 aa, Giardia lamblia
ITELYDRIRALTDELHLALDSLNT

SEQ ID NO: 3189048 - protein, 24 aa, Giardia lamblia
ITETTIIGLLLHAAAALGFVCNPI

SEQ ID NO: 3189049 - protein, 19 aa, Giardia lamblia
ITFIDRAVVRLEREAISRC

SEQ ID NO: 3189050 - protein, 18 aa, Giardia lamblia
ITFLGLSFSRLRANPQTS

SEQ ID NO: 3189051 - protein, 26 aa, Giardia lamblia
ITFYDDPLRILRAIRFSKRLGFELDK

SEQ ID NO: 3189052 - protein, 33 aa, Giardia lamblia
ITGGDDKMLFLWRVRDWEPMLTLRRHRHPISSV

SEQ ID NO: 3189053 - protein, 24 aa, Giardia lamblia
ITGGRTHLKFWKMAQTFTGVKLQG

SEQ ID NO: 3189054 - protein, 26 aa, Giardia lamblia
ITGLAADLFLIVFYSCIDVHKMWAHM

SEQ ID NO: 3189055 - protein, 25 aa, Giardia lamblia
ITGTEKYLIIWNFDKVKAGVVSSSR

SEQ ID NO: 3189056 - protein, 20 aa, Giardia lamblia
ITHYVRKCPLYHKLNWVIPD

SEQ ID NO: 3189057 - protein, 21 aa, Giardia lamblia
ITIEKPLFFVPKESDLAASQD

SEQ ID NO: 3189058 - protein, 17 aa, Giardia lamblia
ITIINQRGSKPSYSWNN

SEQ ID NO: 3189059 - protein, 20 aa, Giardia lamblia
ITIPARPRAAKSPPLRSAVE

SEQ ID NO: 3189060 - protein, 26 aa, Giardia lamblia
ITIQTLVSRLILMLQQIYTSRAGRPK

SEQ ID NO: 3189061 - protein, 22 aa, Giardia lamblia
ITKELLLMENKMTMKNGETALI

SEQ ID NO: 3189062 - protein, 33 aa, Giardia lamblia
ITLIKAMEQLSRSAALLAWKSIKETNAGKEMAQ

SEQ ID NO: 3189063 - protein, 24 aa, Giardia lamblia
ITLLLCLKVNYPARIYLLRGNHEC

SEQ ID NO: 3189064 - protein, 19 aa, Giardia lamblia
ITLNLRYGFNHMLYQKSMI

SEQ ID NO: 3189065 - protein, 20 aa, Giardia lamblia
ITMDWRNGYTALMLAAKYNK

SEQ ID NO: 3189066 - protein, 18 aa, Giardia lamblia
ITNACKSCWSLDSGKIAM

SEQ ID NO: 3189067 - protein, 23 aa, Giardia lamblia
ITNGRVFILHLIGQTLGKDEPAV

SEQ ID NO: 3189068 - protein, 28 aa, Giardia lamblia
ITNKSAAAISLVFSALLHLASEGHVGLE

SEQ ID NO: 3189069 - protein, 29 aa, Giardia lamblia
ITPHELLRSRFIFFYVHNEVQIKQVMKFM

SEQ ID NO: 3189070 - protein, 24 aa, Giardia lamblia
ITPQNLYEYSFIDPLQPFVRENKA

SEQ ID NO: 3189071 - protein, 34 aa, Giardia lamblia
ITQCPSKVWQMQLYYFLYAHYYTAACILKALQED

SEQ ID NO: 3189072 - protein, 21 aa, Giardia lamblia
ITQLSQGWARFSLYGNTSAKE

SEQ ID NO: 3189073 - protein, 30 aa, Giardia lamblia
ITQSTLPAFGWSLSLYLPGLHDTPLATIHN

SEQ ID NO: 3189074 - protein, 28 aa, Giardia lamblia
ITRDQFELLTAPLVARLIPPCKQALTDA

SEQ ID NO: 3189075 - protein, 49 aa, Giardia lamblia
ITRGYRLVFHTGQFRYLFSDMLLGRPTIFAASPRFFKKLHQYLVEFLTK

SEQ ID NO: 3189076 - protein, 30 aa, Giardia lamblia
ITRKTYMKYLTILNPYKVQTAWYLKEYHTR

SEQ ID NO: 3189077 - protein, 19 aa, Giardia lamblia
ITRLNIGNCIYSLHSFSHD

SEQ ID NO: 3189078 - protein, 24 aa, Giardia lamblia
ITRRFTMMLQPLVSLIVDTIVAQY

SEQ ID NO: 3189079 - protein, 24 aa, Giardia lamblia
ITRTAFGALVQRYLRMRQTRIMVQ

SEQ ID NO: 3189080 - protein, 22 aa, Giardia lamblia
ITSISILDYILQDIIASYSNNL

SEQ ID NO: 3189081 - protein, 18 aa, Giardia lamblia
ITSKQTGALLRLVRIFPP

SEQ ID NO: 3189082 - protein, 20 aa, Giardia lamblia
ITSSLMLREKKRLYRRFMRL

SEQ ID NO: 3189083 - protein, 34 aa, Giardia lamblia
ITTDANPYYDLFVKWQFRKLYRDGYIKFGKRNCI

SEQ ID NO: 3189084 - protein, 25 aa, Giardia lamblia
ITTFKLQIDGLLAETADKSAIIQNL

SEQ ID NO: 3189085 - protein, 21 aa, Giardia lamblia
ITTLYQLLAFCDCSILSVHSF

SEQ ID NO: 3189086 - protein, 26 aa, Giardia lamblia
ITTRQSIKVGLLPKIFTMLLGACDGN

SEQ ID NO: 3189087 - protein, 21 aa, Giardia lamblia
ITTTGLFRRGHVGQKLSSSCS

SEQ ID NO: 3189088 - protein, 26 aa, Giardia lamblia
ITYEAFSRSLPVPPLRKLTKNSKNDS

SEQ ID NO: 3189089 - protein, 38 aa, Giardia lamblia
ITYIKEESFITPSVAELIFIVLKFFPSMTPSAINEKVS

SEQ ID NO: 3189090 - protein, 26 aa, Giardia lamblia
ITYKELLRVHYYKRKPRIARMSTCAC

SEQ ID NO: 3189091 - protein, 22 aa, Giardia lamblia
ITYKKCVPGYFKEAYLNNLSLS

SEQ ID NO: 3189092 - protein, 22 aa, Giardia lamblia
ITYNVMSKRRLLTLVDKKIVMG

SEQ ID NO: 3189093 - protein, 19 aa, Giardia lamblia
IVALLLPYEGGMSSADGWT

SEQ ID NO: 3189094 - protein, 24 aa, Giardia lamblia
IVALLVPHEGGMQRKDGYTALMSA

SEQ ID NO: 3189095 - protein, 38 aa, Giardia lamblia
IVALPVVHSPLRFLLDMILKLNLTVKPIFPCLDKSDDD

SEQ ID NO: 3189096 - protein, 45 aa, Giardia lamblia
IVAQKNLFPFPHSTAPWLWGADPLLNLLPLPNSIILADGAFARCS

SEQ ID NO: 3189097 - protein, 20 aa, Giardia lamblia
IVAQNDLIFRWSTSITILPV

SEQ ID NO: 3189098 - protein, 25 aa, Giardia lamblia
IVATYVVFPIVLDTLGIGGGCTLSA

SEQ ID NO: 3189099 - protein, 21 aa, Giardia lamblia
IVCEQCFIASQLRTCPLCRSP

SEQ ID NO: 3189100 - protein, 26 aa, Giardia lamblia
IVCLCLFSEVFAYLPAHALLDNSSPA

SEQ ID NO: 3189101 - protein, 26 aa, Giardia lamblia
IVCNNPPCVSFLLPYELHMADKNGKT

SEQ ID NO: 3189102 - protein, 25 aa, Giardia lamblia
IVDFMSDFARYFFLISDLSAGNTEP

SEQ ID NO: 3189103 - protein, 24 aa, Giardia lamblia
IVDGRRLVYFFNGDFVDRGGSGYQ

SEQ ID NO: 3189104 - protein, 25 aa, Giardia lamblia
IVDIYPETFPKYMDPIIAKLNDIFN

SEQ ID NO: 3189105 - protein, 25 aa, Giardia lamblia
IVDKAQWFIAYFKHIQSVEFIEQLF

SEQ ID NO: 3189106 - protein, 24 aa, Giardia lamblia
IVDNARILTYIRSDIRMVLRDRNL

SEQ ID NO: 3189107 - protein, 23 aa, Giardia lamblia
IVDRANIQALFRLICNRPEPELN

SEQ ID NO: 3189108 - protein, 26 aa, Giardia lamblia
IVDVDQVLPFPKLQTLNLSHNRIVRL

SEQ ID NO: 3189109 - protein, 28 aa, Giardia lamblia
IVEHRFYDIYLFYQKMVQIAITTPWAYS

SEQ ID NO: 3189110 - protein, 31 aa, Giardia lamblia
IVETIEIVQSIYILPGLRNNKLTTWSTACRT

SEQ ID NO: 3189111 - protein, 25 aa, Giardia lamblia
IVETLFPHEAGFRTLTTVSPYKPNT

SEQ ID NO: 3189112 - protein, 24 aa, Giardia lamblia
IVFEKAGQSLWRARTGLETASRVP

SEQ ID NO: 3189113 - protein, 17 aa, Giardia lamblia
IVFLAFAEKLRTGRESA

SEQ ID NO: 3189114 - protein, 20 aa, Giardia lamblia
IVFVDPLDGTFNFVHGCLFG

SEQ ID NO: 3189115 - protein, 19 aa, Giardia lamblia
IVGLTNIIYFARNSKFGGC

SEQ ID NO: 3189116 - protein, 19 aa, Giardia lamblia
IVGVVNYLTSKAEELKMLS

SEQ ID NO: 3189117 - protein, 18 aa, Giardia lamblia
IVHDERIQRYADPYTPYL

SEQ ID NO: 3189118 - protein, 20 aa, Giardia lamblia
IVHRDLRPASILISEDKKRV

SEQ ID NO: 3189119 - protein, 26 aa, Giardia lamblia
IVIEGYQLALKKALNYIEKRLKVNAS

SEQ ID NO: 3189120 - protein, 26 aa, Giardia lamblia
IVIKGAHLCANWLSVLPSWLMESSVS

SEQ ID NO: 3189121 - protein, 20 aa, Giardia lamblia
IVILMRDYRLTSVKLVAVIK

SEQ ID NO: 3189122 - protein, 18 aa, Giardia lamblia
IVKDSACFVSWALARVYS

SEQ ID NO: 3189123 - protein, 21 aa, Giardia lamblia
IVKLLVCRALYPHYTYKLDAE

SEQ ID NO: 3189124 - protein, 18 aa, Giardia lamblia
IVKLWIHETFREFTDSRS

SEQ ID NO: 3189125 - protein, 18 aa, Giardia lamblia
IVKYIRRYQDKAATLIYI

SEQ ID NO: 3189126 - protein, 17 aa, Giardia lamblia
IVLAQIGCFVPCEAAYI

SEQ ID NO: 3189127 - protein, 30 aa, Giardia lamblia
IVLDQYDLNMIRHRAGPLYPTESVSGRDDT

SEQ ID NO: 3189128 - protein, 18 aa, Giardia lamblia
IVLHLPLACEDKGVPYVF

SEQ ID NO: 3189129 - protein, 18 aa, Giardia lamblia
IVLLIQTIAEVEQTARGI

SEQ ID NO: 3189130 - protein, 18 aa, Giardia lamblia
IVLPYDMPEYRELPIASS

SEQ ID NO: 3189131 - protein, 24 aa, Giardia lamblia
IVLRFGITWSMYRHTYSEMSAGVS

SEQ ID NO: 3189132 - protein, 18 aa, Giardia lamblia
IVMEKILDVLFNYSDPQK

SEQ ID NO: 3189133 - protein, 17 aa, Giardia lamblia
IVMPRRSVPLSLNVKYE

SEQ ID NO: 3189134 - protein, 19 aa, Giardia lamblia
IVNTDLLVNVPLDFIRDTF

SEQ ID NO: 3189135 - protein, 29 aa, Giardia lamblia
IVNVANIPPHRIRMGYGDDLTALVLGIAD

SEQ ID NO: 3189136 - protein, 42 aa, Giardia lamblia
IVPMEEIYFGYLVPYVCSLALHALFFDFSNYLMISLNSIEQS

SEQ ID NO: 3189137 - protein, 24 aa, Giardia lamblia
IVPSKMRLALLISTLAFETVKASE

SEQ ID NO: 3189138 - protein, 18 aa, Giardia lamblia
IVQLVKRLLHPTNGMVSC

SEQ ID NO: 3189139 - protein, 26 aa, Giardia lamblia
IVRALELYAKFQFKVIPVVNAEGSFG

SEQ ID NO: 3189140 - protein, 17 aa, Giardia lamblia
IVRFLREFDFRFTYTRS

SEQ ID NO: 3189141 - protein, 19 aa, Giardia lamblia
IVRLLLPEANIADNSGMTP

SEQ ID NO: 3189142 - protein, 17 aa, Giardia lamblia
IVRLQRELKLIDQPTKS

SEQ ID NO: 3189143 - protein, 17 aa, Giardia lamblia
IVRLWTHECLRVYHDRL

SEQ ID NO: 3189144 - protein, 23 aa, Giardia lamblia
IVRNIFRRLFRVYAHIFMCHYGT

SEQ ID NO: 3189145 - protein, 17 aa, Giardia lamblia
IVRPTLRSLRLSTSSHV

SEQ ID NO: 3189146 - protein, 18 aa, Giardia lamblia
IVRQRLALFYPDGAARNS

SEQ ID NO: 3189147 - protein, 26 aa, Giardia lamblia
IVRTHLRDMIIFPEMIGMTVSVYNGR

SEQ ID NO: 3189148 - protein, 18 aa, Giardia lamblia
IVSALLYGLPGNGKSMFA

SEQ ID NO: 3189149 - protein, 17 aa, Giardia lamblia
IVSIVPYDVWVTSYDRV

SEQ ID NO: 3189150 - protein, 20 aa, Giardia lamblia
IVSKLITLKEFRIRAGSSSC

SEQ ID NO: 3189151 - protein, 30 aa, Giardia lamblia
IVSQLTVLELELLFFEAQLTEIDGKQEQMR

SEQ ID NO: 3189152 - protein, 22 aa, Giardia lamblia
IVSSSRPLLTIQRAFPLLSSRK

SEQ ID NO: 3189153 - protein, 20 aa, Giardia lamblia
IVTAIQIFSLPLLSVVTKKE

SEQ ID NO: 3189154 - protein, 19 aa, Giardia lamblia
IVTARLLCLFPDASVGTLV

SEQ ID NO: 3189155 - protein, 24 aa, Giardia lamblia
IVTDFGIHCRYWKTAAISSTKESQ

SEQ ID NO: 3189156 - protein, 18 aa, Giardia lamblia
IVTPIQSLDPISGNKAIM

SEQ ID NO: 3189157 - protein, 24 aa, Giardia lamblia
IVTPYIDKLLAGDTEFAILGHSWA

SEQ ID NO: 3189158 - protein, 17 aa, Giardia lamblia
IVTTYEYAIKDRSFFRQ

SEQ ID NO: 3189159 - protein, 29 aa, Giardia lamblia
IVVARNMALVRLQAIILCLQKNNEKNIRE

SEQ ID NO: 3189160 - protein, 17 aa, Giardia lamblia
IVVIKDPCYGGTSGSFA

SEQ ID NO: 3189161 - protein, 22 aa, Giardia lamblia
IVYFAHTYPYTYEHEQLWINSL

SEQ ID NO: 3189162 - protein, 31 aa, Giardia lamblia
IWACACILCEILLMKPLFPGANDIDMLNLIT

SEQ ID NO: 3189163 - protein, 19 aa, Giardia lamblia
IWAFTLIHEVLRYHRDFYQ

SEQ ID NO: 3189164 - protein, 18 aa, Giardia lamblia
IWCCLPSSFPETCTFTII

SEQ ID NO: 3189165 - protein, 18 aa, Giardia lamblia
IWDYLRGLYDWVTTEGAG

SEQ ID NO: 3189166 - protein, 19 aa, Giardia lamblia
IWEHRVKFYSLLNTNQTVE

SEQ ID NO: 3189167 - protein, 19 aa, Giardia lamblia
IWEKMRVKKLPPPERLRYI

SEQ ID NO: 3189168 - protein, 22 aa, Giardia lamblia
IWKAYSDIITISYFFGSQLQQI

SEQ ID NO: 3189169 - protein, 17 aa, Giardia lamblia
IWMICKQYRESQAYQYT

SEQ ID NO: 3189170 - protein, 21 aa, Giardia lamblia
IWSFGCIMAEILLGQPLFPGD

SEQ ID NO: 3189171 - protein, 27 aa, Giardia lamblia
IWSLGCIILEICTLKPIPWSTEHLKDN

SEQ ID NO: 3189172 - protein, 23 aa, Giardia lamblia
IWSLGMTALFLCESHYLVVGSTA

SEQ ID NO: 3189173 - protein, 23 aa, Giardia lamblia
IYAKGLRLLHPICLDTWNYGKEY

SEQ ID NO: 3189174 - protein, 24 aa, Giardia lamblia
IYANFMMMRSYIRSIIKSEIMCYM

SEQ ID NO: 3189175 - protein, 27 aa, Giardia lamblia
IYARCNAELGFLIKVTPSSKVVGDLAL

SEQ ID NO: 3189176 - protein, 17 aa, Giardia lamblia
IYDKLQLLASHTTPQDL

SEQ ID NO: 3189177 - protein, 17 aa, Giardia lamblia
IYDLYEKVGIDAKISAC

SEQ ID NO: 3189178 - protein, 25 aa, Giardia lamblia
IYDNRTYTILKDVVFLFVTKFSNDF

SEQ ID NO: 3189179 - protein, 25 aa, Giardia lamblia
IYDVLIQIISRHYVLLLIGGTDAPI

SEQ ID NO: 3189180 - protein, 25 aa, Giardia lamblia
IYEGKLTQIPLYFGGHTRSIPTVYA

SEQ ID NO: 3189181 - protein, 18 aa, Giardia lamblia
IYEIAKLLKDQQSTAVIP

SEQ ID NO: 3189182 - protein, 23 aa, Giardia lamblia
IYEKTLPNRPLSISGLKAMQSDT

SEQ ID NO: 3189183 - protein, 23 aa, Giardia lamblia
IYERLASVMAALPLHVAVRPHGI

SEQ ID NO: 3189184 - protein, 18 aa, Giardia lamblia
IYFELTPANIYDKVIQRN

SEQ ID NO: 3189185 - protein, 21 aa, Giardia lamblia
IYGAPFIVEPLYSLTKSPVKQ

SEQ ID NO: 3189186 - protein, 17 aa, Giardia lamblia
IYGIGYGSALSAPHSTN

SEQ ID NO: 3189187 - protein, 18 aa, Giardia lamblia
IYGKKFIDQALRLPSSDQ

SEQ ID NO: 3189188 - protein, 19 aa, Giardia lamblia
IYINVLYEIEALKGREKVG

SEQ ID NO: 3189189 - protein, 28 aa, Giardia lamblia
IYLGMVDYAFFLRDLSLPPDSSIFLSPE

SEQ ID NO: 3189190 - protein, 17 aa, Giardia lamblia
IYLIPNLVSMEKVTPIC

SEQ ID NO: 3189191 - protein, 20 aa, Giardia lamblia
IYLKLPSIAISFFTYQKQTK

SEQ ID NO: 3189192 - protein, 27 aa, Giardia lamblia
IYLVPLHHHRIFSAKLPLLAEKMTWTS

SEQ ID NO: 3189193 - protein, 18 aa, Giardia lamblia
IYMQPPNILQFAASFFKS

SEQ ID NO: 3189194 - protein, 25 aa, Giardia lamblia
IYNQTLTHLIGVGRIPLSGLLETCE

SEQ ID NO: 3189195 - protein, 19 aa, Giardia lamblia
IYPVYRFGCINTKDKSVLP

SEQ ID NO: 3189196 - protein, 18 aa, Giardia lamblia
IYPVYRFGCLNTKDQSVL

SEQ ID NO: 3189197 - protein, 24 aa, Giardia lamblia
IYQSPVLFTSLADASPLPSSNPTT

SEQ ID NO: 3189198 - protein, 19 aa, Giardia lamblia
IYQYNLLHLDLADNALDEF

SEQ ID NO: 3189199 - protein, 19 aa, Giardia lamblia
IYRARYMLAKIRRTARNLL

SEQ ID NO: 3189200 - protein, 18 aa, Giardia lamblia
IYREIKILTNLLAGPNCI

SEQ ID NO: 3189201 - protein, 19 aa, Giardia lamblia
IYRIVSHASERIYEPIYSC

SEQ ID NO: 3189202 - protein, 17 aa, Giardia lamblia
IYRLFRKAQVEPECLVA

SEQ ID NO: 3189203 - protein, 17 aa, Giardia lamblia
IYSGTNVLFLGLGTVLG

SEQ ID NO: 3189204 - protein, 20 aa, Giardia lamblia
IYSTPFPLPNVIPAAVPEFL

SEQ ID NO: 3189205 - protein, 36 aa, Giardia lamblia
IYTKTDYYTFYCAHFALLGMHRLAAYLINCACNDKG

SEQ ID NO: 3189206 - protein, 24 aa, Giardia lamblia
IYVKDLIKKLLKSMFEWLALKTNE

SEQ ID NO: 3189207 - protein, 17 aa, Giardia lamblia
IYYMLNVNPTNRPLLSD

SEQ ID NO: 3189208 - protein, 26 aa, Giardia lamblia
KAAELGDVVLVFSLLASQAGAKDADG

SEQ ID NO: 3189209 - protein, 23 aa, Giardia lamblia
KAAKYFFEFVGDWSRLSLTLVKL

SEQ ID NO: 3189210 - protein, 22 aa, Giardia lamblia
KAANKMALNDPPIGSVIPPLSD

SEQ ID NO: 3189211 - protein, 47 aa, Giardia lamblia
KAAREKEELLLIVRKQQQLIDVLQRQKLHLQGALHLGLTEAQFNKLL

SEQ ID NO: 3189212 - protein, 24 aa, Giardia lamblia
KACIPQDMITVWSPSLSCIQSNRL

SEQ ID NO: 3189213 - protein, 18 aa, Giardia lamblia
KACLLCSDVIKNAIIYKK

SEQ ID NO: 3189214 - protein, 21 aa, Giardia lamblia
KACRKLQLTLGEFRRVCIIKG

SEQ ID NO: 3189215 - protein, 29 aa, Giardia lamblia
KACTESQRLLFIFITTYADRMNVKLVLAA

SEQ ID NO: 3189216 - protein, 27 aa, Giardia lamblia
KADAVFFQFPVYWFSSPPSLKVFMDSV

SEQ ID NO: 3189217 - protein, 17 aa, Giardia lamblia
KADFVPHVIPTSSPRSG

SEQ ID NO: 3189218 - protein, 44 aa, Giardia lamblia
KADIWSIGCLFIEMFTTYPPFFQFKQVPALLYHIATITEPPGLP

SEQ ID NO: 3189219 - protein, 30 aa, Giardia lamblia
KADIWSVGVLLYLMLGRTLPFQANTLEALF

SEQ ID NO: 3189220 - protein, 25 aa, Giardia lamblia
KADKNLNRYLFGNLSKHEDYPAGGI

SEQ ID NO: 3189221 - protein, 34 aa, Giardia lamblia
KADLGLEPISIMAKPLAVQSPDRIIKDPYDVRGT

SEQ ID NO: 3189222 - protein, 17 aa, Giardia lamblia
KADLVGYRTPVSETALC

SEQ ID NO: 3189223 - protein, 29 aa, Giardia lamblia
KADLWSLGCLIYEFITGLKPLRVSPVMEA

SEQ ID NO: 3189224 - protein, 18 aa, Giardia lamblia
KADPKQFYILVILTDGDV

SEQ ID NO: 3189225 - protein, 24 aa, Giardia lamblia
KADRPSVATFLFQKERHICDKDGI

SEQ ID NO: 3189226 - protein, 24 aa, Giardia lamblia
KADTRMTIVRKISSALSSCFLSDG

SEQ ID NO: 3189227 - protein, 24 aa, Giardia lamblia
KAEDMHVRMLFNFYEKLGQREAIH

SEQ ID NO: 3189228 - protein, 20 aa, Giardia lamblia
KAEEPKDFLKAHSGAAGAPH

SEQ ID NO: 3189229 - protein, 24 aa, Giardia lamblia
KAEGMIKIRPLLKTLNLPESFASD

SEQ ID NO: 3189230 - protein, 23 aa, Giardia lamblia
KAEIHALRVDKQRLKDKLLVAEK

SEQ ID NO: 3189231 - protein, 18 aa, Giardia lamblia
KAEIRRLTADNSALLKEV

SEQ ID NO: 3189232 - protein, 22 aa, Giardia lamblia
KAELEIPYPIQSCIACLYGNID

SEQ ID NO: 3189233 - protein, 21 aa, Giardia lamblia
KAELLHYKQIVGSALTDATPI

SEQ ID NO: 3189234 - protein, 17 aa, Giardia lamblia
KAELPFSLCLTLVPLES

SEQ ID NO: 3189235 - protein, 19 aa, Giardia lamblia
KAEPFLVDTTAHSSLAALE

SEQ ID NO: 3189236 - protein, 23 aa, Giardia lamblia
KAESLYLEHLLNFSLSIGGQTAQ

SEQ ID NO: 3189237 - protein, 20 aa, Giardia lamblia
KAFCLYVLHSLAAGNLRLAK

SEQ ID NO: 3189238 - protein, 19 aa, Giardia lamblia
KAFEARYISRYHAVVAADV

SEQ ID NO: 3189239 - protein, 25 aa, Giardia lamblia
KAFELDYPEIWWTRPTNYSLTNGIV

SEQ ID NO: 3189240 - protein, 24 aa, Giardia lamblia
KAGITFPMWFFGVQNQSDLVSRSF

SEQ ID NO: 3189241 - protein, 26 aa, Giardia lamblia
KAGKTYRIIMPYYELQDLQTYAEMLR

SEQ ID NO: 3189242 - protein, 23 aa, Giardia lamblia
KAGRPIVLSLSQSAILSLSRVLL

SEQ ID NO: 3189243 - protein, 19 aa, Giardia lamblia
KAICALRRYGVSSFADHSD

SEQ ID NO: 3189244 - protein, 21 aa, Giardia lamblia
KAICALRRYGVSSFAGHSDGD

SEQ ID NO: 3189245 - protein, 21 aa, Giardia lamblia
KAICQMILRFNNILLRTSQAQ

SEQ ID NO: 3189246 - protein, 23 aa, Giardia lamblia
KAIGEGLVYAYPSGEKPYIVSVK

SEQ ID NO: 3189247 - protein, 20 aa, Giardia lamblia
KAIILGVAHYLSSAVGSVSR

SEQ ID NO: 3189248 - protein, 20 aa, Giardia lamblia
KAIKLCKLDILYYLSNNTNA

SEQ ID NO: 3189249 - protein, 19 aa, Giardia lamblia
KAILQANVWRQIGGKLPDE

SEQ ID NO: 3189250 - protein, 36 aa, Giardia lamblia
KAIREAVFGPVHPLTIRLYLAIAKTYEQICIELAST

SEQ ID NO: 3189251 - protein, 30 aa, Giardia lamblia
KAISDKEFAFFYKLPFLPTALSSCFHVCTE

SEQ ID NO: 3189252 - protein, 33 aa, Giardia lamblia
KAISEKRRFWDDRVLPLFPPYHFSCPAEPNQGL

SEQ ID NO: 3189253 - protein, 20 aa, Giardia lamblia
KAITIPYSSQYAGYRIQHKE

SEQ ID NO: 3189254 - protein, 33 aa, Giardia lamblia
KAKTGQLSDILFRRALRSIGIHGPVELLNRAIE

SEQ ID NO: 3189255 - protein, 20 aa, Giardia lamblia
KALDELVAQNLCIYTEIGKT

SEQ ID NO: 3189256 - protein, 22 aa, Giardia lamblia
KALDLIVHFIDMGPWCLRATLE

SEQ ID NO: 3189257 - protein, 23 aa, Giardia lamblia
KALLDLIVITPVSQEFLISLLGA

SEQ ID NO: 3189258 - protein, 17 aa, Giardia lamblia
KALRYLHDPAKHGGRVI

SEQ ID NO: 3189259 - protein, 29 aa, Giardia lamblia
KALTELLTKFKVLTIQLSSLANACRFLCD

SEQ ID NO: 3189260 - protein, 21 aa, Giardia lamblia
KALWERIYFWRENAPISILSG

SEQ ID NO: 3189261 - protein, 23 aa, Giardia lamblia
KAMAEFLRGVKNAEKLPPFLSME

SEQ ID NO: 3189262 - protein, 20 aa, Giardia lamblia
KAMLDGLLPTGVRPVVVATY

SEQ ID NO: 3189263 - protein, 30 aa, Giardia lamblia
KAMLNMGQAFKAIVPLKSILRHFEDIPLLE

SEQ ID NO: 3189264 - protein, 20 aa, Giardia lamblia
KAMTTVPPKAPSLSREKKHR

SEQ ID NO: 3189265 - protein, 24 aa, Giardia lamblia
KANGINLWVRVKYIIPHSIKQAVE

SEQ ID NO: 3189266 - protein, 19 aa, Giardia lamblia
KANLYPVEILAILKSNPTI

SEQ ID NO: 3189267 - protein, 25 aa, Giardia lamblia
KANNDAIRALKWLDDVTLISTDSGG

SEQ ID NO: 3189268 - protein, 32 aa, Giardia lamblia
KANQDLSYLIELIEKLLMLHQIRLAETENQRD

SEQ ID NO: 3189269 - protein, 17 aa, Giardia lamblia
KAPDCVKLLAPYELLIK

SEQ ID NO: 3189270 - protein, 18 aa, Giardia lamblia
KAPDHLPIQPIRSPDHPI

SEQ ID NO: 3189271 - protein, 36 aa, Giardia lamblia
KAPLGDIYDPDLRLIIGHLLVLDPLERLTAEELFQM

SEQ ID NO: 3189272 - protein, 21 aa, Giardia lamblia
KAPPDLFLRRICKGIIEGLVV

SEQ ID NO: 3189273 - protein, 26 aa, Giardia lamblia
KAQNSSLRFVFNPAPYRADYDFSKIL

SEQ ID NO: 3189274 - protein, 33 aa, Giardia lamblia
KARFNSRFIALLEYLPRFLLVNDTLEVIQITEG

SEQ ID NO: 3189275 - protein, 17 aa, Giardia lamblia
KARLELLAKQRELAEKK

SEQ ID NO: 3189276 - protein, 27 aa, Giardia lamblia
KASISFLRQFILDRLTLAIPDSHPLSA

SEQ ID NO: 3189277 - protein, 23 aa, Giardia lamblia
KASQLVVEIKRKALDVEHLLQED

SEQ ID NO: 3189278 - protein, 23 aa, Giardia lamblia
KATERFMSFLTASLPTFDTHEER

SEQ ID NO: 3189279 - protein, 24 aa, Giardia lamblia
KATHPPFHIGMYSALPFASSVSQS

SEQ ID NO: 3189280 - protein, 24 aa, Giardia lamblia
KAVCRMILIQIPPSLKLATAENGL

SEQ ID NO: 3189281 - protein, 61 aa, Giardia lamblia
KAVEMLPYVISSAVIRGFFRCFPVYSHIFSVKFRLSIYENVIYYLTGVPPYIDILQDIRKS

SEQ ID NO: 3189282 - protein, 30 aa, Giardia lamblia
KAVIPSCLFSQPFYELLTIPFYQAVVDGDP

SEQ ID NO: 3189283 - protein, 18 aa, Giardia lamblia
KAVLDLLKQRKCGLFGEP

SEQ ID NO: 3189284 - protein, 24 aa, Giardia lamblia
KAVLEKDLFLVKMLVRYEHSITTK

SEQ ID NO: 3189285 - protein, 17 aa, Giardia lamblia
KAVLLRRNCSVGKCLGC

SEQ ID NO: 3189286 - protein, 20 aa, Giardia lamblia
KAVLYALTGLRLSQLMIYDF

SEQ ID NO: 3189287 - protein, 24 aa, Giardia lamblia
KAVNSLRVLLDLPVEQQYGILVSD

SEQ ID NO: 3189288 - protein, 20 aa, Giardia lamblia
KAWVIGLAKHRFSSNHFPAS

SEQ ID NO: 3189289 - protein, 21 aa, Giardia lamblia
KAYALPFLEPPPATEWAPNIV

SEQ ID NO: 3189290 - protein, 22 aa, Giardia lamblia
KAYDTFILSYYCLLETGTAHEF

SEQ ID NO: 3189291 - protein, 33 aa, Giardia lamblia
KAYLVMDYHERCCLADIIVFYHSHKKYIPESVV

SEQ ID NO: 3189292 - protein, 17 aa, Giardia lamblia
KCAAAALALLRILSAQV

SEQ ID NO: 3189293 - protein, 32 aa, Giardia lamblia
KCDKGWSALMLAVKLRRYKIASLLVAEEIRLQ

SEQ ID NO: 3189294 - protein, 33 aa, Giardia lamblia
KCGKKTMPLPGFRWPLAVAFLPCLADFHSLKHV

SEQ ID NO: 3189295 - protein, 22 aa, Giardia lamblia
KCGRIDAVKLLIKNKSRAQNIL

SEQ ID NO: 3189296 - protein, 26 aa, Giardia lamblia
KCIRDLMASFLLPEIDRRVLISRLKQ

SEQ ID NO: 3189297 - protein, 32 aa, Giardia lamblia
KCITTLKLKMRRPLMFLPADSLRITDQATAAD

SEQ ID NO: 3189298 - protein, 24 aa, Giardia lamblia
KCITVAFGVFADTLPVIAIATSRE

SEQ ID NO: 3189299 - protein, 18 aa, Giardia lamblia
KCLAAKYAYKTYGSMKAD

SEQ ID NO: 3189300 - protein, 25 aa, Giardia lamblia
KCLNRDLSFKPICSGVGFCLGPEGC

SEQ ID NO: 3189301 - protein, 17 aa, Giardia lamblia
KCMSTSLKVIDPTMRKR

SEQ ID NO: 3189302 - protein, 17 aa, Giardia lamblia
KCPTLRSIIAKLKRMQL

SEQ ID NO: 3189303 - protein, 22 aa, Giardia lamblia
KCPYDGWPLILHMAEATQKRTF

SEQ ID NO: 3189304 - protein, 34 aa, Giardia lamblia
KCSERKVFLPEPLIWRFAYNITLAILCLHSKGCS

SEQ ID NO: 3189305 - protein, 34 aa, Giardia lamblia
KCYQDVPGTYRYIPQNVTLTMQPPTTGPQAPNMY

SEQ ID NO: 3189306 - protein, 33 aa, Giardia lamblia
KCYQNVILPAQFLVMYSPQWFFEEVIRKHAMFL

SEQ ID NO: 3189307 - protein, 24 aa, Giardia lamblia
KDAVQSPWPSLFDLEVRKLSEFDH

SEQ ID NO: 3189308 - protein, 22 aa, Giardia lamblia
KDCTFIYDQIIRELVLVGTHQH

SEQ ID NO: 3189309 - protein, 27 aa, Giardia lamblia
KDCYETFYINRIPLLTSPQVFGLHSNA

SEQ ID NO: 3189310 - protein, 28 aa, Giardia lamblia
KDDAYRKLLFGISFYHTLLVERRKFGSL

SEQ ID NO: 3189311 - protein, 26 aa, Giardia lamblia
KDDDMGFPYPKMFISISGLIGAGKTT

SEQ ID NO: 3189312 - protein, 28 aa, Giardia lamblia
KDDMRPYISILVPGSIQPLMKQLHEKRK

SEQ ID NO: 3189313 - protein, 24 aa, Giardia lamblia
KDEHTLQLKLPYGVASQENYSFDF

SEQ ID NO: 3189314 - protein, 20 aa, Giardia lamblia
KDELISAMGKDLEQLKADVI

SEQ ID NO: 3189315 - protein, 25 aa, Giardia lamblia
KDESFPLPPTITNSSYKPAAKLDSN

SEQ ID NO: 3189316 - protein, 21 aa, Giardia lamblia
KDEYTALMIAASRGYSDIVLQ

SEQ ID NO: 3189317 - protein, 20 aa, Giardia lamblia
KDFIIYMGNDNYRLVEASYV

SEQ ID NO: 3189318 - protein, 24 aa, Giardia lamblia
KDFLRISVPLTIDDGLASPGPALV

SEQ ID NO: 3189319 - protein, 35 aa, Giardia lamblia
KDFTTGHFELLLDETLRMRRILEGTPKAVSKLRSI

SEQ ID NO: 3189320 - protein, 24 aa, Giardia lamblia
KDGGGHRVIMSNGVQLRPGGIVSC

SEQ ID NO: 3189321 - protein, 24 aa, Giardia lamblia
KDGITRVRFAPDKPLLAVSSWDEN

SEQ ID NO: 3189322 - protein, 25 aa, Giardia lamblia
KDGKLALHLALKREDFKVAQLLTKL

SEQ ID NO: 3189323 - protein, 25 aa, Giardia lamblia
KDGTFVFNLQKVWAKIVFAARILVT

SEQ ID NO: 3189324 - protein, 22 aa, Giardia lamblia
KDGWSALMHAVCNNKLECAMLL

SEQ ID NO: 3189325 - protein, 18 aa, Giardia lamblia
KDHADLGSWPLLGPRYRV

SEQ ID NO: 3189326 - protein, 21 aa, Giardia lamblia
KDHLNLVLQYSYQLLREVRLV

SEQ ID NO: 3189327 - protein, 24 aa, Giardia lamblia
KDIEIARLNERVELLLNTSPEAGD

SEQ ID NO: 3189328 - protein, 34 aa, Giardia lamblia
KDIEKGAISQPWLYTMLYLLIEVRQLSAVGRYFP

SEQ ID NO: 3189329 - protein, 21 aa, Giardia lamblia
KDIGYIITKLLNAGLRVCEMH

SEQ ID NO: 3189330 - protein, 32 aa, Giardia lamblia
KDIINAKPLNKDLLLWIYAEMQSRTVKFVHVK

SEQ ID NO: 3189331 - protein, 20 aa, Giardia lamblia
KDIISEMLLLSQYTGRPIKK

SEQ ID NO: 3189332 - protein, 26 aa, Giardia lamblia
KDIKPVLSILLSPIPARRLPAMALQN

SEQ ID NO: 3189333 - protein, 21 aa, Giardia lamblia
KDIRQVFQPYGFIQLKVRKGN

SEQ ID NO: 3189334 - protein, 28 aa, Giardia lamblia
KDKALMHEVLTFLREHHAHLIEANARIV

SEQ ID NO: 3189335 - protein, 17 aa, Giardia lamblia
KDKEICMLKEMLARLYA

SEQ ID NO: 3189336 - protein, 27 aa, Giardia lamblia
KDKLFLGQLRNILFVSYLAGLDSTFNV

SEQ ID NO: 3189337 - protein, 18 aa, Giardia lamblia
KDKPRYLMGVGFPLDLVV

SEQ ID NO: 3189338 - protein, 22 aa, Giardia lamblia
KDKQAISLLKMMLKMDPAERPS

SEQ ID NO: 3189339 - protein, 22 aa, Giardia lamblia
KDKQIVFLQDQLLESEKRCTRL

SEQ ID NO: 3189340 - protein, 27 aa, Giardia lamblia
KDKTHYDLVFFHNLFSALNNLPFVSMG

SEQ ID NO: 3189341 - protein, 22 aa, Giardia lamblia
KDLAGILKLPGFGPKMGHLLVQ

SEQ ID NO: 3189342 - protein, 23 aa, Giardia lamblia
KDLAVFYDLQPSVAFPFISSTPL

SEQ ID NO: 3189343 - protein, 25 aa, Giardia lamblia
KDLCDLWLRYMTMYSVNGKTAMANI

SEQ ID NO: 3189344 - protein, 26 aa, Giardia lamblia
KDLEIERLRVLLQDSLEKQGIREDEN

SEQ ID NO: 3189345 - protein, 26 aa, Giardia lamblia
KDLIGPQFFDAINSWSGFTVQDRNEC

SEQ ID NO: 3189346 - protein, 18 aa, Giardia lamblia
KDLIKRLISKEACPEEIY

SEQ ID NO: 3189347 - protein, 19 aa, Giardia lamblia
KDLIKRLLDINPKTRLGSK

SEQ ID NO: 3189348 - protein, 37 aa, Giardia lamblia
KDLLKSVIKAEAFLVEFPNKKLALQTSIKQAQAEVVN

SEQ ID NO: 3189349 - protein, 18 aa, Giardia lamblia
KDLLLRQPVPKLAVHFHP

SEQ ID NO: 3189350 - protein, 17 aa, Giardia lamblia
KDLPPFFKEALAKHVTD

SEQ ID NO: 3189351 - protein, 26 aa, Giardia lamblia
KDMCLTNIAYLFKINCINLIVRNICM

SEQ ID NO: 3189352 - protein, 23 aa, Giardia lamblia
KDMFYFVQEYFPCTLHDLLIKHQ

SEQ ID NO: 3189353 - protein, 26 aa, Giardia lamblia
KDMIDYAFQMFPDKNLVVTPPYSGMI

SEQ ID NO: 3189354 - protein, 33 aa, Giardia lamblia
KDMLKGFIITLRTFRRRGYISYLTSFHFNDEHQ

SEQ ID NO: 3189355 - protein, 28 aa, Giardia lamblia
KDMLTVMVNGLYKLRYPLTGQGIDCSFA

SEQ ID NO: 3189356 - protein, 30 aa, Giardia lamblia
KDNEILDLKNRLDQLSREFSAILRETLDTI

SEQ ID NO: 3189357 - protein, 18 aa, Giardia lamblia
KDNFFSLISMNGGSRRES

SEQ ID NO: 3189358 - protein, 25 aa, Giardia lamblia
KDNGGMTALMWAAKHGHAEVARVLV

SEQ ID NO: 3189359 - protein, 33 aa, Giardia lamblia
KDNPGMIPLAFQRIFDFIAQAKDDQFLVRASFV

SEQ ID NO: 3189360 - protein, 18 aa, Giardia lamblia
KDNTFRILIGRHAFVGRA

SEQ ID NO: 3189361 - protein, 23 aa, Giardia lamblia
KDNTVVLYLIRAACLQAVIEENS

SEQ ID NO: 3189362 - protein, 29 aa, Giardia lamblia
KDNVVNIVRKYPPFFAQNPTSASATVTTK

SEQ ID NO: 3189363 - protein, 17 aa, Giardia lamblia
KDPELVRSLLLQYASAL

SEQ ID NO: 3189364 - protein, 18 aa, Giardia lamblia
KDQIFEQTALMKCLSAMH

SEQ ID NO: 3189365 - protein, 18 aa, Giardia lamblia
KDRLLTIPTGVRGFVFVG

SEQ ID NO: 3189366 - protein, 30 aa, Giardia lamblia
KDRPDDVLSYLIHKFASYSPLAAAVLQNPD

SEQ ID NO: 3189367 - protein, 29 aa, Giardia lamblia
KDSFHLRIRVHPFHVIRINKMLSCAGADR

SEQ ID NO: 3189368 - protein, 27 aa, Giardia lamblia
KDSLCLLLHLSLLSLMARRGLLDPIGL

SEQ ID NO: 3189369 - protein, 24 aa, Giardia lamblia
KDSSDYYRRLLNEDAIREFCLTSK

SEQ ID NO: 3189370 - protein, 26 aa, Giardia lamblia
KDSTPLMIAIARGSIPVAKFLLEKAS

SEQ ID NO: 3189371 - protein, 19 aa, Giardia lamblia
KDTEMVHLLASFEHSLRNS

SEQ ID NO: 3189372 - protein, 27 aa, Giardia lamblia
KDTLVIIPGAMYFVIRCSVEVLQDDGG

SEQ ID NO: 3189373 - protein, 28 aa, Giardia lamblia
KDTLVTALLARMRAEGPLFGASVSRSIT

SEQ ID NO: 3189374 - protein, 28 aa, Giardia lamblia
KDTYNYFNDYRILLRRQISSFAKTESER

SEQ ID NO: 3189375 - protein, 25 aa, Giardia lamblia
KDVVKIRIPYAAKLMIQELISMGVL

SEQ ID NO: 3189376 - protein, 21 aa, Giardia lamblia
KDVVPDLPRSISLLSTQTSNE

SEQ ID NO: 3189377 - protein, 24 aa, Giardia lamblia
KDYAQLQETIFGLRNQNADLHRVV

SEQ ID NO: 3189378 - protein, 24 aa, Giardia lamblia
KDYDLVIFDRWLPSTSAFVLFQVQ

SEQ ID NO: 3189379 - protein, 17 aa, Giardia lamblia
KDYQILIILTDGDLTDI

SEQ ID NO: 3189380 - protein, 23 aa, Giardia lamblia
KEAEEKLRILRETEAALERERNE

SEQ ID NO: 3189381 - protein, 24 aa, Giardia lamblia
KEAIKLLCHSISLENVYLQADGHA

SEQ ID NO: 3189382 - protein, 23 aa, Giardia lamblia
KEAKEIFMYTVSMKNDEIERLKE

SEQ ID NO: 3189383 - protein, 20 aa, Giardia lamblia
KEAKKYSSLLSVTCVEAARQ

SEQ ID NO: 3189384 - protein, 43 aa, Giardia lamblia
KEALKEAVILPFKFPQLFQGKREPWRGILLYGCPGTGKSFLAK

SEQ ID NO: 3189385 - protein, 19 aa, Giardia lamblia
KEALLLAKESELSLLAQQL

SEQ ID NO: 3189386 - protein, 25 aa, Giardia lamblia
KEANNFLWPFQLNSAALKDKRNNFA

SEQ ID NO: 3189387 - protein, 32 aa, Giardia lamblia
KEAVPIILNAVNKLLLHIATYKASANYTDAQR

SEQ ID NO: 3189388 - protein, 31 aa, Giardia lamblia
KEAYRYKLLKNIYTIRAVSAMMLAAQLNLRD

SEQ ID NO: 3189389 - protein, 30 aa, Giardia lamblia
KECEVCDGFKLFITSKLPNPRYLPETYAKT

SEQ ID NO: 3189390 - protein, 24 aa, Giardia lamblia
KEDDGTVPLFERTYQPINAASRKP

SEQ ID NO: 3189391 - protein, 28 aa, Giardia lamblia
KEDKFQVVLLIIRYVIELVKKLEFSSAE

SEQ ID NO: 3189392 - protein, 34 aa, Giardia lamblia
KEDKVDMQFTLCKRISGLIHMLPEPSPKEERAFM

SEQ ID NO: 3189393 - protein, 27 aa, Giardia lamblia
KEDPDQYWNSFWLRTHEIPSFINAKPN

SEQ ID NO: 3189394 - protein, 22 aa, Giardia lamblia
KEDRFLLQLIKTARSPPFLPPF

SEQ ID NO: 3189395 - protein, 32 aa, Giardia lamblia
KEDSCRLLRTIWASAIVYNTVYYLGKTKLSVQ

SEQ ID NO: 3189396 - protein, 46 aa, Giardia lamblia
KEEAILVLILISTIARLDFPFCRDIFLMGLIPLANRLYSTYSTINE

SEQ ID NO: 3189397 - protein, 21 aa, Giardia lamblia
KEEARMRLEVEKKLLSEKLEE

SEQ ID NO: 3189398 - protein, 28 aa, Giardia lamblia
KEEEKKAQMLAMLRSSLRQPPIPEGANP

SEQ ID NO: 3189399 - protein, 32 aa, Giardia lamblia
KEEEYRIPQESLIKMAFYLREKGDEVTKLNEL

SEQ ID NO: 3189400 - protein, 21 aa, Giardia lamblia
KEEFGDIFELVRERELKKANE

SEQ ID NO: 3189401 - protein, 23 aa, Giardia lamblia
KEEKAYIMYKEAMDLFSKEASAA

SEQ ID NO: 3189402 - protein, 27 aa, Giardia lamblia
KEENAKLKAALLELGRRYKALQATGVD

SEQ ID NO: 3189403 - protein, 24 aa, Giardia lamblia
KEERQLFFTLLSSNFPVPPLDDWN

SEQ ID NO: 3189404 - protein, 23 aa, Giardia lamblia
KEFESKFQLPMSAYSPGSFSGER

SEQ ID NO: 3189405 - protein, 20 aa, Giardia lamblia
KEFKELNSMLSLPPGRNGPY

SEQ ID NO: 3189406 - protein, 27 aa, Giardia lamblia
KEFSGGWLMRVSLAKALFVAPDILFLD

SEQ ID NO: 3189407 - protein, 26 aa, Giardia lamblia
KEFSSVWAFSPRLMDWTRMNIAGKLP

SEQ ID NO: 3189408 - protein, 18 aa, Giardia lamblia
KEFYMIMDYCNANCLTNI

SEQ ID NO: 3189409 - protein, 21 aa, Giardia lamblia
KEFYNFLCMYTDTPSVPELTA

SEQ ID NO: 3189410 - protein, 35 aa, Giardia lamblia
KEGEQSIILDRIAILRMLDVMIKKFDMVIQNLKTL

SEQ ID NO: 3189411 - protein, 26 aa, Giardia lamblia
KEGKYRCLMHLLCELGISSSTGKSAL

SEQ ID NO: 3189412 - protein, 25 aa, Giardia lamblia
KEGLTALCFACMYGSIDCVRVLLGK

SEQ ID NO: 3189413 - protein, 26 aa, Giardia lamblia
KEGRNIHDFIKLFINDRSLISQLETS

SEQ ID NO: 3189414 - protein, 17 aa, Giardia lamblia
KEGYTALMIAACCDNLD

SEQ ID NO: 3189415 - protein, 29 aa, Giardia lamblia
KEHTDIVKILIPYEYRLINAPSPDLRLYA

SEQ ID NO: 3189416 - protein, 23 aa, Giardia lamblia
KEIATLRRTIAYLSPTTESASST

SEQ ID NO: 3189417 - protein, 34 aa, Giardia lamblia
KEIAVLEYRNYLKFCEFWTTRNAALAATAQRGKN

SEQ ID NO: 3189418 - protein, 29 aa, Giardia lamblia
KEICMLKEMLARLYAKPEGIQPGSIAPAF

SEQ ID NO: 3189419 - protein, 18 aa, Giardia lamblia
KEIHLLREQLARVETDGT

SEQ ID NO: 3189420 - protein, 20 aa, Giardia lamblia
KEIIALHKQLSEKDKIIEAL

SEQ ID NO: 3189421 - protein, 26 aa, Giardia lamblia
KEIMRVLSKYVGWTDLICAAALGSVN

SEQ ID NO: 3189422 - protein, 24 aa, Giardia lamblia
KEINGEQVLIIKKFIFVDQTKTDT

SEQ ID NO: 3189423 - protein, 26 aa, Giardia lamblia
KEIPKFVDPYHWVKHFPALCYKDMCK

SEQ ID NO: 3189424 - protein, 25 aa, Giardia lamblia
KEIPKQSSLYGLDLLEQPSAELMHQ

SEQ ID NO: 3189425 - protein, 34 aa, Giardia lamblia
KEISTGNMSFYYITLQDVLGILSKTSRLSTYVLP

SEQ ID NO: 3189426 - protein, 20 aa, Giardia lamblia
KEISWLKEMLRMHEAEKERV

SEQ ID NO: 3189427 - protein, 23 aa, Giardia lamblia
KEIVDILPNEIYSASSRSACQLL

SEQ ID NO: 3189428 - protein, 26 aa, Giardia lamblia
KEIYKFLMLIAHLWWKQRTSEARRTL

SEQ ID NO: 3189429 - protein, 29 aa, Giardia lamblia
KEKHTMLVQKLIYLLEGLGDEESLASAAK

SEQ ID NO: 3189430 - protein, 19 aa, Giardia lamblia
KEKLICDMDLKIQDMRSHI

SEQ ID NO: 3189431 - protein, 22 aa, Giardia lamblia
KEKLSRQNFFDGAAGLPVITTE

SEQ ID NO: 3189432 - protein, 18 aa, Giardia lamblia
KEKSVTIEKLMEKLSKLK

SEQ ID NO: 3189433 - protein, 17 aa, Giardia lamblia
KELEITKESLRTVTEEL

SEQ ID NO: 3189434 - protein, 24 aa, Giardia lamblia
KELFELYITTIYKASKLKADIERI

SEQ ID NO: 3189435 - protein, 23 aa, Giardia lamblia
KELIRNCLRFTPSSRIGLASIST

SEQ ID NO: 3189436 - protein, 19 aa, Giardia lamblia
KELLCVQRSIFDQATLSNM

SEQ ID NO: 3189437 - protein, 25 aa, Giardia lamblia
KELQERLGLLSIPQQNTRHPINYQY

SEQ ID NO: 3189438 - protein, 26 aa, Giardia lamblia
KELSIDFRTLWISTLAPSTGVLGKNL

SEQ ID NO: 3189439 - protein, 18 aa, Giardia lamblia
KELSKKSTLLIFSIGSRL

SEQ ID NO: 3189440 - protein, 17 aa, Giardia lamblia
KELSLIYDRYLQPLESM

SEQ ID NO: 3189441 - protein, 33 aa, Giardia lamblia
KELTERVLWPILQADQYRYLGVTFGTGILLHAP

SEQ ID NO: 3189442 - protein, 26 aa, Giardia lamblia
KELVYGPGLQFLIIDSLPPDVVSGAE

SEQ ID NO: 3189443 - protein, 20 aa, Giardia lamblia
KELYLRDEETRRLMKKIIAL

SEQ ID NO: 3189444 - protein, 32 aa, Giardia lamblia
KEMPDVIGFIFILKALYRPSWGDYDSWKTRFR

SEQ ID NO: 3189445 - protein, 17 aa, Giardia lamblia
KENAHTEWICKNFSCRC

SEQ ID NO: 3189446 - protein, 23 aa, Giardia lamblia
KENCYNILYYIRQNTDHKIAINS

SEQ ID NO: 3189447 - protein, 19 aa, Giardia lamblia
KENDLLVSFIERHQSFLKN

SEQ ID NO: 3189448 - protein, 27 aa, Giardia lamblia
KEPKSPNPYIRLLHNAFKVVYENTGED

SEQ ID NO: 3189449 - protein, 22 aa, Giardia lamblia
KEQKYFVQPISKKSNKFEELRT

SEQ ID NO: 3189450 - protein, 18 aa, Giardia lamblia
KEQLLAIERADALYGCYR

SEQ ID NO: 3189451 - protein, 24 aa, Giardia lamblia
KEQVDAFVKYLHKGSPKSVVKKVS

SEQ ID NO: 3189452 - protein, 26 aa, Giardia lamblia
KERADLLFEIKSLEKLVYAKCKELYK

SEQ ID NO: 3189453 - protein, 18 aa, Giardia lamblia
KERIEQLVGKLRPCELGL

SEQ ID NO: 3189454 - protein, 22 aa, Giardia lamblia
KERLRLMWSRKISMIRWDCESW

SEQ ID NO: 3189455 - protein, 23 aa, Giardia lamblia
KESELSLLAQQLAEKTARIVELE

SEQ ID NO: 3189456 - protein, 30 aa, Giardia lamblia
KESRKLCSANKLALYYALVEGNLEIAEILT

SEQ ID NO: 3189457 - protein, 24 aa, Giardia lamblia
KETCTGVFTLRLTPSFDPGHVSIK

SEQ ID NO: 3189458 - protein, 18 aa, Giardia lamblia
KETELFARRGLPDNGRKI

SEQ ID NO: 3189459 - protein, 25 aa, Giardia lamblia
KETGKDPLLLALQAHAKSSALEIIA

SEQ ID NO: 3189460 - protein, 23 aa, Giardia lamblia
KETLAFLQSLYDDASQRYYSSMD

SEQ ID NO: 3189461 - protein, 18 aa, Giardia lamblia
KEVATIRPLLEEAQARMR

SEQ ID NO: 3189462 - protein, 26 aa, Giardia lamblia
KEVDYRNLWLAKIALKEKFHGPEAGM

SEQ ID NO: 3189463 - protein, 26 aa, Giardia lamblia
KEVENILQLPLEKLVRMLNGEPEPPS

SEQ ID NO: 3189464 - protein, 19 aa, Giardia lamblia
KEVTSLQNALHRKDREIAQ

SEQ ID NO: 3189465 - protein, 20 aa, Giardia lamblia
KEVVLLLYEVERQLLKSRCI

SEQ ID NO: 3189466 - protein, 26 aa, Giardia lamblia
KEWELWNALPEWPLRGKKPYTCCLRA

SEQ ID NO: 3189467 - protein, 25 aa, Giardia lamblia
KEYCPNVPMILVGTKYDLLSDEAYL

SEQ ID NO: 3189468 - protein, 25 aa, Giardia lamblia
KEYDVWLLSLLPQQSLTTSRLLTIR

SEQ ID NO: 3189469 - protein, 23 aa, Giardia lamblia
KEYTHIHDLLREKSASLLSSNSR

SEQ ID NO: 3189470 - protein, 22 aa, Giardia lamblia
KFAWVHYACWGVMRDDILSRFQ

SEQ ID NO: 3189471 - protein, 19 aa, Giardia lamblia
KFCPFIKTDLMLRNIVHYY

SEQ ID NO: 3189472 - protein, 29 aa, Giardia lamblia
KFDMKSTIQYPYLHTFFSPASGLSSLGLL

SEQ ID NO: 3189473 - protein, 18 aa, Giardia lamblia
KFEVRRFAKSVGAALNMT

SEQ ID NO: 3189474 - protein, 18 aa, Giardia lamblia
KFEYPKILGILKQKDHDK

SEQ ID NO: 3189475 - protein, 18 aa, Giardia lamblia
KFFICTLTANDFEQTSWI

SEQ ID NO: 3189476 - protein, 18 aa, Giardia lamblia
KFFNLKTPKDIELSIQKA

SEQ ID NO: 3189477 - protein, 22 aa, Giardia lamblia
KFGAEGIGLCRTEHMFFAADRI

SEQ ID NO: 3189478 - protein, 18 aa, Giardia lamblia
KFGKLVYKSLPLRSAVTD

SEQ ID NO: 3189479 - protein, 31 aa, Giardia lamblia
KFGLYQDPFTDFYLRLLLNAPYSTLNEQQGY

SEQ ID NO: 3189480 - protein, 26 aa, Giardia lamblia
KFGYDIFHPMIIDDLATLMNCFCPNC

SEQ ID NO: 3189481 - protein, 19 aa, Giardia lamblia
KFHYIFNLRDLSRITQGFI

SEQ ID NO: 3189482 - protein, 19 aa, Giardia lamblia
KFINKSLSALGKIVAALSS

SEQ ID NO: 3189483 - protein, 17 aa, Giardia lamblia
KFIRFQSERFVRVKPSW

SEQ ID NO: 3189484 - protein, 25 aa, Giardia lamblia
KFIRQFSSFYSGRYLEKSFLGLEDY

SEQ ID NO: 3189485 - protein, 17 aa, Giardia lamblia
KFISWQEANAELQEIIN

SEQ ID NO: 3189486 - protein, 20 aa, Giardia lamblia
KFITFGKYIGKLIQERILRL

SEQ ID NO: 3189487 - protein, 18 aa, Giardia lamblia
KFKRLSEYVNYIKAELVN

SEQ ID NO: 3189488 - protein, 17 aa, Giardia lamblia
KFKSFLTDMLVGSGLRV

SEQ ID NO: 3189489 - protein, 18 aa, Giardia lamblia
KFKVLTPTDIVLLQEMER

SEQ ID NO: 3189490 - protein, 28 aa, Giardia lamblia
KFLAKKAEAPLLLWPINPMNKNKINDST

SEQ ID NO: 3189491 - protein, 24 aa, Giardia lamblia
KFLPAFITLFPVLMSSRSSSPPGR

SEQ ID NO: 3189492 - protein, 25 aa, Giardia lamblia
KFLRSKIVFVLIPMVNIDGVMAGFY

SEQ ID NO: 3189493 - protein, 18 aa, Giardia lamblia
KFPDIPADLLEEVAQLTK

SEQ ID NO: 3189494 - protein, 19 aa, Giardia lamblia
KFPTFASLVKLWKNEFMRV

SEQ ID NO: 3189495 - protein, 19 aa, Giardia lamblia
KFREICQALCYVKEPTDAV

SEQ ID NO: 3189496 - protein, 21 aa, Giardia lamblia
KFRMILSLLDRYDLTDVDCCD

SEQ ID NO: 3189497 - protein, 20 aa, Giardia lamblia
KFRYVNWPGPLMKYTIQRKT

SEQ ID NO: 3189498 - protein, 17 aa, Giardia lamblia
KFSAQIVALLNSTNSLK

SEQ ID NO: 3189499 - protein, 26 aa, Giardia lamblia
KFSEVSPSFRMILVSSLDVFVPSDLS

SEQ ID NO: 3189500 - protein, 26 aa, Giardia lamblia
KFSHWDNLPILLRRTLMDSGNVLWSE

SEQ ID NO: 3189501 - protein, 21 aa, Giardia lamblia
KFSTIYGLESPAGRQATALSD

SEQ ID NO: 3189502 - protein, 32 aa, Giardia lamblia
KFTIYNDLSLLIFMFKHLPISLSRSILICQLY

SEQ ID NO: 3189503 - protein, 25 aa, Giardia lamblia
KFVNNPMGYKLLKILGSGGFGSVYL

SEQ ID NO: 3189504 - protein, 34 aa, Giardia lamblia
KFVSFNSNVFMILEVLARLLGISADIKIAMHYKQ

SEQ ID NO: 3189505 - protein, 19 aa, Giardia lamblia
KFYEAQNLDLLRDKEYLEK

SEQ ID NO: 3189506 - protein, 34 aa, Giardia lamblia
KFYLKKLPESIIPPRLWTQFNGLLLKYKDSTVLQ

SEQ ID NO: 3189507 - protein, 23 aa, Giardia lamblia
KFYNYPSLEFYVDPIHTIILKAI

SEQ ID NO: 3189508 - protein, 30 aa, Giardia lamblia
KGAIKALCWQPYYRLLFSGGVDGLVKVWDP

SEQ ID NO: 3189509 - protein, 18 aa, Giardia lamblia
KGALATRLLGKQVIIPPG

SEQ ID NO: 3189510 - protein, 18 aa, Giardia lamblia
KGCRLIFIPSQGYVIRAP

SEQ ID NO: 3189511 - protein, 21 aa, Giardia lamblia
KGCVVFRPYGFFMENAIMRLC

SEQ ID NO: 3189512 - protein, 22 aa, Giardia lamblia
KGDHITLLNIWKAYCEESENKR

SEQ ID NO: 3189513 - protein, 25 aa, Giardia lamblia
KGDSLFLWTLMLQGPPGTLFEGGLF

SEQ ID NO: 3189514 - protein, 25 aa, Giardia lamblia
KGDTKMVRFLLQNNARSYNDLGETA

SEQ ID NO: 3189515 - protein, 23 aa, Giardia lamblia
KGEDYVYVLPKKTTIKAMLGWDS

SEQ ID NO: 3189516 - protein, 42 aa, Giardia lamblia
KGEIAAEFIFRVLPLSRFILLRSIMILCCHIMDAIDVTKMTP

SEQ ID NO: 3189517 - protein, 25 aa, Giardia lamblia
KGENEVLFHSLTPTLKSPGSSLGSN

SEQ ID NO: 3189518 - protein, 23 aa, Giardia lamblia
KGETALMWAARHGDLELVHILAP

SEQ ID NO: 3189519 - protein, 17 aa, Giardia lamblia
KGFNMIHFTPINRFGSS

SEQ ID NO: 3189520 - protein, 23 aa, Giardia lamblia
KGFVGLHYASYFDRLDVVRSLLD

SEQ ID NO: 3189521 - protein, 17 aa, Giardia lamblia
KGGIWSNASLKTFWREL

SEQ ID NO: 3189522 - protein, 28 aa, Giardia lamblia
KGGLGLLMPGFYHDELRRVWASLDVNKG

SEQ ID NO: 3189523 - protein, 23 aa, Giardia lamblia
KGGWSALMLATQLGRLPIAAKLY

SEQ ID NO: 3189524 - protein, 20 aa, Giardia lamblia
KGHAKIVKLLAKTLSKRVTN

SEQ ID NO: 3189525 - protein, 25 aa, Giardia lamblia
KGHEQIAHMLLLKESGLETKEGDFA

SEQ ID NO: 3189526 - protein, 26 aa, Giardia lamblia
KGHLECVKILLPYEYHMRDKSGLSPL

SEQ ID NO: 3189527 - protein, 26 aa, Giardia lamblia
KGIGMFIPSLGAFFFDNIHDARTDRP

SEQ ID NO: 3189528 - protein, 25 aa, Giardia lamblia
KGILTYDGLSPWFLAKEKRMAHDFL

SEQ ID NO: 3189529 - protein, 21 aa, Giardia lamblia
KGIMPRAVEQIFLFASETARD

SEQ ID NO: 3189530 - protein, 17 aa, Giardia lamblia
KGKRHISMEPIVLVFKK

SEQ ID NO: 3189531 - protein, 22 aa, Giardia lamblia
KGKSLGLLSFNRSHCIPPSEIL

SEQ ID NO: 3189532 - protein, 23 aa, Giardia lamblia
KGLFAASLGMLIKSYGYDVVMQK

SEQ ID NO: 3189533 - protein, 20 aa, Giardia lamblia
KGLISLAEALIPYEAGLRDK

SEQ ID NO: 3189534 - protein, 20 aa, Giardia lamblia
KGLIYHLYVLAYEAEERCGA

SEQ ID NO: 3189535 - protein, 28 aa, Giardia lamblia
KGLVHFSIHNHFACCFPDFIFCRRELRF

SEQ ID NO: 3189536 - protein, 36 aa, Giardia lamblia
KGMTALMFAAYGNSVPIIRQLIRYEARRKNKNNETA

SEQ ID NO: 3189537 - protein, 18 aa, Giardia lamblia
KGMWRWRNYRLRADYYPS

SEQ ID NO: 3189538 - protein, 26 aa, Giardia lamblia
KGPQKTRWFFTKLLAKEKGEHLDHHS

SEQ ID NO: 3189539 - protein, 24 aa, Giardia lamblia
KGQDRGFILKALDDILLIIEDNSL

SEQ ID NO: 3189540 - protein, 24 aa, Giardia lamblia
KGQNASFRAALAKDFFLGGSASAI

SEQ ID NO: 3189541 - protein, 22 aa, Giardia lamblia
KGRFYDSAEFILKQGRGETQPS

SEQ ID NO: 3189542 - protein, 22 aa, Giardia lamblia
KGRILEAVVIELINILQTGSTE

SEQ ID NO: 3189543 - protein, 30 aa, Giardia lamblia
KGRSQWVRRFFAQGVLAASQLFFCSDTETA

SEQ ID NO: 3189544 - protein, 32 aa, Giardia lamblia
KGRTALMFACRKNHLNCVFPLLQLEARMQDAR

SEQ ID NO: 3189545 - protein, 29 aa, Giardia lamblia
KGRTDIQVRYRMKRLAKTLLKRNILPREK

SEQ ID NO: 3189546 - protein, 21 aa, Giardia lamblia
KGRTPPPIAPALGTKFSAPVT

SEQ ID NO: 3189547 - protein, 21 aa, Giardia lamblia
KGRVFLGTFLPRSEPYIYFMS

SEQ ID NO: 3189548 - protein, 24 aa, Giardia lamblia
KGSAPLTNLLIGFAPNGLGISPVS

SEQ ID NO: 3189549 - protein, 25 aa, Giardia lamblia
KGSLHLLLLCMEAWGATSELWTRHA

SEQ ID NO: 3189550 - protein, 17 aa, Giardia lamblia
KGTPLMPCMRDRPYRDW

SEQ ID NO: 3189551 - protein, 22 aa, Giardia lamblia
KGTQLLEYFIDSTPEVEEERCV

SEQ ID NO: 3189552 - protein, 25 aa, Giardia lamblia
KGVPVLFMKAQRTVLFLPINERAHK

SEQ ID NO: 3189553 - protein, 24 aa, Giardia lamblia
KGVQRFIFILTDDYNAKTTALSAY

SEQ ID NO: 3189554 - protein, 25 aa, Giardia lamblia
KGWIVEARWPLNDLLVNLDSRQSKS

SEQ ID NO: 3189555 - protein, 17 aa, Giardia lamblia
KGWTALMFAAVAGNLWA

SEQ ID NO: 3189556 - protein, 17 aa, Giardia lamblia
KGYGLLEHALQGNSLEC

SEQ ID NO: 3189557 - protein, 42 aa, Giardia lamblia
KGYRQRSSHFLLIKATLFIMDSLQFYPLSSWADKMQDPSFYE

SEQ ID NO: 3189558 - protein, 23 aa, Giardia lamblia
KGYSNIVDLLYPYQIEYTDIKQN

SEQ ID NO: 3189559 - protein, 22 aa, Giardia lamblia
KGYTALMICARTNYFEIGRMLI

SEQ ID NO: 3189560 - protein, 22 aa, Giardia lamblia
KGYTALMWAAVAGDVTMVRLLA

SEQ ID NO: 3189561 - protein, 23 aa, Giardia lamblia
KHDDLTIELLRKYIDSGANQSKT

SEQ ID NO: 3189562 - protein, 20 aa, Giardia lamblia
KHDMYLPPEATVRRTPTDKW

SEQ ID NO: 3189563 - protein, 25 aa, Giardia lamblia
KHEISKFIEIAPKKTRRYLYSATMP

SEQ ID NO: 3189564 - protein, 17 aa, Giardia lamblia
KHFMKPIFYSAQNVSSR

SEQ ID NO: 3189565 - protein, 26 aa, Giardia lamblia
KHFVSLNFELIILDTSGRHRQEEALF

SEQ ID NO: 3189566 - protein, 22 aa, Giardia lamblia
KHGGDYFALCDPLAAMVCCNEA

SEQ ID NO: 3189567 - protein, 24 aa, Giardia lamblia
KHGKLEVYIPIDTNLELPPEVTFE

SEQ ID NO: 3189568 - protein, 26 aa, Giardia lamblia
KHINGWPMLFPFLTTTEQRQALLEYV

SEQ ID NO: 3189569 - protein, 19 aa, Giardia lamblia
KHIRGLFRYGALPAREIVP

SEQ ID NO: 3189570 - protein, 27 aa, Giardia lamblia
KHIWPKVCGYLNDLFRPILGNLKGTPD

SEQ ID NO: 3189571 - protein, 23 aa, Giardia lamblia
KHKRIFSFMVAVSIQRASGALTG

SEQ ID NO: 3189572 - protein, 19 aa, Giardia lamblia
KHLFLAYDLHPTLQAKQLI

SEQ ID NO: 3189573 - protein, 27 aa, Giardia lamblia
KHLNKSLKQLLAWSKAYANSKLVTNFG

SEQ ID NO: 3189574 - protein, 18 aa, Giardia lamblia
KHLTSLLPDGRLALITVA

SEQ ID NO: 3189575 - protein, 19 aa, Giardia lamblia
KHNFPHYSMLINDVLTEQW

SEQ ID NO: 3189576 - protein, 45 aa, Giardia lamblia
KHNRVDIASFLIPYERNLILDGAFTPLMVCALYNCVDVAIILAAS

SEQ ID NO: 3189577 - protein, 37 aa, Giardia lamblia
KHPEFQRLLATLDATRLRLLSIAEIQYQLSIQHAKHT

SEQ ID NO: 3189578 - protein, 29 aa, Giardia lamblia
KHPRCVNGIFIGLLDYVMGASPVTLLVDN

SEQ ID NO: 3189579 - protein, 22 aa, Giardia lamblia
KHQRLQSQLLCLATALGVPVSS

SEQ ID NO: 3189580 - protein, 33 aa, Giardia lamblia
KHQVNLLIWAFDAWKLRVSLYNGLNLFAATLPR

SEQ ID NO: 3189581 - protein, 18 aa, Giardia lamblia
KHRFKRLNSVSGAPRRHS

SEQ ID NO: 3189582 - protein, 25 aa, Giardia lamblia
KHSSAHVYLRPPVVDPLALHNHDCD

SEQ ID NO: 3189583 - protein, 32 aa, Giardia lamblia
KHTDIALLLRKHEGSFWTPLMNAAADGNVEAV

SEQ ID NO: 3189584 - protein, 24 aa, Giardia lamblia
KHTEIVLKLVLMQAGLQNIDGVTA

SEQ ID NO: 3189585 - protein, 40 aa, Giardia lamblia
KHVDITLFPIAFKIVTLLNLDFFICLYQVHNVVIMIVLCS

SEQ ID NO: 3189586 - protein, 17 aa, Giardia lamblia
KHVSPIMSLQSLDGLGS

SEQ ID NO: 3189587 - protein, 20 aa, Giardia lamblia
KHVVELLALCKDTVTSSPCI

SEQ ID NO: 3189588 - protein, 17 aa, Giardia lamblia
KIAALLAMKVGVEPIKG

SEQ ID NO: 3189589 - protein, 25 aa, Giardia lamblia
KIADFGFCRPLELVSITGSASVQKV

SEQ ID NO: 3189590 - protein, 20 aa, Giardia lamblia
KIAIPLERFRKSFYLRRVLQ

SEQ ID NO: 3189591 - protein, 18 aa, Giardia lamblia
KIALAFMEQYNVLPADLF

SEQ ID NO: 3189592 - protein, 28 aa, Giardia lamblia
KIALKYYSTIRYVTYLRGGDDLDWDQMV

SEQ ID NO: 3189593 - protein, 24 aa, Giardia lamblia
KIANLIKRWLHVIVVKLSDVVHFD

SEQ ID NO: 3189594 - protein, 20 aa, Giardia lamblia
KIAQSWIKFIDELNIPRSTG

SEQ ID NO: 3189595 - protein, 18 aa, Giardia lamblia
KIAWEKMLIHKAPPRKQP

SEQ ID NO: 3189596 - protein, 25 aa, Giardia lamblia
KICRIRAFYMLKVKFTQNTIGQKIS

SEQ ID NO: 3189597 - protein, 24 aa, Giardia lamblia
KICTGTYLPIINYSTDLQNVVARM

SEQ ID NO: 3189598 - protein, 27 aa, Giardia lamblia
KIDEYTLFMSRSLQKSLKTFAEQVMAL

SEQ ID NO: 3189599 - protein, 26 aa, Giardia lamblia
KIDIWALGCALYELCTKQRMFVGKGT

SEQ ID NO: 3189600 - protein, 18 aa, Giardia lamblia
KIDLLYAALFPGEGAPKP

SEQ ID NO: 3189601 - protein, 31 aa, Giardia lamblia
KIDTLNTYLEVFFFFALAWGVGSNIATEDDR

SEQ ID NO: 3189602 - protein, 18 aa, Giardia lamblia
KIEFTYPNEKGRYDILCI

SEQ ID NO: 3189603 - protein, 17 aa, Giardia lamblia
KIEGLLKEKKDLFAQSW

SEQ ID NO: 3189604 - protein, 29 aa, Giardia lamblia
KIEHFIFDIFHFCPLERFGIIISDRATDF

SEQ ID NO: 3189605 - protein, 26 aa, Giardia lamblia
KIEHTTFNYYIDDYKLIFDPFDELTC

SEQ ID NO: 3189606 - protein, 18 aa, Giardia lamblia
KIERDLAALQNRYKELDA

SEQ ID NO: 3189607 - protein, 32 aa, Giardia lamblia
KIESVGFLHYIRILALLQMNQLPLVKREMGLL

SEQ ID NO: 3189608 - protein, 23 aa, Giardia lamblia
KIEYREWNPFRSKLGAAVRLNVL

SEQ ID NO: 3189609 - protein, 29 aa, Giardia lamblia
KIFNSLLADGYFERVPSIKFINLEERRKR

SEQ ID NO: 3189610 - protein, 18 aa, Giardia lamblia
KIFQVDYALKAVEQHGLC

SEQ ID NO: 3189611 - protein, 28 aa, Giardia lamblia
KIGQMLHNLMIFSISYDNLMQCLRPSMT

SEQ ID NO: 3189612 - protein, 17 aa, Giardia lamblia
KIGRLLRYRSGKVVLVL

SEQ ID NO: 3189613 - protein, 56 aa, Giardia lamblia
KIGVSSLNPRAYLRPIFRDLGLTPVVCLLASYLSELTLLDPRFLRYRNFEIAMASV

SEQ ID NO: 3189614 - protein, 22 aa, Giardia lamblia
KIHCKTLPIFILTYSETANSFI

SEQ ID NO: 3189615 - protein, 24 aa, Giardia lamblia
KIHIPTLLHWTRETRLWGEYAYLL

SEQ ID NO: 3189616 - protein, 33 aa, Giardia lamblia
KIHLRALDCWSVGAIMWYLVKLEYPRFHHDSTT

SEQ ID NO: 3189617 - protein, 23 aa, Giardia lamblia
KIHTPLQALLLLLFCSLEAAGIP

SEQ ID NO: 3189618 - protein, 17 aa, Giardia lamblia
KIIQIILPNEVMRRDSR

SEQ ID NO: 3189619 - protein, 20 aa, Giardia lamblia
KILDQRIMFAILTVATNPKF

SEQ ID NO: 3189620 - protein, 19 aa, Giardia lamblia
KILDSPQAISAWLASSPDT

SEQ ID NO: 3189621 - protein, 23 aa, Giardia lamblia
KILHNMPCSYVCALSGCVLLMNA

SEQ ID NO: 3189622 - protein, 17 aa, Giardia lamblia
KILKLLCEAIAWSSLPR

SEQ ID NO: 3189623 - protein, 18 aa, Giardia lamblia
KILLAKPLEVFSAPNGNA

SEQ ID NO: 3189624 - protein, 28 aa, Giardia lamblia
KILLKVELPLLREAGFTDLMLASFFGNK

SEQ ID NO: 3189625 - protein, 24 aa, Giardia lamblia
KILMAMGIGRPKVKFARPALRRNL

SEQ ID NO: 3189626 - protein, 18 aa, Giardia lamblia
KILMEHFPKQVAPMKKYD

SEQ ID NO: 3189627 - protein, 25 aa, Giardia lamblia
KILRESVILPRRYPHLFEGGNGQGS

SEQ ID NO: 3189628 - protein, 18 aa, Giardia lamblia
KILSFFNMKMRDGNALLA

SEQ ID NO: 3189629 - protein, 18 aa, Giardia lamblia
KILYGMEKATWLIVDDKY

SEQ ID NO: 3189630 - protein, 27 aa, Giardia lamblia
KIMCHQADLFLWDNLLSTAKECGAEVP

SEQ ID NO: 3189631 - protein, 21 aa, Giardia lamblia
KINEFLFKRFDPSVKPVVLGK

SEQ ID NO: 3189632 - protein, 17 aa, Giardia lamblia
KINSINMLATASTFPFF

SEQ ID NO: 3189633 - protein, 20 aa, Giardia lamblia
KINVYIYLHGLQAQHLDMLA

SEQ ID NO: 3189634 - protein, 17 aa, Giardia lamblia
KINYLYDSKKEATSSIS

SEQ ID NO: 3189635 - protein, 20 aa, Giardia lamblia
KIPPYVWYNKDSRINLYCKE

SEQ ID NO: 3189636 - protein, 27 aa, Giardia lamblia
KIPSDTVLLAILQIAEAITYLHGFATA

SEQ ID NO: 3189637 - protein, 19 aa, Giardia lamblia
KIQRLLMFYSQDILDKVRN

SEQ ID NO: 3189638 - protein, 19 aa, Giardia lamblia
KIRINWLDIAQRLGQARAS

SEQ ID NO: 3189639 - protein, 28 aa, Giardia lamblia
KISCIWSNGTWKILYTCTTILSGQETHG

SEQ ID NO: 3189640 - protein, 26 aa, Giardia lamblia
KISLVDPCYQLYLPTSQTLSMFLDIL

SEQ ID NO: 3189641 - protein, 29 aa, Giardia lamblia
KISRARLESLLSKPLKPLSKLRRPPMHLV

SEQ ID NO: 3189642 - protein, 19 aa, Giardia lamblia
KITSIIEPTIRQLIGSREA

SEQ ID NO: 3189643 - protein, 23 aa, Giardia lamblia
KITVDGLLREKRTLQTAFDSIIA

SEQ ID NO: 3189644 - protein, 24 aa, Giardia lamblia
KITVTTAIRLLFVDSMLSSTDALG

SEQ ID NO: 3189645 - protein, 20 aa, Giardia lamblia
KIVSLVSFSKFPSVEGALAT

SEQ ID NO: 3189646 - protein, 20 aa, Giardia lamblia
KIWPVEFWSKHDVSVWLSSI

SEQ ID NO: 3189647 - protein, 19 aa, Giardia lamblia
KIYILGADTLRPIYEFQTY

SEQ ID NO: 3189648 - protein, 19 aa, Giardia lamblia
KKALLSTNYVLFGITREGQ

SEQ ID NO: 3189649 - protein, 24 aa, Giardia lamblia
KKAQPPLISQLSYLGVVKDAIANA

SEQ ID NO: 3189650 - protein, 17 aa, Giardia lamblia
KKAYYKLAQKYHPDKPT

SEQ ID NO: 3189651 - protein, 21 aa, Giardia lamblia
KKCATVFLGIKTLLSQGKEDE

SEQ ID NO: 3189652 - protein, 18 aa, Giardia lamblia
KKCCIWWDEWKGMTMDDI

SEQ ID NO: 3189653 - protein, 28 aa, Giardia lamblia
KKDEDIDFFRSQLVLREAEIERLLSSQT

SEQ ID NO: 3189654 - protein, 28 aa, Giardia lamblia
KKDFDELLRILFPGKLYDLKHCGSWSGS

SEQ ID NO: 3189655 - protein, 21 aa, Giardia lamblia
KKDIILLHPGGIEGSLSVPYS

SEQ ID NO: 3189656 - protein, 20 aa, Giardia lamblia
KKDISMLQRAVLKLTSGEHR

SEQ ID NO: 3189657 - protein, 25 aa, Giardia lamblia
KKDPRFNLPLVLPHIAKQNLKLCVI

SEQ ID NO: 3189658 - protein, 26 aa, Giardia lamblia
KKDQLKMIPILAPLEARKKDVDGYTA

SEQ ID NO: 3189659 - protein, 19 aa, Giardia lamblia
KKEAAMEALLQELAASNKI

SEQ ID NO: 3189660 - protein, 24 aa, Giardia lamblia
KKEAAPIWPALAEAWLRGTRSERY

SEQ ID NO: 3189661 - protein, 19 aa, Giardia lamblia
KKEAILRNLELIISDWVYE

SEQ ID NO: 3189662 - protein, 23 aa, Giardia lamblia
KKEHVALLAKMRKLQKYKEMVVQ

SEQ ID NO: 3189663 - protein, 23 aa, Giardia lamblia
KKERNILIFDLGGGTFDVSLLTV

SEQ ID NO: 3189664 - protein, 25 aa, Giardia lamblia
KKEYRRIIEISARFAQFIKKNAILD

SEQ ID NO: 3189665 - protein, 24 aa, Giardia lamblia
KKFDIRMYVLVTSYSPLKAYIYQH

SEQ ID NO: 3189666 - protein, 27 aa, Giardia lamblia
KKGIYTINGFPIWFKHLEMNVFPTNSL

SEQ ID NO: 3189667 - protein, 26 aa, Giardia lamblia
KKGKEAIIHSSINRFSFYRDEDPRTL

SEQ ID NO: 3189668 - protein, 21 aa, Giardia lamblia
KKGVLPHYWPRVGNVRGKGGT

SEQ ID NO: 3189669 - protein, 18 aa, Giardia lamblia
KKHRLTYGCSTYPPSHSI

SEQ ID NO: 3189670 - protein, 25 aa, Giardia lamblia
KKIDFYKILGLETWPGDGEAKKAYY

SEQ ID NO: 3189671 - protein, 17 aa, Giardia lamblia
KKILSPIFDFRTGTRKQ

SEQ ID NO: 3189672 - protein, 22 aa, Giardia lamblia
KKKLLVIYRGTVDMLTPQLAEL

SEQ ID NO: 3189673 - protein, 36 aa, Giardia lamblia
KKLHESIAFVPRLITKASLYPVSNRILRLSLSCTAA

SEQ ID NO: 3189674 - protein, 19 aa, Giardia lamblia
KKLHFCSIDTWLDGVCKSV

SEQ ID NO: 3189675 - protein, 17 aa, Giardia lamblia
KKLLLLTKENKDIRDKL

SEQ ID NO: 3189676 - protein, 17 aa, Giardia lamblia
KKLPVHIFDALGKATYK

SEQ ID NO: 3189677 - protein, 22 aa, Giardia lamblia
KKLRIGRLKRKQELEVSVVEAQ

SEQ ID NO: 3189678 - protein, 25 aa, Giardia lamblia
KKNEEWRHWLSNLSLTLLQCSPLKC

SEQ ID NO: 3189679 - protein, 24 aa, Giardia lamblia
KKNSLLSIFLTPDAKERLRRIEIV

SEQ ID NO: 3189680 - protein, 21 aa, Giardia lamblia
KKPQRFPSYLVWDCFKQKACK

SEQ ID NO: 3189681 - protein, 21 aa, Giardia lamblia
KKPRVRLLPTDSHEPVRKLDT

SEQ ID NO: 3189682 - protein, 25 aa, Giardia lamblia
KKQGRAWKHIRQQLRTRLDSAPAIL

SEQ ID NO: 3189683 - protein, 27 aa, Giardia lamblia
KKQKNIAQLLLPWNAGLISPSGHYALY

SEQ ID NO: 3189684 - protein, 28 aa, Giardia lamblia
KKQNIRSIITQLLFDNSTINPAILNGGL

SEQ ID NO: 3189685 - protein, 21 aa, Giardia lamblia
KKQRLNFLKYRLQQLKAGQPP

SEQ ID NO: 3189686 - protein, 29 aa, Giardia lamblia
KKRHEFSVLRNPVVYPKACIPQDMITVWS

SEQ ID NO: 3189687 - protein, 20 aa, Giardia lamblia
KKSDHEMLVTHPVDFTEVVD

SEQ ID NO: 3189688 - protein, 21 aa, Giardia lamblia
KKSFFDTLTVQKGTRRNNNNG

SEQ ID NO: 3189689 - protein, 21 aa, Giardia lamblia
KKSIRTFLIDPVNGLIFTGGD

SEQ ID NO: 3189690 - protein, 25 aa, Giardia lamblia
KKSLAPAFVTLILESVWAVLACSKL

SEQ ID NO: 3189691 - protein, 36 aa, Giardia lamblia
KKSSIPIQISAPALLKLLEIPYNGAASAFIGSLIEK

SEQ ID NO: 3189692 - protein, 34 aa, Giardia lamblia
KKTLKFFSINFRLTPPYHILFDGTFLNHVAHIHQ

SEQ ID NO: 3189693 - protein, 24 aa, Giardia lamblia
KKTLQPVFPAQLCTASIASSPIPE

SEQ ID NO: 3189694 - protein, 37 aa, Giardia lamblia; identical to SEQ ID NO: 3159797

SEQ ID NO: 3189695 - protein, 18 aa, Giardia lamblia
KKVFGYMEPLTTQAAKTV

SEQ ID NO: 3189696 - protein, 26 aa, Giardia lamblia
KKVFKKLPCINPLITGQRTLDGLFPL

SEQ ID NO: 3189697 - protein, 28 aa, Giardia lamblia
KKVLSLMACATFAFFCHFNKEFFKSMAP

SEQ ID NO: 3189698 - protein, 17 aa, Giardia lamblia
KKVRLACLKYYTIKGDT

SEQ ID NO: 3189699 - protein, 24 aa, Giardia lamblia
KKWGYQMQIWFFNQRLNTYKEAIQ

SEQ ID NO: 3189700 - protein, 33 aa, Giardia lamblia
KKWNIEVPYHPHWPKFVPLSLTVKTHIYNNVDV

SEQ ID NO: 3189701 - protein, 29 aa, Giardia lamblia
KKWRLRRRSRPYPAGRRGHIMVGLDECQL

SEQ ID NO: 3189702 - protein, 23 aa, Giardia lamblia
KKYDSPCYLINPLGERKEGGKFQ

SEQ ID NO: 3189703 - protein, 20 aa, Giardia lamblia
KKYIKALITGNILQVRKLGK

SEQ ID NO: 3189704 - protein, 25 aa, Giardia lamblia
KKYPDFRPMLMTKVETPLAVLNLKQ

SEQ ID NO: 3189705 - protein, 20 aa, Giardia lamblia
KKYRSLKLAPLLIQEITRRS

SEQ ID NO: 3189706 - protein, 26 aa, Giardia lamblia
KKYSPRLPVLIFVASRRQTRRTAMAL

SEQ ID NO: 3189707 - protein, 18 aa, Giardia lamblia
KLADLEHVLGAAKASAAS

SEQ ID NO: 3189708 - protein, 24 aa, Giardia lamblia
KLAHKIYHLLKVLNKLCAVTTFPD

SEQ ID NO: 3189709 - protein, 19 aa, Giardia lamblia
KLALIPTNINYLLHGSFSL

SEQ ID NO: 3189710 - protein, 26 aa, Giardia lamblia
KLALQRPRSSYYLLHRMRLSMCGISN

SEQ ID NO: 3189711 - protein, 34 aa, Giardia lamblia
KLALWHTTSLQRMLSYVFSIWIQQAREKLGKRIE

SEQ ID NO: 3189712 - protein, 18 aa, Giardia lamblia
KLAYYLPDGSRNKPLWTA

SEQ ID NO: 3189713 - protein, 23 aa, Giardia lamblia
KLCEGRLKCIKLLAEMESRLKKS

SEQ ID NO: 3189714 - protein, 30 aa, Giardia lamblia
KLCETVLYYKNKNFKLVFYNDKCTKFDLYD

SEQ ID NO: 3189715 - protein, 19 aa, Giardia lamblia
KLCFRIIGGEQIELPVRAL

SEQ ID NO: 3189716 - protein, 18 aa, Giardia lamblia
KLCNGWTALMTAAYRGHI

SEQ ID NO: 3189717 - protein, 24 aa, Giardia lamblia
KLCPQMFTIQPFDKVPYVSVPLAT

SEQ ID NO: 3189718 - protein, 28 aa, Giardia lamblia
KLCTDFITHGYCPYGRRCNFLHQSPDGL

SEQ ID NO: 3189719 - protein, 19 aa, Giardia lamblia
KLCWYRLIMQNKIATAEKF

SEQ ID NO: 3189720 - protein, 22 aa, Giardia lamblia
KLDAFLVDFSFSMKALAPSFKS

SEQ ID NO: 3189721 - protein, 24 aa, Giardia lamblia
KLDFLRDILDTELMPVPTSTLEGE

SEQ ID NO: 3189722 - protein, 20 aa, Giardia lamblia
KLDLLVFLFEHEDMIREMCS

SEQ ID NO: 3189723 - protein, 17 aa, Giardia lamblia
KLDLLYMSHKYDGSAFS

SEQ ID NO: 3189724 - protein, 17 aa, Giardia lamblia
KLDPTLIVPRQYTPKTD

SEQ ID NO: 3189725 - protein, 21 aa, Giardia lamblia
KLDSRVYVLKEIRLAGATKKE

SEQ ID NO: 3189726 - protein, 26 aa, Giardia lamblia
KLDTSKYFLCPLIESMLAGDSWFSEN

SEQ ID NO: 3189727 - protein, 21 aa, Giardia lamblia
KLEAASINRSLSALGNVVQAL

SEQ ID NO: 3189728 - protein, 26 aa, Giardia lamblia
KLEAFSKSYSQLYPIHAFLSTWNEEL

SEQ ID NO: 3189729 - protein, 29 aa, Giardia lamblia
KLEAKMTLGTFICRTWKLTDATALMMAAC

SEQ ID NO: 3189730 - protein, 20 aa, Giardia lamblia
KLECAMLLLEKERCMQDNDG

SEQ ID NO: 3189731 - protein, 27 aa, Giardia lamblia
KLECTVILAPYERAYLTPAGISPMFLA

SEQ ID NO: 3189732 - protein, 25 aa, Giardia lamblia
KLEEMAIIIRRRELFRKSKSSTEWF

SEQ ID NO: 3189733 - protein, 21 aa, Giardia lamblia
KLELDLDQMKILAEELAMSYV

SEQ ID NO: 3189734 - protein, 21 aa, Giardia lamblia
KLESALLSVFKQREWRQDREA

SEQ ID NO: 3189735 - protein, 27 aa, Giardia lamblia
KLFANRDYILVVFILSSVDIEITAPTQ

SEQ ID NO: 3189736 - protein, 18 aa, Giardia lamblia
KLFNPHIMTTFFSTENCA

SEQ ID NO: 3189737 - protein, 19 aa, Giardia lamblia
KLFTTMITGIYGITPGMPG

SEQ ID NO: 3189738 - protein, 19 aa, Giardia lamblia
KLFVGNYHPIINLLSQYPE

SEQ ID NO: 3189739 - protein, 22 aa, Giardia lamblia
KLGARLTQILKHLFPTGGKSAK

SEQ ID NO: 3189740 - protein, 21 aa, Giardia lamblia
KLGRTRLMRAAIRGCIETAKL

SEQ ID NO: 3189741 - protein, 27 aa, Giardia lamblia
KLGVDLIPRLMSAYYRVIRKKIEDSVP

SEQ ID NO: 3189742 - protein, 21 aa, Giardia lamblia
KLGYTDLLPIQRRVLEIWFNG

SEQ ID NO: 3189743 - protein, 24 aa, Giardia lamblia
KLHAQHEELVLLTAKDDEIAGLRS

SEQ ID NO: 3189744 - protein, 18 aa, Giardia lamblia
KLHKDTLFEFLRSYVQLP

SEQ ID NO: 3189745 - protein, 22 aa, Giardia lamblia
KLHTQRHILKGSQTIRDDGYLD

SEQ ID NO: 3189746 - protein, 19 aa, Giardia lamblia
KLHYKILRFLVNASSKDNP

SEQ ID NO: 3189747 - protein, 21 aa, Giardia lamblia
KLIELPLKAYTSFCVAENVCA

SEQ ID NO: 3189748 - protein, 20 aa, Giardia lamblia
KLIFEAYEKDRAMALAACLS

SEQ ID NO: 3189749 - protein, 24 aa, Giardia lamblia
KLIQFENYIIKALSPFPNIKINQI

SEQ ID NO: 3189750 - protein, 29 aa, Giardia lamblia
KLIRFDSPFTDIQFIRDTRLGLAASRDGR

SEQ ID NO: 3189751 - protein, 17 aa, Giardia lamblia
KLITLRAGSIYVLDETM

SEQ ID NO: 3189752 - protein, 26 aa, Giardia lamblia
KLKCRNHRLLPFLLASNQVNYGKPFK

SEQ ID NO: 3189753 - protein, 28 aa, Giardia lamblia
KLKDQFRLSFPERYLDRLSFDKSETFDK

SEQ ID NO: 3189754 - protein, 25 aa, Giardia lamblia
KLKESEALVLYLRTVVESKDDKIAH

SEQ ID NO: 3189755 - protein, 28 aa, Giardia lamblia
KLKPSIAEVFFSYRFFDVYGESLTDPPQ

SEQ ID NO: 3189756 - protein, 25 aa, Giardia lamblia
KLLDKEAELVDIRRAYDKLSVENSS

SEQ ID NO: 3189757 - protein, 27 aa, Giardia lamblia
KLLELEGFYVPPSFDYFIDSLLVGISD

SEQ ID NO: 3189758 - protein, 17 aa, Giardia lamblia
KLLHHYRSRADEGALED

SEQ ID NO: 3189759 - protein, 17 aa, Giardia lamblia
KLLIADLSPRILSLDSA

SEQ ID NO: 3189760 - protein, 17 aa, Giardia lamblia
KLLLDISGITEFTYSSE

SEQ ID NO: 3189761 - protein, 23 aa, Giardia lamblia
KLLLEADLFNRYRQARVYVPGSG

SEQ ID NO: 3189762 - protein, 19 aa, Giardia lamblia
KLLPHHFNYALKTERKNDP

SEQ ID NO: 3189763 - protein, 20 aa, Giardia lamblia
KLLPSIVREPFPESRRPEVY

SEQ ID NO: 3189764 - protein, 30 aa, Giardia lamblia
KLLSKLAHVPVLARLFPKRLHKPTAIANYT

SEQ ID NO: 3189765 - protein, 24 aa, Giardia lamblia
KLLSRIKSFRPKESTLFRVILRQC

SEQ ID NO: 3189766 - protein, 22 aa, Giardia lamblia
KLMRYMRTVATAVPYLKRSPDY

SEQ ID NO: 3189767 - protein, 30 aa, Giardia lamblia
KLNADLPPLRLFLQYIMHLHSTYKLAADRW

SEQ ID NO: 3189768 - protein, 22 aa, Giardia lamblia
KLNAMRGIEPLYFEGSAAVGVV

SEQ ID NO: 3189769 - protein, 29 aa, Giardia lamblia
KLNKHAIITLLRIEFFLPGPQESFLQTQV

SEQ ID NO: 3189770 - protein, 20 aa, Giardia lamblia
KLNRRVGFPVFSTLIVANYV

SEQ ID NO: 3189771 - protein, 22 aa, Giardia lamblia
KLPFAQLCIPLGCGARDAVGAT

SEQ ID NO: 3189772 - protein, 17 aa, Giardia lamblia
KLPPFLSMEEKTRVANP

SEQ ID NO: 3189773 - protein, 24 aa, Giardia lamblia
KLQAPAFRLERFKFGMKLYLLCCN

SEQ ID NO: 3189774 - protein, 19 aa, Giardia lamblia
KLQENLAALQLDFPDIESI

SEQ ID NO: 3189775 - protein, 19 aa, Giardia lamblia
KLQIDIVLVINKLDRLYNE

SEQ ID NO: 3189776 - protein, 27 aa, Giardia lamblia
KLQITEFYQTLLLPSVQRLYATSGVAP

SEQ ID NO: 3189777 - protein, 18 aa, Giardia lamblia
KLQLRQQLALLTADNEIL

SEQ ID NO: 3189778 - protein, 28 aa, Giardia lamblia
KLQRAREALRLSYRRLNIRKAEAATYKA

SEQ ID NO: 3189779 - protein, 32 aa, Giardia lamblia
KLQREPTLLCLRDLWRFLTLHDYDQKLEEPDP

SEQ ID NO: 3189780 - protein, 17 aa, Giardia lamblia
KLRALPITSRRRLCVNE

SEQ ID NO: 3189781 - protein, 32 aa, Giardia lamblia
KLRDSSHIAILYFMFRTPTSIKQLILGDLPKG

SEQ ID NO: 3189782 - protein, 22 aa, Giardia lamblia
KLRLHCKSLLDENIRISSQWQQ

SEQ ID NO: 3189783 - protein, 21 aa, Giardia lamblia
KLRQKQLLFEKALSASPSPTR

SEQ ID NO: 3189784 - protein, 29 aa, Giardia lamblia
KLRTQSFDLLKPLNPLAIPKNRQISCDLC

SEQ ID NO: 3189785 - protein, 22 aa, Giardia lamblia
KLRVEFLHSCYDDMLTALKING

SEQ ID NO: 3189786 - protein, 23 aa, Giardia lamblia
KLSEERQRRIALEKERIAAEKQI

SEQ ID NO: 3189787 - protein, 26 aa, Giardia lamblia
KLSEWYSGPSFLDLLDELKVPKRDTK

SEQ ID NO: 3189788 - protein, 28 aa, Giardia lamblia
KLSIKPPRVKLLPPSADAPAGKLVINMK

SEQ ID NO: 3189789 - protein, 17 aa, Giardia lamblia
KLSLLIKGPIYQQLLRS

SEQ ID NO: 3189790 - protein, 20 aa, Giardia lamblia
KLSNMNQRVSRFHDKMENEI

SEQ ID NO: 3189791 - protein, 35 aa, Giardia lamblia
KLSQAGIPCFYGLLTSLPLFIKHATKVIMGAHSVS

SEQ ID NO: 3189792 - protein, 26 aa, Giardia lamblia
KLSQRLGHLFYLEPNVLAMAVLNCTS

SEQ ID NO: 3189793 - protein, 28 aa, Giardia lamblia
KLSRIYAHVPWSYPLFQPPVHEQEHILD

SEQ ID NO: 3189794 - protein, 19 aa, Giardia lamblia
KLTAHLLHKVKTLGDRATL

SEQ ID NO: 3189795 - protein, 30 aa, Giardia lamblia
KLTAYSIRQLLFRPIPPAEYARIIGIESEN

SEQ ID NO: 3189796 - protein, 26 aa, Giardia lamblia
KLTDLQLVFCHMYRASLSFIGFEPSH

SEQ ID NO: 3189797 - protein, 24 aa, Giardia lamblia
KLTLARINAIPMAGYAPLVEMDSP

SEQ ID NO: 3189798 - protein, 26 aa, Giardia lamblia
KLTLTNNMLPPPKGFSLPGSPKESSR

SEQ ID NO: 3189799 - protein, 17 aa, Giardia lamblia
KLTMVLRDSFIGNSQTV

SEQ ID NO: 3189800 - protein, 21 aa, Giardia lamblia
KLTVPYVTVSSLLRAKAAVKS

SEQ ID NO: 3189801 - protein, 28 aa, Giardia lamblia
KLVNQKQLQFPILHACYSDHHRTFLFTA

SEQ ID NO: 3189802 - protein, 25 aa, Giardia lamblia
KLVNRLSAGLLILRSALLGSQDEGF

SEQ ID NO: 3189803 - protein, 23 aa, Giardia lamblia
KLVPQFNKLSPVPILLISPPGDT

SEQ ID NO: 3189804 - protein, 26 aa, Giardia lamblia
KLVQTRDKLYEDIKFLSDERAQLNVE

SEQ ID NO: 3189805 - protein, 27 aa, Giardia lamblia
KLVVQHMKLYIFVALGKTPGRGRWDRD

SEQ ID NO: 3189806 - protein, 21 aa, Giardia lamblia
KLWKVCEGVLKCLIEAAKSSF

SEQ ID NO: 3189807 - protein, 18 aa, Giardia lamblia
KLWRHLTVLYADAWSPGE

SEQ ID NO: 3189808 - protein, 20 aa, Giardia lamblia
KLYDDGTLCLLFNTKVFQVN

SEQ ID NO: 3189809 - protein, 19 aa, Giardia lamblia
KLYGPLYASLRKYQQTGVR

SEQ ID NO: 3189810 - protein, 21 aa, Giardia lamblia
KLYHLEYLRRSGRSWQPIEYT

SEQ ID NO: 3189811 - protein, 21 aa, Giardia lamblia
KLYIHLTKGDWARIPLYIHPA

SEQ ID NO: 3189812 - protein, 22 aa, Giardia lamblia
KLYKDVFFVTAAKDGMLYLWSQ

SEQ ID NO: 3189813 - protein, 21 aa, Giardia lamblia
KLYNDLKKVLSRQPGSEVLEK

SEQ ID NO: 3189814 - protein, 18 aa, Giardia lamblia
KLYTLMFATIKKLSESLA

SEQ ID NO: 3189815 - protein, 19 aa, Giardia lamblia
KMAFISPGTLLYHDVDLRS

SEQ ID NO: 3189816 - protein, 18 aa, Giardia lamblia
KMCAVTQSLLRNGNNIFL

SEQ ID NO: 3189817 - protein, 25 aa, Giardia lamblia
KMDIELLLDYLEKKYKFILTNLRIF

SEQ ID NO: 3189818 - protein, 20 aa, Giardia lamblia
KMDVWALGCLIYEICLRKKP

SEQ ID NO: 3189819 - protein, 24 aa, Giardia lamblia
KMDYRGFIDLMLCVSFPRSKAAAV

SEQ ID NO: 3189820 - protein, 22 aa, Giardia lamblia
KMFIKLIALHQDFVSKRSLRRC

SEQ ID NO: 3189821 - protein, 17 aa, Giardia lamblia
KMFPDYCIACKTPYLSE

SEQ ID NO: 3189822 - protein, 19 aa, Giardia lamblia
KMHIEPPFRKPAATVIVEA

SEQ ID NO: 3189823 - protein, 18 aa, Giardia lamblia
KMIFISEAATADIVCKRK

SEQ ID NO: 3189824 - protein, 17 aa, Giardia lamblia
KMIGIIDEKLREYGDSS

SEQ ID NO: 3189825 - protein, 17 aa, Giardia lamblia
KMIPTQQELFIPLGEFV

SEQ ID NO: 3189826 - protein, 17 aa, Giardia lamblia
KMITMDWRNGYTALMLA

SEQ ID NO: 3189827 - protein, 18 aa, Giardia lamblia
KMLVFDRKTTIQPALRSS

SEQ ID NO: 3189828 - protein, 19 aa, Giardia lamblia
KMMSSPFTNSLLIYGEPGC

SEQ ID NO: 3189829 - protein, 38 aa, Giardia lamblia
KMMVEPLDILVTTPGIFGYFYGRNLINLSRVTYAVLDE

SEQ ID NO: 3189830 - protein, 17 aa, Giardia lamblia
KMMWKNSSILLNVSELL

SEQ ID NO: 3189831 - protein, 23 aa, Giardia lamblia
KMNLNDLLLSQPISDVLARKDDE

SEQ ID NO: 3189832 - protein, 25 aa, Giardia lamblia
KMNNPKISSLLILLTQLFDICSSID

SEQ ID NO: 3189833 - protein, 20 aa, Giardia lamblia
KMPMRELFDRSHQNALFGGW

SEQ ID NO: 3189834 - protein, 17 aa, Giardia lamblia
KMTNEIICYLDGSDSEE

SEQ ID NO: 3189835 - protein, 26 aa, Giardia lamblia
KMTNTLITALMFAAQHNSLASIKPLA

SEQ ID NO: 3189836 - protein, 20 aa, Giardia lamblia
KMTPHPTIYLNPYKSRTGLG

SEQ ID NO: 3189837 - protein, 22 aa, Giardia lamblia
KMTVSRDVLLDKLSATHTKNET

SEQ ID NO: 3189838 - protein, 18 aa, Giardia lamblia
KMYDQLNEKVAEGFARIS

SEQ ID NO: 3189839 - protein, 18 aa, Giardia lamblia
KMYKTRTFLHHYTNYMSP

SEQ ID NO: 3189840 - protein, 17 aa, Giardia lamblia
KMYPYICEANALADFFD

SEQ ID NO: 3189841 - protein, 24 aa, Giardia lamblia
KNAMALTLPAYIPVQFRTLYIDNV

SEQ ID NO: 3189842 - protein, 18 aa, Giardia lamblia
KNARIHYLQAALAEFTSK

SEQ ID NO: 3189843 - protein, 29 aa, Giardia lamblia
KNCALVMLFQRRFYLRAFLKRTRQERNRR

SEQ ID NO: 3189844 - protein, 24 aa, Giardia lamblia
KNCRLKILSTIKVLEGRYHKMHIP

SEQ ID NO: 3189845 - protein, 26 aa, Giardia lamblia
KNCSMKLLLNVHPLGHTFPGAGVFEA

SEQ ID NO: 3189846 - protein, 22 aa, Giardia lamblia
KNDLLERFRLLSDTHILQSFQP

SEQ ID NO: 3189847 - protein, 26 aa, Giardia lamblia
KNEELKVLTLRLADLEFKLTESELMR

SEQ ID NO: 3189848 - protein, 19 aa, Giardia lamblia
KNEFIDRLIDLCVSLVPDS

SEQ ID NO: 3189849 - protein, 25 aa, Giardia lamblia
KNETEELLAFKDLQYKQLQKQLEDS

SEQ ID NO: 3189850 - protein, 19 aa, Giardia lamblia
KNFAELPLLPNVISLHLDG

SEQ ID NO: 3189851 - protein, 24 aa, Giardia lamblia
KNHERFCFTFFAALGAMQRVATIV

SEQ ID NO: 3189852 - protein, 17 aa, Giardia lamblia
KNHVLMHCLRRWQLFSL

SEQ ID NO: 3189853 - protein, 21 aa, Giardia lamblia
KNILFQLGLAMGYSYSKDLYE

SEQ ID NO: 3189854 - protein, 23 aa, Giardia lamblia
KNILRYLALHQRGDNVLLIEMEL

SEQ ID NO: 3189855 - protein, 24 aa, Giardia lamblia
KNITTEVILLPSTRGSSEPLRQKT

SEQ ID NO: 3189856 - protein, 27 aa, Giardia lamblia
KNIVNSHPFYVMFEPSLGCDARTDHVS

SEQ ID NO: 3189857 - protein, 28 aa, Giardia lamblia
KNKELRQQFFLLLSKEELLSTLEIAERI

SEQ ID NO: 3189858 - protein, 17 aa, Giardia lamblia
KNKIRVGTFIPAIGAIA

SEQ ID NO: 3189859 - protein, 23 aa, Giardia lamblia
KNKKFYLIHNKFNKKPIPIVTVF

SEQ ID NO: 3189860 - protein, 21 aa, Giardia lamblia
KNKLFAARFLAPYEAGYQDSC

SEQ ID NO: 3189861 - protein, 22 aa, Giardia lamblia
KNLIARDCFPLIVFAFGKKKCE

SEQ ID NO: 3189862 - protein, 21 aa, Giardia lamblia
KNLMLFFRDGCCTTVEGTTAD

SEQ ID NO: 3189863 - protein, 32 aa, Giardia lamblia
KNLQKSVFLLQLFNEFIIARLLGGVSLHFEFA

SEQ ID NO: 3189864 - protein, 22 aa, Giardia lamblia
KNLSVVAIGPFTSLMSIIHLHA

SEQ ID NO: 3189865 - protein, 26 aa, Giardia lamblia
KNMRIGSLVTLLISNSLELGKVDNYG

SEQ ID NO: 3189866 - protein, 26 aa, Giardia lamblia
KNNMDQTIWFQAIRTNNIEFVEEYCE

SEQ ID NO: 3189867 - protein, 24 aa, Giardia lamblia
KNNNISMVWALLGYQKRLQDDGKR

SEQ ID NO: 3189868 - protein, 23 aa, Giardia lamblia
KNNYNVIPKLIPREAKIVDRDGL

SEQ ID NO: 3189869 - protein, 18 aa, Giardia lamblia
KNPFYPERIIKTPVDILC

SEQ ID NO: 3189870 - protein, 23 aa, Giardia lamblia
KNQELLRLKLTSGNTTLALNTFK

SEQ ID NO: 3189871 - protein, 25 aa, Giardia lamblia
KNQKQYHFCVIYGMNFLSMCSTGAS

SEQ ID NO: 3189872 - protein, 23 aa, Giardia lamblia
KNQTALVAVLPRILSLHSRERPS

SEQ ID NO: 3189873 - protein, 21 aa, Giardia lamblia
KNRIRLYFSTANKVVKITSLH

SEQ ID NO: 3189874 - protein, 24 aa, Giardia lamblia
KNRIRSIIAPSIYQYNLLHLDLAD

SEQ ID NO: 3189875 - protein, 22 aa, Giardia lamblia
KNRQHFYFTPQQGLLEYWLFGE

SEQ ID NO: 3189876 - protein, 45 aa, Giardia lamblia
KNRVTQQKTVYLYFLDKRQGLLMLPYATIYIPYTSISRMTLENDT

SEQ ID NO: 3189877 - protein, 21 aa, Giardia lamblia
KNSCIQLHKLLVCAGVTFIDS

SEQ ID NO: 3189878 - protein, 26 aa, Giardia lamblia
KNSELVRLRNILHENNINFALDASIS

SEQ ID NO: 3189879 - protein, 20 aa, Giardia lamblia
KNSNELLLTEIRQLTERKDH

SEQ ID NO: 3189880 - protein, 21 aa, Giardia lamblia
KNSQTFCMFSNYVLSRGNASA

SEQ ID NO: 3189881 - protein, 17 aa, Giardia lamblia
KNSRWMPKKGTIGFGKY

SEQ ID NO: 3189882 - protein, 24 aa, Giardia lamblia
KNVRSTLYVLRLLANQSKAFVLAT

SEQ ID NO: 3189883 - protein, 28 aa, Giardia lamblia
KNYKALFLSTYLLYGSQYALIKSFTLMR

SEQ ID NO: 3189884 - protein, 17 aa, Giardia lamblia
KPAAWIPDKAWLNIIAL

SEQ ID NO: 3189885 - protein, 24 aa, Giardia lamblia
KPALAAIERLPVTQFLLGEVRGSK

SEQ ID NO: 3189886 - protein, 25 aa, Giardia lamblia
KPANESIIRPLPPPSIDATEPFLQS

SEQ ID NO: 3189887 - protein, 34 aa, Giardia lamblia
KPAREISLYKVAKPLYKMGYLFAPRSVCLAGVST

SEQ ID NO: 3189888 - protein, 21 aa, Giardia lamblia
KPCKTIVPNILRLNEQLKLVG

SEQ ID NO: 3189889 - protein, 29 aa, Giardia lamblia
KPDELGNLKDFRFWWASQEAKEACANLSG

SEQ ID NO: 3189890 - protein, 17 aa, Giardia lamblia
KPDFRGNYLPSGSRKES

SEQ ID NO: 3189891 - protein, 18 aa, Giardia lamblia
KPDVTLYPTFQKPELKND

SEQ ID NO: 3189892 - protein, 25 aa, Giardia lamblia
KPEDLPDLSLLLPHADRKLISGHTC

SEQ ID NO: 3189893 - protein, 24 aa, Giardia lamblia
KPEIMQLFCGYAPDYLIQLQNLNS

SEQ ID NO: 3189894 - protein, 22 aa, Giardia lamblia
KPEVVRLLMPLEGGLQDKTGIS

SEQ ID NO: 3189895 - protein, 17 aa, Giardia lamblia
KPFKLNCAEAFAAGLWI

SEQ ID NO: 3189896 - protein, 24 aa, Giardia lamblia
KPFNQSFKFCKCDPLPPFIVFADT

SEQ ID NO: 3189897 - protein, 26 aa, Giardia lamblia
KPFSPRNVLTCGAQILSALMYVYHPR

SEQ ID NO: 3189898 - protein, 31 aa, Giardia lamblia
KPGDHVFITLKFQPTLELRLTKDFGLTFTVS

SEQ ID NO: 3189899 - protein, 22 aa, Giardia lamblia
KPGLIIEFFWEQDKEILTYTDV

SEQ ID NO: 3189900 - protein, 25 aa, Giardia lamblia
KPGRTAYMIAILKKNFLVMELLHEH

SEQ ID NO: 3189901 - protein, 17 aa, Giardia lamblia
KPIFRRKAKTTKKQVIR

SEQ ID NO: 3189902 - protein, 24 aa, Giardia lamblia
KPIKNVYVVPKPYALFKSQREISA

SEQ ID NO: 3189903 - protein, 17 aa, Giardia lamblia
KPISFKVGINQTIRAWD

SEQ ID NO: 3189904 - protein, 18 aa, Giardia lamblia
KPKFIFTIGDGTVPLISS

SEQ ID NO: 3189905 - protein, 36 aa, Giardia lamblia
KPKGPVLPPPGVPVAIAIPCCHMIIDPKRSVKLASN

SEQ ID NO: 3189906 - protein, 20 aa, Giardia lamblia
KPLEALLEEYYLTSIIMRRD

SEQ ID NO: 3189907 - protein, 18 aa, Giardia lamblia
KPLGRIMDRYINEAVIPD

SEQ ID NO: 3189908 - protein, 23 aa, Giardia lamblia
KPLGRITMGLFGSIVPKTAENFK

SEQ ID NO: 3189909 - protein, 23 aa, Giardia lamblia
KPLLPFTIGLSYIFQDVYTHLTA

SEQ ID NO: 3189910 - protein, 34 aa, Giardia lamblia
KPLNMYIAWDIIRQITMVLDWLHNPPPGTQHKPG

SEQ ID NO: 3189911 - protein, 20 aa, Giardia lamblia
KPLTEIAPTLGFKISTWRPQ

SEQ ID NO: 3189912 - protein, 22 aa, Giardia lamblia
KPLTSFFLFKRDNQAKVAEFPR

SEQ ID NO: 3189913 - protein, 20 aa, Giardia lamblia
KPMCVRGCPVQVPIPQFIKK

SEQ ID NO: 3189914 - protein, 23 aa, Giardia lamblia
KPNPPPRRKGALFTLTSVSATGS

SEQ ID NO: 3189915 - protein, 21 aa, Giardia lamblia
KPNRQLNLLAGYYTVSQTDFF

SEQ ID NO: 3189916 - protein, 27 aa, Giardia lamblia
KPPHLIQRIMDTVLLLMNMPLDRVTPD

SEQ ID NO: 3189917 - protein, 19 aa, Giardia lamblia
KPPHTTFCDAPVARNFLGA

SEQ ID NO: 3189918 - protein, 27 aa, Giardia lamblia
KPPPPINLGISRYPPQLRAFIKASASG

SEQ ID NO: 3189919 - protein, 17 aa, Giardia lamblia
KPPSLMDRLLYASIHST

SEQ ID NO: 3189920 - protein, 20 aa, Giardia lamblia
KPQTPLLKLMRNIDTLQPYD

SEQ ID NO: 3189921 - protein, 24 aa, Giardia lamblia
KPRAQSNRIIPRPTYLLSPEHDTA

SEQ ID NO: 3189922 - protein, 25 aa, Giardia lamblia
KPRATTRSALWLHKLISAITSDRYK

SEQ ID NO: 3189923 - protein, 17 aa, Giardia lamblia
KPRILSLTCLKCISDKP

SEQ ID NO: 3189924 - protein, 17 aa, Giardia lamblia
KPRPGEPVALFGFGYLR

SEQ ID NO: 3189925 - protein, 33 aa, Giardia lamblia
KPSSVLATLMMFYNTAYLLPLSKVIDDIPPQFK

SEQ ID NO: 3189926 - protein, 33 aa, Giardia lamblia
KPSWATIYPSIIDTKLLLLTISDGFFITENDIP

SEQ ID NO: 3189927 - protein, 20 aa, Giardia lamblia
KPTCVQAASWPILIQGRDCI

SEQ ID NO: 3189928 - protein, 24 aa, Giardia lamblia
KPTKPFTPYFAFMHDHLDEYRDVV

SEQ ID NO: 3189929 - protein, 19 aa, Giardia lamblia
KPTLLIYDTDTAPVRYRKA

SEQ ID NO: 3189930 - protein, 27 aa, Giardia lamblia
KPTRISKLIDLFFADYFVDSYEDSDID

SEQ ID NO: 3189931 - protein, 25 aa, Giardia lamblia
KPTTATAKFALLQPLKKEATDKGLA

SEQ ID NO: 3189932 - protein, 17 aa, Giardia lamblia
KPTYMEICMILDGLRRA

SEQ ID NO: 3189933 - protein, 19 aa, Giardia lamblia
KPVILMHHMLLGLVGDGKM

SEQ ID NO: 3189934 - protein, 30 aa, Giardia lamblia
KPVPPPPLKEPHYPANPKIRIIESSGTEST

SEQ ID NO: 3189935 - protein, 29 aa, Giardia lamblia
KPYASMLAKLIGIIGPIPRDMILAGRESH

SEQ ID NO: 3189936 - protein, 18 aa, Giardia lamblia
KPYRLSSILIDLTNTLLL

SEQ ID NO: 3189937 - protein, 33 aa, Giardia lamblia
KPYTARDRVLFYSPTIQLQPPAPIRGLSCNVHQ

SEQ ID NO: 3189938 - protein, 22 aa, Giardia lamblia
KQAERLLDTLGIPYVVAAGEAE

SEQ ID NO: 3189939 - protein, 24 aa, Giardia lamblia
KQANIPVLPDLDMAAKRAMFELSE

SEQ ID NO: 3189940 - protein, 21 aa, Giardia lamblia
KQATELILTLGVHEPGKEADL

SEQ ID NO: 3189941 - protein, 24 aa, Giardia lamblia
KQDLAVLLAAHYELLHPARLAFHL

SEQ ID NO: 3189942 - protein, 20 aa, Giardia lamblia
KQDLLIVHPSGIQVLTVGDS

SEQ ID NO: 3189943 - protein, 21 aa, Giardia lamblia
KQDPELILRFLHLQDRTKELD

SEQ ID NO: 3189944 - protein, 17 aa, Giardia lamblia
KQDQYGLLFLQNYGSVC

SEQ ID NO: 3189945 - protein, 24 aa, Giardia lamblia
KQEISRWCQAIPLYTYHGSHQQRR

SEQ ID NO: 3189946 - protein, 31 aa, Giardia lamblia
KQEKRDALMLHRLLLRWKRNARLEASHNHVI

SEQ ID NO: 3189947 - protein, 20 aa, Giardia lamblia
KQENIMLKNALHNQPPPPQP

SEQ ID NO: 3189948 - protein, 23 aa, Giardia lamblia
KQESSIMRQLSSADLDLIKPRTP

SEQ ID NO: 3189949 - protein, 22 aa, Giardia lamblia
KQFCNFVSAFYMPREVITIQCG

SEQ ID NO: 3189950 - protein, 28 aa, Giardia lamblia
KQGLARVFTLKGWRLRELRLFKNPKTQT

SEQ ID NO: 3189951 - protein, 24 aa, Giardia lamblia
KQGLSVHEFYKANGLLAMVNPKKA

SEQ ID NO: 3189952 - protein, 25 aa, Giardia lamblia
KQHIRTVTEPLLQSIAGLEHDNKTL

SEQ ID NO: 3189953 - protein, 24 aa, Giardia lamblia
KQHQFKVLLLKDQQSSLAIERQKQ

SEQ ID NO: 3189954 - protein, 23 aa, Giardia lamblia
KQIDLDFMTWLSDQLYDVSYAEE

SEQ ID NO: 3189955 - protein, 27 aa, Giardia lamblia
KQIFDNNLFVDLPWTTAKSLQFFPQVE

SEQ ID NO: 3189956 - protein, 22 aa, Giardia lamblia
KQIGEGIFGRCFSAYRVYDNEL

SEQ ID NO: 3189957 - protein, 24 aa, Giardia lamblia
KQILQPPLTDVLNSGIPAPAPSVN

SEQ ID NO: 3189958 - protein, 19 aa, Giardia lamblia
KQIQTLMDLPEVATTRNKL

SEQ ID NO: 3189959 - protein, 29 aa, Giardia lamblia
KQKIKQQHYLILQLQNKLNPSTGVPSAPQ

SEQ ID NO: 3189960 - protein, 17 aa, Giardia lamblia
KQKLGKELRFALLDTLS

SEQ ID NO: 3189961 - protein, 28 aa, Giardia lamblia
KQKNATKVLTYLLELRPNQLTHSPPRNK

SEQ ID NO: 3189962 - protein, 25 aa, Giardia lamblia
KQKNRYRIAYTRLLEMYSEDIAAVN

SEQ ID NO: 3189963 - protein, 27 aa, Giardia lamblia
KQLDFTDVIFLLIQTLQAKEPEVRKAS

SEQ ID NO: 3189964 - protein, 20 aa, Giardia lamblia
KQLHALKPYARNALAYISQQ

SEQ ID NO: 3189965 - protein, 25 aa, Giardia lamblia
KQLLVLLSHIFYPGTFDMFSMYDFQ

SEQ ID NO: 3189966 - protein, 27 aa, Giardia lamblia
KQLPNRPLTLLSTYIEKYPACFSAGKI

SEQ ID NO: 3189967 - protein, 21 aa, Giardia lamblia
KQLVETLPKDKWRDINHLLVG

SEQ ID NO: 3189968 - protein, 24 aa, Giardia lamblia
KQNELWHSFVWNYDRLPYSADFME

SEQ ID NO: 3189969 - protein, 25 aa, Giardia lamblia
KQNEYGWTALMWAAENGYVDCVKLL

SEQ ID NO: 3189970 - protein, 23 aa, Giardia lamblia
KQNLFDDFLITAYSHEFDLTDLD

SEQ ID NO: 3189971 - protein, 20 aa, Giardia lamblia
KQPFRYDIIGVRLNRHPYAS

SEQ ID NO: 3189972 - protein, 34 aa, Giardia lamblia
KQPGSMPPPPALVPPPLALPTKATPAPAPACEEC

SEQ ID NO: 3189973 - protein, 17 aa, Giardia lamblia
KQPNLDTAYLLSIRMDL

SEQ ID NO: 3189974 - protein, 24 aa, Giardia lamblia
KQPVKPMLPADWIKGEFVPCVRGR

SEQ ID NO: 3189975 - protein, 22 aa, Giardia lamblia
KQQMTEWFRDRPDKSMAPSLLE

SEQ ID NO: 3189976 - protein, 21 aa, Giardia lamblia
KQRLFDVKYQLAIAKVERAQC

SEQ ID NO: 3189977 - protein, 32 aa, Giardia lamblia
KQRLGTAFSRSKFRNFLFEKVLEHMQPVQAED

SEQ ID NO: 3189978 - protein, 17 aa, Giardia lamblia
KQSIFTLSQRHFLTADF

SEQ ID NO: 3189979 - protein, 30 aa, Giardia lamblia
KQSIRPPANLMKALWNQPLTPRTRDREYIR

SEQ ID NO: 3189980 - protein, 20 aa, Giardia lamblia
KQSLELYPVCLCDRNAAITT

SEQ ID NO: 3189981 - protein, 22 aa, Giardia lamblia
KQTGALLRLVRIFPPVARELNH

SEQ ID NO: 3189982 - protein, 17 aa, Giardia lamblia
KQTILTMRQWIPDIQRS

SEQ ID NO: 3189983 - protein, 27 aa, Giardia lamblia
KQTNYRLHVIAYLKSLRYFDHKVIRES

SEQ ID NO: 3189984 - protein, 25 aa, Giardia lamblia
KQVHLFQSMKLFFQNKPTVIVLSKA

SEQ ID NO: 3189985 - protein, 24 aa, Giardia lamblia
KQVKDAFMQWITTPAIKLSQSNLG

SEQ ID NO: 3189986 - protein, 25 aa, Giardia lamblia
KQVLKFASSLFDRIPADLLPSNIHI

SEQ ID NO: 3189987 - protein, 19 aa, Giardia lamblia
KQVLSLERSLLSADNKQTA

SEQ ID NO: 3189988 - protein, 32 aa, Giardia lamblia
KQVMDCFASSKPVYPLLTPECDMWSLGALVYE

SEQ ID NO: 3189989 - protein, 19 aa, Giardia lamblia
KQVMLGAVQQHKLLTNYKV

SEQ ID NO: 3189990 - protein, 27 aa, Giardia lamblia
KQVPSPHLIPYMQLEKSYKVMQEDLLR

SEQ ID NO: 3189991 - protein, 19 aa, Giardia lamblia
KQYIMRMAPNVFAESGPVI

SEQ ID NO: 3189992 - protein, 21 aa, Giardia lamblia
KQYIYQLRRDSSNRLRQRRGF

SEQ ID NO: 3189993 - protein, 18 aa, Giardia lamblia
KRADNTYVMAHLEEYFLA

SEQ ID NO: 3189994 - protein, 21 aa, Giardia lamblia
KRAFKLMLDAILQTSVQVVLV

SEQ ID NO: 3189995 - protein, 37 aa, Giardia lamblia
KRAIHLAELLCLQNPLFPWVSLYRAADVVYNPTINYQ

SEQ ID NO: 3189996 - protein, 21 aa, Giardia lamblia
KRALLEFDRPDLSAIPGTPIA

SEQ ID NO: 3189997 - protein, 30 aa, Giardia lamblia
KRALRDKVDEIVNLLAIIDRVKTEYENYRA

SEQ ID NO: 3189998 - protein, 22 aa, Giardia lamblia
KRAQVPLYYFNRMAEFVCLREV

SEQ ID NO: 3189999 - protein, 19 aa, Giardia lamblia
KRCDALHFFCTISAKTDTM

SEQ ID NO: 3190000 - protein, 24 aa, Giardia lamblia
KRCSSILLPCRHMCLCRSCALEFR

SEQ ID NO: 3190001 - protein, 18 aa, Giardia lamblia
KRDECCDMVVNFLRDHMS

SEQ ID NO: 3190002 - protein, 33 aa, Giardia lamblia
KRDELLEKYKSRTTILFGLTNRKEQIRIGNVKR

SEQ ID NO: 3190003 - protein, 27 aa, Giardia lamblia
KRDSKKFFVTFPYPYMNGRLHLGHLFS

SEQ ID NO: 3190004 - protein, 18 aa, Giardia lamblia
KREALLYAKYLRSQNSIL

SEQ ID NO: 3190005 - protein, 24 aa, Giardia lamblia
KREDLWIVSKLWPNFHEPEKVAYQ

SEQ ID NO: 3190006 - protein, 17 aa, Giardia lamblia
KREEIDFVIRPNSEEKT

SEQ ID NO: 3190007 - protein, 24 aa, Giardia lamblia
KREGEWFFFCLNGPVDAVWIENLN

SEQ ID NO: 3190008 - protein, 25 aa, Giardia lamblia
KREHRQFEYLANYPFIKKPSYQIVD

SEQ ID NO: 3190009 - protein, 17 aa, Giardia lamblia
KRELLAREESYNKRFHK

SEQ ID NO: 3190010 - protein, 24 aa, Giardia lamblia
KRETYRDIIKNFPQLKKFNGRDVQ

SEQ ID NO: 3190011 - protein, 25 aa, Giardia lamblia
KREVRRVFILLDMLSKPPEDAARSC

SEQ ID NO: 3190012 - protein, 18 aa, Giardia lamblia
KREWNNICTPIVTELLLD

SEQ ID NO: 3190013 - protein, 21 aa, Giardia lamblia
KREYLIIPQETRERLIHMVCI

SEQ ID NO: 3190014 - protein, 18 aa, Giardia lamblia
KRFIIADFGLCKDALRCG

SEQ ID NO: 3190015 - protein, 19 aa, Giardia lamblia
KRGAELTARRLSELEALCD

SEQ ID NO: 3190016 - protein, 19 aa, Giardia lamblia
KRHEPYKLGFDAPRGQDIL

SEQ ID NO: 3190017 - protein, 23 aa, Giardia lamblia
KRHEVAALFLVALNLRASGAINI

SEQ ID NO: 3190018 - protein, 27 aa, Giardia lamblia
KRHISMEPIVLVFKKLSTFIEFEERFC

SEQ ID NO: 3190019 - protein, 19 aa, Giardia lamblia
KRHLPTIYSLIISTPDEVC

SEQ ID NO: 3190020 - protein, 28 aa, Giardia lamblia
KRHNKILERIHLIPGLKLEMLRSDTEPK

SEQ ID NO: 3190021 - protein, 22 aa, Giardia lamblia
KRHVTDMWTQTFNLSVPLEDEL

SEQ ID NO: 3190022 - protein, 25 aa, Giardia lamblia
KRIDKLIHILKSPGSIPTASFLTLI

SEQ ID NO: 3190023 - protein, 52 aa, Giardia lamblia
KRIGDCFLWEIPLYKCMLLWNVHSFYKSPGPLRLLFIILKWSCFKCEQEALE

SEQ ID NO: 3190024 - protein, 19 aa, Giardia lamblia
KRIIELLSEFLLKASVEAC

SEQ ID NO: 3190025 - protein, 26 aa, Giardia lamblia
KRIIYNSVFLPYAPITDYRTPETSLT

SEQ ID NO: 3190026 - protein, 23 aa, Giardia lamblia
KRIKMILKTAYKFTPALPKTIHD

SEQ ID NO: 3190027 - protein, 45 aa, Giardia lamblia
KRITSPRSIVAMRRRAIRFSDIKPLPYSNFQRDYPEPAIADLHYK

SEQ ID NO: 3190028 - protein, 36 aa, Giardia lamblia
KRKDNYAIFFFRPVYTYPFGLIQLLSDTRVKHRKGP

SEQ ID NO: 3190029 - protein, 22 aa, Giardia lamblia
KRKFICLSSFLTWCRTELPPRQ

SEQ ID NO: 3190030 - protein, 18 aa, Giardia lamblia
KRKMDLLSRALPGNRFTQ

SEQ ID NO: 3190031 - protein, 21 aa, Giardia lamblia
KRKPDALGNYALHIAAQANNV

SEQ ID NO: 3190032 - protein, 22 aa, Giardia lamblia
KRKRHSFIPHDIQHISPTELMS

SEQ ID NO: 3190033 - protein, 18 aa, Giardia lamblia
KRKVIYENKALTDRLRSY

SEQ ID NO: 3190034 - protein, 21 aa, Giardia lamblia
KRKYFSLKKKEYEQMLRDGTA

SEQ ID NO: 3190035 - protein, 20 aa, Giardia lamblia
KRKYIEEDIALFKSFSKDPA

SEQ ID NO: 3190036 - protein, 26 aa, Giardia lamblia
KRLATTLPLIFRQTSLANLLIEAYDV

SEQ ID NO: 3190037 - protein, 17 aa, Giardia lamblia
KRLFDPIGLGDLGALEV

SEQ ID NO: 3190038 - protein, 17 aa, Giardia lamblia
KRLIAGLGTEKVRWGQA

SEQ ID NO: 3190039 - protein, 38 aa, Giardia lamblia
KRLITLLHNHLLHFYKIKYPQLFYMRKSVTGTVLTLDE

SEQ ID NO: 3190040 - protein, 44 aa, Giardia lamblia
KRLLEEAVVLPMLLPDFFTGVRSPWRGVLLFGPPGTGKTLLAKA

SEQ ID NO: 3190041 - protein, 22 aa, Giardia lamblia
KRLLKAVMQKFLPAADALLEMI

SEQ ID NO: 3190042 - protein, 20 aa, Giardia lamblia
KRLLLKLMRSDYVEYGQTLH

SEQ ID NO: 3190043 - protein, 25 aa, Giardia lamblia
KRLLRDLPCYISPSSGIVPAGIAIT

SEQ ID NO: 3190044 - protein, 26 aa, Giardia lamblia
KRLSGLRLYIKNLSLTGAILLQFKTP

SEQ ID NO: 3190045 - protein, 31 aa, Giardia lamblia
KRLTKGLPLPQLFLKKWKLYDDGTLCLLFNT

SEQ ID NO: 3190046 - protein, 31 aa, Giardia lamblia
KRMHTLLEYRKLFRTLLQERIICKNETAALL

SEQ ID NO: 3190047 - protein, 34 aa, Giardia lamblia
KRMVPEAAIWGFLAQAIQALTYLHSPFNKKYQDE

SEQ ID NO: 3190048 - protein, 17 aa, Giardia lamblia
KRNLEGQVLFLTEELTK

SEQ ID NO: 3190049 - protein, 20 aa, Giardia lamblia
KRPDIGILGLLAFSKQHSLT

SEQ ID NO: 3190050 - protein, 28 aa, Giardia lamblia
KRPPVELLLDYALLHTPALVQPGSPGSS

SEQ ID NO: 3190051 - protein, 17 aa, Giardia lamblia
KRPYFRAACLYYCPTLE

SEQ ID NO: 3190052 - protein, 17 aa, Giardia lamblia
KRQEFEKYFKSASLLEK

SEQ ID NO: 3190053 - protein, 23 aa, Giardia lamblia
KRQGFFRFTFMNTNEIVKILSAL

SEQ ID NO: 3190054 - protein, 19 aa, Giardia lamblia
KRQYTTIRTGLRLYGGASN

SEQ ID NO: 3190055 - protein, 20 aa, Giardia lamblia
KRRAELEEKILWETKQLNVN

SEQ ID NO: 3190056 - protein, 18 aa, Giardia lamblia
KRRALPPLSQRPSSKERS

SEQ ID NO: 3190057 - protein, 22 aa, Giardia lamblia
KRRIRHVFIDYYLADRTIQIQE

SEQ ID NO: 3190058 - protein, 33 aa, Giardia lamblia
KRRKIPVPIAMILSVLRQVAAALAYLHSVNGAN

SEQ ID NO: 3190059 - protein, 26 aa, Giardia lamblia
KRRLEKRIYIPLPDFESRKQLLKLNL

SEQ ID NO: 3190060 - protein, 22 aa, Giardia lamblia
KRRNQIFSIRPNVDANKLFISY

SEQ ID NO: 3190061 - protein, 20 aa, Giardia lamblia
KRRQTLFFSATFSNSLKEFC

SEQ ID NO: 3190062 - protein, 18 aa, Giardia lamblia
KRRSSLLSDFKILQDLHT

SEQ ID NO: 3190063 - protein, 25 aa, Giardia lamblia
KRSDRMLIEPIPLSSPPLAIASSSN

SEQ ID NO: 3190064 - protein, 28 aa, Giardia lamblia
KRSFLPHELWQLFYRNARSNFHVCLCLS

SEQ ID NO: 3190065 - protein, 25 aa, Giardia lamblia
KRSGHSLVLSWLTYDKITSPSADAD

SEQ ID NO: 3190066 - protein, 37 aa, Giardia lamblia
KRSLRRCIYSFKLPGQKIPLIPFIPSQRLFGHQGAGS

SEQ ID NO: 3190067 - protein, 18 aa, Giardia lamblia
KRTARRVLWAPETSKLPK

SEQ ID NO: 3190068 - protein, 23 aa, Giardia lamblia
KRTDYIFISKPSIDFGLVAVSET

SEQ ID NO: 3190069 - protein, 27 aa, Giardia lamblia
KRTQRLLSRSAIANKLLRKIQTRLNEQ

SEQ ID NO: 3190070 - protein, 37 aa, Giardia lamblia
KRTVSPLILMTILQLKHILLHPSLRYTLASVPNLTLT

SEQ ID NO: 3190071 - protein, 30 aa, Giardia lamblia
KRTYSKIDIVYLVFRFLCSPAGSITNSRTT

SEQ ID NO: 3190072 - protein, 23 aa, Giardia lamblia
KRVRIYDIRNPSEPIYMVSLNND

SEQ ID NO: 3190073 - protein, 27 aa, Giardia lamblia
KRVVAETFLLVVPRFLETDMTAVHDEL

SEQ ID NO: 3190074 - protein, 23 aa, Giardia lamblia
KRVVITCFGPCKDVLRSGNAFVG

SEQ ID NO: 3190075 - protein, 22 aa, Giardia lamblia
KRWSTHTPLMDAVLFRHNHDIP

SEQ ID NO: 3190076 - protein, 20 aa, Giardia lamblia
KRYDSIVSQLKLYLENVGYA

SEQ ID NO: 3190077 - protein, 31 aa, Giardia lamblia
KRYIARLMGPLSIYPYWKGAPVTAPRAYAIQ

SEQ ID NO: 3190078 - protein, 20 aa, Giardia lamblia
KRYIWIPVKHNTSICAMICY

SEQ ID NO: 3190079 - protein, 18 aa, Giardia lamblia
KSAIPVADIKRLLNSHEE

SEQ ID NO: 3190080 - protein, 28 aa, Giardia lamblia
KSAKSLTDNLLLAILPEVKTHVKDSIKH

SEQ ID NO: 3190081 - protein, 19 aa, Giardia lamblia
KSALHILSGGTFMLDDPGT

SEQ ID NO: 3190082 - protein, 21 aa, Giardia lamblia
KSALYILDLHACPYGCYGGAC

SEQ ID NO: 3190083 - protein, 20 aa, Giardia lamblia
KSDAHVPALYDRVNMDWPSR

SEQ ID NO: 3190084 - protein, 27 aa, Giardia lamblia
KSDAKLFLIDRFLGWSQMALCLLTNFR

SEQ ID NO: 3190085 - protein, 23 aa, Giardia lamblia
KSDIWALGVTFYELMNMGKHPFL

SEQ ID NO: 3190086 - protein, 25 aa, Giardia lamblia
KSDIWSFGCVIYYMCTGQPCFWGRT

SEQ ID NO: 3190087 - protein, 25 aa, Giardia lamblia
KSDLQLRFDALMKANPQLHQLIKDC

SEQ ID NO: 3190088 - protein, 29 aa, Giardia lamblia
KSDMWALGIVLYELMMLTTPFRGKNLQAV

SEQ ID NO: 3190089 - protein, 17 aa, Giardia lamblia
KSEIMNFLSQYIGYYRL

SEQ ID NO: 3190090 - protein, 17 aa, Giardia lamblia
KSEISQWGQPALEEHSC

SEQ ID NO: 3190091 - protein, 27 aa, Giardia lamblia
KSELEWLTEPVMQQIKQAILKGDYDTA

SEQ ID NO: 3190092 - protein, 17 aa, Giardia lamblia
KSELLLEASRLAPIGIY

SEQ ID NO: 3190093 - protein, 21 aa, Giardia lamblia
KSFYETGFVSLKQLSMYRAKA

SEQ ID NO: 3190094 - protein, 21 aa, Giardia lamblia
KSGFSPYTRPFSDCQDRKLTQ

SEQ ID NO: 3190095 - protein, 26 aa, Giardia lamblia
KSGKNDYPFPKGFTALMFATLFKQQS

SEQ ID NO: 3190096 - protein, 33 aa, Giardia lamblia
KSGTIPPKPPSVNTFLPLAYSTDTPLHDDYLPS

SEQ ID NO: 3190097 - protein, 24 aa, Giardia lamblia
KSGVPDWVPWVSFTESLQPLTTDE

SEQ ID NO: 3190098 - protein, 24 aa, Giardia lamblia
KSHAFRELDPGYPMALFQPHFVQP

SEQ ID NO: 3190099 - protein, 25 aa, Giardia lamblia
KSHNMAIFRSFFEAFYSLSCSGIDQ

SEQ ID NO: 3190100 - protein, 27 aa, Giardia lamblia
KSHRAGTQFLFRKIYSAKPIYGESYVE

SEQ ID NO: 3190101 - protein, 23 aa, Giardia lamblia
KSHVYPKFSLIARQHREIYFACN

SEQ ID NO: 3190102 - protein, 24 aa, Giardia lamblia
KSIHEFRFYIPTKCLHIDCIHREL

SEQ ID NO: 3190103 - protein, 17 aa, Giardia lamblia
KSILLYGAPGTGKSLIC

SEQ ID NO: 3190104 - protein, 21 aa, Giardia lamblia
KSIMTQIKWIVDDDSLHQALQ

SEQ ID NO: 3190105 - protein, 18 aa, Giardia lamblia
KSISPQFTASARSQRPGL

SEQ ID NO: 3190106 - protein, 21 aa, Giardia lamblia
KSISQFPAIPSGPVAIQTPSQ

SEQ ID NO: 3190107 - protein, 23 aa, Giardia lamblia
KSKPAILLSFPDCNCCLSDKHMP

SEQ ID NO: 3190108 - protein, 24 aa, Giardia lamblia
KSKPYVVYTFTISTEKGVFEVAKR

SEQ ID NO: 3190109 - protein, 17 aa, Giardia lamblia
KSKSPLRKPSTSKRVAR

SEQ ID NO: 3190110 - protein, 17 aa, Giardia lamblia
KSLAELVGALRLLNGCC

SEQ ID NO: 3190111 - protein, 20 aa, Giardia lamblia
KSLFSGPLDVSQSVGYGVLN

SEQ ID NO: 3190112 - protein, 28 aa, Giardia lamblia
KSLIAFQHLLFIVLRQKFLKNLLQMSDD

SEQ ID NO: 3190113 - protein, 29 aa, Giardia lamblia
KSLLPSQKSLNWLVSFVDNVFRARHVYLE

SEQ ID NO: 3190114 - protein, 26 aa, Giardia lamblia
KSLPQAVIIAPTKILCRQIYGVAENL

SEQ ID NO: 3190115 - protein, 27 aa, Giardia lamblia
KSLTRVSLELLFWNGDILKPASLQESK

SEQ ID NO: 3190116 - protein, 25 aa, Giardia lamblia
KSMGDKLYYYELKGVPLRIEVGQRD

SEQ ID NO: 3190117 - protein, 23 aa, Giardia lamblia
KSMPKYIALLALSAGIDARIVWE

SEQ ID NO: 3190118 - protein, 23 aa, Giardia lamblia
KSNEYFFDKITSRGYLEIASLLR

SEQ ID NO: 3190119 - protein, 24 aa, Giardia lamblia
KSNEYFFDKITSRGYLEIASLLRG

SEQ ID NO: 3190120 - protein, 23 aa, Giardia lamblia
KSNFPYTAWLTPEQQRGFNIDES

SEQ ID NO: 3190121 - protein, 24 aa, Giardia lamblia
KSPLRTPISRPNSIYLLAGIEAAI

SEQ ID NO: 3190122 - protein, 24 aa, Giardia lamblia
KSPMRSVVGPMSPPMQPVMSTDAA

SEQ ID NO: 3190123 - protein, 24 aa, Giardia lamblia
KSPPLPEPLTKTQAPISPPIYSVQ

SEQ ID NO: 3190124 - protein, 24 aa, Giardia lamblia
KSPRLLYQLVHQLLTHNGYTIVNK

SEQ ID NO: 3190125 - protein, 25 aa, Giardia lamblia
KSQCQIYIPIIKQYAKSIAKDAYRY

SEQ ID NO: 3190126 - protein, 24 aa, Giardia lamblia
KSQGFINYFGYQRFGSRSTGTHRI

SEQ ID NO: 3190127 - protein, 21 aa, Giardia lamblia
KSQLALLTKALKLYVGTFGPD

SEQ ID NO: 3190128 - protein, 21 aa, Giardia lamblia
KSQRARLLLRQGAKCYLHRRN

SEQ ID NO: 3190129 - protein, 23 aa, Giardia lamblia
KSQTLLDYVLYQTSSLSAEARSR

SEQ ID NO: 3190130 - protein, 21 aa, Giardia lamblia
KSQVDYLCHLSKTPVRVFAGS

SEQ ID NO: 3190131 - protein, 25 aa, Giardia lamblia
KSQVPVADWAVDALLSKCINQSSKI

SEQ ID NO: 3190132 - protein, 20 aa, Giardia lamblia
KSRCAVLYKNKKFYLIHNKF

SEQ ID NO: 3190133 - protein, 19 aa, Giardia lamblia
KSRCPGYLIYPGHGPLASI

SEQ ID NO: 3190134 - protein, 25 aa, Giardia lamblia
KSREMVQMLLQIYLESTKDIVPAVL

SEQ ID NO: 3190135 - protein, 25 aa, Giardia lamblia
KSRFCRGVPDPKIRYFDLGNRRAKV

SEQ ID NO: 3190136 - protein, 18 aa, Giardia lamblia
KSRFYMLSDADKHVWEKF

SEQ ID NO: 3190137 - protein, 19 aa, Giardia lamblia
KSRTPSYMPSSRSSPRKSG

SEQ ID NO: 3190138 - protein, 25 aa, Giardia lamblia
KSSGTYICRACHLALFSSGDKFDSG

SEQ ID NO: 3190139 - protein, 27 aa, Giardia lamblia
KSSSDQAVYVAAAARLEAHELRAVVER

SEQ ID NO: 3190140 - protein, 29 aa, Giardia lamblia
KSTCDKEIYVWFPIQQRQLARPSIEPIVT

SEQ ID NO: 3190141 - protein, 21 aa, Giardia lamblia
KSTDFTVLKTRQLFLTAGGIS

SEQ ID NO: 3190142 - protein, 25 aa, Giardia lamblia
KSTELQVFRYDVSSRIYPAIYELQS

SEQ ID NO: 3190143 - protein, 18 aa, Giardia lamblia
KSTFRPTPTYPATLNIIC

SEQ ID NO: 3190144 - protein, 23 aa, Giardia lamblia
KSTNAYIPISPWTSSMQIQQRGS

SEQ ID NO: 3190145 - protein, 17 aa, Giardia lamblia
KSTTIKAPMRSEHYLLP

SEQ ID NO: 3190146 - protein, 20 aa, Giardia lamblia
KSVFSQFGVIKFIDFQPGAE

SEQ ID NO: 3190147 - protein, 20 aa, Giardia lamblia
KSVFVVPISQALFSKRYGIA

SEQ ID NO: 3190148 - protein, 23 aa, Giardia lamblia
KSVGCTEMRFRRGPKAYNLVKSM

SEQ ID NO: 3190149 - protein, 27 aa, Giardia lamblia
KSVGDRLLLSGYFRDDPPNIALSADNS

SEQ ID NO: 3190150 - protein, 20 aa, Giardia lamblia
KSVLPLLYPDQEDPHFEGFD

SEQ ID NO: 3190151 - protein, 21 aa, Giardia lamblia
KSVYPIFVADFSDVMSSLQCK

SEQ ID NO: 3190152 - protein, 29 aa, Giardia lamblia
KSYLPLRAFKHPWFYISGDRLLLKEDAPY

SEQ ID NO: 3190153 - protein, 25 aa, Giardia lamblia
KTAHGFLYLAVDRYTYRPCVCKRLI

SEQ ID NO: 3190154 - protein, 20 aa, Giardia lamblia
KTAIFKYIIQRLNTDYLPTF

SEQ ID NO: 3190155 - protein, 24 aa, Giardia lamblia
KTAKSPLTSYIKSGPRSSSRSTSR

SEQ ID NO: 3190156 - protein, 25 aa, Giardia lamblia
KTCCVIGFPLGCMTTAAKISETREL

SEQ ID NO: 3190157 - protein, 18 aa, Giardia lamblia
KTCDSRHIVYTLCPRYLA

SEQ ID NO: 3190158 - protein, 19 aa, Giardia lamblia
KTCGQILSKELYNLVSNLR

SEQ ID NO: 3190159 - protein, 24 aa, Giardia lamblia
KTDGTRFLLYIPVDFNEPDMTLDL

SEQ ID NO: 3190160 - protein, 17 aa, Giardia lamblia
KTDHRVYRQNNVFLYNG

SEQ ID NO: 3190161 - protein, 21 aa, Giardia lamblia
KTDLDRFFKDKPVRLIEMGPR

SEQ ID NO: 3190162 - protein, 24 aa, Giardia lamblia
KTEKPLDRLFLSSTIDPPGGSDVP

SEQ ID NO: 3190163 - protein, 28 aa, Giardia lamblia
KTEKRFTQFWSFFADSYNDYLKLANVLH

SEQ ID NO: 3190164 - protein, 26 aa, Giardia lamblia
KTERKTEFCLLTPMATYDHIMSSLQD

SEQ ID NO: 3190165 - protein, 23 aa, Giardia lamblia
KTEYTYELPSVYIPSAGRVMSEY

SEQ ID NO: 3190166 - protein, 27 aa, Giardia lamblia
KTFENRYLPFLQLPDTRLKQIAASLDD

SEQ ID NO: 3190167 - protein, 20 aa, Giardia lamblia
KTFIILEGYSIFQAATDLKS

SEQ ID NO: 3190168 - protein, 19 aa, Giardia lamblia
KTFLPTIKKIQTASMLPTL

SEQ ID NO: 3190169 - protein, 32 aa, Giardia lamblia
KTFLYIPTSDGKCFFFLPKQTDLVFMGSIDSI

SEQ ID NO: 3190170 - protein, 19 aa, Giardia lamblia
KTFQKFLYDKKAVLDLPTL

SEQ ID NO: 3190171 - protein, 19 aa, Giardia lamblia
KTFRTLMKDAFWSLREAHQ

SEQ ID NO: 3190172 - protein, 21 aa, Giardia lamblia
KTGAFGIPLLERMILRGRDTY

SEQ ID NO: 3190173 - protein, 23 aa, Giardia lamblia
KTGKCSCYPLITKIISIKADENE

SEQ ID NO: 3190174 - protein, 31 aa, Giardia lamblia
KTGKRTEVILNKDLCELLNVLDIDHSSVSSK

SEQ ID NO: 3190175 - protein, 25 aa, Giardia lamblia
KTGYCEFRHCLPPGYVIEEKKKVEV

SEQ ID NO: 3190176 - protein, 25 aa, Giardia lamblia
KTGYKALNLCHFFTCGADEVRCWTV

SEQ ID NO: 3190177 - protein, 34 aa, Giardia lamblia
KTHEKQFWPFHKYGYYHLLHSLFEHFDDRVEPLK

SEQ ID NO: 3190178 - protein, 19 aa, Giardia lamblia
KTHPLLSPYVTKLCFEIGR

SEQ ID NO: 3190179 - protein, 21 aa, Giardia lamblia
KTIIHACPKLTYLDDRPVFDD

SEQ ID NO: 3190180 - protein, 34 aa, Giardia lamblia
KTINTLYALTRLPNLSFLSPFLSEEIKTTMRATL

SEQ ID NO: 3190181 - protein, 26 aa, Giardia lamblia
KTIRHVRYIFHPAFSLNKLDIDTPPF

SEQ ID NO: 3190182 - protein, 18 aa, Giardia lamblia
KTIRKDEYYYLLEMELCD

SEQ ID NO: 3190183 - protein, 20 aa, Giardia lamblia
KTITLPIETLPRLPQTKRTQ

SEQ ID NO: 3190184 - protein, 30 aa, Giardia lamblia
KTKDMSFLNFDRFYVLHPDVLNMISGAPED

SEQ ID NO: 3190185 - protein, 22 aa, Giardia lamblia
KTKEHALSKDLEFLKESADNLA

SEQ ID NO: 3190186 - protein, 17 aa, Giardia lamblia
KTKFSWTEAFRKKADAA

SEQ ID NO: 3190187 - protein, 24 aa, Giardia lamblia
KTKYGWTALMFATVQNYLNLVQLL

SEQ ID NO: 3190188 - protein, 21 aa, Giardia lamblia
KTLCFALPILQELSQDPYGIF

SEQ ID NO: 3190189 - protein, 17 aa, Giardia lamblia
KTLCMWLAEYGMPTLLR

SEQ ID NO: 3190190 - protein, 23 aa, Giardia lamblia
KTLDAQLFIKTLTTLFEYSPENV

SEQ ID NO: 3190191 - protein, 17 aa, Giardia lamblia
KTLLLLGVLSEPNGTEA

SEQ ID NO: 3190192 - protein, 17 aa, Giardia lamblia
KTLLSRIIATETGALVI

SEQ ID NO: 3190193 - protein, 25 aa, Giardia lamblia
KTLPDNGFVLLHTLLQLADIQSAEI

SEQ ID NO: 3190194 - protein, 17 aa, Giardia lamblia
KTLPFSENFIADSCSSV

SEQ ID NO: 3190195 - protein, 19 aa, Giardia lamblia
KTMSPGLFDGRARSYQPTS

SEQ ID NO: 3190196 - protein, 25 aa, Giardia lamblia
KTNKGFTALMFAARFGFDECVEILA

SEQ ID NO: 3190197 - protein, 19 aa, Giardia lamblia
KTPPRQPHLECRSKKLYEA

SEQ ID NO: 3190198 - protein, 19 aa, Giardia lamblia
KTPTTPVSIKRSSLRESFG

SEQ ID NO: 3190199 - protein, 28 aa, Giardia lamblia
KTQEKSLVKAIIPLITPVGTCLCMGTEF

SEQ ID NO: 3190200 - protein, 32 aa, Giardia lamblia
KTQIADFKLYMPLLVALRNPGMRKRHWYRISR

SEQ ID NO: 3190201 - protein, 19 aa, Giardia lamblia
KTQLLEMKDATLLVQHSAD

SEQ ID NO: 3190202 - protein, 17 aa, Giardia lamblia
KTQLREALLRISQLEAE

SEQ ID NO: 3190203 - protein, 25 aa, Giardia lamblia
KTRTLNAGALYWAVGHDPQTSFLKK

SEQ ID NO: 3190204 - protein, 24 aa, Giardia lamblia
KTSKFRSFNYRNAFIFKDEHTLQL

SEQ ID NO: 3190205 - protein, 29 aa, Giardia lamblia
KTSKLDYERLMSLITSYQQLRVEYKKHMK

SEQ ID NO: 3190206 - protein, 19 aa, Giardia lamblia
KTTEFFYDTAVRYRSICYN

SEQ ID NO: 3190207 - protein, 17 aa, Giardia lamblia
KTTFLLNSKTNELDVAM

SEQ ID NO: 3190208 - protein, 28 aa, Giardia lamblia
KTTHLSALFDCCIMALSSVGLCVVSQLS

SEQ ID NO: 3190209 - protein, 27 aa, Giardia lamblia
KTTSIAKLLYIFKNNGLRSLVCACDSF

SEQ ID NO: 3190210 - protein, 27 aa, Giardia lamblia
KTVAARKFLLFLLGPTERLAVDNEISI

SEQ ID NO: 3190211 - protein, 33 aa, Giardia lamblia
KTVESFYYPKYYAINKIRTHRLLNFIVKSELAQ

SEQ ID NO: 3190212 - protein, 23 aa, Giardia lamblia
KTVEVLLRILEPLVGLGTELGAG

SEQ ID NO: 3190213 - protein, 25 aa, Giardia lamblia
KTVHYIMEYYPHGDLGAYIRKRAQE

SEQ ID NO: 3190214 - protein, 27 aa, Giardia lamblia
KTVTQHGALQLLRWLRAPTTDLAVISY

SEQ ID NO: 3190215 - protein, 32 aa, Giardia lamblia
KTWDPAAILSARNMIWMLSRSMTFEQAKRCFE

SEQ ID NO: 3190216 - protein, 24 aa, Giardia lamblia
KTYHEFFFDRFISGSIGVCFGRVD

SEQ ID NO: 3190217 - protein, 18 aa, Giardia lamblia
KTYKEVIASGWYMRTGTA

SEQ ID NO: 3190218 - protein, 17 aa, Giardia lamblia
KTYKRSVLLLNKADLVP

SEQ ID NO: 3190219 - protein, 21 aa, Giardia lamblia
KTYSKVQLHLLRDSNPNYYTG

SEQ ID NO: 3190220 - protein, 19 aa, Giardia lamblia
KTYTALAFAILKRNDHVVS

SEQ ID NO: 3190221 - protein, 23 aa, Giardia lamblia
KTYVFLASTGAVPRKMLRPTDLV

SEQ ID NO: 3190222 - protein, 18 aa, Giardia lamblia
KVAANRLAFAQTGIFTEK

SEQ ID NO: 3190223 - protein, 22 aa, Giardia lamblia
KVAAYCKMLSTELPRKLKSKIA

SEQ ID NO: 3190224 - protein, 22 aa, Giardia lamblia
KVAIIDVISSDPTILRSCSATV

SEQ ID NO: 3190225 - protein, 18 aa, Giardia lamblia
KVARQPTEIWIDSLYYLT

SEQ ID NO: 3190226 - protein, 18 aa, Giardia lamblia
KVASYVPYRNNKLTMILQ

SEQ ID NO: 3190227 - protein, 22 aa, Giardia lamblia
KVDAWISILERFMRKRPYMRIG

SEQ ID NO: 3190228 - protein, 23 aa, Giardia lamblia
KVDERVLFAILNGCKERKQIANL

SEQ ID NO: 3190229 - protein, 28 aa, Giardia lamblia
KVDESGFFALLWAIVCNNPPCVSFLLPY

SEQ ID NO: 3190230 - protein, 21 aa, Giardia lamblia
KVDFPDQLKMCTYNMVYFGFY

SEQ ID NO: 3190231 - protein, 27 aa, Giardia lamblia
KVDITRLPAILDPYLKAETFNQFKQEV

SEQ ID NO: 3190232 - protein, 29 aa, Giardia lamblia
KVDSFLETFIPVYLPNLFSTGLLRDHIVE

SEQ ID NO: 3190233 - protein, 20 aa, Giardia lamblia
KVEELLKQRINNCLDELVAA

SEQ ID NO: 3190234 - protein, 17 aa, Giardia lamblia
KVEGRVIDFVAVVKEKD

SEQ ID NO: 3190235 - protein, 17 aa, Giardia lamblia
KVEPYLNRLTIPNSTTS

SEQ ID NO: 3190236 - protein, 20 aa, Giardia lamblia
KVFGRLKDRIANRKMYVLFE

SEQ ID NO: 3190237 - protein, 17 aa, Giardia lamblia
KVFVEHPEKFDPRDYLG

SEQ ID NO: 3190238 - protein, 17 aa, Giardia lamblia
KVFVRKIAEVFPRSAVL

SEQ ID NO: 3190239 - protein, 24 aa, Giardia lamblia
KVGGKRILIIPPHLGYGKKGSPPE

SEQ ID NO: 3190240 - protein, 29 aa, Giardia lamblia
KVHGDRSILELLLIFRNKKEANACQRCGC

SEQ ID NO: 3190241 - protein, 22 aa, Giardia lamblia
KVHRSMKMCPVHSLLSINDRGA

SEQ ID NO: 3190242 - protein, 25 aa, Giardia lamblia
KVHYLVACIFVFLRPDMNYNELKRN

SEQ ID NO: 3190243 - protein, 26 aa, Giardia lamblia
KVIGRTVIFAWRHAILDLRKERVADA

SEQ ID NO: 3190244 - protein, 27 aa, Giardia lamblia
KVIYIFTEFCNKGDLFQLIDKHRYPRT

SEQ ID NO: 3190245 - protein, 27 aa, Giardia lamblia
KVKQHLDRLQFLVQQLGLQLTSNASIE

SEQ ID NO: 3190246 - protein, 30 aa, Giardia lamblia
KVKSKCYAYLLYMRKRYEQITGWRFDMKSP

SEQ ID NO: 3190247 - protein, 34 aa, Giardia lamblia
KVKSNKVHFFSFDWNIPSFLTLPKITRQIDDDVR

SEQ ID NO: 3190248 - protein, 23 aa, Giardia lamblia
KVLAKLSNFFKRFSKHTSQARRV

SEQ ID NO: 3190249 - protein, 22 aa, Giardia lamblia
KVLDFFINPEYLDFRGHLQNIY

SEQ ID NO: 3190250 - protein, 20 aa, Giardia lamblia
KVLEYLLQYTFGINLEELLQ

SEQ ID NO: 3190251 - protein, 21 aa, Giardia lamblia
KVLGIPVFVTVPYCTPRLSLI

SEQ ID NO: 3190252 - protein, 19 aa, Giardia lamblia
KVLGRLIAIIHSKSGKPIF

SEQ ID NO: 3190253 - protein, 21 aa, Giardia lamblia
KVLLARLQAAYLSANNIQTFD

SEQ ID NO: 3190254 - protein, 17 aa, Giardia lamblia
KVLLIETIDKFIGWSSV

SEQ ID NO: 3190255 - protein, 26 aa, Giardia lamblia
KVLLNSFFPYFIELSEFLRSLVTFSP

SEQ ID NO: 3190256 - protein, 24 aa, Giardia lamblia
KVLQIDIFAICRLCTSLFCKRTGK

SEQ ID NO: 3190257 - protein, 24 aa, Giardia lamblia
KVLRGCVIYIPFLPNAADLVTEGP

SEQ ID NO: 3190258 - protein, 21 aa, Giardia lamblia
KVMISLEEFSYFMLCSTFTSK

SEQ ID NO: 3190259 - protein, 19 aa, Giardia lamblia
KVMKQSFKGTPRAIAWAPG

SEQ ID NO: 3190260 - protein, 18 aa, Giardia lamblia
KVMPHLCRLVAATKTPIT

SEQ ID NO: 3190261 - protein, 19 aa, Giardia lamblia
KVMRLVRDFVYALIERILS

SEQ ID NO: 3190262 - protein, 30 aa, Giardia lamblia
KVMRQGHSSIFLPSWINLANSTAAMAALER

SEQ ID NO: 3190263 - protein, 23 aa, Giardia lamblia
KVNALIFQFANWDRKQVALGALR

SEQ ID NO: 3190264 - protein, 24 aa, Giardia lamblia
KVNALLEQSLTYDYSFGSYAGDAD

SEQ ID NO: 3190265 - protein, 20 aa, Giardia lamblia
KVNQKYLKALDGALCRVLDK

SEQ ID NO: 3190266 - protein, 25 aa, Giardia lamblia
KVPAKRYHILTMKEKIAIALRNAEL

SEQ ID NO: 3190267 - protein, 20 aa, Giardia lamblia
KVPALRLNIAVRQYKMTRKD

SEQ ID NO: 3190268 - protein, 25 aa, Giardia lamblia
KVPDKKINLLINPDGLHLDSLEHNR

SEQ ID NO: 3190269 - protein, 18 aa, Giardia lamblia
KVPLAGCAIGPISKNTIQ

SEQ ID NO: 3190270 - protein, 18 aa, Giardia lamblia
KVPQVPQIPAIPPAPAFS

SEQ ID NO: 3190271 - protein, 23 aa, Giardia lamblia
KVQEKLLAIAQEKDTLIAQLTEA

SEQ ID NO: 3190272 - protein, 27 aa, Giardia lamblia
KVQNKLFTNRLLLLLSLDAEVVKRANN

SEQ ID NO: 3190273 - protein, 19 aa, Giardia lamblia
KVQQLLLATQVVRMILKID

SEQ ID NO: 3190274 - protein, 25 aa, Giardia lamblia
KVQRIRHSLHGLSFLLFESISELDR

SEQ ID NO: 3190275 - protein, 25 aa, Giardia lamblia
KVRFHKNFKVHFYGIGISGGEEGAL

SEQ ID NO: 3190276 - protein, 25 aa, Giardia lamblia
KVRLGDTLGRVFSKFSRMSDRFTIL

SEQ ID NO: 3190277 - protein, 24 aa, Giardia lamblia
KVRRVFFGFFETPETLRVLASYPP

SEQ ID NO: 3190278 - protein, 31 aa, Giardia lamblia
KVSEPIMILGESLFKGLDMNIKVAGGGHVSQ

SEQ ID NO: 3190279 - protein, 18 aa, Giardia lamblia
KVSLYPRFIAQYGEDRLS

SEQ ID NO: 3190280 - protein, 25 aa, Giardia lamblia
KVSNWNPLFLAALTHNSKDAREHLS

SEQ ID NO: 3190281 - protein, 24 aa, Giardia lamblia
KVSRIGELELTIIRLENKDMELAN

SEQ ID NO: 3190282 - protein, 29 aa, Giardia lamblia
KVSRLIRESAWRCYLKPFEAIEKVNKLLS

SEQ ID NO: 3190283 - protein, 26 aa, Giardia lamblia
KVTELSRMIALKDAEISLLRKQTTDG

SEQ ID NO: 3190284 - protein, 23 aa, Giardia lamblia
KVTFEELFFLDNIIRLKRKYTRA

SEQ ID NO: 3190285 - protein, 23 aa, Giardia lamblia
KVTGLRFLWLDDNRITHVAELSA

SEQ ID NO: 3190286 - protein, 23 aa, Giardia lamblia
KVTLCNPFYLNRSLAGDQVALAL

SEQ ID NO: 3190287 - protein, 17 aa, Giardia lamblia
KVTNMPITWSTVGMKKS

SEQ ID NO: 3190288 - protein, 28 aa, Giardia lamblia
KVTNYKAFPLLIPLVGAAASLHYRISVQ

SEQ ID NO: 3190289 - protein, 17 aa, Giardia lamblia
KVTYLLKKLHEGPAEDE

SEQ ID NO: 3190290 - protein, 20 aa, Giardia lamblia
KVVALIVLYKLRPATEESQS

SEQ ID NO: 3190291 - protein, 23 aa, Giardia lamblia
KVVGDLALFLLAKNLEPEVLRDK

SEQ ID NO: 3190292 - protein, 22 aa, Giardia lamblia
KVVIQTCCLPNLPLGHVGDVCH

SEQ ID NO: 3190293 - protein, 18 aa, Giardia lamblia
KVVLHKLFSPRSSSLVAA

SEQ ID NO: 3190294 - protein, 18 aa, Giardia lamblia
KVVPAYTVIFNKTLNRHS

SEQ ID NO: 3190295 - protein, 25 aa, Giardia lamblia
KVVPRLLYLCRSMESSYFINMIYVL

SEQ ID NO: 3190296 - protein, 19 aa, Giardia lamblia
KVVQQLLKLEGKLCDQRGW

SEQ ID NO: 3190297 - protein, 20 aa, Giardia lamblia
KVVTDNLILPYSAMKPYIIR

SEQ ID NO: 3190298 - protein, 29 aa, Giardia lamblia
KVVYVPRDPPPSFPARAALRFIATCFCYD

SEQ ID NO: 3190299 - protein, 24 aa, Giardia lamblia
KVYALLYQPLLQACLKGVPLFAHE

SEQ ID NO: 3190300 - protein, 23 aa, Giardia lamblia
KVYKALRKFNYLLRTCRFSMEIP

SEQ ID NO: 3190301 - protein, 29 aa, Giardia lamblia
KVYNRVAIVTRYFGGIPLGPARFKHINDC

SEQ ID NO: 3190302 - protein, 31 aa, Giardia lamblia
KWDNMDPTALRRSHLPYPMQAQMLTKETEHQ

SEQ ID NO: 3190303 - protein, 18 aa, Giardia lamblia
KWIPYTQVTLVPDDSKML

SEQ ID NO: 3190304 - protein, 20 aa, Giardia lamblia
KWITYRPVNAPSESEPFFGG

SEQ ID NO: 3190305 - protein, 19 aa, Giardia lamblia
KWVLERPPSPAPELQPLLV

SEQ ID NO: 3190306 - protein, 17 aa, Giardia lamblia
KYALNDMANRKIATLTR

SEQ ID NO: 3190307 - protein, 24 aa, Giardia lamblia
KYALSGLGNLQLLQALNSAGVDCL

SEQ ID NO: 3190308 - protein, 23 aa, Giardia lamblia
KYAPTFNDLLIPLPQTVSFMSQE

SEQ ID NO: 3190309 - protein, 23 aa, Giardia lamblia
KYATPRYRFVVRRTNKDIICQVT

SEQ ID NO: 3190310 - protein, 21 aa, Giardia lamblia
KYDNLPIPRRDSAAGLMPSKG

SEQ ID NO: 3190311 - protein, 28 aa, Giardia lamblia
KYDQYMTYITTPTLLLRTMQNQQYIPRS

SEQ ID NO: 3190312 - protein, 24 aa, Giardia lamblia
KYELRFRWSDLTNTLILAVVNSKH

SEQ ID NO: 3190313 - protein, 30 aa, Giardia lamblia
KYENEDLIKYAWNGDIWFHVDKHSSAHVYL

SEQ ID NO: 3190314 - protein, 18 aa, Giardia lamblia
KYFAAVEAFSRLCFVRQL

SEQ ID NO: 3190315 - protein, 21 aa, Giardia lamblia
KYFNAQMKYGAFVKPLSVEVG

SEQ ID NO: 3190316 - protein, 18 aa, Giardia lamblia
KYGAPNVKISLPSKIAAP

SEQ ID NO: 3190317 - protein, 22 aa, Giardia lamblia
KYGGYIVWKPTALMICALLNHS

SEQ ID NO: 3190318 - protein, 22 aa, Giardia lamblia
KYGRLDVVTFLLEAESRIVTNT

SEQ ID NO: 3190319 - protein, 19 aa, Giardia lamblia
KYHAALFHELPPASAAALG

SEQ ID NO: 3190320 - protein, 20 aa, Giardia lamblia
KYIIQRLNTDYLPTFAADVT

SEQ ID NO: 3190321 - protein, 25 aa, Giardia lamblia
KYIKNPRILLLDCPLEYKKAQSMMN

SEQ ID NO: 3190322 - protein, 21 aa, Giardia lamblia
KYIQRYPPLKIMCHQADLFLW

SEQ ID NO: 3190323 - protein, 35 aa, Giardia lamblia
KYISNPLLVNGYKFDLRIYVLITSVDPLIMYIYNE

SEQ ID NO: 3190324 - protein, 19 aa, Giardia lamblia
KYKAKRNCWPVVRGVAMNP

SEQ ID NO: 3190325 - protein, 20 aa, Giardia lamblia
KYKFILTNLRIFKAEGTSER

SEQ ID NO: 3190326 - protein, 24 aa, Giardia lamblia
KYKFTSRFIKALLLTIQTFNGKMD

SEQ ID NO: 3190327 - protein, 29 aa, Giardia lamblia
KYLEQKRILFPRFYFLADSDVLEILSTGS

SEQ ID NO: 3190328 - protein, 20 aa, Giardia lamblia
KYLTKRFLYQDYQGVFRVLS

SEQ ID NO: 3190329 - protein, 21 aa, Giardia lamblia
KYNHQIFILRQQIETLTNEKD

SEQ ID NO: 3190330 - protein, 19 aa, Giardia lamblia
KYQDVVTRLAFELYVPLRP

SEQ ID NO: 3190331 - protein, 25 aa, Giardia lamblia
KYRDGTLPIIYGTDGSLHPSPRGTS

SEQ ID NO: 3190332 - protein, 19 aa, Giardia lamblia
KYREFLHAAFILGGVDNTG

SEQ ID NO: 3190333 - protein, 29 aa, Giardia lamblia
KYSPALRLMLLHLLLQRYFSLLKDSLNEH

SEQ ID NO: 3190334 - protein, 18 aa, Giardia lamblia
KYTGRTLVIGVRAIIYIT

SEQ ID NO: 3190335 - protein, 30 aa, Giardia lamblia
KYTIRDMQLLRNNNFYELLPEAQRDLLDSN

SEQ ID NO: 3190336 - protein, 33 aa, Giardia lamblia
KYTLKIGKRTLKFIPVPLLHWPDSTFTYCPEDK

SEQ ID NO: 3190337 - protein, 19 aa, Giardia lamblia
KYTPEALALVNELTANIAT

SEQ ID NO: 3190338 - protein, 21 aa, Giardia lamblia
KYTSNFLFVDLAGSERQSKTE

SEQ ID NO: 3190339 - protein, 24 aa, Giardia lamblia
KYVRRYYDLITPNTKFSSGAGIGF

SEQ ID NO: 3190340 - protein, 22 aa, Giardia lamblia
KYVTSFAPSLIYRVILQIDTSK

SEQ ID NO: 3190341 - protein, 20 aa, Giardia lamblia
KYVYVRLRFDSYEDCLYGTI

SEQ ID NO: 3190342 - protein, 23 aa, Giardia lamblia
KYYDPGSILIFLSGKREIERCID

SEQ ID NO: 3190343 - protein, 17 aa, Giardia lamblia
KYYLDVKATFIHDAFKS

SEQ ID NO: 3190344 - protein, 25 aa, Giardia lamblia
LAADIFLQTVRFLFSGLLEDSNFSE

SEQ ID NO: 3190345 - protein, 26 aa, Giardia lamblia
LAAEDLISLLLIKFTAIYKASQSICA

SEQ ID NO: 3190346 - protein, 27 aa, Giardia lamblia
LAAERDYFKIIRILLERESRMTTNKGV

SEQ ID NO: 3190347 - protein, 18 aa, Giardia lamblia
LAAIPQYLRAKSAIYIIK

SEQ ID NO: 3190348 - protein, 30 aa, Giardia lamblia
LAAKETQLQRLQWINKNLAAKLAAANPRIG

SEQ ID NO: 3190349 - protein, 24 aa, Giardia lamblia
LAAKYTAELLATLSAYQKHPVLLS

SEQ ID NO: 3190350 - protein, 19 aa, Giardia lamblia
LAALEFYINHPNGDSPLIY

SEQ ID NO: 3190351 - protein, 17 aa, Giardia lamblia
LAALFTLFHPGVIKYHQ

SEQ ID NO: 3190352 - protein, 21 aa, Giardia lamblia
LAALREYFILANKQLPNPQNI

SEQ ID NO: 3190353 - protein, 19 aa, Giardia lamblia
LAAMIGHEIPIPKDVLTAC

SEQ ID NO: 3190354 - protein, 22 aa, Giardia lamblia
LAANYWDYKFSSLQEKHQRLQS

SEQ ID NO: 3190355 - protein, 35 aa, Giardia lamblia
LAAPSFCESNFNRLLALVDSLKKDLFEISSYCPNI

SEQ ID NO: 3190356 - protein, 30 aa, Giardia lamblia
LAAQLLMKRSFKIWRYSSDSSTAILLTSLQ

SEQ ID NO: 3190357 - protein, 32 aa, Giardia lamblia
LAAREGYRQIASWLDNWLLTNKQIENASTLVT

SEQ ID NO: 3190358 - protein, 18 aa, Giardia lamblia
LAARFHHYSIRDSVASLF

SEQ ID NO: 3190359 - protein, 23 aa, Giardia lamblia
LAARQFLHELDALRSSWHFASNL

SEQ ID NO: 3190360 - protein, 27 aa, Giardia lamblia
LAASKSPLTVYDPLPRVVIGEGELWEK

SEQ ID NO: 3190361 - protein, 18 aa, Giardia lamblia
LAASMRLSSLHDNGYRSA

SEQ ID NO: 3190362 - protein, 19 aa, Giardia lamblia
LAASWKYYLDVKATFIHDA

SEQ ID NO: 3190363 - protein, 28 aa, Giardia lamblia
LAATYPNKVLCLLSWFFDCSKYSHIQQS

SEQ ID NO: 3190364 - protein, 19 aa, Giardia lamblia
LACLKKRWAWVLEAIHRSI

SEQ ID NO: 3190365 - protein, 25 aa, Giardia lamblia
LACLKNYDHFLDLLLEKEGDIADSM

SEQ ID NO: 3190366 - protein, 25 aa, Giardia lamblia
LACLQRLHKKYPYELEIVGFEERYG

SEQ ID NO: 3190367 - protein, 18 aa, Giardia lamblia
LACNISVQSILQYLEKVR

SEQ ID NO: 3190368 - protein, 22 aa, Giardia lamblia
LADGYAVHYFKHSHYMGAGQAS

SEQ ID NO: 3190369 - protein, 19 aa, Giardia lamblia
LADLEIRYEWAPLASAEQV

SEQ ID NO: 3190370 - protein, 19 aa, Giardia lamblia
LADPNHPLHRRDAQLAMTA

SEQ ID NO: 3190371 - protein, 24 aa, Giardia lamblia
LADSFGWTALMFAARAGHYDICEL

SEQ ID NO: 3190372 - protein, 30 aa, Giardia lamblia
LADSINLDLRTCIWMHWAQIQALGGQPEMA

SEQ ID NO: 3190373 - protein, 17 aa, Giardia lamblia
LADVVGFSEIPPCPVMD

SEQ ID NO: 3190374 - protein, 19 aa, Giardia lamblia
LADWFGQYILRSIMLVMCP

SEQ ID NO: 3190375 - protein, 22 aa, Giardia lamblia
LAELGKKFAKLNRERAKLSMDL

SEQ ID NO: 3190376 - protein, 18 aa, Giardia lamblia
LAELIFTEKLSPVSLSHA

SEQ ID NO: 3190377 - protein, 22 aa, Giardia lamblia
LAELLLNYRIISFKTSIDKQWL

SEQ ID NO: 3190378 - protein, 26 aa, Giardia lamblia
LAELSKFWISLGIPPGERDNAYMKVI

SEQ ID NO: 3190379 - protein, 20 aa, Giardia lamblia
LAENITAVRGLLHYARQINN

SEQ ID NO: 3190380 - protein, 34 aa, Giardia lamblia
LAESGHLCGFLGPTHLRALALFAQAQSLESTAVS

SEQ ID NO: 3190381 - protein, 26 aa, Giardia lamblia
LAESTRLREELREKDLLISELRSQSP

SEQ ID NO: 3190382 - protein, 27 aa, Giardia lamblia
LAETGPSFVLIPFQILSSVMCGDILWR

SEQ ID NO: 3190383 - protein, 36 aa, Giardia lamblia
LAETKWFANRPSQALIWLVTNIDNNRIRQLAAAGLQ

SEQ ID NO: 3190384 - protein, 24 aa, Giardia lamblia
LAEVDSTLPYRVLHGLSAWISDEG

SEQ ID NO: 3190385 - protein, 22 aa, Giardia lamblia
LAEVIHHFLPKLVELHNYQSTT

SEQ ID NO: 3190386 - protein, 19 aa, Giardia lamblia
LAEYDEETMKWAISPEKVD

SEQ ID NO: 3190387 - protein, 17 aa, Giardia lamblia
LAGLLRRQRRAGPFSED

SEQ ID NO: 3190388 - protein, 23 aa, Giardia lamblia
LAGLSYIHNWKNLDGLHSFPHGC

SEQ ID NO: 3190389 - protein, 19 aa, Giardia lamblia
LAGMAKGSGCDFIRSVLAP

SEQ ID NO: 3190390 - protein, 27 aa, Giardia lamblia
LAGNSPTKVLLPTAGRRVSGGYAQGGG

SEQ ID NO: 3190391 - protein, 24 aa, Giardia lamblia
LAGPWIIITSLYISDKLMLRNRAQ

SEQ ID NO: 3190392 - protein, 17 aa, Giardia lamblia
LAGRPWPGLTNKIFSST

SEQ ID NO: 3190393 - protein, 25 aa, Giardia lamblia
LAGTLFSFLSLVASYSCCYSRRLII

SEQ ID NO: 3190394 - protein, 29 aa, Giardia lamblia
LAGYIFLSKHALLAPLYFASTVSLELFAN

SEQ ID NO: 3190395 - protein, 34 aa, Giardia lamblia
LAHETMAYFIGRTYLFLLKLGLDPARLRFRQHLP

SEQ ID NO: 3190396 - protein, 18 aa, Giardia lamblia
LAHILLNVLASHSAYAFV

SEQ ID NO: 3190397 - protein, 17 aa, Giardia lamblia
LAHLFFDMEPPLTSTEV

SEQ ID NO: 3190398 - protein, 17 aa, Giardia lamblia
LAHLFLTYVGRKDPQAL

SEQ ID NO: 3190399 - protein, 20 aa, Giardia lamblia
LAHLQSLRRELDITMGQCQS

SEQ ID NO: 3190400 - protein, 30 aa, Giardia lamblia
LAIDTSILELYIEAQLRFGADFQMLMFMSS

SEQ ID NO: 3190401 - protein, 28 aa, Giardia lamblia
LAIDTVFVLAKRKLAYIVTPDFGDCSLA

SEQ ID NO: 3190402 - protein, 25 aa, Giardia lamblia
LAIKTSSRLLLYRLQDPALKKRNIE

SEQ ID NO: 3190403 - protein, 23 aa, Giardia lamblia
LAILIRFEALHYLNNSTQTIFMQ

SEQ ID NO: 3190404 - protein, 36 aa, Giardia lamblia
LAIPDTPRYVIPFFSLIDAVHCPPIFAPRGKVRLQS

SEQ ID NO: 3190405 - protein, 18 aa, Giardia lamblia
LAIQLLERYRANLLAYAA

SEQ ID NO: 3190406 - protein, 17 aa, Giardia lamblia
LAISKILCRRIAGCQGT

SEQ ID NO: 3190407 - protein, 21 aa, Giardia lamblia
LAIWADFVLVPLILTGKIDEA

SEQ ID NO: 3190408 - protein, 30 aa, Giardia lamblia
LAKERPVKPLLWLGQWFLSNNRKKPLLQAP

SEQ ID NO: 3190409 - protein, 18 aa, Giardia lamblia
LAKFVANSINYEPLEHPH

SEQ ID NO: 3190410 - protein, 23 aa, Giardia lamblia
LAKGRLEMIASLRYSKNGRAVTD

SEQ ID NO: 3190411 - protein, 26 aa, Giardia lamblia
LAKIQVVIEWLLSYGRYEVLSDTDMS

SEQ ID NO: 3190412 - protein, 26 aa, Giardia lamblia
LAKNPKLDKLTLFSSLQDLIADCNEK

SEQ ID NO: 3190413 - protein, 24 aa, Giardia lamblia
LAKRKHFPSVDWLISYSRCTETLA

SEQ ID NO: 3190414 - protein, 25 aa, Giardia lamblia
LAKRVRRLLTLQHRSALSQRAWEEE

SEQ ID NO: 3190415 - protein, 18 aa, Giardia lamblia
LAKSKLLQYVAKISPRSV

SEQ ID NO: 3190416 - protein, 25 aa, Giardia lamblia
LAKVKAFMYAQVWGILHHRELNEVD

SEQ ID NO: 3190417 - protein, 20 aa, Giardia lamblia
LAKVLAYNKCYWNGTYLRVQ

SEQ ID NO: 3190418 - protein, 30 aa, Giardia lamblia
LALAPINELTAAITAFVQRIQKEFSQSLST

SEQ ID NO: 3190419 - protein, 28 aa, Giardia lamblia
LALAYETIKKIRYLIRIPRSISNVYNMI

SEQ ID NO: 3190420 - protein, 18 aa, Giardia lamblia
LALGINVPLSILQKTRNL

SEQ ID NO: 3190421 - protein, 17 aa, Giardia lamblia
LALLNYISHDCIAPEYM

SEQ ID NO: 3190422 - protein, 20 aa, Giardia lamblia
LALPAAERSLIFAKAVHGDN

SEQ ID NO: 3190423 - protein, 18 aa, Giardia lamblia
LALPVFHPGLINDARTML

SEQ ID NO: 3190424 - protein, 23 aa, Giardia lamblia
LALRQTFGVQKWPETASSIPEKV

SEQ ID NO: 3190425 - protein, 17 aa, Giardia lamblia
LALTPRAKYGLGLVLPH

SEQ ID NO: 3190426 - protein, 17 aa, Giardia lamblia
LALVRPEILRTKVSEPI

SEQ ID NO: 3190427 - protein, 17 aa, Giardia lamblia
LAMAEFLDANLSLLPLP

SEQ ID NO: 3190428 - protein, 31 aa, Giardia lamblia
LAMDYRTRQYGWILIGLPLGMLPEDVFGRPA

SEQ ID NO: 3190429 - protein, 19 aa, Giardia lamblia
LAMPLTTVKSIWQTYRREG

SEQ ID NO: 3190430 - protein, 21 aa, Giardia lamblia
LANCLIYLHDPINGVHGSLFP

SEQ ID NO: 3190431 - protein, 25 aa, Giardia lamblia
LANFPNLRILYLQGNRIQDVRDLAP

SEQ ID NO: 3190432 - protein, 22 aa, Giardia lamblia
LANFPPSFSFYDSIPCLYGSQE

SEQ ID NO: 3190433 - protein, 18 aa, Giardia lamblia
LANILIDFLLEYATTPVE

SEQ ID NO: 3190434 - protein, 21 aa, Giardia lamblia
LANLRFLELSFTLLNDPISVL

SEQ ID NO: 3190435 - protein, 20 aa, Giardia lamblia
LANRLKPYILRRLKSDVERS

SEQ ID NO: 3190436 - protein, 19 aa, Giardia lamblia
LANRQPYIHYCRRCVCSEC

SEQ ID NO: 3190437 - protein, 19 aa, Giardia lamblia
LAPCRSRLQHRLALRLEQL

SEQ ID NO: 3190438 - protein, 25 aa, Giardia lamblia
LAPDRAFLELLQKDSTLTTTCGSVK

SEQ ID NO: 3190439 - protein, 17 aa, Giardia lamblia
LAPNQILNKLRLYVKSP

SEQ ID NO: 3190440 - protein, 26 aa, Giardia lamblia
LAPSPVAMPPVLDFRSFDTGFPDFSS

SEQ ID NO: 3190441 - protein, 19 aa, Giardia lamblia
LAQINAILNGLPALFDEEA

SEQ ID NO: 3190442 - protein, 43 aa, Giardia lamblia
LAQKRLYFRSNPGYVYCYWDHCSPRLRRLFQPPHYFRDHYSRH

SEQ ID NO: 3190443 - protein, 19 aa, Giardia lamblia
LAQLVIMQSLQDLSDYSYT

SEQ ID NO: 3190444 - protein, 25 aa, Giardia lamblia
LAQSIAISNGIAFLVGARLIEYHDF

SEQ ID NO: 3190445 - protein, 19 aa, Giardia lamblia
LAQYDFCSLVAELLYLVTE

SEQ ID NO: 3190446 - protein, 17 aa, Giardia lamblia
LARILNLERKGLASSYL

SEQ ID NO: 3190447 - protein, 20 aa, Giardia lamblia
LARRAMQRKGIDIGSPSLSH

SEQ ID NO: 3190448 - protein, 24 aa, Giardia lamblia
LARRNACVLVLLNSTFQQDFIAVT

SEQ ID NO: 3190449 - protein, 21 aa, Giardia lamblia
LASALWYIHSKGLIHRDLKSQ

SEQ ID NO: 3190450 - protein, 24 aa, Giardia lamblia
LASDLFLKPFVISLTRIMSDTERM

SEQ ID NO: 3190451 - protein, 21 aa, Giardia lamblia
LASERAFLLSTWIHVTKLAQG

SEQ ID NO: 3190452 - protein, 24 aa, Giardia lamblia
LASFDLIKAIYKYGFEIPSPVQQY

SEQ ID NO: 3190453 - protein, 22 aa, Giardia lamblia
LASGALVLNLQQLPRSVCAYEP

SEQ ID NO: 3190454 - protein, 20 aa, Giardia lamblia
LASILRRKTFERRWNPLRKR

SEQ ID NO: 3190455 - protein, 19 aa, Giardia lamblia
LASKRKVHVTPAGYLSLVR

SEQ ID NO: 3190456 - protein, 29 aa, Giardia lamblia
LASLFISDKIRFPCLFPSATRVDPSDPRR

SEQ ID NO: 3190457 - protein, 17 aa, Giardia lamblia
LASRFTYVSSKSGVIQI

SEQ ID NO: 3190458 - protein, 22 aa, Giardia lamblia
LASRLFSRSFFEANACFLTGLT

SEQ ID NO: 3190459 - protein, 27 aa, Giardia lamblia
LASSKNCIFYFLVQNYGPVSAARIMLR

SEQ ID NO: 3190460 - protein, 45 aa, Giardia lamblia
LASVALLRLFFRMHHIPFSVYPTYTDFHLLSLLKTLSQMTSLKAE

SEQ ID NO: 3190461 - protein, 44 aa, Giardia lamblia
LATEFLRMHGTFITKIFRSADHDALLYVLRQLFEKVEITKPRAS

SEQ ID NO: 3190462 - protein, 30 aa, Giardia lamblia
LATPIKKRTFVPSPPPLTKPHLLEKGRNLY

SEQ ID NO: 3190463 - protein, 29 aa, Giardia lamblia
LATSFILLDTPHYILRDLKNILLQSKQPL

SEQ ID NO: 3190464 - protein, 25 aa, Giardia lamblia
LAVETGVWPVFRYNPSKPIGDRMKL

SEQ ID NO: 3190465 - protein, 29 aa, Giardia lamblia
LAVIEDNVNVIPYLLNELGIVNKKGYTAL

SEQ ID NO: 3190466 - protein, 19 aa, Giardia lamblia
LAVKHRFTDVVKQLVQWEG

SEQ ID NO: 3190467 - protein, 18 aa, Giardia lamblia
LAVKKNNYRLARLLARWE

SEQ ID NO: 3190468 - protein, 29 aa, Giardia lamblia
LAVKMRSIEVVRILKLKSLRIAMRCGYTA

SEQ ID NO: 3190469 - protein, 23 aa, Giardia lamblia
LAVKWNEFLSKRNGAYYWEDDPL

SEQ ID NO: 3190470 - protein, 30 aa, Giardia lamblia
LAVLCRLNYSFGFVLLPYTTQALNAVLVDL

SEQ ID NO: 3190471 - protein, 17 aa, Giardia lamblia
LAVMPPASAALLPPVMR

SEQ ID NO: 3190472 - protein, 24 aa, Giardia lamblia
LAVPYFKIQHLSTPLLIQLSQNPA

SEQ ID NO: 3190473 - protein, 24 aa, Giardia lamblia
LAVRLEALGIIRLIVVSDGALLED

SEQ ID NO: 3190474 - protein, 18 aa, Giardia lamblia
LAYNLAAARQLKVPRKAF

SEQ ID NO: 3190475 - protein, 30 aa, Giardia lamblia
LAYVRDNFSVNFWFVKFKQLVDTGKEEAIL

SEQ ID NO: 3190476 - protein, 24 aa, Giardia lamblia
LCADATLVFPLLLHETILKKYKED

SEQ ID NO: 3190477 - protein, 37 aa, Giardia lamblia
LCALYDNTVRIYFLDTLRFKLVLYGHSMPITSMALSS

SEQ ID NO: 3190478 - protein, 18 aa, Giardia lamblia
LCANAMYGSLGYQYGRFY

SEQ ID NO: 3190479 - protein, 18 aa, Giardia lamblia
LCAPLNRMISIVRNTEIN

SEQ ID NO: 3190480 - protein, 26 aa, Giardia lamblia
LCCKDLTKSFPFKCPMINTSNAKTTR

SEQ ID NO: 3190481 - protein, 18 aa, Giardia lamblia
LCCQIDFSVQRITKLEFL

SEQ ID NO: 3190482 - protein, 20 aa, Giardia lamblia
LCCRYCGRRWFKHDIQVHEK

SEQ ID NO: 3190483 - protein, 23 aa, Giardia lamblia
LCDPSPERLLKPRKIKSTGNIHW

SEQ ID NO: 3190484 - protein, 24 aa, Giardia lamblia
LCDPTLYDPQNPLIARPIFQPKQS

SEQ ID NO: 3190485 - protein, 34 aa, Giardia lamblia
LCDTYHKMSVQLVNLWYQLPPSKNPINVVELLSK

SEQ ID NO: 3190486 - protein, 17 aa, Giardia lamblia
LCEFEQLMYILQHADLA

SEQ ID NO: 3190487 - protein, 17 aa, Giardia lamblia
LCELREKPLSVAPSDQS

SEQ ID NO: 3190488 - protein, 22 aa, Giardia lamblia
LCEPVASPLRMVLTQSISSPED

SEQ ID NO: 3190489 - protein, 20 aa, Giardia lamblia
LCEVVQLFDIQWATATLQQG

SEQ ID NO: 3190490 - protein, 17 aa, Giardia lamblia
LCFEIHHTEDYTIWVNY

SEQ ID NO: 3190491 - protein, 18 aa, Giardia lamblia
LCFGLRLAELLDWPHIFA

SEQ ID NO: 3190492 - protein, 18 aa, Giardia lamblia
LCGEAHVPQLLLSLENHV

SEQ ID NO: 3190493 - protein, 23 aa, Giardia lamblia
LCGKAERMKGALSLLLGADYSDD

SEQ ID NO: 3190494 - protein, 18 aa, Giardia lamblia
LCGLAALRYQVDLMLLAG

SEQ ID NO: 3190495 - protein, 18 aa, Giardia lamblia
LCGPVFDPYEKYFLMSVH

SEQ ID NO: 3190496 - protein, 18 aa, Giardia lamblia
LCGYPRRVTVATMEDGCV

SEQ ID NO: 3190497 - protein, 24 aa, Giardia lamblia
LCIKDMAGLLRPAHAAPLVARIKE

SEQ ID NO: 3190498 - protein, 17 aa, Giardia lamblia
LCIKQIPEHAIVLGIPG

SEQ ID NO: 3190499 - protein, 25 aa, Giardia lamblia
LCISRFFLHVYVEPLVSVMTEADIK

SEQ ID NO: 3190500 - protein, 18 aa, Giardia lamblia
LCITLRRSRLLSILCECI

SEQ ID NO: 3190501 - protein, 22 aa, Giardia lamblia
LCKLLAIYEKDVLLPNKRTPLM

SEQ ID NO: 3190502 - protein, 18 aa, Giardia lamblia
LCLKIINVPEKGITRIQK

SEQ ID NO: 3190503 - protein, 17 aa, Giardia lamblia
LCLLFNTKVFQVNFADH

SEQ ID NO: 3190504 - protein, 20 aa, Giardia lamblia
LCLTLLACNISVQSILQYLE

SEQ ID NO: 3190505 - protein, 18 aa, Giardia lamblia
LCLWEIRDSFQRLVQVQK

SEQ ID NO: 3190506 - protein, 27 aa, Giardia lamblia
LCMVDGLPWFDTYGPPSAYLAFRHTVK

SEQ ID NO: 3190507 - protein, 20 aa, Giardia lamblia
LCNMLLPYEDKSAYALCIYA

SEQ ID NO: 3190508 - protein, 27 aa, Giardia lamblia
LCNQFQEAPMSDWSLFKHKYDEELAAL

SEQ ID NO: 3190509 - protein, 24 aa, Giardia lamblia
LCNYAIIMSVALRRAASVLFVPHH

SEQ ID NO: 3190510 - protein, 31 aa, Giardia lamblia
LCPHDSLLQRAVLANLQLGFISEAHRYLRML

SEQ ID NO: 3190511 - protein, 31 aa, Giardia lamblia
LCQEGFTDAVYPFHIFYPVKQARAALSDEGI

SEQ ID NO: 3190512 - protein, 26 aa, Giardia lamblia
LCQVQQYFAQYLLYTTSQCEAYLREL

SEQ ID NO: 3190513 - protein, 17 aa, Giardia lamblia
LCSPPQSPYLCAIECER

SEQ ID NO: 3190514 - protein, 19 aa, Giardia lamblia
LCSTDHMDFVFKGVSYKKQ

SEQ ID NO: 3190515 - protein, 30 aa, Giardia lamblia
LCTEEIVLRIFNIAPMRFNTMRLALMYEMI

SEQ ID NO: 3190516 - protein, 26 aa, Giardia lamblia
LCTLESTLLSRLLSTEAYLTARAKVA

SEQ ID NO: 3190517 - protein, 23 aa, Giardia lamblia
LCTLVNDIPITNLLPVSANELAP

SEQ ID NO: 3190518 - protein, 35 aa, Giardia lamblia
LCVFQHVSHPHVLEYFWALQANDFVYLSMWHYHES

SEQ ID NO: 3190519 - protein, 26 aa, Giardia lamblia
LCVSPDGMRFLALTPFGALEYTRETT

SEQ ID NO: 3190520 - protein, 18 aa, Giardia lamblia
LCWCVWQTDRERGKRRVR

SEQ ID NO: 3190521 - protein, 18 aa, Giardia lamblia
LDAALLKALNLKVSSTVG

SEQ ID NO: 3190522 - protein, 21 aa, Giardia lamblia
LDAFQILYYQEKDLKMHSGLS

SEQ ID NO: 3190523 - protein, 25 aa, Giardia lamblia
LDAKQIEIVALQEALRDAKDKCNVL

SEQ ID NO: 3190524 - protein, 25 aa, Giardia lamblia
LDALDVTLPSLWFTTVHSSKLPRTS

SEQ ID NO: 3190525 - protein, 17 aa, Giardia lamblia
LDALRHGLQTEINSLEA

SEQ ID NO: 3190526 - protein, 26 aa, Giardia lamblia
LDANPYPLDGLYTAEGAPRQQRILTR

SEQ ID NO: 3190527 - protein, 25 aa, Giardia lamblia
LDARSLLQTLQPVPLIGLKAVENTA

SEQ ID NO: 3190528 - protein, 25 aa, Giardia lamblia
LDAYIDCCLIITPAPLTFAVETRYL

SEQ ID NO: 3190529 - protein, 32 aa, Giardia lamblia
LDCKRIPMTSAWLYTPSLLIKPDPDPSTIGKY

SEQ ID NO: 3190530 - protein, 19 aa, Giardia lamblia
LDCKSFYTDIFTSELYALV

SEQ ID NO: 3190531 - protein, 19 aa, Giardia lamblia
LDCPVLTGFSLYDDIYMCR

SEQ ID NO: 3190532 - protein, 18 aa, Giardia lamblia
LDCQKEIDRLLRINSQLN

SEQ ID NO: 3190533 - protein, 18 aa, Giardia lamblia
LDCRVETLNFISDLVELV

SEQ ID NO: 3190534 - protein, 27 aa, Giardia lamblia
LDCVKQLIPWEAWVLNEYNRLPSTVIN

SEQ ID NO: 3190535 - protein, 19 aa, Giardia lamblia
LDCVPLLVEKLSGKTISFG

SEQ ID NO: 3190536 - protein, 41 aa, Giardia lamblia
LDDHVFKCLPLFTSQRSWLMADRWWTKNISALIFTYEGGSY

SEQ ID NO: 3190537 - protein, 25 aa, Giardia lamblia
LDDINHRIVFFKQQFLACSNKLLYN

SEQ ID NO: 3190538 - protein, 27 aa, Giardia lamblia
LDDKDKPLNPLFQYYLEAVVSFSNILS

SEQ ID NO: 3190539 - protein, 17 aa, Giardia lamblia
LDDLIVDDALIGTMTAK

SEQ ID NO: 3190540 - protein, 19 aa, Giardia lamblia
LDDLLLKHESLKTDNELLV

SEQ ID NO: 3190541 - protein, 17 aa, Giardia lamblia
LDDPFNKRPPDTALPTL

SEQ ID NO: 3190542 - protein, 30 aa, Giardia lamblia
LDDRSKRLFSLFRNVNLSALRSLSEYLNDV

SEQ ID NO: 3190543 - protein, 17 aa, Giardia lamblia
LDDYAELYKIRITIPEE

SEQ ID NO: 3190544 - protein, 35 aa, Giardia lamblia
LDDYTKIITKYLYDLKLYAMNQRILSYFPDDHVIW

SEQ ID NO: 3190545 - protein, 23 aa, Giardia lamblia
LDEAIAAAMNKKPRLPADESDTL

SEQ ID NO: 3190546 - protein, 20 aa, Giardia lamblia
LDEDYKPRILSLTCLKCISD

SEQ ID NO: 3190547 - protein, 19 aa, Giardia lamblia
LDEHLALKEKLTGKEAVSA

SEQ ID NO: 3190548 - protein, 30 aa, Giardia lamblia
LDEKTDIWSFGSLAVYMLTGAPPAFPPNLS

SEQ ID NO: 3190549 - protein, 25 aa, Giardia lamblia
LDELFFEMPKFLVPSQSLTVEFIWI

SEQ ID NO: 3190550 - protein, 25 aa, Giardia lamblia
LDELSMLKQQLYILRQAEHAARLSY

SEQ ID NO: 3190551 - protein, 26 aa, Giardia lamblia
LDEVDPSLYAILKAECMRLKQCLDFN

SEQ ID NO: 3190552 - protein, 25 aa, Giardia lamblia
LDEYKKLFRDIAGKASRYVKSEEHA

SEQ ID NO: 3190553 - protein, 17 aa, Giardia lamblia
LDGAFFNGPITPSTHSN

SEQ ID NO: 3190554 - protein, 25 aa, Giardia lamblia
LDGETALIRAIRWSRPEAVQELVKD

SEQ ID NO: 3190555 - protein, 28 aa, Giardia lamblia
LDGKLTTRYLRVLRNNKPSVIHLIMEYC

SEQ ID NO: 3190556 - protein, 21 aa, Giardia lamblia
LDGRLRGFAFVQYATEKEAEV

SEQ ID NO: 3190557 - protein, 19 aa, Giardia lamblia
LDHGKAFRYRELYSLLSCM

SEQ ID NO: 3190558 - protein, 25 aa, Giardia lamblia
LDHHKFFTQMFPAEPKQLFDLGMHV

SEQ ID NO: 3190559 - protein, 17 aa, Giardia lamblia
LDHIFYESSLATDALST

SEQ ID NO: 3190560 - protein, 27 aa, Giardia lamblia
LDHTYCAAFLLAKRAKLNYTHGYTMLM

SEQ ID NO: 3190561 - protein, 17 aa, Giardia lamblia
LDIASRESKLLYYSLCE

SEQ ID NO: 3190562 - protein, 17 aa, Giardia lamblia
LDIAVMNNDLAFVTSLI

SEQ ID NO: 3190563 - protein, 21 aa, Giardia lamblia
LDILLTMEVDYLPDAPHLTED

SEQ ID NO: 3190564 - protein, 18 aa, Giardia lamblia
LDILRAVHEFSHRSAWYF

SEQ ID NO: 3190565 - protein, 28 aa, Giardia lamblia
LDIMGDQLLLEWFVDNYKNYGASLEFIT

SEQ ID NO: 3190566 - protein, 25 aa, Giardia lamblia
LDIPDDLRKLAPPESILKCHYMDEA

SEQ ID NO: 3190567 - protein, 29 aa, Giardia lamblia
LDIYKDLLFQPPKSLLRLAKTAYHPNTNA

SEQ ID NO: 3190568 - protein, 18 aa, Giardia lamblia
LDIYTLKEDFKSLQEKSH

SEQ ID NO: 3190569 - protein, 17 aa, Giardia lamblia
LDKATIYERIEYIYLVS

SEQ ID NO: 3190570 - protein, 21 aa, Giardia lamblia
LDKAYTLEFAKAYYAYSRLKV

SEQ ID NO: 3190571 - protein, 21 aa, Giardia lamblia
LDKDMQIQELLAIISQLNKSN

SEQ ID NO: 3190572 - protein, 17 aa, Giardia lamblia
LDKLLCYLNTIPSIQEM

SEQ ID NO: 3190573 - protein, 24 aa, Giardia lamblia
LDKQQKLFDWAYDSLQFTQGTTNI

SEQ ID NO: 3190574 - protein, 23 aa, Giardia lamblia
LDLKLLFRFQGLSQRTYEAGYQV

SEQ ID NO: 3190575 - protein, 19 aa, Giardia lamblia
LDLLARPLVLIQGGDGWSY

SEQ ID NO: 3190576 - protein, 19 aa, Giardia lamblia
LDLREFRPALRGNSGVLLA

SEQ ID NO: 3190577 - protein, 22 aa, Giardia lamblia
LDLRSRMWKRMHEWRIFEDRLM

SEQ ID NO: 3190578 - protein, 24 aa, Giardia lamblia
LDNGSVYTLLAKLIAKKLNSDDLS

SEQ ID NO: 3190579 - protein, 20 aa, Giardia lamblia
LDNRMIKLKQLLLEKKLQEA

SEQ ID NO: 3190580 - protein, 28 aa, Giardia lamblia
LDPESTEFVWLPNKKLPFHPKALTIQAY

SEQ ID NO: 3190581 - protein, 23 aa, Giardia lamblia
LDPPPIYEDGLISRVSHAFTRRP

SEQ ID NO: 3190582 - protein, 25 aa, Giardia lamblia
LDPSNYGLIEKLFVSDLSRSPSIFN

SEQ ID NO: 3190583 - protein, 20 aa, Giardia lamblia
LDQHLAMTQLASDAFNPLPS

SEQ ID NO: 3190584 - protein, 23 aa, Giardia lamblia
LDQHTYKWIFFGGKGGVGKTTTS

SEQ ID NO: 3190585 - protein, 21 aa, Giardia lamblia
LDQLDIVRVLLPYEAGAQTSK

SEQ ID NO: 3190586 - protein, 24 aa, Giardia lamblia
LDQRIYNMKLFKTYQARILVATDL

SEQ ID NO: 3190587 - protein, 17 aa, Giardia lamblia
LDRDKYSFALEPELRKL

SEQ ID NO: 3190588 - protein, 29 aa, Giardia lamblia
LDRDNVMCPYLYETYKYALNDMANRKIAT

SEQ ID NO: 3190589 - protein, 25 aa, Giardia lamblia
LDRGQDFLRAITLGFEVQDALAFLK

SEQ ID NO: 3190590 - protein, 28 aa, Giardia lamblia
LDRNNQYWWFCDKLGLRKPELYDFSRLR

SEQ ID NO: 3190591 - protein, 17 aa, Giardia lamblia
LDRVPISLLPVTVDRPT

SEQ ID NO: 3190592 - protein, 31 aa, Giardia lamblia
LDSCNPLLQMFYLNPYIFYRNGRVYSLDASS

SEQ ID NO: 3190593 - protein, 17 aa, Giardia lamblia
LDSFTLFQNPVVVDYPD

SEQ ID NO: 3190594 - protein, 20 aa, Giardia lamblia
LDSIIRAQIERRLSASLTVQ

SEQ ID NO: 3190595 - protein, 23 aa, Giardia lamblia
LDSKFFNMLVNAADIWVSTDYRA

SEQ ID NO: 3190596 - protein, 33 aa, Giardia lamblia; identical to SEQ ID NO: 3161164

SEQ ID NO: 3190597 - protein, 31 aa, Giardia lamblia
LDSLPLSHRMIINLIFRVKASDLPIVHLAAS

SEQ ID NO: 3190598 - protein, 32 aa, Giardia lamblia
LDSLSPGIYFVRTFLYIFSLDERIRDVTRSFC

SEQ ID NO: 3190599 - protein, 30 aa, Giardia lamblia
LDSLYDARVPSRWLNVSWPASTLGFWLSDV

SEQ ID NO: 3190600 - protein, 18 aa, Giardia lamblia
LDSQAETILLRVSQYITS

SEQ ID NO: 3190601 - protein, 17 aa, Giardia lamblia
LDSVRTLLSDHKILLPC

SEQ ID NO: 3190602 - protein, 26 aa, Giardia lamblia
LDSVVAHTFRYILRVIKQCGVEEKER

SEQ ID NO: 3190603 - protein, 24 aa, Giardia lamblia
LDSYVDDGFLLDKRIGLSCPKEIS

SEQ ID NO: 3190604 - protein, 22 aa, Giardia lamblia
LDTALRELDFFNANRSFYDVHI

SEQ ID NO: 3190605 - protein, 23 aa, Giardia lamblia
LDTAYLLSIRMDLDAAFSSCLQK

SEQ ID NO: 3190606 - protein, 25 aa, Giardia lamblia
LDTGMPLDYSLIAPGQVFSSNSGQP

SEQ ID NO: 3190607 - protein, 21 aa, Giardia lamblia
LDTIQRFPYAKAFLDLNEELL

SEQ ID NO: 3190608 - protein, 26 aa, Giardia lamblia
LDTKFQRPITAKYLPTAGESLAENNE

SEQ ID NO: 3190609 - protein, 25 aa, Giardia lamblia
LDTLLRHIILLNRSQDLAEGAFPVL

SEQ ID NO: 3190610 - protein, 22 aa, Giardia lamblia
LDTLMLVFEIYSGPTCVSTVGL

SEQ ID NO: 3190611 - protein, 26 aa, Giardia lamblia
LDTRGFNWAVCRFPDAVYFQNIARGT

SEQ ID NO: 3190612 - protein, 23 aa, Giardia lamblia
LDTVAEIIFRTKYPMIKYENIAT

SEQ ID NO: 3190613 - protein, 18 aa, Giardia lamblia
LDTYFAMIYMDCTRINDI

SEQ ID NO: 3190614 - protein, 22 aa, Giardia lamblia
LDVERLPIYINPRRLSTLTNYL

SEQ ID NO: 3190615 - protein, 27 aa, Giardia lamblia
LDVIEKLFMGPWSKSASFLRLCSQFIE

SEQ ID NO: 3190616 - protein, 21 aa, Giardia lamblia
LDVLKFMLDKVPSVTPKMLHS

SEQ ID NO: 3190617 - protein, 19 aa, Giardia lamblia
LDVMPLLSHPHIVNYKAVV

SEQ ID NO: 3190618 - protein, 26 aa, Giardia lamblia
LDVNPRIISILRRYKPSLTSVSRSAT

SEQ ID NO: 3190619 - protein, 23 aa, Giardia lamblia
LDVSLLGAILLTKGKLVLAGDPN

SEQ ID NO: 3190620 - protein, 20 aa, Giardia lamblia
LDWSVARRIVKGKMPFISSQ

SEQ ID NO: 3190621 - protein, 21 aa, Giardia lamblia
LDYIVSLNIFLSTSLSDSEEA

SEQ ID NO: 3190622 - protein, 22 aa, Giardia lamblia
LDYSVNPLLTEPVIPLSLAVDT

SEQ ID NO: 3190623 - protein, 21 aa, Giardia lamblia
LDYVELLDFIRENGLLHGHQS

SEQ ID NO: 3190624 - protein, 29 aa, Giardia lamblia
LEADYLDNNGFYKFTLEPIDHFVDVFLIK

SEQ ID NO: 3190625 - protein, 30 aa, Giardia lamblia
LEAEATPITIPFKPMKPAYTRLAARQAMHM

SEQ ID NO: 3190626 - protein, 23 aa, Giardia lamblia
LEAGLNCVGGLFAIAHAIKTNNL

SEQ ID NO: 3190627 - protein, 21 aa, Giardia lamblia
LEAIITQLRTLKTDDENALVC

SEQ ID NO: 3190628 - protein, 17 aa, Giardia lamblia
LEAIKLLREAELKCVDT

SEQ ID NO: 3190629 - protein, 29 aa, Giardia lamblia
LEAKRQAFPRFYFLSDAELLSILSQTRDP

SEQ ID NO: 3190630 - protein, 21 aa, Giardia lamblia
LEAKRYCCHGKTALMYASEAN

SEQ ID NO: 3190631 - protein, 18 aa, Giardia lamblia
LEALAFLHTPNAALNKPA

SEQ ID NO: 3190632 - protein, 31 aa, Giardia lamblia
LEALKAVLLLPYAVYSRKLKAIILGVAHYLS

SEQ ID NO: 3190633 - protein, 27 aa, Giardia lamblia
LEALKKIRLPLIITTYSKKLVNLVSSM

SEQ ID NO: 3190634 - protein, 19 aa, Giardia lamblia
LEALLRQIFCPSSSLRLPQ

SEQ ID NO: 3190635 - protein, 23 aa, Giardia lamblia
LEARIRQLEMRLVTLHDQSSVVL

SEQ ID NO: 3190636 - protein, 28 aa, Giardia lamblia
LEATFAPTFFRVIQLFSLLPERLNYMMN

SEQ ID NO: 3190637 - protein, 17 aa, Giardia lamblia
LECAQILIPYEVGLTTD

SEQ ID NO: 3190638 - protein, 22 aa, Giardia lamblia
LECLKILMPREYELVQASGKTV

SEQ ID NO: 3190639 - protein, 18 aa, Giardia lamblia
LECMYYSYPFMKDVPHDA

SEQ ID NO: 3190640 - protein, 19 aa, Giardia lamblia
LECSLKMCPTPLAAQRLIL

SEQ ID NO: 3190641 - protein, 21 aa, Giardia lamblia
LECVKLLYLREYPVLIRNNFN

SEQ ID NO: 3190642 - protein, 33 aa, Giardia lamblia
LEDAQLFSFFSKLCLWCVRLLDCLISQIFKPDG

SEQ ID NO: 3190643 - protein, 32 aa, Giardia lamblia
LEDARQKRIFLPPVFLTLLLEITRYELHVMSR

SEQ ID NO: 3190644 - protein, 28 aa, Giardia lamblia
LEDDDFALLFYYRGRRMQCDFGRFGKYK

SEQ ID NO: 3190645 - protein, 25 aa, Giardia lamblia
LEDDYLQLRIFSRSLSKHNSPGVHL

SEQ ID NO: 3190646 - protein, 30 aa, Giardia lamblia
LEDFSFLKTENLHLINRTILFDGSIAASNP

SEQ ID NO: 3190647 - protein, 22 aa, Giardia lamblia
LEDHKLLLQALRLNDVAAIRTY

SEQ ID NO: 3190648 - protein, 25 aa, Giardia lamblia
LEDILDVFLLPILEIYKDPELIVRR

SEQ ID NO: 3190649 - protein, 25 aa, Giardia lamblia
LEDKQKIRAFLKERKARLIERQEKK

SEQ ID NO: 3190650 - protein, 23 aa, Giardia lamblia
LEDLLLPRRRISLREAGGFFYIS

SEQ ID NO: 3190651 - protein, 17 aa, Giardia lamblia
LEDLYISWSTALQRCQL

SEQ ID NO: 3190652 - protein, 17 aa, Giardia lamblia
LEDQLAQFLGHKDDPCL

SEQ ID NO: 3190653 - protein, 21 aa, Giardia lamblia
LEDQLRELKICDYLSQVERDF

SEQ ID NO: 3190654 - protein, 17 aa, Giardia lamblia
LEDYVELSEVQRLKGEL

SEQ ID NO: 3190655 - protein, 19 aa, Giardia lamblia
LEEAKFINKSLSALGKIVA

SEQ ID NO: 3190656 - protein, 21 aa, Giardia lamblia
LEEDLLFQINNCKSLLVGTNV

SEQ ID NO: 3190657 - protein, 24 aa, Giardia lamblia
LEEELSRLKIYLARAEEDIRAYKT

SEQ ID NO: 3190658 - protein, 18 aa, Giardia lamblia
LEEEVIYTAVIDMLTQHM

SEQ ID NO: 3190659 - protein, 24 aa, Giardia lamblia
LEEIKLSEILALEKDGHFAAGSMG

SEQ ID NO: 3190660 - protein, 19 aa, Giardia lamblia
LEEMIFKPIAQLPQLLIMA

SEQ ID NO: 3190661 - protein, 26 aa, Giardia lamblia
LEEQLKSIPILLQYEARFMKETGKDP

SEQ ID NO: 3190662 - protein, 34 aa, Giardia lamblia
LEETITDWIKASPWYLLILTFVPVNKYKMLEHMK

SEQ ID NO: 3190663 - protein, 31 aa, Giardia lamblia
LEFAKAYYAYSRLKVKFLQKLAAFRSSPNYQ

SEQ ID NO: 3190664 - protein, 20 aa, Giardia lamblia
LEFGCYVSGLFLEGATWDTA

SEQ ID NO: 3190665 - protein, 19 aa, Giardia lamblia
LEFIGYDRAPAPRLKDVIS

SEQ ID NO: 3190666 - protein, 30 aa, Giardia lamblia
LEFINSCESFYLVDAIFGFSFHGGPIKPPY

SEQ ID NO: 3190667 - protein, 29 aa, Giardia lamblia
LEFKELSRILWYYMILDEGHKLKDNMSQI

SEQ ID NO: 3190668 - protein, 18 aa, Giardia lamblia
LEFLKQDLSSKTKELNMA

SEQ ID NO: 3190669 - protein, 17 aa, Giardia lamblia
LEFLSIVSDVLSLEDIY

SEQ ID NO: 3190670 - protein, 18 aa, Giardia lamblia
LEFPFQAMTHADLARNVR

SEQ ID NO: 3190671 - protein, 26 aa, Giardia lamblia
LEGEASYRICNSLALILESETPTEYS

SEQ ID NO: 3190672 - protein, 32 aa, Giardia lamblia
LEGIDLLVPYEAEYITPLGTTALMYAAQVGYV

SEQ ID NO: 3190673 - protein, 22 aa, Giardia lamblia
LEGLLRIMYDELKRHSVFWLGD

SEQ ID NO: 3190674 - protein, 38 aa, Giardia lamblia
LEGRYHKMHIPAPPEWEPWILPPKVSLAEYNNYASRFY

SEQ ID NO: 3190675 - protein, 18 aa, Giardia lamblia
LEGTIIPDNGFSPLMRAA

SEQ ID NO: 3190676 - protein, 25 aa, Giardia lamblia
LEGYSKHFLAINNPILRLLVLKYSC

SEQ ID NO: 3190677 - protein, 26 aa, Giardia lamblia
LEHCKSLGKLWKDSTAWHTATELLRF

SEQ ID NO: 3190678 - protein, 25 aa, Giardia lamblia
LEHNRAYLLDIKYPKNAIVDDTRAR

SEQ ID NO: 3190679 - protein, 18 aa, Giardia lamblia
LEHTCPGILPLCVKDLFN

SEQ ID NO: 3190680 - protein, 19 aa, Giardia lamblia
LEIKEPAPYVPPPQGIDVS

SEQ ID NO: 3190681 - protein, 19 aa, Giardia lamblia
LEIQLMKKLNHPNIVKYLG

SEQ ID NO: 3190682 - protein, 18 aa, Giardia lamblia
LEIVLQLLKEQGAGALHR

SEQ ID NO: 3190683 - protein, 25 aa, Giardia lamblia
LEKAHLFRTLRVLDLSNNLIENFYT

SEQ ID NO: 3190684 - protein, 21 aa, Giardia lamblia
LEKASLLLEKPKQKASRVPSA

SEQ ID NO: 3190685 - protein, 18 aa, Giardia lamblia
LEKDYASVIAKLADKEDK

SEQ ID NO: 3190686 - protein, 30 aa, Giardia lamblia
LEKEGGMADYYGWTALMWAVSCNQIECVRL

SEQ ID NO: 3190687 - protein, 24 aa, Giardia lamblia
LEKEGGMRGSYGWTALMIAAWNNK

SEQ ID NO: 3190688 - protein, 25 aa, Giardia lamblia
LEKEGGMRSDYGWTALMLAAQNGHP

SEQ ID NO: 3190689 - protein, 22 aa, Giardia lamblia
LEKGIYCLHGLTAYNLLIKEHD

SEQ ID NO: 3190690 - protein, 19 aa, Giardia lamblia
LEKIDWTTMSLIAELTSCM

SEQ ID NO: 3190691 - protein, 24 aa, Giardia lamblia
LEKMEPSFALRNTAWDNFGRRDQT

SEQ ID NO: 3190692 - protein, 18 aa, Giardia lamblia
LEKQFIQNLFERESKREK

SEQ ID NO: 3190693 - protein, 24 aa, Giardia lamblia
LEKSTEFILTQKPLVLKRVEEPTE

SEQ ID NO: 3190694 - protein, 24 aa, Giardia lamblia
LEKVVVFHYEGFQISYTLLDTLNT

SEQ ID NO: 3190695 - protein, 23 aa, Giardia lamblia
LEKYKFPLLVGLSGVCYHGRNAC

SEQ ID NO: 3190696 - protein, 17 aa, Giardia lamblia
LEKYPSISILRRHPKPT

SEQ ID NO: 3190697 - protein, 19 aa, Giardia lamblia
LEKYWKQPNLDTAYLLSIR

SEQ ID NO: 3190698 - protein, 21 aa, Giardia lamblia
LELEFVARNLSVTQSPLFGLY

SEQ ID NO: 3190699 - protein, 26 aa, Giardia lamblia
LELEKRNRLLAARELEVSKLRAMCVK

SEQ ID NO: 3190700 - protein, 19 aa, Giardia lamblia
LELIHLLCKQPSPMWANTS

SEQ ID NO: 3190701 - protein, 25 aa, Giardia lamblia
LELNGHVLVGIWENGEPKQIMKYTI

SEQ ID NO: 3190702 - protein, 31 aa, Giardia lamblia
LELREAVPLTLWLYNIYYYYSRLDWSTKAIQ

SEQ ID NO: 3190703 - protein, 21 aa, Giardia lamblia
LELSDLQPPSCLPSIGSHRGT

SEQ ID NO: 3190704 - protein, 23 aa, Giardia lamblia
LELTNDVSFIRWYEAERDPESQE

SEQ ID NO: 3190705 - protein, 21 aa, Giardia lamblia
LELTVKPLEFYNLEFTKDTVS

SEQ ID NO: 3190706 - protein, 19 aa, Giardia lamblia
LELYVRTPLKAILSGEHSV

SEQ ID NO: 3190707 - protein, 20 aa, Giardia lamblia
LEMDKQVPHYLPTRSTPDIS

SEQ ID NO: 3190708 - protein, 18 aa, Giardia lamblia
LEMFSYFTENHVFHLKKL

SEQ ID NO: 3190709 - protein, 24 aa, Giardia lamblia
LEMKELMMVVLSNDLLKTSSDSDK

SEQ ID NO: 3190710 - protein, 20 aa, Giardia lamblia
LEMLKLFASFCLEYYGSDAP

SEQ ID NO: 3190711 - protein, 20 aa, Giardia lamblia
LEMYRLMNRQYEMGMETLVA

SEQ ID NO: 3190712 - protein, 21 aa, Giardia lamblia
LENAALWLSAAKYDDETNKYP

SEQ ID NO: 3190713 - protein, 17 aa, Giardia lamblia
LENDLLNNSYWAYRLMC

SEQ ID NO: 3190714 - protein, 29 aa, Giardia lamblia
LENHAHAQYRYFLLSRSFATIRKLSQDCF

SEQ ID NO: 3190715 - protein, 26 aa, Giardia lamblia
LENHALATEYLLHRDPKPVRPASARL

SEQ ID NO: 3190716 - protein, 23 aa, Giardia lamblia
LENHFYICWIAASVAFKGYGLGG

SEQ ID NO: 3190717 - protein, 31 aa, Giardia lamblia
LENLIDHFTYYLYTTICRSLFEVHKLLFAVL

SEQ ID NO: 3190718 - protein, 26 aa, Giardia lamblia
LENLKALLGYLKTPGLFHYPSSIPNA

SEQ ID NO: 3190719 - protein, 19 aa, Giardia lamblia
LENPWFSYAYVGHTKFIRQ

SEQ ID NO: 3190720 - protein, 17 aa, Giardia lamblia
LEPALASQLYRSSHYTH

SEQ ID NO: 3190721 - protein, 27 aa, Giardia lamblia
LEPDALTYTILLLSLAYSSMGKVVESV

SEQ ID NO: 3190722 - protein, 28 aa, Giardia lamblia
LEPEPQVLHLLKFTYTPSGFMASGAKTS

SEQ ID NO: 3190723 - protein, 21 aa, Giardia lamblia
LEPHRKLFFAPSYQEFLQCIS

SEQ ID NO: 3190724 - protein, 27 aa, Giardia lamblia
LEPIDHFVDVFLIKDRFRAALAEGYAK

SEQ ID NO: 3190725 - protein, 21 aa, Giardia lamblia
LEPKPYIPQSLGRVGWRVCLV

SEQ ID NO: 3190726 - protein, 24 aa, Giardia lamblia
LEPQLNYLHRSSLTRIAPKDITLE

SEQ ID NO: 3190727 - protein, 21 aa, Giardia lamblia
LEPTVKAAFSFPNMGPLKADD

SEQ ID NO: 3190728 - protein, 33 aa, Giardia lamblia
LEPVVIALVVYKRAYYYSFAYYYVGLCMRTDAK

SEQ ID NO: 3190729 - protein, 17 aa, Giardia lamblia
LEPYLKRCNIEIDELTV

SEQ ID NO: 3190730 - protein, 32 aa, Giardia lamblia
LEQEQWKRYAPPEIHFLLLDRGTELSIDTLEK

SEQ ID NO: 3190731 - protein, 18 aa, Giardia lamblia
LEQIHRAFPLLTDSPKDA

SEQ ID NO: 3190732 - protein, 30 aa, Giardia lamblia
LEQRRNRIMLALEYLLIARDMPAFVTVSQL

SEQ ID NO: 3190733 - protein, 18 aa, Giardia lamblia
LEQSPWTSQGPLTLQDIR

SEQ ID NO: 3190734 - protein, 29 aa, Giardia lamblia
LEQTKTILLQQYIAYLYSSYQADTSLSNV

SEQ ID NO: 3190735 - protein, 28 aa, Giardia lamblia
LEQTVPSVLYKLLAPRVVPSFPSHDSQH

SEQ ID NO: 3190736 - protein, 24 aa, Giardia lamblia
LEQYEGHILWLLTDTYSSLMHQSR

SEQ ID NO: 3190737 - protein, 26 aa, Giardia lamblia
LERDKYELQLLARLTNYKTAVSLLQD

SEQ ID NO: 3190738 - protein, 26 aa, Giardia lamblia
LERDWDALVIWLSPGARQVASELLNR

SEQ ID NO: 3190739 - protein, 28 aa, Giardia lamblia
LERECAASLPLHLESHFRSFMNTMLTTE

SEQ ID NO: 3190740 - protein, 19 aa, Giardia lamblia
LERLLRDVPQPYQNALMTA

SEQ ID NO: 3190741 - protein, 34 aa, Giardia lamblia
LERLPASTDLLIKYPLEWLELNPTKIQACKLPAL

SEQ ID NO: 3190742 - protein, 24 aa, Giardia lamblia
LERLRTPSPVLLTPSPLSHTVTRN

SEQ ID NO: 3190743 - protein, 19 aa, Giardia lamblia
LERRTLPTSPPRSLQYANA

SEQ ID NO: 3190744 - protein, 33 aa, Giardia lamblia
LESCFKQAIAFSAHLVLPILAENLLAAGIKIKT

SEQ ID NO: 3190745 - protein, 18 aa, Giardia lamblia
LESEGIVDPYLQMQPRKL

SEQ ID NO: 3190746 - protein, 25 aa, Giardia lamblia
LESEQFTPFLYLPPQCIINNLADNW

SEQ ID NO: 3190747 - protein, 18 aa, Giardia lamblia
LESLDFLHRLNILHLDLK

SEQ ID NO: 3190748 - protein, 19 aa, Giardia lamblia
LESMPTPEPAIDRELYIEK

SEQ ID NO: 3190749 - protein, 27 aa, Giardia lamblia
LESNAALLYALFPYPKDSVPTNKSLGE

SEQ ID NO: 3190750 - protein, 18 aa, Giardia lamblia
LESSISDCKRVLSSAGCS

SEQ ID NO: 3190751 - protein, 21 aa, Giardia lamblia
LESVRILLPYEASISTHNGTT

SEQ ID NO: 3190752 - protein, 21 aa, Giardia lamblia
LETALAEQLLINSLTELRSEK

SEQ ID NO: 3190753 - protein, 30 aa, Giardia lamblia
LETCDKPQWLPLVYCIAFIHTTLIERKKFG

SEQ ID NO: 3190754 - protein, 17 aa, Giardia lamblia
LETERSSFVLRLAENNS

SEQ ID NO: 3190755 - protein, 28 aa, Giardia lamblia
LETIANAVMLSIPTPSPPAVPKLTICTT

SEQ ID NO: 3190756 - protein, 29 aa, Giardia lamblia
LETLTPNPIFLMYHPVLMSPLAKPHRSIP

SEQ ID NO: 3190757 - protein, 17 aa, Giardia lamblia
LETPAVEFTLDPITKLP

SEQ ID NO: 3190758 - protein, 24 aa, Giardia lamblia
LETPLLDPSLAPKGSLAGTTAVYS

SEQ ID NO: 3190759 - protein, 17 aa, Giardia lamblia
LETRHYIALANDIDLIP

SEQ ID NO: 3190760 - protein, 48 aa, Giardia lamblia
LEVAELFSLAFLQARALLAMRLILHRVLLSSFYNKYLGRRSFAIFMLR

SEQ ID NO: 3190761 - protein, 17 aa, Giardia lamblia
LEVESQKAKLLIADDQM

SEQ ID NO: 3190762 - protein, 24 aa, Giardia lamblia
LEVFPCSVINRFGYTDGFKWLSKY

SEQ ID NO: 3190763 - protein, 24 aa, Giardia lamblia
LEVLLDMFQCWIVPAINAEGIRVG

SEQ ID NO: 3190764 - protein, 18 aa, Giardia lamblia
LEVSGMIFSLMLNCMRRD

SEQ ID NO: 3190765 - protein, 25 aa, Giardia lamblia
LEVSLRGFCYPAMYLNADRFSTGAS

SEQ ID NO: 3190766 - protein, 20 aa, Giardia lamblia
LEVYSLMDTFFDIEIEIANI

SEQ ID NO: 3190767 - protein, 17 aa, Giardia lamblia
LEWVSFRPEFLSAADLL

SEQ ID NO: 3190768 - protein, 31 aa, Giardia lamblia
LEYCERVTSQIFWLFRHIPSVDNSLITISHT

SEQ ID NO: 3190769 - protein, 23 aa, Giardia lamblia
LEYGVFNYENWPKDALLKSSTPT

SEQ ID NO: 3190770 - protein, 17 aa, Giardia lamblia
LEYIFSNSLLKSAGNIW

SEQ ID NO: 3190771 - protein, 31 aa, Giardia lamblia
LEYKEHYFDKPFLFKKFRKLEKKRCLLQQGK

SEQ ID NO: 3190772 - protein, 20 aa, Giardia lamblia
LEYLSALPNLRTLRLDGNGI

SEQ ID NO: 3190773 - protein, 20 aa, Giardia lamblia
LEYSLYYQNAYFFEQSTLHS

SEQ ID NO: 3190774 - protein, 30 aa, Giardia lamblia
LEYTDTWHEHLQVLPLSASFRTLSASLASR

SEQ ID NO: 3190775 - protein, 17 aa, Giardia lamblia
LFASQIFARSIEGVTGV

SEQ ID NO: 3190776 - protein, 18 aa, Giardia lamblia
LFCLKLLAEYGPLRDGQI

SEQ ID NO: 3190777 - protein, 18 aa, Giardia lamblia
LFCNLLCGMLHPNIKQRL

SEQ ID NO: 3190778 - protein, 29 aa, Giardia lamblia
LFDDRYDDRWFLHKAWAHATKIKHPLPSS

SEQ ID NO: 3190779 - protein, 25 aa, Giardia lamblia
LFDNKVRIYPKSFDDVWPLGVAELI

SEQ ID NO: 3190780 - protein, 17 aa, Giardia lamblia
LFEYIRHGVRYIDGKIG

SEQ ID NO: 3190781 - protein, 18 aa, Giardia lamblia
LFFKQIIDTYLITAMGPP

SEQ ID NO: 3190782 - protein, 21 aa, Giardia lamblia
LFFQNKPTVIVLSKADTWTPD

SEQ ID NO: 3190783 - protein, 18 aa, Giardia lamblia
LFFRRFGSHAVTITSVSP

SEQ ID NO: 3190784 - protein, 17 aa, Giardia lamblia
LFFVHRVESNYILSNNR

SEQ ID NO: 3190785 - protein, 31 aa, Giardia lamblia
LFGILRDQDLTLTTLLPFVICKTVYLCSDAE

SEQ ID NO: 3190786 - protein, 17 aa, Giardia lamblia
LFGQWGNPRYTAGKAII

SEQ ID NO: 3190787 - protein, 25 aa, Giardia lamblia
LFGSYSLHILGRTQSYLLLNKRYSI

SEQ ID NO: 3190788 - protein, 21 aa, Giardia lamblia
LFGVEPFCRFHFARGATNRRL

SEQ ID NO: 3190789 - protein, 19 aa, Giardia lamblia
LFHPILLGKKVPIVLDDVL

SEQ ID NO: 3190790 - protein, 19 aa, Giardia lamblia
LFKAELSKRFKKMPTPQVL

SEQ ID NO: 3190791 - protein, 18 aa, Giardia lamblia
LFKASYVHSTLFLEMINL

SEQ ID NO: 3190792 - protein, 18 aa, Giardia lamblia
LFKHLIVAISIAANIFRE

SEQ ID NO: 3190793 - protein, 17 aa, Giardia lamblia
LFKKLQKMMDAYELMYT

SEQ ID NO: 3190794 - protein, 19 aa, Giardia lamblia
LFKLLVIGDSGVGKSALLL

SEQ ID NO: 3190795 - protein, 18 aa, Giardia lamblia
LFKYIVVGDTAVGKSCLL

SEQ ID NO: 3190796 - protein, 17 aa, Giardia lamblia
LFLEPGGVFWEIISIFR

SEQ ID NO: 3190797 - protein, 17 aa, Giardia lamblia
LFLPIYIDRDPSVNRNL

SEQ ID NO: 3190798 - protein, 18 aa, Giardia lamblia
LFLVVEYCSNSGIQPIVG

SEQ ID NO: 3190799 - protein, 18 aa, Giardia lamblia
LFMTMYRRECAFARIHLP

SEQ ID NO: 3190800 - protein, 18 aa, Giardia lamblia
LFNISRWCDNFVLTMMLA

SEQ ID NO: 3190801 - protein, 28 aa, Giardia lamblia
LFPETCLHWWSFMLTRTLGNTFSKGKAM

SEQ ID NO: 3190802 - protein, 17 aa, Giardia lamblia
LFPFGFHVTGMPICGAA

SEQ ID NO: 3190803 - protein, 24 aa, Giardia lamblia
LFPGIYMNTSMGRFYRPVHSLTNN

SEQ ID NO: 3190804 - protein, 20 aa, Giardia lamblia
LFQDDVIPEPYRPASCVPSG

SEQ ID NO: 3190805 - protein, 25 aa, Giardia lamblia
LFQDYFIHESIYLENYLSATVMLEP

SEQ ID NO: 3190806 - protein, 17 aa, Giardia lamblia
LFQLFTYNQPDVPINVI

SEQ ID NO: 3190807 - protein, 24 aa, Giardia lamblia
LFQRYRVYQPERWSTSLPTAMCRD

SEQ ID NO: 3190808 - protein, 25 aa, Giardia lamblia
LFQSSNPYYFHLSSSNLNQPLQVRP

SEQ ID NO: 3190809 - protein, 18 aa, Giardia lamblia
LFRASRYIPAVTLLPSER

SEQ ID NO: 3190810 - protein, 19 aa, Giardia lamblia
LFRNFDINLLQLDMASINH

SEQ ID NO: 3190811 - protein, 17 aa, Giardia lamblia
LFSKVFTHISNNADLLE

SEQ ID NO: 3190812 - protein, 21 aa, Giardia lamblia
LFSYTLGRTNPRFSESGFPMT

SEQ ID NO: 3190813 - protein, 19 aa, Giardia lamblia
LFTCLLHMMITVLEAERNL

SEQ ID NO: 3190814 - protein, 19 aa, Giardia lamblia
LFTEATRHKPEPKMTLVDF

SEQ ID NO: 3190815 - protein, 35 aa, Giardia lamblia
LFTMEKYQVVCKALRLFDSRLLLSALQSVNSEEAK

SEQ ID NO: 3190816 - protein, 19 aa, Giardia lamblia
LFTSIGLKHIFYADCFEAP

SEQ ID NO: 3190817 - protein, 21 aa, Giardia lamblia
LFYDTDIFLFYVMTVRTDVLD

SEQ ID NO: 3190818 - protein, 18 aa, Giardia lamblia
LGAGYIAYLGPFSADERG

SEQ ID NO: 3190819 - protein, 23 aa, Giardia lamblia
LGAIERIYNYAHALKLICQKLRD

SEQ ID NO: 3190820 - protein, 19 aa, Giardia lamblia
LGALILLPTAELCVQTFTV

SEQ ID NO: 3190821 - protein, 25 aa, Giardia lamblia
LGANFPCLPAIPHIFMDTAKSFIGA

SEQ ID NO: 3190822 - protein, 20 aa, Giardia lamblia
LGASNRPPIHSIASPIAVSR

SEQ ID NO: 3190823 - protein, 19 aa, Giardia lamblia
LGCIIYELCTFRPFCLALN

SEQ ID NO: 3190824 - protein, 19 aa, Giardia lamblia
LGCIIYELCVQKQLFAAAS

SEQ ID NO: 3190825 - protein, 18 aa, Giardia lamblia
LGCILYECLTGMPAFMGD

SEQ ID NO: 3190826 - protein, 19 aa, Giardia lamblia
LGCIVYELLTGISLSRDEQ

SEQ ID NO: 3190827 - protein, 23 aa, Giardia lamblia
LGCSFMQPYIIVAYHGINCENIC

SEQ ID NO: 3190828 - protein, 22 aa, Giardia lamblia
LGCVVYELCTLRRPFIELEGES

SEQ ID NO: 3190829 - protein, 21 aa, Giardia lamblia
LGDAFLKCSLALHLHALHPTL

SEQ ID NO: 3190830 - protein, 29 aa, Giardia lamblia
LGDCDIIMRYLLTELGWWDEFLSCARELG

SEQ ID NO: 3190831 - protein, 22 aa, Giardia lamblia
LGDFGIAKILQSTLECARTAIG

SEQ ID NO: 3190832 - protein, 18 aa, Giardia lamblia
LGDFLITRALLDEQGPEI

SEQ ID NO: 3190833 - protein, 35 aa, Giardia lamblia
LGDRKALLYEIKRLDRWDGFLWRTELTEENSGEIV

SEQ ID NO: 3190834 - protein, 24 aa, Giardia lamblia
LGDTLRLHFFSHKADYYMSMTTEA

SEQ ID NO: 3190835 - protein, 33 aa, Giardia lamblia
LGDTYNGLRLYYAYLNMMQWSPPLIDTVIHEYL

SEQ ID NO: 3190836 - protein, 18 aa, Giardia lamblia
LGEFAVSLGLLKLPNHNI

SEQ ID NO: 3190837 - protein, 18 aa, Giardia lamblia
LGEGLLAINLLIETNRYI

SEQ ID NO: 3190838 - protein, 25 aa, Giardia lamblia
LGENALFYTIRNNKHLYLARLAEVA

SEQ ID NO: 3190839 - protein, 29 aa, Giardia lamblia
LGETALMQSVRLFDKHLVQLLLDHEAGVI

SEQ ID NO: 3190840 - protein, 24 aa, Giardia lamblia
LGEYTLIPKFSFSTKVPLTLIYST

SEQ ID NO: 3190841 - protein, 23 aa, Giardia lamblia
LGFEAFIHITYRDSKLPSSIISI

SEQ ID NO: 3190842 - protein, 19 aa, Giardia lamblia
LGFKWRIGGLNASKYYDSN

SEQ ID NO: 3190843 - protein, 27 aa, Giardia lamblia
LGFTVDTIRIFFRDVLKVRIEHVGLRY

SEQ ID NO: 3190844 - protein, 18 aa, Giardia lamblia
LGFYPHRRRTLLFHPDGE

SEQ ID NO: 3190845 - protein, 31 aa, Giardia lamblia
LGGEPQVPYPFKIIQLYLSLGRTIRPILQKD

SEQ ID NO: 3190846 - protein, 18 aa, Giardia lamblia
LGGKFRMILSLLDRYDLT

SEQ ID NO: 3190847 - protein, 25 aa, Giardia lamblia
LGGSVDMLMECPLDLQVPAKKQNTG

SEQ ID NO: 3190848 - protein, 31 aa, Giardia lamblia
LGGSVSMLMGWFWSYHIPYQRIKVIGFCSPP

SEQ ID NO: 3190849 - protein, 42 aa, Giardia lamblia
LGGYKFDIRQWVFVSSINPLIIFQWTSPYLRFCSSKYSLDEH

SEQ ID NO: 3190850 - protein, 31 aa, Giardia lamblia
LGHDVYLRIAPELFLKRLVVGGLNRVFEINK

SEQ ID NO: 3190851 - protein, 24 aa, Giardia lamblia
LGHRSICDFLARFEGRQTTPKGVT

SEQ ID NO: 3190852 - protein, 33 aa, Giardia lamblia
LGHSSSLRYAMQLLFPAFVVAKLEAAGGLTVID

SEQ ID NO: 3190853 - protein, 20 aa, Giardia lamblia
LGHTECAHFLLNKEAPIKHS

SEQ ID NO: 3190854 - protein, 25 aa, Giardia lamblia
LGIEHKSYLVLPMLCRRIVERNLCV

SEQ ID NO: 3190855 - protein, 23 aa, Giardia lamblia
LGIGCFDMIKMIGRLLAITADIR

SEQ ID NO: 3190856 - protein, 18 aa, Giardia lamblia
LGILMRRISGDGAIYKEI

SEQ ID NO: 3190857 - protein, 20 aa, Giardia lamblia
LGISVLYLSSASVGNTMLHR

SEQ ID NO: 3190858 - protein, 31 aa, Giardia lamblia
LGKATYKPRAFYKGIVFPLANTDAHVVVVKA

SEQ ID NO: 3190859 - protein, 23 aa, Giardia lamblia
LGKLCPMHPSLALPISICCRLFD

SEQ ID NO: 3190860 - protein, 23 aa, Giardia lamblia
LGKNLLDGIPNNPLLIATAKESP

SEQ ID NO: 3190861 - protein, 24 aa, Giardia lamblia
LGKSIFSSPRWYGAYIKRASRFSN

SEQ ID NO: 3190862 - protein, 22 aa, Giardia lamblia
LGKTALIYALENDWPELARILA

SEQ ID NO: 3190863 - protein, 30 aa, Giardia lamblia
LGKTYLSIFLLDRFLCSIYGSFRHFLTTEQ

SEQ ID NO: 3190864 - protein, 24 aa, Giardia lamblia
LGKVKQIFDQWPYSPRIIVATDGT

SEQ ID NO: 3190865 - protein, 17 aa, Giardia lamblia
LGLLLRAHQTQIEPFTA

SEQ ID NO: 3190866 - protein, 17 aa, Giardia lamblia
LGLLPASFRREEVSYIL

SEQ ID NO: 3190867 - protein, 28 aa, Giardia lamblia
LGLSNSQFSLFLLPRFIRAARTNETETV

SEQ ID NO: 3190868 - protein, 18 aa, Giardia lamblia
LGLTLLESIISRVVFFLP

SEQ ID NO: 3190869 - protein, 27 aa, Giardia lamblia
LGMDMTNFYNACQVLQMAGVKLSSVAN

SEQ ID NO: 3190870 - protein, 25 aa, Giardia lamblia
LGNCIRYCLTCNPAVSFAGYSVPHP

SEQ ID NO: 3190871 - protein, 17 aa, Giardia lamblia
LGNLKLIKELLDYESRM

SEQ ID NO: 3190872 - protein, 27 aa, Giardia lamblia
LGNNLEHGLFYSLIIDFPSSDACPISS

SEQ ID NO: 3190873 - protein, 26 aa, Giardia lamblia
LGNVSAPQLYWSLYLNMMDADVYEDT

SEQ ID NO: 3190874 - protein, 17 aa, Giardia lamblia
LGPFLTNFVLIKSAVTV

SEQ ID NO: 3190875 - protein, 18 aa, Giardia lamblia
LGPILTELITGKVMFPIP

SEQ ID NO: 3190876 - protein, 38 aa, Giardia lamblia
LGPITKKLLLELGLTRLVAWFEQCYLPPEATETYEPDV

SEQ ID NO: 3190877 - protein, 18 aa, Giardia lamblia
LGPLEPLLSFRTRSTYLS

SEQ ID NO: 3190878 - protein, 20 aa, Giardia lamblia
LGQKIQGLFGHLGKLLAQIT

SEQ ID NO: 3190879 - protein, 25 aa, Giardia lamblia
LGQKSYLLADFYNAVLYKVQLLTKN

SEQ ID NO: 3190880 - protein, 30 aa, Giardia lamblia
LGQTFVVQTILKPKILLLAQQRVSRIVLHK

SEQ ID NO: 3190881 - protein, 24 aa, Giardia lamblia
LGQTTDLFCALSLALKAGHWSCVK

SEQ ID NO: 3190882 - protein, 25 aa, Giardia lamblia
LGRENLAVVRALAPFFGRETDKDGR

SEQ ID NO: 3190883 - protein, 21 aa, Giardia lamblia
LGRIERYLKHACWKCGTKQPV

SEQ ID NO: 3190884 - protein, 31 aa, Giardia lamblia
LGSLIESAIQFLFKVWDYIEEAFALRNSCLN

SEQ ID NO: 3190885 - protein, 17 aa, Giardia lamblia
LGSLLLNTSISADEVSF

SEQ ID NO: 3190886 - protein, 28 aa, Giardia lamblia
LGSVYVAPWYKIKLINNLKPVIDKLARN

SEQ ID NO: 3190887 - protein, 25 aa, Giardia lamblia
LGSYVRPYMCYRPDGYYRTIDDLQP

SEQ ID NO: 3190888 - protein, 21 aa, Giardia lamblia
LGTILVAHLPQLANARLRLNM

SEQ ID NO: 3190889 - protein, 25 aa, Giardia lamblia
LGTQVELGALKRIYKEAMLARDHQI

SEQ ID NO: 3190890 - protein, 23 aa, Giardia lamblia
LGVDASFTAYAPYGGMQNAVGIN

SEQ ID NO: 3190891 - protein, 18 aa, Giardia lamblia
LGVFSTAIPVLNGAKPHV

SEQ ID NO: 3190892 - protein, 19 aa, Giardia lamblia
LGVIIYELVTLKRPDFLGG

SEQ ID NO: 3190893 - protein, 19 aa, Giardia lamblia
LGVKVPIASSILLNDKYVH

SEQ ID NO: 3190894 - protein, 28 aa, Giardia lamblia
LGVPTNHIHFLRLPFYNRNYRSKRTYDQ

SEQ ID NO: 3190895 - protein, 18 aa, Giardia lamblia
LGVRLLHHISRRVYKYDW

SEQ ID NO: 3190896 - protein, 20 aa, Giardia lamblia
LGWTNLIYSAYFGDTNAIKS

SEQ ID NO: 3190897 - protein, 19 aa, Giardia lamblia
LGYLHQAVSLAGMRTGAIG

SEQ ID NO: 3190898 - protein, 18 aa, Giardia lamblia
LGYLYDIMQSASGGTVAE

SEQ ID NO: 3190899 - protein, 24 aa, Giardia lamblia
LHARGIFLCHRAVSDGNLPMVRSL

SEQ ID NO: 3190900 - protein, 19 aa, Giardia lamblia
LHCPARGAAYLLSLACQKK

SEQ ID NO: 3190901 - protein, 17 aa, Giardia lamblia
LHDEVLGLQARIKELEE

SEQ ID NO: 3190902 - protein, 26 aa, Giardia lamblia
LHDLAIMVDLLCLESGLLSVRSSCEL

SEQ ID NO: 3190903 - protein, 25 aa, Giardia lamblia
LHDYADLVPFFLGKETGILSNDSKL

SEQ ID NO: 3190904 - protein, 23 aa, Giardia lamblia
LHEEEVLKIRKAMTGASSIMALT

SEQ ID NO: 3190905 - protein, 23 aa, Giardia lamblia
LHEETAMMKAAALGAYDVVKVLI

SEQ ID NO: 3190906 - protein, 30 aa, Giardia lamblia
LHEKRKTFTPFLSSILIEFSKVSPLHIAPV

SEQ ID NO: 3190907 - protein, 25 aa, Giardia lamblia
LHELSQDKAMRLLKQVMLGAVQQHK

SEQ ID NO: 3190908 - protein, 24 aa, Giardia lamblia
LHEMFDIVILMPSVQTRQLQLTPS

SEQ ID NO: 3190909 - protein, 26 aa, Giardia lamblia
LHEYIEARMLAVAPNFTRIVGSIVGV

SEQ ID NO: 3190910 - protein, 23 aa, Giardia lamblia
LHEYPLEEYLIRLAVPASAVGME

SEQ ID NO: 3190911 - protein, 18 aa, Giardia lamblia
LHFFSIRGFRSHSLGCLF

SEQ ID NO: 3190912 - protein, 26 aa, Giardia lamblia
LHGCFETLIRLFLGYPQQNIPRTGFP

SEQ ID NO: 3190913 - protein, 20 aa, Giardia lamblia
LHGPSLLRLPQASDVMICAL

SEQ ID NO: 3190914 - protein, 27 aa, Giardia lamblia
LHHDEFYPYLLAFLISHDTKKALRFLQ

SEQ ID NO: 3190915 - protein, 30 aa, Giardia lamblia
LHHFADEFLVQMYSLLYNAETKNFIIQWFG

SEQ ID NO: 3190916 - protein, 33 aa, Giardia lamblia
LHHISRRVYKYDWFARLFLAIILSIPTCDPSVQ

SEQ ID NO: 3190917 - protein, 19 aa, Giardia lamblia
LHHLTAKTFRTLMKDAFWS

SEQ ID NO: 3190918 - protein, 18 aa, Giardia lamblia
LHHNCVPVPVHWRLRNGR

SEQ ID NO: 3190919 - protein, 17 aa, Giardia lamblia
LHIFSPQQHHFPLIDPG

SEQ ID NO: 3190920 - protein, 18 aa, Giardia lamblia
LHILARKGIVDIIPQCAQ

SEQ ID NO: 3190921 - protein, 19 aa, Giardia lamblia
LHIYYRNSQAILLELTVKP

SEQ ID NO: 3190922 - protein, 17 aa, Giardia lamblia
LHKIEYLLAGRFMCDPK

SEQ ID NO: 3190923 - protein, 21 aa, Giardia lamblia
LHKLLVCAGVTFIDSLYDTTA

SEQ ID NO: 3190924 - protein, 25 aa, Giardia lamblia
LHLCRSIPKTAFFKGILLSSEGVYV

SEQ ID NO: 3190925 - protein, 20 aa, Giardia lamblia
LHLPRSLFFTPDGKYKNYVR

SEQ ID NO: 3190926 - protein, 23 aa, Giardia lamblia
LHLSNPERFLSMKYFPFAEEPDA

SEQ ID NO: 3190927 - protein, 32 aa, Giardia lamblia
LHMERLRFIFEDYVRLRLSKLSDKPFLYMQTE

SEQ ID NO: 3190928 - protein, 18 aa, Giardia lamblia
LHMLILRNEVPLSSVQPG

SEQ ID NO: 3190929 - protein, 20 aa, Giardia lamblia
LHNFLLDPYASTNQELYLLK

SEQ ID NO: 3190930 - protein, 17 aa, Giardia lamblia
LHNPINFTTIDSLDADE

SEQ ID NO: 3190931 - protein, 24 aa, Giardia lamblia
LHPDPALRPLLTDIMRLPRLSDSF

SEQ ID NO: 3190932 - protein, 20 aa, Giardia lamblia
LHPGINVFIGINGAGKSNFY

SEQ ID NO: 3190933 - protein, 21 aa, Giardia lamblia
LHPHLIPCMFHIYGNHILQAM

SEQ ID NO: 3190934 - protein, 24 aa, Giardia lamblia
LHPQQPICFPTGKLLGKVESIQKD

SEQ ID NO: 3190935 - protein, 26 aa, Giardia lamblia
LHQAVKDLDILIQKQTLQRAEASHAM

SEQ ID NO: 3190936 - protein, 17 aa, Giardia lamblia
LHQKFRAGISHHLKTTT

SEQ ID NO: 3190937 - protein, 25 aa, Giardia lamblia
LHQLSKWHSLSPFNRLKSKIIGAHF

SEQ ID NO: 3190938 - protein, 25 aa, Giardia lamblia
LHQRPEREYVPISQWDALVVPPNGE

SEQ ID NO: 3190939 - protein, 18 aa, Giardia lamblia
LHRAELRALAAVSTELRH

SEQ ID NO: 3190940 - protein, 17 aa, Giardia lamblia
LHRIYPGGRLFCCDIDE

SEQ ID NO: 3190941 - protein, 18 aa, Giardia lamblia
LHRLQSAIVGMYLEFKDR

SEQ ID NO: 3190942 - protein, 18 aa, Giardia lamblia
LHRMSVDMISYWLTDHPQ

SEQ ID NO: 3190943 - protein, 17 aa, Giardia lamblia
LHRNHISHFDLKPDNIL

SEQ ID NO: 3190944 - protein, 23 aa, Giardia lamblia
LHRSRIPQPDFSPTGGYKSSNRE

SEQ ID NO: 3190945 - protein, 28 aa, Giardia lamblia
LHRVCPDRCFLWQVSSTRKSSGWRDGPL

SEQ ID NO: 3190946 - protein, 18 aa, Giardia lamblia
LHSAEILHRDLKPSNLLL

SEQ ID NO: 3190947 - protein, 17 aa, Giardia lamblia
LHSALMETYRKLLGNVC

SEQ ID NO: 3190948 - protein, 39 aa, Giardia lamblia
LHSDGKIVYFYHEKGILMTTIPVVLINPSAAISKDERIS

SEQ ID NO: 3190949 - protein, 25 aa, Giardia lamblia
LHSFNALYSFIKRTIHTLALKQTLS

SEQ ID NO: 3190950 - protein, 28 aa, Giardia lamblia
LHSKFNPMGPLVYKALRPENILIAGIGV

SEQ ID NO: 3190951 - protein, 18 aa, Giardia lamblia
LHSKRTREVSKEPIKVVL

SEQ ID NO: 3190952 - protein, 17 aa, Giardia lamblia
LHSLIDDLNKIDSPSPS

SEQ ID NO: 3190953 - protein, 19 aa, Giardia lamblia
LHSPPLWRSSGSPAILVLE

SEQ ID NO: 3190954 - protein, 26 aa, Giardia lamblia
LHTLADLFHIYYIKNITQWPQKVTHM

SEQ ID NO: 3190955 - protein, 18 aa, Giardia lamblia
LHTTLTIHEERLLNQARL

SEQ ID NO: 3190956 - protein, 28 aa, Giardia lamblia
LHVAILANHEECCFLLAPYEALICTKDG

SEQ ID NO: 3190957 - protein, 17 aa, Giardia lamblia
LHVAILIVQRYGASTPW

SEQ ID NO: 3190958 - protein, 19 aa, Giardia lamblia
LHVDFWALSPKDISWIRHQ

SEQ ID NO: 3190959 - protein, 21 aa, Giardia lamblia
LHVFMEFEFPTYYCEIAQLRP

SEQ ID NO: 3190960 - protein, 20 aa, Giardia lamblia
LHVLVSKLTPRLNDAHAQSE

SEQ ID NO: 3190961 - protein, 18 aa, Giardia lamblia
LHYVFVVSVPPIPMVKGH

SEQ ID NO: 3190962 - protein, 17 aa, Giardia lamblia
LIAIRDHSNISPEEKKY

SEQ ID NO: 3190963 - protein, 26 aa, Giardia lamblia
LIANIAKFYRIPLIVGCETYKVTDQI

SEQ ID NO: 3190964 - protein, 18 aa, Giardia lamblia
LICMSVFTHYAIVTGRLL

SEQ ID NO: 3190965 - protein, 18 aa, Giardia lamblia
LICQIFEAAYRVPRALII

SEQ ID NO: 3190966 - protein, 24 aa, Giardia lamblia
LIDALNRYYDFIKGINLHEARKKQ

SEQ ID NO: 3190967 - protein, 26 aa, Giardia lamblia
LIDDTISRFKKHPFRLSFDINHHQPE

SEQ ID NO: 3190968 - protein, 17 aa, Giardia lamblia
LIDIRKVFHFTGSHVWI

SEQ ID NO: 3190969 - protein, 23 aa, Giardia lamblia
LIDYRIFRRILADIYQRSPIYKN

SEQ ID NO: 3190970 - protein, 23 aa, Giardia lamblia
LIEDEFEEFLKNYRIDKTSDLLE

SEQ ID NO: 3190971 - protein, 23 aa, Giardia lamblia
LIEEVTILKRKLASLKKTYVDIT

SEQ ID NO: 3190972 - protein, 18 aa, Giardia lamblia
LIEGLKRQVNEFSNKLLE

SEQ ID NO: 3190973 - protein, 18 aa, Giardia lamblia
LIEKLFALRSKNDKLKCV

SEQ ID NO: 3190974 - protein, 19 aa, Giardia lamblia
LIELHCWIAGTPFAQAYTA

SEQ ID NO: 3190975 - protein, 18 aa, Giardia lamblia
LIERECCYVLRDGTTALM

SEQ ID NO: 3190976 - protein, 19 aa, Giardia lamblia
LIERFMKMCSMPGHAVNAI

SEQ ID NO: 3190977 - protein, 17 aa, Giardia lamblia
LIESMLAGDSWFSENTL

SEQ ID NO: 3190978 - protein, 18 aa, Giardia lamblia
LIFEAIAKALEIIPYSLC

SEQ ID NO: 3190979 - protein, 17 aa, Giardia lamblia
LIFMRDHPILARITQPL

SEQ ID NO: 3190980 - protein, 34 aa, Giardia lamblia
LIGENTSMLTKLRFPDLFTLLDIRSISESPASHL

SEQ ID NO: 3190981 - protein, 28 aa, Giardia lamblia
LIGIYFNEVLAPILKFLATTGFAAHADL

SEQ ID NO: 3190982 - protein, 17 aa, Giardia lamblia
LIGMFNGSSESGQYAET

SEQ ID NO: 3190983 - protein, 30 aa, Giardia lamblia
LIGPTVEVIMLLTAYLRLYGETKVLPLSQT

SEQ ID NO: 3190984 - protein, 27 aa, Giardia lamblia
LIHDPHEFLLPWLSAFSTNSLRAKHLL

SEQ ID NO: 3190985 - protein, 26 aa, Giardia lamblia
LIHSDRIYPALPYKPSFIPDNPMNDK

SEQ ID NO: 3190986 - protein, 20 aa, Giardia lamblia
LIHTPLTFRCYNTISEAIAL

SEQ ID NO: 3190987 - protein, 38 aa, Giardia lamblia
LIIAAQLDHPKICEILAPLEKTIYYKDGRNALMIAAEA

SEQ ID NO: 3190988 - protein, 18 aa, Giardia lamblia
LIIETILSTSGFVNCKEL

SEQ ID NO: 3190989 - protein, 25 aa, Giardia lamblia
LIILADIFLHYFGATSVSFAPSELY

SEQ ID NO: 3190990 - protein, 37 aa, Giardia lamblia
LIKEKYNTDFYILDKFPLNARPFYTMPDPHDGRYSNS

SEQ ID NO: 3190991 - protein, 18 aa, Giardia lamblia
LIKHYRRARKDIPESTIW

SEQ ID NO: 3190992 - protein, 18 aa, Giardia lamblia
LIKQLKPKELVLMLKICA

SEQ ID NO: 3190993 - protein, 17 aa, Giardia lamblia
LILAIKHKRDLAVTLLG

SEQ ID NO: 3190994 - protein, 17 aa, Giardia lamblia
LILAVKFNRRHVAQLLY

SEQ ID NO: 3190995 - protein, 18 aa, Giardia lamblia
LILEYASLGDLSSLIKCY

SEQ ID NO: 3190996 - protein, 17 aa, Giardia lamblia
LILFELYGDEPSAFILN

SEQ ID NO: 3190997 - protein, 19 aa, Giardia lamblia
LILLGTGYLLGPDEKCYGT

SEQ ID NO: 3190998 - protein, 18 aa, Giardia lamblia
LILTFNADYLPVVAQTSE

SEQ ID NO: 3190999 - protein, 17 aa, Giardia lamblia
LINALRSDIDVLKAHVI

SEQ ID NO: 3191000 - protein, 25 aa, Giardia lamblia
LINETAIEFPLLLSVAQELLREWMH

SEQ ID NO: 3191001 - protein, 17 aa, Giardia lamblia
LINKIQSLLLIRASRPT

SEQ ID NO: 3191002 - protein, 18 aa, Giardia lamblia
LINMNECFNRVLGSSLLG

SEQ ID NO: 3191003 - protein, 31 aa, Giardia lamblia
LINRLDDLIVFNPLTKDALVKIFRSLCGQLE

SEQ ID NO: 3191004 - protein, 29 aa, Giardia lamblia
LINVKQNSFILFVHKRLAAVELFTLCYKD

SEQ ID NO: 3191005 - protein, 18 aa, Giardia lamblia
LIPFYARFQDAQGKTALM

SEQ ID NO: 3191006 - protein, 17 aa, Giardia lamblia
LIPLQKRCQAPGKAYIN

SEQ ID NO: 3191007 - protein, 17 aa, Giardia lamblia
LIPLSAVWKHLFSQLVE

SEQ ID NO: 3191008 - protein, 18 aa, Giardia lamblia
LIQQLKQLNIIEPTLTKA

SEQ ID NO: 3191009 - protein, 20 aa, Giardia lamblia
LIRPEYISFMAPEVLRHQPY

SEQ ID NO: 3191010 - protein, 17 aa, Giardia lamblia
LIRPPPVQAQGGAQPGS

SEQ ID NO: 3191011 - protein, 25 aa, Giardia lamblia
LIRRNDELSLLYERVRVQQATLAKG

SEQ ID NO: 3191012 - protein, 21 aa, Giardia lamblia
LIRVSMATVLWRAYGGSISGD

SEQ ID NO: 3191013 - protein, 31 aa, Giardia lamblia
LIRYCLEVLSLPVLNWIHGFEILDEPPGSPV

SEQ ID NO: 3191014 - protein, 25 aa, Giardia lamblia
LISDHLFRYMGYVSAYVIIAGVDYK

SEQ ID NO: 3191015 - protein, 19 aa, Giardia lamblia
LISFLLSGYLDDVSRMPAT

SEQ ID NO: 3191016 - protein, 21 aa, Giardia lamblia
LISLSLLSLFSSDGEIFCELF

SEQ ID NO: 3191017 - protein, 21 aa, Giardia lamblia
LISNVIRRLKEKRKILASFDM

SEQ ID NO: 3191018 - protein, 21 aa, Giardia lamblia
LISQSFAVLLAVWNDLRTKLA

SEQ ID NO: 3191019 - protein, 18 aa, Giardia lamblia
LISSSKSRHRAERDAFNA

SEQ ID NO: 3191020 - protein, 47 aa, Giardia lamblia
LISSWAHFPDAPKLTFLSLNYNRLENFIQFPFAKLKNLEIFSAVGNN

SEQ ID NO: 3191021 - protein, 17 aa, Giardia lamblia
LISTLPSYIDEDTECLC

SEQ ID NO: 3191022 - protein, 18 aa, Giardia lamblia
LISTTRLPYSDNLLLKVE

SEQ ID NO: 3191023 - protein, 20 aa, Giardia lamblia
LITFHGPWCKDCQYSIPVFN

SEQ ID NO: 3191024 - protein, 17 aa, Giardia lamblia
LITHIYLLQNILEESLH

SEQ ID NO: 3191025 - protein, 25 aa, Giardia lamblia
LITRYNKDDIVLLGLKRDHIENFII

SEQ ID NO: 3191026 - protein, 25 aa, Giardia lamblia
LITSGHFLLELMWAALLCEYDNVIT

SEQ ID NO: 3191027 - protein, 27 aa, Giardia lamblia
LITSVDPLIMYIYNEGLGRFATRKYHK

SEQ ID NO: 3191028 - protein, 17 aa, Giardia lamblia
LIVPGPSNIPALATAFS

SEQ ID NO: 3191029 - protein, 17 aa, Giardia lamblia
LIYALKSGKIELLSELA

SEQ ID NO: 3191030 - protein, 17 aa, Giardia lamblia
LIYFNEGTPMIRDLDSR

SEQ ID NO: 3191031 - protein, 17 aa, Giardia lamblia
LIYKRGFAKVNGQRIPI

SEQ ID NO: 3191032 - protein, 17 aa, Giardia lamblia
LKAAAPVPTLLLEAKEG

SEQ ID NO: 3191033 - protein, 18 aa, Giardia lamblia
LKAALRTGYFQLGSLMMM

SEQ ID NO: 3191034 - protein, 19 aa, Giardia lamblia
LKALFRPISMCVPDFAMIT

SEQ ID NO: 3191035 - protein, 17 aa, Giardia lamblia
LKALKIRGDGCLKPIAS

SEQ ID NO: 3191036 - protein, 18 aa, Giardia lamblia
LKANLRKALARNTTLVAK

SEQ ID NO: 3191037 - protein, 20 aa, Giardia lamblia
LKAQMRNFVLDRELRWAEVS

SEQ ID NO: 3191038 - protein, 28 aa, Giardia lamblia
LKARGRILRAFRNHFYFKGWTEVTPPTI

SEQ ID NO: 3191039 - protein, 18 aa, Giardia lamblia
LKARLTRATAASGGTTAP

SEQ ID NO: 3191040 - protein, 25 aa, Giardia lamblia
LKASYKWICIVSVLRIRVGGETLLV

SEQ ID NO: 3191041 - protein, 29 aa, Giardia lamblia
LKATDPTIIPGMMDALHRLVLSLQNSYSE

SEQ ID NO: 3191042 - protein, 20 aa, Giardia lamblia
LKATLLYAVELSFSVISACG

SEQ ID NO: 3191043 - protein, 19 aa, Giardia lamblia
LKCINIPKSYKARVAYPFS

SEQ ID NO: 3191044 - protein, 20 aa, Giardia lamblia
LKDEFGFEPLPYNQAYQFDT

SEQ ID NO: 3191045 - protein, 38 aa, Giardia lamblia
LKDGSTPLHFAAAMESLRSIVLMHGALKRARDSAGMTS

SEQ ID NO: 3191046 - protein, 30 aa, Giardia lamblia
LKDHNTDLAKMYLCLEKEAKKYSSLLSVTC

SEQ ID NO: 3191047 - protein, 18 aa, Giardia lamblia
LKDIYLKSNVRITTNPGA

SEQ ID NO: 3191048 - protein, 24 aa, Giardia lamblia
LKDLPLPTVILYLDATPETCYYRI

SEQ ID NO: 3191049 - protein, 23 aa, Giardia lamblia
LKDLVLAMLSPYPDARPSAQDLM

SEQ ID NO: 3191050 - protein, 23 aa, Giardia lamblia
LKDREWGMYNIHGTTALMFAAQY

SEQ ID NO: 3191051 - protein, 24 aa, Giardia lamblia
LKDRYSELVLACKKLKQRVVIATS

SEQ ID NO: 3191052 - protein, 25 aa, Giardia lamblia
LKDTILIYEQMLTKTKQRAVGKPRT

SEQ ID NO: 3191053 - protein, 32 aa, Giardia lamblia
LKDWAKLSEKIATLLAKLFKATTDPQIVHKEL

SEQ ID NO: 3191054 - protein, 23 aa, Giardia lamblia
LKDYEIIGFLGQGQFGAVHKVKS

SEQ ID NO: 3191055 - protein, 27 aa, Giardia lamblia
LKEDRYKLKLLSLLMKHLKINQCIVFV

SEQ ID NO: 3191056 - protein, 19 aa, Giardia lamblia
LKEEMAILQIDEHASGAPS

SEQ ID NO: 3191057 - protein, 18 aa, Giardia lamblia
LKEGTGTMLYRTGDTYSG

SEQ ID NO: 3191058 - protein, 23 aa, Giardia lamblia
LKEIMCLRAIVVGYLEYTDTWHE

SEQ ID NO: 3191059 - protein, 19 aa, Giardia lamblia
LKEKRKILASFDMSIHMDT

SEQ ID NO: 3191060 - protein, 25 aa, Giardia lamblia
LKELKMQYALQLIRAQELIDKILDT

SEQ ID NO: 3191061 - protein, 40 aa, Giardia lamblia
LKELKVRLYKNELLRKFLLDKFLFKIVPMVNVDGVIVGNS

SEQ ID NO: 3191062 - protein, 34 aa, Giardia lamblia
LKEYNIKPLSYLFTLPDHLLSLITGTPLGSKRVE

SEQ ID NO: 3191063 - protein, 20 aa, Giardia lamblia
LKFVKEYPQKIIPEATIWNI

SEQ ID NO: 3191064 - protein, 20 aa, Giardia lamblia
LKGLGIHELNLYELGVLKMP

SEQ ID NO: 3191065 - protein, 36 aa, Giardia lamblia
LKGLSLSLVRKFSLQLLIAFAYARKLRIIHADVKPE

SEQ ID NO: 3191066 - protein, 17 aa, Giardia lamblia
LKGPPAHLPKIGSPAAD

SEQ ID NO: 3191067 - protein, 29 aa, Giardia lamblia
LKGSVDHRALLDLLIMCDREDWNNTVVAF

SEQ ID NO: 3191068 - protein, 19 aa, Giardia lamblia
LKGVPFKSECFRIDSSVAF

SEQ ID NO: 3191069 - protein, 21 aa, Giardia lamblia
LKGYPQLISALNLLCTIDSSA

SEQ ID NO: 3191070 - protein, 33 aa, Giardia lamblia
LKHAELFFDCVRLDHILGLFRTWELPLTAGKNN

SEQ ID NO: 3191071 - protein, 29 aa, Giardia lamblia
LKHIWPKVCGYLNDLFRPILGNLKGTPDE

SEQ ID NO: 3191072 - protein, 18 aa, Giardia lamblia
LKHLSHYCQQLFMESLGK

SEQ ID NO: 3191073 - protein, 19 aa, Giardia lamblia
LKHTLNRVAEIIDTAEVNG

SEQ ID NO: 3191074 - protein, 17 aa, Giardia lamblia
LKKRYDVYKINRPAYFK

SEQ ID NO: 3191075 - protein, 31 aa, Giardia lamblia
LKKSGLTANGFLFTNLPLKPADIRNIDDVYQ

SEQ ID NO: 3191076 - protein, 18 aa, Giardia lamblia
LKLCLKFSLNCKEYFVNT

SEQ ID NO: 3191077 - protein, 18 aa, Giardia lamblia
LKLENILILEPYDLDDIL

SEQ ID NO: 3191078 - protein, 21 aa, Giardia lamblia
LKLFKSDLFQLFTYNQPDVPI

SEQ ID NO: 3191079 - protein, 21 aa, Giardia lamblia
LKLGLKQLISLVPEIDEIITR

SEQ ID NO: 3191080 - protein, 30 aa, Giardia lamblia
LKLHNSDVLADPWISSVLLQLDLTAISLQV

SEQ ID NO: 3191081 - protein, 22 aa, Giardia lamblia
LKLNEEIIVLRTSIHVRDEDGR

SEQ ID NO: 3191082 - protein, 26 aa, Giardia lamblia
LKLQAIQLAIGSLNLRLLDRAKTLGT

SEQ ID NO: 3191083 - protein, 29 aa, Giardia lamblia
LKLQTDKALLFFVRWRLTSCIHQWVTFVY

SEQ ID NO: 3191084 - protein, 21 aa, Giardia lamblia
LKLSQLYSFFGESLSSIPAEF

SEQ ID NO: 3191085 - protein, 17 aa, Giardia lamblia
LKLSYPIEHGQIKDWDM

SEQ ID NO: 3191086 - protein, 29 aa, Giardia lamblia
LKLWPVVPTEQIEPLFTLPISASGKVVTK

SEQ ID NO: 3191087 - protein, 27 aa, Giardia lamblia
LKNDYIDIFVHLYPLEQKLSSKGQSLT

SEQ ID NO: 3191088 - protein, 17 aa, Giardia lamblia
LKNFLHRDIKPDNFLIG

SEQ ID NO: 3191089 - protein, 19 aa, Giardia lamblia
LKNFWSDLCGGALGIFRRA

SEQ ID NO: 3191090 - protein, 17 aa, Giardia lamblia
LKNGETAFQRAPVKFSA

SEQ ID NO: 3191091 - protein, 21 aa, Giardia lamblia
LKNHPFFKNINFAIINDPPTI

SEQ ID NO: 3191092 - protein, 20 aa, Giardia lamblia
LKNLPLTGESFKISLQANER

SEQ ID NO: 3191093 - protein, 28 aa, Giardia lamblia
LKNMDIRPTDLPWLCGLYLITGICIDER

SEQ ID NO: 3191094 - protein, 27 aa, Giardia lamblia
LKNTNSFFMRLQEWYSYHFPELKRIMV

SEQ ID NO: 3191095 - protein, 18 aa, Giardia lamblia
LKPHILTVAGRMAAAKCL

SEQ ID NO: 3191096 - protein, 25 aa, Giardia lamblia
LKPNDTLMNLTLDTALLPQGDATDT

SEQ ID NO: 3191097 - protein, 20 aa, Giardia lamblia
LKPQWTYVIGERIQQLSYGR

SEQ ID NO: 3191098 - protein, 26 aa, Giardia lamblia
LKQAPDLCLLYPNPSLAELLLNYRII

SEQ ID NO: 3191099 - protein, 24 aa, Giardia lamblia
LKQISYLRSIFQKVLGVIKGVGHR

SEQ ID NO: 3191100 - protein, 17 aa, Giardia lamblia
LKQNMSRDAELVKKLLE

SEQ ID NO: 3191101 - protein, 17 aa, Giardia lamblia
LKRFYNFEKKFGTATTQ

SEQ ID NO: 3191102 - protein, 22 aa, Giardia lamblia
LKRIHPCHHLYLPVFHQLQAWC

SEQ ID NO: 3191103 - protein, 19 aa, Giardia lamblia
LKRIKAQLEKAHEATGVEL

SEQ ID NO: 3191104 - protein, 20 aa, Giardia lamblia
LKRRARRLQSLLDETPVFYA

SEQ ID NO: 3191105 - protein, 29 aa, Giardia lamblia
LKRVLDAWLKFRPDFKTFLLARDTMNRGT

SEQ ID NO: 3191106 - protein, 26 aa, Giardia lamblia
LKRVRHMQILYPSGSTKPVFFGKGKD

SEQ ID NO: 3191107 - protein, 17 aa, Giardia lamblia
LKRYYSRLNEELTLITQ

SEQ ID NO: 3191108 - protein, 25 aa, Giardia lamblia
LKSCLDLLNSCSFDVLLQSCFLHDR

SEQ ID NO: 3191109 - protein, 24 aa, Giardia lamblia
LKSEDFSFIKYFTTAIMNEKSGLM

SEQ ID NO: 3191110 - protein, 18 aa, Giardia lamblia
LKSFSLQDYISTKTLSAL

SEQ ID NO: 3191111 - protein, 24 aa, Giardia lamblia
LKSKKLILFLDIDNTILYAWGSVK

SEQ ID NO: 3191112 - protein, 25 aa, Giardia lamblia
LKSKKYPALYYAIVSGHIDCVKLLL

SEQ ID NO: 3191113 - protein, 21 aa, Giardia lamblia
LKSLLARIKPDLLNTALEMDK

SEQ ID NO: 3191114 - protein, 20 aa, Giardia lamblia
LKSYLLGSYDKLTPLPTKCS

SEQ ID NO: 3191115 - protein, 23 aa, Giardia lamblia
LKSYQFNILLKRKDTEPPLIPTA

SEQ ID NO: 3191116 - protein, 19 aa, Giardia lamblia
LKTFAEQVMALIYQYKDTL

SEQ ID NO: 3191117 - protein, 26 aa, Giardia lamblia
LKTGETALYYALLHRNYQIADMLLNI

SEQ ID NO: 3191118 - protein, 26 aa, Giardia lamblia
LKTLAVTLYRIVVDLTGLAVKLVERF

SEQ ID NO: 3191119 - protein, 36 aa, Giardia lamblia
LKTLSLRDIVLIFYQIAYGLEYLHSLLIVHHDIKLE

SEQ ID NO: 3191120 - protein, 20 aa, Giardia lamblia
LKTMCDTLLIDTQMVATFDT

SEQ ID NO: 3191121 - protein, 17 aa, Giardia lamblia
LKTNIEIDILQRSIKAK

SEQ ID NO: 3191122 - protein, 31 aa, Giardia lamblia
LKTVTIRYWSYFICGFFRYPYSAVPRFTSLC

SEQ ID NO: 3191123 - protein, 20 aa, Giardia lamblia
LKVMGREPLIISLDNYFVDR

SEQ ID NO: 3191124 - protein, 21 aa, Giardia lamblia
LKVRITEKFVHLPLAIGQDLA

SEQ ID NO: 3191125 - protein, 19 aa, Giardia lamblia
LKVVFIANLTRFIDDERPK

SEQ ID NO: 3191126 - protein, 22 aa, Giardia lamblia
LKVYHILYNTLPNKLVLCSCRL

SEQ ID NO: 3191127 - protein, 25 aa, Giardia lamblia
LKYRKDFIKWYFDQPEMHPNNSPIS

SEQ ID NO: 3191128 - protein, 20 aa, Giardia lamblia
LLAFAAFFSKKNMELPICLV

SEQ ID NO: 3191129 - protein, 31 aa, Giardia lamblia
LLAFDSVTLWSWIPNIFNYTQSTLTKELLDE

SEQ ID NO: 3191130 - protein, 18 aa, Giardia lamblia
LLAGIESSLMQLISKHDP

SEQ ID NO: 3191131 - protein, 24 aa, Giardia lamblia
LLAKIPLSYTFWNYRRDFLSSHQS

SEQ ID NO: 3191132 - protein, 18 aa, Giardia lamblia
LLAPREGQITNFRGQNAL

SEQ ID NO: 3191133 - protein, 27 aa, Giardia lamblia
LLAQLYSPLLQCHMLWRQCFVHQKVFI

SEQ ID NO: 3191134 - protein, 17 aa, Giardia lamblia
LLAYLHSPSKRNAPDIS

SEQ ID NO: 3191135 - protein, 18 aa, Giardia lamblia
LLCNYPEKLLPAILSRCC

SEQ ID NO: 3191136 - protein, 18 aa, Giardia lamblia
LLCQIKLISAQSAYYSNV

SEQ ID NO: 3191137 - protein, 19 aa, Giardia lamblia
LLCQSSMDIFRMSVTDILR

SEQ ID NO: 3191138 - protein, 26 aa, Giardia lamblia
LLCSDVIKNAIIYKKGSLSLDAIQEQ

SEQ ID NO: 3191139 - protein, 24 aa, Giardia lamblia
LLDALERIGWLEPTAIQKEMLTVV

SEQ ID NO: 3191140 - protein, 20 aa, Giardia lamblia
LLDATELHRVQMPVPAAIDS

SEQ ID NO: 3191141 - protein, 24 aa, Giardia lamblia
LLDDTLVYLTNQKTRRSKVSGESI

SEQ ID NO: 3191142 - protein, 18 aa, Giardia lamblia
LLDGVALTYLRTGAASGV

SEQ ID NO: 3191143 - protein, 25 aa, Giardia lamblia
LLDIIMQNRKLYPYVRPEKYVIEAP

SEQ ID NO: 3191144 - protein, 22 aa, Giardia lamblia
LLDLCIYDIRNPGQPLSIYAIN

SEQ ID NO: 3191145 - protein, 20 aa, Giardia lamblia
LLDLHMCFIGRLIARKQLEN

SEQ ID NO: 3191146 - protein, 33 aa, Giardia lamblia
LLDPHPPIDYVPYSLILVFPFCPCDLHSFLHSG

SEQ ID NO: 3191147 - protein, 18 aa, Giardia lamblia
LLDVRKRLNFFLKRTNGT

SEQ ID NO: 3191148 - protein, 36 aa, Giardia lamblia
LLDVSSFSTLFPMYREPYITSIWKDLANMLSSKYGI

SEQ ID NO: 3191149 - protein, 19 aa, Giardia lamblia
LLEALLEPDPRTRPDWREI

SEQ ID NO: 3191150 - protein, 28 aa, Giardia lamblia
LLEARLATYTPLMRAIMKGKASDIEANL

SEQ ID NO: 3191151 - protein, 26 aa, Giardia lamblia
LLEDCDFTFHFGRRYSLIGRNGTGKS

SEQ ID NO: 3191152 - protein, 25 aa, Giardia lamblia
LLEDRVPVLFVCGPLHSGKSYTVEG

SEQ ID NO: 3191153 - protein, 33 aa, Giardia lamblia
LLEHLRRVRKMLVIDQILRLRAAVGADRVFRDI

SEQ ID NO: 3191154 - protein, 20 aa, Giardia lamblia
LLEIRKTPGLLLTDDQIRAA

SEQ ID NO: 3191155 - protein, 17 aa, Giardia lamblia
LLEKAAGTPALGKALTS

SEQ ID NO: 3191156 - protein, 26 aa, Giardia lamblia
LLEKEGGMRSGYGWTALMLAAENGYV

SEQ ID NO: 3191157 - protein, 34 aa, Giardia lamblia
LLEKLIKENVLPKNFLLPFISKVALTRYLPTILE

SEQ ID NO: 3191158 - protein, 17 aa, Giardia lamblia
LLELLSYSVLDDPLFND

SEQ ID NO: 3191159 - protein, 18 aa, Giardia lamblia
LLELTRTLKVHEILYHFP

SEQ ID NO: 3191160 - protein, 33 aa, Giardia lamblia
LLEQLRHWVHCRPIIGKLFYQDFDLHKTGLVTA

SEQ ID NO: 3191161 - protein, 25 aa, Giardia lamblia
LLEQLSTEFLTLPKTSLLGKLAEIR

SEQ ID NO: 3191162 - protein, 17 aa, Giardia lamblia
LLERLVKISKNYLSRLL

SEQ ID NO: 3191163 - protein, 25 aa, Giardia lamblia
LLETPGCIVPLRRPLKLTHSSALLF

SEQ ID NO: 3191164 - protein, 19 aa, Giardia lamblia
LLETSPYLQPAYITEFSAN

SEQ ID NO: 3191165 - protein, 18 aa, Giardia lamblia
LLETYLVEFLAAPGFTPE

SEQ ID NO: 3191166 - protein, 18 aa, Giardia lamblia
LLEVILPRNTQFGSRDTA

SEQ ID NO: 3191167 - protein, 24 aa, Giardia lamblia
LLEYARFFARIVSIPASMKAHIYD

SEQ ID NO: 3191168 - protein, 19 aa, Giardia lamblia
LLFQAKRVKQGGWTALMMA

SEQ ID NO: 3191169 - protein, 25 aa, Giardia lamblia
LLGKESHLLVYFPRFAMGTERAFKR

SEQ ID NO: 3191170 - protein, 23 aa, Giardia lamblia
LLGKFPMIIGSELTYQLPGVEEL

SEQ ID NO: 3191171 - protein, 29 aa, Giardia lamblia
LLGKLAEIRERVWWEVYSSTWSETSRPKT

SEQ ID NO: 3191172 - protein, 30 aa, Giardia lamblia
LLGLPVVIRRPYISPIMLFTLDPTYQDNTP

SEQ ID NO: 3191173 - protein, 18 aa, Giardia lamblia
LLGLVRDGIPILGEKELL

SEQ ID NO: 3191174 - protein, 43 aa, Giardia lamblia
LLGRISFDKVFLLSLKRRSLCYPLLLLQLFSSRVNGAAKLLFS

SEQ ID NO: 3191175 - protein, 25 aa, Giardia lamblia
LLGSCRGLSLSAAPPRQLGIADIIQ

SEQ ID NO: 3191176 - protein, 27 aa, Giardia lamblia
LLHDTHLAMKLLGKQVAYYAASAADHS

SEQ ID NO: 3191177 - protein, 21 aa, Giardia lamblia
LLHEIVKLKKEIYKKDKQILD

SEQ ID NO: 3191178 - protein, 18 aa, Giardia lamblia
LLHLAHWMLAVESTTRIE

SEQ ID NO: 3191179 - protein, 21 aa, Giardia lamblia
LLHPARLAFHLLKQALDGKKP

SEQ ID NO: 3191180 - protein, 24 aa, Giardia lamblia
LLHSSLCRLLVQLVVRILRIHRDN

SEQ ID NO: 3191181 - protein, 17 aa, Giardia lamblia
LLHYELVQNILEYMFSF

SEQ ID NO: 3191182 - protein, 17 aa, Giardia lamblia
LLIAASLNYSGICKALI

SEQ ID NO: 3191183 - protein, 19 aa, Giardia lamblia
LLIELEYFHGSMKALIHDA

SEQ ID NO: 3191184 - protein, 17 aa, Giardia lamblia
LLISPMERNFVWATLCF

SEQ ID NO: 3191185 - protein, 17 aa, Giardia lamblia
LLKCLLGALLENRELAI

SEQ ID NO: 3191186 - protein, 19 aa, Giardia lamblia
LLKDLRTKRAEMHLRRVQY

SEQ ID NO: 3191187 - protein, 23 aa, Giardia lamblia
LLKEAIDVPPPPLPSGQHSTRAR

SEQ ID NO: 3191188 - protein, 17 aa, Giardia lamblia
LLKEIEFLRRLEGKSHI

SEQ ID NO: 3191189 - protein, 20 aa, Giardia lamblia
LLKELRKLEWTALGLHSKES

SEQ ID NO: 3191190 - protein, 17 aa, Giardia lamblia
LLKLMRNIDTLQPYDHL

SEQ ID NO: 3191191 - protein, 18 aa, Giardia lamblia
LLKSGKILQPLTSTPEHI

SEQ ID NO: 3191192 - protein, 20 aa, Giardia lamblia
LLKSVIDGYNVCVLAYGCTG

SEQ ID NO: 3191193 - protein, 25 aa, Giardia lamblia
LLKVQSHLAWFKHYSPVIVALLSPA

SEQ ID NO: 3191194 - protein, 18 aa, Giardia lamblia
LLLCLVCAHLLDATTFGA

SEQ ID NO: 3191195 - protein, 18 aa, Giardia lamblia
LLLILEDMHCVLSVLGSK

SEQ ID NO: 3191196 - protein, 17 aa, Giardia lamblia
LLLMLVCKIKRPNNFFI

SEQ ID NO: 3191197 - protein, 19 aa, Giardia lamblia
LLLMNMPLDRVTPDPEFPI

SEQ ID NO: 3191198 - protein, 23 aa, Giardia lamblia
LLLNDTIRYNPALKRLGIDVKQS

SEQ ID NO: 3191199 - protein, 17 aa, Giardia lamblia
LLLPLEANKRCNCGRTA

SEQ ID NO: 3191200 - protein, 17 aa, Giardia lamblia
LLLQFTEQRFQNAHDMT

SEQ ID NO: 3191201 - protein, 18 aa, Giardia lamblia
LLLRMKKLIKPVVLNRRK

SEQ ID NO: 3191202 - protein, 28 aa, Giardia lamblia
LLMDEQVFLYYVSYLRTIGMDGIITPEF

SEQ ID NO: 3191203 - protein, 31 aa, Giardia lamblia
LLMSIPLAAYPQNLPVLIRVGWRASANGQGV

SEQ ID NO: 3191204 - protein, 22 aa, Giardia lamblia
LLMSLMDALWLLSKDVARPIFK

SEQ ID NO: 3191205 - protein, 24 aa, Giardia lamblia
LLNCLTMLFHAKLIMTQMLMTSYE

SEQ ID NO: 3191206 - protein, 36 aa, Giardia lamblia
LLNDGEIPFLFTFESLLPFTVSPITGIILPNEQCPV

SEQ ID NO: 3191207 - protein, 18 aa, Giardia lamblia
LLNIRKQTGLPNYVLAMD

SEQ ID NO: 3191208 - protein, 17 aa, Giardia lamblia
LLNIVSLVPIDLEIYWY

SEQ ID NO: 3191209 - protein, 17 aa, Giardia lamblia
LLNVQSLVDNKPGLRPP

SEQ ID NO: 3191210 - protein, 22 aa, Giardia lamblia
LLPCTSCDLLWPVTFEVSRLMT

SEQ ID NO: 3191211 - protein, 17 aa, Giardia lamblia
LLPNKRTPLMLAADSGC

SEQ ID NO: 3191212 - protein, 18 aa, Giardia lamblia
LLPRAQRPLPLLLNEYDD

SEQ ID NO: 3191213 - protein, 26 aa, Giardia lamblia
LLPTRHASWRFVMTLLAVGMKIFELT

SEQ ID NO: 3191214 - protein, 19 aa, Giardia lamblia
LLPYEGGMQTTIGWTALME

SEQ ID NO: 3191215 - protein, 24 aa, Giardia lamblia
LLQALQYCHSPTKPGFDYGTVIIH

SEQ ID NO: 3191216 - protein, 20 aa, Giardia lamblia
LLQDFVDQIPLTSAASYLCH

SEQ ID NO: 3191217 - protein, 30 aa, Giardia lamblia
LLQESQLMRSAILLAVDRIAPFIMIDKTDI

SEQ ID NO: 3191218 - protein, 17 aa, Giardia lamblia
LLQITVSGFREAIRFGI

SEQ ID NO: 3191219 - protein, 28 aa, Giardia lamblia
LLQQEAKRLIKLPSLQAKLHPFKDHGQR

SEQ ID NO: 3191220 - protein, 19 aa, Giardia lamblia
LLQTSPLLYNISNTNLCVP

SEQ ID NO: 3191221 - protein, 18 aa, Giardia lamblia
LLQYVAKISPRSVYTSGK

SEQ ID NO: 3191222 - protein, 18 aa, Giardia lamblia
LLQYYKTIRYGKYVIIYS

SEQ ID NO: 3191223 - protein, 25 aa, Giardia lamblia
LLRARNCPFIVALNKIDRLYNWKSV

SEQ ID NO: 3191224 - protein, 24 aa, Giardia lamblia
LLRDWASVSLLEKPLKGTLPINAC

SEQ ID NO: 3191225 - protein, 20 aa, Giardia lamblia
LLREVDALKLRIKEASLNSQ

SEQ ID NO: 3191226 - protein, 17 aa, Giardia lamblia
LLRFLDLYVGQNMNDLA

SEQ ID NO: 3191227 - protein, 19 aa, Giardia lamblia
LLRHAIAQSSHRGLKLKRL

SEQ ID NO: 3191228 - protein, 17 aa, Giardia lamblia
LLRLSTLLQKHSARFSL

SEQ ID NO: 3191229 - protein, 37 aa, Giardia lamblia
LLRNCQPPLTYLRAPNELPLKTLFTAPTSNWGSSMPT

SEQ ID NO: 3191230 - protein, 27 aa, Giardia lamblia
LLRNIQQYLLRHLQELCRLLDIPYDPI

SEQ ID NO: 3191231 - protein, 18 aa, Giardia lamblia
LLRPGMETPLMRSAAVGN

SEQ ID NO: 3191232 - protein, 33 aa, Giardia lamblia
LLRQLYLRYHEVVGLSFLKIDLFKAVTGLSEEL

SEQ ID NO: 3191233 - protein, 27 aa, Giardia lamblia
LLRQYDNLLRVYPFRVFKTPLATESYV

SEQ ID NO: 3191234 - protein, 20 aa, Giardia lamblia
LLRRLFHVPNRPLNRRVTGL

SEQ ID NO: 3191235 - protein, 18 aa, Giardia lamblia
LLRTLPLHQYDKLRDDYK

SEQ ID NO: 3191236 - protein, 18 aa, Giardia lamblia
LLSCIQRLQTGLGSLREE

SEQ ID NO: 3191237 - protein, 23 aa, Giardia lamblia
LLSCKPVVYLLNMSEADYSKKKN

SEQ ID NO: 3191238 - protein, 20 aa, Giardia lamblia
LLSELGIRSPAGWTALMSAA

SEQ ID NO: 3191239 - protein, 25 aa, Giardia lamblia
LLSGFDFACPLTLLADKEQLQVYGS

SEQ ID NO: 3191240 - protein, 23 aa, Giardia lamblia
LLSHVKIVLLLEPKPYIPQSLGR

SEQ ID NO: 3191241 - protein, 21 aa, Giardia lamblia
LLSICFPQVEASSTAFRRIAT

SEQ ID NO: 3191242 - protein, 19 aa, Giardia lamblia
LLSIKFNFAGFTPDINNMK

SEQ ID NO: 3191243 - protein, 31 aa, Giardia lamblia
LLSPHNIQIADFFLKYLNIYLSENYSEIVGY

SEQ ID NO: 3191244 - protein, 22 aa, Giardia lamblia
LLSPKVPPLLHEPSHQPLSTTL

SEQ ID NO: 3191245 - protein, 19 aa, Giardia lamblia
LLSQLFHPNIVSYKQSFLE

SEQ ID NO: 3191246 - protein, 27 aa, Giardia lamblia
LLSSKYKLVEVLFYHTCFGCPPQLIHG

SEQ ID NO: 3191247 - protein, 18 aa, Giardia lamblia
LLSSYRQKIRELEAALQT

SEQ ID NO: 3191248 - protein, 19 aa, Giardia lamblia
LLSYPCEMYYYINDENYIY

SEQ ID NO: 3191249 - protein, 17 aa, Giardia lamblia
LLTCRKYLERSVDSHWC

SEQ ID NO: 3191250 - protein, 22 aa, Giardia lamblia
LLTEAFNLLNPRSLLSAGLSIA

SEQ ID NO: 3191251 - protein, 17 aa, Giardia lamblia
LLTFFRAVAPHISGISV

SEQ ID NO: 3191252 - protein, 21 aa, Giardia lamblia
LLTIPTGVRGFVFVGWTRDPM

SEQ ID NO: 3191253 - protein, 17 aa, Giardia lamblia
LLTLFGTLHPSLIKPQL

SEQ ID NO: 3191254 - protein, 18 aa, Giardia lamblia
LLTLLRTFTLEKERMQAI

SEQ ID NO: 3191255 - protein, 33 aa, Giardia lamblia
LLTNFDFLDAFLEDFFFSTIRYEPDSHQPNILH

SEQ ID NO: 3191256 - protein, 17 aa, Giardia lamblia
LLTRLSIGYAPKPKAYD

SEQ ID NO: 3191257 - protein, 19 aa, Giardia lamblia
LLTTHRFHRLWNQQKKFSE

SEQ ID NO: 3191258 - protein, 24 aa, Giardia lamblia
LLTVSVFNPSLINLLTNFKVDNTG

SEQ ID NO: 3191259 - protein, 19 aa, Giardia lamblia
LLVAHRIAEVVRSKPNCVL

SEQ ID NO: 3191260 - protein, 19 aa, Giardia lamblia
LLVALLKVRDTILFTLEDL

SEQ ID NO: 3191261 - protein, 27 aa, Giardia lamblia
LLVHTYDAWLLGIRPYLKSFNTEYLKK

SEQ ID NO: 3191262 - protein, 17 aa, Giardia lamblia
LLWPVTFEVSRLMTLEH

SEQ ID NO: 3191263 - protein, 17 aa, Giardia lamblia
LLYALKSGDKRLATIST

SEQ ID NO: 3191264 - protein, 20 aa, Giardia lamblia
LLYKLEFGMRGNRGETALMA

SEQ ID NO: 3191265 - protein, 21 aa, Giardia lamblia
LLYPVEVFATTPLQPSPDLWT

SEQ ID NO: 3191266 - protein, 17 aa, Giardia lamblia
LLYTHPKAEAILGMSQV

SEQ ID NO: 3191267 - protein, 17 aa, Giardia lamblia
LMAFVSGHVRVISPLLK

SEQ ID NO: 3191268 - protein, 29 aa, Giardia lamblia
LMALHRYVRMIKRIPTSLRPRCLRHVYAV

SEQ ID NO: 3191269 - protein, 20 aa, Giardia lamblia
LMAQYGILGTQYARDALAEL

SEQ ID NO: 3191270 - protein, 18 aa, Giardia lamblia
LMCAVLENDPHMVQLLAS

SEQ ID NO: 3191271 - protein, 17 aa, Giardia lamblia
LMCIVVDARFPLAHLPV

SEQ ID NO: 3191272 - protein, 24 aa, Giardia lamblia
LMDGIAPSCKLCRLYYSCSQTILP

SEQ ID NO: 3191273 - protein, 18 aa, Giardia lamblia
LMDPPPVISISIGAQVII

SEQ ID NO: 3191274 - protein, 23 aa, Giardia lamblia
LMEKLEVMIMRGLQVVKGIDNVE

SEQ ID NO: 3191275 - protein, 19 aa, Giardia lamblia
LMERLAVLEAQTMHKQARV

SEQ ID NO: 3191276 - protein, 24 aa, Giardia lamblia
LMEYERNISGWTELIYAAYRGDID

SEQ ID NO: 3191277 - protein, 18 aa, Giardia lamblia
LMFAARNCNLIGVQVLAG

SEQ ID NO: 3191278 - protein, 17 aa, Giardia lamblia
LMFAAYYGYTDMVGLLL

SEQ ID NO: 3191279 - protein, 22 aa, Giardia lamblia
LMFDKALKCKFAYEKYGKLGSD

SEQ ID NO: 3191280 - protein, 17 aa, Giardia lamblia
LMFNISFTKATVGTAPL

SEQ ID NO: 3191281 - protein, 19 aa, Giardia lamblia
LMGHFDIAIFLSIRGYNCT

SEQ ID NO: 3191282 - protein, 17 aa, Giardia lamblia
LMGIGYPEKIEVTNPSD

SEQ ID NO: 3191283 - protein, 30 aa, Giardia lamblia
LMHAVLNKRFNCIQLLLRQETGLRDIKGRT

SEQ ID NO: 3191284 - protein, 19 aa, Giardia lamblia
LMHNTTIAQYLKLQFACLK

SEQ ID NO: 3191285 - protein, 17 aa, Giardia lamblia
LMHSIIRQNMHEFNKHY

SEQ ID NO: 3191286 - protein, 18 aa, Giardia lamblia
LMHTAIHDYLQVSKILLP

SEQ ID NO: 3191287 - protein, 25 aa, Giardia lamblia
LMIAANFNFAPACSILYESESTFYQ

SEQ ID NO: 3191288 - protein, 26 aa, Giardia lamblia
LMICAQYNYVEIGRKLLPIEARLQTD

SEQ ID NO: 3191289 - protein, 29 aa, Giardia lamblia
LMINQKPHQIYFSPFVQDLAKRIKAKTGM

SEQ ID NO: 3191290 - protein, 24 aa, Giardia lamblia
LMKAAKFNDIKLAKMLAPVEAGIV

SEQ ID NO: 3191291 - protein, 20 aa, Giardia lamblia
LMKKYKRLLREETRSPIHQH

SEQ ID NO: 3191292 - protein, 27 aa, Giardia lamblia
LMLAAARDFYEVCAILGPYEADVRTAD

SEQ ID NO: 3191293 - protein, 20 aa, Giardia lamblia
LMLAAHFNYAEGCKMLLSDE

SEQ ID NO: 3191294 - protein, 18 aa, Giardia lamblia
LMLAALNGDLMLVDQLRH

SEQ ID NO: 3191295 - protein, 19 aa, Giardia lamblia
LMLAAVCNEGEACKRLVPY

SEQ ID NO: 3191296 - protein, 20 aa, Giardia lamblia
LMLACRINDLEMIRLLAPEE

SEQ ID NO: 3191297 - protein, 18 aa, Giardia lamblia
LMLAIYNNDISELNKYIY

SEQ ID NO: 3191298 - protein, 22 aa, Giardia lamblia
LMLAVQRNLIPYVTRLAPLEAG

SEQ ID NO: 3191299 - protein, 18 aa, Giardia lamblia
LMNAYLELAKKYNVSWLN

SEQ ID NO: 3191300 - protein, 23 aa, Giardia lamblia
LMNMGKHPFLAKNQASLIVKILK

SEQ ID NO: 3191301 - protein, 19 aa, Giardia lamblia
LMNPNPLRRLMPTEALTHP

SEQ ID NO: 3191302 - protein, 29 aa, Giardia lamblia
LMPATHYRCDVLLFLLGTLALAQFENSSK

SEQ ID NO: 3191303 - protein, 26 aa, Giardia lamblia
LMPDEYDFYPMSFYLPADSAEMRQYI

SEQ ID NO: 3191304 - protein, 22 aa, Giardia lamblia
LMPKPIRYYTTFRNTIWTVLQE

SEQ ID NO: 3191305 - protein, 18 aa, Giardia lamblia
LMPQTEPDFVFRQRTMRA

SEQ ID NO: 3191306 - protein, 18 aa, Giardia lamblia
LMRAVAYGHAKIVEILLE

SEQ ID NO: 3191307 - protein, 22 aa, Giardia lamblia
LMSSVYRRSIGCFRLLLEAEAG

SEQ ID NO: 3191308 - protein, 18 aa, Giardia lamblia
LMSTIPRKDWQASISKVC

SEQ ID NO: 3191309 - protein, 18 aa, Giardia lamblia
LMTAIFGLRAECAAILAP

SEQ ID NO: 3191310 - protein, 28 aa, Giardia lamblia
LMTALSFEWVLGHFLAITGTISLDDHKR

SEQ ID NO: 3191311 - protein, 33 aa, Giardia lamblia
LMTELSRELTSPLFRQLPPGLITSARNLRRSTI

SEQ ID NO: 3191312 - protein, 18 aa, Giardia lamblia
LMTRAFNIALEKAFSLCY

SEQ ID NO: 3191313 - protein, 27 aa, Giardia lamblia
LMTYRIADFPFFRALFAFASVDPKVPI

SEQ ID NO: 3191314 - protein, 21 aa, Giardia lamblia
LMVMKYPITPLSQNSGLLYWV

SEQ ID NO: 3191315 - protein, 31 aa, Giardia lamblia
LMVSFLQDQLRTFELWLLDAHPSTEIPDVLP

SEQ ID NO: 3191316 - protein, 18 aa, Giardia lamblia
LMVYVNGLVMLGTASGHR

SEQ ID NO: 3191317 - protein, 18 aa, Giardia lamblia
LMYAAESGQIPLAKPLVK

SEQ ID NO: 3191318 - protein, 18 aa, Giardia lamblia
LMYAAFLGNYAMAKRLLK

SEQ ID NO: 3191319 - protein, 17 aa, Giardia lamblia
LMYACMHGHPECVELLY

SEQ ID NO: 3191320 - protein, 18 aa, Giardia lamblia
LMYAEAKLTRHDGMTALM

SEQ ID NO: 3191321 - protein, 19 aa, Giardia lamblia
LMYCIAPEVLLGDKLTPAA

SEQ ID NO: 3191322 - protein, 18 aa, Giardia lamblia
LMYGIDLSNLYNLCSSLD

SEQ ID NO: 3191323 - protein, 27 aa, Giardia lamblia
LMYKERSIDKLLYLIAIGDKATQTSAA

SEQ ID NO: 3191324 - protein, 25 aa, Giardia lamblia
LNAHDGFTPQLKLSGSSGFNCQTKI

SEQ ID NO: 3191325 - protein, 21 aa, Giardia lamblia
LNAPKHWLLDKMGGIWAPRPT

SEQ ID NO: 3191326 - protein, 17 aa, Giardia lamblia
LNCFLSGSVNPNITGYS

SEQ ID NO: 3191327 - protein, 25 aa, Giardia lamblia
LNCPAFNELLLDAIELMRPSSLYIQ

SEQ ID NO: 3191328 - protein, 18 aa, Giardia lamblia
LNCQLLDLGTRFSGMQTE

SEQ ID NO: 3191329 - protein, 20 aa, Giardia lamblia
LNCRVISGHVFRVSRPLRDV

SEQ ID NO: 3191330 - protein, 26 aa, Giardia lamblia
LNDNVLSPLLLPSGSRYRLQSLKESS

SEQ ID NO: 3191331 - protein, 30 aa, Giardia lamblia
LNDPMTLEALFIFTLVWSIGGLIHDQDRTN

SEQ ID NO: 3191332 - protein, 33 aa, Giardia lamblia
LNDTYILKTAYYTFYLPLIMGYRSGVLFGNMAI

SEQ ID NO: 3191333 - protein, 18 aa, Giardia lamblia
LNEDPLLSGLLRYRIVGK

SEQ ID NO: 3191334 - protein, 18 aa, Giardia lamblia
LNEKTLECDILNDKLQKL

SEQ ID NO: 3191335 - protein, 31 aa, Giardia lamblia
LNELEPKDLWQNFFFMCGIPHGSGNVTAIVQ

SEQ ID NO: 3191336 - protein, 23 aa, Giardia lamblia
LNELSVNLVPFPELNLVCTSLAP

SEQ ID NO: 3191337 - protein, 21 aa, Giardia lamblia
LNEMLIRSNHILFMTADPYSQ

SEQ ID NO: 3191338 - protein, 25 aa, Giardia lamblia
LNEVDPLLQAANFICDEDLKVLAYL

SEQ ID NO: 3191339 - protein, 19 aa, Giardia lamblia
LNFAIFIKNTELVEKLLAL

SEQ ID NO: 3191340 - protein, 21 aa, Giardia lamblia
LNFISDLVELVGHYEEVVVTN

SEQ ID NO: 3191341 - protein, 19 aa, Giardia lamblia
LNFLVFPEMNDNGLKGIFS

SEQ ID NO: 3191342 - protein, 17 aa, Giardia lamblia
LNFMLASNPAKRFSASD

SEQ ID NO: 3191343 - protein, 25 aa, Giardia lamblia
LNGKTVYFHKCILTRAGRSFSHDAA

SEQ ID NO: 3191344 - protein, 26 aa, Giardia lamblia
LNGVFSLLMLILLDIGTERPEIPQDD

SEQ ID NO: 3191345 - protein, 28 aa, Giardia lamblia
LNHEVNSILLLDVAPLSLGLETLGGIFS

SEQ ID NO: 3191346 - protein, 25 aa, Giardia lamblia
LNHKEIVPFFKFYKGVGRHSQARGS

SEQ ID NO: 3191347 - protein, 36 aa, Giardia lamblia
LNHNELTTFLLPKEQRIFYLFYNPKSMTAFNDYMYL

SEQ ID NO: 3191348 - protein, 19 aa, Giardia lamblia
LNHVTLMTNCRMMDCPRGV

SEQ ID NO: 3191349 - protein, 33 aa, Giardia lamblia
LNIESDLELYTFYGIFRDIVYGMYLGMDTRGHL

SEQ ID NO: 3191350 - protein, 25 aa, Giardia lamblia
LNIIEDYLRYREYLYCRIDGSTDLE

SEQ ID NO: 3191351 - protein, 20 aa, Giardia lamblia
LNIKLPRFYSNPKNKAIFDQ

SEQ ID NO: 3191352 - protein, 26 aa, Giardia lamblia
LNITDNIFLGTFIRCLRYFQHSILRE

SEQ ID NO: 3191353 - protein, 24 aa, Giardia lamblia
LNKEKVTIYVPPNEPVRQGKVLAC

SEQ ID NO: 3191354 - protein, 29 aa, Giardia lamblia
LNKERLFIDWEMNVFLPIQQRIMNEVADR

SEQ ID NO: 3191355 - protein, 25 aa, Giardia lamblia
LNKLLPFQREDFIGIFKAMDGKGVN

SEQ ID NO: 3191356 - protein, 33 aa, Giardia lamblia
LNKQFKDIFRRAFMSRIFPPDKLAELGQTHVKG

SEQ ID NO: 3191357 - protein, 32 aa, Giardia lamblia
LNKQFKDIFRRAFMSRIFPPDKLAKLGQTHVK

SEQ ID NO: 3191358 - protein, 22 aa, Giardia lamblia
LNKSKLCRRLVHFEGDLTGGSD

SEQ ID NO: 3191359 - protein, 17 aa, Giardia lamblia
LNKYLLQTRLGLPNPTA

SEQ ID NO: 3191360 - protein, 24 aa, Giardia lamblia
LNLAVRTPLFFTEDHQKVCFIAGR

SEQ ID NO: 3191361 - protein, 18 aa, Giardia lamblia
LNLDYPRVQQEPIRALST

SEQ ID NO: 3191362 - protein, 26 aa, Giardia lamblia
LNLGIVRALVYFKAELMLVNNGPYQV

SEQ ID NO: 3191363 - protein, 20 aa, Giardia lamblia
LNLGLQPYKYLVLKEDPRHS

SEQ ID NO: 3191364 - protein, 21 aa, Giardia lamblia
LNLILARIILNSIFVYDSSST

SEQ ID NO: 3191365 - protein, 17 aa, Giardia lamblia
LNLYLHFSENITTPQRC

SEQ ID NO: 3191366 - protein, 20 aa, Giardia lamblia
LNMMARSKLGAMAQLNAITA

SEQ ID NO: 3191367 - protein, 19 aa, Giardia lamblia
LNMMGFRFSNAFVEPIWND

SEQ ID NO: 3191368 - protein, 27 aa, Giardia lamblia
LNMRHNDLLAILRDMKSAIGYQSNEVG

SEQ ID NO: 3191369 - protein, 29 aa, Giardia lamblia
LNNDFTLLREIIIVYELYIEKLIELMSAS

SEQ ID NO: 3191370 - protein, 17 aa, Giardia lamblia
LNNILTVLPLKELAHIK

SEQ ID NO: 3191371 - protein, 28 aa, Giardia lamblia
LNNLEPSMWSFIHPARIIRIETGHIKLF

SEQ ID NO: 3191372 - protein, 29 aa, Giardia lamblia
LNNLIDVDALRSYLLRCLNSDGGFGTTPG

SEQ ID NO: 3191373 - protein, 25 aa, Giardia lamblia
LNNLLDFFDHHRPDLVRKVTLPAMR

SEQ ID NO: 3191374 - protein, 29 aa, Giardia lamblia
LNNLRASYPHLIFFANGGVWNLETHEHLR

SEQ ID NO: 3191375 - protein, 29 aa, Giardia lamblia
LNNRRIISALDFLCLYDCMASSKISLTPV

SEQ ID NO: 3191376 - protein, 25 aa, Giardia lamblia
LNPDECIVVGLGWIAAIRSPRQKVA

SEQ ID NO: 3191377 - protein, 31 aa, Giardia lamblia
LNPHERITVMPLLHILELYRDNLKKVSEIKE

SEQ ID NO: 3191378 - protein, 30 aa, Giardia lamblia
LNPVKMYIFSYIRKIYMFTSSPCTYEQCES

SEQ ID NO: 3191379 - protein, 27 aa, Giardia lamblia
LNQLGPVLKEAQLRAWYSDICEEISRL

SEQ ID NO: 3191380 - protein, 26 aa, Giardia lamblia
LNQLPKELLFLHMNLQEPKELAFHPQ

SEQ ID NO: 3191381 - protein, 18 aa, Giardia lamblia
LNRILSETFVWSVVGQVA

SEQ ID NO: 3191382 - protein, 20 aa, Giardia lamblia
LNRMISDLRKANTEILMLAP

SEQ ID NO: 3191383 - protein, 22 aa, Giardia lamblia
LNRTDILPLLHATYGWQDEDGK

SEQ ID NO: 3191384 - protein, 21 aa, Giardia lamblia
LNRVTRLVPGYFPLSDDLKTH

SEQ ID NO: 3191385 - protein, 17 aa, Giardia lamblia
LNRYKLLKMVGSATFSN

SEQ ID NO: 3191386 - protein, 28 aa, Giardia lamblia
LNRYMEYLRAIPLVRIEKLTRTLMENSC

SEQ ID NO: 3191387 - protein, 27 aa, Giardia lamblia
LNSEKKPLQYKMLISPGTINKHKTSVP

SEQ ID NO: 3191388 - protein, 24 aa, Giardia lamblia
LNSESCLTPYIPFIPDVVGLSTEN

SEQ ID NO: 3191389 - protein, 34 aa, Giardia lamblia
LNSFSQLRDSIHNRPLYIMMEPSLGCDPMHDHEA

SEQ ID NO: 3191390 - protein, 24 aa, Giardia lamblia
LNSGLYNFLIVACGLIECSVQPRG

SEQ ID NO: 3191391 - protein, 35 aa, Giardia lamblia
LNSHMLRGVYFKQPWMLMNIYLDLQTMCPELVDIR

SEQ ID NO: 3191392 - protein, 24 aa, Giardia lamblia
LNSLAHVHVLLVNKNWSMIPTLEL

SEQ ID NO: 3191393 - protein, 24 aa, Giardia lamblia
LNSPRGYCLTINILSRHPAQKRSK

SEQ ID NO: 3191394 - protein, 23 aa, Giardia lamblia
LNSRRVCLINIPPSGVVALNVFV

SEQ ID NO: 3191395 - protein, 21 aa, Giardia lamblia
LNTAFDPELSTSLKSVALGTP

SEQ ID NO: 3191396 - protein, 18 aa, Giardia lamblia
LNTAPQFLDALTGAAVLT

SEQ ID NO: 3191397 - protein, 17 aa, Giardia lamblia
LNTCFKVPNQQRSFRTC

SEQ ID NO: 3191398 - protein, 25 aa, Giardia lamblia
LNTDKLEYNYRLLAARDVESQNLMV

SEQ ID NO: 3191399 - protein, 22 aa, Giardia lamblia
LNTEVTYLKGLLEKEHETVKSL

SEQ ID NO: 3191400 - protein, 30 aa, Giardia lamblia
LNTKEFDYAPYIPEFLSYPAKGDRQDWKQA

SEQ ID NO: 3191401 - protein, 17 aa, Giardia lamblia
LNTLAGFKSLYPHNLSI

SEQ ID NO: 3191402 - protein, 23 aa, Giardia lamblia
LNTLLDKKIVFLSGPRRHLNRIR

SEQ ID NO: 3191403 - protein, 18 aa, Giardia lamblia
LNTPFRVDSLPPSQRQSR

SEQ ID NO: 3191404 - protein, 17 aa, Giardia lamblia
LNVALNRQLTLLRSYEG

SEQ ID NO: 3191405 - protein, 17 aa, Giardia lamblia
LNVARILSFFRISFESE

SEQ ID NO: 3191406 - protein, 18 aa, Giardia lamblia
LNVIHILHHNCVPVPVHW

SEQ ID NO: 3191407 - protein, 40 aa, Giardia lamblia
LNVITQLLSPDPLQRPRIQSLLLTGPIMSILQGSPPLSPL

SEQ ID NO: 3191408 - protein, 18 aa, Giardia lamblia
LNVLRIINEPTAAAIAYG

SEQ ID NO: 3191409 - protein, 30 aa, Giardia lamblia
LNVNRIHRPFFMTILFKLALSLSQLCNFMP

SEQ ID NO: 3191410 - protein, 18 aa, Giardia lamblia
LNVNWERAIDARIERLTD

SEQ ID NO: 3191411 - protein, 27 aa, Giardia lamblia
LNVSLPDAIFPLLPSTNPLAVCRYIDS

SEQ ID NO: 3191412 - protein, 24 aa, Giardia lamblia
LNYDGAFVLPYFDVKKDSIVTLGA

SEQ ID NO: 3191413 - protein, 19 aa, Giardia lamblia
LNYGIPIHRISRCVFCSPD

SEQ ID NO: 3191414 - protein, 33 aa, Giardia lamblia
LNYQFYAIAKMNLSLQEEYWILRGRFAKTMAKM

SEQ ID NO: 3191415 - protein, 17 aa, Giardia lamblia
LPALIQQYPSLFNGHVL

SEQ ID NO: 3191416 - protein, 19 aa, Giardia lamblia
LPALMPSTAFILKCLEFTD

SEQ ID NO: 3191417 - protein, 23 aa, Giardia lamblia
LPALNGTYHYAGDLPYLRELDTE

SEQ ID NO: 3191418 - protein, 24 aa, Giardia lamblia
LPALSGNLPAVSYLPSSTLPCLPL

SEQ ID NO: 3191419 - protein, 25 aa, Giardia lamblia
LPANNILLMFRETGLLIPDKESSDN

SEQ ID NO: 3191420 - protein, 17 aa, Giardia lamblia
LPAPTYHPPGYSGVPPL

SEQ ID NO: 3191421 - protein, 23 aa, Giardia lamblia
LPASTLQILGSERALFRAKKMRS

SEQ ID NO: 3191422 - protein, 34 aa, Giardia lamblia
LPCKRLSRISYYPRLLLKKVGIINFPASMRKKAG

SEQ ID NO: 3191423 - protein, 19 aa, Giardia lamblia
LPCWTERLSFFTTYSPEML

SEQ ID NO: 3191424 - protein, 25 aa, Giardia lamblia
LPDGLLFSMALFRAPVKEKESTSQP

SEQ ID NO: 3191425 - protein, 25 aa, Giardia lamblia
LPDGYTYGIYLQQGHNLWVCIGLIH

SEQ ID NO: 3191426 - protein, 20 aa, Giardia lamblia
LPDIQRILDILLKPTIVRQD

SEQ ID NO: 3191427 - protein, 24 aa, Giardia lamblia
LPDKWVCDVSPLGYKRGIMSKVKV

SEQ ID NO: 3191428 - protein, 26 aa, Giardia lamblia
LPDLDPGFFDYLKTLSWRQLELYAPK

SEQ ID NO: 3191429 - protein, 27 aa, Giardia lamblia
LPDNLKALFRPIIMTKPDNAIIAEVMF

SEQ ID NO: 3191430 - protein, 26 aa, Giardia lamblia
LPDYSDGKFILVGPSAVSALDIVRKS

SEQ ID NO: 3191431 - protein, 28 aa, Giardia lamblia
LPEDWTRFLIAEIILGLEGLHSIGYCHR

SEQ ID NO: 3191432 - protein, 39 aa, Giardia lamblia
LPEHHKLRHLNIAFNPIKALDVSRLPRSLEILCVSEGQL

SEQ ID NO: 3191433 - protein, 25 aa, Giardia lamblia
LPENVILWISYLMIKTVKTFHEANI

SEQ ID NO: 3191434 - protein, 24 aa, Giardia lamblia
LPEVATLRRLPPHPNIIRLIRVVV

SEQ ID NO: 3191435 - protein, 18 aa, Giardia lamblia
LPEYDEWTHFIGELQLNI

SEQ ID NO: 3191436 - protein, 18 aa, Giardia lamblia
LPEYLMWNNERQGFTNLP

SEQ ID NO: 3191437 - protein, 20 aa, Giardia lamblia
LPFIMQLNIDAGRLFQIILF

SEQ ID NO: 3191438 - protein, 24 aa, Giardia lamblia
LPFSHSTLRPLLKILKGSARLEQL

SEQ ID NO: 3191439 - protein, 18 aa, Giardia lamblia
LPFTITLVNNLRPKPTEK

SEQ ID NO: 3191440 - protein, 26 aa, Giardia lamblia
LPGEVMWQYPMYKLLTQKPVPEHHSL

SEQ ID NO: 3191441 - protein, 20 aa, Giardia lamblia
LPGINYAPRDITFIHSVQIC

SEQ ID NO: 3191442 - protein, 29 aa, Giardia lamblia
LPGSVLESLYRYIHNWFVQLRGMHDFRNN

SEQ ID NO: 3191443 - protein, 34 aa, Giardia lamblia
LPHDRIDPATGKPLHTALPDKYLERMKQEACKEH

SEQ ID NO: 3191444 - protein, 27 aa, Giardia lamblia
LPHIVDIQRMLRALQKEYYAYLEQLRA

SEQ ID NO: 3191445 - protein, 29 aa, Giardia lamblia
LPHVDVLNLVRLQFITESFLQLSPEYLHY

SEQ ID NO: 3191446 - protein, 19 aa, Giardia lamblia
LPIEREWAEWLFQTGQYDK

SEQ ID NO: 3191447 - protein, 26 aa, Giardia lamblia
LPIKETEIIDYFFPKSELAEEVCNIM

SEQ ID NO: 3191448 - protein, 20 aa, Giardia lamblia
LPIYTSFLCEYVVDPRTIPD

SEQ ID NO: 3191449 - protein, 26 aa, Giardia lamblia
LPKCFTKLYLLKLKPYEKALFMDSDM

SEQ ID NO: 3191450 - protein, 24 aa, Giardia lamblia
LPKSNLLVVLTFKFNSFKENQRRV

SEQ ID NO: 3191451 - protein, 17 aa, Giardia lamblia
LPLFLHCRDAGTDFLEI

SEQ ID NO: 3191452 - protein, 18 aa, Giardia lamblia
LPLPVFAGTFNVGNRKFP

SEQ ID NO: 3191453 - protein, 27 aa, Giardia lamblia
LPNGLDLVYVPFRGITRMYGSLHCASQ

SEQ ID NO: 3191454 - protein, 30 aa, Giardia lamblia
LPNGQRIFREDALRFGYKGPARNGTYIFIG

SEQ ID NO: 3191455 - protein, 19 aa, Giardia lamblia
LPNLSLYKILSPLHNSLEA

SEQ ID NO: 3191456 - protein, 18 aa, Giardia lamblia
LPNVPFYESVLPKNERIF

SEQ ID NO: 3191457 - protein, 21 aa, Giardia lamblia
LPPCIQADALFRRSRHRSDGI

SEQ ID NO: 3191458 - protein, 19 aa, Giardia lamblia
LPPFVRIGKLVSLDTKTTY

SEQ ID NO: 3191459 - protein, 17 aa, Giardia lamblia
LPPLGSTGSVQPGQPSQ

SEQ ID NO: 3191460 - protein, 23 aa, Giardia lamblia
LPPMEYLFPWDNNASASPLSELL

SEQ ID NO: 3191461 - protein, 17 aa, Giardia lamblia
LPPQLATASLFSGPAPP

SEQ ID NO: 3191462 - protein, 19 aa, Giardia lamblia
LPPVPHDIFMALLSSGLDS

SEQ ID NO: 3191463 - protein, 19 aa, Giardia lamblia
LPQCPIIIKARYFSSDAEK

SEQ ID NO: 3191464 - protein, 24 aa, Giardia lamblia
LPQFPCLFLHQFGSKASVMESFEP

SEQ ID NO: 3191465 - protein, 28 aa, Giardia lamblia
LPQGMYSNDLIGFIYKILVVDHNARPSS

SEQ ID NO: 3191466 - protein, 21 aa, Giardia lamblia
LPQITSIAWRPDVSVLTVGTS

SEQ ID NO: 3191467 - protein, 32 aa, Giardia lamblia
LPQVRPNPIIARYFVIIVTAFISTPTRISAFT

SEQ ID NO: 3191468 - protein, 26 aa, Giardia lamblia
LPQYDNKLQPMIFPQDTEKSGAFYSS

SEQ ID NO: 3191469 - protein, 19 aa, Giardia lamblia
LPRCDIINIIYKGITKESS

SEQ ID NO: 3191470 - protein, 25 aa, Giardia lamblia
LPRDLLDRLLVIKTLPYQQEDIAKI

SEQ ID NO: 3191471 - protein, 17 aa, Giardia lamblia
LPRKPAVYRQHYYKAGR

SEQ ID NO: 3191472 - protein, 19 aa, Giardia lamblia
LPRNSQIYIPPRPDDPNDS

SEQ ID NO: 3191473 - protein, 18 aa, Giardia lamblia
LPRPKVFNVPLRPDIINF

SEQ ID NO: 3191474 - protein, 19 aa, Giardia lamblia
LPRPTYISPGTGIVHVMPV

SEQ ID NO: 3191475 - protein, 23 aa, Giardia lamblia
LPSATFVTLVFDGGSLPSKTFTN

SEQ ID NO: 3191476 - protein, 33 aa, Giardia lamblia
LPSEFVMRRLWTLPQILLYLYSQFHIVTAQQNA

SEQ ID NO: 3191477 - protein, 29 aa, Giardia lamblia
LPSENGVRLLAIAPSLPIIAMVGGSSKVL

SEQ ID NO: 3191478 - protein, 18 aa, Giardia lamblia
LPSILQQSKKFRTIINYY

SEQ ID NO: 3191479 - protein, 29 aa, Giardia lamblia
LPSKPGKVKQLPPWRGLIDEPNVDLPSKS

SEQ ID NO: 3191480 - protein, 26 aa, Giardia lamblia
LPSKRYWRHVDLFTSLLSQLFSFSTD

SEQ ID NO: 3191481 - protein, 31 aa, Giardia lamblia
LPTCVVYSVFLNFLQWIYSPQMEKLDFQFKD

SEQ ID NO: 3191482 - protein, 20 aa, Giardia lamblia
LPTLQLYHFTATLLRKNTKD

SEQ ID NO: 3191483 - protein, 20 aa, Giardia lamblia
LPTNIPRGVRKKSISQFPAI

SEQ ID NO: 3191484 - protein, 26 aa, Giardia lamblia
LPTPLKPHYVFNLRDLSKFFLSLMKA

SEQ ID NO: 3191485 - protein, 25 aa, Giardia lamblia
LPTTLRLMTLWFRYGSYDEVETEII

SEQ ID NO: 3191486 - protein, 20 aa, Giardia lamblia
LPVDSFISEDLFAWIKDIDE

SEQ ID NO: 3191487 - protein, 19 aa, Giardia lamblia
LPVENENWWYTDGSYHLKQ

SEQ ID NO: 3191488 - protein, 26 aa, Giardia lamblia
LPVFRKAFNFTLYPMFHIELCHKTLE

SEQ ID NO: 3191489 - protein, 41 aa, Giardia lamblia
LPVGMQAVQLWLLKFLNIHYPLFTHLFTNTFIEYVLSHICV

SEQ ID NO: 3191490 - protein, 17 aa, Giardia lamblia
LPVIIVFNKSDLIAPSL

SEQ ID NO: 3191491 - protein, 29 aa, Giardia lamblia
LPVSNFCPKLLLPNLLRLSMTHHNTSVDT

SEQ ID NO: 3191492 - protein, 28 aa, Giardia lamblia
LPVSPRTALFLMVAYYYGVQREACLIAA

SEQ ID NO: 3191493 - protein, 19 aa, Giardia lamblia
LPVTLKKILLAHKRTADEY

SEQ ID NO: 3191494 - protein, 26 aa, Giardia lamblia
LPVVDYWLDLVTIIDAAIRITVATVE

SEQ ID NO: 3191495 - protein, 25 aa, Giardia lamblia
LPYRIHTIVTTFFASLRKFVLTPDF

SEQ ID NO: 3191496 - protein, 22 aa, Giardia lamblia
LQAAPTAPLRLLQKAGYAVKGL

SEQ ID NO: 3191497 - protein, 24 aa, Giardia lamblia
LQAGSVRPPIVTPIQSLDPISGNK

SEQ ID NO: 3191498 - protein, 27 aa, Giardia lamblia
LQASQFEPVVIPLTPPLSASSSSSSSS

SEQ ID NO: 3191499 - protein, 31 aa, Giardia lamblia
LQASVHAMKLLISTQYRGLLAKDQLSRAVFS

SEQ ID NO: 3191500 - protein, 18 aa, Giardia lamblia
LQDFTDTLPCQHLYTAPS

SEQ ID NO: 3191501 - protein, 28 aa, Giardia lamblia
LQDGYELLEGIPLKGLVPLSQERYLKAK

SEQ ID NO: 3191502 - protein, 22 aa, Giardia lamblia
LQDKSMLISTLQNQIKVMQAEK

SEQ ID NO: 3191503 - protein, 21 aa, Giardia lamblia
LQDLINSDVTLFNLATLANAE

SEQ ID NO: 3191504 - protein, 18 aa, Giardia lamblia
LQDLLPECVCSTQLFKQL

SEQ ID NO: 3191505 - protein, 18 aa, Giardia lamblia
LQDLVVLLEATLAENRTF

SEQ ID NO: 3191506 - protein, 29 aa, Giardia lamblia
LQDNNFVVLPGYKYVPRSTPTKLSATNSP

SEQ ID NO: 3191507 - protein, 27 aa, Giardia lamblia
LQEEVYAVTKLLINAGLIKLSTQDRFA

SEQ ID NO: 3191508 - protein, 20 aa, Giardia lamblia
LQEFIKSLLVLDPNKRITAS

SEQ ID NO: 3191509 - protein, 19 aa, Giardia lamblia
LQEHKIFFGDNLQFESDNW

SEQ ID NO: 3191510 - protein, 17 aa, Giardia lamblia
LQEILTVKGASNSMICD

SEQ ID NO: 3191511 - protein, 26 aa, Giardia lamblia
LQELAYFTNFRVYLLIGGTDTAKQAA

SEQ ID NO: 3191512 - protein, 24 aa, Giardia lamblia
LQEPKKAHAYAMPGQLLAIHDNTA

SEQ ID NO: 3191513 - protein, 20 aa, Giardia lamblia
LQETLDSLDLKRAYTMKMGN

SEQ ID NO: 3191514 - protein, 18 aa, Giardia lamblia
LQEYIEGLRNAYSELESK

SEQ ID NO: 3191515 - protein, 17 aa, Giardia lamblia
LQFIDDFIKVLGGVISY

SEQ ID NO: 3191516 - protein, 20 aa, Giardia lamblia
LQGKLDRYVSYADANAALLQ

SEQ ID NO: 3191517 - protein, 19 aa, Giardia lamblia
LQGNCYTTMIACISLASEH

SEQ ID NO: 3191518 - protein, 25 aa, Giardia lamblia
LQGQIFPQYVTPPVSHQSTYPMFPY

SEQ ID NO: 3191519 - protein, 21 aa, Giardia lamblia
LQGRLATPSSLLLLFEDAKIS

SEQ ID NO: 3191520 - protein, 32 aa, Giardia lamblia
LQGTTLPTLSAPLSINLFICTQITLSTYSISQ

SEQ ID NO: 3191521 - protein, 22 aa, Giardia lamblia
LQGWTLCKVVGQIYSRITTPLV

SEQ ID NO: 3191522 - protein, 32 aa, Giardia lamblia
LQHASSYLSPNQPFYIAGGLFTPDMREETFSN

SEQ ID NO: 3191523 - protein, 18 aa, Giardia lamblia
LQHEVGMRQYMGLTALIY

SEQ ID NO: 3191524 - protein, 32 aa, Giardia lamblia
LQHQRSPLWFEKFHWFFSTDGYLVLSGRDAQS

SEQ ID NO: 3191525 - protein, 20 aa, Giardia lamblia
LQIRGILKPQIIFFGEKLSS

SEQ ID NO: 3191526 - protein, 26 aa, Giardia lamblia
LQISYRHLLYLTSTILHHDLELDKKT

SEQ ID NO: 3191527 - protein, 19 aa, Giardia lamblia
LQIVEFLCPYMDFMKDNNN

SEQ ID NO: 3191528 - protein, 19 aa, Giardia lamblia
LQIYLKEVVDLREALRNKI

SEQ ID NO: 3191529 - protein, 19 aa, Giardia lamblia
LQIYVSWFEQKAIVQFLTF

SEQ ID NO: 3191530 - protein, 18 aa, Giardia lamblia
LQKELLDRQLAEYNLPEF

SEQ ID NO: 3191531 - protein, 18 aa, Giardia lamblia
LQLHPRLVTARKLILQEL

SEQ ID NO: 3191532 - protein, 18 aa, Giardia lamblia
LQLIDRMSEREFQNFFVC

SEQ ID NO: 3191533 - protein, 19 aa, Giardia lamblia
LQLQRLNSGFSIAFPLLLN

SEQ ID NO: 3191534 - protein, 18 aa, Giardia lamblia
LQLTLHDEVLGLQARIKE

SEQ ID NO: 3191535 - protein, 18 aa, Giardia lamblia
LQLTPSLIHPYLVKTRLS

SEQ ID NO: 3191536 - protein, 17 aa, Giardia lamblia
LQLYSGMFDAPDEEPEK

SEQ ID NO: 3191537 - protein, 17 aa, Giardia lamblia
LQNCHLCLSWMPNLARF

SEQ ID NO: 3191538 - protein, 32 aa, Giardia lamblia
LQNFARKYVIAIDKLIFRFTISNVMVNTTNFL

SEQ ID NO: 3191539 - protein, 28 aa, Giardia lamblia
LQNNPRIVSAPLLLYDGKNLTGLKTADF

SEQ ID NO: 3191540 - protein, 29 aa, Giardia lamblia
LQNQQCPPLVLARFFTLLGSSQLRCQSYH

SEQ ID NO: 3191541 - protein, 28 aa, Giardia lamblia
LQPLCEFRLKLLPKSGGRWRPIAVQETL

SEQ ID NO: 3191542 - protein, 29 aa, Giardia lamblia
LQPLSLTELAILNLSYNRLQTLQNLVPIA

SEQ ID NO: 3191543 - protein, 18 aa, Giardia lamblia
LQPPDKIFRALLSAGSSG

SEQ ID NO: 3191544 - protein, 26 aa, Giardia lamblia
LQPSGKLCAIKLLWSQKGNNYNEKEE

SEQ ID NO: 3191545 - protein, 19 aa, Giardia lamblia
LQPVTYFCKMPVDMAERSI

SEQ ID NO: 3191546 - protein, 25 aa, Giardia lamblia
LQQANYPYCLPTTEPAATATATSPI

SEQ ID NO: 3191547 - protein, 24 aa, Giardia lamblia
LQQFGKFPLPVVSKIIRDVAQAIQ

SEQ ID NO: 3191548 - protein, 24 aa, Giardia lamblia
LQQFVYKIIQRLPAMIGRHNFMDA

SEQ ID NO: 3191549 - protein, 17 aa, Giardia lamblia
LQQGLPDLSPLYAMILS

SEQ ID NO: 3191550 - protein, 18 aa, Giardia lamblia
LQRAVANYSLPGYAKHIV

SEQ ID NO: 3191551 - protein, 19 aa, Giardia lamblia
LQRLLLQVEPQLVFWACRE

SEQ ID NO: 3191552 - protein, 18 aa, Giardia lamblia
LQRRIPLHVAENFCRLII

SEQ ID NO: 3191553 - protein, 19 aa, Giardia lamblia
LQRYDFDLMFLAPRTQNTW

SEQ ID NO: 3191554 - protein, 25 aa, Giardia lamblia
LQSDLLPIRIVAKLPKNILQLMSLI

SEQ ID NO: 3191555 - protein, 18 aa, Giardia lamblia
LQSFLPLNLLITNVGKRC

SEQ ID NO: 3191556 - protein, 23 aa, Giardia lamblia
LQSGVRYCLNCVAQLELLDELRS

SEQ ID NO: 3191557 - protein, 26 aa, Giardia lamblia
LQSHRANLGLIGIGGLMASGSYTSHR

SEQ ID NO: 3191558 - protein, 18 aa, Giardia lamblia
LQSIFTKSAYLIWPSPSM

SEQ ID NO: 3191559 - protein, 21 aa, Giardia lamblia
LQSIPSFIFSCPELSSADLSN

SEQ ID NO: 3191560 - protein, 21 aa, Giardia lamblia
LQSIRYLPDQLTNALAWCVEK

SEQ ID NO: 3191561 - protein, 18 aa, Giardia lamblia
LQSKERELERVRGKLRDM

SEQ ID NO: 3191562 - protein, 34 aa, Giardia lamblia
LQSNCTLLYDLPTPYLKRFACILLSIDGRPETVD

SEQ ID NO: 3191563 - protein, 34 aa, Giardia lamblia
LQSNFKTPIPPASKLLPRKVPRTTDLFFTSTSGT

SEQ ID NO: 3191564 - protein, 26 aa, Giardia lamblia
LQSPEPFTVNLLALVPPPVSNEILMS

SEQ ID NO: 3191565 - protein, 23 aa, Giardia lamblia
LQSQLEALTLRRSTLMTDSFAMI

SEQ ID NO: 3191566 - protein, 19 aa, Giardia lamblia
LQSRKRLFRLCESSGIASI

SEQ ID NO: 3191567 - protein, 32 aa, Giardia lamblia
LQSVTNRFFVVYFTYWELYNEELKDLLAGEKH

SEQ ID NO: 3191568 - protein, 22 aa, Giardia lamblia
LQTAFINESLPPSMLPPIQSSQ

SEQ ID NO: 3191569 - protein, 29 aa, Giardia lamblia
LQTNNVPRVFIYDLPMLLSEALISKRHTL

SEQ ID NO: 3191570 - protein, 17 aa, Giardia lamblia
LQTPFDWGSQSWTLAKL

SEQ ID NO: 3191571 - protein, 25 aa, Giardia lamblia
LQTRRILMRTYYLCTSRELEEKENV

SEQ ID NO: 3191572 - protein, 24 aa, Giardia lamblia
LQTSLKPLLDLIPSVTDRSVQDAP

SEQ ID NO: 3191573 - protein, 23 aa, Giardia lamblia
LQTVKLLAPLEKGMYTRNHFNDT

SEQ ID NO: 3191574 - protein, 21 aa, Giardia lamblia
LQVEDLELPSLPKAGSPSKSI

SEQ ID NO: 3191575 - protein, 20 aa, Giardia lamblia
LQVRNLKIADFLALGEFGDA

SEQ ID NO: 3191576 - protein, 18 aa, Giardia lamblia
LQVSLQKLDLTAAAAFDG

SEQ ID NO: 3191577 - protein, 18 aa, Giardia lamblia
LQYANAPVIPPNIDELTP

SEQ ID NO: 3191578 - protein, 30 aa, Giardia lamblia
LQYCRNNHILVADADFLWVFSERNLVEPLI

SEQ ID NO: 3191579 - protein, 17 aa, Giardia lamblia
LQYIIPHNVSPGHVAAS

SEQ ID NO: 3191580 - protein, 24 aa, Giardia lamblia
LQYLHDYAGHFYFNCSEYLGLGDT

SEQ ID NO: 3191581 - protein, 17 aa, Giardia lamblia
LQYLHQGVNTTFPAVLE

SEQ ID NO: 3191582 - protein, 25 aa, Giardia lamblia
LRADKVISCYPEKLPVIRQSGTRVF

SEQ ID NO: 3191583 - protein, 19 aa, Giardia lamblia
LRAHWANIVSIIDVSYYTT

SEQ ID NO: 3191584 - protein, 28 aa, Giardia lamblia
LRAKLEEAMPIRRAAYSIIRTAMRAGAA

SEQ ID NO: 3191585 - protein, 20 aa, Giardia lamblia
LRAKLKKYIMMDGGLRKIGN

SEQ ID NO: 3191586 - protein, 17 aa, Giardia lamblia
LRAPVDQSQTVAMLLDE

SEQ ID NO: 3191587 - protein, 24 aa, Giardia lamblia
LRATHFRSLINIKIMANLEVNRGI

SEQ ID NO: 3191588 - protein, 24 aa, Giardia lamblia
LRDKTGWTALMIAAEKGSLEVVKL

SEQ ID NO: 3191589 - protein, 27 aa, Giardia lamblia
LRDRGFLYHQRNLLMAVRAFQERGLKV

SEQ ID NO: 3191590 - protein, 25 aa, Giardia lamblia
LRDRYTPLFQLNLSLSSPEIIVTPS

SEQ ID NO: 3191591 - protein, 25 aa, Giardia lamblia
LRDSAKHFFFSSFICMTFFQEEAQL

SEQ ID NO: 3191592 - protein, 19 aa, Giardia lamblia
LRDSDMVYGARPLRRFIER

SEQ ID NO: 3191593 - protein, 29 aa, Giardia lamblia
LRDTAHLTSFKLFLVPSAGYLVLGDDVDA

SEQ ID NO: 3191594 - protein, 17 aa, Giardia lamblia
LRDTSPPPLLSPAAVSA

SEQ ID NO: 3191595 - protein, 25 aa, Giardia lamblia
LRDTTPTLNFLPKLAELSATIACCE

SEQ ID NO: 3191596 - protein, 20 aa, Giardia lamblia
LREDPLRIMGQNIEKLTIRL

SEQ ID NO: 3191597 - protein, 28 aa, Giardia lamblia
LREGMVSKLLLVLITLTLSNSFELRYVT

SEQ ID NO: 3191598 - protein, 17 aa, Giardia lamblia
LREKKRLYRRFMRLSKG

SEQ ID NO: 3191599 - protein, 26 aa, Giardia lamblia
LREKVQLLEKLQYEKRARDVEMLELR

SEQ ID NO: 3191600 - protein, 35 aa, Giardia lamblia
LRELRLYKARKLARLELLVLLLAKIDRLDTFSRLR

SEQ ID NO: 3191601 - protein, 24 aa, Giardia lamblia
LRENKTLETLIDLLLCKYEVPSTA

SEQ ID NO: 3191602 - protein, 25 aa, Giardia lamblia
LREQYDQRIAFLKDIIYCLKMRSQE

SEQ ID NO: 3191603 - protein, 18 aa, Giardia lamblia
LRERSLLDELATLRNAQY

SEQ ID NO: 3191604 - protein, 18 aa, Giardia lamblia
LRESFGNTLEFNKLNDDL

SEQ ID NO: 3191605 - protein, 19 aa, Giardia lamblia
LRESKVFGLNPSGKTGKPY

SEQ ID NO: 3191606 - protein, 27 aa, Giardia lamblia
LREVLTTIWRPIELAMPAFANEENMQR

SEQ ID NO: 3191607 - protein, 22 aa, Giardia lamblia
LREYIFVEPVECLCYRCSNVLD

SEQ ID NO: 3191608 - protein, 19 aa, Giardia lamblia
LRFDAGDMLLFEPVAEFFV

SEQ ID NO: 3191609 - protein, 17 aa, Giardia lamblia
LRFELEREKRKSQQLQQ

SEQ ID NO: 3191610 - protein, 29 aa, Giardia lamblia
LRGATTLVRLFSACIAPDSLAALVANRGS

SEQ ID NO: 3191611 - protein, 28 aa, Giardia lamblia
LRGATTLVRLFSACIAPDSPAALVANRG

SEQ ID NO: 3191612 - protein, 22 aa, Giardia lamblia
LRGFDFCEALNLLLLNRIPQKL

SEQ ID NO: 3191613 - protein, 17 aa, Giardia lamblia
LRGLLAIHIAALKGHAT

SEQ ID NO: 3191614 - protein, 20 aa, Giardia lamblia
LRGLSGLAFSYSFLANQDIT

SEQ ID NO: 3191615 - protein, 23 aa, Giardia lamblia
LRGRKTLEQMVYPLIRQFRDLST

SEQ ID NO: 3191616 - protein, 22 aa, Giardia lamblia
LRGYLTRYPVFTSLSYPDKAYK

SEQ ID NO: 3191617 - protein, 17 aa, Giardia lamblia
LRHEADIIQLFCKLADD

SEQ ID NO: 3191618 - protein, 19 aa, Giardia lamblia
LRHVARHANRFTWPVPTYT

SEQ ID NO: 3191619 - protein, 21 aa, Giardia lamblia
LRICTDLSEWLLMPAICCVNC

SEQ ID NO: 3191620 - protein, 28 aa, Giardia lamblia
LRIGYRSLVALHTKLALWHTTSLQRMLS

SEQ ID NO: 3191621 - protein, 17 aa, Giardia lamblia
LRIHMENDMLIRQQNAL

SEQ ID NO: 3191622 - protein, 17 aa, Giardia lamblia
LRILPLSLNGSELSWLH

SEQ ID NO: 3191623 - protein, 17 aa, Giardia lamblia
LRIMQKTTLVTPGLRFL

SEQ ID NO: 3191624 - protein, 21 aa, Giardia lamblia
LRIQELIFQNDRMMKFIEEVK

SEQ ID NO: 3191625 - protein, 37 aa, Giardia lamblia
LRIYRYRVRGCLKKAYFFTLAVWDLEFTYLDNGLSTR

SEQ ID NO: 3191626 - protein, 17 aa, Giardia lamblia
LRKCAFYAMLSRYLDLH

SEQ ID NO: 3191627 - protein, 17 aa, Giardia lamblia
LRKKLPLIDFKMIRHAS

SEQ ID NO: 3191628 - protein, 17 aa, Giardia lamblia
LRKLFTMEKYQVVCKAL

SEQ ID NO: 3191629 - protein, 18 aa, Giardia lamblia
LRKLLDRASLEAFQSKAR

SEQ ID NO: 3191630 - protein, 27 aa, Giardia lamblia
LRKLLPKDCFFISRSVFQKNFLSVCKS

SEQ ID NO: 3191631 - protein, 26 aa, Giardia lamblia
LRKMALDYIIYYYSTEILPVLLEKKK

SEQ ID NO: 3191632 - protein, 28 aa, Giardia lamblia
LRKTQAHRSYVHKLLTTAYAELKQKHSY

SEQ ID NO: 3191633 - protein, 26 aa, Giardia lamblia
LRKVEKLWAIALLITDVVTSNSILMC

SEQ ID NO: 3191634 - protein, 18 aa, Giardia lamblia
LRKWRYILPEDRSPEEQP

SEQ ID NO: 3191635 - protein, 19 aa, Giardia lamblia
LRLAGPQTRLCFSPATSMT

SEQ ID NO: 3191636 - protein, 17 aa, Giardia lamblia
LRLASLEPPIYADDSST

SEQ ID NO: 3191637 - protein, 18 aa, Giardia lamblia
LRLGWKFPTTVQEKVIPI

SEQ ID NO: 3191638 - protein, 21 aa, Giardia lamblia
LRLIHFNLNFVTAFCPLPRAM

SEQ ID NO: 3191639 - protein, 25 aa, Giardia lamblia
LRLLARELWRKLGCEVILCIGVQKR

SEQ ID NO: 3191640 - protein, 18 aa, Giardia lamblia
LRLMRRKINVNLFEKIKM

SEQ ID NO: 3191641 - protein, 21 aa, Giardia lamblia
LRLNSYFLTSEFPFSISSDNL

SEQ ID NO: 3191642 - protein, 19 aa, Giardia lamblia
LRLPGFMSNDLLSLVSSLV

SEQ ID NO: 3191643 - protein, 28 aa, Giardia lamblia
LRLVLDVARLHQHPTLIQAIHNVEDSLM

SEQ ID NO: 3191644 - protein, 18 aa, Giardia lamblia
LRMFLQQRASAHGYEVMD

SEQ ID NO: 3191645 - protein, 17 aa, Giardia lamblia
LRMQYSIMSKRHLQWFV

SEQ ID NO: 3191646 - protein, 18 aa, Giardia lamblia
LRMTILPSEEVMTDLLAR

SEQ ID NO: 3191647 - protein, 18 aa, Giardia lamblia
LRNELQGAETLITGLRRE

SEQ ID NO: 3191648 - protein, 19 aa, Giardia lamblia
LRNFAKELRYLFPNTQRVN

SEQ ID NO: 3191649 - protein, 18 aa, Giardia lamblia
LRNGTIAILTKTITDLKA

SEQ ID NO: 3191650 - protein, 29 aa, Giardia lamblia
LRNILGRSIQLMNLLRSTIPTMDEYNMLV

SEQ ID NO: 3191651 - protein, 18 aa, Giardia lamblia
LRNTYTDLPRSLLSTLLS

SEQ ID NO: 3191652 - protein, 24 aa, Giardia lamblia
LRNVYVVVCMHSLKARTRGITASE

SEQ ID NO: 3191653 - protein, 18 aa, Giardia lamblia
LRPGTEALFPKEKTASTV

SEQ ID NO: 3191654 - protein, 20 aa, Giardia lamblia
LRPIGKLKITYKSVVYYYSD

SEQ ID NO: 3191655 - protein, 18 aa, Giardia lamblia
LRPIVIEYTIPYHHISGL

SEQ ID NO: 3191656 - protein, 23 aa, Giardia lamblia
LRQAQQLLAKRMHPMTIIEGFRA

SEQ ID NO: 3191657 - protein, 20 aa, Giardia lamblia
LRQCNGAVRQYPVSATLYPR

SEQ ID NO: 3191658 - protein, 19 aa, Giardia lamblia
LRQENDYFRLQIARSSSRD

SEQ ID NO: 3191659 - protein, 20 aa, Giardia lamblia
LRQKVDAIIIEMTRSTPPSA

SEQ ID NO: 3191660 - protein, 17 aa, Giardia lamblia
LRQLPHCPVLCITSEQR

SEQ ID NO: 3191661 - protein, 20 aa, Giardia lamblia
LRQSSTGYTPLIIAAANGST

SEQ ID NO: 3191662 - protein, 17 aa, Giardia lamblia
LRRDGIHPLMLSYELQV

SEQ ID NO: 3191663 - protein, 22 aa, Giardia lamblia
LRRGVYLVVCRTRKRWASQERC

SEQ ID NO: 3191664 - protein, 29 aa, Giardia lamblia
LRRLRDHCALYEPLIRDLTERHDSIHRAK

SEQ ID NO: 3191665 - protein, 21 aa, Giardia lamblia
LRRVSFNSHVLYSSPTSPAFS

SEQ ID NO: 3191666 - protein, 25 aa, Giardia lamblia
LRSAASMLNARACKLAWDVANCERV

SEQ ID NO: 3191667 - protein, 37 aa, Giardia lamblia
LRSDKSPIIIFFGVAYKMLITMLDFIHSLQFQYVTIL

SEQ ID NO: 3191668 - protein, 21 aa, Giardia lamblia
LRSFIRSMLKIDPVQRPTSVL

SEQ ID NO: 3191669 - protein, 29 aa, Giardia lamblia
LRSICKAAVFVGRLLELTKSRRGYGHKIS

SEQ ID NO: 3191670 - protein, 18 aa, Giardia lamblia
LRSIGYCIVLAQIGCFVP

SEQ ID NO: 3191671 - protein, 18 aa, Giardia lamblia
LRSILFTLHDMCSKYLLD

SEQ ID NO: 3191672 - protein, 31 aa, Giardia lamblia
LRSNVAKRIWVPRLYVHFWGEDPRIYVERLR

SEQ ID NO: 3191673 - protein, 24 aa, Giardia lamblia
LRSSSFLQLRPTTEIARLILASSE

SEQ ID NO: 3191674 - protein, 39 aa, Giardia lamblia
LRSTEAPEIKFRRLEKAYLELMLMNEQLINYLKKSKSTI

SEQ ID NO: 3191675 - protein, 35 aa, Giardia lamblia
LRSYLDALALGFFFILHPRIVFYAPVLGLSEDFLP

SEQ ID NO: 3191676 - protein, 18 aa, Giardia lamblia
LRSYLGMGGGVGGLRLDN

SEQ ID NO: 3191677 - protein, 19 aa, Giardia lamblia
LRTDLLSLKSSDQGPTQLG

SEQ ID NO: 3191678 - protein, 18 aa, Giardia lamblia
LRTKATIDRFLAGAAFTA

SEQ ID NO: 3191679 - protein, 17 aa, Giardia lamblia
LRTLAQTKDFGISAVDQ

SEQ ID NO: 3191680 - protein, 20 aa, Giardia lamblia
LRTLPEMLVIDRVDAFKYAH

SEQ ID NO: 3191681 - protein, 22 aa, Giardia lamblia
LRTLTEASALYDRVFKDLAPTA

SEQ ID NO: 3191682 - protein, 19 aa, Giardia lamblia
LRTMLSIQARLRATENKSS

SEQ ID NO: 3191683 - protein, 28 aa, Giardia lamblia
LRTQKSGYLLLQNAYIRALSLGNAQEIA

SEQ ID NO: 3191684 - protein, 18 aa, Giardia lamblia
LRTQTFGLLIDFSEKPLS

SEQ ID NO: 3191685 - protein, 24 aa, Giardia lamblia
LRTSAIYRSFLKHQDLNFFQGMHR

SEQ ID NO: 3191686 - protein, 23 aa, Giardia lamblia
LRVAVHVITFLSRLEQTMGDHRS

SEQ ID NO: 3191687 - protein, 18 aa, Giardia lamblia
LRVEQIYLRSTVNMPKKW

SEQ ID NO: 3191688 - protein, 18 aa, Giardia lamblia
LRVERPVHRPAPAVSLPE

SEQ ID NO: 3191689 - protein, 28 aa, Giardia lamblia
LRYCHLNRYNLLSGSFYHIGAKSIDIVT

SEQ ID NO: 3191690 - protein, 19 aa, Giardia lamblia
LRYMAIIPTMLNPEIRPRG

SEQ ID NO: 3191691 - protein, 17 aa, Giardia lamblia
LRYQVDLMLLAGDNMQL

SEQ ID NO: 3191692 - protein, 18 aa, Giardia lamblia
LSAAIDLMLNPNPSARPS

SEQ ID NO: 3191693 - protein, 29 aa, Giardia lamblia
LSADPRQRGLLLIKFNVQFPSHIPEVNKA

SEQ ID NO: 3191694 - protein, 35 aa, Giardia lamblia
LSAEYALQMAVFLPNTHNLLINGLEMVCQHRSGLY

SEQ ID NO: 3191695 - protein, 26 aa, Giardia lamblia
LSAIARDILLVSLLRNNFSSEDGQHK

SEQ ID NO: 3191696 - protein, 33 aa, Giardia lamblia
LSAIPSQILIKLFFELPTYAFLRRIVLAAQNVS

SEQ ID NO: 3191697 - protein, 27 aa, Giardia lamblia
LSAIREAKISGFRGFLAEHINAAVGSY

SEQ ID NO: 3191698 - protein, 19 aa, Giardia lamblia
LSAISYWYTCDEEHSTEIE

SEQ ID NO: 3191699 - protein, 27 aa, Giardia lamblia
LSAITDMLVFMILFADSHIQSASCCYS

SEQ ID NO: 3191700 - protein, 26 aa, Giardia lamblia
LSAKFGALKELKYLYEETRMLSFEKN

SEQ ID NO: 3191701 - protein, 22 aa, Giardia lamblia
LSAKMLLFKEIEKKHTVLKQER

SEQ ID NO: 3191702 - protein, 23 aa, Giardia lamblia
LSAKSVIFLSTPHLSDHNSTLLI

SEQ ID NO: 3191703 - protein, 38 aa, Giardia lamblia
LSALQEVQELWRTTRPELYRLVLKYGAVREQIRLLMKA

SEQ ID NO: 3191704 - protein, 31 aa, Giardia lamblia
LSANPLRVQLILMLILRLVLSTGDAARTAFA

SEQ ID NO: 3191705 - protein, 18 aa, Giardia lamblia
LSASALLNYFRYGSSRGT

SEQ ID NO: 3191706 - protein, 19 aa, Giardia lamblia
LSASFRTLSASLASRLSEE

SEQ ID NO: 3191707 - protein, 31 aa, Giardia lamblia
LSASGHLFLIQTTLSLIRRGLRNDVALAQTG

SEQ ID NO: 3191708 - protein, 19 aa, Giardia lamblia
LSASRDMLVVLWDLSTRAK

SEQ ID NO: 3191709 - protein, 23 aa, Giardia lamblia
LSASVRRRYSHVRKLAISGVFIP

SEQ ID NO: 3191710 - protein, 28 aa, Giardia lamblia
LSAVAYAHLLQRLMPHRTITAAAAGPIN

SEQ ID NO: 3191711 - protein, 29 aa, Giardia lamblia
LSCYDILHFIFCIYRAQEVLLLNEHTKMF

SEQ ID NO: 3191712 - protein, 24 aa, Giardia lamblia
LSDARLEAPLVYIGKRDDIFNTYN

SEQ ID NO: 3191713 - protein, 17 aa, Giardia lamblia
LSDFITDLLNPRPERRP

SEQ ID NO: 3191714 - protein, 19 aa, Giardia lamblia
LSDFLYCFSKLALYDSLSI

SEQ ID NO: 3191715 - protein, 24 aa, Giardia lamblia
LSDHYFVIDIFAQAGTYIKEFCNS

SEQ ID NO: 3191716 - protein, 20 aa, Giardia lamblia
LSDKVSLGYFAPTTLTGSGC

SEQ ID NO: 3191717 - protein, 24 aa, Giardia lamblia
LSDPFPFNLMFQTNIGPSAGSTVY

SEQ ID NO: 3191718 - protein, 25 aa, Giardia lamblia
LSDPKQFIPGLPVRENRDGTVFVES

SEQ ID NO: 3191719 - protein, 26 aa, Giardia lamblia
LSDRTITGPLLFPLRSVIHSESTCFA

SEQ ID NO: 3191720 - protein, 31 aa, Giardia lamblia
LSDYKGKYLIVFFYPLDFTFVCPSEIIHFSN

SEQ ID NO: 3191721 - protein, 32 aa, Giardia lamblia
LSDYKGKYLIVFFYPLDFTFVCPSEIIHFSNL

SEQ ID NO: 3191722 - protein, 24 aa, Giardia lamblia
LSDYTNIPVPKIEKIKPASSYASE

SEQ ID NO: 3191723 - protein, 31 aa, Giardia lamblia
LSEATDVYYGLWYTALFKKHYYEVVARYHIS

SEQ ID NO: 3191724 - protein, 29 aa, Giardia lamblia
LSEHVPPTSLMAPPALPPTTRMSQERRIL

SEQ ID NO: 3191725 - protein, 21 aa, Giardia lamblia
LSEILEFYTIPSGRCPEPCTN

SEQ ID NO: 3191726 - protein, 19 aa, Giardia lamblia
LSEILHDPVRAMQLLADVA

SEQ ID NO: 3191727 - protein, 18 aa, Giardia lamblia
LSEIQLLREQLYQKRIHG

SEQ ID NO: 3191728 - protein, 26 aa, Giardia lamblia
LSEKKFKLLSFFRDYLENRSIVPIPA

SEQ ID NO: 3191729 - protein, 25 aa, Giardia lamblia
LSELEKLLQQITFLTEELNASRLSA

SEQ ID NO: 3191730 - protein, 20 aa, Giardia lamblia
LSELPSAFRFLAVEPCNFLM

SEQ ID NO: 3191731 - protein, 23 aa, Giardia lamblia
LSELQQLMQRFPSSSLRSEATKL

SEQ ID NO: 3191732 - protein, 27 aa, Giardia lamblia
LSELRKSLQLELKRLNSFSVANDSMQL

SEQ ID NO: 3191733 - protein, 27 aa, Giardia lamblia
LSELRLAWQYPRRVASPRELVALGTCD

SEQ ID NO: 3191734 - protein, 30 aa, Giardia lamblia
LSEPYQIWTYRYFVEPWPTLTIFAESNEEI

SEQ ID NO: 3191735 - protein, 23 aa, Giardia lamblia
LSEQAIMFTSILSAKLSSPNFMD

SEQ ID NO: 3191736 - protein, 25 aa, Giardia lamblia
LSETDLVFIDPKKSFMQAQARRFIA

SEQ ID NO: 3191737 - protein, 18 aa, Giardia lamblia
LSFGAVAKALRALDDTPM

SEQ ID NO: 3191738 - protein, 20 aa, Giardia lamblia
LSFLKHLLPIYSTHSRDIIS

SEQ ID NO: 3191739 - protein, 17 aa, Giardia lamblia
LSFLNMGEPPVYNFPLL

SEQ ID NO: 3191740 - protein, 21 aa, Giardia lamblia
LSFSSLALAAISRGLLRATQS

SEQ ID NO: 3191741 - protein, 21 aa, Giardia lamblia
LSFTLFTHTLTVGPYAGCECI

SEQ ID NO: 3191742 - protein, 19 aa, Giardia lamblia
LSFVGIRRQDDCDLSPIPD

SEQ ID NO: 3191743 - protein, 49 aa, Giardia lamblia
LSGDEWLRFCDHWFCDGHRIFLYAALAAFPVVVPPRYLAESLSAPYHGF

SEQ ID NO: 3191744 - protein, 25 aa, Giardia lamblia
LSGDFFQRQTYYKDKKMRHIQAMER

SEQ ID NO: 3191745 - protein, 17 aa, Giardia lamblia
LSGFINFSPEKSNENAI

SEQ ID NO: 3191746 - protein, 18 aa, Giardia lamblia
LSGFLTIFLVAGSGEFIE

SEQ ID NO: 3191747 - protein, 30 aa, Giardia lamblia
LSGRLELVRALLPLERLALSFAGYTELMMH

SEQ ID NO: 3191748 - protein, 25 aa, Giardia lamblia
LSGSGLPYNPLLAQIARNARVCVSW

SEQ ID NO: 3191749 - protein, 18 aa, Giardia lamblia
LSGVAFDSLHILGSKKSK

SEQ ID NO: 3191750 - protein, 36 aa, Giardia lamblia
LSGVLRAEYLEFPEKFIPCILQRVKPEYINKTYNIR

SEQ ID NO: 3191751 - protein, 17 aa, Giardia lamblia
LSGYLDDVSRMPATDQN

SEQ ID NO: 3191752 - protein, 17 aa, Giardia lamblia
LSHFIFKAYTDSSDGRC

SEQ ID NO: 3191753 - protein, 18 aa, Giardia lamblia
LSHGIPAWMLNRNNDFES

SEQ ID NO: 3191754 - protein, 18 aa, Giardia lamblia
LSHIFSQLVLLVDHDSTV

SEQ ID NO: 3191755 - protein, 19 aa, Giardia lamblia
LSHLLSPWIEYVVNSIDKE

SEQ ID NO: 3191756 - protein, 25 aa, Giardia lamblia
LSHPALDPWFVIDRTLLESSYLQKS

SEQ ID NO: 3191757 - protein, 22 aa, Giardia lamblia
LSHQIAMFKYNKDDSIIPVSHG

SEQ ID NO: 3191758 - protein, 26 aa, Giardia lamblia
LSHSLLYFSKVVAEFRLLCVHRHLQS

SEQ ID NO: 3191759 - protein, 28 aa, Giardia lamblia
LSIGELQSFFSILRIHKAGIQCVFAEYD

SEQ ID NO: 3191760 - protein, 22 aa, Giardia lamblia
LSIHQLLCKKVAQLTKVVYQLN

SEQ ID NO: 3191761 - protein, 26 aa, Giardia lamblia
LSIIENSLFWCQYSNVLTEIRQEYGF

SEQ ID NO: 3191762 - protein, 20 aa, Giardia lamblia
LSIMAPFIEFRDNTPLLTIN

SEQ ID NO: 3191763 - protein, 20 aa, Giardia lamblia
LSINLYELLTKKDLKGLSLS

SEQ ID NO: 3191764 - protein, 21 aa, Giardia lamblia
LSISQCRLVIRLLCLTMGTQP

SEQ ID NO: 3191765 - protein, 29 aa, Giardia lamblia
LSISTYPSIYYTLLHFYNNGYDNFILLYK

SEQ ID NO: 3191766 - protein, 22 aa, Giardia lamblia
LSIYHLLRTERVSTILLSGVAS

SEQ ID NO: 3191767 - protein, 20 aa, Giardia lamblia
LSKARIFPMDLKESLRQAYL

SEQ ID NO: 3191768 - protein, 33 aa, Giardia lamblia
LSKDLSIDAFDKLPLLAADLNDSGPTALPSSPS

SEQ ID NO: 3191769 - protein, 26 aa, Giardia lamblia
LSKHAYLRAFIIDPLFVQHKDTILNS

SEQ ID NO: 3191770 - protein, 27 aa, Giardia lamblia
LSKHIISLFFMAFYYVLDNYGLLKDPE

SEQ ID NO: 3191771 - protein, 22 aa, Giardia lamblia
LSKLSALVYKAVGRAPVVFDDI

SEQ ID NO: 3191772 - protein, 20 aa, Giardia lamblia
LSKLVHILDAKLAEYETVAS

SEQ ID NO: 3191773 - protein, 18 aa, Giardia lamblia
LSKRGMCGQMILKKSRTI

SEQ ID NO: 3191774 - protein, 24 aa, Giardia lamblia
LSKSLGQLPRPITRPATRAIPMDI

SEQ ID NO: 3191775 - protein, 30 aa, Giardia lamblia
LSKTHFTSFIWPVMKRIMAAVLVAFGKAVL

SEQ ID NO: 3191776 - protein, 20 aa, Giardia lamblia
LSKVLYSFKLPTHQLELRVM

SEQ ID NO: 3191777 - protein, 17 aa, Giardia lamblia
LSKYPKPVAPEGCIPIL

SEQ ID NO: 3191778 - protein, 29 aa, Giardia lamblia
LSLASHLEYQFLLHYERLIIYDEGSTLFA

SEQ ID NO: 3191779 - protein, 18 aa, Giardia lamblia
LSLHIIENVYLWDNVRIK

SEQ ID NO: 3191780 - protein, 19 aa, Giardia lamblia
LSLKLGAIRFICCKKDKIR

SEQ ID NO: 3191781 - protein, 19 aa, Giardia lamblia
LSLPLFSSALVRESSVFPK

SEQ ID NO: 3191782 - protein, 27 aa, Giardia lamblia
LSLPVRSLKISPWSDVEWSLIPPIVSS

SEQ ID NO: 3191783 - protein, 25 aa, Giardia lamblia
LSLQYAFMYYAYLEPGNQARKTKLS

SEQ ID NO: 3191784 - protein, 22 aa, Giardia lamblia
LSLRALLYLPNLTELHVDFWAL

SEQ ID NO: 3191785 - protein, 43 aa, Giardia lamblia
LSLSVLSKTFLDLAVLLRPSIFNNDYLILNGFGSIVLDDSDKR

SEQ ID NO: 3191786 - protein, 28 aa, Giardia lamblia
LSLTDIFSAFLRPRTERELRMVYTSVGS

SEQ ID NO: 3191787 - protein, 24 aa, Giardia lamblia
LSMAMFCQSLVWPVETYLGQYKVV

SEQ ID NO: 3191788 - protein, 22 aa, Giardia lamblia
LSMSSSLLQALGLKSNDRASFG

SEQ ID NO: 3191789 - protein, 18 aa, Giardia lamblia
LSMTGQRPVLEPKNHTPV

SEQ ID NO: 3191790 - protein, 22 aa, Giardia lamblia
LSNALGRMFFSLTSSSQYTTGP

SEQ ID NO: 3191791 - protein, 26 aa, Giardia lamblia
LSNDCNYFSIVLQKLYGDLLSQELLE

SEQ ID NO: 3191792 - protein, 45 aa, Giardia lamblia
LSNERLILNTYFYTNRFFIPQPNRLAMFNILAISGGLFMSRDERL

SEQ ID NO: 3191793 - protein, 18 aa, Giardia lamblia
LSNNDLNHIYAVHPTHFK

SEQ ID NO: 3191794 - protein, 25 aa, Giardia lamblia
LSNNLAMQLIPQLPAFMSIEVFINK

SEQ ID NO: 3191795 - protein, 34 aa, Giardia lamblia
LSNNLIENFYTLCALLSKFPLLQTVILSNNSLQV

SEQ ID NO: 3191796 - protein, 29 aa, Giardia lamblia
LSNNRITSRFLIPYLKPSDLVALGIDCAE

SEQ ID NO: 3191797 - protein, 27 aa, Giardia lamblia
LSNRLEQELLALRKALGSTGITGVEIQ

SEQ ID NO: 3191798 - protein, 17 aa, Giardia lamblia
LSNYLTIHLQSVAVFRT

SEQ ID NO: 3191799 - protein, 27 aa, Giardia lamblia
LSPCDGFDYLLRLILLITEGCNNALAQ

SEQ ID NO: 3191800 - protein, 25 aa, Giardia lamblia
LSPEKIFIIVNQLASGLAYLHSPDK

SEQ ID NO: 3191801 - protein, 26 aa, Giardia lamblia
LSPFQILLRALRSYFPRRIHHYRIGR

SEQ ID NO: 3191802 - protein, 19 aa, Giardia lamblia
LSPIALLESLGIFEQENIC

SEQ ID NO: 3191803 - protein, 18 aa, Giardia lamblia
LSPLALPLSAAGSSAKAL

SEQ ID NO: 3191804 - protein, 21 aa, Giardia lamblia
LSPLLMALKYKQDTIAHMCFE

SEQ ID NO: 3191805 - protein, 28 aa, Giardia lamblia
LSPLRQRRPEAFPAHPGLLIKGPTVREH

SEQ ID NO: 3191806 - protein, 18 aa, Giardia lamblia
LSPPVLKAIHSLGYSTLT

SEQ ID NO: 3191807 - protein, 23 aa, Giardia lamblia
LSPTLRMLLRNIPPTTQVELQIP

SEQ ID NO: 3191808 - protein, 17 aa, Giardia lamblia
LSQGINNFVFPQSYDYY

SEQ ID NO: 3191809 - protein, 18 aa, Giardia lamblia
LSQGLVQGLWPNMEPMLS

SEQ ID NO: 3191810 - protein, 23 aa, Giardia lamblia
LSQHTRALARLQSNLRNYSRHTN

SEQ ID NO: 3191811 - protein, 26 aa, Giardia lamblia
LSQILYKRVPYLYKVIIDRVPVIAEY

SEQ ID NO: 3191812 - protein, 18 aa, Giardia lamblia
LSQIVSALRYLHGNPLGR

SEQ ID NO: 3191813 - protein, 25 aa, Giardia lamblia
LSQNKPPLYSFNKAASRKIVDPPEK

SEQ ID NO: 3191814 - protein, 19 aa, Giardia lamblia
LSQVIISVLFGVTRLDTGM

SEQ ID NO: 3191815 - protein, 25 aa, Giardia lamblia
LSRAGDSAVPLLASASLQGALNKQE

SEQ ID NO: 3191816 - protein, 19 aa, Giardia lamblia
LSRCFDERMAPILRTLWRV

SEQ ID NO: 3191817 - protein, 38 aa, Giardia lamblia
LSRDVPVYLFDGFAPTPYVSYLNKYYKCACGVMVTASH

SEQ ID NO: 3191818 - protein, 24 aa, Giardia lamblia
LSRELVSLVTYFKDAVIPRERQLA

SEQ ID NO: 3191819 - protein, 17 aa, Giardia lamblia
LSRIRVTSLTELIYKQG

SEQ ID NO: 3191820 - protein, 24 aa, Giardia lamblia
LSRLPGTMIVPPRCLFLLDHITAA

SEQ ID NO: 3191821 - protein, 20 aa, Giardia lamblia
LSRPAAPRTLCKQLMVSLLD

SEQ ID NO: 3191822 - protein, 20 aa, Giardia lamblia
LSRQLSEKVFLLGALTIRQS

SEQ ID NO: 3191823 - protein, 28 aa, Giardia lamblia
LSRRGFYPLAFVFLSPTDFTRTVHAIFD

SEQ ID NO: 3191824 - protein, 18 aa, Giardia lamblia
LSRTNLMIRYFNGNIVSL

SEQ ID NO: 3191825 - protein, 23 aa, Giardia lamblia
LSRYFAPMYIVYVTNSDMLLTEP

SEQ ID NO: 3191826 - protein, 26 aa, Giardia lamblia
LSSAEFLMGFLLSAPVPLQRTVLMTI

SEQ ID NO: 3191827 - protein, 39 aa, Giardia lamblia
LSSALRVSKLHYAFPFLHRYIAILYTPSLDLTDSLDPKK

SEQ ID NO: 3191828 - protein, 27 aa, Giardia lamblia
LSSCSSCLLPILPYKLKNEKASVLYDR

SEQ ID NO: 3191829 - protein, 18 aa, Giardia lamblia
LSSFIRKQKIMLEGQEAN

SEQ ID NO: 3191830 - protein, 21 aa, Giardia lamblia
LSSFNLTALMAAAWYGHIECV

SEQ ID NO: 3191831 - protein, 19 aa, Giardia lamblia
LSSIFYLPLTSSLSRDNRE

SEQ ID NO: 3191832 - protein, 20 aa, Giardia lamblia
LSSILEDKLILAKKQYTPEL

SEQ ID NO: 3191833 - protein, 24 aa, Giardia lamblia
LSSILNPLLVVILSKLLSKSESNL

SEQ ID NO: 3191834 - protein, 24 aa, Giardia lamblia
LSSKDILIADLMAQLQSLKSNNEQ

SEQ ID NO: 3191835 - protein, 24 aa, Giardia lamblia
LSSKLKTPFLLEAKQPRTVYVAGW

SEQ ID NO: 3191836 - protein, 49 aa, Giardia lamblia
LSSLFLSGRLRYVLLVVPSTLQTQWLEMVRSWWPLTRCILLNRASAVAY

SEQ ID NO: 3191837 - protein, 24 aa, Giardia lamblia
LSSQSLWIHLLQNGVLNHIKMLFE

SEQ ID NO: 3191838 - protein, 22 aa, Giardia lamblia
LSSQYSLLLPICKELQSHLVPA

SEQ ID NO: 3191839 - protein, 29 aa, Giardia lamblia
LSSSPTELLKLLNLLLDGLIERASYEHKN

SEQ ID NO: 3191840 - protein, 32 aa, Giardia lamblia
LSSSTYPHLGILRPTTIIFPPSDEPSTFFIVG

SEQ ID NO: 3191841 - protein, 26 aa, Giardia lamblia
LSSTCQQPLPMPPYYIKDLSYDVEPN

SEQ ID NO: 3191842 - protein, 30 aa, Giardia lamblia
LSSTLDPFFSTCAPLRFIDCQLQIEVLIPY

SEQ ID NO: 3191843 - protein, 17 aa, Giardia lamblia
LSSVKAEKLLLEEKIRT

SEQ ID NO: 3191844 - protein, 29 aa, Giardia lamblia
LSSVSSIFVRELLKRIFVLTPEDRITADE

SEQ ID NO: 3191845 - protein, 17 aa, Giardia lamblia
LSSYFGDRKKNLFKLVL

SEQ ID NO: 3191846 - protein, 37 aa, Giardia lamblia
LSSYGFVLLVIFYLQILQTPILPVLQPGLGWGPVVRG

SEQ ID NO: 3191847 - protein, 28 aa, Giardia lamblia
LSTDDRKYLILLISGSIFSSAETACPFC

SEQ ID NO: 3191848 - protein, 17 aa, Giardia lamblia
LSTIAGNKRLSSGVIGC

SEQ ID NO: 3191849 - protein, 18 aa, Giardia lamblia
LSTIFHLEYSTTVDNMLL

SEQ ID NO: 3191850 - protein, 17 aa, Giardia lamblia
LSTIFNSGRYFFPSLLR

SEQ ID NO: 3191851 - protein, 24 aa, Giardia lamblia
LSTKFSDVILERSIWNIIAADMLV

SEQ ID NO: 3191852 - protein, 23 aa, Giardia lamblia
LSTLDLLVTLFLCVLCKRPIPAL

SEQ ID NO: 3191853 - protein, 24 aa, Giardia lamblia
LSTLLRSIYHRRFLAAILAGDILP

SEQ ID NO: 3191854 - protein, 26 aa, Giardia lamblia
LSTNGRPILCPSLIEALQQVYARISA

SEQ ID NO: 3191855 - protein, 19 aa, Giardia lamblia
LSTSFLIHQRPHLFSNLFC

SEQ ID NO: 3191856 - protein, 19 aa, Giardia lamblia
LSTSLIKLEYRQLAYEYML

SEQ ID NO: 3191857 - protein, 24 aa, Giardia lamblia
LSTVMKRRCYLDNFCVPFAGYHIE

SEQ ID NO: 3191858 - protein, 18 aa, Giardia lamblia
LSTYSFQMSIPATDYYII

SEQ ID NO: 3191859 - protein, 29 aa, Giardia lamblia
LSVHPSFHSLECLILLFSSAPKPLSSTEA

SEQ ID NO: 3191860 - protein, 21 aa, Giardia lamblia
LSVIIALQYLLYTAELDPVTL

SEQ ID NO: 3191861 - protein, 28 aa, Giardia lamblia
LSVKEVFQYLLSESLKPLGRIMDRYINE

SEQ ID NO: 3191862 - protein, 19 aa, Giardia lamblia
LSVLLGCRAYFEVSAADGT

SEQ ID NO: 3191863 - protein, 17 aa, Giardia lamblia
LSVLPSWLMESSVSFKL

SEQ ID NO: 3191864 - protein, 25 aa, Giardia lamblia
LSVPRAKLLILRTKFPLPPDEVPTS

SEQ ID NO: 3191865 - protein, 19 aa, Giardia lamblia
LSVRSLSLNAAQPTKSMRL

SEQ ID NO: 3191866 - protein, 19 aa, Giardia lamblia
LSYSSILSNLFDGLSAPSG

SEQ ID NO: 3191867 - protein, 29 aa, Giardia lamblia
LSYYTSRLPVPILDLGIISVPYLAEYLFH

SEQ ID NO: 3191868 - protein, 26 aa, Giardia lamblia
LTAANHVFLLNPNWNPTIDDQSVERC

SEQ ID NO: 3191869 - protein, 19 aa, Giardia lamblia
LTAAQYFEKPFTAFRDRRH

SEQ ID NO: 3191870 - protein, 21 aa, Giardia lamblia
LTAAWIAAIQSKNPEKRARST

SEQ ID NO: 3191871 - protein, 19 aa, Giardia lamblia
LTAEDFKRMFPGEKVPSCI

SEQ ID NO: 3191872 - protein, 17 aa, Giardia lamblia
LTALMIAAMLDNKDTCE

SEQ ID NO: 3191873 - protein, 19 aa, Giardia lamblia
LTALMQAALMNCAETAELL

SEQ ID NO: 3191874 - protein, 24 aa, Giardia lamblia
LTAQVQRFIGVNSTLTRCISEATV

SEQ ID NO: 3191875 - protein, 20 aa, Giardia lamblia
LTASQLYNPLVPGSATVATA

SEQ ID NO: 3191876 - protein, 26 aa, Giardia lamblia
LTCPSEFLLLSLLSHALDLVAEESHN

SEQ ID NO: 3191877 - protein, 19 aa, Giardia lamblia
LTCRSQRIRRLYFANKKHC

SEQ ID NO: 3191878 - protein, 25 aa, Giardia lamblia
LTCSPLCVLTVFPYAHRQGFIVVAS

SEQ ID NO: 3191879 - protein, 22 aa, Giardia lamblia
LTDCINLLRILKIDSGSDDPFI

SEQ ID NO: 3191880 - protein, 24 aa, Giardia lamblia
LTDDFNYNYALLLERDKTIDILEA

SEQ ID NO: 3191881 - protein, 26 aa, Giardia lamblia
LTDGKSLLAILLYDRLKGSQGGAFAS

SEQ ID NO: 3191882 - protein, 17 aa, Giardia lamblia
LTDMHEKEIRALRKELA

SEQ ID NO: 3191883 - protein, 28 aa, Giardia lamblia
LTDNYPPDPVGALLRRIYNPAPVHAEGI

SEQ ID NO: 3191884 - protein, 27 aa, Giardia lamblia
LTDSSPQIPLLFILSQGADPTSQLLAF

SEQ ID NO: 3191885 - protein, 23 aa, Giardia lamblia
LTDTIGLIAFDPAAGLLLGLTSS

SEQ ID NO: 3191886 - protein, 24 aa, Giardia lamblia
LTDYLGAKVLPLKYISEPREEFLT

SEQ ID NO: 3191887 - protein, 38 aa, Giardia lamblia
LTEDAVLFDILSYQWPTIYDFLLDFSSLRIPLGKFLRV

SEQ ID NO: 3191888 - protein, 25 aa, Giardia lamblia
LTEKIYRLKAYFVDLLFANDSELVA

SEQ ID NO: 3191889 - protein, 18 aa, Giardia lamblia
LTELAAEASFLASDDLLK

SEQ ID NO: 3191890 - protein, 25 aa, Giardia lamblia
LTELFAIFTIILRKQFNHCVYALEK

SEQ ID NO: 3191891 - protein, 18 aa, Giardia lamblia
LTELITGKVMFPIPQKAD

SEQ ID NO: 3191892 - protein, 24 aa, Giardia lamblia
LTEMRSLLVFYRSISNVYWDADHR

SEQ ID NO: 3191893 - protein, 19 aa, Giardia lamblia
LTEPQYKTAWSSEYMDLVI

SEQ ID NO: 3191894 - protein, 26 aa, Giardia lamblia
LTESLTPVFIKRSGITSLIYLHDDNF

SEQ ID NO: 3191895 - protein, 36 aa, Giardia lamblia
LTEYFTASFCILKGMFRICFLTLPNPHPMVIQVVQL

SEQ ID NO: 3191896 - protein, 23 aa, Giardia lamblia
LTEYNLFLEFLKESVMNVPSYRI

SEQ ID NO: 3191897 - protein, 24 aa, Giardia lamblia
LTFSLQPPQILMFDTYHSIFIIDG

SEQ ID NO: 3191898 - protein, 25 aa, Giardia lamblia
LTGDVIPVYIFNGPIYYQKLKHMVK

SEQ ID NO: 3191899 - protein, 18 aa, Giardia lamblia
LTGFSLYDDIYMCRIILS

SEQ ID NO: 3191900 - protein, 23 aa, Giardia lamblia
LTGSKLLLVPAVTSPLDAELQCV

SEQ ID NO: 3191901 - protein, 17 aa, Giardia lamblia
LTHAAGVRYMTLYEITG

SEQ ID NO: 3191902 - protein, 25 aa, Giardia lamblia
LTHFRRFLIDTWPTSIVWSPDGTSI

SEQ ID NO: 3191903 - protein, 17 aa, Giardia lamblia
LTHILIMNGDVVCRYPF

SEQ ID NO: 3191904 - protein, 20 aa, Giardia lamblia
LTHITIYCPLTDTRPFRYKE

SEQ ID NO: 3191905 - protein, 19 aa, Giardia lamblia
LTHQRACKFIADTICKFTP

SEQ ID NO: 3191906 - protein, 17 aa, Giardia lamblia
LTHSSSAILPLLERKDT

SEQ ID NO: 3191907 - protein, 18 aa, Giardia lamblia
LTIHLQSVAVFRTIAFSA

SEQ ID NO: 3191908 - protein, 18 aa, Giardia lamblia
LTIMLRNQLVSFDGLSSF

SEQ ID NO: 3191909 - protein, 23 aa, Giardia lamblia
LTIPGIRIVIDLGLSRVSRYYPA

SEQ ID NO: 3191910 - protein, 27 aa, Giardia lamblia
LTISDLDYLFPAILARLEQFNMTQLKV

SEQ ID NO: 3191911 - protein, 18 aa, Giardia lamblia
LTKEEILPHIQRFELDNP

SEQ ID NO: 3191912 - protein, 17 aa, Giardia lamblia
LTKELEITKESLRTVTE

SEQ ID NO: 3191913 - protein, 23 aa, Giardia lamblia
LTKELRPIFLDTLIISTMHAEEI

SEQ ID NO: 3191914 - protein, 24 aa, Giardia lamblia
LTKHFQYELNILQMRLKEVEESSF

SEQ ID NO: 3191915 - protein, 25 aa, Giardia lamblia
LTKKNILPLYVAVQYTAHEYVKLLL

SEQ ID NO: 3191916 - protein, 23 aa, Giardia lamblia
LTKQILYYTYLLTTARSSSVTHK

SEQ ID NO: 3191917 - protein, 27 aa, Giardia lamblia
LTKTSFPCLLHFDPGFHLSVCLQNLGD

SEQ ID NO: 3191918 - protein, 18 aa, Giardia lamblia
LTKYIRTYRQKKENIPEA

SEQ ID NO: 3191919 - protein, 25 aa, Giardia lamblia
LTLASSVVPMLLHGDLWGGNAGSSG

SEQ ID NO: 3191920 - protein, 19 aa, Giardia lamblia
LTLDYNLELYPKLNKNARS

SEQ ID NO: 3191921 - protein, 22 aa, Giardia lamblia
LTLEAEVLALRKSLKQSEESRR

SEQ ID NO: 3191922 - protein, 18 aa, Giardia lamblia
LTLGEFRRVCIIKGIYPQ

SEQ ID NO: 3191923 - protein, 18 aa, Giardia lamblia
LTLPKPLEHYVSAAKLSP

SEQ ID NO: 3191924 - protein, 26 aa, Giardia lamblia
LTLYAKHHRLHLTLPHPIDPKSVKAS

SEQ ID NO: 3191925 - protein, 17 aa, Giardia lamblia
LTMDLATAPDNIPELKK

SEQ ID NO: 3191926 - protein, 17 aa, Giardia lamblia
LTMRWDTRAGCRAKRPR

SEQ ID NO: 3191927 - protein, 18 aa, Giardia lamblia
LTNHFLARLLNQTRRALL

SEQ ID NO: 3191928 - protein, 19 aa, Giardia lamblia
LTNLLTELSFATSLCRLLV

SEQ ID NO: 3191929 - protein, 18 aa, Giardia lamblia
LTNNAGETALILAARNGH

SEQ ID NO: 3191930 - protein, 21 aa, Giardia lamblia
LTNPLVVITDTVLSSAAPLVS

SEQ ID NO: 3191931 - protein, 28 aa, Giardia lamblia
LTNPRVLLRLLHEFWMSLREDIVEGDGH

SEQ ID NO: 3191932 - protein, 23 aa, Giardia lamblia
LTPATRRGLYAACLYASPMLMEP

SEQ ID NO: 3191933 - protein, 17 aa, Giardia lamblia
LTPLGLATYGALSCVFL

SEQ ID NO: 3191934 - protein, 17 aa, Giardia lamblia
LTPMMWAAEKGYHEIVH

SEQ ID NO: 3191935 - protein, 31 aa, Giardia lamblia
LTPPTAWAPFHLWPNIPTRPSYFPPATDEVV

SEQ ID NO: 3191936 - protein, 18 aa, Giardia lamblia
LTQEFRLVLSCFSSARLS

SEQ ID NO: 3191937 - protein, 20 aa, Giardia lamblia
LTQEVWRMRAENERLSRANT

SEQ ID NO: 3191938 - protein, 18 aa, Giardia lamblia
LTQLLELPCTMESLASLM

SEQ ID NO: 3191939 - protein, 37 aa, Giardia lamblia
LTQPSSTMYGPPGSDIYLIAPCRHLIVTIGSPLVPQR

SEQ ID NO: 3191940 - protein, 25 aa, Giardia lamblia
LTQQSIEKLPWSLNFHMPTRAEPTP

SEQ ID NO: 3191941 - protein, 18 aa, Giardia lamblia
LTQSCFIPLLNEYKAQIK

SEQ ID NO: 3191942 - protein, 23 aa, Giardia lamblia
LTQYNDPLLTCPNPDLKSSMDSL

SEQ ID NO: 3191943 - protein, 19 aa, Giardia lamblia
LTRAAKLPPLYQPMHSYAK

SEQ ID NO: 3191944 - protein, 19 aa, Giardia lamblia
LTRAVLRLGWKFPTTVQEK

SEQ ID NO: 3191945 - protein, 31 aa, Giardia lamblia
LTREAVYLIVRYLPIALAEPDNLRARYWLSY

SEQ ID NO: 3191946 - protein, 19 aa, Giardia lamblia
LTRHFVAIRDSPTEDYSKP

SEQ ID NO: 3191947 - protein, 33 aa, Giardia lamblia
LTRLVQSLGDFTRPIIKISYIAHHIAVLSMDGY

SEQ ID NO: 3191948 - protein, 26 aa, Giardia lamblia
LTRTILSHLVAFTKYTPLLSDEATTP

SEQ ID NO: 3191949 - protein, 27 aa, Giardia lamblia
LTSFDCFIRFILLADYRMAHAFMDLYK

SEQ ID NO: 3191950 - protein, 17 aa, Giardia lamblia
LTSFPVPAQRWARNARG

SEQ ID NO: 3191951 - protein, 19 aa, Giardia lamblia
LTSLRLRGFDFCEALNLLL

SEQ ID NO: 3191952 - protein, 26 aa, Giardia lamblia
LTSMRAMIVIPRQPPMKLKGRTNPFT

SEQ ID NO: 3191953 - protein, 27 aa, Giardia lamblia
LTSQGPATALLFAVKALELLVTPEKHA

SEQ ID NO: 3191954 - protein, 18 aa, Giardia lamblia
LTSQTSIIRKCEADFLEV

SEQ ID NO: 3191955 - protein, 18 aa, Giardia lamblia
LTTFSYLQKPIVAHSSSE

SEQ ID NO: 3191956 - protein, 17 aa, Giardia lamblia
LTTLGCVISKLVEGSKH

SEQ ID NO: 3191957 - protein, 31 aa, Giardia lamblia
LTTLYFKALCDFHVLFPLLQDIRSVVAQISA

SEQ ID NO: 3191958 - protein, 27 aa, Giardia lamblia
LTTQTPPLPGVTLLSDSLTFSANTVPH

SEQ ID NO: 3191959 - protein, 34 aa, Giardia lamblia
LTVDKHGRPRRLTEAELYLLSKIGDYKSNSTATI

SEQ ID NO: 3191960 - protein, 36 aa, Giardia lamblia
LTVEGYSALYLALLSNHVGIARLLLPYEGFAYEEDQ

SEQ ID NO: 3191961 - protein, 26 aa, Giardia lamblia
LTVETSMLFLRYFLPTPPHCSTADRE

SEQ ID NO: 3191962 - protein, 17 aa, Giardia lamblia
LTVMFPDPQFKASHARR

SEQ ID NO: 3191963 - protein, 24 aa, Giardia lamblia
LTVPKNCSLWLPPGTAHYLGGNFL

SEQ ID NO: 3191964 - protein, 18 aa, Giardia lamblia
LTVVLKMINQFAPALSLH

SEQ ID NO: 3191965 - protein, 18 aa, Giardia lamblia
LTYALLNNNIEVAELLAP

SEQ ID NO: 3191966 - protein, 17 aa, Giardia lamblia
LTYCMDAMRIWSRSNLQ

SEQ ID NO: 3191967 - protein, 25 aa, Giardia lamblia
LTYDEMLTIIFTILNKRREDSDNAR

SEQ ID NO: 3191968 - protein, 26 aa, Giardia lamblia
LTYDTSINLLVLNLPLDATMTEIERR

SEQ ID NO: 3191969 - protein, 18 aa, Giardia lamblia
LTYILSDCSVFVDTSALQ

SEQ ID NO: 3191970 - protein, 19 aa, Giardia lamblia
LTYKKLIPAIYSLASDGYL

SEQ ID NO: 3191971 - protein, 21 aa, Giardia lamblia
LTYLRLAHVLIKMIEQTEGRD

SEQ ID NO: 3191972 - protein, 34 aa, Giardia lamblia
LTYLSEFVNSLFLYVQFILSHRPLIRVAFMTLQN

SEQ ID NO: 3191973 - protein, 17 aa, Giardia lamblia
LTYLTTVPDFRLLHQSL

SEQ ID NO: 3191974 - protein, 28 aa, Giardia lamblia
LTYVCRELKYQYLVRKWIPGQTTDGNGF

SEQ ID NO: 3191975 - protein, 28 aa, Giardia lamblia
LVAAHNVTWIKRFLLLRQRCLELHGPSL

SEQ ID NO: 3191976 - protein, 19 aa, Giardia lamblia
LVAGTRLILRISFAHLCHA

SEQ ID NO: 3191977 - protein, 18 aa, Giardia lamblia
LVAIMQQISPTNADLLPL

SEQ ID NO: 3191978 - protein, 23 aa, Giardia lamblia
LVALLTGAYLYASLLTVHLTFPY

SEQ ID NO: 3191979 - protein, 23 aa, Giardia lamblia
LVALSAYILELIASYYSISMCMS

SEQ ID NO: 3191980 - protein, 18 aa, Giardia lamblia
LVCFEAEHKLPHGSNALI

SEQ ID NO: 3191981 - protein, 25 aa, Giardia lamblia
LVCLDNRATIFYLPCQHMVTCRECE

SEQ ID NO: 3191982 - protein, 23 aa, Giardia lamblia
LVDGWTALMFSAKGNFIKCMDRL

SEQ ID NO: 3191983 - protein, 24 aa, Giardia lamblia
LVDIRAALPAFIGATAFIGASRKN

SEQ ID NO: 3191984 - protein, 17 aa, Giardia lamblia
LVDIVGGLAWLDFDSRK

SEQ ID NO: 3191985 - protein, 22 aa, Giardia lamblia
LVDLINSMLSFDSSARPKAEQL

SEQ ID NO: 3191986 - protein, 18 aa, Giardia lamblia
LVDLLVPYEAGMAMKDGR

SEQ ID NO: 3191987 - protein, 17 aa, Giardia lamblia
LVDLRKMETEWLIDTKA

SEQ ID NO: 3191988 - protein, 25 aa, Giardia lamblia
LVDNKPGLRPPLSLSSRSSSSRRAY

SEQ ID NO: 3191989 - protein, 18 aa, Giardia lamblia
LVDPFTATTLLKYAIKNL

SEQ ID NO: 3191990 - protein, 23 aa, Giardia lamblia
LVDPTPALHGIEHNMRRLEESIA

SEQ ID NO: 3191991 - protein, 19 aa, Giardia lamblia
LVDRLLNCLSPSQRETFLK

SEQ ID NO: 3191992 - protein, 20 aa, Giardia lamblia
LVDVSLLVRFTPCDPLDWVV

SEQ ID NO: 3191993 - protein, 20 aa, Giardia lamblia
LVEDAVTRLAFLEQELTQKS

SEQ ID NO: 3191994 - protein, 24 aa, Giardia lamblia
LVEDFISVFLTQGEKFYLAATEMP

SEQ ID NO: 3191995 - protein, 34 aa, Giardia lamblia
LVEDSYRIMIPAYLIPPRLSLTNRYSAKLLEWRQ

SEQ ID NO: 3191996 - protein, 18 aa, Giardia lamblia
LVEFLAAPGFTPELASSL

SEQ ID NO: 3191997 - protein, 17 aa, Giardia lamblia
LVEGLRFLDYCPQLRAL

SEQ ID NO: 3191998 - protein, 25 aa, Giardia lamblia
LVEKALPVLLATTPSPALPVVRIAS

SEQ ID NO: 3191999 - protein, 18 aa, Giardia lamblia
LVELLALYKELIGQYLRN

SEQ ID NO: 3192000 - protein, 26 aa, Giardia lamblia
LVELRHDCRSLWRSTGAKPIVVLDRS

SEQ ID NO: 3192001 - protein, 20 aa, Giardia lamblia
LVELWTQYHEQQPFDWYAKK

SEQ ID NO: 3192002 - protein, 28 aa, Giardia lamblia
LVERASEILPLLPYPRALERDKFIPPVY

SEQ ID NO: 3192003 - protein, 29 aa, Giardia lamblia
LVERASEILPLLPYPRALERDKFIPPVYN

SEQ ID NO: 3192004 - protein, 17 aa, Giardia lamblia
LVERYLETLTPNPIFLM

SEQ ID NO: 3192005 - protein, 18 aa, Giardia lamblia
LVERYRDDLFPIELIWGS

SEQ ID NO: 3192006 - protein, 23 aa, Giardia lamblia
LVESGVILVHYMERQRRSSLYRY

SEQ ID NO: 3192007 - protein, 19 aa, Giardia lamblia
LVETTFGFSFMSLAATINN

SEQ ID NO: 3192008 - protein, 22 aa, Giardia lamblia
LVFPVCCDVFTQALRFCTSGAT

SEQ ID NO: 3192009 - protein, 19 aa, Giardia lamblia
LVFSHDGRYLFSAGMDGIV

SEQ ID NO: 3192010 - protein, 25 aa, Giardia lamblia
LVGEYIFLHEFLKDAELIFSNCRTY

SEQ ID NO: 3192011 - protein, 26 aa, Giardia lamblia
LVGHPPIQDFLLQLGFQDKDGLTYRE

SEQ ID NO: 3192012 - protein, 24 aa, Giardia lamblia
LVGIEFYKVLLWNNPDLSARHPLA

SEQ ID NO: 3192013 - protein, 27 aa, Giardia lamblia
LVGKEFLPVPIICAVSISIPLPEQIGI

SEQ ID NO: 3192014 - protein, 18 aa, Giardia lamblia
LVGSKPLSHFGISSGSVI

SEQ ID NO: 3192015 - protein, 26 aa, Giardia lamblia
LVGSRVTALMYAAYYGYGMCVSLLAP

SEQ ID NO: 3192016 - protein, 25 aa, Giardia lamblia
LVGSSYPPITALPLGMPHVLHASGV

SEQ ID NO: 3192017 - protein, 30 aa, Giardia lamblia
LVHLSNNVKFLASIFTKDLLDFYRKERRQQ

SEQ ID NO: 3192018 - protein, 24 aa, Giardia lamblia
LVHSQLRFLKRANLKGRTALMHAA

SEQ ID NO: 3192019 - protein, 19 aa, Giardia lamblia
LVHYILSFWDCYNLKRLFM

SEQ ID NO: 3192020 - protein, 17 aa, Giardia lamblia
LVIAARKGYREIVELLD

SEQ ID NO: 3192021 - protein, 17 aa, Giardia lamblia
LVINGSPLTLKPAIERQ

SEQ ID NO: 3192022 - protein, 17 aa, Giardia lamblia
LVIRRCLERIPYARISS

SEQ ID NO: 3192023 - protein, 18 aa, Giardia lamblia
LVKAILFEIEKLANRGMS

SEQ ID NO: 3192024 - protein, 18 aa, Giardia lamblia
LVKFFNYACQLQLLASRT

SEQ ID NO: 3192025 - protein, 17 aa, Giardia lamblia
LVKLLNCFLSGSVNPNI

SEQ ID NO: 3192026 - protein, 19 aa, Giardia lamblia
LVKPNAIKSPLPAISSRPS

SEQ ID NO: 3192027 - protein, 24 aa, Giardia lamblia
LVKVACPFVIWIPGSIAMHEPEPA

SEQ ID NO: 3192028 - protein, 19 aa, Giardia lamblia
LVLAPHILVLLAQSDQNYK

SEQ ID NO: 3192029 - protein, 40 aa, Giardia lamblia
LVLERDFAISTILVEYIVLLLERIWLQRSRITLDTDVKKF

SEQ ID NO: 3192030 - protein, 18 aa, Giardia lamblia
LVLEYEIPIKLSTYVRFN

SEQ ID NO: 3192031 - protein, 18 aa, Giardia lamblia
LVLINYPTLVCTKACRLR

SEQ ID NO: 3192032 - protein, 25 aa, Giardia lamblia
LVMVRFEGFAVLVFCSPFSKITAAE

SEQ ID NO: 3192033 - protein, 26 aa, Giardia lamblia
LVMYPNLYRGALLHKRALSFKKLDTS

SEQ ID NO: 3192034 - protein, 27 aa, Giardia lamblia
LVNCCTLDWFTGWPDEALIDVGRSVYN

SEQ ID NO: 3192035 - protein, 28 aa, Giardia lamblia
LVNDTSPFFKLLFNNLQALKKMPTELSA

SEQ ID NO: 3192036 - protein, 23 aa, Giardia lamblia
LVNPIVLRFLRANPFIKQIPAEK

SEQ ID NO: 3192037 - protein, 17 aa, Giardia lamblia
LVNQVLSKFLTKFLHFK

SEQ ID NO: 3192038 - protein, 28 aa, Giardia lamblia
LVNTDMKYLAWIQHKTAVFNRSVANARP

SEQ ID NO: 3192039 - protein, 27 aa, Giardia lamblia
LVNVKQFLLGIYMKNVWPAAAIMHMNA

SEQ ID NO: 3192040 - protein, 19 aa, Giardia lamblia
LVPAAILSDKLRPTSSYAP

SEQ ID NO: 3192041 - protein, 24 aa, Giardia lamblia
LVPEAKYFSFLVQALPIVSMDRLR

SEQ ID NO: 3192042 - protein, 18 aa, Giardia lamblia
LVPKGTVQCLFFGMGSDG

SEQ ID NO: 3192043 - protein, 17 aa, Giardia lamblia
LVPLPQTTKPQVQVART

SEQ ID NO: 3192044 - protein, 17 aa, Giardia lamblia
LVPLQLPNRPCSTAAMY

SEQ ID NO: 3192045 - protein, 19 aa, Giardia lamblia
LVPLYRSIYEGKLTQIPLY

SEQ ID NO: 3192046 - protein, 29 aa, Giardia lamblia
LVPQQVARAWLAYFKNHAVPCIAFKSSTH

SEQ ID NO: 3192047 - protein, 28 aa, Giardia lamblia
LVQPTPIAAPVQPTPIAAPVQPTPIAAP

SEQ ID NO: 3192048 - protein, 17 aa, Giardia lamblia
LVRAQLSVYFLGPIYAY

SEQ ID NO: 3192049 - protein, 21 aa, Giardia lamblia
LVRESLQLCISSHIKSIMDAL

SEQ ID NO: 3192050 - protein, 24 aa, Giardia lamblia
LVRGNIFLYNFDPWEITRIGVAIL

SEQ ID NO: 3192051 - protein, 17 aa, Giardia lamblia
LVRIFPPVARELNHKAP

SEQ ID NO: 3192052 - protein, 18 aa, Giardia lamblia
LVRIVLLLKASTGDCPPT

SEQ ID NO: 3192053 - protein, 19 aa, Giardia lamblia
LVRKISFSAFQPIYGAQAN

SEQ ID NO: 3192054 - protein, 18 aa, Giardia lamblia
LVRLTLEEEIAALQSTLN

SEQ ID NO: 3192055 - protein, 25 aa, Giardia lamblia
LVRQDTLLFTGLISDLFPGVELQDV

SEQ ID NO: 3192056 - protein, 28 aa, Giardia lamblia
LVRSQKYLPFKQLAVSVAFFPSGPGSDS

SEQ ID NO: 3192057 - protein, 26 aa, Giardia lamblia
LVSASLMWATYGGGIVFYDIRSGKTL

SEQ ID NO: 3192058 - protein, 24 aa, Giardia lamblia
LVSDALAIMYMVPEILKCLQQDDG

SEQ ID NO: 3192059 - protein, 29 aa, Giardia lamblia
LVSDVKIFLNGSWLGFIDREYVQRLITDL

SEQ ID NO: 3192060 - protein, 26 aa, Giardia lamblia
LVSFETLPLCWCVIHGCSIFDILALE

SEQ ID NO: 3192061 - protein, 19 aa, Giardia lamblia
LVSFIERHQSFLKNQENSI

SEQ ID NO: 3192062 - protein, 25 aa, Giardia lamblia
LVSHLNASLRPLIDEVFSMEQRLKA

SEQ ID NO: 3192063 - protein, 18 aa, Giardia lamblia
LVSILERCVKEKRPLLII

SEQ ID NO: 3192064 - protein, 20 aa, Giardia lamblia
LVSLSRPHFIRGCRPTEVFV

SEQ ID NO: 3192065 - protein, 22 aa, Giardia lamblia
LVSNALLLAERLVAEILFADVV

SEQ ID NO: 3192066 - protein, 30 aa, Giardia lamblia
LVSQQASVILPFLRLVWGDASPSKITKGSV

SEQ ID NO: 3192067 - protein, 29 aa, Giardia lamblia
LVSSDAVFSCYLSFLRLAYFYHDKDLYSV

SEQ ID NO: 3192068 - protein, 24 aa, Giardia lamblia
LVSTNKLMLLFLKASNEIDCKSTP

SEQ ID NO: 3192069 - protein, 17 aa, Giardia lamblia
LVSTRDALGRTAMMYLV

SEQ ID NO: 3192070 - protein, 26 aa, Giardia lamblia
LVSTVPYFEKLTISRLTWIKHLYSTI

SEQ ID NO: 3192071 - protein, 24 aa, Giardia lamblia
LVTEEGRFTRRNGWTALMCAAYRG

SEQ ID NO: 3192072 - protein, 19 aa, Giardia lamblia
LVTPGLRFLGTREFLRPMT

SEQ ID NO: 3192073 - protein, 25 aa, Giardia lamblia
LVTSVDLRLLGPIISRLKTCSMCQL

SEQ ID NO: 3192074 - protein, 26 aa, Giardia lamblia
LVTSYSPLKAYIYQHAFCRFCTVEYS

SEQ ID NO: 3192075 - protein, 28 aa, Giardia lamblia
LVTWKTELAYVRPVIALLLAVITSKQGE

SEQ ID NO: 3192076 - protein, 20 aa, Giardia lamblia
LVVEFLGCSTYRFLQQYTRR

SEQ ID NO: 3192077 - protein, 19 aa, Giardia lamblia
LVVKNTFTELLGAVLKGAD

SEQ ID NO: 3192078 - protein, 25 aa, Giardia lamblia
LVVTDIIAGYERALRHILNQLDGNS

SEQ ID NO: 3192079 - protein, 28 aa, Giardia lamblia
LVVTVPWRLERSYALKAAKYRPLVLQGR

SEQ ID NO: 3192080 - protein, 22 aa, Giardia lamblia
LVWQTSVLPKMKAAPNLMTCCI

SEQ ID NO: 3192081 - protein, 18 aa, Giardia lamblia
LVWVIDGTVLTYLAALIP

SEQ ID NO: 3192082 - protein, 25 aa, Giardia lamblia
LVYLVKLRHLLELKAAEGVGSFVPC

SEQ ID NO: 3192083 - protein, 17 aa, Giardia lamblia
LVYRAPESTLRCYDFLS

SEQ ID NO: 3192084 - protein, 22 aa, Giardia lamblia
LVYVILSTFRDSHIGRLFTATH

SEQ ID NO: 3192085 - protein, 28 aa, Giardia lamblia
LWAQDSFGWCPLLYAIGFNRAYAVRCIL

SEQ ID NO: 3192086 - protein, 17 aa, Giardia lamblia
LWKALDDSLIQYKEILQ

SEQ ID NO: 3192087 - protein, 20 aa, Giardia lamblia
LWMNITKMNNPKISSLLILL

SEQ ID NO: 3192088 - protein, 24 aa, Giardia lamblia
LWNIRKFICITTISLPKTMKTPTR

SEQ ID NO: 3192089 - protein, 18 aa, Giardia lamblia
LWQFLIKMVDILPPEVLQ

SEQ ID NO: 3192090 - protein, 17 aa, Giardia lamblia
LWQKRFGRRLDYEERKR

SEQ ID NO: 3192091 - protein, 18 aa, Giardia lamblia
LWSAAKLPKPPKKQRVAR

SEQ ID NO: 3192092 - protein, 29 aa, Giardia lamblia
LWSTIISSPFIVYQYNRLFSTLELDSRSY

SEQ ID NO: 3192093 - protein, 19 aa, Giardia lamblia
LWTALMRAAWFGHSLCCEY

SEQ ID NO: 3192094 - protein, 19 aa, Giardia lamblia
LWTLRAMINLLPTASELHL

SEQ ID NO: 3192095 - protein, 26 aa, Giardia lamblia
LYADDITIILGFRKSCIFAGNRGCDP

SEQ ID NO: 3192096 - protein, 24 aa, Giardia lamblia
LYAFDTLYFKLAIERESLSVEDVL

SEQ ID NO: 3192097 - protein, 20 aa, Giardia lamblia
LYAKEIWFFSQADKEFLPRN

SEQ ID NO: 3192098 - protein, 19 aa, Giardia lamblia
LYAPIPDELLTSKPTTATA

SEQ ID NO: 3192099 - protein, 26 aa, Giardia lamblia
LYASLLTVHLTFPYTLHFVKVSSYKG

SEQ ID NO: 3192100 - protein, 20 aa, Giardia lamblia
LYATVCSTNLLWDISLDALE

SEQ ID NO: 3192101 - protein, 17 aa, Giardia lamblia
LYCFNWDPIFAGTESDP

SEQ ID NO: 3192102 - protein, 22 aa, Giardia lamblia
LYCIRNNNAEQALNLCFKALSC

SEQ ID NO: 3192103 - protein, 26 aa, Giardia lamblia
LYCNDVRFHLPQRLPIAIAKNICLQM

SEQ ID NO: 3192104 - protein, 18 aa, Giardia lamblia
LYDLMKRAENKLLPGVLS

SEQ ID NO: 3192105 - protein, 18 aa, Giardia lamblia
LYDQCYPLRRAKVKQVKD

SEQ ID NO: 3192106 - protein, 17 aa, Giardia lamblia
LYDSFNMAIDRKSQFIA

SEQ ID NO: 3192107 - protein, 19 aa, Giardia lamblia
LYEAKRLYEYMKERFEPIK

SEQ ID NO: 3192108 - protein, 19 aa, Giardia lamblia
LYEFVYQFDEPTIKDHLAY

SEQ ID NO: 3192109 - protein, 28 aa, Giardia lamblia
LYELKDVIYYIYLSVFISYYSTNGKLES

SEQ ID NO: 3192110 - protein, 17 aa, Giardia lamblia
LYELLERSPYETQTGLL

SEQ ID NO: 3192111 - protein, 31 aa, Giardia lamblia
LYESAKAILQPLLQTRLAARKYPEDRVPLST

SEQ ID NO: 3192112 - protein, 20 aa, Giardia lamblia
LYGAMGLVKLREGAFQEAIE

SEQ ID NO: 3192113 - protein, 18 aa, Giardia lamblia
LYGDAPSFIKWFVKLLEV

SEQ ID NO: 3192114 - protein, 17 aa, Giardia lamblia
LYGFMQLKTQPHLTPQF

SEQ ID NO: 3192115 - protein, 17 aa, Giardia lamblia
LYGLLDPVSRARAALRS

SEQ ID NO: 3192116 - protein, 25 aa, Giardia lamblia
LYINDSPVFVTYRSAFKNLKGNILD

SEQ ID NO: 3192117 - protein, 23 aa, Giardia lamblia
LYKHPDAIFIPRSGNLLQTAQFI

SEQ ID NO: 3192118 - protein, 17 aa, Giardia lamblia
LYLKKSLDEVIRACKGG

SEQ ID NO: 3192119 - protein, 19 aa, Giardia lamblia
LYLLLEVVILCMTPLSSDI

SEQ ID NO: 3192120 - protein, 17 aa, Giardia lamblia
LYLWNLQSRKRLFRLCE

SEQ ID NO: 3192121 - protein, 17 aa, Giardia lamblia
LYLYIKPTDDMDSLTSA

SEQ ID NO: 3192122 - protein, 29 aa, Giardia lamblia
LYMGMPSDVWQFGVALYSVLIGKHRELPL

SEQ ID NO: 3192123 - protein, 26 aa, Giardia lamblia
LYPFVRTSRFVPINSPLLDAINSLFP

SEQ ID NO: 3192124 - protein, 17 aa, Giardia lamblia
LYPVCLCDRNAAITTGS

SEQ ID NO: 3192125 - protein, 27 aa, Giardia lamblia
LYQLFTPEWRSELLCALFSILRAGGAL

SEQ ID NO: 3192126 - protein, 17 aa, Giardia lamblia
LYRDMREQLMEYNARQQ

SEQ ID NO: 3192127 - protein, 19 aa, Giardia lamblia
LYREEIDALVMEISGAFMD

SEQ ID NO: 3192128 - protein, 19 aa, Giardia lamblia
LYRIYDHYRDAHYAFGEEI

SEQ ID NO: 3192129 - protein, 18 aa, Giardia lamblia
LYRRCNCNNLMRIYKIVE

SEQ ID NO: 3192130 - protein, 21 aa, Giardia lamblia
LYSDLLFSRMESLASSISQSI

SEQ ID NO: 3192131 - protein, 25 aa, Giardia lamblia
LYSTLHLPHVLLQTTWDNIILPDTV

SEQ ID NO: 3192132 - protein, 18 aa, Giardia lamblia
LYTHYGEVRPFGCSLLIA

SEQ ID NO: 3192133 - protein, 18 aa, Giardia lamblia
LYTILQDGTGLNTEVMSG

SEQ ID NO: 3192134 - protein, 25 aa, Giardia lamblia
LYTNKAFRHGAGHTALMCAADWGDV

SEQ ID NO: 3192135 - protein, 29 aa, Giardia lamblia
LYTYVSRGLFVRHKLAFAFDICLSLQRTS

SEQ ID NO: 3192136 - protein, 17 aa, Giardia lamblia
LYVFMELCESDLQRLID

SEQ ID NO: 3192137 - protein, 33 aa, Giardia lamblia
LYVFVQRTTIVIPRLYLMALAASIWLEHLNNAR

SEQ ID NO: 3192138 - protein, 25 aa, Giardia lamblia
LYVKDITTLLFETALIQSGFDIEDT

SEQ ID NO: 3192139 - protein, 25 aa, Giardia lamblia
LYVTEGILLNWVRPGGAFLSSIGVL

SEQ ID NO: 3192140 - protein, 19 aa, Giardia lamblia
LYVTQIVKGLIFIHYNGYT

SEQ ID NO: 3192141 - protein, 25 aa, Giardia lamblia
LYYQVYFQQKHTPPYFSRAFVNRKI

SEQ ID NO: 3192142 - protein, 32 aa, Giardia lamblia
MAAAFCGHLQVVRFLLSCEGRMQTRFGTTALM

SEQ ID NO: 3192143 - protein, 28 aa, Giardia lamblia
MAALIGKYREIVCCLARLPDAKLPKTLA

SEQ ID NO: 3192144 - protein, 17 aa, Giardia lamblia
MAALKPPFQAAMLDQVL

SEQ ID NO: 3192145 - protein, 23 aa, Giardia lamblia
MADGYYQRRFVAAAVKNISNRPR

SEQ ID NO: 3192146 - protein, 24 aa, Giardia lamblia
MAELRSLLFPVIVQSSIKGFDIMR

SEQ ID NO: 3192147 - protein, 19 aa, Giardia lamblia
MAESISGLIPPIVSRCFCI

SEQ ID NO: 3192148 - protein, 17 aa, Giardia lamblia
MAILIENTGGRFPFWIS

SEQ ID NO: 3192149 - protein, 25 aa, Giardia lamblia
MAKMTLSVPKLAFSGALSLTMEGYI

SEQ ID NO: 3192150 - protein, 24 aa, Giardia lamblia
MAKTELLGRFIADAALDSALVEEV

SEQ ID NO: 3192151 - protein, 17 aa, Giardia lamblia
MALKLRHKIVTPTRVAV

SEQ ID NO: 3192152 - protein, 25 aa, Giardia lamblia
MANEDWSRFIPTFKKKNTKPYKPAK

SEQ ID NO: 3192153 - protein, 37 aa, Giardia lamblia
MAPIPSQICIQLLIHPLLLVSEYYQCFRLLFEANKTA

SEQ ID NO: 3192154 - protein, 19 aa, Giardia lamblia
MAQHLRWLSKLAHTHISPL

SEQ ID NO: 3192155 - protein, 19 aa, Giardia lamblia
MAQLVLFVAGMDLGWEASH

SEQ ID NO: 3192156 - protein, 22 aa, Giardia lamblia
MAQMRIFSKIKVLKLSDKDLVI

SEQ ID NO: 3192157 - protein, 19 aa, Giardia lamblia
MARFYRAASMKLAITAGVL

SEQ ID NO: 3192158 - protein, 24 aa, Giardia lamblia
MASGRRLFCLLTASRCFYGYISHS

SEQ ID NO: 3192159 - protein, 30 aa, Giardia lamblia
MASHSILGAMELLLDRTLAALAQIPVDKFQ

SEQ ID NO: 3192160 - protein, 17 aa, Giardia lamblia
MASRKDSFIKRRARFVG

SEQ ID NO: 3192161 - protein, 22 aa, Giardia lamblia
MASTRVCLLAANRIRVAGMNGV

SEQ ID NO: 3192162 - protein, 25 aa, Giardia lamblia
MASVALNALTLCELQLDLQSQANSS

SEQ ID NO: 3192163 - protein, 18 aa, Giardia lamblia
MASYLPQHARTFPSASPT

SEQ ID NO: 3192164 - protein, 23 aa, Giardia lamblia
MATDGNYWFIKGDVAYLSGDSET

SEQ ID NO: 3192165 - protein, 18 aa, Giardia lamblia
MATVLYPSTLASLRSLYC

SEQ ID NO: 3192166 - protein, 27 aa, Giardia lamblia
MAVIDDLSRKCLFQRKLIIQISDKHAA

SEQ ID NO: 3192167 - protein, 30 aa, Giardia lamblia
MAVKHGYLEIVQLLMPFEGHIYTREGNTSL

SEQ ID NO: 3192168 - protein, 21 aa, Giardia lamblia
MAVTLQPFLGLGEPLGLYARD

SEQ ID NO: 3192169 - protein, 24 aa, Giardia lamblia
MCAAEFGHFECCKLLLGGEGLIHT

SEQ ID NO: 3192170 - protein, 23 aa, Giardia lamblia
MCDLETLPLLSLLANHILGEVAT

SEQ ID NO: 3192171 - protein, 33 aa, Giardia lamblia
MCEACNQHFYGRPIFLYKGGCYVITDPLGDTIC

SEQ ID NO: 3192172 - protein, 43 aa, Giardia lamblia
MCGNNTACAFLAPMEAHIVLPSKLSMLMLAAKLGNCDAVNCVV

SEQ ID NO: 3192173 - protein, 17 aa, Giardia lamblia
MCGQMILKKSRTIKSRA

SEQ ID NO: 3192174 - protein, 17 aa, Giardia lamblia
MCKNYIPHILGMFTNVM

SEQ ID NO: 3192175 - protein, 28 aa, Giardia lamblia
MCLEEFRAFLLLCSSLQRVKLLLHGEKA

SEQ ID NO: 3192176 - protein, 19 aa, Giardia lamblia
MCMYEIATRLKDGSTPLHF

SEQ ID NO: 3192177 - protein, 17 aa, Giardia lamblia
MCRPYINTAIFMGVQGL

SEQ ID NO: 3192178 - protein, 23 aa, Giardia lamblia
MCTGQPCFWGRTPSELADNVASG

SEQ ID NO: 3192179 - protein, 23 aa, Giardia lamblia
MCVPQMQLICEIMILSEGFATAK

SEQ ID NO: 3192180 - protein, 18 aa, Giardia lamblia
MCVSLLAPREHSLVDKNG

SEQ ID NO: 3192181 - protein, 24 aa, Giardia lamblia
MCYTDCTPFLALSKFRATEKQGIL

SEQ ID NO: 3192182 - protein, 28 aa, Giardia lamblia
MDAADPRSFLLLPRLIRAAHMNSTETVR

SEQ ID NO: 3192183 - protein, 22 aa, Giardia lamblia
MDAIPNAVLVPCRHMILCKACA

SEQ ID NO: 3192184 - protein, 17 aa, Giardia lamblia
MDDYNMLPFVWGSSQLI

SEQ ID NO: 3192185 - protein, 20 aa, Giardia lamblia
MDETELMLAALNGDLMLVDQ

SEQ ID NO: 3192186 - protein, 18 aa, Giardia lamblia
MDFVFKGVSYKKQLEAAR

SEQ ID NO: 3192187 - protein, 18 aa, Giardia lamblia
MDGTRFYNPICPLEIAKR

SEQ ID NO: 3192188 - protein, 23 aa, Giardia lamblia
MDNYVTTIAYLTTLPFVILNEFL

SEQ ID NO: 3192189 - protein, 24 aa, Giardia lamblia
MDPEKVVAFLTKTLSKITPAQDHK

SEQ ID NO: 3192190 - protein, 32 aa, Giardia lamblia
MDPELLLNSYRYLLRNVYSTGLFQLYELPSVE

SEQ ID NO: 3192191 - protein, 19 aa, Giardia lamblia
MDPFTLQVLSTFRHLSRTK

SEQ ID NO: 3192192 - protein, 40 aa, Giardia lamblia
MDQPKCDDFFFGFVYRSKYVLLLYHHNLKNLLFVYNSQTA

SEQ ID NO: 3192193 - protein, 24 aa, Giardia lamblia
MDRELWLEKYPAQTALVSLQIWWS

SEQ ID NO: 3192194 - protein, 21 aa, Giardia lamblia
MDRFLQTPFLIDAETDKWRVK

SEQ ID NO: 3192195 - protein, 17 aa, Giardia lamblia
MDRLPDIQRILDILLKP

SEQ ID NO: 3192196 - protein, 22 aa, Giardia lamblia
MDRYFANWDIVERGYLAHIYGY

SEQ ID NO: 3192197 - protein, 21 aa, Giardia lamblia
MDSTSLQQLKLRETPSPYREV

SEQ ID NO: 3192198 - protein, 17 aa, Giardia lamblia
MEAARLGNVSRVKELIK

SEQ ID NO: 3192199 - protein, 30 aa, Giardia lamblia
MECPSPYFKPLVYTLAFFHATIQERQKFGK

SEQ ID NO: 3192200 - protein, 17 aa, Giardia lamblia
MECRVMRALKKLLAEKG

SEQ ID NO: 3192201 - protein, 18 aa, Giardia lamblia
MEDAGLGFRGRSALMMAA

SEQ ID NO: 3192202 - protein, 17 aa, Giardia lamblia
MEDPYIDHALIGTFILE

SEQ ID NO: 3192203 - protein, 30 aa, Giardia lamblia
MEDVHLVPYISMFISDGALPVFRKAFNFTL

SEQ ID NO: 3192204 - protein, 23 aa, Giardia lamblia
MEFSAFEILNLFERRRVKVDLVP

SEQ ID NO: 3192205 - protein, 24 aa, Giardia lamblia
MEIMPRLGALYPYHQERLSQCSDM

SEQ ID NO: 3192206 - protein, 24 aa, Giardia lamblia
MEKEHSIFYNGFSSLYIAANSGHL

SEQ ID NO: 3192207 - protein, 19 aa, Giardia lamblia
MEKRLNEYAKLVNLQAQCS

SEQ ID NO: 3192208 - protein, 25 aa, Giardia lamblia
MELTWLELESLFALLQAYNAEVRIK

SEQ ID NO: 3192209 - protein, 18 aa, Giardia lamblia
MELVGLSHTKLSGLYWVL

SEQ ID NO: 3192210 - protein, 27 aa, Giardia lamblia
MENYIYLTTLRRRLLIHQLKADSDWLK

SEQ ID NO: 3192211 - protein, 18 aa, Giardia lamblia
MEPLAPGTYLSEKELSRP

SEQ ID NO: 3192212 - protein, 26 aa, Giardia lamblia
MEPNNRPIIANPALTVAGIVQPIQSV

SEQ ID NO: 3192213 - protein, 19 aa, Giardia lamblia
MEPQLILSPLGREVVRFPT

SEQ ID NO: 3192214 - protein, 21 aa, Giardia lamblia
MEQEILDLKARLNKLTVDLDL

SEQ ID NO: 3192215 - protein, 22 aa, Giardia lamblia
MEQFLLGLRRPSVGPEVYEEDV

SEQ ID NO: 3192216 - protein, 25 aa, Giardia lamblia
MEQTLNRLLSELILTTHTRSLGIDE

SEQ ID NO: 3192217 - protein, 17 aa, Giardia lamblia
MERAHSLVYMLDTIEYF

SEQ ID NO: 3192218 - protein, 17 aa, Giardia lamblia
MERLISRDLEYAYFLTA

SEQ ID NO: 3192219 - protein, 23 aa, Giardia lamblia
MERRHWQLSYVRLAIACSLDNEL

SEQ ID NO: 3192220 - protein, 26 aa, Giardia lamblia
MERRRQLYIAAQRRAELERSLATPFA

SEQ ID NO: 3192221 - protein, 17 aa, Giardia lamblia
MERVACILYQRALCERD

SEQ ID NO: 3192222 - protein, 25 aa, Giardia lamblia
MESLQYVTPYFLFEGAMVEAVTALT

SEQ ID NO: 3192223 - protein, 25 aa, Giardia lamblia
MESPNQYLYLITLSRSELLVHELHS

SEQ ID NO: 3192224 - protein, 30 aa, Giardia lamblia
MESRGYIFNSFIRGLNPAEFYFHAVGGREG

SEQ ID NO: 3192225 - protein, 18 aa, Giardia lamblia
MESVYAGDLPLPLGNFSI

SEQ ID NO: 3192226 - protein, 18 aa, Giardia lamblia
MEVEIFDRFAGVLTTLRH

SEQ ID NO: 3192227 - protein, 19 aa, Giardia lamblia
MEWDWRGSYYPLDFSEYLM

SEQ ID NO: 3192228 - protein, 20 aa, Giardia lamblia
MEWIQTVVITYLPARRELVR

SEQ ID NO: 3192229 - protein, 26 aa, Giardia lamblia
MEYAGCALTNGYTALMFACERDNKGA

SEQ ID NO: 3192230 - protein, 20 aa, Giardia lamblia
MEYYAAIKAIRARVLVYTGY

SEQ ID NO: 3192231 - protein, 20 aa, Giardia lamblia
MFAASLGNYVACELLLHAEG

SEQ ID NO: 3192232 - protein, 36 aa, Giardia lamblia
MFARDKIFTGVVSYPMRPSPKWSFRSSDYPTDNKVI

SEQ ID NO: 3192233 - protein, 24 aa, Giardia lamblia
MFDNDGWTALMRLAAQNAVDSVWP

SEQ ID NO: 3192234 - protein, 20 aa, Giardia lamblia
MFISNIRPSLTHYFLRFLAD

SEQ ID NO: 3192235 - protein, 32 aa, Giardia lamblia
MFSDTVVATLIDALLLLRKAGSAPLNKRKKQP

SEQ ID NO: 3192236 - protein, 19 aa, Giardia lamblia
MFSILAACLLPRPPMELIA

SEQ ID NO: 3192237 - protein, 17 aa, Giardia lamblia
MFSNNLIPQTDDRSTLD

SEQ ID NO: 3192238 - protein, 18 aa, Giardia lamblia
MFTRERFDHYRSQAKKYK

SEQ ID NO: 3192239 - protein, 22 aa, Giardia lamblia
MGALEYAIMGNYLEIVKLLVKH

SEQ ID NO: 3192240 - protein, 37 aa, Giardia lamblia
MGALVYDIFLVFSHYKYVSALFKLSLDILPRIVNLFC

SEQ ID NO: 3192241 - protein, 28 aa, Giardia lamblia
MGAPDLRHQPIILLFMACTIEDVSKCRL

SEQ ID NO: 3192242 - protein, 28 aa, Giardia lamblia
MGDLALENWPFPIGKISCHFSLHTDGQT

SEQ ID NO: 3192243 - protein, 19 aa, Giardia lamblia
MGGLLVTTYMRLHPDWNDY

SEQ ID NO: 3192244 - protein, 22 aa, Giardia lamblia
MGHPKNAYLLGKFLPGLQGSGT

SEQ ID NO: 3192245 - protein, 24 aa, Giardia lamblia
MGISEYILSLFPELGIYGEHRYTA

SEQ ID NO: 3192246 - protein, 20 aa, Giardia lamblia
MGKMALPDYLNDGKVIGYVG

SEQ ID NO: 3192247 - protein, 19 aa, Giardia lamblia
MGKVIEGCERGWLAKALMG

SEQ ID NO: 3192248 - protein, 34 aa, Giardia lamblia
MGLCQDIIVKVWSFWERFRLNKNKLFLATGMIKQ

SEQ ID NO: 3192249 - protein, 18 aa, Giardia lamblia
MGLDDAMHTFRRMVLDAY

SEQ ID NO: 3192250 - protein, 28 aa, Giardia lamblia
MGLGKTVMVLFFLRCIIKHPHPVMRPQR

SEQ ID NO: 3192251 - protein, 31 aa, Giardia lamblia
MGPAQIQGILPADYYGIRLYCTCPECTAKLT

SEQ ID NO: 3192252 - protein, 17 aa, Giardia lamblia
MGPCSYGMTVADCLFAM

SEQ ID NO: 3192253 - protein, 26 aa, Giardia lamblia
MGPDLLSWIGPYLPPDQQYATAARGC

SEQ ID NO: 3192254 - protein, 19 aa, Giardia lamblia
MGPMPMPSVPTITACQRRT

SEQ ID NO: 3192255 - protein, 18 aa, Giardia lamblia
MGPPRRTVSRLTEQNIPV

SEQ ID NO: 3192256 - protein, 34 aa, Giardia lamblia
MGQFSLVQYAILETLARLLLLSADIRDFLCVSKG

SEQ ID NO: 3192257 - protein, 22 aa, Giardia lamblia
MGQRALTCYPGIGYPITHLAIT

SEQ ID NO: 3192258 - protein, 17 aa, Giardia lamblia
MGRALTNTLYNLELGHV

SEQ ID NO: 3192259 - protein, 19 aa, Giardia lamblia
MGSFLLDRLSDRYPKALLQ

SEQ ID NO: 3192260 - protein, 22 aa, Giardia lamblia
MGSTRWILKPHSSLRVGFRFVS

SEQ ID NO: 3192261 - protein, 21 aa, Giardia lamblia
MGTQILARLIGDMLRALIQQG

SEQ ID NO: 3192262 - protein, 25 aa, Giardia lamblia
MGTQITMTQPFIPAPDLSTRSNSDL

SEQ ID NO: 3192263 - protein, 30 aa, Giardia lamblia
MGTRKINAQKIPIVPLTGALSGLDAPATLY

SEQ ID NO: 3192264 - protein, 25 aa, Giardia lamblia
MGVSPLDTLYFTTKARYFMPCAAIY

SEQ ID NO: 3192265 - protein, 19 aa, Giardia lamblia
MGYEQKLTNNAGETALILA

SEQ ID NO: 3192266 - protein, 19 aa, Giardia lamblia
MGYVRILYCFSKNYTFRPK

SEQ ID NO: 3192267 - protein, 26 aa, Giardia lamblia
MHDSGVRFQLAMFPPADVVPGTLAEY

SEQ ID NO: 3192268 - protein, 17 aa, Giardia lamblia
MHDVLKLFILRREKKDV

SEQ ID NO: 3192269 - protein, 35 aa, Giardia lamblia
MHELEFFKEKFLLLQQLDAVWLELAIRICMPQIVA

SEQ ID NO: 3192270 - protein, 19 aa, Giardia lamblia
MHEWHIPIRCDKGTDPDGD

SEQ ID NO: 3192271 - protein, 17 aa, Giardia lamblia
MHFVRLNQDLYNIETSA

SEQ ID NO: 3192272 - protein, 19 aa, Giardia lamblia
MHGAPYLHNTWMGICLVMV

SEQ ID NO: 3192273 - protein, 28 aa, Giardia lamblia
MHLLDSLHLIPNIQRSLFLLSNRQCANG

SEQ ID NO: 3192274 - protein, 18 aa, Giardia lamblia
MHLPVYQATNVFAAIMFA

SEQ ID NO: 3192275 - protein, 19 aa, Giardia lamblia
MHPAIAQAIKTRNDHFPLL

SEQ ID NO: 3192276 - protein, 17 aa, Giardia lamblia
MHQNILHMSSDITFIRI

SEQ ID NO: 3192277 - protein, 18 aa, Giardia lamblia
MHRSDVVIYLAAATQASC

SEQ ID NO: 3192278 - protein, 17 aa, Giardia lamblia
MHTFRRMVLDAYAQGVS

SEQ ID NO: 3192279 - protein, 22 aa, Giardia lamblia
MHTKTEYLYYFCISENYVGFLF

SEQ ID NO: 3192280 - protein, 30 aa, Giardia lamblia
MIAAARDYTEICKVLAPLEKHVTLPDGRTA

SEQ ID NO: 3192281 - protein, 31 aa, Giardia lamblia
MIAAERGYLQCVLLLIPIEARIQRTDGVTAL

SEQ ID NO: 3192282 - protein, 24 aa, Giardia lamblia
MIAAFKGHLPVVTLLLNHEKGMRD

SEQ ID NO: 3192283 - protein, 30 aa, Giardia lamblia
MIAAMEGSIDAIISLLPYQKCRADVDGRTA

SEQ ID NO: 3192284 - protein, 17 aa, Giardia lamblia
MIASFFNSVDCVKLLIE

SEQ ID NO: 3192285 - protein, 29 aa, Giardia lamblia
MIDRLFKPPQRTILAYLWSQKHEVRAAIL

SEQ ID NO: 3192286 - protein, 17 aa, Giardia lamblia
MIGKCACKWNTEEIAFF

SEQ ID NO: 3192287 - protein, 20 aa, Giardia lamblia
MIHLSIVRQTPVTSFGGMSF

SEQ ID NO: 3192288 - protein, 26 aa, Giardia lamblia
MIKKMEPLLKAIYPLQRIASEAAVPA

SEQ ID NO: 3192289 - protein, 17 aa, Giardia lamblia
MIKRLFDPIGLGDLGAL

SEQ ID NO: 3192290 - protein, 27 aa, Giardia lamblia
MIKTKDAEILSLRRKLEDYVELSEVQR

SEQ ID NO: 3192291 - protein, 22 aa, Giardia lamblia
MIRATWQLERYTKRLRALLDSC

SEQ ID NO: 3192292 - protein, 19 aa, Giardia lamblia
MIRKQIVKEFYNFLCMYTD

SEQ ID NO: 3192293 - protein, 20 aa, Giardia lamblia
MISMLPLDVPLSRVFCITDD

SEQ ID NO: 3192294 - protein, 18 aa, Giardia lamblia
MISPIFNSNIDISRPTPT

SEQ ID NO: 3192295 - protein, 19 aa, Giardia lamblia
MIVDICRLPNKLYKDVFFV

SEQ ID NO: 3192296 - protein, 18 aa, Giardia lamblia
MIYEHPLVRKLDIETVGS

SEQ ID NO: 3192297 - protein, 17 aa, Giardia lamblia
MKASYSPNFFIMKLLKH

SEQ ID NO: 3192298 - protein, 22 aa, Giardia lamblia
MKDPWVPPPKCRPHRCLGAALS

SEQ ID NO: 3192299 - protein, 31 aa, Giardia lamblia
MKDTGTYYVPLHSPAPIILQPESLTFDQIEP

SEQ ID NO: 3192300 - protein, 17 aa, Giardia lamblia
MKEKEVEKMRKAIAAQE

SEQ ID NO: 3192301 - protein, 20 aa, Giardia lamblia
MKEPLCRIPEDLRSLLSVTI

SEQ ID NO: 3192302 - protein, 32 aa, Giardia lamblia
MKGHQPVLDFILLDYLKLERLFNSSFIQSPEE

SEQ ID NO: 3192303 - protein, 24 aa, Giardia lamblia
MKGSIRVIVRMRPMLQHEKEELKT

SEQ ID NO: 3192304 - protein, 18 aa, Giardia lamblia
MKIFSVCIAKQMLAPFLL

SEQ ID NO: 3192305 - protein, 17 aa, Giardia lamblia
MKKDAEIQELTRKLGTL

SEQ ID NO: 3192306 - protein, 29 aa, Giardia lamblia
MKKQSAERTLLMEKLRLKEEEYRIPQESL

SEQ ID NO: 3192307 - protein, 17 aa, Giardia lamblia
MKLVKISTRVDSCLGML

SEQ ID NO: 3192308 - protein, 21 aa, Giardia lamblia
MKLVPLEFNLERALIRMVYNL

SEQ ID NO: 3192309 - protein, 19 aa, Giardia lamblia
MKLYSPLGLGVCENLIFMD

SEQ ID NO: 3192310 - protein, 19 aa, Giardia lamblia
MKPSAFVTLISEQLHYRLS

SEQ ID NO: 3192311 - protein, 24 aa, Giardia lamblia
MKQADLVFLGLASSSAAQGTGSSI

SEQ ID NO: 3192312 - protein, 20 aa, Giardia lamblia
MKRFQLLRQTTANVLTMMQP

SEQ ID NO: 3192313 - protein, 20 aa, Giardia lamblia
MKTSIALSPLYPHPEDSKEQ

SEQ ID NO: 3192314 - protein, 19 aa, Giardia lamblia
MKVVQNMLPTLTATSKYAY

SEQ ID NO: 3192315 - protein, 17 aa, Giardia lamblia
MLAAIYDNKEAVEILAP

SEQ ID NO: 3192316 - protein, 30 aa, Giardia lamblia
MLCTIYQETLFLQALVLTTLMLSNATQLHI

SEQ ID NO: 3192317 - protein, 50 aa, Giardia lamblia
MLDRWILEASNFDILRNYKFFKHFYQLKTLQTWIAFRKYKRYCRNRKSIT

SEQ ID NO: 3192318 - protein, 17 aa, Giardia lamblia
MLEFKYSERPISKIWIT

SEQ ID NO: 3192319 - protein, 18 aa, Giardia lamblia
MLEIEYNYLLKKVEKIQN

SEQ ID NO: 3192320 - protein, 17 aa, Giardia lamblia
MLELKEGFELQMRGDDQ

SEQ ID NO: 3192321 - protein, 17 aa, Giardia lamblia
MLHQIRLAETENQRDVL

SEQ ID NO: 3192322 - protein, 18 aa, Giardia lamblia
MLHYCSFKNIMTIAHLSD

SEQ ID NO: 3192323 - protein, 19 aa, Giardia lamblia
MLIAFYCLGPVNCSFSKTA

SEQ ID NO: 3192324 - protein, 20 aa, Giardia lamblia
MLIHSEGCTPLLSPEKIVVP

SEQ ID NO: 3192325 - protein, 22 aa, Giardia lamblia
MLIPSEIHFRRKDGRTAIDIAR

SEQ ID NO: 3192326 - protein, 18 aa, Giardia lamblia
MLISTDKELLLLKSVWDV

SEQ ID NO: 3192327 - protein, 23 aa, Giardia lamblia
MLKHVIIGLKRKLKVENEAHMAV

SEQ ID NO: 3192328 - protein, 18 aa, Giardia lamblia
MLKQILSHKHTCKYKYSI

SEQ ID NO: 3192329 - protein, 34 aa, Giardia lamblia
MLKYTPENMYCYCTFWGPIVPANTGFLFFDTIDD

SEQ ID NO: 3192330 - protein, 20 aa, Giardia lamblia
MLLCGFNNKLLRLYDTRKDK

SEQ ID NO: 3192331 - protein, 35 aa, Giardia lamblia
MLLGTFRVELYNELPYLTSIYDKYALRKEHVPSHI

SEQ ID NO: 3192332 - protein, 17 aa, Giardia lamblia
MLLKKIAEQQGLVGSLQ

SEQ ID NO: 3192333 - protein, 17 aa, Giardia lamblia
MLLKQKDIIISLTGKLD

SEQ ID NO: 3192334 - protein, 22 aa, Giardia lamblia
MLNMDMSTLSTSLFRVLRGKFL

SEQ ID NO: 3192335 - protein, 25 aa, Giardia lamblia
MLNSPYDQILYQTNLWISSAHQKQA

SEQ ID NO: 3192336 - protein, 17 aa, Giardia lamblia
MLNVYVIRPGGWEHVLA

SEQ ID NO: 3192337 - protein, 17 aa, Giardia lamblia
MLPFVWGSSQLINRRLK

SEQ ID NO: 3192338 - protein, 17 aa, Giardia lamblia
MLPIDNLVAFYKAAKER

SEQ ID NO: 3192339 - protein, 26 aa, Giardia lamblia
MLPVYSTYFDGLPFTRVPLPVGTGNE

SEQ ID NO: 3192340 - protein, 31 aa, Giardia lamblia
MLREQLFQKKVRIGGLYKPDFAPGSGMDATA

SEQ ID NO: 3192341 - protein, 17 aa, Giardia lamblia
MLRYLCELSQDFCSFIS

SEQ ID NO: 3192342 - protein, 20 aa, Giardia lamblia
MLSCYYNLLSSQYLSRDIFY

SEQ ID NO: 3192343 - protein, 27 aa, Giardia lamblia
MLSLELYNVLPFREVYLHALVRDAHGA

SEQ ID NO: 3192344 - protein, 20 aa, Giardia lamblia
MLSLPPGRNGPYFLKNGFAT

SEQ ID NO: 3192345 - protein, 25 aa, Giardia lamblia
MLSNWIQHLMRRADQYKLWYTQGEP

SEQ ID NO: 3192346 - protein, 24 aa, Giardia lamblia
MLSRLSFDLRPYSNALAFMVASCL

SEQ ID NO: 3192347 - protein, 25 aa, Giardia lamblia
MLSRPLRAYTRRYQPTSPQPLLALS

SEQ ID NO: 3192348 - protein, 31 aa, Giardia lamblia
MLSVDLTMAAIWPRIVSMLSRRDIYRYTVPL

SEQ ID NO: 3192349 - protein, 24 aa, Giardia lamblia
MLTIPRFQKLMRPFSSAIASSRPK

SEQ ID NO: 3192350 - protein, 31 aa, Giardia lamblia
MLTVELVNKYLYYFGKRLNFMEKKPLNHALH

SEQ ID NO: 3192351 - protein, 25 aa, Giardia lamblia
MLVGGPTFSPISKIFCLGPCVIGSE

SEQ ID NO: 3192352 - protein, 17 aa, Giardia lamblia
MLYQKSMIAVQRSAQAL

SEQ ID NO: 3192353 - protein, 19 aa, Giardia lamblia
MMAAKNGYLKLAALLAPHE

SEQ ID NO: 3192354 - protein, 18 aa, Giardia lamblia
MMIDWYSAEIPIGPVVHG

SEQ ID NO: 3192355 - protein, 20 aa, Giardia lamblia
MMTLTAFYDLALLGSDDNLV

SEQ ID NO: 3192356 - protein, 19 aa, Giardia lamblia
MMYHGRILIITASGVQDSE

SEQ ID NO: 3192357 - protein, 17 aa, Giardia lamblia
MNALDYAVISKSSAAVN

SEQ ID NO: 3192358 - protein, 21 aa, Giardia lamblia
MNDPVFVLCDPSAFSHENTDP

SEQ ID NO: 3192359 - protein, 25 aa, Giardia lamblia
MNEKKKIYYHFASDPSREYTLNLPC

SEQ ID NO: 3192360 - protein, 19 aa, Giardia lamblia
MNKASLLPEDKLLHNPPTQ

SEQ ID NO: 3192361 - protein, 18 aa, Giardia lamblia
MNLTYKLVAFVLHRGTEL

SEQ ID NO: 3192362 - protein, 26 aa, Giardia lamblia
MNNGTRIYRKLEAFIRELLHEFDYEE

SEQ ID NO: 3192363 - protein, 26 aa, Giardia lamblia
MNNKDFRKLLKWREKVIAHICEITVP

SEQ ID NO: 3192364 - protein, 24 aa, Giardia lamblia
MNNQHSIWLLQSLLDDLPDEQFLY

SEQ ID NO: 3192365 - protein, 17 aa, Giardia lamblia
MNNVISLEVELASHIRG

SEQ ID NO: 3192366 - protein, 19 aa, Giardia lamblia
MNPVKTLLLLGVLSEPNGT

SEQ ID NO: 3192367 - protein, 25 aa, Giardia lamblia
MNRPRHEYCGTVKIPFILKHLKETP

SEQ ID NO: 3192368 - protein, 28 aa, Giardia lamblia
MNSEEFKFYQIGLIARLLLSLYQEFQKQ

SEQ ID NO: 3192369 - protein, 26 aa, Giardia lamblia
MNTAPFLHALILILDRYPEVEIIQTP

SEQ ID NO: 3192370 - protein, 18 aa, Giardia lamblia
MNTFLCTLVVKFFMKDDK

SEQ ID NO: 3192371 - protein, 17 aa, Giardia lamblia
MNTLLQHEIPTHLQGHN

SEQ ID NO: 3192372 - protein, 29 aa, Giardia lamblia
MNTTWITDSNFRDLLLKLGIPLNYTKGVS

SEQ ID NO: 3192373 - protein, 18 aa, Giardia lamblia
MNVAWTAPALSKKVTNMP

SEQ ID NO: 3192374 - protein, 26 aa, Giardia lamblia
MNVGGNNMFLNPPKYGIPKNPQSRGA

SEQ ID NO: 3192375 - protein, 22 aa, Giardia lamblia
MPAFLSSLLRLALCGVPHMLET

SEQ ID NO: 3192376 - protein, 27 aa, Giardia lamblia
MPATHLFANLLAMRLSRVRKTGVLPFL

SEQ ID NO: 3192377 - protein, 19 aa, Giardia lamblia
MPGMMDTILNLGLNDESVK

SEQ ID NO: 3192378 - protein, 18 aa, Giardia lamblia
MPGQVGPSTYLVDRGNSM

SEQ ID NO: 3192379 - protein, 41 aa, Giardia lamblia
MPHDRVFGVYKEGYYTLINTYLWDISRFNQLIDAFSEYLVV

SEQ ID NO: 3192380 - protein, 19 aa, Giardia lamblia
MPIPVVDTIYRINSVFYAE

SEQ ID NO: 3192381 - protein, 23 aa, Giardia lamblia
MPKDLEMCWIGHASLTDILGITD

SEQ ID NO: 3192382 - protein, 18 aa, Giardia lamblia
MPLFENQRYNNIFAMAYV

SEQ ID NO: 3192383 - protein, 23 aa, Giardia lamblia
MPPDLHYFVKFDESIVIVTGLEG

SEQ ID NO: 3192384 - protein, 27 aa, Giardia lamblia
MPPVESLFHHGLLANFRAKCSFCAPEL

SEQ ID NO: 3192385 - protein, 26 aa, Giardia lamblia
MPRSERLVRLYPFGSYYLGINEPSSD

SEQ ID NO: 3192386 - protein, 20 aa, Giardia lamblia
MPSLARPTARWLPSPVVATH

SEQ ID NO: 3192387 - protein, 21 aa, Giardia lamblia
MQAGAYMWHYERFGVTPTVIR

SEQ ID NO: 3192388 - protein, 21 aa, Giardia lamblia
MQANQPPYPGLAAQSSMTHSF

SEQ ID NO: 3192389 - protein, 37 aa, Giardia lamblia
MQARGHPPKDILSQVLHLTLDVIFPSGPCSTSSSTVA

SEQ ID NO: 3192390 - protein, 29 aa, Giardia lamblia
MQDRYSMTALMWGFKLGFSQVVSHLLDYE

SEQ ID NO: 3192391 - protein, 26 aa, Giardia lamblia
MQEFSVLKYILQGLSTSLKYADLRLI

SEQ ID NO: 3192392 - protein, 32 aa, Giardia lamblia
MQGIRDDLPLFLLILALWQDNVYAARDLLSIV

SEQ ID NO: 3192393 - protein, 25 aa, Giardia lamblia
MQIPSSLIIILYESISRRISDSSST

SEQ ID NO: 3192394 - protein, 19 aa, Giardia lamblia
MQLHTLMFSPHAMKAFITG

SEQ ID NO: 3192395 - protein, 19 aa, Giardia lamblia
MQLQCDNLFHYGKDPNMDR

SEQ ID NO: 3192396 - protein, 23 aa, Giardia lamblia
MQNAAYIKELERQIKDMRAERQR

SEQ ID NO: 3192397 - protein, 27 aa, Giardia lamblia
MQNERGWTALMWAVHSIKLEAVKLLIE

SEQ ID NO: 3192398 - protein, 28 aa, Giardia lamblia
MQPQVFQDFYFLLELLNTYFTSSIFEDK

SEQ ID NO: 3192399 - protein, 24 aa, Giardia lamblia
MQQDKFILKLTPLKRTQNGKVVRP

SEQ ID NO: 3192400 - protein, 32 aa, Giardia lamblia
MQQMGINMLSIVQSLLSMTLWGSKEKMKEHLG

SEQ ID NO: 3192401 - protein, 32 aa, Giardia lamblia
MQRLENTEWMRMFKMFLSINEKAERTAQQANF

SEQ ID NO: 3192402 - protein, 21 aa, Giardia lamblia
MQSIAALKLLVEKKGLFDRNP

SEQ ID NO: 3192403 - protein, 17 aa, Giardia lamblia
MQSKLLTMLNQKHDRSL

SEQ ID NO: 3192404 - protein, 17 aa, Giardia lamblia
MRANLHRLIGHGAFGAV

SEQ ID NO: 3192405 - protein, 24 aa, Giardia lamblia
MRDEVLLSRFIYQRGMRDSNGWTA

SEQ ID NO: 3192406 - protein, 17 aa, Giardia lamblia
MRDFSLGVAYALLENPL

SEQ ID NO: 3192407 - protein, 18 aa, Giardia lamblia
MRDLLPGQMVLRQAALSL

SEQ ID NO: 3192408 - protein, 18 aa, Giardia lamblia
MRDNGFLTALMRASKKGS

SEQ ID NO: 3192409 - protein, 17 aa, Giardia lamblia
MRGTFIEIPSRKCPYDG

SEQ ID NO: 3192410 - protein, 17 aa, Giardia lamblia
MRHTFMSNILMTPKINK

SEQ ID NO: 3192411 - protein, 29 aa, Giardia lamblia
MRLEVTRKYLQDTWRLALDPPDPEKKKKK

SEQ ID NO: 3192412 - protein, 28 aa, Giardia lamblia
MRMDEDSVWMIIAQLADVLSFCHTPDKS

SEQ ID NO: 3192413 - protein, 19 aa, Giardia lamblia
MRNKRRVLAAKKALFVKYL

SEQ ID NO: 3192414 - protein, 19 aa, Giardia lamblia
MRNNDAVRILARYESRFKT

SEQ ID NO: 3192415 - protein, 18 aa, Giardia lamblia
MRQELDVMPLLSHPHIVN

SEQ ID NO: 3192416 - protein, 18 aa, Giardia lamblia
MRQPADYLQWGEGHTKSM

SEQ ID NO: 3192417 - protein, 26 aa, Giardia lamblia
MRQYMGLTALIYAIHEGHSECVAALA

SEQ ID NO: 3192418 - protein, 18 aa, Giardia lamblia
MRRDILAQKALTRSGIDP

SEQ ID NO: 3192419 - protein, 20 aa, Giardia lamblia
MRRIRIEKLVLNICIGGEGD

SEQ ID NO: 3192420 - protein, 17 aa, Giardia lamblia
MRSCIMSSVFISLTEPS

SEQ ID NO: 3192421 - protein, 18 aa, Giardia lamblia
MRSDHTVAVFRNNYLLLF

SEQ ID NO: 3192422 - protein, 28 aa, Giardia lamblia
MRSKQTPKYGFIYHAALVGKASATNRGK

SEQ ID NO: 3192423 - protein, 19 aa, Giardia lamblia
MRSLLLNQRFLASARIQVT

SEQ ID NO: 3192424 - protein, 21 aa, Giardia lamblia
MRTEQTDWMHKMWVLDYQIQG

SEQ ID NO: 3192425 - protein, 19 aa, Giardia lamblia
MRTNPGSISLLYVTPETFR

SEQ ID NO: 3192426 - protein, 19 aa, Giardia lamblia
MRTVHHLDLAFRAYYDLHD

SEQ ID NO: 3192427 - protein, 17 aa, Giardia lamblia
MRVYSKPFLERQEKWTE

SEQ ID NO: 3192428 - protein, 28 aa, Giardia lamblia
MSAAEHGELLKVWFYRPYQAGKQDHHGK

SEQ ID NO: 3192429 - protein, 34 aa, Giardia lamblia
MSAALNGHLDVCKLLIPHEAGMSRKDGWTALMSA

SEQ ID NO: 3192430 - protein, 24 aa, Giardia lamblia
MSAASHGFIKCLSILLPHEKGMQR

SEQ ID NO: 3192431 - protein, 30 aa, Giardia lamblia
MSADWWAFGVLIYEMLTGSPPFFDDNPDMT

SEQ ID NO: 3192432 - protein, 27 aa, Giardia lamblia
MSAGCMLVIRLLQLLFAPDMSASALNV

SEQ ID NO: 3192433 - protein, 26 aa, Giardia lamblia
MSAIDTVYVPFRSLAPFPDPTEIYLS

SEQ ID NO: 3192434 - protein, 18 aa, Giardia lamblia
MSAILSLHKYFFGQNKVQ

SEQ ID NO: 3192435 - protein, 20 aa, Giardia lamblia
MSALMLLCTMRASAAAAAIL

SEQ ID NO: 3192436 - protein, 17 aa, Giardia lamblia
MSALMWAAHQGHKEVVE

SEQ ID NO: 3192437 - protein, 25 aa, Giardia lamblia
MSAVIHRRVPVIRLLIDQEARLQNK

SEQ ID NO: 3192438 - protein, 20 aa, Giardia lamblia
MSAVPLLKKTLRAEFYVNSM

SEQ ID NO: 3192439 - protein, 32 aa, Giardia lamblia
MSAYKPEAIPIFKLFLVLTKHPIISPSVDELN

SEQ ID NO: 3192440 - protein, 33 aa, Giardia lamblia
MSFKCTSDVLAIPLKITPFLSLNVFTDTIQTEL

SEQ ID NO: 3192441 - protein, 23 aa, Giardia lamblia
MSHVMLLIDNCKAYIFACQTEGR

SEQ ID NO: 3192442 - protein, 41 aa, Giardia lamblia
MSIPEACILTILRSVAQALAFLHKEARPLLFARIGGEYTET

SEQ ID NO: 3192443 - protein, 17 aa, Giardia lamblia
MSKFVAAFFAGCWTVTL

SEQ ID NO: 3192444 - protein, 24 aa, Giardia lamblia
MSKRCSFVGTPYWLSPEAITKNEC

SEQ ID NO: 3192445 - protein, 24 aa, Giardia lamblia
MSKYRVCDYYLYDLKRYETSTTLV

SEQ ID NO: 3192446 - protein, 32 aa, Giardia lamblia
MSMKQGIVISLGFSGIFRPDDIRQAIRTAGEC

SEQ ID NO: 3192447 - protein, 27 aa, Giardia lamblia
MSNLHNDVLLLLAPIIHKLSDSQRRTK

SEQ ID NO: 3192448 - protein, 27 aa, Giardia lamblia
MSPEISFFCNKGFVLSNYLTIHLQSVA

SEQ ID NO: 3192449 - protein, 17 aa, Giardia lamblia
MSPYSMGDAYELLLLIL

SEQ ID NO: 3192450 - protein, 22 aa, Giardia lamblia
MSQLRYYVCNVPDQSKPEDLLD

SEQ ID NO: 3192451 - protein, 19 aa, Giardia lamblia
MSRKDGWTALMSAARNNHL

SEQ ID NO: 3192452 - protein, 29 aa, Giardia lamblia
MSRSFKFDRIFTPSYPISAFYESTCLSIA

SEQ ID NO: 3192453 - protein, 35 aa, Giardia lamblia
MSSDITFIRISRDSLFLDIIYNQVTRETLWHLFAV

SEQ ID NO: 3192454 - protein, 29 aa, Giardia lamblia
MSSIVKPPEAWFWYPITSRLCRTALDKRH

SEQ ID NO: 3192455 - protein, 34 aa, Giardia lamblia
MSVCHKQPYQHLYLKRIFPADQKLKGLAPDSPPA

SEQ ID NO: 3192456 - protein, 29 aa, Giardia lamblia
MTALMHAVVHRRFGLISKLAAAEAGMALP

SEQ ID NO: 3192457 - protein, 18 aa, Giardia lamblia
MTCGQLIHLLNLAQKDIE

SEQ ID NO: 3192458 - protein, 19 aa, Giardia lamblia
MTDARLRHFLENNKALLDE

SEQ ID NO: 3192459 - protein, 36 aa, Giardia lamblia
MTDGVAVMRCIRKFWPITCRGIITGGFNWTITEEEE

SEQ ID NO: 3192460 - protein, 34 aa, Giardia lamblia
MTDKKSNVFASYKEVWMQQTRLRKLEAEAKMAEA

SEQ ID NO: 3192461 - protein, 23 aa, Giardia lamblia
MTEHTLFVFAPHKADPSLTGDVY

SEQ ID NO: 3192462 - protein, 28 aa, Giardia lamblia
MTELYTIAWVRKRPYLEDFLASVAKDWE

SEQ ID NO: 3192463 - protein, 20 aa, Giardia lamblia
MTFAGTFSYMAPEILLRKPY

SEQ ID NO: 3192464 - protein, 38 aa, Giardia lamblia
MTGHMLPSMILPHELLRRPYYKDATSKWIPYTQVTLVP

SEQ ID NO: 3192465 - protein, 33 aa, Giardia lamblia
MTMIQAFAALTSGPLYWALHTAHYRNIGMNNGA

SEQ ID NO: 3192466 - protein, 23 aa, Giardia lamblia
MTNMLNKYRFLLDIDRIIKEVHT

SEQ ID NO: 3192467 - protein, 25 aa, Giardia lamblia
MTPIQRYTIPLFTGESVAVFGLSRT

SEQ ID NO: 3192468 - protein, 18 aa, Giardia lamblia
MTPSYSEYEFYDIQAHLG

SEQ ID NO: 3192469 - protein, 26 aa, Giardia lamblia
MTQGEIVLLHRFRYFLDTPPNVQASY

SEQ ID NO: 3192470 - protein, 26 aa, Giardia lamblia
MTRDYELTFWRWPELLSNLDLAAYTA

SEQ ID NO: 3192471 - protein, 29 aa, Giardia lamblia
MTSFVVDFITPFYYVSLTLGVPVAKDKQD

SEQ ID NO: 3192472 - protein, 17 aa, Giardia lamblia
MTSICVINYFSSSQNVQ

SEQ ID NO: 3192473 - protein, 18 aa, Giardia lamblia
MTSSFFQEGLRIVADFVA

SEQ ID NO: 3192474 - protein, 25 aa, Giardia lamblia
MTTSDSLFIMINSRPVPIHPNMIHS

SEQ ID NO: 3192475 - protein, 33 aa, Giardia lamblia
MTTTIQIQLLPFYVLALNYLGVIWANRENRKLA

SEQ ID NO: 3192476 - protein, 23 aa, Giardia lamblia
MTVYDYCGYPPRTTALDIAKKKG

SEQ ID NO: 3192477 - protein, 17 aa, Giardia lamblia
MTYKYDPPTELSSGIDF

SEQ ID NO: 3192478 - protein, 19 aa, Giardia lamblia
MVALVLQKPFITATADEIT

SEQ ID NO: 3192479 - protein, 22 aa, Giardia lamblia
MVAQLPIQLQCGCLSCMICSFD

SEQ ID NO: 3192480 - protein, 21 aa, Giardia lamblia
MVDLFEMCTWWSQQLNYHNRQ

SEQ ID NO: 3192481 - protein, 17 aa, Giardia lamblia
MVDPSHYPFMLSEANLV

SEQ ID NO: 3192482 - protein, 19 aa, Giardia lamblia
MVDSLLAQLASKDAELAGA

SEQ ID NO: 3192483 - protein, 17 aa, Giardia lamblia
MVGLDECQLLFGGDLGS

SEQ ID NO: 3192484 - protein, 19 aa, Giardia lamblia
MVGVGFLHDLGYIHTDIKL

SEQ ID NO: 3192485 - protein, 18 aa, Giardia lamblia
MVHMPMPMMNGMQGQVLA

SEQ ID NO: 3192486 - protein, 20 aa, Giardia lamblia
MVIIQTLRKELRTYRPQVGK

SEQ ID NO: 3192487 - protein, 21 aa, Giardia lamblia
MVKLICKRFPPAGDALHRALN

SEQ ID NO: 3192488 - protein, 27 aa, Giardia lamblia
MVMGLKYSTFLRNLLALVTAPHVLSKP

SEQ ID NO: 3192489 - protein, 27 aa, Giardia lamblia
MVNGKLPLEILLGKWPGQLTIASNQIR

SEQ ID NO: 3192490 - protein, 18 aa, Giardia lamblia
MVNIFKYINNYFLKEIGP

SEQ ID NO: 3192491 - protein, 18 aa, Giardia lamblia
MVNKDGWTALMRAAANGH

SEQ ID NO: 3192492 - protein, 18 aa, Giardia lamblia
MVNNQLRLLYRMNDGIIE

SEQ ID NO: 3192493 - protein, 18 aa, Giardia lamblia
MVPLSILLQQGNVNFMAE

SEQ ID NO: 3192494 - protein, 26 aa, Giardia lamblia
MVPVAGEGFVLRKLFDIPNAHRAAVS

SEQ ID NO: 3192495 - protein, 23 aa, Giardia lamblia
MVQLCDCSFSPDLRLTLSSTKIG

SEQ ID NO: 3192496 - protein, 29 aa, Giardia lamblia
MVQRVVEMYIVFSLVWAFGGSLDSDGRQH

SEQ ID NO: 3192497 - protein, 24 aa, Giardia lamblia
MVRFKHRYIGLRWDADYSITQEDI

SEQ ID NO: 3192498 - protein, 17 aa, Giardia lamblia
MVRLFIPVQGGMKDKDG

SEQ ID NO: 3192499 - protein, 24 aa, Giardia lamblia
MVRNNTLLMFCYNIELMPQADDIA

SEQ ID NO: 3192500 - protein, 18 aa, Giardia lamblia
MVRPYSNYTAKPYEYALS

SEQ ID NO: 3192501 - protein, 23 aa, Giardia lamblia
MVSFFTHDLISINTLLNTARERR

SEQ ID NO: 3192502 - protein, 21 aa, Giardia lamblia
MVSSFYSFWSRFQSVKEFLHE

SEQ ID NO: 3192503 - protein, 29 aa, Giardia lamblia
MVTCARDSLLRFWKLPDIYALNDQSVPLH

SEQ ID NO: 3192504 - protein, 23 aa, Giardia lamblia
MVVFASWDHFIRRIAYRESDGLN

SEQ ID NO: 3192505 - protein, 24 aa, Giardia lamblia
MVWEPSLIRINALQASFEAARTIL

SEQ ID NO: 3192506 - protein, 19 aa, Giardia lamblia
MVYPKIVYIAPMKALIRER

SEQ ID NO: 3192507 - protein, 17 aa, Giardia lamblia
MVYPLIRQFRDLSTSIA

SEQ ID NO: 3192508 - protein, 19 aa, Giardia lamblia
MWCLGVVLYELVGGNLKLL

SEQ ID NO: 3192509 - protein, 20 aa, Giardia lamblia
MWEPDSVLVPLYGEGLTDMM

SEQ ID NO: 3192510 - protein, 23 aa, Giardia lamblia
MWSIGVILYELAVGNITIIRTID

SEQ ID NO: 3192511 - protein, 18 aa, Giardia lamblia
MYAAEAGQFEAAQHLVLR

SEQ ID NO: 3192512 - protein, 17 aa, Giardia lamblia
MYAIQVGSKPCIEYILR

SEQ ID NO: 3192513 - protein, 17 aa, Giardia lamblia
MYAVLGELDACIPYLVD

SEQ ID NO: 3192514 - protein, 18 aa, Giardia lamblia
MYAVRHRNRDATAALVCE

SEQ ID NO: 3192515 - protein, 21 aa, Giardia lamblia
MYHAAVHHIFRRWDAYEGIQA

SEQ ID NO: 3192516 - protein, 23 aa, Giardia lamblia
MYHYISDIRLPPCYMRCLKTDPV

SEQ ID NO: 3192517 - protein, 19 aa, Giardia lamblia
MYLTIKEEIDTMAANFRKS

SEQ ID NO: 3192518 - protein, 17 aa, Giardia lamblia
MYRVFQQKMMEIQALQR

SEQ ID NO: 3192519 - protein, 20 aa, Giardia lamblia
MYSNAYVKIFNGFQTHQVNP

SEQ ID NO: 3192520 - protein, 18 aa, Giardia lamblia
MYSPLATADLHRADLYIA

SEQ ID NO: 3192521 - protein, 39 aa, Giardia lamblia
MYTTEVIFLAKVWKTMARGLLLLGRINSYYSKKAAASGE

SEQ ID NO: 3192522 - protein, 20 aa, Giardia lamblia
MYYYCLRIYGDSELKKRGVG

SEQ ID NO: 3192523 - protein, 28 aa, Giardia lamblia
NAADPQSDFLLLPRLIRAAHMNCTETVR

SEQ ID NO: 3192524 - protein, 34 aa, Giardia lamblia
NAADSARLLLGLEKHIFLFDGRTALHIACESNSN

SEQ ID NO: 3192525 - protein, 21 aa, Giardia lamblia
NAAFCLLSDPNIYGPDDVKSA

SEQ ID NO: 3192526 - protein, 26 aa, Giardia lamblia
NAAGALFHLLPYYDGAQDEDGMTALD

SEQ ID NO: 3192527 - protein, 17 aa, Giardia lamblia
NAAGLMFNISFTKATVG

SEQ ID NO: 3192528 - protein, 23 aa, Giardia lamblia
NAALRPVIELLSIFISDSAATDS

SEQ ID NO: 3192529 - protein, 35 aa, Giardia lamblia
NAANTTLCSYLLRYPTQWYDKRGFSVLAHAVSLGN

SEQ ID NO: 3192530 - protein, 27 aa, Giardia lamblia
NAASLLDTFPTTIPISAKQRTDLSYLS

SEQ ID NO: 3192531 - protein, 26 aa, Giardia lamblia
NADAILVHHGFFGKSFLRVTDSIKKR

SEQ ID NO: 3192532 - protein, 21 aa, Giardia lamblia
NADESAIILAIARDFYPVCAR

SEQ ID NO: 3192533 - protein, 26 aa, Giardia lamblia
NADHAFPLVFVRFDKFVRSGDITLYS

SEQ ID NO: 3192534 - protein, 22 aa, Giardia lamblia
NADSQYLVVRFALPGEDGKDVD

SEQ ID NO: 3192535 - protein, 29 aa, Giardia lamblia
NAEFHLLESYPFDFFSTKPSTEPSSNGIS

SEQ ID NO: 3192536 - protein, 17 aa, Giardia lamblia
NAEIMRQKQAAADARKR

SEQ ID NO: 3192537 - protein, 19 aa, Giardia lamblia
NAELILRIAELEMEVEMLK

SEQ ID NO: 3192538 - protein, 22 aa, Giardia lamblia
NAERFILARDEEIARLAEELEQ

SEQ ID NO: 3192539 - protein, 28 aa, Giardia lamblia
NAESMGLGMFWCGFLLAAVASSQELHDI

SEQ ID NO: 3192540 - protein, 25 aa, Giardia lamblia
NAETKNFIIQWFGSESILASRPNAS

SEQ ID NO: 3192541 - protein, 23 aa, Giardia lamblia
NAETVLLNLIRGDAAKLVRCSEP

SEQ ID NO: 3192542 - protein, 18 aa, Giardia lamblia
NAFEYLQFKKTLAEAETR

SEQ ID NO: 3192543 - protein, 23 aa, Giardia lamblia
NAFPGATLADLRRGEYRKLGEKR

SEQ ID NO: 3192544 - protein, 27 aa, Giardia lamblia
NAFSLSTKLVQCIHAFDLVVLGTGPAG

SEQ ID NO: 3192545 - protein, 25 aa, Giardia lamblia
NAGKHPCPFEFSAPFLRSYSTPTSF

SEQ ID NO: 3192546 - protein, 18 aa, Giardia lamblia
NAGLVYFKQQEYKTAYSC

SEQ ID NO: 3192547 - protein, 27 aa, Giardia lamblia
NAHPLRAPTSAFGTPAPFAGGTAQSPK

SEQ ID NO: 3192548 - protein, 28 aa, Giardia lamblia
NAIDQHLSSFKYLSLYTLKGTDKFMAEE

SEQ ID NO: 3192549 - protein, 18 aa, Giardia lamblia
NAIDSGLIYLLPEARMHA

SEQ ID NO: 3192550 - protein, 29 aa, Giardia lamblia
NAIKSLVSLLPVSIPDSLWEIRCNQAMMR

SEQ ID NO: 3192551 - protein, 19 aa, Giardia lamblia
NAILAWRDIIGPTDPSKCD

SEQ ID NO: 3192552 - protein, 17 aa, Giardia lamblia
NAILFDHVVPHLRFTDK

SEQ ID NO: 3192553 - protein, 20 aa, Giardia lamblia
NAILMLSERLSLPCWARRSR

SEQ ID NO: 3192554 - protein, 21 aa, Giardia lamblia
NAINILCFLNTFSPIGINIPN

SEQ ID NO: 3192555 - protein, 18 aa, Giardia lamblia
NAIPSHDPVLTDTSVHHS

SEQ ID NO: 3192556 - protein, 20 aa, Giardia lamblia
NAIRQLDSELRSLHFEVLED

SEQ ID NO: 3192557 - protein, 19 aa, Giardia lamblia
NAKMFIVMEYCENGDLARY

SEQ ID NO: 3192558 - protein, 22 aa, Giardia lamblia
NAKTVLIIGCGMQGRAALEAIK

SEQ ID NO: 3192559 - protein, 21 aa, Giardia lamblia
NALGHAIAWIRYSLDAVCKQA

SEQ ID NO: 3192560 - protein, 18 aa, Giardia lamblia
NALLAFKLTQLCCDLYSK

SEQ ID NO: 3192561 - protein, 36 aa, Giardia lamblia
NALMLAAKLDVSSCIPILLPYLSDCRRDDSVTPLMV

SEQ ID NO: 3192562 - protein, 17 aa, Giardia lamblia
NALMYAIQVGSKPCIEY

SEQ ID NO: 3192563 - protein, 27 aa, Giardia lamblia
NALNYIPLTCRISQLTALPWQLVCSIG

SEQ ID NO: 3192564 - protein, 25 aa, Giardia lamblia
NALQFLRIDIININFFFARQGIPVL

SEQ ID NO: 3192565 - protein, 21 aa, Giardia lamblia
NALVCNALNLEKRLQCLESEH

SEQ ID NO: 3192566 - protein, 26 aa, Giardia lamblia
NAMNSVYSPWIRSFNTWPSSVRDDFL

SEQ ID NO: 3192567 - protein, 23 aa, Giardia lamblia
NAMYYDGAGWTALLLAAKRNNLE

SEQ ID NO: 3192568 - protein, 24 aa, Giardia lamblia
NANKRYTALLISIKLGSMGLNLTG

SEQ ID NO: 3192569 - protein, 35 aa, Giardia lamblia
NANPNPDASYILTLTRYYKLMRPIAEHANDHDVLR

SEQ ID NO: 3192570 - protein, 20 aa, Giardia lamblia
NANYQFLQLENKELKRKLEE

SEQ ID NO: 3192571 - protein, 28 aa, Giardia lamblia
NAPDDFISFISLFLQWDPQRRCTPEVAM

SEQ ID NO: 3192572 - protein, 17 aa, Giardia lamblia
NAPLPKLSLSATGHAQK

SEQ ID NO: 3192573 - protein, 23 aa, Giardia lamblia
NAPSKPLMLPKSASSGSIPDRQA

SEQ ID NO: 3192574 - protein, 18 aa, Giardia lamblia
NARFAYDSYRRFMQMFGD

SEQ ID NO: 3192575 - protein, 30 aa, Giardia lamblia
NARLEYIRASLRLYDWIVTKELLGQKKVKA

SEQ ID NO: 3192576 - protein, 23 aa, Giardia lamblia
NARPIRPLVRIRESDLDVCDLTS

SEQ ID NO: 3192577 - protein, 22 aa, Giardia lamblia
NARQYRLLLFGLTTCGTISTLR

SEQ ID NO: 3192578 - protein, 26 aa, Giardia lamblia
NARSSWLALRTRSFAKYLLEVSPDVV

SEQ ID NO: 3192579 - protein, 18 aa, Giardia lamblia
NASAWKELLCVQRSIFDQ

SEQ ID NO: 3192580 - protein, 24 aa, Giardia lamblia
NASIVFQYPYKLSPVDRKKLSPTD

SEQ ID NO: 3192581 - protein, 61 aa, Giardia lamblia
NASLLKRFVCLRDQFNSVVPLLQLLPKCRCGKTFISKDTLLHHMKVSHPHWPIPPEYEERY

SEQ ID NO: 3192582 - protein, 18 aa, Giardia lamblia
NASLLPSHLNNRLSNVAA

SEQ ID NO: 3192583 - protein, 17 aa, Giardia lamblia
NATLSKLTIALQIADQE

SEQ ID NO: 3192584 - protein, 20 aa, Giardia lamblia
NAVLANDIEAVLSLIPEQAG

SEQ ID NO: 3192585 - protein, 25 aa, Giardia lamblia
NAVLRLYNLLATCQELLAASAVCYP

SEQ ID NO: 3192586 - protein, 21 aa, Giardia lamblia
NAVPSLYIRVSINGTPVVCVI

SEQ ID NO: 3192587 - protein, 28 aa, Giardia lamblia
NAVQRLIARIMFNLVYLGTRDEFRLESE

SEQ ID NO: 3192588 - protein, 23 aa, Giardia lamblia
NAVSFWEQFLSFTSPMNTTGRGL

SEQ ID NO: 3192589 - protein, 24 aa, Giardia lamblia
NAWRSELLAYRFSLLLDTPYNCSN

SEQ ID NO: 3192590 - protein, 18 aa, Giardia lamblia
NAYVRLNTLYGERVQSAL

SEQ ID NO: 3192591 - protein, 17 aa, Giardia lamblia
NCAEAFAAGLWICGYRD

SEQ ID NO: 3192592 - protein, 23 aa, Giardia lamblia
NCDAAYEYIYDRHLYEMKVRECV

SEQ ID NO: 3192593 - protein, 25 aa, Giardia lamblia
NCDSNIVFFIREYDWRRTKPSRAVF

SEQ ID NO: 3192594 - protein, 20 aa, Giardia lamblia
NCEISIFVLGLLLSISSSDF

SEQ ID NO: 3192595 - protein, 20 aa, Giardia lamblia
NCGIRFLTVYAFSTENWSRP

SEQ ID NO: 3192596 - protein, 22 aa, Giardia lamblia
NCGLEKVPACLRALPCLQELDL

SEQ ID NO: 3192597 - protein, 19 aa, Giardia lamblia
NCHWGSYIYGYNAYRLTPP

SEQ ID NO: 3192598 - protein, 17 aa, Giardia lamblia
NCINLIVRNICMLELLI

SEQ ID NO: 3192599 - protein, 30 aa, Giardia lamblia
NCINQLSCIKKLIPFKLLRELVVTSDDTLS

SEQ ID NO: 3192600 - protein, 24 aa, Giardia lamblia
NCIRDWNRGTVPFYKAPPTQDELA

SEQ ID NO: 3192601 - protein, 24 aa, Giardia lamblia
NCLGIRLVWDIIQEKTTPADRDFA

SEQ ID NO: 3192602 - protein, 17 aa, Giardia lamblia
NCLGIVTPNLNCTFASA

SEQ ID NO: 3192603 - protein, 24 aa, Giardia lamblia
NCLPHLFMFVDTCAKVLEIELSKS

SEQ ID NO: 3192604 - protein, 19 aa, Giardia lamblia
NCLQEVMYWSKLGYDIPEN

SEQ ID NO: 3192605 - protein, 17 aa, Giardia lamblia
NCRGGMATTFLMGIGYP

SEQ ID NO: 3192606 - protein, 22 aa, Giardia lamblia
NCSICHFLGTRILIPMLEYNGH

SEQ ID NO: 3192607 - protein, 24 aa, Giardia lamblia
NCSSLICLVTPLYPHDCERFRTYN

SEQ ID NO: 3192608 - protein, 18 aa, Giardia lamblia
NCVFLNDYNFPYTLAKPL

SEQ ID NO: 3192609 - protein, 24 aa, Giardia lamblia
NCVNYYMVIALKDSTTIQGVLRNV

SEQ ID NO: 3192610 - protein, 34 aa, Giardia lamblia
NCVVDFVFLLTLDPYMLEFGILDFKAFTLDAETK

SEQ ID NO: 3192611 - protein, 30 aa, Giardia lamblia
NCYEDMQLIDMFLLKLPPDLNPRGEVVIGI

SEQ ID NO: 3192612 - protein, 17 aa, Giardia lamblia
NCYSRMYVPLDPVLDKY

SEQ ID NO: 3192613 - protein, 18 aa, Giardia lamblia
NDAAMVKLLVHEESRMTS

SEQ ID NO: 3192614 - protein, 21 aa, Giardia lamblia
NDASALYFAFQRLVQLDSMYE

SEQ ID NO: 3192615 - protein, 20 aa, Giardia lamblia
NDCELAKILCIQEAGIKNKD

SEQ ID NO: 3192616 - protein, 27 aa, Giardia lamblia
NDEADIFALLCPHLLSAQIVSKVDMME

SEQ ID NO: 3192617 - protein, 33 aa, Giardia lamblia
NDEEPGWFYVYSRDIYWVPIGGQKDWLLKQEVR

SEQ ID NO: 3192618 - protein, 24 aa, Giardia lamblia
NDENILALVRYKSITNLAAHIEVS

SEQ ID NO: 3192619 - protein, 26 aa, Giardia lamblia
NDEQIRIVLFQTLRALEWFHIHGIVH

SEQ ID NO: 3192620 - protein, 28 aa, Giardia lamblia
NDETILYRIARHPGLPILYFSARCHPGE

SEQ ID NO: 3192621 - protein, 34 aa, Giardia lamblia
NDEVPLSTWSNLTSWLLHALANICPSEHIVPILK

SEQ ID NO: 3192622 - protein, 23 aa, Giardia lamblia
NDFNLRWQQLTPAPMRFASMCST

SEQ ID NO: 3192623 - protein, 21 aa, Giardia lamblia
NDFPKLKAYGLTPEQLRDAAI

SEQ ID NO: 3192624 - protein, 17 aa, Giardia lamblia
NDFPYCFHLLSGEKEQV

SEQ ID NO: 3192625 - protein, 25 aa, Giardia lamblia
NDFVYLSMWHYHESLASLIVKHKRE

SEQ ID NO: 3192626 - protein, 26 aa, Giardia lamblia
NDGISALMYAAWRGHLQLVELLACFK

SEQ ID NO: 3192627 - protein, 39 aa, Giardia lamblia
NDGLFNLIGAIYMAGWYEIPEVTLFFAGKLYRGNRTQKY

SEQ ID NO: 3192628 - protein, 23 aa, Giardia lamblia
NDGSPIFAIPLRGYHNTSRAYLH

SEQ ID NO: 3192629 - protein, 19 aa, Giardia lamblia
NDGYTALMLAAVCNEGEAC

SEQ ID NO: 3192630 - protein, 25 aa, Giardia lamblia
NDHLWKQVFDPYLARVSFAQCLSQE

SEQ ID NO: 3192631 - protein, 25 aa, Giardia lamblia
NDIDDLYRYLPSHVGMRHASGETAL

SEQ ID NO: 3192632 - protein, 31 aa, Giardia lamblia
NDIVKVGLRLLLFQYDLYLRNTYTDLPRSLL

SEQ ID NO: 3192633 - protein, 21 aa, Giardia lamblia
NDIVQLLKRLDTLHSDGSAAF

SEQ ID NO: 3192634 - protein, 23 aa, Giardia lamblia
NDIVSVWHRMNTQAGIRDHSGST

SEQ ID NO: 3192635 - protein, 27 aa, Giardia lamblia
NDKENCRYYLLMSYFSKSDLGYQLVKR

SEQ ID NO: 3192636 - protein, 23 aa, Giardia lamblia
NDKQFYPLVQFLNGDNFDKIASS

SEQ ID NO: 3192637 - protein, 19 aa, Giardia lamblia
NDLIGVYSLIPFYARFQDA

SEQ ID NO: 3192638 - protein, 27 aa, Giardia lamblia
NDLLDKFNLQPIKARLWSAITNDHYIY

SEQ ID NO: 3192639 - protein, 23 aa, Giardia lamblia
NDLRALGLIYPLVIDTCVLYQHG

SEQ ID NO: 3192640 - protein, 26 aa, Giardia lamblia
NDLTKTSMIALFKFATEELRDTCLAA

SEQ ID NO: 3192641 - protein, 18 aa, Giardia lamblia
NDLVRVYSLLPAQGRMQD

SEQ ID NO: 3192642 - protein, 22 aa, Giardia lamblia
NDMDLNHLISAKALLHNQDSPQ

SEQ ID NO: 3192643 - protein, 26 aa, Giardia lamblia
NDMKGVVSSLLVLDPALRYSASDLLS

SEQ ID NO: 3192644 - protein, 24 aa, Giardia lamblia
NDNGKLYLAVWGKPSALHVDPMEK

SEQ ID NO: 3192645 - protein, 18 aa, Giardia lamblia
NDNTFVDTLPINKPTIST

SEQ ID NO: 3192646 - protein, 28 aa, Giardia lamblia
NDNYRLVEASYVKLLLALNTNPAKYFRR

SEQ ID NO: 3192647 - protein, 25 aa, Giardia lamblia
NDPFTVTFNPRFYNTYLSRFAEQCY

SEQ ID NO: 3192648 - protein, 26 aa, Giardia lamblia
NDQCFEWFSQLKYYLELVGSDFDQPS

SEQ ID NO: 3192649 - protein, 28 aa, Giardia lamblia
NDQQVSFRIFFTANYNAFKARDYLVVKY

SEQ ID NO: 3192650 - protein, 25 aa, Giardia lamblia
NDQRTALMFAILKKNAHAVQVLAPY

SEQ ID NO: 3192651 - protein, 23 aa, Giardia lamblia
NDRLVVSLISPMPSQLARLGLQL

SEQ ID NO: 3192652 - protein, 17 aa, Giardia lamblia
NDRTLRVWGGPEDLKKS

SEQ ID NO: 3192653 - protein, 30 aa, Giardia lamblia
NDRVFFGKHKFCLATLPYTRVELGLELGSE

SEQ ID NO: 3192654 - protein, 21 aa, Giardia lamblia
NDRVMIINHNTKPFMLACDPR

SEQ ID NO: 3192655 - protein, 33 aa, Giardia lamblia
NDSDILLYGPRKALYKYNWRTGTGFLSTIDDLY

SEQ ID NO: 3192656 - protein, 21 aa, Giardia lamblia
NDSVPVYPGDTLRFGTDLPPF

SEQ ID NO: 3192657 - protein, 22 aa, Giardia lamblia
NDSYINVTLRFAYDKSIGKIGG

SEQ ID NO: 3192658 - protein, 17 aa, Giardia lamblia
NDTISVAVWFPRGKRNA

SEQ ID NO: 3192659 - protein, 29 aa, Giardia lamblia
NDTLAIKLPYLVMLIKNMRKYFSFEVQIL

SEQ ID NO: 3192660 - protein, 23 aa, Giardia lamblia
NDTLARYGLLYTTMAYSSIEQVI

SEQ ID NO: 3192661 - protein, 24 aa, Giardia lamblia
NDTVLLGRYRVSLADLLGSRGQSQ

SEQ ID NO: 3192662 - protein, 28 aa, Giardia lamblia
NDVDLARALAPRLAGKKLKFGSTALMIA

SEQ ID NO: 3192663 - protein, 30 aa, Giardia lamblia
NDVDPLELVLWLPTLCHKMGVPYAIVRTKG

SEQ ID NO: 3192664 - protein, 24 aa, Giardia lamblia
NDVDTVKALLPLQGGQKATGNVEI

SEQ ID NO: 3192665 - protein, 30 aa, Giardia lamblia
NDVIELDLIIPLFYLLIHSVDVTTAEMTKL

SEQ ID NO: 3192666 - protein, 31 aa, Giardia lamblia
NDVLYMHCLKRIVEGALSPLYHEDAKELSDV

SEQ ID NO: 3192667 - protein, 22 aa, Giardia lamblia
NDVYTVWCLRSLQGGLTDLSGR

SEQ ID NO: 3192668 - protein, 29 aa, Giardia lamblia
NDWDIFNDIWIIDLRTFEPRRLKLSGDPF

SEQ ID NO: 3192669 - protein, 21 aa, Giardia lamblia
NDWHCFIRNILCNYSPSVAEA

SEQ ID NO: 3192670 - protein, 19 aa, Giardia lamblia
NECFNRVLGSSLLGRLRDI

SEQ ID NO: 3192671 - protein, 32 aa, Giardia lamblia
NECGVRKFLPTTLRPAILADPALCDAGFLAKF

SEQ ID NO: 3192672 - protein, 19 aa, Giardia lamblia
NECYQTQIVPLFRDKKTWG

SEQ ID NO: 3192673 - protein, 22 aa, Giardia lamblia
NEDGVPLYQHSFGTLAVQAQQN

SEQ ID NO: 3192674 - protein, 17 aa, Giardia lamblia
NEEAVRLLLKWESIDQS

SEQ ID NO: 3192675 - protein, 24 aa, Giardia lamblia
NEENDLLLTKAILQTSKQASSTTQ

SEQ ID NO: 3192676 - protein, 17 aa, Giardia lamblia
NEFIPKHDNLTVSDLLD

SEQ ID NO: 3192677 - protein, 27 aa, Giardia lamblia
NEFQQIVSMALVIVSKLITLKEFRIRA

SEQ ID NO: 3192678 - protein, 33 aa, Giardia lamblia
NEHVRLIRLIPFSEEILLTMKLLAELKQQDSIR

SEQ ID NO: 3192679 - protein, 26 aa, Giardia lamblia
NEIAQLKGLLSFQNQRLPLSTARPSI

SEQ ID NO: 3192680 - protein, 17 aa, Giardia lamblia
NEIFVLKEQLKTAKLTS

SEQ ID NO: 3192681 - protein, 24 aa, Giardia lamblia
NEIPLLYHMLAFCQQFGGVSAVVL

SEQ ID NO: 3192682 - protein, 27 aa, Giardia lamblia
NEIVAKSRFWYHLKSLKKIKRTHGEIL

SEQ ID NO: 3192683 - protein, 25 aa, Giardia lamblia
NEKDYFRIRAKVYRFADDEWKERGQ

SEQ ID NO: 3192684 - protein, 25 aa, Giardia lamblia
NEKGRYDILCIHSKKIKLIGRSDDP

SEQ ID NO: 3192685 - protein, 22 aa, Giardia lamblia
NEKIRVIVRVRPSIPEDLHPNP

SEQ ID NO: 3192686 - protein, 23 aa, Giardia lamblia
NEKLDRYILRLRGVPPEELAVEK

SEQ ID NO: 3192687 - protein, 20 aa, Giardia lamblia
NELDIALLKLQNECDRRNTQ

SEQ ID NO: 3192688 - protein, 22 aa, Giardia lamblia
NELIVKIFKFCGSIVLPYVPMV

SEQ ID NO: 3192689 - protein, 26 aa, Giardia lamblia
NELKENLFLLREKGISDGILDGEPTM

SEQ ID NO: 3192690 - protein, 19 aa, Giardia lamblia
NELVLKQSLLRNIQQYLLR

SEQ ID NO: 3192691 - protein, 26 aa, Giardia lamblia
NELVLSLLGQLAGALAYLHGLGGDVD

SEQ ID NO: 3192692 - protein, 17 aa, Giardia lamblia
NELYREVFCVPATRPCR

SEQ ID NO: 3192693 - protein, 26 aa, Giardia lamblia
NEMKQLESLIHGKLQEYPAASLICSQ

SEQ ID NO: 3192694 - protein, 19 aa, Giardia lamblia
NEMYRIFRTAFPELNVKCI

SEQ ID NO: 3192695 - protein, 24 aa, Giardia lamblia
NENAQLLRNLLDQLSANLQKKYAV

SEQ ID NO: 3192696 - protein, 24 aa, Giardia lamblia
NENGCLLYLFTYHASYMIHGTEFQ

SEQ ID NO: 3192697 - protein, 27 aa, Giardia lamblia
NENGERFILCPRCGLRIPLSEIAKEMM

SEQ ID NO: 3192698 - protein, 18 aa, Giardia lamblia
NENLALTALIAQTQTDTA

SEQ ID NO: 3192699 - protein, 20 aa, Giardia lamblia
NENLKRLVRRNPCEPLTEAE

SEQ ID NO: 3192700 - protein, 24 aa, Giardia lamblia
NENLLEALLSSDKLFDALVGNPEL

SEQ ID NO: 3192701 - protein, 23 aa, Giardia lamblia
NENLWNFFLDRVKANLHVVLCFS

SEQ ID NO: 3192702 - protein, 31 aa, Giardia lamblia
NEPGQGTAFPIPLRSLGRIDGSLIYSSLYGS

SEQ ID NO: 3192703 - protein, 24 aa, Giardia lamblia
NEPHCVLRAMWYPENQSSYVVTIF

SEQ ID NO: 3192704 - protein, 32 aa, Giardia lamblia
NEPILDNYFASFRFRTLLSKVVDPFLAPEISS

SEQ ID NO: 3192705 - protein, 26 aa, Giardia lamblia
NEPSKPTGTFLFGKADFSVTSSASTA

SEQ ID NO: 3192706 - protein, 17 aa, Giardia lamblia
NEQIPVTYILKRFYATL

SEQ ID NO: 3192707 - protein, 17 aa, Giardia lamblia
NEQLQLKLRDSLTRLDS

SEQ ID NO: 3192708 - protein, 25 aa, Giardia lamblia
NEQSSYLWIRYVAFHVDRASIDKAE

SEQ ID NO: 3192709 - protein, 26 aa, Giardia lamblia
NERAILSILNLLVPLEATYAEPGTGK

SEQ ID NO: 3192710 - protein, 17 aa, Giardia lamblia
NERNCMCGFTVGSTRGL

SEQ ID NO: 3192711 - protein, 35 aa, Giardia lamblia
NERVERLIEIVMYYIKHFFTIESLRILADPLISSN

SEQ ID NO: 3192712 - protein, 37 aa, Giardia lamblia
NESARTAPLLQIGTPFLAFYEGKAFHFEPYFARLKKE

SEQ ID NO: 3192713 - protein, 25 aa, Giardia lamblia
NESLRRDVIEFKQQLSALASQGVGA

SEQ ID NO: 3192714 - protein, 24 aa, Giardia lamblia
NESTYVTLKYFPSAQVVSRCQVIC

SEQ ID NO: 3192715 - protein, 19 aa, Giardia lamblia
NETLARKNIYKRRFLKIVS

SEQ ID NO: 3192716 - protein, 20 aa, Giardia lamblia
NETLVKLLLAKEGEMVDKNG

SEQ ID NO: 3192717 - protein, 24 aa, Giardia lamblia
NEVDKLLSAVPSFTDPRLSTPVSS

SEQ ID NO: 3192718 - protein, 24 aa, Giardia lamblia
NEVIPLVFTSTFSTGLTATLKVTV

SEQ ID NO: 3192719 - protein, 22 aa, Giardia lamblia
NEVLTKMFIPITDSLQSQINPA

SEQ ID NO: 3192720 - protein, 25 aa, Giardia lamblia
NEVTQLIFKVIYLLMENTIPEGATL

SEQ ID NO: 3192721 - protein, 19 aa, Giardia lamblia
NEWILQRLCTSIWSRTRVL

SEQ ID NO: 3192722 - protein, 24 aa, Giardia lamblia
NEYYRTNFDRKILSCLARLYSGSG

SEQ ID NO: 3192723 - protein, 23 aa, Giardia lamblia
NFASAEFISIDYCLILHSQILQL

SEQ ID NO: 3192724 - protein, 18 aa, Giardia lamblia
NFDALFQPQSHPARDSQD

SEQ ID NO: 3192725 - protein, 20 aa, Giardia lamblia
NFEEQALAGPWIIITSLYIS

SEQ ID NO: 3192726 - protein, 22 aa, Giardia lamblia
NFELLGYDFIIDSALQVWLVEI

SEQ ID NO: 3192727 - protein, 17 aa, Giardia lamblia
NFFGIKDIQRDGAGKIV

SEQ ID NO: 3192728 - protein, 18 aa, Giardia lamblia
NFFNILQAVYRAHDTTRM

SEQ ID NO: 3192729 - protein, 20 aa, Giardia lamblia
NFFPSFGFLAKHSPSDRLVI

SEQ ID NO: 3192730 - protein, 17 aa, Giardia lamblia
NFGPILALVYPAAQAKR

SEQ ID NO: 3192731 - protein, 33 aa, Giardia lamblia
NFICDEDLKVLAYLVKWLTDKGMVNTLKVLELE

SEQ ID NO: 3192732 - protein, 27 aa, Giardia lamblia
NFISTNLIYDILLRCLYTGLDDVFTMM

SEQ ID NO: 3192733 - protein, 18 aa, Giardia lamblia
NFIVLDAVSPPCLQEINS

SEQ ID NO: 3192734 - protein, 38 aa, Giardia lamblia
NFKREPFELIPRLFPLASAIYLRSAICAICHAPAPFSA

SEQ ID NO: 3192735 - protein, 20 aa, Giardia lamblia
NFLEQQLNLGRDLAPEELIR

SEQ ID NO: 3192736 - protein, 21 aa, Giardia lamblia
NFLTYYDFVCFILAEENRDLD

SEQ ID NO: 3192737 - protein, 21 aa, Giardia lamblia
NFNKIINFVKDYELHGICMLL

SEQ ID NO: 3192738 - protein, 25 aa, Giardia lamblia
NFNQPVHPYHILTRLLPILQTYMKD

SEQ ID NO: 3192739 - protein, 18 aa, Giardia lamblia
NFPEIPIIALTATATKYT

SEQ ID NO: 3192740 - protein, 29 aa, Giardia lamblia
NFPSARRLLRLLEPFLPIPVELTPEISLS

SEQ ID NO: 3192741 - protein, 19 aa, Giardia lamblia
NFQIAFQECKLSLSSDFCA

SEQ ID NO: 3192742 - protein, 20 aa, Giardia lamblia
NFRPWIVHNLPQITKLDNIP

SEQ ID NO: 3192743 - protein, 31 aa, Giardia lamblia
NFRSVFLATKNFFPCILKFLYETDETMLTVP

SEQ ID NO: 3192744 - protein, 24 aa, Giardia lamblia
NFSACIVLLLIRVFDDETALLDAL

SEQ ID NO: 3192745 - protein, 17 aa, Giardia lamblia
NFSLCVPALMFDVTHDN

SEQ ID NO: 3192746 - protein, 22 aa, Giardia lamblia
NFSQTYEWVIALPGLEIISEGI

SEQ ID NO: 3192747 - protein, 19 aa, Giardia lamblia
NFTLKLRVFSLEQELHPDR

SEQ ID NO: 3192748 - protein, 24 aa, Giardia lamblia
NFTPKHAFYALRDVPLHAKNADLG

SEQ ID NO: 3192749 - protein, 19 aa, Giardia lamblia
NFYSNLYAPFLNKLSERFD

SEQ ID NO: 3192750 - protein, 35 aa, Giardia lamblia
NGAGKSNFYSAILFALMDPLYDLKTINRAQILSND

SEQ ID NO: 3192751 - protein, 20 aa, Giardia lamblia
NGALKEHPALFIKGKLIIPK

SEQ ID NO: 3192752 - protein, 19 aa, Giardia lamblia
NGCHIPFWFPFLLPPLAEL

SEQ ID NO: 3192753 - protein, 17 aa, Giardia lamblia
NGCTAMMYAARAGSLPI

SEQ ID NO: 3192754 - protein, 20 aa, Giardia lamblia
NGDILWKKKAFTQSVIACYP

SEQ ID NO: 3192755 - protein, 24 aa, Giardia lamblia
NGDLPGVWSYRFQLGLQDKRGYTA

SEQ ID NO: 3192756 - protein, 26 aa, Giardia lamblia
NGESDLYRYFSPAKLSPVRNLQQPSL

SEQ ID NO: 3192757 - protein, 31 aa, Giardia lamblia
NGFGALLLAAQLDRARIAILLAKVIPDQTTP

SEQ ID NO: 3192758 - protein, 30 aa, Giardia lamblia
NGHASPLIYSLLHLFGYNLSMDDLRHFRQL

SEQ ID NO: 3192759 - protein, 36 aa, Giardia lamblia
NGHEFTKAFPGCRCPLLVTPAFILERRSIQLGDACR

SEQ ID NO: 3192760 - protein, 23 aa, Giardia lamblia
NGHLECVHLLLIEAGVKTITRET

SEQ ID NO: 3192761 - protein, 17 aa, Giardia lamblia
NGILGLDYMAGVPDLVL

SEQ ID NO: 3192762 - protein, 34 aa, Giardia lamblia
NGIPLPCCPIISPRYFIYPISPDLRNALSYSVED

SEQ ID NO: 3192763 - protein, 20 aa, Giardia lamblia
NGIVLINGFLFDATYRDCKV

SEQ ID NO: 3192764 - protein, 25 aa, Giardia lamblia
NGIYVLACFDILEYLRVYNGSQGNN

SEQ ID NO: 3192765 - protein, 24 aa, Giardia lamblia
NGKLGPTPFSYFYDRTLKVDSNCE

SEQ ID NO: 3192766 - protein, 38 aa, Giardia lamblia
NGKPNFLLDERFIYVAPLPCFIIIFIGAEVDTLHDSPE

SEQ ID NO: 3192767 - protein, 21 aa, Giardia lamblia
NGLIDEYYRPMPRYSRRASGS

SEQ ID NO: 3192768 - protein, 24 aa, Giardia lamblia
NGLLFKVRRTRISYELWLHKEPSP

SEQ ID NO: 3192769 - protein, 17 aa, Giardia lamblia
NGLLLKYKDSTVLQATD

SEQ ID NO: 3192770 - protein, 22 aa, Giardia lamblia
NGMKATKRSLPSFSLSSRTQTL

SEQ ID NO: 3192771 - protein, 25 aa, Giardia lamblia
NGNWRDYFIIDYTNKPPDYFGGSAL

SEQ ID NO: 3192772 - protein, 18 aa, Giardia lamblia
NGPLMQALGALVLENAPD

SEQ ID NO: 3192773 - protein, 25 aa, Giardia lamblia
NGPTENLLAYLWDKPGDVRAKLIRN

SEQ ID NO: 3192774 - protein, 18 aa, Giardia lamblia
NGPYTFIGLATHQVRCFN

SEQ ID NO: 3192775 - protein, 24 aa, Giardia lamblia
NGQFDMFSKMQLEIKRLARELEET

SEQ ID NO: 3192776 - protein, 24 aa, Giardia lamblia
NGQSEIRLLKWYKVLLAAEQAAAI

SEQ ID NO: 3192777 - protein, 24 aa, Giardia lamblia
NGQYTIAQGFQYFKTMPYSNDGPE

SEQ ID NO: 3192778 - protein, 21 aa, Giardia lamblia
NGRLTALMYAAERGYIEVVKE

SEQ ID NO: 3192779 - protein, 40 aa, Giardia lamblia
NGRTALMLALQNKNFMLCRLLLMEIPALDNRYLSCYEYAI

SEQ ID NO: 3192780 - protein, 25 aa, Giardia lamblia
NGRTALMWAAYRGNSMLVRLLHDAE

SEQ ID NO: 3192781 - protein, 24 aa, Giardia lamblia
NGSEYYACDGANNEFYPLDAIGNT

SEQ ID NO: 3192782 - protein, 29 aa, Giardia lamblia
NGSIQDYLDFDLIPRPLASMQSFLMKDIL

SEQ ID NO: 3192783 - protein, 24 aa, Giardia lamblia
NGSKDIVSILASREGKLLNKRGKT

SEQ ID NO: 3192784 - protein, 24 aa, Giardia lamblia
NGSLGQFVPAAPLHWDWIFEECYD

SEQ ID NO: 3192785 - protein, 24 aa, Giardia lamblia
NGSLQLLINVLKKDRKRVSKSCFF

SEQ ID NO: 3192786 - protein, 27 aa, Giardia lamblia
NGSSTIQYILKMDPRWLPVSEKEIRLH

SEQ ID NO: 3192787 - protein, 27 aa, Giardia lamblia
NGSTRVIPLLIPYFGNETDKQGYTALD

SEQ ID NO: 3192788 - protein, 23 aa, Giardia lamblia
NGTDWFSIFPFEKDTSPCYPVGF

SEQ ID NO: 3192789 - protein, 27 aa, Giardia lamblia
NGTIEADLLLPRMPIQTIKESTSSTRL

SEQ ID NO: 3192790 - protein, 23 aa, Giardia lamblia
NGTMKLQIPHRGEINIKFQNNDL

SEQ ID NO: 3192791 - protein, 24 aa, Giardia lamblia
NGVLLCLSLRYAMIHSQYGSLYAY

SEQ ID NO: 3192792 - protein, 22 aa, Giardia lamblia
NGVLLPSTIPKESAFITADERS

SEQ ID NO: 3192793 - protein, 23 aa, Giardia lamblia
NGVLPAIPYPVDTNGFTPLCTNP

SEQ ID NO: 3192794 - protein, 23 aa, Giardia lamblia
NGVPQTFNLIYDGAVRFVRDAHL

SEQ ID NO: 3192795 - protein, 23 aa, Giardia lamblia
NGVPQTFNLIYDGAVRFVRDASL

SEQ ID NO: 3192796 - protein, 24 aa, Giardia lamblia
NGVSALQMALLNNSLTSAKILTPA

SEQ ID NO: 3192797 - protein, 24 aa, Giardia lamblia
NGVTALMLAVRYNQIEAARLLKDA

SEQ ID NO: 3192798 - protein, 17 aa, Giardia lamblia
NGWIWISEMRNPSDTRE

SEQ ID NO: 3192799 - protein, 23 aa, Giardia lamblia
NGWTALMWAALVGRTEVVKLLLD

SEQ ID NO: 3192800 - protein, 31 aa, Giardia lamblia
NGYDCGVYMLLFMKMIARQFGPGYPLVAQDT

SEQ ID NO: 3192801 - protein, 20 aa, Giardia lamblia
NGYIEEYVALKQTGIKLSTP

SEQ ID NO: 3192802 - protein, 24 aa, Giardia lamblia
NGYSSLMYAIVYQNTPMAKLLLKS

SEQ ID NO: 3192803 - protein, 18 aa, Giardia lamblia
NHCDVIRLLLQKEGGIQD

SEQ ID NO: 3192804 - protein, 20 aa, Giardia lamblia
NHDRTLLYKNLWDAAVAVDL

SEQ ID NO: 3192805 - protein, 24 aa, Giardia lamblia
NHDWMTSLLSIVFRLLRAEACIPH

SEQ ID NO: 3192806 - protein, 19 aa, Giardia lamblia
NHELDNICPLTLIQVRVVK

SEQ ID NO: 3192807 - protein, 26 aa, Giardia lamblia
NHERIVTFLSVIKSGLQSGVRYCLNC

SEQ ID NO: 3192808 - protein, 17 aa, Giardia lamblia
NHKAVLGNYVFVIPIEF

SEQ ID NO: 3192809 - protein, 18 aa, Giardia lamblia
NHKEIVQMLFKGQSRRMD

SEQ ID NO: 3192810 - protein, 21 aa, Giardia lamblia
NHKRTFLYLEQIILHNRAKLN

SEQ ID NO: 3192811 - protein, 21 aa, Giardia lamblia
NHMDQDLAILGPAPGADSNQG

SEQ ID NO: 3192812 - protein, 18 aa, Giardia lamblia
NHMELYPHTACGDPIFAK

SEQ ID NO: 3192813 - protein, 35 aa, Giardia lamblia
NHPNLARIIMFGTNSKLLLIKIPAYTNSLHNEMRK

SEQ ID NO: 3192814 - protein, 19 aa, Giardia lamblia
NHSFLRRKKALPQRTPRKS

SEQ ID NO: 3192815 - protein, 24 aa, Giardia lamblia
NHSIENALFMYNSDKYPLLIDPQG

SEQ ID NO: 3192816 - protein, 24 aa, Giardia lamblia
NHVSCVTLLFLKESGKQDRDGMSA

SEQ ID NO: 3192817 - protein, 23 aa, Giardia lamblia
NHVYPHVLYAYCKHLWVSSNENV

SEQ ID NO: 3192818 - protein, 17 aa, Giardia lamblia
NHYEICKILAPFEARDT

SEQ ID NO: 3192819 - protein, 18 aa, Giardia lamblia
NIAAIKLLMAKEGGMTQP

SEQ ID NO: 3192820 - protein, 25 aa, Giardia lamblia
NIAIITHCPAVRLFITKRNRELISY

SEQ ID NO: 3192821 - protein, 23 aa, Giardia lamblia
NIAVEPVPWLPDSAFDPMEIPNF

SEQ ID NO: 3192822 - protein, 24 aa, Giardia lamblia
NIDRNRAYHWYYETHLRKIIDAKV

SEQ ID NO: 3192823 - protein, 17 aa, Giardia lamblia
NIDTILIPNSPVVVSTI

SEQ ID NO: 3192824 - protein, 23 aa, Giardia lamblia
NIEALRVILPYESSIKSPAGGAT

SEQ ID NO: 3192825 - protein, 25 aa, Giardia lamblia
NIELSIVLPPMSIVALPVVHSPLRF

SEQ ID NO: 3192826 - protein, 28 aa, Giardia lamblia
NIFEKVNNIWPLLLKHIGGDRELGLELY

SEQ ID NO: 3192827 - protein, 19 aa, Giardia lamblia
NIFRIMHTPGHTPGSSLLY

SEQ ID NO: 3192828 - protein, 27 aa, Giardia lamblia
NIGFPDKQKFFSDLLTQFPSTVSVSEL

SEQ ID NO: 3192829 - protein, 20 aa, Giardia lamblia
NIGIMLDYYSILDDLFVGQT

SEQ ID NO: 3192830 - protein, 18 aa, Giardia lamblia
NIGTIILVLSGKGGVGKS

SEQ ID NO: 3192831 - protein, 27 aa, Giardia lamblia
NIGVQDFLLGVRYLGIPSDLISNDDLV

SEQ ID NO: 3192832 - protein, 25 aa, Giardia lamblia
NIHRDFRLWLTSMPSEQFPVSILQN

SEQ ID NO: 3192833 - protein, 17 aa, Giardia lamblia
NIIKFFTMRRDELLRGK

SEQ ID NO: 3192834 - protein, 31 aa, Giardia lamblia
NIIKLYDHWFEGSNLLIFTTELMPSGCLKKY

SEQ ID NO: 3192835 - protein, 25 aa, Giardia lamblia
NIIQDLRGAIRVAVRLRPSTAVTSP

SEQ ID NO: 3192836 - protein, 33 aa, Giardia lamblia
NIIRIIETYYWRKNIILVLELCERDIGAVLNDG

SEQ ID NO: 3192837 - protein, 25 aa, Giardia lamblia
NIITALHLKPLLLPDTPSSSQLALS

SEQ ID NO: 3192838 - protein, 19 aa, Giardia lamblia
NIITYRFARALALDSGEKV

SEQ ID NO: 3192839 - protein, 19 aa, Giardia lamblia
NIIVRADAYDFLIFREFDS

SEQ ID NO: 3192840 - protein, 27 aa, Giardia lamblia
NIKYDYIKTYMFTHIDLHSYYYESGAQ

SEQ ID NO: 3192841 - protein, 18 aa, Giardia lamblia
NILEERVVFGLMATNIVK

SEQ ID NO: 3192842 - protein, 17 aa, Giardia lamblia
NILFASQIFARSIEGVT

SEQ ID NO: 3192843 - protein, 29 aa, Giardia lamblia
NILFCSSVTGLIRIYNYDVTPIPIAEFKE

SEQ ID NO: 3192844 - protein, 39 aa, Giardia lamblia
NILGSAGLFPTILTSRLLSFIKTSFPHNADLAPSPVAMP

SEQ ID NO: 3192845 - protein, 18 aa, Giardia lamblia
NILHIIDRELSVYLKQLL

SEQ ID NO: 3192846 - protein, 17 aa, Giardia lamblia
NILKNIRILDVLCSLNG

SEQ ID NO: 3192847 - protein, 21 aa, Giardia lamblia
NILLYLMDLLRDACAQRDIFL

SEQ ID NO: 3192848 - protein, 17 aa, Giardia lamblia
NILPDICWCICNLTRHI

SEQ ID NO: 3192849 - protein, 19 aa, Giardia lamblia
NILQNLFQFSTDAIQSRFV

SEQ ID NO: 3192850 - protein, 17 aa, Giardia lamblia
NILRSDVLSRYFSNEKI

SEQ ID NO: 3192851 - protein, 20 aa, Giardia lamblia
NIMLKICFELERTGSYRNLI

SEQ ID NO: 3192852 - protein, 31 aa, Giardia lamblia
NIPPYTNNGYIFPLLGVTDQFVPSGHANIPV

SEQ ID NO: 3192853 - protein, 21 aa, Giardia lamblia
NIPRKQLIGSGLLIGKFTHHK

SEQ ID NO: 3192854 - protein, 18 aa, Giardia lamblia
NIQAACPATPLYINPQRE

SEQ ID NO: 3192855 - protein, 17 aa, Giardia lamblia
NIQTLKNALLFRTARNP

SEQ ID NO: 3192856 - protein, 30 aa, Giardia lamblia
NIRALYGIPANCFLFCTFNQVYKFDMGTLG

SEQ ID NO: 3192857 - protein, 19 aa, Giardia lamblia
NIRCYGISSDFLQISNSIR

SEQ ID NO: 3192858 - protein, 23 aa, Giardia lamblia
NIRLKLVSVFAEDKKLRIGRLKR

SEQ ID NO: 3192859 - protein, 18 aa, Giardia lamblia
NIRTVLRDSMKPLDSFTL

SEQ ID NO: 3192860 - protein, 19 aa, Giardia lamblia
NISLVKLLCTHECQMRDTS

SEQ ID NO: 3192861 - protein, 27 aa, Giardia lamblia
NISPLNTISLIALKPLIIFVTTKHETV

SEQ ID NO: 3192862 - protein, 21 aa, Giardia lamblia
NISWKSALMRSGQLGNSMTAS

SEQ ID NO: 3192863 - protein, 25 aa, Giardia lamblia
NITDLPVPLLTPQQLLDAITAEQDT

SEQ ID NO: 3192864 - protein, 29 aa, Giardia lamblia
NITQPYQQNLPYQALPSLPQMQSLSSLQT

SEQ ID NO: 3192865 - protein, 22 aa, Giardia lamblia
NITRFMTHMDTTIALDARGRHQ

SEQ ID NO: 3192866 - protein, 18 aa, Giardia lamblia
NIVFISQVLPDGGLSFVG

SEQ ID NO: 3192867 - protein, 18 aa, Giardia lamblia
NIVKLKEILASKNKIYIV

SEQ ID NO: 3192868 - protein, 29 aa, Giardia lamblia
NIVLDPITTPPWIYMRPACFTLKAMTQGE

SEQ ID NO: 3192869 - protein, 24 aa, Giardia lamblia
NIVRMFRRLINLVDQLIIAVEVIG

SEQ ID NO: 3192870 - protein, 20 aa, Giardia lamblia
NIYAIQLFRDLGVGAEPGVG

SEQ ID NO: 3192871 - protein, 20 aa, Giardia lamblia
NIYEAYIACRLVVLDSFELE

SEQ ID NO: 3192872 - protein, 30 aa, Giardia lamblia
NIYHTHAETLFPLSVILLSSITKSSAIHSS

SEQ ID NO: 3192873 - protein, 21 aa, Giardia lamblia
NIYNHILTNFPIWLQDTSDLV

SEQ ID NO: 3192874 - protein, 18 aa, Giardia lamblia
NIYRELYGLLDPVSRARA

SEQ ID NO: 3192875 - protein, 17 aa, Giardia lamblia
NIYSCRTMINNWVEERA

SEQ ID NO: 3192876 - protein, 18 aa, Giardia lamblia
NIYTLDYYSNLCSEIVAR

SEQ ID NO: 3192877 - protein, 17 aa, Giardia lamblia
NKAGLTALMQAALMNCA

SEQ ID NO: 3192878 - protein, 24 aa, Giardia lamblia
NKAMTEYYNLSLAYNILLSTCQKR

SEQ ID NO: 3192879 - protein, 25 aa, Giardia lamblia
NKAPPPTKILVEKPSLFQIAATKRP

SEQ ID NO: 3192880 - protein, 26 aa, Giardia lamblia
NKAQLIYLSTCRLILQGNGSLIMSEL

SEQ ID NO: 3192881 - protein, 23 aa, Giardia lamblia
NKDQSFMLSLRPKKGRHLRAMRM

SEQ ID NO: 3192882 - protein, 27 aa, Giardia lamblia
NKDSSAQFVLKPPPKKPLGSARVTFDL

SEQ ID NO: 3192883 - protein, 20 aa, Giardia lamblia
NKEFGIIMDIFTKGDLHSYI

SEQ ID NO: 3192884 - protein, 29 aa, Giardia lamblia
NKENLRNEQLLYLEILRARKEKALMESKA

SEQ ID NO: 3192885 - protein, 37 aa, Giardia lamblia
NKFNLQQVILLQQAFLSIISWNLLIERATFAFAVEHL

SEQ ID NO: 3192886 - protein, 25 aa, Giardia lamblia
NKGSTPMHLSFDKRFMLPAGVSVEP

SEQ ID NO: 3192887 - protein, 21 aa, Giardia lamblia
NKIQSLLLIRASRPTTPQKEK

SEQ ID NO: 3192888 - protein, 24 aa, Giardia lamblia
NKIRMRVMKIPRQQVPAPVPVASG

SEQ ID NO: 3192889 - protein, 20 aa, Giardia lamblia
NKIYIVMEYLEGGDILTALR

SEQ ID NO: 3192890 - protein, 25 aa, Giardia lamblia
NKKILRDAAWLLGVPPELVARPKQA

SEQ ID NO: 3192891 - protein, 34 aa, Giardia lamblia
NKKLATGALWLSRTFSFVSTLMCLVVDPSYAYEE

SEQ ID NO: 3192892 - protein, 25 aa, Giardia lamblia
NKKLKSMLIELKRSFNQGNISAIIE

SEQ ID NO: 3192893 - protein, 28 aa, Giardia lamblia
NKKTSEILFWIPLQYIEDVDPWPKYGAK

SEQ ID NO: 3192894 - protein, 25 aa, Giardia lamblia
NKKYPLTYISNFAKAAPLSDKVLLE

SEQ ID NO: 3192895 - protein, 20 aa, Giardia lamblia
NKLAILERRIMEARDCAPGN

SEQ ID NO: 3192896 - protein, 19 aa, Giardia lamblia
NKLLALVRVAFQDVGKAIK

SEQ ID NO: 3192897 - protein, 19 aa, Giardia lamblia
NKLSYALSKTPTFTPDVRK

SEQ ID NO: 3192898 - protein, 26 aa, Giardia lamblia
NKLVLCSCRLMLFQSILSQLLADLNA

SEQ ID NO: 3192899 - protein, 17 aa, Giardia lamblia
NKMLADVVGFSEIPPCP

SEQ ID NO: 3192900 - protein, 19 aa, Giardia lamblia
NKNVYLITPKNTLLQYIAI

SEQ ID NO: 3192901 - protein, 20 aa, Giardia lamblia
NKNWSMIPTLELCNYAIIMS

SEQ ID NO: 3192902 - protein, 25 aa, Giardia lamblia
NKNYEGINLLLSKYNPAPETLQQSL

SEQ ID NO: 3192903 - protein, 54 aa, Giardia lamblia
NKPECVKLLLPHLFTDTYRGLRPLALAIFLKCYDMVRFFLQENNLLYISLDELT

SEQ ID NO: 3192904 - protein, 23 aa, Giardia lamblia
NKPEIVQLLVDREAGLCTNSKFT

SEQ ID NO: 3192905 - protein, 27 aa, Giardia lamblia
NKPHEYTPPVPAPPRLSLPAADDKYAL

SEQ ID NO: 3192906 - protein, 24 aa, Giardia lamblia
NKPPVSPMFFGPQVLGVRKDVGDA

SEQ ID NO: 3192907 - protein, 24 aa, Giardia lamblia
NKQGGFWVVPLIGKCTRPPASGTI

SEQ ID NO: 3192908 - protein, 23 aa, Giardia lamblia
NKQTPRLYVLSPNAVFKEYRAVS

SEQ ID NO: 3192909 - protein, 26 aa, Giardia lamblia
NKRISARILALKEAGMQCRHGLTALM

SEQ ID NO: 3192910 - protein, 31 aa, Giardia lamblia
NKRTKIHEEIIWKFIAQLASALNYMHSPFKK

SEQ ID NO: 3192911 - protein, 23 aa, Giardia lamblia
NKSLQRPKINPTHDILSIPSTQD

SEQ ID NO: 3192912 - protein, 23 aa, Giardia lamblia
NKSTARIPGFQVLSDSLSDENNP

SEQ ID NO: 3192913 - protein, 18 aa, Giardia lamblia
NKTALYYAYVGFDAPLYS

SEQ ID NO: 3192914 - protein, 30 aa, Giardia lamblia
NKTESFIRKLYALLYISTALHIILDARRLY

SEQ ID NO: 3192915 - protein, 28 aa, Giardia lamblia
NKTPMSIGLIYWLLAREVLRLKGSISRT

SEQ ID NO: 3192916 - protein, 22 aa, Giardia lamblia
NKVHSLMWGIVLFDEAHQVMAE

SEQ ID NO: 3192917 - protein, 18 aa, Giardia lamblia
NKVKIFRADIIYHLYDMF

SEQ ID NO: 3192918 - protein, 19 aa, Giardia lamblia
NKVLIKYRKVQQASIISLY

SEQ ID NO: 3192919 - protein, 31 aa, Giardia lamblia
NKYADGTLLLRPELFYYNQGLTLKHQKATVD

SEQ ID NO: 3192920 - protein, 18 aa, Giardia lamblia
NKYFIDHGYLKVLANKKS

SEQ ID NO: 3192921 - protein, 18 aa, Giardia lamblia
NKYKEYIQIPKLVIKCNP

SEQ ID NO: 3192922 - protein, 19 aa, Giardia lamblia
NLAAAKMLLPYEAGMQTKT

SEQ ID NO: 3192923 - protein, 22 aa, Giardia lamblia
NLAAFTMLLDYISDIVVTILES

SEQ ID NO: 3192924 - protein, 27 aa, Giardia lamblia
NLACEMRLLHYVAINGKKFLLSPLTKT

SEQ ID NO: 3192925 - protein, 18 aa, Giardia lamblia
NLACIEVLAPLEAALSGE

SEQ ID NO: 3192926 - protein, 24 aa, Giardia lamblia
NLAEDSLVSCYNIFRKDGPSVQAE

SEQ ID NO: 3192927 - protein, 31 aa, Giardia lamblia
NLAGPYPLRRTVLAPTYGLPINILRHISAYM

SEQ ID NO: 3192928 - protein, 18 aa, Giardia lamblia
NLAIIYYTYVEKSRIIKI

SEQ ID NO: 3192929 - protein, 24 aa, Giardia lamblia
NLAKQIVITVSIPVTRRVSAVRFW

SEQ ID NO: 3192930 - protein, 18 aa, Giardia lamblia
NLARLQKQIKAMEAVLKE

SEQ ID NO: 3192931 - protein, 22 aa, Giardia lamblia
NLCGIDIPVRIAEKRLAVSCDE

SEQ ID NO: 3192932 - protein, 17 aa, Giardia lamblia
NLCLSAIREAKISGFRG

SEQ ID NO: 3192933 - protein, 26 aa, Giardia lamblia
NLDAVKILAPIEMDLTLKGGATALMK

SEQ ID NO: 3192934 - protein, 18 aa, Giardia lamblia
NLDLFLSDAKITGNIPLL

SEQ ID NO: 3192935 - protein, 17 aa, Giardia lamblia
NLDLLRDKEYLEKTNDS

SEQ ID NO: 3192936 - protein, 17 aa, Giardia lamblia
NLDTPVRLDGRPLSLSL

SEQ ID NO: 3192937 - protein, 22 aa, Giardia lamblia
NLEAQILAKNNLIRTLTSTVDA

SEQ ID NO: 3192938 - protein, 34 aa, Giardia lamblia
NLEEYKPFFATLYNSILALLFDDLDIYDVEEAGF

SEQ ID NO: 3192939 - protein, 27 aa, Giardia lamblia
NLEFEKVYCPYLLLNKKRYAGQYWTNP

SEQ ID NO: 3192940 - protein, 17 aa, Giardia lamblia
NLELMKFGEVGIGFIKP

SEQ ID NO: 3192941 - protein, 19 aa, Giardia lamblia
NLERALIRMVYNLTERYGA

SEQ ID NO: 3192942 - protein, 17 aa, Giardia lamblia
NLERTRQIVKLSDAAIL

SEQ ID NO: 3192943 - protein, 19 aa, Giardia lamblia
NLEVLYRHPSTDSGFLEQN

SEQ ID NO: 3192944 - protein, 18 aa, Giardia lamblia
NLFAYHLPMDAHPIIGHN

SEQ ID NO: 3192945 - protein, 35 aa, Giardia lamblia
NLFSSPSIVIDKNSSIYRFLEKSAVNEVFPVDETI

SEQ ID NO: 3192946 - protein, 20 aa, Giardia lamblia
NLFVRPIQLFEELAKSTGKA

SEQ ID NO: 3192947 - protein, 25 aa, Giardia lamblia
NLGAYAVFYGLYDKTEELSSLDKEV

SEQ ID NO: 3192948 - protein, 18 aa, Giardia lamblia
NLGLVPLSSLCVMTGGAL

SEQ ID NO: 3192949 - protein, 18 aa, Giardia lamblia
NLGSIIKYFALKADTVAA

SEQ ID NO: 3192950 - protein, 27 aa, Giardia lamblia
NLHAIKALLPHNRFIYDENGKTALCYA

SEQ ID NO: 3192951 - protein, 28 aa, Giardia lamblia
NLHELINVILVHVPTIASVVFSGIPMLS

SEQ ID NO: 3192952 - protein, 22 aa, Giardia lamblia
NLHSKVVLKYWSTNKWGRTIQD

SEQ ID NO: 3192953 - protein, 17 aa, Giardia lamblia
NLIDSKDVMINQLKALL

SEQ ID NO: 3192954 - protein, 21 aa, Giardia lamblia
NLISDLQMGLYAKNSEISELQ

SEQ ID NO: 3192955 - protein, 28 aa, Giardia lamblia
NLISRPRLRGFYRPLNSYYAVNCLLYHD

SEQ ID NO: 3192956 - protein, 17 aa, Giardia lamblia
NLKAARRNLLKYNLHEL

SEQ ID NO: 3192957 - protein, 37 aa, Giardia lamblia
NLKALFRPISMVVPNYALIAEIILFSEGFTTAKVLSR

SEQ ID NO: 3192958 - protein, 18 aa, Giardia lamblia
NLKYSAAINIVRKFRDCG

SEQ ID NO: 3192959 - protein, 25 aa, Giardia lamblia
NLLALDAVVRILPNPSYKAYATAED

SEQ ID NO: 3192960 - protein, 24 aa, Giardia lamblia
NLLGTFDLGGIPPAPRGTPKIEVT

SEQ ID NO: 3192961 - protein, 18 aa, Giardia lamblia
NLLIDTRGLIRLCDFGLS

SEQ ID NO: 3192962 - protein, 23 aa, Giardia lamblia
NLLLGICAALRKLGSKTDLVLRL

SEQ ID NO: 3192963 - protein, 19 aa, Giardia lamblia
NLLPRFSEILNLKETIRAQ

SEQ ID NO: 3192964 - protein, 23 aa, Giardia lamblia
NLLSTESFRFPLQSARMLVRIYS

SEQ ID NO: 3192965 - protein, 19 aa, Giardia lamblia
NLLTLFSLRVSNIKEIINR

SEQ ID NO: 3192966 - protein, 20 aa, Giardia lamblia
NLLVSLRMYVRAHWFDSVQS

SEQ ID NO: 3192967 - protein, 21 aa, Giardia lamblia
NLMDLEYTVSFFEVLENLYTG

SEQ ID NO: 3192968 - protein, 17 aa, Giardia lamblia
NLMERLISRDLEYAYFL

SEQ ID NO: 3192969 - protein, 17 aa, Giardia lamblia
NLMRCVCERNLVGVYYY

SEQ ID NO: 3192970 - protein, 20 aa, Giardia lamblia
NLNAFLKPLRHIDNPEILVT

SEQ ID NO: 3192971 - protein, 30 aa, Giardia lamblia
NLNLPPSLLSRFDLIYLLLDNRHDTEADRA

SEQ ID NO: 3192972 - protein, 18 aa, Giardia lamblia
NLNSVRILLNTQAGLINN

SEQ ID NO: 3192973 - protein, 25 aa, Giardia lamblia
NLNYDGAFVLPYFDVKKDSIVTLGA

SEQ ID NO: 3192974 - protein, 43 aa, Giardia lamblia
NLNYLNFRSAPFNVLPLFDFQAFVHPILLFADQFNYYVAFNED

SEQ ID NO: 3192975 - protein, 20 aa, Giardia lamblia
NLPAVRALLPLQGGQKATGD

SEQ ID NO: 3192976 - protein, 22 aa, Giardia lamblia
NLPCEGRVSCKFARQHIIIQHT

SEQ ID NO: 3192977 - protein, 21 aa, Giardia lamblia
NLPFLMHGPEKRLLLPIRAMV

SEQ ID NO: 3192978 - protein, 20 aa, Giardia lamblia
NLPIAYTIKVGMYDGTYKPE

SEQ ID NO: 3192979 - protein, 28 aa, Giardia lamblia
NLPSFDTFWLQFDLSAYSKSSLPLAIAF

SEQ ID NO: 3192980 - protein, 20 aa, Giardia lamblia
NLPSLLEQSPWTSQGPLTLQ

SEQ ID NO: 3192981 - protein, 24 aa, Giardia lamblia
NLPSVRQGVYPNTYHLISNKTPTN

SEQ ID NO: 3192982 - protein, 27 aa, Giardia lamblia
NLQKGLLDLVPLLYTERDLLITVTAEA

SEQ ID NO: 3192983 - protein, 26 aa, Giardia lamblia
NLQKKYAVELFIVQKTIESCYDEPKK

SEQ ID NO: 3192984 - protein, 22 aa, Giardia lamblia
NLQLHINTLRQKVDAIIIEMTR

SEQ ID NO: 3192985 - protein, 18 aa, Giardia lamblia
NLQLLHEIVKLKKEIYKK

SEQ ID NO: 3192986 - protein, 18 aa, Giardia lamblia
NLQRELFNTIQLQTRPIT

SEQ ID NO: 3192987 - protein, 19 aa, Giardia lamblia
NLQRVIIAKLKLPNPLPAA

SEQ ID NO: 3192988 - protein, 20 aa, Giardia lamblia
NLQTLMRNASLRKKLEKTKV

SEQ ID NO: 3192989 - protein, 18 aa, Giardia lamblia
NLQYLCFQCKGLCTFQRK

SEQ ID NO: 3192990 - protein, 27 aa, Giardia lamblia
NLRDLYRLLVAFDVKQPFFSNILIGKD

SEQ ID NO: 3192991 - protein, 17 aa, Giardia lamblia
NLRLLERKLHSLNCGFK

SEQ ID NO: 3192992 - protein, 17 aa, Giardia lamblia
NLRQFFLQNDKAKTGQL

SEQ ID NO: 3192993 - protein, 19 aa, Giardia lamblia
NLSALPQLIRAAHTNNMET

SEQ ID NO: 3192994 - protein, 18 aa, Giardia lamblia
NLSALTYSATSRQPNLYK

SEQ ID NO: 3192995 - protein, 22 aa, Giardia lamblia
NLSEYPFLFALAQREEQVRDGR

SEQ ID NO: 3192996 - protein, 17 aa, Giardia lamblia
NLSGLLRRVSSLVVNSL

SEQ ID NO: 3192997 - protein, 19 aa, Giardia lamblia
NLSHLLIDYADALNVSVFT

SEQ ID NO: 3192998 - protein, 17 aa, Giardia lamblia
NLSLLDYTPQFGPAVVG

SEQ ID NO: 3192999 - protein, 17 aa, Giardia lamblia
NLSLNPYYQSYAPATLT

SEQ ID NO: 3193000 - protein, 28 aa, Giardia lamblia
NLSMFADAPLFLLCMQIALLCSRSGADT

SEQ ID NO: 3193001 - protein, 17 aa, Giardia lamblia
NLSPDELATILSDNNRM

SEQ ID NO: 3193002 - protein, 22 aa, Giardia lamblia
NLSRFLLEYSNPILLSIMAPFI

SEQ ID NO: 3193003 - protein, 17 aa, Giardia lamblia
NLSSLNNDFTLLREIII

SEQ ID NO: 3193004 - protein, 20 aa, Giardia lamblia
NLSTMIDKALSLRKELKEFK

SEQ ID NO: 3193005 - protein, 23 aa, Giardia lamblia
NLSTPTIPGPVKPAPAAAKVTPS

SEQ ID NO: 3193006 - protein, 17 aa, Giardia lamblia
NLSVTQSPLFGLYVETR

SEQ ID NO: 3193007 - protein, 21 aa, Giardia lamblia
NLTICMQTVFLGFINNCNVQG

SEQ ID NO: 3193008 - protein, 28 aa, Giardia lamblia
NLTRKQMEKFLRNPKFIGVEFPTSRPEG

SEQ ID NO: 3193009 - protein, 18 aa, Giardia lamblia
NLTSVRAVFSPDGSAYKG

SEQ ID NO: 3193010 - protein, 28 aa, Giardia lamblia
NLTVSELILAWHWTRWGTSGTYSVIPKS

SEQ ID NO: 3193011 - protein, 33 aa, Giardia lamblia
NLTYCYPSHLRKFLRIITDFTMWYSYRDFCCSG

SEQ ID NO: 3193012 - protein, 26 aa, Giardia lamblia
NLVAFDGSIIECGPLGKLLSTSACLT

SEQ ID NO: 3193013 - protein, 19 aa, Giardia lamblia
NLVISLSGIRHGSIPHIVQ

SEQ ID NO: 3193014 - protein, 18 aa, Giardia lamblia
NLVKYIEAFADKEYFYVV

SEQ ID NO: 3193015 - protein, 18 aa, Giardia lamblia
NLVMWYKVVPYEQKLYML

SEQ ID NO: 3193016 - protein, 20 aa, Giardia lamblia
NLVPSEIPALTAIQSRVMSR

SEQ ID NO: 3193017 - protein, 32 aa, Giardia lamblia
NLVQYYRLHEEIIPEPLILEILAQVISATAYL

SEQ ID NO: 3193018 - protein, 26 aa, Giardia lamblia
NLVRPPADWSPIGLPLTCLMNMEMRH

SEQ ID NO: 3193019 - protein, 23 aa, Giardia lamblia
NLVVDRFIPKVLPITDKIYTCIA

SEQ ID NO: 3193020 - protein, 17 aa, Giardia lamblia
NLVVSRIKLLMSNKSTF

SEQ ID NO: 3193021 - protein, 26 aa, Giardia lamblia
NLVYRNSVLLQLAGYRKQIVNEIGND

SEQ ID NO: 3193022 - protein, 19 aa, Giardia lamblia
NLYRHPNGLPLLHSCIPYP

SEQ ID NO: 3193023 - protein, 25 aa, Giardia lamblia
NLYTDPINILSFRKAFSNPSSDQQA

SEQ ID NO: 3193024 - protein, 25 aa, Giardia lamblia
NMDLVPFYLMGLTRTALCHAHRSES

SEQ ID NO: 3193025 - protein, 25 aa, Giardia lamblia
NMEAYLITVELKMKSLVKLAKRIFI

SEQ ID NO: 3193026 - protein, 26 aa, Giardia lamblia
NMEPLEAYFHLLKLIDESNAAYNSVW

SEQ ID NO: 3193027 - protein, 24 aa, Giardia lamblia
NMEQQLRRLSDENFFLAGENSVLL

SEQ ID NO: 3193028 - protein, 23 aa, Giardia lamblia
NMGILAVAVPDFKYIYSSENRKA

SEQ ID NO: 3193029 - protein, 25 aa, Giardia lamblia
NMGMGMGMQRPMGMPRPAGAIPMPA

SEQ ID NO: 3193030 - protein, 19 aa, Giardia lamblia
NMHACLSLLTKQIHDVRSK

SEQ ID NO: 3193031 - protein, 17 aa, Giardia lamblia
NMHLKPLTSELLARAGE

SEQ ID NO: 3193032 - protein, 17 aa, Giardia lamblia
NMKGLVVKILRGQYQPI

SEQ ID NO: 3193033 - protein, 19 aa, Giardia lamblia
NMLEDRITFYKTGANPPRK

SEQ ID NO: 3193034 - protein, 26 aa, Giardia lamblia
NMLKDTGFMALLKFSERHSTFKRLCV

SEQ ID NO: 3193035 - protein, 22 aa, Giardia lamblia
NMLLLSGKYWRRKIYYTTSSYS

SEQ ID NO: 3193036 - protein, 17 aa, Giardia lamblia
NMLYAHYEVVLFSDQAT

SEQ ID NO: 3193037 - protein, 19 aa, Giardia lamblia
NMMLDLFVELLNDIYMTEK

SEQ ID NO: 3193038 - protein, 18 aa, Giardia lamblia
NMMSVLRKKPLAFSSEEA

SEQ ID NO: 3193039 - protein, 17 aa, Giardia lamblia
NMNLQHMLQMAQTGQKH

SEQ ID NO: 3193040 - protein, 17 aa, Giardia lamblia
NMNVIRQLFYSEGRIRD

SEQ ID NO: 3193041 - protein, 33 aa, Giardia lamblia
NMPLDVRLRHNYYFLTGFVWTIPFDSHRTSLEK

SEQ ID NO: 3193042 - protein, 23 aa, Giardia lamblia
NMRNLWIVKPIGLNRGRGIKVVT

SEQ ID NO: 3193043 - protein, 17 aa, Giardia lamblia
NMRPRCMRYTETTTVRS

SEQ ID NO: 3193044 - protein, 23 aa, Giardia lamblia
NMSALLRTKPFRVQLPSTQVSVL

SEQ ID NO: 3193045 - protein, 24 aa, Giardia lamblia
NMTAYLFMELAISDLSSLSRTCAA

SEQ ID NO: 3193046 - protein, 20 aa, Giardia lamblia
NMTIKIFRYIARGLYERDKL

SEQ ID NO: 3193047 - protein, 23 aa, Giardia lamblia
NMTTIEYFKWKDSKASLQHYTNH

SEQ ID NO: 3193048 - protein, 19 aa, Giardia lamblia
NMVIFEYLASSDQWHRLSL

SEQ ID NO: 3193049 - protein, 41 aa, Giardia lamblia
NNADLLEAILKHQFFKKTLFEMILSADYWLKFTTVKGKEGL

SEQ ID NO: 3193050 - protein, 22 aa, Giardia lamblia
NNCKLALHWTLDQSLSKIEQLL

SEQ ID NO: 3193051 - protein, 19 aa, Giardia lamblia
NNDAAGFVLALIEARSLPP

SEQ ID NO: 3193052 - protein, 24 aa, Giardia lamblia
NNDIHSVWQLIPQRAGEQDMDGRT

SEQ ID NO: 3193053 - protein, 25 aa, Giardia lamblia
NNDSRTFLMQYRPQLIYRAVELLDQ

SEQ ID NO: 3193054 - protein, 17 aa, Giardia lamblia
NNEYFLLYLATAAPKTE

SEQ ID NO: 3193055 - protein, 22 aa, Giardia lamblia
NNFFTHALVKIFNKSRAMVLMR

SEQ ID NO: 3193056 - protein, 23 aa, Giardia lamblia
NNFVFLARLIAVKEGKQSLLSTS

SEQ ID NO: 3193057 - protein, 18 aa, Giardia lamblia
NNFVFPQSYDYYSHPVYS

SEQ ID NO: 3193058 - protein, 24 aa, Giardia lamblia
NNGWTALMCAAWRGSNKAALVLAK

SEQ ID NO: 3193059 - protein, 21 aa, Giardia lamblia
NNHLHVCHYLAPYEGGLRDED

SEQ ID NO: 3193060 - protein, 25 aa, Giardia lamblia
NNICTPIVTELLLDIRYNISGRCIE

SEQ ID NO: 3193061 - protein, 19 aa, Giardia lamblia
NNIDLLENLQPLSLTELAI

SEQ ID NO: 3193062 - protein, 21 aa, Giardia lamblia
NNIGYSALMLAAERNFMPGVE

SEQ ID NO: 3193063 - protein, 28 aa, Giardia lamblia
NNIMINQLRLWLTDWADVFINKVPVESV

SEQ ID NO: 3193064 - protein, 22 aa, Giardia lamblia
NNINKSLLTLGRVFSAITSNAA

SEQ ID NO: 3193065 - protein, 25 aa, Giardia lamblia
NNIQAPIVFSIPAKISLFRKLAIIE

SEQ ID NO: 3193066 - protein, 25 aa, Giardia lamblia
NNISALMLSIYYEMPEITKVLIQKE

SEQ ID NO: 3193067 - protein, 27 aa, Giardia lamblia
NNISNLHATILLLREFKDLKVLSLENN

SEQ ID NO: 3193068 - protein, 23 aa, Giardia lamblia
NNISRVWSLFNDLVPFLVEQQNL

SEQ ID NO: 3193069 - protein, 34 aa, Giardia lamblia
NNITISFMIQTLYLLLNLRLNTNLPFPAQFTQST

SEQ ID NO: 3193070 - protein, 18 aa, Giardia lamblia
NNITLAQLVIMQSLQDLS

SEQ ID NO: 3193071 - protein, 23 aa, Giardia lamblia
NNITWRFPESIVALIREANFAKL

SEQ ID NO: 3193072 - protein, 20 aa, Giardia lamblia
NNIVCQVAYQVIKGLHYLST

SEQ ID NO: 3193073 - protein, 20 aa, Giardia lamblia
NNIYNPNFTVLLTEKENDKV

SEQ ID NO: 3193074 - protein, 24 aa, Giardia lamblia
NNKDLIKAFFKRDLSIKVRGEEGY

SEQ ID NO: 3193075 - protein, 17 aa, Giardia lamblia
NNKSLISSVPPLDPLHS

SEQ ID NO: 3193076 - protein, 20 aa, Giardia lamblia
NNLESLLHKALCSQKFLVIP

SEQ ID NO: 3193077 - protein, 19 aa, Giardia lamblia
NNLGPLCAILAPLESNVTL

SEQ ID NO: 3193078 - protein, 18 aa, Giardia lamblia
NNLIINEDRFWYTNKSGS

SEQ ID NO: 3193079 - protein, 24 aa, Giardia lamblia
NNLLKRSVILIQAWCLYEAHILGS

SEQ ID NO: 3193080 - protein, 24 aa, Giardia lamblia
NNLRELFTLLGLIHPAVFCDYDRF

SEQ ID NO: 3193081 - protein, 32 aa, Giardia lamblia
NNLRPTYNPFIDDFIPLLFNNTTDLVLTNDCI

SEQ ID NO: 3193082 - protein, 24 aa, Giardia lamblia
NNLSSIVVLLKIAKHILPFAAGDY

SEQ ID NO: 3193083 - protein, 25 aa, Giardia lamblia
NNNMDLVRRFWPVEAGVQNNRGESA

SEQ ID NO: 3193084 - protein, 24 aa, Giardia lamblia
NNPEISLLVREHVECRSIVDLYQQ

SEQ ID NO: 3193085 - protein, 29 aa, Giardia lamblia
NNPGEWMARLKALWKKYQAFHDDISKSVR

SEQ ID NO: 3193086 - protein, 32 aa, Giardia lamblia
NNPHWDMIQVFILDMDLLDKLGDALSIFGRKE

SEQ ID NO: 3193087 - protein, 32 aa, Giardia lamblia
NNPPALKIQVKFPTPWKGVKVLTLIAKYGGLL

SEQ ID NO: 3193088 - protein, 20 aa, Giardia lamblia
NNQFRQMIDLKDKEILSLQE

SEQ ID NO: 3193089 - protein, 25 aa, Giardia lamblia
NNREAVEMLLPYLAKRRNDMQWTSL

SEQ ID NO: 3193090 - protein, 28 aa, Giardia lamblia
NNRGIRLLNSLIFLSSLVDPLEDLAKHG

SEQ ID NO: 3193091 - protein, 18 aa, Giardia lamblia
NNRILVTNGLPGVSSTPT

SEQ ID NO: 3193092 - protein, 29 aa, Giardia lamblia
NNRRNFRYRRIFWAMHRLALQRRALRKIV

SEQ ID NO: 3193093 - protein, 28 aa, Giardia lamblia
NNSHQITWNFYPFLNPQERMLSHTQSPW

SEQ ID NO: 3193094 - protein, 17 aa, Giardia lamblia
NNSYWAYRLMCVKNLLT

SEQ ID NO: 3193095 - protein, 25 aa, Giardia lamblia
NNTPDFFRLAPGQPVGLRYGPLLLV

SEQ ID NO: 3193096 - protein, 23 aa, Giardia lamblia
NNYLEMAQLPFGSAQEWFDAVKR

SEQ ID NO: 3193097 - protein, 19 aa, Giardia lamblia
NNYLIKASHWLVGGDGWAY

SEQ ID NO: 3193098 - protein, 27 aa, Giardia lamblia
NPACVVCSVPYYILKVKDVPPLSVDAV

SEQ ID NO: 3193099 - protein, 28 aa, Giardia lamblia
NPDARILVITKDAYVGGSLMYALHRSHN

SEQ ID NO: 3193100 - protein, 26 aa, Giardia lamblia
NPDDPHIFQHNILLTPDLSTQTDTVT

SEQ ID NO: 3193101 - protein, 23 aa, Giardia lamblia
NPDGLVLSHLPYGPTAYFTLSNV

SEQ ID NO: 3193102 - protein, 23 aa, Giardia lamblia
NPDGVILGNYRCNLAGADLNRRC

SEQ ID NO: 3193103 - protein, 18 aa, Giardia lamblia
NPDIIVCTPGRILHIHDQ

SEQ ID NO: 3193104 - protein, 21 aa, Giardia lamblia
NPDPTWISGAMWDSLCILDKM

SEQ ID NO: 3193105 - protein, 34 aa, Giardia lamblia
NPELESLPFSRPFMVLAFPLLWCLNGEYISDEER

SEQ ID NO: 3193106 - protein, 23 aa, Giardia lamblia
NPENTIFDAKRLIGRRFNDPEVQ

SEQ ID NO: 3193107 - protein, 35 aa, Giardia lamblia
NPESPHLLDLLFRITHFYSHPSYFARILEASAEEQ

SEQ ID NO: 3193108 - protein, 17 aa, Giardia lamblia
NPEYACILAFDIEVDKA

SEQ ID NO: 3193109 - protein, 19 aa, Giardia lamblia
NPEYSKPWVFVCDSGWKFH

SEQ ID NO: 3193110 - protein, 28 aa, Giardia lamblia
NPFSKQIRLFFVKYNDPLYIKLEKIEML

SEQ ID NO: 3193111 - protein, 19 aa, Giardia lamblia
NPFTRHQMLFMLKEMIAAF

SEQ ID NO: 3193112 - protein, 18 aa, Giardia lamblia
NPFVFTFESVFPGIMADL

SEQ ID NO: 3193113 - protein, 30 aa, Giardia lamblia
NPGDGAFLLPIPQYPLYSAAIALNNAVAVK

SEQ ID NO: 3193114 - protein, 22 aa, Giardia lamblia
NPGPGAYDPNLSKTAPAFSLKG

SEQ ID NO: 3193115 - protein, 22 aa, Giardia lamblia
NPGTPRYVLGTTALMVAAHYNN

SEQ ID NO: 3193116 - protein, 25 aa, Giardia lamblia
NPHVRSWVTLDLPPISQEGYDYFSS

SEQ ID NO: 3193117 - protein, 21 aa, Giardia lamblia
NPHVYPVIILNGGIKNRQEAD

SEQ ID NO: 3193118 - protein, 29 aa, Giardia lamblia
NPIEKVRLIYELYLKRKNSWYSDLATYYK

SEQ ID NO: 3193119 - protein, 25 aa, Giardia lamblia
NPIKTYSALQLFFKHFSDISRQKME

SEQ ID NO: 3193120 - protein, 21 aa, Giardia lamblia
NPKVRKLVDLTRKFFAIACNH

SEQ ID NO: 3193121 - protein, 26 aa, Giardia lamblia
NPLDPFVREAIPIDKATLRRPMGICI

SEQ ID NO: 3193122 - protein, 37 aa, Giardia lamblia
NPLLDSIVYIDIPAKYFADPAVKEWLLDSKNGILLSL

SEQ ID NO: 3193123 - protein, 22 aa, Giardia lamblia
NPLPPSVPYASVPLLVGEEYAA

SEQ ID NO: 3193124 - protein, 21 aa, Giardia lamblia
NPLTFKSFQGALLLSYAFTCS

SEQ ID NO: 3193125 - protein, 27 aa, Giardia lamblia
NPLTTYPYWREYLITVLPHLEKLDGHE

SEQ ID NO: 3193126 - protein, 23 aa, Giardia lamblia
NPLVKRTINLLPRKRGQDRPSVS

SEQ ID NO: 3193127 - protein, 35 aa, Giardia lamblia
NPNTLGSHFFIFPEISFLFKRPSIRDALRPANSTI

SEQ ID NO: 3193128 - protein, 18 aa, Giardia lamblia
NPPNPPLSVTLHPPTRSS

SEQ ID NO: 3193129 - protein, 34 aa, Giardia lamblia
NPQMMMQVAGADPRLMECMLVAMGIDPDMMKDMP

SEQ ID NO: 3193130 - protein, 38 aa, Giardia lamblia
NPQPYVDLVFTEKKFKVLPTLCRYLAKKHLKAKIRTRV

SEQ ID NO: 3193131 - protein, 26 aa, Giardia lamblia
NPQQFDLCIRWLYAILDHIRAEPDKS

SEQ ID NO: 3193132 - protein, 24 aa, Giardia lamblia
NPQRILLYHALLVSEYRGKGWYQC

SEQ ID NO: 3193133 - protein, 24 aa, Giardia lamblia
NPQVLETFLEKEDWFIQIVSATTK

SEQ ID NO: 3193134 - protein, 18 aa, Giardia lamblia
NPRCVLQELYLSGNPLGL

SEQ ID NO: 3193135 - protein, 18 aa, Giardia lamblia
NPSLAELLLNYRIISFKT

SEQ ID NO: 3193136 - protein, 23 aa, Giardia lamblia
NPSSILVPILFDGDVDAIWIESM

SEQ ID NO: 3193137 - protein, 56 aa, Giardia lamblia
NPTDDCMYTLLLDVPPPFELLQKELAVTPTLLRPHGLLSFKLILPAVNCLKMAQNQ

SEQ ID NO: 3193138 - protein, 33 aa, Giardia lamblia
NPTLAGYEWFLLQYQLSIFRLAKTQITIINIAR

SEQ ID NO: 3193139 - protein, 20 aa, Giardia lamblia
NPVLSFVFQFDKIEDYFFAF

SEQ ID NO: 3193140 - protein, 21 aa, Giardia lamblia
NPYIVSFVTQRKLNSIIPCEE

SEQ ID NO: 3193141 - protein, 26 aa, Giardia lamblia
NPYPVNAIPIVRNNWIYKQNVILLCA

SEQ ID NO: 3193142 - protein, 22 aa, Giardia lamblia
NPYSVPCTVAIFLNFDQTRMTP

SEQ ID NO: 3193143 - protein, 25 aa, Giardia lamblia
NQDDSFPYVVLFNGSHYDLFIASVD

SEQ ID NO: 3193144 - protein, 24 aa, Giardia lamblia
NQEAIVSFLLPYERCMQDAGGQTA

SEQ ID NO: 3193145 - protein, 27 aa, Giardia lamblia
NQEGLRSFKHLFLKHVYYADPGTKEPY

SEQ ID NO: 3193146 - protein, 20 aa, Giardia lamblia
NQELYLLKPVMTNGNIFAMA

SEQ ID NO: 3193147 - protein, 23 aa, Giardia lamblia
NQEMLRCYPIDYVNSVNLANQRR

SEQ ID NO: 3193148 - protein, 29 aa, Giardia lamblia
NQFRAEYHALLAKYQLLQTKLEGTRDGSV

SEQ ID NO: 3193149 - protein, 23 aa, Giardia lamblia
NQGIGRFLITSLIERARNNDCYK

SEQ ID NO: 3193150 - protein, 37 aa, Giardia lamblia
NQGLRFIKSLFGMAELRLSIPPAVLQQMVALAAEITI

SEQ ID NO: 3193151 - protein, 21 aa, Giardia lamblia
NQGYHFFKKGIRPAFEDPAHV

SEQ ID NO: 3193152 - protein, 24 aa, Giardia lamblia
NQHIDIAQLLLPLETGHHGNRLTN

SEQ ID NO: 3193153 - protein, 25 aa, Giardia lamblia
NQHLTPLQRLVLQKILQLVDVGRQV

SEQ ID NO: 3193154 - protein, 23 aa, Giardia lamblia
NQILPCGMSISCGFLFSSRIPEQ

SEQ ID NO: 3193155 - protein, 23 aa, Giardia lamblia
NQKKKLSTLPWNTPYKAMEEDNL

SEQ ID NO: 3193156 - protein, 19 aa, Giardia lamblia
NQKLIYLVETRSWATAILI

SEQ ID NO: 3193157 - protein, 22 aa, Giardia lamblia
NQLAGFLTRRYPRSLFLPNAQN

SEQ ID NO: 3193158 - protein, 26 aa, Giardia lamblia
NQLIDAFSEYLVVTPISLESFSTGLV

SEQ ID NO: 3193159 - protein, 27 aa, Giardia lamblia
NQLKHWHTKLMAFIDDYGFTILPEVSA

SEQ ID NO: 3193160 - protein, 23 aa, Giardia lamblia
NQLKLVQQLIPLHAGKETKDGLT

SEQ ID NO: 3193161 - protein, 20 aa, Giardia lamblia
NQLLKLITMAIDMAMPPTLI

SEQ ID NO: 3193162 - protein, 18 aa, Giardia lamblia
NQLSTVLASLETRREQIE

SEQ ID NO: 3193163 - protein, 21 aa, Giardia lamblia
NQNETLNKKLLLLTKENKDIR

SEQ ID NO: 3193164 - protein, 19 aa, Giardia lamblia
NQPLIALAVTFLRRLAITP

SEQ ID NO: 3193165 - protein, 31 aa, Giardia lamblia
NQPNLTEYVPLLPSIIPLTRRYRIPGDKSSS

SEQ ID NO: 3193166 - protein, 25 aa, Giardia lamblia
NQQSPSPHIFLNDGLPPVSPTNLTA

SEQ ID NO: 3193167 - protein, 17 aa, Giardia lamblia
NQRKSFYVFIDDSTMPT

SEQ ID NO: 3193168 - protein, 23 aa, Giardia lamblia
NQRRSVFLLSQHVQDFSLFTLFT

SEQ ID NO: 3193169 - protein, 26 aa, Giardia lamblia
NQSDIVSLLLMYECCRKDKTGTSALM

SEQ ID NO: 3193170 - protein, 24 aa, Giardia lamblia
NQSELYPLLPFKACYYCNKLMHML

SEQ ID NO: 3193171 - protein, 19 aa, Giardia lamblia
NQSIYIRFRKMSGVSMQTL

SEQ ID NO: 3193172 - protein, 20 aa, Giardia lamblia
NQSLFYLEQVIHALGKKKTD

SEQ ID NO: 3193173 - protein, 25 aa, Giardia lamblia
NQTHDAVVLLQRKVTDLSQILSQVM

SEQ ID NO: 3193174 - protein, 24 aa, Giardia lamblia
NQTSSALFPILAQSRLRQSMHQDQ

SEQ ID NO: 3193175 - protein, 20 aa, Giardia lamblia
NQTVQLPKQPHSGKLVFKGL

SEQ ID NO: 3193176 - protein, 22 aa, Giardia lamblia
NQVDKLLKALAAKEKEIEQLKL

SEQ ID NO: 3193177 - protein, 18 aa, Giardia lamblia
NRANAYFKLGQMNLSYDD

SEQ ID NO: 3193178 - protein, 24 aa, Giardia lamblia
NRANVIMFVGLQGAGKTTTCVKFG

SEQ ID NO: 3193179 - protein, 24 aa, Giardia lamblia
NRARALLSHGFLRDIIKYARSLNR

SEQ ID NO: 3193180 - protein, 28 aa, Giardia lamblia
NRAYLGWDYFRVHTGGFLPYNTPHHWNK

SEQ ID NO: 3193181 - protein, 17 aa, Giardia lamblia
NRDAIIAELSKMQSIPP

SEQ ID NO: 3193182 - protein, 17 aa, Giardia lamblia
NRDFIHNNRVLSYTSQR

SEQ ID NO: 3193183 - protein, 22 aa, Giardia lamblia
NRDRYIAFYISELSCLTTSIFK

SEQ ID NO: 3193184 - protein, 20 aa, Giardia lamblia
NREDLLSNSYFQAVERQSDN

SEQ ID NO: 3193185 - protein, 24 aa, Giardia lamblia
NREELTAKLLTYISAPPPAKNSLV

SEQ ID NO: 3193186 - protein, 20 aa, Giardia lamblia
NRELLPIYFSEGNNYHVVEL

SEQ ID NO: 3193187 - protein, 21 aa, Giardia lamblia
NREVSILRRYCAMDITSAEAA

SEQ ID NO: 3193188 - protein, 19 aa, Giardia lamblia
NRFLAEERIWSLLEQALKA

SEQ ID NO: 3193189 - protein, 19 aa, Giardia lamblia
NRFMRFCRVIFQVPVSEDS

SEQ ID NO: 3193190 - protein, 21 aa, Giardia lamblia
NRFMRFCRVIFQVPVSEDSGL

SEQ ID NO: 3193191 - protein, 19 aa, Giardia lamblia
NRFSGIIMFSVPGQGKTLI

SEQ ID NO: 3193192 - protein, 19 aa, Giardia lamblia
NRGSYQRVLHGRKAPEAQI

SEQ ID NO: 3193193 - protein, 29 aa, Giardia lamblia
NRGYIDEKDFIFGLRYSGLPSELISDKES

SEQ ID NO: 3193194 - protein, 20 aa, Giardia lamblia
NRGYNFALARVFNSVVQDIM

SEQ ID NO: 3193195 - protein, 21 aa, Giardia lamblia
NRHLLTCAQLEQMLGHPEIRV

SEQ ID NO: 3193196 - protein, 19 aa, Giardia lamblia
NRIAFWVNEALKYLDLCES

SEQ ID NO: 3193197 - protein, 29 aa, Giardia lamblia
NRILRLSLSCTAAFRWNRAIHGESMDFLV

SEQ ID NO: 3193198 - protein, 24 aa, Giardia lamblia
NRKDEYYRLAREAGYRSRAAYKLI

SEQ ID NO: 3193199 - protein, 39 aa, Giardia lamblia
NRKIVSSKELLWFFRSRLGIAVSPLIILQTFKLGGNDTI

SEQ ID NO: 3193200 - protein, 18 aa, Giardia lamblia
NRKLDHLPSLRLSSAQVS

SEQ ID NO: 3193201 - protein, 24 aa, Giardia lamblia
NRLADALLQLKRLETETTSKYKAL

SEQ ID NO: 3193202 - protein, 25 aa, Giardia lamblia
NRLFKWSPRGLPCYIPLPQNVADVK

SEQ ID NO: 3193203 - protein, 28 aa, Giardia lamblia
NRLGIHHFIKFNCTILRLSSNLVTDDVI

SEQ ID NO: 3193204 - protein, 26 aa, Giardia lamblia
NRLKAIESILSLLRTPGATGQSGQSN

SEQ ID NO: 3193205 - protein, 22 aa, Giardia lamblia
NRLQQRLVILRSAEKFYNLGIK

SEQ ID NO: 3193206 - protein, 20 aa, Giardia lamblia
NRLQTLQNLVPIATLKELKV

SEQ ID NO: 3193207 - protein, 30 aa, Giardia lamblia
NRLSSLNDLLPMFQLLDFNASHNVIVDVDQ

SEQ ID NO: 3193208 - protein, 19 aa, Giardia lamblia
NRLTSLRVKKLPNAPHCAE

SEQ ID NO: 3193209 - protein, 23 aa, Giardia lamblia
NRNITKIYLHTAAHSPQAPIVDS

SEQ ID NO: 3193210 - protein, 25 aa, Giardia lamblia
NRPEMREWFCAVYGLSDLSLAKPNP

SEQ ID NO: 3193211 - protein, 19 aa, Giardia lamblia
NRPLDPCVLKELRLIQSLI

SEQ ID NO: 3193212 - protein, 20 aa, Giardia lamblia
NRPLGLISRGSSPPFQGTEP

SEQ ID NO: 3193213 - protein, 26 aa, Giardia lamblia
NRPRPTFVDFLPHHWLLTSVCQGGQL

SEQ ID NO: 3193214 - protein, 31 aa, Giardia lamblia
NRQISCAVISFKLYYVPFPKEFDSVEKIINA

SEQ ID NO: 3193215 - protein, 18 aa, Giardia lamblia
NRQLLDTATLQRSHFPTA

SEQ ID NO: 3193216 - protein, 29 aa, Giardia lamblia
NRQTAQINELYILIGGILQNRDMSPLTVK

SEQ ID NO: 3193217 - protein, 19 aa, Giardia lamblia
NRRSFVRILARFESRIHGP

SEQ ID NO: 3193218 - protein, 33 aa, Giardia lamblia
NRRSSLQYYKNAQLLLYGFVPDESRGVSILQSW

SEQ ID NO: 3193219 - protein, 23 aa, Giardia lamblia
NRSIYGFYLSFGLIMGFLDMNIE

SEQ ID NO: 3193220 - protein, 25 aa, Giardia lamblia
NRTARDYIMLISPTATDAQREAVQA

SEQ ID NO: 3193221 - protein, 21 aa, Giardia lamblia
NRTFCSLPHIIKAGLGRVGVV

SEQ ID NO: 3193222 - protein, 17 aa, Giardia lamblia
NRTFVEPLMFKADTIVN

SEQ ID NO: 3193223 - protein, 31 aa, Giardia lamblia
NRTKRDPGIPNLYPFKKQMLEAILGSDQHIP

SEQ ID NO: 3193224 - protein, 27 aa, Giardia lamblia
NRTSRLPFVSDGFMFKEHVRRFNNMQR

SEQ ID NO: 3193225 - protein, 31 aa, Giardia lamblia
NRTVVPPVDLFLNQIQSRIRVVIRKRPINPK

SEQ ID NO: 3193226 - protein, 21 aa, Giardia lamblia
NRVEWVVLDLACIALGAVLVP

SEQ ID NO: 3193227 - protein, 19 aa, Giardia lamblia
NRVLFDLSLQRQPSLMSEL

SEQ ID NO: 3193228 - protein, 23 aa, Giardia lamblia
NRVPIIFICNNAHDQKLKTLRSK

SEQ ID NO: 3193229 - protein, 26 aa, Giardia lamblia
NRVYMPCIYAINKIDMVSIPAAEYYA

SEQ ID NO: 3193230 - protein, 24 aa, Giardia lamblia
NRYTNIFPYLRTQPIALYTDKFMI

SEQ ID NO: 3193231 - protein, 27 aa, Giardia lamblia
NSADHNLIWFNDKPVYLFTAGVASEIP

SEQ ID NO: 3193232 - protein, 19 aa, Giardia lamblia
NSAIAPLPPITPSPPNTAL

SEQ ID NO: 3193233 - protein, 20 aa, Giardia lamblia
NSALIFAIHSNFRCCAELLA

SEQ ID NO: 3193234 - protein, 28 aa, Giardia lamblia
NSAMALAERLYIAGYISYPRTESTTYPS

SEQ ID NO: 3193235 - protein, 19 aa, Giardia lamblia
NSCIGSQRVFWSILSGFSL

SEQ ID NO: 3193236 - protein, 23 aa, Giardia lamblia
NSDEVFAILSPQTIIICDNCCLK

SEQ ID NO: 3193237 - protein, 24 aa, Giardia lamblia
NSDYPNIRITRLGNRDPKLCDSIA

SEQ ID NO: 3193238 - protein, 17 aa, Giardia lamblia
NSELGAISVRRLDPESL

SEQ ID NO: 3193239 - protein, 26 aa, Giardia lamblia
NSEVVFLDPNLLLHLGRLIMESSCPA

SEQ ID NO: 3193240 - protein, 26 aa, Giardia lamblia
NSFECLADLSFFPFDSGFDVDSIEDS

SEQ ID NO: 3193241 - protein, 26 aa, Giardia lamblia
NSFRENLLLYLNYTTLYTTQKRLADV

SEQ ID NO: 3193242 - protein, 28 aa, Giardia lamblia
NSGDIRLTALLPYMASVWMHLSAFNFST

SEQ ID NO: 3193243 - protein, 23 aa, Giardia lamblia
NSGIDFLPMELMKLQFYPAELAQ

SEQ ID NO: 3193244 - protein, 27 aa, Giardia lamblia
NSGLFRPEVLLPLGLPEDVQVLAWGLS

SEQ ID NO: 3193245 - protein, 19 aa, Giardia lamblia
NSGLLYWVPGCDTIISLIK

SEQ ID NO: 3193246 - protein, 18 aa, Giardia lamblia
NSGSLRRHPHDAENIFLS

SEQ ID NO: 3193247 - protein, 24 aa, Giardia lamblia
NSGYDALFYMARSKVCIPPEILRK

SEQ ID NO: 3193248 - protein, 27 aa, Giardia lamblia
NSHTLFPSPLIPPHILLRALMSTREQR

SEQ ID NO: 3193249 - protein, 17 aa, Giardia lamblia
NSHVLYSSPTSPAFSSV

SEQ ID NO: 3193250 - protein, 20 aa, Giardia lamblia
NSICALLVLLTEVELLLVTD

SEQ ID NO: 3193251 - protein, 26 aa, Giardia lamblia
NSIIKLCMRFHISIETWSKRYKEESG

SEQ ID NO: 3193252 - protein, 18 aa, Giardia lamblia
NSILHSAVAQIFLNTAIL

SEQ ID NO: 3193253 - protein, 19 aa, Giardia lamblia
NSILPIVDLNNCFLSLVLT

SEQ ID NO: 3193254 - protein, 26 aa, Giardia lamblia
NSKAQDVFLFFLTNYQTRTDAMTKKI

SEQ ID NO: 3193255 - protein, 23 aa, Giardia lamblia
NSKAVVLPPLKTAQARAATPASG

SEQ ID NO: 3193256 - protein, 18 aa, Giardia lamblia
NSKDTCFLYALKQSGVLS

SEQ ID NO: 3193257 - protein, 35 aa, Giardia lamblia
NSKEYHFQFVYMHSPLLYFALEAYSHLVRISNYIL

SEQ ID NO: 3193258 - protein, 31 aa, Giardia lamblia
NSKFLVPVVSFFEIYGGKLFDLLNNRQRLQA

SEQ ID NO: 3193259 - protein, 20 aa, Giardia lamblia
NSKLGSCLYSYSLCSFICSC

SEQ ID NO: 3193260 - protein, 25 aa, Giardia lamblia
NSLAFKYLALLHRLGHHPDSQDSNA

SEQ ID NO: 3193261 - protein, 25 aa, Giardia lamblia
NSLEKLITALYRMKFIDTNTNGIEY

SEQ ID NO: 3193262 - protein, 18 aa, Giardia lamblia
NSLIRGRVAGLRSLLESN

SEQ ID NO: 3193263 - protein, 17 aa, Giardia lamblia
NSLITHIYLLQNILEES

SEQ ID NO: 3193264 - protein, 17 aa, Giardia lamblia
NSLKLGLKQLISLVPEI

SEQ ID NO: 3193265 - protein, 23 aa, Giardia lamblia
NSLKPLVDLLKEKDLTGLLEIVA

SEQ ID NO: 3193266 - protein, 25 aa, Giardia lamblia
NSMAIDLRDSLLARDKLHQKVDSLT

SEQ ID NO: 3193267 - protein, 20 aa, Giardia lamblia
NSMGAFLGFSIRVPRGTTCV

SEQ ID NO: 3193268 - protein, 21 aa, Giardia lamblia
NSMLYRFDYIPPTTRSIVTEP

SEQ ID NO: 3193269 - protein, 22 aa, Giardia lamblia
NSNGPIPPSLLSGSSALNVSVG

SEQ ID NO: 3193270 - protein, 22 aa, Giardia lamblia
NSNVPMLLGIVSVYAGCRNHVG

SEQ ID NO: 3193271 - protein, 20 aa, Giardia lamblia
NSNVPVVLYVLKCLTRTLRS

SEQ ID NO: 3193272 - protein, 22 aa, Giardia lamblia
NSPDNFYGFDALNGQFVNMEKA

SEQ ID NO: 3193273 - protein, 27 aa, Giardia lamblia
NSPEYITPLEQIFLQIAIYGDDVRLGV

SEQ ID NO: 3193274 - protein, 17 aa, Giardia lamblia
NSPLRDAVLSTAAPGEK

SEQ ID NO: 3193275 - protein, 25 aa, Giardia lamblia
NSPLRESLKLLEKLPRHSRILASSS

SEQ ID NO: 3193276 - protein, 35 aa, Giardia lamblia
NSQILYPYKKLHASAFPKIGLFTRPFINRDKNQKR

SEQ ID NO: 3193277 - protein, 29 aa, Giardia lamblia
NSQVFQVYYDISMTMWYLGKTTSEIIQLI

SEQ ID NO: 3193278 - protein, 18 aa, Giardia lamblia
NSRVAVLKPTLERGHCSR

SEQ ID NO: 3193279 - protein, 21 aa, Giardia lamblia
NSRVLLCSAIKSLLILVKCCS

SEQ ID NO: 3193280 - protein, 24 aa, Giardia lamblia
NSSAFLPLEFNALTTITSISLSAD

SEQ ID NO: 3193281 - protein, 31 aa, Giardia lamblia
NSSDRYIIQRYLETPLLLGGYKFDIRQWVFV

SEQ ID NO: 3193282 - protein, 29 aa, Giardia lamblia
NSSLDEIVFPVQLLLIKCILQPSASTTQF

SEQ ID NO: 3193283 - protein, 26 aa, Giardia lamblia
NSSNYTKMIYLLHLLRKVCDNPCELS

SEQ ID NO: 3193284 - protein, 24 aa, Giardia lamblia
NSSRFLNLQLMSGSMRIKTSLHNR

SEQ ID NO: 3193285 - protein, 25 aa, Giardia lamblia
NSSSPAFTAFAPLSLQSCRDSAKAK

SEQ ID NO: 3193286 - protein, 25 aa, Giardia lamblia
NSSSTLIYRPFGDLHDKKQLALAIK

SEQ ID NO: 3193287 - protein, 31 aa, Giardia lamblia
NSSVLYELFTLKVFAIPLLKSVPQSSRNFPS

SEQ ID NO: 3193288 - protein, 25 aa, Giardia lamblia
NSTAYILQPFGWSLATPIQDVFNIR

SEQ ID NO: 3193289 - protein, 17 aa, Giardia lamblia
NSTIFGTLGYCSPEVLK

SEQ ID NO: 3193290 - protein, 27 aa, Giardia lamblia
NSTMAKKFYLLLFSGHKPEQLPAALDG

SEQ ID NO: 3193291 - protein, 25 aa, Giardia lamblia
NSVGWTPMMIYTMLSDLDSVKQYAA

SEQ ID NO: 3193292 - protein, 24 aa, Giardia lamblia
NSVLLDIVALLYNTVSACYTLAAS

SEQ ID NO: 3193293 - protein, 19 aa, Giardia lamblia
NSVMLIQPKFKDYVGHILV

SEQ ID NO: 3193294 - protein, 27 aa, Giardia lamblia
NSVMQYPKIISTPLIDPARSSCSSTQM

SEQ ID NO: 3193295 - protein, 23 aa, Giardia lamblia
NSVYLYEQVVPPNPLEKLDTIAC

SEQ ID NO: 3193296 - protein, 18 aa, Giardia lamblia
NSWIFDFSKDPRKPETFA

SEQ ID NO: 3193297 - protein, 26 aa, Giardia lamblia
NSYAYKLQFPFATTGLIRLISPSNMS

SEQ ID NO: 3193298 - protein, 40 aa, Giardia lamblia
NSYLNRFTSIQLWSQLLQGFPVPSLPPPSVFQQLCGPRAT

SEQ ID NO: 3193299 - protein, 20 aa, Giardia lamblia
NTAAYLLYSFTRISSICRKA

SEQ ID NO: 3193300 - protein, 34 aa, Giardia lamblia
NTACCKVLAPLERLVILPDCRTALMIAAEAGSYE

SEQ ID NO: 3193301 - protein, 27 aa, Giardia lamblia
NTAGPQSSLFLLPRLMRAAHTNGMETV

SEQ ID NO: 3193302 - protein, 24 aa, Giardia lamblia
NTALIHAVLSRQYEAALLLAPHEA

SEQ ID NO: 3193303 - protein, 25 aa, Giardia lamblia
NTALMLAALMNRSKLIPALMEKEAM

SEQ ID NO: 3193304 - protein, 21 aa, Giardia lamblia
NTAYLIDFFGTVPSAEYRPIA

SEQ ID NO: 3193305 - protein, 24 aa, Giardia lamblia
NTCFFNSALQFLNAIRPISYPICL

SEQ ID NO: 3193306 - protein, 24 aa, Giardia lamblia
NTCLKHFLLFVREFQLIEANELEP

SEQ ID NO: 3193307 - protein, 19 aa, Giardia lamblia
NTCRIWDLKDFYPGLTIDV

SEQ ID NO: 3193308 - protein, 22 aa, Giardia lamblia
NTDFTGMLLQCPAAKDGSRLVR

SEQ ID NO: 3193309 - protein, 21 aa, Giardia lamblia
NTDIDVIRISKLNLVDLAGSE

SEQ ID NO: 3193310 - protein, 19 aa, Giardia lamblia
NTDILKYLKEYQSLSTHSQ

SEQ ID NO: 3193311 - protein, 23 aa, Giardia lamblia
NTDILVYEDLEFLRPSSAKKPRR

SEQ ID NO: 3193312 - protein, 23 aa, Giardia lamblia
NTDKVFTLLLSLDALNQLTEVEP

SEQ ID NO: 3193313 - protein, 20 aa, Giardia lamblia
NTDLLPLFKADQSYLQLLLE

SEQ ID NO: 3193314 - protein, 23 aa, Giardia lamblia
NTDQTIALLNDRVANLAAELNKQ

SEQ ID NO: 3193315 - protein, 26 aa, Giardia lamblia
NTDSTLKILSLTTPVCPPLVQSKQQQ

SEQ ID NO: 3193316 - protein, 24 aa, Giardia lamblia
NTEDRLLPLMHRIAKHITARVRSS

SEQ ID NO: 3193317 - protein, 25 aa, Giardia lamblia
NTEIIRLLAPREAGLQLKDGKTALM

SEQ ID NO: 3193318 - protein, 25 aa, Giardia lamblia
NTERNRFLYLRSVAAQLLCSENILS

SEQ ID NO: 3193319 - protein, 33 aa, Giardia lamblia
NTFGYPPRVAFLVTPAVITFLRGWKVFADGDDA

SEQ ID NO: 3193320 - protein, 23 aa, Giardia lamblia
NTGSFLFNLERFSYDLISQLRYS

SEQ ID NO: 3193321 - protein, 17 aa, Giardia lamblia
NTHLAMELAPIEAGIRS

SEQ ID NO: 3193322 - protein, 20 aa, Giardia lamblia
NTHLVSLLEDAIRQAYIHCT

SEQ ID NO: 3193323 - protein, 19 aa, Giardia lamblia
NTIFPLFVSLSQEPRHVFN

SEQ ID NO: 3193324 - protein, 37 aa, Giardia lamblia
NTIHTLMRHLALLFKIPKLIILYKVLGWPTAALDEEQ

SEQ ID NO: 3193325 - protein, 27 aa, Giardia lamblia
NTIKLRIAFLQRHLLQYVNTTFPIGSK

SEQ ID NO: 3193326 - protein, 20 aa, Giardia lamblia
NTILPQKLFQLITAKKQFEL

SEQ ID NO: 3193327 - protein, 25 aa, Giardia lamblia
NTITLFLHPRYHKVAGLERFLGGLT

SEQ ID NO: 3193328 - protein, 22 aa, Giardia lamblia
NTKYGISMPLLLMNSFNTEKDT

SEQ ID NO: 3193329 - protein, 19 aa, Giardia lamblia
NTLAKFPFLVELEHSIADG

SEQ ID NO: 3193330 - protein, 17 aa, Giardia lamblia
NTLFLQYDWRDIPQESE

SEQ ID NO: 3193331 - protein, 26 aa, Giardia lamblia
NTLINEAFAILLSLRQDSMQSSMLMN

SEQ ID NO: 3193332 - protein, 25 aa, Giardia lamblia
NTLKCVDLIFNRLFDDRNGALTKML

SEQ ID NO: 3193333 - protein, 26 aa, Giardia lamblia
NTLSLSIIQLLRRFPKIIQPAADEEI

SEQ ID NO: 3193334 - protein, 18 aa, Giardia lamblia
NTMICAASPFPPGSSVSG

SEQ ID NO: 3193335 - protein, 24 aa, Giardia lamblia
NTMNLDVLARMRANLQARQHASKG

SEQ ID NO: 3193336 - protein, 26 aa, Giardia lamblia
NTNPAKYFRRLISTSFDQLLLGIEQM

SEQ ID NO: 3193337 - protein, 24 aa, Giardia lamblia
NTNTVMRVMPFTVSYLMSSYKKTV

SEQ ID NO: 3193338 - protein, 21 aa, Giardia lamblia
NTPLIQSILTDESFLSNNYPQ

SEQ ID NO: 3193339 - protein, 26 aa, Giardia lamblia
NTPTNPAFVFLLSTRAGCLGLNLTAA

SEQ ID NO: 3193340 - protein, 24 aa, Giardia lamblia
NTQAVGYSVFPIIDGFSPSRASTL

SEQ ID NO: 3193341 - protein, 22 aa, Giardia lamblia
NTRIPYLDVSTTIRLANEAFRY

SEQ ID NO: 3193342 - protein, 17 aa, Giardia lamblia
NTSDAITLLKAKDYLLL

SEQ ID NO: 3193343 - protein, 25 aa, Giardia lamblia
NTSLQEMLLDILKLSSMSLRVENLR

SEQ ID NO: 3193344 - protein, 31 aa, Giardia lamblia
NTSSSPRQIPFLALLIIRGQDFGQGLLKYVL

SEQ ID NO: 3193345 - protein, 23 aa, Giardia lamblia
NTTAIIFTVLKFFGQRTFQEVQN

SEQ ID NO: 3193346 - protein, 27 aa, Giardia lamblia
NTTDPQSSLFLLPGLMRAAHTNSTETV

SEQ ID NO: 3193347 - protein, 27 aa, Giardia lamblia
NTTDPQSSLFLLPRLMRAAHTNSTETV

SEQ ID NO: 3193348 - protein, 21 aa, Giardia lamblia
NTVNIVLAYKPMIMKNTHGDI

SEQ ID NO: 3193349 - protein, 19 aa, Giardia lamblia
NTWREYVMLHIVGYLCGIW

SEQ ID NO: 3193350 - protein, 24 aa, Giardia lamblia
NTYASWVVRTLFKEGQIDPAVLSQ

SEQ ID NO: 3193351 - protein, 25 aa, Giardia lamblia
NTYIDGFFGILSLAGGTGSGLGSHV

SEQ ID NO: 3193352 - protein, 27 aa, Giardia lamblia
NVACIKLLLSREAGLLTNAKFVTGQGM

SEQ ID NO: 3193353 - protein, 26 aa, Giardia lamblia
NVAFSILLAIERLSSAGLYLSTIQCS

SEQ ID NO: 3193354 - protein, 26 aa, Giardia lamblia
NVASPEELNWLLCQAFDNRAVGSTDM

SEQ ID NO: 3193355 - protein, 33 aa, Giardia lamblia
NVDALFRCDLLGRTPLHYAAFMGSYRSLYTIVS

SEQ ID NO: 3193356 - protein, 32 aa, Giardia lamblia
NVDANKLFISYINSKSLMLEIALDLDKGYKMY

SEQ ID NO: 3193357 - protein, 24 aa, Giardia lamblia
NVDKLVEYFKVPGISNLYGNDVVG

SEQ ID NO: 3193358 - protein, 27 aa, Giardia lamblia
NVDNPTFLVLQGRITTILSMKPMELLG

SEQ ID NO: 3193359 - protein, 23 aa, Giardia lamblia
NVDSLLEYLLRSKAKDSYSALYH

SEQ ID NO: 3193360 - protein, 23 aa, Giardia lamblia
NVDTRFYVLLKELKTRLGKDYFS

SEQ ID NO: 3193361 - protein, 25 aa, Giardia lamblia
NVEAPVLVRTAPTGRTLLSITKADI

SEQ ID NO: 3193362 - protein, 26 aa, Giardia lamblia
NVEFISGFLQSPVLRRGYTLEYDASG

SEQ ID NO: 3193363 - protein, 27 aa, Giardia lamblia
NVELCSLKLIYTAQTLVSGPLLAVLAE

SEQ ID NO: 3193364 - protein, 23 aa, Giardia lamblia
NVEMFIHLMYIFEMADTTDPRAI

SEQ ID NO: 3193365 - protein, 26 aa, Giardia lamblia
NVERQLRMGFLPEINYVWTAIDNELI

SEQ ID NO: 3193366 - protein, 24 aa, Giardia lamblia
NVESWYRDVFRICPTRRDASTGEE

SEQ ID NO: 3193367 - protein, 19 aa, Giardia lamblia
NVFLYNGKKLVGAYNAPFI

SEQ ID NO: 3193368 - protein, 18 aa, Giardia lamblia
NVGFINTIVSLIYCEDRF

SEQ ID NO: 3193369 - protein, 30 aa, Giardia lamblia
NVGGFCDPLLQQAILRFLGRAIRAAFSYNC

SEQ ID NO: 3193370 - protein, 21 aa, Giardia lamblia
NVGLYAAAPLLPLASAPVGPS

SEQ ID NO: 3193371 - protein, 18 aa, Giardia lamblia
NVGSLFTPALFQTPKGAA

SEQ ID NO: 3193372 - protein, 27 aa, Giardia lamblia
NVGYASKNIFFLPISGFTGENLISTKE

SEQ ID NO: 3193373 - protein, 20 aa, Giardia lamblia
NVHVSCAIFVWKWACQHRFS

SEQ ID NO: 3193374 - protein, 19 aa, Giardia lamblia
NVHVVVHYPSFMANSERPD

SEQ ID NO: 3193375 - protein, 17 aa, Giardia lamblia
NVIDLFLEPGGVFWEII

SEQ ID NO: 3193376 - protein, 23 aa, Giardia lamblia
NVILKLKGYGVKVTLAVTLDSSS

SEQ ID NO: 3193377 - protein, 23 aa, Giardia lamblia
NVIRGIALRLISVSKTASLQNSE

SEQ ID NO: 3193378 - protein, 22 aa, Giardia lamblia
NVKELLTLVQQKGLITGLAADL

SEQ ID NO: 3193379 - protein, 17 aa, Giardia lamblia
NVKRNLLQLSFNVQFKL

SEQ ID NO: 3193380 - protein, 32 aa, Giardia lamblia
NVLAAQRIYDPLWFQPSLAATASFVAANRINQ

SEQ ID NO: 3193381 - protein, 24 aa, Giardia lamblia
NVLAPYIISSAIVTSFELLNERYR

SEQ ID NO: 3193382 - protein, 18 aa, Giardia lamblia
NVLGSPLTKNYLFLGDVV

SEQ ID NO: 3193383 - protein, 28 aa, Giardia lamblia
NVLGVFVRTSHRIIWFSPANESYNVSIP

SEQ ID NO: 3193384 - protein, 21 aa, Giardia lamblia
NVLLQIQRLVAELPAEELRVF

SEQ ID NO: 3193385 - protein, 20 aa, Giardia lamblia
NVLNVITKFAKTRLTTNEAV

SEQ ID NO: 3193386 - protein, 23 aa, Giardia lamblia
NVLPPSHSLLLSTAPPVQSRQED

SEQ ID NO: 3193387 - protein, 23 aa, Giardia lamblia
NVLSFKFNSAIAKAISWSHHWQA

SEQ ID NO: 3193388 - protein, 17 aa, Giardia lamblia
NVNLAKLNLLMRQEGKS

SEQ ID NO: 3193389 - protein, 20 aa, Giardia lamblia
NVPFLICTLNARLFANIRTR

SEQ ID NO: 3193390 - protein, 26 aa, Giardia lamblia
NVPKPPSKGFVFGAPVAPAQQPPPPS

SEQ ID NO: 3193391 - protein, 18 aa, Giardia lamblia
NVPPYNDEKLWLEARRCC

SEQ ID NO: 3193392 - protein, 35 aa, Giardia lamblia
NVPQSPQLLSSPRSPTRILSRKTLEYEPVRHLEIL

SEQ ID NO: 3193393 - protein, 22 aa, Giardia lamblia
NVPRPQLPMNLSISVKDMAVGA

SEQ ID NO: 3193394 - protein, 35 aa, Giardia lamblia
NVPTALILLATIHALLELLAMKYSEHQPFTFGSQL

SEQ ID NO: 3193395 - protein, 20 aa, Giardia lamblia
NVPVLPSLRSGSLVQNNKRR

SEQ ID NO: 3193396 - protein, 25 aa, Giardia lamblia
NVQHLSALLLNYYKGFSPRLEILYG

SEQ ID NO: 3193397 - protein, 26 aa, Giardia lamblia
NVRMVTWYYSPFPPPYTHLPEIFICP

SEQ ID NO: 3193398 - protein, 19 aa, Giardia lamblia
NVSFPPEPLYLGSLTTYSG

SEQ ID NO: 3193399 - protein, 26 aa, Giardia lamblia
NVSGRLYLFDSFGDVVGFISSAGNIT

SEQ ID NO: 3193400 - protein, 21 aa, Giardia lamblia
NVSIRFHFHKAYGVPVIYTKN

SEQ ID NO: 3193401 - protein, 18 aa, Giardia lamblia
NVSPLCALLADYAQVLLD

SEQ ID NO: 3193402 - protein, 24 aa, Giardia lamblia
NVSQYLHQWIANDYAHYIEKKKAG

SEQ ID NO: 3193403 - protein, 29 aa, Giardia lamblia
NVSRERGHLLLVFRDTERKSYHSCVKVDE

SEQ ID NO: 3193404 - protein, 18 aa, Giardia lamblia
NVSYDYKLNAPFQTCCQQ

SEQ ID NO: 3193405 - protein, 25 aa, Giardia lamblia
NVTALMYTSWWNQPACAALLIEHEA

SEQ ID NO: 3193406 - protein, 27 aa, Giardia lamblia
NVTNKEVLRLWYSYKRALYDMMRGAID

SEQ ID NO: 3193407 - protein, 18 aa, Giardia lamblia
NVTPLMRAVLNDKISEVD

SEQ ID NO: 3193408 - protein, 24 aa, Giardia lamblia
NVTRSLELVLLLTAAQVASLVIGI

SEQ ID NO: 3193409 - protein, 25 aa, Giardia lamblia
NVTTNHLLLPLQIREDKGGIFVNNV

SEQ ID NO: 3193410 - protein, 27 aa, Giardia lamblia
NVTYETIYHVYTLDLTLSTTGSAAAGY

SEQ ID NO: 3193411 - protein, 17 aa, Giardia lamblia
NVTYTVSFLYDSKRKHV

SEQ ID NO: 3193412 - protein, 20 aa, Giardia lamblia
NVVKFIVRPTLRSLRLSTSS

SEQ ID NO: 3193413 - protein, 23 aa, Giardia lamblia
NVVPFLLCEVGMKNNMGYSALMI

SEQ ID NO: 3193414 - protein, 25 aa, Giardia lamblia
NVVQLLVQYEKGIRMFNSRTACMRA

SEQ ID NO: 3193415 - protein, 18 aa, Giardia lamblia
NVYVIRPGGWEHVLAMDN

SEQ ID NO: 3193416 - protein, 24 aa, Giardia lamblia
NVYVRLSHSYFFPQSGGQLGDVGS

SEQ ID NO: 3193417 - protein, 18 aa, Giardia lamblia
NWAQLQPLCEFRLKLLPK

SEQ ID NO: 3193418 - protein, 25 aa, Giardia lamblia
NWEHFLSCIWGIHKPPREGSLVQTH

SEQ ID NO: 3193419 - protein, 20 aa, Giardia lamblia
NWPTIPQLYVKGELIGGSDI

SEQ ID NO: 3193420 - protein, 21 aa, Giardia lamblia
NWTSILYPATVLQAYPSTNIP

SEQ ID NO: 3193421 - protein, 23 aa, Giardia lamblia
NYDEDGFLYYFSKAGDGVSDIQL

SEQ ID NO: 3193422 - protein, 24 aa, Giardia lamblia
NYEIYTKFISTPVFMKDIEAHVSK

SEQ ID NO: 3193423 - protein, 25 aa, Giardia lamblia
NYELIQSKYFPFYQLNYVKSRYTAT

SEQ ID NO: 3193424 - protein, 22 aa, Giardia lamblia
NYEPLIVHRLIHSNLKPSNVMI

SEQ ID NO: 3193425 - protein, 18 aa, Giardia lamblia
NYERLRILLETHSLVSIP

SEQ ID NO: 3193426 - protein, 24 aa, Giardia lamblia
NYESSILHVLQLLKSSANHYLDQD

SEQ ID NO: 3193427 - protein, 26 aa, Giardia lamblia
NYEYKVLMRLLKSVGCTEMRFRRGPK

SEQ ID NO: 3193428 - protein, 24 aa, Giardia lamblia
NYGFSPEIIVWDTSTRKALTLITQ

SEQ ID NO: 3193429 - protein, 21 aa, Giardia lamblia
NYGIFCILCSLMPATHYRCDV

SEQ ID NO: 3193430 - protein, 25 aa, Giardia lamblia
NYIANFETTFLTLNPSRKQLLLAPH

SEQ ID NO: 3193431 - protein, 26 aa, Giardia lamblia
NYKEILDIIRRWDLFPDKNSLESFLK

SEQ ID NO: 3193432 - protein, 34 aa, Giardia lamblia
NYKNPETLRFLLQNVRWWLQEFKIDGFRFDGVMS

SEQ ID NO: 3193433 - protein, 18 aa, Giardia lamblia
NYLVVQLLKSKEAGLCDK

SEQ ID NO: 3193434 - protein, 18 aa, Giardia lamblia
NYRLARLLARWEGGYQNT

SEQ ID NO: 3193435 - protein, 17 aa, Giardia lamblia
NYRRSGMRLVKINPEAL

SEQ ID NO: 3193436 - protein, 21 aa, Giardia lamblia
NYSGLPYSMIFAIVAGCDVHF

SEQ ID NO: 3193437 - protein, 27 aa, Giardia lamblia
NYSWDRFLHLCFLLVRSVAILHSVGWS

SEQ ID NO: 3193438 - protein, 19 aa, Giardia lamblia
NYTAKPYEYALSSSGTVKK

SEQ ID NO: 3193439 - protein, 17 aa, Giardia lamblia
NYTEVACLLKCELGKQT

SEQ ID NO: 3193440 - protein, 25 aa, Giardia lamblia
NYTVPLLADLLNYAKIKPLVNQIEI

SEQ ID NO: 3193441 - protein, 23 aa, Giardia lamblia
NYVFVIPIEFKQSIIGFLTCNVS

SEQ ID NO: 3193442 - protein, 21 aa, Giardia lamblia
NYYREPMLPQIRNNAKPPATN

SEQ ID NO: 3193443 - protein, 19 aa, Giardia lamblia
PAAAALLKTVNKPLDDHIS

SEQ ID NO: 3193444 - protein, 23 aa, Giardia lamblia
PAAIWALGCLAWSFADPQSFYSK

SEQ ID NO: 3193445 - protein, 20 aa, Giardia lamblia
PAAQGVQPVLAPNPQIQAGA

SEQ ID NO: 3193446 - protein, 24 aa, Giardia lamblia
PAAVRPLRELYKEGSLITITSFTS

SEQ ID NO: 3193447 - protein, 24 aa, Giardia lamblia
PADGVMLGVGLLKNPACLLKNAPQ

SEQ ID NO: 3193448 - protein, 23 aa, Giardia lamblia
PADHDKFYSYWKMSGQQTDKHRF

SEQ ID NO: 3193449 - protein, 17 aa, Giardia lamblia
PADLYPELIIDSLLHND

SEQ ID NO: 3193450 - protein, 19 aa, Giardia lamblia
PADPYDFLYRYYRTLAQES

SEQ ID NO: 3193451 - protein, 20 aa, Giardia lamblia
PADRPWKALIDRWMEHDRHY

SEQ ID NO: 3193452 - protein, 26 aa, Giardia lamblia
PAELPVKFPYELDPFQRRAIGALHIG

SEQ ID NO: 3193453 - protein, 26 aa, Giardia lamblia
PAELSTYSIVLPPVSAGAGIPRVAQE

SEQ ID NO: 3193454 - protein, 18 aa, Giardia lamblia
PAETLLMYAWTDAQEVRA

SEQ ID NO: 3193455 - protein, 19 aa, Giardia lamblia
PAFDYLKSALHILSGGTFM

SEQ ID NO: 3193456 - protein, 30 aa, Giardia lamblia
PAFEIHKDFRLYLTTIPFPQFPSSITRNST

SEQ ID NO: 3193457 - protein, 26 aa, Giardia lamblia
PAFNSYIEAPVRPGYESSLLSYVKVS

SEQ ID NO: 3193458 - protein, 18 aa, Giardia lamblia
PAGLLYYGQEYRPVPLAQ

SEQ ID NO: 3193459 - protein, 20 aa, Giardia lamblia
PAHLDLLNTVTPTALWRECG

SEQ ID NO: 3193460 - protein, 21 aa, Giardia lamblia
PAHPIIIPAQPKQILEEAPVV

SEQ ID NO: 3193461 - protein, 30 aa, Giardia lamblia
PAHTFKTAMLLFVPTPMQIKMIFSTAREVL

SEQ ID NO: 3193462 - protein, 25 aa, Giardia lamblia
PAIYDRIALLLTTRNYRKAAELCLQ

SEQ ID NO: 3193463 - protein, 19 aa, Giardia lamblia
PAKALHYPTKLMLPQGSRE

SEQ ID NO: 3193464 - protein, 22 aa, Giardia lamblia
PAKISLFRKLAIIETPIDFYRQ

SEQ ID NO: 3193465 - protein, 26 aa, Giardia lamblia
PAKKLALRLFLAAREAKKILTVNRSA

SEQ ID NO: 3193466 - protein, 20 aa, Giardia lamblia
PALCEVVSLKLRPPGSSNTV

SEQ ID NO: 3193467 - protein, 28 aa, Giardia lamblia
PALDLERRWTFRPLVKLGDLLSVGDIFG

SEQ ID NO: 3193468 - protein, 24 aa, Giardia lamblia
PALGRELLRPMPYVEKYGQIQGCL

SEQ ID NO: 3193469 - protein, 24 aa, Giardia lamblia
PALIARLDSPFLGKYILVQPDNQR

SEQ ID NO: 3193470 - protein, 21 aa, Giardia lamblia
PALIIVFFAGTPYRMYWDLKF

SEQ ID NO: 3193471 - protein, 21 aa, Giardia lamblia
PALIIWLDKNVFSKEGRIEAS

SEQ ID NO: 3193472 - protein, 18 aa, Giardia lamblia
PALNFKHIIIGFLSLFNE

SEQ ID NO: 3193473 - protein, 22 aa, Giardia lamblia
PALQDYYFPTVDPGWETILQNT

SEQ ID NO: 3193474 - protein, 30 aa, Giardia lamblia
PALVPYFRQILPVFNLFYTRNINIGDSIYY

SEQ ID NO: 3193475 - protein, 17 aa, Giardia lamblia
PAMLHFVRSPTSLRRSD

SEQ ID NO: 3193476 - protein, 32 aa, Giardia lamblia
PANITIDPLLNLRLIDFQGIRLARDSTYRQTL

SEQ ID NO: 3193477 - protein, 23 aa, Giardia lamblia
PANPPNICFKKIGGRRGAMFSFG

SEQ ID NO: 3193478 - protein, 22 aa, Giardia lamblia
PANTGFLFFDTIDDTQRSFRIG

SEQ ID NO: 3193479 - protein, 20 aa, Giardia lamblia
PAPAPFPGPTYDLFDICIAP

SEQ ID NO: 3193480 - protein, 19 aa, Giardia lamblia
PAPKPSGYLPAQALSLDTM

SEQ ID NO: 3193481 - protein, 17 aa, Giardia lamblia
PAPTVLCAPLAIADTTA

SEQ ID NO: 3193482 - protein, 22 aa, Giardia lamblia
PAPVLNIHPPPPNPSAFCGPGS

SEQ ID NO: 3193483 - protein, 29 aa, Giardia lamblia
PAQEIQDIIAYKYIFGNASMLKVKDMGRR

SEQ ID NO: 3193484 - protein, 22 aa, Giardia lamblia
PAQPAIIPGIMSAPPQVPVTMP

SEQ ID NO: 3193485 - protein, 17 aa, Giardia lamblia
PAQQKMLYLAQQLQNTT

SEQ ID NO: 3193486 - protein, 18 aa, Giardia lamblia
PARHHGVRPPILDASISQ

SEQ ID NO: 3193487 - protein, 18 aa, Giardia lamblia
PARILLAGQVRKISEDRT

SEQ ID NO: 3193488 - protein, 17 aa, Giardia lamblia
PARLQLSAYTAEKERDM

SEQ ID NO: 3193489 - protein, 23 aa, Giardia lamblia
PARSYAHLLQLPNVPRFSCTSKT

SEQ ID NO: 3193490 - protein, 26 aa, Giardia lamblia
PASDFKFSFGYIPDQEPPRKSLRSHG

SEQ ID NO: 3193491 - protein, 23 aa, Giardia lamblia
PASHLVYMAPEILRREKYTDKAD

SEQ ID NO: 3193492 - protein, 22 aa, Giardia lamblia
PASIEWMELHRKGNVLLVGAED

SEQ ID NO: 3193493 - protein, 27 aa, Giardia lamblia
PASILGYRITWSFVKTFFARVFDSVHS

SEQ ID NO: 3193494 - protein, 18 aa, Giardia lamblia
PASIPRPRREHHSLLATL

SEQ ID NO: 3193495 - protein, 29 aa, Giardia lamblia
PASTIQILGAEKALFRSLKARNRKTPKYG

SEQ ID NO: 3193496 - protein, 17 aa, Giardia lamblia
PATNLNRILGVRHLAYH

SEQ ID NO: 3193497 - protein, 24 aa, Giardia lamblia
PATRNMVISITRKASVNTPKQTTR

SEQ ID NO: 3193498 - protein, 27 aa, Giardia lamblia
PAVDIWALGCTIYELATSSSLFLGVTP

SEQ ID NO: 3193499 - protein, 20 aa, Giardia lamblia
PAVVGPVRYISCPCPSIFSP

SEQ ID NO: 3193500 - protein, 17 aa, Giardia lamblia
PAWSVPPLGLLCCVSPL

SEQ ID NO: 3193501 - protein, 25 aa, Giardia lamblia
PAYKDMIFRLYPNIKALYDTVSKEG

SEQ ID NO: 3193502 - protein, 19 aa, Giardia lamblia
PAYLITLSYIVRFSERDHI

SEQ ID NO: 3193503 - protein, 23 aa, Giardia lamblia
PCDDDYIHHFLFTECFTGNGSAT

SEQ ID NO: 3193504 - protein, 23 aa, Giardia lamblia
PCEETLLRELFSKACLRHDILHE

SEQ ID NO: 3193505 - protein, 30 aa, Giardia lamblia
PCEPQAEVLGYFYLVTSGLEYLRAPIDAAC

SEQ ID NO: 3193506 - protein, 22 aa, Giardia lamblia
PCGDVNLRLPFVTMARPADAEV

SEQ ID NO: 3193507 - protein, 19 aa, Giardia lamblia
PCKGYNDVLAAIRATDTFA

SEQ ID NO: 3193508 - protein, 19 aa, Giardia lamblia
PCLETLPNPLQSPGDEFEK

SEQ ID NO: 3193509 - protein, 18 aa, Giardia lamblia
PCLLPTGQLFRTTRGRIV

SEQ ID NO: 3193510 - protein, 25 aa, Giardia lamblia
PCLSQPCIVYPRQLYSGKQVLSVLM

SEQ ID NO: 3193511 - protein, 18 aa, Giardia lamblia
PCNHLIDLAYFVMKSHGE

SEQ ID NO: 3193512 - protein, 19 aa, Giardia lamblia
PCPASIKCYSVGYLGIAYN

SEQ ID NO: 3193513 - protein, 18 aa, Giardia lamblia
PCQHSLIVATLFDPSDAS

SEQ ID NO: 3193514 - protein, 24 aa, Giardia lamblia
PCSKQFIVRPLFGNSIDLPKDATT

SEQ ID NO: 3193515 - protein, 24 aa, Giardia lamblia
PCTMESLASLMFLTGARPANIQSH

SEQ ID NO: 3193516 - protein, 27 aa, Giardia lamblia
PCTQQLIARLGALLGPGKAGMLKLSLK

SEQ ID NO: 3193517 - protein, 19 aa, Giardia lamblia
PCTTIRLLLEYCSGGNCVK

SEQ ID NO: 3193518 - protein, 27 aa, Giardia lamblia
PCVDISHPESPLYPLEPRQTVVHVIDL

SEQ ID NO: 3193519 - protein, 25 aa, Giardia lamblia
PCVSQLLLVKTLQRRFFEVDAVLQN

SEQ ID NO: 3193520 - protein, 17 aa, Giardia lamblia
PCYRHILISAPTSAGKS

SEQ ID NO: 3193521 - protein, 27 aa, Giardia lamblia
PDALKRIIMARMHDIRCLIVENNQLEK

SEQ ID NO: 3193522 - protein, 22 aa, Giardia lamblia
PDARFNLAMLARLTLDLQTAWT

SEQ ID NO: 3193523 - protein, 21 aa, Giardia lamblia
PDCVKLLAPYELLIKNIDNKT

SEQ ID NO: 3193524 - protein, 25 aa, Giardia lamblia
PDDMINAIFKYFTPGKLPKCLNRKK

SEQ ID NO: 3193525 - protein, 24 aa, Giardia lamblia
PDECKALVFNLLTESSANPDALQE

SEQ ID NO: 3193526 - protein, 21 aa, Giardia lamblia
PDELCPASPTLRNAAQRKGVG

SEQ ID NO: 3193527 - protein, 25 aa, Giardia lamblia
PDFDSIIRVFGLRLPEEWKVIVAAY

SEQ ID NO: 3193528 - protein, 34 aa, Giardia lamblia
PDFIALERYMQLRHPCLLNILDVYHNKPARKVVV

SEQ ID NO: 3193529 - protein, 20 aa, Giardia lamblia
PDFRKALPPELLDDTLVYLT

SEQ ID NO: 3193530 - protein, 19 aa, Giardia lamblia
PDFSALLERCLRQIMTAFI

SEQ ID NO: 3193531 - protein, 25 aa, Giardia lamblia
PDGKKPLYIPLLHSVMEMIIEAVKP

SEQ ID NO: 3193532 - protein, 25 aa, Giardia lamblia
PDGRTPLMLAAERGNLHAIKALLPH

SEQ ID NO: 3193533 - protein, 25 aa, Giardia lamblia
PDGTTPLMKAVIRDDMRLVQKYLPT

SEQ ID NO: 3193534 - protein, 26 aa, Giardia lamblia
PDGVPFAPQYFLADPTSLLSDEPSFI

SEQ ID NO: 3193535 - protein, 19 aa, Giardia lamblia
PDIVPRYTTLPRSKELLKE

SEQ ID NO: 3193536 - protein, 22 aa, Giardia lamblia
PDKAFIDELLKSAAPSGELYGT

SEQ ID NO: 3193537 - protein, 17 aa, Giardia lamblia
PDKKRYLKLAIHNDLTK

SEQ ID NO: 3193538 - protein, 21 aa, Giardia lamblia
PDLAYLSADAPRSVERFPTTQ

SEQ ID NO: 3193539 - protein, 24 aa, Giardia lamblia
PDLEALLEYLPASAQKFFLSATLD

SEQ ID NO: 3193540 - protein, 17 aa, Giardia lamblia
PDLIQLLLPMEVSLTTT

SEQ ID NO: 3193541 - protein, 35 aa, Giardia lamblia
PDLSDYLAQYTPRLRKFLGVCLRFDVTKRHLTNGL

SEQ ID NO: 3193542 - protein, 21 aa, Giardia lamblia
PDMMCLILETMRELGFKWRIG

SEQ ID NO: 3193543 - protein, 25 aa, Giardia lamblia
PDMRGNLPRMFASTNDILKLCQLLG

SEQ ID NO: 3193544 - protein, 23 aa, Giardia lamblia
PDNGTILLYPGQEVRMHLGILPN

SEQ ID NO: 3193545 - protein, 21 aa, Giardia lamblia
PDNQAYWYPPGHGDVLRSLIS

SEQ ID NO: 3193546 - protein, 21 aa, Giardia lamblia
PDNTEFLSLCPFSGTAMISVL

SEQ ID NO: 3193547 - protein, 24 aa, Giardia lamblia
PDPEAVRCDLFWRRGRKLEIEGRL

SEQ ID NO: 3193548 - protein, 32 aa, Giardia lamblia
PDPRVRTDIPRRVVGPFYPPDNLRINSSSSPL

SEQ ID NO: 3193549 - protein, 31 aa, Giardia lamblia
PDPTLLPLMPNQSFINLPYPAAPHGYVPMSY

SEQ ID NO: 3193550 - protein, 23 aa, Giardia lamblia
PDQRAVYFANRAAARLGLKAEEE

SEQ ID NO: 3193551 - protein, 23 aa, Giardia lamblia
PDRLDRSVILAKIKELRARKDKE

SEQ ID NO: 3193552 - protein, 27 aa, Giardia lamblia
PDRLPGIMALGFIAAFSETLALSIIVA

SEQ ID NO: 3193553 - protein, 19 aa, Giardia lamblia
PDRSFYHTSSFSSLLAQLN

SEQ ID NO: 3193554 - protein, 17 aa, Giardia lamblia
PDRTFIASLPLHNKPIF

SEQ ID NO: 3193555 - protein, 23 aa, Giardia lamblia
PDSEPTTVLYTKTLDRLVTAVNK

SEQ ID NO: 3193556 - protein, 35 aa, Giardia lamblia
PDSFDFATLKRVTLIFFKLYYLNKIANIGTSNLLD

SEQ ID NO: 3193557 - protein, 22 aa, Giardia lamblia
PDSGLLVQLETMKQLLATQTAD

SEQ ID NO: 3193558 - protein, 25 aa, Giardia lamblia
PDSIALGACLLARELGAKLIIVFSK

SEQ ID NO: 3193559 - protein, 20 aa, Giardia lamblia
PDSYFKIRDDIRHQAAELLH

SEQ ID NO: 3193560 - protein, 26 aa, Giardia lamblia
PDTCNYLQVYFLPNYNVSSAEIIFPG

SEQ ID NO: 3193561 - protein, 21 aa, Giardia lamblia
PDTIMNLWEPQFIELLEKVDL

SEQ ID NO: 3193562 - protein, 26 aa, Giardia lamblia
PDTMKDGVLFTWAKYLFNKEDQSAIN

SEQ ID NO: 3193563 - protein, 32 aa, Giardia lamblia
PDTREWIDGLLSKIFRNINDPSFYLTNPMIAN

SEQ ID NO: 3193564 - protein, 22 aa, Giardia lamblia
PDTRYVAYGGAGYGIWMANIPD

SEQ ID NO: 3193565 - protein, 20 aa, Giardia lamblia
PDVECPLFVTWHTALRTGDP

SEQ ID NO: 3193566 - protein, 23 aa, Giardia lamblia
PDVHAFRFLIATDTFTKQGLIYL

SEQ ID NO: 3193567 - protein, 22 aa, Giardia lamblia
PDVLMDIMDLATPSSLLAANCE

SEQ ID NO: 3193568 - protein, 25 aa, Giardia lamblia
PDVSFRIQCSFYLELVIPLLRNEAQ

SEQ ID NO: 3193569 - protein, 30 aa, Giardia lamblia
PDVYAGKPFILYLYLKAAVSVPPVSLIATY

SEQ ID NO: 3193570 - protein, 19 aa, Giardia lamblia
PDYAYLRKIFRELFVREGF

SEQ ID NO: 3193571 - protein, 26 aa, Giardia lamblia
PDYSPFTNTYLPEPPINMGPSPNMNY

SEQ ID NO: 3193572 - protein, 37 aa, Giardia lamblia
PDYVFVFNNIRVLIHVCIIIIKNSLYLLNCLAKKLDS

SEQ ID NO: 3193573 - protein, 26 aa, Giardia lamblia
PEADAVYILERIISRAASVNRSESIQ

SEQ ID NO: 3193574 - protein, 37 aa, Giardia lamblia
PEADSKLCLMAFDLMNDLLHRCSHAWRAAGVNIFRLN

SEQ ID NO: 3193575 - protein, 28 aa, Giardia lamblia
PEAINELELLLTVPFGAGSADIYEEIED

SEQ ID NO: 3193576 - protein, 24 aa, Giardia lamblia
PEALFRNIMSLKDLPRPPTKGKHC

SEQ ID NO: 3193577 - protein, 29 aa, Giardia lamblia
PEASPNDAWVLVYRPGAPSVSKYVPVDKL

SEQ ID NO: 3193578 - protein, 22 aa, Giardia lamblia
PEATIWNIMGQLLQALQYCHSP

SEQ ID NO: 3193579 - protein, 23 aa, Giardia lamblia
PEATIWSMFHQMALALEYCHSPN

SEQ ID NO: 3193580 - protein, 30 aa, Giardia lamblia
PECVCSTQLFKQLLIDLGSLGSTQGFILSV

SEQ ID NO: 3193581 - protein, 20 aa, Giardia lamblia
PECVKFLLKREGGKRRNNGT

SEQ ID NO: 3193582 - protein, 29 aa, Giardia lamblia
PEDAEALLLAYPAALLGLKMLVTDVADIR

SEQ ID NO: 3193583 - protein, 18 aa, Giardia lamblia
PEDHLEAEELVIINVDLD

SEQ ID NO: 3193584 - protein, 17 aa, Giardia lamblia
PEDKGIMPRAVEQIFLF

SEQ ID NO: 3193585 - protein, 24 aa, Giardia lamblia
PEDLVRNILPPEDREKLDDILSRV

SEQ ID NO: 3193586 - protein, 26 aa, Giardia lamblia
PEDTLSCVWIFRYAATSPVALSVQTS

SEQ ID NO: 3193587 - protein, 24 aa, Giardia lamblia
PEDVRKRIKYWKTLKGLMTNQSIH

SEQ ID NO: 3193588 - protein, 23 aa, Giardia lamblia
PEECTFKPAILSYSKQLDTKDHV

SEQ ID NO: 3193589 - protein, 31 aa, Giardia lamblia
PEEDLIYLRDYMKFQFLHFFEEVDASETIFC

SEQ ID NO: 3193590 - protein, 30 aa, Giardia lamblia
PEEFLVHMKLFARPYRSMAYRPTPNSTSYM

SEQ ID NO: 3193591 - protein, 19 aa, Giardia lamblia
PEEGVYIHGLFLDAAAWDK

SEQ ID NO: 3193592 - protein, 28 aa, Giardia lamblia
PEEKKLHILLDCLRLLPFSQAVIFARDI

SEQ ID NO: 3193593 - protein, 21 aa, Giardia lamblia
PEERKLRLVVKQYSFTQAIVR

SEQ ID NO: 3193594 - protein, 25 aa, Giardia lamblia
PEERYALLLAHDYLHSPAAAYAFMA

SEQ ID NO: 3193595 - protein, 22 aa, Giardia lamblia
PEFRVMLTDYLSTELDLLEFGP

SEQ ID NO: 3193596 - protein, 25 aa, Giardia lamblia
PEGATLYSYWIPCRKIVAANDFIDR

SEQ ID NO: 3193597 - protein, 24 aa, Giardia lamblia
PEHASLPAYPLIDPSFDDNDSSYV

SEQ ID NO: 3193598 - protein, 25 aa, Giardia lamblia
PEHSNLHFVISRVLLPLVEFVNYNS

SEQ ID NO: 3193599 - protein, 21 aa, Giardia lamblia
PEIEVLFSRPQLDKISIDRRV

SEQ ID NO: 3193600 - protein, 21 aa, Giardia lamblia
PEIHNCLLDIEDLTILCEDCQ

SEQ ID NO: 3193601 - protein, 17 aa, Giardia lamblia
PEILISTPSLVMNLIKD

SEQ ID NO: 3193602 - protein, 19 aa, Giardia lamblia
PEILLRKPYNEKVDIWSLG

SEQ ID NO: 3193603 - protein, 18 aa, Giardia lamblia
PEIPSISGLMAKVGIGAK

SEQ ID NO: 3193604 - protein, 18 aa, Giardia lamblia
PEKLLPAILSRCCAFRFL

SEQ ID NO: 3193605 - protein, 25 aa, Giardia lamblia
PEKRTVVVKLLKTGPLSIVALKYSS

SEQ ID NO: 3193606 - protein, 28 aa, Giardia lamblia
PEKVMHMYYGYAIIDLQSPKAAESLVRT

SEQ ID NO: 3193607 - protein, 18 aa, Giardia lamblia
PELESFYADLPIELNDPG

SEQ ID NO: 3193608 - protein, 23 aa, Giardia lamblia
PELIGIWGLVFSPEDPNLVAVSS

SEQ ID NO: 3193609 - protein, 22 aa, Giardia lamblia
PELIRQQFNSPLFQHMIRQQFG

SEQ ID NO: 3193610 - protein, 26 aa, Giardia lamblia
PELKEYRLYLEQLILQGAQQEASSVL

SEQ ID NO: 3193611 - protein, 20 aa, Giardia lamblia
PELLPAPAPAPKPSGYLPAQ

SEQ ID NO: 3193612 - protein, 19 aa, Giardia lamblia
PELLVRDILHQLSKRPDYL

SEQ ID NO: 3193613 - protein, 35 aa, Giardia lamblia
PELNFSYPYQAQVEPYAFLPQVSASQPGLLDALSE

SEQ ID NO: 3193614 - protein, 32 aa, Giardia lamblia
PELNKAFQDIKLLKRNITRYALAKEKQIRKLS

SEQ ID NO: 3193615 - protein, 25 aa, Giardia lamblia
PELQDRLLSILPGLLAQNAQRIASL

SEQ ID NO: 3193616 - protein, 20 aa, Giardia lamblia
PEMKMSRVTWLMVYAALGDV

SEQ ID NO: 3193617 - protein, 25 aa, Giardia lamblia
PEMNYSNFWDLRRQGIIRGNPKSVR

SEQ ID NO: 3193618 - protein, 24 aa, Giardia lamblia
PEMTKRLLICFALISRNSTYRMNC

SEQ ID NO: 3193619 - protein, 19 aa, Giardia lamblia
PENAAIDTIPGPGAYSIAT

SEQ ID NO: 3193620 - protein, 18 aa, Giardia lamblia
PENDLWLKPDRNIGVTSC

SEQ ID NO: 3193621 - protein, 21 aa, Giardia lamblia
PENILVRTLEIENRTLREQIA

SEQ ID NO: 3193622 - protein, 18 aa, Giardia lamblia
PENLFMYLRNARTARNRA

SEQ ID NO: 3193623 - protein, 23 aa, Giardia lamblia
PENLTALEIALYKGNYATAAILR

SEQ ID NO: 3193624 - protein, 29 aa, Giardia lamblia
PENPFTVAQKPIYYSPPKSELTTTTDETS

SEQ ID NO: 3193625 - protein, 26 aa, Giardia lamblia
PEPAYISAVVFNDLYKLPTATDGGKR

SEQ ID NO: 3193626 - protein, 25 aa, Giardia lamblia
PEPKMTLVDFERLLTRIENIDTVSC

SEQ ID NO: 3193627 - protein, 26 aa, Giardia lamblia
PEPSLRSLLQTDIRPSFLLSHCDPAA

SEQ ID NO: 3193628 - protein, 26 aa, Giardia lamblia
PEPVLPKRILLPFNSIPLSLTEATLY

SEQ ID NO: 3193629 - protein, 26 aa, Giardia lamblia
PEPVMSDELQRWFMAARQGEEDYIKS

SEQ ID NO: 3193630 - protein, 52 aa, Giardia lamblia
PEQDILITLVQLLAMARYLSSLKLSNPEWVRYIFLPAHIYVSAMGILTFDYA

SEQ ID NO: 3193631 - protein, 29 aa, Giardia lamblia
PEQEKSYRYTFNSKPLPPLITASPSAGDH

SEQ ID NO: 3193632 - protein, 29 aa, Giardia lamblia
PEQGKRYRQLLFQLKRKKTQLVLATQQCK

SEQ ID NO: 3193633 - protein, 17 aa, Giardia lamblia
PERLVKFTTELFDVASK

SEQ ID NO: 3193634 - protein, 19 aa, Giardia lamblia
PERYYPRVVFDDFGFKRHI

SEQ ID NO: 3193635 - protein, 29 aa, Giardia lamblia
PESPFIWTRPYVLPRLLGTYIPEKLIGLE

SEQ ID NO: 3193636 - protein, 27 aa, Giardia lamblia
PESPPPLLPVTLAQLTAYPPSADVKGT

SEQ ID NO: 3193637 - protein, 25 aa, Giardia lamblia
PESRLRTEHLWTYRADVLRGMSAVC

SEQ ID NO: 3193638 - protein, 19 aa, Giardia lamblia
PESTLRCYDFLSTNGSLFD

SEQ ID NO: 3193639 - protein, 22 aa, Giardia lamblia
PESTTCEVLLKFIPRLIQMEQG

SEQ ID NO: 3193640 - protein, 18 aa, Giardia lamblia
PESVVWRVLAHMMAALCY

SEQ ID NO: 3193641 - protein, 28 aa, Giardia lamblia
PESWNPTWGIRNIIIGLRSLFDEETPGS

SEQ ID NO: 3193642 - protein, 24 aa, Giardia lamblia
PETCEILVTLEKHIPLRDGRDALM

SEQ ID NO: 3193643 - protein, 26 aa, Giardia lamblia
PETNLKAVIFSLPELSINLLQAMKGV

SEQ ID NO: 3193644 - protein, 27 aa, Giardia lamblia
PETRGVAALALLRYLPTLQGVHFTERS

SEQ ID NO: 3193645 - protein, 24 aa, Giardia lamblia
PETRYDVDSLGRTALALAAEANAV

SEQ ID NO: 3193646 - protein, 17 aa, Giardia lamblia
PEVDLVSTLTRKTPILT

SEQ ID NO: 3193647 - protein, 25 aa, Giardia lamblia
PEVEDWLTIAMGLYLRVRNPVCAEI

SEQ ID NO: 3193648 - protein, 21 aa, Giardia lamblia
PEWDEMWAVKRIQDLAVRGKA

SEQ ID NO: 3193649 - protein, 20 aa, Giardia lamblia
PEYRYSYPPPTIFPDIGHGT

SEQ ID NO: 3193650 - protein, 26 aa, Giardia lamblia
PFAGYRWRRKGLINKVVSFTGLVSIL

SEQ ID NO: 3193651 - protein, 29 aa, Giardia lamblia
PFCDVQLPFTFTPKSLKLVKAKFLVHVQQ

SEQ ID NO: 3193652 - protein, 18 aa, Giardia lamblia
PFCFALAQKLHAHLLNKT

SEQ ID NO: 3193653 - protein, 17 aa, Giardia lamblia
PFEGPLYQHAQHAIARN

SEQ ID NO: 3193654 - protein, 17 aa, Giardia lamblia
PFEPKIATYLAPESVRA

SEQ ID NO: 3193655 - protein, 21 aa, Giardia lamblia
PFETIYALCRIDINTFSVEIL

SEQ ID NO: 3193656 - protein, 21 aa, Giardia lamblia
PFEYRQCILPQKQKPIDYVAK

SEQ ID NO: 3193657 - protein, 23 aa, Giardia lamblia
PFEYYSQYLSGCPLVNVLDIEWY

SEQ ID NO: 3193658 - protein, 27 aa, Giardia lamblia
PFGSQQEYYYFSPALPGETRACEVISN

SEQ ID NO: 3193659 - protein, 21 aa, Giardia lamblia
PFHERPFFATKIRELCDLYPI

SEQ ID NO: 3193660 - protein, 18 aa, Giardia lamblia
PFITFSELLGIIEDFVIS

SEQ ID NO: 3193661 - protein, 17 aa, Giardia lamblia
PFKEETLIISDFSNNFI

SEQ ID NO: 3193662 - protein, 28 aa, Giardia lamblia
PFLMSTNITHRQLIERLSLLEKRRKEHD

SEQ ID NO: 3193663 - protein, 20 aa, Giardia lamblia
PFMFKILVVGKAYAGKTCCI

SEQ ID NO: 3193664 - protein, 20 aa, Giardia lamblia
PFSLIMPYTSFLDESGVIVG

SEQ ID NO: 3193665 - protein, 17 aa, Giardia lamblia
PFSLSVSAFIRSLAPFQ

SEQ ID NO: 3193666 - protein, 20 aa, Giardia lamblia
PFSRLNSNIPFYMPDAENYP

SEQ ID NO: 3193667 - protein, 17 aa, Giardia lamblia
PFTPASKLSPRGPSQHQ

SEQ ID NO: 3193668 - protein, 18 aa, Giardia lamblia
PFTVRHVLQDGSSTHFLT

SEQ ID NO: 3193669 - protein, 27 aa, Giardia lamblia
PFVKKMPSLQILILDGNPITSLGFLGE

SEQ ID NO: 3193670 - protein, 17 aa, Giardia lamblia
PFYAMDLSSLAHLFTDP

SEQ ID NO: 3193671 - protein, 20 aa, Giardia lamblia
PGAIFPILLKQEPGLHVSTE

SEQ ID NO: 3193672 - protein, 17 aa, Giardia lamblia
PGALWGQGLDRCLYTVE

SEQ ID NO: 3193673 - protein, 22 aa, Giardia lamblia
PGARFYPHPLHNPKSLSDGLIL

SEQ ID NO: 3193674 - protein, 26 aa, Giardia lamblia
PGASTLNFTFNYIFHSASQEEIFDSV

SEQ ID NO: 3193675 - protein, 27 aa, Giardia lamblia
PGASTNLVFPDLPPPQFSNYSQVRENN

SEQ ID NO: 3193676 - protein, 25 aa, Giardia lamblia
PGCDSSLIYAIKANKLPFAQLCIPL

SEQ ID NO: 3193677 - protein, 21 aa, Giardia lamblia
PGCYDFCTLIGFLDLNPQIMS

SEQ ID NO: 3193678 - protein, 32 aa, Giardia lamblia
PGDFLSVCVRLTGLWLLFKRLTVVDLEDSKGL

SEQ ID NO: 3193679 - protein, 24 aa, Giardia lamblia
PGDPMAIVVAMQHLITGFASSVLP

SEQ ID NO: 3193680 - protein, 20 aa, Giardia lamblia
PGDRVVVVGIYRLRQTRPKQ

SEQ ID NO: 3193681 - protein, 25 aa, Giardia lamblia
PGDSSFLRPWLHYFSRHQVPDAPAP

SEQ ID NO: 3193682 - protein, 25 aa, Giardia lamblia
PGDYQVSMTPLWPRIHGGTIGMRPV

SEQ ID NO: 3193683 - protein, 26 aa, Giardia lamblia
PGEASLIEVLPFYANLPTTEQMRVFS

SEQ ID NO: 3193684 - protein, 27 aa, Giardia lamblia
PGEPVALFGFGYLRSGLQRPEFFSMSS

SEQ ID NO: 3193685 - protein, 26 aa, Giardia lamblia
PGETKVWQYVSLTKRINLIDAPGVVW

SEQ ID NO: 3193686 - protein, 31 aa, Giardia lamblia
PGFGGSFSGPMPFMPQSYPGMPVVGQYKPVT

SEQ ID NO: 3193687 - protein, 23 aa, Giardia lamblia
PGFTQVLVTIRLPERPRSIQIEG

SEQ ID NO: 3193688 - protein, 23 aa, Giardia lamblia
PGGDTILFLIHPDDYQAGYRIRT

SEQ ID NO: 3193689 - protein, 26 aa, Giardia lamblia
PGGFRLWILSLLELGVPPTQILADLG

SEQ ID NO: 3193690 - protein, 17 aa, Giardia lamblia
PGGWEHVLAMDNYEYYR

SEQ ID NO: 3193691 - protein, 29 aa, Giardia lamblia
PGHAVHVWCAIWMICKQYRESQVYQYMRF

SEQ ID NO: 3193692 - protein, 22 aa, Giardia lamblia
PGHCFRLYSPGLFQRMHDFPVP

SEQ ID NO: 3193693 - protein, 17 aa, Giardia lamblia
PGILPLTNVTNQSYINP

SEQ ID NO: 3193694 - protein, 19 aa, Giardia lamblia
PGIRYNFFIANFTKTSSQY

SEQ ID NO: 3193695 - protein, 23 aa, Giardia lamblia
PGKKAGFLLHLGLSPDSLMVYSD

SEQ ID NO: 3193696 - protein, 17 aa, Giardia lamblia
PGKLAILVKIFIDEEIR

SEQ ID NO: 3193697 - protein, 20 aa, Giardia lamblia
PGKMQILVQAPFRVRAIAKD

SEQ ID NO: 3193698 - protein, 18 aa, Giardia lamblia
PGKPGFQIKYDRTPRDWT

SEQ ID NO: 3193699 - protein, 18 aa, Giardia lamblia
PGLGYCIGSLRGHMGPVL

SEQ ID NO: 3193700 - protein, 19 aa, Giardia lamblia
PGLIFPSFTHCRSDLLCNG

SEQ ID NO: 3193701 - protein, 23 aa, Giardia lamblia
PGLPEGVIGLLRDFLSMSTLSFT

SEQ ID NO: 3193702 - protein, 26 aa, Giardia lamblia
PGLRSTLFAGVLYPDSLSFASHMCSS

SEQ ID NO: 3193703 - protein, 31 aa, Giardia lamblia
PGLSKLRFCLFISSPIFFVKPMDTCLVVGVP

SEQ ID NO: 3193704 - protein, 36 aa, Giardia lamblia
PGLTTLMWCILNGKSNYIKWLLPESLRSVDSQGRTA

SEQ ID NO: 3193705 - protein, 17 aa, Giardia lamblia
PGLVSLLIGVLKNDKLF

SEQ ID NO: 3193706 - protein, 17 aa, Giardia lamblia
PGLWPIFTEQLEAMARK

SEQ ID NO: 3193707 - protein, 17 aa, Giardia lamblia
PGLYHPTHLLLTASSFV

SEQ ID NO: 3193708 - protein, 26 aa, Giardia lamblia
PGPAGYHPRLLRRSAPAFTIQRKGRS

SEQ ID NO: 3193709 - protein, 17 aa, Giardia lamblia
PGPGTYDILRDLSAHKS

SEQ ID NO: 3193710 - protein, 18 aa, Giardia lamblia
PGPGYYYSSAAPVNHKQA

SEQ ID NO: 3193711 - protein, 17 aa, Giardia lamblia
PGPPRSIAPVDLQALKR

SEQ ID NO: 3193712 - protein, 27 aa, Giardia lamblia
PGRDAITEMLIPKIKAFGSAGHAGDYK

SEQ ID NO: 3193713 - protein, 28 aa, Giardia lamblia
PGRTIRVWCAIWMICKQYRESQAYQYTR

SEQ ID NO: 3193714 - protein, 24 aa, Giardia lamblia
PGSTFPPILPVEVIKIVLSCLTDP

SEQ ID NO: 3193715 - protein, 20 aa, Giardia lamblia
PGSVRSVENLLLKSPKHGNP

SEQ ID NO: 3193716 - protein, 22 aa, Giardia lamblia
PGTAHYLGGNFLTPLLAMEYDV

SEQ ID NO: 3193717 - protein, 19 aa, Giardia lamblia
PGTFPVIDLLQPRIDMIHR

SEQ ID NO: 3193718 - protein, 23 aa, Giardia lamblia
PGTLKTNILFRELQFWGIMTQDE

SEQ ID NO: 3193719 - protein, 26 aa, Giardia lamblia
PGTMIPRPTQLLKNQINLLKADLGSA

SEQ ID NO: 3193720 - protein, 20 aa, Giardia lamblia
PGTYDILRDLSAHKSFMLNE

SEQ ID NO: 3193721 - protein, 24 aa, Giardia lamblia
PGVGVGDLALLYGAPRAATVITTV

SEQ ID NO: 3193722 - protein, 24 aa, Giardia lamblia
PGVHLRVVDPTRLSILLQEALQQP

SEQ ID NO: 3193723 - protein, 17 aa, Giardia lamblia
PGVLRYHQVIEDEGFIY

SEQ ID NO: 3193724 - protein, 17 aa, Giardia lamblia
PGVTETILPGLSLSAHT

SEQ ID NO: 3193725 - protein, 19 aa, Giardia lamblia
PGYHIVFISTYQMLTNAKS

SEQ ID NO: 3193726 - protein, 27 aa, Giardia lamblia
PGYPMALFQPHFVQPLERDLIASCLFE

SEQ ID NO: 3193727 - protein, 23 aa, Giardia lamblia
PGYRPNIMYLLITRNTMSSNSMV

SEQ ID NO: 3193728 - protein, 23 aa, Giardia lamblia
PGYSPLVAYILFNEYKPLSHGEH

SEQ ID NO: 3193729 - protein, 18 aa, Giardia lamblia
PHALGTPLYELPAQFFLQ

SEQ ID NO: 3193730 - protein, 29 aa, Giardia lamblia
PHENVLIGGLFKNKYLKPKNLIRPSAFDE

SEQ ID NO: 3193731 - protein, 18 aa, Giardia lamblia
PHGRILNDLAADLQELVT

SEQ ID NO: 3193732 - protein, 18 aa, Giardia lamblia
PHHENLFLKIRCPTCQAV

SEQ ID NO: 3193733 - protein, 20 aa, Giardia lamblia
PHHPITLALKRKADKLRAAG

SEQ ID NO: 3193734 - protein, 33 aa, Giardia lamblia
PHHPPFETIFNEPLILHRYVSQMRVNWLEVSSA

SEQ ID NO: 3193735 - protein, 33 aa, Giardia lamblia
PHKAARIFGLHPRTLYHWMSQYRGGTLMESRSK

SEQ ID NO: 3193736 - protein, 30 aa, Giardia lamblia
PHLALLDEAIPYMLSFFSLNVFGAVKTGLG

SEQ ID NO: 3193737 - protein, 26 aa, Giardia lamblia
PHLEKFLVHDLQLPTSICFLVCDEIS

SEQ ID NO: 3193738 - protein, 22 aa, Giardia lamblia
PHLLEHPFAKNLLDKIRHIPPQ

SEQ ID NO: 3193739 - protein, 29 aa, Giardia lamblia
PHSNMMLDYIAYLQAYTPKLRAPPQRNHA

SEQ ID NO: 3193740 - protein, 25 aa, Giardia lamblia
PHSTRDSFWTPLMRAAAEGNAGTVR

SEQ ID NO: 3193741 - protein, 25 aa, Giardia lamblia
PHVLLNMYVKLIAQTLRWSPHTSNP

SEQ ID NO: 3193742 - protein, 21 aa, Giardia lamblia
PHVMETILHLSKSVPRDSSVD

SEQ ID NO: 3193743 - protein, 31 aa, Giardia lamblia
PHYFRDHYSRHLYWYLICGTANCTELKDNTF

SEQ ID NO: 3193744 - protein, 21 aa, Giardia lamblia
PIASCALGPVAASRLLTELAA

SEQ ID NO: 3193745 - protein, 19 aa, Giardia lamblia
PIAVQMHAGLVVAICVTIS

SEQ ID NO: 3193746 - protein, 18 aa, Giardia lamblia
PICARNLSLFSIFGIDSP

SEQ ID NO: 3193747 - protein, 30 aa, Giardia lamblia
PICPHCKYYLRPRVLMFDDAMFMELTDEEE

SEQ ID NO: 3193748 - protein, 18 aa, Giardia lamblia
PIEARLQTDLGVTALMIA

SEQ ID NO: 3193749 - protein, 28 aa, Giardia lamblia
PIEIETQLAHPFRLPRELTLQQDTLSSS

SEQ ID NO: 3193750 - protein, 20 aa, Giardia lamblia
PIFHGAPWLILISTGHNEDD

SEQ ID NO: 3193751 - protein, 17 aa, Giardia lamblia
PIGLILSLLTKNMEPSK

SEQ ID NO: 3193752 - protein, 19 aa, Giardia lamblia
PIHALVQNPIQYPPVFVLL

SEQ ID NO: 3193753 - protein, 24 aa, Giardia lamblia
PIHISGKCDVIVGVVNYLTSKAEE

SEQ ID NO: 3193754 - protein, 20 aa, Giardia lamblia
PIIELLAPLEGTLSGMTALM

SEQ ID NO: 3193755 - protein, 18 aa, Giardia lamblia
PIIFGTASGNLYLYSFQS

SEQ ID NO: 3193756 - protein, 21 aa, Giardia lamblia
PIIQTVLVPLPQTTKPQVQVA

SEQ ID NO: 3193757 - protein, 22 aa, Giardia lamblia
PIIRAFLTTQAGIQLLKEPVDQ

SEQ ID NO: 3193758 - protein, 23 aa, Giardia lamblia
PIKQRRIFGLYHLAADPEASPIN

SEQ ID NO: 3193759 - protein, 19 aa, Giardia lamblia
PILALVYPAAQAKRGMWYL

SEQ ID NO: 3193760 - protein, 25 aa, Giardia lamblia
PILLSPDTFVWLGPGDYMLVEFLST

SEQ ID NO: 3193761 - protein, 18 aa, Giardia lamblia
PILPTKIEPTTGSAMPQI

SEQ ID NO: 3193762 - protein, 20 aa, Giardia lamblia
PILQVTFFEPLTNLMLARNN

SEQ ID NO: 3193763 - protein, 24 aa, Giardia lamblia
PILSYTVIFNYFNGGKGLIYHLYV

SEQ ID NO: 3193764 - protein, 20 aa, Giardia lamblia
PIMEKYFRDFNRREQDRLHD

SEQ ID NO: 3193765 - protein, 17 aa, Giardia lamblia
PIMEVVLGALYEISQLD

SEQ ID NO: 3193766 - protein, 19 aa, Giardia lamblia
PINTWNPYKQGKTPNLSSA

SEQ ID NO: 3193767 - protein, 21 aa, Giardia lamblia
PINVKTMRLLMDALHEFCTSI

SEQ ID NO: 3193768 - protein, 17 aa, Giardia lamblia
PIPALKQPIIDILSVDE

SEQ ID NO: 3193769 - protein, 27 aa, Giardia lamblia
PIPDLITRWNAYLWSHPSAYLPKERMN

SEQ ID NO: 3193770 - protein, 31 aa, Giardia lamblia
PIPEDTVWFYLRQSLSALAYLHSPKKGGNVP

SEQ ID NO: 3193771 - protein, 18 aa, Giardia lamblia
PIPEGYLWAQVWSGYDID

SEQ ID NO: 3193772 - protein, 26 aa, Giardia lamblia
PIPSRIIIEPPLKRRGELPTTFQCSL

SEQ ID NO: 3193773 - protein, 17 aa, Giardia lamblia
PIQMSPEQEEFSMRVMA

SEQ ID NO: 3193774 - protein, 24 aa, Giardia lamblia
PIRGLLCISIIDYCKTHTGSLSRE

SEQ ID NO: 3193775 - protein, 18 aa, Giardia lamblia
PIRLNYNLKTQASLPLSW

SEQ ID NO: 3193776 - protein, 41 aa, Giardia lamblia
PISAPQNPILLDKYAHYPLMTSSLLLKRHLCNEKGGVPGKR

SEQ ID NO: 3193777 - protein, 17 aa, Giardia lamblia
PISAVPTKPVPTANPWG

SEQ ID NO: 3193778 - protein, 35 aa, Giardia lamblia
PISNVFIKHTPVAGTLPRPLVYKNVAQPRSEMQGS

SEQ ID NO: 3193779 - protein, 45 aa, Giardia lamblia
PITIPKNMKTRMLLYTIVCYLRLGKSLHFFQLHRAAHGVLDVCLV

SEQ ID NO: 3193780 - protein, 20 aa, Giardia lamblia
PITMILSVMKQVAAALAYLH

SEQ ID NO: 3193781 - protein, 19 aa, Giardia lamblia
PIVMLLARYEQRLVDTGGH

SEQ ID NO: 3193782 - protein, 22 aa, Giardia lamblia
PIVRSALSLKILPLVLAEPDDE

SEQ ID NO: 3193783 - protein, 17 aa, Giardia lamblia
PIWTSEFSRDMSFFATA

SEQ ID NO: 3193784 - protein, 20 aa, Giardia lamblia
PIYSVQNVPRKSGVKQPQII

SEQ ID NO: 3193785 - protein, 33 aa, Giardia lamblia
PKADLPLSSFKRLVRKRYRLNSLLLPCITCFSE

SEQ ID NO: 3193786 - protein, 17 aa, Giardia lamblia
PKALPTRCIEHITVETQ

SEQ ID NO: 3193787 - protein, 19 aa, Giardia lamblia
PKAMAGCISALMLELETAC

SEQ ID NO: 3193788 - protein, 21 aa, Giardia lamblia
PKDIAKFRSRLPKPGQTNTTG

SEQ ID NO: 3193789 - protein, 25 aa, Giardia lamblia
PKDLQACLVPFTKVTFQPGSPSLHF

SEQ ID NO: 3193790 - protein, 25 aa, Giardia lamblia
PKDLSVARSLLYTADLPAPPPIEEP

SEQ ID NO: 3193791 - protein, 22 aa, Giardia lamblia
PKDVFVDRWRPDLSSVTDGFIK

SEQ ID NO: 3193792 - protein, 23 aa, Giardia lamblia
PKEKKYRLLLHRDQTLKCAVNLP

SEQ ID NO: 3193793 - protein, 19 aa, Giardia lamblia
PKFLVDDIELFMGIIQDLF

SEQ ID NO: 3193794 - protein, 24 aa, Giardia lamblia
PKGLLITPDPVGPLIMKQAASMKA

SEQ ID NO: 3193795 - protein, 20 aa, Giardia lamblia
PKIHPLPCYSSISSINGPIV

SEQ ID NO: 3193796 - protein, 19 aa, Giardia lamblia
PKILGILKQKDHDKWITDL

SEQ ID NO: 3193797 - protein, 23 aa, Giardia lamblia
PKKFAINDFLRDPSAKNKERPSS

SEQ ID NO: 3193798 - protein, 17 aa, Giardia lamblia
PKKRAARHLLLEKAMEL

SEQ ID NO: 3193799 - protein, 28 aa, Giardia lamblia
PKKVAMLPVRILLIDPVLMSADHVAHEE

SEQ ID NO: 3193800 - protein, 24 aa, Giardia lamblia
PKLKPLPTDLFLQQQKQAFAAITA

SEQ ID NO: 3193801 - protein, 17 aa, Giardia lamblia
PKLLIKRLKAENKALKE

SEQ ID NO: 3193802 - protein, 20 aa, Giardia lamblia
PKLLIYQEFTDRVPVSIALS

SEQ ID NO: 3193803 - protein, 19 aa, Giardia lamblia
PKLPTLTRTPPARTNHGLT

SEQ ID NO: 3193804 - protein, 17 aa, Giardia lamblia
PKMRTDALLSTLGIRNA

SEQ ID NO: 3193805 - protein, 18 aa, Giardia lamblia
PKNLIRPSAFDERTRFRN

SEQ ID NO: 3193806 - protein, 21 aa, Giardia lamblia
PKNMFSTLNTGGRKLPGMQLT

SEQ ID NO: 3193807 - protein, 25 aa, Giardia lamblia
PKNTLLQYIAIPVHGPYLSLFGKRT

SEQ ID NO: 3193808 - protein, 25 aa, Giardia lamblia
PKPRDPIILEAYSPQLASILRNCLT

SEQ ID NO: 3193809 - protein, 28 aa, Giardia lamblia
PKQLVACSLVLRRQSILGPITMSYTGKE

SEQ ID NO: 3193810 - protein, 25 aa, Giardia lamblia
PKQPFQPTPTPAFSKSLRGTTFDSP

SEQ ID NO: 3193811 - protein, 24 aa, Giardia lamblia
PKQSGWSSLIFYSGPDSLIAELGY

SEQ ID NO: 3193812 - protein, 27 aa, Giardia lamblia
PKREALRVARKFLQEKALAKSMTDTRP

SEQ ID NO: 3193813 - protein, 18 aa, Giardia lamblia
PKREAPTTIYIKNISFST

SEQ ID NO: 3193814 - protein, 25 aa, Giardia lamblia
PKREHVLAFILTFIADWKNLTPMET

SEQ ID NO: 3193815 - protein, 34 aa, Giardia lamblia
PKRLRNLVLGNGYGRLFWPGYIDLSKEHGTSTVK

SEQ ID NO: 3193816 - protein, 22 aa, Giardia lamblia
PKRQIYLPIPTVTKQFCVLDMR

SEQ ID NO: 3193817 - protein, 18 aa, Giardia lamblia
PKSEVGCRLLLTGKIYAS

SEQ ID NO: 3193818 - protein, 27 aa, Giardia lamblia
PKSRDNLLPRPYFSIYLQDDGSNIALT

SEQ ID NO: 3193819 - protein, 26 aa, Giardia lamblia
PKTDSFMISVFYYRLKLTCQTVAEEE

SEQ ID NO: 3193820 - protein, 25 aa, Giardia lamblia
PKTLQVHLTFWKPVIETILEEVVRA

SEQ ID NO: 3193821 - protein, 23 aa, Giardia lamblia
PKTQKDLLELSRKYRHMEGDRKM

SEQ ID NO: 3193822 - protein, 28 aa, Giardia lamblia
PKTSDLLLDIVFKPFDYFPDSTDRTYFR

SEQ ID NO: 3193823 - protein, 20 aa, Giardia lamblia
PKVHLFVQDFFQCNLIQGYG

SEQ ID NO: 3193824 - protein, 31 aa, Giardia lamblia
PKVLNLLGLQYDVTYPLNLVLTTPVMERLNL

SEQ ID NO: 3193825 - protein, 23 aa, Giardia lamblia
PKVYLVVRIRGIVGVAPKVRTIL

SEQ ID NO: 3193826 - protein, 36 aa, Giardia lamblia
PKYSSKLLDMRYTQAQLLRAGRYKDATKKRGEADAQ

SEQ ID NO: 3193827 - protein, 21 aa, Giardia lamblia
PLAHSYATVRVLWRDHRGTVS

SEQ ID NO: 3193828 - protein, 33 aa, Giardia lamblia
PLAIDKQLDMLYWIRKALLKTFGIKIKDSDSEQ

SEQ ID NO: 3193829 - protein, 18 aa, Giardia lamblia
PLAMNFDIPMYTASGIEV

SEQ ID NO: 3193830 - protein, 29 aa, Giardia lamblia
PLCTNPPLHPALISYIPIATPTSYEAPHL

SEQ ID NO: 3193831 - protein, 23 aa, Giardia lamblia
PLCTVYLDFSPLGNGASGNYCAV

SEQ ID NO: 3193832 - protein, 23 aa, Giardia lamblia
PLDATQPLFLLKRAGRSMGPIQT

SEQ ID NO: 3193833 - protein, 27 aa, Giardia lamblia
PLDEWECLHRPLFSNNKLPTPASGEVP

SEQ ID NO: 3193834 - protein, 19 aa, Giardia lamblia
PLDHKIILDRYRYGIIRCE

SEQ ID NO: 3193835 - protein, 17 aa, Giardia lamblia
PLDILRAICTNCVNLMQ

SEQ ID NO: 3193836 - protein, 22 aa, Giardia lamblia
PLDQIIEIIKILGPPSLKELKE

SEQ ID NO: 3193837 - protein, 24 aa, Giardia lamblia
PLDTRLAYDLIGPTLGFFTINTKR

SEQ ID NO: 3193838 - protein, 17 aa, Giardia lamblia
PLDYLYPGETSHNAASV

SEQ ID NO: 3193839 - protein, 31 aa, Giardia lamblia
PLEAGLVDHYGWFALLYAIDGACIKAIPPLY

SEQ ID NO: 3193840 - protein, 26 aa, Giardia lamblia
PLEARKIWTQYFAANRIEHVYFSALR

SEQ ID NO: 3193841 - protein, 27 aa, Giardia lamblia
PLEDELSYNVPLISPTYKLLPNITQSE

SEQ ID NO: 3193842 - protein, 17 aa, Giardia lamblia
PLEFYNLEFTKDTVSLL

SEQ ID NO: 3193843 - protein, 17 aa, Giardia lamblia
PLELARALGLTKVVDEI

SEQ ID NO: 3193844 - protein, 27 aa, Giardia lamblia
PLELEICSQLAFYYAQDASITDLLTEL

SEQ ID NO: 3193845 - protein, 18 aa, Giardia lamblia
PLELRLKVVQLREQQSLP

SEQ ID NO: 3193846 - protein, 20 aa, Giardia lamblia
PLEMVLFAYDGLEKVSVSIG

SEQ ID NO: 3193847 - protein, 19 aa, Giardia lamblia
PLERSLLWVANFGEIKAAF

SEQ ID NO: 3193848 - protein, 18 aa, Giardia lamblia
PLEVWAKIRALSSASLDK

SEQ ID NO: 3193849 - protein, 21 aa, Giardia lamblia
PLHIAASLLNFNYMEEYLTFA

SEQ ID NO: 3193850 - protein, 20 aa, Giardia lamblia
PLHIGMLQGPPRLLQGYDYD

SEQ ID NO: 3193851 - protein, 28 aa, Giardia lamblia
PLHNIDSPFPRLRILNNLIITVDDYDRA

SEQ ID NO: 3193852 - protein, 24 aa, Giardia lamblia
PLHVRYIFGLLTNQLSVLVSTYEF

SEQ ID NO: 3193853 - protein, 30 aa, Giardia lamblia
PLIAKVLINYYVLYLSQCAIELIKESTGVE

SEQ ID NO: 3193854 - protein, 19 aa, Giardia lamblia
PLIEVNVHPRLIIRVLSEA

SEQ ID NO: 3193855 - protein, 26 aa, Giardia lamblia
PLINTLERLFGFSKDAIFSRFYFFED

SEQ ID NO: 3193856 - protein, 44 aa, Giardia lamblia
PLIPFCIDTSKTFPTYFLAGASLHTSWFINRLKALAYVSCGTLV

SEQ ID NO: 3193857 - protein, 19 aa, Giardia lamblia
PLKLMEKLMILVNTIELCR

SEQ ID NO: 3193858 - protein, 19 aa, Giardia lamblia
PLKQLFIVRGRPKIRVHGR

SEQ ID NO: 3193859 - protein, 21 aa, Giardia lamblia
PLKRSLPLKSINWPAKKLSNE

SEQ ID NO: 3193860 - protein, 18 aa, Giardia lamblia
PLLAYLEEIVFPYSKLVT

SEQ ID NO: 3193861 - protein, 25 aa, Giardia lamblia
PLLDSHAMLKLLERAFTPLTDFGSQ

SEQ ID NO: 3193862 - protein, 20 aa, Giardia lamblia
PLLELITKWSRMIRQSRPAS

SEQ ID NO: 3193863 - protein, 18 aa, Giardia lamblia
PLLIDELVERYAGMQDAR

SEQ ID NO: 3193864 - protein, 21 aa, Giardia lamblia
PLLSDLFEMRQVVDMLYMMNK

SEQ ID NO: 3193865 - protein, 26 aa, Giardia lamblia
PLLTNGFYGDMRWLVGPHTYIDLSAP

SEQ ID NO: 3193866 - protein, 17 aa, Giardia lamblia
PLMCAIEQRKYDIARLL

SEQ ID NO: 3193867 - protein, 19 aa, Giardia lamblia
PLMFSSIQPLSTPSEKECC

SEQ ID NO: 3193868 - protein, 18 aa, Giardia lamblia
PLMHAVMNKKMSLVKAYM

SEQ ID NO: 3193869 - protein, 17 aa, Giardia lamblia
PLMKAIIAGNNSAVSQT

SEQ ID NO: 3193870 - protein, 17 aa, Giardia lamblia
PLMLMSDLAITSLGGIS

SEQ ID NO: 3193871 - protein, 19 aa, Giardia lamblia
PLMYIYLAIERDVAIFNLR

SEQ ID NO: 3193872 - protein, 24 aa, Giardia lamblia
PLNAVLDRNLLFKLLEKLRDNNSS

SEQ ID NO: 3193873 - protein, 17 aa, Giardia lamblia
PLNAYSAGSFSQAGCHG

SEQ ID NO: 3193874 - protein, 21 aa, Giardia lamblia
PLNDMWILNLNTQQHLYTPVC

SEQ ID NO: 3193875 - protein, 24 aa, Giardia lamblia
PLNFNQTKLLTVQALLLAADTHQM

SEQ ID NO: 3193876 - protein, 29 aa, Giardia lamblia
PLNHMAIEALLILVYLQYIDKDVNFSIHS

SEQ ID NO: 3193877 - protein, 22 aa, Giardia lamblia
PLNSVEALRFSPSGRFLAVAGC

SEQ ID NO: 3193878 - protein, 22 aa, Giardia lamblia
PLPFSIEKYKLGQLYMVARSTL

SEQ ID NO: 3193879 - protein, 20 aa, Giardia lamblia
PLPLGTIVNRHLLDGDYVLF

SEQ ID NO: 3193880 - protein, 20 aa, Giardia lamblia
PLQENYPLHLLDKRPEHSID

SEQ ID NO: 3193881 - protein, 20 aa, Giardia lamblia
PLQISFGRYNDWKTPGNLVQ

SEQ ID NO: 3193882 - protein, 19 aa, Giardia lamblia
PLQLRRYIELFLNSLAVEP

SEQ ID NO: 3193883 - protein, 17 aa, Giardia lamblia
PLQMKKPVKHASRSLNN

SEQ ID NO: 3193884 - protein, 21 aa, Giardia lamblia
PLQMPLSFLFETDSLAHASPA

SEQ ID NO: 3193885 - protein, 24 aa, Giardia lamblia
PLQNLVCLFLQENLISKVENLDKN

SEQ ID NO: 3193886 - protein, 23 aa, Giardia lamblia
PLQRVDGGFAFFAPGGVGPVPAE

SEQ ID NO: 3193887 - protein, 20 aa, Giardia lamblia
PLQSRLPVGVIPPKAYSMKL

SEQ ID NO: 3193888 - protein, 20 aa, Giardia lamblia
PLQTIRVWARKYLTSFKKLQ

SEQ ID NO: 3193889 - protein, 17 aa, Giardia lamblia
PLRMVLTQSISSPEDAV

SEQ ID NO: 3193890 - protein, 19 aa, Giardia lamblia
PLRNEGVYYNPFSDTLGPS

SEQ ID NO: 3193891 - protein, 18 aa, Giardia lamblia
PLRNPDIFKRVGIKPPKS

SEQ ID NO: 3193892 - protein, 21 aa, Giardia lamblia
PLRQAPTLSFDPLTNIEWKLI

SEQ ID NO: 3193893 - protein, 21 aa, Giardia lamblia
PLSLGTTIIVMKYSNGVLLSA

SEQ ID NO: 3193894 - protein, 25 aa, Giardia lamblia
PLSNNGLGPKGAIGPISMPKHLPAP

SEQ ID NO: 3193895 - protein, 26 aa, Giardia lamblia
PLSPYEQIFVLPLETIKMDKGTGIVT

SEQ ID NO: 3193896 - protein, 37 aa, Giardia lamblia
PLSQSLYLRDWAIPRLLIFHEFQDHLVLSTALMQDYI

SEQ ID NO: 3193897 - protein, 21 aa, Giardia lamblia
PLSRSAPKALPTRCIEHITVE

SEQ ID NO: 3193898 - protein, 30 aa, Giardia lamblia
PLSSDLHLDLFLLIAGLLHPNPKARMSISE

SEQ ID NO: 3193899 - protein, 26 aa, Giardia lamblia
PLSVDPYLIDFGISIDLSLLNTKIIT

SEQ ID NO: 3193900 - protein, 19 aa, Giardia lamblia
PLSVFPPVHAAKIRRLVYD

SEQ ID NO: 3193901 - protein, 20 aa, Giardia lamblia
PLTDNLLSMSSSLLQALGLK

SEQ ID NO: 3193902 - protein, 24 aa, Giardia lamblia
PLTDRCYVTLTSALQLRKGGAPQG

SEQ ID NO: 3193903 - protein, 19 aa, Giardia lamblia
PLTEYLRCFSRYTELILLD

SEQ ID NO: 3193904 - protein, 35 aa, Giardia lamblia
PLTHEHPFILYVGFRRLYTVPLPSQPLTPTRSKLQ

SEQ ID NO: 3193905 - protein, 20 aa, Giardia lamblia
PLTPMYLSQQPFLKPEELHP

SEQ ID NO: 3193906 - protein, 29 aa, Giardia lamblia
PLTTHPPTLLYHTLLQRGVPPLSDNWSPR

SEQ ID NO: 3193907 - protein, 19 aa, Giardia lamblia
PLVQKALQKQFLNWTYDAK

SEQ ID NO: 3193908 - protein, 23 aa, Giardia lamblia
PLVTFKSMPAPTHVTLSPGLGRL

SEQ ID NO: 3193909 - protein, 18 aa, Giardia lamblia
PLYAAFGDTLRGLFGPSS

SEQ ID NO: 3193910 - protein, 17 aa, Giardia lamblia
PLYMEAPDRILSTPVFA

SEQ ID NO: 3193911 - protein, 17 aa, Giardia lamblia
PLYPPKLDVERLPIYIN

SEQ ID NO: 3193912 - protein, 17 aa, Giardia lamblia
PMAAPIREQVETPRRDE

SEQ ID NO: 3193913 - protein, 17 aa, Giardia lamblia
PMALEIPEYICPLHICD

SEQ ID NO: 3193914 - protein, 27 aa, Giardia lamblia
PMASFQRMMDHMNDFFGSTRSIFGNMD

SEQ ID NO: 3193915 - protein, 20 aa, Giardia lamblia
PMCENYKWIKDSLGFHNITM

SEQ ID NO: 3193916 - protein, 19 aa, Giardia lamblia
PMDKNVNLGLVPLSSLCVM

SEQ ID NO: 3193917 - protein, 19 aa, Giardia lamblia
PMDSSITTPAMLHFVRSPT

SEQ ID NO: 3193918 - protein, 19 aa, Giardia lamblia
PMEFNTSLLSSAPGLTSHG

SEQ ID NO: 3193919 - protein, 25 aa, Giardia lamblia
PMEKKPLYHYYPGEAILSIGTIGCN

SEQ ID NO: 3193920 - protein, 33 aa, Giardia lamblia
PMELLAEAYRLVTHGQIFNVKRAPNASIAVDKS

SEQ ID NO: 3193921 - protein, 17 aa, Giardia lamblia
PMEVLRCIGNLLSICFP

SEQ ID NO: 3193922 - protein, 18 aa, Giardia lamblia
PMFIRNRPSPLPLNTPEP

SEQ ID NO: 3193923 - protein, 17 aa, Giardia lamblia
PMIPFNLYDSSKSYAEM

SEQ ID NO: 3193924 - protein, 19 aa, Giardia lamblia
PMKSGIVVDRCEDAWCPTC

SEQ ID NO: 3193925 - protein, 20 aa, Giardia lamblia
PMLRRGLFYAHRDFEEFLSY

SEQ ID NO: 3193926 - protein, 21 aa, Giardia lamblia
PMLTEFAPILPEEGPVSGYGK

SEQ ID NO: 3193927 - protein, 19 aa, Giardia lamblia
PMLTVYIAKVSLHFSEAQG

SEQ ID NO: 3193928 - protein, 20 aa, Giardia lamblia
PMLVEPGPVNQLLLSKTTAS

SEQ ID NO: 3193929 - protein, 21 aa, Giardia lamblia
PMNHQLIPMLEKYLRCLAKAR

SEQ ID NO: 3193930 - protein, 17 aa, Giardia lamblia
PMNLSISVKDMAVGASM

SEQ ID NO: 3193931 - protein, 26 aa, Giardia lamblia
PMRAIHKPRPLPQHIEKFLSDEIKQT

SEQ ID NO: 3193932 - protein, 22 aa, Giardia lamblia
PMRNCISCPAVWNRDRSRHLSP

SEQ ID NO: 3193933 - protein, 19 aa, Giardia lamblia
PMSAYSPGSFSGERPPPVV

SEQ ID NO: 3193934 - protein, 18 aa, Giardia lamblia
PMSGHVPYPLPQGNDIYG

SEQ ID NO: 3193935 - protein, 20 aa, Giardia lamblia
PMTIKPLPDLGGRVLNICGY

SEQ ID NO: 3193936 - protein, 18 aa, Giardia lamblia
PMYFAPEVLLKKKYSPAS

SEQ ID NO: 3193937 - protein, 22 aa, Giardia lamblia
PNAFLDCHFMTNDPGFWISSTA

SEQ ID NO: 3193938 - protein, 20 aa, Giardia lamblia
PNCRYRIFTIGLPVENIGHN

SEQ ID NO: 3193939 - protein, 21 aa, Giardia lamblia
PNDDIILNDGYIRLVATSVDR

SEQ ID NO: 3193940 - protein, 33 aa, Giardia lamblia
PNDPPPWLARQSLLLKPSWLQDISIAALNVSAP

SEQ ID NO: 3193941 - protein, 25 aa, Giardia lamblia
PNEAVRFYSPFVLRYEIGLKQMQQK

SEQ ID NO: 3193942 - protein, 21 aa, Giardia lamblia
PNELDLFRWICGVPGKKGTIW

SEQ ID NO: 3193943 - protein, 24 aa, Giardia lamblia
PNELESHYLLLKIAGSKSQTHSTC

SEQ ID NO: 3193944 - protein, 25 aa, Giardia lamblia
PNERLSLLKYLLCFHFEDMAKALMR

SEQ ID NO: 3193945 - protein, 25 aa, Giardia lamblia
PNFESDFWLHVIFEFDDHAKSNYIT

SEQ ID NO: 3193946 - protein, 23 aa, Giardia lamblia
PNFPLQMYIAGLQNVNIPLTLSA

SEQ ID NO: 3193947 - protein, 24 aa, Giardia lamblia
PNFVAELLHYCRAAFAVYGSYESR

SEQ ID NO: 3193948 - protein, 28 aa, Giardia lamblia
PNGDKKAHTFIYDYAYWSLDGRYEKATQ

SEQ ID NO: 3193949 - protein, 26 aa, Giardia lamblia
PNIAYICSRYYRAPELIFGSRYYTTV

SEQ ID NO: 3193950 - protein, 26 aa, Giardia lamblia
PNINNERPFIVYNIKQGGVGISSRMS

SEQ ID NO: 3193951 - protein, 24 aa, Giardia lamblia
PNKNIIWLPDTWTKARERLKERLS

SEQ ID NO: 3193952 - protein, 30 aa, Giardia lamblia
PNKNIQVDVILLLYLLSFGGAVDEVKSDND

SEQ ID NO: 3193953 - protein, 36 aa, Giardia lamblia
PNKRYKHWSFVDNLQLLIQFIILESLDFSKAQELFQ

SEQ ID NO: 3193954 - protein, 23 aa, Giardia lamblia
PNLACLLLKLRDTGLENIDSLFL

SEQ ID NO: 3193955 - protein, 30 aa, Giardia lamblia
PNLENQYQKIFLFKAIFDEIIDKACMEPNF

SEQ ID NO: 3193956 - protein, 23 aa, Giardia lamblia
PNLIRYEGIYKSNNAIYMTMARY

SEQ ID NO: 3193957 - protein, 30 aa, Giardia lamblia
PNLNDHDILLLFKRYFSMGTLPNVLSDSRA

SEQ ID NO: 3193958 - protein, 25 aa, Giardia lamblia
PNLPECKRAFRVSDYLYLQVTRYHG

SEQ ID NO: 3193959 - protein, 24 aa, Giardia lamblia
PNLPLAHYYSIVSTLLRCSVSRKV

SEQ ID NO: 3193960 - protein, 23 aa, Giardia lamblia
PNLSPICLKSYIDSAPPIHPKLL

SEQ ID NO: 3193961 - protein, 34 aa, Giardia lamblia
PNLTSVQSPLLRELLRYILVLDPEARLSAKELVS

SEQ ID NO: 3193962 - protein, 29 aa, Giardia lamblia
PNMVTLIEFPTLFGVIRDRIRKHFLLSEN

SEQ ID NO: 3193963 - protein, 35 aa, Giardia lamblia
PNNARLNVFFKFCVEELLVHLPANAVKNIIFCFTN

SEQ ID NO: 3193964 - protein, 19 aa, Giardia lamblia
PNNIKLIMGILKKMTSSCA

SEQ ID NO: 3193965 - protein, 18 aa, Giardia lamblia
PNPVLFNRLMRPCVQFIR

SEQ ID NO: 3193966 - protein, 23 aa, Giardia lamblia
PNQSWIELARYYKASHLTGKELI

SEQ ID NO: 3193967 - protein, 20 aa, Giardia lamblia
PNQVSFVYVLSLMDKPVEIV

SEQ ID NO: 3193968 - protein, 23 aa, Giardia lamblia
PNRLTKTLCNSPWHISSNLASLA

SEQ ID NO: 3193969 - protein, 24 aa, Giardia lamblia
PNSKFTEDFIWNAFGRVVSAVCMM

SEQ ID NO: 3193970 - protein, 24 aa, Giardia lamblia
PNSSKIALLLDYLKNYQACVAGPR

SEQ ID NO: 3193971 - protein, 24 aa, Giardia lamblia
PNTCLLRFMDPPVIPPDNADEFPS

SEQ ID NO: 3193972 - protein, 26 aa, Giardia lamblia
PNTGFVFRLVSWWRRRHSDLTTARIA

SEQ ID NO: 3193973 - protein, 19 aa, Giardia lamblia
PNTIPFDRLRTAFVPGYKE

SEQ ID NO: 3193974 - protein, 25 aa, Giardia lamblia
PNTLIVPYGSFISKIYLPSSDLDIC

SEQ ID NO: 3193975 - protein, 20 aa, Giardia lamblia
PNTLLTYKVPIPCTIMEFFL

SEQ ID NO: 3193976 - protein, 20 aa, Giardia lamblia
PNTMYWAGWMAKVARGEVST

SEQ ID NO: 3193977 - protein, 21 aa, Giardia lamblia
PNVITAELPPIVVKGSLEEAN

SEQ ID NO: 3193978 - protein, 28 aa, Giardia lamblia
PNVYQLPFNMSFIPTWTKKLVVVTEPGV

SEQ ID NO: 3193979 - protein, 18 aa, Giardia lamblia
PNWKELRLLHAHLSFNNY

SEQ ID NO: 3193980 - protein, 23 aa, Giardia lamblia
PNYGYDMNYGFNQAGFKPTSNSP

SEQ ID NO: 3193981 - protein, 25 aa, Giardia lamblia
PPASLYEEPLRLDYHRHPVQVPIVY

SEQ ID NO: 3193982 - protein, 23 aa, Giardia lamblia
PPATPLKLIIMSATLHQKELLEN

SEQ ID NO: 3193983 - protein, 17 aa, Giardia lamblia
PPAVPKLTICTTAPGVN

SEQ ID NO: 3193984 - protein, 22 aa, Giardia lamblia
PPCLQRIALFSEKREEDIYLAE

SEQ ID NO: 3193985 - protein, 18 aa, Giardia lamblia
PPCVLGCATPPLVPPVGG

SEQ ID NO: 3193986 - protein, 17 aa, Giardia lamblia
PPDLRLASLEPPIYADD

SEQ ID NO: 3193987 - protein, 37 aa, Giardia lamblia
PPDTPLIPELLPVGEMYFLNIIRIPPQLTEANNWLVL

SEQ ID NO: 3193988 - protein, 32 aa, Giardia lamblia
PPEAKLTRHPILKDFLLISAPDMKIPFHNLWV

SEQ ID NO: 3193989 - protein, 19 aa, Giardia lamblia
PPECILWRIIAQTLSVYHY

SEQ ID NO: 3193990 - protein, 26 aa, Giardia lamblia
PPEELHSRPALYRLAPYNDMMPDMIV

SEQ ID NO: 3193991 - protein, 19 aa, Giardia lamblia
PPEFPGLLMDLCREVLREQ

SEQ ID NO: 3193992 - protein, 17 aa, Giardia lamblia
PPEMPAPIAGAGINGLG

SEQ ID NO: 3193993 - protein, 25 aa, Giardia lamblia
PPEYRRVLHTILLEDIGRGCQFSFY

SEQ ID NO: 3193994 - protein, 21 aa, Giardia lamblia
PPFLVIGTPMTQTVFSCHCPS

SEQ ID NO: 3193995 - protein, 20 aa, Giardia lamblia
PPGFLAGFNPMASFQRMMDH

SEQ ID NO: 3193996 - protein, 23 aa, Giardia lamblia
PPGRIFDELLANVKALIACASGL

SEQ ID NO: 3193997 - protein, 20 aa, Giardia lamblia
PPHILKTQWISRSAPVLPKL

SEQ ID NO: 3193998 - protein, 19 aa, Giardia lamblia
PPIIAAPPPISDIMAPCPI

SEQ ID NO: 3193999 - protein, 29 aa, Giardia lamblia
PPIPEGANPKDFPCIFFLHNCCDKGDKCK

SEQ ID NO: 3194000 - protein, 33 aa, Giardia lamblia
PPIRDLVIYRSSVTHLIIKQLPSLVRVELADNP

SEQ ID NO: 3194001 - protein, 17 aa, Giardia lamblia
PPKSILLYGAPGTGKSL

SEQ ID NO: 3194002 - protein, 22 aa, Giardia lamblia
PPKWNGLKFVGPSSIFLTPDEC

SEQ ID NO: 3194003 - protein, 23 aa, Giardia lamblia
PPKWQPCLIEFRRSRVQCSTFQF

SEQ ID NO: 3194004 - protein, 21 aa, Giardia lamblia
PPMQVSMWPMTPRATVFLNIM

SEQ ID NO: 3194005 - protein, 25 aa, Giardia lamblia
PPNCIAWITKPSVPLAKALMGHPKT

SEQ ID NO: 3194006 - protein, 25 aa, Giardia lamblia
PPNNPYVTLLPLAVSLAKKPLISTA

SEQ ID NO: 3194007 - protein, 17 aa, Giardia lamblia
PPPFYAMDLSSLAHLFT

SEQ ID NO: 3194008 - protein, 21 aa, Giardia lamblia
PPPKRMYFTKVENWAPGPDAL

SEQ ID NO: 3194009 - protein, 17 aa, Giardia lamblia
PPQLNLSLNPYYQSYAP

SEQ ID NO: 3194010 - protein, 21 aa, Giardia lamblia
PPRMAPLQYTNASLPTEAMAR

SEQ ID NO: 3194011 - protein, 19 aa, Giardia lamblia
PPRNINDLLLSKYQEKHKS

SEQ ID NO: 3194012 - protein, 25 aa, Giardia lamblia
PPSCDLLSHNLQLLDKTLVSHKVVA

SEQ ID NO: 3194013 - protein, 18 aa, Giardia lamblia
PPTAIQATLDRFLNRKKD

SEQ ID NO: 3194014 - protein, 24 aa, Giardia lamblia
PPTAPLYSSFTRFSKIRKYCLSNK

SEQ ID NO: 3194015 - protein, 24 aa, Giardia lamblia
PPTIVPRPEIWTRQAKLFYQEIMR

SEQ ID NO: 3194016 - protein, 27 aa, Giardia lamblia
PPTNGICYILPTEFLRASAIACQIVIT

SEQ ID NO: 3194017 - protein, 23 aa, Giardia lamblia
PPTSLTAGPLNIGLSSPGYGTNP

SEQ ID NO: 3194018 - protein, 24 aa, Giardia lamblia
PPTYNSFMKVKFEALLLIVNDPSM

SEQ ID NO: 3194019 - protein, 27 aa, Giardia lamblia
PPTYQHIHERFLPPSYTYVSHNPTTSS

SEQ ID NO: 3194020 - protein, 20 aa, Giardia lamblia
PPVALPLQPINSASTFATPQ

SEQ ID NO: 3194021 - protein, 18 aa, Giardia lamblia
PPVLVFASTSDRVFTIYK

SEQ ID NO: 3194022 - protein, 19 aa, Giardia lamblia
PPVQLQWISTASKFGHGIF

SEQ ID NO: 3194023 - protein, 22 aa, Giardia lamblia
PPVTLERGLWAPSRARLLPAHG

SEQ ID NO: 3194024 - protein, 18 aa, Giardia lamblia
PPVYNAINIMVFPATGMP

SEQ ID NO: 3194025 - protein, 33 aa, Giardia lamblia
PQASSNYFMRFMRSIRVPFIAKKSMPLVDPYNG

SEQ ID NO: 3194026 - protein, 38 aa, Giardia lamblia
PQDARKAFNMLAFKRVGKLKVPMFLEFAMMQNTVDQIK

SEQ ID NO: 3194027 - protein, 20 aa, Giardia lamblia
PQDDAWSLGIILYECITNQK

SEQ ID NO: 3194028 - protein, 23 aa, Giardia lamblia
PQDLFSQLISARKLLLTIDMVSG

SEQ ID NO: 3194029 - protein, 25 aa, Giardia lamblia
PQDYTDILRCTIYYMLNVNPTNRPL

SEQ ID NO: 3194030 - protein, 21 aa, Giardia lamblia
PQECRERWAHVLQYKRTVSVV

SEQ ID NO: 3194031 - protein, 17 aa, Giardia lamblia
PQEFQIKLMHLIRKGMS

SEQ ID NO: 3194032 - protein, 30 aa, Giardia lamblia
PQESGSLTVLPYAPHVRPIQKHVTLNRLND

SEQ ID NO: 3194033 - protein, 20 aa, Giardia lamblia
PQESLLPQYVESDIFAEGGE

SEQ ID NO: 3194034 - protein, 22 aa, Giardia lamblia
PQFADLVAKNEALLKSLQDVKE

SEQ ID NO: 3194035 - protein, 26 aa, Giardia lamblia
PQFTRDLSWTPLMHAAADGDFEAAEK

SEQ ID NO: 3194036 - protein, 17 aa, Giardia lamblia
PQGLDPPIYEGQHIQTQ

SEQ ID NO: 3194037 - protein, 40 aa, Giardia lamblia
PQGQEKMMLQLPQAGSFQGLMLTPRMNSIANASECTARHA

SEQ ID NO: 3194038 - protein, 24 aa, Giardia lamblia
PQGVILLSTFHRTKWAAPLDNTPI

SEQ ID NO: 3194039 - protein, 17 aa, Giardia lamblia
PQHRFTFDRVFGPSTTQ

SEQ ID NO: 3194040 - protein, 22 aa, Giardia lamblia
PQHVALLTKPVPDVSLLAGPDN

SEQ ID NO: 3194041 - protein, 18 aa, Giardia lamblia
PQKIIPEATIWNIMGQLL

SEQ ID NO: 3194042 - protein, 30 aa, Giardia lamblia
PQKYVPVDLVYVMGPYPLLRKISELTRDYG

SEQ ID NO: 3194043 - protein, 25 aa, Giardia lamblia
PQLCGKWMYFWNDRAFVARICELAV

SEQ ID NO: 3194044 - protein, 19 aa, Giardia lamblia
PQLDERFYSLIRVPTKHTK

SEQ ID NO: 3194045 - protein, 31 aa, Giardia lamblia
PQLKTTSPPPPPPPAVVSPSKPPAPATPTTA

SEQ ID NO: 3194046 - protein, 26 aa, Giardia lamblia
PQNIRNARIYALDLGALIAGAQYRGQ

SEQ ID NO: 3194047 - protein, 33 aa, Giardia lamblia
PQNNKSISLLMRTPIMSFPAMLQPLRDCVMEDA

SEQ ID NO: 3194048 - protein, 28 aa, Giardia lamblia
PQNTITTRILIAWIAYRRTPRNSPTEDI

SEQ ID NO: 3194049 - protein, 20 aa, Giardia lamblia
PQQDTRLFLPIYIDRDPSVN

SEQ ID NO: 3194050 - protein, 28 aa, Giardia lamblia
PQQESLSLPLIFIGTPRPTTGATPVSCI

SEQ ID NO: 3194051 - protein, 22 aa, Giardia lamblia
PQQHHFPLIDPGARQLPMALEI

SEQ ID NO: 3194052 - protein, 17 aa, Giardia lamblia
PQRCCIALLASDLFLKP

SEQ ID NO: 3194053 - protein, 17 aa, Giardia lamblia
PQRCILELSYYLPGVYA

SEQ ID NO: 3194054 - protein, 17 aa, Giardia lamblia
PQRDAFGSQPPLEFMRQ

SEQ ID NO: 3194055 - protein, 28 aa, Giardia lamblia
PQRRREQVLALIFWKRLGARVVGDCREG

SEQ ID NO: 3194056 - protein, 25 aa, Giardia lamblia
PQRRRTFLFSATFPSAVQALQNECT

SEQ ID NO: 3194057 - protein, 25 aa, Giardia lamblia
PQSRPNFADLYIFLSSLVELQQNPQ

SEQ ID NO: 3194058 - protein, 17 aa, Giardia lamblia
PQSSGPSFSLSGRSPVR

SEQ ID NO: 3194059 - protein, 29 aa, Giardia lamblia
PQTCKYIQTILEQVMRRFVAMPGVLSGLY

SEQ ID NO: 3194060 - protein, 25 aa, Giardia lamblia
PQTDVKNRIRCFLDRARALPECAPN

SEQ ID NO: 3194061 - protein, 20 aa, Giardia lamblia
PQTLHLENTFLRAKLREVSE

SEQ ID NO: 3194062 - protein, 21 aa, Giardia lamblia
PQTRRFFSSLLKLSQEKENKL

SEQ ID NO: 3194063 - protein, 23 aa, Giardia lamblia
PQTSAQYNLPLKDLKPLGVIPMD

SEQ ID NO: 3194064 - protein, 25 aa, Giardia lamblia
PQVAACALKRLISELLEHPRAMSPT

SEQ ID NO: 3194065 - protein, 17 aa, Giardia lamblia
PQVFFTYTAGCLYETAV

SEQ ID NO: 3194066 - protein, 23 aa, Giardia lamblia
PQVGTILILTAIELGIDIPITVN

SEQ ID NO: 3194067 - protein, 20 aa, Giardia lamblia
PQVICLPTIHRYNSPQLLSS

SEQ ID NO: 3194068 - protein, 18 aa, Giardia lamblia
PQVQALKANLRKALARNT

SEQ ID NO: 3194069 - protein, 23 aa, Giardia lamblia
PQVTLPEKNLTNKPLISIPDETY

SEQ ID NO: 3194070 - protein, 19 aa, Giardia lamblia
PQYHKTVYCLLLRKQRPDQ

SEQ ID NO: 3194071 - protein, 24 aa, Giardia lamblia
PQYQQYLEFQNQLAERRARIAAAQ

SEQ ID NO: 3194072 - protein, 21 aa, Giardia lamblia
PQYRSYVIKALPQLKRLDDVD

SEQ ID NO: 3194073 - protein, 24 aa, Giardia lamblia
PQYSRNLLIPVRVSPDMWQSDANS

SEQ ID NO: 3194074 - protein, 23 aa, Giardia lamblia
PRARMEAVTFDFVDVPVVERLPT

SEQ ID NO: 3194075 - protein, 32 aa, Giardia lamblia
PRATAKMISSFLYKHRFGPYFISPIIAGFEAD

SEQ ID NO: 3194076 - protein, 27 aa, Giardia lamblia
PRATLAEKSLLRPGARVGPPLPMNFGK

SEQ ID NO: 3194077 - protein, 26 aa, Giardia lamblia
PRCFDLKIFVDLPPIINHLKTNLSLG

SEQ ID NO: 3194078 - protein, 18 aa, Giardia lamblia
PRDNDLFGKVISPGICPP

SEQ ID NO: 3194079 - protein, 22 aa, Giardia lamblia
PRDVYRLVRSQLSLIDVGLRDN

SEQ ID NO: 3194080 - protein, 28 aa, Giardia lamblia
PREDYDGVPLALPLPRGSDNYNKLKPDI

SEQ ID NO: 3194081 - protein, 20 aa, Giardia lamblia
PREIQAYMRSILTALSHLEK

SEQ ID NO: 3194082 - protein, 19 aa, Giardia lamblia
PREIVYLPCRHFIVCEQCF

SEQ ID NO: 3194083 - protein, 24 aa, Giardia lamblia
PREKACVMHFLLMIADRHEAQQQF

SEQ ID NO: 3194084 - protein, 18 aa, Giardia lamblia
PRFCLHPYMIRLDTMEST

SEQ ID NO: 3194085 - protein, 17 aa, Giardia lamblia
PRFGLFEYIRHGVRYID

SEQ ID NO: 3194086 - protein, 21 aa, Giardia lamblia
PRFQKLYSNWLPKCFTKLYLL

SEQ ID NO: 3194087 - protein, 29 aa, Giardia lamblia
PRFRNVRFTPALKLVLPNSLCLSNVAVRL

SEQ ID NO: 3194088 - protein, 23 aa, Giardia lamblia
PRGAWILYCKQQALRRLRDEQTL

SEQ ID NO: 3194089 - protein, 17 aa, Giardia lamblia
PRGCGWTPLFEAVYNGY

SEQ ID NO: 3194090 - protein, 27 aa, Giardia lamblia
PRGSDLLLQSLLVRVLTDIRHNRLESL

SEQ ID NO: 3194091 - protein, 25 aa, Giardia lamblia
PRHINARLRVARVFAAREKYILAAS

SEQ ID NO: 3194092 - protein, 20 aa, Giardia lamblia
PRHWEKIFETLKPFAKEPGS

SEQ ID NO: 3194093 - protein, 18 aa, Giardia lamblia
PRIPPRSEKSRKPSASER

SEQ ID NO: 3194094 - protein, 38 aa, Giardia lamblia
PRIQPVHKTPIQQPLTPINFSLPGPRYSRSRATSGSSS

SEQ ID NO: 3194095 - protein, 20 aa, Giardia lamblia
PRKNIDLMLDLYPSGSSADV

SEQ ID NO: 3194096 - protein, 26 aa, Giardia lamblia
PRKRMRLPIRLATGEVLYRAPDGSFT

SEQ ID NO: 3194097 - protein, 19 aa, Giardia lamblia
PRKVRWTKTYRLLHNKDMA

SEQ ID NO: 3194098 - protein, 22 aa, Giardia lamblia
PRLCDALRNLGLYEALPIQKLA

SEQ ID NO: 3194099 - protein, 27 aa, Giardia lamblia
PRLEQLGLLFRYASLMCPQSLEYMVLD

SEQ ID NO: 3194100 - protein, 19 aa, Giardia lamblia
PRLQDLARRYLLKDIQTNA

SEQ ID NO: 3194101 - protein, 22 aa, Giardia lamblia
PRMITDVCYPTLKPLSSWIVDL

SEQ ID NO: 3194102 - protein, 21 aa, Giardia lamblia
PRQEIMMTYNNMLRSRDIQRI

SEQ ID NO: 3194103 - protein, 21 aa, Giardia lamblia
PRRERLQPEFTTRIGDRPPSY

SEQ ID NO: 3194104 - protein, 18 aa, Giardia lamblia
PRRPLPSAKALRARQLRM

SEQ ID NO: 3194105 - protein, 26 aa, Giardia lamblia
PRRSTRISGIRPFLPGDTSRQIPGYM

SEQ ID NO: 3194106 - protein, 28 aa, Giardia lamblia
PRSDDQARAYLLHFGSPTLTLCLSASDE

SEQ ID NO: 3194107 - protein, 25 aa, Giardia lamblia
PRSEGILRKLGVPIALSVSPLAPLD

SEQ ID NO: 3194108 - protein, 20 aa, Giardia lamblia
PRSFLTNLCTRPAYSDAALR

SEQ ID NO: 3194109 - protein, 22 aa, Giardia lamblia
PRSIPVILRNHLIDKCKSGDLV

SEQ ID NO: 3194110 - protein, 23 aa, Giardia lamblia
PRSPLVIPALNLQSLPKESAGIK

SEQ ID NO: 3194111 - protein, 22 aa, Giardia lamblia
PRSPSVPAMSITASPLAVSRAS

SEQ ID NO: 3194112 - protein, 30 aa, Giardia lamblia
PRTDVLRWIKFGNLCLRFLAKFAPCDCNKP

SEQ ID NO: 3194113 - protein, 28 aa, Giardia lamblia
PRTLCKQLMVSLLDPALSPHGSRSLTSP

SEQ ID NO: 3194114 - protein, 33 aa, Giardia lamblia
PRTNIPEERIWKLFGQLLLALEYCHCPTKENFE

SEQ ID NO: 3194115 - protein, 19 aa, Giardia lamblia
PRTSYFQRFNQQPAQEYSP

SEQ ID NO: 3194116 - protein, 28 aa, Giardia lamblia
PRVVDMVETLFWLVHSVVFSPKSTSIPA

SEQ ID NO: 3194117 - protein, 24 aa, Giardia lamblia
PRWASNYYFYKLLDRQDVSYEVMH

SEQ ID NO: 3194118 - protein, 24 aa, Giardia lamblia
PRYEERLLIVTGPQSGFPSDFGKS

SEQ ID NO: 3194119 - protein, 17 aa, Giardia lamblia
PRYMDSEASLKDGRRLG

SEQ ID NO: 3194120 - protein, 29 aa, Giardia lamblia
PRYNARDAVWFMLSALLDYIRYTGDESIL

SEQ ID NO: 3194121 - protein, 23 aa, Giardia lamblia
PSAAELLLHIQYLCQNNTICTRE

SEQ ID NO: 3194122 - protein, 34 aa, Giardia lamblia
PSAEGLLLQFLLLLRTQYVLSNSFILISAALKGR

SEQ ID NO: 3194123 - protein, 23 aa, Giardia lamblia
PSAGDHLPILPPLNSHKNSHKIR

SEQ ID NO: 3194124 - protein, 25 aa, Giardia lamblia
PSAIFFLTTNTPLPHSFNRVVKPFK

SEQ ID NO: 3194125 - protein, 23 aa, Giardia lamblia
PSAKMRRYNWSYKSLRRRTQGTG

SEQ ID NO: 3194126 - protein, 21 aa, Giardia lamblia
PSALGLGYLEAGSSTKRLASI

SEQ ID NO: 3194127 - protein, 23 aa, Giardia lamblia
PSAMLELPLLCKRLADITNEARN

SEQ ID NO: 3194128 - protein, 23 aa, Giardia lamblia
PSASELLLCPKFKEVGVVTAEDH

SEQ ID NO: 3194129 - protein, 23 aa, Giardia lamblia
PSAYEILCHPLINRWVYRERYLD

SEQ ID NO: 3194130 - protein, 19 aa, Giardia lamblia
PSAYENLLLLVLFEAERAL

SEQ ID NO: 3194131 - protein, 18 aa, Giardia lamblia
PSCLIVRDALLVHELYGC

SEQ ID NO: 3194132 - protein, 23 aa, Giardia lamblia
PSDAAVHHFLLSTTSDLLILLFD

SEQ ID NO: 3194133 - protein, 26 aa, Giardia lamblia
PSDDDFFLRYALGLRGIIQNPIVVYS

SEQ ID NO: 3194134 - protein, 27 aa, Giardia lamblia
PSDDSGHFIYPYLLQPETAKHTMHQNI

SEQ ID NO: 3194135 - protein, 30 aa, Giardia lamblia
PSDELRLLRLRSKKYELLLAPDKGYLMVVI

SEQ ID NO: 3194136 - protein, 25 aa, Giardia lamblia
PSDIYLNLRVVIAGKWKGTKQHSKH

SEQ ID NO: 3194137 - protein, 19 aa, Giardia lamblia
PSDKLLKRASGAATGSCID

SEQ ID NO: 3194138 - protein, 26 aa, Giardia lamblia
PSDPVPGIIYMLPLQCLNCVSIDPST

SEQ ID NO: 3194139 - protein, 28 aa, Giardia lamblia
PSDRLRKYFGVVAIFRALVDILQKTNED

SEQ ID NO: 3194140 - protein, 25 aa, Giardia lamblia
PSDSFLTERLRNLSKLTGYKVTGKD

SEQ ID NO: 3194141 - protein, 29 aa, Giardia lamblia
PSDWTHDYLKVIPVNKFWDIGLGYTDSGE

SEQ ID NO: 3194142 - protein, 24 aa, Giardia lamblia
PSEDCLLSVPFVVTRSLSLPLFSS

SEQ ID NO: 3194143 - protein, 20 aa, Giardia lamblia
PSEEFYLGRLVPAESVRNIS

SEQ ID NO: 3194144 - protein, 27 aa, Giardia lamblia
PSEIPRPILVTHPIFPLASTLSGVVEE

SEQ ID NO: 3194145 - protein, 20 aa, Giardia lamblia
PSEQAMLIWSTGSSLTIIAN

SEQ ID NO: 3194146 - protein, 29 aa, Giardia lamblia
PSEQPRPYMTTKLWYNITSPFFDVRREKD

SEQ ID NO: 3194147 - protein, 22 aa, Giardia lamblia
PSEYALLSAWWELLQRTNEPDM

SEQ ID NO: 3194148 - protein, 18 aa, Giardia lamblia
PSFEQFNCHLDCNPPVPC

SEQ ID NO: 3194149 - protein, 21 aa, Giardia lamblia
PSFVELGFTAQYRKLFQLSGY

SEQ ID NO: 3194150 - protein, 24 aa, Giardia lamblia
PSGEMFVSRFFVGVGKKAYLDILQ

SEQ ID NO: 3194151 - protein, 21 aa, Giardia lamblia
PSGFSTIDPFFIIPHELEEEH

SEQ ID NO: 3194152 - protein, 31 aa, Giardia lamblia
PSGIIPVISKPELLPMMPSAKSAPSIDQREL

SEQ ID NO: 3194153 - protein, 29 aa, Giardia lamblia
PSGKQFYEIYMNPLLKWNNTNIIDFDELP

SEQ ID NO: 3194154 - protein, 25 aa, Giardia lamblia
PSGLTGLMYSAMRNDYRMVHILKQH

SEQ ID NO: 3194155 - protein, 26 aa, Giardia lamblia
PSGSSSEMIPLPTKPIPGKSQSSQTS

SEQ ID NO: 3194156 - protein, 23 aa, Giardia lamblia
PSHDFVRFKLQTAASPFPYLESL

SEQ ID NO: 3194157 - protein, 19 aa, Giardia lamblia
PSHLLSLQLVGPMPKFEIQ

SEQ ID NO: 3194158 - protein, 31 aa, Giardia lamblia
PSHPLPPIMPYHCYLYRLSSSQLRFICQRYS

SEQ ID NO: 3194159 - protein, 24 aa, Giardia lamblia
PSHRPAVPRILRPQSQEIVALTNI

SEQ ID NO: 3194160 - protein, 19 aa, Giardia lamblia
PSHSDVLPPAPMLTEFAPI

SEQ ID NO: 3194161 - protein, 23 aa, Giardia lamblia
PSIEDFIWVLKEAAKVLSTLPNN

SEQ ID NO: 3194162 - protein, 22 aa, Giardia lamblia
PSILTHGDFLHSIDYRILEHTV

SEQ ID NO: 3194163 - protein, 26 aa, Giardia lamblia
PSINYSLDLKCPCGCLSVANLTRAQQ

SEQ ID NO: 3194164 - protein, 22 aa, Giardia lamblia
PSISTRFGIARRHHELESDQVV

SEQ ID NO: 3194165 - protein, 18 aa, Giardia lamblia
PSITKTLRYTHSHATAAQ

SEQ ID NO: 3194166 - protein, 17 aa, Giardia lamblia
PSIVLPRCSLTNSLISA

SEQ ID NO: 3194167 - protein, 23 aa, Giardia lamblia
PSKKLLRSLQTQNIFISRPTGFT

SEQ ID NO: 3194168 - protein, 31 aa, Giardia lamblia
PSKLRNSFRRYIDFSFWFIRDTSCEDKNGNQ

SEQ ID NO: 3194169 - protein, 24 aa, Giardia lamblia
PSKPALLCTIISSLAYRGENLRAT

SEQ ID NO: 3194170 - protein, 26 aa, Giardia lamblia
PSKVYPYVRYTSEPSFVLLGVSKGSP

SEQ ID NO: 3194171 - protein, 33 aa, Giardia lamblia
PSKYGQTVLFGTPLICRYYPIMFQPGRRVNDWD

SEQ ID NO: 3194172 - protein, 17 aa, Giardia lamblia
PSLCYLNEKYRHMIQAT

SEQ ID NO: 3194173 - protein, 25 aa, Giardia lamblia
PSLDPKLTAYIRYLRAECARLYTPE

SEQ ID NO: 3194174 - protein, 20 aa, Giardia lamblia
PSLHLLYDTAVLGPRMMRLY

SEQ ID NO: 3194175 - protein, 24 aa, Giardia lamblia
PSLKPLHCNLKPTNILFLDENLSM

SEQ ID NO: 3194176 - protein, 21 aa, Giardia lamblia
PSLLDIRSLSLFTSLGILDFT

SEQ ID NO: 3194177 - protein, 19 aa, Giardia lamblia
PSLPQKNLIFFECIQSIYS

SEQ ID NO: 3194178 - protein, 26 aa, Giardia lamblia
PSLTHYFLRFLADEGILKLILTQNID

SEQ ID NO: 3194179 - protein, 23 aa, Giardia lamblia
PSLVPDLMAVLVKATLVVMQCEI

SEQ ID NO: 3194180 - protein, 23 aa, Giardia lamblia
PSLVYPDLFSHVFCKIRNFKSRM

SEQ ID NO: 3194181 - protein, 24 aa, Giardia lamblia
PSMGLLVSFRLRPGTLVRFRMNTY

SEQ ID NO: 3194182 - protein, 29 aa, Giardia lamblia
PSNANDLRIQLFNRLSLEGLTHISDETIL

SEQ ID NO: 3194183 - protein, 17 aa, Giardia lamblia
PSNIFLSQALTVFIVDP

SEQ ID NO: 3194184 - protein, 26 aa, Giardia lamblia
PSNIYISDLYYVKLGRPLLTSERKET

SEQ ID NO: 3194185 - protein, 17 aa, Giardia lamblia
PSNMKFIFEVTNLMLVP

SEQ ID NO: 3194186 - protein, 17 aa, Giardia lamblia
PSPAFASAVDRFSIKYD

SEQ ID NO: 3194187 - protein, 25 aa, Giardia lamblia
PSPETIVFLLGQIVLRLILTTDDFT

SEQ ID NO: 3194188 - protein, 23 aa, Giardia lamblia
PSPIRKRGTLGNITRFMTHMDTT

SEQ ID NO: 3194189 - protein, 29 aa, Giardia lamblia
PSPKLLKQAKMLPIDQLEYTFTPHVLEAA

SEQ ID NO: 3194190 - protein, 28 aa, Giardia lamblia
PSQFSTQRPSLPYSSRPTSRTSDNIVAQ

SEQ ID NO: 3194191 - protein, 29 aa, Giardia lamblia
PSQKDPIYVYLSCLYLPGTPKYSVAQETR

SEQ ID NO: 3194192 - protein, 23 aa, Giardia lamblia
PSQWGILPGSRLLSKLFGENNTH

SEQ ID NO: 3194193 - protein, 18 aa, Giardia lamblia
PSQYRGISTLFLSNNRIS

SEQ ID NO: 3194194 - protein, 20 aa, Giardia lamblia
PSRDLLVASPLETLVPGVKE

SEQ ID NO: 3194195 - protein, 17 aa, Giardia lamblia
PSRFLQLSNNTLAPANR

SEQ ID NO: 3194196 - protein, 22 aa, Giardia lamblia
PSRMTDFSFKYADRSLARNSML

SEQ ID NO: 3194197 - protein, 25 aa, Giardia lamblia
PSRNSIMYVYLYIADTQLDSLQCAP

SEQ ID NO: 3194198 - protein, 27 aa, Giardia lamblia
PSSEIYSLEALLYMHLRDIDRAISSCL

SEQ ID NO: 3194199 - protein, 27 aa, Giardia lamblia
PSSFLGRLIFRYYGTYSLDEAAKREKE

SEQ ID NO: 3194200 - protein, 25 aa, Giardia lamblia
PSSIYRYPNGQLKLTFYGLRTDSQS

SEQ ID NO: 3194201 - protein, 26 aa, Giardia lamblia
PSSKLASLLLPHSLHICDPRGRTALH

SEQ ID NO: 3194202 - protein, 23 aa, Giardia lamblia
PSSLLIRIYAMFTITTGKPGTSS

SEQ ID NO: 3194203 - protein, 21 aa, Giardia lamblia
PSSLSLLKRSLSDRRRPICTW

SEQ ID NO: 3194204 - protein, 28 aa, Giardia lamblia
PSSLSQTFFLLIRKILTHILVTQSAPDP

SEQ ID NO: 3194205 - protein, 27 aa, Giardia lamblia
PSSSLRLPQLLLCALLAYCGHSCNSLL

SEQ ID NO: 3194206 - protein, 26 aa, Giardia lamblia
PSSVKKSRPIVLLDNVSLSMATSPQQ

SEQ ID NO: 3194207 - protein, 35 aa, Giardia lamblia
PSSYEYMDVIWLSCLQYMHLFVHQLHIVPDSNKEF

SEQ ID NO: 3194208 - protein, 28 aa, Giardia lamblia
PSTALILYKRVLLFVPADPAIWNNLGVC

SEQ ID NO: 3194209 - protein, 25 aa, Giardia lamblia
PSTRRVMVTIYPEPEYFARYASDIY

SEQ ID NO: 3194210 - protein, 28 aa, Giardia lamblia
PSTSPAHLNLIPSNIFLSSLSSVLTSEP

SEQ ID NO: 3194211 - protein, 26 aa, Giardia lamblia
PSTSVFPYSTPLTLTPQIPAYYCPGI

SEQ ID NO: 3194212 - protein, 23 aa, Giardia lamblia
PSTVAVPLIRKTATYRSKVANDD

SEQ ID NO: 3194213 - protein, 31 aa, Giardia lamblia
PSTYDYLHRFTVVWPVLSLDPIVDNFGLNRS

SEQ ID NO: 3194214 - protein, 24 aa, Giardia lamblia
PSVEAVCQCLCGCPAYSNAIKEAL

SEQ ID NO: 3194215 - protein, 36 aa, Giardia lamblia
PSVNQILKLPFLQERIRRLLPEDYWNEEFSHTIIHG

SEQ ID NO: 3194216 - protein, 31 aa, Giardia lamblia
PSVPVEWYMLRRFVKFYIKPLQHLIHDLNNE

SEQ ID NO: 3194217 - protein, 25 aa, Giardia lamblia
PSVRRAVLLLRRSCTDARVPFDDAS

SEQ ID NO: 3194218 - protein, 25 aa, Giardia lamblia
PSVSFRYLELMPFRAELRASEEDHQ

SEQ ID NO: 3194219 - protein, 28 aa, Giardia lamblia
PSVVSRRPLFITPVKKTGAATVLQSISL

SEQ ID NO: 3194220 - protein, 18 aa, Giardia lamblia
PSVWSYLTSKKWTRVLNL

SEQ ID NO: 3194221 - protein, 21 aa, Giardia lamblia
PSYARYLLVSILQELEKGTLQ

SEQ ID NO: 3194222 - protein, 26 aa, Giardia lamblia
PTADNYQPLIYTEKPYYDPGTSTFRA

SEQ ID NO: 3194223 - protein, 17 aa, Giardia lamblia
PTAFKNFTAIQDLTLYG

SEQ ID NO: 3194224 - protein, 22 aa, Giardia lamblia
PTAMEILAHPFYDILRDPDTLL

SEQ ID NO: 3194225 - protein, 26 aa, Giardia lamblia
PTAPVETVFTLLSRSPYASSSRSLSN

SEQ ID NO: 3194226 - protein, 26 aa, Giardia lamblia
PTASELHLRFIWANLANAIMLKIVGA

SEQ ID NO: 3194227 - protein, 32 aa, Giardia lamblia
PTAVDVMFSSFPLFDLAFMAPEVLSGEEAYSL

SEQ ID NO: 3194228 - protein, 26 aa, Giardia lamblia
PTDDGVPLWTFDWGSAVYFSEHNIGS

SEQ ID NO: 3194229 - protein, 20 aa, Giardia lamblia
PTDIAVLVSLLKDLIEKVPP

SEQ ID NO: 3194230 - protein, 30 aa, Giardia lamblia
PTDLMSMKILLNILLRRTFESSLGMLNIRS

SEQ ID NO: 3194231 - protein, 24 aa, Giardia lamblia
PTEEILKAFRLFDDDATGRISLKN

SEQ ID NO: 3194232 - protein, 25 aa, Giardia lamblia
PTEFTSDILLLLYAYHDMSADISTR

SEQ ID NO: 3194233 - protein, 19 aa, Giardia lamblia
PTELIPFKPNELLHDVYSE

SEQ ID NO: 3194234 - protein, 19 aa, Giardia lamblia
PTEPGIIPRAIEDIFAKIH

SEQ ID NO: 3194235 - protein, 33 aa, Giardia lamblia
PTEQEYVIFPASIINMYMAMRNKGTDVAQSSVQ

SEQ ID NO: 3194236 - protein, 27 aa, Giardia lamblia
PTESLDLHGILPRRSPLGTLEYTSQSR

SEQ ID NO: 3194237 - protein, 18 aa, Giardia lamblia
PTFIYRDLIPIPDIVWDE

SEQ ID NO: 3194238 - protein, 33 aa, Giardia lamblia
PTFVDKLLHNLYKKPLSFVPLPEVTPEQVRVAS

SEQ ID NO: 3194239 - protein, 25 aa, Giardia lamblia
PTGQTQVLPPYQLTPLTSCEFDLHI

SEQ ID NO: 3194240 - protein, 28 aa, Giardia lamblia
PTHKRRIVQLLFLRASDSQLLILSKHRF

SEQ ID NO: 3194241 - protein, 29 aa, Giardia lamblia
PTHPYPRLRDRFGSPLLALSTKRLSTEAT

SEQ ID NO: 3194242 - protein, 22 aa, Giardia lamblia
PTHTNSTLPFLLQGTPQQYTHQ

SEQ ID NO: 3194243 - protein, 31 aa, Giardia lamblia
PTHYRTVLEFMVKLIFYPPLKHGQARDRIWT

SEQ ID NO: 3194244 - protein, 38 aa, Giardia lamblia
PTIVVRRLMSIGTRPDYLPLLSALLPSLKTIDGVSIAP

SEQ ID NO: 3194245 - protein, 25 aa, Giardia lamblia
PTKEYRATVIRKPKPTVWSKEPSIS

SEQ ID NO: 3194246 - protein, 25 aa, Giardia lamblia
PTKPKLPGHALSYNPPLEYLNIDGD

SEQ ID NO: 3194247 - protein, 17 aa, Giardia lamblia
PTKRQFLLIDFPGQVEC

SEQ ID NO: 3194248 - protein, 21 aa, Giardia lamblia
PTKVCTAVLPRVAYIKMIFNQ

SEQ ID NO: 3194249 - protein, 25 aa, Giardia lamblia
PTKVFITKEPLPLRRTHHKHQFSMF

SEQ ID NO: 3194250 - protein, 18 aa, Giardia lamblia
PTLHWCPAGYNPTIEVIS

SEQ ID NO: 3194251 - protein, 20 aa, Giardia lamblia
PTLHWCPAGYNPTIEVISHW

SEQ ID NO: 3194252 - protein, 20 aa, Giardia lamblia
PTLHWCPAGYNPTIEVISRW

SEQ ID NO: 3194253 - protein, 18 aa, Giardia lamblia
PTLWGYSRQQAISKTTAP

SEQ ID NO: 3194254 - protein, 29 aa, Giardia lamblia
PTMFETWNLILDYRVLKQWVANTKQDGCY

SEQ ID NO: 3194255 - protein, 19 aa, Giardia lamblia
PTMPAGCLEKLGFTLDGRG

SEQ ID NO: 3194256 - protein, 19 aa, Giardia lamblia
PTNAWFYVNEIRPMYSLQV

SEQ ID NO: 3194257 - protein, 26 aa, Giardia lamblia
PTNINYLLHGSFSLSIFGFLAGNSRK

SEQ ID NO: 3194258 - protein, 24 aa, Giardia lamblia
PTNKYDPYKLSKYMRSKTAIKLDD

SEQ ID NO: 3194259 - protein, 33 aa, Giardia lamblia
PTPANTIRALLIYILPQLLYLNWAEVTIDERLE

SEQ ID NO: 3194260 - protein, 34 aa, Giardia lamblia
PTPEPAIDRELYIEKELYLALESKVSGLSKELSA

SEQ ID NO: 3194261 - protein, 22 aa, Giardia lamblia
PTPKLDLAIFDLKPDFLQDIKK

SEQ ID NO: 3194262 - protein, 28 aa, Giardia lamblia
PTPLILRKHLAYHVHICILAAKVAAIKV

SEQ ID NO: 3194263 - protein, 27 aa, Giardia lamblia
PTPQEYSIGMWPLETILSSTLTTTTAS

SEQ ID NO: 3194264 - protein, 23 aa, Giardia lamblia
PTPSVLLPRYCLKKVLGAGSYGK

SEQ ID NO: 3194265 - protein, 27 aa, Giardia lamblia
PTQVSKASFTFLPQNRFPGGAGPVNPV

SEQ ID NO: 3194266 - protein, 18 aa, Giardia lamblia
PTRKSGGPLFGFLSQALR

SEQ ID NO: 3194267 - protein, 23 aa, Giardia lamblia
PTRKSVVGTPFWMAPELIRGTEY

SEQ ID NO: 3194268 - protein, 23 aa, Giardia lamblia
PTRLIMVLEYVPGGELFFHLKKK

SEQ ID NO: 3194269 - protein, 24 aa, Giardia lamblia
PTRNEEIIHMLIGLEAGHVCSNGD

SEQ ID NO: 3194270 - protein, 18 aa, Giardia lamblia
PTSAESIRLALSLSLHGM

SEQ ID NO: 3194271 - protein, 24 aa, Giardia lamblia
PTSAGLRYLTLLGMKGLCAYAEHC

SEQ ID NO: 3194272 - protein, 24 aa, Giardia lamblia
PTSAPSLFQRTMMGRHLSGMQFKE

SEQ ID NO: 3194273 - protein, 23 aa, Giardia lamblia
PTSLPGFQCPHPFKVSPPFGFPF

SEQ ID NO: 3194274 - protein, 27 aa, Giardia lamblia
PTSMFDLSYYCLRPRPFSSLSVSIFPS

SEQ ID NO: 3194275 - protein, 24 aa, Giardia lamblia
PTSNDVVFPPTWEATFVPVASNQN

SEQ ID NO: 3194276 - protein, 18 aa, Giardia lamblia
PTSPRKPPYKRVSSTLVL

SEQ ID NO: 3194277 - protein, 24 aa, Giardia lamblia
PTSTQLLAASLPYFSSDYPFATVQ

SEQ ID NO: 3194278 - protein, 24 aa, Giardia lamblia
PTTAIKSALSTVPLLSSLNNSGIH

SEQ ID NO: 3194279 - protein, 21 aa, Giardia lamblia
PTTCFYRTPLSTYTDDFRPYP

SEQ ID NO: 3194280 - protein, 27 aa, Giardia lamblia
PTTDLPLFFNYCWDKFYIHQSAFPYSL

SEQ ID NO: 3194281 - protein, 24 aa, Giardia lamblia
PTTIYDYCFVYPPIDAKVTMDDNE

SEQ ID NO: 3194282 - protein, 19 aa, Giardia lamblia
PTTRLLLCLVCAHLLDATT

SEQ ID NO: 3194283 - protein, 26 aa, Giardia lamblia
PTWATPWIPLYPFSVSGFIPAYSILW

SEQ ID NO: 3194284 - protein, 25 aa, Giardia lamblia
PTYNFPKDGVYVPGYPYIVPTEFGD

SEQ ID NO: 3194285 - protein, 20 aa, Giardia lamblia
PVACLATYRYQGCDSLVLGT

SEQ ID NO: 3194286 - protein, 20 aa, Giardia lamblia
PVAFACVPCFPPVGYGGVPG

SEQ ID NO: 3194287 - protein, 22 aa, Giardia lamblia
PVASIPTNFRAALGPANEHTID

SEQ ID NO: 3194288 - protein, 22 aa, Giardia lamblia
PVASLSIYYRDLSPSTSGPVDK

SEQ ID NO: 3194289 - protein, 27 aa, Giardia lamblia
PVAVEGFLPTLPFSLKPQTIAPSFKGT

SEQ ID NO: 3194290 - protein, 28 aa, Giardia lamblia
PVDYKSIPNSFLIYNIPPEKRDPKELFQ

SEQ ID NO: 3194291 - protein, 20 aa, Giardia lamblia
PVETMPSRTLCSPKRIANPA

SEQ ID NO: 3194292 - protein, 17 aa, Giardia lamblia
PVFLQFSPSVQACAAIY

SEQ ID NO: 3194293 - protein, 24 aa, Giardia lamblia
PVFQTDLSPIYRKSESKLGPKHVS

SEQ ID NO: 3194294 - protein, 24 aa, Giardia lamblia
PVFSGRIWFNSLMQFIEAVEQKLQ

SEQ ID NO: 3194295 - protein, 23 aa, Giardia lamblia
PVGVLPSIAAKPWRAAESSLGDG

SEQ ID NO: 3194296 - protein, 44 aa, Giardia lamblia
PVHDVQILKTLAMIKARDPRIFDKDVRFFSDDALPQAPASVKAA

SEQ ID NO: 3194297 - protein, 18 aa, Giardia lamblia
PVHIRDKCRLRLKKIKEM

SEQ ID NO: 3194298 - protein, 24 aa, Giardia lamblia
PVHTGPLRSFKYCNWSLEGTHRQR

SEQ ID NO: 3194299 - protein, 21 aa, Giardia lamblia
PVIVSLIHKIVPLHGLPNITQ

SEQ ID NO: 3194300 - protein, 20 aa, Giardia lamblia
PVKIAASYTFLYVLHRETGS

SEQ ID NO: 3194301 - protein, 18 aa, Giardia lamblia
PVKQPPILVVSQQSPPGG

SEQ ID NO: 3194302 - protein, 21 aa, Giardia lamblia
PVKRIVFWNIRDGPWIPTLRL

SEQ ID NO: 3194303 - protein, 21 aa, Giardia lamblia
PVLAHACLKYDWDATVKVLEE

SEQ ID NO: 3194304 - protein, 17 aa, Giardia lamblia
PVLAPNPQIQAGAKPRF

SEQ ID NO: 3194305 - protein, 25 aa, Giardia lamblia
PVLAQFEAFYRLRDDSTPLHYAVRN

SEQ ID NO: 3194306 - protein, 18 aa, Giardia lamblia
PVLEEAHRLGRIEIAKFL

SEQ ID NO: 3194307 - protein, 18 aa, Giardia lamblia
PVLITFISNTVMSFSSRC

SEQ ID NO: 3194308 - protein, 29 aa, Giardia lamblia
PVLTFNTCLTFRPPPMTVLSSVSLANTDK

SEQ ID NO: 3194309 - protein, 19 aa, Giardia lamblia
PVLWNTVAQITVALNALLE

SEQ ID NO: 3194310 - protein, 18 aa, Giardia lamblia
PVMPEMDLATILEAAGVD

SEQ ID NO: 3194311 - protein, 21 aa, Giardia lamblia
PVMRPQRIVIVVQKVLIPQWK

SEQ ID NO: 3194312 - protein, 26 aa, Giardia lamblia
PVNLDNLFSVAIRRSSRLPQVVMLLL

SEQ ID NO: 3194313 - protein, 39 aa, Giardia lamblia
PVPEAIPEYLLTLNAYRRKLFHVMFDLRRLAHAKETAEA

SEQ ID NO: 3194314 - protein, 24 aa, Giardia lamblia
PVPIVKTFARHLLVALGYVHAAGY

SEQ ID NO: 3194315 - protein, 25 aa, Giardia lamblia
PVPNNPQILSLPPLAGAYPYRKLSP

SEQ ID NO: 3194316 - protein, 18 aa, Giardia lamblia
PVPPRLGEVQRRAGSQDP

SEQ ID NO: 3194317 - protein, 20 aa, Giardia lamblia
PVPTLLRSIDSISNFTSLPT

SEQ ID NO: 3194318 - protein, 27 aa, Giardia lamblia
PVQEQPYIYLPPELSAEGKIFTLGKTG

SEQ ID NO: 3194319 - protein, 18 aa, Giardia lamblia
PVQRFYDRLLAASSPRTI

SEQ ID NO: 3194320 - protein, 23 aa, Giardia lamblia
PVRERNMRLFNCAAYLMSYSNER

SEQ ID NO: 3194321 - protein, 22 aa, Giardia lamblia
PVRLTLEMLVRCIPQQCAVTQQ

SEQ ID NO: 3194322 - protein, 33 aa, Giardia lamblia
PVRMDPSLLPAISFDLDLPLHKRRSDGYLAPVT

SEQ ID NO: 3194323 - protein, 17 aa, Giardia lamblia
PVRQRYFSTPSLRKKLL

SEQ ID NO: 3194324 - protein, 17 aa, Giardia lamblia
PVRYISCPCPSIFSPTS

SEQ ID NO: 3194325 - protein, 25 aa, Giardia lamblia
PVSCIQFHPKFHDLFAAAYGSFEFQ

SEQ ID NO: 3194326 - protein, 21 aa, Giardia lamblia
PVSREYLIRTLGLSPDAINNE

SEQ ID NO: 3194327 - protein, 34 aa, Giardia lamblia
PVSRLDMMIHKILSFQLYLLARIGPDDLKQRAHR

SEQ ID NO: 3194328 - protein, 20 aa, Giardia lamblia
PVSSRIPCQTMDELYGLLES

SEQ ID NO: 3194329 - protein, 24 aa, Giardia lamblia
PVTAPMYITLLFQWVQGQLEDEAI

SEQ ID NO: 3194330 - protein, 26 aa, Giardia lamblia
PVTIPSTITPLVVDPPSILASAPTSV

SEQ ID NO: 3194331 - protein, 18 aa, Giardia lamblia
PVTLISNDFLPQGVTVGN

SEQ ID NO: 3194332 - protein, 22 aa, Giardia lamblia
PVTTIAAYFKKAYNVPTQCCKK

SEQ ID NO: 3194333 - protein, 32 aa, Giardia lamblia
PVTYSLRLKQLGLFTVLCFCVLLQDAEANPTL

SEQ ID NO: 3194334 - protein, 18 aa, Giardia lamblia
PVVARWRDDCEFTAAGIQ

SEQ ID NO: 3194335 - protein, 35 aa, Giardia lamblia
PVVDFLGYTTPLRKFVRLLLQPDPKARPTAEQLLS

SEQ ID NO: 3194336 - protein, 21 aa, Giardia lamblia
PVVGHIILKRLVYDVLEHEQF

SEQ ID NO: 3194337 - protein, 19 aa, Giardia lamblia
PVVIRAGAVAPPMSFEENI

SEQ ID NO: 3194338 - protein, 20 aa, Giardia lamblia
PVVRGPLPRGGAELLQDAGG

SEQ ID NO: 3194339 - protein, 36 aa, Giardia lamblia
PVVRSNNPLVWLFEATAFQLIPLKASLTHCFRQSDK

SEQ ID NO: 3194340 - protein, 30 aa, Giardia lamblia
PVVSIILEQRIIFAIAWGLAGSIVAEHKIN

SEQ ID NO: 3194341 - protein, 24 aa, Giardia lamblia
PVVTDDELFYMYTSRHFEVPPEPS

SEQ ID NO: 3194342 - protein, 26 aa, Giardia lamblia
PVVVPCSKSIPINRLPDLSVSAPIDT

SEQ ID NO: 3194343 - protein, 26 aa, Giardia lamblia
PVYDSYGRFCFTDLFPAESGQMEGQT

SEQ ID NO: 3194344 - protein, 21 aa, Giardia lamblia
PVYYDFRRYGLSFHKMKTPRI

SEQ ID NO: 3194345 - protein, 27 aa, Giardia lamblia
PWAKEIIEILFVEGLVKILYATETFAM

SEQ ID NO: 3194346 - protein, 19 aa, Giardia lamblia
PWTWTAPYPCAELKALFQH

SEQ ID NO: 3194347 - protein, 22 aa, Giardia lamblia
PWVTERVPLKGNVWLYKVCKNE

SEQ ID NO: 3194348 - protein, 28 aa, Giardia lamblia
PYAWPDFRPRPHLLLSPSNIIVGPDDSF

SEQ ID NO: 3194349 - protein, 25 aa, Giardia lamblia
PYDADPIYMHAPNPAKLTRLHDAHL

SEQ ID NO: 3194350 - protein, 17 aa, Giardia lamblia
PYEEILCNEFPQMEFAD

SEQ ID NO: 3194351 - protein, 19 aa, Giardia lamblia
PYEGIPVARIPVLHREQKH

SEQ ID NO: 3194352 - protein, 22 aa, Giardia lamblia
PYEKELIGFSYTSLMTAIFGLR

SEQ ID NO: 3194353 - protein, 25 aa, Giardia lamblia
PYELSRYLAHPHLLVYHEAYVIPGE

SEQ ID NO: 3194354 - protein, 19 aa, Giardia lamblia
PYEVMLQDAKRNTALMLAC

SEQ ID NO: 3194355 - protein, 29 aa, Giardia lamblia
PYFSSCFAAFLQHFPFKIMPQRVFSAYTQ

SEQ ID NO: 3194356 - protein, 19 aa, Giardia lamblia
PYFVERVNIYLGNSVQFSL

SEQ ID NO: 3194357 - protein, 18 aa, Giardia lamblia
PYHELFLEFTNPTDSAHC

SEQ ID NO: 3194358 - protein, 21 aa, Giardia lamblia
PYHSAMKILSLDRFTYPTLYR

SEQ ID NO: 3194359 - protein, 20 aa, Giardia lamblia
PYIFTPARVLISNDMRFRFF

SEQ ID NO: 3194360 - protein, 17 aa, Giardia lamblia
PYIIIRAISDSGSGEAT

SEQ ID NO: 3194361 - protein, 24 aa, Giardia lamblia
PYIRHEYLHKLINDFKARSDAISQ

SEQ ID NO: 3194362 - protein, 20 aa, Giardia lamblia
PYIVSVKVAFIPNKPPRPKR

SEQ ID NO: 3194363 - protein, 23 aa, Giardia lamblia
PYKPISNFIYLCDSKFHTEHLRE

SEQ ID NO: 3194364 - protein, 24 aa, Giardia lamblia
PYLDEVLAHPFIFGFMVKSGSREN

SEQ ID NO: 3194365 - protein, 25 aa, Giardia lamblia
PYLELFYEDPKKWGYQMQIWFFNQR

SEQ ID NO: 3194366 - protein, 17 aa, Giardia lamblia
PYLIDKEARRQLVDGWT

SEQ ID NO: 3194367 - protein, 19 aa, Giardia lamblia
PYLMHQYWHPNSCYFSPMP

SEQ ID NO: 3194368 - protein, 26 aa, Giardia lamblia
PYLQMPPKKFVSEPAYLLIAFDNVLG

SEQ ID NO: 3194369 - protein, 19 aa, Giardia lamblia
PYMSELSFELPEALPSITK

SEQ ID NO: 3194370 - protein, 25 aa, Giardia lamblia
PYNPNFRVYLVTSLPNPKYSPENAV

SEQ ID NO: 3194371 - protein, 19 aa, Giardia lamblia
PYPSLIMPLSTNSLAYVGL

SEQ ID NO: 3194372 - protein, 19 aa, Giardia lamblia
PYQDLESLLPRFVDSILKE

SEQ ID NO: 3194373 - protein, 27 aa, Giardia lamblia
PYQHPPQPIPQQYPTDGPLPGTYSDQV

SEQ ID NO: 3194374 - protein, 27 aa, Giardia lamblia
PYSMGDAYELLLLILDNISTAEIRVAR

SEQ ID NO: 3194375 - protein, 25 aa, Giardia lamblia
PYTISDYLILDKVTPLPVPDAQSGL

SEQ ID NO: 3194376 - protein, 34 aa, Giardia lamblia
PYTQFRERIEKYSDLLWLMPSSVYCKGLTVGESC

SEQ ID NO: 3194377 - protein, 28 aa, Giardia lamblia
PYVLSRAYIFTMLSLLASSPASVSITVL

SEQ ID NO: 3194378 - protein, 25 aa, Giardia lamblia
PYVPETCKVRYPRLPIPSGDVGETD

SEQ ID NO: 3194379 - protein, 18 aa, Giardia lamblia
PYVWTADICRTTLGCICQ

SEQ ID NO: 3194380 - protein, 19 aa, Giardia lamblia
PYYSILQRIRNKGSVDLPD

SEQ ID NO: 3194381 - protein, 27 aa, Giardia lamblia
QAAAFGQTPILPYLIPSEAGICTNKSQ

SEQ ID NO: 3194382 - protein, 24 aa, Giardia lamblia
QAAALIRMLKAPISQQLYVCDVVS

SEQ ID NO: 3194383 - protein, 31 aa, Giardia lamblia
QAAIYIFTLQEKYGLYPCKLGKPVYPEIVSG

SEQ ID NO: 3194384 - protein, 19 aa, Giardia lamblia
QAALFPLSIKVMPGVLTVG

SEQ ID NO: 3194385 - protein, 17 aa, Giardia lamblia
QAALWKHKRTLLHIDIK

SEQ ID NO: 3194386 - protein, 24 aa, Giardia lamblia
QAANKLLHLPLAPNTDLNKSSPDD

SEQ ID NO: 3194387 - protein, 26 aa, Giardia lamblia
QAARITGLFHDLHKFAWVHYACWGVM

SEQ ID NO: 3194388 - protein, 30 aa, Giardia lamblia
QAARQNDVVALWSFLPVQSGLQDAQGRTAL

SEQ ID NO: 3194389 - protein, 26 aa, Giardia lamblia
QAASLLLPYEAGLLKKSKYSALYYAS

SEQ ID NO: 3194390 - protein, 25 aa, Giardia lamblia
QAATLYLTFVAALFSQSLSVFKALR

SEQ ID NO: 3194391 - protein, 21 aa, Giardia lamblia
QACILSTLNCLLAVVYRSDNG

SEQ ID NO: 3194392 - protein, 25 aa, Giardia lamblia
QACSLYLEQLKLTATIRALPCSDTS

SEQ ID NO: 3194393 - protein, 24 aa, Giardia lamblia
QADLHELLVFKSVQTVRELFTVDD

SEQ ID NO: 3194394 - protein, 24 aa, Giardia lamblia
QADRQFVISYFFSDGTVSVFEPTE

SEQ ID NO: 3194395 - protein, 19 aa, Giardia lamblia
QAELEKLRYLANPDDQYSS

SEQ ID NO: 3194396 - protein, 23 aa, Giardia lamblia
QAFAKFNTLCIVSMDSTVLFLNL

SEQ ID NO: 3194397 - protein, 22 aa, Giardia lamblia
QAFSRLLYRLGGGSMRFFFCHQ

SEQ ID NO: 3194398 - protein, 20 aa, Giardia lamblia
QAFVLKRDLFREGVLSKRVL

SEQ ID NO: 3194399 - protein, 23 aa, Giardia lamblia
QAGALDILLPLGPYVDEFQRRTV

SEQ ID NO: 3194400 - protein, 20 aa, Giardia lamblia
QAGVSISILSDYPPKRPSKT

SEQ ID NO: 3194401 - protein, 18 aa, Giardia lamblia
QAGWTAMMHALDSRFDDI

SEQ ID NO: 3194402 - protein, 23 aa, Giardia lamblia
QAHDLLFGLFEGGVLAVPERPAL

SEQ ID NO: 3194403 - protein, 29 aa, Giardia lamblia
QAHNPRVVLTRKAIYFFSQQSPEHNLYMD

SEQ ID NO: 3194404 - protein, 21 aa, Giardia lamblia
QAIACGKVLRDPSRAFFVGAV

SEQ ID NO: 3194405 - protein, 22 aa, Giardia lamblia
QAIEIPLSTSLLLHSKGDEYTQ

SEQ ID NO: 3194406 - protein, 26 aa, Giardia lamblia
QAILADKLWTDRLLMDISPGITPQEI

SEQ ID NO: 3194407 - protein, 17 aa, Giardia lamblia
QAILLELTVKPLEFYNL

SEQ ID NO: 3194408 - protein, 22 aa, Giardia lamblia
QAINVVYRLYNSHKRYTDKMER

SEQ ID NO: 3194409 - protein, 28 aa, Giardia lamblia
QAISYLPDERYLFKPMPNRVVSQIIANG

SEQ ID NO: 3194410 - protein, 24 aa, Giardia lamblia
QAKEIIVTAIRRPEVAPASNTPIA

SEQ ID NO: 3194411 - protein, 22 aa, Giardia lamblia
QAKGILVALSARASLHSAPGQP

SEQ ID NO: 3194412 - protein, 18 aa, Giardia lamblia
QAKGLLRPPKSPISANKN

SEQ ID NO: 3194413 - protein, 26 aa, Giardia lamblia
QAKILALTRLLLTEDQFIGLFTGFCE

SEQ ID NO: 3194414 - protein, 19 aa, Giardia lamblia
QAKIWYRRVSCHICISYWR

SEQ ID NO: 3194415 - protein, 25 aa, Giardia lamblia
QAKMLVYLVLVRASCHFYRFINCHT

SEQ ID NO: 3194416 - protein, 17 aa, Giardia lamblia
QAKPTPHRPLGPASSTA

SEQ ID NO: 3194417 - protein, 24 aa, Giardia lamblia
QAKRGMWYLVYATEAATDTLLASP

SEQ ID NO: 3194418 - protein, 31 aa, Giardia lamblia
QAKTHRLASVPAPPYMSCGLKRRDAGRLFVD

SEQ ID NO: 3194419 - protein, 25 aa, Giardia lamblia
QALAKLLFDIPTSNGTLPLDIALTE

SEQ ID NO: 3194420 - protein, 22 aa, Giardia lamblia
QALALLRYGVIHVPKDIDHSMH

SEQ ID NO: 3194421 - protein, 17 aa, Giardia lamblia
QALERLQMQALVIPGYS

SEQ ID NO: 3194422 - protein, 19 aa, Giardia lamblia
QALGKLDLYRDMREQLMEY

SEQ ID NO: 3194423 - protein, 33 aa, Giardia lamblia
QALGYSVPEPVPLVHRGPLTFAAELHALESEVR

SEQ ID NO: 3194424 - protein, 22 aa, Giardia lamblia
QALLESTLQEYEREVRTLRGSL

SEQ ID NO: 3194425 - protein, 18 aa, Giardia lamblia
QALLPRRRSAARRVWRTS

SEQ ID NO: 3194426 - protein, 25 aa, Giardia lamblia
QALLRARLVFVLFQSLHTLQKYPHI

SEQ ID NO: 3194427 - protein, 27 aa, Giardia lamblia
QALPDKQKLFRLITTLKSRENILEQQP

SEQ ID NO: 3194428 - protein, 26 aa, Giardia lamblia
QALQGKGVYFNRLLTHTPASGQSGGV

SEQ ID NO: 3194429 - protein, 21 aa, Giardia lamblia
QALREREAMIESLRTDANSTR

SEQ ID NO: 3194430 - protein, 18 aa, Giardia lamblia
QAMYEYHFIALEVEPKRA

SEQ ID NO: 3194431 - protein, 32 aa, Giardia lamblia
QANASYLFNLKKFLITSFYNLDIYVTKLEAEL

SEQ ID NO: 3194432 - protein, 17 aa, Giardia lamblia
QANLLIVSTAENLVITS

SEQ ID NO: 3194433 - protein, 18 aa, Giardia lamblia
QANLNEWILQRLCTSIWS

SEQ ID NO: 3194434 - protein, 28 aa, Giardia lamblia
QANVFVSYPINAIKWCGWRNALFTGGSD

SEQ ID NO: 3194435 - protein, 20 aa, Giardia lamblia
QAPFTFGTFGQQGAATASAP

SEQ ID NO: 3194436 - protein, 18 aa, Giardia lamblia
QAPISPPIYSVQNVPRKS

SEQ ID NO: 3194437 - protein, 17 aa, Giardia lamblia
QAPLLAYSTIEPSMQNV

SEQ ID NO: 3194438 - protein, 18 aa, Giardia lamblia
QAPPQPMLYSMTPSTSLV

SEQ ID NO: 3194439 - protein, 27 aa, Giardia lamblia
QAQAQAIQLLLRRIADLEDLTRRQQMA

SEQ ID NO: 3194440 - protein, 25 aa, Giardia lamblia
QAQRADFHIFTPERQSLPRGGDSGN

SEQ ID NO: 3194441 - protein, 25 aa, Giardia lamblia
QARCQLCLELPFNGSFDSAISPAFR

SEQ ID NO: 3194442 - protein, 17 aa, Giardia lamblia
QARLLIATELFTRGIDI

SEQ ID NO: 3194443 - protein, 27 aa, Giardia lamblia
QARTHASYVFPPAYFPIPDVYETRGFK

SEQ ID NO: 3194444 - protein, 25 aa, Giardia lamblia
QASIADPHFAGWRPKSLRGPSTPSP

SEQ ID NO: 3194445 - protein, 18 aa, Giardia lamblia
QASSLCLLVWEWIRRYEE

SEQ ID NO: 3194446 - protein, 28 aa, Giardia lamblia
QASYYPYRPLYSYDLLFSPNSLVSAGTD

SEQ ID NO: 3194447 - protein, 25 aa, Giardia lamblia
QATAKYLLYMVHRPLGDDQGFSPIQ

SEQ ID NO: 3194448 - protein, 28 aa, Giardia lamblia
QATGARFRLWMDAILRMRMFTKFDRPQT

SEQ ID NO: 3194449 - protein, 27 aa, Giardia lamblia
QATKARMLPTPAKFHYIFNLRDLSRIT

SEQ ID NO: 3194450 - protein, 25 aa, Giardia lamblia
QATKEGVWYVFVKNLPDGLTWREVQ

SEQ ID NO: 3194451 - protein, 24 aa, Giardia lamblia
QATRANVLSLYSPTAQMIFNGTHC

SEQ ID NO: 3194452 - protein, 23 aa, Giardia lamblia
QAVARRLITLTKEIDGGLVQGEE

SEQ ID NO: 3194453 - protein, 24 aa, Giardia lamblia
QAVNDGLILWQIADSLVLYLEDKC

SEQ ID NO: 3194454 - protein, 19 aa, Giardia lamblia
QAYLSTKGYYTPLTKFTGP

SEQ ID NO: 3194455 - protein, 24 aa, Giardia lamblia
QAYVPVPSMSMPPQLYSHPPALAD

SEQ ID NO: 3194456 - protein, 30 aa, Giardia lamblia
QCCKKVHAVIHMPWFVNPDAGRPKGKRLSV

SEQ ID NO: 3194457 - protein, 34 aa, Giardia lamblia
QCCVKVLSSFYFRSHLCIAFELLSINLYELLTKK

SEQ ID NO: 3194458 - protein, 38 aa, Giardia lamblia
QCFKRQQAFLPLFGYLPDQYIRYITNLYQYAQSLEKLT

SEQ ID NO: 3194459 - protein, 30 aa, Giardia lamblia
QCGWEQCVRMLLPLEWHIMHSNGLTADAFA

SEQ ID NO: 3194460 - protein, 17 aa, Giardia lamblia
QCKKPMCVRGCPVQVPI

SEQ ID NO: 3194461 - protein, 17 aa, Giardia lamblia
QCPGSGTIYLIRELCKE

SEQ ID NO: 3194462 - protein, 23 aa, Giardia lamblia
QCSQHWLRVLDPSIVKGKWTPED

SEQ ID NO: 3194463 - protein, 34 aa, Giardia lamblia
QCSRSCRIDSIYRLPFYYRFNINKQTMRCSTGST

SEQ ID NO: 3194464 - protein, 33 aa, Giardia lamblia
QCVNYRKQRWKPHYIFIKITTSSKIMTDSKPNT

SEQ ID NO: 3194465 - protein, 25 aa, Giardia lamblia
QDASRVLFALVLKDSSLNGCHIPFW

SEQ ID NO: 3194466 - protein, 24 aa, Giardia lamblia
QDCLRHPWFVNTCPTTAAASASSS

SEQ ID NO: 3194467 - protein, 20 aa, Giardia lamblia
QDCLRRVFRGSFGAERYPSI

SEQ ID NO: 3194468 - protein, 37 aa, Giardia lamblia
QDCRLDVLYFLHQVKSLFPDSLFKTILMSMSSDLQFL

SEQ ID NO: 3194469 - protein, 24 aa, Giardia lamblia
QDDNCTALIYAVEFQNFECAEILA

SEQ ID NO: 3194470 - protein, 25 aa, Giardia lamblia
QDDRAILELYRRILLQLYEQVESSA

SEQ ID NO: 3194471 - protein, 30 aa, Giardia lamblia
QDDSPMPLPNFLFRSRTLNALIDLSDIESF

SEQ ID NO: 3194472 - protein, 26 aa, Giardia lamblia
QDEIVLGWTLFRYEDKGIRRIESLLA

SEQ ID NO: 3194473 - protein, 29 aa, Giardia lamblia
QDERDVAIAWEFNLWKSAETARFEAELKK

SEQ ID NO: 3194474 - protein, 17 aa, Giardia lamblia
QDFISLKNKYEALSAQV

SEQ ID NO: 3194475 - protein, 30 aa, Giardia lamblia
QDGDLLRVRRKYLLWVSYMQIYNESINDLL

SEQ ID NO: 3194476 - protein, 22 aa, Giardia lamblia
QDGIPYLKICSSLPAFDLRSYP

SEQ ID NO: 3194477 - protein, 26 aa, Giardia lamblia
QDGLKKLWSLIKHPNLLVVTAVARAL

SEQ ID NO: 3194478 - protein, 33 aa, Giardia lamblia
QDGSYKWYEVILIDPFHPWIRNDPKINWICNPV

SEQ ID NO: 3194479 - protein, 22 aa, Giardia lamblia
QDGTLLYEVIVENLNPSAPCSP

SEQ ID NO: 3194480 - protein, 35 aa, Giardia lamblia
QDHVPEQLVWLIMTQLIEGLAYLHNPHKRNAQGIG

SEQ ID NO: 3194481 - protein, 21 aa, Giardia lamblia
QDHVTALMYAARSGHLAVVKL

SEQ ID NO: 3194482 - protein, 23 aa, Giardia lamblia
QDIFLILEQVASGLAYLYDSGKI

SEQ ID NO: 3194483 - protein, 25 aa, Giardia lamblia
QDIPLDAYTFLRQLGNTQSPGLQLE

SEQ ID NO: 3194484 - protein, 29 aa, Giardia lamblia
QDIQDSWLRLYPIYVGKYTEFFGHRATEF

SEQ ID NO: 3194485 - protein, 20 aa, Giardia lamblia
QDITRFPNCPTSLVIQGDSI

SEQ ID NO: 3194486 - protein, 21 aa, Giardia lamblia
QDIWKLMDGLCQALQFLCTSA

SEQ ID NO: 3194487 - protein, 24 aa, Giardia lamblia
QDKIPKWRGFSRRKAIAKDDNKAT

SEQ ID NO: 3194488 - protein, 25 aa, Giardia lamblia
QDKRPTIFDVIVHPLIVSAAESITS

SEQ ID NO: 3194489 - protein, 27 aa, Giardia lamblia
QDLAPLDALPPLLSFSLPVLPPKENHS

SEQ ID NO: 3194490 - protein, 22 aa, Giardia lamblia
QDLLFSIPMESIGTSPPPVPTA

SEQ ID NO: 3194491 - protein, 31 aa, Giardia lamblia
QDLLNEAARALPPLSPYVDNGLNADLEQLRA

SEQ ID NO: 3194492 - protein, 22 aa, Giardia lamblia
QDMALYHTPDYIRFLKNITPET

SEQ ID NO: 3194493 - protein, 18 aa, Giardia lamblia
QDMKRKYFSLKKKEYEQM

SEQ ID NO: 3194494 - protein, 22 aa, Giardia lamblia
QDNKKFLSKFSFVDLAGSERAK

SEQ ID NO: 3194495 - protein, 26 aa, Giardia lamblia
QDPDVTIDWLIPRLAGFSSAEISAIA

SEQ ID NO: 3194496 - protein, 21 aa, Giardia lamblia
QDPIPAAPPFTLNKADFIAKP

SEQ ID NO: 3194497 - protein, 18 aa, Giardia lamblia
QDRKFTVTPLRKSDAPPT

SEQ ID NO: 3194498 - protein, 28 aa, Giardia lamblia
QDRKRDAVVLVLDFLRAEGYVTALANLE

SEQ ID NO: 3194499 - protein, 27 aa, Giardia lamblia
QDRQSLIVDLALHLGLPQSTNETALKE

SEQ ID NO: 3194500 - protein, 26 aa, Giardia lamblia
QDRTNFDLYLRELSGLPLKSGISVAE

SEQ ID NO: 3194501 - protein, 24 aa, Giardia lamblia
QDRWTALMFAAYYGKVDVVRLLVS

SEQ ID NO: 3194502 - protein, 17 aa, Giardia lamblia
QDSLDSLYDARVPSRWL

SEQ ID NO: 3194503 - protein, 29 aa, Giardia lamblia
QDSYAVARPLYDFLFKLLEIASQVSDSEH

SEQ ID NO: 3194504 - protein, 17 aa, Giardia lamblia
QDSYGWTALMRAAENGH

SEQ ID NO: 3194505 - protein, 23 aa, Giardia lamblia
QDTPVFPPIIKGYERALMAMNAE

SEQ ID NO: 3194506 - protein, 23 aa, Giardia lamblia
QDVVEILAVHEWHLSNNAGQTAL

SEQ ID NO: 3194507 - protein, 20 aa, Giardia lamblia
QDWMDACTLVVHDVPFKVVD

SEQ ID NO: 3194508 - protein, 24 aa, Giardia lamblia
QDYIAIIYTKLPPAKRAKSSGKAS

SEQ ID NO: 3194509 - protein, 21 aa, Giardia lamblia
QEADHLLATYPADGVMLGVGL

SEQ ID NO: 3194510 - protein, 33 aa, Giardia lamblia
QEALKLPTILAHNQSLITLNFGYVPLGCVSNRS

SEQ ID NO: 3194511 - protein, 30 aa, Giardia lamblia
QECPPPLPPPLPRPNTILDFIHSPLRPIEA

SEQ ID NO: 3194512 - protein, 36 aa, Giardia lamblia
QEEAKQLIMSLYEKYIPPLIDYVLNGVKLNSSTGQI

SEQ ID NO: 3194513 - protein, 20 aa, Giardia lamblia
QEEIPEDSLFWNCTRMKLHI

SEQ ID NO: 3194514 - protein, 37 aa, Giardia lamblia
QEELINNNILPNPAPVPLYTDLPYRQYPSVTTSPHNG

SEQ ID NO: 3194515 - protein, 25 aa, Giardia lamblia
QEENVHLQNLLIARANKLASVKLQN

SEQ ID NO: 3194516 - protein, 22 aa, Giardia lamblia
QEEPSPWKPLGGRGGKTFDEIA

SEQ ID NO: 3194517 - protein, 33 aa, Giardia lamblia
QEERGIWSCCYTALVRITLPNGCYHEGIGVGNA

SEQ ID NO: 3194518 - protein, 23 aa, Giardia lamblia
QEFVMITPTLLRKCTEKFKGEDS

SEQ ID NO: 3194519 - protein, 18 aa, Giardia lamblia
QEHSGFVDDLGMTALMYA

SEQ ID NO: 3194520 - protein, 23 aa, Giardia lamblia
QEIALLEDNEELRRLLNEERKGI

SEQ ID NO: 3194521 - protein, 26 aa, Giardia lamblia
QEILRLQTLLVQLSSHMKLKVANLIT

SEQ ID NO: 3194522 - protein, 24 aa, Giardia lamblia
QEILRTEVKLLAKAVVKLQTGDIA

SEQ ID NO: 3194523 - protein, 29 aa, Giardia lamblia
QEIPFKAVSPYLYLLQKLYKDETGTSKHI

SEQ ID NO: 3194524 - protein, 33 aa, Giardia lamblia
QEISPLSIFLFNESLQHAFIPTSKTFRSIVDFL

SEQ ID NO: 3194525 - protein, 17 aa, Giardia lamblia
QEKALAKSMTDTRPPKP

SEQ ID NO: 3194526 - protein, 17 aa, Giardia lamblia
QEKDLFEFFHANDSLIN

SEQ ID NO: 3194527 - protein, 24 aa, Giardia lamblia
QEKRDLERHLADLRLSRQDTNSRL

SEQ ID NO: 3194528 - protein, 23 aa, Giardia lamblia
QEKTGWTALMMAAKNGYLKLAAL

SEQ ID NO: 3194529 - protein, 17 aa, Giardia lamblia
QEKTPLMWAAHMGATAT

SEQ ID NO: 3194530 - protein, 18 aa, Giardia lamblia
QELAGAKGLERKPLRRDL

SEQ ID NO: 3194531 - protein, 21 aa, Giardia lamblia
QELCLFIDMMLTVDFSKRPAA

SEQ ID NO: 3194532 - protein, 22 aa, Giardia lamblia
QELDYYRNMQANQPPYPGLAAQ

SEQ ID NO: 3194533 - protein, 33 aa, Giardia lamblia
QELGSKTFWARLCLSWIAFRRAPRNDPAGDAEA

SEQ ID NO: 3194534 - protein, 21 aa, Giardia lamblia
QELLRKISLLSNHLSSLLDSR

SEQ ID NO: 3194535 - protein, 17 aa, Giardia lamblia
QELLVKMFQLHKQAVKS

SEQ ID NO: 3194536 - protein, 26 aa, Giardia lamblia
QELMVATQLIFRRYPERYEGIIGILC

SEQ ID NO: 3194537 - protein, 21 aa, Giardia lamblia
QELYRRLDELSLQNAELHARV

SEQ ID NO: 3194538 - protein, 18 aa, Giardia lamblia
QEMELTWSPIHYATPFTA

SEQ ID NO: 3194539 - protein, 22 aa, Giardia lamblia
QEMIPGVYWVGIVDWMVRIFHG

SEQ ID NO: 3194540 - protein, 21 aa, Giardia lamblia
QEMLIFLKHCYGFSTELGVMT

SEQ ID NO: 3194541 - protein, 19 aa, Giardia lamblia
QEMQHLKLAVRLEEQETKS

SEQ ID NO: 3194542 - protein, 19 aa, Giardia lamblia
QENLKLLASNKQIVEKLLA

SEQ ID NO: 3194543 - protein, 17 aa, Giardia lamblia
QENLPIAYTIKVGMYDG

SEQ ID NO: 3194544 - protein, 25 aa, Giardia lamblia
QEPATLDLVLRGFEWFTQTGTEFYM

SEQ ID NO: 3194545 - protein, 19 aa, Giardia lamblia
QEPVFLETFARCLARLAGR

SEQ ID NO: 3194546 - protein, 21 aa, Giardia lamblia
QEQIIPFYTSFFDNLKTSISG

SEQ ID NO: 3194547 - protein, 24 aa, Giardia lamblia
QEQITHLIDLLYQSKAALEKMSEV

SEQ ID NO: 3194548 - protein, 29 aa, Giardia lamblia
QEQNPMFTQSFLKKYIAYAQATCTPKLDQ

SEQ ID NO: 3194549 - protein, 33 aa, Giardia lamblia
QEQPYARLTKYLLPMGIPPVRLVLLDEPLCGPV

SEQ ID NO: 3194550 - protein, 23 aa, Giardia lamblia
QEQYQRRLVLINDNLAVLAGQKL

SEQ ID NO: 3194551 - protein, 29 aa, Giardia lamblia
QERGAQNYYWMPDLTKLAGLIVHSLVAIE

SEQ ID NO: 3194552 - protein, 28 aa, Giardia lamblia
QERGYLADPAYRVLLSRCEDLGGKLLES

SEQ ID NO: 3194553 - protein, 17 aa, Giardia lamblia
QERLRELAEIQPTSYEH

SEQ ID NO: 3194554 - protein, 27 aa, Giardia lamblia
QERNVKALFVFISPPSVELLEQRLRGR

SEQ ID NO: 3194555 - protein, 22 aa, Giardia lamblia
QERPSAQALLKHPLIAANRPNS

SEQ ID NO: 3194556 - protein, 18 aa, Giardia lamblia
QERQIAIWQLKRTIEKLE

SEQ ID NO: 3194557 - protein, 21 aa, Giardia lamblia
QESFGVVRFQLATNTQLAKTA

SEQ ID NO: 3194558 - protein, 17 aa, Giardia lamblia
QESGRVYQAAAPAIVIS

SEQ ID NO: 3194559 - protein, 22 aa, Giardia lamblia
QESLHKDIINLRANFKEIHNNN

SEQ ID NO: 3194560 - protein, 27 aa, Giardia lamblia
QETDTLLPIIIPSVPPRRPSLAQQLPQ

SEQ ID NO: 3194561 - protein, 18 aa, Giardia lamblia
QETGFTRLTFEEDLLDYL

SEQ ID NO: 3194562 - protein, 24 aa, Giardia lamblia
QETPGILPIFYDDPSRMDPNVKCD

SEQ ID NO: 3194563 - protein, 23 aa, Giardia lamblia
QETSIELRILEKENRRLHEKVQE

SEQ ID NO: 3194564 - protein, 18 aa, Giardia lamblia
QEVCSGRLKFFELEYTCE

SEQ ID NO: 3194565 - protein, 22 aa, Giardia lamblia
QEYRQFLVTQIWLKDLEERRLP

SEQ ID NO: 3194566 - protein, 23 aa, Giardia lamblia
QEYSRYEALWKEYERVSTEFHNV

SEQ ID NO: 3194567 - protein, 31 aa, Giardia lamblia
QFAELELDVDLWWNIADLKRVIPVVPTSAFT

SEQ ID NO: 3194568 - protein, 26 aa, Giardia lamblia
QFAGDPMAFILLCKLFAVTDDTVTTT

SEQ ID NO: 3194569 - protein, 24 aa, Giardia lamblia
QFALDLEAFFRPEEERIVTCFHTP

SEQ ID NO: 3194570 - protein, 20 aa, Giardia lamblia
QFALKNKKIMAFSAKSADML

SEQ ID NO: 3194571 - protein, 37 aa, Giardia lamblia
QFAMRLREWMVWHFPELITIVPDNIDYARTVVVLRDR

SEQ ID NO: 3194572 - protein, 24 aa, Giardia lamblia
QFAPGLLTNFAYAFVAYACHELGA

SEQ ID NO: 3194573 - protein, 22 aa, Giardia lamblia
QFCQVGLTMLTFISAGLTFNIN

SEQ ID NO: 3194574 - protein, 23 aa, Giardia lamblia
QFDKMWEEYWKTQQMKLVESGMQ

SEQ ID NO: 3194575 - protein, 18 aa, Giardia lamblia
QFDRCVTLYLNPRQRLRK

SEQ ID NO: 3194576 - protein, 20 aa, Giardia lamblia
QFDTLPLRYDTHDLIREGDL

SEQ ID NO: 3194577 - protein, 19 aa, Giardia lamblia
QFDVLTTPTEKWLYLTRLQ

SEQ ID NO: 3194578 - protein, 21 aa, Giardia lamblia
QFERTCFHPMVLIKETATVSD

SEQ ID NO: 3194579 - protein, 24 aa, Giardia lamblia
QFERVHSLIYYNGSLFTIVEQSVA

SEQ ID NO: 3194580 - protein, 25 aa, Giardia lamblia
QFFDTLSEHLLLSFQSICGCKYGSH

SEQ ID NO: 3194581 - protein, 18 aa, Giardia lamblia
QFFKNFRCERACSLGVRT

SEQ ID NO: 3194582 - protein, 19 aa, Giardia lamblia
QFHSALTLLEYTTVRLIGE

SEQ ID NO: 3194583 - protein, 22 aa, Giardia lamblia
QFIQKWKPLYQNTVDLLLQPVK

SEQ ID NO: 3194584 - protein, 27 aa, Giardia lamblia
QFKPTVVHLFMRLLEKRGQLQRIYTQN

SEQ ID NO: 3194585 - protein, 19 aa, Giardia lamblia
QFLADLFIKREEEIYAATE

SEQ ID NO: 3194586 - protein, 36 aa, Giardia lamblia
QFPEIHAIALNKGLIPVCYRIIYGSLTPVIEGDASR

SEQ ID NO: 3194587 - protein, 19 aa, Giardia lamblia
QFRCILIVCKIVTANYSTI

SEQ ID NO: 3194588 - protein, 33 aa, Giardia lamblia
QFRTIGRDPYQFLPSIWNIFRKDEKLPRSLAHF

SEQ ID NO: 3194589 - protein, 25 aa, Giardia lamblia
QFSNYLCFTELMRSALFPCTMQLQE

SEQ ID NO: 3194590 - protein, 19 aa, Giardia lamblia
QFTDSWYILHSENVLYRNG

SEQ ID NO: 3194591 - protein, 27 aa, Giardia lamblia
QFTGVIEMYATLLGSFRAAEKKLERLS

SEQ ID NO: 3194592 - protein, 19 aa, Giardia lamblia
QFVLEELTVIGSLKTDRMT

SEQ ID NO: 3194593 - protein, 30 aa, Giardia lamblia
QFVQLRKQFRLWLLADLHYQVLTLLDSNCT

SEQ ID NO: 3194594 - protein, 26 aa, Giardia lamblia
QFVTCYIRLFYYRKATLSKAELTLPD

SEQ ID NO: 3194595 - protein, 28 aa, Giardia lamblia
QFVVCGIMQVIQRMFKFDIQFTTEVLPD

SEQ ID NO: 3194596 - protein, 18 aa, Giardia lamblia
QFYRDSYNSLLEKHKQLA

SEQ ID NO: 3194597 - protein, 25 aa, Giardia lamblia
QGAIKPVARRPLAPEPTLTVMEPTE

SEQ ID NO: 3194598 - protein, 24 aa, Giardia lamblia
QGATDPVFLNPTTGLHASVSKPSD

SEQ ID NO: 3194599 - protein, 27 aa, Giardia lamblia
QGATMLMKAAWYSRPQFVLDLKARLLG

SEQ ID NO: 3194600 - protein, 26 aa, Giardia lamblia
QGATPKMRKPPLKARAYTVEDIALAR

SEQ ID NO: 3194601 - protein, 21 aa, Giardia lamblia
QGDHLLLLKILDAYAELKKDR

SEQ ID NO: 3194602 - protein, 25 aa, Giardia lamblia
QGDKLAYTPLLAILADGTAVELDFL

SEQ ID NO: 3194603 - protein, 24 aa, Giardia lamblia
QGDSYHFVVGMFSFPLKTNKYSVD

SEQ ID NO: 3194604 - protein, 24 aa, Giardia lamblia
QGELVAIVLRRGIIAALSVTKLPG

SEQ ID NO: 3194605 - protein, 24 aa, Giardia lamblia
QGETALMFAAINGYTELVRMLKDR

SEQ ID NO: 3194606 - protein, 20 aa, Giardia lamblia
QGFAIPKLYNKVQYCVSCSI

SEQ ID NO: 3194607 - protein, 25 aa, Giardia lamblia
QGFPMYQGVLKSQRARLLLRQGAKC

SEQ ID NO: 3194608 - protein, 17 aa, Giardia lamblia
QGHLRTSGHYMCYIDPA

SEQ ID NO: 3194609 - protein, 20 aa, Giardia lamblia
QGHTALYYALYSEHYDVARI

SEQ ID NO: 3194610 - protein, 26 aa, Giardia lamblia
QGICELQSGLLFIDEAHLLDLECFSF

SEQ ID NO: 3194611 - protein, 19 aa, Giardia lamblia
QGIPITIRNVLLAYEMAKV

SEQ ID NO: 3194612 - protein, 21 aa, Giardia lamblia
QGISQHFTQFLNSGKWGTGKI

SEQ ID NO: 3194613 - protein, 21 aa, Giardia lamblia
QGIYLGILSIGELQSFFSILR

SEQ ID NO: 3194614 - protein, 19 aa, Giardia lamblia
QGKFKVIYLDLNPQSTDVD

SEQ ID NO: 3194615 - protein, 23 aa, Giardia lamblia
QGKILPTLILNSASHILLQDTVA

SEQ ID NO: 3194616 - protein, 24 aa, Giardia lamblia
QGKPPTDLTIPASSPRLLLSGIQG

SEQ ID NO: 3194617 - protein, 25 aa, Giardia lamblia
QGKREPWRGILLYGCPGTGKSFLAK

SEQ ID NO: 3194618 - protein, 19 aa, Giardia lamblia
QGLDIFGKSIADTSIRLPS

SEQ ID NO: 3194619 - protein, 20 aa, Giardia lamblia
QGLGIAPTRALKSASQPLNA

SEQ ID NO: 3194620 - protein, 26 aa, Giardia lamblia
QGLPAFREYLTKLIYQLSISPCSEDS

SEQ ID NO: 3194621 - protein, 20 aa, Giardia lamblia
QGLPQHRPTFEPITVLERRV

SEQ ID NO: 3194622 - protein, 25 aa, Giardia lamblia
QGLRLLHPFMPFLSEELFQHLPRWS

SEQ ID NO: 3194623 - protein, 17 aa, Giardia lamblia
QGLWLLIHAGFQETFEQ

SEQ ID NO: 3194624 - protein, 18 aa, Giardia lamblia
QGMSALIFAVYRGDVPLV

SEQ ID NO: 3194625 - protein, 25 aa, Giardia lamblia
QGNRALLELLVPHELELLYNDGFTE

SEQ ID NO: 3194626 - protein, 24 aa, Giardia lamblia
QGNTDIIRILMGYEQKLTNNAGET

SEQ ID NO: 3194627 - protein, 22 aa, Giardia lamblia
QGPPHGLGFGAGQRKVYGATSS

SEQ ID NO: 3194628 - protein, 25 aa, Giardia lamblia
QGPTRLQLFDPIFSPLSALSSNPTE

SEQ ID NO: 3194629 - protein, 24 aa, Giardia lamblia
QGQDLYQTPSLKDIRIQDGKTVNI

SEQ ID NO: 3194630 - protein, 17 aa, Giardia lamblia
QGRLFTGLVVLPASTKN

SEQ ID NO: 3194631 - protein, 26 aa, Giardia lamblia
QGRVKGLLRVAKISRRILFDKEPDLI

SEQ ID NO: 3194632 - protein, 23 aa, Giardia lamblia
QGSPIVFETLLNKLRSLCVPIKV

SEQ ID NO: 3194633 - protein, 27 aa, Giardia lamblia
QGSSDPELLTLYLLTTFVSQYGHNHQL

SEQ ID NO: 3194634 - protein, 23 aa, Giardia lamblia
QGVTALMYLAMTGGRISKNCLRP

SEQ ID NO: 3194635 - protein, 25 aa, Giardia lamblia
QGWDIKDRWYAGASALHFAAHGNQK

SEQ ID NO: 3194636 - protein, 21 aa, Giardia lamblia
QGYALQHLPGNIPGPTPSNPS

SEQ ID NO: 3194637 - protein, 29 aa, Giardia lamblia
QHDNRAFQIPLLGIAGRPFLTLMGDDLSR

SEQ ID NO: 3194638 - protein, 31 aa, Giardia lamblia
QHDQKLADTWILYETNRIWKRIPESDLTPQP

SEQ ID NO: 3194639 - protein, 18 aa, Giardia lamblia
QHDYASLLLPEQWIQPRE

SEQ ID NO: 3194640 - protein, 19 aa, Giardia lamblia
QHFLQLVDTLLEIIHHRQL

SEQ ID NO: 3194641 - protein, 22 aa, Giardia lamblia
QHISGMLSLISYTIEFGTATLH

SEQ ID NO: 3194642 - protein, 33 aa, Giardia lamblia
QHKRISRFNFLPPYLFVVINRFLWEEQAQRRLK

SEQ ID NO: 3194643 - protein, 18 aa, Giardia lamblia
QHLKLVIDNLTAELREKD

SEQ ID NO: 3194644 - protein, 20 aa, Giardia lamblia
QHLRRELHLGWLQYEPYAPG

SEQ ID NO: 3194645 - protein, 22 aa, Giardia lamblia
QHLVAPEMLLCKHGVFTPVPYQ

SEQ ID NO: 3194646 - protein, 27 aa, Giardia lamblia
QHLVLREKEHISKDAKTALILAAQNKH

SEQ ID NO: 3194647 - protein, 31 aa, Giardia lamblia
QHLYTPVCLQIPSTLPVPRHAFGAITTSTGT

SEQ ID NO: 3194648 - protein, 20 aa, Giardia lamblia
QHMCDILATVPFPGTEYFQA

SEQ ID NO: 3194649 - protein, 23 aa, Giardia lamblia
QHNALDAIHLLRQELWGQTDLKG

SEQ ID NO: 3194650 - protein, 33 aa, Giardia lamblia
QHNNHICLVFPKYGISLLDLLKANNFRGFNIDW

SEQ ID NO: 3194651 - protein, 26 aa, Giardia lamblia
QHNNVDFVSLLIPYEARMIDREGRTA

SEQ ID NO: 3194652 - protein, 19 aa, Giardia lamblia
QHQGAILTIRDRVLNYILS

SEQ ID NO: 3194653 - protein, 18 aa, Giardia lamblia
QHRHLFTPYAASYKTTGD

SEQ ID NO: 3194654 - protein, 24 aa, Giardia lamblia
QHSKAHLLAQFKDDLFSLFNTVPM

SEQ ID NO: 3194655 - protein, 23 aa, Giardia lamblia
QHSQTLYSLRAFPPKKVRRASNM

SEQ ID NO: 3194656 - protein, 25 aa, Giardia lamblia
QHTDKPACLPLPQADSPFGSAAHQE

SEQ ID NO: 3194657 - protein, 23 aa, Giardia lamblia
QHTQMLSEYERRLREKDSVVDEL

SEQ ID NO: 3194658 - protein, 17 aa, Giardia lamblia
QHVLVHYKIIREPDMIL

SEQ ID NO: 3194659 - protein, 25 aa, Giardia lamblia
QHYISKESLLFLVLARNMLGNVYPE

SEQ ID NO: 3194660 - protein, 23 aa, Giardia lamblia
QHYTPLMIAIISNQLHTARIVYK

SEQ ID NO: 3194661 - protein, 23 aa, Giardia lamblia
QIAAGLSWLHSPFNGVGVVPHCN

SEQ ID NO: 3194662 - protein, 22 aa, Giardia lamblia
QIAFTFPYPLNEIFLRMRELRA

SEQ ID NO: 3194663 - protein, 17 aa, Giardia lamblia
QICRRKLTLSDDAIWGI

SEQ ID NO: 3194664 - protein, 29 aa, Giardia lamblia
QIDGRGYDICWIPGFRLTTATLRGKLGLQ

SEQ ID NO: 3194665 - protein, 18 aa, Giardia lamblia
QIDYLYKEMTEYQRKLRI

SEQ ID NO: 3194666 - protein, 21 aa, Giardia lamblia
QIEVVSPLRLIYATSDISMVS

SEQ ID NO: 3194667 - protein, 18 aa, Giardia lamblia
QIFTWLYSHDFKYDSKSN

SEQ ID NO: 3194668 - protein, 26 aa, Giardia lamblia
QIGCFVPCEAAYIPIQKRLSIRLGTG

SEQ ID NO: 3194669 - protein, 26 aa, Giardia lamblia
QIGMRRINAFVFFNELCDWTAYGRFV

SEQ ID NO: 3194670 - protein, 30 aa, Giardia lamblia
QIGRIVHRRLTPRNILFNNVNQLKISNFSI

SEQ ID NO: 3194671 - protein, 26 aa, Giardia lamblia
QIHMAPRLSLPESLRGSFCCHMSEST

SEQ ID NO: 3194672 - protein, 20 aa, Giardia lamblia
QIHVSTVRYILLSSTTSYGR

SEQ ID NO: 3194673 - protein, 20 aa, Giardia lamblia
QIIACACFISIMSALSSVNA

SEQ ID NO: 3194674 - protein, 17 aa, Giardia lamblia
QIIDSVFRGFNATILAY

SEQ ID NO: 3194675 - protein, 17 aa, Giardia lamblia
QIIKDHLNLVLQYSYQL

SEQ ID NO: 3194676 - protein, 19 aa, Giardia lamblia
QIIYTIYKRYGGTSILMPF

SEQ ID NO: 3194677 - protein, 18 aa, Giardia lamblia
QIKDRPSNMFYPSRALSG

SEQ ID NO: 3194678 - protein, 24 aa, Giardia lamblia
QIKGGSIFDRLTDPSTYQASHRAR

SEQ ID NO: 3194679 - protein, 17 aa, Giardia lamblia
QILANKIENYKALLLTK

SEQ ID NO: 3194680 - protein, 24 aa, Giardia lamblia
QILATHPYPKRLPGQRTRMMNACM

SEQ ID NO: 3194681 - protein, 25 aa, Giardia lamblia
QILCALKYCHSPAKPGFAVGKKVVH

SEQ ID NO: 3194682 - protein, 20 aa, Giardia lamblia
QILIPYEVGLTTDNGWTSLM

SEQ ID NO: 3194683 - protein, 19 aa, Giardia lamblia
QILLSKSPYHKVQPSIALY

SEQ ID NO: 3194684 - protein, 24 aa, Giardia lamblia
QILSALMYVYHPRKKQRGTGPDVP

SEQ ID NO: 3194685 - protein, 19 aa, Giardia lamblia
QILYVVADYFKHSNLSAYC

SEQ ID NO: 3194686 - protein, 21 aa, Giardia lamblia
QIMETIDLYFKPYYHSQEVVG

SEQ ID NO: 3194687 - protein, 26 aa, Giardia lamblia
QIMLSNTYFLNLRPGIQKLNELGGLH

SEQ ID NO: 3194688 - protein, 30 aa, Giardia lamblia
QINHLNAVPLPPRAGPFSAGPPTLPAVPVT

SEQ ID NO: 3194689 - protein, 28 aa, Giardia lamblia
QINPATRSILILSKIRTLLSFLKHLLPI

SEQ ID NO: 3194690 - protein, 34 aa, Giardia lamblia
QIPIEGQIHFGWHAFPKPTPLILAAGHGHLDCVR

SEQ ID NO: 3194691 - protein, 31 aa, Giardia lamblia
QIPKEVLNRLDAYSPLYSEKYAHLTKKDREF

SEQ ID NO: 3194692 - protein, 24 aa, Giardia lamblia
QIPMLGNLLSLWRTAANAQQTIKI

SEQ ID NO: 3194693 - protein, 20 aa, Giardia lamblia
QIPQFLLEGGYSSLAYPYMM

SEQ ID NO: 3194694 - protein, 19 aa, Giardia lamblia
QIPVTYILKRFYATLDPVH

SEQ ID NO: 3194695 - protein, 17 aa, Giardia lamblia
QIQLKADADQVRRALWT

SEQ ID NO: 3194696 - protein, 24 aa, Giardia lamblia
QIQSAYAEFLPIYLRNNQQLRDKS

SEQ ID NO: 3194697 - protein, 19 aa, Giardia lamblia
QIRPFFGILPDRKTMDVIN

SEQ ID NO: 3194698 - protein, 22 aa, Giardia lamblia
QIRRMFLTYFDDPATYFRDKDA

SEQ ID NO: 3194699 - protein, 19 aa, Giardia lamblia
QIRSLWMKSRRSSIAELLP

SEQ ID NO: 3194700 - protein, 29 aa, Giardia lamblia
QISAQLPYNSKLLQSLVAKLVPELLPYFR

SEQ ID NO: 3194701 - protein, 20 aa, Giardia lamblia
QISEAIRYFLQSSVQNFNAL

SEQ ID NO: 3194702 - protein, 29 aa, Giardia lamblia
QISERIVQVQWLPPANGALFLLTTNERTV

SEQ ID NO: 3194703 - protein, 22 aa, Giardia lamblia
QISILTSAGFVPLSMDAVRIYQ

SEQ ID NO: 3194704 - protein, 28 aa, Giardia lamblia
QISPTNADLLPLLESLAHILEDATKNDY

SEQ ID NO: 3194705 - protein, 17 aa, Giardia lamblia
QISYLLQDMERYARRIH

SEQ ID NO: 3194706 - protein, 22 aa, Giardia lamblia
QIVLRQVFVERNKAFFARFKEQ

SEQ ID NO: 3194707 - protein, 20 aa, Giardia lamblia
QIVPLFRDKKTWGKMALNNC

SEQ ID NO: 3194708 - protein, 26 aa, Giardia lamblia
QIVQRQMIILLRLQMLDTAFGLFSEN

SEQ ID NO: 3194709 - protein, 27 aa, Giardia lamblia
QIWAIIGQLCLALKAVYTALGSLQTSA

SEQ ID NO: 3194710 - protein, 22 aa, Giardia lamblia
QIYAGQPPLLYLQDRESHIGST

SEQ ID NO: 3194711 - protein, 27 aa, Giardia lamblia
QIYHTPLAPVTGLLKYYDLHTYKDGFV

SEQ ID NO: 3194712 - protein, 20 aa, Giardia lamblia
QIYRLKQDLNRFRMLYMREV

SEQ ID NO: 3194713 - protein, 26 aa, Giardia lamblia
QKAVKQLIVLLAGELDFIPKLEQAGV

SEQ ID NO: 3194714 - protein, 25 aa, Giardia lamblia
QKCRFTVPRAFWEAVRDPWDPVFKE

SEQ ID NO: 3194715 - protein, 30 aa, Giardia lamblia
QKDLLRIINTLLLSPKFYQHWLTSNHVSYL

SEQ ID NO: 3194716 - protein, 21 aa, Giardia lamblia
QKDNIQLMLKPGGGQQAPPID

SEQ ID NO: 3194717 - protein, 20 aa, Giardia lamblia
QKEIDILKISLATAENTIST

SEQ ID NO: 3194718 - protein, 19 aa, Giardia lamblia
QKEIILKTMGLDNEFIAYA

SEQ ID NO: 3194719 - protein, 23 aa, Giardia lamblia
QKGFIEFFIHQGRSTSLIKDVTL

SEQ ID NO: 3194720 - protein, 26 aa, Giardia lamblia
QKGHRRIIQLLARFEAKRQRVSGETA

SEQ ID NO: 3194721 - protein, 23 aa, Giardia lamblia
QKGIKSLPPLSTDRKLILTMDNI

SEQ ID NO: 3194722 - protein, 24 aa, Giardia lamblia
QKHDGWSALMYAAAYGYGDCVEYL

SEQ ID NO: 3194723 - protein, 17 aa, Giardia lamblia
QKHFRIALKADIRLNMP

SEQ ID NO: 3194724 - protein, 22 aa, Giardia lamblia
QKHNIYLFKMQTLFISCVARPR

SEQ ID NO: 3194725 - protein, 31 aa, Giardia lamblia
QKHNVYLFRMRMLFIQTYKKQIYDLFLSYCM

SEQ ID NO: 3194726 - protein, 25 aa, Giardia lamblia
QKHRDAQPLLKLLDEQFSHMPPEEV

SEQ ID NO: 3194727 - protein, 22 aa, Giardia lamblia
QKIRSTLFFMADVFELHVYFDD

SEQ ID NO: 3194728 - protein, 24 aa, Giardia lamblia
QKIVALQWMMMGNYAFREELLPMA

SEQ ID NO: 3194729 - protein, 26 aa, Giardia lamblia
QKIVRKYQMYLVAYRRNSSNIEILKL

SEQ ID NO: 3194730 - protein, 19 aa, Giardia lamblia
QKKDHPVFSFGSMSASTTQ

SEQ ID NO: 3194731 - protein, 22 aa, Giardia lamblia
QKLFDTTILIRNRLYRGQTLFY

SEQ ID NO: 3194732 - protein, 25 aa, Giardia lamblia
QKLHPVSSPLSLSPPLLAPDGRIFC

SEQ ID NO: 3194733 - protein, 25 aa, Giardia lamblia
QKMKTYYTGIITSNLDLIKSLKDEL

SEQ ID NO: 3194734 - protein, 17 aa, Giardia lamblia
QKNFRPWIVHNLPQITK

SEQ ID NO: 3194735 - protein, 17 aa, Giardia lamblia
QKNTDILVYEDLEFLRP

SEQ ID NO: 3194736 - protein, 17 aa, Giardia lamblia
QKPFSLNTPFRVDSLPP

SEQ ID NO: 3194737 - protein, 20 aa, Giardia lamblia
QKPLMLAPMCTVGTIPFRRL

SEQ ID NO: 3194738 - protein, 26 aa, Giardia lamblia
QKPYNKFERFTPRQFLSSTSISYTFR

SEQ ID NO: 3194739 - protein, 30 aa, Giardia lamblia
QKQERFIRERPLILVGTPGRLYDISRSNAF

SEQ ID NO: 3194740 - protein, 34 aa, Giardia lamblia
QKRIAEFAVYFSTYFYSMMSYVTDFYVTITGHSK

SEQ ID NO: 3194741 - protein, 26 aa, Giardia lamblia
QKRIFRRFFWRWHHIFSLACEQRSLE

SEQ ID NO: 3194742 - protein, 19 aa, Giardia lamblia
QKRLLAECILWKATEIDYL

SEQ ID NO: 3194743 - protein, 33 aa, Giardia lamblia
QKRMQPICELSLHGCEHLLRAPFTGSINGRAVG

SEQ ID NO: 3194744 - protein, 25 aa, Giardia lamblia
QKRRIPITIRSVLFAYELAKTAVRK

SEQ ID NO: 3194745 - protein, 20 aa, Giardia lamblia
QKRRLAIRKYYKLNPKSQLK

SEQ ID NO: 3194746 - protein, 20 aa, Giardia lamblia
QKSHLLEHSAHMDRRSSAHN

SEQ ID NO: 3194747 - protein, 19 aa, Giardia lamblia
QKSISSPLPLSVPSAMPAS

SEQ ID NO: 3194748 - protein, 25 aa, Giardia lamblia
QKSLLPFVRDFVLTAFRLAAGIPDM

SEQ ID NO: 3194749 - protein, 22 aa, Giardia lamblia
QKSYLFYRQRYRKIDPIPGVHV

SEQ ID NO: 3194750 - protein, 21 aa, Giardia lamblia
QKTCKLLSPSSKAPLPVIIPK

SEQ ID NO: 3194751 - protein, 30 aa, Giardia lamblia
QKTEPKLVCRMLIRLGAWYSDLLTPLDHKS

SEQ ID NO: 3194752 - protein, 31 aa, Giardia lamblia
QKTQDVPVYWVPWFGVWIYHGCECTRDLGAV

SEQ ID NO: 3194753 - protein, 27 aa, Giardia lamblia
QKTTALPALDPLLFQSPPSILKHVVAQ

SEQ ID NO: 3194754 - protein, 22 aa, Giardia lamblia
QKYNRALVTIKAMRLTAGLDCV

SEQ ID NO: 3194755 - protein, 25 aa, Giardia lamblia
QLAMQSLIKYQPKSPLKYLSSYFGD

SEQ ID NO: 3194756 - protein, 24 aa, Giardia lamblia
QLANGIMRLSPILQNKEVELKTRP

SEQ ID NO: 3194757 - protein, 24 aa, Giardia lamblia
QLATRAALATTPYYNPVAAQAAAT

SEQ ID NO: 3194758 - protein, 17 aa, Giardia lamblia
QLAYLTGLGLLPASFRR

SEQ ID NO: 3194759 - protein, 27 aa, Giardia lamblia
QLCADYKVKFLGRVPLDPQLTKASESG

SEQ ID NO: 3194760 - protein, 17 aa, Giardia lamblia
QLCISSHIKSIMDALDL

SEQ ID NO: 3194761 - protein, 31 aa, Giardia lamblia
QLCKDDLVYLPRRFYNQLGGLGPLCIVSKVN

SEQ ID NO: 3194762 - protein, 27 aa, Giardia lamblia
QLCTHPKIVFYLTHNIQLQGISVAHPE

SEQ ID NO: 3194763 - protein, 20 aa, Giardia lamblia
QLCVKYDSMKLFLETEARSL

SEQ ID NO: 3194764 - protein, 22 aa, Giardia lamblia
QLDFHHYLPIFFEGLREKDHPY

SEQ ID NO: 3194765 - protein, 20 aa, Giardia lamblia
QLDFMAVRDLVPILAELIFT

SEQ ID NO: 3194766 - protein, 20 aa, Giardia lamblia
QLDFNLPSKDRFDLLYSVYD

SEQ ID NO: 3194767 - protein, 32 aa, Giardia lamblia
QLDFPDIESIIQDKLCLLQQINEFHASIDDRG

SEQ ID NO: 3194768 - protein, 28 aa, Giardia lamblia
QLDIKAYRKFCKQLVILAAEQQKLKQGL

SEQ ID NO: 3194769 - protein, 21 aa, Giardia lamblia
QLDRPSYPAVLLFIDEIDSEQ

SEQ ID NO: 3194770 - protein, 25 aa, Giardia lamblia
QLDVALYFRELVLAEIIVNRIKEKT

SEQ ID NO: 3194771 - protein, 26 aa, Giardia lamblia
QLEDVYQCILLNKIPRMITDVCYPTL

SEQ ID NO: 3194772 - protein, 23 aa, Giardia lamblia
QLEHPVLLRHFKIDQGIANKCFV

SEQ ID NO: 3194773 - protein, 18 aa, Giardia lamblia
QLELAINAVFRSWTNPRA

SEQ ID NO: 3194774 - protein, 19 aa, Giardia lamblia
QLELYGTSNVFLKEILFEC

SEQ ID NO: 3194775 - protein, 25 aa, Giardia lamblia
QLENEAVDFFLPENRLRSDLAAPSF

SEQ ID NO: 3194776 - protein, 27 aa, Giardia lamblia
QLERFETAMFLLDYPQQPLTSTKILKL

SEQ ID NO: 3194777 - protein, 21 aa, Giardia lamblia
QLEVSILEMGLPLSECTGPAS

SEQ ID NO: 3194778 - protein, 23 aa, Giardia lamblia
QLFKIFEVLGLPDDTTWPGVTAL

SEQ ID NO: 3194779 - protein, 26 aa, Giardia lamblia
QLGRLLLSILNVLHRAFGEYEQLAQF

SEQ ID NO: 3194780 - protein, 18 aa, Giardia lamblia
QLHLLRDSNPNYYTGHYA

SEQ ID NO: 3194781 - protein, 26 aa, Giardia lamblia
QLHPKAMVLYGYDMPPLLPSKDRQAV

SEQ ID NO: 3194782 - protein, 23 aa, Giardia lamblia
QLHQEILSKYDNLPIPRRDSAAG

SEQ ID NO: 3194783 - protein, 20 aa, Giardia lamblia
QLIIVGLTRPDTTALLTVLR

SEQ ID NO: 3194784 - protein, 25 aa, Giardia lamblia
QLIKFLNQWCYGAPFTPFEACLACT

SEQ ID NO: 3194785 - protein, 31 aa, Giardia lamblia
QLIPKPLSIDSFPWPIPSTPSFFWHVQGTHE

SEQ ID NO: 3194786 - protein, 22 aa, Giardia lamblia
QLIPYGSFVTRIFLPDGDIDLA

SEQ ID NO: 3194787 - protein, 23 aa, Giardia lamblia
QLKALLSADTDDLLRALRMDNQT

SEQ ID NO: 3194788 - protein, 27 aa, Giardia lamblia
QLKEGAESLAWLKAATARYIEAVQQEL

SEQ ID NO: 3194789 - protein, 26 aa, Giardia lamblia
QLKEKEEFIMSLSVGSVLAESSRRPT

SEQ ID NO: 3194790 - protein, 27 aa, Giardia lamblia
QLKLAEVAARQRLLLNYEAYCADFKPV

SEQ ID NO: 3194791 - protein, 17 aa, Giardia lamblia
QLKLYLENVGYASKNIF

SEQ ID NO: 3194792 - protein, 31 aa, Giardia lamblia
QLKMCTYNMVYFGFYSLFDGLLEDDQGFLVG

SEQ ID NO: 3194793 - protein, 29 aa, Giardia lamblia
QLKQRDALFFELLGLYEKLLRGNNGEEEQ

SEQ ID NO: 3194794 - protein, 19 aa, Giardia lamblia
QLKTAYLWSNYHMLSPIYD

SEQ ID NO: 3194795 - protein, 18 aa, Giardia lamblia
QLKTSLLRTIAALKHETD

SEQ ID NO: 3194796 - protein, 21 aa, Giardia lamblia
QLLDVYVFMRDTYGLIIDIFC

SEQ ID NO: 3194797 - protein, 18 aa, Giardia lamblia
QLLHLRIVLRSYIELGVV

SEQ ID NO: 3194798 - protein, 20 aa, Giardia lamblia
QLLKILYKQGSASARDFDPK

SEQ ID NO: 3194799 - protein, 18 aa, Giardia lamblia
QLLLPMEVSLTTTTGETV

SEQ ID NO: 3194800 - protein, 19 aa, Giardia lamblia
QLLSAYMKSIQGSIALFAE

SEQ ID NO: 3194801 - protein, 20 aa, Giardia lamblia
QLLSEYAYYLKSGGFLFVCS

SEQ ID NO: 3194802 - protein, 28 aa, Giardia lamblia
QLLVEKSARLLNLARKTALMQCVCSDYS

SEQ ID NO: 3194803 - protein, 33 aa, Giardia lamblia
QLMNIPPQHHSFLSPDFIFINEHTRMASIVAVG

SEQ ID NO: 3194804 - protein, 26 aa, Giardia lamblia
QLMNQHISFVPLFYNQKIICYRRINH

SEQ ID NO: 3194805 - protein, 19 aa, Giardia lamblia
QLNEYMNIKVAFESYQREK

SEQ ID NO: 3194806 - protein, 17 aa, Giardia lamblia
QLNFYRTLCSTNSGERQ

SEQ ID NO: 3194807 - protein, 36 aa, Giardia lamblia
QLNSYMRSKGLPPISFQRMFVGSNVLAPYIISSAIV

SEQ ID NO: 3194808 - protein, 20 aa, Giardia lamblia
QLNTILNFMLASNPAKRFSA

SEQ ID NO: 3194809 - protein, 30 aa, Giardia lamblia
QLNTRTRLICRAWVSLLRYTRRAEKIRAMV

SEQ ID NO: 3194810 - protein, 17 aa, Giardia lamblia
QLPFIQRIMQEKIAGRS

SEQ ID NO: 3194811 - protein, 17 aa, Giardia lamblia
QLQDLLDTRTKNLRIRE

SEQ ID NO: 3194812 - protein, 17 aa, Giardia lamblia
QLQLKLRDSLTRLDSQQ

SEQ ID NO: 3194813 - protein, 26 aa, Giardia lamblia
QLQSEALFIVPFLNILGASPGSPILL

SEQ ID NO: 3194814 - protein, 20 aa, Giardia lamblia
QLRGFAWVRIPKDAYSPLPS

SEQ ID NO: 3194815 - protein, 26 aa, Giardia lamblia
QLRGNLTMLVTIVSAFYPSVPTTIQF

SEQ ID NO: 3194816 - protein, 35 aa, Giardia lamblia
QLRKRAYTELLSFIQIYTALDHRGLMRYRAIETEP

SEQ ID NO: 3194817 - protein, 18 aa, Giardia lamblia
QLRPFPDPQKQVHSFGIS

SEQ ID NO: 3194818 - protein, 19 aa, Giardia lamblia
QLRRFHMLIIMRRRQYVLA

SEQ ID NO: 3194819 - protein, 24 aa, Giardia lamblia
QLRVGFLNCIKYICGLAYTSVTKI

SEQ ID NO: 3194820 - protein, 36 aa, Giardia lamblia
QLRVVKKAPLMFQMIIKWGGYLSIAGLRQSFLMGKQ

SEQ ID NO: 3194821 - protein, 23 aa, Giardia lamblia
QLRYNFDTYLDRALELYERSKAQ

SEQ ID NO: 3194822 - protein, 33 aa, Giardia lamblia
QLSDRKITVPLHLLKVALPLYSKQSTQVEYVPT

SEQ ID NO: 3194823 - protein, 25 aa, Giardia lamblia
QLSGTALLLNPPLATKPKPASEKDS

SEQ ID NO: 3194824 - protein, 21 aa, Giardia lamblia
QLSLFISVYDQIFTGTPDNIK

SEQ ID NO: 3194825 - protein, 30 aa, Giardia lamblia
QLSPEYSLMLGKPLYHAAIGDYDWIKRHIK

SEQ ID NO: 3194826 - protein, 17 aa, Giardia lamblia
QLSPRKPALYYAIRGQN

SEQ ID NO: 3194827 - protein, 17 aa, Giardia lamblia
QLSQLTREFLDLAPANL

SEQ ID NO: 3194828 - protein, 21 aa, Giardia lamblia
QLSYLNFYIMQTRIHRIYASP

SEQ ID NO: 3194829 - protein, 25 aa, Giardia lamblia
QLTPVQTVVPMLLVHGYNVICSAPT

SEQ ID NO: 3194830 - protein, 17 aa, Giardia lamblia
QLTRRLGFLFGLNDTIP

SEQ ID NO: 3194831 - protein, 20 aa, Giardia lamblia
QLTYLLQDALGGNAMTCMVA

SEQ ID NO: 3194832 - protein, 17 aa, Giardia lamblia
QLVAKMTCAYLWGFNVS

SEQ ID NO: 3194833 - protein, 20 aa, Giardia lamblia
QLVDNLLLSYLKNCKLYVSS

SEQ ID NO: 3194834 - protein, 18 aa, Giardia lamblia
QLVELRRTILQRQNAIST

SEQ ID NO: 3194835 - protein, 23 aa, Giardia lamblia
QLVLKDVLLPKQVPIRVLSLGRD

SEQ ID NO: 3194836 - protein, 26 aa, Giardia lamblia
QLVSLMGRDLPWAEHDFLLNLATEKF

SEQ ID NO: 3194837 - protein, 18 aa, Giardia lamblia
QLVVIIPSQYTSATSFLS

SEQ ID NO: 3194838 - protein, 20 aa, Giardia lamblia
QLYCFSRAYTRMLSGQCVTF

SEQ ID NO: 3194839 - protein, 18 aa, Giardia lamblia
QLYELVVAYKQQYFSDIT

SEQ ID NO: 3194840 - protein, 21 aa, Giardia lamblia
QLYIQETALWYAMHLQQALSL

SEQ ID NO: 3194841 - protein, 21 aa, Giardia lamblia
QMCEYSLPFYWNGIEDIHKDL

SEQ ID NO: 3194842 - protein, 19 aa, Giardia lamblia
QMDNLQRQIVKIELELVES

SEQ ID NO: 3194843 - protein, 27 aa, Giardia lamblia
QMEDSSLISILLPYSAAELNLYNQNAL

SEQ ID NO: 3194844 - protein, 19 aa, Giardia lamblia
QMEILSTNYSRLIEQHEKT

SEQ ID NO: 3194845 - protein, 26 aa, Giardia lamblia
QMESHFLQKMGYYIAYTRAMALSGSI

SEQ ID NO: 3194846 - protein, 24 aa, Giardia lamblia
QMGNAALFNILLHYEQYVLDEQGA

SEQ ID NO: 3194847 - protein, 19 aa, Giardia lamblia
QMITSLGPVWFAPCTELDK

SEQ ID NO: 3194848 - protein, 19 aa, Giardia lamblia
QMLAPRDVLLSVLTAIDKC

SEQ ID NO: 3194849 - protein, 19 aa, Giardia lamblia
QMLKAKGISLPPSLIKDAA

SEQ ID NO: 3194850 - protein, 27 aa, Giardia lamblia
QMLVKRIYEMILTKLINTKFEYYSYIK

SEQ ID NO: 3194851 - protein, 23 aa, Giardia lamblia
QMNQLQDAVMLLTREQAQQPQSQ

SEQ ID NO: 3194852 - protein, 32 aa, Giardia lamblia
QMPEEFTFELPLLLTFQKQFFNYGRSDYLKQH

SEQ ID NO: 3194853 - protein, 20 aa, Giardia lamblia
QMQIAWPYEIFADSVVCRRI

SEQ ID NO: 3194854 - protein, 20 aa, Giardia lamblia
QMSAILRAPVDQSQTVAMLL

SEQ ID NO: 3194855 - protein, 30 aa, Giardia lamblia
QMSEKKFALLIIDSLTALFRVDFTGRGELA

SEQ ID NO: 3194856 - protein, 17 aa, Giardia lamblia
QMSPEQEEFSMRVMASS

SEQ ID NO: 3194857 - protein, 26 aa, Giardia lamblia
QNAKIIKTLNLLITAGRKNKTAIADL

SEQ ID NO: 3194858 - protein, 25 aa, Giardia lamblia
QNAMLKDHWTYLKSTLDACSAQSGR

SEQ ID NO: 3194859 - protein, 25 aa, Giardia lamblia
QNEAKTTELLLLKQTMETQSATMDE

SEQ ID NO: 3194860 - protein, 26 aa, Giardia lamblia
QNEKPKYPPIVKLSTLFNSDCIGCGQ

SEQ ID NO: 3194861 - protein, 24 aa, Giardia lamblia
QNGPQSFYILFDLNPPSIYTQLTA

SEQ ID NO: 3194862 - protein, 19 aa, Giardia lamblia
QNIDLLKRQAHYLNRSDRV

SEQ ID NO: 3194863 - protein, 18 aa, Giardia lamblia
QNILHMSSDITFIRISRD

SEQ ID NO: 3194864 - protein, 17 aa, Giardia lamblia
QNILYKEEIFTTHTLIT

SEQ ID NO: 3194865 - protein, 24 aa, Giardia lamblia
QNKRVAVRILLPHEYESLNGFTIP

SEQ ID NO: 3194866 - protein, 17 aa, Giardia lamblia
QNLLMQLRKVCNHPYII

SEQ ID NO: 3194867 - protein, 22 aa, Giardia lamblia
QNLPPVLAFINKSISPGYCSIK

SEQ ID NO: 3194868 - protein, 19 aa, Giardia lamblia
QNMSLIIKTLWNEIGIQLA

SEQ ID NO: 3194869 - protein, 32 aa, Giardia lamblia
QNNLHELWALLNFISPLIFNVPEDFVGLVRGE

SEQ ID NO: 3194870 - protein, 27 aa, Giardia lamblia
QNPIQYPPVFVLLNPQATTIPFNTNAQ

SEQ ID NO: 3194871 - protein, 22 aa, Giardia lamblia
QNPWMAIGFSRPISQAVAPVSN

SEQ ID NO: 3194872 - protein, 23 aa, Giardia lamblia
QNQKPDIWLVDKCKAIDVGVIQP

SEQ ID NO: 3194873 - protein, 24 aa, Giardia lamblia
QNSELMKRVLQLQASPDRVAGKTR

SEQ ID NO: 3194874 - protein, 23 aa, Giardia lamblia
QNTLRHQRFPRHSSPTKQPAALS

SEQ ID NO: 3194875 - protein, 31 aa, Giardia lamblia
QNTLVLQGLLLHQGFLVLLGRHHGHLALTIH

SEQ ID NO: 3194876 - protein, 22 aa, Giardia lamblia
QNTYRYKAFADIPFNSTITPHA

SEQ ID NO: 3194877 - protein, 27 aa, Giardia lamblia
QNVEHHLPILLLKFTSTHPNFTANLRA

SEQ ID NO: 3194878 - protein, 25 aa, Giardia lamblia
QNVKRYFFTAMLLAYNMLTDTPYDL

SEQ ID NO: 3194879 - protein, 17 aa, Giardia lamblia
QNYSSINPLVLGVVLPG

SEQ ID NO: 3194880 - protein, 17 aa, Giardia lamblia
QPACAKLLAPWEKGFRN

SEQ ID NO: 3194881 - protein, 30 aa, Giardia lamblia
QPADFIVRCATFLITRYFAKAANTQGLAVL

SEQ ID NO: 3194882 - protein, 25 aa, Giardia lamblia
QPAQPVYKPPPPLYMEAPDRILSTP

SEQ ID NO: 3194883 - protein, 17 aa, Giardia lamblia
QPAVLKHIWPKVCGYLN

SEQ ID NO: 3194884 - protein, 29 aa, Giardia lamblia
QPCDAGPIIYAHLSPRSILLTDRSIHARI

SEQ ID NO: 3194885 - protein, 27 aa, Giardia lamblia
QPDSIAYGYMTLLRSLSILQNDGYVFG

SEQ ID NO: 3194886 - protein, 17 aa, Giardia lamblia
QPEFTTRIGDRPPSYHA

SEQ ID NO: 3194887 - protein, 18 aa, Giardia lamblia
QPELVISALLHFGPNLEV

SEQ ID NO: 3194888 - protein, 25 aa, Giardia lamblia
QPEPQPIMDLLIAPKAVEAVYAPLQ

SEQ ID NO: 3194889 - protein, 39 aa, Giardia lamblia
QPETLPIPQPYQDALTPFQRFLPLMCIRPDKIIAYSRIY

SEQ ID NO: 3194890 - protein, 18 aa, Giardia lamblia
QPGAFHTFKLRGRVPSVI

SEQ ID NO: 3194891 - protein, 18 aa, Giardia lamblia
QPGIPAPLSVGLDMADPL

SEQ ID NO: 3194892 - protein, 21 aa, Giardia lamblia
QPHDYLIRHYGKASTFIVALT

SEQ ID NO: 3194893 - protein, 19 aa, Giardia lamblia
QPHILSLRAMISFVGAVHS

SEQ ID NO: 3194894 - protein, 25 aa, Giardia lamblia
QPHPKFVTYAYSLAAQAYELLLGKY

SEQ ID NO: 3194895 - protein, 20 aa, Giardia lamblia
QPHSAGLYIENIPPAGQQSV

SEQ ID NO: 3194896 - protein, 28 aa, Giardia lamblia
QPHSGKLVFKGLKLLKPAKATESGPQMH

SEQ ID NO: 3194897 - protein, 25 aa, Giardia lamblia
QPIIKWLHQGIRLKGPKQLKTAYLW

SEQ ID NO: 3194898 - protein, 23 aa, Giardia lamblia
QPILSRFDLAFVLLDEPNKEVDN

SEQ ID NO: 3194899 - protein, 30 aa, Giardia lamblia
QPIRQDIITLRRFPYSNSLLHLAHWMLAVE

SEQ ID NO: 3194900 - protein, 24 aa, Giardia lamblia
QPKSPQTVIKFPKASPHVTNPEGM

SEQ ID NO: 3194901 - protein, 17 aa, Giardia lamblia
QPLKALDKELRICQKDV

SEQ ID NO: 3194902 - protein, 18 aa, Giardia lamblia
QPLRRVRLSVPESVKIQS

SEQ ID NO: 3194903 - protein, 20 aa, Giardia lamblia
QPLVAWICREGFARFSLRPF

SEQ ID NO: 3194904 - protein, 19 aa, Giardia lamblia
QPMAKVRIIIKPHIPVLAA

SEQ ID NO: 3194905 - protein, 21 aa, Giardia lamblia
QPNCILLLYMNKEKHMVAQFP

SEQ ID NO: 3194906 - protein, 21 aa, Giardia lamblia
QPNVLYIKSNIYIVGDTHGQL

SEQ ID NO: 3194907 - protein, 23 aa, Giardia lamblia
QPPFSKLQNVIFLSPPRSPELLS

SEQ ID NO: 3194908 - protein, 17 aa, Giardia lamblia
QPQILAHLRKTITPRLL

SEQ ID NO: 3194909 - protein, 22 aa, Giardia lamblia
QPQKFDFVQFSLVNGTGLVRSK

SEQ ID NO: 3194910 - protein, 18 aa, Giardia lamblia
QPQLCLRFNDLDSIGLSG

SEQ ID NO: 3194911 - protein, 19 aa, Giardia lamblia
QPRLDQICGIPVVYKKKKK

SEQ ID NO: 3194912 - protein, 17 aa, Giardia lamblia
QPRLLRLTQDLITVLLS

SEQ ID NO: 3194913 - protein, 28 aa, Giardia lamblia
QPRYSEHSVYPNTLIWTPSTSSLNQEIP

SEQ ID NO: 3194914 - protein, 23 aa, Giardia lamblia
QPSDLIEFSIKYFKQLSALRPNS

SEQ ID NO: 3194915 - protein, 22 aa, Giardia lamblia
QPSIPAIVSLVRYLATAYVQSG

SEQ ID NO: 3194916 - protein, 27 aa, Giardia lamblia
QPSTDDNLFILVHVTDLYLAQGLQALA

SEQ ID NO: 3194917 - protein, 23 aa, Giardia lamblia
QPSYQDGYSPTLNPTLHGNGGSI

SEQ ID NO: 3194918 - protein, 29 aa, Giardia lamblia
QPTEIWIDSLYYLTGALAASLGWETDSGM

SEQ ID NO: 3194919 - protein, 19 aa, Giardia lamblia
QPTIEEPGLYSIKKTVYSL

SEQ ID NO: 3194920 - protein, 21 aa, Giardia lamblia
QPTISFLQALQNRIYYDITED

SEQ ID NO: 3194921 - protein, 18 aa, Giardia lamblia
QPVIIFWDEIDAVFPTNS

SEQ ID NO: 3194922 - protein, 19 aa, Giardia lamblia
QPVPSSSIGFFIDSDPHAS

SEQ ID NO: 3194923 - protein, 27 aa, Giardia lamblia
QPYSILQLQFKVFADQTLLSIGRYQWP

SEQ ID NO: 3194924 - protein, 31 aa, Giardia lamblia
QQANSKFLITVWDLLQTYLNEDSRKIEMLDR

SEQ ID NO: 3194925 - protein, 23 aa, Giardia lamblia
QQATKTPSFLPDLPRVTSKTETP

SEQ ID NO: 3194926 - protein, 23 aa, Giardia lamblia
QQDAIILSFRHFIGAHPEDAEAL

SEQ ID NO: 3194927 - protein, 24 aa, Giardia lamblia
QQDVDGRTALWFAAMKGHVSCVRE

SEQ ID NO: 3194928 - protein, 30 aa, Giardia lamblia
QQELMIQKLPWIPGGWMFTADRRVIRLSEQ

SEQ ID NO: 3194929 - protein, 26 aa, Giardia lamblia
QQEPQYFRGLSIPYGSRTTALTAGCT

SEQ ID NO: 3194930 - protein, 24 aa, Giardia lamblia
QQETAAMLANRFLETLRANARLDA

SEQ ID NO: 3194931 - protein, 24 aa, Giardia lamblia
QQETQLLRQQLAQKDALVDALSAK

SEQ ID NO: 3194932 - protein, 26 aa, Giardia lamblia
QQGLPQQASLPPHILHQQYPTNDAPV

SEQ ID NO: 3194933 - protein, 25 aa, Giardia lamblia
QQGPKSLNILMREKRVREIEAENQR

SEQ ID NO: 3194934 - protein, 27 aa, Giardia lamblia
QQIRILSLLYRFSAAESYLIPYRIRTG

SEQ ID NO: 3194935 - protein, 20 aa, Giardia lamblia
QQKMWEDMKLLLAPSQRQAG

SEQ ID NO: 3194936 - protein, 22 aa, Giardia lamblia
QQKYGLPLMVAKDPALSKYLGE

SEQ ID NO: 3194937 - protein, 18 aa, Giardia lamblia
QQLKLALGEAEDIKMHAQ

SEQ ID NO: 3194938 - protein, 27 aa, Giardia lamblia
QQLKLKIPIYILPLHATPLPSSPTIVV

SEQ ID NO: 3194939 - protein, 24 aa, Giardia lamblia
QQLLSNLSFLQRASLVSGLERFEL

SEQ ID NO: 3194940 - protein, 24 aa, Giardia lamblia
QQLQLICAFLKPLKPDACKGAMHA

SEQ ID NO: 3194941 - protein, 24 aa, Giardia lamblia
QQMHSSAPTLPLRSASVTKSIIEE

SEQ ID NO: 3194942 - protein, 26 aa, Giardia lamblia
QQNEETFMDILKRKISTTLTNVEYAI

SEQ ID NO: 3194943 - protein, 19 aa, Giardia lamblia
QQPIYSYRKQILSSLYVNP

SEQ ID NO: 3194944 - protein, 32 aa, Giardia lamblia
QQPVQVVYVPVYYPSQGPIGEMNPFPPTTSSQ

SEQ ID NO: 3194945 - protein, 25 aa, Giardia lamblia
QQQKELDGLYKMVKLGISGIDSSKQ

SEQ ID NO: 3194946 - protein, 18 aa, Giardia lamblia
QQQKLPRSRYTQGLLHIT

SEQ ID NO: 3194947 - protein, 26 aa, Giardia lamblia
QQQKRPRFRLLVAKLPRGTSPLQLTT

SEQ ID NO: 3194948 - protein, 25 aa, Giardia lamblia
QQQLPPRQVQLPPVDNRYSSAITSM

SEQ ID NO: 3194949 - protein, 25 aa, Giardia lamblia
QQQVLRTDLLSDPLKYASIDVSLLS

SEQ ID NO: 3194950 - protein, 19 aa, Giardia lamblia
QQRDRPLRGLLPPGGPAET

SEQ ID NO: 3194951 - protein, 19 aa, Giardia lamblia
QQRKKLLEEITPDATVTIT

SEQ ID NO: 3194952 - protein, 29 aa, Giardia lamblia
QQRLKDLFILLITAFLKDVAIVYNSVTDE

SEQ ID NO: 3194953 - protein, 21 aa, Giardia lamblia
QQRTALMYAAMKGNVECIPLL

SEQ ID NO: 3194954 - protein, 41 aa, Giardia lamblia
QQSEQLWLGFFTAIETPLVRKAIIKLIKYFGIAEHMLKIAD

SEQ ID NO: 3194955 - protein, 23 aa, Giardia lamblia
QQSTHFFRTYRSVLDMATVSLIK

SEQ ID NO: 3194956 - protein, 24 aa, Giardia lamblia
QQTKINRPFLFLDPTESGPENVVH

SEQ ID NO: 3194957 - protein, 20 aa, Giardia lamblia
QQTLLRMCVLAPSDNAHEKL

SEQ ID NO: 3194958 - protein, 21 aa, Giardia lamblia
QQVAIPRLIAQNLTFPEIVTS

SEQ ID NO: 3194959 - protein, 21 aa, Giardia lamblia
QQVDLFLQYKPYTNTGALSHT

SEQ ID NO: 3194960 - protein, 20 aa, Giardia lamblia
QQVMDLLDYPGITEAYGMGD

SEQ ID NO: 3194961 - protein, 23 aa, Giardia lamblia
QQVTFVCNYDFPRDPHSYMHRAG

SEQ ID NO: 3194962 - protein, 20 aa, Giardia lamblia
QQYAVPYMPALVSSDTQLVA

SEQ ID NO: 3194963 - protein, 25 aa, Giardia lamblia
QQYLQTIKIFIHRTALLLSDPAVSI

SEQ ID NO: 3194964 - protein, 23 aa, Giardia lamblia
QQYSPLYDGPLTPSLLTDLGTNH

SEQ ID NO: 3194965 - protein, 19 aa, Giardia lamblia
QRAAEALQFDEDLLGSLAA

SEQ ID NO: 3194966 - protein, 27 aa, Giardia lamblia
QRAEELRIRYLRKRELILQERKRTTER

SEQ ID NO: 3194967 - protein, 25 aa, Giardia lamblia
QRAMFMAHHLKVDPNFLFTADNSSR

SEQ ID NO: 3194968 - protein, 24 aa, Giardia lamblia
QRAVNSLCLLPLSGDGHILLAAAC

SEQ ID NO: 3194969 - protein, 24 aa, Giardia lamblia
QRCAYWCMKLLLPYEGEIKDNTGK

SEQ ID NO: 3194970 - protein, 39 aa, Giardia lamblia
QRDFWNCQVIFFINPYETINYFLFSNITLGLQVEAPDGR

SEQ ID NO: 3194971 - protein, 18 aa, Giardia lamblia
QRDLAIYWREKAQQWEEM

SEQ ID NO: 3194972 - protein, 24 aa, Giardia lamblia
QREKEIERFYRNLIDSKDVMINQL

SEQ ID NO: 3194973 - protein, 22 aa, Giardia lamblia
QREQDWLHDPGSRYENVMTKGP

SEQ ID NO: 3194974 - protein, 18 aa, Giardia lamblia
QRFITITIQDYGALGIQA

SEQ ID NO: 3194975 - protein, 20 aa, Giardia lamblia
QRFYDSLRCPTLSTLTHKQR

SEQ ID NO: 3194976 - protein, 25 aa, Giardia lamblia
QRGFAIYVMDPILQLFDAVMTEQKK

SEQ ID NO: 3194977 - protein, 23 aa, Giardia lamblia
QRGNLAVIKLLVPHEARIPTRRG

SEQ ID NO: 3194978 - protein, 24 aa, Giardia lamblia
QRGRSILFLLENEAGLVPLLGSYG

SEQ ID NO: 3194979 - protein, 22 aa, Giardia lamblia
QRGRVVDMLFPDNTELSLSRDE

SEQ ID NO: 3194980 - protein, 26 aa, Giardia lamblia
QRHCIHEFQYLLKRQASNGATSLMYA

SEQ ID NO: 3194981 - protein, 21 aa, Giardia lamblia
QRIQPVAIDFLDDSPDRLPTP

SEQ ID NO: 3194982 - protein, 31 aa, Giardia lamblia
QRITFQFPSLLEIIPLFPASTILYFITEEPQ

SEQ ID NO: 3194983 - protein, 27 aa, Giardia lamblia
QRKGYHWTPSRLIWKLGKRINDERSIA

SEQ ID NO: 3194984 - protein, 31 aa, Giardia lamblia
QRKHERAEMIITQLKRLLMGISDVCLTGTER

SEQ ID NO: 3194985 - protein, 31 aa, Giardia lamblia
QRKIPIPIATILSVMKQLAAALAYLHSVNGA

SEQ ID NO: 3194986 - protein, 26 aa, Giardia lamblia
QRKPKPNIIFSPVQLPPEPEESRRKP

SEQ ID NO: 3194987 - protein, 22 aa, Giardia lamblia
QRKQIIFAEMNRMEKLSKAHMV

SEQ ID NO: 3194988 - protein, 17 aa, Giardia lamblia
QRKTLVIVPVYPTSDDW

SEQ ID NO: 3194989 - protein, 31 aa, Giardia lamblia
QRLAQVSLITIPPHLRSISLQAILEGELPQS

SEQ ID NO: 3194990 - protein, 18 aa, Giardia lamblia
QRLDGLGALILLPTAELC

SEQ ID NO: 3194991 - protein, 20 aa, Giardia lamblia
QRLDVLLQVKWCLKEFDCDL

SEQ ID NO: 3194992 - protein, 26 aa, Giardia lamblia
QRLILVSLCVIPMVNYAPLVEITSDK

SEQ ID NO: 3194993 - protein, 22 aa, Giardia lamblia
QRLNYLHFLIRTCRVYCNDEPR

SEQ ID NO: 3194994 - protein, 18 aa, Giardia lamblia
QRLPNLKVLNLMNNKIVR

SEQ ID NO: 3194995 - protein, 17 aa, Giardia lamblia
QRLYRSHLNIAPSNIYI

SEQ ID NO: 3194996 - protein, 18 aa, Giardia lamblia
QRMDAYNAYFLLQKEMEP

SEQ ID NO: 3194997 - protein, 19 aa, Giardia lamblia
QRMDSLLSALDTRTKELSE

SEQ ID NO: 3194998 - protein, 22 aa, Giardia lamblia
QRMHETLFDARNMRLEVTRKYL

SEQ ID NO: 3194999 - protein, 27 aa, Giardia lamblia
QRNATFAFLSPLEMRLHRVENLLIDHM

SEQ ID NO: 3195000 - protein, 28 aa, Giardia lamblia
QRNLPSYKQLILQAIRFRLLTACPELRN

SEQ ID NO: 3195001 - protein, 19 aa, Giardia lamblia
QRPLRGTPIAWKMKGQQRL

SEQ ID NO: 3195002 - protein, 24 aa, Giardia lamblia
QRQKKRLDYLKHQQMHDSKAVKES

SEQ ID NO: 3195003 - protein, 24 aa, Giardia lamblia
QRQNRALFASQPLSFDDRIAQKRA

SEQ ID NO: 3195004 - protein, 23 aa, Giardia lamblia
QRQQGRLLPSCYLERSLQNFTDC

SEQ ID NO: 3195005 - protein, 17 aa, Giardia lamblia
QRQQVEIPGWKKLDLRY

SEQ ID NO: 3195006 - protein, 20 aa, Giardia lamblia
QRREHLDRELASLRLKCENL

SEQ ID NO: 3195007 - protein, 26 aa, Giardia lamblia
QRRRCIRTHLSTMDGILALLQERSAL

SEQ ID NO: 3195008 - protein, 21 aa, Giardia lamblia
QRSHIKLVSYPHKVNSEYHDE

SEQ ID NO: 3195009 - protein, 18 aa, Giardia lamblia
QRSILALCGPCPFFETVL

SEQ ID NO: 3195010 - protein, 28 aa, Giardia lamblia
QRSYQWLHMCWGCRPVLHPGNIDSMKTL

SEQ ID NO: 3195011 - protein, 24 aa, Giardia lamblia
QRTALMWAARYNNSAAVKLLAPHE

SEQ ID NO: 3195012 - protein, 19 aa, Giardia lamblia
QRTDGMTALMWAAQNRHVD

SEQ ID NO: 3195013 - protein, 27 aa, Giardia lamblia
QRTLDGLFPLAIGATAAIPGGFGCGKT

SEQ ID NO: 3195014 - protein, 19 aa, Giardia lamblia
QRVAILWPEIAYDLITQAS

SEQ ID NO: 3195015 - protein, 22 aa, Giardia lamblia
QRVIQGVMWYCSGATGFWCGSI

SEQ ID NO: 3195016 - protein, 26 aa, Giardia lamblia
QRVMLYRSRLPVFEKTMTVLKLKCDA

SEQ ID NO: 3195017 - protein, 17 aa, Giardia lamblia
QRYDGWTALMTASSNNK

SEQ ID NO: 3195018 - protein, 23 aa, Giardia lamblia
QRYFSTPSLRKKLLLSITDLIQS

SEQ ID NO: 3195019 - protein, 21 aa, Giardia lamblia
QRYPTLLPVLLTDASCPKFIL

SEQ ID NO: 3195020 - protein, 21 aa, Giardia lamblia
QRYQIVFPEFQLLFDQSSIVS

SEQ ID NO: 3195021 - protein, 31 aa, Giardia lamblia
QSALDNNRIPFFLPAIRVFKGHIADVISCSW

SEQ ID NO: 3195022 - protein, 18 aa, Giardia lamblia
QSAMSAVPLLKKTLRAEF

SEQ ID NO: 3195023 - protein, 26 aa, Giardia lamblia
QSANSYHIWLRIFAESLAQGQGLIAR

SEQ ID NO: 3195024 - protein, 24 aa, Giardia lamblia
QSARLPCITVLNSLFIFGQRIATR

SEQ ID NO: 3195025 - protein, 24 aa, Giardia lamblia
QSCQLVDRSIMAQSLILSRSISRS

SEQ ID NO: 3195026 - protein, 20 aa, Giardia lamblia
QSCVIAYGPGLYILDCNQTG

SEQ ID NO: 3195027 - protein, 17 aa, Giardia lamblia
QSDFAELRKLLKLYKEE

SEQ ID NO: 3195028 - protein, 27 aa, Giardia lamblia
QSDFTPLMMAIMHKDIDAVKANLKYAG

SEQ ID NO: 3195029 - protein, 21 aa, Giardia lamblia
QSDILIEYFSKPATLKKLLRI

SEQ ID NO: 3195030 - protein, 17 aa, Giardia lamblia
QSDIWSLGKLLSDMCLL

SEQ ID NO: 3195031 - protein, 26 aa, Giardia lamblia
QSDSLYPIEPSAFLTAIQIALLSLRH

SEQ ID NO: 3195032 - protein, 21 aa, Giardia lamblia
QSDVDMLSLFHACLHAQPPTT

SEQ ID NO: 3195033 - protein, 27 aa, Giardia lamblia
QSEFRNIWVHYYVDKHAAIFVVDAADH

SEQ ID NO: 3195034 - protein, 18 aa, Giardia lamblia
QSELFLQTIWSIFSASHY

SEQ ID NO: 3195035 - protein, 28 aa, Giardia lamblia
QSELQFPGLVVLEIFAHWCDVCKSIDPI

SEQ ID NO: 3195036 - protein, 23 aa, Giardia lamblia
QSERLLEVIPLNKKNLICCILST

SEQ ID NO: 3195037 - protein, 65 aa, Giardia lamblia
QSEVTKLVRILQELGYPARSLGPLQDNLLPPNRFEFTSLALLTLIRWLETDSLPIYTSFLCEYVV

SEQ ID NO: 3195038 - protein, 27 aa, Giardia lamblia
QSEVWALGCILYEALAARRCFSAETGA

SEQ ID NO: 3195039 - protein, 22 aa, Giardia lamblia
QSFLHYDLRVSPHLMPVLYCHT

SEQ ID NO: 3195040 - protein, 19 aa, Giardia lamblia
QSFLMGKQIRRMFLTYFDD

SEQ ID NO: 3195041 - protein, 30 aa, Giardia lamblia
QSGIIQSMFMLFLSNAPFDSLMHASFIICS

SEQ ID NO: 3195042 - protein, 18 aa, Giardia lamblia
QSHRNMLYAHYEVVLFSD

SEQ ID NO: 3195043 - protein, 18 aa, Giardia lamblia
QSHTFFDSPQPFAKLASA

SEQ ID NO: 3195044 - protein, 27 aa, Giardia lamblia
QSIPHIPISGLLPTKAHDFPRDGTLSP

SEQ ID NO: 3195045 - protein, 25 aa, Giardia lamblia
QSIQGVLRAILKDALFPSSITNPGI

SEQ ID NO: 3195046 - protein, 19 aa, Giardia lamblia
QSIVAARWILSRLYNTVRT

SEQ ID NO: 3195047 - protein, 26 aa, Giardia lamblia
QSKKDIKMHFVSWYKQAATAVASREN

SEQ ID NO: 3195048 - protein, 23 aa, Giardia lamblia
QSLEAIIMSWLDAFVGISALIPN

SEQ ID NO: 3195049 - protein, 22 aa, Giardia lamblia
QSLEPSHVLFALGLDPEFAHTA

SEQ ID NO: 3195050 - protein, 17 aa, Giardia lamblia
QSLGLIILNLLVAGSRI

SEQ ID NO: 3195051 - protein, 20 aa, Giardia lamblia
QSLILNVRPTCRGVLKGVVI

SEQ ID NO: 3195052 - protein, 24 aa, Giardia lamblia
QSLKEDIQYYKGLDFAQRTKIMSL

SEQ ID NO: 3195053 - protein, 22 aa, Giardia lamblia
QSLLMTLMRQLSGTEAPLPETV

SEQ ID NO: 3195054 - protein, 17 aa, Giardia lamblia
QSLNLKIISLQQELQDS

SEQ ID NO: 3195055 - protein, 17 aa, Giardia lamblia
QSLRKAMNTLSAEKLSL

SEQ ID NO: 3195056 - protein, 31 aa, Giardia lamblia
QSLRRLADQPFIIRLIEILFDRTTGRLALVF

SEQ ID NO: 3195057 - protein, 22 aa, Giardia lamblia
QSLSEPKPLPTVLASSGGADDS

SEQ ID NO: 3195058 - protein, 21 aa, Giardia lamblia
QSLTTLVWPEPKVRTVKIVPT

SEQ ID NO: 3195059 - protein, 26 aa, Giardia lamblia
QSNLMVWMEKASFPSLAKLLGGQKEL

SEQ ID NO: 3195060 - protein, 25 aa, Giardia lamblia
QSNLVPVLFACMVPYVFKGERVLLT

SEQ ID NO: 3195061 - protein, 22 aa, Giardia lamblia
QSPATPFTQPSFVLPSSISYGG

SEQ ID NO: 3195062 - protein, 21 aa, Giardia lamblia
QSPIALSRIMPFPSAISVYHP

SEQ ID NO: 3195063 - protein, 23 aa, Giardia lamblia
QSPSYLINFFDNPSLTKGFTQYV

SEQ ID NO: 3195064 - protein, 17 aa, Giardia lamblia
QSPYSCVIIYKSTGYHN

SEQ ID NO: 3195065 - protein, 24 aa, Giardia lamblia
QSQDKILVFCQGRMMLNIVEKALL

SEQ ID NO: 3195066 - protein, 26 aa, Giardia lamblia
QSQHIPSFSSYYMSPSGSVYGSELQV

SEQ ID NO: 3195067 - protein, 34 aa, Giardia lamblia
QSRDDLLFDIQSLKLLLPMIPVSGISTCSRAVIN

SEQ ID NO: 3195068 - protein, 22 aa, Giardia lamblia
QSRDGWTALMWAAKNGHAGCVR

SEQ ID NO: 3195069 - protein, 23 aa, Giardia lamblia
QSRDLYVFAHGYRGTYCDLRLMS

SEQ ID NO: 3195070 - protein, 23 aa, Giardia lamblia
QSRIELFNINFFEFAKDAVAFRS

SEQ ID NO: 3195071 - protein, 44 aa, Giardia lamblia
QSRLRSVPVIWRIARQTRFIVLSSYMLYIGNPEQALWPAIEAAN

SEQ ID NO: 3195072 - protein, 17 aa, Giardia lamblia
QSRYPGWPANMESVFLK

SEQ ID NO: 3195073 - protein, 28 aa, Giardia lamblia
QSSNAEFAFVFDWLEGNGFTKTQLVLEV

SEQ ID NO: 3195074 - protein, 43 aa, Giardia lamblia
QSSNIRYVLLFVNGTLWTPFPGVFVRPNCYSNYFATLTSSLKN

SEQ ID NO: 3195075 - protein, 40 aa, Giardia lamblia
QSSNKYGLRLNLLPNAPPLMHESLLLSSRRRSPSIVGMGG

SEQ ID NO: 3195076 - protein, 36 aa, Giardia lamblia
QSSPLIEYWIYSYMLYRYFIDVFEGLSFLDPSTDMS

SEQ ID NO: 3195077 - protein, 23 aa, Giardia lamblia
QSSRAHCIYTIYLKQRSRVDETA

SEQ ID NO: 3195078 - protein, 26 aa, Giardia lamblia
QSSRSTPMLFILSPGSDPIIEITKLA

SEQ ID NO: 3195079 - protein, 30 aa, Giardia lamblia
QSSSISCFPYLFPYLSFEKDYQGRTALDHA

SEQ ID NO: 3195080 - protein, 26 aa, Giardia lamblia
QSTERLHFRRPYWKGTTALMIASAMG

SEQ ID NO: 3195081 - protein, 25 aa, Giardia lamblia
QSTEYAIFTVALLLLSNASPEQVSA

SEQ ID NO: 3195082 - protein, 18 aa, Giardia lamblia
QSTFTLKDIYLKSNVRIT

SEQ ID NO: 3195083 - protein, 22 aa, Giardia lamblia
QSTGLLLLCLRGGCPQATVLPV

SEQ ID NO: 3195084 - protein, 23 aa, Giardia lamblia
QSTKKEYVFRFSLACLSVNEYIS

SEQ ID NO: 3195085 - protein, 22 aa, Giardia lamblia
QSTLIDMIMKYVTDFRPEPIIV

SEQ ID NO: 3195086 - protein, 23 aa, Giardia lamblia
QSTTLLHLLHKGGSYVRDVTADV

SEQ ID NO: 3195087 - protein, 25 aa, Giardia lamblia
QSTVLVLEDILLALNVFCLADAGTS

SEQ ID NO: 3195088 - protein, 24 aa, Giardia lamblia
QSVDVMNYIKLSTDLYRLHVHPLR

SEQ ID NO: 3195089 - protein, 22 aa, Giardia lamblia
QSVILVFKGPDYALASGASARL

SEQ ID NO: 3195090 - protein, 20 aa, Giardia lamblia
QSVLPLLYPEQDDPHFEGFA

SEQ ID NO: 3195091 - protein, 23 aa, Giardia lamblia
QSVNLPPCTLYLHSHANSLHRNQ

SEQ ID NO: 3195092 - protein, 18 aa, Giardia lamblia
QSVRYLTVMFPDPQFKAS

SEQ ID NO: 3195093 - protein, 17 aa, Giardia lamblia
QSWRARGPRRRGCKISS

SEQ ID NO: 3195094 - protein, 18 aa, Giardia lamblia
QSYLLLNKRYSIPIQHPV

SEQ ID NO: 3195095 - protein, 34 aa, Giardia lamblia
QSYVAEFRSFHHFFLFIYAYHASLCRASITYGRS

SEQ ID NO: 3195096 - protein, 24 aa, Giardia lamblia
QSYVKPLTAFIQEALERIPDHTVE

SEQ ID NO: 3195097 - protein, 24 aa, Giardia lamblia
QTAELLMKKILMIDNVEIPDGFID

SEQ ID NO: 3195098 - protein, 21 aa, Giardia lamblia
QTAFPEKPVYLVKGGIRALVQ

SEQ ID NO: 3195099 - protein, 22 aa, Giardia lamblia
QTALMMASFWNNSDAVSILASR

SEQ ID NO: 3195100 - protein, 18 aa, Giardia lamblia
QTALRTLTEASALYDRVF

SEQ ID NO: 3195101 - protein, 26 aa, Giardia lamblia
QTAPKILNLVLMPQTPELIIEEIDIE

SEQ ID NO: 3195102 - protein, 18 aa, Giardia lamblia
QTAYSFAFAAGHRNVCAL

SEQ ID NO: 3195103 - protein, 27 aa, Giardia lamblia
QTCAKLLQAESELLFYKTQAQTRADSE

SEQ ID NO: 3195104 - protein, 25 aa, Giardia lamblia
QTCTEVERPALRRKIADLANTIDEL

SEQ ID NO: 3195105 - protein, 23 aa, Giardia lamblia
QTDCIFIRELPVIAGWVGCGVWD

SEQ ID NO: 3195106 - protein, 26 aa, Giardia lamblia
QTDDFFFHHNILITSIPLCTVYLDFS

SEQ ID NO: 3195107 - protein, 28 aa, Giardia lamblia
QTDGSVLYRPINTLSILSLASVDDILKQ

SEQ ID NO: 3195108 - protein, 23 aa, Giardia lamblia
QTDISRMKAIVKVKNREIAELKE

SEQ ID NO: 3195109 - protein, 17 aa, Giardia lamblia
QTDLGVTALMIAAENDA

SEQ ID NO: 3195110 - protein, 25 aa, Giardia lamblia
QTDLQMWLSIIRAAKLSRTPGGNLL

SEQ ID NO: 3195111 - protein, 28 aa, Giardia lamblia
QTDTHYTYMLQKVSIYDPAITPRSGHSV

SEQ ID NO: 3195112 - protein, 21 aa, Giardia lamblia
QTERVLLPFGSGPVRHECNSN

SEQ ID NO: 3195113 - protein, 25 aa, Giardia lamblia
QTESLLKYDLFINSMPVSGLFEFSD

SEQ ID NO: 3195114 - protein, 26 aa, Giardia lamblia
QTEYQKVLLTTYWELGRALGHDCTQG

SEQ ID NO: 3195115 - protein, 26 aa, Giardia lamblia
QTGEPVIAIHYLLPDGSTQPGDRKAM

SEQ ID NO: 3195116 - protein, 21 aa, Giardia lamblia
QTGNDFQWGAGCTALMIACYY

SEQ ID NO: 3195117 - protein, 39 aa, Giardia lamblia
QTGVPVPEDLVWRILVHANEGLFYYHSVFKSNAPDVRRI

SEQ ID NO: 3195118 - protein, 24 aa, Giardia lamblia
QTHERLFNILRLPNRNYITLEDLE

SEQ ID NO: 3195119 - protein, 17 aa, Giardia lamblia
QTIDILVDLLINIQNYR

SEQ ID NO: 3195120 - protein, 24 aa, Giardia lamblia
QTIDKDMLLTQYSRIKSLVADCNH

SEQ ID NO: 3195121 - protein, 18 aa, Giardia lamblia
QTIIALRERMQVEMVKLL

SEQ ID NO: 3195122 - protein, 19 aa, Giardia lamblia
QTIPPPLPDPFCDPVKELA

SEQ ID NO: 3195123 - protein, 18 aa, Giardia lamblia
QTIRAENVLLRDALRSRT

SEQ ID NO: 3195124 - protein, 20 aa, Giardia lamblia
QTIVLSPTITLCDCPGLIFP

SEQ ID NO: 3195125 - protein, 22 aa, Giardia lamblia
QTKEVFVYRLLAENTVDTRIYE

SEQ ID NO: 3195126 - protein, 25 aa, Giardia lamblia
QTKISIPNLVFPKISLVDPCYQLYL

SEQ ID NO: 3195127 - protein, 25 aa, Giardia lamblia
QTLEDFSFIGVLQLAIKQSQLLSTS

SEQ ID NO: 3195128 - protein, 18 aa, Giardia lamblia
QTLIIAPTRELATQINTV

SEQ ID NO: 3195129 - protein, 25 aa, Giardia lamblia
QTLKCTVLLLQHPGAPVYPYSGYAE

SEQ ID NO: 3195130 - protein, 22 aa, Giardia lamblia
QTLNALICRPAPPDHKLIVLGT

SEQ ID NO: 3195131 - protein, 18 aa, Giardia lamblia
QTLPKAILSALPENERPK

SEQ ID NO: 3195132 - protein, 17 aa, Giardia lamblia
QTLRYVLVNLITGNMCG

SEQ ID NO: 3195133 - protein, 20 aa, Giardia lamblia
QTLVMSWRYDSDPPKITRKE

SEQ ID NO: 3195134 - protein, 24 aa, Giardia lamblia
QTNGEVLARLNIPGRRPSTSQTPS

SEQ ID NO: 3195135 - protein, 30 aa, Giardia lamblia
QTNIYEPEEFPFLSARKLLYALNAEGECQG

SEQ ID NO: 3195136 - protein, 25 aa, Giardia lamblia
QTNNPLIDLPVRLSVPAEAAKSSAS

SEQ ID NO: 3195137 - protein, 18 aa, Giardia lamblia
QTPAIDLILALGTTLPNF

SEQ ID NO: 3195138 - protein, 25 aa, Giardia lamblia
QTPGRVFKQLKYPIIIPDKHIDEPR

SEQ ID NO: 3195139 - protein, 27 aa, Giardia lamblia
QTPMVRFFGFSLLETFIRRSWYVIPTE

SEQ ID NO: 3195140 - protein, 21 aa, Giardia lamblia
QTPTQHYPGLAAAPGPYAAYP

SEQ ID NO: 3195141 - protein, 17 aa, Giardia lamblia
QTRILNQLKKIKTDSMV

SEQ ID NO: 3195142 - protein, 19 aa, Giardia lamblia
QTRLGLPNPTARLLDRLAT

SEQ ID NO: 3195143 - protein, 33 aa, Giardia lamblia
QTSDIDAWPAVLLWFIKTIIRAPKGSWNPDFLG

SEQ ID NO: 3195144 - protein, 23 aa, Giardia lamblia
QTSDPIMRWYDAKPGDLIRITRT

SEQ ID NO: 3195145 - protein, 17 aa, Giardia lamblia
QTSIPAPRVLALSVIDE

SEQ ID NO: 3195146 - protein, 31 aa, Giardia lamblia
QTSKAYTYIPINPTAIAPPFRESRGPGLALS

SEQ ID NO: 3195147 - protein, 25 aa, Giardia lamblia
QTSTKTYLLLSALALSMCDHFSEAS

SEQ ID NO: 3195148 - protein, 35 aa, Giardia lamblia
QTSTLYDFYFDLKRNYWCPWSQFVKPYTPPSDGRF

SEQ ID NO: 3195149 - protein, 32 aa, Giardia lamblia
QTSVKRTIIVKRARFFGLTYPELTSAVYNAGP

SEQ ID NO: 3195150 - protein, 18 aa, Giardia lamblia
QTTFSCQRIIPLVDIEKQ

SEQ ID NO: 3195151 - protein, 24 aa, Giardia lamblia
QTTMVDFRDLRSKCEDMRVVLNQR

SEQ ID NO: 3195152 - protein, 24 aa, Giardia lamblia
QTTREWLGFPPGTTALDIARRHGH

SEQ ID NO: 3195153 - protein, 22 aa, Giardia lamblia
QTTVVHIYLKDLPVDLATCIKH

SEQ ID NO: 3195154 - protein, 44 aa, Giardia lamblia
QTVEFFISANPIPTAPITQLVLPILARARPVLIGMFNGSSESGQ

SEQ ID NO: 3195155 - protein, 25 aa, Giardia lamblia
QTVELSVPTYPRPLRQFQTFEQLLH

SEQ ID NO: 3195156 - protein, 22 aa, Giardia lamblia
QTVIGLIGSVDYYIGTQVHQLA

SEQ ID NO: 3195157 - protein, 24 aa, Giardia lamblia
QTVVPYPLIAMDYDDLRCLLVTVA

SEQ ID NO: 3195158 - protein, 17 aa, Giardia lamblia
QTYHRIYSMYHSPPRHC

SEQ ID NO: 3195159 - protein, 29 aa, Giardia lamblia
QTYKHLPASDIWSLGIIALEMFSSRKPKV

SEQ ID NO: 3195160 - protein, 17 aa, Giardia lamblia
QTYLYSTPYVKHPLVKT

SEQ ID NO: 3195161 - protein, 22 aa, Giardia lamblia
QTYSILNKLNGAVPSRMLNASE

SEQ ID NO: 3195162 - protein, 20 aa, Giardia lamblia
QVAFARMKELQILESIYLCG

SEQ ID NO: 3195163 - protein, 20 aa, Giardia lamblia
QVDAFWQKLMETVASNPCIM

SEQ ID NO: 3195164 - protein, 38 aa, Giardia lamblia
QVDAMRVLLPYEFHLPDKTGHFFMYQAGLTGSRQLIKC

SEQ ID NO: 3195165 - protein, 25 aa, Giardia lamblia
QVDRKDAFITLLSRYISIAEEQRRR

SEQ ID NO: 3195166 - protein, 27 aa, Giardia lamblia
QVEASSTAFRRIATLANRAWSRILSAD

SEQ ID NO: 3195167 - protein, 22 aa, Giardia lamblia
QVEKACLILNTPSPPEQSQTGR

SEQ ID NO: 3195168 - protein, 28 aa, Giardia lamblia
QVENGDLTWMLLDKFVAFAGPVSQSHPF

SEQ ID NO: 3195169 - protein, 25 aa, Giardia lamblia
QVEPQLVFWACREVQDFNSCFPGFE

SEQ ID NO: 3195170 - protein, 20 aa, Giardia lamblia
QVEVLTVPILLRLDNVDVMN

SEQ ID NO: 3195171 - protein, 18 aa, Giardia lamblia
QVFDGLWVKDAFQKGKIS

SEQ ID NO: 3195172 - protein, 18 aa, Giardia lamblia
QVFRIRPHLTDANSVLVI

SEQ ID NO: 3195173 - protein, 19 aa, Giardia lamblia
QVFVITFRTEIITVANQCF

SEQ ID NO: 3195174 - protein, 35 aa, Giardia lamblia
QVGLKLSVDPSLVRLIYSGQMLVGSKPLSHFGISS

SEQ ID NO: 3195175 - protein, 32 aa, Giardia lamblia
QVGMPGAPAPMLPPCLPFPPTADSRPTGHFRQ

SEQ ID NO: 3195176 - protein, 19 aa, Giardia lamblia
QVGPILYNLLGDPRILVQA

SEQ ID NO: 3195177 - protein, 25 aa, Giardia lamblia
QVHSSYYCHLPYNSLFERIMEHGAI

SEQ ID NO: 3195178 - protein, 24 aa, Giardia lamblia
QVIELLYMSVLEHKPPRDQLYVFV

SEQ ID NO: 3195179 - protein, 32 aa, Giardia lamblia
QVIEQLFDYFVIFLKQLKLFYKMGANPEVVQK

SEQ ID NO: 3195180 - protein, 17 aa, Giardia lamblia
QVIGLKIDPFIEASAQA

SEQ ID NO: 3195181 - protein, 25 aa, Giardia lamblia
QVIPELIAEILALIGIANALNYIPL

SEQ ID NO: 3195182 - protein, 21 aa, Giardia lamblia
QVITGVFPLARTREFLTPLRL

SEQ ID NO: 3195183 - protein, 23 aa, Giardia lamblia
QVKERHWHSFAVNTQYIDTLTEH

SEQ ID NO: 3195184 - protein, 22 aa, Giardia lamblia
QVKGGSIFDRLTDPSTYHGTHK

SEQ ID NO: 3195185 - protein, 19 aa, Giardia lamblia
QVKRKMPAYSLAGRTNQAR

SEQ ID NO: 3195186 - protein, 23 aa, Giardia lamblia
QVKTFLDAMTDHISRRVSPEIAL

SEQ ID NO: 3195187 - protein, 18 aa, Giardia lamblia
QVLAFITALPREVLYVMR

SEQ ID NO: 3195188 - protein, 23 aa, Giardia lamblia
QVLEFLDFAPKISLYLFDAKFFS

SEQ ID NO: 3195189 - protein, 19 aa, Giardia lamblia
QVLKALDYIHRLGITHLDL

SEQ ID NO: 3195190 - protein, 24 aa, Giardia lamblia
QVLKSHRLPHLLTVARRRAIIHNQ

SEQ ID NO: 3195191 - protein, 23 aa, Giardia lamblia
QVLRPLYISCYGMNNVLLLSELT

SEQ ID NO: 3195192 - protein, 19 aa, Giardia lamblia
QVLVLLIVSSSRPLLTIQR

SEQ ID NO: 3195193 - protein, 25 aa, Giardia lamblia
QVMDKQMEIIALQAQLQQVTTELDE

SEQ ID NO: 3195194 - protein, 18 aa, Giardia lamblia
QVMKLLTSGKFDDGWMLI

SEQ ID NO: 3195195 - protein, 25 aa, Giardia lamblia
QVNPDFRIFLTTEPTTDFPLSIVSN

SEQ ID NO: 3195196 - protein, 29 aa, Giardia lamblia
QVNPPCESPPWASGYLPPLHRLRSRIRNL

SEQ ID NO: 3195197 - protein, 19 aa, Giardia lamblia
QVPELLRKFNLLEGLHAEH

SEQ ID NO: 3195198 - protein, 26 aa, Giardia lamblia
QVPNLDKRYVNLLVSYLCTQENLRQS

SEQ ID NO: 3195199 - protein, 18 aa, Giardia lamblia
QVPQPRPAGFVSPASTSL

SEQ ID NO: 3195200 - protein, 23 aa, Giardia lamblia
QVQAVLPNLRLPGYSREFADLIR

SEQ ID NO: 3195201 - protein, 26 aa, Giardia lamblia
QVQPSSVNFPLICAGATSLLRSALSD

SEQ ID NO: 3195202 - protein, 25 aa, Giardia lamblia
QVQTPQLTPILPQAATAPAASETPN

SEQ ID NO: 3195203 - protein, 25 aa, Giardia lamblia
QVRDGRLACIIFIRDRNHSGQEISG

SEQ ID NO: 3195204 - protein, 26 aa, Giardia lamblia
QVRKDPVIHLLTQLLLATSGISLTMP

SEQ ID NO: 3195205 - protein, 25 aa, Giardia lamblia
QVRKNPQYFYFIEALGELIHDQAVS

SEQ ID NO: 3195206 - protein, 17 aa, Giardia lamblia
QVRLPYTSSHVLALTIV

SEQ ID NO: 3195207 - protein, 21 aa, Giardia lamblia
QVRRKYIRLNLEPGSPCGAVA

SEQ ID NO: 3195208 - protein, 17 aa, Giardia lamblia
QVSLWLGSHVMVEFPHG

SEQ ID NO: 3195209 - protein, 20 aa, Giardia lamblia
QVSPILRRALDRLNAARNTL

SEQ ID NO: 3195210 - protein, 26 aa, Giardia lamblia
QVSRALQVASYLYLFYTSHAIGVANS

SEQ ID NO: 3195211 - protein, 25 aa, Giardia lamblia
QVTRETLWHLFAVDLAASASSTTQA

SEQ ID NO: 3195212 - protein, 34 aa, Giardia lamblia
QVVESVFAQMKLIFCYLFCMIKLSGDSTKAAEIE

SEQ ID NO: 3195213 - protein, 27 aa, Giardia lamblia
QVVKFFAVEILLALGYLHNLGIAYRDL

SEQ ID NO: 3195214 - protein, 20 aa, Giardia lamblia
QVVLSLIRTTLADLQLAIAG

SEQ ID NO: 3195215 - protein, 17 aa, Giardia lamblia
QVVMLLLEQSTTPSVSI

SEQ ID NO: 3195216 - protein, 20 aa, Giardia lamblia
QVYKGRFYQDLFDGTGEMQY

SEQ ID NO: 3195217 - protein, 27 aa, Giardia lamblia
QWDRKMNGLQYYIKLWIKRQCGYVLEL

SEQ ID NO: 3195218 - protein, 19 aa, Giardia lamblia
QWIIEVVSMYLQYSQVDIE

SEQ ID NO: 3195219 - protein, 19 aa, Giardia lamblia
QYAEIRAALPRFRGSDDGD

SEQ ID NO: 3195220 - protein, 22 aa, Giardia lamblia
QYCGPSGMIPDATIKQCFTNPY

SEQ ID NO: 3195221 - protein, 24 aa, Giardia lamblia
QYCRKPLVLLLQHISPGSTVTIHR

SEQ ID NO: 3195222 - protein, 17 aa, Giardia lamblia
QYDDLDFDILNMKLGSS

SEQ ID NO: 3195223 - protein, 17 aa, Giardia lamblia
QYDFLSFPPEHLKGLVG

SEQ ID NO: 3195224 - protein, 25 aa, Giardia lamblia
QYESLRIYVIDYFRPASLANVASQH

SEQ ID NO: 3195225 - protein, 30 aa, Giardia lamblia
QYESVAIPRGVRFFLSISPAAECYFLCCVV

SEQ ID NO: 3195226 - protein, 17 aa, Giardia lamblia
QYFEKPFTAFRDRRHKV

SEQ ID NO: 3195227 - protein, 17 aa, Giardia lamblia
QYFISERPSALLELNCN

SEQ ID NO: 3195228 - protein, 21 aa, Giardia lamblia
QYGAVLRCIQPCPGFAIVEMG

SEQ ID NO: 3195229 - protein, 24 aa, Giardia lamblia
QYGKPRDVVPWYMIGMRTVHHLDL

SEQ ID NO: 3195230 - protein, 25 aa, Giardia lamblia
QYHPEFTSKHRLPHTLFVAFVSAIY

SEQ ID NO: 3195231 - protein, 23 aa, Giardia lamblia
QYHSWRFTPTIMPLDLPARTAKK

SEQ ID NO: 3195232 - protein, 19 aa, Giardia lamblia
QYIVLRNDLPWGLGALAAQ

SEQ ID NO: 3195233 - protein, 22 aa, Giardia lamblia
QYLDQMALIDILTEQRKTLQDK

SEQ ID NO: 3195234 - protein, 17 aa, Giardia lamblia
QYLKLQFACLKLSTPTQ

SEQ ID NO: 3195235 - protein, 24 aa, Giardia lamblia
QYNQSFLITQLNNTFYLIDQHAAH

SEQ ID NO: 3195236 - protein, 20 aa, Giardia lamblia
QYNRIVEMLAHRKQSARAIQ

SEQ ID NO: 3195237 - protein, 26 aa, Giardia lamblia
QYNRPQIVSLLIDKEARMLTKRIHEH

SEQ ID NO: 3195238 - protein, 26 aa, Giardia lamblia
QYPCFYCTSWMYPKRKRPLCSVPGIP

SEQ ID NO: 3195239 - protein, 29 aa, Giardia lamblia
QYRESQVYQYMRFLCGHGIKMSSADDSDH

SEQ ID NO: 3195240 - protein, 17 aa, Giardia lamblia
QYRRPLFEYHGACAGCG

SEQ ID NO: 3195241 - protein, 17 aa, Giardia lamblia
QYSILDAIIAFQGVPRD

SEQ ID NO: 3195242 - protein, 25 aa, Giardia lamblia
QYTINISGRILQWISSMPLNALQVL

SEQ ID NO: 3195243 - protein, 29 aa, Giardia lamblia
QYVLSTARSLFIRLLAQLQGYSLLNKGYT

SEQ ID NO: 3195244 - protein, 20 aa, Giardia lamblia
QYVPNIFINNLILANAYGTS

SEQ ID NO: 3195245 - protein, 25 aa, Giardia lamblia
QYYKEICIGYIPIMLRSNRCILTNK

SEQ ID NO: 3195246 - protein, 20 aa, Giardia lamblia
RAACYMKLQLWQKALEDTTR

SEQ ID NO: 3195247 - protein, 28 aa, Giardia lamblia
RAAELRFLELIDWKIGVSSLNPRAYLRP

SEQ ID NO: 3195248 - protein, 31 aa, Giardia lamblia
RAAKERTYLLYRNLLWRIHIFVNDCPPVNIQ

SEQ ID NO: 3195249 - protein, 17 aa, Giardia lamblia
RAAKFEIVRLEDANSRL

SEQ ID NO: 3195250 - protein, 17 aa, Giardia lamblia
RAALFISNSFQALGFCP

SEQ ID NO: 3195251 - protein, 18 aa, Giardia lamblia
RAALLSLLVLSIDTADPG

SEQ ID NO: 3195252 - protein, 18 aa, Giardia lamblia
RAARLRFFLSRLRAALKE

SEQ ID NO: 3195253 - protein, 21 aa, Giardia lamblia
RAARQPKFLDPALFVGPGRED

SEQ ID NO: 3195254 - protein, 28 aa, Giardia lamblia
RAATRHDMIVACLYLRVSGKLSAELEVK

SEQ ID NO: 3195255 - protein, 19 aa, Giardia lamblia
RACAIKVYCRIRPIIDQET

SEQ ID NO: 3195256 - protein, 23 aa, Giardia lamblia
RACKLELFISQLILLEKTARIPI

SEQ ID NO: 3195257 - protein, 21 aa, Giardia lamblia
RACVLCGLPGTNLAYYCERCV

SEQ ID NO: 3195258 - protein, 17 aa, Giardia lamblia
RADHIRTKRTQDGTGSG

SEQ ID NO: 3195259 - protein, 25 aa, Giardia lamblia
RADKTMQITLYARAGHFFDEASNMA

SEQ ID NO: 3195260 - protein, 25 aa, Giardia lamblia
RADMLAHQRLFLLIEFTFLADLNKE

SEQ ID NO: 3195261 - protein, 17 aa, Giardia lamblia
RADMNRRLLLNLGAIDT

SEQ ID NO: 3195262 - protein, 31 aa, Giardia lamblia
RADPMSYLCKDPFYDMLPKNTTPANTTTQVA

SEQ ID NO: 3195263 - protein, 21 aa, Giardia lamblia
RADPYFILNAITESLYTELLE

SEQ ID NO: 3195264 - protein, 33 aa, Giardia lamblia
RADQYKLWYTQGEPAVMWLSGLHIPESYLTALV

SEQ ID NO: 3195265 - protein, 24 aa, Giardia lamblia
RADRKIFMDYPTKRDKRLIFQTCS

SEQ ID NO: 3195266 - protein, 19 aa, Giardia lamblia
RADVWYLAEAIQAKTGIQF

SEQ ID NO: 3195267 - protein, 23 aa, Giardia lamblia
RAEIIALRRRLSMGIPYEKVLSD

SEQ ID NO: 3195268 - protein, 20 aa, Giardia lamblia
RAENVLLRDALRSRTSTYVP

SEQ ID NO: 3195269 - protein, 28 aa, Giardia lamblia
RAETFRKEFQLLDFGNTGLLSEARFKAA

SEQ ID NO: 3195270 - protein, 18 aa, Giardia lamblia
RAFADNDYTALMYAAQRG

SEQ ID NO: 3195271 - protein, 31 aa, Giardia lamblia
RAFNLLIDRRRSCRRFLTASAILDDKITMNI

SEQ ID NO: 3195272 - protein, 18 aa, Giardia lamblia
RAFQTWAKKHGIKKLFRA

SEQ ID NO: 3195273 - protein, 28 aa, Giardia lamblia
RAFSEALDIIPLTLARNSSIQPIETLAM

SEQ ID NO: 3195274 - protein, 23 aa, Giardia lamblia
RAGFNHLKEVIYRDIYEERAATL

SEQ ID NO: 3195275 - protein, 25 aa, Giardia lamblia
RAGIRTVHFLLFGLKELDASGRGTT

SEQ ID NO: 3195276 - protein, 24 aa, Giardia lamblia
RAGLPDIVRCLLPVESGRATLGGV

SEQ ID NO: 3195277 - protein, 30 aa, Giardia lamblia
RAGTAINQLAILDQKLLHYDITVTENKSLK

SEQ ID NO: 3195278 - protein, 17 aa, Giardia lamblia
RAHSLVYMLDTIEYFEE

SEQ ID NO: 3195279 - protein, 18 aa, Giardia lamblia
RAHVIVGNRDGFIGYGAG

SEQ ID NO: 3195280 - protein, 24 aa, Giardia lamblia
RAIDTILNLTKFLDRMSLYDLHAE

SEQ ID NO: 3195281 - protein, 20 aa, Giardia lamblia
RAIFGGVMLSNLMAIVFPQG

SEQ ID NO: 3195282 - protein, 27 aa, Giardia lamblia
RAIGIDPQYTKILVRRGRLYLDRGDYQ

SEQ ID NO: 3195283 - protein, 32 aa, Giardia lamblia
RAIHRKLRLIKTVHLTSILLLTNQGYLRSLSN

SEQ ID NO: 3195284 - protein, 17 aa, Giardia lamblia
RAIIVYCNPKMALARLV

SEQ ID NO: 3195285 - protein, 17 aa, Giardia lamblia
RAIKKHPFFTEHNVDFA

SEQ ID NO: 3195286 - protein, 34 aa, Giardia lamblia
RAILQSVHGKLMYAGSKGYLYREEIDALVMEISG

SEQ ID NO: 3195287 - protein, 29 aa, Giardia lamblia
RAIMCDYDMWLERRLCLLKIPVDKLKEVI

SEQ ID NO: 3195288 - protein, 20 aa, Giardia lamblia
RAIPSPYVLEGYALHYLYIK

SEQ ID NO: 3195289 - protein, 26 aa, Giardia lamblia
RAKFEDLCIDLFRKCLDPVDRVLRDS

SEQ ID NO: 3195290 - protein, 23 aa, Giardia lamblia
RAKKLLPRSTDLSFYNWDTQFVS

SEQ ID NO: 3195291 - protein, 18 aa, Giardia lamblia
RAKYGLGLVLPHHYYDEM

SEQ ID NO: 3195292 - protein, 17 aa, Giardia lamblia
RAKYSQSLLALLEGMLS

SEQ ID NO: 3195293 - protein, 25 aa, Giardia lamblia
RALELYSIYKFHVLPVINSQDQCIG

SEQ ID NO: 3195294 - protein, 32 aa, Giardia lamblia
RALESLQSLFRTFLLVLQKDVPFTVLSAQFSH

SEQ ID NO: 3195295 - protein, 33 aa, Giardia lamblia
RALIGHKRFISSLAWQPLPLLPVENIPKNSKMS

SEQ ID NO: 3195296 - protein, 18 aa, Giardia lamblia
RALKKLLAEKGSAVSPSA

SEQ ID NO: 3195297 - protein, 19 aa, Giardia lamblia
RALLHLYVGLADANGQTAL

SEQ ID NO: 3195298 - protein, 17 aa, Giardia lamblia
RALLPLQGGQKATGDVK

SEQ ID NO: 3195299 - protein, 19 aa, Giardia lamblia
RALVFGKLLREIGRRPEEI

SEQ ID NO: 3195300 - protein, 26 aa, Giardia lamblia
RAMDALSIFFGMERDFDGLSVLEHAI

SEQ ID NO: 3195301 - protein, 20 aa, Giardia lamblia
RAMDLLSRGVFIIAPERIYL

SEQ ID NO: 3195302 - protein, 18 aa, Giardia lamblia
RAMFELSEAGGCSLSGPA

SEQ ID NO: 3195303 - protein, 20 aa, Giardia lamblia
RAMNSPPRRQGPAAAPLNVH

SEQ ID NO: 3195304 - protein, 20 aa, Giardia lamblia
RAMQNVFLTEPVLEELLPEQ

SEQ ID NO: 3195305 - protein, 27 aa, Giardia lamblia
RAMVLMRNGPFFAPLQNMTNPFLITSI

SEQ ID NO: 3195306 - protein, 17 aa, Giardia lamblia
RANAAFCLLSDPNIYGP

SEQ ID NO: 3195307 - protein, 24 aa, Giardia lamblia
RANDIIRQCIPVKSILIHSEEELG

SEQ ID NO: 3195308 - protein, 29 aa, Giardia lamblia
RANGIVIEHFLVTRLLINITKHVLVPKHV

SEQ ID NO: 3195309 - protein, 28 aa, Giardia lamblia
RANSVTLIGLFMVCVLQKSAKDIADLIS

SEQ ID NO: 3195310 - protein, 20 aa, Giardia lamblia
RANTFILRRENAKLMEHLRN

SEQ ID NO: 3195311 - protein, 19 aa, Giardia lamblia
RAPCWDPAALAADPVPALE

SEQ ID NO: 3195312 - protein, 19 aa, Giardia lamblia
RAPELIFGSRYYTTVIDIW

SEQ ID NO: 3195313 - protein, 21 aa, Giardia lamblia
RAPEPLFLKLGGPDAELAFRG

SEQ ID NO: 3195314 - protein, 18 aa, Giardia lamblia
RAPHVVQLILQYPNDISH

SEQ ID NO: 3195315 - protein, 25 aa, Giardia lamblia
RAPLCTPLDTDLLPLSFDSLVIAAR

SEQ ID NO: 3195316 - protein, 21 aa, Giardia lamblia
RAPPFRKLRALPITSRRRLCV

SEQ ID NO: 3195317 - protein, 19 aa, Giardia lamblia
RAPQFTKCSYSLSSSLLGL

SEQ ID NO: 3195318 - protein, 24 aa, Giardia lamblia
RAPSTLSMLLSQKAGPSFGVSTGQ

SEQ ID NO: 3195319 - protein, 20 aa, Giardia lamblia
RAPVKFSAALLNLREKQISA

SEQ ID NO: 3195320 - protein, 35 aa, Giardia lamblia
RAQKNMYLDWKTVIVSMLCRYLNLLEQSRGKNILR

SEQ ID NO: 3195321 - protein, 27 aa, Giardia lamblia
RAQLSVYFLGPIYAYNNLYATVCSTNL

SEQ ID NO: 3195322 - protein, 34 aa, Giardia lamblia
RAQQLDVPLPFPLFILTPDPYFLSGPGRQLLFSG

SEQ ID NO: 3195323 - protein, 34 aa, Giardia lamblia
RARCNECVLFWKPGLQAPYQRWPARMIAVVGCKS

SEQ ID NO: 3195324 - protein, 24 aa, Giardia lamblia
RARGLPTVPALYCDVDASTGAVSG

SEQ ID NO: 3195325 - protein, 31 aa, Giardia lamblia
RARKRHVLIFSIELANPYSICKYLYTGKTPE

SEQ ID NO: 3195326 - protein, 24 aa, Giardia lamblia
RARKRITAFVLTKERFDEFREEVD

SEQ ID NO: 3195327 - protein, 21 aa, Giardia lamblia
RARSLLSDKLGANWTREFDKY

SEQ ID NO: 3195328 - protein, 17 aa, Giardia lamblia
RARYLEDKLATKTYDEE

SEQ ID NO: 3195329 - protein, 30 aa, Giardia lamblia
RASALRNIAYLRLYDVLPIRNCPGVEDCTD

SEQ ID NO: 3195330 - protein, 19 aa, Giardia lamblia
RASIGFKIYATDLETAIPG

SEQ ID NO: 3195331 - protein, 20 aa, Giardia lamblia
RASLAFNSAVIPDASSLSAE

SEQ ID NO: 3195332 - protein, 24 aa, Giardia lamblia
RASPFPIAIARILIQRLKCIKKQE

SEQ ID NO: 3195333 - protein, 19 aa, Giardia lamblia
RASSLKKGLPTPTSIAIRL

SEQ ID NO: 3195334 - protein, 29 aa, Giardia lamblia
RASTNLLLYPQQTLLLREPLTEQEPGDAG

SEQ ID NO: 3195335 - protein, 18 aa, Giardia lamblia
RATDFFDELAAEESQVCP

SEQ ID NO: 3195336 - protein, 22 aa, Giardia lamblia
RATDPISFRNYLKDFTQESLTN

SEQ ID NO: 3195337 - protein, 24 aa, Giardia lamblia
RATEAKIRLAKYSLRTFYELSNGT

SEQ ID NO: 3195338 - protein, 23 aa, Giardia lamblia
RATITPLVIQRIADVIILATGED

SEQ ID NO: 3195339 - protein, 26 aa, Giardia lamblia
RATKWYSYHAALATDLLLVHAATEKP

SEQ ID NO: 3195340 - protein, 30 aa, Giardia lamblia
RATMHKYYHDKPFAFLWVDPTALDEKNCDD

SEQ ID NO: 3195341 - protein, 27 aa, Giardia lamblia
RATTEAVYPFLFDSKLLTDYASELHSA

SEQ ID NO: 3195342 - protein, 19 aa, Giardia lamblia
RAVLAFRRKPRNQVERTEN

SEQ ID NO: 3195343 - protein, 17 aa, Giardia lamblia
RAVRCICQYYYKGEYTK

SEQ ID NO: 3195344 - protein, 19 aa, Giardia lamblia
RAVYFANRAAARLGLKAEE

SEQ ID NO: 3195345 - protein, 19 aa, Giardia lamblia
RAYELANEKLRLKESDEQA

SEQ ID NO: 3195346 - protein, 23 aa, Giardia lamblia
RAYKYRGVRYQGLTALHIAAING

SEQ ID NO: 3195347 - protein, 20 aa, Giardia lamblia
RAYMAGFVPSLNDHIMYTHV

SEQ ID NO: 3195348 - protein, 24 aa, Giardia lamblia
RAYQPGWALLVQRTLACFFLVIRG

SEQ ID NO: 3195349 - protein, 23 aa, Giardia lamblia
RAYTKRLTVIPPLSNITFSGEKG

SEQ ID NO: 3195350 - protein, 19 aa, Giardia lamblia
RAYTLAMLAGNHGIAKILS

SEQ ID NO: 3195351 - protein, 17 aa, Giardia lamblia
RCDCGPSATWNEGLKAC

SEQ ID NO: 3195352 - protein, 33 aa, Giardia lamblia
RCDCHTLPPHQIELLPYLRCPMCLCKIRSAMEN

SEQ ID NO: 3195353 - protein, 28 aa, Giardia lamblia
RCGCLRKQLIYLSSQFHRLYSNFSNPSK

SEQ ID NO: 3195354 - protein, 17 aa, Giardia lamblia
RCGITPPDILYVSREEL

SEQ ID NO: 3195355 - protein, 27 aa, Giardia lamblia
RCGSPTSFLLLMLYGCCFNAQSEEPPS

SEQ ID NO: 3195356 - protein, 22 aa, Giardia lamblia
RCHNWAEISLGYTPEMALMEAS

SEQ ID NO: 3195357 - protein, 22 aa, Giardia lamblia
RCHNYAIAEILIPKEGVSIMQY

SEQ ID NO: 3195358 - protein, 37 aa, Giardia lamblia
RCILELSYYLPGVYAPILRILFTAVPIRRNPASVNML

SEQ ID NO: 3195359 - protein, 34 aa, Giardia lamblia
RCKRDYFNILSVYLDAVFRPALLKDPRIYAQEGW

SEQ ID NO: 3195360 - protein, 18 aa, Giardia lamblia
RCLFYIRNLGYKHNVKLT

SEQ ID NO: 3195361 - protein, 24 aa, Giardia lamblia
RCLQPILDVFFQRPEKRIIAVYAS

SEQ ID NO: 3195362 - protein, 25 aa, Giardia lamblia
RCMAASSFLSVIWGPAGTGKTTTLS

SEQ ID NO: 3195363 - protein, 25 aa, Giardia lamblia
RCNDNLMELLLAIDAAKRASAAHVT

SEQ ID NO: 3195364 - protein, 17 aa, Giardia lamblia
RCRGILEKVLLPCNQTE

SEQ ID NO: 3195365 - protein, 20 aa, Giardia lamblia
RCRIFIQPVGNLIWDELRLF

SEQ ID NO: 3195366 - protein, 20 aa, Giardia lamblia
RCRLFSQILHVFYGNERRVR

SEQ ID NO: 3195367 - protein, 24 aa, Giardia lamblia
RCSPHYVALSPTYAQPIAPSPIRN

SEQ ID NO: 3195368 - protein, 19 aa, Giardia lamblia
RCTLPSPSVLQQMLRYEPL

SEQ ID NO: 3195369 - protein, 18 aa, Giardia lamblia
RCTSLPTSLVRRPVVTDD

SEQ ID NO: 3195370 - protein, 27 aa, Giardia lamblia
RCVSSLIHPFAKSIFRSPLHPWQKIEE

SEQ ID NO: 3195371 - protein, 17 aa, Giardia lamblia
RCYAALGDLPLSITARE

SEQ ID NO: 3195372 - protein, 25 aa, Giardia lamblia
RDAFPALGFKFKYDDSIFVCRSIKL

SEQ ID NO: 3195373 - protein, 23 aa, Giardia lamblia
RDAKIVFLYSFTKYGRVQADTQS

SEQ ID NO: 3195374 - protein, 28 aa, Giardia lamblia
RDALGRAPLHYAVLSRAPHVVQLILQYP

SEQ ID NO: 3195375 - protein, 31 aa, Giardia lamblia
RDALLKIARIDLLGFLLSLYNTTLSGSLSKL

SEQ ID NO: 3195376 - protein, 26 aa, Giardia lamblia
RDARGRTALMYAAEAGHLVIAEALLP

SEQ ID NO: 3195377 - protein, 25 aa, Giardia lamblia
RDCNVHIISRKPGLWPIFTEQLEAM

SEQ ID NO: 3195378 - protein, 29 aa, Giardia lamblia
RDCNVHIISRKPGLWPIFTEQLEAMARKY

SEQ ID NO: 3195379 - protein, 21 aa, Giardia lamblia
RDCYLYLQLTSAIYLSFMRCP

SEQ ID NO: 3195380 - protein, 18 aa, Giardia lamblia
RDDFGNTALIYACKAGRA

SEQ ID NO: 3195381 - protein, 25 aa, Giardia lamblia
RDDFINIGLRLFPAYLQLAQDIQNI

SEQ ID NO: 3195382 - protein, 20 aa, Giardia lamblia
RDDILHWEKNNSLLPAVFVP

SEQ ID NO: 3195383 - protein, 23 aa, Giardia lamblia
RDDLKALLNANTVLRDVFVRQNN

SEQ ID NO: 3195384 - protein, 23 aa, Giardia lamblia
RDDTSLLFIQNTSAPVIAKAVGD

SEQ ID NO: 3195385 - protein, 27 aa, Giardia lamblia
RDEAALGLFQLLPRPDVRIGLQSLADL

SEQ ID NO: 3195386 - protein, 30 aa, Giardia lamblia
RDELKQTKKAPVRYLITLSCLCIAQRGRVV

SEQ ID NO: 3195387 - protein, 24 aa, Giardia lamblia
RDENSIIVIFWGLNPADESQQYSF

SEQ ID NO: 3195388 - protein, 21 aa, Giardia lamblia
RDFLMKLVSNGNRYPGAVSKT

SEQ ID NO: 3195389 - protein, 17 aa, Giardia lamblia
RDFRFNAKGSRAYPFCI

SEQ ID NO: 3195390 - protein, 18 aa, Giardia lamblia
RDFSTLCVKSMFLYDMES

SEQ ID NO: 3195391 - protein, 31 aa, Giardia lamblia
RDGDKLSLFGKIGCYWVFRAETDAYIEPEEE

SEQ ID NO: 3195392 - protein, 29 aa, Giardia lamblia
RDHTLAMAALLIPIYNLIAKYHLTQVMSC

SEQ ID NO: 3195393 - protein, 21 aa, Giardia lamblia
RDICAHIFDIVLVGSSYPPIT

SEQ ID NO: 3195394 - protein, 26 aa, Giardia lamblia
RDIKEKLCFVALDYESVLAASMESAN

SEQ ID NO: 3195395 - protein, 23 aa, Giardia lamblia
RDIKPGNVFLTRDGSIKLGDFGL

SEQ ID NO: 3195396 - protein, 26 aa, Giardia lamblia
RDKELLEKDLTIDRLLDAIRVQEDSF

SEQ ID NO: 3195397 - protein, 23 aa, Giardia lamblia
RDKFKSIQGYLSYLAPEVLQTYK

SEQ ID NO: 3195398 - protein, 17 aa, Giardia lamblia
RDKIVHVLSIMGFSYAR

SEQ ID NO: 3195399 - protein, 26 aa, Giardia lamblia
RDKKKNFIRFSFTPDYMKFGMTSGLD

SEQ ID NO: 3195400 - protein, 17 aa, Giardia lamblia
RDKLAFLENKAKSYEYK

SEQ ID NO: 3195401 - protein, 27 aa, Giardia lamblia
RDKLKAMLMRWFSTKLAQPETSNAELL

SEQ ID NO: 3195402 - protein, 24 aa, Giardia lamblia
RDKLTLEDWYCSSIRREQLHQEIL

SEQ ID NO: 3195403 - protein, 21 aa, Giardia lamblia
RDKYSFALEPELRKLGLPTSL

SEQ ID NO: 3195404 - protein, 21 aa, Giardia lamblia
RDLAALQNRYKELDAALIQKT

SEQ ID NO: 3195405 - protein, 26 aa, Giardia lamblia
RDLASIFSLHLGFFGIPVLGSPTRRN

SEQ ID NO: 3195406 - protein, 18 aa, Giardia lamblia
RDLEAGMRTTMGLSALMI

SEQ ID NO: 3195407 - protein, 23 aa, Giardia lamblia
RDLIYAMQGLPGQYFELIKDPTS

SEQ ID NO: 3195408 - protein, 17 aa, Giardia lamblia
RDLKPANVLISKKGKRF

SEQ ID NO: 3195409 - protein, 21 aa, Giardia lamblia
RDLNTNGLFACKKIDYGNVAV

SEQ ID NO: 3195410 - protein, 24 aa, Giardia lamblia
RDLPPQMVSLFIQQVRSIAPIRVP

SEQ ID NO: 3195411 - protein, 23 aa, Giardia lamblia
RDLPVMREGFGYALLSSMGITEE

SEQ ID NO: 3195412 - protein, 18 aa, Giardia lamblia
RDLQLRFPYMEFPGSCPG

SEQ ID NO: 3195413 - protein, 26 aa, Giardia lamblia
RDLSKVFQGILMIDPLSVVAKLSNDG

SEQ ID NO: 3195414 - protein, 31 aa, Giardia lamblia
RDLVGRFFSGDPVYAELLRLLAEGSISPDLV

SEQ ID NO: 3195415 - protein, 24 aa, Giardia lamblia
RDLYRLYADFVVKNPFFVPNQLIR

SEQ ID NO: 3195416 - protein, 19 aa, Giardia lamblia
RDMGTVFRAALFISNSFQA

SEQ ID NO: 3195417 - protein, 17 aa, Giardia lamblia
RDMLVGRVHFVHAAKKL

SEQ ID NO: 3195418 - protein, 27 aa, Giardia lamblia
RDNSELERLLCVISEKDRELVSLRDII

SEQ ID NO: 3195419 - protein, 23 aa, Giardia lamblia
RDNSGWTALIWAARTGHIDCLEL

SEQ ID NO: 3195420 - protein, 28 aa, Giardia lamblia
RDNYNRTPLMYLVMHRRDTLARHDLGRC

SEQ ID NO: 3195421 - protein, 32 aa, Giardia lamblia
RDPKDRYNIPPLSLKLPLQNALPTAANPPTVM

SEQ ID NO: 3195422 - protein, 22 aa, Giardia lamblia
RDPNVRVMRKISRSLLTQFVFI

SEQ ID NO: 3195423 - protein, 25 aa, Giardia lamblia
RDPVFKAILEHIFTLDPHARLTADE

SEQ ID NO: 3195424 - protein, 23 aa, Giardia lamblia
RDQAVFSAVLPNLILSTLDLTGT

SEQ ID NO: 3195425 - protein, 25 aa, Giardia lamblia
RDQLMRYIEKIPTTPLARETSTRNS

SEQ ID NO: 3195426 - protein, 22 aa, Giardia lamblia
RDQLYVFVANFFRQLNEERQRA

SEQ ID NO: 3195427 - protein, 20 aa, Giardia lamblia
RDRIRKHFLLSENQGAGVRS

SEQ ID NO: 3195428 - protein, 21 aa, Giardia lamblia
RDRYLTFYRAQDSLLEAMITD

SEQ ID NO: 3195429 - protein, 23 aa, Giardia lamblia
RDSALLLQKYLWDGKREFSGALI

SEQ ID NO: 3195430 - protein, 20 aa, Giardia lamblia
RDSHVLLKADFFSCIIKFKI

SEQ ID NO: 3195431 - protein, 17 aa, Giardia lamblia
RDSKLTRVLQDSLGGNC

SEQ ID NO: 3195432 - protein, 26 aa, Giardia lamblia
RDSKLTYYITFARAFLRISVKLSDEA

SEQ ID NO: 3195433 - protein, 27 aa, Giardia lamblia
RDSLDTQYIAFGKIAKPPSVTAIAQLS

SEQ ID NO: 3195434 - protein, 22 aa, Giardia lamblia
RDSMGWSALIWASAKGHLKVVM

SEQ ID NO: 3195435 - protein, 28 aa, Giardia lamblia
RDSPGPPQGFLKRLKRAVKYLFSGTYEG

SEQ ID NO: 3195436 - protein, 22 aa, Giardia lamblia
RDSREEILKAFRLFDEDDTGKI

SEQ ID NO: 3195437 - protein, 26 aa, Giardia lamblia
RDSSGWTALMFAAWYGHPECVELFLE

SEQ ID NO: 3195438 - protein, 26 aa, Giardia lamblia
RDSWTSFMVMFAQTLLRMAAGVVDDR

SEQ ID NO: 3195439 - protein, 20 aa, Giardia lamblia
RDSYYCITAYAHAYFREHVF

SEQ ID NO: 3195440 - protein, 23 aa, Giardia lamblia
RDTLARHDLGRCIKLLIRTQEGA

SEQ ID NO: 3195441 - protein, 25 aa, Giardia lamblia
RDTQPLTMEYFLGTNDFFIDTPPLS

SEQ ID NO: 3195442 - protein, 33 aa, Giardia lamblia
RDTRFCYCAVLSLTILLKRVPSLIGLHLNNLID

SEQ ID NO: 3195443 - protein, 31 aa, Giardia lamblia
RDTTRSDLTVLYPFINILSSSTYPHLGILRP

SEQ ID NO: 3195444 - protein, 25 aa, Giardia lamblia
RDVKPGNIMLANDGFFKLCDFNLAR

SEQ ID NO: 3195445 - protein, 18 aa, Giardia lamblia
RDVLMKYISLLFCDGFAA

SEQ ID NO: 3195446 - protein, 24 aa, Giardia lamblia
RDVLYIIMELFERGDLKNFIKNLR

SEQ ID NO: 3195447 - protein, 71 aa, Giardia lamblia
RDVMAKFPLVLDKLLYRDLLSCKVLPWLGPVEYVSFLAKTAHTPLFCYLAHKLRDCACYYLPIISDHKRSL

SEQ ID NO: 3195448 - protein, 23 aa, Giardia lamblia
RDVRQQYIFLNIIGSGSFGKVHK

SEQ ID NO: 3195449 - protein, 17 aa, Giardia lamblia
REAFILKEALYVPGRFN

SEQ ID NO: 3195450 - protein, 23 aa, Giardia lamblia
REAFLLPDISGMQTLPLPSPESD

SEQ ID NO: 3195451 - protein, 30 aa, Giardia lamblia
REAGIALGILLFQYVSSLYDIMWNDIAYVS

SEQ ID NO: 3195452 - protein, 19 aa, Giardia lamblia
REALIFDSFTTQMAGTSGQ

SEQ ID NO: 3195453 - protein, 23 aa, Giardia lamblia
REALIYERVLLPMRSAPSRPSRQ

SEQ ID NO: 3195454 - protein, 27 aa, Giardia lamblia
REALKLAMHKQTLLRQIDLAESILQSV

SEQ ID NO: 3195455 - protein, 24 aa, Giardia lamblia
REARFDHDPLLKRAATDNTTLRTL

SEQ ID NO: 3195456 - protein, 40 aa, Giardia lamblia
REASIYCHYCYGKLFLFGEKLNILSSFWSTGPSTAGALAT

SEQ ID NO: 3195457 - protein, 22 aa, Giardia lamblia
REATLVLLRPCAQKEELYISYI

SEQ ID NO: 3195458 - protein, 17 aa, Giardia lamblia
RECGELQDLVVLLEATL

SEQ ID NO: 3195459 - protein, 28 aa, Giardia lamblia
REDFKLSESEFFLRSLNISGGADIVYNA

SEQ ID NO: 3195460 - protein, 23 aa, Giardia lamblia
REDSYLSILEALRATMHKYYHDK

SEQ ID NO: 3195461 - protein, 23 aa, Giardia lamblia
REEALAMQVVSLQKALEAETQDG

SEQ ID NO: 3195462 - protein, 27 aa, Giardia lamblia
REEDLPLIVEKLKTNTKMLIKNITRQN

SEQ ID NO: 3195463 - protein, 24 aa, Giardia lamblia
REEDLRLAAMLRQKEIEERKKEEE

SEQ ID NO: 3195464 - protein, 27 aa, Giardia lamblia
REELVAIVLALRKEVEVKNKLLTLGSQ

SEQ ID NO: 3195465 - protein, 19 aa, Giardia lamblia
REETRHLLAQRQLDMQERR

SEQ ID NO: 3195466 - protein, 17 aa, Giardia lamblia
REEVPSKAVTILRQVCI

SEQ ID NO: 3195467 - protein, 21 aa, Giardia lamblia
REFADILLPIIKEKGYNVIQL

SEQ ID NO: 3195468 - protein, 22 aa, Giardia lamblia
REFADLIRRMLCIDPRSRASVT

SEQ ID NO: 3195469 - protein, 17 aa, Giardia lamblia
REFAKTLSWERCMVIEK

SEQ ID NO: 3195470 - protein, 25 aa, Giardia lamblia
REFCDAIKILLPLEEHMKNVAGHTA

SEQ ID NO: 3195471 - protein, 30 aa, Giardia lamblia
REFEARKVLLKLLHKTVTLIKDSPLRAQEI

SEQ ID NO: 3195472 - protein, 32 aa, Giardia lamblia
REFNTLLKVLFPGRLYDLKQCCSWIGSLESLA

SEQ ID NO: 3195473 - protein, 17 aa, Giardia lamblia
REFRIVSFKSLRQVAQI

SEQ ID NO: 3195474 - protein, 33 aa, Giardia lamblia
REGHLLQPGVYWDLLSELMPVVLRVVLPRLNTP

SEQ ID NO: 3195475 - protein, 17 aa, Giardia lamblia
REGLLVISPELGDYELD

SEQ ID NO: 3195476 - protein, 23 aa, Giardia lamblia
REGYTALMYAAMNGNIVGLSCLL

SEQ ID NO: 3195477 - protein, 19 aa, Giardia lamblia
REHGLLSQVLLYKDDADND

SEQ ID NO: 3195478 - protein, 26 aa, Giardia lamblia
REIEKRLYLRPALAALLTLHAQNLAE

SEQ ID NO: 3195479 - protein, 30 aa, Giardia lamblia
REIRCCLHCGFPILPGFLSSRRGMTSFLTS

SEQ ID NO: 3195480 - protein, 30 aa, Giardia lamblia
REIRIRPGSAIPFVIKYKFPDERASDGVLS

SEQ ID NO: 3195481 - protein, 20 aa, Giardia lamblia
REIWEQVLVLLIVSSSRPLL

SEQ ID NO: 3195482 - protein, 20 aa, Giardia lamblia
REKAMISHDEKTALILAAEN

SEQ ID NO: 3195483 - protein, 27 aa, Giardia lamblia
REKEKLYLLFYHLCITGIESLRAHMSQ

SEQ ID NO: 3195484 - protein, 19 aa, Giardia lamblia
REKLDLALRFYDGALEVDL

SEQ ID NO: 3195485 - protein, 19 aa, Giardia lamblia
REKLFGFSERRWNALKTEV

SEQ ID NO: 3195486 - protein, 22 aa, Giardia lamblia
REKVIAHICEITVPVEIPKSAP

SEQ ID NO: 3195487 - protein, 26 aa, Giardia lamblia
RELCKDILPAYAPASISSGGLISLAR

SEQ ID NO: 3195488 - protein, 18 aa, Giardia lamblia
RELFRRAAASPAETQVSV

SEQ ID NO: 3195489 - protein, 18 aa, Giardia lamblia
RELLSGSGRPGFTSVTQP

SEQ ID NO: 3195490 - protein, 21 aa, Giardia lamblia
RELMALREQLTASEKDLIDAR

SEQ ID NO: 3195491 - protein, 17 aa, Giardia lamblia
RELPKAEGRRRILYSFM

SEQ ID NO: 3195492 - protein, 19 aa, Giardia lamblia
RELQDPHFLKYLKQKSNPK

SEQ ID NO: 3195493 - protein, 21 aa, Giardia lamblia
RELQLLPYLKHRNVINCCEAH

SEQ ID NO: 3195494 - protein, 23 aa, Giardia lamblia
RELQRAEYFTKKDGFYYPCEAND

SEQ ID NO: 3195495 - protein, 17 aa, Giardia lamblia
RELWAKHTRGLSLGEPL

SEQ ID NO: 3195496 - protein, 19 aa, Giardia lamblia
RELYVPSDIARKLLFRVET

SEQ ID NO: 3195497 - protein, 18 aa, Giardia lamblia
REMLHRPPVLLVIGMAGA

SEQ ID NO: 3195498 - protein, 27 aa, Giardia lamblia
REMSPALFVEIIQAPYLYIPAIEEHIN

SEQ ID NO: 3195499 - protein, 25 aa, Giardia lamblia
RENGLRYTIAFNLGFLNANISNKEV

SEQ ID NO: 3195500 - protein, 20 aa, Giardia lamblia
RENLYARLVMAPVTLTHEQL

SEQ ID NO: 3195501 - protein, 20 aa, Giardia lamblia
RENNLKYFKAGRTNILIGTD

SEQ ID NO: 3195502 - protein, 26 aa, Giardia lamblia
RENSTLILPGYLWSLAVLEEKDLSSA

SEQ ID NO: 3195503 - protein, 25 aa, Giardia lamblia
REPHGIAVLQLYRALTTKMGVALLG

SEQ ID NO: 3195504 - protein, 23 aa, Giardia lamblia
REPKYIPIFERMLEPERVIIFRV

SEQ ID NO: 3195505 - protein, 31 aa, Giardia lamblia
REQAVKFILQMRVTTLKDLETALFLAVEKEY

SEQ ID NO: 3195506 - protein, 25 aa, Giardia lamblia
REQHCFIHYYRPKGSILLSDLVTEY

SEQ ID NO: 3195507 - protein, 20 aa, Giardia lamblia
REQHVFMDFTSIGPGPNVGL

SEQ ID NO: 3195508 - protein, 23 aa, Giardia lamblia
REQKQYIAIFFVGADGLTGKVDI

SEQ ID NO: 3195509 - protein, 19 aa, Giardia lamblia
REQLLRFDSFKDSAAMAED

SEQ ID NO: 3195510 - protein, 29 aa, Giardia lamblia
REQRPISLELLIPCFVRLLIAYKSHSLLY

SEQ ID NO: 3195511 - protein, 26 aa, Giardia lamblia
RERFLERAWAWKEQFGGRILSQLRIL

SEQ ID NO: 3195512 - protein, 26 aa, Giardia lamblia
RERFSQKTLSVIDLYKILGNYDRQIA

SEQ ID NO: 3195513 - protein, 19 aa, Giardia lamblia
RERVHPVIKLLADLEAGVK

SEQ ID NO: 3195514 - protein, 23 aa, Giardia lamblia
RESAVFWINGDTILLDIVRSYVT

SEQ ID NO: 3195515 - protein, 21 aa, Giardia lamblia
RESCHFILLQPHDYLIRHYGK

SEQ ID NO: 3195516 - protein, 34 aa, Giardia lamblia
RESKLLYYSLCEFTKVYAPLISPCDTRVFDDLRS

SEQ ID NO: 3195517 - protein, 23 aa, Giardia lamblia
RESNLELVSLLEEKKRIEEDITE

SEQ ID NO: 3195518 - protein, 25 aa, Giardia lamblia
RESRTITRLIEVLNFQPYKDSCTSG

SEQ ID NO: 3195519 - protein, 29 aa, Giardia lamblia
RESSPTPQGLLWRILKHLTFASNKNDTEW

SEQ ID NO: 3195520 - protein, 23 aa, Giardia lamblia
RETGGFTALVWAAREGHLACIKV

SEQ ID NO: 3195521 - protein, 19 aa, Giardia lamblia
RETLACLHLTYYDLDYYYY

SEQ ID NO: 3195522 - protein, 17 aa, Giardia lamblia
RETLSRQLILLRSKVVV

SEQ ID NO: 3195523 - protein, 31 aa, Giardia lamblia
RETNIFGWNALMFAAYFDNHDAVKLFLNDEK

SEQ ID NO: 3195524 - protein, 30 aa, Giardia lamblia
RETPIPEPQIWWLLAQMGSALRFLHSGGNG

SEQ ID NO: 3195525 - protein, 25 aa, Giardia lamblia
RETPRSFELFTKLFKELILVESNTT

SEQ ID NO: 3195526 - protein, 22 aa, Giardia lamblia
REVMKLLRPDLFDKSGAYIKGA

SEQ ID NO: 3195527 - protein, 24 aa, Giardia lamblia
REVQPTYFEKLSFSLPVPSTMDEF

SEQ ID NO: 3195528 - protein, 25 aa, Giardia lamblia
REVQRLKLLLLDRDSQIQRVRDINE

SEQ ID NO: 3195529 - protein, 17 aa, Giardia lamblia
REVSKEPIKVVLTGVRG

SEQ ID NO: 3195530 - protein, 19 aa, Giardia lamblia
REWRRPPLAMNFDIPMYTA

SEQ ID NO: 3195531 - protein, 17 aa, Giardia lamblia
REYTRLQGLMVVENKQR

SEQ ID NO: 3195532 - protein, 17 aa, Giardia lamblia
RFAASLAVLIGPMGPYS

SEQ ID NO: 3195533 - protein, 18 aa, Giardia lamblia
RFAKIYYWGQQANKQYNG

SEQ ID NO: 3195534 - protein, 18 aa, Giardia lamblia
RFAKPCVALIGLRPSYEV

SEQ ID NO: 3195535 - protein, 19 aa, Giardia lamblia
RFAKQPISTGFKLHTKKMT

SEQ ID NO: 3195536 - protein, 29 aa, Giardia lamblia
RFCTTERLQMILTFYKKMIPTQQELFIPL

SEQ ID NO: 3195537 - protein, 26 aa, Giardia lamblia
RFDARRYVQWADLFQTMKHAQLILST

SEQ ID NO: 3195538 - protein, 18 aa, Giardia lamblia
RFDDDDIYPVYRFGCINT

SEQ ID NO: 3195539 - protein, 28 aa, Giardia lamblia
RFDHYRSQAKKYKDLYRRAFNVVERMKV

SEQ ID NO: 3195540 - protein, 25 aa, Giardia lamblia
RFDMTFISVLVHYLSIGYDANGYRS

SEQ ID NO: 3195541 - protein, 26 aa, Giardia lamblia
RFDNRALFELVLQYLLRHPDAPALAS

SEQ ID NO: 3195542 - protein, 20 aa, Giardia lamblia
RFEGGTPVRPTNATTLAAET

SEQ ID NO: 3195543 - protein, 23 aa, Giardia lamblia
RFEKRIEIVLPDAAARKNILRSG

SEQ ID NO: 3195544 - protein, 18 aa, Giardia lamblia
RFGRLLYCLLTTSVCDSL

SEQ ID NO: 3195545 - protein, 17 aa, Giardia lamblia
RFGRTVSIPIFTSTWRP

SEQ ID NO: 3195546 - protein, 19 aa, Giardia lamblia
RFHLGKKLGLFLTDSITNK

SEQ ID NO: 3195547 - protein, 19 aa, Giardia lamblia
RFHSPSLFCLKLLAEYGPL

SEQ ID NO: 3195548 - protein, 21 aa, Giardia lamblia
RFIAQLQLNYAEKCSEAEILR

SEQ ID NO: 3195549 - protein, 31 aa, Giardia lamblia
RFIDLEKLLVDTRLWFQSQLKEELVALSDYM

SEQ ID NO: 3195550 - protein, 29 aa, Giardia lamblia
RFKKMPTPQVLPLQRIQLRTPKPPVYVRT

SEQ ID NO: 3195551 - protein, 24 aa, Giardia lamblia
RFKVIKVAGIGLLALFLRKREKRA

SEQ ID NO: 3195552 - protein, 20 aa, Giardia lamblia
RFLEIERALVSFKNNARRTS

SEQ ID NO: 3195553 - protein, 23 aa, Giardia lamblia
RFLKKTVFPGILPKILQVLLDAR

SEQ ID NO: 3195554 - protein, 18 aa, Giardia lamblia
RFLREFDFRFTYTRSSID

SEQ ID NO: 3195555 - protein, 19 aa, Giardia lamblia
RFLSYIEPGTQRWKAAATL

SEQ ID NO: 3195556 - protein, 17 aa, Giardia lamblia
RFMAILIENTGGRFPFW

SEQ ID NO: 3195557 - protein, 18 aa, Giardia lamblia
RFMEDLITLWNITSSNMF

SEQ ID NO: 3195558 - protein, 18 aa, Giardia lamblia
RFNGGWRAIKKHPFFTEH

SEQ ID NO: 3195559 - protein, 23 aa, Giardia lamblia
RFNPFPHRSFTHTLIFNTSLGLN

SEQ ID NO: 3195560 - protein, 21 aa, Giardia lamblia
RFNRTWEERLLAFENKARAKR

SEQ ID NO: 3195561 - protein, 20 aa, Giardia lamblia
RFPPAGDALHRALNLARTAA

SEQ ID NO: 3195562 - protein, 21 aa, Giardia lamblia
RFQVVNITQYYARKNTPAASM

SEQ ID NO: 3195563 - protein, 22 aa, Giardia lamblia
RFREYVELYRRCNCNNLMRIYK

SEQ ID NO: 3195564 - protein, 28 aa, Giardia lamblia
RFRNEGHSVLPRFLWRYSKNDSSVEYED

SEQ ID NO: 3195565 - protein, 18 aa, Giardia lamblia
RFSGLLSSSKIKANVTFK

SEQ ID NO: 3195566 - protein, 30 aa, Giardia lamblia
RFSGSMQQTLLLNPVRPRSFQIEFSPISET

SEQ ID NO: 3195567 - protein, 17 aa, Giardia lamblia
RFSLLLDTPYNCSNSYF

SEQ ID NO: 3195568 - protein, 24 aa, Giardia lamblia
RFSRRVLCMGVIPKKAIPNHANGV

SEQ ID NO: 3195569 - protein, 25 aa, Giardia lamblia
RFTRAIIHRYIMPRRIFMVSETRCK

SEQ ID NO: 3195570 - protein, 26 aa, Giardia lamblia
RFVIADFGLCRNTLWSGSTLIGIMAY

SEQ ID NO: 3195571 - protein, 27 aa, Giardia lamblia
RFVKDIQKHFPLYTLAALVAHNEFMVR

SEQ ID NO: 3195572 - protein, 19 aa, Giardia lamblia
RFVKKYLPTIGVDYGVRAL

SEQ ID NO: 3195573 - protein, 19 aa, Giardia lamblia
RFVLDFKIKELRKCIEPRE

SEQ ID NO: 3195574 - protein, 17 aa, Giardia lamblia
RGAGLVTRIPFLNAKHA

SEQ ID NO: 3195575 - protein, 17 aa, Giardia lamblia
RGALVYLVKLRHLLELK

SEQ ID NO: 3195576 - protein, 23 aa, Giardia lamblia
RGANISLLYIQRLVLQCPEQPEL

SEQ ID NO: 3195577 - protein, 20 aa, Giardia lamblia
RGANLLFYGAPFYSRVYLEY

SEQ ID NO: 3195578 - protein, 22 aa, Giardia lamblia
RGAPLPPPIMTSCGPPYLSSQV

SEQ ID NO: 3195579 - protein, 24 aa, Giardia lamblia
RGASGILYALEGYPALAVREIQLD

SEQ ID NO: 3195580 - protein, 28 aa, Giardia lamblia
RGCFLEQNYLYIILELVDFGSLQTLIKQ

SEQ ID NO: 3195581 - protein, 18 aa, Giardia lamblia
RGCFSEVGGTNYLKLMKR

SEQ ID NO: 3195582 - protein, 25 aa, Giardia lamblia
RGCPAMVMWAIIDGLLPGFDFAIPR

SEQ ID NO: 3195583 - protein, 23 aa, Giardia lamblia
RGCSLLHIRTMDSLVRRLKSFFI

SEQ ID NO: 3195584 - protein, 19 aa, Giardia lamblia
RGDHILARISSRPGQVGTA

SEQ ID NO: 3195585 - protein, 17 aa, Giardia lamblia
RGDLYKGIKQFYTHMGI

SEQ ID NO: 3195586 - protein, 20 aa, Giardia lamblia
RGDSSLFPFGFHVTGMPICG

SEQ ID NO: 3195587 - protein, 26 aa, Giardia lamblia
RGDTKIIKYLLQRFSFTEQELLSTLH

SEQ ID NO: 3195588 - protein, 26 aa, Giardia lamblia
RGELHKKMLLLANSLNVDDDFSKKLL

SEQ ID NO: 3195589 - protein, 25 aa, Giardia lamblia
RGEMPRNWLLAMHRVLETFAECSSS

SEQ ID NO: 3195590 - protein, 19 aa, Giardia lamblia
RGEQYKLITEIRAKEMECD

SEQ ID NO: 3195591 - protein, 21 aa, Giardia lamblia
RGESFSFFRGWKSQCLFDSLN

SEQ ID NO: 3195592 - protein, 24 aa, Giardia lamblia
RGETALLLAASNNHVKCCELLVAA

SEQ ID NO: 3195593 - protein, 21 aa, Giardia lamblia
RGEWRLVGFSCCLPGGINFEF

SEQ ID NO: 3195594 - protein, 25 aa, Giardia lamblia
RGGDPTKPILFFGRNYEEELAMQLA

SEQ ID NO: 3195595 - protein, 33 aa, Giardia lamblia
RGGGLYMQIPVLDFLMHPSPITLLAKYSVISFD

SEQ ID NO: 3195596 - protein, 20 aa, Giardia lamblia
RGGLTKLMSAAIRGDLVTAK

SEQ ID NO: 3195597 - protein, 26 aa, Giardia lamblia
RGGSGYQIVFLLAYMAIACPGSCYLN

SEQ ID NO: 3195598 - protein, 22 aa, Giardia lamblia
RGHDVIFLLGDLNYRLHTFSTK

SEQ ID NO: 3195599 - protein, 18 aa, Giardia lamblia
RGHIQLLMTLVWSMNTAA

SEQ ID NO: 3195600 - protein, 42 aa, Giardia lamblia
RGIPSTLIHHFYFQPIRPVDFKFRLLFMELPEEVFDEAYLYL

SEQ ID NO: 3195601 - protein, 18 aa, Giardia lamblia
RGIQRDILHLCESALMTN

SEQ ID NO: 3195602 - protein, 23 aa, Giardia lamblia
RGISGDFEKFKENSRTCLKALEQ

SEQ ID NO: 3195603 - protein, 20 aa, Giardia lamblia
RGIYVDGLSMHRVTTAAELS

SEQ ID NO: 3195604 - protein, 26 aa, Giardia lamblia
RGKKKLGRPFGCSLLIGGLDGSTPRL

SEQ ID NO: 3195605 - protein, 18 aa, Giardia lamblia
RGKPRSFLTNLCTRPAYS

SEQ ID NO: 3195606 - protein, 25 aa, Giardia lamblia
RGKQFICLLKMHHRLIELKVRANNP

SEQ ID NO: 3195607 - protein, 18 aa, Giardia lamblia
RGKTKPYYTYNPGTSMMS

SEQ ID NO: 3195608 - protein, 22 aa, Giardia lamblia
RGLDIPNVRLVLNYDLPGNVDD

SEQ ID NO: 3195609 - protein, 33 aa, Giardia lamblia
RGLDKQFYAMPLTFSMLGYERVMLSKLASTDWV

SEQ ID NO: 3195610 - protein, 26 aa, Giardia lamblia
RGLIPRTISYLFQFFEESNSPTFTIE

SEQ ID NO: 3195611 - protein, 17 aa, Giardia lamblia
RGLMPRALEQVFGFVAN

SEQ ID NO: 3195612 - protein, 17 aa, Giardia lamblia
RGLMVMKYPITPLSQNS

SEQ ID NO: 3195613 - protein, 18 aa, Giardia lamblia
RGLRTYLGSVFAGSLLSQ

SEQ ID NO: 3195614 - protein, 30 aa, Giardia lamblia
RGLSTVLVQKSLFFLCHCGVASFGENFCSN

SEQ ID NO: 3195615 - protein, 22 aa, Giardia lamblia
RGLTGSYKLDPALIPKLCEPCD

SEQ ID NO: 3195616 - protein, 27 aa, Giardia lamblia
RGNIEVMKVIHPYFALRTDQSGFSALD

SEQ ID NO: 3195617 - protein, 24 aa, Giardia lamblia
RGNIKKVIVDLNTQIRQLTSVNER

SEQ ID NO: 3195618 - protein, 17 aa, Giardia lamblia
RGNYLPSGSRKESTDGY

SEQ ID NO: 3195619 - protein, 28 aa, Giardia lamblia
RGPFPSVTMWKWYKQGSLPNTLRIRVAG

SEQ ID NO: 3195620 - protein, 24 aa, Giardia lamblia
RGPSIVYTGPGFRWTPIYRPPEVF

SEQ ID NO: 3195621 - protein, 17 aa, Giardia lamblia
RGQRLSHLGPTRKAISL

SEQ ID NO: 3195622 - protein, 24 aa, Giardia lamblia
RGQRYNFYPMFKTAAQIAGGEPEE

SEQ ID NO: 3195623 - protein, 17 aa, Giardia lamblia
RGQTAMMLAAQRGYLDI

SEQ ID NO: 3195624 - protein, 24 aa, Giardia lamblia
RGREGSLQAVRRIRKLELDLDQMK

SEQ ID NO: 3195625 - protein, 23 aa, Giardia lamblia
RGRKLIISCKLPSYDQIESSIDF

SEQ ID NO: 3195626 - protein, 22 aa, Giardia lamblia
RGRLRSVPLDTLLARIRSSLAD

SEQ ID NO: 3195627 - protein, 25 aa, Giardia lamblia
RGRLTTDYLFGKEPEFLFQAFVGCT

SEQ ID NO: 3195628 - protein, 17 aa, Giardia lamblia
RGRPIECPLCRKVAIKA

SEQ ID NO: 3195629 - protein, 21 aa, Giardia lamblia
RGRTAFIPLLVDKEKGIQDKY

SEQ ID NO: 3195630 - protein, 25 aa, Giardia lamblia
RGRTVSKLYSLRKLSTVLSATLATY

SEQ ID NO: 3195631 - protein, 17 aa, Giardia lamblia
RGSAEIIQILLNRDTRL

SEQ ID NO: 3195632 - protein, 32 aa, Giardia lamblia
RGSFSIECLVVLLGLKILFPNAVYLLRGNHET

SEQ ID NO: 3195633 - protein, 33 aa, Giardia lamblia
RGSRGLACVLFIYVLKYLYPRNVLLLRGNHECD

SEQ ID NO: 3195634 - protein, 26 aa, Giardia lamblia
RGSSNVIYIGYSWNYVKQLVSGVSGL

SEQ ID NO: 3195635 - protein, 24 aa, Giardia lamblia
RGSWIILMNCHLAVSWMPELDKII

SEQ ID NO: 3195636 - protein, 20 aa, Giardia lamblia
RGTCRYPDGSVYRGEWLNDV

SEQ ID NO: 3195637 - protein, 19 aa, Giardia lamblia
RGTIIYMTCTFFAGEHPPA

SEQ ID NO: 3195638 - protein, 21 aa, Giardia lamblia
RGTLAWQRPSTVRVLVMSSET

SEQ ID NO: 3195639 - protein, 20 aa, Giardia lamblia
RGTPIAWKMKGQQRLSQDVL

SEQ ID NO: 3195640 - protein, 22 aa, Giardia lamblia
RGTSVYFPDRRIDMLPAILTED

SEQ ID NO: 3195641 - protein, 26 aa, Giardia lamblia
RGVDFVQTMLDLVDLRKMETEWLIDT

SEQ ID NO: 3195642 - protein, 19 aa, Giardia lamblia
RGVFITVEDCYPLTRVRAR

SEQ ID NO: 3195643 - protein, 26 aa, Giardia lamblia
RGVHTNIAFIYYLKGDYEASARHAQI

SEQ ID NO: 3195644 - protein, 26 aa, Giardia lamblia
RGVKFTMPVLCRGPLDSASDLAFLKT

SEQ ID NO: 3195645 - protein, 28 aa, Giardia lamblia
RGVPKLILPGYMLLLSDVFFSMKVPQFP

SEQ ID NO: 3195646 - protein, 30 aa, Giardia lamblia
RGVTALMLAAYFDNFDAIQLLLDKESKTQD

SEQ ID NO: 3195647 - protein, 17 aa, Giardia lamblia
RGVVVVPDYFTPQTRRH

SEQ ID NO: 3195648 - protein, 18 aa, Giardia lamblia
RGVYSAIELLKLAGLYED

SEQ ID NO: 3195649 - protein, 33 aa, Giardia lamblia
RGWTALMMASYLGYTQIIKALLVWENGIVLGSS

SEQ ID NO: 3195650 - protein, 18 aa, Giardia lamblia
RGWTPTRSAPRRANSRPY

SEQ ID NO: 3195651 - protein, 26 aa, Giardia lamblia
RGYCDLCCLSLSKAFMLGCGHTFCDR

SEQ ID NO: 3195652 - protein, 19 aa, Giardia lamblia
RGYDVLFSKKERKRIYENW

SEQ ID NO: 3195653 - protein, 17 aa, Giardia lamblia
RGYFSVISFFGRFTTTS

SEQ ID NO: 3195654 - protein, 22 aa, Giardia lamblia
RGYITTVILRVGSWRPRRPGTE

SEQ ID NO: 3195655 - protein, 24 aa, Giardia lamblia
RGYLDILNVLLPKEKNMRFRDGAT

SEQ ID NO: 3195656 - protein, 19 aa, Giardia lamblia
RGYLEIASLLRGSTPSVNG

SEQ ID NO: 3195657 - protein, 19 aa, Giardia lamblia
RGYPSLAVQEILLDGLGKS

SEQ ID NO: 3195658 - protein, 25 aa, Giardia lamblia
RGYSDIVLQLLPKEAGIVTSNGVTA

SEQ ID NO: 3195659 - protein, 17 aa, Giardia lamblia
RGYSPWDTGTMATLFGS

SEQ ID NO: 3195660 - protein, 20 aa, Giardia lamblia
RGYTALMLAAEADNPEVCLC

SEQ ID NO: 3195661 - protein, 17 aa, Giardia lamblia
RHAYEYFDLRFARLESM

SEQ ID NO: 3195662 - protein, 25 aa, Giardia lamblia
RHDAKTLLQFVFQELGDAIRVRAQR

SEQ ID NO: 3195663 - protein, 20 aa, Giardia lamblia
RHDHLECVKLLLEKERDISG

SEQ ID NO: 3195664 - protein, 24 aa, Giardia lamblia
RHDKVLLIFLNRKASVHYLNKWNP

SEQ ID NO: 3195665 - protein, 19 aa, Giardia lamblia
RHDRHVPVPPRLGEVQRRP

SEQ ID NO: 3195666 - protein, 26 aa, Giardia lamblia
RHDRHVPVPPRLREVQRRAGGQDPQP

SEQ ID NO: 3195667 - protein, 29 aa, Giardia lamblia
RHEMTLKHLDLPCIIAIVGKFVAREDSYL

SEQ ID NO: 3195668 - protein, 23 aa, Giardia lamblia
RHERNLPIPINPDSIYLQKTARV

SEQ ID NO: 3195669 - protein, 20 aa, Giardia lamblia
RHFLKYKELYFDKTNSTLYI

SEQ ID NO: 3195670 - protein, 21 aa, Giardia lamblia
RHGHSLVNQYHIAAALFADDD

SEQ ID NO: 3195671 - protein, 26 aa, Giardia lamblia
RHGNTALIIALFLNHFKAVQLLLQHE

SEQ ID NO: 3195672 - protein, 21 aa, Giardia lamblia
RHHGFLGVLGIITALKGWSSA

SEQ ID NO: 3195673 - protein, 22 aa, Giardia lamblia
RHILPIECLMIKIGFIPETQRA

SEQ ID NO: 3195674 - protein, 28 aa, Giardia lamblia
RHINIIRLYTWFQDETRVFLVLEVAPYG

SEQ ID NO: 3195675 - protein, 22 aa, Giardia lamblia
RHKGRELLQEALNKAWDSKKEL

SEQ ID NO: 3195676 - protein, 25 aa, Giardia lamblia
RHKTAKLLILGRQFSGKSTLINYLK

SEQ ID NO: 3195677 - protein, 17 aa, Giardia lamblia
RHMLLNLIHINRRRCEL

SEQ ID NO: 3195678 - protein, 24 aa, Giardia lamblia
RHNKNFILLCSLLMRMSVPVLDTH

SEQ ID NO: 3195679 - protein, 20 aa, Giardia lamblia
RHRVCILRPMLSVHVSEISR

SEQ ID NO: 3195680 - protein, 27 aa, Giardia lamblia
RHSDGKYYYIGLSNLPQKQSPPSTVRL

SEQ ID NO: 3195681 - protein, 23 aa, Giardia lamblia
RHSFISVGQERLFLPQTAEDLSI

SEQ ID NO: 3195682 - protein, 22 aa, Giardia lamblia
RHTENHTCILIITSFIKHMDLQ

SEQ ID NO: 3195683 - protein, 17 aa, Giardia lamblia
RHTGLLLSKYKSGTLPK

SEQ ID NO: 3195684 - protein, 25 aa, Giardia lamblia
RHYEAVTMALRLIGNLTTHGLCVAR

SEQ ID NO: 3195685 - protein, 19 aa, Giardia lamblia
RHYIALANDIDLIPNSLEK

SEQ ID NO: 3195686 - protein, 24 aa, Giardia lamblia
RHYQKAAAFVLRSVARHSPSLAQA

SEQ ID NO: 3195687 - protein, 20 aa, Giardia lamblia
RHYSPRTECYLVMKGGPMLP

SEQ ID NO: 3195688 - protein, 17 aa, Giardia lamblia
RIAAIAVYIPPIVVSQE

SEQ ID NO: 3195689 - protein, 29 aa, Giardia lamblia
RIADSCRYFESWFPASFMALINEKAEMMG

SEQ ID NO: 3195690 - protein, 19 aa, Giardia lamblia
RIAISDLLISPYLDQIFAN

SEQ ID NO: 3195691 - protein, 32 aa, Giardia lamblia
RIAKSLFPSLGYYYWFLGNVADTTILPKAKPI

SEQ ID NO: 3195692 - protein, 26 aa, Giardia lamblia
RIALISLHLPTQFFKNFRCERACSLG

SEQ ID NO: 3195693 - protein, 19 aa, Giardia lamblia
RIARASQPVIIFWDEIDAV

SEQ ID NO: 3195694 - protein, 34 aa, Giardia lamblia
RIATMALYEMASTRLFLHPLAHRELQVAPLIDEV

SEQ ID NO: 3195695 - protein, 23 aa, Giardia lamblia
RIAVKLCLFAERILNVFKSILSA

SEQ ID NO: 3195696 - protein, 18 aa, Giardia lamblia
RICGNYNSVYRKYGLFIC

SEQ ID NO: 3195697 - protein, 19 aa, Giardia lamblia
RIDCVIELLDGVHGRYCYD

SEQ ID NO: 3195698 - protein, 33 aa, Giardia lamblia
RIDIIDPGLLRPGRFDKIIYIPLPNLEDRVNIL

SEQ ID NO: 3195699 - protein, 36 aa, Giardia lamblia
RIDMIHRFWTITYEHCTILPVWFDCLLSDLAAKYSG

SEQ ID NO: 3195700 - protein, 18 aa, Giardia lamblia
RIGLIALEWFQVAADRDE

SEQ ID NO: 3195701 - protein, 17 aa, Giardia lamblia
RIGPETFFQSNLAAFTM

SEQ ID NO: 3195702 - protein, 21 aa, Giardia lamblia
RIGRLLGKVCTIRIGAKTELE

SEQ ID NO: 3195703 - protein, 32 aa, Giardia lamblia
RIHDKPIRQLVYSHLLNACIKLFKAGKTGASQ

SEQ ID NO: 3195704 - protein, 21 aa, Giardia lamblia
RIHFPIPHRDIKPDNILLDYD

SEQ ID NO: 3195705 - protein, 18 aa, Giardia lamblia
RIHIFVNDCPPVNIQNPC

SEQ ID NO: 3195706 - protein, 17 aa, Giardia lamblia
RIHINDELLRLLVAAPI

SEQ ID NO: 3195707 - protein, 21 aa, Giardia lamblia
RIHLPELDILLTMEVDYLPDA

SEQ ID NO: 3195708 - protein, 18 aa, Giardia lamblia
RIIADVASGLHYLHTYHT

SEQ ID NO: 3195709 - protein, 18 aa, Giardia lamblia
RIIKELMKRIFATPHLHH

SEQ ID NO: 3195710 - protein, 18 aa, Giardia lamblia
RIIKHRIGYFITRFNIEG

SEQ ID NO: 3195711 - protein, 17 aa, Giardia lamblia
RIILEHIKPSMSEVANT

SEQ ID NO: 3195712 - protein, 20 aa, Giardia lamblia
RIIMYSFYEVLKDSKFPALQ

SEQ ID NO: 3195713 - protein, 19 aa, Giardia lamblia
RIIQLLTVVLKMINQFAPA

SEQ ID NO: 3195714 - protein, 18 aa, Giardia lamblia
RIKKLNNKITALMTEKNI

SEQ ID NO: 3195715 - protein, 20 aa, Giardia lamblia
RIKVRLLIQAEVQQGAVLQQ

SEQ ID NO: 3195716 - protein, 20 aa, Giardia lamblia
RILCLLNFRDVICRATRGQL

SEQ ID NO: 3195717 - protein, 17 aa, Giardia lamblia
RILDIKANIRYLGSRNA

SEQ ID NO: 3195718 - protein, 24 aa, Giardia lamblia
RILNDMWIYIPQSDEWRKIVCPPS

SEQ ID NO: 3195719 - protein, 18 aa, Giardia lamblia
RILQHALGGSCHTTMICT

SEQ ID NO: 3195720 - protein, 17 aa, Giardia lamblia
RILRAYSVPTLEAAAQS

SEQ ID NO: 3195721 - protein, 25 aa, Giardia lamblia
RILTLMRRHYDIETFLRSCSKLQSA

SEQ ID NO: 3195722 - protein, 18 aa, Giardia lamblia
RILTPVSVTLPPQYSRDL

SEQ ID NO: 3195723 - protein, 18 aa, Giardia lamblia
RILVPTEGGIRMLDGTSA

SEQ ID NO: 3195724 - protein, 17 aa, Giardia lamblia
RILVPYETGLRDTDGAT

SEQ ID NO: 3195725 - protein, 17 aa, Giardia lamblia
RILYELEGRVRNVNGET

SEQ ID NO: 3195726 - protein, 17 aa, Giardia lamblia
RIMCYVTAFAKALPQMV

SEQ ID NO: 3195727 - protein, 31 aa, Giardia lamblia
RIMSRPYHHYTFSFDVLKYARILNLSQITGI

SEQ ID NO: 3195728 - protein, 20 aa, Giardia lamblia
RINFYPYTVLPSARPVYQYD

SEQ ID NO: 3195729 - protein, 18 aa, Giardia lamblia
RINLWTGCPIQCTELIYG

SEQ ID NO: 3195730 - protein, 28 aa, Giardia lamblia
RINRLHVYLLKETCFLEWRYHAYIRRER

SEQ ID NO: 3195731 - protein, 29 aa, Giardia lamblia
RIPGPMIGYFRRQMLLVKGTPAKDFSHGE

SEQ ID NO: 3195732 - protein, 22 aa, Giardia lamblia
RIQEIEPYHLTFGPKAQRKRSK

SEQ ID NO: 3195733 - protein, 32 aa, Giardia lamblia
RIQLLCVSEAQVWFFLEQILAALCYMHDNQTD

SEQ ID NO: 3195734 - protein, 24 aa, Giardia lamblia
RIQTSIKHQALAQPPFCIQTNHEL

SEQ ID NO: 3195735 - protein, 17 aa, Giardia lamblia
RIRGDINILLIGDPGSA

SEQ ID NO: 3195736 - protein, 19 aa, Giardia lamblia
RIRQLAAAGLQQQGYRYDN

SEQ ID NO: 3195737 - protein, 22 aa, Giardia lamblia
RIRRLLLMEAYEVYASLLAQSR

SEQ ID NO: 3195738 - protein, 30 aa, Giardia lamblia
RIRVAGDTGPFLPLFSRWAKSLARGVDPFS

SEQ ID NO: 3195739 - protein, 17 aa, Giardia lamblia
RIRVSLKELVALQDREK

SEQ ID NO: 3195740 - protein, 19 aa, Giardia lamblia
RIRVTSLTELIYKQGQAGI

SEQ ID NO: 3195741 - protein, 39 aa, Giardia lamblia
RISKNLWQPQKIKPLKKMRYVVTPIPLPAATVSDRPSLP

SEQ ID NO: 3195742 - protein, 18 aa, Giardia lamblia
RISNIDSPLSPLAQFKTG

SEQ ID NO: 3195743 - protein, 26 aa, Giardia lamblia
RISPANILAYLLPVLTDRASNDNSIF

SEQ ID NO: 3195744 - protein, 30 aa, Giardia lamblia
RISQQTFSFFIPLRYLSTIFNSGRYFFPSL

SEQ ID NO: 3195745 - protein, 18 aa, Giardia lamblia
RISRIIRMPRGHCLLVGV

SEQ ID NO: 3195746 - protein, 26 aa, Giardia lamblia
RISTKGFLFAFRRLGLLSEISKRRHL

SEQ ID NO: 3195747 - protein, 24 aa, Giardia lamblia
RITELELELKQRPLAREYTTVDMT

SEQ ID NO: 3195748 - protein, 19 aa, Giardia lamblia
RITSINFLTPLSQHMYFLS

SEQ ID NO: 3195749 - protein, 18 aa, Giardia lamblia
RITTILSMKPMELLGLIE

SEQ ID NO: 3195750 - protein, 31 aa, Giardia lamblia
RIVAQLFSVLHYLHTLPYSSLFFVHGDVKRS

SEQ ID NO: 3195751 - protein, 32 aa, Giardia lamblia
RIVEATSFVVFPWFIYHDLFTIVFGILKNDTS

SEQ ID NO: 3195752 - protein, 18 aa, Giardia lamblia
RIVFRLCFRNWTGPGDCS

SEQ ID NO: 3195753 - protein, 19 aa, Giardia lamblia
RIVGAFPDDIIVLKGGEQT

SEQ ID NO: 3195754 - protein, 37 aa, Giardia lamblia
RIVGSIVGVRLLAKAGSLLNLAKLPASTLQILGSERA

SEQ ID NO: 3195755 - protein, 18 aa, Giardia lamblia
RIVKYVISLFAPGSQPHE

SEQ ID NO: 3195756 - protein, 17 aa, Giardia lamblia
RIVPYPDNLERKFGLLI

SEQ ID NO: 3195757 - protein, 35 aa, Giardia lamblia
RIVQQDVFFSAMSSFGGILSCRFVRGTRTTTGFGA

SEQ ID NO: 3195758 - protein, 21 aa, Giardia lamblia
RIYDRIPPFPGCEAHYLRCII

SEQ ID NO: 3195759 - protein, 18 aa, Giardia lamblia
RIYEYPECLDLRTAKTFS

SEQ ID NO: 3195760 - protein, 35 aa, Giardia lamblia
RIYTYVYTIGIRYIKFFYLRRWKLSLRASREAIYL

SEQ ID NO: 3195761 - protein, 27 aa, Giardia lamblia
RKAMQDFIHLIKAVSYLAIPAPIGTVE

SEQ ID NO: 3195762 - protein, 24 aa, Giardia lamblia
RKAPKYERFIRPSALRYRHAHVVH

SEQ ID NO: 3195763 - protein, 23 aa, Giardia lamblia
RKATGTIVGTVAYLAPEIASMKS

SEQ ID NO: 3195764 - protein, 23 aa, Giardia lamblia
RKAYLAKLSEREAHRMRYKMQAT

SEQ ID NO: 3195765 - protein, 30 aa, Giardia lamblia
RKCPLYHKLNWVIPDDPRDIFIRLYQNARE

SEQ ID NO: 3195766 - protein, 24 aa, Giardia lamblia
RKDCGDKYMWAKLINAVATGDRIP

SEQ ID NO: 3195767 - protein, 18 aa, Giardia lamblia
RKDDILVLMESEREARRL

SEQ ID NO: 3195768 - protein, 33 aa, Giardia lamblia
RKDDTYGRFVCMSGRPLIYCTNKYVPSLDAHIQ

SEQ ID NO: 3195769 - protein, 25 aa, Giardia lamblia
RKDISKLVSDIKIYRGKLAHANNKI

SEQ ID NO: 3195770 - protein, 23 aa, Giardia lamblia
RKDLYLIAAACQTELDLRAQNAT

SEQ ID NO: 3195771 - protein, 20 aa, Giardia lamblia
RKDYLHLTSGLLPNATSIEP

SEQ ID NO: 3195772 - protein, 21 aa, Giardia lamblia
RKEIVGILPNEICSSLSRSAC

SEQ ID NO: 3195773 - protein, 23 aa, Giardia lamblia
RKELILRIHMTPLQISCSEWLLE

SEQ ID NO: 3195774 - protein, 29 aa, Giardia lamblia
RKERLRSEYPKVIEPLPPKPDYGPVEKAV

SEQ ID NO: 3195775 - protein, 19 aa, Giardia lamblia
RKEWPLLKKVEHASVAQII

SEQ ID NO: 3195776 - protein, 26 aa, Giardia lamblia
RKGEKVGGWAAPVFAALCNRSNDPLV

SEQ ID NO: 3195777 - protein, 30 aa, Giardia lamblia
RKGLATLDRYLSALLALWGSSGPEAPLYQP

SEQ ID NO: 3195778 - protein, 24 aa, Giardia lamblia
RKGRIVIQNIIKPSPNTSIRPLFD

SEQ ID NO: 3195779 - protein, 19 aa, Giardia lamblia
RKGTYSNRLLSHTPASGQS

SEQ ID NO: 3195780 - protein, 17 aa, Giardia lamblia
RKHDLQLPGSRIKHLLE

SEQ ID NO: 3195781 - protein, 22 aa, Giardia lamblia
RKHFLHCFDFLSKEISAVYYAL

SEQ ID NO: 3195782 - protein, 24 aa, Giardia lamblia
RKHPKVNALKLLRDLADTTTCITV

SEQ ID NO: 3195783 - protein, 30 aa, Giardia lamblia
RKHQETLDLLFFELLTRTLLMKQASLTSIY

SEQ ID NO: 3195784 - protein, 22 aa, Giardia lamblia
RKHRIYFLNLVVEKARSAAHTK

SEQ ID NO: 3195785 - protein, 26 aa, Giardia lamblia
RKIFWNGGFVVGWFIAHPVQGPKIKK

SEQ ID NO: 3195786 - protein, 25 aa, Giardia lamblia
RKIKESCIDYILFSDSIPLSPKQIE

SEQ ID NO: 3195787 - protein, 26 aa, Giardia lamblia
RKILDSWQLTSVYGPNLIPFGGSNTK

SEQ ID NO: 3195788 - protein, 24 aa, Giardia lamblia
RKILTYKRFLEFDHGKRGREHPMT

SEQ ID NO: 3195789 - protein, 23 aa, Giardia lamblia
RKIRGLFPLCLIGSLEITNRLSQ

SEQ ID NO: 3195790 - protein, 21 aa, Giardia lamblia
RKITPDSLRRFVSSQVPNLDK

SEQ ID NO: 3195791 - protein, 17 aa, Giardia lamblia
RKKAGAILTVSRPKPQT

SEQ ID NO: 3195792 - protein, 23 aa, Giardia lamblia
RKKIQYLDWHPTENILAISTVSN

SEQ ID NO: 3195793 - protein, 26 aa, Giardia lamblia
RKKQKIARDFIKENKWLAAHPDLIHE

SEQ ID NO: 3195794 - protein, 35 aa, Giardia lamblia
RKKRRAYFKRVLLLRRWIDSYTNPLYQLPVPIVVN

SEQ ID NO: 3195795 - protein, 27 aa, Giardia lamblia
RKKSAKGHLYFLALDRELYIDAAHKGN

SEQ ID NO: 3195796 - protein, 30 aa, Giardia lamblia
RKKWGLDEELLLLRLFKVYNRSWSQYVAYY

SEQ ID NO: 3195797 - protein, 26 aa, Giardia lamblia
RKLAEKILAVPYGWDSATKSPFTKKW

SEQ ID NO: 3195798 - protein, 19 aa, Giardia lamblia
RKLALYNLLGYTQSGAIVS

SEQ ID NO: 3195799 - protein, 25 aa, Giardia lamblia
RKLEAARRMLLLEPVPHSCPDRQGL

SEQ ID NO: 3195800 - protein, 18 aa, Giardia lamblia
RKLKILMEHFPKQVAPMK

SEQ ID NO: 3195801 - protein, 28 aa, Giardia lamblia
RKLQAYLHAHPAPLLQHFSIFDKRHTGV

SEQ ID NO: 3195802 - protein, 20 aa, Giardia lamblia
RKMVVRNLLIALNKDLVKCT

SEQ ID NO: 3195803 - protein, 31 aa, Giardia lamblia
RKNKQPPPPLYFVPLMNRYNILDYQIKTEKI

SEQ ID NO: 3195804 - protein, 23 aa, Giardia lamblia
RKNMFDDYRWKKIEELKSMGVED

SEQ ID NO: 3195805 - protein, 22 aa, Giardia lamblia
RKNPDPYLKKEWYPVIAPAHFK

SEQ ID NO: 3195806 - protein, 23 aa, Giardia lamblia
RKPPNIPIISILIEYCIKHSAKR

SEQ ID NO: 3195807 - protein, 21 aa, Giardia lamblia
RKQEILKLRALIRKLEAGSVT

SEQ ID NO: 3195808 - protein, 23 aa, Giardia lamblia
RKQIRELVKVRFVLDYKIREYSR

SEQ ID NO: 3195809 - protein, 23 aa, Giardia lamblia
RKQIRLMERGEITERARAILQSN

SEQ ID NO: 3195810 - protein, 17 aa, Giardia lamblia
RKQLEAQMQLIHKTKLT

SEQ ID NO: 3195811 - protein, 31 aa, Giardia lamblia
RKQPLPERTIWQIFKGLASALVYLHSPEKKP

SEQ ID NO: 3195812 - protein, 20 aa, Giardia lamblia
RKQVIDLQVLSLKKNCSPDS

SEQ ID NO: 3195813 - protein, 25 aa, Giardia lamblia
RKRALDLLLLLVHKKDIRGYIADLF

SEQ ID NO: 3195814 - protein, 24 aa, Giardia lamblia
RKRHWYRISREINIDLSCLRYING

SEQ ID NO: 3195815 - protein, 22 aa, Giardia lamblia
RKRSGTPDYGYYRHMHREEKQR

SEQ ID NO: 3195816 - protein, 32 aa, Giardia lamblia
RKSDIWSLGIMLYAMLIGKLPFPSDNYEVLVE

SEQ ID NO: 3195817 - protein, 25 aa, Giardia lamblia
RKSLVRIKFVRIVNDIYFSNLDFKT

SEQ ID NO: 3195818 - protein, 26 aa, Giardia lamblia
RKTLEQTFLVLIKNLTGQTITIVHPS

SEQ ID NO: 3195819 - protein, 35 aa, Giardia lamblia
RKTPVSPELILSILRQLAAALAYLHSVSVGGTRGL

SEQ ID NO: 3195820 - protein, 35 aa, Giardia lamblia
RKTPVSPELVLSVLRQLAAALAYLHGLSGVGANGL

SEQ ID NO: 3195821 - protein, 23 aa, Giardia lamblia
RKTQERWVKKYLLIKVRKSSHEQ

SEQ ID NO: 3195822 - protein, 29 aa, Giardia lamblia
RKTYKEVIASRWYMRKGIALMMAAASGHA

SEQ ID NO: 3195823 - protein, 33 aa, Giardia lamblia
RKVFDRFTHTQVLMFIFAVSSQERKLKCISKTY

SEQ ID NO: 3195824 - protein, 23 aa, Giardia lamblia
RKVRGLFLIVKTHCRRVKLMHQW

SEQ ID NO: 3195825 - protein, 31 aa, Giardia lamblia
RKYHLPESSIKWYMWQLLHAVRIAHASGTFH

SEQ ID NO: 3195826 - protein, 18 aa, Giardia lamblia
RKYILDASQRRKYIAAVA

SEQ ID NO: 3195827 - protein, 19 aa, Giardia lamblia
RLAEAGIKPIFVFDGKPPE

SEQ ID NO: 3195828 - protein, 20 aa, Giardia lamblia
RLAHLLSTLVERMRLEPPSD

SEQ ID NO: 3195829 - protein, 24 aa, Giardia lamblia
RLAKCFFYEPDGLLISPMERNFVW

SEQ ID NO: 3195830 - protein, 33 aa, Giardia lamblia
RLAKLQYYVTNLPLLRYSLSAISIIPGIVTSNY

SEQ ID NO: 3195831 - protein, 24 aa, Giardia lamblia
RLANEAFRYDGWSSNIISITQDFI

SEQ ID NO: 3195832 - protein, 28 aa, Giardia lamblia
RLATLEGSMILGRGCTALIYAASVQDAD

SEQ ID NO: 3195833 - protein, 19 aa, Giardia lamblia
RLCAPVRGARPGEAALYRK

SEQ ID NO: 3195834 - protein, 22 aa, Giardia lamblia
RLCDFGLSMALQAGNPPAAAKR

SEQ ID NO: 3195835 - protein, 23 aa, Giardia lamblia
RLDEARLINLSLSTLGNVISALS

SEQ ID NO: 3195836 - protein, 21 aa, Giardia lamblia
RLDERRILYTEEIKALEDREA

SEQ ID NO: 3195837 - protein, 17 aa, Giardia lamblia
RLDGRPLSLSLSARGRS

SEQ ID NO: 3195838 - protein, 34 aa, Giardia lamblia
RLDSSLSLRTALVLMLFNYKSHLCLIFVDEYVKL

SEQ ID NO: 3195839 - protein, 21 aa, Giardia lamblia
RLEALLQLPTPDRALKLAADS

SEQ ID NO: 3195840 - protein, 26 aa, Giardia lamblia
RLEANVFIEWIYIPPQECIAGTVVVL

SEQ ID NO: 3195841 - protein, 29 aa, Giardia lamblia
RLEDVELINQLRALLDKREQELDAAAKAV

SEQ ID NO: 3195842 - protein, 23 aa, Giardia lamblia
RLEFIKHMFAFQNTLQENPMDEI

SEQ ID NO: 3195843 - protein, 20 aa, Giardia lamblia
RLEKELLDLIPAGKRVRISS

SEQ ID NO: 3195844 - protein, 38 aa, Giardia lamblia
RLEKLLLVEPLKNLCRIFSWIFALDLPKTMLKQQAAEL

SEQ ID NO: 3195845 - protein, 17 aa, Giardia lamblia
RLELLAKQRELAEKKRI

SEQ ID NO: 3195846 - protein, 17 aa, Giardia lamblia
RLELPVIIVFNKSDLIA

SEQ ID NO: 3195847 - protein, 18 aa, Giardia lamblia
RLEMRLAELKIKVNNYDQ

SEQ ID NO: 3195848 - protein, 27 aa, Giardia lamblia
RLENAWRARLVLLMLHNLVVARRKRYM

SEQ ID NO: 3195849 - protein, 27 aa, Giardia lamblia
RLEQRTFLAFFGLAARTLELTGDPDVL

SEQ ID NO: 3195850 - protein, 28 aa, Giardia lamblia
RLEQRTFLAFFGLAARTLELTGDPDVLA

SEQ ID NO: 3195851 - protein, 32 aa, Giardia lamblia
RLESQLWQPLRLATPYDIIRTPSLQLIPPSYR

SEQ ID NO: 3195852 - protein, 18 aa, Giardia lamblia
RLFAFSLLSNKRLFAYPT

SEQ ID NO: 3195853 - protein, 17 aa, Giardia lamblia
RLFCDFLARHTILDIDG

SEQ ID NO: 3195854 - protein, 19 aa, Giardia lamblia
RLFSPLARAHCQASLALSL

SEQ ID NO: 3195855 - protein, 28 aa, Giardia lamblia
RLFSSFMEEIFRELFLELAPTNLEIKEY

SEQ ID NO: 3195856 - protein, 17 aa, Giardia lamblia
RLFTTITGLYKGVPVTI

SEQ ID NO: 3195857 - protein, 19 aa, Giardia lamblia
RLGGSYRWDKETALAIVES

SEQ ID NO: 3195858 - protein, 17 aa, Giardia lamblia
RLGHYLPLDATVPERIG

SEQ ID NO: 3195859 - protein, 17 aa, Giardia lamblia
RLGLTPMMWAAEKGYHE

SEQ ID NO: 3195860 - protein, 19 aa, Giardia lamblia
RLGMRFPTEYYRSLELPVK

SEQ ID NO: 3195861 - protein, 17 aa, Giardia lamblia
RLGNVSRVKELIKSESG

SEQ ID NO: 3195862 - protein, 18 aa, Giardia lamblia
RLGRETFFDLLNPNLSQQ

SEQ ID NO: 3195863 - protein, 25 aa, Giardia lamblia
RLGRLLSWAFLHRRCLPLHLSNLMV

SEQ ID NO: 3195864 - protein, 17 aa, Giardia lamblia
RLHNDLRNLIKQKLIGM

SEQ ID NO: 3195865 - protein, 19 aa, Giardia lamblia
RLHSCHITIVLFKASQTPS

SEQ ID NO: 3195866 - protein, 19 aa, Giardia lamblia
RLHYLTVYDDITKRPYFRA

SEQ ID NO: 3195867 - protein, 18 aa, Giardia lamblia
RLIAIIHSKSGKPIFGKI

SEQ ID NO: 3195868 - protein, 18 aa, Giardia lamblia
RLIDRKRGIFKLAQGEYI

SEQ ID NO: 3195869 - protein, 31 aa, Giardia lamblia
RLIDSQRPCIPLRYLQKLSLGSNLIGNTVSP

SEQ ID NO: 3195870 - protein, 18 aa, Giardia lamblia
RLIHLKQQYAQSVECYNA

SEQ ID NO: 3195871 - protein, 27 aa, Giardia lamblia
RLIKHEKDVLKWTFLMCAAAKGDVATV

SEQ ID NO: 3195872 - protein, 22 aa, Giardia lamblia
RLIKTYLKLLSSRWFIDAVHTG

SEQ ID NO: 3195873 - protein, 25 aa, Giardia lamblia
RLIKYAYRDFAIAVPGYDRNMGIPH

SEQ ID NO: 3195874 - protein, 19 aa, Giardia lamblia
RLIQPHTNPRFIDHKRDTI

SEQ ID NO: 3195875 - protein, 17 aa, Giardia lamblia
RLIRPALDGYNCSIFAY

SEQ ID NO: 3195876 - protein, 17 aa, Giardia lamblia
RLISTISTKTLIKALSK

SEQ ID NO: 3195877 - protein, 24 aa, Giardia lamblia
RLKDKPLVDYTPPGSVNASLIQHS

SEQ ID NO: 3195878 - protein, 23 aa, Giardia lamblia
RLKHITLVWAAKFGSAGTKNFYT

SEQ ID NO: 3195879 - protein, 18 aa, Giardia lamblia
RLKKHFDGLSPDEVELYK

SEQ ID NO: 3195880 - protein, 23 aa, Giardia lamblia
RLKKQEQRLMRRIEQSKQVEEEE

SEQ ID NO: 3195881 - protein, 31 aa, Giardia lamblia
RLKMGSMTVTRPTALILAAYYNYQSIIEILL

SEQ ID NO: 3195882 - protein, 25 aa, Giardia lamblia
RLKRRVNELVAYSKKIRAILQSVHG

SEQ ID NO: 3195883 - protein, 24 aa, Giardia lamblia
RLKSGMHYLLLSTLTTMGHKYYER

SEQ ID NO: 3195884 - protein, 17 aa, Giardia lamblia
RLKSSYSSPCPPASRSV

SEQ ID NO: 3195885 - protein, 19 aa, Giardia lamblia
RLLADIMCFRGRVLGFTRF

SEQ ID NO: 3195886 - protein, 23 aa, Giardia lamblia
RLLDIALRKRLLEQLVPLYKAMH

SEQ ID NO: 3195887 - protein, 24 aa, Giardia lamblia
RLLESITFMNGKLTRREFYSRGRA

SEQ ID NO: 3195888 - protein, 21 aa, Giardia lamblia
RLLFYRRQICLVKAAFRQWNI

SEQ ID NO: 3195889 - protein, 21 aa, Giardia lamblia
RLLGEDLLRMYKENAVLQVKL

SEQ ID NO: 3195890 - protein, 27 aa, Giardia lamblia
RLLGKAYTYLCHYGEALAAYQKAQSLD

SEQ ID NO: 3195891 - protein, 19 aa, Giardia lamblia
RLLGLELTPLLQKADREAS

SEQ ID NO: 3195892 - protein, 19 aa, Giardia lamblia
RLLIPFQSRKQTSLGETLA

SEQ ID NO: 3195893 - protein, 18 aa, Giardia lamblia
RLLLKHDSDFLRNDFRSS

SEQ ID NO: 3195894 - protein, 20 aa, Giardia lamblia
RLLLSVMRLALNGSMSGSDG

SEQ ID NO: 3195895 - protein, 19 aa, Giardia lamblia
RLLQHSSALVRKLPEKYHI

SEQ ID NO: 3195896 - protein, 20 aa, Giardia lamblia
RLLSDYRYGGFAMSARDDRA

SEQ ID NO: 3195897 - protein, 17 aa, Giardia lamblia
RLLTELAAEASFLASDD

SEQ ID NO: 3195898 - protein, 17 aa, Giardia lamblia
RLLYCLLTTSVCDSLPT

SEQ ID NO: 3195899 - protein, 18 aa, Giardia lamblia
RLMDWTRMNIAGKLPNLF

SEQ ID NO: 3195900 - protein, 22 aa, Giardia lamblia
RLMSNYLRKIQLLRADCALIDM

SEQ ID NO: 3195901 - protein, 26 aa, Giardia lamblia
RLNEPAPLWVPDGIRTLPLTYEGDDT

SEQ ID NO: 3195902 - protein, 18 aa, Giardia lamblia
RLNFLLSSFALSLVEDFI

SEQ ID NO: 3195903 - protein, 19 aa, Giardia lamblia
RLNQVEMIHLLIGKEARLS

SEQ ID NO: 3195904 - protein, 24 aa, Giardia lamblia
RLNQVSLYNLYDEELRTIYAELKV

SEQ ID NO: 3195905 - protein, 20 aa, Giardia lamblia
RLNVLDMPIKPGAKVLYLGA

SEQ ID NO: 3195906 - protein, 18 aa, Giardia lamblia
RLPFFSVARIAKGAGTLT

SEQ ID NO: 3195907 - protein, 18 aa, Giardia lamblia
RLPGRLPGVPKEKGGLGL

SEQ ID NO: 3195908 - protein, 18 aa, Giardia lamblia
RLPHTLFVAFVSAIYRLQ

SEQ ID NO: 3195909 - protein, 26 aa, Giardia lamblia
RLPKFEEVYTFIYRLFRKAQVEPECL

SEQ ID NO: 3195910 - protein, 27 aa, Giardia lamblia
RLPPAQSLLRKGLLGRAWQALLSETSS

SEQ ID NO: 3195911 - protein, 17 aa, Giardia lamblia
RLPYPKTVPIYCTPGEN

SEQ ID NO: 3195912 - protein, 21 aa, Giardia lamblia
RLQADIVFYKDNLQLSEARII

SEQ ID NO: 3195913 - protein, 19 aa, Giardia lamblia
RLQAQLQDAELALQSHRAN

SEQ ID NO: 3195914 - protein, 20 aa, Giardia lamblia
RLQASLKIKEDRWRKLMGEE

SEQ ID NO: 3195915 - protein, 27 aa, Giardia lamblia
RLQDTAALRSFLPLALLGCAPLDNTQV

SEQ ID NO: 3195916 - protein, 25 aa, Giardia lamblia
RLQKAKAIFPCPLQKLRPSVTRCSQ

SEQ ID NO: 3195917 - protein, 25 aa, Giardia lamblia
RLQKLTEVLPLHAAGKYLPQFSTAL

SEQ ID NO: 3195918 - protein, 17 aa, Giardia lamblia
RLQLWGETQKLDIARLT

SEQ ID NO: 3195919 - protein, 21 aa, Giardia lamblia
RLQRLAPMLLERGILTADQLP

SEQ ID NO: 3195920 - protein, 29 aa, Giardia lamblia
RLQRRRASLLVIKRYLMDTYRQNTWMAAT

SEQ ID NO: 3195921 - protein, 20 aa, Giardia lamblia
RLRADLKFIAAQSQGLIVIS

SEQ ID NO: 3195922 - protein, 17 aa, Giardia lamblia
RLRALVISRGIEIANMD

SEQ ID NO: 3195923 - protein, 17 aa, Giardia lamblia
RLREIEALPGALELSNR

SEQ ID NO: 3195924 - protein, 18 aa, Giardia lamblia
RLRELAEIQPTSYEHAIK

SEQ ID NO: 3195925 - protein, 18 aa, Giardia lamblia
RLRGNINVLLISDPGLGK

SEQ ID NO: 3195926 - protein, 22 aa, Giardia lamblia
RLRGRSLPLTIARAAVHGDSSG

SEQ ID NO: 3195927 - protein, 20 aa, Giardia lamblia
RLRILTSDNATFFRKKLAAK

SEQ ID NO: 3195928 - protein, 19 aa, Giardia lamblia
RLRLESMVLAPSAKHSLPP

SEQ ID NO: 3195929 - protein, 22 aa, Giardia lamblia
RLRLNMLLEIQQLMDALASLTT

SEQ ID NO: 3195930 - protein, 26 aa, Giardia lamblia
RLRQHVPLLIVRLITYQLARSLAYLH

SEQ ID NO: 3195931 - protein, 24 aa, Giardia lamblia
RLRSNESFAPYDPVSMIQESQPYS

SEQ ID NO: 3195932 - protein, 17 aa, Giardia lamblia
RLRVIKKALLLTAVRSK

SEQ ID NO: 3195933 - protein, 21 aa, Giardia lamblia
RLRVRDFPYYKAVDKPVVVCG

SEQ ID NO: 3195934 - protein, 27 aa, Giardia lamblia
RLSAAELLMFPIITESLQKLSFKYAPE

SEQ ID NO: 3195935 - protein, 20 aa, Giardia lamblia
RLSELRPDELGPLRVMIQIN

SEQ ID NO: 3195936 - protein, 24 aa, Giardia lamblia
RLSFENLLYWKDLAANVKSAEFYY

SEQ ID NO: 3195937 - protein, 25 aa, Giardia lamblia
RLSKQIVEFLPIYPKELPGSFEVVE

SEQ ID NO: 3195938 - protein, 17 aa, Giardia lamblia
RLSNGDRLYLFYSVPRG

SEQ ID NO: 3195939 - protein, 24 aa, Giardia lamblia
RLSNLHVNLFRNVYLISTDGSLFF

SEQ ID NO: 3195940 - protein, 19 aa, Giardia lamblia
RLSPLLCDKCLNAKNYYSE

SEQ ID NO: 3195941 - protein, 29 aa, Giardia lamblia
RLSTVLDAKEDILFNLRTARELDSEELTA

SEQ ID NO: 3195942 - protein, 21 aa, Giardia lamblia
RLSYFRACSLLKQALALNSSV

SEQ ID NO: 3195943 - protein, 22 aa, Giardia lamblia
RLSYIYKRPHKIGRNARAVYLK

SEQ ID NO: 3195944 - protein, 23 aa, Giardia lamblia
RLSYLLIEELMVKVRAAFGADSS

SEQ ID NO: 3195945 - protein, 25 aa, Giardia lamblia
RLSYWDLDSFLLISILGEGRSGSYF

SEQ ID NO: 3195946 - protein, 22 aa, Giardia lamblia
RLSYYLCRERGFHTLAISHQAS

SEQ ID NO: 3195947 - protein, 19 aa, Giardia lamblia
RLTARFPPLSKSQLKRMSL

SEQ ID NO: 3195948 - protein, 24 aa, Giardia lamblia
RLTDRALFYQYNFEKVFGLIESTA

SEQ ID NO: 3195949 - protein, 24 aa, Giardia lamblia
RLTEFSLITYLTQKRRAFLSEVDL

SEQ ID NO: 3195950 - protein, 23 aa, Giardia lamblia
RLTIKQLLAPYLGYEQRALSQRS

SEQ ID NO: 3195951 - protein, 27 aa, Giardia lamblia
RLTNKALTSLALFIIQNRPPITRLNIG

SEQ ID NO: 3195952 - protein, 17 aa, Giardia lamblia
RLVDIYRRRLEAANLHV

SEQ ID NO: 3195953 - protein, 29 aa, Giardia lamblia
RLVDTGGHCALIYSLKARWPMITEYLQPL

SEQ ID NO: 3195954 - protein, 24 aa, Giardia lamblia
RLVKQGVVLDLLDYYEGRPSEERA

SEQ ID NO: 3195955 - protein, 30 aa, Giardia lamblia
RLVPDFSRIITLFSYLLRYIKEIKMKTEKE

SEQ ID NO: 3195956 - protein, 21 aa, Giardia lamblia
RLVRDYVAEVLEYMPVGILTD

SEQ ID NO: 3195957 - protein, 22 aa, Giardia lamblia
RLVVEYLLYLRAAQAVEDTDNL

SEQ ID NO: 3195958 - protein, 23 aa, Giardia lamblia
RLVVEYLLYLRAAQAVEDTDNLD

SEQ ID NO: 3195959 - protein, 25 aa, Giardia lamblia
RLWAKMRTPFMQLISLAHGCRLDVA

SEQ ID NO: 3195960 - protein, 18 aa, Giardia lamblia
RLYEMQRSVTDLLMSFQC

SEQ ID NO: 3195961 - protein, 21 aa, Giardia lamblia
RLYMLFADEQHRVYTHYFSCR

SEQ ID NO: 3195962 - protein, 24 aa, Giardia lamblia
RLYREFFNCITPQMSSSGLLIPPE

SEQ ID NO: 3195963 - protein, 18 aa, Giardia lamblia
RLYYSCSQTILPRRHQAE

SEQ ID NO: 3195964 - protein, 24 aa, Giardia lamblia
RMAEAHFMPLLRKPCLGGDMRHSY

SEQ ID NO: 3195965 - protein, 24 aa, Giardia lamblia
RMASIVAVGIYWNLLQPEDSRDMM

SEQ ID NO: 3195966 - protein, 29 aa, Giardia lamblia
RMCFTEDALIFRLLGSLLKRLDDIYAGRY

SEQ ID NO: 3195967 - protein, 18 aa, Giardia lamblia
RMCREHESLISRLDAALG

SEQ ID NO: 3195968 - protein, 29 aa, Giardia lamblia
RMDAADPRSFLLLPKLIRAAHTNNTETVR

SEQ ID NO: 3195969 - protein, 26 aa, Giardia lamblia
RMDPGAIPEFLTGTTSIHIGGRRLSD

SEQ ID NO: 3195970 - protein, 22 aa, Giardia lamblia
RMDTLRMMYKVGFGPSSSHTMG

SEQ ID NO: 3195971 - protein, 21 aa, Giardia lamblia
RMEEMRPFINELGLIAYEDAE

SEQ ID NO: 3195972 - protein, 21 aa, Giardia lamblia
RMGKTKLLFVDIPKFQQCIVS

SEQ ID NO: 3195973 - protein, 24 aa, Giardia lamblia
RMHQASTHLLLISSLFKGERQTIS

SEQ ID NO: 3195974 - protein, 24 aa, Giardia lamblia
RMIIKGKCSCWVLQAIFSCGYVHD

SEQ ID NO: 3195975 - protein, 29 aa, Giardia lamblia
RMIISRVYFFYFNFHFTISPLDPSQQITA

SEQ ID NO: 3195976 - protein, 18 aa, Giardia lamblia
RMIQLTHSSRKSIAPIIM

SEQ ID NO: 3195977 - protein, 20 aa, Giardia lamblia
RMKAFFASHQLANSSKLSIL

SEQ ID NO: 3195978 - protein, 18 aa, Giardia lamblia
RMKALVLAAHEAEDRIIS

SEQ ID NO: 3195979 - protein, 28 aa, Giardia lamblia
RMKASMMPEYLRLLPSRALKCYLMQKSD

SEQ ID NO: 3195980 - protein, 19 aa, Giardia lamblia
RMKELQILESIYLCGSSES

SEQ ID NO: 3195981 - protein, 20 aa, Giardia lamblia
RMKKKIKERPYRPILRQKEI

SEQ ID NO: 3195982 - protein, 20 aa, Giardia lamblia
RMLAILERWELNQSGCIVPL

SEQ ID NO: 3195983 - protein, 26 aa, Giardia lamblia
RMLEPRSGFSTVPPGPYPVGRQSFLS

SEQ ID NO: 3195984 - protein, 24 aa, Giardia lamblia
RMLTKFFCSLPLACLINSIALCIH

SEQ ID NO: 3195985 - protein, 18 aa, Giardia lamblia
RMMPLVTPHPTITSLTDE

SEQ ID NO: 3195986 - protein, 43 aa, Giardia lamblia
RMPAQNQVLFRIPTNMAPILPCYLKLLKQQRINALLAVENDFI

SEQ ID NO: 3195987 - protein, 24 aa, Giardia lamblia
RMPAVPRLYTILREVLIMVVEDPP

SEQ ID NO: 3195988 - protein, 27 aa, Giardia lamblia
RMPKPRFSLRQYAPLDKKVEIGIDVHV

SEQ ID NO: 3195989 - protein, 26 aa, Giardia lamblia
RMPSKTLWIQRQRVLRRLLSRYRDDE

SEQ ID NO: 3195990 - protein, 17 aa, Giardia lamblia
RMQEQIMDLAYSAARPS

SEQ ID NO: 3195991 - protein, 17 aa, Giardia lamblia
RMRIIEQLIPSIRSIMD

SEQ ID NO: 3195992 - protein, 26 aa, Giardia lamblia
RMRSDIWFNIGICFLHLSDMGAAKNC

SEQ ID NO: 3195993 - protein, 18 aa, Giardia lamblia
RMTSFLDPLFASVDGLSV

SEQ ID NO: 3195994 - protein, 18 aa, Giardia lamblia
RMVNEHVILFRSPSNRRL

SEQ ID NO: 3195995 - protein, 24 aa, Giardia lamblia
RMVTNIFHCVLPKRLVRHASYLSC

SEQ ID NO: 3195996 - protein, 18 aa, Giardia lamblia
RMYIRSNSNRRYSSTAFG

SEQ ID NO: 3195997 - protein, 18 aa, Giardia lamblia
RNALYYALKNEHLKAAKI

SEQ ID NO: 3195998 - protein, 22 aa, Giardia lamblia
RNANYYTALMLAAKRGYTEIVE

SEQ ID NO: 3195999 - protein, 33 aa, Giardia lamblia
RNASSEAYILIPIGQKIYAACGGWGHAPRIYDS

SEQ ID NO: 3196000 - protein, 22 aa, Giardia lamblia
RNCIIFSPHHRAVKSTIHAARI

SEQ ID NO: 3196001 - protein, 18 aa, Giardia lamblia
RNCVLGYVSGLVYGSRSD

SEQ ID NO: 3196002 - protein, 18 aa, Giardia lamblia
RNCWPVVRGVAMNPVDHP

SEQ ID NO: 3196003 - protein, 23 aa, Giardia lamblia
RNDELYEELIAWLDKRDNSSQVQ

SEQ ID NO: 3196004 - protein, 23 aa, Giardia lamblia
RNDFINYYTTLFPTHMDRVIIGQ

SEQ ID NO: 3196005 - protein, 23 aa, Giardia lamblia
RNDLMAVKALLPLQGGQKATGDV

SEQ ID NO: 3196006 - protein, 21 aa, Giardia lamblia
RNDLMAVKALLPLQGGQREFG

SEQ ID NO: 3196007 - protein, 19 aa, Giardia lamblia
RNDNLSFLSCGIALGVHGT

SEQ ID NO: 3196008 - protein, 27 aa, Giardia lamblia
RNDVEMVELLIPFQKARMAKGAVKVGE

SEQ ID NO: 3196009 - protein, 28 aa, Giardia lamblia
RNDVSPFETYFLRPCGKKRVLAKKSRVD

SEQ ID NO: 3196010 - protein, 23 aa, Giardia lamblia
RNECYEYLLRMPISTMTKESYRN

SEQ ID NO: 3196011 - protein, 21 aa, Giardia lamblia
RNEFNIVMRLSSPYIVNYYAV

SEQ ID NO: 3196012 - protein, 21 aa, Giardia lamblia
RNEGKLFIPTISGPNEYAKLL

SEQ ID NO: 3196013 - protein, 22 aa, Giardia lamblia
RNELLFEIEGLKAEFKNRPSRL

SEQ ID NO: 3196014 - protein, 18 aa, Giardia lamblia
RNFAIIDLHYRIDLSKAQ

SEQ ID NO: 3196015 - protein, 18 aa, Giardia lamblia
RNFPSLVNCCTLDWFTGW

SEQ ID NO: 3196016 - protein, 22 aa, Giardia lamblia
RNFVDFLTSYLSLLQKLRQDCD

SEQ ID NO: 3196017 - protein, 29 aa, Giardia lamblia
RNGRLSRLGSILLLATFRAYPVGAIVSAY

SEQ ID NO: 3196018 - protein, 34 aa, Giardia lamblia
RNHFELGRLLPKKPLLDSFGCTQLMLAIEAGDET

SEQ ID NO: 3196019 - protein, 33 aa, Giardia lamblia
RNHSGTWFAVLYLPPGIYQYKFIVDGNWVCAPD

SEQ ID NO: 3196020 - protein, 20 aa, Giardia lamblia
RNIKIFEYVMDSGEEMISSA

SEQ ID NO: 3196021 - protein, 24 aa, Giardia lamblia
RNIQLVSFELLYLDSSSIQLSTTD

SEQ ID NO: 3196022 - protein, 33 aa, Giardia lamblia
RNITRRLRTLGVMYTINFINPTERNYYDIADAF

SEQ ID NO: 3196023 - protein, 29 aa, Giardia lamblia
RNKFRKTVDRWGRTALMYAARAGHSEILE

SEQ ID NO: 3196024 - protein, 22 aa, Giardia lamblia
RNKPTYYILKGLEDLFANLEEH

SEQ ID NO: 3196025 - protein, 22 aa, Giardia lamblia
RNLHSSGLPSLALTGITKSSGT

SEQ ID NO: 3196026 - protein, 24 aa, Giardia lamblia
RNLTSMFDPSLLPMSLVSLQLDEI

SEQ ID NO: 3196027 - protein, 17 aa, Giardia lamblia
RNLYHLIDCKHPSLLVY

SEQ ID NO: 3196028 - protein, 26 aa, Giardia lamblia
RNMERAYFHYLFTHDSVHGPPHGFTC

SEQ ID NO: 3196029 - protein, 28 aa, Giardia lamblia
RNNADRYLDFFIIKLVRSSDSMQRLYGY

SEQ ID NO: 3196030 - protein, 24 aa, Giardia lamblia
RNNGKLISLNYYRNGPVSQQEVDK

SEQ ID NO: 3196031 - protein, 28 aa, Giardia lamblia
RNNLQWLEALLDELAHFAASARRLSHIA

SEQ ID NO: 3196032 - protein, 21 aa, Giardia lamblia
RNPLCVQTVDQFIFLHDYCNF

SEQ ID NO: 3196033 - protein, 25 aa, Giardia lamblia
RNQNSASFPPVPLSAALSTTQHNIS

SEQ ID NO: 3196034 - protein, 27 aa, Giardia lamblia
RNRADCIPLLLRELGIQVWDGQTALMR

SEQ ID NO: 3196035 - protein, 25 aa, Giardia lamblia
RNRAPKAWSIFMDLGARDIDQERLV

SEQ ID NO: 3196036 - protein, 17 aa, Giardia lamblia
RNRDFLMKLVSNGNRYP

SEQ ID NO: 3196037 - protein, 32 aa, Giardia lamblia
RNRTQQQILYDQFILMIEGTLKRLKSFKVDAR

SEQ ID NO: 3196038 - protein, 25 aa, Giardia lamblia
RNSFSSLEEFYRLATEYAELPDTRC

SEQ ID NO: 3196039 - protein, 26 aa, Giardia lamblia
RNSHRRLLIPLPSNSFLPPLLSQNCL

SEQ ID NO: 3196040 - protein, 17 aa, Giardia lamblia
RNSLVINSPVRLSGAWG

SEQ ID NO: 3196041 - protein, 28 aa, Giardia lamblia
RNSTAVFRVPLFFAQRHRLGLPTDRFVF

SEQ ID NO: 3196042 - protein, 17 aa, Giardia lamblia
RNTAVIPLWAKRNECVI

SEQ ID NO: 3196043 - protein, 24 aa, Giardia lamblia
RNTCHFHWVLKSISNAFPDCASIE

SEQ ID NO: 3196044 - protein, 26 aa, Giardia lamblia
RNTSDGVGYFLFYGGCYNNDEWPGTD

SEQ ID NO: 3196045 - protein, 26 aa, Giardia lamblia
RNTSWPRWTNIFFSATKALLGGRCSL

SEQ ID NO: 3196046 - protein, 26 aa, Giardia lamblia
RNVEAILLLMPYTYTGGRLALSQCLS

SEQ ID NO: 3196047 - protein, 21 aa, Giardia lamblia
RNVIIGSHIYCKMSKDIFGPV

SEQ ID NO: 3196048 - protein, 29 aa, Giardia lamblia
RNVLRRVFHILVSRGWWDAIGGIDGLCQI

SEQ ID NO: 3196049 - protein, 18 aa, Giardia lamblia
RNVLYYAFKSEHTKDIEA

SEQ ID NO: 3196050 - protein, 19 aa, Giardia lamblia
RNWLKNYDERCIDCDNLIY

SEQ ID NO: 3196051 - protein, 17 aa, Giardia lamblia
RNYRLRADYYPSQKIQT

SEQ ID NO: 3196052 - protein, 34 aa, Giardia lamblia
RNYVPDEYIMIALRLALAEYLLLEGSVPAAQKCL

SEQ ID NO: 3196053 - protein, 26 aa, Giardia lamblia
RPAMAPVAILPTEPLALQAPDSRESL

SEQ ID NO: 3196054 - protein, 25 aa, Giardia lamblia
RPCFKTVSDLLLFRAGKAIDLAVVG

SEQ ID NO: 3196055 - protein, 39 aa, Giardia lamblia
RPDAYEILLHPWLQQEMIKPALAKGILILDPAPPVVKVQ

SEQ ID NO: 3196056 - protein, 25 aa, Giardia lamblia
RPDCAWKVPILVDLTVPPAATSEEL

SEQ ID NO: 3196057 - protein, 25 aa, Giardia lamblia
RPDDFCPFRRGVGFLPATMIKRLFD

SEQ ID NO: 3196058 - protein, 26 aa, Giardia lamblia
RPDDFGPFRRGVGFLPATMIKRLFDP

SEQ ID NO: 3196059 - protein, 26 aa, Giardia lamblia
RPDGSTALEIALLRGYFSVAEVLTGV

SEQ ID NO: 3196060 - protein, 17 aa, Giardia lamblia
RPDGWFALMFATQKGSI

SEQ ID NO: 3196061 - protein, 37 aa, Giardia lamblia
RPDKEPDTCYSWWIGSPAYILLDYLLNANNSRAAEWD

SEQ ID NO: 3196062 - protein, 24 aa, Giardia lamblia
RPDKLLLIDAPADALVLVPGEYAI

SEQ ID NO: 3196063 - protein, 33 aa, Giardia lamblia
RPDLEPCMAHFLYDLLFHEVVLAEFLASTCLDK

SEQ ID NO: 3196064 - protein, 22 aa, Giardia lamblia
RPDSPTTLFLAALKSLEARGKM

SEQ ID NO: 3196065 - protein, 29 aa, Giardia lamblia
RPDTVLYYLKETVWPILFGKPAADIKKPA

SEQ ID NO: 3196066 - protein, 18 aa, Giardia lamblia
RPEYSREYDIHRKDVLKV

SEQ ID NO: 3196067 - protein, 17 aa, Giardia lamblia
RPFLPGEVVPNPACITA

SEQ ID NO: 3196068 - protein, 18 aa, Giardia lamblia
RPFTFRAGCQSPQACILS

SEQ ID NO: 3196069 - protein, 17 aa, Giardia lamblia
RPGLQFRTIGRDPYQFL

SEQ ID NO: 3196070 - protein, 26 aa, Giardia lamblia
RPGRRFIHCQLKPSNIFLSQALTVFI

SEQ ID NO: 3196071 - protein, 19 aa, Giardia lamblia
RPHPLAFDFLVNGSFMHTA

SEQ ID NO: 3196072 - protein, 20 aa, Giardia lamblia
RPIAHRLGTVPRPASMNAVA

SEQ ID NO: 3196073 - protein, 18 aa, Giardia lamblia
RPIFPLASEFIDTSPISP

SEQ ID NO: 3196074 - protein, 20 aa, Giardia lamblia
RPISKIWITMGTFNSERGKT

SEQ ID NO: 3196075 - protein, 18 aa, Giardia lamblia
RPITLAIFKECVGVGGED

SEQ ID NO: 3196076 - protein, 19 aa, Giardia lamblia
RPKAVGCFLSRPGPATILD

SEQ ID NO: 3196077 - protein, 19 aa, Giardia lamblia
RPKPTANTLNLPPSGRSSA

SEQ ID NO: 3196078 - protein, 22 aa, Giardia lamblia
RPKSSIRYPPPPSSSSKDAHVI

SEQ ID NO: 3196079 - protein, 18 aa, Giardia lamblia
RPKYMNSASIRSAVYRPA

SEQ ID NO: 3196080 - protein, 30 aa, Giardia lamblia
RPLDVSLPEMPLMTTLMPYTVHPSLKYLDL

SEQ ID NO: 3196081 - protein, 25 aa, Giardia lamblia
RPLEKPPPHLTLPRMRESIGTDEVD

SEQ ID NO: 3196082 - protein, 18 aa, Giardia lamblia
RPLLLHRHVLRTAIDWKK

SEQ ID NO: 3196083 - protein, 17 aa, Giardia lamblia
RPLMCTLNIGRIVRPGY

SEQ ID NO: 3196084 - protein, 18 aa, Giardia lamblia
RPLQVITGVFPLARTREF

SEQ ID NO: 3196085 - protein, 30 aa, Giardia lamblia
RPLVSEFELFLFNILLSQKWGHLDMSFTDC

SEQ ID NO: 3196086 - protein, 20 aa, Giardia lamblia
RPMSAQLYQMSARSPNLTGY

SEQ ID NO: 3196087 - protein, 25 aa, Giardia lamblia
RPNDIVYRHLLPNDTLLFNRQPSLH

SEQ ID NO: 3196088 - protein, 23 aa, Giardia lamblia
RPNSYWLSGYFNPQGFLTSVKQE

SEQ ID NO: 3196089 - protein, 23 aa, Giardia lamblia
RPPEAYLGLPFDQTLDIWSCGCV

SEQ ID NO: 3196090 - protein, 29 aa, Giardia lamblia
RPPHTVYVGTRWYRAVELFLKDSSYSAKN

SEQ ID NO: 3196091 - protein, 17 aa, Giardia lamblia
RPPISAPHRSHVAFTNG

SEQ ID NO: 3196092 - protein, 24 aa, Giardia lamblia
RPPLLPVAGWLVKYMRHTRLSGSC

SEQ ID NO: 3196093 - protein, 21 aa, Giardia lamblia
RPPTPPRKLEELAAEAAAAAA

SEQ ID NO: 3196094 - protein, 20 aa, Giardia lamblia
RPQDVILTHIPVPPSCLRPS

SEQ ID NO: 3196095 - protein, 31 aa, Giardia lamblia
RPQQQVELPTTLSPILFPHNLETTPHIRTSG

SEQ ID NO: 3196096 - protein, 17 aa, Giardia lamblia
RPQSARAPYTPSGSEYR

SEQ ID NO: 3196097 - protein, 18 aa, Giardia lamblia
RPQSARAPYTPSGSEYRI

SEQ ID NO: 3196098 - protein, 18 aa, Giardia lamblia
RPRCMRYTETTTVRSTSC

SEQ ID NO: 3196099 - protein, 21 aa, Giardia lamblia
RPRIVGYKRSPFGRVGGSISK

SEQ ID NO: 3196100 - protein, 20 aa, Giardia lamblia
RPRREHHSLLATLAIERSST

SEQ ID NO: 3196101 - protein, 24 aa, Giardia lamblia
RPRTPPMCGPKRSTADPSENVFSR

SEQ ID NO: 3196102 - protein, 17 aa, Giardia lamblia
RPSEITEFLRIKYYGRE

SEQ ID NO: 3196103 - protein, 17 aa, Giardia lamblia
RPSLDIPLLNSKVGYVV

SEQ ID NO: 3196104 - protein, 26 aa, Giardia lamblia
RPSLLNFIYEEFPVIASPDYFIERAD

SEQ ID NO: 3196105 - protein, 23 aa, Giardia lamblia
RPSPYDLYRICEMDLLNSASHTS

SEQ ID NO: 3196106 - protein, 20 aa, Giardia lamblia
RPSVSAFDLDKRSIPFLSSQ

SEQ ID NO: 3196107 - protein, 18 aa, Giardia lamblia
RPSWLKTMRTLLNLKHCN

SEQ ID NO: 3196108 - protein, 36 aa, Giardia lamblia
RPTFASDSWDLGCLLFALIFQKYPFRKPKATQQSYV

SEQ ID NO: 3196109 - protein, 21 aa, Giardia lamblia
RPTILLLKDSTDTSQGKGQLL

SEQ ID NO: 3196110 - protein, 17 aa, Giardia lamblia
RPTNYFKLMGISETYDI

SEQ ID NO: 3196111 - protein, 23 aa, Giardia lamblia
RPTPQLLKVAISLCIDPVNLGDS

SEQ ID NO: 3196112 - protein, 33 aa, Giardia lamblia
RPTSETAIYSMFSKWVRSYKDLPLKIHQTCTIF

SEQ ID NO: 3196113 - protein, 25 aa, Giardia lamblia
RPTSSYLHLFLASRGIHITYMGSKV

SEQ ID NO: 3196114 - protein, 26 aa, Giardia lamblia
RPTTTATAPYLLAPGGQYISQLVISR

SEQ ID NO: 3196115 - protein, 54 aa, Giardia lamblia
RPVLKSCTDLLYAQNPQLLPSAKNLYYVLFYYTIFELLRQPFSKLRAILVSQQA

SEQ ID NO: 3196116 - protein, 20 aa, Giardia lamblia
RPVPVLGRLSSGCLPRPVRL

SEQ ID NO: 3196117 - protein, 27 aa, Giardia lamblia
RPVSRTKFLSLTLIPPHMSAQQILSMR

SEQ ID NO: 3196118 - protein, 31 aa, Giardia lamblia
RPYVISNLGFILQLYQDHFLLTNKLLQSQHV

SEQ ID NO: 3196119 - protein, 24 aa, Giardia lamblia
RQADALASSLRRDIDERLADYVSQ

SEQ ID NO: 3196120 - protein, 18 aa, Giardia lamblia
RQAIFLRDQTESLLKYDL

SEQ ID NO: 3196121 - protein, 25 aa, Giardia lamblia
RQAMYLHYLIDVYMSYAGILPATHV

SEQ ID NO: 3196122 - protein, 23 aa, Giardia lamblia
RQCSKCFWFPNLNISDIPCVYCG

SEQ ID NO: 3196123 - protein, 26 aa, Giardia lamblia
RQCVVKDIFYFWSKEGSRVKRNAASD

SEQ ID NO: 3196124 - protein, 28 aa, Giardia lamblia
RQDKRLINLLIFINGRRVQYPRLKNAVQ

SEQ ID NO: 3196125 - protein, 28 aa, Giardia lamblia
RQEDRNFYLLTLPLQRKCLDSPPLRYCH

SEQ ID NO: 3196126 - protein, 25 aa, Giardia lamblia
RQEEKELRRLLAEEKLRMDKEIERA

SEQ ID NO: 3196127 - protein, 32 aa, Giardia lamblia
RQEIYPCDQRRWQVYARLATGAQVYARAATGS

SEQ ID NO: 3196128 - protein, 19 aa, Giardia lamblia
RQELYDLRQSQLKMSMTMG

SEQ ID NO: 3196129 - protein, 17 aa, Giardia lamblia
RQFFLQNDKAKTGQLSD

SEQ ID NO: 3196130 - protein, 19 aa, Giardia lamblia
RQHFVLRTDIYNMNALDYA

SEQ ID NO: 3196131 - protein, 30 aa, Giardia lamblia
RQHHPFNIRPGLRRIPLYDEGQLLDLIAKI

SEQ ID NO: 3196132 - protein, 28 aa, Giardia lamblia
RQIIVTSFSLLRHGLLPNLQDSGRRPRY

SEQ ID NO: 3196133 - protein, 17 aa, Giardia lamblia
RQILAPGGTFVSKVFRG

SEQ ID NO: 3196134 - protein, 18 aa, Giardia lamblia
RQILYELAKRYKAQAEEL

SEQ ID NO: 3196135 - protein, 31 aa, Giardia lamblia
RQIMTAFIRYMRVYNLWFNMLAAIPGDCTKL

SEQ ID NO: 3196136 - protein, 30 aa, Giardia lamblia
RQKACKICRLRYRITPNINICLHHIVELAG

SEQ ID NO: 3196137 - protein, 26 aa, Giardia lamblia
RQKEDLYFVFEYINSGNLFDFVVQQR

SEQ ID NO: 3196138 - protein, 17 aa, Giardia lamblia
RQKLEEAGLLNAPVDAF

SEQ ID NO: 3196139 - protein, 19 aa, Giardia lamblia
RQLLVQEMKIHRMLAHPNI

SEQ ID NO: 3196140 - protein, 27 aa, Giardia lamblia
RQLSSYLHIIKNEPLWPVIRDGRGEVL

SEQ ID NO: 3196141 - protein, 21 aa, Giardia lamblia
RQLSTLVVAITLKVRRKKVSG

SEQ ID NO: 3196142 - protein, 23 aa, Giardia lamblia
RQLTSTLLMLLDGGTKRSVGAQG

SEQ ID NO: 3196143 - protein, 25 aa, Giardia lamblia
RQLVNKYVFLLPLAEKIMKKQSRSL

SEQ ID NO: 3196144 - protein, 22 aa, Giardia lamblia
RQLVYELLQDKARLARLANDGH

SEQ ID NO: 3196145 - protein, 22 aa, Giardia lamblia
RQMKEYRIVVSERDILGTQLIR

SEQ ID NO: 3196146 - protein, 33 aa, Giardia lamblia
RQMLLAICINNVILVYRIYANLKLVEVLRPDGT

SEQ ID NO: 3196147 - protein, 18 aa, Giardia lamblia
RQMPTKFAIIRLVSVMAE

SEQ ID NO: 3196148 - protein, 19 aa, Giardia lamblia
RQMYIVLDHLRSLMVAIQD

SEQ ID NO: 3196149 - protein, 29 aa, Giardia lamblia
RQPIVGHRQLDMYQLFRAVQARGGAKNVT

SEQ ID NO: 3196150 - protein, 23 aa, Giardia lamblia
RQPPFEHVFLIDRGIDLLSLTLD

SEQ ID NO: 3196151 - protein, 35 aa, Giardia lamblia
RQPSQHAAIVLPLELMPVPVPLDYVTFLRSEYEDR

SEQ ID NO: 3196152 - protein, 24 aa, Giardia lamblia
RQPWHGRPRTRVLLPLRRERREPK

SEQ ID NO: 3196153 - protein, 25 aa, Giardia lamblia
RQQARLKDNLGVTALMYAAQAGRYE

SEQ ID NO: 3196154 - protein, 20 aa, Giardia lamblia
RQQGLYPPAYHDTDGALSCP

SEQ ID NO: 3196155 - protein, 28 aa, Giardia lamblia
RQQLKSCLVLFIRSLVVNPSFDSQTKIS

SEQ ID NO: 3196156 - protein, 30 aa, Giardia lamblia
RQQMAAPVHPFIPSHMPLQPHGTMPSAPNI

SEQ ID NO: 3196157 - protein, 27 aa, Giardia lamblia
RQQNLICTVLPLFPRGDLARFIRHNRE

SEQ ID NO: 3196158 - protein, 26 aa, Giardia lamblia
RQQQYATFLSLAAFAGAPVLFDQCSQ

SEQ ID NO: 3196159 - protein, 18 aa, Giardia lamblia
RQQRHNEWLMLRGKIEQA

SEQ ID NO: 3196160 - protein, 18 aa, Giardia lamblia
RQRAFTLGTLPNLPAQAI

SEQ ID NO: 3196161 - protein, 34 aa, Giardia lamblia
RQRFLQADHFFTLSLFRRSLASMRWRLHQADLEA

SEQ ID NO: 3196162 - protein, 22 aa, Giardia lamblia
RQRIFESILAYQVAWVSDGIKG

SEQ ID NO: 3196163 - protein, 17 aa, Giardia lamblia
RQRNIILDYQQQVSQAS

SEQ ID NO: 3196164 - protein, 24 aa, Giardia lamblia
RQRQMTMHLKFVPSYLLPNAEGIR

SEQ ID NO: 3196165 - protein, 17 aa, Giardia lamblia
RQRSLRLAGSSGAEALL

SEQ ID NO: 3196166 - protein, 25 aa, Giardia lamblia
RQSDISHAILLANRRGLTTLENVLK

SEQ ID NO: 3196167 - protein, 23 aa, Giardia lamblia
RQSKSFFSYVLKSIIRQFKGEDS

SEQ ID NO: 3196168 - protein, 18 aa, Giardia lamblia
RQSMLEPSVERKSFDFSA

SEQ ID NO: 3196169 - protein, 24 aa, Giardia lamblia
RQSQLLEIMAQAFDRYAALAGALS

SEQ ID NO: 3196170 - protein, 25 aa, Giardia lamblia
RQSSWRLVVPMPKILEFSKRLPESI

SEQ ID NO: 3196171 - protein, 18 aa, Giardia lamblia
RQVFKYLERKRAKICFLA

SEQ ID NO: 3196172 - protein, 31 aa, Giardia lamblia
RRAASLDQYFVFSLLIFDKFRHNAEAECQRR

SEQ ID NO: 3196173 - protein, 23 aa, Giardia lamblia
RRAGTPLLYREGITTILSYDDED

SEQ ID NO: 3196174 - protein, 20 aa, Giardia lamblia
RRAHLNPNGFEDGFISMPGS

SEQ ID NO: 3196175 - protein, 23 aa, Giardia lamblia
RRALASIGIQRLIDSLPAAYNPG

SEQ ID NO: 3196176 - protein, 20 aa, Giardia lamblia
RRCGRIFCNACCIKPIDILS

SEQ ID NO: 3196177 - protein, 30 aa, Giardia lamblia
RRCLPLHLSNLMVALLKFGSTYTYAEETLH

SEQ ID NO: 3196178 - protein, 27 aa, Giardia lamblia
RRDAELKRYITWLLNHVANNNPEFLLQ

SEQ ID NO: 3196179 - protein, 19 aa, Giardia lamblia
RRDFTVNALFYNINTREIE

SEQ ID NO: 3196180 - protein, 19 aa, Giardia lamblia
RRDGATALFTAVFWNRCEC

SEQ ID NO: 3196181 - protein, 34 aa, Giardia lamblia
RRDKLFDVMQILVPQLYQKNILITLDPIETTQTD

SEQ ID NO: 3196182 - protein, 20 aa, Giardia lamblia
RRDNILVQYYSAISQCLNEL

SEQ ID NO: 3196183 - protein, 28 aa, Giardia lamblia
RRDQQRDPPPLPHARVLPAVRGRLRRRP

SEQ ID NO: 3196184 - protein, 19 aa, Giardia lamblia
RRDRKHVAPLTEEEKRKLE

SEQ ID NO: 3196185 - protein, 34 aa, Giardia lamblia
RRDSLALSPSLVPYSPAPGADLPTFPRPEDQSET

SEQ ID NO: 3196186 - protein, 19 aa, Giardia lamblia
RRECAFARIHLPELDILLT

SEQ ID NO: 3196187 - protein, 27 aa, Giardia lamblia
RREIETTLMRLLETKTHLQGVSPSLED

SEQ ID NO: 3196188 - protein, 17 aa, Giardia lamblia
RRELDRVFLLLENENST

SEQ ID NO: 3196189 - protein, 26 aa, Giardia lamblia
RREPLPDLVAKLWRAELRTSSDGPAP

SEQ ID NO: 3196190 - protein, 20 aa, Giardia lamblia
RRERCLLSEVVYLREMLEAL

SEQ ID NO: 3196191 - protein, 24 aa, Giardia lamblia
RRERLEELRIALAAAYEEQKRLQA

SEQ ID NO: 3196192 - protein, 23 aa, Giardia lamblia
RRERREPKRCVWLRCGSAAAVDK

SEQ ID NO: 3196193 - protein, 25 aa, Giardia lamblia
RRFDVNDFYMVLFSHSFPADAHQHP

SEQ ID NO: 3196194 - protein, 26 aa, Giardia lamblia
RRGAMFSFGLKLYRFSEQSGELVLSW

SEQ ID NO: 3196195 - protein, 19 aa, Giardia lamblia
RRGASLLAFGSNLLVIGGR

SEQ ID NO: 3196196 - protein, 19 aa, Giardia lamblia
RRGHIACVGALFFAEYSIC

SEQ ID NO: 3196197 - protein, 18 aa, Giardia lamblia
RRGMPYFFSRNEVVFSDF

SEQ ID NO: 3196198 - protein, 17 aa, Giardia lamblia
RRHGMANLTTYNRVYKL

SEQ ID NO: 3196199 - protein, 22 aa, Giardia lamblia
RRHMASSSGDFLLSPEDFLYAS

SEQ ID NO: 3196200 - protein, 20 aa, Giardia lamblia
RRHMDRLAPSPYLAPEALAG

SEQ ID NO: 3196201 - protein, 19 aa, Giardia lamblia
RRHYNTLFYYDLVNGQWGE

SEQ ID NO: 3196202 - protein, 32 aa, Giardia lamblia
RRIAQQWFTSVEIWLLITQLLEGVKAYQSFYA

SEQ ID NO: 3196203 - protein, 26 aa, Giardia lamblia
RRIARFKYNLIRRIVENWSSVTSFDW

SEQ ID NO: 3196204 - protein, 25 aa, Giardia lamblia
RRIGIFRSDGILMGIHFISSSPMDI

SEQ ID NO: 3196205 - protein, 18 aa, Giardia lamblia
RRIVELEARAGSLLHDLK

SEQ ID NO: 3196206 - protein, 31 aa, Giardia lamblia
RRKDDEISRLQKLLYSYQPSPAQPAFVRAQV

SEQ ID NO: 3196207 - protein, 30 aa, Giardia lamblia
RRKKQTFPQRLIFSIIRQVAMGLAHLHKWT

SEQ ID NO: 3196208 - protein, 19 aa, Giardia lamblia
RRKLPDESKRYFQVDFDFG

SEQ ID NO: 3196209 - protein, 19 aa, Giardia lamblia
RRKLTLSDDAIWGIIAQVF

SEQ ID NO: 3196210 - protein, 30 aa, Giardia lamblia
RRKTAVRLLPLVRQWLLEPLKDLVARLEAA

SEQ ID NO: 3196211 - protein, 22 aa, Giardia lamblia
RRLEDEIKGLQLRLTENDFTKE

SEQ ID NO: 3196212 - protein, 30 aa, Giardia lamblia
RRLEKRIFIELPGFISRIVMIRKFLGDKLR

SEQ ID NO: 3196213 - protein, 21 aa, Giardia lamblia
RRLKFIKDCKACHYVIGFSSG

SEQ ID NO: 3196214 - protein, 29 aa, Giardia lamblia
RRLKINRRFTFPFAVDLYRYCSAGLQTSL

SEQ ID NO: 3196215 - protein, 22 aa, Giardia lamblia
RRLNVGLTRCRCALIIVGNATA

SEQ ID NO: 3196216 - protein, 26 aa, Giardia lamblia
RRNMSRLMAVLLTAFENPSDASVYAE

SEQ ID NO: 3196217 - protein, 25 aa, Giardia lamblia
RRNVSAHFLGDGYRYLLSSDDPCEL

SEQ ID NO: 3196218 - protein, 18 aa, Giardia lamblia
RRPSCPSVILWSSSVRSI

SEQ ID NO: 3196219 - protein, 18 aa, Giardia lamblia
RRPSIMTPISYTPTAPRA

SEQ ID NO: 3196220 - protein, 24 aa, Giardia lamblia
RRPTARKLVRLLRILNISADGQEA

SEQ ID NO: 3196221 - protein, 17 aa, Giardia lamblia
RRQLQEQSVLYDKQIRQ

SEQ ID NO: 3196222 - protein, 20 aa, Giardia lamblia
RRQWLNTSDNSKLVFRRELL

SEQ ID NO: 3196223 - protein, 33 aa, Giardia lamblia
RRRCHLRGALKKRRVMMHAGDLVLVSLREFSTE

SEQ ID NO: 3196224 - protein, 18 aa, Giardia lamblia
RRRESRAPRPLTSQPLLG

SEQ ID NO: 3196225 - protein, 18 aa, Giardia lamblia
RRRLDLFNHTSMTNLPLA

SEQ ID NO: 3196226 - protein, 18 aa, Giardia lamblia
RRRLRMFPALSSCMTIDW

SEQ ID NO: 3196227 - protein, 20 aa, Giardia lamblia
RRRPASAHSIPTRGLLSPHN

SEQ ID NO: 3196228 - protein, 31 aa, Giardia lamblia
RRRQEPIPELQIWEILAQIAAGLAYLHSQIK

SEQ ID NO: 3196229 - protein, 18 aa, Giardia lamblia
RRRRELMVAFGQEMSRQI

SEQ ID NO: 3196230 - protein, 24 aa, Giardia lamblia
RRRRLRPIVDPTPNGSYHSFNTSR

SEQ ID NO: 3196231 - protein, 17 aa, Giardia lamblia
RRSAPAFTIQRKGRSLN

SEQ ID NO: 3196232 - protein, 22 aa, Giardia lamblia
RRSFAIFMLRRLQNCIMLQKAS

SEQ ID NO: 3196233 - protein, 30 aa, Giardia lamblia
RRSFREIQRTFLRHLALLSRVPYNHFDVRS

SEQ ID NO: 3196234 - protein, 19 aa, Giardia lamblia
RRSGGSINVFTLAGAKKGK

SEQ ID NO: 3196235 - protein, 26 aa, Giardia lamblia
RRSHFLRAAYYFKSAAKFIGSLPQAI

SEQ ID NO: 3196236 - protein, 36 aa, Giardia lamblia
RRSWVHWNEVLPRGWRPNPAIPLYSTLVPTVDTLRT

SEQ ID NO: 3196237 - protein, 22 aa, Giardia lamblia
RRTALQLALINGHSALFVYLLP

SEQ ID NO: 3196238 - protein, 23 aa, Giardia lamblia
RRTDLEAFLSKLLAATLDLETRA

SEQ ID NO: 3196239 - protein, 26 aa, Giardia lamblia
RRTIPRSYMIRPTSFHPPPEQLPMSN

SEQ ID NO: 3196240 - protein, 30 aa, Giardia lamblia
RRTPIPSYYCNLLLFKNAPATFPYTVSSYD

SEQ ID NO: 3196241 - protein, 25 aa, Giardia lamblia
RRVEKGRMILPAQLPQDYQKKMDAS

SEQ ID NO: 3196242 - protein, 22 aa, Giardia lamblia
RRVHLINLPGPPAGVLPVHRSS

SEQ ID NO: 3196243 - protein, 42 aa, Giardia lamblia
RRVIEYPIKIPKIFRHNVWPTTGLLLYGPAGTGKTLIASSVA

SEQ ID NO: 3196244 - protein, 18 aa, Giardia lamblia
RRVLCALAIGYPAVQMPP

SEQ ID NO: 3196245 - protein, 20 aa, Giardia lamblia
RRVNYILRDINKMVELYRDL

SEQ ID NO: 3196246 - protein, 18 aa, Giardia lamblia
RRVRGHCGILPPVESTLS

SEQ ID NO: 3196247 - protein, 26 aa, Giardia lamblia
RRVTHDEILIPRVIDISALPSLEETT

SEQ ID NO: 3196248 - protein, 26 aa, Giardia lamblia
RRYDNATALSLALKMQNWELAELLRT

SEQ ID NO: 3196249 - protein, 17 aa, Giardia lamblia
RRYLDAMASINKLLQRD

SEQ ID NO: 3196250 - protein, 29 aa, Giardia lamblia
RRYLQRLTFQRISFCILELLRIPQATRLI

SEQ ID NO: 3196251 - protein, 17 aa, Giardia lamblia
RRYSDILVHRLLAAADG

SEQ ID NO: 3196252 - protein, 33 aa, Giardia lamblia
RSAELLSPEFKKSFIEILRLHKQMPEADAVYIL

SEQ ID NO: 3196253 - protein, 18 aa, Giardia lamblia
RSAGLVYMEGTMTLDALN

SEQ ID NO: 3196254 - protein, 37 aa, Giardia lamblia
RSAGPLEADALRHSIRKLQFQLTQRDRLHLDTEISNQ

SEQ ID NO: 3196255 - protein, 17 aa, Giardia lamblia
RSALATTSFVLTYSLNS

SEQ ID NO: 3196256 - protein, 18 aa, Giardia lamblia
RSALTEKVGFIRKQLEVA

SEQ ID NO: 3196257 - protein, 26 aa, Giardia lamblia
RSATLTPLMVAIYSKSLLDVERYLDY

SEQ ID NO: 3196258 - protein, 26 aa, Giardia lamblia
RSATRQPVLLKLRWFQDHLRKDLDRN

SEQ ID NO: 3196259 - protein, 20 aa, Giardia lamblia
RSCFYALKQIRFQRFTNPLS

SEQ ID NO: 3196260 - protein, 19 aa, Giardia lamblia
RSDCILPQLVPVKIDDINN

SEQ ID NO: 3196261 - protein, 30 aa, Giardia lamblia
RSDDANLSVSLPLPALKGPGSGLIEEEKKR

SEQ ID NO: 3196262 - protein, 17 aa, Giardia lamblia
RSDDMLLCGFNNKLLRL

SEQ ID NO: 3196263 - protein, 25 aa, Giardia lamblia
RSDFQELIRLFLKESPQPLSIQEAE

SEQ ID NO: 3196264 - protein, 26 aa, Giardia lamblia
RSDGYLDIYDLFYKVDTPTLSCNVGN

SEQ ID NO: 3196265 - protein, 29 aa, Giardia lamblia
RSDIWAIGATLYYLATLTPFMDSVASTGY

SEQ ID NO: 3196266 - protein, 18 aa, Giardia lamblia
RSDLLYINIASLACTRYR

SEQ ID NO: 3196267 - protein, 24 aa, Giardia lamblia
RSDLSRLLIGIILSGSMGCFDEIN

SEQ ID NO: 3196268 - protein, 31 aa, Giardia lamblia
RSDLYSLGVVIYTLVMLRKPFSLHTAENLLQ

SEQ ID NO: 3196269 - protein, 22 aa, Giardia lamblia
RSDPKLAYESLFILASLADLTH

SEQ ID NO: 3196270 - protein, 26 aa, Giardia lamblia
RSDYELTVGLPLLSGYRNLEVGVSDG

SEQ ID NO: 3196271 - protein, 24 aa, Giardia lamblia
RSEELLKLRRRTVSTLQILAHIRE

SEQ ID NO: 3196272 - protein, 27 aa, Giardia lamblia
RSEGRPLITLPIHPFVKDYAQRLLESD

SEQ ID NO: 3196273 - protein, 19 aa, Giardia lamblia
RSELPFSLTKLLRGCFMGR

SEQ ID NO: 3196274 - protein, 17 aa, Giardia lamblia
RSFGKYNGILGLDYMAG

SEQ ID NO: 3196275 - protein, 29 aa, Giardia lamblia
RSFKVSPCERFLLTFSYTANVDELDEYDL

SEQ ID NO: 3196276 - protein, 23 aa, Giardia lamblia
RSFSAQSFLSNMRMLLSDLKDAP

SEQ ID NO: 3196277 - protein, 18 aa, Giardia lamblia
RSGAFLYSGKEYSSFIAD

SEQ ID NO: 3196278 - protein, 25 aa, Giardia lamblia
RSGDLHLPWLVNALHRAYAVTWTSK

SEQ ID NO: 3196279 - protein, 24 aa, Giardia lamblia
RSGNYRLFILGGRGREGIAAEFWC

SEQ ID NO: 3196280 - protein, 23 aa, Giardia lamblia
RSGRARGPYRGEQKIEDSPLIKA

SEQ ID NO: 3196281 - protein, 26 aa, Giardia lamblia
RSGSFQILSIIYSYALEHSLGICVSR

SEQ ID NO: 3196282 - protein, 25 aa, Giardia lamblia
RSGTLLAACQFSLDPQAHLPYNLTE

SEQ ID NO: 3196283 - protein, 23 aa, Giardia lamblia
RSGTLPVFLVVGMGEAAELAQKE

SEQ ID NO: 3196284 - protein, 36 aa, Giardia lamblia
RSGTVTDELFTWLYHKICLLADSLVMVITDAIPMVE

SEQ ID NO: 3196285 - protein, 18 aa, Giardia lamblia
RSGWYMRKGTALMVAAAM

SEQ ID NO: 3196286 - protein, 23 aa, Giardia lamblia
RSHAILQIALKYTKSGKEYSRIS

SEQ ID NO: 3196287 - protein, 26 aa, Giardia lamblia
RSHSLGCLFCLRLPSFPLPQQSMEQW

SEQ ID NO: 3196288 - protein, 18 aa, Giardia lamblia
RSHTILIITINYTFRTTE

SEQ ID NO: 3196289 - protein, 20 aa, Giardia lamblia
RSHYSYLNFLVSCLSSKNAM

SEQ ID NO: 3196290 - protein, 17 aa, Giardia lamblia
RSILLTDRSIHARIKLS

SEQ ID NO: 3196291 - protein, 21 aa, Giardia lamblia
RSIRPPILSTIFAGGAPQAND

SEQ ID NO: 3196292 - protein, 19 aa, Giardia lamblia
RSITRSYYRGSCCALLVYD

SEQ ID NO: 3196293 - protein, 25 aa, Giardia lamblia
RSKCALFPFERPQKDMIGKFLLSVA

SEQ ID NO: 3196294 - protein, 25 aa, Giardia lamblia
RSKCDFDLTPFVRWPRQVRIQRQKA

SEQ ID NO: 3196295 - protein, 18 aa, Giardia lamblia
RSKGALKMTFGLSGEQAS

SEQ ID NO: 3196296 - protein, 22 aa, Giardia lamblia
RSKHVPYRDSKLTRILQDSLGG

SEQ ID NO: 3196297 - protein, 22 aa, Giardia lamblia
RSKIVRYKRTPGNRLTSLRVKK

SEQ ID NO: 3196298 - protein, 26 aa, Giardia lamblia
RSKKELFFLVAATMQKVKKPQHIARK

SEQ ID NO: 3196299 - protein, 28 aa, Giardia lamblia
RSKVLIEDLACEPAVPPAPLTLTPANAR

SEQ ID NO: 3196300 - protein, 25 aa, Giardia lamblia
RSKYNVALMRLQAPSVTLGLVPSQQ

SEQ ID NO: 3196301 - protein, 18 aa, Giardia lamblia
RSLDGYLPRRLSMKHALL

SEQ ID NO: 3196302 - protein, 27 aa, Giardia lamblia
RSLDKLTYFVYILRTKESLAVPYFKIQ

SEQ ID NO: 3196303 - protein, 37 aa, Giardia lamblia
RSLDLATCHISDTGFIALAFACLNLPSLVCLNLRDNF

SEQ ID NO: 3196304 - protein, 21 aa, Giardia lamblia
RSLEDLLCTETIWIGAHSVIY

SEQ ID NO: 3196305 - protein, 18 aa, Giardia lamblia
RSLEGAHYISWRRSIRMR

SEQ ID NO: 3196306 - protein, 17 aa, Giardia lamblia
RSLFLLSNRQCANGGLC

SEQ ID NO: 3196307 - protein, 20 aa, Giardia lamblia
RSLFNNWLAKYKDLILNLTS

SEQ ID NO: 3196308 - protein, 17 aa, Giardia lamblia
RSLITPRDVLPLTEMHL

SEQ ID NO: 3196309 - protein, 21 aa, Giardia lamblia
RSLLETFLMTYNGQISPLVSF

SEQ ID NO: 3196310 - protein, 18 aa, Giardia lamblia
RSLLLQYASALETRDNEI

SEQ ID NO: 3196311 - protein, 17 aa, Giardia lamblia
RSLLRRFDVNDFYMVLF

SEQ ID NO: 3196312 - protein, 20 aa, Giardia lamblia
RSLPNFLYESKLSDFIKLEP

SEQ ID NO: 3196313 - protein, 18 aa, Giardia lamblia
RSLQLPLNTSLYGAMKKY

SEQ ID NO: 3196314 - protein, 21 aa, Giardia lamblia
RSLRPALPEHVPKSLLPEGTT

SEQ ID NO: 3196315 - protein, 35 aa, Giardia lamblia
RSLRPICRQLLNLWREAYLGVCVLPKDTYKDLQPQ

SEQ ID NO: 3196316 - protein, 20 aa, Giardia lamblia
RSLSPLSVLMRPSVTGNPVL

SEQ ID NO: 3196317 - protein, 20 aa, Giardia lamblia
RSLVLLPFTLETEQAEIPFD

SEQ ID NO: 3196318 - protein, 20 aa, Giardia lamblia
RSLVNVYYEITSSFSLLFTG

SEQ ID NO: 3196319 - protein, 22 aa, Giardia lamblia
RSLYERCCALRLSLKKMSYVLK

SEQ ID NO: 3196320 - protein, 20 aa, Giardia lamblia
RSMPHVKFRYLPAGQNVIIA

SEQ ID NO: 3196321 - protein, 28 aa, Giardia lamblia
RSMQTMYIHAFQAYLFNLATSRCITRIK

SEQ ID NO: 3196322 - protein, 18 aa, Giardia lamblia
RSMTVSFSDLATAMLCKD

SEQ ID NO: 3196323 - protein, 29 aa, Giardia lamblia
RSNDNFFILKLLLGSYILETTLLDKLYRE

SEQ ID NO: 3196324 - protein, 24 aa, Giardia lamblia
RSNHAIVLWQSRSGNYRLFILGGR

SEQ ID NO: 3196325 - protein, 38 aa, Giardia lamblia
RSNSIIKAANLPYPLRRFSLTYVQNRVVLIGGSQYSQK

SEQ ID NO: 3196326 - protein, 24 aa, Giardia lamblia
RSPHVLNPGILLQNTPQNTLGVTT

SEQ ID NO: 3196327 - protein, 17 aa, Giardia lamblia
RSPPIIAAPPPISDIMA

SEQ ID NO: 3196328 - protein, 22 aa, Giardia lamblia
RSPPPIIQIDPLSSLARELPTQ

SEQ ID NO: 3196329 - protein, 21 aa, Giardia lamblia
RSPSPMRRLYSTKALLSTAAE

SEQ ID NO: 3196330 - protein, 26 aa, Giardia lamblia
RSQEILVDLLNTFPLDQGPGNIAVLS

SEQ ID NO: 3196331 - protein, 23 aa, Giardia lamblia
RSRGLIPCFTYEESIGYSVGGVV

SEQ ID NO: 3196332 - protein, 18 aa, Giardia lamblia
RSRLCNYLNLYPTEFVTA

SEQ ID NO: 3196333 - protein, 17 aa, Giardia lamblia
RSRLLSILCECIADINI

SEQ ID NO: 3196334 - protein, 18 aa, Giardia lamblia
RSRPPEPMNFAPSPPSVP

SEQ ID NO: 3196335 - protein, 23 aa, Giardia lamblia
RSRRRDTLLIAYTDDALSFHAND

SEQ ID NO: 3196336 - protein, 22 aa, Giardia lamblia
RSSAPVFDPFLNDLVNAASQLD

SEQ ID NO: 3196337 - protein, 26 aa, Giardia lamblia
RSSGDAVSFWRIGISGLPDSVLDAIV

SEQ ID NO: 3196338 - protein, 25 aa, Giardia lamblia
RSSGMQLVQAIPILVDMLDATEALI

SEQ ID NO: 3196339 - protein, 39 aa, Giardia lamblia
RSSIIEQYRLYGSILIVCEVLLYPVPINDAERYSDNQSA

SEQ ID NO: 3196340 - protein, 23 aa, Giardia lamblia
RSSKGLSVLDLCLKWALEGVSDF

SEQ ID NO: 3196341 - protein, 23 aa, Giardia lamblia
RSSMAIYMNPNLNDYLWSTAASD

SEQ ID NO: 3196342 - protein, 28 aa, Giardia lamblia
RSSNEWTALMWAALFGRTEVVKLLLDVE

SEQ ID NO: 3196343 - protein, 17 aa, Giardia lamblia
RSSNGWTALMWAALVGR

SEQ ID NO: 3196344 - protein, 27 aa, Giardia lamblia
RSSNQILLLAIVLRVIRYNPRVHVILM

SEQ ID NO: 3196345 - protein, 26 aa, Giardia lamblia
RSSQVYDILYQILKAISITGNAAQWV

SEQ ID NO: 3196346 - protein, 24 aa, Giardia lamblia
RSSRIYNLLTGDKLSTLYPGVKQV

SEQ ID NO: 3196347 - protein, 26 aa, Giardia lamblia
RSSSCILFGGVHRAQMSPWATIEGGA

SEQ ID NO: 3196348 - protein, 24 aa, Giardia lamblia
RSSSLATLQPLKPPLKPADYSGLL

SEQ ID NO: 3196349 - protein, 25 aa, Giardia lamblia
RSSSMPNIFPERLLATYADDSETHL

SEQ ID NO: 3196350 - protein, 31 aa, Giardia lamblia
RSSTKLDVVNLLPYFYYKQGETITLAQLPEI

SEQ ID NO: 3196351 - protein, 29 aa, Giardia lamblia
RSSVAIQQMLQLALKFISSGSTLTLRAAL

SEQ ID NO: 3196352 - protein, 24 aa, Giardia lamblia
RSTLQQDVAYWKAQCELAKAQNAN

SEQ ID NO: 3196353 - protein, 26 aa, Giardia lamblia
RSTYPLGYMFFGMTVYLTVLSTKPEQ

SEQ ID NO: 3196354 - protein, 26 aa, Giardia lamblia
RSVCGSLNLFVYLSDTTLQAITEAFY

SEQ ID NO: 3196355 - protein, 21 aa, Giardia lamblia
RSVINSLYIAIIQELPVEIPD

SEQ ID NO: 3196356 - protein, 22 aa, Giardia lamblia
RSVLCLGGSDMFKIIFAVNMQA

SEQ ID NO: 3196357 - protein, 21 aa, Giardia lamblia
RSVLEKMLVLDPAERPTAKGL

SEQ ID NO: 3196358 - protein, 21 aa, Giardia lamblia
RSVLERMLVLDPAERPTAREL

SEQ ID NO: 3196359 - protein, 18 aa, Giardia lamblia
RSVLLLNKADLVPLEARK

SEQ ID NO: 3196360 - protein, 26 aa, Giardia lamblia
RSVMERNILAVWYWKMHQAGMQDTEG

SEQ ID NO: 3196361 - protein, 31 aa, Giardia lamblia
RSVRAFQRKPGLFSVHKYASALASSLCEGTP

SEQ ID NO: 3196362 - protein, 24 aa, Giardia lamblia
RSVSTKILLILRDCDIVAPDEFAH

SEQ ID NO: 3196363 - protein, 22 aa, Giardia lamblia
RSVTGIFGLLIQGLKTVANGTA

SEQ ID NO: 3196364 - protein, 20 aa, Giardia lamblia
RSWMPMEYSYALCRGRSMAL

SEQ ID NO: 3196365 - protein, 22 aa, Giardia lamblia
RSYALQLLTGISALERLNFCPT

SEQ ID NO: 3196366 - protein, 17 aa, Giardia lamblia
RSYAQAILVLLDLTKHS

SEQ ID NO: 3196367 - protein, 22 aa, Giardia lamblia
RSYRAMRAMAQYYSKELPTENS

SEQ ID NO: 3196368 - protein, 32 aa, Giardia lamblia
RSYTHEVVTLWYRCPSVLLGCRKYGGALDIWS

SEQ ID NO: 3196369 - protein, 33 aa, Giardia lamblia
RTAGNLPPWHQHYRAGPLELLAVPHNKTRQPAD

SEQ ID NO: 3196370 - protein, 22 aa, Giardia lamblia
RTAGRVGLVLPFCNLKNTLSDA

SEQ ID NO: 3196371 - protein, 17 aa, Giardia lamblia
RTAHLRLLEDRQAFRMV

SEQ ID NO: 3196372 - protein, 20 aa, Giardia lamblia
RTALMYALDHDHSRCAKILI

SEQ ID NO: 3196373 - protein, 19 aa, Giardia lamblia
RTALYRAIELGYLGLVQVL

SEQ ID NO: 3196374 - protein, 32 aa, Giardia lamblia
RTAPVFGVIIPMPTEFHAFKLQLGDKESYKEE

SEQ ID NO: 3196375 - protein, 28 aa, Giardia lamblia
RTARKIGAVPIIIGLLRQAMKDYQAKPS

SEQ ID NO: 3196376 - protein, 28 aa, Giardia lamblia
RTARMIETIILHLPVSLTECLSICHDSV

SEQ ID NO: 3196377 - protein, 27 aa, Giardia lamblia
RTASLKKLNQPLPRIGSLSADSAGTKS

SEQ ID NO: 3196378 - protein, 23 aa, Giardia lamblia
RTATYRILPLLITSPPGTYAVEP

SEQ ID NO: 3196379 - protein, 26 aa, Giardia lamblia
RTAVEKLYLNRKISILVATSTLAWGL

SEQ ID NO: 3196380 - protein, 28 aa, Giardia lamblia
RTCEAFLAQFMEYLGPYTATTFTKARTT

SEQ ID NO: 3196381 - protein, 17 aa, Giardia lamblia
RTDAIILLSPLAAGYVE

SEQ ID NO: 3196382 - protein, 25 aa, Giardia lamblia
RTDEILQKNLIRHLPRMFKSTASLN

SEQ ID NO: 3196383 - protein, 26 aa, Giardia lamblia
RTDLSYLSELPIACGITPTVTPGIGR

SEQ ID NO: 3196384 - protein, 24 aa, Giardia lamblia
RTEAQSHRFLYDEFVPLQALSESL

SEQ ID NO: 3196385 - protein, 37 aa, Giardia lamblia
RTEPFRTGVPHRLPLPPLLSAPTPSGPSLFFTGTSQG

SEQ ID NO: 3196386 - protein, 21 aa, Giardia lamblia
RTGLIKLFGEDVVDQGFTDLL

SEQ ID NO: 3196387 - protein, 21 aa, Giardia lamblia
RTGPAILLYIINFAAKRAGVA

SEQ ID NO: 3196388 - protein, 17 aa, Giardia lamblia
RTGSATALWYAAYCGHL

SEQ ID NO: 3196389 - protein, 38 aa, Giardia lamblia
RTGSGKTLAFLIPLLQRLISLQWQRLDGLGALILLPTA

SEQ ID NO: 3196390 - protein, 20 aa, Giardia lamblia
RTGWFQVMAHMDFIKVVVGM

SEQ ID NO: 3196391 - protein, 18 aa, Giardia lamblia
RTGYFQLGSLMMMLCDKT

SEQ ID NO: 3196392 - protein, 19 aa, Giardia lamblia
RTHGGLLVSIPTSSPLEDP

SEQ ID NO: 3196393 - protein, 44 aa, Giardia lamblia
RTIISFPSMTELFLRNGYMVDILLILQLFPNLKCLQLENCILLN

SEQ ID NO: 3196394 - protein, 21 aa, Giardia lamblia
RTILEETIVFAPLAHPHIAGC

SEQ ID NO: 3196395 - protein, 35 aa, Giardia lamblia
RTIPDQTVIYLMYNALIDILHYEPKLSAEAFLDKI

SEQ ID NO: 3196396 - protein, 19 aa, Giardia lamblia
RTISLSETHRLLWPSYRDA

SEQ ID NO: 3196397 - protein, 20 aa, Giardia lamblia
RTIWAVPMSFSLIDNNYKQV

SEQ ID NO: 3196398 - protein, 26 aa, Giardia lamblia
RTKIKIPTPNLPLQALPQQDALPKQP

SEQ ID NO: 3196399 - protein, 25 aa, Giardia lamblia
RTKKGPFDFLAGRGSFRHHSQEQPR

SEQ ID NO: 3196400 - protein, 26 aa, Giardia lamblia
RTKTIPLLCPFLKRKSISIPAQITYV

SEQ ID NO: 3196401 - protein, 19 aa, Giardia lamblia
RTLFISDLMSFIRNLATSS

SEQ ID NO: 3196402 - protein, 17 aa, Giardia lamblia
RTLFLVVEYCSNSGIQP

SEQ ID NO: 3196403 - protein, 19 aa, Giardia lamblia
RTLLPMLVNLTKDKIRCLF

SEQ ID NO: 3196404 - protein, 35 aa, Giardia lamblia
RTLPHSSVIHPVIGPILSPLRSKILSETQFEIERK

SEQ ID NO: 3196405 - protein, 24 aa, Giardia lamblia
RTLRLIYEILGVRFSLEPVTIAFE

SEQ ID NO: 3196406 - protein, 29 aa, Giardia lamblia
RTLSSSKIINWWRYATVTGAFNSACATVT

SEQ ID NO: 3196407 - protein, 24 aa, Giardia lamblia
RTLVIGVRAIIYITRSLYESTYGK

SEQ ID NO: 3196408 - protein, 17 aa, Giardia lamblia
RTLYQALAIHTEYHAKL

SEQ ID NO: 3196409 - protein, 18 aa, Giardia lamblia
RTMLKRELDGEKGRTIAP

SEQ ID NO: 3196410 - protein, 25 aa, Giardia lamblia
RTMTNTTPLTTLLVEETRDLGEAVH

SEQ ID NO: 3196411 - protein, 20 aa, Giardia lamblia
RTNARLLQRIAELENELLMA

SEQ ID NO: 3196412 - protein, 18 aa, Giardia lamblia
RTNPRFSESGFPMTYSQM

SEQ ID NO: 3196413 - protein, 24 aa, Giardia lamblia
RTNTHILSLLPYICTYGVFECCTS

SEQ ID NO: 3196414 - protein, 29 aa, Giardia lamblia
RTPANGLLGQLLPFLNDELTKKKALNIDA

SEQ ID NO: 3196415 - protein, 19 aa, Giardia lamblia
RTPEQLLIEKLNLTRASTA

SEQ ID NO: 3196416 - protein, 40 aa, Giardia lamblia
RTPEQWVGIPFSFASDTFALGTFLLHLIHARPRIATFSEC

SEQ ID NO: 3196417 - protein, 18 aa, Giardia lamblia
RTPIFDKILSTITASITD

SEQ ID NO: 3196418 - protein, 24 aa, Giardia lamblia
RTPITIDSLVPRNIAASPRFELQS

SEQ ID NO: 3196419 - protein, 26 aa, Giardia lamblia
RTPKPRLAILPGANRTFCSLPHIIKA

SEQ ID NO: 3196420 - protein, 22 aa, Giardia lamblia
RTPRDWTVKGVFARLYQNAEEI

SEQ ID NO: 3196421 - protein, 17 aa, Giardia lamblia
RTQALTRLPPIQKREQH

SEQ ID NO: 3196422 - protein, 17 aa, Giardia lamblia
RTQFRMMPLVTPHPTIT

SEQ ID NO: 3196423 - protein, 33 aa, Giardia lamblia
RTRDPTLIMHQFTASVYAFYLSAAENYCKKSLH

SEQ ID NO: 3196424 - protein, 21 aa, Giardia lamblia
RTREELTNTKFITSIGAMNAK

SEQ ID NO: 3196425 - protein, 26 aa, Giardia lamblia
RTRIPYKDCLKLLKAPDHLPIQPIRS

SEQ ID NO: 3196426 - protein, 18 aa, Giardia lamblia
RTRKLLDVKIPHMGHAQA

SEQ ID NO: 3196427 - protein, 24 aa, Giardia lamblia
RTRLHVIMEPFFKTLQNLIDECEK

SEQ ID NO: 3196428 - protein, 19 aa, Giardia lamblia
RTRPSLSELLFGECIHGEK

SEQ ID NO: 3196429 - protein, 19 aa, Giardia lamblia
RTRQIVKLSDAAILRQVRA

SEQ ID NO: 3196430 - protein, 23 aa, Giardia lamblia
RTSEPTEIFKMAKLNLVDLAGSE

SEQ ID NO: 3196431 - protein, 20 aa, Giardia lamblia
RTSLMLLIKDGRKDVAQLLV

SEQ ID NO: 3196432 - protein, 23 aa, Giardia lamblia
RTSMEIYFPIISTSTLTVILLQK

SEQ ID NO: 3196433 - protein, 30 aa, Giardia lamblia
RTSQLSSLAMLLLDPYYRTLRGFCILIEKE

SEQ ID NO: 3196434 - protein, 21 aa, Giardia lamblia
RTSRGIKAELLPSVLLECCKD

SEQ ID NO: 3196435 - protein, 26 aa, Giardia lamblia
RTTERILRALSLLTDAPVVAQPTLVS

SEQ ID NO: 3196436 - protein, 21 aa, Giardia lamblia
RTTQFSWIFNRLIGLRMHTDA

SEQ ID NO: 3196437 - protein, 21 aa, Giardia lamblia
RTTTDGLHRKILERNEYDRPD

SEQ ID NO: 3196438 - protein, 27 aa, Giardia lamblia
RTTTVKYYPLMLLAAKTAGDGTRALTC

SEQ ID NO: 3196439 - protein, 17 aa, Giardia lamblia
RTTWTMRQPADYLQWGE

SEQ ID NO: 3196440 - protein, 23 aa, Giardia lamblia
RTVDFLQCRGLLTAGADPEPYVY

SEQ ID NO: 3196441 - protein, 36 aa, Giardia lamblia
RTVGGLPVLAAKNIILAKYLHALAAFTEEKVSGTLL

SEQ ID NO: 3196442 - protein, 20 aa, Giardia lamblia
RTVLANRIPAPAAIQPSYFD

SEQ ID NO: 3196443 - protein, 24 aa, Giardia lamblia
RTVQFLTKMLPICLEKRMLSVDLT

SEQ ID NO: 3196444 - protein, 21 aa, Giardia lamblia
RTYERVLNCKASMLKEALRIL

SEQ ID NO: 3196445 - protein, 18 aa, Giardia lamblia
RTYKFPEITAYSAIQYSR

SEQ ID NO: 3196446 - protein, 25 aa, Giardia lamblia
RTYKSNILALETWLSENLASVSTER

SEQ ID NO: 3196447 - protein, 20 aa, Giardia lamblia
RTYLEQYKDLLLRPKCLNCN

SEQ ID NO: 3196448 - protein, 24 aa, Giardia lamblia
RTYPNSIIRLLLSYSGDIPKAPDT

SEQ ID NO: 3196449 - protein, 18 aa, Giardia lamblia
RTYWRNYFSSTDALIWVV

SEQ ID NO: 3196450 - protein, 22 aa, Giardia lamblia
RVACILYQRALCERDKVLRDIE

SEQ ID NO: 3196451 - protein, 26 aa, Giardia lamblia
RVAKSLLQWRFLRPRSRLMSGSFIGG

SEQ ID NO: 3196452 - protein, 18 aa, Giardia lamblia
RVCAKGVWPSVLSATSIN

SEQ ID NO: 3196453 - protein, 19 aa, Giardia lamblia
RVCLFLFNEHIFPSQMLFY

SEQ ID NO: 3196454 - protein, 26 aa, Giardia lamblia
RVDESYYLIDLSKLARSLCLIEMRLE

SEQ ID NO: 3196455 - protein, 18 aa, Giardia lamblia
RVDHMSDFFTSKLRDPLP

SEQ ID NO: 3196456 - protein, 36 aa, Giardia lamblia
RVEAQTSYRGFLRNKWKTLCKLINGAGATITEQGDE

SEQ ID NO: 3196457 - protein, 18 aa, Giardia lamblia
RVEKLVFSVLSSNALMKL

SEQ ID NO: 3196458 - protein, 25 aa, Giardia lamblia
RVESPRPYIYLANDPQNKYIISDPK

SEQ ID NO: 3196459 - protein, 19 aa, Giardia lamblia
RVFINSFHIPHPLYKEPCT

SEQ ID NO: 3196460 - protein, 17 aa, Giardia lamblia
RVGLMRFMALLAEFCEL

SEQ ID NO: 3196461 - protein, 31 aa, Giardia lamblia
RVHFGVRGCSTVFPLVFVCKCDFPHIIEQLN

SEQ ID NO: 3196462 - protein, 18 aa, Giardia lamblia
RVHPTPKKYLFLGDYVDR

SEQ ID NO: 3196463 - protein, 24 aa, Giardia lamblia
RVIAQSFFLRMWSKGKLLTEAMRA

SEQ ID NO: 3196464 - protein, 40 aa, Giardia lamblia
RVIDFSDLLLNARLRLMSLSRLSCYVFYNHICSAFAQLIL

SEQ ID NO: 3196465 - protein, 44 aa, Giardia lamblia
RVIGHLLAVSLIKDFKFPIALSPALLFLLLHCTVSPVGAHYYGE

SEQ ID NO: 3196466 - protein, 30 aa, Giardia lamblia
RVIKYQRVVWREGLLYIFMKRYSQSLDSVI

SEQ ID NO: 3196467 - protein, 23 aa, Giardia lamblia
RVILRIRPLVRAELMDGGGVSVQ

SEQ ID NO: 3196468 - protein, 27 aa, Giardia lamblia
RVILSAIRQIATALAYLHSVKRADAEG

SEQ ID NO: 3196469 - protein, 18 aa, Giardia lamblia
RVILSLANPYDIPVELSL

SEQ ID NO: 3196470 - protein, 18 aa, Giardia lamblia
RVKALFNPRRRCHKLSST

SEQ ID NO: 3196471 - protein, 22 aa, Giardia lamblia
RVKCVVFHPKRPWVIFSCQNGV

SEQ ID NO: 3196472 - protein, 17 aa, Giardia lamblia
RVKLIDFGICKELVDCS

SEQ ID NO: 3196473 - protein, 24 aa, Giardia lamblia
RVKPMPTSVLPKTAKPRIFSNSTR

SEQ ID NO: 3196474 - protein, 31 aa, Giardia lamblia
RVKSPVILYPRIRKVMRYDIAPSAKAGELQE

SEQ ID NO: 3196475 - protein, 17 aa, Giardia lamblia
RVKYVDFSTIPHAGMIP

SEQ ID NO: 3196476 - protein, 18 aa, Giardia lamblia
RVLAISPLQTRLNGIGFI

SEQ ID NO: 3196477 - protein, 20 aa, Giardia lamblia
RVLATYFLPNYKEIQRIVRN

SEQ ID NO: 3196478 - protein, 21 aa, Giardia lamblia
RVLDHLLLRIMENAPLVEIVQ

SEQ ID NO: 3196479 - protein, 18 aa, Giardia lamblia
RVLFLHQHHTNIIPYLQL

SEQ ID NO: 3196480 - protein, 30 aa, Giardia lamblia
RVLGSSLLGRLRDIYKLSLALEDAAELVSI

SEQ ID NO: 3196481 - protein, 17 aa, Giardia lamblia
RVLKVRTIGHLNNLCYK

SEQ ID NO: 3196482 - protein, 18 aa, Giardia lamblia
RVLLPLRRERREPKRCVW

SEQ ID NO: 3196483 - protein, 17 aa, Giardia lamblia
RVLLSDHLTVFQFPAHL

SEQ ID NO: 3196484 - protein, 25 aa, Giardia lamblia
RVLYDKALILEKRLSRQIASMLQNV

SEQ ID NO: 3196485 - protein, 17 aa, Giardia lamblia
RVLYRKLLGYKGVFEDL

SEQ ID NO: 3196486 - protein, 25 aa, Giardia lamblia
RVMDPYGWTALMSAVWNNHGSVAEL

SEQ ID NO: 3196487 - protein, 19 aa, Giardia lamblia
RVMHIYIPPGSSTTLIMSI

SEQ ID NO: 3196488 - protein, 20 aa, Giardia lamblia
RVMRASPFAVPYPTKADASV

SEQ ID NO: 3196489 - protein, 17 aa, Giardia lamblia
RVMTWKDTFLKESKALG

SEQ ID NO: 3196490 - protein, 23 aa, Giardia lamblia
RVMVLVELREALLTALTASTGEL

SEQ ID NO: 3196491 - protein, 19 aa, Giardia lamblia
RVPIILIPGLCSTKLDIVH

SEQ ID NO: 3196492 - protein, 33 aa, Giardia lamblia
RVPRLKSSGRGPRLLIRLLKDKLTGEIRDELGR

SEQ ID NO: 3196493 - protein, 25 aa, Giardia lamblia
RVPTDSRICVLLTTLFTVPPGGDPA

SEQ ID NO: 3196494 - protein, 17 aa, Giardia lamblia
RVPYIIIRAISDSGSGE

SEQ ID NO: 3196495 - protein, 28 aa, Giardia lamblia
RVQQSTPGFYKLPSTLGGPAFSMSSRTK

SEQ ID NO: 3196496 - protein, 17 aa, Giardia lamblia
RVRLIPAPRGAGIVASP

SEQ ID NO: 3196497 - protein, 17 aa, Giardia lamblia
RVRMSPENVLDLLKHPF

SEQ ID NO: 3196498 - protein, 29 aa, Giardia lamblia
RVRPTSRSHPPIPEPPLPGSLSEGGQISQ

SEQ ID NO: 3196499 - protein, 18 aa, Giardia lamblia
RVRRDAYLTQVKSDRLQE

SEQ ID NO: 3196500 - protein, 17 aa, Giardia lamblia
RVSFIRSWTVEGVPKVV

SEQ ID NO: 3196501 - protein, 32 aa, Giardia lamblia
RVSKSCFFSYTYQLLTALSYLHCPRKDETYQG

SEQ ID NO: 3196502 - protein, 18 aa, Giardia lamblia
RVSLLKGVPFKSECFRID

SEQ ID NO: 3196503 - protein, 34 aa, Giardia lamblia
RVSNIKEIINRLLHWIEMVYPLLMLDGRALLSSV

SEQ ID NO: 3196504 - protein, 21 aa, Giardia lamblia
RVSSHSPVLLPPSAHILNAKA

SEQ ID NO: 3196505 - protein, 17 aa, Giardia lamblia
RVTALMLAAARPNNSRM

SEQ ID NO: 3196506 - protein, 28 aa, Giardia lamblia
RVTEYMADIILFIQKIMDNGFAYVSAGS

SEQ ID NO: 3196507 - protein, 26 aa, Giardia lamblia
RVTGKVQGVFFRKYTKKEADALSLVG

SEQ ID NO: 3196508 - protein, 20 aa, Giardia lamblia
RVTIFSSAHLHEACIFPPVT

SEQ ID NO: 3196509 - protein, 26 aa, Giardia lamblia
RVTLDTLCRHPLIVKFLTSSRDEMVA

SEQ ID NO: 3196510 - protein, 24 aa, Giardia lamblia
RVVCAAYSHELPRYGIPVGLTNYA

SEQ ID NO: 3196511 - protein, 17 aa, Giardia lamblia
RVVFSGMPFANLDEAFK

SEQ ID NO: 3196512 - protein, 28 aa, Giardia lamblia
RVVGHPGILCWLQFHMNLRSEFTMDPES

SEQ ID NO: 3196513 - protein, 18 aa, Giardia lamblia
RVVQPYSIDRRCIFFSLA

SEQ ID NO: 3196514 - protein, 23 aa, Giardia lamblia
RVVRLLPNKWVLDIGAIQHATLH

SEQ ID NO: 3196515 - protein, 25 aa, Giardia lamblia
RVVVRHMFFYPEDVKYFAPVDLYTE

SEQ ID NO: 3196516 - protein, 18 aa, Giardia lamblia
RVWREGKVMLNFVCTTLQ

SEQ ID NO: 3196517 - protein, 19 aa, Giardia lamblia
RVYHFEGVVGWYTSGTAIQ

SEQ ID NO: 3196518 - protein, 17 aa, Giardia lamblia
RVYIAVQLFVASVLGEK

SEQ ID NO: 3196519 - protein, 20 aa, Giardia lamblia
RVYNFVSLLNMLHGSFPMLR

SEQ ID NO: 3196520 - protein, 28 aa, Giardia lamblia
RVYVAYGDRLFFSTVPIAANILTSSAMH

SEQ ID NO: 3196521 - protein, 18 aa, Giardia lamblia
RWAAIIIGPSQTPWEGAV

SEQ ID NO: 3196522 - protein, 24 aa, Giardia lamblia
RWAWVLEAIHRSIKEDALLLLLAD

SEQ ID NO: 3196523 - protein, 27 aa, Giardia lamblia
RWTGKQVFSMFVPRGVFYRSGDPKDIS

SEQ ID NO: 3196524 - protein, 18 aa, Giardia lamblia
RWTGPKPCPFLSSKDMNE

SEQ ID NO: 3196525 - protein, 17 aa, Giardia lamblia
RWVPPVQTMLEAGAFTV

SEQ ID NO: 3196526 - protein, 24 aa, Giardia lamblia
RYCKAILQAFRRRAEVQTKEEAKY

SEQ ID NO: 3196527 - protein, 19 aa, Giardia lamblia
RYEGMWHQGLRSGFGCHFY

SEQ ID NO: 3196528 - protein, 18 aa, Giardia lamblia
RYEQITGWRFDMKSPSEY

SEQ ID NO: 3196529 - protein, 19 aa, Giardia lamblia
RYFFMLRVDEKEHQAPGYY

SEQ ID NO: 3196530 - protein, 17 aa, Giardia lamblia
RYFLQSSVQNFNALQAL

SEQ ID NO: 3196531 - protein, 21 aa, Giardia lamblia
RYFNDFWLYDSVSMQWREINI

SEQ ID NO: 3196532 - protein, 27 aa, Giardia lamblia
RYGATALMKAAYKGYLEAVKLLIKKKV

SEQ ID NO: 3196533 - protein, 24 aa, Giardia lamblia
RYGDYPPPDLVAIIGPKGVGKTTL

SEQ ID NO: 3196534 - protein, 31 aa, Giardia lamblia
RYGGTSILMPFTFPVGLFVKLKELSPSIPMT

SEQ ID NO: 3196535 - protein, 27 aa, Giardia lamblia
RYGRTECVRLLLSKERTLKDLNGWSAL

SEQ ID NO: 3196536 - protein, 22 aa, Giardia lamblia
RYGSWLIIRLPRGKGGAIVPSR

SEQ ID NO: 3196537 - protein, 18 aa, Giardia lamblia
RYHILEPYSVEPHIQVSL

SEQ ID NO: 3196538 - protein, 17 aa, Giardia lamblia
RYHRFLSVMYVKDLSAV

SEQ ID NO: 3196539 - protein, 17 aa, Giardia lamblia
RYIDGKKMLAIKSLSRR

SEQ ID NO: 3196540 - protein, 18 aa, Giardia lamblia
RYIGFLRHVEVLKQLREN

SEQ ID NO: 3196541 - protein, 17 aa, Giardia lamblia
RYIISTCVITLPSPSTE

SEQ ID NO: 3196542 - protein, 17 aa, Giardia lamblia
RYKLKRASLFLSGKTVL

SEQ ID NO: 3196543 - protein, 20 aa, Giardia lamblia
RYKLKRFTITANERFIFAVD

SEQ ID NO: 3196544 - protein, 19 aa, Giardia lamblia
RYKYAPRPHSKLPGSTIGS

SEQ ID NO: 3196545 - protein, 19 aa, Giardia lamblia
RYLELTNPLVVITDTVLSS

SEQ ID NO: 3196546 - protein, 21 aa, Giardia lamblia
RYLHDYVSTGDLLEVAPPYGD

SEQ ID NO: 3196547 - protein, 19 aa, Giardia lamblia
RYLSDFWRCDLATGVFEEI

SEQ ID NO: 3196548 - protein, 33 aa, Giardia lamblia
RYLSKYKTIPNLPLNTWYLGDRRLMSISSSVYL

SEQ ID NO: 3196549 - protein, 19 aa, Giardia lamblia
RYLSSVLHYPLLSIASTQL

SEQ ID NO: 3196550 - protein, 19 aa, Giardia lamblia
RYLYSLHQYAQSTEAIMPP

SEQ ID NO: 3196551 - protein, 26 aa, Giardia lamblia
RYNLKPPPEYATLPPKSDYLMIDDEI

SEQ ID NO: 3196552 - protein, 19 aa, Giardia lamblia
RYNNIFAMAYVCSGAPWHE

SEQ ID NO: 3196553 - protein, 19 aa, Giardia lamblia
RYNYHHHGMFMNSLNKSLH

SEQ ID NO: 3196554 - protein, 25 aa, Giardia lamblia
RYQPTSPQPLLALSGTSPLSAQQHI

SEQ ID NO: 3196555 - protein, 29 aa, Giardia lamblia
RYQVIRDMLLEYWNHVCLFIQKADNLEKE

SEQ ID NO: 3196556 - protein, 20 aa, Giardia lamblia
RYRKKLFLGASLCGLRLGLQ

SEQ ID NO: 3196557 - protein, 22 aa, Giardia lamblia
RYRSCFRVIGVELLITVALNYY

SEQ ID NO: 3196558 - protein, 17 aa, Giardia lamblia
RYRSGKVVLVLNGGITM

SEQ ID NO: 3196559 - protein, 32 aa, Giardia lamblia
RYRSITSSYYRGAHGCLLVFDVTKRTSFEHCT

SEQ ID NO: 3196560 - protein, 19 aa, Giardia lamblia
RYSFPHYLILERLEDKASI

SEQ ID NO: 3196561 - protein, 18 aa, Giardia lamblia
RYSPVLVYGFEQLAARAA

SEQ ID NO: 3196562 - protein, 24 aa, Giardia lamblia
RYSRFNSIALTGYRWKYLGEDLHM

SEQ ID NO: 3196563 - protein, 18 aa, Giardia lamblia
RYVGRNPLLLQPPSPHNH

SEQ ID NO: 3196564 - protein, 18 aa, Giardia lamblia
RYVSYADANAALLQKLHE

SEQ ID NO: 3196565 - protein, 22 aa, Giardia lamblia
RYYNEWRILTKQTQLQLWTNQI

SEQ ID NO: 3196566 - protein, 24 aa, Giardia lamblia
RYYRAPEVLLLQPYDYQIDIWSIA

SEQ ID NO: 3196567 - protein, 18 aa, Giardia lamblia
RYYSHSAVWKLFVDSFDY

SEQ ID NO: 3196568 - protein, 24 aa, Giardia lamblia
SAAFTKAYLYLRLIDGCALDDISF

SEQ ID NO: 3196569 - protein, 17 aa, Giardia lamblia
SAAIHMGYARISDKIKL

SEQ ID NO: 3196570 - protein, 31 aa, Giardia lamblia
SAAVDANARIRYFENFYATLSNETTAAAGAN

SEQ ID NO: 3196571 - protein, 25 aa, Giardia lamblia
SACGSFVSVWSLITGRELVRISVPG

SEQ ID NO: 3196572 - protein, 21 aa, Giardia lamblia
SACLFYLRDDICKWRLMLLYF

SEQ ID NO: 3196573 - protein, 31 aa, Giardia lamblia
SACLNMVSVPADPYLLFRQPIATCTAAKEYV

SEQ ID NO: 3196574 - protein, 17 aa, Giardia lamblia
SACLPLLEILRADACAF

SEQ ID NO: 3196575 - protein, 24 aa, Giardia lamblia
SADDDYFYNLLADRDRQIKELSDI

SEQ ID NO: 3196576 - protein, 27 aa, Giardia lamblia
SADEVSFLIYITILTHGGLPDAHPVLL

SEQ ID NO: 3196577 - protein, 23 aa, Giardia lamblia
SADGEHFIIADFGLCKDALRCGS

SEQ ID NO: 3196578 - protein, 26 aa, Giardia lamblia
SADILCWEPLYDGGRFLLKQSRPLLM

SEQ ID NO: 3196579 - protein, 18 aa, Giardia lamblia
SADLLLVPDIQEVLRRME

SEQ ID NO: 3196580 - protein, 22 aa, Giardia lamblia
SADLRLMSLRSSVDSLLERWPA

SEQ ID NO: 3196581 - protein, 24 aa, Giardia lamblia
SADNLYLLGGPQYEFALYGFMQLK

SEQ ID NO: 3196582 - protein, 24 aa, Giardia lamblia
SADQRYLLLRIKVDTSNEYIGTLG

SEQ ID NO: 3196583 - protein, 22 aa, Giardia lamblia
SADSMFGFDLPADASATVEPST

SEQ ID NO: 3196584 - protein, 24 aa, Giardia lamblia
SADVWVELARLFLNPAYNCFNTAT

SEQ ID NO: 3196585 - protein, 20 aa, Giardia lamblia
SADYLSFLEAYRIGLRSPGP

SEQ ID NO: 3196586 - protein, 32 aa, Giardia lamblia
SAELMHQFQQFQLFQQFQQLQRMKCYQDVPGT

SEQ ID NO: 3196587 - protein, 23 aa, Giardia lamblia
SAEPLMLTIDLNNSYTLVAQQGK

SEQ ID NO: 3196588 - protein, 21 aa, Giardia lamblia
SAERSLERPSLFDSKDSPSCP

SEQ ID NO: 3196589 - protein, 19 aa, Giardia lamblia
SAESLLHLTNPRVARRLRS

SEQ ID NO: 3196590 - protein, 26 aa, Giardia lamblia
SAFHPTNIFVLLDTLGKIPNLRHLWL

SEQ ID NO: 3196591 - protein, 21 aa, Giardia lamblia
SAFICAMLKPDPSARSSVSTL

SEQ ID NO: 3196592 - protein, 25 aa, Giardia lamblia
SAFNQRCFLNPPYMVKPVTEVALPQ

SEQ ID NO: 3196593 - protein, 21 aa, Giardia lamblia
SAFPEIDVFFGSLGSFFDYDI

SEQ ID NO: 3196594 - protein, 29 aa, Giardia lamblia
SAGKSLVAFIYILRCLSLCKKSAIIAVPF

SEQ ID NO: 3196595 - protein, 24 aa, Giardia lamblia
SAGLKFYFHANGNTPVALIPIAEL

SEQ ID NO: 3196596 - protein, 22 aa, Giardia lamblia
SAGLSFKAFCFSRLLSLDAHRS

SEQ ID NO: 3196597 - protein, 25 aa, Giardia lamblia
SAGPPTLPAVPVTSSYPPSCHPSIN

SEQ ID NO: 3196598 - protein, 25 aa, Giardia lamblia
SAGRRRLAIMRSFYLDKLAIYERAE

SEQ ID NO: 3196599 - protein, 27 aa, Giardia lamblia
SAGSTDFALFLWGVDYPTFDLMIDSTV

SEQ ID NO: 3196600 - protein, 20 aa, Giardia lamblia
SAHLHEACIFPPVTTKLSST

SEQ ID NO: 3196601 - protein, 26 aa, Giardia lamblia
SAHTSPPHRLLSSRSLYSGAGESAAD

SEQ ID NO: 3196602 - protein, 24 aa, Giardia lamblia
SAIKKDLYALARASRQSRHGSEAI

SEQ ID NO: 3196603 - protein, 25 aa, Giardia lamblia
SAIKVLAYYIPIAQSFSLSFLPPSS

SEQ ID NO: 3196604 - protein, 18 aa, Giardia lamblia
SAILALLPDLLSVDCGSA

SEQ ID NO: 3196605 - protein, 20 aa, Giardia lamblia
SAILKAFKKTKRKAAAKAGI

SEQ ID NO: 3196606 - protein, 30 aa, Giardia lamblia
SAILVPPVPPIPIFALAHAGLPYPAQITTS

SEQ ID NO: 3196607 - protein, 24 aa, Giardia lamblia
SAIPGTPIALQTDVTRSASVLNIE

SEQ ID NO: 3196608 - protein, 23 aa, Giardia lamblia
SAIYAAHPFGYFAVRKIVFSDCK

SEQ ID NO: 3196609 - protein, 24 aa, Giardia lamblia
SAKALSSAILLVRYSDFETDAKGY

SEQ ID NO: 3196610 - protein, 23 aa, Giardia lamblia
SAKAMRVPLLMNVIDTPGHCDFS

SEQ ID NO: 3196611 - protein, 29 aa, Giardia lamblia
SAKENNIVRVWSLLPLQGGLVDQEGCTAL

SEQ ID NO: 3196612 - protein, 18 aa, Giardia lamblia
SAKLPLLAEKMTWTSTLG

SEQ ID NO: 3196613 - protein, 18 aa, Giardia lamblia
SAKPMLLTTHHTDAYHLP

SEQ ID NO: 3196614 - protein, 18 aa, Giardia lamblia
SALAFLHNPINFTTIDSL

SEQ ID NO: 3196615 - protein, 17 aa, Giardia lamblia
SALDPPYARKADFLRRV

SEQ ID NO: 3196616 - protein, 22 aa, Giardia lamblia
SALGMMHYLTSIRSFINVPFPL

SEQ ID NO: 3196617 - protein, 24 aa, Giardia lamblia
SALGQHILTLERRLLKKEQELQAL

SEQ ID NO: 3196618 - protein, 26 aa, Giardia lamblia
SALHQLAMQLLIYKNEKFYNSLIGKL

SEQ ID NO: 3196619 - protein, 34 aa, Giardia lamblia
SALHYAVIYEYLDSIPILAKYLKDVPDPEGLLPL

SEQ ID NO: 3196620 - protein, 17 aa, Giardia lamblia
SALKAVTYAYKSIRLRL

SEQ ID NO: 3196621 - protein, 20 aa, Giardia lamblia
SALLNYFRYGSSRGTSIEES

SEQ ID NO: 3196622 - protein, 18 aa, Giardia lamblia
SALLRSESYFDAHRRLCR

SEQ ID NO: 3196623 - protein, 18 aa, Giardia lamblia
SALMIAAMEGSIDAIISL

SEQ ID NO: 3196624 - protein, 25 aa, Giardia lamblia
SALMLSVWHRFYDLALRLTAYEKGH

SEQ ID NO: 3196625 - protein, 20 aa, Giardia lamblia
SALPAYLKRMTDGDTSTRSR

SEQ ID NO: 3196626 - protein, 26 aa, Giardia lamblia
SALQILQHPTVERMWQMYRGYLDVGV

SEQ ID NO: 3196627 - protein, 18 aa, Giardia lamblia
SALQRAMHSFLSSDELIA

SEQ ID NO: 3196628 - protein, 26 aa, Giardia lamblia
SALRPSAYHALQWFKRIHAGVDLSCV

SEQ ID NO: 3196629 - protein, 22 aa, Giardia lamblia
SALSFLGLYKKKATIVFVGLDN

SEQ ID NO: 3196630 - protein, 19 aa, Giardia lamblia
SALTFQPNIRRASSAGTGG

SEQ ID NO: 3196631 - protein, 28 aa, Giardia lamblia
SALVHSFERDLLGICLALAPYEHSVLDA

SEQ ID NO: 3196632 - protein, 19 aa, Giardia lamblia
SAMCSASMVDSLAALHADL

SEQ ID NO: 3196633 - protein, 24 aa, Giardia lamblia
SAMSRLKLYNRLPPNGLAVYCGEI

SEQ ID NO: 3196634 - protein, 27 aa, Giardia lamblia
SANLLPSGLYLLRYPHYELIRITPDGH

SEQ ID NO: 3196635 - protein, 17 aa, Giardia lamblia
SANLLSRHDFTPGGTVT

SEQ ID NO: 3196636 - protein, 18 aa, Giardia lamblia
SANLRGLLAIHIAALKGH

SEQ ID NO: 3196637 - protein, 25 aa, Giardia lamblia
SANNCSFILTRVFSKNLHELINVIL

SEQ ID NO: 3196638 - protein, 20 aa, Giardia lamblia
SANQPFYPLVSNAALEAMAK

SEQ ID NO: 3196639 - protein, 24 aa, Giardia lamblia
SANRFIICETILSTTALYACVCSP

SEQ ID NO: 3196640 - protein, 23 aa, Giardia lamblia
SANRSFYAFYHSVGRTDSANRPV

SEQ ID NO: 3196641 - protein, 24 aa, Giardia lamblia
SANSHLLTPKSGLPFSSRLSPCPD

SEQ ID NO: 3196642 - protein, 24 aa, Giardia lamblia
SAPDNIIHFSYRDKMFKADGLVSQ

SEQ ID NO: 3196643 - protein, 22 aa, Giardia lamblia
SAPIVFARMRQGLAEAATTPSA

SEQ ID NO: 3196644 - protein, 22 aa, Giardia lamblia
SAPLANLLAIQSTVPSTMHVNK

SEQ ID NO: 3196645 - protein, 21 aa, Giardia lamblia
SAPLITALQRQIGSHLQFTSS

SEQ ID NO: 3196646 - protein, 22 aa, Giardia lamblia
SAPNQMYLPGSPNTSFREIKPP

SEQ ID NO: 3196647 - protein, 35 aa, Giardia lamblia
SAPSIRSDIWSFGLLLWTMCTLRHPLFNLDEVTEE

SEQ ID NO: 3196648 - protein, 17 aa, Giardia lamblia
SAPTNSAPWTAKYSVYE

SEQ ID NO: 3196649 - protein, 23 aa, Giardia lamblia
SAQLKSFLHAFNPVFNPKSNPFE

SEQ ID NO: 3196650 - protein, 51 aa, Giardia lamblia
SAQLLSREPFMITSIGDIFLKRGLLSLLLTPAQAKFYIFASVGLSSVQQLM

SEQ ID NO: 3196651 - protein, 17 aa, Giardia lamblia
SAQLSVRSLSLNAAQPT

SEQ ID NO: 3196652 - protein, 24 aa, Giardia lamblia
SARFGWLVINLKPAKQTLITNIGK

SEQ ID NO: 3196653 - protein, 18 aa, Giardia lamblia
SARGIPPDILKDKQIATY

SEQ ID NO: 3196654 - protein, 24 aa, Giardia lamblia
SARGYSALMWAIMGGSRECFDLLL

SEQ ID NO: 3196655 - protein, 24 aa, Giardia lamblia
SARINRPVSLYTEPLMALLETSTS

SEQ ID NO: 3196656 - protein, 22 aa, Giardia lamblia
SARIRTRTLHPERPVALKTTND

SEQ ID NO: 3196657 - protein, 28 aa, Giardia lamblia
SARTNVMKTIWSLLSSTNSKSWKQIYKT

SEQ ID NO: 3196658 - protein, 32 aa, Giardia lamblia
SARVARYLMTFNPLIFIPRIPKDGTEQSILEH

SEQ ID NO: 3196659 - protein, 23 aa, Giardia lamblia
SARVTFLRIEFSSPLTPRIISQL

SEQ ID NO: 3196660 - protein, 20 aa, Giardia lamblia
SASAPIPYPTNRENPMLAVQ

SEQ ID NO: 3196661 - protein, 30 aa, Giardia lamblia
SASEPTLTMPFAISTIPLYTMNPAKTEATR

SEQ ID NO: 3196662 - protein, 24 aa, Giardia lamblia
SASGLLGPSPYLPLNPHILEPCYM

SEQ ID NO: 3196663 - protein, 23 aa, Giardia lamblia
SASIKFLDYCCDTLTIVLESGHI

SEQ ID NO: 3196664 - protein, 21 aa, Giardia lamblia
SASMIWSPFQTPTPADRAQRK

SEQ ID NO: 3196665 - protein, 41 aa, Giardia lamblia
SASNSFYAILPSPVDVWCFGVTILYIMIGAARTEPLYRRSN

SEQ ID NO: 3196666 - protein, 22 aa, Giardia lamblia
SASQTILGVPLINLLSSSSSGP

SEQ ID NO: 3196667 - protein, 28 aa, Giardia lamblia
SATYKHLPFMAYFSSNKLFLRAVTPTLG

SEQ ID NO: 3196668 - protein, 22 aa, Giardia lamblia
SAVACQDYTFAPQLFAKAQACL

SEQ ID NO: 3196669 - protein, 42 aa, Giardia lamblia
SAVEKEFIYNLQQQVYFLELQSKLLRDKLVDAGPKLKSRSVE

SEQ ID NO: 3196670 - protein, 33 aa, Giardia lamblia
SAVESAVDGLIGKLLMLLNTNAISRESARDILH

SEQ ID NO: 3196671 - protein, 22 aa, Giardia lamblia
SAVFEQWPTLEAILLTLPSAAT

SEQ ID NO: 3196672 - protein, 25 aa, Giardia lamblia
SAVLEAGLSEIYQRFYTALKTMTGV

SEQ ID NO: 3196673 - protein, 20 aa, Giardia lamblia
SAVPLLKKLAAAELALPVTL

SEQ ID NO: 3196674 - protein, 23 aa, Giardia lamblia
SAVSQTISFIGKAALDGTTALML

SEQ ID NO: 3196675 - protein, 22 aa, Giardia lamblia
SAVYAFTSTFFAFGNLARRGIV

SEQ ID NO: 3196676 - protein, 25 aa, Giardia lamblia
SAVYASCLFYMHYLRGVLKHEREDY

SEQ ID NO: 3196677 - protein, 27 aa, Giardia lamblia
SAWLKPAALPRYLQYMPDGWVDVTDTK

SEQ ID NO: 3196678 - protein, 23 aa, Giardia lamblia
SAYDGNEFYRPPTGRDTKSDDTD

SEQ ID NO: 3196679 - protein, 25 aa, Giardia lamblia
SAYEHALAMPFPFISEDRYKRCAKM

SEQ ID NO: 3196680 - protein, 19 aa, Giardia lamblia
SAYGIRKFCSEFYSEFCSE

SEQ ID NO: 3196681 - protein, 21 aa, Giardia lamblia
SAYIWKPHARPLLSFTGPGRT

SEQ ID NO: 3196682 - protein, 24 aa, Giardia lamblia
SCAELLNHPWLIKNANSLMRQKQL

SEQ ID NO: 3196683 - protein, 32 aa, Giardia lamblia
SCARILYYSLVATWAELLLPLLQSLGQGGDTQ

SEQ ID NO: 3196684 - protein, 25 aa, Giardia lamblia
SCDRPDRQLFLKKITSIPGCCTSEK

SEQ ID NO: 3196685 - protein, 25 aa, Giardia lamblia
SCEAEGLIGLILDSSSKITMCPATL

SEQ ID NO: 3196686 - protein, 25 aa, Giardia lamblia
SCEEHYLVPVDILLDWDSKSSTSAP

SEQ ID NO: 3196687 - protein, 28 aa, Giardia lamblia
SCERFPIRWFDIVVLLRLGTEELYDRLV

SEQ ID NO: 3196688 - protein, 30 aa, Giardia lamblia
SCEWAILTSKGLFRIALDDTFRVIECADEF

SEQ ID NO: 3196689 - protein, 24 aa, Giardia lamblia
SCFKNAREDILLTLGKSADINLET

SEQ ID NO: 3196690 - protein, 21 aa, Giardia lamblia
SCFLGRFHRPFISMSLSHAVS

SEQ ID NO: 3196691 - protein, 29 aa, Giardia lamblia
SCGEGKITDELLPPSFRPMRREGTKSFLE

SEQ ID NO: 3196692 - protein, 24 aa, Giardia lamblia
SCGVNFAEYYCPMCLLYCDAGQEM

SEQ ID NO: 3196693 - protein, 23 aa, Giardia lamblia
SCGYDRDGLLNVFLFGEDTENIE

SEQ ID NO: 3196694 - protein, 18 aa, Giardia lamblia
SCHTVWTAIFTANGNSIL

SEQ ID NO: 3196695 - protein, 18 aa, Giardia lamblia
SCIFTYFDLARELVQRQQ

SEQ ID NO: 3196696 - protein, 19 aa, Giardia lamblia
SCIPLFIQMCKVSSNLLID

SEQ ID NO: 3196697 - protein, 24 aa, Giardia lamblia
SCKIPWTCVSILQAAGWINAPEVE

SEQ ID NO: 3196698 - protein, 24 aa, Giardia lamblia
SCKNDKYWFNKGTTALMLAAHYGH

SEQ ID NO: 3196699 - protein, 23 aa, Giardia lamblia
SCKTMPIMWYVARVCCASTNTVA

SEQ ID NO: 3196700 - protein, 22 aa, Giardia lamblia
SCKYNDILAENRKLRSEIENLR

SEQ ID NO: 3196701 - protein, 17 aa, Giardia lamblia
SCLLMDPFTLQVLSTFR

SEQ ID NO: 3196702 - protein, 19 aa, Giardia lamblia
SCLLYLAAAGVRKLIIVDN

SEQ ID NO: 3196703 - protein, 27 aa, Giardia lamblia
SCLRDSFHPQFGSITFLLCVSQVVRQE

SEQ ID NO: 3196704 - protein, 17 aa, Giardia lamblia
SCMALANSGKYLITGTV

SEQ ID NO: 3196705 - protein, 35 aa, Giardia lamblia
SCPDVLDYVKKQKLKVLFILLTHTHFDHVFGTGYV

SEQ ID NO: 3196706 - protein, 20 aa, Giardia lamblia
SCPSFSRTAFLLRAYARAHQ

SEQ ID NO: 3196707 - protein, 19 aa, Giardia lamblia
SCRAQVFDGLWVKDAFQKG

SEQ ID NO: 3196708 - protein, 24 aa, Giardia lamblia
SCRLTCCSVFERCGYISNISRFNE

SEQ ID NO: 3196709 - protein, 20 aa, Giardia lamblia
SCRPLAHRLGSPLREELRNV

SEQ ID NO: 3196710 - protein, 26 aa, Giardia lamblia
SCSASRLRTAIYLLHSNLSWTVSVVE

SEQ ID NO: 3196711 - protein, 20 aa, Giardia lamblia
SCSKKIIEFVYAFCKERDLL

SEQ ID NO: 3196712 - protein, 22 aa, Giardia lamblia
SCSPPLFLELLEEKAANEDSES

SEQ ID NO: 3196713 - protein, 18 aa, Giardia lamblia
SCSYQELLVKMFQLHKQA

SEQ ID NO: 3196714 - protein, 28 aa, Giardia lamblia
SCTLAREVVFLVARYLPRALADKDDRRA

SEQ ID NO: 3196715 - protein, 18 aa, Giardia lamblia
SCTVGLFLRVEFTHQMDA

SEQ ID NO: 3196716 - protein, 30 aa, Giardia lamblia
SCTVLTSHLLYLLLVCFQDLHTVKPGRSRI

SEQ ID NO: 3196717 - protein, 18 aa, Giardia lamblia
SCVIIYKSTGYHNLQNLV

SEQ ID NO: 3196718 - protein, 19 aa, Giardia lamblia
SCVLMVPNINNERPFIVYN

SEQ ID NO: 3196719 - protein, 18 aa, Giardia lamblia
SDAAQPLSIFQPVKEEAL

SEQ ID NO: 3196720 - protein, 24 aa, Giardia lamblia
SDADKELWLNFWYDLDEENKNKVK

SEQ ID NO: 3196721 - protein, 23 aa, Giardia lamblia
SDAIRILLPIERPTDELGRTALM

SEQ ID NO: 3196722 - protein, 20 aa, Giardia lamblia
SDAITLLKAKDYLLLREEVE

SEQ ID NO: 3196723 - protein, 30 aa, Giardia lamblia
SDALGNRMYPYSLVLRLPPGGSRFYSGPGY

SEQ ID NO: 3196724 - protein, 36 aa, Giardia lamblia
SDCSHQPYVYFYLPKNPLFIADLIESSLFNAFSGGY

SEQ ID NO: 3196725 - protein, 31 aa, Giardia lamblia
SDDIFIFGSAYPFPLGVVYYSTESLCLTTGS

SEQ ID NO: 3196726 - protein, 27 aa, Giardia lamblia
SDDIPVDLMIQTLVDCIATKSADLRQV

SEQ ID NO: 3196727 - protein, 25 aa, Giardia lamblia
SDDQAFDYFIQIACALRYCHRFGIC

SEQ ID NO: 3196728 - protein, 30 aa, Giardia lamblia
SDDYEALCYLWLDILTDRLAWRKCKKPSLI

SEQ ID NO: 3196729 - protein, 25 aa, Giardia lamblia
SDEDHLRFFGSLNFSYLDSYTDQRN

SEQ ID NO: 3196730 - protein, 26 aa, Giardia lamblia
SDEDVSLYFLLGLQADAVFAGDDLPI

SEQ ID NO: 3196731 - protein, 23 aa, Giardia lamblia
SDEIAKLLVPLKYDWHAAKQTRE

SEQ ID NO: 3196732 - protein, 22 aa, Giardia lamblia
SDEPYTWFVFVGCADNSIHAWS

SEQ ID NO: 3196733 - protein, 22 aa, Giardia lamblia
SDETILFLEALCDQASKAQQYR

SEQ ID NO: 3196734 - protein, 20 aa, Giardia lamblia
SDFDCSLCYSLGAVAAILGC

SEQ ID NO: 3196735 - protein, 22 aa, Giardia lamblia
SDFMKRLFIDSALPPAQDADID

SEQ ID NO: 3196736 - protein, 28 aa, Giardia lamblia
SDFPEAFELLLPLEHRRARKDGSTALMA

SEQ ID NO: 3196737 - protein, 26 aa, Giardia lamblia
SDGAQFRRLSMAWSSAARFLSDTPSV

SEQ ID NO: 3196738 - protein, 24 aa, Giardia lamblia
SDGDFEIYLFQLRTSKLLEVLSGH

SEQ ID NO: 3196739 - protein, 23 aa, Giardia lamblia
SDGLTALMFATMNHHTKCVELLA

SEQ ID NO: 3196740 - protein, 23 aa, Giardia lamblia
SDGSDFFILMVVGMFGDNREIVS

SEQ ID NO: 3196741 - protein, 23 aa, Giardia lamblia
SDGSVRFFSVYYDAQDYSGKDSV

SEQ ID NO: 3196742 - protein, 18 aa, Giardia lamblia
SDGYIRLWSGHQLLQAQF

SEQ ID NO: 3196743 - protein, 26 aa, Giardia lamblia
SDHDQLSIIIYQLLLCFAHAGVSTSS

SEQ ID NO: 3196744 - protein, 24 aa, Giardia lamblia
SDHLTVFQFPAHLPVAKMTRTQSA

SEQ ID NO: 3196745 - protein, 20 aa, Giardia lamblia
SDIKYFMPQSITLSKRPTDK

SEQ ID NO: 3196746 - protein, 18 aa, Giardia lamblia
SDILIWVNTLLKERPEVL

SEQ ID NO: 3196747 - protein, 28 aa, Giardia lamblia
SDIWALGVIIYELATLKRPNFTRTGDPK

SEQ ID NO: 3196748 - protein, 25 aa, Giardia lamblia
SDIWSLGCITYELATLQAFVKNPTA

SEQ ID NO: 3196749 - protein, 25 aa, Giardia lamblia
SDIWSLGCLLYELCTFQAFVTGRTP

SEQ ID NO: 3196750 - protein, 20 aa, Giardia lamblia
SDKAAMLQSVIPLAVAKGVA

SEQ ID NO: 3196751 - protein, 29 aa, Giardia lamblia
SDKASILHTAPPTRFDITGPIAIDARKQT

SEQ ID NO: 3196752 - protein, 26 aa, Giardia lamblia
SDKILNFITVIPHGPIRFSPTVENFV

SEQ ID NO: 3196753 - protein, 17 aa, Giardia lamblia
SDKISEIGTLKKKLEEA

SEQ ID NO: 3196754 - protein, 34 aa, Giardia lamblia
SDKITMPMMVITMGGRFFDCKDAELTVTMKVNDE

SEQ ID NO: 3196755 - protein, 26 aa, Giardia lamblia
SDKLGLPPVKLHCSVLAEDAIRQAID

SEQ ID NO: 3196756 - protein, 23 aa, Giardia lamblia
SDKLSFILPVCSSKMISSLNTYT

SEQ ID NO: 3196757 - protein, 18 aa, Giardia lamblia
SDKREIICIPEGKYFIIA

SEQ ID NO: 3196758 - protein, 24 aa, Giardia lamblia
SDKRFLKLINSIAPSIFGPAYSDI

SEQ ID NO: 3196759 - protein, 25 aa, Giardia lamblia
SDLCHLTFKFTLQLGSKKVSLSPHR

SEQ ID NO: 3196760 - protein, 25 aa, Giardia lamblia
SDLEDRFILVMLDLFGYGCWHEIVM

SEQ ID NO: 3196761 - protein, 17 aa, Giardia lamblia
SDLFPQSSTLLSSSSVS

SEQ ID NO: 3196762 - protein, 21 aa, Giardia lamblia
SDLGLMSYLSYWKRRICEVLV

SEQ ID NO: 3196763 - protein, 25 aa, Giardia lamblia
SDLKPLLSISCLKLIVIKHNSLCIP

SEQ ID NO: 3196764 - protein, 28 aa, Giardia lamblia
SDLLEHDFMIILRYILCPPSQDATHHRI

SEQ ID NO: 3196765 - protein, 19 aa, Giardia lamblia
SDLLTLHNNLLYTQLTGAQ

SEQ ID NO: 3196766 - protein, 21 aa, Giardia lamblia
SDLMALKLELEAERDSLQVRV

SEQ ID NO: 3196767 - protein, 19 aa, Giardia lamblia
SDLMSFIRNLATSSSYEDR

SEQ ID NO: 3196768 - protein, 29 aa, Giardia lamblia
SDLNLPKAVWLPALFNPQSFLRAVLQSTA

SEQ ID NO: 3196769 - protein, 31 aa, Giardia lamblia
SDLQLTSFDFVIPMTIFALLTTNRYKTYDPK

SEQ ID NO: 3196770 - protein, 22 aa, Giardia lamblia
SDLRAQLLLVNNTISPVKEAIN

SEQ ID NO: 3196771 - protein, 23 aa, Giardia lamblia
SDLSGLRPIVEKTRAFEDELAGL

SEQ ID NO: 3196772 - protein, 21 aa, Giardia lamblia
SDLVEILLEPEARHINRRGET

SEQ ID NO: 3196773 - protein, 17 aa, Giardia lamblia
SDMLLTEPKLRTITGKR

SEQ ID NO: 3196774 - protein, 23 aa, Giardia lamblia
SDMTTNIPIFLNFSARTGANQTQ

SEQ ID NO: 3196775 - protein, 26 aa, Giardia lamblia
SDMWSLGIIIYELVSLSRPHFIRGCR

SEQ ID NO: 3196776 - protein, 24 aa, Giardia lamblia
SDMWSLGMLIYTMCTLQAPEGISL

SEQ ID NO: 3196777 - protein, 26 aa, Giardia lamblia
SDMWSLGVIIYELTTLRRPDFLEGKD

SEQ ID NO: 3196778 - protein, 19 aa, Giardia lamblia
SDNGFDLGLFSWSLQSARE

SEQ ID NO: 3196779 - protein, 33 aa, Giardia lamblia
SDNIVAQIAAINRPFTPITFDQSQYTPAEVIRK

SEQ ID NO: 3196780 - protein, 25 aa, Giardia lamblia
SDNLFKFIVMRRQLKYWMALVQNRR

SEQ ID NO: 3196781 - protein, 23 aa, Giardia lamblia
SDNLIIVTTDRIVRLFHASTLVE

SEQ ID NO: 3196782 - protein, 25 aa, Giardia lamblia
SDNPKVYFSSKVLGLRKEAATLFKL

SEQ ID NO: 3196783 - protein, 25 aa, Giardia lamblia
SDNTAIPLISLWRAYDIGKILAEKH

SEQ ID NO: 3196784 - protein, 24 aa, Giardia lamblia
SDNVSLISILAPKEAHIRNGAGKT

SEQ ID NO: 3196785 - protein, 28 aa, Giardia lamblia
SDPAIFGFPTLPYTQVIPGIQPISNQLV

SEQ ID NO: 3196786 - protein, 30 aa, Giardia lamblia
SDPAVSIFIKLKMLNLLLLLSNEAKEHKYT

SEQ ID NO: 3196787 - protein, 20 aa, Giardia lamblia
SDPLRIIREKNLAQGLDIFG

SEQ ID NO: 3196788 - protein, 24 aa, Giardia lamblia
SDPSFLLVVYSRNFGFDPVSKAIL

SEQ ID NO: 3196789 - protein, 31 aa, Giardia lamblia
SDPTKLPGGENFKYGWKIGSPAGCGRGIDIS

SEQ ID NO: 3196790 - protein, 24 aa, Giardia lamblia
SDPTPRLWPQAPVPSIVLPRCSLT

SEQ ID NO: 3196791 - protein, 48 aa, Giardia lamblia
SDPYRRLTTLSHKYWTGLHSFLYWKSRVYGWFYSPPLGANSALYRLPD

SEQ ID NO: 3196792 - protein, 17 aa, Giardia lamblia
SDQISILTSAGFVPLSM

SEQ ID NO: 3196793 - protein, 24 aa, Giardia lamblia
SDQPQYTKLLINPSDRFVIGGPKS

SEQ ID NO: 3196794 - protein, 22 aa, Giardia lamblia
SDRLVLFLETNFMAGGSNHAAS

SEQ ID NO: 3196795 - protein, 52 aa, Giardia lamblia
SDRRLLVRLQKTCTALYYWSPDLASVSWLAQFVFPFVKFWERDTVAAFETCV

SEQ ID NO: 3196796 - protein, 26 aa, Giardia lamblia
SDSANMRVLLSAILKDLAASRETIYV

SEQ ID NO: 3196797 - protein, 27 aa, Giardia lamblia
SDSKYLQFYDPLRRLILVKSEPCTMGE

SEQ ID NO: 3196798 - protein, 22 aa, Giardia lamblia
SDSLLSIRALIPLEAGLADNEG

SEQ ID NO: 3196799 - protein, 27 aa, Giardia lamblia
SDSMQRLYGYRLLYTVSRIFTKKMAID

SEQ ID NO: 3196800 - protein, 24 aa, Giardia lamblia
SDSPSRVFTFPPILSLTKNVHKDI

SEQ ID NO: 3196801 - protein, 24 aa, Giardia lamblia
SDTELIEHLLPSYNLFCSTPQSSK

SEQ ID NO: 3196802 - protein, 28 aa, Giardia lamblia
SDTLDVFEIFNYQSFFTVLSYVSIVTEL

SEQ ID NO: 3196803 - protein, 41 aa, Giardia lamblia
SDTLQYLVQIELSNLFPAAYFCALFWRYYENLKGNKDKSFS

SEQ ID NO: 3196804 - protein, 32 aa, Giardia lamblia
SDTTRRSLRLLLFHALSYLPYAGAISTDAGFY

SEQ ID NO: 3196805 - protein, 17 aa, Giardia lamblia
SDVFPIRGLLCISIIDY

SEQ ID NO: 3196806 - protein, 19 aa, Giardia lamblia
SDVIVTRLLSPDPQLYASQ

SEQ ID NO: 3196807 - protein, 23 aa, Giardia lamblia
SDVRSFPFVTHPGPDRLDKALAE

SEQ ID NO: 3196808 - protein, 25 aa, Giardia lamblia
SDVWSLGVILYELTTLRKPDFLEGK

SEQ ID NO: 3196809 - protein, 26 aa, Giardia lamblia
SDYAHSIPMYVPLASHLNLPKPSNFI

SEQ ID NO: 3196810 - protein, 25 aa, Giardia lamblia
SDYGLYYIRPLFGKKNRYPSFLAPE

SEQ ID NO: 3196811 - protein, 21 aa, Giardia lamblia
SDYMLKLKEIKLKVKEAMLGG

SEQ ID NO: 3196812 - protein, 17 aa, Giardia lamblia
SDYWKVIDTIFSDELCF

SEQ ID NO: 3196813 - protein, 19 aa, Giardia lamblia
SEAFPRDLHAYILEEMNKL

SEQ ID NO: 3196814 - protein, 26 aa, Giardia lamblia
SEAHVPKVFAPFEPPHPYKLIPDSTE

SEQ ID NO: 3196815 - protein, 20 aa, Giardia lamblia
SEALAYLHSPTKRDSDGRLL

SEQ ID NO: 3196816 - protein, 24 aa, Giardia lamblia
SEAPPFPDLGPLSYFRQTQQPGIS

SEQ ID NO: 3196817 - protein, 33 aa, Giardia lamblia
SEATQDRILLFDSFFNVLVWTGSSVAAWRKAEY

SEQ ID NO: 3196818 - protein, 26 aa, Giardia lamblia
SEAYGYFAREFLRKRLAGHRIHLEIT

SEQ ID NO: 3196819 - protein, 25 aa, Giardia lamblia
SECEEDLLHYPQPPQTLHPVDSVRF

SEQ ID NO: 3196820 - protein, 24 aa, Giardia lamblia
SECKKLHMEPQRLSLETWIFQLEQ

SEQ ID NO: 3196821 - protein, 21 aa, Giardia lamblia
SECLLEDIGVQWRRYVSSLEV

SEQ ID NO: 3196822 - protein, 23 aa, Giardia lamblia
SECQDVMHFLLAAEELLLSGKSE

SEQ ID NO: 3196823 - protein, 17 aa, Giardia lamblia
SECSTVLQTSLKPLLDL

SEQ ID NO: 3196824 - protein, 23 aa, Giardia lamblia
SEDDIEFKLIKPTLGKFGTRSIS

SEQ ID NO: 3196825 - protein, 25 aa, Giardia lamblia
SEDDVSLYLLLGLDAEAIFDGDNLA

SEQ ID NO: 3196826 - protein, 24 aa, Giardia lamblia
SEDHNIWIYYPSVKGPLTEAGEKP

SEQ ID NO: 3196827 - protein, 23 aa, Giardia lamblia
SEDHTLFIYLRTTVSISQPVSRV

SEQ ID NO: 3196828 - protein, 26 aa, Giardia lamblia
SEDSYLANSSLLLALEKRVASEVADV

SEQ ID NO: 3196829 - protein, 28 aa, Giardia lamblia
SEEARCDILVALLWIFNTEGTKVMSDAD

SEQ ID NO: 3196830 - protein, 24 aa, Giardia lamblia
SEEFRLKIFTFISKVIEAVLPNTL

SEQ ID NO: 3196831 - protein, 26 aa, Giardia lamblia
SEEHFYFKALNRLSPYFSIKDCRYSI

SEQ ID NO: 3196832 - protein, 20 aa, Giardia lamblia
SEEIVRYLVKALAGKQTKTG

SEQ ID NO: 3196833 - protein, 24 aa, Giardia lamblia
SEELWASVLVPYMEKRGISCQLIE

SEQ ID NO: 3196834 - protein, 28 aa, Giardia lamblia
SEERVTHISIPCQLAALLELQEDHKKCD

SEQ ID NO: 3196835 - protein, 21 aa, Giardia lamblia
SEFDNVLFQRRFDNFNFVNLS

SEQ ID NO: 3196836 - protein, 20 aa, Giardia lamblia
SEFKTVIARLLPGVTETILP

SEQ ID NO: 3196837 - protein, 30 aa, Giardia lamblia
SEFLAGQALIYQWSLLGLPKDNFSAENGIL

SEQ ID NO: 3196838 - protein, 28 aa, Giardia lamblia
SEFRKKPGITPLPGFLPTSAESIRLALS

SEQ ID NO: 3196839 - protein, 25 aa, Giardia lamblia
SEGGVPLVQFLKRLQDPPTRTTTPR

SEQ ID NO: 3196840 - protein, 26 aa, Giardia lamblia
SEGKIKYNVFSPDLGFNLISKAGRAS

SEQ ID NO: 3196841 - protein, 17 aa, Giardia lamblia
SEGKMALMIAKEAGHKI

SEQ ID NO: 3196842 - protein, 18 aa, Giardia lamblia
SEGKMALMIAKEAGHKII

SEQ ID NO: 3196843 - protein, 31 aa, Giardia lamblia
SEGRTALMYACEAGHVACARLLLVEKEIRDN

SEQ ID NO: 3196844 - protein, 23 aa, Giardia lamblia
SEHAYIPYSKYKVGAAILTESGE

SEQ ID NO: 3196845 - protein, 23 aa, Giardia lamblia
SEHPLTDFIVFDKTIIAIDIHGS

SEQ ID NO: 3196846 - protein, 25 aa, Giardia lamblia
SEIENLRSEHLAFEKIHSGLVKDSE

SEQ ID NO: 3196847 - protein, 39 aa, Giardia lamblia
SEIGQISYHFLLITYNSIRFNIKPGYTLEQALRPKNCTP

SEQ ID NO: 3196848 - protein, 18 aa, Giardia lamblia
SEIGTLKKKLEEATTKQA

SEQ ID NO: 3196849 - protein, 23 aa, Giardia lamblia
SEIHIDLRLRILDSPGVVLNEGR

SEQ ID NO: 3196850 - protein, 27 aa, Giardia lamblia
SEIIGRIRFTSLSPYTAPIPEFGKYPP

SEQ ID NO: 3196851 - protein, 24 aa, Giardia lamblia
SEIPISRNMPILQKLKAMLSSRTD

SEQ ID NO: 3196852 - protein, 19 aa, Giardia lamblia
SEIPLTIYTGYPIVATAIS

SEQ ID NO: 3196853 - protein, 22 aa, Giardia lamblia
SEIQYRLHLGLRYKAKGDRTLD

SEQ ID NO: 3196854 - protein, 21 aa, Giardia lamblia
SEKDLLYQKIGCTPLMFAAGG

SEQ ID NO: 3196855 - protein, 38 aa, Giardia lamblia
SEKIPYHRFPMFVPWRINDTWYFVEKAVRLTNVIHFIV

SEQ ID NO: 3196856 - protein, 17 aa, Giardia lamblia
SEKLLELALLKYRSALQ

SEQ ID NO: 3196857 - protein, 26 aa, Giardia lamblia
SEKTALWKGVLLLPFINSSELISAAQ

SEQ ID NO: 3196858 - protein, 33 aa, Giardia lamblia
SEKYLRRRDAAIILIQACWRRYKAMCRADSIRV

SEQ ID NO: 3196859 - protein, 23 aa, Giardia lamblia
SELAALLEYLRMARVVVAQKGET

SEQ ID NO: 3196860 - protein, 26 aa, Giardia lamblia
SELASLIISLLAPLAGVRPKLSQLRK

SEQ ID NO: 3196861 - protein, 24 aa, Giardia lamblia
SELEELLRHNMQLQINLQSLEESV

SEQ ID NO: 3196862 - protein, 24 aa, Giardia lamblia
SELEKRIIKQLESELIKVKKQHEK

SEQ ID NO: 3196863 - protein, 20 aa, Giardia lamblia
SELFFGLLNRQLAEVCKVEV

SEQ ID NO: 3196864 - protein, 22 aa, Giardia lamblia
SELFYTRCFLARGLLPSKETPP

SEQ ID NO: 3196865 - protein, 21 aa, Giardia lamblia
SELLCGFFRFYGYQFDSTDSV

SEQ ID NO: 3196866 - protein, 28 aa, Giardia lamblia
SELLKRYTVLYYGSLPNLLTVHASQRKN

SEQ ID NO: 3196867 - protein, 24 aa, Giardia lamblia
SELRRKFRVLSHVIDQLKSEIQTK

SEQ ID NO: 3196868 - protein, 18 aa, Giardia lamblia
SELRSLLRRFDVNDFYMV

SEQ ID NO: 3196869 - protein, 27 aa, Giardia lamblia
SELTSDPPLLLNPLREQLNNLVKVELP

SEQ ID NO: 3196870 - protein, 27 aa, Giardia lamblia
SEMQSQIGHILLKNDPLLITSDEAAKV

SEQ ID NO: 3196871 - protein, 26 aa, Giardia lamblia
SENHDTCIFLLAQYLGSTRDIYGRTA

SEQ ID NO: 3196872 - protein, 32 aa, Giardia lamblia
SENLPQGCAASIPTSLRDLPDGPLAQEIRHEI

SEQ ID NO: 3196873 - protein, 22 aa, Giardia lamblia
SENPLMLQWDSGGSRFIVASGR

SEQ ID NO: 3196874 - protein, 26 aa, Giardia lamblia
SENPRARLIRFFQSLYSCLCHGARAA

SEQ ID NO: 3196875 - protein, 27 aa, Giardia lamblia
SENRRPIMFVVFVPEWRVPPAQYHLDL

SEQ ID NO: 3196876 - protein, 23 aa, Giardia lamblia
SEPLRALVSLVLDRNLELATYRG

SEQ ID NO: 3196877 - protein, 24 aa, Giardia lamblia
SEPLYPVPELFRRATKNLVTTYGI

SEQ ID NO: 3196878 - protein, 23 aa, Giardia lamblia
SEPRTSLDTLPIISNLLATKIVE

SEQ ID NO: 3196879 - protein, 25 aa, Giardia lamblia
SEPVAQDPYLIIRHAIRRADHRICM

SEQ ID NO: 3196880 - protein, 27 aa, Giardia lamblia
SEQGSICTELFLFSSERLSTLTLSSSE

SEQ ID NO: 3196881 - protein, 28 aa, Giardia lamblia
SEQKEQQQFLLIKEKLKDFQGALKIEQE

SEQ ID NO: 3196882 - protein, 19 aa, Giardia lamblia
SEQLEPFLSAYNFTKDNVD

SEQ ID NO: 3196883 - protein, 24 aa, Giardia lamblia
SEQLERYRIPSDDKAPTVIGHASG

SEQ ID NO: 3196884 - protein, 22 aa, Giardia lamblia
SEQLFPSYLFSNTSGAYKELFG

SEQ ID NO: 3196885 - protein, 23 aa, Giardia lamblia
SEQLIACSIIQKDLLRIINTLLL

SEQ ID NO: 3196886 - protein, 17 aa, Giardia lamblia
SEQPHILSLRAMISFVG

SEQ ID NO: 3196887 - protein, 24 aa, Giardia lamblia
SEQRALPIYPIKKQLIDSILHSPQ

SEQ ID NO: 3196888 - protein, 22 aa, Giardia lamblia
SEQRVRFLSRFPGSSLMTSPAF

SEQ ID NO: 3196889 - protein, 26 aa, Giardia lamblia
SEQSIWAILSQLAYALSYCHSKTRAQ

SEQ ID NO: 3196890 - protein, 24 aa, Giardia lamblia
SEREFQNFFVCILDVLLKVKYQRS

SEQ ID NO: 3196891 - protein, 18 aa, Giardia lamblia
SERESCIVTLQDDYTKLS

SEQ ID NO: 3196892 - protein, 25 aa, Giardia lamblia
SERHRRLYFPLSGRIDHEFLLLTKT

SEQ ID NO: 3196893 - protein, 22 aa, Giardia lamblia
SERMIKLNRWLAIGTPLEVVSQ

SEQ ID NO: 3196894 - protein, 25 aa, Giardia lamblia
SERRSFCIVELDKSCWPLDNRIWLT

SEQ ID NO: 3196895 - protein, 23 aa, Giardia lamblia
SESDMIRWNIARARAMVGAREAV

SEQ ID NO: 3196896 - protein, 18 aa, Giardia lamblia
SESGIYTTLLDLAKQRGS

SEQ ID NO: 3196897 - protein, 29 aa, Giardia lamblia
SESIESVIRLYRNYYLLGASDGVVHLVGL

SEQ ID NO: 3196898 - protein, 19 aa, Giardia lamblia
SESPLPRNSQIYIPPRPDD

SEQ ID NO: 3196899 - protein, 21 aa, Giardia lamblia
SESRMYVRGRFIYTPEETDIN

SEQ ID NO: 3196900 - protein, 24 aa, Giardia lamblia
SESVQLLLQNILAQIQVFAEKETA

SEQ ID NO: 3196901 - protein, 17 aa, Giardia lamblia
SETLARAEAILSPKRVI

SEQ ID NO: 3196902 - protein, 20 aa, Giardia lamblia
SETLLAYKAMRVPSDEQGQF

SEQ ID NO: 3196903 - protein, 17 aa, Giardia lamblia
SETSPIRMQFDSPIWFT

SEQ ID NO: 3196904 - protein, 19 aa, Giardia lamblia
SEVFAVGRYLGLPESILDA

SEQ ID NO: 3196905 - protein, 27 aa, Giardia lamblia
SEVGGTNYLKLMKRTRLLIDEASDVLS

SEQ ID NO: 3196906 - protein, 24 aa, Giardia lamblia
SEVINLRRMSHPHIIAYYSTIHDQ

SEQ ID NO: 3196907 - protein, 28 aa, Giardia lamblia
SEVQSLTFDPLLTRIFFTIAKCYKNYKI

SEQ ID NO: 3196908 - protein, 30 aa, Giardia lamblia
SEVRRAPCLGSCLLPPWSSADSLQPPDVKQ

SEQ ID NO: 3196909 - protein, 22 aa, Giardia lamblia
SEWSVVTQLRPLTDAEAAERDA

SEQ ID NO: 3196910 - protein, 18 aa, Giardia lamblia
SEYALAYGPNCFCRINKV

SEQ ID NO: 3196911 - protein, 26 aa, Giardia lamblia
SEYCDLYNCPLVKDRLLTISKRASSA

SEQ ID NO: 3196912 - protein, 24 aa, Giardia lamblia
SEYSQLPRFRMLVVSTICSDSGEV

SEQ ID NO: 3196913 - protein, 21 aa, Giardia lamblia
SEYTQWIRVLKVRTIGHLNNL

SEQ ID NO: 3196914 - protein, 19 aa, Giardia lamblia
SFAGIRSLRSGELPAKQLL

SEQ ID NO: 3196915 - protein, 27 aa, Giardia lamblia
SFALKRGYIYVPPQMQGSTAPKPIYAK

SEQ ID NO: 3196916 - protein, 35 aa, Giardia lamblia
SFANELVTIFFKFFSLFYYQLRDHSLVKHPINTEE

SEQ ID NO: 3196917 - protein, 25 aa, Giardia lamblia
SFCLNLIDGIYTNVTPLMRAVLNDK

SEQ ID NO: 3196918 - protein, 24 aa, Giardia lamblia
SFCTTRFMYLIYDAPELDPVRIDA

SEQ ID NO: 3196919 - protein, 21 aa, Giardia lamblia
SFDCNATMKGLYDTKTVIVMA

SEQ ID NO: 3196920 - protein, 23 aa, Giardia lamblia
SFDDLKLLYQQDADRFSAVAQSI

SEQ ID NO: 3196921 - protein, 18 aa, Giardia lamblia
SFDFVLPASLLSNTYVIA

SEQ ID NO: 3196922 - protein, 24 aa, Giardia lamblia
SFDRIHRGHLLLLAVAVACVEKGG

SEQ ID NO: 3196923 - protein, 35 aa, Giardia lamblia
SFDSIICILVKLLAPSIPVFLLFLGDNETVAPYMD

SEQ ID NO: 3196924 - protein, 27 aa, Giardia lamblia
SFDYATRLLYVFRANFHIVAICGSKSM

SEQ ID NO: 3196925 - protein, 19 aa, Giardia lamblia
SFDYKFDFYPGVKPKYPCF

SEQ ID NO: 3196926 - protein, 26 aa, Giardia lamblia
SFEESLVWRVLAQIAAKLYALHFPGE

SEQ ID NO: 3196927 - protein, 24 aa, Giardia lamblia
SFEEYPLIYGYDFRFSSLDGAKMA

SEQ ID NO: 3196928 - protein, 25 aa, Giardia lamblia
SFELARVMRLYNEAIRVFRTKLNEA

SEQ ID NO: 3196929 - protein, 33 aa, Giardia lamblia
SFEQHALYNITMLGHLLLEMALMRPLEKGTANS

SEQ ID NO: 3196930 - protein, 23 aa, Giardia lamblia
SFERTSCLLFPRVDSMALQEGLS

SEQ ID NO: 3196931 - protein, 18 aa, Giardia lamblia
SFFAELERDLHAYTSFYS

SEQ ID NO: 3196932 - protein, 19 aa, Giardia lamblia
SFFFGQCLGVFPPFAIIRA

SEQ ID NO: 3196933 - protein, 18 aa, Giardia lamblia
SFFMLTAHNSPFCSVYFL

SEQ ID NO: 3196934 - protein, 18 aa, Giardia lamblia
SFFQAFFSSSYDGDHLPT

SEQ ID NO: 3196935 - protein, 23 aa, Giardia lamblia
SFGCLVFSMIYGRPPFEAADIKT

SEQ ID NO: 3196936 - protein, 31 aa, Giardia lamblia
SFGFQQPFITLSSRFFLDAMTLLCPAQNAFL

SEQ ID NO: 3196937 - protein, 18 aa, Giardia lamblia
SFGSILRFVHRINRAIFA

SEQ ID NO: 3196938 - protein, 26 aa, Giardia lamblia
SFGTMYEPVFFFQIQIVRMKDGQRKF

SEQ ID NO: 3196939 - protein, 24 aa, Giardia lamblia
SFGTMYEPVFIFQIQIIRTREGQR

SEQ ID NO: 3196940 - protein, 18 aa, Giardia lamblia
SFKAHILLQAQLVRSSLQ

SEQ ID NO: 3196941 - protein, 19 aa, Giardia lamblia
SFLALIREFFAQRNSTAVF

SEQ ID NO: 3196942 - protein, 28 aa, Giardia lamblia
SFLASLKLLDLLAWNKYCVLSRSKGPII

SEQ ID NO: 3196943 - protein, 23 aa, Giardia lamblia
SFLEKLYLSMNKGSQFSSLSTFK

SEQ ID NO: 3196944 - protein, 18 aa, Giardia lamblia
SFLHLLRIVFSEPESSCI

SEQ ID NO: 3196945 - protein, 22 aa, Giardia lamblia
SFLHNRLWVINTATIGVPLGAI

SEQ ID NO: 3196946 - protein, 25 aa, Giardia lamblia
SFLQFQQLFRLPRCIDKILALENAN

SEQ ID NO: 3196947 - protein, 24 aa, Giardia lamblia
SFLQSSFYHFIKKEVEYCVVDCIS

SEQ ID NO: 3196948 - protein, 27 aa, Giardia lamblia
SFLVIFTCPTSIFYEPFRAETLKEPPM

SEQ ID NO: 3196949 - protein, 21 aa, Giardia lamblia
SFLYPNLQAVGHPMAYCPLTV

SEQ ID NO: 3196950 - protein, 30 aa, Giardia lamblia
SFMELTRPKFKSYQPLPSSSRRFSDGMPLA

SEQ ID NO: 3196951 - protein, 20 aa, Giardia lamblia
SFMLSPPLSPQRSPSPLPLS

SEQ ID NO: 3196952 - protein, 20 aa, Giardia lamblia
SFNNLLASDAFWSIKREGLN

SEQ ID NO: 3196953 - protein, 17 aa, Giardia lamblia
SFPALRDYYAPASEGWG

SEQ ID NO: 3196954 - protein, 17 aa, Giardia lamblia
SFPFASLSAAWKRIEDT

SEQ ID NO: 3196955 - protein, 17 aa, Giardia lamblia
SFPFSPYTKNAKGQGPA

SEQ ID NO: 3196956 - protein, 20 aa, Giardia lamblia
SFPKFRGKTLKRVLGALLDD

SEQ ID NO: 3196957 - protein, 35 aa, Giardia lamblia
SFPRVASHFVFRLKNFAFIYAMESASLHLSQLKVP

SEQ ID NO: 3196958 - protein, 19 aa, Giardia lamblia
SFRDTEVAAFYLMMRAFKL

SEQ ID NO: 3196959 - protein, 43 aa, Giardia lamblia
SFRSSPLTMALRPYLQPASDFSLPCNAVIFLNLHGKVDGFFSN

SEQ ID NO: 3196960 - protein, 25 aa, Giardia lamblia
SFSASLIPEGLFNTSVYPIFFNTRL

SEQ ID NO: 3196961 - protein, 25 aa, Giardia lamblia
SFSDIYRYLEGFIMVANWSTLHSGV

SEQ ID NO: 3196962 - protein, 38 aa, Giardia lamblia
SFSLEDRFLLVQLAPPEWPIIVWAIPPFINENASMHGD

SEQ ID NO: 3196963 - protein, 19 aa, Giardia lamblia
SFSLTICHENLFSDSAVGV

SEQ ID NO: 3196964 - protein, 18 aa, Giardia lamblia
SFSLTKKAIAECQQILVL

SEQ ID NO: 3196965 - protein, 25 aa, Giardia lamblia
SFSRRLSYTIYSLHKIGIIHKDIKV

SEQ ID NO: 3196966 - protein, 27 aa, Giardia lamblia
SFTIHRHGFVFPLPRRRFSVTLMQAGK

SEQ ID NO: 3196967 - protein, 24 aa, Giardia lamblia
SFTKGLPSVLPPSPATLGNQLYGI

SEQ ID NO: 3196968 - protein, 24 aa, Giardia lamblia
SFTKLHEKLLALLPGKILDIDNPY

SEQ ID NO: 3196969 - protein, 18 aa, Giardia lamblia
SFTNLRVTALMLAAARPN

SEQ ID NO: 3196970 - protein, 37 aa, Giardia lamblia
SFTRRTNVILSLKALGLLLYNFISFGASHQLSTDPLS

SEQ ID NO: 3196971 - protein, 17 aa, Giardia lamblia
SFTSCFSMVPFVIDLSM

SEQ ID NO: 3196972 - protein, 23 aa, Giardia lamblia
SFVGGFLVPKLLSPLLDRMLAAD

SEQ ID NO: 3196973 - protein, 17 aa, Giardia lamblia
SFVHVKRLIPATSLWDA

SEQ ID NO: 3196974 - protein, 19 aa, Giardia lamblia
SFVPCRIIFALVEASSPAE

SEQ ID NO: 3196975 - protein, 26 aa, Giardia lamblia
SFVQSLLPYEYAILGAAYTLSSLSQR

SEQ ID NO: 3196976 - protein, 28 aa, Giardia lamblia
SFYDRACPGLSLMFPKPLCIKDELPFFE

SEQ ID NO: 3196977 - protein, 20 aa, Giardia lamblia
SFYELSLELLSKPTLDLTAY

SEQ ID NO: 3196978 - protein, 27 aa, Giardia lamblia
SFYENNVMLLRCLRLLQTAINTLGAGT

SEQ ID NO: 3196979 - protein, 17 aa, Giardia lamblia
SFYHTHFTAICAHVPLL

SEQ ID NO: 3196980 - protein, 17 aa, Giardia lamblia
SFYIKHMPKLYDPSPGI

SEQ ID NO: 3196981 - protein, 25 aa, Giardia lamblia
SGAAQFYPQYPLPYAQHSQPIFSQR

SEQ ID NO: 3196982 - protein, 25 aa, Giardia lamblia
SGAINDILLLDVTPLSLGIETSGTN

SEQ ID NO: 3196983 - protein, 26 aa, Giardia lamblia
SGAMYAFPRLYLPKRFVEEAEAGKMA

SEQ ID NO: 3196984 - protein, 26 aa, Giardia lamblia
SGANTLLYAPSWIMEYCNIRPGDSVV

SEQ ID NO: 3196985 - protein, 30 aa, Giardia lamblia
SGASKAMRLPVYLSLLTPSGPFGTIFADAI

SEQ ID NO: 3196986 - protein, 31 aa, Giardia lamblia
SGAYTLPFYTHPTLVLCDNFVDLMNVVYAEQ

SEQ ID NO: 3196987 - protein, 23 aa, Giardia lamblia
SGCAKGMYFHLVSKVLFSEHVID

SEQ ID NO: 3196988 - protein, 24 aa, Giardia lamblia
SGCKAIVELLLEPLCRKQTKAGKT

SEQ ID NO: 3196989 - protein, 26 aa, Giardia lamblia
SGCLRCTLCDLAFKDSLALVQHLSSE

SEQ ID NO: 3196990 - protein, 25 aa, Giardia lamblia
SGCRGLLRFPVRTLCGHYYCYNCYM

SEQ ID NO: 3196991 - protein, 24 aa, Giardia lamblia
SGDAAILCIGFRPVTEMILESAER

SEQ ID NO: 3196992 - protein, 20 aa, Giardia lamblia
SGDFLLSPEDFLYASKVVGK

SEQ ID NO: 3196993 - protein, 22 aa, Giardia lamblia
SGDHGFMFICDGAVHNTDEAVP

SEQ ID NO: 3196994 - protein, 32 aa, Giardia lamblia
SGDIWALGCYLYELIFKKRPFTTGREIDLYLS

SEQ ID NO: 3196995 - protein, 23 aa, Giardia lamblia
SGDLFYMLRHVDCLHYLEFGRVA

SEQ ID NO: 3196996 - protein, 26 aa, Giardia lamblia
SGDLSDGMVLQPAYRQSLSKTQSARS

SEQ ID NO: 3196997 - protein, 19 aa, Giardia lamblia
SGDPYLYAESLFAARRYAE

SEQ ID NO: 3196998 - protein, 22 aa, Giardia lamblia
SGDRFHAIARELPFISQMALSG

SEQ ID NO: 3196999 - protein, 32 aa, Giardia lamblia
SGDTALMIAAHKGYFTIAKLLHNHEARLQNND

SEQ ID NO: 3197000 - protein, 23 aa, Giardia lamblia
SGEEIVVTPARVPQFRSFGHQDQ

SEQ ID NO: 3197001 - protein, 39 aa, Giardia lamblia
SGEKSIALLALVFCLHRYKTLPFLLLDEVDKNLDSRNVE

SEQ ID NO: 3197002 - protein, 23 aa, Giardia lamblia
SGEMFVSRYFIGVGKKAYLDILQ

SEQ ID NO: 3197003 - protein, 27 aa, Giardia lamblia
SGERPIVLILCELFNINPRSIASPEID

SEQ ID NO: 3197004 - protein, 26 aa, Giardia lamblia
SGESFQKILLILANVTRSMNPASQLT

SEQ ID NO: 3197005 - protein, 25 aa, Giardia lamblia
SGEVPPLILSAFFNAVTKVKNRQLL

SEQ ID NO: 3197006 - protein, 22 aa, Giardia lamblia
SGFGNFIVYCLPDPARSALLSE

SEQ ID NO: 3197007 - protein, 25 aa, Giardia lamblia
SGFLDVLYRHATLLEHTLELHKIVV

SEQ ID NO: 3197008 - protein, 24 aa, Giardia lamblia
SGGIRGALGYRDPMKRPSDGLGRV

SEQ ID NO: 3197009 - protein, 33 aa, Giardia lamblia
SGGKSRLPRPILTDDLSLAAHNPRPPLPSYLES

SEQ ID NO: 3197010 - protein, 20 aa, Giardia lamblia
SGGLTQFWASWLDLASTVQT

SEQ ID NO: 3197011 - protein, 25 aa, Giardia lamblia
SGGLYLFRNSILQIYLRLMMVSKKC

SEQ ID NO: 3197012 - protein, 18 aa, Giardia lamblia
SGGMLNVYVIRPGGWEHV

SEQ ID NO: 3197013 - protein, 37 aa, Giardia lamblia
SGGQRSLLALSLIFSLLLYKPCPLYILDEIDAALDLN

SEQ ID NO: 3197014 - protein, 25 aa, Giardia lamblia
SGHDPRYAEFLLYFSTDEAIEAYYS

SEQ ID NO: 3197015 - protein, 26 aa, Giardia lamblia
SGHKRLTRYLMPYPHTSEFVRRRAAS

SEQ ID NO: 3197016 - protein, 22 aa, Giardia lamblia
SGHLLNKLFNRCFWKIDDSLDM

SEQ ID NO: 3197017 - protein, 24 aa, Giardia lamblia
SGHYYVLECLPFKPRKKMFRFQGP

SEQ ID NO: 3197018 - protein, 27 aa, Giardia lamblia
SGIELHSRFFKLVSWYDNECGYSAKLV

SEQ ID NO: 3197019 - protein, 24 aa, Giardia lamblia
SGITMNDLALQQPALSAGSVVSSA

SEQ ID NO: 3197020 - protein, 21 aa, Giardia lamblia
SGITPYRYSNKAIWSNFVMAS

SEQ ID NO: 3197021 - protein, 22 aa, Giardia lamblia
SGITSLMLAASLGNLEICKLLA

SEQ ID NO: 3197022 - protein, 18 aa, Giardia lamblia
SGIVIGGWFTLSNTSYDG

SEQ ID NO: 3197023 - protein, 17 aa, Giardia lamblia
SGKANFIVLDAVSPPCL

SEQ ID NO: 3197024 - protein, 25 aa, Giardia lamblia
SGKELYDFIPKTYILPQSASIAVRD

SEQ ID NO: 3197025 - protein, 24 aa, Giardia lamblia
SGKRHQHFLSKKLKLSKKDDSDER

SEQ ID NO: 3197026 - protein, 24 aa, Giardia lamblia
SGKRSYTNPAWKDVPFPYPDGREM

SEQ ID NO: 3197027 - protein, 23 aa, Giardia lamblia
SGKTFSFLSPIIAQLISSRAKDA

SEQ ID NO: 3197028 - protein, 28 aa, Giardia lamblia
SGKTLAYLLPALHKAFTLVTNALKRPDQ

SEQ ID NO: 3197029 - protein, 25 aa, Giardia lamblia
SGKVQKLVMVLLPIGGSEPIEKWEF

SEQ ID NO: 3197030 - protein, 19 aa, Giardia lamblia
SGLAYLHMYARNTIPWAET

SEQ ID NO: 3197031 - protein, 24 aa, Giardia lamblia
SGLCNALLELGFLRVAYDVMTSTL

SEQ ID NO: 3197032 - protein, 33 aa, Giardia lamblia
SGLDLNAFLMNDLNPLTYGYLSPTSQSGSGGPS

SEQ ID NO: 3197033 - protein, 25 aa, Giardia lamblia
SGLDVDVLIFQWINAPSPRRQVKTG

SEQ ID NO: 3197034 - protein, 18 aa, Giardia lamblia
SGLFLQCASWSEAGLADA

SEQ ID NO: 3197035 - protein, 35 aa, Giardia lamblia
SGLIKLNPVKLLDYCQLFVYRVTPFDLGSSLRVIV

SEQ ID NO: 3197036 - protein, 20 aa, Giardia lamblia
SGLIYLLPEARMHAPSGWTA

SEQ ID NO: 3197037 - protein, 23 aa, Giardia lamblia
SGLLNFTISIYRFRKLESKDAHT

SEQ ID NO: 3197038 - protein, 17 aa, Giardia lamblia
SGLSLHDRLRLLSACVV

SEQ ID NO: 3197039 - protein, 28 aa, Giardia lamblia
SGMFDTMTSLFATMPLCCLINKEIFCTH

SEQ ID NO: 3197040 - protein, 24 aa, Giardia lamblia
SGMIDLNDFFRIMTAKMAERDSRE

SEQ ID NO: 3197041 - protein, 28 aa, Giardia lamblia
SGMTALNYLVLFPTYPDFDVIANKLAIH

SEQ ID NO: 3197042 - protein, 25 aa, Giardia lamblia
SGNIIKAWHFLNAQANILDVNGKTA

SEQ ID NO: 3197043 - protein, 33 aa, Giardia lamblia
SGNIWLVRMICSKPDKWYAALKAQTYEGKTALM

SEQ ID NO: 3197044 - protein, 20 aa, Giardia lamblia
SGNKSMIALLLPSQAGRVTT

SEQ ID NO: 3197045 - protein, 26 aa, Giardia lamblia
SGNLVHALYAFLSLYFGDHHISIVED

SEQ ID NO: 3197046 - protein, 23 aa, Giardia lamblia
SGNLWFTRLYLPMQAGKVTTAGE

SEQ ID NO: 3197047 - protein, 23 aa, Giardia lamblia
SGNMPHMLLYGPAGTGKTTLIHA

SEQ ID NO: 3197048 - protein, 36 aa, Giardia lamblia
SGNSHHIPIYNPAELFNTLLLTDSFRAFIESRSLDP

SEQ ID NO: 3197049 - protein, 22 aa, Giardia lamblia
SGPFRFLIEFRHKLDLPETYES

SEQ ID NO: 3197050 - protein, 20 aa, Giardia lamblia
SGPINYIEPRFLHTFKHMLN

SEQ ID NO: 3197051 - protein, 58 aa, Giardia lamblia
SGPLFTNDPILEMAMLVELYVQDLTLLGLFCQYITKYSYRVIYFSPELICKKGADASS

SEQ ID NO: 3197052 - protein, 25 aa, Giardia lamblia
SGPMWLHVTQIDWDFYKARTQAISA

SEQ ID NO: 3197053 - protein, 28 aa, Giardia lamblia
SGPYGLEAWLRPLLSQPIETFVIPMNLN

SEQ ID NO: 3197054 - protein, 22 aa, Giardia lamblia
SGQIPLAKPLVKLEAGLKNIDN

SEQ ID NO: 3197055 - protein, 18 aa, Giardia lamblia
SGQKISFAGSFMAMFGDK

SEQ ID NO: 3197056 - protein, 39 aa, Giardia lamblia
SGQPDYKLHYLRSKLDAFMLRHQVLKIFNVLGTLLEENN

SEQ ID NO: 3197057 - protein, 27 aa, Giardia lamblia
SGQTHSLEILLRSSLFGKQAILNTIQR

SEQ ID NO: 3197058 - protein, 17 aa, Giardia lamblia
SGRHSRPLLPHHSDGII

SEQ ID NO: 3197059 - protein, 23 aa, Giardia lamblia
SGRICAHMRIPLSTLTDSSRSLV

SEQ ID NO: 3197060 - protein, 18 aa, Giardia lamblia
SGRIILICDTGNNCIRCL

SEQ ID NO: 3197061 - protein, 28 aa, Giardia lamblia
SGRKEDLMIIKYLLSLEEENQRLRQKLT

SEQ ID NO: 3197062 - protein, 29 aa, Giardia lamblia
SGRLNHITPTLYLTLLSTFARVLQAQYNK

SEQ ID NO: 3197063 - protein, 33 aa, Giardia lamblia
SGRPVYVHLASISDWFFVSMDTGNLFIINDSGH

SEQ ID NO: 3197064 - protein, 27 aa, Giardia lamblia
SGRSLDISLLRLMHKLCPLIEDVIYEE

SEQ ID NO: 3197065 - protein, 25 aa, Giardia lamblia
SGRTTLVWRSWLARVTYDHEVEGSS

SEQ ID NO: 3197066 - protein, 33 aa, Giardia lamblia
SGRVQRLFITQDEIVLLLLSILKPQEADSAENL

SEQ ID NO: 3197067 - protein, 21 aa, Giardia lamblia
SGRVYQAAAPAIVISQSLLES

SEQ ID NO: 3197068 - protein, 23 aa, Giardia lamblia
SGSDWNIYWAPVAVVQKMFAIGS

SEQ ID NO: 3197069 - protein, 26 aa, Giardia lamblia
SGSFYTMNCPLFRFIEAVFNQNNYFV

SEQ ID NO: 3197070 - protein, 30 aa, Giardia lamblia
SGSLSLPQWIRLTSLCLLGRRLFTEWDVQV

SEQ ID NO: 3197071 - protein, 24 aa, Giardia lamblia
SGSSPMPRILRDCLIIQTDGVSEA

SEQ ID NO: 3197072 - protein, 32 aa, Giardia lamblia
SGSVHDPVLLAYSFSMQTIGPAVLDTGLQADN

SEQ ID NO: 3197073 - protein, 27 aa, Giardia lamblia
SGSVTGYPPALYWLSEDPTVECYNCYN

SEQ ID NO: 3197074 - protein, 17 aa, Giardia lamblia
SGSVYIWDVCRPDDPFA

SEQ ID NO: 3197075 - protein, 19 aa, Giardia lamblia
SGTFSFSFSKSMKSPRSFS

SEQ ID NO: 3197076 - protein, 30 aa, Giardia lamblia
SGTVTAQLLIILKTFALLLTVRSTPMNTND

SEQ ID NO: 3197077 - protein, 18 aa, Giardia lamblia
SGTWFNDLPHGKGEFQYN

SEQ ID NO: 3197078 - protein, 26 aa, Giardia lamblia
SGVAPSSIFLLIPLDPTVTVDQTETR

SEQ ID NO: 3197079 - protein, 24 aa, Giardia lamblia
SGVDLTCFLKYPEPREVSYNICTL

SEQ ID NO: 3197080 - protein, 24 aa, Giardia lamblia
SGVGRDVIMRKLGALLTDTPSDVP

SEQ ID NO: 3197081 - protein, 17 aa, Giardia lamblia
SGVRFIDFSPDSHFLAA

SEQ ID NO: 3197082 - protein, 31 aa, Giardia lamblia
SGVTTLIKYLTLSPLFQYIEPLSSAAGEPIL

SEQ ID NO: 3197083 - protein, 27 aa, Giardia lamblia
SGVVKLMNIFPLEHRMLYEKGDASFPG

SEQ ID NO: 3197084 - protein, 17 aa, Giardia lamblia
SGVYALSSSIDYLTCFY

SEQ ID NO: 3197085 - protein, 17 aa, Giardia lamblia
SGWAYVRARNSLYPECD

SEQ ID NO: 3197086 - protein, 23 aa, Giardia lamblia
SGWTAMIWAAQRCAYWCMKLLLP

SEQ ID NO: 3197087 - protein, 20 aa, Giardia lamblia
SGWTGLIYSAYLGDTDGVRE

SEQ ID NO: 3197088 - protein, 21 aa, Giardia lamblia
SGWTKLMYAASLGLTATAGAH

SEQ ID NO: 3197089 - protein, 17 aa, Giardia lamblia
SGWTVLMYASCIGDAEL

SEQ ID NO: 3197090 - protein, 20 aa, Giardia lamblia
SGYSLFTKQRLFDCKLRGVC

SEQ ID NO: 3197091 - protein, 27 aa, Giardia lamblia
SGYSPHISSLYLHRPQNVLPVTNYSDP

SEQ ID NO: 3197092 - protein, 22 aa, Giardia lamblia
SGYTALMFACRIGNLAAAKMLL

SEQ ID NO: 3197093 - protein, 26 aa, Giardia lamblia
SGYVPRLYSLNYPTLARDLPPELKPA

SEQ ID NO: 3197094 - protein, 19 aa, Giardia lamblia
SHALSWVQLDPVSKTQIFP

SEQ ID NO: 3197095 - protein, 19 aa, Giardia lamblia
SHASFRRKLPDESKRYFQV

SEQ ID NO: 3197096 - protein, 18 aa, Giardia lamblia
SHCIYLEGLRVIIDMNCC

SEQ ID NO: 3197097 - protein, 29 aa, Giardia lamblia
SHDQTSLLGVYFVGIWNIAINSWDVDGIQ

SEQ ID NO: 3197098 - protein, 19 aa, Giardia lamblia
SHEILLWPEMQTVATLVSG

SEQ ID NO: 3197099 - protein, 33 aa, Giardia lamblia
SHELIYNTLVSRTVFIHGWFAIKSEFVVTGSLV

SEQ ID NO: 3197100 - protein, 20 aa, Giardia lamblia
SHFDQRLFQESAEGTLPLST

SEQ ID NO: 3197101 - protein, 22 aa, Giardia lamblia
SHFKHGLIFPEAEIWNVVAHIA

SEQ ID NO: 3197102 - protein, 26 aa, Giardia lamblia
SHGARICLLIIIKDTGRFLVPLSSIT

SEQ ID NO: 3197103 - protein, 21 aa, Giardia lamblia
SHGIDLFTSVFTKGSFNTQEL

SEQ ID NO: 3197104 - protein, 34 aa, Giardia lamblia
SHGMTLLLMGAALNLPWLVQAILDSVPEALCDTD

SEQ ID NO: 3197105 - protein, 44 aa, Giardia lamblia
SHGTGFLLLVTLLYSKPRLLFVDVQLLTIYSLTTLPLHSGQMMS

SEQ ID NO: 3197106 - protein, 18 aa, Giardia lamblia
SHIFTIPINLVLDESEFC

SEQ ID NO: 3197107 - protein, 28 aa, Giardia lamblia
SHKGIVYNLTPYLRYHPAGIAPIEDYYG

SEQ ID NO: 3197108 - protein, 23 aa, Giardia lamblia
SHLCLIFVDEYVKLSLYKRVLQY

SEQ ID NO: 3197109 - protein, 18 aa, Giardia lamblia
SHLNIAPSNIYISDLYYV

SEQ ID NO: 3197110 - protein, 18 aa, Giardia lamblia
SHLPAYRLSPVTGVYESI

SEQ ID NO: 3197111 - protein, 20 aa, Giardia lamblia
SHLVKLHRMLRTPRGSMLLV

SEQ ID NO: 3197112 - protein, 26 aa, Giardia lamblia
SHNNIYSLDLIAPVLSLKSLESLDIR

SEQ ID NO: 3197113 - protein, 26 aa, Giardia lamblia
SHNNLRYMIDAYWKSREQIGEGTIIR

SEQ ID NO: 3197114 - protein, 22 aa, Giardia lamblia
SHNVLRSFADWPHARDGMGSAS

SEQ ID NO: 3197115 - protein, 22 aa, Giardia lamblia
SHQLVMEGMKFQFNNKLLTLWS

SEQ ID NO: 3197116 - protein, 19 aa, Giardia lamblia
SHQYLLKLSAKELGAFKTL

SEQ ID NO: 3197117 - protein, 32 aa, Giardia lamblia
SHSAPLSILQSLAYRTLQHGVLSTKPLRPHTT

SEQ ID NO: 3197118 - protein, 17 aa, Giardia lamblia
SHSLSMPTLLADNTQTS

SEQ ID NO: 3197119 - protein, 27 aa, Giardia lamblia
SHSPVAGPVPFYFTPHTAPQLAYSQPV

SEQ ID NO: 3197120 - protein, 24 aa, Giardia lamblia
SHSTRSWMPAEYSYTLASGRRLGP

SEQ ID NO: 3197121 - protein, 26 aa, Giardia lamblia
SHTGRIVFIQWFNMNQLLGIITAGTD

SEQ ID NO: 3197122 - protein, 24 aa, Giardia lamblia
SHTKKLYPGAFDLSASGFVRAGER

SEQ ID NO: 3197123 - protein, 23 aa, Giardia lamblia
SHTYVITSCILPCLLESELFYKH

SEQ ID NO: 3197124 - protein, 17 aa, Giardia lamblia
SHYNIHRPESLLVQIEM

SEQ ID NO: 3197125 - protein, 28 aa, Giardia lamblia
SHYNPNAEPLFYPSIKADPRHPSASFLA

SEQ ID NO: 3197126 - protein, 25 aa, Giardia lamblia
SHYTHLVFRWCLINEDFAHYVGSIR

SEQ ID NO: 3197127 - protein, 17 aa, Giardia lamblia
SIAALENNFELCKLLAI

SEQ ID NO: 3197128 - protein, 20 aa, Giardia lamblia
SIAEYRRLFGLPPCSEEGFA

SEQ ID NO: 3197129 - protein, 19 aa, Giardia lamblia
SIAGLRQSFLMGKQIRRMF

SEQ ID NO: 3197130 - protein, 26 aa, Giardia lamblia
SIAHYSIYKYQLVSLPFCSLRSNDGD

SEQ ID NO: 3197131 - protein, 24 aa, Giardia lamblia
SIALLLREHEAPSWTPLMCASFTG

SEQ ID NO: 3197132 - protein, 17 aa, Giardia lamblia
SIALTRRSSGYGKFGGA

SEQ ID NO: 3197133 - protein, 18 aa, Giardia lamblia
SIAPPRFTPLVNLIAHQG

SEQ ID NO: 3197134 - protein, 18 aa, Giardia lamblia
SIARTAGNLPPWHQHYRA

SEQ ID NO: 3197135 - protein, 24 aa, Giardia lamblia
SIASMLYPVIYNITTYLTSFVPEI

SEQ ID NO: 3197136 - protein, 19 aa, Giardia lamblia
SIASRYRTILYSSIDATPQ

SEQ ID NO: 3197137 - protein, 23 aa, Giardia lamblia
SIATGFLEVLRIFADLKDDTMFP

SEQ ID NO: 3197138 - protein, 21 aa, Giardia lamblia
SIAYWAYRNKIPIFCPAITDG

SEQ ID NO: 3197139 - protein, 23 aa, Giardia lamblia
SICDLIFDVPLFKTIHRDDLKAT

SEQ ID NO: 3197140 - protein, 19 aa, Giardia lamblia
SICGTIWWRAPEQSFRKNV

SEQ ID NO: 3197141 - protein, 31 aa, Giardia lamblia
SICKQMLSEYSILKSNLLTLGLESSIISQNF

SEQ ID NO: 3197142 - protein, 30 aa, Giardia lamblia
SIDASNCLRLLFLLYKFSKHKLEKPDAHLY

SEQ ID NO: 3197143 - protein, 27 aa, Giardia lamblia
SIDDKLEYAIFLATEPIREDILEYLKQ

SEQ ID NO: 3197144 - protein, 20 aa, Giardia lamblia
SIDIDGVLIKGIWGQSGSLV

SEQ ID NO: 3197145 - protein, 21 aa, Giardia lamblia
SIDILKKYYRDDLTKEDWVCV

SEQ ID NO: 3197146 - protein, 19 aa, Giardia lamblia
SIDIYRIGSAISPQLGILM

SEQ ID NO: 3197147 - protein, 20 aa, Giardia lamblia
SIDLLGLRTSGQKRYVMPSQ

SEQ ID NO: 3197148 - protein, 18 aa, Giardia lamblia
SIDMSLPLTISRFTPSQE

SEQ ID NO: 3197149 - protein, 23 aa, Giardia lamblia
SIDPAMAFSRTLVAKARGVLQAA

SEQ ID NO: 3197150 - protein, 28 aa, Giardia lamblia
SIDRRCIFFSLALGQLLLKCEVRLAPRR

SEQ ID NO: 3197151 - protein, 24 aa, Giardia lamblia
SIDRRRICNFIKQLPAAAKQDSTH

SEQ ID NO: 3197152 - protein, 26 aa, Giardia lamblia
SIEDVTFIPMIFPSVTMLKIVDCQID

SEQ ID NO: 3197153 - protein, 18 aa, Giardia lamblia
SIEFTDSWIRRQASKEAS

SEQ ID NO: 3197154 - protein, 19 aa, Giardia lamblia
SIEHFLSYYTGDMAPIITH

SEQ ID NO: 3197155 - protein, 25 aa, Giardia lamblia
SIEHSVLRFPPLIKLAGCAHMTTAA

SEQ ID NO: 3197156 - protein, 20 aa, Giardia lamblia
SIELVRLLLDSGHVKFREIC

SEQ ID NO: 3197157 - protein, 18 aa, Giardia lamblia
SIFNSQFENALQSNDMDA

SEQ ID NO: 3197158 - protein, 21 aa, Giardia lamblia
SIFPHLTHPHIATYYLQTYDA

SEQ ID NO: 3197159 - protein, 24 aa, Giardia lamblia
SIFRRVQHFYPLLVYALQQEVADP

SEQ ID NO: 3197160 - protein, 19 aa, Giardia lamblia
SIGEKFLCVELDYGNIKHF

SEQ ID NO: 3197161 - protein, 19 aa, Giardia lamblia
SIGNFLLALSINVLERTPI

SEQ ID NO: 3197162 - protein, 30 aa, Giardia lamblia
SIGRTPIYAPFDECSIVPAVPIDAASKSRK

SEQ ID NO: 3197163 - protein, 25 aa, Giardia lamblia
SIHDLIGCNAIINSWILLYKQACDN

SEQ ID NO: 3197164 - protein, 20 aa, Giardia lamblia
SIHFYICPKLAEVWAMSFVP

SEQ ID NO: 3197165 - protein, 20 aa, Giardia lamblia
SIHGHGLFALVYIPRGKNVI

SEQ ID NO: 3197166 - protein, 17 aa, Giardia lamblia
SIHIWDTSKRGKLQDIA

SEQ ID NO: 3197167 - protein, 20 aa, Giardia lamblia
SIHKSFLFVQAGTKLFIHRL

SEQ ID NO: 3197168 - protein, 25 aa, Giardia lamblia
SIHLKVRFIKINALGAGFFVNKLKI

SEQ ID NO: 3197169 - protein, 27 aa, Giardia lamblia
SIHRQMNYQLFLRSYQYFYGLDDEEID

SEQ ID NO: 3197170 - protein, 19 aa, Giardia lamblia
SIHTLIKKLRDVSVLPDIV

SEQ ID NO: 3197171 - protein, 20 aa, Giardia lamblia
SIIPSKVLAVIAYPLLTVIE

SEQ ID NO: 3197172 - protein, 17 aa, Giardia lamblia
SIIPVQLVLLSPCLHMI

SEQ ID NO: 3197173 - protein, 24 aa, Giardia lamblia
SIISLLGYYKQEHLLRVGRLVSSD

SEQ ID NO: 3197174 - protein, 38 aa, Giardia lamblia
SIIYDYQTMFPGPRYIQYNPFILYIDEQLDTQLHALMG

SEQ ID NO: 3197175 - protein, 24 aa, Giardia lamblia
SIKCLRTWIQPFKPATPEFESPCP

SEQ ID NO: 3197176 - protein, 21 aa, Giardia lamblia
SIKCYSVGYLGIAYNVFRKRF

SEQ ID NO: 3197177 - protein, 18 aa, Giardia lamblia
SIKIWHVDSPTALLTLKS

SEQ ID NO: 3197178 - protein, 24 aa, Giardia lamblia
SIKLPVKAPDLVRPSVRPALVVDT

SEQ ID NO: 3197179 - protein, 25 aa, Giardia lamblia
SIKQELKMFILPQIRELLAENPVVL

SEQ ID NO: 3197180 - protein, 25 aa, Giardia lamblia
SIKQKNIYLIDLLKCIMDGTFDDSM

SEQ ID NO: 3197181 - protein, 27 aa, Giardia lamblia
SIKSDIWALGLTILELCTRNRTFVGEP

SEQ ID NO: 3197182 - protein, 19 aa, Giardia lamblia
SILAITMGSILWVSLARDT

SEQ ID NO: 3197183 - protein, 27 aa, Giardia lamblia
SILASLNHPFLMRLYGAFQTPTRLIMV

SEQ ID NO: 3197184 - protein, 36 aa, Giardia lamblia
SILDKLVEDNIIDRTLHSIFLSKYKKAVDVLTQSLQ

SEQ ID NO: 3197185 - protein, 18 aa, Giardia lamblia
SILLLDMQPLPTAESAFE

SEQ ID NO: 3197186 - protein, 25 aa, Giardia lamblia
SILMIQKICLIQAFTRGYLVHRRYC

SEQ ID NO: 3197187 - protein, 17 aa, Giardia lamblia
SILRYAKICVRPVIIVL

SEQ ID NO: 3197188 - protein, 17 aa, Giardia lamblia
SILSDYPPKRPSKTLED

SEQ ID NO: 3197189 - protein, 17 aa, Giardia lamblia
SILSNLFDGLSAPSGSQ

SEQ ID NO: 3197190 - protein, 19 aa, Giardia lamblia
SIMSKRHLQWFVEEGLVEG

SEQ ID NO: 3197191 - protein, 24 aa, Giardia lamblia
SINHSFTLRYLKTLALKLQREPTL

SEQ ID NO: 3197192 - protein, 21 aa, Giardia lamblia
SINMKAFAKPYNIPRGTIIYM

SEQ ID NO: 3197193 - protein, 21 aa, Giardia lamblia
SINMLTLYNYMQTPNAQLALT

SEQ ID NO: 3197194 - protein, 19 aa, Giardia lamblia
SINNGLSPSFRNLLEMNSA

SEQ ID NO: 3197195 - protein, 17 aa, Giardia lamblia
SINPLVLGVVLPGEQNY

SEQ ID NO: 3197196 - protein, 28 aa, Giardia lamblia
SINYADLKRLFWISCGQLGLIPNLGMEN

SEQ ID NO: 3197197 - protein, 17 aa, Giardia lamblia
SIPAWKPGRHHSRSNFQ

SEQ ID NO: 3197198 - protein, 27 aa, Giardia lamblia
SIPDNFEIIFLFSVEALRYKNRGPLCI

SEQ ID NO: 3197199 - protein, 24 aa, Giardia lamblia
SIPDSLMILVEKMDQLPPSCFQPH

SEQ ID NO: 3197200 - protein, 25 aa, Giardia lamblia
SIPEKIPRFHILLTTPQMAVKHEDD

SEQ ID NO: 3197201 - protein, 37 aa, Giardia lamblia
SIPLIMIAPNPMILEIIRLLVLYTPALLENSNELKII

SEQ ID NO: 3197202 - protein, 19 aa, Giardia lamblia
SIPSLFILDEPFLPQDASD

SEQ ID NO: 3197203 - protein, 23 aa, Giardia lamblia
SIPSMALKALPIDVLYQCLYHVD

SEQ ID NO: 3197204 - protein, 21 aa, Giardia lamblia
SIPTRGLLSPHNTSLPIQHGK

SEQ ID NO: 3197205 - protein, 23 aa, Giardia lamblia
SIPVLSHVPFISDLLRPKPIKQA

SEQ ID NO: 3197206 - protein, 28 aa, Giardia lamblia
SIPVPSLRRLFYYSDYLSLYFSMPQGQE

SEQ ID NO: 3197207 - protein, 19 aa, Giardia lamblia
SIPVYHDLSICYLPVRAEN

SEQ ID NO: 3197208 - protein, 24 aa, Giardia lamblia
SIPYHKFYYAHRLSRLLLHIISTG

SEQ ID NO: 3197209 - protein, 25 aa, Giardia lamblia
SIQNHAIRRFIATSKPSLSGSPRPA

SEQ ID NO: 3197210 - protein, 19 aa, Giardia lamblia
SIQSIALSLTLAECQILRS

SEQ ID NO: 3197211 - protein, 28 aa, Giardia lamblia
SIQYASRKVAFQLPKLLGIEAYLKRNTR

SEQ ID NO: 3197212 - protein, 17 aa, Giardia lamblia
SIRIKFSPQRGGKPSHF

SEQ ID NO: 3197213 - protein, 18 aa, Giardia lamblia
SIRKYGAAGLPGWTPQMS

SEQ ID NO: 3197214 - protein, 25 aa, Giardia lamblia
SIRLALSLSLHGMPHDRVFGVYKEG

SEQ ID NO: 3197215 - protein, 23 aa, Giardia lamblia
SIRPLWRHYYQNTDALIYVIDSA

SEQ ID NO: 3197216 - protein, 29 aa, Giardia lamblia
SISDASVFQFLHRLLPDATDHQIRLVMEH

SEQ ID NO: 3197217 - protein, 19 aa, Giardia lamblia
SISDSWICLPKLRQLELGH

SEQ ID NO: 3197218 - protein, 28 aa, Giardia lamblia
SISKAADKLLLRTLTRSSNNPRTQRSSG

SEQ ID NO: 3197219 - protein, 19 aa, Giardia lamblia
SISLDTIPLGSIASTTKSA

SEQ ID NO: 3197220 - protein, 17 aa, Giardia lamblia
SISLHEGAKSFRLDSCD

SEQ ID NO: 3197221 - protein, 19 aa, Giardia lamblia
SISPAFLQFMETNFNGFLS

SEQ ID NO: 3197222 - protein, 24 aa, Giardia lamblia
SISRICSMILPAASTQFLRAAALV

SEQ ID NO: 3197223 - protein, 30 aa, Giardia lamblia
SISSLAQQLPYQIPLVAPQSNLRITIPSVS

SEQ ID NO: 3197224 - protein, 26 aa, Giardia lamblia
SISSPDDLILYLLMDYYPETIHSIYR

SEQ ID NO: 3197225 - protein, 25 aa, Giardia lamblia
SISTDGRVLWWDARNFSKYTQEPVE

SEQ ID NO: 3197226 - protein, 54 aa, Giardia lamblia
SISVDKLPIYLYSPVIYTCIFILQHQIHVLKLRLLRTIYLLDGGPKRERRRPTD

SEQ ID NO: 3197227 - protein, 24 aa, Giardia lamblia
SISVSFFEGLLNEPTHSDGISLTT

SEQ ID NO: 3197228 - protein, 29 aa, Giardia lamblia
SITDFGSPLLVDLFGYRLIMGSTVEQDVK

SEQ ID NO: 3197229 - protein, 21 aa, Giardia lamblia
SITQIPLITLPNDDITHIIAD

SEQ ID NO: 3197230 - protein, 28 aa, Giardia lamblia
SITVPFVKCIYMFKKELKARRLTTIPRC

SEQ ID NO: 3197231 - protein, 23 aa, Giardia lamblia
SITYDAILNLLPLEVQCEDRIGY

SEQ ID NO: 3197232 - protein, 20 aa, Giardia lamblia
SITYNAPRCLRFLLENEYME

SEQ ID NO: 3197233 - protein, 19 aa, Giardia lamblia
SIVAFVYSPLELSVDKEDM

SEQ ID NO: 3197234 - protein, 19 aa, Giardia lamblia
SIVALTWLSSSANVIVAAT

SEQ ID NO: 3197235 - protein, 20 aa, Giardia lamblia
SIVDIVKDFPGRNVDLSMLS

SEQ ID NO: 3197236 - protein, 24 aa, Giardia lamblia
SIVDPKDVFPLSPAGTGRLSKDLS

SEQ ID NO: 3197237 - protein, 29 aa, Giardia lamblia
SIVLTYQPYWRLHKLRRLIVTTEALGKKC

SEQ ID NO: 3197238 - protein, 20 aa, Giardia lamblia
SIVQIWPITLSESVTFTLVA

SEQ ID NO: 3197239 - protein, 29 aa, Giardia lamblia
SIYCISFCLCPQYPLLAAGLDNGACLILS

SEQ ID NO: 3197240 - protein, 26 aa, Giardia lamblia
SIYESLDLAWKCLRVLPINLLSRISD

SEQ ID NO: 3197241 - protein, 18 aa, Giardia lamblia
SIYFLDAYNVPADMMKRF

SEQ ID NO: 3197242 - protein, 20 aa, Giardia lamblia
SIYKKLSRVSIDRLALERES

SEQ ID NO: 3197243 - protein, 17 aa, Giardia lamblia
SIYKLIMNSCYGKSILK

SEQ ID NO: 3197244 - protein, 28 aa, Giardia lamblia
SIYLSDRVCPMLPPLFSNIICSLNPAVP

SEQ ID NO: 3197245 - protein, 21 aa, Giardia lamblia
SIYLTCYRQPLFSIAVSVLDG

SEQ ID NO: 3197246 - protein, 23 aa, Giardia lamblia
SIYQSEWYRLVRDNTLYAPGIAE

SEQ ID NO: 3197247 - protein, 26 aa, Giardia lamblia
SKAAKSLCMWCRAIDIYAKVFAEIEP

SEQ ID NO: 3197248 - protein, 24 aa, Giardia lamblia
SKAIDSMLRLLSESWMERNINREC

SEQ ID NO: 3197249 - protein, 25 aa, Giardia lamblia
SKARDDYLMGLMLDAEKRLSQREHD

SEQ ID NO: 3197250 - protein, 30 aa, Giardia lamblia
SKDDKLTLFLEAILAKQITWGDLKAVFEHA

SEQ ID NO: 3197251 - protein, 26 aa, Giardia lamblia
SKDFESLVLMLYKPRAQLLCELIRGA

SEQ ID NO: 3197252 - protein, 27 aa, Giardia lamblia
SKDGANLIPERPLLNTVGNLNSTRLHT

SEQ ID NO: 3197253 - protein, 29 aa, Giardia lamblia
SKDGSLLPIIDALKDCWLLELAKQDRVSI

SEQ ID NO: 3197254 - protein, 26 aa, Giardia lamblia
SKDISELFKLSIHYKIKLAPGQSRND

SEQ ID NO: 3197255 - protein, 24 aa, Giardia lamblia
SKDPHIWANLTYVFVSLSNLEAAL

SEQ ID NO: 3197256 - protein, 18 aa, Giardia lamblia
SKEFIAWLQTVNPSLRPF

SEQ ID NO: 3197257 - protein, 34 aa, Giardia lamblia
SKELATLLLIEGGIYRKDGWSALMSAARAGLPDI

SEQ ID NO: 3197258 - protein, 22 aa, Giardia lamblia
SKEVFELLVSFMGIRPCTGIHK

SEQ ID NO: 3197259 - protein, 22 aa, Giardia lamblia
SKFLTKFLHFKQNIGKLEALLN

SEQ ID NO: 3197260 - protein, 20 aa, Giardia lamblia
SKFWLVMDYHANGELLKHMK

SEQ ID NO: 3197261 - protein, 24 aa, Giardia lamblia
SKGETALMLALLIEDTTAVELLAP

SEQ ID NO: 3197262 - protein, 18 aa, Giardia lamblia
SKGQLPLMVSLIEKMDAV

SEQ ID NO: 3197263 - protein, 24 aa, Giardia lamblia
SKGRFCALSWRSPVTGAALCRCSQ

SEQ ID NO: 3197264 - protein, 24 aa, Giardia lamblia
SKGSPLVNVFTYIIRDTQLVVSSS

SEQ ID NO: 3197265 - protein, 29 aa, Giardia lamblia
SKGSRKAPFLRYILFKYKQRDLAIPDTPR

SEQ ID NO: 3197266 - protein, 25 aa, Giardia lamblia
SKGYGFYVAQNWPLVHQIISETSSA

SEQ ID NO: 3197267 - protein, 26 aa, Giardia lamblia
SKGYRNILNLLPFEYMPDIQISGHIH

SEQ ID NO: 3197268 - protein, 26 aa, Giardia lamblia
SKHGKHFIIIPNLFATPRKIVERYDL

SEQ ID NO: 3197269 - protein, 17 aa, Giardia lamblia
SKHIPLTMYQQLRQDQP

SEQ ID NO: 3197270 - protein, 25 aa, Giardia lamblia
SKHQNVYQIPLFAAKLYNPKDIYAR

SEQ ID NO: 3197271 - protein, 36 aa, Giardia lamblia
SKIFTTYLAGHVFFRSKYLYLLYVAGTQRPGSLAGN

SEQ ID NO: 3197272 - protein, 27 aa, Giardia lamblia
SKIKDFLRRMCYLVEGIIAGSALFPMQ

SEQ ID NO: 3197273 - protein, 26 aa, Giardia lamblia
SKILAAFPTLYLAHLSRFCFKDNDPL

SEQ ID NO: 3197274 - protein, 21 aa, Giardia lamblia
SKIPILEPHSFVGTTLVSPEK

SEQ ID NO: 3197275 - protein, 24 aa, Giardia lamblia
SKKDKILTFLTNYKEHTYAARNDI

SEQ ID NO: 3197276 - protein, 26 aa, Giardia lamblia
SKKMESIVFPNRLYYRPSAFPTVVNE

SEQ ID NO: 3197277 - protein, 23 aa, Giardia lamblia
SKKNMELPICLVPFIEAAACNKI

SEQ ID NO: 3197278 - protein, 22 aa, Giardia lamblia
SKKSRGRMPVFTALSVEDEVQE

SEQ ID NO: 3197279 - protein, 22 aa, Giardia lamblia
SKKVRRFYPHKDPYFLSLRGTV

SEQ ID NO: 3197280 - protein, 26 aa, Giardia lamblia
SKLEASPLTRGWFHYGLKGDSMLQRF

SEQ ID NO: 3197281 - protein, 26 aa, Giardia lamblia
SKLFCRTGVYLIKLANRKTLRDFIIT

SEQ ID NO: 3197282 - protein, 20 aa, Giardia lamblia
SKLGAIIRKAIQRTDDVLRQ

SEQ ID NO: 3197283 - protein, 20 aa, Giardia lamblia
SKLKRIFRRITITMADTIRY

SEQ ID NO: 3197284 - protein, 22 aa, Giardia lamblia
SKLRRTIFVFQADGVLFSSIEV

SEQ ID NO: 3197285 - protein, 19 aa, Giardia lamblia
SKLRVIKHLFRSAGLNVDN

SEQ ID NO: 3197286 - protein, 23 aa, Giardia lamblia
SKLSVSHLVSTKPALRPGTGSIS

SEQ ID NO: 3197287 - protein, 19 aa, Giardia lamblia
SKMLSAYISGTNALIFVYD

SEQ ID NO: 3197288 - protein, 18 aa, Giardia lamblia
SKMMAQVVIENRHLRQVM

SEQ ID NO: 3197289 - protein, 24 aa, Giardia lamblia
SKNFQVWPHRYALMQILPEEDRKS

SEQ ID NO: 3197290 - protein, 25 aa, Giardia lamblia
SKNNALHLLLWQAGLAKHDGMTALM

SEQ ID NO: 3197291 - protein, 26 aa, Giardia lamblia
SKNYKKIESLLPLYDDWRAANGNTGL

SEQ ID NO: 3197292 - protein, 25 aa, Giardia lamblia
SKPARICVEVARLPKDALVEIDAIA

SEQ ID NO: 3197293 - protein, 18 aa, Giardia lamblia
SKPSDFYSMGLPSSLTKS

SEQ ID NO: 3197294 - protein, 25 aa, Giardia lamblia
SKPVKPLTAFFIYFKEQSVGMTEKS

SEQ ID NO: 3197295 - protein, 45 aa, Giardia lamblia
SKQESSFPRGLFLRRLRTLLIGRINLPLHWINASIQYELTRWNDF

SEQ ID NO: 3197296 - protein, 32 aa, Giardia lamblia
SKQFKADVWAMGALLLCLCLGRPLNHRDDCVH

SEQ ID NO: 3197297 - protein, 19 aa, Giardia lamblia
SKQKDKIFFALAHASLLGP

SEQ ID NO: 3197298 - protein, 32 aa, Giardia lamblia
SKQWAGRLCHLSLLKGLISLARPLAFSSMEYS

SEQ ID NO: 3197299 - protein, 18 aa, Giardia lamblia
SKRDAFIEPERILRLVQL

SEQ ID NO: 3197300 - protein, 17 aa, Giardia lamblia
SKRDLGFSLAQEKPSRT

SEQ ID NO: 3197301 - protein, 21 aa, Giardia lamblia
SKRFILHLPRNTTTRSIYSVG

SEQ ID NO: 3197302 - protein, 18 aa, Giardia lamblia
SKRNVAIIPSKRLRNKVA

SEQ ID NO: 3197303 - protein, 25 aa, Giardia lamblia
SKRPRTFAFLVHAASVLCLVGPGIK

SEQ ID NO: 3197304 - protein, 25 aa, Giardia lamblia
SKRTRIRIGDIYWNALMSIRDSSTS

SEQ ID NO: 3197305 - protein, 23 aa, Giardia lamblia
SKSATAFLYTGLHPESGPPQLID

SEQ ID NO: 3197306 - protein, 24 aa, Giardia lamblia
SKSCCYKYRLTSEQLDRILATIEE

SEQ ID NO: 3197307 - protein, 26 aa, Giardia lamblia
SKSGAHIPFRGSKLTMVLRDSFIGNS

SEQ ID NO: 3197308 - protein, 28 aa, Giardia lamblia
SKSGNIRALWREAKRDYHQLRRFHMLII

SEQ ID NO: 3197309 - protein, 27 aa, Giardia lamblia
SKSPLYKFPVLFLSTAVVMNIAKSALL

SEQ ID NO: 3197310 - protein, 23 aa, Giardia lamblia
SKSSLPFLSVAADSGYILTRRIC

SEQ ID NO: 3197311 - protein, 25 aa, Giardia lamblia
SKSVTQPPPSINQPSLHPSAAPTEQ

SEQ ID NO: 3197312 - protein, 22 aa, Giardia lamblia
SKTFRSIVDFLVRAFQSYKDEY

SEQ ID NO: 3197313 - protein, 24 aa, Giardia lamblia
SKTKFTPLYHFFGYEGRCAAPSDF

SEQ ID NO: 3197314 - protein, 24 aa, Giardia lamblia
SKTLEVHILATFPEDFYGATLYTT

SEQ ID NO: 3197315 - protein, 31 aa, Giardia lamblia
SKTPLTPVELWRLLSPVISALAYLHGSYKTE

SEQ ID NO: 3197316 - protein, 27 aa, Giardia lamblia
SKTPSPSGLLPFKFSMITISDSYVDIQ

SEQ ID NO: 3197317 - protein, 42 aa, Giardia lamblia
SKTRDRKLIRQVWALEKFGLRLSGMRRMYGLAMTLGKEEAVR

SEQ ID NO: 3197318 - protein, 25 aa, Giardia lamblia
SKTTPQESVLLPGYKTPRVNETSQP

SEQ ID NO: 3197319 - protein, 23 aa, Giardia lamblia
SKVNLHIVLAFSPSGEVFRRRLR

SEQ ID NO: 3197320 - protein, 23 aa, Giardia lamblia
SKVSGLGRLCLSREETKGAVIDE

SEQ ID NO: 3197321 - protein, 26 aa, Giardia lamblia
SKWEVNPIALFIDLLERVLAGDAEGG

SEQ ID NO: 3197322 - protein, 25 aa, Giardia lamblia
SKYDTQLLTIPLNSVLRPLEVAIPS

SEQ ID NO: 3197323 - protein, 29 aa, Giardia lamblia
SKYEEGMPVYFQLFATYSLISVKALAILH

SEQ ID NO: 3197324 - protein, 25 aa, Giardia lamblia
SKYGDLYRNLIYLREQYELLRKSDE

SEQ ID NO: 3197325 - protein, 18 aa, Giardia lamblia
SKYMNILDFVKKAPKQST

SEQ ID NO: 3197326 - protein, 30 aa, Giardia lamblia
SKYVFIHTRVCPQWPFVTLDKSYVATFFSA

SEQ ID NO: 3197327 - protein, 21 aa, Giardia lamblia
SLADIAILVVDLMHGLERQTI

SEQ ID NO: 3197328 - protein, 28 aa, Giardia lamblia
SLADIWSLGLVLYFLLQGEVLLTNDNVS

SEQ ID NO: 3197329 - protein, 25 aa, Giardia lamblia
SLADSIVFYLPRGHIQLLMTLVWSM

SEQ ID NO: 3197330 - protein, 18 aa, Giardia lamblia
SLAILPRIESFTLEFLSA

SEQ ID NO: 3197331 - protein, 17 aa, Giardia lamblia
SLAIMLGYNPYLQHNQS

SEQ ID NO: 3197332 - protein, 19 aa, Giardia lamblia
SLALADIWHHVRAEVRSLA

SEQ ID NO: 3197333 - protein, 20 aa, Giardia lamblia
SLALRKLRKSYGALLISMPE

SEQ ID NO: 3197334 - protein, 17 aa, Giardia lamblia
SLASMYSSLLLQGHGLR

SEQ ID NO: 3197335 - protein, 19 aa, Giardia lamblia
SLASSLAFNRSLLASSARS

SEQ ID NO: 3197336 - protein, 31 aa, Giardia lamblia
SLATRRAIFWNAALTLYMYEYCIELCKILYV

SEQ ID NO: 3197337 - protein, 21 aa, Giardia lamblia
SLAVQEILLDGLGKSNVDAIR

SEQ ID NO: 3197338 - protein, 19 aa, Giardia lamblia
SLCCLNYSILQKFDPSQTG

SEQ ID NO: 3197339 - protein, 28 aa, Giardia lamblia
SLCIPYMHGFYIDKALYDKAKFANTSLN

SEQ ID NO: 3197340 - protein, 23 aa, Giardia lamblia
SLCQTTRMYSKGGGAPSYKTLNA

SEQ ID NO: 3197341 - protein, 20 aa, Giardia lamblia
SLCTAMSIMSLFFQERRINS

SEQ ID NO: 3197342 - protein, 22 aa, Giardia lamblia
SLDIHVCAVFLTESFGVPFHYA

SEQ ID NO: 3197343 - protein, 28 aa, Giardia lamblia
SLDKKVEMGFYWSTQLYNDAMCLARIDL

SEQ ID NO: 3197344 - protein, 22 aa, Giardia lamblia
SLDLTTSTALRPPGIHTSMLQT

SEQ ID NO: 3197345 - protein, 24 aa, Giardia lamblia
SLDPVLTFEFVYEVNLDWSVARRI

SEQ ID NO: 3197346 - protein, 21 aa, Giardia lamblia
SLDSLYSFFQAFFSSSYDGDH

SEQ ID NO: 3197347 - protein, 28 aa, Giardia lamblia
SLDSNRMHWFVRLQALIYINDHLTKDDM

SEQ ID NO: 3197348 - protein, 25 aa, Giardia lamblia
SLDTTPFTSLPIYHRMREFDRRYII

SEQ ID NO: 3197349 - protein, 18 aa, Giardia lamblia
SLDYFQLVVLTDKQMFMS

SEQ ID NO: 3197350 - protein, 18 aa, Giardia lamblia
SLECIPLLLSEMPLRNRM

SEQ ID NO: 3197351 - protein, 19 aa, Giardia lamblia
SLECPPFYTAFFEMDVIKA

SEQ ID NO: 3197352 - protein, 27 aa, Giardia lamblia
SLECVQCVVLYFKPSPEQIYPVLEEAH

SEQ ID NO: 3197353 - protein, 23 aa, Giardia lamblia
SLEDLPACFLDLGWYRLTAEQGQ

SEQ ID NO: 3197354 - protein, 30 aa, Giardia lamblia
SLEFAKIAPFYIYYSLIFSSQFDSTNRVAF

SEQ ID NO: 3197355 - protein, 24 aa, Giardia lamblia
SLEFCTFRASLLSAAGLDCSHVTE

SEQ ID NO: 3197356 - protein, 23 aa, Giardia lamblia
SLENTAIFDMLYSSSKLPRNSAP

SEQ ID NO: 3197357 - protein, 18 aa, Giardia lamblia
SLEQDSVSSLLLNTSNRS

SEQ ID NO: 3197358 - protein, 38 aa, Giardia lamblia
SLERQRFRYLRMLIPVALNCLLVFYKTTLLPGEGEPKW

SEQ ID NO: 3197359 - protein, 19 aa, Giardia lamblia
SLERSVALDLPLSSRYLKG

SEQ ID NO: 3197360 - protein, 26 aa, Giardia lamblia
SLETDFPLFDFYEPVFGYGVIDSTIT

SEQ ID NO: 3197361 - protein, 19 aa, Giardia lamblia
SLETQYLACSLFHRFLSIC

SEQ ID NO: 3197362 - protein, 18 aa, Giardia lamblia
SLEVELASHIRGLDLMSH

SEQ ID NO: 3197363 - protein, 18 aa, Giardia lamblia
SLEVPTRVLLRKDAIAKP

SEQ ID NO: 3197364 - protein, 24 aa, Giardia lamblia
SLEYLVEGLILTMLELVQIAKRVY

SEQ ID NO: 3197365 - protein, 20 aa, Giardia lamblia
SLFNGHVLYFIPCYTDGKAI

SEQ ID NO: 3197366 - protein, 18 aa, Giardia lamblia
SLFRAEAFVKLPYDNLED

SEQ ID NO: 3197367 - protein, 17 aa, Giardia lamblia
SLFRNRPEMREWFCAVY

SEQ ID NO: 3197368 - protein, 26 aa, Giardia lamblia
SLFSSDGEIFCELFLDLIGNEVISEW

SEQ ID NO: 3197369 - protein, 17 aa, Giardia lamblia
SLFSYTAILQPSILFSS

SEQ ID NO: 3197370 - protein, 17 aa, Giardia lamblia
SLFTPALFQTPKGAAEQ

SEQ ID NO: 3197371 - protein, 20 aa, Giardia lamblia
SLFTQKLLEKDIYATRGFVL

SEQ ID NO: 3197372 - protein, 20 aa, Giardia lamblia
SLFYADLLTDTRLLVITGSP

SEQ ID NO: 3197373 - protein, 19 aa, Giardia lamblia
SLGCAIYEVCKGYQLFYNE

SEQ ID NO: 3197374 - protein, 31 aa, Giardia lamblia
SLGCTIYELCTKTLLFRAKNISDLANKHKEF

SEQ ID NO: 3197375 - protein, 20 aa, Giardia lamblia
SLGCVIYELCALQPPFVASN

SEQ ID NO: 3197376 - protein, 24 aa, Giardia lamblia
SLGFNVDMRLLAASLLTADYNPRY

SEQ ID NO: 3197377 - protein, 23 aa, Giardia lamblia
SLGGRTALMLAARCNQPQSAAML

SEQ ID NO: 3197378 - protein, 17 aa, Giardia lamblia
SLGILLLDMVSLALYRD

SEQ ID NO: 3197379 - protein, 20 aa, Giardia lamblia
SLGLTLLESIISRVVFFLPL

SEQ ID NO: 3197380 - protein, 18 aa, Giardia lamblia
SLGQMIRRSFREIQRTFL

SEQ ID NO: 3197381 - protein, 30 aa, Giardia lamblia
SLGQRSLVFSFPTLPLVVSCSLVVGGQEYL

SEQ ID NO: 3197382 - protein, 18 aa, Giardia lamblia
SLGTCLYELCQGRKLFHT

SEQ ID NO: 3197383 - protein, 21 aa, Giardia lamblia
SLGVIIYELVTLRMLDFLEDR

SEQ ID NO: 3197384 - protein, 19 aa, Giardia lamblia
SLGVILYELATGTKIPFLK

SEQ ID NO: 3197385 - protein, 18 aa, Giardia lamblia
SLGYFAPTTLTGSGCDAG

SEQ ID NO: 3197386 - protein, 19 aa, Giardia lamblia
SLHEFVLVQLVKTSATLAD

SEQ ID NO: 3197387 - protein, 28 aa, Giardia lamblia
SLHIGFEFLHLWMPKAEFYMPSTTWPNH

SEQ ID NO: 3197388 - protein, 26 aa, Giardia lamblia
SLHILSGNAVWLMRLLKASCESDGRR

SEQ ID NO: 3197389 - protein, 23 aa, Giardia lamblia
SLHTIPVYTVLSVSLEKTLHSEL

SEQ ID NO: 3197390 - protein, 35 aa, Giardia lamblia
SLIADSALMIFLPKIAVLFLEPEFVFNNGAAVASS

SEQ ID NO: 3197391 - protein, 17 aa, Giardia lamblia
SLIARQHREIYFACNSL

SEQ ID NO: 3197392 - protein, 17 aa, Giardia lamblia
SLICYYDIRTKTKEDIP

SEQ ID NO: 3197393 - protein, 26 aa, Giardia lamblia
SLIESQSHFLLINLLSNQLGVRGAKG

SEQ ID NO: 3197394 - protein, 42 aa, Giardia lamblia
SLIFEQDFCYIVSGCGTHKTIYLDTYRFSTMSLRNALGIHVE

SEQ ID NO: 3197395 - protein, 18 aa, Giardia lamblia
SLIGSRVELIFTTGDKLT

SEQ ID NO: 3197396 - protein, 26 aa, Giardia lamblia
SLILDELHRLILYLTGNLIDTYSGAL

SEQ ID NO: 3197397 - protein, 17 aa, Giardia lamblia
SLILFSDGSAFRGQFSE

SEQ ID NO: 3197398 - protein, 27 aa, Giardia lamblia
SLILSRILPERWCVGITAVPCPTAPHD

SEQ ID NO: 3197399 - protein, 19 aa, Giardia lamblia
SLINEMALPVQPPSAQGIF

SEQ ID NO: 3197400 - protein, 25 aa, Giardia lamblia
SLITLRLEVASYFYIRAGDYVSYNF

SEQ ID NO: 3197401 - protein, 32 aa, Giardia lamblia
SLKEAYSLALPLAKQLPWASKEFKELISQHSH

SEQ ID NO: 3197402 - protein, 20 aa, Giardia lamblia
SLKELPLPSIQALDQLNKHI

SEQ ID NO: 3197403 - protein, 31 aa, Giardia lamblia
SLKMPEYKVRIPYLDLFRFAINILDQPANTV

SEQ ID NO: 3197404 - protein, 19 aa, Giardia lamblia
SLKQRRLLRELEDDVKLLE

SEQ ID NO: 3197405 - protein, 17 aa, Giardia lamblia
SLKSKSPTFLWTEDMEP

SEQ ID NO: 3197406 - protein, 21 aa, Giardia lamblia
SLKSLNFYSIFKKATLDELAD

SEQ ID NO: 3197407 - protein, 27 aa, Giardia lamblia
SLKSNRLMAIPESIFTPVLNIEELYLN

SEQ ID NO: 3197408 - protein, 21 aa, Giardia lamblia
SLKYLLPVEGRMTRRNGRTAL

SEQ ID NO: 3197409 - protein, 22 aa, Giardia lamblia
SLLAKYRVAPQIQATLDSALSR

SEQ ID NO: 3197410 - protein, 17 aa, Giardia lamblia
SLLKKQVLSLERSLLSA

SEQ ID NO: 3197411 - protein, 20 aa, Giardia lamblia
SLLKYTLIAVSRIVDIYPET

SEQ ID NO: 3197412 - protein, 21 aa, Giardia lamblia
SLLLELLRRVDLLQYQIDQKS

SEQ ID NO: 3197413 - protein, 17 aa, Giardia lamblia
SLLMLDRAMKDLKSLNC

SEQ ID NO: 3197414 - protein, 17 aa, Giardia lamblia
SLLSLNALLLCPKELAS

SEQ ID NO: 3197415 - protein, 24 aa, Giardia lamblia
SLLSYPGPYLSLIKEIIAVMMSVS

SEQ ID NO: 3197416 - protein, 25 aa, Giardia lamblia
SLLVHQFLPAYYRSSALKVVPTYVQ

SEQ ID NO: 3197417 - protein, 25 aa, Giardia lamblia
SLLVLPCGSLSRPLVALLQPWEPAL

SEQ ID NO: 3197418 - protein, 18 aa, Giardia lamblia
SLLVPYEKDRIGSEGKTA

SEQ ID NO: 3197419 - protein, 19 aa, Giardia lamblia
SLLVPYEKDRIGSEGKTAL

SEQ ID NO: 3197420 - protein, 17 aa, Giardia lamblia
SLLYAVAAVEEGCTYLN

SEQ ID NO: 3197421 - protein, 23 aa, Giardia lamblia
SLMAAHFLWFLNTSSRGVMTTPV

SEQ ID NO: 3197422 - protein, 19 aa, Giardia lamblia
SLMLAAEMGNIRLVNELLP

SEQ ID NO: 3197423 - protein, 34 aa, Giardia lamblia
SLNANTRFKLHELSIWFMSHIIKAAPGNVSLASI

SEQ ID NO: 3197424 - protein, 19 aa, Giardia lamblia
SLNERAFLSDLLSVLPNLT

SEQ ID NO: 3197425 - protein, 19 aa, Giardia lamblia
SLNFPLRVVDIEGVDTCLC

SEQ ID NO: 3197426 - protein, 38 aa, Giardia lamblia
SLNIPADFEDLPPQTFIDTAVIPLQKRLDEAIAAAMNK

SEQ ID NO: 3197427 - protein, 33 aa, Giardia lamblia
SLNSVEIMPCCTLLRVFTVKTCPLPTLELYCPK

SEQ ID NO: 3197428 - protein, 28 aa, Giardia lamblia
SLPCEKLHPVVKLFGSIYGKKFIDQALR

SEQ ID NO: 3197429 - protein, 21 aa, Giardia lamblia
SLPFFLRDYVISPSSTKCLDF

SEQ ID NO: 3197430 - protein, 19 aa, Giardia lamblia
SLPGFSPLLAEFISSMVVI

SEQ ID NO: 3197431 - protein, 24 aa, Giardia lamblia
SLPKTHPIYALPSVSIRAQLWDIA

SEQ ID NO: 3197432 - protein, 21 aa, Giardia lamblia
SLPLAIAFPRPEFIKDTVRFS

SEQ ID NO: 3197433 - protein, 20 aa, Giardia lamblia
SLPLFLTDEILQFLEANYGV

SEQ ID NO: 3197434 - protein, 17 aa, Giardia lamblia
SLPLFPGAPIMPRSGPP

SEQ ID NO: 3197435 - protein, 19 aa, Giardia lamblia
SLPMTTEDSSWQGGAAALQ

SEQ ID NO: 3197436 - protein, 19 aa, Giardia lamblia
SLPPLYRCYLENDYLIVEQ

SEQ ID NO: 3197437 - protein, 24 aa, Giardia lamblia
SLPRLRVFFAKRFSIRIRNGVRMP

SEQ ID NO: 3197438 - protein, 17 aa, Giardia lamblia
SLPSTNSYLAYKKAIMQ

SEQ ID NO: 3197439 - protein, 22 aa, Giardia lamblia
SLQDVIRRYIADMQARGHPPKD

SEQ ID NO: 3197440 - protein, 20 aa, Giardia lamblia
SLQHLSGLKNDLYAKAREAE

SEQ ID NO: 3197441 - protein, 46 aa, Giardia lamblia
SLQIQLLGHLEEPFTRLPLEGNLESIPSYWLERLQKTRAGLSRGRS

SEQ ID NO: 3197442 - protein, 23 aa, Giardia lamblia
SLQLRDKFGSILAPGALRFGTNV

SEQ ID NO: 3197443 - protein, 26 aa, Giardia lamblia
SLQQRYKFTLDILGQLARGAQHICEL

SEQ ID NO: 3197444 - protein, 20 aa, Giardia lamblia
SLQRIRRYLDAMASINKLLQ

SEQ ID NO: 3197445 - protein, 24 aa, Giardia lamblia
SLQRRWDCILRQLDDYEALIAASK

SEQ ID NO: 3197446 - protein, 20 aa, Giardia lamblia
SLQSAIPPKVTPASAISAAI

SEQ ID NO: 3197447 - protein, 18 aa, Giardia lamblia
SLQTILLMKVIANECFAA

SEQ ID NO: 3197448 - protein, 23 aa, Giardia lamblia
SLQVWPDVKWWYDVYDRLREKYA

SEQ ID NO: 3197449 - protein, 17 aa, Giardia lamblia
SLQWLVSINQICTHFRA

SEQ ID NO: 3197450 - protein, 20 aa, Giardia lamblia
SLREYFCRHLAKEKLRLQGI

SEQ ID NO: 3197451 - protein, 30 aa, Giardia lamblia
SLRLARGISLEKPVLLPVSLVVPGRRLNPK

SEQ ID NO: 3197452 - protein, 19 aa, Giardia lamblia
SLRPVAFRSPFQFLHVSRL

SEQ ID NO: 3197453 - protein, 17 aa, Giardia lamblia
SLRRAYGLPPTGALSNC

SEQ ID NO: 3197454 - protein, 17 aa, Giardia lamblia
SLRRLEDEVRQLNDALC

SEQ ID NO: 3197455 - protein, 18 aa, Giardia lamblia
SLRRRMIQLTHSSRKSIA

SEQ ID NO: 3197456 - protein, 25 aa, Giardia lamblia
SLRSKVISYLQLLPSGNKRSSEVGS

SEQ ID NO: 3197457 - protein, 30 aa, Giardia lamblia
SLRYNLTILLTAITNLLISLSKLVAEPYFS

SEQ ID NO: 3197458 - protein, 18 aa, Giardia lamblia
SLSDRKLLYVFTGHTDYV

SEQ ID NO: 3197459 - protein, 27 aa, Giardia lamblia
SLSFARKATSLPLLLKAYAAEQPHPKF

SEQ ID NO: 3197460 - protein, 26 aa, Giardia lamblia
SLSKVFPQAIFPPPGPYSPPVQTSLK

SEQ ID NO: 3197461 - protein, 18 aa, Giardia lamblia
SLSLLGSGYSHHGAECLA

SEQ ID NO: 3197462 - protein, 26 aa, Giardia lamblia
SLSNVSQIFLFCSDLFEADPSLRIST

SEQ ID NO: 3197463 - protein, 35 aa, Giardia lamblia
SLSQLQLYYTIYPERFSTEVFWDCSAQLILAVDVL

SEQ ID NO: 3197464 - protein, 25 aa, Giardia lamblia
SLSQPHMQMILRKPTLLLNAQAGET

SEQ ID NO: 3197465 - protein, 28 aa, Giardia lamblia
SLSQVGFAAHVFPLPVCLLVVMEELISE

SEQ ID NO: 3197466 - protein, 27 aa, Giardia lamblia
SLSSPEFLPLILLMDLSRVCTILQNDL

SEQ ID NO: 3197467 - protein, 22 aa, Giardia lamblia
SLSTPFITRLLTGLSSLSNLYE

SEQ ID NO: 3197468 - protein, 37 aa, Giardia lamblia
SLSVSAFIRSLAPFQRLMLLKAINPGRLMFYIPQYIA

SEQ ID NO: 3197469 - protein, 18 aa, Giardia lamblia
SLSWFRAQGFDCDLDASF

SEQ ID NO: 3197470 - protein, 26 aa, Giardia lamblia
SLTAFVITGFKKLLTSIAKLSDIFKY

SEQ ID NO: 3197471 - protein, 26 aa, Giardia lamblia
SLTELRQRLLLMKEVNLQILEDRRKA

SEQ ID NO: 3197472 - protein, 22 aa, Giardia lamblia
SLTGELDIYPQLQSRYIVNCTR

SEQ ID NO: 3197473 - protein, 22 aa, Giardia lamblia
SLTIDRFLESIAKTNRILGLEQ

SEQ ID NO: 3197474 - protein, 33 aa, Giardia lamblia
SLTILGIEQGALVQWCLICASFHILQNYNMIGD

SEQ ID NO: 3197475 - protein, 20 aa, Giardia lamblia
SLTLALLYTMYDREFDGFSH

SEQ ID NO: 3197476 - protein, 21 aa, Giardia lamblia
SLTMEGYISFKLTCGSFEKTA

SEQ ID NO: 3197477 - protein, 20 aa, Giardia lamblia
SLTQPVSILGLFAAIHEDSI

SEQ ID NO: 3197478 - protein, 29 aa, Giardia lamblia
SLTSLACHPFSPLLLIGEYTGGISIWDLR

SEQ ID NO: 3197479 - protein, 19 aa, Giardia lamblia
SLVDSKTAIFKYIIQRLNT

SEQ ID NO: 3197480 - protein, 18 aa, Giardia lamblia
SLVHLTIPKVSAKAAYII

SEQ ID NO: 3197481 - protein, 19 aa, Giardia lamblia
SLVIPIQYSLALRTLMHDM

SEQ ID NO: 3197482 - protein, 18 aa, Giardia lamblia
SLVLPQLYHEIEVAVART

SEQ ID NO: 3197483 - protein, 29 aa, Giardia lamblia
SLVNDVPTHRLIYTLSISYSSFIELTASM

SEQ ID NO: 3197484 - protein, 26 aa, Giardia lamblia
SLVNEFKPWFLALRKRCPVKDLTRLT

SEQ ID NO: 3197485 - protein, 20 aa, Giardia lamblia
SLVNFLLPYESGQFNLRGET

SEQ ID NO: 3197486 - protein, 23 aa, Giardia lamblia
SLVPIDLEIYWYQELDDNERVYI

SEQ ID NO: 3197487 - protein, 26 aa, Giardia lamblia
SLVPTPRLHFLMSSYTPITSSSLNVK

SEQ ID NO: 3197488 - protein, 20 aa, Giardia lamblia
SLVRLKGFRILRSVLRKNGC

SEQ ID NO: 3197489 - protein, 25 aa, Giardia lamblia
SLVSSLKVYLQDLGAAIFSIDSIER

SEQ ID NO: 3197490 - protein, 24 aa, Giardia lamblia
SLVTINLVLKYIYADPPILNTEQC

SEQ ID NO: 3197491 - protein, 21 aa, Giardia lamblia
SLVVDDLGTLGLIEERIQQNI

SEQ ID NO: 3197492 - protein, 23 aa, Giardia lamblia
SLYKRVLQYLRKIASPSAKLLRV

SEQ ID NO: 3197493 - protein, 25 aa, Giardia lamblia
SLYPHNLSILFVRLTTLRKRIPAEF

SEQ ID NO: 3197494 - protein, 18 aa, Giardia lamblia
SLYSCVLRYKVPAEQIIT

SEQ ID NO: 3197495 - protein, 18 aa, Giardia lamblia
SLYSIKQNTLNPYMQTLI

SEQ ID NO: 3197496 - protein, 20 aa, Giardia lamblia
SLYYHDYSTNTLQYISKKKI

SEQ ID NO: 3197497 - protein, 27 aa, Giardia lamblia
SMALHTCVYGFKKVLLSLVSCPSGSLI

SEQ ID NO: 3197498 - protein, 24 aa, Giardia lamblia
SMDIYSTLWAKMPQILHSEGHVML

SEQ ID NO: 3197499 - protein, 30 aa, Giardia lamblia
SMDLEKQLHWIHILTIRLRSVRRAAQAAAK

SEQ ID NO: 3197500 - protein, 29 aa, Giardia lamblia
SMELGISVFLILDRTLMHPGLVRLENIMN

SEQ ID NO: 3197501 - protein, 24 aa, Giardia lamblia
SMERRTQILFIPDISIILTRSNIQ

SEQ ID NO: 3197502 - protein, 19 aa, Giardia lamblia
SMFPLYVAALRARTRSEWS

SEQ ID NO: 3197503 - protein, 18 aa, Giardia lamblia
SMGIPYEKVLSDNQIYRL

SEQ ID NO: 3197504 - protein, 19 aa, Giardia lamblia
SMGTPLLRPHNRPSSASMT

SEQ ID NO: 3197505 - protein, 18 aa, Giardia lamblia
SMHGSLECAVLLASLEAG

SEQ ID NO: 3197506 - protein, 24 aa, Giardia lamblia
SMHRDMLLQVLAHSPPIPLDTLSD

SEQ ID NO: 3197507 - protein, 26 aa, Giardia lamblia
SMIDAAYLDVIWRSPSANWSILVDAC

SEQ ID NO: 3197508 - protein, 21 aa, Giardia lamblia
SMIKLLLPHEVTCKTKEGITA

SEQ ID NO: 3197509 - protein, 33 aa, Giardia lamblia
SMIQAARNFTLKTNPYLLSRRLFGEQSACDQSY

SEQ ID NO: 3197510 - protein, 25 aa, Giardia lamblia
SMITLNDFLFATQSLIPTALREGFA

SEQ ID NO: 3197511 - protein, 23 aa, Giardia lamblia
SMIVKIITLPVLLQHPRAPEFLF

SEQ ID NO: 3197512 - protein, 17 aa, Giardia lamblia
SMKMLEFLKQDLSSKTK

SEQ ID NO: 3197513 - protein, 26 aa, Giardia lamblia
SMLDMVRFYLAALRLLRDSDPGKIAF

SEQ ID NO: 3197514 - protein, 27 aa, Giardia lamblia
SMLFATNICFIFFSLSHHCTYGRQLLR

SEQ ID NO: 3197515 - protein, 26 aa, Giardia lamblia
SMLGHKLWFLIERLPKQPATGADLTN

SEQ ID NO: 3197516 - protein, 19 aa, Giardia lamblia
SMLLSLGSLLLNTSISADE

SEQ ID NO: 3197517 - protein, 26 aa, Giardia lamblia
SMLMSAIIFGNEEAALLILKELQKQS

SEQ ID NO: 3197518 - protein, 25 aa, Giardia lamblia
SMLPQLVHRPILLSVFMRCCIEKSI

SEQ ID NO: 3197519 - protein, 21 aa, Giardia lamblia
SMLQASRALLSPVRSAAQPSP

SEQ ID NO: 3197520 - protein, 33 aa, Giardia lamblia
SMNFQRMRQLEKNLLIYYDKYNQLRVKNGSLNQ

SEQ ID NO: 3197521 - protein, 23 aa, Giardia lamblia
SMNPSFIEPHISLAGAHLVAESF

SEQ ID NO: 3197522 - protein, 23 aa, Giardia lamblia
SMNTIYELIEYIFRESGCENIGG

SEQ ID NO: 3197523 - protein, 17 aa, Giardia lamblia
SMPASEFAIKRAQELMV

SEQ ID NO: 3197524 - protein, 18 aa, Giardia lamblia
SMPDGVTPLILAIQKRFY

SEQ ID NO: 3197525 - protein, 25 aa, Giardia lamblia
SMPVYGISWNTFNPDLLVSCSEDFT

SEQ ID NO: 3197526 - protein, 24 aa, Giardia lamblia
SMQSSIPGWPGSSLIFFSECSGAA

SEQ ID NO: 3197527 - protein, 29 aa, Giardia lamblia
SMQSTELMQYILGVLMTEKSPRPTRPAWN

SEQ ID NO: 3197528 - protein, 24 aa, Giardia lamblia
SMRDIVLVSSSLVRYCDLLPVDRC

SEQ ID NO: 3197529 - protein, 19 aa, Giardia lamblia
SMRNASIISLLGYYKQEHL

SEQ ID NO: 3197530 - protein, 18 aa, Giardia lamblia
SMRQSLLMRSSNTQSTSL

SEQ ID NO: 3197531 - protein, 36 aa, Giardia lamblia
SMRSQDAITLLALKSAIYLECNFVKSISGAGPPSKQ

SEQ ID NO: 3197532 - protein, 23 aa, Giardia lamblia
SMSAAANVIPLAAPSYVSQEEYN

SEQ ID NO: 3197533 - protein, 23 aa, Giardia lamblia
SMSIDEKAALLPLLESTEKEARG

SEQ ID NO: 3197534 - protein, 17 aa, Giardia lamblia
SMSQYMSFAFTHIFELL

SEQ ID NO: 3197535 - protein, 26 aa, Giardia lamblia
SMSTVFLPVFLNLKESKPALAAIERL

SEQ ID NO: 3197536 - protein, 24 aa, Giardia lamblia
SMTLERTMNYSLGRMWAVSYNFDV

SEQ ID NO: 3197537 - protein, 20 aa, Giardia lamblia
SMTMTPLMKAAKNNDVKLVK

SEQ ID NO: 3197538 - protein, 28 aa, Giardia lamblia
SMTYRSLCKFLVGKFRLPSKILQTPVLS

SEQ ID NO: 3197539 - protein, 19 aa, Giardia lamblia
SMVDFSGHTAFLYACNNGY

SEQ ID NO: 3197540 - protein, 20 aa, Giardia lamblia
SMVEIAYWRTQAQTAIIDLC

SEQ ID NO: 3197541 - protein, 20 aa, Giardia lamblia
SMVLSAITSLIPFPDHNQSP

SEQ ID NO: 3197542 - protein, 20 aa, Giardia lamblia
SMVLVPIYDSLSAHGMSYCI

SEQ ID NO: 3197543 - protein, 32 aa, Giardia lamblia
SMYLRTSLALLRLFEYYGIASTIKWPNDIIVD

SEQ ID NO: 3197544 - protein, 23 aa, Giardia lamblia
SNAIEVFILAWGNAICCYNFSGE

SEQ ID NO: 3197545 - protein, 20 aa, Giardia lamblia
SNAIFNLLGDYEGLTTRIVK

SEQ ID NO: 3197546 - protein, 17 aa, Giardia lamblia
SNAIYFQLGKEDILKPA

SEQ ID NO: 3197547 - protein, 35 aa, Giardia lamblia
SNCFIDQSTGILRLGLFLPFLLKYEKEEQSTRESI

SEQ ID NO: 3197548 - protein, 25 aa, Giardia lamblia
SNDEAFLICTLLNDVLIYAISEDIF

SEQ ID NO: 3197549 - protein, 27 aa, Giardia lamblia
SNDKRISLLVLHFLLLENTAAAKDSDE

SEQ ID NO: 3197550 - protein, 25 aa, Giardia lamblia
SNDLEMLTCLLKRKAYLDLDAVDNH

SEQ ID NO: 3197551 - protein, 21 aa, Giardia lamblia
SNDLTPLMRAAIRNDVDAVES

SEQ ID NO: 3197552 - protein, 30 aa, Giardia lamblia
SNDRNAILSHAPFEWGWADVDGYTALMHAV

SEQ ID NO: 3197553 - protein, 25 aa, Giardia lamblia
SNEDKIRYYQLLRNELINKQTQVQK

SEQ ID NO: 3197554 - protein, 32 aa, Giardia lamblia
SNEKVKWLSLGKDLANYPLYVTKYAPCGKCQH

SEQ ID NO: 3197555 - protein, 23 aa, Giardia lamblia
SNERLPLWLSSLNCYPADVFTQC

SEQ ID NO: 3197556 - protein, 19 aa, Giardia lamblia
SNFSISIIALGIGIGPFTS

SEQ ID NO: 3197557 - protein, 23 aa, Giardia lamblia
SNFTSLPTLAQPATAKAATKPEA

SEQ ID NO: 3197558 - protein, 34 aa, Giardia lamblia
SNGDVVLWNLVTLRPRIILHAFHGFDVTALAFDP

SEQ ID NO: 3197559 - protein, 32 aa, Giardia lamblia
SNGICLNAVYPKWMYNPPVIKRKKQKIARDFI

SEQ ID NO: 3197560 - protein, 26 aa, Giardia lamblia
SNHPDLYVDFPFLPLLDIIDVSSSTK

SEQ ID NO: 3197561 - protein, 33 aa, Giardia lamblia
SNIDQSIYMSWLAKKLAFLTLNSAALVMGDIGA

SEQ ID NO: 3197562 - protein, 26 aa, Giardia lamblia
SNIEQRLFELVDAANRIFELLTELAE

SEQ ID NO: 3197563 - protein, 17 aa, Giardia lamblia
SNILRDLVPSKYLDWDL

SEQ ID NO: 3197564 - protein, 36 aa, Giardia lamblia
SNKEGLIIQGLRRIYNLGFMVKLSFLEVYCERLYDL

SEQ ID NO: 3197565 - protein, 21 aa, Giardia lamblia
SNKHAIFFDAIFERSPHNVVR

SEQ ID NO: 3197566 - protein, 22 aa, Giardia lamblia
SNKKLHDYMSELTLKNNEVDSL

SEQ ID NO: 3197567 - protein, 23 aa, Giardia lamblia
SNKLLYNNILVELMYFSNIVSTI

SEQ ID NO: 3197568 - protein, 19 aa, Giardia lamblia
SNLFIPFSQALYKTLQGQS

SEQ ID NO: 3197569 - protein, 20 aa, Giardia lamblia
SNLLYNGTTLDTRYISRLIA

SEQ ID NO: 3197570 - protein, 37 aa, Giardia lamblia
SNLPDAMSSVLQSLILLLKEEPLSFSPIEPSRQLTRT

SEQ ID NO: 3197571 - protein, 23 aa, Giardia lamblia
SNLRTMFVLKEYPPGSTLYRVDE

SEQ ID NO: 3197572 - protein, 24 aa, Giardia lamblia
SNLSQSIFRCPQDVALWPEARSSM

SEQ ID NO: 3197573 - protein, 22 aa, Giardia lamblia
SNMFRVITNNKLVFFETPDPIE

SEQ ID NO: 3197574 - protein, 19 aa, Giardia lamblia
SNMLNVHFTFLGPSDSPFS

SEQ ID NO: 3197575 - protein, 25 aa, Giardia lamblia
SNNAPACITLLPLEGTIIPDNGFSP

SEQ ID NO: 3197576 - protein, 66 aa, Giardia lamblia
SNNKTPALWLKYSYPCLKPLASYYIDLLDRISFINVWIEKGIPICFWISGFFFTQGFLTGCLQNFA

SEQ ID NO: 3197577 - protein, 24 aa, Giardia lamblia
SNNQTSLMLAIQSGSLRAAKELVI

SEQ ID NO: 3197578 - protein, 24 aa, Giardia lamblia
SNNVTPLLFILSSGSDPMADLFRF

SEQ ID NO: 3197579 - protein, 24 aa, Giardia lamblia
SNPENLMYLAPPPSSKLPKHCIDI

SEQ ID NO: 3197580 - protein, 22 aa, Giardia lamblia
SNPKILLSIRIWRTREEAQLHT

SEQ ID NO: 3197581 - protein, 33 aa, Giardia lamblia
SNPMANLDFLIVPVPMYLENHVRFGRLLGSRAP

SEQ ID NO: 3197582 - protein, 23 aa, Giardia lamblia
SNPPSNVPPYPGLPANIDTMETL

SEQ ID NO: 3197583 - protein, 29 aa, Giardia lamblia
SNQNMKKYQASLLHKLFVTKTCTAIDKQE

SEQ ID NO: 3197584 - protein, 25 aa, Giardia lamblia
SNRELPWQLIIVRYTKVQASRLRDK

SEQ ID NO: 3197585 - protein, 23 aa, Giardia lamblia
SNRFFGKRYMELDNTPSWPVLPD

SEQ ID NO: 3197586 - protein, 21 aa, Giardia lamblia
SNRLFVQLLVTIIRTCSAAEA

SEQ ID NO: 3197587 - protein, 23 aa, Giardia lamblia
SNRPRVLDYTKSIYYLLCQSSFH

SEQ ID NO: 3197588 - protein, 23 aa, Giardia lamblia
SNRSFLRKPLRITFDWEDGIDQG

SEQ ID NO: 3197589 - protein, 28 aa, Giardia lamblia
SNSCLWFYFCVNSIVINKPFLFHIIGFS

SEQ ID NO: 3197590 - protein, 23 aa, Giardia lamblia
SNSPRFRAFSEKVLRTNLWARFS

SEQ ID NO: 3197591 - protein, 18 aa, Giardia lamblia
SNSPSFMLSPPLSPQRSP

SEQ ID NO: 3197592 - protein, 26 aa, Giardia lamblia
SNSVSLFILPFPSLEQVTKKGARIPS

SEQ ID NO: 3197593 - protein, 24 aa, Giardia lamblia
SNSYHELLIKLNFSPDEIDDILSH

SEQ ID NO: 3197594 - protein, 18 aa, Giardia lamblia
SNTEPIIRIISEAPSEDE

SEQ ID NO: 3197595 - protein, 24 aa, Giardia lamblia
SNTIDFSSRILLLTGPNAGGKTTL

SEQ ID NO: 3197596 - protein, 22 aa, Giardia lamblia
SNTLLDPVFFKSELDRRVKEKT

SEQ ID NO: 3197597 - protein, 23 aa, Giardia lamblia
SNTNTYITPLPTTTTKKAEDLRE

SEQ ID NO: 3197598 - protein, 25 aa, Giardia lamblia
SNTWYLDMQVVLEALLRNGSVSGDV

SEQ ID NO: 3197599 - protein, 21 aa, Giardia lamblia
SNVFQAVTWFYNESEQKERRL

SEQ ID NO: 3197600 - protein, 18 aa, Giardia lamblia
SNVGIYLNASSLGSMEAL

SEQ ID NO: 3197601 - protein, 20 aa, Giardia lamblia
SNVIIRMKPDVKWDDVVGLT

SEQ ID NO: 3197602 - protein, 25 aa, Giardia lamblia
SNVKNFLKTLPLVSSLRSPAMRERH

SEQ ID NO: 3197603 - protein, 24 aa, Giardia lamblia
SNVQTLPTLRLFTETMDDSIETYM

SEQ ID NO: 3197604 - protein, 25 aa, Giardia lamblia
SPAAPLSILSFKNTNLRPLPPNDSR

SEQ ID NO: 3197605 - protein, 20 aa, Giardia lamblia
SPADIRSPFTKFGTTKQTAA

SEQ ID NO: 3197606 - protein, 28 aa, Giardia lamblia
SPAELRKYHLLLRVFVSLCKIAVDRCVK

SEQ ID NO: 3197607 - protein, 23 aa, Giardia lamblia
SPAETYILGINWGYITANIDNEE

SEQ ID NO: 3197608 - protein, 21 aa, Giardia lamblia
SPAFILEPIMEVVLGALYEIS

SEQ ID NO: 3197609 - protein, 22 aa, Giardia lamblia
SPALCNALFILMGRIATDRTLH

SEQ ID NO: 3197610 - protein, 26 aa, Giardia lamblia
SPARAVSIPRYTVIYSTGTTSTSLRS

SEQ ID NO: 3197611 - protein, 27 aa, Giardia lamblia
SPASNLLKGLPWEVTYRLSLNSSATSE

SEQ ID NO: 3197612 - protein, 23 aa, Giardia lamblia
SPATFFDALRLYYGHNLNVGFSK

SEQ ID NO: 3197613 - protein, 24 aa, Giardia lamblia
SPAYTILNRLQLLANLSIEPTTEL

SEQ ID NO: 3197614 - protein, 17 aa, Giardia lamblia
SPCILSTLLRSIYHRRF

SEQ ID NO: 3197615 - protein, 25 aa, Giardia lamblia
SPCITCNYYRTLWVSQLSAPTSRKD

SEQ ID NO: 3197616 - protein, 24 aa, Giardia lamblia
SPDERYLVVYTSNLILFYELTIIQ

SEQ ID NO: 3197617 - protein, 26 aa, Giardia lamblia
SPDHMQYFVYQLLRGLKYLHSANCVH

SEQ ID NO: 3197618 - protein, 23 aa, Giardia lamblia
SPDKQYIVISCHPYRSVGVCIMN

SEQ ID NO: 3197619 - protein, 17 aa, Giardia lamblia
SPDLAYSKSLEASNASL

SEQ ID NO: 3197620 - protein, 33 aa, Giardia lamblia
SPDRRLKAVVFDPPLPLNGLNTPPRQADLPPSR

SEQ ID NO: 3197621 - protein, 24 aa, Giardia lamblia
SPDSPSHFLLEQALLRCNRKITPR

SEQ ID NO: 3197622 - protein, 20 aa, Giardia lamblia
SPEAFIYQLRRARKVIFLVG

SEQ ID NO: 3197623 - protein, 26 aa, Giardia lamblia
SPEEITKFFQLGFGNFGRYNPSEGSV

SEQ ID NO: 3197624 - protein, 24 aa, Giardia lamblia
SPEEWLLIVLCITETYFSGTITTT

SEQ ID NO: 3197625 - protein, 23 aa, Giardia lamblia
SPEEYRWYVMTKEKLRTQSFDLL

SEQ ID NO: 3197626 - protein, 25 aa, Giardia lamblia
SPEFRKIFSLFVSPGIYIQENAIDI

SEQ ID NO: 3197627 - protein, 18 aa, Giardia lamblia
SPEQEEFSMRVMASSVRR

SEQ ID NO: 3197628 - protein, 22 aa, Giardia lamblia
SPETAPFLTLGAPGSSPSDSRL

SEQ ID NO: 3197629 - protein, 24 aa, Giardia lamblia
SPFALEVLQLKVQLSRLVICETLE

SEQ ID NO: 3197630 - protein, 20 aa, Giardia lamblia
SPFGLIRHTLTATGAKIDKI

SEQ ID NO: 3197631 - protein, 21 aa, Giardia lamblia
SPGDPLLLRQGGEKGDIGELD

SEQ ID NO: 3197632 - protein, 20 aa, Giardia lamblia
SPGGFDYALRRLTDGSDLLG

SEQ ID NO: 3197633 - protein, 24 aa, Giardia lamblia
SPGGSLMLWDPKGPIIYWQTTYSE

SEQ ID NO: 3197634 - protein, 20 aa, Giardia lamblia
SPGLAMMGVGLRSTYVGAQY

SEQ ID NO: 3197635 - protein, 25 aa, Giardia lamblia
SPGRLSRLLALPPHLRRLRQGSGPP

SEQ ID NO: 3197636 - protein, 19 aa, Giardia lamblia
SPHFFYLQQIHTDAQFVLV

SEQ ID NO: 3197637 - protein, 26 aa, Giardia lamblia
SPIATLPMLTLSSLGILPLCSADSLA

SEQ ID NO: 3197638 - protein, 26 aa, Giardia lamblia
SPIIYSYEYLGLTTRLVLTPLTDRCI

SEQ ID NO: 3197639 - protein, 20 aa, Giardia lamblia
SPKEAFLDAVRRWPTTVPSQ

SEQ ID NO: 3197640 - protein, 30 aa, Giardia lamblia
SPKHDLPFKNRLHIFPFSLREDQSRPLLEG

SEQ ID NO: 3197641 - protein, 24 aa, Giardia lamblia
SPKILFYEKLPNAEALLVHFLSAM

SEQ ID NO: 3197642 - protein, 17 aa, Giardia lamblia
SPKLLLERLVKISKNYL

SEQ ID NO: 3197643 - protein, 23 aa, Giardia lamblia
SPKQWGHELCIPDSLLLNCKQKE

SEQ ID NO: 3197644 - protein, 23 aa, Giardia lamblia
SPKTPYTNMFARSFLAHMRQESH

SEQ ID NO: 3197645 - protein, 29 aa, Giardia lamblia
SPKVTSRPLKILFSYPTRELAKDALEFFN

SEQ ID NO: 3197646 - protein, 35 aa, Giardia lamblia
SPLAKYVQGLPRFLNRFFPFSFTQSLFSSAANAPY

SEQ ID NO: 3197647 - protein, 32 aa, Giardia lamblia
SPLDQLSIGLIKPSVAPIVTAILRSSEQSAHE

SEQ ID NO: 3197648 - protein, 17 aa, Giardia lamblia
SPLFFDVQPLQLDAFVL

SEQ ID NO: 3197649 - protein, 21 aa, Giardia lamblia
SPLPIFLLTCTLFTQRLLLRR

SEQ ID NO: 3197650 - protein, 21 aa, Giardia lamblia
SPLRYTGITPLATDFLGISYK

SEQ ID NO: 3197651 - protein, 25 aa, Giardia lamblia
SPLSGKPVVLHYASNILLAKDAEIG

SEQ ID NO: 3197652 - protein, 24 aa, Giardia lamblia
SPLSRAALYNAFYICYLQAAHQIA

SEQ ID NO: 3197653 - protein, 26 aa, Giardia lamblia
SPLSTFLFCMAIERLLRRLRERGITF

SEQ ID NO: 3197654 - protein, 25 aa, Giardia lamblia
SPNFMDQLNLFTIDLADKAVSEMSR

SEQ ID NO: 3197655 - protein, 24 aa, Giardia lamblia
SPNSRSYLVPKFFDLAHTLGKSQS

SEQ ID NO: 3197656 - protein, 48 aa, Giardia lamblia
SPPIELVNHRRFFLLQNYSNYAHILWSNSVVFYFIAYGKKLNKSSNVE

SEQ ID NO: 3197657 - protein, 28 aa, Giardia lamblia
SPPIVQSFNIIRLPPRPVKKATKETPTF

SEQ ID NO: 3197658 - protein, 22 aa, Giardia lamblia
SPPRSPLYKRPDSTRRNLVLGT

SEQ ID NO: 3197659 - protein, 18 aa, Giardia lamblia
SPPRYNLKPPPEYATLPP

SEQ ID NO: 3197660 - protein, 22 aa, Giardia lamblia
SPPSLPVELYFTSILSSIMSND

SEQ ID NO: 3197661 - protein, 17 aa, Giardia lamblia
SPQAHYIAPAPESPKRE

SEQ ID NO: 3197662 - protein, 25 aa, Giardia lamblia
SPQHKIRLLVHQLLVLIGTEHPQAL

SEQ ID NO: 3197663 - protein, 20 aa, Giardia lamblia
SPQILNIIFGYSLHGDRKMH

SEQ ID NO: 3197664 - protein, 25 aa, Giardia lamblia
SPQRRIPDLISYQGGLLSPAKVRTN

SEQ ID NO: 3197665 - protein, 23 aa, Giardia lamblia
SPQRYQSYLTLRGCSLIAAAITQ

SEQ ID NO: 3197666 - protein, 18 aa, Giardia lamblia
SPQTWPSAIISTSIFCPF

SEQ ID NO: 3197667 - protein, 19 aa, Giardia lamblia
SPQYIPKDRREDSPSARLH

SEQ ID NO: 3197668 - protein, 19 aa, Giardia lamblia
SPREAPVASLPPPPQTTSP

SEQ ID NO: 3197669 - protein, 17 aa, Giardia lamblia
SPRLAHLLSTLVERMRL

SEQ ID NO: 3197670 - protein, 19 aa, Giardia lamblia
SPRLEILYGTLKLTASEMT

SEQ ID NO: 3197671 - protein, 26 aa, Giardia lamblia
SPRNPQLYDRFIYLQKLSSTSDRMKI

SEQ ID NO: 3197672 - protein, 19 aa, Giardia lamblia
SPRVARFVRYTILENFGGS

SEQ ID NO: 3197673 - protein, 18 aa, Giardia lamblia
SPSGILHRNIRPSSIIVV

SEQ ID NO: 3197674 - protein, 23 aa, Giardia lamblia
SPSIIPGMHNPAPPSLNTLYREG

SEQ ID NO: 3197675 - protein, 28 aa, Giardia lamblia
SPSKQTFWLVLMQLAELLAYLHSPSKRN

SEQ ID NO: 3197676 - protein, 20 aa, Giardia lamblia
SPSLLTALTILAGRIPEAFE

SEQ ID NO: 3197677 - protein, 30 aa, Giardia lamblia
SPSLSPLLEYLLMALLRLTPENRIHTVFAA

SEQ ID NO: 3197678 - protein, 26 aa, Giardia lamblia
SPSSKAPLPVIIPKFRSKNKASILVQ

SEQ ID NO: 3197679 - protein, 21 aa, Giardia lamblia
SPSYFALIAGAFCDAALRGDD

SEQ ID NO: 3197680 - protein, 34 aa, Giardia lamblia
SPSYYNLYNLRRIVSQMYRYLYRYADADGSDPYT

SEQ ID NO: 3197681 - protein, 29 aa, Giardia lamblia
SPTAGILSISFNPKYDWLYAISTDSGIVR

SEQ ID NO: 3197682 - protein, 21 aa, Giardia lamblia
SPTHSYLLSLNEDPLLSGLLR

SEQ ID NO: 3197683 - protein, 29 aa, Giardia lamblia
SPTNTTQLIFPPFVQFQSNLRTLSLISGD

SEQ ID NO: 3197684 - protein, 26 aa, Giardia lamblia
SPTPSRFHYLFNLRDLSRVYEGLCMA

SEQ ID NO: 3197685 - protein, 25 aa, Giardia lamblia
SPTVVPLTLVDLPGLVKNALPGQPA

SEQ ID NO: 3197686 - protein, 25 aa, Giardia lamblia
SPVAFACVPCFPPAGYGGQMCLPVG

SEQ ID NO: 3197687 - protein, 24 aa, Giardia lamblia
SPVAFACVPCFPPASYGGVPGCAD

SEQ ID NO: 3197688 - protein, 24 aa, Giardia lamblia
SPVIHPPSFPAITQNYYTPSTMNY

SEQ ID NO: 3197689 - protein, 35 aa, Giardia lamblia
SPVSKPLFLSSPSLIDLPLYKFLVPDEAAGLDLSY

SEQ ID NO: 3197690 - protein, 32 aa, Giardia lamblia
SPYAFFDEVLALRKPVLVQLRSGRFITGVLKA

SEQ ID NO: 3197691 - protein, 20 aa, Giardia lamblia
SPYDPLILSTRIFEYVATDK

SEQ ID NO: 3197692 - protein, 31 aa, Giardia lamblia
SPYEDSPYIPPAFRYLLNNPFTRHQMLFMLK

SEQ ID NO: 3197693 - protein, 19 aa, Giardia lamblia
SPYIGRYVSLLSEPNLSHR

SEQ ID NO: 3197694 - protein, 21 aa, Giardia lamblia
SPYLARLSHYFNDDASALLTM

SEQ ID NO: 3197695 - protein, 17 aa, Giardia lamblia
SPYLCAIECERYCDILV

SEQ ID NO: 3197696 - protein, 20 aa, Giardia lamblia
SPYQDFPHFSDIKKWCFAND

SEQ ID NO: 3197697 - protein, 26 aa, Giardia lamblia
SPYQIKKFMYQLLQGLSLVHKNEILH

SEQ ID NO: 3197698 - protein, 20 aa, Giardia lamblia
SPYTAPIPEFGKYPPVLTCG

SEQ ID NO: 3197699 - protein, 20 aa, Giardia lamblia
SPYVINLIDDTISRFKKHPF

SEQ ID NO: 3197700 - protein, 26 aa, Giardia lamblia
SQADLARAVYWTKLGTFYEELAADSL

SEQ ID NO: 3197701 - protein, 27 aa, Giardia lamblia
SQAFALLGVSWIRYNFYDSVSGSQPTP

SEQ ID NO: 3197702 - protein, 18 aa, Giardia lamblia
SQALLVEESMLLAGKTRA

SEQ ID NO: 3197703 - protein, 45 aa, Giardia lamblia
SQARDYLSSSYLLYSLVNQEPVFSFKGLLLFVASDMSRIVRFSGH

SEQ ID NO: 3197704 - protein, 20 aa, Giardia lamblia
SQARKKFKVLTPTDIVLLQE

SEQ ID NO: 3197705 - protein, 26 aa, Giardia lamblia
SQDENVYLLGFSKRLSGLLLDAIYGV

SEQ ID NO: 3197706 - protein, 17 aa, Giardia lamblia
SQDKIFHSFITPNDIVF

SEQ ID NO: 3197707 - protein, 22 aa, Giardia lamblia
SQDWLSLRQQLASKFYSYAADN

SEQ ID NO: 3197708 - protein, 26 aa, Giardia lamblia
SQERQSVPSLLLKDSIRAVPLAVSSS

SEQ ID NO: 3197709 - protein, 24 aa, Giardia lamblia
SQERYHIHRIRSKGSYRSYRRRSK

SEQ ID NO: 3197710 - protein, 35 aa, Giardia lamblia
SQEYANNLYILQYPLRPTWRLYNWSSMSSVTFHPS

SEQ ID NO: 3197711 - protein, 22 aa, Giardia lamblia
SQFIFPYCGLFDDTLTQAWLTS

SEQ ID NO: 3197712 - protein, 23 aa, Giardia lamblia
SQGLLSMRLKSLTYLATRLLETT

SEQ ID NO: 3197713 - protein, 17 aa, Giardia lamblia
SQGPVPIQLSQSGPAIS

SEQ ID NO: 3197714 - protein, 27 aa, Giardia lamblia
SQHLAPLLFDLTRYLFSVSSYRGLCVA

SEQ ID NO: 3197715 - protein, 17 aa, Giardia lamblia
SQHSDILSSFRSVKKTP

SEQ ID NO: 3197716 - protein, 24 aa, Giardia lamblia
SQHVFLFDEGLILGSLLLSFFPQK

SEQ ID NO: 3197717 - protein, 26 aa, Giardia lamblia
SQIKRYCLLSMLQTRKYKAHTISGIF

SEQ ID NO: 3197718 - protein, 18 aa, Giardia lamblia
SQIKYKIRALKEELAIDD

SEQ ID NO: 3197719 - protein, 20 aa, Giardia lamblia
SQILTIVTQVSAALAYLHSA

SEQ ID NO: 3197720 - protein, 18 aa, Giardia lamblia
SQILYPSMQCADIFELKL

SEQ ID NO: 3197721 - protein, 24 aa, Giardia lamblia
SQINQIYTMFLNKITIFQDSTYDP

SEQ ID NO: 3197722 - protein, 25 aa, Giardia lamblia
SQKERLPCLLTIAGIPEALAFDDIK

SEQ ID NO: 3197723 - protein, 18 aa, Giardia lamblia
SQKKAFELAVMASNGIFG

SEQ ID NO: 3197724 - protein, 25 aa, Giardia lamblia
SQKTQLMLMVKQRRPGLVYCLLSQA

SEQ ID NO: 3197725 - protein, 26 aa, Giardia lamblia
SQLCHQPPFTRLLNARSALFLANHYT

SEQ ID NO: 3197726 - protein, 17 aa, Giardia lamblia
SQLESNTLFLQYDWRDI

SEQ ID NO: 3197727 - protein, 21 aa, Giardia lamblia
SQLGPYRLLSPYAKSSQIIQA

SEQ ID NO: 3197728 - protein, 21 aa, Giardia lamblia
SQLNGVLFERSSCTLDLRVVM

SEQ ID NO: 3197729 - protein, 27 aa, Giardia lamblia
SQLQDLLSRIALELPTQPAAPAECVAL

SEQ ID NO: 3197730 - protein, 18 aa, Giardia lamblia
SQLRAENERLRRAAVSAG

SEQ ID NO: 3197731 - protein, 19 aa, Giardia lamblia
SQLRILGSSFDWSRSVFTL

SEQ ID NO: 3197732 - protein, 31 aa, Giardia lamblia
SQLSPTYRAYFWLIIGIAYNVYDIYHDQAAT

SEQ ID NO: 3197733 - protein, 24 aa, Giardia lamblia
SQLSTIAPIRWPVTSGSGDALSKL

SEQ ID NO: 3197734 - protein, 22 aa, Giardia lamblia
SQLTREFLDLAPANLAAGANLC

SEQ ID NO: 3197735 - protein, 22 aa, Giardia lamblia
SQMLKMWLMNPLYDVETIQLRQ

SEQ ID NO: 3197736 - protein, 21 aa, Giardia lamblia
SQPGPVYALALRALGHADPLK

SEQ ID NO: 3197737 - protein, 24 aa, Giardia lamblia
SQPSYLQQIYYASHQQALEQQNSE

SEQ ID NO: 3197738 - protein, 25 aa, Giardia lamblia
SQPTLAFSIYYFVRLETMPADFTDW

SEQ ID NO: 3197739 - protein, 24 aa, Giardia lamblia
SQPYSESLRPYQSLKPPKCPSLRE

SEQ ID NO: 3197740 - protein, 28 aa, Giardia lamblia
SQQEPACILWYICQYFLMDAQHVSHDDS

SEQ ID NO: 3197741 - protein, 24 aa, Giardia lamblia
SQQLPLLQALHKHLTTRSLLALRE

SEQ ID NO: 3197742 - protein, 26 aa, Giardia lamblia
SQQLPLVFHAGLLAFVRKYNTAMTGE

SEQ ID NO: 3197743 - protein, 20 aa, Giardia lamblia
SQQLYQPQNLAYNPSHSYSA

SEQ ID NO: 3197744 - protein, 23 aa, Giardia lamblia
SQQNKPMYFNPNGGYQPPAANQK

SEQ ID NO: 3197745 - protein, 29 aa, Giardia lamblia
SQQPEGHAYFKIDKLAPLTPEELLQNARI

SEQ ID NO: 3197746 - protein, 23 aa, Giardia lamblia
SQQQLFSPRAIAVRITKRKSPSL

SEQ ID NO: 3197747 - protein, 17 aa, Giardia lamblia
SQRAFVFFQTADNLDQA

SEQ ID NO: 3197748 - protein, 23 aa, Giardia lamblia
SQRLLTTFYWHRRSPEAFRCLGT

SEQ ID NO: 3197749 - protein, 23 aa, Giardia lamblia
SQSAINCGRNYYYQQRLHEQQIH

SEQ ID NO: 3197750 - protein, 22 aa, Giardia lamblia
SQSINVFKSFSGLSFEHFHGLQ

SEQ ID NO: 3197751 - protein, 27 aa, Giardia lamblia
SQSQVVTTLLLRLHKYIDRAQAMRDEI

SEQ ID NO: 3197752 - protein, 26 aa, Giardia lamblia
SQSRMKVLVRMKPVDRYKIFSTAMSF

SEQ ID NO: 3197753 - protein, 23 aa, Giardia lamblia
SQSSVFLFRFIMSLHSQLSSHIN

SEQ ID NO: 3197754 - protein, 18 aa, Giardia lamblia
SQTLKLSHLNTTAAPPAQ

SEQ ID NO: 3197755 - protein, 23 aa, Giardia lamblia
SQTQYSHIVLDDSLSDYPFDTSN

SEQ ID NO: 3197756 - protein, 23 aa, Giardia lamblia
SQTSFTFYQTPYQSGLHDTHGTH

SEQ ID NO: 3197757 - protein, 32 aa, Giardia lamblia
SQTSLGGLRRRLLALFLQFAETPEFNPGTLEL

SEQ ID NO: 3197758 - protein, 18 aa, Giardia lamblia
SQVDILPVSLSRSGLTNF

SEQ ID NO: 3197759 - protein, 20 aa, Giardia lamblia
SQWIALRCLRLVASAFINQE

SEQ ID NO: 3197760 - protein, 21 aa, Giardia lamblia
SQYDFASIYCYFKLKELEMNN

SEQ ID NO: 3197761 - protein, 17 aa, Giardia lamblia
SQYFGWKVDVREVPFTE

SEQ ID NO: 3197762 - protein, 21 aa, Giardia lamblia
SQYNSGLGASNRPPIHSIASP

SEQ ID NO: 3197763 - protein, 21 aa, Giardia lamblia
SRACVPLHKLSCEYLVGEETP

SEQ ID NO: 3197764 - protein, 20 aa, Giardia lamblia
SRALEKTTFLLNSKTNELDV

SEQ ID NO: 3197765 - protein, 26 aa, Giardia lamblia
SRCCAFRFLPVPRESCLLMLEKIADA

SEQ ID NO: 3197766 - protein, 19 aa, Giardia lamblia
SRCFEATHLIIQLAKLFIG

SEQ ID NO: 3197767 - protein, 25 aa, Giardia lamblia
SRCKFTLLIPPPNVTGSLHIGHALT

SEQ ID NO: 3197768 - protein, 18 aa, Giardia lamblia
SRCKLVASSYDYLSVFPL

SEQ ID NO: 3197769 - protein, 20 aa, Giardia lamblia
SRCRAQFDVLTTPTEKWLYL

SEQ ID NO: 3197770 - protein, 26 aa, Giardia lamblia
SRDEKYLFWTLFRATDESKLIPRFGD

SEQ ID NO: 3197771 - protein, 21 aa, Giardia lamblia
SRDIQMVKLLAPLESGIFNND

SEQ ID NO: 3197772 - protein, 17 aa, Giardia lamblia
SRDRQIVALLEEAEAAA

SEQ ID NO: 3197773 - protein, 20 aa, Giardia lamblia
SRDYSYNSTRWRQIDKEFVL

SEQ ID NO: 3197774 - protein, 26 aa, Giardia lamblia
SREAFYVLLRIYIKLYEQRDLRASIF

SEQ ID NO: 3197775 - protein, 23 aa, Giardia lamblia
SREFQRILYTLVDILFAALMGDD

SEQ ID NO: 3197776 - protein, 25 aa, Giardia lamblia
SREGSVYKLRLSVRALELEIDNLKT

SEQ ID NO: 3197777 - protein, 25 aa, Giardia lamblia
SREIRRLCIVLSTRLASMYLPTQPF

SEQ ID NO: 3197778 - protein, 24 aa, Giardia lamblia
SREKRHVPYRDSKLTRLLQDSLGG

SEQ ID NO: 3197779 - protein, 32 aa, Giardia lamblia
SREKWTISNMKLDYIFLLELFHAIECKSETKL

SEQ ID NO: 3197780 - protein, 24 aa, Giardia lamblia
SRELYSRMPVIHFLPDEQGKDVDP

SEQ ID NO: 3197781 - protein, 29 aa, Giardia lamblia
SREQASVIIQKYWRRALAKSKVNAMKQAD

SEQ ID NO: 3197782 - protein, 23 aa, Giardia lamblia
SREQEAFYIWRSELAKLEQERVV

SEQ ID NO: 3197783 - protein, 18 aa, Giardia lamblia
SRFDVYRRMDQHSIPTCM

SEQ ID NO: 3197784 - protein, 29 aa, Giardia lamblia
SRFGQSPFIYPLYGLGDLPQAFSRVAAVW

SEQ ID NO: 3197785 - protein, 25 aa, Giardia lamblia
SRGDTALILACKRGDRRITKLLAPI

SEQ ID NO: 3197786 - protein, 27 aa, Giardia lamblia
SRGELLSYIYISLSLRRWLNIQQSSSP

SEQ ID NO: 3197787 - protein, 25 aa, Giardia lamblia
SRGENALFWAIRNNDLTYIDKLIVH

SEQ ID NO: 3197788 - protein, 26 aa, Giardia lamblia
SRGGHHLFHYQGCAPRAPLSWSHSTH

SEQ ID NO: 3197789 - protein, 24 aa, Giardia lamblia
SRGQILFNLFSNLVKLSYANKHLM

SEQ ID NO: 3197790 - protein, 24 aa, Giardia lamblia
SRGRTALMYAAYAGNLRVVELLLQ

SEQ ID NO: 3197791 - protein, 23 aa, Giardia lamblia
SRGYLEIASLLRGSTPSVNGCND

SEQ ID NO: 3197792 - protein, 21 aa, Giardia lamblia
SRHIVYTLCPRYLAGFCPEGP

SEQ ID NO: 3197793 - protein, 35 aa, Giardia lamblia
SRIEVSLLALFVQSFEELAFIMTGRRSRPLDMSAY

SEQ ID NO: 3197794 - protein, 21 aa, Giardia lamblia
SRITMPLATVCKYHLAGSGAA

SEQ ID NO: 3197795 - protein, 24 aa, Giardia lamblia
SRKDVLKKPAALLPQHFEVLDLAP

SEQ ID NO: 3197796 - protein, 17 aa, Giardia lamblia
SRKHKLLNRLHMAIMGM

SEQ ID NO: 3197797 - protein, 17 aa, Giardia lamblia
SRKKQLLPHLMTVLPLA

SEQ ID NO: 3197798 - protein, 23 aa, Giardia lamblia
SRKLLRTSPYRKAFSKSPIKALV

SEQ ID NO: 3197799 - protein, 22 aa, Giardia lamblia
SRKLMYYKCFPVHTAEYRAPEL

SEQ ID NO: 3197800 - protein, 30 aa, Giardia lamblia
SRKNFQLVDTLYLLRMLAMVQQGKELDDEV

SEQ ID NO: 3197801 - protein, 22 aa, Giardia lamblia
SRKRSMIFLSKLTEIVRKQRSE

SEQ ID NO: 3197802 - protein, 18 aa, Giardia lamblia
SRLDIKLVPIGYEPTHML

SEQ ID NO: 3197803 - protein, 27 aa, Giardia lamblia
SRLIKDSRFLLYYRAKKYKTSDNITSV

SEQ ID NO: 3197804 - protein, 19 aa, Giardia lamblia
SRLLILYSSGRIDLFSTAA

SEQ ID NO: 3197805 - protein, 34 aa, Giardia lamblia
SRLNPYKQLFSRRTLLIDLVFLSSHYKIANLIKR

SEQ ID NO: 3197806 - protein, 18 aa, Giardia lamblia
SRLPKFKRSYTATSPCLT

SEQ ID NO: 3197807 - protein, 17 aa, Giardia lamblia
SRLPLTDEIRRLLEEHK

SEQ ID NO: 3197808 - protein, 18 aa, Giardia lamblia
SRLPQKIDFVIHLAAAVS

SEQ ID NO: 3197809 - protein, 19 aa, Giardia lamblia
SRLQLLHQAVKDLDILIQK

SEQ ID NO: 3197810 - protein, 29 aa, Giardia lamblia
SRLQTINIIMPLMKYSLKKLIQSHRRRRE

SEQ ID NO: 3197811 - protein, 20 aa, Giardia lamblia
SRLRDVFYLHTLHNLAIIYY

SEQ ID NO: 3197812 - protein, 19 aa, Giardia lamblia
SRMIASLSLQLEEVKLSKL

SEQ ID NO: 3197813 - protein, 26 aa, Giardia lamblia
SRNIIHRDLKLLNFLLAADGTVKLGD

SEQ ID NO: 3197814 - protein, 31 aa, Giardia lamblia
SRNMPKVITEPFLPVLLLHNELAISLHELPA

SEQ ID NO: 3197815 - protein, 25 aa, Giardia lamblia
SRNSFFDRTLCIQLAFMSSDYTAFK

SEQ ID NO: 3197816 - protein, 29 aa, Giardia lamblia
SRNSLQQILLRHGWLAPRISRPSPSRSSP

SEQ ID NO: 3197817 - protein, 19 aa, Giardia lamblia
SRPFLLICKLRQCSKFVRQ

SEQ ID NO: 3197818 - protein, 18 aa, Giardia lamblia
SRPLLPHHSDGIIFTAVN

SEQ ID NO: 3197819 - protein, 25 aa, Giardia lamblia
SRQLQARYAFILLALAGFDDVDHII

SEQ ID NO: 3197820 - protein, 18 aa, Giardia lamblia
SRQLSILERNQLIKEQEE

SEQ ID NO: 3197821 - protein, 18 aa, Giardia lamblia
SRQPGFVLDRGTEANLQN

SEQ ID NO: 3197822 - protein, 18 aa, Giardia lamblia
SRRILFDKEPDLISHTPH

SEQ ID NO: 3197823 - protein, 21 aa, Giardia lamblia
SRRKGMLLDRTIPQTFRSTSV

SEQ ID NO: 3197824 - protein, 17 aa, Giardia lamblia
SRRNDLLRLLLERYELL

SEQ ID NO: 3197825 - protein, 31 aa, Giardia lamblia
SRRNICCLTGTWSPDIFALMNNRTLLPTDIE

SEQ ID NO: 3197826 - protein, 35 aa, Giardia lamblia
SRRPPNLDYMLLLQGKLNNLIPYFEDTRSTSAISG

SEQ ID NO: 3197827 - protein, 28 aa, Giardia lamblia
SRRVNAIEYILLPKLENTIKWITDSLEE

SEQ ID NO: 3197828 - protein, 30 aa, Giardia lamblia
SRSCPTDIRLLLLKCLSLNPANRPSVLEIA

SEQ ID NO: 3197829 - protein, 24 aa, Giardia lamblia
SRSEGEIVDLYRAFASGLVSAYST

SEQ ID NO: 3197830 - protein, 26 aa, Giardia lamblia
SRSGDILITFLIDPLLFIEKELQLQQ

SEQ ID NO: 3197831 - protein, 21 aa, Giardia lamblia
SRSHCIVFLRILDTATGQASG

SEQ ID NO: 3197832 - protein, 23 aa, Giardia lamblia
SRSHSIFTICLIVKETAPSSNNN

SEQ ID NO: 3197833 - protein, 25 aa, Giardia lamblia
SRSHSVFTIMFKKITIKHNSSGKIC

SEQ ID NO: 3197834 - protein, 25 aa, Giardia lamblia
SRSHTVFLIEITSYRETAKGTRTAR

SEQ ID NO: 3197835 - protein, 24 aa, Giardia lamblia
SRSILATSSLMYERDIDRVREQYE

SEQ ID NO: 3197836 - protein, 17 aa, Giardia lamblia
SRSILICQLYSQAVLNI

SEQ ID NO: 3197837 - protein, 24 aa, Giardia lamblia
SRSKSPAIYTPQSLHFQYSSNQPS

SEQ ID NO: 3197838 - protein, 28 aa, Giardia lamblia
SRSLLTQFVFIDFHDGVYKIGLDSLSRH

SEQ ID NO: 3197839 - protein, 19 aa, Giardia lamblia
SRSLNPFESALLGSLALAN

SEQ ID NO: 3197840 - protein, 23 aa, Giardia lamblia
SRSPISFRFRYGHKDLQVILPSV

SEQ ID NO: 3197841 - protein, 27 aa, Giardia lamblia
SRSVLDDSLLDYPFDTSNKLVGASRAL

SEQ ID NO: 3197842 - protein, 35 aa, Giardia lamblia
SRSVVLLAGYLVHRFHWPPHRALQFITTKRFSSKP

SEQ ID NO: 3197843 - protein, 45 aa, Giardia lamblia
SRTEPLRPDLLSFRPRTAPAFGMLPLHSPAHLRLLYNTPMTIERE

SEQ ID NO: 3197844 - protein, 24 aa, Giardia lamblia
SRTISTLHKLFTDLDMIQVPTEQA

SEQ ID NO: 3197845 - protein, 20 aa, Giardia lamblia
SRTSLILALATLADAYLTRL

SEQ ID NO: 3197846 - protein, 26 aa, Giardia lamblia
SRTSLISLCLGLVKYWISTCCGYDFS

SEQ ID NO: 3197847 - protein, 17 aa, Giardia lamblia
SRVCLMAIVRRAFLLSI

SEQ ID NO: 3197848 - protein, 19 aa, Giardia lamblia
SRVIPLVESIGLSTLSTAP

SEQ ID NO: 3197849 - protein, 27 aa, Giardia lamblia
SRVPYYISQLLNLFQHRIVDSLTVNLL

SEQ ID NO: 3197850 - protein, 18 aa, Giardia lamblia
SRWMPKKGTIGFGKYRIA

SEQ ID NO: 3197851 - protein, 26 aa, Giardia lamblia
SRWSCAQLLEHPWIKSVDNAPLDLSD

SEQ ID NO: 3197852 - protein, 23 aa, Giardia lamblia
SRYRLRLERILAKCKKICINPDD

SEQ ID NO: 3197853 - protein, 20 aa, Giardia lamblia
SRYSYANGPFFAEGERIKAS

SEQ ID NO: 3197854 - protein, 33 aa, Giardia lamblia
SRYTLKQACFLMLVLRFAPLPKVVEMMDKPAIS

SEQ ID NO: 3197855 - protein, 23 aa, Giardia lamblia
SSADLQIDKALSSSWYDLTVAEI

SEQ ID NO: 3197856 - protein, 27 aa, Giardia lamblia
SSADMPYTAHVLFSLLRDETHAQLTRV

SEQ ID NO: 3197857 - protein, 27 aa, Giardia lamblia
SSAHNYNRPLTISYGLPEVLSVESVRH

SEQ ID NO: 3197858 - protein, 23 aa, Giardia lamblia
SSAICFMEVVFYFMQNERVFATQ

SEQ ID NO: 3197859 - protein, 19 aa, Giardia lamblia
SSAILPLLERKDTEIRYLQ

SEQ ID NO: 3197860 - protein, 25 aa, Giardia lamblia
SSAKNLPLPAAPVLEEPSLATGTDD

SEQ ID NO: 3197861 - protein, 28 aa, Giardia lamblia
SSANKEMIDLILLKDAVLLKTELHMTAV

SEQ ID NO: 3197862 - protein, 29 aa, Giardia lamblia
SSAPRYISTYLDPLARYLFPEPDDAIMQY

SEQ ID NO: 3197863 - protein, 18 aa, Giardia lamblia
SSAQDITRFPNCPTSLVI

SEQ ID NO: 3197864 - protein, 24 aa, Giardia lamblia
SSATDLWLLSYYSKCKSASLSFIY

SEQ ID NO: 3197865 - protein, 22 aa, Giardia lamblia
SSATLEMYIGGLNYQEIDLQHH

SEQ ID NO: 3197866 - protein, 32 aa, Giardia lamblia
SSAYYFNKQLPLQTALPYKAIYDLPRVAWANS

SEQ ID NO: 3197867 - protein, 17 aa, Giardia lamblia
SSCPALCELVKAVIEKK

SEQ ID NO: 3197868 - protein, 23 aa, Giardia lamblia
SSCPSFEVILNQIIAHCGEGSER

SEQ ID NO: 3197869 - protein, 29 aa, Giardia lamblia
SSDAPLAKLHTWIGPAFKLPTNTQKSGAS

SEQ ID NO: 3197870 - protein, 29 aa, Giardia lamblia
SSDIGVFTLLTNRYALVAPSGAMNYYSAI

SEQ ID NO: 3197871 - protein, 38 aa, Giardia lamblia
SSDKALLKTKLSLGLSDCYLIMEGLLAAKDIGQYILLN

SEQ ID NO: 3197872 - protein, 26 aa, Giardia lamblia
SSDKGIVLQLLQGNKLFLIAVGDNIV

SEQ ID NO: 3197873 - protein, 24 aa, Giardia lamblia
SSDLNFGILLQMHRMNLDAVECIR

SEQ ID NO: 3197874 - protein, 24 aa, Giardia lamblia
SSDLQFLLPHLPSPELNYNSAKYL

SEQ ID NO: 3197875 - protein, 20 aa, Giardia lamblia
SSDLSLLTPLPTPIGINQTT

SEQ ID NO: 3197876 - protein, 22 aa, Giardia lamblia
SSDNLIMAPGRQTDLMYAAEDN

SEQ ID NO: 3197877 - protein, 18 aa, Giardia lamblia
SSDTFDFGKLGVQGLLVP

SEQ ID NO: 3197878 - protein, 25 aa, Giardia lamblia
SSDTLPIIVPLDKGASTRSASGVSS

SEQ ID NO: 3197879 - protein, 34 aa, Giardia lamblia
SSDWLAEKKLFTNTLLRFLINSVSRKNELLAALS

SEQ ID NO: 3197880 - protein, 26 aa, Giardia lamblia
SSEADKIFSVLYVIQMWSGAIKMPWT

SEQ ID NO: 3197881 - protein, 19 aa, Giardia lamblia
SSECVLNWPTTRLLLCLVC

SEQ ID NO: 3197882 - protein, 26 aa, Giardia lamblia
SSEGDVLIPVPFQLADQPPGSIESLA

SEQ ID NO: 3197883 - protein, 24 aa, Giardia lamblia
SSEGTFYTFNWASCRITEVAKLES

SEQ ID NO: 3197884 - protein, 18 aa, Giardia lamblia
SSELLFPGIGGNSPLIHV

SEQ ID NO: 3197885 - protein, 25 aa, Giardia lamblia
SSELWYFPPFFTLQQKIEQADVCTE

SEQ ID NO: 3197886 - protein, 30 aa, Giardia lamblia
SSERPERKLRLLIIYAQFLHALCGPRGTIL

SEQ ID NO: 3197887 - protein, 24 aa, Giardia lamblia
SSERRHFFIPGNTFPFCSTSLPMV

SEQ ID NO: 3197888 - protein, 24 aa, Giardia lamblia
SSEYMFLMMVAPVGPYYRGGLKSV

SEQ ID NO: 3197889 - protein, 21 aa, Giardia lamblia
SSFCREGIDAFQILSFAATNQ

SEQ ID NO: 3197890 - protein, 26 aa, Giardia lamblia
SSFDWESQLRFYWDRIQDTILVKQSS

SEQ ID NO: 3197891 - protein, 23 aa, Giardia lamblia
SSFGWIYHLHVPSTLSPMLVPGA

SEQ ID NO: 3197892 - protein, 21 aa, Giardia lamblia
SSFLELNLFGFAGDFSVKCFS

SEQ ID NO: 3197893 - protein, 18 aa, Giardia lamblia
SSFLHTGRSTALIRAVVA

SEQ ID NO: 3197894 - protein, 28 aa, Giardia lamblia
SSFLLASNMRAFRALKCLLTAPQTALSQ

SEQ ID NO: 3197895 - protein, 18 aa, Giardia lamblia
SSFPFPQDLLVPTVSVDE

SEQ ID NO: 3197896 - protein, 21 aa, Giardia lamblia
SSFPQVFLSRYPKLESKLIAS

SEQ ID NO: 3197897 - protein, 23 aa, Giardia lamblia
SSFQMSLNIQAPRPLPAPTLGDF

SEQ ID NO: 3197898 - protein, 18 aa, Giardia lamblia
SSFSYLPHISTEKAEFMI

SEQ ID NO: 3197899 - protein, 34 aa, Giardia lamblia
SSGALLLRLATDSFVFSVPFLAITGIACDAIQLP

SEQ ID NO: 3197900 - protein, 38 aa, Giardia lamblia
SSGIVFRLLEIQPLPRKFVLMFQLEFAQRLAAEPGQDQ

SEQ ID NO: 3197901 - protein, 37 aa, Giardia lamblia
SSGNLQPYIMSTAVLQSLFSLLTRKQQCIGSYGKDLS

SEQ ID NO: 3197902 - protein, 20 aa, Giardia lamblia
SSGRPADLPLARPSGLPPTK

SEQ ID NO: 3197903 - protein, 26 aa, Giardia lamblia
SSGRVIFYYCLESRAAFPVLFSTYRA

SEQ ID NO: 3197904 - protein, 24 aa, Giardia lamblia
SSGSSYTCYFFTADTYQPTAEECQ

SEQ ID NO: 3197905 - protein, 26 aa, Giardia lamblia
SSHIPVASIFNLPLVYVSAIHNHVQG

SEQ ID NO: 3197906 - protein, 20 aa, Giardia lamblia
SSHLRKLKTLDMPCAIQTQT

SEQ ID NO: 3197907 - protein, 18 aa, Giardia lamblia
SSHLYLLRGVFGSGKSRV

SEQ ID NO: 3197908 - protein, 17 aa, Giardia lamblia
SSHMHAAPALSKRPSSA

SEQ ID NO: 3197909 - protein, 25 aa, Giardia lamblia
SSHYPNVFFMRKSRAYSQAFQALVP

SEQ ID NO: 3197910 - protein, 26 aa, Giardia lamblia
SSIDPLVLEIIPTLETLNLSHNKLTN

SEQ ID NO: 3197911 - protein, 21 aa, Giardia lamblia
SSIDYFFGTCNRKLWDPNQSS

SEQ ID NO: 3197912 - protein, 31 aa, Giardia lamblia
SSIEVCSIGFWITIKMFSSMAWVPRGRLLHN

SEQ ID NO: 3197913 - protein, 29 aa, Giardia lamblia
SSIEYQRWFQTSLPFWPIVRSPVGSMEHI

SEQ ID NO: 3197914 - protein, 24 aa, Giardia lamblia
SSIFPLVCRFAATKDIKLKKVVYL

SEQ ID NO: 3197915 - protein, 40 aa, Giardia lamblia
SSIGDHSFTYKNRGLLPRILEFMFQQINARHGFTFDLQFS

SEQ ID NO: 3197916 - protein, 24 aa, Giardia lamblia
SSIKYSLVVFWQDASRVLFALVLK

SEQ ID NO: 3197917 - protein, 22 aa, Giardia lamblia
SSILQAIHFVLGGKAKNIRDNC

SEQ ID NO: 3197918 - protein, 24 aa, Giardia lamblia
SSILRIIMPQDRMQTFAAYSALSS

SEQ ID NO: 3197919 - protein, 30 aa, Giardia lamblia
SSINKAKWFDPTILRGFLSYASVTITARLT

SEQ ID NO: 3197920 - protein, 25 aa, Giardia lamblia
SSIVSPLFARLFSDAVLSHYCIVNM

SEQ ID NO: 3197921 - protein, 22 aa, Giardia lamblia
SSKALRRLSILTRPLPGQVHSL

SEQ ID NO: 3197922 - protein, 27 aa, Giardia lamblia
SSKFAKVYFEFILKNLPSATNLALGVM

SEQ ID NO: 3197923 - protein, 24 aa, Giardia lamblia
SSKFMRLKTILNQAKAGILELRNA

SEQ ID NO: 3197924 - protein, 23 aa, Giardia lamblia
SSKGTLIRVWTTDSFQKIKEVRR

SEQ ID NO: 3197925 - protein, 27 aa, Giardia lamblia
SSKILNSTYFPNFPGQIAQFRAAYDSR

SEQ ID NO: 3197926 - protein, 27 aa, Giardia lamblia
SSKMYSNIWFYYLGGSSLKLQKLASEE

SEQ ID NO: 3197927 - protein, 27 aa, Giardia lamblia
SSKRKRKFLLEIFLSRVDPEIKQSISP

SEQ ID NO: 3197928 - protein, 22 aa, Giardia lamblia
SSKRSSFLQGEGLRRGYQPDQT

SEQ ID NO: 3197929 - protein, 26 aa, Giardia lamblia
SSKSTLPRPLPMNTVALLKAASTVLG

SEQ ID NO: 3197930 - protein, 45 aa, Giardia lamblia
SSKTEGHFLPSLIPLPLLSEHVELLPSPVLLHPLFLFAENCPEDI

SEQ ID NO: 3197931 - protein, 17 aa, Giardia lamblia
SSKVQQLLLATQVVRMI

SEQ ID NO: 3197932 - protein, 23 aa, Giardia lamblia
SSKWDEILAILPNRIIHVPLTYT

SEQ ID NO: 3197933 - protein, 21 aa, Giardia lamblia
SSLAAIPLDILRAICTNCVNL

SEQ ID NO: 3197934 - protein, 25 aa, Giardia lamblia
SSLDKYILRCLPASSLDPEVLKNVM

SEQ ID NO: 3197935 - protein, 31 aa, Giardia lamblia
SSLHSLFRLNLDYIVNFPRIKHIMTNIGTIL

SEQ ID NO: 3197936 - protein, 25 aa, Giardia lamblia
SSLKAEIDKAWKIVDLAREKEGVQT

SEQ ID NO: 3197937 - protein, 27 aa, Giardia lamblia
SSLLEGLSYLHLLENPTPFLSTSSSSL

SEQ ID NO: 3197938 - protein, 21 aa, Giardia lamblia
SSLLIPFFIAHGSSDDAIFHA

SEQ ID NO: 3197939 - protein, 17 aa, Giardia lamblia
SSLLLLTATLTSTACRR

SEQ ID NO: 3197940 - protein, 19 aa, Giardia lamblia
SSLNTYRRALQSISATLKE

SEQ ID NO: 3197941 - protein, 21 aa, Giardia lamblia
SSLPATFPLVTSAMESTEALS

SEQ ID NO: 3197942 - protein, 17 aa, Giardia lamblia
SSLPVTCNLNIGDALMS

SEQ ID NO: 3197943 - protein, 26 aa, Giardia lamblia
SSLQTKYEFPPFPTIPDVAYPCINYS

SEQ ID NO: 3197944 - protein, 25 aa, Giardia lamblia
SSLRAWFSSLLAPKCVILKDSLEVE

SEQ ID NO: 3197945 - protein, 27 aa, Giardia lamblia
SSLSPSLKFVLFTLGSRGSRIVQTKSY

SEQ ID NO: 3197946 - protein, 24 aa, Giardia lamblia
SSLVHYIDSLIAPVRAHFKSTPEL

SEQ ID NO: 3197947 - protein, 19 aa, Giardia lamblia
SSLVYLIQLLPDRAAKLGS

SEQ ID NO: 3197948 - protein, 33 aa, Giardia lamblia
SSLYDIMWNDIAYVSLVLFTLHEVSLSAYDAST

SEQ ID NO: 3197949 - protein, 24 aa, Giardia lamblia
SSMLAKKFFILYQLCEEQLSKQRH

SEQ ID NO: 3197950 - protein, 25 aa, Giardia lamblia
SSMPTIDCLFPPNKNIQVDVILLLY

SEQ ID NO: 3197951 - protein, 25 aa, Giardia lamblia
SSNARIFSQLIKLLKSYKPCVQMRK

SEQ ID NO: 3197952 - protein, 24 aa, Giardia lamblia
SSNDELAAILLAIQGEYTRVAEAS

SEQ ID NO: 3197953 - protein, 27 aa, Giardia lamblia
SSNENQFIHFFSALYPAGAPHTVIARS

SEQ ID NO: 3197954 - protein, 21 aa, Giardia lamblia
SSNFFVLLRRDDGALVLQTAE

SEQ ID NO: 3197955 - protein, 25 aa, Giardia lamblia
SSNIRPLHFTVLSRSLMDTLSLSIA

SEQ ID NO: 3197956 - protein, 25 aa, Giardia lamblia
SSNLDRWFTAVAERQYNFIIAELPT

SEQ ID NO: 3197957 - protein, 17 aa, Giardia lamblia
SSNLTYCYPSHLRKFLR

SEQ ID NO: 3197958 - protein, 23 aa, Giardia lamblia
SSNQNFLVIGSYLELYNEEIRDL

SEQ ID NO: 3197959 - protein, 26 aa, Giardia lamblia
SSPGKSPIKLIYKTPKRSVTRTMMSG

SEQ ID NO: 3197960 - protein, 20 aa, Giardia lamblia
SSPIFLQWLECVYQVMHQRA

SEQ ID NO: 3197961 - protein, 22 aa, Giardia lamblia
SSPIRGVSPINPTYASASTFAS

SEQ ID NO: 3197962 - protein, 17 aa, Giardia lamblia
SSPLDIYFDVRTGILIF

SEQ ID NO: 3197963 - protein, 17 aa, Giardia lamblia
SSPLPLSVPSAMPASSK

SEQ ID NO: 3197964 - protein, 29 aa, Giardia lamblia
SSPLQRRIDFYRMWASLFVQPESDLGTGD

SEQ ID NO: 3197965 - protein, 18 aa, Giardia lamblia
SSPPLPLGASNFIRRRRC

SEQ ID NO: 3197966 - protein, 23 aa, Giardia lamblia
SSPQSSILAPDSLRFLFEESPQQ

SEQ ID NO: 3197967 - protein, 22 aa, Giardia lamblia
SSPRRISHAPPVPPSAPNIGQA

SEQ ID NO: 3197968 - protein, 26 aa, Giardia lamblia
SSPSALLGSLLLRGYTMSALSCPRGC

SEQ ID NO: 3197969 - protein, 21 aa, Giardia lamblia
SSPSHILHCALNLTSKALTFN

SEQ ID NO: 3197970 - protein, 29 aa, Giardia lamblia
SSPTILTLLARNHAFLEDAIWDIATNLVE

SEQ ID NO: 3197971 - protein, 22 aa, Giardia lamblia
SSPVMYVALIQDLPPVNGEEKT

SEQ ID NO: 3197972 - protein, 24 aa, Giardia lamblia
SSPYAIWNLYGFSTNVLHSCSSYS

SEQ ID NO: 3197973 - protein, 18 aa, Giardia lamblia
SSPYSMIFLKSGSSECLS

SEQ ID NO: 3197974 - protein, 35 aa, Giardia lamblia
SSQFHLLSEWVHLSPLLVLKTDMLLRSATGWFTAI

SEQ ID NO: 3197975 - protein, 17 aa, Giardia lamblia
SSQLLLTPGINASLGVW

SEQ ID NO: 3197976 - protein, 26 aa, Giardia lamblia
SSQLYILQNINKLVPLSVLVEASEKL

SEQ ID NO: 3197977 - protein, 48 aa, Giardia lamblia
SSQPISEQLLSFQWLNPPPTKKLLIHGYRPVFRFLDAHHKPLLVKVLE

SEQ ID NO: 3197978 - protein, 17 aa, Giardia lamblia
SSQRYQIVFPEFQLLFD

SEQ ID NO: 3197979 - protein, 25 aa, Giardia lamblia
SSQVLYVKVVYPSSPTILTLLARNH

SEQ ID NO: 3197980 - protein, 24 aa, Giardia lamblia
SSRDLILSLHKQGLLKPIRSDSLL

SEQ ID NO: 3197981 - protein, 20 aa, Giardia lamblia
SSREQYEYNKGYWPETNQIF

SEQ ID NO: 3197982 - protein, 22 aa, Giardia lamblia
SSRLPAGKWLVIRAGVQEADLE

SEQ ID NO: 3197983 - protein, 23 aa, Giardia lamblia
SSRPGPLMTYRTAAPLTSARCIS

SEQ ID NO: 3197984 - protein, 18 aa, Giardia lamblia
SSRPVSISVQTPLSRSAP

SEQ ID NO: 3197985 - protein, 24 aa, Giardia lamblia
SSRRALLHGEFARNSRLTKSQDKL

SEQ ID NO: 3197986 - protein, 28 aa, Giardia lamblia
SSRRGMTSFLTSFNFRYAPPGASLSSAG

SEQ ID NO: 3197987 - protein, 28 aa, Giardia lamblia
SSRTRTVYPAPLPQLPTCSTPFSKKCWT

SEQ ID NO: 3197988 - protein, 20 aa, Giardia lamblia
SSRTSYVEPPIFSAATATAS

SEQ ID NO: 3197989 - protein, 27 aa, Giardia lamblia
SSSAFAPIIRRVIGPSLLNTIAYRDKN

SEQ ID NO: 3197990 - protein, 27 aa, Giardia lamblia
SSSAKDMLPLFYLIGALTVEYHKESRL

SEQ ID NO: 3197991 - protein, 25 aa, Giardia lamblia
SSSEDDFLLPLPQQTHPPIDTQLPL

SEQ ID NO: 3197992 - protein, 24 aa, Giardia lamblia
SSSFLDPVSEFSWMIKKRSETPGK

SEQ ID NO: 3197993 - protein, 22 aa, Giardia lamblia
SSSFLLQHLNLNTVSSLPKVIV

SEQ ID NO: 3197994 - protein, 25 aa, Giardia lamblia
SSSFPAILNGYLKMTKDELLRELQD

SEQ ID NO: 3197995 - protein, 40 aa, Giardia lamblia
SSSIAKPGFLPKMKKMRSFPYAGTNWVRAKGREPLFGGDP

SEQ ID NO: 3197996 - protein, 24 aa, Giardia lamblia
SSSMPIHNSPGIRPPLHVGTNRTT

SEQ ID NO: 3197997 - protein, 31 aa, Giardia lamblia
SSSNDILLYMRKYRVLLPAAEGLLLFNGATS

SEQ ID NO: 3197998 - protein, 17 aa, Giardia lamblia
SSSPMRAIHKPRPLPQH

SEQ ID NO: 3197999 - protein, 28 aa, Giardia lamblia
SSSQGVLLMISNLYHMAGERIPFVLHVA

SEQ ID NO: 3198000 - protein, 23 aa, Giardia lamblia
SSSRIFVLCATNFPWEIDQAMLR

SEQ ID NO: 3198001 - protein, 17 aa, Giardia lamblia
SSSVRAYELANEKLRLK

SEQ ID NO: 3198002 - protein, 28 aa, Giardia lamblia
SSSVRSIPSPPRRPWPASIPAERSCPSK

SEQ ID NO: 3198003 - protein, 28 aa, Giardia lamblia
SSSYTLFNGSFIKLYIFGGRGADSSLND

SEQ ID NO: 3198004 - protein, 24 aa, Giardia lamblia
SSTANLTFFMDDGAALSTVLADLA

SEQ ID NO: 3198005 - protein, 25 aa, Giardia lamblia
SSTCRTLLINRPLSFLPGLSSEVEQ

SEQ ID NO: 3198006 - protein, 25 aa, Giardia lamblia
SSTDARRWAWVSSSNRMDTTARRSR

SEQ ID NO: 3198007 - protein, 23 aa, Giardia lamblia
SSTDRVMLRKRVLPKWHVDEVIH

SEQ ID NO: 3198008 - protein, 31 aa, Giardia lamblia
SSTELSSLLMLLIQLRRLARDHLLQVKAEIS

SEQ ID NO: 3198009 - protein, 23 aa, Giardia lamblia
SSTELTALMWAAANGRTEVVRLL

SEQ ID NO: 3198010 - protein, 23 aa, Giardia lamblia
SSTFPMQIRQYSAALQILEEEIR

SEQ ID NO: 3198011 - protein, 18 aa, Giardia lamblia
SSTHFLTHNNLRGQMIFD

SEQ ID NO: 3198012 - protein, 21 aa, Giardia lamblia
SSTIEQQLKLLLAERQSAAEA

SEQ ID NO: 3198013 - protein, 20 aa, Giardia lamblia
SSTLYKAPPYLIIHLKRFDQ

SEQ ID NO: 3198014 - protein, 23 aa, Giardia lamblia
SSTRPFNGLLSSAARLGETSMID

SEQ ID NO: 3198015 - protein, 27 aa, Giardia lamblia
SSTSDTILLQFNFPFSLLSEESIEKLR

SEQ ID NO: 3198016 - protein, 26 aa, Giardia lamblia
SSTSLLINMWLPTKILRLRVLERNFK

SEQ ID NO: 3198017 - protein, 24 aa, Giardia lamblia
SSTSSCYLYRPPKIVYKDICKCIA

SEQ ID NO: 3198018 - protein, 22 aa, Giardia lamblia
SSTTKRFSVPLSSLRTNIFSDI

SEQ ID NO: 3198019 - protein, 33 aa, Giardia lamblia
SSVCLYDPLVLRNPHIVFPLRVPSPGSQHAELV

SEQ ID NO: 3198020 - protein, 22 aa, Giardia lamblia
SSVDIPCPVVSIPSALPPSAPS

SEQ ID NO: 3198021 - protein, 32 aa, Giardia lamblia
SSVEDVLLNNIIRRLLIFDPISRMSSSELSSI

SEQ ID NO: 3198022 - protein, 26 aa, Giardia lamblia
SSVGTFLFEVPIFSSTMLYTMADMNS

SEQ ID NO: 3198023 - protein, 24 aa, Giardia lamblia
SSVKALIPYEAGLTRPHGWTALMD

SEQ ID NO: 3198024 - protein, 25 aa, Giardia lamblia
SSVLADLLDRSLLTGPTILVASPQE

SEQ ID NO: 3198025 - protein, 26 aa, Giardia lamblia
SSVPAELILSLYASAALASAVACQDY

SEQ ID NO: 3198026 - protein, 24 aa, Giardia lamblia
SSVPKNLPRWPSKKVTKGISPIAP

SEQ ID NO: 3198027 - protein, 18 aa, Giardia lamblia
SSVQMRRGRHMNQRHFTS

SEQ ID NO: 3198028 - protein, 30 aa, Giardia lamblia
SSVRRDSGFSPIYGFRPPNILSDNSSKARV

SEQ ID NO: 3198029 - protein, 40 aa, Giardia lamblia
SSVSDWIIRLYYSFQDDLYLYLVMEFAIGGDLMGLLIRVD

SEQ ID NO: 3198030 - protein, 36 aa, Giardia lamblia
SSVSYNLMHMFNSVPYFLSIAIPVTPLPGTCEGTIA

SEQ ID NO: 3198031 - protein, 19 aa, Giardia lamblia
SSWTPLMHAAADGGIEAVK

SEQ ID NO: 3198032 - protein, 24 aa, Giardia lamblia
SSYILHGLLEFLISNSPVAKFLRS

SEQ ID NO: 3198033 - protein, 17 aa, Giardia lamblia
SSYIQRLAVVKFINYAE

SEQ ID NO: 3198034 - protein, 20 aa, Giardia lamblia
SSYNLGSLLLSMRMIEPAEQ

SEQ ID NO: 3198035 - protein, 31 aa, Giardia lamblia
SSYPLHDALYAADLLFRIVPYPDNLERKFGL

SEQ ID NO: 3198036 - protein, 18 aa, Giardia lamblia
STAAICFILDNLVVSANC

SEQ ID NO: 3198037 - protein, 38 aa, Giardia lamblia
STAEIARLRSLLYYNEQKLKAWAKIKSKKFRKVHNRDK

SEQ ID NO: 3198038 - protein, 27 aa, Giardia lamblia
STAELRMLYPFPEISLKYSNELYNVVQ

SEQ ID NO: 3198039 - protein, 18 aa, Giardia lamblia
STAFYMVKKEKNPEMYEF

SEQ ID NO: 3198040 - protein, 19 aa, Giardia lamblia
STAIFKCLIALKTRNCIIF

SEQ ID NO: 3198041 - protein, 22 aa, Giardia lamblia
STALHLLLQAKRLCPSPASVKG

SEQ ID NO: 3198042 - protein, 23 aa, Giardia lamblia
STAPVSMLLSKYSCLRGASQALL

SEQ ID NO: 3198043 - protein, 17 aa, Giardia lamblia
STARLLPMSPRARRGSI

SEQ ID NO: 3198044 - protein, 22 aa, Giardia lamblia
STARLNAILGVQIGAGGVSLPQ

SEQ ID NO: 3198045 - protein, 23 aa, Giardia lamblia
STASGVLSPGYLPAESLRVSPMK

SEQ ID NO: 3198046 - protein, 27 aa, Giardia lamblia
STATLDYPLGFDYPAIVAPIECGDIFI

SEQ ID NO: 3198047 - protein, 23 aa, Giardia lamblia
STATPFPHLPAESPSLLQLVNHS

SEQ ID NO: 3198048 - protein, 19 aa, Giardia lamblia
STCRLLLDGGPALCLPLCL

SEQ ID NO: 3198049 - protein, 25 aa, Giardia lamblia
STDIPPFAVFSFNAKGKPTARFTKT

SEQ ID NO: 3198050 - protein, 24 aa, Giardia lamblia
STDMRILCLIILTCLTTDQAVLEA

SEQ ID NO: 3198051 - protein, 29 aa, Giardia lamblia
STDQDTRSYWLLRFAFASDKDAWAWHMNC

SEQ ID NO: 3198052 - protein, 23 aa, Giardia lamblia
STDSILFRFENRIKKILKLTEDA

SEQ ID NO: 3198053 - protein, 21 aa, Giardia lamblia
STEADYLEFLRELESRAGPIN

SEQ ID NO: 3198054 - protein, 18 aa, Giardia lamblia
STECLYARKLPVLNADEL

SEQ ID NO: 3198055 - protein, 24 aa, Giardia lamblia
STEGLTYWFNMKCLIDTKNYEIYT

SEQ ID NO: 3198056 - protein, 28 aa, Giardia lamblia
STETTVIITCRPLALFAVKPVSRSVATL

SEQ ID NO: 3198057 - protein, 29 aa, Giardia lamblia
STEYLDALKGMRIIKYYPYLDTERAEIRT

SEQ ID NO: 3198058 - protein, 19 aa, Giardia lamblia
STFCLPRVHGWMSLDSVVI

SEQ ID NO: 3198059 - protein, 22 aa, Giardia lamblia
STFPVALARFTPNPSYFVSASG

SEQ ID NO: 3198060 - protein, 29 aa, Giardia lamblia
STFQEGFRCGFIWGVRFYDPDPSCAVADG

SEQ ID NO: 3198061 - protein, 21 aa, Giardia lamblia
STFVNGFINYLRFDKMPESPE

SEQ ID NO: 3198062 - protein, 21 aa, Giardia lamblia
STGFTYTSWLTADPINVVEAM

SEQ ID NO: 3198063 - protein, 32 aa, Giardia lamblia
STGIERGQFRLVFRGRIISNLPPGHLINECGI

SEQ ID NO: 3198064 - protein, 23 aa, Giardia lamblia
STGMVYLVGKLLRRKGNKKVKRF

SEQ ID NO: 3198065 - protein, 17 aa, Giardia lamblia
STGPNTMYWAGWMAKVA

SEQ ID NO: 3198066 - protein, 25 aa, Giardia lamblia
STGQAPLPLTPLNANILAQSSSKPL

SEQ ID NO: 3198067 - protein, 26 aa, Giardia lamblia
STGQTALMLVAQQPSSKLASLLLPHS

SEQ ID NO: 3198068 - protein, 20 aa, Giardia lamblia
STGRLWALYASTAQSKGASS

SEQ ID NO: 3198069 - protein, 25 aa, Giardia lamblia
STHALFSVILFKKDQQRCLDYFREK

SEQ ID NO: 3198070 - protein, 24 aa, Giardia lamblia
STHDTYPLRAWWEHNRSAACAFWR

SEQ ID NO: 3198071 - protein, 25 aa, Giardia lamblia
STHEIDLLNILRQGGIFLSERMLLE

SEQ ID NO: 3198072 - protein, 17 aa, Giardia lamblia
STHVFMRAARTLYPLSI

SEQ ID NO: 3198073 - protein, 33 aa, Giardia lamblia
STIASVLVLVRRIWAIDGRIFPSVFLDGELLVR

SEQ ID NO: 3198074 - protein, 29 aa, Giardia lamblia
STIDKFVIHPVFFGRRRALENEFLLEMFR

SEQ ID NO: 3198075 - protein, 25 aa, Giardia lamblia
STIEANLLPMPMAIDGDLQTQEKAV

SEQ ID NO: 3198076 - protein, 30 aa, Giardia lamblia
STIEMIMPFRGIIIIEGIHALNPLLSRRIP

SEQ ID NO: 3198077 - protein, 21 aa, Giardia lamblia
STILATILRCNVPYLCDQIFD

SEQ ID NO: 3198078 - protein, 17 aa, Giardia lamblia
STILNDFADKHPQIRRC

SEQ ID NO: 3198079 - protein, 23 aa, Giardia lamblia
STINPVLSALHKPASKTCSSTIT

SEQ ID NO: 3198080 - protein, 34 aa, Giardia lamblia
STIRSNVIQFIGAMWYILMNPPYDNLSAQLKSFL

SEQ ID NO: 3198081 - protein, 22 aa, Giardia lamblia
STISRRTRLSRLSSVGGYTDLS

SEQ ID NO: 3198082 - protein, 26 aa, Giardia lamblia
STKFVSRWMDLMCNLALEAVSIVARG

SEQ ID NO: 3198083 - protein, 28 aa, Giardia lamblia
STKGYYTPLTKFTGPDWYRCFESFMREN

SEQ ID NO: 3198084 - protein, 26 aa, Giardia lamblia
STKLGVPLSLVYTPLKAVANPYRASY

SEQ ID NO: 3198085 - protein, 17 aa, Giardia lamblia
STKPSAPAPPPPPSKPT

SEQ ID NO: 3198086 - protein, 26 aa, Giardia lamblia
STLADLLCCIILCKIKGFATKDRISE

SEQ ID NO: 3198087 - protein, 21 aa, Giardia lamblia
STLALLTAGFRIEDSWLLDRP

SEQ ID NO: 3198088 - protein, 33 aa, Giardia lamblia
STLDSMYIYSLDFFKMLFTRTLSKLQSLADETS

SEQ ID NO: 3198089 - protein, 21 aa, Giardia lamblia
STLEPLLQKFTGIIGHLIVVE

SEQ ID NO: 3198090 - protein, 24 aa, Giardia lamblia
STLGRNWFLEMFSATTVAGPSRNS

SEQ ID NO: 3198091 - protein, 21 aa, Giardia lamblia
STLIKIMRLVSRNATSTGAIG

SEQ ID NO: 3198092 - protein, 24 aa, Giardia lamblia
STLIQTMGLYPHFGEHEALLKEVV

SEQ ID NO: 3198093 - protein, 21 aa, Giardia lamblia
STLKALLPPNSDKAQLITEDD

SEQ ID NO: 3198094 - protein, 24 aa, Giardia lamblia
STLWDIAAQLFNLLAVMHSPLDLE

SEQ ID NO: 3198095 - protein, 18 aa, Giardia lamblia
STNKFLECLTLNNCGLTV

SEQ ID NO: 3198096 - protein, 31 aa, Giardia lamblia
STNNHLEIKFKWFTILLGRLPRIVEMDGNPG

SEQ ID NO: 3198097 - protein, 25 aa, Giardia lamblia
STNRSFVPFRDSPLTRLLTESLSGN

SEQ ID NO: 3198098 - protein, 35 aa, Giardia lamblia
STNSKSWKQIYKTLLLIEHLLINASPDTVRDIQSH

SEQ ID NO: 3198099 - protein, 20 aa, Giardia lamblia
STNSYLAYKKAIMQNVTSAH

SEQ ID NO: 3198100 - protein, 36 aa, Giardia lamblia
STNTALIGLIGNLFCHVYLAIMRKYRGAPNGGELVG

SEQ ID NO: 3198101 - protein, 24 aa, Giardia lamblia
STPGPVLHALTTGLLDIASSGQTV

SEQ ID NO: 3198102 - protein, 35 aa, Giardia lamblia
STPLHYAVRNLFPESIPFLVHYLKDKPDGRGMTAL

SEQ ID NO: 3198103 - protein, 22 aa, Giardia lamblia
STPLPMQAVVQRLQEFEKVKEQ

SEQ ID NO: 3198104 - protein, 31 aa, Giardia lamblia
STPNPFSPFDYRTNINTRFFGDRLNVMSANK

SEQ ID NO: 3198105 - protein, 25 aa, Giardia lamblia
STPPSLPQQGLLYTNYPDLGKNTKV

SEQ ID NO: 3198106 - protein, 33 aa, Giardia lamblia
STPSSTLTPVPASGAFPPLPSAMRLSTTATVQQ

SEQ ID NO: 3198107 - protein, 24 aa, Giardia lamblia
STQDLTVEMLFTHPVQQPSARYTD

SEQ ID NO: 3198108 - protein, 24 aa, Giardia lamblia
STQGFILSVFPDCTEMHLPTTVVD

SEQ ID NO: 3198109 - protein, 24 aa, Giardia lamblia
STQKATLLMRYIIEQGIGFVRAED

SEQ ID NO: 3198110 - protein, 25 aa, Giardia lamblia
STQKGSFAFRLGLPEAWRGLRDEAL

SEQ ID NO: 3198111 - protein, 20 aa, Giardia lamblia
STQLVVYLTPMKALASEMTT

SEQ ID NO: 3198112 - protein, 27 aa, Giardia lamblia
STQTPGRLRPSQPVSLLASLSGSRVSN

SEQ ID NO: 3198113 - protein, 17 aa, Giardia lamblia
STQTWYYNLDTNTWSIN

SEQ ID NO: 3198114 - protein, 30 aa, Giardia lamblia
STREALLFVLELVLYILKLDDERMKRLSDV

SEQ ID NO: 3198115 - protein, 19 aa, Giardia lamblia
STREIVVKDFLTMNKNMDN

SEQ ID NO: 3198116 - protein, 22 aa, Giardia lamblia
STRIKYEKLISKYIGNLVAAGK

SEQ ID NO: 3198117 - protein, 28 aa, Giardia lamblia
STRLPMHKLIRVKIGLYVGKNVYYMGTT

SEQ ID NO: 3198118 - protein, 23 aa, Giardia lamblia
STRNLVDVILSEPVIHLAPGVRN

SEQ ID NO: 3198119 - protein, 25 aa, Giardia lamblia
STRRLYLHHVIRYLNKLLISDMQPQ

SEQ ID NO: 3198120 - protein, 23 aa, Giardia lamblia
STRRPKWFVAINEKAQRVLNRGK

SEQ ID NO: 3198121 - protein, 24 aa, Giardia lamblia
STSFLREIYSLSALTLRLADSLSD

SEQ ID NO: 3198122 - protein, 23 aa, Giardia lamblia
STSFTGYQPLPELPSTLSQGINN

SEQ ID NO: 3198123 - protein, 37 aa, Giardia lamblia
STSGWNDLFLAAFTHNAALVARTISLVSTRDALGRTA

SEQ ID NO: 3198124 - protein, 26 aa, Giardia lamblia
STSHTLAMSLFGDATTALPHTERYWT

SEQ ID NO: 3198125 - protein, 24 aa, Giardia lamblia
STSIQNIPPIKPPSNHQTPRRSRS

SEQ ID NO: 3198126 - protein, 37 aa, Giardia lamblia
STSKHGFVPNNYLIGKILPQEPFIKGPSGPINMGEPG

SEQ ID NO: 3198127 - protein, 19 aa, Giardia lamblia
STSLERLKRFARSRGSLSR

SEQ ID NO: 3198128 - protein, 30 aa, Giardia lamblia
STSPVKKYLWLSFEQLPYKSFDELLSKTDC

SEQ ID NO: 3198129 - protein, 22 aa, Giardia lamblia
STSRYMPTLEDLTALFIKREVR

SEQ ID NO: 3198130 - protein, 20 aa, Giardia lamblia
STSSRFWRPLDSSCLCVSHQ

SEQ ID NO: 3198131 - protein, 24 aa, Giardia lamblia
STSTYKIVLWFDLERFHVKEFEKL

SEQ ID NO: 3198132 - protein, 25 aa, Giardia lamblia
STSVYVLPLMIPISARIVPVSKEFY

SEQ ID NO: 3198133 - protein, 20 aa, Giardia lamblia
STTIPQFDPLDMLHSIRLRI

SEQ ID NO: 3198134 - protein, 26 aa, Giardia lamblia
STTPFSPLSIWKLFAQVVAGLLQLYG

SEQ ID NO: 3198135 - protein, 25 aa, Giardia lamblia
STTSDLLILLFDATTMEYICPPGKQ

SEQ ID NO: 3198136 - protein, 25 aa, Giardia lamblia
STTSEILLPFIKAGLYNVLRRNSSG

SEQ ID NO: 3198137 - protein, 30 aa, Giardia lamblia
STTSKLSCLPRYLFSLPLSSIVCQILNTMR

SEQ ID NO: 3198138 - protein, 25 aa, Giardia lamblia
STTSYRAFYTTWIKFDRAPRNNING

SEQ ID NO: 3198139 - protein, 26 aa, Giardia lamblia
STVIGRFCQEYPLCASLYIGQIVREE

SEQ ID NO: 3198140 - protein, 24 aa, Giardia lamblia
STVLNACFLQLKIAKKYDLSSQYS

SEQ ID NO: 3198141 - protein, 24 aa, Giardia lamblia
STVMRAIKKILKLDPYKVGDDGRS

SEQ ID NO: 3198142 - protein, 20 aa, Giardia lamblia
STVNNLLLDTDMRKIFAIGD

SEQ ID NO: 3198143 - protein, 28 aa, Giardia lamblia
STVPIVTPQFLQFKTMSPKRLRSPQHKR

SEQ ID NO: 3198144 - protein, 18 aa, Giardia lamblia
STWQLGAGCLVRCAARPL

SEQ ID NO: 3198145 - protein, 17 aa, Giardia lamblia
STWTPPDTSSFPSEVAY

SEQ ID NO: 3198146 - protein, 26 aa, Giardia lamblia
STYTNLMKIALLNKPAYIDEYLDAEA

SEQ ID NO: 3198147 - protein, 18 aa, Giardia lamblia
SVAFSRVSPKLFAAGNAS

SEQ ID NO: 3198148 - protein, 23 aa, Giardia lamblia
SVALCDMAYLFPNSTPYSSSKYS

SEQ ID NO: 3198149 - protein, 26 aa, Giardia lamblia
SVAQIENILLNPVLERMIDKCPLCNM

SEQ ID NO: 3198150 - protein, 20 aa, Giardia lamblia
SVAQMLAEKRKEWDKRQKEL

SEQ ID NO: 3198151 - protein, 26 aa, Giardia lamblia
SVARAEYDILVRKLADLEHVLGAAKA

SEQ ID NO: 3198152 - protein, 24 aa, Giardia lamblia
SVARTTELAFNRVRKALATRTPEQ

SEQ ID NO: 3198153 - protein, 27 aa, Giardia lamblia
SVASDFQLAFQPPVPEKWEPLDTVQHL

SEQ ID NO: 3198154 - protein, 19 aa, Giardia lamblia
SVAVWFPRGKRNALPRTIC

SEQ ID NO: 3198155 - protein, 28 aa, Giardia lamblia
SVAVYPPMFRDIFQKLLAHTGFGGPTTG

SEQ ID NO: 3198156 - protein, 18 aa, Giardia lamblia
SVAYIWHATNQTLIGVLT

SEQ ID NO: 3198157 - protein, 23 aa, Giardia lamblia
SVAYKNVIGPRRAAWRIVSSIEA

SEQ ID NO: 3198158 - protein, 21 aa, Giardia lamblia
SVCATLLFNGGDYCRVTIEID

SEQ ID NO: 3198159 - protein, 23 aa, Giardia lamblia
SVDALRALLSAYQIARDPSGTSE

SEQ ID NO: 3198160 - protein, 17 aa, Giardia lamblia
SVDDIKVCLIKQAEQWS

SEQ ID NO: 3198161 - protein, 18 aa, Giardia lamblia
SVDLAPMAPLPRVTQIQG

SEQ ID NO: 3198162 - protein, 24 aa, Giardia lamblia
SVDPMYQFSLEAYMKLFINSINNS

SEQ ID NO: 3198163 - protein, 21 aa, Giardia lamblia
SVDVTLLRQQLAEARGQAPET

SEQ ID NO: 3198164 - protein, 35 aa, Giardia lamblia
SVEERLNNLLQVNSIPLLPPTNATFSGTATAGPLG

SEQ ID NO: 3198165 - protein, 26 aa, Giardia lamblia
SVEGPSLPLRFDFSKPDYTVSIATLD

SEQ ID NO: 3198166 - protein, 25 aa, Giardia lamblia
SVEKNIRVKLLARLSPNASGAEIRS

SEQ ID NO: 3198167 - protein, 24 aa, Giardia lamblia
SVEPIEILLSSLPAPWSVATSLSE

SEQ ID NO: 3198168 - protein, 18 aa, Giardia lamblia
SVEPPPYASLSAKKPKSG

SEQ ID NO: 3198169 - protein, 20 aa, Giardia lamblia
SVERLKFVIVLGATNFPEAI

SEQ ID NO: 3198170 - protein, 18 aa, Giardia lamblia
SVEYFFVIMFTQGNGFVK

SEQ ID NO: 3198171 - protein, 21 aa, Giardia lamblia
SVFAFIYVDHFSDAPSSAISG

SEQ ID NO: 3198172 - protein, 19 aa, Giardia lamblia
SVFGCSEVIFLGVAGGIQG

SEQ ID NO: 3198173 - protein, 20 aa, Giardia lamblia
SVFPFHAVTQNWLMTSALLY

SEQ ID NO: 3198174 - protein, 27 aa, Giardia lamblia
SVFPPSCLSVFSLKNPFYPERIIKTPV

SEQ ID NO: 3198175 - protein, 19 aa, Giardia lamblia
SVFQLGWPLVYQNQGVVRN

SEQ ID NO: 3198176 - protein, 21 aa, Giardia lamblia
SVGAVFYELLTLHPFAGDYPA

SEQ ID NO: 3198177 - protein, 18 aa, Giardia lamblia
SVGAYPSSIYLEETDELD

SEQ ID NO: 3198178 - protein, 22 aa, Giardia lamblia
SVGCVIYEFLTGHILFPTVDMS

SEQ ID NO: 3198179 - protein, 28 aa, Giardia lamblia
SVGISRVTWHPRQPWLLCSGTDGVLRLF

SEQ ID NO: 3198180 - protein, 17 aa, Giardia lamblia
SVGKTCLLFVYANNSFP

SEQ ID NO: 3198181 - protein, 18 aa, Giardia lamblia
SVGLPPPSTTYAGGYTPF

SEQ ID NO: 3198182 - protein, 26 aa, Giardia lamblia
SVGNVHCLMLLLGELGILPKNGMTAL

SEQ ID NO: 3198183 - protein, 18 aa, Giardia lamblia
SVGYLPDVITPVSSPRTS

SEQ ID NO: 3198184 - protein, 19 aa, Giardia lamblia
SVHGGEFMVLWGALRANVD

SEQ ID NO: 3198185 - protein, 26 aa, Giardia lamblia
SVHPVPHRASYQPEPGFPLAANEKDL

SEQ ID NO: 3198186 - protein, 25 aa, Giardia lamblia
SVIEKSWYEWWEAAGFFSPDMQKNI

SEQ ID NO: 3198187 - protein, 18 aa, Giardia lamblia
SVIFINSNLEVKLLILNL

SEQ ID NO: 3198188 - protein, 20 aa, Giardia lamblia
SVIKSSYFEPPVSYPKMQSA

SEQ ID NO: 3198189 - protein, 30 aa, Giardia lamblia
SVIKTQYKELARTLWLQSKPEMVEQVRTER

SEQ ID NO: 3198190 - protein, 24 aa, Giardia lamblia
SVINDYIALLFDSSPGPVVGQEER

SEQ ID NO: 3198191 - protein, 18 aa, Giardia lamblia
SVKNRPHYHPSWRGPEDV

SEQ ID NO: 3198192 - protein, 19 aa, Giardia lamblia
SVKPPPYALVPNYVSSQLG

SEQ ID NO: 3198193 - protein, 26 aa, Giardia lamblia
SVKSLRPLSIFIWQINVYHKHRHPFM

SEQ ID NO: 3198194 - protein, 24 aa, Giardia lamblia
SVLDVPLLAFLRDALIPVDVSADT

SEQ ID NO: 3198195 - protein, 25 aa, Giardia lamblia
SVLEDFIALDRYKQAFYEKTLTNME

SEQ ID NO: 3198196 - protein, 46 aa, Giardia lamblia
SVLEIPLSVRPLIPGPLYIPLSIKIGYLERLILPITAKAYIERPLL

SEQ ID NO: 3198197 - protein, 17 aa, Giardia lamblia
SVLKCINIPKSYKARVA

SEQ ID NO: 3198198 - protein, 17 aa, Giardia lamblia
SVLKKRNDLINALDPRI

SEQ ID NO: 3198199 - protein, 17 aa, Giardia lamblia
SVLLETVILPQQRLRNI

SEQ ID NO: 3198200 - protein, 20 aa, Giardia lamblia
SVLQQMLRYEPLSMKAYASK

SEQ ID NO: 3198201 - protein, 20 aa, Giardia lamblia
SVLRMLVINAIHISVLNARL

SEQ ID NO: 3198202 - protein, 24 aa, Giardia lamblia
SVLSSVFEWRDGCSHFYIIEASNR

SEQ ID NO: 3198203 - protein, 17 aa, Giardia lamblia
SVMKQVAAALAYLHGLS

SEQ ID NO: 3198204 - protein, 18 aa, Giardia lamblia
SVMKQVAAALAYLHGLSG

SEQ ID NO: 3198205 - protein, 19 aa, Giardia lamblia
SVMPLLIKALQSNKPSTAN

SEQ ID NO: 3198206 - protein, 24 aa, Giardia lamblia
SVMSIPYLYQYIKKSNMANAGQVL

SEQ ID NO: 3198207 - protein, 24 aa, Giardia lamblia
SVNDTFIRKVLGYLLKLNPHERIT

SEQ ID NO: 3198208 - protein, 28 aa, Giardia lamblia
SVNEYISLHSVKYFKYRSVCGSLNLFVY

SEQ ID NO: 3198209 - protein, 27 aa, Giardia lamblia
SVNKNTLVNLLRALSYSYKSAESLRLI

SEQ ID NO: 3198210 - protein, 17 aa, Giardia lamblia
SVNLGEIALWHVTNVPV

SEQ ID NO: 3198211 - protein, 38 aa, Giardia lamblia
SVPAIGLLNPVVLTVLILEFIDLLPPEKQIKILHKQPV

SEQ ID NO: 3198212 - protein, 19 aa, Giardia lamblia
SVPAPLQMKKPVKHASRSL

SEQ ID NO: 3198213 - protein, 26 aa, Giardia lamblia
SVPDSIIFQIPTKLNAWYLREGFCAL

SEQ ID NO: 3198214 - protein, 21 aa, Giardia lamblia
SVPLEYNFLSLVAMYTQAYVR

SEQ ID NO: 3198215 - protein, 18 aa, Giardia lamblia
SVPLLPVTAYCDINAVID

SEQ ID NO: 3198216 - protein, 26 aa, Giardia lamblia
SVPNAYYALLKFPPASQLHIEAFFRH

SEQ ID NO: 3198217 - protein, 25 aa, Giardia lamblia
SVPSPLDYRSFFANLPTAGLYENSN

SEQ ID NO: 3198218 - protein, 33 aa, Giardia lamblia
SVPSWNVILRNVGLMHFFVYKHQLFALEFDVYN

SEQ ID NO: 3198219 - protein, 24 aa, Giardia lamblia
SVPYNVLQFLFGKINYCGRVTDYN

SEQ ID NO: 3198220 - protein, 17 aa, Giardia lamblia
SVQAITTIISRQKLRIE

SEQ ID NO: 3198221 - protein, 30 aa, Giardia lamblia
SVQDADVVPLLAPYSIIDQRNDEGYSALDI

SEQ ID NO: 3198222 - protein, 25 aa, Giardia lamblia
SVQTPTVFVQLPIGLMAVFDECGKM

SEQ ID NO: 3198223 - protein, 17 aa, Giardia lamblia
SVRAYELANEKLRLKES

SEQ ID NO: 3198224 - protein, 17 aa, Giardia lamblia
SVRLKGSKTRLCVCRPQ

SEQ ID NO: 3198225 - protein, 18 aa, Giardia lamblia
SVRNTYNAILARLKEEKI

SEQ ID NO: 3198226 - protein, 24 aa, Giardia lamblia
SVRQQALLLATRYFEQLVGNPSCS

SEQ ID NO: 3198227 - protein, 30 aa, Giardia lamblia
SVRTLLSDHKILLPCPQWDDLHLEQSAATL

SEQ ID NO: 3198228 - protein, 30 aa, Giardia lamblia
SVSAEPFYKRIFSYIYPSLSSPRPFQIQKS

SEQ ID NO: 3198229 - protein, 24 aa, Giardia lamblia
SVSALDFTSLLLAKDAEIHRLQSL

SEQ ID NO: 3198230 - protein, 21 aa, Giardia lamblia
SVSFRRLYTSLLSIQRQNVVK

SEQ ID NO: 3198231 - protein, 27 aa, Giardia lamblia
SVSLDKYWRVIFFGAYLEMLQGNHGRS

SEQ ID NO: 3198232 - protein, 18 aa, Giardia lamblia
SVSRLIGAPPGYVGYEQA

SEQ ID NO: 3198233 - protein, 25 aa, Giardia lamblia
SVSRREFLIRFLKANYLIQNIITDI

SEQ ID NO: 3198234 - protein, 25 aa, Giardia lamblia
SVSTDLLFGFLKTALDKNPKLRVVV

SEQ ID NO: 3198235 - protein, 31 aa, Giardia lamblia
SVTARIAPARRSRALFRASTRLKSGITEDGA

SEQ ID NO: 3198236 - protein, 28 aa, Giardia lamblia
SVTDLANWNLYLKQEAFYTRNTTAIIFT

SEQ ID NO: 3198237 - protein, 21 aa, Giardia lamblia
SVTIIFTPPLNEKACLTVIDT

SEQ ID NO: 3198238 - protein, 26 aa, Giardia lamblia
SVTILTRFDLVFMLKDKQSPERDAMI

SEQ ID NO: 3198239 - protein, 24 aa, Giardia lamblia
SVTLEFKELFAVAIDHGFSVTEMI

SEQ ID NO: 3198240 - protein, 17 aa, Giardia lamblia
SVTLPPQYSRDLVTVLR

SEQ ID NO: 3198241 - protein, 18 aa, Giardia lamblia
SVTLRKLFTMEKYQVVCK

SEQ ID NO: 3198242 - protein, 17 aa, Giardia lamblia
SVTLYIPVITECLLKVG

SEQ ID NO: 3198243 - protein, 17 aa, Giardia lamblia
SVTMILSSVRQLVAALA

SEQ ID NO: 3198244 - protein, 30 aa, Giardia lamblia
SVTPVREFSWPFAAEFTCLLWSTSDSIIAG

SEQ ID NO: 3198245 - protein, 18 aa, Giardia lamblia
SVVGQRFAFIYEEEKPQE

SEQ ID NO: 3198246 - protein, 35 aa, Giardia lamblia
SVVNRYINIWHDPALQKPWVFCNAGGWKYDELKAH

SEQ ID NO: 3198247 - protein, 28 aa, Giardia lamblia
SVVTDNELLRLYRLFGDAWDVIGNATLS

SEQ ID NO: 3198248 - protein, 24 aa, Giardia lamblia
SVYDNGLQRYSQAAIPALTSSAQL

SEQ ID NO: 3198249 - protein, 24 aa, Giardia lamblia
SVYPASIELGKPIKVGFGSEDKAA

SEQ ID NO: 3198250 - protein, 22 aa, Giardia lamblia
SVYPIFFNTRLLDPTSIQMHAH

SEQ ID NO: 3198251 - protein, 25 aa, Giardia lamblia
SVYPQVYSVRRFVNAPCALSSDHDL

SEQ ID NO: 3198252 - protein, 29 aa, Giardia lamblia
SVYTHDYKPYPVGSGAVLPAASMALQRSH

SEQ ID NO: 3198253 - protein, 26 aa, Giardia lamblia
SWATEFQTWFPNFSILLYKGDQEQRA

SEQ ID NO: 3198254 - protein, 29 aa, Giardia lamblia
SWEALLRVRRLIIFPIEDQEVWIRFSVLC

SEQ ID NO: 3198255 - protein, 21 aa, Giardia lamblia
SWFDCITKRQYTTIRTGLRLY

SEQ ID NO: 3198256 - protein, 17 aa, Giardia lamblia
SWIGLSFCPEGHALMCI

SEQ ID NO: 3198257 - protein, 25 aa, Giardia lamblia
SWLNPSKYFIPESLPPRIISEPYEV

SEQ ID NO: 3198258 - protein, 26 aa, Giardia lamblia
SWSPSPPPDYRYTSGAIPRSISSGSA

SEQ ID NO: 3198259 - protein, 27 aa, Giardia lamblia
SWSVGVILIQILTGKTSLFRGNPTVDI

SEQ ID NO: 3198260 - protein, 45 aa, Giardia lamblia
SYACGNVVVERYLRYFIPWFQRPQTILEFLLLKVQSHKLSRDVHA

SEQ ID NO: 3198261 - protein, 24 aa, Giardia lamblia
SYADIAFIFVQLRHHILSDKATNL

SEQ ID NO: 3198262 - protein, 21 aa, Giardia lamblia
SYAGEPVFAPSYIGGTTLPQS

SEQ ID NO: 3198263 - protein, 20 aa, Giardia lamblia
SYAHFGYVLLHPATQKQLYE

SEQ ID NO: 3198264 - protein, 30 aa, Giardia lamblia
SYAIRFANHYLKEMLSLAMNLPPNKLNVSK

SEQ ID NO: 3198265 - protein, 19 aa, Giardia lamblia
SYALRVMTTFILTNSPELV

SEQ ID NO: 3198266 - protein, 27 aa, Giardia lamblia
SYANKHLMLLVVYFLSANKTFFNSGGT

SEQ ID NO: 3198267 - protein, 29 aa, Giardia lamblia
SYCFNVEDYPYLLPAALLDMNLRVIEASI

SEQ ID NO: 3198268 - protein, 17 aa, Giardia lamblia
SYCYNPLNNLEPSMWSF

SEQ ID NO: 3198269 - protein, 23 aa, Giardia lamblia
SYDIPIITTIPVPIKGMDISCSG

SEQ ID NO: 3198270 - protein, 31 aa, Giardia lamblia
SYDRRKYCLKLMYMHILGHNIDFGLLQASQL

SEQ ID NO: 3198271 - protein, 26 aa, Giardia lamblia
SYEAPHLSFPILSPPAPMALDTYTKF

SEQ ID NO: 3198272 - protein, 25 aa, Giardia lamblia
SYEAVMVLSPYLKDKYSKINRNALS

SEQ ID NO: 3198273 - protein, 24 aa, Giardia lamblia
SYEHFYVIYCKFWELDENHDQKIS

SEQ ID NO: 3198274 - protein, 32 aa, Giardia lamblia
SYFQLINLNLSWHFWLTFMDSIIPASFSRYPL

SEQ ID NO: 3198275 - protein, 25 aa, Giardia lamblia
SYGLARDFFSFDSHRLPDVKVSGGS

SEQ ID NO: 3198276 - protein, 20 aa, Giardia lamblia
SYGLFLLGKKQKRQMQDSVS

SEQ ID NO: 3198277 - protein, 18 aa, Giardia lamblia
SYGMQWFVELYRTNQTKN

SEQ ID NO: 3198278 - protein, 17 aa, Giardia lamblia
SYGTLLLLDLRANKIHN

SEQ ID NO: 3198279 - protein, 24 aa, Giardia lamblia
SYHDIYVILTFAIQTPFTLQTIEQ

SEQ ID NO: 3198280 - protein, 17 aa, Giardia lamblia
SYHELLYTDQKKMLEDT

SEQ ID NO: 3198281 - protein, 39 aa, Giardia lamblia
SYIDTLAELAFIARMMMVHNLMFIACTAFSNAISESDLM

SEQ ID NO: 3198282 - protein, 20 aa, Giardia lamblia
SYIFVLRPAFKYNCAEWIGV

SEQ ID NO: 3198283 - protein, 21 aa, Giardia lamblia
SYIGLYAFNGYGAHLHSLARL

SEQ ID NO: 3198284 - protein, 30 aa, Giardia lamblia
SYKEEVIAGRKYFTKLFEKYTLVLCECGIG

SEQ ID NO: 3198285 - protein, 18 aa, Giardia lamblia
SYKLKRLASTFSSSLPYI

SEQ ID NO: 3198286 - protein, 30 aa, Giardia lamblia
SYKSAESLRLITGLVVEGFHLQGIRQLKSS

SEQ ID NO: 3198287 - protein, 21 aa, Giardia lamblia
SYLEGLLRRALSVFKTVHDEK

SEQ ID NO: 3198288 - protein, 22 aa, Giardia lamblia
SYLGPYLLLTAKYGDDFNMALR

SEQ ID NO: 3198289 - protein, 18 aa, Giardia lamblia
SYLHGRSITFKNTYTAVL

SEQ ID NO: 3198290 - protein, 20 aa, Giardia lamblia
SYLLQDMERYARRIHTNLRG

SEQ ID NO: 3198291 - protein, 19 aa, Giardia lamblia
SYLLRLALCLGSEDNVTIV

SEQ ID NO: 3198292 - protein, 24 aa, Giardia lamblia
SYLSYVSDNYIFYGFPRSQEVNVD

SEQ ID NO: 3198293 - protein, 24 aa, Giardia lamblia
SYLTKYNILLVERCKPGSLLLLNT

SEQ ID NO: 3198294 - protein, 17 aa, Giardia lamblia
SYMAPEILLRKPYNEKV

SEQ ID NO: 3198295 - protein, 18 aa, Giardia lamblia
SYPALIKSGVPLEDNFRE

SEQ ID NO: 3198296 - protein, 24 aa, Giardia lamblia
SYPQAFLTGILQNYARRAKIAIDE

SEQ ID NO: 3198297 - protein, 19 aa, Giardia lamblia
SYQCPSCKKLILYSTMRAE

SEQ ID NO: 3198298 - protein, 24 aa, Giardia lamblia
SYRALQRYIQFDGCIRFPDKSCKD

SEQ ID NO: 3198299 - protein, 29 aa, Giardia lamblia
SYRAPEMIDFFAKFPITIRSDVFALGVML

SEQ ID NO: 3198300 - protein, 31 aa, Giardia lamblia
SYRFTDDSDILMYLIRHGCNDVLLSIVHHFP

SEQ ID NO: 3198301 - protein, 22 aa, Giardia lamblia
SYRICLTRTPYFMKVLECLKGL

SEQ ID NO: 3198302 - protein, 18 aa, Giardia lamblia
SYSAFSNNPSFPSSSRCC

SEQ ID NO: 3198303 - protein, 20 aa, Giardia lamblia
SYSALPYRLRIVYRTLPNST

SEQ ID NO: 3198304 - protein, 23 aa, Giardia lamblia
SYSLVSRALLTIAPTICCQLFAK

SEQ ID NO: 3198305 - protein, 17 aa, Giardia lamblia
SYSPTDSPPLIPATNHY

SEQ ID NO: 3198306 - protein, 27 aa, Giardia lamblia
SYSRTKTHRILDLSQLPASSLTGMDTP

SEQ ID NO: 3198307 - protein, 18 aa, Giardia lamblia
SYTKSLLPSQKSLNWLVS

SEQ ID NO: 3198308 - protein, 36 aa, Giardia lamblia
SYTPSPTSFWQYALGPLLVLYLRAKEWISDEGLSRL

SEQ ID NO: 3198309 - protein, 30 aa, Giardia lamblia
SYVKDFLDDPYPIAVFNLELYDLLLGYFLT

SEQ ID NO: 3198310 - protein, 19 aa, Giardia lamblia
SYVNGLRRAIYADVPTLAI

SEQ ID NO: 3198311 - protein, 34 aa, Giardia lamblia
SYVSFIGFSGHLMRGLFLMPDGEEFIYAAGSHVV

SEQ ID NO: 3198312 - protein, 26 aa, Giardia lamblia
SYVSKVLCYYMIALVRKYSELGSLGY

SEQ ID NO: 3198313 - protein, 21 aa, Giardia lamblia
SYVWSLIMDYVILCPEPREDL

SEQ ID NO: 3198314 - protein, 25 aa, Giardia lamblia
SYYHITRYYIRPYDALLKDDYVRLG

SEQ ID NO: 3198315 - protein, 29 aa, Giardia lamblia
SYYNPVTRLAFLLVDFLADYSIFAEGQDA

SEQ ID NO: 3198316 - protein, 17 aa, Giardia lamblia
SYYPRPSYWQGEFNCMP

SEQ ID NO: 3198317 - protein, 25 aa, Giardia lamblia
SYYTDFERAKLYRPKPRLLNPERVN

SEQ ID NO: 3198318 - protein, 24 aa, Giardia lamblia
SYYTVRLISLIHYLRKELDAPVGL

SEQ ID NO: 3198319 - protein, 26 aa, Giardia lamblia
TAADTIGSYPIIDAALRSSSRHIRSQ

SEQ ID NO: 3198320 - protein, 17 aa, Giardia lamblia
TAAFTIGMLQRIDIGLK

SEQ ID NO: 3198321 - protein, 26 aa, Giardia lamblia
TAAGPTFCITYLMGVLDGLTHRDDSR

SEQ ID NO: 3198322 - protein, 25 aa, Giardia lamblia
TAALIPQFWTLIGAVATFSLYLDPP

SEQ ID NO: 3198323 - protein, 23 aa, Giardia lamblia
TAAPLILRDDLDFVYLPLENKDY

SEQ ID NO: 3198324 - protein, 38 aa, Giardia lamblia
TAAQLAQNLGYTDLLPLLGTVVPAPVATTPFPAISAAS

SEQ ID NO: 3198325 - protein, 23 aa, Giardia lamblia
TAARNRIIMFAERIDELTAENEL

SEQ ID NO: 3198326 - protein, 25 aa, Giardia lamblia
TAAYSIPLVNLLGCHRATTGIRGLV

SEQ ID NO: 3198327 - protein, 30 aa, Giardia lamblia
TACPSLRYDPASSLLYVLAPTTDAGVVLCC

SEQ ID NO: 3198328 - protein, 24 aa, Giardia lamblia
TACPSLRYDPASSLLYVLASTTDA

SEQ ID NO: 3198329 - protein, 27 aa, Giardia lamblia
TADDEYWNSFPLPRDYLDKTAAHNKRI

SEQ ID NO: 3198330 - protein, 26 aa, Giardia lamblia
TADGLIVFFPSYRFMEDLITLWNITS

SEQ ID NO: 3198331 - protein, 25 aa, Giardia lamblia
TADKETIALLQTKLAEIEVENDRLK

SEQ ID NO: 3198332 - protein, 27 aa, Giardia lamblia
TADLKKIMILFYQVVDALCYMHFCNVV

SEQ ID NO: 3198333 - protein, 24 aa, Giardia lamblia
TADLKRFLEALPSDQQQLIYEIAK

SEQ ID NO: 3198334 - protein, 20 aa, Giardia lamblia
TAEASLYRQKLEEAGLLNAP

SEQ ID NO: 3198335 - protein, 17 aa, Giardia lamblia
TAEIPDLPLLKNPLKSS

SEQ ID NO: 3198336 - protein, 23 aa, Giardia lamblia
TAEKLMNALPRLPTATEQEVQDG

SEQ ID NO: 3198337 - protein, 21 aa, Giardia lamblia
TAERPLFLMNDSDGPMGLTFV

SEQ ID NO: 3198338 - protein, 18 aa, Giardia lamblia
TAFDSIIADLRREQSSFL

SEQ ID NO: 3198339 - protein, 26 aa, Giardia lamblia
TAFEYLHYHGIIYRDLKTENVLLHHD

SEQ ID NO: 3198340 - protein, 26 aa, Giardia lamblia
TAGEGTYFNRLLTHTPASGQSGGVLT

SEQ ID NO: 3198341 - protein, 28 aa, Giardia lamblia
TAGVTTIGLLPPPPPRVPPPSTSSRRVH

SEQ ID NO: 3198342 - protein, 17 aa, Giardia lamblia
TAHGYAWIIREAAVMLV

SEQ ID NO: 3198343 - protein, 24 aa, Giardia lamblia
TAHLKVLFHALTTGLLCTVKYIVE

SEQ ID NO: 3198344 - protein, 26 aa, Giardia lamblia
TAHNSPFCSVYFLALCERSKQTHKAG

SEQ ID NO: 3198345 - protein, 23 aa, Giardia lamblia
TAHRFWDVFDTIFNANLSSVYTS

SEQ ID NO: 3198346 - protein, 27 aa, Giardia lamblia
TAHVTQCMAMRLMGLFAKNAHSKDILI

SEQ ID NO: 3198347 - protein, 23 aa, Giardia lamblia
TAICAYFANTFTIAELRAAELRF

SEQ ID NO: 3198348 - protein, 17 aa, Giardia lamblia
TAIIEGLRSRCFLLSFN

SEQ ID NO: 3198349 - protein, 29 aa, Giardia lamblia
TAIMDDFFFSEDTIWMIATQLIKFLADYS

SEQ ID NO: 3198350 - protein, 19 aa, Giardia lamblia
TAISILLLVASFSKKEIQQ

SEQ ID NO: 3198351 - protein, 28 aa, Giardia lamblia
TAKIGTMDTWLLWNLSKEKSYLTDVTAA

SEQ ID NO: 3198352 - protein, 25 aa, Giardia lamblia
TAKKIHSPFILTNKGGVASAKHPRT

SEQ ID NO: 3198353 - protein, 27 aa, Giardia lamblia
TAKLNNLLLQFKGTTSNALISIIKELL

SEQ ID NO: 3198354 - protein, 30 aa, Giardia lamblia
TAKLYLDICFDNYFLMTQPTSRLKDVAHAF

SEQ ID NO: 3198355 - protein, 24 aa, Giardia lamblia
TAKPRFDSYMSQESGLPRPYGGRA

SEQ ID NO: 3198356 - protein, 51 aa, Giardia lamblia
TALAIAALRNYSSVCLLLVKYEKSVPLHKGMTPLLLAIQSSSLDAVRVLTP

SEQ ID NO: 3198357 - protein, 33 aa, Giardia lamblia
TALAIGILEGKLSICKLLAPYEACVPVLLHGEE

SEQ ID NO: 3198358 - protein, 21 aa, Giardia lamblia
TALALAYLHSPYKVGPQHIST

SEQ ID NO: 3198359 - protein, 36 aa, Giardia lamblia
TALDFYSMVISRCIAAKFLLLMVKVVDGDQLCTAGF

SEQ ID NO: 3198360 - protein, 32 aa, Giardia lamblia
TALEIIPRPVKFNYDLITEMSLIDRTVDAAHG

SEQ ID NO: 3198361 - protein, 25 aa, Giardia lamblia
TALFTAVFWNRCECVKVLAPTEAII

SEQ ID NO: 3198362 - protein, 18 aa, Giardia lamblia
TALFYAALSGHIQCATIL

SEQ ID NO: 3198363 - protein, 26 aa, Giardia lamblia
TALHIATRLHLPKLVKLLVNYEAGFK

SEQ ID NO: 3198364 - protein, 35 aa, Giardia lamblia
TALIHAIERKPSLLYRLRLWDEVLLSDNDGLTPLD

SEQ ID NO: 3198365 - protein, 32 aa, Giardia lamblia
TALIKALRYELPAIAKLLIPLETKYTDLSGNY

SEQ ID NO: 3198366 - protein, 17 aa, Giardia lamblia
TALIRRPTQPDHRLVVL

SEQ ID NO: 3198367 - protein, 17 aa, Giardia lamblia
TALIYAAQRNFTDIVRI

SEQ ID NO: 3198368 - protein, 36 aa, Giardia lamblia
TALKLALQTRHLGPASILLNYEGPTLPKQLPGYPRE

SEQ ID NO: 3198369 - protein, 17 aa, Giardia lamblia
TALLKMEKITEAEEKAM

SEQ ID NO: 3198370 - protein, 19 aa, Giardia lamblia
TALMFATLFKQQSVVQELV

SEQ ID NO: 3198371 - protein, 21 aa, Giardia lamblia
TALMHASMHGSLECAVLLASL

SEQ ID NO: 3198372 - protein, 26 aa, Giardia lamblia
TALMHATLCGYRDLIRPLLCEAGSQS

SEQ ID NO: 3198373 - protein, 21 aa, Giardia lamblia
TALMIAIQCNNSKIAALLANS

SEQ ID NO: 3198374 - protein, 18 aa, Giardia lamblia
TALMKAISYKHLEAARLL

SEQ ID NO: 3198375 - protein, 21 aa, Giardia lamblia
TALMKAVRRRDTAIVKILASH

SEQ ID NO: 3198376 - protein, 24 aa, Giardia lamblia
TALMLAAEYNRVSSVPLLLEKEAG

SEQ ID NO: 3198377 - protein, 24 aa, Giardia lamblia
TALMLAAEYNVPAAVKYLAEFEAG

SEQ ID NO: 3198378 - protein, 22 aa, Giardia lamblia
TALMLAILNNHLHVCHYLAPYE

SEQ ID NO: 3198379 - protein, 23 aa, Giardia lamblia
TALMLAVEYNNVQAIKLLSRIEA

SEQ ID NO: 3198380 - protein, 17 aa, Giardia lamblia
TALMLAVKHRFTDVVKQ

SEQ ID NO: 3198381 - protein, 17 aa, Giardia lamblia
TALMLAVRSRDIQMVKL

SEQ ID NO: 3198382 - protein, 21 aa, Giardia lamblia
TALMLSIRYQMHRIATRLVND

SEQ ID NO: 3198383 - protein, 19 aa, Giardia lamblia
TALMYAARRGKLESVQLLL

SEQ ID NO: 3198384 - protein, 21 aa, Giardia lamblia
TALMYAVEYNRHTFVQDLIPF

SEQ ID NO: 3198385 - protein, 20 aa, Giardia lamblia
TALMYAVIYGHRKLVTILKD

SEQ ID NO: 3198386 - protein, 22 aa, Giardia lamblia
TALMYAVLGGSLKCVRLLVREE

SEQ ID NO: 3198387 - protein, 22 aa, Giardia lamblia
TALMYAVRNMDAEMTLLLGPLE

SEQ ID NO: 3198388 - protein, 23 aa, Giardia lamblia
TALMYCVQYNAYETALLLVDKEL

SEQ ID NO: 3198389 - protein, 19 aa, Giardia lamblia
TALMYLALHPVPPPDDLVA

SEQ ID NO: 3198390 - protein, 17 aa, Giardia lamblia
TALMYTARTGHADCLKL

SEQ ID NO: 3198391 - protein, 21 aa, Giardia lamblia
TALQRILMLPVDDSNMEDINE

SEQ ID NO: 3198392 - protein, 27 aa, Giardia lamblia
TALTIDPYRQYLIKQLPKHLHQDLIDA

SEQ ID NO: 3198393 - protein, 24 aa, Giardia lamblia
TALTRLAYAPFQPAFIPAQLATAQ

SEQ ID NO: 3198394 - protein, 20 aa, Giardia lamblia
TALWYAMHLQQALSLMQNIP

SEQ ID NO: 3198395 - protein, 21 aa, Giardia lamblia
TALYHAIMMGRYRIAELLRDS

SEQ ID NO: 3198396 - protein, 17 aa, Giardia lamblia
TAMFVLNIDLFTRTERG

SEQ ID NO: 3198397 - protein, 19 aa, Giardia lamblia
TAMLHYFDVARAADIEKYL

SEQ ID NO: 3198398 - protein, 22 aa, Giardia lamblia
TAMLVDLLSYCRIKPFTNQFES

SEQ ID NO: 3198399 - protein, 17 aa, Giardia lamblia
TAMMIAAMNGSIDCVKL

SEQ ID NO: 3198400 - protein, 21 aa, Giardia lamblia
TAMMLAAQRGYLDIVRALIPK

SEQ ID NO: 3198401 - protein, 25 aa, Giardia lamblia
TAMPALVFRFIPENLAQHGSYLLHL

SEQ ID NO: 3198402 - protein, 29 aa, Giardia lamblia
TANPFPNSSLLLPPDLFTKIAKTLETLLV

SEQ ID NO: 3198403 - protein, 23 aa, Giardia lamblia
TANYIHNYLDFAMLGHLSRLTEL

SEQ ID NO: 3198404 - protein, 22 aa, Giardia lamblia
TAPKLWAPADQLSLFISVYDQI

SEQ ID NO: 3198405 - protein, 25 aa, Giardia lamblia
TAPQAPIQQFKLSSPILSLAVNNNK

SEQ ID NO: 3198406 - protein, 24 aa, Giardia lamblia
TAQEYHHMVRALGVYLQHAPQVSI

SEQ ID NO: 3198407 - protein, 23 aa, Giardia lamblia
TAQKLKFVLTVPPPTPSAISVSG

SEQ ID NO: 3198408 - protein, 28 aa, Giardia lamblia
TAQRIAHLLFLMMIKVYKELRYRITLVA

SEQ ID NO: 3198409 - protein, 23 aa, Giardia lamblia
TARDKWSYELTASFFEIYNDTVQ

SEQ ID NO: 3198410 - protein, 17 aa, Giardia lamblia
TARILESLIRLATALTK

SEQ ID NO: 3198411 - protein, 18 aa, Giardia lamblia
TARRMVFDGSIKIMYDEL

SEQ ID NO: 3198412 - protein, 22 aa, Giardia lamblia
TARSPPFLPPFSRPFRYAKLKY

SEQ ID NO: 3198413 - protein, 23 aa, Giardia lamblia
TARYFYHMHPIQYYSTPTGRIVA

SEQ ID NO: 3198414 - protein, 24 aa, Giardia lamblia
TASALSFFLRNLSKHVVLTGAQIP

SEQ ID NO: 3198415 - protein, 27 aa, Giardia lamblia
TASEPLARRIIKLIQPLYEYSVVITLN

SEQ ID NO: 3198416 - protein, 23 aa, Giardia lamblia
TASGNLYLYSFQSKSIQAFVSSA

SEQ ID NO: 3198417 - protein, 18 aa, Giardia lamblia
TASILHPVSSRDVNLVTK

SEQ ID NO: 3198418 - protein, 24 aa, Giardia lamblia
TASKRAFSIARQRRPLCFGEDNLG

SEQ ID NO: 3198419 - protein, 24 aa, Giardia lamblia
TASPLEERVIIQDLLRNELGETPL

SEQ ID NO: 3198420 - protein, 20 aa, Giardia lamblia
TASPPPPCVLGCAAPPLVPP

SEQ ID NO: 3198421 - protein, 20 aa, Giardia lamblia
TASPPPPCVLGCATPPLVPP

SEQ ID NO: 3198422 - protein, 18 aa, Giardia lamblia
TASRVNPGFMGRLGPEYP

SEQ ID NO: 3198423 - protein, 24 aa, Giardia lamblia
TASSTMHIWPLNFNNVLVIDKTTL

SEQ ID NO: 3198424 - protein, 18 aa, Giardia lamblia
TATAAVPLMVNKYGQVQV

SEQ ID NO: 3198425 - protein, 18 aa, Giardia lamblia
TATACRILLPHSVGLCSD

SEQ ID NO: 3198426 - protein, 32 aa, Giardia lamblia
TATDKYIRSMPLHYPILAIPCPDSKPYDSGQH

SEQ ID NO: 3198427 - protein, 18 aa, Giardia lamblia
TATFFYDSLLEHMRACTQ

SEQ ID NO: 3198428 - protein, 25 aa, Giardia lamblia
TATGDFVWKVRLGFDGAFDSFEDYV

SEQ ID NO: 3198429 - protein, 28 aa, Giardia lamblia
TATGPTFCITYLMGVLDGFAHRDDSRRQ

SEQ ID NO: 3198430 - protein, 24 aa, Giardia lamblia
TATPTLKAPIDRPAFNSSLNVSGF

SEQ ID NO: 3198431 - protein, 29 aa, Giardia lamblia
TATSMMVYRLIDFTAIFPITPSSVMAEMI

SEQ ID NO: 3198432 - protein, 24 aa, Giardia lamblia
TAVARALVPLLYDKSRAQVVGRQI

SEQ ID NO: 3198433 - protein, 23 aa, Giardia lamblia
TAVDIWNLGLLLFNCLAREHFFK

SEQ ID NO: 3198434 - protein, 38 aa, Giardia lamblia
TAVDVFAFGILLYRLMYRRLPFPDNDLRYNYRAEFSFQ

SEQ ID NO: 3198435 - protein, 27 aa, Giardia lamblia
TAVHDELLRLILRLTGYKLAITGYRFV

SEQ ID NO: 3198436 - protein, 22 aa, Giardia lamblia
TAVKLPFYGSYSEKDPVQIAQD

SEQ ID NO: 3198437 - protein, 20 aa, Giardia lamblia
TAVQLSDFIPWLKARCRSTN

SEQ ID NO: 3198438 - protein, 29 aa, Giardia lamblia
TAWSSEYMDLVIIILRTGGLAMDNYDHST

SEQ ID NO: 3198439 - protein, 17 aa, Giardia lamblia
TAYMKQYAHERYGVVDM

SEQ ID NO: 3198440 - protein, 34 aa, Giardia lamblia
TAYVLALELDFQEIANFLAPLEGTFLSGVRRSLG

SEQ ID NO: 3198441 - protein, 27 aa, Giardia lamblia
TAYVSHCVVLAFALHKFSVATKERSLK

SEQ ID NO: 3198442 - protein, 37 aa, Giardia lamblia
TAYYTRVLVLPPNGSPIFNFRLLSTKLSAAYLQELIT

SEQ ID NO: 3198443 - protein, 29 aa, Giardia lamblia
TCAEVDPAFWVTYFSKVTFPIKLTENDKK

SEQ ID NO: 3198444 - protein, 18 aa, Giardia lamblia
TCAIPDYSEKLLVLTIDI

SEQ ID NO: 3198445 - protein, 26 aa, Giardia lamblia
TCDLPPQFAYFFQFSHLSATRNLLCL

SEQ ID NO: 3198446 - protein, 26 aa, Giardia lamblia
TCEEIEPLLLTLSKQSPRNQIHGSGG

SEQ ID NO: 3198447 - protein, 21 aa, Giardia lamblia
TCFKTLITITGFDSSLTSLAC

SEQ ID NO: 3198448 - protein, 19 aa, Giardia lamblia
TCIGCLLYDTNRPGVSVQR

SEQ ID NO: 3198449 - protein, 18 aa, Giardia lamblia
TCIKSIYDPAKQPAADLI

SEQ ID NO: 3198450 - protein, 27 aa, Giardia lamblia
TCINNYFLTRTFLVTERPTIADFAMFG

SEQ ID NO: 3198451 - protein, 29 aa, Giardia lamblia
TCLDSSIHNFLLRTILQLDSKTLELTHIV

SEQ ID NO: 3198452 - protein, 30 aa, Giardia lamblia
TCLLCLESQHYFLIMPLDLSLKTASTKDAL

SEQ ID NO: 3198453 - protein, 21 aa, Giardia lamblia
TCLMLAAVYNASAWVPHFIDQ

SEQ ID NO: 3198454 - protein, 18 aa, Giardia lamblia
TCLNPRGYLAPNSSINIV

SEQ ID NO: 3198455 - protein, 26 aa, Giardia lamblia
TCLRGILRTVLLLSAPLCTSSSQYSL

SEQ ID NO: 3198456 - protein, 32 aa, Giardia lamblia
TCMSEYMAPLLQLGSPYILRPHKIMKREQHCF

SEQ ID NO: 3198457 - protein, 31 aa, Giardia lamblia
TCPHTNLLKTVRWFISVVERLLATNTSVVPS

SEQ ID NO: 3198458 - protein, 23 aa, Giardia lamblia
TCPLCRKLFLKGKSLEEVTSQCS

SEQ ID NO: 3198459 - protein, 22 aa, Giardia lamblia
TCPSSLPFPTLLDIRTGERLDL

SEQ ID NO: 3198460 - protein, 17 aa, Giardia lamblia
TCQSLCAIASRLGKLSG

SEQ ID NO: 3198461 - protein, 25 aa, Giardia lamblia
TCRKYHPEPLPKEDLMQALSIAKYS

SEQ ID NO: 3198462 - protein, 28 aa, Giardia lamblia
TCSRDNLAQFWLPPHLNLSLGQMKHLEY

SEQ ID NO: 3198463 - protein, 18 aa, Giardia lamblia
TCSSGMIQLFRFTHGQLF

SEQ ID NO: 3198464 - protein, 30 aa, Giardia lamblia
TCTDIPLLANTLALFSSKLFRKSKHDVLNH

SEQ ID NO: 3198465 - protein, 27 aa, Giardia lamblia
TCTLFTQRLLLRRLCAFINQGTLSLSD

SEQ ID NO: 3198466 - protein, 26 aa, Giardia lamblia
TCTTKSLPIFGMYAKPATLSVSQALS

SEQ ID NO: 3198467 - protein, 26 aa, Giardia lamblia
TCVKFGAYYKRKGWRVGLVCCDTFRT

SEQ ID NO: 3198468 - protein, 30 aa, Giardia lamblia
TCVSPDSAFVWFYLNGVFYELDLHKLAEMK

SEQ ID NO: 3198469 - protein, 25 aa, Giardia lamblia
TCYDGFIASLNRYLNTLGPSAEKER

SEQ ID NO: 3198470 - protein, 28 aa, Giardia lamblia
TDAPFSAVLGVLYPWHRICVLQGSSKPV

SEQ ID NO: 3198471 - protein, 17 aa, Giardia lamblia
TDCEPLNFVYRDDALDE

SEQ ID NO: 3198472 - protein, 18 aa, Giardia lamblia
TDCVYYTKPYGEKLRKLA

SEQ ID NO: 3198473 - protein, 33 aa, Giardia lamblia
TDDGLSALMFAAIYNRLFAVEYLIHGEAGLVDS

SEQ ID NO: 3198474 - protein, 31 aa, Giardia lamblia
TDEGYMLKYRLAQMLLYDKSIPKPTVKPDKL

SEQ ID NO: 3198475 - protein, 18 aa, Giardia lamblia
TDEPLPFKYLDTGAGISS

SEQ ID NO: 3198476 - protein, 23 aa, Giardia lamblia
TDEYYEDLLANPYIRHEYLHKLI

SEQ ID NO: 3198477 - protein, 26 aa, Giardia lamblia
TDFDKDAVLLLLNKLYNLLVSTANER

SEQ ID NO: 3198478 - protein, 23 aa, Giardia lamblia
TDFGLQHVPFSRTIPTSQSGSAL

SEQ ID NO: 3198479 - protein, 22 aa, Giardia lamblia
TDFINGFNCTIFAYGQTGSGKS

SEQ ID NO: 3198480 - protein, 21 aa, Giardia lamblia
TDFSPPFTMMPRGPIRKMVID

SEQ ID NO: 3198481 - protein, 19 aa, Giardia lamblia
TDGKHLILLSSGSEVGLCL

SEQ ID NO: 3198482 - protein, 22 aa, Giardia lamblia
TDGLFNSSYYLDLSTNNSKLQT

SEQ ID NO: 3198483 - protein, 30 aa, Giardia lamblia
TDGLNLPPFERRMTLITLSEILHDPVRAMQ

SEQ ID NO: 3198484 - protein, 30 aa, Giardia lamblia
TDGNGVISFVEFVRLMVTKSRNTDSEEELR

SEQ ID NO: 3198485 - protein, 26 aa, Giardia lamblia
TDGSWSTIKIDMPPRGAVRDASTPFM

SEQ ID NO: 3198486 - protein, 17 aa, Giardia lamblia
TDGSYCIMGFTPDMRGY

SEQ ID NO: 3198487 - protein, 21 aa, Giardia lamblia
TDHFYITSDYLPQGSLRDEIA

SEQ ID NO: 3198488 - protein, 34 aa, Giardia lamblia
TDHLPAHIIKNPATSYIIPCDLRPSVTSLELQIP

SEQ ID NO: 3198489 - protein, 19 aa, Giardia lamblia
TDHLVPKSVLPIFEDHIDA

SEQ ID NO: 3198490 - protein, 19 aa, Giardia lamblia
TDHNRFTALLYAAMHGHKD

SEQ ID NO: 3198491 - protein, 28 aa, Giardia lamblia
TDHTQARSVLPIFEPFIDKAESFLQSSF

SEQ ID NO: 3198492 - protein, 20 aa, Giardia lamblia
TDIALLLRGHESPSWTPLMC

SEQ ID NO: 3198493 - protein, 29 aa, Giardia lamblia
TDIWSAGCVLYTLLVGRLPFDDHYMPALF

SEQ ID NO: 3198494 - protein, 22 aa, Giardia lamblia
TDKAGMTALMYAAARGFSEAVA

SEQ ID NO: 3198495 - protein, 26 aa, Giardia lamblia
TDKPNQLCYYLFDALFINGTSILSNN

SEQ ID NO: 3198496 - protein, 25 aa, Giardia lamblia
TDKQRAGLLPEKYQRQAALVQQALN

SEQ ID NO: 3198497 - protein, 42 aa, Giardia lamblia
TDLCKSHYTMLILESIVLDDKFLFPASLAPPKPSWATIYPSI

SEQ ID NO: 3198498 - protein, 18 aa, Giardia lamblia
TDLHKNYRKSIEAGDIAV

SEQ ID NO: 3198499 - protein, 17 aa, Giardia lamblia
TDLICEHSRVLEDRIAR

SEQ ID NO: 3198500 - protein, 46 aa, Giardia lamblia
TDLLAHGYLENDLPYFIMYSDPHITPLIRLLTPYFATDENVGFQHD

SEQ ID NO: 3198501 - protein, 20 aa, Giardia lamblia
TDLLATERVLSSANSPLTTC

SEQ ID NO: 3198502 - protein, 23 aa, Giardia lamblia
TDLMRRIIELGPFDPLTDSGLTQ

SEQ ID NO: 3198503 - protein, 24 aa, Giardia lamblia
TDLNATMIPLPSPLRKNVLVPDSS

SEQ ID NO: 3198504 - protein, 20 aa, Giardia lamblia
TDLQRYCHLARELNSAGLTS

SEQ ID NO: 3198505 - protein, 19 aa, Giardia lamblia
TDNLAIAKMFIKEAGFTKS

SEQ ID NO: 3198506 - protein, 23 aa, Giardia lamblia
TDNRLLDYQILPGRTRPAMLGES

SEQ ID NO: 3198507 - protein, 22 aa, Giardia lamblia
TDPDIILAKFYHEDPYVSNVKL

SEQ ID NO: 3198508 - protein, 29 aa, Giardia lamblia
TDPDNLFNPPIILVPGVCGSLLVADNNEV

SEQ ID NO: 3198509 - protein, 31 aa, Giardia lamblia
TDQDIRYREPPTAKLPPLPGTKSNEFTEINA

SEQ ID NO: 3198510 - protein, 24 aa, Giardia lamblia
TDQKIYIYGLTYLSDSRSTSDIVP

SEQ ID NO: 3198511 - protein, 25 aa, Giardia lamblia
TDQLKTYRMYMGEKSPLMPQTEPDF

SEQ ID NO: 3198512 - protein, 21 aa, Giardia lamblia
TDQLTVLLALLLERSDQAKSG

SEQ ID NO: 3198513 - protein, 28 aa, Giardia lamblia
TDQNSRLRELFWLDFTRERVLTSHTIES

SEQ ID NO: 3198514 - protein, 25 aa, Giardia lamblia
TDQPLAPFTPMSFTASYKSLHPHLY

SEQ ID NO: 3198515 - protein, 27 aa, Giardia lamblia
TDQPQQPINFLPPKRLIARSSAHIVQV

SEQ ID NO: 3198516 - protein, 18 aa, Giardia lamblia
TDQRLCVTVAPRILRAFA

SEQ ID NO: 3198517 - protein, 31 aa, Giardia lamblia
TDQTRLYIVMPNYEMYIMDLITYETEFVKTT

SEQ ID NO: 3198518 - protein, 20 aa, Giardia lamblia
TDRDYLINDLTRRFEKANQD

SEQ ID NO: 3198519 - protein, 24 aa, Giardia lamblia
TDRETISLPPLRKSTTQEERPIVK

SEQ ID NO: 3198520 - protein, 28 aa, Giardia lamblia
TDRNLRYYLTMIMKRQKLYGKLDKELIR

SEQ ID NO: 3198521 - protein, 29 aa, Giardia lamblia
TDRPARIPRFVFLSHFLTRSGLQCPKDQN

SEQ ID NO: 3198522 - protein, 18 aa, Giardia lamblia
TDRRALLQVLRHPARDHV

SEQ ID NO: 3198523 - protein, 25 aa, Giardia lamblia
TDSAHCSLFLWFNEKLHKLEVVHSL

SEQ ID NO: 3198524 - protein, 24 aa, Giardia lamblia
TDSDLPEKWLQQLEKRSGGSIVNA

SEQ ID NO: 3198525 - protein, 29 aa, Giardia lamblia
TDSLAEPMILQPVVPRSLGRSTGPRKRES

SEQ ID NO: 3198526 - protein, 24 aa, Giardia lamblia
TDSLRWGLTGGKPYLRNITEENVQ

SEQ ID NO: 3198527 - protein, 26 aa, Giardia lamblia
TDSNGYTALMWAAKNGDARMVRALIN

SEQ ID NO: 3198528 - protein, 23 aa, Giardia lamblia
TDSPILFDAFPYLVAEHGNKDDQ

SEQ ID NO: 3198529 - protein, 24 aa, Giardia lamblia
TDTFRDNYFTSTLTYRNLTATERP

SEQ ID NO: 3198530 - protein, 23 aa, Giardia lamblia
TDTIAGATALLSILMERNKTYGV

SEQ ID NO: 3198531 - protein, 24 aa, Giardia lamblia
TDTLYGFFTVLIERIIRAVFDHAS

SEQ ID NO: 3198532 - protein, 25 aa, Giardia lamblia
TDVLIDPAPIPFTPASKLSPRGPSQ

SEQ ID NO: 3198533 - protein, 35 aa, Giardia lamblia
TDVLRLLYATVSFHLRIMAIFNYLIHLIDPLCAHP

SEQ ID NO: 3198534 - protein, 24 aa, Giardia lamblia
TDYAGYRLILQCVRLGLVSPQHEL

SEQ ID NO: 3198535 - protein, 18 aa, Giardia lamblia
TDYEEKCGFIVQLEQRVS

SEQ ID NO: 3198536 - protein, 32 aa, Giardia lamblia
TDYLNSKRSLFTRFYFISDDELLFLLGNSSDP

SEQ ID NO: 3198537 - protein, 24 aa, Giardia lamblia
TDYRSLALRFSLPSSAYATEFLRE

SEQ ID NO: 3198538 - protein, 20 aa, Giardia lamblia
TDYYVIRRKPCTNWAPEEDE

SEQ ID NO: 3198539 - protein, 31 aa, Giardia lamblia
TEADKRFIRALLLPGQPLTGPFSLEFSFSTN

SEQ ID NO: 3198540 - protein, 17 aa, Giardia lamblia
TEAFLAEYMIKAADCML

SEQ ID NO: 3198541 - protein, 20 aa, Giardia lamblia
TEAHPFFMATQYHPEFTSKH

SEQ ID NO: 3198542 - protein, 19 aa, Giardia lamblia
TEATIRPLSAKGALYINGR

SEQ ID NO: 3198543 - protein, 23 aa, Giardia lamblia
TEATKFLLPQMYADYDRVFDNTN

SEQ ID NO: 3198544 - protein, 39 aa, Giardia lamblia
TECANELFIDEFRLLRHFGWTTLMIGTVFTFTELNKNFL

SEQ ID NO: 3198545 - protein, 26 aa, Giardia lamblia
TECAYCFLNRYNSQGLYLCMHCNFCA

SEQ ID NO: 3198546 - protein, 25 aa, Giardia lamblia
TEDKLGALIRLRERVRRLREDKLRV

SEQ ID NO: 3198547 - protein, 26 aa, Giardia lamblia
TEDLSFYYFNALTQKQLYKIEDESQF

SEQ ID NO: 3198548 - protein, 28 aa, Giardia lamblia
TEDPRNLSLARIGLLIPGIDGFSKADVP

SEQ ID NO: 3198549 - protein, 17 aa, Giardia lamblia
TEDQFIGLFTGFCESTM

SEQ ID NO: 3198550 - protein, 28 aa, Giardia lamblia
TEEDILPINIFHKPLLPVFETTQNAPRS

SEQ ID NO: 3198551 - protein, 27 aa, Giardia lamblia
TEFEHPSHLYYFITYYSKQDDDSVSSP

SEQ ID NO: 3198552 - protein, 18 aa, Giardia lamblia
TEFFATELSPSSVLLFGG

SEQ ID NO: 3198553 - protein, 19 aa, Giardia lamblia
TEFHISVDGPYLFADESYG

SEQ ID NO: 3198554 - protein, 23 aa, Giardia lamblia
TEFQVGLKLIATQVLQKGSCVKV

SEQ ID NO: 3198555 - protein, 19 aa, Giardia lamblia
TEFRIPYMMARSPAAFRSF

SEQ ID NO: 3198556 - protein, 23 aa, Giardia lamblia
TEFTYTVRAFANPAFQVTTFKLY

SEQ ID NO: 3198557 - protein, 25 aa, Giardia lamblia
TEGAQYLFLAYTKLATSSIDVIALE

SEQ ID NO: 3198558 - protein, 22 aa, Giardia lamblia
TEGCIRDFFSSYNDFLRILAVS

SEQ ID NO: 3198559 - protein, 25 aa, Giardia lamblia
TEGEAIRLDFLPGSDLCLDHLDTST

SEQ ID NO: 3198560 - protein, 28 aa, Giardia lamblia
TEGFNRLFGWMILLCECIISYSVLEEDV

SEQ ID NO: 3198561 - protein, 33 aa, Giardia lamblia
TEGPGGHFAFATWLLLWIARSAILPYTGEESTR

SEQ ID NO: 3198562 - protein, 28 aa, Giardia lamblia
TEGQKMELFFLGLYNNIKLAVSYFCDKH

SEQ ID NO: 3198563 - protein, 23 aa, Giardia lamblia
TEGRMHVLLPDGRKGKTALMFAA

SEQ ID NO: 3198564 - protein, 23 aa, Giardia lamblia
TEHISTHLLQLHDWDPLVALDDY

SEQ ID NO: 3198565 - protein, 20 aa, Giardia lamblia
TEHPPVVKGLPLLSSVHLGS

SEQ ID NO: 3198566 - protein, 36 aa, Giardia lamblia
TEHTAIAKQIWWVIKEIHIYLIDGALHPVLGAGEES

SEQ ID NO: 3198567 - protein, 17 aa, Giardia lamblia
TEHTLLMSAAIKGDAKS

SEQ ID NO: 3198568 - protein, 17 aa, Giardia lamblia
TEIALSKRLPLSAVVRA

SEQ ID NO: 3198569 - protein, 20 aa, Giardia lamblia
TEICRILANPPPKTSTSSLK

SEQ ID NO: 3198570 - protein, 22 aa, Giardia lamblia
TEIILPGFYDGKSYKKVITRDQ

SEQ ID NO: 3198571 - protein, 27 aa, Giardia lamblia
TEIPAMAPVLRPLLLPPLGLVDTHASP

SEQ ID NO: 3198572 - protein, 27 aa, Giardia lamblia
TEIPDVLPFVIISIKIQQLRSKALDLI

SEQ ID NO: 3198573 - protein, 23 aa, Giardia lamblia
TEIQRLIMLREKALQHIDTAAQE

SEQ ID NO: 3198574 - protein, 27 aa, Giardia lamblia
TEKDQDGFFPLHRLMRIAPKTLDAQLF

SEQ ID NO: 3198575 - protein, 25 aa, Giardia lamblia
TEKILQGLSYLLFRDRFAGLKKSLQ

SEQ ID NO: 3198576 - protein, 26 aa, Giardia lamblia
TEKLDITFNLRPQCKTHTTKFAGVGD

SEQ ID NO: 3198577 - protein, 30 aa, Giardia lamblia
TEKTAMLRPFRRNLPDFFIRSLSSIDHYIG

SEQ ID NO: 3198578 - protein, 27 aa, Giardia lamblia
TELALDILSFIPSGYHSLLRAASQEAL

SEQ ID NO: 3198579 - protein, 21 aa, Giardia lamblia
TELCNLLMTRYERLVEKTKEV

SEQ ID NO: 3198580 - protein, 24 aa, Giardia lamblia
TELDSGHYLAYVRASLFSEEDLSE

SEQ ID NO: 3198581 - protein, 25 aa, Giardia lamblia
TELFDWYVQLPIFFPHIQKYFHPDK

SEQ ID NO: 3198582 - protein, 20 aa, Giardia lamblia
TELGLLRERLIQEAARRIVL

SEQ ID NO: 3198583 - protein, 32 aa, Giardia lamblia
TELGPRAPSLQRIGPREWIVEKNGAVISVNLG

SEQ ID NO: 3198584 - protein, 22 aa, Giardia lamblia
TELGRILERDARRRQLQQQQLE

SEQ ID NO: 3198585 - protein, 18 aa, Giardia lamblia
TELLGLYCSLPLEVKEML

SEQ ID NO: 3198586 - protein, 19 aa, Giardia lamblia
TELLQKTVKLTISNGSSFI

SEQ ID NO: 3198587 - protein, 18 aa, Giardia lamblia
TELLSAFTKLSIAQAGLS

SEQ ID NO: 3198588 - protein, 31 aa, Giardia lamblia
TELMDAIIADDYLLGWSLFQVQSGLQDKDGK

SEQ ID NO: 3198589 - protein, 18 aa, Giardia lamblia
TELMPSGCLKKYLKKNPT

SEQ ID NO: 3198590 - protein, 27 aa, Giardia lamblia
TELMRRLRQFYRINSQAFALLGVSWIR

SEQ ID NO: 3198591 - protein, 17 aa, Giardia lamblia
TELRFYLENYVGMKDKD

SEQ ID NO: 3198592 - protein, 18 aa, Giardia lamblia
TELSPSSVLLFGGSSAQA

SEQ ID NO: 3198593 - protein, 24 aa, Giardia lamblia
TELTTAFTALRRASFGHLERSHGV

SEQ ID NO: 3198594 - protein, 19 aa, Giardia lamblia
TELTVLSLPSVIYGGACFT

SEQ ID NO: 3198595 - protein, 24 aa, Giardia lamblia
TEMNAAVHILPPLVGIVSEARQNL

SEQ ID NO: 3198596 - protein, 18 aa, Giardia lamblia
TEMSLIDRTVDAAHGLPA

SEQ ID NO: 3198597 - protein, 39 aa, Giardia lamblia
TEMYRSMAGYGFKVDMLTLFHIVLLLTADDPERAREQLL

SEQ ID NO: 3198598 - protein, 38 aa, Giardia lamblia
TENAASPELLLYADLLQALLENIVRLNSRLDTMEQDRQ

SEQ ID NO: 3198599 - protein, 28 aa, Giardia lamblia
TENNPLTVWCLIPLQGRVQDWSGKTALM

SEQ ID NO: 3198600 - protein, 28 aa, Giardia lamblia
TEPADLRLFFMTSTYNVNLAKLNLLMRQ

SEQ ID NO: 3198601 - protein, 30 aa, Giardia lamblia
TEPDDALNYMPFLPIRPYSPTHFEQVRTDE

SEQ ID NO: 3198602 - protein, 21 aa, Giardia lamblia
TEPDFVFRQRTMRAAPNSATS

SEQ ID NO: 3198603 - protein, 25 aa, Giardia lamblia
TEPELNQYFFMDKEGFHSKEAGAGI

SEQ ID NO: 3198604 - protein, 26 aa, Giardia lamblia
TEPMARYFFSQIMSAVLYMHLHGVAH

SEQ ID NO: 3198605 - protein, 25 aa, Giardia lamblia
TEPPNLADLPPPVSASSLLPVQTLE

SEQ ID NO: 3198606 - protein, 23 aa, Giardia lamblia
TEPPPIVQLYSDHLLYSLDDKIM

SEQ ID NO: 3198607 - protein, 17 aa, Giardia lamblia
TEPSFKAHILLQAQLVR

SEQ ID NO: 3198608 - protein, 22 aa, Giardia lamblia
TEPYLIEVSPLKIAKKQYHRIL

SEQ ID NO: 3198609 - protein, 17 aa, Giardia lamblia
TEQEFLPEVLRIITSHP

SEQ ID NO: 3198610 - protein, 30 aa, Giardia lamblia
TEQELLLAFNYLIQLFDPDLFTGYNIDGFD

SEQ ID NO: 3198611 - protein, 22 aa, Giardia lamblia
TEQLLIDYRALSLGDPLKSYDD

SEQ ID NO: 3198612 - protein, 25 aa, Giardia lamblia
TEQYPRVLFLHGFDFDTTINAPFIN

SEQ ID NO: 3198613 - protein, 19 aa, Giardia lamblia
TERIFTENISLKKTVEILS

SEQ ID NO: 3198614 - protein, 24 aa, Giardia lamblia
TERLSELLAEVEGYKAKLGESKEM

SEQ ID NO: 3198615 - protein, 18 aa, Giardia lamblia
TERPTIADFAMFGALVPV

SEQ ID NO: 3198616 - protein, 19 aa, Giardia lamblia
TERRRLTTLFTRERLAATD

SEQ ID NO: 3198617 - protein, 25 aa, Giardia lamblia
TERSPTHVGSFRLLGKAYTYLCHYG

SEQ ID NO: 3198618 - protein, 23 aa, Giardia lamblia
TERTFQPLHFRFSFLPEEQTCSS

SEQ ID NO: 3198619 - protein, 22 aa, Giardia lamblia
TERTRWRALPEENLLDEFIRTA

SEQ ID NO: 3198620 - protein, 25 aa, Giardia lamblia
TESAFPEILIVKAIRQYFDVSRMRS

SEQ ID NO: 3198621 - protein, 18 aa, Giardia lamblia
TESLQKLSFKYAPEDDLR

SEQ ID NO: 3198622 - protein, 33 aa, Giardia lamblia
TESLRAYPFGGLFTSLLCHMWLAYDVTNELNCI

SEQ ID NO: 3198623 - protein, 38 aa, Giardia lamblia
TESSALLLSPPLRQTLVQTLILFVKRGVLSLTDTNLLS

SEQ ID NO: 3198624 - protein, 33 aa, Giardia lamblia
TESSDLEDLFMLTPRSYGVLASQQPDFASSQHI

SEQ ID NO: 3198625 - protein, 24 aa, Giardia lamblia
TESTWLLFAIPRAHPQLVIYRIVS

SEQ ID NO: 3198626 - protein, 17 aa, Giardia lamblia
TETFAMGLNLPARAIIF

SEQ ID NO: 3198627 - protein, 26 aa, Giardia lamblia
TETGRKLMMLPKPTPVSSVLRPKRPG

SEQ ID NO: 3198628 - protein, 23 aa, Giardia lamblia
TETLAPWYNARDISFLTNKEKAK

SEQ ID NO: 3198629 - protein, 20 aa, Giardia lamblia
TETLNRLQQIGLKYLVTISV

SEQ ID NO: 3198630 - protein, 26 aa, Giardia lamblia
TETLPSGLLGFWKQTQTILGMDDMEE

SEQ ID NO: 3198631 - protein, 22 aa, Giardia lamblia
TETLWMVMEYCGSGTLRNLITS

SEQ ID NO: 3198632 - protein, 20 aa, Giardia lamblia
TETTPVFRAFFNRSLEEYMT

SEQ ID NO: 3198633 - protein, 34 aa, Giardia lamblia
TETTVSWYLTIPYDSRFDGLFKHLIVAISIAANI

SEQ ID NO: 3198634 - protein, 26 aa, Giardia lamblia
TEVPRFFRTCLAGLPLEKLVLGINED

SEQ ID NO: 3198635 - protein, 24 aa, Giardia lamblia
TEVVKICFNWVRDPKICDSMIDWE

SEQ ID NO: 3198636 - protein, 27 aa, Giardia lamblia
TEYINEFLDRRGFYPYVARCTKAAHKS

SEQ ID NO: 3198637 - protein, 20 aa, Giardia lamblia
TEYLCGVLAKYLTALNPHQA

SEQ ID NO: 3198638 - protein, 37 aa, Giardia lamblia
TEYNKLVLLLDSQSLLLFLLQVSPLRSLIKATGSASR

SEQ ID NO: 3198639 - protein, 18 aa, Giardia lamblia
TFALWQKVGADCCGLKEQ

SEQ ID NO: 3198640 - protein, 26 aa, Giardia lamblia
TFAYLVPIIVSLIEKIPRLLDVEDES

SEQ ID NO: 3198641 - protein, 32 aa, Giardia lamblia
TFDGASRPMAFLYVKGFALLEALEQGGIRLNA

SEQ ID NO: 3198642 - protein, 17 aa, Giardia lamblia
TFDTMLQGIGRLLTKDL

SEQ ID NO: 3198643 - protein, 20 aa, Giardia lamblia
TFDVVRRILEDYFGLRVRYQ

SEQ ID NO: 3198644 - protein, 20 aa, Giardia lamblia
TFELQGFVFSFANPALTAAY

SEQ ID NO: 3198645 - protein, 26 aa, Giardia lamblia
TFESVAPIFKLHNLTVLDLRQNPIVD

SEQ ID NO: 3198646 - protein, 20 aa, Giardia lamblia
TFGIWPYKAKGDDYTIPVIL

SEQ ID NO: 3198647 - protein, 17 aa, Giardia lamblia
TFHLCSPDKYPSGFTDL

SEQ ID NO: 3198648 - protein, 17 aa, Giardia lamblia
TFHMRITILEDEKFFHE

SEQ ID NO: 3198649 - protein, 27 aa, Giardia lamblia
TFHNQRDFIFFRAYRYIFENKDKKDPT

SEQ ID NO: 3198650 - protein, 19 aa, Giardia lamblia
TFHRVIPKFMIQGGDFTNH

SEQ ID NO: 3198651 - protein, 19 aa, Giardia lamblia
TFIFSHMDGTRFYNPICPL

SEQ ID NO: 3198652 - protein, 25 aa, Giardia lamblia
TFLHAPPEITLFDTLRLLRSHSVHR

SEQ ID NO: 3198653 - protein, 33 aa, Giardia lamblia
TFLTESLIKMFAALRPIYSMVASNRDALLEEKS

SEQ ID NO: 3198654 - protein, 23 aa, Giardia lamblia
TFLTRRDKLFDRVKQAKALSVPK

SEQ ID NO: 3198655 - protein, 26 aa, Giardia lamblia
TFPEDFYGATLYTTIQRRLRSPIKFS

SEQ ID NO: 3198656 - protein, 17 aa, Giardia lamblia
TFQILLGHMLASICWSF

SEQ ID NO: 3198657 - protein, 21 aa, Giardia lamblia
TFQRCDIFVNFISTSLIKGKD

SEQ ID NO: 3198658 - protein, 26 aa, Giardia lamblia
TFRERHRLGFLFLERVRTVLNLPRCD

SEQ ID NO: 3198659 - protein, 19 aa, Giardia lamblia
TFRLEEFVHLLKAMVTNGM

SEQ ID NO: 3198660 - protein, 25 aa, Giardia lamblia
TFRPYKFVITEPLDIYKDLLFQPPK

SEQ ID NO: 3198661 - protein, 19 aa, Giardia lamblia
TFSILGANAVLPVSMACCL

SEQ ID NO: 3198662 - protein, 17 aa, Giardia lamblia
TFSIRLVTPHLIILSAH

SEQ ID NO: 3198663 - protein, 21 aa, Giardia lamblia
TFSMKPLPEPFIKRLVKTLIT

SEQ ID NO: 3198664 - protein, 25 aa, Giardia lamblia
TFSPFPDRHLVIGDSLIPLAKQSHF

SEQ ID NO: 3198665 - protein, 39 aa, Giardia lamblia
TFTDLNYINIHLKKRFPLLPLDTDRLIFISTSEGTILIM

SEQ ID NO: 3198666 - protein, 17 aa, Giardia lamblia
TFTELLGAVLKGADSPS

SEQ ID NO: 3198667 - protein, 18 aa, Giardia lamblia
TFTLLMPGSPHRQSRKRS

SEQ ID NO: 3198668 - protein, 18 aa, Giardia lamblia
TFTLYPFASRCEKDYLNI

SEQ ID NO: 3198669 - protein, 20 aa, Giardia lamblia
TFVDTLPINKPTISTSNTNS

SEQ ID NO: 3198670 - protein, 17 aa, Giardia lamblia
TFVLLGNGDAYKGALAT

SEQ ID NO: 3198671 - protein, 35 aa, Giardia lamblia
TFVQLFEFFCRYCVLLFSLSFSTANPFPNSSLLLP

SEQ ID NO: 3198672 - protein, 27 aa, Giardia lamblia
TFVQLHIDAFYWFLLNIVRVTQDVIHL

SEQ ID NO: 3198673 - protein, 17 aa, Giardia lamblia
TFYLYKLEYMPAVSGTN

SEQ ID NO: 3198674 - protein, 25 aa, Giardia lamblia
TGAHYIVVVWFDLKNYIVTTLKEYT

SEQ ID NO: 3198675 - protein, 22 aa, Giardia lamblia
TGCMLYDKLLGLAKGGKPVVRE

SEQ ID NO: 3198676 - protein, 18 aa, Giardia lamblia
TGCPIQCTELIYGRWANP

SEQ ID NO: 3198677 - protein, 31 aa, Giardia lamblia
TGDCFDLSILLASLLIGAGYNAYVCIGYADK

SEQ ID NO: 3198678 - protein, 28 aa, Giardia lamblia
TGDEYPKYIIAALLLEGFNVKYLDIVPT

SEQ ID NO: 3198679 - protein, 38 aa, Giardia lamblia
TGDKYALKIFKKFFYYYGFYLGNICVLFRPKDYFIAGG

SEQ ID NO: 3198680 - protein, 24 aa, Giardia lamblia
TGDSALMFAVKRGDILAACCLTEE

SEQ ID NO: 3198681 - protein, 27 aa, Giardia lamblia
TGDVKIGHWLTYRETALMRAAEKGYPE

SEQ ID NO: 3198682 - protein, 25 aa, Giardia lamblia
TGEELRLLAILEQGDYEALDALHGM

SEQ ID NO: 3198683 - protein, 25 aa, Giardia lamblia
TGEIVLWDSSTVRLVFQRPGGKKCH

SEQ ID NO: 3198684 - protein, 45 aa, Giardia lamblia
TGELRDLHYYRVRTVRIFAKLLHDLQLRWIRHSSERMRGTDGFIV

SEQ ID NO: 3198685 - protein, 31 aa, Giardia lamblia
TGEMMTYRIFIGPTFYQRLKHMVLDKISSRN

SEQ ID NO: 3198686 - protein, 32 aa, Giardia lamblia
TGEQTRDFVFIKDLIVAAINLLGQLDKFPIGA

SEQ ID NO: 3198687 - protein, 23 aa, Giardia lamblia
TGERLIEGININKSLLVLGSCIN

SEQ ID NO: 3198688 - protein, 34 aa, Giardia lamblia
TGFNNIRLLLSPTEWRYLLPRITGQGRVHPLSYE
